United States Patent 10,706,955 (BIOINFORMATIC PROCESSES FOR DETERMINATION OF PEPTIDE BINDING) - sequence listing, part 35

SEQ ID NO: 1361666 - protein, 8 aa, Mycobacterium tuberculosis
GDPGNGEG

SEQ ID NO: 1361667 - protein, 5 aa, Mycobacterium tuberculosis
GDPLS

SEQ ID NO: 1361668 - protein, 7 aa, Mycobacterium tuberculosis
GDPMSQA

SEQ ID NO: 1361669 - protein, 13 aa, Mycobacterium tuberculosis
GDPPKKRSAANTH

SEQ ID NO: 1361670 - protein, 8 aa, Mycobacterium tuberculosis
GDRLDDSL

SEQ ID NO: 1361671 - protein, 8 aa, Mycobacterium tuberculosis
GDRPLTPA

SEQ ID NO: 1361672 - protein, 10 aa, Mycobacterium tuberculosis
GDTGLTSTGS

SEQ ID NO: 1361673 - protein, 13 aa, Mycobacterium tuberculosis
GDYDEAELEQQLD

SEQ ID NO: 1361674 - protein, 6 aa, Mycobacterium tuberculosis
GEGIGA

SEQ ID NO: 1361675 - protein, 7 aa, Mycobacterium tuberculosis
GEHGGLS

SEQ ID NO: 1361676 - protein, 6 aa, Mycobacterium tuberculosis
GENPVA

SEQ ID NO: 1361677 - protein, 5 aa, Mycobacterium tuberculosis
GERAS

SEQ ID NO: 1361678 - protein, 6 aa, Mycobacterium tuberculosis
GERISA

SEQ ID NO: 1361679 - protein, 9 aa, Mycobacterium tuberculosis
GESGPSGRH

SEQ ID NO: 1361680 - protein, 5 aa, Mycobacterium tuberculosis
GFEDG

SEQ ID NO: 1361681 - protein, 4 aa, Mycobacterium tuberculosis
GFSR

SEQ ID NO: 1361682 - protein, 9 aa, Mycobacterium tuberculosis
GGDDAATLA

SEQ ID NO: 1361683 - protein, 6 aa, Mycobacterium tuberculosis
GGDTTL

SEQ ID NO: 1361684 - protein, 12 aa, Mycobacterium tuberculosis
GGEGLGLRSPGP

SEQ ID NO: 1361685 - protein, 9 aa, Mycobacterium tuberculosis
GGGDTPPPA

SEQ ID NO: 1361686 - protein, 7 aa, Mycobacterium tuberculosis
GGGLRPA

SEQ ID NO: 1361687 - protein, 11 aa, Mycobacterium tuberculosis
GGGQRDPQTPI

SEQ ID NO: 1361688 - protein, 8 aa, Mycobacterium tuberculosis
GGGSEGLA

SEQ ID NO: 1361689 - protein, 13 aa, Mycobacterium tuberculosis
GGKAGFPPDGRAG

SEQ ID NO: 1361690 - protein, 7 aa, Mycobacterium tuberculosis
GGKEFGR

SEQ ID NO: 1361691 - protein, 9 aa, Mycobacterium tuberculosis
GGLAGEPED

SEQ ID NO: 1361692 - protein, 4 aa, Mycobacterium tuberculosis
GGNG

SEQ ID NO: 1361693 - protein, 4 aa, Mycobacterium tuberculosis
GGPI

SEQ ID NO: 1361694 - protein, 11 aa, Mycobacterium tuberculosis
GGPPDGNGGTP

SEQ ID NO: 1361695 - protein, 4 aa, Mycobacterium tuberculosis
GGQT

SEQ ID NO: 1361696 - protein, 13 aa, Mycobacterium tuberculosis
GGSAPVLEGPSSV

SEQ ID NO: 1361697 - protein, 7 aa, Mycobacterium tuberculosis
GGSGSVV

SEQ ID NO: 1361698 - protein, 6 aa, Mycobacterium tuberculosis
GGTGAL

SEQ ID NO: 1361699 - protein, 6 aa, Mycobacterium tuberculosis
GGTHGS

SEQ ID NO: 1361700 - protein, 5 aa, Mycobacterium tuberculosis
GGTST

SEQ ID NO: 1361701 - protein, 5 aa, Mycobacterium tuberculosis
GGTTY

SEQ ID NO: 1361702 - protein, 4 aa, Mycobacterium tuberculosis
GGTV

SEQ ID NO: 1361703 - protein, 6 aa, Mycobacterium tuberculosis
GHDPAT

SEQ ID NO: 1361704 - protein, 7 aa, Mycobacterium tuberculosis
GHNLDTT

SEQ ID NO: 1361705 - protein, 4 aa, Mycobacterium tuberculosis
GITT

SEQ ID NO: 1361706 - protein, 8 aa, Mycobacterium tuberculosis
GKDGHGGL

SEQ ID NO: 1361707 - protein, 8 aa, Mycobacterium tuberculosis
GKEANGSR

SEQ ID NO: 1361708 - protein, 6 aa, Mycobacterium tuberculosis
GKEVPA

SEQ ID NO: 1361709 - protein, 7 aa, Mycobacterium tuberculosis
GKPVPTV

SEQ ID NO: 1361710 - protein, 9 aa, Mycobacterium tuberculosis
GLASSSVGA

SEQ ID NO: 1361711 - protein, 4 aa, Mycobacterium tuberculosis
GLGG

SEQ ID NO: 1361712 - protein, 5 aa, Mycobacterium tuberculosis
GLGRP

SEQ ID NO: 1361713 - protein, 9 aa, Mycobacterium tuberculosis
GLKRQPDHQ

SEQ ID NO: 1361714 - protein, 13 aa, Mycobacterium tuberculosis
GLPDTGPGSLAPM

SEQ ID NO: 1361715 - protein, 6 aa, Mycobacterium tuberculosis
GLPPAA

SEQ ID NO: 1361716 - protein, 8 aa, Mycobacterium tuberculosis
GNANTDGT

SEQ ID NO: 1361717 - protein, 10 aa, Mycobacterium tuberculosis
GNAPNDDPYR

SEQ ID NO: 1361718 - protein, 10 aa, Mycobacterium tuberculosis
GNIAGNPSQY

SEQ ID NO: 1361719 - protein, 10 aa, Mycobacterium tuberculosis
GNNPGAQTSE

SEQ ID NO: 1361720 - protein, 8 aa, Mycobacterium tuberculosis
GNRDNANP

SEQ ID NO: 1361721 - protein, 5 aa, Mycobacterium tuberculosis
GNRPR

SEQ ID NO: 1361722 - protein, 6 aa, Mycobacterium tuberculosis
GNRSER

SEQ ID NO: 1361723 - protein, 5 aa, Mycobacterium tuberculosis
GPAAA

SEQ ID NO: 1361724 - protein, 6 aa, Mycobacterium tuberculosis
GPAPEG

SEQ ID NO: 1361725 - protein, 5 aa, Mycobacterium tuberculosis
GPATS

SEQ ID NO: 1361726 - protein, 8 aa, Mycobacterium tuberculosis
GPDDCASV

SEQ ID NO: 1361727 - protein, 9 aa, Mycobacterium tuberculosis
GPDDTERAI

SEQ ID NO: 1361728 - protein, 17 aa, Mycobacterium tuberculosis
GPDGQNPPDEVTDRLEN

SEQ ID NO: 1361729 - protein, 46 aa, Mycobacterium tuberculosis; identical to SEQ ID NO: 151385

SEQ ID NO: 1361730 - protein, 4 aa, Mycobacterium tuberculosis
GPGD

SEQ ID NO: 1361731 - protein, 9 aa, Mycobacterium tuberculosis
GPGRTSGGW

SEQ ID NO: 1361732 - protein, 4 aa, Mycobacterium tuberculosis
GPGT

SEQ ID NO: 1361733 - protein, 5 aa, Mycobacterium tuberculosis
GPLSD

SEQ ID NO: 1361734 - protein, 7 aa, Mycobacterium tuberculosis
GPLTPKD

SEQ ID NO: 1361735 - protein, 5 aa, Mycobacterium tuberculosis
GPMPT

SEQ ID NO: 1361736 - protein, 5 aa, Mycobacterium tuberculosis
GPNER

SEQ ID NO: 1361737 - protein, 12 aa, Mycobacterium tuberculosis
GPNGSPSTQATT

SEQ ID NO: 1361738 - protein, 8 aa, Mycobacterium tuberculosis
GPPGTGKT

SEQ ID NO: 1361739 - protein, 8 aa, Mycobacterium tuberculosis
GPQNMPKF

SEQ ID NO: 1361740 - protein, 5 aa, Mycobacterium tuberculosis
GPRTQ

SEQ ID NO: 1361741 - protein, 4 aa, Mycobacterium tuberculosis
GPRY

SEQ ID NO: 1361742 - protein, 8 aa, Mycobacterium tuberculosis
GPSGCGKS

SEQ ID NO: 1361743 - protein, 9 aa, Mycobacterium tuberculosis
GPTGAGKTT

SEQ ID NO: 1361744 - protein, 8 aa, Mycobacterium tuberculosis
GPVGNPNA

SEQ ID NO: 1361745 - protein, 14 aa, Mycobacterium tuberculosis
GPVRASSERTLQPV

SEQ ID NO: 1361746 - protein, 8 aa, Mycobacterium tuberculosis
GPYRESNL

SEQ ID NO: 1361747 - protein, 13 aa, Mycobacterium tuberculosis
GQGLPGGTSPASW

SEQ ID NO: 1361748 - protein, 5 aa, Mycobacterium tuberculosis
GQIPN

SEQ ID NO: 1361749 - protein, 9 aa, Mycobacterium tuberculosis
GQLPPDGDY

SEQ ID NO: 1361750 - protein, 6 aa, Mycobacterium tuberculosis
GQPDDG

SEQ ID NO: 1361751 - protein, 34 aa, Mycobacterium tuberculosis; identical to SEQ ID NO: 151448

SEQ ID NO: 1361752 - protein, 6 aa, Mycobacterium tuberculosis
GQQRGE

SEQ ID NO: 1361753 - protein, 6 aa, Mycobacterium tuberculosis
GQRPRN

SEQ ID NO: 1361754 - protein, 4 aa, Mycobacterium tuberculosis
GQRS

SEQ ID NO: 1361755 - protein, 14 aa, Mycobacterium tuberculosis
GRAHRPAAQNAGER

SEQ ID NO: 1361756 - protein, 7 aa, Mycobacterium tuberculosis
GRDPKTD

SEQ ID NO: 1361757 - protein, 17 aa, Mycobacterium tuberculosis
GRDQRGAASAANRGPDS

SEQ ID NO: 1361758 - protein, 13 aa, Mycobacterium tuberculosis
GRITPEEAHSHPQ

SEQ ID NO: 1361759 - protein, 10 aa, Mycobacterium tuberculosis
GRKPTREEER

SEQ ID NO: 1361760 - protein, 8 aa, Mycobacterium tuberculosis
GRKQDNPA

SEQ ID NO: 1361761 - protein, 8 aa, Mycobacterium tuberculosis
GRRPPDAV

SEQ ID NO: 1361762 - protein, 5 aa, Mycobacterium tuberculosis
GRRPV

SEQ ID NO: 1361763 - protein, 9 aa, Mycobacterium tuberculosis
GRSGAGKTT

SEQ ID NO: 1361764 - protein, 4 aa, Mycobacterium tuberculosis
GSAA

SEQ ID NO: 1361765 - protein, 5 aa, Mycobacterium tuberculosis
GSAGG

SEQ ID NO: 1361766 - protein, 14 aa, Mycobacterium tuberculosis
GSDAGHSAAPTYRD

SEQ ID NO: 1361767 - protein, 6 aa, Mycobacterium tuberculosis
GSFGGE

SEQ ID NO: 1361768 - protein, 18 aa, Mycobacterium tuberculosis
GSFTPRHASSSAQTPTPH

SEQ ID NO: 1361769 - protein, 10 aa, Mycobacterium tuberculosis
GSGAADPARL

SEQ ID NO: 1361770 - protein, 9 aa, Mycobacterium tuberculosis
GSGSPASRA

SEQ ID NO: 1361771 - protein, 7 aa, Mycobacterium tuberculosis
GSGSQRG

SEQ ID NO: 1361772 - protein, 10 aa, Mycobacterium tuberculosis
GSGVGKPGAE

SEQ ID NO: 1361773 - protein, 6 aa, Mycobacterium tuberculosis
GSKDGK

SEQ ID NO: 1361774 - protein, 4 aa, Mycobacterium tuberculosis
GSLT

SEQ ID NO: 1361775 - protein, 33 aa, Mycobacterium tuberculosis; identical to SEQ ID NO: 151552

SEQ ID NO: 1361776 - protein, 7 aa, Mycobacterium tuberculosis
GSQAPTA

SEQ ID NO: 1361777 - protein, 8 aa, Mycobacterium tuberculosis
GSRQGVTR

SEQ ID NO: 1361778 - protein, 6 aa, Mycobacterium tuberculosis
GSSIPG

SEQ ID NO: 1361779 - protein, 10 aa, Mycobacterium tuberculosis
GSTGSGKSSF

SEQ ID NO: 1361780 - protein, 9 aa, Mycobacterium tuberculosis
GSTGSGKST

SEQ ID NO: 1361781 - protein, 12 aa, Mycobacterium tuberculosis
GSTLEPQDQPYY

SEQ ID NO: 1361782 - protein, 5 aa, Mycobacterium tuberculosis
GSYTG

SEQ ID NO: 1361783 - protein, 12 aa, Mycobacterium tuberculosis
GTAPGAPGSDFP

SEQ ID NO: 1361784 - protein, 31 aa, Mycobacterium tuberculosis; identical to SEQ ID NO: 151587

SEQ ID NO: 1361785 - protein, 6 aa, Mycobacterium tuberculosis
GTATRG

SEQ ID NO: 1361786 - protein, 5 aa, Mycobacterium tuberculosis
GTDAG

SEQ ID NO: 1361787 - protein, 7 aa, Mycobacterium tuberculosis
GTDDQKK

SEQ ID NO: 1361788 - protein, 10 aa, Mycobacterium tuberculosis
GTDESPITEQ

SEQ ID NO: 1361789 - protein, 12 aa, Mycobacterium tuberculosis
GTDQEQAAATLG

SEQ ID NO: 1361790 - protein, 5 aa, Mycobacterium tuberculosis
GTHGP

SEQ ID NO: 1361791 - protein, 8 aa, Mycobacterium tuberculosis
GTIATDQR

SEQ ID NO: 1361792 - protein, 25 aa, Mycobacterium tuberculosis
GTKAAQHTNVHNPGPHDHPPGPDPL

SEQ ID NO: 1361793 - protein, 8 aa, Mycobacterium tuberculosis
GTKGKTAV

SEQ ID NO: 1361794 - protein, 18 aa, Mycobacterium tuberculosis
GTNGPAPYPEPSSHEPQA

SEQ ID NO: 1361795 - protein, 5 aa, Mycobacterium tuberculosis
GTPDE

SEQ ID NO: 1361796 - protein, 7 aa, Mycobacterium tuberculosis
GTPDLTG

SEQ ID NO: 1361797 - protein, 7 aa, Mycobacterium tuberculosis
GTPGDAR

SEQ ID NO: 1361798 - protein, 13 aa, Mycobacterium tuberculosis
GTPGQVTGPTGPI

SEQ ID NO: 1361799 - protein, 12 aa, Mycobacterium tuberculosis
GTPRGATGLAEG

SEQ ID NO: 1361800 - protein, 6 aa, Mycobacterium tuberculosis
GTRDFS

SEQ ID NO: 1361801 - protein, 5 aa, Mycobacterium tuberculosis
GTRQL

SEQ ID NO: 1361802 - protein, 9 aa, Mycobacterium tuberculosis
GVAKGDTAT

SEQ ID NO: 1361803 - protein, 10 aa, Mycobacterium tuberculosis
GVGDANVPAP

SEQ ID NO: 1361804 - protein, 9 aa, Mycobacterium tuberculosis
GVNDAPALA

SEQ ID NO: 1361805 - protein, 5 aa, Mycobacterium tuberculosis
GVPGV

SEQ ID NO: 1361806 - protein, 7 aa, Mycobacterium tuberculosis
GVRPSHG

SEQ ID NO: 1361807 - protein, 16 aa, Mycobacterium tuberculosis
GVSTATRAKDSDRQDA

SEQ ID NO: 1361808 - protein, 10 aa, Mycobacterium tuberculosis
GWVPPSPAPH

SEQ ID NO: 1361809 - protein, 7 aa, Mycobacterium tuberculosis
GYAARDG

SEQ ID NO: 1361810 - protein, 6 aa, Mycobacterium tuberculosis
GYGPTV

SEQ ID NO: 1361811 - protein, 6 aa, Mycobacterium tuberculosis
GYRSDR

SEQ ID NO: 1361812 - protein, 9 aa, Mycobacterium tuberculosis
GYTGGGGKQ

SEQ ID NO: 1361813 - protein, 6 aa, Mycobacterium tuberculosis
GYTPSV

SEQ ID NO: 1361814 - protein, 11 aa, Mycobacterium tuberculosis
GYYGSDSAGTF

SEQ ID NO: 1361815 - protein, 12 aa, Mycobacterium tuberculosis
HAGNASAAGATG

SEQ ID NO: 1361816 - protein, 16 aa, Mycobacterium tuberculosis
HAPGTDEEKIDGRRGQ

SEQ ID NO: 1361817 - protein, 6 aa, Mycobacterium tuberculosis
HATGGR

SEQ ID NO: 1361818 - protein, 5 aa, Mycobacterium tuberculosis
HDMRN

SEQ ID NO: 1361819 - protein, 7 aa, Mycobacterium tuberculosis
HDQTPLR

SEQ ID NO: 1361820 - protein, 4 aa, Mycobacterium tuberculosis
HEGD

SEQ ID NO: 1361821 - protein, 6 aa, Mycobacterium tuberculosis
HESGSE

SEQ ID NO: 1361822 - protein, 5 aa, Mycobacterium tuberculosis
HETRG

SEQ ID NO: 1361823 - protein, 6 aa, Mycobacterium tuberculosis
HGDRRR

SEQ ID NO: 1361824 - protein, 6 aa, Mycobacterium tuberculosis
HGESPT

SEQ ID NO: 1361825 - protein, 7 aa, Mycobacterium tuberculosis
HGGGTTA

SEQ ID NO: 1361826 - protein, 6 aa, Mycobacterium tuberculosis
HGNPSA

SEQ ID NO: 1361827 - protein, 10 aa, Mycobacterium tuberculosis
HGRPTADGTT

SEQ ID NO: 1361828 - protein, 4 aa, Mycobacterium tuberculosis
HGSG

SEQ ID NO: 1361829 - protein, 4 aa, Mycobacterium tuberculosis
HKAT

SEQ ID NO: 1361830 - protein, 9 aa, Mycobacterium tuberculosis
HNSSPPPPR

SEQ ID NO: 1361831 - protein, 6 aa, Mycobacterium tuberculosis
HPDKTA

SEQ ID NO: 1361832 - protein, 6 aa, Mycobacterium tuberculosis
HPGSGG

SEQ ID NO: 1361833 - protein, 4 aa, Mycobacterium tuberculosis
HPPT

SEQ ID NO: 1361834 - protein, 12 aa, Mycobacterium tuberculosis
HPREPLDGEAPA

SEQ ID NO: 1361835 - protein, 11 aa, Mycobacterium tuberculosis
HRADSEREKTS

SEQ ID NO: 1361836 - protein, 5 aa, Mycobacterium tuberculosis
HRGSA

SEQ ID NO: 1361837 - protein, 9 aa, Mycobacterium tuberculosis
HRPGTPSGF

SEQ ID NO: 1361838 - protein, 15 aa, Mycobacterium tuberculosis
HRQQRTDADAATQTT

SEQ ID NO: 1361839 - protein, 11 aa, Mycobacterium tuberculosis
HRSENPPPPQL

SEQ ID NO: 1361840 - protein, 9 aa, Mycobacterium tuberculosis
HSAAPQRAA

SEQ ID NO: 1361841 - protein, 7 aa, Mycobacterium tuberculosis
HSDPPGL

SEQ ID NO: 1361842 - protein, 12 aa, Mycobacterium tuberculosis
HSKGPAAARNTG

SEQ ID NO: 1361843 - protein, 14 aa, Mycobacterium tuberculosis
HSNDDEQDPDTFAS

SEQ ID NO: 1361844 - protein, 7 aa, Mycobacterium tuberculosis
HSPGAGG

SEQ ID NO: 1361845 - protein, 8 aa, Mycobacterium tuberculosis
HSQAPAPV

SEQ ID NO: 1361846 - protein, 8 aa, Mycobacterium tuberculosis
HSSDQRGT

SEQ ID NO: 1361847 - protein, 10 aa, Mycobacterium tuberculosis
HTEVKDNRRN

SEQ ID NO: 1361848 - protein, 5 aa, Mycobacterium tuberculosis
HTSRT

SEQ ID NO: 1361849 - protein, 7 aa, Mycobacterium tuberculosis
HVAGPDH

SEQ ID NO: 1361850 - protein, 14 aa, Mycobacterium tuberculosis
IAAGGNTAAESFGE

SEQ ID NO: 1361851 - protein, 12 aa, Mycobacterium tuberculosis
IAGAPTTSPTAL

SEQ ID NO: 1361852 - protein, 12 aa, Mycobacterium tuberculosis
IAGPGGDKLPTP

SEQ ID NO: 1361853 - protein, 9 aa, Mycobacterium tuberculosis
IASGGTSTV

SEQ ID NO: 1361854 - protein, 14 aa, Mycobacterium tuberculosis
IDEDQEADDARRRG

SEQ ID NO: 1361855 - protein, 6 aa, Mycobacterium tuberculosis
IDGAGE

SEQ ID NO: 1361856 - protein, 9 aa, Mycobacterium tuberculosis
IDNPDQRIQ

SEQ ID NO: 1361857 - protein, 9 aa, Mycobacterium tuberculosis
IDRSGAQAG

SEQ ID NO: 1361858 - protein, 8 aa, Mycobacterium tuberculosis
IETTGRQQ

SEQ ID NO: 1361859 - protein, 7 aa, Mycobacterium tuberculosis
IGDQPAV

SEQ ID NO: 1361860 - protein, 7 aa, Mycobacterium tuberculosis
IGNGSSY

SEQ ID NO: 1361861 - protein, 6 aa, Mycobacterium tuberculosis
IGQNRE

SEQ ID NO: 1361862 - protein, 10 aa, Mycobacterium tuberculosis
IGSGGHGAAG

SEQ ID NO: 1361863 - protein, 9 aa, Mycobacterium tuberculosis
IGTTTGPTL

SEQ ID NO: 1361864 - protein, 6 aa, Mycobacterium tuberculosis
IKPSNV

SEQ ID NO: 1361865 - protein, 8 aa, Mycobacterium tuberculosis
IKSNSDIT

SEQ ID NO: 1361866 - protein, 12 aa, Mycobacterium tuberculosis
IPAAGAPNSLGL

SEQ ID NO: 1361867 - protein, 4 aa, Mycobacterium tuberculosis
IPDP

SEQ ID NO: 1361868 - protein, 16 aa, Mycobacterium tuberculosis
IPGAPYATPVSAGSTS

SEQ ID NO: 1361869 - protein, 6 aa, Mycobacterium tuberculosis
IPGKSA

SEQ ID NO: 1361870 - protein, 9 aa, Mycobacterium tuberculosis
IPGPEPTSV

SEQ ID NO: 1361871 - protein, 6 aa, Mycobacterium tuberculosis
IPTGAE

SEQ ID NO: 1361872 - protein, 6 aa, Mycobacterium tuberculosis
IQPAEL

SEQ ID NO: 1361873 - protein, 12 aa, Mycobacterium tuberculosis
ISSDEELEPVTG

SEQ ID NO: 1361874 - protein, 8 aa, Mycobacterium tuberculosis
ITNKESGV

SEQ ID NO: 1361875 - protein, 8 aa, Mycobacterium tuberculosis
ITPGGAAD

SEQ ID NO: 1361876 - protein, 6 aa, Mycobacterium tuberculosis
ITPPKG

SEQ ID NO: 1361877 - protein, 20 aa, Mycobacterium tuberculosis
ITTSDGTVLSSNSNDGPQTS

SEQ ID NO: 1361878 - protein, 7 aa, Mycobacterium tuberculosis
IVGTGTH

SEQ ID NO: 1361879 - protein, 9 aa, Mycobacterium tuberculosis
KAEGQTGAA

SEQ ID NO: 1361880 - protein, 6 aa, Mycobacterium tuberculosis
KAKEDV

SEQ ID NO: 1361881 - protein, 4 aa, Mycobacterium tuberculosis
KAPG

SEQ ID NO: 1361882 - protein, 5 aa, Mycobacterium tuberculosis
KAQQP

SEQ ID NO: 1361883 - protein, 5 aa, Mycobacterium tuberculosis
KARAA

SEQ ID NO: 1361884 - protein, 6 aa, Mycobacterium tuberculosis
KDATGT

SEQ ID NO: 1361885 - protein, 6 aa, Mycobacterium tuberculosis
KDFPDN

SEQ ID NO: 1361886 - protein, 5 aa, Mycobacterium tuberculosis
KDGAK

SEQ ID NO: 1361887 - protein, 7 aa, Mycobacterium tuberculosis
KDPDLGT

SEQ ID NO: 1361888 - protein, 87 aa, Mycobacterium tuberculosis; identical to SEQ ID NO: 149272

SEQ ID NO: 1361889 - protein, 6 aa, Mycobacterium tuberculosis
KETERA

SEQ ID NO: 1361890 - protein, 28 aa, Mycobacterium tuberculosis
KETMPTNPDNPKGAYTAARTAKDQGVPI

SEQ ID NO: 1361891 - protein, 5 aa, Mycobacterium tuberculosis
KEYEE

SEQ ID NO: 1361892 - protein, 10 aa, Mycobacterium tuberculosis
KFAGSGNGPV

SEQ ID NO: 1361893 - protein, 17 aa, Mycobacterium tuberculosis
KGAVEDDSHADPPSTRA

SEQ ID NO: 1361894 - protein, 8 aa, Mycobacterium tuberculosis
KGDDDDTI

SEQ ID NO: 1361895 - protein, 15 aa, Mycobacterium tuberculosis
KGGENDAQNHAQTLS

SEQ ID NO: 1361896 - protein, 8 aa, Mycobacterium tuberculosis
KGGPTQGA

SEQ ID NO: 1361897 - protein, 10 aa, Mycobacterium tuberculosis
KGKPGDPRRL

SEQ ID NO: 1361898 - protein, 12 aa, Mycobacterium tuberculosis
KGLGAADERSYK

SEQ ID NO: 1361899 - protein, 8 aa, Mycobacterium tuberculosis
KGPHPATY

SEQ ID NO: 1361900 - protein, 12 aa, Mycobacterium tuberculosis
KGREAPGALRGS

SEQ ID NO: 1361901 - protein, 5 aa, Mycobacterium tuberculosis
KGRRR

SEQ ID NO: 1361902 - protein, 12 aa, Mycobacterium tuberculosis
KKDESDDEAAER

SEQ ID NO: 1361903 - protein, 11 aa, Mycobacterium tuberculosis
KKGEVEQPGDT

SEQ ID NO: 1361904 - protein, 5 aa, Mycobacterium tuberculosis
KKGLT

SEQ ID NO: 1361905 - protein, 9 aa, Mycobacterium tuberculosis
KKKPIRPVA

SEQ ID NO: 1361906 - protein, 7 aa, Mycobacterium tuberculosis
KKLKRAD

SEQ ID NO: 1361907 - protein, 13 aa, Mycobacterium tuberculosis
KKSVTEVSEELKA

SEQ ID NO: 1361908 - protein, 8 aa, Mycobacterium tuberculosis
KKYGKDRQ

SEQ ID NO: 1361909 - protein, 6 aa, Mycobacterium tuberculosis
KLAGGA

SEQ ID NO: 1361910 - protein, 10 aa, Mycobacterium tuberculosis
KNYQSGKIPE

SEQ ID NO: 1361911 - protein, 14 aa, Mycobacterium tuberculosis
KPAVPAKPDRDEAL

SEQ ID NO: 1361912 - protein, 12 aa, Mycobacterium tuberculosis
KPIYPKDSLTKE

SEQ ID NO: 1361913 - protein, 13 aa, Mycobacterium tuberculosis
KPPQGMAAESSSA

SEQ ID NO: 1361914 - protein, 6 aa, Mycobacterium tuberculosis
KPPVIK

SEQ ID NO: 1361915 - protein, 5 aa, Mycobacterium tuberculosis
KPTRH

SEQ ID NO: 1361916 - protein, 6 aa, Mycobacterium tuberculosis
KPVERP

SEQ ID NO: 1361917 - protein, 5 aa, Mycobacterium tuberculosis
KPYTE

SEQ ID NO: 1361918 - protein, 12 aa, Mycobacterium tuberculosis
KQLPPSDPSSVG

SEQ ID NO: 1361919 - protein, 13 aa, Mycobacterium tuberculosis
KQQASHRRAPLLS

SEQ ID NO: 1361920 - protein, 8 aa, Mycobacterium tuberculosis
KQTREEGY

SEQ ID NO: 1361921 - protein, 5 aa, Mycobacterium tuberculosis
KRDPN

SEQ ID NO: 1361922 - protein, 13 aa, Mycobacterium tuberculosis
KRYTYTGSGGVPL

SEQ ID NO: 1361923 - protein, 18 aa, Mycobacterium tuberculosis
KSAGELVPATTAPAGLAY

SEQ ID NO: 1361924 - protein, 8 aa, Mycobacterium tuberculosis
KSANGRYE

SEQ ID NO: 1361925 - protein, 7 aa, Mycobacterium tuberculosis
KTGTLTR

SEQ ID NO: 1361926 - protein, 27 aa, Mycobacterium tuberculosis
KTNTTATEVARPPTSGSAVPSAPTTTV

SEQ ID NO: 1361927 - protein, 5 aa, Mycobacterium tuberculosis
KTQPQ

SEQ ID NO: 1361928 - protein, 8 aa, Mycobacterium tuberculosis
KTSRVQKK

SEQ ID NO: 1361929 - protein, 5 aa, Mycobacterium tuberculosis
KWNNS

SEQ ID NO: 1361930 - protein, 12 aa, Mycobacterium tuberculosis
KYRERGADLPPL

SEQ ID NO: 1361931 - protein, 6 aa, Mycobacterium tuberculosis
LAAEAS

SEQ ID NO: 1361932 - protein, 9 aa, Mycobacterium tuberculosis
LAATRPPAE

SEQ ID NO: 1361933 - protein, 12 aa, Mycobacterium tuberculosis
LADNKKSDEQFA

SEQ ID NO: 1361934 - protein, 9 aa, Mycobacterium tuberculosis
LAEQAEEAE

SEQ ID NO: 1361935 - protein, 11 aa, Mycobacterium tuberculosis
LAGANPAEREP

SEQ ID NO: 1361936 - protein, 4 aa, Mycobacterium tuberculosis
LAGK

SEQ ID NO: 1361937 - protein, 13 aa, Mycobacterium tuberculosis
LAGPPKTPDRTIP

SEQ ID NO: 1361938 - protein, 8 aa, Mycobacterium tuberculosis
LAPPRGKS

SEQ ID NO: 1361939 - protein, 4 aa, Mycobacterium tuberculosis
LAQQ

SEQ ID NO: 1361940 - protein, 11 aa, Mycobacterium tuberculosis
LARKGTTPVTA

SEQ ID NO: 1361941 - protein, 5 aa, Mycobacterium tuberculosis
LASGP

SEQ ID NO: 1361942 - protein, 24 aa, Mycobacterium tuberculosis
LATPPGHGWPPGLPPLPRRPRRYR

SEQ ID NO: 1361943 - protein, 4 aa, Mycobacterium tuberculosis
LATT

SEQ ID NO: 1361944 - protein, 5 aa, Mycobacterium tuberculosis
LDGGT

SEQ ID NO: 1361945 - protein, 7 aa, Mycobacterium tuberculosis
LDGVSTG

SEQ ID NO: 1361946 - protein, 8 aa, Mycobacterium tuberculosis
LDNPDAAR

SEQ ID NO: 1361947 - protein, 10 aa, Mycobacterium tuberculosis
LEAGPPPRRL

SEQ ID NO: 1361948 - protein, 9 aa, Mycobacterium tuberculosis
LGAGAGGRM

SEQ ID NO: 1361949 - protein, 12 aa, Mycobacterium tuberculosis
LGAGSPDTKNLQ

SEQ ID NO: 1361950 - protein, 12 aa, Mycobacterium tuberculosis
LGAPASASVAAP

SEQ ID NO: 1361951 - protein, 7 aa, Mycobacterium tuberculosis
LGDPADS

SEQ ID NO: 1361952 - protein, 4 aa, Mycobacterium tuberculosis
LGGI

SEQ ID NO: 1361953 - protein, 13 aa, Mycobacterium tuberculosis
LGGPQGRGAPEDA

SEQ ID NO: 1361954 - protein, 23 aa, Mycobacterium tuberculosis
LGGRDTRVATPSGLDGPGMSTSA

SEQ ID NO: 1361955 - protein, 7 aa, Mycobacterium tuberculosis
LGKRGRG

SEQ ID NO: 1361956 - protein, 5 aa, Mycobacterium tuberculosis
LGPAG

SEQ ID NO: 1361957 - protein, 5 aa, Mycobacterium tuberculosis
LGPGR

SEQ ID NO: 1361958 - protein, 6 aa, Mycobacterium tuberculosis
LGPRPD

SEQ ID NO: 1361959 - protein, 4 aa, Mycobacterium tuberculosis
LGQG

SEQ ID NO: 1361960 - protein, 13 aa, Mycobacterium tuberculosis
LGSSLTSHTAANQ

SEQ ID NO: 1361961 - protein, 4 aa, Mycobacterium tuberculosis
LGTE

SEQ ID NO: 1361962 - protein, 8 aa, Mycobacterium tuberculosis
LGTTPSGT

SEQ ID NO: 1361963 - protein, 4 aa, Mycobacterium tuberculosis
LHPD

SEQ ID NO: 1361964 - protein, 9 aa, Mycobacterium tuberculosis
LHRPGGENE

SEQ ID NO: 1361965 - protein, 9 aa, Mycobacterium tuberculosis
LKNKTTELS

SEQ ID NO: 1361966 - protein, 4 aa, Mycobacterium tuberculosis
LKPE

SEQ ID NO: 1361967 - protein, 6 aa, Mycobacterium tuberculosis
LKPTEA

SEQ ID NO: 1361968 - protein, 6 aa, Mycobacterium tuberculosis
LNPDEY

SEQ ID NO: 1361969 - protein, 8 aa, Mycobacterium tuberculosis
LPAAGAAG

SEQ ID NO: 1361970 - protein, 17 aa, Mycobacterium tuberculosis
LPADPSPRKVPAGASGA

SEQ ID NO: 1361971 - protein, 16 aa, Mycobacterium tuberculosis
LPAGATRDVKFAKQIG

SEQ ID NO: 1361972 - protein, 5 aa, Mycobacterium tuberculosis
LPAGN

SEQ ID NO: 1361973 - protein, 8 aa, Mycobacterium tuberculosis
LPANEGYA

SEQ ID NO: 1361974 - protein, 6 aa, Mycobacterium tuberculosis
LPDAPP

SEQ ID NO: 1361975 - protein, 14 aa, Mycobacterium tuberculosis
LPDSGAASHPSTGL

SEQ ID NO: 1361976 - protein, 7 aa, Mycobacterium tuberculosis
LPEGSEV

SEQ ID NO: 1361977 - protein, 20 aa, Mycobacterium tuberculosis
LPGVTEAPNPTQRPPQPDRP

SEQ ID NO: 1361978 - protein, 7 aa, Mycobacterium tuberculosis
LPRPPTL

SEQ ID NO: 1361979 - protein, 5 aa, Mycobacterium tuberculosis
LPTGD

SEQ ID NO: 1361980 - protein, 10 aa, Mycobacterium tuberculosis
LQSTRSPQTV

SEQ ID NO: 1361981 - protein, 6 aa, Mycobacterium tuberculosis
LRPDAV

SEQ ID NO: 1361982 - protein, 6 aa, Mycobacterium tuberculosis
LRPEDK

SEQ ID NO: 1361983 - protein, 6 aa, Mycobacterium tuberculosis
LRPGEE

SEQ ID NO: 1361984 - protein, 14 aa, Mycobacterium tuberculosis
LRPSPEPVPAPQKQ

SEQ ID NO: 1361985 - protein, 8 aa, Mycobacterium tuberculosis
LRRQGAGR

SEQ ID NO: 1361986 - protein, 6 aa, Mycobacterium tuberculosis
LRTPRG

SEQ ID NO: 1361987 - protein, 27 aa, Mycobacterium tuberculosis
LSAPGARASARQRGDEGTSPEPAFPTP

SEQ ID NO: 1361988 - protein, 8 aa, Mycobacterium tuberculosis
LSDPVSDE

SEQ ID NO: 1361989 - protein, 8 aa, Mycobacterium tuberculosis
LSGGQRQR

SEQ ID NO: 1361990 - protein, 9 aa, Mycobacterium tuberculosis
LSIGPESAT

SEQ ID NO: 1361991 - protein, 6 aa, Mycobacterium tuberculosis
LSPGEP

SEQ ID NO: 1361992 - protein, 9 aa, Mycobacterium tuberculosis
LSPRPERGV

SEQ ID NO: 1361993 - protein, 8 aa, Mycobacterium tuberculosis
LSRPAGAH

SEQ ID NO: 1361994 - protein, 10 aa, Mycobacterium tuberculosis
LSSATADSNE

SEQ ID NO: 1361995 - protein, 19 aa, Mycobacterium tuberculosis
LSTATPAPAVAATDANDVP

SEQ ID NO: 1361996 - protein, 8 aa, Mycobacterium tuberculosis
LSTGADRI

SEQ ID NO: 1361997 - protein, 6 aa, Mycobacterium tuberculosis
LSTGPT

SEQ ID NO: 1361998 - protein, 8 aa, Mycobacterium tuberculosis
LSTGSGTD

SEQ ID NO: 1361999 - protein, 4 aa, Mycobacterium tuberculosis
LSTL

SEQ ID NO: 1362000 - protein, 10 aa, Mycobacterium tuberculosis
LSTTLPGGPV

SEQ ID NO: 1362001 - protein, 7 aa, Mycobacterium tuberculosis
LTAQPGY

SEQ ID NO: 1362002 - protein, 4 aa, Mycobacterium tuberculosis
LTDA

SEQ ID NO: 1362003 - protein, 16 aa, Mycobacterium tuberculosis
LTEDTPAPTGRSSGAG

SEQ ID NO: 1362004 - protein, 12 aa, Mycobacterium tuberculosis
LTEPDPAATELA

SEQ ID NO: 1362005 - protein, 18 aa, Mycobacterium tuberculosis
LTGSGSRAALTSTGRSQL

SEQ ID NO: 1362006 - protein, 4 aa, Mycobacterium tuberculosis
LTGT

SEQ ID NO: 1362007 - protein, 6 aa, Mycobacterium tuberculosis
LTPATR

SEQ ID NO: 1362008 - protein, 4 aa, Mycobacterium tuberculosis
LTPR

SEQ ID NO: 1362009 - protein, 4 aa, Mycobacterium tuberculosis
LTPS

SEQ ID NO: 1362010 - protein, 6 aa, Mycobacterium tuberculosis
LTQTKG

SEQ ID NO: 1362011 - protein, 6 aa, Mycobacterium tuberculosis
LYGGAT

SEQ ID NO: 1362012 - protein, 6 aa, Mycobacterium tuberculosis
MAPETA

SEQ ID NO: 1362013 - protein, 6 aa, Mycobacterium tuberculosis
MDADPE

SEQ ID NO: 1362014 - protein, 7 aa, Mycobacterium tuberculosis
MEGPTPV

SEQ ID NO: 1362015 - protein, 4 aa, Mycobacterium tuberculosis
MGAG

SEQ ID NO: 1362016 - protein, 9 aa, Mycobacterium tuberculosis
MGGHAAGEV

SEQ ID NO: 1362017 - protein, 5 aa, Mycobacterium tuberculosis
MHSGE

SEQ ID NO: 1362018 - protein, 4 aa, Mycobacterium tuberculosis
MPLP

SEQ ID NO: 1362019 - protein, 8 aa, Mycobacterium tuberculosis
MPPNSGSP

SEQ ID NO: 1362020 - protein, 7 aa, Mycobacterium tuberculosis
MQPGQDD

SEQ ID NO: 1362021 - protein, 13 aa, Mycobacterium tuberculosis
MRSGGDDPDGASG

SEQ ID NO: 1362022 - protein, 7 aa, Mycobacterium tuberculosis
NADAGLS

SEQ ID NO: 1362023 - protein, 16 aa, Mycobacterium tuberculosis
NAGSAGNTKPLTVEPS

SEQ ID NO: 1362024 - protein, 8 aa, Mycobacterium tuberculosis
NARGTPLS

SEQ ID NO: 1362025 - protein, 8 aa, Mycobacterium tuberculosis
NASGGSVG

SEQ ID NO: 1362026 - protein, 7 aa, Mycobacterium tuberculosis
NATGATR

SEQ ID NO: 1362027 - protein, 6 aa, Mycobacterium tuberculosis
NAYSGS

SEQ ID NO: 1362028 - protein, 8 aa, Mycobacterium tuberculosis
NDDRTGAA

SEQ ID NO: 1362029 - protein, 11 aa, Mycobacterium tuberculosis
NDLADGSRQLA

SEQ ID NO: 1362030 - protein, 5 aa, Mycobacterium tuberculosis
NEHSD

SEQ ID NO: 1362031 - protein, 7 aa, Mycobacterium tuberculosis
NELGAQG

SEQ ID NO: 1362032 - protein, 22 aa, Mycobacterium tuberculosis
NEMNPDSAPPKTPLRSGGPGSL

SEQ ID NO: 1362033 - protein, 8 aa, Mycobacterium tuberculosis
NEQRKEND

SEQ ID NO: 1362034 - protein, 14 aa, Mycobacterium tuberculosis
NGANDLASAGRQVA

SEQ ID NO: 1362035 - protein, 7 aa, Mycobacterium tuberculosis
NGDGEVP

SEQ ID NO: 1362036 - protein, 6 aa, Mycobacterium tuberculosis
NGTGHL

SEQ ID NO: 1362037 - protein, 13 aa, Mycobacterium tuberculosis
NGTITVSSSPGYT

SEQ ID NO: 1362038 - protein, 8 aa, Mycobacterium tuberculosis
NKPSAYST

SEQ ID NO: 1362039 - protein, 8 aa, Mycobacterium tuberculosis
NLATPNDT

SEQ ID NO: 1362040 - protein, 7 aa, Mycobacterium tuberculosis
NLPGTSQ

SEQ ID NO: 1362041 - protein, 6 aa, Mycobacterium tuberculosis
NNASGL

SEQ ID NO: 1362042 - protein, 6 aa, Mycobacterium tuberculosis
NNGKEF

SEQ ID NO: 1362043 - protein, 8 aa, Mycobacterium tuberculosis
NNPTSSPY

SEQ ID NO: 1362044 - protein, 11 aa, Mycobacterium tuberculosis
NPAAGTTRAPF

SEQ ID NO: 1362045 - protein, 10 aa, Mycobacterium tuberculosis
NPADASKKLT

SEQ ID NO: 1362046 - protein, 14 aa, Mycobacterium tuberculosis
NPANPATVKSSELS

SEQ ID NO: 1362047 - protein, 9 aa, Mycobacterium tuberculosis
NPDERADEM

SEQ ID NO: 1362048 - protein, 7 aa, Mycobacterium tuberculosis
NPGGSYT

SEQ ID NO: 1362049 - protein, 6 aa, Mycobacterium tuberculosis
NPKATL

SEQ ID NO: 1362050 - protein, 6 aa, Mycobacterium tuberculosis
NPKRNV

SEQ ID NO: 1362051 - protein, 8 aa, Mycobacterium tuberculosis
NPNPDGKH

SEQ ID NO: 1362052 - protein, 19 aa, Mycobacterium tuberculosis
NPPAGTGVNRDGIITLRFG

SEQ ID NO: 1362053 - protein, 8 aa, Mycobacterium tuberculosis
NPPNDTPL

SEQ ID NO: 1362054 - protein, 6 aa, Mycobacterium tuberculosis
NPPVSA

SEQ ID NO: 1362055 - protein, 8 aa, Mycobacterium tuberculosis
NPSAPRPW

SEQ ID NO: 1362056 - protein, 11 aa, Mycobacterium tuberculosis
NPSEGTPAGPW

SEQ ID NO: 1362057 - protein, 6 aa, Mycobacterium tuberculosis
NPSRYQ

SEQ ID NO: 1362058 - protein, 6 aa, Mycobacterium tuberculosis
NPSWRP

SEQ ID NO: 1362059 - protein, 6 aa, Mycobacterium tuberculosis
NPTGDQ

SEQ ID NO: 1362060 - protein, 10 aa, Mycobacterium tuberculosis
NPVPSTGAKI

SEQ ID NO: 1362061 - protein, 5 aa, Mycobacterium tuberculosis
NQLQS

SEQ ID NO: 1362062 - protein, 14 aa, Mycobacterium tuberculosis
NRGVGRSSVPKPIS

SEQ ID NO: 1362063 - protein, 5 aa, Mycobacterium tuberculosis
NRPDI

SEQ ID NO: 1362064 - protein, 7 aa, Mycobacterium tuberculosis
NRPPQYE

SEQ ID NO: 1362065 - protein, 6 aa, Mycobacterium tuberculosis
NRQNKD

SEQ ID NO: 1362066 - protein, 4 aa, Mycobacterium tuberculosis
NSAD

SEQ ID NO: 1362067 - protein, 6 aa, Mycobacterium tuberculosis
NSDAAG

SEQ ID NO: 1362068 - protein, 17 aa, Mycobacterium tuberculosis
NSGNRANRRIADSDDLA

SEQ ID NO: 1362069 - protein, 6 aa, Mycobacterium tuberculosis
NSSHDY

SEQ ID NO: 1362070 - protein, 8 aa, Mycobacterium tuberculosis
NSTPPEGI

SEQ ID NO: 1362071 - protein, 5 aa, Mycobacterium tuberculosis
NTAQA

SEQ ID NO: 1362072 - protein, 6 aa, Mycobacterium tuberculosis
NTNPYN

SEQ ID NO: 1362073 - protein, 9 aa, Mycobacterium tuberculosis
NTPRPSPET

SEQ ID NO: 1362074 - protein, 11 aa, Mycobacterium tuberculosis
NTTTTSPVTKN

SEQ ID NO: 1362075 - protein, 6 aa, Mycobacterium tuberculosis
NVEGSM

SEQ ID NO: 1362076 - protein, 15 aa, Mycobacterium tuberculosis
NVTHTGDRQPGPGRA

SEQ ID NO: 1362077 - protein, 16 aa, Mycobacterium tuberculosis
PAAGRTANELASDAGE

SEQ ID NO: 1362078 - protein, 12 aa, Mycobacterium tuberculosis
PAAKQKSLKTTA

SEQ ID NO: 1362079 - protein, 17 aa, Mycobacterium tuberculosis
PAALGNPDNPKFPTDGV

SEQ ID NO: 1362080 - protein, 10 aa, Mycobacterium tuberculosis
PAEDENVPEE

SEQ ID NO: 1362081 - protein, 7 aa, Mycobacterium tuberculosis
PAGAEEV

SEQ ID NO: 1362082 - protein, 7 aa, Mycobacterium tuberculosis
PANPGMA

SEQ ID NO: 1362083 - protein, 8 aa, Mycobacterium tuberculosis
PAPATDND

SEQ ID NO: 1362084 - protein, 5 aa, Mycobacterium tuberculosis
PAQRV

SEQ ID NO: 1362085 - protein, 19 aa, Mycobacterium tuberculosis
PAQVQPEGAVEPREKRATP

SEQ ID NO: 1362086 - protein, 8 aa, Mycobacterium tuberculosis
PARERPGA

SEQ ID NO: 1362087 - protein, 15 aa, Mycobacterium tuberculosis
PARRSAESAGYPEAD

SEQ ID NO: 1362088 - protein, 4 aa, Mycobacterium tuberculosis
PDAA

SEQ ID NO: 1362089 - protein, 8 aa, Mycobacterium tuberculosis
PDAPAEQV

SEQ ID NO: 1362090 - protein, 7 aa, Mycobacterium tuberculosis
PDATKAA

SEQ ID NO: 1362091 - protein, 5 aa, Mycobacterium tuberculosis
PDDTT

SEQ ID NO: 1362092 - protein, 7 aa, Mycobacterium tuberculosis
PDENQMQ

SEQ ID NO: 1362093 - protein, 8 aa, Mycobacterium tuberculosis
PDFGERGR

SEQ ID NO: 1362094 - protein, 5 aa, Mycobacterium tuberculosis
PDLPR

SEQ ID NO: 1362095 - protein, 5 aa, Mycobacterium tuberculosis
PDLPT

SEQ ID NO: 1362096 - protein, 6 aa, Mycobacterium tuberculosis
PDQIST

SEQ ID NO: 1362097 - protein, 15 aa, Mycobacterium tuberculosis
PDRRGVQAATPVVNT

SEQ ID NO: 1362098 - protein, 7 aa, Mycobacterium tuberculosis
PDYQTGG

SEQ ID NO: 1362099 - protein, 7 aa, Mycobacterium tuberculosis
PEATERT

SEQ ID NO: 1362100 - protein, 7 aa, Mycobacterium tuberculosis
PEERAEL

SEQ ID NO: 1362101 - protein, 5 aa, Mycobacterium tuberculosis
PEEYR

SEQ ID NO: 1362102 - protein, 5 aa, Mycobacterium tuberculosis
PEGIN

SEQ ID NO: 1362103 - protein, 9 aa, Mycobacterium tuberculosis
PEHGTAEEA

SEQ ID NO: 1362104 - protein, 11 aa, Mycobacterium tuberculosis
PEIEQPPSRRN

SEQ ID NO: 1362105 - protein, 14 aa, Mycobacterium tuberculosis
PENDPQDSGYQARQ

SEQ ID NO: 1362106 - protein, 10 aa, Mycobacterium tuberculosis
PEPDSPRRMP

SEQ ID NO: 1362107 - protein, 10 aa, Mycobacterium tuberculosis
PEQVSQARPM

SEQ ID NO: 1362108 - protein, 15 aa, Mycobacterium tuberculosis
PERPKPAQQPPDDPV

SEQ ID NO: 1362109 - protein, 8 aa, Mycobacterium tuberculosis
PETKGRKL

SEQ ID NO: 1362110 - protein, 9 aa, Mycobacterium tuberculosis
PFPQSPPRY

SEQ ID NO: 1362111 - protein, 7 aa, Mycobacterium tuberculosis
PFTSDQD

SEQ ID NO: 1362112 - protein, 8 aa, Mycobacterium tuberculosis
PGDPNEQI

SEQ ID NO: 1362113 - protein, 10 aa, Mycobacterium tuberculosis
PGGLTMPSED

SEQ ID NO: 1362114 - protein, 8 aa, Mycobacterium tuberculosis
PGITPFDT

SEQ ID NO: 1362115 - protein, 4 aa, Mycobacterium tuberculosis
PGKY

SEQ ID NO: 1362116 - protein, 6 aa, Mycobacterium tuberculosis
PGNGTG

SEQ ID NO: 1362117 - protein, 14 aa, Mycobacterium tuberculosis
PGQAFGPDGPLGGI

SEQ ID NO: 1362118 - protein, 9 aa, Mycobacterium tuberculosis
PGQGSERRT

SEQ ID NO: 1362119 - protein, 8 aa, Mycobacterium tuberculosis
PGSPPAGA

SEQ ID NO: 1362120 - protein, 9 aa, Mycobacterium tuberculosis
PGSSTIANQ

SEQ ID NO: 1362121 - protein, 17 aa, Mycobacterium tuberculosis
PGTATRVGAGGGEETVN

SEQ ID NO: 1362122 - protein, 4 aa, Mycobacterium tuberculosis
PGTG

SEQ ID NO: 1362123 - protein, 10 aa, Mycobacterium tuberculosis
PGTGPADRHD

SEQ ID NO: 1362124 - protein, 5 aa, Mycobacterium tuberculosis
PGTGR

SEQ ID NO: 1362125 - protein, 6 aa, Mycobacterium tuberculosis
PGTTTA

SEQ ID NO: 1362126 - protein, 20 aa, Mycobacterium tuberculosis
PGWEPRTIDKSNAAASLVTS

SEQ ID NO: 1362127 - protein, 7 aa, Mycobacterium tuberculosis
PHGSGAA

SEQ ID NO: 1362128 - protein, 4 aa, Mycobacterium tuberculosis
PHPE

SEQ ID NO: 1362129 - protein, 4 aa, Mycobacterium tuberculosis
PHTG

SEQ ID NO: 1362130 - protein, 15 aa, Mycobacterium tuberculosis
PIATGDHKAPAAKEG

SEQ ID NO: 1362131 - protein, 11 aa, Mycobacterium tuberculosis
PISQSDVGSVE

SEQ ID NO: 1362132 - protein, 11 aa, Mycobacterium tuberculosis
PKGPAEPPKQL

SEQ ID NO: 1362133 - protein, 5 aa, Mycobacterium tuberculosis
PKPVT

SEQ ID NO: 1362134 - protein, 4 aa, Mycobacterium tuberculosis
PLDP

SEQ ID NO: 1362135 - protein, 5 aa, Mycobacterium tuberculosis
PLGED

SEQ ID NO: 1362136 - protein, 5 aa, Mycobacterium tuberculosis
PLHTP

SEQ ID NO: 1362137 - protein, 12 aa, Mycobacterium tuberculosis
PLPPSPSGSFAS

SEQ ID NO: 1362138 - protein, 4 aa, Mycobacterium tuberculosis
PMPP

SEQ ID NO: 1362139 - protein, 4 aa, Mycobacterium tuberculosis
PNGK

SEQ ID NO: 1362140 - protein, 9 aa, Mycobacterium tuberculosis
PNGQAGSNA

SEQ ID NO: 1362141 - protein, 12 aa, Mycobacterium tuberculosis
PNGQGGELQPAT

SEQ ID NO: 1362142 - protein, 4 aa, Mycobacterium tuberculosis
PPAH

SEQ ID NO: 1362143 - protein, 7 aa, Mycobacterium tuberculosis
PPAHGGR

SEQ ID NO: 1362144 - protein, 4 aa, Mycobacterium tuberculosis
PPDV

SEQ ID NO: 1362145 - protein, 25 aa, Mycobacterium tuberculosis
PPEGQGDDPDWKPEEDWRDDPVEDG

SEQ ID NO: 1362146 - protein, 4 aa, Mycobacterium tuberculosis
PPGF

SEQ ID NO: 1362147 - protein, 5 aa, Mycobacterium tuberculosis
PPGQP

SEQ ID NO: 1362148 - protein, 7 aa, Mycobacterium tuberculosis
PPGSELT

SEQ ID NO: 1362149 - protein, 4 aa, Mycobacterium tuberculosis
PPPA

SEQ ID NO: 1362150 - protein, 18 aa, Mycobacterium tuberculosis
PPRSRGVPALTDAAANQA

SEQ ID NO: 1362151 - protein, 15 aa, Mycobacterium tuberculosis
PQNAEKARDLLARLA

SEQ ID NO: 1362152 - protein, 8 aa, Mycobacterium tuberculosis
PQPPAPRD

SEQ ID NO: 1362153 - protein, 4 aa, Mycobacterium tuberculosis
PQRR

SEQ ID NO: 1362154 - protein, 4 aa, Mycobacterium tuberculosis
PRAP

SEQ ID NO: 1362155 - protein, 6 aa, Mycobacterium tuberculosis
PRAPGP

SEQ ID NO: 1362156 - protein, 4 aa, Mycobacterium tuberculosis
PRDR

SEQ ID NO: 1362157 - protein, 7 aa, Mycobacterium tuberculosis
PRGAKGM

SEQ ID NO: 1362158 - protein, 4 aa, Mycobacterium tuberculosis
PRGE

SEQ ID NO: 1362159 - protein, 5 aa, Mycobacterium tuberculosis
PRKSI

SEQ ID NO: 1362160 - protein, 28 aa, Mycobacterium tuberculosis
PRLPPALNPDDADALPTTDRLTTRANRA

SEQ ID NO: 1362161 - protein, 15 aa, Mycobacterium tuberculosis
PRNPTGKVLKRELRK

SEQ ID NO: 1362162 - protein, 6 aa, Mycobacterium tuberculosis
PRSGGL

SEQ ID NO: 1362163 - protein, 7 aa, Mycobacterium tuberculosis
PRTKNSA

SEQ ID NO: 1362164 - protein, 8 aa, Mycobacterium tuberculosis
PSAATAAK

SEQ ID NO: 1362165 - protein, 6 aa, Mycobacterium tuberculosis
PSGFDV

SEQ ID NO: 1362166 - protein, 7 aa, Mycobacterium tuberculosis
PSGHRQV

SEQ ID NO: 1362167 - protein, 8 aa, Mycobacterium tuberculosis
PSGQLNES

SEQ ID NO: 1362168 - protein, 4 aa, Mycobacterium tuberculosis
PSPL

SEQ ID NO: 1362169 - protein, 6 aa, Mycobacterium tuberculosis
PTANGD

SEQ ID NO: 1362170 - protein, 7 aa, Mycobacterium tuberculosis
PTARSAA

SEQ ID NO: 1362171 - protein, 5 aa, Mycobacterium tuberculosis
PTFDG

SEQ ID NO: 1362172 - protein, 4 aa, Mycobacterium tuberculosis
PTPL

SEQ ID NO: 1362173 - protein, 28 aa, Mycobacterium tuberculosis
PTPSVSRAVPTPTAQPATTLPPAGASLS

SEQ ID NO: 1362174 - protein, 5 aa, Mycobacterium tuberculosis
PTSAV

SEQ ID NO: 1362175 - protein, 7 aa, Mycobacterium tuberculosis
PTSPAQR

SEQ ID NO: 1362176 - protein, 11 aa, Mycobacterium tuberculosis
PTTNREATKNA

SEQ ID NO: 1362177 - protein, 6 aa, Mycobacterium tuberculosis
PTWSRP

SEQ ID NO: 1362178 - protein, 5 aa, Mycobacterium tuberculosis
PVRRP

SEQ ID NO: 1362179 - protein, 8 aa, Mycobacterium tuberculosis
QAAHDSTA

SEQ ID NO: 1362180 - protein, 8 aa, Mycobacterium tuberculosis
QAAPSRGR

SEQ ID NO: 1362181 - protein, 12 aa, Mycobacterium tuberculosis
QAERSSDPERRA

SEQ ID NO: 1362182 - protein, 5 aa, Mycobacterium tuberculosis
QAGGA

SEQ ID NO: 1362183 - protein, 10 aa, Mycobacterium tuberculosis
QALAARPGVQ

SEQ ID NO: 1362184 - protein, 8 aa, Mycobacterium tuberculosis
QAPNRAGT

SEQ ID NO: 1362185 - protein, 9 aa, Mycobacterium tuberculosis
QASQTKART

SEQ ID NO: 1362186 - protein, 25 aa, Mycobacterium tuberculosis
QASVDSPRPAGEVTGTNPPAGTTVP

SEQ ID NO: 1362187 - protein, 13 aa, Mycobacterium tuberculosis
QAVASARARGDNT

SEQ ID NO: 1362188 - protein, 5 aa, Mycobacterium tuberculosis
QAVGR

SEQ ID NO: 1362189 - protein, 12 aa, Mycobacterium tuberculosis
QDNKGTYEVGRP

SEQ ID NO: 1362190 - protein, 5 aa, Mycobacterium tuberculosis
QDPDG

SEQ ID NO: 1362191 - protein, 5 aa, Mycobacterium tuberculosis
QDPYV

SEQ ID NO: 1362192 - protein, 9 aa, Mycobacterium tuberculosis
QEQEQASTA

SEQ ID NO: 1362193 - protein, 10 aa, Mycobacterium tuberculosis
QFPGPGRTEH

SEQ ID NO: 1362194 - protein, 10 aa, Mycobacterium tuberculosis
QGADSDQAVK

SEQ ID NO: 1362195 - protein, 6 aa, Mycobacterium tuberculosis
QGAIQG

SEQ ID NO: 1362196 - protein, 15 aa, Mycobacterium tuberculosis
QGAPGATANALAAPQ

SEQ ID NO: 1362197 - protein, 8 aa, Mycobacterium tuberculosis
QGASTGET

SEQ ID NO: 1362198 - protein, 8 aa, Mycobacterium tuberculosis
QGDGSERV

SEQ ID NO: 1362199 - protein, 6 aa, Mycobacterium tuberculosis
QGIANN

SEQ ID NO: 1362200 - protein, 7 aa, Mycobacterium tuberculosis
QGKDGRH

SEQ ID NO: 1362201 - protein, 8 aa, Mycobacterium tuberculosis
QGKLGGTS

SEQ ID NO: 1362202 - protein, 7 aa, Mycobacterium tuberculosis
QGPTLSR

SEQ ID NO: 1362203 - protein, 12 aa, Mycobacterium tuberculosis
QGVGSAIASPTG

SEQ ID NO: 1362204 - protein, 4 aa, Mycobacterium tuberculosis
QHGI

SEQ ID NO: 1362205 - protein, 4 aa, Mycobacterium tuberculosis
QHRG

SEQ ID NO: 1362206 - protein, 7 aa, Mycobacterium tuberculosis
QISGPQQ

SEQ ID NO: 1362207 - protein, 19 aa, Mycobacterium tuberculosis
QKLPDGQAERTESDGGTPL

SEQ ID NO: 1362208 - protein, 5 aa, Mycobacterium tuberculosis
QLGAE

SEQ ID NO: 1362209 - protein, 13 aa, Mycobacterium tuberculosis
QLGDSSEPRVSKT

SEQ ID NO: 1362210 - protein, 8 aa, Mycobacterium tuberculosis
QLGQQAGS

SEQ ID NO: 1362211 - protein, 8 aa, Mycobacterium tuberculosis
QLPETPAY

SEQ ID NO: 1362212 - protein, 11 aa, Mycobacterium tuberculosis
QLSGGNSYNAA

SEQ ID NO: 1362213 - protein, 12 aa, Mycobacterium tuberculosis
QPAGPATEATER

SEQ ID NO: 1362214 - protein, 5 aa, Mycobacterium tuberculosis
QPAGR

SEQ ID NO: 1362215 - protein, 9 aa, Mycobacterium tuberculosis
QPALSAPPQ

SEQ ID NO: 1362216 - protein, 7 aa, Mycobacterium tuberculosis
QPKKAAA

SEQ ID NO: 1362217 - protein, 6 aa, Mycobacterium tuberculosis
QPPGTK

SEQ ID NO: 1362218 - protein, 13 aa, Mycobacterium tuberculosis
QPPPTVSDRVPGL

SEQ ID NO: 1362219 - protein, 4 aa, Mycobacterium tuberculosis
QPPW

SEQ ID NO: 1362220 - protein, 4 aa, Mycobacterium tuberculosis
QPSE

SEQ ID NO: 1362221 - protein, 10 aa, Mycobacterium tuberculosis
QPSKSAQDLS

SEQ ID NO: 1362222 - protein, 6 aa, Mycobacterium tuberculosis
QQQPGW

SEQ ID NO: 1362223 - protein, 5 aa, Mycobacterium tuberculosis
QRELD

SEQ ID NO: 1362224 - protein, 9 aa, Mycobacterium tuberculosis
QRFGPNDYR

SEQ ID NO: 1362225 - protein, 5 aa, Mycobacterium tuberculosis
QRGNY

SEQ ID NO: 1362226 - protein, 5 aa, Mycobacterium tuberculosis
QRNRA

SEQ ID NO: 1362227 - protein, 5 aa, Mycobacterium tuberculosis
QRPPG

SEQ ID NO: 1362228 - protein, 5 aa, Mycobacterium tuberculosis
QRPSV

SEQ ID NO: 1362229 - protein, 11 aa, Mycobacterium tuberculosis
QRQPVPVDDET

SEQ ID NO: 1362230 - protein, 4 aa, Mycobacterium tuberculosis
QRRH

SEQ ID NO: 1362231 - protein, 9 aa, Mycobacterium tuberculosis
QRSKADPPF

SEQ ID NO: 1362232 - protein, 4 aa, Mycobacterium tuberculosis
QSAG

SEQ ID NO: 1362233 - protein, 5 aa, Mycobacterium tuberculosis
QSGVQ

SEQ ID NO: 1362234 - protein, 11 aa, Mycobacterium tuberculosis
QSMGGNGLTKE

SEQ ID NO: 1362235 - protein, 9 aa, Mycobacterium tuberculosis
QSPGPNNQQ

SEQ ID NO: 1362236 - protein, 9 aa, Mycobacterium tuberculosis
QTGGEASAR

SEQ ID NO: 1362237 - protein, 28 aa, Mycobacterium tuberculosis
QTNGDSPGRHGGRGTPSPTDGPRASTES

SEQ ID NO: 1362238 - protein, 5 aa, Mycobacterium tuberculosis
QTPDF

SEQ ID NO: 1362239 - protein, 5 aa, Mycobacterium tuberculosis
QVSGD

SEQ ID NO: 1362240 - protein, 15 aa, Mycobacterium tuberculosis
QYQARQSARESSSEQ

SEQ ID NO: 1362241 - protein, 12 aa, Mycobacterium tuberculosis
RAGCSRVDAIDE

SEQ ID NO: 1362242 - protein, 8 aa, Mycobacterium tuberculosis
RAGRDDKV

SEQ ID NO: 1362243 - protein, 10 aa, Mycobacterium tuberculosis
RAGRQADAQL

SEQ ID NO: 1362244 - protein, 21 aa, Mycobacterium tuberculosis
RASGAVNAAEYESKRAQIISE

SEQ ID NO: 1362245 - protein, 9 aa, Mycobacterium tuberculosis
RASGPEQRI

SEQ ID NO: 1362246 - protein, 6 aa, Mycobacterium tuberculosis
RATRPD

SEQ ID NO: 1362247 - protein, 14 aa, Mycobacterium tuberculosis
RDAAANPGNQAAAA

SEQ ID NO: 1362248 - protein, 5 aa, Mycobacterium tuberculosis
RDDEL

SEQ ID NO: 1362249 - protein, 4 aa, Mycobacterium tuberculosis
RDEG

SEQ ID NO: 1362250 - protein, 6 aa, Mycobacterium tuberculosis
RDEGTA

SEQ ID NO: 1362251 - protein, 4 aa, Mycobacterium tuberculosis
RDGE

SEQ ID NO: 1362252 - protein, 7 aa, Mycobacterium tuberculosis
RDGREDV

SEQ ID NO: 1362253 - protein, 7 aa, Mycobacterium tuberculosis
RDGSQTR

SEQ ID NO: 1362254 - protein, 6 aa, Mycobacterium tuberculosis
RDLRDP

SEQ ID NO: 1362255 - protein, 10 aa, Mycobacterium tuberculosis
RDPNGPPGAG

SEQ ID NO: 1362256 - protein, 6 aa, Mycobacterium tuberculosis
RDPQFG

SEQ ID NO: 1362257 - protein, 18 aa, Mycobacterium tuberculosis
REDGPPSHHTKRGTPSMG

SEQ ID NO: 1362258 - protein, 6 aa, Mycobacterium tuberculosis
REDPAT

SEQ ID NO: 1362259 - protein, 12 aa, Mycobacterium tuberculosis
REGADDDAEPIG

SEQ ID NO: 1362260 - protein, 14 aa, Mycobacterium tuberculosis
REPDRESSAPPDDV

SEQ ID NO: 1362261 - protein, 8 aa, Mycobacterium tuberculosis
RERASGTL

SEQ ID NO: 1362262 - protein, 7 aa, Mycobacterium tuberculosis
RERSGVG

SEQ ID NO: 1362263 - protein, 7 aa, Mycobacterium tuberculosis
RESQKRA

SEQ ID NO: 1362264 - protein, 9 aa, Mycobacterium tuberculosis
RETASPTAN

SEQ ID NO: 1362265 - protein, 15 aa, Mycobacterium tuberculosis
RETEEAAASLGANGA

SEQ ID NO: 1362266 - protein, 13 aa, Mycobacterium tuberculosis
RFGVEDSKEARDA

SEQ ID NO: 1362267 - protein, 5 aa, Mycobacterium tuberculosis
RFQGT

SEQ ID NO: 1362268 - protein, 15 aa, Mycobacterium tuberculosis
RGDTSRSRQAGSTGL

SEQ ID NO: 1362269 - protein, 4 aa, Mycobacterium tuberculosis
RGEL

SEQ ID NO: 1362270 - protein, 8 aa, Mycobacterium tuberculosis
RGGGPDNV

SEQ ID NO: 1362271 - protein, 5 aa, Mycobacterium tuberculosis
RGGHD

SEQ ID NO: 1362272 - protein, 10 aa, Mycobacterium tuberculosis
RGGPEGTGTT

SEQ ID NO: 1362273 - protein, 8 aa, Mycobacterium tuberculosis
RGGSGQEG

SEQ ID NO: 1362274 - protein, 7 aa, Mycobacterium tuberculosis
RGHGAGA

SEQ ID NO: 1362275 - protein, 4 aa, Mycobacterium tuberculosis
RGPQ

SEQ ID NO: 1362276 - protein, 7 aa, Mycobacterium tuberculosis
RGPRQTI

SEQ ID NO: 1362277 - protein, 4 aa, Mycobacterium tuberculosis
RGQW

SEQ ID NO: 1362278 - protein, 6 aa, Mycobacterium tuberculosis
RGRSRP

SEQ ID NO: 1362279 - protein, 6 aa, Mycobacterium tuberculosis
RGSGSI

SEQ ID NO: 1362280 - protein, 6 aa, Mycobacterium tuberculosis
RGSSGN

SEQ ID NO: 1362281 - protein, 17 aa, Mycobacterium tuberculosis
RHSAQGLRQARESATRR

SEQ ID NO: 1362282 - protein, 7 aa, Mycobacterium tuberculosis
RHTAESV

SEQ ID NO: 1362283 - protein, 7 aa, Mycobacterium tuberculosis
RHTGPTG

SEQ ID NO: 1362284 - protein, 8 aa, Mycobacterium tuberculosis
RKAGQPPK

SEQ ID NO: 1362285 - protein, 5 aa, Mycobacterium tuberculosis
RKEDK

SEQ ID NO: 1362286 - protein, 7 aa, Mycobacterium tuberculosis
RKGQESF

SEQ ID NO: 1362287 - protein, 8 aa, Mycobacterium tuberculosis
RKPDGKDL

SEQ ID NO: 1362288 - protein, 28 aa, Mycobacterium tuberculosis
RKPGESRGTEPNMRPDRNTNARRTAPDT

SEQ ID NO: 1362289 - protein, 28 aa, Mycobacterium tuberculosis
RKRANPQPAQTQPARKTPRTAPGQPARQ

SEQ ID NO: 1362290 - protein, 7 aa, Mycobacterium tuberculosis
RKRFGDT

SEQ ID NO: 1362291 - protein, 6 aa, Mycobacterium tuberculosis
RKSHGS

SEQ ID NO: 1362292 - protein, 5 aa, Mycobacterium tuberculosis
RLQSG

SEQ ID NO: 1362293 - protein, 5 aa, Mycobacterium tuberculosis
RLRSG

SEQ ID NO: 1362294 - protein, 4 aa, Mycobacterium tuberculosis
RLSQ

SEQ ID NO: 1362295 - protein, 4 aa, Mycobacterium tuberculosis
RNDA

SEQ ID NO: 1362296 - protein, 6 aa, Mycobacterium tuberculosis
RNDSEA

SEQ ID NO: 1362297 - protein, 8 aa, Mycobacterium tuberculosis
RNGESDPR

SEQ ID NO: 1362298 - protein, 11 aa, Mycobacterium tuberculosis
RNGGQTALSAA

SEQ ID NO: 1362299 - protein, 4 aa, Mycobacterium tuberculosis
RNGN

SEQ ID NO: 1362300 - protein, 4 aa, Mycobacterium tuberculosis
RNTD

SEQ ID NO: 1362301 - protein, 14 aa, Mycobacterium tuberculosis
RPAGGGTAKTPGPL

SEQ ID NO: 1362302 - protein, 14 aa, Mycobacterium tuberculosis
RPAPPVGWPPGPQL

SEQ ID NO: 1362303 - protein, 6 aa, Mycobacterium tuberculosis
RPDGGQ

SEQ ID NO: 1362304 - protein, 7 aa, Mycobacterium tuberculosis
RPDPVHK

SEQ ID NO: 1362305 - protein, 22 aa, Mycobacterium tuberculosis
RPDQQTDSGAARAAVAAASDGT

SEQ ID NO: 1362306 - protein, 8 aa, Mycobacterium tuberculosis
RPGASDRV

SEQ ID NO: 1362307 - protein, 11 aa, Mycobacterium tuberculosis
RPGDHDNTTGV

SEQ ID NO: 1362308 - protein, 10 aa, Mycobacterium tuberculosis
RPGPTPPATI

SEQ ID NO: 1362309 - protein, 8 aa, Mycobacterium tuberculosis
RPGSPPLK

SEQ ID NO: 1362310 - protein, 64 aa, Mycobacterium tuberculosis; identical to SEQ ID NO: 153636

SEQ ID NO: 1362311 - protein, 4 aa, Mycobacterium tuberculosis
RPRD

SEQ ID NO: 1362312 - protein, 4 aa, Mycobacterium tuberculosis
RPRE

SEQ ID NO: 1362313 - protein, 76 aa, Mycobacterium tuberculosis; identical to SEQ ID NO: 153640

SEQ ID NO: 1362314 - protein, 13 aa, Mycobacterium tuberculosis
RQEATQSRLPGSI

SEQ ID NO: 1362315 - protein, 7 aa, Mycobacterium tuberculosis
RQRPDHP

SEQ ID NO: 1362316 - protein, 7 aa, Mycobacterium tuberculosis
RQSDSEA

SEQ ID NO: 1362317 - protein, 14 aa, Mycobacterium tuberculosis
RRADTAADKANTAL

SEQ ID NO: 1362318 - protein, 9 aa, Mycobacterium tuberculosis
RRAGRASAR

SEQ ID NO: 1362319 - protein, 5 aa, Mycobacterium tuberculosis
RREPR

SEQ ID NO: 1362320 - protein, 7 aa, Mycobacterium tuberculosis
RRGARNR

SEQ ID NO: 1362321 - protein, 16 aa, Mycobacterium tuberculosis
RRGPATSRNAPPPSTA

SEQ ID NO: 1362322 - protein, 15 aa, Mycobacterium tuberculosis
RRHADGDTVGRRKAD

SEQ ID NO: 1362323 - protein, 5 aa, Mycobacterium tuberculosis
RRLKT

SEQ ID NO: 1362324 - protein, 28 aa, Mycobacterium tuberculosis
RRNSGSPAGSEDASTDGGEQPAAADEQS

SEQ ID NO: 1362325 - protein, 40 aa, Mycobacterium tuberculosis; identical to SEQ ID NO: 153706

SEQ ID NO: 1362326 - protein, 9 aa, Mycobacterium tuberculosis
RRRGGDPVS

SEQ ID NO: 1362327 - protein, 8 aa, Mycobacterium tuberculosis
RRRRPSSA

SEQ ID NO: 1362328 - protein, 4 aa, Mycobacterium tuberculosis
RRRT

SEQ ID NO: 1362329 - protein, 7 aa, Mycobacterium tuberculosis
RRSARSR

SEQ ID NO: 1362330 - protein, 20 aa, Mycobacterium tuberculosis
RRSATSTDAAPGAGDDLNQG

SEQ ID NO: 1362331 - protein, 9 aa, Mycobacterium tuberculosis
RRSRIEPTN

SEQ ID NO: 1362332 - protein, 10 aa, Mycobacterium tuberculosis
RSAKQSEATV

SEQ ID NO: 1362333 - protein, 10 aa, Mycobacterium tuberculosis
RSAVTGAHAP

SEQ ID NO: 1362334 - protein, 10 aa, Mycobacterium tuberculosis
RSEATKHRQA

SEQ ID NO: 1362335 - protein, 20 aa, Mycobacterium tuberculosis
RSGLAPAERDTAGQPIEPAD

SEQ ID NO: 1362336 - protein, 6 aa, Mycobacterium tuberculosis
RSGSLA

SEQ ID NO: 1362337 - protein, 9 aa, Mycobacterium tuberculosis
RSPQSPNGT

SEQ ID NO: 1362338 - protein, 6 aa, Mycobacterium tuberculosis
RSPSSV

SEQ ID NO: 1362339 - protein, 5 aa, Mycobacterium tuberculosis
RSTND

SEQ ID NO: 1362340 - protein, 20 aa, Mycobacterium tuberculosis
RSTQAAATTLAQRRSTLSAK

SEQ ID NO: 1362341 - protein, 8 aa, Mycobacterium tuberculosis
RSTSPIDS

SEQ ID NO: 1362342 - protein, 6 aa, Mycobacterium tuberculosis
RTADSV

SEQ ID NO: 1362343 - protein, 5 aa, Mycobacterium tuberculosis
RTERY

SEQ ID NO: 1362344 - protein, 4 aa, Mycobacterium tuberculosis
RTGG

SEQ ID NO: 1362345 - protein, 6 aa, Mycobacterium tuberculosis
RTKEST

SEQ ID NO: 1362346 - protein, 6 aa, Mycobacterium tuberculosis
RTPDGV

SEQ ID NO: 1362347 - protein, 6 aa, Mycobacterium tuberculosis
RTPGES

SEQ ID NO: 1362348 - protein, 4 aa, Mycobacterium tuberculosis
RTQS

SEQ ID NO: 1362349 - protein, 5 aa, Mycobacterium tuberculosis
RTRPE

SEQ ID NO: 1362350 - protein, 8 aa, Mycobacterium tuberculosis
RTRSAQAA

SEQ ID NO: 1362351 - protein, 6 aa, Mycobacterium tuberculosis
RTTADQ

SEQ ID NO: 1362352 - protein, 5 aa, Mycobacterium tuberculosis
RTTAK

SEQ ID NO: 1362353 - protein, 8 aa, Mycobacterium tuberculosis
RTTGGFGQ

SEQ ID NO: 1362354 - protein, 9 aa, Mycobacterium tuberculosis
RVTSSATSQ

SEQ ID NO: 1362355 - protein, 12 aa, Mycobacterium tuberculosis
RWPAERSPAADE

SEQ ID NO: 1362356 - protein, 4 aa, Mycobacterium tuberculosis
RYGR

SEQ ID NO: 1362357 - protein, 30 aa, Mycobacterium tuberculosis; identical to SEQ ID NO: 149285

SEQ ID NO: 1362358 - protein, 6 aa, Mycobacterium tuberculosis
SAAGST

SEQ ID NO: 1362359 - protein, 6 aa, Mycobacterium tuberculosis
SAAGTL

SEQ ID NO: 1362360 - protein, 4 aa, Mycobacterium tuberculosis
SAAW

SEQ ID NO: 1362361 - protein, 6 aa, Mycobacterium tuberculosis
SADGSF

SEQ ID NO: 1362362 - protein, 15 aa, Mycobacterium tuberculosis
SADSAAAAGEHEAAA

SEQ ID NO: 1362363 - protein, 11 aa, Mycobacterium tuberculosis
SAGDQSPQSTV

SEQ ID NO: 1362364 - protein, 5 aa, Mycobacterium tuberculosis
SAHQP

SEQ ID NO: 1362365 - protein, 8 aa, Mycobacterium tuberculosis
SALTSGAV

SEQ ID NO: 1362366 - protein, 8 aa, Mycobacterium tuberculosis
SAMTDSTN

SEQ ID NO: 1362367 - protein, 7 aa, Mycobacterium tuberculosis
SAPLTQQ

SEQ ID NO: 1362368 - protein, 5 aa, Mycobacterium tuberculosis
SAQGR

SEQ ID NO: 1362369 - protein, 5 aa, Mycobacterium tuberculosis
SAQPV

SEQ ID NO: 1362370 - protein, 4 aa, Mycobacterium tuberculosis
SAQV

SEQ ID NO: 1362371 - protein, 8 aa, Mycobacterium tuberculosis
SARQVTAE

SEQ ID NO: 1362372 - protein, 4 aa, Mycobacterium tuberculosis
SART

SEQ ID NO: 1362373 - protein, 6 aa, Mycobacterium tuberculosis
SARTIT

SEQ ID NO: 1362374 - protein, 7 aa, Mycobacterium tuberculosis
SCQPGAS

SEQ ID NO: 1362375 - protein, 5 aa, Mycobacterium tuberculosis
SDGNT

SEQ ID NO: 1362376 - protein, 4 aa, Mycobacterium tuberculosis
SDGP

SEQ ID NO: 1362377 - protein, 4 aa, Mycobacterium tuberculosis
SDLG

SEQ ID NO: 1362378 - protein, 4 aa, Mycobacterium tuberculosis
SDPS

SEQ ID NO: 1362379 - protein, 9 aa, Mycobacterium tuberculosis
SDQLGAKGG

SEQ ID NO: 1362380 - protein, 4 aa, Mycobacterium tuberculosis
SDRF

SEQ ID NO: 1362381 - protein, 4 aa, Mycobacterium tuberculosis
SDRS

SEQ ID NO: 1362382 - protein, 5 aa, Mycobacterium tuberculosis
SDSGS

SEQ ID NO: 1362383 - protein, 7 aa, Mycobacterium tuberculosis
SEAERRD

SEQ ID NO: 1362384 - protein, 9 aa, Mycobacterium tuberculosis
SEAVGGLGS

SEQ ID NO: 1362385 - protein, 11 aa, Mycobacterium tuberculosis
SEDGARPAPPD

SEQ ID NO: 1362386 - protein, 15 aa, Mycobacterium tuberculosis
SEQAEGKDTAAESVP

SEQ ID NO: 1362387 - protein, 7 aa, Mycobacterium tuberculosis
SESQRRR

SEQ ID NO: 1362388 - protein, 7 aa, Mycobacterium tuberculosis
SEYQSSS

SEQ ID NO: 1362389 - protein, 14 aa, Mycobacterium tuberculosis
SFASRTPVNNNPDK

SEQ ID NO: 1362390 - protein, 4 aa, Mycobacterium tuberculosis
SGAA

SEQ ID NO: 1362391 - protein, 10 aa, Mycobacterium tuberculosis
SGANNNGSAF

SEQ ID NO: 1362392 - protein, 16 aa, Mycobacterium tuberculosis
SGASDVDQRSITGESM

SEQ ID NO: 1362393 - protein, 9 aa, Mycobacterium tuberculosis
SGATPATQA

SEQ ID NO: 1362394 - protein, 6 aa, Mycobacterium tuberculosis
SGATPV

SEQ ID NO: 1362395 - protein, 7 aa, Mycobacterium tuberculosis
SGDEGAS

SEQ ID NO: 1362396 - protein, 5 aa, Mycobacterium tuberculosis
SGESP

SEQ ID NO: 1362397 - protein, 6 aa, Mycobacterium tuberculosis
SGEVPA

SEQ ID NO: 1362398 - protein, 4 aa, Mycobacterium tuberculosis
SGGQ

SEQ ID NO: 1362399 - protein, 6 aa, Mycobacterium tuberculosis
SGGRSN

SEQ ID NO: 1362400 - protein, 8 aa, Mycobacterium tuberculosis
SGKSRKSP

SEQ ID NO: 1362401 - protein, 9 aa, Mycobacterium tuberculosis
SGLNGKRPK

SEQ ID NO: 1362402 - protein, 11 aa, Mycobacterium tuberculosis
SGLPTPGVPPV

SEQ ID NO: 1362403 - protein, 8 aa, Mycobacterium tuberculosis
SGNLTGGG

SEQ ID NO: 1362404 - protein, 4 aa, Mycobacterium tuberculosis
SGQM

SEQ ID NO: 1362405 - protein, 9 aa, Mycobacterium tuberculosis
SGRPLERGP

SEQ ID NO: 1362406 - protein, 7 aa, Mycobacterium tuberculosis
SGRTSLR

SEQ ID NO: 1362407 - protein, 5 aa, Mycobacterium tuberculosis
SGRTT

SEQ ID NO: 1362408 - protein, 8 aa, Mycobacterium tuberculosis
SGSPQPGI

SEQ ID NO: 1362409 - protein, 9 aa, Mycobacterium tuberculosis
SGSTRTPAG

SEQ ID NO: 1362410 - protein, 13 aa, Mycobacterium tuberculosis
SGTAVAIESLILH

SEQ ID NO: 1362411 - protein, 4 aa, Mycobacterium tuberculosis
SGTE

SEQ ID NO: 1362412 - protein, 6 aa, Mycobacterium tuberculosis
SGTWRD

SEQ ID NO: 1362413 - protein, 6 aa, Mycobacterium tuberculosis
SGVASA

SEQ ID NO: 1362414 - protein, 5 aa, Mycobacterium tuberculosis
SGVAV

SEQ ID NO: 1362415 - protein, 4 aa, Mycobacterium tuberculosis
SGVL

SEQ ID NO: 1362416 - protein, 10 aa, Mycobacterium tuberculosis
SHDRRSDLDR

SEQ ID NO: 1362417 - protein, 10 aa, Mycobacterium tuberculosis
SHDRSTEPER

SEQ ID NO: 1362418 - protein, 6 aa, Mycobacterium tuberculosis
SHEEAT

SEQ ID NO: 1362419 - protein, 16 aa, Mycobacterium tuberculosis
SIARQSAEAAANPQTA

SEQ ID NO: 1362420 - protein, 8 aa, Mycobacterium tuberculosis
SIPPPEGK

SEQ ID NO: 1362421 - protein, 6 aa, Mycobacterium tuberculosis
SITPGG

SEQ ID NO: 1362422 - protein, 4 aa, Mycobacterium tuberculosis
SKDN

SEQ ID NO: 1362423 - protein, 7 aa, Mycobacterium tuberculosis
SKESPRT

SEQ ID NO: 1362424 - protein, 16 aa, Mycobacterium tuberculosis
SLAADPGKAIEGTAYS

SEQ ID NO: 1362425 - protein, 11 aa, Mycobacterium tuberculosis
SLKADGEVTEP

SEQ ID NO: 1362426 - protein, 6 aa, Mycobacterium tuberculosis
SLRDQR

SEQ ID NO: 1362427 - protein, 13 aa, Mycobacterium tuberculosis
SLSGDSSAFDTRG

SEQ ID NO: 1362428 - protein, 7 aa, Mycobacterium tuberculosis
SNAAQAD

SEQ ID NO: 1362429 - protein, 7 aa, Mycobacterium tuberculosis
SNARERT

SEQ ID NO: 1362430 - protein, 14 aa, Mycobacterium tuberculosis
SNSPPTGQLTDSPV

SEQ ID NO: 1362431 - protein, 10 aa, Mycobacterium tuberculosis
SNYDSDGYVG

SEQ ID NO: 1362432 - protein, 7 aa, Mycobacterium tuberculosis
SPDPRYT

SEQ ID NO: 1362433 - protein, 6 aa, Mycobacterium tuberculosis
SPDTLD

SEQ ID NO: 1362434 - protein, 7 aa, Mycobacterium tuberculosis
SPGEQQR

SEQ ID NO: 1362435 - protein, 16 aa, Mycobacterium tuberculosis
SPGSPGPGGTPVTAAG

SEQ ID NO: 1362436 - protein, 7 aa, Mycobacterium tuberculosis
SPPTRAA

SEQ ID NO: 1362437 - protein, 9 aa, Mycobacterium tuberculosis
SPQSYRGAP

SEQ ID NO: 1362438 - protein, 7 aa, Mycobacterium tuberculosis
SQDYNGD

SEQ ID NO: 1362439 - protein, 5 aa, Mycobacterium tuberculosis
SQSER

SEQ ID NO: 1362440 - protein, 12 aa, Mycobacterium tuberculosis
SQTLRGASENEC

SEQ ID NO: 1362441 - protein, 7 aa, Mycobacterium tuberculosis
SQTSNRL

SEQ ID NO: 1362442 - protein, 14 aa, Mycobacterium tuberculosis
SRAKQLSKDMPKTT

SEQ ID NO: 1362443 - protein, 7 aa, Mycobacterium tuberculosis
SRAKRTE

SEQ ID NO: 1362444 - protein, 13 aa, Mycobacterium tuberculosis
SREYQADESGAVL

SEQ ID NO: 1362445 - protein, 10 aa, Mycobacterium tuberculosis
SRFNRSKQAA

SEQ ID NO: 1362446 - protein, 10 aa, Mycobacterium tuberculosis
SRKTKDEDME

SEQ ID NO: 1362447 - protein, 6 aa, Mycobacterium tuberculosis
SRPARH

SEQ ID NO: 1362448 - protein, 6 aa, Mycobacterium tuberculosis
SRPQDP

SEQ ID NO: 1362449 - protein, 9 aa, Mycobacterium tuberculosis
SRRHDAAGN

SEQ ID NO: 1362450 - protein, 5 aa, Mycobacterium tuberculosis
SRSAD

SEQ ID NO: 1362451 - protein, 8 aa, Mycobacterium tuberculosis
SRTGGAPT

SEQ ID NO: 1362452 - protein, 15 aa, Mycobacterium tuberculosis
SRVTNSAGAKDEPRA

SEQ ID NO: 1362453 - protein, 17 aa, Mycobacterium tuberculosis
SSANGAGGAGPGQQRYR

SEQ ID NO: 1362454 - protein, 7 aa, Mycobacterium tuberculosis
SSAPPFE

SEQ ID NO: 1362455 - protein, 10 aa, Mycobacterium tuberculosis
SSAQPPTPRC

SEQ ID NO: 1362456 - protein, 9 aa, Mycobacterium tuberculosis
SSCGPTDHI

SEQ ID NO: 1362457 - protein, 6 aa, Mycobacterium tuberculosis
SSDGTA

SEQ ID NO: 1362458 - protein, 4 aa, Mycobacterium tuberculosis
SSFE

SEQ ID NO: 1362459 - protein, 7 aa, Mycobacterium tuberculosis
SSGLSGN

SEQ ID NO: 1362460 - protein, 8 aa, Mycobacterium tuberculosis
SSGRGQAA

SEQ ID NO: 1362461 - protein, 8 aa, Mycobacterium tuberculosis
SSPARGTM

SEQ ID NO: 1362462 - protein, 6 aa, Mycobacterium tuberculosis
SSPEPY

SEQ ID NO: 1362463 - protein, 5 aa, Mycobacterium tuberculosis
SSSFR

SEQ ID NO: 1362464 - protein, 8 aa, Mycobacterium tuberculosis
SSSRRGRA

SEQ ID NO: 1362465 - protein, 7 aa, Mycobacterium tuberculosis
SSTGEFR

SEQ ID NO: 1362466 - protein, 16 aa, Mycobacterium tuberculosis
SSTGHDVEGAQKNFTA

SEQ ID NO: 1362467 - protein, 4 aa, Mycobacterium tuberculosis
STAS

SEQ ID NO: 1362468 - protein, 4 aa, Mycobacterium tuberculosis
STFP

SEQ ID NO: 1362469 - protein, 5 aa, Mycobacterium tuberculosis
STGGV

SEQ ID NO: 1362470 - protein, 4 aa, Mycobacterium tuberculosis
STGR

SEQ ID NO: 1362471 - protein, 8 aa, Mycobacterium tuberculosis
STGSGKST

SEQ ID NO: 1362472 - protein, 11 aa, Mycobacterium tuberculosis
STPEDPASARF

SEQ ID NO: 1362473 - protein, 9 aa, Mycobacterium tuberculosis
STPSTAGRI

SEQ ID NO: 1362474 - protein, 6 aa, Mycobacterium tuberculosis
STQDTN

SEQ ID NO: 1362475 - protein, 7 aa, Mycobacterium tuberculosis
STSGTFQ

SEQ ID NO: 1362476 - protein, 7 aa, Mycobacterium tuberculosis
STSTFQG

SEQ ID NO: 1362477 - protein, 7 aa, Mycobacterium tuberculosis
STTGYGD

SEQ ID NO: 1362478 - protein, 12 aa, Mycobacterium tuberculosis
STTHADSDTQAM

SEQ ID NO: 1362479 - protein, 5 aa, Mycobacterium tuberculosis
STTQS

SEQ ID NO: 1362480 - protein, 13 aa, Mycobacterium tuberculosis
STTSKDSPNPSMA

SEQ ID NO: 1362481 - protein, 13 aa, Mycobacterium tuberculosis
STTSTSGSGGGRR

SEQ ID NO: 1362482 - protein, 4 aa, Mycobacterium tuberculosis
STVD

SEQ ID NO: 1362483 - protein, 25 aa, Mycobacterium tuberculosis
SVAGTADDAAVEGTKVGVNTGGTYT

SEQ ID NO: 1362484 - protein, 8 aa, Mycobacterium tuberculosis
SVPPSGAH

SEQ ID NO: 1362485 - protein, 8 aa, Mycobacterium tuberculosis
SVSGPSQD

SEQ ID NO: 1362486 - protein, 5 aa, Mycobacterium tuberculosis
SYPSR

SEQ ID NO: 1362487 - protein, 7 aa, Mycobacterium tuberculosis
SYSTQYP

SEQ ID NO: 1362488 - protein, 5 aa, Mycobacterium tuberculosis
TAAQE

SEQ ID NO: 1362489 - protein, 6 aa, Mycobacterium tuberculosis
TANTYS

SEQ ID NO: 1362490 - protein, 14 aa, Mycobacterium tuberculosis
TAPLGTSPDGRSAT

SEQ ID NO: 1362491 - protein, 10 aa, Mycobacterium tuberculosis
TAQESADSMD

SEQ ID NO: 1362492 - protein, 13 aa, Mycobacterium tuberculosis
TAQQPGQTLPVGA

SEQ ID NO: 1362493 - protein, 8 aa, Mycobacterium tuberculosis
TARDNGTL

SEQ ID NO: 1362494 - protein, 9 aa, Mycobacterium tuberculosis
TARPGTTTA

SEQ ID NO: 1362495 - protein, 4 aa, Mycobacterium tuberculosis
TASA

SEQ ID NO: 1362496 - protein, 7 aa, Mycobacterium tuberculosis
TASDGSV

SEQ ID NO: 1362497 - protein, 4 aa, Mycobacterium tuberculosis
TASR

SEQ ID NO: 1362498 - protein, 6 aa, Mycobacterium tuberculosis
TATTPA

SEQ ID NO: 1362499 - protein, 6 aa, Mycobacterium tuberculosis
TAYGTA

SEQ ID NO: 1362500 - protein, 6 aa, Mycobacterium tuberculosis
TDADRR

SEQ ID NO: 1362501 - protein, 8 aa, Mycobacterium tuberculosis
TDAERTSL

SEQ ID NO: 1362502 - protein, 10 aa, Mycobacterium tuberculosis
TDAGARDRAS

SEQ ID NO: 1362503 - protein, 5 aa, Mycobacterium tuberculosis
TDGAI

SEQ ID NO: 1362504 - protein, 5 aa, Mycobacterium tuberculosis
TDHTR

SEQ ID NO: 1362505 - protein, 8 aa, Mycobacterium tuberculosis
TDLRTPKA

SEQ ID NO: 1362506 - protein, 15 aa, Mycobacterium tuberculosis
TDPAANTSVSAGDEI

SEQ ID NO: 1362507 - protein, 6 aa, Mycobacterium tuberculosis
TDPDAA

SEQ ID NO: 1362508 - protein, 21 aa, Mycobacterium tuberculosis
TDPGASPNLSDVSKQRVSGSQ

SEQ ID NO: 1362509 - protein, 16 aa, Mycobacterium tuberculosis
TDTEADQTKPGDEPKK

SEQ ID NO: 1362510 - protein, 8 aa, Mycobacterium tuberculosis
TEARQPGG

SEQ ID NO: 1362511 - protein, 6 aa, Mycobacterium tuberculosis
TEGFSG

SEQ ID NO: 1362512 - protein, 12 aa, Mycobacterium tuberculosis
TEPDSGSDAFGG

SEQ ID NO: 1362513 - protein, 7 aa, Mycobacterium tuberculosis
TESAERD

SEQ ID NO: 1362514 - protein, 4 aa, Mycobacterium tuberculosis
TETT

SEQ ID NO: 1362515 - protein, 5 aa, Mycobacterium tuberculosis
TFSPA

SEQ ID NO: 1362516 - protein, 10 aa, Mycobacterium tuberculosis
TGAGSGIGRE

SEQ ID NO: 1362517 - protein, 4 aa, Mycobacterium tuberculosis
TGAT

SEQ ID NO: 1362518 - protein, 8 aa, Mycobacterium tuberculosis
TGATARES

SEQ ID NO: 1362519 - protein, 10 aa, Mycobacterium tuberculosis
TGCTRGPTVT

SEQ ID NO: 1362520 - protein, 4 aa, Mycobacterium tuberculosis
TGDP

SEQ ID NO: 1362521 - protein, 8 aa, Mycobacterium tuberculosis
TGEPDELT

SEQ ID NO: 1362522 - protein, 10 aa, Mycobacterium tuberculosis
TGETSPGVAG

SEQ ID NO: 1362523 - protein, 12 aa, Mycobacterium tuberculosis
TGGGLPAAAVAS

SEQ ID NO: 1362524 - protein, 10 aa, Mycobacterium tuberculosis
TGGGPQGSTD

SEQ ID NO: 1362525 - protein, 6 aa, Mycobacterium tuberculosis
TGHSLG

SEQ ID NO: 1362526 - protein, 22 aa, Mycobacterium tuberculosis
TGKGGALSSGKYAPDLAPANEQ

SEQ ID NO: 1362527 - protein, 5 aa, Mycobacterium tuberculosis
TGNSV

SEQ ID NO: 1362528 - protein, 4 aa, Mycobacterium tuberculosis
TGPG

SEQ ID NO: 1362529 - protein, 8 aa, Mycobacterium tuberculosis
TGPKTAVR

SEQ ID NO: 1362530 - protein, 16 aa, Mycobacterium tuberculosis
TGQGSRVAVAAAQDGT

SEQ ID NO: 1362531 - protein, 7 aa, Mycobacterium tuberculosis
TGQTRDA

SEQ ID NO: 1362532 - protein, 8 aa, Mycobacterium tuberculosis
TGRPDNPH

SEQ ID NO: 1362533 - protein, 12 aa, Mycobacterium tuberculosis
TGRPTVGRAGPV

SEQ ID NO: 1362534 - protein, 10 aa, Mycobacterium tuberculosis
TGTLTRGTPE

SEQ ID NO: 1362535 - protein, 4 aa, Mycobacterium tuberculosis
THGT

SEQ ID NO: 1362536 - protein, 17 aa, Mycobacterium tuberculosis
THRAGPGYRRRSPVETT

SEQ ID NO: 1362537 - protein, 10 aa, Mycobacterium tuberculosis
TIGGGFTDAG

SEQ ID NO: 1362538 - protein, 10 aa, Mycobacterium tuberculosis
TMGDPSPGFP

SEQ ID NO: 1362539 - protein, 20 aa, Mycobacterium tuberculosis
TNGANTAGTFSEGPAKTAIQ

SEQ ID NO: 1362540 - protein, 5 aa, Mycobacterium tuberculosis
TNPEH

SEQ ID NO: 1362541 - protein, 10 aa, Mycobacterium tuberculosis
TNSAGNYHPW

SEQ ID NO: 1362542 - protein, 12 aa, Mycobacterium tuberculosis
TNVTRYSDATAG

SEQ ID NO: 1362543 - protein, 9 aa, Mycobacterium tuberculosis
TPAAGAPAI

SEQ ID NO: 1362544 - protein, 5 aa, Mycobacterium tuberculosis
TPAEQ

SEQ ID NO: 1362545 - protein, 4 aa, Mycobacterium tuberculosis
TPAL

SEQ ID NO: 1362546 - protein, 11 aa, Mycobacterium tuberculosis
TPDRDFNRDSR

SEQ ID NO: 1362547 - protein, 4 aa, Mycobacterium tuberculosis
TPEY

SEQ ID NO: 1362548 - protein, 7 aa, Mycobacterium tuberculosis
TPFTGDS

SEQ ID NO: 1362549 - protein, 4 aa, Mycobacterium tuberculosis
TPGA

SEQ ID NO: 1362550 - protein, 11 aa, Mycobacterium tuberculosis
TPPQSTPLPQT

SEQ ID NO: 1362551 - protein, 7 aa, Mycobacterium tuberculosis
TPSGALT

SEQ ID NO: 1362552 - protein, 6 aa, Mycobacterium tuberculosis
TPTARG

SEQ ID NO: 1362553 - protein, 5 aa, Mycobacterium tuberculosis
TPTTA

SEQ ID NO: 1362554 - protein, 4 aa, Mycobacterium tuberculosis
TPTV

SEQ ID NO: 1362555 - protein, 4 aa, Mycobacterium tuberculosis
TQHA

SEQ ID NO: 1362556 - protein, 16 aa, Mycobacterium tuberculosis
TQQTTVDQSGGNLEGK

SEQ ID NO: 1362557 - protein, 11 aa, Mycobacterium tuberculosis
TRAGRSAFSPD

SEQ ID NO: 1362558 - protein, 6 aa, Mycobacterium tuberculosis
TRARRA

SEQ ID NO: 1362559 - protein, 4 aa, Mycobacterium tuberculosis
TRDA

SEQ ID NO: 1362560 - protein, 6 aa, Mycobacterium tuberculosis
TRDYSD

SEQ ID NO: 1362561 - protein, 7 aa, Mycobacterium tuberculosis
TRGDGGF

SEQ ID NO: 1362562 - protein, 12 aa, Mycobacterium tuberculosis
TRGGKPFTGAGY

SEQ ID NO: 1362563 - protein, 5 aa, Mycobacterium tuberculosis
TRGLP

SEQ ID NO: 1362564 - protein, 4 aa, Mycobacterium tuberculosis
TRPG

SEQ ID NO: 1362565 - protein, 6 aa, Mycobacterium tuberculosis
TRPQGV

SEQ ID NO: 1362566 - protein, 10 aa, Mycobacterium tuberculosis
TRPSDDESVE

SEQ ID NO: 1362567 - protein, 13 aa, Mycobacterium tuberculosis
TRQSGRLPETPAY

SEQ ID NO: 1362568 - protein, 14 aa, Mycobacterium tuberculosis
TRTPSSPAARPVGT

SEQ ID NO: 1362569 - protein, 7 aa, Mycobacterium tuberculosis
TRTSGPY

SEQ ID NO: 1362570 - protein, 10 aa, Mycobacterium tuberculosis
TSALDAENEA

SEQ ID NO: 1362571 - protein, 10 aa, Mycobacterium tuberculosis
TSAPRATPQD

SEQ ID NO: 1362572 - protein, 27 aa, Mycobacterium tuberculosis
TSAQGMPPGPPGRRAWQADTESTAPSA

SEQ ID NO: 1362573 - protein, 4 aa, Mycobacterium tuberculosis
TSGA

SEQ ID NO: 1362574 - protein, 13 aa, Mycobacterium tuberculosis
TSGPLPDQADQAA

SEQ ID NO: 1362575 - protein, 6 aa, Mycobacterium tuberculosis
TSHSSA

SEQ ID NO: 1362576 - protein, 5 aa, Mycobacterium tuberculosis
TSPVC

SEQ ID NO: 1362577 - protein, 4 aa, Mycobacterium tuberculosis
TSRA

SEQ ID NO: 1362578 - protein, 5 aa, Mycobacterium tuberculosis
TSRPA

SEQ ID NO: 1362579 - protein, 7 aa, Mycobacterium tuberculosis
TSRSEWP

SEQ ID NO: 1362580 - protein, 19 aa, Mycobacterium tuberculosis
TSTEETVESQVNAARDERD

SEQ ID NO: 1362581 - protein, 4 aa, Mycobacterium tuberculosis
TSTG

SEQ ID NO: 1362582 - protein, 7 aa, Mycobacterium tuberculosis
TSTGTGW

SEQ ID NO: 1362583 - protein, 8 aa, Mycobacterium tuberculosis
TSVSGAVG

SEQ ID NO: 1362584 - protein, 7 aa, Mycobacterium tuberculosis
TTAPLRT

SEQ ID NO: 1362585 - protein, 6 aa, Mycobacterium tuberculosis
TTATGI

SEQ ID NO: 1362586 - protein, 5 aa, Mycobacterium tuberculosis
TTDTV

SEQ ID NO: 1362587 - protein, 10 aa, Mycobacterium tuberculosis
TTESDTPTEV

SEQ ID NO: 1362588 - protein, 8 aa, Mycobacterium tuberculosis
TTGSGKSE

SEQ ID NO: 1362589 - protein, 13 aa, Mycobacterium tuberculosis
TTKGGPKGVGTAV

SEQ ID NO: 1362590 - protein, 8 aa, Mycobacterium tuberculosis
TTNPSAAA

SEQ ID NO: 1362591 - protein, 11 aa, Mycobacterium tuberculosis
TTSQSGPELSP

SEQ ID NO: 1362592 - protein, 5 aa, Mycobacterium tuberculosis
TTTPS

SEQ ID NO: 1362593 - protein, 11 aa, Mycobacterium tuberculosis
TVKPKSDIAPE

SEQ ID NO: 1362594 - protein, 5 aa, Mycobacterium tuberculosis
TVNGS

SEQ ID NO: 1362595 - protein, 7 aa, Mycobacterium tuberculosis
TVNGTGA

SEQ ID NO: 1362596 - protein, 7 aa, Mycobacterium tuberculosis
TVPPTAA

SEQ ID NO: 1362597 - protein, 11 aa, Mycobacterium tuberculosis
TVTPEGDTKTI

SEQ ID NO: 1362598 - protein, 7 aa, Mycobacterium tuberculosis
VAPPGST

SEQ ID NO: 1362599 - protein, 6 aa, Mycobacterium tuberculosis
VDGASA

SEQ ID NO: 1362600 - protein, 6 aa, Mycobacterium tuberculosis
VDTAGD

SEQ ID NO: 1362601 - protein, 5 aa, Mycobacterium tuberculosis
VDTNT

SEQ ID NO: 1362602 - protein, 6 aa, Mycobacterium tuberculosis
VEEITP

SEQ ID NO: 1362603 - protein, 7 aa, Mycobacterium tuberculosis
VEQGDLS

SEQ ID NO: 1362604 - protein, 7 aa, Mycobacterium tuberculosis
VFEPGDS

SEQ ID NO: 1362605 - protein, 6 aa, Mycobacterium tuberculosis
VGARGQ

SEQ ID NO: 1362606 - protein, 9 aa, Mycobacterium tuberculosis
VGASKDPSV

SEQ ID NO: 1362607 - protein, 7 aa, Mycobacterium tuberculosis
VGATPRS

SEQ ID NO: 1362608 - protein, 14 aa, Mycobacterium tuberculosis
VGGSPVQVSGPAAG

SEQ ID NO: 1362609 - protein, 19 aa, Mycobacterium tuberculosis
VGRQRGAGLGGGHDEREQT

SEQ ID NO: 1362610 - protein, 20 aa, Mycobacterium tuberculosis
VGTTTYSSTAQHSAVAAEPP

SEQ ID NO: 1362611 - protein, 12 aa, Mycobacterium tuberculosis
VKAGSPAQKGGI

SEQ ID NO: 1362612 - protein, 13 aa, Mycobacterium tuberculosis
VKGDQSGQTANGK

SEQ ID NO: 1362613 - protein, 7 aa, Mycobacterium tuberculosis
VKGGGSG

SEQ ID NO: 1362614 - protein, 9 aa, Mycobacterium tuberculosis
VNRDSVDAV

SEQ ID NO: 1362615 - protein, 6 aa, Mycobacterium tuberculosis
VPARPA

SEQ ID NO: 1362616 - protein, 30 aa, Mycobacterium tuberculosis; identical to SEQ ID NO: 154911

SEQ ID NO: 1362617 - protein, 8 aa, Mycobacterium tuberculosis
VPGDQPDE

SEQ ID NO: 1362618 - protein, 9 aa, Mycobacterium tuberculosis
VPGEDAHAR

SEQ ID NO: 1362619 - protein, 8 aa, Mycobacterium tuberculosis
VPGKTEVS

SEQ ID NO: 1362620 - protein, 9 aa, Mycobacterium tuberculosis
VPGRGPANL

SEQ ID NO: 1362621 - protein, 7 aa, Mycobacterium tuberculosis
VPISGSA

SEQ ID NO: 1362622 - protein, 4 aa, Mycobacterium tuberculosis
VPLD

SEQ ID NO: 1362623 - protein, 19 aa, Mycobacterium tuberculosis
VPNAETAKSLGLSSPQNAP

SEQ ID NO: 1362624 - protein, 4 aa, Mycobacterium tuberculosis
VPPQ

SEQ ID NO: 1362625 - protein, 9 aa, Mycobacterium tuberculosis
VPRAESPED

SEQ ID NO: 1362626 - protein, 7 aa, Mycobacterium tuberculosis
VPTAEGK

SEQ ID NO: 1362627 - protein, 11 aa, Mycobacterium tuberculosis
VPTDPDDRSVD

SEQ ID NO: 1362628 - protein, 4 aa, Mycobacterium tuberculosis
VPTR

SEQ ID NO: 1362629 - protein, 8 aa, Mycobacterium tuberculosis
VPTSADLG

SEQ ID NO: 1362630 - protein, 6 aa, Mycobacterium tuberculosis
VPTTGP

SEQ ID NO: 1362631 - protein, 6 aa, Mycobacterium tuberculosis
VQRQYP

SEQ ID NO: 1362632 - protein, 7 aa, Mycobacterium tuberculosis
VQSNPST

SEQ ID NO: 1362633 - protein, 8 aa, Mycobacterium tuberculosis
VRAGNSAI

SEQ ID NO: 1362634 - protein, 11 aa, Mycobacterium tuberculosis
VRDKRSDQALA

SEQ ID NO: 1362635 - protein, 5 aa, Mycobacterium tuberculosis
VRPAT

SEQ ID NO: 1362636 - protein, 7 aa, Mycobacterium tuberculosis
VRPDARE

SEQ ID NO: 1362637 - protein, 12 aa, Mycobacterium tuberculosis
VSANDSSCDTTA

SEQ ID NO: 1362638 - protein, 12 aa, Mycobacterium tuberculosis
VSDPTSAPPDWP

SEQ ID NO: 1362639 - protein, 24 aa, Mycobacterium tuberculosis
VSGDDDQLTLPNTAAGRASAISQR

SEQ ID NO: 1362640 - protein, 7 aa, Mycobacterium tuberculosis
VSLAGGG

SEQ ID NO: 1362641 - protein, 9 aa, Mycobacterium tuberculosis
VSNPDLAGR

SEQ ID NO: 1362642 - protein, 7 aa, Mycobacterium tuberculosis
VSPEQTS

SEQ ID NO: 1362643 - protein, 8 aa, Mycobacterium tuberculosis
VSRRTTTV

SEQ ID NO: 1362644 - protein, 9 aa, Mycobacterium tuberculosis
VSRSGSTIS

SEQ ID NO: 1362645 - protein, 9 aa, Mycobacterium tuberculosis
VSSASALGT

SEQ ID NO: 1362646 - protein, 10 aa, Mycobacterium tuberculosis
VSSSSSRTAL

SEQ ID NO: 1362647 - protein, 11 aa, Mycobacterium tuberculosis
VSTGPEQREIP

SEQ ID NO: 1362648 - protein, 5 aa, Mycobacterium tuberculosis
VSTTR

SEQ ID NO: 1362649 - protein, 11 aa, Mycobacterium tuberculosis
VTDKTRQPLYD

SEQ ID NO: 1362650 - protein, 10 aa, Mycobacterium tuberculosis
VTEGTVNATA

SEQ ID NO: 1362651 - protein, 5 aa, Mycobacterium tuberculosis
VTPRR

SEQ ID NO: 1362652 - protein, 10 aa, Mycobacterium tuberculosis
VTPSESPVSL

SEQ ID NO: 1362653 - protein, 11 aa, Mycobacterium tuberculosis
VTQPGTSNPKA

SEQ ID NO: 1362654 - protein, 6 aa, Mycobacterium tuberculosis
VTRDGE

SEQ ID NO: 1362655 - protein, 6 aa, Mycobacterium tuberculosis
VTRNPD

SEQ ID NO: 1362656 - protein, 16 aa, Mycobacterium tuberculosis
VTRPTTGGAPSPGNYL

SEQ ID NO: 1362657 - protein, 9 aa, Mycobacterium tuberculosis
VTTASSAGA

SEQ ID NO: 1362658 - protein, 5 aa, Mycobacterium tuberculosis
VTTPR

SEQ ID NO: 1362659 - protein, 6 aa, Mycobacterium tuberculosis
VTVGGA

SEQ ID NO: 1362660 - protein, 12 aa, Mycobacterium tuberculosis
VTVGTDDDAPGL

SEQ ID NO: 1362661 - protein, 6 aa, Mycobacterium tuberculosis
VVEDGS

SEQ ID NO: 1362662 - protein, 4 aa, Mycobacterium tuberculosis
WDTH

SEQ ID NO: 1362663 - protein, 7 aa, Mycobacterium tuberculosis
WGEPGEG

SEQ ID NO: 1362664 - protein, 10 aa, Mycobacterium tuberculosis
WNPGNTYGET

SEQ ID NO: 1362665 - protein, 4 aa, Mycobacterium tuberculosis
WRPT

SEQ ID NO: 1362666 - protein, 15 aa, Mycobacterium tuberculosis
WRSPADTSTAPLPKG

SEQ ID NO: 1362667 - protein, 10 aa, Mycobacterium tuberculosis
WTPGAHPHEA

SEQ ID NO: 1362668 - protein, 4 aa, Mycobacterium tuberculosis
YADR

SEQ ID NO: 1362669 - protein, 11 aa, Mycobacterium tuberculosis
YAGDRRRAREA

SEQ ID NO: 1362670 - protein, 7 aa, Mycobacterium tuberculosis
YAPDDAA

SEQ ID NO: 1362671 - protein, 4 aa, Mycobacterium tuberculosis
YAPT

SEQ ID NO: 1362672 - protein, 4 aa, Mycobacterium tuberculosis
YASH

SEQ ID NO: 1362673 - protein, 6 aa, Mycobacterium tuberculosis
YASTRH

SEQ ID NO: 1362674 - protein, 14 aa, Mycobacterium tuberculosis
YDDRKTLPASVESS

SEQ ID NO: 1362675 - protein, 9 aa, Mycobacterium tuberculosis
YDGGSGPVL

SEQ ID NO: 1362676 - protein, 14 aa, Mycobacterium tuberculosis
YGAKTAAKTAALER

SEQ ID NO: 1362677 - protein, 10 aa, Mycobacterium tuberculosis
YGERPGTQGA

SEQ ID NO: 1362678 - protein, 6 aa, Mycobacterium tuberculosis
YGGSAA

SEQ ID NO: 1362679 - protein, 9 aa, Mycobacterium tuberculosis
YGPATGSQI

SEQ ID NO: 1362680 - protein, 6 aa, Mycobacterium tuberculosis
YGPDKV

SEQ ID NO: 1362681 - protein, 6 aa, Mycobacterium tuberculosis
YGPPQR

SEQ ID NO: 1362682 - protein, 6 aa, Mycobacterium tuberculosis
YGQTQP

SEQ ID NO: 1362683 - protein, 6 aa, Mycobacterium tuberculosis
YGRDRS

SEQ ID NO: 1362684 - protein, 17 aa, Mycobacterium tuberculosis
YGRPDATDAQVERAARE

SEQ ID NO: 1362685 - protein, 5 aa, Mycobacterium tuberculosis
YGSRE

SEQ ID NO: 1362686 - protein, 19 aa, Mycobacterium tuberculosis
YHSGSPKISNAGGSNSVQQ

SEQ ID NO: 1362687 - protein, 12 aa, Mycobacterium tuberculosis
YKPSQVSAGSQP

SEQ ID NO: 1362688 - protein, 14 aa, Mycobacterium tuberculosis
YLPPTNSVRQAQEE

SEQ ID NO: 1362689 - protein, 9 aa, Mycobacterium tuberculosis
YNPTTGRAE

SEQ ID NO: 1362690 - protein, 21 aa, Mycobacterium tuberculosis
YPESDTADRQVETPPSPPADA

SEQ ID NO: 1362691 - protein, 10 aa, Mycobacterium tuberculosis
YPNAGNKTQT

SEQ ID NO: 1362692 - protein, 11 aa, Mycobacterium tuberculosis
YQIPTDASANV

SEQ ID NO: 1362693 - protein, 5 aa, Mycobacterium tuberculosis
YQPQL

SEQ ID NO: 1362694 - protein, 9 aa, Mycobacterium tuberculosis
YQTNKSDQI

SEQ ID NO: 1362695 - protein, 5 aa, Mycobacterium tuberculosis
YQTPY

SEQ ID NO: 1362696 - protein, 5 aa, Mycobacterium tuberculosis
AAAAT

SEQ ID NO: 1362697 - protein, 8 aa, Mycobacterium tuberculosis
AAADKITP

SEQ ID NO: 1362698 - protein, 9 aa, Mycobacterium tuberculosis
AAAPDDRAL

SEQ ID NO: 1362699 - protein, 12 aa, Mycobacterium tuberculosis
AAAPPGPVGSPQ

SEQ ID NO: 1362700 - protein, 9 aa, Mycobacterium tuberculosis
AAAQSTEFT

SEQ ID NO: 1362701 - protein, 9 aa, Mycobacterium tuberculosis
AAASRSTPT

SEQ ID NO: 1362702 - protein, 9 aa, Mycobacterium tuberculosis
AADAPPGRL

SEQ ID NO: 1362703 - protein, 10 aa, Mycobacterium tuberculosis
AADPEADAAR

SEQ ID NO: 1362704 - protein, 9 aa, Mycobacterium tuberculosis
AAGGDPEAM

SEQ ID NO: 1362705 - protein, 8 aa, Mycobacterium tuberculosis
AAGGGPFA

SEQ ID NO: 1362706 - protein, 6 aa, Mycobacterium tuberculosis
AAGGNI

SEQ ID NO: 1362707 - protein, 8 aa, Mycobacterium tuberculosis
AAGHPGPG

SEQ ID NO: 1362708 - protein, 6 aa, Mycobacterium tuberculosis
AAGVGA

SEQ ID NO: 1362709 - protein, 8 aa, Mycobacterium tuberculosis
AANNDHLK

SEQ ID NO: 1362710 - protein, 5 aa, Mycobacterium tuberculosis
AANPA

SEQ ID NO: 1362711 - protein, 10 aa, Mycobacterium tuberculosis
AAPGHPAASG

SEQ ID NO: 1362712 - protein, 6 aa, Mycobacterium tuberculosis
AAPGWE

SEQ ID NO: 1362713 - protein, 6 aa, Mycobacterium tuberculosis
AAQETL

SEQ ID NO: 1362714 - protein, 10 aa, Mycobacterium tuberculosis
AARARARAAR

SEQ ID NO: 1362715 - protein, 14 aa, Mycobacterium tuberculosis
AARDLRSHPRTGPY

SEQ ID NO: 1362716 - protein, 10 aa, Mycobacterium tuberculosis
AARHPSPNAG

SEQ ID NO: 1362717 - protein, 9 aa, Mycobacterium tuberculosis
AARQQTPNE

SEQ ID NO: 1362718 - protein, 17 aa, Mycobacterium tuberculosis
AASARSEPGEPVGSTRY

SEQ ID NO: 1362719 - protein, 21 aa, Mycobacterium tuberculosis
AASEQPPASVAEDVPPSHDDI

SEQ ID NO: 1362720 - protein, 15 aa, Mycobacterium tuberculosis
AASRTREARRASQEA

SEQ ID NO: 1362721 - protein, 4 aa, Mycobacterium tuberculosis
AATD

SEQ ID NO: 1362722 - protein, 6 aa, Mycobacterium tuberculosis
AATTSA

SEQ ID NO: 1362723 - protein, 4 aa, Mycobacterium tuberculosis
ADAR

SEQ ID NO: 1362724 - protein, 4 aa, Mycobacterium tuberculosis
ADAW

SEQ ID NO: 1362725 - protein, 9 aa, Mycobacterium tuberculosis
ADDPDAAKA

SEQ ID NO: 1362726 - protein, 8 aa, Mycobacterium tuberculosis
ADETGGPV

SEQ ID NO: 1362727 - protein, 5 aa, Mycobacterium tuberculosis
ADGAD

SEQ ID NO: 1362728 - protein, 10 aa, Mycobacterium tuberculosis
ADGEPASDWR

SEQ ID NO: 1362729 - protein, 15 aa, Mycobacterium tuberculosis
ADGGRDPQYHHDGPD

SEQ ID NO: 1362730 - protein, 15 aa, Mycobacterium tuberculosis
ADGKTCRFNPWPYPI

SEQ ID NO: 1362731 - protein, 9 aa, Mycobacterium tuberculosis
ADGNDNTQA

SEQ ID NO: 1362732 - protein, 8 aa, Mycobacterium tuberculosis
ADGRTAAD

SEQ ID NO: 1362733 - protein, 20 aa, Mycobacterium tuberculosis
ADQSSGGVDASEVTAAAGEE

SEQ ID NO: 1362734 - protein, 11 aa, Mycobacterium tuberculosis
ADRELASQTEA

SEQ ID NO: 1362735 - protein, 5 aa, Mycobacterium tuberculosis
ADRST

SEQ ID NO: 1362736 - protein, 10 aa, Mycobacterium tuberculosis
ADSGNSVTQT

SEQ ID NO: 1362737 - protein, 11 aa, Mycobacterium tuberculosis
ADSSRNVKGDS

SEQ ID NO: 1362738 - protein, 4 aa, Mycobacterium tuberculosis
ADTP

SEQ ID NO: 1362739 - protein, 6 aa, Mycobacterium tuberculosis
ADVPTQ

SEQ ID NO: 1362740 - protein, 37 aa, Mycobacterium tuberculosis; identical to SEQ ID NO: 149512

SEQ ID NO: 1362741 - protein, 10 aa, Mycobacterium tuberculosis
AEAPDPQRAV

SEQ ID NO: 1362742 - protein, 11 aa, Mycobacterium tuberculosis
AEGRGKAQAAA

SEQ ID NO: 1362743 - protein, 5 aa, Mycobacterium tuberculosis
AEHTD

SEQ ID NO: 1362744 - protein, 6 aa, Mycobacterium tuberculosis
AEPGGV

SEQ ID NO: 1362745 - protein, 5 aa, Mycobacterium tuberculosis
AERRL

SEQ ID NO: 1362746 - protein, 5 aa, Mycobacterium tuberculosis
AESNN

SEQ ID NO: 1362747 - protein, 12 aa, Mycobacterium tuberculosis
AEYGATDAQLQS

SEQ ID NO: 1362748 - protein, 10 aa, Mycobacterium tuberculosis
AGAAGTAAAL

SEQ ID NO: 1362749 - protein, 6 aa, Mycobacterium tuberculosis
AGADRA

SEQ ID NO: 1362750 - protein, 6 aa, Mycobacterium tuberculosis
AGDREP

SEQ ID NO: 1362751 - protein, 9 aa, Mycobacterium tuberculosis
AGETAEPAK

SEQ ID NO: 1362752 - protein, 7 aa, Mycobacterium tuberculosis
AGFGGGN

SEQ ID NO: 1362753 - protein, 11 aa, Mycobacterium tuberculosis
AGFSASEQDRV

SEQ ID NO: 1362754 - protein, 22 aa, Mycobacterium tuberculosis
AGGAAGPLGAKKGGQYPIGGDG

SEQ ID NO: 1362755 - protein, 12 aa, Mycobacterium tuberculosis
AGGASAPEHSQT

SEQ ID NO: 1362756 - protein, 5 aa, Mycobacterium tuberculosis
AGGCA

SEQ ID NO: 1362757 - protein, 8 aa, Mycobacterium tuberculosis
AGGGVDPR

SEQ ID NO: 1362758 - protein, 9 aa, Mycobacterium tuberculosis
AGGSGKTTA

SEQ ID NO: 1362759 - protein, 16 aa, Mycobacterium tuberculosis
AGKELSGLSSRDYPGA

SEQ ID NO: 1362760 - protein, 13 aa, Mycobacterium tuberculosis
AGNQGESLANESV

SEQ ID NO: 1362761 - protein, 13 aa, Mycobacterium tuberculosis
AGNQGTPLANESV

SEQ ID NO: 1362762 - protein, 9 aa, Mycobacterium tuberculosis
AGNTVDGTS

SEQ ID NO: 1362763 - protein, 9 aa, Mycobacterium tuberculosis
AGPAPPGLS

SEQ ID NO: 1362764 - protein, 5 aa, Mycobacterium tuberculosis
AGPGL

SEQ ID NO: 1362765 - protein, 4 aa, Mycobacterium tuberculosis
AGQG

SEQ ID NO: 1362766 - protein, 4 aa, Mycobacterium tuberculosis
AGQT

SEQ ID NO: 1362767 - protein, 11 aa, Mycobacterium tuberculosis
AGREPPPGLSA

SEQ ID NO: 1362768 - protein, 6 aa, Mycobacterium tuberculosis
AGRPVQ

SEQ ID NO: 1362769 - protein, 13 aa, Mycobacterium tuberculosis
AGSAASWSRTRST

SEQ ID NO: 1362770 - protein, 11 aa, Mycobacterium tuberculosis
AGSATTANGVA

SEQ ID NO: 1362771 - protein, 12 aa, Mycobacterium tuberculosis
AGSGTSERDREE

SEQ ID NO: 1362772 - protein, 7 aa, Mycobacterium tuberculosis
AGSKTQT

SEQ ID NO: 1362773 - protein, 7 aa, Mycobacterium tuberculosis
AGSNNQT

SEQ ID NO: 1362774 - protein, 4 aa, Mycobacterium tuberculosis
AGVA

SEQ ID NO: 1362775 - protein, 7 aa, Mycobacterium tuberculosis
AGWRPGP

SEQ ID NO: 1362776 - protein, 9 aa, Mycobacterium tuberculosis
AGYGAPAGV

SEQ ID NO: 1362777 - protein, 13 aa, Mycobacterium tuberculosis
AHAEPEPKSPPIP

SEQ ID NO: 1362778 - protein, 6 aa, Mycobacterium tuberculosis
AHERTD

SEQ ID NO: 1362779 - protein, 7 aa, Mycobacterium tuberculosis
AHPGDAK

SEQ ID NO: 1362780 - protein, 9 aa, Mycobacterium tuberculosis
AIEGNAAVP

SEQ ID NO: 1362781 - protein, 4 aa, Mycobacterium tuberculosis
AIGT

SEQ ID NO: 1362782 - protein, 6 aa, Mycobacterium tuberculosis
AIPPNA

SEQ ID NO: 1362783 - protein, 10 aa, Mycobacterium tuberculosis
AKGGNPQSCG

SEQ ID NO: 1362784 - protein, 8 aa, Mycobacterium tuberculosis
AKQPKDRY

SEQ ID NO: 1362785 - protein, 7 aa, Mycobacterium tuberculosis
AKTSSVD

SEQ ID NO: 1362786 - protein, 10 aa, Mycobacterium tuberculosis
ALSDSVAASE

SEQ ID NO: 1362787 - protein, 8 aa, Mycobacterium tuberculosis
ALSPNDRA

SEQ ID NO: 1362788 - protein, 8 aa, Mycobacterium tuberculosis
AMGQSRTQ

SEQ ID NO: 1362789 - protein, 5 aa, Mycobacterium tuberculosis
ANAAP

SEQ ID NO: 1362790 - protein, 7 aa, Mycobacterium tuberculosis
ANGSGKT

SEQ ID NO: 1362791 - protein, 14 aa, Mycobacterium tuberculosis
ANNRAGNPVGSSYL

SEQ ID NO: 1362792 - protein, 7 aa, Mycobacterium tuberculosis
ANPSYTR

SEQ ID NO: 1362793 - protein, 10 aa, Mycobacterium tuberculosis
ANVAAGARTR

SEQ ID NO: 1362794 - protein, 5 aa, Mycobacterium tuberculosis
APAGA

SEQ ID NO: 1362795 - protein, 10 aa, Mycobacterium tuberculosis
APAPAGTSAS

SEQ ID NO: 1362796 - protein, 12 aa, Mycobacterium tuberculosis
APEATGHGTDEA

SEQ ID NO: 1362797 - protein, 8 aa, Mycobacterium tuberculosis
APEEGQMS

SEQ ID NO: 1362798 - protein, 8 aa, Mycobacterium tuberculosis
APFKSATK

SEQ ID NO: 1362799 - protein, 17 aa, Mycobacterium tuberculosis
APGASSAPPPAPGRPSA

SEQ ID NO: 1362800 - protein, 8 aa, Mycobacterium tuberculosis
APGFDAKE

SEQ ID NO: 1362801 - protein, 4 aa, Mycobacterium tuberculosis
APGH

SEQ ID NO: 1362802 - protein, 12 aa, Mycobacterium tuberculosis
APGSAPAPGDVS

SEQ ID NO: 1362803 - protein, 5 aa, Mycobacterium tuberculosis
APIDH

SEQ ID NO: 1362804 - protein, 4 aa, Mycobacterium tuberculosis
APMP

SEQ ID NO: 1362805 - protein, 19 aa, Mycobacterium tuberculosis
APRPGGAMAPASTSSTGGH

SEQ ID NO: 1362806 - protein, 11 aa, Mycobacterium tuberculosis
APTPAVPSTAP

SEQ ID NO: 1362807 - protein, 4 aa, Mycobacterium tuberculosis
APYP

SEQ ID NO: 1362808 - protein, 14 aa, Mycobacterium tuberculosis
AQAAASTIRSADRD

SEQ ID NO: 1362809 - protein, 16 aa, Mycobacterium tuberculosis
AQAAKREQAPLPPGAP

SEQ ID NO: 1362810 - protein, 8 aa, Mycobacterium tuberculosis
AQAANGAP

SEQ ID NO: 1362811 - protein, 9 aa, Mycobacterium tuberculosis
AQADPPGTV

SEQ ID NO: 1362812 - protein, 12 aa, Mycobacterium tuberculosis
AQAQKADAQRLA

SEQ ID NO: 1362813 - protein, 14 aa, Mycobacterium tuberculosis
AQASLAAAASGAPL

SEQ ID NO: 1362814 - protein, 5 aa, Mycobacterium tuberculosis
AQHSR

SEQ ID NO: 1362815 - protein, 6 aa, Mycobacterium tuberculosis
AQIPSR

SEQ ID NO: 1362816 - protein, 6 aa, Mycobacterium tuberculosis
AQPPLG

SEQ ID NO: 1362817 - protein, 9 aa, Mycobacterium tuberculosis
AQQARADET

SEQ ID NO: 1362818 - protein, 18 aa, Mycobacterium tuberculosis
ARASTQPHNGEGHAHATD

SEQ ID NO: 1362819 - protein, 17 aa, Mycobacterium tuberculosis
ARATPAGRATGATIDAS

SEQ ID NO: 1362820 - protein, 10 aa, Mycobacterium tuberculosis
ARDFATSGLE

SEQ ID NO: 1362821 - protein, 4 aa, Mycobacterium tuberculosis
AREP

SEQ ID NO: 1362822 - protein, 6 aa, Mycobacterium tuberculosis
ARPAET

SEQ ID NO: 1362823 - protein, 8 aa, Mycobacterium tuberculosis
ARPEAGGK

SEQ ID NO: 1362824 - protein, 4 aa, Mycobacterium tuberculosis
ARPG

SEQ ID NO: 1362825 - protein, 8 aa, Mycobacterium tuberculosis
ARRRGREY

SEQ ID NO: 1362826 - protein, 7 aa, Mycobacterium tuberculosis
ARSGKTT

SEQ ID NO: 1362827 - protein, 17 aa, Mycobacterium tuberculosis
ARSPDMAEAAAGTGRDV

SEQ ID NO: 1362828 - protein, 8 aa, Mycobacterium tuberculosis
ARSQNALG

SEQ ID NO: 1362829 - protein, 14 aa, Mycobacterium tuberculosis
ARTPDGSAPSREAL

SEQ ID NO: 1362830 - protein, 20 aa, Mycobacterium tuberculosis
ASADAAGAAAQHEAAAAAYT

SEQ ID NO: 1362831 - protein, 5 aa, Mycobacterium tuberculosis
ASAGA

SEQ ID NO: 1362832 - protein, 9 aa, Mycobacterium tuberculosis
ASAQTSARR

SEQ ID NO: 1362833 - protein, 5 aa, Mycobacterium tuberculosis
ASDGY

SEQ ID NO: 1362834 - protein, 5 aa, Mycobacterium tuberculosis
ASEGY

SEQ ID NO: 1362835 - protein, 16 aa, Mycobacterium tuberculosis
ASGAALASAPRTVPAP

SEQ ID NO: 1362836 - protein, 8 aa, Mycobacterium tuberculosis
ASGESKSR

SEQ ID NO: 1362837 - protein, 4 aa, Mycobacterium tuberculosis
ASGS

SEQ ID NO: 1362838 - protein, 7 aa, Mycobacterium tuberculosis
ASKDNKA

SEQ ID NO: 1362839 - protein, 4 aa, Mycobacterium tuberculosis
ASLA

SEQ ID NO: 1362840 - protein, 5 aa, Mycobacterium tuberculosis
ASLAE

SEQ ID NO: 1362841 - protein, 6 aa, Mycobacterium tuberculosis
ASLPST

SEQ ID NO: 1362842 - protein, 9 aa, Mycobacterium tuberculosis
ASPDPGPVN

SEQ ID NO: 1362843 - protein, 6 aa, Mycobacterium tuberculosis
ASPSVS

SEQ ID NO: 1362844 - protein, 12 aa, Mycobacterium tuberculosis
ASRDTRQGVGAG

SEQ ID NO: 1362845 - protein, 16 aa, Mycobacterium tuberculosis
ASTTAAGPISQNAYGA

SEQ ID NO: 1362846 - protein, 4 aa, Mycobacterium tuberculosis
ASVA

SEQ ID NO: 1362847 - protein, 4 aa, Mycobacterium tuberculosis
ASWG

SEQ ID NO: 1362848 - protein, 10 aa, Mycobacterium tuberculosis
ATADQDRATD

SEQ ID NO: 1362849 - protein, 8 aa, Mycobacterium tuberculosis
ATAPADRF

SEQ ID NO: 1362850 - protein, 5 aa, Mycobacterium tuberculosis
ATAQR

SEQ ID NO: 1362851 - protein, 8 aa, Mycobacterium tuberculosis
ATELTGGN

SEQ ID NO: 1362852 - protein, 8 aa, Mycobacterium tuberculosis
ATGSTGTT

SEQ ID NO: 1362853 - protein, 12 aa, Mycobacterium tuberculosis
ATPEATSEETPT

SEQ ID NO: 1362854 - protein, 8 aa, Mycobacterium tuberculosis
ATTDTPPV

SEQ ID NO: 1362855 - protein, 7 aa, Mycobacterium tuberculosis
ATTPVGG

SEQ ID NO: 1362856 - protein, 7 aa, Mycobacterium tuberculosis
ATTRRDA

SEQ ID NO: 1362857 - protein, 8 aa, Mycobacterium tuberculosis
ATVAETNN

SEQ ID NO: 1362858 - protein, 17 aa, Mycobacterium tuberculosis
AVAANRKDFDPDELESD

SEQ ID NO: 1362859 - protein, 7 aa, Mycobacterium tuberculosis
AVDGSAA

SEQ ID NO: 1362860 - protein, 12 aa, Mycobacterium tuberculosis
AVGASRTAEGPH

SEQ ID NO: 1362861 - protein, 5 aa, Mycobacterium tuberculosis
AVGEG

SEQ ID NO: 1362862 - protein, 8 aa, Mycobacterium tuberculosis
AVKPSYGL

SEQ ID NO: 1362863 - protein, 11 aa, Mycobacterium tuberculosis
AVNNGTLPYGN

SEQ ID NO: 1362864 - protein, 8 aa, Mycobacterium tuberculosis
AVRTSTNE

SEQ ID NO: 1362865 - protein, 10 aa, Mycobacterium tuberculosis
AVSATGPAAP

SEQ ID NO: 1362866 - protein, 4 aa, Mycobacterium tuberculosis
AVSG

SEQ ID NO: 1362867 - protein, 11 aa, Mycobacterium tuberculosis
AVTPTRTDRPA

SEQ ID NO: 1362868 - protein, 4 aa, Mycobacterium tuberculosis
AYAP

SEQ ID NO: 1362869 - protein, 10 aa, Mycobacterium tuberculosis
CDESLPSPRV

SEQ ID NO: 1362870 - protein, 8 aa, Mycobacterium tuberculosis
DAANNDDS

SEQ ID NO: 1362871 - protein, 10 aa, Mycobacterium tuberculosis
DAASPETQAA

SEQ ID NO: 1362872 - protein, 9 aa, Mycobacterium tuberculosis
DADESSPPV

SEQ ID NO: 1362873 - protein, 8 aa, Mycobacterium tuberculosis
DADKPSMA

SEQ ID NO: 1362874 - protein, 5 aa, Mycobacterium tuberculosis
DAETE

SEQ ID NO: 1362875 - protein, 28 aa, Mycobacterium tuberculosis
DAKPGVKLPQPSSTTTPDLTPRAALTPE

SEQ ID NO: 1362876 - protein, 8 aa, Mycobacterium tuberculosis
DANGQPLS

SEQ ID NO: 1362877 - protein, 7 aa, Mycobacterium tuberculosis
DAPNAVA

SEQ ID NO: 1362878 - protein, 6 aa, Mycobacterium tuberculosis
DARAQQ

SEQ ID NO: 1362879 - protein, 15 aa, Mycobacterium tuberculosis
DARPSSGSRSAAHGH

SEQ ID NO: 1362880 - protein, 8 aa, Mycobacterium tuberculosis
DASQPSMA

SEQ ID NO: 1362881 - protein, 9 aa, Mycobacterium tuberculosis
DAYAPHESF

SEQ ID NO: 1362882 - protein, 26 aa, Mycobacterium tuberculosis
DDADRETDARTPAPAARHASRSQGRG

SEQ ID NO: 1362883 - protein, 19 aa, Mycobacterium tuberculosis
DDIEGGEDEDEEGVRTPKV

SEQ ID NO: 1362884 - protein, 6 aa, Mycobacterium tuberculosis
DDPGNI

SEQ ID NO: 1362885 - protein, 8 aa, Mycobacterium tuberculosis
DDRKQTAA

SEQ ID NO: 1362886 - protein, 8 aa, Mycobacterium tuberculosis
DDSSDDCA

SEQ ID NO: 1362887 - protein, 7 aa, Mycobacterium tuberculosis
DDVPDEV

SEQ ID NO: 1362888 - protein, 4 aa, Mycobacterium tuberculosis
DEGV

SEQ ID NO: 1362889 - protein, 15 aa, Mycobacterium tuberculosis
DELTAAPDSDDLGEG

SEQ ID NO: 1362890 - protein, 4 aa, Mycobacterium tuberculosis
DEMA

SEQ ID NO: 1362891 - protein, 7 aa, Mycobacterium tuberculosis
DEMSSDH

SEQ ID NO: 1362892 - protein, 12 aa, Mycobacterium tuberculosis
DEPPTGTAPNQV

SEQ ID NO: 1362893 - protein, 22 aa, Mycobacterium tuberculosis
DESDVDGYQSRSGPGAASSENR

SEQ ID NO: 1362894 - protein, 6 aa, Mycobacterium tuberculosis
DESPHG

SEQ ID NO: 1362895 - protein, 14 aa, Mycobacterium tuberculosis
DEYDQAETAPVEDL

SEQ ID NO: 1362896 - protein, 6 aa, Mycobacterium tuberculosis
DEYRGQ

SEQ ID NO: 1362897 - protein, 12 aa, Mycobacterium tuberculosis
DGDAQSAGRRAR

SEQ ID NO: 1362898 - protein, 9 aa, Mycobacterium tuberculosis
DGDYSGAAV

SEQ ID NO: 1362899 - protein, 5 aa, Mycobacterium tuberculosis
DGHDH

SEQ ID NO: 1362900 - protein, 4 aa, Mycobacterium tuberculosis
DGHR

SEQ ID NO: 1362901 - protein, 5 aa, Mycobacterium tuberculosis
DGKPV

SEQ ID NO: 1362902 - protein, 21 aa, Mycobacterium tuberculosis
DGPGYAGSSPTLGPTKTSSIT

SEQ ID NO: 1362903 - protein, 4 aa, Mycobacterium tuberculosis
DGPS

SEQ ID NO: 1362904 - protein, 7 aa, Mycobacterium tuberculosis
DGQDPDM

SEQ ID NO: 1362905 - protein, 4 aa, Mycobacterium tuberculosis
DGRS

SEQ ID NO: 1362906 - protein, 9 aa, Mycobacterium tuberculosis
DGSNDAAAI

SEQ ID NO: 1362907 - protein, 13 aa, Mycobacterium tuberculosis
DHAPGEPHPQPSR

SEQ ID NO: 1362908 - protein, 7 aa, Mycobacterium tuberculosis
DHQASVS

SEQ ID NO: 1362909 - protein, 8 aa, Mycobacterium tuberculosis
DIDKNTAY

SEQ ID NO: 1362910 - protein, 7 aa, Mycobacterium tuberculosis
DIRGTYR

SEQ ID NO: 1362911 - protein, 7 aa, Mycobacterium tuberculosis
DKDIQDA

SEQ ID NO: 1362912 - protein, 8 aa, Mycobacterium tuberculosis
DKPDLQGA

SEQ ID NO: 1362913 - protein, 7 aa, Mycobacterium tuberculosis
DKTAGQA

SEQ ID NO: 1362914 - protein, 5 aa, Mycobacterium tuberculosis
DLRNP

SEQ ID NO: 1362915 - protein, 5 aa, Mycobacterium tuberculosis
DLSGF

SEQ ID NO: 1362916 - protein, 11 aa, Mycobacterium tuberculosis
DNAVEDEGLQP

SEQ ID NO: 1362917 - protein, 6 aa, Mycobacterium tuberculosis
DNPDFQ

SEQ ID NO: 1362918 - protein, 12 aa, Mycobacterium tuberculosis
DNPGPSDPTTKA

SEQ ID NO: 1362919 - protein, 4 aa, Mycobacterium tuberculosis
DNPK

SEQ ID NO: 1362920 - protein, 8 aa, Mycobacterium tuberculosis
DNRAAADA

SEQ ID NO: 1362921 - protein, 9 aa, Mycobacterium tuberculosis
DNTGSPDAW

SEQ ID NO: 1362922 - protein, 9 aa, Mycobacterium tuberculosis
DPAKPLPAS

SEQ ID NO: 1362923 - protein, 6 aa, Mycobacterium tuberculosis
DPDEGF

SEQ ID NO: 1362924 - protein, 7 aa, Mycobacterium tuberculosis
DPGPGVA

SEQ ID NO: 1362925 - protein, 10 aa, Mycobacterium tuberculosis
DPGPRRLPYP

SEQ ID NO: 1362926 - protein, 8 aa, Mycobacterium tuberculosis
DPGSEQRW

SEQ ID NO: 1362927 - protein, 5 aa, Mycobacterium tuberculosis
DPHNG

SEQ ID NO: 1362928 - protein, 15 aa, Mycobacterium tuberculosis
DPPAGSYPNPDERRK

SEQ ID NO: 1362929 - protein, 8 aa, Mycobacterium tuberculosis
DPSGLTAT

SEQ ID NO: 1362930 - protein, 5 aa, Mycobacterium tuberculosis
DPTSG

SEQ ID NO: 1362931 - protein, 12 aa, Mycobacterium tuberculosis
DPTYADPSQSML

SEQ ID NO: 1362932 - protein, 11 aa, Mycobacterium tuberculosis
DPYRVGPASGL

SEQ ID NO: 1362933 - protein, 15 aa, Mycobacterium tuberculosis
DPYTGDEDPQTAQKI

SEQ ID NO: 1362934 - protein, 6 aa, Mycobacterium tuberculosis
DQPDIY

SEQ ID NO: 1362935 - protein, 7 aa, Mycobacterium tuberculosis
DQPLGGD

SEQ ID NO: 1362936 - protein, 9 aa, Mycobacterium tuberculosis
DQQQAGDRS

SEQ ID NO: 1362937 - protein, 9 aa, Mycobacterium tuberculosis
DQRPGAGSL

SEQ ID NO: 1362938 - protein, 6 aa, Mycobacterium tuberculosis
DRAGSA

SEQ ID NO: 1362939 - protein, 17 aa, Mycobacterium tuberculosis
DRATTAYTNTSGVSSES

SEQ ID NO: 1362940 - protein, 14 aa, Mycobacterium tuberculosis
DRESELRPPVRSGF

SEQ ID NO: 1362941 - protein, 7 aa, Mycobacterium tuberculosis
DRESIDD

SEQ ID NO: 1362942 - protein, 6 aa, Mycobacterium tuberculosis
DRGNNR

SEQ ID NO: 1362943 - protein, 15 aa, Mycobacterium tuberculosis
DRHTPEPARLRPAVG

SEQ ID NO: 1362944 - protein, 7 aa, Mycobacterium tuberculosis
DRIGGGR

SEQ ID NO: 1362945 - protein, 9 aa, Mycobacterium tuberculosis
DRPHPTEAD

SEQ ID NO: 1362946 - protein, 21 aa, Mycobacterium tuberculosis
DRRVASREDRHADSDYADDEL

SEQ ID NO: 1362947 - protein, 7 aa, Mycobacterium tuberculosis
DSDPQAG

SEQ ID NO: 1362948 - protein, 6 aa, Mycobacterium tuberculosis
DSDPTK

SEQ ID NO: 1362949 - protein, 4 aa, Mycobacterium tuberculosis
DSGS

SEQ ID NO: 1362950 - protein, 5 aa, Mycobacterium tuberculosis
DSKPL

SEQ ID NO: 1362951 - protein, 15 aa, Mycobacterium tuberculosis
DSNTTATSAPPRTKI

SEQ ID NO: 1362952 - protein, 10 aa, Mycobacterium tuberculosis
DSQGSVNVPT

SEQ ID NO: 1362953 - protein, 10 aa, Mycobacterium tuberculosis
DTASELPDGQ

SEQ ID NO: 1362954 - protein, 13 aa, Mycobacterium tuberculosis
DTDEQEPADPPRK

SEQ ID NO: 1362955 - protein, 10 aa, Mycobacterium tuberculosis
DTGTSFGGMG

SEQ ID NO: 1362956 - protein, 7 aa, Mycobacterium tuberculosis
DTPDGGL

SEQ ID NO: 1362957 - protein, 7 aa, Mycobacterium tuberculosis
DTPKGVQ

SEQ ID NO: 1362958 - protein, 7 aa, Mycobacterium tuberculosis
DTPRAQA

SEQ ID NO: 1362959 - protein, 5 aa, Mycobacterium tuberculosis
DTQPH

SEQ ID NO: 1362960 - protein, 7 aa, Mycobacterium tuberculosis
DTSGPGA

SEQ ID NO: 1362961 - protein, 6 aa, Mycobacterium tuberculosis
DTTHDV

SEQ ID NO: 1362962 - protein, 5 aa, Mycobacterium tuberculosis
DTTHV

SEQ ID NO: 1362963 - protein, 4 aa, Mycobacterium tuberculosis
DYGT

SEQ ID NO: 1362964 - protein, 8 aa, Mycobacterium tuberculosis
DYTGPGKR

SEQ ID NO: 1362965 - protein, 7 aa, Mycobacterium tuberculosis
EAAARPD

SEQ ID NO: 1362966 - protein, 16 aa, Mycobacterium tuberculosis
EAAEPVSRRRSHAGGL

SEQ ID NO: 1362967 - protein, 6 aa, Mycobacterium tuberculosis
EAASEH

SEQ ID NO: 1362968 - protein, 20 aa, Mycobacterium tuberculosis
EADGRETSGEEPAKWQSART

SEQ ID NO: 1362969 - protein, 9 aa, Mycobacterium tuberculosis
EAGHAAEQR

SEQ ID NO: 1362970 - protein, 6 aa, Mycobacterium tuberculosis
EAPPLT

SEQ ID NO: 1362971 - protein, 11 aa, Mycobacterium tuberculosis
EARATGQNREA

SEQ ID NO: 1362972 - protein, 12 aa, Mycobacterium tuberculosis
EARGLGQDRESA

SEQ ID NO: 1362973 - protein, 12 aa, Mycobacterium tuberculosis
EARQAGEDKEAA

SEQ ID NO: 1362974 - protein, 5 aa, Mycobacterium tuberculosis
EATRV

SEQ ID NO: 1362975 - protein, 6 aa, Mycobacterium tuberculosis
EATSAV

SEQ ID NO: 1362976 - protein, 14 aa, Mycobacterium tuberculosis
EATVKDTAAEIAAR

SEQ ID NO: 1362977 - protein, 19 aa, Mycobacterium tuberculosis
EDSRNGIQERIGQKVEAEP

SEQ ID NO: 1362978 - protein, 9 aa, Mycobacterium tuberculosis
EEAGTAKPK

SEQ ID NO: 1362979 - protein, 31 aa, Mycobacterium tuberculosis; identical to SEQ ID NO: 150713

SEQ ID NO: 1362980 - protein, 8 aa, Mycobacterium tuberculosis
EEGDSDSA

SEQ ID NO: 1362981 - protein, 5 aa, Mycobacterium tuberculosis
EERRR

SEQ ID NO: 1362982 - protein, 4 aa, Mycobacterium tuberculosis
EGDA

SEQ ID NO: 1362983 - protein, 10 aa, Mycobacterium tuberculosis
EGDGRDSARA

SEQ ID NO: 1362984 - protein, 10 aa, Mycobacterium tuberculosis
EGDPATPEGI

SEQ ID NO: 1362985 - protein, 6 aa, Mycobacterium tuberculosis
EGDSDS

SEQ ID NO: 1362986 - protein, 4 aa, Mycobacterium tuberculosis
EGED

SEQ ID NO: 1362987 - protein, 5 aa, Mycobacterium tuberculosis
EGMPR

SEQ ID NO: 1362988 - protein, 6 aa, Mycobacterium tuberculosis
EGRAGA

SEQ ID NO: 1362989 - protein, 10 aa, Mycobacterium tuberculosis
EGVARRGQLR

SEQ ID NO: 1362990 - protein, 6 aa, Mycobacterium tuberculosis
EHDRSE

SEQ ID NO: 1362991 - protein, 4 aa, Mycobacterium tuberculosis
EHIP

SEQ ID NO: 1362992 - protein, 5 aa, Mycobacterium tuberculosis
EHPVP

SEQ ID NO: 1362993 - protein, 6 aa, Mycobacterium tuberculosis
EHSTAD

SEQ ID NO: 1362994 - protein, 8 aa, Mycobacterium tuberculosis
EIREGRSF

SEQ ID NO: 1362995 - protein, 8 aa, Mycobacterium tuberculosis
ELGPGDAP

SEQ ID NO: 1362996 - protein, 10 aa, Mycobacterium tuberculosis
ELGTHPRART

SEQ ID NO: 1362997 - protein, 38 aa, Mycobacterium tuberculosis; identical to SEQ ID NO: 150802

SEQ ID NO: 1362998 - protein, 5 aa, Mycobacterium tuberculosis
EMPGG

SEQ ID NO: 1362999 - protein, 4 aa, Mycobacterium tuberculosis
ENGS

SEQ ID NO: 1363000 - protein, 6 aa, Mycobacterium tuberculosis
EPDEIE

SEQ ID NO: 1363001 - protein, 6 aa, Mycobacterium tuberculosis
EPDTNA

SEQ ID NO: 1363002 - protein, 5 aa, Mycobacterium tuberculosis
EPSTD

SEQ ID NO: 1363003 - protein, 13 aa, Mycobacterium tuberculosis
EQETTRRGAAVAP

SEQ ID NO: 1363004 - protein, 15 aa, Mycobacterium tuberculosis
ERADEKTRLGPAETP

SEQ ID NO: 1363005 - protein, 10 aa, Mycobacterium tuberculosis
ERASSTAPAD

SEQ ID NO: 1363006 - protein, 10 aa, Mycobacterium tuberculosis
ERGRKEPSSE

SEQ ID NO: 1363007 - protein, 13 aa, Mycobacterium tuberculosis
ERIPPPTGLARRA

SEQ ID NO: 1363008 - protein, 9 aa, Mycobacterium tuberculosis
ERNNNDGSV

SEQ ID NO: 1363009 - protein, 23 aa, Mycobacterium tuberculosis
ERPALEPRRQPAERSAPRGFADH

SEQ ID NO: 1363010 - protein, 14 aa, Mycobacterium tuberculosis
ERPGTLAPPPSTFG

SEQ ID NO: 1363011 - protein, 37 aa, Mycobacterium tuberculosis; identical to SEQ ID NO: 150875

SEQ ID NO: 1363012 - protein, 11 aa, Mycobacterium tuberculosis
ERRKTQRELSQ

SEQ ID NO: 1363013 - protein, 17 aa, Mycobacterium tuberculosis
ERSGEVNAKPGTKSGDR

SEQ ID NO: 1363014 - protein, 4 aa, Mycobacterium tuberculosis
ERSK

SEQ ID NO: 1363015 - protein, 9 aa, Mycobacterium tuberculosis
ESFEPQYES

SEQ ID NO: 1363016 - protein, 9 aa, Mycobacterium tuberculosis
ESGDTPHVA

SEQ ID NO: 1363017 - protein, 8 aa, Mycobacterium tuberculosis
ESGKEHKG

SEQ ID NO: 1363018 - protein, 6 aa, Mycobacterium tuberculosis
ESGSPT

SEQ ID NO: 1363019 - protein, 7 aa, Mycobacterium tuberculosis
ESITDPN

SEQ ID NO: 1363020 - protein, 15 aa, Mycobacterium tuberculosis
ESPSPTPGRRTVTAR

SEQ ID NO: 1363021 - protein, 11 aa, Mycobacterium tuberculosis
ETDSNGTPQLR

SEQ ID NO: 1363022 - protein, 6 aa, Mycobacterium tuberculosis
ETRSPT

SEQ ID NO: 1363023 - protein, 15 aa, Mycobacterium tuberculosis
EVATSDTDRAQRTPW

SEQ ID NO: 1363024 - protein, 7 aa, Mycobacterium tuberculosis
EVSDREG

SEQ ID NO: 1363025 - protein, 5 aa, Mycobacterium tuberculosis
EYAEE

SEQ ID NO: 1363026 - protein, 9 aa, Mycobacterium tuberculosis
EYAPASKRG

SEQ ID NO: 1363027 - protein, 15 aa, Mycobacterium tuberculosis
EYPTDQYSANDPKLN

SEQ ID NO: 1363028 - protein, 14 aa, Mycobacterium tuberculosis
FEDDTQGGAVNGED

SEQ ID NO: 1363029 - protein, 6 aa, Mycobacterium tuberculosis
FENPDF

SEQ ID NO: 1363030 - protein, 10 aa, Mycobacterium tuberculosis
FGESGTDPDF

SEQ ID NO: 1363031 - protein, 6 aa, Mycobacterium tuberculosis
FSGPQI

SEQ ID NO: 1363032 - protein, 12 aa, Mycobacterium tuberculosis
FSTSNDDAAKFD

SEQ ID NO: 1363033 - protein, 8 aa, Mycobacterium tuberculosis
FTNPDAAV

SEQ ID NO: 1363034 - protein, 15 aa, Mycobacterium tuberculosis
FTSGSQNMTGRWAAP

SEQ ID NO: 1363035 - protein, 9 aa, Mycobacterium tuberculosis
GAAPTTGYT

SEQ ID NO: 1363036 - protein, 9 aa, Mycobacterium tuberculosis
GAATAGGGA

SEQ ID NO: 1363037 - protein, 21 aa, Mycobacterium tuberculosis
GADGLQTPSPGAVSGSLEGGA

SEQ ID NO: 1363038 - protein, 6 aa, Mycobacterium tuberculosis
GAETEL

SEQ ID NO: 1363039 - protein, 9 aa, Mycobacterium tuberculosis
GAGDAGHAK

SEQ ID NO: 1363040 - protein, 6 aa, Mycobacterium tuberculosis
GATGSF

SEQ ID NO: 1363041 - protein, 12 aa, Mycobacterium tuberculosis
GATPPAAPAAPA

SEQ ID NO: 1363042 - protein, 8 aa, Mycobacterium tuberculosis
GATTAAAA

SEQ ID NO: 1363043 - protein, 7 aa, Mycobacterium tuberculosis
GATVSSR

SEQ ID NO: 1363044 - protein, 11 aa, Mycobacterium tuberculosis
GDEAKKPGDRV

SEQ ID NO: 1363045 - protein, 6 aa, Mycobacterium tuberculosis
GDEEVR

SEQ ID NO: 1363046 - protein, 5 aa, Mycobacterium tuberculosis
GDGLA

SEQ ID NO: 1363047 - protein, 11 aa, Mycobacterium tuberculosis
GDGRRTARPTR

SEQ ID NO: 1363048 - protein, 11 aa, Mycobacterium tuberculosis
GDGVNDAPALR

SEQ ID NO: 1363049 - protein, 10 aa, Mycobacterium tuberculosis
GDLDEDSWQD

SEQ ID NO: 1363050 - protein, 4 aa, Mycobacterium tuberculosis
GDLR

SEQ ID NO: 1363051 - protein, 46 aa, Mycobacterium tuberculosis; identical to SEQ ID NO: 151117

SEQ ID NO: 1363052 - protein, 9 aa, Mycobacterium tuberculosis
GDNPESAAA

SEQ ID NO: 1363053 - protein, 13 aa, Mycobacterium tuberculosis
GDPKGDGTGGPGY

SEQ ID NO: 1363054 - protein, 6 aa, Mycobacterium tuberculosis
GDPSDS

SEQ ID NO: 1363055 - protein, 10 aa, Mycobacterium tuberculosis
GDQPPREGSG

SEQ ID NO: 1363056 - protein, 5 aa, Mycobacterium tuberculosis
GDRSA

SEQ ID NO: 1363057 - protein, 8 aa, Mycobacterium tuberculosis
GDSTTAVG

SEQ ID NO: 1363058 - protein, 12 aa, Mycobacterium tuberculosis
GDTGLDSGRPQS

SEQ ID NO: 1363059 - protein, 6 aa, Mycobacterium tuberculosis
GDTPAR

SEQ ID NO: 1363060 - protein, 7 aa, Mycobacterium tuberculosis
GDVTETI

SEQ ID NO: 1363061 - protein, 5 aa, Mycobacterium tuberculosis
GEAIR

SEQ ID NO: 1363062 - protein, 10 aa, Mycobacterium tuberculosis
GEAQAPRKDP

SEQ ID NO: 1363063 - protein, 5 aa, Mycobacterium tuberculosis
GEDPL

SEQ ID NO: 1363064 - protein, 5 aa, Mycobacterium tuberculosis
GEIDD

SEQ ID NO: 1363065 - protein, 16 aa, Mycobacterium tuberculosis
GELDSGTSTPATNYGS

SEQ ID NO: 1363066 - protein, 12 aa, Mycobacterium tuberculosis
GEPWPQPVPEPA

SEQ ID NO: 1363067 - protein, 16 aa, Mycobacterium tuberculosis
GERAKREKRDSSGSFG

SEQ ID NO: 1363068 - protein, 4 aa, Mycobacterium tuberculosis
GERK

SEQ ID NO: 1363069 - protein, 4 aa, Mycobacterium tuberculosis
GGAA

SEQ ID NO: 1363070 - protein, 13 aa, Mycobacterium tuberculosis
GGAGDPDDTRVSQ

SEQ ID NO: 1363071 - protein, 8 aa, Mycobacterium tuberculosis
GGAGGPAL

SEQ ID NO: 1363072 - protein, 10 aa, Mycobacterium tuberculosis
GGAPNPYTYP

SEQ ID NO: 1363073 - protein, 9 aa, Mycobacterium tuberculosis
GGCNSAGGR

SEQ ID NO: 1363074 - protein, 8 aa, Mycobacterium tuberculosis
GGDGLSDC

SEQ ID NO: 1363075 - protein, 9 aa, Mycobacterium tuberculosis
GGELDPPKL

SEQ ID NO: 1363076 - protein, 7 aa, Mycobacterium tuberculosis
GGFSGGT

SEQ ID NO: 1363077 - protein, 10 aa, Mycobacterium tuberculosis
GGLRDPRNVS

SEQ ID NO: 1363078 - protein, 4 aa, Mycobacterium tuberculosis
GGMD

SEQ ID NO: 1363079 - protein, 8 aa, Mycobacterium tuberculosis
GGNAEDAL

SEQ ID NO: 1363080 - protein, 6 aa, Mycobacterium tuberculosis
GGPGFC

SEQ ID NO: 1363081 - protein, 15 aa, Mycobacterium tuberculosis
GGPGNTGPDFGKASP

SEQ ID NO: 1363082 - protein, 10 aa, Mycobacterium tuberculosis
GGPKSGKSTA

SEQ ID NO: 1363083 - protein, 4 aa, Mycobacterium tuberculosis
GGPL

SEQ ID NO: 1363084 - protein, 12 aa, Mycobacterium tuberculosis
GGQTSGASSARL

SEQ ID NO: 1363085 - protein, 9 aa, Mycobacterium tuberculosis
GGSNNTGSV

SEQ ID NO: 1363086 - protein, 7 aa, Mycobacterium tuberculosis
GGSPRGA

SEQ ID NO: 1363087 - protein, 4 aa, Mycobacterium tuberculosis
GGTR

SEQ ID NO: 1363088 - protein, 11 aa, Mycobacterium tuberculosis
GGTSLARTGRQ

SEQ ID NO: 1363089 - protein, 7 aa, Mycobacterium tuberculosis
GGVPSAY

SEQ ID NO: 1363090 - protein, 5 aa, Mycobacterium tuberculosis
GHGKL

SEQ ID NO: 1363091 - protein, 5 aa, Mycobacterium tuberculosis
GHPPG

SEQ ID NO: 1363092 - protein, 9 aa, Mycobacterium tuberculosis
GIASPESYS

SEQ ID NO: 1363093 - protein, 8 aa, Mycobacterium tuberculosis
GINDGPAL

SEQ ID NO: 1363094 - protein, 9 aa, Mycobacterium tuberculosis
GINDGPALA

SEQ ID NO: 1363095 - protein, 4 aa, Mycobacterium tuberculosis
GISA

SEQ ID NO: 1363096 - protein, 6 aa, Mycobacterium tuberculosis
GKAQAI

SEQ ID NO: 1363097 - protein, 9 aa, Mycobacterium tuberculosis
GKEEESAQT

SEQ ID NO: 1363098 - protein, 5 aa, Mycobacterium tuberculosis
GKFGP

SEQ ID NO: 1363099 - protein, 4 aa, Mycobacterium tuberculosis
GKGS

SEQ ID NO: 1363100 - protein, 5 aa, Mycobacterium tuberculosis
GKGTF

SEQ ID NO: 1363101 - protein, 5 aa, Mycobacterium tuberculosis
GKYTG

SEQ ID NO: 1363102 - protein, 36 aa, Mycobacterium tuberculosis; identical to SEQ ID NO: 151314

SEQ ID NO: 1363103 - protein, 4 aa, Mycobacterium tuberculosis
GLAT

SEQ ID NO: 1363104 - protein, 7 aa, Mycobacterium tuberculosis
GLGPPIG

SEQ ID NO: 1363105 - protein, 6 aa, Mycobacterium tuberculosis
GLQTGS

SEQ ID NO: 1363106 - protein, 8 aa, Mycobacterium tuberculosis
GMAGARAS

SEQ ID NO: 1363107 - protein, 4 aa, Mycobacterium tuberculosis
GNAG

SEQ ID NO: 1363108 - protein, 17 aa, Mycobacterium tuberculosis
GNDVANSFGTSVGAGTL

SEQ ID NO: 1363109 - protein, 7 aa, Mycobacterium tuberculosis
GNGPRTD

SEQ ID NO: 1363110 - protein, 7 aa, Mycobacterium tuberculosis
GNRETPA

SEQ ID NO: 1363111 - protein, 10 aa, Mycobacterium tuberculosis
GPAEDSSAQV

SEQ ID NO: 1363112 - protein, 5 aa, Mycobacterium tuberculosis
GPAIG

SEQ ID NO: 1363113 - protein, 5 aa, Mycobacterium tuberculosis
GPANA

SEQ ID NO: 1363114 - protein, 5 aa, Mycobacterium tuberculosis
GPATG

SEQ ID NO: 1363115 - protein, 6 aa, Mycobacterium tuberculosis
GPEANS

SEQ ID NO: 1363116 - protein, 6 aa, Mycobacterium tuberculosis
GPGRYG

SEQ ID NO: 1363117 - protein, 27 aa, Mycobacterium tuberculosis
GPKGTDGQPSKQAISDSAVSETWGGQI

SEQ ID NO: 1363118 - protein, 7 aa, Mycobacterium tuberculosis
GPLAPPR

SEQ ID NO: 1363119 - protein, 19 aa, Mycobacterium tuberculosis
GPNAEHPGAPLRGERSGYD

SEQ ID NO: 1363120 - protein, 6 aa, Mycobacterium tuberculosis
GPPGLR

SEQ ID NO: 1363121 - protein, 5 aa, Mycobacterium tuberculosis
GPVDS

SEQ ID NO: 1363122 - protein, 8 aa, Mycobacterium tuberculosis
GQASSTHM

SEQ ID NO: 1363123 - protein, 7 aa, Mycobacterium tuberculosis
GQEERET

SEQ ID NO: 1363124 - protein, 6 aa, Mycobacterium tuberculosis
GQGSAN

SEQ ID NO: 1363125 - protein, 5 aa, Mycobacterium tuberculosis
GRAGN

SEQ ID NO: 1363126 - protein, 6 aa, Mycobacterium tuberculosis
GRATGS

SEQ ID NO: 1363127 - protein, 5 aa, Mycobacterium tuberculosis
GRDVG

SEQ ID NO: 1363128 - protein, 5 aa, Mycobacterium tuberculosis
GRGEC

SEQ ID NO: 1363129 - protein, 10 aa, Mycobacterium tuberculosis
GRGGTEVAKD

SEQ ID NO: 1363130 - protein, 13 aa, Mycobacterium tuberculosis
GRIPGTAAGPSRR

SEQ ID NO: 1363131 - protein, 15 aa, Mycobacterium tuberculosis
GRIPSDKPPIKTPGE

SEQ ID NO: 1363132 - protein, 8 aa, Mycobacterium tuberculosis
GRKVQGSA

SEQ ID NO: 1363133 - protein, 9 aa, Mycobacterium tuberculosis
GRPDLPEGR

SEQ ID NO: 1363134 - protein, 20 aa, Mycobacterium tuberculosis
GRPGDDAGRPAARAGAGCSH

SEQ ID NO: 1363135 - protein, 6 aa, Mycobacterium tuberculosis
GRTGGH

SEQ ID NO: 1363136 - protein, 23 aa, Mycobacterium tuberculosis
GSDAGDHASAPQPSGSGSVPASV

SEQ ID NO: 1363137 - protein, 7 aa, Mycobacterium tuberculosis
GSDPARV

SEQ ID NO: 1363138 - protein, 4 aa, Mycobacterium tuberculosis
GSEP

SEQ ID NO: 1363139 - protein, 7 aa, Mycobacterium tuberculosis
GSEPAAT

SEQ ID NO: 1363140 - protein, 5 aa, Mycobacterium tuberculosis
GSGGM

SEQ ID NO: 1363141 - protein, 7 aa, Mycobacterium tuberculosis
GSGKSQT

SEQ ID NO: 1363142 - protein, 6 aa, Mycobacterium tuberculosis
GSGPLT

SEQ ID NO: 1363143 - protein, 8 aa, Mycobacterium tuberculosis
GSGPPVPL

SEQ ID NO: 1363144 - protein, 5 aa, Mycobacterium tuberculosis
GSGVV

SEQ ID NO: 1363145 - protein, 5 aa, Mycobacterium tuberculosis
GSHNG

SEQ ID NO: 1363146 - protein, 9 aa, Mycobacterium tuberculosis
GSIEERAQQ

SEQ ID NO: 1363147 - protein, 6 aa, Mycobacterium tuberculosis
GSNDIA

SEQ ID NO: 1363148 - protein, 18 aa, Mycobacterium tuberculosis
GSPDAPHDHHDRHDDHLG

SEQ ID NO: 1363149 - protein, 8 aa, Mycobacterium tuberculosis
GSPPYQGD

SEQ ID NO: 1363150 - protein, 4 aa, Mycobacterium tuberculosis
GSQA

SEQ ID NO: 1363151 - protein, 10 aa, Mycobacterium tuberculosis
GSRSIADYGG

SEQ ID NO: 1363152 - protein, 12 aa, Mycobacterium tuberculosis
GSSAIAKASLDA

SEQ ID NO: 1363153 - protein, 9 aa, Mycobacterium tuberculosis
GSSNSPISG

SEQ ID NO: 1363154 - protein, 9 aa, Mycobacterium tuberculosis
GSTADGNIT

SEQ ID NO: 1363155 - protein, 6 aa, Mycobacterium tuberculosis
GSTTST

SEQ ID NO: 1363156 - protein, 15 aa, Mycobacterium tuberculosis
GTAGKESVGRPAGLT

SEQ ID NO: 1363157 - protein, 11 aa, Mycobacterium tuberculosis
GTAPTTSGAAA

SEQ ID NO: 1363158 - protein, 8 aa, Mycobacterium tuberculosis
GTDRYPPF

SEQ ID NO: 1363159 - protein, 5 aa, Mycobacterium tuberculosis
GTITL

SEQ ID NO: 1363160 - protein, 9 aa, Mycobacterium tuberculosis
GTKPLSPEA

SEQ ID NO: 1363161 - protein, 14 aa, Mycobacterium tuberculosis
GTLTYDGADPERKR

SEQ ID NO: 1363162 - protein, 9 aa, Mycobacterium tuberculosis
GTRHRSNKE

SEQ ID NO: 1363163 - protein, 13 aa, Mycobacterium tuberculosis
GTSQKLTEKYNQD

SEQ ID NO: 1363164 - protein, 4 aa, Mycobacterium tuberculosis
GTTA

SEQ ID NO: 1363165 - protein, 7 aa, Mycobacterium tuberculosis
GTTGHPK

SEQ ID NO: 1363166 - protein, 18 aa, Mycobacterium tuberculosis
GTTGTPKGANRNTPPTLA

SEQ ID NO: 1363167 - protein, 9 aa, Mycobacterium tuberculosis
GTTPQVGQG

SEQ ID NO: 1363168 - protein, 12 aa, Mycobacterium tuberculosis
GVAPQDFDTPTE

SEQ ID NO: 1363169 - protein, 8 aa, Mycobacterium tuberculosis
GVEDNPGY

SEQ ID NO: 1363170 - protein, 4 aa, Mycobacterium tuberculosis
GVPH

SEQ ID NO: 1363171 - protein, 11 aa, Mycobacterium tuberculosis
GVPRDDEPPLD

SEQ ID NO: 1363172 - protein, 13 aa, Mycobacterium tuberculosis
GVRRASGRSDPSA

SEQ ID NO: 1363173 - protein, 52 aa, Mycobacterium tuberculosis; identical to SEQ ID NO: 151672

SEQ ID NO: 1363174 - protein, 7 aa, Mycobacterium tuberculosis
GYRPGYN

SEQ ID NO: 1363175 - protein, 5 aa, Mycobacterium tuberculosis
HAEAN

SEQ ID NO: 1363176 - protein, 5 aa, Mycobacterium tuberculosis
HAKPG

SEQ ID NO: 1363177 - protein, 6 aa, Mycobacterium tuberculosis
HARQRD

SEQ ID NO: 1363178 - protein, 6 aa, Mycobacterium tuberculosis
HDGKTQ

SEQ ID NO: 1363179 - protein, 9 aa, Mycobacterium tuberculosis
HDSAATAAK

SEQ ID NO: 1363180 - protein, 6 aa, Mycobacterium tuberculosis
HETPER

SEQ ID NO: 1363181 - protein, 24 aa, Mycobacterium tuberculosis
HGAATAVKAGRDGADADDDQRPAP

SEQ ID NO: 1363182 - protein, 13 aa, Mycobacterium tuberculosis
HGGELDQLTGGAH

SEQ ID NO: 1363183 - protein, 6 aa, Mycobacterium tuberculosis
HGPRTD

SEQ ID NO: 1363184 - protein, 4 aa, Mycobacterium tuberculosis
HGPT

SEQ ID NO: 1363185 - protein, 5 aa, Mycobacterium tuberculosis
HGPVS

SEQ ID NO: 1363186 - protein, 8 aa, Mycobacterium tuberculosis
HGSAAQRQ

SEQ ID NO: 1363187 - protein, 9 aa, Mycobacterium tuberculosis
HGTNDAQKT

SEQ ID NO: 1363188 - protein, 4 aa, Mycobacterium tuberculosis
HNTN

SEQ ID NO: 1363189 - protein, 24 aa, Mycobacterium tuberculosis
HPDPTALASVPGSRRQWERDPHDP

SEQ ID NO: 1363190 - protein, 34 aa, Mycobacterium tuberculosis; identical to SEQ ID NO: 151754

SEQ ID NO: 1363191 - protein, 9 aa, Mycobacterium tuberculosis
HPIDPRSYS

SEQ ID NO: 1363192 - protein, 5 aa, Mycobacterium tuberculosis
HPPIE

SEQ ID NO: 1363193 - protein, 6 aa, Mycobacterium tuberculosis
HPQRHT

SEQ ID NO: 1363194 - protein, 12 aa, Mycobacterium tuberculosis
HQANPTNPGDSL

SEQ ID NO: 1363195 - protein, 9 aa, Mycobacterium tuberculosis
HQESQSIAR

SEQ ID NO: 1363196 - protein, 5 aa, Mycobacterium tuberculosis
HRGAE

SEQ ID NO: 1363197 - protein, 6 aa, Mycobacterium tuberculosis
HSGDRS

SEQ ID NO: 1363198 - protein, 7 aa, Mycobacterium tuberculosis
HSPRNTW

SEQ ID NO: 1363199 - protein, 11 aa, Mycobacterium tuberculosis
IAAETQDEPDV

SEQ ID NO: 1363200 - protein, 7 aa, Mycobacterium tuberculosis
IDGEEAP

SEQ ID NO: 1363201 - protein, 4 aa, Mycobacterium tuberculosis
IDGF

SEQ ID NO: 1363202 - protein, 7 aa, Mycobacterium tuberculosis
IDGQETG

SEQ ID NO: 1363203 - protein, 12 aa, Mycobacterium tuberculosis
IDPQAQRAAEKA

SEQ ID NO: 1363204 - protein, 9 aa, Mycobacterium tuberculosis
IDPSASAET

SEQ ID NO: 1363205 - protein, 9 aa, Mycobacterium tuberculosis
IDQGPAAGT

SEQ ID NO: 1363206 - protein, 4 aa, Mycobacterium tuberculosis
IEPG

SEQ ID NO: 1363207 - protein, 42 aa, Mycobacterium tuberculosis; identical to SEQ ID NO: 151835

SEQ ID NO: 1363208 - protein, 8 aa, Mycobacterium tuberculosis
IGDRDSGA

SEQ ID NO: 1363209 - protein, 7 aa, Mycobacterium tuberculosis
IGESSPT

SEQ ID NO: 1363210 - protein, 6 aa, Mycobacterium tuberculosis
IGPTQQ

SEQ ID NO: 1363211 - protein, 8 aa, Mycobacterium tuberculosis
IGQTGMPS

SEQ ID NO: 1363212 - protein, 5 aa, Mycobacterium tuberculosis
IGRQG

SEQ ID NO: 1363213 - protein, 16 aa, Mycobacterium tuberculosis
IGSGGSGGREGPTAQI

SEQ ID NO: 1363214 - protein, 6 aa, Mycobacterium tuberculosis
IGSSMD

SEQ ID NO: 1363215 - protein, 4 aa, Mycobacterium tuberculosis
IPGV

SEQ ID NO: 1363216 - protein, 4 aa, Mycobacterium tuberculosis
IPNP

SEQ ID NO: 1363217 - protein, 6 aa, Mycobacterium tuberculosis
IPPSGV

SEQ ID NO: 1363218 - protein, 10 aa, Mycobacterium tuberculosis
IPRPSTVRPG

SEQ ID NO: 1363219 - protein, 4 aa, Mycobacterium tuberculosis
IQPG

SEQ ID NO: 1363220 - protein, 6 aa, Mycobacterium tuberculosis
IQSGPR

SEQ ID NO: 1363221 - protein, 14 aa, Mycobacterium tuberculosis
IRESGGDRSAVTGG

SEQ ID NO: 1363222 - protein, 12 aa, Mycobacterium tuberculosis
ISESRAEGAPDD

SEQ ID NO: 1363223 - protein, 17 aa, Mycobacterium tuberculosis
ISGGVQAAPLPPEPQLA

SEQ ID NO: 1363224 - protein, 6 aa, Mycobacterium tuberculosis
ISGTGA

SEQ ID NO: 1363225 - protein, 8 aa, Mycobacterium tuberculosis
ISSGGGTP

SEQ ID NO: 1363226 - protein, 9 aa, Mycobacterium tuberculosis
ITGTSPLNT

SEQ ID NO: 1363227 - protein, 11 aa, Mycobacterium tuberculosis
ITRPDGKPIEH

SEQ ID NO: 1363228 - protein, 9 aa, Mycobacterium tuberculosis
KADNRLDGG

SEQ ID NO: 1363229 - protein, 24 aa, Mycobacterium tuberculosis
KAGVAGGGEDGKPATEVTITSVLL

SEQ ID NO: 1363230 - protein, 10 aa, Mycobacterium tuberculosis
KAVRGPAKDT

SEQ ID NO: 1363231 - protein, 12 aa, Mycobacterium tuberculosis
KDASAGGEAGHQ

SEQ ID NO: 1363232 - protein, 7 aa, Mycobacterium tuberculosis
KDFSRET

SEQ ID NO: 1363233 - protein, 4 aa, Mycobacterium tuberculosis
KDRA

SEQ ID NO: 1363234 - protein, 4 aa, Mycobacterium tuberculosis
KEFT

SEQ ID NO: 1363235 - protein, 30 aa, Mycobacterium tuberculosis; identical to SEQ ID NO: 151980

SEQ ID NO: 1363236 - protein, 6 aa, Mycobacterium tuberculosis
KGATGF

SEQ ID NO: 1363237 - protein, 9 aa, Mycobacterium tuberculosis
KGEAGADSF

SEQ ID NO: 1363238 - protein, 8 aa, Mycobacterium tuberculosis
KGGPLPRG

SEQ ID NO: 1363239 - protein, 8 aa, Mycobacterium tuberculosis
KGGSAVKP

SEQ ID NO: 1363240 - protein, 10 aa, Mycobacterium tuberculosis
KGVSPTGNAA

SEQ ID NO: 1363241 - protein, 6 aa, Mycobacterium tuberculosis
KHTAPK

SEQ ID NO: 1363242 - protein, 8 aa, Mycobacterium tuberculosis
KIEPAGDK

SEQ ID NO: 1363243 - protein, 7 aa, Mycobacterium tuberculosis
KIGPSQA

SEQ ID NO: 1363244 - protein, 8 aa, Mycobacterium tuberculosis
KKDQLGEG

SEQ ID NO: 1363245 - protein, 6 aa, Mycobacterium tuberculosis
KKHVQS

SEQ ID NO: 1363246 - protein, 9 aa, Mycobacterium tuberculosis
KKNTDTELP

SEQ ID NO: 1363247 - protein, 10 aa, Mycobacterium tuberculosis
KLPDAARSLG

SEQ ID NO: 1363248 - protein, 11 aa, Mycobacterium tuberculosis
KLSGGQRKRAS

SEQ ID NO: 1363249 - protein, 5 aa, Mycobacterium tuberculosis
KNRDI

SEQ ID NO: 1363250 - protein, 7 aa, Mycobacterium tuberculosis
KPEPDGL

SEQ ID NO: 1363251 - protein, 12 aa, Mycobacterium tuberculosis
KPNAAQKESEYI

SEQ ID NO: 1363252 - protein, 6 aa, Mycobacterium tuberculosis
KPRSDI

SEQ ID NO: 1363253 - protein, 5 aa, Mycobacterium tuberculosis
KQGQT

SEQ ID NO: 1363254 - protein, 6 aa, Mycobacterium tuberculosis
KQSRDR

SEQ ID NO: 1363255 - protein, 6 aa, Mycobacterium tuberculosis
KRASTL

SEQ ID NO: 1363256 - protein, 4 aa, Mycobacterium tuberculosis
KRGS

SEQ ID NO: 1363257 - protein, 4 aa, Mycobacterium tuberculosis
KRPR

SEQ ID NO: 1363258 - protein, 11 aa, Mycobacterium tuberculosis
KRTKDPDGAHA

SEQ ID NO: 1363259 - protein, 7 aa, Mycobacterium tuberculosis
KSRPGKL

SEQ ID NO: 1363260 - protein, 8 aa, Mycobacterium tuberculosis
KTGTLTEN

SEQ ID NO: 1363261 - protein, 8 aa, Mycobacterium tuberculosis
KTGTLTES

SEQ ID NO: 1363262 - protein, 7 aa, Mycobacterium tuberculosis
KTSRAAA

SEQ ID NO: 1363263 - protein, 6 aa, Mycobacterium tuberculosis
KVPANA

SEQ ID NO: 1363264 - protein, 5 aa, Mycobacterium tuberculosis
KYPTG

SEQ ID NO: 1363265 - protein, 6 aa, Mycobacterium tuberculosis
KYVSDT

SEQ ID NO: 1363266 - protein, 6 aa, Mycobacterium tuberculosis
LAGKGA

SEQ ID NO: 1363267 - protein, 11 aa, Mycobacterium tuberculosis
LAKDAAGDKWS

SEQ ID NO: 1363268 - protein, 5 aa, Mycobacterium tuberculosis
LAPEH

SEQ ID NO: 1363269 - protein, 9 aa, Mycobacterium tuberculosis
LAPPSSHQG

SEQ ID NO: 1363270 - protein, 8 aa, Mycobacterium tuberculosis
LDAQTNPV

SEQ ID NO: 1363271 - protein, 11 aa, Mycobacterium tuberculosis
LDEGGDGPHGV

SEQ ID NO: 1363272 - protein, 8 aa, Mycobacterium tuberculosis
LDGESRGE

SEQ ID NO: 1363273 - protein, 7 aa, Mycobacterium tuberculosis
LDGRADQ

SEQ ID NO: 1363274 - protein, 9 aa, Mycobacterium tuberculosis
LDPPPGDDV

SEQ ID NO: 1363275 - protein, 19 aa, Mycobacterium tuberculosis
LDPQPGKLPDWSPTSSRTW

SEQ ID NO: 1363276 - protein, 11 aa, Mycobacterium tuberculosis
LDTQSGAARPV

SEQ ID NO: 1363277 - protein, 39 aa, Mycobacterium tuberculosis; identical to SEQ ID NO: 152179

SEQ ID NO: 1363278 - protein, 5 aa, Mycobacterium tuberculosis
LEEDP

SEQ ID NO: 1363279 - protein, 11 aa, Mycobacterium tuberculosis
LGAGGRCDSAS

SEQ ID NO: 1363280 - protein, 13 aa, Mycobacterium tuberculosis
LGAPDFPSPGYPL

SEQ ID NO: 1363281 - protein, 6 aa, Mycobacterium tuberculosis
LGATAG

SEQ ID NO: 1363282 - protein, 9 aa, Mycobacterium tuberculosis
LGDSSKVRV

SEQ ID NO: 1363283 - protein, 25 aa, Mycobacterium tuberculosis
LGEASGDLASDSPAMPRPTTVENDA

SEQ ID NO: 1363284 - protein, 6 aa, Mycobacterium tuberculosis
LGESAQ

SEQ ID NO: 1363285 - protein, 12 aa, Mycobacterium tuberculosis
LGKGEDDATPAF

SEQ ID NO: 1363286 - protein, 4 aa, Mycobacterium tuberculosis
LGLS

SEQ ID NO: 1363287 - protein, 7 aa, Mycobacterium tuberculosis
LGPGDQW

SEQ ID NO: 1363288 - protein, 11 aa, Mycobacterium tuberculosis
LGSAGSPGSGS

SEQ ID NO: 1363289 - protein, 5 aa, Mycobacterium tuberculosis
LGVSG

SEQ ID NO: 1363290 - protein, 7 aa, Mycobacterium tuberculosis
LKEPERN

SEQ ID NO: 1363291 - protein, 4 aa, Mycobacterium tuberculosis
LKEQ

SEQ ID NO: 1363292 - protein, 5 aa, Mycobacterium tuberculosis
LPANG

SEQ ID NO: 1363293 - protein, 7 aa, Mycobacterium tuberculosis
LPGAGDA

SEQ ID NO: 1363294 - protein, 12 aa, Mycobacterium tuberculosis
LPPDTTKDDRTQ

SEQ ID NO: 1363295 - protein, 114 aa, Mycobacterium tuberculosis; identical to SEQ ID NO: 152289

SEQ ID NO: 1363296 - protein, 16 aa, Mycobacterium tuberculosis
LPPRPGSPRTADPPVR

SEQ ID NO: 1363297 - protein, 7 aa, Mycobacterium tuberculosis
LPPSEGL

SEQ ID NO: 1363298 - protein, 6 aa, Mycobacterium tuberculosis
LPRRAS

SEQ ID NO: 1363299 - protein, 8 aa, Mycobacterium tuberculosis
LPTSTKDG

SEQ ID NO: 1363300 - protein, 9 aa, Mycobacterium tuberculosis
LQGGSTITQ

SEQ ID NO: 1363301 - protein, 9 aa, Mycobacterium tuberculosis
LQSASERLR

SEQ ID NO: 1363302 - protein, 6 aa, Mycobacterium tuberculosis
LRARTT

SEQ ID NO: 1363303 - protein, 10 aa, Mycobacterium tuberculosis
LRDDADLRDK

SEQ ID NO: 1363304 - protein, 8 aa, Mycobacterium tuberculosis
LRETNKER

SEQ ID NO: 1363305 - protein, 20 aa, Mycobacterium tuberculosis
LRGPNGKLGAPVGDQTVDGD

SEQ ID NO: 1363306 - protein, 23 aa, Mycobacterium tuberculosis
LRGTPAGETASFPTGWRGLRFST

SEQ ID NO: 1363307 - protein, 4 aa, Mycobacterium tuberculosis
LRRP

SEQ ID NO: 1363308 - protein, 14 aa, Mycobacterium tuberculosis
LSAAAAANTKHDIA

SEQ ID NO: 1363309 - protein, 6 aa, Mycobacterium tuberculosis
LSDAGR

SEQ ID NO: 1363310 - protein, 16 aa, Mycobacterium tuberculosis
LSPEQARGDSVDARSD

SEQ ID NO: 1363311 - protein, 8 aa, Mycobacterium tuberculosis
LSPFGDGT

SEQ ID NO: 1363312 - protein, 7 aa, Mycobacterium tuberculosis
LSPRDDG

SEQ ID NO: 1363313 - protein, 29 aa, Mycobacterium tuberculosis
LSRSDHARARPDIARPGAGGSRVSRADVT

SEQ ID NO: 1363314 - protein, 5 aa, Mycobacterium tuberculosis
LSSAE

SEQ ID NO: 1363315 - protein, 4 aa, Mycobacterium tuberculosis
LSSG

SEQ ID NO: 1363316 - protein, 9 aa, Mycobacterium tuberculosis
LTAPSSGRI

SEQ ID NO: 1363317 - protein, 8 aa, Mycobacterium tuberculosis
LTDAGTPI

SEQ ID NO: 1363318 - protein, 12 aa, Mycobacterium tuberculosis
LTDDTERMDTTQ

SEQ ID NO: 1363319 - protein, 9 aa, Mycobacterium tuberculosis
LTKSAVPKR

SEQ ID NO: 1363320 - protein, 10 aa, Mycobacterium tuberculosis
LTNPKGWTHN

SEQ ID NO: 1363321 - protein, 5 aa, Mycobacterium tuberculosis
LTRRS

SEQ ID NO: 1363322 - protein, 10 aa, Mycobacterium tuberculosis
LTRTDNSGWG

SEQ ID NO: 1363323 - protein, 5 aa, Mycobacterium tuberculosis
LTSSN

SEQ ID NO: 1363324 - protein, 4 aa, Mycobacterium tuberculosis
LTTR

SEQ ID NO: 1363325 - protein, 9 aa, Mycobacterium tuberculosis
MARASAESH

SEQ ID NO: 1363326 - protein, 7 aa, Mycobacterium tuberculosis
MGSGLNE

SEQ ID NO: 1363327 - protein, 12 aa, Mycobacterium tuberculosis
MNPGGGAASTVG

SEQ ID NO: 1363328 - protein, 7 aa, Mycobacterium tuberculosis
MPPTGGL

SEQ ID NO: 1363329 - protein, 9 aa, Mycobacterium tuberculosis
MPRGGPDAS

SEQ ID NO: 1363330 - protein, 7 aa, Mycobacterium tuberculosis
MPSGTAR

SEQ ID NO: 1363331 - protein, 5 aa, Mycobacterium tuberculosis
MQGTG

SEQ ID NO: 1363332 - protein, 8 aa, Mycobacterium tuberculosis
MQTESKDL

SEQ ID NO: 1363333 - protein, 4 aa, Mycobacterium tuberculosis
MSGG

SEQ ID NO: 1363334 - protein, 8 aa, Mycobacterium tuberculosis
MSPDAAPS

SEQ ID NO: 1363335 - protein, 7 aa, Mycobacterium tuberculosis
NAASTLA

SEQ ID NO: 1363336 - protein, 6 aa, Mycobacterium tuberculosis
NADPRT

SEQ ID NO: 1363337 - protein, 7 aa, Mycobacterium tuberculosis
NAGGGNL

SEQ ID NO: 1363338 - protein, 9 aa, Mycobacterium tuberculosis
NAGPNTNSS

SEQ ID NO: 1363339 - protein, 4 aa, Mycobacterium tuberculosis
NAGR

SEQ ID NO: 1363340 - protein, 8 aa, Mycobacterium tuberculosis
NAGSLDNP

SEQ ID NO: 1363341 - protein, 7 aa, Mycobacterium tuberculosis
NANGNVE

SEQ ID NO: 1363342 - protein, 11 aa, Mycobacterium tuberculosis
NAPSRGGADGV

SEQ ID NO: 1363343 - protein, 5 aa, Mycobacterium tuberculosis
NAQSD

SEQ ID NO: 1363344 - protein, 7 aa, Mycobacterium tuberculosis
NARPEKP

SEQ ID NO: 1363345 - protein, 6 aa, Mycobacterium tuberculosis
NDPAAL

SEQ ID NO: 1363346 - protein, 5 aa, Mycobacterium tuberculosis
NDPAT

SEQ ID NO: 1363347 - protein, 13 aa, Mycobacterium tuberculosis
NDPDGVAVDNSGN

SEQ ID NO: 1363348 - protein, 4 aa, Mycobacterium tuberculosis
NEQA

SEQ ID NO: 1363349 - protein, 6 aa, Mycobacterium tuberculosis
NESPCT

SEQ ID NO: 1363350 - protein, 11 aa, Mycobacterium tuberculosis
NETDGGFGPSS

SEQ ID NO: 1363351 - protein, 4 aa, Mycobacterium tuberculosis
NGAP

SEQ ID NO: 1363352 - protein, 6 aa, Mycobacterium tuberculosis
NGGAGA

SEQ ID NO: 1363353 - protein, 10 aa, Mycobacterium tuberculosis
NGSEPVSPAS

SEQ ID NO: 1363354 - protein, 9 aa, Mycobacterium tuberculosis
NGSGPRFTA

SEQ ID NO: 1363355 - protein, 12 aa, Mycobacterium tuberculosis
NGTPSDLGGDNI

SEQ ID NO: 1363356 - protein, 7 aa, Mycobacterium tuberculosis
NGTSTAN

SEQ ID NO: 1363357 - protein, 4 aa, Mycobacterium tuberculosis
NHYP

SEQ ID NO: 1363358 - protein, 10 aa, Mycobacterium tuberculosis
NKTAKTVGQI

SEQ ID NO: 1363359 - protein, 6 aa, Mycobacterium tuberculosis
NNTPEG

SEQ ID NO: 1363360 - protein, 8 aa, Mycobacterium tuberculosis
NPATTEAM

SEQ ID NO: 1363361 - protein, 7 aa, Mycobacterium tuberculosis
NPDSPDR

SEQ ID NO: 1363362 - protein, 8 aa, Mycobacterium tuberculosis
NPEQHKDF

SEQ ID NO: 1363363 - protein, 8 aa, Mycobacterium tuberculosis
NPQVNEPL

SEQ ID NO: 1363364 - protein, 7 aa, Mycobacterium tuberculosis
NPSRSLP

SEQ ID NO: 1363365 - protein, 9 aa, Mycobacterium tuberculosis
NPTDKPAVT

SEQ ID NO: 1363366 - protein, 6 aa, Mycobacterium tuberculosis
NPTSRM

SEQ ID NO: 1363367 - protein, 35 aa, Mycobacterium tuberculosis; identical to SEQ ID NO: 152585

SEQ ID NO: 1363368 - protein, 6 aa, Mycobacterium tuberculosis
NQGYAA

SEQ ID NO: 1363369 - protein, 7 aa, Mycobacterium tuberculosis
NQPLGDA

SEQ ID NO: 1363370 - protein, 7 aa, Mycobacterium tuberculosis
NRADPLA

SEQ ID NO: 1363371 - protein, 10 aa, Mycobacterium tuberculosis
NRDGSDAMST

SEQ ID NO: 1363372 - protein, 5 aa, Mycobacterium tuberculosis
NSDGS

SEQ ID NO: 1363373 - protein, 4 aa, Mycobacterium tuberculosis
NSQR

SEQ ID NO: 1363374 - protein, 6 aa, Mycobacterium tuberculosis
NSSDID

SEQ ID NO: 1363375 - protein, 10 aa, Mycobacterium tuberculosis
NTFTTDPANL

SEQ ID NO: 1363376 - protein, 28 aa, Mycobacterium tuberculosis
NTNGHASKAATKSVPNGKPADLAEGNGE

SEQ ID NO: 1363377 - protein, 6 aa, Mycobacterium tuberculosis
NTSDDG

SEQ ID NO: 1363378 - protein, 4 aa, Mycobacterium tuberculosis
NTVP

SEQ ID NO: 1363379 - protein, 6 aa, Mycobacterium tuberculosis
NVTTAT

SEQ ID NO: 1363380 - protein, 10 aa, Mycobacterium tuberculosis
PAAAPPLRES

SEQ ID NO: 1363381 - protein, 12 aa, Mycobacterium tuberculosis
PAAPPPPPDHRA

SEQ ID NO: 1363382 - protein, 10 aa, Mycobacterium tuberculosis
PAASSAGQDY

SEQ ID NO: 1363383 - protein, 15 aa, Mycobacterium tuberculosis
PAEPDGADDEEADHP

SEQ ID NO: 1363384 - protein, 10 aa, Mycobacterium tuberculosis
PAFTGQPTDA

SEQ ID NO: 1363385 - protein, 10 aa, Mycobacterium tuberculosis
PAGGVDTGKA

SEQ ID NO: 1363386 - protein, 8 aa, Mycobacterium tuberculosis
PAGPRPWQ

SEQ ID NO: 1363387 - protein, 4 aa, Mycobacterium tuberculosis
PAGS

SEQ ID NO: 1363388 - protein, 7 aa, Mycobacterium tuberculosis
PAGSANL

SEQ ID NO: 1363389 - protein, 9 aa, Mycobacterium tuberculosis
PALGSTPDN

SEQ ID NO: 1363390 - protein, 7 aa, Mycobacterium tuberculosis
PANGAVP

SEQ ID NO: 1363391 - protein, 7 aa, Mycobacterium tuberculosis
PAQPGAA

SEQ ID NO: 1363392 - protein, 4 aa, Mycobacterium tuberculosis
PARG

SEQ ID NO: 1363393 - protein, 9 aa, Mycobacterium tuberculosis
PATGANAVE

SEQ ID NO: 1363394 - protein, 61 aa, Mycobacterium tuberculosis; identical to SEQ ID NO: 152705

SEQ ID NO: 1363395 - protein, 10 aa, Mycobacterium tuberculosis
PDAGNPASFG

SEQ ID NO: 1363396 - protein, 9 aa, Mycobacterium tuberculosis
PDAGQRISA

SEQ ID NO: 1363397 - protein, 5 aa, Mycobacterium tuberculosis
PDGKA

SEQ ID NO: 1363398 - protein, 38 aa, Mycobacterium tuberculosis; identical to SEQ ID NO: 152725

SEQ ID NO: 1363399 - protein, 6 aa, Mycobacterium tuberculosis
PDGSIA

SEQ ID NO: 1363400 - protein, 7 aa, Mycobacterium tuberculosis
PDGSYSE

SEQ ID NO: 1363401 - protein, 7 aa, Mycobacterium tuberculosis
PDKVNSI

SEQ ID NO: 1363402 - protein, 6 aa, Mycobacterium tuberculosis
PDPNRA

SEQ ID NO: 1363403 - protein, 23 aa, Mycobacterium tuberculosis
PDRGAEPELGPQPDLPSRRGRRL

SEQ ID NO: 1363404 - protein, 5 aa, Mycobacterium tuberculosis
PDRPE

SEQ ID NO: 1363405 - protein, 16 aa, Mycobacterium tuberculosis
PDRPPTPVDGSPGRAV

SEQ ID NO: 1363406 - protein, 8 aa, Mycobacterium tuberculosis
PDTGLQPP

SEQ ID NO: 1363407 - protein, 6 aa, Mycobacterium tuberculosis
PDYDLG

SEQ ID NO: 1363408 - protein, 4 aa, Mycobacterium tuberculosis
PEAD

SEQ ID NO: 1363409 - protein, 6 aa, Mycobacterium tuberculosis
PEAPAI

SEQ ID NO: 1363410 - protein, 7 aa, Mycobacterium tuberculosis
PEAPRIT

SEQ ID NO: 1363411 - protein, 4 aa, Mycobacterium tuberculosis
PEDP

SEQ ID NO: 1363412 - protein, 4 aa, Mycobacterium tuberculosis
PEKG

SEQ ID NO: 1363413 - protein, 5 aa, Mycobacterium tuberculosis
PFATR

SEQ ID NO: 1363414 - protein, 5 aa, Mycobacterium tuberculosis
PGAPE

SEQ ID NO: 1363415 - protein, 16 aa, Mycobacterium tuberculosis
PGAPSRPASAVSRPSY

SEQ ID NO: 1363416 - protein, 6 aa, Mycobacterium tuberculosis
PGGKTA

SEQ ID NO: 1363417 - protein, 14 aa, Mycobacterium tuberculosis
PGKRAATPRECRSN

SEQ ID NO: 1363418 - protein, 8 aa, Mycobacterium tuberculosis
PGLGGNRP

SEQ ID NO: 1363419 - protein, 4 aa, Mycobacterium tuberculosis
PGMA

SEQ ID NO: 1363420 - protein, 4 aa, Mycobacterium tuberculosis
PGMD

SEQ ID NO: 1363421 - protein, 13 aa, Mycobacterium tuberculosis
PGNDGSEARNLGQ

SEQ ID NO: 1363422 - protein, 11 aa, Mycobacterium tuberculosis
PGRPRENPEWT

SEQ ID NO: 1363423 - protein, 13 aa, Mycobacterium tuberculosis
PHAGRRRGGGSGA

SEQ ID NO: 1363424 - protein, 30 aa, Mycobacterium tuberculosis; identical to SEQ ID NO: 152865

SEQ ID NO: 1363425 - protein, 19 aa, Mycobacterium tuberculosis
PHNDTGTAKHGAHKPTPRI

SEQ ID NO: 1363426 - protein, 5 aa, Mycobacterium tuberculosis
PHRPR

SEQ ID NO: 1363427 - protein, 10 aa, Mycobacterium tuberculosis
PIGDATSRAT

SEQ ID NO: 1363428 - protein, 4 aa, Mycobacterium tuberculosis
PKET

SEQ ID NO: 1363429 - protein, 15 aa, Mycobacterium tuberculosis
PKPGTGPSAAARERG

SEQ ID NO: 1363430 - protein, 9 aa, Mycobacterium tuberculosis
PKQAPKAVD

SEQ ID NO: 1363431 - protein, 22 aa, Mycobacterium tuberculosis
PKQRGGYAQFGTGTAQQGFPAD

SEQ ID NO: 1363432 - protein, 6 aa, Mycobacterium tuberculosis
PLADRS

SEQ ID NO: 1363433 - protein, 13 aa, Mycobacterium tuberculosis
PLGSRSPAEPAHP

SEQ ID NO: 1363434 - protein, 9 aa, Mycobacterium tuberculosis
PPAGAQPPF

SEQ ID NO: 1363435 - protein, 4 aa, Mycobacterium tuberculosis
PPDA

SEQ ID NO: 1363436 - protein, 35 aa, Mycobacterium tuberculosis; identical to SEQ ID NO: 152939

SEQ ID NO: 1363437 - protein, 4 aa, Mycobacterium tuberculosis
PPLP

SEQ ID NO: 1363438 - protein, 5 aa, Mycobacterium tuberculosis
PPLTS

SEQ ID NO: 1363439 - protein, 6 aa, Mycobacterium tuberculosis
PPNGTH

SEQ ID NO: 1363440 - protein, 11 aa, Mycobacterium tuberculosis
PPRFADDNGSA

SEQ ID NO: 1363441 - protein, 13 aa, Mycobacterium tuberculosis
PPRVAAEPPSPGS

SEQ ID NO: 1363442 - protein, 10 aa, Mycobacterium tuberculosis
PPSHAGRATT

SEQ ID NO: 1363443 - protein, 6 aa, Mycobacterium tuberculosis
PQPAAS

SEQ ID NO: 1363444 - protein, 11 aa, Mycobacterium tuberculosis
PQQDSSAPDAQ

SEQ ID NO: 1363445 - protein, 8 aa, Mycobacterium tuberculosis
PQSPPATG

SEQ ID NO: 1363446 - protein, 8 aa, Mycobacterium tuberculosis
PQWGPPAG

SEQ ID NO: 1363447 - protein, 8 aa, Mycobacterium tuberculosis
PRAGQDAL

SEQ ID NO: 1363448 - protein, 4 aa, Mycobacterium tuberculosis
PRDV

SEQ ID NO: 1363449 - protein, 5 aa, Mycobacterium tuberculosis
PRNEL

SEQ ID NO: 1363450 - protein, 8 aa, Mycobacterium tuberculosis
PRQQDEGD

SEQ ID NO: 1363451 - protein, 21 aa, Mycobacterium tuberculosis
PSGPELSRANASVARDTVAPG

SEQ ID NO: 1363452 - protein, 8 aa, Mycobacterium tuberculosis
PSGQATSF

SEQ ID NO: 1363453 - protein, 4 aa, Mycobacterium tuberculosis
PSLA

SEQ ID NO: 1363454 - protein, 16 aa, Mycobacterium tuberculosis
PSSGTAPGGKPAPKPQ

SEQ ID NO: 1363455 - protein, 6 aa, Mycobacterium tuberculosis
PSSSSH

SEQ ID NO: 1363456 - protein, 21 aa, Mycobacterium tuberculosis
PSSTAAERDPLPQTTDAPSAE

SEQ ID NO: 1363457 - protein, 14 aa, Mycobacterium tuberculosis
PSTLDPAVDPEGAH

SEQ ID NO: 1363458 - protein, 9 aa, Mycobacterium tuberculosis
PTARPQEPL

SEQ ID NO: 1363459 - protein, 4 aa, Mycobacterium tuberculosis
PTDG

SEQ ID NO: 1363460 - protein, 6 aa, Mycobacterium tuberculosis
PTEQLD

SEQ ID NO: 1363461 - protein, 6 aa, Mycobacterium tuberculosis
PTGSGL

SEQ ID NO: 1363462 - protein, 14 aa, Mycobacterium tuberculosis
PTPGSATTPMGRGP

SEQ ID NO: 1363463 - protein, 8 aa, Mycobacterium tuberculosis
PTSGLDPA

SEQ ID NO: 1363464 - protein, 11 aa, Mycobacterium tuberculosis
PTTAAGSAALG

SEQ ID NO: 1363465 - protein, 9 aa, Mycobacterium tuberculosis
PVAEGNERI

SEQ ID NO: 1363466 - protein, 6 aa, Mycobacterium tuberculosis
PVGGPT

SEQ ID NO: 1363467 - protein, 6 aa, Mycobacterium tuberculosis
PVPPQT

SEQ ID NO: 1363468 - protein, 39 aa, Mycobacterium tuberculosis; identical to SEQ ID NO: 153092

SEQ ID NO: 1363469 - protein, 16 aa, Mycobacterium tuberculosis
PVSEADADDEDNELTD

SEQ ID NO: 1363470 - protein, 16 aa, Mycobacterium tuberculosis
PVSGAPVASGASGNLK

SEQ ID NO: 1363471 - protein, 19 aa, Mycobacterium tuberculosis
PWQPPGQGADHSSDPTVAA

SEQ ID NO: 1363472 - protein, 4 aa, Mycobacterium tuberculosis
QAAY

SEQ ID NO: 1363473 - protein, 9 aa, Mycobacterium tuberculosis
QADGRGPAL

SEQ ID NO: 1363474 - protein, 8 aa, Mycobacterium tuberculosis
QADPATAD

SEQ ID NO: 1363475 - protein, 4 aa, Mycobacterium tuberculosis
QAEG

SEQ ID NO: 1363476 - protein, 6 aa, Mycobacterium tuberculosis
QAHTDD

SEQ ID NO: 1363477 - protein, 7 aa, Mycobacterium tuberculosis
QAPRSRG

SEQ ID NO: 1363478 - protein, 7 aa, Mycobacterium tuberculosis
QAPVDPQ

SEQ ID NO: 1363479 - protein, 20 aa, Mycobacterium tuberculosis
QAQGALAAAEQAEHAEQEAA

SEQ ID NO: 1363480 - protein, 16 aa, Mycobacterium tuberculosis
QASGNTDQAALESAQA

SEQ ID NO: 1363481 - protein, 40 aa, Mycobacterium tuberculosis
QASSQSAPRAAQGSSKPAPGARPVRPVGTRRPTGKRNAGR

SEQ ID NO: 1363482 - protein, 5 aa, Mycobacterium tuberculosis
QDGAT

SEQ ID NO: 1363483 - protein, 10 aa, Mycobacterium tuberculosis
QDGGEQQGMP

SEQ ID NO: 1363484 - protein, 11 aa, Mycobacterium tuberculosis
QDSVRESGPVR

SEQ ID NO: 1363485 - protein, 9 aa, Mycobacterium tuberculosis
QEANTQDFP

SEQ ID NO: 1363486 - protein, 6 aa, Mycobacterium tuberculosis
QEAPAQ

SEQ ID NO: 1363487 - protein, 6 aa, Mycobacterium tuberculosis
QFSADE

SEQ ID NO: 1363488 - protein, 4 aa, Mycobacterium tuberculosis
QGAT

SEQ ID NO: 1363489 - protein, 11 aa, Mycobacterium tuberculosis
QGATSDGNDAA

SEQ ID NO: 1363490 - protein, 6 aa, Mycobacterium tuberculosis
QGFDGR

SEQ ID NO: 1363491 - protein, 6 aa, Mycobacterium tuberculosis
QGQSAN

SEQ ID NO: 1363492 - protein, 7 aa, Mycobacterium tuberculosis
QGQSGST

SEQ ID NO: 1363493 - protein, 10 aa, Mycobacterium tuberculosis
QGRQSKSEHT

SEQ ID NO: 1363494 - protein, 10 aa, Mycobacterium tuberculosis
QHDPATVARA

SEQ ID NO: 1363495 - protein, 7 aa, Mycobacterium tuberculosis
QHPTGAG

SEQ ID NO: 1363496 - protein, 12 aa, Mycobacterium tuberculosis
QHRHERSRATVG

SEQ ID NO: 1363497 - protein, 8 aa, Mycobacterium tuberculosis
QKRPQPGK

SEQ ID NO: 1363498 - protein, 8 aa, Mycobacterium tuberculosis
QLPPGFDS

SEQ ID NO: 1363499 - protein, 11 aa, Mycobacterium tuberculosis
QNRTKEALASA

SEQ ID NO: 1363500 - protein, 8 aa, Mycobacterium tuberculosis
QNTSTDAN

SEQ ID NO: 1363501 - protein, 19 aa, Mycobacterium tuberculosis
QPEPTFTTSPQDADRFSDA

SEQ ID NO: 1363502 - protein, 7 aa, Mycobacterium tuberculosis
QPNGEVL

SEQ ID NO: 1363503 - protein, 9 aa, Mycobacterium tuberculosis
QPQPGQNAP

SEQ ID NO: 1363504 - protein, 5 aa, Mycobacterium tuberculosis
QPRRT

SEQ ID NO: 1363505 - protein, 11 aa, Mycobacterium tuberculosis
QPSQSNGQNYT

SEQ ID NO: 1363506 - protein, 6 aa, Mycobacterium tuberculosis
QPTDLV

SEQ ID NO: 1363507 - protein, 23 aa, Mycobacterium tuberculosis
QPTDPDVAQPRVADEAEQHAKKS

SEQ ID NO: 1363508 - protein, 9 aa, Mycobacterium tuberculosis
QPWPEPGDE

SEQ ID NO: 1363509 - protein, 31 aa, Mycobacterium tuberculosis; identical to SEQ ID NO: 153271

SEQ ID NO: 1363510 - protein, 10 aa, Mycobacterium tuberculosis
QQISTGTEIR

SEQ ID NO: 1363511 - protein, 7 aa, Mycobacterium tuberculosis
QRDRAND

SEQ ID NO: 1363512 - protein, 5 aa, Mycobacterium tuberculosis
QREAT

SEQ ID NO: 1363513 - protein, 6 aa, Mycobacterium tuberculosis
QRPLGD

SEQ ID NO: 1363514 - protein, 4 aa, Mycobacterium tuberculosis
QRPY

SEQ ID NO: 1363515 - protein, 10 aa, Mycobacterium tuberculosis
QRSIGDVPTG

SEQ ID NO: 1363516 - protein, 7 aa, Mycobacterium tuberculosis
QRTGWSG

SEQ ID NO: 1363517 - protein, 10 aa, Mycobacterium tuberculosis
QSARSTAAGL

SEQ ID NO: 1363518 - protein, 8 aa, Mycobacterium tuberculosis
QSDVDQAR

SEQ ID NO: 1363519 - protein, 4 aa, Mycobacterium tuberculosis
QSEV

SEQ ID NO: 1363520 - protein, 12 aa, Mycobacterium tuberculosis
QSSSPALGDRTT

SEQ ID NO: 1363521 - protein, 8 aa, Mycobacterium tuberculosis
QSYSGEAT

SEQ ID NO: 1363522 - protein, 4 aa, Mycobacterium tuberculosis
QTAS

SEQ ID NO: 1363523 - protein, 16 aa, Mycobacterium tuberculosis
QTASASGYNEPRGYDR

SEQ ID NO: 1363524 - protein, 15 aa, Mycobacterium tuberculosis
QTDSEAGTTPDRGTD

SEQ ID NO: 1363525 - protein, 10 aa, Mycobacterium tuberculosis
QTETDAAGST

SEQ ID NO: 1363526 - protein, 9 aa, Mycobacterium tuberculosis
QTGADQIKA

SEQ ID NO: 1363527 - protein, 16 aa, Mycobacterium tuberculosis
QTGDPNICDTFSAADL

SEQ ID NO: 1363528 - protein, 5 aa, Mycobacterium tuberculosis
QTLNT

SEQ ID NO: 1363529 - protein, 22 aa, Mycobacterium tuberculosis
QTLTTTPHPDTDAPLPVPPTDD

SEQ ID NO: 1363530 - protein, 6 aa, Mycobacterium tuberculosis
QTQPAV

SEQ ID NO: 1363531 - protein, 31 aa, Mycobacterium tuberculosis; identical to SEQ ID NO: 153350

SEQ ID NO: 1363532 - protein, 6 aa, Mycobacterium tuberculosis
QTSAGY

SEQ ID NO: 1363533 - protein, 12 aa, Mycobacterium tuberculosis
QVPDSPAMTGPY

SEQ ID NO: 1363534 - protein, 11 aa, Mycobacterium tuberculosis
QYPPSPDKAVK

SEQ ID NO: 1363535 - protein, 8 aa, Mycobacterium tuberculosis
RAAGRAGY

SEQ ID NO: 1363536 - protein, 7 aa, Mycobacterium tuberculosis
RAAGTHK

SEQ ID NO: 1363537 - protein, 7 aa, Mycobacterium tuberculosis
RAAPTQL

SEQ ID NO: 1363538 - protein, 53 aa, Mycobacterium tuberculosis; identical to SEQ ID NO: 153376

SEQ ID NO: 1363539 - protein, 10 aa, Mycobacterium tuberculosis
RADEESGRAE

SEQ ID NO: 1363540 - protein, 11 aa, Mycobacterium tuberculosis
RADTNGPQSGA

SEQ ID NO: 1363541 - protein, 8 aa, Mycobacterium tuberculosis
RADTQDKI

SEQ ID NO: 1363542 - protein, 7 aa, Mycobacterium tuberculosis
RAGGDAR

SEQ ID NO: 1363543 - protein, 7 aa, Mycobacterium tuberculosis
RAGVGPR

SEQ ID NO: 1363544 - protein, 10 aa, Mycobacterium tuberculosis
RAKSKAGSAL

SEQ ID NO: 1363545 - protein, 10 aa, Mycobacterium tuberculosis
RAKSQAGSAL

SEQ ID NO: 1363546 - protein, 12 aa, Mycobacterium tuberculosis
RALPDDVRRDRA

SEQ ID NO: 1363547 - protein, 6 aa, Mycobacterium tuberculosis
RASGDE

SEQ ID NO: 1363548 - protein, 8 aa, Mycobacterium tuberculosis
RATGTGYA

SEQ ID NO: 1363549 - protein, 6 aa, Mycobacterium tuberculosis
RATQID

SEQ ID NO: 1363550 - protein, 8 aa, Mycobacterium tuberculosis
RDDSGERT

SEQ ID NO: 1363551 - protein, 14 aa, Mycobacterium tuberculosis
RDQRKRRAYTPDEV

SEQ ID NO: 1363552 - protein, 6 aa, Mycobacterium tuberculosis
READAA

SEQ ID NO: 1363553 - protein, 10 aa, Mycobacterium tuberculosis
REARTAGRLQ

SEQ ID NO: 1363554 - protein, 10 aa, Mycobacterium tuberculosis
REDGAGELTD

SEQ ID NO: 1363555 - protein, 4 aa, Mycobacterium tuberculosis
REED

SEQ ID NO: 1363556 - protein, 8 aa, Mycobacterium tuberculosis
REEETRIS

SEQ ID NO: 1363557 - protein, 29 aa, Mycobacterium tuberculosis
REGDAEAVDPLGQQQLDQSGAVGVSPSAV

SEQ ID NO: 1363558 - protein, 6 aa, Mycobacterium tuberculosis
REIGRS

SEQ ID NO: 1363559 - protein, 4 aa, Mycobacterium tuberculosis
RERE

SEQ ID NO: 1363560 - protein, 4 aa, Mycobacterium tuberculosis
RETE

SEQ ID NO: 1363561 - protein, 7 aa, Mycobacterium tuberculosis
RGAGEGR

SEQ ID NO: 1363562 - protein, 8 aa, Mycobacterium tuberculosis
RGGPRKRH

SEQ ID NO: 1363563 - protein, 6 aa, Mycobacterium tuberculosis
RGGPYL

SEQ ID NO: 1363564 - protein, 13 aa, Mycobacterium tuberculosis
RGHSGQRLAPGAT

SEQ ID NO: 1363565 - protein, 6 aa, Mycobacterium tuberculosis
RGNSTG

SEQ ID NO: 1363566 - protein, 6 aa, Mycobacterium tuberculosis
RGQIGS

SEQ ID NO: 1363567 - protein, 10 aa, Mycobacterium tuberculosis
RGRDGRAPYD

SEQ ID NO: 1363568 - protein, 5 aa, Mycobacterium tuberculosis
RGRSL

SEQ ID NO: 1363569 - protein, 5 aa, Mycobacterium tuberculosis
RGRYQ

SEQ ID NO: 1363570 - protein, 4 aa, Mycobacterium tuberculosis
RGTH

SEQ ID NO: 1363571 - protein, 8 aa, Mycobacterium tuberculosis
RGTYGPKV

SEQ ID NO: 1363572 - protein, 13 aa, Mycobacterium tuberculosis
RGVAEKRTERGFR

SEQ ID NO: 1363573 - protein, 6 aa, Mycobacterium tuberculosis
RHPTPG

SEQ ID NO: 1363574 - protein, 6 aa, Mycobacterium tuberculosis
RHRTTS

SEQ ID NO: 1363575 - protein, 8 aa, Mycobacterium tuberculosis
RIASKSSA

SEQ ID NO: 1363576 - protein, 22 aa, Mycobacterium tuberculosis
RKEHADEPEVQEQPTLAPQVEP

SEQ ID NO: 1363577 - protein, 12 aa, Mycobacterium tuberculosis
RKPGETGGTFSA

SEQ ID NO: 1363578 - protein, 5 aa, Mycobacterium tuberculosis
RLDQG

SEQ ID NO: 1363579 - protein, 5 aa, Mycobacterium tuberculosis
RLPRQ

SEQ ID NO: 1363580 - protein, 8 aa, Mycobacterium tuberculosis
RMSQGRTL

SEQ ID NO: 1363581 - protein, 10 aa, Mycobacterium tuberculosis
RNAAADDTPA

SEQ ID NO: 1363582 - protein, 16 aa, Mycobacterium tuberculosis
RNEPISVGELQADAIA

SEQ ID NO: 1363583 - protein, 15 aa, Mycobacterium tuberculosis
RPADAVPHDQPGRGL

SEQ ID NO: 1363584 - protein, 8 aa, Mycobacterium tuberculosis
RPAGPGPL

SEQ ID NO: 1363585 - protein, 6 aa, Mycobacterium tuberculosis
RPASTQ

SEQ ID NO: 1363586 - protein, 8 aa, Mycobacterium tuberculosis
RPDNPQTL

SEQ ID NO: 1363587 - protein, 6 aa, Mycobacterium tuberculosis
RPDTSH

SEQ ID NO: 1363588 - protein, 8 aa, Mycobacterium tuberculosis
RPEATRDA

SEQ ID NO: 1363589 - protein, 11 aa, Mycobacterium tuberculosis
RPETQRALAPA

SEQ ID NO: 1363590 - protein, 11 aa, Mycobacterium tuberculosis
RPGDTDPDNEV

SEQ ID NO: 1363591 - protein, 7 aa, Mycobacterium tuberculosis
RPGETIA

SEQ ID NO: 1363592 - protein, 15 aa, Mycobacterium tuberculosis
RPGPNRVGPKGALQS

SEQ ID NO: 1363593 - protein, 4 aa, Mycobacterium tuberculosis
RPLG

SEQ ID NO: 1363594 - protein, 6 aa, Mycobacterium tuberculosis
RPRPAS

SEQ ID NO: 1363595 - protein, 13 aa, Mycobacterium tuberculosis
RPRTDKGSDGTRH

SEQ ID NO: 1363596 - protein, 12 aa, Mycobacterium tuberculosis
RPRTLDPSTLDN

SEQ ID NO: 1363597 - protein, 4 aa, Mycobacterium tuberculosis
RQAL

SEQ ID NO: 1363598 - protein, 6 aa, Mycobacterium tuberculosis
RQETPT

SEQ ID NO: 1363599 - protein, 6 aa, Mycobacterium tuberculosis
RQGTET

SEQ ID NO: 1363600 - protein, 11 aa, Mycobacterium tuberculosis
RQMRDNANELR

SEQ ID NO: 1363601 - protein, 8 aa, Mycobacterium tuberculosis
RQPDGGWG

SEQ ID NO: 1363602 - protein, 8 aa, Mycobacterium tuberculosis
RQQDRWSS

SEQ ID NO: 1363603 - protein, 14 aa, Mycobacterium tuberculosis
RQTDSGDSLETARP

SEQ ID NO: 1363604 - protein, 15 aa, Mycobacterium tuberculosis
RQTLADKIMTTVCVP

SEQ ID NO: 1363605 - protein, 6 aa, Mycobacterium tuberculosis
RRASGG

SEQ ID NO: 1363606 - protein, 6 aa, Mycobacterium tuberculosis
RRGDDM

SEQ ID NO: 1363607 - protein, 5 aa, Mycobacterium tuberculosis
RRGEM

SEQ ID NO: 1363608 - protein, 4 aa, Mycobacterium tuberculosis
RRGQ

SEQ ID NO: 1363609 - protein, 34 aa, Mycobacterium tuberculosis; identical to SEQ ID NO: 153694

SEQ ID NO: 1363610 - protein, 5 aa, Mycobacterium tuberculosis
RRGYR

SEQ ID NO: 1363611 - protein, 4 aa, Mycobacterium tuberculosis
RRMN

SEQ ID NO: 1363612 - protein, 15 aa, Mycobacterium tuberculosis
RRNAPQSDPDPLVLP

SEQ ID NO: 1363613 - protein, 8 aa, Mycobacterium tuberculosis
RRPPAGMS

SEQ ID NO: 1363614 - protein, 12 aa, Mycobacterium tuberculosis
RRPPDSSSEPVV

SEQ ID NO: 1363615 - protein, 6 aa, Mycobacterium tuberculosis
RRPSRL

SEQ ID NO: 1363616 - protein, 6 aa, Mycobacterium tuberculosis
RRRDEE

SEQ ID NO: 1363617 - protein, 4 aa, Mycobacterium tuberculosis
RRRI

SEQ ID NO: 1363618 - protein, 9 aa, Mycobacterium tuberculosis
RRRNPGPDV

SEQ ID NO: 1363619 - protein, 9 aa, Mycobacterium tuberculosis
RRTTPNPDC

SEQ ID NO: 1363620 - protein, 6 aa, Mycobacterium tuberculosis
RRVDPT

SEQ ID NO: 1363621 - protein, 6 aa, Mycobacterium tuberculosis
RRVESD

SEQ ID NO: 1363622 - protein, 4 aa, Mycobacterium tuberculosis
RSDA

SEQ ID NO: 1363623 - protein, 5 aa, Mycobacterium tuberculosis
RSGTP

SEQ ID NO: 1363624 - protein, 5 aa, Mycobacterium tuberculosis
RSIDS

SEQ ID NO: 1363625 - protein, 42 aa, Mycobacterium tuberculosis; identical to SEQ ID NO: 153749

SEQ ID NO: 1363626 - protein, 5 aa, Mycobacterium tuberculosis
RSPID

SEQ ID NO: 1363627 - protein, 10 aa, Mycobacterium tuberculosis
RSQKAASGAD

SEQ ID NO: 1363628 - protein, 5 aa, Mycobacterium tuberculosis
RSSAG

SEQ ID NO: 1363629 - protein, 13 aa, Mycobacterium tuberculosis
RSTARATSPQSSG

SEQ ID NO: 1363630 - protein, 15 aa, Mycobacterium tuberculosis
RSTVEANARGGTSRD

SEQ ID NO: 1363631 - protein, 5 aa, Mycobacterium tuberculosis
RTAAD

SEQ ID NO: 1363632 - protein, 13 aa, Mycobacterium tuberculosis
RTAGAAQAAGVPN

SEQ ID NO: 1363633 - protein, 8 aa, Mycobacterium tuberculosis
RTDTMGRS

SEQ ID NO: 1363634 - protein, 6 aa, Mycobacterium tuberculosis
RTGAAI

SEQ ID NO: 1363635 - protein, 13 aa, Mycobacterium tuberculosis
RTGFSREEQQRLA

SEQ ID NO: 1363636 - protein, 10 aa, Mycobacterium tuberculosis
RTGGPGALPA

SEQ ID NO: 1363637 - protein, 22 aa, Mycobacterium tuberculosis
RTGPTPPPPPVEQPAELGDPAH

SEQ ID NO: 1363638 - protein, 10 aa, Mycobacterium tuberculosis
RTGYADVPTP

SEQ ID NO: 1363639 - protein, 11 aa, Mycobacterium tuberculosis
RTPEVAAPPVK

SEQ ID NO: 1363640 - protein, 5 aa, Mycobacterium tuberculosis
RTPST

SEQ ID NO: 1363641 - protein, 6 aa, Mycobacterium tuberculosis
RTQELT

SEQ ID NO: 1363642 - protein, 15 aa, Mycobacterium tuberculosis
RTRAGIERGIAGELD

SEQ ID NO: 1363643 - protein, 7 aa, Mycobacterium tuberculosis
RTSSNDI

SEQ ID NO: 1363644 - protein, 8 aa, Mycobacterium tuberculosis
RVDPADDR

SEQ ID NO: 1363645 - protein, 5 aa, Mycobacterium tuberculosis
RVGTD

SEQ ID NO: 1363646 - protein, 5 aa, Mycobacterium tuberculosis
RVSKT

SEQ ID NO: 1363647 - protein, 6 aa, Mycobacterium tuberculosis
RYAGDE

SEQ ID NO: 1363648 - protein, 14 aa, Mycobacterium tuberculosis
SAAADEPAVECGGD

SEQ ID NO: 1363649 - protein, 8 aa, Mycobacterium tuberculosis
SAAPSNIG

SEQ ID NO: 1363650 - protein, 8 aa, Mycobacterium tuberculosis
SAASSWAS

SEQ ID NO: 1363651 - protein, 8 aa, Mycobacterium tuberculosis
SAATRGAS

SEQ ID NO: 1363652 - protein, 6 aa, Mycobacterium tuberculosis
SADTRR

SEQ ID NO: 1363653 - protein, 26 aa, Mycobacterium tuberculosis
SAGEPGARRSAKSVRKLASDDSQSAH

SEQ ID NO: 1363654 - protein, 6 aa, Mycobacterium tuberculosis
SAGKVG

SEQ ID NO: 1363655 - protein, 13 aa, Mycobacterium tuberculosis
SAGVDDAKEYNSV

SEQ ID NO: 1363656 - protein, 5 aa, Mycobacterium tuberculosis
SALST

SEQ ID NO: 1363657 - protein, 7 aa, Mycobacterium tuberculosis
SAPAAVR

SEQ ID NO: 1363658 - protein, 6 aa, Mycobacterium tuberculosis
SAPGTD

SEQ ID NO: 1363659 - protein, 14 aa, Mycobacterium tuberculosis
SAPHREQYSDPEKP

SEQ ID NO: 1363660 - protein, 4 aa, Mycobacterium tuberculosis
SAPV

SEQ ID NO: 1363661 - protein, 4 aa, Mycobacterium tuberculosis
SAQH

SEQ ID NO: 1363662 - protein, 6 aa, Mycobacterium tuberculosis
SASLNS

SEQ ID NO: 1363663 - protein, 6 aa, Mycobacterium tuberculosis
SASMGR

SEQ ID NO: 1363664 - protein, 13 aa, Mycobacterium tuberculosis
SATTDEKLTQLGN

SEQ ID NO: 1363665 - protein, 7 aa, Mycobacterium tuberculosis
SCPPPRH

SEQ ID NO: 1363666 - protein, 13 aa, Mycobacterium tuberculosis
SDAGATAQERERA

SEQ ID NO: 1363667 - protein, 8 aa, Mycobacterium tuberculosis
SDDQNPNL

SEQ ID NO: 1363668 - protein, 8 aa, Mycobacterium tuberculosis
SDGPERKV

SEQ ID NO: 1363669 - protein, 6 aa, Mycobacterium tuberculosis
SDGSEI

SEQ ID NO: 1363670 - protein, 8 aa, Mycobacterium tuberculosis
SDNGGSTT

SEQ ID NO: 1363671 - protein, 6 aa, Mycobacterium tuberculosis
SDSEVS

SEQ ID NO: 1363672 - protein, 6 aa, Mycobacterium tuberculosis
SEAKAN

SEQ ID NO: 1363673 - protein, 4 aa, Mycobacterium tuberculosis
SERP

SEQ ID NO: 1363674 - protein, 8 aa, Mycobacterium tuberculosis
SETTGQPI

SEQ ID NO: 1363675 - protein, 7 aa, Mycobacterium tuberculosis
SEYGGDP

SEQ ID NO: 1363676 - protein, 5 aa, Mycobacterium tuberculosis
SGADT

SEQ ID NO: 1363677 - protein, 4 aa, Mycobacterium tuberculosis
SGAG

SEQ ID NO: 1363678 - protein, 14 aa, Mycobacterium tuberculosis
SGAPFDGASLQGKP

SEQ ID NO: 1363679 - protein, 6 aa, Mycobacterium tuberculosis
SGAPRA

SEQ ID NO: 1363680 - protein, 5 aa, Mycobacterium tuberculosis
SGEEI

SEQ ID NO: 1363681 - protein, 6 aa, Mycobacterium tuberculosis
SGEWSK

SEQ ID NO: 1363682 - protein, 5 aa, Mycobacterium tuberculosis
SGGGQ

SEQ ID NO: 1363683 - protein, 6 aa, Mycobacterium tuberculosis
SGKPDF

SEQ ID NO: 1363684 - protein, 4 aa, Mycobacterium tuberculosis
SGMP

SEQ ID NO: 1363685 - protein, 4 aa, Mycobacterium tuberculosis
SGNY

SEQ ID NO: 1363686 - protein, 6 aa, Mycobacterium tuberculosis
SGQGGA

SEQ ID NO: 1363687 - protein, 4 aa, Mycobacterium tuberculosis
SGQS

SEQ ID NO: 1363688 - protein, 8 aa, Mycobacterium tuberculosis
SGRAAAAG

SEQ ID NO: 1363689 - protein, 8 aa, Mycobacterium tuberculosis
SGRGNSAV

SEQ ID NO: 1363690 - protein, 28 aa, Mycobacterium tuberculosis
SGSGCSGSAGYADIDRGTQVTVKNGQGD

SEQ ID NO: 1363691 - protein, 8 aa, Mycobacterium tuberculosis
SGSGTADV

SEQ ID NO: 1363692 - protein, 9 aa, Mycobacterium tuberculosis
SGVPENVNA

SEQ ID NO: 1363693 - protein, 4 aa, Mycobacterium tuberculosis
SHPG

SEQ ID NO: 1363694 - protein, 7 aa, Mycobacterium tuberculosis
SHSTSTT

SEQ ID NO: 1363695 - protein, 12 aa, Mycobacterium tuberculosis
SIPGQPTSQAAR

SEQ ID NO: 1363696 - protein, 6 aa, Mycobacterium tuberculosis
SLEATR

SEQ ID NO: 1363697 - protein, 8 aa, Mycobacterium tuberculosis
SLGGPVSS

SEQ ID NO: 1363698 - protein, 7 aa, Mycobacterium tuberculosis
SLPAPTH

SEQ ID NO: 1363699 - protein, 5 aa, Mycobacterium tuberculosis
SLPEA

SEQ ID NO: 1363700 - protein, 4 aa, Mycobacterium tuberculosis
SLPP

SEQ ID NO: 1363701 - protein, 6 aa, Mycobacterium tuberculosis
SLSGAE

SEQ ID NO: 1363702 - protein, 10 aa, Mycobacterium tuberculosis
SLSGGGTGTR

SEQ ID NO: 1363703 - protein, 16 aa, Mycobacterium tuberculosis
SLSPGGFQDPRSESAR

SEQ ID NO: 1363704 - protein, 8 aa, Mycobacterium tuberculosis
SNEDGRTA

SEQ ID NO: 1363705 - protein, 12 aa, Mycobacterium tuberculosis
SNRDRLAARASR

SEQ ID NO: 1363706 - protein, 6 aa, Mycobacterium tuberculosis
SPAQRA

SEQ ID NO: 1363707 - protein, 6 aa, Mycobacterium tuberculosis
SPARAV

SEQ ID NO: 1363708 - protein, 5 aa, Mycobacterium tuberculosis
SPGDF

SEQ ID NO: 1363709 - protein, 8 aa, Mycobacterium tuberculosis
SPGTGFGR

SEQ ID NO: 1363710 - protein, 5 aa, Mycobacterium tuberculosis
SPIER

SEQ ID NO: 1363711 - protein, 6 aa, Mycobacterium tuberculosis
SPPFQH

SEQ ID NO: 1363712 - protein, 21 aa, Mycobacterium tuberculosis
SPPTIDPGALPPDGPPGPLAP

SEQ ID NO: 1363713 - protein, 13 aa, Mycobacterium tuberculosis
SPQDPTEHADGAE

SEQ ID NO: 1363714 - protein, 6 aa, Mycobacterium tuberculosis
SPRSGI

SEQ ID NO: 1363715 - protein, 4 aa, Mycobacterium tuberculosis
SPRT

SEQ ID NO: 1363716 - protein, 5 aa, Mycobacterium tuberculosis
SPSQS

SEQ ID NO: 1363717 - protein, 11 aa, Mycobacterium tuberculosis
SQATGMATADK

SEQ ID NO: 1363718 - protein, 5 aa, Mycobacterium tuberculosis
SQGTT

SEQ ID NO: 1363719 - protein, 4 aa, Mycobacterium tuberculosis
SQHT

SEQ ID NO: 1363720 - protein, 7 aa, Mycobacterium tuberculosis
SQSAGDQ

SEQ ID NO: 1363721 - protein, 5 aa, Mycobacterium tuberculosis
SRGRT

SEQ ID NO: 1363722 - protein, 9 aa, Mycobacterium tuberculosis
SRKDQERAV

SEQ ID NO: 1363723 - protein, 5 aa, Mycobacterium tuberculosis
SRMGA

SEQ ID NO: 1363724 - protein, 7 aa, Mycobacterium tuberculosis
SRMPQSR

SEQ ID NO: 1363725 - protein, 27 aa, Mycobacterium tuberculosis
SRPARTPTVPSETQPAGRPLAMSSDRL

SEQ ID NO: 1363726 - protein, 18 aa, Mycobacterium tuberculosis
SRQRKAKVTQDDTGTYRI

SEQ ID NO: 1363727 - protein, 8 aa, Mycobacterium tuberculosis
SRSHPAPL

SEQ ID NO: 1363728 - protein, 6 aa, Mycobacterium tuberculosis
SRSRRD

SEQ ID NO: 1363729 - protein, 5 aa, Mycobacterium tuberculosis
SRSSI

SEQ ID NO: 1363730 - protein, 6 aa, Mycobacterium tuberculosis
SRTRDE

SEQ ID NO: 1363731 - protein, 10 aa, Mycobacterium tuberculosis
SRYAGEDRET

SEQ ID NO: 1363732 - protein, 9 aa, Mycobacterium tuberculosis
SSAASNIGS

SEQ ID NO: 1363733 - protein, 5 aa, Mycobacterium tuberculosis
SSAGV

SEQ ID NO: 1363734 - protein, 8 aa, Mycobacterium tuberculosis
SSEAATDV

SEQ ID NO: 1363735 - protein, 12 aa, Mycobacterium tuberculosis
SSLLAKPAYNGL

SEQ ID NO: 1363736 - protein, 5 aa, Mycobacterium tuberculosis
SSNPM

SEQ ID NO: 1363737 - protein, 7 aa, Mycobacterium tuberculosis
SSPDTNT

SEQ ID NO: 1363738 - protein, 5 aa, Mycobacterium tuberculosis
SSPTG

SEQ ID NO: 1363739 - protein, 5 aa, Mycobacterium tuberculosis
SSQAF

SEQ ID NO: 1363740 - protein, 5 aa, Mycobacterium tuberculosis
SSRIA

SEQ ID NO: 1363741 - protein, 18 aa, Mycobacterium tuberculosis
SSSAPTESSECSADRQPG

SEQ ID NO: 1363742 - protein, 7 aa, Mycobacterium tuberculosis
SSSDREF

SEQ ID NO: 1363743 - protein, 12 aa, Mycobacterium tuberculosis
SSTAPAPKASRR

SEQ ID NO: 1363744 - protein, 7 aa, Mycobacterium tuberculosis
SSWDGPA

SEQ ID NO: 1363745 - protein, 11 aa, Mycobacterium tuberculosis
STGTTKTGATA

SEQ ID NO: 1363746 - protein, 5 aa, Mycobacterium tuberculosis
STHKS

SEQ ID NO: 1363747 - protein, 9 aa, Mycobacterium tuberculosis
STNGGRETT

SEQ ID NO: 1363748 - protein, 9 aa, Mycobacterium tuberculosis
STNPRAGTL

SEQ ID NO: 1363749 - protein, 19 aa, Mycobacterium tuberculosis
STPPAVDSSEVPAAGEPPL

SEQ ID NO: 1363750 - protein, 7 aa, Mycobacterium tuberculosis
STSALDT

SEQ ID NO: 1363751 - protein, 8 aa, Mycobacterium tuberculosis
STSFPSGH

SEQ ID NO: 1363752 - protein, 5 aa, Mycobacterium tuberculosis
STSYA

SEQ ID NO: 1363753 - protein, 4 aa, Mycobacterium tuberculosis
SVAA

SEQ ID NO: 1363754 - protein, 29 aa, Mycobacterium tuberculosis
SVGSTGELTQREGPHELRSPDGPRQLPPP

SEQ ID NO: 1363755 - protein, 10 aa, Mycobacterium tuberculosis
SVHGDPRAIR

SEQ ID NO: 1363756 - protein, 7 aa, Mycobacterium tuberculosis
SVTGRGR

SEQ ID NO: 1363757 - protein, 4 aa, Mycobacterium tuberculosis
SWPT

SEQ ID NO: 1363758 - protein, 9 aa, Mycobacterium tuberculosis
SYGQSGGPL

SEQ ID NO: 1363759 - protein, 8 aa, Mycobacterium tuberculosis
SYPTYAEA

SEQ ID NO: 1363760 - protein, 12 aa, Mycobacterium tuberculosis
TAAGSQSADDRA

SEQ ID NO: 1363761 - protein, 5 aa, Mycobacterium tuberculosis
TAENP

SEQ ID NO: 1363762 - protein, 7 aa, Mycobacterium tuberculosis
TAGIDSS

SEQ ID NO: 1363763 - protein, 4 aa, Mycobacterium tuberculosis
TAGM

SEQ ID NO: 1363764 - protein, 5 aa, Mycobacterium tuberculosis
TAGRT

SEQ ID NO: 1363765 - protein, 8 aa, Mycobacterium tuberculosis
TAHHPPAG

SEQ ID NO: 1363766 - protein, 9 aa, Mycobacterium tuberculosis
TAKGGEVAA

SEQ ID NO: 1363767 - protein, 4 aa, Mycobacterium tuberculosis
TALT

SEQ ID NO: 1363768 - protein, 5 aa, Mycobacterium tuberculosis
TALTE

SEQ ID NO: 1363769 - protein, 8 aa, Mycobacterium tuberculosis
TAQPHTAP

SEQ ID NO: 1363770 - protein, 8 aa, Mycobacterium tuberculosis
TATAGASG

SEQ ID NO: 1363771 - protein, 13 aa, Mycobacterium tuberculosis
TATGAQSSDGKAA

SEQ ID NO: 1363772 - protein, 4 aa, Mycobacterium tuberculosis
TATI

SEQ ID NO: 1363773 - protein, 11 aa, Mycobacterium tuberculosis
TDGDEAVANET

SEQ ID NO: 1363774 - protein, 7 aa, Mycobacterium tuberculosis
TDGYRRG

SEQ ID NO: 1363775 - protein, 4 aa, Mycobacterium tuberculosis
TDHK

SEQ ID NO: 1363776 - protein, 8 aa, Mycobacterium tuberculosis
TDNSSARA

SEQ ID NO: 1363777 - protein, 6 aa, Mycobacterium tuberculosis
TDPHNR

SEQ ID NO: 1363778 - protein, 7 aa, Mycobacterium tuberculosis
TDTDNNR

SEQ ID NO: 1363779 - protein, 23 aa, Mycobacterium tuberculosis
TEATESAVARTDGDSTTDTASKL

SEQ ID NO: 1363780 - protein, 9 aa, Mycobacterium tuberculosis
TEDSSPTRV

SEQ ID NO: 1363781 - protein, 4 aa, Mycobacterium tuberculosis
TEFD

SEQ ID NO: 1363782 - protein, 6 aa, Mycobacterium tuberculosis
TERDGV

SEQ ID NO: 1363783 - protein, 7 aa, Mycobacterium tuberculosis
TERPHPY

SEQ ID NO: 1363784 - protein, 11 aa, Mycobacterium tuberculosis
TESVEKRSEQR

SEQ ID NO: 1363785 - protein, 7 aa, Mycobacterium tuberculosis
TETETAT

SEQ ID NO: 1363786 - protein, 8 aa, Mycobacterium tuberculosis
TGATSVPA

SEQ ID NO: 1363787 - protein, 7 aa, Mycobacterium tuberculosis
TGDFGAQ

SEQ ID NO: 1363788 - protein, 5 aa, Mycobacterium tuberculosis
TGEAV

SEQ ID NO: 1363789 - protein, 7 aa, Mycobacterium tuberculosis
TGETADR

SEQ ID NO: 1363790 - protein, 6 aa, Mycobacterium tuberculosis
TGGAGA

SEQ ID NO: 1363791 - protein, 9 aa, Mycobacterium tuberculosis
TGGPESETL

SEQ ID NO: 1363792 - protein, 10 aa, Mycobacterium tuberculosis
TGGQGDAPPA

SEQ ID NO: 1363793 - protein, 7 aa, Mycobacterium tuberculosis
TGGRTAQ

SEQ ID NO: 1363794 - protein, 9 aa, Mycobacterium tuberculosis
TGHSSGVGG

SEQ ID NO: 1363795 - protein, 7 aa, Mycobacterium tuberculosis
TGKPLSP

SEQ ID NO: 1363796 - protein, 8 aa, Mycobacterium tuberculosis
TGPGPLGA

SEQ ID NO: 1363797 - protein, 4 aa, Mycobacterium tuberculosis
TGQY

SEQ ID NO: 1363798 - protein, 9 aa, Mycobacterium tuberculosis
TGSPLDPSA

SEQ ID NO: 1363799 - protein, 6 aa, Mycobacterium tuberculosis
TGSPVA

SEQ ID NO: 1363800 - protein, 9 aa, Mycobacterium tuberculosis
TGSPVTPDH

SEQ ID NO: 1363801 - protein, 5 aa, Mycobacterium tuberculosis
TGSVG

SEQ ID NO: 1363802 - protein, 5 aa, Mycobacterium tuberculosis
TGTGE

SEQ ID NO: 1363803 - protein, 7 aa, Mycobacterium tuberculosis
TGTLTTG

SEQ ID NO: 1363804 - protein, 19 aa, Mycobacterium tuberculosis
TGTSTPRPAAAQTVRDSPA

SEQ ID NO: 1363805 - protein, 8 aa, Mycobacterium tuberculosis
THPTDGTV

SEQ ID NO: 1363806 - protein, 6 aa, Mycobacterium tuberculosis
TIESRA

SEQ ID NO: 1363807 - protein, 7 aa, Mycobacterium tuberculosis
TKTTPTA

SEQ ID NO: 1363808 - protein, 11 aa, Mycobacterium tuberculosis
TLGDGRSPKVA

SEQ ID NO: 1363809 - protein, 6 aa, Mycobacterium tuberculosis
TLGNGG

SEQ ID NO: 1363810 - protein, 6 aa, Mycobacterium tuberculosis
TLSSDP

SEQ ID NO: 1363811 - protein, 4 aa, Mycobacterium tuberculosis
TNGA

SEQ ID NO: 1363812 - protein, 8 aa, Mycobacterium tuberculosis
TNNARGEV

SEQ ID NO: 1363813 - protein, 6 aa, Mycobacterium tuberculosis
TPAPYG

SEQ ID NO: 1363814 - protein, 12 aa, Mycobacterium tuberculosis
TPPATRPSYAGA

SEQ ID NO: 1363815 - protein, 10 aa, Mycobacterium tuberculosis
TPPNSGSPEW

SEQ ID NO: 1363816 - protein, 6 aa, Mycobacterium tuberculosis
TPRAVA

SEQ ID NO: 1363817 - protein, 23 aa, Mycobacterium tuberculosis
TPRTSRTLAPRLDPEAVGRTTES

SEQ ID NO: 1363818 - protein, 13 aa, Mycobacterium tuberculosis
TPTKRTWSSGSLP

SEQ ID NO: 1363819 - protein, 5 aa, Mycobacterium tuberculosis
TPTPQ

SEQ ID NO: 1363820 - protein, 6 aa, Mycobacterium tuberculosis
TPTPRM

SEQ ID NO: 1363821 - protein, 66 aa, Mycobacterium tuberculosis; identical to SEQ ID NO: 154613

SEQ ID NO: 1363822 - protein, 6 aa, Mycobacterium tuberculosis
TQPMPG

SEQ ID NO: 1363823 - protein, 6 aa, Mycobacterium tuberculosis
TQPTVA

SEQ ID NO: 1363824 - protein, 9 aa, Mycobacterium tuberculosis
TQQGQLGAK

SEQ ID NO: 1363825 - protein, 7 aa, Mycobacterium tuberculosis
TQRADAP

SEQ ID NO: 1363826 - protein, 4 aa, Mycobacterium tuberculosis
TQSR

SEQ ID NO: 1363827 - protein, 8 aa, Mycobacterium tuberculosis
TQVATGSV

SEQ ID NO: 1363828 - protein, 5 aa, Mycobacterium tuberculosis
TRAGA

SEQ ID NO: 1363829 - protein, 19 aa, Mycobacterium tuberculosis
TRGTASGPARGRAGVTGRA

SEQ ID NO: 1363830 - protein, 9 aa, Mycobacterium tuberculosis
TRGTKRKPV

SEQ ID NO: 1363831 - protein, 4 aa, Mycobacterium tuberculosis
TRIE

SEQ ID NO: 1363832 - protein, 9 aa, Mycobacterium tuberculosis
TRPEGTTMD

SEQ ID NO: 1363833 - protein, 9 aa, Mycobacterium tuberculosis
TSAQAPPVR

SEQ ID NO: 1363834 - protein, 18 aa, Mycobacterium tuberculosis
TSDNDAAVTQPEAQRERR

SEQ ID NO: 1363835 - protein, 5 aa, Mycobacterium tuberculosis
TSPAK

SEQ ID NO: 1363836 - protein, 7 aa, Mycobacterium tuberculosis
TSRPPAD

SEQ ID NO: 1363837 - protein, 8 aa, Mycobacterium tuberculosis
TSTTSGGL

SEQ ID NO: 1363838 - protein, 6 aa, Mycobacterium tuberculosis
TSTVTA

SEQ ID NO: 1363839 - protein, 4 aa, Mycobacterium tuberculosis
TTGR

SEQ ID NO: 1363840 - protein, 8 aa, Mycobacterium tuberculosis
TTPGKPPS

SEQ ID NO: 1363841 - protein, 5 aa, Mycobacterium tuberculosis
TTSSR

SEQ ID NO: 1363842 - protein, 9 aa, Mycobacterium tuberculosis
TTTDSAEGV

SEQ ID NO: 1363843 - protein, 19 aa, Mycobacterium tuberculosis
TVPPDLARAENQTKGPNGL

SEQ ID NO: 1363844 - protein, 6 aa, Mycobacterium tuberculosis
TVSPAR

SEQ ID NO: 1363845 - protein, 5 aa, Mycobacterium tuberculosis
TVTGD

SEQ ID NO: 1363846 - protein, 12 aa, Mycobacterium tuberculosis
VADPAESSAAAA

SEQ ID NO: 1363847 - protein, 12 aa, Mycobacterium tuberculosis
VADTRAQPCDPD

SEQ ID NO: 1363848 - protein, 12 aa, Mycobacterium tuberculosis
VADVNGDDAGPA

SEQ ID NO: 1363849 - protein, 10 aa, Mycobacterium tuberculosis
VAETERDNRI

SEQ ID NO: 1363850 - protein, 11 aa, Mycobacterium tuberculosis
VAGAADAGRTL

SEQ ID NO: 1363851 - protein, 7 aa, Mycobacterium tuberculosis
VAGGALP

SEQ ID NO: 1363852 - protein, 10 aa, Mycobacterium tuberculosis
VAGPTDPYGV

SEQ ID NO: 1363853 - protein, 9 aa, Mycobacterium tuberculosis
VAPDDAQSM

SEQ ID NO: 1363854 - protein, 12 aa, Mycobacterium tuberculosis
VAPSRRSTTSVG

SEQ ID NO: 1363855 - protein, 6 aa, Mycobacterium tuberculosis
VDAPRT

SEQ ID NO: 1363856 - protein, 5 aa, Mycobacterium tuberculosis
VDDAE

SEQ ID NO: 1363857 - protein, 10 aa, Mycobacterium tuberculosis
VDDPSSALRT

SEQ ID NO: 1363858 - protein, 10 aa, Mycobacterium tuberculosis
VDEPAPPARA

SEQ ID NO: 1363859 - protein, 4 aa, Mycobacterium tuberculosis
VDPG

SEQ ID NO: 1363860 - protein, 12 aa, Mycobacterium tuberculosis
VDTRYSSSPTPL

SEQ ID NO: 1363861 - protein, 6 aa, Mycobacterium tuberculosis
VEDSGG

SEQ ID NO: 1363862 - protein, 6 aa, Mycobacterium tuberculosis
VEEGRG

SEQ ID NO: 1363863 - protein, 7 aa, Mycobacterium tuberculosis
VEESYGS

SEQ ID NO: 1363864 - protein, 8 aa, Mycobacterium tuberculosis
VEPDPGTV

SEQ ID NO: 1363865 - protein, 8 aa, Mycobacterium tuberculosis
VERARGRL

SEQ ID NO: 1363866 - protein, 7 aa, Mycobacterium tuberculosis
VESASEH

SEQ ID NO: 1363867 - protein, 6 aa, Mycobacterium tuberculosis
VGADTQ

SEQ ID NO: 1363868 - protein, 8 aa, Mycobacterium tuberculosis
VGAGTTAA

SEQ ID NO: 1363869 - protein, 5 aa, Mycobacterium tuberculosis
VGERL

SEQ ID NO: 1363870 - protein, 12 aa, Mycobacterium tuberculosis
VGESSQTSDRPD

SEQ ID NO: 1363871 - protein, 11 aa, Mycobacterium tuberculosis
VGGGPAGVGRA

SEQ ID NO: 1363872 - protein, 8 aa, Mycobacterium tuberculosis
VGNTAAPD

SEQ ID NO: 1363873 - protein, 5 aa, Mycobacterium tuberculosis
VGSYR

SEQ ID NO: 1363874 - protein, 5 aa, Mycobacterium tuberculosis
VGTAA

SEQ ID NO: 1363875 - protein, 7 aa, Mycobacterium tuberculosis
VGTDNEQ

SEQ ID NO: 1363876 - protein, 4 aa, Mycobacterium tuberculosis
VGTQ

SEQ ID NO: 1363877 - protein, 7 aa, Mycobacterium tuberculosis
VHTGPGT

SEQ ID NO: 1363878 - protein, 8 aa, Mycobacterium tuberculosis
VKDSARDA

SEQ ID NO: 1363879 - protein, 8 aa, Mycobacterium tuberculosis
VKQESTGV

SEQ ID NO: 1363880 - protein, 11 aa, Mycobacterium tuberculosis
VLTSSGRTAVT

SEQ ID NO: 1363881 - protein, 13 aa, Mycobacterium tuberculosis
VNPDRGLRKEASV

SEQ ID NO: 1363882 - protein, 12 aa, Mycobacterium tuberculosis
VNPGEATLSRRG

SEQ ID NO: 1363883 - protein, 6 aa, Mycobacterium tuberculosis
VNSSEQ

SEQ ID NO: 1363884 - protein, 5 aa, Mycobacterium tuberculosis
VPAAT

SEQ ID NO: 1363885 - protein, 4 aa, Mycobacterium tuberculosis
VPAP

SEQ ID NO: 1363886 - protein, 6 aa, Mycobacterium tuberculosis
VPAVPS

SEQ ID NO: 1363887 - protein, 35 aa, Mycobacterium tuberculosis; identical to SEQ ID NO: 154922

SEQ ID NO: 1363888 - protein, 5 aa, Mycobacterium tuberculosis
VPPAG

SEQ ID NO: 1363889 - protein, 7 aa, Mycobacterium tuberculosis
VPPEGNR

SEQ ID NO: 1363890 - protein, 7 aa, Mycobacterium tuberculosis
VPRGPIP

SEQ ID NO: 1363891 - protein, 8 aa, Mycobacterium tuberculosis
VPSPEAGQ

SEQ ID NO: 1363892 - protein, 34 aa, Mycobacterium tuberculosis; identical to SEQ ID NO: 154955

SEQ ID NO: 1363893 - protein, 6 aa, Mycobacterium tuberculosis
VQSPPA

SEQ ID NO: 1363894 - protein, 5 aa, Mycobacterium tuberculosis
VRAES

SEQ ID NO: 1363895 - protein, 11 aa, Mycobacterium tuberculosis
VRGASGSGKTT

SEQ ID NO: 1363896 - protein, 11 aa, Mycobacterium tuberculosis
VRGRPADAGLP

SEQ ID NO: 1363897 - protein, 11 aa, Mycobacterium tuberculosis
VRRNPDHELRR

SEQ ID NO: 1363898 - protein, 5 aa, Mycobacterium tuberculosis
VRSTR

SEQ ID NO: 1363899 - protein, 8 aa, Mycobacterium tuberculosis
VSADGEYR

SEQ ID NO: 1363900 - protein, 18 aa, Mycobacterium tuberculosis
VSARTRRRGQAVGQTERD

SEQ ID NO: 1363901 - protein, 11 aa, Mycobacterium tuberculosis
VSENAGAKPQT

SEQ ID NO: 1363902 - protein, 6 aa, Mycobacterium tuberculosis
VSGEVG

SEQ ID NO: 1363903 - protein, 17 aa, Mycobacterium tuberculosis
VSGQNQPSTSAMPPPGK

SEQ ID NO: 1363904 - protein, 18 aa, Mycobacterium tuberculosis
VSKPSDPVTPATRGPDQR

SEQ ID NO: 1363905 - protein, 11 aa, Mycobacterium tuberculosis
VSMSPSDAASI

SEQ ID NO: 1363906 - protein, 7 aa, Mycobacterium tuberculosis
VSTTASV

SEQ ID NO: 1363907 - protein, 15 aa, Mycobacterium tuberculosis
VTGNPGQGPDHDYAT

SEQ ID NO: 1363908 - protein, 8 aa, Mycobacterium tuberculosis
VTGPTPKP

SEQ ID NO: 1363909 - protein, 9 aa, Mycobacterium tuberculosis
VTPGDERVG

SEQ ID NO: 1363910 - protein, 6 aa, Mycobacterium tuberculosis
VTQPGD

SEQ ID NO: 1363911 - protein, 12 aa, Mycobacterium tuberculosis
WGPSSDPAWKRN

SEQ ID NO: 1363912 - protein, 15 aa, Mycobacterium tuberculosis
WPVEGTKAEKRAERS

SEQ ID NO: 1363913 - protein, 5 aa, Mycobacterium tuberculosis
WQGPS

SEQ ID NO: 1363914 - protein, 10 aa, Mycobacterium tuberculosis
WQQPEANEET

SEQ ID NO: 1363915 - protein, 10 aa, Mycobacterium tuberculosis
WSPTQASGQT

SEQ ID NO: 1363916 - protein, 9 aa, Mycobacterium tuberculosis
YGGDNANGF

SEQ ID NO: 1363917 - protein, 5 aa, Mycobacterium tuberculosis
YGSGP

SEQ ID NO: 1363918 - protein, 8 aa, Mycobacterium tuberculosis
YPDPSGAG

SEQ ID NO: 1363919 - protein, 9 aa, Mycobacterium tuberculosis
YPNGMPGPE

SEQ ID NO: 1363920 - protein, 7 aa, Mycobacterium tuberculosis
YPNQPNV

SEQ ID NO: 1363921 - protein, 4 aa, Mycobacterium tuberculosis
YPRE

SEQ ID NO: 1363922 - protein, 5 aa, Mycobacterium tuberculosis
YQTNY

SEQ ID NO: 1363923 - protein, 18 aa, Mycobacterium tuberculosis
YRGNDKKMRTEEVDAERA

SEQ ID NO: 1363924 - protein, 7 aa, Mycobacterium tuberculosis
YRRPPAE

SEQ ID NO: 1363925 - protein, 6 aa, Mycobacterium tuberculosis
YRTATE

SEQ ID NO: 1363926 - protein, 4 aa, Mycobacterium tuberculosis
YRTT

SEQ ID NO: 1363927 - protein, 6 aa, Mycobacterium tuberculosis
YSATPY

SEQ ID NO: 1363928 - protein, 7 aa, Mycobacterium tuberculosis
YSEHPAA

SEQ ID NO: 1363929 - protein, 8 aa, Mycobacterium tuberculosis
YTTTTTGA

SEQ ID NO: 1363930 - protein, 19 aa, Mycobacterium tuberculosis
AAAAASGTDGAEPGAAEPA

SEQ ID NO: 1363931 - protein, 7 aa, Mycobacterium tuberculosis
AAAAGTS

SEQ ID NO: 1363932 - protein, 8 aa, Mycobacterium tuberculosis
AAADEVST

SEQ ID NO: 1363933 - protein, 11 aa, Mycobacterium tuberculosis
AAAGTNPTVPT

SEQ ID NO: 1363934 - protein, 8 aa, Mycobacterium tuberculosis
AAAIPDAT

SEQ ID NO: 1363935 - protein, 15 aa, Mycobacterium tuberculosis
AAASAPAGAPATAGI

SEQ ID NO: 1363936 - protein, 7 aa, Mycobacterium tuberculosis
AADPTTC

SEQ ID NO: 1363937 - protein, 7 aa, Mycobacterium tuberculosis
AAEQTRP

SEQ ID NO: 1363938 - protein, 4 aa, Mycobacterium tuberculosis
AAER

SEQ ID NO: 1363939 - protein, 7 aa, Mycobacterium tuberculosis
AAPAKRS

SEQ ID NO: 1363940 - protein, 11 aa, Mycobacterium tuberculosis
AAPASNGPQVH

SEQ ID NO: 1363941 - protein, 27 aa, Mycobacterium tuberculosis
AAPPAGLPGPAPVAATPGLSGGSQPMV

SEQ ID NO: 1363942 - protein, 19 aa, Mycobacterium tuberculosis
AAQSSESPQGTPPATEAAP

SEQ ID NO: 1363943 - protein, 7 aa, Mycobacterium tuberculosis
AAQTGGV

SEQ ID NO: 1363944 - protein, 21 aa, Mycobacterium tuberculosis
AARTEPPEPPGAYSAARGRFN

SEQ ID NO: 1363945 - protein, 4 aa, Mycobacterium tuberculosis
AASP

SEQ ID NO: 1363946 - protein, 5 aa, Mycobacterium tuberculosis
AASPL

SEQ ID NO: 1363947 - protein, 6 aa, Mycobacterium tuberculosis
AATADA

SEQ ID NO: 1363948 - protein, 6 aa, Mycobacterium tuberculosis
AAVRPE

SEQ ID NO: 1363949 - protein, 9 aa, Mycobacterium tuberculosis
ADESSSALL

SEQ ID NO: 1363950 - protein, 5 aa, Mycobacterium tuberculosis
ADEVS

SEQ ID NO: 1363951 - protein, 6 aa, Mycobacterium tuberculosis
ADFSGT

SEQ ID NO: 1363952 - protein, 4 aa, Mycobacterium tuberculosis
ADLP

SEQ ID NO: 1363953 - protein, 6 aa, Mycobacterium tuberculosis
ADPTRC

SEQ ID NO: 1363954 - protein, 5 aa, Mycobacterium tuberculosis
ADQRP

SEQ ID NO: 1363955 - protein, 6 aa, Mycobacterium tuberculosis
AEAEPA

SEQ ID NO: 1363956 - protein, 6 aa, Mycobacterium tuberculosis
AGASFT

SEQ ID NO: 1363957 - protein, 10 aa, Mycobacterium tuberculosis
AGETTAPVGP

SEQ ID NO: 1363958 - protein, 12 aa, Mycobacterium tuberculosis
AGEVGGKLDEAT

SEQ ID NO: 1363959 - protein, 13 aa, Mycobacterium tuberculosis
AGGAFRMASGLGH

SEQ ID NO: 1363960 - protein, 16 aa, Mycobacterium tuberculosis
AGGGPSQLASMGSQQA

SEQ ID NO: 1363961 - protein, 7 aa, Mycobacterium tuberculosis
AGGSRPL

SEQ ID NO: 1363962 - protein, 6 aa, Mycobacterium tuberculosis
AGHDED

SEQ ID NO: 1363963 - protein, 14 aa, Mycobacterium tuberculosis
AGHRAPHRGSGFTG

SEQ ID NO: 1363964 - protein, 6 aa, Mycobacterium tuberculosis
AGHSRE

SEQ ID NO: 1363965 - protein, 11 aa, Mycobacterium tuberculosis
AGLAGSQNTGK

SEQ ID NO: 1363966 - protein, 10 aa, Mycobacterium tuberculosis
AGNGGPPVTR

SEQ ID NO: 1363967 - protein, 8 aa, Mycobacterium tuberculosis
AGRAPVGT

SEQ ID NO: 1363968 - protein, 8 aa, Mycobacterium tuberculosis
AGRYGADP

SEQ ID NO: 1363969 - protein, 7 aa, Mycobacterium tuberculosis
AGSGINP

SEQ ID NO: 1363970 - protein, 8 aa, Mycobacterium tuberculosis
AGSSTRYT

SEQ ID NO: 1363971 - protein, 9 aa, Mycobacterium tuberculosis
AGTAAPDEI

SEQ ID NO: 1363972 - protein, 9 aa, Mycobacterium tuberculosis
AGVAPSPDQ

SEQ ID NO: 1363973 - protein, 11 aa, Mycobacterium tuberculosis
AGVQSNDGKAA

SEQ ID NO: 1363974 - protein, 10 aa, Mycobacterium tuberculosis
AHNPPAGVDN

SEQ ID NO: 1363975 - protein, 8 aa, Mycobacterium tuberculosis
AHRPRPAT

SEQ ID NO: 1363976 - protein, 6 aa, Mycobacterium tuberculosis
AIGAGQ

SEQ ID NO: 1363977 - protein, 7 aa, Mycobacterium tuberculosis
AITGKST

SEQ ID NO: 1363978 - protein, 8 aa, Mycobacterium tuberculosis
AKAGLDGF

SEQ ID NO: 1363979 - protein, 12 aa, Mycobacterium tuberculosis
AKDDARKQNRTT

SEQ ID NO: 1363980 - protein, 11 aa, Mycobacterium tuberculosis
AKNPENRYQTA

SEQ ID NO: 1363981 - protein, 14 aa, Mycobacterium tuberculosis
AKPPSTSAVASRTG

SEQ ID NO: 1363982 - protein, 7 aa, Mycobacterium tuberculosis
AKREKQK

SEQ ID NO: 1363983 - protein, 7 aa, Mycobacterium tuberculosis
AKYPTGP

SEQ ID NO: 1363984 - protein, 14 aa, Mycobacterium tuberculosis
ALPGPFSPSSASVT

SEQ ID NO: 1363985 - protein, 17 aa, Mycobacterium tuberculosis
ALPSPQNGEQPNPTGPA

SEQ ID NO: 1363986 - protein, 5 aa, Mycobacterium tuberculosis
ALPVP

SEQ ID NO: 1363987 - protein, 6 aa, Mycobacterium tuberculosis
AMPPSS

SEQ ID NO: 1363988 - protein, 12 aa, Mycobacterium tuberculosis
ANSYGAAAPRVV

SEQ ID NO: 1363989 - protein, 4 aa, Mycobacterium tuberculosis
APAA

SEQ ID NO: 1363990 - protein, 13 aa, Mycobacterium tuberculosis
APAGVRSPAAVPP

SEQ ID NO: 1363991 - protein, 8 aa, Mycobacterium tuberculosis
APAPDGGI

SEQ ID NO: 1363992 - protein, 13 aa, Mycobacterium tuberculosis
APDAQSDNFSGVA

SEQ ID NO: 1363993 - protein, 23 aa, Mycobacterium tuberculosis
APEHGPGMPRVSDGRAPSTPDEV

SEQ ID NO: 1363994 - protein, 7 aa, Mycobacterium tuberculosis
APPSRGT

SEQ ID NO: 1363995 - protein, 5 aa, Mycobacterium tuberculosis
APSNE

SEQ ID NO: 1363996 - protein, 8 aa, Mycobacterium tuberculosis
AQAVGGLG

SEQ ID NO: 1363997 - protein, 4 aa, Mycobacterium tuberculosis
AQNG

SEQ ID NO: 1363998 - protein, 6 aa, Mycobacterium tuberculosis
AQQSYF

SEQ ID NO: 1363999 - protein, 8 aa, Mycobacterium tuberculosis
AQTAGGGS

SEQ ID NO: 1364000 - protein, 6 aa, Mycobacterium tuberculosis
ARDSNV

SEQ ID NO: 1364001 - protein, 8 aa, Mycobacterium tuberculosis
ARHPGGGV

SEQ ID NO: 1364002 - protein, 17 aa, Mycobacterium tuberculosis
ARRREKAGSPPPDKPMT

SEQ ID NO: 1364003 - protein, 16 aa, Mycobacterium tuberculosis
ASAESSAEKARDSEDR

SEQ ID NO: 1364004 - protein, 13 aa, Mycobacterium tuberculosis
ASASADSGAPTDS

SEQ ID NO: 1364005 - protein, 12 aa, Mycobacterium tuberculosis
ASATQSQPPLPA

SEQ ID NO: 1364006 - protein, 15 aa, Mycobacterium tuberculosis
ASGPRPRPDAVAAEP

SEQ ID NO: 1364007 - protein, 6 aa, Mycobacterium tuberculosis
ASIPGM

SEQ ID NO: 1364008 - protein, 7 aa, Mycobacterium tuberculosis
ASPDPAL

SEQ ID NO: 1364009 - protein, 7 aa, Mycobacterium tuberculosis
ASQPGCA

SEQ ID NO: 1364010 - protein, 11 aa, Mycobacterium tuberculosis
ASTAAASGPAI

SEQ ID NO: 1364011 - protein, 7 aa, Mycobacterium tuberculosis
ASTGTKV

SEQ ID NO: 1364012 - protein, 12 aa, Mycobacterium tuberculosis
ASTLRRSSLESK

SEQ ID NO: 1364013 - protein, 12 aa, Mycobacterium tuberculosis
ATADGADKSGLT

SEQ ID NO: 1364014 - protein, 8 aa, Mycobacterium tuberculosis
ATAPRRLS

SEQ ID NO: 1364015 - protein, 5 aa, Mycobacterium tuberculosis
ATEPS

SEQ ID NO: 1364016 - protein, 12 aa, Mycobacterium tuberculosis
ATNREVDPDGAV

SEQ ID NO: 1364017 - protein, 11 aa, Mycobacterium tuberculosis
ATPDNPYPTTT

SEQ ID NO: 1364018 - protein, 5 aa, Mycobacterium tuberculosis
ATPVQ

SEQ ID NO: 1364019 - protein, 7 aa, Mycobacterium tuberculosis
ATRGRSV

SEQ ID NO: 1364020 - protein, 6 aa, Mycobacterium tuberculosis
ATRRRR

SEQ ID NO: 1364021 - protein, 7 aa, Mycobacterium tuberculosis
ATSSDDG

SEQ ID NO: 1364022 - protein, 9 aa, Mycobacterium tuberculosis
ATTAEPPAH

SEQ ID NO: 1364023 - protein, 6 aa, Mycobacterium tuberculosis
AVAAPT

SEQ ID NO: 1364024 - protein, 10 aa, Mycobacterium tuberculosis
AVAAPTTGLA

SEQ ID NO: 1364025 - protein, 28 aa, Mycobacterium tuberculosis
AVDSPADDGVAPRLAGPEGANGEFDTPI

SEQ ID NO: 1364026 - protein, 10 aa, Mycobacterium tuberculosis
AVEPTDQGAR

SEQ ID NO: 1364027 - protein, 10 aa, Mycobacterium tuberculosis
AVRAAGRTPL

SEQ ID NO: 1364028 - protein, 12 aa, Mycobacterium tuberculosis
AVSGETQQKGSQ

SEQ ID NO: 1364029 - protein, 22 aa, Mycobacterium tuberculosis
AVTSSTALRTSLDGGTDQYQPA

SEQ ID NO: 1364030 - protein, 13 aa, Mycobacterium tuberculosis
AYDDKAKKTTKAV

SEQ ID NO: 1364031 - protein, 10 aa, Mycobacterium tuberculosis
CEQPNAGACS

SEQ ID NO: 1364032 - protein, 4 aa, Mycobacterium tuberculosis
CSND

SEQ ID NO: 1364033 - protein, 6 aa, Mycobacterium tuberculosis
DAASQR

SEQ ID NO: 1364034 - protein, 8 aa, Mycobacterium tuberculosis
DAGARTAG

SEQ ID NO: 1364035 - protein, 12 aa, Mycobacterium tuberculosis
DANYEGEEDVNG

SEQ ID NO: 1364036 - protein, 5 aa, Mycobacterium tuberculosis
DDAET

SEQ ID NO: 1364037 - protein, 8 aa, Mycobacterium tuberculosis
DDAPVPVN

SEQ ID NO: 1364038 - protein, 12 aa, Mycobacterium tuberculosis
DDVDPASTAAVG

SEQ ID NO: 1364039 - protein, 22 aa, Mycobacterium tuberculosis
DEAPVSAAPRTSAPNSETYTRR

SEQ ID NO: 1364040 - protein, 4 aa, Mycobacterium tuberculosis
DEAT

SEQ ID NO: 1364041 - protein, 5 aa, Mycobacterium tuberculosis
DERGV

SEQ ID NO: 1364042 - protein, 8 aa, Mycobacterium tuberculosis
DFGKPDGY

SEQ ID NO: 1364043 - protein, 14 aa, Mycobacterium tuberculosis
DFSPEEQQGSSQIG

SEQ ID NO: 1364044 - protein, 9 aa, Mycobacterium tuberculosis
DGAGPIPEL

SEQ ID NO: 1364045 - protein, 9 aa, Mycobacterium tuberculosis
DGGQLKKYG

SEQ ID NO: 1364046 - protein, 4 aa, Mycobacterium tuberculosis
DGMS

SEQ ID NO: 1364047 - protein, 5 aa, Mycobacterium tuberculosis
DGRGS

SEQ ID NO: 1364048 - protein, 8 aa, Mycobacterium tuberculosis
DGSPDAAL

SEQ ID NO: 1364049 - protein, 9 aa, Mycobacterium tuberculosis
DGVGVTGDT

SEQ ID NO: 1364050 - protein, 10 aa, Mycobacterium tuberculosis
DIPTDARADK

SEQ ID NO: 1364051 - protein, 8 aa, Mycobacterium tuberculosis
DISDGKRP

SEQ ID NO: 1364052 - protein, 24 aa, Mycobacterium tuberculosis
DKKPPLPGGDPSSSVLNRVEYGNR

SEQ ID NO: 1364053 - protein, 5 aa, Mycobacterium tuberculosis
DKPFE

SEQ ID NO: 1364054 - protein, 5 aa, Mycobacterium tuberculosis
DLGAS

SEQ ID NO: 1364055 - protein, 10 aa, Mycobacterium tuberculosis
DLPASGGLYP

SEQ ID NO: 1364056 - protein, 19 aa, Mycobacterium tuberculosis
DNASRGRRRGHLWPTDGSA

SEQ ID NO: 1364057 - protein, 7 aa, Mycobacterium tuberculosis
DNATAMG

SEQ ID NO: 1364058 - protein, 6 aa, Mycobacterium tuberculosis
DNEGSR

SEQ ID NO: 1364059 - protein, 14 aa, Mycobacterium tuberculosis
DNEPQGVAGGGKAV

SEQ ID NO: 1364060 - protein, 18 aa, Mycobacterium tuberculosis
DPAGPASSWARTVKPGAT

SEQ ID NO: 1364061 - protein, 6 aa, Mycobacterium tuberculosis
DPDTPV

SEQ ID NO: 1364062 - protein, 11 aa, Mycobacterium tuberculosis
DPEDDLTPARY

SEQ ID NO: 1364063 - protein, 6 aa, Mycobacterium tuberculosis
DPGAAV

SEQ ID NO: 1364064 - protein, 6 aa, Mycobacterium tuberculosis
DPKRGH

SEQ ID NO: 1364065 - protein, 9 aa, Mycobacterium tuberculosis
DPNGSNTEF

SEQ ID NO: 1364066 - protein, 21 aa, Mycobacterium tuberculosis
DPPRKSRTKASEQELASPYRG

SEQ ID NO: 1364067 - protein, 5 aa, Mycobacterium tuberculosis
DPPTL

SEQ ID NO: 1364068 - protein, 6 aa, Mycobacterium tuberculosis
DQDPGQ

SEQ ID NO: 1364069 - protein, 8 aa, Mycobacterium tuberculosis
DQPLGEKA

SEQ ID NO: 1364070 - protein, 7 aa, Mycobacterium tuberculosis
DRAPASV

SEQ ID NO: 1364071 - protein, 8 aa, Mycobacterium tuberculosis
DRCEEKAE

SEQ ID NO: 1364072 - protein, 5 aa, Mycobacterium tuberculosis
DRNQH

SEQ ID NO: 1364073 - protein, 27 aa, Mycobacterium tuberculosis
DRPAPAKNTSQAKARAKARKAKAPKLV

SEQ ID NO: 1364074 - protein, 7 aa, Mycobacterium tuberculosis
DRPEQPR

SEQ ID NO: 1364075 - protein, 9 aa, Mycobacterium tuberculosis
DSAREMEHN

SEQ ID NO: 1364076 - protein, 7 aa, Mycobacterium tuberculosis
DSGPQTF

SEQ ID NO: 1364077 - protein, 6 aa, Mycobacterium tuberculosis
DSRETW

SEQ ID NO: 1364078 - protein, 8 aa, Mycobacterium tuberculosis
DVPEEQPA

SEQ ID NO: 1364079 - protein, 13 aa, Mycobacterium tuberculosis
EAAKYGATTESSL

SEQ ID NO: 1364080 - protein, 4 aa, Mycobacterium tuberculosis
EAAP

SEQ ID NO: 1364081 - protein, 9 aa, Mycobacterium tuberculosis
EAATRERRG

SEQ ID NO: 1364082 - protein, 6 aa, Mycobacterium tuberculosis
EADTRV

SEQ ID NO: 1364083 - protein, 8 aa, Mycobacterium tuberculosis
EAERRQWS

SEQ ID NO: 1364084 - protein, 10 aa, Mycobacterium tuberculosis
EAPLEATGRG

SEQ ID NO: 1364085 - protein, 6 aa, Mycobacterium tuberculosis
EARSEH

SEQ ID NO: 1364086 - protein, 7 aa, Mycobacterium tuberculosis
EATPEDK

SEQ ID NO: 1364087 - protein, 9 aa, Mycobacterium tuberculosis
EAVKGTPLQ

SEQ ID NO: 1364088 - protein, 9 aa, Mycobacterium tuberculosis
EGDDCPDST

SEQ ID NO: 1364089 - protein, 25 aa, Mycobacterium tuberculosis
EGLRAAQRGQTGTVTSTDYTGSREL

SEQ ID NO: 1364090 - protein, 13 aa, Mycobacterium tuberculosis
EGNDDPRTQVATH

SEQ ID NO: 1364091 - protein, 7 aa, Mycobacterium tuberculosis
EGPMTPK

SEQ ID NO: 1364092 - protein, 10 aa, Mycobacterium tuberculosis
EGSDGTEIDR

SEQ ID NO: 1364093 - protein, 5 aa, Mycobacterium tuberculosis
EGTET

SEQ ID NO: 1364094 - protein, 5 aa, Mycobacterium tuberculosis
EHGEG

SEQ ID NO: 1364095 - protein, 8 aa, Mycobacterium tuberculosis
EHGSTGDR

SEQ ID NO: 1364096 - protein, 6 aa, Mycobacterium tuberculosis
EIEPGA

SEQ ID NO: 1364097 - protein, 7 aa, Mycobacterium tuberculosis
EKSLAEA

SEQ ID NO: 1364098 - protein, 10 aa, Mycobacterium tuberculosis
ELGPQQDTDE

SEQ ID NO: 1364099 - protein, 7 aa, Mycobacterium tuberculosis
EPAKTGA

SEQ ID NO: 1364100 - protein, 19 aa, Mycobacterium tuberculosis
EPGTGSPQPTGTILAELPL

SEQ ID NO: 1364101 - protein, 10 aa, Mycobacterium tuberculosis
EPSEAQTVSA

SEQ ID NO: 1364102 - protein, 8 aa, Mycobacterium tuberculosis
EQVTSPQC

SEQ ID NO: 1364103 - protein, 8 aa, Mycobacterium tuberculosis
ERDADKPA

SEQ ID NO: 1364104 - protein, 6 aa, Mycobacterium tuberculosis
ESEASR

SEQ ID NO: 1364105 - protein, 16 aa, Mycobacterium tuberculosis
ESVPVEKTAGDRVAGA

SEQ ID NO: 1364106 - protein, 7 aa, Mycobacterium tuberculosis
ETGATVS

SEQ ID NO: 1364107 - protein, 16 aa, Mycobacterium tuberculosis
ETKGNPWGQNASDRTN

SEQ ID NO: 1364108 - protein, 11 aa, Mycobacterium tuberculosis
ETSDTQRDTVK

SEQ ID NO: 1364109 - protein, 15 aa, Mycobacterium tuberculosis
EVRPSKGLQVFSFTY

SEQ ID NO: 1364110 - protein, 11 aa, Mycobacterium tuberculosis
EVSTDHAERER

SEQ ID NO: 1364111 - protein, 17 aa, Mycobacterium tuberculosis
EYPRRADDGNAKFADDL

SEQ ID NO: 1364112 - protein, 29 aa, Mycobacterium tuberculosis
FDAAPDADSEGDSKAAKTDEPRPAKRSTL

SEQ ID NO: 1364113 - protein, 5 aa, Mycobacterium tuberculosis
FDSDT

SEQ ID NO: 1364114 - protein, 8 aa, Mycobacterium tuberculosis
FGQAQNQA

SEQ ID NO: 1364115 - protein, 15 aa, Mycobacterium tuberculosis
FQPQENAASDRTDAE

SEQ ID NO: 1364116 - protein, 8 aa, Mycobacterium tuberculosis
FSPGEQVT

SEQ ID NO: 1364117 - protein, 9 aa, Mycobacterium tuberculosis
FSTSDPPDK

SEQ ID NO: 1364118 - protein, 11 aa, Mycobacterium tuberculosis
FTPNGIPADVT

SEQ ID NO: 1364119 - protein, 9 aa, Mycobacterium tuberculosis
FTPNGVPEH

SEQ ID NO: 1364120 - protein, 6 aa, Mycobacterium tuberculosis
GAAEYR

SEQ ID NO: 1364121 - protein, 9 aa, Mycobacterium tuberculosis
GADASSSEI

SEQ ID NO: 1364122 - protein, 18 aa, Mycobacterium tuberculosis
GADLGTAQTKATNASETL

SEQ ID NO: 1364123 - protein, 7 aa, Mycobacterium tuberculosis
GAGGNSY

SEQ ID NO: 1364124 - protein, 4 aa, Mycobacterium tuberculosis
GAGS

SEQ ID NO: 1364125 - protein, 25 aa, Mycobacterium tuberculosis
GAPGSAPREYDTDTSKYTYTGAGGV

SEQ ID NO: 1364126 - protein, 8 aa, Mycobacterium tuberculosis
GAPPYRAD

SEQ ID NO: 1364127 - protein, 26 aa, Mycobacterium tuberculosis
GARRPLRTRPRNKSPITAAGTEVIER

SEQ ID NO: 1364128 - protein, 6 aa, Mycobacterium tuberculosis
GATGPG

SEQ ID NO: 1364129 - protein, 9 aa, Mycobacterium tuberculosis
GATPDTDYA

SEQ ID NO: 1364130 - protein, 9 aa, Mycobacterium tuberculosis
GAVASSSGI

SEQ ID NO: 1364131 - protein, 5 aa, Mycobacterium tuberculosis
GAVST

SEQ ID NO: 1364132 - protein, 18 aa, Mycobacterium tuberculosis
GAWPTDGPPQTGTLGSGQ

SEQ ID NO: 1364133 - protein, 8 aa, Mycobacterium tuberculosis
GDAGSGTL

SEQ ID NO: 1364134 - protein, 7 aa, Mycobacterium tuberculosis
GDATKSD

SEQ ID NO: 1364135 - protein, 13 aa, Mycobacterium tuberculosis
GDEQAVGAPLTTT

SEQ ID NO: 1364136 - protein, 15 aa, Mycobacterium tuberculosis
GDNPATAKAIAQEAG

SEQ ID NO: 1364137 - protein, 9 aa, Mycobacterium tuberculosis
GDPATPEGI

SEQ ID NO: 1364138 - protein, 8 aa, Mycobacterium tuberculosis
GDTRNRGR

SEQ ID NO: 1364139 - protein, 4 aa, Mycobacterium tuberculosis
GEFG

SEQ ID NO: 1364140 - protein, 18 aa, Mycobacterium tuberculosis
GEGFENTTGTLAPRAAVP

SEQ ID NO: 1364141 - protein, 23 aa, Mycobacterium tuberculosis
GESGSEPAGERSADPGEERTESY

SEQ ID NO: 1364142 - protein, 9 aa, Mycobacterium tuberculosis
GGEVTPDSA

SEQ ID NO: 1364143 - protein, 4 aa, Mycobacterium tuberculosis
GGGA

SEQ ID NO: 1364144 - protein, 6 aa, Mycobacterium tuberculosis
GGGARG

SEQ ID NO: 1364145 - protein, 4 aa, Mycobacterium tuberculosis
GGPV

SEQ ID NO: 1364146 - protein, 8 aa, Mycobacterium tuberculosis
GGSAGGHL

SEQ ID NO: 1364147 - protein, 9 aa, Mycobacterium tuberculosis
GGSKPYGYA

SEQ ID NO: 1364148 - protein, 6 aa, Mycobacterium tuberculosis
GGWEPG

SEQ ID NO: 1364149 - protein, 34 aa, Mycobacterium tuberculosis; identical to SEQ ID NO: 151272

SEQ ID NO: 1364150 - protein, 13 aa, Mycobacterium tuberculosis
GHGEHQDGDDVGE

SEQ ID NO: 1364151 - protein, 6 aa, Mycobacterium tuberculosis
GKIAGN

SEQ ID NO: 1364152 - protein, 11 aa, Mycobacterium tuberculosis
GKQYSSGGGAV

SEQ ID NO: 1364153 - protein, 7 aa, Mycobacterium tuberculosis
GKSPGGI

SEQ ID NO: 1364154 - protein, 11 aa, Mycobacterium tuberculosis
GLETRARRQSV

SEQ ID NO: 1364155 - protein, 6 aa, Mycobacterium tuberculosis
GLGGGN

SEQ ID NO: 1364156 - protein, 10 aa, Mycobacterium tuberculosis
GLQTNPNSLS

SEQ ID NO: 1364157 - protein, 9 aa, Mycobacterium tuberculosis
GNDDPANRK

SEQ ID NO: 1364158 - protein, 4 aa, Mycobacterium tuberculosis
GPAA

SEQ ID NO: 1364159 - protein, 10 aa, Mycobacterium tuberculosis
GPAASREHRR

SEQ ID NO: 1364160 - protein, 7 aa, Mycobacterium tuberculosis
GPAATAS

SEQ ID NO: 1364161 - protein, 6 aa, Mycobacterium tuberculosis
GPALSR

SEQ ID NO: 1364162 - protein, 9 aa, Mycobacterium tuberculosis
GPGPGGLAS

SEQ ID NO: 1364163 - protein, 13 aa, Mycobacterium tuberculosis
GPITGGGRATHLR

SEQ ID NO: 1364164 - protein, 6 aa, Mycobacterium tuberculosis
GPLTPA

SEQ ID NO: 1364165 - protein, 9 aa, Mycobacterium tuberculosis
GPNAPSPSQ

SEQ ID NO: 1364166 - protein, 4 aa, Mycobacterium tuberculosis
GPPL

SEQ ID NO: 1364167 - protein, 9 aa, Mycobacterium tuberculosis
GQGAGRSRA

SEQ ID NO: 1364168 - protein, 7 aa, Mycobacterium tuberculosis
GQNDPKL

SEQ ID NO: 1364169 - protein, 12 aa, Mycobacterium tuberculosis
GQPASGRTDNLG

SEQ ID NO: 1364170 - protein, 29 aa, Mycobacterium tuberculosis
GQQDRAGKSWPGSTPKPQEDPVGVAPSAS

SEQ ID NO: 1364171 - protein, 22 aa, Mycobacterium tuberculosis
GRAASNAADSLGRKITEWRQPS

SEQ ID NO: 1364172 - protein, 6 aa, Mycobacterium tuberculosis
GRDGGD

SEQ ID NO: 1364173 - protein, 26 aa, Mycobacterium tuberculosis
GREGRTEVPAGPLADPVNGQPRPAAL

SEQ ID NO: 1364174 - protein, 21 aa, Mycobacterium tuberculosis
GRRQQGVGNQVPPSPRGEGAE

SEQ ID NO: 1364175 - protein, 7 aa, Mycobacterium tuberculosis
GSGVRAY

SEQ ID NO: 1364176 - protein, 11 aa, Mycobacterium tuberculosis
GTKRGPIPSYD

SEQ ID NO: 1364177 - protein, 11 aa, Mycobacterium tuberculosis
GTNPPANQTSA

SEQ ID NO: 1364178 - protein, 6 aa, Mycobacterium tuberculosis
GTQQGV

SEQ ID NO: 1364179 - protein, 8 aa, Mycobacterium tuberculosis
GTSSTYKD

SEQ ID NO: 1364180 - protein, 12 aa, Mycobacterium tuberculosis
GTVKSEDQIPDE

SEQ ID NO: 1364181 - protein, 12 aa, Mycobacterium tuberculosis
GTYTTGAQQQST

SEQ ID NO: 1364182 - protein, 10 aa, Mycobacterium tuberculosis
GVPSQNPNLI

SEQ ID NO: 1364183 - protein, 7 aa, Mycobacterium tuberculosis
GVSDHSA

SEQ ID NO: 1364184 - protein, 14 aa, Mycobacterium tuberculosis
GWYTDPDGSAGQRY

SEQ ID NO: 1364185 - protein, 6 aa, Mycobacterium tuberculosis
GYTPEG

SEQ ID NO: 1364186 - protein, 6 aa, Mycobacterium tuberculosis
HDDNDT

SEQ ID NO: 1364187 - protein, 7 aa, Mycobacterium tuberculosis
HDTGNAM

SEQ ID NO: 1364188 - protein, 20 aa, Mycobacterium tuberculosis
HEIRTGAAAAAQALGPGALG

SEQ ID NO: 1364189 - protein, 4 aa, Mycobacterium tuberculosis
HGPI

SEQ ID NO: 1364190 - protein, 26 aa, Mycobacterium tuberculosis
HNLAGGRDSAAKTGTTQFGDTTANKD

SEQ ID NO: 1364191 - protein, 5 aa, Mycobacterium tuberculosis
HPDSE

SEQ ID NO: 1364192 - protein, 7 aa, Mycobacterium tuberculosis
HQAAQRE

SEQ ID NO: 1364193 - protein, 12 aa, Mycobacterium tuberculosis
HRPPPLPPQQER

SEQ ID NO: 1364194 - protein, 16 aa, Mycobacterium tuberculosis
HRRKAPIPAPKPPHTK

SEQ ID NO: 1364195 - protein, 8 aa, Mycobacterium tuberculosis
HSDPANYG

SEQ ID NO: 1364196 - protein, 13 aa, Mycobacterium tuberculosis
HTNTPGSKNPKRW

SEQ ID NO: 1364197 - protein, 8 aa, Mycobacterium tuberculosis
HYPDRGAP

SEQ ID NO: 1364198 - protein, 9 aa, Mycobacterium tuberculosis
IDGKTNAEA

SEQ ID NO: 1364199 - protein, 9 aa, Mycobacterium tuberculosis
IDGNPATSW

SEQ ID NO: 1364200 - protein, 4 aa, Mycobacterium tuberculosis
IGAG

SEQ ID NO: 1364201 - protein, 4 aa, Mycobacterium tuberculosis
IGGA

SEQ ID NO: 1364202 - protein, 5 aa, Mycobacterium tuberculosis
IGSEG

SEQ ID NO: 1364203 - protein, 5 aa, Mycobacterium tuberculosis
IGSES

SEQ ID NO: 1364204 - protein, 10 aa, Mycobacterium tuberculosis
IGTGGSGGLF

SEQ ID NO: 1364205 - protein, 12 aa, Mycobacterium tuberculosis
IPGGAQDGVKRV

SEQ ID NO: 1364206 - protein, 19 aa, Mycobacterium tuberculosis
IPQNPGAGEPQNPFGSLGS

SEQ ID NO: 1364207 - protein, 4 aa, Mycobacterium tuberculosis
IQRN

SEQ ID NO: 1364208 - protein, 12 aa, Mycobacterium tuberculosis
ISERDDAENARV

SEQ ID NO: 1364209 - protein, 6 aa, Mycobacterium tuberculosis
ITAESR

SEQ ID NO: 1364210 - protein, 24 aa, Mycobacterium tuberculosis
ITAPAPRPKFDPYGQYGRYGQYGQ

SEQ ID NO: 1364211 - protein, 7 aa, Mycobacterium tuberculosis
ITARRQD

SEQ ID NO: 1364212 - protein, 9 aa, Mycobacterium tuberculosis
ITRDHREPV

SEQ ID NO: 1364213 - protein, 11 aa, Mycobacterium tuberculosis
KAGGDTSTLGV

SEQ ID NO: 1364214 - protein, 9 aa, Mycobacterium tuberculosis
KASTDPQAR

SEQ ID NO: 1364215 - protein, 8 aa, Mycobacterium tuberculosis
KDESPNVY

SEQ ID NO: 1364216 - protein, 17 aa, Mycobacterium tuberculosis
KDPSGAPLRSGFPDPNL

SEQ ID NO: 1364217 - protein, 8 aa, Mycobacterium tuberculosis
KEGNTDQR

SEQ ID NO: 1364218 - protein, 9 aa, Mycobacterium tuberculosis
KEKDGGERR

SEQ ID NO: 1364219 - protein, 12 aa, Mycobacterium tuberculosis
KENSNDVAAGRR

SEQ ID NO: 1364220 - protein, 6 aa, Mycobacterium tuberculosis
KEPKRE

SEQ ID NO: 1364221 - protein, 4 aa, Mycobacterium tuberculosis
KGAP

SEQ ID NO: 1364222 - protein, 6 aa, Mycobacterium tuberculosis
KGGGLS

SEQ ID NO: 1364223 - protein, 14 aa, Mycobacterium tuberculosis
KGKPMAADADLDGL

SEQ ID NO: 1364224 - protein, 18 aa, Mycobacterium tuberculosis
KIAGRSDGQTIPASLTRN

SEQ ID NO: 1364225 - protein, 9 aa, Mycobacterium tuberculosis
KKLRQSTNQ

SEQ ID NO: 1364226 - protein, 6 aa, Mycobacterium tuberculosis
KPDDGH

SEQ ID NO: 1364227 - protein, 6 aa, Mycobacterium tuberculosis
KPSWIG

SEQ ID NO: 1364228 - protein, 7 aa, Mycobacterium tuberculosis
KPTSPPV

SEQ ID NO: 1364229 - protein, 6 aa, Mycobacterium tuberculosis
KSMSGP

SEQ ID NO: 1364230 - protein, 8 aa, Mycobacterium tuberculosis
KTGTLTAN

SEQ ID NO: 1364231 - protein, 4 aa, Mycobacterium tuberculosis
KTYP

SEQ ID NO: 1364232 - protein, 9 aa, Mycobacterium tuberculosis
LADTGLPAA

SEQ ID NO: 1364233 - protein, 5 aa, Mycobacterium tuberculosis
LAGAE

SEQ ID NO: 1364234 - protein, 5 aa, Mycobacterium tuberculosis
LARRE

SEQ ID NO: 1364235 - protein, 5 aa, Mycobacterium tuberculosis
LASDD

SEQ ID NO: 1364236 - protein, 7 aa, Mycobacterium tuberculosis
LATDATA

SEQ ID NO: 1364237 - protein, 4 aa, Mycobacterium tuberculosis
LDPA

SEQ ID NO: 1364238 - protein, 8 aa, Mycobacterium tuberculosis
LDRGQEAG

SEQ ID NO: 1364239 - protein, 10 aa, Mycobacterium tuberculosis
LETGELSPYP

SEQ ID NO: 1364240 - protein, 15 aa, Mycobacterium tuberculosis
LGQSGQRPGRRHVPA

SEQ ID NO: 1364241 - protein, 9 aa, Mycobacterium tuberculosis
LKDPRGNPV

SEQ ID NO: 1364242 - protein, 5 aa, Mycobacterium tuberculosis
LNGGG

SEQ ID NO: 1364243 - protein, 6 aa, Mycobacterium tuberculosis
LNTEDR

SEQ ID NO: 1364244 - protein, 16 aa, Mycobacterium tuberculosis
LPADDGAPLAAAGGSR

SEQ ID NO: 1364245 - protein, 8 aa, Mycobacterium tuberculosis
LPDDQRKE

SEQ ID NO: 1364246 - protein, 8 aa, Mycobacterium tuberculosis
LPGTDRRN

SEQ ID NO: 1364247 - protein, 15 aa, Mycobacterium tuberculosis
LPPPPPQPGIDCRAA

SEQ ID NO: 1364248 - protein, 6 aa, Mycobacterium tuberculosis
LPTSGS

SEQ ID NO: 1364249 - protein, 7 aa, Mycobacterium tuberculosis
LPVPPSM

SEQ ID NO: 1364250 - protein, 7 aa, Mycobacterium tuberculosis
LQPPPEV

SEQ ID NO: 1364251 - protein, 8 aa, Mycobacterium tuberculosis
LRPPERAQ

SEQ ID NO: 1364252 - protein, 14 aa, Mycobacterium tuberculosis
LRSGVGSPTVFATS

SEQ ID NO: 1364253 - protein, 5 aa, Mycobacterium tuberculosis
LRSSG

SEQ ID NO: 1364254 - protein, 6 aa, Mycobacterium tuberculosis
LSAGDT

SEQ ID NO: 1364255 - protein, 13 aa, Mycobacterium tuberculosis
LSEATAAAAIPTT

SEQ ID NO: 1364256 - protein, 13 aa, Mycobacterium tuberculosis
LSEDGKGGPPNNG

SEQ ID NO: 1364257 - protein, 11 aa, Mycobacterium tuberculosis
LSERAEGPITA

SEQ ID NO: 1364258 - protein, 5 aa, Mycobacterium tuberculosis
LSGGQ

SEQ ID NO: 1364259 - protein, 25 aa, Mycobacterium tuberculosis
LSGPSNVGVEEEDTDAVDTTPTPVV

SEQ ID NO: 1364260 - protein, 9 aa, Mycobacterium tuberculosis
LTGPGGATQ

SEQ ID NO: 1364261 - protein, 6 aa, Mycobacterium tuberculosis
LTNAPQ

SEQ ID NO: 1364262 - protein, 14 aa, Mycobacterium tuberculosis
LTRQDSSDLPPTTE

SEQ ID NO: 1364263 - protein, 18 aa, Mycobacterium tuberculosis
LTTDNQMSYNDSRAEGTR

SEQ ID NO: 1364264 - protein, 8 aa, Mycobacterium tuberculosis
MAKNPAER

SEQ ID NO: 1364265 - protein, 6 aa, Mycobacterium tuberculosis
MPTPAE

SEQ ID NO: 1364266 - protein, 11 aa, Mycobacterium tuberculosis
MSDPPRAAAAS

SEQ ID NO: 1364267 - protein, 11 aa, Mycobacterium tuberculosis
NARGGPGGAPG

SEQ ID NO: 1364268 - protein, 4 aa, Mycobacterium tuberculosis
NDPR

SEQ ID NO: 1364269 - protein, 7 aa, Mycobacterium tuberculosis
NGQPTIS

SEQ ID NO: 1364270 - protein, 4 aa, Mycobacterium tuberculosis
NPDA

SEQ ID NO: 1364271 - protein, 8 aa, Mycobacterium tuberculosis
NPNNPNGG

SEQ ID NO: 1364272 - protein, 6 aa, Mycobacterium tuberculosis
NPPPVP

SEQ ID NO: 1364273 - protein, 19 aa, Mycobacterium tuberculosis
NPTAAMSQDELSGRVAALT

SEQ ID NO: 1364274 - protein, 6 aa, Mycobacterium tuberculosis
NQSTAL

SEQ ID NO: 1364275 - protein, 5 aa, Mycobacterium tuberculosis
NSGPI

SEQ ID NO: 1364276 - protein, 9 aa, Mycobacterium tuberculosis
NTEPAAGSV

SEQ ID NO: 1364277 - protein, 14 aa, Mycobacterium tuberculosis
PAKSQQPTGTGGQR

SEQ ID NO: 1364278 - protein, 16 aa, Mycobacterium tuberculosis
PAPQPSQLRPGRVPPA

SEQ ID NO: 1364279 - protein, 6 aa, Mycobacterium tuberculosis
PATEPL

SEQ ID NO: 1364280 - protein, 5 aa, Mycobacterium tuberculosis
PDEND

SEQ ID NO: 1364281 - protein, 8 aa, Mycobacterium tuberculosis
PDPTPQPL

SEQ ID NO: 1364282 - protein, 15 aa, Mycobacterium tuberculosis
PDSRPARPVSAEGGY

SEQ ID NO: 1364283 - protein, 8 aa, Mycobacterium tuberculosis
PEAVPPDV

SEQ ID NO: 1364284 - protein, 25 aa, Mycobacterium tuberculosis
PEPDPPPQAAPWPQQAPDGPGFSPP

SEQ ID NO: 1364285 - protein, 4 aa, Mycobacterium tuberculosis
PEQV

SEQ ID NO: 1364286 - protein, 5 aa, Mycobacterium tuberculosis
PEREP

SEQ ID NO: 1364287 - protein, 8 aa, Mycobacterium tuberculosis
PGAPRLPK

SEQ ID NO: 1364288 - protein, 7 aa, Mycobacterium tuberculosis
PGDVATA

SEQ ID NO: 1364289 - protein, 18 aa, Mycobacterium tuberculosis
PGEKIPVDGEVTDGRAAV

SEQ ID NO: 1364290 - protein, 12 aa, Mycobacterium tuberculosis
PGGGNFTATPAR

SEQ ID NO: 1364291 - protein, 5 aa, Mycobacterium tuberculosis
PGGSR

SEQ ID NO: 1364292 - protein, 9 aa, Mycobacterium tuberculosis
PGKEDDEPI

SEQ ID NO: 1364293 - protein, 4 aa, Mycobacterium tuberculosis
PGLP

SEQ ID NO: 1364294 - protein, 8 aa, Mycobacterium tuberculosis
PGLPGLPS

SEQ ID NO: 1364295 - protein, 9 aa, Mycobacterium tuberculosis
PGVRPGSGA

SEQ ID NO: 1364296 - protein, 7 aa, Mycobacterium tuberculosis
PHNSNSL

SEQ ID NO: 1364297 - protein, 8 aa, Mycobacterium tuberculosis
PHQSGGGA

SEQ ID NO: 1364298 - protein, 9 aa, Mycobacterium tuberculosis
PLDPSDPRD

SEQ ID NO: 1364299 - protein, 46 aa, Mycobacterium tuberculosis; identical to SEQ ID NO: 152913

SEQ ID NO: 1364300 - protein, 7 aa, Mycobacterium tuberculosis
PNAAPRT

SEQ ID NO: 1364301 - protein, 26 aa, Mycobacterium tuberculosis
PNGPRRPGPPGQPRRVRQGGTAITPP

SEQ ID NO: 1364302 - protein, 7 aa, Mycobacterium tuberculosis
PPASDTN

SEQ ID NO: 1364303 - protein, 10 aa, Mycobacterium tuberculosis
PPGPASAPYN

SEQ ID NO: 1364304 - protein, 13 aa, Mycobacterium tuberculosis
PPVVEPGPDRRPI

SEQ ID NO: 1364305 - protein, 15 aa, Mycobacterium tuberculosis
PPYDAASSGVGNSGY

SEQ ID NO: 1364306 - protein, 10 aa, Mycobacterium tuberculosis
PQGGAHDERT

SEQ ID NO: 1364307 - protein, 10 aa, Mycobacterium tuberculosis
PRDDHATPAE

SEQ ID NO: 1364308 - protein, 6 aa, Mycobacterium tuberculosis
PRDGNV

SEQ ID NO: 1364309 - protein, 12 aa, Mycobacterium tuberculosis
PRLAPGAPGGTV

SEQ ID NO: 1364310 - protein, 7 aa, Mycobacterium tuberculosis
PRNPTGK

SEQ ID NO: 1364311 - protein, 5 aa, Mycobacterium tuberculosis
PRPAS

SEQ ID NO: 1364312 - protein, 12 aa, Mycobacterium tuberculosis
PRRSTPGPSDRR

SEQ ID NO: 1364313 - protein, 5 aa, Mycobacterium tuberculosis
PRVQA

SEQ ID NO: 1364314 - protein, 23 aa, Mycobacterium tuberculosis
PSIADQVKESADSYNASAGPVGD

SEQ ID NO: 1364315 - protein, 5 aa, Mycobacterium tuberculosis
PTLSR

SEQ ID NO: 1364316 - protein, 9 aa, Mycobacterium tuberculosis
PTNEQRDRA

SEQ ID NO: 1364317 - protein, 6 aa, Mycobacterium tuberculosis
PTPSLD

SEQ ID NO: 1364318 - protein, 5 aa, Mycobacterium tuberculosis
PTSWE

SEQ ID NO: 1364319 - protein, 6 aa, Mycobacterium tuberculosis
PTYSNG

SEQ ID NO: 1364320 - protein, 8 aa, Mycobacterium tuberculosis
PVGAATSS

SEQ ID NO: 1364321 - protein, 15 aa, Mycobacterium tuberculosis
PVRGEPARKSLQCRP

SEQ ID NO: 1364322 - protein, 18 aa, Mycobacterium tuberculosis
PYAQRSSLEGPVTSPTGI

SEQ ID NO: 1364323 - protein, 5 aa, Mycobacterium tuberculosis
QADPD

SEQ ID NO: 1364324 - protein, 11 aa, Mycobacterium tuberculosis
QAQGDKAPVQR

SEQ ID NO: 1364325 - protein, 9 aa, Mycobacterium tuberculosis
QARAETDAA

SEQ ID NO: 1364326 - protein, 9 aa, Mycobacterium tuberculosis
QDARTQRRS

SEQ ID NO: 1364327 - protein, 7 aa, Mycobacterium tuberculosis
QDEKDPV

SEQ ID NO: 1364328 - protein, 7 aa, Mycobacterium tuberculosis
QDGLPDD

SEQ ID NO: 1364329 - protein, 9 aa, Mycobacterium tuberculosis
QEQTSAASA

SEQ ID NO: 1364330 - protein, 23 aa, Mycobacterium tuberculosis
QFAEPDDAEYPTDDAAERAQREH

SEQ ID NO: 1364331 - protein, 5 aa, Mycobacterium tuberculosis
QGAAR

SEQ ID NO: 1364332 - protein, 5 aa, Mycobacterium tuberculosis
QGTNT

SEQ ID NO: 1364333 - protein, 13 aa, Mycobacterium tuberculosis
QHAGSEPGPAVAI

SEQ ID NO: 1364334 - protein, 12 aa, Mycobacterium tuberculosis
QHEVDTAEVPSA

SEQ ID NO: 1364335 - protein, 8 aa, Mycobacterium tuberculosis
QLKRERDA

SEQ ID NO: 1364336 - protein, 26 aa, Mycobacterium tuberculosis
QLPPATTRIPAAPPSGPQPRYPTGGQ

SEQ ID NO: 1364337 - protein, 7 aa, Mycobacterium tuberculosis
QNEVSEQ

SEQ ID NO: 1364338 - protein, 17 aa, Mycobacterium tuberculosis
QPGPAEPELSSRDPDIA

SEQ ID NO: 1364339 - protein, 6 aa, Mycobacterium tuberculosis
QPQHAP

SEQ ID NO: 1364340 - protein, 33 aa, Mycobacterium tuberculosis; identical to SEQ ID NO: 153262

SEQ ID NO: 1364341 - protein, 7 aa, Mycobacterium tuberculosis
QPRTANM

SEQ ID NO: 1364342 - protein, 12 aa, Mycobacterium tuberculosis
QQERNNKDPGAM

SEQ ID NO: 1364343 - protein, 8 aa, Mycobacterium tuberculosis
QQSAQPSF

SEQ ID NO: 1364344 - protein, 10 aa, Mycobacterium tuberculosis
QRPPSESSRA

SEQ ID NO: 1364345 - protein, 11 aa, Mycobacterium tuberculosis
QSHSKNYSTRA

SEQ ID NO: 1364346 - protein, 9 aa, Mycobacterium tuberculosis
QSKEQPELA

SEQ ID NO: 1364347 - protein, 10 aa, Mycobacterium tuberculosis
QSLSDAENTL

SEQ ID NO: 1364348 - protein, 8 aa, Mycobacterium tuberculosis
QSNADEDK

SEQ ID NO: 1364349 - protein, 12 aa, Mycobacterium tuberculosis
QSPGQVSPDTKL

SEQ ID NO: 1364350 - protein, 20 aa, Mycobacterium tuberculosis
QSSSKFAPVGDPSSTGVGDV

SEQ ID NO: 1364351 - protein, 6 aa, Mycobacterium tuberculosis
QTQEYQ

SEQ ID NO: 1364352 - protein, 8 aa, Mycobacterium tuberculosis
QTRHPATA

SEQ ID NO: 1364353 - protein, 7 aa, Mycobacterium tuberculosis
QTSGQNL

SEQ ID NO: 1364354 - protein, 8 aa, Mycobacterium tuberculosis
QVNTGDQI

SEQ ID NO: 1364355 - protein, 9 aa, Mycobacterium tuberculosis
QVRKGASQR

SEQ ID NO: 1364356 - protein, 7 aa, Mycobacterium tuberculosis
RAADPGM

SEQ ID NO: 1364357 - protein, 4 aa, Mycobacterium tuberculosis
RAAH

SEQ ID NO: 1364358 - protein, 7 aa, Mycobacterium tuberculosis
RAASESA

SEQ ID NO: 1364359 - protein, 8 aa, Mycobacterium tuberculosis
RADPLTAA

SEQ ID NO: 1364360 - protein, 7 aa, Mycobacterium tuberculosis
RATISRP

SEQ ID NO: 1364361 - protein, 4 aa, Mycobacterium tuberculosis
RDHT

SEQ ID NO: 1364362 - protein, 8 aa, Mycobacterium tuberculosis
RDLRTPGA

SEQ ID NO: 1364363 - protein, 12 aa, Mycobacterium tuberculosis
RDPAQLGGPGLT

SEQ ID NO: 1364364 - protein, 14 aa, Mycobacterium tuberculosis
RDRHGHPDPGPQRR

SEQ ID NO: 1364365 - protein, 11 aa, Mycobacterium tuberculosis
RDTAPAAGPEL

SEQ ID NO: 1364366 - protein, 10 aa, Mycobacterium tuberculosis
READTAGRLT

SEQ ID NO: 1364367 - protein, 14 aa, Mycobacterium tuberculosis
REAPPPATDSTSPE

SEQ ID NO: 1364368 - protein, 4 aa, Mycobacterium tuberculosis
REGA

SEQ ID NO: 1364369 - protein, 7 aa, Mycobacterium tuberculosis
REQQGGR

SEQ ID NO: 1364370 - protein, 8 aa, Mycobacterium tuberculosis
RERGMSTQ

SEQ ID NO: 1364371 - protein, 10 aa, Mycobacterium tuberculosis
REYETSGDMR

SEQ ID NO: 1364372 - protein, 10 aa, Mycobacterium tuberculosis
RGDPASAEGI

SEQ ID NO: 1364373 - protein, 8 aa, Mycobacterium tuberculosis
RGGPAAGH

SEQ ID NO: 1364374 - protein, 5 aa, Mycobacterium tuberculosis
RGNSW

SEQ ID NO: 1364375 - protein, 5 aa, Mycobacterium tuberculosis
RGPAE

SEQ ID NO: 1364376 - protein, 6 aa, Mycobacterium tuberculosis
RGPART

SEQ ID NO: 1364377 - protein, 17 aa, Mycobacterium tuberculosis
RGQTGDRRRQATHPAAV

SEQ ID NO: 1364378 - protein, 13 aa, Mycobacterium tuberculosis
RGSVTAESGNGQT

SEQ ID NO: 1364379 - protein, 7 aa, Mycobacterium tuberculosis
RHAESLG

SEQ ID NO: 1364380 - protein, 7 aa, Mycobacterium tuberculosis
RHPGGAS

SEQ ID NO: 1364381 - protein, 14 aa, Mycobacterium tuberculosis
RHRRPNPSAPRSPL

SEQ ID NO: 1364382 - protein, 5 aa, Mycobacterium tuberculosis
RITPR

SEQ ID NO: 1364383 - protein, 8 aa, Mycobacterium tuberculosis
RKDPAYSH

SEQ ID NO: 1364384 - protein, 28 aa, Mycobacterium tuberculosis
RKPARPHDSHNGPTRESDQDTAASTTSC

SEQ ID NO: 1364385 - protein, 10 aa, Mycobacterium tuberculosis
RMESTDSVGQ

SEQ ID NO: 1364386 - protein, 11 aa, Mycobacterium tuberculosis
RPDAYTAADKL

SEQ ID NO: 1364387 - protein, 6 aa, Mycobacterium tuberculosis
RPHQDA

SEQ ID NO: 1364388 - protein, 9 aa, Mycobacterium tuberculosis
RPNAADVER

SEQ ID NO: 1364389 - protein, 8 aa, Mycobacterium tuberculosis
RPQQPPPA

SEQ ID NO: 1364390 - protein, 9 aa, Mycobacterium tuberculosis
RPSPPPTVA

SEQ ID NO: 1364391 - protein, 8 aa, Mycobacterium tuberculosis
RPTDRARR

SEQ ID NO: 1364392 - protein, 22 aa, Mycobacterium tuberculosis
RPTVPEAHTRQGARRIQPHLHR

SEQ ID NO: 1364393 - protein, 12 aa, Mycobacterium tuberculosis
RQPKQHQYAQPV

SEQ ID NO: 1364394 - protein, 5 aa, Mycobacterium tuberculosis
RRADR

SEQ ID NO: 1364395 - protein, 8 aa, Mycobacterium tuberculosis
RRGRGTPT

SEQ ID NO: 1364396 - protein, 9 aa, Mycobacterium tuberculosis
RRPGDTSAT

SEQ ID NO: 1364397 - protein, 5 aa, Mycobacterium tuberculosis
RRPLE

SEQ ID NO: 1364398 - protein, 9 aa, Mycobacterium tuberculosis
RRPSPLPTP

SEQ ID NO: 1364399 - protein, 12 aa, Mycobacterium tuberculosis
RRYAEAGNPYPG

SEQ ID NO: 1364400 - protein, 7 aa, Mycobacterium tuberculosis
RRYPSEP

SEQ ID NO: 1364401 - protein, 9 aa, Mycobacterium tuberculosis
RSAASGAAL

SEQ ID NO: 1364402 - protein, 12 aa, Mycobacterium tuberculosis
RSADNRDCPSRT

SEQ ID NO: 1364403 - protein, 13 aa, Mycobacterium tuberculosis
RSFSASVSGTELT

SEQ ID NO: 1364404 - protein, 8 aa, Mycobacterium tuberculosis
RSPRPPQA

SEQ ID NO: 1364405 - protein, 9 aa, Mycobacterium tuberculosis
RSQIDPTNR

SEQ ID NO: 1364406 - protein, 32 aa, Mycobacterium tuberculosis; identical to SEQ ID NO: 153756

SEQ ID NO: 1364407 - protein, 8 aa, Mycobacterium tuberculosis
RSREGQAL

SEQ ID NO: 1364408 - protein, 5 aa, Mycobacterium tuberculosis
RSREM

SEQ ID NO: 1364409 - protein, 18 aa, Mycobacterium tuberculosis
RSSGPRTSAPPPPPPADA

SEQ ID NO: 1364410 - protein, 6 aa, Mycobacterium tuberculosis
RTAGRG

SEQ ID NO: 1364411 - protein, 5 aa, Mycobacterium tuberculosis
RTESG

SEQ ID NO: 1364412 - protein, 10 aa, Mycobacterium tuberculosis
RTGPAGDDNI

SEQ ID NO: 1364413 - protein, 7 aa, Mycobacterium tuberculosis
RTGPNAP

SEQ ID NO: 1364414 - protein, 6 aa, Mycobacterium tuberculosis
RVEPAR

SEQ ID NO: 1364415 - protein, 11 aa, Mycobacterium tuberculosis
RVKPSNRGLQS

SEQ ID NO: 1364416 - protein, 15 aa, Mycobacterium tuberculosis
SAAPHALAGEPSPTP

SEQ ID NO: 1364417 - protein, 5 aa, Mycobacterium tuberculosis
SAATR

SEQ ID NO: 1364418 - protein, 7 aa, Mycobacterium tuberculosis
SAEDKIN

SEQ ID NO: 1364419 - protein, 10 aa, Mycobacterium tuberculosis
SAGSPRDTDA

SEQ ID NO: 1364420 - protein, 7 aa, Mycobacterium tuberculosis
SAKERPR

SEQ ID NO: 1364421 - protein, 5 aa, Mycobacterium tuberculosis
SAPRA

SEQ ID NO: 1364422 - protein, 6 aa, Mycobacterium tuberculosis
SAPRCP

SEQ ID NO: 1364423 - protein, 15 aa, Mycobacterium tuberculosis
SAQNGDGGQADSGAA

SEQ ID NO: 1364424 - protein, 8 aa, Mycobacterium tuberculosis
SATEGASV

SEQ ID NO: 1364425 - protein, 14 aa, Mycobacterium tuberculosis
SATGYRAPDGPYET

SEQ ID NO: 1364426 - protein, 9 aa, Mycobacterium tuberculosis
SDDGGPERF

SEQ ID NO: 1364427 - protein, 25 aa, Mycobacterium tuberculosis
SDDTHTGGAVQKPRGLNDENPPTAI

SEQ ID NO: 1364428 - protein, 11 aa, Mycobacterium tuberculosis
SDDTTRSRAKT

SEQ ID NO: 1364429 - protein, 13 aa, Mycobacterium tuberculosis
SDGTGTALDSASL

SEQ ID NO: 1364430 - protein, 4 aa, Mycobacterium tuberculosis
SDHA

SEQ ID NO: 1364431 - protein, 5 aa, Mycobacterium tuberculosis
SDYGG

SEQ ID NO: 1364432 - protein, 9 aa, Mycobacterium tuberculosis
SEADPAAGR

SEQ ID NO: 1364433 - protein, 10 aa, Mycobacterium tuberculosis
SEGEDLETED

SEQ ID NO: 1364434 - protein, 7 aa, Mycobacterium tuberculosis
SFQPNDK

SEQ ID NO: 1364435 - protein, 9 aa, Mycobacterium tuberculosis
SGDGSTYMP

SEQ ID NO: 1364436 - protein, 4 aa, Mycobacterium tuberculosis
SGFS

SEQ ID NO: 1364437 - protein, 4 aa, Mycobacterium tuberculosis
SGGI

SEQ ID NO: 1364438 - protein, 8 aa, Mycobacterium tuberculosis
SGGLNKDE

SEQ ID NO: 1364439 - protein, 4 aa, Mycobacterium tuberculosis
SGPT

SEQ ID NO: 1364440 - protein, 11 aa, Mycobacterium tuberculosis
SGRTGALSRSA

SEQ ID NO: 1364441 - protein, 4 aa, Mycobacterium tuberculosis
SGVP

SEQ ID NO: 1364442 - protein, 8 aa, Mycobacterium tuberculosis
SKETRPDV

SEQ ID NO: 1364443 - protein, 11 aa, Mycobacterium tuberculosis
SKSRSNGSGHG

SEQ ID NO: 1364444 - protein, 12 aa, Mycobacterium tuberculosis
SLRRTDKQKDSG

SEQ ID NO: 1364445 - protein, 4 aa, Mycobacterium tuberculosis
SMEP

SEQ ID NO: 1364446 - protein, 17 aa, Mycobacterium tuberculosis
SNGKRVTSEPEGLATGN

SEQ ID NO: 1364447 - protein, 7 aa, Mycobacterium tuberculosis
SNRSHTA

SEQ ID NO: 1364448 - protein, 5 aa, Mycobacterium tuberculosis
SPAAF

SEQ ID NO: 1364449 - protein, 13 aa, Mycobacterium tuberculosis
SPDGGADNPGEAD

SEQ ID NO: 1364450 - protein, 4 aa, Mycobacterium tuberculosis
SPEQ

SEQ ID NO: 1364451 - protein, 5 aa, Mycobacterium tuberculosis
SPEQK

SEQ ID NO: 1364452 - protein, 11 aa, Mycobacterium tuberculosis
SPKSLTGNQTD

SEQ ID NO: 1364453 - protein, 15 aa, Mycobacterium tuberculosis
SPPTLTSGRPSGNLP

SEQ ID NO: 1364454 - protein, 20 aa, Mycobacterium tuberculosis
SPQGGGPVNAYPPSRPGEKN

SEQ ID NO: 1364455 - protein, 11 aa, Mycobacterium tuberculosis
SPRSPAAPSLR

SEQ ID NO: 1364456 - protein, 6 aa, Mycobacterium tuberculosis
SQAGDL

SEQ ID NO: 1364457 - protein, 10 aa, Mycobacterium tuberculosis
SQAQQGGQQH

SEQ ID NO: 1364458 - protein, 6 aa, Mycobacterium tuberculosis
SQDTTH

SEQ ID NO: 1364459 - protein, 6 aa, Mycobacterium tuberculosis
SQIGGE

SEQ ID NO: 1364460 - protein, 7 aa, Mycobacterium tuberculosis
SRGDAGE

SEQ ID NO: 1364461 - protein, 8 aa, Mycobacterium tuberculosis
SRPLGAGT

SEQ ID NO: 1364462 - protein, 4 aa, Mycobacterium tuberculosis
SRTP

SEQ ID NO: 1364463 - protein, 63 aa, Mycobacterium tuberculosis; identical to SEQ ID NO: 154210

SEQ ID NO: 1364464 - protein, 4 aa, Mycobacterium tuberculosis
SSAP

SEQ ID NO: 1364465 - protein, 10 aa, Mycobacterium tuberculosis
SSARSGALDD

SEQ ID NO: 1364466 - protein, 5 aa, Mycobacterium tuberculosis
SSDGH

SEQ ID NO: 1364467 - protein, 6 aa, Mycobacterium tuberculosis
SSNQLA

SEQ ID NO: 1364468 - protein, 9 aa, Mycobacterium tuberculosis
SSSDQQSLA

SEQ ID NO: 1364469 - protein, 8 aa, Mycobacterium tuberculosis
SSTRGATV

SEQ ID NO: 1364470 - protein, 9 aa, Mycobacterium tuberculosis
SSVGQDLTR

SEQ ID NO: 1364471 - protein, 9 aa, Mycobacterium tuberculosis
SSWQGTAAT

SEQ ID NO: 1364472 - protein, 7 aa, Mycobacterium tuberculosis
STAGWRD

SEQ ID NO: 1364473 - protein, 9 aa, Mycobacterium tuberculosis
STGTPRPPF

SEQ ID NO: 1364474 - protein, 5 aa, Mycobacterium tuberculosis
STHAG

SEQ ID NO: 1364475 - protein, 5 aa, Mycobacterium tuberculosis
STLDG

SEQ ID NO: 1364476 - protein, 7 aa, Mycobacterium tuberculosis
STLGRNL

SEQ ID NO: 1364477 - protein, 6 aa, Mycobacterium tuberculosis
STPARI

SEQ ID NO: 1364478 - protein, 7 aa, Mycobacterium tuberculosis
SVAPSAL

SEQ ID NO: 1364479 - protein, 14 aa, Mycobacterium tuberculosis
SVDDLSDGHAAEQQ

SEQ ID NO: 1364480 - protein, 13 aa, Mycobacterium tuberculosis
SYGENNLAATATS

SEQ ID NO: 1364481 - protein, 13 aa, Mycobacterium tuberculosis
TAAEESLKGTPLE

SEQ ID NO: 1364482 - protein, 13 aa, Mycobacterium tuberculosis
TAAEQRAVPGDGA

SEQ ID NO: 1364483 - protein, 13 aa, Mycobacterium tuberculosis
TAAGSQSADGKAA

SEQ ID NO: 1364484 - protein, 15 aa, Mycobacterium tuberculosis
TAATGASELGSGGRT

SEQ ID NO: 1364485 - protein, 10 aa, Mycobacterium tuberculosis
TAGQGEDPRY

SEQ ID NO: 1364486 - protein, 12 aa, Mycobacterium tuberculosis
TAGRPRSADKPV

SEQ ID NO: 1364487 - protein, 5 aa, Mycobacterium tuberculosis
TALAP

SEQ ID NO: 1364488 - protein, 8 aa, Mycobacterium tuberculosis
TATRQAYG

SEQ ID NO: 1364489 - protein, 9 aa, Mycobacterium tuberculosis
TDDGPDIDP

SEQ ID NO: 1364490 - protein, 15 aa, Mycobacterium tuberculosis
TDDGRSASDPDADHA

SEQ ID NO: 1364491 - protein, 21 aa, Mycobacterium tuberculosis
TDFPSEAPARFEGDSYNEGGP

SEQ ID NO: 1364492 - protein, 8 aa, Mycobacterium tuberculosis
TDPAPANR

SEQ ID NO: 1364493 - protein, 4 aa, Mycobacterium tuberculosis
TDSD

SEQ ID NO: 1364494 - protein, 12 aa, Mycobacterium tuberculosis
TDVGTDSATYAR

SEQ ID NO: 1364495 - protein, 7 aa, Mycobacterium tuberculosis
TELGGQP

SEQ ID NO: 1364496 - protein, 34 aa, Mycobacterium tuberculosis; identical to SEQ ID NO: 154443

SEQ ID NO: 1364497 - protein, 10 aa, Mycobacterium tuberculosis
TGDGRPPGAR

SEQ ID NO: 1364498 - protein, 13 aa, Mycobacterium tuberculosis
TGDQGGSQANESV

SEQ ID NO: 1364499 - protein, 11 aa, Mycobacterium tuberculosis
TGEAETPAGPL

SEQ ID NO: 1364500 - protein, 4 aa, Mycobacterium tuberculosis
TGEQ

SEQ ID NO: 1364501 - protein, 9 aa, Mycobacterium tuberculosis
TGGNTGTQI

SEQ ID NO: 1364502 - protein, 18 aa, Mycobacterium tuberculosis
TGPAALNADQAEAGDKSI

SEQ ID NO: 1364503 - protein, 9 aa, Mycobacterium tuberculosis
TGPAPPGLA

SEQ ID NO: 1364504 - protein, 18 aa, Mycobacterium tuberculosis
TGQTRRECREEIRRSNGW

SEQ ID NO: 1364505 - protein, 6 aa, Mycobacterium tuberculosis
TGRGAE

SEQ ID NO: 1364506 - protein, 9 aa, Mycobacterium tuberculosis
TGSPIPTPS

SEQ ID NO: 1364507 - protein, 7 aa, Mycobacterium tuberculosis
TGTLSEN

SEQ ID NO: 1364508 - protein, 4 aa, Mycobacterium tuberculosis
THDD

SEQ ID NO: 1364509 - protein, 13 aa, Mycobacterium tuberculosis
TIPRTSSGKIGRR

SEQ ID NO: 1364510 - protein, 7 aa, Mycobacterium tuberculosis
TKAAITA

SEQ ID NO: 1364511 - protein, 18 aa, Mycobacterium tuberculosis
TKSHSRPHTSNDNPLSEA

SEQ ID NO: 1364512 - protein, 7 aa, Mycobacterium tuberculosis
TLGTSTE

SEQ ID NO: 1364513 - protein, 5 aa, Mycobacterium tuberculosis
TPAQI

SEQ ID NO: 1364514 - protein, 10 aa, Mycobacterium tuberculosis
TPGTERRTAT

SEQ ID NO: 1364515 - protein, 5 aa, Mycobacterium tuberculosis
TPRYQ

SEQ ID NO: 1364516 - protein, 6 aa, Mycobacterium tuberculosis
TPSSQT

SEQ ID NO: 1364517 - protein, 7 aa, Mycobacterium tuberculosis
TPTTAGT

SEQ ID NO: 1364518 - protein, 15 aa, Mycobacterium tuberculosis
TQATTAASDVQAVPG

SEQ ID NO: 1364519 - protein, 4 aa, Mycobacterium tuberculosis
TQQQ

SEQ ID NO: 1364520 - protein, 11 aa, Mycobacterium tuberculosis
TRPNGEPLKET

SEQ ID NO: 1364521 - protein, 10 aa, Mycobacterium tuberculosis
TRPPRDPDQP

SEQ ID NO: 1364522 - protein, 8 aa, Mycobacterium tuberculosis
TRPPSTSA

SEQ ID NO: 1364523 - protein, 7 aa, Mycobacterium tuberculosis
TSAGSDA

SEQ ID NO: 1364524 - protein, 11 aa, Mycobacterium tuberculosis
TSPADEGPTQA

SEQ ID NO: 1364525 - protein, 8 aa, Mycobacterium tuberculosis
TSTSPNQQ

SEQ ID NO: 1364526 - protein, 4 aa, Mycobacterium tuberculosis
TTAD

SEQ ID NO: 1364527 - protein, 13 aa, Mycobacterium tuberculosis
TTNPPADGPTDTV

SEQ ID NO: 1364528 - protein, 7 aa, Mycobacterium tuberculosis
TTPPPHG

SEQ ID NO: 1364529 - protein, 8 aa, Mycobacterium tuberculosis
TVESPANA

SEQ ID NO: 1364530 - protein, 4 aa, Mycobacterium tuberculosis
TVPT

SEQ ID NO: 1364531 - protein, 5 aa, Mycobacterium tuberculosis
TVSPR

SEQ ID NO: 1364532 - protein, 12 aa, Mycobacterium tuberculosis
TWESSPQQNPLN

SEQ ID NO: 1364533 - protein, 14 aa, Mycobacterium tuberculosis
TYPGRADDSRDAPT

SEQ ID NO: 1364534 - protein, 18 aa, Mycobacterium tuberculosis
VADGAENADSRGSGGRTA

SEQ ID NO: 1364535 - protein, 8 aa, Mycobacterium tuberculosis
VAENTADA

SEQ ID NO: 1364536 - protein, 7 aa, Mycobacterium tuberculosis
VAPETTA

SEQ ID NO: 1364537 - protein, 5 aa, Mycobacterium tuberculosis
VAPTT

SEQ ID NO: 1364538 - protein, 5 aa, Mycobacterium tuberculosis
VDETP

SEQ ID NO: 1364539 - protein, 7 aa, Mycobacterium tuberculosis
VDPEAGR

SEQ ID NO: 1364540 - protein, 7 aa, Mycobacterium tuberculosis
VEGEGCG

SEQ ID NO: 1364541 - protein, 8 aa, Mycobacterium tuberculosis
VEPPKGPA

SEQ ID NO: 1364542 - protein, 10 aa, Mycobacterium tuberculosis
VEQGDSGGPL

SEQ ID NO: 1364543 - protein, 9 aa, Mycobacterium tuberculosis
VESGSEHPI

SEQ ID NO: 1364544 - protein, 7 aa, Mycobacterium tuberculosis
VESTPAT

SEQ ID NO: 1364545 - protein, 6 aa, Mycobacterium tuberculosis
VGAEPT

SEQ ID NO: 1364546 - protein, 11 aa, Mycobacterium tuberculosis
VGGGPDAPGAG

SEQ ID NO: 1364547 - protein, 5 aa, Mycobacterium tuberculosis
VGGKD

SEQ ID NO: 1364548 - protein, 4 aa, Mycobacterium tuberculosis
VGPS

SEQ ID NO: 1364549 - protein, 10 aa, Mycobacterium tuberculosis
VGPSEGSKAR

SEQ ID NO: 1364550 - protein, 10 aa, Mycobacterium tuberculosis
VKPPSSPVTS

SEQ ID NO: 1364551 - protein, 9 aa, Mycobacterium tuberculosis
VMERPGDRS

SEQ ID NO: 1364552 - protein, 8 aa, Mycobacterium tuberculosis
VNDAPAMA

SEQ ID NO: 1364553 - protein, 7 aa, Mycobacterium tuberculosis
VNDPDRA

SEQ ID NO: 1364554 - protein, 13 aa, Mycobacterium tuberculosis
VNDRQEEAGRSGV

SEQ ID NO: 1364555 - protein, 7 aa, Mycobacterium tuberculosis
VNRDQPD

SEQ ID NO: 1364556 - protein, 12 aa, Mycobacterium tuberculosis
VPEEDKGLRTRS

SEQ ID NO: 1364557 - protein, 10 aa, Mycobacterium tuberculosis
VPPDQATDFG

SEQ ID NO: 1364558 - protein, 7 aa, Mycobacterium tuberculosis
VPPGDRA

SEQ ID NO: 1364559 - protein, 5 aa, Mycobacterium tuberculosis
VPPNY

SEQ ID NO: 1364560 - protein, 7 aa, Mycobacterium tuberculosis
VPPPPGI

SEQ ID NO: 1364561 - protein, 8 aa, Mycobacterium tuberculosis
VPPRDAAE

SEQ ID NO: 1364562 - protein, 21 aa, Mycobacterium tuberculosis
VPPVSGGPRHYEAPPPPQPEP

SEQ ID NO: 1364563 - protein, 10 aa, Mycobacterium tuberculosis
VPRPRPDHTQ

SEQ ID NO: 1364564 - protein, 12 aa, Mycobacterium tuberculosis
VPTPAPAREVPT

SEQ ID NO: 1364565 - protein, 13 aa, Mycobacterium tuberculosis
VSGRGSSAARGAA

SEQ ID NO: 1364566 - protein, 13 aa, Mycobacterium tuberculosis
VSKPEGKDKYGEE

SEQ ID NO: 1364567 - protein, 21 aa, Mycobacterium tuberculosis
VSPSPPEASQPAPGPRDPNRP

SEQ ID NO: 1364568 - protein, 7 aa, Mycobacterium tuberculosis
VSTDPVG

SEQ ID NO: 1364569 - protein, 39 aa, Mycobacterium tuberculosis; identical to SEQ ID NO: 155030

SEQ ID NO: 1364570 - protein, 50 aa, Mycobacterium tuberculosis; identical to SEQ ID NO: 155459

SEQ ID NO: 1364571 - protein, 7 aa, Mycobacterium tuberculosis
WKGTTTY

SEQ ID NO: 1364572 - protein, 9 aa, Mycobacterium tuberculosis
WRPGGTAPV

SEQ ID NO: 1364573 - protein, 10 aa, Mycobacterium tuberculosis
WSPDSGETIA

SEQ ID NO: 1364574 - protein, 4 aa, Mycobacterium tuberculosis
YDPS

SEQ ID NO: 1364575 - protein, 5 aa, Mycobacterium tuberculosis
YDSGT

SEQ ID NO: 1364576 - protein, 7 aa, Mycobacterium tuberculosis
YEPPQTA

SEQ ID NO: 1364577 - protein, 5 aa, Mycobacterium tuberculosis
YGPRP

SEQ ID NO: 1364578 - protein, 54 aa, Mycobacterium tuberculosis
YPYGPNTYGQDPYWGGQPQGGSYPPAYPPQQYPPGWPAGPYPPGPPPPGPGSKT

SEQ ID NO: 1364579 - protein, 8 aa, Mycobacterium tuberculosis
YSSPTTPV

SEQ ID NO: 1364580 - protein, 7 aa, Mycobacterium tuberculosis
YYNPPQH

SEQ ID NO: 1364581 - protein, 8 aa, Mycobacterium tuberculosis
AAAPGDQR

SEQ ID NO: 1364582 - protein, 6 aa, Mycobacterium tuberculosis
AAAPTS

SEQ ID NO: 1364583 - protein, 4 aa, Mycobacterium tuberculosis
AAEA

SEQ ID NO: 1364584 - protein, 13 aa, Mycobacterium tuberculosis
AAEEMDAPDRNLP

SEQ ID NO: 1364585 - protein, 6 aa, Mycobacterium tuberculosis
AAGATA

SEQ ID NO: 1364586 - protein, 10 aa, Mycobacterium tuberculosis
AANPAGARRI

SEQ ID NO: 1364587 - protein, 9 aa, Mycobacterium tuberculosis
AANPSTGAF

SEQ ID NO: 1364588 - protein, 7 aa, Mycobacterium tuberculosis
AAPSPVA

SEQ ID NO: 1364589 - protein, 11 aa, Mycobacterium tuberculosis
AAQAAAAAAER

SEQ ID NO: 1364590 - protein, 11 aa, Mycobacterium tuberculosis
AAQTATRDQNV

SEQ ID NO: 1364591 - protein, 14 aa, Mycobacterium tuberculosis
ADAPDAIDEANTAF

SEQ ID NO: 1364592 - protein, 9 aa, Mycobacterium tuberculosis
ADKPKTPRG

SEQ ID NO: 1364593 - protein, 7 aa, Mycobacterium tuberculosis
ADPDRAT

SEQ ID NO: 1364594 - protein, 6 aa, Mycobacterium tuberculosis
ADPIPA

SEQ ID NO: 1364595 - protein, 7 aa, Mycobacterium tuberculosis
ADPRDDA

SEQ ID NO: 1364596 - protein, 8 aa, Mycobacterium tuberculosis
ADQAPDAV

SEQ ID NO: 1364597 - protein, 13 aa, Mycobacterium tuberculosis
AEPAEGPDAPSAA

SEQ ID NO: 1364598 - protein, 6 aa, Mycobacterium tuberculosis
AEPGHV

SEQ ID NO: 1364599 - protein, 6 aa, Mycobacterium tuberculosis
AETGTG

SEQ ID NO: 1364600 - protein, 8 aa, Mycobacterium tuberculosis
AETPGSQW

SEQ ID NO: 1364601 - protein, 11 aa, Mycobacterium tuberculosis
AGGVPQDEGAK

SEQ ID NO: 1364602 - protein, 7 aa, Mycobacterium tuberculosis
AGNGGVA

SEQ ID NO: 1364603 - protein, 4 aa, Mycobacterium tuberculosis
AGPL

SEQ ID NO: 1364604 - protein, 11 aa, Mycobacterium tuberculosis
AGPVRSGRGGR

SEQ ID NO: 1364605 - protein, 62 aa, Mycobacterium tuberculosis; identical to SEQ ID NO: 149683

SEQ ID NO: 1364606 - protein, 10 aa, Mycobacterium tuberculosis
AGSRLGYQES

SEQ ID NO: 1364607 - protein, 5 aa, Mycobacterium tuberculosis
AGTAT

SEQ ID NO: 1364608 - protein, 15 aa, Mycobacterium tuberculosis
AGVSPAPAKPSMSAP

SEQ ID NO: 1364609 - protein, 4 aa, Mycobacterium tuberculosis
AHGT

SEQ ID NO: 1364610 - protein, 6 aa, Mycobacterium tuberculosis
AITGEN

SEQ ID NO: 1364611 - protein, 10 aa, Mycobacterium tuberculosis
ALPAPPRPTV

SEQ ID NO: 1364612 - protein, 7 aa, Mycobacterium tuberculosis
ANQIADP

SEQ ID NO: 1364613 - protein, 22 aa, Mycobacterium tuberculosis
ANYPPDDANYRRSRRPPPMPSA

SEQ ID NO: 1364614 - protein, 25 aa, Mycobacterium tuberculosis
ANYPRADHARREPELPGKQLTGSAR

SEQ ID NO: 1364615 - protein, 8 aa, Mycobacterium tuberculosis
APAASVGS

SEQ ID NO: 1364616 - protein, 16 aa, Mycobacterium tuberculosis
APDPYPGHNPDRPPSR

SEQ ID NO: 1364617 - protein, 9 aa, Mycobacterium tuberculosis
APLPSGSTV

SEQ ID NO: 1364618 - protein, 6 aa, Mycobacterium tuberculosis
APPAQL

SEQ ID NO: 1364619 - protein, 6 aa, Mycobacterium tuberculosis
APPPGV

SEQ ID NO: 1364620 - protein, 10 aa, Mycobacterium tuberculosis
APPPPPGVPP

SEQ ID NO: 1364621 - protein, 7 aa, Mycobacterium tuberculosis
ARANTEI

SEQ ID NO: 1364622 - protein, 11 aa, Mycobacterium tuberculosis
ARATGKASEAI

SEQ ID NO: 1364623 - protein, 15 aa, Mycobacterium tuberculosis
ARGESGEQLSDSEIR

SEQ ID NO: 1364624 - protein, 17 aa, Mycobacterium tuberculosis
ARPQPPNAHPVAQPPAQ

SEQ ID NO: 1364625 - protein, 6 aa, Mycobacterium tuberculosis
ARRQQG

SEQ ID NO: 1364626 - protein, 6 aa, Mycobacterium tuberculosis
ARSSAS

SEQ ID NO: 1364627 - protein, 4 aa, Mycobacterium tuberculosis
ARTD

SEQ ID NO: 1364628 - protein, 25 aa, Mycobacterium tuberculosis
ASDISAPAQPARGKPQQRPPSWSPR

SEQ ID NO: 1364629 - protein, 7 aa, Mycobacterium tuberculosis
ASKNSRL

SEQ ID NO: 1364630 - protein, 14 aa, Mycobacterium tuberculosis
ASRRLRPGRNGIAG

SEQ ID NO: 1364631 - protein, 5 aa, Mycobacterium tuberculosis
ASTDT

SEQ ID NO: 1364632 - protein, 4 aa, Mycobacterium tuberculosis
ATGE

SEQ ID NO: 1364633 - protein, 22 aa, Mycobacterium tuberculosis
AVPSTQPAPPIRAPGGDAADTR

SEQ ID NO: 1364634 - protein, 13 aa, Mycobacterium tuberculosis
DAAHDARAMDPKR

SEQ ID NO: 1364635 - protein, 7 aa, Mycobacterium tuberculosis
DAAPVTQ

SEQ ID NO: 1364636 - protein, 6 aa, Mycobacterium tuberculosis
DARPGD

SEQ ID NO: 1364637 - protein, 9 aa, Mycobacterium tuberculosis
DDGPGMSQE

SEQ ID NO: 1364638 - protein, 9 aa, Mycobacterium tuberculosis
DDPRGATPW

SEQ ID NO: 1364639 - protein, 6 aa, Mycobacterium tuberculosis
DDYPSS

SEQ ID NO: 1364640 - protein, 5 aa, Mycobacterium tuberculosis
DEYRP

SEQ ID NO: 1364641 - protein, 15 aa, Mycobacterium tuberculosis
DGAKATAVPREPDEA

SEQ ID NO: 1364642 - protein, 5 aa, Mycobacterium tuberculosis
DHDQM

SEQ ID NO: 1364643 - protein, 53 aa, Mycobacterium tuberculosis; identical to SEQ ID NO: 150408

SEQ ID NO: 1364644 - protein, 5 aa, Mycobacterium tuberculosis
DKVPA

SEQ ID NO: 1364645 - protein, 14 aa, Mycobacterium tuberculosis
DLERRKREAQQAVQ

SEQ ID NO: 1364646 - protein, 4 aa, Mycobacterium tuberculosis
DLQP

SEQ ID NO: 1364647 - protein, 11 aa, Mycobacterium tuberculosis
DNGSGVPEGER

SEQ ID NO: 1364648 - protein, 6 aa, Mycobacterium tuberculosis
DPEEVR

SEQ ID NO: 1364649 - protein, 16 aa, Mycobacterium tuberculosis
DPERTRKSAQRRDEGV

SEQ ID NO: 1364650 - protein, 7 aa, Mycobacterium tuberculosis
DPLPGTV

SEQ ID NO: 1364651 - protein, 4 aa, Mycobacterium tuberculosis
DPPP

SEQ ID NO: 1364652 - protein, 11 aa, Mycobacterium tuberculosis
DPSAGSDAATE

SEQ ID NO: 1364653 - protein, 7 aa, Mycobacterium tuberculosis
DQITGRP

SEQ ID NO: 1364654 - protein, 7 aa, Mycobacterium tuberculosis
DRPNPTS

SEQ ID NO: 1364655 - protein, 14 aa, Mycobacterium tuberculosis
DRSPRLTASGDPPT

SEQ ID NO: 1364656 - protein, 7 aa, Mycobacterium tuberculosis
DSDSPTY

SEQ ID NO: 1364657 - protein, 7 aa, Mycobacterium tuberculosis
DSQRRQH

SEQ ID NO: 1364658 - protein, 5 aa, Mycobacterium tuberculosis
DSSKT

SEQ ID NO: 1364659 - protein, 5 aa, Mycobacterium tuberculosis
DTAGL

SEQ ID NO: 1364660 - protein, 11 aa, Mycobacterium tuberculosis
DTQGADGPAGL

SEQ ID NO: 1364661 - protein, 21 aa, Mycobacterium tuberculosis
DTSIGEPAVGHAGSKPDAKLS

SEQ ID NO: 1364662 - protein, 8 aa, Mycobacterium tuberculosis
EAEDTRKH

SEQ ID NO: 1364663 - protein, 9 aa, Mycobacterium tuberculosis
EAVGGGEAF

SEQ ID NO: 1364664 - protein, 11 aa, Mycobacterium tuberculosis
EEQATADRLNR

SEQ ID NO: 1364665 - protein, 8 aa, Mycobacterium tuberculosis
EGAPADLR

SEQ ID NO: 1364666 - protein, 7 aa, Mycobacterium tuberculosis
EKTGTMG

SEQ ID NO: 1364667 - protein, 5 aa, Mycobacterium tuberculosis
EMGAD

SEQ ID NO: 1364668 - protein, 9 aa, Mycobacterium tuberculosis
ERGETRHSG

SEQ ID NO: 1364669 - protein, 12 aa, Mycobacterium tuberculosis
ERGPRLGPPPVM

SEQ ID NO: 1364670 - protein, 13 aa, Mycobacterium tuberculosis
ESALTGESTPVHK

SEQ ID NO: 1364671 - protein, 5 aa, Mycobacterium tuberculosis
ESGMS

SEQ ID NO: 1364672 - protein, 12 aa, Mycobacterium tuberculosis
ESLGGAADSDLG

SEQ ID NO: 1364673 - protein, 42 aa, Mycobacterium tuberculosis; identical to SEQ ID NO: 150939

SEQ ID NO: 1364674 - protein, 6 aa, Mycobacterium tuberculosis
EVRPEA

SEQ ID NO: 1364675 - protein, 4 aa, Mycobacterium tuberculosis
FDTP

SEQ ID NO: 1364676 - protein, 13 aa, Mycobacterium tuberculosis
FDTRRGELAPQPV

SEQ ID NO: 1364677 - protein, 9 aa, Mycobacterium tuberculosis
FPEAKEKAR

SEQ ID NO: 1364678 - protein, 17 aa, Mycobacterium tuberculosis
FPPEPVAPDAGSTPRVS

SEQ ID NO: 1364679 - protein, 8 aa, Mycobacterium tuberculosis
GAGLHEAR

SEQ ID NO: 1364680 - protein, 6 aa, Mycobacterium tuberculosis
GAGYQP

SEQ ID NO: 1364681 - protein, 25 aa, Mycobacterium tuberculosis
GAKRPGAKKAAPTPAAPAAPAAPVK

SEQ ID NO: 1364682 - protein, 6 aa, Mycobacterium tuberculosis
GANSGA

SEQ ID NO: 1364683 - protein, 5 aa, Mycobacterium tuberculosis
GCGPG

SEQ ID NO: 1364684 - protein, 23 aa, Mycobacterium tuberculosis
GDEHARERTPDAGRDRTFSGQHR

SEQ ID NO: 1364685 - protein, 9 aa, Mycobacterium tuberculosis
GDFGSGTTT

SEQ ID NO: 1364686 - protein, 16 aa, Mycobacterium tuberculosis
GDGPRAASTAGPVDQV

SEQ ID NO: 1364687 - protein, 6 aa, Mycobacterium tuberculosis
GDIAPT

SEQ ID NO: 1364688 - protein, 9 aa, Mycobacterium tuberculosis
GDNARTAAA

SEQ ID NO: 1364689 - protein, 16 aa, Mycobacterium tuberculosis
GDPNPQAARLPARARG

SEQ ID NO: 1364690 - protein, 15 aa, Mycobacterium tuberculosis
GGAGTLPPEKKPQVG

SEQ ID NO: 1364691 - protein, 4 aa, Mycobacterium tuberculosis
GGLG

SEQ ID NO: 1364692 - protein, 7 aa, Mycobacterium tuberculosis
GGSGTGI

SEQ ID NO: 1364693 - protein, 10 aa, Mycobacterium tuberculosis
GHDASPASDV

SEQ ID NO: 1364694 - protein, 15 aa, Mycobacterium tuberculosis
GITDQNGDEPPRTSD

SEQ ID NO: 1364695 - protein, 12 aa, Mycobacterium tuberculosis
GKTVTVTNKAKT

SEQ ID NO: 1364696 - protein, 11 aa, Mycobacterium tuberculosis
GLQTQTADTAQ

SEQ ID NO: 1364697 - protein, 5 aa, Mycobacterium tuberculosis
GMAPQ

SEQ ID NO: 1364698 - protein, 5 aa, Mycobacterium tuberculosis
GNQDT

SEQ ID NO: 1364699 - protein, 5 aa, Mycobacterium tuberculosis
GNQTT

SEQ ID NO: 1364700 - protein, 6 aa, Mycobacterium tuberculosis
GPHDAP

SEQ ID NO: 1364701 - protein, 5 aa, Mycobacterium tuberculosis
GPHPG

SEQ ID NO: 1364702 - protein, 12 aa, Mycobacterium tuberculosis
GPTPEQPKGPFG

SEQ ID NO: 1364703 - protein, 13 aa, Mycobacterium tuberculosis
GPVTGEQGTGTTA

SEQ ID NO: 1364704 - protein, 8 aa, Mycobacterium tuberculosis
GRPAPTDG

SEQ ID NO: 1364705 - protein, 5 aa, Mycobacterium tuberculosis
GSGAN

SEQ ID NO: 1364706 - protein, 13 aa, Mycobacterium tuberculosis
GSNRVRETESTVS

SEQ ID NO: 1364707 - protein, 12 aa, Mycobacterium tuberculosis
GSSALPTIAVPG

SEQ ID NO: 1364708 - protein, 7 aa, Mycobacterium tuberculosis
GSTGGVI

SEQ ID NO: 1364709 - protein, 5 aa, Mycobacterium tuberculosis
GSVYR

SEQ ID NO: 1364710 - protein, 8 aa, Mycobacterium tuberculosis
GTAIPSNV

SEQ ID NO: 1364711 - protein, 11 aa, Mycobacterium tuberculosis
GTAPAQPPKPR

SEQ ID NO: 1364712 - protein, 17 aa, Mycobacterium tuberculosis
GTATRSGLWSPGKIRIG

SEQ ID NO: 1364713 - protein, 7 aa, Mycobacterium tuberculosis
GTDYVPT

SEQ ID NO: 1364714 - protein, 11 aa, Mycobacterium tuberculosis
GTFSPDPRPNA

SEQ ID NO: 1364715 - protein, 4 aa, Mycobacterium tuberculosis
GTGT

SEQ ID NO: 1364716 - protein, 6 aa, Mycobacterium tuberculosis
GTLTEN

SEQ ID NO: 1364717 - protein, 7 aa, Mycobacterium tuberculosis
GTSGRSV

SEQ ID NO: 1364718 - protein, 19 aa, Mycobacterium tuberculosis
GTTDGKSQADISEITIYAA

SEQ ID NO: 1364719 - protein, 8 aa, Mycobacterium tuberculosis
GTVSTAPA

SEQ ID NO: 1364720 - protein, 11 aa, Mycobacterium tuberculosis
GTVTNTGDRPV

SEQ ID NO: 1364721 - protein, 9 aa, Mycobacterium tuberculosis
GVGGPSSRV

SEQ ID NO: 1364722 - protein, 7 aa, Mycobacterium tuberculosis
GVNDAPA

SEQ ID NO: 1364723 - protein, 13 aa, Mycobacterium tuberculosis
GVPGRGPETRTAN

SEQ ID NO: 1364724 - protein, 6 aa, Mycobacterium tuberculosis
HETTAT

SEQ ID NO: 1364725 - protein, 8 aa, Mycobacterium tuberculosis
HNGGGPLG

SEQ ID NO: 1364726 - protein, 4 aa, Mycobacterium tuberculosis
HSIT

SEQ ID NO: 1364727 - protein, 5 aa, Mycobacterium tuberculosis
IDGPT

SEQ ID NO: 1364728 - protein, 10 aa, Mycobacterium tuberculosis
IGEKTKGRNW

SEQ ID NO: 1364729 - protein, 6 aa, Mycobacterium tuberculosis
IGNGAR

SEQ ID NO: 1364730 - protein, 11 aa, Mycobacterium tuberculosis
IPPGADPDPGV

SEQ ID NO: 1364731 - protein, 5 aa, Mycobacterium tuberculosis
KAETE

SEQ ID NO: 1364732 - protein, 5 aa, Mycobacterium tuberculosis
KALKR

SEQ ID NO: 1364733 - protein, 7 aa, Mycobacterium tuberculosis
KARLGDP

SEQ ID NO: 1364734 - protein, 6 aa, Mycobacterium tuberculosis
KEDKQN

SEQ ID NO: 1364735 - protein, 6 aa, Mycobacterium tuberculosis
KEFDET

SEQ ID NO: 1364736 - protein, 14 aa, Mycobacterium tuberculosis
KEPPPPLPPDLPPN

SEQ ID NO: 1364737 - protein, 8 aa, Mycobacterium tuberculosis
KGDEPLVT

SEQ ID NO: 1364738 - protein, 7 aa, Mycobacterium tuberculosis
KGSPPTI

SEQ ID NO: 1364739 - protein, 13 aa, Mycobacterium tuberculosis
KGTAKKGEVPARP

SEQ ID NO: 1364740 - protein, 5 aa, Mycobacterium tuberculosis
KHGGA

SEQ ID NO: 1364741 - protein, 11 aa, Mycobacterium tuberculosis
KHSKMSQEDQV

SEQ ID NO: 1364742 - protein, 12 aa, Mycobacterium tuberculosis
KPVQPPQPVAEE

SEQ ID NO: 1364743 - protein, 41 aa, Mycobacterium tuberculosis; identical to SEQ ID NO: 152114

SEQ ID NO: 1364744 - protein, 9 aa, Mycobacterium tuberculosis
LARPDTAPA

SEQ ID NO: 1364745 - protein, 7 aa, Mycobacterium tuberculosis
LDGRTNE

SEQ ID NO: 1364746 - protein, 4 aa, Mycobacterium tuberculosis
LDPR

SEQ ID NO: 1364747 - protein, 18 aa, Mycobacterium tuberculosis
LDPRSTRRLDGHTDAPAD

SEQ ID NO: 1364748 - protein, 6 aa, Mycobacterium tuberculosis
LGHGDP

SEQ ID NO: 1364749 - protein, 4 aa, Mycobacterium tuberculosis
LGSP

SEQ ID NO: 1364750 - protein, 11 aa, Mycobacterium tuberculosis
LKDSGKTISDT

SEQ ID NO: 1364751 - protein, 6 aa, Mycobacterium tuberculosis
LNEGRG

SEQ ID NO: 1364752 - protein, 18 aa, Mycobacterium tuberculosis
LNRQTAEAERGGSDRPTT

SEQ ID NO: 1364753 - protein, 5 aa, Mycobacterium tuberculosis
LPGGP

SEQ ID NO: 1364754 - protein, 17 aa, Mycobacterium tuberculosis
LPGTGAFDPAGTSAIGS

SEQ ID NO: 1364755 - protein, 17 aa, Mycobacterium tuberculosis
LPNRRRRGRGRASRARL

SEQ ID NO: 1364756 - protein, 11 aa, Mycobacterium tuberculosis
LPQATPNGAAP

SEQ ID NO: 1364757 - protein, 7 aa, Mycobacterium tuberculosis
LPTTRTA

SEQ ID NO: 1364758 - protein, 8 aa, Mycobacterium tuberculosis
LRAPAADE

SEQ ID NO: 1364759 - protein, 25 aa, Mycobacterium tuberculosis
LSGGSYQNLETSASPDLATAVNIFL

SEQ ID NO: 1364760 - protein, 10 aa, Mycobacterium tuberculosis
LTARGGERGM

SEQ ID NO: 1364761 - protein, 4 aa, Mycobacterium tuberculosis
MPAD

SEQ ID NO: 1364762 - protein, 80 aa, Mycobacterium tuberculosis; identical to SEQ ID NO: 152427

SEQ ID NO: 1364763 - protein, 6 aa, Mycobacterium tuberculosis
NANYPQ

SEQ ID NO: 1364764 - protein, 4 aa, Mycobacterium tuberculosis
NDAK

SEQ ID NO: 1364765 - protein, 16 aa, Mycobacterium tuberculosis
NDYSDGIRGTDDDRVG

SEQ ID NO: 1364766 - protein, 4 aa, Mycobacterium tuberculosis
NEES

SEQ ID NO: 1364767 - protein, 10 aa, Mycobacterium tuberculosis
NGEETRSLDS

SEQ ID NO: 1364768 - protein, 10 aa, Mycobacterium tuberculosis
NGTGKTTTVG

SEQ ID NO: 1364769 - protein, 8 aa, Mycobacterium tuberculosis
NPDLPRSE

SEQ ID NO: 1364770 - protein, 11 aa, Mycobacterium tuberculosis
NPETGKYGPIY

SEQ ID NO: 1364771 - protein, 5 aa, Mycobacterium tuberculosis
NQAGQ

SEQ ID NO: 1364772 - protein, 7 aa, Mycobacterium tuberculosis
NRQPPER

SEQ ID NO: 1364773 - protein, 8 aa, Mycobacterium tuberculosis
NSRQLGTA

SEQ ID NO: 1364774 - protein, 6 aa, Mycobacterium tuberculosis
NTRIGQ

SEQ ID NO: 1364775 - protein, 19 aa, Mycobacterium tuberculosis
PAGGLSNDAVRQAAAKVGQ

SEQ ID NO: 1364776 - protein, 8 aa, Mycobacterium tuberculosis
PALTRSGA

SEQ ID NO: 1364777 - protein, 23 aa, Mycobacterium tuberculosis
PANRVNAAARDAENISDSNSGYP

SEQ ID NO: 1364778 - protein, 5 aa, Mycobacterium tuberculosis
PARRP

SEQ ID NO: 1364779 - protein, 4 aa, Mycobacterium tuberculosis
PDGH

SEQ ID NO: 1364780 - protein, 7 aa, Mycobacterium tuberculosis
PDGPLTG

SEQ ID NO: 1364781 - protein, 6 aa, Mycobacterium tuberculosis
PDPLDG

SEQ ID NO: 1364782 - protein, 4 aa, Mycobacterium tuberculosis
PDTD

SEQ ID NO: 1364783 - protein, 10 aa, Mycobacterium tuberculosis
PEAARTPSTT

SEQ ID NO: 1364784 - protein, 10 aa, Mycobacterium tuberculosis
PGCAPGPDGV

SEQ ID NO: 1364785 - protein, 4 aa, Mycobacterium tuberculosis
PGER

SEQ ID NO: 1364786 - protein, 7 aa, Mycobacterium tuberculosis
PGKRAPT

SEQ ID NO: 1364787 - protein, 8 aa, Mycobacterium tuberculosis
PGNEQAAA

SEQ ID NO: 1364788 - protein, 13 aa, Mycobacterium tuberculosis
PGNVAANVSSGAQ

SEQ ID NO: 1364789 - protein, 7 aa, Mycobacterium tuberculosis
PNAPPID

SEQ ID NO: 1364790 - protein, 4 aa, Mycobacterium tuberculosis
PNLG

SEQ ID NO: 1364791 - protein, 5 aa, Mycobacterium tuberculosis
PNLSP

SEQ ID NO: 1364792 - protein, 5 aa, Mycobacterium tuberculosis
PPEAD

SEQ ID NO: 1364793 - protein, 11 aa, Mycobacterium tuberculosis
PPENPSSTKLR

SEQ ID NO: 1364794 - protein, 4 aa, Mycobacterium tuberculosis
PPGA

SEQ ID NO: 1364795 - protein, 6 aa, Mycobacterium tuberculosis
PPGRSA

SEQ ID NO: 1364796 - protein, 9 aa, Mycobacterium tuberculosis
PPPPPPQPA

SEQ ID NO: 1364797 - protein, 5 aa, Mycobacterium tuberculosis
PPRVP

SEQ ID NO: 1364798 - protein, 7 aa, Mycobacterium tuberculosis
PQEDGPK

SEQ ID NO: 1364799 - protein, 5 aa, Mycobacterium tuberculosis
PQYSD

SEQ ID NO: 1364800 - protein, 13 aa, Mycobacterium tuberculosis
PRNRRSRVNPDAT

SEQ ID NO: 1364801 - protein, 10 aa, Mycobacterium tuberculosis
PSSGNGDAAY

SEQ ID NO: 1364802 - protein, 5 aa, Mycobacterium tuberculosis
PTADK

SEQ ID NO: 1364803 - protein, 15 aa, Mycobacterium tuberculosis
PTPHSRASLARYEIA

SEQ ID NO: 1364804 - protein, 10 aa, Mycobacterium tuberculosis
QAAEEGGESS

SEQ ID NO: 1364805 - protein, 8 aa, Mycobacterium tuberculosis
QAAPTADE

SEQ ID NO: 1364806 - protein, 11 aa, Mycobacterium tuberculosis
QAFSPANLPTT

SEQ ID NO: 1364807 - protein, 8 aa, Mycobacterium tuberculosis
QAGNGLSD

SEQ ID NO: 1364808 - protein, 8 aa, Mycobacterium tuberculosis
QHTPESAD

SEQ ID NO: 1364809 - protein, 26 aa, Mycobacterium tuberculosis
QLHGGTASLENSPLGGARLVLRLPGP

SEQ ID NO: 1364810 - protein, 9 aa, Mycobacterium tuberculosis
QNTSTAGVG

SEQ ID NO: 1364811 - protein, 4 aa, Mycobacterium tuberculosis
QPPL

SEQ ID NO: 1364812 - protein, 26 aa, Mycobacterium tuberculosis
QPPPPPGPVPAPGPAQAPPPESPAQG

SEQ ID NO: 1364813 - protein, 11 aa, Mycobacterium tuberculosis
QPQTPNGSINP

SEQ ID NO: 1364814 - protein, 13 aa, Mycobacterium tuberculosis
QPTAQPLPQSPAE

SEQ ID NO: 1364815 - protein, 6 aa, Mycobacterium tuberculosis
QQASAR

SEQ ID NO: 1364816 - protein, 6 aa, Mycobacterium tuberculosis
QRPALQ

SEQ ID NO: 1364817 - protein, 4 aa, Mycobacterium tuberculosis
QRSQ

SEQ ID NO: 1364818 - protein, 8 aa, Mycobacterium tuberculosis
QSSSTGGP

SEQ ID NO: 1364819 - protein, 8 aa, Mycobacterium tuberculosis
QSTVPGDA

SEQ ID NO: 1364820 - protein, 12 aa, Mycobacterium tuberculosis
QTSNAGEADPVP

SEQ ID NO: 1364821 - protein, 6 aa, Mycobacterium tuberculosis
QVNGGP

SEQ ID NO: 1364822 - protein, 11 aa, Mycobacterium tuberculosis
QVTTTSPKEVT

SEQ ID NO: 1364823 - protein, 13 aa, Mycobacterium tuberculosis
QYGGAAARGLDEA

SEQ ID NO: 1364824 - protein, 8 aa, Mycobacterium tuberculosis
RADPRLGE

SEQ ID NO: 1364825 - protein, 8 aa, Mycobacterium tuberculosis
RAQIPERT

SEQ ID NO: 1364826 - protein, 11 aa, Mycobacterium tuberculosis
RAQPPASTGPV

SEQ ID NO: 1364827 - protein, 6 aa, Mycobacterium tuberculosis
RARTTV

SEQ ID NO: 1364828 - protein, 4 aa, Mycobacterium tuberculosis
RDGT

SEQ ID NO: 1364829 - protein, 9 aa, Mycobacterium tuberculosis
RDRDGAAPI

SEQ ID NO: 1364830 - protein, 13 aa, Mycobacterium tuberculosis
RDSEPSVAGKDPF

SEQ ID NO: 1364831 - protein, 12 aa, Mycobacterium tuberculosis
RGHEQPTRLAVP

SEQ ID NO: 1364832 - protein, 16 aa, Mycobacterium tuberculosis
RGSKVGELAQDTRTSL

SEQ ID NO: 1364833 - protein, 12 aa, Mycobacterium tuberculosis
RGSTASHSGSGL

SEQ ID NO: 1364834 - protein, 7 aa, Mycobacterium tuberculosis
RHAQDQR

SEQ ID NO: 1364835 - protein, 7 aa, Mycobacterium tuberculosis
RLASAGP

SEQ ID NO: 1364836 - protein, 13 aa, Mycobacterium tuberculosis
RLDGERAPVPSAR

SEQ ID NO: 1364837 - protein, 4 aa, Mycobacterium tuberculosis
RLTA

SEQ ID NO: 1364838 - protein, 7 aa, Mycobacterium tuberculosis
RPPAPLT

SEQ ID NO: 1364839 - protein, 15 aa, Mycobacterium tuberculosis
RPPDLPPGTHDAQTD

SEQ ID NO: 1364840 - protein, 17 aa, Mycobacterium tuberculosis
RPPEVGVPSENPRLDEP

SEQ ID NO: 1364841 - protein, 7 aa, Mycobacterium tuberculosis
RPTASSD

SEQ ID NO: 1364842 - protein, 5 aa, Mycobacterium tuberculosis
RPTGV

SEQ ID NO: 1364843 - protein, 18 aa, Mycobacterium tuberculosis
RPVPQPWPSPASARTFAL

SEQ ID NO: 1364844 - protein, 5 aa, Mycobacterium tuberculosis
RQAET

SEQ ID NO: 1364845 - protein, 5 aa, Mycobacterium tuberculosis
RRSAE

SEQ ID NO: 1364846 - protein, 7 aa, Mycobacterium tuberculosis
RSGGPFA

SEQ ID NO: 1364847 - protein, 5 aa, Mycobacterium tuberculosis
RSGIR

SEQ ID NO: 1364848 - protein, 10 aa, Mycobacterium tuberculosis
RSPADESVRE

SEQ ID NO: 1364849 - protein, 9 aa, Mycobacterium tuberculosis
RTAHDDDGI

SEQ ID NO: 1364850 - protein, 16 aa, Mycobacterium tuberculosis
RTSPAPAKPAPNSGRR

SEQ ID NO: 1364851 - protein, 4 aa, Mycobacterium tuberculosis
RVSD

SEQ ID NO: 1364852 - protein, 8 aa, Mycobacterium tuberculosis
SADPAKPI

SEQ ID NO: 1364853 - protein, 12 aa, Mycobacterium tuberculosis
SAESLKETLRGQ

SEQ ID NO: 1364854 - protein, 9 aa, Mycobacterium tuberculosis
SARQASETR

SEQ ID NO: 1364855 - protein, 4 aa, Mycobacterium tuberculosis
SDAD

SEQ ID NO: 1364856 - protein, 8 aa, Mycobacterium tuberculosis
SDGEPATE

SEQ ID NO: 1364857 - protein, 26 aa, Mycobacterium tuberculosis
SDSPDGAAQLPGTPTHPGTGQAAASS

SEQ ID NO: 1364858 - protein, 13 aa, Mycobacterium tuberculosis
SEDGPALPGSDLS

SEQ ID NO: 1364859 - protein, 7 aa, Mycobacterium tuberculosis
SGHQPRV

SEQ ID NO: 1364860 - protein, 4 aa, Mycobacterium tuberculosis
SGIT

SEQ ID NO: 1364861 - protein, 10 aa, Mycobacterium tuberculosis
SGKRPFAGDG

SEQ ID NO: 1364862 - protein, 17 aa, Mycobacterium tuberculosis
SGLTGEFNSDANAIARG

SEQ ID NO: 1364863 - protein, 6 aa, Mycobacterium tuberculosis
SGVTTQ

SEQ ID NO: 1364864 - protein, 7 aa, Mycobacterium tuberculosis
SHLEQAG

SEQ ID NO: 1364865 - protein, 8 aa, Mycobacterium tuberculosis
SKAEAALQ

SEQ ID NO: 1364866 - protein, 7 aa, Mycobacterium tuberculosis
SNGAGTV

SEQ ID NO: 1364867 - protein, 19 aa, Mycobacterium tuberculosis
SNSTGQAGLATTATDQLKR

SEQ ID NO: 1364868 - protein, 6 aa, Mycobacterium tuberculosis
SNTAAT

SEQ ID NO: 1364869 - protein, 8 aa, Mycobacterium tuberculosis
SPDGSVHD

SEQ ID NO: 1364870 - protein, 12 aa, Mycobacterium tuberculosis
SPSVPTANVALI

SEQ ID NO: 1364871 - protein, 4 aa, Mycobacterium tuberculosis
SQPD

SEQ ID NO: 1364872 - protein, 23 aa, Mycobacterium tuberculosis
SRAGANANIGAGDAEDAGGARSD

SEQ ID NO: 1364873 - protein, 8 aa, Mycobacterium tuberculosis
SSEPGDNY

SEQ ID NO: 1364874 - protein, 20 aa, Mycobacterium tuberculosis
SSGPAPDPMHEPPPDNVDEP

SEQ ID NO: 1364875 - protein, 6 aa, Mycobacterium tuberculosis
SSLTGE

SEQ ID NO: 1364876 - protein, 8 aa, Mycobacterium tuberculosis
SSNSAQRA

SEQ ID NO: 1364877 - protein, 5 aa, Mycobacterium tuberculosis
SSRAG

SEQ ID NO: 1364878 - protein, 18 aa, Mycobacterium tuberculosis
SSRPEPSPRPPSVEVQPR

SEQ ID NO: 1364879 - protein, 6 aa, Mycobacterium tuberculosis
STEERR

SEQ ID NO: 1364880 - protein, 6 aa, Mycobacterium tuberculosis
STPTAI

SEQ ID NO: 1364881 - protein, 7 aa, Mycobacterium tuberculosis
TAAAQEA

SEQ ID NO: 1364882 - protein, 13 aa, Mycobacterium tuberculosis
TAAGEPNAAPAAC

SEQ ID NO: 1364883 - protein, 13 aa, Mycobacterium tuberculosis
TAQNDPSTVRGAR

SEQ ID NO: 1364884 - protein, 11 aa, Mycobacterium tuberculosis
TATGGRALPGS

SEQ ID NO: 1364885 - protein, 17 aa, Mycobacterium tuberculosis
TCPPESGPATESLPKSW

SEQ ID NO: 1364886 - protein, 12 aa, Mycobacterium tuberculosis
TEASSGRVPNPY

SEQ ID NO: 1364887 - protein, 14 aa, Mycobacterium tuberculosis
TEDAERQIDSCDPT

SEQ ID NO: 1364888 - protein, 5 aa, Mycobacterium tuberculosis
TGAHS

SEQ ID NO: 1364889 - protein, 9 aa, Mycobacterium tuberculosis
TGASGAGKT

SEQ ID NO: 1364890 - protein, 10 aa, Mycobacterium tuberculosis
TGESDGPPRA

SEQ ID NO: 1364891 - protein, 4 aa, Mycobacterium tuberculosis
TGGI

SEQ ID NO: 1364892 - protein, 9 aa, Mycobacterium tuberculosis
TGPRPGGFG

SEQ ID NO: 1364893 - protein, 7 aa, Mycobacterium tuberculosis
THSSGRI

SEQ ID NO: 1364894 - protein, 10 aa, Mycobacterium tuberculosis
TLPPAGQAPW

SEQ ID NO: 1364895 - protein, 15 aa, Mycobacterium tuberculosis
TLTSKTDPASGAGLA

SEQ ID NO: 1364896 - protein, 19 aa, Mycobacterium tuberculosis
TNANPQPVSESELGHTKRG

SEQ ID NO: 1364897 - protein, 21 aa, Mycobacterium tuberculosis
TPDYSAKKLDTDTWEDGTNGG

SEQ ID NO: 1364898 - protein, 5 aa, Mycobacterium tuberculosis
TPGAV

SEQ ID NO: 1364899 - protein, 7 aa, Mycobacterium tuberculosis
TPKAPGL

SEQ ID NO: 1364900 - protein, 15 aa, Mycobacterium tuberculosis
TPPQTPGGTAPRART

SEQ ID NO: 1364901 - protein, 6 aa, Mycobacterium tuberculosis
TPRPQL

SEQ ID NO: 1364902 - protein, 17 aa, Mycobacterium tuberculosis
TPTAGAHRAPLTNAVSR

SEQ ID NO: 1364903 - protein, 5 aa, Mycobacterium tuberculosis
TPTAL

SEQ ID NO: 1364904 - protein, 8 aa, Mycobacterium tuberculosis
TQEGAEGW

SEQ ID NO: 1364905 - protein, 10 aa, Mycobacterium tuberculosis
TQGAPPSPLQ

SEQ ID NO: 1364906 - protein, 9 aa, Mycobacterium tuberculosis
TRQPDPAGA

SEQ ID NO: 1364907 - protein, 11 aa, Mycobacterium tuberculosis
TSGRAVEAAGD

SEQ ID NO: 1364908 - protein, 7 aa, Mycobacterium tuberculosis
TSYADNP

SEQ ID NO: 1364909 - protein, 14 aa, Mycobacterium tuberculosis
TTARAARRYGAGNR

SEQ ID NO: 1364910 - protein, 4 aa, Mycobacterium tuberculosis
TTPL

SEQ ID NO: 1364911 - protein, 4 aa, Mycobacterium tuberculosis
TTQS

SEQ ID NO: 1364912 - protein, 8 aa, Mycobacterium tuberculosis
TVGGDADK

SEQ ID NO: 1364913 - protein, 6 aa, Mycobacterium tuberculosis
TYGPDR

SEQ ID NO: 1364914 - protein, 6 aa, Mycobacterium tuberculosis
VAAAGD

SEQ ID NO: 1364915 - protein, 13 aa, Mycobacterium tuberculosis
VAAAGSDRQPPID

SEQ ID NO: 1364916 - protein, 32 aa, Mycobacterium tuberculosis; identical to SEQ ID NO: 154820

SEQ ID NO: 1364917 - protein, 8 aa, Mycobacterium tuberculosis
VEQEERGR

SEQ ID NO: 1364918 - protein, 8 aa, Mycobacterium tuberculosis
VEVGPGDE

SEQ ID NO: 1364919 - protein, 10 aa, Mycobacterium tuberculosis
VPAPQPPTPV

SEQ ID NO: 1364920 - protein, 21 aa, Mycobacterium tuberculosis
VPTEVSQRSEGQGPQPTRIPA

SEQ ID NO: 1364921 - protein, 10 aa, Mycobacterium tuberculosis
VQSSLSGSTV

SEQ ID NO: 1364922 - protein, 14 aa, Mycobacterium tuberculosis
VSPPEESRYQMALP

SEQ ID NO: 1364923 - protein, 7 aa, Mycobacterium tuberculosis
VSPPPID

SEQ ID NO: 1364924 - protein, 18 aa, Mycobacterium tuberculosis
VTAESGRAFGRAERSAQL

SEQ ID NO: 1364925 - protein, 7 aa, Mycobacterium tuberculosis
VTASGDC

SEQ ID NO: 1364926 - protein, 4 aa, Mycobacterium tuberculosis
VTVP

SEQ ID NO: 1364927 - protein, 17 aa, Mycobacterium tuberculosis
WEPSPSSAAALAAGDTL

SEQ ID NO: 1364928 - protein, 7 aa, Mycobacterium tuberculosis
YDPVDND

SEQ ID NO: 1364929 - protein, 7 aa, Mycobacterium tuberculosis
YGEQPKA

SEQ ID NO: 1364930 - protein, 12 aa, Mycobacterium tuberculosis
YGESQMNGEGRT

SEQ ID NO: 1364931 - protein, 21 aa, Mycobacterium tuberculosis
YSRGGEKPDGRLYPEDQPERV

SEQ ID NO: 1364932 - protein, 7 aa, Mycobacterium tuberculosis
YSRKDTT

SEQ ID NO: 1364933 - protein, 5 aa, Mycobacterium tuberculosis
YTPGQ

SEQ ID NO: 1364934 - protein, 5 aa, Mycobacterium tuberculosis
YTSDQ

SEQ ID NO: 1364935 - protein, 9 aa, Mycobacterium tuberculosis
AAAETQDRW

SEQ ID NO: 1364936 - protein, 10 aa, Mycobacterium tuberculosis
AAAGQDAQRI

SEQ ID NO: 1364937 - protein, 13 aa, Mycobacterium tuberculosis
AAGDGADATARRR

SEQ ID NO: 1364938 - protein, 6 aa, Mycobacterium tuberculosis
AAGRVA

SEQ ID NO: 1364939 - protein, 4 aa, Mycobacterium tuberculosis
AAQV

SEQ ID NO: 1364940 - protein, 15 aa, Mycobacterium tuberculosis
AARGPHAPDSLPGGP

SEQ ID NO: 1364941 - protein, 7 aa, Mycobacterium tuberculosis
AAYGGDP

SEQ ID NO: 1364942 - protein, 10 aa, Mycobacterium tuberculosis
ADISGSGAAI

SEQ ID NO: 1364943 - protein, 7 aa, Mycobacterium tuberculosis
AEAEGKF

SEQ ID NO: 1364944 - protein, 27 aa, Mycobacterium tuberculosis
AEKAERHRHPDQAADQLAQSPGSLPGD

SEQ ID NO: 1364945 - protein, 12 aa, Mycobacterium tuberculosis
AESGDDSREVIG

SEQ ID NO: 1364946 - protein, 11 aa, Mycobacterium tuberculosis
AESITAKEHPL

SEQ ID NO: 1364947 - protein, 9 aa, Mycobacterium tuberculosis
AGADDQPRY

SEQ ID NO: 1364948 - protein, 7 aa, Mycobacterium tuberculosis
AGARPVV

SEQ ID NO: 1364949 - protein, 14 aa, Mycobacterium tuberculosis
AGAYRATKVGSEAY

SEQ ID NO: 1364950 - protein, 6 aa, Mycobacterium tuberculosis
AGEPAA

SEQ ID NO: 1364951 - protein, 7 aa, Mycobacterium tuberculosis
AGGAGQP

SEQ ID NO: 1364952 - protein, 11 aa, Mycobacterium tuberculosis
AGLTSPAMPAR

SEQ ID NO: 1364953 - protein, 7 aa, Mycobacterium tuberculosis
AGNPGTI

SEQ ID NO: 1364954 - protein, 31 aa, Mycobacterium tuberculosis; identical to SEQ ID NO: 149655

SEQ ID NO: 1364955 - protein, 9 aa, Mycobacterium tuberculosis
AGPDGTTAA

SEQ ID NO: 1364956 - protein, 14 aa, Mycobacterium tuberculosis
AGQPGNDGFSGVAP

SEQ ID NO: 1364957 - protein, 18 aa, Mycobacterium tuberculosis
AGSTGGGGKKVPEINADR

SEQ ID NO: 1364958 - protein, 8 aa, Mycobacterium tuberculosis
AGTAVHDS

SEQ ID NO: 1364959 - protein, 5 aa, Mycobacterium tuberculosis
AHRDD

SEQ ID NO: 1364960 - protein, 6 aa, Mycobacterium tuberculosis
AHRTGA

SEQ ID NO: 1364961 - protein, 13 aa, Mycobacterium tuberculosis
AKALSGELSRETL

SEQ ID NO: 1364962 - protein, 12 aa, Mycobacterium tuberculosis
AKERLSSSTVTT

SEQ ID NO: 1364963 - protein, 16 aa, Mycobacterium tuberculosis
AKGGSYATASAVTGTI

SEQ ID NO: 1364964 - protein, 6 aa, Mycobacterium tuberculosis
AKPAAV

SEQ ID NO: 1364965 - protein, 7 aa, Mycobacterium tuberculosis
AKPNGEL

SEQ ID NO: 1364966 - protein, 6 aa, Mycobacterium tuberculosis
ALEPER

SEQ ID NO: 1364967 - protein, 10 aa, Mycobacterium tuberculosis
ALPEGSTGPL

SEQ ID NO: 1364968 - protein, 21 aa, Mycobacterium tuberculosis
ALPSPDEQAPAKAPPSPYPAR

SEQ ID NO: 1364969 - protein, 8 aa, Mycobacterium tuberculosis
ALPSPGVN

SEQ ID NO: 1364970 - protein, 18 aa, Mycobacterium tuberculosis
ANSSTTGDDGWKEMLAPA

SEQ ID NO: 1364971 - protein, 7 aa, Mycobacterium tuberculosis
APANRGR

SEQ ID NO: 1364972 - protein, 8 aa, Mycobacterium tuberculosis
APEEPANL

SEQ ID NO: 1364973 - protein, 5 aa, Mycobacterium tuberculosis
APKAG

SEQ ID NO: 1364974 - protein, 10 aa, Mycobacterium tuberculosis
APRAEPGLGT

SEQ ID NO: 1364975 - protein, 12 aa, Mycobacterium tuberculosis
APSTTRASGDSD

SEQ ID NO: 1364976 - protein, 19 aa, Mycobacterium tuberculosis
APYGPGSARAGADGSGPQG

SEQ ID NO: 1364977 - protein, 9 aa, Mycobacterium tuberculosis
AQAPRPAPA

SEQ ID NO: 1364978 - protein, 9 aa, Mycobacterium tuberculosis
AQPEAQTAA

SEQ ID NO: 1364979 - protein, 5 aa, Mycobacterium tuberculosis
AQSRR

SEQ ID NO: 1364980 - protein, 17 aa, Mycobacterium tuberculosis
ARAARQRGNEISGGASA

SEQ ID NO: 1364981 - protein, 4 aa, Mycobacterium tuberculosis
ARAG

SEQ ID NO: 1364982 - protein, 4 aa, Mycobacterium tuberculosis
ARAQ

SEQ ID NO: 1364983 - protein, 8 aa, Mycobacterium tuberculosis
ARDDGTLA

SEQ ID NO: 1364984 - protein, 8 aa, Mycobacterium tuberculosis
AREAGRVA

SEQ ID NO: 1364985 - protein, 8 aa, Mycobacterium tuberculosis
ARGDRIPD

SEQ ID NO: 1364986 - protein, 6 aa, Mycobacterium tuberculosis
ARGQDM

SEQ ID NO: 1364987 - protein, 11 aa, Mycobacterium tuberculosis
ARPPARGVDNQ

SEQ ID NO: 1364988 - protein, 9 aa, Mycobacterium tuberculosis
ARTVQESGG

SEQ ID NO: 1364989 - protein, 7 aa, Mycobacterium tuberculosis
ASGSTYP

SEQ ID NO: 1364990 - protein, 30 aa, Mycobacterium tuberculosis
ASPASAITPPPIDPGALPPDVTGPDQPTEQ

SEQ ID NO: 1364991 - protein, 12 aa, Mycobacterium tuberculosis
ASQSLSATVGGV

SEQ ID NO: 1364992 - protein, 5 aa, Mycobacterium tuberculosis
ASRPE

SEQ ID NO: 1364993 - protein, 12 aa, Mycobacterium tuberculosis
ASRSGDLPPAVT

SEQ ID NO: 1364994 - protein, 13 aa, Mycobacterium tuberculosis
ASSPAAGTPSDRW

SEQ ID NO: 1364995 - protein, 17 aa, Mycobacterium tuberculosis
ASTHAGADGWKVMLAPT

SEQ ID NO: 1364996 - protein, 7 aa, Mycobacterium tuberculosis
ATGKTRS

SEQ ID NO: 1364997 - protein, 11 aa, Mycobacterium tuberculosis
ATKGASHTSQM

SEQ ID NO: 1364998 - protein, 9 aa, Mycobacterium tuberculosis
ATLKDGTEL

SEQ ID NO: 1364999 - protein, 12 aa, Mycobacterium tuberculosis
ATPKASRTTPEA

SEQ ID NO: 1365000 - protein, 8 aa, Mycobacterium tuberculosis
ATTNQPID

SEQ ID NO: 1365001 - protein, 30 aa, Mycobacterium tuberculosis; identical to SEQ ID NO: 150198

SEQ ID NO: 1365002 - protein, 19 aa, Mycobacterium tuberculosis
DAADAEALATAAAADAEPD

SEQ ID NO: 1365003 - protein, 6 aa, Mycobacterium tuberculosis
DAPGRR

SEQ ID NO: 1365004 - protein, 7 aa, Mycobacterium tuberculosis
DDPDTSL

SEQ ID NO: 1365005 - protein, 8 aa, Mycobacterium tuberculosis
DDPKWRTG

SEQ ID NO: 1365006 - protein, 6 aa, Mycobacterium tuberculosis
DDYADT

SEQ ID NO: 1365007 - protein, 5 aa, Mycobacterium tuberculosis
DEDTV

SEQ ID NO: 1365008 - protein, 18 aa, Mycobacterium tuberculosis
DERKRPVSNGRPARPPVT

SEQ ID NO: 1365009 - protein, 15 aa, Mycobacterium tuberculosis
DFGTTITGQPVGTEL

SEQ ID NO: 1365010 - protein, 11 aa, Mycobacterium tuberculosis
DGDISYGEYGR

SEQ ID NO: 1365011 - protein, 9 aa, Mycobacterium tuberculosis
DGEIGDGPG

SEQ ID NO: 1365012 - protein, 4 aa, Mycobacterium tuberculosis
DGLG

SEQ ID NO: 1365013 - protein, 6 aa, Mycobacterium tuberculosis
DGSAIG

SEQ ID NO: 1365014 - protein, 5 aa, Mycobacterium tuberculosis
DKEFG

SEQ ID NO: 1365015 - protein, 8 aa, Mycobacterium tuberculosis
DKHGHTTE

SEQ ID NO: 1365016 - protein, 4 aa, Mycobacterium tuberculosis
DLPP

SEQ ID NO: 1365017 - protein, 11 aa, Mycobacterium tuberculosis
DLQRPDAPWGR

SEQ ID NO: 1365018 - protein, 12 aa, Mycobacterium tuberculosis
DPHAGPAEPSIG

SEQ ID NO: 1365019 - protein, 10 aa, Mycobacterium tuberculosis
DPRDKKTPSL

SEQ ID NO: 1365020 - protein, 21 aa, Mycobacterium tuberculosis
DQRCRRRGTNSSDNNTNASAK

SEQ ID NO: 1365021 - protein, 8 aa, Mycobacterium tuberculosis
DRGPGIPV

SEQ ID NO: 1365022 - protein, 6 aa, Mycobacterium tuberculosis
DRIGGA

SEQ ID NO: 1365023 - protein, 6 aa, Mycobacterium tuberculosis
DSPDGV

SEQ ID NO: 1365024 - protein, 13 aa, Mycobacterium tuberculosis
DSSRARASGGTGL

SEQ ID NO: 1365025 - protein, 34 aa, Mycobacterium tuberculosis; identical to SEQ ID NO: 150611

SEQ ID NO: 1365026 - protein, 12 aa, Mycobacterium tuberculosis
DTDPGGQPPGTS

SEQ ID NO: 1365027 - protein, 7 aa, Mycobacterium tuberculosis
DTNRDEI

SEQ ID NO: 1365028 - protein, 10 aa, Mycobacterium tuberculosis
DTRGYKPVDT

SEQ ID NO: 1365029 - protein, 5 aa, Mycobacterium tuberculosis
DYGIE

SEQ ID NO: 1365030 - protein, 7 aa, Mycobacterium tuberculosis
EATATRI

SEQ ID NO: 1365031 - protein, 8 aa, Mycobacterium tuberculosis
EAVPSSRT

SEQ ID NO: 1365032 - protein, 4 aa, Mycobacterium tuberculosis
EAVS

SEQ ID NO: 1365033 - protein, 5 aa, Mycobacterium tuberculosis
EDGAH

SEQ ID NO: 1365034 - protein, 6 aa, Mycobacterium tuberculosis
EDPEPV

SEQ ID NO: 1365035 - protein, 5 aa, Mycobacterium tuberculosis
EESAA

SEQ ID NO: 1365036 - protein, 7 aa, Mycobacterium tuberculosis
EIGRDGL

SEQ ID NO: 1365037 - protein, 10 aa, Mycobacterium tuberculosis
EIPRSPNDQD

SEQ ID NO: 1365038 - protein, 22 aa, Mycobacterium tuberculosis
EKEPEPEPEPKAAAEPAEAPTL

SEQ ID NO: 1365039 - protein, 16 aa, Mycobacterium tuberculosis
ELGGGDGAVSGDTGLP

SEQ ID NO: 1365040 - protein, 16 aa, Mycobacterium tuberculosis
ENPTRQGGAQVLPGNA

SEQ ID NO: 1365041 - protein, 8 aa, Mycobacterium tuberculosis
EPRTEGGV

SEQ ID NO: 1365042 - protein, 8 aa, Mycobacterium tuberculosis
EQLGPDYA

SEQ ID NO: 1365043 - protein, 10 aa, Mycobacterium tuberculosis
ERQRKAQQAI

SEQ ID NO: 1365044 - protein, 9 aa, Mycobacterium tuberculosis
ESALTGESL

SEQ ID NO: 1365045 - protein, 7 aa, Mycobacterium tuberculosis
ESLSQER

SEQ ID NO: 1365046 - protein, 12 aa, Mycobacterium tuberculosis
ESTGGGRRRRRG

SEQ ID NO: 1365047 - protein, 7 aa, Mycobacterium tuberculosis
ESTRADW

SEQ ID NO: 1365048 - protein, 7 aa, Mycobacterium tuberculosis
FDDKGRP

SEQ ID NO: 1365049 - protein, 13 aa, Mycobacterium tuberculosis
FGGEAGPVPDDGF

SEQ ID NO: 1365050 - protein, 6 aa, Mycobacterium tuberculosis
FHDPPW

SEQ ID NO: 1365051 - protein, 8 aa, Mycobacterium tuberculosis
GAAGIGPA

SEQ ID NO: 1365052 - protein, 9 aa, Mycobacterium tuberculosis
GAGAPAPAV

SEQ ID NO: 1365053 - protein, 9 aa, Mycobacterium tuberculosis
GARDANDYE

SEQ ID NO: 1365054 - protein, 27 aa, Mycobacterium tuberculosis
GARRPPRPAPVASPAAAVAPTPKTSRE

SEQ ID NO: 1365055 - protein, 13 aa, Mycobacterium tuberculosis
GASSQGAQTYREA

SEQ ID NO: 1365056 - protein, 8 aa, Mycobacterium tuberculosis
GATTPGPV

SEQ ID NO: 1365057 - protein, 6 aa, Mycobacterium tuberculosis
GDGPQV

SEQ ID NO: 1365058 - protein, 12 aa, Mycobacterium tuberculosis
GDGTNDAPALAQ

SEQ ID NO: 1365059 - protein, 7 aa, Mycobacterium tuberculosis
GEHRDGG

SEQ ID NO: 1365060 - protein, 11 aa, Mycobacterium tuberculosis
GEQIDNAGNAA

SEQ ID NO: 1365061 - protein, 10 aa, Mycobacterium tuberculosis
GERRRAERER

SEQ ID NO: 1365062 - protein, 5 aa, Mycobacterium tuberculosis
GFSGK

SEQ ID NO: 1365063 - protein, 6 aa, Mycobacterium tuberculosis
GGIPGM

SEQ ID NO: 1365064 - protein, 9 aa, Mycobacterium tuberculosis
GHRQAKDPV

SEQ ID NO: 1365065 - protein, 5 aa, Mycobacterium tuberculosis
GIAAG

SEQ ID NO: 1365066 - protein, 7 aa, Mycobacterium tuberculosis
GIQPNPA

SEQ ID NO: 1365067 - protein, 7 aa, Mycobacterium tuberculosis
GKQALSA

SEQ ID NO: 1365068 - protein, 12 aa, Mycobacterium tuberculosis
GLAGKGKQINTT

SEQ ID NO: 1365069 - protein, 5 aa, Mycobacterium tuberculosis
GLSTA

SEQ ID NO: 1365070 - protein, 8 aa, Mycobacterium tuberculosis
GNPDGPAL

SEQ ID NO: 1365071 - protein, 4 aa, Mycobacterium tuberculosis
GPLR

SEQ ID NO: 1365072 - protein, 34 aa, Mycobacterium tuberculosis; identical to SEQ ID NO: 151407

SEQ ID NO: 1365073 - protein, 5 aa, Mycobacterium tuberculosis
GPSPY

SEQ ID NO: 1365074 - protein, 6 aa, Mycobacterium tuberculosis
GPVTTG

SEQ ID NO: 1365075 - protein, 4 aa, Mycobacterium tuberculosis
GQSI

SEQ ID NO: 1365076 - protein, 70 aa, Mycobacterium tuberculosis; identical to SEQ ID NO: 151473

SEQ ID NO: 1365077 - protein, 5 aa, Mycobacterium tuberculosis
GRSQM

SEQ ID NO: 1365078 - protein, 5 aa, Mycobacterium tuberculosis
GRTGR

SEQ ID NO: 1365079 - protein, 18 aa, Mycobacterium tuberculosis
GRTNRNPVQMPAPEPAIA

SEQ ID NO: 1365080 - protein, 6 aa, Mycobacterium tuberculosis
GSAARV

SEQ ID NO: 1365081 - protein, 7 aa, Mycobacterium tuberculosis
GSAASAT

SEQ ID NO: 1365082 - protein, 9 aa, Mycobacterium tuberculosis
GSQRGADAA

SEQ ID NO: 1365083 - protein, 17 aa, Mycobacterium tuberculosis
GSTHPVRPKIYRPPDHS

SEQ ID NO: 1365084 - protein, 7 aa, Mycobacterium tuberculosis
GSVATYS

SEQ ID NO: 1365085 - protein, 5 aa, Mycobacterium tuberculosis
GTATL

SEQ ID NO: 1365086 - protein, 18 aa, Mycobacterium tuberculosis
GTEDLSASVGSTHPPGTP

SEQ ID NO: 1365087 - protein, 7 aa, Mycobacterium tuberculosis
GTQPDYS

SEQ ID NO: 1365088 - protein, 4 aa, Mycobacterium tuberculosis
GVPV

SEQ ID NO: 1365089 - protein, 4 aa, Mycobacterium tuberculosis
GVTN

SEQ ID NO: 1365090 - protein, 6 aa, Mycobacterium tuberculosis
HGAGRA

SEQ ID NO: 1365091 - protein, 19 aa, Mycobacterium tuberculosis
HHAGPDAHASQSPAANGRV

SEQ ID NO: 1365092 - protein, 8 aa, Mycobacterium tuberculosis
HLPSKENG

SEQ ID NO: 1365093 - protein, 4 aa, Mycobacterium tuberculosis
HPEK

SEQ ID NO: 1365094 - protein, 8 aa, Mycobacterium tuberculosis
HPGVGSAS

SEQ ID NO: 1365095 - protein, 12 aa, Mycobacterium tuberculosis
HRANGQPPERAH

SEQ ID NO: 1365096 - protein, 6 aa, Mycobacterium tuberculosis
HRHRPA

SEQ ID NO: 1365097 - protein, 6 aa, Mycobacterium tuberculosis
HRSPRR

SEQ ID NO: 1365098 - protein, 4 aa, Mycobacterium tuberculosis
HRTG

SEQ ID NO: 1365099 - protein, 22 aa, Mycobacterium tuberculosis
HSDRAPAGPPSGAEHMSPDPVE

SEQ ID NO: 1365100 - protein, 7 aa, Mycobacterium tuberculosis
HSGSTAR

SEQ ID NO: 1365101 - protein, 4 aa, Mycobacterium tuberculosis
HSPD

SEQ ID NO: 1365102 - protein, 6 aa, Mycobacterium tuberculosis
IDTSSA

SEQ ID NO: 1365103 - protein, 9 aa, Mycobacterium tuberculosis
IGAGATAQL

SEQ ID NO: 1365104 - protein, 8 aa, Mycobacterium tuberculosis
IGGPPEQV

SEQ ID NO: 1365105 - protein, 6 aa, Mycobacterium tuberculosis
IGQNGL

SEQ ID NO: 1365106 - protein, 6 aa, Mycobacterium tuberculosis
IKGDAS

SEQ ID NO: 1365107 - protein, 8 aa, Mycobacterium tuberculosis
IKPGGEPI

SEQ ID NO: 1365108 - protein, 11 aa, Mycobacterium tuberculosis
ISTSPSSSTFP

SEQ ID NO: 1365109 - protein, 14 aa, Mycobacterium tuberculosis
ITSGSADGQRRSPR

SEQ ID NO: 1365110 - protein, 8 aa, Mycobacterium tuberculosis
KAGTDYAD

SEQ ID NO: 1365111 - protein, 15 aa, Mycobacterium tuberculosis
KCNNGSDPTVKKGAT

SEQ ID NO: 1365112 - protein, 5 aa, Mycobacterium tuberculosis
KDDSL

SEQ ID NO: 1365113 - protein, 5 aa, Mycobacterium tuberculosis
KEVAR

SEQ ID NO: 1365114 - protein, 15 aa, Mycobacterium tuberculosis
KFSPRTSGGDPQLAQ

SEQ ID NO: 1365115 - protein, 6 aa, Mycobacterium tuberculosis
KLPPSI

SEQ ID NO: 1365116 - protein, 11 aa, Mycobacterium tuberculosis
KPGADLDEDTI

SEQ ID NO: 1365117 - protein, 5 aa, Mycobacterium tuberculosis
KPPGL

SEQ ID NO: 1365118 - protein, 7 aa, Mycobacterium tuberculosis
KQRGKTT

SEQ ID NO: 1365119 - protein, 8 aa, Mycobacterium tuberculosis
KQVEPTPG

SEQ ID NO: 1365120 - protein, 6 aa, Mycobacterium tuberculosis
KTPPTL

SEQ ID NO: 1365121 - protein, 13 aa, Mycobacterium tuberculosis
LAGPNATHDADKP

SEQ ID NO: 1365122 - protein, 5 aa, Mycobacterium tuberculosis
LAPNG

SEQ ID NO: 1365123 - protein, 17 aa, Mycobacterium tuberculosis
LATAPSTIRQGTSARNV

SEQ ID NO: 1365124 - protein, 9 aa, Mycobacterium tuberculosis
LGAASSSCS

SEQ ID NO: 1365125 - protein, 5 aa, Mycobacterium tuberculosis
LGATR

SEQ ID NO: 1365126 - protein, 5 aa, Mycobacterium tuberculosis
LGEAA

SEQ ID NO: 1365127 - protein, 21 aa, Mycobacterium tuberculosis
LGGGGPGSARQDGSPKVPGIG

SEQ ID NO: 1365128 - protein, 7 aa, Mycobacterium tuberculosis
LGHTGPF

SEQ ID NO: 1365129 - protein, 12 aa, Mycobacterium tuberculosis
LGPGPVTTGAAA

SEQ ID NO: 1365130 - protein, 8 aa, Mycobacterium tuberculosis
LGTAGAAA

SEQ ID NO: 1365131 - protein, 4 aa, Mycobacterium tuberculosis
LNPD

SEQ ID NO: 1365132 - protein, 6 aa, Mycobacterium tuberculosis
LPRDAK

SEQ ID NO: 1365133 - protein, 18 aa, Mycobacterium tuberculosis
LRPEAAAAISAATKLTGA

SEQ ID NO: 1365134 - protein, 15 aa, Mycobacterium tuberculosis
LSSSPSDSASSLNEH

SEQ ID NO: 1365135 - protein, 8 aa, Mycobacterium tuberculosis
LSTDGKSG

SEQ ID NO: 1365136 - protein, 12 aa, Mycobacterium tuberculosis
LTPGRGFRNGPF

SEQ ID NO: 1365137 - protein, 15 aa, Mycobacterium tuberculosis
LTTPKNPTKRRITPK

SEQ ID NO: 1365138 - protein, 5 aa, Mycobacterium tuberculosis
MNPNG

SEQ ID NO: 1365139 - protein, 13 aa, Mycobacterium tuberculosis
MPSNVGDAAAGRH

SEQ ID NO: 1365140 - protein, 17 aa, Mycobacterium tuberculosis
MTPQRSLTRGLTPAPTA

SEQ ID NO: 1365141 - protein, 9 aa, Mycobacterium tuberculosis
NADQLADQA

SEQ ID NO: 1365142 - protein, 8 aa, Mycobacterium tuberculosis
NARRAPNR

SEQ ID NO: 1365143 - protein, 5 aa, Mycobacterium tuberculosis
NERGD

SEQ ID NO: 1365144 - protein, 8 aa, Mycobacterium tuberculosis
NLGKDERH

SEQ ID NO: 1365145 - protein, 11 aa, Mycobacterium tuberculosis
NRAAGRRRVPD

SEQ ID NO: 1365146 - protein, 8 aa, Mycobacterium tuberculosis
NRQEKRDR

SEQ ID NO: 1365147 - protein, 12 aa, Mycobacterium tuberculosis
NRQGHPGTRDRL

SEQ ID NO: 1365148 - protein, 19 aa, Mycobacterium tuberculosis
NTRSPLDFTSDPGAKPDGI

SEQ ID NO: 1365149 - protein, 12 aa, Mycobacterium tuberculosis
PAAGGPPRGQVQ

SEQ ID NO: 1365150 - protein, 29 aa, Mycobacterium tuberculosis
PAEPGGGAAPAKPVADPPVPAPKDTTPRN

SEQ ID NO: 1365151 - protein, 18 aa, Mycobacterium tuberculosis
PAEVAEAGPESPADPEIE

SEQ ID NO: 1365152 - protein, 12 aa, Mycobacterium tuberculosis
PAPAGADGSGAN

SEQ ID NO: 1365153 - protein, 10 aa, Mycobacterium tuberculosis
PAPQATGPGC

SEQ ID NO: 1365154 - protein, 5 aa, Mycobacterium tuberculosis
PASRS

SEQ ID NO: 1365155 - protein, 9 aa, Mycobacterium tuberculosis
PDDASSFGD

SEQ ID NO: 1365156 - protein, 21 aa, Mycobacterium tuberculosis
PDIAPPSSGLQTPPGPPNAYD

SEQ ID NO: 1365157 - protein, 7 aa, Mycobacterium tuberculosis
PDNPQRA

SEQ ID NO: 1365158 - protein, 7 aa, Mycobacterium tuberculosis
PDPAGQP

SEQ ID NO: 1365159 - protein, 5 aa, Mycobacterium tuberculosis
PDTGA

SEQ ID NO: 1365160 - protein, 8 aa, Mycobacterium tuberculosis
PEDDPEAR

SEQ ID NO: 1365161 - protein, 9 aa, Mycobacterium tuberculosis
PEDPTYDPT

SEQ ID NO: 1365162 - protein, 6 aa, Mycobacterium tuberculosis
PERRSA

SEQ ID NO: 1365163 - protein, 8 aa, Mycobacterium tuberculosis
PGGVGPGG

SEQ ID NO: 1365164 - protein, 22 aa, Mycobacterium tuberculosis
PGPVPPTPAPVGAPLPAEAGGG

SEQ ID NO: 1365165 - protein, 6 aa, Mycobacterium tuberculosis
PLPSLA

SEQ ID NO: 1365166 - protein, 11 aa, Mycobacterium tuberculosis
PLSGEGSDTDT

SEQ ID NO: 1365167 - protein, 8 aa, Mycobacterium tuberculosis
PNNERAYP

SEQ ID NO: 1365168 - protein, 10 aa, Mycobacterium tuberculosis
PPPGAGAPPW

SEQ ID NO: 1365169 - protein, 12 aa, Mycobacterium tuberculosis
PQADIDRPVGSA

SEQ ID NO: 1365170 - protein, 4 aa, Mycobacterium tuberculosis
PQPA

SEQ ID NO: 1365171 - protein, 19 aa, Mycobacterium tuberculosis
PQTVPDATHPGAEQVTHPG

SEQ ID NO: 1365172 - protein, 4 aa, Mycobacterium tuberculosis
PRDL

SEQ ID NO: 1365173 - protein, 22 aa, Mycobacterium tuberculosis
PREQVSQPATAASDYSAGGAES

SEQ ID NO: 1365174 - protein, 12 aa, Mycobacterium tuberculosis
PRPARSTQPVQR

SEQ ID NO: 1365175 - protein, 20 aa, Mycobacterium tuberculosis
PSAATTSPPPSPQQEKPPRL

SEQ ID NO: 1365176 - protein, 10 aa, Mycobacterium tuberculosis
PSGSGPTAIQ

SEQ ID NO: 1365177 - protein, 8 aa, Mycobacterium tuberculosis
PSPLPDEP

SEQ ID NO: 1365178 - protein, 5 aa, Mycobacterium tuberculosis
PTAAE

SEQ ID NO: 1365179 - protein, 4 aa, Mycobacterium tuberculosis
PTRR

SEQ ID NO: 1365180 - protein, 8 aa, Mycobacterium tuberculosis
PTTLPGSG

SEQ ID NO: 1365181 - protein, 21 aa, Mycobacterium tuberculosis
PVAEPTTAGATAWRTGPNSTP

SEQ ID NO: 1365182 - protein, 10 aa, Mycobacterium tuberculosis
QANSPSTPEL

SEQ ID NO: 1365183 - protein, 12 aa, Mycobacterium tuberculosis
QASSGGSAHPVY

SEQ ID NO: 1365184 - protein, 5 aa, Mycobacterium tuberculosis
QAYDD

SEQ ID NO: 1365185 - protein, 6 aa, Mycobacterium tuberculosis
QDPTAL

SEQ ID NO: 1365186 - protein, 27 aa, Mycobacterium tuberculosis
QEDAEDDSRPDAAEAAAAEPKSSAGPM

SEQ ID NO: 1365187 - protein, 8 aa, Mycobacterium tuberculosis
QEKKRTAR

SEQ ID NO: 1365188 - protein, 5 aa, Mycobacterium tuberculosis
QGKSQ

SEQ ID NO: 1365189 - protein, 8 aa, Mycobacterium tuberculosis
QLATRGPK

SEQ ID NO: 1365190 - protein, 25 aa, Mycobacterium tuberculosis
QLSTPGAGLSSATVTSAETGAWGPT

SEQ ID NO: 1365191 - protein, 11 aa, Mycobacterium tuberculosis
QNAAPPSPARI

SEQ ID NO: 1365192 - protein, 10 aa, Mycobacterium tuberculosis
QNPDEPGRST

SEQ ID NO: 1365193 - protein, 15 aa, Mycobacterium tuberculosis
QPDERPDDAEDSDAG

SEQ ID NO: 1365194 - protein, 29 aa, Mycobacterium tuberculosis
QQEPKQPPAPEPRPAPPPAKPAPPAGPVD

SEQ ID NO: 1365195 - protein, 10 aa, Mycobacterium tuberculosis
QRTKTREEVE

SEQ ID NO: 1365196 - protein, 7 aa, Mycobacterium tuberculosis
QSPARAT

SEQ ID NO: 1365197 - protein, 8 aa, Mycobacterium tuberculosis
QVNSGNEI

SEQ ID NO: 1365198 - protein, 12 aa, Mycobacterium tuberculosis
RAGRPPRAHRPH

SEQ ID NO: 1365199 - protein, 6 aa, Mycobacterium tuberculosis
RDPSQT

SEQ ID NO: 1365200 - protein, 8 aa, Mycobacterium tuberculosis
RDVAERQR

SEQ ID NO: 1365201 - protein, 7 aa, Mycobacterium tuberculosis
RGDCPDD

SEQ ID NO: 1365202 - protein, 11 aa, Mycobacterium tuberculosis
RGPEGADPASV

SEQ ID NO: 1365203 - protein, 8 aa, Mycobacterium tuberculosis
RGRAQNAM

SEQ ID NO: 1365204 - protein, 4 aa, Mycobacterium tuberculosis
RIGV

SEQ ID NO: 1365205 - protein, 8 aa, Mycobacterium tuberculosis
RKKAAAAE

SEQ ID NO: 1365206 - protein, 6 aa, Mycobacterium tuberculosis
RKNQYD

SEQ ID NO: 1365207 - protein, 14 aa, Mycobacterium tuberculosis
RLPPPGSAARPAMS

SEQ ID NO: 1365208 - protein, 5 aa, Mycobacterium tuberculosis
RMGRP

SEQ ID NO: 1365209 - protein, 15 aa, Mycobacterium tuberculosis
RNGITVKDSDGTVRR

SEQ ID NO: 1365210 - protein, 6 aa, Mycobacterium tuberculosis
RQGPKL

SEQ ID NO: 1365211 - protein, 13 aa, Mycobacterium tuberculosis
RQLADRPTPPWRP

SEQ ID NO: 1365212 - protein, 7 aa, Mycobacterium tuberculosis
RQPIPPW

SEQ ID NO: 1365213 - protein, 7 aa, Mycobacterium tuberculosis
RRGRGDD

SEQ ID NO: 1365214 - protein, 7 aa, Mycobacterium tuberculosis
RRSERQA

SEQ ID NO: 1365215 - protein, 15 aa, Mycobacterium tuberculosis
RSAGTEPAGQVNPTA

SEQ ID NO: 1365216 - protein, 5 aa, Mycobacterium tuberculosis
RSDTR

SEQ ID NO: 1365217 - protein, 8 aa, Mycobacterium tuberculosis
RSSAPAGA

SEQ ID NO: 1365218 - protein, 11 aa, Mycobacterium tuberculosis
RTASSDPEARR

SEQ ID NO: 1365219 - protein, 16 aa, Mycobacterium tuberculosis
RTGRSHARESSQGPNQ

SEQ ID NO: 1365220 - protein, 6 aa, Mycobacterium tuberculosis
RTSPAL

SEQ ID NO: 1365221 - protein, 8 aa, Mycobacterium tuberculosis
RTSTGARL

SEQ ID NO: 1365222 - protein, 4 aa, Mycobacterium tuberculosis
RVDP

SEQ ID NO: 1365223 - protein, 9 aa, Mycobacterium tuberculosis
RYPASGGTY

SEQ ID NO: 1365224 - protein, 7 aa, Mycobacterium tuberculosis
SAAGAAS

SEQ ID NO: 1365225 - protein, 6 aa, Mycobacterium tuberculosis
SACPVE

SEQ ID NO: 1365226 - protein, 4 aa, Mycobacterium tuberculosis
SAGA

SEQ ID NO: 1365227 - protein, 7 aa, Mycobacterium tuberculosis
SAGATVP

SEQ ID NO: 1365228 - protein, 9 aa, Mycobacterium tuberculosis
SAHATSTTA

SEQ ID NO: 1365229 - protein, 7 aa, Mycobacterium tuberculosis
SAPVVGP

SEQ ID NO: 1365230 - protein, 6 aa, Mycobacterium tuberculosis
SAQPSA

SEQ ID NO: 1365231 - protein, 9 aa, Mycobacterium tuberculosis
SARALPGSG

SEQ ID NO: 1365232 - protein, 4 aa, Mycobacterium tuberculosis
SARR

SEQ ID NO: 1365233 - protein, 40 aa, Mycobacterium tuberculosis
SDDGPPAWPSAEVPQDDTATIPEASAGRGSGRRGRRKDTQ

SEQ ID NO: 1365234 - protein, 5 aa, Mycobacterium tuberculosis
SDPRE

SEQ ID NO: 1365235 - protein, 6 aa, Mycobacterium tuberculosis
SERVQP

SEQ ID NO: 1365236 - protein, 4 aa, Mycobacterium tuberculosis
SGGA

SEQ ID NO: 1365237 - protein, 7 aa, Mycobacterium tuberculosis
SGPAGVD

SEQ ID NO: 1365238 - protein, 6 aa, Mycobacterium tuberculosis
SKSPVA

SEQ ID NO: 1365239 - protein, 6 aa, Mycobacterium tuberculosis
SLQTGG

SEQ ID NO: 1365240 - protein, 9 aa, Mycobacterium tuberculosis
SLSSAAGRL

SEQ ID NO: 1365241 - protein, 6 aa, Mycobacterium tuberculosis
SNPALR

SEQ ID NO: 1365242 - protein, 16 aa, Mycobacterium tuberculosis
SPGPPSPDNAVADTTT

SEQ ID NO: 1365243 - protein, 9 aa, Mycobacterium tuberculosis
SRDITPSEA

SEQ ID NO: 1365244 - protein, 8 aa, Mycobacterium tuberculosis
SRRNHGRS

SEQ ID NO: 1365245 - protein, 4 aa, Mycobacterium tuberculosis
SRRS

SEQ ID NO: 1365246 - protein, 9 aa, Mycobacterium tuberculosis
SRVTGSDLG

SEQ ID NO: 1365247 - protein, 8 aa, Mycobacterium tuberculosis
STASTLPK

SEQ ID NO: 1365248 - protein, 13 aa, Mycobacterium tuberculosis
TAAAATAAVAPPR

SEQ ID NO: 1365249 - protein, 8 aa, Mycobacterium tuberculosis
TAACGPPQ

SEQ ID NO: 1365250 - protein, 8 aa, Mycobacterium tuberculosis
TAATETTR

SEQ ID NO: 1365251 - protein, 7 aa, Mycobacterium tuberculosis
TAGATAV

SEQ ID NO: 1365252 - protein, 13 aa, Mycobacterium tuberculosis
TAHRGARESSNIV

SEQ ID NO: 1365253 - protein, 11 aa, Mycobacterium tuberculosis
TAKRGAQITQA

SEQ ID NO: 1365254 - protein, 10 aa, Mycobacterium tuberculosis
TAPKQGKDAN

SEQ ID NO: 1365255 - protein, 7 aa, Mycobacterium tuberculosis
TDSQDPY

SEQ ID NO: 1365256 - protein, 7 aa, Mycobacterium tuberculosis
TGQTPGN

SEQ ID NO: 1365257 - protein, 9 aa, Mycobacterium tuberculosis
TKPEVRRQS

SEQ ID NO: 1365258 - protein, 13 aa, Mycobacterium tuberculosis
TLPTEPMRSRGRN

SEQ ID NO: 1365259 - protein, 7 aa, Mycobacterium tuberculosis
TLRSSPP

SEQ ID NO: 1365260 - protein, 15 aa, Mycobacterium tuberculosis
TLTTDRGAEPELGAQ

SEQ ID NO: 1365261 - protein, 9 aa, Mycobacterium tuberculosis
TPAPGAAEE

SEQ ID NO: 1365262 - protein, 17 aa, Mycobacterium tuberculosis
TPKPGTGPSRKTQERGH

SEQ ID NO: 1365263 - protein, 8 aa, Mycobacterium tuberculosis
TPTPGAAQ

SEQ ID NO: 1365264 - protein, 22 aa, Mycobacterium tuberculosis
TPTSGPSAVYSPASGELVGPDG

SEQ ID NO: 1365265 - protein, 6 aa, Mycobacterium tuberculosis
TQASYA

SEQ ID NO: 1365266 - protein, 14 aa, Mycobacterium tuberculosis
TRQQGDSVEVSAEK

SEQ ID NO: 1365267 - protein, 9 aa, Mycobacterium tuberculosis
TRRGETEYG

SEQ ID NO: 1365268 - protein, 7 aa, Mycobacterium tuberculosis
TSQEFTE

SEQ ID NO: 1365269 - protein, 6 aa, Mycobacterium tuberculosis
TSRDDT

SEQ ID NO: 1365270 - protein, 9 aa, Mycobacterium tuberculosis
TSRTRTALT

SEQ ID NO: 1365271 - protein, 8 aa, Mycobacterium tuberculosis
TTGKEEPL

SEQ ID NO: 1365272 - protein, 8 aa, Mycobacterium tuberculosis
TTLATPGM

SEQ ID NO: 1365273 - protein, 9 aa, Mycobacterium tuberculosis
TTTTTGARY

SEQ ID NO: 1365274 - protein, 8 aa, Mycobacterium tuberculosis
TVKDDAAD

SEQ ID NO: 1365275 - protein, 17 aa, Mycobacterium tuberculosis
TWDNGTTHDDETDADAV

SEQ ID NO: 1365276 - protein, 26 aa, Mycobacterium tuberculosis
VAAQPSGETSDACCDGEDNEDREPEQ

SEQ ID NO: 1365277 - protein, 13 aa, Mycobacterium tuberculosis
VAEEPEPELPGVT

SEQ ID NO: 1365278 - protein, 7 aa, Mycobacterium tuberculosis
VAEEPTR

SEQ ID NO: 1365279 - protein, 6 aa, Mycobacterium tuberculosis
VAPAGS

SEQ ID NO: 1365280 - protein, 5 aa, Mycobacterium tuberculosis
VDSGH

SEQ ID NO: 1365281 - protein, 8 aa, Mycobacterium tuberculosis
VEDGTGEL

SEQ ID NO: 1365282 - protein, 7 aa, Mycobacterium tuberculosis
VEQGDLR

SEQ ID NO: 1365283 - protein, 8 aa, Mycobacterium tuberculosis
VEREAPTE

SEQ ID NO: 1365284 - protein, 5 aa, Mycobacterium tuberculosis
VGGGG

SEQ ID NO: 1365285 - protein, 4 aa, Mycobacterium tuberculosis
VGGL

SEQ ID NO: 1365286 - protein, 33 aa, Mycobacterium tuberculosis
VGPAAPIPDSTATPDASSTTPSRPQPPQDNNDD

SEQ ID NO: 1365287 - protein, 10 aa, Mycobacterium tuberculosis
VGPDTQERRA

SEQ ID NO: 1365288 - protein, 7 aa, Mycobacterium tuberculosis
VGTEGDD

SEQ ID NO: 1365289 - protein, 12 aa, Mycobacterium tuberculosis
VKGGPKGVGNAV

SEQ ID NO: 1365290 - protein, 4 aa, Mycobacterium tuberculosis
VNQT

SEQ ID NO: 1365291 - protein, 15 aa, Mycobacterium tuberculosis
VPEPDANPSTEVGQL

SEQ ID NO: 1365292 - protein, 7 aa, Mycobacterium tuberculosis
VPESATS

SEQ ID NO: 1365293 - protein, 13 aa, Mycobacterium tuberculosis
VPIPPPPPGPDVI

SEQ ID NO: 1365294 - protein, 8 aa, Mycobacterium tuberculosis
VRDPDAVR

SEQ ID NO: 1365295 - protein, 5 aa, Mycobacterium tuberculosis
VREPG

SEQ ID NO: 1365296 - protein, 6 aa, Mycobacterium tuberculosis
VRGEDD

SEQ ID NO: 1365297 - protein, 6 aa, Mycobacterium tuberculosis
VRSELE

SEQ ID NO: 1365298 - protein, 10 aa, Mycobacterium tuberculosis
VSASGSDSAV

SEQ ID NO: 1365299 - protein, 16 aa, Mycobacterium tuberculosis
VSTAGDEVKDPQKTMP

SEQ ID NO: 1365300 - protein, 10 aa, Mycobacterium tuberculosis
VTGTKAPGDI

SEQ ID NO: 1365301 - protein, 7 aa, Mycobacterium tuberculosis
VTTSPLP

SEQ ID NO: 1365302 - protein, 4 aa, Mycobacterium tuberculosis
WSSE

SEQ ID NO: 1365303 - protein, 9 aa, Mycobacterium tuberculosis
YGATSGQAL

SEQ ID NO: 1365304 - protein, 6 aa, Mycobacterium tuberculosis
YKSAQT

SEQ ID NO: 1365305 - protein, 7 aa, Mycobacterium tuberculosis
YLDAQGD

SEQ ID NO: 1365306 - protein, 5 aa, Mycobacterium tuberculosis
YPGLN

SEQ ID NO: 1365307 - protein, 9 aa, Mycobacterium tuberculosis
AAADAAHRA

SEQ ID NO: 1365308 - protein, 12 aa, Mycobacterium tuberculosis
AAADGASVPHGP

SEQ ID NO: 1365309 - protein, 13 aa, Mycobacterium tuberculosis
AAADGDPATAWTA

SEQ ID NO: 1365310 - protein, 7 aa, Mycobacterium tuberculosis
AAAGEAS

SEQ ID NO: 1365311 - protein, 8 aa, Mycobacterium tuberculosis
AADPRSRT

SEQ ID NO: 1365312 - protein, 14 aa, Mycobacterium tuberculosis
AAERERPQLGGEDR

SEQ ID NO: 1365313 - protein, 5 aa, Mycobacterium tuberculosis
AAGAS

SEQ ID NO: 1365314 - protein, 12 aa, Mycobacterium tuberculosis
AAGAVSADGKAA

SEQ ID NO: 1365315 - protein, 4 aa, Mycobacterium tuberculosis
AAGD

SEQ ID NO: 1365316 - protein, 8 aa, Mycobacterium tuberculosis
AAGKQAPN

SEQ ID NO: 1365317 - protein, 8 aa, Mycobacterium tuberculosis
AAGLSEGA

SEQ ID NO: 1365318 - protein, 7 aa, Mycobacterium tuberculosis
AALKASA

SEQ ID NO: 1365319 - protein, 8 aa, Mycobacterium tuberculosis
AAPELGEP

SEQ ID NO: 1365320 - protein, 9 aa, Mycobacterium tuberculosis
AAPRARRSI

SEQ ID NO: 1365321 - protein, 6 aa, Mycobacterium tuberculosis
AARPGT

SEQ ID NO: 1365322 - protein, 10 aa, Mycobacterium tuberculosis
AATDDGSAGV

SEQ ID NO: 1365323 - protein, 12 aa, Mycobacterium tuberculosis
AATYQDIRDGTK

SEQ ID NO: 1365324 - protein, 5 aa, Mycobacterium tuberculosis
ADDST

SEQ ID NO: 1365325 - protein, 5 aa, Mycobacterium tuberculosis
ADGGM

SEQ ID NO: 1365326 - protein, 8 aa, Mycobacterium tuberculosis
ADGSPSYE

SEQ ID NO: 1365327 - protein, 6 aa, Mycobacterium tuberculosis
ADPAVA

SEQ ID NO: 1365328 - protein, 21 aa, Mycobacterium tuberculosis
ADPQPSDLGDQSPGADAQAKW

SEQ ID NO: 1365329 - protein, 8 aa, Mycobacterium tuberculosis
AEATNTSA

SEQ ID NO: 1365330 - protein, 7 aa, Mycobacterium tuberculosis
AEEASRR

SEQ ID NO: 1365331 - protein, 5 aa, Mycobacterium tuberculosis
AEHGV

SEQ ID NO: 1365332 - protein, 4 aa, Mycobacterium tuberculosis
AEPG

SEQ ID NO: 1365333 - protein, 4 aa, Mycobacterium tuberculosis
AGAD

SEQ ID NO: 1365334 - protein, 11 aa, Mycobacterium tuberculosis
AGAKSQEPRHS

SEQ ID NO: 1365335 - protein, 13 aa, Mycobacterium tuberculosis
AGDGSKKDCKQNP

SEQ ID NO: 1365336 - protein, 21 aa, Mycobacterium tuberculosis
AGGSEVDQATVTGEPLPVDKS

SEQ ID NO: 1365337 - protein, 5 aa, Mycobacterium tuberculosis
AGHGG

SEQ ID NO: 1365338 - protein, 6 aa, Mycobacterium tuberculosis
AGKPLT

SEQ ID NO: 1365339 - protein, 7 aa, Mycobacterium tuberculosis
AGLDPGV

SEQ ID NO: 1365340 - protein, 15 aa, Mycobacterium tuberculosis
AGPHAGDRSPSRTVP

SEQ ID NO: 1365341 - protein, 11 aa, Mycobacterium tuberculosis
AGSGSGGEPTV

SEQ ID NO: 1365342 - protein, 4 aa, Mycobacterium tuberculosis
AGSL

SEQ ID NO: 1365343 - protein, 5 aa, Mycobacterium tuberculosis
AGSTA

SEQ ID NO: 1365344 - protein, 6 aa, Mycobacterium tuberculosis
AGTPLR

SEQ ID NO: 1365345 - protein, 5 aa, Mycobacterium tuberculosis
AHPEL

SEQ ID NO: 1365346 - protein, 12 aa, Mycobacterium tuberculosis
AIRAPGDARHTY

SEQ ID NO: 1365347 - protein, 8 aa, Mycobacterium tuberculosis
AKARGDEV

SEQ ID NO: 1365348 - protein, 12 aa, Mycobacterium tuberculosis
AKGAQPNTSLAD

SEQ ID NO: 1365349 - protein, 9 aa, Mycobacterium tuberculosis
AKNAKVSTV

SEQ ID NO: 1365350 - protein, 4 aa, Mycobacterium tuberculosis
AKVN

SEQ ID NO: 1365351 - protein, 5 aa, Mycobacterium tuberculosis
ALERD

SEQ ID NO: 1365352 - protein, 8 aa, Mycobacterium tuberculosis
ALNTDQNI

SEQ ID NO: 1365353 - protein, 4 aa, Mycobacterium tuberculosis
ALPS

SEQ ID NO: 1365354 - protein, 12 aa, Mycobacterium tuberculosis
ALPTGREELADT

SEQ ID NO: 1365355 - protein, 8 aa, Mycobacterium tuberculosis
AMTPLSPD

SEQ ID NO: 1365356 - protein, 9 aa, Mycobacterium tuberculosis
ANGGPETAT

SEQ ID NO: 1365357 - protein, 6 aa, Mycobacterium tuberculosis
ANPPAA

SEQ ID NO: 1365358 - protein, 19 aa, Mycobacterium tuberculosis
ANRAGSVQWGPSDTYQATG

SEQ ID NO: 1365359 - protein, 7 aa, Mycobacterium tuberculosis
ANSSDDG

SEQ ID NO: 1365360 - protein, 10 aa, Mycobacterium tuberculosis
ANVTGPAATV

SEQ ID NO: 1365361 - protein, 9 aa, Mycobacterium tuberculosis
APANPGAPY

SEQ ID NO: 1365362 - protein, 6 aa, Mycobacterium tuberculosis
APGVGK

SEQ ID NO: 1365363 - protein, 15 aa, Mycobacterium tuberculosis
APPPPAPPAATPTPP

SEQ ID NO: 1365364 - protein, 6 aa, Mycobacterium tuberculosis
APRKTR

SEQ ID NO: 1365365 - protein, 14 aa, Mycobacterium tuberculosis
APTTGAAPEIDTAR

SEQ ID NO: 1365366 - protein, 9 aa, Mycobacterium tuberculosis
AQAAEQRAS

SEQ ID NO: 1365367 - protein, 9 aa, Mycobacterium tuberculosis
AQADYDEAM

SEQ ID NO: 1365368 - protein, 14 aa, Mycobacterium tuberculosis
AQARYTDPNTRSFT

SEQ ID NO: 1365369 - protein, 16 aa, Mycobacterium tuberculosis
AQQGAQGAAGSGVRTE

SEQ ID NO: 1365370 - protein, 6 aa, Mycobacterium tuberculosis
ARATEV

SEQ ID NO: 1365371 - protein, 11 aa, Mycobacterium tuberculosis
ARNAGTSDVAK

SEQ ID NO: 1365372 - protein, 5 aa, Mycobacterium tuberculosis
ARPAR

SEQ ID NO: 1365373 - protein, 12 aa, Mycobacterium tuberculosis
ARRGQEVNANAE

SEQ ID NO: 1365374 - protein, 24 aa, Mycobacterium tuberculosis
ARRQHSNAAGRAAPQDDGPDMGPR

SEQ ID NO: 1365375 - protein, 8 aa, Mycobacterium tuberculosis
ARSGAQPR

SEQ ID NO: 1365376 - protein, 23 aa, Mycobacterium tuberculosis
ASGGNPSPASGGHRRGKPRVPGL

SEQ ID NO: 1365377 - protein, 22 aa, Mycobacterium tuberculosis
ASHALSPPVEVSRQPEPEVDTA

SEQ ID NO: 1365378 - protein, 7 aa, Mycobacterium tuberculosis
ASLTATL

SEQ ID NO: 1365379 - protein, 15 aa, Mycobacterium tuberculosis
ASRQLPAPTTGAGWT

SEQ ID NO: 1365380 - protein, 7 aa, Mycobacterium tuberculosis
ASSDQLM

SEQ ID NO: 1365381 - protein, 9 aa, Mycobacterium tuberculosis
ASTAGDITG

SEQ ID NO: 1365382 - protein, 6 aa, Mycobacterium tuberculosis
ASVGEY

SEQ ID NO: 1365383 - protein, 16 aa, Mycobacterium tuberculosis
ATAAPAAPSGASTTRM

SEQ ID NO: 1365384 - protein, 7 aa, Mycobacterium tuberculosis
ATANGAL

SEQ ID NO: 1365385 - protein, 4 aa, Mycobacterium tuberculosis
ATAT

SEQ ID NO: 1365386 - protein, 14 aa, Mycobacterium tuberculosis
ATGESVKAETMPSE

SEQ ID NO: 1365387 - protein, 8 aa, Mycobacterium tuberculosis
ATGTSQGA

SEQ ID NO: 1365388 - protein, 5 aa, Mycobacterium tuberculosis
ATMPR

SEQ ID NO: 1365389 - protein, 14 aa, Mycobacterium tuberculosis
ATTAAANGLTQSLG

SEQ ID NO: 1365390 - protein, 21 aa, Mycobacterium tuberculosis
ATYAPHRERGESEHSIPAGPH

SEQ ID NO: 1365391 - protein, 6 aa, Mycobacterium tuberculosis
AVADRT

SEQ ID NO: 1365392 - protein, 7 aa, Mycobacterium tuberculosis
CDQQGGL

SEQ ID NO: 1365393 - protein, 8 aa, Mycobacterium tuberculosis
CRTGADAN

SEQ ID NO: 1365394 - protein, 4 aa, Mycobacterium tuberculosis
CTPA

SEQ ID NO: 1365395 - protein, 5 aa, Mycobacterium tuberculosis
DAANR

SEQ ID NO: 1365396 - protein, 8 aa, Mycobacterium tuberculosis
DAGIDPRT

SEQ ID NO: 1365397 - protein, 5 aa, Mycobacterium tuberculosis
DAGTM

SEQ ID NO: 1365398 - protein, 33 aa, Mycobacterium tuberculosis
DAPAGRDPGPVSRPHPSDLQNGDLPADAARGPI

SEQ ID NO: 1365399 - protein, 13 aa, Mycobacterium tuberculosis
DASINHGNSGGPL

SEQ ID NO: 1365400 - protein, 5 aa, Mycobacterium tuberculosis
DATHD

SEQ ID NO: 1365401 - protein, 6 aa, Mycobacterium tuberculosis
DATTQM

SEQ ID NO: 1365402 - protein, 7 aa, Mycobacterium tuberculosis
DDAETRE

SEQ ID NO: 1365403 - protein, 14 aa, Mycobacterium tuberculosis
DDAGDGSAWSAANA

SEQ ID NO: 1365404 - protein, 8 aa, Mycobacterium tuberculosis
DDAPQTTI

SEQ ID NO: 1365405 - protein, 13 aa, Mycobacterium tuberculosis
DDPNIQQSDRNGA

SEQ ID NO: 1365406 - protein, 13 aa, Mycobacterium tuberculosis
DDTGVREVSTGDD

SEQ ID NO: 1365407 - protein, 9 aa, Mycobacterium tuberculosis
DEAEGGMGP

SEQ ID NO: 1365408 - protein, 6 aa, Mycobacterium tuberculosis
DELTPG

SEQ ID NO: 1365409 - protein, 10 aa, Mycobacterium tuberculosis
DEPQRDPVAP

SEQ ID NO: 1365410 - protein, 11 aa, Mycobacterium tuberculosis
DESAITGESAP

SEQ ID NO: 1365411 - protein, 9 aa, Mycobacterium tuberculosis
DFADTGEGG

SEQ ID NO: 1365412 - protein, 6 aa, Mycobacterium tuberculosis
DFSDGY

SEQ ID NO: 1365413 - protein, 5 aa, Mycobacterium tuberculosis
DGLPT

SEQ ID NO: 1365414 - protein, 18 aa, Mycobacterium tuberculosis
DGQSCAARPVTADELTEV

SEQ ID NO: 1365415 - protein, 5 aa, Mycobacterium tuberculosis
DGSVD

SEQ ID NO: 1365416 - protein, 11 aa, Mycobacterium tuberculosis
DGVASRTHDDV

SEQ ID NO: 1365417 - protein, 12 aa, Mycobacterium tuberculosis
DHQTEAADQIAS

SEQ ID NO: 1365418 - protein, 9 aa, Mycobacterium tuberculosis
DISGAGAAL

SEQ ID NO: 1365419 - protein, 20 aa, Mycobacterium tuberculosis
DKVRSGAITAPLGSQREYRP

SEQ ID NO: 1365420 - protein, 7 aa, Mycobacterium tuberculosis
DLAEPQL

SEQ ID NO: 1365421 - protein, 10 aa, Mycobacterium tuberculosis
DLGTPKSYHA

SEQ ID NO: 1365422 - protein, 8 aa, Mycobacterium tuberculosis
DLPARRRE

SEQ ID NO: 1365423 - protein, 4 aa, Mycobacterium tuberculosis
DLTP

SEQ ID NO: 1365424 - protein, 4 aa, Mycobacterium tuberculosis
DMRN

SEQ ID NO: 1365425 - protein, 5 aa, Mycobacterium tuberculosis
DMTGA

SEQ ID NO: 1365426 - protein, 4 aa, Mycobacterium tuberculosis
DNGE

SEQ ID NO: 1365427 - protein, 8 aa, Mycobacterium tuberculosis
DNHATAAA

SEQ ID NO: 1365428 - protein, 7 aa, Mycobacterium tuberculosis
DPETVQR

SEQ ID NO: 1365429 - protein, 8 aa, Mycobacterium tuberculosis
DPGETTDD

SEQ ID NO: 1365430 - protein, 4 aa, Mycobacterium tuberculosis
DQLD

SEQ ID NO: 1365431 - protein, 8 aa, Mycobacterium tuberculosis
DQLGDNTA

SEQ ID NO: 1365432 - protein, 12 aa, Mycobacterium tuberculosis
DQSSRPGPVTYP

SEQ ID NO: 1365433 - protein, 4 aa, Mycobacterium tuberculosis
DRAT

SEQ ID NO: 1365434 - protein, 79 aa, Mycobacterium tuberculosis
DRDGESTPAVEETSEADIEREQPGDLAGQAPAAHQVDAEAASAAPEEPAALASEAHDETEPEVPEKAAPIPDPAKPDEL

SEQ ID NO: 1365435 - protein, 13 aa, Mycobacterium tuberculosis
DRGANGSTPDDGF

SEQ ID NO: 1365436 - protein, 7 aa, Mycobacterium tuberculosis
DRNHGPS

SEQ ID NO: 1365437 - protein, 13 aa, Mycobacterium tuberculosis
DRSGGYTASSGIT

SEQ ID NO: 1365438 - protein, 12 aa, Mycobacterium tuberculosis
DSAGDMGAAART

SEQ ID NO: 1365439 - protein, 13 aa, Mycobacterium tuberculosis
DSGLGPDRRTASA

SEQ ID NO: 1365440 - protein, 4 aa, Mycobacterium tuberculosis
DSLM

SEQ ID NO: 1365441 - protein, 9 aa, Mycobacterium tuberculosis
DSNPTHAGL

SEQ ID NO: 1365442 - protein, 11 aa, Mycobacterium tuberculosis
DSSPDGTGQLA

SEQ ID NO: 1365443 - protein, 11 aa, Mycobacterium tuberculosis
DSWRDTETERG

SEQ ID NO: 1365444 - protein, 6 aa, Mycobacterium tuberculosis
DTDRDR

SEQ ID NO: 1365445 - protein, 5 aa, Mycobacterium tuberculosis
DTIDA

SEQ ID NO: 1365446 - protein, 6 aa, Mycobacterium tuberculosis
DTPPVP

SEQ ID NO: 1365447 - protein, 4 aa, Mycobacterium tuberculosis
DTRH

SEQ ID NO: 1365448 - protein, 6 aa, Mycobacterium tuberculosis
DTYRGP

SEQ ID NO: 1365449 - protein, 6 aa, Mycobacterium tuberculosis
DVRGQV

SEQ ID NO: 1365450 - protein, 9 aa, Mycobacterium tuberculosis
DYPVPGAEP

SEQ ID NO: 1365451 - protein, 6 aa, Mycobacterium tuberculosis
DYQPTA

SEQ ID NO: 1365452 - protein, 11 aa, Mycobacterium tuberculosis
EAAERVARTDD

SEQ ID NO: 1365453 - protein, 6 aa, Mycobacterium tuberculosis
EAAKQF

SEQ ID NO: 1365454 - protein, 4 aa, Mycobacterium tuberculosis
EAEN

SEQ ID NO: 1365455 - protein, 5 aa, Mycobacterium tuberculosis
ECRAG

SEQ ID NO: 1365456 - protein, 25 aa, Mycobacterium tuberculosis
EDAEDYDDYDDYEAADQEAARSASW

SEQ ID NO: 1365457 - protein, 7 aa, Mycobacterium tuberculosis
EDMDAGG

SEQ ID NO: 1365458 - protein, 4 aa, Mycobacterium tuberculosis
EEGH

SEQ ID NO: 1365459 - protein, 4 aa, Mycobacterium tuberculosis
EEGT

SEQ ID NO: 1365460 - protein, 18 aa, Mycobacterium tuberculosis
EEHDEYGAAADRSAPLSR

SEQ ID NO: 1365461 - protein, 5 aa, Mycobacterium tuberculosis
EEQCE

SEQ ID NO: 1365462 - protein, 10 aa, Mycobacterium tuberculosis
EEVRDPARTI

SEQ ID NO: 1365463 - protein, 6 aa, Mycobacterium tuberculosis
EFSSDP

SEQ ID NO: 1365464 - protein, 8 aa, Mycobacterium tuberculosis
EGQEGDRG

SEQ ID NO: 1365465 - protein, 23 aa, Mycobacterium tuberculosis
EHDAEPAAHGAPRDDEVAPLSFA

SEQ ID NO: 1365466 - protein, 5 aa, Mycobacterium tuberculosis
EHGAE

SEQ ID NO: 1365467 - protein, 5 aa, Mycobacterium tuberculosis
EIAPK

SEQ ID NO: 1365468 - protein, 5 aa, Mycobacterium tuberculosis
EKDGV

SEQ ID NO: 1365469 - protein, 9 aa, Mycobacterium tuberculosis
EKGLGAADE

SEQ ID NO: 1365470 - protein, 8 aa, Mycobacterium tuberculosis
EKKSLADR

SEQ ID NO: 1365471 - protein, 9 aa, Mycobacterium tuberculosis
EKPTAGTGA

SEQ ID NO: 1365472 - protein, 6 aa, Mycobacterium tuberculosis
ELAGAT

SEQ ID NO: 1365473 - protein, 10 aa, Mycobacterium tuberculosis
ELDPDERDRA

SEQ ID NO: 1365474 - protein, 7 aa, Mycobacterium tuberculosis
ELRPEAA

SEQ ID NO: 1365475 - protein, 5 aa, Mycobacterium tuberculosis
ENTHG

SEQ ID NO: 1365476 - protein, 12 aa, Mycobacterium tuberculosis
EPALASPRRPQA

SEQ ID NO: 1365477 - protein, 8 aa, Mycobacterium tuberculosis
EPDADSDI

SEQ ID NO: 1365478 - protein, 9 aa, Mycobacterium tuberculosis
EPDNDPANM

SEQ ID NO: 1365479 - protein, 11 aa, Mycobacterium tuberculosis
EPPIPQPAAAP

SEQ ID NO: 1365480 - protein, 26 aa, Mycobacterium tuberculosis
EPTTADDVDAGYRGDWPATCTSATEV

SEQ ID NO: 1365481 - protein, 8 aa, Mycobacterium tuberculosis
EQKEKIPD

SEQ ID NO: 1365482 - protein, 11 aa, Mycobacterium tuberculosis
ERAPSQADGRN

SEQ ID NO: 1365483 - protein, 6 aa, Mycobacterium tuberculosis
ESCGGG

SEQ ID NO: 1365484 - protein, 4 aa, Mycobacterium tuberculosis
ESEA

SEQ ID NO: 1365485 - protein, 19 aa, Mycobacterium tuberculosis
ESIETAATGQPRPASGAYL

SEQ ID NO: 1365486 - protein, 9 aa, Mycobacterium tuberculosis
ETEAASRTV

SEQ ID NO: 1365487 - protein, 4 aa, Mycobacterium tuberculosis
ETSR

SEQ ID NO: 1365488 - protein, 6 aa, Mycobacterium tuberculosis
EVGAGL

SEQ ID NO: 1365489 - protein, 18 aa, Mycobacterium tuberculosis
EVSQGKLEQCTGPGPAAL

SEQ ID NO: 1365490 - protein, 9 aa, Mycobacterium tuberculosis
FADPAGGTG

SEQ ID NO: 1365491 - protein, 5 aa, Mycobacterium tuberculosis
FATTT

SEQ ID NO: 1365492 - protein, 10 aa, Mycobacterium tuberculosis
FDGDDADTVE

SEQ ID NO: 1365493 - protein, 4 aa, Mycobacterium tuberculosis
FEDP

SEQ ID NO: 1365494 - protein, 13 aa, Mycobacterium tuberculosis
FEPEPQAPEVPEA

SEQ ID NO: 1365495 - protein, 15 aa, Mycobacterium tuberculosis
FGGPATAGAFSRPGL

SEQ ID NO: 1365496 - protein, 8 aa, Mycobacterium tuberculosis
FGPAGMTA

SEQ ID NO: 1365497 - protein, 9 aa, Mycobacterium tuberculosis
FNGTPAVEP

SEQ ID NO: 1365498 - protein, 5 aa, Mycobacterium tuberculosis
FRAAT

SEQ ID NO: 1365499 - protein, 8 aa, Mycobacterium tuberculosis
FTPAQATA

SEQ ID NO: 1365500 - protein, 4 aa, Mycobacterium tuberculosis
FTYP

SEQ ID NO: 1365501 - protein, 8 aa, Mycobacterium tuberculosis
GAALPSAN

SEQ ID NO: 1365502 - protein, 9 aa, Mycobacterium tuberculosis
GAARTAGAD

SEQ ID NO: 1365503 - protein, 12 aa, Mycobacterium tuberculosis
GADSATSDLAER

SEQ ID NO: 1365504 - protein, 14 aa, Mycobacterium tuberculosis
GAEAAAQREATPLV

SEQ ID NO: 1365505 - protein, 4 aa, Mycobacterium tuberculosis
GALA

SEQ ID NO: 1365506 - protein, 7 aa, Mycobacterium tuberculosis
GAPLPKR

SEQ ID NO: 1365507 - protein, 4 aa, Mycobacterium tuberculosis
GARE

SEQ ID NO: 1365508 - protein, 7 aa, Mycobacterium tuberculosis
GARQAQQ

SEQ ID NO: 1365509 - protein, 13 aa, Mycobacterium tuberculosis
GDGVGGTDPTDAF

SEQ ID NO: 1365510 - protein, 15 aa, Mycobacterium tuberculosis
GDHQTHTIYRGAHPT

SEQ ID NO: 1365511 - protein, 5 aa, Mycobacterium tuberculosis
GDREA

SEQ ID NO: 1365512 - protein, 8 aa, Mycobacterium tuberculosis
GDRIPADG

SEQ ID NO: 1365513 - protein, 8 aa, Mycobacterium tuberculosis
GDTGEPVN

SEQ ID NO: 1365514 - protein, 9 aa, Mycobacterium tuberculosis
GEHRHPSAN

SEQ ID NO: 1365515 - protein, 8 aa, Mycobacterium tuberculosis
GEPQNMPT

SEQ ID NO: 1365516 - protein, 25 aa, Mycobacterium tuberculosis
GFKEQYAKSSADLARRGVTAQAATL

SEQ ID NO: 1365517 - protein, 6 aa, Mycobacterium tuberculosis
GGATAR

SEQ ID NO: 1365518 - protein, 9 aa, Mycobacterium tuberculosis
GGERADRTD

SEQ ID NO: 1365519 - protein, 8 aa, Mycobacterium tuberculosis
GGGGRLGN

SEQ ID NO: 1365520 - protein, 11 aa, Mycobacterium tuberculosis
GGGQQQMSRPK

SEQ ID NO: 1365521 - protein, 9 aa, Mycobacterium tuberculosis
GGNGSGKST

SEQ ID NO: 1365522 - protein, 9 aa, Mycobacterium tuberculosis
GGNKTFNEI

SEQ ID NO: 1365523 - protein, 7 aa, Mycobacterium tuberculosis
GGTAETG

SEQ ID NO: 1365524 - protein, 6 aa, Mycobacterium tuberculosis
GGVPAP

SEQ ID NO: 1365525 - protein, 6 aa, Mycobacterium tuberculosis
GHGSQT

SEQ ID NO: 1365526 - protein, 13 aa, Mycobacterium tuberculosis
GIASGDGTVKRSG

SEQ ID NO: 1365527 - protein, 7 aa, Mycobacterium tuberculosis
GKDATGI

SEQ ID NO: 1365528 - protein, 13 aa, Mycobacterium tuberculosis
GLGGGNFASSMSN

SEQ ID NO: 1365529 - protein, 12 aa, Mycobacterium tuberculosis
GLSETGTRINDQ

SEQ ID NO: 1365530 - protein, 4 aa, Mycobacterium tuberculosis
GMGT

SEQ ID NO: 1365531 - protein, 5 aa, Mycobacterium tuberculosis
GNPHT

SEQ ID NO: 1365532 - protein, 4 aa, Mycobacterium tuberculosis
GPEA

SEQ ID NO: 1365533 - protein, 8 aa, Mycobacterium tuberculosis
GPHPSTLA

SEQ ID NO: 1365534 - protein, 9 aa, Mycobacterium tuberculosis
GPYAKEGWD

SEQ ID NO: 1365535 - protein, 21 aa, Mycobacterium tuberculosis
GQVNGPKLANNAITTDPAVSQ

SEQ ID NO: 1365536 - protein, 5 aa, Mycobacterium tuberculosis
GRAAL

SEQ ID NO: 1365537 - protein, 7 aa, Mycobacterium tuberculosis
GRAPERL

SEQ ID NO: 1365538 - protein, 6 aa, Mycobacterium tuberculosis
GRATRL

SEQ ID NO: 1365539 - protein, 7 aa, Mycobacterium tuberculosis
GRDNQNR

SEQ ID NO: 1365540 - protein, 11 aa, Mycobacterium tuberculosis
GRDNTDQFNTR

SEQ ID NO: 1365541 - protein, 7 aa, Mycobacterium tuberculosis
GRGVPAL

SEQ ID NO: 1365542 - protein, 22 aa, Mycobacterium tuberculosis
GRIADEATGARSKGAVSGRGAV

SEQ ID NO: 1365543 - protein, 11 aa, Mycobacterium tuberculosis
GRNGAGKSTTL

SEQ ID NO: 1365544 - protein, 16 aa, Mycobacterium tuberculosis
GRNGDDREYDYETNID

SEQ ID NO: 1365545 - protein, 4 aa, Mycobacterium tuberculosis
GRVE

SEQ ID NO: 1365546 - protein, 6 aa, Mycobacterium tuberculosis
GSEPQS

SEQ ID NO: 1365547 - protein, 4 aa, Mycobacterium tuberculosis
GSES

SEQ ID NO: 1365548 - protein, 13 aa, Mycobacterium tuberculosis
GSHNESPDGMTPP

SEQ ID NO: 1365549 - protein, 6 aa, Mycobacterium tuberculosis
GSKVTY

SEQ ID NO: 1365550 - protein, 8 aa, Mycobacterium tuberculosis
GSPYSTPT

SEQ ID NO: 1365551 - protein, 8 aa, Mycobacterium tuberculosis
GSTNGTYL

SEQ ID NO: 1365552 - protein, 11 aa, Mycobacterium tuberculosis
GTITGTSVEGN

SEQ ID NO: 1365553 - protein, 6 aa, Mycobacterium tuberculosis
GTNTTA

SEQ ID NO: 1365554 - protein, 13 aa, Mycobacterium tuberculosis
GVEPTERGARATM

SEQ ID NO: 1365555 - protein, 17 aa, Mycobacterium tuberculosis
GVNPDDDKPSGSSDETL

SEQ ID NO: 1365556 - protein, 7 aa, Mycobacterium tuberculosis
GVRAGDG

SEQ ID NO: 1365557 - protein, 11 aa, Mycobacterium tuberculosis
HARVGDDGGRV

SEQ ID NO: 1365558 - protein, 4 aa, Mycobacterium tuberculosis
HEAN

SEQ ID NO: 1365559 - protein, 10 aa, Mycobacterium tuberculosis
HGDHPGYELE

SEQ ID NO: 1365560 - protein, 7 aa, Mycobacterium tuberculosis
HGDYTLP

SEQ ID NO: 1365561 - protein, 6 aa, Mycobacterium tuberculosis
HGEGQS

SEQ ID NO: 1365562 - protein, 6 aa, Mycobacterium tuberculosis
HHEPPG

SEQ ID NO: 1365563 - protein, 7 aa, Mycobacterium tuberculosis
HHGGGLD

SEQ ID NO: 1365564 - protein, 4 aa, Mycobacterium tuberculosis
HHSA

SEQ ID NO: 1365565 - protein, 13 aa, Mycobacterium tuberculosis
HNPDTSRRLTGEQ

SEQ ID NO: 1365566 - protein, 8 aa, Mycobacterium tuberculosis
HPTPACPQ

SEQ ID NO: 1365567 - protein, 9 aa, Mycobacterium tuberculosis
HQRPKLERY

SEQ ID NO: 1365568 - protein, 12 aa, Mycobacterium tuberculosis
HRRKRSESGVGI

SEQ ID NO: 1365569 - protein, 6 aa, Mycobacterium tuberculosis
HSVKTY

SEQ ID NO: 1365570 - protein, 6 aa, Mycobacterium tuberculosis
HVSPRG

SEQ ID NO: 1365571 - protein, 10 aa, Mycobacterium tuberculosis
IAKDDNSASY

SEQ ID NO: 1365572 - protein, 16 aa, Mycobacterium tuberculosis
IDPPKPVRVAPNPPIA

SEQ ID NO: 1365573 - protein, 13 aa, Mycobacterium tuberculosis
IDTAKGSRAGPVE

SEQ ID NO: 1365574 - protein, 6 aa, Mycobacterium tuberculosis
IGDRSP

SEQ ID NO: 1365575 - protein, 5 aa, Mycobacterium tuberculosis
IGGQD

SEQ ID NO: 1365576 - protein, 16 aa, Mycobacterium tuberculosis
IGPRTQSDRFSGCSIS

SEQ ID NO: 1365577 - protein, 17 aa, Mycobacterium tuberculosis
IGRSGRSSHAIGAADDT

SEQ ID NO: 1365578 - protein, 28 aa, Mycobacterium tuberculosis
IGSEEPSEEASEATEESAVSADRSDDSA

SEQ ID NO: 1365579 - protein, 10 aa, Mycobacterium tuberculosis
IGTPPYAGRR

SEQ ID NO: 1365580 - protein, 5 aa, Mycobacterium tuberculosis
IPPAK

SEQ ID NO: 1365581 - protein, 8 aa, Mycobacterium tuberculosis
IPQQSRTS

SEQ ID NO: 1365582 - protein, 8 aa, Mycobacterium tuberculosis
IPSQRSAT

SEQ ID NO: 1365583 - protein, 10 aa, Mycobacterium tuberculosis
IRGSAGEDMA

SEQ ID NO: 1365584 - protein, 11 aa, Mycobacterium tuberculosis
ISEQEKKITAY

SEQ ID NO: 1365585 - protein, 8 aa, Mycobacterium tuberculosis
ISESAPTV

SEQ ID NO: 1365586 - protein, 5 aa, Mycobacterium tuberculosis
ISGEP

SEQ ID NO: 1365587 - protein, 16 aa, Mycobacterium tuberculosis
ISRRPKRLRPAPPVEL

SEQ ID NO: 1365588 - protein, 18 aa, Mycobacterium tuberculosis
ITARGGTGQLSAHPGRPK

SEQ ID NO: 1365589 - protein, 14 aa, Mycobacterium tuberculosis
KAAATAAGAAGSVR

SEQ ID NO: 1365590 - protein, 4 aa, Mycobacterium tuberculosis
KDGP

SEQ ID NO: 1365591 - protein, 12 aa, Mycobacterium tuberculosis
KEGQAGQSKMTQ

SEQ ID NO: 1365592 - protein, 9 aa, Mycobacterium tuberculosis
KFPSNTESR

SEQ ID NO: 1365593 - protein, 7 aa, Mycobacterium tuberculosis
KIETRSD

SEQ ID NO: 1365594 - protein, 8 aa, Mycobacterium tuberculosis
KLAPSRPQ

SEQ ID NO: 1365595 - protein, 4 aa, Mycobacterium tuberculosis
KPLR

SEQ ID NO: 1365596 - protein, 10 aa, Mycobacterium tuberculosis
KPVGGEQSKR

SEQ ID NO: 1365597 - protein, 20 aa, Mycobacterium tuberculosis
KREHPNWDEDGVKDSGTNAS

SEQ ID NO: 1365598 - protein, 9 aa, Mycobacterium tuberculosis
KRSINARKP

SEQ ID NO: 1365599 - protein, 8 aa, Mycobacterium tuberculosis
KSRDEIGD

SEQ ID NO: 1365600 - protein, 15 aa, Mycobacterium tuberculosis
KTAAKEAIKGTPLEG

SEQ ID NO: 1365601 - protein, 11 aa, Mycobacterium tuberculosis
KYRADKKITAT

SEQ ID NO: 1365602 - protein, 7 aa, Mycobacterium tuberculosis
LAAKPST

SEQ ID NO: 1365603 - protein, 5 aa, Mycobacterium tuberculosis
LAARD

SEQ ID NO: 1365604 - protein, 10 aa, Mycobacterium tuberculosis
LAEPRSALSD

SEQ ID NO: 1365605 - protein, 5 aa, Mycobacterium tuberculosis
LAGAA

SEQ ID NO: 1365606 - protein, 8 aa, Mycobacterium tuberculosis
LANERPPS

SEQ ID NO: 1365607 - protein, 4 aa, Mycobacterium tuberculosis
LANT

SEQ ID NO: 1365608 - protein, 8 aa, Mycobacterium tuberculosis
LARPPKPV

SEQ ID NO: 1365609 - protein, 6 aa, Mycobacterium tuberculosis
LATATD

SEQ ID NO: 1365610 - protein, 6 aa, Mycobacterium tuberculosis
LDDEGQ

SEQ ID NO: 1365611 - protein, 12 aa, Mycobacterium tuberculosis
LDDNTPETPAQR

SEQ ID NO: 1365612 - protein, 10 aa, Mycobacterium tuberculosis
LDGAGRQESV

SEQ ID NO: 1365613 - protein, 7 aa, Mycobacterium tuberculosis
LDGTAKG

SEQ ID NO: 1365614 - protein, 8 aa, Mycobacterium tuberculosis
LDQATTAS

SEQ ID NO: 1365615 - protein, 16 aa, Mycobacterium tuberculosis
LDTTARPQCQRTTRLS

SEQ ID NO: 1365616 - protein, 6 aa, Mycobacterium tuberculosis
LESYTS

SEQ ID NO: 1365617 - protein, 6 aa, Mycobacterium tuberculosis
LGARPG

SEQ ID NO: 1365618 - protein, 4 aa, Mycobacterium tuberculosis
LGDT

SEQ ID NO: 1365619 - protein, 11 aa, Mycobacterium tuberculosis
LGGEAKTPKAA

SEQ ID NO: 1365620 - protein, 13 aa, Mycobacterium tuberculosis
LGPARNLSTDPDE

SEQ ID NO: 1365621 - protein, 17 aa, Mycobacterium tuberculosis
LGPRRTTALSAERAALL

SEQ ID NO: 1365622 - protein, 7 aa, Mycobacterium tuberculosis
LGQRAAA

SEQ ID NO: 1365623 - protein, 6 aa, Mycobacterium tuberculosis
LGQREA

SEQ ID NO: 1365624 - protein, 7 aa, Mycobacterium tuberculosis
LKEPRES

SEQ ID NO: 1365625 - protein, 5 aa, Mycobacterium tuberculosis
LLTPG

SEQ ID NO: 1365626 - protein, 5 aa, Mycobacterium tuberculosis
LPAGS

SEQ ID NO: 1365627 - protein, 5 aa, Mycobacterium tuberculosis
LPAQA

SEQ ID NO: 1365628 - protein, 6 aa, Mycobacterium tuberculosis
LPCPED

SEQ ID NO: 1365629 - protein, 9 aa, Mycobacterium tuberculosis
LPGKQFEAG

SEQ ID NO: 1365630 - protein, 11 aa, Mycobacterium tuberculosis
LPRSASARQVG

SEQ ID NO: 1365631 - protein, 6 aa, Mycobacterium tuberculosis
LQQGPG

SEQ ID NO: 1365632 - protein, 7 aa, Mycobacterium tuberculosis
LRARPDS

SEQ ID NO: 1365633 - protein, 8 aa, Mycobacterium tuberculosis
LRDDETSG

SEQ ID NO: 1365634 - protein, 7 aa, Mycobacterium tuberculosis
LRSSEGE

SEQ ID NO: 1365635 - protein, 11 aa, Mycobacterium tuberculosis
LRYGGGPDQVV

SEQ ID NO: 1365636 - protein, 7 aa, Mycobacterium tuberculosis
LSEQNGA

SEQ ID NO: 1365637 - protein, 7 aa, Mycobacterium tuberculosis
LSGPEMR

SEQ ID NO: 1365638 - protein, 4 aa, Mycobacterium tuberculosis
LSPE

SEQ ID NO: 1365639 - protein, 4 aa, Mycobacterium tuberculosis
LSRG

SEQ ID NO: 1365640 - protein, 6 aa, Mycobacterium tuberculosis
LSSDAF

SEQ ID NO: 1365641 - protein, 9 aa, Mycobacterium tuberculosis
LTGQRDRSR

SEQ ID NO: 1365642 - protein, 11 aa, Mycobacterium tuberculosis
LTNGDGVERRL

SEQ ID NO: 1365643 - protein, 6 aa, Mycobacterium tuberculosis
LTQITK

SEQ ID NO: 1365644 - protein, 23 aa, Mycobacterium tuberculosis
LTRQPGDCSEPASGSEPEHEPIT

SEQ ID NO: 1365645 - protein, 10 aa, Mycobacterium tuberculosis
LTSVSDPDAD

SEQ ID NO: 1365646 - protein, 4 aa, Mycobacterium tuberculosis
MARR

SEQ ID NO: 1365647 - protein, 6 aa, Mycobacterium tuberculosis
MASTSG

SEQ ID NO: 1365648 - protein, 4 aa, Mycobacterium tuberculosis
MATS

SEQ ID NO: 1365649 - protein, 9 aa, Mycobacterium tuberculosis
MGDAPNEPG

SEQ ID NO: 1365650 - protein, 9 aa, Mycobacterium tuberculosis
MGHKKDSLE

SEQ ID NO: 1365651 - protein, 6 aa, Mycobacterium tuberculosis
MIPTRD

SEQ ID NO: 1365652 - protein, 11 aa, Mycobacterium tuberculosis
MPNDEGGNSRL

SEQ ID NO: 1365653 - protein, 5 aa, Mycobacterium tuberculosis
MPPAG

SEQ ID NO: 1365654 - protein, 9 aa, Mycobacterium tuberculosis
MRTNRGGDY

SEQ ID NO: 1365655 - protein, 6 aa, Mycobacterium tuberculosis
MSRGEL

SEQ ID NO: 1365656 - protein, 9 aa, Mycobacterium tuberculosis
MSSPGGVRS

SEQ ID NO: 1365657 - protein, 8 aa, Mycobacterium tuberculosis
MTGASSAE

SEQ ID NO: 1365658 - protein, 69 aa, Mycobacterium tuberculosis
MTGDSDDDGGRRSAQRPARTRSRHARPPSEDNREPIAERRSRRRPRPQNDPHPRRNAHERPAPRSSRFD

SEQ ID NO: 1365659 - protein, 6 aa, Mycobacterium tuberculosis
MTPGAT

SEQ ID NO: 1365660 - protein, 11 aa, Mycobacterium tuberculosis
MTTNSGAPFPD

SEQ ID NO: 1365661 - protein, 9 aa, Mycobacterium tuberculosis
NAASPPLKN

SEQ ID NO: 1365662 - protein, 8 aa, Mycobacterium tuberculosis
NDSDGGTG

SEQ ID NO: 1365663 - protein, 7 aa, Mycobacterium tuberculosis
NDTADEI

SEQ ID NO: 1365664 - protein, 4 aa, Mycobacterium tuberculosis
NEDA

SEQ ID NO: 1365665 - protein, 5 aa, Mycobacterium tuberculosis
NESVE

SEQ ID NO: 1365666 - protein, 10 aa, Mycobacterium tuberculosis
NGEPPEAPKV

SEQ ID NO: 1365667 - protein, 6 aa, Mycobacterium tuberculosis
NGSTTL

SEQ ID NO: 1365668 - protein, 14 aa, Mycobacterium tuberculosis
NGTVVSDGPAPLDQ

SEQ ID NO: 1365669 - protein, 10 aa, Mycobacterium tuberculosis
NNRSGGGVRV

SEQ ID NO: 1365670 - protein, 5 aa, Mycobacterium tuberculosis
NNSPV

SEQ ID NO: 1365671 - protein, 5 aa, Mycobacterium tuberculosis
NPAVP

SEQ ID NO: 1365672 - protein, 4 aa, Mycobacterium tuberculosis
NPDF

SEQ ID NO: 1365673 - protein, 16 aa, Mycobacterium tuberculosis
NPIAGETFASDKGSPL

SEQ ID NO: 1365674 - protein, 6 aa, Mycobacterium tuberculosis
NPRTMT

SEQ ID NO: 1365675 - protein, 4 aa, Mycobacterium tuberculosis
NPSF

SEQ ID NO: 1365676 - protein, 7 aa, Mycobacterium tuberculosis
NQDQGVP

SEQ ID NO: 1365677 - protein, 6 aa, Mycobacterium tuberculosis
NQPPPC

SEQ ID NO: 1365678 - protein, 9 aa, Mycobacterium tuberculosis
NRRRRADEL

SEQ ID NO: 1365679 - protein, 13 aa, Mycobacterium tuberculosis
NSPGMGDDATRVT

SEQ ID NO: 1365680 - protein, 6 aa, Mycobacterium tuberculosis
NSSRGN

SEQ ID NO: 1365681 - protein, 12 aa, Mycobacterium tuberculosis
NTGTQAAREAGN

SEQ ID NO: 1365682 - protein, 13 aa, Mycobacterium tuberculosis
NTPADWARAGNAV

SEQ ID NO: 1365683 - protein, 8 aa, Mycobacterium tuberculosis
NTPAGTQI

SEQ ID NO: 1365684 - protein, 9 aa, Mycobacterium tuberculosis
NTPGNKPID

SEQ ID NO: 1365685 - protein, 5 aa, Mycobacterium tuberculosis
NTSAD

SEQ ID NO: 1365686 - protein, 12 aa, Mycobacterium tuberculosis
NYGGGGAYDEGS

SEQ ID NO: 1365687 - protein, 22 aa, Mycobacterium tuberculosis
NYSGDSPATAQQVAADRATTSN

SEQ ID NO: 1365688 - protein, 5 aa, Mycobacterium tuberculosis
PAASR

SEQ ID NO: 1365689 - protein, 9 aa, Mycobacterium tuberculosis
PACASARTE

SEQ ID NO: 1365690 - protein, 7 aa, Mycobacterium tuberculosis
PAERAGM

SEQ ID NO: 1365691 - protein, 12 aa, Mycobacterium tuberculosis
PAGKTVDDPAWS

SEQ ID NO: 1365692 - protein, 17 aa, Mycobacterium tuberculosis
PAGTLPDGGPFTEAGDK

SEQ ID NO: 1365693 - protein, 7 aa, Mycobacterium tuberculosis
PALNDPY

SEQ ID NO: 1365694 - protein, 6 aa, Mycobacterium tuberculosis
PAPDLA

SEQ ID NO: 1365695 - protein, 12 aa, Mycobacterium tuberculosis
PAPRNSAQHRSA

SEQ ID NO: 1365696 - protein, 13 aa, Mycobacterium tuberculosis
PAQGPSATPAQGL

SEQ ID NO: 1365697 - protein, 8 aa, Mycobacterium tuberculosis
PDGYQTAV

SEQ ID NO: 1365698 - protein, 6 aa, Mycobacterium tuberculosis
PDLGQT

SEQ ID NO: 1365699 - protein, 4 aa, Mycobacterium tuberculosis
PDPA

SEQ ID NO: 1365700 - protein, 8 aa, Mycobacterium tuberculosis
PEASPTLP

SEQ ID NO: 1365701 - protein, 5 aa, Mycobacterium tuberculosis
PEESQ

SEQ ID NO: 1365702 - protein, 5 aa, Mycobacterium tuberculosis
PEGLP

SEQ ID NO: 1365703 - protein, 4 aa, Mycobacterium tuberculosis
PEGY

SEQ ID NO: 1365704 - protein, 16 aa, Mycobacterium tuberculosis
PGAPSSFSPKSPPASS

SEQ ID NO: 1365705 - protein, 7 aa, Mycobacterium tuberculosis
PGHRPAA

SEQ ID NO: 1365706 - protein, 16 aa, Mycobacterium tuberculosis
PGHTATPAGSISTPVD

SEQ ID NO: 1365707 - protein, 9 aa, Mycobacterium tuberculosis
PGPPPGSAI

SEQ ID NO: 1365708 - protein, 8 aa, Mycobacterium tuberculosis
PGRRFRED

SEQ ID NO: 1365709 - protein, 7 aa, Mycobacterium tuberculosis
PGSDPFS

SEQ ID NO: 1365710 - protein, 10 aa, Mycobacterium tuberculosis
PGVSEGQVDN

SEQ ID NO: 1365711 - protein, 23 aa, Mycobacterium tuberculosis
PGWQSAPPGYPPPYPQYPGPGSY

SEQ ID NO: 1365712 - protein, 13 aa, Mycobacterium tuberculosis
PGYPPEPPQVPYP

SEQ ID NO: 1365713 - protein, 10 aa, Mycobacterium tuberculosis
PKPGDIRTNQ

SEQ ID NO: 1365714 - protein, 19 aa, Mycobacterium tuberculosis
PLAATDRRVRARRDRKRQW

SEQ ID NO: 1365715 - protein, 4 aa, Mycobacterium tuberculosis
PLGG

SEQ ID NO: 1365716 - protein, 5 aa, Mycobacterium tuberculosis
PLNDG

SEQ ID NO: 1365717 - protein, 10 aa, Mycobacterium tuberculosis
PLSHRNTQPG

SEQ ID NO: 1365718 - protein, 4 aa, Mycobacterium tuberculosis
PNGA

SEQ ID NO: 1365719 - protein, 4 aa, Mycobacterium tuberculosis
PNPR

SEQ ID NO: 1365720 - protein, 6 aa, Mycobacterium tuberculosis
PPPNAV

SEQ ID NO: 1365721 - protein, 7 aa, Mycobacterium tuberculosis
PQPGKHD

SEQ ID NO: 1365722 - protein, 7 aa, Mycobacterium tuberculosis
PRGWPEA

SEQ ID NO: 1365723 - protein, 14 aa, Mycobacterium tuberculosis
PSDPTNDANATQPP

SEQ ID NO: 1365724 - protein, 14 aa, Mycobacterium tuberculosis
PSNNATFNKTMSEQ

SEQ ID NO: 1365725 - protein, 5 aa, Mycobacterium tuberculosis
PTHGT

SEQ ID NO: 1365726 - protein, 9 aa, Mycobacterium tuberculosis
PTPVGGNAL

SEQ ID NO: 1365727 - protein, 7 aa, Mycobacterium tuberculosis
PTTVRGG

SEQ ID NO: 1365728 - protein, 4 aa, Mycobacterium tuberculosis
PTVP

SEQ ID NO: 1365729 - protein, 6 aa, Mycobacterium tuberculosis
PVHHPT

SEQ ID NO: 1365730 - protein, 6 aa, Mycobacterium tuberculosis
PVNEAA

SEQ ID NO: 1365731 - protein, 4 aa, Mycobacterium tuberculosis
PVTG

SEQ ID NO: 1365732 - protein, 4 aa, Mycobacterium tuberculosis
PWQP

SEQ ID NO: 1365733 - protein, 7 aa, Mycobacterium tuberculosis
QAANGSL

SEQ ID NO: 1365734 - protein, 7 aa, Mycobacterium tuberculosis
QAKADEL

SEQ ID NO: 1365735 - protein, 5 aa, Mycobacterium tuberculosis
QALAP

SEQ ID NO: 1365736 - protein, 31 aa, Mycobacterium tuberculosis
QANGGGPTVVRNPDGSIATQSLRGNDLGRGG

SEQ ID NO: 1365737 - protein, 16 aa, Mycobacterium tuberculosis
QASSLRDNARADGRKV

SEQ ID NO: 1365738 - protein, 20 aa, Mycobacterium tuberculosis
QDSAGRTGPLSAVGRAAAAT

SEQ ID NO: 1365739 - protein, 8 aa, Mycobacterium tuberculosis
QEFQKSAN

SEQ ID NO: 1365740 - protein, 7 aa, Mycobacterium tuberculosis
QETTREV

SEQ ID NO: 1365741 - protein, 9 aa, Mycobacterium tuberculosis
QFDTSDDEQ

SEQ ID NO: 1365742 - protein, 9 aa, Mycobacterium tuberculosis
QGAQLGAGP

SEQ ID NO: 1365743 - protein, 9 aa, Mycobacterium tuberculosis
QGDEPGWDD

SEQ ID NO: 1365744 - protein, 6 aa, Mycobacterium tuberculosis
QGGGPH

SEQ ID NO: 1365745 - protein, 6 aa, Mycobacterium tuberculosis
QLPAGA

SEQ ID NO: 1365746 - protein, 17 aa, Mycobacterium tuberculosis
QPASGNAAAASARAKVA

SEQ ID NO: 1365747 - protein, 5 aa, Mycobacterium tuberculosis
QPTRG

SEQ ID NO: 1365748 - protein, 6 aa, Mycobacterium tuberculosis
QRPVIT

SEQ ID NO: 1365749 - protein, 9 aa, Mycobacterium tuberculosis
QRRASPARV

SEQ ID NO: 1365750 - protein, 15 aa, Mycobacterium tuberculosis
QRVAEGKSNDIPERV

SEQ ID NO: 1365751 - protein, 12 aa, Mycobacterium tuberculosis
QSARADISADGE

SEQ ID NO: 1365752 - protein, 4 aa, Mycobacterium tuberculosis
QSDV

SEQ ID NO: 1365753 - protein, 12 aa, Mycobacterium tuberculosis
QSLPPDTRNGLA

SEQ ID NO: 1365754 - protein, 8 aa, Mycobacterium tuberculosis
QVDVGGPT

SEQ ID NO: 1365755 - protein, 8 aa, Mycobacterium tuberculosis
QWKSRPET

SEQ ID NO: 1365756 - protein, 36 aa, Mycobacterium tuberculosis; identical to SEQ ID NO: 153367

SEQ ID NO: 1365757 - protein, 6 aa, Mycobacterium tuberculosis
RAAGLP

SEQ ID NO: 1365758 - protein, 6 aa, Mycobacterium tuberculosis
RAAGRA

SEQ ID NO: 1365759 - protein, 15 aa, Mycobacterium tuberculosis
RAPTSGTVDRPGTVG

SEQ ID NO: 1365760 - protein, 6 aa, Mycobacterium tuberculosis
RARGSP

SEQ ID NO: 1365761 - protein, 42 aa, Mycobacterium tuberculosis
RASELGGSQSGGYTYPPGPPPPPYSYGGPFGGPSPRSSSGNR

SEQ ID NO: 1365762 - protein, 7 aa, Mycobacterium tuberculosis
RAVADSD

SEQ ID NO: 1365763 - protein, 4 aa, Mycobacterium tuberculosis
RDAA

SEQ ID NO: 1365764 - protein, 5 aa, Mycobacterium tuberculosis
RDASE

SEQ ID NO: 1365765 - protein, 18 aa, Mycobacterium tuberculosis
RDDKKDGVAGPGDAVRVT

SEQ ID NO: 1365766 - protein, 6 aa, Mycobacterium tuberculosis
RDESAL

SEQ ID NO: 1365767 - protein, 6 aa, Mycobacterium tuberculosis
RDLEGR

SEQ ID NO: 1365768 - protein, 10 aa, Mycobacterium tuberculosis
RDPHGRHRPA

SEQ ID NO: 1365769 - protein, 12 aa, Mycobacterium tuberculosis
RDPVSDTGSAQH

SEQ ID NO: 1365770 - protein, 4 aa, Mycobacterium tuberculosis
RDRG

SEQ ID NO: 1365771 - protein, 8 aa, Mycobacterium tuberculosis
RDSPSWSP

SEQ ID NO: 1365772 - protein, 7 aa, Mycobacterium tuberculosis
RECGRTT

SEQ ID NO: 1365773 - protein, 9 aa, Mycobacterium tuberculosis
REFADESDR

SEQ ID NO: 1365774 - protein, 8 aa, Mycobacterium tuberculosis
REGYERDK

SEQ ID NO: 1365775 - protein, 6 aa, Mycobacterium tuberculosis
RETARF

SEQ ID NO: 1365776 - protein, 5 aa, Mycobacterium tuberculosis
RGIGN

SEQ ID NO: 1365777 - protein, 9 aa, Mycobacterium tuberculosis
RGKRTQSTL

SEQ ID NO: 1365778 - protein, 9 aa, Mycobacterium tuberculosis
RGPRLTPGE

SEQ ID NO: 1365779 - protein, 11 aa, Mycobacterium tuberculosis
RGRGDTASIEG

SEQ ID NO: 1365780 - protein, 9 aa, Mycobacterium tuberculosis
RGTERTDHD

SEQ ID NO: 1365781 - protein, 17 aa, Mycobacterium tuberculosis
RHPVTGQPFSDKSKTVA

SEQ ID NO: 1365782 - protein, 6 aa, Mycobacterium tuberculosis
RHTRSV

SEQ ID NO: 1365783 - protein, 7 aa, Mycobacterium tuberculosis
RKHEHTS

SEQ ID NO: 1365784 - protein, 9 aa, Mycobacterium tuberculosis
RLSHPEDAA

SEQ ID NO: 1365785 - protein, 6 aa, Mycobacterium tuberculosis
RNGDRA

SEQ ID NO: 1365786 - protein, 4 aa, Mycobacterium tuberculosis
RPDR

SEQ ID NO: 1365787 - protein, 8 aa, Mycobacterium tuberculosis
RPGRPTAD

SEQ ID NO: 1365788 - protein, 4 aa, Mycobacterium tuberculosis
RPGT

SEQ ID NO: 1365789 - protein, 38 aa, Mycobacterium tuberculosis; identical to SEQ ID NO: 153630

SEQ ID NO: 1365790 - protein, 17 aa, Mycobacterium tuberculosis
RPQKYQDQSDFTPNDQL

SEQ ID NO: 1365791 - protein, 11 aa, Mycobacterium tuberculosis
RPRTGAPSTAT

SEQ ID NO: 1365792 - protein, 19 aa, Mycobacterium tuberculosis
RPTAASKPVEGHQNAQPGK

SEQ ID NO: 1365793 - protein, 5 aa, Mycobacterium tuberculosis
RQAGR

SEQ ID NO: 1365794 - protein, 10 aa, Mycobacterium tuberculosis
RQLDDTTDMK

SEQ ID NO: 1365795 - protein, 7 aa, Mycobacterium tuberculosis
RQNNCDS

SEQ ID NO: 1365796 - protein, 4 aa, Mycobacterium tuberculosis
RRDT

SEQ ID NO: 1365797 - protein, 10 aa, Mycobacterium tuberculosis
RRLQGQPPLG

SEQ ID NO: 1365798 - protein, 12 aa, Mycobacterium tuberculosis
RRRGRSRRRKSW

SEQ ID NO: 1365799 - protein, 4 aa, Mycobacterium tuberculosis
RSAA

SEQ ID NO: 1365800 - protein, 10 aa, Mycobacterium tuberculosis
RSAFGTPPAR

SEQ ID NO: 1365801 - protein, 6 aa, Mycobacterium tuberculosis
RSAKMN

SEQ ID NO: 1365802 - protein, 4 aa, Mycobacterium tuberculosis
RSDR

SEQ ID NO: 1365803 - protein, 17 aa, Mycobacterium tuberculosis
RSKQTYDYTPTPQPPDV

SEQ ID NO: 1365804 - protein, 4 aa, Mycobacterium tuberculosis
RTFA

SEQ ID NO: 1365805 - protein, 6 aa, Mycobacterium tuberculosis
RTRTAL

SEQ ID NO: 1365806 - protein, 14 aa, Mycobacterium tuberculosis
RTWSATAEHRAQRG

SEQ ID NO: 1365807 - protein, 6 aa, Mycobacterium tuberculosis
RVDGGP

SEQ ID NO: 1365808 - protein, 6 aa, Mycobacterium tuberculosis
RVEGTQ

SEQ ID NO: 1365809 - protein, 6 aa, Mycobacterium tuberculosis
RVSATQ

SEQ ID NO: 1365810 - protein, 7 aa, Mycobacterium tuberculosis
RYGPRAP

SEQ ID NO: 1365811 - protein, 21 aa, Mycobacterium tuberculosis
RYTGPERCSGDGQVRAAGDRY

SEQ ID NO: 1365812 - protein, 7 aa, Mycobacterium tuberculosis
SAAPGTV

SEQ ID NO: 1365813 - protein, 12 aa, Mycobacterium tuberculosis
SAATGGPPPSLS

SEQ ID NO: 1365814 - protein, 8 aa, Mycobacterium tuberculosis
SAGPRRST

SEQ ID NO: 1365815 - protein, 7 aa, Mycobacterium tuberculosis
SAKAGLT

SEQ ID NO: 1365816 - protein, 5 aa, Mycobacterium tuberculosis
SAPQI

SEQ ID NO: 1365817 - protein, 19 aa, Mycobacterium tuberculosis
SARNGFSTTSADPLQSVYH

SEQ ID NO: 1365818 - protein, 7 aa, Mycobacterium tuberculosis
SARSELT

SEQ ID NO: 1365819 - protein, 9 aa, Mycobacterium tuberculosis
SASPPAIGD

SEQ ID NO: 1365820 - protein, 15 aa, Mycobacterium tuberculosis
SASRLGRDLAEQSRV

SEQ ID NO: 1365821 - protein, 7 aa, Mycobacterium tuberculosis
SATPAQA

SEQ ID NO: 1365822 - protein, 8 aa, Mycobacterium tuberculosis
SDELPDTR

SEQ ID NO: 1365823 - protein, 9 aa, Mycobacterium tuberculosis
SEEAKTGKL

SEQ ID NO: 1365824 - protein, 13 aa, Mycobacterium tuberculosis
SELTDPVEQRRRL

SEQ ID NO: 1365825 - protein, 13 aa, Mycobacterium tuberculosis
SEQNPAKPAARGV

SEQ ID NO: 1365826 - protein, 7 aa, Mycobacterium tuberculosis
SFPGPAE

SEQ ID NO: 1365827 - protein, 5 aa, Mycobacterium tuberculosis
SFPSR

SEQ ID NO: 1365828 - protein, 12 aa, Mycobacterium tuberculosis
SFSPSAPAAAVD

SEQ ID NO: 1365829 - protein, 26 aa, Mycobacterium tuberculosis
SFTPQASAVPGSDAERQAERAGATQT

SEQ ID NO: 1365830 - protein, 6 aa, Mycobacterium tuberculosis
SGDPAN

SEQ ID NO: 1365831 - protein, 8 aa, Mycobacterium tuberculosis
SGDPVGDH

SEQ ID NO: 1365832 - protein, 17 aa, Mycobacterium tuberculosis
SGPATKDIPDVAGQTVD

SEQ ID NO: 1365833 - protein, 7 aa, Mycobacterium tuberculosis
SGPIRDD

SEQ ID NO: 1365834 - protein, 6 aa, Mycobacterium tuberculosis
SGSPSL

SEQ ID NO: 1365835 - protein, 6 aa, Mycobacterium tuberculosis
SGSPVR

SEQ ID NO: 1365836 - protein, 4 aa, Mycobacterium tuberculosis
SGSR

SEQ ID NO: 1365837 - protein, 11 aa, Mycobacterium tuberculosis
SGTTGSGKSTL

SEQ ID NO: 1365838 - protein, 4 aa, Mycobacterium tuberculosis
SGVQ

SEQ ID NO: 1365839 - protein, 13 aa, Mycobacterium tuberculosis
SHPTTPFVAVDYD

SEQ ID NO: 1365840 - protein, 11 aa, Mycobacterium tuberculosis
SIETVGSNIGG

SEQ ID NO: 1365841 - protein, 11 aa, Mycobacterium tuberculosis
SIPITTSGKIR

SEQ ID NO: 1365842 - protein, 14 aa, Mycobacterium tuberculosis
SKAAAKDRQRGAGP

SEQ ID NO: 1365843 - protein, 7 aa, Mycobacterium tuberculosis
SKTGVPY

SEQ ID NO: 1365844 - protein, 8 aa, Mycobacterium tuberculosis
SLAPDERL

SEQ ID NO: 1365845 - protein, 7 aa, Mycobacterium tuberculosis
SLDDAGV

SEQ ID NO: 1365846 - protein, 5 aa, Mycobacterium tuberculosis
SLGGL

SEQ ID NO: 1365847 - protein, 7 aa, Mycobacterium tuberculosis
SLTPPDD

SEQ ID NO: 1365848 - protein, 4 aa, Mycobacterium tuberculosis
SPDG

SEQ ID NO: 1365849 - protein, 8 aa, Mycobacterium tuberculosis
SPKDAEGI

SEQ ID NO: 1365850 - protein, 8 aa, Mycobacterium tuberculosis
SPTDAAAV

SEQ ID NO: 1365851 - protein, 5 aa, Mycobacterium tuberculosis
SPTSC

SEQ ID NO: 1365852 - protein, 10 aa, Mycobacterium tuberculosis
SQGSRSQKIR

SEQ ID NO: 1365853 - protein, 9 aa, Mycobacterium tuberculosis
SRTGTVGDY

SEQ ID NO: 1365854 - protein, 6 aa, Mycobacterium tuberculosis
SSETAG

SEQ ID NO: 1365855 - protein, 6 aa, Mycobacterium tuberculosis
SSPLTV

SEQ ID NO: 1365856 - protein, 15 aa, Mycobacterium tuberculosis
SSPVCNSDPACRTSR

SEQ ID NO: 1365857 - protein, 10 aa, Mycobacterium tuberculosis
SSRIQGPAAQ

SEQ ID NO: 1365858 - protein, 7 aa, Mycobacterium tuberculosis
SSTVSSY

SEQ ID NO: 1365859 - protein, 12 aa, Mycobacterium tuberculosis
SVAARQAERIGA

SEQ ID NO: 1365860 - protein, 13 aa, Mycobacterium tuberculosis
SVGLGASARERNI

SEQ ID NO: 1365861 - protein, 64 aa, Mycobacterium tuberculosis; identical to SEQ ID NO: 154316

SEQ ID NO: 1365862 - protein, 16 aa, Mycobacterium tuberculosis
SVSQPTVAPRRSRHYA

SEQ ID NO: 1365863 - protein, 25 aa, Mycobacterium tuberculosis
TAAESASKTPATRRPTAAPDAYADS

SEQ ID NO: 1365864 - protein, 6 aa, Mycobacterium tuberculosis
TAAKPL

SEQ ID NO: 1365865 - protein, 16 aa, Mycobacterium tuberculosis
TAAPNAFATGRNPRNA

SEQ ID NO: 1365866 - protein, 17 aa, Mycobacterium tuberculosis
TAAQHRSTAESYAAEGN

SEQ ID NO: 1365867 - protein, 4 aa, Mycobacterium tuberculosis
TADI

SEQ ID NO: 1365868 - protein, 12 aa, Mycobacterium tuberculosis
TAGKSLSDSASG

SEQ ID NO: 1365869 - protein, 5 aa, Mycobacterium tuberculosis
TARAE

SEQ ID NO: 1365870 - protein, 7 aa, Mycobacterium tuberculosis
TARGTAI

SEQ ID NO: 1365871 - protein, 9 aa, Mycobacterium tuberculosis
TARNPADRY

SEQ ID NO: 1365872 - protein, 8 aa, Mycobacterium tuberculosis
TASRFGQR

SEQ ID NO: 1365873 - protein, 10 aa, Mycobacterium tuberculosis
TATAKGLSRP

SEQ ID NO: 1365874 - protein, 21 aa, Mycobacterium tuberculosis
TDGRSAPASSVAVELDGQEPA

SEQ ID NO: 1365875 - protein, 9 aa, Mycobacterium tuberculosis
TDRSLAGEN

SEQ ID NO: 1365876 - protein, 21 aa, Mycobacterium tuberculosis
TDTDGYGQRGDRRPPGSEKYY

SEQ ID NO: 1365877 - protein, 4 aa, Mycobacterium tuberculosis
TEQP

SEQ ID NO: 1365878 - protein, 21 aa, Mycobacterium tuberculosis
TGAAKGIQKGLSSGSKSTAAA

SEQ ID NO: 1365879 - protein, 6 aa, Mycobacterium tuberculosis
TGDGLR

SEQ ID NO: 1365880 - protein, 16 aa, Mycobacterium tuberculosis
TGEADPIAKDAGDTVM

SEQ ID NO: 1365881 - protein, 6 aa, Mycobacterium tuberculosis
TGPSAL

SEQ ID NO: 1365882 - protein, 7 aa, Mycobacterium tuberculosis
TGRFGTP

SEQ ID NO: 1365883 - protein, 14 aa, Mycobacterium tuberculosis
TGSSQFEEPTGSIA

SEQ ID NO: 1365884 - protein, 8 aa, Mycobacterium tuberculosis
THGRNKTA

SEQ ID NO: 1365885 - protein, 5 aa, Mycobacterium tuberculosis
THTPQ

SEQ ID NO: 1365886 - protein, 30 aa, Mycobacterium tuberculosis; identical to SEQ ID NO: 154518

SEQ ID NO: 1365887 - protein, 12 aa, Mycobacterium tuberculosis
TISATDTPGGGL

SEQ ID NO: 1365888 - protein, 10 aa, Mycobacterium tuberculosis
TITDSPVPAA

SEQ ID NO: 1365889 - protein, 14 aa, Mycobacterium tuberculosis
TITTTTVPSQIGPA

SEQ ID NO: 1365890 - protein, 7 aa, Mycobacterium tuberculosis
TKQAYRG

SEQ ID NO: 1365891 - protein, 4 aa, Mycobacterium tuberculosis
TKRG

SEQ ID NO: 1365892 - protein, 7 aa, Mycobacterium tuberculosis
TLEQPAA

SEQ ID NO: 1365893 - protein, 4 aa, Mycobacterium tuberculosis
TLNP

SEQ ID NO: 1365894 - protein, 5 aa, Mycobacterium tuberculosis
TLPSR

SEQ ID NO: 1365895 - protein, 15 aa, Mycobacterium tuberculosis
TLSTTGNAQEPAGRF

SEQ ID NO: 1365896 - protein, 12 aa, Mycobacterium tuberculosis
TMPDANPQDDIR

SEQ ID NO: 1365897 - protein, 11 aa, Mycobacterium tuberculosis
TPDGTATLGGA

SEQ ID NO: 1365898 - protein, 5 aa, Mycobacterium tuberculosis
TPGLA

SEQ ID NO: 1365899 - protein, 15 aa, Mycobacterium tuberculosis
TPGPLPQPDVGTTDD

SEQ ID NO: 1365900 - protein, 5 aa, Mycobacterium tuberculosis
TPSAH

SEQ ID NO: 1365901 - protein, 8 aa, Mycobacterium tuberculosis
TPSATAVG

SEQ ID NO: 1365902 - protein, 6 aa, Mycobacterium tuberculosis
TPTPAI

SEQ ID NO: 1365903 - protein, 5 aa, Mycobacterium tuberculosis
TQAAT

SEQ ID NO: 1365904 - protein, 7 aa, Mycobacterium tuberculosis
TQEGLQD

SEQ ID NO: 1365905 - protein, 9 aa, Mycobacterium tuberculosis
TQKISAGDY

SEQ ID NO: 1365906 - protein, 5 aa, Mycobacterium tuberculosis
TQPGC

SEQ ID NO: 1365907 - protein, 15 aa, Mycobacterium tuberculosis
TQSGFYDDGSQSVQA

SEQ ID NO: 1365908 - protein, 7 aa, Mycobacterium tuberculosis
TRPLAGE

SEQ ID NO: 1365909 - protein, 27 aa, Mycobacterium tuberculosis
TRPNGETLEQARATYQAGQVGNRLGGA

SEQ ID NO: 1365910 - protein, 17 aa, Mycobacterium tuberculosis
TRYRDSAQTSTPTGNLP

SEQ ID NO: 1365911 - protein, 4 aa, Mycobacterium tuberculosis
TSAD

SEQ ID NO: 1365912 - protein, 10 aa, Mycobacterium tuberculosis
TSAISKSHGL

SEQ ID NO: 1365913 - protein, 32 aa, Mycobacterium tuberculosis
TSRRQRKSAPARISGDRIESPAPSARSESLAR

SEQ ID NO: 1365914 - protein, 7 aa, Mycobacterium tuberculosis
TSVPPDI

SEQ ID NO: 1365915 - protein, 4 aa, Mycobacterium tuberculosis
TTAG

SEQ ID NO: 1365916 - protein, 9 aa, Mycobacterium tuberculosis
TTDATEVAE

SEQ ID NO: 1365917 - protein, 9 aa, Mycobacterium tuberculosis
TTDHGAGLS

SEQ ID NO: 1365918 - protein, 10 aa, Mycobacterium tuberculosis
TTEFPGQAGL

SEQ ID NO: 1365919 - protein, 9 aa, Mycobacterium tuberculosis
TTLTGGDLS

SEQ ID NO: 1365920 - protein, 5 aa, Mycobacterium tuberculosis
TTQIG

SEQ ID NO: 1365921 - protein, 50 aa, Mycobacterium tuberculosis
TTTAPPVTTTPRPSPTTTTTTAPPSTTTTTEPPVTTTSTIPTIPTTTTTV

SEQ ID NO: 1365922 - protein, 9 aa, Mycobacterium tuberculosis
TVGAGATAE

SEQ ID NO: 1365923 - protein, 9 aa, Mycobacterium tuberculosis
TVGAGATAQ

SEQ ID NO: 1365924 - protein, 12 aa, Mycobacterium tuberculosis
TVGGPQMTAPSS

SEQ ID NO: 1365925 - protein, 5 aa, Mycobacterium tuberculosis
TVPAT

SEQ ID NO: 1365926 - protein, 6 aa, Mycobacterium tuberculosis
VAGTTL

SEQ ID NO: 1365927 - protein, 42 aa, Mycobacterium tuberculosis; identical to SEQ ID NO: 154783

SEQ ID NO: 1365928 - protein, 25 aa, Mycobacterium tuberculosis
VASAASAVGPVGPGEPNQPDDVAEA

SEQ ID NO: 1365929 - protein, 12 aa, Mycobacterium tuberculosis
VDAAKASASLQE

SEQ ID NO: 1365930 - protein, 6 aa, Mycobacterium tuberculosis
VDAAQR

SEQ ID NO: 1365931 - protein, 7 aa, Mycobacterium tuberculosis
VDGHSTG

SEQ ID NO: 1365932 - protein, 5 aa, Mycobacterium tuberculosis
VDPSR

SEQ ID NO: 1365933 - protein, 14 aa, Mycobacterium tuberculosis
VGASGPQEAAARAP

SEQ ID NO: 1365934 - protein, 7 aa, Mycobacterium tuberculosis
VGGPDIE

SEQ ID NO: 1365935 - protein, 4 aa, Mycobacterium tuberculosis
VGMT

SEQ ID NO: 1365936 - protein, 17 aa, Mycobacterium tuberculosis
VGQERSVSLSPKDAPSF

SEQ ID NO: 1365937 - protein, 12 aa, Mycobacterium tuberculosis
VGTGCGPASSEV

SEQ ID NO: 1365938 - protein, 5 aa, Mycobacterium tuberculosis
VIESG

SEQ ID NO: 1365939 - protein, 34 aa, Mycobacterium tuberculosis
VKETRTALTPGHDKTPVTPKPVTSDRATPVDPSG

SEQ ID NO: 1365940 - protein, 13 aa, Mycobacterium tuberculosis
VMPQGSQSLAGTP

SEQ ID NO: 1365941 - protein, 6 aa, Mycobacterium tuberculosis
VPAERR

SEQ ID NO: 1365942 - protein, 14 aa, Mycobacterium tuberculosis
VPAFQKPKSRNAAT

SEQ ID NO: 1365943 - protein, 5 aa, Mycobacterium tuberculosis
VPDPV

SEQ ID NO: 1365944 - protein, 17 aa, Mycobacterium tuberculosis
VPNAGGPATFPGAPGPI

SEQ ID NO: 1365945 - protein, 6 aa, Mycobacterium tuberculosis
VPNTDR

SEQ ID NO: 1365946 - protein, 14 aa, Mycobacterium tuberculosis
VPPQADTFSRPRWS

SEQ ID NO: 1365947 - protein, 8 aa, Mycobacterium tuberculosis
VPTSYREA

SEQ ID NO: 1365948 - protein, 12 aa, Mycobacterium tuberculosis
VRDGKATTLGAA

SEQ ID NO: 1365949 - protein, 16 aa, Mycobacterium tuberculosis
VREAASAPALAEAARR

SEQ ID NO: 1365950 - protein, 8 aa, Mycobacterium tuberculosis
VRGARNNP

SEQ ID NO: 1365951 - protein, 12 aa, Mycobacterium tuberculosis
VRGGSKGLGTAV

SEQ ID NO: 1365952 - protein, 14 aa, Mycobacterium tuberculosis
VRRQSGTRTRSTNE

SEQ ID NO: 1365953 - protein, 7 aa, Mycobacterium tuberculosis
VRTPAGD

SEQ ID NO: 1365954 - protein, 10 aa, Mycobacterium tuberculosis
VSAPPAATPG

SEQ ID NO: 1365955 - protein, 6 aa, Mycobacterium tuberculosis
VSDGAR

SEQ ID NO: 1365956 - protein, 10 aa, Mycobacterium tuberculosis
VSDQEGMQGS

SEQ ID NO: 1365957 - protein, 6 aa, Mycobacterium tuberculosis
VSHPRG

SEQ ID NO: 1365958 - protein, 9 aa, Mycobacterium tuberculosis
VSPGGTGVG

SEQ ID NO: 1365959 - protein, 7 aa, Mycobacterium tuberculosis
VSRQSLR

SEQ ID NO: 1365960 - protein, 19 aa, Mycobacterium tuberculosis
VSSDSIPQAGTATSDPAPV

SEQ ID NO: 1365961 - protein, 15 aa, Mycobacterium tuberculosis
VSSPNSAPFADPGNP

SEQ ID NO: 1365962 - protein, 7 aa, Mycobacterium tuberculosis
VSTPRSY

SEQ ID NO: 1365963 - protein, 8 aa, Mycobacterium tuberculosis
VTAPPDPL

SEQ ID NO: 1365964 - protein, 16 aa, Mycobacterium tuberculosis
VTEEGGQYKMSKVEFV

SEQ ID NO: 1365965 - protein, 8 aa, Mycobacterium tuberculosis
VTGKRRDR

SEQ ID NO: 1365966 - protein, 16 aa, Mycobacterium tuberculosis
VTPGPDDPAPPARSGP

SEQ ID NO: 1365967 - protein, 6 aa, Mycobacterium tuberculosis
VTPHPR

SEQ ID NO: 1365968 - protein, 20 aa, Mycobacterium tuberculosis
WEPQGWKSEERAGDRTVADR

SEQ ID NO: 1365969 - protein, 13 aa, Mycobacterium tuberculosis
WGQDGPLASTAGH

SEQ ID NO: 1365970 - protein, 4 aa, Mycobacterium tuberculosis
WIGE

SEQ ID NO: 1365971 - protein, 5 aa, Mycobacterium tuberculosis
WSAGS

SEQ ID NO: 1365972 - protein, 18 aa, Mycobacterium tuberculosis
WSPTSRSEVTDSTSGAAE

SEQ ID NO: 1365973 - protein, 9 aa, Mycobacterium tuberculosis
YAADGGRNG

SEQ ID NO: 1365974 - protein, 4 aa, Mycobacterium tuberculosis
YAGN

SEQ ID NO: 1365975 - protein, 14 aa, Mycobacterium tuberculosis
YGRPDATPEQIATA

SEQ ID NO: 1365976 - protein, 120 aa, Mycobacterium tuberculosis; identical to SEQ ID NO: 155115

SEQ ID NO: 1365977 - protein, 9 aa, Mycobacterium tuberculosis
YKHDQPPWT

SEQ ID NO: 1365978 - protein, 25 aa, Mycobacterium tuberculosis
YMPPAAGVETNGEAGGPGQQTTRQA

SEQ ID NO: 1365979 - protein, 7 aa, Mycobacterium tuberculosis
YNGQPNI

SEQ ID NO: 1365980 - protein, 7 aa, Mycobacterium tuberculosis
YPDRPAG

SEQ ID NO: 1365981 - protein, 8 aa, Mycobacterium tuberculosis
YRTNYNDR

SEQ ID NO: 1365982 - protein, 6 aa, Mycobacterium tuberculosis
YSPSAL

SEQ ID NO: 1365983 - protein, 6 aa, Mycobacterium tuberculosis
YSQASD

SEQ ID NO: 1365984 - protein, 15 aa, Mycobacterium tuberculosis
AAAERERSKLGGEER

SEQ ID NO: 1365985 - protein, 13 aa, Mycobacterium tuberculosis
AAAETADPRRTLP

SEQ ID NO: 1365986 - protein, 10 aa, Mycobacterium tuberculosis
AADARPNASM

SEQ ID NO: 1365987 - protein, 8 aa, Mycobacterium tuberculosis
AAESALGQ

SEQ ID NO: 1365988 - protein, 4 aa, Mycobacterium tuberculosis
AAET

SEQ ID NO: 1365989 - protein, 6 aa, Mycobacterium tuberculosis
AAGAEA

SEQ ID NO: 1365990 - protein, 10 aa, Mycobacterium tuberculosis
AAKAPLRQTA

SEQ ID NO: 1365991 - protein, 5 aa, Mycobacterium tuberculosis
AATKV

SEQ ID NO: 1365992 - protein, 8 aa, Mycobacterium tuberculosis
AATQLTGG

SEQ ID NO: 1365993 - protein, 8 aa, Mycobacterium tuberculosis
ACASATAV

SEQ ID NO: 1365994 - protein, 12 aa, Mycobacterium tuberculosis
ADDEFSTAERVE

SEQ ID NO: 1365995 - protein, 16 aa, Mycobacterium tuberculosis
ADGKPIDFENPSEDAV

SEQ ID NO: 1365996 - protein, 4 aa, Mycobacterium tuberculosis
AEAG

SEQ ID NO: 1365997 - protein, 6 aa, Mycobacterium tuberculosis
AEASAQ

SEQ ID NO: 1365998 - protein, 10 aa, Mycobacterium tuberculosis
AEGGTDHRGR

SEQ ID NO: 1365999 - protein, 5 aa, Mycobacterium tuberculosis
AEIGR

SEQ ID NO: 1366000 - protein, 18 aa, Mycobacterium tuberculosis
AEQESTGIDEAEHAESGY

SEQ ID NO: 1366001 - protein, 16 aa, Mycobacterium tuberculosis
AEQTRSIDAGDEAPRV

SEQ ID NO: 1366002 - protein, 13 aa, Mycobacterium tuberculosis
AERDTGSLSGGEL

SEQ ID NO: 1366003 - protein, 5 aa, Mycobacterium tuberculosis
AERRA

SEQ ID NO: 1366004 - protein, 4 aa, Mycobacterium tuberculosis
AGDG

SEQ ID NO: 1366005 - protein, 9 aa, Mycobacterium tuberculosis
AGEDGGLPR

SEQ ID NO: 1366006 - protein, 14 aa, Mycobacterium tuberculosis
AGEDQPPAPDEPVT

SEQ ID NO: 1366007 - protein, 5 aa, Mycobacterium tuberculosis
AGEPV

SEQ ID NO: 1366008 - protein, 7 aa, Mycobacterium tuberculosis
AGGSDRF

SEQ ID NO: 1366009 - protein, 9 aa, Mycobacterium tuberculosis
AGLTPGSAD

SEQ ID NO: 1366010 - protein, 21 aa, Mycobacterium tuberculosis
AGNTGGAAQCPPQAPGVTRDS

SEQ ID NO: 1366011 - protein, 6 aa, Mycobacterium tuberculosis
AGPTEQ

SEQ ID NO: 1366012 - protein, 4 aa, Mycobacterium tuberculosis
AGQL

SEQ ID NO: 1366013 - protein, 6 aa, Mycobacterium tuberculosis
AGRSTQ

SEQ ID NO: 1366014 - protein, 9 aa, Mycobacterium tuberculosis
AGVSAPQLG

SEQ ID NO: 1366015 - protein, 13 aa, Mycobacterium tuberculosis
AHAAGATHRDVKP

SEQ ID NO: 1366016 - protein, 12 aa, Mycobacterium tuberculosis
AHEADPDGALRG

SEQ ID NO: 1366017 - protein, 12 aa, Mycobacterium tuberculosis
AHGGPAGVGEAV

SEQ ID NO: 1366018 - protein, 8 aa, Mycobacterium tuberculosis
AIYGQGSG

SEQ ID NO: 1366019 - protein, 16 aa, Mycobacterium tuberculosis
AKGKEARGTGNAAATV

SEQ ID NO: 1366020 - protein, 8 aa, Mycobacterium tuberculosis
AKNPEDRY

SEQ ID NO: 1366021 - protein, 13 aa, Mycobacterium tuberculosis
ALAGSLSSQGDSE

SEQ ID NO: 1366022 - protein, 16 aa, Mycobacterium tuberculosis
ALDGAPPMPPPRDPLE

SEQ ID NO: 1366023 - protein, 9 aa, Mycobacterium tuberculosis
ALQPPGNPL

SEQ ID NO: 1366024 - protein, 7 aa, Mycobacterium tuberculosis
ALSPTGQ

SEQ ID NO: 1366025 - protein, 6 aa, Mycobacterium tuberculosis
ANPLWG

SEQ ID NO: 1366026 - protein, 16 aa, Mycobacterium tuberculosis
ANRSTDAAGDPAEPTA

SEQ ID NO: 1366027 - protein, 10 aa, Mycobacterium tuberculosis
APDAKPYQGG

SEQ ID NO: 1366028 - protein, 4 aa, Mycobacterium tuberculosis
APIR

SEQ ID NO: 1366029 - protein, 6 aa, Mycobacterium tuberculosis
APNPAA

SEQ ID NO: 1366030 - protein, 17 aa, Mycobacterium tuberculosis
APPVDRSHTGPLQPPKL

SEQ ID NO: 1366031 - protein, 5 aa, Mycobacterium tuberculosis
APTTE

SEQ ID NO: 1366032 - protein, 4 aa, Mycobacterium tuberculosis
AQAL

SEQ ID NO: 1366033 - protein, 48 aa, Mycobacterium tuberculosis
AQATQAAEAARSDAGQTGHGANGSPAGTHRSGDRQYGSTQPDYGAPAG

SEQ ID NO: 1366034 - protein, 6 aa, Mycobacterium tuberculosis
AQIIPE

SEQ ID NO: 1366035 - protein, 9 aa, Mycobacterium tuberculosis
AQKFSGGEV

SEQ ID NO: 1366036 - protein, 9 aa, Mycobacterium tuberculosis
ARAPHSAGV

SEQ ID NO: 1366037 - protein, 6 aa, Mycobacterium tuberculosis
ARNRAV

SEQ ID NO: 1366038 - protein, 18 aa, Mycobacterium tuberculosis
ARRGARGAQAGLETYLDP

SEQ ID NO: 1366039 - protein, 6 aa, Mycobacterium tuberculosis
ARVDAA

SEQ ID NO: 1366040 - protein, 7 aa, Mycobacterium tuberculosis
ASADAQA

SEQ ID NO: 1366041 - protein, 10 aa, Mycobacterium tuberculosis
ASAGSGADGA

SEQ ID NO: 1366042 - protein, 6 aa, Mycobacterium tuberculosis
ASAKPE

SEQ ID NO: 1366043 - protein, 6 aa, Mycobacterium tuberculosis
ASDLAS

SEQ ID NO: 1366044 - protein, 4 aa, Mycobacterium tuberculosis
ASIP

SEQ ID NO: 1366045 - protein, 7 aa, Mycobacterium tuberculosis
ASLGSGR

SEQ ID NO: 1366046 - protein, 23 aa, Mycobacterium tuberculosis
ASQPSYPAPELSAGADVDGRADQ

SEQ ID NO: 1366047 - protein, 5 aa, Mycobacterium tuberculosis
ASQQI

SEQ ID NO: 1366048 - protein, 4 aa, Mycobacterium tuberculosis
ASQY

SEQ ID NO: 1366049 - protein, 4 aa, Mycobacterium tuberculosis
ATAA

SEQ ID NO: 1366050 - protein, 5 aa, Mycobacterium tuberculosis
ATLDP

SEQ ID NO: 1366051 - protein, 5 aa, Mycobacterium tuberculosis
ATLEQ

SEQ ID NO: 1366052 - protein, 5 aa, Mycobacterium tuberculosis
ATRDS

SEQ ID NO: 1366053 - protein, 17 aa, Mycobacterium tuberculosis
ATSARVDRETTASTQIP

SEQ ID NO: 1366054 - protein, 7 aa, Mycobacterium tuberculosis
ATSTTIE

SEQ ID NO: 1366055 - protein, 24 aa, Mycobacterium tuberculosis
ATVDAATDVPAPANAAGSQGAGTL

SEQ ID NO: 1366056 - protein, 9 aa, Mycobacterium tuberculosis
AVEASKPAY

SEQ ID NO: 1366057 - protein, 26 aa, Mycobacterium tuberculosis
AVSAAEDRGGRHAAAEPPEPPSAGVR

SEQ ID NO: 1366058 - protein, 12 aa, Mycobacterium tuberculosis
AYPVADRDGSIT

SEQ ID NO: 1366059 - protein, 9 aa, Mycobacterium tuberculosis
CGSTRDGYV

SEQ ID NO: 1366060 - protein, 5 aa, Mycobacterium tuberculosis
DAAAA

SEQ ID NO: 1366061 - protein, 17 aa, Mycobacterium tuberculosis
DAAARALDRARGAADPL

SEQ ID NO: 1366062 - protein, 17 aa, Mycobacterium tuberculosis
DAADSVDDTLESTAAGI

SEQ ID NO: 1366063 - protein, 6 aa, Mycobacterium tuberculosis
DAAGDL

SEQ ID NO: 1366064 - protein, 6 aa, Mycobacterium tuberculosis
DAHQSG

SEQ ID NO: 1366065 - protein, 7 aa, Mycobacterium tuberculosis
DASPGFR

SEQ ID NO: 1366066 - protein, 8 aa, Mycobacterium tuberculosis
DDARRDGD

SEQ ID NO: 1366067 - protein, 4 aa, Mycobacterium tuberculosis
DDDH

SEQ ID NO: 1366068 - protein, 38 aa, Mycobacterium tuberculosis
DDHQSTTSATPTDSASTSPPQAATAPPLPPFKPSANLG

SEQ ID NO: 1366069 - protein, 5 aa, Mycobacterium tuberculosis
DELNN

SEQ ID NO: 1366070 - protein, 22 aa, Mycobacterium tuberculosis
DGAPVAPETPAEDADAETLSDS

SEQ ID NO: 1366071 - protein, 5 aa, Mycobacterium tuberculosis
DGKAA

SEQ ID NO: 1366072 - protein, 6 aa, Mycobacterium tuberculosis
DGTSTF

SEQ ID NO: 1366073 - protein, 4 aa, Mycobacterium tuberculosis
DGVT

SEQ ID NO: 1366074 - protein, 6 aa, Mycobacterium tuberculosis
DIADAA

SEQ ID NO: 1366075 - protein, 21 aa, Mycobacterium tuberculosis
DKPKQRRAVRRASRRAHPYRP

SEQ ID NO: 1366076 - protein, 37 aa, Mycobacterium tuberculosis
DKRKAKREAAIPDDEASVIDPPSPVPAPSVIGSHDDV

SEQ ID NO: 1366077 - protein, 6 aa, Mycobacterium tuberculosis
DLSEVG

SEQ ID NO: 1366078 - protein, 21 aa, Mycobacterium tuberculosis
DNEADSADRTLSLSDSPDNTD

SEQ ID NO: 1366079 - protein, 12 aa, Mycobacterium tuberculosis
DNLSGTVTDAEQ

SEQ ID NO: 1366080 - protein, 5 aa, Mycobacterium tuberculosis
DNPPT

SEQ ID NO: 1366081 - protein, 6 aa, Mycobacterium tuberculosis
DNTTRK

SEQ ID NO: 1366082 - protein, 9 aa, Mycobacterium tuberculosis
DPGVDHEHA

SEQ ID NO: 1366083 - protein, 5 aa, Mycobacterium tuberculosis
DPTVA

SEQ ID NO: 1366084 - protein, 7 aa, Mycobacterium tuberculosis
DQDMRNP

SEQ ID NO: 1366085 - protein, 6 aa, Mycobacterium tuberculosis
DQQGRD

SEQ ID NO: 1366086 - protein, 5 aa, Mycobacterium tuberculosis
DRFGP

SEQ ID NO: 1366087 - protein, 5 aa, Mycobacterium tuberculosis
DRTQA

SEQ ID NO: 1366088 - protein, 4 aa, Mycobacterium tuberculosis
DSGF

SEQ ID NO: 1366089 - protein, 8 aa, Mycobacterium tuberculosis
DSGGYNAN

SEQ ID NO: 1366090 - protein, 10 aa, Mycobacterium tuberculosis
DSPATAPDSL

SEQ ID NO: 1366091 - protein, 8 aa, Mycobacterium tuberculosis
DYPQAKRV

SEQ ID NO: 1366092 - protein, 8 aa, Mycobacterium tuberculosis
EAGNKGIA

SEQ ID NO: 1366093 - protein, 4 aa, Mycobacterium tuberculosis
EAIG

SEQ ID NO: 1366094 - protein, 5 aa, Mycobacterium tuberculosis
EALTG

SEQ ID NO: 1366095 - protein, 7 aa, Mycobacterium tuberculosis
EAPSLSQ

SEQ ID NO: 1366096 - protein, 6 aa, Mycobacterium tuberculosis
EARAGD

SEQ ID NO: 1366097 - protein, 15 aa, Mycobacterium tuberculosis
EAYVPGGTNPWYGDP

SEQ ID NO: 1366098 - protein, 14 aa, Mycobacterium tuberculosis
EDPIPPSARHEGLS

SEQ ID NO: 1366099 - protein, 17 aa, Mycobacterium tuberculosis
EEEATEDAERQGGSAPL

SEQ ID NO: 1366100 - protein, 17 aa, Mycobacterium tuberculosis
EETPPQPPTGGAAAEIP

SEQ ID NO: 1366101 - protein, 15 aa, Mycobacterium tuberculosis
EGAGKPHHTSRPQGL

SEQ ID NO: 1366102 - protein, 6 aa, Mycobacterium tuberculosis
EGDYNV

SEQ ID NO: 1366103 - protein, 24 aa, Mycobacterium tuberculosis
EGEPETDLAGDDAEDWSRTGPAER

SEQ ID NO: 1366104 - protein, 18 aa, Mycobacterium tuberculosis
EGTSDAALASAPQTTPAP

SEQ ID NO: 1366105 - protein, 5 aa, Mycobacterium tuberculosis
EIGAG

SEQ ID NO: 1366106 - protein, 10 aa, Mycobacterium tuberculosis
ENGLGPADEA

SEQ ID NO: 1366107 - protein, 14 aa, Mycobacterium tuberculosis
EPAEELRSARTPQE

SEQ ID NO: 1366108 - protein, 15 aa, Mycobacterium tuberculosis
EPTTGAVSDIEQATK

SEQ ID NO: 1366109 - protein, 16 aa, Mycobacterium tuberculosis
ERFRPGGHPTPLPNPG

SEQ ID NO: 1366110 - protein, 4 aa, Mycobacterium tuberculosis
ERIA

SEQ ID NO: 1366111 - protein, 6 aa, Mycobacterium tuberculosis
ERTVDS

SEQ ID NO: 1366112 - protein, 7 aa, Mycobacterium tuberculosis
ESSRGYA

SEQ ID NO: 1366113 - protein, 9 aa, Mycobacterium tuberculosis
ESTPAPPGI

SEQ ID NO: 1366114 - protein, 8 aa, Mycobacterium tuberculosis
ETNRAPFD

SEQ ID NO: 1366115 - protein, 4 aa, Mycobacterium tuberculosis
EVVP

SEQ ID NO: 1366116 - protein, 8 aa, Mycobacterium tuberculosis
FDPEDTSE

SEQ ID NO: 1366117 - protein, 5 aa, Mycobacterium tuberculosis
FDRQS

SEQ ID NO: 1366118 - protein, 8 aa, Mycobacterium tuberculosis
FGPSSPLS

SEQ ID NO: 1366119 - protein, 9 aa, Mycobacterium tuberculosis
FGSSGGPFA

SEQ ID NO: 1366120 - protein, 5 aa, Mycobacterium tuberculosis
FGSTS

SEQ ID NO: 1366121 - protein, 8 aa, Mycobacterium tuberculosis
FKPSAEPY

SEQ ID NO: 1366122 - protein, 16 aa, Mycobacterium tuberculosis
FSTATKAPASPTRRRP

SEQ ID NO: 1366123 - protein, 14 aa, Mycobacterium tuberculosis
FTSTDTVTVSSPRA

SEQ ID NO: 1366124 - protein, 7 aa, Mycobacterium tuberculosis
GAAGRPN

SEQ ID NO: 1366125 - protein, 31 aa, Mycobacterium tuberculosis
GAAVGESADEADAEAADGVAGHADPEADPVE

SEQ ID NO: 1366126 - protein, 25 aa, Mycobacterium tuberculosis
GAGPGTPARPAHSDSLTAQAERGIE

SEQ ID NO: 1366127 - protein, 8 aa, Mycobacterium tuberculosis
GARTRGGY

SEQ ID NO: 1366128 - protein, 7 aa, Mycobacterium tuberculosis
GASATVQ

SEQ ID NO: 1366129 - protein, 9 aa, Mycobacterium tuberculosis
GASKTGTPS

SEQ ID NO: 1366130 - protein, 10 aa, Mycobacterium tuberculosis
GATLAEGAAT

SEQ ID NO: 1366131 - protein, 5 aa, Mycobacterium tuberculosis
GCGKT

SEQ ID NO: 1366132 - protein, 7 aa, Mycobacterium tuberculosis
GCHDSAC

SEQ ID NO: 1366133 - protein, 10 aa, Mycobacterium tuberculosis
GDPQSPEGIK

SEQ ID NO: 1366134 - protein, 13 aa, Mycobacterium tuberculosis
GEAAPQSPAEPVA

SEQ ID NO: 1366135 - protein, 12 aa, Mycobacterium tuberculosis
GEPPFTGDSPVS

SEQ ID NO: 1366136 - protein, 11 aa, Mycobacterium tuberculosis
GERIDADTGLT

SEQ ID NO: 1366137 - protein, 8 aa, Mycobacterium tuberculosis
GERRTAPF

SEQ ID NO: 1366138 - protein, 7 aa, Mycobacterium tuberculosis
GFGNTTA

SEQ ID NO: 1366139 - protein, 9 aa, Mycobacterium tuberculosis
GFQQGTAPN

SEQ ID NO: 1366140 - protein, 16 aa, Mycobacterium tuberculosis
GGAPIAPADAARNRAR

SEQ ID NO: 1366141 - protein, 11 aa, Mycobacterium tuberculosis
GGDGASRTDEA

SEQ ID NO: 1366142 - protein, 5 aa, Mycobacterium tuberculosis
GGGDF

SEQ ID NO: 1366143 - protein, 8 aa, Mycobacterium tuberculosis
GGHPTEEV

SEQ ID NO: 1366144 - protein, 4 aa, Mycobacterium tuberculosis
GGKL

SEQ ID NO: 1366145 - protein, 14 aa, Mycobacterium tuberculosis
GGQPDPSKGRCAFA

SEQ ID NO: 1366146 - protein, 7 aa, Mycobacterium tuberculosis
GGQRTAL

SEQ ID NO: 1366147 - protein, 4 aa, Mycobacterium tuberculosis
GGSH

SEQ ID NO: 1366148 - protein, 5 aa, Mycobacterium tuberculosis
GHAHP

SEQ ID NO: 1366149 - protein, 5 aa, Mycobacterium tuberculosis
GKFPY

SEQ ID NO: 1366150 - protein, 4 aa, Mycobacterium tuberculosis
GKTG

SEQ ID NO: 1366151 - protein, 14 aa, Mycobacterium tuberculosis
GLEPTLTPRASLGR

SEQ ID NO: 1366152 - protein, 14 aa, Mycobacterium tuberculosis
GLGNGQPDTVPAAS

SEQ ID NO: 1366153 - protein, 22 aa, Mycobacterium tuberculosis
GLKAPTADDEALPLSDEPPPRA

SEQ ID NO: 1366154 - protein, 18 aa, Mycobacterium tuberculosis
GLNAHPDGLNQRPPGGWC

SEQ ID NO: 1366155 - protein, 9 aa, Mycobacterium tuberculosis
GLPGGITKA

SEQ ID NO: 1366156 - protein, 6 aa, Mycobacterium tuberculosis
GLRPRY

SEQ ID NO: 1366157 - protein, 15 aa, Mycobacterium tuberculosis
GMTPAPLSVTPERVA

SEQ ID NO: 1366158 - protein, 4 aa, Mycobacterium tuberculosis
GNGT

SEQ ID NO: 1366159 - protein, 12 aa, Mycobacterium tuberculosis
GNPADSGKIRGE

SEQ ID NO: 1366160 - protein, 5 aa, Mycobacterium tuberculosis
GNRQA

SEQ ID NO: 1366161 - protein, 5 aa, Mycobacterium tuberculosis
GPGAD

SEQ ID NO: 1366162 - protein, 32 aa, Mycobacterium tuberculosis
GPRLSGRMDRGGSAAGASRQRRTKGAGGSFTS

SEQ ID NO: 1366163 - protein, 6 aa, Mycobacterium tuberculosis
GQAIPG

SEQ ID NO: 1366164 - protein, 6 aa, Mycobacterium tuberculosis
GQGGPL

SEQ ID NO: 1366165 - protein, 6 aa, Mycobacterium tuberculosis
GRASQI

SEQ ID NO: 1366166 - protein, 7 aa, Mycobacterium tuberculosis
GRDGELR

SEQ ID NO: 1366167 - protein, 12 aa, Mycobacterium tuberculosis
GRDPSTPPTKAD

SEQ ID NO: 1366168 - protein, 8 aa, Mycobacterium tuberculosis
GRPSAGLA

SEQ ID NO: 1366169 - protein, 8 aa, Mycobacterium tuberculosis
GRPTHEQV

SEQ ID NO: 1366170 - protein, 6 aa, Mycobacterium tuberculosis
GSLQRR

SEQ ID NO: 1366171 - protein, 11 aa, Mycobacterium tuberculosis
GSSTEPPTTRL

SEQ ID NO: 1366172 - protein, 4 aa, Mycobacterium tuberculosis
GTDT

SEQ ID NO: 1366173 - protein, 5 aa, Mycobacterium tuberculosis
GTPTR

SEQ ID NO: 1366174 - protein, 9 aa, Mycobacterium tuberculosis
GTREQCEAA

SEQ ID NO: 1366175 - protein, 7 aa, Mycobacterium tuberculosis
GVDDPVG

SEQ ID NO: 1366176 - protein, 5 aa, Mycobacterium tuberculosis
GVVGT

SEQ ID NO: 1366177 - protein, 20 aa, Mycobacterium tuberculosis
GYDPNAGYSAHAGAQPQRIP

SEQ ID NO: 1366178 - protein, 10 aa, Mycobacterium tuberculosis
GYGPSQPGMN

SEQ ID NO: 1366179 - protein, 10 aa, Mycobacterium tuberculosis
GYKTSYNDRD

SEQ ID NO: 1366180 - protein, 9 aa, Mycobacterium tuberculosis
HAASETERA

SEQ ID NO: 1366181 - protein, 5 aa, Mycobacterium tuberculosis
HDPGQ

SEQ ID NO: 1366182 - protein, 8 aa, Mycobacterium tuberculosis
HDTGVGPA

SEQ ID NO: 1366183 - protein, 7 aa, Mycobacterium tuberculosis
HGNTAIS

SEQ ID NO: 1366184 - protein, 5 aa, Mycobacterium tuberculosis
HGTGT

SEQ ID NO: 1366185 - protein, 4 aa, Mycobacterium tuberculosis
HNPA

SEQ ID NO: 1366186 - protein, 6 aa, Mycobacterium tuberculosis
HQGGDD

SEQ ID NO: 1366187 - protein, 4 aa, Mycobacterium tuberculosis
IDGA

SEQ ID NO: 1366188 - protein, 13 aa, Mycobacterium tuberculosis
IGATQPVGTGACV

SEQ ID NO: 1366189 - protein, 4 aa, Mycobacterium tuberculosis
INTI

SEQ ID NO: 1366190 - protein, 14 aa, Mycobacterium tuberculosis
IPLPGTTQQIAGTG

SEQ ID NO: 1366191 - protein, 27 aa, Mycobacterium tuberculosis
IRASRRPELGASPRAGASRAVKPRPEW

SEQ ID NO: 1366192 - protein, 5 aa, Mycobacterium tuberculosis
IRTGL

SEQ ID NO: 1366193 - protein, 7 aa, Mycobacterium tuberculosis
KAEYPAD

SEQ ID NO: 1366194 - protein, 9 aa, Mycobacterium tuberculosis
KLGSSGGVL

SEQ ID NO: 1366195 - protein, 7 aa, Mycobacterium tuberculosis
KLPPGGT

SEQ ID NO: 1366196 - protein, 6 aa, Mycobacterium tuberculosis
KLPPQY

SEQ ID NO: 1366197 - protein, 12 aa, Mycobacterium tuberculosis
KNAKTSRENQQI

SEQ ID NO: 1366198 - protein, 8 aa, Mycobacterium tuberculosis
KPTSTVKD

SEQ ID NO: 1366199 - protein, 9 aa, Mycobacterium tuberculosis
KQQITPAGT

SEQ ID NO: 1366200 - protein, 35 aa, Mycobacterium tuberculosis
KRLSAQSDTFTSTAVTDPSGPRESAQPRALSAAER

SEQ ID NO: 1366201 - protein, 5 aa, Mycobacterium tuberculosis
KVVAP

SEQ ID NO: 1366202 - protein, 8 aa, Mycobacterium tuberculosis
LADPGTGE

SEQ ID NO: 1366203 - protein, 5 aa, Mycobacterium tuberculosis
LAEPA

SEQ ID NO: 1366204 - protein, 7 aa, Mycobacterium tuberculosis
LATPGVP

SEQ ID NO: 1366205 - protein, 6 aa, Mycobacterium tuberculosis
LGATGG

SEQ ID NO: 1366206 - protein, 4 aa, Mycobacterium tuberculosis
LGPE

SEQ ID NO: 1366207 - protein, 7 aa, Mycobacterium tuberculosis
LGQPANE

SEQ ID NO: 1366208 - protein, 7 aa, Mycobacterium tuberculosis
LGTNGGG

SEQ ID NO: 1366209 - protein, 6 aa, Mycobacterium tuberculosis
LGVQDG

SEQ ID NO: 1366210 - protein, 4 aa, Mycobacterium tuberculosis
LHRP

SEQ ID NO: 1366211 - protein, 9 aa, Mycobacterium tuberculosis
LIPGGPVAS

SEQ ID NO: 1366212 - protein, 8 aa, Mycobacterium tuberculosis
LKDSAAAA

SEQ ID NO: 1366213 - protein, 5 aa, Mycobacterium tuberculosis
LNPDH

SEQ ID NO: 1366214 - protein, 4 aa, Mycobacterium tuberculosis
LPAG

SEQ ID NO: 1366215 - protein, 7 aa, Mycobacterium tuberculosis
LPESQRP

SEQ ID NO: 1366216 - protein, 5 aa, Mycobacterium tuberculosis
LPPGV

SEQ ID NO: 1366217 - protein, 6 aa, Mycobacterium tuberculosis
LPPQDN

SEQ ID NO: 1366218 - protein, 10 aa, Mycobacterium tuberculosis
LQGREGPVPI

SEQ ID NO: 1366219 - protein, 14 aa, Mycobacterium tuberculosis
LQQAQQPQTGRTGD

SEQ ID NO: 1366220 - protein, 6 aa, Mycobacterium tuberculosis
LQRDTD

SEQ ID NO: 1366221 - protein, 6 aa, Mycobacterium tuberculosis
LQTPSA

SEQ ID NO: 1366222 - protein, 5 aa, Mycobacterium tuberculosis
LRATQ

SEQ ID NO: 1366223 - protein, 15 aa, Mycobacterium tuberculosis
LRGTRKAEEAAESAR

SEQ ID NO: 1366224 - protein, 6 aa, Mycobacterium tuberculosis
LRNGEA

SEQ ID NO: 1366225 - protein, 5 aa, Mycobacterium tuberculosis
LRPAG

SEQ ID NO: 1366226 - protein, 14 aa, Mycobacterium tuberculosis
LRPAQSYPQKPPVG

SEQ ID NO: 1366227 - protein, 13 aa, Mycobacterium tuberculosis
LSFPTSAAPGWSA

SEQ ID NO: 1366228 - protein, 6 aa, Mycobacterium tuberculosis
LSGQGG

SEQ ID NO: 1366229 - protein, 10 aa, Mycobacterium tuberculosis
LTGPAGQDAT

SEQ ID NO: 1366230 - protein, 6 aa, Mycobacterium tuberculosis
LTPAEG

SEQ ID NO: 1366231 - protein, 7 aa, Mycobacterium tuberculosis
LTPRTPT

SEQ ID NO: 1366232 - protein, 8 aa, Mycobacterium tuberculosis
MGGTGKVV

SEQ ID NO: 1366233 - protein, 10 aa, Mycobacterium tuberculosis
MPGLTQGKPF

SEQ ID NO: 1366234 - protein, 9 aa, Mycobacterium tuberculosis
MRATDVEPS

SEQ ID NO: 1366235 - protein, 7 aa, Mycobacterium tuberculosis
MRSRRNR

SEQ ID NO: 1366236 - protein, 10 aa, Mycobacterium tuberculosis
NAARTDGASA

SEQ ID NO: 1366237 - protein, 7 aa, Mycobacterium tuberculosis
NAKAALS

SEQ ID NO: 1366238 - protein, 7 aa, Mycobacterium tuberculosis
NAQQAEL

SEQ ID NO: 1366239 - protein, 5 aa, Mycobacterium tuberculosis
NASGR

SEQ ID NO: 1366240 - protein, 7 aa, Mycobacterium tuberculosis
NGNITDD

SEQ ID NO: 1366241 - protein, 6 aa, Mycobacterium tuberculosis
NGPAGS

SEQ ID NO: 1366242 - protein, 18 aa, Mycobacterium tuberculosis
NGPVFNQGERVEANTSTA

SEQ ID NO: 1366243 - protein, 8 aa, Mycobacterium tuberculosis
NLGHTEAA

SEQ ID NO: 1366244 - protein, 11 aa, Mycobacterium tuberculosis
NNASGSSAELV

SEQ ID NO: 1366245 - protein, 20 aa, Mycobacterium tuberculosis
NRLGGQHGSIPISGTSYAAP

SEQ ID NO: 1366246 - protein, 6 aa, Mycobacterium tuberculosis
NVGGAA

SEQ ID NO: 1366247 - protein, 26 aa, Mycobacterium tuberculosis
PAEGDAPVPITPAGRPRSGQRSYPDR

SEQ ID NO: 1366248 - protein, 11 aa, Mycobacterium tuberculosis
PALESTRATLG

SEQ ID NO: 1366249 - protein, 12 aa, Mycobacterium tuberculosis
PAPGDPTPSAPP

SEQ ID NO: 1366250 - protein, 74 aa, Mycobacterium tuberculosis
PAPPPEEGVPPGAPVPGPEPPPAPGPQPPAVDRGGGTVTVPSYSGGRKIAPIDNPRNPHPSAPSPALGPPPDAF

SEQ ID NO: 1366251 - protein, 9 aa, Mycobacterium tuberculosis
PASPWATPP

SEQ ID NO: 1366252 - protein, 8 aa, Mycobacterium tuberculosis
PASSLRGQ

SEQ ID NO: 1366253 - protein, 11 aa, Mycobacterium tuberculosis
PAVGGGPAQHL

SEQ ID NO: 1366254 - protein, 14 aa, Mycobacterium tuberculosis
PAYASRSASNRKAG

SEQ ID NO: 1366255 - protein, 12 aa, Mycobacterium tuberculosis
PDIPTKQTGGSF

SEQ ID NO: 1366256 - protein, 4 aa, Mycobacterium tuberculosis
PFST

SEQ ID NO: 1366257 - protein, 9 aa, Mycobacterium tuberculosis
PFTQGDTRT

SEQ ID NO: 1366258 - protein, 10 aa, Mycobacterium tuberculosis
PGEMNTPEQT

SEQ ID NO: 1366259 - protein, 4 aa, Mycobacterium tuberculosis
PGHD

SEQ ID NO: 1366260 - protein, 11 aa, Mycobacterium tuberculosis
PGNVAKGAANL

SEQ ID NO: 1366261 - protein, 5 aa, Mycobacterium tuberculosis
PGPGA

SEQ ID NO: 1366262 - protein, 14 aa, Mycobacterium tuberculosis
PGRGVSGTVSGRAV

SEQ ID NO: 1366263 - protein, 6 aa, Mycobacterium tuberculosis
PKERVQ

SEQ ID NO: 1366264 - protein, 15 aa, Mycobacterium tuberculosis
PKRMPPSRKARRQRH

SEQ ID NO: 1366265 - protein, 9 aa, Mycobacterium tuberculosis
PLASTTTDL

SEQ ID NO: 1366266 - protein, 16 aa, Mycobacterium tuberculosis
PLEDTGARAAALGPGQ

SEQ ID NO: 1366267 - protein, 6 aa, Mycobacterium tuberculosis
PLGPRS

SEQ ID NO: 1366268 - protein, 7 aa, Mycobacterium tuberculosis
PLTPPQT

SEQ ID NO: 1366269 - protein, 4 aa, Mycobacterium tuberculosis
PMDE

SEQ ID NO: 1366270 - protein, 4 aa, Mycobacterium tuberculosis
PNIT

SEQ ID NO: 1366271 - protein, 20 aa, Mycobacterium tuberculosis
PNPVEESSPRGPGPICQNYT

SEQ ID NO: 1366272 - protein, 9 aa, Mycobacterium tuberculosis
PNQPGTDYD

SEQ ID NO: 1366273 - protein, 6 aa, Mycobacterium tuberculosis
PPEHTR

SEQ ID NO: 1366274 - protein, 9 aa, Mycobacterium tuberculosis
PPKGLSQEE

SEQ ID NO: 1366275 - protein, 32 aa, Mycobacterium tuberculosis
PQGTPCDDPVETTPQGPAPTPDLRPEGGETPP

SEQ ID NO: 1366276 - protein, 12 aa, Mycobacterium tuberculosis
PRIRGGGRASVG

SEQ ID NO: 1366277 - protein, 4 aa, Mycobacterium tuberculosis
PRSV

SEQ ID NO: 1366278 - protein, 8 aa, Mycobacterium tuberculosis
PRTLGRQN

SEQ ID NO: 1366279 - protein, 5 aa, Mycobacterium tuberculosis
PSAPV

SEQ ID NO: 1366280 - protein, 54 aa, Mycobacterium tuberculosis
PSDASTPPAKKLPAKKAAKKAPARKTPAKKAPAKKTPAKGAKSAPPKPAEAPVS

SEQ ID NO: 1366281 - protein, 8 aa, Mycobacterium tuberculosis
PSRQAKER

SEQ ID NO: 1366282 - protein, 6 aa, Mycobacterium tuberculosis
PSVARG

SEQ ID NO: 1366283 - protein, 18 aa, Mycobacterium tuberculosis
PVDPASRQAFGRPSGVQG

SEQ ID NO: 1366284 - protein, 5 aa, Mycobacterium tuberculosis
PVPAE

SEQ ID NO: 1366285 - protein, 16 aa, Mycobacterium tuberculosis
PVSPTTVKSTELDQFP

SEQ ID NO: 1366286 - protein, 4 aa, Mycobacterium tuberculosis
PWEG

SEQ ID NO: 1366287 - protein, 4 aa, Mycobacterium tuberculosis
PWGY

SEQ ID NO: 1366288 - protein, 15 aa, Mycobacterium tuberculosis
PYIPGGDSPAGTDCS

SEQ ID NO: 1366289 - protein, 6 aa, Mycobacterium tuberculosis
QAIPAL

SEQ ID NO: 1366290 - protein, 4 aa, Mycobacterium tuberculosis
QDDG

SEQ ID NO: 1366291 - protein, 10 aa, Mycobacterium tuberculosis
QDGDPGYKAT

SEQ ID NO: 1366292 - protein, 9 aa, Mycobacterium tuberculosis
QEATAGLAD

SEQ ID NO: 1366293 - protein, 8 aa, Mycobacterium tuberculosis
QEKLGDEA

SEQ ID NO: 1366294 - protein, 14 aa, Mycobacterium tuberculosis
QEVRPAPGQGLSPA

SEQ ID NO: 1366295 - protein, 8 aa, Mycobacterium tuberculosis
QGVPDHGP

SEQ ID NO: 1366296 - protein, 5 aa, Mycobacterium tuberculosis
QIQPY

SEQ ID NO: 1366297 - protein, 9 aa, Mycobacterium tuberculosis
QPASTPAEL

SEQ ID NO: 1366298 - protein, 12 aa, Mycobacterium tuberculosis
QPPVPPPDIPEE

SEQ ID NO: 1366299 - protein, 7 aa, Mycobacterium tuberculosis
QQPLDTR

SEQ ID NO: 1366300 - protein, 23 aa, Mycobacterium tuberculosis
QQQAPVPPPPPDDPTAGFQGGTI

SEQ ID NO: 1366301 - protein, 11 aa, Mycobacterium tuberculosis
QRTTRTSELGN

SEQ ID NO: 1366302 - protein, 12 aa, Mycobacterium tuberculosis
QSTGTGPGDQRV

SEQ ID NO: 1366303 - protein, 7 aa, Mycobacterium tuberculosis
QSVAEGA

SEQ ID NO: 1366304 - protein, 15 aa, Mycobacterium tuberculosis
QSVDAAQVAKPEGAV

SEQ ID NO: 1366305 - protein, 14 aa, Mycobacterium tuberculosis
QTEWPATGHPRRAG

SEQ ID NO: 1366306 - protein, 7 aa, Mycobacterium tuberculosis
QTLPPGR

SEQ ID NO: 1366307 - protein, 6 aa, Mycobacterium tuberculosis
QTTGRA

SEQ ID NO: 1366308 - protein, 12 aa, Mycobacterium tuberculosis
RAEASGLRGDGG

SEQ ID NO: 1366309 - protein, 9 aa, Mycobacterium tuberculosis
RAPHSAEIR

SEQ ID NO: 1366310 - protein, 13 aa, Mycobacterium tuberculosis
RDATPRDIHPKHN

SEQ ID NO: 1366311 - protein, 9 aa, Mycobacterium tuberculosis
RDKSLPDHQ

SEQ ID NO: 1366312 - protein, 14 aa, Mycobacterium tuberculosis
REVEQAEVGGSPRH

SEQ ID NO: 1366313 - protein, 9 aa, Mycobacterium tuberculosis
REVSDSARV

SEQ ID NO: 1366314 - protein, 5 aa, Mycobacterium tuberculosis
RGDDG

SEQ ID NO: 1366315 - protein, 7 aa, Mycobacterium tuberculosis
RGESLSR

SEQ ID NO: 1366316 - protein, 8 aa, Mycobacterium tuberculosis
RGRPEDSP

SEQ ID NO: 1366317 - protein, 25 aa, Mycobacterium tuberculosis
RGRRPPSGSPDERCADPGSKGGSRR

SEQ ID NO: 1366318 - protein, 9 aa, Mycobacterium tuberculosis
RGTETAPLQ

SEQ ID NO: 1366319 - protein, 13 aa, Mycobacterium tuberculosis
RIPAPSAAAIATT

SEQ ID NO: 1366320 - protein, 13 aa, Mycobacterium tuberculosis
RKSASVDDANLLK

SEQ ID NO: 1366321 - protein, 7 aa, Mycobacterium tuberculosis
RKTEDIA

SEQ ID NO: 1366322 - protein, 6 aa, Mycobacterium tuberculosis
RLGEDR

SEQ ID NO: 1366323 - protein, 11 aa, Mycobacterium tuberculosis
RLGEPTGEGAL

SEQ ID NO: 1366324 - protein, 5 aa, Mycobacterium tuberculosis
RMARQ

SEQ ID NO: 1366325 - protein, 14 aa, Mycobacterium tuberculosis
RNKGSYEAARERLT

SEQ ID NO: 1366326 - protein, 6 aa, Mycobacterium tuberculosis
RNPADE

SEQ ID NO: 1366327 - protein, 5 aa, Mycobacterium tuberculosis
RNSAN

SEQ ID NO: 1366328 - protein, 6 aa, Mycobacterium tuberculosis
RPAPAR

SEQ ID NO: 1366329 - protein, 9 aa, Mycobacterium tuberculosis
RPASSPGGM

SEQ ID NO: 1366330 - protein, 16 aa, Mycobacterium tuberculosis
RPQAPGPGDSPPTQVV

SEQ ID NO: 1366331 - protein, 5 aa, Mycobacterium tuberculosis
RPVVP

SEQ ID NO: 1366332 - protein, 9 aa, Mycobacterium tuberculosis
RQWSRPANA

SEQ ID NO: 1366333 - protein, 5 aa, Mycobacterium tuberculosis
RRGPA

SEQ ID NO: 1366334 - protein, 28 aa, Mycobacterium tuberculosis
RRGRAQRTKRKPLLPKEEEEQSPPDDDD

SEQ ID NO: 1366335 - protein, 7 aa, Mycobacterium tuberculosis
RRQSRRS

SEQ ID NO: 1366336 - protein, 6 aa, Mycobacterium tuberculosis
RRRATD

SEQ ID NO: 1366337 - protein, 5 aa, Mycobacterium tuberculosis
RRSRS

SEQ ID NO: 1366338 - protein, 22 aa, Mycobacterium tuberculosis
RRTPGSSGIADVPAQPMQQRRR

SEQ ID NO: 1366339 - protein, 23 aa, Mycobacterium tuberculosis
RSETMANRRTAAGNIESVPSSRL

SEQ ID NO: 1366340 - protein, 10 aa, Mycobacterium tuberculosis
RSGPLAEGRT

SEQ ID NO: 1366341 - protein, 7 aa, Mycobacterium tuberculosis
RSRQPKF

SEQ ID NO: 1366342 - protein, 8 aa, Mycobacterium tuberculosis
RSTIAAGG

SEQ ID NO: 1366343 - protein, 5 aa, Mycobacterium tuberculosis
RTAAP

SEQ ID NO: 1366344 - protein, 9 aa, Mycobacterium tuberculosis
RTRSTDYSR

SEQ ID NO: 1366345 - protein, 7 aa, Mycobacterium tuberculosis
RVRPDQK

SEQ ID NO: 1366346 - protein, 7 aa, Mycobacterium tuberculosis
SAATTLP

SEQ ID NO: 1366347 - protein, 7 aa, Mycobacterium tuberculosis
SAMASGT

SEQ ID NO: 1366348 - protein, 12 aa, Mycobacterium tuberculosis
SARGKDRGSASV

SEQ ID NO: 1366349 - protein, 9 aa, Mycobacterium tuberculosis
SASPAPPVT

SEQ ID NO: 1366350 - protein, 11 aa, Mycobacterium tuberculosis
SATPDGVSERE

SEQ ID NO: 1366351 - protein, 43 aa, Mycobacterium tuberculosis; identical to SEQ ID NO: 153928

SEQ ID NO: 1366352 - protein, 7 aa, Mycobacterium tuberculosis
SGAGATV

SEQ ID NO: 1366353 - protein, 5 aa, Mycobacterium tuberculosis
SGPAY

SEQ ID NO: 1366354 - protein, 9 aa, Mycobacterium tuberculosis
SGQSTAQAS

SEQ ID NO: 1366355 - protein, 30 aa, Mycobacterium tuberculosis
SHQPRTATPPSAAALSPTSSSTTPPQPPIV

SEQ ID NO: 1366356 - protein, 9 aa, Mycobacterium tuberculosis
SLAGGDRTL

SEQ ID NO: 1366357 - protein, 10 aa, Mycobacterium tuberculosis
SLGAPQVAGA

SEQ ID NO: 1366358 - protein, 8 aa, Mycobacterium tuberculosis
SNHQPVTD

SEQ ID NO: 1366359 - protein, 6 aa, Mycobacterium tuberculosis
SPDEAR

SEQ ID NO: 1366360 - protein, 9 aa, Mycobacterium tuberculosis
SPEAPESRL

SEQ ID NO: 1366361 - protein, 13 aa, Mycobacterium tuberculosis
SPPGWTQQKTERL

SEQ ID NO: 1366362 - protein, 8 aa, Mycobacterium tuberculosis
SQTQGLKD

SEQ ID NO: 1366363 - protein, 6 aa, Mycobacterium tuberculosis
SQTSAK

SEQ ID NO: 1366364 - protein, 9 aa, Mycobacterium tuberculosis
SRAGSESVL

SEQ ID NO: 1366365 - protein, 8 aa, Mycobacterium tuberculosis
SRLKAGQK

SEQ ID NO: 1366366 - protein, 7 aa, Mycobacterium tuberculosis
SRLPTGA

SEQ ID NO: 1366367 - protein, 28 aa, Mycobacterium tuberculosis
SRPGAPPHAGLPSRRTAGDQDHRADPKV

SEQ ID NO: 1366368 - protein, 5 aa, Mycobacterium tuberculosis
SRRPL

SEQ ID NO: 1366369 - protein, 13 aa, Mycobacterium tuberculosis
SSGRKEPTFTGAG

SEQ ID NO: 1366370 - protein, 17 aa, Mycobacterium tuberculosis
STTASRSAKDTAAESLK

SEQ ID NO: 1366371 - protein, 5 aa, Mycobacterium tuberculosis
SVLPP

SEQ ID NO: 1366372 - protein, 5 aa, Mycobacterium tuberculosis
SVPSD

SEQ ID NO: 1366373 - protein, 12 aa, Mycobacterium tuberculosis
SWRDTPKYRFDD

SEQ ID NO: 1366374 - protein, 5 aa, Mycobacterium tuberculosis
SYTYP

SEQ ID NO: 1366375 - protein, 8 aa, Mycobacterium tuberculosis
TAAATAAT

SEQ ID NO: 1366376 - protein, 11 aa, Mycobacterium tuberculosis
TAASSDLSSVP

SEQ ID NO: 1366377 - protein, 9 aa, Mycobacterium tuberculosis
TAEAEAMRR

SEQ ID NO: 1366378 - protein, 7 aa, Mycobacterium tuberculosis
TAEPDRV

SEQ ID NO: 1366379 - protein, 13 aa, Mycobacterium tuberculosis
TASNDPDARRQLS

SEQ ID NO: 1366380 - protein, 8 aa, Mycobacterium tuberculosis
TDAQRDGD

SEQ ID NO: 1366381 - protein, 7 aa, Mycobacterium tuberculosis
TDKQAEH

SEQ ID NO: 1366382 - protein, 10 aa, Mycobacterium tuberculosis
TEADNIDPQQ

SEQ ID NO: 1366383 - protein, 5 aa, Mycobacterium tuberculosis
TERQV

SEQ ID NO: 1366384 - protein, 4 aa, Mycobacterium tuberculosis
TEWA

SEQ ID NO: 1366385 - protein, 32 aa, Mycobacterium tuberculosis; identical to SEQ ID NO: 154440

SEQ ID NO: 1366386 - protein, 7 aa, Mycobacterium tuberculosis
TGEPAGA

SEQ ID NO: 1366387 - protein, 4 aa, Mycobacterium tuberculosis
TGIV

SEQ ID NO: 1366388 - protein, 14 aa, Mycobacterium tuberculosis
TIPTTETPPPPQTV

SEQ ID NO: 1366389 - protein, 37 aa, Mycobacterium tuberculosis
TPATAAVPGGSPPTSNPAPAAPSSNSVGSASAAPGIS

SEQ ID NO: 1366390 - protein, 30 aa, Mycobacterium tuberculosis
TPKPADGVPPPPLNTKLPEDPPPPPKPAAV

SEQ ID NO: 1366391 - protein, 8 aa, Mycobacterium tuberculosis
TRFAPAKS

SEQ ID NO: 1366392 - protein, 30 aa, Mycobacterium tuberculosis
TRPAGRSLEQARTSWQAGEVGSKLDEGSKQ

SEQ ID NO: 1366393 - protein, 6 aa, Mycobacterium tuberculosis
TRPDLQ

SEQ ID NO: 1366394 - protein, 5 aa, Mycobacterium tuberculosis
TRPWN

SEQ ID NO: 1366395 - protein, 15 aa, Mycobacterium tuberculosis
TRRGSIGPEARTRLA

SEQ ID NO: 1366396 - protein, 7 aa, Mycobacterium tuberculosis
TSGPGEL

SEQ ID NO: 1366397 - protein, 10 aa, Mycobacterium tuberculosis
TSGSTRIPSG

SEQ ID NO: 1366398 - protein, 9 aa, Mycobacterium tuberculosis
TSPNPDSRP

SEQ ID NO: 1366399 - protein, 6 aa, Mycobacterium tuberculosis
TSRRSR

SEQ ID NO: 1366400 - protein, 4 aa, Mycobacterium tuberculosis
TSVP

SEQ ID NO: 1366401 - protein, 20 aa, Mycobacterium tuberculosis
TVATGDGRQVDGRDPATGES

SEQ ID NO: 1366402 - protein, 22 aa, Mycobacterium tuberculosis
TVEKEARAARALDGESPPADWV

SEQ ID NO: 1366403 - protein, 7 aa, Mycobacterium tuberculosis
VAGCGAQ

SEQ ID NO: 1366404 - protein, 23 aa, Mycobacterium tuberculosis
VAGPGDDPAEPDGIRRQDDFSSR

SEQ ID NO: 1366405 - protein, 8 aa, Mycobacterium tuberculosis
VDDGRAGM

SEQ ID NO: 1366406 - protein, 9 aa, Mycobacterium tuberculosis
VDERGGGIG

SEQ ID NO: 1366407 - protein, 17 aa, Mycobacterium tuberculosis
VDPGRVDRDGLDRAERV

SEQ ID NO: 1366408 - protein, 4 aa, Mycobacterium tuberculosis
VDRS

SEQ ID NO: 1366409 - protein, 4 aa, Mycobacterium tuberculosis
VDVT

SEQ ID NO: 1366410 - protein, 18 aa, Mycobacterium tuberculosis
VEPEMPAPCPTQRPPVTP

SEQ ID NO: 1366411 - protein, 11 aa, Mycobacterium tuberculosis
VGKAPDSIDES

SEQ ID NO: 1366412 - protein, 9 aa, Mycobacterium tuberculosis
VGRPPSHTV

SEQ ID NO: 1366413 - protein, 56 aa, Mycobacterium tuberculosis
VNAEGSDPNDQPPLESHSPAAPAESNPIASSDSARRSRLATNDDHPPLAQVPPRDL

SEQ ID NO: 1366414 - protein, 9 aa, Mycobacterium tuberculosis
VNAQGEPSA

SEQ ID NO: 1366415 - protein, 8 aa, Mycobacterium tuberculosis
VNATTAAA

SEQ ID NO: 1366416 - protein, 11 aa, Mycobacterium tuberculosis
VNKTAAAAGIT

SEQ ID NO: 1366417 - protein, 10 aa, Mycobacterium tuberculosis
VNQDGRSNGL

SEQ ID NO: 1366418 - protein, 11 aa, Mycobacterium tuberculosis
VPEAGTPSTWV

SEQ ID NO: 1366419 - protein, 8 aa, Mycobacterium tuberculosis
VPGKRAPT

SEQ ID NO: 1366420 - protein, 4 aa, Mycobacterium tuberculosis
VPPS

SEQ ID NO: 1366421 - protein, 8 aa, Mycobacterium tuberculosis
VPRPESYE

SEQ ID NO: 1366422 - protein, 17 aa, Mycobacterium tuberculosis
VPTPGGTEIRDNRSING

SEQ ID NO: 1366423 - protein, 20 aa, Mycobacterium tuberculosis
VQCRSDTGLTVNGRPLKEPY

SEQ ID NO: 1366424 - protein, 9 aa, Mycobacterium tuberculosis
VRSYDDDGS

SEQ ID NO: 1366425 - protein, 8 aa, Mycobacterium tuberculosis
VSASPPSH

SEQ ID NO: 1366426 - protein, 10 aa, Mycobacterium tuberculosis
VSDDERADID

SEQ ID NO: 1366427 - protein, 26 aa, Mycobacterium tuberculosis
VSLQPPEEIEGPAIPPASSQLVCVAP

SEQ ID NO: 1366428 - protein, 11 aa, Mycobacterium tuberculosis
VSNTDSDAHEV

SEQ ID NO: 1366429 - protein, 16 aa, Mycobacterium tuberculosis
VSPLTRPHRSKRGVAE

SEQ ID NO: 1366430 - protein, 11 aa, Mycobacterium tuberculosis
VTRASSGLTDE

SEQ ID NO: 1366431 - protein, 7 aa, Mycobacterium tuberculosis
VTTARTI

SEQ ID NO: 1366432 - protein, 7 aa, Mycobacterium tuberculosis
VTTDDGS

SEQ ID NO: 1366433 - protein, 12 aa, Mycobacterium tuberculosis
VYPDRSARAAAA

SEQ ID NO: 1366434 - protein, 24 aa, Mycobacterium tuberculosis
WPRGAGAAVGDAEHLPGEEGYGSD

SEQ ID NO: 1366435 - protein, 4 aa, Mycobacterium tuberculosis
YGDR

SEQ ID NO: 1366436 - protein, 6 aa, Mycobacterium tuberculosis
YGGTAG

SEQ ID NO: 1366437 - protein, 10 aa, Mycobacterium tuberculosis
YHAAPHTETT

SEQ ID NO: 1366438 - protein, 14 aa, Mycobacterium tuberculosis
YPAGSVGSAPRAGT

SEQ ID NO: 1366439 - protein, 5 aa, Mycobacterium tuberculosis
AAAPE

SEQ ID NO: 1366440 - protein, 16 aa, Mycobacterium tuberculosis
AADPGEVRGAEPRTAG

SEQ ID NO: 1366441 - protein, 6 aa, Mycobacterium tuberculosis
AAGEEF

SEQ ID NO: 1366442 - protein, 8 aa, Mycobacterium tuberculosis
AAHGNDPV

SEQ ID NO: 1366443 - protein, 6 aa, Mycobacterium tuberculosis
AALPTE

SEQ ID NO: 1366444 - protein, 15 aa, Mycobacterium tuberculosis
AASDPGLTQTGTAVG

SEQ ID NO: 1366445 - protein, 5 aa, Mycobacterium tuberculosis
AASGF

SEQ ID NO: 1366446 - protein, 9 aa, Mycobacterium tuberculosis
AATASSALA

SEQ ID NO: 1366447 - protein, 11 aa, Mycobacterium tuberculosis
AATGRAPASYY

SEQ ID NO: 1366448 - protein, 10 aa, Mycobacterium tuberculosis
AATGRTPTLY

SEQ ID NO: 1366449 - protein, 7 aa, Mycobacterium tuberculosis
AATPTPG

SEQ ID NO: 1366450 - protein, 7 aa, Mycobacterium tuberculosis
ADPGIPA

SEQ ID NO: 1366451 - protein, 6 aa, Mycobacterium tuberculosis
ADPQGL

SEQ ID NO: 1366452 - protein, 9 aa, Mycobacterium tuberculosis
ADQYPEAVD

SEQ ID NO: 1366453 - protein, 7 aa, Mycobacterium tuberculosis
AEDPDRR

SEQ ID NO: 1366454 - protein, 6 aa, Mycobacterium tuberculosis
AEDTVR

SEQ ID NO: 1366455 - protein, 5 aa, Mycobacterium tuberculosis
AEIGT

SEQ ID NO: 1366456 - protein, 8 aa, Mycobacterium tuberculosis
AEPATCTR

SEQ ID NO: 1366457 - protein, 23 aa, Mycobacterium tuberculosis
AEQPARGAKQQPATETSRAGRDL

SEQ ID NO: 1366458 - protein, 9 aa, Mycobacterium tuberculosis
AGETIPSDG

SEQ ID NO: 1366459 - protein, 5 aa, Mycobacterium tuberculosis
AGGPA

SEQ ID NO: 1366460 - protein, 6 aa, Mycobacterium tuberculosis
AGGPVR

SEQ ID NO: 1366461 - protein, 15 aa, Mycobacterium tuberculosis
AGNDGEAGCGNNPMY

SEQ ID NO: 1366462 - protein, 5 aa, Mycobacterium tuberculosis
AGPDR

SEQ ID NO: 1366463 - protein, 10 aa, Mycobacterium tuberculosis
AGQADSSPGW

SEQ ID NO: 1366464 - protein, 6 aa, Mycobacterium tuberculosis
AGSPGL

SEQ ID NO: 1366465 - protein, 7 aa, Mycobacterium tuberculosis
AGSRTPL

SEQ ID NO: 1366466 - protein, 7 aa, Mycobacterium tuberculosis
AGTEPST

SEQ ID NO: 1366467 - protein, 6 aa, Mycobacterium tuberculosis
AGVPGA

SEQ ID NO: 1366468 - protein, 13 aa, Mycobacterium tuberculosis
AKGPRSAGTMGTA

SEQ ID NO: 1366469 - protein, 6 aa, Mycobacterium tuberculosis
AKNGLG

SEQ ID NO: 1366470 - protein, 8 aa, Mycobacterium tuberculosis
AKNRDPIA

SEQ ID NO: 1366471 - protein, 6 aa, Mycobacterium tuberculosis
AKPSKS

SEQ ID NO: 1366472 - protein, 19 aa, Mycobacterium tuberculosis
ALKGTSNETFPKPTEVGGY

SEQ ID NO: 1366473 - protein, 10 aa, Mycobacterium tuberculosis
ALPEGTPVAD

SEQ ID NO: 1366474 - protein, 11 aa, Mycobacterium tuberculosis
ALSRSTAGDRG

SEQ ID NO: 1366475 - protein, 11 aa, Mycobacterium tuberculosis
AMSDAQDSRVG

SEQ ID NO: 1366476 - protein, 9 aa, Mycobacterium tuberculosis
ANRDAGSPQ

SEQ ID NO: 1366477 - protein, 5 aa, Mycobacterium tuberculosis
APAPV

SEQ ID NO: 1366478 - protein, 22 aa, Mycobacterium tuberculosis
APEPSPDSDAAVKRGARNSLDE

SEQ ID NO: 1366479 - protein, 6 aa, Mycobacterium tuberculosis
APETLG

SEQ ID NO: 1366480 - protein, 7 aa, Mycobacterium tuberculosis
APGQPAG

SEQ ID NO: 1366481 - protein, 15 aa, Mycobacterium tuberculosis
APPAPVPANGEQFGP

SEQ ID NO: 1366482 - protein, 8 aa, Mycobacterium tuberculosis
APRRQHSP

SEQ ID NO: 1366483 - protein, 15 aa, Mycobacterium tuberculosis
APTKLTSPGINGSTV

SEQ ID NO: 1366484 - protein, 9 aa, Mycobacterium tuberculosis
AQLSPSARF

SEQ ID NO: 1366485 - protein, 13 aa, Mycobacterium tuberculosis
AQRTAEAQAKANE

SEQ ID NO: 1366486 - protein, 4 aa, Mycobacterium tuberculosis
ARDP

SEQ ID NO: 1366487 - protein, 10 aa, Mycobacterium tuberculosis
ARLPGSAAAA

SEQ ID NO: 1366488 - protein, 6 aa, Mycobacterium tuberculosis
ARPQVR

SEQ ID NO: 1366489 - protein, 6 aa, Mycobacterium tuberculosis
ARSITG

SEQ ID NO: 1366490 - protein, 15 aa, Mycobacterium tuberculosis
ASATQLPTQGTTSNT

SEQ ID NO: 1366491 - protein, 7 aa, Mycobacterium tuberculosis
ASGDGIT

SEQ ID NO: 1366492 - protein, 6 aa, Mycobacterium tuberculosis
ASLTEM

SEQ ID NO: 1366493 - protein, 7 aa, Mycobacterium tuberculosis
ASPATRV

SEQ ID NO: 1366494 - protein, 8 aa, Mycobacterium tuberculosis
ASPMGDAE

SEQ ID NO: 1366495 - protein, 28 aa, Mycobacterium tuberculosis
ASSEDAEAESDASNPSRGETVVHYRSDP

SEQ ID NO: 1366496 - protein, 12 aa, Mycobacterium tuberculosis
ATAAPTGPIARG

SEQ ID NO: 1366497 - protein, 7 aa, Mycobacterium tuberculosis
ATEGSGV

SEQ ID NO: 1366498 - protein, 6 aa, Mycobacterium tuberculosis
ATGEFE

SEQ ID NO: 1366499 - protein, 10 aa, Mycobacterium tuberculosis
ATGPFPPTTF

SEQ ID NO: 1366500 - protein, 64 aa, Mycobacterium tuberculosis
ATPADTGLSQSESGIAGAGTGPPTPGAARWSPGDSATVAGPLAADSRGGNWPSQTGHSPAVPNA

SEQ ID NO: 1366501 - protein, 11 aa, Mycobacterium tuberculosis
ATQAPDAGAMS

SEQ ID NO: 1366502 - protein, 6 aa, Mycobacterium tuberculosis
ATTGLA

SEQ ID NO: 1366503 - protein, 21 aa, Mycobacterium tuberculosis
ATTSLPPAEAGQSGSEGEQLA

SEQ ID NO: 1366504 - protein, 6 aa, Mycobacterium tuberculosis
AVGADT

SEQ ID NO: 1366505 - protein, 11 aa, Mycobacterium tuberculosis
AVTPSTTATLT

SEQ ID NO: 1366506 - protein, 8 aa, Mycobacterium tuberculosis
CAPPGALG

SEQ ID NO: 1366507 - protein, 4 aa, Mycobacterium tuberculosis
CHPN

SEQ ID NO: 1366508 - protein, 13 aa, Mycobacterium tuberculosis
CVNGRRGNAADHL

SEQ ID NO: 1366509 - protein, 7 aa, Mycobacterium tuberculosis
DAVRRTS

SEQ ID NO: 1366510 - protein, 10 aa, Mycobacterium tuberculosis
DDADDLGDGF

SEQ ID NO: 1366511 - protein, 5 aa, Mycobacterium tuberculosis
DDVEA

SEQ ID NO: 1366512 - protein, 4 aa, Mycobacterium tuberculosis
DGAG

SEQ ID NO: 1366513 - protein, 17 aa, Mycobacterium tuberculosis
DGKPATLPISGPPTTHQ

SEQ ID NO: 1366514 - protein, 4 aa, Mycobacterium tuberculosis
DGKT

SEQ ID NO: 1366515 - protein, 7 aa, Mycobacterium tuberculosis
DGPGPYT

SEQ ID NO: 1366516 - protein, 14 aa, Mycobacterium tuberculosis
DGPGTPEVLGDESR

SEQ ID NO: 1366517 - protein, 5 aa, Mycobacterium tuberculosis
DGSVA

SEQ ID NO: 1366518 - protein, 9 aa, Mycobacterium tuberculosis
DGWSNSGGA

SEQ ID NO: 1366519 - protein, 6 aa, Mycobacterium tuberculosis
DIDTAV

SEQ ID NO: 1366520 - protein, 4 aa, Mycobacterium tuberculosis
DPAA

SEQ ID NO: 1366521 - protein, 11 aa, Mycobacterium tuberculosis
DPAPAAPEGPW

SEQ ID NO: 1366522 - protein, 8 aa, Mycobacterium tuberculosis
DPGVTSPI

SEQ ID NO: 1366523 - protein, 17 aa, Mycobacterium tuberculosis
DPHSGDIVNPSGQHGDE

SEQ ID NO: 1366524 - protein, 4 aa, Mycobacterium tuberculosis
DPLQ

SEQ ID NO: 1366525 - protein, 5 aa, Mycobacterium tuberculosis
DPNLR

SEQ ID NO: 1366526 - protein, 5 aa, Mycobacterium tuberculosis
DQDLA

SEQ ID NO: 1366527 - protein, 4 aa, Mycobacterium tuberculosis
DQER

SEQ ID NO: 1366528 - protein, 10 aa, Mycobacterium tuberculosis
DRGSSMSSKP

SEQ ID NO: 1366529 - protein, 4 aa, Mycobacterium tuberculosis
DRNT

SEQ ID NO: 1366530 - protein, 11 aa, Mycobacterium tuberculosis
DSDPAGADETD

SEQ ID NO: 1366531 - protein, 6 aa, Mycobacterium tuberculosis
DSLPQT

SEQ ID NO: 1366532 - protein, 9 aa, Mycobacterium tuberculosis
DTARSSSRP

SEQ ID NO: 1366533 - protein, 6 aa, Mycobacterium tuberculosis
DTEEMK

SEQ ID NO: 1366534 - protein, 11 aa, Mycobacterium tuberculosis
DTLTQGPQQIQ

SEQ ID NO: 1366535 - protein, 20 aa, Mycobacterium tuberculosis
EAKRQLEAAHDRKSSNPTEA

SEQ ID NO: 1366536 - protein, 7 aa, Mycobacterium tuberculosis
EAQNAAA

SEQ ID NO: 1366537 - protein, 5 aa, Mycobacterium tuberculosis
EARTT

SEQ ID NO: 1366538 - protein, 5 aa, Mycobacterium tuberculosis
EGDEY

SEQ ID NO: 1366539 - protein, 4 aa, Mycobacterium tuberculosis
EGGA

SEQ ID NO: 1366540 - protein, 7 aa, Mycobacterium tuberculosis
EGGDIGD

SEQ ID NO: 1366541 - protein, 8 aa, Mycobacterium tuberculosis
EGGPPEVA

SEQ ID NO: 1366542 - protein, 8 aa, Mycobacterium tuberculosis
EGSERTFA

SEQ ID NO: 1366543 - protein, 7 aa, Mycobacterium tuberculosis
EGVGPAA

SEQ ID NO: 1366544 - protein, 13 aa, Mycobacterium tuberculosis
EHPDGAGAALSAA

SEQ ID NO: 1366545 - protein, 6 aa, Mycobacterium tuberculosis
ENPPGV

SEQ ID NO: 1366546 - protein, 6 aa, Mycobacterium tuberculosis
ENVYPA

SEQ ID NO: 1366547 - protein, 5 aa, Mycobacterium tuberculosis
EPAGA

SEQ ID NO: 1366548 - protein, 25 aa, Mycobacterium tuberculosis
EQGSNEPEAPDGSGRGGGDGLPHDS

SEQ ID NO: 1366549 - protein, 4 aa, Mycobacterium tuberculosis
EQRG

SEQ ID NO: 1366550 - protein, 4 aa, Mycobacterium tuberculosis
EREE

SEQ ID NO: 1366551 - protein, 10 aa, Mycobacterium tuberculosis
ERNEEDPARL

SEQ ID NO: 1366552 - protein, 9 aa, Mycobacterium tuberculosis
ESAAASSAA

SEQ ID NO: 1366553 - protein, 4 aa, Mycobacterium tuberculosis
ESTA

SEQ ID NO: 1366554 - protein, 4 aa, Mycobacterium tuberculosis
EVED

SEQ ID NO: 1366555 - protein, 4 aa, Mycobacterium tuberculosis
FAES

SEQ ID NO: 1366556 - protein, 8 aa, Mycobacterium tuberculosis
FAGPYATG

SEQ ID NO: 1366557 - protein, 16 aa, Mycobacterium tuberculosis
FAQANTALSNAALSAG

SEQ ID NO: 1366558 - protein, 8 aa, Mycobacterium tuberculosis
FEDDGDAQ

SEQ ID NO: 1366559 - protein, 8 aa, Mycobacterium tuberculosis
FGSPQPGD

SEQ ID NO: 1366560 - protein, 5 aa, Mycobacterium tuberculosis
FPPGS

SEQ ID NO: 1366561 - protein, 5 aa, Mycobacterium tuberculosis
FQPPF

SEQ ID NO: 1366562 - protein, 7 aa, Mycobacterium tuberculosis
FSTRPTT

SEQ ID NO: 1366563 - protein, 12 aa, Mycobacterium tuberculosis
GAAAAGLASPID

SEQ ID NO: 1366564 - protein, 16 aa, Mycobacterium tuberculosis
GAAGGALAALASRRQS

SEQ ID NO: 1366565 - protein, 9 aa, Mycobacterium tuberculosis
GAPGAPGLD

SEQ ID NO: 1366566 - protein, 15 aa, Mycobacterium tuberculosis
GAPTYLDATGQTQEP

SEQ ID NO: 1366567 - protein, 7 aa, Mycobacterium tuberculosis
GAQPGLS

SEQ ID NO: 1366568 - protein, 8 aa, Mycobacterium tuberculosis
GARSGEPQ

SEQ ID NO: 1366569 - protein, 4 aa, Mycobacterium tuberculosis
GASV

SEQ ID NO: 1366570 - protein, 9 aa, Mycobacterium tuberculosis
GDGANDAAA

SEQ ID NO: 1366571 - protein, 5 aa, Mycobacterium tuberculosis
GDGLT

SEQ ID NO: 1366572 - protein, 10 aa, Mycobacterium tuberculosis
GDGTADCDAH

SEQ ID NO: 1366573 - protein, 8 aa, Mycobacterium tuberculosis
GDPDAPPT

SEQ ID NO: 1366574 - protein, 17 aa, Mycobacterium tuberculosis
GDPRFGYSTSPANVPTP

SEQ ID NO: 1366575 - protein, 6 aa, Mycobacterium tuberculosis
GDPTEG

SEQ ID NO: 1366576 - protein, 6 aa, Mycobacterium tuberculosis
GDTPVP

SEQ ID NO: 1366577 - protein, 6 aa, Mycobacterium tuberculosis
GERLAT

SEQ ID NO: 1366578 - protein, 7 aa, Mycobacterium tuberculosis
GERTRVT

SEQ ID NO: 1366579 - protein, 14 aa, Mycobacterium tuberculosis
GETCNGDSARRSGN

SEQ ID NO: 1366580 - protein, 7 aa, Mycobacterium tuberculosis
GETSRFT

SEQ ID NO: 1366581 - protein, 4 aa, Mycobacterium tuberculosis
GEVP

SEQ ID NO: 1366582 - protein, 9 aa, Mycobacterium tuberculosis
GFDQSNDPL

SEQ ID NO: 1366583 - protein, 11 aa, Mycobacterium tuberculosis
GGEFGGSPSVP

SEQ ID NO: 1366584 - protein, 6 aa, Mycobacterium tuberculosis
GGGGTL

SEQ ID NO: 1366585 - protein, 34 aa, Mycobacterium tuberculosis; identical to SEQ ID NO: 151240

SEQ ID NO: 1366586 - protein, 8 aa, Mycobacterium tuberculosis
GGQPDRAV

SEQ ID NO: 1366587 - protein, 9 aa, Mycobacterium tuberculosis
GGQPSTDTP

SEQ ID NO: 1366588 - protein, 53 aa, Mycobacterium tuberculosis; identical to SEQ ID NO: 151251

SEQ ID NO: 1366589 - protein, 8 aa, Mycobacterium tuberculosis
GGTGMAGS

SEQ ID NO: 1366590 - protein, 15 aa, Mycobacterium tuberculosis
GGTTVSFPRGSTQVA

SEQ ID NO: 1366591 - protein, 6 aa, Mycobacterium tuberculosis
GHDQPV

SEQ ID NO: 1366592 - protein, 5 aa, Mycobacterium tuberculosis
GIGQA

SEQ ID NO: 1366593 - protein, 5 aa, Mycobacterium tuberculosis
GISGT

SEQ ID NO: 1366594 - protein, 6 aa, Mycobacterium tuberculosis
GITPEA

SEQ ID NO: 1366595 - protein, 18 aa, Mycobacterium tuberculosis
GKRAATPKECRSKDPYVP

SEQ ID NO: 1366596 - protein, 7 aa, Mycobacterium tuberculosis
GLNPNGV

SEQ ID NO: 1366597 - protein, 8 aa, Mycobacterium tuberculosis
GMSATGPQ

SEQ ID NO: 1366598 - protein, 10 aa, Mycobacterium tuberculosis
GNNETDGSEK

SEQ ID NO: 1366599 - protein, 12 aa, Mycobacterium tuberculosis
GPDIYGDPEPVT

SEQ ID NO: 1366600 - protein, 5 aa, Mycobacterium tuberculosis
GPTPA

SEQ ID NO: 1366601 - protein, 6 aa, Mycobacterium tuberculosis
GPVDEH

SEQ ID NO: 1366602 - protein, 6 aa, Mycobacterium tuberculosis
GQGGTI

SEQ ID NO: 1366603 - protein, 7 aa, Mycobacterium tuberculosis
GQISGSV

SEQ ID NO: 1366604 - protein, 12 aa, Mycobacterium tuberculosis
GQPQAEKLASQW

SEQ ID NO: 1366605 - protein, 7 aa, Mycobacterium tuberculosis
GRAQTVG

SEQ ID NO: 1366606 - protein, 5 aa, Mycobacterium tuberculosis
GRGDG

SEQ ID NO: 1366607 - protein, 8 aa, Mycobacterium tuberculosis
GRPRRAGV

SEQ ID NO: 1366608 - protein, 29 aa, Mycobacterium tuberculosis
GRSAGKTSEPTCPTEPIDAADSSTTPDPS

SEQ ID NO: 1366609 - protein, 25 aa, Mycobacterium tuberculosis
GRVPGHGPEQATRPLVGTEEQGGVI

SEQ ID NO: 1366610 - protein, 9 aa, Mycobacterium tuberculosis
GSDENGAVE

SEQ ID NO: 1366611 - protein, 5 aa, Mycobacterium tuberculosis
GTGSV

SEQ ID NO: 1366612 - protein, 5 aa, Mycobacterium tuberculosis
GTGTD

SEQ ID NO: 1366613 - protein, 10 aa, Mycobacterium tuberculosis
GTPRPAPRTT

SEQ ID NO: 1366614 - protein, 9 aa, Mycobacterium tuberculosis
GTPVNRGYA

SEQ ID NO: 1366615 - protein, 6 aa, Mycobacterium tuberculosis
GTTPKM

SEQ ID NO: 1366616 - protein, 8 aa, Mycobacterium tuberculosis
HADEGASK

SEQ ID NO: 1366617 - protein, 9 aa, Mycobacterium tuberculosis
HAGAQAGGD

SEQ ID NO: 1366618 - protein, 8 aa, Mycobacterium tuberculosis
HGEKSDMA

SEQ ID NO: 1366619 - protein, 42 aa, Mycobacterium tuberculosis
HLPTQAGPQLPGPVPIPGAPGPMPAPPLGAVPSPAPAENPVP

SEQ ID NO: 1366620 - protein, 9 aa, Mycobacterium tuberculosis
HPEAPSPVS

SEQ ID NO: 1366621 - protein, 15 aa, Mycobacterium tuberculosis
HQSPAAAGEHRGPAR

SEQ ID NO: 1366622 - protein, 4 aa, Mycobacterium tuberculosis
HRPA

SEQ ID NO: 1366623 - protein, 6 aa, Mycobacterium tuberculosis
HSDQLA

SEQ ID NO: 1366624 - protein, 5 aa, Mycobacterium tuberculosis
HSQGE

SEQ ID NO: 1366625 - protein, 5 aa, Mycobacterium tuberculosis
IAQEH

SEQ ID NO: 1366626 - protein, 6 aa, Mycobacterium tuberculosis
IEPRTS

SEQ ID NO: 1366627 - protein, 10 aa, Mycobacterium tuberculosis
IGGPRRKGRI

SEQ ID NO: 1366628 - protein, 6 aa, Mycobacterium tuberculosis
INDAPA

SEQ ID NO: 1366629 - protein, 6 aa, Mycobacterium tuberculosis
INQATA

SEQ ID NO: 1366630 - protein, 9 aa, Mycobacterium tuberculosis
IPPASTPLA

SEQ ID NO: 1366631 - protein, 16 aa, Mycobacterium tuberculosis
IPTPVGEGGHRGSTGF

SEQ ID NO: 1366632 - protein, 8 aa, Mycobacterium tuberculosis
IRSRPAQE

SEQ ID NO: 1366633 - protein, 5 aa, Mycobacterium tuberculosis
ISSET

SEQ ID NO: 1366634 - protein, 8 aa, Mycobacterium tuberculosis
ISYSGNQA

SEQ ID NO: 1366635 - protein, 25 aa, Mycobacterium tuberculosis
ITGSEPGTEGGTTAAPGINGSRARL

SEQ ID NO: 1366636 - protein, 8 aa, Mycobacterium tuberculosis
KASTVGTI

SEQ ID NO: 1366637 - protein, 16 aa, Mycobacterium tuberculosis
KEPLPESDGDADDDDY

SEQ ID NO: 1366638 - protein, 14 aa, Mycobacterium tuberculosis
KLPRTGKVPTDPAQ

SEQ ID NO: 1366639 - protein, 7 aa, Mycobacterium tuberculosis
KPKQTAQ

SEQ ID NO: 1366640 - protein, 14 aa, Mycobacterium tuberculosis
KREAREAIKGTPLQ

SEQ ID NO: 1366641 - protein, 8 aa, Mycobacterium tuberculosis
KSELSGDR

SEQ ID NO: 1366642 - protein, 6 aa, Mycobacterium tuberculosis
KTIRQL

SEQ ID NO: 1366643 - protein, 6 aa, Mycobacterium tuberculosis
LAAPGE

SEQ ID NO: 1366644 - protein, 8 aa, Mycobacterium tuberculosis
LAGTTPSR

SEQ ID NO: 1366645 - protein, 8 aa, Mycobacterium tuberculosis
LDDEAAAK

SEQ ID NO: 1366646 - protein, 16 aa, Mycobacterium tuberculosis
LDGDSGSWGPLGPLGG

SEQ ID NO: 1366647 - protein, 10 aa, Mycobacterium tuberculosis
LDPETSRSAR

SEQ ID NO: 1366648 - protein, 12 aa, Mycobacterium tuberculosis
LERGTELGGQER

SEQ ID NO: 1366649 - protein, 10 aa, Mycobacterium tuberculosis
LGSRAGAGVM

SEQ ID NO: 1366650 - protein, 6 aa, Mycobacterium tuberculosis
LKDPAY

SEQ ID NO: 1366651 - protein, 6 aa, Mycobacterium tuberculosis
LNEGRE

SEQ ID NO: 1366652 - protein, 26 aa, Mycobacterium tuberculosis
LPDGTPVSSGEGGGVRVGGGGAYQPK

SEQ ID NO: 1366653 - protein, 9 aa, Mycobacterium tuberculosis
LPGSAPRPA

SEQ ID NO: 1366654 - protein, 8 aa, Mycobacterium tuberculosis
LPSASAGG

SEQ ID NO: 1366655 - protein, 11 aa, Mycobacterium tuberculosis
LRKAGSAGRAT

SEQ ID NO: 1366656 - protein, 7 aa, Mycobacterium tuberculosis
LRSRSPA

SEQ ID NO: 1366657 - protein, 7 aa, Mycobacterium tuberculosis
LTAGQAE

SEQ ID NO: 1366658 - protein, 6 aa, Mycobacterium tuberculosis
LTGLPP

SEQ ID NO: 1366659 - protein, 8 aa, Mycobacterium tuberculosis
LTPDDTGR

SEQ ID NO: 1366660 - protein, 4 aa, Mycobacterium tuberculosis
MASA

SEQ ID NO: 1366661 - protein, 38 aa, Mycobacterium tuberculosis
MGTHRATEPAATEPEVGAAPQPESAVPAPARGSWRAQA

SEQ ID NO: 1366662 - protein, 11 aa, Mycobacterium tuberculosis
MNGEAGSYLEG

SEQ ID NO: 1366663 - protein, 6 aa, Mycobacterium tuberculosis
MPTESY

SEQ ID NO: 1366664 - protein, 6 aa, Mycobacterium tuberculosis
NASGTP

SEQ ID NO: 1366665 - protein, 35 aa, Mycobacterium tuberculosis
NDATDADDLSPASGRYPQRPAPPRLRSSGGERTRG

SEQ ID NO: 1366666 - protein, 4 aa, Mycobacterium tuberculosis
NDRI

SEQ ID NO: 1366667 - protein, 6 aa, Mycobacterium tuberculosis
NHYPDD

SEQ ID NO: 1366668 - protein, 6 aa, Mycobacterium tuberculosis
NLQTKE

SEQ ID NO: 1366669 - protein, 15 aa, Mycobacterium tuberculosis
NNSYGLQQPPRLGAD

SEQ ID NO: 1366670 - protein, 20 aa, Mycobacterium tuberculosis
NTDAAAGPLRRHGPAAARRR

SEQ ID NO: 1366671 - protein, 7 aa, Mycobacterium tuberculosis
PAIGPGT

SEQ ID NO: 1366672 - protein, 22 aa, Mycobacterium tuberculosis
PDGANTIVGEAGSALSGGERQR

SEQ ID NO: 1366673 - protein, 5 aa, Mycobacterium tuberculosis
PDLSA

SEQ ID NO: 1366674 - protein, 10 aa, Mycobacterium tuberculosis
PEAGAAPKTV

SEQ ID NO: 1366675 - protein, 5 aa, Mycobacterium tuberculosis
PGGVL

SEQ ID NO: 1366676 - protein, 17 aa, Mycobacterium tuberculosis
PGLAGPDSRVSTFSAAD

SEQ ID NO: 1366677 - protein, 11 aa, Mycobacterium tuberculosis
PGPDGRPTTSF

SEQ ID NO: 1366678 - protein, 7 aa, Mycobacterium tuberculosis
PKAKRVG

SEQ ID NO: 1366679 - protein, 20 aa, Mycobacterium tuberculosis
PKGPLPTTAKMRSVQRTVRR

SEQ ID NO: 1366680 - protein, 9 aa, Mycobacterium tuberculosis
PKRATTKRR

SEQ ID NO: 1366681 - protein, 33 aa, Mycobacterium tuberculosis
PLPLENDHNAQRLGNTPSTPPTTTKKAPQAGLT

SEQ ID NO: 1366682 - protein, 15 aa, Mycobacterium tuberculosis
PLRATQSLTEQDVYD

SEQ ID NO: 1366683 - protein, 10 aa, Mycobacterium tuberculosis
PNATAGAPLV

SEQ ID NO: 1366684 - protein, 17 aa, Mycobacterium tuberculosis
PNPPTVAQYENAANGYA

SEQ ID NO: 1366685 - protein, 18 aa, Mycobacterium tuberculosis
PPHTPHPPEPHPPIPTTP

SEQ ID NO: 1366686 - protein, 81 aa, Mycobacterium tuberculosis; identical to SEQ ID NO: 152970

SEQ ID NO: 1366687 - protein, 5 aa, Mycobacterium tuberculosis
PQPPT

SEQ ID NO: 1366688 - protein, 6 aa, Mycobacterium tuberculosis
PRSATV

SEQ ID NO: 1366689 - protein, 16 aa, Mycobacterium tuberculosis
PRSTQAEAAREAPASM

SEQ ID NO: 1366690 - protein, 4 aa, Mycobacterium tuberculosis
PRTG

SEQ ID NO: 1366691 - protein, 10 aa, Mycobacterium tuberculosis
PSGVAVDSAG

SEQ ID NO: 1366692 - protein, 13 aa, Mycobacterium tuberculosis
PSTLSVGDDSMRA

SEQ ID NO: 1366693 - protein, 9 aa, Mycobacterium tuberculosis
PVENDSSTL

SEQ ID NO: 1366694 - protein, 7 aa, Mycobacterium tuberculosis
PVGGQPF

SEQ ID NO: 1366695 - protein, 8 aa, Mycobacterium tuberculosis
PVSGANNR

SEQ ID NO: 1366696 - protein, 23 aa, Mycobacterium tuberculosis
PVSVRPNRHRRTRVSRAQRRHAQ

SEQ ID NO: 1366697 - protein, 18 aa, Mycobacterium tuberculosis
QADPRRRRRYQRARGKGG

SEQ ID NO: 1366698 - protein, 8 aa, Mycobacterium tuberculosis
QALRADAK

SEQ ID NO: 1366699 - protein, 5 aa, Mycobacterium tuberculosis
QDHPD

SEQ ID NO: 1366700 - protein, 9 aa, Mycobacterium tuberculosis
QGTIGSSIG

SEQ ID NO: 1366701 - protein, 5 aa, Mycobacterium tuberculosis
QHSSN

SEQ ID NO: 1366702 - protein, 15 aa, Mycobacterium tuberculosis
QPALTGATTDEGSHS

SEQ ID NO: 1366703 - protein, 8 aa, Mycobacterium tuberculosis
QQLKPAPR

SEQ ID NO: 1366704 - protein, 4 aa, Mycobacterium tuberculosis
QRHP

SEQ ID NO: 1366705 - protein, 7 aa, Mycobacterium tuberculosis
QRPDSGG

SEQ ID NO: 1366706 - protein, 4 aa, Mycobacterium tuberculosis
QRTV

SEQ ID NO: 1366707 - protein, 6 aa, Mycobacterium tuberculosis
QSALGQ

SEQ ID NO: 1366708 - protein, 13 aa, Mycobacterium tuberculosis
QSIADTDEPTTRL

SEQ ID NO: 1366709 - protein, 4 aa, Mycobacterium tuberculosis
QTTA

SEQ ID NO: 1366710 - protein, 13 aa, Mycobacterium tuberculosis
QVTTESNGDYGRI

SEQ ID NO: 1366711 - protein, 8 aa, Mycobacterium tuberculosis
RANGTYGD

SEQ ID NO: 1366712 - protein, 16 aa, Mycobacterium tuberculosis
RASGPQDYANIPPTRF

SEQ ID NO: 1366713 - protein, 5 aa, Mycobacterium tuberculosis
RCESD

SEQ ID NO: 1366714 - protein, 5 aa, Mycobacterium tuberculosis
RELPA

SEQ ID NO: 1366715 - protein, 5 aa, Mycobacterium tuberculosis
RFTPR

SEQ ID NO: 1366716 - protein, 6 aa, Mycobacterium tuberculosis
RGMRDT

SEQ ID NO: 1366717 - protein, 19 aa, Mycobacterium tuberculosis
RGPGDWQAGHRSADGRRGV

SEQ ID NO: 1366718 - protein, 39 aa, Mycobacterium tuberculosis; identical to SEQ ID NO: 153536

SEQ ID NO: 1366719 - protein, 17 aa, Mycobacterium tuberculosis
RGWPPGLSGATPWSPQQ

SEQ ID NO: 1366720 - protein, 14 aa, Mycobacterium tuberculosis
RHRGSAGRPPQTTS

SEQ ID NO: 1366721 - protein, 14 aa, Mycobacterium tuberculosis
RKNGDDGKSEGSGV

SEQ ID NO: 1366722 - protein, 12 aa, Mycobacterium tuberculosis
RLATGTAGQPTW

SEQ ID NO: 1366723 - protein, 12 aa, Mycobacterium tuberculosis
RPGTSLSESDRH

SEQ ID NO: 1366724 - protein, 10 aa, Mycobacterium tuberculosis
RPIDETSLGA

SEQ ID NO: 1366725 - protein, 5 aa, Mycobacterium tuberculosis
RPTLV

SEQ ID NO: 1366726 - protein, 14 aa, Mycobacterium tuberculosis
RQLPDGYQTVNRAD

SEQ ID NO: 1366727 - protein, 20 aa, Mycobacterium tuberculosis
RRDPLPVAGRRSRTSGGIGD

SEQ ID NO: 1366728 - protein, 7 aa, Mycobacterium tuberculosis
RRGSTAE

SEQ ID NO: 1366729 - protein, 4 aa, Mycobacterium tuberculosis
RRGV

SEQ ID NO: 1366730 - protein, 12 aa, Mycobacterium tuberculosis
RSASTPTPATLE

SEQ ID NO: 1366731 - protein, 10 aa, Mycobacterium tuberculosis
RSGEQADRAA

SEQ ID NO: 1366732 - protein, 7 aa, Mycobacterium tuberculosis
RSGPGPR

SEQ ID NO: 1366733 - protein, 8 aa, Mycobacterium tuberculosis
RTPLPPRR

SEQ ID NO: 1366734 - protein, 11 aa, Mycobacterium tuberculosis
RTPTPAPTPPS

SEQ ID NO: 1366735 - protein, 26 aa, Mycobacterium tuberculosis
RTTTPTVGAATTATGWRPDPTGRHEG

SEQ ID NO: 1366736 - protein, 9 aa, Mycobacterium tuberculosis
SADPGTTLG

SEQ ID NO: 1366737 - protein, 14 aa, Mycobacterium tuberculosis
SATATAPADAPASV

SEQ ID NO: 1366738 - protein, 5 aa, Mycobacterium tuberculosis
SATEQ

SEQ ID NO: 1366739 - protein, 6 aa, Mycobacterium tuberculosis
SDGTTV

SEQ ID NO: 1366740 - protein, 23 aa, Mycobacterium tuberculosis
SDSGFGPSTGDHGAQASERGAGT

SEQ ID NO: 1366741 - protein, 6 aa, Mycobacterium tuberculosis
SESPSR

SEQ ID NO: 1366742 - protein, 23 aa, Mycobacterium tuberculosis
SFGGSSNAPGSSPDGGFLGGGGR

SEQ ID NO: 1366743 - protein, 14 aa, Mycobacterium tuberculosis
SGAAVGAAATLPGI

SEQ ID NO: 1366744 - protein, 8 aa, Mycobacterium tuberculosis
SGDAPVPA

SEQ ID NO: 1366745 - protein, 11 aa, Mycobacterium tuberculosis
SGDRMAPGAQS

SEQ ID NO: 1366746 - protein, 9 aa, Mycobacterium tuberculosis
SGGTRGGLG

SEQ ID NO: 1366747 - protein, 4 aa, Mycobacterium tuberculosis
SGLA

SEQ ID NO: 1366748 - protein, 5 aa, Mycobacterium tuberculosis
SHSAQ

SEQ ID NO: 1366749 - protein, 4 aa, Mycobacterium tuberculosis
SIAP

SEQ ID NO: 1366750 - protein, 12 aa, Mycobacterium tuberculosis
SIPITTSGKIRR

SEQ ID NO: 1366751 - protein, 11 aa, Mycobacterium tuberculosis
SLRSGKAGTDA

SEQ ID NO: 1366752 - protein, 10 aa, Mycobacterium tuberculosis
SNDNLQDLKT

SEQ ID NO: 1366753 - protein, 4 aa, Mycobacterium tuberculosis
SNGD

SEQ ID NO: 1366754 - protein, 11 aa, Mycobacterium tuberculosis
SPSEADKMDPQ

SEQ ID NO: 1366755 - protein, 10 aa, Mycobacterium tuberculosis
SQIAERDQAI

SEQ ID NO: 1366756 - protein, 9 aa, Mycobacterium tuberculosis
SRASGRRRM

SEQ ID NO: 1366757 - protein, 4 aa, Mycobacterium tuberculosis
SRGL

SEQ ID NO: 1366758 - protein, 13 aa, Mycobacterium tuberculosis
SRNSSSPPTKLPE

SEQ ID NO: 1366759 - protein, 10 aa, Mycobacterium tuberculosis
SSISQVPPQR

SEQ ID NO: 1366760 - protein, 28 aa, Mycobacterium tuberculosis
SSRAFEPVNPSSAGPNSDEKVKAGTLDS

SEQ ID NO: 1366761 - protein, 19 aa, Mycobacterium tuberculosis
SSSMQPGKPITSMDSSPVT

SEQ ID NO: 1366762 - protein, 4 aa, Mycobacterium tuberculosis
STEG

SEQ ID NO: 1366763 - protein, 8 aa, Mycobacterium tuberculosis
SVRTPSAA

SEQ ID NO: 1366764 - protein, 5 aa, Mycobacterium tuberculosis
SYTPL

SEQ ID NO: 1366765 - protein, 5 aa, Mycobacterium tuberculosis
TAAAS

SEQ ID NO: 1366766 - protein, 16 aa, Mycobacterium tuberculosis
TAGQARPCGTDGSVGT

SEQ ID NO: 1366767 - protein, 10 aa, Mycobacterium tuberculosis
TASGGPVGVG

SEQ ID NO: 1366768 - protein, 5 aa, Mycobacterium tuberculosis
TATGL

SEQ ID NO: 1366769 - protein, 12 aa, Mycobacterium tuberculosis
TDIRDGQTVAER

SEQ ID NO: 1366770 - protein, 4 aa, Mycobacterium tuberculosis
TEPF

SEQ ID NO: 1366771 - protein, 5 aa, Mycobacterium tuberculosis
TERRS

SEQ ID NO: 1366772 - protein, 9 aa, Mycobacterium tuberculosis
TGAYGPASI

SEQ ID NO: 1366773 - protein, 5 aa, Mycobacterium tuberculosis
TGDEV

SEQ ID NO: 1366774 - protein, 11 aa, Mycobacterium tuberculosis
TGEAKPVRAYP

SEQ ID NO: 1366775 - protein, 6 aa, Mycobacterium tuberculosis
TGTLTR

SEQ ID NO: 1366776 - protein, 138 aa, Mycobacterium tuberculosis; identical to SEQ ID NO: 154520

SEQ ID NO: 1366777 - protein, 27 aa, Mycobacterium tuberculosis
TKSDSRTSDFQPVSATARYQDFSGSQI

SEQ ID NO: 1366778 - protein, 5 aa, Mycobacterium tuberculosis
TLAPQ

SEQ ID NO: 1366779 - protein, 5 aa, Mycobacterium tuberculosis
TLEGR

SEQ ID NO: 1366780 - protein, 5 aa, Mycobacterium tuberculosis
TLPAA

SEQ ID NO: 1366781 - protein, 7 aa, Mycobacterium tuberculosis
TLPQTPM

SEQ ID NO: 1366782 - protein, 16 aa, Mycobacterium tuberculosis
TNPCRDVDSADTAIEV

SEQ ID NO: 1366783 - protein, 4 aa, Mycobacterium tuberculosis
TPAT

SEQ ID NO: 1366784 - protein, 8 aa, Mycobacterium tuberculosis
TPERRQRE

SEQ ID NO: 1366785 - protein, 8 aa, Mycobacterium tuberculosis
TPRMPDER

SEQ ID NO: 1366786 - protein, 17 aa, Mycobacterium tuberculosis
TQPGRTYDVSSPDLPTV

SEQ ID NO: 1366787 - protein, 6 aa, Mycobacterium tuberculosis
TRAQWD

SEQ ID NO: 1366788 - protein, 6 aa, Mycobacterium tuberculosis
TRVASE

SEQ ID NO: 1366789 - protein, 6 aa, Mycobacterium tuberculosis
TSHDEP

SEQ ID NO: 1366790 - protein, 12 aa, Mycobacterium tuberculosis
TTEDDDIAAATE

SEQ ID NO: 1366791 - protein, 9 aa, Mycobacterium tuberculosis
TTNGATREE

SEQ ID NO: 1366792 - protein, 5 aa, Mycobacterium tuberculosis
TTRRR

SEQ ID NO: 1366793 - protein, 9 aa, Mycobacterium tuberculosis
TTSSHESKA

SEQ ID NO: 1366794 - protein, 13 aa, Mycobacterium tuberculosis
VAKGGSYATSSAV

SEQ ID NO: 1366795 - protein, 6 aa, Mycobacterium tuberculosis
VAKQNG

SEQ ID NO: 1366796 - protein, 7 aa, Mycobacterium tuberculosis
VAPPGTF

SEQ ID NO: 1366797 - protein, 7 aa, Mycobacterium tuberculosis
VEQSGTR

SEQ ID NO: 1366798 - protein, 7 aa, Mycobacterium tuberculosis
VETAAGV

SEQ ID NO: 1366799 - protein, 10 aa, Mycobacterium tuberculosis
VGAAAGAPAA

SEQ ID NO: 1366800 - protein, 8 aa, Mycobacterium tuberculosis
VGPVTSEF

SEQ ID NO: 1366801 - protein, 4 aa, Mycobacterium tuberculosis
VGRG

SEQ ID NO: 1366802 - protein, 7 aa, Mycobacterium tuberculosis
VIGTPEA

SEQ ID NO: 1366803 - protein, 7 aa, Mycobacterium tuberculosis
VPEAGPG

SEQ ID NO: 1366804 - protein, 8 aa, Mycobacterium tuberculosis
VPVKPGRG

SEQ ID NO: 1366805 - protein, 5 aa, Mycobacterium tuberculosis
VPYRT

SEQ ID NO: 1366806 - protein, 5 aa, Mycobacterium tuberculosis
VQPAA

SEQ ID NO: 1366807 - protein, 4 aa, Mycobacterium tuberculosis
VSGD

SEQ ID NO: 1366808 - protein, 15 aa, Mycobacterium tuberculosis
VSKPNGDGAHIGKEP

SEQ ID NO: 1366809 - protein, 10 aa, Mycobacterium tuberculosis
VSTRASPDGP

SEQ ID NO: 1366810 - protein, 9 aa, Mycobacterium tuberculosis
VTGPDGRIQ

SEQ ID NO: 1366811 - protein, 9 aa, Mycobacterium tuberculosis
VTGPRSSVT

SEQ ID NO: 1366812 - protein, 11 aa, Mycobacterium tuberculosis
VVTTSSEPHVT

SEQ ID NO: 1366813 - protein, 12 aa, Mycobacterium tuberculosis
WPPSGPQRAPQI

SEQ ID NO: 1366814 - protein, 9 aa, Mycobacterium tuberculosis
WPPTPGSPL

SEQ ID NO: 1366815 - protein, 11 aa, Mycobacterium tuberculosis
WQQQPTQEATW

SEQ ID NO: 1366816 - protein, 8 aa, Mycobacterium tuberculosis
WQTAQQKL

SEQ ID NO: 1366817 - protein, 4 aa, Mycobacterium tuberculosis
WSQP

SEQ ID NO: 1366818 - protein, 12 aa, Mycobacterium tuberculosis
YAGDEDGKVTTS

SEQ ID NO: 1366819 - protein, 10 aa, Mycobacterium tuberculosis
YASGTPWAKT

SEQ ID NO: 1366820 - protein, 12 aa, Mycobacterium tuberculosis
YDAAATQSGGVC

SEQ ID NO: 1366821 - protein, 9 aa, Mycobacterium tuberculosis
YGSPDPSSV

SEQ ID NO: 1366822 - protein, 9 aa, Mycobacterium tuberculosis
YPTGTVDVG

SEQ ID NO: 1366823 - protein, 23 aa, Mycobacterium tuberculosis
YRPPTAAPPPAGARGGTEAGNLA

SEQ ID NO: 1366824 - protein, 15 aa, Mycobacterium tuberculosis
YRSTDVAPPRGETPD

SEQ ID NO: 1366825 - protein, 7 aa, Mycobacterium tuberculosis
AAARTGA

SEQ ID NO: 1366826 - protein, 23 aa, Mycobacterium tuberculosis
AAAVGDDRIQQQTTGRTNPETWT

SEQ ID NO: 1366827 - protein, 5 aa, Mycobacterium tuberculosis
ADAGL

SEQ ID NO: 1366828 - protein, 6 aa, Mycobacterium tuberculosis
ADPRLR

SEQ ID NO: 1366829 - protein, 11 aa, Mycobacterium tuberculosis
AEDIDTRYHPS

SEQ ID NO: 1366830 - protein, 9 aa, Mycobacterium tuberculosis
AEPATPAEL

SEQ ID NO: 1366831 - protein, 55 aa, Mycobacterium tuberculosis
AGAKRPGAKKTPPPAPGLAEPAAQPQPEAKPQPEPAAPPKPQTDGDPAAPAAPVK

SEQ ID NO: 1366832 - protein, 7 aa, Mycobacterium tuberculosis
AGDHASV

SEQ ID NO: 1366833 - protein, 7 aa, Mycobacterium tuberculosis
AGFNPER

SEQ ID NO: 1366834 - protein, 7 aa, Mycobacterium tuberculosis
AGLGPPI

SEQ ID NO: 1366835 - protein, 8 aa, Mycobacterium tuberculosis
AGLRGGSV

SEQ ID NO: 1366836 - protein, 6 aa, Mycobacterium tuberculosis
AGQLQR

SEQ ID NO: 1366837 - protein, 5 aa, Mycobacterium tuberculosis
AGRKG

SEQ ID NO: 1366838 - protein, 7 aa, Mycobacterium tuberculosis
AGTGGLL

SEQ ID NO: 1366839 - protein, 10 aa, Mycobacterium tuberculosis
AGTRDADMAA

SEQ ID NO: 1366840 - protein, 6 aa, Mycobacterium tuberculosis
AHQAGI

SEQ ID NO: 1366841 - protein, 6 aa, Mycobacterium tuberculosis
AKGLTR

SEQ ID NO: 1366842 - protein, 8 aa, Mycobacterium tuberculosis
ALRPGHNT

SEQ ID NO: 1366843 - protein, 25 aa, Mycobacterium tuberculosis
APEPEPSGRGPKVHDDADDQQDTEA

SEQ ID NO: 1366844 - protein, 11 aa, Mycobacterium tuberculosis
APGARCDQPVK

SEQ ID NO: 1366845 - protein, 9 aa, Mycobacterium tuberculosis
APRPPEVEE

SEQ ID NO: 1366846 - protein, 13 aa, Mycobacterium tuberculosis
APVGDETYDGEVT

SEQ ID NO: 1366847 - protein, 7 aa, Mycobacterium tuberculosis
AQDDYNG

SEQ ID NO: 1366848 - protein, 36 aa, Mycobacterium tuberculosis
AQHPAATGANRAAYTTPRRTTSCGSPERALEPTTPR

SEQ ID NO: 1366849 - protein, 9 aa, Mycobacterium tuberculosis
AQRRRARRS

SEQ ID NO: 1366850 - protein, 5 aa, Mycobacterium tuberculosis
AQTVT

SEQ ID NO: 1366851 - protein, 4 aa, Mycobacterium tuberculosis
ARAP

SEQ ID NO: 1366852 - protein, 18 aa, Mycobacterium tuberculosis
ARGRIGEEAPLPAGARVD

SEQ ID NO: 1366853 - protein, 13 aa, Mycobacterium tuberculosis
ASDIGNGRGPVDE

SEQ ID NO: 1366854 - protein, 12 aa, Mycobacterium tuberculosis
ASGNVRTEADAR

SEQ ID NO: 1366855 - protein, 20 aa, Mycobacterium tuberculosis
ASPADPPPPDASASHSPVDM

SEQ ID NO: 1366856 - protein, 8 aa, Mycobacterium tuberculosis
ATISPAQQ

SEQ ID NO: 1366857 - protein, 8 aa, Mycobacterium tuberculosis
AVDDEPER

SEQ ID NO: 1366858 - protein, 20 aa, Mycobacterium tuberculosis
AVNQDGASNGLATPNGPAQQ

SEQ ID NO: 1366859 - protein, 13 aa, Mycobacterium tuberculosis
AYAGAADGTAFAE

SEQ ID NO: 1366860 - protein, 8 aa, Mycobacterium tuberculosis
AYSDSYND

SEQ ID NO: 1366861 - protein, 4 aa, Mycobacterium tuberculosis
DAQT

SEQ ID NO: 1366862 - protein, 8 aa, Mycobacterium tuberculosis
DEQENTTL

SEQ ID NO: 1366863 - protein, 6 aa, Mycobacterium tuberculosis
DGATGE

SEQ ID NO: 1366864 - protein, 5 aa, Mycobacterium tuberculosis
DGVSQ

SEQ ID NO: 1366865 - protein, 7 aa, Mycobacterium tuberculosis
DLDPTSV

SEQ ID NO: 1366866 - protein, 5 aa, Mycobacterium tuberculosis
DLRES

SEQ ID NO: 1366867 - protein, 7 aa, Mycobacterium tuberculosis
DRTGLTG

SEQ ID NO: 1366868 - protein, 9 aa, Mycobacterium tuberculosis
DSQGNGGGL

SEQ ID NO: 1366869 - protein, 6 aa, Mycobacterium tuberculosis
EAKADV

SEQ ID NO: 1366870 - protein, 5 aa, Mycobacterium tuberculosis
EGAPQ

SEQ ID NO: 1366871 - protein, 9 aa, Mycobacterium tuberculosis
EIDQTRDQL

SEQ ID NO: 1366872 - protein, 5 aa, Mycobacterium tuberculosis
ELRPG

SEQ ID NO: 1366873 - protein, 5 aa, Mycobacterium tuberculosis
ENVRP

SEQ ID NO: 1366874 - protein, 11 aa, Mycobacterium tuberculosis
EPAAGASGFGK

SEQ ID NO: 1366875 - protein, 9 aa, Mycobacterium tuberculosis
EPPYRGGPV

SEQ ID NO: 1366876 - protein, 6 aa, Mycobacterium tuberculosis
ERTAPP

SEQ ID NO: 1366877 - protein, 10 aa, Mycobacterium tuberculosis
ETAAAGAPRL

SEQ ID NO: 1366878 - protein, 16 aa, Mycobacterium tuberculosis
EWRSPADTSPRPLPSG

SEQ ID NO: 1366879 - protein, 13 aa, Mycobacterium tuberculosis
EWSHGTSSTAQPL

SEQ ID NO: 1366880 - protein, 5 aa, Mycobacterium tuberculosis
FATGA

SEQ ID NO: 1366881 - protein, 52 aa, Mycobacterium tuberculosis
FKPEGVGEDLKSDPVVSKPGLVNSDASPNKPNAAITDSAGTAGGKGPVGING

SEQ ID NO: 1366882 - protein, 8 aa, Mycobacterium tuberculosis
GAEANSPV

SEQ ID NO: 1366883 - protein, 5 aa, Mycobacterium tuberculosis
GAGQR

SEQ ID NO: 1366884 - protein, 6 aa, Mycobacterium tuberculosis
GALRPL

SEQ ID NO: 1366885 - protein, 6 aa, Mycobacterium tuberculosis
GAPDSV

SEQ ID NO: 1366886 - protein, 6 aa, Mycobacterium tuberculosis
GGSAGG

SEQ ID NO: 1366887 - protein, 8 aa, Mycobacterium tuberculosis
GINDAPAL

SEQ ID NO: 1366888 - protein, 7 aa, Mycobacterium tuberculosis
GLQAERT

SEQ ID NO: 1366889 - protein, 8 aa, Mycobacterium tuberculosis
GLRGHGDD

SEQ ID NO: 1366890 - protein, 4 aa, Mycobacterium tuberculosis
GLRS

SEQ ID NO: 1366891 - protein, 6 aa, Mycobacterium tuberculosis
GPTGIA

SEQ ID NO: 1366892 - protein, 5 aa, Mycobacterium tuberculosis
GPTIP

SEQ ID NO: 1366893 - protein, 7 aa, Mycobacterium tuberculosis
GRDDGGV

SEQ ID NO: 1366894 - protein, 10 aa, Mycobacterium tuberculosis
GTGQEARGEA

SEQ ID NO: 1366895 - protein, 5 aa, Mycobacterium tuberculosis
GTLTV

SEQ ID NO: 1366896 - protein, 4 aa, Mycobacterium tuberculosis
GTQP

SEQ ID NO: 1366897 - protein, 13 aa, Mycobacterium tuberculosis
GTRRAEAAAESAR

SEQ ID NO: 1366898 - protein, 9 aa, Mycobacterium tuberculosis
GTSGSGKSE

SEQ ID NO: 1366899 - protein, 6 aa, Mycobacterium tuberculosis
GYEPED

SEQ ID NO: 1366900 - protein, 4 aa, Mycobacterium tuberculosis
HRPF

SEQ ID NO: 1366901 - protein, 9 aa, Mycobacterium tuberculosis
HSDADLSNA

SEQ ID NO: 1366902 - protein, 4 aa, Mycobacterium tuberculosis
HTGS

SEQ ID NO: 1366903 - protein, 5 aa, Mycobacterium tuberculosis
IQNTT

SEQ ID NO: 1366904 - protein, 4 aa, Mycobacterium tuberculosis
KAYF

SEQ ID NO: 1366905 - protein, 4 aa, Mycobacterium tuberculosis
KPPV

SEQ ID NO: 1366906 - protein, 7 aa, Mycobacterium tuberculosis
KPSPVTA

SEQ ID NO: 1366907 - protein, 47 aa, Mycobacterium tuberculosis
LAAEKDGAGPDEPDDPWRDPAAAAALGTPALAAPAPHGALAGSGKLG

SEQ ID NO: 1366908 - protein, 39 aa, Mycobacterium tuberculosis
LAPVPDKPAAAKEAPAKASKTTARKTSGRRAGTAELRST

SEQ ID NO: 1366909 - protein, 6 aa, Mycobacterium tuberculosis
LATPRS

SEQ ID NO: 1366910 - protein, 5 aa, Mycobacterium tuberculosis
LPAGQ

SEQ ID NO: 1366911 - protein, 9 aa, Mycobacterium tuberculosis
LRSGGDDEL

SEQ ID NO: 1366912 - protein, 9 aa, Mycobacterium tuberculosis
LSDFDEDEL

SEQ ID NO: 1366913 - protein, 4 aa, Mycobacterium tuberculosis
LSGV

SEQ ID NO: 1366914 - protein, 9 aa, Mycobacterium tuberculosis
LTTSEQHQA

SEQ ID NO: 1366915 - protein, 10 aa, Mycobacterium tuberculosis
LVPSESGPAA

SEQ ID NO: 1366916 - protein, 12 aa, Mycobacterium tuberculosis
MGAGAGTPDDFD

SEQ ID NO: 1366917 - protein, 15 aa, Mycobacterium tuberculosis
MQQGANALADGSAAL

SEQ ID NO: 1366918 - protein, 16 aa, Mycobacterium tuberculosis
MTGEAKPTRVRPGGQV

SEQ ID NO: 1366919 - protein, 8 aa, Mycobacterium tuberculosis
NAATARPV

SEQ ID NO: 1366920 - protein, 5 aa, Mycobacterium tuberculosis
NDEVT

SEQ ID NO: 1366921 - protein, 6 aa, Mycobacterium tuberculosis
NECGQQ

SEQ ID NO: 1366922 - protein, 7 aa, Mycobacterium tuberculosis
NETEAYD

SEQ ID NO: 1366923 - protein, 7 aa, Mycobacterium tuberculosis
NGKGGQP

SEQ ID NO: 1366924 - protein, 11 aa, Mycobacterium tuberculosis
NIGHTSAAAGV

SEQ ID NO: 1366925 - protein, 5 aa, Mycobacterium tuberculosis
NPEQR

SEQ ID NO: 1366926 - protein, 10 aa, Mycobacterium tuberculosis
NRTHSADSRA

SEQ ID NO: 1366927 - protein, 19 aa, Mycobacterium tuberculosis
PAARSARVTSLQRGGAFGE

SEQ ID NO: 1366928 - protein, 9 aa, Mycobacterium tuberculosis
PADEVSNQK

SEQ ID NO: 1366929 - protein, 46 aa, Mycobacterium tuberculosis; identical to SEQ ID NO: 152690

SEQ ID NO: 1366930 - protein, 5 aa, Mycobacterium tuberculosis
PARRG

SEQ ID NO: 1366931 - protein, 19 aa, Mycobacterium tuberculosis
PASEIPPLPNTSSPKPMPN

SEQ ID NO: 1366932 - protein, 4 aa, Mycobacterium tuberculosis
PASV

SEQ ID NO: 1366933 - protein, 9 aa, Mycobacterium tuberculosis
PDGQTRTST

SEQ ID NO: 1366934 - protein, 5 aa, Mycobacterium tuberculosis
PEDSV

SEQ ID NO: 1366935 - protein, 5 aa, Mycobacterium tuberculosis
PEQVN

SEQ ID NO: 1366936 - protein, 11 aa, Mycobacterium tuberculosis
PGQGSYAAANS

SEQ ID NO: 1366937 - protein, 25 aa, Mycobacterium tuberculosis
PHDKPSPAPSAPTFTSQQISDAKEN

SEQ ID NO: 1366938 - protein, 52 aa, Mycobacterium tuberculosis
PHTSKLATGDTTSSAPPVQDEITTTKPAPPPPPPAPPPTTEIPTATETQTVT

SEQ ID NO: 1366939 - protein, 9 aa, Mycobacterium tuberculosis
PKLADDSLT

SEQ ID NO: 1366940 - protein, 7 aa, Mycobacterium tuberculosis
PKTAPHG

SEQ ID NO: 1366941 - protein, 14 aa, Mycobacterium tuberculosis
PLAGPEGLVPGTAA

SEQ ID NO: 1366942 - protein, 8 aa, Mycobacterium tuberculosis
PLSGSGYS

SEQ ID NO: 1366943 - protein, 16 aa, Mycobacterium tuberculosis
PPCPEPAAADPTDVPA

SEQ ID NO: 1366944 - protein, 8 aa, Mycobacterium tuberculosis
PPGPAAVA

SEQ ID NO: 1366945 - protein, 5 aa, Mycobacterium tuberculosis
PSYDR

SEQ ID NO: 1366946 - protein, 7 aa, Mycobacterium tuberculosis
PTDWPRY

SEQ ID NO: 1366947 - protein, 7 aa, Mycobacterium tuberculosis
PVAPGPG

SEQ ID NO: 1366948 - protein, 14 aa, Mycobacterium tuberculosis
QAQPAGSYGGVTPS

SEQ ID NO: 1366949 - protein, 13 aa, Mycobacterium tuberculosis
QAVDAASEEERAR

SEQ ID NO: 1366950 - protein, 23 aa, Mycobacterium tuberculosis
QDVRPAPPPERTAPILISGSVWS

SEQ ID NO: 1366951 - protein, 6 aa, Mycobacterium tuberculosis
QEGRGA

SEQ ID NO: 1366952 - protein, 6 aa, Mycobacterium tuberculosis
QGGTTL

SEQ ID NO: 1366953 - protein, 4 aa, Mycobacterium tuberculosis
QLPA

SEQ ID NO: 1366954 - protein, 4 aa, Mycobacterium tuberculosis
QQIT

SEQ ID NO: 1366955 - protein, 5 aa, Mycobacterium tuberculosis
QVPTE

SEQ ID NO: 1366956 - protein, 62 aa, Mycobacterium tuberculosis; identical to SEQ ID NO: 153363

SEQ ID NO: 1366957 - protein, 14 aa, Mycobacterium tuberculosis
RADAKASPDPDRRQ

SEQ ID NO: 1366958 - protein, 6 aa, Mycobacterium tuberculosis
RAGDRA

SEQ ID NO: 1366959 - protein, 6 aa, Mycobacterium tuberculosis
RATERV

SEQ ID NO: 1366960 - protein, 22 aa, Mycobacterium tuberculosis
RDASALNGTVNGDSVLQGVAED

SEQ ID NO: 1366961 - protein, 7 aa, Mycobacterium tuberculosis
RDREVRR

SEQ ID NO: 1366962 - protein, 7 aa, Mycobacterium tuberculosis
RGATGEP

SEQ ID NO: 1366963 - protein, 5 aa, Mycobacterium tuberculosis
RGPAK

SEQ ID NO: 1366964 - protein, 6 aa, Mycobacterium tuberculosis
RHHRNP

SEQ ID NO: 1366965 - protein, 6 aa, Mycobacterium tuberculosis
RKTDIS

SEQ ID NO: 1366966 - protein, 4 aa, Mycobacterium tuberculosis
RRNS

SEQ ID NO: 1366967 - protein, 21 aa, Mycobacterium tuberculosis
RSQESTLPAPPKPVPPPTMPA

SEQ ID NO: 1366968 - protein, 8 aa, Mycobacterium tuberculosis
RTNGYTAE

SEQ ID NO: 1366969 - protein, 5 aa, Mycobacterium tuberculosis
RTREP

SEQ ID NO: 1366970 - protein, 4 aa, Mycobacterium tuberculosis
RTSQ

SEQ ID NO: 1366971 - protein, 9 aa, Mycobacterium tuberculosis
RVSKKASEW

SEQ ID NO: 1366972 - protein, 5 aa, Mycobacterium tuberculosis
RYTGS

SEQ ID NO: 1366973 - protein, 5 aa, Mycobacterium tuberculosis
SAASR

SEQ ID NO: 1366974 - protein, 4 aa, Mycobacterium tuberculosis
SALP

SEQ ID NO: 1366975 - protein, 7 aa, Mycobacterium tuberculosis
SAPSLNR

SEQ ID NO: 1366976 - protein, 8 aa, Mycobacterium tuberculosis
SAQALTNQ

SEQ ID NO: 1366977 - protein, 16 aa, Mycobacterium tuberculosis
SEPRLQPPNGYKDTTV

SEQ ID NO: 1366978 - protein, 6 aa, Mycobacterium tuberculosis
SGLGTP

SEQ ID NO: 1366979 - protein, 4 aa, Mycobacterium tuberculosis
SGPV

SEQ ID NO: 1366980 - protein, 6 aa, Mycobacterium tuberculosis
SKPLRR

SEQ ID NO: 1366981 - protein, 5 aa, Mycobacterium tuberculosis
SRFPG

SEQ ID NO: 1366982 - protein, 13 aa, Mycobacterium tuberculosis
SRRARDRAADALR

SEQ ID NO: 1366983 - protein, 16 aa, Mycobacterium tuberculosis
SVRERASGLRSDARTT

SEQ ID NO: 1366984 - protein, 4 aa, Mycobacterium tuberculosis
TAAG

SEQ ID NO: 1366985 - protein, 9 aa, Mycobacterium tuberculosis
TAQESTKAL

SEQ ID NO: 1366986 - protein, 7 aa, Mycobacterium tuberculosis
TARRPLA

SEQ ID NO: 1366987 - protein, 5 aa, Mycobacterium tuberculosis
TGKAH

SEQ ID NO: 1366988 - protein, 12 aa, Mycobacterium tuberculosis
TIPPEDIPGQFS

SEQ ID NO: 1366989 - protein, 8 aa, Mycobacterium tuberculosis
TNGAGPEL

SEQ ID NO: 1366990 - protein, 15 aa, Mycobacterium tuberculosis
TNQANPVPGDPTGDL

SEQ ID NO: 1366991 - protein, 10 aa, Mycobacterium tuberculosis
TPDTSRGQQA

SEQ ID NO: 1366992 - protein, 6 aa, Mycobacterium tuberculosis
TRLPKE

SEQ ID NO: 1366993 - protein, 5 aa, Mycobacterium tuberculosis
TRPQT

SEQ ID NO: 1366994 - protein, 27 aa, Mycobacterium tuberculosis
TSEAFEPVGSQANPNDPNATPAAGSIR

SEQ ID NO: 1366995 - protein, 12 aa, Mycobacterium tuberculosis
TSQDPVYAGTGY

SEQ ID NO: 1366996 - protein, 4 aa, Mycobacterium tuberculosis
TSRT

SEQ ID NO: 1366997 - protein, 6 aa, Mycobacterium tuberculosis
TSSLTD

SEQ ID NO: 1366998 - protein, 4 aa, Mycobacterium tuberculosis
TSSN

SEQ ID NO: 1366999 - protein, 5 aa, Mycobacterium tuberculosis
TTAQI

SEQ ID NO: 1367000 - protein, 4 aa, Mycobacterium tuberculosis
TTEN

SEQ ID NO: 1367001 - protein, 5 aa, Mycobacterium tuberculosis
TVAPT

SEQ ID NO: 1367002 - protein, 11 aa, Mycobacterium tuberculosis
VAQGAIQGARY

SEQ ID NO: 1367003 - protein, 12 aa, Mycobacterium tuberculosis
VGKTEPVDSEAG

SEQ ID NO: 1367004 - protein, 11 aa, Mycobacterium tuberculosis
VGPSGSGKSTL

SEQ ID NO: 1367005 - protein, 5 aa, Mycobacterium tuberculosis
VGRGG

SEQ ID NO: 1367006 - protein, 5 aa, Mycobacterium tuberculosis
VGSTQ

SEQ ID NO: 1367007 - protein, 12 aa, Mycobacterium tuberculosis
VNPAEGSPGPGT

SEQ ID NO: 1367008 - protein, 11 aa, Mycobacterium tuberculosis
VRTNGASYAYT

SEQ ID NO: 1367009 - protein, 6 aa, Mycobacterium tuberculosis
VTLTRG

SEQ ID NO: 1367010 - protein, 4 aa, Mycobacterium tuberculosis
VVSG

SEQ ID NO: 1367011 - protein, 4 aa, Mycobacterium tuberculosis
WPPA

SEQ ID NO: 1367012 - protein, 20 aa, Mycobacterium tuberculosis
YDQSTEDKINQLNQQRAQTS

SEQ ID NO: 1367013 - protein, 10 aa, Mycobacterium tuberculosis
YYPDAQPADL

SEQ ID NO: 1367014 - protein, 16 aa, Mycobacterium tuberculosis
AAAEAADKPVQSRTDY

SEQ ID NO: 1367015 - protein, 5 aa, Mycobacterium tuberculosis
ADIDQ

SEQ ID NO: 1367016 - protein, 8 aa, Mycobacterium tuberculosis
ADPGESQM

SEQ ID NO: 1367017 - protein, 5 aa, Mycobacterium tuberculosis
ADTRS

SEQ ID NO: 1367018 - protein, 7 aa, Mycobacterium tuberculosis
AEATMET

SEQ ID NO: 1367019 - protein, 4 aa, Mycobacterium tuberculosis
AEGR

SEQ ID NO: 1367020 - protein, 7 aa, Mycobacterium tuberculosis
AELSDPL

SEQ ID NO: 1367021 - protein, 6 aa, Mycobacterium tuberculosis
AGNRGL

SEQ ID NO: 1367022 - protein, 8 aa, Mycobacterium tuberculosis
AGQHAPGV

SEQ ID NO: 1367023 - protein, 8 aa, Mycobacterium tuberculosis
AGRSSERL

SEQ ID NO: 1367024 - protein, 29 aa, Mycobacterium tuberculosis
AGVTTDAAAPAAKLPGDQAQSSASKATRL

SEQ ID NO: 1367025 - protein, 13 aa, Mycobacterium tuberculosis
AIRQGSLENAADQ

SEQ ID NO: 1367026 - protein, 9 aa, Mycobacterium tuberculosis
AIYGSGLPS

SEQ ID NO: 1367027 - protein, 15 aa, Mycobacterium tuberculosis
AKPKNSKDTGPALDG

SEQ ID NO: 1367028 - protein, 6 aa, Mycobacterium tuberculosis
ALRGDN

SEQ ID NO: 1367029 - protein, 22 aa, Mycobacterium tuberculosis
ANADVQSAQRAYTRRGGNNAGA

SEQ ID NO: 1367030 - protein, 10 aa, Mycobacterium tuberculosis
APFGNRSDNG

SEQ ID NO: 1367031 - protein, 21 aa, Mycobacterium tuberculosis
APHDVSQDNQISALSSSAGSV

SEQ ID NO: 1367032 - protein, 13 aa, Mycobacterium tuberculosis
ARSVQGDGGIRSA

SEQ ID NO: 1367033 - protein, 8 aa, Mycobacterium tuberculosis
ARVGDDEA

SEQ ID NO: 1367034 - protein, 28 aa, Mycobacterium tuberculosis
ASDEPATGAEQAVDTAATPQTPEPQPIR

SEQ ID NO: 1367035 - protein, 9 aa, Mycobacterium tuberculosis
ASGGPNCRG

SEQ ID NO: 1367036 - protein, 8 aa, Mycobacterium tuberculosis
ATAANNSL

SEQ ID NO: 1367037 - protein, 5 aa, Mycobacterium tuberculosis
AVEPV

SEQ ID NO: 1367038 - protein, 8 aa, Mycobacterium tuberculosis
AVSGPAGP

SEQ ID NO: 1367039 - protein, 4 aa, Mycobacterium tuberculosis
AYKS

SEQ ID NO: 1367040 - protein, 7 aa, Mycobacterium tuberculosis
CGPPTQI

SEQ ID NO: 1367041 - protein, 4 aa, Mycobacterium tuberculosis
DAPS

SEQ ID NO: 1367042 - protein, 5 aa, Mycobacterium tuberculosis
DAVSE

SEQ ID NO: 1367043 - protein, 8 aa, Mycobacterium tuberculosis
DERTGDLN

SEQ ID NO: 1367044 - protein, 6 aa, Mycobacterium tuberculosis
DPANRG

SEQ ID NO: 1367045 - protein, 8 aa, Mycobacterium tuberculosis
DQKDNLND

SEQ ID NO: 1367046 - protein, 21 aa, Mycobacterium tuberculosis
EAIPGGRTQISGGDPPFTAAT

SEQ ID NO: 1367047 - protein, 11 aa, Mycobacterium tuberculosis
EEYATARTRRG

SEQ ID NO: 1367048 - protein, 12 aa, Mycobacterium tuberculosis
ELAEEAGQAEAI

SEQ ID NO: 1367049 - protein, 10 aa, Mycobacterium tuberculosis
ELAEGSDRDE

SEQ ID NO: 1367050 - protein, 17 aa, Mycobacterium tuberculosis
EPGGTGEPAETPGRGRL

SEQ ID NO: 1367051 - protein, 7 aa, Mycobacterium tuberculosis
FGDGAPV

SEQ ID NO: 1367052 - protein, 56 aa, Mycobacterium tuberculosis
FGPGTGRVATAPGGDAASAPPPGAGGPAPPQAVPPPRTTQPPAAPPRGPDVPPATV

SEQ ID NO: 1367053 - protein, 4 aa, Mycobacterium tuberculosis
FPEI

SEQ ID NO: 1367054 - protein, 4 aa, Mycobacterium tuberculosis
GAAR

SEQ ID NO: 1367055 - protein, 7 aa, Mycobacterium tuberculosis
GAPSPLL

SEQ ID NO: 1367056 - protein, 13 aa, Mycobacterium tuberculosis
GAWTTGNKRGQAH

SEQ ID NO: 1367057 - protein, 5 aa, Mycobacterium tuberculosis
GDTIG

SEQ ID NO: 1367058 - protein, 5 aa, Mycobacterium tuberculosis
GFGGT

SEQ ID NO: 1367059 - protein, 7 aa, Mycobacterium tuberculosis
GGLASPV

SEQ ID NO: 1367060 - protein, 7 aa, Mycobacterium tuberculosis
GGQVQSS

SEQ ID NO: 1367061 - protein, 9 aa, Mycobacterium tuberculosis
GLGMTDADR

SEQ ID NO: 1367062 - protein, 8 aa, Mycobacterium tuberculosis
GLPAGTLD

SEQ ID NO: 1367063 - protein, 12 aa, Mycobacterium tuberculosis
GPHTDQTLDGPG

SEQ ID NO: 1367064 - protein, 7 aa, Mycobacterium tuberculosis
GQIPPNQ

SEQ ID NO: 1367065 - protein, 6 aa, Mycobacterium tuberculosis
GRANDN

SEQ ID NO: 1367066 - protein, 6 aa, Mycobacterium tuberculosis
GRFDSR

SEQ ID NO: 1367067 - protein, 12 aa, Mycobacterium tuberculosis
GRGHDAAPQVAE

SEQ ID NO: 1367068 - protein, 7 aa, Mycobacterium tuberculosis
GRGSQWA

SEQ ID NO: 1367069 - protein, 25 aa, Mycobacterium tuberculosis
GSTPAAAGAGRRGVPALPTPPKGWP

SEQ ID NO: 1367070 - protein, 15 aa, Mycobacterium tuberculosis
GTFPTNSQLTNESAA

SEQ ID NO: 1367071 - protein, 6 aa, Mycobacterium tuberculosis
GTVGQL

SEQ ID NO: 1367072 - protein, 9 aa, Mycobacterium tuberculosis
GWSSAGSDP

SEQ ID NO: 1367073 - protein, 6 aa, Mycobacterium tuberculosis
HEHTMP

SEQ ID NO: 1367074 - protein, 14 aa, Mycobacterium tuberculosis
HSDGPSRQSWPAAT

SEQ ID NO: 1367075 - protein, 6 aa, Mycobacterium tuberculosis
IGPPTT

SEQ ID NO: 1367076 - protein, 16 aa, Mycobacterium tuberculosis
INGDNVKSAQIDDREQ

SEQ ID NO: 1367077 - protein, 7 aa, Mycobacterium tuberculosis
IPAEGQS

SEQ ID NO: 1367078 - protein, 12 aa, Mycobacterium tuberculosis
IPKSAPGSATGL

SEQ ID NO: 1367079 - protein, 11 aa, Mycobacterium tuberculosis
IPVPGETVDNE

SEQ ID NO: 1367080 - protein, 24 aa, Mycobacterium tuberculosis
IQNEDEVTSDQGNNGGPNGGGRLA

SEQ ID NO: 1367081 - protein, 4 aa, Mycobacterium tuberculosis
ISPD

SEQ ID NO: 1367082 - protein, 4 aa, Mycobacterium tuberculosis
ISPG

SEQ ID NO: 1367083 - protein, 6 aa, Mycobacterium tuberculosis
ITGESV

SEQ ID NO: 1367084 - protein, 8 aa, Mycobacterium tuberculosis
KEGTSTRN

SEQ ID NO: 1367085 - protein, 7 aa, Mycobacterium tuberculosis
KGAPTTV

SEQ ID NO: 1367086 - protein, 8 aa, Mycobacterium tuberculosis
KPELGTPQ

SEQ ID NO: 1367087 - protein, 5 aa, Mycobacterium tuberculosis
LGATA

SEQ ID NO: 1367088 - protein, 12 aa, Mycobacterium tuberculosis
LKQNERLKRENR

SEQ ID NO: 1367089 - protein, 10 aa, Mycobacterium tuberculosis
LKTGPQTQNV

SEQ ID NO: 1367090 - protein, 18 aa, Mycobacterium tuberculosis
LPDRARELGSLSKAELGK

SEQ ID NO: 1367091 - protein, 21 aa, Mycobacterium tuberculosis
LPGATAGARSTDIENSRGSAN

SEQ ID NO: 1367092 - protein, 8 aa, Mycobacterium tuberculosis
LPPGIPQV

SEQ ID NO: 1367093 - protein, 4 aa, Mycobacterium tuberculosis
LPPM

SEQ ID NO: 1367094 - protein, 4 aa, Mycobacterium tuberculosis
LTAG

SEQ ID NO: 1367095 - protein, 11 aa, Mycobacterium tuberculosis
LTRQANPKLPA

SEQ ID NO: 1367096 - protein, 20 aa, Mycobacterium tuberculosis
MAPTPGRRTRNGSVNGHPGM

SEQ ID NO: 1367097 - protein, 11 aa, Mycobacterium tuberculosis
NAYETLAPAEQ

SEQ ID NO: 1367098 - protein, 4 aa, Mycobacterium tuberculosis
NSGF

SEQ ID NO: 1367099 - protein, 6 aa, Mycobacterium tuberculosis
NSPRQT

SEQ ID NO: 1367100 - protein, 4 aa, Mycobacterium tuberculosis
NSTA

SEQ ID NO: 1367101 - protein, 8 aa, Mycobacterium tuberculosis
PAAPQTTR

SEQ ID NO: 1367102 - protein, 15 aa, Mycobacterium tuberculosis
PAGSVATDSATPGIV

SEQ ID NO: 1367103 - protein, 29 aa, Mycobacterium tuberculosis
PEHGPGMPRVSEGRSPSKPDEVAASSTMG

SEQ ID NO: 1367104 - protein, 11 aa, Mycobacterium tuberculosis
PEKELDTDRPF

SEQ ID NO: 1367105 - protein, 10 aa, Mycobacterium tuberculosis
PGANEASNAV

SEQ ID NO: 1367106 - protein, 7 aa, Mycobacterium tuberculosis
PLETNAT

SEQ ID NO: 1367107 - protein, 4 aa, Mycobacterium tuberculosis
PNSG

SEQ ID NO: 1367108 - protein, 7 aa, Mycobacterium tuberculosis
PRAHHTA

SEQ ID NO: 1367109 - protein, 43 aa, Mycobacterium tuberculosis
PSINTGLNPAPADQVQGTPPPVSDPLQRPGSGTVQCNGQQPNP

SEQ ID NO: 1367110 - protein, 8 aa, Mycobacterium tuberculosis
QAVSAGQR

SEQ ID NO: 1367111 - protein, 11 aa, Mycobacterium tuberculosis
QAVTDGSRRQD

SEQ ID NO: 1367112 - protein, 6 aa, Mycobacterium tuberculosis
QDSPFN

SEQ ID NO: 1367113 - protein, 23 aa, Mycobacterium tuberculosis
QETDYPSVGPDRPEYEPRGCPRG

SEQ ID NO: 1367114 - protein, 26 aa, Mycobacterium tuberculosis
QPEPRWPKSPPQDRRESGPELSEYPR

SEQ ID NO: 1367115 - protein, 7 aa, Mycobacterium tuberculosis
QVGGSIG

SEQ ID NO: 1367116 - protein, 5 aa, Mycobacterium tuberculosis
QYRDY

SEQ ID NO: 1367117 - protein, 10 aa, Mycobacterium tuberculosis
RAEQQVASTL

SEQ ID NO: 1367118 - protein, 10 aa, Mycobacterium tuberculosis
RATPVAAPRN

SEQ ID NO: 1367119 - protein, 14 aa, Mycobacterium tuberculosis
RATTVTGSVTVESD

SEQ ID NO: 1367120 - protein, 4 aa, Mycobacterium tuberculosis
RGEG

SEQ ID NO: 1367121 - protein, 6 aa, Mycobacterium tuberculosis
RLERGT

SEQ ID NO: 1367122 - protein, 15 aa, Mycobacterium tuberculosis
RLGRREPAVYGGTTH

SEQ ID NO: 1367123 - protein, 7 aa, Mycobacterium tuberculosis
RPDTQQI

SEQ ID NO: 1367124 - protein, 8 aa, Mycobacterium tuberculosis
RPGRDLAP

SEQ ID NO: 1367125 - protein, 7 aa, Mycobacterium tuberculosis
RQRITDP

SEQ ID NO: 1367126 - protein, 6 aa, Mycobacterium tuberculosis
RRGRRA

SEQ ID NO: 1367127 - protein, 7 aa, Mycobacterium tuberculosis
RSHAEGL

SEQ ID NO: 1367128 - protein, 5 aa, Mycobacterium tuberculosis
RTTEP

SEQ ID NO: 1367129 - protein, 8 aa, Mycobacterium tuberculosis
SAIPSTAT

SEQ ID NO: 1367130 - protein, 8 aa, Mycobacterium tuberculosis
SGTSAGGI

SEQ ID NO: 1367131 - protein, 8 aa, Mycobacterium tuberculosis
SGTSYAAG

SEQ ID NO: 1367132 - protein, 19 aa, Mycobacterium tuberculosis
SISAARLTGAAGSQAISDS

SEQ ID NO: 1367133 - protein, 8 aa, Mycobacterium tuberculosis
SPQPRPSS

SEQ ID NO: 1367134 - protein, 5 aa, Mycobacterium tuberculosis
SQPLT

SEQ ID NO: 1367135 - protein, 4 aa, Mycobacterium tuberculosis
SRPG

SEQ ID NO: 1367136 - protein, 7 aa, Mycobacterium tuberculosis
SSRGPEY

SEQ ID NO: 1367137 - protein, 13 aa, Mycobacterium tuberculosis
STDVRRAPHAGGR

SEQ ID NO: 1367138 - protein, 11 aa, Mycobacterium tuberculosis
SYGGQGRVPGD

SEQ ID NO: 1367139 - protein, 10 aa, Mycobacterium tuberculosis
TAGSDLSERL

SEQ ID NO: 1367140 - protein, 14 aa, Mycobacterium tuberculosis
TAYNPLPNGTGNGL

SEQ ID NO: 1367141 - protein, 4 aa, Mycobacterium tuberculosis
TELG

SEQ ID NO: 1367142 - protein, 11 aa, Mycobacterium tuberculosis
TPGVGGLGQPH

SEQ ID NO: 1367143 - protein, 9 aa, Mycobacterium tuberculosis
TPNDPRFQP

SEQ ID NO: 1367144 - protein, 6 aa, Mycobacterium tuberculosis
TSAVTG

SEQ ID NO: 1367145 - protein, 4 aa, Mycobacterium tuberculosis
TSEV

SEQ ID NO: 1367146 - protein, 26 aa, Mycobacterium tuberculosis
TTPAPAPTTSAAPTAPSTPGSSAAQG

SEQ ID NO: 1367147 - protein, 6 aa, Mycobacterium tuberculosis
TVPPGS

SEQ ID NO: 1367148 - protein, 8 aa, Mycobacterium tuberculosis
VAAPTGTF

SEQ ID NO: 1367149 - protein, 12 aa, Mycobacterium tuberculosis
VEPPPGPPVAPL

SEQ ID NO: 1367150 - protein, 6 aa, Mycobacterium tuberculosis
VEQGDL

SEQ ID NO: 1367151 - protein, 7 aa, Mycobacterium tuberculosis
VGRPRGY

SEQ ID NO: 1367152 - protein, 7 aa, Mycobacterium tuberculosis
VKSATTN

SEQ ID NO: 1367153 - protein, 10 aa, Mycobacterium tuberculosis
VPAGPAAPGI

SEQ ID NO: 1367154 - protein, 4 aa, Mycobacterium tuberculosis
VPRN

SEQ ID NO: 1367155 - protein, 5 aa, Mycobacterium tuberculosis
VRGEG

SEQ ID NO: 1367156 - protein, 13 aa, Mycobacterium tuberculosis
VSNRNSPTPQIDR

SEQ ID NO: 1367157 - protein, 10 aa, Mycobacterium tuberculosis
VTRRGGRDGD

SEQ ID NO: 1367158 - protein, 11 aa, Mycobacterium tuberculosis
VTSTNGDRIEP

SEQ ID NO: 1367159 - protein, 7 aa, Mycobacterium tuberculosis
AAAAYAA

SEQ ID NO: 1367160 - protein, 10 aa, Mycobacterium tuberculosis
AAGTDYADLT

SEQ ID NO: 1367161 - protein, 5 aa, Mycobacterium tuberculosis
AARRA

SEQ ID NO: 1367162 - protein, 12 aa, Mycobacterium tuberculosis
AASGTSRASSSR

SEQ ID NO: 1367163 - protein, 10 aa, Mycobacterium tuberculosis
AEAVADAAQL

SEQ ID NO: 1367164 - protein, 5 aa, Mycobacterium tuberculosis
AEHTT

SEQ ID NO: 1367165 - protein, 31 aa, Mycobacterium tuberculosis; identical to SEQ ID NO: 149562

SEQ ID NO: 1367166 - protein, 16 aa, Mycobacterium tuberculosis
AGAGGTPNAPSNGTAS

SEQ ID NO: 1367167 - protein, 6 aa, Mycobacterium tuberculosis
AHAGSV

SEQ ID NO: 1367168 - protein, 8 aa, Mycobacterium tuberculosis
AKERLSTD

SEQ ID NO: 1367169 - protein, 9 aa, Mycobacterium tuberculosis
AKSAQFSAS

SEQ ID NO: 1367170 - protein, 9 aa, Mycobacterium tuberculosis
AKWSPPGGH

SEQ ID NO: 1367171 - protein, 10 aa, Mycobacterium tuberculosis
ANLTGPAATV

SEQ ID NO: 1367172 - protein, 8 aa, Mycobacterium tuberculosis
APAKLSDT

SEQ ID NO: 1367173 - protein, 9 aa, Mycobacterium tuberculosis
APFAAGAGA

SEQ ID NO: 1367174 - protein, 7 aa, Mycobacterium tuberculosis
APGATPI

SEQ ID NO: 1367175 - protein, 8 aa, Mycobacterium tuberculosis
APRSASVR

SEQ ID NO: 1367176 - protein, 4 aa, Mycobacterium tuberculosis
AQDV

SEQ ID NO: 1367177 - protein, 5 aa, Mycobacterium tuberculosis
AQGTL

SEQ ID NO: 1367178 - protein, 12 aa, Mycobacterium tuberculosis
AQPTAANDPIYA

SEQ ID NO: 1367179 - protein, 7 aa, Mycobacterium tuberculosis
ATALGSG

SEQ ID NO: 1367180 - protein, 5 aa, Mycobacterium tuberculosis
ATPEE

SEQ ID NO: 1367181 - protein, 16 aa, Mycobacterium tuberculosis
AVGGELAAASAAPQPF

SEQ ID NO: 1367182 - protein, 9 aa, Mycobacterium tuberculosis
AYAAPGGPD

SEQ ID NO: 1367183 - protein, 9 aa, Mycobacterium tuberculosis
CTPDEVDPD

SEQ ID NO: 1367184 - protein, 9 aa, Mycobacterium tuberculosis
DATNSSPDQ

SEQ ID NO: 1367185 - protein, 5 aa, Mycobacterium tuberculosis
DAYTA

SEQ ID NO: 1367186 - protein, 27 aa, Mycobacterium tuberculosis
DDIDEELNEDLDKDVDDVAGERRVTND

SEQ ID NO: 1367187 - protein, 10 aa, Mycobacterium tuberculosis
DEPADQPQSL

SEQ ID NO: 1367188 - protein, 6 aa, Mycobacterium tuberculosis
DETASV

SEQ ID NO: 1367189 - protein, 4 aa, Mycobacterium tuberculosis
DFGG

SEQ ID NO: 1367190 - protein, 8 aa, Mycobacterium tuberculosis
DHAGTATA

SEQ ID NO: 1367191 - protein, 7 aa, Mycobacterium tuberculosis
DPTMYGG

SEQ ID NO: 1367192 - protein, 4 aa, Mycobacterium tuberculosis
DQDE

SEQ ID NO: 1367193 - protein, 10 aa, Mycobacterium tuberculosis
DRGGPALGET

SEQ ID NO: 1367194 - protein, 8 aa, Mycobacterium tuberculosis
DRKERLDR

SEQ ID NO: 1367195 - protein, 8 aa, Mycobacterium tuberculosis
DSEQIRTQ

SEQ ID NO: 1367196 - protein, 9 aa, Mycobacterium tuberculosis
DSQTHTSDA

SEQ ID NO: 1367197 - protein, 39 aa, Mycobacterium tuberculosis
DTPFAEPYPEQRPPWGVPPPGWDGSSRPAPSTTPRSPGR

SEQ ID NO: 1367198 - protein, 11 aa, Mycobacterium tuberculosis
EAGTTQAAESL

SEQ ID NO: 1367199 - protein, 7 aa, Mycobacterium tuberculosis
EAQAATA

SEQ ID NO: 1367200 - protein, 5 aa, Mycobacterium tuberculosis
EATRE

SEQ ID NO: 1367201 - protein, 6 aa, Mycobacterium tuberculosis
EEADRE

SEQ ID NO: 1367202 - protein, 4 aa, Mycobacterium tuberculosis
EERD

SEQ ID NO: 1367203 - protein, 8 aa, Mycobacterium tuberculosis
EHFPNPGS

SEQ ID NO: 1367204 - protein, 10 aa, Mycobacterium tuberculosis
EINGNGSRIQ

SEQ ID NO: 1367205 - protein, 12 aa, Mycobacterium tuberculosis
ELGEPGAPTTGL

SEQ ID NO: 1367206 - protein, 22 aa, Mycobacterium tuberculosis
EPTYEPQRRRARPSEPTNPTHH

SEQ ID NO: 1367207 - protein, 9 aa, Mycobacterium tuberculosis
ESAPAQMPA

SEQ ID NO: 1367208 - protein, 4 aa, Mycobacterium tuberculosis
ETAT

SEQ ID NO: 1367209 - protein, 18 aa, Mycobacterium tuberculosis
EVAHDRDGVTVRAGGSAM

SEQ ID NO: 1367210 - protein, 29 aa, Mycobacterium tuberculosis
GADQTGPQVKAADSAESDAGELGEDACPE

SEQ ID NO: 1367211 - protein, 17 aa, Mycobacterium tuberculosis
GAPARRRRRRRGDSDAI

SEQ ID NO: 1367212 - protein, 17 aa, Mycobacterium tuberculosis
GARRATANQFERPAKGA

SEQ ID NO: 1367213 - protein, 6 aa, Mycobacterium tuberculosis
GATRPA

SEQ ID NO: 1367214 - protein, 14 aa, Mycobacterium tuberculosis
GDQIQNATSGMDQR

SEQ ID NO: 1367215 - protein, 29 aa, Mycobacterium tuberculosis
GDTASPVGSSGASGGAIASGSVARVGTAT

SEQ ID NO: 1367216 - protein, 11 aa, Mycobacterium tuberculosis
GEQDKTTNPAS

SEQ ID NO: 1367217 - protein, 6 aa, Mycobacterium tuberculosis
GGTTGP

SEQ ID NO: 1367218 - protein, 13 aa, Mycobacterium tuberculosis
GIPPGTLRRSATG

SEQ ID NO: 1367219 - protein, 13 aa, Mycobacterium tuberculosis
GMGSGTETYLAGP

SEQ ID NO: 1367220 - protein, 5 aa, Mycobacterium tuberculosis
GNDAA

SEQ ID NO: 1367221 - protein, 6 aa, Mycobacterium tuberculosis
GPASTN

SEQ ID NO: 1367222 - protein, 4 aa, Mycobacterium tuberculosis
GPHA

SEQ ID NO: 1367223 - protein, 9 aa, Mycobacterium tuberculosis
GQLQTHDSA

SEQ ID NO: 1367224 - protein, 8 aa, Mycobacterium tuberculosis
GQRRQPDQ

SEQ ID NO: 1367225 - protein, 15 aa, Mycobacterium tuberculosis
GSPAVMGGDTNHRAT

SEQ ID NO: 1367226 - protein, 11 aa, Mycobacterium tuberculosis
GSPENAAGTVE

SEQ ID NO: 1367227 - protein, 4 aa, Mycobacterium tuberculosis
GSTL

SEQ ID NO: 1367228 - protein, 8 aa, Mycobacterium tuberculosis
GVQHAPDS

SEQ ID NO: 1367229 - protein, 4 aa, Mycobacterium tuberculosis
HAGH

SEQ ID NO: 1367230 - protein, 7 aa, Mycobacterium tuberculosis
HANGVTH

SEQ ID NO: 1367231 - protein, 5 aa, Mycobacterium tuberculosis
HGKEG

SEQ ID NO: 1367232 - protein, 10 aa, Mycobacterium tuberculosis
HGVAASESSV

SEQ ID NO: 1367233 - protein, 12 aa, Mycobacterium tuberculosis
HQKTQTAEEIAR

SEQ ID NO: 1367234 - protein, 8 aa, Mycobacterium tuberculosis
HSGATTAS

SEQ ID NO: 1367235 - protein, 10 aa, Mycobacterium tuberculosis
IAPNQDAQAD

SEQ ID NO: 1367236 - protein, 6 aa, Mycobacterium tuberculosis
IDIPSD

SEQ ID NO: 1367237 - protein, 8 aa, Mycobacterium tuberculosis
IEERSGHA

SEQ ID NO: 1367238 - protein, 9 aa, Mycobacterium tuberculosis
KYGSEHGDP

SEQ ID NO: 1367239 - protein, 23 aa, Mycobacterium tuberculosis
LAPDSKTGRPWNSTPEDSNYDPC

SEQ ID NO: 1367240 - protein, 8 aa, Mycobacterium tuberculosis
LATDRYRP

SEQ ID NO: 1367241 - protein, 7 aa, Mycobacterium tuberculosis
LDPATEA

SEQ ID NO: 1367242 - protein, 22 aa, Mycobacterium tuberculosis
LNAPTASTSAASSAPPGSVVKP

SEQ ID NO: 1367243 - protein, 7 aa, Mycobacterium tuberculosis
LPGARDT

SEQ ID NO: 1367244 - protein, 8 aa, Mycobacterium tuberculosis
LPTRATGA

SEQ ID NO: 1367245 - protein, 8 aa, Mycobacterium tuberculosis
LQPDDPRA

SEQ ID NO: 1367246 - protein, 17 aa, Mycobacterium tuberculosis
LSPEQVRDGNADPRSDV

SEQ ID NO: 1367247 - protein, 73 aa, Mycobacterium tuberculosis
LSTGDQPTAPGTPQRPGVTTTAAPPPSPAPASDGPTTEPAPPVQAPATGGPAPPLQQPLPPPPTTTNTQPAVT

SEQ ID NO: 1367248 - protein, 15 aa, Mycobacterium tuberculosis
LTAQQAQSVVDDPDE

SEQ ID NO: 1367249 - protein, 90 aa, Mycobacterium tuberculosis
MAPRQPPAPPVTPPGVQPAPKPSYTPPAQPGPAGQRPGPTGQPSWAPNSGPMPASGPTPTPQYYQGGGWGAPPSGGPSPWAQTPRKTNPW

SEQ ID NO: 1367250 - protein, 23 aa, Mycobacterium tuberculosis
MSTDRNPADRQRVDPQAAARISA

SEQ ID NO: 1367251 - protein, 10 aa, Mycobacterium tuberculosis
NAAPTADQVN

SEQ ID NO: 1367252 - protein, 5 aa, Mycobacterium tuberculosis
NAPTL

SEQ ID NO: 1367253 - protein, 9 aa, Mycobacterium tuberculosis
NDPQNRINR

SEQ ID NO: 1367254 - protein, 8 aa, Mycobacterium tuberculosis
NGPGIPAA

SEQ ID NO: 1367255 - protein, 7 aa, Mycobacterium tuberculosis
NGTSTVG

SEQ ID NO: 1367256 - protein, 14 aa, Mycobacterium tuberculosis
NQAKLTSGALSTAA

SEQ ID NO: 1367257 - protein, 5 aa, Mycobacterium tuberculosis
NQTFR

SEQ ID NO: 1367258 - protein, 8 aa, Mycobacterium tuberculosis
NTGNEEAA

SEQ ID NO: 1367259 - protein, 20 aa, Mycobacterium tuberculosis
NWKGDPNATVPGLGSGQDIP

SEQ ID NO: 1367260 - protein, 5 aa, Mycobacterium tuberculosis
NWTGP

SEQ ID NO: 1367261 - protein, 15 aa, Mycobacterium tuberculosis
PARARKPKDKPRVER

SEQ ID NO: 1367262 - protein, 20 aa, Mycobacterium tuberculosis
PAYQPSDDVDTTPPAPGGSW

SEQ ID NO: 1367263 - protein, 15 aa, Mycobacterium tuberculosis
PDALGGPPGLPAPRG

SEQ ID NO: 1367264 - protein, 5 aa, Mycobacterium tuberculosis
PDPSL

SEQ ID NO: 1367265 - protein, 5 aa, Mycobacterium tuberculosis
PDPVM

SEQ ID NO: 1367266 - protein, 5 aa, Mycobacterium tuberculosis
PERDK

SEQ ID NO: 1367267 - protein, 7 aa, Mycobacterium tuberculosis
PGAPAAM

SEQ ID NO: 1367268 - protein, 9 aa, Mycobacterium tuberculosis
PGGGELGVD

SEQ ID NO: 1367269 - protein, 9 aa, Mycobacterium tuberculosis
PGTRSANRE

SEQ ID NO: 1367270 - protein, 9 aa, Mycobacterium tuberculosis
PGVAATGNL

SEQ ID NO: 1367271 - protein, 7 aa, Mycobacterium tuberculosis
PNPVANN

SEQ ID NO: 1367272 - protein, 8 aa, Mycobacterium tuberculosis
PPSEATTV

SEQ ID NO: 1367273 - protein, 5 aa, Mycobacterium tuberculosis
PPSSN

SEQ ID NO: 1367274 - protein, 8 aa, Mycobacterium tuberculosis
PRTPENAN

SEQ ID NO: 1367275 - protein, 8 aa, Mycobacterium tuberculosis
PTAIRPSY

SEQ ID NO: 1367276 - protein, 9 aa, Mycobacterium tuberculosis
QEDSAAMGE

SEQ ID NO: 1367277 - protein, 12 aa, Mycobacterium tuberculosis
QEVADTSPSPVG

SEQ ID NO: 1367278 - protein, 17 aa, Mycobacterium tuberculosis
QHAGETAFGSATNADEI

SEQ ID NO: 1367279 - protein, 10 aa, Mycobacterium tuberculosis
QKPDSTIPPD

SEQ ID NO: 1367280 - protein, 5 aa, Mycobacterium tuberculosis
QTRVA

SEQ ID NO: 1367281 - protein, 6 aa, Mycobacterium tuberculosis
RALTSN

SEQ ID NO: 1367282 - protein, 6 aa, Mycobacterium tuberculosis
RDRGPV

SEQ ID NO: 1367283 - protein, 4 aa, Mycobacterium tuberculosis
RDVK

SEQ ID NO: 1367284 - protein, 6 aa, Mycobacterium tuberculosis
RGGRRP

SEQ ID NO: 1367285 - protein, 9 aa, Mycobacterium tuberculosis
RIGDDPEAV

SEQ ID NO: 1367286 - protein, 6 aa, Mycobacterium tuberculosis
RLAEGK

SEQ ID NO: 1367287 - protein, 6 aa, Mycobacterium tuberculosis
RLRAES

SEQ ID NO: 1367288 - protein, 10 aa, Mycobacterium tuberculosis
RPERRSGIPA

SEQ ID NO: 1367289 - protein, 36 aa, Mycobacterium tuberculosis
RPGANQAAPATTSAPARPTSPASQVGPCGPDEATAV

SEQ ID NO: 1367290 - protein, 6 aa, Mycobacterium tuberculosis
RPPDVR

SEQ ID NO: 1367291 - protein, 7 aa, Mycobacterium tuberculosis
RPQPQGD

SEQ ID NO: 1367292 - protein, 6 aa, Mycobacterium tuberculosis
RPRTLP

SEQ ID NO: 1367293 - protein, 15 aa, Mycobacterium tuberculosis
RQHQTRVASQRTTPE

SEQ ID NO: 1367294 - protein, 8 aa, Mycobacterium tuberculosis
RQSCDGCQ

SEQ ID NO: 1367295 - protein, 6 aa, Mycobacterium tuberculosis
RRAEQR

SEQ ID NO: 1367296 - protein, 7 aa, Mycobacterium tuberculosis
RVGSPAL

SEQ ID NO: 1367297 - protein, 8 aa, Mycobacterium tuberculosis
SAAEDAAL

SEQ ID NO: 1367298 - protein, 15 aa, Mycobacterium tuberculosis
SAGPGPGSLQAAAAG

SEQ ID NO: 1367299 - protein, 6 aa, Mycobacterium tuberculosis
SATVTT

SEQ ID NO: 1367300 - protein, 7 aa, Mycobacterium tuberculosis
SEFPADR

SEQ ID NO: 1367301 - protein, 8 aa, Mycobacterium tuberculosis
SGLDAAGV

SEQ ID NO: 1367302 - protein, 5 aa, Mycobacterium tuberculosis
SHYPP

SEQ ID NO: 1367303 - protein, 7 aa, Mycobacterium tuberculosis
SITAAGA

SEQ ID NO: 1367304 - protein, 8 aa, Mycobacterium tuberculosis
SPANTVRG

SEQ ID NO: 1367305 - protein, 8 aa, Mycobacterium tuberculosis
SPFNSQPN

SEQ ID NO: 1367306 - protein, 9 aa, Mycobacterium tuberculosis
SPKKSWEGF

SEQ ID NO: 1367307 - protein, 35 aa, Mycobacterium tuberculosis
SQTPTTQPAERIDTSGLPAVGDDATVPRDAPKRTI

SEQ ID NO: 1367308 - protein, 7 aa, Mycobacterium tuberculosis
SRADDSV

SEQ ID NO: 1367309 - protein, 7 aa, Mycobacterium tuberculosis
SREARIR

SEQ ID NO: 1367310 - protein, 9 aa, Mycobacterium tuberculosis
SRTGAGFGR

SEQ ID NO: 1367311 - protein, 22 aa, Mycobacterium tuberculosis
STPLAPPQPGSDAATATNNEPW

SEQ ID NO: 1367312 - protein, 10 aa, Mycobacterium tuberculosis
STSVRDAGAN

SEQ ID NO: 1367313 - protein, 11 aa, Mycobacterium tuberculosis
TAAGETAEPEK

SEQ ID NO: 1367314 - protein, 7 aa, Mycobacterium tuberculosis
TDDNPYP

SEQ ID NO: 1367315 - protein, 5 aa, Mycobacterium tuberculosis
TEYEW

SEQ ID NO: 1367316 - protein, 21 aa, Mycobacterium tuberculosis
TGGAARSIGRARDIEPGHRRD

SEQ ID NO: 1367317 - protein, 12 aa, Mycobacterium tuberculosis
TGVDKPDLYDPQ

SEQ ID NO: 1367318 - protein, 5 aa, Mycobacterium tuberculosis
TPARA

SEQ ID NO: 1367319 - protein, 22 aa, Mycobacterium tuberculosis
TPRPAPPAQQLPSTPPGTQHLP

SEQ ID NO: 1367320 - protein, 6 aa, Mycobacterium tuberculosis
TRRPSR

SEQ ID NO: 1367321 - protein, 8 aa, Mycobacterium tuberculosis
TRSDPSRP

SEQ ID NO: 1367322 - protein, 7 aa, Mycobacterium tuberculosis
TSAAAGL

SEQ ID NO: 1367323 - protein, 5 aa, Mycobacterium tuberculosis
TSDGK

SEQ ID NO: 1367324 - protein, 8 aa, Mycobacterium tuberculosis
TSIPSSAY

SEQ ID NO: 1367325 - protein, 10 aa, Mycobacterium tuberculosis
VAGADATSTV

SEQ ID NO: 1367326 - protein, 11 aa, Mycobacterium tuberculosis
VAGGGTEDAAG

SEQ ID NO: 1367327 - protein, 4 aa, Mycobacterium tuberculosis
VAGT

SEQ ID NO: 1367328 - protein, 4 aa, Mycobacterium tuberculosis
VPQH

SEQ ID NO: 1367329 - protein, 15 aa, Mycobacterium tuberculosis
VPRGPVDAGSEAQID

SEQ ID NO: 1367330 - protein, 9 aa, Mycobacterium tuberculosis
VQTPDDPTF

SEQ ID NO: 1367331 - protein, 5 aa, Mycobacterium tuberculosis
VSQDE

SEQ ID NO: 1367332 - protein, 31 aa, Mycobacterium tuberculosis
VSSSSADATAMPDVAPASAPAAAVDGDPATA

SEQ ID NO: 1367333 - protein, 5 aa, Mycobacterium tuberculosis
WRQAG

SEQ ID NO: 1367334 - protein, 6 aa, Mycobacterium tuberculosis
YEREST

SEQ ID NO: 1367335 - protein, 15 aa, Mycobacterium tuberculosis
AAANGLNRSPSSSSR

SEQ ID NO: 1367336 - protein, 6 aa, Mycobacterium tuberculosis
AAAPLS

SEQ ID NO: 1367337 - protein, 33 aa, Mycobacterium tuberculosis
AAFPPPAGPPPVTAAPAPPVEVPPPMPPPPPVT

SEQ ID NO: 1367338 - protein, 5 aa, Mycobacterium tuberculosis
AAGGA

SEQ ID NO: 1367339 - protein, 13 aa, Mycobacterium tuberculosis
AAHEAVKGTPMAG

SEQ ID NO: 1367340 - protein, 4 aa, Mycobacterium tuberculosis
AARG

SEQ ID NO: 1367341 - protein, 10 aa, Mycobacterium tuberculosis
AASTAQRSGI

SEQ ID NO: 1367342 - protein, 6 aa, Mycobacterium tuberculosis
ADPSVG

SEQ ID NO: 1367343 - protein, 29 aa, Mycobacterium tuberculosis
AGRSVQSPASTPPPTPTPPSAPSAGQTRA

SEQ ID NO: 1367344 - protein, 10 aa, Mycobacterium tuberculosis
AGTATKERRV

SEQ ID NO: 1367345 - protein, 11 aa, Mycobacterium tuberculosis
AGTPLGGPIGG

SEQ ID NO: 1367346 - protein, 17 aa, Mycobacterium tuberculosis
AHGSTLGSRVAGTQPAP

SEQ ID NO: 1367347 - protein, 6 aa, Mycobacterium tuberculosis
AHTDRL

SEQ ID NO: 1367348 - protein, 8 aa, Mycobacterium tuberculosis
ALAGAGAA

SEQ ID NO: 1367349 - protein, 13 aa, Mycobacterium tuberculosis
ALTPNDPRFQPGF

SEQ ID NO: 1367350 - protein, 6 aa, Mycobacterium tuberculosis
ANQLPQ

SEQ ID NO: 1367351 - protein, 5 aa, Mycobacterium tuberculosis
APDGR

SEQ ID NO: 1367352 - protein, 35 aa, Mycobacterium tuberculosis; identical to SEQ ID NO: 149868

SEQ ID NO: 1367353 - protein, 5 aa, Mycobacterium tuberculosis
APPRG

SEQ ID NO: 1367354 - protein, 7 aa, Mycobacterium tuberculosis
ARVGPRQ

SEQ ID NO: 1367355 - protein, 7 aa, Mycobacterium tuberculosis
ASDRGAG

SEQ ID NO: 1367356 - protein, 12 aa, Mycobacterium tuberculosis
ASGRGGQAADIA

SEQ ID NO: 1367357 - protein, 6 aa, Mycobacterium tuberculosis
ASKPPL

SEQ ID NO: 1367358 - protein, 8 aa, Mycobacterium tuberculosis
ASPRRASA

SEQ ID NO: 1367359 - protein, 8 aa, Mycobacterium tuberculosis
ATLTGASI

SEQ ID NO: 1367360 - protein, 13 aa, Mycobacterium tuberculosis
ATTREIKATTSEL

SEQ ID NO: 1367361 - protein, 9 aa, Mycobacterium tuberculosis
AVPPAGNKR

SEQ ID NO: 1367362 - protein, 6 aa, Mycobacterium tuberculosis
AVPTRN

SEQ ID NO: 1367363 - protein, 6 aa, Mycobacterium tuberculosis
DAAANM

SEQ ID NO: 1367364 - protein, 8 aa, Mycobacterium tuberculosis
DDPDAAGH

SEQ ID NO: 1367365 - protein, 12 aa, Mycobacterium tuberculosis
DLTTREPSSLKT

SEQ ID NO: 1367366 - protein, 6 aa, Mycobacterium tuberculosis
DNEYTA

SEQ ID NO: 1367367 - protein, 4 aa, Mycobacterium tuberculosis
DPSA

SEQ ID NO: 1367368 - protein, 7 aa, Mycobacterium tuberculosis
DSAATDI

SEQ ID NO: 1367369 - protein, 12 aa, Mycobacterium tuberculosis
DTLHAASETERA

SEQ ID NO: 1367370 - protein, 5 aa, Mycobacterium tuberculosis
DVPEH

SEQ ID NO: 1367371 - protein, 5 aa, Mycobacterium tuberculosis
EALAD

SEQ ID NO: 1367372 - protein, 23 aa, Mycobacterium tuberculosis
EATGEMSGQADTATTAEARTPAH

SEQ ID NO: 1367373 - protein, 7 aa, Mycobacterium tuberculosis
EELGPRP

SEQ ID NO: 1367374 - protein, 5 aa, Mycobacterium tuberculosis
EGAGG

SEQ ID NO: 1367375 - protein, 74 aa, Mycobacterium tuberculosis; identical to SEQ ID NO: 150830

SEQ ID NO: 1367376 - protein, 10 aa, Mycobacterium tuberculosis
ERGTPPNQRY

SEQ ID NO: 1367377 - protein, 4 aa, Mycobacterium tuberculosis
ETDR

SEQ ID NO: 1367378 - protein, 5 aa, Mycobacterium tuberculosis
ETVDS

SEQ ID NO: 1367379 - protein, 15 aa, Mycobacterium tuberculosis
FSADADGYTRSEGGG

SEQ ID NO: 1367380 - protein, 4 aa, Mycobacterium tuberculosis
FYSN

SEQ ID NO: 1367381 - protein, 5 aa, Mycobacterium tuberculosis
GARGL

SEQ ID NO: 1367382 - protein, 8 aa, Mycobacterium tuberculosis
GDGAKDEV

SEQ ID NO: 1367383 - protein, 6 aa, Mycobacterium tuberculosis
GDSGFL

SEQ ID NO: 1367384 - protein, 9 aa, Mycobacterium tuberculosis
GELSTSDDH

SEQ ID NO: 1367385 - protein, 11 aa, Mycobacterium tuberculosis
GGVNFSGGQRQ

SEQ ID NO: 1367386 - protein, 14 aa, Mycobacterium tuberculosis
GGWGDATSSAKSIA

SEQ ID NO: 1367387 - protein, 7 aa, Mycobacterium tuberculosis
GIPDPGD

SEQ ID NO: 1367388 - protein, 10 aa, Mycobacterium tuberculosis
GLSDGEAAQR

SEQ ID NO: 1367389 - protein, 4 aa, Mycobacterium tuberculosis
GPVS

SEQ ID NO: 1367390 - protein, 9 aa, Mycobacterium tuberculosis
GRPAGREHR

SEQ ID NO: 1367391 - protein, 22 aa, Mycobacterium tuberculosis
GRTVSGAATATTAAAGAVGGAA

SEQ ID NO: 1367392 - protein, 6 aa, Mycobacterium tuberculosis
GRVTRA

SEQ ID NO: 1367393 - protein, 7 aa, Mycobacterium tuberculosis
GTSQADA

SEQ ID NO: 1367394 - protein, 5 aa, Mycobacterium tuberculosis
GVSSR

SEQ ID NO: 1367395 - protein, 11 aa, Mycobacterium tuberculosis
HPRPPSGPSHR

SEQ ID NO: 1367396 - protein, 7 aa, Mycobacterium tuberculosis
IAATGPE

SEQ ID NO: 1367397 - protein, 7 aa, Mycobacterium tuberculosis
IDGPDNS

SEQ ID NO: 1367398 - protein, 4 aa, Mycobacterium tuberculosis
IGPS

SEQ ID NO: 1367399 - protein, 4 aa, Mycobacterium tuberculosis
IGRK

SEQ ID NO: 1367400 - protein, 18 aa, Mycobacterium tuberculosis
ISAARDLADQAVSGRQAG

SEQ ID NO: 1367401 - protein, 7 aa, Mycobacterium tuberculosis
ISSAAGT

SEQ ID NO: 1367402 - protein, 8 aa, Mycobacterium tuberculosis
ITGTSSSI

SEQ ID NO: 1367403 - protein, 13 aa, Mycobacterium tuberculosis
KHGRPFRRRNPRP

SEQ ID NO: 1367404 - protein, 5 aa, Mycobacterium tuberculosis
LAGAQ

SEQ ID NO: 1367405 - protein, 9 aa, Mycobacterium tuberculosis
LAGNDDPKL

SEQ ID NO: 1367406 - protein, 9 aa, Mycobacterium tuberculosis
LGEGPDDLA

SEQ ID NO: 1367407 - protein, 6 aa, Mycobacterium tuberculosis
LGGPTR

SEQ ID NO: 1367408 - protein, 9 aa, Mycobacterium tuberculosis
LGRSSSVDI

SEQ ID NO: 1367409 - protein, 11 aa, Mycobacterium tuberculosis
LGSDAVAGSAQ

SEQ ID NO: 1367410 - protein, 9 aa, Mycobacterium tuberculosis
LGTTGRTVA

SEQ ID NO: 1367411 - protein, 5 aa, Mycobacterium tuberculosis
LPEPE

SEQ ID NO: 1367412 - protein, 7 aa, Mycobacterium tuberculosis
LPSVPRR

SEQ ID NO: 1367413 - protein, 7 aa, Mycobacterium tuberculosis
LSDCDAH

SEQ ID NO: 1367414 - protein, 6 aa, Mycobacterium tuberculosis
LTPDRV

SEQ ID NO: 1367415 - protein, 13 aa, Mycobacterium tuberculosis
NGTPDYGAPARLD

SEQ ID NO: 1367416 - protein, 5 aa, Mycobacterium tuberculosis
NLTAL

SEQ ID NO: 1367417 - protein, 7 aa, Mycobacterium tuberculosis
NSLANGG

SEQ ID NO: 1367418 - protein, 11 aa, Mycobacterium tuberculosis
PADATKRRANL

SEQ ID NO: 1367419 - protein, 7 aa, Mycobacterium tuberculosis
PARTPVM

SEQ ID NO: 1367420 - protein, 74 aa, Mycobacterium tuberculosis
PCPAPRATSPPGRPAPPTTSETTEPNVTSSPASPSPTTSASAPTGTTPAIPTSASPAAPASPPTPWPVTSSPTM

SEQ ID NO: 1367421 - protein, 13 aa, Mycobacterium tuberculosis
PDGPGGQSGLAGG

SEQ ID NO: 1367422 - protein, 11 aa, Mycobacterium tuberculosis
PGANEASNAVA

SEQ ID NO: 1367423 - protein, 21 aa, Mycobacterium tuberculosis
PGDPASPPHGEAEQPLPGPRW

SEQ ID NO: 1367424 - protein, 31 aa, Mycobacterium tuberculosis
PGGWTPNSGGRGGIENGRADPATGQRRNAAT

SEQ ID NO: 1367425 - protein, 6 aa, Mycobacterium tuberculosis
PKTPEF

SEQ ID NO: 1367426 - protein, 5 aa, Mycobacterium tuberculosis
PPGTV

SEQ ID NO: 1367427 - protein, 8 aa, Mycobacterium tuberculosis
PPRSPDRP

SEQ ID NO: 1367428 - protein, 8 aa, Mycobacterium tuberculosis
PRRRTDRR

SEQ ID NO: 1367429 - protein, 14 aa, Mycobacterium tuberculosis
PSAPVAPRVTTEPV

SEQ ID NO: 1367430 - protein, 11 aa, Mycobacterium tuberculosis
QAQTQKARAQR

SEQ ID NO: 1367431 - protein, 7 aa, Mycobacterium tuberculosis
QGNSDSI

SEQ ID NO: 1367432 - protein, 9 aa, Mycobacterium tuberculosis
QHDPAPSVA

SEQ ID NO: 1367433 - protein, 14 aa, Mycobacterium tuberculosis
QLPPLPRATTATTL

SEQ ID NO: 1367434 - protein, 25 aa, Mycobacterium tuberculosis
QNAQLSNCSDGAAQLESCGTAPDLK

SEQ ID NO: 1367435 - protein, 5 aa, Mycobacterium tuberculosis
QRNNG

SEQ ID NO: 1367436 - protein, 23 aa, Mycobacterium tuberculosis
QRSHDRPASLDNPRSPRRRAGMP

SEQ ID NO: 1367437 - protein, 10 aa, Mycobacterium tuberculosis
QSAIGTPTEI

SEQ ID NO: 1367438 - protein, 12 aa, Mycobacterium tuberculosis
RDEHDDATPDVV

SEQ ID NO: 1367439 - protein, 11 aa, Mycobacterium tuberculosis
RDGITDLPDGR

SEQ ID NO: 1367440 - protein, 20 aa, Mycobacterium tuberculosis
RERIGEESPTPAISDLHDHD

SEQ ID NO: 1367441 - protein, 12 aa, Mycobacterium tuberculosis
RGGERDSRTRTS

SEQ ID NO: 1367442 - protein, 12 aa, Mycobacterium tuberculosis
RHATRTATVSAK

SEQ ID NO: 1367443 - protein, 10 aa, Mycobacterium tuberculosis
RLGRDDSEVH

SEQ ID NO: 1367444 - protein, 20 aa, Mycobacterium tuberculosis
RPGATEPSDPALLAKIHANS

SEQ ID NO: 1367445 - protein, 8 aa, Mycobacterium tuberculosis
RTSDQDMA

SEQ ID NO: 1367446 - protein, 5 aa, Mycobacterium tuberculosis
SATAR

SEQ ID NO: 1367447 - protein, 6 aa, Mycobacterium tuberculosis
SDEPYL

SEQ ID NO: 1367448 - protein, 33 aa, Mycobacterium tuberculosis
SDKKEDEEGVAEAERAPIDAGTAASQRGQEGTV

SEQ ID NO: 1367449 - protein, 14 aa, Mycobacterium tuberculosis
SEAAQGPISSPIGA

SEQ ID NO: 1367450 - protein, 22 aa, Mycobacterium tuberculosis
SEADEDSHIGPAPGYTAARPSL

SEQ ID NO: 1367451 - protein, 7 aa, Mycobacterium tuberculosis
SEPQRVD

SEQ ID NO: 1367452 - protein, 4 aa, Mycobacterium tuberculosis
SERI

SEQ ID NO: 1367453 - protein, 42 aa, Mycobacterium tuberculosis
SGYPPAYQPGYPTGYPPPMPPGGYAPPGYPPPGTSSAGYGDI

SEQ ID NO: 1367454 - protein, 7 aa, Mycobacterium tuberculosis
SISDDPN

SEQ ID NO: 1367455 - protein, 6 aa, Mycobacterium tuberculosis
SLPVDK

SEQ ID NO: 1367456 - protein, 7 aa, Mycobacterium tuberculosis
SLSTSLS

SEQ ID NO: 1367457 - protein, 7 aa, Mycobacterium tuberculosis
SPNSVRS

SEQ ID NO: 1367458 - protein, 6 aa, Mycobacterium tuberculosis
SSTNDY

SEQ ID NO: 1367459 - protein, 18 aa, Mycobacterium tuberculosis
TAATAVSATLAKTGVGTG

SEQ ID NO: 1367460 - protein, 6 aa, Mycobacterium tuberculosis
TAATGR

SEQ ID NO: 1367461 - protein, 5 aa, Mycobacterium tuberculosis
TAESR

SEQ ID NO: 1367462 - protein, 7 aa, Mycobacterium tuberculosis
TAGQATA

SEQ ID NO: 1367463 - protein, 13 aa, Mycobacterium tuberculosis
TASGSDQQSLSDR

SEQ ID NO: 1367464 - protein, 13 aa, Mycobacterium tuberculosis
TDEQAAAGHHGGS

SEQ ID NO: 1367465 - protein, 5 aa, Mycobacterium tuberculosis
TDEVA

SEQ ID NO: 1367466 - protein, 5 aa, Mycobacterium tuberculosis
TELGE

SEQ ID NO: 1367467 - protein, 6 aa, Mycobacterium tuberculosis
THAQRV

SEQ ID NO: 1367468 - protein, 8 aa, Mycobacterium tuberculosis
TNAAAGSV

SEQ ID NO: 1367469 - protein, 5 aa, Mycobacterium tuberculosis
TPEAA

SEQ ID NO: 1367470 - protein, 8 aa, Mycobacterium tuberculosis
TPTADPTA

SEQ ID NO: 1367471 - protein, 9 aa, Mycobacterium tuberculosis
TRLPGSQNA

SEQ ID NO: 1367472 - protein, 7 aa, Mycobacterium tuberculosis
TSGTATS

SEQ ID NO: 1367473 - protein, 10 aa, Mycobacterium tuberculosis
TTATASQRYH

SEQ ID NO: 1367474 - protein, 7 aa, Mycobacterium tuberculosis
TVKPGDH

SEQ ID NO: 1367475 - protein, 5 aa, Mycobacterium tuberculosis
TVPAA

SEQ ID NO: 1367476 - protein, 7 aa, Mycobacterium tuberculosis
VAPSAGE

SEQ ID NO: 1367477 - protein, 10 aa, Mycobacterium tuberculosis
VEADREHPTK

SEQ ID NO: 1367478 - protein, 8 aa, Mycobacterium tuberculosis
VFTRPAGG

SEQ ID NO: 1367479 - protein, 5 aa, Mycobacterium tuberculosis
VGAAG

SEQ ID NO: 1367480 - protein, 5 aa, Mycobacterium tuberculosis
VGPGG

SEQ ID NO: 1367481 - protein, 10 aa, Mycobacterium tuberculosis
VNHDGRSNGL

SEQ ID NO: 1367482 - protein, 7 aa, Mycobacterium tuberculosis
VPPYKTA

SEQ ID NO: 1367483 - protein, 9 aa, Mycobacterium tuberculosis
VRAERVSNE

SEQ ID NO: 1367484 - protein, 6 aa, Mycobacterium tuberculosis
VSPGTE

SEQ ID NO: 1367485 - protein, 8 aa, Mycobacterium tuberculosis
WRTGRQAT

SEQ ID NO: 1367486 - protein, 8 aa, Mycobacterium tuberculosis
YDQPATTV

SEQ ID NO: 1367487 - protein, 10 aa, Mycobacterium tuberculosis
YGRPEATTDE

SEQ ID NO: 1367488 - protein, 13 aa, Mycobacterium tuberculosis
YPGIGTKQPRDVP

SEQ ID NO: 1367489 - protein, 20 aa, Mycobacterium tuberculosis
YPPMPPPYGGSPGGYYPEPG

SEQ ID NO: 1367490 - protein, 15 aa, Mycobacterium tuberculosis
AAAERERPQLGGEDR

SEQ ID NO: 1367491 - protein, 5 aa, Mycobacterium tuberculosis
AAASG

SEQ ID NO: 1367492 - protein, 16 aa, Mycobacterium tuberculosis
AAATPSAAESNRGYRA

SEQ ID NO: 1367493 - protein, 10 aa, Mycobacterium tuberculosis
AAGETAEPEK

SEQ ID NO: 1367494 - protein, 13 aa, Mycobacterium tuberculosis
AALTASAGNLGDQ

SEQ ID NO: 1367495 - protein, 8 aa, Mycobacterium tuberculosis
AAVTNTLA

SEQ ID NO: 1367496 - protein, 8 aa, Mycobacterium tuberculosis
ADAAGQLA

SEQ ID NO: 1367497 - protein, 7 aa, Mycobacterium tuberculosis
ADKSHAL

SEQ ID NO: 1367498 - protein, 61 aa, Mycobacterium tuberculosis; identical to SEQ ID NO: 149484

SEQ ID NO: 1367499 - protein, 12 aa, Mycobacterium tuberculosis
AEETDEGTLRPT

SEQ ID NO: 1367500 - protein, 4 aa, Mycobacterium tuberculosis
AGAP

SEQ ID NO: 1367501 - protein, 11 aa, Mycobacterium tuberculosis
AGLDRRATPDQ

SEQ ID NO: 1367502 - protein, 9 aa, Mycobacterium tuberculosis
AGPTRRRID

SEQ ID NO: 1367503 - protein, 10 aa, Mycobacterium tuberculosis
AGTPLGGPIG

SEQ ID NO: 1367504 - protein, 12 aa, Mycobacterium tuberculosis
AHPRPPSGPSHR

SEQ ID NO: 1367505 - protein, 9 aa, Mycobacterium tuberculosis
AKDPTTPAA

SEQ ID NO: 1367506 - protein, 7 aa, Mycobacterium tuberculosis
AMKGQPG

SEQ ID NO: 1367507 - protein, 25 aa, Mycobacterium tuberculosis
APGENIASVSNSGDGALANGLPDAH

SEQ ID NO: 1367508 - protein, 6 aa, Mycobacterium tuberculosis
APLTTE

SEQ ID NO: 1367509 - protein, 7 aa, Mycobacterium tuberculosis
ASHPNGM

SEQ ID NO: 1367510 - protein, 8 aa, Mycobacterium tuberculosis
ASSTAQEN

SEQ ID NO: 1367511 - protein, 11 aa, Mycobacterium tuberculosis
ATGGEYGTSAT

SEQ ID NO: 1367512 - protein, 10 aa, Mycobacterium tuberculosis
ATNGSETGRR

SEQ ID NO: 1367513 - protein, 7 aa, Mycobacterium tuberculosis
AVGGPST

SEQ ID NO: 1367514 - protein, 12 aa, Mycobacterium tuberculosis
AVGPVDDDVTDL

SEQ ID NO: 1367515 - protein, 6 aa, Mycobacterium tuberculosis
AWRPSG

SEQ ID NO: 1367516 - protein, 4 aa, Mycobacterium tuberculosis
AYTG

SEQ ID NO: 1367517 - protein, 25 aa, Mycobacterium tuberculosis
CNPPPQPAGSAPTNLGEQVSRTDMT

SEQ ID NO: 1367518 - protein, 7 aa, Mycobacterium tuberculosis
DAELPDT

SEQ ID NO: 1367519 - protein, 8 aa, Mycobacterium tuberculosis
DATPQVRG

SEQ ID NO: 1367520 - protein, 65 aa, Mycobacterium tuberculosis; identical to SEQ ID NO: 155198

SEQ ID NO: 1367521 - protein, 8 aa, Mycobacterium tuberculosis
DEFGNGPR

SEQ ID NO: 1367522 - protein, 60 aa, Mycobacterium tuberculosis; identical to SEQ ID NO: 155203

SEQ ID NO: 1367523 - protein, 4 aa, Mycobacterium tuberculosis
DLAG

SEQ ID NO: 1367524 - protein, 10 aa, Mycobacterium tuberculosis
DPLPPTPRRE

SEQ ID NO: 1367525 - protein, 9 aa, Mycobacterium tuberculosis
DQLTSRQAT

SEQ ID NO: 1367526 - protein, 9 aa, Mycobacterium tuberculosis
DRRDAAEAA

SEQ ID NO: 1367527 - protein, 5 aa, Mycobacterium tuberculosis
DSGFL

SEQ ID NO: 1367528 - protein, 6 aa, Mycobacterium tuberculosis
DSVSEA

SEQ ID NO: 1367529 - protein, 25 aa, Mycobacterium tuberculosis
DTVASPTVTATADPTEAPLPIEQES

SEQ ID NO: 1367530 - protein, 11 aa, Mycobacterium tuberculosis
DVEADREHPTK

SEQ ID NO: 1367531 - protein, 9 aa, Mycobacterium tuberculosis
DVGQTATSF

SEQ ID NO: 1367532 - protein, 16 aa, Mycobacterium tuberculosis
ENTATARQAIAATGPE

SEQ ID NO: 1367533 - protein, 5 aa, Mycobacterium tuberculosis
ERAEQ

SEQ ID NO: 1367534 - protein, 9 aa, Mycobacterium tuberculosis
GADQATLGS

SEQ ID NO: 1367535 - protein, 9 aa, Mycobacterium tuberculosis
GAPVGPDPL

SEQ ID NO: 1367536 - protein, 4 aa, Mycobacterium tuberculosis
GATP

SEQ ID NO: 1367537 - protein, 10 aa, Mycobacterium tuberculosis
GDQTDVPESG

SEQ ID NO: 1367538 - protein, 4 aa, Mycobacterium tuberculosis
GEFT

SEQ ID NO: 1367539 - protein, 7 aa, Mycobacterium tuberculosis
GELPPGA

SEQ ID NO: 1367540 - protein, 8 aa, Mycobacterium tuberculosis
GEQAAAAA

SEQ ID NO: 1367541 - protein, 6 aa, Mycobacterium tuberculosis
GETDAV

SEQ ID NO: 1367542 - protein, 9 aa, Mycobacterium tuberculosis
GGAFNNDTE

SEQ ID NO: 1367543 - protein, 9 aa, Mycobacterium tuberculosis
GGGANIPAV

SEQ ID NO: 1367544 - protein, 8 aa, Mycobacterium tuberculosis
GGITPGNS

SEQ ID NO: 1367545 - protein, 13 aa, Mycobacterium tuberculosis
GGRKAYDVERRGE

SEQ ID NO: 1367546 - protein, 13 aa, Mycobacterium tuberculosis
GHGTGTTLGDPIE

SEQ ID NO: 1367547 - protein, 7 aa, Mycobacterium tuberculosis
GKLPDSL

SEQ ID NO: 1367548 - protein, 4 aa, Mycobacterium tuberculosis
GLGP

SEQ ID NO: 1367549 - protein, 6 aa, Mycobacterium tuberculosis
GLPQRT

SEQ ID NO: 1367550 - protein, 6 aa, Mycobacterium tuberculosis
GMGPGP

SEQ ID NO: 1367551 - protein, 24 aa, Mycobacterium tuberculosis
GNTGGDCVQNPAPDPSTPGDPRGW

SEQ ID NO: 1367552 - protein, 19 aa, Mycobacterium tuberculosis
GPRAPGSSYGSRENGPPVN

SEQ ID NO: 1367553 - protein, 5 aa, Mycobacterium tuberculosis
GPWGV

SEQ ID NO: 1367554 - protein, 6 aa, Mycobacterium tuberculosis
GQGPTI

SEQ ID NO: 1367555 - protein, 12 aa, Mycobacterium tuberculosis
GRNANDLNRPQF

SEQ ID NO: 1367556 - protein, 9 aa, Mycobacterium tuberculosis
GRPEATTDE

SEQ ID NO: 1367557 - protein, 7 aa, Mycobacterium tuberculosis
GRPGFAE

SEQ ID NO: 1367558 - protein, 13 aa, Mycobacterium tuberculosis
GSEWGDDGAQRAR

SEQ ID NO: 1367559 - protein, 6 aa, Mycobacterium tuberculosis
GSGPGF

SEQ ID NO: 1367560 - protein, 24 aa, Mycobacterium tuberculosis
GSYDYPGVDQPDDGPLSSEGHYSA

SEQ ID NO: 1367561 - protein, 10 aa, Mycobacterium tuberculosis
GTPAQGNYAA

SEQ ID NO: 1367562 - protein, 6 aa, Mycobacterium tuberculosis
GTSQAD

SEQ ID NO: 1367563 - protein, 8 aa, Mycobacterium tuberculosis
GVGPATRD

SEQ ID NO: 1367564 - protein, 7 aa, Mycobacterium tuberculosis
GYGYGPA

SEQ ID NO: 1367565 - protein, 10 aa, Mycobacterium tuberculosis
HKQTAASSNL

SEQ ID NO: 1367566 - protein, 8 aa, Mycobacterium tuberculosis
IDTSEAVD

SEQ ID NO: 1367567 - protein, 7 aa, Mycobacterium tuberculosis
INDAPAL

SEQ ID NO: 1367568 - protein, 6 aa, Mycobacterium tuberculosis
IRNPAG

SEQ ID NO: 1367569 - protein, 6 aa, Mycobacterium tuberculosis
ITGGRA

SEQ ID NO: 1367570 - protein, 8 aa, Mycobacterium tuberculosis
KDPTTPAA

SEQ ID NO: 1367571 - protein, 9 aa, Mycobacterium tuberculosis
KIAASDDTV

SEQ ID NO: 1367572 - protein, 4 aa, Mycobacterium tuberculosis
LAQA

SEQ ID NO: 1367573 - protein, 7 aa, Mycobacterium tuberculosis
LGGTLRQ

SEQ ID NO: 1367574 - protein, 10 aa, Mycobacterium tuberculosis
LQDDGTQPAY

SEQ ID NO: 1367575 - protein, 6 aa, Mycobacterium tuberculosis
LQGSAG

SEQ ID NO: 1367576 - protein, 8 aa, Mycobacterium tuberculosis
LSPNSVRS

SEQ ID NO: 1367577 - protein, 4 aa, Mycobacterium tuberculosis
NGHA

SEQ ID NO: 1367578 - protein, 4 aa, Mycobacterium tuberculosis
PEPE

SEQ ID NO: 1367579 - protein, 27 aa, Mycobacterium tuberculosis
PETWRRRKRRQSQKIRRSVQKQRRSTV

SEQ ID NO: 1367580 - protein, 4 aa, Mycobacterium tuberculosis
PGAT

SEQ ID NO: 1367581 - protein, 12 aa, Mycobacterium tuberculosis
PLDDGASGSLDE

SEQ ID NO: 1367582 - protein, 24 aa, Mycobacterium tuberculosis
PLGEQPEPERSRVPPRTTRAGERI

SEQ ID NO: 1367583 - protein, 14 aa, Mycobacterium tuberculosis
PPKTPSPKPLSPNA

SEQ ID NO: 1367584 - protein, 5 aa, Mycobacterium tuberculosis
PPPCT

SEQ ID NO: 1367585 - protein, 5 aa, Mycobacterium tuberculosis
PQNGT

SEQ ID NO: 1367586 - protein, 23 aa, Mycobacterium tuberculosis
PRPGTSPGVGGTPASPAPEAPAV

SEQ ID NO: 1367587 - protein, 5 aa, Mycobacterium tuberculosis
PRPPW

SEQ ID NO: 1367588 - protein, 24 aa, Mycobacterium tuberculosis
PVDPGDPASPPHGEAEQPLPGPRW

SEQ ID NO: 1367589 - protein, 6 aa, Mycobacterium tuberculosis
QARAGA

SEQ ID NO: 1367590 - protein, 9 aa, Mycobacterium tuberculosis
QDDGTQPAY

SEQ ID NO: 1367591 - protein, 5 aa, Mycobacterium tuberculosis
QLDPA

SEQ ID NO: 1367592 - protein, 16 aa, Mycobacterium tuberculosis
QNPAPDPSTPGDPRGW

SEQ ID NO: 1367593 - protein, 16 aa, Mycobacterium tuberculosis
QSPEGQASSLESIGRS

SEQ ID NO: 1367594 - protein, 4 aa, Mycobacterium tuberculosis
RDPL

SEQ ID NO: 1367595 - protein, 12 aa, Mycobacterium tuberculosis
REVTSAISKSHS

SEQ ID NO: 1367596 - protein, 7 aa, Mycobacterium tuberculosis
RFPDPKD

SEQ ID NO: 1367597 - protein, 7 aa, Mycobacterium tuberculosis
RKEFGPA

SEQ ID NO: 1367598 - protein, 9 aa, Mycobacterium tuberculosis
RLPVDNPAT

SEQ ID NO: 1367599 - protein, 10 aa, Mycobacterium tuberculosis
RLTMPNTPEM

SEQ ID NO: 1367600 - protein, 6 aa, Mycobacterium tuberculosis
RQDGYG

SEQ ID NO: 1367601 - protein, 6 aa, Mycobacterium tuberculosis
RQRNNG

SEQ ID NO: 1367602 - protein, 4 aa, Mycobacterium tuberculosis
RQSR

SEQ ID NO: 1367603 - protein, 17 aa, Mycobacterium tuberculosis
RRGRARSVTGIAPAGGW

SEQ ID NO: 1367604 - protein, 27 aa, Mycobacterium tuberculosis
RSYQPSEPSGPAEPVNRYERRGARYQP

SEQ ID NO: 1367605 - protein, 7 aa, Mycobacterium tuberculosis
RTTTPYT

SEQ ID NO: 1367606 - protein, 15 aa, Mycobacterium tuberculosis
SAASSAASSSFPDPT

SEQ ID NO: 1367607 - protein, 26 aa, Mycobacterium tuberculosis
SADATPAAVQASASLQQARNARTALD

SEQ ID NO: 1367608 - protein, 5 aa, Mycobacterium tuberculosis
SDATG

SEQ ID NO: 1367609 - protein, 5 aa, Mycobacterium tuberculosis
SDPSA

SEQ ID NO: 1367610 - protein, 5 aa, Mycobacterium tuberculosis
SEIHS

SEQ ID NO: 1367611 - protein, 9 aa, Mycobacterium tuberculosis
SGRAPSGAL

SEQ ID NO: 1367612 - protein, 16 aa, Mycobacterium tuberculosis
SGRAPSGALAVGGPST

SEQ ID NO: 1367613 - protein, 8 aa, Mycobacterium tuberculosis
SHTAMTPR

SEQ ID NO: 1367614 - protein, 7 aa, Mycobacterium tuberculosis
SPKTPEF

SEQ ID NO: 1367615 - protein, 8 aa, Mycobacterium tuberculosis
SPTPRPAS

SEQ ID NO: 1367616 - protein, 7 aa, Mycobacterium tuberculosis
SQSAPGV

SEQ ID NO: 1367617 - protein, 7 aa, Mycobacterium tuberculosis
SSTAQEN

SEQ ID NO: 1367618 - protein, 13 aa, Mycobacterium tuberculosis
STADNTGDQRIPK

SEQ ID NO: 1367619 - protein, 20 aa, Mycobacterium tuberculosis
STIDGSTGRRGAARSGYADP

SEQ ID NO: 1367620 - protein, 8 aa, Mycobacterium tuberculosis
TAMKGQPG

SEQ ID NO: 1367621 - protein, 56 aa, Mycobacterium tuberculosis; identical to SEQ ID NO: 155859

SEQ ID NO: 1367622 - protein, 6 aa, Mycobacterium tuberculosis
TETDDR

SEQ ID NO: 1367623 - protein, 21 aa, Mycobacterium tuberculosis
TNPWRGPPIPYGTEVTDGRNI

SEQ ID NO: 1367624 - protein, 39 aa, Mycobacterium tuberculosis
TPAPTTPASAPPATTQPPATTQPPATTSPSPPPIPPIPP

SEQ ID NO: 1367625 - protein, 5 aa, Mycobacterium tuberculosis
TRDAV

SEQ ID NO: 1367626 - protein, 5 aa, Mycobacterium tuberculosis
TSDYS

SEQ ID NO: 1367627 - protein, 6 aa, Mycobacterium tuberculosis
TTIATS

SEQ ID NO: 1367628 - protein, 12 aa, Mycobacterium tuberculosis
TTREIKATTSEL

SEQ ID NO: 1367629 - protein, 13 aa, Mycobacterium tuberculosis
VAATPSTPPAPQI

SEQ ID NO: 1367630 - protein, 15 aa, Mycobacterium tuberculosis
VDASPRVPAEPGGDF

SEQ ID NO: 1367631 - protein, 9 aa, Mycobacterium tuberculosis
VENTRDREY

SEQ ID NO: 1367632 - protein, 6 aa, Mycobacterium tuberculosis
VGGDLG

SEQ ID NO: 1367633 - protein, 4 aa, Mycobacterium tuberculosis
VPEH

SEQ ID NO: 1367634 - protein, 15 aa, Mycobacterium tuberculosis
VSPAGSGKSTTIPLS

SEQ ID NO: 1367635 - protein, 7 aa, Mycobacterium tuberculosis
VSPGTEL

SEQ ID NO: 1367636 - protein, 4 aa, Mycobacterium tuberculosis
YKTS

SEQ ID NO: 1367637 - protein, 10 aa, Mycobacterium tuberculosis
AAASAAPQPF

SEQ ID NO: 1367638 - protein, 6 aa, Mycobacterium tuberculosis
AADTAV

SEQ ID NO: 1367639 - protein, 14 aa, Mycobacterium tuberculosis
AANGLNRSPSSSSR

SEQ ID NO: 1367640 - protein, 17 aa, Mycobacterium tuberculosis
AAPDTVEGDSHTAMTPR

SEQ ID NO: 1367641 - protein, 5 aa, Mycobacterium tuberculosis
AAPLS

SEQ ID NO: 1367642 - protein, 11 aa, Mycobacterium tuberculosis
AASTAQRSGIK

SEQ ID NO: 1367643 - protein, 7 aa, Mycobacterium tuberculosis
ADAAANM

SEQ ID NO: 1367644 - protein, 4 aa, Mycobacterium tuberculosis
AGAQ

SEQ ID NO: 1367645 - protein, 5 aa, Mycobacterium tuberculosis
AGGRF

SEQ ID NO: 1367646 - protein, 6 aa, Mycobacterium tuberculosis
AGLPPG

SEQ ID NO: 1367647 - protein, 8 aa, Mycobacterium tuberculosis
AGNDDPKL

SEQ ID NO: 1367648 - protein, 12 aa, Mycobacterium tuberculosis
AHTRRSGRQAAH

SEQ ID NO: 1367649 - protein, 7 aa, Mycobacterium tuberculosis
AKSAAES

SEQ ID NO: 1367650 - protein, 8 aa, Mycobacterium tuberculosis
ALSADGRC

SEQ ID NO: 1367651 - protein, 9 aa, Mycobacterium tuberculosis
ANLTGPAAT

SEQ ID NO: 1367652 - protein, 8 aa, Mycobacterium tuberculosis
APFAAGAG

SEQ ID NO: 1367653 - protein, 17 aa, Mycobacterium tuberculosis
APVTAGPVGGTAEVPTP

SEQ ID NO: 1367654 - protein, 4 aa, Mycobacterium tuberculosis
AQLT

SEQ ID NO: 1367655 - protein, 5 aa, Mycobacterium tuberculosis
AQPLG

SEQ ID NO: 1367656 - protein, 10 aa, Mycobacterium tuberculosis
AQTQKARAQR

SEQ ID NO: 1367657 - protein, 8 aa, Mycobacterium tuberculosis
ARRDGAPP

SEQ ID NO: 1367658 - protein, 6 aa, Mycobacterium tuberculosis
ASDRGA

SEQ ID NO: 1367659 - protein, 9 aa, Mycobacterium tuberculosis
ASPANTVRG

SEQ ID NO: 1367660 - protein, 16 aa, Mycobacterium tuberculosis
ASQAGSDAGASPEHKH

SEQ ID NO: 1367661 - protein, 13 aa, Mycobacterium tuberculosis
ATANQFERPAKGA

SEQ ID NO: 1367662 - protein, 4 aa, Mycobacterium tuberculosis
ATAR

SEQ ID NO: 1367663 - protein, 4 aa, Mycobacterium tuberculosis
ATPE

SEQ ID NO: 1367664 - protein, 6 aa, Mycobacterium tuberculosis
AVGGEL

SEQ ID NO: 1367665 - protein, 4 aa, Mycobacterium tuberculosis
AWDP

SEQ ID NO: 1367666 - protein, 8 aa, Mycobacterium tuberculosis
DAEPAQAE

SEQ ID NO: 1367667 - protein, 6 aa, Mycobacterium tuberculosis
DAPPRG

SEQ ID NO: 1367668 - protein, 6 aa, Mycobacterium tuberculosis
DARTEQ

SEQ ID NO: 1367669 - protein, 7 aa, Mycobacterium tuberculosis
DDPDAAG

SEQ ID NO: 1367670 - protein, 4 aa, Mycobacterium tuberculosis
DEPP

SEQ ID NO: 1367671 - protein, 6 aa, Mycobacterium tuberculosis
DGPDNS

SEQ ID NO: 1367672 - protein, 5 aa, Mycobacterium tuberculosis
DMRNP

SEQ ID NO: 1367673 - protein, 5 aa, Mycobacterium tuberculosis
DRGPV

SEQ ID NO: 1367674 - protein, 4 aa, Mycobacterium tuberculosis
DRNR

SEQ ID NO: 1367675 - protein, 10 aa, Mycobacterium tuberculosis
DSARPNTELE

SEQ ID NO: 1367676 - protein, 7 aa, Mycobacterium tuberculosis
DSEQIRT

SEQ ID NO: 1367677 - protein, 12 aa, Mycobacterium tuberculosis
EAGTTQAAESLD

SEQ ID NO: 1367678 - protein, 12 aa, Mycobacterium tuberculosis
EEHTPSRADQRN

SEQ ID NO: 1367679 - protein, 11 aa, Mycobacterium tuberculosis
ELASANSTSGH

SEQ ID NO: 1367680 - protein, 4 aa, Mycobacterium tuberculosis
ELGE

SEQ ID NO: 1367681 - protein, 16 aa, Mycobacterium tuberculosis
EQAPEPDPDELPATGA

SEQ ID NO: 1367682 - protein, 9 aa, Mycobacterium tuberculosis
ERGTPPNQR

SEQ ID NO: 1367683 - protein, 6 aa, Mycobacterium tuberculosis
ERRGQP

SEQ ID NO: 1367684 - protein, 16 aa, Mycobacterium tuberculosis
ESAAHHPLPDPGESVP

SEQ ID NO: 1367685 - protein, 8 aa, Mycobacterium tuberculosis
ESAPAQMP

SEQ ID NO: 1367686 - protein, 11 aa, Mycobacterium tuberculosis
ETAGNQIRDAK

SEQ ID NO: 1367687 - protein, 6 aa, Mycobacterium tuberculosis
FGDGAP

SEQ ID NO: 1367688 - protein, 4 aa, Mycobacterium tuberculosis
FKGP

SEQ ID NO: 1367689 - protein, 9 aa, Mycobacterium tuberculosis
GAAAGAPAA

SEQ ID NO: 1367690 - protein, 5 aa, Mycobacterium tuberculosis
GAAGN

SEQ ID NO: 1367691 - protein, 15 aa, Mycobacterium tuberculosis
GAGGTPNAPSNGTAS

SEQ ID NO: 1367692 - protein, 10 aa, Mycobacterium tuberculosis
GAPQTGKSTA

SEQ ID NO: 1367693 - protein, 4 aa, Mycobacterium tuberculosis
GARG

SEQ ID NO: 1367694 - protein, 5 aa, Mycobacterium tuberculosis
GEMSR

SEQ ID NO: 1367695 - protein, 4 aa, Mycobacterium tuberculosis
GEQQ

SEQ ID NO: 1367696 - protein, 10 aa, Mycobacterium tuberculosis
GERDRARMTQ

SEQ ID NO: 1367697 - protein, 9 aa, Mycobacterium tuberculosis
GGPQAVADA

SEQ ID NO: 1367698 - protein, 5 aa, Mycobacterium tuberculosis
GGPTR

SEQ ID NO: 1367699 - protein, 6 aa, Mycobacterium tuberculosis
GGTLRQ

SEQ ID NO: 1367700 - protein, 7 aa, Mycobacterium tuberculosis
GGTTGPV

SEQ ID NO: 1367701 - protein, 4 aa, Mycobacterium tuberculosis
GKEG

SEQ ID NO: 1367702 - protein, 7 aa, Mycobacterium tuberculosis
GLPQRTA

SEQ ID NO: 1367703 - protein, 12 aa, Mycobacterium tuberculosis
GMGSGTETYLAG

SEQ ID NO: 1367704 - protein, 10 aa, Mycobacterium tuberculosis
GQHDPAPSVA

SEQ ID NO: 1367705 - protein, 7 aa, Mycobacterium tuberculosis
GRAQPQL

SEQ ID NO: 1367706 - protein, 10 aa, Mycobacterium tuberculosis
GSPENAAGTV

SEQ ID NO: 1367707 - protein, 5 aa, Mycobacterium tuberculosis
GSTLT

SEQ ID NO: 1367708 - protein, 22 aa, Mycobacterium tuberculosis
GSYDYPGVDQPDDGPLSSEGHY

SEQ ID NO: 1367709 - protein, 6 aa, Mycobacterium tuberculosis
GTAPIR

SEQ ID NO: 1367710 - protein, 9 aa, Mycobacterium tuberculosis
GTSIPSSAY

SEQ ID NO: 1367711 - protein, 8 aa, Mycobacterium tuberculosis
GVAATGNL

SEQ ID NO: 1367712 - protein, 18 aa, Mycobacterium tuberculosis
GVPARNEPPSDPSAPIPG

SEQ ID NO: 1367713 - protein, 13 aa, Mycobacterium tuberculosis
GWGDATSSAKSIA

SEQ ID NO: 1367714 - protein, 8 aa, Mycobacterium tuberculosis
HASTEYAL

SEQ ID NO: 1367715 - protein, 4 aa, Mycobacterium tuberculosis
HDAG

SEQ ID NO: 1367716 - protein, 4 aa, Mycobacterium tuberculosis
HGPA

SEQ ID NO: 1367717 - protein, 7 aa, Mycobacterium tuberculosis
IGTEATA

SEQ ID NO: 1367718 - protein, 8 aa, Mycobacterium tuberculosis
IKPTSPTC

SEQ ID NO: 1367719 - protein, 10 aa, Mycobacterium tuberculosis
ISPKKSWEGF

SEQ ID NO: 1367720 - protein, 9 aa, Mycobacterium tuberculosis
KELNEESNF

SEQ ID NO: 1367721 - protein, 11 aa, Mycobacterium tuberculosis
KNTPNSRGTIG

SEQ ID NO: 1367722 - protein, 6 aa, Mycobacterium tuberculosis
KQDEVS

SEQ ID NO: 1367723 - protein, 24 aa, Mycobacterium tuberculosis
KRGAWTPPTVASPTAMGSALETGQ

SEQ ID NO: 1367724 - protein, 15 aa, Mycobacterium tuberculosis
KRGEGKGANDLLPPG

SEQ ID NO: 1367725 - protein, 5 aa, Mycobacterium tuberculosis
LEDTI

SEQ ID NO: 1367726 - protein, 4 aa, Mycobacterium tuberculosis
LGAT

SEQ ID NO: 1367727 - protein, 6 aa, Mycobacterium tuberculosis
LPGARD

SEQ ID NO: 1367728 - protein, 11 aa, Mycobacterium tuberculosis
LPPAQRADPVT

SEQ ID NO: 1367729 - protein, 18 aa, Mycobacterium tuberculosis
LPQPPHTPALSRPAGSPR

SEQ ID NO: 1367730 - protein, 9 aa, Mycobacterium tuberculosis
LRRASPSAV

SEQ ID NO: 1367731 - protein, 8 aa, Mycobacterium tuberculosis
LTSGTATS

SEQ ID NO: 1367732 - protein, 8 aa, Mycobacterium tuberculosis
NAGMQPSE

SEQ ID NO: 1367733 - protein, 5 aa, Mycobacterium tuberculosis
NAGRH

SEQ ID NO: 1367734 - protein, 9 aa, Mycobacterium tuberculosis
NDRKERLDR

SEQ ID NO: 1367735 - protein, 7 aa, Mycobacterium tuberculosis
NECGKTA

SEQ ID NO: 1367736 - protein, 7 aa, Mycobacterium tuberculosis
NGPGIPA

SEQ ID NO: 1367737 - protein, 6 aa, Mycobacterium tuberculosis
NRRDEA

SEQ ID NO: 1367738 - protein, 4 aa, Mycobacterium tuberculosis
NSPE

SEQ ID NO: 1367739 - protein, 16 aa, Mycobacterium tuberculosis
PGLSQPSDVLPADDGA

SEQ ID NO: 1367740 - protein, 6 aa, Mycobacterium tuberculosis
PQNGTF

SEQ ID NO: 1367741 - protein, 7 aa, Mycobacterium tuberculosis
PRTPENA

SEQ ID NO: 1367742 - protein, 15 aa, Mycobacterium tuberculosis
PSAPVAPRVTTEPVT

SEQ ID NO: 1367743 - protein, 18 aa, Mycobacterium tuberculosis
PTMPEAEDIGNEAAGGRF

SEQ ID NO: 1367744 - protein, 5 aa, Mycobacterium tuberculosis
QARAG

SEQ ID NO: 1367745 - protein, 6 aa, Mycobacterium tuberculosis
QATASF

SEQ ID NO: 1367746 - protein, 4 aa, Mycobacterium tuberculosis
QEST

SEQ ID NO: 1367747 - protein, 9 aa, Mycobacterium tuberculosis
QKPDSTIPP

SEQ ID NO: 1367748 - protein, 5 aa, Mycobacterium tuberculosis
QLEPQ

SEQ ID NO: 1367749 - protein, 9 aa, Mycobacterium tuberculosis
QLPNTPGAG

SEQ ID NO: 1367750 - protein, 4 aa, Mycobacterium tuberculosis
QPAY

SEQ ID NO: 1367751 - protein, 7 aa, Mycobacterium tuberculosis
QRGQLGS

SEQ ID NO: 1367752 - protein, 5 aa, Mycobacterium tuberculosis
QVTST

SEQ ID NO: 1367753 - protein, 7 aa, Mycobacterium tuberculosis
RESAAGV

SEQ ID NO: 1367754 - protein, 9 aa, Mycobacterium tuberculosis
RGRPADRPA

SEQ ID NO: 1367755 - protein, 13 aa, Mycobacterium tuberculosis
RGRRGDFGGLKGK

SEQ ID NO: 1367756 - protein, 8 aa, Mycobacterium tuberculosis
RIGDDPEA

SEQ ID NO: 1367757 - protein, 6 aa, Mycobacterium tuberculosis
RLDEGR

SEQ ID NO: 1367758 - protein, 8 aa, Mycobacterium tuberculosis
RLPVDNPA

SEQ ID NO: 1367759 - protein, 5 aa, Mycobacterium tuberculosis
RNAQA

SEQ ID NO: 1367760 - protein, 6 aa, Mycobacterium tuberculosis
RNAQAI

SEQ ID NO: 1367761 - protein, 8 aa, Mycobacterium tuberculosis
RPQPQGDL

SEQ ID NO: 1367762 - protein, 12 aa, Mycobacterium tuberculosis
RTREATKQAQTL

SEQ ID NO: 1367763 - protein, 13 aa, Mycobacterium tuberculosis
RTREATKQAQTLT

SEQ ID NO: 1367764 - protein, 12 aa, Mycobacterium tuberculosis
RYGRPRLSRRAR

SEQ ID NO: 1367765 - protein, 6 aa, Mycobacterium tuberculosis
SAATDI

SEQ ID NO: 1367766 - protein, 25 aa, Mycobacterium tuberculosis
SADATPAAVQASASLQQARNARTAL

SEQ ID NO: 1367767 - protein, 4 aa, Mycobacterium tuberculosis
SAPL

SEQ ID NO: 1367768 - protein, 5 aa, Mycobacterium tuberculosis
SAPRL

SEQ ID NO: 1367769 - protein, 10 aa, Mycobacterium tuberculosis
SAQPGARYTS

SEQ ID NO: 1367770 - protein, 7 aa, Mycobacterium tuberculosis
SATVTTR

SEQ ID NO: 1367771 - protein, 9 aa, Mycobacterium tuberculosis
SDLPYPEGV

SEQ ID NO: 1367772 - protein, 4 aa, Mycobacterium tuberculosis
SERQ

SEQ ID NO: 1367773 - protein, 6 aa, Mycobacterium tuberculosis
SESHAT

SEQ ID NO: 1367774 - protein, 6 aa, Mycobacterium tuberculosis
SESPRM

SEQ ID NO: 1367775 - protein, 6 aa, Mycobacterium tuberculosis
SLSTSL

SEQ ID NO: 1367776 - protein, 16 aa, Mycobacterium tuberculosis
SPEQVRDGNADPRSDV

SEQ ID NO: 1367777 - protein, 9 aa, Mycobacterium tuberculosis
SPFNSQPNC

SEQ ID NO: 1367778 - protein, 7 aa, Mycobacterium tuberculosis
SPRRASA

SEQ ID NO: 1367779 - protein, 34 aa, Mycobacterium tuberculosis; identical to SEQ ID NO: 154165

SEQ ID NO: 1367780 - protein, 14 aa, Mycobacterium tuberculosis
SREAARRTLNRPGF

SEQ ID NO: 1367781 - protein, 8 aa, Mycobacterium tuberculosis
SRTGAGFG

SEQ ID NO: 1367782 - protein, 9 aa, Mycobacterium tuberculosis
SSPAALGAK

SEQ ID NO: 1367783 - protein, 4 aa, Mycobacterium tuberculosis
SSQL

SEQ ID NO: 1367784 - protein, 15 aa, Mycobacterium tuberculosis
STRSVSNAIASGAQV

SEQ ID NO: 1367785 - protein, 7 aa, Mycobacterium tuberculosis
SVNQVGR

SEQ ID NO: 1367786 - protein, 16 aa, Mycobacterium tuberculosis
SYQPSEPSGPAEPVNR

SEQ ID NO: 1367787 - protein, 4 aa, Mycobacterium tuberculosis
TACS

SEQ ID NO: 1367788 - protein, 9 aa, Mycobacterium tuberculosis
TAERGNGAI

SEQ ID NO: 1367789 - protein, 11 aa, Mycobacterium tuberculosis
TDVAAGQALQA

SEQ ID NO: 1367790 - protein, 4 aa, Mycobacterium tuberculosis
TGAD

SEQ ID NO: 1367791 - protein, 8 aa, Mycobacterium tuberculosis
TGELPPGA

SEQ ID NO: 1367792 - protein, 6 aa, Mycobacterium tuberculosis
TGRGRR

SEQ ID NO: 1367793 - protein, 5 aa, Mycobacterium tuberculosis
THAQR

SEQ ID NO: 1367794 - protein, 15 aa, Mycobacterium tuberculosis
TLSPRTGRRPETPAY

SEQ ID NO: 1367795 - protein, 6 aa, Mycobacterium tuberculosis
TSAAAG

SEQ ID NO: 1367796 - protein, 6 aa, Mycobacterium tuberculosis
TSDGKY

SEQ ID NO: 1367797 - protein, 6 aa, Mycobacterium tuberculosis
TSGGVA

SEQ ID NO: 1367798 - protein, 10 aa, Mycobacterium tuberculosis
TSQAGESITA

SEQ ID NO: 1367799 - protein, 9 aa, Mycobacterium tuberculosis
VAPTSSSVA

SEQ ID NO: 1367800 - protein, 7 aa, Mycobacterium tuberculosis
VTPDGTA

SEQ ID NO: 1367801 - protein, 25 aa, Mycobacterium tuberculosis
VVGSAHGGHGHDASEFTVGGGASGT

SEQ ID NO: 1367802 - protein, 6 aa, Mycobacterium tuberculosis
WRQAGE

SEQ ID NO: 1367803 - protein, 4 aa, Mycobacterium tuberculosis
WTGP

SEQ ID NO: 1367804 - protein, 10 aa, Mycobacterium tuberculosis
YERRGARYQP

SEQ ID NO: 1367805 - protein, 8 aa, Mycobacterium tuberculosis
YGQRPADR

SEQ ID NO: 1367806 - protein, 6 aa, Mycobacterium tuberculosis
YPRTAA

SEQ ID NO: 1367807 - protein, 9 aa, Mycobacterium tuberculosis
AAGTDYADL

SEQ ID NO: 1367808 - protein, 12 aa, Mycobacterium tuberculosis
AAHEAVKGTPMA

SEQ ID NO: 1367809 - protein, 6 aa, Mycobacterium tuberculosis
ADELST

SEQ ID NO: 1367810 - protein, 4 aa, Mycobacterium tuberculosis
ADID

SEQ ID NO: 1367811 - protein, 12 aa, Mycobacterium tuberculosis
AEAQDELAEVSS

SEQ ID NO: 1367812 - protein, 21 aa, Mycobacterium tuberculosis
AEAVADAAQLSSLADETPEGR

SEQ ID NO: 1367813 - protein, 10 aa, Mycobacterium tuberculosis
AEYASTAAEL

SEQ ID NO: 1367814 - protein, 7 aa, Mycobacterium tuberculosis
AGASSGV

SEQ ID NO: 1367815 - protein, 15 aa, Mycobacterium tuberculosis
AGGVGPGGETPVGST

SEQ ID NO: 1367816 - protein, 4 aa, Mycobacterium tuberculosis
AHAG

SEQ ID NO: 1367817 - protein, 8 aa, Mycobacterium tuberculosis
ANGTSTVG

SEQ ID NO: 1367818 - protein, 6 aa, Mycobacterium tuberculosis
APGATP

SEQ ID NO: 1367819 - protein, 7 aa, Mycobacterium tuberculosis
AQAEHPG

SEQ ID NO: 1367820 - protein, 10 aa, Mycobacterium tuberculosis
ARDPLTGGQS

SEQ ID NO: 1367821 - protein, 12 aa, Mycobacterium tuberculosis
ASATSGVSGLPN

SEQ ID NO: 1367822 - protein, 10 aa, Mycobacterium tuberculosis
ASPHRRPPGS

SEQ ID NO: 1367823 - protein, 8 aa, Mycobacterium tuberculosis
ATGSGKSE

SEQ ID NO: 1367824 - protein, 4 aa, Mycobacterium tuberculosis
AVGA

SEQ ID NO: 1367825 - protein, 12 aa, Mycobacterium tuberculosis
AWTTGNKRGQAH

SEQ ID NO: 1367826 - protein, 12 aa, Mycobacterium tuberculosis
DEQAAAGHHGGS

SEQ ID NO: 1367827 - protein, 7 aa, Mycobacterium tuberculosis
DERTGDL

SEQ ID NO: 1367828 - protein, 10 aa, Mycobacterium tuberculosis
DKELNEESNF

SEQ ID NO: 1367829 - protein, 13 aa, Mycobacterium tuberculosis
DQIQNATSGMDQR

SEQ ID NO: 1367830 - protein, 9 aa, Mycobacterium tuberculosis
DQTDVPESG

SEQ ID NO: 1367831 - protein, 6 aa, Mycobacterium tuberculosis
DRPEEP

SEQ ID NO: 1367832 - protein, 7 aa, Mycobacterium tuberculosis
DRRGRRA

SEQ ID NO: 1367833 - protein, 15 aa, Mycobacterium tuberculosis
DRYGGGTARRLERTG

SEQ ID NO: 1367834 - protein, 12 aa, Mycobacterium tuberculosis
DTPVARETDYGR

SEQ ID NO: 1367835 - protein, 13 aa, Mycobacterium tuberculosis
DTPVARETDYGRV

SEQ ID NO: 1367836 - protein, 13 aa, Mycobacterium tuberculosis
EAAQGPISSPIGA

SEQ ID NO: 1367837 - protein, 21 aa, Mycobacterium tuberculosis
EADEDSHIGPAPGYTAARPSL

SEQ ID NO: 1367838 - protein, 4 aa, Mycobacterium tuberculosis
EDSR

SEQ ID NO: 1367839 - protein, 8 aa, Mycobacterium tuberculosis
EHPADRTA

SEQ ID NO: 1367840 - protein, 11 aa, Mycobacterium tuberculosis
ELAEGSDRDEA

SEQ ID NO: 1367841 - protein, 6 aa, Mycobacterium tuberculosis
EQRAEC

SEQ ID NO: 1367842 - protein, 8 aa, Mycobacterium tuberculosis
ERAEQTAD

SEQ ID NO: 1367843 - protein, 10 aa, Mycobacterium tuberculosis
ERRAKQAKRR

SEQ ID NO: 1367844 - protein, 11 aa, Mycobacterium tuberculosis
EVADTSPSPVG

SEQ ID NO: 1367845 - protein, 15 aa, Mycobacterium tuberculosis
GAGDEQLVQVAWSPP

SEQ ID NO: 1367846 - protein, 5 aa, Mycobacterium tuberculosis
GARRQ

SEQ ID NO: 1367847 - protein, 7 aa, Mycobacterium tuberculosis
GDPSYRT

SEQ ID NO: 1367848 - protein, 6 aa, Mycobacterium tuberculosis
GDTIGR

SEQ ID NO: 1367849 - protein, 8 aa, Mycobacterium tuberculosis
GGPQAVAD

SEQ ID NO: 1367850 - protein, 5 aa, Mycobacterium tuberculosis
GGTFE

SEQ ID NO: 1367851 - protein, 30 aa, Mycobacterium tuberculosis; identical to SEQ ID NO: 155247

SEQ ID NO: 1367852 - protein, 8 aa, Mycobacterium tuberculosis
GLQPGGPV

SEQ ID NO: 1367853 - protein, 4 aa, Mycobacterium tuberculosis
GPSA

SEQ ID NO: 1367854 - protein, 23 aa, Mycobacterium tuberculosis
GQVSTIDGSTGRRGAARSGYADP

SEQ ID NO: 1367855 - protein, 8 aa, Mycobacterium tuberculosis
GRPDEGAL

SEQ ID NO: 1367856 - protein, 6 aa, Mycobacterium tuberculosis
GRPRGY

SEQ ID NO: 1367857 - protein, 14 aa, Mycobacterium tuberculosis
GRVGPGGETPVGST

SEQ ID NO: 1367858 - protein, 14 aa, Mycobacterium tuberculosis
GSPAVMGGDTNHRA

SEQ ID NO: 1367859 - protein, 8 aa, Mycobacterium tuberculosis
GTTGRTVA

SEQ ID NO: 1367860 - protein, 5 aa, Mycobacterium tuberculosis
HAGSV

SEQ ID NO: 1367861 - protein, 9 aa, Mycobacterium tuberculosis
HKQTAASSN

SEQ ID NO: 1367862 - protein, 11 aa, Mycobacterium tuberculosis
HPLPDPGESVP

SEQ ID NO: 1367863 - protein, 4 aa, Mycobacterium tuberculosis
HSPP

SEQ ID NO: 1367864 - protein, 5 aa, Mycobacterium tuberculosis
IHRQT

SEQ ID NO: 1367865 - protein, 7 aa, Mycobacterium tuberculosis
IKPTSPT

SEQ ID NO: 1367866 - protein, 6 aa, Mycobacterium tuberculosis
ISDDPN

SEQ ID NO: 1367867 - protein, 5 aa, Mycobacterium tuberculosis
ISPDD

SEQ ID NO: 1367868 - protein, 5 aa, Mycobacterium tuberculosis
ISPGR

SEQ ID NO: 1367869 - protein, 8 aa, Mycobacterium tuberculosis
ISSAAGTL

SEQ ID NO: 1367870 - protein, 7 aa, Mycobacterium tuberculosis
KETVQST

SEQ ID NO: 1367871 - protein, 7 aa, Mycobacterium tuberculosis
KMSGSNI

SEQ ID NO: 1367872 - protein, 8 aa, Mycobacterium tuberculosis
KMSGSNIR

SEQ ID NO: 1367873 - protein, 11 aa, Mycobacterium tuberculosis
LAEEAGQAEAI

SEQ ID NO: 1367874 - protein, 6 aa, Mycobacterium tuberculosis
LDPATE

SEQ ID NO: 1367875 - protein, 9 aa, Mycobacterium tuberculosis
LERAEQTAD

SEQ ID NO: 1367876 - protein, 9 aa, Mycobacterium tuberculosis
LKTGPQTQN

SEQ ID NO: 1367877 - protein, 8 aa, Mycobacterium tuberculosis
LNDQDRAY

SEQ ID NO: 1367878 - protein, 7 aa, Mycobacterium tuberculosis
LRDPPAY

SEQ ID NO: 1367879 - protein, 4 aa, Mycobacterium tuberculosis
LSKS

SEQ ID NO: 1367880 - protein, 13 aa, Mycobacterium tuberculosis
LTSAGQPSKFSMP

SEQ ID NO: 1367881 - protein, 15 aa, Mycobacterium tuberculosis
NGDNVKSAQIDDREQ

SEQ ID NO: 1367882 - protein, 9 aa, Mycobacterium tuberculosis
NGVAQTVRA

SEQ ID NO: 1367883 - protein, 13 aa, Mycobacterium tuberculosis
NKGSYEAARERLT

SEQ ID NO: 1367884 - protein, 8 aa, Mycobacterium tuberculosis
NSLANGGR

SEQ ID NO: 1367885 - protein, 8 aa, Mycobacterium tuberculosis
PAKIPTGT

SEQ ID NO: 1367886 - protein, 9 aa, Mycobacterium tuberculosis
PAPDVSQAQ

SEQ ID NO: 1367887 - protein, 6 aa, Mycobacterium tuberculosis
PDPVMP

SEQ ID NO: 1367888 - protein, 74 aa, Mycobacterium tuberculosis
PGGSYPPPPPPPGPSGGHEPPPAAPPGGSGYAPPPPPSSGSGYPPPPPPPGGGAYPPPPPSAGGYAPPPPGPAI

SEQ ID NO: 1367889 - protein, 9 aa, Mycobacterium tuberculosis
PGGVDSPET

SEQ ID NO: 1367890 - protein, 12 aa, Mycobacterium tuberculosis
PGIGTKQPRDVP

SEQ ID NO: 1367891 - protein, 4 aa, Mycobacterium tuberculosis
PGVT

SEQ ID NO: 1367892 - protein, 6 aa, Mycobacterium tuberculosis
PHQTPK

SEQ ID NO: 1367893 - protein, 18 aa, Mycobacterium tuberculosis
PLAKAAAGGGNGYSLRTN

SEQ ID NO: 1367894 - protein, 25 aa, Mycobacterium tuberculosis
PPLGEQPEPERSRVPPRTTRAGERI

SEQ ID NO: 1367895 - protein, 7 aa, Mycobacterium tuberculosis
PPRSPDR

SEQ ID NO: 1367896 - protein, 17 aa, Mycobacterium tuberculosis
PQPPHTPALSRPAGSPR

SEQ ID NO: 1367897 - protein, 7 aa, Mycobacterium tuberculosis
PQPRPSS

SEQ ID NO: 1367898 - protein, 6 aa, Mycobacterium tuberculosis
PSVPRR

SEQ ID NO: 1367899 - protein, 7 aa, Mycobacterium tuberculosis
PTADPTA

SEQ ID NO: 1367900 - protein, 6 aa, Mycobacterium tuberculosis
PTMYGG

SEQ ID NO: 1367901 - protein, 10 aa, Mycobacterium tuberculosis
QGELSTSDDH

SEQ ID NO: 1367902 - protein, 7 aa, Mycobacterium tuberculosis
QLGGTSY

SEQ ID NO: 1367903 - protein, 7 aa, Mycobacterium tuberculosis
QPDDPRA

SEQ ID NO: 1367904 - protein, 6 aa, Mycobacterium tuberculosis
QVGGSI

SEQ ID NO: 1367905 - protein, 6 aa, Mycobacterium tuberculosis
RAEQQV

SEQ ID NO: 1367906 - protein, 9 aa, Mycobacterium tuberculosis
RAREAGRIA

SEQ ID NO: 1367907 - protein, 11 aa, Mycobacterium tuberculosis
RDEHDDATPDV

SEQ ID NO: 1367908 - protein, 6 aa, Mycobacterium tuberculosis
REARIR

SEQ ID NO: 1367909 - protein, 13 aa, Mycobacterium tuberculosis
RGGERDSRTRTSI

SEQ ID NO: 1367910 - protein, 6 aa, Mycobacterium tuberculosis
RGQLGS

SEQ ID NO: 1367911 - protein, 12 aa, Mycobacterium tuberculosis
RGRRGDFGGLKG

SEQ ID NO: 1367912 - protein, 6 aa, Mycobacterium tuberculosis
RGSQTG

SEQ ID NO: 1367913 - protein, 8 aa, Mycobacterium tuberculosis
RPMPLPPG

SEQ ID NO: 1367914 - protein, 5 aa, Mycobacterium tuberculosis
RQRRA

SEQ ID NO: 1367915 - protein, 4 aa, Mycobacterium tuberculosis
RRCA

SEQ ID NO: 1367916 - protein, 10 aa, Mycobacterium tuberculosis
RRGRSGPMTR

SEQ ID NO: 1367917 - protein, 7 aa, Mycobacterium tuberculosis
RSGGAAR

SEQ ID NO: 1367918 - protein, 4 aa, Mycobacterium tuberculosis
RTAG

SEQ ID NO: 1367919 - protein, 4 aa, Mycobacterium tuberculosis
SAEL

SEQ ID NO: 1367920 - protein, 11 aa, Mycobacterium tuberculosis
SAQPETGQIAG

SEQ ID NO: 1367921 - protein, 11 aa, Mycobacterium tuberculosis
SASESRNVLGT

SEQ ID NO: 1367922 - protein, 21 aa, Mycobacterium tuberculosis
SENRPSYSDTNLENSKPFNPK

SEQ ID NO: 1367923 - protein, 13 aa, Mycobacterium tuberculosis
SGDTQLPASGRDM

SEQ ID NO: 1367924 - protein, 9 aa, Mycobacterium tuberculosis
SNGPGPGSL

SEQ ID NO: 1367925 - protein, 6 aa, Mycobacterium tuberculosis
SQAETR

SEQ ID NO: 1367926 - protein, 4 aa, Mycobacterium tuberculosis
SRDA

SEQ ID NO: 1367927 - protein, 53 aa, Mycobacterium tuberculosis
SSDRRRRADSPAAATRRTTTNSAPSRRIRSRAGKTSAPGRQARVSRPGPQTSP

SEQ ID NO: 1367928 - protein, 11 aa, Mycobacterium tuberculosis
SSLADETPEGR

SEQ ID NO: 1367929 - protein, 9 aa, Mycobacterium tuberculosis
SSWQGPSAD

SEQ ID NO: 1367930 - protein, 14 aa, Mycobacterium tuberculosis
STADNTGDQRIPKA

SEQ ID NO: 1367931 - protein, 21 aa, Mycobacterium tuberculosis
STPLAPPQPGSDAATATNNEP

SEQ ID NO: 1367932 - protein, 4 aa, Mycobacterium tuberculosis
STSL

SEQ ID NO: 1367933 - protein, 14 aa, Mycobacterium tuberculosis
TAQQAQSVVDDPDE

SEQ ID NO: 1367934 - protein, 5 aa, Mycobacterium tuberculosis
TDLAG

SEQ ID NO: 1367935 - protein, 9 aa, Mycobacterium tuberculosis
TGQEARGEA

SEQ ID NO: 1367936 - protein, 8 aa, Mycobacterium tuberculosis
THPADGTV

SEQ ID NO: 1367937 - protein, 4 aa, Mycobacterium tuberculosis
TPEA

SEQ ID NO: 1367938 - protein, 4 aa, Mycobacterium tuberculosis
TRVA

SEQ ID NO: 1367939 - protein, 7 aa, Mycobacterium tuberculosis
VAAPTGT

SEQ ID NO: 1367940 - protein, 5 aa, Mycobacterium tuberculosis
VAGTS

SEQ ID NO: 1367941 - protein, 8 aa, Mycobacterium tuberculosis
VARSDDHH

SEQ ID NO: 1367942 - protein, 4 aa, Mycobacterium tuberculosis
VASA

SEQ ID NO: 1367943 - protein, 14 aa, Mycobacterium tuberculosis
VDASPRVPAEPGGD

SEQ ID NO: 1367944 - protein, 4 aa, Mycobacterium tuberculosis
VGDP

SEQ ID NO: 1367945 - protein, 6 aa, Mycobacterium tuberculosis
VGSPAL

SEQ ID NO: 1367946 - protein, 10 aa, Mycobacterium tuberculosis
VPGTRSANRE

SEQ ID NO: 1367947 - protein, 8 aa, Mycobacterium tuberculosis
VPPAGNKR

SEQ ID NO: 1367948 - protein, 5 aa, Mycobacterium tuberculosis
VPPGS

SEQ ID NO: 1367949 - protein, 10 aa, Mycobacterium tuberculosis
VTSTNGDRIE

SEQ ID NO: 1367950 - protein, 8 aa, Mycobacterium tuberculosis
YGSEHGDP

SEQ ID NO: 1367951 - protein, 4 aa, Mycobacterium tuberculosis
YRDY

SEQ ID NO: 1367952 - protein, 6 aa, Mycobacterium tuberculosis
YYPEPG

SEQ ID NO: 1367953 - protein, 20 aa, Mycobacterium tuberculosis
AAAQHAGETAFGSATNADEI

SEQ ID NO: 1367954 - protein, 10 aa, Mycobacterium tuberculosis
AAFSQAPGDN

SEQ ID NO: 1367955 - protein, 6 aa, Mycobacterium tuberculosis
AGASSG

SEQ ID NO: 1367956 - protein, 8 aa, Mycobacterium tuberculosis
AGDHASVG

SEQ ID NO: 1367957 - protein, 4 aa, Mycobacterium tuberculosis
AGIT

SEQ ID NO: 1367958 - protein, 10 aa, Mycobacterium tuberculosis
AGSGPLPQVR

SEQ ID NO: 1367959 - protein, 7 aa, Mycobacterium tuberculosis
AKGLTRR

SEQ ID NO: 1367960 - protein, 24 aa, Mycobacterium tuberculosis
APGENIASVSNSGDGALANGLPDA

SEQ ID NO: 1367961 - protein, 10 aa, Mycobacterium tuberculosis
APRPPEVEEW

SEQ ID NO: 1367962 - protein, 7 aa, Mycobacterium tuberculosis
AQPQLAA

SEQ ID NO: 1367963 - protein, 4 aa, Mycobacterium tuberculosis
ATGR

SEQ ID NO: 1367964 - protein, 6 aa, Mycobacterium tuberculosis
CGPPTQ

SEQ ID NO: 1367965 - protein, 14 aa, Mycobacterium tuberculosis
DAYTAAYAAPGGPD

SEQ ID NO: 1367966 - protein, 6 aa, Mycobacterium tuberculosis
DDNPYP

SEQ ID NO: 1367967 - protein, 4 aa, Mycobacterium tuberculosis
DGIG

SEQ ID NO: 1367968 - protein, 9 aa, Mycobacterium tuberculosis
DHAGTATAI

SEQ ID NO: 1367969 - protein, 13 aa, Mycobacterium tuberculosis
DPDPDAVGKSYTR

SEQ ID NO: 1367970 - protein, 4 aa, Mycobacterium tuberculosis
EALA

SEQ ID NO: 1367971 - protein, 20 aa, Mycobacterium tuberculosis
EDQPFSPAGTATSRAVERSA

SEQ ID NO: 1367972 - protein, 7 aa, Mycobacterium tuberculosis
EGIKESV

SEQ ID NO: 1367973 - protein, 17 aa, Mycobacterium tuberculosis
EHAANEPTTSSPASTAG

SEQ ID NO: 1367974 - protein, 12 aa, Mycobacterium tuberculosis
ELGEPGTPTTGL

SEQ ID NO: 1367975 - protein, 7 aa, Mycobacterium tuberculosis
EPGGSTI

SEQ ID NO: 1367976 - protein, 15 aa, Mycobacterium tuberculosis
EQAPEPDPDELPATG

SEQ ID NO: 1367977 - protein, 10 aa, Mycobacterium tuberculosis
EQDKTTNPAS

SEQ ID NO: 1367978 - protein, 10 aa, Mycobacterium tuberculosis
EQFGTDTPRR

SEQ ID NO: 1367979 - protein, 12 aa, Mycobacterium tuberculosis
ESESTPAKKRHK

SEQ ID NO: 1367980 - protein, 10 aa, Mycobacterium tuberculosis
EVSGSPPPRL

SEQ ID NO: 1367981 - protein, 10 aa, Mycobacterium tuberculosis
FGAGPRDQHR

SEQ ID NO: 1367982 - protein, 7 aa, Mycobacterium tuberculosis
GADELST

SEQ ID NO: 1367983 - protein, 4 aa, Mycobacterium tuberculosis
GGRT

SEQ ID NO: 1367984 - protein, 8 aa, Mycobacterium tuberculosis
GQRRQPNQ

SEQ ID NO: 1367985 - protein, 15 aa, Mycobacterium tuberculosis
GRADAKASPDPDRRQ

SEQ ID NO: 1367986 - protein, 10 aa, Mycobacterium tuberculosis
GRGRPADRPA

SEQ ID NO: 1367987 - protein, 6 aa, Mycobacterium tuberculosis
GRPPLE

SEQ ID NO: 1367988 - protein, 7 aa, Mycobacterium tuberculosis
GRVTRAE

SEQ ID NO: 1367989 - protein, 7 aa, Mycobacterium tuberculosis
GSPATRH

SEQ ID NO: 1367990 - protein, 6 aa, Mycobacterium tuberculosis
GSPRRT

SEQ ID NO: 1367991 - protein, 16 aa, Mycobacterium tuberculosis
GSTGEFKDKYGKSSAH

SEQ ID NO: 1367992 - protein, 4 aa, Mycobacterium tuberculosis
GTAT

SEQ ID NO: 1367993 - protein, 5 aa, Mycobacterium tuberculosis
GTQPW

SEQ ID NO: 1367994 - protein, 16 aa, Mycobacterium tuberculosis
GVPPPPPPSEVPPSET

SEQ ID NO: 1367995 - protein, 8 aa, Mycobacterium tuberculosis
GVSPNPRL

SEQ ID NO: 1367996 - protein, 9 aa, Mycobacterium tuberculosis
HAAGEPLER

SEQ ID NO: 1367997 - protein, 10 aa, Mycobacterium tuberculosis
HPRSKVGPLR

SEQ ID NO: 1367998 - protein, 11 aa, Mycobacterium tuberculosis
HQKTQTAEEIA

SEQ ID NO: 1367999 - protein, 4 aa, Mycobacterium tuberculosis
HSVR

SEQ ID NO: 1368000 - protein, 7 aa, Mycobacterium tuberculosis
IGPGPHA

SEQ ID NO: 1368001 - protein, 18 aa, Mycobacterium tuberculosis
KRKLERQLERRAKQAKRR

SEQ ID NO: 1368002 - protein, 6 aa, Mycobacterium tuberculosis
KRPPRF

SEQ ID NO: 1368003 - protein, 11 aa, Mycobacterium tuberculosis
LDDGASGSLDE

SEQ ID NO: 1368004 - protein, 19 aa, Mycobacterium tuberculosis
LPPGPTPAHPHKPRPAFQD

SEQ ID NO: 1368005 - protein, 13 aa, Mycobacterium tuberculosis
LQPGERVHTTSGL

SEQ ID NO: 1368006 - protein, 6 aa, Mycobacterium tuberculosis
NAGRHG

SEQ ID NO: 1368007 - protein, 4 aa, Mycobacterium tuberculosis
NDEV

SEQ ID NO: 1368008 - protein, 7 aa, Mycobacterium tuberculosis
NECGQQG

SEQ ID NO: 1368009 - protein, 6 aa, Mycobacterium tuberculosis
NQHPNA

SEQ ID NO: 1368010 - protein, 51 aa, Mycobacterium tuberculosis; identical to SEQ ID NO: 155710

SEQ ID NO: 1368011 - protein, 6 aa, Mycobacterium tuberculosis
PAERAE

SEQ ID NO: 1368012 - protein, 9 aa, Mycobacterium tuberculosis
PFGNRSDNG

SEQ ID NO: 1368013 - protein, 20 aa, Mycobacterium tuberculosis
PGAAPPPRHGPRLRGPTPRY

SEQ ID NO: 1368014 - protein, 8 aa, Mycobacterium tuberculosis
PGAPAAMP

SEQ ID NO: 1368015 - protein, 18 aa, Mycobacterium tuberculosis
PLAKAASGGGNGYSLRTN

SEQ ID NO: 1368016 - protein, 11 aa, Mycobacterium tuberculosis
PPPELRRSEPS

SEQ ID NO: 1368017 - protein, 29 aa, Mycobacterium tuberculosis
PSDQTGETDAYSRAYSAPESEHVTGGPYV

SEQ ID NO: 1368018 - protein, 23 aa, Mycobacterium tuberculosis
PTPRPAPPAQQLPSTPPGTQHLP

SEQ ID NO: 1368019 - protein, 5 aa, Mycobacterium tuberculosis
PTPSI

SEQ ID NO: 1368020 - protein, 10 aa, Mycobacterium tuberculosis
PVPGETVDNE

SEQ ID NO: 1368021 - protein, 17 aa, Mycobacterium tuberculosis
QAPVPASAKAGPSPAAV

SEQ ID NO: 1368022 - protein, 18 aa, Mycobacterium tuberculosis
QEEEPAAVKTKRRARRDP

SEQ ID NO: 1368023 - protein, 4 aa, Mycobacterium tuberculosis
QGGR

SEQ ID NO: 1368024 - protein, 9 aa, Mycobacterium tuberculosis
RAGGDIKSL

SEQ ID NO: 1368025 - protein, 9 aa, Mycobacterium tuberculosis
RLGRDDSEV

SEQ ID NO: 1368026 - protein, 20 aa, Mycobacterium tuberculosis
RPLATELDNRKAEVNNDIEQ

SEQ ID NO: 1368027 - protein, 5 aa, Mycobacterium tuberculosis
RRGFS

SEQ ID NO: 1368028 - protein, 11 aa, Mycobacterium tuberculosis
RRRHDRGRGPR

SEQ ID NO: 1368029 - protein, 10 aa, Mycobacterium tuberculosis
RRSGDPVAPP

SEQ ID NO: 1368030 - protein, 11 aa, Mycobacterium tuberculosis
RRTAGGDQDPL

SEQ ID NO: 1368031 - protein, 10 aa, Mycobacterium tuberculosis
SDLPYPEGVA

SEQ ID NO: 1368032 - protein, 7 aa, Mycobacterium tuberculosis
SGATTAS

SEQ ID NO: 1368033 - protein, 5 aa, Mycobacterium tuberculosis
SSLTD

SEQ ID NO: 1368034 - protein, 4 aa, Mycobacterium tuberculosis
STGV

SEQ ID NO: 1368035 - protein, 7 aa, Mycobacterium tuberculosis
TATPRAY

SEQ ID NO: 1368036 - protein, 7 aa, Mycobacterium tuberculosis
TISPAQQ

SEQ ID NO: 1368037 - protein, 14 aa, Mycobacterium tuberculosis
TRSVSNAIASGAQV

SEQ ID NO: 1368038 - protein, 9 aa, Mycobacterium tuberculosis
TSADKWKNC

SEQ ID NO: 1368039 - protein, 5 aa, Mycobacterium tuberculosis
TVASA

SEQ ID NO: 1368040 - protein, 9 aa, Mycobacterium tuberculosis
TVKSSQPPV

SEQ ID NO: 1368041 - protein, 6 aa, Mycobacterium tuberculosis
VASGQT

SEQ ID NO: 1368042 - protein, 8 aa, Mycobacterium tuberculosis
VGQTATSF

SEQ ID NO: 1368043 - protein, 24 aa, Mycobacterium tuberculosis
VGSAHGGHGHDASEFTVGGGASGT

SEQ ID NO: 1368044 - protein, 8 aa, Mycobacterium tuberculosis
WSSAGSDP

SEQ ID NO: 1368045 - protein, 4 aa, Mycobacterium tuberculosis
YPRT

SEQ ID NO: 1368046 - protein, 7 aa, Mycobacterium tuberculosis
YSTGNGV

SEQ ID NO: 1368047 - protein, 6 aa, Mycobacterium tuberculosis
AAAAGL

SEQ ID NO: 1368048 - protein, 14 aa, Mycobacterium tuberculosis
AAAHETAAAGYTSA

SEQ ID NO: 1368049 - protein, 8 aa, Mycobacterium tuberculosis
AAEQGMGP

SEQ ID NO: 1368050 - protein, 22 aa, Mycobacterium tuberculosis
AAVGDDRIQQQTTGRTNPETWT

SEQ ID NO: 1368051 - protein, 5 aa, Mycobacterium tuberculosis
ADDGR

SEQ ID NO: 1368052 - protein, 8 aa, Mycobacterium tuberculosis
ADPGTTLG

SEQ ID NO: 1368053 - protein, 6 aa, Mycobacterium tuberculosis
AEDPDR

SEQ ID NO: 1368054 - protein, 6 aa, Mycobacterium tuberculosis
AEIGTQ

SEQ ID NO: 1368055 - protein, 4 aa, Mycobacterium tuberculosis
AESR

SEQ ID NO: 1368056 - protein, 8 aa, Mycobacterium tuberculosis
AGGDIKSL

SEQ ID NO: 1368057 - protein, 6 aa, Mycobacterium tuberculosis
AGIGQA

SEQ ID NO: 1368058 - protein, 7 aa, Mycobacterium tuberculosis
AGPYATG

SEQ ID NO: 1368059 - protein, 6 aa, Mycobacterium tuberculosis
AGTGGL

SEQ ID NO: 1368060 - protein, 7 aa, Mycobacterium tuberculosis
AIPSTAT

SEQ ID NO: 1368061 - protein, 4 aa, Mycobacterium tuberculosis
AITG

SEQ ID NO: 1368062 - protein, 4 aa, Mycobacterium tuberculosis
AKIP

SEQ ID NO: 1368063 - protein, 7 aa, Mycobacterium tuberculosis
AKNGLGA

SEQ ID NO: 1368064 - protein, 6 aa, Mycobacterium tuberculosis
APIQTV

SEQ ID NO: 1368065 - protein, 12 aa, Mycobacterium tuberculosis
APPSRPSQAETR

SEQ ID NO: 1368066 - protein, 38 aa, Mycobacterium tuberculosis; identical to SEQ ID NO: 149917

SEQ ID NO: 1368067 - protein, 15 aa, Mycobacterium tuberculosis
AQANTALSNAALSAG

SEQ ID NO: 1368068 - protein, 6 aa, Mycobacterium tuberculosis
AQDDYN

SEQ ID NO: 1368069 - protein, 4 aa, Mycobacterium tuberculosis
AQEH

SEQ ID NO: 1368070 - protein, 7 aa, Mycobacterium tuberculosis
ARPRTLP

SEQ ID NO: 1368071 - protein, 4 aa, Mycobacterium tuberculosis
ARTE

SEQ ID NO: 1368072 - protein, 5 aa, Mycobacterium tuberculosis
ASGQT

SEQ ID NO: 1368073 - protein, 4 aa, Mycobacterium tuberculosis
ASPL

SEQ ID NO: 1368074 - protein, 7 aa, Mycobacterium tuberculosis
ATAANNS

SEQ ID NO: 1368075 - protein, 11 aa, Mycobacterium tuberculosis
ATAAPTGPIAR

SEQ ID NO: 1368076 - protein, 8 aa, Mycobacterium tuberculosis
ATASSALA

SEQ ID NO: 1368077 - protein, 9 aa, Mycobacterium tuberculosis
DADDLGDGF

SEQ ID NO: 1368078 - protein, 9 aa, Mycobacterium tuberculosis
DATGQTQEP

SEQ ID NO: 1368079 - protein, 8 aa, Mycobacterium tuberculosis
DDRTGLTG

SEQ ID NO: 1368080 - protein, 8 aa, Mycobacterium tuberculosis
DEARRPGF

SEQ ID NO: 1368081 - protein, 10 aa, Mycobacterium tuberculosis
DEIARRESAA

SEQ ID NO: 1368082 - protein, 7 aa, Mycobacterium tuberculosis
DEPTTRL

SEQ ID NO: 1368083 - protein, 8 aa, Mycobacterium tuberculosis
DNGDPANR

SEQ ID NO: 1368084 - protein, 26 aa, Mycobacterium tuberculosis
DNRSANAAEPDPQLAGTGGRPKVSTR

SEQ ID NO: 1368085 - protein, 26 aa, Mycobacterium tuberculosis
DPADSELDRRQAQRVPVDRPGRGLSR

SEQ ID NO: 1368086 - protein, 12 aa, Mycobacterium tuberculosis
DPANRGVIMDRG

SEQ ID NO: 1368087 - protein, 5 aa, Mycobacterium tuberculosis
DPLQS

SEQ ID NO: 1368088 - protein, 11 aa, Mycobacterium tuberculosis
DSARPNTELED

SEQ ID NO: 1368089 - protein, 7 aa, Mycobacterium tuberculosis
DSVSEAI

SEQ ID NO: 1368090 - protein, 25 aa, Mycobacterium tuberculosis
DTAVTEPPGFGGPSEPSGAPRTSRT

SEQ ID NO: 1368091 - protein, 5 aa, Mycobacterium tuberculosis
DTPVP

SEQ ID NO: 1368092 - protein, 20 aa, Mycobacterium tuberculosis
EAIPGGRTQISGGDPPFTAA

SEQ ID NO: 1368093 - protein, 7 aa, Mycobacterium tuberculosis
EAKADVK

SEQ ID NO: 1368094 - protein, 7 aa, Mycobacterium tuberculosis
EDDGDAQ

SEQ ID NO: 1368095 - protein, 4 aa, Mycobacterium tuberculosis
EGAP

SEQ ID NO: 1368096 - protein, 12 aa, Mycobacterium tuberculosis
EHPDGAGAALSA

SEQ ID NO: 1368097 - protein, 9 aa, Mycobacterium tuberculosis
ENTATARQA

SEQ ID NO: 1368098 - protein, 11 aa, Mycobacterium tuberculosis
ERGTELGGQER

SEQ ID NO: 1368099 - protein, 5 aa, Mycobacterium tuberculosis
ESHAT

SEQ ID NO: 1368100 - protein, 21 aa, Mycobacterium tuberculosis
ETSAATTARHSQADAGAHDAV

SEQ ID NO: 1368101 - protein, 4 aa, Mycobacterium tuberculosis
GDGL

SEQ ID NO: 1368102 - protein, 22 aa, Mycobacterium tuberculosis
GGAFNNDTECVNGRRGNAADHL

SEQ ID NO: 1368103 - protein, 7 aa, Mycobacterium tuberculosis
GLPAGTL

SEQ ID NO: 1368104 - protein, 7 aa, Mycobacterium tuberculosis
GMSATGP

SEQ ID NO: 1368105 - protein, 11 aa, Mycobacterium tuberculosis
GNNETDGSEKV

SEQ ID NO: 1368106 - protein, 5 aa, Mycobacterium tuberculosis
GPPQQ

SEQ ID NO: 1368107 - protein, 20 aa, Mycobacterium tuberculosis
GPRAPGSSYGSRENGPPVNE

SEQ ID NO: 1368108 - protein, 10 aa, Mycobacterium tuberculosis
GPSGSGKSTL

SEQ ID NO: 1368109 - protein, 5 aa, Mycobacterium tuberculosis
GPTGI

SEQ ID NO: 1368110 - protein, 4 aa, Mycobacterium tuberculosis
GPTI

SEQ ID NO: 1368111 - protein, 8 aa, Mycobacterium tuberculosis
GQPSTDTP

SEQ ID NO: 1368112 - protein, 6 aa, Mycobacterium tuberculosis
GSRTPL

SEQ ID NO: 1368113 - protein, 6 aa, Mycobacterium tuberculosis
GTEPST

SEQ ID NO: 1368114 - protein, 7 aa, Mycobacterium tuberculosis
HKSPRDH

SEQ ID NO: 1368115 - protein, 5 aa, Mycobacterium tuberculosis
HPDPA

SEQ ID NO: 1368116 - protein, 9 aa, Mycobacterium tuberculosis
IDGDPTKVR

SEQ ID NO: 1368117 - protein, 6 aa, Mycobacterium tuberculosis
IHRQTQ

SEQ ID NO: 1368118 - protein, 4 aa, Mycobacterium tuberculosis
ITPS

SEQ ID NO: 1368119 - protein, 15 aa, Mycobacterium tuberculosis
KEPLPESDGDADDDD

SEQ ID NO: 1368120 - protein, 7 aa, Mycobacterium tuberculosis
KPPQHKR

SEQ ID NO: 1368121 - protein, 7 aa, Mycobacterium tuberculosis
KSTQPSQ

SEQ ID NO: 1368122 - protein, 7 aa, Mycobacterium tuberculosis
LAGNSAK

SEQ ID NO: 1368123 - protein, 6 aa, Mycobacterium tuberculosis
LDPTSV

SEQ ID NO: 1368124 - protein, 4 aa, Mycobacterium tuberculosis
LEGR

SEQ ID NO: 1368125 - protein, 5 aa, Mycobacterium tuberculosis
LETGQ

SEQ ID NO: 1368126 - protein, 4 aa, Mycobacterium tuberculosis
LKRL

SEQ ID NO: 1368127 - protein, 11 aa, Mycobacterium tuberculosis
LPDRARELGSL

SEQ ID NO: 1368128 - protein, 13 aa, Mycobacterium tuberculosis
LRDPTPPGGPHGI

SEQ ID NO: 1368129 - protein, 4 aa, Mycobacterium tuberculosis
LSGA

SEQ ID NO: 1368130 - protein, 20 aa, Mycobacterium tuberculosis
LTSTEEAGGAGEPNAPAPPR

SEQ ID NO: 1368131 - protein, 16 aa, Mycobacterium tuberculosis
MQQGANALADGSAALA

SEQ ID NO: 1368132 - protein, 21 aa, Mycobacterium tuberculosis
NADVQSAQRAYTRRGGNNAGA

SEQ ID NO: 1368133 - protein, 8 aa, Mycobacterium tuberculosis
NNETEAYD

SEQ ID NO: 1368134 - protein, 15 aa, Mycobacterium tuberculosis
NPCRDVDSADTAIEV

SEQ ID NO: 1368135 - protein, 8 aa, Mycobacterium tuberculosis
NQLGGTSY

SEQ ID NO: 1368136 - protein, 6 aa, Mycobacterium tuberculosis
NRAPNN

SEQ ID NO: 1368137 - protein, 4 aa, Mycobacterium tuberculosis
PAPA

SEQ ID NO: 1368138 - protein, 7 aa, Mycobacterium tuberculosis
PDGANTI

SEQ ID NO: 1368139 - protein, 7 aa, Mycobacterium tuberculosis
PDNEYTA

SEQ ID NO: 1368140 - protein, 10 aa, Mycobacterium tuberculosis
PGARNAAPLQ

SEQ ID NO: 1368141 - protein, 4 aa, Mycobacterium tuberculosis
PGGV

SEQ ID NO: 1368142 - protein, 6 aa, Mycobacterium tuberculosis
PGQAGL

SEQ ID NO: 1368143 - protein, 54 aa, Mycobacterium tuberculosis; identical to SEQ ID NO: 155741

SEQ ID NO: 1368144 - protein, 4 aa, Mycobacterium tuberculosis
PRSR

SEQ ID NO: 1368145 - protein, 10 aa, Mycobacterium tuberculosis
PSRPSQAETR

SEQ ID NO: 1368146 - protein, 10 aa, Mycobacterium tuberculosis
PTSGLDPGYE

SEQ ID NO: 1368147 - protein, 73 aa, Mycobacterium tuberculosis
PVAPGYAPAGYPPYPATPPGYGPPGYGAPPSYGPPPGYGPPLGYPAAPPGCGPPPGYGPPLGYGPPVAPGAVK

SEQ ID NO: 1368148 - protein, 8 aa, Mycobacterium tuberculosis
PVENDSST

SEQ ID NO: 1368149 - protein, 12 aa, Mycobacterium tuberculosis
PVGDETYDGEVT

SEQ ID NO: 1368150 - protein, 13 aa, Mycobacterium tuberculosis
PYHGLSDGEAAQR

SEQ ID NO: 1368151 - protein, 6 aa, Mycobacterium tuberculosis
QAEHPG

SEQ ID NO: 1368152 - protein, 12 aa, Mycobacterium tuberculosis
QAVDAASEEERA

SEQ ID NO: 1368153 - protein, 7 aa, Mycobacterium tuberculosis
QDRDLGN

SEQ ID NO: 1368154 - protein, 4 aa, Mycobacterium tuberculosis
QPPF

SEQ ID NO: 1368155 - protein, 6 aa, Mycobacterium tuberculosis
QQDHPD

SEQ ID NO: 1368156 - protein, 9 aa, Mycobacterium tuberculosis
QRARQTGAQ

SEQ ID NO: 1368157 - protein, 20 aa, Mycobacterium tuberculosis
QRNPEPSRHNPHRYSQGEAS

SEQ ID NO: 1368158 - protein, 5 aa, Mycobacterium tuberculosis
RADRG

SEQ ID NO: 1368159 - protein, 5 aa, Mycobacterium tuberculosis
RAEQR

SEQ ID NO: 1368160 - protein, 5 aa, Mycobacterium tuberculosis
RAGAP

SEQ ID NO: 1368161 - protein, 6 aa, Mycobacterium tuberculosis
RAGDEL

SEQ ID NO: 1368162 - protein, 5 aa, Mycobacterium tuberculosis
RAGDR

SEQ ID NO: 1368163 - protein, 8 aa, Mycobacterium tuberculosis
RDGEWTTN

SEQ ID NO: 1368164 - protein, 9 aa, Mycobacterium tuberculosis
RDPLTGGQS

SEQ ID NO: 1368165 - protein, 4 aa, Mycobacterium tuberculosis
RETT

SEQ ID NO: 1368166 - protein, 6 aa, Mycobacterium tuberculosis
RGLGPV

SEQ ID NO: 1368167 - protein, 4 aa, Mycobacterium tuberculosis
RGPA

SEQ ID NO: 1368168 - protein, 19 aa, Mycobacterium tuberculosis
RGRHELPADHPRSKVGPLR

SEQ ID NO: 1368169 - protein, 17 aa, Mycobacterium tuberculosis
RPARPAAARHARPVAQQ

SEQ ID NO: 1368170 - protein, 9 aa, Mycobacterium tuberculosis
RRPSGRSTD

SEQ ID NO: 1368171 - protein, 6 aa, Mycobacterium tuberculosis
RSHAEG

SEQ ID NO: 1368172 - protein, 6 aa, Mycobacterium tuberculosis
RSRSPA

SEQ ID NO: 1368173 - protein, 16 aa, Mycobacterium tuberculosis
SAGPGPGSLQAAAAGW

SEQ ID NO: 1368174 - protein, 9 aa, Mycobacterium tuberculosis
SAQPGARYT

SEQ ID NO: 1368175 - protein, 7 aa, Mycobacterium tuberculosis
SESPSRR

SEQ ID NO: 1368176 - protein, 11 aa, Mycobacterium tuberculosis
SIATSSPGRCD

SEQ ID NO: 1368177 - protein, 7 aa, Mycobacterium tuberculosis
SKAELGK

SEQ ID NO: 1368178 - protein, 5 aa, Mycobacterium tuberculosis
SKAYF

SEQ ID NO: 1368179 - protein, 8 aa, Mycobacterium tuberculosis
SNDNLQDL

SEQ ID NO: 1368180 - protein, 4 aa, Mycobacterium tuberculosis
SQDE

SEQ ID NO: 1368181 - protein, 13 aa, Mycobacterium tuberculosis
SREAARRTLNRPG

SEQ ID NO: 1368182 - protein, 5 aa, Mycobacterium tuberculosis
SSAEL

SEQ ID NO: 1368183 - protein, 4 aa, Mycobacterium tuberculosis
SSPL

SEQ ID NO: 1368184 - protein, 15 aa, Mycobacterium tuberculosis
STAYNPLPNGTGNGL

SEQ ID NO: 1368185 - protein, 6 aa, Mycobacterium tuberculosis
TAIRAG

SEQ ID NO: 1368186 - protein, 10 aa, Mycobacterium tuberculosis
TANRDAGSPQ

SEQ ID NO: 1368187 - protein, 8 aa, Mycobacterium tuberculosis
TAQESTKA

SEQ ID NO: 1368188 - protein, 7 aa, Mycobacterium tuberculosis
TAQPLGI

SEQ ID NO: 1368189 - protein, 9 aa, Mycobacterium tuberculosis
TASGGPVGV

SEQ ID NO: 1368190 - protein, 35 aa, Mycobacterium tuberculosis; identical to SEQ ID NO: 155857

SEQ ID NO: 1368191 - protein, 6 aa, Mycobacterium tuberculosis
TERRSQ

SEQ ID NO: 1368192 - protein, 10 aa, Mycobacterium tuberculosis
TGPDSPNKTL

SEQ ID NO: 1368193 - protein, 9 aa, Mycobacterium tuberculosis
TNAGMQPSE

SEQ ID NO: 1368194 - protein, 4 aa, Mycobacterium tuberculosis
TNPA

SEQ ID NO: 1368195 - protein, 9 aa, Mycobacterium tuberculosis
TPDTSRGQQ

SEQ ID NO: 1368196 - protein, 7 aa, Mycobacterium tuberculosis
TRLPKEV

SEQ ID NO: 1368197 - protein, 4 aa, Mycobacterium tuberculosis
TSGH

SEQ ID NO: 1368198 - protein, 16 aa, Mycobacterium tuberculosis
TTSSHESKAVIGTPEA

SEQ ID NO: 1368199 - protein, 7 aa, Mycobacterium tuberculosis
VASGQTY

SEQ ID NO: 1368200 - protein, 8 aa, Mycobacterium tuberculosis
VDEPDPSA

SEQ ID NO: 1368201 - protein, 15 aa, Mycobacterium tuberculosis
VGEAGSALSGGERQR

SEQ ID NO: 1368202 - protein, 6 aa, Mycobacterium tuberculosis
VNQVGR

SEQ ID NO: 1368203 - protein, 6 aa, Mycobacterium tuberculosis
VPEAGP

SEQ ID NO: 1368204 - protein, 20 aa, Mycobacterium tuberculosis
VTSGDASNRYSGSPVRQPGF

SEQ ID NO: 1368205 - protein, 40 aa, Mycobacterium tuberculosis
YRGSATRDARRDNYREEQRFDRRDRSRAPRRPPAESWEYD

SEQ ID NO: 1368206 - protein, 4 aa, Mycobacterium tuberculosis
YTGS

SEQ ID NO: 1368207 - protein, 12 aa, Mycobacterium tuberculosis
AAAETADPRRTL

SEQ ID NO: 1368208 - protein, 14 aa, Mycobacterium tuberculosis
AARCDQPVKPGQVI

SEQ ID NO: 1368209 - protein, 60 aa, Mycobacterium tuberculosis
AARCDQPVKPGQVIPAPSVNNGINPLPADQLPGTPPPVNDPLQRPGSGTVQCNGQQPNPC

SEQ ID NO: 1368210 - protein, 12 aa, Mycobacterium tuberculosis
AATQAPDAGAMS

SEQ ID NO: 1368211 - protein, 8 aa, Mycobacterium tuberculosis
ADAELPDT

SEQ ID NO: 1368212 - protein, 62 aa, Mycobacterium tuberculosis
ADPQGGNQGAGSYPPPGYGAPPPPPGYGPPPGTYLPPGYNAPPPPPGYGPPPGPPPPGYPTH

SEQ ID NO: 1368213 - protein, 5 aa, Mycobacterium tuberculosis
ADPSV

SEQ ID NO: 1368214 - protein, 5 aa, Mycobacterium tuberculosis
ADTAV

SEQ ID NO: 1368215 - protein, 5 aa, Mycobacterium tuberculosis
AEDTV

SEQ ID NO: 1368216 - protein, 5 aa, Mycobacterium tuberculosis
AEELG

SEQ ID NO: 1368217 - protein, 8 aa, Mycobacterium tuberculosis
AEQGKATA

SEQ ID NO: 1368218 - protein, 22 aa, Mycobacterium tuberculosis
AEQPARGAKQQPATETSRAGRD

SEQ ID NO: 1368219 - protein, 11 aa, Mycobacterium tuberculosis
AESPPSAVPPG

SEQ ID NO: 1368220 - protein, 6 aa, Mycobacterium tuberculosis
AETSTP

SEQ ID NO: 1368221 - protein, 7 aa, Mycobacterium tuberculosis
AGAGATV

SEQ ID NO: 1368222 - protein, 6 aa, Mycobacterium tuberculosis
AGGPAA

SEQ ID NO: 1368223 - protein, 5 aa, Mycobacterium tuberculosis
AGPER

SEQ ID NO: 1368224 - protein, 20 aa, Mycobacterium tuberculosis
AGVPPPPPPPPPSEVPPSET

SEQ ID NO: 1368225 - protein, 10 aa, Mycobacterium tuberculosis
AHPQPGNPAP

SEQ ID NO: 1368226 - protein, 8 aa, Mycobacterium tuberculosis
AHPRPEDL

SEQ ID NO: 1368227 - protein, 5 aa, Mycobacterium tuberculosis
ANQLP

SEQ ID NO: 1368228 - protein, 35 aa, Mycobacterium tuberculosis
APGDNSPQQAPTPTVTTTGNPPARNTGGTDASPRL

SEQ ID NO: 1368229 - protein, 5 aa, Mycobacterium tuberculosis
APGTV

SEQ ID NO: 1368230 - protein, 5 aa, Mycobacterium tuberculosis
APIQT

SEQ ID NO: 1368231 - protein, 4 aa, Mycobacterium tuberculosis
APTL

SEQ ID NO: 1368232 - protein, 8 aa, Mycobacterium tuberculosis
AQGDSNSI

SEQ ID NO: 1368233 - protein, 5 aa, Mycobacterium tuberculosis
ARAGD

SEQ ID NO: 1368234 - protein, 6 aa, Mycobacterium tuberculosis
ARPPES

SEQ ID NO: 1368235 - protein, 11 aa, Mycobacterium tuberculosis
ASGNVRTEADA

SEQ ID NO: 1368236 - protein, 10 aa, Mycobacterium tuberculosis
ASPSGARTDR

SEQ ID NO: 1368237 - protein, 8 aa, Mycobacterium tuberculosis
ATHEQAES

SEQ ID NO: 1368238 - protein, 5 aa, Mycobacterium tuberculosis
ATPRQ

SEQ ID NO: 1368239 - protein, 6 aa, Mycobacterium tuberculosis
AVRRTS

SEQ ID NO: 1368240 - protein, 5 aa, Mycobacterium tuberculosis
DAQTL

SEQ ID NO: 1368241 - protein, 9 aa, Mycobacterium tuberculosis
DEPADQPQS

SEQ ID NO: 1368242 - protein, 16 aa, Mycobacterium tuberculosis
DGKPATLPISGPPTTH

SEQ ID NO: 1368243 - protein, 5 aa, Mycobacterium tuberculosis
DGKTG

SEQ ID NO: 1368244 - protein, 8 aa, Mycobacterium tuberculosis
DKPLGNDA

SEQ ID NO: 1368245 - protein, 4 aa, Mycobacterium tuberculosis
DLDG

SEQ ID NO: 1368246 - protein, 4 aa, Mycobacterium tuberculosis
DLGE

SEQ ID NO: 1368247 - protein, 9 aa, Mycobacterium tuberculosis
DLSDSDLDD

SEQ ID NO: 1368248 - protein, 4 aa, Mycobacterium tuberculosis
DNGS

SEQ ID NO: 1368249 - protein, 4 aa, Mycobacterium tuberculosis
DRQS

SEQ ID NO: 1368250 - protein, 21 aa, Mycobacterium tuberculosis
DSNSWVPNKPDAATPVIPGPV

SEQ ID NO: 1368251 - protein, 9 aa, Mycobacterium tuberculosis
DTARPSSRP

SEQ ID NO: 1368252 - protein, 5 aa, Mycobacterium tuberculosis
DVSPV

SEQ ID NO: 1368253 - protein, 5 aa, Mycobacterium tuberculosis
EEADR

SEQ ID NO: 1368254 - protein, 10 aa, Mycobacterium tuberculosis
EESPAGPRTS

SEQ ID NO: 1368255 - protein, 5 aa, Mycobacterium tuberculosis
EHTMP

SEQ ID NO: 1368256 - protein, 5 aa, Mycobacterium tuberculosis
EIDGA

SEQ ID NO: 1368257 - protein, 12 aa, Mycobacterium tuberculosis
ELRAENRRRISP

SEQ ID NO: 1368258 - protein, 13 aa, Mycobacterium tuberculosis
EPPSAVRATPGTS

SEQ ID NO: 1368259 - protein, 5 aa, Mycobacterium tuberculosis
EQRAE

SEQ ID NO: 1368260 - protein, 9 aa, Mycobacterium tuberculosis
ERNEEDPAR

SEQ ID NO: 1368261 - protein, 6 aa, Mycobacterium tuberculosis
ETVDSD

SEQ ID NO: 1368262 - protein, 10 aa, Mycobacterium tuberculosis
FDKDGTALSS

SEQ ID NO: 1368263 - protein, 4 aa, Mycobacterium tuberculosis
FGST

SEQ ID NO: 1368264 - protein, 12 aa, Mycobacterium tuberculosis
FRPAGNGTVRYD

SEQ ID NO: 1368265 - protein, 7 aa, Mycobacterium tuberculosis
FTRPAGG

SEQ ID NO: 1368266 - protein, 5 aa, Mycobacterium tuberculosis
FYSNP

SEQ ID NO: 1368267 - protein, 9 aa, Mycobacterium tuberculosis
GAEANSPVM

SEQ ID NO: 1368268 - protein, 6 aa, Mycobacterium tuberculosis
GAPTTV

SEQ ID NO: 1368269 - protein, 8 aa, Mycobacterium tuberculosis
GAQPGLSA

SEQ ID NO: 1368270 - protein, 6 aa, Mycobacterium tuberculosis
GDNPQT

SEQ ID NO: 1368271 - protein, 9 aa, Mycobacterium tuberculosis
GDPIGDEAQ

SEQ ID NO: 1368272 - protein, 8 aa, Mycobacterium tuberculosis
GEDGGLPR

SEQ ID NO: 1368273 - protein, 4 aa, Mycobacterium tuberculosis
GEPL

SEQ ID NO: 1368274 - protein, 10 aa, Mycobacterium tuberculosis
GGPDGEGFNP

SEQ ID NO: 1368275 - protein, 14 aa, Mycobacterium tuberculosis
GGTTVSFPRGSTQV

SEQ ID NO: 1368276 - protein, 10 aa, Mycobacterium tuberculosis
GLDRRATPDQ

SEQ ID NO: 1368277 - protein, 6 aa, Mycobacterium tuberculosis
GNDAAY

SEQ ID NO: 1368278 - protein, 7 aa, Mycobacterium tuberculosis
GNQGEAL

SEQ ID NO: 1368279 - protein, 8 aa, Mycobacterium tuberculosis
GNTGGDCV

SEQ ID NO: 1368280 - protein, 13 aa, Mycobacterium tuberculosis
GPHTDQTLDGPGL

SEQ ID NO: 1368281 - protein, 5 aa, Mycobacterium tuberculosis
GQLQR

SEQ ID NO: 1368282 - protein, 5 aa, Mycobacterium tuberculosis
GRASQ

SEQ ID NO: 1368283 - protein, 8 aa, Mycobacterium tuberculosis
GSSGGPFA

SEQ ID NO: 1368284 - protein, 15 aa, Mycobacterium tuberculosis
GSTGEFKDKYGKSSA

SEQ ID NO: 1368285 - protein, 10 aa, Mycobacterium tuberculosis
GTPPGRGGSA

SEQ ID NO: 1368286 - protein, 10 aa, Mycobacterium tuberculosis
GVNFSGGQRQ

SEQ ID NO: 1368287 - protein, 7 aa, Mycobacterium tuberculosis
GVQHAPD

SEQ ID NO: 1368288 - protein, 30 aa, Mycobacterium tuberculosis
GVQPGPRLPNVDAGGDFVESTDGLTDCDGH

SEQ ID NO: 1368289 - protein, 5 aa, Mycobacterium tuberculosis
GYEPE

SEQ ID NO: 1368290 - protein, 4 aa, Mycobacterium tuberculosis
GYGA

SEQ ID NO: 1368291 - protein, 7 aa, Mycobacterium tuberculosis
GYKTSYD

SEQ ID NO: 1368292 - protein, 11 aa, Mycobacterium tuberculosis
HDTTSTAGGVA

SEQ ID NO: 1368293 - protein, 41 aa, Mycobacterium tuberculosis; identical to SEQ ID NO: 151745

SEQ ID NO: 1368294 - protein, 20 aa, Mycobacterium tuberculosis
HTAGSDAKREAAYSDDRRVR

SEQ ID NO: 1368295 - protein, 8 aa, Mycobacterium tuberculosis
HTPPPAGV

SEQ ID NO: 1368296 - protein, 9 aa, Mycobacterium tuberculosis
IDEPRPITS

SEQ ID NO: 1368297 - protein, 6 aa, Mycobacterium tuberculosis
IETADD

SEQ ID NO: 1368298 - protein, 6 aa, Mycobacterium tuberculosis
ITAAGA

SEQ ID NO: 1368299 - protein, 5 aa, Mycobacterium tuberculosis
ITGES

SEQ ID NO: 1368300 - protein, 5 aa, Mycobacterium tuberculosis
ITSGR

SEQ ID NO: 1368301 - protein, 6 aa, Mycobacterium tuberculosis
KDAGVQ

SEQ ID NO: 1368302 - protein, 15 aa, Mycobacterium tuberculosis
KLPRTGKVPTDPAQV

SEQ ID NO: 1368303 - protein, 51 aa, Mycobacterium tuberculosis; identical to SEQ ID NO: 152042

SEQ ID NO: 1368304 - protein, 6 aa, Mycobacterium tuberculosis
KPFNPK

SEQ ID NO: 1368305 - protein, 8 aa, Mycobacterium tuberculosis
KPTAGTGA

SEQ ID NO: 1368306 - protein, 9 aa, Mycobacterium tuberculosis
KPTSTVKDG

SEQ ID NO: 1368307 - protein, 16 aa, Mycobacterium tuberculosis
KTKKTPAGDAVNDYRA

SEQ ID NO: 1368308 - protein, 8 aa, Mycobacterium tuberculosis
KWSPPGGH

SEQ ID NO: 1368309 - protein, 46 aa, Mycobacterium tuberculosis; identical to SEQ ID NO: 152112

SEQ ID NO: 1368310 - protein, 4 aa, Mycobacterium tuberculosis
LAPQ

SEQ ID NO: 1368311 - protein, 5 aa, Mycobacterium tuberculosis
LAQSR

SEQ ID NO: 1368312 - protein, 6 aa, Mycobacterium tuberculosis
LAQTGY

SEQ ID NO: 1368313 - protein, 6 aa, Mycobacterium tuberculosis
LQTGTG

SEQ ID NO: 1368314 - protein, 5 aa, Mycobacterium tuberculosis
LRAES

SEQ ID NO: 1368315 - protein, 4 aa, Mycobacterium tuberculosis
LRES

SEQ ID NO: 1368316 - protein, 5 aa, Mycobacterium tuberculosis
LTGLP

SEQ ID NO: 1368317 - protein, 12 aa, Mycobacterium tuberculosis
LTSAGQPSKFSM

SEQ ID NO: 1368318 - protein, 10 aa, Mycobacterium tuberculosis
LTTSEQHQAT

SEQ ID NO: 1368319 - protein, 10 aa, Mycobacterium tuberculosis
MNGEAGSYLE

SEQ ID NO: 1368320 - protein, 24 aa, Mycobacterium tuberculosis
NAQLSNCSDGAAQLESCGTAPDLK

SEQ ID NO: 1368321 - protein, 5 aa, Mycobacterium tuberculosis
NTTRK

SEQ ID NO: 1368322 - protein, 10 aa, Mycobacterium tuberculosis
PADPRPKRQR

SEQ ID NO: 1368323 - protein, 4 aa, Mycobacterium tuberculosis
PAGA

SEQ ID NO: 1368324 - protein, 6 aa, Mycobacterium tuberculosis
PARRGE

SEQ ID NO: 1368325 - protein, 7 aa, Mycobacterium tuberculosis
PARRGFS

SEQ ID NO: 1368326 - protein, 4 aa, Mycobacterium tuberculosis
PEDS

SEQ ID NO: 1368327 - protein, 4 aa, Mycobacterium tuberculosis
PEQR

SEQ ID NO: 1368328 - protein, 9 aa, Mycobacterium tuberculosis
PERRSGIPA

SEQ ID NO: 1368329 - protein, 6 aa, Mycobacterium tuberculosis
PESQRP

SEQ ID NO: 1368330 - protein, 5 aa, Mycobacterium tuberculosis
PETLG

SEQ ID NO: 1368331 - protein, 16 aa, Mycobacterium tuberculosis
PKRMPPSRKARRQRHA

SEQ ID NO: 1368332 - protein, 6 aa, Mycobacterium tuberculosis
PLGTPI

SEQ ID NO: 1368333 - protein, 7 aa, Mycobacterium tuberculosis
PPGPAAV

SEQ ID NO: 1368334 - protein, 15 aa, Mycobacterium tuberculosis
PPKTPSPKPLSPNAH

SEQ ID NO: 1368335 - protein, 5 aa, Mycobacterium tuberculosis
PPLDE

SEQ ID NO: 1368336 - protein, 5 aa, Mycobacterium tuberculosis
PPPDQ

SEQ ID NO: 1368337 - protein, 69 aa, Mycobacterium tuberculosis
PPPPPPPGPSGGHEPPPAAPPGGSGYAPPPPPSSGSGYPPPPPPPGGGAYPPPPPSAGGYAPPPPGPAI

SEQ ID NO: 1368338 - protein, 5 aa, Mycobacterium tuberculosis
PRSAT

SEQ ID NO: 1368339 - protein, 9 aa, Mycobacterium tuberculosis
PSGVAVDSA

SEQ ID NO: 1368340 - protein, 4 aa, Mycobacterium tuberculosis
PTDP

SEQ ID NO: 1368341 - protein, 15 aa, Mycobacterium tuberculosis
PTPVGEGGHRGSTGF

SEQ ID NO: 1368342 - protein, 61 aa, Mycobacterium tuberculosis
PYPATPPGYGPPGYGAPPSYGPPPGYGPPLGYPAAPPGCGPPPGYGPPLGYGPPVAPGAVK

SEQ ID NO: 1368343 - protein, 7 aa, Mycobacterium tuberculosis
QAESGAH

SEQ ID NO: 1368344 - protein, 5 aa, Mycobacterium tuberculosis
QGGTT

SEQ ID NO: 1368345 - protein, 9 aa, Mycobacterium tuberculosis
QLDDQRQAE

SEQ ID NO: 1368346 - protein, 10 aa, Mycobacterium tuberculosis
QLNQQRAQTS

SEQ ID NO: 1368347 - protein, 4 aa, Mycobacterium tuberculosis
QNTT

SEQ ID NO: 1368348 - protein, 16 aa, Mycobacterium tuberculosis
QPGRTYDVSSPDLPTV

SEQ ID NO: 1368349 - protein, 5 aa, Mycobacterium tuberculosis
QPKDE

SEQ ID NO: 1368350 - protein, 6 aa, Mycobacterium tuberculosis
QPQLAA

SEQ ID NO: 1368351 - protein, 8 aa, Mycobacterium tuberculosis
QQPLDTRD

SEQ ID NO: 1368352 - protein, 5 aa, Mycobacterium tuberculosis
QRDRA

SEQ ID NO: 1368353 - protein, 5 aa, Mycobacterium tuberculosis
QRPFG

SEQ ID NO: 1368354 - protein, 22 aa, Mycobacterium tuberculosis
QRSHDRPASLDNPRSPRRRAGM

SEQ ID NO: 1368355 - protein, 9 aa, Mycobacterium tuberculosis
QSAIGTPTE

SEQ ID NO: 1368356 - protein, 5 aa, Mycobacterium tuberculosis
QSALG

SEQ ID NO: 1368357 - protein, 6 aa, Mycobacterium tuberculosis
RANPEV

SEQ ID NO: 1368358 - protein, 15 aa, Mycobacterium tuberculosis
RASGPDSGGKARFVP

SEQ ID NO: 1368359 - protein, 12 aa, Mycobacterium tuberculosis
RCDQPVKPGQVI

SEQ ID NO: 1368360 - protein, 4 aa, Mycobacterium tuberculosis
RCES

SEQ ID NO: 1368361 - protein, 17 aa, Mycobacterium tuberculosis
RDQDKDGVGSAGIDPDG

SEQ ID NO: 1368362 - protein, 7 aa, Mycobacterium tuberculosis
RDSLRRA

SEQ ID NO: 1368363 - protein, 13 aa, Mycobacterium tuberculosis
REAREAIKGTPLQ

SEQ ID NO: 1368364 - protein, 9 aa, Mycobacterium tuberculosis
RGRVDNDAT

SEQ ID NO: 1368365 - protein, 7 aa, Mycobacterium tuberculosis
RLAEGKT

SEQ ID NO: 1368366 - protein, 4 aa, Mycobacterium tuberculosis
RMED

SEQ ID NO: 1368367 - protein, 41 aa, Mycobacterium tuberculosis
RPDDNPKRNIATSPGTPTTTATTSLPATTTPTTAPASDPQT

SEQ ID NO: 1368368 - protein, 5 aa, Mycobacterium tuberculosis
RPPEV

SEQ ID NO: 1368369 - protein, 11 aa, Mycobacterium tuberculosis
RQGTTGSSIGK

SEQ ID NO: 1368370 - protein, 6 aa, Mycobacterium tuberculosis
RRGGDV

SEQ ID NO: 1368371 - protein, 27 aa, Mycobacterium tuberculosis
RRGRAQRTKRKPLLPKEEEEQSPPDDD

SEQ ID NO: 1368372 - protein, 10 aa, Mycobacterium tuberculosis
RRPSGRSTDF

SEQ ID NO: 1368373 - protein, 12 aa, Mycobacterium tuberculosis
RVAPAERCQTPQ

SEQ ID NO: 1368374 - protein, 4 aa, Mycobacterium tuberculosis
SAPR

SEQ ID NO: 1368375 - protein, 11 aa, Mycobacterium tuberculosis
SARGKDRGSAS

SEQ ID NO: 1368376 - protein, 11 aa, Mycobacterium tuberculosis
SDIGNGRGPVD

SEQ ID NO: 1368377 - protein, 10 aa, Mycobacterium tuberculosis
SDNASANGTY

SEQ ID NO: 1368378 - protein, 21 aa, Mycobacterium tuberculosis
SGAPRGPANPGQRGQVPPDDR

SEQ ID NO: 1368379 - protein, 4 aa, Mycobacterium tuberculosis
SNDG

SEQ ID NO: 1368380 - protein, 6 aa, Mycobacterium tuberculosis
SNDTKH

SEQ ID NO: 1368381 - protein, 12 aa, Mycobacterium tuberculosis
SPPGWTQQKTER

SEQ ID NO: 1368382 - protein, 10 aa, Mycobacterium tuberculosis
SRLPGDRVGN

SEQ ID NO: 1368383 - protein, 9 aa, Mycobacterium tuberculosis
SSPNTPGLR

SEQ ID NO: 1368384 - protein, 21 aa, Mycobacterium tuberculosis
SSSLSGDRRTYQQEPGNAAEA

SEQ ID NO: 1368385 - protein, 20 aa, Mycobacterium tuberculosis
STQADQRIDSLSGGQRKRTS

SEQ ID NO: 1368386 - protein, 4 aa, Mycobacterium tuberculosis
SVDP

SEQ ID NO: 1368387 - protein, 8 aa, Mycobacterium tuberculosis
TAAGRKGY

SEQ ID NO: 1368388 - protein, 13 aa, Mycobacterium tuberculosis
TAAGSQSTDGKAA

SEQ ID NO: 1368389 - protein, 10 aa, Mycobacterium tuberculosis
TAASSDLSSV

SEQ ID NO: 1368390 - protein, 8 aa, Mycobacterium tuberculosis
TAGGGSDM

SEQ ID NO: 1368391 - protein, 6 aa, Mycobacterium tuberculosis
TALGSG

SEQ ID NO: 1368392 - protein, 5 aa, Mycobacterium tuberculosis
TAPAN

SEQ ID NO: 1368393 - protein, 10 aa, Mycobacterium tuberculosis
TAPAPQGPWS

SEQ ID NO: 1368394 - protein, 6 aa, Mycobacterium tuberculosis
TAQGTL

SEQ ID NO: 1368395 - protein, 14 aa, Mycobacterium tuberculosis
TEDPAGRKADREGL

SEQ ID NO: 1368396 - protein, 37 aa, Mycobacterium tuberculosis; identical to SEQ ID NO: 154557

SEQ ID NO: 1368397 - protein, 37 aa, Mycobacterium tuberculosis; identical to SEQ ID NO: 154639

SEQ ID NO: 1368398 - protein, 5 aa, Mycobacterium tuberculosis
TRPWT

SEQ ID NO: 1368399 - protein, 6 aa, Mycobacterium tuberculosis
TSEAVD

SEQ ID NO: 1368400 - protein, 5 aa, Mycobacterium tuberculosis
TVGQL

SEQ ID NO: 1368401 - protein, 20 aa, Mycobacterium tuberculosis
TYAPHRERGESEHSIPAGPH

SEQ ID NO: 1368402 - protein, 34 aa, Mycobacterium tuberculosis
VAGPGDDPAEPDGIRRQDDFSSRRRRWWRLRRRR

SEQ ID NO: 1368403 - protein, 17 aa, Mycobacterium tuberculosis
VAHDRDGVTVRAGGSAM

SEQ ID NO: 1368404 - protein, 12 aa, Mycobacterium tuberculosis
VAKGGSYATSSA

SEQ ID NO: 1368405 - protein, 12 aa, Mycobacterium tuberculosis
VAQSSPDDPSLQ

SEQ ID NO: 1368406 - protein, 8 aa, Mycobacterium tuberculosis
VDERNQRI

SEQ ID NO: 1368407 - protein, 6 aa, Mycobacterium tuberculosis
VDGHST

SEQ ID NO: 1368408 - protein, 28 aa, Mycobacterium tuberculosis
VETRDPNATLRPGSPSNPAAPGSVGNSW

SEQ ID NO: 1368409 - protein, 10 aa, Mycobacterium tuberculosis
VGSGPTIGGV

SEQ ID NO: 1368410 - protein, 10 aa, Mycobacterium tuberculosis
VGSKGTAKVT

SEQ ID NO: 1368411 - protein, 9 aa, Mycobacterium tuberculosis
VQNTRDREY

SEQ ID NO: 1368412 - protein, 15 aa, Mycobacterium tuberculosis
VRERASGLRSDARTT

SEQ ID NO: 1368413 - protein, 6 aa, Mycobacterium tuberculosis
VRPDQK

SEQ ID NO: 1368414 - protein, 8 aa, Mycobacterium tuberculosis
VSKDNGQT

SEQ ID NO: 1368415 - protein, 4 aa, Mycobacterium tuberculosis
VVAP

SEQ ID NO: 1368416 - protein, 10 aa, Mycobacterium tuberculosis
WQQQPTQEAT

SEQ ID NO: 1368417 - protein, 8 aa, Mycobacterium tuberculosis
YAAQDRET

SEQ ID NO: 1368418 - protein, 10 aa, Mycobacterium tuberculosis
YDQSTEDKIN

SEQ ID NO: 1368419 - protein, 23 aa, Mycobacterium tuberculosis
YEPTYEPQRRRARPSEPTNPTHH

SEQ ID NO: 1368420 - protein, 12 aa, Mycobacterium tuberculosis
YRSDGFKRLDVA

SEQ ID NO: 1368421 - protein, 9 aa, Mycobacterium tuberculosis
AAAGQDAQR

SEQ ID NO: 1368422 - protein, 8 aa, Mycobacterium tuberculosis
AAARTGAI

SEQ ID NO: 1368423 - protein, 4 aa, Mycobacterium tuberculosis
AAAS

SEQ ID NO: 1368424 - protein, 6 aa, Mycobacterium tuberculosis
AAASGF

SEQ ID NO: 1368425 - protein, 8 aa, Mycobacterium tuberculosis
AADAAHRA

SEQ ID NO: 1368426 - protein, 9 aa, Mycobacterium tuberculosis
AADRATTSN

SEQ ID NO: 1368427 - protein, 15 aa, Mycobacterium tuberculosis
AAEAADKPVQSRTDY

SEQ ID NO: 1368428 - protein, 7 aa, Mycobacterium tuberculosis
AAEDAAL

SEQ ID NO: 1368429 - protein, 14 aa, Mycobacterium tuberculosis
AAERERSKLGGEER

SEQ ID NO: 1368430 - protein, 24 aa, Mycobacterium tuberculosis
AAESASKTPATRRPTAAPDAYADS

SEQ ID NO: 1368431 - protein, 7 aa, Mycobacterium tuberculosis
AAGLSEG

SEQ ID NO: 1368432 - protein, 5 aa, Mycobacterium tuberculosis
AAGRA

SEQ ID NO: 1368433 - protein, 6 aa, Mycobacterium tuberculosis
AAGRPN

SEQ ID NO: 1368434 - protein, 4 aa, Mycobacterium tuberculosis
AAGT

SEQ ID NO: 1368435 - protein, 5 aa, Mycobacterium tuberculosis
AAKPL

SEQ ID NO: 1368436 - protein, 6 aa, Mycobacterium tuberculosis
AAKPST

SEQ ID NO: 1368437 - protein, 8 aa, Mycobacterium tuberculosis
AAPTADQV

SEQ ID NO: 1368438 - protein, 9 aa, Mycobacterium tuberculosis
AAPTADQVN

SEQ ID NO: 1368439 - protein, 16 aa, Mycobacterium tuberculosis
AAQHRSTAESYAAEGN

SEQ ID NO: 1368440 - protein, 4 aa, Mycobacterium tuberculosis
AARD

SEQ ID NO: 1368441 - protein, 4 aa, Mycobacterium tuberculosis
AARR

SEQ ID NO: 1368442 - protein, 8 aa, Mycobacterium tuberculosis
AARTAGAD

SEQ ID NO: 1368443 - protein, 9 aa, Mycobacterium tuberculosis
AARTDGASA

SEQ ID NO: 1368444 - protein, 14 aa, Mycobacterium tuberculosis
AASDPGLTQTGTAV

SEQ ID NO: 1368445 - protein, 9 aa, Mycobacterium tuberculosis
AASPMGDAE

SEQ ID NO: 1368446 - protein, 11 aa, Mycobacterium tuberculosis
AATGGPPPSLS

SEQ ID NO: 1368447 - protein, 10 aa, Mycobacterium tuberculosis
AATGRAPASY

SEQ ID NO: 1368448 - protein, 11 aa, Mycobacterium tuberculosis
AATSSTPREAP

SEQ ID NO: 1368449 - protein, 6 aa, Mycobacterium tuberculosis
AATTLP

SEQ ID NO: 1368450 - protein, 29 aa, Mycobacterium tuberculosis
AAVGESADEADAEAADGVAGHADPEADPV

SEQ ID NO: 1368451 - protein, 9 aa, Mycobacterium tuberculosis
ADARPNASM

SEQ ID NO: 1368452 - protein, 8 aa, Mycobacterium tuberculosis
ADEVSNQK

SEQ ID NO: 1368453 - protein, 4 aa, Mycobacterium tuberculosis
ADGG

SEQ ID NO: 1368454 - protein, 20 aa, Mycobacterium tuberculosis
ADPQPSDLGDQSPGADAQAK

SEQ ID NO: 1368455 - protein, 7 aa, Mycobacterium tuberculosis
ADPRSRT

SEQ ID NO: 1368456 - protein, 10 aa, Mycobacterium tuberculosis
ADQAVSGRQA

SEQ ID NO: 1368457 - protein, 8 aa, Mycobacterium tuberculosis
ADQYPEAV

SEQ ID NO: 1368458 - protein, 11 aa, Mycobacterium tuberculosis
AEAQDELAEVS

SEQ ID NO: 1368459 - protein, 4 aa, Mycobacterium tuberculosis
AEDE

SEQ ID NO: 1368460 - protein, 10 aa, Mycobacterium tuberculosis
AEDIDTRYHP

SEQ ID NO: 1368461 - protein, 4 aa, Mycobacterium tuberculosis
AEHG

SEQ ID NO: 1368462 - protein, 4 aa, Mycobacterium tuberculosis
AEHT

SEQ ID NO: 1368463 - protein, 16 aa, Mycobacterium tuberculosis
AEIPATAKSAALGRQL

SEQ ID NO: 1368464 - protein, 4 aa, Mycobacterium tuberculosis
AEPA

SEQ ID NO: 1368465 - protein, 7 aa, Mycobacterium tuberculosis
AEPATCT

SEQ ID NO: 1368466 - protein, 9 aa, Mycobacterium tuberculosis
AEPRSALSD

SEQ ID NO: 1368467 - protein, 17 aa, Mycobacterium tuberculosis
AEQESTGIDEAEHAESG

SEQ ID NO: 1368468 - protein, 15 aa, Mycobacterium tuberculosis
AEQTRSIDAGDEAPR

SEQ ID NO: 1368469 - protein, 6 aa, Mycobacterium tuberculosis
AERAGM

SEQ ID NO: 1368470 - protein, 4 aa, Mycobacterium tuberculosis
AERR

SEQ ID NO: 1368471 - protein, 9 aa, Mycobacterium tuberculosis
AERVARTDD

SEQ ID NO: 1368472 - protein, 7 aa, Mycobacterium tuberculosis
AESALGQ

SEQ ID NO: 1368473 - protein, 10 aa, Mycobacterium tuberculosis
AESITAKEHP

SEQ ID NO: 1368474 - protein, 4 aa, Mycobacterium tuberculosis
AEST

SEQ ID NO: 1368475 - protein, 9 aa, Mycobacterium tuberculosis
AEYASAAQE

SEQ ID NO: 1368476 - protein, 9 aa, Mycobacterium tuberculosis
AGADATSTV

SEQ ID NO: 1368477 - protein, 5 aa, Mycobacterium tuberculosis
AGAEA

SEQ ID NO: 1368478 - protein, 10 aa, Mycobacterium tuberculosis
AGAVSADGKA

SEQ ID NO: 1368479 - protein, 11 aa, Mycobacterium tuberculosis
AGDEDGKVTTS

SEQ ID NO: 1368480 - protein, 6 aa, Mycobacterium tuberculosis
AGFNPE

SEQ ID NO: 1368481 - protein, 6 aa, Mycobacterium tuberculosis
AGGDIK

SEQ ID NO: 1368482 - protein, 10 aa, Mycobacterium tuberculosis
AGGGTEDAAG

SEQ ID NO: 1368483 - protein, 18 aa, Mycobacterium tuberculosis
AGGSEVDQATVTGEPLPV

SEQ ID NO: 1368484 - protein, 12 aa, Mycobacterium tuberculosis
AGHRSADGRRGV

SEQ ID NO: 1368485 - protein, 14 aa, Mycobacterium tuberculosis
AGNDGEAGCGNNPM

SEQ ID NO: 1368486 - protein, 7 aa, Mycobacterium tuberculosis
AGNKGIA

SEQ ID NO: 1368487 - protein, 20 aa, Mycobacterium tuberculosis
AGNTGGAAQCPPQAPGVTRD

SEQ ID NO: 1368488 - protein, 24 aa, Mycobacterium tuberculosis
AGPGTPARPAHSDSLTAQAERGIE

SEQ ID NO: 1368489 - protein, 14 aa, Mycobacterium tuberculosis
AGPHAGDRSPSRTV

SEQ ID NO: 1368490 - protein, 7 aa, Mycobacterium tuberculosis
AGPTRRR

SEQ ID NO: 1368491 - protein, 4 aa, Mycobacterium tuberculosis
AGRH

SEQ ID NO: 1368492 - protein, 8 aa, Mycobacterium tuberculosis
AGSADGAG

SEQ ID NO: 1368493 - protein, 4 aa, Mycobacterium tuberculosis
AGST

SEQ ID NO: 1368494 - protein, 13 aa, Mycobacterium tuberculosis
AGSVATDSATPGI

SEQ ID NO: 1368495 - protein, 4 aa, Mycobacterium tuberculosis
AGTM

SEQ ID NO: 1368496 - protein, 5 aa, Mycobacterium tuberculosis
AGTTL

SEQ ID NO: 1368497 - protein, 7 aa, Mycobacterium tuberculosis
AGTTPSR

SEQ ID NO: 1368498 - protein, 11 aa, Mycobacterium tuberculosis
AHEADPDGALR

SEQ ID NO: 1368499 - protein, 11 aa, Mycobacterium tuberculosis
AHGGPAGVGEA

SEQ ID NO: 1368500 - protein, 4 aa, Mycobacterium tuberculosis
AHPE

SEQ ID NO: 1368501 - protein, 5 aa, Mycobacterium tuberculosis
AHQSG

SEQ ID NO: 1368502 - protein, 6 aa, Mycobacterium tuberculosis
AIGPGT

SEQ ID NO: 1368503 - protein, 9 aa, Mycobacterium tuberculosis
AKDDNSASY

SEQ ID NO: 1368504 - protein, 11 aa, Mycobacterium tuberculosis
AKGAQPNTSLA

SEQ ID NO: 1368505 - protein, 12 aa, Mycobacterium tuberculosis
AKGPRSAGTMGT

SEQ ID NO: 1368506 - protein, 8 aa, Mycobacterium tuberculosis
AKNAKVST

SEQ ID NO: 1368507 - protein, 7 aa, Mycobacterium tuberculosis
AKNPEDR

SEQ ID NO: 1368508 - protein, 14 aa, Mycobacterium tuberculosis
AKPKNSKDTGPALD

SEQ ID NO: 1368509 - protein, 5 aa, Mycobacterium tuberculosis
AKQNG

SEQ ID NO: 1368510 - protein, 12 aa, Mycobacterium tuberculosis
ALAGSLSSQGDS

SEQ ID NO: 1368511 - protein, 6 aa, Mycobacterium tuberculosis
ALNDPY

SEQ ID NO: 1368512 - protein, 5 aa, Mycobacterium tuberculosis
ALPTE

SEQ ID NO: 1368513 - protein, 11 aa, Mycobacterium tuberculosis
ALPTGREELAD

SEQ ID NO: 1368514 - protein, 7 aa, Mycobacterium tuberculosis
ALRPGHN

SEQ ID NO: 1368515 - protein, 7 aa, Mycobacterium tuberculosis
ALSADGR

SEQ ID NO: 1368516 - protein, 6 aa, Mycobacterium tuberculosis
AMASGT

SEQ ID NO: 1368517 - protein, 30 aa, Mycobacterium tuberculosis; identical to SEQ ID NO: 149821

SEQ ID NO: 1368518 - protein, 8 aa, Mycobacterium tuberculosis
ANGGPETA

SEQ ID NO: 1368519 - protein, 4 aa, Mycobacterium tuberculosis
ANGR

SEQ ID NO: 1368520 - protein, 18 aa, Mycobacterium tuberculosis
ANRAGSVQWGPSDTYQAT

SEQ ID NO: 1368521 - protein, 4 aa, Mycobacterium tuberculosis
APAP

SEQ ID NO: 1368522 - protein, 25 aa, Mycobacterium tuberculosis
APEPEPSGRGPKVPDDADDQQDTEA

SEQ ID NO: 1368523 - protein, 11 aa, Mycobacterium tuberculosis
APGDPTPSAPP

SEQ ID NO: 1368524 - protein, 11 aa, Mycobacterium tuberculosis
APHDVSQDNQI

SEQ ID NO: 1368525 - protein, 16 aa, Mycobacterium tuberculosis
APPAPVPANGEQFGPV

SEQ ID NO: 1368526 - protein, 9 aa, Mycobacterium tuberculosis
APPSGQPRV

SEQ ID NO: 1368527 - protein, 16 aa, Mycobacterium tuberculosis
APPVDRSHTGPLQPPK

SEQ ID NO: 1368528 - protein, 8 aa, Mycobacterium tuberculosis
APRARRSI

SEQ ID NO: 1368529 - protein, 65 aa, Mycobacterium tuberculosis
APRQPPAPPVTPPGVQPAPKPSYTPPAQPGPAGQRPGPTGQPSWAPNSGPMPASGPTPTPQYYQG

SEQ ID NO: 1368530 - protein, 7 aa, Mycobacterium tuberculosis
APRRQHS

SEQ ID NO: 1368531 - protein, 6 aa, Mycobacterium tuberculosis
APSAGE

SEQ ID NO: 1368532 - protein, 6 aa, Mycobacterium tuberculosis
APSLSQ

SEQ ID NO: 1368533 - protein, 6 aa, Mycobacterium tuberculosis
APSPLL

SEQ ID NO: 1368534 - protein, 14 aa, Mycobacterium tuberculosis
APTKLTSPGINGST

SEQ ID NO: 1368535 - protein, 8 aa, Mycobacterium tuberculosis
APVGPDPL

SEQ ID NO: 1368536 - protein, 6 aa, Mycobacterium tuberculosis
AQAATA

SEQ ID NO: 1368537 - protein, 5 aa, Mycobacterium tuberculosis
AQALR

SEQ ID NO: 1368538 - protein, 4 aa, Mycobacterium tuberculosis
AQII

SEQ ID NO: 1368539 - protein, 6 aa, Mycobacterium tuberculosis
AQPLGI

SEQ ID NO: 1368540 - protein, 10 aa, Mycobacterium tuberculosis
AQPQLAAQPA

SEQ ID NO: 1368541 - protein, 8 aa, Mycobacterium tuberculosis
AQRRRARR

SEQ ID NO: 1368542 - protein, 5 aa, Mycobacterium tuberculosis
ARAQQ

SEQ ID NO: 1368543 - protein, 5 aa, Mycobacterium tuberculosis
ARDAA

SEQ ID NO: 1368544 - protein, 7 aa, Mycobacterium tuberculosis
AREAGRI

SEQ ID NO: 1368545 - protein, 6 aa, Mycobacterium tuberculosis
ARGTAI

SEQ ID NO: 1368546 - protein, 10 aa, Mycobacterium tuberculosis
ARNAGTSDVA

SEQ ID NO: 1368547 - protein, 8 aa, Mycobacterium tuberculosis
ARNPADRY

SEQ ID NO: 1368548 - protein, 5 aa, Mycobacterium tuberculosis
ARPGT

SEQ ID NO: 1368549 - protein, 6 aa, Mycobacterium tuberculosis
ARQAQQ

SEQ ID NO: 1368550 - protein, 10 aa, Mycobacterium tuberculosis
ARRGQEVNAN

SEQ ID NO: 1368551 - protein, 6 aa, Mycobacterium tuberculosis
ARSELT

SEQ ID NO: 1368552 - protein, 6 aa, Mycobacterium tuberculosis
ARVGPR

SEQ ID NO: 1368553 - protein, 5 aa, Mycobacterium tuberculosis
ARYQD

SEQ ID NO: 1368554 - protein, 41 aa, Mycobacterium tuberculosis; identical to SEQ ID NO: 150054

SEQ ID NO: 1368555 - protein, 9 aa, Mycobacterium tuberculosis
ASGLDAAGV

SEQ ID NO: 1368556 - protein, 15 aa, Mycobacterium tuberculosis
ASGPQDYANIPPTRF

SEQ ID NO: 1368557 - protein, 6 aa, Mycobacterium tuberculosis
ASGRVQ

SEQ ID NO: 1368558 - protein, 12 aa, Mycobacterium tuberculosis
ASINHGNSGGPL

SEQ ID NO: 1368559 - protein, 8 aa, Mycobacterium tuberculosis
ASKTGTPS

SEQ ID NO: 1368560 - protein, 19 aa, Mycobacterium tuberculosis
ASPADPPPPDASASHSPVD

SEQ ID NO: 1368561 - protein, 6 aa, Mycobacterium tuberculosis
ASPATR

SEQ ID NO: 1368562 - protein, 6 aa, Mycobacterium tuberculosis
ASPGFR

SEQ ID NO: 1368563 - protein, 14 aa, Mycobacterium tuberculosis
ASRQLPAPTTGAGW

SEQ ID NO: 1368564 - protein, 25 aa, Mycobacterium tuberculosis
ASRRPELGASPRAGASRAVKPRPEW

SEQ ID NO: 1368565 - protein, 6 aa, Mycobacterium tuberculosis
ASSDQL

SEQ ID NO: 1368566 - protein, 6 aa, Mycobacterium tuberculosis
ASSGQR

SEQ ID NO: 1368567 - protein, 15 aa, Mycobacterium tuberculosis
ASSLRDNARADGRKV

SEQ ID NO: 1368568 - protein, 5 aa, Mycobacterium tuberculosis
ASTSG

SEQ ID NO: 1368569 - protein, 8 aa, Mycobacterium tuberculosis
ATAAPKTY

SEQ ID NO: 1368570 - protein, 9 aa, Mycobacterium tuberculosis
ATAKGLSRP

SEQ ID NO: 1368571 - protein, 8 aa, Mycobacterium tuberculosis
ATARTRRG

SEQ ID NO: 1368572 - protein, 6 aa, Mycobacterium tuberculosis
ATDRYR

SEQ ID NO: 1368573 - protein, 5 aa, Mycobacterium tuberculosis
ATERV

SEQ ID NO: 1368574 - protein, 12 aa, Mycobacterium tuberculosis
ATGGEYGTSATY

SEQ ID NO: 1368575 - protein, 7 aa, Mycobacterium tuberculosis
ATGTSQG

SEQ ID NO: 1368576 - protein, 9 aa, Mycobacterium tuberculosis
ATLAEGAAT

SEQ ID NO: 1368577 - protein, 4 aa, Mycobacterium tuberculosis
ATLE

SEQ ID NO: 1368578 - protein, 6 aa, Mycobacterium tuberculosis
ATPGVP

SEQ ID NO: 1368579 - protein, 5 aa, Mycobacterium tuberculosis
ATPRS

SEQ ID NO: 1368580 - protein, 7 aa, Mycobacterium tuberculosis
ATQLTGG

SEQ ID NO: 1368581 - protein, 6 aa, Mycobacterium tuberculosis
ATQPGC

SEQ ID NO: 1368582 - protein, 6 aa, Mycobacterium tuberculosis
ATSTTI

SEQ ID NO: 1368583 - protein, 5 aa, Mycobacterium tuberculosis
ATTGL

SEQ ID NO: 1368584 - protein, 5 aa, Mycobacterium tuberculosis
ATTQM

SEQ ID NO: 1368585 - protein, 9 aa, Mycobacterium tuberculosis
AVAASKPAY

SEQ ID NO: 1368586 - protein, 5 aa, Mycobacterium tuberculosis
AVADR

SEQ ID NO: 1368587 - protein, 8 aa, Mycobacterium tuberculosis
AVGPVDDD

SEQ ID NO: 1368588 - protein, 7 aa, Mycobacterium tuberculosis
AVSAGQR

SEQ ID NO: 1368589 - protein, 10 aa, Mycobacterium tuberculosis
AVTPSTTATL

SEQ ID NO: 1368590 - protein, 7 aa, Mycobacterium tuberculosis
AYSDSYN

SEQ ID NO: 1368591 - protein, 4 aa, Mycobacterium tuberculosis
AYSG

SEQ ID NO: 1368592 - protein, 13 aa, Mycobacterium tuberculosis
AYVPGGTNPWYGD

SEQ ID NO: 1368593 - protein, 7 aa, Mycobacterium tuberculosis
CAPPGAL

SEQ ID NO: 1368594 - protein, 6 aa, Mycobacterium tuberculosis
CASATA

SEQ ID NO: 1368595 - protein, 8 aa, Mycobacterium tuberculosis
CGSTRDGY

SEQ ID NO: 1368596 - protein, 5 aa, Mycobacterium tuberculosis
CHDSA

SEQ ID NO: 1368597 - protein, 7 aa, Mycobacterium tuberculosis
CRTGADA

SEQ ID NO: 1368598 - protein, 8 aa, Mycobacterium tuberculosis
CSSPRAGL

SEQ ID NO: 1368599 - protein, 4 aa, Mycobacterium tuberculosis
DAAA

SEQ ID NO: 1368600 - protein, 4 aa, Mycobacterium tuberculosis
DAAN

SEQ ID NO: 1368601 - protein, 4 aa, Mycobacterium tuberculosis
DAEA

SEQ ID NO: 1368602 - protein, 32 aa, Mycobacterium tuberculosis; identical to SEQ ID NO: 150267

SEQ ID NO: 1368603 - protein, 34 aa, Mycobacterium tuberculosis; identical to SEQ ID NO: 150279

SEQ ID NO: 1368604 - protein, 4 aa, Mycobacterium tuberculosis
DATG

SEQ ID NO: 1368605 - protein, 6 aa, Mycobacterium tuberculosis
DDAETR

SEQ ID NO: 1368606 - protein, 13 aa, Mycobacterium tuberculosis
DDAGDGSAWSAAN

SEQ ID NO: 1368607 - protein, 7 aa, Mycobacterium tuberculosis
DDEAAAK

SEQ ID NO: 1368608 - protein, 7 aa, Mycobacterium tuberculosis
DDGRAGM

SEQ ID NO: 1368609 - protein, 37 aa, Mycobacterium tuberculosis; identical to SEQ ID NO: 150298

SEQ ID NO: 1368610 - protein, 4 aa, Mycobacterium tuberculosis
DDVE

SEQ ID NO: 1368611 - protein, 17 aa, Mycobacterium tuberculosis
DENGRMTGYDLKYPDGG

SEQ ID NO: 1368612 - protein, 5 aa, Mycobacterium tuberculosis
DFGGN

SEQ ID NO: 1368613 - protein, 5 aa, Mycobacterium tuberculosis
DGATG

SEQ ID NO: 1368614 - protein, 9 aa, Mycobacterium tuberculosis
DGDDADTVE

SEQ ID NO: 1368615 - protein, 4 aa, Mycobacterium tuberculosis
DGKA

SEQ ID NO: 1368616 - protein, 14 aa, Mycobacterium tuberculosis
DGKPIDFENPSEDA

SEQ ID NO: 1368617 - protein, 8 aa, Mycobacterium tuberculosis
DGQTRTST

SEQ ID NO: 1368618 - protein, 20 aa, Mycobacterium tuberculosis
DGRSAPASSVAVELDGQEPA

SEQ ID NO: 1368619 - protein, 7 aa, Mycobacterium tuberculosis
DGSPSYE

SEQ ID NO: 1368620 - protein, 11 aa, Mycobacterium tuberculosis
DHQTEAADQIA

SEQ ID NO: 1368621 - protein, 5 aa, Mycobacterium tuberculosis
DIADA

SEQ ID NO: 1368622 - protein, 8 aa, Mycobacterium tuberculosis
DISGAGAA

SEQ ID NO: 1368623 - protein, 5 aa, Mycobacterium tuberculosis
DISYQ

SEQ ID NO: 1368624 - protein, 7 aa, Mycobacterium tuberculosis
DKHGHTT

SEQ ID NO: 1368625 - protein, 36 aa, Mycobacterium tuberculosis; identical to SEQ ID NO: 150412

SEQ ID NO: 1368626 - protein, 10 aa, Mycobacterium tuberculosis
DKPKQRRAVR

SEQ ID NO: 1368627 - protein, 5 aa, Mycobacterium tuberculosis
DKQAE

SEQ ID NO: 1368628 - protein, 8 aa, Mycobacterium tuberculosis
DKSLPDHQ

SEQ ID NO: 1368629 - protein, 6 aa, Mycobacterium tuberculosis
DLAEPQ

SEQ ID NO: 1368630 - protein, 5 aa, Mycobacterium tuberculosis
DLGQT

SEQ ID NO: 1368631 - protein, 9 aa, Mycobacterium tuberculosis
DLGTPKSYH

SEQ ID NO: 1368632 - protein, 7 aa, Mycobacterium tuberculosis
DLPARRR

SEQ ID NO: 1368633 - protein, 8 aa, Mycobacterium tuberculosis
DLPYPEGV

SEQ ID NO: 1368634 - protein, 6 aa, Mycobacterium tuberculosis
DMDAGG

SEQ ID NO: 1368635 - protein, 12 aa, Mycobacterium tuberculosis
DNEADSADRTLS

SEQ ID NO: 1368636 - protein, 5 aa, Mycobacterium tuberculosis
DNGEA

SEQ ID NO: 1368637 - protein, 7 aa, Mycobacterium tuberculosis
DNHATAA

SEQ ID NO: 1368638 - protein, 10 aa, Mycobacterium tuberculosis
DNRKAEVNND

SEQ ID NO: 1368639 - protein, 10 aa, Mycobacterium tuberculosis
DPACASARTE

SEQ ID NO: 1368640 - protein, 11 aa, Mycobacterium tuberculosis
DPDPDAVGKSY

SEQ ID NO: 1368641 - protein, 7 aa, Mycobacterium tuberculosis
DPEDTSE

SEQ ID NO: 1368642 - protein, 6 aa, Mycobacterium tuberculosis
DPETVQ

SEQ ID NO: 1368643 - protein, 7 aa, Mycobacterium tuberculosis
DPGETTD

SEQ ID NO: 1368644 - protein, 8 aa, Mycobacterium tuberculosis
DPGVDHEH

SEQ ID NO: 1368645 - protein, 7 aa, Mycobacterium tuberculosis
DPGVTSP

SEQ ID NO: 1368646 - protein, 13 aa, Mycobacterium tuberculosis
DPIPPSARHEGLS

SEQ ID NO: 1368647 - protein, 7 aa, Mycobacterium tuberculosis
DPNDPTP

SEQ ID NO: 1368648 - protein, 14 aa, Mycobacterium tuberculosis
DPPKPVRVAPNPPI

SEQ ID NO: 1368649 - protein, 16 aa, Mycobacterium tuberculosis
DPRFGYSTSPANVPTP

SEQ ID NO: 1368650 - protein, 5 aa, Mycobacterium tuberculosis
DPRLR

SEQ ID NO: 1368651 - protein, 4 aa, Mycobacterium tuberculosis
DPSL

SEQ ID NO: 1368652 - protein, 5 aa, Mycobacterium tuberculosis
DPTEG

SEQ ID NO: 1368653 - protein, 14 aa, Mycobacterium tuberculosis
DQSPDTSRRLTDEQ

SEQ ID NO: 1368654 - protein, 4 aa, Mycobacterium tuberculosis
DRFG

SEQ ID NO: 1368655 - protein, 9 aa, Mycobacterium tuberculosis
DRGSSMSSK

SEQ ID NO: 1368656 - protein, 6 aa, Mycobacterium tuberculosis
DRNHGP

SEQ ID NO: 1368657 - protein, 12 aa, Mycobacterium tuberculosis
DRSGGYTASSGI

SEQ ID NO: 1368658 - protein, 9 aa, Mycobacterium tuberculosis
DSAGDMGAA

SEQ ID NO: 1368659 - protein, 7 aa, Mycobacterium tuberculosis
DSDGGTG

SEQ ID NO: 1368660 - protein, 7 aa, Mycobacterium tuberculosis
DSGGYNA

SEQ ID NO: 1368661 - protein, 4 aa, Mycobacterium tuberculosis
DSHA

SEQ ID NO: 1368662 - protein, 9 aa, Mycobacterium tuberculosis
DSPATAPDS

SEQ ID NO: 1368663 - protein, 10 aa, Mycobacterium tuberculosis
DSSPDGTGQL

SEQ ID NO: 1368664 - protein, 20 aa, Mycobacterium tuberculosis
DTDGYGQRGDRRPPGSEKYY

SEQ ID NO: 1368665 - protein, 4 aa, Mycobacterium tuberculosis
DTDP

SEQ ID NO: 1368666 - protein, 5 aa, Mycobacterium tuberculosis
DTDRD

SEQ ID NO: 1368667 - protein, 5 aa, Mycobacterium tuberculosis
DTEEM

SEQ ID NO: 1368668 - protein, 4 aa, Mycobacterium tuberculosis
DTID

SEQ ID NO: 1368669 - protein, 10 aa, Mycobacterium tuberculosis
DTLTQGPQQI

SEQ ID NO: 1368670 - protein, 8 aa, Mycobacterium tuberculosis
DTSRGQGW

SEQ ID NO: 1368671 - protein, 5 aa, Mycobacterium tuberculosis
DVRGQ

SEQ ID NO: 1368672 - protein, 5 aa, Mycobacterium tuberculosis
DYQPT

SEQ ID NO: 1368673 - protein, 5 aa, Mycobacterium tuberculosis
EAAKQ

SEQ ID NO: 1368674 - protein, 6 aa, Mycobacterium tuberculosis
EALTGL

SEQ ID NO: 1368675 - protein, 5 aa, Mycobacterium tuberculosis
EASAQ

SEQ ID NO: 1368676 - protein, 7 aa, Mycobacterium tuberculosis
EASPTLP

SEQ ID NO: 1368677 - protein, 5 aa, Mycobacterium tuberculosis
EATME

SEQ ID NO: 1368678 - protein, 24 aa, Mycobacterium tuberculosis
EDAEDYDDYDDYEAADQEAARSAS

SEQ ID NO: 1368679 - protein, 7 aa, Mycobacterium tuberculosis
EDSAAMG

SEQ ID NO: 1368680 - protein, 4 aa, Mycobacterium tuberculosis
EDTI

SEQ ID NO: 1368681 - protein, 6 aa, Mycobacterium tuberculosis
EELGPR

SEQ ID NO: 1368682 - protein, 6 aa, Mycobacterium tuberculosis
EENTHG

SEQ ID NO: 1368683 - protein, 4 aa, Mycobacterium tuberculosis
EEQC

SEQ ID NO: 1368684 - protein, 10 aa, Mycobacterium tuberculosis
EESSAGPRTS

SEQ ID NO: 1368685 - protein, 13 aa, Mycobacterium tuberculosis
EGERATADAVGRT

SEQ ID NO: 1368686 - protein, 9 aa, Mycobacterium tuberculosis
EGGTDHRGR

SEQ ID NO: 1368687 - protein, 7 aa, Mycobacterium tuberculosis
EGSERTF

SEQ ID NO: 1368688 - protein, 17 aa, Mycobacterium tuberculosis
EGTSDAALASAPQTTPA

SEQ ID NO: 1368689 - protein, 4 aa, Mycobacterium tuberculosis
EHGA

SEQ ID NO: 1368690 - protein, 8 aa, Mycobacterium tuberculosis
EHRHPSAN

SEQ ID NO: 1368691 - protein, 8 aa, Mycobacterium tuberculosis
EIDQTRDQ

SEQ ID NO: 1368692 - protein, 6 aa, Mycobacterium tuberculosis
EKDGVA

SEQ ID NO: 1368693 - protein, 9 aa, Mycobacterium tuberculosis
EKELDTDRP

SEQ ID NO: 1368694 - protein, 5 aa, Mycobacterium tuberculosis
ELGPR

SEQ ID NO: 1368695 - protein, 4 aa, Mycobacterium tuberculosis
ELNN

SEQ ID NO: 1368696 - protein, 6 aa, Mycobacterium tuberculosis
ELRPEA

SEQ ID NO: 1368697 - protein, 5 aa, Mycobacterium tuberculosis
ELTPG

SEQ ID NO: 1368698 - protein, 8 aa, Mycobacterium tuberculosis
ENTATARQ

SEQ ID NO: 1368699 - protein, 10 aa, Mycobacterium tuberculosis
EPPIPQPAAA

SEQ ID NO: 1368700 - protein, 8 aa, Mycobacterium tuberculosis
EPPYRGGP

SEQ ID NO: 1368701 - protein, 19 aa, Mycobacterium tuberculosis
EPQGWKSEERAGDRTVADR

SEQ ID NO: 1368702 - protein, 12 aa, Mycobacterium tuberculosis
EPTLTPRASLGR

SEQ ID NO: 1368703 - protein, 9 aa, Mycobacterium tuberculosis
ERDRARMTQ

SEQ ID NO: 1368704 - protein, 12 aa, Mycobacterium tuberculosis
ERDTGSLSGGEL

SEQ ID NO: 1368705 - protein, 5 aa, Mycobacterium tuberculosis
EREST

SEQ ID NO: 1368706 - protein, 10 aa, Mycobacterium tuberculosis
ERIDADTGLT

SEQ ID NO: 1368707 - protein, 19 aa, Mycobacterium tuberculosis
ERIGEESPTPAISDLHDHD

SEQ ID NO: 1368708 - protein, 7 aa, Mycobacterium tuberculosis
ERRTAPF

SEQ ID NO: 1368709 - protein, 6 aa, Mycobacterium tuberculosis
ESGMST

SEQ ID NO: 1368710 - protein, 18 aa, Mycobacterium tuberculosis
ESIETAATGQPRPASGAY

SEQ ID NO: 1368711 - protein, 6 aa, Mycobacterium tuberculosis
ESSRGY

SEQ ID NO: 1368712 - protein, 6 aa, Mycobacterium tuberculosis
ETAAGV

SEQ ID NO: 1368713 - protein, 5 aa, Mycobacterium tuberculosis
ETARF

SEQ ID NO: 1368714 - protein, 13 aa, Mycobacterium tuberculosis
ETCNGDSARRSGN

SEQ ID NO: 1368715 - protein, 8 aa, Mycobacterium tuberculosis
ETEAASRT

SEQ ID NO: 1368716 - protein, 7 aa, Mycobacterium tuberculosis
ETNRAPF

SEQ ID NO: 1368717 - protein, 16 aa, Mycobacterium tuberculosis
ETPPQPPTGGAAAEIP

SEQ ID NO: 1368718 - protein, 6 aa, Mycobacterium tuberculosis
ETTREV

SEQ ID NO: 1368719 - protein, 13 aa, Mycobacterium tuberculosis
EVEQAEVGGSPRH

SEQ ID NO: 1368720 - protein, 5 aa, Mycobacterium tuberculosis
EVGAG

SEQ ID NO: 1368721 - protein, 9 aa, Mycobacterium tuberculosis
EVRDPARTI

SEQ ID NO: 1368722 - protein, 7 aa, Mycobacterium tuberculosis
EVSQGKL

SEQ ID NO: 1368723 - protein, 8 aa, Mycobacterium tuberculosis
FADTGEGG

SEQ ID NO: 1368724 - protein, 8 aa, Mycobacterium tuberculosis
FDQSNDPL

SEQ ID NO: 1368725 - protein, 8 aa, Mycobacterium tuberculosis
FDTSDDEQ

SEQ ID NO: 1368726 - protein, 22 aa, Mycobacterium tuberculosis
FGGSSNAPGSSPDGGFLGGGGR

SEQ ID NO: 1368727 - protein, 6 aa, Mycobacterium tuberculosis
FPGPAE

SEQ ID NO: 1368728 - protein, 5 aa, Mycobacterium tuberculosis
FPNPR

SEQ ID NO: 1368729 - protein, 4 aa, Mycobacterium tuberculosis
FPSR

SEQ ID NO: 1368730 - protein, 4 aa, Mycobacterium tuberculosis
FSDG

SEQ ID NO: 1368731 - protein, 6 aa, Mycobacterium tuberculosis
FSGSQI

SEQ ID NO: 1368732 - protein, 11 aa, Mycobacterium tuberculosis
FSPSAPAAAVD

SEQ ID NO: 1368733 - protein, 7 aa, Mycobacterium tuberculosis
FTPAQAT

SEQ ID NO: 1368734 - protein, 8 aa, Mycobacterium tuberculosis
FTQGDTRT

SEQ ID NO: 1368735 - protein, 13 aa, Mycobacterium tuberculosis
GADSATSDLAERN

SEQ ID NO: 1368736 - protein, 11 aa, Mycobacterium tuberculosis
GAGAGTPDDFD

SEQ ID NO: 1368737 - protein, 4 aa, Mycobacterium tuberculosis
GAGQ

SEQ ID NO: 1368738 - protein, 5 aa, Mycobacterium tuberculosis
GALRP

SEQ ID NO: 1368739 - protein, 5 aa, Mycobacterium tuberculosis
GAPTY

SEQ ID NO: 1368740 - protein, 8 aa, Mycobacterium tuberculosis
GAQLGAGP

SEQ ID NO: 1368741 - protein, 5 aa, Mycobacterium tuberculosis
GARPG

SEQ ID NO: 1368742 - protein, 6 aa, Mycobacterium tuberculosis
GASATV

SEQ ID NO: 1368743 - protein, 5 aa, Mycobacterium tuberculosis
GASSG

SEQ ID NO: 1368744 - protein, 7 aa, Mycobacterium tuberculosis
GDAPVPA

SEQ ID NO: 1368745 - protein, 9 aa, Mycobacterium tuberculosis
GDEFGNGPR

SEQ ID NO: 1368746 - protein, 4 aa, Mycobacterium tuberculosis
GDEV

SEQ ID NO: 1368747 - protein, 4 aa, Mycobacterium tuberculosis
GDEY

SEQ ID NO: 1368748 - protein, 7 aa, Mycobacterium tuberculosis
GDGAKDE

SEQ ID NO: 1368749 - protein, 8 aa, Mycobacterium tuberculosis
GDGANDAA

SEQ ID NO: 1368750 - protein, 7 aa, Mycobacterium tuberculosis
GDPVGDH

SEQ ID NO: 1368751 - protein, 7 aa, Mycobacterium tuberculosis
GDRIPAD

SEQ ID NO: 1368752 - protein, 10 aa, Mycobacterium tuberculosis
GDRMAPGAQS

SEQ ID NO: 1368753 - protein, 5 aa, Mycobacterium tuberculosis
GDYNV

SEQ ID NO: 1368754 - protein, 15 aa, Mycobacterium tuberculosis
GEADPIAKDAGDTVM

SEQ ID NO: 1368755 - protein, 8 aa, Mycobacterium tuberculosis
GEGPDDLA

SEQ ID NO: 1368756 - protein, 7 aa, Mycobacterium tuberculosis
GEKSDMA

SEQ ID NO: 1368757 - protein, 11 aa, Mycobacterium tuberculosis
GEPPFTGDSPV

SEQ ID NO: 1368758 - protein, 7 aa, Mycobacterium tuberculosis
GEPQNMP

SEQ ID NO: 1368759 - protein, 7 aa, Mycobacterium tuberculosis
GEQAAAA

SEQ ID NO: 1368760 - protein, 8 aa, Mycobacterium tuberculosis
GERADRTD

SEQ ID NO: 1368761 - protein, 5 aa, Mycobacterium tuberculosis
GERLA

SEQ ID NO: 1368762 - protein, 5 aa, Mycobacterium tuberculosis
GETDA

SEQ ID NO: 1368763 - protein, 6 aa, Mycobacterium tuberculosis
GFGNTT

SEQ ID NO: 1368764 - protein, 24 aa, Mycobacterium tuberculosis
GFKEQYAKSSADLARRGVTAQAAT

SEQ ID NO: 1368765 - protein, 8 aa, Mycobacterium tuberculosis
GGAFNNDT

SEQ ID NO: 1368766 - protein, 7 aa, Mycobacterium tuberculosis
GGANIPA

SEQ ID NO: 1368767 - protein, 10 aa, Mycobacterium tuberculosis
GGAWEGPSAE

SEQ ID NO: 1368768 - protein, 10 aa, Mycobacterium tuberculosis
GGEFGGSPSV

SEQ ID NO: 1368769 - protein, 4 aa, Mycobacterium tuberculosis
GGGD

SEQ ID NO: 1368770 - protein, 10 aa, Mycobacterium tuberculosis
GGGQQQMSRP

SEQ ID NO: 1368771 - protein, 7 aa, Mycobacterium tuberculosis
GGHPTEE

SEQ ID NO: 1368772 - protein, 6 aa, Mycobacterium tuberculosis
GGLASP

SEQ ID NO: 1368773 - protein, 8 aa, Mycobacterium tuberculosis
GGNKTFNE

SEQ ID NO: 1368774 - protein, 7 aa, Mycobacterium tuberculosis
GGPRRKG

SEQ ID NO: 1368775 - protein, 4 aa, Mycobacterium tuberculosis
GGQL

SEQ ID NO: 1368776 - protein, 6 aa, Mycobacterium tuberculosis
GGQRTA

SEQ ID NO: 1368777 - protein, 7 aa, Mycobacterium tuberculosis
GGTGKVV

SEQ ID NO: 1368778 - protein, 5 aa, Mycobacterium tuberculosis
GGVPA

SEQ ID NO: 1368779 - protein, 24 aa, Mycobacterium tuberculosis
GGWGAPPSGGPSPWAQTPRKTNPW

SEQ ID NO: 1368780 - protein, 4 aa, Mycobacterium tuberculosis
GHGG

SEQ ID NO: 1368781 - protein, 12 aa, Mycobacterium tuberculosis
GHGTGTTLGDPI

SEQ ID NO: 1368782 - protein, 5 aa, Mycobacterium tuberculosis
GHHSA

SEQ ID NO: 1368783 - protein, 7 aa, Mycobacterium tuberculosis
GHKKDSL

SEQ ID NO: 1368784 - protein, 6 aa, Mycobacterium tuberculosis
GHTGPF

SEQ ID NO: 1368785 - protein, 4 aa, Mycobacterium tuberculosis
GIGP

SEQ ID NO: 1368786 - protein, 4 aa, Mycobacterium tuberculosis
GKAH

SEQ ID NO: 1368787 - protein, 10 aa, Mycobacterium tuberculosis
GKTEPVDSEA

SEQ ID NO: 1368788 - protein, 5 aa, Mycobacterium tuberculosis
GLDPG

SEQ ID NO: 1368789 - protein, 8 aa, Mycobacterium tuberculosis
GLGMTDAD

SEQ ID NO: 1368790 - protein, 6 aa, Mycobacterium tuberculosis
GLGPPI

SEQ ID NO: 1368791 - protein, 5 aa, Mycobacterium tuberculosis
GLGPV

SEQ ID NO: 1368792 - protein, 8 aa, Mycobacterium tuberculosis
GLPGGITK

SEQ ID NO: 1368793 - protein, 6 aa, Mycobacterium tuberculosis
GLQAER

SEQ ID NO: 1368794 - protein, 8 aa, Mycobacterium tuberculosis
GLTPGSAD

SEQ ID NO: 1368795 - protein, 4 aa, Mycobacterium tuberculosis
GNPH

SEQ ID NO: 1368796 - protein, 7 aa, Mycobacterium tuberculosis
GNTGGDC

SEQ ID NO: 1368797 - protein, 7 aa, Mycobacterium tuberculosis
GPAGMTA

SEQ ID NO: 1368798 - protein, 4 aa, Mycobacterium tuberculosis
GPAY

SEQ ID NO: 1368799 - protein, 7 aa, Mycobacterium tuberculosis
GPSSPLS

SEQ ID NO: 1368800 - protein, 6 aa, Mycobacterium tuberculosis
GPTGVE

SEQ ID NO: 1368801 - protein, 7 aa, Mycobacterium tuberculosis
GPVTSEF

SEQ ID NO: 1368802 - protein, 4 aa, Mycobacterium tuberculosis
GPWG

SEQ ID NO: 1368803 - protein, 8 aa, Mycobacterium tuberculosis
GPYAKEGW

SEQ ID NO: 1368804 - protein, 12 aa, Mycobacterium tuberculosis
GQDGPLASTAGH

SEQ ID NO: 1368805 - protein, 10 aa, Mycobacterium tuberculosis
GQGSYAAANS

SEQ ID NO: 1368806 - protein, 7 aa, Mycobacterium tuberculosis
GQPDRAV

SEQ ID NO: 1368807 - protein, 7 aa, Mycobacterium tuberculosis
GQRPADR

SEQ ID NO: 1368808 - protein, 16 aa, Mycobacterium tuberculosis
GQSCAARPVTADELTE

SEQ ID NO: 1368809 - protein, 8 aa, Mycobacterium tuberculosis
GQSTAQAS

SEQ ID NO: 1368810 - protein, 9 aa, Mycobacterium tuberculosis
GQVNGPKLA

SEQ ID NO: 1368811 - protein, 6 aa, Mycobacterium tuberculosis
GQVQSS

SEQ ID NO: 1368812 - protein, 4 aa, Mycobacterium tuberculosis
GRAA

SEQ ID NO: 1368813 - protein, 7 aa, Mycobacterium tuberculosis
GRAAAAT

SEQ ID NO: 1368814 - protein, 6 aa, Mycobacterium tuberculosis
GRAPER

SEQ ID NO: 1368815 - protein, 7 aa, Mycobacterium tuberculosis
GRASEAD

SEQ ID NO: 1368816 - protein, 6 aa, Mycobacterium tuberculosis
GRDGEL

SEQ ID NO: 1368817 - protein, 11 aa, Mycobacterium tuberculosis
GRDPSTPPTKA

SEQ ID NO: 1368818 - protein, 4 aa, Mycobacterium tuberculosis
GRGA

SEQ ID NO: 1368819 - protein, 6 aa, Mycobacterium tuberculosis
GRGVPA

SEQ ID NO: 1368820 - protein, 21 aa, Mycobacterium tuberculosis
GRIADEATGARSKGAVSGRGA

SEQ ID NO: 1368821 - protein, 4 aa, Mycobacterium tuberculosis
GRRP

SEQ ID NO: 1368822 - protein, 24 aa, Mycobacterium tuberculosis
GRRPPSGSPDERCADPGSKGGSRR

SEQ ID NO: 1368823 - protein, 7 aa, Mycobacterium tuberculosis
GRSSERL

SEQ ID NO: 1368824 - protein, 5 aa, Mycobacterium tuberculosis
GRSTQ

SEQ ID NO: 1368825 - protein, 12 aa, Mycobacterium tuberculosis
GSAHGGHGHDAS

SEQ ID NO: 1368826 - protein, 10 aa, Mycobacterium tuberculosis
GSDAVAGSAQ

SEQ ID NO: 1368827 - protein, 8 aa, Mycobacterium tuberculosis
GSDENGAV

SEQ ID NO: 1368828 - protein, 7 aa, Mycobacterium tuberculosis
GSKVTYN

SEQ ID NO: 1368829 - protein, 5 aa, Mycobacterium tuberculosis
GSQTG

SEQ ID NO: 1368830 - protein, 36 aa, Mycobacterium tuberculosis
GSSPNSEDDSSAISTMTTTTAAPTSTSVKPAAPRAE

SEQ ID NO: 1368831 - protein, 13 aa, Mycobacterium tuberculosis
GSSQFEEPTGSIA

SEQ ID NO: 1368832 - protein, 7 aa, Mycobacterium tuberculosis
GSTNGTY

SEQ ID NO: 1368833 - protein, 14 aa, Mycobacterium tuberculosis
GSYASGGFATGTDY

SEQ ID NO: 1368834 - protein, 4 aa, Mycobacterium tuberculosis
GTAA

SEQ ID NO: 1368835 - protein, 6 aa, Mycobacterium tuberculosis
GTAETG

SEQ ID NO: 1368836 - protein, 5 aa, Mycobacterium tuberculosis
GTAPI

SEQ ID NO: 1368837 - protein, 8 aa, Mycobacterium tuberculosis
GTATPRAY

SEQ ID NO: 1368838 - protein, 7 aa, Mycobacterium tuberculosis
GTERTDH

SEQ ID NO: 1368839 - protein, 8 aa, Mycobacterium tuberculosis
GTETAPLQ

SEQ ID NO: 1368840 - protein, 11 aa, Mycobacterium tuberculosis
GTGCGPASSEV

SEQ ID NO: 1368841 - protein, 37 aa, Mycobacterium tuberculosis; identical to SEQ ID NO: 151607

SEQ ID NO: 1368842 - protein, 5 aa, Mycobacterium tuberculosis
GTNTT

SEQ ID NO: 1368843 - protein, 9 aa, Mycobacterium tuberculosis
GTPAQGNYA

SEQ ID NO: 1368844 - protein, 11 aa, Mycobacterium tuberculosis
GTPDYGAPARL

SEQ ID NO: 1368845 - protein, 7 aa, Mycobacterium tuberculosis
GTSAGGI

SEQ ID NO: 1368846 - protein, 5 aa, Mycobacterium tuberculosis
GTSTF

SEQ ID NO: 1368847 - protein, 7 aa, Mycobacterium tuberculosis
GTSYAAG

SEQ ID NO: 1368848 - protein, 13 aa, Mycobacterium tuberculosis
GTVVSDGPAPLDQ

SEQ ID NO: 1368849 - protein, 8 aa, Mycobacterium tuberculosis
GVASEEGL

SEQ ID NO: 1368850 - protein, 6 aa, Mycobacterium tuberculosis
GVDDPV

SEQ ID NO: 1368851 - protein, 12 aa, Mycobacterium tuberculosis
GVEPTERGARAT

SEQ ID NO: 1368852 - protein, 8 aa, Mycobacterium tuberculosis
GVNKPSMP

SEQ ID NO: 1368853 - protein, 15 aa, Mycobacterium tuberculosis
GVPAFQKPKSRNAAT

SEQ ID NO: 1368854 - protein, 7 aa, Mycobacterium tuberculosis
GVPDHGP

SEQ ID NO: 1368855 - protein, 5 aa, Mycobacterium tuberculosis
GVQDG

SEQ ID NO: 1368856 - protein, 4 aa, Mycobacterium tuberculosis
GVSQ

SEQ ID NO: 1368857 - protein, 4 aa, Mycobacterium tuberculosis
GVVG

SEQ ID NO: 1368858 - protein, 16 aa, Mycobacterium tuberculosis
GWPPGLSGATPWSPQQ

SEQ ID NO: 1368859 - protein, 9 aa, Mycobacterium tuberculosis
GYKTSYNDR

SEQ ID NO: 1368860 - protein, 12 aa, Mycobacterium tuberculosis
HAAGATHRDVKP

SEQ ID NO: 1368861 - protein, 9 aa, Mycobacterium tuberculosis
HAAPHTETT

SEQ ID NO: 1368862 - protein, 4 aa, Mycobacterium tuberculosis
HAHP

SEQ ID NO: 1368863 - protein, 18 aa, Mycobacterium tuberculosis
HDAADSVDDTLESTAAGI

SEQ ID NO: 1368864 - protein, 22 aa, Mycobacterium tuberculosis
HDAEPAAHGAPRDDEVAPLSFA

SEQ ID NO: 1368865 - protein, 4 aa, Mycobacterium tuberculosis
HDQP

SEQ ID NO: 1368866 - protein, 5 aa, Mycobacterium tuberculosis
HEPPG

SEQ ID NO: 1368867 - protein, 9 aa, Mycobacterium tuberculosis
HGDHPGYEL

SEQ ID NO: 1368868 - protein, 6 aa, Mycobacterium tuberculosis
HGGGLD

SEQ ID NO: 1368869 - protein, 6 aa, Mycobacterium tuberculosis
HGNTAI

SEQ ID NO: 1368870 - protein, 4 aa, Mycobacterium tuberculosis
HGRR

SEQ ID NO: 1368871 - protein, 4 aa, Mycobacterium tuberculosis
HGST

SEQ ID NO: 1368872 - protein, 16 aa, Mycobacterium tuberculosis
HGSTLGSRVAGTQPAP

SEQ ID NO: 1368873 - protein, 16 aa, Mycobacterium tuberculosis
HPVTGQPFSDKSKTVA

SEQ ID NO: 1368874 - protein, 13 aa, Mycobacterium tuberculosis
HRGSAGRPPQTTS

SEQ ID NO: 1368875 - protein, 8 aa, Mycobacterium tuberculosis
HSDADLSN

SEQ ID NO: 1368876 - protein, 7 aa, Mycobacterium tuberculosis
HSVKTYP

SEQ ID NO: 1368877 - protein, 26 aa, Mycobacterium tuberculosis
IAPIDNPRNPHPSAPSPALGPPPDAF

SEQ ID NO: 1368878 - protein, 4 aa, Mycobacterium tuberculosis
IAPK

SEQ ID NO: 1368879 - protein, 9 aa, Mycobacterium tuberculosis
IAPNAGLDP

SEQ ID NO: 1368880 - protein, 12 aa, Mycobacterium tuberculosis
IASGDGTVKRSG

SEQ ID NO: 1368881 - protein, 5 aa, Mycobacterium tuberculosis
IDIPS

SEQ ID NO: 1368882 - protein, 4 aa, Mycobacterium tuberculosis
IDTA

SEQ ID NO: 1368883 - protein, 4 aa, Mycobacterium tuberculosis
IESG

SEQ ID NO: 1368884 - protein, 6 aa, Mycobacterium tuberculosis
IETRSD

SEQ ID NO: 1368885 - protein, 10 aa, Mycobacterium tuberculosis
IETVGSNIGG

SEQ ID NO: 1368886 - protein, 5 aa, Mycobacterium tuberculosis
IGDRS

SEQ ID NO: 1368887 - protein, 16 aa, Mycobacterium tuberculosis
IGRSGRSSHAIGAADD

SEQ ID NO: 1368888 - protein, 6 aa, Mycobacterium tuberculosis
IGTAAT

SEQ ID NO: 1368889 - protein, 6 aa, Mycobacterium tuberculosis
IPAEGQ

SEQ ID NO: 1368890 - protein, 4 aa, Mycobacterium tuberculosis
IPAL

SEQ ID NO: 1368891 - protein, 11 aa, Mycobacterium tuberculosis
IPAPSAAAIAT

SEQ ID NO: 1368892 - protein, 7 aa, Mycobacterium tuberculosis
IPGGPVA

SEQ ID NO: 1368893 - protein, 11 aa, Mycobacterium tuberculosis
IPPEDIPGQFS

SEQ ID NO: 1368894 - protein, 7 aa, Mycobacterium tuberculosis
IPQQSRT

SEQ ID NO: 1368895 - protein, 5 aa, Mycobacterium tuberculosis
IPTRD

SEQ ID NO: 1368896 - protein, 13 aa, Mycobacterium tuberculosis
IPTTETPPPPQTV

SEQ ID NO: 1368897 - protein, 9 aa, Mycobacterium tuberculosis
IRGSAGEDM

SEQ ID NO: 1368898 - protein, 11 aa, Mycobacterium tuberculosis
ISATDTPGGGL

SEQ ID NO: 1368899 - protein, 6 aa, Mycobacterium tuberculosis
ISGEPW

SEQ ID NO: 1368900 - protein, 4 aa, Mycobacterium tuberculosis
ISSE

SEQ ID NO: 1368901 - protein, 5 aa, Mycobacterium tuberculosis
ITGGR

SEQ ID NO: 1368902 - protein, 24 aa, Mycobacterium tuberculosis
ITGSEPGTEGGTTAAPGINGSRAR

SEQ ID NO: 1368903 - protein, 7 aa, Mycobacterium tuberculosis
ITGTSSS

SEQ ID NO: 1368904 - protein, 4 aa, Mycobacterium tuberculosis
ITPE

SEQ ID NO: 1368905 - protein, 13 aa, Mycobacterium tuberculosis
ITTTTVPSQIGPA

SEQ ID NO: 1368906 - protein, 7 aa, Mycobacterium tuberculosis
IYGQGSG

SEQ ID NO: 1368907 - protein, 6 aa, Mycobacterium tuberculosis
KAEYPA

SEQ ID NO: 1368908 - protein, 10 aa, Mycobacterium tuberculosis
KALQPPGNPL

SEQ ID NO: 1368909 - protein, 6 aa, Mycobacterium tuberculosis
KARGDE

SEQ ID NO: 1368910 - protein, 6 aa, Mycobacterium tuberculosis
KDATGI

SEQ ID NO: 1368911 - protein, 7 aa, Mycobacterium tuberculosis
KDSAAAA

SEQ ID NO: 1368912 - protein, 33 aa, Mycobacterium tuberculosis; identical to SEQ ID NO: 151984

SEQ ID NO: 1368913 - protein, 4 aa, Mycobacterium tuberculosis
KGAA

SEQ ID NO: 1368914 - protein, 8 aa, Mycobacterium tuberculosis
KGLGAADE

SEQ ID NO: 1368915 - protein, 19 aa, Mycobacterium tuberculosis
KGPLPTTAKMRSVQRTVRR

SEQ ID NO: 1368916 - protein, 8 aa, Mycobacterium tuberculosis
KGTDTGQA

SEQ ID NO: 1368917 - protein, 8 aa, Mycobacterium tuberculosis
KIAASDDT

SEQ ID NO: 1368918 - protein, 9 aa, Mycobacterium tuberculosis
KIAASGDTV

SEQ ID NO: 1368919 - protein, 8 aa, Mycobacterium tuberculosis
KLGSSGGV

SEQ ID NO: 1368920 - protein, 15 aa, Mycobacterium tuberculosis
KLPEDPPPPPKPAAV

SEQ ID NO: 1368921 - protein, 5 aa, Mycobacterium tuberculosis
KLPPQ

SEQ ID NO: 1368922 - protein, 11 aa, Mycobacterium tuberculosis
KNAKTSRENQQ

SEQ ID NO: 1368923 - protein, 7 aa, Mycobacterium tuberculosis
KPSAEPY

SEQ ID NO: 1368924 - protein, 5 aa, Mycobacterium tuberculosis
KPSKS

SEQ ID NO: 1368925 - protein, 8 aa, Mycobacterium tuberculosis
KQQITPAG

SEQ ID NO: 1368926 - protein, 7 aa, Mycobacterium tuberculosis
KRARGSP

SEQ ID NO: 1368927 - protein, 7 aa, Mycobacterium tuberculosis
KRATTKR

SEQ ID NO: 1368928 - protein, 17 aa, Mycobacterium tuberculosis
KRGAWTPPTVASPTAMG

SEQ ID NO: 1368929 - protein, 25 aa, Mycobacterium tuberculosis
KRGAWTPPTVASPTAMGSALETGQV

SEQ ID NO: 1368930 - protein, 14 aa, Mycobacterium tuberculosis
KRGEGKGANDLLPP

SEQ ID NO: 1368931 - protein, 15 aa, Mycobacterium tuberculosis
KRKAKREAAIPDDEA

SEQ ID NO: 1368932 - protein, 18 aa, Mycobacterium tuberculosis
KRQLEAAHDRKSSNPTEA

SEQ ID NO: 1368933 - protein, 12 aa, Mycobacterium tuberculosis
KSASVDDANLLK

SEQ ID NO: 1368934 - protein, 10 aa, Mycobacterium tuberculosis
KSSADSARLA

SEQ ID NO: 1368935 - protein, 6 aa, Mycobacterium tuberculosis
KTEDIA

SEQ ID NO: 1368936 - protein, 19 aa, Mycobacterium tuberculosis
KVRSGAITAPLGSQREYRP

SEQ ID NO: 1368937 - protein, 4 aa, Mycobacterium tuberculosis
LAGA

SEQ ID NO: 1368938 - protein, 5 aa, Mycobacterium tuberculosis
LAGAT

SEQ ID NO: 1368939 - protein, 7 aa, Mycobacterium tuberculosis
LAPDERL

SEQ ID NO: 1368940 - protein, 7 aa, Mycobacterium tuberculosis
LARPPKP

SEQ ID NO: 1368941 - protein, 4 aa, Mycobacterium tuberculosis
LASE

SEQ ID NO: 1368942 - protein, 7 aa, Mycobacterium tuberculosis
LATDRYR

SEQ ID NO: 1368943 - protein, 11 aa, Mycobacterium tuberculosis
LATGTAGQPTW

SEQ ID NO: 1368944 - protein, 6 aa, Mycobacterium tuberculosis
LDDAGV

SEQ ID NO: 1368945 - protein, 5 aa, Mycobacterium tuberculosis
LDDEG

SEQ ID NO: 1368946 - protein, 9 aa, Mycobacterium tuberculosis
LDPDERDRA

SEQ ID NO: 1368947 - protein, 9 aa, Mycobacterium tuberculosis
LDRRATPDQ

SEQ ID NO: 1368948 - protein, 15 aa, Mycobacterium tuberculosis
LDTTARPQCQRTTRL

SEQ ID NO: 1368949 - protein, 15 aa, Mycobacterium tuberculosis
LEDTGARAAALGPGQ

SEQ ID NO: 1368950 - protein, 6 aa, Mycobacterium tuberculosis
LEDTIR

SEQ ID NO: 1368951 - protein, 4 aa, Mycobacterium tuberculosis
LERD

SEQ ID NO: 1368952 - protein, 9 aa, Mycobacterium tuberculosis
LGAPQVAGA

SEQ ID NO: 1368953 - protein, 5 aa, Mycobacterium tuberculosis
LGATG

SEQ ID NO: 1368954 - protein, 5 aa, Mycobacterium tuberculosis
LGDGE

SEQ ID NO: 1368955 - protein, 5 aa, Mycobacterium tuberculosis
LGEDR

SEQ ID NO: 1368956 - protein, 10 aa, Mycobacterium tuberculosis
LGGEAKTPKA

SEQ ID NO: 1368957 - protein, 13 aa, Mycobacterium tuberculosis
LGNGQPDTVPAAS

SEQ ID NO: 1368958 - protein, 5 aa, Mycobacterium tuberculosis
LGPED

SEQ ID NO: 1368959 - protein, 5 aa, Mycobacterium tuberculosis
LGPRS

SEQ ID NO: 1368960 - protein, 6 aa, Mycobacterium tuberculosis
LGQPAN

SEQ ID NO: 1368961 - protein, 6 aa, Mycobacterium tuberculosis
LGQRAA

SEQ ID NO: 1368962 - protein, 5 aa, Mycobacterium tuberculosis
LGRLG

SEQ ID NO: 1368963 - protein, 14 aa, Mycobacterium tuberculosis
LGRREPAVYGGTTH

SEQ ID NO: 1368964 - protein, 9 aa, Mycobacterium tuberculosis
LGSRAGAGV

SEQ ID NO: 1368965 - protein, 6 aa, Mycobacterium tuberculosis
LGTNGG

SEQ ID NO: 1368966 - protein, 21 aa, Mycobacterium tuberculosis
LKAPTADDEALPLSDEPPPRA

SEQ ID NO: 1368967 - protein, 17 aa, Mycobacterium tuberculosis
LNAHPDGLNQRPPGGWC

SEQ ID NO: 1368968 - protein, 21 aa, Mycobacterium tuberculosis
LNAPTASTSAASSAPPGSVVK

SEQ ID NO: 1368969 - protein, 7 aa, Mycobacterium tuberculosis
LNTDQNI

SEQ ID NO: 1368970 - protein, 6 aa, Mycobacterium tuberculosis
LPQTPM

SEQ ID NO: 1368971 - protein, 10 aa, Mycobacterium tuberculosis
LPRSASARQV

SEQ ID NO: 1368972 - protein, 7 aa, Mycobacterium tuberculosis
LPTRATG

SEQ ID NO: 1368973 - protein, 4 aa, Mycobacterium tuberculosis
LQTK

SEQ ID NO: 1368974 - protein, 9 aa, Mycobacterium tuberculosis
LRDDETSGR

SEQ ID NO: 1368975 - protein, 7 aa, Mycobacterium tuberculosis
LRNGDRA

SEQ ID NO: 1368976 - protein, 10 aa, Mycobacterium tuberculosis
LRSGKAGTDA

SEQ ID NO: 1368977 - protein, 13 aa, Mycobacterium tuberculosis
LSDQPPGVIVVVT

SEQ ID NO: 1368978 - protein, 9 aa, Mycobacterium tuberculosis
LSDSPDNTD

SEQ ID NO: 1368979 - protein, 6 aa, Mycobacterium tuberculosis
LSEQNG

SEQ ID NO: 1368980 - protein, 11 aa, Mycobacterium tuberculosis
LSETGTRINDQ

SEQ ID NO: 1368981 - protein, 8 aa, Mycobacterium tuberculosis
LSHPEDAA

SEQ ID NO: 1368982 - protein, 10 aa, Mycobacterium tuberculosis
LSKQTGQQVS

SEQ ID NO: 1368983 - protein, 8 aa, Mycobacterium tuberculosis
LTGEPAGA

SEQ ID NO: 1368984 - protein, 9 aa, Mycobacterium tuberculosis
LTGPAGQDA

SEQ ID NO: 1368985 - protein, 5 aa, Mycobacterium tuberculosis
LTPDR

SEQ ID NO: 1368986 - protein, 4 aa, Mycobacterium tuberculosis
LTPG

SEQ ID NO: 1368987 - protein, 11 aa, Mycobacterium tuberculosis
LTPNDPRFQPG

SEQ ID NO: 1368988 - protein, 22 aa, Mycobacterium tuberculosis
LTRQPGDCSEPASGSEPEHEPI

SEQ ID NO: 1368989 - protein, 10 aa, Mycobacterium tuberculosis
LTTREPSSLK

SEQ ID NO: 1368990 - protein, 24 aa, Mycobacterium tuberculosis
MPPAAGVETNGEAGGPGQQTTRQA

SEQ ID NO: 1368991 - protein, 6 aa, Mycobacterium tuberculosis
MRSRRN

SEQ ID NO: 1368992 - protein, 8 aa, Mycobacterium tuberculosis
MRTNRGGD

SEQ ID NO: 1368993 - protein, 6 aa, Mycobacterium tuberculosis
MSGSNI

SEQ ID NO: 1368994 - protein, 8 aa, Mycobacterium tuberculosis
MSSPGGVR

SEQ ID NO: 1368995 - protein, 22 aa, Mycobacterium tuberculosis
MSTDRNPADRQRVDPQAAARIS

SEQ ID NO: 1368996 - protein, 7 aa, Mycobacterium tuberculosis
MTPLSPD

SEQ ID NO: 1368997 - protein, 10 aa, Mycobacterium tuberculosis
NAGGTHPTTT

SEQ ID NO: 1368998 - protein, 6 aa, Mycobacterium tuberculosis
NAKAAL

SEQ ID NO: 1368999 - protein, 8 aa, Mycobacterium tuberculosis
NAQGEPSA

SEQ ID NO: 1369000 - protein, 10 aa, Mycobacterium tuberculosis
NASGSSAELV

SEQ ID NO: 1369001 - protein, 5 aa, Mycobacterium tuberculosis
NASGT

SEQ ID NO: 1369002 - protein, 7 aa, Mycobacterium tuberculosis
NATTAAA

SEQ ID NO: 1369003 - protein, 4 aa, Mycobacterium tuberculosis
NESV

SEQ ID NO: 1369004 - protein, 7 aa, Mycobacterium tuberculosis
NGAGPEL

SEQ ID NO: 1369005 - protein, 6 aa, Mycobacterium tuberculosis
NGNITD

SEQ ID NO: 1369006 - protein, 5 aa, Mycobacterium tuberculosis
NGRFT

SEQ ID NO: 1369007 - protein, 7 aa, Mycobacterium tuberculosis
NGTEYEW

SEQ ID NO: 1369008 - protein, 8 aa, Mycobacterium tuberculosis
NGTPAVEP

SEQ ID NO: 1369009 - protein, 8 aa, Mycobacterium tuberculosis
NGTSGPLR

SEQ ID NO: 1369010 - protein, 7 aa, Mycobacterium tuberculosis
NHQPVTD

SEQ ID NO: 1369011 - protein, 10 aa, Mycobacterium tuberculosis
NLSGTVTDAE

SEQ ID NO: 1369012 - protein, 4 aa, Mycobacterium tuberculosis
NLTA

SEQ ID NO: 1369013 - protein, 12 aa, Mycobacterium tuberculosis
NNAITTDPAVSQ

SEQ ID NO: 1369014 - protein, 5 aa, Mycobacterium tuberculosis
NNNVD

SEQ ID NO: 1369015 - protein, 15 aa, Mycobacterium tuberculosis
NNQAKLTSGALSTAA

SEQ ID NO: 1369016 - protein, 4 aa, Mycobacterium tuberculosis
NNSP

SEQ ID NO: 1369017 - protein, 5 aa, Mycobacterium tuberculosis
NPADE

SEQ ID NO: 1369018 - protein, 6 aa, Mycobacterium tuberculosis
NPKLPG

SEQ ID NO: 1369019 - protein, 5 aa, Mycobacterium tuberculosis
NPLAG

SEQ ID NO: 1369020 - protein, 11 aa, Mycobacterium tuberculosis
NPMGDAPNEPG

SEQ ID NO: 1369021 - protein, 5 aa, Mycobacterium tuberculosis
NPPAA

SEQ ID NO: 1369022 - protein, 4 aa, Mycobacterium tuberculosis
NPPT

SEQ ID NO: 1369023 - protein, 5 aa, Mycobacterium tuberculosis
NPRTM

SEQ ID NO: 1369024 - protein, 6 aa, Mycobacterium tuberculosis
NPRVSR

SEQ ID NO: 1369025 - protein, 5 aa, Mycobacterium tuberculosis
NQATA

SEQ ID NO: 1369026 - protein, 6 aa, Mycobacterium tuberculosis
NQDQGV

SEQ ID NO: 1369027 - protein, 5 aa, Mycobacterium tuberculosis
NQPPP

SEQ ID NO: 1369028 - protein, 4 aa, Mycobacterium tuberculosis
NRAD

SEQ ID NO: 1369029 - protein, 18 aa, Mycobacterium tuberculosis
NRLGGQHGSIPISGTSYA

SEQ ID NO: 1369030 - protein, 11 aa, Mycobacterium tuberculosis
NRQGHPGTRDR

SEQ ID NO: 1369031 - protein, 9 aa, Mycobacterium tuberculosis
NRTHSADSR

SEQ ID NO: 1369032 - protein, 19 aa, Mycobacterium tuberculosis
NTDAAAGPLRRHGPAAARR

SEQ ID NO: 1369033 - protein, 5 aa, Mycobacterium tuberculosis
NTPAD

SEQ ID NO: 1369034 - protein, 7 aa, Mycobacterium tuberculosis
NTPAGTQ

SEQ ID NO: 1369035 - protein, 4 aa, Mycobacterium tuberculosis
NTSA

SEQ ID NO: 1369036 - protein, 9 aa, Mycobacterium tuberculosis
NVTGPAATV

SEQ ID NO: 1369037 - protein, 13 aa, Mycobacterium tuberculosis
NYSGDSPATAQQV

SEQ ID NO: 1369038 - protein, 19 aa, Mycobacterium tuberculosis
PAAHGSTLGSRVAGTQPAP

SEQ ID NO: 1369039 - protein, 24 aa, Mycobacterium tuberculosis
PAAIPTGPDSAPANAPRIASPTEA

SEQ ID NO: 1369040 - protein, 8 aa, Mycobacterium tuberculosis
PAARSARV

SEQ ID NO: 1369041 - protein, 4 aa, Mycobacterium tuberculosis
PAAS

SEQ ID NO: 1369042 - protein, 13 aa, Mycobacterium tuberculosis
PAEELRSARTPQE

SEQ ID NO: 1369043 - protein, 5 aa, Mycobacterium tuberculosis
PAERR

SEQ ID NO: 1369044 - protein, 11 aa, Mycobacterium tuberculosis
PAGKTVDDPAW

SEQ ID NO: 1369045 - protein, 10 aa, Mycobacterium tuberculosis
PALESTRATL

SEQ ID NO: 1369046 - protein, 5 aa, Mycobacterium tuberculosis
PAPDL

SEQ ID NO: 1369047 - protein, 48 aa, Mycobacterium tuberculosis; identical to SEQ ID NO: 152687

SEQ ID NO: 1369048 - protein, 11 aa, Mycobacterium tuberculosis
PAPRNSAQHRS

SEQ ID NO: 1369049 - protein, 4 aa, Mycobacterium tuberculosis
PARA

SEQ ID NO: 1369050 - protein, 36 aa, Mycobacterium tuberculosis; identical to SEQ ID NO: 152702

SEQ ID NO: 1369051 - protein, 74 aa, Mycobacterium tuberculosis; identical to SEQ ID NO: 152707

SEQ ID NO: 1369052 - protein, 5 aa, Mycobacterium tuberculosis
PDEAR

SEQ ID NO: 1369053 - protein, 4 aa, Mycobacterium tuberculosis
PDGR

SEQ ID NO: 1369054 - protein, 7 aa, Mycobacterium tuberculosis
PDGYQTA

SEQ ID NO: 1369055 - protein, 11 aa, Mycobacterium tuberculosis
PDIYGDPEPVT

SEQ ID NO: 1369056 - protein, 4 aa, Mycobacterium tuberculosis
PDKL

SEQ ID NO: 1369057 - protein, 8 aa, Mycobacterium tuberculosis
PDNDPANM

SEQ ID NO: 1369058 - protein, 28 aa, Mycobacterium tuberculosis
PDPSLMSTDRNPADRQRVDPQAAARISA

SEQ ID NO: 1369059 - protein, 8 aa, Mycobacterium tuberculosis
PEAAGPTQ

SEQ ID NO: 1369060 - protein, 15 aa, Mycobacterium tuberculosis
PGAPSSFSPKSPPAS

SEQ ID NO: 1369061 - protein, 20 aa, Mycobacterium tuberculosis
PGATAGARSTDIENSRGSAN

SEQ ID NO: 1369062 - protein, 10 aa, Mycobacterium tuberculosis
PGEGPSPDGW

SEQ ID NO: 1369063 - protein, 8 aa, Mycobacterium tuberculosis
PGGVDSPE

SEQ ID NO: 1369064 - protein, 6 aa, Mycobacterium tuberculosis
PGHRPA

SEQ ID NO: 1369065 - protein, 8 aa, Mycobacterium tuberculosis
PGKQFEAG

SEQ ID NO: 1369066 - protein, 16 aa, Mycobacterium tuberculosis
PGLAGPDSRVSTFSAA

SEQ ID NO: 1369067 - protein, 9 aa, Mycobacterium tuberculosis
PGLTQGKPF

SEQ ID NO: 1369068 - protein, 10 aa, Mycobacterium tuberculosis
PGNVAKGAAN

SEQ ID NO: 1369069 - protein, 10 aa, Mycobacterium tuberculosis
PGPDGRPTTS

SEQ ID NO: 1369070 - protein, 14 aa, Mycobacterium tuberculosis
PGPLPQPDVGTTDD

SEQ ID NO: 1369071 - protein, 6 aa, Mycobacterium tuberculosis
PGRDLA

SEQ ID NO: 1369072 - protein, 12 aa, Mycobacterium tuberculosis
PGRGVSGTVSGR

SEQ ID NO: 1369073 - protein, 7 aa, Mycobacterium tuberculosis
PGRRFRE

SEQ ID NO: 1369074 - protein, 6 aa, Mycobacterium tuberculosis
PGSDPF

SEQ ID NO: 1369075 - protein, 8 aa, Mycobacterium tuberculosis
PGTPRAPA

SEQ ID NO: 1369076 - protein, 10 aa, Mycobacterium tuberculosis
PGVGGLGQPH

SEQ ID NO: 1369077 - protein, 22 aa, Mycobacterium tuberculosis
PGWQSAPPGYPPPYPQYPGPGS

SEQ ID NO: 1369078 - protein, 13 aa, Mycobacterium tuberculosis
PHAAPGDTRRGIF

SEQ ID NO: 1369079 - protein, 7 aa, Mycobacterium tuberculosis
PHPSTLA

SEQ ID NO: 1369080 - protein, 6 aa, Mycobacterium tuberculosis
PKAKRV

SEQ ID NO: 1369081 - protein, 8 aa, Mycobacterium tuberculosis
PKLADDSL

SEQ ID NO: 1369082 - protein, 13 aa, Mycobacterium tuberculosis
PLAGPEGLVPGTA

SEQ ID NO: 1369083 - protein, 6 aa, Mycobacterium tuberculosis
PLATEL

SEQ ID NO: 1369084 - protein, 4 aa, Mycobacterium tuberculosis
PLND

SEQ ID NO: 1369085 - protein, 13 aa, Mycobacterium tuberculosis
PLPGTTQQIAGTG

SEQ ID NO: 1369086 - protein, 14 aa, Mycobacterium tuberculosis
PLRATQSLTEQDVY

SEQ ID NO: 1369087 - protein, 4 aa, Mycobacterium tuberculosis
PLWG

SEQ ID NO: 1369088 - protein, 16 aa, Mycobacterium tuberculosis
PNAGGPATFPGAPGPI

SEQ ID NO: 1369089 - protein, 8 aa, Mycobacterium tuberculosis
PNPPTVAQ

SEQ ID NO: 1369090 - protein, 5 aa, Mycobacterium tuberculosis
PNTDR

SEQ ID NO: 1369091 - protein, 5 aa, Mycobacterium tuberculosis
PPEHT

SEQ ID NO: 1369092 - protein, 4 aa, Mycobacterium tuberculosis
PPGV

SEQ ID NO: 1369093 - protein, 5 aa, Mycobacterium tuberculosis
PPPNA

SEQ ID NO: 1369094 - protein, 5 aa, Mycobacterium tuberculosis
PPQDN

SEQ ID NO: 1369095 - protein, 4 aa, Mycobacterium tuberculosis
PPRC

SEQ ID NO: 1369096 - protein, 25 aa, Mycobacterium tuberculosis
PPVEPVSPTNPRSSASPGSPDRSGL

SEQ ID NO: 1369097 - protein, 6 aa, Mycobacterium tuberculosis
PQPPTI

SEQ ID NO: 1369098 - protein, 25 aa, Mycobacterium tuberculosis
PRLPNVDAGGDFVESTDGLTDCDGH

SEQ ID NO: 1369099 - protein, 7 aa, Mycobacterium tuberculosis
PRPESYE

SEQ ID NO: 1369100 - protein, 6 aa, Mycobacterium tuberculosis
PRPPWR

SEQ ID NO: 1369101 - protein, 7 aa, Mycobacterium tuberculosis
PRSASVR

SEQ ID NO: 1369102 - protein, 7 aa, Mycobacterium tuberculosis
PRTLGRQ

SEQ ID NO: 1369103 - protein, 4 aa, Mycobacterium tuberculosis
PSAH

SEQ ID NO: 1369104 - protein, 4 aa, Mycobacterium tuberculosis
PSAP

SEQ ID NO: 1369105 - protein, 53 aa, Mycobacterium tuberculosis; identical to SEQ ID NO: 153028

SEQ ID NO: 1369106 - protein, 6 aa, Mycobacterium tuberculosis
PSGPHP

SEQ ID NO: 1369107 - protein, 13 aa, Mycobacterium tuberculosis
PSNNATFNKTMSE

SEQ ID NO: 1369108 - protein, 7 aa, Mycobacterium tuberculosis
PSQRSAT

SEQ ID NO: 1369109 - protein, 7 aa, Mycobacterium tuberculosis
PSRQAKE

SEQ ID NO: 1369110 - protein, 5 aa, Mycobacterium tuberculosis
PSVAR

SEQ ID NO: 1369111 - protein, 4 aa, Mycobacterium tuberculosis
PSYD

SEQ ID NO: 1369112 - protein, 8 aa, Mycobacterium tuberculosis
PTGTVDVG

SEQ ID NO: 1369113 - protein, 4 aa, Mycobacterium tuberculosis
PTLV

SEQ ID NO: 1369114 - protein, 4 aa, Mycobacterium tuberculosis
PTPA

SEQ ID NO: 1369115 - protein, 7 aa, Mycobacterium tuberculosis
PTPACPQ

SEQ ID NO: 1369116 - protein, 9 aa, Mycobacterium tuberculosis
PVAPPSVRP

SEQ ID NO: 1369117 - protein, 9 aa, Mycobacterium tuberculosis
PVGGEQSKR

SEQ ID NO: 1369118 - protein, 7 aa, Mycobacterium tuberculosis
PVKPGRG

SEQ ID NO: 1369119 - protein, 5 aa, Mycobacterium tuberculosis
PVNEA

SEQ ID NO: 1369120 - protein, 7 aa, Mycobacterium tuberculosis
PVSGANN

SEQ ID NO: 1369121 - protein, 4 aa, Mycobacterium tuberculosis
QAGH

SEQ ID NO: 1369122 - protein, 5 aa, Mycobacterium tuberculosis
QAIPG

SEQ ID NO: 1369123 - protein, 13 aa, Mycobacterium tuberculosis
QARYTDPNTRSFT

SEQ ID NO: 1369124 - protein, 10 aa, Mycobacterium tuberculosis
QCTGPGPAAL

SEQ ID NO: 1369125 - protein, 9 aa, Mycobacterium tuberculosis
QDGDPGYKA

SEQ ID NO: 1369126 - protein, 4 aa, Mycobacterium tuberculosis
QDLA

SEQ ID NO: 1369127 - protein, 6 aa, Mycobacterium tuberculosis
QDMRNP

SEQ ID NO: 1369128 - protein, 8 aa, Mycobacterium tuberculosis
QEATAGLA

SEQ ID NO: 1369129 - protein, 8 aa, Mycobacterium tuberculosis
QEDSAAMG

SEQ ID NO: 1369130 - protein, 22 aa, Mycobacterium tuberculosis
QETDYPSVGPDRPEYEPRGCPR

SEQ ID NO: 1369131 - protein, 6 aa, Mycobacterium tuberculosis
QGRRGV

SEQ ID NO: 1369132 - protein, 31 aa, Mycobacterium tuberculosis; identical to SEQ ID NO: 153192

SEQ ID NO: 1369133 - protein, 35 aa, Mycobacterium tuberculosis; identical to SEQ ID NO: 153200

SEQ ID NO: 1369134 - protein, 14 aa, Mycobacterium tuberculosis
QHQTRVASQRTTPE

SEQ ID NO: 1369135 - protein, 8 aa, Mycobacterium tuberculosis
QKFSGGEV

SEQ ID NO: 1369136 - protein, 7 aa, Mycobacterium tuberculosis
QLGDNTA

SEQ ID NO: 1369137 - protein, 7 aa, Mycobacterium tuberculosis
QLKPAPR

SEQ ID NO: 1369138 - protein, 8 aa, Mycobacterium tuberculosis
QLQTHDSA

SEQ ID NO: 1369139 - protein, 8 aa, Mycobacterium tuberculosis
QLSPSARF

SEQ ID NO: 1369140 - protein, 11 aa, Mycobacterium tuberculosis
QNTNQGGPSRA

SEQ ID NO: 1369141 - protein, 8 aa, Mycobacterium tuberculosis
QPASTPAE

SEQ ID NO: 1369142 - protein, 25 aa, Mycobacterium tuberculosis
QPEPRWPKSPPQDRRESGPELSEYP

SEQ ID NO: 1369143 - protein, 11 aa, Mycobacterium tuberculosis
QPPVPPPDIPE

SEQ ID NO: 1369144 - protein, 5 aa, Mycobacterium tuberculosis
QPTQL

SEQ ID NO: 1369145 - protein, 4 aa, Mycobacterium tuberculosis
QPTR

SEQ ID NO: 1369146 - protein, 5 aa, Mycobacterium tuberculosis
QQGPG

SEQ ID NO: 1369147 - protein, 5 aa, Mycobacterium tuberculosis
QQGRD

SEQ ID NO: 1369148 - protein, 7 aa, Mycobacterium tuberculosis
QRGGAFG

SEQ ID NO: 1369149 - protein, 6 aa, Mycobacterium tuberculosis
QRITDP

SEQ ID NO: 1369150 - protein, 5 aa, Mycobacterium tuberculosis
QRPVI

SEQ ID NO: 1369151 - protein, 8 aa, Mycobacterium tuberculosis
QRRASPAR

SEQ ID NO: 1369152 - protein, 12 aa, Mycobacterium tuberculosis
QRTAEAQAKANE

SEQ ID NO: 1369153 - protein, 11 aa, Mycobacterium tuberculosis
QSARADISADG

SEQ ID NO: 1369154 - protein, 37 aa, Mycobacterium tuberculosis
QSPTPTPASHPPAPPRPATPKPAQRQGETTVARPPTA

SEQ ID NO: 1369155 - protein, 11 aa, Mycobacterium tuberculosis
QSSRPGPVTYP

SEQ ID NO: 1369156 - protein, 11 aa, Mycobacterium tuberculosis
QSTGTGPGDQR

SEQ ID NO: 1369157 - protein, 32 aa, Mycobacterium tuberculosis
QSTTRRARRKASRPAGPAEGESSRPAQGAATV

SEQ ID NO: 1369158 - protein, 7 aa, Mycobacterium tuberculosis
QTAQQKL

SEQ ID NO: 1369159 - protein, 4 aa, Mycobacterium tuberculosis
QTEH

SEQ ID NO: 1369160 - protein, 6 aa, Mycobacterium tuberculosis
QTPDVT

SEQ ID NO: 1369161 - protein, 5 aa, Mycobacterium tuberculosis
QTPSA

SEQ ID NO: 1369162 - protein, 4 aa, Mycobacterium tuberculosis
QTVT

SEQ ID NO: 1369163 - protein, 4 aa, Mycobacterium tuberculosis
QVPT

SEQ ID NO: 1369164 - protein, 9 aa, Mycobacterium tuberculosis
QVPTSYREA

SEQ ID NO: 1369165 - protein, 8 aa, Mycobacterium tuberculosis
QWSRPANA

SEQ ID NO: 1369166 - protein, 29 aa, Mycobacterium tuberculosis
RAAARTESKPAKAAKPALRPVKPPPRRPA

SEQ ID NO: 1369167 - protein, 9 aa, Mycobacterium tuberculosis
RADPGRAGA

SEQ ID NO: 1369168 - protein, 6 aa, Mycobacterium tuberculosis
RAHHTA

SEQ ID NO: 1369169 - protein, 6 aa, Mycobacterium tuberculosis
RAPENT

SEQ ID NO: 1369170 - protein, 10 aa, Mycobacterium tuberculosis
RAPSQADGRN

SEQ ID NO: 1369171 - protein, 8 aa, Mycobacterium tuberculosis
RASGRRRM

SEQ ID NO: 1369172 - protein, 11 aa, Mycobacterium tuberculosis
RASRRAHPYRP

SEQ ID NO: 1369173 - protein, 4 aa, Mycobacterium tuberculosis
RATE

SEQ ID NO: 1369174 - protein, 8 aa, Mycobacterium tuberculosis
RATPVAAP

SEQ ID NO: 1369175 - protein, 4 aa, Mycobacterium tuberculosis
RATQ

SEQ ID NO: 1369176 - protein, 5 aa, Mycobacterium tuberculosis
RATRL

SEQ ID NO: 1369177 - protein, 13 aa, Mycobacterium tuberculosis
RATTVTGSVTVES

SEQ ID NO: 1369178 - protein, 6 aa, Mycobacterium tuberculosis
RAVADS

SEQ ID NO: 1369179 - protein, 11 aa, Mycobacterium tuberculosis
RDADARQARNQ

SEQ ID NO: 1369180 - protein, 12 aa, Mycobacterium tuberculosis
RDATPRDIHPKH

SEQ ID NO: 1369181 - protein, 17 aa, Mycobacterium tuberculosis
RDDKKDGVAGPGDAVRV

SEQ ID NO: 1369182 - protein, 7 aa, Mycobacterium tuberculosis
RDESALG

SEQ ID NO: 1369183 - protein, 10 aa, Mycobacterium tuberculosis
RDGITDLPDG

SEQ ID NO: 1369184 - protein, 6 aa, Mycobacterium tuberculosis
RDNQNR

SEQ ID NO: 1369185 - protein, 11 aa, Mycobacterium tuberculosis
RDPVSDTGSAQ

SEQ ID NO: 1369186 - protein, 6 aa, Mycobacterium tuberculosis
RDREVR

SEQ ID NO: 1369187 - protein, 15 aa, Mycobacterium tuberculosis
REAASAPALAEAARR

SEQ ID NO: 1369188 - protein, 8 aa, Mycobacterium tuberculosis
REFADESD

SEQ ID NO: 1369189 - protein, 7 aa, Mycobacterium tuberculosis
REGYERD

SEQ ID NO: 1369190 - protein, 19 aa, Mycobacterium tuberculosis
REHPNWDEDGVKDSGTNAS

SEQ ID NO: 1369191 - protein, 8 aa, Mycobacterium tuberculosis
REVSDSAR

SEQ ID NO: 1369192 - protein, 7 aa, Mycobacterium tuberculosis
REVTSAI

SEQ ID NO: 1369193 - protein, 6 aa, Mycobacterium tuberculosis
RFAPAK

SEQ ID NO: 1369194 - protein, 4 aa, Mycobacterium tuberculosis
RFDS

SEQ ID NO: 1369195 - protein, 15 aa, Mycobacterium tuberculosis
RFRPGGHPTPLPNPG

SEQ ID NO: 1369196 - protein, 7 aa, Mycobacterium tuberculosis
RGARNNP

SEQ ID NO: 1369197 - protein, 4 aa, Mycobacterium tuberculosis
RGDD

SEQ ID NO: 1369198 - protein, 6 aa, Mycobacterium tuberculosis
RGESLS

SEQ ID NO: 1369199 - protein, 9 aa, Mycobacterium tuberculosis
RGGPALGET

SEQ ID NO: 1369200 - protein, 11 aa, Mycobacterium tuberculosis
RGGSKGLGTAV

SEQ ID NO: 1369201 - protein, 10 aa, Mycobacterium tuberculosis
RGHDAAPQVA

SEQ ID NO: 1369202 - protein, 5 aa, Mycobacterium tuberculosis
RGMRD

SEQ ID NO: 1369203 - protein, 7 aa, Mycobacterium tuberculosis
RGPGDWQ

SEQ ID NO: 1369204 - protein, 10 aa, Mycobacterium tuberculosis
RGRGDTASIE

SEQ ID NO: 1369205 - protein, 11 aa, Mycobacterium tuberculosis
RHATRTATVSA

SEQ ID NO: 1369206 - protein, 5 aa, Mycobacterium tuberculosis
RHTRS

SEQ ID NO: 1369207 - protein, 11 aa, Mycobacterium tuberculosis
RIRGGGRASVG

SEQ ID NO: 1369208 - protein, 9 aa, Mycobacterium tuberculosis
RKAGSAGRA

SEQ ID NO: 1369209 - protein, 13 aa, Mycobacterium tuberculosis
RKEGQAGQSKMTQ

SEQ ID NO: 1369210 - protein, 6 aa, Mycobacterium tuberculosis
RKHEHT

SEQ ID NO: 1369211 - protein, 9 aa, Mycobacterium tuberculosis
RKPELGTPQ

SEQ ID NO: 1369212 - protein, 8 aa, Mycobacterium tuberculosis
RKQDEVSS

SEQ ID NO: 1369213 - protein, 4 aa, Mycobacterium tuberculosis
RMAR

SEQ ID NO: 1369214 - protein, 15 aa, Mycobacterium tuberculosis
RNGDDREYDYETNID

SEQ ID NO: 1369215 - protein, 5 aa, Mycobacterium tuberculosis
RNRAV

SEQ ID NO: 1369216 - protein, 4 aa, Mycobacterium tuberculosis
RPAG

SEQ ID NO: 1369217 - protein, 8 aa, Mycobacterium tuberculosis
RPAGREHR

SEQ ID NO: 1369218 - protein, 5 aa, Mycobacterium tuberculosis
RPDLQ

SEQ ID NO: 1369219 - protein, 9 aa, Mycobacterium tuberculosis
RPDSWPSSA

SEQ ID NO: 1369220 - protein, 7 aa, Mycobacterium tuberculosis
RPGRPTA

SEQ ID NO: 1369221 - protein, 14 aa, Mycobacterium tuberculosis
RPKTQRRLPRPRWQ

SEQ ID NO: 1369222 - protein, 6 aa, Mycobacterium tuberculosis
RPTHEQ

SEQ ID NO: 1369223 - protein, 10 aa, Mycobacterium tuberculosis
RQLPDGYQTV

SEQ ID NO: 1369224 - protein, 6 aa, Mycobacterium tuberculosis
RQNNCD

SEQ ID NO: 1369225 - protein, 5 aa, Mycobacterium tuberculosis
RRATD

SEQ ID NO: 1369226 - protein, 7 aa, Mycobacterium tuberculosis
RRDAAEA

SEQ ID NO: 1369227 - protein, 17 aa, Mycobacterium tuberculosis
RRGARGAQAGLETYLDP

SEQ ID NO: 1369228 - protein, 4 aa, Mycobacterium tuberculosis
RRGP

SEQ ID NO: 1369229 - protein, 13 aa, Mycobacterium tuberculosis
RRGSIGPEARTRL

SEQ ID NO: 1369230 - protein, 5 aa, Mycobacterium tuberculosis
RRPGA

SEQ ID NO: 1369231 - protein, 6 aa, Mycobacterium tuberculosis
RRPGAA

SEQ ID NO: 1369232 - protein, 23 aa, Mycobacterium tuberculosis
RRQHSNAAGRAAPQDDGPDMGPR

SEQ ID NO: 1369233 - protein, 13 aa, Mycobacterium tuberculosis
RRQSGTRTRSTNE

SEQ ID NO: 1369234 - protein, 6 aa, Mycobacterium tuberculosis
RRQSRR

SEQ ID NO: 1369235 - protein, 5 aa, Mycobacterium tuberculosis
RSDRG

SEQ ID NO: 1369236 - protein, 5 aa, Mycobacterium tuberculosis
RSDRL

SEQ ID NO: 1369237 - protein, 10 aa, Mycobacterium tuberculosis
RSEEAKTGKL

SEQ ID NO: 1369238 - protein, 5 aa, Mycobacterium tuberculosis
RSITG

SEQ ID NO: 1369239 - protein, 20 aa, Mycobacterium tuberculosis
RSQESTLPAPPKPVPPPTMP

SEQ ID NO: 1369240 - protein, 7 aa, Mycobacterium tuberculosis
RSRPAQE

SEQ ID NO: 1369241 - protein, 4 aa, Mycobacterium tuberculosis
RSRS

SEQ ID NO: 1369242 - protein, 6 aa, Mycobacterium tuberculosis
RSSEGE

SEQ ID NO: 1369243 - protein, 14 aa, Mycobacterium tuberculosis
RSTDVAPPRGETPD

SEQ ID NO: 1369244 - protein, 5 aa, Mycobacterium tuberculosis
RTAPP

SEQ ID NO: 1369245 - protein, 9 aa, Mycobacterium tuberculosis
RTNGASYAY

SEQ ID NO: 1369246 - protein, 7 aa, Mycobacterium tuberculosis
RTNYNDR

SEQ ID NO: 1369247 - protein, 6 aa, Mycobacterium tuberculosis
RTPAGD

SEQ ID NO: 1369248 - protein, 5 aa, Mycobacterium tuberculosis
RTRTA

SEQ ID NO: 1369249 - protein, 7 aa, Mycobacterium tuberculosis
RTSDQDM

SEQ ID NO: 1369250 - protein, 10 aa, Mycobacterium tuberculosis
RTTRTSELGN

SEQ ID NO: 1369251 - protein, 25 aa, Mycobacterium tuberculosis
RTTTPTVGAATTATGWRPDPTGRHE

SEQ ID NO: 1369252 - protein, 13 aa, Mycobacterium tuberculosis
RTWSATAEHRAQR

SEQ ID NO: 1369253 - protein, 14 aa, Mycobacterium tuberculosis
RVAEGKSNDIPERV

SEQ ID NO: 1369254 - protein, 5 aa, Mycobacterium tuberculosis
RVASE

SEQ ID NO: 1369255 - protein, 7 aa, Mycobacterium tuberculosis
RVGDDEA

SEQ ID NO: 1369256 - protein, 15 aa, Mycobacterium tuberculosis
RVPPQADTFSRPRWS

SEQ ID NO: 1369257 - protein, 10 aa, Mycobacterium tuberculosis
RYGGGPDQVV

SEQ ID NO: 1369258 - protein, 16 aa, Mycobacterium tuberculosis
RYRDSAQTSTPTGNLP

SEQ ID NO: 1369259 - protein, 8 aa, Mycobacterium tuberculosis
SAAASSAA

SEQ ID NO: 1369260 - protein, 6 aa, Mycobacterium tuberculosis
SAARDL

SEQ ID NO: 1369261 - protein, 4 aa, Mycobacterium tuberculosis
SAAS

SEQ ID NO: 1369262 - protein, 14 aa, Mycobacterium tuberculosis
SADADGYTRSEGGG

SEQ ID NO: 1369263 - protein, 6 aa, Mycobacterium tuberculosis
SADAQA

SEQ ID NO: 1369264 - protein, 9 aa, Mycobacterium tuberculosis
SAFGTPPAR

SEQ ID NO: 1369265 - protein, 7 aa, Mycobacterium tuberculosis
SAGPRRS

SEQ ID NO: 1369266 - protein, 27 aa, Mycobacterium tuberculosis
SAHLDPEPHDPTDDGPDHDEPRDDPNS

SEQ ID NO: 1369267 - protein, 8 aa, Mycobacterium tuberculosis
SAIGTPTE

SEQ ID NO: 1369268 - protein, 10 aa, Mycobacterium tuberculosis
SALSSSAGSV

SEQ ID NO: 1369269 - protein, 12 aa, Mycobacterium tuberculosis
SAMSDAQDSRVG

SEQ ID NO: 1369270 - protein, 9 aa, Mycobacterium tuberculosis
SAPPAATPG

SEQ ID NO: 1369271 - protein, 6 aa, Mycobacterium tuberculosis
SAPSLN

SEQ ID NO: 1369272 - protein, 6 aa, Mycobacterium tuberculosis
SAPVAA

SEQ ID NO: 1369273 - protein, 9 aa, Mycobacterium tuberculosis
SARPNTELE

SEQ ID NO: 1369274 - protein, 6 aa, Mycobacterium tuberculosis
SASRLG

SEQ ID NO: 1369275 - protein, 6 aa, Mycobacterium tuberculosis
SATPAQ

SEQ ID NO: 1369276 - protein, 14 aa, Mycobacterium tuberculosis
SATYQSAIPPRGTQ

SEQ ID NO: 1369277 - protein, 6 aa, Mycobacterium tuberculosis
SDEGIQ

SEQ ID NO: 1369278 - protein, 8 aa, Mycobacterium tuberculosis
SDFDEDEL

SEQ ID NO: 1369279 - protein, 8 aa, Mycobacterium tuberculosis
SDQEGMQG

SEQ ID NO: 1369280 - protein, 7 aa, Mycobacterium tuberculosis
SELSGDR

SEQ ID NO: 1369281 - protein, 7 aa, Mycobacterium tuberculosis
SEQEKKI

SEQ ID NO: 1369282 - protein, 12 aa, Mycobacterium tuberculosis
SEQNPAKPAARG

SEQ ID NO: 1369283 - protein, 7 aa, Mycobacterium tuberculosis
SESAPTV

SEQ ID NO: 1369284 - protein, 7 aa, Mycobacterium tuberculosis
SESHATY

SEQ ID NO: 1369285 - protein, 5 aa, Mycobacterium tuberculosis
SETAG

SEQ ID NO: 1369286 - protein, 21 aa, Mycobacterium tuberculosis
SETMANRRTAAGNIESVPSSR

SEQ ID NO: 1369287 - protein, 11 aa, Mycobacterium tuberculosis
SFPTSAAPGWS

SEQ ID NO: 1369288 - protein, 8 aa, Mycobacterium tuberculosis
SGAAVGAA

SEQ ID NO: 1369289 - protein, 6 aa, Mycobacterium tuberculosis
SGDGIT

SEQ ID NO: 1369290 - protein, 8 aa, Mycobacterium tuberculosis
SGGTRGGL

SEQ ID NO: 1369291 - protein, 12 aa, Mycobacterium tuberculosis
SGLGPDRRTASA

SEQ ID NO: 1369292 - protein, 8 aa, Mycobacterium tuberculosis
SGLGSSPA

SEQ ID NO: 1369293 - protein, 5 aa, Mycobacterium tuberculosis
SGLGT

SEQ ID NO: 1369294 - protein, 6 aa, Mycobacterium tuberculosis
SGLTNG

SEQ ID NO: 1369295 - protein, 13 aa, Mycobacterium tuberculosis
SGPATKDIPDVAG

SEQ ID NO: 1369296 - protein, 6 aa, Mycobacterium tuberculosis
SGPEMR

SEQ ID NO: 1369297 - protein, 6 aa, Mycobacterium tuberculosis
SGPIRD

SEQ ID NO: 1369298 - protein, 9 aa, Mycobacterium tuberculosis
SGPLAEGRT

SEQ ID NO: 1369299 - protein, 18 aa, Mycobacterium tuberculosis
SGRALGAPPTTATAGAHA

SEQ ID NO: 1369300 - protein, 5 aa, Mycobacterium tuberculosis
SGSPS

SEQ ID NO: 1369301 - protein, 9 aa, Mycobacterium tuberculosis
SGSTRIPSG

SEQ ID NO: 1369302 - protein, 13 aa, Mycobacterium tuberculosis
SGTEGAAARTADR

SEQ ID NO: 1369303 - protein, 17 aa, Mycobacterium tuberculosis
SGYPTGTCKPTTPKPNS

SEQ ID NO: 1369304 - protein, 29 aa, Mycobacterium tuberculosis
SHQPRTATPPSAAALSPTSSSTTPPQPPI

SEQ ID NO: 1369305 - protein, 10 aa, Mycobacterium tuberculosis
SIPITTSGKI

SEQ ID NO: 1369306 - protein, 7 aa, Mycobacterium tuberculosis
SKPLRRG

SEQ ID NO: 1369307 - protein, 16 aa, Mycobacterium tuberculosis
SKQTYDYTPTPQPPDV

SEQ ID NO: 1369308 - protein, 5 aa, Mycobacterium tuberculosis
SKSHS

SEQ ID NO: 1369309 - protein, 8 aa, Mycobacterium tuberculosis
SLAGGDRT

SEQ ID NO: 1369310 - protein, 4 aa, Mycobacterium tuberculosis
SLGG

SEQ ID NO: 1369311 - protein, 11 aa, Mycobacterium tuberculosis
SLPPDTRNGLA

SEQ ID NO: 1369312 - protein, 14 aa, Mycobacterium tuberculosis
SLQPGERVHTTSGL

SEQ ID NO: 1369313 - protein, 25 aa, Mycobacterium tuberculosis
SLQPPEEIEGPAIPPASSQLVCVAP

SEQ ID NO: 1369314 - protein, 10 aa, Mycobacterium tuberculosis
SMRATDVEPS

SEQ ID NO: 1369315 - protein, 10 aa, Mycobacterium tuberculosis
SNAIASGAQV

SEQ ID NO: 1369316 - protein, 9 aa, Mycobacterium tuberculosis
SNTDSDAHE

SEQ ID NO: 1369317 - protein, 8 aa, Mycobacterium tuberculosis
SPDQRQER

SEQ ID NO: 1369318 - protein, 8 aa, Mycobacterium tuberculosis
SPEAPESR

SEQ ID NO: 1369319 - protein, 8 aa, Mycobacterium tuberculosis
SPNPDSRP

SEQ ID NO: 1369320 - protein, 7 aa, Mycobacterium tuberculosis
SPTDAAA

SEQ ID NO: 1369321 - protein, 7 aa, Mycobacterium tuberculosis
SPTPRPA

SEQ ID NO: 1369322 - protein, 34 aa, Mycobacterium tuberculosis; identical to SEQ ID NO: 155841

SEQ ID NO: 1369323 - protein, 11 aa, Mycobacterium tuberculosis
SQDPVYAGTGY

SEQ ID NO: 1369324 - protein, 4 aa, Mycobacterium tuberculosis
SQPL

SEQ ID NO: 1369325 - protein, 22 aa, Mycobacterium tuberculosis
SQPSYPAPELSAGADVDGRADQ

SEQ ID NO: 1369326 - protein, 8 aa, Mycobacterium tuberculosis
SQTHTSDA

SEQ ID NO: 1369327 - protein, 7 aa, Mycobacterium tuberculosis
SQTQGLK

SEQ ID NO: 1369328 - protein, 7 aa, Mycobacterium tuberculosis
SRDEIGD

SEQ ID NO: 1369329 - protein, 9 aa, Mycobacterium tuberculosis
SRIQGPAAQ

SEQ ID NO: 1369330 - protein, 6 aa, Mycobacterium tuberculosis
SRLPTG

SEQ ID NO: 1369331 - protein, 6 aa, Mycobacterium tuberculosis
SRQSLR

SEQ ID NO: 1369332 - protein, 4 aa, Mycobacterium tuberculosis
SSDA

SEQ ID NO: 1369333 - protein, 5 aa, Mycobacterium tuberculosis
SSERI

SEQ ID NO: 1369334 - protein, 4 aa, Mycobacterium tuberculosis
SSGN

SEQ ID NO: 1369335 - protein, 5 aa, Mycobacterium tuberculosis
SSRGN

SEQ ID NO: 1369336 - protein, 5 aa, Mycobacterium tuberculosis
SSTND

SEQ ID NO: 1369337 - protein, 8 aa, Mycobacterium tuberculosis
STAGDITG

SEQ ID NO: 1369338 - protein, 15 aa, Mycobacterium tuberculosis
STATKAPASPTRRRP

SEQ ID NO: 1369339 - protein, 6 aa, Mycobacterium tuberculosis
STIAAG

SEQ ID NO: 1369340 - protein, 8 aa, Mycobacterium tuberculosis
STPAPPGI

SEQ ID NO: 1369341 - protein, 6 aa, Mycobacterium tuberculosis
STPRSY

SEQ ID NO: 1369342 - protein, 6 aa, Mycobacterium tuberculosis
STRPTT

SEQ ID NO: 1369343 - protein, 16 aa, Mycobacterium tuberculosis
STTASRSAKDTAAESL

SEQ ID NO: 1369344 - protein, 8 aa, Mycobacterium tuberculosis
SVTQTAAA

SEQ ID NO: 1369345 - protein, 5 aa, Mycobacterium tuberculosis
SWRDT

SEQ ID NO: 1369346 - protein, 10 aa, Mycobacterium tuberculosis
SWRDTETERG

SEQ ID NO: 1369347 - protein, 9 aa, Mycobacterium tuberculosis
SYYPDQKSL

SEQ ID NO: 1369348 - protein, 7 aa, Mycobacterium tuberculosis
TAAATAA

SEQ ID NO: 1369349 - protein, 14 aa, Mycobacterium tuberculosis
TAAKEAIKGTPLEG

SEQ ID NO: 1369350 - protein, 15 aa, Mycobacterium tuberculosis
TAAPNAFATGRNPRN

SEQ ID NO: 1369351 - protein, 13 aa, Mycobacterium tuberculosis
TAATYQDIRDGTK

SEQ ID NO: 1369352 - protein, 6 aa, Mycobacterium tuberculosis
TAEPDR

SEQ ID NO: 1369353 - protein, 6 aa, Mycobacterium tuberculosis
TANGAL

SEQ ID NO: 1369354 - protein, 7 aa, Mycobacterium tuberculosis
TAPPDPL

SEQ ID NO: 1369355 - protein, 17 aa, Mycobacterium tuberculosis
TARGGTGQLSAHPGRPK

SEQ ID NO: 1369356 - protein, 12 aa, Mycobacterium tuberculosis
TASNDPDARRQL

SEQ ID NO: 1369357 - protein, 11 aa, Mycobacterium tuberculosis
TDGGGYPTGRE

SEQ ID NO: 1369358 - protein, 8 aa, Mycobacterium tuberculosis
TDHGAGLS

SEQ ID NO: 1369359 - protein, 12 aa, Mycobacterium tuberculosis
TDVRRAPHAGGR

SEQ ID NO: 1369360 - protein, 15 aa, Mycobacterium tuberculosis
TEEGGQYKMSKVEFV

SEQ ID NO: 1369361 - protein, 8 aa, Mycobacterium tuberculosis
TEFPGQAG

SEQ ID NO: 1369362 - protein, 4 aa, Mycobacterium tuberculosis
TEPV

SEQ ID NO: 1369363 - protein, 14 aa, Mycobacterium tuberculosis
TFPTNSQLTNESAA

SEQ ID NO: 1369364 - protein, 5 aa, Mycobacterium tuberculosis
TGDGL

SEQ ID NO: 1369365 - protein, 67 aa, Mycobacterium tuberculosis; identical to SEQ ID NO: 154453

SEQ ID NO: 1369366 - protein, 10 aa, Mycobacterium tuberculosis
TGEAKPVRAY

SEQ ID NO: 1369367 - protein, 5 aa, Mycobacterium tuberculosis
TGEFE

SEQ ID NO: 1369368 - protein, 10 aa, Mycobacterium tuberculosis
TGGEYGTSAT

SEQ ID NO: 1369369 - protein, 7 aa, Mycobacterium tuberculosis
TGKEEPL

SEQ ID NO: 1369370 - protein, 7 aa, Mycobacterium tuberculosis
TGKRRDR

SEQ ID NO: 1369371 - protein, 8 aa, Mycobacterium tuberculosis
TGQRDRSR

SEQ ID NO: 1369372 - protein, 4 aa, Mycobacterium tuberculosis
TGSV

SEQ ID NO: 1369373 - protein, 5 aa, Mycobacterium tuberculosis
TGTLT

SEQ ID NO: 1369374 - protein, 11 aa, Mycobacterium tuberculosis
TGVREVSTGDD

SEQ ID NO: 1369375 - protein, 10 aa, Mycobacterium tuberculosis
TITGTSVEGN

SEQ ID NO: 1369376 - protein, 16 aa, Mycobacterium tuberculosis
TKSDSRTSDFQPVSAT

SEQ ID NO: 1369377 - protein, 4 aa, Mycobacterium tuberculosis
TLDP

SEQ ID NO: 1369378 - protein, 14 aa, Mycobacterium tuberculosis
TLSTTGNAQEPAGR

SEQ ID NO: 1369379 - protein, 13 aa, Mycobacterium tuberculosis
TMPDANPQDDIRG

SEQ ID NO: 1369380 - protein, 27 aa, Mycobacterium tuberculosis
TNAQRRATAKRKLERQLERRAKQAKRR

SEQ ID NO: 1369381 - protein, 8 aa, Mycobacterium tuberculosis
TNATSEAV

SEQ ID NO: 1369382 - protein, 10 aa, Mycobacterium tuberculosis
TNGDGVERRL

SEQ ID NO: 1369383 - protein, 5 aa, Mycobacterium tuberculosis
TNGTF

SEQ ID NO: 1369384 - protein, 7 aa, Mycobacterium tuberculosis
TNGYTAE

SEQ ID NO: 1369385 - protein, 15 aa, Mycobacterium tuberculosis
TPKPADGVPPPPLNT

SEQ ID NO: 1369386 - protein, 7 aa, Mycobacterium tuberculosis
TPLPPRR

SEQ ID NO: 1369387 - protein, 5 aa, Mycobacterium tuberculosis
TPMDE

SEQ ID NO: 1369388 - protein, 8 aa, Mycobacterium tuberculosis
TPNDPRFQ

SEQ ID NO: 1369389 - protein, 5 aa, Mycobacterium tuberculosis
TPTPA

SEQ ID NO: 1369390 - protein, 8 aa, Mycobacterium tuberculosis
TPVNRGYA

SEQ ID NO: 1369391 - protein, 6 aa, Mycobacterium tuberculosis
TQEGLQ

SEQ ID NO: 1369392 - protein, 22 aa, Mycobacterium tuberculosis
TQISRQSNLPPAAGGAANYSRR

SEQ ID NO: 1369393 - protein, 5 aa, Mycobacterium tuberculosis
TQITK

SEQ ID NO: 1369394 - protein, 8 aa, Mycobacterium tuberculosis
TQKISAGD

SEQ ID NO: 1369395 - protein, 6 aa, Mycobacterium tuberculosis
TRADSL

SEQ ID NO: 1369396 - protein, 10 aa, Mycobacterium tuberculosis
TRASSGLTDE

SEQ ID NO: 1369397 - protein, 4 aa, Mycobacterium tuberculosis
TRDS

SEQ ID NO: 1369398 - protein, 6 aa, Mycobacterium tuberculosis
TRPLAG

SEQ ID NO: 1369399 - protein, 4 aa, Mycobacterium tuberculosis
TRPQ

SEQ ID NO: 1369400 - protein, 9 aa, Mycobacterium tuberculosis
TRRGGRDGD

SEQ ID NO: 1369401 - protein, 4 aa, Mycobacterium tuberculosis
TRRR

SEQ ID NO: 1369402 - protein, 4 aa, Mycobacterium tuberculosis
TRSV

SEQ ID NO: 1369403 - protein, 9 aa, Mycobacterium tuberculosis
TSAISKSHG

SEQ ID NO: 1369404 - protein, 16 aa, Mycobacterium tuberculosis
TSARVDRETTASTQIP

SEQ ID NO: 1369405 - protein, 15 aa, Mycobacterium tuberculosis
TSATATAPADAPASV

SEQ ID NO: 1369406 - protein, 26 aa, Mycobacterium tuberculosis
TSEAFEPVGSQANPNDPNATPAAGSI

SEQ ID NO: 1369407 - protein, 5 aa, Mycobacterium tuberculosis
TSGGV

SEQ ID NO: 1369408 - protein, 4 aa, Mycobacterium tuberculosis
TSLE

SEQ ID NO: 1369409 - protein, 31 aa, Mycobacterium tuberculosis; identical to SEQ ID NO: 155892

SEQ ID NO: 1369410 - protein, 5 aa, Mycobacterium tuberculosis
TSRRS

SEQ ID NO: 1369411 - protein, 8 aa, Mycobacterium tuberculosis
TTDATEVA

SEQ ID NO: 1369412 - protein, 7 aa, Mycobacterium tuberculosis
TTIATSP

SEQ ID NO: 1369413 - protein, 8 aa, Mycobacterium tuberculosis
TTLTGGDL

SEQ ID NO: 1369414 - protein, 8 aa, Mycobacterium tuberculosis
TTNGATRE

SEQ ID NO: 1369415 - protein, 10 aa, Mycobacterium tuberculosis
TTNSGAPFPD

SEQ ID NO: 1369416 - protein, 5 aa, Mycobacterium tuberculosis
TTPKM

SEQ ID NO: 1369417 - protein, 10 aa, Mycobacterium tuberculosis
TTVKSSQPPV

SEQ ID NO: 1369418 - protein, 4 aa, Mycobacterium tuberculosis
TVAP

SEQ ID NO: 1369419 - protein, 23 aa, Mycobacterium tuberculosis
TVASPTVTATADPTEAPLPIEQE

SEQ ID NO: 1369420 - protein, 24 aa, Mycobacterium tuberculosis
TVASPTVTATADPTEAPLPIEQES

SEQ ID NO: 1369421 - protein, 23 aa, Mycobacterium tuberculosis
TVDAATDVPAPANAAGSQGAGTL

SEQ ID NO: 1369422 - protein, 4 aa, Mycobacterium tuberculosis
TVDS

SEQ ID NO: 1369423 - protein, 6 aa, Mycobacterium tuberculosis
TVKPGD

SEQ ID NO: 1369424 - protein, 4 aa, Mycobacterium tuberculosis
TVPA

SEQ ID NO: 1369425 - protein, 5 aa, Mycobacterium tuberculosis
TYRGP

SEQ ID NO: 1369426 - protein, 11 aa, Mycobacterium tuberculosis
VAARQAERIGA

SEQ ID NO: 1369427 - protein, 7 aa, Mycobacterium tuberculosis
VANTPQS

SEQ ID NO: 1369428 - protein, 18 aa, Mycobacterium tuberculosis
VAPASAPAAAVDGDPATA

SEQ ID NO: 1369429 - protein, 6 aa, Mycobacterium tuberculosis
VAPGPG

SEQ ID NO: 1369430 - protein, 8 aa, Mycobacterium tuberculosis
VAPPSVRP

SEQ ID NO: 1369431 - protein, 8 aa, Mycobacterium tuberculosis
VAPSAGEL

SEQ ID NO: 1369432 - protein, 5 aa, Mycobacterium tuberculosis
VAQGA

SEQ ID NO: 1369433 - protein, 5 aa, Mycobacterium tuberculosis
VATAA

SEQ ID NO: 1369434 - protein, 11 aa, Mycobacterium tuberculosis
VDAAKASASLQ

SEQ ID NO: 1369435 - protein, 7 aa, Mycobacterium tuberculosis
VDDEPER

SEQ ID NO: 1369436 - protein, 8 aa, Mycobacterium tuberculosis
VDERGGGI

SEQ ID NO: 1369437 - protein, 4 aa, Mycobacterium tuberculosis
VDPS

SEQ ID NO: 1369438 - protein, 5 aa, Mycobacterium tuberculosis
VEGTQ

SEQ ID NO: 1369439 - protein, 8 aa, Mycobacterium tuberculosis
VENTRDRE

SEQ ID NO: 1369440 - protein, 11 aa, Mycobacterium tuberculosis
VEPPPGPPVAP

SEQ ID NO: 1369441 - protein, 27 aa, Mycobacterium tuberculosis
VETRDPNATLRPGSPSNPAAPGSVGNS

SEQ ID NO: 1369442 - protein, 8 aa, Mycobacterium tuberculosis
VGAGATAE

SEQ ID NO: 1369443 - protein, 8 aa, Mycobacterium tuberculosis
VGAGATAQ

SEQ ID NO: 1369444 - protein, 13 aa, Mycobacterium tuberculosis
VGASGPQEAAARA

SEQ ID NO: 1369445 - protein, 5 aa, Mycobacterium tuberculosis
VGGDL

SEQ ID NO: 1369446 - protein, 11 aa, Mycobacterium tuberculosis
VGGPDGEGFNP

SEQ ID NO: 1369447 - protein, 6 aa, Mycobacterium tuberculosis
VGGQPF

SEQ ID NO: 1369448 - protein, 4 aa, Mycobacterium tuberculosis
VGGY

SEQ ID NO: 1369449 - protein, 12 aa, Mycobacterium tuberculosis
VGLGASARERNI

SEQ ID NO: 1369450 - protein, 5 aa, Mycobacterium tuberculosis
VHHPT

SEQ ID NO: 1369451 - protein, 5 aa, Mycobacterium tuberculosis
VKPGD

SEQ ID NO: 1369452 - protein, 14 aa, Mycobacterium tuberculosis
VMPQGSQSLAGTPF

SEQ ID NO: 1369453 - protein, 9 aa, Mycobacterium tuberculosis
VNFSGGQRQ

SEQ ID NO: 1369454 - protein, 9 aa, Mycobacterium tuberculosis
VNHDGRSNG

SEQ ID NO: 1369455 - protein, 10 aa, Mycobacterium tuberculosis
VNKTAAAAGI

SEQ ID NO: 1369456 - protein, 5 aa, Mycobacterium tuberculosis
VNQVG

SEQ ID NO: 1369457 - protein, 4 aa, Mycobacterium tuberculosis
VPDP

SEQ ID NO: 1369458 - protein, 5 aa, Mycobacterium tuberculosis
VPPRD

SEQ ID NO: 1369459 - protein, 6 aa, Mycobacterium tuberculosis
VPPYKT

SEQ ID NO: 1369460 - protein, 9 aa, Mycobacterium tuberculosis
VPSESGPAA

SEQ ID NO: 1369461 - protein, 8 aa, Mycobacterium tuberculosis
VQTPDDPT

SEQ ID NO: 1369462 - protein, 8 aa, Mycobacterium tuberculosis
VRSYDDDG

SEQ ID NO: 1369463 - protein, 7 aa, Mycobacterium tuberculosis
VRTPSAA

SEQ ID NO: 1369464 - protein, 8 aa, Mycobacterium tuberculosis
VSKKASEW

SEQ ID NO: 1369465 - protein, 8 aa, Mycobacterium tuberculosis
VSPGGTGV

SEQ ID NO: 1369466 - protein, 13 aa, Mycobacterium tuberculosis
VTDDRSAPHADSI

SEQ ID NO: 1369467 - protein, 4 aa, Mycobacterium tuberculosis
VTDL

SEQ ID NO: 1369468 - protein, 7 aa, Mycobacterium tuberculosis
VTQTAAA

SEQ ID NO: 1369469 - protein, 28 aa, Mycobacterium tuberculosis
VTRPNGETLEQARATYQAGQVGNRLGGA

SEQ ID NO: 1369470 - protein, 14 aa, Mycobacterium tuberculosis
VTTARTINAQQAEL

SEQ ID NO: 1369471 - protein, 10 aa, Mycobacterium tuberculosis
VTTSSEPHVT

SEQ ID NO: 1369472 - protein, 11 aa, Mycobacterium tuberculosis
VYPDRSARAAA

SEQ ID NO: 1369473 - protein, 8 aa, Mycobacterium tuberculosis
WARAGNAV

SEQ ID NO: 1369474 - protein, 19 aa, Mycobacterium tuberculosis
WKGDPNATVPGLGSGQDIP

SEQ ID NO: 1369475 - protein, 7 aa, Mycobacterium tuberculosis
WKSRPET

SEQ ID NO: 1369476 - protein, 11 aa, Mycobacterium tuberculosis
WPPSGPQRAPQ

SEQ ID NO: 1369477 - protein, 24 aa, Mycobacterium tuberculosis
WRTPARPQVPTASDTRRTPPRLPP

SEQ ID NO: 1369478 - protein, 4 aa, Mycobacterium tuberculosis
WSAG

SEQ ID NO: 1369479 - protein, 9 aa, Mycobacterium tuberculosis
YASGTPWAK

SEQ ID NO: 1369480 - protein, 13 aa, Mycobacterium tuberculosis
YGRPDATPEQIAT

SEQ ID NO: 1369481 - protein, 5 aa, Mycobacterium tuberculosis
YGYGP

SEQ ID NO: 1369482 - protein, 9 aa, Mycobacterium tuberculosis
YPDAQPADL

SEQ ID NO: 1369483 - protein, 11 aa, Mycobacterium tuberculosis
YPVADRDGSIT

SEQ ID NO: 1369484 - protein, 4 aa, Mycobacterium tuberculosis
YSRG

SEQ ID NO: 1369485 - protein, 10 aa, Mycobacterium tuberculosis
YTGAAQAAGA

SEQ ID NO: 1369486 - protein, 20 aa, Mycobacterium tuberculosis
YTGPERCSGDGQVRAAGDRY

SEQ ID NO: 1369487 - protein, 9 aa, Mycobacterium tuberculosis
AAAAGLASP

SEQ ID NO: 1369488 - protein, 16 aa, Mycobacterium tuberculosis
AAARALDRARGAADPL

SEQ ID NO: 1369489 - protein, 13 aa, Mycobacterium tuberculosis
AAATAAGAAGSVR

SEQ ID NO: 1369490 - protein, 9 aa, Mycobacterium tuberculosis
AAATSAPRL

SEQ ID NO: 1369491 - protein, 6 aa, Mycobacterium tuberculosis
AAATTQ

SEQ ID NO: 1369492 - protein, 6 aa, Mycobacterium tuberculosis
AAAYAA

SEQ ID NO: 1369493 - protein, 7 aa, Mycobacterium tuberculosis
AACGPPQ

SEQ ID NO: 1369494 - protein, 11 aa, Mycobacterium tuberculosis
AADGASVPHGP

SEQ ID NO: 1369495 - protein, 16 aa, Mycobacterium tuberculosis
AADPGEVRGAEPRTVG

SEQ ID NO: 1369496 - protein, 5 aa, Mycobacterium tuberculosis
AAEPK

SEQ ID NO: 1369497 - protein, 12 aa, Mycobacterium tuberculosis
AAGDGADATARR

SEQ ID NO: 1369498 - protein, 30 aa, Mycobacterium tuberculosis
AAGRSVQSPASTPPPTPTPPSAPSAGQTRA

SEQ ID NO: 1369499 - protein, 9 aa, Mycobacterium tuberculosis
AAKERLSTD

SEQ ID NO: 1369500 - protein, 6 aa, Mycobacterium tuberculosis
AALPSA

SEQ ID NO: 1369501 - protein, 7 aa, Mycobacterium tuberculosis
AAPELGE

SEQ ID NO: 1369502 - protein, 7 aa, Mycobacterium tuberculosis
AAPQTTR

SEQ ID NO: 1369503 - protein, 9 aa, Mycobacterium tuberculosis
AATGRTPTL

SEQ ID NO: 1369504 - protein, 9 aa, Mycobacterium tuberculosis
AAVTNTLAD

SEQ ID NO: 1369505 - protein, 4 aa, Mycobacterium tuberculosis
ADAG

SEQ ID NO: 1369506 - protein, 11 aa, Mycobacterium tuberculosis
ADDEFSTAERV

SEQ ID NO: 1369507 - protein, 5 aa, Mycobacterium tuberculosis
ADPAV

SEQ ID NO: 1369508 - protein, 17 aa, Mycobacterium tuberculosis
ADPRRRRRYQRARGKGG

SEQ ID NO: 1369509 - protein, 6 aa, Mycobacterium tuberculosis
AEEASR

SEQ ID NO: 1369510 - protein, 4 aa, Mycobacterium tuberculosis
AEIG

SEQ ID NO: 1369511 - protein, 14 aa, Mycobacterium tuberculosis
AEPQPTPRPAKPRL

SEQ ID NO: 1369512 - protein, 32 aa, Mycobacterium tuberculosis; identical to SEQ ID NO: 149572

SEQ ID NO: 1369513 - protein, 5 aa, Mycobacterium tuberculosis
AGAAA

SEQ ID NO: 1369514 - protein, 8 aa, Mycobacterium tuberculosis
AGAVGGAA

SEQ ID NO: 1369515 - protein, 12 aa, Mycobacterium tuberculosis
AGDGSKKDCKQN

SEQ ID NO: 1369516 - protein, 4 aa, Mycobacterium tuberculosis
AGEE

SEQ ID NO: 1369517 - protein, 10 aa, Mycobacterium tuberculosis
AGETIPSDGE

SEQ ID NO: 1369518 - protein, 5 aa, Mycobacterium tuberculosis
AGGPV

SEQ ID NO: 1369519 - protein, 11 aa, Mycobacterium tuberculosis
AGKSLSDSASG

SEQ ID NO: 1369520 - protein, 6 aa, Mycobacterium tuberculosis
AGPSAQ

SEQ ID NO: 1369521 - protein, 14 aa, Mycobacterium tuberculosis
AGPVPSASSVLPAG

SEQ ID NO: 1369522 - protein, 17 aa, Mycobacterium tuberculosis
AGSTGGGGKKVPEINAD

SEQ ID NO: 1369523 - protein, 9 aa, Mycobacterium tuberculosis
AGTATKERR

SEQ ID NO: 1369524 - protein, 8 aa, Mycobacterium tuberculosis
AGVSAPQL

SEQ ID NO: 1369525 - protein, 8 aa, Mycobacterium tuberculosis
AHATSTTA

SEQ ID NO: 1369526 - protein, 5 aa, Mycobacterium tuberculosis
AHQAG

SEQ ID NO: 1369527 - protein, 11 aa, Mycobacterium tuberculosis
AISAATKLTGA

SEQ ID NO: 1369528 - protein, 5 aa, Mycobacterium tuberculosis
AKAGG

SEQ ID NO: 1369529 - protein, 6 aa, Mycobacterium tuberculosis
AKIPTG

SEQ ID NO: 1369530 - protein, 18 aa, Mycobacterium tuberculosis
AKPKNSKDTGPALDGDVP

SEQ ID NO: 1369531 - protein, 5 aa, Mycobacterium tuberculosis
AKPRL

SEQ ID NO: 1369532 - protein, 8 aa, Mycobacterium tuberculosis
AKSAQFSA

SEQ ID NO: 1369533 - protein, 11 aa, Mycobacterium tuberculosis
AKYGATTESSL

SEQ ID NO: 1369534 - protein, 7 aa, Mycobacterium tuberculosis
ALPSPGV

SEQ ID NO: 1369535 - protein, 5 aa, Mycobacterium tuberculosis
APLPK

SEQ ID NO: 1369536 - protein, 36 aa, Mycobacterium tuberculosis
APMPDGGHRHRAQPVSVRPNRHRRTRVSRAQRRHAQ

SEQ ID NO: 1369537 - protein, 8 aa, Mycobacterium tuberculosis
APNQDAQA

SEQ ID NO: 1369538 - protein, 13 aa, Mycobacterium tuberculosis
APTTGAAPEIDTA

SEQ ID NO: 1369539 - protein, 8 aa, Mycobacterium tuberculosis
AQAAEQRA

SEQ ID NO: 1369540 - protein, 16 aa, Mycobacterium tuberculosis
AQHGAQGAAGSGVRTE

SEQ ID NO: 1369541 - protein, 14 aa, Mycobacterium tuberculosis
AQLTSQIAERDQAI

SEQ ID NO: 1369542 - protein, 6 aa, Mycobacterium tuberculosis
AQNAAA

SEQ ID NO: 1369543 - protein, 4 aa, Mycobacterium tuberculosis
AQSR

SEQ ID NO: 1369544 - protein, 8 aa, Mycobacterium tuberculosis
AQTRNGDL

SEQ ID NO: 1369545 - protein, 4 aa, Mycobacterium tuberculosis
ARAE

SEQ ID NO: 1369546 - protein, 10 aa, Mycobacterium tuberculosis
ARAPHSAEIR

SEQ ID NO: 1369547 - protein, 14 aa, Mycobacterium tuberculosis
ARGPHAPDSLPGGP

SEQ ID NO: 1369548 - protein, 10 aa, Mycobacterium tuberculosis
ARPPARGVDN

SEQ ID NO: 1369549 - protein, 6 aa, Mycobacterium tuberculosis
ARRGFS

SEQ ID NO: 1369550 - protein, 12 aa, Mycobacterium tuberculosis
ARSVQGDGGIRS

SEQ ID NO: 1369551 - protein, 9 aa, Mycobacterium tuberculosis
ARVGDDGGR

SEQ ID NO: 1369552 - protein, 8 aa, Mycobacterium tuberculosis
ARYSDDQS

SEQ ID NO: 1369553 - protein, 27 aa, Mycobacterium tuberculosis
ASDEPATGAEQAVDTAATPQTPEPQPI

SEQ ID NO: 1369554 - protein, 7 aa, Mycobacterium tuberculosis
ASDLASL

SEQ ID NO: 1369555 - protein, 28 aa, Mycobacterium tuberculosis
ASEAHDETEPEVPEKAAPIPDPAKPDEL

SEQ ID NO: 1369556 - protein, 18 aa, Mycobacterium tuberculosis
ASEIPPLPNTSSPKPMPN

SEQ ID NO: 1369557 - protein, 6 aa, Mycobacterium tuberculosis
ASGSTY

SEQ ID NO: 1369558 - protein, 10 aa, Mycobacterium tuberculosis
ASLSSAAGRL

SEQ ID NO: 1369559 - protein, 7 aa, Mycobacterium tuberculosis
ASPAPPV

SEQ ID NO: 1369560 - protein, 8 aa, Mycobacterium tuberculosis
ASPPAIGD

SEQ ID NO: 1369561 - protein, 5 aa, Mycobacterium tuberculosis
ASRFG

SEQ ID NO: 1369562 - protein, 4 aa, Mycobacterium tuberculosis
ASRP

SEQ ID NO: 1369563 - protein, 7 aa, Mycobacterium tuberculosis
ATLTGAS

SEQ ID NO: 1369564 - protein, 4 aa, Mycobacterium tuberculosis
ATMP

SEQ ID NO: 1369565 - protein, 12 aa, Mycobacterium tuberculosis
ATQLPTQGTTSN

SEQ ID NO: 1369566 - protein, 4 aa, Mycobacterium tuberculosis
ATRE

SEQ ID NO: 1369567 - protein, 7 aa, Mycobacterium tuberculosis
ATTNQPI

SEQ ID NO: 1369568 - protein, 4 aa, Mycobacterium tuberculosis
ATTT

SEQ ID NO: 1369569 - protein, 9 aa, Mycobacterium tuberculosis
AVGGGPAQH

SEQ ID NO: 1369570 - protein, 7 aa, Mycobacterium tuberculosis
AVPSSRT

SEQ ID NO: 1369571 - protein, 5 aa, Mycobacterium tuberculosis
AVPTR

SEQ ID NO: 1369572 - protein, 9 aa, Mycobacterium tuberculosis
AVSGGAPLG

SEQ ID NO: 1369573 - protein, 7 aa, Mycobacterium tuberculosis
CDPDGNR

SEQ ID NO: 1369574 - protein, 6 aa, Mycobacterium tuberculosis
CDQQGG

SEQ ID NO: 1369575 - protein, 7 aa, Mycobacterium tuberculosis
CDRGGPG

SEQ ID NO: 1369576 - protein, 15 aa, Mycobacterium tuberculosis
DAAIPTGIQNPCFSH

SEQ ID NO: 1369577 - protein, 5 aa, Mycobacterium tuberculosis
DAAQR

SEQ ID NO: 1369578 - protein, 21 aa, Mycobacterium tuberculosis
DASALNGTVNGDSVLQGVAED

SEQ ID NO: 1369579 - protein, 4 aa, Mycobacterium tuberculosis
DASE

SEQ ID NO: 1369580 - protein, 11 aa, Mycobacterium tuberculosis
DATAVESAMTG

SEQ ID NO: 1369581 - protein, 4 aa, Mycobacterium tuberculosis
DATH

SEQ ID NO: 1369582 - protein, 8 aa, Mycobacterium tuberculosis
DDGPGPYT

SEQ ID NO: 1369583 - protein, 39 aa, Mycobacterium tuberculosis; identical to SEQ ID NO: 150296

SEQ ID NO: 1369584 - protein, 11 aa, Mycobacterium tuberculosis
DDNTPETPAQR

SEQ ID NO: 1369585 - protein, 7 aa, Mycobacterium tuberculosis
DDPKWRT

SEQ ID NO: 1369586 - protein, 5 aa, Mycobacterium tuberculosis
DDYAD

SEQ ID NO: 1369587 - protein, 7 aa, Mycobacterium tuberculosis
DEEIGYG

SEQ ID NO: 1369588 - protein, 7 aa, Mycobacterium tuberculosis
DEQENTT

SEQ ID NO: 1369589 - protein, 6 aa, Mycobacterium tuberculosis
DETGII

SEQ ID NO: 1369590 - protein, 4 aa, Mycobacterium tuberculosis
DEVA

SEQ ID NO: 1369591 - protein, 14 aa, Mycobacterium tuberculosis
DFGTTITGQPVGTE

SEQ ID NO: 1369592 - protein, 9 aa, Mycobacterium tuberculosis
DGAGRQESV

SEQ ID NO: 1369593 - protein, 4 aa, Mycobacterium tuberculosis
DGAH

SEQ ID NO: 1369594 - protein, 4 aa, Mycobacterium tuberculosis
DGDI

SEQ ID NO: 1369595 - protein, 8 aa, Mycobacterium tuberculosis
DGEIGDGP

SEQ ID NO: 1369596 - protein, 4 aa, Mycobacterium tuberculosis
DGLP

SEQ ID NO: 1369597 - protein, 10 aa, Mycobacterium tuberculosis
DGPGTPEVLG

SEQ ID NO: 1369598 - protein, 5 aa, Mycobacterium tuberculosis
DGSAI

SEQ ID NO: 1369599 - protein, 6 aa, Mycobacterium tuberculosis
DGSVDA

SEQ ID NO: 1369600 - protein, 10 aa, Mycobacterium tuberculosis
DGVASRTHDD

SEQ ID NO: 1369601 - protein, 9 aa, Mycobacterium tuberculosis
DISGSGAAI

SEQ ID NO: 1369602 - protein, 32 aa, Mycobacterium tuberculosis
DKKEDEEGVAEAERAPIDAGTAASQRGQEGTV

SEQ ID NO: 1369603 - protein, 7 aa, Mycobacterium tuberculosis
DLAEQSR

SEQ ID NO: 1369604 - protein, 4 aa, Mycobacterium tuberculosis
DLEG

SEQ ID NO: 1369605 - protein, 10 aa, Mycobacterium tuberculosis
DLQRPDAPWG

SEQ ID NO: 1369606 - protein, 4 aa, Mycobacterium tuberculosis
DMTG

SEQ ID NO: 1369607 - protein, 6 aa, Mycobacterium tuberculosis
DNPQRA

SEQ ID NO: 1369608 - protein, 7 aa, Mycobacterium tuberculosis
DPGESQM

SEQ ID NO: 1369609 - protein, 6 aa, Mycobacterium tuberculosis
DPGIPA

SEQ ID NO: 1369610 - protein, 7 aa, Mycobacterium tuberculosis
DPHSGDI

SEQ ID NO: 1369611 - protein, 18 aa, Mycobacterium tuberculosis
DPNAGYSAHAGAQPQRIP

SEQ ID NO: 1369612 - protein, 5 aa, Mycobacterium tuberculosis
DPSQT

SEQ ID NO: 1369613 - protein, 4 aa, Mycobacterium tuberculosis
DPSV

SEQ ID NO: 1369614 - protein, 7 aa, Mycobacterium tuberculosis
DQATTAS

SEQ ID NO: 1369615 - protein, 51 aa, Mycobacterium tuberculosis; identical to SEQ ID NO: 150541

SEQ ID NO: 1369616 - protein, 5 aa, Mycobacterium tuberculosis
DRIGG

SEQ ID NO: 1369617 - protein, 11 aa, Mycobacterium tuberculosis
DSAGRTGPLSA

SEQ ID NO: 1369618 - protein, 8 aa, Mycobacterium tuberculosis
DSNPQAAR

SEQ ID NO: 1369619 - protein, 8 aa, Mycobacterium tuberculosis
DSNPTHAG

SEQ ID NO: 1369620 - protein, 5 aa, Mycobacterium tuberculosis
DSPDG

SEQ ID NO: 1369621 - protein, 6 aa, Mycobacterium tuberculosis
DTADEI

SEQ ID NO: 1369622 - protein, 7 aa, Mycobacterium tuberculosis
DTGEPVN

SEQ ID NO: 1369623 - protein, 7 aa, Mycobacterium tuberculosis
DTGVGPA

SEQ ID NO: 1369624 - protein, 13 aa, Mycobacterium tuberculosis
DTPRPARSRCDQV

SEQ ID NO: 1369625 - protein, 9 aa, Mycobacterium tuberculosis
DTRGYKPVD

SEQ ID NO: 1369626 - protein, 5 aa, Mycobacterium tuberculosis
DTSSA

SEQ ID NO: 1369627 - protein, 22 aa, Mycobacterium tuberculosis
DVRPAPPPERTAPILISGSVWS

SEQ ID NO: 1369628 - protein, 7 aa, Mycobacterium tuberculosis
DYPQAKR

SEQ ID NO: 1369629 - protein, 8 aa, Mycobacterium tuberculosis
EAEGGMGP

SEQ ID NO: 1369630 - protein, 8 aa, Mycobacterium tuberculosis
EAGLTDRA

SEQ ID NO: 1369631 - protein, 4 aa, Mycobacterium tuberculosis
EART

SEQ ID NO: 1369632 - protein, 6 aa, Mycobacterium tuberculosis
EATMET

SEQ ID NO: 1369633 - protein, 6 aa, Mycobacterium tuberculosis
EATREA

SEQ ID NO: 1369634 - protein, 6 aa, Mycobacterium tuberculosis
ECGRTT

SEQ ID NO: 1369635 - protein, 4 aa, Mycobacterium tuberculosis
EDTV

SEQ ID NO: 1369636 - protein, 18 aa, Mycobacterium tuberculosis
EEEATEDAERQGGSAPLE

SEQ ID NO: 1369637 - protein, 7 aa, Mycobacterium tuberculosis
EFQKSAN

SEQ ID NO: 1369638 - protein, 14 aa, Mycobacterium tuberculosis
EGAGKPHHTSRPQG

SEQ ID NO: 1369639 - protein, 8 aa, Mycobacterium tuberculosis
EGQESDRG

SEQ ID NO: 1369640 - protein, 7 aa, Mycobacterium tuberculosis
EGTSTRN

SEQ ID NO: 1369641 - protein, 7 aa, Mycobacterium tuberculosis
EHPADRT

SEQ ID NO: 1369642 - protein, 5 aa, Mycobacterium tuberculosis
EISDN

SEQ ID NO: 1369643 - protein, 7 aa, Mycobacterium tuberculosis
EKKRTAR

SEQ ID NO: 1369644 - protein, 7 aa, Mycobacterium tuberculosis
EKKSLAD

SEQ ID NO: 1369645 - protein, 7 aa, Mycobacterium tuberculosis
EKLGDEA

SEQ ID NO: 1369646 - protein, 15 aa, Mycobacterium tuberculosis
ELGGGDGAVSGDTGL

SEQ ID NO: 1369647 - protein, 5 aa, Mycobacterium tuberculosis
ELNPD

SEQ ID NO: 1369648 - protein, 4 aa, Mycobacterium tuberculosis
ELRP

SEQ ID NO: 1369649 - protein, 12 aa, Mycobacterium tuberculosis
ELTDPVEQRRRL

SEQ ID NO: 1369650 - protein, 8 aa, Mycobacterium tuberculosis
ENAANGYA

SEQ ID NO: 1369651 - protein, 10 aa, Mycobacterium tuberculosis
ENPTRQGGAQ

SEQ ID NO: 1369652 - protein, 11 aa, Mycobacterium tuberculosis
EPEPQAPEVPE

SEQ ID NO: 1369653 - protein, 15 aa, Mycobacterium tuberculosis
EPRLQPPNGYKDTTV

SEQ ID NO: 1369654 - protein, 15 aa, Mycobacterium tuberculosis
EPTTADDVDAGYRGD

SEQ ID NO: 1369655 - protein, 7 aa, Mycobacterium tuberculosis
EREAPTE

SEQ ID NO: 1369656 - protein, 9 aa, Mycobacterium tuberculosis
ERVEANTST

SEQ ID NO: 1369657 - protein, 4 aa, Mycobacterium tuberculosis
ESAA

SEQ ID NO: 1369658 - protein, 10 aa, Mycobacterium tuberculosis
ESAITGESAP

SEQ ID NO: 1369659 - protein, 5 aa, Mycobacterium tuberculosis
ESCGG

SEQ ID NO: 1369660 - protein, 10 aa, Mycobacterium tuberculosis
ESCGTAPDLK

SEQ ID NO: 1369661 - protein, 6 aa, Mycobacterium tuberculosis
ESLSQE

SEQ ID NO: 1369662 - protein, 12 aa, Mycobacterium tuberculosis
ESTDGLTDCDGH

SEQ ID NO: 1369663 - protein, 6 aa, Mycobacterium tuberculosis
ESTRAD

SEQ ID NO: 1369664 - protein, 5 aa, Mycobacterium tuberculosis
ESYTS

SEQ ID NO: 1369665 - protein, 9 aa, Mycobacterium tuberculosis
ETAAAGAPR

SEQ ID NO: 1369666 - protein, 6 aa, Mycobacterium tuberculosis
ETSRFT

SEQ ID NO: 1369667 - protein, 6 aa, Mycobacterium tuberculosis
FDDKGR

SEQ ID NO: 1369668 - protein, 14 aa, Mycobacterium tuberculosis
FGGPATAGAFSRPG

SEQ ID NO: 1369669 - protein, 4 aa, Mycobacterium tuberculosis
FPPG

SEQ ID NO: 1369670 - protein, 7 aa, Mycobacterium tuberculosis
FPSNTES

SEQ ID NO: 1369671 - protein, 25 aa, Mycobacterium tuberculosis
FTPQASAVPGSDAERQAERAGATQT

SEQ ID NO: 1369672 - protein, 12 aa, Mycobacterium tuberculosis
FTSDPGAKPDGI

SEQ ID NO: 1369673 - protein, 7 aa, Mycobacterium tuberculosis
GAAGIGP

SEQ ID NO: 1369674 - protein, 8 aa, Mycobacterium tuberculosis
GAASSSCS

SEQ ID NO: 1369675 - protein, 15 aa, Mycobacterium tuberculosis
GAEAAAQREATPLVN

SEQ ID NO: 1369676 - protein, 54 aa, Mycobacterium tuberculosis; identical to SEQ ID NO: 155616

SEQ ID NO: 1369677 - protein, 16 aa, Mycobacterium tuberculosis
GAPARRRRRRRGDSDA

SEQ ID NO: 1369678 - protein, 21 aa, Mycobacterium tuberculosis
GAPVAPETPAEDADAETLSDS

SEQ ID NO: 1369679 - protein, 5 aa, Mycobacterium tuberculosis
GASLT

SEQ ID NO: 1369680 - protein, 12 aa, Mycobacterium tuberculosis
GASSQGAQTYRE

SEQ ID NO: 1369681 - protein, 5 aa, Mycobacterium tuberculosis
GATAR

SEQ ID NO: 1369682 - protein, 12 aa, Mycobacterium tuberculosis
GATQPVGTGACV

SEQ ID NO: 1369683 - protein, 13 aa, Mycobacterium tuberculosis
GAYRATKVGSEAY

SEQ ID NO: 1369684 - protein, 9 aa, Mycobacterium tuberculosis
GDGTADCDA

SEQ ID NO: 1369685 - protein, 5 aa, Mycobacterium tuberculosis
GDPAN

SEQ ID NO: 1369686 - protein, 9 aa, Mycobacterium tuberculosis
GDPQSPEGI

SEQ ID NO: 1369687 - protein, 4 aa, Mycobacterium tuberculosis
GDRE

SEQ ID NO: 1369688 - protein, 8 aa, Mycobacterium tuberculosis
GEHRDGGA

SEQ ID NO: 1369689 - protein, 5 aa, Mycobacterium tuberculosis
GEVPS

SEQ ID NO: 1369690 - protein, 5 aa, Mycobacterium tuberculosis
GGEPL

SEQ ID NO: 1369691 - protein, 11 aa, Mycobacterium tuberculosis
GGGAGGGRGSV

SEQ ID NO: 1369692 - protein, 10 aa, Mycobacterium tuberculosis
GGGANIPAVT

SEQ ID NO: 1369693 - protein, 7 aa, Mycobacterium tuberculosis
GGGGRLG

SEQ ID NO: 1369694 - protein, 9 aa, Mycobacterium tuberculosis
GGHADRSWG

SEQ ID NO: 1369695 - protein, 5 aa, Mycobacterium tuberculosis
GGPDI

SEQ ID NO: 1369696 - protein, 12 aa, Mycobacterium tuberculosis
GGRKAYDVERRG

SEQ ID NO: 1369697 - protein, 7 aa, Mycobacterium tuberculosis
GGSAGGH

SEQ ID NO: 1369698 - protein, 14 aa, Mycobacterium tuberculosis
GGVGPGGETPVGST

SEQ ID NO: 1369699 - protein, 8 aa, Mycobacterium tuberculosis
GHRQAKDP

SEQ ID NO: 1369700 - protein, 7 aa, Mycobacterium tuberculosis
GIAPAGG

SEQ ID NO: 1369701 - protein, 7 aa, Mycobacterium tuberculosis
GIGPAEL

SEQ ID NO: 1369702 - protein, 15 aa, Mycobacterium tuberculosis
GIGPARLDKRRNLVR

SEQ ID NO: 1369703 - protein, 8 aa, Mycobacterium tuberculosis
GIPDPGDI

SEQ ID NO: 1369704 - protein, 6 aa, Mycobacterium tuberculosis
GLRGGS

SEQ ID NO: 1369705 - protein, 11 aa, Mycobacterium tuberculosis
GLRPLSGSGYS

SEQ ID NO: 1369706 - protein, 4 aa, Mycobacterium tuberculosis
GLST

SEQ ID NO: 1369707 - protein, 13 aa, Mycobacterium tuberculosis
GMTPAPLSVTPER

SEQ ID NO: 1369708 - protein, 9 aa, Mycobacterium tuberculosis
GNAGDRSMR

SEQ ID NO: 1369709 - protein, 8 aa, Mycobacterium tuberculosis
GNGSGKST

SEQ ID NO: 1369710 - protein, 11 aa, Mycobacterium tuberculosis
GNPADSGKIRG

SEQ ID NO: 1369711 - protein, 32 aa, Mycobacterium tuberculosis; identical to SEQ ID NO: 151368

SEQ ID NO: 1369712 - protein, 15 aa, Mycobacterium tuberculosis
GPETTPAAPARTAEL

SEQ ID NO: 1369713 - protein, 5 aa, Mycobacterium tuberculosis
GPPTT

SEQ ID NO: 1369714 - protein, 16 aa, Mycobacterium tuberculosis
GPRRTTALSAERAALL

SEQ ID NO: 1369715 - protein, 15 aa, Mycobacterium tuberculosis
GPRTQSDRFSGCSIS

SEQ ID NO: 1369716 - protein, 6 aa, Mycobacterium tuberculosis
GPSGAV

SEQ ID NO: 1369717 - protein, 5 aa, Mycobacterium tuberculosis
GPVFN

SEQ ID NO: 1369718 - protein, 7 aa, Mycobacterium tuberculosis
GQGPTIG

SEQ ID NO: 1369719 - protein, 4 aa, Mycobacterium tuberculosis
GQRE

SEQ ID NO: 1369720 - protein, 8 aa, Mycobacterium tuberculosis
GQSDVDPA

SEQ ID NO: 1369721 - protein, 6 aa, Mycobacterium tuberculosis
GQTPGN

SEQ ID NO: 1369722 - protein, 5 aa, Mycobacterium tuberculosis
GRFGT

SEQ ID NO: 1369723 - protein, 11 aa, Mycobacterium tuberculosis
GRGHDAAPQVA

SEQ ID NO: 1369724 - protein, 11 aa, Mycobacterium tuberculosis
GRKAYDVERRG

SEQ ID NO: 1369725 - protein, 12 aa, Mycobacterium tuberculosis
GRNGAGKSTTLQ

SEQ ID NO: 1369726 - protein, 8 aa, Mycobacterium tuberculosis
GRPPSHTV

SEQ ID NO: 1369727 - protein, 5 aa, Mycobacterium tuberculosis
GSAAR

SEQ ID NO: 1369728 - protein, 6 aa, Mycobacterium tuberculosis
GSAASA

SEQ ID NO: 1369729 - protein, 6 aa, Mycobacterium tuberculosis
GSDDIV

SEQ ID NO: 1369730 - protein, 27 aa, Mycobacterium tuberculosis
GSEEPSEEASEATEESAVSADRSDDSA

SEQ ID NO: 1369731 - protein, 5 aa, Mycobacterium tuberculosis
GSEPQ

SEQ ID NO: 1369732 - protein, 7 aa, Mycobacterium tuberculosis
GSGPNAL

SEQ ID NO: 1369733 - protein, 6 aa, Mycobacterium tuberculosis
GSPQPG

SEQ ID NO: 1369734 - protein, 7 aa, Mycobacterium tuberculosis
GSPYSTP

SEQ ID NO: 1369735 - protein, 22 aa, Mycobacterium tuberculosis
GSSGASGGAIASGSVARVGTAT

SEQ ID NO: 1369736 - protein, 9 aa, Mycobacterium tuberculosis
GSVNGHPGM

SEQ ID NO: 1369737 - protein, 4 aa, Mycobacterium tuberculosis
GSVP

SEQ ID NO: 1369738 - protein, 6 aa, Mycobacterium tuberculosis
GVRAGD

SEQ ID NO: 1369739 - protein, 5 aa, Mycobacterium tuberculosis
GWPEA

SEQ ID NO: 1369740 - protein, 9 aa, Mycobacterium tuberculosis
GYGPSQPGM

SEQ ID NO: 1369741 - protein, 12 aa, Mycobacterium tuberculosis
HAGSGSGGEPTV

SEQ ID NO: 1369742 - protein, 6 aa, Mycobacterium tuberculosis
HANGVT

SEQ ID NO: 1369743 - protein, 11 aa, Mycobacterium tuberculosis
HANGVTHRDVK

SEQ ID NO: 1369744 - protein, 7 aa, Mycobacterium tuberculosis
HFPNPGS

SEQ ID NO: 1369745 - protein, 8 aa, Mycobacterium tuberculosis
HGPTTPPF

SEQ ID NO: 1369746 - protein, 5 aa, Mycobacterium tuberculosis
HGSQT

SEQ ID NO: 1369747 - protein, 12 aa, Mycobacterium tuberculosis
HHPLPDPGESVP

SEQ ID NO: 1369748 - protein, 26 aa, Mycobacterium tuberculosis
HNAQRLGNTPSTPPTTTKKAPQAGLT

SEQ ID NO: 1369749 - protein, 6 aa, Mycobacterium tuberculosis
HPERDK

SEQ ID NO: 1369750 - protein, 6 aa, Mycobacterium tuberculosis
HPRPRV

SEQ ID NO: 1369751 - protein, 12 aa, Mycobacterium tuberculosis
HPTTPFVAVDYD

SEQ ID NO: 1369752 - protein, 7 aa, Mycobacterium tuberculosis
HQEKRDR

SEQ ID NO: 1369753 - protein, 6 aa, Mycobacterium tuberculosis
HQPTQL

SEQ ID NO: 1369754 - protein, 4 aa, Mycobacterium tuberculosis
HRDD

SEQ ID NO: 1369755 - protein, 5 aa, Mycobacterium tuberculosis
HRHRP

SEQ ID NO: 1369756 - protein, 4 aa, Mycobacterium tuberculosis
HRQT

SEQ ID NO: 1369757 - protein, 11 aa, Mycobacterium tuberculosis
HRRKRSESGVG

SEQ ID NO: 1369758 - protein, 6 aa, Mycobacterium tuberculosis
HSEGQS

SEQ ID NO: 1369759 - protein, 9 aa, Mycobacterium tuberculosis
HTAATETTR

SEQ ID NO: 1369760 - protein, 4 aa, Mycobacterium tuberculosis
HTPQ

SEQ ID NO: 1369761 - protein, 23 aa, Mycobacterium tuberculosis
IDTTSSTPAAARRVTSPPARETR

SEQ ID NO: 1369762 - protein, 8 aa, Mycobacterium tuberculosis
IGAGATAQ

SEQ ID NO: 1369763 - protein, 6 aa, Mycobacterium tuberculosis
IGTEAT

SEQ ID NO: 1369764 - protein, 8 aa, Mycobacterium tuberculosis
IPAEGQSI

SEQ ID NO: 1369765 - protein, 13 aa, Mycobacterium tuberculosis
IPGTDPGVPTPSQ

SEQ ID NO: 1369766 - protein, 11 aa, Mycobacterium tuberculosis
IPITTSGKVRR

SEQ ID NO: 1369767 - protein, 9 aa, Mycobacterium tuberculosis
IPRSPNDQD

SEQ ID NO: 1369768 - protein, 25 aa, Mycobacterium tuberculosis
IQNEDEVTSDQGNNGGPNGGGRLAP

SEQ ID NO: 1369769 - protein, 6 aa, Mycobacterium tuberculosis
IQPNPA

SEQ ID NO: 1369770 - protein, 4 aa, Mycobacterium tuberculosis
IQPY

SEQ ID NO: 1369771 - protein, 17 aa, Mycobacterium tuberculosis
ISAARDLADQAVSGRQA

SEQ ID NO: 1369772 - protein, 15 aa, Mycobacterium tuberculosis
ISRRPKRLRPAPPVE

SEQ ID NO: 1369773 - protein, 5 aa, Mycobacterium tuberculosis
ITAAG

SEQ ID NO: 1369774 - protein, 9 aa, Mycobacterium tuberculosis
ITDSPVPAA

SEQ ID NO: 1369775 - protein, 7 aa, Mycobacterium tuberculosis
IYGSGLP

SEQ ID NO: 1369776 - protein, 4 aa, Mycobacterium tuberculosis
KAET

SEQ ID NO: 1369777 - protein, 14 aa, Mycobacterium tuberculosis
KCNNGSDPTVKKGA

SEQ ID NO: 1369778 - protein, 4 aa, Mycobacterium tuberculosis
KDDS

SEQ ID NO: 1369779 - protein, 5 aa, Mycobacterium tuberculosis
KDPAY

SEQ ID NO: 1369780 - protein, 4 aa, Mycobacterium tuberculosis
KEFG

SEQ ID NO: 1369781 - protein, 7 aa, Mycobacterium tuberculosis
KERLSTD

SEQ ID NO: 1369782 - protein, 5 aa, Mycobacterium tuberculosis
KGDAS

SEQ ID NO: 1369783 - protein, 11 aa, Mycobacterium tuberculosis
KGGPKGVGNAV

SEQ ID NO: 1369784 - protein, 14 aa, Mycobacterium tuberculosis
KGKEARGTGNAAAT

SEQ ID NO: 1369785 - protein, 23 aa, Mycobacterium tuberculosis
KGTGGAARSIGRARDIEPGHRRD

SEQ ID NO: 1369786 - protein, 8 aa, Mycobacterium tuberculosis
KHDQPPWT

SEQ ID NO: 1369787 - protein, 7 aa, Mycobacterium tuberculosis
KLAPSRP

SEQ ID NO: 1369788 - protein, 12 aa, Mycobacterium tuberculosis
KMPSQTPPEPPT

SEQ ID NO: 1369789 - protein, 7 aa, Mycobacterium tuberculosis
KPELGTP

SEQ ID NO: 1369790 - protein, 34 aa, Mycobacterium tuberculosis; identical to SEQ ID NO: 152079

SEQ ID NO: 1369791 - protein, 8 aa, Mycobacterium tuberculosis
KSSPDCRA

SEQ ID NO: 1369792 - protein, 6 aa, Mycobacterium tuberculosis
KTGVPY

SEQ ID NO: 1369793 - protein, 5 aa, Mycobacterium tuberculosis
LAAPG

SEQ ID NO: 1369794 - protein, 9 aa, Mycobacterium tuberculosis
LADETPEGR

SEQ ID NO: 1369795 - protein, 7 aa, Mycobacterium tuberculosis
LAGAGAA

SEQ ID NO: 1369796 - protein, 8 aa, Mycobacterium tuberculosis
LAGNSAKV

SEQ ID NO: 1369797 - protein, 15 aa, Mycobacterium tuberculosis
LAKAASGGGNGYSLR

SEQ ID NO: 1369798 - protein, 4 aa, Mycobacterium tuberculosis
LAPN

SEQ ID NO: 1369799 - protein, 10 aa, Mycobacterium tuberculosis
LASANSTSGH

SEQ ID NO: 1369800 - protein, 5 aa, Mycobacterium tuberculosis
LDAQG

SEQ ID NO: 1369801 - protein, 15 aa, Mycobacterium tuberculosis
LDGAPPMPPPRDPLE

SEQ ID NO: 1369802 - protein, 14 aa, Mycobacterium tuberculosis
LDGDSGSWGPLGPL

SEQ ID NO: 1369803 - protein, 4 aa, Mycobacterium tuberculosis
LERG

SEQ ID NO: 1369804 - protein, 8 aa, Mycobacterium tuberculosis
LGATATAS

SEQ ID NO: 1369805 - protein, 12 aa, Mycobacterium tuberculosis
LGGGNFASSMSN

SEQ ID NO: 1369806 - protein, 12 aa, Mycobacterium tuberculosis
LGPARNLSTDPD

SEQ ID NO: 1369807 - protein, 7 aa, Mycobacterium tuberculosis
LGRREPA

SEQ ID NO: 1369808 - protein, 8 aa, Mycobacterium tuberculosis
LGRSSSVD

SEQ ID NO: 1369809 - protein, 5 aa, Mycobacterium tuberculosis
LKASA

SEQ ID NO: 1369810 - protein, 6 aa, Mycobacterium tuberculosis
LNPNGV

SEQ ID NO: 1369811 - protein, 6 aa, Mycobacterium tuberculosis
LPAGSP

SEQ ID NO: 1369812 - protein, 5 aa, Mycobacterium tuberculosis
LPCPE

SEQ ID NO: 1369813 - protein, 9 aa, Mycobacterium tuberculosis
LPEGTPVAD

SEQ ID NO: 1369814 - protein, 6 aa, Mycobacterium tuberculosis
LPGFPG

SEQ ID NO: 1369815 - protein, 6 aa, Mycobacterium tuberculosis
LPGGDT

SEQ ID NO: 1369816 - protein, 15 aa, Mycobacterium tuberculosis
LQPIDSKGCHTRRTR

SEQ ID NO: 1369817 - protein, 13 aa, Mycobacterium tuberculosis
LRDPTAPGGPHGI

SEQ ID NO: 1369818 - protein, 5 aa, Mycobacterium tuberculosis
LRGDN

SEQ ID NO: 1369819 - protein, 7 aa, Mycobacterium tuberculosis
LRPEAAA

SEQ ID NO: 1369820 - protein, 6 aa, Mycobacterium tuberculosis
LRSSPP

SEQ ID NO: 1369821 - protein, 5 aa, Mycobacterium tuberculosis
LSDCD

SEQ ID NO: 1369822 - protein, 8 aa, Mycobacterium tuberculosis
LSETSGGV

SEQ ID NO: 1369823 - protein, 5 aa, Mycobacterium tuberculosis
LSEVG

SEQ ID NO: 1369824 - protein, 7 aa, Mycobacterium tuberculosis
LSGAGPT

SEQ ID NO: 1369825 - protein, 10 aa, Mycobacterium tuberculosis
LSGEGSDTDT

SEQ ID NO: 1369826 - protein, 7 aa, Mycobacterium tuberculosis
LSTDGKS

SEQ ID NO: 1369827 - protein, 12 aa, Mycobacterium tuberculosis
LTPNDPRFQPGF

SEQ ID NO: 1369828 - protein, 6 aa, Mycobacterium tuberculosis
LTPPDD

SEQ ID NO: 1369829 - protein, 7 aa, Mycobacterium tuberculosis
LTRDPAA

SEQ ID NO: 1369830 - protein, 14 aa, Mycobacterium tuberculosis
LTTPKNPTKRRITP

SEQ ID NO: 1369831 - protein, 48 aa, Mycobacterium tuberculosis; identical to SEQ ID NO: 152457

SEQ ID NO: 1369832 - protein, 14 aa, Mycobacterium tuberculosis
NAQLSNCSDGAAQL

SEQ ID NO: 1369833 - protein, 9 aa, Mycobacterium tuberculosis
NATAGAPLV

SEQ ID NO: 1369834 - protein, 4 aa, Mycobacterium tuberculosis
NDAA

SEQ ID NO: 1369835 - protein, 8 aa, Mycobacterium tuberculosis
NDPQNRIN

SEQ ID NO: 1369836 - protein, 4 aa, Mycobacterium tuberculosis
NEGR

SEQ ID NO: 1369837 - protein, 9 aa, Mycobacterium tuberculosis
NGEPPEAPK

SEQ ID NO: 1369838 - protein, 14 aa, Mycobacterium tuberculosis
NGITVKDSDGTVRR

SEQ ID NO: 1369839 - protein, 8 aa, Mycobacterium tuberculosis
NGLGPADE

SEQ ID NO: 1369840 - protein, 12 aa, Mycobacterium tuberculosis
NGTPDYGAPARL

SEQ ID NO: 1369841 - protein, 16 aa, Mycobacterium tuberculosis
NNQAKLTSGALSTAAT

SEQ ID NO: 1369842 - protein, 5 aa, Mycobacterium tuberculosis
NPALR

SEQ ID NO: 1369843 - protein, 5 aa, Mycobacterium tuberculosis
NPVAN

SEQ ID NO: 1369844 - protein, 19 aa, Mycobacterium tuberculosis
NPVEESSPRGPGPICQNYT

SEQ ID NO: 1369845 - protein, 4 aa, Mycobacterium tuberculosis
NQLP

SEQ ID NO: 1369846 - protein, 6 aa, Mycobacterium tuberculosis
NQTFRD

SEQ ID NO: 1369847 - protein, 8 aa, Mycobacterium tuberculosis
NRRRRADE

SEQ ID NO: 1369848 - protein, 16 aa, Mycobacterium tuberculosis
NRTASCRTSSCAPRTL

SEQ ID NO: 1369849 - protein, 13 aa, Mycobacterium tuberculosis
NSYGLQQPPRLGA

SEQ ID NO: 1369850 - protein, 13 aa, Mycobacterium tuberculosis
NTAEQNAANAGKG

SEQ ID NO: 1369851 - protein, 9 aa, Mycobacterium tuberculosis
NTGNEEAAL

SEQ ID NO: 1369852 - protein, 11 aa, Mycobacterium tuberculosis
NTGTQAAREAG

SEQ ID NO: 1369853 - protein, 6 aa, Mycobacterium tuberculosis
NTLPGI

SEQ ID NO: 1369854 - protein, 8 aa, Mycobacterium tuberculosis
NTPGNKPI

SEQ ID NO: 1369855 - protein, 8 aa, Mycobacterium tuberculosis
NTPTDTIS

SEQ ID NO: 1369856 - protein, 7 aa, Mycobacterium tuberculosis
NTRSPLD

SEQ ID NO: 1369857 - protein, 4 aa, Mycobacterium tuberculosis
NVPS

SEQ ID NO: 1369858 - protein, 4 aa, Mycobacterium tuberculosis
NVYP

SEQ ID NO: 1369859 - protein, 10 aa, Mycobacterium tuberculosis
PAAGASGFGK

SEQ ID NO: 1369860 - protein, 11 aa, Mycobacterium tuberculosis
PAAGGPPRGQV

SEQ ID NO: 1369861 - protein, 9 aa, Mycobacterium tuberculosis
PAGPAAPGI

SEQ ID NO: 1369862 - protein, 4 aa, Mycobacterium tuberculosis
PAGQ

SEQ ID NO: 1369863 - protein, 16 aa, Mycobacterium tuberculosis
PAGTLPDGGPFTEAGD

SEQ ID NO: 1369864 - protein, 9 aa, Mycobacterium tuberculosis
PAHRPSSQA

SEQ ID NO: 1369865 - protein, 7 aa, Mycobacterium tuberculosis
PALTRSG

SEQ ID NO: 1369866 - protein, 4 aa, Mycobacterium tuberculosis
PAQA

SEQ ID NO: 1369867 - protein, 8 aa, Mycobacterium tuberculosis
PASPWATP

SEQ ID NO: 1369868 - protein, 8 aa, Mycobacterium tuberculosis
PASSPGGM

SEQ ID NO: 1369869 - protein, 14 aa, Mycobacterium tuberculosis
PCPEPAAADPTDVP

SEQ ID NO: 1369870 - protein, 16 aa, Mycobacterium tuberculosis
PCSGDAANAPPPPSAI

SEQ ID NO: 1369871 - protein, 12 aa, Mycobacterium tuberculosis
PDGPGGQSGLAG

SEQ ID NO: 1369872 - protein, 7 aa, Mycobacterium tuberculosis
PDTIDES

SEQ ID NO: 1369873 - protein, 10 aa, Mycobacterium tuberculosis
PEAGTPSTWV

SEQ ID NO: 1369874 - protein, 8 aa, Mycobacterium tuberculosis
PEHGPGMP

SEQ ID NO: 1369875 - protein, 13 aa, Mycobacterium tuberculosis
PEPDANPSTEVGQ

SEQ ID NO: 1369876 - protein, 10 aa, Mycobacterium tuberculosis
PGARCDQPVK

SEQ ID NO: 1369877 - protein, 5 aa, Mycobacterium tuberculosis
PGFVG

SEQ ID NO: 1369878 - protein, 35 aa, Mycobacterium tuberculosis
PGGPPPPGMGPGFPGGPGGPAVGPTGPGPTTAPAR

SEQ ID NO: 1369879 - protein, 15 aa, Mycobacterium tuberculosis
PGHTATPAGSISTPV

SEQ ID NO: 1369880 - protein, 4 aa, Mycobacterium tuberculosis
PGLA

SEQ ID NO: 1369881 - protein, 9 aa, Mycobacterium tuberculosis
PGVSEGQVD

SEQ ID NO: 1369882 - protein, 11 aa, Mycobacterium tuberculosis
PHAGPAEPSIG

SEQ ID NO: 1369883 - protein, 5 aa, Mycobacterium tuberculosis
PHQTP

SEQ ID NO: 1369884 - protein, 51 aa, Mycobacterium tuberculosis; identical to SEQ ID NO: 152873

SEQ ID NO: 1369885 - protein, 15 aa, Mycobacterium tuberculosis
PIAGETFASDKGSPL

SEQ ID NO: 1369886 - protein, 5 aa, Mycobacterium tuberculosis
PKERV

SEQ ID NO: 1369887 - protein, 9 aa, Mycobacterium tuberculosis
PKPGDIRTN

SEQ ID NO: 1369888 - protein, 7 aa, Mycobacterium tuberculosis
PLPLEND

SEQ ID NO: 1369889 - protein, 13 aa, Mycobacterium tuberculosis
PLTRPHRSKRGVA

SEQ ID NO: 1369890 - protein, 4 aa, Mycobacterium tuberculosis
PLTT

SEQ ID NO: 1369891 - protein, 4 aa, Mycobacterium tuberculosis
PNLR

SEQ ID NO: 1369892 - protein, 7 aa, Mycobacterium tuberculosis
PNNERAY

SEQ ID NO: 1369893 - protein, 6 aa, Mycobacterium tuberculosis
PNPVAN

SEQ ID NO: 1369894 - protein, 8 aa, Mycobacterium tuberculosis
PNQPGTDY

SEQ ID NO: 1369895 - protein, 4 aa, Mycobacterium tuberculosis
PPAM

SEQ ID NO: 1369896 - protein, 8 aa, Mycobacterium tuberculosis
PPASTPLA

SEQ ID NO: 1369897 - protein, 7 aa, Mycobacterium tuberculosis
PPATVGG

SEQ ID NO: 1369898 - protein, 75 aa, Mycobacterium tuberculosis
PPPVAPGYAPAGYPPYPATPPGYGPPGYGAPPSYGPPPGYGPPLGYPAAPPGCGPPPGYGPPLGYGPPVAPGAVK

SEQ ID NO: 1369899 - protein, 8 aa, Mycobacterium tuberculosis
PPTPGSPL

SEQ ID NO: 1369900 - protein, 6 aa, Mycobacterium tuberculosis
PQPGKH

SEQ ID NO: 1369901 - protein, 9 aa, Mycobacterium tuberculosis
PRAEPGLGT

SEQ ID NO: 1369902 - protein, 6 aa, Mycobacterium tuberculosis
PRGPLP

SEQ ID NO: 1369903 - protein, 4 aa, Mycobacterium tuberculosis
PRKT

SEQ ID NO: 1369904 - protein, 31 aa, Mycobacterium tuberculosis; identical to SEQ ID NO: 155744

SEQ ID NO: 1369905 - protein, 7 aa, Mycobacterium tuberculosis
PSPLPDE

SEQ ID NO: 1369906 - protein, 5 aa, Mycobacterium tuberculosis
PSTAT

SEQ ID NO: 1369907 - protein, 11 aa, Mycobacterium tuberculosis
PSTSVRDAGAN

SEQ ID NO: 1369908 - protein, 8 aa, Mycobacterium tuberculosis
PTPVGGNA

SEQ ID NO: 1369909 - protein, 12 aa, Mycobacterium tuberculosis
PTTGAVSDIEQA

SEQ ID NO: 1369910 - protein, 6 aa, Mycobacterium tuberculosis
PTTVRG

SEQ ID NO: 1369911 - protein, 4 aa, Mycobacterium tuberculosis
PVNQ

SEQ ID NO: 1369912 - protein, 22 aa, Mycobacterium tuberculosis
PVSVRPNRHRRTRVSRAQRRHA

SEQ ID NO: 1369913 - protein, 4 aa, Mycobacterium tuberculosis
PVVP

SEQ ID NO: 1369914 - protein, 8 aa, Mycobacterium tuberculosis
QADYDEAM

SEQ ID NO: 1369915 - protein, 11 aa, Mycobacterium tuberculosis
QAQQPQTGRTG

SEQ ID NO: 1369916 - protein, 5 aa, Mycobacterium tuberculosis
QASYA

SEQ ID NO: 1369917 - protein, 46 aa, Mycobacterium tuberculosis; identical to SEQ ID NO: 153133

SEQ ID NO: 1369918 - protein, 4 aa, Mycobacterium tuberculosis
QAYD

SEQ ID NO: 1369919 - protein, 18 aa, Mycobacterium tuberculosis
QCRSDTGLTVNGRPLKEP

SEQ ID NO: 1369920 - protein, 5 aa, Mycobacterium tuberculosis
QDPTA

SEQ ID NO: 1369921 - protein, 7 aa, Mycobacterium tuberculosis
QDSPFNV

SEQ ID NO: 1369922 - protein, 5 aa, Mycobacterium tuberculosis
QEGRG

SEQ ID NO: 1369923 - protein, 18 aa, Mycobacterium tuberculosis
QEPVSPPTQPEQQPQTEH

SEQ ID NO: 1369924 - protein, 5 aa, Mycobacterium tuberculosis
QGGGP

SEQ ID NO: 1369925 - protein, 9 aa, Mycobacterium tuberculosis
QGREGPVPI

SEQ ID NO: 1369926 - protein, 10 aa, Mycobacterium tuberculosis
QGSLENAADQ

SEQ ID NO: 1369927 - protein, 7 aa, Mycobacterium tuberculosis
QKEKIPD

SEQ ID NO: 1369928 - protein, 7 aa, Mycobacterium tuberculosis
QLATRGP

SEQ ID NO: 1369929 - protein, 9 aa, Mycobacterium tuberculosis
QLDDTTDMK

SEQ ID NO: 1369930 - protein, 13 aa, Mycobacterium tuberculosis
QLPPLPRATTATT

SEQ ID NO: 1369931 - protein, 10 aa, Mycobacterium tuberculosis
QNAAPPSPAR

SEQ ID NO: 1369932 - protein, 5 aa, Mycobacterium tuberculosis
QNPDF

SEQ ID NO: 1369933 - protein, 8 aa, Mycobacterium tuberculosis
QPEAQTAA

SEQ ID NO: 1369934 - protein, 6 aa, Mycobacterium tuberculosis
QPIPPW

SEQ ID NO: 1369935 - protein, 5 aa, Mycobacterium tuberculosis
QPQLA

SEQ ID NO: 1369936 - protein, 7 aa, Mycobacterium tuberculosis
QQNSAGR

SEQ ID NO: 1369937 - protein, 7 aa, Mycobacterium tuberculosis
QRPKLER

SEQ ID NO: 1369938 - protein, 5 aa, Mycobacterium tuberculosis
QRPPA

SEQ ID NO: 1369939 - protein, 31 aa, Mycobacterium tuberculosis
QRPQPTDPAGTPCPHQHESRQARCGEAEPSN

SEQ ID NO: 1369940 - protein, 4 aa, Mycobacterium tuberculosis
QRRA

SEQ ID NO: 1369941 - protein, 9 aa, Mycobacterium tuberculosis
QRTKTREEV

SEQ ID NO: 1369942 - protein, 14 aa, Mycobacterium tuberculosis
QSGFYDDGSQSVQA

SEQ ID NO: 1369943 - protein, 14 aa, Mycobacterium tuberculosis
QSPAAAGEHRGPAR

SEQ ID NO: 1369944 - protein, 4 aa, Mycobacterium tuberculosis
QTLT

SEQ ID NO: 1369945 - protein, 12 aa, Mycobacterium tuberculosis
QVTTESNGDYGR

SEQ ID NO: 1369946 - protein, 8 aa, Mycobacterium tuberculosis
RAGSESVL

SEQ ID NO: 1369947 - protein, 4 aa, Mycobacterium tuberculosis
RAND

SEQ ID NO: 1369948 - protein, 7 aa, Mycobacterium tuberculosis
RANGTYG

SEQ ID NO: 1369949 - protein, 14 aa, Mycobacterium tuberculosis
RAPTSGTVDRPGTV

SEQ ID NO: 1369950 - protein, 8 aa, Mycobacterium tuberculosis
RAREAGRI

SEQ ID NO: 1369951 - protein, 6 aa, Mycobacterium tuberculosis
RARPDS

SEQ ID NO: 1369952 - protein, 11 aa, Mycobacterium tuberculosis
RCDQPVKPGQV

SEQ ID NO: 1369953 - protein, 16 aa, Mycobacterium tuberculosis
RDAAIPTGIQNPCFSH

SEQ ID NO: 1369954 - protein, 7 aa, Mycobacterium tuberculosis
RDDGTLA

SEQ ID NO: 1369955 - protein, 11 aa, Mycobacterium tuberculosis
RDGKATTLGAA

SEQ ID NO: 1369956 - protein, 9 aa, Mycobacterium tuberculosis
RDIEPGHRR

SEQ ID NO: 1369957 - protein, 10 aa, Mycobacterium tuberculosis
RDNTDQFNTR

SEQ ID NO: 1369958 - protein, 9 aa, Mycobacterium tuberculosis
RDPHGRHRP

SEQ ID NO: 1369959 - protein, 7 aa, Mycobacterium tuberculosis
RDSPSWS

SEQ ID NO: 1369960 - protein, 12 aa, Mycobacterium tuberculosis
RGANGSTPDDGF

SEQ ID NO: 1369961 - protein, 9 aa, Mycobacterium tuberculosis
RGAPGGPQH

SEQ ID NO: 1369962 - protein, 5 aa, Mycobacterium tuberculosis
RGEDD

SEQ ID NO: 1369963 - protein, 13 aa, Mycobacterium tuberculosis
RGEGKGANDLLPP

SEQ ID NO: 1369964 - protein, 12 aa, Mycobacterium tuberculosis
RGGDGASRTDEA

SEQ ID NO: 1369965 - protein, 4 aa, Mycobacterium tuberculosis
RGLP

SEQ ID NO: 1369966 - protein, 8 aa, Mycobacterium tuberculosis
RGPRLTPG

SEQ ID NO: 1369967 - protein, 7 aa, Mycobacterium tuberculosis
RGRAQNA

SEQ ID NO: 1369968 - protein, 8 aa, Mycobacterium tuberculosis
RGRARSVT

SEQ ID NO: 1369969 - protein, 13 aa, Mycobacterium tuberculosis
RHATRTATVSAKS

SEQ ID NO: 1369970 - protein, 10 aa, Mycobacterium tuberculosis
RLGEPTGEGA

SEQ ID NO: 1369971 - protein, 13 aa, Mycobacterium tuberculosis
RLPPPGSAARPAM

SEQ ID NO: 1369972 - protein, 14 aa, Mycobacterium tuberculosis
RLTGAAGSQAISDS

SEQ ID NO: 1369973 - protein, 10 aa, Mycobacterium tuberculosis
RNANPPNAEL

SEQ ID NO: 1369974 - protein, 6 aa, Mycobacterium tuberculosis
RPDTQQ

SEQ ID NO: 1369975 - protein, 18 aa, Mycobacterium tuberculosis
RPGESDGTCGRGEPQAGR

SEQ ID NO: 1369976 - protein, 9 aa, Mycobacterium tuberculosis
RPIDETSLG

SEQ ID NO: 1369977 - protein, 18 aa, Mycobacterium tuberculosis
RPLATELDNRKAEVNNDI

SEQ ID NO: 1369978 - protein, 22 aa, Mycobacterium tuberculosis
RPPTAAPPPAGARGGTEAGNLA

SEQ ID NO: 1369979 - protein, 15 aa, Mycobacterium tuberculosis
RPQAPGPGDSPPTQV

SEQ ID NO: 1369980 - protein, 23 aa, Mycobacterium tuberculosis
RQRYRTSGVPKAADLRSALKPLL

SEQ ID NO: 1369981 - protein, 12 aa, Mycobacterium tuberculosis
RRARDRAADALR

SEQ ID NO: 1369982 - protein, 4 aa, Mycobacterium tuberculosis
RRGF

SEQ ID NO: 1369983 - protein, 11 aa, Mycobacterium tuberculosis
RRHGGELPRRG

SEQ ID NO: 1369984 - protein, 6 aa, Mycobacterium tuberculosis
RSERQA

SEQ ID NO: 1369985 - protein, 8 aa, Mycobacterium tuberculosis
RSGGDDEL

SEQ ID NO: 1369986 - protein, 83 aa, Mycobacterium tuberculosis
RSQESTLPGTAAVTAQPPTMPTVTPPPIQAAPTGQPSWAPNSGPMPASGPTPTPQYYQGGGWGAPPSGGPSPWAQTPRKTNPW

SEQ ID NO: 1369987 - protein, 7 aa, Mycobacterium tuberculosis
RSTDPAT

SEQ ID NO: 1369988 - protein, 12 aa, Mycobacterium tuberculosis
RSVQGDGGIRSA

SEQ ID NO: 1369989 - protein, 7 aa, Mycobacterium tuberculosis
RTGSRMA

SEQ ID NO: 1369990 - protein, 17 aa, Mycobacterium tuberculosis
RTNRNPVQMPAPEPAIA

SEQ ID NO: 1369991 - protein, 5 aa, Mycobacterium tuberculosis
RVDAA

SEQ ID NO: 1369992 - protein, 14 aa, Mycobacterium tuberculosis
RVPGHGPEQATRPL

SEQ ID NO: 1369993 - protein, 6 aa, Mycobacterium tuberculosis
RYGPRA

SEQ ID NO: 1369994 - protein, 8 aa, Mycobacterium tuberculosis
RYPASGGT

SEQ ID NO: 1369995 - protein, 9 aa, Mycobacterium tuberculosis
SAAEDAALR

SEQ ID NO: 1369996 - protein, 7 aa, Mycobacterium tuberculosis
SACPVES

SEQ ID NO: 1369997 - protein, 6 aa, Mycobacterium tuberculosis
SAGATV

SEQ ID NO: 1369998 - protein, 11 aa, Mycobacterium tuberculosis
SAGPGPASLQA

SEQ ID NO: 1369999 - protein, 4 aa, Mycobacterium tuberculosis
SAPQ

SEQ ID NO: 1370000 - protein, 6 aa, Mycobacterium tuberculosis
SAPVVG

SEQ ID NO: 1370001 - protein, 11 aa, Mycobacterium tuberculosis
SASTPTPATLE

SEQ ID NO: 1370002 - protein, 4 aa, Mycobacterium tuberculosis
SATE

SEQ ID NO: 1370003 - protein, 5 aa, Mycobacterium tuberculosis
SDDTS

SEQ ID NO: 1370004 - protein, 5 aa, Mycobacterium tuberculosis
SDGAR

SEQ ID NO: 1370005 - protein, 10 aa, Mycobacterium tuberculosis
SDPAGADETD

SEQ ID NO: 1370006 - protein, 5 aa, Mycobacterium tuberculosis
SDQLA

SEQ ID NO: 1370007 - protein, 5 aa, Mycobacterium tuberculosis
SERVQ

SEQ ID NO: 1370008 - protein, 12 aa, Mycobacterium tuberculosis
SGRKEPTFTGAG

SEQ ID NO: 1370009 - protein, 7 aa, Mycobacterium tuberculosis
SGSPVRN

SEQ ID NO: 1370010 - protein, 13 aa, Mycobacterium tuberculosis
SGTTGRPKGCQLT

SEQ ID NO: 1370011 - protein, 10 aa, Mycobacterium tuberculosis
SGTTGSGKST

SEQ ID NO: 1370012 - protein, 21 aa, Mycobacterium tuberculosis
SHALSPPVEVSRQPEPEVDTA

SEQ ID NO: 1370013 - protein, 6 aa, Mycobacterium tuberculosis
SHDPGQ

SEQ ID NO: 1370014 - protein, 4 aa, Mycobacterium tuberculosis
SHPR

SEQ ID NO: 1370015 - protein, 7 aa, Mycobacterium tuberculosis
SINARKP

SEQ ID NO: 1370016 - protein, 42 aa, Mycobacterium tuberculosis; identical to SEQ ID NO: 154053

SEQ ID NO: 1370017 - protein, 11 aa, Mycobacterium tuberculosis
SKGEPLSDHSP

SEQ ID NO: 1370018 - protein, 6 aa, Mycobacterium tuberculosis
SLGSGR

SEQ ID NO: 1370019 - protein, 5 aa, Mycobacterium tuberculosis
SLPQT

SEQ ID NO: 1370020 - protein, 5 aa, Mycobacterium tuberculosis
SLPVD

SEQ ID NO: 1370021 - protein, 4 aa, Mycobacterium tuberculosis
SLQR

SEQ ID NO: 1370022 - protein, 7 aa, Mycobacterium tuberculosis
SLQTGGV

SEQ ID NO: 1370023 - protein, 15 aa, Mycobacterium tuberculosis
SPANAGDDGRGQRRC

SEQ ID NO: 1370024 - protein, 12 aa, Mycobacterium tuberculosis
SPEGQASSLESI

SEQ ID NO: 1370025 - protein, 13 aa, Mycobacterium tuberculosis
SPEGQASSLESIG

SEQ ID NO: 1370026 - protein, 15 aa, Mycobacterium tuberculosis
SPGPPSPDNAVADTT

SEQ ID NO: 1370027 - protein, 20 aa, Mycobacterium tuberculosis
SPLGGSASSLAAIPGASVPQ

SEQ ID NO: 1370028 - protein, 4 aa, Mycobacterium tuberculosis
SPQQ

SEQ ID NO: 1370029 - protein, 5 aa, Mycobacterium tuberculosis
SRDDT

SEQ ID NO: 1370030 - protein, 6 aa, Mycobacterium tuberculosis
SRGPEY

SEQ ID NO: 1370031 - protein, 14 aa, Mycobacterium tuberculosis
SRNSSSPPTKLPED

SEQ ID NO: 1370032 - protein, 14 aa, Mycobacterium tuberculosis
SRRARDRAADALRT

SEQ ID NO: 1370033 - protein, 4 aa, Mycobacterium tuberculosis
SRRH

SEQ ID NO: 1370034 - protein, 11 aa, Mycobacterium tuberculosis
SRSGDLPPAVT

SEQ ID NO: 1370035 - protein, 7 aa, Mycobacterium tuberculosis
SSAPAGA

SEQ ID NO: 1370036 - protein, 6 aa, Mycobacterium tuberculosis
SSAVST

SEQ ID NO: 1370037 - protein, 18 aa, Mycobacterium tuberculosis
SSDSIPQAGTATSDPAPV

SEQ ID NO: 1370038 - protein, 18 aa, Mycobacterium tuberculosis
SSMQPGKPITSMDSSPVT

SEQ ID NO: 1370039 - protein, 5 aa, Mycobacterium tuberculosis
SSPLT

SEQ ID NO: 1370040 - protein, 27 aa, Mycobacterium tuberculosis
SSRAFEPVNPSSAGPNSDEKVKAGTLD

SEQ ID NO: 1370041 - protein, 10 aa, Mycobacterium tuberculosis
SSTVSSYRQV

SEQ ID NO: 1370042 - protein, 15 aa, Mycobacterium tuberculosis
STAGDEVKDPQKTMP

SEQ ID NO: 1370043 - protein, 72 aa, Mycobacterium tuberculosis; identical to SEQ ID NO: 154269

SEQ ID NO: 1370044 - protein, 16 aa, Mycobacterium tuberculosis
STHAGADGWKVMLAPT

SEQ ID NO: 1370045 - protein, 9 aa, Mycobacterium tuberculosis
STRASPDGP

SEQ ID NO: 1370046 - protein, 6 aa, Mycobacterium tuberculosis
SVAEGA

SEQ ID NO: 1370047 - protein, 8 aa, Mycobacterium tuberculosis
SVGDDSMR

SEQ ID NO: 1370048 - protein, 5 aa, Mycobacterium tuberculosis
SVGEY

SEQ ID NO: 1370049 - protein, 7 aa, Mycobacterium tuberculosis
SYGEYGR

SEQ ID NO: 1370050 - protein, 12 aa, Mycobacterium tuberculosis
SYRPRKRPGRTT

SEQ ID NO: 1370051 - protein, 4 aa, Mycobacterium tuberculosis
TAAE

SEQ ID NO: 1370052 - protein, 4 aa, Mycobacterium tuberculosis
TAAT

SEQ ID NO: 1370053 - protein, 8 aa, Mycobacterium tuberculosis
TAEAEAMR

SEQ ID NO: 1370054 - protein, 6 aa, Mycobacterium tuberculosis
TAGQAE

SEQ ID NO: 1370055 - protein, 7 aa, Mycobacterium tuberculosis
TAIRPSY

SEQ ID NO: 1370056 - protein, 5 aa, Mycobacterium tuberculosis
TALGS

SEQ ID NO: 1370057 - protein, 14 aa, Mycobacterium tuberculosis
TASGSDQQSLSDRV

SEQ ID NO: 1370058 - protein, 6 aa, Mycobacterium tuberculosis
TDSQDP

SEQ ID NO: 1370059 - protein, 10 aa, Mycobacterium tuberculosis
TDVAAGQALQ

SEQ ID NO: 1370060 - protein, 6 aa, Mycobacterium tuberculosis
TDWPRY

SEQ ID NO: 1370061 - protein, 12 aa, Mycobacterium tuberculosis
TEAGASVDPAEL

SEQ ID NO: 1370062 - protein, 7 aa, Mycobacterium tuberculosis
TESRGSR

SEQ ID NO: 1370063 - protein, 13 aa, Mycobacterium tuberculosis
TGEAKPTRVRPGG

SEQ ID NO: 1370064 - protein, 13 aa, Mycobacterium tuberculosis
TGESVKAETMPSE

SEQ ID NO: 1370065 - protein, 11 aa, Mycobacterium tuberculosis
TGGAARSIGRA

SEQ ID NO: 1370066 - protein, 6 aa, Mycobacterium tuberculosis
TGKTRS

SEQ ID NO: 1370067 - protein, 8 aa, Mycobacterium tuberculosis
TGPDGRIQ

SEQ ID NO: 1370068 - protein, 9 aa, Mycobacterium tuberculosis
TGPFPPTTF

SEQ ID NO: 1370069 - protein, 5 aa, Mycobacterium tuberculosis
TGPSA

SEQ ID NO: 1370070 - protein, 11 aa, Mycobacterium tuberculosis
THNDSAPTSRR

SEQ ID NO: 1370071 - protein, 4 aa, Mycobacterium tuberculosis
TIRQ

SEQ ID NO: 1370072 - protein, 15 aa, Mycobacterium tuberculosis
TITSGSADGQRRSPR

SEQ ID NO: 1370073 - protein, 10 aa, Mycobacterium tuberculosis
TLAKTGVGTG

SEQ ID NO: 1370074 - protein, 7 aa, Mycobacterium tuberculosis
TLDSPVS

SEQ ID NO: 1370075 - protein, 5 aa, Mycobacterium tuberculosis
TLPGI

SEQ ID NO: 1370076 - protein, 19 aa, Mycobacterium tuberculosis
TNPWRGPPIPYGTEVTDGR

SEQ ID NO: 1370077 - protein, 23 aa, Mycobacterium tuberculosis
TNPWRGPPIPYGTEVTDGRNILP

SEQ ID NO: 1370078 - protein, 6 aa, Mycobacterium tuberculosis
TNRDEI

SEQ ID NO: 1370079 - protein, 12 aa, Mycobacterium tuberculosis
TNTGGGPTTNAN

SEQ ID NO: 1370080 - protein, 62 aa, Mycobacterium tuberculosis
TPADTGLSQSESGIAGAGTGPPTPGAARWSPGDSATVAGPLAADSRGGNWPSQTGHSPAVPN

SEQ ID NO: 1370081 - protein, 10 aa, Mycobacterium tuberculosis
TPDGTATLGG

SEQ ID NO: 1370082 - protein, 5 aa, Mycobacterium tuberculosis
TPGAT

SEQ ID NO: 1370083 - protein, 15 aa, Mycobacterium tuberculosis
TPGPDDPAPPARSGP

SEQ ID NO: 1370084 - protein, 20 aa, Mycobacterium tuberculosis
TPIPRPDARYGRPRLSRRAR

SEQ ID NO: 1370085 - protein, 9 aa, Mycobacterium tuberculosis
TPPPHQTPK

SEQ ID NO: 1370086 - protein, 5 aa, Mycobacterium tuberculosis
TPPVP

SEQ ID NO: 1370087 - protein, 7 aa, Mycobacterium tuberculosis
TPRMPDE

SEQ ID NO: 1370088 - protein, 4 aa, Mycobacterium tuberculosis
TQIG

SEQ ID NO: 1370089 - protein, 14 aa, Mycobacterium tuberculosis
TQSPYPGGGPIPEK

SEQ ID NO: 1370090 - protein, 4 aa, Mycobacterium tuberculosis
TREP

SEQ ID NO: 1370091 - protein, 6 aa, Mycobacterium tuberculosis
TRPAGG

SEQ ID NO: 1370092 - protein, 8 aa, Mycobacterium tuberculosis
TRRGETEY

SEQ ID NO: 1370093 - protein, 8 aa, Mycobacterium tuberculosis
TRRTAAPT

SEQ ID NO: 1370094 - protein, 7 aa, Mycobacterium tuberculosis
TRSTDYS

SEQ ID NO: 1370095 - protein, 5 aa, Mycobacterium tuberculosis
TSADK

SEQ ID NO: 1370096 - protein, 11 aa, Mycobacterium tuberculosis
TSAGQPSKFSM

SEQ ID NO: 1370097 - protein, 24 aa, Mycobacterium tuberculosis
TSGGGVAREDPLEPDPLAPIIDDS

SEQ ID NO: 1370098 - protein, 8 aa, Mycobacterium tuberculosis
TSGGSGPA

SEQ ID NO: 1370099 - protein, 8 aa, Mycobacterium tuberculosis
TSGSGKSE

SEQ ID NO: 1370100 - protein, 13 aa, Mycobacterium tuberculosis
TSRNGAGPAPDAP

SEQ ID NO: 1370101 - protein, 8 aa, Mycobacterium tuberculosis
TSRTRTAL

SEQ ID NO: 1370102 - protein, 6 aa, Mycobacterium tuberculosis
TSSAEQ

SEQ ID NO: 1370103 - protein, 12 aa, Mycobacterium tuberculosis
TTAAAGAVGGAA

SEQ ID NO: 1370104 - protein, 6 aa, Mycobacterium tuberculosis
TTDDGS

SEQ ID NO: 1370105 - protein, 7 aa, Mycobacterium tuberculosis
TTLATPG

SEQ ID NO: 1370106 - protein, 9 aa, Mycobacterium tuberculosis
TVRAGGSAM

SEQ ID NO: 1370107 - protein, 4 aa, Mycobacterium tuberculosis
VAGC

SEQ ID NO: 1370108 - protein, 8 aa, Mycobacterium tuberculosis
VAHDRDGV

SEQ ID NO: 1370109 - protein, 4 aa, Mycobacterium tuberculosis
VAQT

SEQ ID NO: 1370110 - protein, 19 aa, Mycobacterium tuberculosis
VATAAAAAHETAAAGYTSA

SEQ ID NO: 1370111 - protein, 19 aa, Mycobacterium tuberculosis
VATGDGRQVDGRDPATGES

SEQ ID NO: 1370112 - protein, 16 aa, Mycobacterium tuberculosis
VDPGRVDRDGLDRAER

SEQ ID NO: 1370113 - protein, 8 aa, Mycobacterium tuberculosis
VDPGSIPD

SEQ ID NO: 1370114 - protein, 7 aa, Mycobacterium tuberculosis
VDVGGPT

SEQ ID NO: 1370115 - protein, 21 aa, Mycobacterium tuberculosis
VEKEARAARALDGESPPADWV

SEQ ID NO: 1370116 - protein, 4 aa, Mycobacterium tuberculosis
VGGA

SEQ ID NO: 1370117 - protein, 4 aa, Mycobacterium tuberculosis
VGGG

SEQ ID NO: 1370118 - protein, 9 aa, Mycobacterium tuberculosis
VGKPVPGNS

SEQ ID NO: 1370119 - protein, 4 aa, Mycobacterium tuberculosis
VGPG

SEQ ID NO: 1370120 - protein, 18 aa, Mycobacterium tuberculosis
VGQERSVSLSPKDAPSFE

SEQ ID NO: 1370121 - protein, 7 aa, Mycobacterium tuberculosis
VGQTATS

SEQ ID NO: 1370122 - protein, 10 aa, Mycobacterium tuberculosis
VGTEEQGGVI

SEQ ID NO: 1370123 - protein, 20 aa, Mycobacterium tuberculosis
VIDPPSPVPAPSVIGSHDDV

SEQ ID NO: 1370124 - protein, 16 aa, Mycobacterium tuberculosis
VNPDDDKPSGSSDETL

SEQ ID NO: 1370125 - protein, 10 aa, Mycobacterium tuberculosis
VNPSGQHGDE

SEQ ID NO: 1370126 - protein, 7 aa, Mycobacterium tuberculosis
VNSGNEI

SEQ ID NO: 1370127 - protein, 8 aa, Mycobacterium tuberculosis
VPDSSGLP

SEQ ID NO: 1370128 - protein, 16 aa, Mycobacterium tuberculosis
VPTPGGTEIRDNRSIN

SEQ ID NO: 1370129 - protein, 6 aa, Mycobacterium tuberculosis
VQHAPD

SEQ ID NO: 1370130 - protein, 29 aa, Mycobacterium tuberculosis
VQPGPRLPNVDAGGDFVESTDGLTDCDGH

SEQ ID NO: 1370131 - protein, 25 aa, Mycobacterium tuberculosis
VSAAEDRGGRHAAAEPPEPPSAGVR

SEQ ID NO: 1370132 - protein, 9 aa, Mycobacterium tuberculosis
VSDDERADI

SEQ ID NO: 1370133 - protein, 20 aa, Mycobacterium tuberculosis
VSEGRSPSKPDEVAASSTMG

SEQ ID NO: 1370134 - protein, 14 aa, Mycobacterium tuberculosis
VSKPNGDGAHIGKE

SEQ ID NO: 1370135 - protein, 14 aa, Mycobacterium tuberculosis
VSLAPGSCTPARPS

SEQ ID NO: 1370136 - protein, 4 aa, Mycobacterium tuberculosis
VSPR

SEQ ID NO: 1370137 - protein, 14 aa, Mycobacterium tuberculosis
VSPTTVKSTELDQF

SEQ ID NO: 1370138 - protein, 15 aa, Mycobacterium tuberculosis
VSQPTVAPRRSRHYA

SEQ ID NO: 1370139 - protein, 4 aa, Mycobacterium tuberculosis
VSSR

SEQ ID NO: 1370140 - protein, 17 aa, Mycobacterium tuberculosis
VTAEPQPTPRPAKPRLL

SEQ ID NO: 1370141 - protein, 8 aa, Mycobacterium tuberculosis
VTGPRSSV

SEQ ID NO: 1370142 - protein, 9 aa, Mycobacterium tuberculosis
VTGTKAPGD

SEQ ID NO: 1370143 - protein, 5 aa, Mycobacterium tuberculosis
VTPHP

SEQ ID NO: 1370144 - protein, 6 aa, Mycobacterium tuberculosis
VTTSPL

SEQ ID NO: 1370145 - protein, 7 aa, Mycobacterium tuberculosis
VYGGTTH

SEQ ID NO: 1370146 - protein, 5 aa, Mycobacterium tuberculosis
WRPSG

SEQ ID NO: 1370147 - protein, 15 aa, Mycobacterium tuberculosis
WRSPADTSPRPLPSG

SEQ ID NO: 1370148 - protein, 11 aa, Mycobacterium tuberculosis
WSHGTSSTAQP

SEQ ID NO: 1370149 - protein, 17 aa, Mycobacterium tuberculosis
WSPTSRSEVTDSTSGAA

SEQ ID NO: 1370150 - protein, 8 aa, Mycobacterium tuberculosis
YAADGGRN

SEQ ID NO: 1370151 - protein, 23 aa, Mycobacterium tuberculosis
YEPTYESQRRRARPSEPTNPTHH

SEQ ID NO: 1370152 - protein, 11 aa, Mycobacterium tuberculosis
YGGGGAYDEGS

SEQ ID NO: 1370153 - protein, 5 aa, Mycobacterium tuberculosis
YGGTA

SEQ ID NO: 1370154 - protein, 7 aa, Mycobacterium tuberculosis
YGNEAPK

SEQ ID NO: 1370155 - protein, 5 aa, Mycobacterium tuberculosis
YKNRP

SEQ ID NO: 1370156 - protein, 10 aa, Mycobacterium tuberculosis
YRADKKITAT

SEQ ID NO: 1370157 - protein, 5 aa, Mycobacterium tuberculosis
YTPSA

SEQ ID NO: 1370158 - protein, 7 aa, Mycobacterium tuberculosis
AAAVGKV

SEQ ID NO: 1370159 - protein, 7 aa, Mycobacterium tuberculosis
AAEQGMG

SEQ ID NO: 1370160 - protein, 10 aa, Mycobacterium tuberculosis
AAFGHSANAA

SEQ ID NO: 1370161 - protein, 9 aa, Mycobacterium tuberculosis
AAGADPAAV

SEQ ID NO: 1370162 - protein, 15 aa, Mycobacterium tuberculosis
AAQPPSGDPGPVAPM

SEQ ID NO: 1370163 - protein, 8 aa, Mycobacterium tuberculosis
AEEGGESS

SEQ ID NO: 1370164 - protein, 11 aa, Mycobacterium tuberculosis
AETAADPVAKL

SEQ ID NO: 1370165 - protein, 7 aa, Mycobacterium tuberculosis
AGLRGGS

SEQ ID NO: 1370166 - protein, 18 aa, Mycobacterium tuberculosis
AGQLPPEPPIWPTTSTPT

SEQ ID NO: 1370167 - protein, 8 aa, Mycobacterium tuberculosis
AGRQGQTD

SEQ ID NO: 1370168 - protein, 10 aa, Mycobacterium tuberculosis
AGTAVQDSRS

SEQ ID NO: 1370169 - protein, 9 aa, Mycobacterium tuberculosis
AHNGYADDG

SEQ ID NO: 1370170 - protein, 5 aa, Mycobacterium tuberculosis
AHTDR

SEQ ID NO: 1370171 - protein, 15 aa, Mycobacterium tuberculosis
AKSPGAAAAAVASGQ

SEQ ID NO: 1370172 - protein, 5 aa, Mycobacterium tuberculosis
ALEPE

SEQ ID NO: 1370173 - protein, 39 aa, Mycobacterium tuberculosis
AMPDGEQSQPPAQEDAEDDSRPDAAEAAAAEPKSSAGPM

SEQ ID NO: 1370174 - protein, 9 aa, Mycobacterium tuberculosis
ANSPSTPEL

SEQ ID NO: 1370175 - protein, 8 aa, Mycobacterium tuberculosis
ANSSDDGY

SEQ ID NO: 1370176 - protein, 5 aa, Mycobacterium tuberculosis
APGAV

SEQ ID NO: 1370177 - protein, 9 aa, Mycobacterium tuberculosis
APSAGTPVG

SEQ ID NO: 1370178 - protein, 16 aa, Mycobacterium tuberculosis
AQPALTGATTDEGSHS

SEQ ID NO: 1370179 - protein, 7 aa, Mycobacterium tuberculosis
AQTRNGD

SEQ ID NO: 1370180 - protein, 5 aa, Mycobacterium tuberculosis
ARGQD

SEQ ID NO: 1370181 - protein, 9 aa, Mycobacterium tuberculosis
ARSGAQPRV

SEQ ID NO: 1370182 - protein, 5 aa, Mycobacterium tuberculosis
ARTEQ

SEQ ID NO: 1370183 - protein, 9 aa, Mycobacterium tuberculosis
ARTVQEPGG

SEQ ID NO: 1370184 - protein, 10 aa, Mycobacterium tuberculosis
ARVRRGGRRP

SEQ ID NO: 1370185 - protein, 6 aa, Mycobacterium tuberculosis
ASGALA

SEQ ID NO: 1370186 - protein, 8 aa, Mycobacterium tuberculosis
ASGGPNCR

SEQ ID NO: 1370187 - protein, 14 aa, Mycobacterium tuberculosis
ASRRLRPRRNGIAG

SEQ ID NO: 1370188 - protein, 26 aa, Mycobacterium tuberculosis
ATLTGASITAATAVSATLAKTGVGTG

SEQ ID NO: 1370189 - protein, 8 aa, Mycobacterium tuberculosis
CGSSDHSR

SEQ ID NO: 1370190 - protein, 6 aa, Mycobacterium tuberculosis
CSEASR

SEQ ID NO: 1370191 - protein, 14 aa, Mycobacterium tuberculosis
DASGQRGEQRRRPG

SEQ ID NO: 1370192 - protein, 6 aa, Mycobacterium tuberculosis
DAVSEI

SEQ ID NO: 1370193 - protein, 6 aa, Mycobacterium tuberculosis
DGTGGT

SEQ ID NO: 1370194 - protein, 12 aa, Mycobacterium tuberculosis
DLPANNKGRDRT

SEQ ID NO: 1370195 - protein, 11 aa, Mycobacterium tuberculosis
DLTSVSDPDAD

SEQ ID NO: 1370196 - protein, 5 aa, Mycobacterium tuberculosis
DNEYT

SEQ ID NO: 1370197 - protein, 8 aa, Mycobacterium tuberculosis
DPACRTSR

SEQ ID NO: 1370198 - protein, 15 aa, Mycobacterium tuberculosis
DPADSELDRRQAQRV

SEQ ID NO: 1370199 - protein, 10 aa, Mycobacterium tuberculosis
DPVCSSGGNW

SEQ ID NO: 1370200 - protein, 7 aa, Mycobacterium tuberculosis
DQKDNLN

SEQ ID NO: 1370201 - protein, 16 aa, Mycobacterium tuberculosis
DRDRSPRLTASGDPPT

SEQ ID NO: 1370202 - protein, 7 aa, Mycobacterium tuberculosis
DTSTDWT

SEQ ID NO: 1370203 - protein, 8 aa, Mycobacterium tuberculosis
DTSTDWTG

SEQ ID NO: 1370204 - protein, 7 aa, Mycobacterium tuberculosis
DVTPAGS

SEQ ID NO: 1370205 - protein, 7 aa, Mycobacterium tuberculosis
EARTPAH

SEQ ID NO: 1370206 - protein, 7 aa, Mycobacterium tuberculosis
EATNTSA

SEQ ID NO: 1370207 - protein, 9 aa, Mycobacterium tuberculosis
EDTGELTPT

SEQ ID NO: 1370208 - protein, 4 aa, Mycobacterium tuberculosis
EGAG

SEQ ID NO: 1370209 - protein, 22 aa, Mycobacterium tuberculosis
EHAANEPTTSSPASTAGGVPAR

SEQ ID NO: 1370210 - protein, 9 aa, Mycobacterium tuberculosis
EINGNGSRI

SEQ ID NO: 1370211 - protein, 10 aa, Mycobacterium tuberculosis
EKPDETERTF

SEQ ID NO: 1370212 - protein, 11 aa, Mycobacterium tuberculosis
ELSGAPRTSRT

SEQ ID NO: 1370213 - protein, 20 aa, Mycobacterium tuberculosis
ENRPSYSDTNLENSKPFNPK

SEQ ID NO: 1370214 - protein, 9 aa, Mycobacterium tuberculosis
EPQRDPVAP

SEQ ID NO: 1370215 - protein, 7 aa, Mycobacterium tuberculosis
ERATKRR

SEQ ID NO: 1370216 - protein, 8 aa, Mycobacterium tuberculosis
ERCSTNSI

SEQ ID NO: 1370217 - protein, 6 aa, Mycobacterium tuberculosis
ERSGHA

SEQ ID NO: 1370218 - protein, 5 aa, Mycobacterium tuberculosis
ERTVD

SEQ ID NO: 1370219 - protein, 8 aa, Mycobacterium tuberculosis
ETLAPAEQ

SEQ ID NO: 1370220 - protein, 4 aa, Mycobacterium tuberculosis
EVEN

SEQ ID NO: 1370221 - protein, 10 aa, Mycobacterium tuberculosis
FPEAKEKARA

SEQ ID NO: 1370222 - protein, 6 aa, Mycobacterium tuberculosis
FPNPGS

SEQ ID NO: 1370223 - protein, 8 aa, Mycobacterium tuberculosis
GAGAPAPA

SEQ ID NO: 1370224 - protein, 11 aa, Mycobacterium tuberculosis
GCSADTGDRHP

SEQ ID NO: 1370225 - protein, 6 aa, Mycobacterium tuberculosis
GDPSYR

SEQ ID NO: 1370226 - protein, 23 aa, Mycobacterium tuberculosis
GDTASPVGSSGASGGAIASGSVA

SEQ ID NO: 1370227 - protein, 28 aa, Mycobacterium tuberculosis
GDTASPVGSSGASGGAIASGSVARVGTA

SEQ ID NO: 1370228 - protein, 9 aa, Mycobacterium tuberculosis
GEGVGPAAA

SEQ ID NO: 1370229 - protein, 8 aa, Mycobacterium tuberculosis
GEPTDGIT

SEQ ID NO: 1370230 - protein, 12 aa, Mycobacterium tuberculosis
GGEAGPVPDDGF

SEQ ID NO: 1370231 - protein, 8 aa, Mycobacterium tuberculosis
GGHADRSW

SEQ ID NO: 1370232 - protein, 7 aa, Mycobacterium tuberculosis
GGKNVAP

SEQ ID NO: 1370233 - protein, 9 aa, Mycobacterium tuberculosis
GGPDGEGFN

SEQ ID NO: 1370234 - protein, 4 aa, Mycobacterium tuberculosis
GGTF

SEQ ID NO: 1370235 - protein, 12 aa, Mycobacterium tuberculosis
GIPPGTLRRSAT

SEQ ID NO: 1370236 - protein, 23 aa, Mycobacterium tuberculosis
GLNAPTASTSAASSAPPGSVVKP

SEQ ID NO: 1370237 - protein, 4 aa, Mycobacterium tuberculosis
GLRP

SEQ ID NO: 1370238 - protein, 5 aa, Mycobacterium tuberculosis
GPASQ

SEQ ID NO: 1370239 - protein, 7 aa, Mycobacterium tuberculosis
GQAFSAA

SEQ ID NO: 1370240 - protein, 7 aa, Mycobacterium tuberculosis
GQHAPGV

SEQ ID NO: 1370241 - protein, 7 aa, Mycobacterium tuberculosis
GQIAGDS

SEQ ID NO: 1370242 - protein, 5 aa, Mycobacterium tuberculosis
GRAND

SEQ ID NO: 1370243 - protein, 8 aa, Mycobacterium tuberculosis
GRDPFDES

SEQ ID NO: 1370244 - protein, 12 aa, Mycobacterium tuberculosis
GRPAGPQRADVD

SEQ ID NO: 1370245 - protein, 6 aa, Mycobacterium tuberculosis
GRPGFA

SEQ ID NO: 1370246 - protein, 7 aa, Mycobacterium tuberculosis
GSTPDSE

SEQ ID NO: 1370247 - protein, 8 aa, Mycobacterium tuberculosis
GTQPDYSH

SEQ ID NO: 1370248 - protein, 8 aa, Mycobacterium tuberculosis
GTREQCEA

SEQ ID NO: 1370249 - protein, 5 aa, Mycobacterium tuberculosis
GVGGI

SEQ ID NO: 1370250 - protein, 6 aa, Mycobacterium tuberculosis
HHGTYR

SEQ ID NO: 1370251 - protein, 13 aa, Mycobacterium tuberculosis
HNPDTSRRLTDEQ

SEQ ID NO: 1370252 - protein, 4 aa, Mycobacterium tuberculosis
HPDP

SEQ ID NO: 1370253 - protein, 8 aa, Mycobacterium tuberculosis
HSEQSASI

SEQ ID NO: 1370254 - protein, 8 aa, Mycobacterium tuberculosis
IDGDPTKV

SEQ ID NO: 1370255 - protein, 6 aa, Mycobacterium tuberculosis
IDSHAA

SEQ ID NO: 1370256 - protein, 7 aa, Mycobacterium tuberculosis
IDTSEAV

SEQ ID NO: 1370257 - protein, 7 aa, Mycobacterium tuberculosis
IEERSGH

SEQ ID NO: 1370258 - protein, 16 aa, Mycobacterium tuberculosis
IPDGAPLDAPRPMPPE

SEQ ID NO: 1370259 - protein, 6 aa, Mycobacterium tuberculosis
KAIDDD

SEQ ID NO: 1370260 - protein, 8 aa, Mycobacterium tuberculosis
KRKLERQL

SEQ ID NO: 1370261 - protein, 7 aa, Mycobacterium tuberculosis
KSSPDCR

SEQ ID NO: 1370262 - protein, 5 aa, Mycobacterium tuberculosis
LATPR

SEQ ID NO: 1370263 - protein, 6 aa, Mycobacterium tuberculosis
LETNAT

SEQ ID NO: 1370264 - protein, 6 aa, Mycobacterium tuberculosis
LGAVDE

SEQ ID NO: 1370265 - protein, 4 aa, Mycobacterium tuberculosis
LGGP

SEQ ID NO: 1370266 - protein, 7 aa, Mycobacterium tuberculosis
LGPAGES

SEQ ID NO: 1370267 - protein, 4 aa, Mycobacterium tuberculosis
LGRL

SEQ ID NO: 1370268 - protein, 8 aa, Mycobacterium tuberculosis
LKPPQHKR

SEQ ID NO: 1370269 - protein, 4 aa, Mycobacterium tuberculosis
LPGR

SEQ ID NO: 1370270 - protein, 5 aa, Mycobacterium tuberculosis
LRGPA

SEQ ID NO: 1370271 - protein, 9 aa, Mycobacterium tuberculosis
LTMPNTPEM

SEQ ID NO: 1370272 - protein, 11 aa, Mycobacterium tuberculosis
LTTREPSSLKT

SEQ ID NO: 1370273 - protein, 4 aa, Mycobacterium tuberculosis
MGRP

SEQ ID NO: 1370274 - protein, 11 aa, Mycobacterium tuberculosis
MPNDEGGNGRL

SEQ ID NO: 1370275 - protein, 14 aa, Mycobacterium tuberculosis
MPSNVGDAAAGRRF

SEQ ID NO: 1370276 - protein, 5 aa, Mycobacterium tuberculosis
MPTES

SEQ ID NO: 1370277 - protein, 6 aa, Mycobacterium tuberculosis
MSRGKL

SEQ ID NO: 1370278 - protein, 7 aa, Mycobacterium tuberculosis
NAAAGSV

SEQ ID NO: 1370279 - protein, 5 aa, Mycobacterium tuberculosis
NADRG

SEQ ID NO: 1370280 - protein, 7 aa, Mycobacterium tuberculosis
NAELPDT

SEQ ID NO: 1370281 - protein, 15 aa, Mycobacterium tuberculosis
NAQRRATAKRKLERQ

SEQ ID NO: 1370282 - protein, 9 aa, Mycobacterium tuberculosis
NARRAPNRA

SEQ ID NO: 1370283 - protein, 7 aa, Mycobacterium tuberculosis
NDRINSD

SEQ ID NO: 1370284 - protein, 5 aa, Mycobacterium tuberculosis
NEGRE

SEQ ID NO: 1370285 - protein, 7 aa, Mycobacterium tuberculosis
NGVAQTV

SEQ ID NO: 1370286 - protein, 7 aa, Mycobacterium tuberculosis
NRGNLDT

SEQ ID NO: 1370287 - protein, 13 aa, Mycobacterium tuberculosis
NSPGMGGDATRVT

SEQ ID NO: 1370288 - protein, 5 aa, Mycobacterium tuberculosis
NSPRQ

SEQ ID NO: 1370289 - protein, 14 aa, Mycobacterium tuberculosis
NTTVSRDGLTTPGV

SEQ ID NO: 1370290 - protein, 29 aa, Mycobacterium tuberculosis
NTTVSRDGLTTPGVDRLGPGGISGPPLAQ

SEQ ID NO: 1370291 - protein, 4 aa, Mycobacterium tuberculosis
PAMT

SEQ ID NO: 1370292 - protein, 7 aa, Mycobacterium tuberculosis
PATTDFP

SEQ ID NO: 1370293 - protein, 74 aa, Mycobacterium tuberculosis
PCPAPRATSPPGRPAPPTTSETTEPNVTSSPASPSPTTSAPAPTGTTPAIPTSASPAAPASPPTPWPVTSSPTM

SEQ ID NO: 1370294 - protein, 8 aa, Mycobacterium tuberculosis
PDAEAAGD

SEQ ID NO: 1370295 - protein, 10 aa, Mycobacterium tuberculosis
PGADLDEDTI

SEQ ID NO: 1370296 - protein, 17 aa, Mycobacterium tuberculosis
PGIGAPSWTADYGSETL

SEQ ID NO: 1370297 - protein, 4 aa, Mycobacterium tuberculosis
PGNA

SEQ ID NO: 1370298 - protein, 6 aa, Mycobacterium tuberculosis
PGPGAL

SEQ ID NO: 1370299 - protein, 7 aa, Mycobacterium tuberculosis
PGRRTAT

SEQ ID NO: 1370300 - protein, 7 aa, Mycobacterium tuberculosis
PKYRFDD

SEQ ID NO: 1370301 - protein, 11 aa, Mycobacterium tuberculosis
PNTNTECPPGT

SEQ ID NO: 1370302 - protein, 68 aa, Mycobacterium tuberculosis; identical to SEQ ID NO: 152956

SEQ ID NO: 1370303 - protein, 5 aa, Mycobacterium tuberculosis
PREFR

SEQ ID NO: 1370304 - protein, 13 aa, Mycobacterium tuberculosis
PRLPNVDAGGDFV

SEQ ID NO: 1370305 - protein, 14 aa, Mycobacterium tuberculosis
PSDPTNNANATQPP

SEQ ID NO: 1370306 - protein, 5 aa, Mycobacterium tuberculosis
PSNGV

SEQ ID NO: 1370307 - protein, 4 aa, Mycobacterium tuberculosis
PSSN

SEQ ID NO: 1370308 - protein, 13 aa, Mycobacterium tuberculosis
PSYRPRKRPGRTT

SEQ ID NO: 1370309 - protein, 11 aa, Mycobacterium tuberculosis
PVDRPGRGLSR

SEQ ID NO: 1370310 - protein, 13 aa, Mycobacterium tuberculosis
QAAGGAVDGADTV

SEQ ID NO: 1370311 - protein, 12 aa, Mycobacterium tuberculosis
QAEDIDTRYHPS

SEQ ID NO: 1370312 - protein, 7 aa, Mycobacterium tuberculosis
QALRADA

SEQ ID NO: 1370313 - protein, 9 aa, Mycobacterium tuberculosis
QATPNGAAP

SEQ ID NO: 1370314 - protein, 6 aa, Mycobacterium tuberculosis
QENTTL

SEQ ID NO: 1370315 - protein, 4 aa, Mycobacterium tuberculosis
QHSS

SEQ ID NO: 1370316 - protein, 6 aa, Mycobacterium tuberculosis
QIPPNQ

SEQ ID NO: 1370317 - protein, 19 aa, Mycobacterium tuberculosis
QRNSKTAGASVGDLATDPD

SEQ ID NO: 1370318 - protein, 5 aa, Mycobacterium tuberculosis
QTGTG

SEQ ID NO: 1370319 - protein, 72 aa, Mycobacterium tuberculosis
QYGESGRRSRHSAEHRDHDIGGSGAGTGERPPSPPMAPPPPAEPTRRHRTADTPPDDSGGLHARDPLTGGQS

SEQ ID NO: 1370320 - protein, 13 aa, Mycobacterium tuberculosis
RADGVDRAQYPQA

SEQ ID NO: 1370321 - protein, 11 aa, Mycobacterium tuberculosis
RAEASGLRGDG

SEQ ID NO: 1370322 - protein, 5 aa, Mycobacterium tuberculosis
RAGDE

SEQ ID NO: 1370323 - protein, 8 aa, Mycobacterium tuberculosis
RARQTGAQ

SEQ ID NO: 1370324 - protein, 11 aa, Mycobacterium tuberculosis
RDGGGLDGDAA

SEQ ID NO: 1370325 - protein, 12 aa, Mycobacterium tuberculosis
RDPTPPGGPHGI

SEQ ID NO: 1370326 - protein, 10 aa, Mycobacterium tuberculosis
RGAPNGIDER

SEQ ID NO: 1370327 - protein, 12 aa, Mycobacterium tuberculosis
RGEQIDNAGNAA

SEQ ID NO: 1370328 - protein, 6 aa, Mycobacterium tuberculosis
RGSQWA

SEQ ID NO: 1370329 - protein, 5 aa, Mycobacterium tuberculosis
RHHRN

SEQ ID NO: 1370330 - protein, 7 aa, Mycobacterium tuberculosis
RKQDEVS

SEQ ID NO: 1370331 - protein, 19 aa, Mycobacterium tuberculosis
RRDPLPVAGRRSRTSGGID

SEQ ID NO: 1370332 - protein, 19 aa, Mycobacterium tuberculosis
RRDPLPVAGRRSRTSGGIG

SEQ ID NO: 1370333 - protein, 27 aa, Mycobacterium tuberculosis
RTAYPAKPCGNRRTGATRGLTSPGYSQ

SEQ ID NO: 1370334 - protein, 6 aa, Mycobacterium tuberculosis
RVGTAT

SEQ ID NO: 1370335 - protein, 5 aa, Mycobacterium tuberculosis
RVSAT

SEQ ID NO: 1370336 - protein, 18 aa, Mycobacterium tuberculosis
SAAPTDPSSSSTDSPVDA

SEQ ID NO: 1370337 - protein, 17 aa, Mycobacterium tuberculosis
SAARLTGAAGSQAISDS

SEQ ID NO: 1370338 - protein, 14 aa, Mycobacterium tuberculosis
SAGQAKPCATGAGT

SEQ ID NO: 1370339 - protein, 8 aa, Mycobacterium tuberculosis
SAISTSHG

SEQ ID NO: 1370340 - protein, 5 aa, Mycobacterium tuberculosis
SALTE

SEQ ID NO: 1370341 - protein, 8 aa, Mycobacterium tuberculosis
SARQASET

SEQ ID NO: 1370342 - protein, 10 aa, Mycobacterium tuberculosis
SCTEAPASRS

SEQ ID NO: 1370343 - protein, 5 aa, Mycobacterium tuberculosis
SDEPY

SEQ ID NO: 1370344 - protein, 8 aa, Mycobacterium tuberculosis
SEIGRDGL

SEQ ID NO: 1370345 - protein, 4 aa, Mycobacterium tuberculosis
SEIH

SEQ ID NO: 1370346 - protein, 6 aa, Mycobacterium tuberculosis
SFPDPT

SEQ ID NO: 1370347 - protein, 5 aa, Mycobacterium tuberculosis
SFSNK

SEQ ID NO: 1370348 - protein, 7 aa, Mycobacterium tuberculosis
SGKQIPA

SEQ ID NO: 1370349 - protein, 7 aa, Mycobacterium tuberculosis
SKIGEKS

SEQ ID NO: 1370350 - protein, 26 aa, Mycobacterium tuberculosis
SLAGPKLSREERRAEKAANRARMTER

SEQ ID NO: 1370351 - protein, 5 aa, Mycobacterium tuberculosis
SRGYN

SEQ ID NO: 1370352 - protein, 7 aa, Mycobacterium tuberculosis
SRKNQYD

SEQ ID NO: 1370353 - protein, 5 aa, Mycobacterium tuberculosis
SSIPY

SEQ ID NO: 1370354 - protein, 28 aa, Mycobacterium tuberculosis
SVGAGTPGPAGTSGTATTGPKTAPKTAE

SEQ ID NO: 1370355 - protein, 10 aa, Mycobacterium tuberculosis
TAKAWGGGDL

SEQ ID NO: 1370356 - protein, 9 aa, Mycobacterium tuberculosis
TARGGERGM

SEQ ID NO: 1370357 - protein, 4 aa, Mycobacterium tuberculosis
TGIK

SEQ ID NO: 1370358 - protein, 12 aa, Mycobacterium tuberculosis
THVEQTAANCPQ

SEQ ID NO: 1370359 - protein, 13 aa, Mycobacterium tuberculosis
TIAPNGDVSPPIR

SEQ ID NO: 1370360 - protein, 8 aa, Mycobacterium tuberculosis
TPDEVDPD

SEQ ID NO: 1370361 - protein, 9 aa, Mycobacterium tuberculosis
TPPLPTRRN

SEQ ID NO: 1370362 - protein, 16 aa, Mycobacterium tuberculosis
TPQRSLTRGLTPAPTA

SEQ ID NO: 1370363 - protein, 19 aa, Mycobacterium tuberculosis
TPVANPQQVSVPEGGTVGP

SEQ ID NO: 1370364 - protein, 17 aa, Mycobacterium tuberculosis
TRITGGPGRGPETRTAN

SEQ ID NO: 1370365 - protein, 10 aa, Mycobacterium tuberculosis
TRQANPKLPA

SEQ ID NO: 1370366 - protein, 4 aa, Mycobacterium tuberculosis
TSAS

SEQ ID NO: 1370367 - protein, 4 aa, Mycobacterium tuberculosis
TSDY

SEQ ID NO: 1370368 - protein, 6 aa, Mycobacterium tuberculosis
TSMEQG

SEQ ID NO: 1370369 - protein, 9 aa, Mycobacterium tuberculosis
TSQAGQPPE

SEQ ID NO: 1370370 - protein, 8 aa, Mycobacterium tuberculosis
TTADPDIP

SEQ ID NO: 1370371 - protein, 16 aa, Mycobacterium tuberculosis
TWDNGTTHDDETDADA

SEQ ID NO: 1370372 - protein, 4 aa, Mycobacterium tuberculosis
VATH

SEQ ID NO: 1370373 - protein, 5 aa, Mycobacterium tuberculosis
VDAQL

SEQ ID NO: 1370374 - protein, 10 aa, Mycobacterium tuberculosis
VGSAGTVTTL

SEQ ID NO: 1370375 - protein, 4 aa, Mycobacterium tuberculosis
VGSH

SEQ ID NO: 1370376 - protein, 25 aa, Mycobacterium tuberculosis
VPRPGTSPGVGGTPASPAPEAPAVP

SEQ ID NO: 1370377 - protein, 10 aa, Mycobacterium tuberculosis
VPTGPAAPGI

SEQ ID NO: 1370378 - protein, 7 aa, Mycobacterium tuberculosis
VSLRPNR

SEQ ID NO: 1370379 - protein, 13 aa, Mycobacterium tuberculosis
VSSSSADATAMPD

SEQ ID NO: 1370380 - protein, 16 aa, Mycobacterium tuberculosis
VTAEPQPTPRPAKPRL

SEQ ID NO: 1370381 - protein, 23 aa, Mycobacterium tuberculosis
WRTPARPQVPTASDTRRTPPRLP

SEQ ID NO: 1370382 - protein, 21 aa, Mycobacterium tuberculosis
WSSEPAARASRSSSCRWSMGS

SEQ ID NO: 1370383 - protein, 8 aa, Mycobacterium tuberculosis
YDVERRGE

SEQ ID NO: 1370384 - protein, 120 aa, Mycobacterium tuberculosis
YGVQPGGYYGQQGAQQAAGLQSPSPQQSPQPPGYGSQYGGYSSSPSQSGSGYTAQPPAQPPAQSGSQQSHQGPSTPPTGFPSFSPPPPVSAGTGSQAGSAPVNYSNPSGGEQSSSPGGAP

SEQ ID NO: 1370385 - protein, 6 aa, Mycobacterium tuberculosis
YSRKDA

SEQ ID NO: 1370386 - protein, 6 aa, Mycobacterium tuberculosis
AAAIGG

SEQ ID NO: 1370387 - protein, 13 aa, Mycobacterium tuberculosis
AAAITSGAAITND

SEQ ID NO: 1370388 - protein, 11 aa, Mycobacterium tuberculosis
AAGGAVDGADT

SEQ ID NO: 1370389 - protein, 18 aa, Mycobacterium tuberculosis
AAGSAYATAEAANASPLQ

SEQ ID NO: 1370390 - protein, 13 aa, Mycobacterium tuberculosis
AANRPLRRVKLGS

SEQ ID NO: 1370391 - protein, 7 aa, Mycobacterium tuberculosis
AATARPV

SEQ ID NO: 1370392 - protein, 10 aa, Mycobacterium tuberculosis
AATSKDAIDK

SEQ ID NO: 1370393 - protein, 15 aa, Mycobacterium tuberculosis
ACCDGEDNEDREPEQ

SEQ ID NO: 1370394 - protein, 24 aa, Mycobacterium tuberculosis
ADDGRTSATPASAGHRLPGGGMTT

SEQ ID NO: 1370395 - protein, 9 aa, Mycobacterium tuberculosis
ADGKKMENA

SEQ ID NO: 1370396 - protein, 8 aa, Mycobacterium tuberculosis
ADPETGSA

SEQ ID NO: 1370397 - protein, 8 aa, Mycobacterium tuberculosis
ADQLADQA

SEQ ID NO: 1370398 - protein, 10 aa, Mycobacterium tuberculosis
AEASGLRGDG

SEQ ID NO: 1370399 - protein, 12 aa, Mycobacterium tuberculosis
AEEMDAPDRNLP

SEQ ID NO: 1370400 - protein, 11 aa, Mycobacterium tuberculosis
AELGPQQDTDE

SEQ ID NO: 1370401 - protein, 6 aa, Mycobacterium tuberculosis
AELSDP

SEQ ID NO: 1370402 - protein, 15 aa, Mycobacterium tuberculosis
AEPQPTPRPAKPRLL

SEQ ID NO: 1370403 - protein, 10 aa, Mycobacterium tuberculosis
AESPPSAVPP

SEQ ID NO: 1370404 - protein, 9 aa, Mycobacterium tuberculosis
AFSQAPGDN

SEQ ID NO: 1370405 - protein, 7 aa, Mycobacterium tuberculosis
AGAGSGP

SEQ ID NO: 1370406 - protein, 10 aa, Mycobacterium tuberculosis
AGARPVVQDP

SEQ ID NO: 1370407 - protein, 5 aa, Mycobacterium tuberculosis
AGASF

SEQ ID NO: 1370408 - protein, 6 aa, Mycobacterium tuberculosis
AGDEVS

SEQ ID NO: 1370409 - protein, 13 aa, Mycobacterium tuberculosis
AGDYTTAAEDKPA

SEQ ID NO: 1370410 - protein, 23 aa, Mycobacterium tuberculosis
AGGGGATGVAGAGGAAAVDGGEA

SEQ ID NO: 1370411 - protein, 12 aa, Mycobacterium tuberculosis
AGRGPGRPRRRK

SEQ ID NO: 1370412 - protein, 6 aa, Mycobacterium tuberculosis
AGSGAN

SEQ ID NO: 1370413 - protein, 23 aa, Mycobacterium tuberculosis
AGSPATARPPQRIGSAAPGRWCW

SEQ ID NO: 1370414 - protein, 8 aa, Mycobacterium tuberculosis
AGTRDADM

SEQ ID NO: 1370415 - protein, 9 aa, Mycobacterium tuberculosis
AGTRDADMA

SEQ ID NO: 1370416 - protein, 18 aa, Mycobacterium tuberculosis
AGVPPPPPPPSEVPPSET

SEQ ID NO: 1370417 - protein, 8 aa, Mycobacterium tuberculosis
AHASTAEF

SEQ ID NO: 1370418 - protein, 9 aa, Mycobacterium tuberculosis
AKASTVGTI

SEQ ID NO: 1370419 - protein, 18 aa, Mycobacterium tuberculosis
AKGGPGGRPGCGPLPDAT

SEQ ID NO: 1370420 - protein, 18 aa, Mycobacterium tuberculosis
AKGIQKGLSSGSKSTAAA

SEQ ID NO: 1370421 - protein, 8 aa, Mycobacterium tuberculosis
AKPGVPRS

SEQ ID NO: 1370422 - protein, 6 aa, Mycobacterium tuberculosis
AKPRLL

SEQ ID NO: 1370423 - protein, 18 aa, Mycobacterium tuberculosis
ALKGTSNETFPKPTEVGG

SEQ ID NO: 1370424 - protein, 7 aa, Mycobacterium tuberculosis
ANPKLPG

SEQ ID NO: 1370425 - protein, 15 aa, Mycobacterium tuberculosis
APAADSRRASPKPRP

SEQ ID NO: 1370426 - protein, 5 aa, Mycobacterium tuberculosis
APAGY

SEQ ID NO: 1370427 - protein, 17 aa, Mycobacterium tuberculosis
APCSGDAANAPPPPSAI

SEQ ID NO: 1370428 - protein, 35 aa, Mycobacterium tuberculosis
APGDNSPRPAPTPTVTTTGNPPASNTGGTDASPRL

SEQ ID NO: 1370429 - protein, 5 aa, Mycobacterium tuberculosis
APGMT

SEQ ID NO: 1370430 - protein, 14 aa, Mycobacterium tuberculosis
APIAPADAARNRAR

SEQ ID NO: 1370431 - protein, 6 aa, Mycobacterium tuberculosis
APKAGY

SEQ ID NO: 1370432 - protein, 11 aa, Mycobacterium tuberculosis
APLGGASDERV

SEQ ID NO: 1370433 - protein, 5 aa, Mycobacterium tuberculosis
APPPG

SEQ ID NO: 1370434 - protein, 29 aa, Mycobacterium tuberculosis
APTADRRAAVGTTSDINQQDPATLQDGGN

SEQ ID NO: 1370435 - protein, 53 aa, Mycobacterium tuberculosis
APTGQPSWAPNSGPMPASGPTPTPQYYQGGGWGAPPSGGPSPWAQTPRKTNPW

SEQ ID NO: 1370436 - protein, 25 aa, Mycobacterium tuberculosis
AQDGNSAPAGHQRSGGTDQLGQGKQ

SEQ ID NO: 1370437 - protein, 12 aa, Mycobacterium tuberculosis
AQRRPPATRGRS

SEQ ID NO: 1370438 - protein, 9 aa, Mycobacterium tuberculosis
ARGDTIGGN

SEQ ID NO: 1370439 - protein, 8 aa, Mycobacterium tuberculosis
ARGKSGRL

SEQ ID NO: 1370440 - protein, 7 aa, Mycobacterium tuberculosis
ARRDDPL

SEQ ID NO: 1370441 - protein, 18 aa, Mycobacterium tuberculosis
ARRREKAGSPPPDKPMTV

SEQ ID NO: 1370442 - protein, 7 aa, Mycobacterium tuberculosis
ARSDDHH

SEQ ID NO: 1370443 - protein, 13 aa, Mycobacterium tuberculosis
ASATSGVSGLPNA

SEQ ID NO: 1370444 - protein, 7 aa, Mycobacterium tuberculosis
ASTTSAT

SEQ ID NO: 1370445 - protein, 11 aa, Mycobacterium tuberculosis
ATAPAGTPGEY

SEQ ID NO: 1370446 - protein, 21 aa, Mycobacterium tuberculosis
ATTSLPRAEAGQSGSEGEQLA

SEQ ID NO: 1370447 - protein, 8 aa, Mycobacterium tuberculosis
ATVDAYDG

SEQ ID NO: 1370448 - protein, 4 aa, Mycobacterium tuberculosis
AVEP

SEQ ID NO: 1370449 - protein, 6 aa, Mycobacterium tuberculosis
AVPAAA

SEQ ID NO: 1370450 - protein, 16 aa, Mycobacterium tuberculosis
AVRGQGERIGQATTDL

SEQ ID NO: 1370451 - protein, 8 aa, Mycobacterium tuberculosis
AVSTDPVG

SEQ ID NO: 1370452 - protein, 14 aa, Mycobacterium tuberculosis
CGASPTPHRLPAEI

SEQ ID NO: 1370453 - protein, 15 aa, Mycobacterium tuberculosis
CSPNAATDANDDRSR

SEQ ID NO: 1370454 - protein, 14 aa, Mycobacterium tuberculosis
CTTPADSACAPAAA

SEQ ID NO: 1370455 - protein, 6 aa, Mycobacterium tuberculosis
DAALSA

SEQ ID NO: 1370456 - protein, 4 aa, Mycobacterium tuberculosis
DAKP

SEQ ID NO: 1370457 - protein, 5 aa, Mycobacterium tuberculosis
DCATA

SEQ ID NO: 1370458 - protein, 7 aa, Mycobacterium tuberculosis
DELPDTR

SEQ ID NO: 1370459 - protein, 9 aa, Mycobacterium tuberculosis
DFGKPDGYL

SEQ ID NO: 1370460 - protein, 7 aa, Mycobacterium tuberculosis
DFPQTDR

SEQ ID NO: 1370461 - protein, 7 aa, Mycobacterium tuberculosis
DGQPLGR

SEQ ID NO: 1370462 - protein, 4 aa, Mycobacterium tuberculosis
DGTP

SEQ ID NO: 1370463 - protein, 8 aa, Mycobacterium tuberculosis
DKEMDPTI

SEQ ID NO: 1370464 - protein, 6 aa, Mycobacterium tuberculosis
DKSHAL

SEQ ID NO: 1370465 - protein, 9 aa, Mycobacterium tuberculosis
DLQEDKEPV

SEQ ID NO: 1370466 - protein, 12 aa, Mycobacterium tuberculosis
DLTSVSDPDADV

SEQ ID NO: 1370467 - protein, 5 aa, Mycobacterium tuberculosis
DPEAR

SEQ ID NO: 1370468 - protein, 14 aa, Mycobacterium tuberculosis
DPGNVAANVSSGAQ

SEQ ID NO: 1370469 - protein, 31 aa, Mycobacterium tuberculosis
DPVAPAARGPPAAQGSVRTGQDLLTRFCLAR

SEQ ID NO: 1370470 - protein, 19 aa, Mycobacterium tuberculosis
DQIDRRKAKGSAGGRPPAF

SEQ ID NO: 1370471 - protein, 5 aa, Mycobacterium tuberculosis
DQSVG

SEQ ID NO: 1370472 - protein, 7 aa, Mycobacterium tuberculosis
DRAAEST

SEQ ID NO: 1370473 - protein, 11 aa, Mycobacterium tuberculosis
DRGQRRGCAPG

SEQ ID NO: 1370474 - protein, 13 aa, Mycobacterium tuberculosis
DRHGHPDPGPQRR

SEQ ID NO: 1370475 - protein, 7 aa, Mycobacterium tuberculosis
DRREDVA

SEQ ID NO: 1370476 - protein, 20 aa, Mycobacterium tuberculosis
DRSPGRASSAPRQEPPQSQR

SEQ ID NO: 1370477 - protein, 14 aa, Mycobacterium tuberculosis
DRYGGGTARRLERT

SEQ ID NO: 1370478 - protein, 10 aa, Mycobacterium tuberculosis
DSAREMEHNR

SEQ ID NO: 1370479 - protein, 6 aa, Mycobacterium tuberculosis
DSGFVS

SEQ ID NO: 1370480 - protein, 4 aa, Mycobacterium tuberculosis
DSVG

SEQ ID NO: 1370481 - protein, 25 aa, Mycobacterium tuberculosis
DTAVTEPPGFGGPSELSGAPRTSRT

SEQ ID NO: 1370482 - protein, 6 aa, Mycobacterium tuberculosis
DTGDTF

SEQ ID NO: 1370483 - protein, 10 aa, Mycobacterium tuberculosis
EAAHQAAQRE

SEQ ID NO: 1370484 - protein, 12 aa, Mycobacterium tuberculosis
EAERKAGESAEQ

SEQ ID NO: 1370485 - protein, 9 aa, Mycobacterium tuberculosis
EAERRQWSR

SEQ ID NO: 1370486 - protein, 21 aa, Mycobacterium tuberculosis
EAPVSAAPRTSAPNSETYTRR

SEQ ID NO: 1370487 - protein, 11 aa, Mycobacterium tuberculosis
EASERAGEEVP

SEQ ID NO: 1370488 - protein, 19 aa, Mycobacterium tuberculosis
EDQPFSPAGTATSRAVERS

SEQ ID NO: 1370489 - protein, 4 aa, Mycobacterium tuberculosis
EDRL

SEQ ID NO: 1370490 - protein, 10 aa, Mycobacterium tuberculosis
EEQATADRLN

SEQ ID NO: 1370491 - protein, 7 aa, Mycobacterium tuberculosis
EFSSDPE

SEQ ID NO: 1370492 - protein, 9 aa, Mycobacterium tuberculosis
EGLRGHGDD

SEQ ID NO: 1370493 - protein, 18 aa, Mycobacterium tuberculosis
EHAPDALGGPPGLPAPRG

SEQ ID NO: 1370494 - protein, 23 aa, Mycobacterium tuberculosis
EKSDVTAAPDTVEGDSHTAMTPR

SEQ ID NO: 1370495 - protein, 5 aa, Mycobacterium tuberculosis
ENVYP

SEQ ID NO: 1370496 - protein, 13 aa, Mycobacterium tuberculosis
EPPSEVRATPGTS

SEQ ID NO: 1370497 - protein, 4 aa, Mycobacterium tuberculosis
EPPV

SEQ ID NO: 1370498 - protein, 11 aa, Mycobacterium tuberculosis
EPSGAPRTSRT

SEQ ID NO: 1370499 - protein, 19 aa, Mycobacterium tuberculosis
EQEEEPAAVKTKRRARRDP

SEQ ID NO: 1370500 - protein, 7 aa, Mycobacterium tuberculosis
EQSGTAL

SEQ ID NO: 1370501 - protein, 5 aa, Mycobacterium tuberculosis
ERRHE

SEQ ID NO: 1370502 - protein, 6 aa, Mycobacterium tuberculosis
ETGEFE

SEQ ID NO: 1370503 - protein, 4 aa, Mycobacterium tuberculosis
EVLE

SEQ ID NO: 1370504 - protein, 8 aa, Mycobacterium tuberculosis
GADELSTA

SEQ ID NO: 1370505 - protein, 7 aa, Mycobacterium tuberculosis
GAGLHEA

SEQ ID NO: 1370506 - protein, 7 aa, Mycobacterium tuberculosis
GAHTPAA

SEQ ID NO: 1370507 - protein, 6 aa, Mycobacterium tuberculosis
GAPGSI

SEQ ID NO: 1370508 - protein, 6 aa, Mycobacterium tuberculosis
GAPTYL

SEQ ID NO: 1370509 - protein, 18 aa, Mycobacterium tuberculosis
GAVGSGAALAGQAAESHG

SEQ ID NO: 1370510 - protein, 4 aa, Mycobacterium tuberculosis
GAVP

SEQ ID NO: 1370511 - protein, 10 aa, Mycobacterium tuberculosis
GDEDGKVTTS

SEQ ID NO: 1370512 - protein, 51 aa, Mycobacterium tuberculosis
GDHAAAGDHAAAGDHVPQPSTDPADPTDSGDSAAPPRNTSGSRDRAVQRDF

SEQ ID NO: 1370513 - protein, 9 aa, Mycobacterium tuberculosis
GDPDAPPTM

SEQ ID NO: 1370514 - protein, 25 aa, Mycobacterium tuberculosis
GDYHPDRSPDHHYPGATAPGPARCD

SEQ ID NO: 1370515 - protein, 12 aa, Mycobacterium tuberculosis
GEAAERLRRQLV

SEQ ID NO: 1370516 - protein, 14 aa, Mycobacterium tuberculosis
GEAAPQSPAEPVAE

SEQ ID NO: 1370517 - protein, 16 aa, Mycobacterium tuberculosis
GGAGDDDGTPAVADGQ

SEQ ID NO: 1370518 - protein, 15 aa, Mycobacterium tuberculosis
GGPQAVADAAHQAGI

SEQ ID NO: 1370519 - protein, 7 aa, Mycobacterium tuberculosis
GHGADGA

SEQ ID NO: 1370520 - protein, 7 aa, Mycobacterium tuberculosis
GHNDPEL

SEQ ID NO: 1370521 - protein, 7 aa, Mycobacterium tuberculosis
GLGMTDA

SEQ ID NO: 1370522 - protein, 16 aa, Mycobacterium tuberculosis
GLTGEFNSDANAIARG

SEQ ID NO: 1370523 - protein, 7 aa, Mycobacterium tuberculosis
GNPDGPA

SEQ ID NO: 1370524 - protein, 5 aa, Mycobacterium tuberculosis
GNRQI

SEQ ID NO: 1370525 - protein, 6 aa, Mycobacterium tuberculosis
GPAGVD

SEQ ID NO: 1370526 - protein, 13 aa, Mycobacterium tuberculosis
GPAIGPNPAAGEQ

SEQ ID NO: 1370527 - protein, 9 aa, Mycobacterium tuberculosis
GPDHRSASV

SEQ ID NO: 1370528 - protein, 54 aa, Mycobacterium tuberculosis; identical to SEQ ID NO: 151391

SEQ ID NO: 1370529 - protein, 54 aa, Mycobacterium tuberculosis
GPGTGRVATARGGDAASAPPPGAGGPAPPQAVPPPRTTQPPAAPPRGPDVPPAT

SEQ ID NO: 1370530 - protein, 5 aa, Mycobacterium tuberculosis
GPQPA

SEQ ID NO: 1370531 - protein, 19 aa, Mycobacterium tuberculosis
GPRAPGSSYGSRENGPPIN

SEQ ID NO: 1370532 - protein, 4 aa, Mycobacterium tuberculosis
GPTV

SEQ ID NO: 1370533 - protein, 66 aa, Mycobacterium tuberculosis
GRDKSGQPNPQPPETDALSRDASPGPRRRRRATARRKAPVKAPSATRQTTKPKGPPAHRSSSTYPR

SEQ ID NO: 1370534 - protein, 5 aa, Mycobacterium tuberculosis
GRPSA

SEQ ID NO: 1370535 - protein, 4 aa, Mycobacterium tuberculosis
GSAR

SEQ ID NO: 1370536 - protein, 21 aa, Mycobacterium tuberculosis
GTEDQPVAAETLQDHDCSITK

SEQ ID NO: 1370537 - protein, 9 aa, Mycobacterium tuberculosis
GTGKTTTVG

SEQ ID NO: 1370538 - protein, 5 aa, Mycobacterium tuberculosis
GTLTE

SEQ ID NO: 1370539 - protein, 15 aa, Mycobacterium tuberculosis
GTREQCEAAYKSAQT

SEQ ID NO: 1370540 - protein, 7 aa, Mycobacterium tuberculosis
GTTPKML

SEQ ID NO: 1370541 - protein, 9 aa, Mycobacterium tuberculosis
GTVSTAPAF

SEQ ID NO: 1370542 - protein, 5 aa, Mycobacterium tuberculosis
GVDSG

SEQ ID NO: 1370543 - protein, 8 aa, Mycobacterium tuberculosis
GVSDHSAT

SEQ ID NO: 1370544 - protein, 20 aa, Mycobacterium tuberculosis
GYDPNAGYSAHAGAKPQRIP

SEQ ID NO: 1370545 - protein, 16 aa, Mycobacterium tuberculosis
HEAAGAAVRAAEQRGV

SEQ ID NO: 1370546 - protein, 8 aa, Mycobacterium tuberculosis
HGDRRGGH

SEQ ID NO: 1370547 - protein, 5 aa, Mycobacterium tuberculosis
HNDPE

SEQ ID NO: 1370548 - protein, 7 aa, Mycobacterium tuberculosis
HPRLTTK

SEQ ID NO: 1370549 - protein, 98 aa, Mycobacterium tuberculosis
HQRADASPDAGSKDGCRPDSGRTSGSDTSRGSQTTGPKGRPTPKRNQSRRHTKKGPVAPAPMTAAQARARRKSLAGPKLSREERRAEKAANRARMTER

SEQ ID NO: 1370550 - protein, 4 aa, Mycobacterium tuberculosis
HRET

SEQ ID NO: 1370551 - protein, 11 aa, Mycobacterium tuberculosis
HSGTDDPRFRA

SEQ ID NO: 1370552 - protein, 5 aa, Mycobacterium tuberculosis
HTIPE

SEQ ID NO: 1370553 - protein, 9 aa, Mycobacterium tuberculosis
HYPDRGAPA

SEQ ID NO: 1370554 - protein, 10 aa, Mycobacterium tuberculosis
IASSSGAERV

SEQ ID NO: 1370555 - protein, 8 aa, Mycobacterium tuberculosis
IDQTRDQL

SEQ ID NO: 1370556 - protein, 15 aa, Mycobacterium tuberculosis
IGAPSWTADYGSETL

SEQ ID NO: 1370557 - protein, 8 aa, Mycobacterium tuberculosis
IGGPRRKG

SEQ ID NO: 1370558 - protein, 4 aa, Mycobacterium tuberculosis
ISAR

SEQ ID NO: 1370559 - protein, 5 aa, Mycobacterium tuberculosis
ISDPG

SEQ ID NO: 1370560 - protein, 13 aa, Mycobacterium tuberculosis
KAAAKDRQRGAGP

SEQ ID NO: 1370561 - protein, 4 aa, Mycobacterium tuberculosis
KAFE

SEQ ID NO: 1370562 - protein, 8 aa, Mycobacterium tuberculosis
KAGTVGTI

SEQ ID NO: 1370563 - protein, 6 aa, Mycobacterium tuberculosis
KAYEAP

SEQ ID NO: 1370564 - protein, 7 aa, Mycobacterium tuberculosis
KEDKQNR

SEQ ID NO: 1370565 - protein, 10 aa, Mycobacterium tuberculosis
KGAAGVSGAG

SEQ ID NO: 1370566 - protein, 4 aa, Mycobacterium tuberculosis
KGRS

SEQ ID NO: 1370567 - protein, 12 aa, Mycobacterium tuberculosis
KHSKMSQEDQVR

SEQ ID NO: 1370568 - protein, 28 aa, Mycobacterium tuberculosis
KMPPSPPGCPTGPLAPSAPSPTSGRPSS

SEQ ID NO: 1370569 - protein, 19 aa, Mycobacterium tuberculosis
KRGAWTPPTVASPTAMGSA

SEQ ID NO: 1370570 - protein, 7 aa, Mycobacterium tuberculosis
KRKLERQ

SEQ ID NO: 1370571 - protein, 6 aa, Mycobacterium tuberculosis
KTAPHG

SEQ ID NO: 1370572 - protein, 6 aa, Mycobacterium tuberculosis
KWAGSE

SEQ ID NO: 1370573 - protein, 6 aa, Mycobacterium tuberculosis
KYRFDD

SEQ ID NO: 1370574 - protein, 8 aa, Mycobacterium tuberculosis
LGGTLRQP

SEQ ID NO: 1370575 - protein, 6 aa, Mycobacterium tuberculosis
LGPART

SEQ ID NO: 1370576 - protein, 30 aa, Mycobacterium tuberculosis
LGSRAGAGVMPKGPLPTTAKMRSVQRTVRR

SEQ ID NO: 1370577 - protein, 7 aa, Mycobacterium tuberculosis
LKRERDA

SEQ ID NO: 1370578 - protein, 15 aa, Mycobacterium tuberculosis
LNDTKTKALTMCVAA

SEQ ID NO: 1370579 - protein, 11 aa, Mycobacterium tuberculosis
LPAMSPPRRSV

SEQ ID NO: 1370580 - protein, 6 aa, Mycobacterium tuberculosis
LPEREP

SEQ ID NO: 1370581 - protein, 18 aa, Mycobacterium tuberculosis
LPSRNTSGSRDRTVQRDF

SEQ ID NO: 1370582 - protein, 15 aa, Mycobacterium tuberculosis
LPTAAGEPNAAPAAC

SEQ ID NO: 1370583 - protein, 12 aa, Mycobacterium tuberculosis
LQDRAARTPQHE

SEQ ID NO: 1370584 - protein, 19 aa, Mycobacterium tuberculosis
LRSSGTDAFPVGRPPSHTV

SEQ ID NO: 1370585 - protein, 6 aa, Mycobacterium tuberculosis
LTDPKR

SEQ ID NO: 1370586 - protein, 8 aa, Mycobacterium tuberculosis
LTTREPSS

SEQ ID NO: 1370587 - protein, 6 aa, Mycobacterium tuberculosis
MNPNGG

SEQ ID NO: 1370588 - protein, 5 aa, Mycobacterium tuberculosis
MPPCP

SEQ ID NO: 1370589 - protein, 5 aa, Mycobacterium tuberculosis
MPSPA

SEQ ID NO: 1370590 - protein, 4 aa, Mycobacterium tuberculosis
MQRV

SEQ ID NO: 1370591 - protein, 72 aa, Mycobacterium tuberculosis
MSQPPEHPGNPADPQGGNQGAGSYPPPGYGAPPPPPGYGPPPGTYLPPGYNAPPPPPGYGPPPGPPPPGYPT

SEQ ID NO: 1370592 - protein, 73 aa, Mycobacterium tuberculosis
MSQPPEHPGNPADPQGGNQGAGSYPPPGYGAPPPPPGYGPPPGTYLPPGYNAPPPPPGYGPPPGPPPPGYPTH

SEQ ID NO: 1370593 - protein, 10 aa, Mycobacterium tuberculosis
MTTPGEDHAG

SEQ ID NO: 1370594 - protein, 6 aa, Mycobacterium tuberculosis
NAPTQT

SEQ ID NO: 1370595 - protein, 6 aa, Mycobacterium tuberculosis
NDQDRA

SEQ ID NO: 1370596 - protein, 9 aa, Mycobacterium tuberculosis
NEQATTEAF

SEQ ID NO: 1370597 - protein, 5 aa, Mycobacterium tuberculosis
NLQTK

SEQ ID NO: 1370598 - protein, 4 aa, Mycobacterium tuberculosis
NNAE

SEQ ID NO: 1370599 - protein, 12 aa, Mycobacterium tuberculosis
NNSASTVSGSLS

SEQ ID NO: 1370600 - protein, 17 aa, Mycobacterium tuberculosis
NRQTAEAERGGSDRPTT

SEQ ID NO: 1370601 - protein, 7 aa, Mycobacterium tuberculosis
NRTGPSV

SEQ ID NO: 1370602 - protein, 6 aa, Mycobacterium tuberculosis
NSLPES

SEQ ID NO: 1370603 - protein, 10 aa, Mycobacterium tuberculosis
NTIDATGVGT

SEQ ID NO: 1370604 - protein, 7 aa, Mycobacterium tuberculosis
NTSPTRW

SEQ ID NO: 1370605 - protein, 6 aa, Mycobacterium tuberculosis
NVDTSE

SEQ ID NO: 1370606 - protein, 13 aa, Mycobacterium tuberculosis
PADHPRSKVGPLR

SEQ ID NO: 1370607 - protein, 7 aa, Mycobacterium tuberculosis
PAEPGHV

SEQ ID NO: 1370608 - protein, 9 aa, Mycobacterium tuberculosis
PALRESAGR

SEQ ID NO: 1370609 - protein, 4 aa, Mycobacterium tuberculosis
PALS

SEQ ID NO: 1370610 - protein, 11 aa, Mycobacterium tuberculosis
PARPNRPEADR

SEQ ID NO: 1370611 - protein, 10 aa, Mycobacterium tuberculosis
PDGQTRTSTV

SEQ ID NO: 1370612 - protein, 9 aa, Mycobacterium tuberculosis
PDGSTTVDT

SEQ ID NO: 1370613 - protein, 4 aa, Mycobacterium tuberculosis
PDGT

SEQ ID NO: 1370614 - protein, 10 aa, Mycobacterium tuberculosis
PERSGTVATR

SEQ ID NO: 1370615 - protein, 26 aa, Mycobacterium tuberculosis
PETWRRRKRRQSQKIRRSVQKQRRST

SEQ ID NO: 1370616 - protein, 18 aa, Mycobacterium tuberculosis
PFRPGSSTCCSTSKSSSG

SEQ ID NO: 1370617 - protein, 16 aa, Mycobacterium tuberculosis
PGGAGTLPPEKKPQVG

SEQ ID NO: 1370618 - protein, 10 aa, Mycobacterium tuberculosis
PGGGELGVDG

SEQ ID NO: 1370619 - protein, 7 aa, Mycobacterium tuberculosis
PGGRPGM

SEQ ID NO: 1370620 - protein, 20 aa, Mycobacterium tuberculosis
PHDEEPPAATPHGGGVPTNP

SEQ ID NO: 1370621 - protein, 91 aa, Mycobacterium tuberculosis
PHTSKLATGDTTSSAPPVQDEITTTKPAPPPPPPAPPPTTEIPTATETQTVTVTPPPPPPPATTTAPPPATTTTAAAPPPTTTTPTGPRQV

SEQ ID NO: 1370622 - protein, 17 aa, Mycobacterium tuberculosis
PIPQPWPSPASARTFAL

SEQ ID NO: 1370623 - protein, 4 aa, Mycobacterium tuberculosis
PIQT

SEQ ID NO: 1370624 - protein, 8 aa, Mycobacterium tuberculosis
PKNARTQD

SEQ ID NO: 1370625 - protein, 18 aa, Mycobacterium tuberculosis
PLATAPSTIRQGTSARNV

SEQ ID NO: 1370626 - protein, 10 aa, Mycobacterium tuberculosis
PLPGSAPRPA

SEQ ID NO: 1370627 - protein, 5 aa, Mycobacterium tuberculosis
PLPPL

SEQ ID NO: 1370628 - protein, 26 aa, Mycobacterium tuberculosis
PLPSSNPPRPPLPPAPPGAPLPPLPP

SEQ ID NO: 1370629 - protein, 5 aa, Mycobacterium tuberculosis
PPGRS

SEQ ID NO: 1370630 - protein, 5 aa, Mycobacterium tuberculosis
PPRLN

SEQ ID NO: 1370631 - protein, 27 aa, Mycobacterium tuberculosis
PPSSPAVRSSASASRGHWRSNPRSWHS

SEQ ID NO: 1370632 - protein, 10 aa, Mycobacterium tuberculosis
PQTPNGSINP

SEQ ID NO: 1370633 - protein, 22 aa, Mycobacterium tuberculosis
PRGAGAAVGDAEHLPGEEGYGS

SEQ ID NO: 1370634 - protein, 7 aa, Mycobacterium tuberculosis
PRPAGRL

SEQ ID NO: 1370635 - protein, 24 aa, Mycobacterium tuberculosis
PRPGTSPGVGGTPASPAPEAPAVP

SEQ ID NO: 1370636 - protein, 8 aa, Mycobacterium tuberculosis
PRTGPTRR

SEQ ID NO: 1370637 - protein, 7 aa, Mycobacterium tuberculosis
PSATHRR

SEQ ID NO: 1370638 - protein, 4 aa, Mycobacterium tuberculosis
PTGT

SEQ ID NO: 1370639 - protein, 4 aa, Mycobacterium tuberculosis
PTPS

SEQ ID NO: 1370640 - protein, 61 aa, Mycobacterium tuberculosis; identical to SEQ ID NO: 155758

SEQ ID NO: 1370641 - protein, 13 aa, Mycobacterium tuberculosis
PYSEPRHEQAASG

SEQ ID NO: 1370642 - protein, 6 aa, Mycobacterium tuberculosis
QALRAD

SEQ ID NO: 1370643 - protein, 8 aa, Mycobacterium tuberculosis
QATEGAVG

SEQ ID NO: 1370644 - protein, 6 aa, Mycobacterium tuberculosis
QDEKDP

SEQ ID NO: 1370645 - protein, 6 aa, Mycobacterium tuberculosis
QDEVSS

SEQ ID NO: 1370646 - protein, 6 aa, Mycobacterium tuberculosis
QGGTAG

SEQ ID NO: 1370647 - protein, 5 aa, Mycobacterium tuberculosis
QGGTI

SEQ ID NO: 1370648 - protein, 16 aa, Mycobacterium tuberculosis
QGGTINDTLDQTAQLT

SEQ ID NO: 1370649 - protein, 13 aa, Mycobacterium tuberculosis
QGRNTGPTEGPAI

SEQ ID NO: 1370650 - protein, 18 aa, Mycobacterium tuberculosis
QHAGETAFGSATNADEIN

SEQ ID NO: 1370651 - protein, 16 aa, Mycobacterium tuberculosis
QHESRQARCGEAEPSN

SEQ ID NO: 1370652 - protein, 5 aa, Mycobacterium tuberculosis
QHPNA

SEQ ID NO: 1370653 - protein, 4 aa, Mycobacterium tuberculosis
QNGA

SEQ ID NO: 1370654 - protein, 9 aa, Mycobacterium tuberculosis
QNPSRARLS

SEQ ID NO: 1370655 - protein, 5 aa, Mycobacterium tuberculosis
QPADA

SEQ ID NO: 1370656 - protein, 10 aa, Mycobacterium tuberculosis
QPDASVRSDA

SEQ ID NO: 1370657 - protein, 14 aa, Mycobacterium tuberculosis
QPPAGSFSPGGHDA

SEQ ID NO: 1370658 - protein, 5 aa, Mycobacterium tuberculosis
QPPGL

SEQ ID NO: 1370659 - protein, 14 aa, Mycobacterium tuberculosis
QPPNAHPVAQPPAQ

SEQ ID NO: 1370660 - protein, 12 aa, Mycobacterium tuberculosis
QRANLTTGATDR

SEQ ID NO: 1370661 - protein, 13 aa, Mycobacterium tuberculosis
QRNPEPSREPPRH

SEQ ID NO: 1370662 - protein, 15 aa, Mycobacterium tuberculosis
QRPQPTDPAGTPCPH

SEQ ID NO: 1370663 - protein, 9 aa, Mycobacterium tuberculosis
QRTTPVGGG

SEQ ID NO: 1370664 - protein, 10 aa, Mycobacterium tuberculosis
RAAAETQDRW

SEQ ID NO: 1370665 - protein, 22 aa, Mycobacterium tuberculosis
RAAQRGQTGTVTSTDYTGSREL

SEQ ID NO: 1370666 - protein, 16 aa, Mycobacterium tuberculosis
RAATPKECRSKDPYVP

SEQ ID NO: 1370667 - protein, 4 aa, Mycobacterium tuberculosis
RAGR

SEQ ID NO: 1370668 - protein, 12 aa, Mycobacterium tuberculosis
RAGRTDRAGGRE

SEQ ID NO: 1370669 - protein, 6 aa, Mycobacterium tuberculosis
RAGTAT

SEQ ID NO: 1370670 - protein, 7 aa, Mycobacterium tuberculosis
RAPLPGL

SEQ ID NO: 1370671 - protein, 7 aa, Mycobacterium tuberculosis
RAPRGDE

SEQ ID NO: 1370672 - protein, 5 aa, Mycobacterium tuberculosis
RDRRG

SEQ ID NO: 1370673 - protein, 9 aa, Mycobacterium tuberculosis
RDSEGISES

SEQ ID NO: 1370674 - protein, 12 aa, Mycobacterium tuberculosis
RDSEPSVAGKDP

SEQ ID NO: 1370675 - protein, 6 aa, Mycobacterium tuberculosis
RDVAER

SEQ ID NO: 1370676 - protein, 4 aa, Mycobacterium tuberculosis
RELP

SEQ ID NO: 1370677 - protein, 5 aa, Mycobacterium tuberculosis
RFDSR

SEQ ID NO: 1370678 - protein, 5 aa, Mycobacterium tuberculosis
RGLPR

SEQ ID NO: 1370679 - protein, 5 aa, Mycobacterium tuberculosis
RGRHE

SEQ ID NO: 1370680 - protein, 4 aa, Mycobacterium tuberculosis
RGRP

SEQ ID NO: 1370681 - protein, 13 aa, Mycobacterium tuberculosis
RHSQADAGAHDAV

SEQ ID NO: 1370682 - protein, 6 aa, Mycobacterium tuberculosis
RHSRTS

SEQ ID NO: 1370683 - protein, 5 aa, Mycobacterium tuberculosis
RKGFD

SEQ ID NO: 1370684 - protein, 9 aa, Mycobacterium tuberculosis
RKVPKSRRA

SEQ ID NO: 1370685 - protein, 14 aa, Mycobacterium tuberculosis
RLGPGGISGPPLAQ

SEQ ID NO: 1370686 - protein, 6 aa, Mycobacterium tuberculosis
RLPGGP

SEQ ID NO: 1370687 - protein, 6 aa, Mycobacterium tuberculosis
RNDGIA

SEQ ID NO: 1370688 - protein, 9 aa, Mycobacterium tuberculosis
RNPDLPRSE

SEQ ID NO: 1370689 - protein, 5 aa, Mycobacterium tuberculosis
RPAGR

SEQ ID NO: 1370690 - protein, 18 aa, Mycobacterium tuberculosis
RPASLDNPRSPRRRAGMP

SEQ ID NO: 1370691 - protein, 13 aa, Mycobacterium tuberculosis
RPGMSGDSSSWKG

SEQ ID NO: 1370692 - protein, 6 aa, Mycobacterium tuberculosis
RPNPGI

SEQ ID NO: 1370693 - protein, 4 aa, Mycobacterium tuberculosis
RPPI

SEQ ID NO: 1370694 - protein, 7 aa, Mycobacterium tuberculosis
RRAPGPS

SEQ ID NO: 1370695 - protein, 11 aa, Mycobacterium tuberculosis
RRGAPNGIDER

SEQ ID NO: 1370696 - protein, 4 aa, Mycobacterium tuberculosis
RRLN

SEQ ID NO: 1370697 - protein, 9 aa, Mycobacterium tuberculosis
RRQPTASPR

SEQ ID NO: 1370698 - protein, 11 aa, Mycobacterium tuberculosis
RRRSGDPVAPP

SEQ ID NO: 1370699 - protein, 12 aa, Mycobacterium tuberculosis
RRSGPITRAPRR

SEQ ID NO: 1370700 - protein, 10 aa, Mycobacterium tuberculosis
RRTPGSRGIA

SEQ ID NO: 1370701 - protein, 7 aa, Mycobacterium tuberculosis
RRVEPAR

SEQ ID NO: 1370702 - protein, 9 aa, Mycobacterium tuberculosis
RSPRPPQAV

SEQ ID NO: 1370703 - protein, 4 aa, Mycobacterium tuberculosis
RSRR

SEQ ID NO: 1370704 - protein, 28 aa, Mycobacterium tuberculosis
RSYQPSEPSGPAEPVNRYERRGARYQPY

SEQ ID NO: 1370705 - protein, 4 aa, Mycobacterium tuberculosis
RTAP

SEQ ID NO: 1370706 - protein, 10 aa, Mycobacterium tuberculosis
RTNGASYAYT

SEQ ID NO: 1370707 - protein, 14 aa, Mycobacterium tuberculosis
RTRLTRGSPSCSIS

SEQ ID NO: 1370708 - protein, 19 aa, Mycobacterium tuberculosis
RYRRSPPAESGHHSNRRQA

SEQ ID NO: 1370709 - protein, 13 aa, Mycobacterium tuberculosis
SAANAAAAGPTTQ

SEQ ID NO: 1370710 - protein, 14 aa, Mycobacterium tuberculosis
SAANRPLRRVKLGS

SEQ ID NO: 1370711 - protein, 21 aa, Mycobacterium tuberculosis
SAMRPTPALPAAARPRSSPGW

SEQ ID NO: 1370712 - protein, 5 aa, Mycobacterium tuberculosis
SAQLG

SEQ ID NO: 1370713 - protein, 6 aa, Mycobacterium tuberculosis
SASGTQ

SEQ ID NO: 1370714 - protein, 21 aa, Mycobacterium tuberculosis
SDAAAHAGTLQSAKGGGQFGG

SEQ ID NO: 1370715 - protein, 8 aa, Mycobacterium tuberculosis
SEGIKESV

SEQ ID NO: 1370716 - protein, 11 aa, Mycobacterium tuberculosis
SFQGKSRPWTQ

SEQ ID NO: 1370717 - protein, 4 aa, Mycobacterium tuberculosis
SGGV

SEQ ID NO: 1370718 - protein, 4 aa, Mycobacterium tuberculosis
SGIN

SEQ ID NO: 1370719 - protein, 7 aa, Mycobacterium tuberculosis
SGRNAQA

SEQ ID NO: 1370720 - protein, 10 aa, Mycobacterium tuberculosis
SGRTGALSRS

SEQ ID NO: 1370721 - protein, 4 aa, Mycobacterium tuberculosis
SLNR

SEQ ID NO: 1370722 - protein, 4 aa, Mycobacterium tuberculosis
SLQT

SEQ ID NO: 1370723 - protein, 15 aa, Mycobacterium tuberculosis
SNAGTNLLGSSRDNL

SEQ ID NO: 1370724 - protein, 6 aa, Mycobacterium tuberculosis
SPATRH

SEQ ID NO: 1370725 - protein, 6 aa, Mycobacterium tuberculosis
SPELTP

SEQ ID NO: 1370726 - protein, 4 aa, Mycobacterium tuberculosis
SPIR

SEQ ID NO: 1370727 - protein, 4 aa, Mycobacterium tuberculosis
SPTS

SEQ ID NO: 1370728 - protein, 38 aa, Mycobacterium tuberculosis
SRPSAPPTPGAVRSTPNACTRSSVGSRARTAREYGESE

SEQ ID NO: 1370729 - protein, 5 aa, Mycobacterium tuberculosis
SSAPR

SEQ ID NO: 1370730 - protein, 8 aa, Mycobacterium tuberculosis
SSPTTSAA

SEQ ID NO: 1370731 - protein, 8 aa, Mycobacterium tuberculosis
SSTAASPL

SEQ ID NO: 1370732 - protein, 19 aa, Mycobacterium tuberculosis
SSTTASPVTTSDIPTNATG

SEQ ID NO: 1370733 - protein, 8 aa, Mycobacterium tuberculosis
SSWQGPSA

SEQ ID NO: 1370734 - protein, 4 aa, Mycobacterium tuberculosis
STAA

SEQ ID NO: 1370735 - protein, 7 aa, Mycobacterium tuberculosis
STQDRRV

SEQ ID NO: 1370736 - protein, 18 aa, Mycobacterium tuberculosis
STRDAAIPTGIQNPCFSH

SEQ ID NO: 1370737 - protein, 10 aa, Mycobacterium tuberculosis
STVPPSSATP

SEQ ID NO: 1370738 - protein, 27 aa, Mycobacterium tuberculosis
SVGAGTPGPAGTSGTATTGPKTAPKTA

SEQ ID NO: 1370739 - protein, 16 aa, Mycobacterium tuberculosis
TAADHDRITATRETLE

SEQ ID NO: 1370740 - protein, 12 aa, Mycobacterium tuberculosis
TAGLPANADAAA

SEQ ID NO: 1370741 - protein, 11 aa, Mycobacterium tuberculosis
TAGSDLSERLP

SEQ ID NO: 1370742 - protein, 7 aa, Mycobacterium tuberculosis
TAIRAGG

SEQ ID NO: 1370743 - protein, 8 aa, Mycobacterium tuberculosis
TAPSTGKS

SEQ ID NO: 1370744 - protein, 9 aa, Mycobacterium tuberculosis
TAPSTGKSL

SEQ ID NO: 1370745 - protein, 7 aa, Mycobacterium tuberculosis
TAQGTLS

SEQ ID NO: 1370746 - protein, 4 aa, Mycobacterium tuberculosis
TATA

SEQ ID NO: 1370747 - protein, 9 aa, Mycobacterium tuberculosis
TATASQRYH

SEQ ID NO: 1370748 - protein, 5 aa, Mycobacterium tuberculosis
TATAT

SEQ ID NO: 1370749 - protein, 21 aa, Mycobacterium tuberculosis
TATPEAFNKGQLDGPGPSAGP

SEQ ID NO: 1370750 - protein, 9 aa, Mycobacterium tuberculosis
TATRQAYGL

SEQ ID NO: 1370751 - protein, 31 aa, Mycobacterium tuberculosis
TDRAGGPCSPPATGAKLTSSVASRPTVGTKP

SEQ ID NO: 1370752 - protein, 5 aa, Mycobacterium tuberculosis
TDRAH

SEQ ID NO: 1370753 - protein, 9 aa, Mycobacterium tuberculosis
TDRKLTPAW

SEQ ID NO: 1370754 - protein, 8 aa, Mycobacterium tuberculosis
TFSSRERY

SEQ ID NO: 1370755 - protein, 13 aa, Mycobacterium tuberculosis
TGALSQSSNISPL

SEQ ID NO: 1370756 - protein, 13 aa, Mycobacterium tuberculosis
TGDGTNDAPALAQ

SEQ ID NO: 1370757 - protein, 5 aa, Mycobacterium tuberculosis
TGDMT

SEQ ID NO: 1370758 - protein, 15 aa, Mycobacterium tuberculosis
TGEAKPTRVRPGGQV

SEQ ID NO: 1370759 - protein, 4 aa, Mycobacterium tuberculosis
TGII

SEQ ID NO: 1370760 - protein, 22 aa, Mycobacterium tuberculosis
TGQRPGRRDLGKQHAGHRHGGR

SEQ ID NO: 1370761 - protein, 10 aa, Mycobacterium tuberculosis
TGSTPGAFDS

SEQ ID NO: 1370762 - protein, 4 aa, Mycobacterium tuberculosis
TGWG

SEQ ID NO: 1370763 - protein, 6 aa, Mycobacterium tuberculosis
TKAAIT

SEQ ID NO: 1370764 - protein, 12 aa, Mycobacterium tuberculosis
TMGPRGDRNRRE

SEQ ID NO: 1370765 - protein, 4 aa, Mycobacterium tuberculosis
TNFS

SEQ ID NO: 1370766 - protein, 9 aa, Mycobacterium tuberculosis
TNGSETGRR

SEQ ID NO: 1370767 - protein, 45 aa, Mycobacterium tuberculosis
TPAPTTPASAPPATTQPPATTQPPATTQPPATTSPSPPPIPPIPP

SEQ ID NO: 1370768 - protein, 7 aa, Mycobacterium tuberculosis
TPDDTGR

SEQ ID NO: 1370769 - protein, 38 aa, Mycobacterium tuberculosis; identical to SEQ ID NO: 155877

SEQ ID NO: 1370770 - protein, 4 aa, Mycobacterium tuberculosis
TQAN

SEQ ID NO: 1370771 - protein, 5 aa, Mycobacterium tuberculosis
TRAQW

SEQ ID NO: 1370772 - protein, 7 aa, Mycobacterium tuberculosis
TRGVDDR

SEQ ID NO: 1370773 - protein, 7 aa, Mycobacterium tuberculosis
TRHHRNP

SEQ ID NO: 1370774 - protein, 6 aa, Mycobacterium tuberculosis
TSADKW

SEQ ID NO: 1370775 - protein, 9 aa, Mycobacterium tuberculosis
TSGSTRTPA

SEQ ID NO: 1370776 - protein, 9 aa, Mycobacterium tuberculosis
TVPPSSATP

SEQ ID NO: 1370777 - protein, 18 aa, Mycobacterium tuberculosis
VADGAENADTRGSGGRTA

SEQ ID NO: 1370778 - protein, 23 aa, Mycobacterium tuberculosis
VASAASAVGPVGPGEPNQPDDVA

SEQ ID NO: 1370779 - protein, 24 aa, Mycobacterium tuberculosis
VASAASAVGPVGPGEPNQPDDVAE

SEQ ID NO: 1370780 - protein, 9 aa, Mycobacterium tuberculosis
VDTRGDGKC

SEQ ID NO: 1370781 - protein, 13 aa, Mycobacterium tuberculosis
VGGAGKGPGRDEL

SEQ ID NO: 1370782 - protein, 4 aa, Mycobacterium tuberculosis
VGGV

SEQ ID NO: 1370783 - protein, 4 aa, Mycobacterium tuberculosis
VGQL

SEQ ID NO: 1370784 - protein, 12 aa, Mycobacterium tuberculosis
VGTGGAGSGSAL

SEQ ID NO: 1370785 - protein, 12 aa, Mycobacterium tuberculosis
VNPADGSPGPGT

SEQ ID NO: 1370786 - protein, 19 aa, Mycobacterium tuberculosis
VNPGSRPSTWRPNRPSSPL

SEQ ID NO: 1370787 - protein, 5 aa, Mycobacterium tuberculosis
VNRAD

SEQ ID NO: 1370788 - protein, 11 aa, Mycobacterium tuberculosis
VPAQPMRQRRR

SEQ ID NO: 1370789 - protein, 5 aa, Mycobacterium tuberculosis
VPDGH

SEQ ID NO: 1370790 - protein, 7 aa, Mycobacterium tuberculosis
VPDSSGL

SEQ ID NO: 1370791 - protein, 6 aa, Mycobacterium tuberculosis
VPEPPS

SEQ ID NO: 1370792 - protein, 26 aa, Mycobacterium tuberculosis
VPGPNPQDGAKDGAKATAVPREPDEA

SEQ ID NO: 1370793 - protein, 24 aa, Mycobacterium tuberculosis
VPPPPGDPVPPVDTHAGGRPADQL

SEQ ID NO: 1370794 - protein, 9 aa, Mycobacterium tuberculosis
VRAAGRTPL

SEQ ID NO: 1370795 - protein, 15 aa, Mycobacterium tuberculosis
VRRSSAIRNTSTPGD

SEQ ID NO: 1370796 - protein, 12 aa, Mycobacterium tuberculosis
VSSSSADATAMP

SEQ ID NO: 1370797 - protein, 44 aa, Mycobacterium tuberculosis
VTDGTAMPDTNVAPAYRSSVSASVSASAATSSIRESQRQQSLTT

SEQ ID NO: 1370798 - protein, 22 aa, Mycobacterium tuberculosis
VTGAAKGIQKGLSSGSKSTAAA

SEQ ID NO: 1370799 - protein, 13 aa, Mycobacterium tuberculosis
VTPPPGIASPPTV

SEQ ID NO: 1370800 - protein, 13 aa, Mycobacterium tuberculosis
VVGTGGAGSGSAL

SEQ ID NO: 1370801 - protein, 23 aa, Mycobacterium tuberculosis
WPRGAGAAVGDAEHLPGEEGYGS

SEQ ID NO: 1370802 - protein, 12 aa, Mycobacterium tuberculosis
YAAWGGADGRTL

SEQ ID NO: 1370803 - protein, 13 aa, Mycobacterium tuberculosis
YEPPPALSSWTNR

SEQ ID NO: 1370804 - protein, 20 aa, Mycobacterium tuberculosis
YGGNPGRPSEQGLAADARAA

SEQ ID NO: 1370805 - protein, 21 aa, Mycobacterium tuberculosis
YGGNPGRPSEQGLAADARAAQ

SEQ ID NO: 1370806 - protein, 15 aa, Mycobacterium tuberculosis
AAAAESRRLDHAPNA

SEQ ID NO: 1370807 - protein, 19 aa, Mycobacterium tuberculosis
AAAARAAAVAGGAAGDACS

SEQ ID NO: 1370808 - protein, 15 aa, Mycobacterium tuberculosis
AAAARASAATHRRKP

SEQ ID NO: 1370809 - protein, 6 aa, Mycobacterium tuberculosis
AAAATD

SEQ ID NO: 1370810 - protein, 10 aa, Mycobacterium tuberculosis
AAAATSAPRL

SEQ ID NO: 1370811 - protein, 5 aa, Mycobacterium tuberculosis
AAAAY

SEQ ID NO: 1370812 - protein, 12 aa, Mycobacterium tuberculosis
AAADGDPATAWA

SEQ ID NO: 1370813 - protein, 19 aa, Mycobacterium tuberculosis
AAAERERSKLGRRRTPRRR

SEQ ID NO: 1370814 - protein, 7 aa, Mycobacterium tuberculosis
AAAGTST

SEQ ID NO: 1370815 - protein, 7 aa, Mycobacterium tuberculosis
AAAIPDA

SEQ ID NO: 1370816 - protein, 7 aa, Mycobacterium tuberculosis
AAAPAPA

SEQ ID NO: 1370817 - protein, 27 aa, Mycobacterium tuberculosis
AAAPDRSQLGTGPQPVPMTAFRPADLP

SEQ ID NO: 1370818 - protein, 12 aa, Mycobacterium tuberculosis
AAAPLSEAMRVA

SEQ ID NO: 1370819 - protein, 8 aa, Mycobacterium tuberculosis
AAAPSPVA

SEQ ID NO: 1370820 - protein, 6 aa, Mycobacterium tuberculosis
AAAQLD

SEQ ID NO: 1370821 - protein, 31 aa, Mycobacterium tuberculosis
AAAQPGARDQRRTRGGDGDPRTRGKAGAHRH

SEQ ID NO: 1370822 - protein, 6 aa, Mycobacterium tuberculosis
AAARGL

SEQ ID NO: 1370823 - protein, 6 aa, Mycobacterium tuberculosis
AAARPD

SEQ ID NO: 1370824 - protein, 10 aa, Mycobacterium tuberculosis
AAASANDRAG

SEQ ID NO: 1370825 - protein, 7 aa, Mycobacterium tuberculosis
AAATNSL

SEQ ID NO: 1370826 - protein, 8 aa, Mycobacterium tuberculosis
AAATSAPR

SEQ ID NO: 1370827 - protein, 11 aa, Mycobacterium tuberculosis
AAAVGKGRRAG

SEQ ID NO: 1370828 - protein, 9 aa, Mycobacterium tuberculosis
AADEKESEL

SEQ ID NO: 1370829 - protein, 10 aa, Mycobacterium tuberculosis
AADGSTRRPD

SEQ ID NO: 1370830 - protein, 10 aa, Mycobacterium tuberculosis
AADGTGFSEG

SEQ ID NO: 1370831 - protein, 18 aa, Mycobacterium tuberculosis
AADPGEVRGGRTPHGRGL

SEQ ID NO: 1370832 - protein, 6 aa, Mycobacterium tuberculosis
AADPGM

SEQ ID NO: 1370833 - protein, 10 aa, Mycobacterium tuberculosis
AADPTDTQPH

SEQ ID NO: 1370834 - protein, 10 aa, Mycobacterium tuberculosis
AAEARGQQVD

SEQ ID NO: 1370835 - protein, 75 aa, Mycobacterium tuberculosis
AAEEPQPALSAEPQLPGQPAAPPPAQSGAPASPQPGAQPRPYPQDPAPSPNPTSPASPPPAPPAEAPATDPRKDL

SEQ ID NO: 1370836 - protein, 7 aa, Mycobacterium tuberculosis
AAERDPE

SEQ ID NO: 1370837 - protein, 9 aa, Mycobacterium tuberculosis
AAESGVPGT

SEQ ID NO: 1370838 - protein, 19 aa, Mycobacterium tuberculosis
AAGAGPRNRPPQPGSAGPC

SEQ ID NO: 1370839 - protein, 7 aa, Mycobacterium tuberculosis
AAGATAA

SEQ ID NO: 1370840 - protein, 12 aa, Mycobacterium tuberculosis
AAGATAARPATT

SEQ ID NO: 1370841 - protein, 14 aa, Mycobacterium tuberculosis
AAGDYTTAAEDKPA

SEQ ID NO: 1370842 - protein, 5 aa, Mycobacterium tuberculosis
AAGEE

SEQ ID NO: 1370843 - protein, 9 aa, Mycobacterium tuberculosis
AAGEHEAAA

SEQ ID NO: 1370844 - protein, 12 aa, Mycobacterium tuberculosis
AAGGAGPGRGRP

SEQ ID NO: 1370845 - protein, 15 aa, Mycobacterium tuberculosis
AAGGALAALASRRQS

SEQ ID NO: 1370846 - protein, 25 aa, Mycobacterium tuberculosis
AAGGGGATGVAGAGGAAAVDGGEAA

SEQ ID NO: 1370847 - protein, 10 aa, Mycobacterium tuberculosis
AAGGHPDDRA

SEQ ID NO: 1370848 - protein, 15 aa, Mycobacterium tuberculosis
AAGGRRCGNQLLAVA

SEQ ID NO: 1370849 - protein, 13 aa, Mycobacterium tuberculosis
AAGGTRGRDGAQG

SEQ ID NO: 1370850 - protein, 18 aa, Mycobacterium tuberculosis
AAGLRRRAAPGHRHRGHP

SEQ ID NO: 1370851 - protein, 7 aa, Mycobacterium tuberculosis
AAGPAHP

SEQ ID NO: 1370852 - protein, 17 aa, Mycobacterium tuberculosis
AAGPATTPSRSRRPRPP

SEQ ID NO: 1370853 - protein, 6 aa, Mycobacterium tuberculosis
AAGPRH

SEQ ID NO: 1370854 - protein, 16 aa, Mycobacterium tuberculosis
AAGPRRARSGAGTGLA

SEQ ID NO: 1370855 - protein, 25 aa, Mycobacterium tuberculosis
AAGPSRGGARRSVSRDELPKSAWPL

SEQ ID NO: 1370856 - protein, 4 aa, Mycobacterium tuberculosis
AAGR

SEQ ID NO: 1370857 - protein, 7 aa, Mycobacterium tuberculosis
AAGRDAC

SEQ ID NO: 1370858 - protein, 24 aa, Mycobacterium tuberculosis
AAGRHHRASADRKRGASAGRGGVG

SEQ ID NO: 1370859 - protein, 18 aa, Mycobacterium tuberculosis
AAGRSARRSWRQTRSPTP

SEQ ID NO: 1370860 - protein, 4 aa, Mycobacterium tuberculosis
AAGS

SEQ ID NO: 1370861 - protein, 12 aa, Mycobacterium tuberculosis
AAGVQSNDGKAA

SEQ ID NO: 1370862 - protein, 8 aa, Mycobacterium tuberculosis
AAHAGQQH

SEQ ID NO: 1370863 - protein, 11 aa, Mycobacterium tuberculosis
AAINPGNSGGA

SEQ ID NO: 1370864 - protein, 6 aa, Mycobacterium tuberculosis
AAIPDA

SEQ ID NO: 1370865 - protein, 12 aa, Mycobacterium tuberculosis
AAKYGATTESSL

SEQ ID NO: 1370866 - protein, 22 aa, Mycobacterium tuberculosis
AALASAAPAGPAARAATAAPAG

SEQ ID NO: 1370867 - protein, 15 aa, Mycobacterium tuberculosis
AALGRGSAVPVAGVG

SEQ ID NO: 1370868 - protein, 11 aa, Mycobacterium tuberculosis
AALPGPVGSPQ

SEQ ID NO: 1370869 - protein, 6 aa, Mycobacterium tuberculosis
AALRPE

SEQ ID NO: 1370870 - protein, 4 aa, Mycobacterium tuberculosis
AALS

SEQ ID NO: 1370871 - protein, 10 aa, Mycobacterium tuberculosis
AANPSTGAFA

SEQ ID NO: 1370872 - protein, 6 aa, Mycobacterium tuberculosis
AANTKK

SEQ ID NO: 1370873 - protein, 10 aa, Mycobacterium tuberculosis
AAPAAGLGRR

SEQ ID NO: 1370874 - protein, 21 aa, Mycobacterium tuberculosis
AAPALGGTGMTETVTRTAAPA

SEQ ID NO: 1370875 - protein, 5 aa, Mycobacterium tuberculosis
AAPGC

SEQ ID NO: 1370876 - protein, 15 aa, Mycobacterium tuberculosis
AAPKVADAVGGNGYS

SEQ ID NO: 1370877 - protein, 8 aa, Mycobacterium tuberculosis
AAPLPTAP

SEQ ID NO: 1370878 - protein, 13 aa, Mycobacterium tuberculosis
AAPPRFADDNGSA

SEQ ID NO: 1370879 - protein, 25 aa, Mycobacterium tuberculosis
AAPSSLPTRTRSASSRSSSTAEPRL

SEQ ID NO: 1370880 - protein, 5 aa, Mycobacterium tuberculosis
AAPYA

SEQ ID NO: 1370881 - protein, 4 aa, Mycobacterium tuberculosis
AAQE

SEQ ID NO: 1370882 - protein, 19 aa, Mycobacterium tuberculosis
AAQPPRRSQRDPRCRQTQR

SEQ ID NO: 1370883 - protein, 11 aa, Mycobacterium tuberculosis
AAQSAGAAGQA

SEQ ID NO: 1370884 - protein, 6 aa, Mycobacterium tuberculosis
AAQTGG

SEQ ID NO: 1370885 - protein, 11 aa, Mycobacterium tuberculosis
AARAEQAGMQA

SEQ ID NO: 1370886 - protein, 9 aa, Mycobacterium tuberculosis
AARARARAA

SEQ ID NO: 1370887 - protein, 60 aa, Mycobacterium tuberculosis
AARCDQPVKPGQVIPAPSVNNGISPLPADQLPGTPPPVNDPLQRPGSGTVQCNGQQPNPC

SEQ ID NO: 1370888 - protein, 42 aa, Mycobacterium tuberculosis
AARGAPRRPRLQPPRPEPAEPARLPPGTPPSRRPAVPRGGRR

SEQ ID NO: 1370889 - protein, 9 aa, Mycobacterium tuberculosis
AARGAPRYR

SEQ ID NO: 1370890 - protein, 12 aa, Mycobacterium tuberculosis
AARHRPGRRPLP

SEQ ID NO: 1370891 - protein, 16 aa, Mycobacterium tuberculosis
AARPTSTRRPIWVIWW

SEQ ID NO: 1370892 - protein, 16 aa, Mycobacterium tuberculosis
AARPTWPPAPEPGCRR

SEQ ID NO: 1370893 - protein, 20 aa, Mycobacterium tuberculosis
AARSSRMPTSCPSTGPTDMR

SEQ ID NO: 1370894 - protein, 23 aa, Mycobacterium tuberculosis
AASAAAVGGTTFGDRHPAHGRNC

SEQ ID NO: 1370895 - protein, 12 aa, Mycobacterium tuberculosis
AASAEQAAAQAV

SEQ ID NO: 1370896 - protein, 10 aa, Mycobacterium tuberculosis
AASDVQAVPG

SEQ ID NO: 1370897 - protein, 5 aa, Mycobacterium tuberculosis
AASGM

SEQ ID NO: 1370898 - protein, 11 aa, Mycobacterium tuberculosis
AASKGGRPCAP

SEQ ID NO: 1370899 - protein, 4 aa, Mycobacterium tuberculosis
AASL

SEQ ID NO: 1370900 - protein, 10 aa, Mycobacterium tuberculosis
AASPQDIQDA

SEQ ID NO: 1370901 - protein, 8 aa, Mycobacterium tuberculosis
AASRAQRV

SEQ ID NO: 1370902 - protein, 15 aa, Mycobacterium tuberculosis
AASRTREARHASQEA

SEQ ID NO: 1370903 - protein, 18 aa, Mycobacterium tuberculosis
AATAARGGKTRARRSRGR

SEQ ID NO: 1370904 - protein, 7 aa, Mycobacterium tuberculosis
AATGGRG

SEQ ID NO: 1370905 - protein, 14 aa, Mycobacterium tuberculosis
AATKTAPIRSARQV

SEQ ID NO: 1370906 - protein, 8 aa, Mycobacterium tuberculosis
AATRERRG

SEQ ID NO: 1370907 - protein, 8 aa, Mycobacterium tuberculosis
AATSTFSR

SEQ ID NO: 1370908 - protein, 51 aa, Mycobacterium tuberculosis
AATTSAVANAAARRGDASDGWPSGVAPSNRRPEDMTDSLRSTPMTARPPES

SEQ ID NO: 1370909 - protein, 6 aa, Mycobacterium tuberculosis
AAVAAS

SEQ ID NO: 1370910 - protein, 18 aa, Mycobacterium tuberculosis
AAVAASADNDEYATGGDH

SEQ ID NO: 1370911 - protein, 19 aa, Mycobacterium tuberculosis
AAVGGTGPVSAGLGNAATI

SEQ ID NO: 1370912 - protein, 19 aa, Mycobacterium tuberculosis
AAVGGTTFGDRHPAHGRNC

SEQ ID NO: 1370913 - protein, 10 aa, Mycobacterium tuberculosis
AAVSAAGSAV

SEQ ID NO: 1370914 - protein, 10 aa, Mycobacterium tuberculosis
AAVYGSGLPS

SEQ ID NO: 1370915 - protein, 5 aa, Mycobacterium tuberculosis
ACASA

SEQ ID NO: 1370916 - protein, 16 aa, Mycobacterium tuberculosis
ACKSSPGDGGKGRKLV

SEQ ID NO: 1370917 - protein, 28 aa, Mycobacterium tuberculosis
ACRGGPQTHGWAPTPSPGAGPKGKKFWV

SEQ ID NO: 1370918 - protein, 29 aa, Mycobacterium tuberculosis
ACTAGPARAEDRAAGAARAAVAAGSTAES

SEQ ID NO: 1370919 - protein, 10 aa, Mycobacterium tuberculosis
ADARAGGPAV

SEQ ID NO: 1370920 - protein, 5 aa, Mycobacterium tuberculosis
ADAWG

SEQ ID NO: 1370921 - protein, 10 aa, Mycobacterium tuberculosis
ADDAADGDRD

SEQ ID NO: 1370922 - protein, 7 aa, Mycobacterium tuberculosis
ADDLGSR

SEQ ID NO: 1370923 - protein, 5 aa, Mycobacterium tuberculosis
ADDRL

SEQ ID NO: 1370924 - protein, 4 aa, Mycobacterium tuberculosis
ADDS

SEQ ID NO: 1370925 - protein, 9 aa, Mycobacterium tuberculosis
ADEQARAAK

SEQ ID NO: 1370926 - protein, 8 aa, Mycobacterium tuberculosis
ADESSSAL

SEQ ID NO: 1370927 - protein, 7 aa, Mycobacterium tuberculosis
ADETGGP

SEQ ID NO: 1370928 - protein, 4 aa, Mycobacterium tuberculosis
ADEV

SEQ ID NO: 1370929 - protein, 6 aa, Mycobacterium tuberculosis
ADGGSV

SEQ ID NO: 1370930 - protein, 14 aa, Mycobacterium tuberculosis
ADGPAVRAGQRHRN

SEQ ID NO: 1370931 - protein, 21 aa, Mycobacterium tuberculosis
ADGRGDRRGAAGSPGPAVASA

SEQ ID NO: 1370932 - protein, 5 aa, Mycobacterium tuberculosis
ADLTG

SEQ ID NO: 1370933 - protein, 6 aa, Mycobacterium tuberculosis
ADLTGI

SEQ ID NO: 1370934 - protein, 10 aa, Mycobacterium tuberculosis
ADLVTGRRRP

SEQ ID NO: 1370935 - protein, 8 aa, Mycobacterium tuberculosis
ADNTDIDG

SEQ ID NO: 1370936 - protein, 23 aa, Mycobacterium tuberculosis
ADPNIARSRPPDLPPGTHDAQTD

SEQ ID NO: 1370937 - protein, 6 aa, Mycobacterium tuberculosis
ADPTSD

SEQ ID NO: 1370938 - protein, 5 aa, Mycobacterium tuberculosis
ADPYP

SEQ ID NO: 1370939 - protein, 9 aa, Mycobacterium tuberculosis
ADQDPVAGS

SEQ ID NO: 1370940 - protein, 13 aa, Mycobacterium tuberculosis
ADQLQTWAARVGA

SEQ ID NO: 1370941 - protein, 90 aa, Mycobacterium tuberculosis
ADQPGRPTRPTRPTCGGARGAPRAASTAGAAGAAEHAGAAADPTLPAGGEAEPAGAATPAGAEEYAGVTAGSAGAALTTTEDSAASPTGA

SEQ ID NO: 1370942 - protein, 4 aa, Mycobacterium tuberculosis
ADRA

SEQ ID NO: 1370943 - protein, 15 aa, Mycobacterium tuberculosis
ADRRRTAAISAPQGL

SEQ ID NO: 1370944 - protein, 12 aa, Mycobacterium tuberculosis
ADRSTAAPARSS

SEQ ID NO: 1370945 - protein, 6 aa, Mycobacterium tuberculosis
ADSLPS

SEQ ID NO: 1370946 - protein, 5 aa, Mycobacterium tuberculosis
ADTDN

SEQ ID NO: 1370947 - protein, 5 aa, Mycobacterium tuberculosis
ADTGI

SEQ ID NO: 1370948 - protein, 20 aa, Mycobacterium tuberculosis
ADTPSPESGSRRGWPRSPRC

SEQ ID NO: 1370949 - protein, 8 aa, Mycobacterium tuberculosis
ADTRGVGV

SEQ ID NO: 1370950 - protein, 11 aa, Mycobacterium tuberculosis
ADTRKREPAER

SEQ ID NO: 1370951 - protein, 10 aa, Mycobacterium tuberculosis
ADVNGSGSPL

SEQ ID NO: 1370952 - protein, 11 aa, Mycobacterium tuberculosis
AEAAEAAGAAL

SEQ ID NO: 1370953 - protein, 37 aa, Mycobacterium tuberculosis
AEAEPATRPTGASVRGGRSIGPGHPAKRAVAESAPVQ

SEQ ID NO: 1370954 - protein, 15 aa, Mycobacterium tuberculosis
AEAQDELAESAAPCR

SEQ ID NO: 1370955 - protein, 13 aa, Mycobacterium tuberculosis
AEAQDELAEVSST

SEQ ID NO: 1370956 - protein, 16 aa, Mycobacterium tuberculosis
AEAQDELAEVSSTVAG

SEQ ID NO: 1370957 - protein, 24 aa, Mycobacterium tuberculosis
AEAQDELAEVSSTVQAVTDGSAGR

SEQ ID NO: 1370958 - protein, 24 aa, Mycobacterium tuberculosis
AEAQDELAEVSSTVQAVTDGSRRQ

SEQ ID NO: 1370959 - protein, 12 aa, Mycobacterium tuberculosis
AEAVQRARDSVD

SEQ ID NO: 1370960 - protein, 10 aa, Mycobacterium tuberculosis
AEEAGTAKPK

SEQ ID NO: 1370961 - protein, 25 aa, Mycobacterium tuberculosis
AEGDAPVPITPAGRPRSGQRSYPDR

SEQ ID NO: 1370962 - protein, 12 aa, Mycobacterium tuberculosis
AEHPGRRRRPAG

SEQ ID NO: 1370963 - protein, 6 aa, Mycobacterium tuberculosis
AEHPRP

SEQ ID NO: 1370964 - protein, 4 aa, Mycobacterium tuberculosis
AENP

SEQ ID NO: 1370965 - protein, 24 aa, Mycobacterium tuberculosis
AEPPALEPRRQPAERSAPRGFADH

SEQ ID NO: 1370966 - protein, 22 aa, Mycobacterium tuberculosis
AEPTESGAVSEGVAAQGNWADR

SEQ ID NO: 1370967 - protein, 44 aa, Mycobacterium tuberculosis
AEQQPALTARTPDTADTPGAGGVGASPAGAAVASATKKGQRAGG

SEQ ID NO: 1370968 - protein, 9 aa, Mycobacterium tuberculosis
AEQRQAGRT

SEQ ID NO: 1370969 - protein, 8 aa, Mycobacterium tuberculosis
AERARTIS

SEQ ID NO: 1370970 - protein, 29 aa, Mycobacterium tuberculosis
AESPPSAVPPGVLPPGPTPAHPHKPRPGL

SEQ ID NO: 1370971 - protein, 9 aa, Mycobacterium tuberculosis
AETPGNQCA

SEQ ID NO: 1370972 - protein, 15 aa, Mycobacterium tuberculosis
AEVQGGQRDHRATNR

SEQ ID NO: 1370973 - protein, 17 aa, Mycobacterium tuberculosis
AEWSPPGPPRSASASWP

SEQ ID NO: 1370974 - protein, 5 aa, Mycobacterium tuberculosis
AFDSS

SEQ ID NO: 1370975 - protein, 32 aa, Mycobacterium tuberculosis
AFPPPAGPPPVTAAPASPVEVPPPMPPPPPVT

SEQ ID NO: 1370976 - protein, 8 aa, Mycobacterium tuberculosis
AGAAGLGG

SEQ ID NO: 1370977 - protein, 9 aa, Mycobacterium tuberculosis
AGAAGTAAA

SEQ ID NO: 1370978 - protein, 8 aa, Mycobacterium tuberculosis
AGAAGTTV

SEQ ID NO: 1370979 - protein, 105 aa, Mycobacterium tuberculosis
AGAASGNACGESAAATPAEPSRADEQAGVPAGPADAAGGGGGPADTTGTAGTDQEGGSAGATGPAGTRRSDAAGPAGATGAKQDPACPTGAARAAVGAGRTGPAV

SEQ ID NO: 1370980 - protein, 8 aa, Mycobacterium tuberculosis
AGAELPDT

SEQ ID NO: 1370981 - protein, 9 aa, Mycobacterium tuberculosis
AGAGPRNRR

SEQ ID NO: 1370982 - protein, 15 aa, Mycobacterium tuberculosis
AGAGSYASAEAANVQ

SEQ ID NO: 1370983 - protein, 16 aa, Mycobacterium tuberculosis
AGAGTGLRDTPHTGRR

SEQ ID NO: 1370984 - protein, 6 aa, Mycobacterium tuberculosis
AGARPV

SEQ ID NO: 1370985 - protein, 35 aa, Mycobacterium tuberculosis; identical to SEQ ID NO: 168140

SEQ ID NO: 1370986 - protein, 9 aa, Mycobacterium tuberculosis
AGCPSPVSS

SEQ ID NO: 1370987 - protein, 9 aa, Mycobacterium tuberculosis
AGDGPSRRF

SEQ ID NO: 1370988 - protein, 32 aa, Mycobacterium tuberculosis
AGDRDRPGAGEPPDLDRAARRPGTHPQIGAAP

SEQ ID NO: 1370989 - protein, 20 aa, Mycobacterium tuberculosis
AGDRLPDDLPRKRAHRPADS

SEQ ID NO: 1370990 - protein, 5 aa, Mycobacterium tuberculosis
AGEEF

SEQ ID NO: 1370991 - protein, 6 aa, Mycobacterium tuberculosis
AGEPVR

SEQ ID NO: 1370992 - protein, 19 aa, Mycobacterium tuberculosis
AGFNPGAAGDNSAASGSHT

SEQ ID NO: 1370993 - protein, 9 aa, Mycobacterium tuberculosis
AGGAQRGSA

SEQ ID NO: 1370994 - protein, 12 aa, Mycobacterium tuberculosis
AGGGAPVGNPAD

SEQ ID NO: 1370995 - protein, 8 aa, Mycobacterium tuberculosis
AGGPQRHA

SEQ ID NO: 1370996 - protein, 4 aa, Mycobacterium tuberculosis
AGGR

SEQ ID NO: 1370997 - protein, 5 aa, Mycobacterium tuberculosis
AGGRL

SEQ ID NO: 1370998 - protein, 9 aa, Mycobacterium tuberculosis
AGGRSNRTS

SEQ ID NO: 1370999 - protein, 6 aa, Mycobacterium tuberculosis
AGHPVD

SEQ ID NO: 1371000 - protein, 4 aa, Mycobacterium tuberculosis
AGIP

SEQ ID NO: 1371001 - protein, 5 aa, Mycobacterium tuberculosis
AGIRP

SEQ ID NO: 1371002 - protein, 6 aa, Mycobacterium tuberculosis
AGKGVD

SEQ ID NO: 1371003 - protein, 7 aa, Mycobacterium tuberculosis
AGKQAPN

SEQ ID NO: 1371004 - protein, 4 aa, Mycobacterium tuberculosis
AGLP

SEQ ID NO: 1371005 - protein, 5 aa, Mycobacterium tuberculosis
AGLPG

SEQ ID NO: 1371006 - protein, 20 aa, Mycobacterium tuberculosis
AGLPSRRTAGDQDHRADPKV

SEQ ID NO: 1371007 - protein, 13 aa, Mycobacterium tuberculosis
AGMRPPTGTLAQP

SEQ ID NO: 1371008 - protein, 8 aa, Mycobacterium tuberculosis
AGNGGVAT

SEQ ID NO: 1371009 - protein, 28 aa, Mycobacterium tuberculosis
AGPKGTDGQPSKQAISDSAVSETWGGQI

SEQ ID NO: 1371010 - protein, 9 aa, Mycobacterium tuberculosis
AGPPATPPV

SEQ ID NO: 1371011 - protein, 11 aa, Mycobacterium tuberculosis
AGPSEQQAGST

SEQ ID NO: 1371012 - protein, 5 aa, Mycobacterium tuberculosis
AGPTV

SEQ ID NO: 1371013 - protein, 9 aa, Mycobacterium tuberculosis
AGPWSGPAS

SEQ ID NO: 1371014 - protein, 8 aa, Mycobacterium tuberculosis
AGQAWQGP

SEQ ID NO: 1371015 - protein, 6 aa, Mycobacterium tuberculosis
AGRDGR

SEQ ID NO: 1371016 - protein, 29 aa, Mycobacterium tuberculosis
AGRGNLDRRGRGRRGRGADRRPDAGQIGR

SEQ ID NO: 1371017 - protein, 13 aa, Mycobacterium tuberculosis
AGRGNSRRSAHRR

SEQ ID NO: 1371018 - protein, 5 aa, Mycobacterium tuberculosis
AGRGR

SEQ ID NO: 1371019 - protein, 4 aa, Mycobacterium tuberculosis
AGRP

SEQ ID NO: 1371020 - protein, 10 aa, Mycobacterium tuberculosis
AGRRDVPQVP

SEQ ID NO: 1371021 - protein, 9 aa, Mycobacterium tuberculosis
AGRRGQRAD

SEQ ID NO: 1371022 - protein, 9 aa, Mycobacterium tuberculosis
AGRRQDSVA

SEQ ID NO: 1371023 - protein, 6 aa, Mycobacterium tuberculosis
AGRSIR

SEQ ID NO: 1371024 - protein, 11 aa, Mycobacterium tuberculosis
AGRSSAIPPRA

SEQ ID NO: 1371025 - protein, 29 aa, Mycobacterium tuberculosis
AGRSVQSPASTPPPTPTPPSALSAGQTRA

SEQ ID NO: 1371026 - protein, 10 aa, Mycobacterium tuberculosis
AGRTVPAQRS

SEQ ID NO: 1371027 - protein, 5 aa, Mycobacterium tuberculosis
AGRWH

SEQ ID NO: 1371028 - protein, 20 aa, Mycobacterium tuberculosis
AGSAPGDRGTARNKRGPWPA

SEQ ID NO: 1371029 - protein, 6 aa, Mycobacterium tuberculosis
AGSGLP

SEQ ID NO: 1371030 - protein, 14 aa, Mycobacterium tuberculosis
AGSGTGTGGAGPRY

SEQ ID NO: 1371031 - protein, 16 aa, Mycobacterium tuberculosis
AGSPGQPEPGSTGDLN

SEQ ID NO: 1371032 - protein, 12 aa, Mycobacterium tuberculosis
AGSPRPPPRSPP

SEQ ID NO: 1371033 - protein, 44 aa, Mycobacterium tuberculosis
AGSVATDSATLGSWRTNGTGRRRTRRAGRAGRRLSGHRATAGVR

SEQ ID NO: 1371034 - protein, 6 aa, Mycobacterium tuberculosis
AGTGDA

SEQ ID NO: 1371035 - protein, 8 aa, Mycobacterium tuberculosis
AGTPDDFD

SEQ ID NO: 1371036 - protein, 6 aa, Mycobacterium tuberculosis
AGTPSV

SEQ ID NO: 1371037 - protein, 9 aa, Mycobacterium tuberculosis
AGTRSAAGV

SEQ ID NO: 1371038 - protein, 20 aa, Mycobacterium tuberculosis
AGTRSAGTRRADGARRPIRR

SEQ ID NO: 1371039 - protein, 13 aa, Mycobacterium tuberculosis
AGTTSAQRTQGGG

SEQ ID NO: 1371040 - protein, 31 aa, Mycobacterium tuberculosis
AGVGDRAAGGGRRRATAQRRPGTGGADGTTR

SEQ ID NO: 1371041 - protein, 23 aa, Mycobacterium tuberculosis
AGVPPPGGGWGRPASPAPEAAGR

SEQ ID NO: 1371042 - protein, 17 aa, Mycobacterium tuberculosis
AGVPPPPPPPEVPPSET

SEQ ID NO: 1371043 - protein, 19 aa, Mycobacterium tuberculosis
AGVPPPPPPPPSEVPPSET

SEQ ID NO: 1371044 - protein, 6 aa, Mycobacterium tuberculosis
AHDDGS

SEQ ID NO: 1371045 - protein, 10 aa, Mycobacterium tuberculosis
AHGGPGGRPG

SEQ ID NO: 1371046 - protein, 6 aa, Mycobacterium tuberculosis
AHGGQA

SEQ ID NO: 1371047 - protein, 12 aa, Mycobacterium tuberculosis
AHKRTGAPISTH

SEQ ID NO: 1371048 - protein, 20 aa, Mycobacterium tuberculosis
AHRGGSSARPDWVKPGPRDR

SEQ ID NO: 1371049 - protein, 7 aa, Mycobacterium tuberculosis
AHSRSPQ

SEQ ID NO: 1371050 - protein, 22 aa, Mycobacterium tuberculosis
AHSRTSRSTSKWPSRRRSTVTD

SEQ ID NO: 1371051 - protein, 21 aa, Mycobacterium tuberculosis
AIGTSGDRKRGEPGAAGHRHR

SEQ ID NO: 1371052 - protein, 14 aa, Mycobacterium tuberculosis
AIRQGSLENATDQL

SEQ ID NO: 1371053 - protein, 12 aa, Mycobacterium tuberculosis
AKCSPPGGHVVS

SEQ ID NO: 1371054 - protein, 13 aa, Mycobacterium tuberculosis
AKDDARKKQNRTT

SEQ ID NO: 1371055 - protein, 25 aa, Mycobacterium tuberculosis
AKDDARKQNRTTAGPHRKARGAAHQ

SEQ ID NO: 1371056 - protein, 12 aa, Mycobacterium tuberculosis
AKERRSSSTVTT

SEQ ID NO: 1371057 - protein, 8 aa, Mycobacterium tuberculosis
AKGRGRDM

SEQ ID NO: 1371058 - protein, 12 aa, Mycobacterium tuberculosis
AKKRTSTRISNP

SEQ ID NO: 1371059 - protein, 13 aa, Mycobacterium tuberculosis
AKNPENRYQTAAE

SEQ ID NO: 1371060 - protein, 11 aa, Mycobacterium tuberculosis
AKPGRMVGPDP

SEQ ID NO: 1371061 - protein, 15 aa, Mycobacterium tuberculosis
AKPPLGSPPPKTTVT

SEQ ID NO: 1371062 - protein, 4 aa, Mycobacterium tuberculosis
AKQQ

SEQ ID NO: 1371063 - protein, 19 aa, Mycobacterium tuberculosis
AKRQLEAAHDRKSSNPTEA

SEQ ID NO: 1371064 - protein, 7 aa, Mycobacterium tuberculosis
AKRYPGA

SEQ ID NO: 1371065 - protein, 9 aa, Mycobacterium tuberculosis
ALAGGGPKY

SEQ ID NO: 1371066 - protein, 15 aa, Mycobacterium tuberculosis
ALAPTGGWCCVAGLR

SEQ ID NO: 1371067 - protein, 8 aa, Mycobacterium tuberculosis
ALGGTRPG

SEQ ID NO: 1371068 - protein, 12 aa, Mycobacterium tuberculosis
ALKDSGKAISDT

SEQ ID NO: 1371069 - protein, 8 aa, Mycobacterium tuberculosis
ALNSRDEA

SEQ ID NO: 1371070 - protein, 11 aa, Mycobacterium tuberculosis
ALPDDVRRDRA

SEQ ID NO: 1371071 - protein, 5 aa, Mycobacterium tuberculosis
ALPGD

SEQ ID NO: 1371072 - protein, 23 aa, Mycobacterium tuberculosis
ALPNPTLPRPGTPAVRPELPTPT

SEQ ID NO: 1371073 - protein, 18 aa, Mycobacterium tuberculosis
ALPNRRRRGRGRASRARL

SEQ ID NO: 1371074 - protein, 22 aa, Mycobacterium tuberculosis
ALPPSDEPADPAARPATRSRVP

SEQ ID NO: 1371075 - protein, 6 aa, Mycobacterium tuberculosis
AMTGGL

SEQ ID NO: 1371076 - protein, 6 aa, Mycobacterium tuberculosis
ANAPFG

SEQ ID NO: 1371077 - protein, 8 aa, Mycobacterium tuberculosis
ANAYESAY

SEQ ID NO: 1371078 - protein, 12 aa, Mycobacterium tuberculosis
ANGGATDARGTA

SEQ ID NO: 1371079 - protein, 20 aa, Mycobacterium tuberculosis
ANISGHPPPVDAEQARSQLG

SEQ ID NO: 1371080 - protein, 6 aa, Mycobacterium tuberculosis
ANLTAL

SEQ ID NO: 1371081 - protein, 11 aa, Mycobacterium tuberculosis
ANNRSGGGVRV

SEQ ID NO: 1371082 - protein, 9 aa, Mycobacterium tuberculosis
ANPASSRSC

SEQ ID NO: 1371083 - protein, 5 aa, Mycobacterium tuberculosis
ANPCR

SEQ ID NO: 1371084 - protein, 11 aa, Mycobacterium tuberculosis
ANRDPRQYEDP

SEQ ID NO: 1371085 - protein, 10 aa, Mycobacterium tuberculosis
ANRNTPPTLA

SEQ ID NO: 1371086 - protein, 9 aa, Mycobacterium tuberculosis
APACPPERP

SEQ ID NO: 1371087 - protein, 5 aa, Mycobacterium tuberculosis
APADG

SEQ ID NO: 1371088 - protein, 5 aa, Mycobacterium tuberculosis
APAGG

SEQ ID NO: 1371089 - protein, 12 aa, Mycobacterium tuberculosis
APAGVRSPAAVP

SEQ ID NO: 1371090 - protein, 6 aa, Mycobacterium tuberculosis
APAKRS

SEQ ID NO: 1371091 - protein, 28 aa, Mycobacterium tuberculosis
APAPAGGSYQNLETSPSPRPATAVNIFL

SEQ ID NO: 1371092 - protein, 6 aa, Mycobacterium tuberculosis
APDPYP

SEQ ID NO: 1371093 - protein, 16 aa, Mycobacterium tuberculosis
APDPYPIHNPDRPPSR

SEQ ID NO: 1371094 - protein, 7 aa, Mycobacterium tuberculosis
APEEGQM

SEQ ID NO: 1371095 - protein, 15 aa, Mycobacterium tuberculosis
APEEPANLSRTLTVP

SEQ ID NO: 1371096 - protein, 7 aa, Mycobacterium tuberculosis
APEHSQT

SEQ ID NO: 1371097 - protein, 5 aa, Mycobacterium tuberculosis
APFSA

SEQ ID NO: 1371098 - protein, 16 aa, Mycobacterium tuberculosis
APGGSAATQAGDGRPA

SEQ ID NO: 1371099 - protein, 6 aa, Mycobacterium tuberculosis
APGHPE

SEQ ID NO: 1371100 - protein, 5 aa, Mycobacterium tuberculosis
APGMA

SEQ ID NO: 1371101 - protein, 14 aa, Mycobacterium tuberculosis
APGPTHHQRDNRTK

SEQ ID NO: 1371102 - protein, 15 aa, Mycobacterium tuberculosis
APGPTHHQRDNRTKR

SEQ ID NO: 1371103 - protein, 13 aa, Mycobacterium tuberculosis
APGQPGGRGGDAG

SEQ ID NO: 1371104 - protein, 4 aa, Mycobacterium tuberculosis
APID

SEQ ID NO: 1371105 - protein, 10 aa, Mycobacterium tuberculosis
APKIPQQQRI

SEQ ID NO: 1371106 - protein, 9 aa, Mycobacterium tuberculosis
APLEATGRG

SEQ ID NO: 1371107 - protein, 10 aa, Mycobacterium tuberculosis
APLPGDDGVG

SEQ ID NO: 1371108 - protein, 4 aa, Mycobacterium tuberculosis
APLR

SEQ ID NO: 1371109 - protein, 19 aa, Mycobacterium tuberculosis
APMAAPQRARLRSSKERVR

SEQ ID NO: 1371110 - protein, 6 aa, Mycobacterium tuberculosis
APPRPA

SEQ ID NO: 1371111 - protein, 16 aa, Mycobacterium tuberculosis
APPRWRSPPRATTSSW

SEQ ID NO: 1371112 - protein, 5 aa, Mycobacterium tuberculosis
APRKT

SEQ ID NO: 1371113 - protein, 19 aa, Mycobacterium tuberculosis
APRPGGAMAPTSTSSTGGH

SEQ ID NO: 1371114 - protein, 89 aa, Mycobacterium tuberculosis
APRQPPAPPVIPPGVQPAPKPSYTPPAQPGPAGQRPGPTGQPSWAPNSGPMPASGPTPTPQYYQGGGWGAPPSGGPSPWAQTPRKTNPW

SEQ ID NO: 1371115 - protein, 17 aa, Mycobacterium tuberculosis
APRSPPRCGAPATTSRC

SEQ ID NO: 1371116 - protein, 8 aa, Mycobacterium tuberculosis
APSFPADA

SEQ ID NO: 1371117 - protein, 4 aa, Mycobacterium tuberculosis
APTA

SEQ ID NO: 1371118 - protein, 35 aa, Mycobacterium tuberculosis
APTSIPSTSLTRAASNSTGPTPPRTSRSAAANTSV

SEQ ID NO: 1371119 - protein, 6 aa, Mycobacterium tuberculosis
APTSWE

SEQ ID NO: 1371120 - protein, 6 aa, Mycobacterium tuberculosis
AQAAAD

SEQ ID NO: 1371121 - protein, 7 aa, Mycobacterium tuberculosis
AQAGRTR

SEQ ID NO: 1371122 - protein, 11 aa, Mycobacterium tuberculosis
AQASLAAAASG

SEQ ID NO: 1371123 - protein, 5 aa, Mycobacterium tuberculosis
AQGFG

SEQ ID NO: 1371124 - protein, 48 aa, Mycobacterium tuberculosis
AQGVAQPALRPSKDARRCRRGPGGGRGSVADTGGLDRGDPAAGTGPAL

SEQ ID NO: 1371125 - protein, 6 aa, Mycobacterium tuberculosis
AQGYQT

SEQ ID NO: 1371126 - protein, 36 aa, Mycobacterium tuberculosis
AQHPAATGANRAAYTTPRRTTSCGSPARALEPTTPR

SEQ ID NO: 1371127 - protein, 26 aa, Mycobacterium tuberculosis
AQHRDGAGLDPTERGTSEGDQGLVSG

SEQ ID NO: 1371128 - protein, 8 aa, Mycobacterium tuberculosis
AQISSAPN

SEQ ID NO: 1371129 - protein, 4 aa, Mycobacterium tuberculosis
AQLD

SEQ ID NO: 1371130 - protein, 13 aa, Mycobacterium tuberculosis
AQPGALPHPHPGA

SEQ ID NO: 1371131 - protein, 10 aa, Mycobacterium tuberculosis
AQQPAAGTAI

SEQ ID NO: 1371132 - protein, 20 aa, Mycobacterium tuberculosis
AQQQPAEAAEAGLAGERADA

SEQ ID NO: 1371133 - protein, 4 aa, Mycobacterium tuberculosis
AQSD

SEQ ID NO: 1371134 - protein, 6 aa, Mycobacterium tuberculosis
AQSNGS

SEQ ID NO: 1371135 - protein, 9 aa, Mycobacterium tuberculosis
AQSRRRNGA

SEQ ID NO: 1371136 - protein, 7 aa, Mycobacterium tuberculosis
AQTEHPG

SEQ ID NO: 1371137 - protein, 9 aa, Mycobacterium tuberculosis
AQTRHPATA

SEQ ID NO: 1371138 - protein, 56 aa, Mycobacterium tuberculosis
AQVDSESTERTHPSARPRRCAQPGQSAAHPGGAVPAPLQPGPRGRSRATGGNAVSS

SEQ ID NO: 1371139 - protein, 7 aa, Mycobacterium tuberculosis
AQYPAST

SEQ ID NO: 1371140 - protein, 5 aa, Mycobacterium tuberculosis
ARAGA

SEQ ID NO: 1371141 - protein, 14 aa, Mycobacterium tuberculosis
ARAPTSTGRWSGRA

SEQ ID NO: 1371142 - protein, 9 aa, Mycobacterium tuberculosis
ARDRDDPRP

SEQ ID NO: 1371143 - protein, 5 aa, Mycobacterium tuberculosis
ARDSN

SEQ ID NO: 1371144 - protein, 6 aa, Mycobacterium tuberculosis
ARGGIK

SEQ ID NO: 1371145 - protein, 9 aa, Mycobacterium tuberculosis
ARGKGISDI

SEQ ID NO: 1371146 - protein, 7 aa, Mycobacterium tuberculosis
ARGLDEA

SEQ ID NO: 1371147 - protein, 4 aa, Mycobacterium tuberculosis
ARGR

SEQ ID NO: 1371148 - protein, 58 aa, Mycobacterium tuberculosis
ARGSGHGQRRRRGRGRSAARHGATGSHDHRRQRPHGCRDRQAGRHREGAGRGVAAGQG

SEQ ID NO: 1371149 - protein, 42 aa, Mycobacterium tuberculosis
ARHPGGGRAGDHRAGHRGGGVDGGHRRLGGPRHHRGPTRRPA

SEQ ID NO: 1371150 - protein, 14 aa, Mycobacterium tuberculosis
ARHPGGGVDDPVGA

SEQ ID NO: 1371151 - protein, 4 aa, Mycobacterium tuberculosis
ARHT

SEQ ID NO: 1371152 - protein, 7 aa, Mycobacterium tuberculosis
ARMPPAG

SEQ ID NO: 1371153 - protein, 8 aa, Mycobacterium tuberculosis
ARPDTQQI

SEQ ID NO: 1371154 - protein, 13 aa, Mycobacterium tuberculosis
ARPTPEQPKGPFG

SEQ ID NO: 1371155 - protein, 5 aa, Mycobacterium tuberculosis
ARQRG

SEQ ID NO: 1371156 - protein, 15 aa, Mycobacterium tuberculosis
ARRPVQRQSARAGDP

SEQ ID NO: 1371157 - protein, 8 aa, Mycobacterium tuberculosis
ARRSRQLR

SEQ ID NO: 1371158 - protein, 13 aa, Mycobacterium tuberculosis
ARRYAEAGNPYPG

SEQ ID NO: 1371159 - protein, 10 aa, Mycobacterium tuberculosis
ARSAQALTNQ

SEQ ID NO: 1371160 - protein, 7 aa, Mycobacterium tuberculosis
ARSFSGA

SEQ ID NO: 1371161 - protein, 4 aa, Mycobacterium tuberculosis
ARSG

SEQ ID NO: 1371162 - protein, 14 aa, Mycobacterium tuberculosis
ARSGKSVAADAATS

SEQ ID NO: 1371163 - protein, 24 aa, Mycobacterium tuberculosis
ARSPGRPAAPQQRQPAGAGRCADY

SEQ ID NO: 1371164 - protein, 7 aa, Mycobacterium tuberculosis
ARSSALP

SEQ ID NO: 1371165 - protein, 4 aa, Mycobacterium tuberculosis
ARTQ

SEQ ID NO: 1371166 - protein, 7 aa, Mycobacterium tuberculosis
ASADGSW

SEQ ID NO: 1371167 - protein, 13 aa, Mycobacterium tuberculosis
ASADPPDPHQPDM

SEQ ID NO: 1371168 - protein, 19 aa, Mycobacterium tuberculosis
ASAEATRRYGTGCSGSPLL

SEQ ID NO: 1371169 - protein, 14 aa, Mycobacterium tuberculosis
ASATQLPTQGTTSN

SEQ ID NO: 1371170 - protein, 14 aa, Mycobacterium tuberculosis
ASAYDEAAATMSGK

SEQ ID NO: 1371171 - protein, 9 aa, Mycobacterium tuberculosis
ASDDPAGVD

SEQ ID NO: 1371172 - protein, 6 aa, Mycobacterium tuberculosis
ASDPEG

SEQ ID NO: 1371173 - protein, 4 aa, Mycobacterium tuberculosis
ASGG

SEQ ID NO: 1371174 - protein, 11 aa, Mycobacterium tuberculosis
ASGRGGQAADI

SEQ ID NO: 1371175 - protein, 5 aa, Mycobacterium tuberculosis
ASGRV

SEQ ID NO: 1371176 - protein, 10 aa, Mycobacterium tuberculosis
ASGVRSSRGW

SEQ ID NO: 1371177 - protein, 7 aa, Mycobacterium tuberculosis
ASKGKWD

SEQ ID NO: 1371178 - protein, 5 aa, Mycobacterium tuberculosis
ASLAP

SEQ ID NO: 1371179 - protein, 4 aa, Mycobacterium tuberculosis
ASLT

SEQ ID NO: 1371180 - protein, 8 aa, Mycobacterium tuberculosis
ASPAPPVT

SEQ ID NO: 1371181 - protein, 7 aa, Mycobacterium tuberculosis
ASPARAV

SEQ ID NO: 1371182 - protein, 18 aa, Mycobacterium tuberculosis
ASPGRSRRAPDRGTRPGG

SEQ ID NO: 1371183 - protein, 7 aa, Mycobacterium tuberculosis
ASPWATP

SEQ ID NO: 1371184 - protein, 5 aa, Mycobacterium tuberculosis
ASQHT

SEQ ID NO: 1371185 - protein, 7 aa, Mycobacterium tuberculosis
ASRAGGE

SEQ ID NO: 1371186 - protein, 4 aa, Mycobacterium tuberculosis
ASRD

SEQ ID NO: 1371187 - protein, 9 aa, Mycobacterium tuberculosis
ASRPPDRRC

SEQ ID NO: 1371188 - protein, 8 aa, Mycobacterium tuberculosis
ASSGIGRA

SEQ ID NO: 1371189 - protein, 9 aa, Mycobacterium tuberculosis
ASSRPGQAA

SEQ ID NO: 1371190 - protein, 24 aa, Mycobacterium tuberculosis
ASSSASASLSPGNRIGSGPKRSPI

SEQ ID NO: 1371191 - protein, 5 aa, Mycobacterium tuberculosis
ASSSL

SEQ ID NO: 1371192 - protein, 13 aa, Mycobacterium tuberculosis
ASTAQATDADGCA

SEQ ID NO: 1371193 - protein, 10 aa, Mycobacterium tuberculosis
ASVPAPSHSP

SEQ ID NO: 1371194 - protein, 8 aa, Mycobacterium tuberculosis
ATAAPGGA

SEQ ID NO: 1371195 - protein, 6 aa, Mycobacterium tuberculosis
ATATRI

SEQ ID NO: 1371196 - protein, 6 aa, Mycobacterium tuberculosis
ATAVAS

SEQ ID NO: 1371197 - protein, 9 aa, Mycobacterium tuberculosis
ATCTTTTTE

SEQ ID NO: 1371198 - protein, 10 aa, Mycobacterium tuberculosis
ATDKPPVRGA

SEQ ID NO: 1371199 - protein, 5 aa, Mycobacterium tuberculosis
ATDTG

SEQ ID NO: 1371200 - protein, 5 aa, Mycobacterium tuberculosis
ATEDR

SEQ ID NO: 1371201 - protein, 18 aa, Mycobacterium tuberculosis
ATESPTSPGWTGARGTPT

SEQ ID NO: 1371202 - protein, 10 aa, Mycobacterium tuberculosis
ATGAGNNGED

SEQ ID NO: 1371203 - protein, 9 aa, Mycobacterium tuberculosis
ATGAHTGHA

SEQ ID NO: 1371204 - protein, 6 aa, Mycobacterium tuberculosis
ATGAVG

SEQ ID NO: 1371205 - protein, 8 aa, Mycobacterium tuberculosis
ATGCGGSR

SEQ ID NO: 1371206 - protein, 9 aa, Mycobacterium tuberculosis
ATGGEYGTS

SEQ ID NO: 1371207 - protein, 8 aa, Mycobacterium tuberculosis
ATGSTETG

SEQ ID NO: 1371208 - protein, 10 aa, Mycobacterium tuberculosis
ATGTGKSATT

SEQ ID NO: 1371209 - protein, 8 aa, Mycobacterium tuberculosis
ATKDPRGL

SEQ ID NO: 1371210 - protein, 10 aa, Mycobacterium tuberculosis
ATKPRTPPFG

SEQ ID NO: 1371211 - protein, 6 aa, Mycobacterium tuberculosis
ATLPGI

SEQ ID NO: 1371212 - protein, 63 aa, Mycobacterium tuberculosis
ATPADTGLSQSESGIAGAGTGPPTPGAARWSPGDSATVAGPLAADSRGGNWPSQTGHSPAVPN

SEQ ID NO: 1371213 - protein, 8 aa, Mycobacterium tuberculosis
ATPAPDGT

SEQ ID NO: 1371214 - protein, 17 aa, Mycobacterium tuberculosis
ATPGPYELSQTGGESSS

SEQ ID NO: 1371215 - protein, 9 aa, Mycobacterium tuberculosis
ATPPAVDPA

SEQ ID NO: 1371216 - protein, 12 aa, Mycobacterium tuberculosis
ATPRPRPRWGTP

SEQ ID NO: 1371217 - protein, 7 aa, Mycobacterium tuberculosis
ATQESEM

SEQ ID NO: 1371218 - protein, 5 aa, Mycobacterium tuberculosis
ATRPA

SEQ ID NO: 1371219 - protein, 4 aa, Mycobacterium tuberculosis
ATSD

SEQ ID NO: 1371220 - protein, 14 aa, Mycobacterium tuberculosis
ATSESVKAETMPSE

SEQ ID NO: 1371221 - protein, 16 aa, Mycobacterium tuberculosis
ATSSTSGPGTGPPPRL

SEQ ID NO: 1371222 - protein, 15 aa, Mycobacterium tuberculosis
ATVAETNNRTRVLLI

SEQ ID NO: 1371223 - protein, 5 aa, Mycobacterium tuberculosis
ATVPP

SEQ ID NO: 1371224 - protein, 21 aa, Mycobacterium tuberculosis
ATWDSNGGVGSPAAASPQQQI

SEQ ID NO: 1371225 - protein, 30 aa, Mycobacterium tuberculosis
ATWGPTAALSAGPGAIAQPDLTGQPAAGAA

SEQ ID NO: 1371226 - protein, 12 aa, Mycobacterium tuberculosis
AVAPNSAPALSG

SEQ ID NO: 1371227 - protein, 4 aa, Mycobacterium tuberculosis
AVGE

SEQ ID NO: 1371228 - protein, 40 aa, Mycobacterium tuberculosis; identical to SEQ ID NO: 193797

SEQ ID NO: 1371229 - protein, 56 aa, Mycobacterium tuberculosis
AVGGSGGPGSGHGGPIRGENRDGLAGSVRAGGAAGAGPARPVAPAAGQPRDGDPGP

SEQ ID NO: 1371230 - protein, 19 aa, Mycobacterium tuberculosis
AVPNGDVGVGAVGGPLVVV

SEQ ID NO: 1371231 - protein, 6 aa, Mycobacterium tuberculosis
AVQPAH

SEQ ID NO: 1371232 - protein, 17 aa, Mycobacterium tuberculosis
AVQQEPNLTGHLGALIG

SEQ ID NO: 1371233 - protein, 5 aa, Mycobacterium tuberculosis
AVRRP

SEQ ID NO: 1371234 - protein, 9 aa, Mycobacterium tuberculosis
AVRSDQPGH

SEQ ID NO: 1371235 - protein, 9 aa, Mycobacterium tuberculosis
AVSATGPAV

SEQ ID NO: 1371236 - protein, 11 aa, Mycobacterium tuberculosis
AVSPPGRRTAT

SEQ ID NO: 1371237 - protein, 6 aa, Mycobacterium tuberculosis
AVTGKG

SEQ ID NO: 1371238 - protein, 7 aa, Mycobacterium tuberculosis
AYKPAQT

SEQ ID NO: 1371239 - protein, 6 aa, Mycobacterium tuberculosis
CAGPGQ

SEQ ID NO: 1371240 - protein, 22 aa, Mycobacterium tuberculosis
CAGRPGRRRRPSQREHAGNRRG

SEQ ID NO: 1371241 - protein, 13 aa, Mycobacterium tuberculosis
CAPPGALGAAHAL

SEQ ID NO: 1371242 - protein, 14 aa, Mycobacterium tuberculosis
CASDPSSDSASTAT

SEQ ID NO: 1371243 - protein, 10 aa, Mycobacterium tuberculosis
CASPRRTRCG

SEQ ID NO: 1371244 - protein, 6 aa, Mycobacterium tuberculosis
CATGRA

SEQ ID NO: 1371245 - protein, 11 aa, Mycobacterium tuberculosis
CDDRPTAYGSR

SEQ ID NO: 1371246 - protein, 9 aa, Mycobacterium tuberculosis
CEQPNAGAC

SEQ ID NO: 1371247 - protein, 15 aa, Mycobacterium tuberculosis
CESGGNWAANTGNGL

SEQ ID NO: 1371248 - protein, 19 aa, Mycobacterium tuberculosis
CGGSDRGWPGPPIGGLPRG

SEQ ID NO: 1371249 - protein, 6 aa, Mycobacterium tuberculosis
CGRRAT

SEQ ID NO: 1371250 - protein, 6 aa, Mycobacterium tuberculosis
CGSGFG

SEQ ID NO: 1371251 - protein, 5 aa, Mycobacterium tuberculosis
CHPNM

SEQ ID NO: 1371252 - protein, 11 aa, Mycobacterium tuberculosis
CKSSPATAQRT

SEQ ID NO: 1371253 - protein, 25 aa, Mycobacterium tuberculosis
CNPPPQPAGSAPTNLGEQVSPTDMT

SEQ ID NO: 1371254 - protein, 8 aa, Mycobacterium tuberculosis
CPPHSSLR

SEQ ID NO: 1371255 - protein, 11 aa, Mycobacterium tuberculosis
CPSNRRKPKRF

SEQ ID NO: 1371256 - protein, 18 aa, Mycobacterium tuberculosis
CPSNTTPTSSNTWRSTPT

SEQ ID NO: 1371257 - protein, 21 aa, Mycobacterium tuberculosis
CPTNRHHRKPRRRIPSPIRGT

SEQ ID NO: 1371258 - protein, 18 aa, Mycobacterium tuberculosis
CRGSSASADHRLESAESI

SEQ ID NO: 1371259 - protein, 8 aa, Mycobacterium tuberculosis
CRPGDAGT

SEQ ID NO: 1371260 - protein, 14 aa, Mycobacterium tuberculosis
CRPQRGSGGPARGL

SEQ ID NO: 1371261 - protein, 34 aa, Mycobacterium tuberculosis
CRQASRRAPCRTPRPRWQPAPARRHQNPSRAQLT

SEQ ID NO: 1371262 - protein, 18 aa, Mycobacterium tuberculosis
CRTSTSRRIEANSGRGQH

SEQ ID NO: 1371263 - protein, 14 aa, Mycobacterium tuberculosis
CSAPADSACAPAAA

SEQ ID NO: 1371264 - protein, 22 aa, Mycobacterium tuberculosis
CSAPADSACAPAAARRARRHSR

SEQ ID NO: 1371265 - protein, 5 aa, Mycobacterium tuberculosis
CSGPV

SEQ ID NO: 1371266 - protein, 12 aa, Mycobacterium tuberculosis
CSPSPSASAGPP

SEQ ID NO: 1371267 - protein, 9 aa, Mycobacterium tuberculosis
CSTPRWPQP

SEQ ID NO: 1371268 - protein, 18 aa, Mycobacterium tuberculosis
DAAARALDRARGAADPLT

SEQ ID NO: 1371269 - protein, 26 aa, Mycobacterium tuberculosis
DAAEARLRDGPRAAALPASGTSEGRQ

SEQ ID NO: 1371270 - protein, 8 aa, Mycobacterium tuberculosis
DAAGRPRL

SEQ ID NO: 1371271 - protein, 18 aa, Mycobacterium tuberculosis
DAAHDARAMDPKRRITLR

SEQ ID NO: 1371272 - protein, 12 aa, Mycobacterium tuberculosis
DAAQAAAAAAER

SEQ ID NO: 1371273 - protein, 7 aa, Mycobacterium tuberculosis
DAATDDA

SEQ ID NO: 1371274 - protein, 5 aa, Mycobacterium tuberculosis
DADAE

SEQ ID NO: 1371275 - protein, 9 aa, Mycobacterium tuberculosis
DAEHNRASA

SEQ ID NO: 1371276 - protein, 11 aa, Mycobacterium tuberculosis
DAFGGSPRTPM

SEQ ID NO: 1371277 - protein, 7 aa, Mycobacterium tuberculosis
DAGARTA

SEQ ID NO: 1371278 - protein, 7 aa, Mycobacterium tuberculosis
DAGEGAG

SEQ ID NO: 1371279 - protein, 22 aa, Mycobacterium tuberculosis
DAGPWQRDGALSRSAVAGRRRS

SEQ ID NO: 1371280 - protein, 7 aa, Mycobacterium tuberculosis
DAPLESD

SEQ ID NO: 1371281 - protein, 8 aa, Mycobacterium tuberculosis
DARAQAGA

SEQ ID NO: 1371282 - protein, 78 aa, Mycobacterium tuberculosis
DARPGRDTSRGSQTTGPKGRPTPKRNQSRRHTKKGPVAPAPMTAAQARARRKSLAGPKLSREERRAEKAANRARMTER

SEQ ID NO: 1371283 - protein, 5 aa, Mycobacterium tuberculosis
DATAV

SEQ ID NO: 1371284 - protein, 6 aa, Mycobacterium tuberculosis
DATKSD

SEQ ID NO: 1371285 - protein, 9 aa, Mycobacterium tuberculosis
DATRGPGLT

SEQ ID NO: 1371286 - protein, 4 aa, Mycobacterium tuberculosis
DCGG

SEQ ID NO: 1371287 - protein, 8 aa, Mycobacterium tuberculosis
DDATAQRH

SEQ ID NO: 1371288 - protein, 20 aa, Mycobacterium tuberculosis
DDAVGVPPTCGGRSDEEERR

SEQ ID NO: 1371289 - protein, 4 aa, Mycobacterium tuberculosis
DDGI

SEQ ID NO: 1371290 - protein, 4 aa, Mycobacterium tuberculosis
DDGS

SEQ ID NO: 1371291 - protein, 13 aa, Mycobacterium tuberculosis
DDIPESGKMTSRS

SEQ ID NO: 1371292 - protein, 5 aa, Mycobacterium tuberculosis
DDRAE

SEQ ID NO: 1371293 - protein, 7 aa, Mycobacterium tuberculosis
DDRGLPA

SEQ ID NO: 1371294 - protein, 8 aa, Mycobacterium tuberculosis
DDSPGREG

SEQ ID NO: 1371295 - protein, 7 aa, Mycobacterium tuberculosis
DDSYGQD

SEQ ID NO: 1371296 - protein, 7 aa, Mycobacterium tuberculosis
DEARRPG

SEQ ID NO: 1371297 - protein, 6 aa, Mycobacterium tuberculosis
DEGHSA

SEQ ID NO: 1371298 - protein, 22 aa, Mycobacterium tuberculosis
DEHARERTPDAGRDRTFSGQHR

SEQ ID NO: 1371299 - protein, 8 aa, Mycobacterium tuberculosis
DELPDTRG

SEQ ID NO: 1371300 - protein, 14 aa, Mycobacterium tuberculosis
DELTAAPDSDDLGE

SEQ ID NO: 1371301 - protein, 4 aa, Mycobacterium tuberculosis
DENR

SEQ ID NO: 1371302 - protein, 11 aa, Mycobacterium tuberculosis
DERQRKAQQAI

SEQ ID NO: 1371303 - protein, 4 aa, Mycobacterium tuberculosis
DEVL

SEQ ID NO: 1371304 - protein, 44 aa, Mycobacterium tuberculosis
DFASRRGPPTGAAASPAIRPRGSPEAAQALGATGARCALVVTSG

SEQ ID NO: 1371305 - protein, 9 aa, Mycobacterium tuberculosis
DGADKSGLT

SEQ ID NO: 1371306 - protein, 28 aa, Mycobacterium tuberculosis
DGAPDTVPAEGGGGAARGGHRGGPQGLS

SEQ ID NO: 1371307 - protein, 35 aa, Mycobacterium tuberculosis
DGAPDTVPAEGGGGDARGGHRGGPQGLSGARCARG

SEQ ID NO: 1371308 - protein, 12 aa, Mycobacterium tuberculosis
DGGAAAGRDRGA

SEQ ID NO: 1371309 - protein, 5 aa, Mycobacterium tuberculosis
DGGNT

SEQ ID NO: 1371310 - protein, 8 aa, Mycobacterium tuberculosis
DGIPPPNS

SEQ ID NO: 1371311 - protein, 12 aa, Mycobacterium tuberculosis
DGITPPSAARAI

SEQ ID NO: 1371312 - protein, 8 aa, Mycobacterium tuberculosis
DGLGGKFG

SEQ ID NO: 1371313 - protein, 12 aa, Mycobacterium tuberculosis
DGPATDPVVTDD

SEQ ID NO: 1371314 - protein, 13 aa, Mycobacterium tuberculosis
DGPPAGSTDVPGS

SEQ ID NO: 1371315 - protein, 7 aa, Mycobacterium tuberculosis
DGQKRLK

SEQ ID NO: 1371316 - protein, 7 aa, Mycobacterium tuberculosis
DGRDGQT

SEQ ID NO: 1371317 - protein, 22 aa, Mycobacterium tuberculosis
DGRGARARHVDPGGDPDRHRSH

SEQ ID NO: 1371318 - protein, 31 aa, Mycobacterium tuberculosis
DGRGARARHVDPGGDPGSAPQPPGRIITAAA

SEQ ID NO: 1371319 - protein, 11 aa, Mycobacterium tuberculosis
DGRGPGTPPAT

SEQ ID NO: 1371320 - protein, 5 aa, Mycobacterium tuberculosis
DGRIQ

SEQ ID NO: 1371321 - protein, 6 aa, Mycobacterium tuberculosis
DGRLGG

SEQ ID NO: 1371322 - protein, 15 aa, Mycobacterium tuberculosis
DGSCSRRRGHDGGDR

SEQ ID NO: 1371323 - protein, 19 aa, Mycobacterium tuberculosis
DGSLPGQADHSSKSSFGNR

SEQ ID NO: 1371324 - protein, 8 aa, Mycobacterium tuberculosis
DGSMDAGD

SEQ ID NO: 1371325 - protein, 5 aa, Mycobacterium tuberculosis
DGSSS

SEQ ID NO: 1371326 - protein, 9 aa, Mycobacterium tuberculosis
DGTADCDAH

SEQ ID NO: 1371327 - protein, 9 aa, Mycobacterium tuberculosis
DGTGPIPEL

SEQ ID NO: 1371328 - protein, 18 aa, Mycobacterium tuberculosis
DGVACPDGSTAPSSETYA

SEQ ID NO: 1371329 - protein, 5 aa, Mycobacterium tuberculosis
DGVTI

SEQ ID NO: 1371330 - protein, 5 aa, Mycobacterium tuberculosis
DHPGY

SEQ ID NO: 1371331 - protein, 122 aa, Mycobacterium tuberculosis
DHPHRTADDASDHVGDDAADHAADHAGDHAANDAADHAGDHAANDAADHAGDHATNDRRPDDRRPDDGRSDHRRPDHGRSSHRHADDRRSAADAAAHATTNPTDANPAADRGPADGGAGSAA

SEQ ID NO: 1371332 - protein, 4 aa, Mycobacterium tuberculosis
DHRA

SEQ ID NO: 1371333 - protein, 30 aa, Mycobacterium tuberculosis
DHVPGAAGRDVLPGAGDGSGAAAVTPDRLR

SEQ ID NO: 1371334 - protein, 5 aa, Mycobacterium tuberculosis
DIGGS

SEQ ID NO: 1371335 - protein, 43 aa, Mycobacterium tuberculosis
DIPTDARADKITAGGAAGRRPDPDALPGPAGGRRGADVRANAG

SEQ ID NO: 1371336 - protein, 5 aa, Mycobacterium tuberculosis
DISRK

SEQ ID NO: 1371337 - protein, 6 aa, Mycobacterium tuberculosis
DISYQA

SEQ ID NO: 1371338 - protein, 4 aa, Mycobacterium tuberculosis
DKEL

SEQ ID NO: 1371339 - protein, 9 aa, Mycobacterium tuberculosis
DKKPPLPRG

SEQ ID NO: 1371340 - protein, 7 aa, Mycobacterium tuberculosis
DKKTRAG

SEQ ID NO: 1371341 - protein, 18 aa, Mycobacterium tuberculosis
DKRKAKREARDSRRRSFG

SEQ ID NO: 1371342 - protein, 8 aa, Mycobacterium tuberculosis
DLADPRRG

SEQ ID NO: 1371343 - protein, 14 aa, Mycobacterium tuberculosis
DLRQGEPADADRVD

SEQ ID NO: 1371344 - protein, 5 aa, Mycobacterium tuberculosis
DNPEI

SEQ ID NO: 1371345 - protein, 17 aa, Mycobacterium tuberculosis
DNPGPSDPTTKAALQVL

SEQ ID NO: 1371346 - protein, 8 aa, Mycobacterium tuberculosis
DNSTDWTG

SEQ ID NO: 1371347 - protein, 20 aa, Mycobacterium tuberculosis
DNTGSPDAWESVSGRSARPG

SEQ ID NO: 1371348 - protein, 4 aa, Mycobacterium tuberculosis
DPAP

SEQ ID NO: 1371349 - protein, 12 aa, Mycobacterium tuberculosis
DPDPDAVGKSYT

SEQ ID NO: 1371350 - protein, 10 aa, Mycobacterium tuberculosis
DPDRARRNDP

SEQ ID NO: 1371351 - protein, 18 aa, Mycobacterium tuberculosis
DPERTRKSAQRRDEGAAG

SEQ ID NO: 1371352 - protein, 18 aa, Mycobacterium tuberculosis
DPETGHDPTGSPQGAGTL

SEQ ID NO: 1371353 - protein, 4 aa, Mycobacterium tuberculosis
DPFH

SEQ ID NO: 1371354 - protein, 18 aa, Mycobacterium tuberculosis
DPGARSTRADRDRRARFL

SEQ ID NO: 1371355 - protein, 21 aa, Mycobacterium tuberculosis
DPHDEEPPAATPHGGGVPTNP

SEQ ID NO: 1371356 - protein, 4 aa, Mycobacterium tuberculosis
DPLG

SEQ ID NO: 1371357 - protein, 15 aa, Mycobacterium tuberculosis
DPNPQAARLPARARG

SEQ ID NO: 1371358 - protein, 15 aa, Mycobacterium tuberculosis
DPPADSTGTPMLLPT

SEQ ID NO: 1371359 - protein, 6 aa, Mycobacterium tuberculosis
DPPTLA

SEQ ID NO: 1371360 - protein, 11 aa, Mycobacterium tuberculosis
DPQAALDPAGD

SEQ ID NO: 1371361 - protein, 8 aa, Mycobacterium tuberculosis
DPRGATPW

SEQ ID NO: 1371362 - protein, 14 aa, Mycobacterium tuberculosis
DPSAAAQLADTTDQ

SEQ ID NO: 1371363 - protein, 5 aa, Mycobacterium tuberculosis
DPSVG

SEQ ID NO: 1371364 - protein, 8 aa, Mycobacterium tuberculosis
DPTEDQAK

SEQ ID NO: 1371365 - protein, 16 aa, Mycobacterium tuberculosis
DPTKKARTYSKGNRQK

SEQ ID NO: 1371366 - protein, 12 aa, Mycobacterium tuberculosis
DPTVKGGTSNPW

SEQ ID NO: 1371367 - protein, 11 aa, Mycobacterium tuberculosis
DPTYADPSQSM

SEQ ID NO: 1371368 - protein, 8 aa, Mycobacterium tuberculosis
DPVPADPV

SEQ ID NO: 1371369 - protein, 6 aa, Mycobacterium tuberculosis
DQADES

SEQ ID NO: 1371370 - protein, 6 aa, Mycobacterium tuberculosis
DQATTA

SEQ ID NO: 1371371 - protein, 6 aa, Mycobacterium tuberculosis
DQDSGE

SEQ ID NO: 1371372 - protein, 5 aa, Mycobacterium tuberculosis
DQHRQ

SEQ ID NO: 1371373 - protein, 5 aa, Mycobacterium tuberculosis
DQPAR

SEQ ID NO: 1371374 - protein, 11 aa, Mycobacterium tuberculosis
DQPHRDPCGGA

SEQ ID NO: 1371375 - protein, 6 aa, Mycobacterium tuberculosis
DQPPRL

SEQ ID NO: 1371376 - protein, 7 aa, Mycobacterium tuberculosis
DQPQHAP

SEQ ID NO: 1371377 - protein, 13 aa, Mycobacterium tuberculosis
DQPSGTRNMNDYS

SEQ ID NO: 1371378 - protein, 12 aa, Mycobacterium tuberculosis
DQRDDPGRAGGH

SEQ ID NO: 1371379 - protein, 21 aa, Mycobacterium tuberculosis
DQRQPSPRPRAAARKPARTTR

SEQ ID NO: 1371380 - protein, 11 aa, Mycobacterium tuberculosis
DQSDFTPNDQL

SEQ ID NO: 1371381 - protein, 7 aa, Mycobacterium tuberculosis
DQTISAQ

SEQ ID NO: 1371382 - protein, 6 aa, Mycobacterium tuberculosis
DRAAES

SEQ ID NO: 1371383 - protein, 9 aa, Mycobacterium tuberculosis
DRARRDRRR

SEQ ID NO: 1371384 - protein, 11 aa, Mycobacterium tuberculosis
DRCTTRRRRPV

SEQ ID NO: 1371385 - protein, 79 aa, Mycobacterium tuberculosis
DRDGESTPAVEETSEADIEREQPGDLASQAPAAHQVDAEAASAAPEEPAALASEAHDETEPEVPEKAAPIPDPAKPDEL

SEQ ID NO: 1371386 - protein, 59 aa, Mycobacterium tuberculosis
DRDGRADRPDRQHRRGSGAAAPARPGRRPAQVDPGAVGPDAGRSCADRSGADSRRAGVG

SEQ ID NO: 1371387 - protein, 11 aa, Mycobacterium tuberculosis
DRGAGQRGGPI

SEQ ID NO: 1371388 - protein, 8 aa, Mycobacterium tuberculosis
DRGATGEP

SEQ ID NO: 1371389 - protein, 6 aa, Mycobacterium tuberculosis
DRGRTR

SEQ ID NO: 1371390 - protein, 8 aa, Mycobacterium tuberculosis
DRHAGRRG

SEQ ID NO: 1371391 - protein, 6 aa, Mycobacterium tuberculosis
DRIGGG

SEQ ID NO: 1371392 - protein, 5 aa, Mycobacterium tuberculosis
DRNPV

SEQ ID NO: 1371393 - protein, 4 aa, Mycobacterium tuberculosis
DRPL

SEQ ID NO: 1371394 - protein, 16 aa, Mycobacterium tuberculosis
DRRQTHQVADEYLRRP

SEQ ID NO: 1371395 - protein, 11 aa, Mycobacterium tuberculosis
DRVGGRSLTGR

SEQ ID NO: 1371396 - protein, 5 aa, Mycobacterium tuberculosis
DRVSA

SEQ ID NO: 1371397 - protein, 7 aa, Mycobacterium tuberculosis
DRVSATQ

SEQ ID NO: 1371398 - protein, 12 aa, Mycobacterium tuberculosis
DSAGRTGPLSAV

SEQ ID NO: 1371399 - protein, 18 aa, Mycobacterium tuberculosis
DSAGSSRRAADPPDACIG

SEQ ID NO: 1371400 - protein, 7 aa, Mycobacterium tuberculosis
DSASVEH

SEQ ID NO: 1371401 - protein, 5 aa, Mycobacterium tuberculosis
DSGAF

SEQ ID NO: 1371402 - protein, 6 aa, Mycobacterium tuberculosis
DSGFVT

SEQ ID NO: 1371403 - protein, 9 aa, Mycobacterium tuberculosis
DSNIELGPG

SEQ ID NO: 1371404 - protein, 8 aa, Mycobacterium tuberculosis
DSPEESQQ

SEQ ID NO: 1371405 - protein, 8 aa, Mycobacterium tuberculosis
DSQTQGLK

SEQ ID NO: 1371406 - protein, 6 aa, Mycobacterium tuberculosis
DSRHRD

SEQ ID NO: 1371407 - protein, 9 aa, Mycobacterium tuberculosis
DSRTGEMDT

SEQ ID NO: 1371408 - protein, 9 aa, Mycobacterium tuberculosis
DSSANLDQT

SEQ ID NO: 1371409 - protein, 13 aa, Mycobacterium tuberculosis
DSSRAHASGGTGL

SEQ ID NO: 1371410 - protein, 11 aa, Mycobacterium tuberculosis
DSSRPGQAHRR

SEQ ID NO: 1371411 - protein, 10 aa, Mycobacterium tuberculosis
DSVRESGPVR

SEQ ID NO: 1371412 - protein, 5 aa, Mycobacterium tuberculosis
DTAAA

SEQ ID NO: 1371413 - protein, 12 aa, Mycobacterium tuberculosis
DTAAGPSAPDYY

SEQ ID NO: 1371414 - protein, 8 aa, Mycobacterium tuberculosis
DTDQIQPY

SEQ ID NO: 1371415 - protein, 7 aa, Mycobacterium tuberculosis
DTGANSQ

SEQ ID NO: 1371416 - protein, 6 aa, Mycobacterium tuberculosis
DTGVGP

SEQ ID NO: 1371417 - protein, 9 aa, Mycobacterium tuberculosis
DTRAARSRR

SEQ ID NO: 1371418 - protein, 30 aa, Mycobacterium tuberculosis
DTTRRSCRPRVRPPNRLRSAPRKPLLRLPH

SEQ ID NO: 1371419 - protein, 22 aa, Mycobacterium tuberculosis
DTTSSTPAAARRVTSPPARETR

SEQ ID NO: 1371420 - protein, 13 aa, Mycobacterium tuberculosis
DTYIEKDSSINDD

SEQ ID NO: 1371421 - protein, 16 aa, Mycobacterium tuberculosis
DTYTTAKTRRRAAPRI

SEQ ID NO: 1371422 - protein, 4 aa, Mycobacterium tuberculosis
DVAS

SEQ ID NO: 1371423 - protein, 5 aa, Mycobacterium tuberculosis
DVEPS

SEQ ID NO: 1371424 - protein, 13 aa, Mycobacterium tuberculosis
DVEQAAPRPRDGR

SEQ ID NO: 1371425 - protein, 6 aa, Mycobacterium tuberculosis
DVERRG

SEQ ID NO: 1371426 - protein, 8 aa, Mycobacterium tuberculosis
DVNPPGDE

SEQ ID NO: 1371427 - protein, 5 aa, Mycobacterium tuberculosis
DVPGL

SEQ ID NO: 1371428 - protein, 6 aa, Mycobacterium tuberculosis
DYEEGG

SEQ ID NO: 1371429 - protein, 10 aa, Mycobacterium tuberculosis
DYGPGSHTGA

SEQ ID NO: 1371430 - protein, 23 aa, Mycobacterium tuberculosis
EAAADVGADAEAAIAASRSGSQI

SEQ ID NO: 1371431 - protein, 14 aa, Mycobacterium tuberculosis
EAAEAAAAAPAAVG

SEQ ID NO: 1371432 - protein, 5 aa, Mycobacterium tuberculosis
EAAGD

SEQ ID NO: 1371433 - protein, 12 aa, Mycobacterium tuberculosis
EAAQGPISSPIG

SEQ ID NO: 1371434 - protein, 13 aa, Mycobacterium tuberculosis
EAARREAQSAFGD

SEQ ID NO: 1371435 - protein, 5 aa, Mycobacterium tuberculosis
EADPD

SEQ ID NO: 1371436 - protein, 9 aa, Mycobacterium tuberculosis
EAEGQPQVN

SEQ ID NO: 1371437 - protein, 37 aa, Mycobacterium tuberculosis
EAETEVREAQPGRGERHAAAAAAGTDVEGDGAAEARV

SEQ ID NO: 1371438 - protein, 4 aa, Mycobacterium tuberculosis
EAGR

SEQ ID NO: 1371439 - protein, 35 aa, Mycobacterium tuberculosis
EAIPGGRTQISGGDRHSPRRPHASSPTSSSTGRCR

SEQ ID NO: 1371440 - protein, 10 aa, Mycobacterium tuberculosis
EANSPSTPEL

SEQ ID NO: 1371441 - protein, 6 aa, Mycobacterium tuberculosis
EAPSPL

SEQ ID NO: 1371442 - protein, 41 aa, Mycobacterium tuberculosis; identical to SEQ ID NO: 172888

SEQ ID NO: 1371443 - protein, 13 aa, Mycobacterium tuberculosis
EATVKDTAAEIAA

SEQ ID NO: 1371444 - protein, 6 aa, Mycobacterium tuberculosis
ECRAGA

SEQ ID NO: 1371445 - protein, 13 aa, Mycobacterium tuberculosis
EDPAGRKADREGL

SEQ ID NO: 1371446 - protein, 9 aa, Mycobacterium tuberculosis
EDPAHGWQP

SEQ ID NO: 1371447 - protein, 6 aa, Mycobacterium tuberculosis
EDTATR

SEQ ID NO: 1371448 - protein, 5 aa, Mycobacterium tuberculosis
EEAAS

SEQ ID NO: 1371449 - protein, 6 aa, Mycobacterium tuberculosis
EEIGYG

SEQ ID NO: 1371450 - protein, 7 aa, Mycobacterium tuberculosis
EEPIDHT

SEQ ID NO: 1371451 - protein, 35 aa, Mycobacterium tuberculosis
EEQPSDMTNHPRYSPPPQQPGTPGYAQGQQQTYSQ

SEQ ID NO: 1371452 - protein, 4 aa, Mycobacterium tuberculosis
EESL

SEQ ID NO: 1371453 - protein, 7 aa, Mycobacterium tuberculosis
EESQKAT

SEQ ID NO: 1371454 - protein, 13 aa, Mycobacterium tuberculosis
EETDNAEDKPETL

SEQ ID NO: 1371455 - protein, 17 aa, Mycobacterium tuberculosis
EETPPQPPTGGAAAAIP

SEQ ID NO: 1371456 - protein, 7 aa, Mycobacterium tuberculosis
EETTQDL

SEQ ID NO: 1371457 - protein, 6 aa, Mycobacterium tuberculosis
EEVPRD

SEQ ID NO: 1371458 - protein, 6 aa, Mycobacterium tuberculosis
EFTPKT

SEQ ID NO: 1371459 - protein, 5 aa, Mycobacterium tuberculosis
EGKPA

SEQ ID NO: 1371460 - protein, 4 aa, Mycobacterium tuberculosis
EGRG

SEQ ID NO: 1371461 - protein, 5 aa, Mycobacterium tuberculosis
EGTTV

SEQ ID NO: 1371462 - protein, 8 aa, Mycobacterium tuberculosis
EGVGPAAA

SEQ ID NO: 1371463 - protein, 12 aa, Mycobacterium tuberculosis
EGVGPNRESMGQ

SEQ ID NO: 1371464 - protein, 6 aa, Mycobacterium tuberculosis
EHEPSD

SEQ ID NO: 1371465 - protein, 6 aa, Mycobacterium tuberculosis
EHGEGE

SEQ ID NO: 1371466 - protein, 11 aa, Mycobacterium tuberculosis
EHRCGSSDHSR

SEQ ID NO: 1371467 - protein, 7 aa, Mycobacterium tuberculosis
EHRQPRV

SEQ ID NO: 1371468 - protein, 10 aa, Mycobacterium tuberculosis
EIERDGRPAA

SEQ ID NO: 1371469 - protein, 7 aa, Mycobacterium tuberculosis
EIREGRS

SEQ ID NO: 1371470 - protein, 7 aa, Mycobacterium tuberculosis
EKATKRR

SEQ ID NO: 1371471 - protein, 12 aa, Mycobacterium tuberculosis
EKSGEGGGNRVS

SEQ ID NO: 1371472 - protein, 8 aa, Mycobacterium tuberculosis
ELGGSDAP

SEQ ID NO: 1371473 - protein, 9 aa, Mycobacterium tuberculosis
ELGTAAQSF

SEQ ID NO: 1371474 - protein, 8 aa, Mycobacterium tuberculosis
ELNEESNF

SEQ ID NO: 1371475 - protein, 5 aa, Mycobacterium tuberculosis
ELTRQ

SEQ ID NO: 1371476 - protein, 7 aa, Mycobacterium tuberculosis
ENAANGY

SEQ ID NO: 1371477 - protein, 4 aa, Mycobacterium tuberculosis
ENGG

SEQ ID NO: 1371478 - protein, 4 aa, Mycobacterium tuberculosis
ENVR

SEQ ID NO: 1371479 - protein, 13 aa, Mycobacterium tuberculosis
EPASREHVGVGAG

SEQ ID NO: 1371480 - protein, 4 aa, Mycobacterium tuberculosis
EPAY

SEQ ID NO: 1371481 - protein, 4 aa, Mycobacterium tuberculosis
EPDE

SEQ ID NO: 1371482 - protein, 5 aa, Mycobacterium tuberculosis
EPDER

SEQ ID NO: 1371483 - protein, 12 aa, Mycobacterium tuberculosis
EPEPQAPEVPEA

SEQ ID NO: 1371484 - protein, 8 aa, Mycobacterium tuberculosis
EPGGAADA

SEQ ID NO: 1371485 - protein, 8 aa, Mycobacterium tuberculosis
EPPEAPKV

SEQ ID NO: 1371486 - protein, 7 aa, Mycobacterium tuberculosis
EPPYRGG

SEQ ID NO: 1371487 - protein, 5 aa, Mycobacterium tuberculosis
EPSEV

SEQ ID NO: 1371488 - protein, 6 aa, Mycobacterium tuberculosis
EPSRGL

SEQ ID NO: 1371489 - protein, 7 aa, Mycobacterium tuberculosis
EPSSGLD

SEQ ID NO: 1371490 - protein, 7 aa, Mycobacterium tuberculosis
EPTPAER

SEQ ID NO: 1371491 - protein, 8 aa, Mycobacterium tuberculosis
EQATTEAF

SEQ ID NO: 1371492 - protein, 10 aa, Mycobacterium tuberculosis
EQLASSDPGV

SEQ ID NO: 1371493 - protein, 7 aa, Mycobacterium tuberculosis
EQPDRAV

SEQ ID NO: 1371494 - protein, 10 aa, Mycobacterium tuberculosis
EQPEAGAAGN

SEQ ID NO: 1371495 - protein, 25 aa, Mycobacterium tuberculosis
EQSGRTDRDQGSERAKHPVPGGPHR

SEQ ID NO: 1371496 - protein, 7 aa, Mycobacterium tuberculosis
EQVQPNT

SEQ ID NO: 1371497 - protein, 19 aa, Mycobacterium tuberculosis
ERAQARASRLQRRQAATDA

SEQ ID NO: 1371498 - protein, 7 aa, Mycobacterium tuberculosis
ERARTAK

SEQ ID NO: 1371499 - protein, 8 aa, Mycobacterium tuberculosis
ERDRARMT

SEQ ID NO: 1371500 - protein, 7 aa, Mycobacterium tuberculosis
ERECGGS

SEQ ID NO: 1371501 - protein, 6 aa, Mycobacterium tuberculosis
ERGHGD

SEQ ID NO: 1371502 - protein, 21 aa, Mycobacterium tuberculosis
ERGRSHRRVRPAAGAGPAGGR

SEQ ID NO: 1371503 - protein, 6 aa, Mycobacterium tuberculosis
ERPSRY

SEQ ID NO: 1371504 - protein, 12 aa, Mycobacterium tuberculosis
ERQRKAQQAIRR

SEQ ID NO: 1371505 - protein, 4 aa, Mycobacterium tuberculosis
ERRD

SEQ ID NO: 1371506 - protein, 5 aa, Mycobacterium tuberculosis
ERSGH

SEQ ID NO: 1371507 - protein, 7 aa, Mycobacterium tuberculosis
ERTARAD

SEQ ID NO: 1371508 - protein, 6 aa, Mycobacterium tuberculosis
ERTRVT

SEQ ID NO: 1371509 - protein, 5 aa, Mycobacterium tuberculosis
ESAMT

SEQ ID NO: 1371510 - protein, 5 aa, Mycobacterium tuberculosis
ESAVS

SEQ ID NO: 1371511 - protein, 6 aa, Mycobacterium tuberculosis
ESAVSD

SEQ ID NO: 1371512 - protein, 8 aa, Mycobacterium tuberculosis
ESEERQAL

SEQ ID NO: 1371513 - protein, 26 aa, Mycobacterium tuberculosis
ESFTEGAETADARADEHSAGAAQAAV

SEQ ID NO: 1371514 - protein, 4 aa, Mycobacterium tuberculosis
ESKV

SEQ ID NO: 1371515 - protein, 13 aa, Mycobacterium tuberculosis
ESLGGAADSDLGL

SEQ ID NO: 1371516 - protein, 9 aa, Mycobacterium tuberculosis
ESLQRPSHR

SEQ ID NO: 1371517 - protein, 17 aa, Mycobacterium tuberculosis
ESLSAGHAKPCAGGGAT

SEQ ID NO: 1371518 - protein, 4 aa, Mycobacterium tuberculosis
ESMN

SEQ ID NO: 1371519 - protein, 12 aa, Mycobacterium tuberculosis
ESNLQRQVIHGG

SEQ ID NO: 1371520 - protein, 12 aa, Mycobacterium tuberculosis
ESPRSPAAPSLR

SEQ ID NO: 1371521 - protein, 13 aa, Mycobacterium tuberculosis
ESQSTRTSYLCSY

SEQ ID NO: 1371522 - protein, 12 aa, Mycobacterium tuberculosis
ESSPASVRPPPW

SEQ ID NO: 1371523 - protein, 13 aa, Mycobacterium tuberculosis
ESVAPLPIGLTFL

SEQ ID NO: 1371524 - protein, 11 aa, Mycobacterium tuberculosis
ESYPTSGTATS

SEQ ID NO: 1371525 - protein, 5 aa, Mycobacterium tuberculosis
ETAAR

SEQ ID NO: 1371526 - protein, 26 aa, Mycobacterium tuberculosis
ETAHHPDDHRVGTAGAPGGHRQPGHR

SEQ ID NO: 1371527 - protein, 9 aa, Mycobacterium tuberculosis
ETLTGTHTT

SEQ ID NO: 1371528 - protein, 7 aa, Mycobacterium tuberculosis
ETRAQGR

SEQ ID NO: 1371529 - protein, 27 aa, Mycobacterium tuberculosis
ETRDPNATLRPGSPSNPAAPGSVGNSW

SEQ ID NO: 1371530 - protein, 11 aa, Mycobacterium tuberculosis
ETRMENPAGTV

SEQ ID NO: 1371531 - protein, 20 aa, Mycobacterium tuberculosis
ETSAATTARHSQADAGAYDA

SEQ ID NO: 1371532 - protein, 14 aa, Mycobacterium tuberculosis
EVAKGGSYATSSAV

SEQ ID NO: 1371533 - protein, 28 aa, Mycobacterium tuberculosis
EVAPGTVAPVAGASRPQLPTGDLTSVSA

SEQ ID NO: 1371534 - protein, 42 aa, Mycobacterium tuberculosis
EVGEAESETAVREAQPGRGERHAAAAAAGTDVEGDGAAEARV

SEQ ID NO: 1371535 - protein, 11 aa, Mycobacterium tuberculosis
EVSGSPPPRLN

SEQ ID NO: 1371536 - protein, 7 aa, Mycobacterium tuberculosis
EVSQPTI

SEQ ID NO: 1371537 - protein, 8 aa, Mycobacterium tuberculosis
EVSTRTPV

SEQ ID NO: 1371538 - protein, 12 aa, Mycobacterium tuberculosis
EWSHGTSSTAQP

SEQ ID NO: 1371539 - protein, 4 aa, Mycobacterium tuberculosis
EYPP

SEQ ID NO: 1371540 - protein, 5 aa, Mycobacterium tuberculosis
EYSQG

SEQ ID NO: 1371541 - protein, 11 aa, Mycobacterium tuberculosis
EYTSGTPWAKT

SEQ ID NO: 1371542 - protein, 6 aa, Mycobacterium tuberculosis
FAPAKS

SEQ ID NO: 1371543 - protein, 8 aa, Mycobacterium tuberculosis
FASGNPAT

SEQ ID NO: 1371544 - protein, 4 aa, Mycobacterium tuberculosis
FDGN

SEQ ID NO: 1371545 - protein, 12 aa, Mycobacterium tuberculosis
FENTTGDAWLRA

SEQ ID NO: 1371546 - protein, 5 aa, Mycobacterium tuberculosis
FETER

SEQ ID NO: 1371547 - protein, 11 aa, Mycobacterium tuberculosis
FGGRRSQTAAG

SEQ ID NO: 1371548 - protein, 29 aa, Mycobacterium tuberculosis
FGNGGAGGAGYSPAAGTGAAGGAGGAGGA

SEQ ID NO: 1371549 - protein, 57 aa, Mycobacterium tuberculosis
FGPGTGRVATAPGGDAASAPPPGAGGPAPPQAVPPPRTTQPPAAPPRGPERPPPRRW

SEQ ID NO: 1371550 - protein, 56 aa, Mycobacterium tuberculosis
FGPGTGRVATARGGDAASAPPPGAGGPAPPQAVPPPRTTQPPAAPPRGPDVPPATV

SEQ ID NO: 1371551 - protein, 6 aa, Mycobacterium tuberculosis
FGPRRQ

SEQ ID NO: 1371552 - protein, 10 aa, Mycobacterium tuberculosis
FGPSSPLSGM

SEQ ID NO: 1371553 - protein, 18 aa, Mycobacterium tuberculosis
FGPTPTRCCPGSRPRHGC

SEQ ID NO: 1371554 - protein, 7 aa, Mycobacterium tuberculosis
FGSPQPG

SEQ ID NO: 1371555 - protein, 18 aa, Mycobacterium tuberculosis
FGTGRGRRKRRGARPLVF

SEQ ID NO: 1371556 - protein, 22 aa, Mycobacterium tuberculosis
FKPEGRGRGPQVRPGGLQTRAG

SEQ ID NO: 1371557 - protein, 11 aa, Mycobacterium tuberculosis
FPEPSSAVEQG

SEQ ID NO: 1371558 - protein, 10 aa, Mycobacterium tuberculosis
FPPAPGAGQV

SEQ ID NO: 1371559 - protein, 8 aa, Mycobacterium tuberculosis
FPSNTESR

SEQ ID NO: 1371560 - protein, 12 aa, Mycobacterium tuberculosis
FPSTGRRPPTGC

SEQ ID NO: 1371561 - protein, 5 aa, Mycobacterium tuberculosis
FPTGP

SEQ ID NO: 1371562 - protein, 4 aa, Mycobacterium tuberculosis
FPVE

SEQ ID NO: 1371563 - protein, 6 aa, Mycobacterium tuberculosis
FQPPAK

SEQ ID NO: 1371564 - protein, 4 aa, Mycobacterium tuberculosis
FRAA

SEQ ID NO: 1371565 - protein, 6 aa, Mycobacterium tuberculosis
FRAPPS

SEQ ID NO: 1371566 - protein, 13 aa, Mycobacterium tuberculosis
FREPSSGKIGPPR

SEQ ID NO: 1371567 - protein, 4 aa, Mycobacterium tuberculosis
FRQG

SEQ ID NO: 1371568 - protein, 15 aa, Mycobacterium tuberculosis
FSTSDPTTSSRRPNV

SEQ ID NO: 1371569 - protein, 11 aa, Mycobacterium tuberculosis
FYDDGSQSVQA

SEQ ID NO: 1371570 - protein, 10 aa, Mycobacterium tuberculosis
GAAAAGLASP

SEQ ID NO: 1371571 - protein, 6 aa, Mycobacterium tuberculosis
GAAADR

SEQ ID NO: 1371572 - protein, 7 aa, Mycobacterium tuberculosis
GAACPRP

SEQ ID NO: 1371573 - protein, 6 aa, Mycobacterium tuberculosis
GAAGSV

SEQ ID NO: 1371574 - protein, 9 aa, Mycobacterium tuberculosis
GAAGVSGAG

SEQ ID NO: 1371575 - protein, 7 aa, Mycobacterium tuberculosis
GAALPSA

SEQ ID NO: 1371576 - protein, 42 aa, Mycobacterium tuberculosis
GAAVGESADEADAEAADGVAGHADPEADPVEYDTNTNTSRHC

SEQ ID NO: 1371577 - protein, 6 aa, Mycobacterium tuberculosis
GADEVS

SEQ ID NO: 1371578 - protein, 11 aa, Mycobacterium tuberculosis
GADGSAGSEDA

SEQ ID NO: 1371579 - protein, 23 aa, Mycobacterium tuberculosis
GADNDRHFQRTPSVHPAAVSSGR

SEQ ID NO: 1371580 - protein, 8 aa, Mycobacterium tuberculosis
GADTPQRR

SEQ ID NO: 1371581 - protein, 8 aa, Mycobacterium tuberculosis
GAEQIRTG

SEQ ID NO: 1371582 - protein, 7 aa, Mycobacterium tuberculosis
GAGAGAA

SEQ ID NO: 1371583 - protein, 41 aa, Mycobacterium tuberculosis
GAGGGTAAGRTHGAAEPPRSLAGRSGDQVHRSERRGAAARD

SEQ ID NO: 1371584 - protein, 6 aa, Mycobacterium tuberculosis
GAGGVG

SEQ ID NO: 1371585 - protein, 8 aa, Mycobacterium tuberculosis
GAGIRPDS

SEQ ID NO: 1371586 - protein, 25 aa, Mycobacterium tuberculosis
GAGPGTPARPAHSDSLTARAERGIE

SEQ ID NO: 1371587 - protein, 28 aa, Mycobacterium tuberculosis
GAGRRRRRAVAPRGRRPGGAGDAGGPLA

SEQ ID NO: 1371588 - protein, 7 aa, Mycobacterium tuberculosis
GAGTAGA

SEQ ID NO: 1371589 - protein, 8 aa, Mycobacterium tuberculosis
GAHTPAAV

SEQ ID NO: 1371590 - protein, 53 aa, Mycobacterium tuberculosis; identical to SEQ ID NO: 155240

SEQ ID NO: 1371591 - protein, 13 aa, Mycobacterium tuberculosis
GANPGPDHHSPVP

SEQ ID NO: 1371592 - protein, 6 aa, Mycobacterium tuberculosis
GAPDGD

SEQ ID NO: 1371593 - protein, 9 aa, Mycobacterium tuberculosis
GAPKASPVE

SEQ ID NO: 1371594 - protein, 7 aa, Mycobacterium tuberculosis
GAPRAST

SEQ ID NO: 1371595 - protein, 55 aa, Mycobacterium tuberculosis
GAPTPPTPPSPPAPISPALPPAPPLPGNPPMTAAPPAPPTPPLPNAPAASPAPPL

SEQ ID NO: 1371596 - protein, 14 aa, Mycobacterium tuberculosis
GAPTPPTPPSPSAP

SEQ ID NO: 1371597 - protein, 7 aa, Mycobacterium tuberculosis
GAQLDGP

SEQ ID NO: 1371598 - protein, 13 aa, Mycobacterium tuberculosis
GAQPRTGDLRGGG

SEQ ID NO: 1371599 - protein, 10 aa, Mycobacterium tuberculosis
GARDRTDRTH

SEQ ID NO: 1371600 - protein, 7 aa, Mycobacterium tuberculosis
GARGNSY

SEQ ID NO: 1371601 - protein, 8 aa, Mycobacterium tuberculosis
GARKPSRY

SEQ ID NO: 1371602 - protein, 26 aa, Mycobacterium tuberculosis
GARRPLRNRPRNKSPITAAGTEVIER

SEQ ID NO: 1371603 - protein, 20 aa, Mycobacterium tuberculosis
GASEPGGTGEPAETPGRGRL

SEQ ID NO: 1371604 - protein, 6 aa, Mycobacterium tuberculosis
GASGSF

SEQ ID NO: 1371605 - protein, 12 aa, Mycobacterium tuberculosis
GASTYRKCAPPQ

SEQ ID NO: 1371606 - protein, 5 aa, Mycobacterium tuberculosis
GASVT

SEQ ID NO: 1371607 - protein, 13 aa, Mycobacterium tuberculosis
GATAGRYRGASGR

SEQ ID NO: 1371608 - protein, 9 aa, Mycobacterium tuberculosis
GATGSGKSE

SEQ ID NO: 1371609 - protein, 6 aa, Mycobacterium tuberculosis
GATRRQ

SEQ ID NO: 1371610 - protein, 33 aa, Mycobacterium tuberculosis
GAVRAGRSAARRCADGGHARRHRDRRHTGHRGE

SEQ ID NO: 1371611 - protein, 21 aa, Mycobacterium tuberculosis
GCRSGRRREPPDYPASRLAGR

SEQ ID NO: 1371612 - protein, 15 aa, Mycobacterium tuberculosis
GCSPFNGSKGIADHG

SEQ ID NO: 1371613 - protein, 23 aa, Mycobacterium tuberculosis
GCSSASATNTATPKAWSTRQSPM

SEQ ID NO: 1371614 - protein, 23 aa, Mycobacterium tuberculosis
GDEHARERTPDAGPRSHFSGQHR

SEQ ID NO: 1371615 - protein, 10 aa, Mycobacterium tuberculosis
GDFGSGTTTV

SEQ ID NO: 1371616 - protein, 17 aa, Mycobacterium tuberculosis
GDGADGTAPGQNGGAGG

SEQ ID NO: 1371617 - protein, 23 aa, Mycobacterium tuberculosis
GDGPGDTVVGNGADAAARGQSAV

SEQ ID NO: 1371618 - protein, 16 aa, Mycobacterium tuberculosis
GDHVTGNGGGCRRPAA

SEQ ID NO: 1371619 - protein, 6 aa, Mycobacterium tuberculosis
GDLSGF

SEQ ID NO: 1371620 - protein, 15 aa, Mycobacterium tuberculosis
GDNPATAKAIAQEAR

SEQ ID NO: 1371621 - protein, 5 aa, Mycobacterium tuberculosis
GDNTI

SEQ ID NO: 1371622 - protein, 9 aa, Mycobacterium tuberculosis
GDPAPGGGI

SEQ ID NO: 1371623 - protein, 8 aa, Mycobacterium tuberculosis
GDPATPEG

SEQ ID NO: 1371624 - protein, 5 aa, Mycobacterium tuberculosis
GDPHR

SEQ ID NO: 1371625 - protein, 7 aa, Mycobacterium tuberculosis
GDPQLAG

SEQ ID NO: 1371626 - protein, 5 aa, Mycobacterium tuberculosis
GDPWT

SEQ ID NO: 1371627 - protein, 14 aa, Mycobacterium tuberculosis
GDQPAAGRRRQAAQ

SEQ ID NO: 1371628 - protein, 7 aa, Mycobacterium tuberculosis
GDRGSAT

SEQ ID NO: 1371629 - protein, 13 aa, Mycobacterium tuberculosis
GDRTRRIRGRQSR

SEQ ID NO: 1371630 - protein, 7 aa, Mycobacterium tuberculosis
GDSGFVS

SEQ ID NO: 1371631 - protein, 8 aa, Mycobacterium tuberculosis
GDSSKVRV

SEQ ID NO: 1371632 - protein, 6 aa, Mycobacterium tuberculosis
GDSTDV

SEQ ID NO: 1371633 - protein, 7 aa, Mycobacterium tuberculosis
GDTVTAG

SEQ ID NO: 1371634 - protein, 4 aa, Mycobacterium tuberculosis
GEEH

SEQ ID NO: 1371635 - protein, 19 aa, Mycobacterium tuberculosis
GEGFENTTGTLAPRAAVPA

SEQ ID NO: 1371636 - protein, 4 aa, Mycobacterium tuberculosis
GEHK

SEQ ID NO: 1371637 - protein, 12 aa, Mycobacterium tuberculosis
GEKGTAKSTAVR

SEQ ID NO: 1371638 - protein, 7 aa, Mycobacterium tuberculosis
GEKYPDG

SEQ ID NO: 1371639 - protein, 10 aa, Mycobacterium tuberculosis
GELGEDACPE

SEQ ID NO: 1371640 - protein, 7 aa, Mycobacterium tuberculosis
GELGPAT

SEQ ID NO: 1371641 - protein, 12 aa, Mycobacterium tuberculosis
GEPGVGKTTAAK

SEQ ID NO: 1371642 - protein, 17 aa, Mycobacterium tuberculosis
GEQGGQGGDGGSRRRRR

SEQ ID NO: 1371643 - protein, 11 aa, Mycobacterium tuberculosis
GERRRAERERL

SEQ ID NO: 1371644 - protein, 8 aa, Mycobacterium tuberculosis
GETIPSDG

SEQ ID NO: 1371645 - protein, 9 aa, Mycobacterium tuberculosis
GETIPSDGE

SEQ ID NO: 1371646 - protein, 10 aa, Mycobacterium tuberculosis
GETSRRHRRA

SEQ ID NO: 1371647 - protein, 9 aa, Mycobacterium tuberculosis
GFDSAAPTA

SEQ ID NO: 1371648 - protein, 11 aa, Mycobacterium tuberculosis
GGAAPVFPGRT

SEQ ID NO: 1371649 - protein, 7 aa, Mycobacterium tuberculosis
GGAARHR

SEQ ID NO: 1371650 - protein, 15 aa, Mycobacterium tuberculosis
GGAGAAGAATVLLLF

SEQ ID NO: 1371651 - protein, 9 aa, Mycobacterium tuberculosis
GGAGGPALT

SEQ ID NO: 1371652 - protein, 9 aa, Mycobacterium tuberculosis
GGAGPAGGR

SEQ ID NO: 1371653 - protein, 29 aa, Mycobacterium tuberculosis
GGAGPWSGGPGKLGVPPRMRPRSASVRAV

SEQ ID NO: 1371654 - protein, 6 aa, Mycobacterium tuberculosis
GGAGQP

SEQ ID NO: 1371655 - protein, 35 aa, Mycobacterium tuberculosis
GGAGSKLTDLASPKLGQRRESRRADWRQRRQEAAY

SEQ ID NO: 1371656 - protein, 8 aa, Mycobacterium tuberculosis
GGAPGASS

SEQ ID NO: 1371657 - protein, 14 aa, Mycobacterium tuberculosis
GGEFGGSPSVPDGA

SEQ ID NO: 1371658 - protein, 5 aa, Mycobacterium tuberculosis
GGEGA

SEQ ID NO: 1371659 - protein, 8 aa, Mycobacterium tuberculosis
GGELDPPK

SEQ ID NO: 1371660 - protein, 25 aa, Mycobacterium tuberculosis
GGEPLPGPPPPGGCGGAIPSEQPNA

SEQ ID NO: 1371661 - protein, 8 aa, Mycobacterium tuberculosis
GGGAATDV

SEQ ID NO: 1371662 - protein, 10 aa, Mycobacterium tuberculosis
GGGAMPATQQ

SEQ ID NO: 1371663 - protein, 8 aa, Mycobacterium tuberculosis
GGGELGVD

SEQ ID NO: 1371664 - protein, 6 aa, Mycobacterium tuberculosis
GGGETV

SEQ ID NO: 1371665 - protein, 6 aa, Mycobacterium tuberculosis
GGGGRL

SEQ ID NO: 1371666 - protein, 15 aa, Mycobacterium tuberculosis
GGGGSGDQCRSPDGC

SEQ ID NO: 1371667 - protein, 22 aa, Mycobacterium tuberculosis
GGGRPGLASTRSLPQKCQESAT

SEQ ID NO: 1371668 - protein, 4 aa, Mycobacterium tuberculosis
GGGV

SEQ ID NO: 1371669 - protein, 19 aa, Mycobacterium tuberculosis
GGHRRAGGDTVVRRPDRRC

SEQ ID NO: 1371670 - protein, 6 aa, Mycobacterium tuberculosis
GGKLPT

SEQ ID NO: 1371671 - protein, 5 aa, Mycobacterium tuberculosis
GGLAD

SEQ ID NO: 1371672 - protein, 14 aa, Mycobacterium tuberculosis
GGLQNNSGPGKGFG

SEQ ID NO: 1371673 - protein, 6 aa, Mycobacterium tuberculosis
GGLTRT

SEQ ID NO: 1371674 - protein, 4 aa, Mycobacterium tuberculosis
GGPH

SEQ ID NO: 1371675 - protein, 22 aa, Mycobacterium tuberculosis
GGQSVTASPGCGRCRGPPRPTC

SEQ ID NO: 1371676 - protein, 38 aa, Mycobacterium tuberculosis
GGRGAHRGVGHRRRRSGGGAADRHRRAARRGRDMTDRP

SEQ ID NO: 1371677 - protein, 8 aa, Mycobacterium tuberculosis
GGRTADTP

SEQ ID NO: 1371678 - protein, 14 aa, Mycobacterium tuberculosis
GGSGDWGLSLRPTV

SEQ ID NO: 1371679 - protein, 16 aa, Mycobacterium tuberculosis
GGSGRRPPVVTGRANA

SEQ ID NO: 1371680 - protein, 4 aa, Mycobacterium tuberculosis
GGSP

SEQ ID NO: 1371681 - protein, 9 aa, Mycobacterium tuberculosis
GGSPTTQQA

SEQ ID NO: 1371682 - protein, 8 aa, Mycobacterium tuberculosis
GGSTDETL

SEQ ID NO: 1371683 - protein, 7 aa, Mycobacterium tuberculosis
GGTRRSC

SEQ ID NO: 1371684 - protein, 180 aa, Mycobacterium tuberculosis
GGVGGFGGQGGIGGEGRTGGNGGSGGDGGGGISLGGNGGLGGNGGVSETGFGGAGGNGGYGGPGGPEGNGGLGGNGGAGGNGGVSTTGGDGGAGGKGGNGGDGGNVGLGGDAGSGGAGGNGGIGTDAGGAGGAGGAGGNGGSSKSTTTGNAGSGGAGGNGGTGLNGAGGAGGAGGNAGVA

SEQ ID NO: 1371685 - protein, 5 aa, Mycobacterium tuberculosis
GHAGA

SEQ ID NO: 1371686 - protein, 42 aa, Mycobacterium tuberculosis
GHDDDQRHRQRGPAASHVSASSTRRRRSRHAGRRTARGPRRS

SEQ ID NO: 1371687 - protein, 43 aa, Mycobacterium tuberculosis; identical to SEQ ID NO: 229908

SEQ ID NO: 1371688 - protein, 6 aa, Mycobacterium tuberculosis
GHPKPR

SEQ ID NO: 1371689 - protein, 16 aa, Mycobacterium tuberculosis
GHRPVAARSPIPPAAR

SEQ ID NO: 1371690 - protein, 4 aa, Mycobacterium tuberculosis
GIDL

SEQ ID NO: 1371691 - protein, 7 aa, Mycobacterium tuberculosis
GIDNARR

SEQ ID NO: 1371692 - protein, 13 aa, Mycobacterium tuberculosis
GIDPTGLRGSATG

SEQ ID NO: 1371693 - protein, 6 aa, Mycobacterium tuberculosis
GIGGAA

SEQ ID NO: 1371694 - protein, 4 aa, Mycobacterium tuberculosis
GIGN

SEQ ID NO: 1371695 - protein, 15 aa, Mycobacterium tuberculosis
GIGPARLDKLRNLVR

SEQ ID NO: 1371696 - protein, 7 aa, Mycobacterium tuberculosis
GIGSERP

SEQ ID NO: 1371697 - protein, 24 aa, Mycobacterium tuberculosis
GINGDGGTGGMGGQGGAGGNGWAA

SEQ ID NO: 1371698 - protein, 5 aa, Mycobacterium tuberculosis
GISHS

SEQ ID NO: 1371699 - protein, 8 aa, Mycobacterium tuberculosis
GITGQHGR

SEQ ID NO: 1371700 - protein, 12 aa, Mycobacterium tuberculosis
GKDDPRTQETTH

SEQ ID NO: 1371701 - protein, 7 aa, Mycobacterium tuberculosis
GKDGNAG

SEQ ID NO: 1371702 - protein, 20 aa, Mycobacterium tuberculosis
GKPSRYRSEPQRQHLAAAPA

SEQ ID NO: 1371703 - protein, 9 aa, Mycobacterium tuberculosis
GLAETAEEI

SEQ ID NO: 1371704 - protein, 13 aa, Mycobacterium tuberculosis
GLAGGSGQAWQGA

SEQ ID NO: 1371705 - protein, 14 aa, Mycobacterium tuberculosis
GLAGKGKQTNTTLN

SEQ ID NO: 1371706 - protein, 7 aa, Mycobacterium tuberculosis
GLAGTGL

SEQ ID NO: 1371707 - protein, 26 aa, Mycobacterium tuberculosis
GLAPGRRQRHRQRGQARRRHPGSTLR

SEQ ID NO: 1371708 - protein, 8 aa, Mycobacterium tuberculosis
GLAPMSPA

SEQ ID NO: 1371709 - protein, 7 aa, Mycobacterium tuberculosis
GLASGAG

SEQ ID NO: 1371710 - protein, 5 aa, Mycobacterium tuberculosis
GLGAP

SEQ ID NO: 1371711 - protein, 13 aa, Mycobacterium tuberculosis
GLGGRTAAAQEAI

SEQ ID NO: 1371712 - protein, 5 aa, Mycobacterium tuberculosis
GLGNG

SEQ ID NO: 1371713 - protein, 15 aa, Mycobacterium tuberculosis
GLGNGQPDTVPAAST

SEQ ID NO: 1371714 - protein, 8 aa, Mycobacterium tuberculosis
GLGRGRER

SEQ ID NO: 1371715 - protein, 8 aa, Mycobacterium tuberculosis
GLGTSRSP

SEQ ID NO: 1371716 - protein, 9 aa, Mycobacterium tuberculosis
GLPNHRTGR

SEQ ID NO: 1371717 - protein, 17 aa, Mycobacterium tuberculosis
GLPQRTARLPLACVRWY

SEQ ID NO: 1371718 - protein, 16 aa, Mycobacterium tuberculosis
GLQPIDSKGCHTRRTR

SEQ ID NO: 1371719 - protein, 18 aa, Mycobacterium tuberculosis
GNGANGAPGTGANGAPGG

SEQ ID NO: 1371720 - protein, 9 aa, Mycobacterium tuberculosis
GNGGARRQR

SEQ ID NO: 1371721 - protein, 19 aa, Mycobacterium tuberculosis
GNGGNGAAGVNAGIAGASG

SEQ ID NO: 1371722 - protein, 9 aa, Mycobacterium tuberculosis
GNQGDGGRF

SEQ ID NO: 1371723 - protein, 21 aa, Mycobacterium tuberculosis
GNRSLGKPQPGRHRLSAILSP

SEQ ID NO: 1371724 - protein, 20 aa, Mycobacterium tuberculosis
GNSRETAKSIARGRPDLPGP

SEQ ID NO: 1371725 - protein, 5 aa, Mycobacterium tuberculosis
GPAAT

SEQ ID NO: 1371726 - protein, 6 aa, Mycobacterium tuberculosis
GPAATA

SEQ ID NO: 1371727 - protein, 5 aa, Mycobacterium tuberculosis
GPAVS

SEQ ID NO: 1371728 - protein, 10 aa, Mycobacterium tuberculosis
GPDGRGARPN

SEQ ID NO: 1371729 - protein, 4 aa, Mycobacterium tuberculosis
GPDR

SEQ ID NO: 1371730 - protein, 9 aa, Mycobacterium tuberculosis
GPDTQERRA

SEQ ID NO: 1371731 - protein, 4 aa, Mycobacterium tuberculosis
GPLG

SEQ ID NO: 1371732 - protein, 5 aa, Mycobacterium tuberculosis
GPNAV

SEQ ID NO: 1371733 - protein, 10 aa, Mycobacterium tuberculosis
GPNGAGKSTT

SEQ ID NO: 1371734 - protein, 35 aa, Mycobacterium tuberculosis
GPPPPGQVAGPGPAPHQPAQPARPPNDNGPPPPFT

SEQ ID NO: 1371735 - protein, 8 aa, Mycobacterium tuberculosis
GPPPSPVQ

SEQ ID NO: 1371736 - protein, 46 aa, Mycobacterium tuberculosis
GPPSRSAAMKAAPKAFGARRRPDATASRPPTTNTETADVTPEATAV

SEQ ID NO: 1371737 - protein, 5 aa, Mycobacterium tuberculosis
GPQRN

SEQ ID NO: 1371738 - protein, 27 aa, Mycobacterium tuberculosis
GPRLSGRMDRGGSAAGGFAPASYQGGR

SEQ ID NO: 1371739 - protein, 6 aa, Mycobacterium tuberculosis
GPRPKI

SEQ ID NO: 1371740 - protein, 9 aa, Mycobacterium tuberculosis
GPTARSGCR

SEQ ID NO: 1371741 - protein, 9 aa, Mycobacterium tuberculosis
GPTGRAAAL

SEQ ID NO: 1371742 - protein, 14 aa, Mycobacterium tuberculosis
GPTPGGAPGNDDLG

SEQ ID NO: 1371743 - protein, 14 aa, Mycobacterium tuberculosis
GPVDEHGHPLGRIA

SEQ ID NO: 1371744 - protein, 15 aa, Mycobacterium tuberculosis
GPVEGTKAEKRAERS

SEQ ID NO: 1371745 - protein, 8 aa, Mycobacterium tuberculosis
GPVPAATT

SEQ ID NO: 1371746 - protein, 6 aa, Mycobacterium tuberculosis
GQAQLT

SEQ ID NO: 1371747 - protein, 28 aa, Mycobacterium tuberculosis
GQCSAGHRRGDRHQAHARREPRLGPAPH

SEQ ID NO: 1371748 - protein, 10 aa, Mycobacterium tuberculosis
GQDPPHGHPG

SEQ ID NO: 1371749 - protein, 14 aa, Mycobacterium tuberculosis
GQNTPAIATSEAQY

SEQ ID NO: 1371750 - protein, 13 aa, Mycobacterium tuberculosis
GQNTPAIEANQAA

SEQ ID NO: 1371751 - protein, 16 aa, Mycobacterium tuberculosis
GQQRRRDPRWHHHRRP

SEQ ID NO: 1371752 - protein, 6 aa, Mycobacterium tuberculosis
GQRAEC

SEQ ID NO: 1371753 - protein, 17 aa, Mycobacterium tuberculosis
GQRPPGPLLLNSIIFTN

SEQ ID NO: 1371754 - protein, 11 aa, Mycobacterium tuberculosis
GQTSGASSARL

SEQ ID NO: 1371755 - protein, 7 aa, Mycobacterium tuberculosis
GRAAAAG

SEQ ID NO: 1371756 - protein, 10 aa, Mycobacterium tuberculosis
GRAHNTGHPD

SEQ ID NO: 1371757 - protein, 4 aa, Mycobacterium tuberculosis
GRDG

SEQ ID NO: 1371758 - protein, 87 aa, Mycobacterium tuberculosis
GRDKSGQPNPQPPETDALSRDASPGAPPGPRRRRRATARRKAPVKAPSATRQTTKPKGPPAHRSSSTYPRPVTAPPCTTANPSLLKG

SEQ ID NO: 1371759 - protein, 8 aa, Mycobacterium tuberculosis
GRDPPARR

SEQ ID NO: 1371760 - protein, 5 aa, Mycobacterium tuberculosis
GRDRN

SEQ ID NO: 1371761 - protein, 5 aa, Mycobacterium tuberculosis
GRDRQ

SEQ ID NO: 1371762 - protein, 9 aa, Mycobacterium tuberculosis
GREDESAVG

SEQ ID NO: 1371763 - protein, 6 aa, Mycobacterium tuberculosis
GRFGTP

SEQ ID NO: 1371764 - protein, 7 aa, Mycobacterium tuberculosis
GRGAGTI

SEQ ID NO: 1371765 - protein, 30 aa, Mycobacterium tuberculosis
GRGGQRARYRRPTAKIPHESLRTGAGQPLS

SEQ ID NO: 1371766 - protein, 5 aa, Mycobacterium tuberculosis
GRGPV

SEQ ID NO: 1371767 - protein, 6 aa, Mycobacterium tuberculosis
GRGVAG

SEQ ID NO: 1371768 - protein, 15 aa, Mycobacterium tuberculosis
GRHELPADHPRSKVG

SEQ ID NO: 1371769 - protein, 14 aa, Mycobacterium tuberculosis
GRHRPGRPHPATGA

SEQ ID NO: 1371770 - protein, 15 aa, Mycobacterium tuberculosis
GRLDGAGVALAMLLD

SEQ ID NO: 1371771 - protein, 10 aa, Mycobacterium tuberculosis
GRLPVDNPAT

SEQ ID NO: 1371772 - protein, 27 aa, Mycobacterium tuberculosis
GRMDRGGSAAGASRQRRTKGAGGSFTS

SEQ ID NO: 1371773 - protein, 4 aa, Mycobacterium tuberculosis
GRPE

SEQ ID NO: 1371774 - protein, 5 aa, Mycobacterium tuberculosis
GRPGM

SEQ ID NO: 1371775 - protein, 14 aa, Mycobacterium tuberculosis
GRPPADSPTKAAQT

SEQ ID NO: 1371776 - protein, 6 aa, Mycobacterium tuberculosis
GRPRDR

SEQ ID NO: 1371777 - protein, 14 aa, Mycobacterium tuberculosis
GRPSAEDVDPDTEF

SEQ ID NO: 1371778 - protein, 9 aa, Mycobacterium tuberculosis
GRQSEEGSG

SEQ ID NO: 1371779 - protein, 12 aa, Mycobacterium tuberculosis
GRQSRGAGDPAS

SEQ ID NO: 1371780 - protein, 10 aa, Mycobacterium tuberculosis
GRRARRGWST

SEQ ID NO: 1371781 - protein, 4 aa, Mycobacterium tuberculosis
GRRG

SEQ ID NO: 1371782 - protein, 5 aa, Mycobacterium tuberculosis
GRRLN

SEQ ID NO: 1371783 - protein, 14 aa, Mycobacterium tuberculosis
GRRRLGSAGGPAPW

SEQ ID NO: 1371784 - protein, 8 aa, Mycobacterium tuberculosis
GRRRPGWP

SEQ ID NO: 1371785 - protein, 18 aa, Mycobacterium tuberculosis
GRRRRRRRRRRGRHRRHW

SEQ ID NO: 1371786 - protein, 11 aa, Mycobacterium tuberculosis
GRTDEEEKNRL

SEQ ID NO: 1371787 - protein, 22 aa, Mycobacterium tuberculosis
GRVPGHGPGAGDSPAGRHRGTG

SEQ ID NO: 1371788 - protein, 7 aa, Mycobacterium tuberculosis
GRVPRSQ

SEQ ID NO: 1371789 - protein, 4 aa, Mycobacterium tuberculosis
GRYG

SEQ ID NO: 1371790 - protein, 12 aa, Mycobacterium tuberculosis
GSAGARDERGWE

SEQ ID NO: 1371791 - protein, 9 aa, Mycobacterium tuberculosis
GSANSGVMP

SEQ ID NO: 1371792 - protein, 12 aa, Mycobacterium tuberculosis
GSATRERRLCCP

SEQ ID NO: 1371793 - protein, 16 aa, Mycobacterium tuberculosis
GSDAVAGSAQRWKAIP

SEQ ID NO: 1371794 - protein, 10 aa, Mycobacterium tuberculosis
GSDPTGGDGR

SEQ ID NO: 1371795 - protein, 8 aa, Mycobacterium tuberculosis
GSGDGCRH

SEQ ID NO: 1371796 - protein, 4 aa, Mycobacterium tuberculosis
GSGL

SEQ ID NO: 1371797 - protein, 5 aa, Mycobacterium tuberculosis
GSGTL

SEQ ID NO: 1371798 - protein, 7 aa, Mycobacterium tuberculosis
GSGTQFR

SEQ ID NO: 1371799 - protein, 4 aa, Mycobacterium tuberculosis
GSGV

SEQ ID NO: 1371800 - protein, 6 aa, Mycobacterium tuberculosis
GSKIES

SEQ ID NO: 1371801 - protein, 5 aa, Mycobacterium tuberculosis
GSLGV

SEQ ID NO: 1371802 - protein, 12 aa, Mycobacterium tuberculosis
GSPAVMGGDTNH

SEQ ID NO: 1371803 - protein, 7 aa, Mycobacterium tuberculosis
GSPDAAL

SEQ ID NO: 1371804 - protein, 4 aa, Mycobacterium tuberculosis
GSPE

SEQ ID NO: 1371805 - protein, 22 aa, Mycobacterium tuberculosis
GSPRTRSSRWPNDMGRQPRSRP

SEQ ID NO: 1371806 - protein, 10 aa, Mycobacterium tuberculosis
GSRRPGADDL

SEQ ID NO: 1371807 - protein, 12 aa, Mycobacterium tuberculosis
GSRRPHSCSRGC

SEQ ID NO: 1371808 - protein, 13 aa, Mycobacterium tuberculosis
GSSAIAKASLDAS

SEQ ID NO: 1371809 - protein, 10 aa, Mycobacterium tuberculosis
GSSDGSYAGL

SEQ ID NO: 1371810 - protein, 7 aa, Mycobacterium tuberculosis
GSSGGKN

SEQ ID NO: 1371811 - protein, 4 aa, Mycobacterium tuberculosis
GSSP

SEQ ID NO: 1371812 - protein, 35 aa, Mycobacterium tuberculosis; identical to SEQ ID NO: 155272

SEQ ID NO: 1371813 - protein, 5 aa, Mycobacterium tuberculosis
GSSRC

SEQ ID NO: 1371814 - protein, 10 aa, Mycobacterium tuberculosis
GSSTEPPTTR

SEQ ID NO: 1371815 - protein, 15 aa, Mycobacterium tuberculosis
GSTAAAATAAVAPPR

SEQ ID NO: 1371816 - protein, 4 aa, Mycobacterium tuberculosis
GSTQ

SEQ ID NO: 1371817 - protein, 7 aa, Mycobacterium tuberculosis
GSTSGVI

SEQ ID NO: 1371818 - protein, 11 aa, Mycobacterium tuberculosis
GTAATAARAAP

SEQ ID NO: 1371819 - protein, 10 aa, Mycobacterium tuberculosis
GTASASSTDE

SEQ ID NO: 1371820 - protein, 17 aa, Mycobacterium tuberculosis
GTASGPARGRAGVTGRA

SEQ ID NO: 1371821 - protein, 4 aa, Mycobacterium tuberculosis
GTDQ

SEQ ID NO: 1371822 - protein, 25 aa, Mycobacterium tuberculosis
GTDYVPPPDPAGGNSDTTSPPIAGA

SEQ ID NO: 1371823 - protein, 7 aa, Mycobacterium tuberculosis
GTGGAEW

SEQ ID NO: 1371824 - protein, 7 aa, Mycobacterium tuberculosis
GTGGNSY

SEQ ID NO: 1371825 - protein, 7 aa, Mycobacterium tuberculosis
GTGMAGS

SEQ ID NO: 1371826 - protein, 12 aa, Mycobacterium tuberculosis
GTGTAQQGFPAD

SEQ ID NO: 1371827 - protein, 12 aa, Mycobacterium tuberculosis
GTNPPANQTSAI

SEQ ID NO: 1371828 - protein, 13 aa, Mycobacterium tuberculosis
GTNPPANQTSATT

SEQ ID NO: 1371829 - protein, 11 aa, Mycobacterium tuberculosis
GTSQAGESITA

SEQ ID NO: 1371830 - protein, 9 aa, Mycobacterium tuberculosis
GTTAAQQTL

SEQ ID NO: 1371831 - protein, 6 aa, Mycobacterium tuberculosis
GTTGPG

SEQ ID NO: 1371832 - protein, 11 aa, Mycobacterium tuberculosis
GTTHKASPGQV

SEQ ID NO: 1371833 - protein, 8 aa, Mycobacterium tuberculosis
GTVTAKPS

SEQ ID NO: 1371834 - protein, 17 aa, Mycobacterium tuberculosis
GVAGAGGAAAVDGGEAA

SEQ ID NO: 1371835 - protein, 15 aa, Mycobacterium tuberculosis
GVAGAGNRDGCRRRH

SEQ ID NO: 1371836 - protein, 6 aa, Mycobacterium tuberculosis
GVASDN

SEQ ID NO: 1371837 - protein, 17 aa, Mycobacterium tuberculosis
GVDRRRRSDAAHDCARG

SEQ ID NO: 1371838 - protein, 19 aa, Mycobacterium tuberculosis
GVGHQPRRAAAGARRRPVG

SEQ ID NO: 1371839 - protein, 17 aa, Mycobacterium tuberculosis
GVPARNEPPSDPSAPIP

SEQ ID NO: 1371840 - protein, 6 aa, Mycobacterium tuberculosis
GVPTEQ

SEQ ID NO: 1371841 - protein, 12 aa, Mycobacterium tuberculosis
GVPTTRATHRPW

SEQ ID NO: 1371842 - protein, 55 aa, Mycobacterium tuberculosis
GVRGAGQRRAGGGRTAQARRRTTFGSARPPRCGGRGAGRARPHRGVRRPRRPGCG

SEQ ID NO: 1371843 - protein, 8 aa, Mycobacterium tuberculosis
GVSAPQLG

SEQ ID NO: 1371844 - protein, 8 aa, Mycobacterium tuberculosis
GVSRGSPR

SEQ ID NO: 1371845 - protein, 7 aa, Mycobacterium tuberculosis
GVTPSAG

SEQ ID NO: 1371846 - protein, 4 aa, Mycobacterium tuberculosis
GYAG

SEQ ID NO: 1371847 - protein, 5 aa, Mycobacterium tuberculosis
GYCPG

SEQ ID NO: 1371848 - protein, 4 aa, Mycobacterium tuberculosis
GYQS

SEQ ID NO: 1371849 - protein, 48 aa, Mycobacterium tuberculosis
GYRPSNPSARRSKPDTERPWGQPNSTPRARKAAGSKISTRSGSARQPN

SEQ ID NO: 1371850 - protein, 5 aa, Mycobacterium tuberculosis
GYTGA

SEQ ID NO: 1371851 - protein, 17 aa, Mycobacterium tuberculosis
HAAAGVPAQAAAAPVDV

SEQ ID NO: 1371852 - protein, 7 aa, Mycobacterium tuberculosis
HAGAAGG

SEQ ID NO: 1371853 - protein, 23 aa, Mycobacterium tuberculosis
HAGRAGDFASARQPRRGGGDVTE

SEQ ID NO: 1371854 - protein, 16 aa, Mycobacterium tuberculosis
HAKPGGLPAGGQHRGL

SEQ ID NO: 1371855 - protein, 11 aa, Mycobacterium tuberculosis
HAPAGDQPAAI

SEQ ID NO: 1371856 - protein, 16 aa, Mycobacterium tuberculosis
HAPAGPPSRCPRGYSP

SEQ ID NO: 1371857 - protein, 4 aa, Mycobacterium tuberculosis
HARG

SEQ ID NO: 1371858 - protein, 6 aa, Mycobacterium tuberculosis
HARGQA

SEQ ID NO: 1371859 - protein, 7 aa, Mycobacterium tuberculosis
HARRQPA

SEQ ID NO: 1371860 - protein, 10 aa, Mycobacterium tuberculosis
HARVGDDGGR

SEQ ID NO: 1371861 - protein, 20 aa, Mycobacterium tuberculosis
HCQEHGNDRRPTPLRFFFFF

SEQ ID NO: 1371862 - protein, 4 aa, Mycobacterium tuberculosis
HCRD

SEQ ID NO: 1371863 - protein, 6 aa, Mycobacterium tuberculosis
HDDGDS

SEQ ID NO: 1371864 - protein, 8 aa, Mycobacterium tuberculosis
HDEAKAGG

SEQ ID NO: 1371865 - protein, 11 aa, Mycobacterium tuberculosis
HDGARHDVPGA

SEQ ID NO: 1371866 - protein, 9 aa, Mycobacterium tuberculosis
HDNDGSGAA

SEQ ID NO: 1371867 - protein, 5 aa, Mycobacterium tuberculosis
HDPSQ

SEQ ID NO: 1371868 - protein, 5 aa, Mycobacterium tuberculosis
HDQPV

SEQ ID NO: 1371869 - protein, 8 aa, Mycobacterium tuberculosis
HDRVDPSS

SEQ ID NO: 1371870 - protein, 12 aa, Mycobacterium tuberculosis
HDSAATASTNVN

SEQ ID NO: 1371871 - protein, 6 aa, Mycobacterium tuberculosis
HDSGSH

SEQ ID NO: 1371872 - protein, 20 aa, Mycobacterium tuberculosis
HEIRTGAAAAAQALGPGSLG

SEQ ID NO: 1371873 - protein, 16 aa, Mycobacterium tuberculosis
HELRTPANVAAHQCRT

SEQ ID NO: 1371874 - protein, 12 aa, Mycobacterium tuberculosis
HGAGRAAVAPPS

SEQ ID NO: 1371875 - protein, 13 aa, Mycobacterium tuberculosis
HGAPGTGQPGGAG

SEQ ID NO: 1371876 - protein, 14 aa, Mycobacterium tuberculosis
HGDEQAVGAPLTTT

SEQ ID NO: 1371877 - protein, 5 aa, Mycobacterium tuberculosis
HGEAS

SEQ ID NO: 1371878 - protein, 25 aa, Mycobacterium tuberculosis
HGGDCRRDQPPPQAAPAGPAGRAGR

SEQ ID NO: 1371879 - protein, 15 aa, Mycobacterium tuberculosis
HGISTGPADTTGAAT

SEQ ID NO: 1371880 - protein, 9 aa, Mycobacterium tuberculosis
HGPDALQTR

SEQ ID NO: 1371881 - protein, 9 aa, Mycobacterium tuberculosis
HGPGWPSAA

SEQ ID NO: 1371882 - protein, 11 aa, Mycobacterium tuberculosis
HGPRLGPPPVM

SEQ ID NO: 1371883 - protein, 9 aa, Mycobacterium tuberculosis
HGQHPGLAG

SEQ ID NO: 1371884 - protein, 12 aa, Mycobacterium tuberculosis
HGRPFRRRNPRP

SEQ ID NO: 1371885 - protein, 4 aa, Mycobacterium tuberculosis
HHRN

SEQ ID NO: 1371886 - protein, 8 aa, Mycobacterium tuberculosis
HIGDSRTC

SEQ ID NO: 1371887 - protein, 8 aa, Mycobacterium tuberculosis
HISDSRSL

SEQ ID NO: 1371888 - protein, 8 aa, Mycobacterium tuberculosis
HKGERRPM

SEQ ID NO: 1371889 - protein, 35 aa, Mycobacterium tuberculosis
HLPDRGRRRDRTAPLYAGGRGGGRHGRAAAPCPHR

SEQ ID NO: 1371890 - protein, 35 aa, Mycobacterium tuberculosis
HLPDRGRRRDRTAPLYSGGRGGGRHGRAAAPCPHR

SEQ ID NO: 1371891 - protein, 12 aa, Mycobacterium tuberculosis
HNPDTSRRLTDE

SEQ ID NO: 1371892 - protein, 7 aa, Mycobacterium tuberculosis
HPADGTV

SEQ ID NO: 1371893 - protein, 15 aa, Mycobacterium tuberculosis
HPASRRDGSCGAGQG

SEQ ID NO: 1371894 - protein, 42 aa, Mycobacterium tuberculosis
HPEFEGPRRRARRERAERRAAQARATAIEQARRAAKRRARGQ

SEQ ID NO: 1371895 - protein, 7 aa, Mycobacterium tuberculosis
HPERDKQ

SEQ ID NO: 1371896 - protein, 15 aa, Mycobacterium tuberculosis
HPGHLPGRSGRAGRT

SEQ ID NO: 1371897 - protein, 11 aa, Mycobacterium tuberculosis
HPGPPPSSATC

SEQ ID NO: 1371898 - protein, 5 aa, Mycobacterium tuberculosis
HPGPR

SEQ ID NO: 1371899 - protein, 6 aa, Mycobacterium tuberculosis
HPLTTS

SEQ ID NO: 1371900 - protein, 4 aa, Mycobacterium tuberculosis
HPNS

SEQ ID NO: 1371901 - protein, 13 aa, Mycobacterium tuberculosis
HPPEPHPPIPTTP

SEQ ID NO: 1371902 - protein, 9 aa, Mycobacterium tuberculosis
HPRLTTKSR

SEQ ID NO: 1371903 - protein, 12 aa, Mycobacterium tuberculosis
HQARTEGRSGWS

SEQ ID NO: 1371904 - protein, 13 aa, Mycobacterium tuberculosis
HQGRAGRVRRRGR

SEQ ID NO: 1371905 - protein, 8 aa, Mycobacterium tuberculosis
HQRPKLER

SEQ ID NO: 1371906 - protein, 5 aa, Mycobacterium tuberculosis
HQSGC

SEQ ID NO: 1371907 - protein, 24 aa, Mycobacterium tuberculosis
HRDARLATAGATGQRDRPADLADA

SEQ ID NO: 1371908 - protein, 7 aa, Mycobacterium tuberculosis
HRGPEYG

SEQ ID NO: 1371909 - protein, 5 aa, Mycobacterium tuberculosis
HRNDH

SEQ ID NO: 1371910 - protein, 16 aa, Mycobacterium tuberculosis
HRRKAPIPGPKPPHTK

SEQ ID NO: 1371911 - protein, 23 aa, Mycobacterium tuberculosis
HRSRRTDAQPNDAESACGLAVFP

SEQ ID NO: 1371912 - protein, 7 aa, Mycobacterium tuberculosis
HSLSGAE

SEQ ID NO: 1371913 - protein, 7 aa, Mycobacterium tuberculosis
HTATDAA

SEQ ID NO: 1371914 - protein, 6 aa, Mycobacterium tuberculosis
HTGPGT

SEQ ID NO: 1371915 - protein, 5 aa, Mycobacterium tuberculosis
HTGPI

SEQ ID NO: 1371916 - protein, 9 aa, Mycobacterium tuberculosis
HTREPGPYL

SEQ ID NO: 1371917 - protein, 5 aa, Mycobacterium tuberculosis
HTRGE

SEQ ID NO: 1371918 - protein, 10 aa, Mycobacterium tuberculosis
HTSPGLEDQI

SEQ ID NO: 1371919 - protein, 19 aa, Mycobacterium tuberculosis
HTSPSLTSSSASVRDRSQA

SEQ ID NO: 1371920 - protein, 5 aa, Mycobacterium tuberculosis
HVSPR

SEQ ID NO: 1371921 - protein, 7 aa, Mycobacterium tuberculosis
IAASDDT

SEQ ID NO: 1371922 - protein, 9 aa, Mycobacterium tuberculosis
IAPNQDAQA

SEQ ID NO: 1371923 - protein, 7 aa, Mycobacterium tuberculosis
IATTGLA

SEQ ID NO: 1371924 - protein, 6 aa, Mycobacterium tuberculosis
IDASPA

SEQ ID NO: 1371925 - protein, 8 aa, Mycobacterium tuberculosis
IDPRDTRT

SEQ ID NO: 1371926 - protein, 7 aa, Mycobacterium tuberculosis
IDQTRDQ

SEQ ID NO: 1371927 - protein, 17 aa, Mycobacterium tuberculosis
IDRTTDVQQGCLLISSP

SEQ ID NO: 1371928 - protein, 10 aa, Mycobacterium tuberculosis
IDTDQIQPYD

SEQ ID NO: 1371929 - protein, 10 aa, Mycobacterium tuberculosis
IEERSGHASY

SEQ ID NO: 1371930 - protein, 8 aa, Mycobacterium tuberculosis
IEGVASPQ

SEQ ID NO: 1371931 - protein, 5 aa, Mycobacterium tuberculosis
IERGE

SEQ ID NO: 1371932 - protein, 4 aa, Mycobacterium tuberculosis
IGAS

SEQ ID NO: 1371933 - protein, 9 aa, Mycobacterium tuberculosis
IGDPGDLSQ

SEQ ID NO: 1371934 - protein, 9 aa, Mycobacterium tuberculosis
IGENTKGRH

SEQ ID NO: 1371935 - protein, 16 aa, Mycobacterium tuberculosis
IGGARDRVDRRQPTQS

SEQ ID NO: 1371936 - protein, 4 aa, Mycobacterium tuberculosis
IGGQ

SEQ ID NO: 1371937 - protein, 14 aa, Mycobacterium tuberculosis
IGPAPGYTAARPSL

SEQ ID NO: 1371938 - protein, 21 aa, Mycobacterium tuberculosis
IGPGTYPGDGQLRGEQPGRHG

SEQ ID NO: 1371939 - protein, 15 aa, Mycobacterium tuberculosis
IGPPRQLPADSPQGQ

SEQ ID NO: 1371940 - protein, 5 aa, Mycobacterium tuberculosis
IGPTQ

SEQ ID NO: 1371941 - protein, 10 aa, Mycobacterium tuberculosis
IHNPDRPPSR

SEQ ID NO: 1371942 - protein, 12 aa, Mycobacterium tuberculosis
IHPARSRSPSWA

SEQ ID NO: 1371943 - protein, 5 aa, Mycobacterium tuberculosis
INAGE

SEQ ID NO: 1371944 - protein, 10 aa, Mycobacterium tuberculosis
IPGPASQALT

SEQ ID NO: 1371945 - protein, 17 aa, Mycobacterium tuberculosis
IPGRRTRNGSVNGHPGM

SEQ ID NO: 1371946 - protein, 18 aa, Mycobacterium tuberculosis
IPPASTPLAAAAAAAGSV

SEQ ID NO: 1371947 - protein, 6 aa, Mycobacterium tuberculosis
IPPGKA

SEQ ID NO: 1371948 - protein, 11 aa, Mycobacterium tuberculosis
IPPRPADTRRA

SEQ ID NO: 1371949 - protein, 9 aa, Mycobacterium tuberculosis
IPPSAPPVI

SEQ ID NO: 1371950 - protein, 8 aa, Mycobacterium tuberculosis
IPRNPTGK

SEQ ID NO: 1371951 - protein, 10 aa, Mycobacterium tuberculosis
IPSSRTSPAL

SEQ ID NO: 1371952 - protein, 11 aa, Mycobacterium tuberculosis
IPTTPTHRDGR

SEQ ID NO: 1371953 - protein, 14 aa, Mycobacterium tuberculosis
IPVTTSGKVRRSAS

SEQ ID NO: 1371954 - protein, 28 aa, Mycobacterium tuberculosis
IRASRRPELGASPRAGASRAVKSRPEWG

SEQ ID NO: 1371955 - protein, 12 aa, Mycobacterium tuberculosis
IRQGSLENAADQ

SEQ ID NO: 1371956 - protein, 10 aa, Mycobacterium tuberculosis
IRTKPSTGRA

SEQ ID NO: 1371957 - protein, 4 aa, Mycobacterium tuberculosis
ISDN

SEQ ID NO: 1371958 - protein, 14 aa, Mycobacterium tuberculosis
ISPADPPAPPATPG

SEQ ID NO: 1371959 - protein, 24 aa, Mycobacterium tuberculosis
ISPRRSARCSRPTQRSSKASNSCR

SEQ ID NO: 1371960 - protein, 6 aa, Mycobacterium tuberculosis
ISRDKR

SEQ ID NO: 1371961 - protein, 8 aa, Mycobacterium tuberculosis
ISSKADDI

SEQ ID NO: 1371962 - protein, 19 aa, Mycobacterium tuberculosis
ISTSPSSSTFPATFPGAGS

SEQ ID NO: 1371963 - protein, 12 aa, Mycobacterium tuberculosis
ISTSPSSSTFPE

SEQ ID NO: 1371964 - protein, 7 aa, Mycobacterium tuberculosis
ISYSGNH

SEQ ID NO: 1371965 - protein, 144 aa, Mycobacterium tuberculosis
ITAPAPRPKFDPYGQYGRYGQYGQYGVQPGGYYGQQGAQQAAGLQSPGPQQSPQPPGYGSQYGGDSSSPSQSGSGYTAQPPAQPPAQSGSQQSHQGPSTPPTGFPSFSPPPPVSAGTGSQAGSAPVNYSNPSGGEQSSSPGGAP

SEQ ID NO: 1371966 - protein, 144 aa, Mycobacterium tuberculosis
ITAPAPRPKFDPYGQYGRYGQYGQYGVQPGGYYGQQGAQQAAGLQSPGPQQSPQPPGYGSQYGGYSSSPSQSGSGYTAQPPAQPPAQSGSQQSHQGPSTPPTGFPSFSPPPPVSAGTGSQAGSAPVNYSNPSGGEQSSSPGGAP

SEQ ID NO: 1371967 - protein, 5 aa, Mycobacterium tuberculosis
ITGGS

SEQ ID NO: 1371968 - protein, 9 aa, Mycobacterium tuberculosis
ITNNARGEV

SEQ ID NO: 1371969 - protein, 5 aa, Mycobacterium tuberculosis
ITNPG

SEQ ID NO: 1371970 - protein, 5 aa, Mycobacterium tuberculosis
ITPEA

SEQ ID NO: 1371971 - protein, 19 aa, Mycobacterium tuberculosis
ITSGVSPQGPGGPKAAATN

SEQ ID NO: 1371972 - protein, 5 aa, Mycobacterium tuberculosis
ITSSN

SEQ ID NO: 1371973 - protein, 5 aa, Mycobacterium tuberculosis
KALGG

SEQ ID NO: 1371974 - protein, 13 aa, Mycobacterium tuberculosis
KATGLSAKGAKTF

SEQ ID NO: 1371975 - protein, 7 aa, Mycobacterium tuberculosis
KAYEAPR

SEQ ID NO: 1371976 - protein, 5 aa, Mycobacterium tuberculosis
KDPLA

SEQ ID NO: 1371977 - protein, 6 aa, Mycobacterium tuberculosis
KDRRQH

SEQ ID NO: 1371978 - protein, 7 aa, Mycobacterium tuberculosis
KEANGSR

SEQ ID NO: 1371979 - protein, 8 aa, Mycobacterium tuberculosis
KEAYADGI

SEQ ID NO: 1371980 - protein, 30 aa, Mycobacterium tuberculosis
KEQAEPEYTEGVTTAKHTAERTDVDPDIGD

SEQ ID NO: 1371981 - protein, 6 aa, Mycobacterium tuberculosis
KETVQS

SEQ ID NO: 1371982 - protein, 10 aa, Mycobacterium tuberculosis
KGKPMAADAD

SEQ ID NO: 1371983 - protein, 16 aa, Mycobacterium tuberculosis
KGRRERAARAAPGGPI

SEQ ID NO: 1371984 - protein, 12 aa, Mycobacterium tuberculosis
KGSYEAARERLT

SEQ ID NO: 1371985 - protein, 22 aa, Mycobacterium tuberculosis
KIAGRSDGQTIPASLYAQWLTS

SEQ ID NO: 1371986 - protein, 53 aa, Mycobacterium tuberculosis
KKKKKKKKIKKKKKKKKKKKKKKKKKKKKKKKKKNKKKKKKKKKKKKKKKKKK

SEQ ID NO: 1371987 - protein, 12 aa, Mycobacterium tuberculosis
KKKKKKKKKKKK

SEQ ID NO: 1371988 - protein, 41 aa, Mycobacterium tuberculosis
KKKKKKKKKKKKKKKKKKKKKKKKKKKKKKKIKKTPPPPPP

SEQ ID NO: 1371989 - protein, 27 aa, Mycobacterium tuberculosis
KKKKKKKKKKKTKKKKHCRSAVLLGVL

SEQ ID NO: 1371990 - protein, 5 aa, Mycobacterium tuberculosis
KLADR

SEQ ID NO: 1371991 - protein, 5 aa, Mycobacterium tuberculosis
KLREV

SEQ ID NO: 1371992 - protein, 21 aa, Mycobacterium tuberculosis
KNKKKKKKKIKKKKKKKKKKK

SEQ ID NO: 1371993 - protein, 7 aa, Mycobacterium tuberculosis
KNRDPIA

SEQ ID NO: 1371994 - protein, 21 aa, Mycobacterium tuberculosis
KNTSQAKARAKARKAKAPKLV

SEQ ID NO: 1371995 - protein, 4 aa, Mycobacterium tuberculosis
KPAL

SEQ ID NO: 1371996 - protein, 4 aa, Mycobacterium tuberculosis
KPGT

SEQ ID NO: 1371997 - protein, 9 aa, Mycobacterium tuberculosis
KPPGHPPGF

SEQ ID NO: 1371998 - protein, 12 aa, Mycobacterium tuberculosis
KPSQASRSCSHR

SEQ ID NO: 1371999 - protein, 7 aa, Mycobacterium tuberculosis
KPSWIGS

SEQ ID NO: 1372000 - protein, 6 aa, Mycobacterium tuberculosis
KPSYGM

SEQ ID NO: 1372001 - protein, 15 aa, Mycobacterium tuberculosis
KQEGNEWKISSLLPV

SEQ ID NO: 1372002 - protein, 8 aa, Mycobacterium tuberculosis
KQRRDGQR

SEQ ID NO: 1372003 - protein, 17 aa, Mycobacterium tuberculosis
KRAATPKECRSKDPYVP

SEQ ID NO: 1372004 - protein, 7 aa, Mycobacterium tuberculosis
KRATQID

SEQ ID NO: 1372005 - protein, 16 aa, Mycobacterium tuberculosis
KRATTKRRWRRIGTVV

SEQ ID NO: 1372006 - protein, 24 aa, Mycobacterium tuberculosis
KRGAWTPATVASPTAMGSALETGQ

SEQ ID NO: 1372007 - protein, 10 aa, Mycobacterium tuberculosis
KRGDSDQDAM

SEQ ID NO: 1372008 - protein, 17 aa, Mycobacterium tuberculosis
KRGEGKGANDLLPPGGL

SEQ ID NO: 1372009 - protein, 9 aa, Mycobacterium tuberculosis
KRGGPAAGH

SEQ ID NO: 1372010 - protein, 13 aa, Mycobacterium tuberculosis
KRLPADSVTHWNG

SEQ ID NO: 1372011 - protein, 20 aa, Mycobacterium tuberculosis
KSASVDDAPRCSAANRRSGC

SEQ ID NO: 1372012 - protein, 7 aa, Mycobacterium tuberculosis
KSATGLS

SEQ ID NO: 1372013 - protein, 6 aa, Mycobacterium tuberculosis
KSAVMG

SEQ ID NO: 1372014 - protein, 8 aa, Mycobacterium tuberculosis
KSDGAERP

SEQ ID NO: 1372015 - protein, 14 aa, Mycobacterium tuberculosis
KSPQDPTEHADGAE

SEQ ID NO: 1372016 - protein, 10 aa, Mycobacterium tuberculosis
KTAPAGAGGT

SEQ ID NO: 1372017 - protein, 10 aa, Mycobacterium tuberculosis
KTHPRTPSGA

SEQ ID NO: 1372018 - protein, 9 aa, Mycobacterium tuberculosis
KTQGPGAWP

SEQ ID NO: 1372019 - protein, 16 aa, Mycobacterium tuberculosis
KTRVPGYAVSSAQSGV

SEQ ID NO: 1372020 - protein, 7 aa, Mycobacterium tuberculosis
KTSEEDM

SEQ ID NO: 1372021 - protein, 8 aa, Mycobacterium tuberculosis
KTVESGSL

SEQ ID NO: 1372022 - protein, 4 aa, Mycobacterium tuberculosis
KVPT

SEQ ID NO: 1372023 - protein, 4 aa, Mycobacterium tuberculosis
KWAS

SEQ ID NO: 1372024 - protein, 7 aa, Mycobacterium tuberculosis
KYGVTTE

SEQ ID NO: 1372025 - protein, 16 aa, Mycobacterium tuberculosis
LAAPAPHGALAGSGKL

SEQ ID NO: 1372026 - protein, 42 aa, Mycobacterium tuberculosis
LAAPPGKPPRGDQLGGRRRPPGPPGPPGSSGQPAGRLPQPGV

SEQ ID NO: 1372027 - protein, 10 aa, Mycobacterium tuberculosis
LADKGEPAAY

SEQ ID NO: 1372028 - protein, 6 aa, Mycobacterium tuberculosis
LADPRR

SEQ ID NO: 1372029 - protein, 9 aa, Mycobacterium tuberculosis
LADTPEKVR

SEQ ID NO: 1372030 - protein, 6 aa, Mycobacterium tuberculosis
LAEQSR

SEQ ID NO: 1372031 - protein, 6 aa, Mycobacterium tuberculosis
LAGAES

SEQ ID NO: 1372032 - protein, 6 aa, Mycobacterium tuberculosis
LAGPRA

SEQ ID NO: 1372033 - protein, 18 aa, Mycobacterium tuberculosis
LAGRRGDRHRRQRQRSAR

SEQ ID NO: 1372034 - protein, 9 aa, Mycobacterium tuberculosis
LAGSQNTGK

SEQ ID NO: 1372035 - protein, 17 aa, Mycobacterium tuberculosis
LAKAAAGGGNGYSLRTN

SEQ ID NO: 1372036 - protein, 12 aa, Mycobacterium tuberculosis
LAKTPDDRTQIR

SEQ ID NO: 1372037 - protein, 19 aa, Mycobacterium tuberculosis
LANIGSSISAASAAAAGPT

SEQ ID NO: 1372038 - protein, 16 aa, Mycobacterium tuberculosis
LAPGDRAVGRRPGSRP

SEQ ID NO: 1372039 - protein, 12 aa, Mycobacterium tuberculosis
LAPSPISGRPNS

SEQ ID NO: 1372040 - protein, 6 aa, Mycobacterium tuberculosis
LAPTPA

SEQ ID NO: 1372041 - protein, 12 aa, Mycobacterium tuberculosis
LARDESTSSAGA

SEQ ID NO: 1372042 - protein, 5 aa, Mycobacterium tuberculosis
LARGH

SEQ ID NO: 1372043 - protein, 22 aa, Mycobacterium tuberculosis
LASGRDSISNAAPPTPTATTTS

SEQ ID NO: 1372044 - protein, 6 aa, Mycobacterium tuberculosis
LATPGN

SEQ ID NO: 1372045 - protein, 5 aa, Mycobacterium tuberculosis
LATRR

SEQ ID NO: 1372046 - protein, 13 aa, Mycobacterium tuberculosis
LATSGRAVEAAGD

SEQ ID NO: 1372047 - protein, 16 aa, Mycobacterium tuberculosis
LDAPHDHHDRHDDHLG

SEQ ID NO: 1372048 - protein, 11 aa, Mycobacterium tuberculosis
LDEPSGDNCDL

SEQ ID NO: 1372049 - protein, 21 aa, Mycobacterium tuberculosis
LDGDSGSCGPLGPAGWSQPGR

SEQ ID NO: 1372050 - protein, 15 aa, Mycobacterium tuberculosis
LDGDSGSWGPLGPLG

SEQ ID NO: 1372051 - protein, 4 aa, Mycobacterium tuberculosis
LDGL

SEQ ID NO: 1372052 - protein, 12 aa, Mycobacterium tuberculosis
LDGPRASSGPCW

SEQ ID NO: 1372053 - protein, 9 aa, Mycobacterium tuberculosis
LDKPPGVAE

SEQ ID NO: 1372054 - protein, 17 aa, Mycobacterium tuberculosis
LDPETSRSARPILLHRS

SEQ ID NO: 1372055 - protein, 4 aa, Mycobacterium tuberculosis
LDSR

SEQ ID NO: 1372056 - protein, 11 aa, Mycobacterium tuberculosis
LDTEPPPAQGY

SEQ ID NO: 1372057 - protein, 12 aa, Mycobacterium tuberculosis
LEEYATARTRRG

SEQ ID NO: 1372058 - protein, 23 aa, Mycobacterium tuberculosis
LEPQAAPAPFEPPTAGSSLPTRI

SEQ ID NO: 1372059 - protein, 5 aa, Mycobacterium tuberculosis
LESQG

SEQ ID NO: 1372060 - protein, 16 aa, Mycobacterium tuberculosis
LEVRPSKGLQVFSFTY

SEQ ID NO: 1372061 - protein, 5 aa, Mycobacterium tuberculosis
LGAAA

SEQ ID NO: 1372062 - protein, 8 aa, Mycobacterium tuberculosis
LGAEPSAI

SEQ ID NO: 1372063 - protein, 13 aa, Mycobacterium tuberculosis
LGATGGLVVASAL

SEQ ID NO: 1372064 - protein, 12 aa, Mycobacterium tuberculosis
LGEHHPSGHRGV

SEQ ID NO: 1372065 - protein, 5 aa, Mycobacterium tuberculosis
LGQRE

SEQ ID NO: 1372066 - protein, 5 aa, Mycobacterium tuberculosis
LGSPE

SEQ ID NO: 1372067 - protein, 16 aa, Mycobacterium tuberculosis
LGSSGSGPGVPPTLGR

SEQ ID NO: 1372068 - protein, 7 aa, Mycobacterium tuberculosis
LGTPPTA

SEQ ID NO: 1372069 - protein, 11 aa, Mycobacterium tuberculosis
LKDSGKTMSDT

SEQ ID NO: 1372070 - protein, 6 aa, Mycobacterium tuberculosis
LNTEGV

SEQ ID NO: 1372071 - protein, 13 aa, Mycobacterium tuberculosis
LPAGAKITRTTTK

SEQ ID NO: 1372072 - protein, 7 aa, Mycobacterium tuberculosis
LPAPREA

SEQ ID NO: 1372073 - protein, 8 aa, Mycobacterium tuberculosis
LPARPGGH

SEQ ID NO: 1372074 - protein, 8 aa, Mycobacterium tuberculosis
LPDGPLTG

SEQ ID NO: 1372075 - protein, 22 aa, Mycobacterium tuberculosis
LPDGTPVSSGEGGGVRVGGGGA

SEQ ID NO: 1372076 - protein, 6 aa, Mycobacterium tuberculosis
LPDNGR

SEQ ID NO: 1372077 - protein, 6 aa, Mycobacterium tuberculosis
LPDTDE

SEQ ID NO: 1372078 - protein, 7 aa, Mycobacterium tuberculosis
LPEPLGS

SEQ ID NO: 1372079 - protein, 6 aa, Mycobacterium tuberculosis
LPGAHN

SEQ ID NO: 1372080 - protein, 8 aa, Mycobacterium tuberculosis
LPGRTRNR

SEQ ID NO: 1372081 - protein, 13 aa, Mycobacterium tuberculosis
LPGTDRRNLARRA

SEQ ID NO: 1372082 - protein, 7 aa, Mycobacterium tuberculosis
LPPGELT

SEQ ID NO: 1372083 - protein, 20 aa, Mycobacterium tuberculosis
LPPHPQRRHPRTEAARRHRR

SEQ ID NO: 1372084 - protein, 21 aa, Mycobacterium tuberculosis
LPPLPGCPAGPTVAAASGEAL

SEQ ID NO: 1372085 - protein, 18 aa, Mycobacterium tuberculosis
LPPQSSGGATGPSFPHWC

SEQ ID NO: 1372086 - protein, 19 aa, Mycobacterium tuberculosis
LPPRNTAHAGPVELVLPSP

SEQ ID NO: 1372087 - protein, 18 aa, Mycobacterium tuberculosis
LPPRNTSGSRDRAVQRDF

SEQ ID NO: 1372088 - protein, 16 aa, Mycobacterium tuberculosis
LPPRPGSTRTVDPPVR

SEQ ID NO: 1372089 - protein, 7 aa, Mycobacterium tuberculosis
LPPRVQA

SEQ ID NO: 1372090 - protein, 6 aa, Mycobacterium tuberculosis
LPQTTD

SEQ ID NO: 1372091 - protein, 7 aa, Mycobacterium tuberculosis
LPTGSHP

SEQ ID NO: 1372092 - protein, 4 aa, Mycobacterium tuberculosis
LPTP

SEQ ID NO: 1372093 - protein, 8 aa, Mycobacterium tuberculosis
LRAPAAEE

SEQ ID NO: 1372094 - protein, 26 aa, Mycobacterium tuberculosis
LRAPGRRRGSSPAGRTGRAANQPGDF

SEQ ID NO: 1372095 - protein, 7 aa, Mycobacterium tuberculosis
LRDKRTG

SEQ ID NO: 1372096 - protein, 10 aa, Mycobacterium tuberculosis
LRKAGSAGRA

SEQ ID NO: 1372097 - protein, 22 aa, Mycobacterium tuberculosis
LRPPGARTGFGPVSQPALSNDA

SEQ ID NO: 1372098 - protein, 33 aa, Mycobacterium tuberculosis
LRRKRDTRFAGADRPASDERSTTSGRGIGGGGL

SEQ ID NO: 1372099 - protein, 4 aa, Mycobacterium tuberculosis
LRSA

SEQ ID NO: 1372100 - protein, 5 aa, Mycobacterium tuberculosis
LRSGE

SEQ ID NO: 1372101 - protein, 15 aa, Mycobacterium tuberculosis
LSAAAAANTKHDIAN

SEQ ID NO: 1372102 - protein, 7 aa, Mycobacterium tuberculosis
LSAPGSM

SEQ ID NO: 1372103 - protein, 6 aa, Mycobacterium tuberculosis
LSDCDA

SEQ ID NO: 1372104 - protein, 16 aa, Mycobacterium tuberculosis
LSDRQRANLTTGATDR

SEQ ID NO: 1372105 - protein, 9 aa, Mycobacterium tuberculosis
LSHRNTQPG

SEQ ID NO: 1372106 - protein, 5 aa, Mycobacterium tuberculosis
LSKQP

SEQ ID NO: 1372107 - protein, 15 aa, Mycobacterium tuberculosis
LSNQKHTDLTARYGR

SEQ ID NO: 1372108 - protein, 12 aa, Mycobacterium tuberculosis
LSPAAGELQGPL

SEQ ID NO: 1372109 - protein, 6 aa, Mycobacterium tuberculosis
LSPDGR

SEQ ID NO: 1372110 - protein, 13 aa, Mycobacterium tuberculosis
LSPITSVAGRKGY

SEQ ID NO: 1372111 - protein, 26 aa, Mycobacterium tuberculosis
LSRSDHARARPDIARPGAGVPGSAAP

SEQ ID NO: 1372112 - protein, 4 aa, Mycobacterium tuberculosis
LSSA

SEQ ID NO: 1372113 - protein, 18 aa, Mycobacterium tuberculosis
LSSGSSPLPRRRRHATTR

SEQ ID NO: 1372114 - protein, 73 aa, Mycobacterium tuberculosis
LSTGDQPTAPGTPQRPGVTTTAAPPPSPAPASDGPTAEPAPPVQAPATGGPAPPLQQPLPPPPTTTNTQPAVT

SEQ ID NO: 1372115 - protein, 74 aa, Mycobacterium tuberculosis
LSTGDQPTAPGTPQRPGVTTTAAPPPSPAPASDGPTTEPAPPVQAPATGGPAPPLQQPLPPPPTTTNTQPGGDH

SEQ ID NO: 1372116 - protein, 70 aa, Mycobacterium tuberculosis
LSTGDQPTAPGTPQRPGVTTTAAPPPSPAPASDGPTTEPAPPVQAPATGGPAPPLRQPLPPPPTTTNRNR

SEQ ID NO: 1372117 - protein, 31 aa, Mycobacterium tuberculosis
LSTTTTTEPPGDTTFDDPTDSGRLRRREDDT

SEQ ID NO: 1372118 - protein, 31 aa, Mycobacterium tuberculosis
LTAGPSRGCTSISGAGTATRSCATRADGLPD

SEQ ID NO: 1372119 - protein, 6 aa, Mycobacterium tuberculosis
LTEAGA

SEQ ID NO: 1372120 - protein, 8 aa, Mycobacterium tuberculosis
LTEQDVYD

SEQ ID NO: 1372121 - protein, 10 aa, Mycobacterium tuberculosis
LTGSPVTPDH

SEQ ID NO: 1372122 - protein, 9 aa, Mycobacterium tuberculosis
LTPEPALPP

SEQ ID NO: 1372123 - protein, 11 aa, Mycobacterium tuberculosis
LTPGRGFRNGP

SEQ ID NO: 1372124 - protein, 17 aa, Mycobacterium tuberculosis
LTPRASRPGNPAGNGGW

SEQ ID NO: 1372125 - protein, 6 aa, Mycobacterium tuberculosis
LTRDPA

SEQ ID NO: 1372126 - protein, 7 aa, Mycobacterium tuberculosis
LTSDPVP

SEQ ID NO: 1372127 - protein, 7 aa, Mycobacterium tuberculosis
LVPGTAA

SEQ ID NO: 1372128 - protein, 90 aa, Mycobacterium tuberculosis
MAPRQPPAPPVTPPGVQPAPKPSYTPPAQPGPAGQRPGPTGQPSWAPNSGPMPASDPLPPRSTTRAAAGAHRRPAAPAPGPRPRAKTNPW

SEQ ID NO: 1372129 - protein, 20 aa, Mycobacterium tuberculosis
MAPTPGRPTRNGSVNGHPGM

SEQ ID NO: 1372130 - protein, 5 aa, Mycobacterium tuberculosis
MEQPG

SEQ ID NO: 1372131 - protein, 9 aa, Mycobacterium tuberculosis
MGPRAGIPQ

SEQ ID NO: 1372132 - protein, 38 aa, Mycobacterium tuberculosis
MGTHRATEPAATEPEVGAAPQPEAAVPAPARGSWRAQA

SEQ ID NO: 1372133 - protein, 7 aa, Mycobacterium tuberculosis
MKGPTEQ

SEQ ID NO: 1372134 - protein, 4 aa, Mycobacterium tuberculosis
MKGR

SEQ ID NO: 1372135 - protein, 35 aa, Mycobacterium tuberculosis
MPAQPAAEEPQPGTQRRTAAARSTRRTAASPIGGA

SEQ ID NO: 1372136 - protein, 11 aa, Mycobacterium tuberculosis
MPRPPRDPDQP

SEQ ID NO: 1372137 - protein, 16 aa, Mycobacterium tuberculosis
MPTQETTPTRGIPSGP

SEQ ID NO: 1372138 - protein, 16 aa, Mycobacterium tuberculosis
MSGSRPTESGDPTSQV

SEQ ID NO: 1372139 - protein, 8 aa, Mycobacterium tuberculosis
MSNPPPIT

SEQ ID NO: 1372140 - protein, 12 aa, Mycobacterium tuberculosis
MSRGELGPHPAA

SEQ ID NO: 1372141 - protein, 7 aa, Mycobacterium tuberculosis
MTPPPGM

SEQ ID NO: 1372142 - protein, 12 aa, Mycobacterium tuberculosis
MTSPSSRRCGCE

SEQ ID NO: 1372143 - protein, 17 aa, Mycobacterium tuberculosis
NAAPNPELRATAKRAIG

SEQ ID NO: 1372144 - protein, 20 aa, Mycobacterium tuberculosis
NAATTRAKDKGRGMQTTSRQ

SEQ ID NO: 1372145 - protein, 10 aa, Mycobacterium tuberculosis
NADVQSRPAR

SEQ ID NO: 1372146 - protein, 7 aa, Mycobacterium tuberculosis
NAGRHGG

SEQ ID NO: 1372147 - protein, 11 aa, Mycobacterium tuberculosis
NAHPVAQPPAQ

SEQ ID NO: 1372148 - protein, 9 aa, Mycobacterium tuberculosis
NANPPNAEL

SEQ ID NO: 1372149 - protein, 6 aa, Mycobacterium tuberculosis
NAPTQA

SEQ ID NO: 1372150 - protein, 5 aa, Mycobacterium tuberculosis
NAQLE

SEQ ID NO: 1372151 - protein, 10 aa, Mycobacterium tuberculosis
NARGGPGGAA

SEQ ID NO: 1372152 - protein, 13 aa, Mycobacterium tuberculosis
NATMTSAAPVPRR

SEQ ID NO: 1372153 - protein, 12 aa, Mycobacterium tuberculosis
NATTAAGLRATQ

SEQ ID NO: 1372154 - protein, 19 aa, Mycobacterium tuberculosis
NDAMDAAAQSAAADADPAK

SEQ ID NO: 1372155 - protein, 9 aa, Mycobacterium tuberculosis
NDASQPSMA

SEQ ID NO: 1372156 - protein, 14 aa, Mycobacterium tuberculosis
NDEVTYRADSAGTL

SEQ ID NO: 1372157 - protein, 5 aa, Mycobacterium tuberculosis
NDPAP

SEQ ID NO: 1372158 - protein, 5 aa, Mycobacterium tuberculosis
NEPGF

SEQ ID NO: 1372159 - protein, 16 aa, Mycobacterium tuberculosis
NGADGGPGQNGGPGGL

SEQ ID NO: 1372160 - protein, 14 aa, Mycobacterium tuberculosis
NGADGLPGQNGGAG

SEQ ID NO: 1372161 - protein, 12 aa, Mycobacterium tuberculosis
NGAVASSSGIVN

SEQ ID NO: 1372162 - protein, 5 aa, Mycobacterium tuberculosis
NGDAV

SEQ ID NO: 1372163 - protein, 51 aa, Mycobacterium tuberculosis
NGGAGGQGGSGGLGGSGGTGGAGMAAGPAGGTGGIGGIGGIGGAGGVGGHG

SEQ ID NO: 1372164 - protein, 29 aa, Mycobacterium tuberculosis
NGGAGGSAAAGSGLPAGTAVAPGCSEPAG

SEQ ID NO: 1372165 - protein, 21 aa, Mycobacterium tuberculosis
NGGAGGSGAPGQVGGDARGAG

SEQ ID NO: 1372166 - protein, 10 aa, Mycobacterium tuberculosis
NGGGPRGTDV

SEQ ID NO: 1372167 - protein, 23 aa, Mycobacterium tuberculosis
NGGNGGAGDAAHPNGGNGGDAGM

SEQ ID NO: 1372168 - protein, 46 aa, Mycobacterium tuberculosis; identical to SEQ ID NO: 181319

SEQ ID NO: 1372169 - protein, 22 aa, Mycobacterium tuberculosis
NGGNGGSGAAGQVGGPGGSPGL

SEQ ID NO: 1372170 - protein, 19 aa, Mycobacterium tuberculosis
NGGPGGLGPGSDPAGGVRP

SEQ ID NO: 1372171 - protein, 16 aa, Mycobacterium tuberculosis
NGKRVTSEPEGLATGN

SEQ ID NO: 1372172 - protein, 9 aa, Mycobacterium tuberculosis
NGLGPADEA

SEQ ID NO: 1372173 - protein, 4 aa, Mycobacterium tuberculosis
NGLR

SEQ ID NO: 1372174 - protein, 5 aa, Mycobacterium tuberculosis
NGNAL

SEQ ID NO: 1372175 - protein, 5 aa, Mycobacterium tuberculosis
NGNVT

SEQ ID NO: 1372176 - protein, 7 aa, Mycobacterium tuberculosis
NHPLTTS

SEQ ID NO: 1372177 - protein, 6 aa, Mycobacterium tuberculosis
NHYPED

SEQ ID NO: 1372178 - protein, 15 aa, Mycobacterium tuberculosis
NLRSKPLRPTGDGGV

SEQ ID NO: 1372179 - protein, 8 aa, Mycobacterium tuberculosis
NNKGRDRT

SEQ ID NO: 1372180 - protein, 9 aa, Mycobacterium tuberculosis
NNRSGGGVH

SEQ ID NO: 1372181 - protein, 12 aa, Mycobacterium tuberculosis
NNSTDDTATVAA

SEQ ID NO: 1372182 - protein, 14 aa, Mycobacterium tuberculosis
NNSYGLQQPPRLGA

SEQ ID NO: 1372183 - protein, 4 aa, Mycobacterium tuberculosis
NPAK

SEQ ID NO: 1372184 - protein, 24 aa, Mycobacterium tuberculosis
NPATGPQLDEAGRPLDDLSCFIAG

SEQ ID NO: 1372185 - protein, 10 aa, Mycobacterium tuberculosis
NPDPDAAGAC

SEQ ID NO: 1372186 - protein, 8 aa, Mycobacterium tuberculosis
NPEEGELR

SEQ ID NO: 1372187 - protein, 6 aa, Mycobacterium tuberculosis
NPGTSE

SEQ ID NO: 1372188 - protein, 24 aa, Mycobacterium tuberculosis
NPPPQPAGSAPTNLGEQVSRTDMT

SEQ ID NO: 1372189 - protein, 8 aa, Mycobacterium tuberculosis
NPQQTEAT

SEQ ID NO: 1372190 - protein, 17 aa, Mycobacterium tuberculosis
NPRRPDRGHDGCAGNLA

SEQ ID NO: 1372191 - protein, 22 aa, Mycobacterium tuberculosis
NPTAAMSQDELSGRVGCADVLT

SEQ ID NO: 1372192 - protein, 10 aa, Mycobacterium tuberculosis
NRAAGRRRVP

SEQ ID NO: 1372193 - protein, 28 aa, Mycobacterium tuberculosis
NRDPHHHDPAGSGAQQLPARVGNGRPAA

SEQ ID NO: 1372194 - protein, 4 aa, Mycobacterium tuberculosis
NRQA

SEQ ID NO: 1372195 - protein, 5 aa, Mycobacterium tuberculosis
NRQRQ

SEQ ID NO: 1372196 - protein, 47 aa, Mycobacterium tuberculosis; identical to SEQ ID NO: 192901

SEQ ID NO: 1372197 - protein, 12 aa, Mycobacterium tuberculosis
NSPGMGGDATRV

SEQ ID NO: 1372198 - protein, 14 aa, Mycobacterium tuberculosis
NSRPDAEPAEPPDG

SEQ ID NO: 1372199 - protein, 10 aa, Mycobacterium tuberculosis
NSTAGGAYVP

SEQ ID NO: 1372200 - protein, 5 aa, Mycobacterium tuberculosis
NSTDR

SEQ ID NO: 1372201 - protein, 28 aa, Mycobacterium tuberculosis
NSTPRSSNWRAPPCATSTPVRWTTRAYT

SEQ ID NO: 1372202 - protein, 4 aa, Mycobacterium tuberculosis
NSTR

SEQ ID NO: 1372203 - protein, 5 aa, Mycobacterium tuberculosis
NSTVP

SEQ ID NO: 1372204 - protein, 7 aa, Mycobacterium tuberculosis
NSYGSGP

SEQ ID NO: 1372205 - protein, 5 aa, Mycobacterium tuberculosis
NTADV

SEQ ID NO: 1372206 - protein, 7 aa, Mycobacterium tuberculosis
NTGQQVE

SEQ ID NO: 1372207 - protein, 19 aa, Mycobacterium tuberculosis
NTTATTDRDKVAPTRVVAA

SEQ ID NO: 1372208 - protein, 6 aa, Mycobacterium tuberculosis
NVGPNE

SEQ ID NO: 1372209 - protein, 5 aa, Mycobacterium tuberculosis
NVSTE

SEQ ID NO: 1372210 - protein, 6 aa, Mycobacterium tuberculosis
NVSTEI

SEQ ID NO: 1372211 - protein, 5 aa, Mycobacterium tuberculosis
NVVER

SEQ ID NO: 1372212 - protein, 14 aa, Mycobacterium tuberculosis
NYPEAWGDEDKRVA

SEQ ID NO: 1372213 - protein, 17 aa, Mycobacterium tuberculosis
PAAAAAPVPKWWSRRGR

SEQ ID NO: 1372214 - protein, 13 aa, Mycobacterium tuberculosis
PAAAARHGRARGG

SEQ ID NO: 1372215 - protein, 7 aa, Mycobacterium tuberculosis
PAADAAR

SEQ ID NO: 1372216 - protein, 4 aa, Mycobacterium tuberculosis
PAAF

SEQ ID NO: 1372217 - protein, 10 aa, Mycobacterium tuberculosis
PAAGQRTAQR

SEQ ID NO: 1372218 - protein, 15 aa, Mycobacterium tuberculosis
PADDGAPLAAAGGSR

SEQ ID NO: 1372219 - protein, 4 aa, Mycobacterium tuberculosis
PADR

SEQ ID NO: 1372220 - protein, 11 aa, Mycobacterium tuberculosis
PAETAAAQEAI

SEQ ID NO: 1372221 - protein, 15 aa, Mycobacterium tuberculosis
PAGCGSDSPAGSLTQ

SEQ ID NO: 1372222 - protein, 14 aa, Mycobacterium tuberculosis
PAGSVATDSATPGI

SEQ ID NO: 1372223 - protein, 14 aa, Mycobacterium tuberculosis
PAGTCGAGRRVPPR

SEQ ID NO: 1372224 - protein, 13 aa, Mycobacterium tuberculosis
PAGYGGRSNGGRR

SEQ ID NO: 1372225 - protein, 14 aa, Mycobacterium tuberculosis
PAHGGPAPTACSPQ

SEQ ID NO: 1372226 - protein, 9 aa, Mycobacterium tuberculosis
PAHRPSSRA

SEQ ID NO: 1372227 - protein, 9 aa, Mycobacterium tuberculosis
PAIRTRPGA

SEQ ID NO: 1372228 - protein, 7 aa, Mycobacterium tuberculosis
PAKIPTG

SEQ ID NO: 1372229 - protein, 13 aa, Mycobacterium tuberculosis
PAKSQQPTGTGGQ

SEQ ID NO: 1372230 - protein, 7 aa, Mycobacterium tuberculosis
PALAGAG

SEQ ID NO: 1372231 - protein, 10 aa, Mycobacterium tuberculosis
PALESTRATM

SEQ ID NO: 1372232 - protein, 18 aa, Mycobacterium tuberculosis
PALSGDPAPRRLRKDGAR

SEQ ID NO: 1372233 - protein, 5 aa, Mycobacterium tuberculosis
PANRK

SEQ ID NO: 1372234 - protein, 23 aa, Mycobacterium tuberculosis
PANRVNAAARGAENISDSNSGYP

SEQ ID NO: 1372235 - protein, 12 aa, Mycobacterium tuberculosis
PAPAVRPGSAHD

SEQ ID NO: 1372236 - protein, 7 aa, Mycobacterium tuberculosis
PAPDGGI

SEQ ID NO: 1372237 - protein, 12 aa, Mycobacterium tuberculosis
PAPDVSPGAAAS

SEQ ID NO: 1372238 - protein, 113 aa, Mycobacterium tuberculosis
PAPPPKPLKPKKPKQRRLRRKKTAKGDEAEPEAAEEAENTELAAQEDEEAVEAPPESIESPGGEPESATREAPAAETATAEEPRGGLRNRRPTGKTSHRRRRTRSGVQVAKVD

SEQ ID NO: 1372239 - protein, 17 aa, Mycobacterium tuberculosis
PAPQGHRSRLQSTAGRR

SEQ ID NO: 1372240 - protein, 17 aa, Mycobacterium tuberculosis
PAPSGPTRRTAISSTAS

SEQ ID NO: 1372241 - protein, 46 aa, Mycobacterium tuberculosis
PAPSVNNGISPLPADQLPGTPPPVNDPLQRPGSGTVQCNGQQPNPC

SEQ ID NO: 1372242 - protein, 6 aa, Mycobacterium tuberculosis
PAPTSS

SEQ ID NO: 1372243 - protein, 6 aa, Mycobacterium tuberculosis
PAQGTL

SEQ ID NO: 1372244 - protein, 8 aa, Mycobacterium tuberculosis
PAQPMRQR

SEQ ID NO: 1372245 - protein, 7 aa, Mycobacterium tuberculosis
PAQPRYL

SEQ ID NO: 1372246 - protein, 29 aa, Mycobacterium tuberculosis
PARVTGRNVPSGAKGTSTIPSALTAPSTS

SEQ ID NO: 1372247 - protein, 10 aa, Mycobacterium tuberculosis
PASAAGGFAG

SEQ ID NO: 1372248 - protein, 18 aa, Mycobacterium tuberculosis
PASEIPPLPNTSSPKPMS

SEQ ID NO: 1372249 - protein, 5 aa, Mycobacterium tuberculosis
PASSF

SEQ ID NO: 1372250 - protein, 36 aa, Mycobacterium tuberculosis
PATAAFPPPAGPPPVTAAPAPPVEVPPPMPPPPPVT

SEQ ID NO: 1372251 - protein, 5 aa, Mycobacterium tuberculosis
PATEA

SEQ ID NO: 1372252 - protein, 10 aa, Mycobacterium tuberculosis
PAVGGGPAQH

SEQ ID NO: 1372253 - protein, 10 aa, Mycobacterium tuberculosis
PAVRTTSEDP

SEQ ID NO: 1372254 - protein, 74 aa, Mycobacterium tuberculosis
PCPAPRATSPPGRPAPPTTSETTEPNVTSSPASPSPTTSASVPTGTTPAIPTSASPAAPASPPTPWPVTSSPTM

SEQ ID NO: 1372255 - protein, 15 aa, Mycobacterium tuberculosis
PCSGDAANAPPPPSA

SEQ ID NO: 1372256 - protein, 7 aa, Mycobacterium tuberculosis
PDAEAAG

SEQ ID NO: 1372257 - protein, 9 aa, Mycobacterium tuberculosis
PDAEAGKDL

SEQ ID NO: 1372258 - protein, 10 aa, Mycobacterium tuberculosis
PDASPRLSPR

SEQ ID NO: 1372259 - protein, 6 aa, Mycobacterium tuberculosis
PDAVTT

SEQ ID NO: 1372260 - protein, 5 aa, Mycobacterium tuberculosis
PDDAS

SEQ ID NO: 1372261 - protein, 6 aa, Mycobacterium tuberculosis
PDDRTE

SEQ ID NO: 1372262 - protein, 4 aa, Mycobacterium tuberculosis
PDFQ

SEQ ID NO: 1372263 - protein, 9 aa, Mycobacterium tuberculosis
PDLPDHPGA

SEQ ID NO: 1372264 - protein, 4 aa, Mycobacterium tuberculosis
PDMD

SEQ ID NO: 1372265 - protein, 8 aa, Mycobacterium tuberculosis
PDRADGQH

SEQ ID NO: 1372266 - protein, 6 aa, Mycobacterium tuberculosis
PDTIDE

SEQ ID NO: 1372267 - protein, 4 aa, Mycobacterium tuberculosis
PEAE

SEQ ID NO: 1372268 - protein, 15 aa, Mycobacterium tuberculosis
PEAGAAPKTVRLTTS

SEQ ID NO: 1372269 - protein, 5 aa, Mycobacterium tuberculosis
PEANS

SEQ ID NO: 1372270 - protein, 8 aa, Mycobacterium tuberculosis
PEAPSPVS

SEQ ID NO: 1372271 - protein, 8 aa, Mycobacterium tuberculosis
PEAVHEPS

SEQ ID NO: 1372272 - protein, 8 aa, Mycobacterium tuberculosis
PEDDPGAR

SEQ ID NO: 1372273 - protein, 6 aa, Mycobacterium tuberculosis
PEPDRA

SEQ ID NO: 1372274 - protein, 15 aa, Mycobacterium tuberculosis
PEPPGAYSAARGRFN

SEQ ID NO: 1372275 - protein, 11 aa, Mycobacterium tuberculosis
PEQFGSDTPRR

SEQ ID NO: 1372276 - protein, 6 aa, Mycobacterium tuberculosis
PERPAP

SEQ ID NO: 1372277 - protein, 15 aa, Mycobacterium tuberculosis
PESGFSRSAVDAAQR

SEQ ID NO: 1372278 - protein, 5 aa, Mycobacterium tuberculosis
PETAV

SEQ ID NO: 1372279 - protein, 5 aa, Mycobacterium tuberculosis
PEVAA

SEQ ID NO: 1372280 - protein, 5 aa, Mycobacterium tuberculosis
PGAAE

SEQ ID NO: 1372281 - protein, 9 aa, Mycobacterium tuberculosis
PGADLDEDT

SEQ ID NO: 1372282 - protein, 5 aa, Mycobacterium tuberculosis
PGALG

SEQ ID NO: 1372283 - protein, 19 aa, Mycobacterium tuberculosis
PGAVGSGAALAGQAAESHG

SEQ ID NO: 1372284 - protein, 20 aa, Mycobacterium tuberculosis
PGCRPSPGRTANRSSTPQSR

SEQ ID NO: 1372285 - protein, 7 aa, Mycobacterium tuberculosis
PGDDEVS

SEQ ID NO: 1372286 - protein, 8 aa, Mycobacterium tuberculosis
PGEAAAAR

SEQ ID NO: 1372287 - protein, 16 aa, Mycobacterium tuberculosis
PGESDGTCGRGEPQAG

SEQ ID NO: 1372288 - protein, 16 aa, Mycobacterium tuberculosis
PGEYTQLTGRAGRRGI

SEQ ID NO: 1372289 - protein, 13 aa, Mycobacterium tuberculosis
PGGFQDPRSESAR

SEQ ID NO: 1372290 - protein, 4 aa, Mycobacterium tuberculosis
PGGM

SEQ ID NO: 1372291 - protein, 4 aa, Mycobacterium tuberculosis
PGGS

SEQ ID NO: 1372292 - protein, 73 aa, Mycobacterium tuberculosis
PGGSYPPPPPPPGPSGGHEPPPAAPPGGSGYAPPPPPSSGSGYPPPPPPPGGGAYPPPPPSAGGYAPPPPGPA

SEQ ID NO: 1372293 - protein, 9 aa, Mycobacterium tuberculosis
PGGVNSPDD

SEQ ID NO: 1372294 - protein, 5 aa, Mycobacterium tuberculosis
PGGYR

SEQ ID NO: 1372295 - protein, 9 aa, Mycobacterium tuberculosis
PGHPVSGEE

SEQ ID NO: 1372296 - protein, 15 aa, Mycobacterium tuberculosis
PGHTATPAGSIATPV

SEQ ID NO: 1372297 - protein, 13 aa, Mycobacterium tuberculosis
PGKRAATPRECRS

SEQ ID NO: 1372298 - protein, 10 aa, Mycobacterium tuberculosis
PGLPGGITKA

SEQ ID NO: 1372299 - protein, 15 aa, Mycobacterium tuberculosis
PGLSQPSDVLPADDG

SEQ ID NO: 1372300 - protein, 9 aa, Mycobacterium tuberculosis
PGPPTPPMP

SEQ ID NO: 1372301 - protein, 7 aa, Mycobacterium tuberculosis
PGPVSTE

SEQ ID NO: 1372302 - protein, 7 aa, Mycobacterium tuberculosis
PGRSRAI

SEQ ID NO: 1372303 - protein, 10 aa, Mycobacterium tuberculosis
PGSLQAAAAG

SEQ ID NO: 1372304 - protein, 18 aa, Mycobacterium tuberculosis
PGVGSRPPLSTNARPEGV

SEQ ID NO: 1372305 - protein, 31 aa, Mycobacterium tuberculosis
PGVRPASGTPVGGRRGGPPPPASYAHRRPAS

SEQ ID NO: 1372306 - protein, 20 aa, Mycobacterium tuberculosis
PHAGNAPRTRRRDDSGGLHA

SEQ ID NO: 1372307 - protein, 10 aa, Mycobacterium tuberculosis
PHPPPLPPPP

SEQ ID NO: 1372308 - protein, 51 aa, Mycobacterium tuberculosis
PHTSKLATGDTTSSAPPVQDEITTTKPAPPPAPPAPPATTEIPTATETQTV

SEQ ID NO: 1372309 - protein, 49 aa, Mycobacterium tuberculosis
PHTSKLATGDTTSSAPPVQDEITTTKPAPPPAPPPTTEIPTATETQTVT

SEQ ID NO: 1372310 - protein, 8 aa, Mycobacterium tuberculosis
PIDETSLG

SEQ ID NO: 1372311 - protein, 8 aa, Mycobacterium tuberculosis
PIDPRSYS

SEQ ID NO: 1372312 - protein, 15 aa, Mycobacterium tuberculosis
PISPADPPAPPATPG

SEQ ID NO: 1372313 - protein, 9 aa, Mycobacterium tuberculosis
PKATRSHRR

SEQ ID NO: 1372314 - protein, 9 aa, Mycobacterium tuberculosis
PKSGYPGHA

SEQ ID NO: 1372315 - protein, 8 aa, Mycobacterium tuberculosis
PLNPPAAA

SEQ ID NO: 1372316 - protein, 6 aa, Mycobacterium tuberculosis
PLPNKQ

SEQ ID NO: 1372317 - protein, 4 aa, Mycobacterium tuberculosis
PLPP

SEQ ID NO: 1372318 - protein, 5 aa, Mycobacterium tuberculosis
PLPSL

SEQ ID NO: 1372319 - protein, 5 aa, Mycobacterium tuberculosis
PLQRA

SEQ ID NO: 1372320 - protein, 7 aa, Mycobacterium tuberculosis
PLRATQS

SEQ ID NO: 1372321 - protein, 21 aa, Mycobacterium tuberculosis
PLSGTTVPGSVPGKAPEEPPV

SEQ ID NO: 1372322 - protein, 12 aa, Mycobacterium tuberculosis
PLSVTTQLRTTW

SEQ ID NO: 1372323 - protein, 5 aa, Mycobacterium tuberculosis
PLTTE

SEQ ID NO: 1372324 - protein, 12 aa, Mycobacterium tuberculosis
PLTTTPSRGPGS

SEQ ID NO: 1372325 - protein, 60 aa, Mycobacterium tuberculosis
PNDCGDNGAVAAAAAGGMPAAGTDGPPTPTAGALGGRGGETVPGGGGPGGMGAVPNGDVG

SEQ ID NO: 1372326 - protein, 33 aa, Mycobacterium tuberculosis
PNDCGDNGAVAAAGGMPAAGTDGPPTPTAGALG

SEQ ID NO: 1372327 - protein, 47 aa, Mycobacterium tuberculosis
PNDCGDNGAVAAAGGMPAAGTDGPPTPTAGALGGRGGETVHGGGGPG

SEQ ID NO: 1372328 - protein, 23 aa, Mycobacterium tuberculosis
PPAPGPAPAPPAPGAGPGEHGGG

SEQ ID NO: 1372329 - protein, 6 aa, Mycobacterium tuberculosis
PPATVG

SEQ ID NO: 1372330 - protein, 15 aa, Mycobacterium tuberculosis
PPCPEPAAADPTDVP

SEQ ID NO: 1372331 - protein, 14 aa, Mycobacterium tuberculosis
PPEPTWRALSPMTR

SEQ ID NO: 1372332 - protein, 4 aa, Mycobacterium tuberculosis
PPEV

SEQ ID NO: 1372333 - protein, 6 aa, Mycobacterium tuberculosis
PPGDGP

SEQ ID NO: 1372334 - protein, 14 aa, Mycobacterium tuberculosis
PPGKDIVGVNSQVP

SEQ ID NO: 1372335 - protein, 21 aa, Mycobacterium tuberculosis
PPGNPPEPPQVTYPATIPPPP

SEQ ID NO: 1372336 - protein, 11 aa, Mycobacterium tuberculosis
PPGPASAPYNV

SEQ ID NO: 1372337 - protein, 8 aa, Mycobacterium tuberculosis
PPGQSGQL

SEQ ID NO: 1372338 - protein, 7 aa, Mycobacterium tuberculosis
PPNSSWP

SEQ ID NO: 1372339 - protein, 8 aa, Mycobacterium tuberculosis
PPNSSWPN

SEQ ID NO: 1372340 - protein, 22 aa, Mycobacterium tuberculosis
PPNWAGASPSLAPTVGSASAPL

SEQ ID NO: 1372341 - protein, 37 aa, Mycobacterium tuberculosis
PPPEDAGAMAPSNGPPDPQTEDEPAVPPPPPGAPDGV

SEQ ID NO: 1372342 - protein, 58 aa, Mycobacterium tuberculosis
PPPPPLPPPPPPPPPPPPPPPPPPPPPPPPPPPPPPPPPPTPPPPPPPPPPPPPPPPP

SEQ ID NO: 1372343 - protein, 46 aa, Mycobacterium tuberculosis
PPPPPPPPPPPPPPPPPPPPPPPPPPPPPPAPPPPRPPKTQKRKKK

SEQ ID NO: 1372344 - protein, 36 aa, Mycobacterium tuberculosis
PPPPPPPPPPPPSPPPRPPPPPPPPPPPPPPPPPPP

SEQ ID NO: 1372345 - protein, 8 aa, Mycobacterium tuberculosis
PPPPPPQL

SEQ ID NO: 1372346 - protein, 75 aa, Mycobacterium tuberculosis
PPPVAPGYAPAGYPPYPATPPGYGPPGYGAPPNYGPPPGYGPPLGYPAAPPGCGPPPGYGPPLGYGPPLAPGAVK

SEQ ID NO: 1372347 - protein, 75 aa, Mycobacterium tuberculosis; identical to SEQ ID NO: 155739

SEQ ID NO: 1372348 - protein, 4 aa, Mycobacterium tuberculosis
PPRI

SEQ ID NO: 1372349 - protein, 8 aa, Mycobacterium tuberculosis
PPRPGRIG

SEQ ID NO: 1372350 - protein, 6 aa, Mycobacterium tuberculosis
PPSEGL

SEQ ID NO: 1372351 - protein, 15 aa, Mycobacterium tuberculosis
PPSPPPQPTQYRQPY

SEQ ID NO: 1372352 - protein, 14 aa, Mycobacterium tuberculosis
PPTCGGRSDEEERR

SEQ ID NO: 1372353 - protein, 6 aa, Mycobacterium tuberculosis
PPTWTT

SEQ ID NO: 1372354 - protein, 5 aa, Mycobacterium tuberculosis
PPWPG

SEQ ID NO: 1372355 - protein, 9 aa, Mycobacterium tuberculosis
PQDFDTPTE

SEQ ID NO: 1372356 - protein, 8 aa, Mycobacterium tuberculosis
PQDGGDVG

SEQ ID NO: 1372357 - protein, 56 aa, Mycobacterium tuberculosis
PQEMPQQTGVGPRGAAPGRPVGPGRPRGVTAAARPAGSGNHGAARSGSSGPRADPP

SEQ ID NO: 1372358 - protein, 13 aa, Mycobacterium tuberculosis
PQGTPCDDPVEPH

SEQ ID NO: 1372359 - protein, 8 aa, Mycobacterium tuberculosis
PQHAGGGG

SEQ ID NO: 1372360 - protein, 8 aa, Mycobacterium tuberculosis
PQITPATP

SEQ ID NO: 1372361 - protein, 4 aa, Mycobacterium tuberculosis
PQLT

SEQ ID NO: 1372362 - protein, 15 aa, Mycobacterium tuberculosis
PQPPTIARGAHRVAL

SEQ ID NO: 1372363 - protein, 7 aa, Mycobacterium tuberculosis
PQRQRRG

SEQ ID NO: 1372364 - protein, 8 aa, Mycobacterium tuberculosis
PQSIEPSR

SEQ ID NO: 1372365 - protein, 7 aa, Mycobacterium tuberculosis
PQTADPV

SEQ ID NO: 1372366 - protein, 23 aa, Mycobacterium tuberculosis
PQTVPDATHPGAEQVTEQVTHPG

SEQ ID NO: 1372367 - protein, 10 aa, Mycobacterium tuberculosis
PRAGGLGRLG

SEQ ID NO: 1372368 - protein, 9 aa, Mycobacterium tuberculosis
PRAGLPGTK

SEQ ID NO: 1372369 - protein, 5 aa, Mycobacterium tuberculosis
PRAQS

SEQ ID NO: 1372370 - protein, 4 aa, Mycobacterium tuberculosis
PRER

SEQ ID NO: 1372371 - protein, 15 aa, Mycobacterium tuberculosis
PRGAGAAVGDAEHLS

SEQ ID NO: 1372372 - protein, 8 aa, Mycobacterium tuberculosis
PRGSTQVA

SEQ ID NO: 1372373 - protein, 7 aa, Mycobacterium tuberculosis
PRHRSSQ

SEQ ID NO: 1372374 - protein, 4 aa, Mycobacterium tuberculosis
PRLS

SEQ ID NO: 1372375 - protein, 16 aa, Mycobacterium tuberculosis
PRPAGWGGRHQGMSRK

SEQ ID NO: 1372376 - protein, 21 aa, Mycobacterium tuberculosis
PRPAPGQSPAPSLPSPTRHIQ

SEQ ID NO: 1372377 - protein, 6 aa, Mycobacterium tuberculosis
PRPDRE

SEQ ID NO: 1372378 - protein, 11 aa, Mycobacterium tuberculosis
PRPETSAGVPT

SEQ ID NO: 1372379 - protein, 22 aa, Mycobacterium tuberculosis
PRPGRPERPAPGGGVGARVPRP

SEQ ID NO: 1372380 - protein, 23 aa, Mycobacterium tuberculosis
PRPGTSPGVGGTPASPVPEAPAV

SEQ ID NO: 1372381 - protein, 7 aa, Mycobacterium tuberculosis
PRPGYGS

SEQ ID NO: 1372382 - protein, 14 aa, Mycobacterium tuberculosis
PRPSVSRTERRTGS

SEQ ID NO: 1372383 - protein, 4 aa, Mycobacterium tuberculosis
PRQL

SEQ ID NO: 1372384 - protein, 18 aa, Mycobacterium tuberculosis
PRRRTRQQSSDGKNGVRA

SEQ ID NO: 1372385 - protein, 19 aa, Mycobacterium tuberculosis
PRRRTRQQSSDGKNGVRAA

SEQ ID NO: 1372386 - protein, 12 aa, Mycobacterium tuberculosis
PRRSTPGSSDRR

SEQ ID NO: 1372387 - protein, 60 aa, Mycobacterium tuberculosis
PRRWGQPKAGSLSSKEPLDTGRTAAPMSNAPEPDRSAGESGSEPAGERSADPGEERTESY

SEQ ID NO: 1372388 - protein, 12 aa, Mycobacterium tuberculosis
PRSATVRRCATP

SEQ ID NO: 1372389 - protein, 5 aa, Mycobacterium tuberculosis
PRSSD

SEQ ID NO: 1372390 - protein, 14 aa, Mycobacterium tuberculosis
PRSYPSRKRRVRRR

SEQ ID NO: 1372391 - protein, 20 aa, Mycobacterium tuberculosis
PRWNPPTRRRIRRGSQHRKR

SEQ ID NO: 1372392 - protein, 19 aa, Mycobacterium tuberculosis
PSAATTSPPPSPQQEKPPR

SEQ ID NO: 1372393 - protein, 5 aa, Mycobacterium tuberculosis
PSAGA

SEQ ID NO: 1372394 - protein, 24 aa, Mycobacterium tuberculosis
PSDGARRGTPLVPDAGNGYQSHQG

SEQ ID NO: 1372395 - protein, 43 aa, Mycobacterium tuberculosis
PSINTGLNPAPADQVQGTPPPVSDPLQRRGSGTVQCNGQQPNP

SEQ ID NO: 1372396 - protein, 42 aa, Mycobacterium tuberculosis; identical to SEQ ID NO: 183459

SEQ ID NO: 1372397 - protein, 4 aa, Mycobacterium tuberculosis
PSMA

SEQ ID NO: 1372398 - protein, 4 aa, Mycobacterium tuberculosis
PSPA

SEQ ID NO: 1372399 - protein, 9 aa, Mycobacterium tuberculosis
PSSGNGDAA

SEQ ID NO: 1372400 - protein, 4 aa, Mycobacterium tuberculosis
PSTP

SEQ ID NO: 1372401 - protein, 20 aa, Mycobacterium tuberculosis
PSTQPAPPIRAPGGDAADTR

SEQ ID NO: 1372402 - protein, 6 aa, Mycobacterium tuberculosis
PSTWPP

SEQ ID NO: 1372403 - protein, 5 aa, Mycobacterium tuberculosis
PSVPR

SEQ ID NO: 1372404 - protein, 13 aa, Mycobacterium tuberculosis
PTATAPQTPPRSW

SEQ ID NO: 1372405 - protein, 7 aa, Mycobacterium tuberculosis
PTDGGVP

SEQ ID NO: 1372406 - protein, 8 aa, Mycobacterium tuberculosis
PTGAGKTV

SEQ ID NO: 1372407 - protein, 7 aa, Mycobacterium tuberculosis
PTLPDDM

SEQ ID NO: 1372408 - protein, 9 aa, Mycobacterium tuberculosis
PTPSLPPRW

SEQ ID NO: 1372409 - protein, 6 aa, Mycobacterium tuberculosis
PTPTAV

SEQ ID NO: 1372410 - protein, 15 aa, Mycobacterium tuberculosis
PTQETTPTRGIPSGP

SEQ ID NO: 1372411 - protein, 24 aa, Mycobacterium tuberculosis
PTSPSTSTGTATRTPGFQTSRTRQ

SEQ ID NO: 1372412 - protein, 14 aa, Mycobacterium tuberculosis
PTTGAVSDIEQATK

SEQ ID NO: 1372413 - protein, 6 aa, Mycobacterium tuberculosis
PTTRTA

SEQ ID NO: 1372414 - protein, 11 aa, Mycobacterium tuberculosis
PTVTPRGPGRL

SEQ ID NO: 1372415 - protein, 5 aa, Mycobacterium tuberculosis
PTYSN

SEQ ID NO: 1372416 - protein, 73 aa, Mycobacterium tuberculosis; identical to SEQ ID NO: 155751

SEQ ID NO: 1372417 - protein, 18 aa, Mycobacterium tuberculosis
PVDPASGQAFGRPSGVQG

SEQ ID NO: 1372418 - protein, 22 aa, Mycobacterium tuberculosis
PVGPAEPAGSAGSAATAATAVS

SEQ ID NO: 1372419 - protein, 13 aa, Mycobacterium tuberculosis
PVPNADAPLGPGQ

SEQ ID NO: 1372420 - protein, 5 aa, Mycobacterium tuberculosis
PVPSA

SEQ ID NO: 1372421 - protein, 16 aa, Mycobacterium tuberculosis
PVSEAGADDEDNELTD

SEQ ID NO: 1372422 - protein, 16 aa, Mycobacterium tuberculosis
PVSPPTQPEQQPQTEH

SEQ ID NO: 1372423 - protein, 11 aa, Mycobacterium tuberculosis
PYPARTGPKGS

SEQ ID NO: 1372424 - protein, 13 aa, Mycobacterium tuberculosis
QAADTLDGNGDSL

SEQ ID NO: 1372425 - protein, 10 aa, Mycobacterium tuberculosis
QAAGADAVHP

SEQ ID NO: 1372426 - protein, 4 aa, Mycobacterium tuberculosis
QAAT

SEQ ID NO: 1372427 - protein, 13 aa, Mycobacterium tuberculosis
QACGPRRGRGSGD

SEQ ID NO: 1372428 - protein, 7 aa, Mycobacterium tuberculosis
QADYDEA

SEQ ID NO: 1372429 - protein, 14 aa, Mycobacterium tuberculosis
QAGHEAVKGTPMAG

SEQ ID NO: 1372430 - protein, 6 aa, Mycobacterium tuberculosis
QAPGDN

SEQ ID NO: 1372431 - protein, 7 aa, Mycobacterium tuberculosis
QAPIQTV

SEQ ID NO: 1372432 - protein, 13 aa, Mycobacterium tuberculosis
QAQPAGSYGGVTP

SEQ ID NO: 1372433 - protein, 19 aa, Mycobacterium tuberculosis
QARAGAGAGTRTHRQPADA

SEQ ID NO: 1372434 - protein, 4 aa, Mycobacterium tuberculosis
QASA

SEQ ID NO: 1372435 - protein, 17 aa, Mycobacterium tuberculosis
QASASLQQARNARTALD

SEQ ID NO: 1372436 - protein, 13 aa, Mycobacterium tuberculosis
QASDGSDDQPEEV

SEQ ID NO: 1372437 - protein, 26 aa, Mycobacterium tuberculosis
QASSQSAPRAAQGSSKPAPGARPSAV

SEQ ID NO: 1372438 - protein, 6 aa, Mycobacterium tuberculosis
QASTDR

SEQ ID NO: 1372439 - protein, 11 aa, Mycobacterium tuberculosis
QATAGGPRPMT

SEQ ID NO: 1372440 - protein, 47 aa, Mycobacterium tuberculosis
QATQAAEAARSDAGQTGHGANGSPAGTHRSGDRQYGSTQPDYGAPAG

SEQ ID NO: 1372441 - protein, 14 aa, Mycobacterium tuberculosis
QAVTDGSRRQDLIT

SEQ ID NO: 1372442 - protein, 8 aa, Mycobacterium tuberculosis
QDARTQRC

SEQ ID NO: 1372443 - protein, 6 aa, Mycobacterium tuberculosis
QDGLPE

SEQ ID NO: 1372444 - protein, 18 aa, Mycobacterium tuberculosis
QDRCGVGGNDAKPRCAGN

SEQ ID NO: 1372445 - protein, 14 aa, Mycobacterium tuberculosis
QEFQKSANAQIIPE

SEQ ID NO: 1372446 - protein, 10 aa, Mycobacterium tuberculosis
QEMPQQPGWD

SEQ ID NO: 1372447 - protein, 5 aa, Mycobacterium tuberculosis
QENTT

SEQ ID NO: 1372448 - protein, 9 aa, Mycobacterium tuberculosis
QGAIQGARY

SEQ ID NO: 1372449 - protein, 6 aa, Mycobacterium tuberculosis
QGATGF

SEQ ID NO: 1372450 - protein, 4 aa, Mycobacterium tuberculosis
QGDA

SEQ ID NO: 1372451 - protein, 9 aa, Mycobacterium tuberculosis
QGPAPAPVT

SEQ ID NO: 1372452 - protein, 8 aa, Mycobacterium tuberculosis
QGPRDTQN

SEQ ID NO: 1372453 - protein, 8 aa, Mycobacterium tuberculosis
QGREGPVP

SEQ ID NO: 1372454 - protein, 20 aa, Mycobacterium tuberculosis
QGVTGAPARRRRRRRGDSDA

SEQ ID NO: 1372455 - protein, 21 aa, Mycobacterium tuberculosis
QGVTGAPARRRRRRRGDSDAI

SEQ ID NO: 1372456 - protein, 16 aa, Mycobacterium tuberculosis
QHEVDTAEVPSAAWGR

SEQ ID NO: 1372457 - protein, 49 aa, Mycobacterium tuberculosis
QHGPRPNQAVPPGGAGAAADQPDQRRPNRPRTHAGRATAGALGQRRQRY

SEQ ID NO: 1372458 - protein, 4 aa, Mycobacterium tuberculosis
QHKY

SEQ ID NO: 1372459 - protein, 13 aa, Mycobacterium tuberculosis
QHPRRPPNPDPAI

SEQ ID NO: 1372460 - protein, 6 aa, Mycobacterium tuberculosis
QIPSGR

SEQ ID NO: 1372461 - protein, 5 aa, Mycobacterium tuberculosis
QIQRN

SEQ ID NO: 1372462 - protein, 8 aa, Mycobacterium tuberculosis
QKFGGPHT

SEQ ID NO: 1372463 - protein, 10 aa, Mycobacterium tuberculosis
QKPDESERTF

SEQ ID NO: 1372464 - protein, 7 aa, Mycobacterium tuberculosis
QLAGPTV

SEQ ID NO: 1372465 - protein, 6 aa, Mycobacterium tuberculosis
QLPPPE

SEQ ID NO: 1372466 - protein, 23 aa, Mycobacterium tuberculosis
QNVRPAPPPERTAPILISGSVWS

SEQ ID NO: 1372467 - protein, 4 aa, Mycobacterium tuberculosis
QPAI

SEQ ID NO: 1372468 - protein, 9 aa, Mycobacterium tuberculosis
QPGGRASAA

SEQ ID NO: 1372469 - protein, 4 aa, Mycobacterium tuberculosis
QPGQ

SEQ ID NO: 1372470 - protein, 13 aa, Mycobacterium tuberculosis
QPMRRSNSCSTPI

SEQ ID NO: 1372471 - protein, 5 aa, Mycobacterium tuberculosis
QPPAK

SEQ ID NO: 1372472 - protein, 21 aa, Mycobacterium tuberculosis
QPPPPPGPVPAPGPAQAPPPE

SEQ ID NO: 1372473 - protein, 20 aa, Mycobacterium tuberculosis
QPRRRGSGRPGFYRPPGRPE

SEQ ID NO: 1372474 - protein, 5 aa, Mycobacterium tuberculosis
QPSEL

SEQ ID NO: 1372475 - protein, 23 aa, Mycobacterium tuberculosis
QPTDPDVAQPRWPTRRSSHAKKS

SEQ ID NO: 1372476 - protein, 8 aa, Mycobacterium tuberculosis
QPWPEPGD

SEQ ID NO: 1372477 - protein, 12 aa, Mycobacterium tuberculosis
QQAQQPQTGRTG

SEQ ID NO: 1372478 - protein, 12 aa, Mycobacterium tuberculosis
QQARNNKDPGAM

SEQ ID NO: 1372479 - protein, 27 aa, Mycobacterium tuberculosis
QQEPKQPPAPEPRPAPPPAKPAPPAGP

SEQ ID NO: 1372480 - protein, 28 aa, Mycobacterium tuberculosis
QQQAPVPPPPPDDPTAGFQGGTNPAVTG

SEQ ID NO: 1372481 - protein, 11 aa, Mycobacterium tuberculosis
QRGDAAAGRRA

SEQ ID NO: 1372482 - protein, 23 aa, Mycobacterium tuberculosis
QRPGSGDLAARARADAESHDLSS

SEQ ID NO: 1372483 - protein, 11 aa, Mycobacterium tuberculosis
QRPRARAVPRH

SEQ ID NO: 1372484 - protein, 43 aa, Mycobacterium tuberculosis
QRPRGRRRRVPRDVPRPSDRRPAHRAARAQPLPQQRGDRAVRR

SEQ ID NO: 1372485 - protein, 7 aa, Mycobacterium tuberculosis
QRRGGTS

SEQ ID NO: 1372486 - protein, 14 aa, Mycobacterium tuberculosis
QRRGSDRLRGRRRA

SEQ ID NO: 1372487 - protein, 10 aa, Mycobacterium tuberculosis
QRRRAGPQSQ

SEQ ID NO: 1372488 - protein, 20 aa, Mycobacterium tuberculosis
QRRTGTHGGRGDRDETQPAR

SEQ ID NO: 1372489 - protein, 5 aa, Mycobacterium tuberculosis
QRSRG

SEQ ID NO: 1372490 - protein, 10 aa, Mycobacterium tuberculosis
QRSTYRGRDA

SEQ ID NO: 1372491 - protein, 8 aa, Mycobacterium tuberculosis
QRVSPQDL

SEQ ID NO: 1372492 - protein, 4 aa, Mycobacterium tuberculosis
QRYH

SEQ ID NO: 1372493 - protein, 9 aa, Mycobacterium tuberculosis
QSDNFSGVA

SEQ ID NO: 1372494 - protein, 6 aa, Mycobacterium tuberculosis
QSGADT

SEQ ID NO: 1372495 - protein, 10 aa, Mycobacterium tuberculosis
QSGDAGSGHR

SEQ ID NO: 1372496 - protein, 6 aa, Mycobacterium tuberculosis
QSGLRP

SEQ ID NO: 1372497 - protein, 7 aa, Mycobacterium tuberculosis
QSGPGHE

SEQ ID NO: 1372498 - protein, 4 aa, Mycobacterium tuberculosis
QSLA

SEQ ID NO: 1372499 - protein, 7 aa, Mycobacterium tuberculosis
QSPPATG

SEQ ID NO: 1372500 - protein, 27 aa, Mycobacterium tuberculosis
QSPSAGRAAGSQSSSRSRQRPYSSVSP

SEQ ID NO: 1372501 - protein, 14 aa, Mycobacterium tuberculosis
QSPVPGETLPGTAQ

SEQ ID NO: 1372502 - protein, 6 aa, Mycobacterium tuberculosis
QSRERQ

SEQ ID NO: 1372503 - protein, 18 aa, Mycobacterium tuberculosis
QSSGGVDASEVTAAAGEE

SEQ ID NO: 1372504 - protein, 5 aa, Mycobacterium tuberculosis
QSSGM

SEQ ID NO: 1372505 - protein, 5 aa, Mycobacterium tuberculosis
QTASE

SEQ ID NO: 1372506 - protein, 16 aa, Mycobacterium tuberculosis
QTEAGTTSPTTSKSRT

SEQ ID NO: 1372507 - protein, 19 aa, Mycobacterium tuberculosis
QTELSEQRRYSGRGNPGLN

SEQ ID NO: 1372508 - protein, 7 aa, Mycobacterium tuberculosis
QTESKDL

SEQ ID NO: 1372509 - protein, 4 aa, Mycobacterium tuberculosis
QTET

SEQ ID NO: 1372510 - protein, 10 aa, Mycobacterium tuberculosis
QTETDADGST

SEQ ID NO: 1372511 - protein, 4 aa, Mycobacterium tuberculosis
QTFR

SEQ ID NO: 1372512 - protein, 11 aa, Mycobacterium tuberculosis
QTGGTAAGRPR

SEQ ID NO: 1372513 - protein, 5 aa, Mycobacterium tuberculosis
QTPAD

SEQ ID NO: 1372514 - protein, 5 aa, Mycobacterium tuberculosis
QTQDR

SEQ ID NO: 1372515 - protein, 5 aa, Mycobacterium tuberculosis
QTQRR

SEQ ID NO: 1372516 - protein, 18 aa, Mycobacterium tuberculosis
QTRRRADGCAAGRPCGRD

SEQ ID NO: 1372517 - protein, 6 aa, Mycobacterium tuberculosis
QTRVAQ

SEQ ID NO: 1372518 - protein, 5 aa, Mycobacterium tuberculosis
QTTGR

SEQ ID NO: 1372519 - protein, 9 aa, Mycobacterium tuberculosis
QVDVGGPTA

SEQ ID NO: 1372520 - protein, 10 aa, Mycobacterium tuberculosis
QVPGSGGIRG

SEQ ID NO: 1372521 - protein, 11 aa, Mycobacterium tuberculosis
QVPGSGGIRGP

SEQ ID NO: 1372522 - protein, 6 aa, Mycobacterium tuberculosis
QVRGGR

SEQ ID NO: 1372523 - protein, 15 aa, Mycobacterium tuberculosis
QVSRTSRPKTGGLAA

SEQ ID NO: 1372524 - protein, 22 aa, Mycobacterium tuberculosis
QVSTIDGSTGRRGAARSGYADP

SEQ ID NO: 1372525 - protein, 55 aa, Mycobacterium tuberculosis
QYGESGRRSRHSAEHRDHDIGGSGAGTGERPPSPPMAPPPPAEPTRRHKHRGHAA

SEQ ID NO: 1372526 - protein, 68 aa, Mycobacterium tuberculosis
QYGESGRRSRHSAEHRDHDIGGSGAGTGERPPSPPMAPPPPGEPTRQHRTADTPPDDSGGLHAPNPVT

SEQ ID NO: 1372527 - protein, 13 aa, Mycobacterium tuberculosis
RAAAAGARVAPGR

SEQ ID NO: 1372528 - protein, 25 aa, Mycobacterium tuberculosis
RAADRANPCRPAHQRRPADPARRPR

SEQ ID NO: 1372529 - protein, 36 aa, Mycobacterium tuberculosis
RAAGDPRPPHDPTHPLAESPRPARSSRASSPELTPA

SEQ ID NO: 1372530 - protein, 9 aa, Mycobacterium tuberculosis
RAAGRRRVP

SEQ ID NO: 1372531 - protein, 12 aa, Mycobacterium tuberculosis
RAARPGHPAGAV

SEQ ID NO: 1372532 - protein, 5 aa, Mycobacterium tuberculosis
RAASA

SEQ ID NO: 1372533 - protein, 5 aa, Mycobacterium tuberculosis
RADDE

SEQ ID NO: 1372534 - protein, 6 aa, Mycobacterium tuberculosis
RADHRD

SEQ ID NO: 1372535 - protein, 4 aa, Mycobacterium tuberculosis
RADS

SEQ ID NO: 1372536 - protein, 4 aa, Mycobacterium tuberculosis
RADT

SEQ ID NO: 1372537 - protein, 39 aa, Mycobacterium tuberculosis; identical to SEQ ID NO: 184673

SEQ ID NO: 1372538 - protein, 18 aa, Mycobacterium tuberculosis
RAEASGCAATAASSNGRN

SEQ ID NO: 1372539 - protein, 14 aa, Mycobacterium tuberculosis
RAEKFSPFSGFRLF

SEQ ID NO: 1372540 - protein, 8 aa, Mycobacterium tuberculosis
RAGHRGGH

SEQ ID NO: 1372541 - protein, 9 aa, Mycobacterium tuberculosis
RAGPKRRSG

SEQ ID NO: 1372542 - protein, 12 aa, Mycobacterium tuberculosis
RAGTGWRTGPPD

SEQ ID NO: 1372543 - protein, 17 aa, Mycobacterium tuberculosis
RAHPRPAGHPAGGVPVA

SEQ ID NO: 1372544 - protein, 30 aa, Mycobacterium tuberculosis; identical to SEQ ID NO: 230997

SEQ ID NO: 1372545 - protein, 8 aa, Mycobacterium tuberculosis
RAPHSAGV

SEQ ID NO: 1372546 - protein, 15 aa, Mycobacterium tuberculosis
RAPRTESRASSGSVA

SEQ ID NO: 1372547 - protein, 19 aa, Mycobacterium tuberculosis
RAPSARPDRTAAEKPGSFR

SEQ ID NO: 1372548 - protein, 35 aa, Mycobacterium tuberculosis
RAPSRTSPAPHRPPDPPDPETPSDNPCSANTSGQV

SEQ ID NO: 1372549 - protein, 5 aa, Mycobacterium tuberculosis
RAPTR

SEQ ID NO: 1372550 - protein, 9 aa, Mycobacterium tuberculosis
RARGQSAQL

SEQ ID NO: 1372551 - protein, 18 aa, Mycobacterium tuberculosis
RARPAGHRAPHRGSGFTG

SEQ ID NO: 1372552 - protein, 15 aa, Mycobacterium tuberculosis
RARPPAGSARRACGT

SEQ ID NO: 1372553 - protein, 18 aa, Mycobacterium tuberculosis
RARRRSPARCRPAYGPAT

SEQ ID NO: 1372554 - protein, 9 aa, Mycobacterium tuberculosis
RASAVSSGV

SEQ ID NO: 1372555 - protein, 14 aa, Mycobacterium tuberculosis
RASGRGAHARSGGR

SEQ ID NO: 1372556 - protein, 12 aa, Mycobacterium tuberculosis
RASPPSRPPRSD

SEQ ID NO: 1372557 - protein, 7 aa, Mycobacterium tuberculosis
RASSETA

SEQ ID NO: 1372558 - protein, 12 aa, Mycobacterium tuberculosis
RASSGPAKARRP

SEQ ID NO: 1372559 - protein, 12 aa, Mycobacterium tuberculosis
RASTTGLSPTGF

SEQ ID NO: 1372560 - protein, 6 aa, Mycobacterium tuberculosis
RATGPA

SEQ ID NO: 1372561 - protein, 13 aa, Mycobacterium tuberculosis
RCGRRPPSSPWRS

SEQ ID NO: 1372562 - protein, 17 aa, Mycobacterium tuberculosis
RDAGAGAGAGDRQGGQR

SEQ ID NO: 1372563 - protein, 18 aa, Mycobacterium tuberculosis
RDAHSRAGAGGPGRPVRH

SEQ ID NO: 1372564 - protein, 12 aa, Mycobacterium tuberculosis
RDDDRRPQDRSD

SEQ ID NO: 1372565 - protein, 6 aa, Mycobacterium tuberculosis
RDDGGV

SEQ ID NO: 1372566 - protein, 10 aa, Mycobacterium tuberculosis
RDDVPRDSRI

SEQ ID NO: 1372567 - protein, 8 aa, Mycobacterium tuberculosis
RDFPGRQN

SEQ ID NO: 1372568 - protein, 5 aa, Mycobacterium tuberculosis
RDGGD

SEQ ID NO: 1372569 - protein, 6 aa, Mycobacterium tuberculosis
RDGPRP

SEQ ID NO: 1372570 - protein, 6 aa, Mycobacterium tuberculosis
RDGPVV

SEQ ID NO: 1372571 - protein, 29 aa, Mycobacterium tuberculosis
RDGQRPARARTRARPFGPPRRTRSRRRRR

SEQ ID NO: 1372572 - protein, 9 aa, Mycobacterium tuberculosis
RDNANRMED

SEQ ID NO: 1372573 - protein, 8 aa, Mycobacterium tuberculosis
RDPRTARR

SEQ ID NO: 1372574 - protein, 12 aa, Mycobacterium tuberculosis
RDPTAPGGPHGI

SEQ ID NO: 1372575 - protein, 22 aa, Mycobacterium tuberculosis
RDRDGAAPIRGSSTPRALPTIN

SEQ ID NO: 1372576 - protein, 5 aa, Mycobacterium tuberculosis
RDRYQ

SEQ ID NO: 1372577 - protein, 12 aa, Mycobacterium tuberculosis
RDSDPAGADETD

SEQ ID NO: 1372578 - protein, 11 aa, Mycobacterium tuberculosis
RDSEPSMAGKD

SEQ ID NO: 1372579 - protein, 9 aa, Mycobacterium tuberculosis
RDVGGTPAC

SEQ ID NO: 1372580 - protein, 16 aa, Mycobacterium tuberculosis
RDVGHQHRNSGAGAAV

SEQ ID NO: 1372581 - protein, 16 aa, Mycobacterium tuberculosis
REAARNHDTLSSARGV

SEQ ID NO: 1372582 - protein, 4 aa, Mycobacterium tuberculosis
READ

SEQ ID NO: 1372583 - protein, 4 aa, Mycobacterium tuberculosis
REGL

SEQ ID NO: 1372584 - protein, 12 aa, Mycobacterium tuberculosis
REHGPDHAGARC

SEQ ID NO: 1372585 - protein, 7 aa, Mycobacterium tuberculosis
REPRTEG

SEQ ID NO: 1372586 - protein, 4 aa, Mycobacterium tuberculosis
REQQ

SEQ ID NO: 1372587 - protein, 6 aa, Mycobacterium tuberculosis
RETSTC

SEQ ID NO: 1372588 - protein, 13 aa, Mycobacterium tuberculosis
REVEQAEVGGSPR

SEQ ID NO: 1372589 - protein, 22 aa, Mycobacterium tuberculosis
RFAGQDRVAPEGQHGPGAGSGD

SEQ ID NO: 1372590 - protein, 6 aa, Mycobacterium tuberculosis
RFPDPK

SEQ ID NO: 1372591 - protein, 10 aa, Mycobacterium tuberculosis
RGAAKGYRSS

SEQ ID NO: 1372592 - protein, 11 aa, Mycobacterium tuberculosis
RGAERDRGRAV

SEQ ID NO: 1372593 - protein, 22 aa, Mycobacterium tuberculosis
RGAGRDGAGGVCGRDQGRRVGA

SEQ ID NO: 1372594 - protein, 9 aa, Mycobacterium tuberculosis
RGAPNGIDE

SEQ ID NO: 1372595 - protein, 8 aa, Mycobacterium tuberculosis
RGDATKSD

SEQ ID NO: 1372596 - protein, 4 aa, Mycobacterium tuberculosis
RGDG

SEQ ID NO: 1372597 - protein, 16 aa, Mycobacterium tuberculosis
RGDPASAEASHTSTPS

SEQ ID NO: 1372598 - protein, 5 aa, Mycobacterium tuberculosis
RGGAS

SEQ ID NO: 1372599 - protein, 6 aa, Mycobacterium tuberculosis
RGGGDL

SEQ ID NO: 1372600 - protein, 19 aa, Mycobacterium tuberculosis
RGGGDRGAVAGSHPPSPSC

SEQ ID NO: 1372601 - protein, 7 aa, Mycobacterium tuberculosis
RGGLTSS

SEQ ID NO: 1372602 - protein, 7 aa, Mycobacterium tuberculosis
RGGPAAG

SEQ ID NO: 1372603 - protein, 10 aa, Mycobacterium tuberculosis
RGGPLRPSEL

SEQ ID NO: 1372604 - protein, 21 aa, Mycobacterium tuberculosis
RGGQDQPGHRRDRQHAGRSAG

SEQ ID NO: 1372605 - protein, 8 aa, Mycobacterium tuberculosis
RGGTRRSC

SEQ ID NO: 1372606 - protein, 11 aa, Mycobacterium tuberculosis
RGHRDRRVDPA

SEQ ID NO: 1372607 - protein, 8 aa, Mycobacterium tuberculosis
RGKLTPRE

SEQ ID NO: 1372608 - protein, 5 aa, Mycobacterium tuberculosis
RGKWD

SEQ ID NO: 1372609 - protein, 9 aa, Mycobacterium tuberculosis
RGNPGPAGY

SEQ ID NO: 1372610 - protein, 6 aa, Mycobacterium tuberculosis
RGPTPP

SEQ ID NO: 1372611 - protein, 10 aa, Mycobacterium tuberculosis
RGQRRPATTR

SEQ ID NO: 1372612 - protein, 17 aa, Mycobacterium tuberculosis
RGQTGDCRRQATHPAAV

SEQ ID NO: 1372613 - protein, 15 aa, Mycobacterium tuberculosis
RGRARSVTGIAPAGG

SEQ ID NO: 1372614 - protein, 16 aa, Mycobacterium tuberculosis
RGRARSVTGIAPAGGW

SEQ ID NO: 1372615 - protein, 6 aa, Mycobacterium tuberculosis
RGRGRL

SEQ ID NO: 1372616 - protein, 5 aa, Mycobacterium tuberculosis
RGRHR

SEQ ID NO: 1372617 - protein, 6 aa, Mycobacterium tuberculosis
RGRSHR

SEQ ID NO: 1372618 - protein, 6 aa, Mycobacterium tuberculosis
RGSRAA

SEQ ID NO: 1372619 - protein, 12 aa, Mycobacterium tuberculosis
RGTAGRATAHPR

SEQ ID NO: 1372620 - protein, 4 aa, Mycobacterium tuberculosis
RGTD

SEQ ID NO: 1372621 - protein, 7 aa, Mycobacterium tuberculosis
RGTLPNQ

SEQ ID NO: 1372622 - protein, 19 aa, Mycobacterium tuberculosis
RGVGAGGRGLRRQDRHTDR

SEQ ID NO: 1372623 - protein, 31 aa, Mycobacterium tuberculosis
RGWPAAPRPHRSARSPESSPRQADWAVTSRR

SEQ ID NO: 1372624 - protein, 5 aa, Mycobacterium tuberculosis
RGYRG

SEQ ID NO: 1372625 - protein, 43 aa, Mycobacterium tuberculosis
RHAPAQGGSGRTQPAHRSPVGRGACQPAGPDAPSTPGHPQSEP

SEQ ID NO: 1372626 - protein, 5 aa, Mycobacterium tuberculosis
RHGLP

SEQ ID NO: 1372627 - protein, 7 aa, Mycobacterium tuberculosis
RHPCSAP

SEQ ID NO: 1372628 - protein, 9 aa, Mycobacterium tuberculosis
RHPNATAGN

SEQ ID NO: 1372629 - protein, 24 aa, Mycobacterium tuberculosis
RHPRRAGEHGERSHQRPARLADGS

SEQ ID NO: 1372630 - protein, 11 aa, Mycobacterium tuberculosis
RHTGADGRGPS

SEQ ID NO: 1372631 - protein, 14 aa, Mycobacterium tuberculosis
RHTPEPARLRPAVG

SEQ ID NO: 1372632 - protein, 10 aa, Mycobacterium tuberculosis
RISGDTSAAH

SEQ ID NO: 1372633 - protein, 29 aa, Mycobacterium tuberculosis
RKARPAAAPGPCREPGRLPGQQDRRRRRI

SEQ ID NO: 1372634 - protein, 4 aa, Mycobacterium tuberculosis
RKDP

SEQ ID NO: 1372635 - protein, 4 aa, Mycobacterium tuberculosis
RKGF

SEQ ID NO: 1372636 - protein, 9 aa, Mycobacterium tuberculosis
RKGRDQDRV

SEQ ID NO: 1372637 - protein, 19 aa, Mycobacterium tuberculosis
RKRARKWGDTVTQPDDPRR

SEQ ID NO: 1372638 - protein, 9 aa, Mycobacterium tuberculosis
RLDGERAPL

SEQ ID NO: 1372639 - protein, 12 aa, Mycobacterium tuberculosis
RLGARSGAGGIP

SEQ ID NO: 1372640 - protein, 9 aa, Mycobacterium tuberculosis
RLGDSRGDI

SEQ ID NO: 1372641 - protein, 13 aa, Mycobacterium tuberculosis
RLGPGGISGPPLA

SEQ ID NO: 1372642 - protein, 8 aa, Mycobacterium tuberculosis
RLPPGGQG

SEQ ID NO: 1372643 - protein, 12 aa, Mycobacterium tuberculosis
RLPTGGGAAARV

SEQ ID NO: 1372644 - protein, 9 aa, Mycobacterium tuberculosis
RLTSPTLPK

SEQ ID NO: 1372645 - protein, 5 aa, Mycobacterium tuberculosis
RNDGI

SEQ ID NO: 1372646 - protein, 13 aa, Mycobacterium tuberculosis
RNGSLASNSTRGE

SEQ ID NO: 1372647 - protein, 12 aa, Mycobacterium tuberculosis
RNPEVPHHTGLL

SEQ ID NO: 1372648 - protein, 7 aa, Mycobacterium tuberculosis
RNSDKAA

SEQ ID NO: 1372649 - protein, 7 aa, Mycobacterium tuberculosis
RNTYADR

SEQ ID NO: 1372650 - protein, 4 aa, Mycobacterium tuberculosis
RPAA

SEQ ID NO: 1372651 - protein, 12 aa, Mycobacterium tuberculosis
RPAATSPGPTPA

SEQ ID NO: 1372652 - protein, 9 aa, Mycobacterium tuberculosis
RPAGREHPR

SEQ ID NO: 1372653 - protein, 17 aa, Mycobacterium tuberculosis
RPASLDNPRSPRRRAGM

SEQ ID NO: 1372654 - protein, 6 aa, Mycobacterium tuberculosis
RPATAA

SEQ ID NO: 1372655 - protein, 4 aa, Mycobacterium tuberculosis
RPAV

SEQ ID NO: 1372656 - protein, 12 aa, Mycobacterium tuberculosis
RPDAYTAADKLT

SEQ ID NO: 1372657 - protein, 25 aa, Mycobacterium tuberculosis
RPDQRDLRPGRPDLCGPGTGVQSRQ

SEQ ID NO: 1372658 - protein, 6 aa, Mycobacterium tuberculosis
RPDRTE

SEQ ID NO: 1372659 - protein, 12 aa, Mycobacterium tuberculosis
RPDTGQRGSVLR

SEQ ID NO: 1372660 - protein, 6 aa, Mycobacterium tuberculosis
RPEFGT

SEQ ID NO: 1372661 - protein, 4 aa, Mycobacterium tuberculosis
RPGA

SEQ ID NO: 1372662 - protein, 20 aa, Mycobacterium tuberculosis
RPGATEPSDPALLAKTHANS

SEQ ID NO: 1372663 - protein, 16 aa, Mycobacterium tuberculosis
RPGPNRVGPKGALQSL

SEQ ID NO: 1372664 - protein, 14 aa, Mycobacterium tuberculosis
RPGTLAPPPSTFGQ

SEQ ID NO: 1372665 - protein, 16 aa, Mycobacterium tuberculosis
RPHQDALETGELSPYP

SEQ ID NO: 1372666 - protein, 18 aa, Mycobacterium tuberculosis
RPIPQPWPSPASARTFAL

SEQ ID NO: 1372667 - protein, 10 aa, Mycobacterium tuberculosis
RPKVADDSLT

SEQ ID NO: 1372668 - protein, 6 aa, Mycobacterium tuberculosis
RPLGAP

SEQ ID NO: 1372669 - protein, 5 aa, Mycobacterium tuberculosis
RPLNT

SEQ ID NO: 1372670 - protein, 23 aa, Mycobacterium tuberculosis
RPLPGRPTSIPTPSRSLASRTES

SEQ ID NO: 1372671 - protein, 13 aa, Mycobacterium tuberculosis
RPNGVSVKPTSGT

SEQ ID NO: 1372672 - protein, 9 aa, Mycobacterium tuberculosis
RPPDCRRAP

SEQ ID NO: 1372673 - protein, 26 aa, Mycobacterium tuberculosis
RPPGAAPSSAGCTTSHRQVHEDSGLR

SEQ ID NO: 1372674 - protein, 7 aa, Mycobacterium tuberculosis
RPPRLPP

SEQ ID NO: 1372675 - protein, 6 aa, Mycobacterium tuberculosis
RPPTSF

SEQ ID NO: 1372676 - protein, 15 aa, Mycobacterium tuberculosis
RPQAPGHGDSPPTQV

SEQ ID NO: 1372677 - protein, 19 aa, Mycobacterium tuberculosis
RPRAPSGAGDRGERGQGRA

SEQ ID NO: 1372678 - protein, 6 aa, Mycobacterium tuberculosis
RPRGAG

SEQ ID NO: 1372679 - protein, 7 aa, Mycobacterium tuberculosis
RPRPDFS

SEQ ID NO: 1372680 - protein, 4 aa, Mycobacterium tuberculosis
RPRR

SEQ ID NO: 1372681 - protein, 9 aa, Mycobacterium tuberculosis
RPRTNTSPK

SEQ ID NO: 1372682 - protein, 8 aa, Mycobacterium tuberculosis
RPSDRGSV

SEQ ID NO: 1372683 - protein, 4 aa, Mycobacterium tuberculosis
RPSG

SEQ ID NO: 1372684 - protein, 13 aa, Mycobacterium tuberculosis
RPSSGSRSAAHGH

SEQ ID NO: 1372685 - protein, 7 aa, Mycobacterium tuberculosis
RPTDRAR

SEQ ID NO: 1372686 - protein, 11 aa, Mycobacterium tuberculosis
RPTGVSPNNGF

SEQ ID NO: 1372687 - protein, 14 aa, Mycobacterium tuberculosis
RPVSTTGEAGNQNT

SEQ ID NO: 1372688 - protein, 4 aa, Mycobacterium tuberculosis
RQAA

SEQ ID NO: 1372689 - protein, 14 aa, Mycobacterium tuberculosis
RQEAPDRIEHHPPI

SEQ ID NO: 1372690 - protein, 11 aa, Mycobacterium tuberculosis
RQGPSPDPDVS

SEQ ID NO: 1372691 - protein, 27 aa, Mycobacterium tuberculosis
RQHQTRVASQRTTPGGRLSRSSVSTPM

SEQ ID NO: 1372692 - protein, 6 aa, Mycobacterium tuberculosis
RQPGCG

SEQ ID NO: 1372693 - protein, 6 aa, Mycobacterium tuberculosis
RQPPID

SEQ ID NO: 1372694 - protein, 8 aa, Mycobacterium tuberculosis
RQQRGSTV

SEQ ID NO: 1372695 - protein, 6 aa, Mycobacterium tuberculosis
RQRGCP

SEQ ID NO: 1372696 - protein, 10 aa, Mycobacterium tuberculosis
RQWSRPANAD

SEQ ID NO: 1372697 - protein, 8 aa, Mycobacterium tuberculosis
RRCEEKAE

SEQ ID NO: 1372698 - protein, 6 aa, Mycobacterium tuberculosis
RRCSRR

SEQ ID NO: 1372699 - protein, 34 aa, Mycobacterium tuberculosis
RRDTPTPRRDFTGTGCHPSPLAGYAQSGGEFGRA

SEQ ID NO: 1372700 - protein, 21 aa, Mycobacterium tuberculosis
RRGAGDPGRHTGTGRSRRGVA

SEQ ID NO: 1372701 - protein, 4 aa, Mycobacterium tuberculosis
RRGD

SEQ ID NO: 1372702 - protein, 11 aa, Mycobacterium tuberculosis
RRGDRAEGAAE

SEQ ID NO: 1372703 - protein, 5 aa, Mycobacterium tuberculosis
RRGGD

SEQ ID NO: 1372704 - protein, 10 aa, Mycobacterium tuberculosis
RRGPDAPGAA

SEQ ID NO: 1372705 - protein, 6 aa, Mycobacterium tuberculosis
RRGRAA

SEQ ID NO: 1372706 - protein, 11 aa, Mycobacterium tuberculosis
RRGRPPPRIGQ

SEQ ID NO: 1372707 - protein, 11 aa, Mycobacterium tuberculosis
RRGSGSGTRAV

SEQ ID NO: 1372708 - protein, 6 aa, Mycobacterium tuberculosis
RRGTQN

SEQ ID NO: 1372709 - protein, 9 aa, Mycobacterium tuberculosis
RRGTTSPSC

SEQ ID NO: 1372710 - protein, 11 aa, Mycobacterium tuberculosis
RRGVGGSRPRA

SEQ ID NO: 1372711 - protein, 9 aa, Mycobacterium tuberculosis
RRGVRSGEL

SEQ ID NO: 1372712 - protein, 16 aa, Mycobacterium tuberculosis
RRGYRAGPGVPGSRRD

SEQ ID NO: 1372713 - protein, 8 aa, Mycobacterium tuberculosis
RRHAESLG

SEQ ID NO: 1372714 - protein, 8 aa, Mycobacterium tuberculosis
RRHAPAPI

SEQ ID NO: 1372715 - protein, 20 aa, Mycobacterium tuberculosis
RRHPGVPPQVGPGAPNLAER

SEQ ID NO: 1372716 - protein, 17 aa, Mycobacterium tuberculosis
RRNEPISVGELQADAIA

SEQ ID NO: 1372717 - protein, 5 aa, Mycobacterium tuberculosis
RRNHA

SEQ ID NO: 1372718 - protein, 27 aa, Mycobacterium tuberculosis
RRPADGAGDPAEAGCDHDRRTAPVPSA

SEQ ID NO: 1372719 - protein, 16 aa, Mycobacterium tuberculosis
RRPASTQSWFWSAGSG

SEQ ID NO: 1372720 - protein, 20 aa, Mycobacterium tuberculosis
RRPDGRGADDATVEDRGAAD

SEQ ID NO: 1372721 - protein, 44 aa, Mycobacterium tuberculosis
RRPEPASLSRRQGTGRRAGDSRSAGQRNARVPGRDRRGGGAGHC

SEQ ID NO: 1372722 - protein, 7 aa, Mycobacterium tuberculosis
RRPGSAI

SEQ ID NO: 1372723 - protein, 10 aa, Mycobacterium tuberculosis
RRPGSSRPRR

SEQ ID NO: 1372724 - protein, 4 aa, Mycobacterium tuberculosis
RRPL

SEQ ID NO: 1372725 - protein, 13 aa, Mycobacterium tuberculosis
RRPRADRAGRRIL

SEQ ID NO: 1372726 - protein, 22 aa, Mycobacterium tuberculosis
RRPRRRQIDDTGDATSSKSALA

SEQ ID NO: 1372727 - protein, 12 aa, Mycobacterium tuberculosis
RRRAGSGECQCG

SEQ ID NO: 1372728 - protein, 14 aa, Mycobacterium tuberculosis
RRREGPGRDQRVAR

SEQ ID NO: 1372729 - protein, 5 aa, Mycobacterium tuberculosis
RRRGD

SEQ ID NO: 1372730 - protein, 15 aa, Mycobacterium tuberculosis
RRRGGQARPASMPGA

SEQ ID NO: 1372731 - protein, 17 aa, Mycobacterium tuberculosis
RRRPPPVVEPGPDRRPI

SEQ ID NO: 1372732 - protein, 13 aa, Mycobacterium tuberculosis
RRRRAPAVTDQPR

SEQ ID NO: 1372733 - protein, 13 aa, Mycobacterium tuberculosis
RRRRPRPGVSAPP

SEQ ID NO: 1372734 - protein, 17 aa, Mycobacterium tuberculosis
RRRSQHGAPRAPAVGAW

SEQ ID NO: 1372735 - protein, 35 aa, Mycobacterium tuberculosis
RRRTGHRRRGRPDARSSGGAATAKSCPTSRPGSSS

SEQ ID NO: 1372736 - protein, 12 aa, Mycobacterium tuberculosis
RRRTTACSGPSE

SEQ ID NO: 1372737 - protein, 13 aa, Mycobacterium tuberculosis
RRSDHRPTAGRRT

SEQ ID NO: 1372738 - protein, 14 aa, Mycobacterium tuberculosis
RRSGDCPGVPGPAR

SEQ ID NO: 1372739 - protein, 9 aa, Mycobacterium tuberculosis
RRSGHRHGD

SEQ ID NO: 1372740 - protein, 5 aa, Mycobacterium tuberculosis
RRSGY

SEQ ID NO: 1372741 - protein, 14 aa, Mycobacterium tuberculosis
RRSHRAGSCARRNC

SEQ ID NO: 1372742 - protein, 17 aa, Mycobacterium tuberculosis
RRSMPAHGPGPRPKNPL

SEQ ID NO: 1372743 - protein, 5 aa, Mycobacterium tuberculosis
RRSPG

SEQ ID NO: 1372744 - protein, 10 aa, Mycobacterium tuberculosis
RRSPPRPDMD

SEQ ID NO: 1372745 - protein, 34 aa, Mycobacterium tuberculosis
RRSQDGAAARRKRQRIRGDEPPFPDERDDSDGAV

SEQ ID NO: 1372746 - protein, 6 aa, Mycobacterium tuberculosis
RRSQPV

SEQ ID NO: 1372747 - protein, 12 aa, Mycobacterium tuberculosis
RRSREGQALEAA

SEQ ID NO: 1372748 - protein, 27 aa, Mycobacterium tuberculosis
RRTATPGCGHTTRPPSSRRAPVCLTWS

SEQ ID NO: 1372749 - protein, 9 aa, Mycobacterium tuberculosis
RRTPGSRGI

SEQ ID NO: 1372750 - protein, 12 aa, Mycobacterium tuberculosis
RRTTDDDMAGRD

SEQ ID NO: 1372751 - protein, 8 aa, Mycobacterium tuberculosis
RRVGDQPV

SEQ ID NO: 1372752 - protein, 7 aa, Mycobacterium tuberculosis
RRYPPRR

SEQ ID NO: 1372753 - protein, 12 aa, Mycobacterium tuberculosis
RSAGPGPASLQA

SEQ ID NO: 1372754 - protein, 6 aa, Mycobacterium tuberculosis
RSAGSW

SEQ ID NO: 1372755 - protein, 11 aa, Mycobacterium tuberculosis
RSASTPTPATL

SEQ ID NO: 1372756 - protein, 4 aa, Mycobacterium tuberculosis
RSAT

SEQ ID NO: 1372757 - protein, 26 aa, Mycobacterium tuberculosis
RSCGTSSRAGATARWSPSTTRGGTGI

SEQ ID NO: 1372758 - protein, 4 aa, Mycobacterium tuberculosis
RSDH

SEQ ID NO: 1372759 - protein, 12 aa, Mycobacterium tuberculosis
RSDPSWTTSGTT

SEQ ID NO: 1372760 - protein, 6 aa, Mycobacterium tuberculosis
RSDTDL

SEQ ID NO: 1372761 - protein, 8 aa, Mycobacterium tuberculosis
RSEDMAGD

SEQ ID NO: 1372762 - protein, 6 aa, Mycobacterium tuberculosis
RSGATA

SEQ ID NO: 1372763 - protein, 4 aa, Mycobacterium tuberculosis
RSGE

SEQ ID NO: 1372764 - protein, 7 aa, Mycobacterium tuberculosis
RSGISDS

SEQ ID NO: 1372765 - protein, 17 aa, Mycobacterium tuberculosis
RSGSTQCRPGRGRRQKY

SEQ ID NO: 1372766 - protein, 14 aa, Mycobacterium tuberculosis
RSGVTAASSPPSRR

SEQ ID NO: 1372767 - protein, 41 aa, Mycobacterium tuberculosis
RSHANAGPWLGRDGDSRWRRKQRPAATTKPRRRSNSPRPPR

SEQ ID NO: 1372768 - protein, 16 aa, Mycobacterium tuberculosis
RSMPAHGPGPRPKNPL

SEQ ID NO: 1372769 - protein, 5 aa, Mycobacterium tuberculosis
RSNGL

SEQ ID NO: 1372770 - protein, 5 aa, Mycobacterium tuberculosis
RSNRA

SEQ ID NO: 1372771 - protein, 8 aa, Mycobacterium tuberculosis
RSPKERPR

SEQ ID NO: 1372772 - protein, 23 aa, Mycobacterium tuberculosis
RSPPRTDRHRSAVEKDARRRPGC

SEQ ID NO: 1372773 - protein, 21 aa, Mycobacterium tuberculosis
RSPSTPTPACAAGPGNGGGEI

SEQ ID NO: 1372774 - protein, 27 aa, Mycobacterium tuberculosis
RSQECPRARPVGTDRAAATLDEDSWQD

SEQ ID NO: 1372775 - protein, 8 aa, Mycobacterium tuberculosis
RSQRGRKI

SEQ ID NO: 1372776 - protein, 11 aa, Mycobacterium tuberculosis
RSRAPKSLQRH

SEQ ID NO: 1372777 - protein, 17 aa, Mycobacterium tuberculosis
RSRNSRVEQDGQDRRAD

SEQ ID NO: 1372778 - protein, 8 aa, Mycobacterium tuberculosis
RSRPGTVG

SEQ ID NO: 1372779 - protein, 20 aa, Mycobacterium tuberculosis
RSRSPKATPAPSSTSPCMPS

SEQ ID NO: 1372780 - protein, 9 aa, Mycobacterium tuberculosis
RSSGGDSGA

SEQ ID NO: 1372781 - protein, 18 aa, Mycobacterium tuberculosis
RSSGPRTSAPPPPPPAEC

SEQ ID NO: 1372782 - protein, 12 aa, Mycobacterium tuberculosis
RSSPLRTEDPWL

SEQ ID NO: 1372783 - protein, 6 aa, Mycobacterium tuberculosis
RSSSRL

SEQ ID NO: 1372784 - protein, 13 aa, Mycobacterium tuberculosis
RSTGGLAGPQGRL

SEQ ID NO: 1372785 - protein, 5 aa, Mycobacterium tuberculosis
RSTPG

SEQ ID NO: 1372786 - protein, 6 aa, Mycobacterium tuberculosis
RSVPAP

SEQ ID NO: 1372787 - protein, 11 aa, Mycobacterium tuberculosis
RSVQGDGGIRS

SEQ ID NO: 1372788 - protein, 11 aa, Mycobacterium tuberculosis
RTAPKQGKDAN

SEQ ID NO: 1372789 - protein, 31 aa, Mycobacterium tuberculosis
RTASTDAAGDPAETHRGPANHTVGRRRLRGS

SEQ ID NO: 1372790 - protein, 14 aa, Mycobacterium tuberculosis
RTATEHTRLGVVSP

SEQ ID NO: 1372791 - protein, 7 aa, Mycobacterium tuberculosis
RTDGASA

SEQ ID NO: 1372792 - protein, 5 aa, Mycobacterium tuberculosis
RTEGR

SEQ ID NO: 1372793 - protein, 4 aa, Mycobacterium tuberculosis
RTER

SEQ ID NO: 1372794 - protein, 14 aa, Mycobacterium tuberculosis
RTFPDGRRAIDPLG

SEQ ID NO: 1372795 - protein, 11 aa, Mycobacterium tuberculosis
RTGQRHEPGTR

SEQ ID NO: 1372796 - protein, 4 aa, Mycobacterium tuberculosis
RTGR

SEQ ID NO: 1372797 - protein, 8 aa, Mycobacterium tuberculosis
RTHSSGRI

SEQ ID NO: 1372798 - protein, 7 aa, Mycobacterium tuberculosis
RTPPHVT

SEQ ID NO: 1372799 - protein, 13 aa, Mycobacterium tuberculosis
RTQGTDGVGRAAG

SEQ ID NO: 1372800 - protein, 7 aa, Mycobacterium tuberculosis
RTRRRSG

SEQ ID NO: 1372801 - protein, 8 aa, Mycobacterium tuberculosis
RTRSTDYS

SEQ ID NO: 1372802 - protein, 8 aa, Mycobacterium tuberculosis
RTSDDDMA

SEQ ID NO: 1372803 - protein, 9 aa, Mycobacterium tuberculosis
RTSRTGASH

SEQ ID NO: 1372804 - protein, 16 aa, Mycobacterium tuberculosis
RTTRTSGSSFPPSTKP

SEQ ID NO: 1372805 - protein, 26 aa, Mycobacterium tuberculosis
RTTTPTVGAATTATGWRPDSTGRHEG

SEQ ID NO: 1372806 - protein, 4 aa, Mycobacterium tuberculosis
RTVD

SEQ ID NO: 1372807 - protein, 8 aa, Mycobacterium tuberculosis
RTVQESGG

SEQ ID NO: 1372808 - protein, 5 aa, Mycobacterium tuberculosis
RTVSA

SEQ ID NO: 1372809 - protein, 4 aa, Mycobacterium tuberculosis
RTYP

SEQ ID NO: 1372810 - protein, 15 aa, Mycobacterium tuberculosis
RVDPADDRRVLAYTY

SEQ ID NO: 1372811 - protein, 24 aa, Mycobacterium tuberculosis
RVPGHGPEQATRPLVGTEEQGGVI

SEQ ID NO: 1372812 - protein, 20 aa, Mycobacterium tuberculosis
RVSEAGGFHDPELESSREQL

SEQ ID NO: 1372813 - protein, 21 aa, Mycobacterium tuberculosis
RVSGREKPGAAGDPDRRCRGN

SEQ ID NO: 1372814 - protein, 7 aa, Mycobacterium tuberculosis
RVTPSGD

SEQ ID NO: 1372815 - protein, 23 aa, Mycobacterium tuberculosis
RWGRTSSPTTVTSTRSGPRPGEA

SEQ ID NO: 1372816 - protein, 6 aa, Mycobacterium tuberculosis
RWPRGD

SEQ ID NO: 1372817 - protein, 7 aa, Mycobacterium tuberculosis
SAAAAGL

SEQ ID NO: 1372818 - protein, 25 aa, Mycobacterium tuberculosis
SAAAPRRQRSRRGATPAARAAAGAR

SEQ ID NO: 1372819 - protein, 17 aa, Mycobacterium tuberculosis
SAADGADSARCGRLPAD

SEQ ID NO: 1372820 - protein, 13 aa, Mycobacterium tuberculosis
SAANGAAAPTTAG

SEQ ID NO: 1372821 - protein, 17 aa, Mycobacterium tuberculosis
SAAPTDPSSSSTDSPVD

SEQ ID NO: 1372822 - protein, 16 aa, Mycobacterium tuberculosis
SAARDLADQAVSGRQA

SEQ ID NO: 1372823 - protein, 11 aa, Mycobacterium tuberculosis
SAATAGLSQRR

SEQ ID NO: 1372824 - protein, 14 aa, Mycobacterium tuberculosis
SAATARSSNPARIR

SEQ ID NO: 1372825 - protein, 12 aa, Mycobacterium tuberculosis
SAAVGREDERRS

SEQ ID NO: 1372826 - protein, 36 aa, Mycobacterium tuberculosis
SADATPAAVQASASLQQARNARTALDSASSGRADDW

SEQ ID NO: 1372827 - protein, 4 aa, Mycobacterium tuberculosis
SADK

SEQ ID NO: 1372828 - protein, 32 aa, Mycobacterium tuberculosis
SADPAADHSSAGLRATPVRRRTTVGGAGRYPC

SEQ ID NO: 1372829 - protein, 15 aa, Mycobacterium tuberculosis
SADPAKPIAGQHPST

SEQ ID NO: 1372830 - protein, 25 aa, Mycobacterium tuberculosis
SAESTEGDAAAGSGSRVLTGVGSAF

SEQ ID NO: 1372831 - protein, 6 aa, Mycobacterium tuberculosis
SAFPDG

SEQ ID NO: 1372832 - protein, 16 aa, Mycobacterium tuberculosis
SAGAGAYANAEAANVQ

SEQ ID NO: 1372833 - protein, 26 aa, Mycobacterium tuberculosis
SAGAQAGMTPGAAGCRSRPSPRCTDR

SEQ ID NO: 1372834 - protein, 30 aa, Mycobacterium tuberculosis
SAGCGPDARHRDTIGAGPQRSTRCWRRFEP

SEQ ID NO: 1372835 - protein, 8 aa, Mycobacterium tuberculosis
SAGGGGRG

SEQ ID NO: 1372836 - protein, 28 aa, Mycobacterium tuberculosis
SAGGNRRPFGGAGADGRVSGRSAPDQRV

SEQ ID NO: 1372837 - protein, 5 aa, Mycobacterium tuberculosis
SAGKI

SEQ ID NO: 1372838 - protein, 24 aa, Mycobacterium tuberculosis
SAGSPATARPPQRIGSAAPGRWCW

SEQ ID NO: 1372839 - protein, 5 aa, Mycobacterium tuberculosis
SAGTF

SEQ ID NO: 1372840 - protein, 8 aa, Mycobacterium tuberculosis
SAGTSGTA

SEQ ID NO: 1372841 - protein, 5 aa, Mycobacterium tuberculosis
SAGWD

SEQ ID NO: 1372842 - protein, 6 aa, Mycobacterium tuberculosis
SAHGIN

SEQ ID NO: 1372843 - protein, 4 aa, Mycobacterium tuberculosis
SALG

SEQ ID NO: 1372844 - protein, 4 aa, Mycobacterium tuberculosis
SALS

SEQ ID NO: 1372845 - protein, 8 aa, Mycobacterium tuberculosis
SALSREEV

SEQ ID NO: 1372846 - protein, 8 aa, Mycobacterium tuberculosis
SAMSDAQD

SEQ ID NO: 1372847 - protein, 7 aa, Mycobacterium tuberculosis
SAPPPPM

SEQ ID NO: 1372848 - protein, 9 aa, Mycobacterium tuberculosis
SAPSVPRSN

SEQ ID NO: 1372849 - protein, 21 aa, Mycobacterium tuberculosis
SAPTRRQVDDSVAAAKSKSAL

SEQ ID NO: 1372850 - protein, 5 aa, Mycobacterium tuberculosis
SARGP

SEQ ID NO: 1372851 - protein, 7 aa, Mycobacterium tuberculosis
SARNETE

SEQ ID NO: 1372852 - protein, 24 aa, Mycobacterium tuberculosis
SARRSPTCSGPTSCTAAARWRPST

SEQ ID NO: 1372853 - protein, 17 aa, Mycobacterium tuberculosis
SARSAKRERKNASTAAS

SEQ ID NO: 1372854 - protein, 32 aa, Mycobacterium tuberculosis
SARSRKKKKKKKKKKKKKKKKKKKKKKKKKKK

SEQ ID NO: 1372855 - protein, 9 aa, Mycobacterium tuberculosis
SARSYRGTI

SEQ ID NO: 1372856 - protein, 13 aa, Mycobacterium tuberculosis
SASESRNVLGTQD

SEQ ID NO: 1372857 - protein, 13 aa, Mycobacterium tuberculosis
SASIGARPSRSRP

SEQ ID NO: 1372858 - protein, 25 aa, Mycobacterium tuberculosis
SASRRHDGRPRPRRCRRSRSWPARR

SEQ ID NO: 1372859 - protein, 5 aa, Mycobacterium tuberculosis
SASTW

SEQ ID NO: 1372860 - protein, 12 aa, Mycobacterium tuberculosis
SATARGACATPF

SEQ ID NO: 1372861 - protein, 24 aa, Mycobacterium tuberculosis
SATASTTLPPWPPPAPLSPWAPAP

SEQ ID NO: 1372862 - protein, 9 aa, Mycobacterium tuberculosis
SATGLPGRV

SEQ ID NO: 1372863 - protein, 9 aa, Mycobacterium tuberculosis
SATRGGGNS

SEQ ID NO: 1372864 - protein, 8 aa, Mycobacterium tuberculosis
SATRTSRI

SEQ ID NO: 1372865 - protein, 9 aa, Mycobacterium tuberculosis
SATSPPALG

SEQ ID NO: 1372866 - protein, 5 aa, Mycobacterium tuberculosis
SATTA

SEQ ID NO: 1372867 - protein, 6 aa, Mycobacterium tuberculosis
SATTAF

SEQ ID NO: 1372868 - protein, 10 aa, Mycobacterium tuberculosis
SCDGGPSSRH

SEQ ID NO: 1372869 - protein, 47 aa, Mycobacterium tuberculosis
SCWRSSGRSATKSVTTNDAGTGNPAEQPARGAKQQPATETSRAGRDL

SEQ ID NO: 1372870 - protein, 5 aa, Mycobacterium tuberculosis
SDAPY

SEQ ID NO: 1372871 - protein, 9 aa, Mycobacterium tuberculosis
SDATDPGPT

SEQ ID NO: 1372872 - protein, 6 aa, Mycobacterium tuberculosis
SDCDAH

SEQ ID NO: 1372873 - protein, 6 aa, Mycobacterium tuberculosis
SDDKEP

SEQ ID NO: 1372874 - protein, 7 aa, Mycobacterium tuberculosis
SDGRTAP

SEQ ID NO: 1372875 - protein, 10 aa, Mycobacterium tuberculosis
SDIRAGRPAV

SEQ ID NO: 1372876 - protein, 13 aa, Mycobacterium tuberculosis
SDPANRGVIMDRG

SEQ ID NO: 1372877 - protein, 4 aa, Mycobacterium tuberculosis
SDPG

SEQ ID NO: 1372878 - protein, 5 aa, Mycobacterium tuberculosis
SDPGY

SEQ ID NO: 1372879 - protein, 4 aa, Mycobacterium tuberculosis
SDPL

SEQ ID NO: 1372880 - protein, 4 aa, Mycobacterium tuberculosis
SDRR

SEQ ID NO: 1372881 - protein, 26 aa, Mycobacterium tuberculosis
SDSPHGAAQLPGTPTHPGTGQAAASS

SEQ ID NO: 1372882 - protein, 6 aa, Mycobacterium tuberculosis
SDSPTY

SEQ ID NO: 1372883 - protein, 17 aa, Mycobacterium tuberculosis
SDTIGARSGTGAARARV

SEQ ID NO: 1372884 - protein, 5 aa, Mycobacterium tuberculosis
SDVAD

SEQ ID NO: 1372885 - protein, 7 aa, Mycobacterium tuberculosis
SEAGPAR

SEQ ID NO: 1372886 - protein, 8 aa, Mycobacterium tuberculosis
SEFPADRG

SEQ ID NO: 1372887 - protein, 6 aa, Mycobacterium tuberculosis
SEGSVR

SEQ ID NO: 1372888 - protein, 4 aa, Mycobacterium tuberculosis
SELP

SEQ ID NO: 1372889 - protein, 22 aa, Mycobacterium tuberculosis
SEQPEPERSRVPPRTTRAGERI

SEQ ID NO: 1372890 - protein, 6 aa, Mycobacterium tuberculosis
SERVQA

SEQ ID NO: 1372891 - protein, 6 aa, Mycobacterium tuberculosis
SESDEQ

SEQ ID NO: 1372892 - protein, 13 aa, Mycobacterium tuberculosis
SEVSGSHACLNAS

SEQ ID NO: 1372893 - protein, 26 aa, Mycobacterium tuberculosis
SFTPQASAVPGSDAERQAERAGTTQT

SEQ ID NO: 1372894 - protein, 14 aa, Mycobacterium tuberculosis
SGAAVGAASTLPGI

SEQ ID NO: 1372895 - protein, 13 aa, Mycobacterium tuberculosis
SGATTGSESPTKN

SEQ ID NO: 1372896 - protein, 19 aa, Mycobacterium tuberculosis
SGDLGEQSRRAAGRGDPAL

SEQ ID NO: 1372897 - protein, 18 aa, Mycobacterium tuberculosis
SGDPARALGPPPDGSYSF

SEQ ID NO: 1372898 - protein, 7 aa, Mycobacterium tuberculosis
SGEGADE

SEQ ID NO: 1372899 - protein, 9 aa, Mycobacterium tuberculosis
SGGADLPTQ

SEQ ID NO: 1372900 - protein, 8 aa, Mycobacterium tuberculosis
SGGDRGRC

SEQ ID NO: 1372901 - protein, 8 aa, Mycobacterium tuberculosis
SGGTAPAA

SEQ ID NO: 1372902 - protein, 6 aa, Mycobacterium tuberculosis
SGHPPG

SEQ ID NO: 1372903 - protein, 15 aa, Mycobacterium tuberculosis
SGLASDNVRTEADAR

SEQ ID NO: 1372904 - protein, 7 aa, Mycobacterium tuberculosis
SGLRPRY

SEQ ID NO: 1372905 - protein, 10 aa, Mycobacterium tuberculosis
SGLRSDARVE

SEQ ID NO: 1372906 - protein, 4 aa, Mycobacterium tuberculosis
SGPM

SEQ ID NO: 1372907 - protein, 13 aa, Mycobacterium tuberculosis
SGPPASPRRRRRN

SEQ ID NO: 1372908 - protein, 4 aa, Mycobacterium tuberculosis
SGRA

SEQ ID NO: 1372909 - protein, 8 aa, Mycobacterium tuberculosis
SGRAPSRC

SEQ ID NO: 1372910 - protein, 17 aa, Mycobacterium tuberculosis
SGRQGGQPAGRRYRSSL

SEQ ID NO: 1372911 - protein, 30 aa, Mycobacterium tuberculosis
SGSGAWRRSPPLTARRSSRLRTHDRSAPRC

SEQ ID NO: 1372912 - protein, 8 aa, Mycobacterium tuberculosis
SGSPTCAT

SEQ ID NO: 1372913 - protein, 13 aa, Mycobacterium tuberculosis
SGSQNMTGRWAAP

SEQ ID NO: 1372914 - protein, 19 aa, Mycobacterium tuberculosis
SGTAMADRSPCTVGTPSNR

SEQ ID NO: 1372915 - protein, 18 aa, Mycobacterium tuberculosis
SGTEGAAARTADRAQGGR

SEQ ID NO: 1372916 - protein, 28 aa, Mycobacterium tuberculosis
SGYPTGTCKPDHAEAETAYGVNAVAMVD

SEQ ID NO: 1372917 - protein, 4 aa, Mycobacterium tuberculosis
SHPA

SEQ ID NO: 1372918 - protein, 9 aa, Mycobacterium tuberculosis
SHQEAGAGE

SEQ ID NO: 1372919 - protein, 14 aa, Mycobacterium tuberculosis
SHQPRTATPPKRCS

SEQ ID NO: 1372920 - protein, 6 aa, Mycobacterium tuberculosis
SHQRAA

SEQ ID NO: 1372921 - protein, 38 aa, Mycobacterium tuberculosis
SIPRPADQSSGASAAGDLDQAGQRLAGARRDADQRSLR

SEQ ID NO: 1372922 - protein, 10 aa, Mycobacterium tuberculosis
SITPPGGESF

SEQ ID NO: 1372923 - protein, 15 aa, Mycobacterium tuberculosis
SKGKPMAADADLDGL

SEQ ID NO: 1372924 - protein, 9 aa, Mycobacterium tuberculosis
SKPLPEGMR

SEQ ID NO: 1372925 - protein, 13 aa, Mycobacterium tuberculosis
SKQAIGRATNNVA

SEQ ID NO: 1372926 - protein, 9 aa, Mycobacterium tuberculosis
SKSGRTRRR

SEQ ID NO: 1372927 - protein, 6 aa, Mycobacterium tuberculosis
SKVTYN

SEQ ID NO: 1372928 - protein, 10 aa, Mycobacterium tuberculosis
SLAGGDRTLR

SEQ ID NO: 1372929 - protein, 22 aa, Mycobacterium tuberculosis
SLAGPKERRAEKAANRARMTER

SEQ ID NO: 1372930 - protein, 12 aa, Mycobacterium tuberculosis
SLGAPQVAGRRY

SEQ ID NO: 1372931 - protein, 7 aa, Mycobacterium tuberculosis
SLGQRTG

SEQ ID NO: 1372932 - protein, 26 aa, Mycobacterium tuberculosis
SLGSPSLRRAESSGLRSSSSSPQRSS

SEQ ID NO: 1372933 - protein, 10 aa, Mycobacterium tuberculosis
SLGSSSDLRV

SEQ ID NO: 1372934 - protein, 14 aa, Mycobacterium tuberculosis
SLHGDTALGRPVGK

SEQ ID NO: 1372935 - protein, 25 aa, Mycobacterium tuberculosis
SLQQSTGALPNRRRRGRGRASRTRL

SEQ ID NO: 1372936 - protein, 5 aa, Mycobacterium tuberculosis
SLTGE

SEQ ID NO: 1372937 - protein, 4 aa, Mycobacterium tuberculosis
SLYE

SEQ ID NO: 1372938 - protein, 4 aa, Mycobacterium tuberculosis
SMAG

SEQ ID NO: 1372939 - protein, 8 aa, Mycobacterium tuberculosis
SNDPTELG

SEQ ID NO: 1372940 - protein, 15 aa, Mycobacterium tuberculosis
SNGRPARPSRSQLGW

SEQ ID NO: 1372941 - protein, 8 aa, Mycobacterium tuberculosis
SNHQPVTE

SEQ ID NO: 1372942 - protein, 7 aa, Mycobacterium tuberculosis
SNISART

SEQ ID NO: 1372943 - protein, 12 aa, Mycobacterium tuberculosis
SNPGEATLSRRG

SEQ ID NO: 1372944 - protein, 5 aa, Mycobacterium tuberculosis
SNRGP

SEQ ID NO: 1372945 - protein, 7 aa, Mycobacterium tuberculosis
SNRSRDL

SEQ ID NO: 1372946 - protein, 7 aa, Mycobacterium tuberculosis
SPADSLR

SEQ ID NO: 1372947 - protein, 4 aa, Mycobacterium tuberculosis
SPAE

SEQ ID NO: 1372948 - protein, 5 aa, Mycobacterium tuberculosis
SPALQ

SEQ ID NO: 1372949 - protein, 4 aa, Mycobacterium tuberculosis
SPES

SEQ ID NO: 1372950 - protein, 6 aa, Mycobacterium tuberculosis
SPGPRC

SEQ ID NO: 1372951 - protein, 10 aa, Mycobacterium tuberculosis
SPGQARRKIA

SEQ ID NO: 1372952 - protein, 11 aa, Mycobacterium tuberculosis
SPHGVSAGGSR

SEQ ID NO: 1372953 - protein, 5 aa, Mycobacterium tuberculosis
SPKVA

SEQ ID NO: 1372954 - protein, 8 aa, Mycobacterium tuberculosis
SPNGSVHD

SEQ ID NO: 1372955 - protein, 11 aa, Mycobacterium tuberculosis
SPPAGSTATGW

SEQ ID NO: 1372956 - protein, 6 aa, Mycobacterium tuberculosis
SPRNTW

SEQ ID NO: 1372957 - protein, 5 aa, Mycobacterium tuberculosis
SPRPR

SEQ ID NO: 1372958 - protein, 8 aa, Mycobacterium tuberculosis
SPRRTSTH

SEQ ID NO: 1372959 - protein, 7 aa, Mycobacterium tuberculosis
SPTRRRP

SEQ ID NO: 1372960 - protein, 12 aa, Mycobacterium tuberculosis
SQATGMATADKK

SEQ ID NO: 1372961 - protein, 21 aa, Mycobacterium tuberculosis
SQIEPAPPASADTCAASAATG

SEQ ID NO: 1372962 - protein, 4 aa, Mycobacterium tuberculosis
SQQI

SEQ ID NO: 1372963 - protein, 5 aa, Mycobacterium tuberculosis
SQQRG

SEQ ID NO: 1372964 - protein, 17 aa, Mycobacterium tuberculosis
SQRHPELSRTENDAVRA

SEQ ID NO: 1372965 - protein, 10 aa, Mycobacterium tuberculosis
SRAGKRAGKR

SEQ ID NO: 1372966 - protein, 9 aa, Mycobacterium tuberculosis
SRDITPSGG

SEQ ID NO: 1372967 - protein, 9 aa, Mycobacterium tuberculosis
SREAARRTL

SEQ ID NO: 1372968 - protein, 7 aa, Mycobacterium tuberculosis
SREAQAL

SEQ ID NO: 1372969 - protein, 8 aa, Mycobacterium tuberculosis
SREGTQFG

SEQ ID NO: 1372970 - protein, 4 aa, Mycobacterium tuberculosis
SRFP

SEQ ID NO: 1372971 - protein, 11 aa, Mycobacterium tuberculosis
SRGAGAGGDAE

SEQ ID NO: 1372972 - protein, 10 aa, Mycobacterium tuberculosis
SRGGDPDFDP

SEQ ID NO: 1372973 - protein, 5 aa, Mycobacterium tuberculosis
SRGHA

SEQ ID NO: 1372974 - protein, 5 aa, Mycobacterium tuberculosis
SRGPQ

SEQ ID NO: 1372975 - protein, 12 aa, Mycobacterium tuberculosis
SRNGAGPAPDAP

SEQ ID NO: 1372976 - protein, 28 aa, Mycobacterium tuberculosis
SRPADHLRGSSRIGRSTTTVRRRSRSQL

SEQ ID NO: 1372977 - protein, 47 aa, Mycobacterium tuberculosis
SRPASPGGAAVGGAAVTAGSAGATTTTGAAGRAGAYGAGCAGSANAA

SEQ ID NO: 1372978 - protein, 24 aa, Mycobacterium tuberculosis
SRPGADSEGTQTSATSDDISTRRS

SEQ ID NO: 1372979 - protein, 6 aa, Mycobacterium tuberculosis
SRPNGE

SEQ ID NO: 1372980 - protein, 17 aa, Mycobacterium tuberculosis
SRQRKAKVTQDDTGTYR

SEQ ID NO: 1372981 - protein, 14 aa, Mycobacterium tuberculosis
SRRATSLIAAHSES

SEQ ID NO: 1372982 - protein, 6 aa, Mycobacterium tuberculosis
SRRDAA

SEQ ID NO: 1372983 - protein, 11 aa, Mycobacterium tuberculosis
SRRHPPPSPVG

SEQ ID NO: 1372984 - protein, 10 aa, Mycobacterium tuberculosis
SRRHTGTAGA

SEQ ID NO: 1372985 - protein, 7 aa, Mycobacterium tuberculosis
SRRRGRR

SEQ ID NO: 1372986 - protein, 23 aa, Mycobacterium tuberculosis
SRSPTSRGSAAAISPRCRCCGCW

SEQ ID NO: 1372987 - protein, 10 aa, Mycobacterium tuberculosis
SRSPVPADRS

SEQ ID NO: 1372988 - protein, 6 aa, Mycobacterium tuberculosis
SRSSIG

SEQ ID NO: 1372989 - protein, 17 aa, Mycobacterium tuberculosis
SRTGTVGDYPRVYDAEI

SEQ ID NO: 1372990 - protein, 9 aa, Mycobacterium tuberculosis
SRTPGNGQV

SEQ ID NO: 1372991 - protein, 13 aa, Mycobacterium tuberculosis
SRTQPAAAGQPSA

SEQ ID NO: 1372992 - protein, 21 aa, Mycobacterium tuberculosis
SRWPSPPTAPPPGKPWPESSG

SEQ ID NO: 1372993 - protein, 6 aa, Mycobacterium tuberculosis
SSAAGT

SEQ ID NO: 1372994 - protein, 13 aa, Mycobacterium tuberculosis
SSADYSGTTPVGS

SEQ ID NO: 1372995 - protein, 35 aa, Mycobacterium tuberculosis
SSAGAKPVSADKPASAQSHLGSPALSSTPAGRANR

SEQ ID NO: 1372996 - protein, 13 aa, Mycobacterium tuberculosis
SSARSGALDDATA

SEQ ID NO: 1372997 - protein, 9 aa, Mycobacterium tuberculosis
SSATASTTL

SEQ ID NO: 1372998 - protein, 12 aa, Mycobacterium tuberculosis
SSCSQGDAPLGS

SEQ ID NO: 1372999 - protein, 15 aa, Mycobacterium tuberculosis
SSDSAAAAGEHEAAA

SEQ ID NO: 1373000 - protein, 20 aa, Mycobacterium tuberculosis
SSEPAARASRSSSCRWSMGS

SEQ ID NO: 1373001 - protein, 14 aa, Mycobacterium tuberculosis
SSERINDVTAARGS

SEQ ID NO: 1373002 - protein, 5 aa, Mycobacterium tuberculosis
SSGFP

SEQ ID NO: 1373003 - protein, 18 aa, Mycobacterium tuberculosis
SSKFAPVGDPSSTGVGDV

SEQ ID NO: 1373004 - protein, 8 aa, Mycobacterium tuberculosis
SSLLPSRH

SEQ ID NO: 1373005 - protein, 8 aa, Mycobacterium tuberculosis
SSLSGSTV

SEQ ID NO: 1373006 - protein, 5 aa, Mycobacterium tuberculosis
SSNQL

SEQ ID NO: 1373007 - protein, 8 aa, Mycobacterium tuberculosis
SSNSPISG

SEQ ID NO: 1373008 - protein, 10 aa, Mycobacterium tuberculosis
SSPERGRGRH

SEQ ID NO: 1373009 - protein, 7 aa, Mycobacterium tuberculosis
SSPGPYE

SEQ ID NO: 1373010 - protein, 14 aa, Mycobacterium tuberculosis
SSPVCNSDPAVGRR

SEQ ID NO: 1373011 - protein, 18 aa, Mycobacterium tuberculosis
SSRPEPSPRPPSVEVQLR

SEQ ID NO: 1373012 - protein, 25 aa, Mycobacterium tuberculosis
SSRPGAVAPTTRASRCNRASEARSS

SEQ ID NO: 1373013 - protein, 7 aa, Mycobacterium tuberculosis
SSRPRSC

SEQ ID NO: 1373014 - protein, 8 aa, Mycobacterium tuberculosis
SSRRPPRR

SEQ ID NO: 1373015 - protein, 5 aa, Mycobacterium tuberculosis
SSRVG

SEQ ID NO: 1373016 - protein, 6 aa, Mycobacterium tuberculosis
SSVASG

SEQ ID NO: 1373017 - protein, 10 aa, Mycobacterium tuberculosis
STAAASGPAI

SEQ ID NO: 1373018 - protein, 18 aa, Mycobacterium tuberculosis
STADNTGDQRIPKPVADN

SEQ ID NO: 1373019 - protein, 8 aa, Mycobacterium tuberculosis
STAPVRRG

SEQ ID NO: 1373020 - protein, 72 aa, Mycobacterium tuberculosis
STGDQPTAPGTPQRPGVTTTAAPPPSPAPASDGPTAEPAPPVQAPATGGPAPPLQQPLPPPPTTTNTQPAVT

SEQ ID NO: 1373021 - protein, 7 aa, Mycobacterium tuberculosis
STGNKRT

SEQ ID NO: 1373022 - protein, 38 aa, Mycobacterium tuberculosis
STHPPRRPRRPVRRRPAASSNPPRSRSSPPTAAPTTPG

SEQ ID NO: 1373023 - protein, 11 aa, Mycobacterium tuberculosis
STLSVGDDSMR

SEQ ID NO: 1373024 - protein, 10 aa, Mycobacterium tuberculosis
STNSAQLHTD

SEQ ID NO: 1373025 - protein, 11 aa, Mycobacterium tuberculosis
STPSTPRKGVQ

SEQ ID NO: 1373026 - protein, 10 aa, Mycobacterium tuberculosis
STRPPSRGAG

SEQ ID NO: 1373027 - protein, 5 aa, Mycobacterium tuberculosis
STSLN

SEQ ID NO: 1373028 - protein, 8 aa, Mycobacterium tuberculosis
STSSMSHC

SEQ ID NO: 1373029 - protein, 10 aa, Mycobacterium tuberculosis
STTPQQITRT

SEQ ID NO: 1373030 - protein, 14 aa, Mycobacterium tuberculosis
STTRRSRFSSACKA

SEQ ID NO: 1373031 - protein, 4 aa, Mycobacterium tuberculosis
SVAS

SEQ ID NO: 1373032 - protein, 14 aa, Mycobacterium tuberculosis
SVEAGSNHAADKTA

SEQ ID NO: 1373033 - protein, 13 aa, Mycobacterium tuberculosis
SVEPETTPAVPRP

SEQ ID NO: 1373034 - protein, 17 aa, Mycobacterium tuberculosis
SVGSYAAAEAANASPLQ

SEQ ID NO: 1373035 - protein, 21 aa, Mycobacterium tuberculosis
SVIDPPSPVPAPSVIGSHDDV

SEQ ID NO: 1373036 - protein, 18 aa, Mycobacterium tuberculosis
SVKSSKNEQYIGANTASA

SEQ ID NO: 1373037 - protein, 6 aa, Mycobacterium tuberculosis
SVNGNA

SEQ ID NO: 1373038 - protein, 8 aa, Mycobacterium tuberculosis
SVPPDRHA

SEQ ID NO: 1373039 - protein, 19 aa, Mycobacterium tuberculosis
SVPRPGTSMPARHQPNRIS

SEQ ID NO: 1373040 - protein, 4 aa, Mycobacterium tuberculosis
SVPS

SEQ ID NO: 1373041 - protein, 64 aa, Mycobacterium tuberculosis
SVRGSSAKSKPPTARKPAVKSGTKREESPTAKTKVATASAAEQIPVAGEPAAEPIPVAGEPAAR

SEQ ID NO: 1373042 - protein, 12 aa, Mycobacterium tuberculosis
SVRSTRSNQPAT

SEQ ID NO: 1373043 - protein, 17 aa, Mycobacterium tuberculosis
SVSARDCRGGTAPGRVA

SEQ ID NO: 1373044 - protein, 6 aa, Mycobacterium tuberculosis
SVVATS

SEQ ID NO: 1373045 - protein, 12 aa, Mycobacterium tuberculosis
SWPPRPASTRSG

SEQ ID NO: 1373046 - protein, 14 aa, Mycobacterium tuberculosis
SYGENNLAATATSG

SEQ ID NO: 1373047 - protein, 4 aa, Mycobacterium tuberculosis
SYTP

SEQ ID NO: 1373048 - protein, 7 aa, Mycobacterium tuberculosis
TAAATPG

SEQ ID NO: 1373049 - protein, 15 aa, Mycobacterium tuberculosis
TAADHDRITATRETL

SEQ ID NO: 1373050 - protein, 11 aa, Mycobacterium tuberculosis
TAADSSPALAS

SEQ ID NO: 1373051 - protein, 17 aa, Mycobacterium tuberculosis
TAAGTSADHGKAPGARL

SEQ ID NO: 1373052 - protein, 4 aa, Mycobacterium tuberculosis
TAAP

SEQ ID NO: 1373053 - protein, 15 aa, Mycobacterium tuberculosis
TAATAATPGPAGMAA

SEQ ID NO: 1373054 - protein, 6 aa, Mycobacterium tuberculosis
TAATAT

SEQ ID NO: 1373055 - protein, 11 aa, Mycobacterium tuberculosis
TADPPESSPDS

SEQ ID NO: 1373056 - protein, 31 aa, Mycobacterium tuberculosis
TADQARAALASGAARGTRAADAAGTAGAPVT

SEQ ID NO: 1373057 - protein, 10 aa, Mycobacterium tuberculosis
TADTSPQAAT

SEQ ID NO: 1373058 - protein, 7 aa, Mycobacterium tuberculosis
TAEAEAM

SEQ ID NO: 1373059 - protein, 5 aa, Mycobacterium tuberculosis
TAGGI

SEQ ID NO: 1373060 - protein, 13 aa, Mycobacterium tuberculosis
TAGKSLSDSASGL

SEQ ID NO: 1373061 - protein, 9 aa, Mycobacterium tuberculosis
TAGPGRAPK

SEQ ID NO: 1373062 - protein, 7 aa, Mycobacterium tuberculosis
TAGRATA

SEQ ID NO: 1373063 - protein, 6 aa, Mycobacterium tuberculosis
TAGRNH

SEQ ID NO: 1373064 - protein, 9 aa, Mycobacterium tuberculosis
TAGSDLSER

SEQ ID NO: 1373065 - protein, 6 aa, Mycobacterium tuberculosis
TAGTTA

SEQ ID NO: 1373066 - protein, 9 aa, Mycobacterium tuberculosis
TAHGSQATL

SEQ ID NO: 1373067 - protein, 8 aa, Mycobacterium tuberculosis
TAKGARNV

SEQ ID NO: 1373068 - protein, 14 aa, Mycobacterium tuberculosis
TAPAASSKPLPDLP

SEQ ID NO: 1373069 - protein, 6 aa, Mycobacterium tuberculosis
TAPATG

SEQ ID NO: 1373070 - protein, 14 aa, Mycobacterium tuberculosis
TAPQPGPAAGGGFR

SEQ ID NO: 1373071 - protein, 8 aa, Mycobacterium tuberculosis
TAPQPGPG

SEQ ID NO: 1373072 - protein, 12 aa, Mycobacterium tuberculosis
TARRPGSSRPRR

SEQ ID NO: 1373073 - protein, 5 aa, Mycobacterium tuberculosis
TARTG

SEQ ID NO: 1373074 - protein, 12 aa, Mycobacterium tuberculosis
TARTLTSQQRDL

SEQ ID NO: 1373075 - protein, 9 aa, Mycobacterium tuberculosis
TASAVTGTI

SEQ ID NO: 1373076 - protein, 16 aa, Mycobacterium tuberculosis
TASGAAVGAAATLPGI

SEQ ID NO: 1373077 - protein, 5 aa, Mycobacterium tuberculosis
TASHH

SEQ ID NO: 1373078 - protein, 7 aa, Mycobacterium tuberculosis
TASRFGQ

SEQ ID NO: 1373079 - protein, 8 aa, Mycobacterium tuberculosis
TATAASYS

SEQ ID NO: 1373080 - protein, 6 aa, Mycobacterium tuberculosis
TATGLT

SEQ ID NO: 1373081 - protein, 4 aa, Mycobacterium tuberculosis
TATR

SEQ ID NO: 1373082 - protein, 26 aa, Mycobacterium tuberculosis
TATRVAQSAVSAGLGAAGGRRGAHCR

SEQ ID NO: 1373083 - protein, 15 aa, Mycobacterium tuberculosis
TCATRRRSWPRSCAT

SEQ ID NO: 1373084 - protein, 24 aa, Mycobacterium tuberculosis
TCSTSSTTSRTARTIRRERWPPRT

SEQ ID NO: 1373085 - protein, 11 aa, Mycobacterium tuberculosis
TDAGPAPEFTD

SEQ ID NO: 1373086 - protein, 9 aa, Mycobacterium tuberculosis
TDEPGLTPG

SEQ ID NO: 1373087 - protein, 7 aa, Mycobacterium tuberculosis
TDGEDRA

SEQ ID NO: 1373088 - protein, 4 aa, Mycobacterium tuberculosis
TDGS

SEQ ID NO: 1373089 - protein, 7 aa, Mycobacterium tuberculosis
TDIRDAQ

SEQ ID NO: 1373090 - protein, 6 aa, Mycobacterium tuberculosis
TDIRDP

SEQ ID NO: 1373091 - protein, 4 aa, Mycobacterium tuberculosis
TDND

SEQ ID NO: 1373092 - protein, 15 aa, Mycobacterium tuberculosis
TDPDAAAPHAAEADA

SEQ ID NO: 1373093 - protein, 4 aa, Mycobacterium tuberculosis
TDPL

SEQ ID NO: 1373094 - protein, 6 aa, Mycobacterium tuberculosis
TDPVHT

SEQ ID NO: 1373095 - protein, 5 aa, Mycobacterium tuberculosis
TDQGV

SEQ ID NO: 1373096 - protein, 8 aa, Mycobacterium tuberculosis
TDQRASGQ

SEQ ID NO: 1373097 - protein, 4 aa, Mycobacterium tuberculosis
TDRF

SEQ ID NO: 1373098 - protein, 27 aa, Mycobacterium tuberculosis
TDRGAAGGIPARAHQPAPPVGKSNQRL

SEQ ID NO: 1373099 - protein, 7 aa, Mycobacterium tuberculosis
TDTYDAA

SEQ ID NO: 1373100 - protein, 8 aa, Mycobacterium tuberculosis
TDTYDAAA

SEQ ID NO: 1373101 - protein, 18 aa, Mycobacterium tuberculosis
TDVAAGQALQAARSYVVK

SEQ ID NO: 1373102 - protein, 11 aa, Mycobacterium tuberculosis
TEAKDYQREDL

SEQ ID NO: 1373103 - protein, 14 aa, Mycobacterium tuberculosis
TEDPAGRKADQEGL

SEQ ID NO: 1373104 - protein, 18 aa, Mycobacterium tuberculosis
TERAANEPTTSSPASTAG

SEQ ID NO: 1373105 - protein, 5 aa, Mycobacterium tuberculosis
TERAS

SEQ ID NO: 1373106 - protein, 16 aa, Mycobacterium tuberculosis
TFSTSDPTTSSRRPNV

SEQ ID NO: 1373107 - protein, 12 aa, Mycobacterium tuberculosis
TFTSDTTREALR

SEQ ID NO: 1373108 - protein, 8 aa, Mycobacterium tuberculosis
TGAADGYA

SEQ ID NO: 1373109 - protein, 7 aa, Mycobacterium tuberculosis
TGAGGVV

SEQ ID NO: 1373110 - protein, 12 aa, Mycobacterium tuberculosis
TGAGTAGAATPA

SEQ ID NO: 1373111 - protein, 40 aa, Mycobacterium tuberculosis
TGAGTAGAATPAAAAAPSAGAAPAPQLPRTASFGLCGGWQ

SEQ ID NO: 1373112 - protein, 40 aa, Mycobacterium tuberculosis
TGAGTAGAATPAAGAAPSAGAAPAPGSSRDRQFRLCGGWQ

SEQ ID NO: 1373113 - protein, 4 aa, Mycobacterium tuberculosis
TGAN

SEQ ID NO: 1373114 - protein, 20 aa, Mycobacterium tuberculosis
TGAPAPGQSDASAVRAAPIG

SEQ ID NO: 1373115 - protein, 7 aa, Mycobacterium tuberculosis
TGATGAV

SEQ ID NO: 1373116 - protein, 5 aa, Mycobacterium tuberculosis
TGAVP

SEQ ID NO: 1373117 - protein, 14 aa, Mycobacterium tuberculosis
TGCPKSELGHTKRG

SEQ ID NO: 1373118 - protein, 14 aa, Mycobacterium tuberculosis
TGEAKPTRVRPGGQ

SEQ ID NO: 1373119 - protein, 7 aa, Mycobacterium tuberculosis
TGEAKPV

SEQ ID NO: 1373120 - protein, 13 aa, Mycobacterium tuberculosis
TGEESDDESLGGA

SEQ ID NO: 1373121 - protein, 5 aa, Mycobacterium tuberculosis
TGEPQ

SEQ ID NO: 1373122 - protein, 20 aa, Mycobacterium tuberculosis
TGGAARSIGRARDIEPGHRR

SEQ ID NO: 1373123 - protein, 5 aa, Mycobacterium tuberculosis
TGGET

SEQ ID NO: 1373124 - protein, 8 aa, Mycobacterium tuberculosis
TGGGGVHP

SEQ ID NO: 1373125 - protein, 6 aa, Mycobacterium tuberculosis
TGKAHT

SEQ ID NO: 1373126 - protein, 8 aa, Mycobacterium tuberculosis
TGKASEAI

SEQ ID NO: 1373127 - protein, 9 aa, Mycobacterium tuberculosis
TGPAGDDNI

SEQ ID NO: 1373128 - protein, 10 aa, Mycobacterium tuberculosis
TGPATKRFGE

SEQ ID NO: 1373129 - protein, 7 aa, Mycobacterium tuberculosis
TGPKPFQ

SEQ ID NO: 1373130 - protein, 11 aa, Mycobacterium tuberculosis
TGPQRSTVKAA

SEQ ID NO: 1373131 - protein, 10 aa, Mycobacterium tuberculosis
TGRQPSRSSP

SEQ ID NO: 1373132 - protein, 18 aa, Mycobacterium tuberculosis
TGSPARQRLPAPRSTTTP

SEQ ID NO: 1373133 - protein, 5 aa, Mycobacterium tuberculosis
TGTAS

SEQ ID NO: 1373134 - protein, 4 aa, Mycobacterium tuberculosis
TGTG

SEQ ID NO: 1373135 - protein, 17 aa, Mycobacterium tuberculosis
TGTRSAPPLGSRRCADH

SEQ ID NO: 1373136 - protein, 10 aa, Mycobacterium tuberculosis
THAEQGRLSD

SEQ ID NO: 1373137 - protein, 8 aa, Mycobacterium tuberculosis
THDGDAHR

SEQ ID NO: 1373138 - protein, 7 aa, Mycobacterium tuberculosis
THENTRR

SEQ ID NO: 1373139 - protein, 5 aa, Mycobacterium tuberculosis
THERT

SEQ ID NO: 1373140 - protein, 6 aa, Mycobacterium tuberculosis
THSSGR

SEQ ID NO: 1373141 - protein, 122 aa, Mycobacterium tuberculosis
TIPTAPPTTPVTTPPTTPPTTPVTTPPTTPPTTPVTTPPTTVAPTTVAPTTVAPTTVAPTTVAPATATPTTVAPQPTQQPTQQPTQQMPTQQQTVAPQTVAPAPQPPSGGRNGSGGGDLFGG

SEQ ID NO: 1373142 - protein, 5 aa, Mycobacterium tuberculosis
TIRQL

SEQ ID NO: 1373143 - protein, 13 aa, Mycobacterium tuberculosis
TKAGSPPTSTEFD

SEQ ID NO: 1373144 - protein, 12 aa, Mycobacterium tuberculosis
TKDGDARPERHA

SEQ ID NO: 1373145 - protein, 9 aa, Mycobacterium tuberculosis
TKPDVRRQS

SEQ ID NO: 1373146 - protein, 10 aa, Mycobacterium tuberculosis
TKPDVRRQSR

SEQ ID NO: 1373147 - protein, 7 aa, Mycobacterium tuberculosis
TKRRANL

SEQ ID NO: 1373148 - protein, 7 aa, Mycobacterium tuberculosis
TKTGDQI

SEQ ID NO: 1373149 - protein, 8 aa, Mycobacterium tuberculosis
TLKDGTEL

SEQ ID NO: 1373150 - protein, 9 aa, Mycobacterium tuberculosis
TLSDQSENI

SEQ ID NO: 1373151 - protein, 10 aa, Mycobacterium tuberculosis
TLSPAGQAPW

SEQ ID NO: 1373152 - protein, 17 aa, Mycobacterium tuberculosis
TNAQRRATAKRKLERQL

SEQ ID NO: 1373153 - protein, 5 aa, Mycobacterium tuberculosis
TNFSG

SEQ ID NO: 1373154 - protein, 5 aa, Mycobacterium tuberculosis
TNGGG

SEQ ID NO: 1373155 - protein, 7 aa, Mycobacterium tuberculosis
TNLPTTD

SEQ ID NO: 1373156 - protein, 20 aa, Mycobacterium tuberculosis
TNPWRGPPIPYGTEVTDGRN

SEQ ID NO: 1373157 - protein, 13 aa, Mycobacterium tuberculosis
TPATEAKSETPVP

SEQ ID NO: 1373158 - protein, 10 aa, Mycobacterium tuberculosis
TPEAIDPDKA

SEQ ID NO: 1373159 - protein, 5 aa, Mycobacterium tuberculosis
TPESV

SEQ ID NO: 1373160 - protein, 4 aa, Mycobacterium tuberculosis
TPGC

SEQ ID NO: 1373161 - protein, 10 aa, Mycobacterium tuberculosis
TPGSKNPKRW

SEQ ID NO: 1373162 - protein, 7 aa, Mycobacterium tuberculosis
TPLADTA

SEQ ID NO: 1373163 - protein, 8 aa, Mycobacterium tuberculosis
TPMTTSAR

SEQ ID NO: 1373164 - protein, 4 aa, Mycobacterium tuberculosis
TPNR

SEQ ID NO: 1373165 - protein, 7 aa, Mycobacterium tuberculosis
TPPARPV

SEQ ID NO: 1373166 - protein, 8 aa, Mycobacterium tuberculosis
TPPPHQTP

SEQ ID NO: 1373167 - protein, 5 aa, Mycobacterium tuberculosis
TPQRS

SEQ ID NO: 1373168 - protein, 5 aa, Mycobacterium tuberculosis
TPQSY

SEQ ID NO: 1373169 - protein, 33 aa, Mycobacterium tuberculosis; identical to SEQ ID NO: 155881

SEQ ID NO: 1373170 - protein, 32 aa, Mycobacterium tuberculosis
TPRRRARRTRVGRTAERVGAAAAGHLRAASGS

SEQ ID NO: 1373171 - protein, 24 aa, Mycobacterium tuberculosis
TPRTSRTLAPRLDPEAVAESNRTV

SEQ ID NO: 1373172 - protein, 6 aa, Mycobacterium tuberculosis
TPRYQG

SEQ ID NO: 1373173 - protein, 11 aa, Mycobacterium tuberculosis
TPSPGAPEGPW

SEQ ID NO: 1373174 - protein, 11 aa, Mycobacterium tuberculosis
TPSPGTSEGPW

SEQ ID NO: 1373175 - protein, 12 aa, Mycobacterium tuberculosis
TPSSPTVSPPQI

SEQ ID NO: 1373176 - protein, 5 aa, Mycobacterium tuberculosis
TPTKR

SEQ ID NO: 1373177 - protein, 8 aa, Mycobacterium tuberculosis
TPTTAGTV

SEQ ID NO: 1373178 - protein, 23 aa, Mycobacterium tuberculosis
TPTTYPPTGSRVSTSSRRSGPSS

SEQ ID NO: 1373179 - protein, 18 aa, Mycobacterium tuberculosis
TPVANPQQVSVPEGGTVG

SEQ ID NO: 1373180 - protein, 8 aa, Mycobacterium tuberculosis
TPVNRGYE

SEQ ID NO: 1373181 - protein, 10 aa, Mycobacterium tuberculosis
TQARAPTQHY

SEQ ID NO: 1373182 - protein, 5 aa, Mycobacterium tuberculosis
TQEAT

SEQ ID NO: 1373183 - protein, 17 aa, Mycobacterium tuberculosis
TQPARARPQLEPRYPAG

SEQ ID NO: 1373184 - protein, 8 aa, Mycobacterium tuberculosis
TQQGQLGA

SEQ ID NO: 1373185 - protein, 18 aa, Mycobacterium tuberculosis
TQRSGSRDVALGTTDSAA

SEQ ID NO: 1373186 - protein, 28 aa, Mycobacterium tuberculosis
TQTSRLSTTLRADEQAHRITPSREPDDG

SEQ ID NO: 1373187 - protein, 6 aa, Mycobacterium tuberculosis
TQVATG

SEQ ID NO: 1373188 - protein, 8 aa, Mycobacterium tuberculosis
TREDTGYH

SEQ ID NO: 1373189 - protein, 20 aa, Mycobacterium tuberculosis
TRGGDGQGAPFGADVPTPRL

SEQ ID NO: 1373190 - protein, 15 aa, Mycobacterium tuberculosis
TRGRAYRAGLSITRR

SEQ ID NO: 1373191 - protein, 6 aa, Mycobacterium tuberculosis
TRHHRN

SEQ ID NO: 1373192 - protein, 7 aa, Mycobacterium tuberculosis
TRPDLQR

SEQ ID NO: 1373193 - protein, 4 aa, Mycobacterium tuberculosis
TRPR

SEQ ID NO: 1373194 - protein, 19 aa, Mycobacterium tuberculosis
TRRRSRSLRRSTPKCGRKT

SEQ ID NO: 1373195 - protein, 5 aa, Mycobacterium tuberculosis
TRSAC

SEQ ID NO: 1373196 - protein, 5 aa, Mycobacterium tuberculosis
TRSGS

SEQ ID NO: 1373197 - protein, 31 aa, Mycobacterium tuberculosis
TRSRRSSPRSLYGGSACSPPTPSSRPRSRRP

SEQ ID NO: 1373198 - protein, 6 aa, Mycobacterium tuberculosis
TRSSAL

SEQ ID NO: 1373199 - protein, 4 aa, Mycobacterium tuberculosis
TRTT

SEQ ID NO: 1373200 - protein, 4 aa, Mycobacterium tuberculosis
TSAL

SEQ ID NO: 1373201 - protein, 9 aa, Mycobacterium tuberculosis
TSDPPAHTR

SEQ ID NO: 1373202 - protein, 5 aa, Mycobacterium tuberculosis
TSEAV

SEQ ID NO: 1373203 - protein, 8 aa, Mycobacterium tuberculosis
TSEEERAR

SEQ ID NO: 1373204 - protein, 6 aa, Mycobacterium tuberculosis
TSGLAG

SEQ ID NO: 1373205 - protein, 6 aa, Mycobacterium tuberculosis
TSGQNL

SEQ ID NO: 1373206 - protein, 4 aa, Mycobacterium tuberculosis
TSGR

SEQ ID NO: 1373207 - protein, 10 aa, Mycobacterium tuberculosis
TSGSTANPRG

SEQ ID NO: 1373208 - protein, 10 aa, Mycobacterium tuberculosis
TSGSTRTPAG

SEQ ID NO: 1373209 - protein, 5 aa, Mycobacterium tuberculosis
TSGSV

SEQ ID NO: 1373210 - protein, 11 aa, Mycobacterium tuberculosis
TSKPGQPPETV

SEQ ID NO: 1373211 - protein, 11 aa, Mycobacterium tuberculosis
TSKSADGKRVV

SEQ ID NO: 1373212 - protein, 4 aa, Mycobacterium tuberculosis
TSPA

SEQ ID NO: 1373213 - protein, 9 aa, Mycobacterium tuberculosis
TSPTSWEQA

SEQ ID NO: 1373214 - protein, 8 aa, Mycobacterium tuberculosis
TSQAETRV

SEQ ID NO: 1373215 - protein, 7 aa, Mycobacterium tuberculosis
TSQTGVR

SEQ ID NO: 1373216 - protein, 4 aa, Mycobacterium tuberculosis
TSRR

SEQ ID NO: 1373217 - protein, 4 aa, Mycobacterium tuberculosis
TSSV

SEQ ID NO: 1373218 - protein, 7 aa, Mycobacterium tuberculosis
TSTAQEL

SEQ ID NO: 1373219 - protein, 9 aa, Mycobacterium tuberculosis
TSTATGREA

SEQ ID NO: 1373220 - protein, 14 aa, Mycobacterium tuberculosis
TTAAGPISQNAYGA

SEQ ID NO: 1373221 - protein, 10 aa, Mycobacterium tuberculosis
TTAAGSAALG

SEQ ID NO: 1373222 - protein, 4 aa, Mycobacterium tuberculosis
TTAQ

SEQ ID NO: 1373223 - protein, 13 aa, Mycobacterium tuberculosis
TTARAARRYGAGN

SEQ ID NO: 1373224 - protein, 24 aa, Mycobacterium tuberculosis
TTGDSSEPPAAGEEGVTAAPEMGP

SEQ ID NO: 1373225 - protein, 15 aa, Mycobacterium tuberculosis
TTGSQQRHTSHRTPA

SEQ ID NO: 1373226 - protein, 8 aa, Mycobacterium tuberculosis
TTLQRPPT

SEQ ID NO: 1373227 - protein, 9 aa, Mycobacterium tuberculosis
TTPTAGGYT

SEQ ID NO: 1373228 - protein, 4 aa, Mycobacterium tuberculosis
TTSS

SEQ ID NO: 1373229 - protein, 19 aa, Mycobacterium tuberculosis
TTTAPPVNTTSRPSPTTIT

SEQ ID NO: 1373230 - protein, 50 aa, Mycobacterium tuberculosis; identical to SEQ ID NO: 155897

SEQ ID NO: 1373231 - protein, 49 aa, Mycobacterium tuberculosis
TTTAPPVTTTPRPSPTTTTTTAPPSTTTTTEPPVTTTSTIPTIPTTTTT

SEQ ID NO: 1373232 - protein, 6 aa, Mycobacterium tuberculosis
TTTASV

SEQ ID NO: 1373233 - protein, 7 aa, Mycobacterium tuberculosis
TTTPSDE

SEQ ID NO: 1373234 - protein, 5 aa, Mycobacterium tuberculosis
TVGAG

SEQ ID NO: 1373235 - protein, 19 aa, Mycobacterium tuberculosis
TVGPADHAAGLDRRATPDQ

SEQ ID NO: 1373236 - protein, 12 aa, Mycobacterium tuberculosis
TVGSPGQGNYSA

SEQ ID NO: 1373237 - protein, 9 aa, Mycobacterium tuberculosis
TVKDDATDV

SEQ ID NO: 1373238 - protein, 41 aa, Mycobacterium tuberculosis
TVPAPTSPTIRGATPRPRALGTPALAAPAPHGALAGSGKLG

SEQ ID NO: 1373239 - protein, 9 aa, Mycobacterium tuberculosis
TVPGKRAPT

SEQ ID NO: 1373240 - protein, 8 aa, Mycobacterium tuberculosis
TVSNAEEF

SEQ ID NO: 1373241 - protein, 9 aa, Mycobacterium tuberculosis
TVTGGSANY

SEQ ID NO: 1373242 - protein, 10 aa, Mycobacterium tuberculosis
TVTNTGDRPV

SEQ ID NO: 1373243 - protein, 4 aa, Mycobacterium tuberculosis
TYGG

SEQ ID NO: 1373244 - protein, 11 aa, Mycobacterium tuberculosis
TYRDDADTEHR

SEQ ID NO: 1373245 - protein, 26 aa, Mycobacterium tuberculosis
VADQGAAVTAGATVTGVGSDCGTGTT

SEQ ID NO: 1373246 - protein, 15 aa, Mycobacterium tuberculosis
VAEAGPESPADPEIE

SEQ ID NO: 1373247 - protein, 12 aa, Mycobacterium tuberculosis
VAGAGSGRGGRV

SEQ ID NO: 1373248 - protein, 6 aa, Mycobacterium tuberculosis
VAGCGA

SEQ ID NO: 1373249 - protein, 24 aa, Mycobacterium tuberculosis
VAGGIGAAAGIDASRTYRSQKSIG

SEQ ID NO: 1373250 - protein, 13 aa, Mycobacterium tuberculosis
VAGGSPDRADGQH

SEQ ID NO: 1373251 - protein, 5 aa, Mycobacterium tuberculosis
VAGPG

SEQ ID NO: 1373252 - protein, 4 aa, Mycobacterium tuberculosis
VAGV

SEQ ID NO: 1373253 - protein, 9 aa, Mycobacterium tuberculosis
VAHRPRPAT

SEQ ID NO: 1373254 - protein, 28 aa, Mycobacterium tuberculosis
VANPDLPDHRAPDVSDGALPPPFRVGRL

SEQ ID NO: 1373255 - protein, 6 aa, Mycobacterium tuberculosis
VAPAEA

SEQ ID NO: 1373256 - protein, 12 aa, Mycobacterium tuberculosis
VAPDAGSTPRVS

SEQ ID NO: 1373257 - protein, 9 aa, Mycobacterium tuberculosis
VAPDDTQSM

SEQ ID NO: 1373258 - protein, 9 aa, Mycobacterium tuberculosis
VAPTSSSVT

SEQ ID NO: 1373259 - protein, 25 aa, Mycobacterium tuberculosis
VASAASAVGPVGPGGPNQPDDVAEA

SEQ ID NO: 1373260 - protein, 10 aa, Mycobacterium tuberculosis
VASGASGNLK

SEQ ID NO: 1373261 - protein, 19 aa, Mycobacterium tuberculosis
VDAAQRARGGTGGGGHCAA

SEQ ID NO: 1373262 - protein, 4 aa, Mycobacterium tuberculosis
VDAQ

SEQ ID NO: 1373263 - protein, 10 aa, Mycobacterium tuberculosis
VDDDHQGQLQ

SEQ ID NO: 1373264 - protein, 7 aa, Mycobacterium tuberculosis
VDGPDEA

SEQ ID NO: 1373265 - protein, 4 aa, Mycobacterium tuberculosis
VDGS

SEQ ID NO: 1373266 - protein, 18 aa, Mycobacterium tuberculosis
VDQRAGDTADPAGRGRPR

SEQ ID NO: 1373267 - protein, 9 aa, Mycobacterium tuberculosis
VDRPGRPAR

SEQ ID NO: 1373268 - protein, 12 aa, Mycobacterium tuberculosis
VDRPGSPRPARS

SEQ ID NO: 1373269 - protein, 8 aa, Mycobacterium tuberculosis
VDTRGDGK

SEQ ID NO: 1373270 - protein, 8 aa, Mycobacterium tuberculosis
VEGEGCGT

SEQ ID NO: 1373271 - protein, 4 aa, Mycobacterium tuberculosis
VEPD

SEQ ID NO: 1373272 - protein, 7 aa, Mycobacterium tuberculosis
VEPTTGT

SEQ ID NO: 1373273 - protein, 17 aa, Mycobacterium tuberculosis
VERSVSGCESACRSDAT

SEQ ID NO: 1373274 - protein, 17 aa, Mycobacterium tuberculosis
VETRDPNARCGPARRPT

SEQ ID NO: 1373275 - protein, 14 aa, Mycobacterium tuberculosis
VGAAAGAPAAFGGQ

SEQ ID NO: 1373276 - protein, 47 aa, Mycobacterium tuberculosis
VGAGTRRSHDADDPCRSQPAGPSRYPRPAATAQSPASHRSVGGAGRD

SEQ ID NO: 1373277 - protein, 21 aa, Mycobacterium tuberculosis
VGAPPRGDGGYRAAGLPGGGL

SEQ ID NO: 1373278 - protein, 8 aa, Mycobacterium tuberculosis
VGAPSSGI

SEQ ID NO: 1373279 - protein, 8 aa, Mycobacterium tuberculosis
VGAPSSRV

SEQ ID NO: 1373280 - protein, 15 aa, Mycobacterium tuberculosis
VGDGSDRGAIRARTG

SEQ ID NO: 1373281 - protein, 47 aa, Mycobacterium tuberculosis
VGEDLKSDPVVSKPGLVNSDASPNKPNAAITDSAGTAGGKGPVGING

SEQ ID NO: 1373282 - protein, 13 aa, Mycobacterium tuberculosis
VGESSQTSDRPDN

SEQ ID NO: 1373283 - protein, 5 aa, Mycobacterium tuberculosis
VGGAA

SEQ ID NO: 1373284 - protein, 8 aa, Mycobacterium tuberculosis
VGGAAAEA

SEQ ID NO: 1373285 - protein, 9 aa, Mycobacterium tuberculosis
VGGGRSALR

SEQ ID NO: 1373286 - protein, 14 aa, Mycobacterium tuberculosis
VGGKTGINTDAGKN

SEQ ID NO: 1373287 - protein, 8 aa, Mycobacterium tuberculosis
VGGQRTAL

SEQ ID NO: 1373288 - protein, 4 aa, Mycobacterium tuberculosis
VGGR

SEQ ID NO: 1373289 - protein, 14 aa, Mycobacterium tuberculosis
VGGVGCGFAGLGVL

SEQ ID NO: 1373290 - protein, 11 aa, Mycobacterium tuberculosis
VGKTEPVDSEA

SEQ ID NO: 1373291 - protein, 14 aa, Mycobacterium tuberculosis
VGPGARAQHRGPDL

SEQ ID NO: 1373292 - protein, 24 aa, Mycobacterium tuberculosis
VGPGRGGHRATAGLRGDEPDGRFD

SEQ ID NO: 1373293 - protein, 12 aa, Mycobacterium tuberculosis
VGPSGSGKSTLT

SEQ ID NO: 1373294 - protein, 15 aa, Mycobacterium tuberculosis
VGQAKRAENGSEGAN

SEQ ID NO: 1373295 - protein, 8 aa, Mycobacterium tuberculosis
VGRDGELR

SEQ ID NO: 1373296 - protein, 10 aa, Mycobacterium tuberculosis
VGRGDRAGGV

SEQ ID NO: 1373297 - protein, 8 aa, Mycobacterium tuberculosis
VGSAGGRV

SEQ ID NO: 1373298 - protein, 11 aa, Mycobacterium tuberculosis
VGSSGQANYAA

SEQ ID NO: 1373299 - protein, 7 aa, Mycobacterium tuberculosis
VGSSQAG

SEQ ID NO: 1373300 - protein, 25 aa, Mycobacterium tuberculosis
VGSTGRDPATATRRRSAAGDPITRG

SEQ ID NO: 1373301 - protein, 8 aa, Mycobacterium tuberculosis
VGSTSGVI

SEQ ID NO: 1373302 - protein, 8 aa, Mycobacterium tuberculosis
VGTEGDDG

SEQ ID NO: 1373303 - protein, 18 aa, Mycobacterium tuberculosis
VGVGGGAGSREHVGVGAG

SEQ ID NO: 1373304 - protein, 4 aa, Mycobacterium tuberculosis
VGVP

SEQ ID NO: 1373305 - protein, 13 aa, Mycobacterium tuberculosis
VKPNAAQKESEYI

SEQ ID NO: 1373306 - protein, 4 aa, Mycobacterium tuberculosis
VKPP

SEQ ID NO: 1373307 - protein, 49 aa, Mycobacterium tuberculosis
VNAEGSDPNDQPPLESHSPAAPAESNPIASSDSARRSRLATNDDHPPLA

SEQ ID NO: 1373308 - protein, 22 aa, Mycobacterium tuberculosis
VNAEGSDPNDQPRWNPTPRLPL

SEQ ID NO: 1373309 - protein, 4 aa, Mycobacterium tuberculosis
VNAT

SEQ ID NO: 1373310 - protein, 4 aa, Mycobacterium tuberculosis
VNEG

SEQ ID NO: 1373311 - protein, 17 aa, Mycobacterium tuberculosis
VNPQPVSESELGHTKRG

SEQ ID NO: 1373312 - protein, 23 aa, Mycobacterium tuberculosis
VNPRTEGGVRGPGTHRPWPNLWI

SEQ ID NO: 1373313 - protein, 6 aa, Mycobacterium tuberculosis
VNPTGG

SEQ ID NO: 1373314 - protein, 5 aa, Mycobacterium tuberculosis
VPADM

SEQ ID NO: 1373315 - protein, 11 aa, Mycobacterium tuberculosis
VPAGAGADAAH

SEQ ID NO: 1373316 - protein, 4 aa, Mycobacterium tuberculosis
VPDG

SEQ ID NO: 1373317 - protein, 7 aa, Mycobacterium tuberculosis
VPDGNGH

SEQ ID NO: 1373318 - protein, 11 aa, Mycobacterium tuberculosis
VPEEDKGLRTR

SEQ ID NO: 1373319 - protein, 8 aa, Mycobacterium tuberculosis
VPGATAPL

SEQ ID NO: 1373320 - protein, 8 aa, Mycobacterium tuberculosis
VPGDRSTE

SEQ ID NO: 1373321 - protein, 7 aa, Mycobacterium tuberculosis
VPGGQGA

SEQ ID NO: 1373322 - protein, 12 aa, Mycobacterium tuberculosis
VPGGTNPWYGDP

SEQ ID NO: 1373323 - protein, 4 aa, Mycobacterium tuberculosis
VPGH

SEQ ID NO: 1373324 - protein, 10 aa, Mycobacterium tuberculosis
VPGSRRPTVA

SEQ ID NO: 1373325 - protein, 5 aa, Mycobacterium tuberculosis
VPPGA

SEQ ID NO: 1373326 - protein, 23 aa, Mycobacterium tuberculosis
VPPPPGDPVPPVDTHAGGRPADQ

SEQ ID NO: 1373327 - protein, 12 aa, Mycobacterium tuberculosis
VPRPTPGRYCVT

SEQ ID NO: 1373328 - protein, 5 aa, Mycobacterium tuberculosis
VPSNY

SEQ ID NO: 1373329 - protein, 7 aa, Mycobacterium tuberculosis
VPSRPPT

SEQ ID NO: 1373330 - protein, 33 aa, Mycobacterium tuberculosis
VPTEVSQRSEGQGPQPHADTGRLTAGAQDPPML

SEQ ID NO: 1373331 - protein, 24 aa, Mycobacterium tuberculosis
VQEPGDQGQPVGSERLRSHQLDRR

SEQ ID NO: 1373332 - protein, 17 aa, Mycobacterium tuberculosis
VQPGPRLPNVDAGGDFV

SEQ ID NO: 1373333 - protein, 6 aa, Mycobacterium tuberculosis
VQYNPK

SEQ ID NO: 1373334 - protein, 61 aa, Mycobacterium tuberculosis
VRDRDGRADRPDRQHRRRSGAAAPARPGRRPAQVDPGAVGPDAGRSCADRSGADSRRAGVG

SEQ ID NO: 1373335 - protein, 8 aa, Mycobacterium tuberculosis
VRETNKER

SEQ ID NO: 1373336 - protein, 7 aa, Mycobacterium tuberculosis
VRGLTGK

SEQ ID NO: 1373337 - protein, 10 aa, Mycobacterium tuberculosis
VRHRDGRRRR

SEQ ID NO: 1373338 - protein, 17 aa, Mycobacterium tuberculosis
VRQGYANQHHAEQACLR

SEQ ID NO: 1373339 - protein, 8 aa, Mycobacterium tuberculosis
VRQPRRAN

SEQ ID NO: 1373340 - protein, 5 aa, Mycobacterium tuberculosis
VRQQR

SEQ ID NO: 1373341 - protein, 14 aa, Mycobacterium tuberculosis
VRQTTGGSVPDGGH

SEQ ID NO: 1373342 - protein, 8 aa, Mycobacterium tuberculosis
VRSSGSVA

SEQ ID NO: 1373343 - protein, 16 aa, Mycobacterium tuberculosis
VSARDCRGGTAPGRVA

SEQ ID NO: 1373344 - protein, 10 aa, Mycobacterium tuberculosis
VSDPARPGAV

SEQ ID NO: 1373345 - protein, 10 aa, Mycobacterium tuberculosis
VSGADRNGSI

SEQ ID NO: 1373346 - protein, 7 aa, Mycobacterium tuberculosis
VSGAGGG

SEQ ID NO: 1373347 - protein, 9 aa, Mycobacterium tuberculosis
VSGPGSARV

SEQ ID NO: 1373348 - protein, 5 aa, Mycobacterium tuberculosis
VSHPR

SEQ ID NO: 1373349 - protein, 10 aa, Mycobacterium tuberculosis
VSKDNGQTWG

SEQ ID NO: 1373350 - protein, 14 aa, Mycobacterium tuberculosis
VSKPEGKDKYGEEL

SEQ ID NO: 1373351 - protein, 21 aa, Mycobacterium tuberculosis
VSKPNGDGAHIGKEPVDHLLG

SEQ ID NO: 1373352 - protein, 22 aa, Mycobacterium tuberculosis
VSKPNGDGAHIGKNRRPSTRPL

SEQ ID NO: 1373353 - protein, 15 aa, Mycobacterium tuberculosis
VSPLTRPHRSKRGVA

SEQ ID NO: 1373354 - protein, 31 aa, Mycobacterium tuberculosis
VSPSPPEASQPAPGPRDPNRPFTVSVFGDSI

SEQ ID NO: 1373355 - protein, 15 aa, Mycobacterium tuberculosis
VSPTTVKSTELDQFP

SEQ ID NO: 1373356 - protein, 14 aa, Mycobacterium tuberculosis
VSTGYHNADDALNR

SEQ ID NO: 1373357 - protein, 12 aa, Mycobacterium tuberculosis
VSTIRSGQRSVR

SEQ ID NO: 1373358 - protein, 13 aa, Mycobacterium tuberculosis
VSTIRSGQRSVRS

SEQ ID NO: 1373359 - protein, 12 aa, Mycobacterium tuberculosis
VTDDRSAPHADS

SEQ ID NO: 1373360 - protein, 43 aa, Mycobacterium tuberculosis
VTDGTAMPDTNVAPAYRSSVSASVSGFGGDVEHPGVAAPTIAD

SEQ ID NO: 1373361 - protein, 7 aa, Mycobacterium tuberculosis
VTEETTG

SEQ ID NO: 1373362 - protein, 23 aa, Mycobacterium tuberculosis
VTEGDAARAAGRRGADPVSIRPF

SEQ ID NO: 1373363 - protein, 4 aa, Mycobacterium tuberculosis
VTGR

SEQ ID NO: 1373364 - protein, 11 aa, Mycobacterium tuberculosis
VTSALSSSHGL

SEQ ID NO: 1373365 - protein, 8 aa, Mycobacterium tuberculosis
VTSPADPE

SEQ ID NO: 1373366 - protein, 5 aa, Mycobacterium tuberculosis
VTVPP

SEQ ID NO: 1373367 - protein, 4 aa, Mycobacterium tuberculosis
WAGS

SEQ ID NO: 1373368 - protein, 4 aa, Mycobacterium tuberculosis
WAPA

SEQ ID NO: 1373369 - protein, 9 aa, Mycobacterium tuberculosis
WEHPDDRTA

SEQ ID NO: 1373370 - protein, 29 aa, Mycobacterium tuberculosis
WEPPTERVKPTSRRSRFTPRPDRAGHGQP

SEQ ID NO: 1373371 - protein, 10 aa, Mycobacterium tuberculosis
WGARNAQGRY

SEQ ID NO: 1373372 - protein, 10 aa, Mycobacterium tuberculosis
WGGADEPDRP

SEQ ID NO: 1373373 - protein, 6 aa, Mycobacterium tuberculosis
WGRPGP

SEQ ID NO: 1373374 - protein, 13 aa, Mycobacterium tuberculosis
WGSSAPGADVPGG

SEQ ID NO: 1373375 - protein, 7 aa, Mycobacterium tuberculosis
WKTQRTV

SEQ ID NO: 1373376 - protein, 7 aa, Mycobacterium tuberculosis
WNEDGSA

SEQ ID NO: 1373377 - protein, 14 aa, Mycobacterium tuberculosis
WPARSSSLRWAAIS

SEQ ID NO: 1373378 - protein, 6 aa, Mycobacterium tuberculosis
WPDQGD

SEQ ID NO: 1373379 - protein, 8 aa, Mycobacterium tuberculosis
WPPTPGSP

SEQ ID NO: 1373380 - protein, 12 aa, Mycobacterium tuberculosis
WPQSPVSPCRPL

SEQ ID NO: 1373381 - protein, 18 aa, Mycobacterium tuberculosis
WPRAAPRSYRRGAPSRIR

SEQ ID NO: 1373382 - protein, 13 aa, Mycobacterium tuberculosis
WPTARSAARRGLP

SEQ ID NO: 1373383 - protein, 14 aa, Mycobacterium tuberculosis
WRTPGSCSGRNSRM

SEQ ID NO: 1373384 - protein, 9 aa, Mycobacterium tuberculosis
WSSAGASDR

SEQ ID NO: 1373385 - protein, 4 aa, Mycobacterium tuberculosis
WVGE

SEQ ID NO: 1373386 - protein, 5 aa, Mycobacterium tuberculosis
YAGDE

SEQ ID NO: 1373387 - protein, 9 aa, Mycobacterium tuberculosis
YAGPGSASL

SEQ ID NO: 1373388 - protein, 5 aa, Mycobacterium tuberculosis
YAGSV

SEQ ID NO: 1373389 - protein, 15 aa, Mycobacterium tuberculosis
YARQSKSADYPSCTP

SEQ ID NO: 1373390 - protein, 54 aa, Mycobacterium tuberculosis
YATRAGGGGLARRPARRFGAGRSPALARTDSGSGSGDGRRGPGGALRAPVRRCH

SEQ ID NO: 1373391 - protein, 6 aa, Mycobacterium tuberculosis
YDPDAL

SEQ ID NO: 1373392 - protein, 14 aa, Mycobacterium tuberculosis
YDPVDNDYTVRVAC

SEQ ID NO: 1373393 - protein, 27 aa, Mycobacterium tuberculosis
YEAEKKKKKKKWANRVKKTRSFFFFFF

SEQ ID NO: 1373394 - protein, 6 aa, Mycobacterium tuberculosis
YEPPQT

SEQ ID NO: 1373395 - protein, 24 aa, Mycobacterium tuberculosis
YGFGSDEPVRQPPHPDHQRGRRAH

SEQ ID NO: 1373396 - protein, 12 aa, Mycobacterium tuberculosis
YGGRPCSGRCCE

SEQ ID NO: 1373397 - protein, 16 aa, Mycobacterium tuberculosis
YGPRTGGKSKVSGSLR

SEQ ID NO: 1373398 - protein, 9 aa, Mycobacterium tuberculosis
YGQRAGRSA

SEQ ID NO: 1373399 - protein, 4 aa, Mycobacterium tuberculosis
YHER

SEQ ID NO: 1373400 - protein, 23 aa, Mycobacterium tuberculosis
YHRGHSPTAGSRPVISVRWTKTG

SEQ ID NO: 1373401 - protein, 4 aa, Mycobacterium tuberculosis
YKNR

SEQ ID NO: 1373402 - protein, 4 aa, Mycobacterium tuberculosis
YNQD

SEQ ID NO: 1373403 - protein, 4 aa, Mycobacterium tuberculosis
YPGD

SEQ ID NO: 1373404 - protein, 4 aa, Mycobacterium tuberculosis
YPGT

SEQ ID NO: 1373405 - protein, 6 aa, Mycobacterium tuberculosis
YPNQPN

SEQ ID NO: 1373406 - protein, 10 aa, Mycobacterium tuberculosis
YPSPGLQRST

SEQ ID NO: 1373407 - protein, 4 aa, Mycobacterium tuberculosis
YPTG

SEQ ID NO: 1373408 - protein, 54 aa, Mycobacterium tuberculosis
YPYGPNTYGQDPYWGGQPQGGSYPPAYPPQKYPPGWPAGPYPPGPPPPGPGSKT

SEQ ID NO: 1373409 - protein, 8 aa, Mycobacterium tuberculosis
YQSSPVPG

SEQ ID NO: 1373410 - protein, 20 aa, Mycobacterium tuberculosis
YRPATPNPIHSDERSTPPDH

SEQ ID NO: 1373411 - protein, 23 aa, Mycobacterium tuberculosis
YRPPTAAPPPAGARGGTKAGNLA

SEQ ID NO: 1373412 - protein, 10 aa, Mycobacterium tuberculosis
YRSVPSGNTW

SEQ ID NO: 1373413 - protein, 19 aa, Mycobacterium tuberculosis
YRTPTSPTAVSRSGGWSRW

SEQ ID NO: 1373414 - protein, 6 aa, Mycobacterium tuberculosis
YSEHPA

SEQ ID NO: 1373415 - protein, 9 aa, Mycobacterium tuberculosis
YSGPGSRPL

SEQ ID NO: 1373416 - protein, 22 aa, Mycobacterium tuberculosis
YSRGGEKPDGRLYPEDQPERVS

SEQ ID NO: 1373417 - protein, 6 aa, Mycobacterium tuberculosis
YSRGPQ

SEQ ID NO: 1373418 - protein, 7 aa, Mycobacterium tuberculosis
YTPRADC

SEQ ID NO: 1373419 - protein, 5 aa, Mycobacterium tuberculosis
YTSGQ

SEQ ID NO: 1373420 - protein, 5 aa, Mycobacterium tuberculosis
YYNRG

SEQ ID NO: 1373421 - protein, 24 aa, Mycobacterium tuberculosis
AISRRSGCHLLLLAVLAAIALADL

SEQ ID NO: 1373422 - protein, 21 aa, Mycobacterium tuberculosis
CYHTAGIWRRGIVGHPIKLLK

SEQ ID NO: 1373423 - protein, 22 aa, Mycobacterium tuberculosis
EWFGELEFWAALIKVLALMAFL

SEQ ID NO: 1373424 - protein, 17 aa, Mycobacterium tuberculosis
FVFVCYHTAGIWRRGIV

SEQ ID NO: 1373425 - protein, 19 aa, Mycobacterium tuberculosis
FWAALIKVLALMAFLVVGT

SEQ ID NO: 1373426 - protein, 18 aa, Mycobacterium tuberculosis
GWATIVLCQLRLHKLANA

SEQ ID NO: 1373427 - protein, 27 aa, Mycobacterium tuberculosis
NNHGGLFPTSWLPLLIVTSGVVFAYSA

SEQ ID NO: 1373428 - protein, 21 aa, Mycobacterium tuberculosis
RAGLMAAVGFELFKQVGAIYL

SEQ ID NO: 1373429 - protein, 24 aa, Mycobacterium tuberculosis
TAGWYLVRKRVMAVARERLGHTGP

SEQ ID NO: 1373430 - protein, 18 aa, Mycobacterium tuberculosis
AAALIIIVGVVFVEQGQR

SEQ ID NO: 1373431 - protein, 27 aa, Mycobacterium tuberculosis
AAAPRCWQARAVSWMWQALAATLVAAV

SEQ ID NO: 1373432 - protein, 25 aa, Mycobacterium tuberculosis
AAAWAFSLAMIDGWQRGFAGRLTTR

SEQ ID NO: 1373433 - protein, 23 aa, Mycobacterium tuberculosis
AADELYTRVGFVLQEAQLVHGTA

SEQ ID NO: 1373434 - protein, 23 aa, Mycobacterium tuberculosis
AAGDLRRYAVLAATLGLLVGLIC

SEQ ID NO: 1373435 - protein, 26 aa, Mycobacterium tuberculosis
AAIPGRWRPAWIGWWVSLGLATATIG

SEQ ID NO: 1373436 - protein, 22 aa, Mycobacterium tuberculosis
AAKEGFVSFLLLSLSVAIVIGV

SEQ ID NO: 1373437 - protein, 19 aa, Mycobacterium tuberculosis
AALAGPRVAVAIATVNAVA

SEQ ID NO: 1373438 - protein, 29 aa, Mycobacterium tuberculosis
AALTGTPAWEMFKPWAITSMAIAVAVALV

SEQ ID NO: 1373439 - protein, 26 aa, Mycobacterium tuberculosis
AAPLLGVLCSISWQRPVPVIQVHGDP

SEQ ID NO: 1373440 - protein, 25 aa, Mycobacterium tuberculosis
AAPWHVRAGAFAIDVLPGLAVAATM

SEQ ID NO: 1373441 - protein, 23 aa, Mycobacterium tuberculosis
AASLDHPGTLYGYVYADQTPDFP

SEQ ID NO: 1373442 - protein, 17 aa, Mycobacterium tuberculosis
AAVCVRYALELSSPLAV

SEQ ID NO: 1373443 - protein, 19 aa, Mycobacterium tuberculosis
ADAPSSVAVRQMAEAFHES

SEQ ID NO: 1373444 - protein, 17 aa, Mycobacterium tuberculosis
ADGESDFIYSLTTPLYG

SEQ ID NO: 1373445 - protein, 17 aa, Mycobacterium tuberculosis
ADIMLMSAIMPVTVAAA

SEQ ID NO: 1373446 - protein, 22 aa, Mycobacterium tuberculosis
AEGQRLLARLDVLSLAAASAPV

SEQ ID NO: 1373447 - protein, 21 aa, Mycobacterium tuberculosis
AEILITAGFFFGREVPDNAAA

SEQ ID NO: 1373448 - protein, 26 aa, Mycobacterium tuberculosis
AFELPFYRLMLSYMLVSVFLAFVANL

SEQ ID NO: 1373449 - protein, 19 aa, Mycobacterium tuberculosis
AFVDFSRPALIAVGVPVMI

SEQ ID NO: 1373450 - protein, 27 aa, Mycobacterium tuberculosis
AGGLRLRSRGKLAWSAFAFSLPIPPVV

SEQ ID NO: 1373451 - protein, 23 aa, Mycobacterium tuberculosis
AGLAAICYAELASAVPISGSAYS

SEQ ID NO: 1373452 - protein, 23 aa, Mycobacterium tuberculosis
AGNWATSIWCFRGDAEATMETSV

SEQ ID NO: 1373453 - protein, 17 aa, Mycobacterium tuberculosis
AGTKLLVVFGISVLLTF

SEQ ID NO: 1373454 - protein, 18 aa, Mycobacterium tuberculosis
AIGPWRLLVRDLAHLVDT

SEQ ID NO: 1373455 - protein, 26 aa, Mycobacterium tuberculosis
AILPPRLFGSPVFAVCCVLSFVVGFA

SEQ ID NO: 1373456 - protein, 18 aa, Mycobacterium tuberculosis
AIVAPLYLVGSVVISYMS

SEQ ID NO: 1373457 - protein, 19 aa, Mycobacterium tuberculosis
AIWLRSRRAPIDHTNVNAD

SEQ ID NO: 1373458 - protein, 18 aa, Mycobacterium tuberculosis
AKADVLLDCFRPGTCERL

SEQ ID NO: 1373459 - protein, 22 aa, Mycobacterium tuberculosis
AKSLGAWFPLAFLLVHTVVTVP

SEQ ID NO: 1373460 - protein, 24 aa, Mycobacterium tuberculosis
AKTGKLRPALFVVPTDAPGFSYTP

SEQ ID NO: 1373461 - protein, 25 aa, Mycobacterium tuberculosis
AKVVNLRSAPGFSFVSEDLDRVRSL

SEQ ID NO: 1373462 - protein, 24 aa, Mycobacterium tuberculosis
ALADRLRRILPFVNRISGALLVVV

SEQ ID NO: 1373463 - protein, 21 aa, Mycobacterium tuberculosis
ALIAVPVGLLIGHTGRGTLLV

SEQ ID NO: 1373464 - protein, 23 aa, Mycobacterium tuberculosis
ALIEREAAELGLKAVVRQSDSEA

SEQ ID NO: 1373465 - protein, 24 aa, Mycobacterium tuberculosis
ALLAGTLPLLWSRGLSALPVTYVG

SEQ ID NO: 1373466 - protein, 25 aa, Mycobacterium tuberculosis
ALLGFPLLLVVGVSLAYLYVVLLFA

SEQ ID NO: 1373467 - protein, 24 aa, Mycobacterium tuberculosis
ALLMIGWWSGFPYWTTAAVCALGG

SEQ ID NO: 1373468 - protein, 17 aa, Mycobacterium tuberculosis
ALLYKPFVRQIRTTRQM

SEQ ID NO: 1373469 - protein, 26 aa, Mycobacterium tuberculosis
ALRYYRKETLRLIAQIGMGTGAMAVV

SEQ ID NO: 1373470 - protein, 24 aa, Mycobacterium tuberculosis
ALTARKRIAWLVLLANMVLAAVVN

SEQ ID NO: 1373471 - protein, 31 aa, Mycobacterium tuberculosis; identical to SEQ ID NO: 156196

SEQ ID NO: 1373472 - protein, 26 aa, Mycobacterium tuberculosis
ALWACADGLVGFWKLSIMQVANTFAA

SEQ ID NO: 1373473 - protein, 18 aa, Mycobacterium tuberculosis
APFPDRNLIIFVVSVVIL

SEQ ID NO: 1373474 - protein, 17 aa, Mycobacterium tuberculosis
APFVLPLAVTIFVFILI

SEQ ID NO: 1373475 - protein, 27 aa, Mycobacterium tuberculosis
APMGRRLAALLIDWLIAYGLALLGVEF

SEQ ID NO: 1373476 - protein, 19 aa, Mycobacterium tuberculosis
APSRGRVAAVVAMCVASAG

SEQ ID NO: 1373477 - protein, 23 aa, Mycobacterium tuberculosis
ARDRASIELAIAVMLLVILMVIY

SEQ ID NO: 1373478 - protein, 19 aa, Mycobacterium tuberculosis
ARETLDYFAVQNVSVKVIS

SEQ ID NO: 1373479 - protein, 21 aa, Mycobacterium tuberculosis
ARLLYQWRWSLATLWFTTVFL

SEQ ID NO: 1373480 - protein, 24 aa, Mycobacterium tuberculosis
ARLWLPTYLAWFVGGMMLAVLAAM

SEQ ID NO: 1373481 - protein, 19 aa, Mycobacterium tuberculosis
ARQGFKRWWTRFVPPSIER

SEQ ID NO: 1373482 - protein, 19 aa, Mycobacterium tuberculosis
ARQPGGYLLGGFGPAPEGM

SEQ ID NO: 1373483 - protein, 23 aa, Mycobacterium tuberculosis
ASGKSRKSPVIWWTVVTAAALGA

SEQ ID NO: 1373484 - protein, 23 aa, Mycobacterium tuberculosis
ASHELRTPLAAIRGYTELTQRIG

SEQ ID NO: 1373485 - protein, 24 aa, Mycobacterium tuberculosis
ASVSSWLLAWPMWADGAVFLLVSV

SEQ ID NO: 1373486 - protein, 26 aa, Mycobacterium tuberculosis
ATCALAALCYAEFASTLPVAGSAYTF

SEQ ID NO: 1373487 - protein, 23 aa, Mycobacterium tuberculosis
ATRLRDRLGYVFGPPGWEPRTID

SEQ ID NO: 1373488 - protein, 19 aa, Mycobacterium tuberculosis
ATVAITFLGMVFTQLGILK

SEQ ID NO: 1373489 - protein, 26 aa, Mycobacterium tuberculosis
AVADRLKFGAWLLFAGLWATFVYFPV

SEQ ID NO: 1373490 - protein, 25 aa, Mycobacterium tuberculosis
AVDAWLRLCQTYGWAPGVMGASSQG

SEQ ID NO: 1373491 - protein, 20 aa, Mycobacterium tuberculosis
AVVGTWWRYRYDKFGWTTRS

SEQ ID NO: 1373492 - protein, 22 aa, Mycobacterium tuberculosis
AWLMSVVLWGGLIAVFGPALIP

SEQ ID NO: 1373493 - protein, 25 aa, Mycobacterium tuberculosis
AYDIGLFYRYAWQNPVFADIVATRT

SEQ ID NO: 1373494 - protein, 25 aa, Mycobacterium tuberculosis
AYLLLVLVCRRRWQPRLLLATMAGL

SEQ ID NO: 1373495 - protein, 26 aa, Mycobacterium tuberculosis
CAIAVWCVTAIIGAFAARHGYRQWRA

SEQ ID NO: 1373496 - protein, 17 aa, Mycobacterium tuberculosis
CIKEASAGEAGQIYSLI

SEQ ID NO: 1373497 - protein, 24 aa, Mycobacterium tuberculosis
CLALLHYRAWAIPVAFVIAQGTAT

SEQ ID NO: 1373498 - protein, 19 aa, Mycobacterium tuberculosis
CLVSVWRSVPFATVVLLAA

SEQ ID NO: 1373499 - protein, 20 aa, Mycobacterium tuberculosis
CVLLGVPMALVLARSRGRLV

SEQ ID NO: 1373500 - protein, 21 aa, Mycobacterium tuberculosis
DAGLAVGMFLTFSTFGTLSYA

SEQ ID NO: 1373501 - protein, 25 aa, Mycobacterium tuberculosis
DAVTARIGIELGFAVLNHTQHDVAD

SEQ ID NO: 1373502 - protein, 24 aa, Mycobacterium tuberculosis
DAYLKALGANAVDFTWITDFKPYQ

SEQ ID NO: 1373503 - protein, 23 aa, Mycobacterium tuberculosis
DCFRPGTCERLGIGPDDCASVNP

SEQ ID NO: 1373504 - protein, 24 aa, Mycobacterium tuberculosis
DDPKWRTGADFGIAAGSWLPALLW

SEQ ID NO: 1373505 - protein, 23 aa, Mycobacterium tuberculosis
DEPRAWRLKVTVTEEGGQYKMSK

SEQ ID NO: 1373506 - protein, 22 aa, Mycobacterium tuberculosis
DFLSVGWWPVFNVADPSVVGGA

SEQ ID NO: 1373507 - protein, 24 aa, Mycobacterium tuberculosis
DGIKERRFHIALVGAMMVAALALT

SEQ ID NO: 1373508 - protein, 24 aa, Mycobacterium tuberculosis
DGVVLHWIIDYWNRFSLWVQHLVS

SEQ ID NO: 1373509 - protein, 36 aa, Mycobacterium tuberculosis; identical to SEQ ID NO: 156480

SEQ ID NO: 1373510 - protein, 18 aa, Mycobacterium tuberculosis
DLMLYALVMAFSFTTLST

SEQ ID NO: 1373511 - protein, 18 aa, Mycobacterium tuberculosis
DMIEVLTGMCARLYGRRG

SEQ ID NO: 1373512 - protein, 19 aa, Mycobacterium tuberculosis
DPARWPWPTFTVNVVGAFL

SEQ ID NO: 1373513 - protein, 17 aa, Mycobacterium tuberculosis
DPCHVRAVVDWELSTLG

SEQ ID NO: 1373514 - protein, 18 aa, Mycobacterium tuberculosis
DPDRRQDLAMTWLLAGLV

SEQ ID NO: 1373515 - protein, 21 aa, Mycobacterium tuberculosis
DPPFVAYHLFGPAPATDNDLL

SEQ ID NO: 1373516 - protein, 23 aa, Mycobacterium tuberculosis
DPSRVRRSGGTGLGLAISVEDAR

SEQ ID NO: 1373517 - protein, 24 aa, Mycobacterium tuberculosis
DRAGELLFWLPYPSFATYLHVGCA

SEQ ID NO: 1373518 - protein, 24 aa, Mycobacterium tuberculosis
DRDRLKIPFGHELKTGNVMYLDIK

SEQ ID NO: 1373519 - protein, 21 aa, Mycobacterium tuberculosis
DRRLTARGGERGMTYDIALWA

SEQ ID NO: 1373520 - protein, 21 aa, Mycobacterium tuberculosis
DRYADAIAMGADLEAIAEELA

SEQ ID NO: 1373521 - protein, 19 aa, Mycobacterium tuberculosis
DSRGYLLRDGELTQITKDD

SEQ ID NO: 1373522 - protein, 24 aa, Mycobacterium tuberculosis
DTRHVGSVLDWWSDPVTAPLGTSP

SEQ ID NO: 1373523 - protein, 18 aa, Mycobacterium tuberculosis
DVDIKLIARTTHHLFQPL

SEQ ID NO: 1373524 - protein, 18 aa, Mycobacterium tuberculosis
DVKLADFGLVRAVAAASI

SEQ ID NO: 1373525 - protein, 19 aa, Mycobacterium tuberculosis
DVPTWPFVVGTVAAVAVAA

SEQ ID NO: 1373526 - protein, 29 aa, Mycobacterium tuberculosis
DYSDHDLRLIIAMTVCIVLLILIVLLRAI

SEQ ID NO: 1373527 - protein, 21 aa, Mycobacterium tuberculosis
EAFAAVASFSRALVLVTVGII

SEQ ID NO: 1373528 - protein, 18 aa, Mycobacterium tuberculosis
EAIEQGWFITSVSLLPTL

SEQ ID NO: 1373529 - protein, 32 aa, Mycobacterium tuberculosis; identical to SEQ ID NO: 156602

SEQ ID NO: 1373530 - protein, 25 aa, Mycobacterium tuberculosis
EAVMNKLRWVLLIVGGIGVAVAAVA

SEQ ID NO: 1373531 - protein, 19 aa, Mycobacterium tuberculosis
EAWQVIAVALIVYSAYANW

SEQ ID NO: 1373532 - protein, 25 aa, Mycobacterium tuberculosis
EDSKEARDALGLTLTPSLAPWVALR

SEQ ID NO: 1373533 - protein, 25 aa, Mycobacterium tuberculosis
EEIRKRWDRYAAFAEKTFNVTIPAI

SEQ ID NO: 1373534 - protein, 25 aa, Mycobacterium tuberculosis
EELRKAGEVFTAIARMYSDADVRAA

SEQ ID NO: 1373535 - protein, 18 aa, Mycobacterium tuberculosis
EFVWCMQGLPSPYLTIAF

SEQ ID NO: 1373536 - protein, 19 aa, Mycobacterium tuberculosis
EGEIAPPTRVVLRKQRNVQ

SEQ ID NO: 1373537 - protein, 26 aa, Mycobacterium tuberculosis
EGKEVRFGVGASGLWAASTTGTSNGS

SEQ ID NO: 1373538 - protein, 22 aa, Mycobacterium tuberculosis
EGSFWRRLLSPPGFTSIAHVFV

SEQ ID NO: 1373539 - protein, 19 aa, Mycobacterium tuberculosis
EGTWWGWHGAGWFLLTLMV

SEQ ID NO: 1373540 - protein, 26 aa, Mycobacterium tuberculosis
EHTTHWGLQIDHFWWTAIWAAILLSI

SEQ ID NO: 1373541 - protein, 25 aa, Mycobacterium tuberculosis
EIELTGQEAFVWIGLHEPDENQMQD

SEQ ID NO: 1373542 - protein, 26 aa, Mycobacterium tuberculosis
EIPGCLVALYLVARLRHRGMNEAGYM

SEQ ID NO: 1373543 - protein, 20 aa, Mycobacterium tuberculosis
EIVLAVANLMWFVFAGFGAL

SEQ ID NO: 1373544 - protein, 19 aa, Mycobacterium tuberculosis
ELAFRGVLHGALNRAWGFR

SEQ ID NO: 1373545 - protein, 20 aa, Mycobacterium tuberculosis
ELGIILALLMGWQFTAAEFV

SEQ ID NO: 1373546 - protein, 20 aa, Mycobacterium tuberculosis
ELLDRLGAHLTRHVGPGVEY

SEQ ID NO: 1373547 - protein, 23 aa, Mycobacterium tuberculosis
ENFNSAFYLFGLVLLVMAGNLAR

SEQ ID NO: 1373548 - protein, 25 aa, Mycobacterium tuberculosis
EPEPELPNLTGRVEFEHVNFAYLPG

SEQ ID NO: 1373549 - protein, 26 aa, Mycobacterium tuberculosis
EQTRKRFGDTMGYRLVIYPEYASLDR

SEQ ID NO: 1373550 - protein, 21 aa, Mycobacterium tuberculosis
ERKIEAFAMFNVFYQSGILLG

SEQ ID NO: 1373551 - protein, 20 aa, Mycobacterium tuberculosis
ERLFNRWGVRAVFLGRFIAL

SEQ ID NO: 1373552 - protein, 26 aa, Mycobacterium tuberculosis
ERLPKRLAEAVGIVLELLAGIPSVVV

SEQ ID NO: 1373553 - protein, 19 aa, Mycobacterium tuberculosis
ERQVRRWGSQWELVRLPDD

SEQ ID NO: 1373554 - protein, 19 aa, Mycobacterium tuberculosis
ESAAWPAGVPWTDASLSSA

SEQ ID NO: 1373555 - protein, 27 aa, Mycobacterium tuberculosis
ESLIDVVHWPGYLLIVAGVVGGVGALA

SEQ ID NO: 1373556 - protein, 22 aa, Mycobacterium tuberculosis
ETERGFSMALGRLGDPADSDCL

SEQ ID NO: 1373557 - protein, 19 aa, Mycobacterium tuberculosis
EVLKCGAQVVLPADADGHA

SEQ ID NO: 1373558 - protein, 27 aa, Mycobacterium tuberculosis
EVRWGVAGRMVVAWLVTLPLAGLVGAF

SEQ ID NO: 1373559 - protein, 24 aa, Mycobacterium tuberculosis
EYLCLMPIFPLALWLMNVYAAIRY

SEQ ID NO: 1373560 - protein, 26 aa, Mycobacterium tuberculosis
FARLQFRGRDALFWVYVATLMVPGTV

SEQ ID NO: 1373561 - protein, 24 aa, Mycobacterium tuberculosis
FATARSHLAGDFLSYYDQFTQQIV

SEQ ID NO: 1373562 - protein, 27 aa, Mycobacterium tuberculosis
FAVCCVLSFVVGFAMLGALTFVPIYLG

SEQ ID NO: 1373563 - protein, 21 aa, Mycobacterium tuberculosis
FCAALGLPIVPLFAYSRTAAM

SEQ ID NO: 1373564 - protein, 31 aa, Mycobacterium tuberculosis; identical to SEQ ID NO: 156778

SEQ ID NO: 1373565 - protein, 29 aa, Mycobacterium tuberculosis
FEAHLAGCPECRGAVTELCGVPALLSQLD

SEQ ID NO: 1373566 - protein, 31 aa, Mycobacterium tuberculosis; identical to SEQ ID NO: 156792

SEQ ID NO: 1373567 - protein, 19 aa, Mycobacterium tuberculosis
FGARLRAFVVKKPGADLDE

SEQ ID NO: 1373568 - protein, 20 aa, Mycobacterium tuberculosis
FGNDHFAEFAPGMKSIDDAL

SEQ ID NO: 1373569 - protein, 20 aa, Mycobacterium tuberculosis
FGRDLGFYAFELPFYRLMLS

SEQ ID NO: 1373570 - protein, 18 aa, Mycobacterium tuberculosis
FGVPRLAQQKVLLFGIAF

SEQ ID NO: 1373571 - protein, 20 aa, Mycobacterium tuberculosis
FGYASALAWVMFAILLVLTV

SEQ ID NO: 1373572 - protein, 18 aa, Mycobacterium tuberculosis
FIDYCVNMLLSTAATYAP

SEQ ID NO: 1373573 - protein, 20 aa, Mycobacterium tuberculosis
FIGLWIFGWNRLPRLVHLAC

SEQ ID NO: 1373574 - protein, 18 aa, Mycobacterium tuberculosis
FKRWWTRFVPPSIERSTY

SEQ ID NO: 1373575 - protein, 18 aa, Mycobacterium tuberculosis
FLEFGYASALAWVMFAIL

SEQ ID NO: 1373576 - protein, 18 aa, Mycobacterium tuberculosis
FLLGQEMHWSIPGLTFVI

SEQ ID NO: 1373577 - protein, 20 aa, Mycobacterium tuberculosis
FLLLPRLTTVLSKLPEGSEV

SEQ ID NO: 1373578 - protein, 32 aa, Mycobacterium tuberculosis; identical to SEQ ID NO: 156849

SEQ ID NO: 1373579 - protein, 18 aa, Mycobacterium tuberculosis
FLTRLRVGEKLVDAKAVA

SEQ ID NO: 1373580 - protein, 18 aa, Mycobacterium tuberculosis
FLVLIWVFGGLLAAGLPM

SEQ ID NO: 1373581 - protein, 17 aa, Mycobacterium tuberculosis
FLYELIWNVLVFVALIY

SEQ ID NO: 1373582 - protein, 19 aa, Mycobacterium tuberculosis
FPGQAGLGVGGLALNQPPP

SEQ ID NO: 1373583 - protein, 22 aa, Mycobacterium tuberculosis
FPPDGRAGVTVITLGNHRGSAY

SEQ ID NO: 1373584 - protein, 25 aa, Mycobacterium tuberculosis
FRAIDRLGPELSVRQIAEEAGTAKP

SEQ ID NO: 1373585 - protein, 18 aa, Mycobacterium tuberculosis
FREAVGILAGGRLHIVIG

SEQ ID NO: 1373586 - protein, 23 aa, Mycobacterium tuberculosis
FRLNCASCHNFTGKGGALSSGKY

SEQ ID NO: 1373587 - protein, 24 aa, Mycobacterium tuberculosis
FRQRCVTSWAGFRGAVSLAAALAV

SEQ ID NO: 1373588 - protein, 24 aa, Mycobacterium tuberculosis
FTISSVLCAVAWDEATLVIARLSQ

SEQ ID NO: 1373589 - protein, 18 aa, Mycobacterium tuberculosis
FTPFSWVIEHAVLPYFTA

SEQ ID NO: 1373590 - protein, 32 aa, Mycobacterium tuberculosis; identical to SEQ ID NO: 156912

SEQ ID NO: 1373591 - protein, 24 aa, Mycobacterium tuberculosis
FYFVLPRWPELMGDTGHSLGTGLR

SEQ ID NO: 1373592 - protein, 30 aa, Mycobacterium tuberculosis; identical to SEQ ID NO: 156946

SEQ ID NO: 1373593 - protein, 18 aa, Mycobacterium tuberculosis
GAGVLYFYFVLPRWPELM

SEQ ID NO: 1373594 - protein, 19 aa, Mycobacterium tuberculosis
GALRVNWAVGIQLFDYTGE

SEQ ID NO: 1373595 - protein, 29 aa, Mycobacterium tuberculosis
GALYVRVGDRLYPALNLASARLITGRPDN

SEQ ID NO: 1373596 - protein, 31 aa, Mycobacterium tuberculosis; identical to SEQ ID NO: 156964

SEQ ID NO: 1373597 - protein, 23 aa, Mycobacterium tuberculosis
GANFWRRGALLIGIGVGVAAVLR

SEQ ID NO: 1373598 - protein, 29 aa, Mycobacterium tuberculosis
GAPIGRAWLRLFGVLPFDYDRLSIAELEP

SEQ ID NO: 1373599 - protein, 23 aa, Mycobacterium tuberculosis
GAVIGTAWGYRWGGLGAGVIGAV

SEQ ID NO: 1373600 - protein, 25 aa, Mycobacterium tuberculosis
GAVNGLRALPTLGVLLLGVLLFGLG

SEQ ID NO: 1373601 - protein, 22 aa, Mycobacterium tuberculosis
GCRRCGIPLPVLLDAVAPGVVL

SEQ ID NO: 1373602 - protein, 22 aa, Mycobacterium tuberculosis
GDRLAFSNGILFLAAAAIGAVV

SEQ ID NO: 1373603 - protein, 19 aa, Mycobacterium tuberculosis
GDVVWPAFVVGVASSAPPF

SEQ ID NO: 1373604 - protein, 22 aa, Mycobacterium tuberculosis
GDWLLAIPWWTWAFVFGLGAFL

SEQ ID NO: 1373605 - protein, 24 aa, Mycobacterium tuberculosis
GEDMARYAAPRARRSIARRQHSNA

SEQ ID NO: 1373606 - protein, 20 aa, Mycobacterium tuberculosis
GETLWEFLPRSVIGGLRSAV

SEQ ID NO: 1373607 - protein, 18 aa, Mycobacterium tuberculosis
GEVLPHLAGELTQAATAF

SEQ ID NO: 1373608 - protein, 45 aa, Mycobacterium tuberculosis; identical to SEQ ID NO: 157025

SEQ ID NO: 1373609 - protein, 17 aa, Mycobacterium tuberculosis
GGILGVMYSIPLRRALV

SEQ ID NO: 1373610 - protein, 25 aa, Mycobacterium tuberculosis
GGQLRITRWFAVRWGAERSLVVGAT

SEQ ID NO: 1373611 - protein, 19 aa, Mycobacterium tuberculosis
GGTLRHWLQPVVGSHEEAT

SEQ ID NO: 1373612 - protein, 25 aa, Mycobacterium tuberculosis
GGTPAILFCFGFFLLVFTGGGIYSI

SEQ ID NO: 1373613 - protein, 27 aa, Mycobacterium tuberculosis
GGVGLKAFWYHFAIMFEALFILTTVDA

SEQ ID NO: 1373614 - protein, 20 aa, Mycobacterium tuberculosis
GIGPIPWLIEPRWAMVSLCL

SEQ ID NO: 1373615 - protein, 18 aa, Mycobacterium tuberculosis
GILAIRWRLPSGTEIDVG

SEQ ID NO: 1373616 - protein, 24 aa, Mycobacterium tuberculosis
GILILVAVGMFDWHAMRKAHVSPR

SEQ ID NO: 1373617 - protein, 24 aa, Mycobacterium tuberculosis
GIMQRPRFRMPFSPYSGYLTLLFL

SEQ ID NO: 1373618 - protein, 18 aa, Mycobacterium tuberculosis
GIVSGILLSIARVVGETA

SEQ ID NO: 1373619 - protein, 22 aa, Mycobacterium tuberculosis
GKGDFLLGLLLPHGLLELTAVF

SEQ ID NO: 1373620 - protein, 20 aa, Mycobacterium tuberculosis
GLIFGWLAFLLVFGLFVRKG

SEQ ID NO: 1373621 - protein, 19 aa, Mycobacterium tuberculosis
GLIGIAWCALFPIIWALSG

SEQ ID NO: 1373622 - protein, 17 aa, Mycobacterium tuberculosis
GLMAYRFRGHFWLATIV

SEQ ID NO: 1373623 - protein, 24 aa, Mycobacterium tuberculosis
GLQVLCAIGAVYLGSRTGAGFGRD

SEQ ID NO: 1373624 - protein, 23 aa, Mycobacterium tuberculosis
GLRRPWRPRTFLRAISQTLRLSY

SEQ ID NO: 1373625 - protein, 25 aa, Mycobacterium tuberculosis
GMLPVPRYLAGQSFWRTPSIFHFRY

SEQ ID NO: 1373626 - protein, 26 aa, Mycobacterium tuberculosis
GMSNWECVRRVTLPWVSSGIVGAVVL

SEQ ID NO: 1373627 - protein, 23 aa, Mycobacterium tuberculosis
GNEALAVPIWWSYAAAEILITAG

SEQ ID NO: 1373628 - protein, 18 aa, Mycobacterium tuberculosis
GNFVENWAILIIPFALCF

SEQ ID NO: 1373629 - protein, 19 aa, Mycobacterium tuberculosis
GPQQYSLVLGDGVQTLPPL

SEQ ID NO: 1373630 - protein, 19 aa, Mycobacterium tuberculosis
GQFAGIAIEEFIWARQHAR

SEQ ID NO: 1373631 - protein, 28 aa, Mycobacterium tuberculosis
GQIPNQRWFSWLALLTMPAPFLANSAGW

SEQ ID NO: 1373632 - protein, 20 aa, Mycobacterium tuberculosis
GRAGPAIRWLGGIGAVIPLL

SEQ ID NO: 1373633 - protein, 23 aa, Mycobacterium tuberculosis
GRMLFGDELWEWVNPNNVTHTGD

SEQ ID NO: 1373634 - protein, 28 aa, Mycobacterium tuberculosis
GRMRLGDFWGYLAGWGFVVGKTASCAAM

SEQ ID NO: 1373635 - protein, 20 aa, Mycobacterium tuberculosis
GRPKLADWVTLAITAMASGT

SEQ ID NO: 1373636 - protein, 20 aa, Mycobacterium tuberculosis
GRSATAMVWLRGEAGTTQAA

SEQ ID NO: 1373637 - protein, 22 aa, Mycobacterium tuberculosis
GRYKIFPVAGMALMAVAFLLMS

SEQ ID NO: 1373638 - protein, 23 aa, Mycobacterium tuberculosis
GTEYEWSTPAALVAKIKEIVGDV

SEQ ID NO: 1373639 - protein, 23 aa, Mycobacterium tuberculosis
GTPELAGIWVYERRFTDDELLRL

SEQ ID NO: 1373640 - protein, 22 aa, Mycobacterium tuberculosis
GTSLPTVVRWARMPEDVAHANE

SEQ ID NO: 1373641 - protein, 25 aa, Mycobacterium tuberculosis
GVPKWKTIVRIVAPIAMPGIVSGIL

SEQ ID NO: 1373642 - protein, 18 aa, Mycobacterium tuberculosis
GYFVCFVALFVLSGLGNG

SEQ ID NO: 1373643 - protein, 24 aa, Mycobacterium tuberculosis
HANDLRPSWLPKLMAHGGGTTAEF

SEQ ID NO: 1373644 - protein, 21 aa, Mycobacterium tuberculosis
HELKTGNVMYLDIKEGAEFGA

SEQ ID NO: 1373645 - protein, 20 aa, Mycobacterium tuberculosis
HKATSMVVVPVMLSRILDQL

SEQ ID NO: 1373646 - protein, 22 aa, Mycobacterium tuberculosis
HNLFKPLLLFFYFGFLIPIFKV

SEQ ID NO: 1373647 - protein, 21 aa, Mycobacterium tuberculosis
HPPGALLTFVWLDRIGLRGGG

SEQ ID NO: 1373648 - protein, 19 aa, Mycobacterium tuberculosis
HRLVVPRVVAATIVAALLN

SEQ ID NO: 1373649 - protein, 19 aa, Mycobacterium tuberculosis
HTEMPGWMRAFASFTPARA

SEQ ID NO: 1373650 - protein, 22 aa, Mycobacterium tuberculosis
HYFPRHRFLFGDKYDSVMIDQK

SEQ ID NO: 1373651 - protein, 18 aa, Mycobacterium tuberculosis
IAAFKIIMLCLWWGAATS

SEQ ID NO: 1373652 - protein, 24 aa, Mycobacterium tuberculosis
IAAKRVDCPLTWVERWARTKAAMT

SEQ ID NO: 1373653 - protein, 25 aa, Mycobacterium tuberculosis
IAVFGMRLVFPLAIIWTTAGLDPVR

SEQ ID NO: 1373654 - protein, 19 aa, Mycobacterium tuberculosis
ICEPVRIGLVVLMLNRRRP

SEQ ID NO: 1373655 - protein, 26 aa, Mycobacterium tuberculosis
IDDALELRGRILSAFEQAERSSDPER

SEQ ID NO: 1373656 - protein, 17 aa, Mycobacterium tuberculosis
IEGGTLRELLIERGPMP

SEQ ID NO: 1373657 - protein, 22 aa, Mycobacterium tuberculosis
IETESRFTLIYGNRTKESTMFR

SEQ ID NO: 1373658 - protein, 25 aa, Mycobacterium tuberculosis
IFMVGFYIPFAIPWNQFVGGASSGV

SEQ ID NO: 1373659 - protein, 17 aa, Mycobacterium tuberculosis
IFSEHRSSALVLVGLGL

SEQ ID NO: 1373660 - protein, 25 aa, Mycobacterium tuberculosis
IFVITPLRIAFLILLVGTTLEVLTE

SEQ ID NO: 1373661 - protein, 26 aa, Mycobacterium tuberculosis
IGAFLGRIYDSWARWSGDDDERKKRL

SEQ ID NO: 1373662 - protein, 20 aa, Mycobacterium tuberculosis
IGFALGWRPALTALTLGAGI

SEQ ID NO: 1373663 - protein, 28 aa, Mycobacterium tuberculosis
IGGFYRTCVLTGKALVRRPFHWREAIEQ

SEQ ID NO: 1373664 - protein, 24 aa, Mycobacterium tuberculosis
IGGITVRTGLLWWTVAIHLLASMT

SEQ ID NO: 1373665 - protein, 20 aa, Mycobacterium tuberculosis
IGLVIATAVAVSWTARALGM

SEQ ID NO: 1373666 - protein, 25 aa, Mycobacterium tuberculosis
IGVVPLWRYRVHRWEISPQAVFTRT

SEQ ID NO: 1373667 - protein, 25 aa, Mycobacterium tuberculosis
ILLVKKIWWPLAVWLLLIVMNVDAG

SEQ ID NO: 1373668 - protein, 24 aa, Mycobacterium tuberculosis
ILRSAARPGTWSLFDGGYTFASKI

SEQ ID NO: 1373669 - protein, 21 aa, Mycobacterium tuberculosis
ILSRRCRRVVLIAAVVDGVVD

SEQ ID NO: 1373670 - protein, 19 aa, Mycobacterium tuberculosis
ILYIISFSLFIYGLMGLTG

SEQ ID NO: 1373671 - protein, 24 aa, Mycobacterium tuberculosis
IPDVLRPDLTIAYTDTDGYGQRGD

SEQ ID NO: 1373672 - protein, 25 aa, Mycobacterium tuberculosis
IPIAIFMGCYLRFLRPGRVSEVSLI

SEQ ID NO: 1373673 - protein, 17 aa, Mycobacterium tuberculosis
IPQRRASPARVISRRVV

SEQ ID NO: 1373674 - protein, 24 aa, Mycobacterium tuberculosis
IPVDEWAVALALALRAFPMLIDEF

SEQ ID NO: 1373675 - protein, 20 aa, Mycobacterium tuberculosis
IRDGTKYDILIVGIAAVCLV

SEQ ID NO: 1373676 - protein, 25 aa, Mycobacterium tuberculosis
IRPVAPEAYALYGISRVLPQALRST

SEQ ID NO: 1373677 - protein, 26 aa, Mycobacterium tuberculosis
ISDGAVFCGLLWWIAFHMRDRPLVIA

SEQ ID NO: 1373678 - protein, 26 aa, Mycobacterium tuberculosis
ISFIIGRPLIWLSFRNEKLNAAFRYA

SEQ ID NO: 1373679 - protein, 32 aa, Mycobacterium tuberculosis; identical to SEQ ID NO: 157496

SEQ ID NO: 1373680 - protein, 17 aa, Mycobacterium tuberculosis
ISGFGWASGYVGSVALL

SEQ ID NO: 1373681 - protein, 20 aa, Mycobacterium tuberculosis
ISIDGVRIGPNVTIRQAGGA

SEQ ID NO: 1373682 - protein, 18 aa, Mycobacterium tuberculosis
ISPKKSWEGFAGSLVCGI

SEQ ID NO: 1373683 - protein, 17 aa, Mycobacterium tuberculosis
ITSGHKWRVLTVATADL

SEQ ID NO: 1373684 - protein, 31 aa, Mycobacterium tuberculosis; identical to SEQ ID NO: 157518

SEQ ID NO: 1373685 - protein, 19 aa, Mycobacterium tuberculosis
ITVLILWAPLLIFGFILMW

SEQ ID NO: 1373686 - protein, 25 aa, Mycobacterium tuberculosis
IVFDIEIVFLYPWAVSYDSLGTFAL

SEQ ID NO: 1373687 - protein, 24 aa, Mycobacterium tuberculosis
IVTVVASYSWYYAWTPGTGYLANL

SEQ ID NO: 1373688 - protein, 26 aa, Mycobacterium tuberculosis
IVVICVASMLIAHAMVRPIRRLEVGT

SEQ ID NO: 1373689 - protein, 24 aa, Mycobacterium tuberculosis
KHRGELVYLPPAWFDREHRSENPP

SEQ ID NO: 1373690 - protein, 17 aa, Mycobacterium tuberculosis
KKVATDWHQLVGAQSVE

SEQ ID NO: 1373691 - protein, 24 aa, Mycobacterium tuberculosis
KLAMQEIPQVFGYDYQTVERSLTA

SEQ ID NO: 1373692 - protein, 23 aa, Mycobacterium tuberculosis
KLSEISAAIGLRQLVGLDRRLAS

SEQ ID NO: 1373693 - protein, 25 aa, Mycobacterium tuberculosis
KMGFGLGEASAFLLAMKDTATTPAM

SEQ ID NO: 1373694 - protein, 19 aa, Mycobacterium tuberculosis
KPFVRQIRTTRQMQELQPQ

SEQ ID NO: 1373695 - protein, 31 aa, Mycobacterium tuberculosis; identical to SEQ ID NO: 157583

SEQ ID NO: 1373696 - protein, 21 aa, Mycobacterium tuberculosis
KRERDAVELDLRAHVGTMSAT

SEQ ID NO: 1373697 - protein, 23 aa, Mycobacterium tuberculosis
KREVVELRRCVNPLSTAFQRMQT

SEQ ID NO: 1373698 - protein, 18 aa, Mycobacterium tuberculosis
KRTARLVGDVPIYDIIVG

SEQ ID NO: 1373699 - protein, 23 aa, Mycobacterium tuberculosis
KTVAGLLQLLGLFGIAGIGRIYL

SEQ ID NO: 1373700 - protein, 26 aa, Mycobacterium tuberculosis
LAALLFAVIACRTYRDPIAGLTLSVI

SEQ ID NO: 1373701 - protein, 26 aa, Mycobacterium tuberculosis
LAEAFLPRRWRYGAQVTLALGGSAVA

SEQ ID NO: 1373702 - protein, 20 aa, Mycobacterium tuberculosis
LAGFCLHATLLGMLAGTNRW

SEQ ID NO: 1373703 - protein, 25 aa, Mycobacterium tuberculosis
LAGLSRFVWATAIIWILGGLGTWLI

SEQ ID NO: 1373704 - protein, 23 aa, Mycobacterium tuberculosis
LAHLEFARAPLLVVVAIPIALAR

SEQ ID NO: 1373705 - protein, 25 aa, Mycobacterium tuberculosis
LALSWPRVTAVFLVDVLILAVASHC

SEQ ID NO: 1373706 - protein, 17 aa, Mycobacterium tuberculosis
LAMMVFSKSFSVLRSAV

SEQ ID NO: 1373707 - protein, 25 aa, Mycobacterium tuberculosis
LAPNGFSVFGVFWGAFGLVTGAANG

SEQ ID NO: 1373708 - protein, 17 aa, Mycobacterium tuberculosis
LAPNLFATLGIIVAHGY

SEQ ID NO: 1373709 - protein, 24 aa, Mycobacterium tuberculosis
LATAAWVGLGWMWHLREALSQMWA

SEQ ID NO: 1373710 - protein, 21 aa, Mycobacterium tuberculosis
LAVATRGLWAAALQLASAICR

SEQ ID NO: 1373711 - protein, 18 aa, Mycobacterium tuberculosis
LDLLLAIVRRTRAGRSAF

SEQ ID NO: 1373712 - protein, 23 aa, Mycobacterium tuberculosis
LEAGRPPRRFAPGIMGRTMTVWS

SEQ ID NO: 1373713 - protein, 26 aa, Mycobacterium tuberculosis
LFIGAVLILGFWAPGFFVTTKLDVIK

SEQ ID NO: 1373714 - protein, 24 aa, Mycobacterium tuberculosis
LFITAVDWTRWWVMITLDVAIVYI

SEQ ID NO: 1373715 - protein, 19 aa, Mycobacterium tuberculosis
LFMMVGIMMMMFRGMGGGQ

SEQ ID NO: 1373716 - protein, 21 aa, Mycobacterium tuberculosis
LFPVVQPWYLLWAIIPLAAWA

SEQ ID NO: 1373717 - protein, 27 aa, Mycobacterium tuberculosis
LGEVWRCLRCGDFALGGPQGRGAPEDA

SEQ ID NO: 1373718 - protein, 23 aa, Mycobacterium tuberculosis
LGFDGALSWAGKLGVALSVGVLG

SEQ ID NO: 1373719 - protein, 20 aa, Mycobacterium tuberculosis
LGLFPLFVMFVITAITMQRE

SEQ ID NO: 1373720 - protein, 18 aa, Mycobacterium tuberculosis
LGLLWPHIDLPEAWQVIA

SEQ ID NO: 1373721 - protein, 23 aa, Mycobacterium tuberculosis
LGLMRAIICQLAFSHGPDHVQMI

SEQ ID NO: 1373722 - protein, 21 aa, Mycobacterium tuberculosis
LGLSRQHWKSGLVYALAAVAL

SEQ ID NO: 1373723 - protein, 22 aa, Mycobacterium tuberculosis
LGTFGSFIGFSFVFGQVLQTNF

SEQ ID NO: 1373724 - protein, 18 aa, Mycobacterium tuberculosis
LGVIVLLLAGPRLIDAYV

SEQ ID NO: 1373725 - protein, 24 aa, Mycobacterium tuberculosis
LIMIAVFCGFAFAGMPLVAEIGVA

SEQ ID NO: 1373726 - protein, 28 aa, Mycobacterium tuberculosis
LLAGPRLIDAYVDWLWFGELGYRSVFTT

SEQ ID NO: 1373727 - protein, 24 aa, Mycobacterium tuberculosis
LLDRELNALVPLVSFAVLASCGVP

SEQ ID NO: 1373728 - protein, 18 aa, Mycobacterium tuberculosis
LLGTGLCGGLTTFSTMQV

SEQ ID NO: 1373729 - protein, 18 aa, Mycobacterium tuberculosis
LLHGLLMHSGNDAAYALA

SEQ ID NO: 1373730 - protein, 20 aa, Mycobacterium tuberculosis
LLLRARLSVRAAAIVLLTAD

SEQ ID NO: 1373731 - protein, 25 aa, Mycobacterium tuberculosis
LLRVEVPNALPLMLGGLRSATLQVV

SEQ ID NO: 1373732 - protein, 24 aa, Mycobacterium tuberculosis
LLSSLIVGAGWPLIVEQISVKPNA

SEQ ID NO: 1373733 - protein, 24 aa, Mycobacterium tuberculosis
LLTDFKGGSTFLGMEKLPHTAAVV

SEQ ID NO: 1373734 - protein, 25 aa, Mycobacterium tuberculosis
LLVSIPFTVLVAFTLNILLREIGAA

SEQ ID NO: 1373735 - protein, 28 aa, Mycobacterium tuberculosis
LLVYVLPLLLLVGLFVMFSRMQGGARMG

SEQ ID NO: 1373736 - protein, 22 aa, Mycobacterium tuberculosis
LMPLKLFPHWIHPFVRNQPISQ

SEQ ID NO: 1373737 - protein, 23 aa, Mycobacterium tuberculosis
LNVDKSRSVIVLKRSMNSGFAGI

SEQ ID NO: 1373738 - protein, 29 aa, Mycobacterium tuberculosis
LPFLLGFRLTCYYYRKAYYRSVWQSPTSC

SEQ ID NO: 1373739 - protein, 24 aa, Mycobacterium tuberculosis
LPFYHDMGFVLGLILPILAGIPAV

SEQ ID NO: 1373740 - protein, 21 aa, Mycobacterium tuberculosis
LPPACFSIFAVFWGALGIATG

SEQ ID NO: 1373741 - protein, 26 aa, Mycobacterium tuberculosis
LPWYAILCLPVLFAAGMCLLDTIDGS

SEQ ID NO: 1373742 - protein, 28 aa, Mycobacterium tuberculosis
LQLASAICRHYWPLALLAAILSRRCRRV

SEQ ID NO: 1373743 - protein, 19 aa, Mycobacterium tuberculosis
LRDAFRFEPGQHVTVRTDL

SEQ ID NO: 1373744 - protein, 18 aa, Mycobacterium tuberculosis
LREVHALLYHEVFDTLGS

SEQ ID NO: 1373745 - protein, 19 aa, Mycobacterium tuberculosis
LRGNLALPVLASALLVPLF

SEQ ID NO: 1373746 - protein, 23 aa, Mycobacterium tuberculosis
LRRDRTSFIIAHRLSTIRDADHI

SEQ ID NO: 1373747 - protein, 19 aa, Mycobacterium tuberculosis
LSGAVAWLISLFYKAIYTG

SEQ ID NO: 1373748 - protein, 26 aa, Mycobacterium tuberculosis
LSTPEFPWSALTIVLLIGVLAAAVGA

SEQ ID NO: 1373749 - protein, 36 aa, Mycobacterium tuberculosis; identical to SEQ ID NO: 157977

SEQ ID NO: 1373750 - protein, 22 aa, Mycobacterium tuberculosis
LSYGLAVILGFIGVKLMLEALH

SEQ ID NO: 1373751 - protein, 22 aa, Mycobacterium tuberculosis
LTALTWIRFGIWLVAGTAIYVG

SEQ ID NO: 1373752 - protein, 20 aa, Mycobacterium tuberculosis
LTDRAADVVVLIDMYRQPAG

SEQ ID NO: 1373753 - protein, 22 aa, Mycobacterium tuberculosis
LTHGFFKAGLFLGSGAVIHAMH

SEQ ID NO: 1373754 - protein, 25 aa, Mycobacterium tuberculosis
LTINASSVALIWFGGLRIDSGQMQV

SEQ ID NO: 1373755 - protein, 19 aa, Mycobacterium tuberculosis
LTRVIEVPYVLPFLAEGRI

SEQ ID NO: 1373756 - protein, 25 aa, Mycobacterium tuberculosis
LTTPLRRLDLLAGYGTAFSIAAAAQ

SEQ ID NO: 1373757 - protein, 17 aa, Mycobacterium tuberculosis
LTTVLSKLPEGSEVTLN

SEQ ID NO: 1373758 - protein, 20 aa, Mycobacterium tuberculosis
LTVTLVWLYIEILRLLSYLQ

SEQ ID NO: 1373759 - protein, 20 aa, Mycobacterium tuberculosis
LVAGALSGAVAWLISLFYKA

SEQ ID NO: 1373760 - protein, 30 aa, Mycobacterium tuberculosis; identical to SEQ ID NO: 158020

SEQ ID NO: 1373761 - protein, 30 aa, Mycobacterium tuberculosis; identical to SEQ ID NO: 158026

SEQ ID NO: 1373762 - protein, 24 aa, Mycobacterium tuberculosis
LVGGGLFASFSLRTEGALMAASGD

SEQ ID NO: 1373763 - protein, 20 aa, Mycobacterium tuberculosis
LVQYLRYLGGILHGDLGRAY

SEQ ID NO: 1373764 - protein, 19 aa, Mycobacterium tuberculosis
LVVAIVFLLVRVVRAPVEV

SEQ ID NO: 1373765 - protein, 19 aa, Mycobacterium tuberculosis
LWAGYACSTLIIFPLVVYG

SEQ ID NO: 1373766 - protein, 25 aa, Mycobacterium tuberculosis
LWNRVRERFGLVGLFVGSALVSIAA

SEQ ID NO: 1373767 - protein, 18 aa, Mycobacterium tuberculosis
LYGRRGARNRAMRAVTEA

SEQ ID NO: 1373768 - protein, 20 aa, Mycobacterium tuberculosis
LYLAAALMIWAQARLLNLTV

SEQ ID NO: 1373769 - protein, 25 aa, Mycobacterium tuberculosis
MAILGWASGLGFGWINTLGTANVVR

SEQ ID NO: 1373770 - protein, 30 aa, Mycobacterium tuberculosis; identical to SEQ ID NO: 158082

SEQ ID NO: 1373771 - protein, 25 aa, Mycobacterium tuberculosis
MELNRAALELAAFAAFGSAASATEW

SEQ ID NO: 1373772 - protein, 17 aa, Mycobacterium tuberculosis
MGRDGLLPARFAKVNPR

SEQ ID NO: 1373773 - protein, 18 aa, Mycobacterium tuberculosis
MIAGIYGMNFHFMPELDS

SEQ ID NO: 1373774 - protein, 19 aa, Mycobacterium tuberculosis
MIEHGHWGLAAAYSVVSIT

SEQ ID NO: 1373775 - protein, 26 aa, Mycobacterium tuberculosis
MTLPRPRDLAPLLAAWVISVGVMVFE

SEQ ID NO: 1373776 - protein, 20 aa, Mycobacterium tuberculosis
MYKQATWKRVAVLFAGPGMN

SEQ ID NO: 1373777 - protein, 27 aa, Mycobacterium tuberculosis
NAAMVARRAPRRWGVRSTVRDLDQQAV

SEQ ID NO: 1373778 - protein, 24 aa, Mycobacterium tuberculosis
NDGKEVPANLVGRDPKTDLAVLKV

SEQ ID NO: 1373779 - protein, 24 aa, Mycobacterium tuberculosis
NERAYPGFVRRVMTSAVPFGLVIG

SEQ ID NO: 1373780 - protein, 24 aa, Mycobacterium tuberculosis
NGGISFGGVIAFIFADLLILPILN

SEQ ID NO: 1373781 - protein, 25 aa, Mycobacterium tuberculosis
NRLFIPRFLFSMGVIGVVAATSCYL

SEQ ID NO: 1373782 - protein, 21 aa, Mycobacterium tuberculosis
NRVGAEWLFTPVLLSQNYHLV

SEQ ID NO: 1373783 - protein, 19 aa, Mycobacterium tuberculosis
NVKDVKCNNGSDPTVKKGA

SEQ ID NO: 1373784 - protein, 18 aa, Mycobacterium tuberculosis
NVRMAMLVAAAWLALLGL

SEQ ID NO: 1373785 - protein, 28 aa, Mycobacterium tuberculosis
NWAILIIPFALCFAFGKMVHDRRQGWAV

SEQ ID NO: 1373786 - protein, 32 aa, Mycobacterium tuberculosis; identical to SEQ ID NO: 158228

SEQ ID NO: 1373787 - protein, 19 aa, Mycobacterium tuberculosis
PAMMLRPGSPHGGPAAVRP

SEQ ID NO: 1373788 - protein, 23 aa, Mycobacterium tuberculosis
PAVVSWAAFLGWINLHGTWASWM

SEQ ID NO: 1373789 - protein, 23 aa, Mycobacterium tuberculosis
PDDPDWSWLKWLPHVQHQTETDA

SEQ ID NO: 1373790 - protein, 28 aa, Mycobacterium tuberculosis
PDFIGLFDRICRVGRSLRVHLLLATQSL

SEQ ID NO: 1373791 - protein, 24 aa, Mycobacterium tuberculosis
PDGSHGMYSWLHFWIATACALTAW

SEQ ID NO: 1373792 - protein, 25 aa, Mycobacterium tuberculosis
PDILDPALLRPGRFDRQIPVSNPDL

SEQ ID NO: 1373793 - protein, 24 aa, Mycobacterium tuberculosis
PDSWQADHHVAWWVGVGVAAVVTL

SEQ ID NO: 1373794 - protein, 24 aa, Mycobacterium tuberculosis
PEAKEKARAIGIWTAIASIGTTTG

SEQ ID NO: 1373795 - protein, 23 aa, Mycobacterium tuberculosis
PEHLRLGPYAVMHAIADYVVDHY

SEQ ID NO: 1373796 - protein, 22 aa, Mycobacterium tuberculosis
PEKISFLPAMRYYAGNWATSIW

SEQ ID NO: 1373797 - protein, 22 aa, Mycobacterium tuberculosis
PGSGGVALWWMIGLLVAAGVLG

SEQ ID NO: 1373798 - protein, 20 aa, Mycobacterium tuberculosis
PIEVVREGRHVTLTVKPDPD

SEQ ID NO: 1373799 - protein, 20 aa, Mycobacterium tuberculosis
PIFFVLSGFLLFRPWVKSAA

SEQ ID NO: 1373800 - protein, 21 aa, Mycobacterium tuberculosis
PILARYANWVSHAVRGDFGTT

SEQ ID NO: 1373801 - protein, 17 aa, Mycobacterium tuberculosis
PKATLGLTAMVVVTLQI

SEQ ID NO: 1373802 - protein, 18 aa, Mycobacterium tuberculosis
PKAVVSFYEDFLCPACGI

SEQ ID NO: 1373803 - protein, 26 aa, Mycobacterium tuberculosis
PKRRHKRLLIGIVVALALVSAMTAAI

SEQ ID NO: 1373804 - protein, 24 aa, Mycobacterium tuberculosis
PLDQPRIYFGPVISNTSADYAIVG

SEQ ID NO: 1373805 - protein, 18 aa, Mycobacterium tuberculosis
PLGRAIVAEARRRGIAIP

SEQ ID NO: 1373806 - protein, 30 aa, Mycobacterium tuberculosis; identical to SEQ ID NO: 158342

SEQ ID NO: 1373807 - protein, 28 aa, Mycobacterium tuberculosis
PLMGLPPWMVFCSWSLNLIYQFWVHTER

SEQ ID NO: 1373808 - protein, 25 aa, Mycobacterium tuberculosis
PLPEPYLPPRLEAFRDRKRANPQPA

SEQ ID NO: 1373809 - protein, 24 aa, Mycobacterium tuberculosis
PLTPPRAVAIITQIASALDAAHAD

SEQ ID NO: 1373810 - protein, 25 aa, Mycobacterium tuberculosis
PLVAEIGVACAVAIAVDATVVRLVL

SEQ ID NO: 1373811 - protein, 31 aa, Mycobacterium tuberculosis; identical to SEQ ID NO: 158354

SEQ ID NO: 1373812 - protein, 21 aa, Mycobacterium tuberculosis
PNLFATLGIIVAHGYAYVTNN

SEQ ID NO: 1373813 - protein, 21 aa, Mycobacterium tuberculosis
PPLHDQWRPVLWAIAILTMTV

SEQ ID NO: 1373814 - protein, 26 aa, Mycobacterium tuberculosis
PPPSLSRYAWHRVRRIMPAYTVTVLL

SEQ ID NO: 1373815 - protein, 17 aa, Mycobacterium tuberculosis
PPRVHRRVGGQRTALTA

SEQ ID NO: 1373816 - protein, 27 aa, Mycobacterium tuberculosis
PQGAVGRIFVGNAFPFEGYTGGGGKQI

SEQ ID NO: 1373817 - protein, 27 aa, Mycobacterium tuberculosis
PRELEIWKRTLFRFVQQVYFRRRKTVI

SEQ ID NO: 1373818 - protein, 20 aa, Mycobacterium tuberculosis
PRYLWAGLVLLAATAASSDL

SEQ ID NO: 1373819 - protein, 18 aa, Mycobacterium tuberculosis
PSAIRPGIPKAFDAVVAR

SEQ ID NO: 1373820 - protein, 21 aa, Mycobacterium tuberculosis
PSNFFAWALSVMFLVFTLRAL

SEQ ID NO: 1373821 - protein, 18 aa, Mycobacterium tuberculosis
PTIWTAVGAVCFAASDSM

SEQ ID NO: 1373822 - protein, 24 aa, Mycobacterium tuberculosis
PTWPQCFPGSFTPVVVAEVPRVHQ

SEQ ID NO: 1373823 - protein, 34 aa, Mycobacterium tuberculosis; identical to SEQ ID NO: 158447

SEQ ID NO: 1373824 - protein, 18 aa, Mycobacterium tuberculosis
PVIASVLGITVLDEVLHT

SEQ ID NO: 1373825 - protein, 24 aa, Mycobacterium tuberculosis
PVTLKRFIDRFAPFNLDPKAIRPS

SEQ ID NO: 1373826 - protein, 25 aa, Mycobacterium tuberculosis
QAMYRPATILGCWVALAATAGLLFT

SEQ ID NO: 1373827 - protein, 18 aa, Mycobacterium tuberculosis
QASILMPRNQYLLIAAMF

SEQ ID NO: 1373828 - protein, 17 aa, Mycobacterium tuberculosis
QAVAAVLALLVETGAIT

SEQ ID NO: 1373829 - protein, 32 aa, Mycobacterium tuberculosis; identical to SEQ ID NO: 158477

SEQ ID NO: 1373830 - protein, 24 aa, Mycobacterium tuberculosis
QFVMPDLSGMFWVDAEPRLRALGW

SEQ ID NO: 1373831 - protein, 19 aa, Mycobacterium tuberculosis
QGVLCLFLLEMGMTASRKL

SEQ ID NO: 1373832 - protein, 23 aa, Mycobacterium tuberculosis
QKQLGCVRFALIFGLTAINPATF

SEQ ID NO: 1373833 - protein, 24 aa, Mycobacterium tuberculosis
QLLVLLCGGLVGPIFLVVYFTLGL

SEQ ID NO: 1373834 - protein, 23 aa, Mycobacterium tuberculosis
QLMTGRLSSLVARARSAVTGAHA

SEQ ID NO: 1373835 - protein, 28 aa, Mycobacterium tuberculosis
QPFLEPVSHMWVVKFLRTHGLIHDCPKL

SEQ ID NO: 1373836 - protein, 23 aa, Mycobacterium tuberculosis
QPKKAAAALAWLVDEMEQRYQDM

SEQ ID NO: 1373837 - protein, 24 aa, Mycobacterium tuberculosis
QQQMSRPKLDAMRAQFMLMLDMLR

SEQ ID NO: 1373838 - protein, 20 aa, Mycobacterium tuberculosis
QSVTTEFPGQAGLGVGGLAL

SEQ ID NO: 1373839 - protein, 23 aa, Mycobacterium tuberculosis
QTISPGRCAAIAVSEHGAEKLVA

SEQ ID NO: 1373840 - protein, 24 aa, Mycobacterium tuberculosis
QVNSGNEIARWAANLNTLAAQTAQ

SEQ ID NO: 1373841 - protein, 23 aa, Mycobacterium tuberculosis
QVPVLPREGAIALGMSNWECVRR

SEQ ID NO: 1373842 - protein, 21 aa, Mycobacterium tuberculosis
QWNNFMWPLVITSGHKWRVLT

SEQ ID NO: 1373843 - protein, 23 aa, Mycobacterium tuberculosis
RAYAESLTQVFLCAVSVTVVGFI

SEQ ID NO: 1373844 - protein, 24 aa, Mycobacterium tuberculosis
RDDAYRFAVWLSLPVAGLVAGFGL

SEQ ID NO: 1373845 - protein, 28 aa, Mycobacterium tuberculosis
RDDELPEFSFWAWLAMLFSAGMGIGLVF

SEQ ID NO: 1373846 - protein, 23 aa, Mycobacterium tuberculosis
RDGLLPARFAKVNPRTMTPVHNT

SEQ ID NO: 1373847 - protein, 22 aa, Mycobacterium tuberculosis
RDLRIPAIGLVLLLLSSLIVGA

SEQ ID NO: 1373848 - protein, 23 aa, Mycobacterium tuberculosis
RDRNRLVTFSAILLAGGVMFSLT

SEQ ID NO: 1373849 - protein, 21 aa, Mycobacterium tuberculosis
REITRPVLDYVKRVSKESPRT

SEQ ID NO: 1373850 - protein, 25 aa, Mycobacterium tuberculosis
RELLQEVFLNPGLVLLFGGIVIGLI

SEQ ID NO: 1373851 - protein, 26 aa, Mycobacterium tuberculosis
REQVHEFGWRIGFAVGGGAAIVVFWL

SEQ ID NO: 1373852 - protein, 20 aa, Mycobacterium tuberculosis
RETTMPWGLEIFYRRDPSGF

SEQ ID NO: 1373853 - protein, 25 aa, Mycobacterium tuberculosis
REVLGSKDGKAWILPIGLAGDLGTP

SEQ ID NO: 1373854 - protein, 25 aa, Mycobacterium tuberculosis
REYHTERLWSAIGLVPQRSYLFSGT

SEQ ID NO: 1373855 - protein, 17 aa, Mycobacterium tuberculosis
RFGPLTPPRAVAIITQI

SEQ ID NO: 1373856 - protein, 21 aa, Mycobacterium tuberculosis
RFKDLELRYARIARALALEGA

SEQ ID NO: 1373857 - protein, 21 aa, Mycobacterium tuberculosis
RFRLEARAVARLNNRALVAVY

SEQ ID NO: 1373858 - protein, 23 aa, Mycobacterium tuberculosis
RGACEIFSFHATKPFAVGEGGAL

SEQ ID NO: 1373859 - protein, 27 aa, Mycobacterium tuberculosis
RGALPSVPRWLWIVLAIGFLTAALAGG

SEQ ID NO: 1373860 - protein, 17 aa, Mycobacterium tuberculosis
RGAVSLAAALAVPMTTN

SEQ ID NO: 1373861 - protein, 19 aa, Mycobacterium tuberculosis
RGLGSRWVAMNDLTLASAG

SEQ ID NO: 1373862 - protein, 24 aa, Mycobacterium tuberculosis
RGPMPPHAVVAVLRPVLGGLAAAH

SEQ ID NO: 1373863 - protein, 35 aa, Mycobacterium tuberculosis; identical to SEQ ID NO: 158662

SEQ ID NO: 1373864 - protein, 20 aa, Mycobacterium tuberculosis
RIAIGSVRNKLLLILPGALL

SEQ ID NO: 1373865 - protein, 25 aa, Mycobacterium tuberculosis
RILEKGSSIPGGWFTITVLLILLMI

SEQ ID NO: 1373866 - protein, 20 aa, Mycobacterium tuberculosis
RKEYLRYLAGLRTRVTSSAT

SEQ ID NO: 1373867 - protein, 26 aa, Mycobacterium tuberculosis
RLDRRLDEAAGFAIPFVPRGLDEIPR

SEQ ID NO: 1373868 - protein, 23 aa, Mycobacterium tuberculosis
RLGATPLPVWGIIAGKSLAVVAV

SEQ ID NO: 1373869 - protein, 18 aa, Mycobacterium tuberculosis
RLIWPVVVLVLLTGLAAF

SEQ ID NO: 1373870 - protein, 18 aa, Mycobacterium tuberculosis
RLQLGRPAVLVVRCTVLV

SEQ ID NO: 1373871 - protein, 19 aa, Mycobacterium tuberculosis
RLYALHILLLPGIILALIG

SEQ ID NO: 1373872 - protein, 17 aa, Mycobacterium tuberculosis
RNTFWALVLPFMFGSPY

SEQ ID NO: 1373873 - protein, 20 aa, Mycobacterium tuberculosis
RPAGLGVVFGLAFFQVLLVA

SEQ ID NO: 1373874 - protein, 26 aa, Mycobacterium tuberculosis
RPALIAVGVPVMILAGIATYFNSRAS

SEQ ID NO: 1373875 - protein, 20 aa, Mycobacterium tuberculosis
RPFHWREAIEQGWFITSVSL

SEQ ID NO: 1373876 - protein, 19 aa, Mycobacterium tuberculosis
RPGARILGWGWLVLTIVGV

SEQ ID NO: 1373877 - protein, 19 aa, Mycobacterium tuberculosis
RPLILLPLVLPPVVGGIAL

SEQ ID NO: 1373878 - protein, 23 aa, Mycobacterium tuberculosis
RPQDPALCWSWQRSAGDQSPQST

SEQ ID NO: 1373879 - protein, 24 aa, Mycobacterium tuberculosis
RPRWSGRRLAFVVALVTVLMTAGL

SEQ ID NO: 1373880 - protein, 27 aa, Mycobacterium tuberculosis
RQLPAPTTGAGWTGRLSLPVSSASALG

SEQ ID NO: 1373881 - protein, 18 aa, Mycobacterium tuberculosis
RRDIKAGHFSPMSHPQVM

SEQ ID NO: 1373882 - protein, 17 aa, Mycobacterium tuberculosis
RRICTALAIGPGTVSVL

SEQ ID NO: 1373883 - protein, 23 aa, Mycobacterium tuberculosis
RRIESACKVWSAGVSASRLGRDL

SEQ ID NO: 1373884 - protein, 25 aa, Mycobacterium tuberculosis
RRLLREFRGPLALSLLLVAVQTCAG

SEQ ID NO: 1373885 - protein, 20 aa, Mycobacterium tuberculosis
RRNVQVFVCVVLVLAVIPTG

SEQ ID NO: 1373886 - protein, 21 aa, Mycobacterium tuberculosis
RRQDLAMTWLLAGLVAGALSG

SEQ ID NO: 1373887 - protein, 20 aa, Mycobacterium tuberculosis
RRRPMLNLFAFWVGGMVAGV

SEQ ID NO: 1373888 - protein, 27 aa, Mycobacterium tuberculosis
RRRRRALRWGLVFTAGCLLWGLVTALL

SEQ ID NO: 1373889 - protein, 26 aa, Mycobacterium tuberculosis
RRRTQHNVYIPWSMTVTPISQSDVGS

SEQ ID NO: 1373890 - protein, 24 aa, Mycobacterium tuberculosis
RSARSRAWVKVGYVLFVLAGIYAV

SEQ ID NO: 1373891 - protein, 20 aa, Mycobacterium tuberculosis
RSPSRTVPRLKVEITTLVHM

SEQ ID NO: 1373892 - protein, 20 aa, Mycobacterium tuberculosis
RSVIIRLADRFLRTSQDYNG

SEQ ID NO: 1373893 - protein, 24 aa, Mycobacterium tuberculosis
RTAAQRLLAGWGIVLGLIGLVAVW

SEQ ID NO: 1373894 - protein, 20 aa, Mycobacterium tuberculosis
RTGPFKWVRHPIYTAMMAFG

SEQ ID NO: 1373895 - protein, 22 aa, Mycobacterium tuberculosis
RTREVPALAGINLRIPAGQTVV

SEQ ID NO: 1373896 - protein, 19 aa, Mycobacterium tuberculosis
RTVDLRRKILFTLGIVILY

SEQ ID NO: 1373897 - protein, 20 aa, Mycobacterium tuberculosis
RVSLVPTLLVSIPFTVLVAF

SEQ ID NO: 1373898 - protein, 17 aa, Mycobacterium tuberculosis
RWYWIGLAVGILVGVAF

SEQ ID NO: 1373899 - protein, 24 aa, Mycobacterium tuberculosis
RYGSREPLVLTALLQLLSAVAQNC

SEQ ID NO: 1373900 - protein, 29 aa, Mycobacterium tuberculosis
SALRAGVGFIPFVIAMGIGLGVSSQLVSR

SEQ ID NO: 1373901 - protein, 17 aa, Mycobacterium tuberculosis
SATEWWLGPEPDSPRRM

SEQ ID NO: 1373902 - protein, 26 aa, Mycobacterium tuberculosis
SAVGMGRFALGRAVDYVKTRKVWSTP

SEQ ID NO: 1373903 - protein, 21 aa, Mycobacterium tuberculosis
SELHPDSAVVLVFVDQSTTSK

SEQ ID NO: 1373904 - protein, 21 aa, Mycobacterium tuberculosis
SEPFGLAWRLNRGSLLLWTVG

SEQ ID NO: 1373905 - protein, 25 aa, Mycobacterium tuberculosis
SEYQSSSALLAWLTAAAVAIAMLTL

SEQ ID NO: 1373906 - protein, 23 aa, Mycobacterium tuberculosis
SFMNFAYGWAFSSPVRKIYYNIT

SEQ ID NO: 1373907 - protein, 25 aa, Mycobacterium tuberculosis
SGGVPLGGWLARSVFAAKFAERNFL

SEQ ID NO: 1373908 - protein, 21 aa, Mycobacterium tuberculosis
SGQLHPVYNLTSARLVLGNPA

SEQ ID NO: 1373909 - protein, 24 aa, Mycobacterium tuberculosis
SGQRFPIKYYLTAMLFIVFDIEIV

SEQ ID NO: 1373910 - protein, 17 aa, Mycobacterium tuberculosis
SHVPFKAGEVTLLPSPM

SEQ ID NO: 1373911 - protein, 17 aa, Mycobacterium tuberculosis
SLAFVALVLTWGKQIGP

SEQ ID NO: 1373912 - protein, 26 aa, Mycobacterium tuberculosis
SLRSRIGMVLQDTWLYDGTIAENIAY

SEQ ID NO: 1373913 - protein, 25 aa, Mycobacterium tuberculosis
SLYRIGALCPYCMVVWAVIATLLVV

SEQ ID NO: 1373914 - protein, 20 aa, Mycobacterium tuberculosis
SMDANYRWFHPAPNTLAAAV

SEQ ID NO: 1373915 - protein, 17 aa, Mycobacterium tuberculosis
SMVNLCLVTLVLTIPLA

SEQ ID NO: 1373916 - protein, 31 aa, Mycobacterium tuberculosis; identical to SEQ ID NO: 159018

SEQ ID NO: 1373917 - protein, 19 aa, Mycobacterium tuberculosis
SPASRAVAQIVLLNNRFAT

SEQ ID NO: 1373918 - protein, 23 aa, Mycobacterium tuberculosis
SPETWRLGPATIRASRRPELGAS

SEQ ID NO: 1373919 - protein, 31 aa, Mycobacterium tuberculosis; identical to SEQ ID NO: 159024

SEQ ID NO: 1373920 - protein, 23 aa, Mycobacterium tuberculosis
SPGEWPWAYAMLLGIHVVLLFTC

SEQ ID NO: 1373921 - protein, 20 aa, Mycobacterium tuberculosis
SPWQIYWRILLPHSRPAVLV

SEQ ID NO: 1373922 - protein, 21 aa, Mycobacterium tuberculosis
SQVKLPSLLAMGFVTTVLAYR

SEQ ID NO: 1373923 - protein, 23 aa, Mycobacterium tuberculosis
SQVPGVAMVRGITRPAGRSLEQA

SEQ ID NO: 1373924 - protein, 25 aa, Mycobacterium tuberculosis
SSYPRLIRVAMMYNDKVGYGPTVRD

SEQ ID NO: 1373925 - protein, 24 aa, Mycobacterium tuberculosis
STIRRRKLIGLSFGVGMGAFGLGT

SEQ ID NO: 1373926 - protein, 20 aa, Mycobacterium tuberculosis
SVNLSKDWARAVVDIPVPTS

SEQ ID NO: 1373927 - protein, 18 aa, Mycobacterium tuberculosis
SVTIEFVLGLALALVMHR

SEQ ID NO: 1373928 - protein, 22 aa, Mycobacterium tuberculosis
SWVKLSPIWHVFSFAVDTRPIA

SEQ ID NO: 1373929 - protein, 25 aa, Mycobacterium tuberculosis
SYGFAASVLPVWLLLAPRDYLSTFM

SEQ ID NO: 1373930 - protein, 24 aa, Mycobacterium tuberculosis
TAAEPRLALFTVVSSFALAELGDK

SEQ ID NO: 1373931 - protein, 28 aa, Mycobacterium tuberculosis
TADLSLAVAWPLAAVVRGHDWGTDSVFS

SEQ ID NO: 1373932 - protein, 17 aa, Mycobacterium tuberculosis
TALIQLYIVGVFISFTM

SEQ ID NO: 1373933 - protein, 24 aa, Mycobacterium tuberculosis
TATDLRSPLLLAIVIAVVAVVIMG

SEQ ID NO: 1373934 - protein, 18 aa, Mycobacterium tuberculosis
TAVAVSWTARALGMESHA

SEQ ID NO: 1373935 - protein, 25 aa, Mycobacterium tuberculosis
TAVFLAAAIGMRLGWSVISAGNRPR

SEQ ID NO: 1373936 - protein, 21 aa, Mycobacterium tuberculosis
TEFALRPMAAQALEVGATPRS

SEQ ID NO: 1373937 - protein, 20 aa, Mycobacterium tuberculosis
TFFAELRGNLALPVLASALL

SEQ ID NO: 1373938 - protein, 21 aa, Mycobacterium tuberculosis
TFGEFLAWVIGWNLVLELAMG

SEQ ID NO: 1373939 - protein, 22 aa, Mycobacterium tuberculosis
TFLGMRFAKLGVFSTVGPALAI

SEQ ID NO: 1373940 - protein, 21 aa, Mycobacterium tuberculosis
TGGAALVMWMGELITERGIGN

SEQ ID NO: 1373941 - protein, 26 aa, Mycobacterium tuberculosis
TGRVLARWQSSWLRYAPLSFSGLVMI

SEQ ID NO: 1373942 - protein, 24 aa, Mycobacterium tuberculosis
TGTYRIDGPLSFLSVDGVFGSLRD

SEQ ID NO: 1373943 - protein, 25 aa, Mycobacterium tuberculosis
TGVGLGMSVARGFVEAMGGTISATD

SEQ ID NO: 1373944 - protein, 17 aa, Mycobacterium tuberculosis
TIVGLSAAGGWFYWDRV

SEQ ID NO: 1373945 - protein, 32 aa, Mycobacterium tuberculosis; identical to SEQ ID NO: 159194

SEQ ID NO: 1373946 - protein, 26 aa, Mycobacterium tuberculosis
TMTGRAVSFLGPWLFSVFVDVFHTVR

SEQ ID NO: 1373947 - protein, 25 aa, Mycobacterium tuberculosis
TMTYTLRYRWWVVLTGVAIAAFTVH

SEQ ID NO: 1373948 - protein, 22 aa, Mycobacterium tuberculosis
TQQYLIDWERSALVNGLVPAQF

SEQ ID NO: 1373949 - protein, 23 aa, Mycobacterium tuberculosis
TRAGFLMLLWVFIWSVLRILKTD

SEQ ID NO: 1373950 - protein, 20 aa, Mycobacterium tuberculosis
TRHHELRMVIIGSGATAVTL

SEQ ID NO: 1373951 - protein, 24 aa, Mycobacterium tuberculosis
TSRSEWPQQIVLIGVYAVAALWAL

SEQ ID NO: 1373952 - protein, 25 aa, Mycobacterium tuberculosis
TTLVNLLMRFYEIGSGRILIDGVDI

SEQ ID NO: 1373953 - protein, 26 aa, Mycobacterium tuberculosis
TVGPMLGISVAVVFFAAVTLLPALMV

SEQ ID NO: 1373954 - protein, 19 aa, Mycobacterium tuberculosis
TVIASLWFTIFGDSALLRQ

SEQ ID NO: 1373955 - protein, 32 aa, Mycobacterium tuberculosis; identical to SEQ ID NO: 159281

SEQ ID NO: 1373956 - protein, 21 aa, Mycobacterium tuberculosis
TVSVDWFGIVVLAVWGALAAL

SEQ ID NO: 1373957 - protein, 22 aa, Mycobacterium tuberculosis
TVVLCVIALFAVNVILTTIGVR

SEQ ID NO: 1373958 - protein, 18 aa, Mycobacterium tuberculosis
TVVSWLPFYHDMGFVLGL

SEQ ID NO: 1373959 - protein, 21 aa, Mycobacterium tuberculosis
TWSGLGARDRQGWAAVVGAGV

SEQ ID NO: 1373960 - protein, 25 aa, Mycobacterium tuberculosis
TYLGGWRIIRTLGKGLVEIKPPQGM

SEQ ID NO: 1373961 - protein, 22 aa, Mycobacterium tuberculosis
TYLQRWTIFTVVPQWILALIAL

SEQ ID NO: 1373962 - protein, 17 aa, Mycobacterium tuberculosis
VAAPTINVLRVWPEIVG

SEQ ID NO: 1373963 - protein, 26 aa, Mycobacterium tuberculosis
VAARVGEPFGSLVLAVAVTTIEVALI

SEQ ID NO: 1373964 - protein, 25 aa, Mycobacterium tuberculosis
VADGHPWRWFLIGFMVLFHLNILSN

SEQ ID NO: 1373965 - protein, 24 aa, Mycobacterium tuberculosis
VADRLPVVRLDWFTAENTATARQA

SEQ ID NO: 1373966 - protein, 28 aa, Mycobacterium tuberculosis
VAGTMLLRLCMLPGLALLVWATPRLASH

SEQ ID NO: 1373967 - protein, 18 aa, Mycobacterium tuberculosis
VALGLTVTLVWLYIEILR

SEQ ID NO: 1373968 - protein, 23 aa, Mycobacterium tuberculosis
VANLELYLIFPLASEQATITLVR

SEQ ID NO: 1373969 - protein, 20 aa, Mycobacterium tuberculosis
VARLRHRGMNEAGYMADEPG

SEQ ID NO: 1373970 - protein, 26 aa, Mycobacterium tuberculosis
VAWLLRFLVRHNMYWFVGYRVLVGTG

SEQ ID NO: 1373971 - protein, 26 aa, Mycobacterium tuberculosis
VCGQRLPGKYTYAAALREVREIELTG

SEQ ID NO: 1373972 - protein, 17 aa, Mycobacterium tuberculosis
VCGYVIGFRFHRGALYI

SEQ ID NO: 1373973 - protein, 17 aa, Mycobacterium tuberculosis
VDLCWRLIEAGARLRYE

SEQ ID NO: 1373974 - protein, 23 aa, Mycobacterium tuberculosis
VESRLAALGSRAGAGVMPKGPLP

SEQ ID NO: 1373975 - protein, 17 aa, Mycobacterium tuberculosis
VEVAFYLALPALAYLLL

SEQ ID NO: 1373976 - protein, 19 aa, Mycobacterium tuberculosis
VFASDAMSSIAYAPEEIFL

SEQ ID NO: 1373977 - protein, 17 aa, Mycobacterium tuberculosis
VGFALNFVIGTLAYFLL

SEQ ID NO: 1373978 - protein, 20 aa, Mycobacterium tuberculosis
VGIGRLVVRGLLIGLVVPPL

SEQ ID NO: 1373979 - protein, 20 aa, Mycobacterium tuberculosis
VGLASYLLIGFWYHKPSAAT

SEQ ID NO: 1373980 - protein, 24 aa, Mycobacterium tuberculosis
VGVAQAALWTGYRPWFIDIDANTW

SEQ ID NO: 1373981 - protein, 24 aa, Mycobacterium tuberculosis
VGVRVMPVFAFKSGAFFAAIVGVL

SEQ ID NO: 1373982 - protein, 18 aa, Mycobacterium tuberculosis
VIDVLPVPVGALVGPAAV

SEQ ID NO: 1373983 - protein, 26 aa, Mycobacterium tuberculosis
VIICGFTGLSGYIVWQHHEATERQQR

SEQ ID NO: 1373984 - protein, 17 aa, Mycobacterium tuberculosis
VKRKGQESFNFGEFFAF

SEQ ID NO: 1373985 - protein, 23 aa, Mycobacterium tuberculosis
VLAARFVTWLANRVTRRLDLGFT

SEQ ID NO: 1373986 - protein, 25 aa, Mycobacterium tuberculosis
VLAICMLPIIGMRWGVAENPTRQGG

SEQ ID NO: 1373987 - protein, 24 aa, Mycobacterium tuberculosis
VLAWATSGINGWFYVGNYGVPWYD

SEQ ID NO: 1373988 - protein, 32 aa, Mycobacterium tuberculosis; identical to SEQ ID NO: 159483

SEQ ID NO: 1373989 - protein, 25 aa, Mycobacterium tuberculosis
VLGLAAYFASFGPMFTLSTELGGGD

SEQ ID NO: 1373990 - protein, 25 aa, Mycobacterium tuberculosis
VLLWQHLFWFFGHPEVYIIALPFFG

SEQ ID NO: 1373991 - protein, 23 aa, Mycobacterium tuberculosis
VLMLGQCRVLFAMARDGLVPRQL

SEQ ID NO: 1373992 - protein, 17 aa, Mycobacterium tuberculosis
VLSAAPWDTHPGWVNLP

SEQ ID NO: 1373993 - protein, 25 aa, Mycobacterium tuberculosis
VLSLPLYLMCGLARNRRLLSQEAAM

SEQ ID NO: 1373994 - protein, 26 aa, Mycobacterium tuberculosis
VLTGLRLLAGLIWLYNVVWKVPPDFG

SEQ ID NO: 1373995 - protein, 21 aa, Mycobacterium tuberculosis
VPEAIALIVVMVRYLEPFTAV

SEQ ID NO: 1373996 - protein, 24 aa, Mycobacterium tuberculosis
VPPARLTKMTAMPQLVAFFNGVGG

SEQ ID NO: 1373997 - protein, 24 aa, Mycobacterium tuberculosis
VPTGIKFFNWIGTMWKGQLTFETP

SEQ ID NO: 1373998 - protein, 24 aa, Mycobacterium tuberculosis
VRHFGELEFWFALIKVAAIVCLIA

SEQ ID NO: 1373999 - protein, 22 aa, Mycobacterium tuberculosis
VSIPLTVLIIFTLNILLAEFGA

SEQ ID NO: 1374000 - protein, 21 aa, Mycobacterium tuberculosis
VSLRLLVVGSVFGTVAGVVIG

SEQ ID NO: 1374001 - protein, 23 aa, Mycobacterium tuberculosis
VSTRTSGPYLRHGQTITTTTVPS

SEQ ID NO: 1374002 - protein, 24 aa, Mycobacterium tuberculosis
VTACIAVSLIVYVFFIKNKADTYL

SEQ ID NO: 1374003 - protein, 28 aa, Mycobacterium tuberculosis
VTAGGLLGWCWRRGTAPGAPGSDFPQRC

SEQ ID NO: 1374004 - protein, 24 aa, Mycobacterium tuberculosis
VTEQEMWEALRVAAADGFVQTDGL

SEQ ID NO: 1374005 - protein, 17 aa, Mycobacterium tuberculosis
VTLAKVDGNWLITKFTP

SEQ ID NO: 1374006 - protein, 29 aa, Mycobacterium tuberculosis
VTLLPALMVLTGRRGWIAPRRDLTRRFWR

SEQ ID NO: 1374007 - protein, 27 aa, Mycobacterium tuberculosis
VVALIPLVWLLWVVIARGWFAVTRSGW

SEQ ID NO: 1374008 - protein, 19 aa, Mycobacterium tuberculosis
VVGTVAAVAVAALWAVRRG

SEQ ID NO: 1374009 - protein, 26 aa, Mycobacterium tuberculosis
VVLGSALIVFGVLRWLTRHRHTEMPG

SEQ ID NO: 1374010 - protein, 18 aa, Mycobacterium tuberculosis
VVMSCFFGTLMVITQHFQ

SEQ ID NO: 1374011 - protein, 37 aa, Mycobacterium tuberculosis; identical to SEQ ID NO: 159650

SEQ ID NO: 1374012 - protein, 18 aa, Mycobacterium tuberculosis
VVVLMSFAVYAVISAALY

SEQ ID NO: 1374013 - protein, 19 aa, Mycobacterium tuberculosis
VWDRLGDRLQHLILPSLTL

SEQ ID NO: 1374014 - protein, 27 aa, Mycobacterium tuberculosis
VYAVLAVIWCWLLKRYIVEGPLEHDAE

SEQ ID NO: 1374015 - protein, 28 aa, Mycobacterium tuberculosis
VYFTLGLGSLMSWMFYVGLIITVADVLV

SEQ ID NO: 1374016 - protein, 18 aa, Mycobacterium tuberculosis
WAMVSLCLVSVWRSVPFA

SEQ ID NO: 1374017 - protein, 17 aa, Mycobacterium tuberculosis
WAPGFFVTTKLDVIKAQ

SEQ ID NO: 1374018 - protein, 25 aa, Mycobacterium tuberculosis
WARQHARRMVLVWVSVVLAITGLVA

SEQ ID NO: 1374019 - protein, 18 aa, Mycobacterium tuberculosis
WCALFPIIWALSGSLKAD

SEQ ID NO: 1374020 - protein, 23 aa, Mycobacterium tuberculosis
WFGELGYRSVFTTMLATRIVVCL

SEQ ID NO: 1374021 - protein, 17 aa, Mycobacterium tuberculosis
WFLAAVIPLAIMLAPPV

SEQ ID NO: 1374022 - protein, 21 aa, Mycobacterium tuberculosis
WFRSIWMLAPRGDLMAQATLY

SEQ ID NO: 1374023 - protein, 21 aa, Mycobacterium tuberculosis
WGTDSVFSWTLAAVLTIGTIT

SEQ ID NO: 1374024 - protein, 19 aa, Mycobacterium tuberculosis
WILNRGLRIVMLLIAAVLA

SEQ ID NO: 1374025 - protein, 22 aa, Mycobacterium tuberculosis
WIMWVWYRLFAFVLGPSNFFAW

SEQ ID NO: 1374026 - protein, 27 aa, Mycobacterium tuberculosis
WLAILSLRLIPVVPFAAINYAAGASGV

SEQ ID NO: 1374027 - protein, 22 aa, Mycobacterium tuberculosis
WMAARLPWVVIGSFDELGPPKE

SEQ ID NO: 1374028 - protein, 18 aa, Mycobacterium tuberculosis
WMVARVSLVPTLLVSIPF

SEQ ID NO: 1374029 - protein, 17 aa, Mycobacterium tuberculosis
WNEYLWPFLMSDDESVA

SEQ ID NO: 1374030 - protein, 20 aa, Mycobacterium tuberculosis
WQAAGGGWRAFWLAVSSHAA

SEQ ID NO: 1374031 - protein, 18 aa, Mycobacterium tuberculosis
WRTMPAVIWDVRQPAGRV

SEQ ID NO: 1374032 - protein, 24 aa, Mycobacterium tuberculosis
WSEGPRYQRLMLWIIGSVFLLLMV

SEQ ID NO: 1374033 - protein, 19 aa, Mycobacterium tuberculosis
WVAVAVIFYLMWGRHHSAL

SEQ ID NO: 1374034 - protein, 32 aa, Mycobacterium tuberculosis; identical to SEQ ID NO: 159772

SEQ ID NO: 1374035 - protein, 19 aa, Mycobacterium tuberculosis
YIAGCVGAVLAVRQSDLFT

SEQ ID NO: 1374036 - protein, 24 aa, Mycobacterium tuberculosis
YIVGFCLLVIAIGAVLSFAADLVG

SEQ ID NO: 1374037 - protein, 22 aa, Mycobacterium tuberculosis
YKLSEPWTHPPILWAATDEVVG

SEQ ID NO: 1374038 - protein, 31 aa, Mycobacterium tuberculosis; identical to SEQ ID NO: 159810

SEQ ID NO: 1374039 - protein, 20 aa, Mycobacterium tuberculosis
YPEDLFKVQRMLLAKYHVND

SEQ ID NO: 1374040 - protein, 24 aa, Mycobacterium tuberculosis
YQALGAKIPKGVLLYGPPGTGKTL

SEQ ID NO: 1374041 - protein, 29 aa, Mycobacterium tuberculosis
YRAVVLARLRLVGIGIPAAIGLLAGIVAQ

SEQ ID NO: 1374042 - protein, 21 aa, Mycobacterium tuberculosis
YSADHLKDFVPFGVAGIGSAA

SEQ ID NO: 1374043 - protein, 18 aa, Mycobacterium tuberculosis
YSFLPSWLSFLVDKENAR

SEQ ID NO: 1374044 - protein, 19 aa, Mycobacterium tuberculosis
YSIPLRRALVTGSDLPYPE

SEQ ID NO: 1374045 - protein, 40 aa, Mycobacterium tuberculosis; identical to SEQ ID NO: 159849

SEQ ID NO: 1374046 - protein, 19 aa, Mycobacterium tuberculosis
YSYGGPFGGPSPRSSSGNR

SEQ ID NO: 1374047 - protein, 19 aa, Mycobacterium tuberculosis
AAALHRAYLLGWVSATVAS

SEQ ID NO: 1374048 - protein, 20 aa, Mycobacterium tuberculosis
AAAVLTWKVYDRRTVTDMGM

SEQ ID NO: 1374049 - protein, 19 aa, Mycobacterium tuberculosis
AAEGNWAAAIRHRLQAVAR

SEQ ID NO: 1374050 - protein, 18 aa, Mycobacterium tuberculosis
AAELSRWTFAGHTHYLII

SEQ ID NO: 1374051 - protein, 18 aa, Mycobacterium tuberculosis
AAFGRRIGIYVGVTHAIT

SEQ ID NO: 1374052 - protein, 18 aa, Mycobacterium tuberculosis
AAGIPAVAAVAILTGQDF

SEQ ID NO: 1374053 - protein, 26 aa, Mycobacterium tuberculosis
AAGIVLACPVWFYQLWAFITPGLYQR

SEQ ID NO: 1374054 - protein, 26 aa, Mycobacterium tuberculosis
AALDPYVRDGWAFVAIRLTSTDLIVG

SEQ ID NO: 1374055 - protein, 30 aa, Mycobacterium tuberculosis; identical to SEQ ID NO: 155977

SEQ ID NO: 1374056 - protein, 23 aa, Mycobacterium tuberculosis
AALRSRGLRTILLTGDNRAAADA

SEQ ID NO: 1374057 - protein, 35 aa, Mycobacterium tuberculosis; identical to SEQ ID NO: 155982

SEQ ID NO: 1374058 - protein, 24 aa, Mycobacterium tuberculosis
AAPVVTWAAWPFHSVALRNARHRT

SEQ ID NO: 1374059 - protein, 27 aa, Mycobacterium tuberculosis
AAQEWLKSILPFGGFPWGSVAFGQAEG

SEQ ID NO: 1374060 - protein, 24 aa, Mycobacterium tuberculosis
AATLDPASIIGIIIEILIQLFLIS

SEQ ID NO: 1374061 - protein, 35 aa, Mycobacterium tuberculosis; identical to SEQ ID NO: 155996

SEQ ID NO: 1374062 - protein, 25 aa, Mycobacterium tuberculosis
AATTLPRRLAIAAMGAVLVYGLVGT

SEQ ID NO: 1374063 - protein, 18 aa, Mycobacterium tuberculosis
AATVAWVMAGFTGLPRRA

SEQ ID NO: 1374064 - protein, 21 aa, Mycobacterium tuberculosis
AAYTRRTEIGIMRLVGASRWY

SEQ ID NO: 1374065 - protein, 17 aa, Mycobacterium tuberculosis
ACISFFFIGGLLALLMR

SEQ ID NO: 1374066 - protein, 19 aa, Mycobacterium tuberculosis
ADARAVLRDVLINELQPGM

SEQ ID NO: 1374067 - protein, 20 aa, Mycobacterium tuberculosis
ADIRGAIGFSSFGVLVYYAI

SEQ ID NO: 1374068 - protein, 19 aa, Mycobacterium tuberculosis
ADLSTLFAIVPSARVPGWG

SEQ ID NO: 1374069 - protein, 22 aa, Mycobacterium tuberculosis
ADRPRYVNLVVLLRTSCEITAT

SEQ ID NO: 1374070 - protein, 17 aa, Mycobacterium tuberculosis
AELFLACAALAGSAASW

SEQ ID NO: 1374071 - protein, 27 aa, Mycobacterium tuberculosis
AEYRFEKAWPLLWFVVIGLIAAAVGYL

SEQ ID NO: 1374072 - protein, 19 aa, Mycobacterium tuberculosis
AFALSAFIVGGLWIITTQH

SEQ ID NO: 1374073 - protein, 19 aa, Mycobacterium tuberculosis
AFIQLLADRAFQWSLNAGV

SEQ ID NO: 1374074 - protein, 23 aa, Mycobacterium tuberculosis
AFRTSCTPTECLAAATMLDDNDH

SEQ ID NO: 1374075 - protein, 21 aa, Mycobacterium tuberculosis
AGAFSRPGLPVEYLQVPSASM

SEQ ID NO: 1374076 - protein, 19 aa, Mycobacterium tuberculosis
AGAVFAILPRVTWAGIEAR

SEQ ID NO: 1374077 - protein, 23 aa, Mycobacterium tuberculosis
AGIFAGVVAIVFATAARYVRTNG

SEQ ID NO: 1374078 - protein, 23 aa, Mycobacterium tuberculosis
AGKDSFPASFIVKLENPEQHKDF

SEQ ID NO: 1374079 - protein, 20 aa, Mycobacterium tuberculosis
AGLTFNDFMLHLTPLVVIVL

SEQ ID NO: 1374080 - protein, 25 aa, Mycobacterium tuberculosis
AGLVGGIVWNLLTWLLGIPSSSSHA

SEQ ID NO: 1374081 - protein, 22 aa, Mycobacterium tuberculosis
AGRDLRAAIVVGLSIGLVLIAV

SEQ ID NO: 1374082 - protein, 18 aa, Mycobacterium tuberculosis
AGSLARKGTTPVTAATFP

SEQ ID NO: 1374083 - protein, 22 aa, Mycobacterium tuberculosis
AGVAFGTFLMRNHFLSLPAEII

SEQ ID NO: 1374084 - protein, 19 aa, Mycobacterium tuberculosis
AGVFQILFGACRLGSLIRY

SEQ ID NO: 1374085 - protein, 17 aa, Mycobacterium tuberculosis
AIARVEWPAFPSSNQLH

SEQ ID NO: 1374086 - protein, 24 aa, Mycobacterium tuberculosis
AIEIAEAMRGMLQRIWNEQNRTKE

SEQ ID NO: 1374087 - protein, 21 aa, Mycobacterium tuberculosis
AIGALCFPLGSTGTTKTGATA

SEQ ID NO: 1374088 - protein, 18 aa, Mycobacterium tuberculosis
AIGAPILIGTLMDVPGRP

SEQ ID NO: 1374089 - protein, 18 aa, Mycobacterium tuberculosis
AILCGRLPVATGLAVFVG

SEQ ID NO: 1374090 - protein, 24 aa, Mycobacterium tuberculosis
AIRVTPKFTRMVVAALFGVLVLML

SEQ ID NO: 1374091 - protein, 25 aa, Mycobacterium tuberculosis
AIVPARSLLGLAVGWLVGALVVLVV

SEQ ID NO: 1374092 - protein, 24 aa, Mycobacterium tuberculosis
AKGLSRPRVVTVHILRNSLIPVVT

SEQ ID NO: 1374093 - protein, 19 aa, Mycobacterium tuberculosis
AKQAKRRRILTIVGGSLAA

SEQ ID NO: 1374094 - protein, 20 aa, Mycobacterium tuberculosis
ALAAAIAWAGAQVFGPSSPL

SEQ ID NO: 1374095 - protein, 34 aa, Mycobacterium tuberculosis; identical to SEQ ID NO: 156153

SEQ ID NO: 1374096 - protein, 31 aa, Mycobacterium tuberculosis; identical to SEQ ID NO: 156156

SEQ ID NO: 1374097 - protein, 18 aa, Mycobacterium tuberculosis
ALMSSCIVAAQVVMVPVA

SEQ ID NO: 1374098 - protein, 23 aa, Mycobacterium tuberculosis
ALTVWVVGYALRPLRRVAATAAE

SEQ ID NO: 1374099 - protein, 23 aa, Mycobacterium tuberculosis
AMGAIRLNGLHFFTATEWNPGNT

SEQ ID NO: 1374100 - protein, 22 aa, Mycobacterium tuberculosis
AMGGRAAEELVFREPTTGAVSD

SEQ ID NO: 1374101 - protein, 21 aa, Mycobacterium tuberculosis
ANALCALGRANGIYCAVVPQP

SEQ ID NO: 1374102 - protein, 24 aa, Mycobacterium tuberculosis
ANRCADVLTALGIAKGDRVALLMP

SEQ ID NO: 1374103 - protein, 19 aa, Mycobacterium tuberculosis
APDAQWRRVTATGQYLPDV

SEQ ID NO: 1374104 - protein, 17 aa, Mycobacterium tuberculosis
APDDALWVRTGDYGTYF

SEQ ID NO: 1374105 - protein, 25 aa, Mycobacterium tuberculosis
APLDGGRLVRAYLWRRHGDSVRAGI

SEQ ID NO: 1374106 - protein, 27 aa, Mycobacterium tuberculosis
APQQSWRKRLPAIFVDVARFALIGIGL

SEQ ID NO: 1374107 - protein, 18 aa, Mycobacterium tuberculosis
APVILVVATTVVFGAFAH

SEQ ID NO: 1374108 - protein, 25 aa, Mycobacterium tuberculosis
AQMLKVELPLSIPVLVAGLRVVAVT

SEQ ID NO: 1374109 - protein, 25 aa, Mycobacterium tuberculosis
AQRHLADLASIWRRCGGRTVTLFRS

SEQ ID NO: 1374110 - protein, 24 aa, Mycobacterium tuberculosis
AQRRELLTRVIVSAAHADRELASQ

SEQ ID NO: 1374111 - protein, 27 aa, Mycobacterium tuberculosis
ARFALGVAEGGFFPGVIAYLTVWFPCA

SEQ ID NO: 1374112 - protein, 19 aa, Mycobacterium tuberculosis
ARLAYWAQAEIVAMATDVA

SEQ ID NO: 1374113 - protein, 22 aa, Mycobacterium tuberculosis
ARLELTLLVGEWLNQIPDFELA

SEQ ID NO: 1374114 - protein, 19 aa, Mycobacterium tuberculosis
ARLLHRLLGLTVLRVGTGQ

SEQ ID NO: 1374115 - protein, 19 aa, Mycobacterium tuberculosis
ARLRRARAGLNAHPDGLNQ

SEQ ID NO: 1374116 - protein, 18 aa, Mycobacterium tuberculosis
ARRAQQMIVGVALGIVLG

SEQ ID NO: 1374117 - protein, 23 aa, Mycobacterium tuberculosis
ARRLLRRLLVAAVLFVPLADLST

SEQ ID NO: 1374118 - protein, 26 aa, Mycobacterium tuberculosis
ARVPILAGLCMLMLGLLMLIFSEHRS

SEQ ID NO: 1374119 - protein, 24 aa, Mycobacterium tuberculosis
ARYNVPWQPAFVFYRADGTSTFVN

SEQ ID NO: 1374120 - protein, 25 aa, Mycobacterium tuberculosis
ASANTGWWPLIWFTAKVWGFLFIYF

SEQ ID NO: 1374121 - protein, 20 aa, Mycobacterium tuberculosis
ASCITAGGGLMLVRNALGTN

SEQ ID NO: 1374122 - protein, 20 aa, Mycobacterium tuberculosis
ASFGAPRLWTALADSGVLPT

SEQ ID NO: 1374123 - protein, 25 aa, Mycobacterium tuberculosis
ASFGASLLVSWLAGVLLSGMLTVIV

SEQ ID NO: 1374124 - protein, 19 aa, Mycobacterium tuberculosis
ASLILAVLAFRHFGDAVLL

SEQ ID NO: 1374125 - protein, 25 aa, Mycobacterium tuberculosis
ATALPLRLISWLLMPISRLLVLLGN

SEQ ID NO: 1374126 - protein, 22 aa, Mycobacterium tuberculosis
ATARRRPLLVAVSWAIFALVLA

SEQ ID NO: 1374127 - protein, 26 aa, Mycobacterium tuberculosis
ATLGLRVYLAWITRTGYTYGALATPI

SEQ ID NO: 1374128 - protein, 25 aa, Mycobacterium tuberculosis
ATMRTVKLNMVWAFGYNIAAIPVAA

SEQ ID NO: 1374129 - protein, 26 aa, Mycobacterium tuberculosis
ATTVVFGAFAHRWLARRTRRRINPGL

SEQ ID NO: 1374130 - protein, 18 aa, Mycobacterium tuberculosis
AVDRIWLRGTVVLTSAIG

SEQ ID NO: 1374131 - protein, 31 aa, Mycobacterium tuberculosis; identical to SEQ ID NO: 156360

SEQ ID NO: 1374132 - protein, 19 aa, Mycobacterium tuberculosis
AVLFLPYSLLGPFAGALMD

SEQ ID NO: 1374133 - protein, 30 aa, Mycobacterium tuberculosis; identical to SEQ ID NO: 156376

SEQ ID NO: 1374134 - protein, 24 aa, Mycobacterium tuberculosis
AVVPQPGKHDWPFADRVFAAALPW

SEQ ID NO: 1374135 - protein, 31 aa, Mycobacterium tuberculosis; identical to SEQ ID NO: 10665

SEQ ID NO: 1374136 - protein, 20 aa, Mycobacterium tuberculosis
AYRREALEAIDLDGVDSKGY

SEQ ID NO: 1374137 - protein, 18 aa, Mycobacterium tuberculosis
CFGVEVWFLAALAAPLLT

SEQ ID NO: 1374138 - protein, 30 aa, Mycobacterium tuberculosis; identical to SEQ ID NO: 160297

SEQ ID NO: 1374139 - protein, 18 aa, Mycobacterium tuberculosis
CITDRFDGLLARNYGMAT

SEQ ID NO: 1374140 - protein, 18 aa, Mycobacterium tuberculosis
CVLNPLVLIHLMGGVHNE

SEQ ID NO: 1374141 - protein, 19 aa, Mycobacterium tuberculosis
DAAEAVGFYRGERVEGTQL

SEQ ID NO: 1374142 - protein, 18 aa, Mycobacterium tuberculosis
DAGFRRAAVVTALMTAVI

SEQ ID NO: 1374143 - protein, 24 aa, Mycobacterium tuberculosis
DALTAVPLWIAFALGAKPATRRYT

SEQ ID NO: 1374144 - protein, 19 aa, Mycobacterium tuberculosis
DAPYACMGGACGTCRAKLI

SEQ ID NO: 1374145 - protein, 19 aa, Mycobacterium tuberculosis
DAVPLLAPHSGYLQTVDVD

SEQ ID NO: 1374146 - protein, 23 aa, Mycobacterium tuberculosis
DDLWFNPVMFWFRGHPVTAAMQL

SEQ ID NO: 1374147 - protein, 31 aa, Mycobacterium tuberculosis; identical to SEQ ID NO: 156465

SEQ ID NO: 1374148 - protein, 17 aa, Mycobacterium tuberculosis
DGPTVVLVHGFPDSHVL

SEQ ID NO: 1374149 - protein, 18 aa, Mycobacterium tuberculosis
DISGIWPVRTVHDAISEA

SEQ ID NO: 1374150 - protein, 26 aa, Mycobacterium tuberculosis
DLEPTWSRPGWRHLKHFNGYATSFWV

SEQ ID NO: 1374151 - protein, 19 aa, Mycobacterium tuberculosis
DLFLRIAPELYLKRLCVGG

SEQ ID NO: 1374152 - protein, 24 aa, Mycobacterium tuberculosis
DLYSLGCALFRLLTGEAPFAAGAG

SEQ ID NO: 1374153 - protein, 17 aa, Mycobacterium tuberculosis
DNAEFQQGMKLFLSPNG

SEQ ID NO: 1374154 - protein, 19 aa, Mycobacterium tuberculosis
DQRALGAAVHYAAVDKDAV

SEQ ID NO: 1374155 - protein, 19 aa, Mycobacterium tuberculosis
DRATLKLVFSMDLGMCLNR

SEQ ID NO: 1374156 - protein, 23 aa, Mycobacterium tuberculosis
DRGEFDGQLWIAMDYVDGIDATQ

SEQ ID NO: 1374157 - protein, 23 aa, Mycobacterium tuberculosis
DRLGRRPILLSGIATMITADAVL

SEQ ID NO: 1374158 - protein, 18 aa, Mycobacterium tuberculosis
DRLWIRFIADTERRSQVI

SEQ ID NO: 1374159 - protein, 19 aa, Mycobacterium tuberculosis
DRRVLAYTYRGGWGDATSS

SEQ ID NO: 1374160 - protein, 31 aa, Mycobacterium tuberculosis; identical to SEQ ID NO: 156558

SEQ ID NO: 1374161 - protein, 19 aa, Mycobacterium tuberculosis
DTARAAFRRPFQFREFLDQ

SEQ ID NO: 1374162 - protein, 23 aa, Mycobacterium tuberculosis
DTGIDWDVIFLLVGMMIIVGVLR

SEQ ID NO: 1374163 - protein, 23 aa, Mycobacterium tuberculosis
DTMGRSRLRAPFGNRSDNGELLF

SEQ ID NO: 1374164 - protein, 22 aa, Mycobacterium tuberculosis
DTPADVLGGFDFTAQGVWAFAR

SEQ ID NO: 1374165 - protein, 17 aa, Mycobacterium tuberculosis
DTRMFDDPLQFYSRSIA

SEQ ID NO: 1374166 - protein, 23 aa, Mycobacterium tuberculosis
DVFDRSAGLYRLRLLETSYGVGV

SEQ ID NO: 1374167 - protein, 24 aa, Mycobacterium tuberculosis
DVRIPRNRAVVMLVIDVSQSMRAT

SEQ ID NO: 1374168 - protein, 29 aa, Mycobacterium tuberculosis
DVSAEAWLVADLDSGAVIAARDPHGRHRP

SEQ ID NO: 1374169 - protein, 25 aa, Mycobacterium tuberculosis
DWDRHLRPMLARRFEIATGHRQAKD

SEQ ID NO: 1374170 - protein, 20 aa, Mycobacterium tuberculosis
EAEGGMGPHGLMIGMTGSGK

SEQ ID NO: 1374171 - protein, 18 aa, Mycobacterium tuberculosis
EALIKIYAAKNIEVVQGY

SEQ ID NO: 1374172 - protein, 20 aa, Mycobacterium tuberculosis
EALTGDMFLLMLGGGALAAS

SEQ ID NO: 1374173 - protein, 21 aa, Mycobacterium tuberculosis
EARLSWVLAALAGILGATAFT

SEQ ID NO: 1374174 - protein, 21 aa, Mycobacterium tuberculosis
EASVRGWPVLSFSRPVSLRDR

SEQ ID NO: 1374175 - protein, 17 aa, Mycobacterium tuberculosis
EATRDAFDNGWFRTGDI

SEQ ID NO: 1374176 - protein, 26 aa, Mycobacterium tuberculosis
EEDKGLRTRSEMIAQLVFAMGGRAAE

SEQ ID NO: 1374177 - protein, 25 aa, Mycobacterium tuberculosis
EELGPRPHLAVVAGRVGALSGLAPE

SEQ ID NO: 1374178 - protein, 19 aa, Mycobacterium tuberculosis
EEPLAMVGDGFRFASQPLG

SEQ ID NO: 1374179 - protein, 22 aa, Mycobacterium tuberculosis
EGAATIGTWVRMVINYLVPFLV

SEQ ID NO: 1374180 - protein, 25 aa, Mycobacterium tuberculosis
EGALVLGVLFWFTFVGWVTVVIAGG

SEQ ID NO: 1374181 - protein, 25 aa, Mycobacterium tuberculosis
EHVGFSVWMLWSIVVVQMTAAAPGH

SEQ ID NO: 1374182 - protein, 20 aa, Mycobacterium tuberculosis
EIAFSFKRTHKVTVNAEGSD

SEQ ID NO: 1374183 - protein, 24 aa, Mycobacterium tuberculosis
EIGQFIRWLFRFLVGQVDRIAPFR

SEQ ID NO: 1374184 - protein, 20 aa, Mycobacterium tuberculosis
EKYARIALKLVSDIPNPRIL

SEQ ID NO: 1374185 - protein, 24 aa, Mycobacterium tuberculosis
ELDAELWIAALIFPAFTAGGAIGN

SEQ ID NO: 1374186 - protein, 18 aa, Mycobacterium tuberculosis
ELLVVMLPLIGVLYVGIK

SEQ ID NO: 1374187 - protein, 20 aa, Mycobacterium tuberculosis
ELRVPIGVTGTGEPLMFDLK

SEQ ID NO: 1374188 - protein, 26 aa, Mycobacterium tuberculosis
EPASDWRNRPVLVFVLDAGMPGLTQG

SEQ ID NO: 1374189 - protein, 21 aa, Mycobacterium tuberculosis
EPDYRFTLANERTFLAWQRTA

SEQ ID NO: 1374190 - protein, 20 aa, Mycobacterium tuberculosis
ERGEPWPQPVPEPAFKAAIA

SEQ ID NO: 1374191 - protein, 20 aa, Mycobacterium tuberculosis
ERGIGNGMSLLIFVGIAARI

SEQ ID NO: 1374192 - protein, 19 aa, Mycobacterium tuberculosis
ESRLLRIASPMFHFGILVV

SEQ ID NO: 1374193 - protein, 23 aa, Mycobacterium tuberculosis
ESSRGYAAAIGRVGTDGIPMLML

SEQ ID NO: 1374194 - protein, 23 aa, Mycobacterium tuberculosis
ESYTSTYLRFVWTLSATAVVLCY

SEQ ID NO: 1374195 - protein, 17 aa, Mycobacterium tuberculosis
ETARFGAPTLLTRSTND

SEQ ID NO: 1374196 - protein, 26 aa, Mycobacterium tuberculosis
ETATALAWFPLWFVLLAVGWLVTQRR

SEQ ID NO: 1374197 - protein, 29 aa, Mycobacterium tuberculosis
ETIKGDASVGWLRLGALALALAALAALLI

SEQ ID NO: 1374198 - protein, 26 aa, Mycobacterium tuberculosis
EVAAAGDHRLRVIGVTWNAEASAQAA

SEQ ID NO: 1374199 - protein, 18 aa, Mycobacterium tuberculosis
EVPYVLPFLAEGRISGVT

SEQ ID NO: 1374200 - protein, 27 aa, Mycobacterium tuberculosis
EVSEFSWQLERVLPVPVFAQTMAQVTV

SEQ ID NO: 1374201 - protein, 23 aa, Mycobacterium tuberculosis
EVVGRRRLWFGVSGAIVAVAIAS

SEQ ID NO: 1374202 - protein, 19 aa, Mycobacterium tuberculosis
EWDTLLFFAGLFVMVGALV

SEQ ID NO: 1374203 - protein, 18 aa, Mycobacterium tuberculosis
FAAFPGWYATVFSALYLP

SEQ ID NO: 1374204 - protein, 17 aa, Mycobacterium tuberculosis
FAAGRLYTTLSVADAAA

SEQ ID NO: 1374205 - protein, 17 aa, Mycobacterium tuberculosis
FAFFGGFAIMLGAELNA

SEQ ID NO: 1374206 - protein, 18 aa, Mycobacterium tuberculosis
FAKMPLMVVILLTTTIVL

SEQ ID NO: 1374207 - protein, 25 aa, Mycobacterium tuberculosis
FALKRGALMFGKLVPMGIGAIIGAI

SEQ ID NO: 1374208 - protein, 19 aa, Mycobacterium tuberculosis
FAVGGEWAGSALLSAEYAP

SEQ ID NO: 1374209 - protein, 18 aa, Mycobacterium tuberculosis
FAVGVVRLGQRQCLVQEL

SEQ ID NO: 1374210 - protein, 23 aa, Mycobacterium tuberculosis
FAVLCGAASYIAVPAVQRLAIPE

SEQ ID NO: 1374211 - protein, 19 aa, Mycobacterium tuberculosis
FAWGLSREYSVLVEMDADG

SEQ ID NO: 1374212 - protein, 26 aa, Mycobacterium tuberculosis
FEKYGKWTIILARFVPIARTFVPVIA

SEQ ID NO: 1374213 - protein, 22 aa, Mycobacterium tuberculosis
FEVRGGLFVRQIHHWAALMFAA

SEQ ID NO: 1374214 - protein, 18 aa, Mycobacterium tuberculosis
FFSPHSWWPIMVALSGSV

SEQ ID NO: 1374215 - protein, 18 aa, Mycobacterium tuberculosis
FGELMVGQPVQFRARISR

SEQ ID NO: 1374216 - protein, 17 aa, Mycobacterium tuberculosis
FGIAGWVDDPSGLTATN

SEQ ID NO: 1374217 - protein, 27 aa, Mycobacterium tuberculosis
FGVALCAGLWFIGRRVIATVGHNLTTM

SEQ ID NO: 1374218 - protein, 18 aa, Mycobacterium tuberculosis
FGVRDLFMVTALSSITAL

SEQ ID NO: 1374219 - protein, 19 aa, Mycobacterium tuberculosis
FKGTTCHRLTTSPMLAVLQ

SEQ ID NO: 1374220 - protein, 22 aa, Mycobacterium tuberculosis
FKLSGPEMRGVRQAVTRARRAG

SEQ ID NO: 1374221 - protein, 18 aa, Mycobacterium tuberculosis
FMLHLTPLVVIVLIALIA

SEQ ID NO: 1374222 - protein, 19 aa, Mycobacterium tuberculosis
FMLRLKVGMAAGIVLACPV

SEQ ID NO: 1374223 - protein, 20 aa, Mycobacterium tuberculosis
FPSVAFRPVRLFFINVGLAA

SEQ ID NO: 1374224 - protein, 19 aa, Mycobacterium tuberculosis
FRTLDAFRIFDNIYVLTGG

SEQ ID NO: 1374225 - protein, 17 aa, Mycobacterium tuberculosis
FRVPALILAAIAYGAWH

SEQ ID NO: 1374226 - protein, 27 aa, Mycobacterium tuberculosis
FSLLGAICLLGTLWLVMRARSSAPAGA

SEQ ID NO: 1374227 - protein, 18 aa, Mycobacterium tuberculosis
FSSFFVVSNSLRLRKFGR

SEQ ID NO: 1374228 - protein, 18 aa, Mycobacterium tuberculosis
FTDAAAWYAEPIVFEKVV

SEQ ID NO: 1374229 - protein, 25 aa, Mycobacterium tuberculosis
FTGPEVWWVLRVAHWASGVPAATVP

SEQ ID NO: 1374230 - protein, 26 aa, Mycobacterium tuberculosis
FTLGVLSAFGLVFVRFPGRTAVFLVI

SEQ ID NO: 1374231 - protein, 17 aa, Mycobacterium tuberculosis
FVIAGLAGAAWLVSGAG

SEQ ID NO: 1374232 - protein, 18 aa, Mycobacterium tuberculosis
FVLGLALALVMHRTLIGK

SEQ ID NO: 1374233 - protein, 23 aa, Mycobacterium tuberculosis
FVWNVFKSWRYGEVVTVDDPWGY

SEQ ID NO: 1374234 - protein, 22 aa, Mycobacterium tuberculosis
FVYEHKVLFAVGAIVLIMAMNL

SEQ ID NO: 1374235 - protein, 30 aa, Mycobacterium tuberculosis; identical to SEQ ID NO: 156931

SEQ ID NO: 1374236 - protein, 17 aa, Mycobacterium tuberculosis
GADRLFVGVSLSLANQI

SEQ ID NO: 1374237 - protein, 18 aa, Mycobacterium tuberculosis
GAILGFALLWLTATAIWL

SEQ ID NO: 1374238 - protein, 17 aa, Mycobacterium tuberculosis
GALLLSQLVPWLLTPLL

SEQ ID NO: 1374239 - protein, 24 aa, Mycobacterium tuberculosis
GAMYCLSFARLPYFETLGAPIAIG

SEQ ID NO: 1374240 - protein, 28 aa, Mycobacterium tuberculosis
GAQLVKLAHIKLAWRTGNFVIYAITIVC

SEQ ID NO: 1374241 - protein, 17 aa, Mycobacterium tuberculosis
GATMVGYFVCFVALFVL

SEQ ID NO: 1374242 - protein, 21 aa, Mycobacterium tuberculosis
GCAQAAATVLVWRRVSDGWAF

SEQ ID NO: 1374243 - protein, 25 aa, Mycobacterium tuberculosis
GDDLRLYLDGGLQFCTRDEYRYTES

SEQ ID NO: 1374244 - protein, 20 aa, Mycobacterium tuberculosis
GDGVAILARNHRWFVIANYG

SEQ ID NO: 1374245 - protein, 19 aa, Mycobacterium tuberculosis
GEAIFGYNGFGWRFTGALL

SEQ ID NO: 1374246 - protein, 19 aa, Mycobacterium tuberculosis
GEHCIGWLILALLGAIALP

SEQ ID NO: 1374247 - protein, 20 aa, Mycobacterium tuberculosis
GEMVRRPYLRATLFVIALGF

SEQ ID NO: 1374248 - protein, 18 aa, Mycobacterium tuberculosis
GFHHGFFIFAIVLTALSI

SEQ ID NO: 1374249 - protein, 18 aa, Mycobacterium tuberculosis
GFIGVLFAALWVLIAYLR

SEQ ID NO: 1374250 - protein, 27 aa, Mycobacterium tuberculosis
GGALTEVSWRWAFLVNVPIGLVMIYLA

SEQ ID NO: 1374251 - protein, 28 aa, Mycobacterium tuberculosis
GGGRASVGLPGFLVGGVVRITRASGDEY

SEQ ID NO: 1374252 - protein, 21 aa, Mycobacterium tuberculosis
GGGSMLVLLGIVVALYERERS

SEQ ID NO: 1374253 - protein, 22 aa, Mycobacterium tuberculosis
GGIRLSGRTGALSRSARVQLVS

SEQ ID NO: 1374254 - protein, 25 aa, Mycobacterium tuberculosis
GGLVGGVWLAFIGWFIFAAAREEET

SEQ ID NO: 1374255 - protein, 19 aa, Mycobacterium tuberculosis
GGPDASWLDRRFQTDALEY

SEQ ID NO: 1374256 - protein, 30 aa, Mycobacterium tuberculosis; identical to SEQ ID NO: 10389

SEQ ID NO: 1374257 - protein, 23 aa, Mycobacterium tuberculosis
GGVDPRRCLAVSLDVGTDNEQLL

SEQ ID NO: 1374258 - protein, 21 aa, Mycobacterium tuberculosis
GHPGPGIGLIVAWITAIVLTF

SEQ ID NO: 1374259 - protein, 25 aa, Mycobacterium tuberculosis
GIERPAGTIGEIWVHGDNVAIGYWQ

SEQ ID NO: 1374260 - protein, 19 aa, Mycobacterium tuberculosis
GIFIKGYRALETIRSIDTV

SEQ ID NO: 1374261 - protein, 21 aa, Mycobacterium tuberculosis
GILAAMPAFWSRCTAALAGPR

SEQ ID NO: 1374262 - protein, 26 aa, Mycobacterium tuberculosis
GIMPMLPGLAVFRAVFAFAVNDTPDG

SEQ ID NO: 1374263 - protein, 21 aa, Mycobacterium tuberculosis
GISVLLTFYPGWVTIGMMAAL

SEQ ID NO: 1374264 - protein, 19 aa, Mycobacterium tuberculosis
GKSTLAWIMAGLTIPTTGA

SEQ ID NO: 1374265 - protein, 19 aa, Mycobacterium tuberculosis
GKTGIGWLGYIVIGGIAGW

SEQ ID NO: 1374266 - protein, 24 aa, Mycobacterium tuberculosis
GKVEDWLGYFLLHASFVLGAAAGG

SEQ ID NO: 1374267 - protein, 17 aa, Mycobacterium tuberculosis
GLAHPLAQCHIEVELAK

SEQ ID NO: 1374268 - protein, 18 aa, Mycobacterium tuberculosis
GLALAYRTRPVFVPDADN

SEQ ID NO: 1374269 - protein, 26 aa, Mycobacterium tuberculosis
GLARKRASTLGNFWVDLARTVLRIMF

SEQ ID NO: 1374270 - protein, 24 aa, Mycobacterium tuberculosis
GLASRYIRLLPRGLVKRVVPKPGT

SEQ ID NO: 1374271 - protein, 25 aa, Mycobacterium tuberculosis
GLDRELAARFGFLLAIPAVFASGLF

SEQ ID NO: 1374272 - protein, 19 aa, Mycobacterium tuberculosis
GLGGLRTGLLAARHLQVTL

SEQ ID NO: 1374273 - protein, 24 aa, Mycobacterium tuberculosis
GLGVAELWALLRIYQYQRLFEAVR

SEQ ID NO: 1374274 - protein, 23 aa, Mycobacterium tuberculosis
GLQPPWAMSVSFVLTTVSACGVA

SEQ ID NO: 1374275 - protein, 17 aa, Mycobacterium tuberculosis
GLTFNDFLIHMAPAVLV

SEQ ID NO: 1374276 - protein, 19 aa, Mycobacterium tuberculosis
GMVTRAGLRPVGRLTEAAE

SEQ ID NO: 1374277 - protein, 33 aa, Mycobacterium tuberculosis; identical to SEQ ID NO: 157130

SEQ ID NO: 1374278 - protein, 17 aa, Mycobacterium tuberculosis
GNVEMDHNFALRKAELD

SEQ ID NO: 1374279 - protein, 18 aa, Mycobacterium tuberculosis
GPKIHYRASALLCDPPLH

SEQ ID NO: 1374280 - protein, 23 aa, Mycobacterium tuberculosis
GQGGAALRMVQWDQIGQIVVSWV

SEQ ID NO: 1374281 - protein, 24 aa, Mycobacterium tuberculosis
GQGGRFLCTFPFSFEITEGEDRYV

SEQ ID NO: 1374282 - protein, 22 aa, Mycobacterium tuberculosis
GQTLVDSHAWLVVLTALGSLAA

SEQ ID NO: 1374283 - protein, 18 aa, Mycobacterium tuberculosis
GQYGRYGQYGQYGVQPGG

SEQ ID NO: 1374284 - protein, 17 aa, Mycobacterium tuberculosis
GRFREHIDAPALHPAVF

SEQ ID NO: 1374285 - protein, 26 aa, Mycobacterium tuberculosis
GSPLTAAMSLMWGWRLAAVCVTGAAA

SEQ ID NO: 1374286 - protein, 17 aa, Mycobacterium tuberculosis
GSQWELVRLPDDHRDAD

SEQ ID NO: 1374287 - protein, 17 aa, Mycobacterium tuberculosis
GSVPIVVERDGTAIVTY

SEQ ID NO: 1374288 - protein, 24 aa, Mycobacterium tuberculosis
GTDGIPMLMLKGAPETILPRCRLA

SEQ ID NO: 1374289 - protein, 21 aa, Mycobacterium tuberculosis
GTPQLALSMRIWSIMAHVLAG

SEQ ID NO: 1374290 - protein, 27 aa, Mycobacterium tuberculosis
GTVIAILLMWSKLPAKVRIIPGPLVAI

SEQ ID NO: 1374291 - protein, 23 aa, Mycobacterium tuberculosis
GVGIGAAILLGWFTLAHRHPDQP

SEQ ID NO: 1374292 - protein, 19 aa, Mycobacterium tuberculosis
GVLGWWRWHHNTWLTTIYT

SEQ ID NO: 1374293 - protein, 24 aa, Mycobacterium tuberculosis
GVMSHARFVPFTAETRMSGVDLAE

SEQ ID NO: 1374294 - protein, 26 aa, Mycobacterium tuberculosis
GWPPGLPPLPRRPRRYRRGVAAVAAV

SEQ ID NO: 1374295 - protein, 18 aa, Mycobacterium tuberculosis
GWVPPSPAPHVISQGAVP

SEQ ID NO: 1374296 - protein, 22 aa, Mycobacterium tuberculosis
GYARFWWPGLPIWVPALVTVAL

SEQ ID NO: 1374297 - protein, 20 aa, Mycobacterium tuberculosis
GYSLIERFPLMLGTAAGVLL

SEQ ID NO: 1374298 - protein, 18 aa, Mycobacterium tuberculosis
HALNKVWRRHMLRVHNLD

SEQ ID NO: 1374299 - protein, 33 aa, Mycobacterium tuberculosis; identical to SEQ ID NO: 157254

SEQ ID NO: 1374300 - protein, 17 aa, Mycobacterium tuberculosis
HDLPLRSRDRVPLMTTL

SEQ ID NO: 1374301 - protein, 23 aa, Mycobacterium tuberculosis
HDRGEFDGQLWIDMDFVDGTDTV

SEQ ID NO: 1374302 - protein, 22 aa, Mycobacterium tuberculosis
HIAGVFVPVVFVIAGLAGAAWL

SEQ ID NO: 1374303 - protein, 19 aa, Mycobacterium tuberculosis
HLAVDIGFALSVAATGALV

SEQ ID NO: 1374304 - protein, 18 aa, Mycobacterium tuberculosis
HLDVRWVVALIVINLAFT

SEQ ID NO: 1374305 - protein, 19 aa, Mycobacterium tuberculosis
HPITAFVLFVASPYIVYFT

SEQ ID NO: 1374306 - protein, 18 aa, Mycobacterium tuberculosis
HRIVPRVHAAPGLHKLVY

SEQ ID NO: 1374307 - protein, 24 aa, Mycobacterium tuberculosis
HSAERLIVIYADFKGEAGADSFRD

SEQ ID NO: 1374308 - protein, 24 aa, Mycobacterium tuberculosis
HSSDPTVAAGYPWQQQPTQEATWQ

SEQ ID NO: 1374309 - protein, 18 aa, Mycobacterium tuberculosis
HTSIPFLISMQGTSQKLT

SEQ ID NO: 1374310 - protein, 17 aa, Mycobacterium tuberculosis
HTVPKLTTALIHAYPAE

SEQ ID NO: 1374311 - protein, 17 aa, Mycobacterium tuberculosis
HVAPGFDLSQCRTGADA

SEQ ID NO: 1374312 - protein, 39 aa, Mycobacterium tuberculosis; identical to SEQ ID NO: 157316

SEQ ID NO: 1374313 - protein, 18 aa, Mycobacterium tuberculosis
HVGSRFGLFDPKRLLKVR

SEQ ID NO: 1374314 - protein, 24 aa, Mycobacterium tuberculosis
HWPGYLFGRIRTSTLVLIAAFLAV

SEQ ID NO: 1374315 - protein, 25 aa, Mycobacterium tuberculosis
IAEEMFFRGALYTALGRRYPVTIST

SEQ ID NO: 1374316 - protein, 17 aa, Mycobacterium tuberculosis
IAFLSALVLELLATLGV

SEQ ID NO: 1374317 - protein, 18 aa, Mycobacterium tuberculosis
IAIIFPKPWSWADLSFLP

SEQ ID NO: 1374318 - protein, 17 aa, Mycobacterium tuberculosis
IALALFALWPFTRLVHA

SEQ ID NO: 1374319 - protein, 20 aa, Mycobacterium tuberculosis
IAPELYLKRLCVGGVERVFE

SEQ ID NO: 1374320 - protein, 17 aa, Mycobacterium tuberculosis
IAPKAKIVASIREAENQ

SEQ ID NO: 1374321 - protein, 23 aa, Mycobacterium tuberculosis
IAVLPRLFGSITVEADRIADVMA

SEQ ID NO: 1374322 - protein, 19 aa, Mycobacterium tuberculosis
IDRILVGACAAVWLVFTGV

SEQ ID NO: 1374323 - protein, 18 aa, Mycobacterium tuberculosis
IEALGRVDTICFDKTGTL

SEQ ID NO: 1374324 - protein, 23 aa, Mycobacterium tuberculosis
IELPPGYLPLRVPIEVNFTQRVA

SEQ ID NO: 1374325 - protein, 24 aa, Mycobacterium tuberculosis
IGFKTKITTLLSWTVTFLSTRRGQ

SEQ ID NO: 1374326 - protein, 27 aa, Mycobacterium tuberculosis
IGGAIALRIMFNLPLPIGGIITGVVSL

SEQ ID NO: 1374327 - protein, 19 aa, Mycobacterium tuberculosis
IGPEKGWMSGITIGSGLVA

SEQ ID NO: 1374328 - protein, 17 aa, Mycobacterium tuberculosis
IGSGRILIDGVDIASVS

SEQ ID NO: 1374329 - protein, 17 aa, Mycobacterium tuberculosis
IGTAFTALVTKFTDSII

SEQ ID NO: 1374330 - protein, 19 aa, Mycobacterium tuberculosis
IGTPLFFQRVFGAGIATLV

SEQ ID NO: 1374331 - protein, 23 aa, Mycobacterium tuberculosis
IIGSISFWGSIVAFGKLQEIISG

SEQ ID NO: 1374332 - protein, 19 aa, Mycobacterium tuberculosis
IKYYLPRGRSRPVIEVAET

SEQ ID NO: 1374333 - protein, 35 aa, Mycobacterium tuberculosis; identical to SEQ ID NO: 157432

SEQ ID NO: 1374334 - protein, 28 aa, Mycobacterium tuberculosis
ILFGACRLGSLIRYVPHPVISGFMGGIA

SEQ ID NO: 1374335 - protein, 25 aa, Mycobacterium tuberculosis
ILNERELRAVLGHELSHVYNRDILI

SEQ ID NO: 1374336 - protein, 26 aa, Mycobacterium tuberculosis
ILTLLRLVMVPVFLLALFYGGGHHSA

SEQ ID NO: 1374337 - protein, 18 aa, Mycobacterium tuberculosis
IMLVCTYYGYAAHGGPAG

SEQ ID NO: 1374338 - protein, 17 aa, Mycobacterium tuberculosis
INAVPLRVAVFYIGALL

SEQ ID NO: 1374339 - protein, 20 aa, Mycobacterium tuberculosis
INECHRLCVDYAKTRTLWGR

SEQ ID NO: 1374340 - protein, 19 aa, Mycobacterium tuberculosis
INLLPLLPFDGGHIAVAVF

SEQ ID NO: 1374341 - protein, 27 aa, Mycobacterium tuberculosis
INVLRVWPEIVGAIVLLVIAAMGIGHG

SEQ ID NO: 1374342 - protein, 18 aa, Mycobacterium tuberculosis
IPIHIVAMVVLLSLIPIG

SEQ ID NO: 1374343 - protein, 23 aa, Mycobacterium tuberculosis
IPPPEGKPWWLIVVGVVVVGLLG

SEQ ID NO: 1374344 - protein, 17 aa, Mycobacterium tuberculosis
IQKSAWLTRSIVAVVLV

SEQ ID NO: 1374345 - protein, 29 aa, Mycobacterium tuberculosis
IRGKMKGGPLPRGRGLLMAEDTGVFVQVA

SEQ ID NO: 1374346 - protein, 21 aa, Mycobacterium tuberculosis
ISGFMGGIAILIIMTQLDQVR

SEQ ID NO: 1374347 - protein, 34 aa, Mycobacterium tuberculosis; identical to SEQ ID NO: 157499

SEQ ID NO: 1374348 - protein, 18 aa, Mycobacterium tuberculosis
ISTISFGTPYGFVEINDQ

SEQ ID NO: 1374349 - protein, 17 aa, Mycobacterium tuberculosis
ITYRVEVGVCLASGDPV

SEQ ID NO: 1374350 - protein, 18 aa, Mycobacterium tuberculosis
IVAATAWSLSSVFGDQPP

SEQ ID NO: 1374351 - protein, 17 aa, Mycobacterium tuberculosis
IVFVLIFQRRIVAGLTS

SEQ ID NO: 1374352 - protein, 18 aa, Mycobacterium tuberculosis
IVQSMFIGPVFNPLLKML

SEQ ID NO: 1374353 - protein, 31 aa, Mycobacterium tuberculosis; identical to SEQ ID NO: 157536

SEQ ID NO: 1374354 - protein, 18 aa, Mycobacterium tuberculosis
IYYPRYLILTAPAAAVIL

SEQ ID NO: 1374355 - protein, 19 aa, Mycobacterium tuberculosis
IYYPVSWIMWVWYRLFAFV

SEQ ID NO: 1374356 - protein, 20 aa, Mycobacterium tuberculosis
KIIMLCLWWGAATSKLNHHF

SEQ ID NO: 1374357 - protein, 19 aa, Mycobacterium tuberculosis
KLGIVWLVLSVFTVMIIVV

SEQ ID NO: 1374358 - protein, 23 aa, Mycobacterium tuberculosis
KLSFPTSAAPGWSAFSDDQNPNL

SEQ ID NO: 1374359 - protein, 22 aa, Mycobacterium tuberculosis
KRRGWPATLFRPHNLPFVMLGA

SEQ ID NO: 1374360 - protein, 22 aa, Mycobacterium tuberculosis
KSGLTALTWPVMANFAVDSAMA

SEQ ID NO: 1374361 - protein, 19 aa, Mycobacterium tuberculosis
KTAEVVDAFTTSKVTLSTT

SEQ ID NO: 1374362 - protein, 17 aa, Mycobacterium tuberculosis
KTAYFDTDFFQVLVTQF

SEQ ID NO: 1374363 - protein, 24 aa, Mycobacterium tuberculosis
KVLDLTIRLAEVMLSSGSGTADVV

SEQ ID NO: 1374364 - protein, 24 aa, Mycobacterium tuberculosis
KVNQAGVIPVIFASSLIYIPHLIT

SEQ ID NO: 1374365 - protein, 21 aa, Mycobacterium tuberculosis
LAAMVRLRHLIFKVMTANVDG

SEQ ID NO: 1374366 - protein, 17 aa, Mycobacterium tuberculosis
LALGIGIHDITAGYRAY

SEQ ID NO: 1374367 - protein, 18 aa, Mycobacterium tuberculosis
LALVGLLALPGYRPGYND

SEQ ID NO: 1374368 - protein, 23 aa, Mycobacterium tuberculosis
LANLFPFQLFLVLYGLPLEDRDR

SEQ ID NO: 1374369 - protein, 20 aa, Mycobacterium tuberculosis
LAPDAICVTDPLAFTGCGCD

SEQ ID NO: 1374370 - protein, 19 aa, Mycobacterium tuberculosis
LARHPRLPRQDALKVLRAD

SEQ ID NO: 1374371 - protein, 18 aa, Mycobacterium tuberculosis
LARYGPRAPQLWLPPLDE

SEQ ID NO: 1374372 - protein, 24 aa, Mycobacterium tuberculosis
LASDRGAGALGFVGTAGKESVGQP

SEQ ID NO: 1374373 - protein, 27 aa, Mycobacterium tuberculosis
LATHYWKPLLLCFLVTLGGTVAFYTYS

SEQ ID NO: 1374374 - protein, 24 aa, Mycobacterium tuberculosis
LATRGGVAFLGFHRIIGLSTFATN

SEQ ID NO: 1374375 - protein, 26 aa, Mycobacterium tuberculosis
LCALAVGLKFKLGFDDSLDVVGVHLV

SEQ ID NO: 1374376 - protein, 26 aa, Mycobacterium tuberculosis
LCAVAPNILLLIIFRVVQGFGGGMLT

SEQ ID NO: 1374377 - protein, 17 aa, Mycobacterium tuberculosis
LCSARADVLAAVRDILA

SEQ ID NO: 1374378 - protein, 18 aa, Mycobacterium tuberculosis
LDAQMIAFFTMVVAACEV

SEQ ID NO: 1374379 - protein, 26 aa, Mycobacterium tuberculosis
LDGFRPDRWDVIGALGCMAGVAVIMY

SEQ ID NO: 1374380 - protein, 18 aa, Mycobacterium tuberculosis
LDQWDWVKWLPHFGDSRR

SEQ ID NO: 1374381 - protein, 22 aa, Mycobacterium tuberculosis
LDVRAGEHLAIIGANGSGKTTL

SEQ ID NO: 1374382 - protein, 19 aa, Mycobacterium tuberculosis
LEHGPWIAALTAMLAAVAM

SEQ ID NO: 1374383 - protein, 17 aa, Mycobacterium tuberculosis
LELRLHDARDSNVRVVG

SEQ ID NO: 1374384 - protein, 23 aa, Mycobacterium tuberculosis
LEVSARMAVLLAGLSPRLPPALN

SEQ ID NO: 1374385 - protein, 31 aa, Mycobacterium tuberculosis; identical to SEQ ID NO: 157720

SEQ ID NO: 1374386 - protein, 19 aa, Mycobacterium tuberculosis
LFCVGLMTAYLAARVGTTA

SEQ ID NO: 1374387 - protein, 18 aa, Mycobacterium tuberculosis
LFVVAGLVALYILMQLAR

SEQ ID NO: 1374388 - protein, 18 aa, Mycobacterium tuberculosis
LGAAIAVALGLWPRLKEY

SEQ ID NO: 1374389 - protein, 18 aa, Mycobacterium tuberculosis
LGALLWSFISPSGQLNES

SEQ ID NO: 1374390 - protein, 18 aa, Mycobacterium tuberculosis
LGFGCGSGPLTGRFWPPI

SEQ ID NO: 1374391 - protein, 24 aa, Mycobacterium tuberculosis
LGITRISLNFAVFRAAFEQGAQLG

SEQ ID NO: 1374392 - protein, 29 aa, Mycobacterium tuberculosis
LGYLYFLVCLCVFRPPSIFGAQRASHALS

SEQ ID NO: 1374393 - protein, 26 aa, Mycobacterium tuberculosis
LIDELGWPMLCLMTIAAGALQIVFGL

SEQ ID NO: 1374394 - protein, 25 aa, Mycobacterium tuberculosis
LIGLSFLGLCHLWAGSPEAPESRLR

SEQ ID NO: 1374395 - protein, 28 aa, Mycobacterium tuberculosis
LIGLSMLGDLPWWVTVLILTRELGVTVL

SEQ ID NO: 1374396 - protein, 27 aa, Mycobacterium tuberculosis
LIHDCPKLLQLRTFPTIAIGGDLAGAA

SEQ ID NO: 1374397 - protein, 21 aa, Mycobacterium tuberculosis
LILALILKFTIGLRLDAEQES

SEQ ID NO: 1374398 - protein, 20 aa, Mycobacterium tuberculosis
LISLEILFAIVAYTIIIVLI

SEQ ID NO: 1374399 - protein, 26 aa, Mycobacterium tuberculosis
LKLTGGRTAQAWARRHQQLRAALTPL

SEQ ID NO: 1374400 - protein, 21 aa, Mycobacterium tuberculosis
LKLVFSMDLGMCLNRFTYDSK

SEQ ID NO: 1374401 - protein, 21 aa, Mycobacterium tuberculosis
LLAGSHGWRAMFGLAAAPATL

SEQ ID NO: 1374402 - protein, 17 aa, Mycobacterium tuberculosis
LLGACAKSAQVPLQAWL

SEQ ID NO: 1374403 - protein, 31 aa, Mycobacterium tuberculosis
LLGGWLTDYLSWRWAFWINVPVSIAVLTVAA

SEQ ID NO: 1374404 - protein, 19 aa, Mycobacterium tuberculosis
LLHRDVKPANILIANPDSP

SEQ ID NO: 1374405 - protein, 19 aa, Mycobacterium tuberculosis
LLLGMLVTACFTRPARWTL

SEQ ID NO: 1374406 - protein, 23 aa, Mycobacterium tuberculosis
LLPLHLLLLPWSSMRSSMHDGFI

SEQ ID NO: 1374407 - protein, 18 aa, Mycobacterium tuberculosis
LLRRIGVGVPDFYQDARW

SEQ ID NO: 1374408 - protein, 18 aa, Mycobacterium tuberculosis
LLVAVSWAIFALVLAVVI

SEQ ID NO: 1374409 - protein, 34 aa, Mycobacterium tuberculosis; identical to SEQ ID NO: 157853

SEQ ID NO: 1374410 - protein, 18 aa, Mycobacterium tuberculosis
LMENMGYRLVLKARTAGA

SEQ ID NO: 1374411 - protein, 17 aa, Mycobacterium tuberculosis
LMSLGIINECHRLCVDY

SEQ ID NO: 1374412 - protein, 29 aa, Mycobacterium tuberculosis
LNGAPEAMWWTLYLACYLAGGWGSAWAGA

SEQ ID NO: 1374413 - protein, 18 aa, Mycobacterium tuberculosis
LPGVFPVPLTISGDPANW

SEQ ID NO: 1374414 - protein, 23 aa, Mycobacterium tuberculosis
LPPSVFGSGPLKWIYLTMSVQMI

SEQ ID NO: 1374415 - protein, 17 aa, Mycobacterium tuberculosis
LPTDGFQGLNVVSTIGA

SEQ ID NO: 1374416 - protein, 22 aa, Mycobacterium tuberculosis
LPYVMGGAMLGMIAIMVAGGTR

SEQ ID NO: 1374417 - protein, 17 aa, Mycobacterium tuberculosis
LQPAFKASMAVLLAAAA

SEQ ID NO: 1374418 - protein, 18 aa, Mycobacterium tuberculosis
LRAGFAYQRLARLIAEDG

SEQ ID NO: 1374419 - protein, 24 aa, Mycobacterium tuberculosis
LREEAAKFGVEWLPAKGFITDRLP

SEQ ID NO: 1374420 - protein, 20 aa, Mycobacterium tuberculosis
LRIASPMFHFGILVVIVGHG

SEQ ID NO: 1374421 - protein, 26 aa, Mycobacterium tuberculosis
LRLLSKLSRLPLGWFTSRGSGSIKKL

SEQ ID NO: 1374422 - protein, 19 aa, Mycobacterium tuberculosis
LRLTVAFVVGHIGATLLVA

SEQ ID NO: 1374423 - protein, 17 aa, Mycobacterium tuberculosis
LRPTTFFLSITVLINSL

SEQ ID NO: 1374424 - protein, 17 aa, Mycobacterium tuberculosis
LRRGELDSGTSTPATNY

SEQ ID NO: 1374425 - protein, 26 aa, Mycobacterium tuberculosis
LRSLAELWPYASGTLHRPGGENETMF

SEQ ID NO: 1374426 - protein, 20 aa, Mycobacterium tuberculosis
LRSPGPLGIIFSLVCIGIAA

SEQ ID NO: 1374427 - protein, 25 aa, Mycobacterium tuberculosis
LRTNSEILSGIGISLLSPLALATNG

SEQ ID NO: 1374428 - protein, 24 aa, Mycobacterium tuberculosis
LSGFAHSWFFLFLFVVAGLVALYI

SEQ ID NO: 1374429 - protein, 19 aa, Mycobacterium tuberculosis
LSMTLPILIPFVYFSHALN

SEQ ID NO: 1374430 - protein, 34 aa, Mycobacterium tuberculosis; identical to SEQ ID NO: 157970

SEQ ID NO: 1374431 - protein, 25 aa, Mycobacterium tuberculosis
LSPEARLSLEFQRVSFGYVADRPVL

SEQ ID NO: 1374432 - protein, 24 aa, Mycobacterium tuberculosis
LSPYMLMMPLMMIVMMVGGLAGST

SEQ ID NO: 1374433 - protein, 18 aa, Mycobacterium tuberculosis
LSQCRTGADANRFVQCRV

SEQ ID NO: 1374434 - protein, 18 aa, Mycobacterium tuberculosis
LSYMALFSVPVVAPLLLR

SEQ ID NO: 1374435 - protein, 22 aa, Mycobacterium tuberculosis
LTKHYPGRVVFLGVNLAIALIL

SEQ ID NO: 1374436 - protein, 29 aa, Mycobacterium tuberculosis
LTLLLARWLLFRVEFGAGLIKMRGDSCWR

SEQ ID NO: 1374437 - protein, 17 aa, Mycobacterium tuberculosis
LTLPGIRDALAARTDDS

SEQ ID NO: 1374438 - protein, 19 aa, Mycobacterium tuberculosis
LTMLTRWAPRAPGPIIAVL

SEQ ID NO: 1374439 - protein, 17 aa, Mycobacterium tuberculosis
LTPAVFLLYFLLRRDGR

SEQ ID NO: 1374440 - protein, 17 aa, Mycobacterium tuberculosis
LTPEERAELSARLTEDT

SEQ ID NO: 1374441 - protein, 18 aa, Mycobacterium tuberculosis
LTSGFVSKFAVFRAAASA

SEQ ID NO: 1374442 - protein, 19 aa, Mycobacterium tuberculosis
LTWLFAFVVILALSSTIVL

SEQ ID NO: 1374443 - protein, 17 aa, Mycobacterium tuberculosis
LVAIAGLAGLGIANQSI

SEQ ID NO: 1374444 - protein, 18 aa, Mycobacterium tuberculosis
LVALPLSLGIAIASGAPI

SEQ ID NO: 1374445 - protein, 20 aa, Mycobacterium tuberculosis
LVGACAAVWLVFTGVSVAAA

SEQ ID NO: 1374446 - protein, 18 aa, Mycobacterium tuberculosis
LVIATLFLVRSMNQQLKK

SEQ ID NO: 1374447 - protein, 17 aa, Mycobacterium tuberculosis
LVLTWIVLNLFAVGLRW

SEQ ID NO: 1374448 - protein, 27 aa, Mycobacterium tuberculosis
LVNRVMKRPVLFAAPIVIIMILLIIPV

SEQ ID NO: 1374449 - protein, 18 aa, Mycobacterium tuberculosis
LWGAMTFGPFIAHHIAPV

SEQ ID NO: 1374450 - protein, 25 aa, Mycobacterium tuberculosis
LYFWLPCLACLLAVAELQLRSLRLT

SEQ ID NO: 1374451 - protein, 26 aa, Mycobacterium tuberculosis
LYVISSWRPVLLIPLTFALFTPLAVP

SEQ ID NO: 1374452 - protein, 17 aa, Mycobacterium tuberculosis
LYYPPAVISVVLAGACL

SEQ ID NO: 1374453 - protein, 19 aa, Mycobacterium tuberculosis
MAPTLTWLFAFVVILALSS

SEQ ID NO: 1374454 - protein, 20 aa, Mycobacterium tuberculosis
MAVISPAIWAARGARGLERV

SEQ ID NO: 1374455 - protein, 21 aa, Mycobacterium tuberculosis
MCVLAALIRGLARKRASTLGN

SEQ ID NO: 1374456 - protein, 29 aa, Mycobacterium tuberculosis
MDHNFALRKAELDAGYILTCQSHPTTPFV

SEQ ID NO: 1374457 - protein, 24 aa, Mycobacterium tuberculosis
MDRIGAYERYWLYPGAQNLATFRA

SEQ ID NO: 1374458 - protein, 21 aa, Mycobacterium tuberculosis
MEEVLAIKPDICFLWDEAWYA

SEQ ID NO: 1374459 - protein, 18 aa, Mycobacterium tuberculosis
MGGACGTCRAKLIEGNVE

SEQ ID NO: 1374460 - protein, 17 aa, Mycobacterium tuberculosis
MIAQLVFAMGGRAAEEL

SEQ ID NO: 1374461 - protein, 21 aa, Mycobacterium tuberculosis
MKYQPEWVPRYACYEDARVIP

SEQ ID NO: 1374462 - protein, 23 aa, Mycobacterium tuberculosis
MPGPEVTEIITAVAEALDYAHER

SEQ ID NO: 1374463 - protein, 21 aa, Mycobacterium tuberculosis
MPLETRTVIALLFGPTVGIAI

SEQ ID NO: 1374464 - protein, 25 aa, Mycobacterium tuberculosis
MSGPLHLGGICWRGRNQRPVITGTT

SEQ ID NO: 1374465 - protein, 18 aa, Mycobacterium tuberculosis
MVLICLFLYHVFRNRNWL

SEQ ID NO: 1374466 - protein, 21 aa, Mycobacterium tuberculosis
MVPLTAWLCGAYSAVRHLDLT

SEQ ID NO: 1374467 - protein, 25 aa, Mycobacterium tuberculosis
MWLGRLRFGALYAVSALGGSVLVYL

SEQ ID NO: 1374468 - protein, 21 aa, Mycobacterium tuberculosis
NAAPLRIMILLVLVTALGSAL

SEQ ID NO: 1374469 - protein, 28 aa, Mycobacterium tuberculosis
NDHRARLIGFALLAFCSVVARAVGTVLL

SEQ ID NO: 1374470 - protein, 26 aa, Mycobacterium tuberculosis
NIGIMIVSLIGWWALSRLLERMRGIP

SEQ ID NO: 1374471 - protein, 18 aa, Mycobacterium tuberculosis
NPQFAFVRIDSGKPDFRI

SEQ ID NO: 1374472 - protein, 20 aa, Mycobacterium tuberculosis
NPSQYWGLKGLIGVNAVAAD

SEQ ID NO: 1374473 - protein, 17 aa, Mycobacterium tuberculosis
NQQMLWTLVGVAAFALV

SEQ ID NO: 1374474 - protein, 25 aa, Mycobacterium tuberculosis
NRWWTWTLLAGPGWVAFGATKQIIG

SEQ ID NO: 1374475 - protein, 19 aa, Mycobacterium tuberculosis
NSVEFCCLFYGAAKLGAVA

SEQ ID NO: 1374476 - protein, 18 aa, Mycobacterium tuberculosis
NVFTRINAILGVLLLIVL

SEQ ID NO: 1374477 - protein, 19 aa, Mycobacterium tuberculosis
NVVIGWPFVGLLALGLVYV

SEQ ID NO: 1374478 - protein, 18 aa, Mycobacterium tuberculosis
PAAGLWASIAPLAIYALL

SEQ ID NO: 1374479 - protein, 22 aa, Mycobacterium tuberculosis
PATRRYTYGFGRVEDLAGSFVV

SEQ ID NO: 1374480 - protein, 25 aa, Mycobacterium tuberculosis
PDGDYAVAVARIFSTDVRFIGAGAI

SEQ ID NO: 1374481 - protein, 21 aa, Mycobacterium tuberculosis
PDGGAAFVRRLVTLATTLLLG

SEQ ID NO: 1374482 - protein, 18 aa, Mycobacterium tuberculosis
PDIARPGAGGSRVSRADV

SEQ ID NO: 1374483 - protein, 23 aa, Mycobacterium tuberculosis
PDQRELWRAVGIRGATTAAAATV

SEQ ID NO: 1374484 - protein, 23 aa, Mycobacterium tuberculosis
PDRNLPRAIPIAIFSVGAIYLLT

SEQ ID NO: 1374485 - protein, 24 aa, Mycobacterium tuberculosis
PDSRPRLILGASLIGLSFLGLCHL

SEQ ID NO: 1374486 - protein, 22 aa, Mycobacterium tuberculosis
PEAPRITAPRIRGGGRASVGLP

SEQ ID NO: 1374487 - protein, 20 aa, Mycobacterium tuberculosis
PEGRSIVVLAKDEFGLRARD

SEQ ID NO: 1374488 - protein, 35 aa, Mycobacterium tuberculosis; identical to SEQ ID NO: 158273

SEQ ID NO: 1374489 - protein, 21 aa, Mycobacterium tuberculosis
PENGSGWVFCMMIAVIASDVG

SEQ ID NO: 1374490 - protein, 24 aa, Mycobacterium tuberculosis
PESRLRAAGFIGFAIGGPLSDGLT

SEQ ID NO: 1374491 - protein, 30 aa, Mycobacterium tuberculosis; identical to SEQ ID NO: 158283

SEQ ID NO: 1374492 - protein, 24 aa, Mycobacterium tuberculosis
PFIALGVAGAFVWSPLTVTATRNL

SEQ ID NO: 1374493 - protein, 25 aa, Mycobacterium tuberculosis
PFVMLGAALLWFGWYGFNAGSATTA

SEQ ID NO: 1374494 - protein, 17 aa, Mycobacterium tuberculosis
PGISDAFASYAFGTFGV

SEQ ID NO: 1374495 - protein, 25 aa, Mycobacterium tuberculosis
PGKKFTWHWWWLGAAALGVLLVVMV

SEQ ID NO: 1374496 - protein, 17 aa, Mycobacterium tuberculosis
PGPMPAPPLGAVPSPAP

SEQ ID NO: 1374497 - protein, 20 aa, Mycobacterium tuberculosis
PHIDLPEAWQVIAVALIVYS

SEQ ID NO: 1374498 - protein, 21 aa, Mycobacterium tuberculosis
PHPRLPRLIPGGDYVMAGGDG

SEQ ID NO: 1374499 - protein, 22 aa, Mycobacterium tuberculosis
PHTIYSPLFRKFVEWIEYLCLM

SEQ ID NO: 1374500 - protein, 23 aa, Mycobacterium tuberculosis
PKTPEFRRGMLYAINPVGFGSLL

SEQ ID NO: 1374501 - protein, 20 aa, Mycobacterium tuberculosis
PLWTDILLPIVMWALYAWSW

SEQ ID NO: 1374502 - protein, 21 aa, Mycobacterium tuberculosis
PMLPGRGWSIFVGVISLIAGI

SEQ ID NO: 1374503 - protein, 19 aa, Mycobacterium tuberculosis
PPEELQFVLADLKGGSAVK

SEQ ID NO: 1374504 - protein, 19 aa, Mycobacterium tuberculosis
PPLLREWTHYDSMTTTVLG

SEQ ID NO: 1374505 - protein, 21 aa, Mycobacterium tuberculosis
PPPAPGRPSAQVWLVDPRRQL

SEQ ID NO: 1374506 - protein, 17 aa, Mycobacterium tuberculosis
PPPARIVLFSDGKETMP

SEQ ID NO: 1374507 - protein, 24 aa, Mycobacterium tuberculosis
PQFFARRIGRNEAFNHAGNASAAG

SEQ ID NO: 1374508 - protein, 17 aa, Mycobacterium tuberculosis
PQFGRDLGFYAFELPFY

SEQ ID NO: 1374509 - protein, 20 aa, Mycobacterium tuberculosis
PRALAAFGRNDIRGTYRDPL

SEQ ID NO: 1374510 - protein, 19 aa, Mycobacterium tuberculosis
PRAPQLWLPPLDETIPLSA

SEQ ID NO: 1374511 - protein, 24 aa, Mycobacterium tuberculosis
PRVLEAIQVLRIRYILTSTPTVRG

SEQ ID NO: 1374512 - protein, 20 aa, Mycobacterium tuberculosis
PRWLTFGVVPGYVLLALALG

SEQ ID NO: 1374513 - protein, 24 aa, Mycobacterium tuberculosis
PSAYDLGTVIGFYGLTIDEPPTGT

SEQ ID NO: 1374514 - protein, 18 aa, Mycobacterium tuberculosis
PTALAPTGVIVWLCTIVV

SEQ ID NO: 1374515 - protein, 24 aa, Mycobacterium tuberculosis
PTGSGLPALLGIAALAAVLANVVN

SEQ ID NO: 1374516 - protein, 24 aa, Mycobacterium tuberculosis
PTRRRPRRILVGAVAVLLLAGLFA

SEQ ID NO: 1374517 - protein, 24 aa, Mycobacterium tuberculosis
PVKFTRAAAVWSALIVGFLILILL

SEQ ID NO: 1374518 - protein, 24 aa, Mycobacterium tuberculosis
PWQLSAHRWYTWVIAIVGVDLLYY

SEQ ID NO: 1374519 - protein, 25 aa, Mycobacterium tuberculosis
QAGPQLPGPVPIPGAPGPMPAPPLG

SEQ ID NO: 1374520 - protein, 22 aa, Mycobacterium tuberculosis
QELRHWLVVLVLTVVGWMLAAF

SEQ ID NO: 1374521 - protein, 18 aa, Mycobacterium tuberculosis
QGAVIRIPAVASRSGDLP

SEQ ID NO: 1374522 - protein, 23 aa, Mycobacterium tuberculosis
QGGARMGFGFGKSRAKQLSKDMP

SEQ ID NO: 1374523 - protein, 30 aa, Mycobacterium tuberculosis; identical to SEQ ID NO: 158490

SEQ ID NO: 1374524 - protein, 20 aa, Mycobacterium tuberculosis
QHGAWPWAVLLVVLVVGAFA

SEQ ID NO: 1374525 - protein, 18 aa, Mycobacterium tuberculosis
QHGRRVALALSFGLRTAL

SEQ ID NO: 1374526 - protein, 34 aa, Mycobacterium tuberculosis; identical to SEQ ID NO: 158497

SEQ ID NO: 1374527 - protein, 19 aa, Mycobacterium tuberculosis
QLLLLPVAWYLIVGSHQPA

SEQ ID NO: 1374528 - protein, 19 aa, Mycobacterium tuberculosis
QLSMCFVLLISGVGSLIHI

SEQ ID NO: 1374529 - protein, 22 aa, Mycobacterium tuberculosis
QLTVKHALMYAAELRLPPDTTK

SEQ ID NO: 1374530 - protein, 24 aa, Mycobacterium tuberculosis
QNAYCTEVGVLPGTDFQLQPKYME

SEQ ID NO: 1374531 - protein, 30 aa, Mycobacterium tuberculosis; identical to SEQ ID NO: 158512

SEQ ID NO: 1374532 - protein, 28 aa, Mycobacterium tuberculosis
QPKDRYQRCVDFARALGHRLGGAGDPDD

SEQ ID NO: 1374533 - protein, 23 aa, Mycobacterium tuberculosis
QPLSKMSIAGPWVSISAPGTDVV

SEQ ID NO: 1374534 - protein, 22 aa, Mycobacterium tuberculosis
QRADAPVGIIALWALALLIIGT

SEQ ID NO: 1374535 - protein, 18 aa, Mycobacterium tuberculosis
QRLAIARAVIRRPAIYVF

SEQ ID NO: 1374536 - protein, 25 aa, Mycobacterium tuberculosis
QRLFPRAILHFEDFGPANARKILDT

SEQ ID NO: 1374537 - protein, 18 aa, Mycobacterium tuberculosis
QRRMEVLALPLVAVVLFF

SEQ ID NO: 1374538 - protein, 28 aa, Mycobacterium tuberculosis
QSALRLKGRLLFMPGVMVTSVPWQLTSS

SEQ ID NO: 1374539 - protein, 24 aa, Mycobacterium tuberculosis
QTGMPSSFSMHGPWVDVAAPAENI

SEQ ID NO: 1374540 - protein, 21 aa, Mycobacterium tuberculosis
QTLFFPFVLLLAATALYRGND

SEQ ID NO: 1374541 - protein, 24 aa, Mycobacterium tuberculosis
QYALALTAIHLFAGAPPVDRSHTG

SEQ ID NO: 1374542 - protein, 18 aa, Mycobacterium tuberculosis
RAAILAAVVCVLTLTIAR

SEQ ID NO: 1374543 - protein, 20 aa, Mycobacterium tuberculosis
RADETLSLIRRGDEEVRKQA

SEQ ID NO: 1374544 - protein, 18 aa, Mycobacterium tuberculosis
RAGWSLDRINGAYEAILN

SEQ ID NO: 1374545 - protein, 18 aa, Mycobacterium tuberculosis
RAQFMLMLDMLRETAQES

SEQ ID NO: 1374546 - protein, 24 aa, Mycobacterium tuberculosis
RARRTRPELARMLLLGTLIGLVWE

SEQ ID NO: 1374547 - protein, 37 aa, Mycobacterium tuberculosis; identical to SEQ ID NO: 158585

SEQ ID NO: 1374548 - protein, 27 aa, Mycobacterium tuberculosis
RATMRTIRMNMIWAFGYNVAAIPIAAA

SEQ ID NO: 1374549 - protein, 18 aa, Mycobacterium tuberculosis
RAVAIEWRGKIDDPKWRT

SEQ ID NO: 1374550 - protein, 22 aa, Mycobacterium tuberculosis
RAWESRLLMVARRFDGDAQSAG

SEQ ID NO: 1374551 - protein, 27 aa, Mycobacterium tuberculosis
RCGACGAYKIGSTWHRTTTPTVGAATT

SEQ ID NO: 1374552 - protein, 18 aa, Mycobacterium tuberculosis
RDMVPIWVAAGGLAGALL

SEQ ID NO: 1374553 - protein, 19 aa, Mycobacterium tuberculosis
RDQLSGVRVVRAFTREGYE

SEQ ID NO: 1374554 - protein, 24 aa, Mycobacterium tuberculosis
RDRHLPRWLAAVHPRFKVPFRAEL

SEQ ID NO: 1374555 - protein, 23 aa, Mycobacterium tuberculosis
RDRLAARASRYARVPWVGAAAAP

SEQ ID NO: 1374556 - protein, 18 aa, Mycobacterium tuberculosis
RDTWLLSLLYLGTFGSFI

SEQ ID NO: 1374557 - protein, 20 aa, Mycobacterium tuberculosis
RDWNWLKWLPHVDIPGRLDA

SEQ ID NO: 1374558 - protein, 21 aa, Mycobacterium tuberculosis
REHIDAPALHPAVFATAVMLL

SEQ ID NO: 1374559 - protein, 27 aa, Mycobacterium tuberculosis
RELPASVPVWLVWHIPGGTVWAEEAAF

SEQ ID NO: 1374560 - protein, 18 aa, Mycobacterium tuberculosis
RENPEWTNTAIVWNPGTG

SEQ ID NO: 1374561 - protein, 19 aa, Mycobacterium tuberculosis
REPDLPRGFKVPGYPVTPV

SEQ ID NO: 1374562 - protein, 18 aa, Mycobacterium tuberculosis
RFPGRTAVFLVIIAALMV

SEQ ID NO: 1374563 - protein, 19 aa, Mycobacterium tuberculosis
RGGPAAGHRWGYLPPEGQG

SEQ ID NO: 1374564 - protein, 17 aa, Mycobacterium tuberculosis
RGIPRLASVAPLDPNVV

SEQ ID NO: 1374565 - protein, 25 aa, Mycobacterium tuberculosis
RGQFEGRLWIAMQFVDGGNAEDALR

SEQ ID NO: 1374566 - protein, 23 aa, Mycobacterium tuberculosis
RGTIAFLGYHGMVGLSTFVVNIL

SEQ ID NO: 1374567 - protein, 19 aa, Mycobacterium tuberculosis
RLAIGGGLGGLLVVVVAML

SEQ ID NO: 1374568 - protein, 25 aa, Mycobacterium tuberculosis
RLARTELDGLIVLPDRTRAGIERGI

SEQ ID NO: 1374569 - protein, 20 aa, Mycobacterium tuberculosis
RLATLLAQFLDDPRWIAMLA

SEQ ID NO: 1374570 - protein, 17 aa, Mycobacterium tuberculosis
RLCELAKSYPSRLLASS

SEQ ID NO: 1374571 - protein, 17 aa, Mycobacterium tuberculosis
RLFRALRRGELDSGTST

SEQ ID NO: 1374572 - protein, 22 aa, Mycobacterium tuberculosis
RLKTFLLLVGMSALIVAVGALF

SEQ ID NO: 1374573 - protein, 26 aa, Mycobacterium tuberculosis
RLLAPLKLPLVLSGVLAALVTLAQLA

SEQ ID NO: 1374574 - protein, 18 aa, Mycobacterium tuberculosis
RLLLPTITGWSLGRALTG

SEQ ID NO: 1374575 - protein, 26 aa, Mycobacterium tuberculosis
RLLRVTRWDVGLAMLIAGGVNAAMLL

SEQ ID NO: 1374576 - protein, 17 aa, Mycobacterium tuberculosis
RLSIAVITLGIAGTTIG

SEQ ID NO: 1374577 - protein, 20 aa, Mycobacterium tuberculosis
RLVRSLRPLILLPLVLPPVV

SEQ ID NO: 1374578 - protein, 27 aa, Mycobacterium tuberculosis
RMIHAFAVPIILGWLAVCVVVTVFVPS

SEQ ID NO: 1374579 - protein, 24 aa, Mycobacterium tuberculosis
RPDLARLDGVLSRALATAPADRFG

SEQ ID NO: 1374580 - protein, 22 aa, Mycobacterium tuberculosis
RPEKPFIARMIHAFAVPIILGW

SEQ ID NO: 1374581 - protein, 20 aa, Mycobacterium tuberculosis
RPGWLALALVVVAFTYLCFT

SEQ ID NO: 1374582 - protein, 19 aa, Mycobacterium tuberculosis
RPRDVPVRTAIGAMAIAFY

SEQ ID NO: 1374583 - protein, 18 aa, Mycobacterium tuberculosis
RPTGASVRGGRSIGSGHP

SEQ ID NO: 1374584 - protein, 19 aa, Mycobacterium tuberculosis
RQGRAYWIHLMMASQTIES

SEQ ID NO: 1374585 - protein, 25 aa, Mycobacterium tuberculosis
RQGWAVLAIMGIIWIGMSVAAMSFE

SEQ ID NO: 1374586 - protein, 26 aa, Mycobacterium tuberculosis
RRLLPLLFVLYVINFVDRANISVAAL

SEQ ID NO: 1374587 - protein, 19 aa, Mycobacterium tuberculosis
RRLRWRLMAVLAIAVGTYG

SEQ ID NO: 1374588 - protein, 20 aa, Mycobacterium tuberculosis
RRQVDIEGFELVRHVYNMAL

SEQ ID NO: 1374589 - protein, 17 aa, Mycobacterium tuberculosis
RRRALVVSLVCLTVSQL

SEQ ID NO: 1374590 - protein, 19 aa, Mycobacterium tuberculosis
RRRFFGYLNLFLASMLLLV

SEQ ID NO: 1374591 - protein, 21 aa, Mycobacterium tuberculosis
RRRLAPPSSHQGTIIIEAPPE

SEQ ID NO: 1374592 - protein, 28 aa, Mycobacterium tuberculosis
RRTFLAPWRVAVGHLMFWGVGTALLTTL

SEQ ID NO: 1374593 - protein, 20 aa, Mycobacterium tuberculosis
RRVALALSFGLRTALAVVLI

SEQ ID NO: 1374594 - protein, 18 aa, Mycobacterium tuberculosis
RRYADYLPTDGFQGLNVV

SEQ ID NO: 1374595 - protein, 26 aa, Mycobacterium tuberculosis
RRYGGLRAALPVTFATFGLAYLAIIG

SEQ ID NO: 1374596 - protein, 21 aa, Mycobacterium tuberculosis
RSGKTTLLRHIIRTVREHSTA

SEQ ID NO: 1374597 - protein, 23 aa, Mycobacterium tuberculosis
RSVRSLPDFWRLLQVRVASQFGD

SEQ ID NO: 1374598 - protein, 24 aa, Mycobacterium tuberculosis
RTLPRWQRIVALTMIGISTALIGG

SEQ ID NO: 1374599 - protein, 22 aa, Mycobacterium tuberculosis
RTPGESSFYWLTLALAAVWIAG

SEQ ID NO: 1374600 - protein, 17 aa, Mycobacterium tuberculosis
RTRLEQLAELAAEAQGS

SEQ ID NO: 1374601 - protein, 19 aa, Mycobacterium tuberculosis
RTRMSTILHGVWILLFASL

SEQ ID NO: 1374602 - protein, 20 aa, Mycobacterium tuberculosis
RVGARIILLNSEFSGPQIKE

SEQ ID NO: 1374603 - protein, 22 aa, Mycobacterium tuberculosis
RWRVDIDGTLSFLLLPRLTTVL

SEQ ID NO: 1374604 - protein, 24 aa, Mycobacterium tuberculosis
RWVRIKRIVTVYIMTANLTGIVVA

SEQ ID NO: 1374605 - protein, 36 aa, Mycobacterium tuberculosis; identical to SEQ ID NO: 158900

SEQ ID NO: 1374606 - protein, 22 aa, Mycobacterium tuberculosis
SAITGGVGWWYILVATGFVVFA

SEQ ID NO: 1374607 - protein, 26 aa, Mycobacterium tuberculosis
SALMWQWREHRGPQMVAGLSIGLTTA

SEQ ID NO: 1374608 - protein, 21 aa, Mycobacterium tuberculosis
SAMNRFKRDYLAAYISASSDP

SEQ ID NO: 1374609 - protein, 18 aa, Mycobacterium tuberculosis
SAPPQWFAGLVVVFTAAV

SEQ ID NO: 1374610 - protein, 24 aa, Mycobacterium tuberculosis
SAPRLRLAKRSLFDPMIVRSALPQ

SEQ ID NO: 1374611 - protein, 18 aa, Mycobacterium tuberculosis
SATFLLRQQRIWGASTVV

SEQ ID NO: 1374612 - protein, 21 aa, Mycobacterium tuberculosis
SEGWWPTLIGLAMNDSGGYNA

SEQ ID NO: 1374613 - protein, 24 aa, Mycobacterium tuberculosis
SENECARWSLGETVTLRGHDQPIR

SEQ ID NO: 1374614 - protein, 23 aa, Mycobacterium tuberculosis
SGKSEFLRTLILSLVAMTHPDQV

SEQ ID NO: 1374615 - protein, 21 aa, Mycobacterium tuberculosis
SGLWLGIAGWSLWAANSPGMG

SEQ ID NO: 1374616 - protein, 25 aa, Mycobacterium tuberculosis
SGPLADRSRRFWAWTIAGYTLTVVT

SEQ ID NO: 1374617 - protein, 19 aa, Mycobacterium tuberculosis
SHHYGLVLAGAYPMYLDAY

SEQ ID NO: 1374618 - protein, 18 aa, Mycobacterium tuberculosis
SIVAALFVFSLWIATLGF

SEQ ID NO: 1374619 - protein, 20 aa, Mycobacterium tuberculosis
SIYTDAPWWVTFGVAPAYAT

SEQ ID NO: 1374620 - protein, 21 aa, Mycobacterium tuberculosis
SKLMQCVADGPGYAGSSPTLG

SEQ ID NO: 1374621 - protein, 21 aa, Mycobacterium tuberculosis
SKSRVALYLLITIAPFAVIAP

SEQ ID NO: 1374622 - protein, 20 aa, Mycobacterium tuberculosis
SKWPVGWVVVLLYAVCVVLR

SEQ ID NO: 1374623 - protein, 25 aa, Mycobacterium tuberculosis
SLANLLRYGYYPALILGLTVGVILL

SEQ ID NO: 1374624 - protein, 24 aa, Mycobacterium tuberculosis
SLCAAQLVGLGIMRYGVRSEPLHS

SEQ ID NO: 1374625 - protein, 27 aa, Mycobacterium tuberculosis
SLEDIIRFQAEFLWRDYFQPGVSIDGE

SEQ ID NO: 1374626 - protein, 18 aa, Mycobacterium tuberculosis
SLTMAFAITEPDAGSNSH

SEQ ID NO: 1374627 - protein, 19 aa, Mycobacterium tuberculosis
SMFPFVWNVFKSWRYGEVV

SEQ ID NO: 1374628 - protein, 22 aa, Mycobacterium tuberculosis
SMRKFFEAFAPYGLKQTAVKPS

SEQ ID NO: 1374629 - protein, 20 aa, Mycobacterium tuberculosis
SNVIPTAFKWVARVTPSGAL

SEQ ID NO: 1374630 - protein, 19 aa, Mycobacterium tuberculosis
SPPSIRWAAGRDQRGAASA

SEQ ID NO: 1374631 - protein, 18 aa, Mycobacterium tuberculosis
SQIWPIDRPGLLFDDMDD

SEQ ID NO: 1374632 - protein, 20 aa, Mycobacterium tuberculosis
SQTLRLSYMALFSVPVVAPL

SEQ ID NO: 1374633 - protein, 20 aa, Mycobacterium tuberculosis
SRLDVPALWAPRRRDEELRV

SEQ ID NO: 1374634 - protein, 18 aa, Mycobacterium tuberculosis
SRMARAALAIAPVVVHAM

SEQ ID NO: 1374635 - protein, 20 aa, Mycobacterium tuberculosis
SRPAAEVVMLLNRFFTVIVD

SEQ ID NO: 1374636 - protein, 17 aa, Mycobacterium tuberculosis
SRRGRRLAPELAGVWTA

SEQ ID NO: 1374637 - protein, 20 aa, Mycobacterium tuberculosis
SRRLEIRLTTLLGAGFGLGI

SEQ ID NO: 1374638 - protein, 18 aa, Mycobacterium tuberculosis
SRSWCGRAGTATIAAVLL

SEQ ID NO: 1374639 - protein, 24 aa, Mycobacterium tuberculosis
SRTLPELWSLLGHIDAVHGLYYLL

SEQ ID NO: 1374640 - protein, 25 aa, Mycobacterium tuberculosis
SSVDAFRALQNWVPLVAAAGSMIIV

SEQ ID NO: 1374641 - protein, 25 aa, Mycobacterium tuberculosis
SVRSAAALWWIPAWLAMIVEVAVLG

SEQ ID NO: 1374642 - protein, 20 aa, Mycobacterium tuberculosis
TADPPVRRSVHHGAGQRYAG

SEQ ID NO: 1374643 - protein, 21 aa, Mycobacterium tuberculosis
TAGLLIGRAIIRSNYYVADYA

SEQ ID NO: 1374644 - protein, 18 aa, Mycobacterium tuberculosis
TAIRRWGRYATANGALAA

SEQ ID NO: 1374645 - protein, 18 aa, Mycobacterium tuberculosis
TAVALGIGAGIGAIFAAP

SEQ ID NO: 1374646 - protein, 27 aa, Mycobacterium tuberculosis
TDDQKKRWLPGIADGSLTMAFAITEPD

SEQ ID NO: 1374647 - protein, 21 aa, Mycobacterium tuberculosis
TDHRGRVRIGTVLLSPAEPDG

SEQ ID NO: 1374648 - protein, 21 aa, Mycobacterium tuberculosis
TEFALRPFAAQALEAGPPPRR

SEQ ID NO: 1374649 - protein, 25 aa, Mycobacterium tuberculosis
TELQADCYAGVWAYYASTVKQESTG

SEQ ID NO: 1374650 - protein, 24 aa, Mycobacterium tuberculosis
TELWSRLPSCLAIGAAAAGVVVFA

SEQ ID NO: 1374651 - protein, 22 aa, Mycobacterium tuberculosis
TENRLRVVCALPSSTAAERDPL

SEQ ID NO: 1374652 - protein, 24 aa, Mycobacterium tuberculosis
TESPIPRWLRFVLTSDRAGSAWYI

SEQ ID NO: 1374653 - protein, 22 aa, Mycobacterium tuberculosis
TETIRLAEIVKIYPEADGRETS

SEQ ID NO: 1374654 - protein, 23 aa, Mycobacterium tuberculosis
TFLTREMPAWLQANKGVSPTGNA

SEQ ID NO: 1374655 - protein, 17 aa, Mycobacterium tuberculosis
TGGICWAGGTTALVYFA

SEQ ID NO: 1374656 - protein, 20 aa, Mycobacterium tuberculosis
TGIAGWMFGWLADRSGSLAA

SEQ ID NO: 1374657 - protein, 21 aa, Mycobacterium tuberculosis
TGIGIAWPHLTVRAMDSVADP

SEQ ID NO: 1374658 - protein, 19 aa, Mycobacterium tuberculosis
TGLPLPVVLVPPMALSRIL

SEQ ID NO: 1374659 - protein, 34 aa, Mycobacterium tuberculosis; identical to SEQ ID NO: 160170

SEQ ID NO: 1374660 - protein, 25 aa, Mycobacterium tuberculosis
TIRSPRSGIALSIAALVPIGAALAL

SEQ ID NO: 1374661 - protein, 18 aa, Mycobacterium tuberculosis
TKIARSMVTEFGMSSKLG

SEQ ID NO: 1374662 - protein, 26 aa, Mycobacterium tuberculosis
TMGLWPPRLWAGLRLGWAAGAAAATA

SEQ ID NO: 1374663 - protein, 26 aa, Mycobacterium tuberculosis
TMLSVPRWAVGPVMELGTDHRRIEGL

SEQ ID NO: 1374664 - protein, 18 aa, Mycobacterium tuberculosis
TNVLRARRAQQMIVGVAL

SEQ ID NO: 1374665 - protein, 30 aa, Mycobacterium tuberculosis; identical to SEQ ID NO: 159225

SEQ ID NO: 1374666 - protein, 17 aa, Mycobacterium tuberculosis
TQACPAVHVLVVDDSSP

SEQ ID NO: 1374667 - protein, 17 aa, Mycobacterium tuberculosis
TQIPAPVILVVATTVVF

SEQ ID NO: 1374668 - protein, 23 aa, Mycobacterium tuberculosis
TQTELFPLAMLSVGGMMVFPASN

SEQ ID NO: 1374669 - protein, 19 aa, Mycobacterium tuberculosis
TRIVVCLVAGVVVGGIVFG

SEQ ID NO: 1374670 - protein, 23 aa, Mycobacterium tuberculosis
TRVQRIYCRLVLRLFGVRITVSG

SEQ ID NO: 1374671 - protein, 30 aa, Mycobacterium tuberculosis; identical to SEQ ID NO: 159250

SEQ ID NO: 1374672 - protein, 26 aa, Mycobacterium tuberculosis
TTCALFPGIFGLFAVVVRLLPGWPIW

SEQ ID NO: 1374673 - protein, 30 aa, Mycobacterium tuberculosis; identical to SEQ ID NO: 159262

SEQ ID NO: 1374674 - protein, 17 aa, Mycobacterium tuberculosis
TVACKAIAEATRVGKRF

SEQ ID NO: 1374675 - protein, 26 aa, Mycobacterium tuberculosis
TVPLVRWTAHWPRRRALVVSLVCLTV

SEQ ID NO: 1374676 - protein, 18 aa, Mycobacterium tuberculosis
VAALSAWGLYRFNQILAG

SEQ ID NO: 1374677 - protein, 29 aa, Mycobacterium tuberculosis
VAPKRPSRWRHVPAILLVLSLLLFTIAMA

SEQ ID NO: 1374678 - protein, 33 aa, Mycobacterium tuberculosis; identical to SEQ ID NO: 159336

SEQ ID NO: 1374679 - protein, 19 aa, Mycobacterium tuberculosis
VARRLARTFPYGTLTVNIT

SEQ ID NO: 1374680 - protein, 26 aa, Mycobacterium tuberculosis
VAVALVLWWRMIRFEYALLVTVATAA

SEQ ID NO: 1374681 - protein, 28 aa, Mycobacterium tuberculosis
VAVGQQCARRALPFVAAMAKLLVAAVAG

SEQ ID NO: 1374682 - protein, 25 aa, Mycobacterium tuberculosis
VAVLCARGLVAQGLMFINQAAVSAV

SEQ ID NO: 1374683 - protein, 19 aa, Mycobacterium tuberculosis
VAVYAWIRPLPDDWSQLPK

SEQ ID NO: 1374684 - protein, 26 aa, Mycobacterium tuberculosis
VDNTAGWRPGPIRALLATRPAAFRSL

SEQ ID NO: 1374685 - protein, 20 aa, Mycobacterium tuberculosis
VDPVAALTWDVPKGPAEPPK

SEQ ID NO: 1374686 - protein, 24 aa, Mycobacterium tuberculosis
VDQWGWRSIFYVNLPMGALVLFLT

SEQ ID NO: 1374687 - protein, 27 aa, Mycobacterium tuberculosis
VEKRSEQRLGFTARRAAILAAVVCVLT

SEQ ID NO: 1374688 - protein, 20 aa, Mycobacterium tuberculosis
VEWDTLLFFAGLFIMVGALV

SEQ ID NO: 1374689 - protein, 26 aa, Mycobacterium tuberculosis
VFNFPPNGTHSWPYWNEQLVAMKADI

SEQ ID NO: 1374690 - protein, 17 aa, Mycobacterium tuberculosis
VFRGFTFGIDFKGGTTV

SEQ ID NO: 1374691 - protein, 21 aa, Mycobacterium tuberculosis
VGALADWFAVTALFKHPLGIP

SEQ ID NO: 1374692 - protein, 20 aa, Mycobacterium tuberculosis
VGALFGRTALMLAALFAVGM

SEQ ID NO: 1374693 - protein, 18 aa, Mycobacterium tuberculosis
VGEVLAIVTAVAGALDYA

SEQ ID NO: 1374694 - protein, 33 aa, Mycobacterium tuberculosis; identical to SEQ ID NO: 159404

SEQ ID NO: 1374695 - protein, 17 aa, Mycobacterium tuberculosis
VGLCVVGVVALALVVAK

SEQ ID NO: 1374696 - protein, 19 aa, Mycobacterium tuberculosis
VGVATCWEVIFDRAPRKSI

SEQ ID NO: 1374697 - protein, 18 aa, Mycobacterium tuberculosis
VGVLVYLFVVDWRVALVL

SEQ ID NO: 1374698 - protein, 25 aa, Mycobacterium tuberculosis
VHYLLDVLRRVAIDLDRSQKAASGA

SEQ ID NO: 1374699 - protein, 24 aa, Mycobacterium tuberculosis
VIAEVWKTTPFMSLLLLAGLALVP

SEQ ID NO: 1374700 - protein, 22 aa, Mycobacterium tuberculosis
VIASVCRRHFWAAHPHGPTVLT

SEQ ID NO: 1374701 - protein, 22 aa, Mycobacterium tuberculosis
VIDEFYEWFRIMPTAVDVLDSI

SEQ ID NO: 1374702 - protein, 24 aa, Mycobacterium tuberculosis
VIGLGCGFGPLNNRFFPPMGSILY

SEQ ID NO: 1374703 - protein, 18 aa, Mycobacterium tuberculosis
VILPPFVYFITYRWCIGL

SEQ ID NO: 1374704 - protein, 20 aa, Mycobacterium tuberculosis
VLAILAWRALDRSDRLGKLL

SEQ ID NO: 1374705 - protein, 24 aa, Mycobacterium tuberculosis
VLALSFASVNGWWYVSNFGVPWSN

SEQ ID NO: 1374706 - protein, 26 aa, Mycobacterium tuberculosis
VLDRLRARFGWLDHVVRAFTRFNDRN

SEQ ID NO: 1374707 - protein, 28 aa, Mycobacterium tuberculosis
VLGAVARRFALSPIPVYLLAGLSLGNGG

SEQ ID NO: 1374708 - protein, 17 aa, Mycobacterium tuberculosis
VLLLAGFGWMISSRMVR

SEQ ID NO: 1374709 - protein, 21 aa, Mycobacterium tuberculosis
VLVFVPRVWVAIVAVATLVAT

SEQ ID NO: 1374710 - protein, 18 aa, Mycobacterium tuberculosis
VNGKIRFPANTNLVRHVE

SEQ ID NO: 1374711 - protein, 20 aa, Mycobacterium tuberculosis
VPLFCSFGAMLVYPENGSGW

SEQ ID NO: 1374712 - protein, 22 aa, Mycobacterium tuberculosis
VPLGGFCDIAGMTPVEELDPDE

SEQ ID NO: 1374713 - protein, 18 aa, Mycobacterium tuberculosis
VRDLMGVEHLRWYDYPLA

SEQ ID NO: 1374714 - protein, 20 aa, Mycobacterium tuberculosis
VRPYGYDQTARWVPRLWRRD

SEQ ID NO: 1374715 - protein, 24 aa, Mycobacterium tuberculosis
VRQRTWGWALAVVVIVLALAAIAI

SEQ ID NO: 1374716 - protein, 19 aa, Mycobacterium tuberculosis
VSATVFLAVWVPLFCSFGA

SEQ ID NO: 1374717 - protein, 19 aa, Mycobacterium tuberculosis
VSGLARVVAFLGAVLVLAK

SEQ ID NO: 1374718 - protein, 19 aa, Mycobacterium tuberculosis
VSMLSKWPVGWVVVLLYAV

SEQ ID NO: 1374719 - protein, 26 aa, Mycobacterium tuberculosis
VSPGTRWPQPTPWAGGAPPWGPPSSP

SEQ ID NO: 1374720 - protein, 21 aa, Mycobacterium tuberculosis
VSVESVTLWLFGGVTALGGEA

SEQ ID NO: 1374721 - protein, 18 aa, Mycobacterium tuberculosis
VSWSHHWVWMLPAVLVIG

SEQ ID NO: 1374722 - protein, 26 aa, Mycobacterium tuberculosis
VSYMRYPVFLGFDIVGGVAWGAGVTL

SEQ ID NO: 1374723 - protein, 24 aa, Mycobacterium tuberculosis
VTAGMPVIEWLYARQLRRVVAPQS

SEQ ID NO: 1374724 - protein, 17 aa, Mycobacterium tuberculosis
VTGKALQEFGRYQSVVY

SEQ ID NO: 1374725 - protein, 19 aa, Mycobacterium tuberculosis
VTMGVAWSVLYIPVGGVGT

SEQ ID NO: 1374726 - protein, 24 aa, Mycobacterium tuberculosis
VTSNQLVAWVCIGASVLGVALLIV

SEQ ID NO: 1374727 - protein, 17 aa, Mycobacterium tuberculosis
VVAELIDELGWPMLCLM

SEQ ID NO: 1374728 - protein, 18 aa, Mycobacterium tuberculosis
VVFPLGMYGVGAYRLGLA

SEQ ID NO: 1374729 - protein, 19 aa, Mycobacterium tuberculosis
VVTPAWYAPLVLSVGGIGQ

SEQ ID NO: 1374730 - protein, 29 aa, Mycobacterium tuberculosis
VVVRLLPGWPIWFAVGWAAQEWLKSILPF

SEQ ID NO: 1374731 - protein, 23 aa, Mycobacterium tuberculosis
VYFITYRWCIGLQRSDRSVLEHG

SEQ ID NO: 1374732 - protein, 24 aa, Mycobacterium tuberculosis
VYKVCKGLEKIPLLGHLWSWELAI

SEQ ID NO: 1374733 - protein, 24 aa, Mycobacterium tuberculosis
VYLGLRVGLTFATSIPAAVISMGV

SEQ ID NO: 1374734 - protein, 21 aa, Mycobacterium tuberculosis
WAISELDLAPVYLNFAENSHL

SEQ ID NO: 1374735 - protein, 21 aa, Mycobacterium tuberculosis
WARQRTAMIAAERLEQMLSTA

SEQ ID NO: 1374736 - protein, 25 aa, Mycobacterium tuberculosis
WCMQGLPSPYLTIAFPNRPPQYEEY

SEQ ID NO: 1374737 - protein, 17 aa, Mycobacterium tuberculosis
WDGPAWSISAEWLAYLL

SEQ ID NO: 1374738 - protein, 28 aa, Mycobacterium tuberculosis
WEKHCFDVPLCWSIRSIFDMFDSVDQLS

SEQ ID NO: 1374739 - protein, 22 aa, Mycobacterium tuberculosis
WETIGRPIARRNLIFSIFAEHV

SEQ ID NO: 1374740 - protein, 18 aa, Mycobacterium tuberculosis
WFICGPLAMATAVRETLI

SEQ ID NO: 1374741 - protein, 26 aa, Mycobacterium tuberculosis
WHKEYGSACNLVFPIGIIDRPYKHDQ

SEQ ID NO: 1374742 - protein, 23 aa, Mycobacterium tuberculosis
WIRELRPHIDLYLLTDESIAAET

SEQ ID NO: 1374743 - protein, 26 aa, Mycobacterium tuberculosis
WITTRIVRASIRWAIEERAPSQADGR

SEQ ID NO: 1374744 - protein, 19 aa, Mycobacterium tuberculosis
WKRVAVLFAGPGMNLAICL

SEQ ID NO: 1374745 - protein, 26 aa, Mycobacterium tuberculosis
WLFVRHEHRAAFPLVDLKLFAEPLYR

SEQ ID NO: 1374746 - protein, 17 aa, Mycobacterium tuberculosis
WLIEPRWAMVSLCLVSV

SEQ ID NO: 1374747 - protein, 18 aa, Mycobacterium tuberculosis
WPTSRLVPAPARLRRLWL

SEQ ID NO: 1374748 - protein, 22 aa, Mycobacterium tuberculosis
WQHILGIELHWLVLAMAVIILL

SEQ ID NO: 1374749 - protein, 21 aa, Mycobacterium tuberculosis
WRGEIGDWILNRGLRIVMLLI

SEQ ID NO: 1374750 - protein, 18 aa, Mycobacterium tuberculosis
WRPALTALTLGAGIIALG

SEQ ID NO: 1374751 - protein, 18 aa, Mycobacterium tuberculosis
WRVARNAGITDVRAALLP

SEQ ID NO: 1374752 - protein, 25 aa, Mycobacterium tuberculosis
WSTLKVSLLLSVALFFVWMITVAFL

SEQ ID NO: 1374753 - protein, 35 aa, Mycobacterium tuberculosis; identical to SEQ ID NO: 159763

SEQ ID NO: 1374754 - protein, 17 aa, Mycobacterium tuberculosis
WVFLFPASILVLILVCA

SEQ ID NO: 1374755 - protein, 24 aa, Mycobacterium tuberculosis
WVSLYRAKWWWLLAAVAAAGASMH

SEQ ID NO: 1374756 - protein, 17 aa, Mycobacterium tuberculosis
YAIHKLGFCSVVMLGIN

SEQ ID NO: 1374757 - protein, 17 aa, Mycobacterium tuberculosis
YFIGRRIGPALFKKEDS

SEQ ID NO: 1374758 - protein, 26 aa, Mycobacterium tuberculosis
YFQTLGIPCAVGMLVAVAVALTLGPA

SEQ ID NO: 1374759 - protein, 19 aa, Mycobacterium tuberculosis
YGAPAGWHAPGWPPRSSHR

SEQ ID NO: 1374760 - protein, 17 aa, Mycobacterium tuberculosis
YHLLPLVAGIVLGTLLM

SEQ ID NO: 1374761 - protein, 18 aa, Mycobacterium tuberculosis
YLAGFAWGLSREYSVLVE

SEQ ID NO: 1374762 - protein, 18 aa, Mycobacterium tuberculosis
YLPPEAFDNPDFQRGLKL

SEQ ID NO: 1374763 - protein, 18 aa, Mycobacterium tuberculosis
YLTAPRPGGAMAPASTSS

SEQ ID NO: 1374764 - protein, 24 aa, Mycobacterium tuberculosis
YLWAFELTSALLITAAVGAMVLAH

SEQ ID NO: 1374765 - protein, 25 aa, Mycobacterium tuberculosis
YMEMLNLNEAWQFGRGDGVKVAVID

SEQ ID NO: 1374766 - protein, 31 aa, Mycobacterium tuberculosis; identical to SEQ ID NO: 159821

SEQ ID NO: 1374767 - protein, 23 aa, Mycobacterium tuberculosis
YQRERRFAVAFVIPAAVLFVAGA

SEQ ID NO: 1374768 - protein, 21 aa, Mycobacterium tuberculosis
YRNPVTMLLPLVTIGASLMTA

SEQ ID NO: 1374769 - protein, 24 aa, Mycobacterium tuberculosis
YRTIELLECLALIAMVPLTAWLCG

SEQ ID NO: 1374770 - protein, 23 aa, Mycobacterium tuberculosis
YSVIGFLCAFAPNFTVLVILRLL

SEQ ID NO: 1374771 - protein, 24 aa, Mycobacterium tuberculosis
YVCLRMSVRFMRRIAFSGFAITIV

SEQ ID NO: 1374772 - protein, 18 aa, Mycobacterium tuberculosis
AAAIGARYQQAFALMYGE

SEQ ID NO: 1374773 - protein, 21 aa, Mycobacterium tuberculosis
AAAKRSALVHWSRRPASTQSW

SEQ ID NO: 1374774 - protein, 18 aa, Mycobacterium tuberculosis
AADGDWPPDEDFGSEHFG

SEQ ID NO: 1374775 - protein, 18 aa, Mycobacterium tuberculosis
AAGNGWRVSGLLRIDEVA

SEQ ID NO: 1374776 - protein, 25 aa, Mycobacterium tuberculosis
AAGNLRAAIELPLAATIGLAALGGM

SEQ ID NO: 1374777 - protein, 27 aa, Mycobacterium tuberculosis
AAISGWRAGALGSMLSFGGVLLGATAG

SEQ ID NO: 1374778 - protein, 19 aa, Mycobacterium tuberculosis
AAPAKRSLLRTAVIVPAVL

SEQ ID NO: 1374779 - protein, 25 aa, Mycobacterium tuberculosis
AAQHWLERFSWIALVIAVIAGITAA

SEQ ID NO: 1374780 - protein, 22 aa, Mycobacterium tuberculosis
AASYRWGHHVGRLVTHPDSEQL

SEQ ID NO: 1374781 - protein, 21 aa, Mycobacterium tuberculosis
AAVGCALFVWLERRSSNPMMD

SEQ ID NO: 1374782 - protein, 25 aa, Mycobacterium tuberculosis
AAVVCVLTLTIARPVRTYFAQRAEM

SEQ ID NO: 1374783 - protein, 25 aa, Mycobacterium tuberculosis
AAVVLACTLVGFAVAVLGDPVMLRA

SEQ ID NO: 1374784 - protein, 20 aa, Mycobacterium tuberculosis
ACSIGATLGNGGWATLVNSA

SEQ ID NO: 1374785 - protein, 20 aa, Mycobacterium tuberculosis
ACYKVSRPIDETSLGASIDY

SEQ ID NO: 1374786 - protein, 22 aa, Mycobacterium tuberculosis
ADAARGPIAFDALREPDRESSA

SEQ ID NO: 1374787 - protein, 21 aa, Mycobacterium tuberculosis
ADLSFLPALALIFLNCVWVSL

SEQ ID NO: 1374788 - protein, 21 aa, Mycobacterium tuberculosis
ADPSYRHVRESMFSSDGTATR

SEQ ID NO: 1374789 - protein, 22 aa, Mycobacterium tuberculosis
ADVGAAPAWRNLRAPLSAIPST

SEQ ID NO: 1374790 - protein, 18 aa, Mycobacterium tuberculosis
ADVKPVWQSLRHADTWIM

SEQ ID NO: 1374791 - protein, 18 aa, Mycobacterium tuberculosis
ADYARMWIQAATTMSIYE

SEQ ID NO: 1374792 - protein, 22 aa, Mycobacterium tuberculosis
ADYPTVLLSGAWLSQEQTSAAS

SEQ ID NO: 1374793 - protein, 25 aa, Mycobacterium tuberculosis
AEAEPAAWLRFWFPDPNGSNTEFQR

SEQ ID NO: 1374794 - protein, 17 aa, Mycobacterium tuberculosis
AEFVAGGLVGGVWLAFI

SEQ ID NO: 1374795 - protein, 19 aa, Mycobacterium tuberculosis
AEPLYRSVLIVYFVVMSCF

SEQ ID NO: 1374796 - protein, 24 aa, Mycobacterium tuberculosis
AEQPLPGPRWPRALRASATRRALL

SEQ ID NO: 1374797 - protein, 18 aa, Mycobacterium tuberculosis
AFDNGWFRTGDIGEIDDE

SEQ ID NO: 1374798 - protein, 19 aa, Mycobacterium tuberculosis
AGAQLLWQLPLLSIGCGLI

SEQ ID NO: 1374799 - protein, 23 aa, Mycobacterium tuberculosis
AGNGGPPVTRRAVLTLYPHCAPK

SEQ ID NO: 1374800 - protein, 23 aa, Mycobacterium tuberculosis
AGPLPYIVMEYVDGVTLRDIVHT

SEQ ID NO: 1374801 - protein, 17 aa, Mycobacterium tuberculosis
AHGGRYHGIWSMAVAAS

SEQ ID NO: 1374802 - protein, 26 aa, Mycobacterium tuberculosis
AIAIRVDWPRFWALITTPSSQTALLL

SEQ ID NO: 1374803 - protein, 23 aa, Mycobacterium tuberculosis
AIDPSAAINMAWRAAGGAAGPLG

SEQ ID NO: 1374804 - protein, 18 aa, Mycobacterium tuberculosis
AIGLGAALLIAALLLSTY

SEQ ID NO: 1374805 - protein, 29 aa, Mycobacterium tuberculosis
AILQRMSPFWQRMFLTIGILIAVFGMRLV

SEQ ID NO: 1374806 - protein, 18 aa, Mycobacterium tuberculosis
AIPVIGPPLAALVEPNLE

SEQ ID NO: 1374807 - protein, 17 aa, Mycobacterium tuberculosis
AISSARLAARYPASGGT

SEQ ID NO: 1374808 - protein, 22 aa, Mycobacterium tuberculosis
AKALGGWAGFSVGWLYWYFWVI

SEQ ID NO: 1374809 - protein, 23 aa, Mycobacterium tuberculosis
AKHPRLRVRWVMRRDEKSLAEAI

SEQ ID NO: 1374810 - protein, 19 aa, Mycobacterium tuberculosis
AKLAADMQVFARVSPEQKV

SEQ ID NO: 1374811 - protein, 18 aa, Mycobacterium tuberculosis
ALAVSRWPAVTVAAGVLL

SEQ ID NO: 1374812 - protein, 19 aa, Mycobacterium tuberculosis
ALDDPRGATPWTADLITGT

SEQ ID NO: 1374813 - protein, 20 aa, Mycobacterium tuberculosis
ALFALWPFTRLVHAFSAPIA

SEQ ID NO: 1374814 - protein, 18 aa, Mycobacterium tuberculosis
ALGGLMVDGLGWRSVFLV

SEQ ID NO: 1374815 - protein, 25 aa, Mycobacterium tuberculosis
ALGQMAVFALGGWMAAQGSITVGTF

SEQ ID NO: 1374816 - protein, 19 aa, Mycobacterium tuberculosis
ALLANMLPASIAERLKEPE

SEQ ID NO: 1374817 - protein, 17 aa, Mycobacterium tuberculosis
ALLERMAPLGPRSRALV

SEQ ID NO: 1374818 - protein, 23 aa, Mycobacterium tuberculosis
ALLIKPLLAHAAIAFIAVEAVLG

SEQ ID NO: 1374819 - protein, 20 aa, Mycobacterium tuberculosis
ALLRRASLRQAVADGVAIAV

SEQ ID NO: 1374820 - protein, 24 aa, Mycobacterium tuberculosis
ALRNGLRTHVGFVRSGMAPRLVSD

SEQ ID NO: 1374821 - protein, 22 aa, Mycobacterium tuberculosis
ALVAVGIGLRLVFGEMSLTAGL

SEQ ID NO: 1374822 - protein, 18 aa, Mycobacterium tuberculosis
ALVLELLATLGVALVAVG

SEQ ID NO: 1374823 - protein, 19 aa, Mycobacterium tuberculosis
AMLVAAAWLALLGLPLLLV

SEQ ID NO: 1374824 - protein, 21 aa, Mycobacterium tuberculosis
ANILREFKEPKREALLTLLPL

SEQ ID NO: 1374825 - protein, 24 aa, Mycobacterium tuberculosis
APARLDNARFLLPVVGVPPDQATD

SEQ ID NO: 1374826 - protein, 27 aa, Mycobacterium tuberculosis
APPVRRLPARFGVEQVRELASRDTRQG

SEQ ID NO: 1374827 - protein, 17 aa, Mycobacterium tuberculosis
APSCMRIDYELITQNHR

SEQ ID NO: 1374828 - protein, 18 aa, Mycobacterium tuberculosis
AQGLRVLLLAAGSVAVDH

SEQ ID NO: 1374829 - protein, 24 aa, Mycobacterium tuberculosis
AQLRVARLNAHFGPLLQTLPALGQ

SEQ ID NO: 1374830 - protein, 17 aa, Mycobacterium tuberculosis
AQPPFRLSNYVTDNAGV

SEQ ID NO: 1374831 - protein, 25 aa, Mycobacterium tuberculosis
AQTRLRSGSPILFYPAGALAITVLA

SEQ ID NO: 1374832 - protein, 21 aa, Mycobacterium tuberculosis
ARADLGMAIGRGTDVAIGAAD

SEQ ID NO: 1374833 - protein, 20 aa, Mycobacterium tuberculosis
ARARRYATAYLDLHYETESA

SEQ ID NO: 1374834 - protein, 17 aa, Mycobacterium tuberculosis
ARGPAWRLMGVIFGTMF

SEQ ID NO: 1374835 - protein, 17 aa, Mycobacterium tuberculosis
ARPMAAVLRWLEIPQFS

SEQ ID NO: 1374836 - protein, 19 aa, Mycobacterium tuberculosis
ARSRALRMPLYRTLISLAV

SEQ ID NO: 1374837 - protein, 23 aa, Mycobacterium tuberculosis
ARVFHASVAITRRLPGGPVLKPA

SEQ ID NO: 1374838 - protein, 18 aa, Mycobacterium tuberculosis
ARVIPRVGVASVIAEGFL

SEQ ID NO: 1374839 - protein, 24 aa, Mycobacterium tuberculosis
ASEEERARWSLGRHVKLRGHDQPV

SEQ ID NO: 1374840 - protein, 18 aa, Mycobacterium tuberculosis
ASEMPECQAGIGVAAGQV

SEQ ID NO: 1374841 - protein, 18 aa, Mycobacterium tuberculosis
ASGFSRFPVVEGDLDATV

SEQ ID NO: 1374842 - protein, 26 aa, Mycobacterium tuberculosis
ASGSFMLCAAFNVLLRGLCGRDTAPA

SEQ ID NO: 1374843 - protein, 18 aa, Mycobacterium tuberculosis
ASIAWGVLASFFVSTLLR

SEQ ID NO: 1374844 - protein, 19 aa, Mycobacterium tuberculosis
ASISMSGYPVMLRDIRDYY

SEQ ID NO: 1374845 - protein, 24 aa, Mycobacterium tuberculosis
ASLLAGRAVNKWGPQLPVLTCLAA

SEQ ID NO: 1374846 - protein, 23 aa, Mycobacterium tuberculosis
ASRPELIEGIGRRVLSWANSVRG

SEQ ID NO: 1374847 - protein, 18 aa, Mycobacterium tuberculosis
ASVVFWAFGPWLIPPLVA

SEQ ID NO: 1374848 - protein, 25 aa, Mycobacterium tuberculosis
ATGRGRWALCLVDGAPLRATQSLTE

SEQ ID NO: 1374849 - protein, 17 aa, Mycobacterium tuberculosis
ATKVWSLIVEERVCIGG

SEQ ID NO: 1374850 - protein, 18 aa, Mycobacterium tuberculosis
ATLWSVVFPLGMYGVGAY

SEQ ID NO: 1374851 - protein, 27 aa, Mycobacterium tuberculosis
ATREAYRIGGDWVQYRSYPGIGTKQPR

SEQ ID NO: 1374852 - protein, 27 aa, Mycobacterium tuberculosis
ATVFTVAQWRWRWFRAAMCKTMAVAVI

SEQ ID NO: 1374853 - protein, 23 aa, Mycobacterium tuberculosis
ATVVIRWVVQWGSAMVAGYTGEQ

SEQ ID NO: 1374854 - protein, 18 aa, Mycobacterium tuberculosis
AVAAGRIRSLLSTRTPSS

SEQ ID NO: 1374855 - protein, 29 aa, Mycobacterium tuberculosis
AVAPETTAPVWITMLWPLADRPRLAPGAP

SEQ ID NO: 1374856 - protein, 31 aa, Mycobacterium tuberculosis; identical to SEQ ID NO: 156349

SEQ ID NO: 1374857 - protein, 18 aa, Mycobacterium tuberculosis
AVCGIRVVKAFGQEERET

SEQ ID NO: 1374858 - protein, 24 aa, Mycobacterium tuberculosis
AVGAICIAGAWLYTGGSKPYGYAG

SEQ ID NO: 1374859 - protein, 20 aa, Mycobacterium tuberculosis
AVLGFFGFYLSFVAELPPPP

SEQ ID NO: 1374860 - protein, 17 aa, Mycobacterium tuberculosis
AVLTSPIGFLQRPARWI

SEQ ID NO: 1374861 - protein, 27 aa, Mycobacterium tuberculosis
AVLVGELLCFVGMLIGIPVAALIHVYT

SEQ ID NO: 1374862 - protein, 23 aa, Mycobacterium tuberculosis
AVLVTLAGRRLWHRFRGQPDRAD

SEQ ID NO: 1374863 - protein, 27 aa, Mycobacterium tuberculosis
AVVVMVAGVILWRFFGDALSNRSHTAA

SEQ ID NO: 1374864 - protein, 19 aa, Mycobacterium tuberculosis
AWGVLVGFIALYLLGSLAG

SEQ ID NO: 1374865 - protein, 27 aa, Mycobacterium tuberculosis
AYSWYLWHWPLLIFWLSYTGHRHANFV

SEQ ID NO: 1374866 - protein, 20 aa, Mycobacterium tuberculosis
CAAAMGALLLANRGGERDSR

SEQ ID NO: 1374867 - protein, 18 aa, Mycobacterium tuberculosis
CASAEWRAAGAAGTAAAL

SEQ ID NO: 1374868 - protein, 25 aa, Mycobacterium tuberculosis
CDAAGVPYRTQWDAGAVVLELYEHL

SEQ ID NO: 1374869 - protein, 20 aa, Mycobacterium tuberculosis
CDTALLVRRAWAIPSVALGW

SEQ ID NO: 1374870 - protein, 18 aa, Mycobacterium tuberculosis
CIGASVLGVALLIVDALR

SEQ ID NO: 1374871 - protein, 22 aa, Mycobacterium tuberculosis
CLGLWQKIVFGRRVAETVIADP

SEQ ID NO: 1374872 - protein, 24 aa, Mycobacterium tuberculosis
DADSHLLGVIAFRALVLANPEQRV

SEQ ID NO: 1374873 - protein, 18 aa, Mycobacterium tuberculosis
DAGLPKWRETLMQLESVS

SEQ ID NO: 1374874 - protein, 20 aa, Mycobacterium tuberculosis
DALGAMLWRSLEPNAAPRTQ

SEQ ID NO: 1374875 - protein, 20 aa, Mycobacterium tuberculosis
DAPLWLASLCLMMMMTATNL

SEQ ID NO: 1374876 - protein, 21 aa, Mycobacterium tuberculosis
DCPGCGSLRIQCSLIHADLLA

SEQ ID NO: 1374877 - protein, 17 aa, Mycobacterium tuberculosis
DDFAYLVDFGIASATTD

SEQ ID NO: 1374878 - protein, 25 aa, Mycobacterium tuberculosis
DEGRPRRLIPLVGLIGCVVLAFALP

SEQ ID NO: 1374879 - protein, 21 aa, Mycobacterium tuberculosis
DEMEAVIALAFFIPLLIGTGG

SEQ ID NO: 1374880 - protein, 22 aa, Mycobacterium tuberculosis
DIREGARYDLLIAGVAAISLIL

SEQ ID NO: 1374881 - protein, 24 aa, Mycobacterium tuberculosis
DIREHPSTCWWWERTAGENRARVR

SEQ ID NO: 1374882 - protein, 17 aa, Mycobacterium tuberculosis
DKNTAYRIGLKVASPSV

SEQ ID NO: 1374883 - protein, 19 aa, Mycobacterium tuberculosis
DKPVIFWTPDHGAFVVRGA

SEQ ID NO: 1374884 - protein, 23 aa, Mycobacterium tuberculosis
DLDRPDLPTGKHAPQRRAVASRD

SEQ ID NO: 1374885 - protein, 26 aa, Mycobacterium tuberculosis
DLPFYRSVLNWLFVAVVLAFLASLLT

SEQ ID NO: 1374886 - protein, 31 aa, Mycobacterium tuberculosis; identical to SEQ ID NO: 156507

SEQ ID NO: 1374887 - protein, 21 aa, Mycobacterium tuberculosis
DPKETVSFVAWVVYAAYLHAR

SEQ ID NO: 1374888 - protein, 20 aa, Mycobacterium tuberculosis
DQALLLRVIDQFGYGDDVDP

SEQ ID NO: 1374889 - protein, 24 aa, Mycobacterium tuberculosis
DQAQAAGMLLWFLIALPIGAVTGG

SEQ ID NO: 1374890 - protein, 20 aa, Mycobacterium tuberculosis
DQASSILLTLALTVSIVNAM

SEQ ID NO: 1374891 - protein, 20 aa, Mycobacterium tuberculosis
DRISSVFVPAVLVIAALTAA

SEQ ID NO: 1374892 - protein, 20 aa, Mycobacterium tuberculosis
DRYVTCGDLSAAAHAALATA

SEQ ID NO: 1374893 - protein, 19 aa, Mycobacterium tuberculosis
DRYVVSVSRRGEMSYSFAD

SEQ ID NO: 1374894 - protein, 23 aa, Mycobacterium tuberculosis
DSARRSGNEFLFQQLAQQAVETL

SEQ ID NO: 1374895 - protein, 22 aa, Mycobacterium tuberculosis
DTRVQAAVPFYGVYDFTRLQDA

SEQ ID NO: 1374896 - protein, 33 aa, Mycobacterium tuberculosis
DTSVCMFKPPFAWREYLLQCWFVARVSTLPGVL

SEQ ID NO: 1374897 - protein, 19 aa, Mycobacterium tuberculosis
DTTIGVAMLIGRFFLIIPV

SEQ ID NO: 1374898 - protein, 25 aa, Mycobacterium tuberculosis
DVEKRPRLTMFDDFGGRIPSDKPPI

SEQ ID NO: 1374899 - protein, 24 aa, Mycobacterium tuberculosis
DVPAPRIIASGLFNAIPEAPPLTA

SEQ ID NO: 1374900 - protein, 31 aa, Mycobacterium tuberculosis; identical to SEQ ID NO: 156586

SEQ ID NO: 1374901 - protein, 26 aa, Mycobacterium tuberculosis
DVVLRPHWTPLFAYAAAFLIAVAHVA

SEQ ID NO: 1374902 - protein, 21 aa, Mycobacterium tuberculosis
EAGFWGKLVNRVMKRPVLFAA

SEQ ID NO: 1374903 - protein, 19 aa, Mycobacterium tuberculosis
EGFALPLVHTAWLTALVFT

SEQ ID NO: 1374904 - protein, 20 aa, Mycobacterium tuberculosis
EGPMTPKRAIEVIADACQAL

SEQ ID NO: 1374905 - protein, 26 aa, Mycobacterium tuberculosis
EKHCYGIPICWSFRSIFDALDGIDKL

SEQ ID NO: 1374906 - protein, 19 aa, Mycobacterium tuberculosis
ELGVTVLRLAVIRRGVIPA

SEQ ID NO: 1374907 - protein, 20 aa, Mycobacterium tuberculosis
EQIMPLLVVAVMSQLVFSGG

SEQ ID NO: 1374908 - protein, 23 aa, Mycobacterium tuberculosis
ERDSRTRTSIGLATAAAAGTSVI

SEQ ID NO: 1374909 - protein, 17 aa, Mycobacterium tuberculosis
ESVRMLAPIPGKSAVGI

SEQ ID NO: 1374910 - protein, 34 aa, Mycobacterium tuberculosis; identical to SEQ ID NO: 159947

SEQ ID NO: 1374911 - protein, 29 aa, Mycobacterium tuberculosis
FADFPKYPLNILADVNALLGIYYSHSLYY

SEQ ID NO: 1374912 - protein, 21 aa, Mycobacterium tuberculosis
FAEARWLSVALLSIGLAGFCL

SEQ ID NO: 1374913 - protein, 17 aa, Mycobacterium tuberculosis
FAELYRQGAARDVGMLL

SEQ ID NO: 1374914 - protein, 29 aa, Mycobacterium tuberculosis
FAGLLAWLYQRTRVTASYRLAAPAGSSKP

SEQ ID NO: 1374915 - protein, 17 aa, Mycobacterium tuberculosis
FAHIPRVGGGDFTAVPL

SEQ ID NO: 1374916 - protein, 24 aa, Mycobacterium tuberculosis
FAIVPLLHRFGGLVAPLTFIGTAY

SEQ ID NO: 1374917 - protein, 18 aa, Mycobacterium tuberculosis
FDIPLCSATRSLFDTLDG

SEQ ID NO: 1374918 - protein, 25 aa, Mycobacterium tuberculosis
FDLRGRATLYLTYWTAGDTRNRGRE

SEQ ID NO: 1374919 - protein, 17 aa, Mycobacterium tuberculosis
FEAMGRIGMVFKEGDSD

SEQ ID NO: 1374920 - protein, 19 aa, Mycobacterium tuberculosis
FEAVGDWQLWVFKSDPANR

SEQ ID NO: 1374921 - protein, 17 aa, Mycobacterium tuberculosis
FFIPLLIGTGGNTGTQI

SEQ ID NO: 1374922 - protein, 19 aa, Mycobacterium tuberculosis
FGGIGSIFPLFMMVGIMMM

SEQ ID NO: 1374923 - protein, 25 aa, Mycobacterium tuberculosis
FGPAPEGMAMWIIGMVAAIGLALWI

SEQ ID NO: 1374924 - protein, 17 aa, Mycobacterium tuberculosis
FGVARQADYLPILPTGL

SEQ ID NO: 1374925 - protein, 17 aa, Mycobacterium tuberculosis
FKEPKREALLTLLPLER

SEQ ID NO: 1374926 - protein, 18 aa, Mycobacterium tuberculosis
FLACFTLIAAIGAQNAFV

SEQ ID NO: 1374927 - protein, 19 aa, Mycobacterium tuberculosis
FLLIITIPFGFAALRIASY

SEQ ID NO: 1374928 - protein, 23 aa, Mycobacterium tuberculosis
FLSRPFGAAVFGYFGDRLGRKKT

SEQ ID NO: 1374929 - protein, 19 aa, Mycobacterium tuberculosis
FPGGSRWARIDLADDEYIP

SEQ ID NO: 1374930 - protein, 19 aa, Mycobacterium tuberculosis
FPSNLIIPEYLFIQSSTDL

SEQ ID NO: 1374931 - protein, 30 aa, Mycobacterium tuberculosis; identical to SEQ ID NO: 156880

SEQ ID NO: 1374932 - protein, 18 aa, Mycobacterium tuberculosis
FTAVPLLWLLAIDAALIT

SEQ ID NO: 1374933 - protein, 25 aa, Mycobacterium tuberculosis
FTLTDAVVIFGFLLWHVIGANSSDD

SEQ ID NO: 1374934 - protein, 18 aa, Mycobacterium tuberculosis
FVAQFAVAFAVDRSTSPI

SEQ ID NO: 1374935 - protein, 18 aa, Mycobacterium tuberculosis
FVVNVHWSVLVILWLFTW

SEQ ID NO: 1374936 - protein, 17 aa, Mycobacterium tuberculosis
FWINVPLTAIAMVMIHF

SEQ ID NO: 1374937 - protein, 17 aa, Mycobacterium tuberculosis
FYLALKYTSEFLLGYLA

SEQ ID NO: 1374938 - protein, 22 aa, Mycobacterium tuberculosis
FYTLLRITRLIGIVIIAVSLPL

SEQ ID NO: 1374939 - protein, 22 aa, Mycobacterium tuberculosis
FYWAVGIAIGLPAGLIVLTELH

SEQ ID NO: 1374940 - protein, 29 aa, Mycobacterium tuberculosis
GADANRFVQCRVVATGNSVDAVWKPLLPG

SEQ ID NO: 1374941 - protein, 25 aa, Mycobacterium tuberculosis
GAMYCLGFTRLPYFNTLASPCAIGL

SEQ ID NO: 1374942 - protein, 30 aa, Mycobacterium tuberculosis; identical to SEQ ID NO: 156971

SEQ ID NO: 1374943 - protein, 19 aa, Mycobacterium tuberculosis
GAVAFSIVRRSSRPEPSPR

SEQ ID NO: 1374944 - protein, 18 aa, Mycobacterium tuberculosis
GAYFLRNYFVLIVVAAVG

SEQ ID NO: 1374945 - protein, 26 aa, Mycobacterium tuberculosis
GDDDERKKRLGVMLATGLIVGESLYG

SEQ ID NO: 1374946 - protein, 20 aa, Mycobacterium tuberculosis
GDGFALDFAGGKMFFTPATG

SEQ ID NO: 1374947 - protein, 17 aa, Mycobacterium tuberculosis
GDLFRIEGPPGLRRAVG

SEQ ID NO: 1374948 - protein, 29 aa, Mycobacterium tuberculosis
GESSPTFMQWGWRIPFLVSAALIAVALYV

SEQ ID NO: 1374949 - protein, 33 aa, Mycobacterium tuberculosis; identical to SEQ ID NO: 157011

SEQ ID NO: 1374950 - protein, 25 aa, Mycobacterium tuberculosis
GFGGMVVVCMIWRLFMQDSVTRPTT

SEQ ID NO: 1374951 - protein, 27 aa, Mycobacterium tuberculosis
GGLFAQLGLWRWAFGVMTLLTALMAML

SEQ ID NO: 1374952 - protein, 18 aa, Mycobacterium tuberculosis
GGNRPRWLGADIGQRQFY

SEQ ID NO: 1374953 - protein, 25 aa, Mycobacterium tuberculosis
GGRPMLRILVRRHRLVGTLPLVSPM

SEQ ID NO: 1374954 - protein, 18 aa, Mycobacterium tuberculosis
GHRIEWLTDPGLALPVVS

SEQ ID NO: 1374955 - protein, 20 aa, Mycobacterium tuberculosis
GIESRFPGTVTYYDRPEQPR

SEQ ID NO: 1374956 - protein, 18 aa, Mycobacterium tuberculosis
GKDVRFVGLIDAVRAGEE

SEQ ID NO: 1374957 - protein, 32 aa, Mycobacterium tuberculosis; identical to SEQ ID NO: 157072

SEQ ID NO: 1374958 - protein, 17 aa, Mycobacterium tuberculosis
GLAGAAWLVSGAGADRA

SEQ ID NO: 1374959 - protein, 17 aa, Mycobacterium tuberculosis
GLNPPPVPIPWSVLSLF

SEQ ID NO: 1374960 - protein, 22 aa, Mycobacterium tuberculosis
GLSAAGGWFYWDRVQTGGEASA

SEQ ID NO: 1374961 - protein, 20 aa, Mycobacterium tuberculosis
GLSYRFPFHTEKKTYPYFDP

SEQ ID NO: 1374962 - protein, 19 aa, Mycobacterium tuberculosis
GLTTYRFTQNVGYTPEGKL

SEQ ID NO: 1374963 - protein, 25 aa, Mycobacterium tuberculosis
GLYTPAQFQPWTGIPSLTYDQSVAE

SEQ ID NO: 1374964 - protein, 23 aa, Mycobacterium tuberculosis
GMALGFLTVFGIFGALTISAATA

SEQ ID NO: 1374965 - protein, 28 aa, Mycobacterium tuberculosis
GNLLQMAFRFWAFRRWVFPDEFARNPDK

SEQ ID NO: 1374966 - protein, 23 aa, Mycobacterium tuberculosis
GPDAPGAGSLFWVSDTGVRYGID

SEQ ID NO: 1374967 - protein, 19 aa, Mycobacterium tuberculosis
GPGSWAEYVRLMFTNPAAS

SEQ ID NO: 1374968 - protein, 24 aa, Mycobacterium tuberculosis
GPYETIGGLVLRELGHIPVAGETV

SEQ ID NO: 1374969 - protein, 25 aa, Mycobacterium tuberculosis
GQSGGPLDCHLMKLEDLRPPERAQV

SEQ ID NO: 1374970 - protein, 17 aa, Mycobacterium tuberculosis
GRAAAAILPPRLFGSPV

SEQ ID NO: 1374971 - protein, 18 aa, Mycobacterium tuberculosis
GRLFTPFFITVGLVEAAY

SEQ ID NO: 1374972 - protein, 24 aa, Mycobacterium tuberculosis
GRPPGAREWLTWLLHSRVTTFLSH

SEQ ID NO: 1374973 - protein, 19 aa, Mycobacterium tuberculosis
GRSVGKIVMGLRVVSDDGG

SEQ ID NO: 1374974 - protein, 30 aa, Mycobacterium tuberculosis; identical to SEQ ID NO: 157184

SEQ ID NO: 1374975 - protein, 24 aa, Mycobacterium tuberculosis
GTVRNWPWRRLVLSKTANTYSRLA

SEQ ID NO: 1374976 - protein, 26 aa, Mycobacterium tuberculosis
GVTGRASVAVAVGFVVGELAALVMFS

SEQ ID NO: 1374977 - protein, 25 aa, Mycobacterium tuberculosis
GWAVGQLLCGWLVDRVGARVTLVST

SEQ ID NO: 1374978 - protein, 17 aa, Mycobacterium tuberculosis
GWVNLPAVILIGLCALL

SEQ ID NO: 1374979 - protein, 32 aa, Mycobacterium tuberculosis; identical to SEQ ID NO: 157238

SEQ ID NO: 1374980 - protein, 19 aa, Mycobacterium tuberculosis
GYFRKSLEDIIRFQAEFLW

SEQ ID NO: 1374981 - protein, 24 aa, Mycobacterium tuberculosis
GYIVIGGIAGWLASKIVKGGGSGI

SEQ ID NO: 1374982 - protein, 25 aa, Mycobacterium tuberculosis
GYLYIKDRLKDMIISGGENVYPAEI

SEQ ID NO: 1374983 - protein, 24 aa, Mycobacterium tuberculosis
HDAVWPVMIVLLLNLTAAYSATRF

SEQ ID NO: 1374984 - protein, 24 aa, Mycobacterium tuberculosis
HEAGIDWDVIFLLLGMMIIVSVLR

SEQ ID NO: 1374985 - protein, 20 aa, Mycobacterium tuberculosis
HELADPLTPILAVGAAASAI

SEQ ID NO: 1374986 - protein, 20 aa, Mycobacterium tuberculosis
HELIKFAIVGGTTFIIDTAI

SEQ ID NO: 1374987 - protein, 20 aa, Mycobacterium tuberculosis
HELRRSATRFLFDFADDLQH

SEQ ID NO: 1374988 - protein, 17 aa, Mycobacterium tuberculosis
HHTIPAPVWVAVIMGLV

SEQ ID NO: 1374989 - protein, 24 aa, Mycobacterium tuberculosis
HNVAVRWVQNALSFIGFVPPDEND

SEQ ID NO: 1374990 - protein, 26 aa, Mycobacterium tuberculosis
HPLMSHLAELGWICVAINYRHSPRNT

SEQ ID NO: 1374991 - protein, 22 aa, Mycobacterium tuberculosis
HPRGAVLRLVVRFAEPLPPSPS

SEQ ID NO: 1374992 - protein, 40 aa, Mycobacterium tuberculosis; identical to SEQ ID NO: 157294

SEQ ID NO: 1374993 - protein, 25 aa, Mycobacterium tuberculosis
HQVTGWRFVMRRIAAGIALHDTRML

SEQ ID NO: 1374994 - protein, 17 aa, Mycobacterium tuberculosis
HRILAWIAAGAMASVVA

SEQ ID NO: 1374995 - protein, 19 aa, Mycobacterium tuberculosis
HRLSPRMLLVHPVHEMLRQ

SEQ ID NO: 1374996 - protein, 34 aa, Mycobacterium tuberculosis; identical to SEQ ID NO: 157303

SEQ ID NO: 1374997 - protein, 23 aa, Mycobacterium tuberculosis
HVHPDTFWWALALSADFGGNLTA

SEQ ID NO: 1374998 - protein, 23 aa, Mycobacterium tuberculosis
HVSDELFATIGVTFFGAGVISTG

SEQ ID NO: 1374999 - protein, 25 aa, Mycobacterium tuberculosis
IAAAPPPLFRFGHRGPGDWQAGHRS

SEQ ID NO: 1375000 - protein, 27 aa, Mycobacterium tuberculosis
IAAVGLRGVIWSGVVSKVIVPAVVAAL

SEQ ID NO: 1375001 - protein, 27 aa, Mycobacterium tuberculosis
IAHGLGMPIPLGWQVWLYGVFAIIAVG

SEQ ID NO: 1375002 - protein, 20 aa, Mycobacterium tuberculosis
IALPFLVWVWLRHLRERRGY

SEQ ID NO: 1375003 - protein, 23 aa, Mycobacterium tuberculosis
IAVSLPLLWWRFRRDDRAALTGV

SEQ ID NO: 1375004 - protein, 27 aa, Mycobacterium tuberculosis
ICFLWDEAWYAFATAVPWARQRTAMIA

SEQ ID NO: 1375005 - protein, 22 aa, Mycobacterium tuberculosis
IDGRLYPALNLTSARLATGTAG

SEQ ID NO: 1375006 - protein, 19 aa, Mycobacterium tuberculosis
IDMRTFPGMEYGQNAAPPS

SEQ ID NO: 1375007 - protein, 26 aa, Mycobacterium tuberculosis
IDRSHPLCVLGFGFSVLAIAMTWLLC

SEQ ID NO: 1375008 - protein, 19 aa, Mycobacterium tuberculosis
IELLALILHDRRLVLAGSG

SEQ ID NO: 1375009 - protein, 24 aa, Mycobacterium tuberculosis
IEPDLRAIIELGYDRTGYADVPTP

SEQ ID NO: 1375010 - protein, 29 aa, Mycobacterium tuberculosis
IEPEVVQWKLKPGVVSTMSAQARYTDPNT

SEQ ID NO: 1375011 - protein, 23 aa, Mycobacterium tuberculosis
IFGCVAVIAFIFIKLFGAAAPGG

SEQ ID NO: 1375012 - protein, 17 aa, Mycobacterium tuberculosis
IFLMRSSPFTALELAQT

SEQ ID NO: 1375013 - protein, 24 aa, Mycobacterium tuberculosis
IGFLQRPARWIQMLASNTLAFTAA

SEQ ID NO: 1375014 - protein, 17 aa, Mycobacterium tuberculosis
IGIGGGQTIDLNVLLSA

SEQ ID NO: 1375015 - protein, 17 aa, Mycobacterium tuberculosis
IGLHSRRNLTLYVTALL

SEQ ID NO: 1375016 - protein, 18 aa, Mycobacterium tuberculosis
IGSFPILSVFGFVVMFGG

SEQ ID NO: 1375017 - protein, 21 aa, Mycobacterium tuberculosis
IGSVLRFLVDRSVARRLARTF

SEQ ID NO: 1375018 - protein, 25 aa, Mycobacterium tuberculosis
IGTIPICILGLFFKDDIRSGVRNLW

SEQ ID NO: 1375019 - protein, 17 aa, Mycobacterium tuberculosis
IGVEAFTGFFAALINVR

SEQ ID NO: 1375020 - protein, 17 aa, Mycobacterium tuberculosis
IHAQAYWNAGRAMGTHR

SEQ ID NO: 1375021 - protein, 18 aa, Mycobacterium tuberculosis
IILGWLVTIAVLNVTVPQ

SEQ ID NO: 1375022 - protein, 26 aa, Mycobacterium tuberculosis
IKAMPPSSVVGLWTFDGREGRTEVPA

SEQ ID NO: 1375023 - protein, 30 aa, Mycobacterium tuberculosis; identical to SEQ ID NO: 157436

SEQ ID NO: 1375024 - protein, 20 aa, Mycobacterium tuberculosis
ILVGGLWPLLMEQFSVRPNA

SEQ ID NO: 1375025 - protein, 20 aa, Mycobacterium tuberculosis
ILVPRDARLNSALMLLSVFA

SEQ ID NO: 1375026 - protein, 25 aa, Mycobacterium tuberculosis
INCQRAIPHVVGWYQAYKDSGLAVI

SEQ ID NO: 1375027 - protein, 21 aa, Mycobacterium tuberculosis
IPADVCRRTESGLRACTAMSK

SEQ ID NO: 1375028 - protein, 20 aa, Mycobacterium tuberculosis
IQPQTRWEAFANQSLASLGY

SEQ ID NO: 1375029 - protein, 23 aa, Mycobacterium tuberculosis
IRPSYGMAEATVYVATRKAGQPP

SEQ ID NO: 1375030 - protein, 17 aa, Mycobacterium tuberculosis
ISFEVRGGLFVRQIHHW

SEQ ID NO: 1375031 - protein, 18 aa, Mycobacterium tuberculosis
ITHWDPEDLGAWEAGNKG

SEQ ID NO: 1375032 - protein, 19 aa, Mycobacterium tuberculosis
IVAEARRRGIAIPPAKDFR

SEQ ID NO: 1375033 - protein, 41 aa, Mycobacterium tuberculosis; identical to SEQ ID NO: 157523

SEQ ID NO: 1375034 - protein, 23 aa, Mycobacterium tuberculosis
IVATARPSALWNQATWWQSIAVW

SEQ ID NO: 1375035 - protein, 17 aa, Mycobacterium tuberculosis
IVGGVAWGAGVTLAGYF

SEQ ID NO: 1375036 - protein, 29 aa, Mycobacterium tuberculosis
IVRRSNALLDWAYGRRFRYSETMSVGSTV

SEQ ID NO: 1375037 - protein, 22 aa, Mycobacterium tuberculosis
IVTIPFGIGMIFYGNIAGGIFV

SEQ ID NO: 1375038 - protein, 20 aa, Mycobacterium tuberculosis
IVTRSRLPGLLPPLDDVKNF

SEQ ID NO: 1375039 - protein, 24 aa, Mycobacterium tuberculosis
IYAQPTSWWPLRWYPQNYRTATEQ

SEQ ID NO: 1375040 - protein, 22 aa, Mycobacterium tuberculosis
IYQTSRISSDFTFGNAPNDDPY

SEQ ID NO: 1375041 - protein, 24 aa, Mycobacterium tuberculosis
KANVRRFVDDISFVVSKQSRDRLK

SEQ ID NO: 1375042 - protein, 23 aa, Mycobacterium tuberculosis
KAPLWPFHRWLPDAAVESTPATA

SEQ ID NO: 1375043 - protein, 20 aa, Mycobacterium tuberculosis
KFPELSAYQIINRLIHTARP

SEQ ID NO: 1375044 - protein, 17 aa, Mycobacterium tuberculosis
KNFFSFAEILDIDRYRI

SEQ ID NO: 1375045 - protein, 18 aa, Mycobacterium tuberculosis
KPDICFLWDEAWYAFATA

SEQ ID NO: 1375046 - protein, 20 aa, Mycobacterium tuberculosis
KPVTIATFFRPRNLGLVLVT

SEQ ID NO: 1375047 - protein, 20 aa, Mycobacterium tuberculosis
KRSLLRTAVIVPAVLAMLLV

SEQ ID NO: 1375048 - protein, 18 aa, Mycobacterium tuberculosis
KVPLPRWYWIGLAVGILV

SEQ ID NO: 1375049 - protein, 20 aa, Mycobacterium tuberculosis
LAATIGFGWTLLVLLATFVL

SEQ ID NO: 1375050 - protein, 19 aa, Mycobacterium tuberculosis
LACATKWSGVYFVLFFGAM

SEQ ID NO: 1375051 - protein, 20 aa, Mycobacterium tuberculosis
LAERGVHAGLMFPAVVCTLA

SEQ ID NO: 1375052 - protein, 25 aa, Mycobacterium tuberculosis
LAGFNASGTPFVWDGSMVVNYQDPS

SEQ ID NO: 1375053 - protein, 24 aa, Mycobacterium tuberculosis
LAGGLGIALAHPWRSSGPRTSAPP

SEQ ID NO: 1375054 - protein, 17 aa, Mycobacterium tuberculosis
LAGLLIVIGAQLVKLAH

SEQ ID NO: 1375055 - protein, 18 aa, Mycobacterium tuberculosis
LAITGLVASAAWTIGSNL

SEQ ID NO: 1375056 - protein, 19 aa, Mycobacterium tuberculosis
LALVGLLTLPGYRTNYNDR

SEQ ID NO: 1375057 - protein, 17 aa, Mycobacterium tuberculosis
LAPTLWGWRRTPVLRWF

SEQ ID NO: 1375058 - protein, 17 aa, Mycobacterium tuberculosis
LATRCYDVTQGAVRIGG

SEQ ID NO: 1375059 - protein, 18 aa, Mycobacterium tuberculosis
LAVIRRGVIPASWGGKLK

SEQ ID NO: 1375060 - protein, 21 aa, Mycobacterium tuberculosis
LAWWFDWLPHHGLEDTQRSNR

SEQ ID NO: 1375061 - protein, 18 aa, Mycobacterium tuberculosis
LCLIFIIMLIITRAFIAA

SEQ ID NO: 1375062 - protein, 18 aa, Mycobacterium tuberculosis
LDQMSWVTPARWGFAASA

SEQ ID NO: 1375063 - protein, 18 aa, Mycobacterium tuberculosis
LDRLRTLVHRTCVTPLPF

SEQ ID NO: 1375064 - protein, 22 aa, Mycobacterium tuberculosis
LEAPLKFRAAGVTLQIGLGIGR

SEQ ID NO: 1375065 - protein, 21 aa, Mycobacterium tuberculosis
LEMRHLASLPAGVAPSPDQLS

SEQ ID NO: 1375066 - protein, 45 aa, Mycobacterium tuberculosis; identical to SEQ ID NO: 157723

SEQ ID NO: 1375067 - protein, 25 aa, Mycobacterium tuberculosis
LFHLSLRHALWWLGSLAAVASFTLQ

SEQ ID NO: 1375068 - protein, 17 aa, Mycobacterium tuberculosis
LFLGAISFVLANFTVAS

SEQ ID NO: 1375069 - protein, 23 aa, Mycobacterium tuberculosis
LFRGPRAPYLRTMFVVLLSTLTL

SEQ ID NO: 1375070 - protein, 20 aa, Mycobacterium tuberculosis
LFRPRFIKRMFFKKFPGDLR

SEQ ID NO: 1375071 - protein, 20 aa, Mycobacterium tuberculosis
LGAIVFAGLLAWLYQRTRVT

SEQ ID NO: 1375072 - protein, 22 aa, Mycobacterium tuberculosis
LGECSACRAWFTQVASQAGDLR

SEQ ID NO: 1375073 - protein, 17 aa, Mycobacterium tuberculosis
LGGMVAMVFASGSHVFG

SEQ ID NO: 1375074 - protein, 27 aa, Mycobacterium tuberculosis
LGMSLHQPYLMGCLSPRNELSQISYGQ

SEQ ID NO: 1375075 - protein, 24 aa, Mycobacterium tuberculosis
LGPDRRTASAGLWRRPAGGGTAKT

SEQ ID NO: 1375076 - protein, 25 aa, Mycobacterium tuberculosis
LGSTLVLRRRFKPALVLEDIEKHKA

SEQ ID NO: 1375077 - protein, 18 aa, Mycobacterium tuberculosis
LGTFAFGVARQADYLPIL

SEQ ID NO: 1375078 - protein, 18 aa, Mycobacterium tuberculosis
LGVMPLLPVLLMVWATAR

SEQ ID NO: 1375079 - protein, 35 aa, Mycobacterium tuberculosis; identical to SEQ ID NO: 157781

SEQ ID NO: 1375080 - protein, 19 aa, Mycobacterium tuberculosis
LIVGGLTFFPALALGPIVE

SEQ ID NO: 1375081 - protein, 20 aa, Mycobacterium tuberculosis
LIVVCCYVALVVTNFAWLYP

SEQ ID NO: 1375082 - protein, 32 aa, Mycobacterium tuberculosis; identical to SEQ ID NO: 157797

SEQ ID NO: 1375083 - protein, 19 aa, Mycobacterium tuberculosis
LKDDFVLRERGHINVKGKG

SEQ ID NO: 1375084 - protein, 18 aa, Mycobacterium tuberculosis
LLALFAGSVLRGADLATL

SEQ ID NO: 1375085 - protein, 21 aa, Mycobacterium tuberculosis
LLELATPYALNAVSDDERADI

SEQ ID NO: 1375086 - protein, 18 aa, Mycobacterium tuberculosis
LLGGLPITGVIVRSSANV

SEQ ID NO: 1375087 - protein, 18 aa, Mycobacterium tuberculosis
LLIARPGFVIGRMTEGMT

SEQ ID NO: 1375088 - protein, 19 aa, Mycobacterium tuberculosis
LLIRLAIAAVLFVPVADLS

SEQ ID NO: 1375089 - protein, 18 aa, Mycobacterium tuberculosis
LLPAILVLASPRGWVAPR

SEQ ID NO: 1375090 - protein, 21 aa, Mycobacterium tuberculosis
LLPPRSHRLWLAVNAAGALLL

SEQ ID NO: 1375091 - protein, 29 aa, Mycobacterium tuberculosis
LLQGHWSLLVGYGCLPWVATAMLTMRTTV

SEQ ID NO: 1375092 - protein, 20 aa, Mycobacterium tuberculosis
LLSIGCGLIVAALLVTIQAA

SEQ ID NO: 1375093 - protein, 20 aa, Mycobacterium tuberculosis
LLWDGKRSPIDLADHAVTSG

SEQ ID NO: 1375094 - protein, 24 aa, Mycobacterium tuberculosis
LLYLLPLILRLWRGDTTHDRHAAA

SEQ ID NO: 1375095 - protein, 20 aa, Mycobacterium tuberculosis
LMIANPFRAGERIGSLFSTH

SEQ ID NO: 1375096 - protein, 19 aa, Mycobacterium tuberculosis
LNMWASANTGWWPLIWFTA

SEQ ID NO: 1375097 - protein, 19 aa, Mycobacterium tuberculosis
LPAGSPVRLCMAAVNRDGS

SEQ ID NO: 1375098 - protein, 18 aa, Mycobacterium tuberculosis
LPAPLSVHVYRLVWRQMI

SEQ ID NO: 1375099 - protein, 23 aa, Mycobacterium tuberculosis
LPDDLLSGLGLRAALSSITLGMP

SEQ ID NO: 1375100 - protein, 20 aa, Mycobacterium tuberculosis
LPDDSMRWLATVIQMDGRRI

SEQ ID NO: 1375101 - protein, 17 aa, Mycobacterium tuberculosis
LPLLFFALAGQRIAERV

SEQ ID NO: 1375102 - protein, 32 aa, Mycobacterium tuberculosis; identical to SEQ ID NO: 157893

SEQ ID NO: 1375103 - protein, 26 aa, Mycobacterium tuberculosis
LPVLALMVVAVWLLGVGTLKDLALVQ

SEQ ID NO: 1375104 - protein, 22 aa, Mycobacterium tuberculosis
LRALVLPWLLARAVGAEAAAQR

SEQ ID NO: 1375105 - protein, 24 aa, Mycobacterium tuberculosis
LRDLRIPAMAAALLVLSAILVGGL

SEQ ID NO: 1375106 - protein, 22 aa, Mycobacterium tuberculosis
LRHVLTLLLGVAVMTWLSVPLA

SEQ ID NO: 1375107 - protein, 20 aa, Mycobacterium tuberculosis
LRQLRWALSEVQRGNYNAHM

SEQ ID NO: 1375108 - protein, 24 aa, Mycobacterium tuberculosis
LRRGWAMAAICFIAVAVAAAVLGR

SEQ ID NO: 1375109 - protein, 18 aa, Mycobacterium tuberculosis
LRSLPVPFILNQPPPPPG

SEQ ID NO: 1375110 - protein, 24 aa, Mycobacterium tuberculosis
LRTELLRRGIVFAMARVKQDLRES

SEQ ID NO: 1375111 - protein, 18 aa, Mycobacterium tuberculosis
LSDRLATLLAQFLDDPRW

SEQ ID NO: 1375112 - protein, 20 aa, Mycobacterium tuberculosis
LSGLDLPAWGSLRLAMPSSG

SEQ ID NO: 1375113 - protein, 25 aa, Mycobacterium tuberculosis
LTLWLHVIDARFARALRLRLLSKLS

SEQ ID NO: 1375114 - protein, 31 aa, Mycobacterium tuberculosis; identical to SEQ ID NO: 158004

SEQ ID NO: 1375115 - protein, 21 aa, Mycobacterium tuberculosis
LVGGLAWPFLLLPQLGMIRGA

SEQ ID NO: 1375116 - protein, 29 aa, Mycobacterium tuberculosis
LVGVLVLLKAVAYWLDRYELLSHTRGGKP

SEQ ID NO: 1375117 - protein, 23 aa, Mycobacterium tuberculosis
LVIPCLLLAWAVSHPSLPFAVLV

SEQ ID NO: 1375118 - protein, 17 aa, Mycobacterium tuberculosis
LVISPVLLAVRPELQQA

SEQ ID NO: 1375119 - protein, 17 aa, Mycobacterium tuberculosis
LVSDAIAALTAVNSELG

SEQ ID NO: 1375120 - protein, 23 aa, Mycobacterium tuberculosis
LYGIARFQGVLPFNPTDKPAVTD

SEQ ID NO: 1375121 - protein, 30 aa, Mycobacterium tuberculosis; identical to SEQ ID NO: 158070

SEQ ID NO: 1375122 - protein, 17 aa, Mycobacterium tuberculosis
LYRLRLLETSYGVGVSV

SEQ ID NO: 1375123 - protein, 19 aa, Mycobacterium tuberculosis
MALRRMKVVAVGFLVGATG

SEQ ID NO: 1375124 - protein, 19 aa, Mycobacterium tuberculosis
MDAFQALLRWDGRQQDRWS

SEQ ID NO: 1375125 - protein, 17 aa, Mycobacterium tuberculosis
MDLGMCLNRFTYDSKLA

SEQ ID NO: 1375126 - protein, 25 aa, Mycobacterium tuberculosis
MGKLFAGACVVWFFVLFDMLDGAMA

SEQ ID NO: 1375127 - protein, 24 aa, Mycobacterium tuberculosis
MIFSTSRLKPWGIAHIQRGALAAV

SEQ ID NO: 1375128 - protein, 20 aa, Mycobacterium tuberculosis
MKILRPGRLTGELPPGAVRI

SEQ ID NO: 1375129 - protein, 29 aa, Mycobacterium tuberculosis
MLAALWAVYTPRWWLSGLLVGVASGVKLT

SEQ ID NO: 1375130 - protein, 22 aa, Mycobacterium tuberculosis
MLISGGATGWLYLEQYRPDQQT

SEQ ID NO: 1375131 - protein, 32 aa, Mycobacterium tuberculosis
MMMHLLRLARSFGVLPVGGWALRAIVAALLEW

SEQ ID NO: 1375132 - protein, 23 aa, Mycobacterium tuberculosis
MNNRCPLTSYVLIGFSQGAVIAG

SEQ ID NO: 1375133 - protein, 25 aa, Mycobacterium tuberculosis
MPNGYPVKASVSFGLYYPPGSALYH

SEQ ID NO: 1375134 - protein, 32 aa, Mycobacterium tuberculosis; identical to SEQ ID NO: 158139

SEQ ID NO: 1375135 - protein, 24 aa, Mycobacterium tuberculosis
MTASCKHPMIFPLSNPTSRMEAIP

SEQ ID NO: 1375136 - protein, 29 aa, Mycobacterium tuberculosis
MTPSIAALLGRWFWWPNMIHSRPTVPEAH

SEQ ID NO: 1375137 - protein, 18 aa, Mycobacterium tuberculosis
MTRYYAAQRTFWVDPVSG

SEQ ID NO: 1375138 - protein, 31 aa, Mycobacterium tuberculosis; identical to SEQ ID NO: 158162

SEQ ID NO: 1375139 - protein, 18 aa, Mycobacterium tuberculosis
NEDLPLLQPLRGIVPEPL

SEQ ID NO: 1375140 - protein, 18 aa, Mycobacterium tuberculosis
NGQTVFRVRLPMIEQQIA

SEQ ID NO: 1375141 - protein, 23 aa, Mycobacterium tuberculosis
NKAWKGTTTYTFRRKVATLVDNV

SEQ ID NO: 1375142 - protein, 26 aa, Mycobacterium tuberculosis
NNAFIPRFLFAVSFCGVLVATATYLH

SEQ ID NO: 1375143 - protein, 17 aa, Mycobacterium tuberculosis
NPSAPRSPLALRVDGLR

SEQ ID NO: 1375144 - protein, 18 aa, Mycobacterium tuberculosis
PAGALGLTVQVLWGQLTA

SEQ ID NO: 1375145 - protein, 20 aa, Mycobacterium tuberculosis
PAGPWLRTGDSGFLSEGELF

SEQ ID NO: 1375146 - protein, 17 aa, Mycobacterium tuberculosis
PANADFYAATRIGIGDQ

SEQ ID NO: 1375147 - protein, 18 aa, Mycobacterium tuberculosis
PAVLSVLVLEDFAMAAYL

SEQ ID NO: 1375148 - protein, 19 aa, Mycobacterium tuberculosis
PCAQRARAVATFLLAIPVA

SEQ ID NO: 1375149 - protein, 25 aa, Mycobacterium tuberculosis
PDFGERGRRDLYHFTHLAVEHPVFT

SEQ ID NO: 1375150 - protein, 27 aa, Mycobacterium tuberculosis
PDGAVGRALCLAIDPDLLITVNAMTGG

SEQ ID NO: 1375151 - protein, 18 aa, Mycobacterium tuberculosis
PEDLGAWEAGNKGIARRN

SEQ ID NO: 1375152 - protein, 19 aa, Mycobacterium tuberculosis
PFRAGERIGSLFSTHPPIE

SEQ ID NO: 1375153 - protein, 26 aa, Mycobacterium tuberculosis
PGAAVQAPWPLLRTFAAGPALSRDAA

SEQ ID NO: 1375154 - protein, 17 aa, Mycobacterium tuberculosis
PGDVMPATYVGIWQTFA

SEQ ID NO: 1375155 - protein, 18 aa, Mycobacterium tuberculosis
PGLLDLPAPAPVDLRRLL

SEQ ID NO: 1375156 - protein, 22 aa, Mycobacterium tuberculosis
PGTGQAAASSWLDRLRTLVHRT

SEQ ID NO: 1375157 - protein, 21 aa, Mycobacterium tuberculosis
PKEFRCVSVDLLARRPVVHRR

SEQ ID NO: 1375158 - protein, 25 aa, Mycobacterium tuberculosis
PLATGCLRVRASITISPDDLVSGEI

SEQ ID NO: 1375159 - protein, 21 aa, Mycobacterium tuberculosis
PLDRWPKGAVIVGMTGLTAAF

SEQ ID NO: 1375160 - protein, 23 aa, Mycobacterium tuberculosis
PLGGWQLGRRLLWLRSGLAEPRS

SEQ ID NO: 1375161 - protein, 18 aa, Mycobacterium tuberculosis
PLRYGAGRIGDLFRIEGP

SEQ ID NO: 1375162 - protein, 21 aa, Mycobacterium tuberculosis
PMGVPLEWNVFMIFGVLSLFV

SEQ ID NO: 1375163 - protein, 20 aa, Mycobacterium tuberculosis
PMLVAGRLGDRFGPKNLYLI

SEQ ID NO: 1375164 - protein, 17 aa, Mycobacterium tuberculosis
PMMLPLLERMVVKQPRT

SEQ ID NO: 1375165 - protein, 31 aa, Mycobacterium tuberculosis; identical to SEQ ID NO: 158365

SEQ ID NO: 1375166 - protein, 19 aa, Mycobacterium tuberculosis
PNPWQYIRYCYGARLPDSM

SEQ ID NO: 1375167 - protein, 22 aa, Mycobacterium tuberculosis
PPEPPGAYSAARGRFNDDITTQ

SEQ ID NO: 1375168 - protein, 25 aa, Mycobacterium tuberculosis
PPGRRRLAKWAGMVVSVLTLAVSIV

SEQ ID NO: 1375169 - protein, 23 aa, Mycobacterium tuberculosis
PRCPLPRPAIGPGTYNLVVQLGN

SEQ ID NO: 1375170 - protein, 30 aa, Mycobacterium tuberculosis; identical to SEQ ID NO: 158408

SEQ ID NO: 1375171 - protein, 19 aa, Mycobacterium tuberculosis
PSAGVRPAIHLPLEDPYQM

SEQ ID NO: 1375172 - protein, 24 aa, Mycobacterium tuberculosis
PSGMTRWSPDSGETIAERLGLIVG

SEQ ID NO: 1375173 - protein, 24 aa, Mycobacterium tuberculosis
PSRGTVYQMWLLGGAKGPRSAGTM

SEQ ID NO: 1375174 - protein, 25 aa, Mycobacterium tuberculosis
PSTVRPGIPVAFDAVIARGMAKNPE

SEQ ID NO: 1375175 - protein, 24 aa, Mycobacterium tuberculosis
PTAWALCGVFPLAAVPLVPVRLLP

SEQ ID NO: 1375176 - protein, 19 aa, Mycobacterium tuberculosis
PTFGDWGFALARLTDIAPT

SEQ ID NO: 1375177 - protein, 18 aa, Mycobacterium tuberculosis
PTLSRADALLAHDTLVPD

SEQ ID NO: 1375178 - protein, 18 aa, Mycobacterium tuberculosis
PTPGFRFIDHTVIGCSLV

SEQ ID NO: 1375179 - protein, 23 aa, Mycobacterium tuberculosis
PTRFKRKEHWLPAHFSGDGSTYM

SEQ ID NO: 1375180 - protein, 17 aa, Mycobacterium tuberculosis
PVGFLTVVAVDLFIDGL

SEQ ID NO: 1375181 - protein, 29 aa, Mycobacterium tuberculosis
PVNANAALRWSLLAGACSNDAALVRDGTR

SEQ ID NO: 1375182 - protein, 18 aa, Mycobacterium tuberculosis
PWWVTFGVAPAYATLALA

SEQ ID NO: 1375183 - protein, 28 aa, Mycobacterium tuberculosis
PYKYFLEFFEQFGFSPAVTVVLALVALQ

SEQ ID NO: 1375184 - protein, 24 aa, Mycobacterium tuberculosis
QLAKLARAGFRVSDVKPPSSPVTS

SEQ ID NO: 1375185 - protein, 18 aa, Mycobacterium tuberculosis
QLILFAIVSVVAIVVLGW

SEQ ID NO: 1375186 - protein, 23 aa, Mycobacterium tuberculosis
QLPVLTCLAAMFIGLAIFAISMD

SEQ ID NO: 1375187 - protein, 19 aa, Mycobacterium tuberculosis
QPYLVAGVLLVFYTATGRY

SEQ ID NO: 1375188 - protein, 21 aa, Mycobacterium tuberculosis
QRLTARGALVRSPRTIEALGR

SEQ ID NO: 1375189 - protein, 24 aa, Mycobacterium tuberculosis
QRRRDCIACTGIIGWTVRQTLFQR

SEQ ID NO: 1375190 - protein, 25 aa, Mycobacterium tuberculosis
QSTALADVSIRWQLKQAAAPELFQQ

SEQ ID NO: 1375191 - protein, 50 aa, Mycobacterium tuberculosis; identical to SEQ ID NO: 158554

SEQ ID NO: 1375192 - protein, 21 aa, Mycobacterium tuberculosis
RADAWGRKPIFLVGFAVLTAR

SEQ ID NO: 1375193 - protein, 24 aa, Mycobacterium tuberculosis
RAQIPMYLGYAFRAMNSHGRALFT

SEQ ID NO: 1375194 - protein, 24 aa, Mycobacterium tuberculosis
RARSRLQAHAFWDIATFLINGSLW

SEQ ID NO: 1375195 - protein, 17 aa, Mycobacterium tuberculosis
RASTVALVALVAAQLGQ

SEQ ID NO: 1375196 - protein, 18 aa, Mycobacterium tuberculosis
RATISRPAAVAVPTPAPA

SEQ ID NO: 1375197 - protein, 18 aa, Mycobacterium tuberculosis
RDTRDVVMLQDFVTTPPL

SEQ ID NO: 1375198 - protein, 20 aa, Mycobacterium tuberculosis
REPRNIWVMIGVPALIVALI

SEQ ID NO: 1375199 - protein, 18 aa, Mycobacterium tuberculosis
RFTGWQWVLSALALPVVT

SEQ ID NO: 1375200 - protein, 18 aa, Mycobacterium tuberculosis
RGAPALALVAAPRPDASY

SEQ ID NO: 1375201 - protein, 32 aa, Mycobacterium tuberculosis; identical to SEQ ID NO: 158641

SEQ ID NO: 1375202 - protein, 22 aa, Mycobacterium tuberculosis
RGHTSVLRIARAVNVSFLVFVL

SEQ ID NO: 1375203 - protein, 22 aa, Mycobacterium tuberculosis
RGIVGRTMLVWLLCSGVPNVGV

SEQ ID NO: 1375204 - protein, 24 aa, Mycobacterium tuberculosis
RGLLELGVGLGLQSARSTAAGLRR

SEQ ID NO: 1375205 - protein, 25 aa, Mycobacterium tuberculosis
RGRLPLLCCLVAFVLTFLVTRSFVR

SEQ ID NO: 1375206 - protein, 19 aa, Mycobacterium tuberculosis
RIAAPRWHFDLSDRLATLL

SEQ ID NO: 1375207 - protein, 18 aa, Mycobacterium tuberculosis
RIDRVPRYELVRCGLDVP

SEQ ID NO: 1375208 - protein, 23 aa, Mycobacterium tuberculosis
RILGHATDLLFNGVIGRGLPGGI

SEQ ID NO: 1375209 - protein, 17 aa, Mycobacterium tuberculosis
RIVALKLMSETLSSDPV

SEQ ID NO: 1375210 - protein, 18 aa, Mycobacterium tuberculosis
RKDIARFAAYTRGRVQEV

SEQ ID NO: 1375211 - protein, 18 aa, Mycobacterium tuberculosis
RKEPTFTGAGYTDIHAEL

SEQ ID NO: 1375212 - protein, 22 aa, Mycobacterium tuberculosis
RKGQESFNFGEFFAFTKVCSHL

SEQ ID NO: 1375213 - protein, 23 aa, Mycobacterium tuberculosis
RLELWRSDMVRMLAYGEIDARVK

SEQ ID NO: 1375214 - protein, 21 aa, Mycobacterium tuberculosis
RLLEDLRRARGLTVVVVSHDF

SEQ ID NO: 1375215 - protein, 18 aa, Mycobacterium tuberculosis
RLLGRGGMGEVYEAEHTV

SEQ ID NO: 1375216 - protein, 17 aa, Mycobacterium tuberculosis
RLMGVIFGTMFFLMFTP

SEQ ID NO: 1375217 - protein, 19 aa, Mycobacterium tuberculosis
RLMVFGGQISFCLYMVHEL

SEQ ID NO: 1375218 - protein, 19 aa, Mycobacterium tuberculosis
RLPAPWRIPLQAGLGSVLV

SEQ ID NO: 1375219 - protein, 20 aa, Mycobacterium tuberculosis
RLPRQDALKVLRADVSADGE

SEQ ID NO: 1375220 - protein, 28 aa, Mycobacterium tuberculosis
RLTHHRCTPREWMWAVLLAGAVAVIVMS

SEQ ID NO: 1375221 - protein, 17 aa, Mycobacterium tuberculosis
RNLIIFVVSVVILVTVL

SEQ ID NO: 1375222 - protein, 21 aa, Mycobacterium tuberculosis
RPAQETWIALEIAYAAGSSTR

SEQ ID NO: 1375223 - protein, 19 aa, Mycobacterium tuberculosis
RPGDIVLIDRNCHKSHHYG

SEQ ID NO: 1375224 - protein, 17 aa, Mycobacterium tuberculosis
RPLETKVVLDWDALPPV

SEQ ID NO: 1375225 - protein, 22 aa, Mycobacterium tuberculosis
RPWMAVMFFAGFLILYGLGVME

SEQ ID NO: 1375226 - protein, 18 aa, Mycobacterium tuberculosis
RQARRVVTVNLAIAATFI

SEQ ID NO: 1375227 - protein, 21 aa, Mycobacterium tuberculosis
RREVVLVTGPWLAGVSGVRAA

SEQ ID NO: 1375228 - protein, 35 aa, Mycobacterium tuberculosis; identical to SEQ ID NO: 158785

SEQ ID NO: 1375229 - protein, 17 aa, Mycobacterium tuberculosis
RRIEGLIAPGTFNIDPS

SEQ ID NO: 1375230 - protein, 17 aa, Mycobacterium tuberculosis
RRMALRRMKVVAVGFLV

SEQ ID NO: 1375231 - protein, 18 aa, Mycobacterium tuberculosis
RRRSMLTLADRVAVLDSG

SEQ ID NO: 1375232 - protein, 24 aa, Mycobacterium tuberculosis
RSADGRRGVSIGVIVALVAVVVMV

SEQ ID NO: 1375233 - protein, 23 aa, Mycobacterium tuberculosis
RSAMATLRIAFLSALVLELLATL

SEQ ID NO: 1375234 - protein, 22 aa, Mycobacterium tuberculosis
RSIDSARRWLIEGPAHLRGEQI

SEQ ID NO: 1375235 - protein, 20 aa, Mycobacterium tuberculosis
RSPAAPSLRRLGGSRHITHW

SEQ ID NO: 1375236 - protein, 22 aa, Mycobacterium tuberculosis
RSPITLRHKIFFVAVAVIGALA

SEQ ID NO: 1375237 - protein, 21 aa, Mycobacterium tuberculosis
RSRGPLWLIVVGFSAGVAVLV

SEQ ID NO: 1375238 - protein, 24 aa, Mycobacterium tuberculosis
RTQSRAVLMGVLIVITGLIGSFVF

SEQ ID NO: 1375239 - protein, 23 aa, Mycobacterium tuberculosis
RVADGLITFFALVIVTSLSMVFG

SEQ ID NO: 1375240 - protein, 22 aa, Mycobacterium tuberculosis
RVASGDCLMWPDGTPESAAIVS

SEQ ID NO: 1375241 - protein, 27 aa, Mycobacterium tuberculosis
RVGSMFGPYHLKRLLGRGGMGEVYEAE

SEQ ID NO: 1375242 - protein, 20 aa, Mycobacterium tuberculosis
RVHAAPGLHKLVYVGWTAIR

SEQ ID NO: 1375243 - protein, 17 aa, Mycobacterium tuberculosis
RVNLRAGQQVRIDQGPA

SEQ ID NO: 1375244 - protein, 18 aa, Mycobacterium tuberculosis
RVRAKIGPSQAWYTENLR

SEQ ID NO: 1375245 - protein, 22 aa, Mycobacterium tuberculosis
RVTDVFLGLPLLLAAIVLMQVM

SEQ ID NO: 1375246 - protein, 27 aa, Mycobacterium tuberculosis
RWLGMPAGLRLTVPVAAVLTMVGVAVY

SEQ ID NO: 1375247 - protein, 26 aa, Mycobacterium tuberculosis
RYFAEGLQYWPWVLLGYFNIGIMIVS

SEQ ID NO: 1375248 - protein, 20 aa, Mycobacterium tuberculosis
RYIAPHYLGYAFSGLYTPAQ

SEQ ID NO: 1375249 - protein, 18 aa, Mycobacterium tuberculosis
RYLEAAGISIAFSTAAVV

SEQ ID NO: 1375250 - protein, 21 aa, Mycobacterium tuberculosis
RYPASGGTYVYGRMRLGDFWG

SEQ ID NO: 1375251 - protein, 20 aa, Mycobacterium tuberculosis
SADAPPFFVLHGRNDSLVPV

SEQ ID NO: 1375252 - protein, 23 aa, Mycobacterium tuberculosis
SAGYLRKWFLLGITIGVIAGLGA

SEQ ID NO: 1375253 - protein, 24 aa, Mycobacterium tuberculosis
SAIAFLIFAVWVWREDTASDSETS

SEQ ID NO: 1375254 - protein, 26 aa, Mycobacterium tuberculosis
SARLKATMLAHWAWLSMLLVGGAGAA

SEQ ID NO: 1375255 - protein, 37 aa, Mycobacterium tuberculosis; identical to SEQ ID NO: 158922

SEQ ID NO: 1375256 - protein, 18 aa, Mycobacterium tuberculosis
SDLLWSFMQAIAMSIAVM

SEQ ID NO: 1375257 - protein, 31 aa, Mycobacterium tuberculosis; identical to SEQ ID NO: 158956

SEQ ID NO: 1375258 - protein, 17 aa, Mycobacterium tuberculosis
SGIPMKKMHAVSVPPNY

SEQ ID NO: 1375259 - protein, 21 aa, Mycobacterium tuberculosis
SGLRTLPMVIGLLIASTGTGV

SEQ ID NO: 1375260 - protein, 20 aa, Mycobacterium tuberculosis
SGNFSWLNWLTILLACSAID

SEQ ID NO: 1375261 - protein, 26 aa, Mycobacterium tuberculosis
SGPLTGRFWPPIGGFLYWLRPNTIRL

SEQ ID NO: 1375262 - protein, 19 aa, Mycobacterium tuberculosis
SGRACITYRVEVGVCLASG

SEQ ID NO: 1375263 - protein, 24 aa, Mycobacterium tuberculosis
SISREVFRQTPLIQIEAALALGAT

SEQ ID NO: 1375264 - protein, 20 aa, Mycobacterium tuberculosis
SKGLKWLSNINMALAAALAL

SEQ ID NO: 1375265 - protein, 26 aa, Mycobacterium tuberculosis
SKITKLMPWLWVAWFGLGSFGVLMLW

SEQ ID NO: 1375266 - protein, 19 aa, Mycobacterium tuberculosis
SKKDCKQNPIFDPLQPDDP

SEQ ID NO: 1375267 - protein, 25 aa, Mycobacterium tuberculosis
SLAPRCQKVLEGTGFVISPDRVMTN

SEQ ID NO: 1375268 - protein, 17 aa, Mycobacterium tuberculosis
SLDFIYYPVSWIMWVWY

SEQ ID NO: 1375269 - protein, 19 aa, Mycobacterium tuberculosis
SMGVLRLFANHSVVENNIV

SEQ ID NO: 1375270 - protein, 25 aa, Mycobacterium tuberculosis
SMLQRKLRVGFAKAGRLMDLMETRG

SEQ ID NO: 1375271 - protein, 18 aa, Mycobacterium tuberculosis
SPLWSGRVFAEARWLSVA

SEQ ID NO: 1375272 - protein, 38 aa, Mycobacterium tuberculosis; identical to SEQ ID NO: 159033

SEQ ID NO: 1375273 - protein, 26 aa, Mycobacterium tuberculosis
SPVSLGRGRLMFRATVQRLRDDETSG

SEQ ID NO: 1375274 - protein, 19 aa, Mycobacterium tuberculosis
SPVTLCWLLISYGFAASVL

SEQ ID NO: 1375275 - protein, 17 aa, Mycobacterium tuberculosis
SQARMKPEILMIESDHD

SEQ ID NO: 1375276 - protein, 21 aa, Mycobacterium tuberculosis
SQLRTANWWWALLGLAVSALT

SEQ ID NO: 1375277 - protein, 19 aa, Mycobacterium tuberculosis
SRAVRWDDIDGLRFHRGSW

SEQ ID NO: 1375278 - protein, 19 aa, Mycobacterium tuberculosis
SRESLFWVSGNGVRFGIAN

SEQ ID NO: 1375279 - protein, 22 aa, Mycobacterium tuberculosis
SRIAEIPLDIDATLISDGTGTA

SEQ ID NO: 1375280 - protein, 17 aa, Mycobacterium tuberculosis
SRRSFGFHCQVVGVRQQ

SEQ ID NO: 1375281 - protein, 27 aa, Mycobacterium tuberculosis
SSPLPRSARQPWLWVGVAVAVVVALAG

SEQ ID NO: 1375282 - protein, 33 aa, Mycobacterium tuberculosis; identical to SEQ ID NO: 159069

SEQ ID NO: 1375283 - protein, 26 aa, Mycobacterium tuberculosis
SSWFDAARPLGAWVDALLRTFIGSAV

SEQ ID NO: 1375284 - protein, 24 aa, Mycobacterium tuberculosis
STGTPRPPFDYMQQVYDRYIAPHY

SEQ ID NO: 1375285 - protein, 21 aa, Mycobacterium tuberculosis
STPRVSWPRGAGAAVGDAEHL

SEQ ID NO: 1375286 - protein, 26 aa, Mycobacterium tuberculosis
SYNEGGPCWSMRLNAVEPPKGPAWRR

SEQ ID NO: 1375287 - protein, 24 aa, Mycobacterium tuberculosis
TAAALPWLRIAILGTPAILVSLAG

SEQ ID NO: 1375288 - protein, 24 aa, Mycobacterium tuberculosis
TAGAARPGLARAHRRKRSESGVGI

SEQ ID NO: 1375289 - protein, 22 aa, Mycobacterium tuberculosis
TALCGYAVIYLAARNLAPNGFS

SEQ ID NO: 1375290 - protein, 19 aa, Mycobacterium tuberculosis
TAWLMRRSLQFGALTAEEL

SEQ ID NO: 1375291 - protein, 20 aa, Mycobacterium tuberculosis
TAYISGWIPFWVTIPVNAAV

SEQ ID NO: 1375292 - protein, 20 aa, Mycobacterium tuberculosis
TCAIALVGLLALPGYKTSYN

SEQ ID NO: 1375293 - protein, 19 aa, Mycobacterium tuberculosis
TDAGARFGVEDSKEARDAL

SEQ ID NO: 1375294 - protein, 17 aa, Mycobacterium tuberculosis
TEATSVRQRTWGWALAV

SEQ ID NO: 1375295 - protein, 25 aa, Mycobacterium tuberculosis
THRWVKNLPDEPVWVNGDHARLHQL

SEQ ID NO: 1375296 - protein, 21 aa, Mycobacterium tuberculosis
TIEAMWWIRSRMLGVKPRVWR

SEQ ID NO: 1375297 - protein, 17 aa, Mycobacterium tuberculosis
TLFQGAPQQSWRKRLPA

SEQ ID NO: 1375298 - protein, 23 aa, Mycobacterium tuberculosis
TLLSIPLWIVIVLPIAKILATSL

SEQ ID NO: 1375299 - protein, 26 aa, Mycobacterium tuberculosis
TLLVASAWWLFAWELDNGAGLHEART

SEQ ID NO: 1375300 - protein, 25 aa, Mycobacterium tuberculosis
TLVHRTCVTPLPFAQADLDALQRVN

SEQ ID NO: 1375301 - protein, 25 aa, Mycobacterium tuberculosis
TMREARAGDRYLLCSDGLSDPVSDE

SEQ ID NO: 1375302 - protein, 17 aa, Mycobacterium tuberculosis
TPAELAANHAIHGVLIA

SEQ ID NO: 1375303 - protein, 25 aa, Mycobacterium tuberculosis
TQATFLRWVWYAARREGLHLDEADD

SEQ ID NO: 1375304 - protein, 24 aa, Mycobacterium tuberculosis
TQRRSKHHLWIFAGIAAAILAGGA

SEQ ID NO: 1375305 - protein, 20 aa, Mycobacterium tuberculosis
TRDRTVLVIAHRLHTITRAD

SEQ ID NO: 1375306 - protein, 22 aa, Mycobacterium tuberculosis
TSFQWNWKFGYQRVNFKDGTLT

SEQ ID NO: 1375307 - protein, 23 aa, Mycobacterium tuberculosis
TSLPVEYYPAGRLNFVDTAADPT

SEQ ID NO: 1375308 - protein, 23 aa, Mycobacterium tuberculosis
TSVVAGLAWYLTHDVFNHPQAFF

SEQ ID NO: 1375309 - protein, 32 aa, Mycobacterium tuberculosis; identical to SEQ ID NO: 159256

SEQ ID NO: 1375310 - protein, 18 aa, Mycobacterium tuberculosis
TTSLALGCVLAIVAAMGC

SEQ ID NO: 1375311 - protein, 18 aa, Mycobacterium tuberculosis
TTVGAGWFGLFGLAFWVA

SEQ ID NO: 1375312 - protein, 18 aa, Mycobacterium tuberculosis
TVHLGYSVWTLWPVLELL

SEQ ID NO: 1375313 - protein, 17 aa, Mycobacterium tuberculosis
TVRERIVALKLMSETLS

SEQ ID NO: 1375314 - protein, 17 aa, Mycobacterium tuberculosis
TYFKDHLYIAGRIKDLV

SEQ ID NO: 1375315 - protein, 21 aa, Mycobacterium tuberculosis
VAAHGPYLAWLEQTAINSAVT

SEQ ID NO: 1375316 - protein, 24 aa, Mycobacterium tuberculosis
VAAMGCAFVALLRPQSALGQAPIV

SEQ ID NO: 1375317 - protein, 23 aa, Mycobacterium tuberculosis
VAAVPRRHRLFIIVSCLAVLAGV

SEQ ID NO: 1375318 - protein, 17 aa, Mycobacterium tuberculosis
VAFYCYGEGKAQAIREL

SEQ ID NO: 1375319 - protein, 19 aa, Mycobacterium tuberculosis
VAHVAGGLLLKVGSSGVVF

SEQ ID NO: 1375320 - protein, 18 aa, Mycobacterium tuberculosis
VALACLVGSAIEFYDFLI

SEQ ID NO: 1375321 - protein, 21 aa, Mycobacterium tuberculosis
VALLAIRARLVLLIFTTMPVL

SEQ ID NO: 1375322 - protein, 19 aa, Mycobacterium tuberculosis
VALLMPNSVEFCCLFYGAA

SEQ ID NO: 1375323 - protein, 20 aa, Mycobacterium tuberculosis
VALPLASLVGWLVSQISSGR

SEQ ID NO: 1375324 - protein, 28 aa, Mycobacterium tuberculosis
VAMPGAGRPRWQCGVAALGSALVGALPW

SEQ ID NO: 1375325 - protein, 25 aa, Mycobacterium tuberculosis
VAPSALRQSFLWGLAGVIAAEHPEL

SEQ ID NO: 1375326 - protein, 31 aa, Mycobacterium tuberculosis; identical to SEQ ID NO: 159341

SEQ ID NO: 1375327 - protein, 18 aa, Mycobacterium tuberculosis
VASPRRASAYGVFAAGLG

SEQ ID NO: 1375328 - protein, 23 aa, Mycobacterium tuberculosis
VAVAFVWLGMVVAISFLEAPLKF

SEQ ID NO: 1375329 - protein, 24 aa, Mycobacterium tuberculosis
VCYVSAAAVAARFGAAALAAHQVV

SEQ ID NO: 1375330 - protein, 27 aa, Mycobacterium tuberculosis
VDQRRWSSDLSMTWDLLCRSVTHGIVP

SEQ ID NO: 1375331 - protein, 29 aa, Mycobacterium tuberculosis
VDRLYADRRIRLWVVYVENFSGQSALNWA

SEQ ID NO: 1375332 - protein, 20 aa, Mycobacterium tuberculosis
VDSMGWEWIFFVNVPVGVIG

SEQ ID NO: 1375333 - protein, 23 aa, Mycobacterium tuberculosis
VEGLAALIFSRYLWAFELTSALL

SEQ ID NO: 1375334 - protein, 21 aa, Mycobacterium tuberculosis
VERDSPSWSPRFIDHLVGDRI

SEQ ID NO: 1375335 - protein, 26 aa, Mycobacterium tuberculosis
VGAFLRLPYTFAIPIFGGRNWTTVSA

SEQ ID NO: 1375336 - protein, 24 aa, Mycobacterium tuberculosis
VGALGILVMVVWVGTALTISTTAS

SEQ ID NO: 1375337 - protein, 23 aa, Mycobacterium tuberculosis
VGAYLFTPLFKWFTKRFNTGLSA

SEQ ID NO: 1375338 - protein, 23 aa, Mycobacterium tuberculosis
VGIALWLPWLIAAGVAFILASAA

SEQ ID NO: 1375339 - protein, 18 aa, Mycobacterium tuberculosis
VGNYRAATQVALGKGEDD

SEQ ID NO: 1375340 - protein, 36 aa, Mycobacterium tuberculosis; identical to SEQ ID NO: 159419

SEQ ID NO: 1375341 - protein, 17 aa, Mycobacterium tuberculosis
VGSAIEFYDFLIYGTAA

SEQ ID NO: 1375342 - protein, 40 aa, Mycobacterium tuberculosis; identical to SEQ ID NO: 159426

SEQ ID NO: 1375343 - protein, 21 aa, Mycobacterium tuberculosis
VGVRWWRFGAGVLLGLACATK

SEQ ID NO: 1375344 - protein, 17 aa, Mycobacterium tuberculosis
VHPRFKVPFRAELVVGA

SEQ ID NO: 1375345 - protein, 31 aa, Mycobacterium tuberculosis; identical to SEQ ID NO: 159461

SEQ ID NO: 1375346 - protein, 17 aa, Mycobacterium tuberculosis
VINELRAAGAEAIQIND

SEQ ID NO: 1375347 - protein, 20 aa, Mycobacterium tuberculosis
VKAEMLVGTPAMWWLAVPVL

SEQ ID NO: 1375348 - protein, 20 aa, Mycobacterium tuberculosis
VKPRPEWGPLAMLLAGSILI

SEQ ID NO: 1375349 - protein, 17 aa, Mycobacterium tuberculosis
VLAQMMWTMKGIGSLRD

SEQ ID NO: 1375350 - protein, 17 aa, Mycobacterium tuberculosis
VLLPQLRPTTFFLSITV

SEQ ID NO: 1375351 - protein, 17 aa, Mycobacterium tuberculosis
VLLWLFVRHEHRAAFPL

SEQ ID NO: 1375352 - protein, 19 aa, Mycobacterium tuberculosis
VLMTIPWAVISGFLFNVLL

SEQ ID NO: 1375353 - protein, 26 aa, Mycobacterium tuberculosis
VLPLAAPWLRDLRAGPVSINRTVDYI

SEQ ID NO: 1375354 - protein, 27 aa, Mycobacterium tuberculosis
VLVAIAVLCAVSFFTAIFLRDLRIPAM

SEQ ID NO: 1375355 - protein, 24 aa, Mycobacterium tuberculosis
VMVFASGLLAMFPIAALGALVVYA

SEQ ID NO: 1375356 - protein, 18 aa, Mycobacterium tuberculosis
VNALLGIYYSHSLYYGLT

SEQ ID NO: 1375357 - protein, 26 aa, Mycobacterium tuberculosis
VNAPGVILRLMLAWIPSTGVPLLAIV

SEQ ID NO: 1375358 - protein, 22 aa, Mycobacterium tuberculosis
VNDPRLSAIATISPADIVDRIL

SEQ ID NO: 1375359 - protein, 31 aa, Mycobacterium tuberculosis; identical to SEQ ID NO: 159530

SEQ ID NO: 1375360 - protein, 24 aa, Mycobacterium tuberculosis
VPPIPWRLRLRRPTIVLGSVVALL

SEQ ID NO: 1375361 - protein, 23 aa, Mycobacterium tuberculosis
VPPPFELPPPFGPGTTTPTPPAP

SEQ ID NO: 1375362 - protein, 19 aa, Mycobacterium tuberculosis
VPVRRLRAIETLAQAIAPV

SEQ ID NO: 1375363 - protein, 21 aa, Mycobacterium tuberculosis
VPWPAGAQVLIRFTGPEVWWV

SEQ ID NO: 1375364 - protein, 19 aa, Mycobacterium tuberculosis
VQIPRLVANNTRIWVYCGN

SEQ ID NO: 1375365 - protein, 29 aa, Mycobacterium tuberculosis
VRPLRSYFYWEHHCFDIPLCSATRSLFDT

SEQ ID NO: 1375366 - protein, 22 aa, Mycobacterium tuberculosis
VRWQGEFLVAVIELIPRPFTPT

SEQ ID NO: 1375367 - protein, 20 aa, Mycobacterium tuberculosis
VSAKSLRVGDVIDLAAPEVV

SEQ ID NO: 1375368 - protein, 22 aa, Mycobacterium tuberculosis
VSHPSLPFAVLVVIAATAGFGG

SEQ ID NO: 1375369 - protein, 19 aa, Mycobacterium tuberculosis
VSPASMRKFFEAFAPYGLK

SEQ ID NO: 1375370 - protein, 19 aa, Mycobacterium tuberculosis
VSTLPGVLMTIPWAVISGF

SEQ ID NO: 1375371 - protein, 19 aa, Mycobacterium tuberculosis
VTFMLVWLINHHGWSVAQA

SEQ ID NO: 1375372 - protein, 17 aa, Mycobacterium tuberculosis
VTIRLALIALAVEAVLG

SEQ ID NO: 1375373 - protein, 25 aa, Mycobacterium tuberculosis
VTLQIGLGIGRLVFRALNTVEVGFA

SEQ ID NO: 1375374 - protein, 17 aa, Mycobacterium tuberculosis
VTPEELYPITGVKSLPF

SEQ ID NO: 1375375 - protein, 23 aa, Mycobacterium tuberculosis
VVATALRLYTRWLGHVVLLVPTV

SEQ ID NO: 1375376 - protein, 17 aa, Mycobacterium tuberculosis
VVCAIGLGSVAGLSRVF

SEQ ID NO: 1375377 - protein, 27 aa, Mycobacterium tuberculosis
VVDLADPAVVWALRLQGRVPHVVAQSL

SEQ ID NO: 1375378 - protein, 20 aa, Mycobacterium tuberculosis
VVEIGKQLLITRGALTTFSI

SEQ ID NO: 1375379 - protein, 26 aa, Mycobacterium tuberculosis
VVLLYAVCVVLRLARYNALQDDGTQP

SEQ ID NO: 1375380 - protein, 25 aa, Mycobacterium tuberculosis
VVLVGYCAGWLPWFADIDRQMYFFY

SEQ ID NO: 1375381 - protein, 20 aa, Mycobacterium tuberculosis
VVMVALVVFGLRRRRRGYDA

SEQ ID NO: 1375382 - protein, 18 aa, Mycobacterium tuberculosis
VVRRSLRPLAEFEQTAAA

SEQ ID NO: 1375383 - protein, 22 aa, Mycobacterium tuberculosis
VVVAVAASLIWWTSDARATISR

SEQ ID NO: 1375384 - protein, 18 aa, Mycobacterium tuberculosis
VYFSHALNKVWRRHMLRV

SEQ ID NO: 1375385 - protein, 19 aa, Mycobacterium tuberculosis
WAIALLVWHYGRVEERWTP

SEQ ID NO: 1375386 - protein, 21 aa, Mycobacterium tuberculosis
WAIYVRRGLKSAGELVPATTA

SEQ ID NO: 1375387 - protein, 17 aa, Mycobacterium tuberculosis
WDQIGQIVVSWVLSPVL

SEQ ID NO: 1375388 - protein, 17 aa, Mycobacterium tuberculosis
WFSLSPVTLCWLLISYG

SEQ ID NO: 1375389 - protein, 19 aa, Mycobacterium tuberculosis
WHAPWPLNMWASANTGWWP

SEQ ID NO: 1375390 - protein, 17 aa, Mycobacterium tuberculosis
WIGTMWKGQLTFETPML

SEQ ID NO: 1375391 - protein, 21 aa, Mycobacterium tuberculosis
WKVYDRRTVTDMGMLQAALVR

SEQ ID NO: 1375392 - protein, 18 aa, Mycobacterium tuberculosis
WLAALLFAGALLAERVSL

SEQ ID NO: 1375393 - protein, 26 aa, Mycobacterium tuberculosis
WLAQFEPMHQVFLGVRSLLYLNGNAD

SEQ ID NO: 1375394 - protein, 27 aa, Mycobacterium tuberculosis
WLSSELMFFAGLFAFYFSARAQAGGNW

SEQ ID NO: 1375395 - protein, 20 aa, Mycobacterium tuberculosis
WMMQAEVAITNFVTTMDVAA

SEQ ID NO: 1375396 - protein, 17 aa, Mycobacterium tuberculosis
WNDFLWPLLMIQRNSLA

SEQ ID NO: 1375397 - protein, 17 aa, Mycobacterium tuberculosis
WNVFMIFGVLSLFVGHA

SEQ ID NO: 1375398 - protein, 20 aa, Mycobacterium tuberculosis
WPQPVPEPAFKAAIAQATQA

SEQ ID NO: 1375399 - protein, 19 aa, Mycobacterium tuberculosis
WRGHAAAARDLRSHPRTGP

SEQ ID NO: 1375400 - protein, 22 aa, Mycobacterium tuberculosis
WRPIRSYFYWEKHCYGIPICWS

SEQ ID NO: 1375401 - protein, 17 aa, Mycobacterium tuberculosis
WSWADLSFLPALALIFL

SEQ ID NO: 1375402 - protein, 17 aa, Mycobacterium tuberculosis
WYLQRVGSEPDFLRVWL

SEQ ID NO: 1375403 - protein, 20 aa, Mycobacterium tuberculosis
YAANRVVGFALADPDLFTGR

SEQ ID NO: 1375404 - protein, 18 aa, Mycobacterium tuberculosis
YADRLEILHVLSSEPLHT

SEQ ID NO: 1375405 - protein, 20 aa, Mycobacterium tuberculosis
YCLGLGIPFVLLAFGSAWAV

SEQ ID NO: 1375406 - protein, 21 aa, Mycobacterium tuberculosis
YDYRCIFLVRGGPNYFSIALI

SEQ ID NO: 1375407 - protein, 25 aa, Mycobacterium tuberculosis
YERLKSWRRGLIFAMFVFAAIFTPG

SEQ ID NO: 1375408 - protein, 17 aa, Mycobacterium tuberculosis
YFLIGGFGQGAGRSRAA

SEQ ID NO: 1375409 - protein, 26 aa, Mycobacterium tuberculosis
YGVYLWHWPIFLALNGQRTGWSGPAL

SEQ ID NO: 1375410 - protein, 26 aa, Mycobacterium tuberculosis
YHIAKPWRWGYLGVLLVIFGFPLIAM

SEQ ID NO: 1375411 - protein, 17 aa, Mycobacterium tuberculosis
YLERIFDPKVFVVSFVF

SEQ ID NO: 1375412 - protein, 17 aa, Mycobacterium tuberculosis
YLISFFGALYSGRIAVP

SEQ ID NO: 1375413 - protein, 25 aa, Mycobacterium tuberculosis
YLSALERLRDFAVFKAIGVPTRSIL

SEQ ID NO: 1375414 - protein, 20 aa, Mycobacterium tuberculosis
YPIRSGIDPIVFGVVRELLS

SEQ ID NO: 1375415 - protein, 22 aa, Mycobacterium tuberculosis
YSLDNKRLWSNLDCAPSNETLV

SEQ ID NO: 1375416 - protein, 24 aa, Mycobacterium tuberculosis
YTLKADLPASGGLYPTANVTYRGI

SEQ ID NO: 1375417 - protein, 25 aa, Mycobacterium tuberculosis
YTRLRRPIVVWWIVWIVSNAISMFA

SEQ ID NO: 1375418 - protein, 24 aa, Mycobacterium tuberculosis
YVLVSTWLVVWGIWHVYFVEAVFP

SEQ ID NO: 1375419 - protein, 28 aa, Mycobacterium tuberculosis
YWERHCFDIPICWSMRSLLNSMDNVDKL

SEQ ID NO: 1375420 - protein, 20 aa, Mycobacterium tuberculosis
AAAPCALAIAVPVTVVASIG

SEQ ID NO: 1375421 - protein, 22 aa, Mycobacterium tuberculosis
AADTRLDVLSSIGQLIRDILDF

SEQ ID NO: 1375422 - protein, 22 aa, Mycobacterium tuberculosis
AAEPKSSAGPMFSTYGIASTLL

SEQ ID NO: 1375423 - protein, 17 aa, Mycobacterium tuberculosis
AALPLLFFALAGQRIAE

SEQ ID NO: 1375424 - protein, 18 aa, Mycobacterium tuberculosis
ADALLAHDTLVPDSRPAR

SEQ ID NO: 1375425 - protein, 23 aa, Mycobacterium tuberculosis
ADLPEYRTGLIIVGLARCIAMVI

SEQ ID NO: 1375426 - protein, 19 aa, Mycobacterium tuberculosis
ADPAAGRFAVDVVLHDPAG

SEQ ID NO: 1375427 - protein, 20 aa, Mycobacterium tuberculosis
ADRGPVLLITAVHRDFASTD

SEQ ID NO: 1375428 - protein, 18 aa, Mycobacterium tuberculosis
ADYAAKALGGWAGFSVGW

SEQ ID NO: 1375429 - protein, 21 aa, Mycobacterium tuberculosis
AELPLREILPAVQRLVVPSAQ

SEQ ID NO: 1375430 - protein, 22 aa, Mycobacterium tuberculosis
AERSVAVWLLLGGVFGLALLLI

SEQ ID NO: 1375431 - protein, 21 aa, Mycobacterium tuberculosis
AGDFWPWALQFVATLWVSTFL

SEQ ID NO: 1375432 - protein, 26 aa, Mycobacterium tuberculosis
AGEETRLRLLVNEMFETMSRRSRSLV

SEQ ID NO: 1375433 - protein, 24 aa, Mycobacterium tuberculosis
AGTRDRYLLMPSFTFVGVAQAALW

SEQ ID NO: 1375434 - protein, 28 aa, Mycobacterium tuberculosis
AGVIAAEHPELWGGLVDLAINDDLGEFG

SEQ ID NO: 1375435 - protein, 20 aa, Mycobacterium tuberculosis
AHRLIELALRGGGPDNVTVV

SEQ ID NO: 1375436 - protein, 22 aa, Mycobacterium tuberculosis
AHRPLELCRVDLLALASDAAHD

SEQ ID NO: 1375437 - protein, 23 aa, Mycobacterium tuberculosis
AIAHYCHYWRAFQPIPQWTLALI

SEQ ID NO: 1375438 - protein, 24 aa, Mycobacterium tuberculosis
AIDPARLGLAVVMLSRRRPMLNLF

SEQ ID NO: 1375439 - protein, 18 aa, Mycobacterium tuberculosis
AINKGISPLGCWPGSSAL

SEQ ID NO: 1375440 - protein, 22 aa, Mycobacterium tuberculosis
AIPVLIVGTVVWVGITNDRKER

SEQ ID NO: 1375441 - protein, 22 aa, Mycobacterium tuberculosis
AKFPELTAYQVINRIVQSAHNP

SEQ ID NO: 1375442 - protein, 19 aa, Mycobacterium tuberculosis
ALACAELGQLLGEVQASSW

SEQ ID NO: 1375443 - protein, 18 aa, Mycobacterium tuberculosis
ALAILTLIALLFGAYFLR

SEQ ID NO: 1375444 - protein, 18 aa, Mycobacterium tuberculosis
ALLDGFLTFFVVAAFGAL

SEQ ID NO: 1375445 - protein, 19 aa, Mycobacterium tuberculosis
ALLSAIGIAGMDRLVQHNV

SEQ ID NO: 1375446 - protein, 19 aa, Mycobacterium tuberculosis
ALLTIAIQPQTRWEAFANQ

SEQ ID NO: 1375447 - protein, 28 aa, Mycobacterium tuberculosis
ALSAFFTPRFVRWFGLFTTHAIVAAALA

SEQ ID NO: 1375448 - protein, 17 aa, Mycobacterium tuberculosis
ALSWAWGWLPLDAGSGI

SEQ ID NO: 1375449 - protein, 30 aa, Mycobacterium tuberculosis; identical to SEQ ID NO: 160268

SEQ ID NO: 1375450 - protein, 23 aa, Mycobacterium tuberculosis
AMAAGLLLGRWIPGLHTALEGVQ

SEQ ID NO: 1375451 - protein, 23 aa, Mycobacterium tuberculosis
AMDPKRRITLEVLDGPGTPEVLG

SEQ ID NO: 1375452 - protein, 19 aa, Mycobacterium tuberculosis
AMLIPMYFLIGGFGQGAGR

SEQ ID NO: 1375453 - protein, 26 aa, Mycobacterium tuberculosis
AMNLAGNRPRLVWYAPDHIEGEMSSP

SEQ ID NO: 1375454 - protein, 17 aa, Mycobacterium tuberculosis
ANLMLGFAAIFVGTVCA

SEQ ID NO: 1375455 - protein, 23 aa, Mycobacterium tuberculosis
APGLRLAVVFLCAAAISAAVVTG

SEQ ID NO: 1375456 - protein, 25 aa, Mycobacterium tuberculosis
APVIGMAMRAWWETGRSLWWPLAIG

SEQ ID NO: 1375457 - protein, 23 aa, Mycobacterium tuberculosis
APYHLRLDWLMWFAAISPGYALP

SEQ ID NO: 1375458 - protein, 22 aa, Mycobacterium tuberculosis
AQLDGWRYGWVLNIGAAITGGV

SEQ ID NO: 1375459 - protein, 28 aa, Mycobacterium tuberculosis
AQRWASPFWQTWDLLLLWLAQLHGGNGL

SEQ ID NO: 1375460 - protein, 33 aa, Mycobacterium tuberculosis; identical to SEQ ID NO: 156261

SEQ ID NO: 1375461 - protein, 21 aa, Mycobacterium tuberculosis
ARIREAIRLSGPDIYGDPEPV

SEQ ID NO: 1375462 - protein, 20 aa, Mycobacterium tuberculosis
ARPADLLVLLDSLRQREATL

SEQ ID NO: 1375463 - protein, 27 aa, Mycobacterium tuberculosis
ARPGTVWWRVTLPLLLPGVVSGSVLAF

SEQ ID NO: 1375464 - protein, 24 aa, Mycobacterium tuberculosis
ASEMARGWIVAAICALVVATALRL

SEQ ID NO: 1375465 - protein, 27 aa, Mycobacterium tuberculosis
ATFCLSFTRLPYFQTLGVPLAIGMVIV

SEQ ID NO: 1375466 - protein, 28 aa, Mycobacterium tuberculosis
ATLIRTPELYAWILVLPIGLMLQQSSLR

SEQ ID NO: 1375467 - protein, 26 aa, Mycobacterium tuberculosis
ATLVGACLRFPYTFATAKFGGRNWTI

SEQ ID NO: 1375468 - protein, 21 aa, Mycobacterium tuberculosis
ATPPGHGWPPGLPPLPRRPRR

SEQ ID NO: 1375469 - protein, 23 aa, Mycobacterium tuberculosis
ATVIGLLTILGFSLYDTVIVFDK

SEQ ID NO: 1375470 - protein, 24 aa, Mycobacterium tuberculosis
AVGSWWRYRYDKFGWTTRSSQLYE

SEQ ID NO: 1375471 - protein, 18 aa, Mycobacterium tuberculosis
AVGVIVWGLIFWSAVFHR

SEQ ID NO: 1375472 - protein, 25 aa, Mycobacterium tuberculosis
AVIGVAVATFAGWTLIAANPVAGMT

SEQ ID NO: 1375473 - protein, 25 aa, Mycobacterium tuberculosis
AVLALATPVVREWLFGTQQQPGWVG

SEQ ID NO: 1375474 - protein, 25 aa, Mycobacterium tuberculosis
AVPPAGNKRKVWAVVGAAAIVLVAI

SEQ ID NO: 1375475 - protein, 20 aa, Mycobacterium tuberculosis
AVVCAAVALVAFVILVQPTA

SEQ ID NO: 1375476 - protein, 28 aa, Mycobacterium tuberculosis
AVVNLKLLMPVFRWQRRDNLLTEPDPAA

SEQ ID NO: 1375477 - protein, 19 aa, Mycobacterium tuberculosis
CAAGLWAFLRTYRVWRAEG

SEQ ID NO: 1375478 - protein, 25 aa, Mycobacterium tuberculosis
CGTAPDLKGITGWLNTPGNKPIDLK

SEQ ID NO: 1375479 - protein, 19 aa, Mycobacterium tuberculosis
CRQQITATILLSWSQPTAQ

SEQ ID NO: 1375480 - protein, 18 aa, Mycobacterium tuberculosis
CVDYAKTRTLWGRNIGQF

SEQ ID NO: 1375481 - protein, 25 aa, Mycobacterium tuberculosis
DAADEYRPVAATVRHQAFSGDLIDQ

SEQ ID NO: 1375482 - protein, 22 aa, Mycobacterium tuberculosis
DDSRDAPTMAWKLFDLATTQRA

SEQ ID NO: 1375483 - protein, 29 aa, Mycobacterium tuberculosis
DERDRLALWSRVLPITFTAAGLVALVGGG

SEQ ID NO: 1375484 - protein, 17 aa, Mycobacterium tuberculosis
DGPYVLVGWSLGGVLAY

SEQ ID NO: 1375485 - protein, 25 aa, Mycobacterium tuberculosis
DGSPMCGDASMALTMALLAAAVLYA

SEQ ID NO: 1375486 - protein, 24 aa, Mycobacterium tuberculosis
DGSTGRRGAARSGYADPRVRLFSD

SEQ ID NO: 1375487 - protein, 18 aa, Mycobacterium tuberculosis
DLQIKWNGFQAGGPVRTV

SEQ ID NO: 1375488 - protein, 37 aa, Mycobacterium tuberculosis; identical to SEQ ID NO: 197967

SEQ ID NO: 1375489 - protein, 25 aa, Mycobacterium tuberculosis
DRFVRALSAAAGWYVDAEAANAALV

SEQ ID NO: 1375490 - protein, 22 aa, Mycobacterium tuberculosis
DRLPRLCRKYLLTPSRQAKERH

SEQ ID NO: 1375491 - protein, 24 aa, Mycobacterium tuberculosis
DRYELGEILGFGGMSEVHLARDLR

SEQ ID NO: 1375492 - protein, 19 aa, Mycobacterium tuberculosis
DSDLHWSILATRNDSEAFA

SEQ ID NO: 1375493 - protein, 21 aa, Mycobacterium tuberculosis
DTARWYLLKGRIADARSALRR

SEQ ID NO: 1375494 - protein, 23 aa, Mycobacterium tuberculosis
DVIHAFWVPEFLFKRDVMPNPVA

SEQ ID NO: 1375495 - protein, 20 aa, Mycobacterium tuberculosis
EAAMKYFLLGAFSSAFFLYG

SEQ ID NO: 1375496 - protein, 23 aa, Mycobacterium tuberculosis
EDGARPAPPDVIRAIEAQVWDGG

SEQ ID NO: 1375497 - protein, 23 aa, Mycobacterium tuberculosis
EGKKAVLWTSGWTPRYQGETIYL

SEQ ID NO: 1375498 - protein, 17 aa, Mycobacterium tuberculosis
EGTQFGPYRLRRLVGRG

SEQ ID NO: 1375499 - protein, 24 aa, Mycobacterium tuberculosis
EHAPELRVAGALRNVIADSQRRQH

SEQ ID NO: 1375500 - protein, 20 aa, Mycobacterium tuberculosis
EIRALTGLRIVAAVWVVLFH

SEQ ID NO: 1375501 - protein, 19 aa, Mycobacterium tuberculosis
ELFCTIRNFYDADPLAKAA

SEQ ID NO: 1375502 - protein, 40 aa, Mycobacterium tuberculosis; identical to SEQ ID NO: 156675

SEQ ID NO: 1375503 - protein, 24 aa, Mycobacterium tuberculosis
EPGIPAWRRILDDLSYEPVMAPLR

SEQ ID NO: 1375504 - protein, 19 aa, Mycobacterium tuberculosis
EQDLGFKIIFGLPGIVLAS

SEQ ID NO: 1375505 - protein, 25 aa, Mycobacterium tuberculosis
ERIFDPKVFVVSFVFNVLVAALIVY

SEQ ID NO: 1375506 - protein, 24 aa, Mycobacterium tuberculosis
ERLGKLHFWLTFIGFHTTFLVQHW

SEQ ID NO: 1375507 - protein, 20 aa, Mycobacterium tuberculosis
ERYMTISAITAMLFDLTVTA

SEQ ID NO: 1375508 - protein, 25 aa, Mycobacterium tuberculosis
ESAELCAQYLAPVLDAIKFNYFPFG

SEQ ID NO: 1375509 - protein, 25 aa, Mycobacterium tuberculosis
ETEHLPLLAPLRAIPVIGPPLAALV

SEQ ID NO: 1375510 - protein, 21 aa, Mycobacterium tuberculosis
ETPDFLPVVLEFAATVDPEAG

SEQ ID NO: 1375511 - protein, 24 aa, Mycobacterium tuberculosis
ETVNRCPVYMPFDDVDIALNLGDA

SEQ ID NO: 1375512 - protein, 20 aa, Mycobacterium tuberculosis
EVIQPYLPIAVVAALDAVFG

SEQ ID NO: 1375513 - protein, 20 aa, Mycobacterium tuberculosis
EWNHAYGIAALRAALIALAL

SEQ ID NO: 1375514 - protein, 18 aa, Mycobacterium tuberculosis
EYAGPRLALVEWAAGMRL

SEQ ID NO: 1375515 - protein, 26 aa, Mycobacterium tuberculosis
FAFFGWRWSLPLGVAILLAAVGGGLI

SEQ ID NO: 1375516 - protein, 22 aa, Mycobacterium tuberculosis
FAGGCRRPVWVTLIGNLLSLGV

SEQ ID NO: 1375517 - protein, 17 aa, Mycobacterium tuberculosis
FALFLYVVMLVFLVATA

SEQ ID NO: 1375518 - protein, 17 aa, Mycobacterium tuberculosis
FAVSGFLLWRGHAAAAR

SEQ ID NO: 1375519 - protein, 25 aa, Mycobacterium tuberculosis
FDYAARSQLWLSLLSWAVVVGCYLV

SEQ ID NO: 1375520 - protein, 18 aa, Mycobacterium tuberculosis
FENPDFKRGLKMFLSPDG

SEQ ID NO: 1375521 - protein, 21 aa, Mycobacterium tuberculosis
FGADLRPVLLRAMTFMIVASP

SEQ ID NO: 1375522 - protein, 18 aa, Mycobacterium tuberculosis
FGEFEFWFAGVKVATIVG

SEQ ID NO: 1375523 - protein, 17 aa, Mycobacterium tuberculosis
FGEFFAFTKVCSHLGCP

SEQ ID NO: 1375524 - protein, 21 aa, Mycobacterium tuberculosis
FGPYRLRRLVGRGGMGDVYEA

SEQ ID NO: 1375525 - protein, 17 aa, Mycobacterium tuberculosis
FGVAVAVMALVLSASLL

SEQ ID NO: 1375526 - protein, 17 aa, Mycobacterium tuberculosis
FISEFLVLLGTFSRYWL

SEQ ID NO: 1375527 - protein, 30 aa, Mycobacterium tuberculosis; identical to SEQ ID NO: 156835

SEQ ID NO: 1375528 - protein, 22 aa, Mycobacterium tuberculosis
FLYGGRSIWQYVTKAFPASVRD

SEQ ID NO: 1375529 - protein, 23 aa, Mycobacterium tuberculosis
FNLSRLNNVVNMFIGNSYVDNVK

SEQ ID NO: 1375530 - protein, 21 aa, Mycobacterium tuberculosis
FPGDLRPGLLSRIVAHVSTVI

SEQ ID NO: 1375531 - protein, 19 aa, Mycobacterium tuberculosis
FPRGNLIGIPGAPERMVQN

SEQ ID NO: 1375532 - protein, 17 aa, Mycobacterium tuberculosis
FRLAATLAVVLSVVMIV

SEQ ID NO: 1375533 - protein, 35 aa, Mycobacterium tuberculosis
FRPIRSYFYWEKHCYDIPVCWSLRSVFDTLDGIDV

SEQ ID NO: 1375534 - protein, 19 aa, Mycobacterium tuberculosis
FSNVSGLRQGQFVRASGVE

SEQ ID NO: 1375535 - protein, 17 aa, Mycobacterium tuberculosis
FTEVIVIANGVRAGRIK

SEQ ID NO: 1375536 - protein, 17 aa, Mycobacterium tuberculosis
FTGIDFRLSPSGVAVDS

SEQ ID NO: 1375537 - protein, 17 aa, Mycobacterium tuberculosis
FVIAMVLLRSSLAGFGH

SEQ ID NO: 1375538 - protein, 18 aa, Mycobacterium tuberculosis
FVREADVAAGLDHPNIVA

SEQ ID NO: 1375539 - protein, 17 aa, Mycobacterium tuberculosis
FWASLIKVIALVTFLIV

SEQ ID NO: 1375540 - protein, 18 aa, Mycobacterium tuberculosis
FYLPPEVFKNKDFQRAMK

SEQ ID NO: 1375541 - protein, 19 aa, Mycobacterium tuberculosis
GAFFCSVFLMHVSAGAWVT

SEQ ID NO: 1375542 - protein, 17 aa, Mycobacterium tuberculosis
GCAIGSAIVLASIVAGV

SEQ ID NO: 1375543 - protein, 26 aa, Mycobacterium tuberculosis
GEGACFRLTLPLVRGHKVTTSPLPMK

SEQ ID NO: 1375544 - protein, 23 aa, Mycobacterium tuberculosis
GELGEAATLAFLFSISEGLEEYA

SEQ ID NO: 1375545 - protein, 24 aa, Mycobacterium tuberculosis
GFSVGWLYWYFWVIVVGFEAVAGG

SEQ ID NO: 1375546 - protein, 34 aa, Mycobacterium tuberculosis; identical to SEQ ID NO: 157021

SEQ ID NO: 1375547 - protein, 23 aa, Mycobacterium tuberculosis
GGVRASWPWALVVFLVVVFVAPL

SEQ ID NO: 1375548 - protein, 18 aa, Mycobacterium tuberculosis
GLASWRPVTVAGLATGLL

SEQ ID NO: 1375549 - protein, 17 aa, Mycobacterium tuberculosis
GLGAVLIAHGLQKLFGW

SEQ ID NO: 1375550 - protein, 29 aa, Mycobacterium tuberculosis
GLLNRRAVLKSSYAQFIFLLSGADHDQMD

SEQ ID NO: 1375551 - protein, 17 aa, Mycobacterium tuberculosis
GPAFPDLPTHRHVAPEP

SEQ ID NO: 1375552 - protein, 21 aa, Mycobacterium tuberculosis
GPERFRQALFRALASVVEIWM

SEQ ID NO: 1375553 - protein, 26 aa, Mycobacterium tuberculosis
GQVFFCSLAGYAFARLQFRGRDTLFV

SEQ ID NO: 1375554 - protein, 31 aa, Mycobacterium tuberculosis; identical to SEQ ID NO: 157170

SEQ ID NO: 1375555 - protein, 17 aa, Mycobacterium tuberculosis
GRRDLGVAFGWSLFNWI

SEQ ID NO: 1375556 - protein, 24 aa, Mycobacterium tuberculosis
GTAPRARTAAFFDLDKTIIAKSST

SEQ ID NO: 1375557 - protein, 17 aa, Mycobacterium tuberculosis
GVILLFAGLAGRGVPAL

SEQ ID NO: 1375558 - protein, 17 aa, Mycobacterium tuberculosis
GVMRTWYLIGRKVAADP

SEQ ID NO: 1375559 - protein, 18 aa, Mycobacterium tuberculosis
GWYRRYLLVQVLFGSVVL

SEQ ID NO: 1375560 - protein, 24 aa, Mycobacterium tuberculosis
GYQDWVPAGGIAFGLFIVTNAAKL

SEQ ID NO: 1375561 - protein, 24 aa, Mycobacterium tuberculosis
HDYGEINGQFFVEMRMIDGTSLRA

SEQ ID NO: 1375562 - protein, 20 aa, Mycobacterium tuberculosis
HILLLPGIILALIGLHLALV

SEQ ID NO: 1375563 - protein, 18 aa, Mycobacterium tuberculosis
HRALMAIAFGDLGMANTT

SEQ ID NO: 1375564 - protein, 24 aa, Mycobacterium tuberculosis
HRRKRSESGVGIRGYRDEFLDATA

SEQ ID NO: 1375565 - protein, 17 aa, Mycobacterium tuberculosis
HRRSAMATLRIAFLSAL

SEQ ID NO: 1375566 - protein, 17 aa, Mycobacterium tuberculosis
HSAIRFAVVAAVVGVGF

SEQ ID NO: 1375567 - protein, 25 aa, Mycobacterium tuberculosis
IAALLGKWFWWPQVVRQRPVPQPWP

SEQ ID NO: 1375568 - protein, 18 aa, Mycobacterium tuberculosis
IAAVCLVFIVMLMITQSL

SEQ ID NO: 1375569 - protein, 17 aa, Mycobacterium tuberculosis
IAYCLGLGIPFVLLAFG

SEQ ID NO: 1375570 - protein, 19 aa, Mycobacterium tuberculosis
ICVTDPLAFTGCGCDGKAL

SEQ ID NO: 1375571 - protein, 19 aa, Mycobacterium tuberculosis
IFTGYPFLRGALRSLRSGK

SEQ ID NO: 1375572 - protein, 33 aa, Mycobacterium tuberculosis; identical to SEQ ID NO: 157390

SEQ ID NO: 1375573 - protein, 18 aa, Mycobacterium tuberculosis
IGGVALALLGVRRYVFAR

SEQ ID NO: 1375574 - protein, 18 aa, Mycobacterium tuberculosis
IGPSQAWYTENLRYYYLI

SEQ ID NO: 1375575 - protein, 18 aa, Mycobacterium tuberculosis
IIAGRPAPTDGFVGVAPD

SEQ ID NO: 1375576 - protein, 24 aa, Mycobacterium tuberculosis
IKVLLEVFPQAKFIHIVRDPYVVY

SEQ ID NO: 1375577 - protein, 17 aa, Mycobacterium tuberculosis
ILQDWRVVVRNRPFLTL

SEQ ID NO: 1375578 - protein, 21 aa, Mycobacterium tuberculosis
IPMKKMHAVSVPPNYAAALLA

SEQ ID NO: 1375579 - protein, 21 aa, Mycobacterium tuberculosis
IPRTVDFALEMRRIVDRFNCQ

SEQ ID NO: 1375580 - protein, 18 aa, Mycobacterium tuberculosis
IREQLNLGGIVNAQNAQL

SEQ ID NO: 1375581 - protein, 19 aa, Mycobacterium tuberculosis
IRHVIGIGTPKAVDLWLDV

SEQ ID NO: 1375582 - protein, 25 aa, Mycobacterium tuberculosis
IRKGAAAAVMKWVRDHGGHPTEEVG

SEQ ID NO: 1375583 - protein, 20 aa, Mycobacterium tuberculosis
IVVTCPHCFNTIGKEYRQLG

SEQ ID NO: 1375584 - protein, 18 aa, Mycobacterium tuberculosis
KANGYRLVTVSELLGPRA

SEQ ID NO: 1375585 - protein, 19 aa, Mycobacterium tuberculosis
KASAWVGALVTGWWIGVLA

SEQ ID NO: 1375586 - protein, 18 aa, Mycobacterium tuberculosis
KDPAYSHVSDELFATIGV

SEQ ID NO: 1375587 - protein, 31 aa, Mycobacterium tuberculosis
KFGHMLSGMAIRIVDVFRITRKVGVEESYGS

SEQ ID NO: 1375588 - protein, 20 aa, Mycobacterium tuberculosis
KPFFAQGLLNRRAVLKSSYA

SEQ ID NO: 1375589 - protein, 20 aa, Mycobacterium tuberculosis
KPQTVHWNLRLDVSDVDGKL

SEQ ID NO: 1375590 - protein, 22 aa, Mycobacterium tuberculosis
KVDWVRCDSRRAVAVEEAVAKQ

SEQ ID NO: 1375591 - protein, 18 aa, Mycobacterium tuberculosis
KYRPDFPKRFESIEAARV

SEQ ID NO: 1375592 - protein, 24 aa, Mycobacterium tuberculosis
LADDAKTRVIAFLRKPIVTVSLVG

SEQ ID NO: 1375593 - protein, 18 aa, Mycobacterium tuberculosis
LAHLCFIGALLPLARQAA

SEQ ID NO: 1375594 - protein, 17 aa, Mycobacterium tuberculosis
LALPFVILIGLIVSRQW

SEQ ID NO: 1375595 - protein, 18 aa, Mycobacterium tuberculosis
LARLMMRGWRRRSERQAE

SEQ ID NO: 1375596 - protein, 18 aa, Mycobacterium tuberculosis
LAVAAAVCAFLFMNNLTE

SEQ ID NO: 1375597 - protein, 19 aa, Mycobacterium tuberculosis
LAVLAILVWWALRHRNRCS

SEQ ID NO: 1375598 - protein, 21 aa, Mycobacterium tuberculosis
LAVVFALAATIGFGWTLLVLL

SEQ ID NO: 1375599 - protein, 18 aa, Mycobacterium tuberculosis
LDGRVVRLGRPGWLDAAE

SEQ ID NO: 1375600 - protein, 24 aa, Mycobacterium tuberculosis
LERQWRARMAGLRTNALVATGATL

SEQ ID NO: 1375601 - protein, 24 aa, Mycobacterium tuberculosis
LGLLWWMMVCWSQPLRARPDSQMF

SEQ ID NO: 1375602 - protein, 17 aa, Mycobacterium tuberculosis
LGSAGVRLLLVSELVVF

SEQ ID NO: 1375603 - protein, 22 aa, Mycobacterium tuberculosis
LHEVPVLSGLGLTMTGPRPGGF

SEQ ID NO: 1375604 - protein, 19 aa, Mycobacterium tuberculosis
LIALWRLDQLDGRGSIAQL

SEQ ID NO: 1375605 - protein, 17 aa, Mycobacterium tuberculosis
LIPLVPAAVVALALIVA

SEQ ID NO: 1375606 - protein, 35 aa, Mycobacterium tuberculosis; identical to SEQ ID NO: 160457

SEQ ID NO: 1375607 - protein, 19 aa, Mycobacterium tuberculosis
LIVITGLIGSFVFSLIRPN

SEQ ID NO: 1375608 - protein, 18 aa, Mycobacterium tuberculosis
LLAGAVSRTHWLASHLAM

SEQ ID NO: 1375609 - protein, 22 aa, Mycobacterium tuberculosis
LLAGIALLVSRQVVVPVRSASR

SEQ ID NO: 1375610 - protein, 26 aa, Mycobacterium tuberculosis
LLAVLRGRLHPIGGLGVALAVTVLLF

SEQ ID NO: 1375611 - protein, 21 aa, Mycobacterium tuberculosis
LLLIFLFWPWEFKAADGESDF

SEQ ID NO: 1375612 - protein, 19 aa, Mycobacterium tuberculosis
LLLSQLVPWLLTPLLMLGA

SEQ ID NO: 1375613 - protein, 17 aa, Mycobacterium tuberculosis
LPAVQRLVVPSAQNGDG

SEQ ID NO: 1375614 - protein, 18 aa, Mycobacterium tuberculosis
LPDGRHVWEYAPRDGNVD

SEQ ID NO: 1375615 - protein, 27 aa, Mycobacterium tuberculosis
LPDTRGRIVLRWLRIAVLIVTGLVTLQ

SEQ ID NO: 1375616 - protein, 18 aa, Mycobacterium tuberculosis
LPFTGLNTPLAVAVDSDR

SEQ ID NO: 1375617 - protein, 22 aa, Mycobacterium tuberculosis
LPFVILIGLIVSRQWKLLGAYA

SEQ ID NO: 1375618 - protein, 17 aa, Mycobacterium tuberculosis
LPTPRPAPPAQQLPSTP

SEQ ID NO: 1375619 - protein, 18 aa, Mycobacterium tuberculosis
LRKIVLKTAMPGIVTGML

SEQ ID NO: 1375620 - protein, 19 aa, Mycobacterium tuberculosis
LRLSRIDKPGVARVLDVVH

SEQ ID NO: 1375621 - protein, 19 aa, Mycobacterium tuberculosis
LRRFRSMGRLEPFAFTAVD

SEQ ID NO: 1375622 - protein, 25 aa, Mycobacterium tuberculosis
LRRGLRIALRGRRDPLPVAGRRSRT

SEQ ID NO: 1375623 - protein, 17 aa, Mycobacterium tuberculosis
LRTPLAAIQGYAELTRQ

SEQ ID NO: 1375624 - protein, 18 aa, Mycobacterium tuberculosis
LRWRASQLTLAIATCAGV

SEQ ID NO: 1375625 - protein, 25 aa, Mycobacterium tuberculosis
LSAVSSRAGVEIAIDDNGSGVPEGE

SEQ ID NO: 1375626 - protein, 18 aa, Mycobacterium tuberculosis
LSDAALVSHSWAMAFATL

SEQ ID NO: 1375627 - protein, 25 aa, Mycobacterium tuberculosis
LTAKLIIWYPHYAWLLLSVYLTVAL

SEQ ID NO: 1375628 - protein, 20 aa, Mycobacterium tuberculosis
LTGGAWQWSASKNSRLNMVS

SEQ ID NO: 1375629 - protein, 24 aa, Mycobacterium tuberculosis
LTGRTPLPPRRDWQLDTLDTELRR

SEQ ID NO: 1375630 - protein, 27 aa, Mycobacterium tuberculosis
LTMTGPRPGGFGALDGRTNEICAQGDL

SEQ ID NO: 1375631 - protein, 20 aa, Mycobacterium tuberculosis
LTYLDVCDQVLLLAPGGKTA

SEQ ID NO: 1375632 - protein, 26 aa, Mycobacterium tuberculosis
LVGAVVPHVRWPMWLRTAVATAALAA

SEQ ID NO: 1375633 - protein, 21 aa, Mycobacterium tuberculosis
LVRHVEKWAKVRGDKLAYRFL

SEQ ID NO: 1375634 - protein, 20 aa, Mycobacterium tuberculosis
LYRIRVGHRIGSAALIADGL

SEQ ID NO: 1375635 - protein, 19 aa, Mycobacterium tuberculosis
LYTGTGAFEVVGRRRLWFG

SEQ ID NO: 1375636 - protein, 18 aa, Mycobacterium tuberculosis
MGLHPLIFFLPVRQGANW

SEQ ID NO: 1375637 - protein, 18 aa, Mycobacterium tuberculosis
MIPLIGVRAACAATGRAP

SEQ ID NO: 1375638 - protein, 17 aa, Mycobacterium tuberculosis
MNIGRHCFSDYAMVAAA

SEQ ID NO: 1375639 - protein, 17 aa, Mycobacterium tuberculosis
MPAFPPYVPTLLPPPPP

SEQ ID NO: 1375640 - protein, 23 aa, Mycobacterium tuberculosis
MPLLGRASDRFGRKLMLQVSLAG

SEQ ID NO: 1375641 - protein, 26 aa, Mycobacterium tuberculosis
MRAMRRAGKVFNEFDSNSIAMVVLES

SEQ ID NO: 1375642 - protein, 18 aa, Mycobacterium tuberculosis
MSAPRRMLLFGLVVVVAL

SEQ ID NO: 1375643 - protein, 33 aa, Mycobacterium tuberculosis; identical to SEQ ID NO: 158143

SEQ ID NO: 1375644 - protein, 29 aa, Mycobacterium tuberculosis
MTPSIAALLGRWFWWPLRVRSRPARTPTV

SEQ ID NO: 1375645 - protein, 20 aa, Mycobacterium tuberculosis
MVFGELVPKYLAVARPLRTA

SEQ ID NO: 1375646 - protein, 25 aa, Mycobacterium tuberculosis
NALNEGRGDFFAVVRSLALFVNALH

SEQ ID NO: 1375647 - protein, 23 aa, Mycobacterium tuberculosis
NGSGPRFTAPMSKTGVPYGGILL

SEQ ID NO: 1375648 - protein, 22 aa, Mycobacterium tuberculosis
NPDRPPSRFYVRVISPDGQSYT

SEQ ID NO: 1375649 - protein, 26 aa, Mycobacterium tuberculosis
NPPPVPIPWSVLSLFVPGPTLSRADA

SEQ ID NO: 1375650 - protein, 17 aa, Mycobacterium tuberculosis
NPVIFWTPEHGAFVVRG

SEQ ID NO: 1375651 - protein, 18 aa, Mycobacterium tuberculosis
NRNLGWLFLFKQGNVSLA

SEQ ID NO: 1375652 - protein, 18 aa, Mycobacterium tuberculosis
NVDLAALVRAAAAHVLPD

SEQ ID NO: 1375653 - protein, 26 aa, Mycobacterium tuberculosis
NYFLTEPRYTWTIAEPDAAVTEFVLL

SEQ ID NO: 1375654 - protein, 17 aa, Mycobacterium tuberculosis
NYRRSRRPPPMPSANRY

SEQ ID NO: 1375655 - protein, 18 aa, Mycobacterium tuberculosis
PAAVPLEVPVRVTPGPDD

SEQ ID NO: 1375656 - protein, 22 aa, Mycobacterium tuberculosis
PAHRRGVALGAWGTVASVASLV

SEQ ID NO: 1375657 - protein, 19 aa, Mycobacterium tuberculosis
PAKPIAVNIIDFGADPDRA

SEQ ID NO: 1375658 - protein, 27 aa, Mycobacterium tuberculosis
PAPDSLIRMCLFLGALTFMYISARAVD

SEQ ID NO: 1375659 - protein, 18 aa, Mycobacterium tuberculosis
PASVIKVLVAMASINTLT

SEQ ID NO: 1375660 - protein, 18 aa, Mycobacterium tuberculosis
PDQVLGWAGYLRASQATG

SEQ ID NO: 1375661 - protein, 25 aa, Mycobacterium tuberculosis
PEAAALKCVRVRLRDEFGFPKSEIH

SEQ ID NO: 1375662 - protein, 27 aa, Mycobacterium tuberculosis
PEDSVAWEAGNKFIARRNLIWSVAAEH

SEQ ID NO: 1375663 - protein, 20 aa, Mycobacterium tuberculosis
PELLPSLLAAVHRRRRRTRL

SEQ ID NO: 1375664 - protein, 24 aa, Mycobacterium tuberculosis
PESYSLPLRRLLGLVAAGLDVSLI

SEQ ID NO: 1375665 - protein, 17 aa, Mycobacterium tuberculosis
PGIPGYIDQQWVTQAEA

SEQ ID NO: 1375666 - protein, 24 aa, Mycobacterium tuberculosis
PGLPLWPYLVCGALAGLGGGNFAA

SEQ ID NO: 1375667 - protein, 18 aa, Mycobacterium tuberculosis
PGQILVLLNVGAVFMGTA

SEQ ID NO: 1375668 - protein, 24 aa, Mycobacterium tuberculosis
PGVTVTIGITCHRTGPNAPCVELS

SEQ ID NO: 1375669 - protein, 21 aa, Mycobacterium tuberculosis
PGWPPRSSHRPSYSGEPAPTY

SEQ ID NO: 1375670 - protein, 24 aa, Mycobacterium tuberculosis
PHEECEVLVGLGMRTWADGRTLLL

SEQ ID NO: 1375671 - protein, 17 aa, Mycobacterium tuberculosis
PHLPPPPLVFAAEPAKT

SEQ ID NO: 1375672 - protein, 22 aa, Mycobacterium tuberculosis
PLALPLASLVFFGAFIPLIGAV

SEQ ID NO: 1375673 - protein, 25 aa, Mycobacterium tuberculosis
PNSGRRPMVLAARSLAALFAALALA

SEQ ID NO: 1375674 - protein, 25 aa, Mycobacterium tuberculosis
PNTRSFTGAGIWLGIAAFAAAGVVA

SEQ ID NO: 1375675 - protein, 19 aa, Mycobacterium tuberculosis
PPGRRRRARHASPADQAYN

SEQ ID NO: 1375676 - protein, 20 aa, Mycobacterium tuberculosis
PPLLKKLRIDPAIVSGPMIA

SEQ ID NO: 1375677 - protein, 26 aa, Mycobacterium tuberculosis
PPPPDHRARNIAIGFVGAVATGVLAM

SEQ ID NO: 1375678 - protein, 25 aa, Mycobacterium tuberculosis
PPSRPGEKNMPFWGTSFSAAYVSGV

SEQ ID NO: 1375679 - protein, 19 aa, Mycobacterium tuberculosis
PRTQIGFAVLVIVVVAVLA

SEQ ID NO: 1375680 - protein, 19 aa, Mycobacterium tuberculosis
PSAAAWLGAAARRRLVKLG

SEQ ID NO: 1375681 - protein, 23 aa, Mycobacterium tuberculosis
PSANLGANCQYPPSPDKAVKPVK

SEQ ID NO: 1375682 - protein, 17 aa, Mycobacterium tuberculosis
PSGFGFGLGNVILTINV

SEQ ID NO: 1375683 - protein, 19 aa, Mycobacterium tuberculosis
PSPGFPLTRAERLNVVFLL

SEQ ID NO: 1375684 - protein, 22 aa, Mycobacterium tuberculosis
PSWMPLWAFVIAMVLLRSSLAG

SEQ ID NO: 1375685 - protein, 22 aa, Mycobacterium tuberculosis
PTPAALFPVHIDPIAVPPQIGA

SEQ ID NO: 1375686 - protein, 18 aa, Mycobacterium tuberculosis
PVALFGRAAAKLEQITYR

SEQ ID NO: 1375687 - protein, 26 aa, Mycobacterium tuberculosis
PVLLEVWPVIAVGALAWLVAAVAAFV

SEQ ID NO: 1375688 - protein, 21 aa, Mycobacterium tuberculosis
PVLRPVGALGDFFAMTLDTSV

SEQ ID NO: 1375689 - protein, 20 aa, Mycobacterium tuberculosis
PVVIGAVLAIMVWRSASGPR

SEQ ID NO: 1375690 - protein, 21 aa, Mycobacterium tuberculosis
PYVLVGWSLGGVLAYACAIGL

SEQ ID NO: 1375691 - protein, 25 aa, Mycobacterium tuberculosis
QADGRNTLLLPFRVAAVHLILWDIG

SEQ ID NO: 1375692 - protein, 21 aa, Mycobacterium tuberculosis
QEERGRTAVFVGQDGQVVGVL

SEQ ID NO: 1375693 - protein, 20 aa, Mycobacterium tuberculosis
QGAVPGSPWWQHPVGSVTAL

SEQ ID NO: 1375694 - protein, 23 aa, Mycobacterium tuberculosis
QHGDENFLLVGMDSRAGANANIG

SEQ ID NO: 1375695 - protein, 23 aa, Mycobacterium tuberculosis
QPPPEVWSAATFITLAVCLGVGT

SEQ ID NO: 1375696 - protein, 33 aa, Mycobacterium tuberculosis; identical to SEQ ID NO: 160122

SEQ ID NO: 1375697 - protein, 17 aa, Mycobacterium tuberculosis
QRFFALFLYVVMLVFLV

SEQ ID NO: 1375698 - protein, 26 aa, Mycobacterium tuberculosis
QSSGFSVGDAISWSWNRFTQNAVTLV

SEQ ID NO: 1375699 - protein, 17 aa, Mycobacterium tuberculosis
RAAACLLEAIPRPGQTL

SEQ ID NO: 1375700 - protein, 24 aa, Mycobacterium tuberculosis
RAAGRARTLIYHRLAHGPAAAAVG

SEQ ID NO: 1375701 - protein, 20 aa, Mycobacterium tuberculosis
RAALPHFLGSAGVRLLLVSE

SEQ ID NO: 1375702 - protein, 20 aa, Mycobacterium tuberculosis
RAATTRFSVRMKHDDRKQTA

SEQ ID NO: 1375703 - protein, 27 aa, Mycobacterium tuberculosis
RAIGLFDTWPGLILPYITFALPLAIYT

SEQ ID NO: 1375704 - protein, 27 aa, Mycobacterium tuberculosis
RAIGWPETIFRFALYAFLCATALMVVR

SEQ ID NO: 1375705 - protein, 31 aa, Mycobacterium tuberculosis; identical to SEQ ID NO: 158606

SEQ ID NO: 1375706 - protein, 18 aa, Mycobacterium tuberculosis
RFGFLITALCLFTAVFIM

SEQ ID NO: 1375707 - protein, 17 aa, Mycobacterium tuberculosis
RGARGLERVVIFVTLGA

SEQ ID NO: 1375708 - protein, 22 aa, Mycobacterium tuberculosis
RGVGVCGGRVRGRVRIVRPETI

SEQ ID NO: 1375709 - protein, 36 aa, Mycobacterium tuberculosis; identical to SEQ ID NO: 160134

SEQ ID NO: 1375710 - protein, 22 aa, Mycobacterium tuberculosis
RIRELQRQLGILSQVNDNLAGL

SEQ ID NO: 1375711 - protein, 19 aa, Mycobacterium tuberculosis
RIVPEPGVRPGSGARVLVV

SEQ ID NO: 1375712 - protein, 21 aa, Mycobacterium tuberculosis
RKLQNPSWRPGAWACSLVVVA

SEQ ID NO: 1375713 - protein, 19 aa, Mycobacterium tuberculosis
RLAQQKVLLFGIAFALVTR

SEQ ID NO: 1375714 - protein, 26 aa, Mycobacterium tuberculosis
RLPYPGRIGLLFAVMPFHAFFGIALM

SEQ ID NO: 1375715 - protein, 19 aa, Mycobacterium tuberculosis
RLTGELPPGAVRIGRANDN

SEQ ID NO: 1375716 - protein, 20 aa, Mycobacterium tuberculosis
RPMFVALRLLPRFVWRRMPR

SEQ ID NO: 1375717 - protein, 17 aa, Mycobacterium tuberculosis
RPWNIKPGDVMPATYVG

SEQ ID NO: 1375718 - protein, 25 aa, Mycobacterium tuberculosis
RPYGPRPVVRELLLREGNDDPRTQV

SEQ ID NO: 1375719 - protein, 19 aa, Mycobacterium tuberculosis
RQAETPLLLAVDGTLVGLI

SEQ ID NO: 1375720 - protein, 18 aa, Mycobacterium tuberculosis
RQWAPYHLRLDWLMWFAA

SEQ ID NO: 1375721 - protein, 17 aa, Mycobacterium tuberculosis
RRASAYGVFAAGLGAAT

SEQ ID NO: 1375722 - protein, 18 aa, Mycobacterium tuberculosis
RRLPGGPVLKPAIGGLLV

SEQ ID NO: 1375723 - protein, 18 aa, Mycobacterium tuberculosis
RRMLRLIRRYGPIMTMPI

SEQ ID NO: 1375724 - protein, 20 aa, Mycobacterium tuberculosis
RRSAEPFLWLLFSAGGMVTA

SEQ ID NO: 1375725 - protein, 19 aa, Mycobacterium tuberculosis
RRTTLIVAHGLAIAEHADR

SEQ ID NO: 1375726 - protein, 24 aa, Mycobacterium tuberculosis
RRVPDVRGAVLLAFALGLLTLGLI

SEQ ID NO: 1375727 - protein, 18 aa, Mycobacterium tuberculosis
RSAILSAVIFNALVIVAL

SEQ ID NO: 1375728 - protein, 32 aa, Mycobacterium tuberculosis; identical to SEQ ID NO: 158830

SEQ ID NO: 1375729 - protein, 17 aa, Mycobacterium tuberculosis
RSLAALFAALALALTGG

SEQ ID NO: 1375730 - protein, 23 aa, Mycobacterium tuberculosis
RTLRTDLWWLPPLLTNLGLLAFI

SEQ ID NO: 1375731 - protein, 21 aa, Mycobacterium tuberculosis
RTSDMKALFTAIIDDDPLPLE

SEQ ID NO: 1375732 - protein, 18 aa, Mycobacterium tuberculosis
RVHVVIDDAMSWLRGAAV

SEQ ID NO: 1375733 - protein, 20 aa, Mycobacterium tuberculosis
RVVTIAGLVFAFTMGSMVAS

SEQ ID NO: 1375734 - protein, 19 aa, Mycobacterium tuberculosis
RYRALDFGLDVGRAQPPAS

SEQ ID NO: 1375735 - protein, 22 aa, Mycobacterium tuberculosis
SADSRAHCPLLCTDDPLPGTVP

SEQ ID NO: 1375736 - protein, 19 aa, Mycobacterium tuberculosis
SADVRMVLKSAAKLKRLAP

SEQ ID NO: 1375737 - protein, 18 aa, Mycobacterium tuberculosis
SASGLGFAIPVNEMKLVA

SEQ ID NO: 1375738 - protein, 28 aa, Mycobacterium tuberculosis
SAVAAVYVVFRWFFARDLRVVPDRQQLK

SEQ ID NO: 1375739 - protein, 23 aa, Mycobacterium tuberculosis
SDFARLGLLAGVILTSVWLFDCW

SEQ ID NO: 1375740 - protein, 24 aa, Mycobacterium tuberculosis
SDGEPATEWTLNWAHQLIENAPHP

SEQ ID NO: 1375741 - protein, 18 aa, Mycobacterium tuberculosis
SDILLKEYWNRPEATRDA

SEQ ID NO: 1375742 - protein, 30 aa, Mycobacterium tuberculosis; identical to SEQ ID NO: 158930

SEQ ID NO: 1375743 - protein, 17 aa, Mycobacterium tuberculosis
SENFDYMGLLLLSPGLA

SEQ ID NO: 1375744 - protein, 23 aa, Mycobacterium tuberculosis
SFDGYEYLFWVGCAGAYDDKAKK

SEQ ID NO: 1375745 - protein, 35 aa, Mycobacterium tuberculosis; identical to SEQ ID NO: 158949

SEQ ID NO: 1375746 - protein, 20 aa, Mycobacterium tuberculosis
SFTTLRLIYQEMLANYRVGQ

SEQ ID NO: 1375747 - protein, 18 aa, Mycobacterium tuberculosis
SFVTARTALLDGFLTFFV

SEQ ID NO: 1375748 - protein, 26 aa, Mycobacterium tuberculosis
SGTLSWCSPLGWSLQVRPYAGERWWV

SEQ ID NO: 1375749 - protein, 19 aa, Mycobacterium tuberculosis
SHPMLSLGLPMLFIALGGI

SEQ ID NO: 1375750 - protein, 20 aa, Mycobacterium tuberculosis
SLDAPLLRQIVNRGVVTAAG

SEQ ID NO: 1375751 - protein, 24 aa, Mycobacterium tuberculosis
SNTESRWRLGLYAAGRASQIRRLR

SEQ ID NO: 1375752 - protein, 22 aa, Mycobacterium tuberculosis
SPDRRIMLADFGIAGWVDDPSG

SEQ ID NO: 1375753 - protein, 24 aa, Mycobacterium tuberculosis
SPVGLPHRWARRRVAMAVTALLGY

SEQ ID NO: 1375754 - protein, 19 aa, Mycobacterium tuberculosis
SQIPGVAMVRGVTRPNGET

SEQ ID NO: 1375755 - protein, 21 aa, Mycobacterium tuberculosis
SRLNMVSALDPHSGDIVNPSG

SEQ ID NO: 1375756 - protein, 19 aa, Mycobacterium tuberculosis
SRLRQVLRNLVANAIQHTP

SEQ ID NO: 1375757 - protein, 17 aa, Mycobacterium tuberculosis
SRWAVFRRVLLPQLRPT

SEQ ID NO: 1375758 - protein, 19 aa, Mycobacterium tuberculosis
SSHELRTPLTAMRTNLEVL

SEQ ID NO: 1375759 - protein, 19 aa, Mycobacterium tuberculosis
SVLIVWRRDLRAIVRLLAW

SEQ ID NO: 1375760 - protein, 20 aa, Mycobacterium tuberculosis
SWVTPARWGFAASAATVDLI

SEQ ID NO: 1375761 - protein, 17 aa, Mycobacterium tuberculosis
TAALYVRVGEQLHPVLN

SEQ ID NO: 1375762 - protein, 26 aa, Mycobacterium tuberculosis
TAIATACPFCRVMVTDGVNDRQEEAG

SEQ ID NO: 1375763 - protein, 18 aa, Mycobacterium tuberculosis
TAVIFTRRRSMLTLADRV

SEQ ID NO: 1375764 - protein, 17 aa, Mycobacterium tuberculosis
TAVVVGLVLLQTGCGVG

SEQ ID NO: 1375765 - protein, 24 aa, Mycobacterium tuberculosis
TDMFPALAVAVTSQFAEPDDAEYP

SEQ ID NO: 1375766 - protein, 28 aa, Mycobacterium tuberculosis
TIQAAQLSALWARFPLPVIPAPGDPTPS

SEQ ID NO: 1375767 - protein, 21 aa, Mycobacterium tuberculosis
TKVCSHLGCPSSLYEQQSYRI

SEQ ID NO: 1375768 - protein, 19 aa, Mycobacterium tuberculosis
TLAARRTTLIVAHGLAIAE

SEQ ID NO: 1375769 - protein, 23 aa, Mycobacterium tuberculosis
TLVIAVLVWWHFVGANTSDDGYI

SEQ ID NO: 1375770 - protein, 28 aa, Mycobacterium tuberculosis
TMLLRVGARSSYLMGLAVFGLASLVCAA

SEQ ID NO: 1375771 - protein, 19 aa, Mycobacterium tuberculosis
TMPSEYRDLLGGLNVDQLK

SEQ ID NO: 1375772 - protein, 17 aa, Mycobacterium tuberculosis
TPLLLAVDGTLVGLISL

SEQ ID NO: 1375773 - protein, 23 aa, Mycobacterium tuberculosis
TPTKWTHHFGVFAGLAGSLGALA

SEQ ID NO: 1375774 - protein, 27 aa, Mycobacterium tuberculosis
TRFVMLRLAPGLGRLLGPIGRMAPRNI

SEQ ID NO: 1375775 - protein, 28 aa, Mycobacterium tuberculosis
TRRWRRVGTAIVRWPGPVLAATCLVASI

SEQ ID NO: 1375776 - protein, 20 aa, Mycobacterium tuberculosis
TSAFWAFGVFYLVASVLTWA

SEQ ID NO: 1375777 - protein, 30 aa, Mycobacterium tuberculosis; identical to SEQ ID NO: 159247

SEQ ID NO: 1375778 - protein, 22 aa, Mycobacterium tuberculosis
TSREFRAAGLTHLTAVSGANVT

SEQ ID NO: 1375779 - protein, 18 aa, Mycobacterium tuberculosis
TVILAVLVKPQFVVLGVV

SEQ ID NO: 1375780 - protein, 17 aa, Mycobacterium tuberculosis
TVLGRGGVGLSLGQRQR

SEQ ID NO: 1375781 - protein, 18 aa, Mycobacterium tuberculosis
TVTVTFMLVWLINHHGWS

SEQ ID NO: 1375782 - protein, 27 aa, Mycobacterium tuberculosis
TWRRPVVRIKLWLQYVIAGTPRMPDER

SEQ ID NO: 1375783 - protein, 23 aa, Mycobacterium tuberculosis
TWTLPVLGVWVIFSPWVLPGVAV

SEQ ID NO: 1375784 - protein, 19 aa, Mycobacterium tuberculosis
TYLTRVMLTAAEWTAVLIN

SEQ ID NO: 1375785 - protein, 25 aa, Mycobacterium tuberculosis
VAAAGYLVLRPSWSPTQASGQTVLP

SEQ ID NO: 1375786 - protein, 21 aa, Mycobacterium tuberculosis
VACQVPIFLMRSSPFTALELA

SEQ ID NO: 1375787 - protein, 19 aa, Mycobacterium tuberculosis
VAFVLTFLVTRSFVRFIHR

SEQ ID NO: 1375788 - protein, 21 aa, Mycobacterium tuberculosis
VAGCAYLLRRLFRGPRAPYLR

SEQ ID NO: 1375789 - protein, 19 aa, Mycobacterium tuberculosis
VAIACIIGALTLFSGPTGI

SEQ ID NO: 1375790 - protein, 30 aa, Mycobacterium tuberculosis; identical to SEQ ID NO: 159323

SEQ ID NO: 1375791 - protein, 22 aa, Mycobacterium tuberculosis
VALTVAAIVVWSSLVAAVLPPL

SEQ ID NO: 1375792 - protein, 18 aa, Mycobacterium tuberculosis
VAVGVCLLAGLVSFASPC

SEQ ID NO: 1375793 - protein, 20 aa, Mycobacterium tuberculosis
VAVMVPVFLGATLLIYGMVF

SEQ ID NO: 1375794 - protein, 25 aa, Mycobacterium tuberculosis
VDAEPRLRALGWTGMLDKGADVDAG

SEQ ID NO: 1375795 - protein, 20 aa, Mycobacterium tuberculosis
VDSMLGYVPAEFGPVYRFAE

SEQ ID NO: 1375796 - protein, 24 aa, Mycobacterium tuberculosis
VEIGKVKALHLVDGGRRVRVEFNI

SEQ ID NO: 1375797 - protein, 17 aa, Mycobacterium tuberculosis
VEMKLAGGCRLDKLDSE

SEQ ID NO: 1375798 - protein, 24 aa, Mycobacterium tuberculosis
VFTMMMRLPWLYRVPVHTIHKFGH

SEQ ID NO: 1375799 - protein, 19 aa, Mycobacterium tuberculosis
VGGALAWLAGETVQPLAYA

SEQ ID NO: 1375800 - protein, 26 aa, Mycobacterium tuberculosis
VGQAEILWDVIPFDWINDSNTAATRH

SEQ ID NO: 1375801 - protein, 21 aa, Mycobacterium tuberculosis
VGVAAVFRLAATLAVVLSVVM

SEQ ID NO: 1375802 - protein, 19 aa, Mycobacterium tuberculosis
VHAGLMFPAVVCTLAAVAS

SEQ ID NO: 1375803 - protein, 24 aa, Mycobacterium tuberculosis
VHLARIFFTGAFRRPRETNWVIGS

SEQ ID NO: 1375804 - protein, 18 aa, Mycobacterium tuberculosis
VILLRALVAPIYLIGSVL

SEQ ID NO: 1375805 - protein, 26 aa, Mycobacterium tuberculosis
VILTSVWLFDCWRLLVRPPHAGRRRG

SEQ ID NO: 1375806 - protein, 18 aa, Mycobacterium tuberculosis
VIQKLSGLSINRFIAIDF

SEQ ID NO: 1375807 - protein, 24 aa, Mycobacterium tuberculosis
VLASDRGAGVLGFAGTAGKESVGR

SEQ ID NO: 1375808 - protein, 19 aa, Mycobacterium tuberculosis
VLIGLALFALWPFTRLVHA

SEQ ID NO: 1375809 - protein, 23 aa, Mycobacterium tuberculosis
VLLIGLVRWYLGTALFDSIARKL

SEQ ID NO: 1375810 - protein, 23 aa, Mycobacterium tuberculosis
VLTFHWAQVVWSRTIVQLAAEER

SEQ ID NO: 1375811 - protein, 20 aa, Mycobacterium tuberculosis
VLTLRRWLRPATAAVVCCLA

SEQ ID NO: 1375812 - protein, 26 aa, Mycobacterium tuberculosis
VLVWQHLLGIQLYWIVLALAVILLLA

SEQ ID NO: 1375813 - protein, 18 aa, Mycobacterium tuberculosis
VMPFHAFFGIALMTMSST

SEQ ID NO: 1375814 - protein, 19 aa, Mycobacterium tuberculosis
VPKLRRWLATAVRPKLREV

SEQ ID NO: 1375815 - protein, 23 aa, Mycobacterium tuberculosis
VPLEAVPAFFRWLAQFEPMHQVF

SEQ ID NO: 1375816 - protein, 30 aa, Mycobacterium tuberculosis; identical to SEQ ID NO: 159546

SEQ ID NO: 1375817 - protein, 23 aa, Mycobacterium tuberculosis
VRKYLTLMAFRVPALILAAIAYG

SEQ ID NO: 1375818 - protein, 19 aa, Mycobacterium tuberculosis
VRLGSMYGYGISYAVASLS

SEQ ID NO: 1375819 - protein, 26 aa, Mycobacterium tuberculosis
VRYALRRLGALRVWPARARANTEIDD

SEQ ID NO: 1375820 - protein, 22 aa, Mycobacterium tuberculosis
VTADICSRIVSLPVHDHMAPDD

SEQ ID NO: 1375821 - protein, 25 aa, Mycobacterium tuberculosis
VVALAVLLCCWGFRVQRARHAQDQR

SEQ ID NO: 1375822 - protein, 38 aa, Mycobacterium tuberculosis
VVELRLPQELPMLAPGQEWRMVWDSALDRAEIGRGIES

SEQ ID NO: 1375823 - protein, 18 aa, Mycobacterium tuberculosis
VVGLGLFNPLSVGAGLIL

SEQ ID NO: 1375824 - protein, 25 aa, Mycobacterium tuberculosis
VVLRRARYRPLWVFLLVPVLILLTV

SEQ ID NO: 1375825 - protein, 19 aa, Mycobacterium tuberculosis
VVVAQRLVAIAGLAGLGIA

SEQ ID NO: 1375826 - protein, 17 aa, Mycobacterium tuberculosis
VVVDAAPGLGVLRDGQK

SEQ ID NO: 1375827 - protein, 17 aa, Mycobacterium tuberculosis
VVVLIGFWVAGSHEVQS

SEQ ID NO: 1375828 - protein, 25 aa, Mycobacterium tuberculosis
VWTVIAILALFGWPQVARIARGAVL

SEQ ID NO: 1375829 - protein, 19 aa, Mycobacterium tuberculosis
VYNMALVFRHRVRKDRLIS

SEQ ID NO: 1375830 - protein, 26 aa, Mycobacterium tuberculosis
VYTETKLNSAFSFGGPKCLVKVIQKL

SEQ ID NO: 1375831 - protein, 21 aa, Mycobacterium tuberculosis
WEAVDNRLGRRVAVKVLKSEF

SEQ ID NO: 1375832 - protein, 19 aa, Mycobacterium tuberculosis
WGVLASFFVSTLLRVAFPD

SEQ ID NO: 1375833 - protein, 17 aa, Mycobacterium tuberculosis
WLFMRFSGVVLVFLAIG

SEQ ID NO: 1375834 - protein, 18 aa, Mycobacterium tuberculosis
WLLHSRVTTFLSHPITAF

SEQ ID NO: 1375835 - protein, 26 aa, Mycobacterium tuberculosis
WRILLPHSRPAVLVLGVLTWVNVWND

SEQ ID NO: 1375836 - protein, 17 aa, Mycobacterium tuberculosis
WRRGRRPLETKVVLDWD

SEQ ID NO: 1375837 - protein, 20 aa, Mycobacterium tuberculosis
WSLVSPRLPAPWRIPLQAGL

SEQ ID NO: 1375838 - protein, 17 aa, Mycobacterium tuberculosis
WTVCDGLNAPSRGGADG

SEQ ID NO: 1375839 - protein, 19 aa, Mycobacterium tuberculosis
WVIQAPRLFAGQIDFGDVG

SEQ ID NO: 1375840 - protein, 20 aa, Mycobacterium tuberculosis
WWCVARRSWHAPRLGSISAG

SEQ ID NO: 1375841 - protein, 18 aa, Mycobacterium tuberculosis
WYADLPVASPQVFGDQTD

SEQ ID NO: 1375842 - protein, 22 aa, Mycobacterium tuberculosis
WYTENLRYYYLILPTVDGSLSR

SEQ ID NO: 1375843 - protein, 17 aa, Mycobacterium tuberculosis
YDYPLAAALSLVVLFTL

SEQ ID NO: 1375844 - protein, 19 aa, Mycobacterium tuberculosis
YFLLAPMLIVFSVAVAGVL

SEQ ID NO: 1375845 - protein, 32 aa, Mycobacterium tuberculosis; identical to SEQ ID NO: 159799

SEQ ID NO: 1375846 - protein, 17 aa, Mycobacterium tuberculosis
YLLWAIIPLAAWATRPG

SEQ ID NO: 1375847 - protein, 20 aa, Mycobacterium tuberculosis
YLRFRREAQNAAALNHPAIV

SEQ ID NO: 1375848 - protein, 23 aa, Mycobacterium tuberculosis
YNVRRLPPPVVEPGPDRRPITAV

SEQ ID NO: 1375849 - protein, 28 aa, Mycobacterium tuberculosis
YPPQQYPPGWPAGPYPPGPPPPGPGSKT

SEQ ID NO: 1375850 - protein, 23 aa, Mycobacterium tuberculosis
YREAKARLGDPVAAWADIQADPR

SEQ ID NO: 1375851 - protein, 17 aa, Mycobacterium tuberculosis
YTSEFLLGYLADYQIPT

SEQ ID NO: 1375852 - protein, 29 aa, Mycobacterium tuberculosis
AAARSSALPAYWERLAVCWQLGSDHGLAI

SEQ ID NO: 1375853 - protein, 20 aa, Mycobacterium tuberculosis
AAAVGARLMQLRGRRSATST

SEQ ID NO: 1375854 - protein, 23 aa, Mycobacterium tuberculosis
AADALPVRVGVAVIGALIVFGLI

SEQ ID NO: 1375855 - protein, 18 aa, Mycobacterium tuberculosis
AAFQLARSDADIAALAEV

SEQ ID NO: 1375856 - protein, 20 aa, Mycobacterium tuberculosis
AAKLYPLLFLYPLLLLGIRA

SEQ ID NO: 1375857 - protein, 20 aa, Mycobacterium tuberculosis
AALQRCGRVTAMVGDGANDA

SEQ ID NO: 1375858 - protein, 17 aa, Mycobacterium tuberculosis
AALTHWVDTGGYAKVIA

SEQ ID NO: 1375859 - protein, 24 aa, Mycobacterium tuberculosis
AAVFFFLGCFTIVGTRQFAIMTTF

SEQ ID NO: 1375860 - protein, 21 aa, Mycobacterium tuberculosis
AAVQLPAVWLLSAVTVGLFGL

SEQ ID NO: 1375861 - protein, 19 aa, Mycobacterium tuberculosis
AEALCWDVGEVVELRGRAA

SEQ ID NO: 1375862 - protein, 18 aa, Mycobacterium tuberculosis
AEMIPAITKYMSALDVAV

SEQ ID NO: 1375863 - protein, 21 aa, Mycobacterium tuberculosis
AESRLNRLLAQQIPPARKVLA

SEQ ID NO: 1375864 - protein, 17 aa, Mycobacterium tuberculosis
AFDLFVGAIQAFIFALL

SEQ ID NO: 1375865 - protein, 24 aa, Mycobacterium tuberculosis
AGAAICLLALMATLATASRRLRPG

SEQ ID NO: 1375866 - protein, 19 aa, Mycobacterium tuberculosis
AGAPPWYADVLLPDLGAAW

SEQ ID NO: 1375867 - protein, 19 aa, Mycobacterium tuberculosis
AGIILNLVTGPGFYDIALR

SEQ ID NO: 1375868 - protein, 17 aa, Mycobacterium tuberculosis
AGLVGFIGNEWVALYRI

SEQ ID NO: 1375869 - protein, 24 aa, Mycobacterium tuberculosis
AGQLHRVRMLLLTNCTFDGVVYNP

SEQ ID NO: 1375870 - protein, 18 aa, Mycobacterium tuberculosis
AGVDEWFICGPLAMATAV

SEQ ID NO: 1375871 - protein, 25 aa, Mycobacterium tuberculosis
AHLQRARVPMPIIAVSSLLRSHAVT

SEQ ID NO: 1375872 - protein, 27 aa, Mycobacterium tuberculosis
AIGVLIITVMVCWLLLAVLRGRLHPIG

SEQ ID NO: 1375873 - protein, 18 aa, Mycobacterium tuberculosis
AIHRAWRPTASSDLSVLV

SEQ ID NO: 1375874 - protein, 17 aa, Mycobacterium tuberculosis
AIPAPWPVLATLPSGPE

SEQ ID NO: 1375875 - protein, 23 aa, Mycobacterium tuberculosis
AISRGVLHYCERLATHDTALRAA

SEQ ID NO: 1375876 - protein, 17 aa, Mycobacterium tuberculosis
AKAGLFPFHTWLADAHS

SEQ ID NO: 1375877 - protein, 26 aa, Mycobacterium tuberculosis
AKARKAKAPKLVRPTPMERLAARLTS

SEQ ID NO: 1375878 - protein, 22 aa, Mycobacterium tuberculosis
AKTYRWTFADVKGSPPTITVID

SEQ ID NO: 1375879 - protein, 24 aa, Mycobacterium tuberculosis
ALGEGCCFRVSLPRVSDVDQLSLT

SEQ ID NO: 1375880 - protein, 18 aa, Mycobacterium tuberculosis
ALLTRRWALAWVALAGSA

SEQ ID NO: 1375881 - protein, 22 aa, Mycobacterium tuberculosis
ALPRRIHAFVRWVVRTPWPLFS

SEQ ID NO: 1375882 - protein, 20 aa, Mycobacterium tuberculosis
ANLADIWRRRDLPRDAKAPV

SEQ ID NO: 1375883 - protein, 18 aa, Mycobacterium tuberculosis
APAARLLSIRAMSTKFSP

SEQ ID NO: 1375884 - protein, 26 aa, Mycobacterium tuberculosis
APPGRLPSWLRPRLGDEHARERTPDA

SEQ ID NO: 1375885 - protein, 17 aa, Mycobacterium tuberculosis
APTVRLGSMYGYGISYA

SEQ ID NO: 1375886 - protein, 25 aa, Mycobacterium tuberculosis
ARDLQRPDAPWGRPRVVYLQHASDP

SEQ ID NO: 1375887 - protein, 25 aa, Mycobacterium tuberculosis
ARLISSLCGLLCTFTVSRVIVGVVL

SEQ ID NO: 1375888 - protein, 21 aa, Mycobacterium tuberculosis
ARRLSHFGALVRIPRSVEALG

SEQ ID NO: 1375889 - protein, 17 aa, Mycobacterium tuberculosis
ASLQEWEPQGWKSEERA

SEQ ID NO: 1375890 - protein, 20 aa, Mycobacterium tuberculosis
ASYLKDDWFRDWGALQRLTP

SEQ ID NO: 1375891 - protein, 18 aa, Mycobacterium tuberculosis
ATAVPWARQRTAMIAAER

SEQ ID NO: 1375892 - protein, 19 aa, Mycobacterium tuberculosis
ATIMVCFHLGILTAIPMGV

SEQ ID NO: 1375893 - protein, 29 aa, Mycobacterium tuberculosis
ATPYELAATIARRLGLTGALGTVAESVDG

SEQ ID NO: 1375894 - protein, 23 aa, Mycobacterium tuberculosis
AVEAPEFHSAVLAELTLIGHRGP

SEQ ID NO: 1375895 - protein, 24 aa, Mycobacterium tuberculosis
AVKGSLWWDIWSLGLLVLIPAVVY

SEQ ID NO: 1375896 - protein, 20 aa, Mycobacterium tuberculosis
AVLRLARRSAASGAALADGI

SEQ ID NO: 1375897 - protein, 19 aa, Mycobacterium tuberculosis
AVNPWQWLLALLQQLWNAY

SEQ ID NO: 1375898 - protein, 19 aa, Mycobacterium tuberculosis
AVRMFRPVSMQVLAICVLV

SEQ ID NO: 1375899 - protein, 23 aa, Mycobacterium tuberculosis
AVRPEALSVVGWYLVAATAAAAT

SEQ ID NO: 1375900 - protein, 29 aa, Mycobacterium tuberculosis
AYDLAKGCALTVIRAAFQLARSDADIAAL

SEQ ID NO: 1375901 - protein, 29 aa, Mycobacterium tuberculosis
AYMTYRRGRPLSVRWLLEPVVGRGRVEGA

SEQ ID NO: 1375902 - protein, 25 aa, Mycobacterium tuberculosis
AYSEPRLQPPNGYKDTTVPGIWVPD

SEQ ID NO: 1375903 - protein, 20 aa, Mycobacterium tuberculosis
CAACGLVYELALLTLAASLN

SEQ ID NO: 1375904 - protein, 17 aa, Mycobacterium tuberculosis
CHADLRVADGSVDATLL

SEQ ID NO: 1375905 - protein, 19 aa, Mycobacterium tuberculosis
DFSEFDLAFRPDDASSFGD

SEQ ID NO: 1375906 - protein, 19 aa, Mycobacterium tuberculosis
DKRLLPYMIGAFLLIVGAS

SEQ ID NO: 1375907 - protein, 31 aa, Mycobacterium tuberculosis; identical to SEQ ID NO: 156492

SEQ ID NO: 1375908 - protein, 17 aa, Mycobacterium tuberculosis
DPRRVRWIVGERADTNG

SEQ ID NO: 1375909 - protein, 26 aa, Mycobacterium tuberculosis
DPVPFPSFKNGVGLMLQLPQATVVGT

SEQ ID NO: 1375910 - protein, 21 aa, Mycobacterium tuberculosis
DREPEQLWQVAKLRRAAFSGV

SEQ ID NO: 1375911 - protein, 22 aa, Mycobacterium tuberculosis
DRGVGWKTLRDAGPVVFMNGWY

SEQ ID NO: 1375912 - protein, 31 aa, Mycobacterium tuberculosis; identical to SEQ ID NO: 156561

SEQ ID NO: 1375913 - protein, 24 aa, Mycobacterium tuberculosis
DTLWPRFLAGKGVMLSEPMVSRQH

SEQ ID NO: 1375914 - protein, 25 aa, Mycobacterium tuberculosis
DTSPRPLPSGTYCKIPQDAQLQVRG

SEQ ID NO: 1375915 - protein, 17 aa, Mycobacterium tuberculosis
DVLLPDLGAAWRVLHAI

SEQ ID NO: 1375916 - protein, 22 aa, Mycobacterium tuberculosis
DVRRAPHAGGREVLRVEVGAPS

SEQ ID NO: 1375917 - protein, 17 aa, Mycobacterium tuberculosis
EEVLRCAAHAAPASNGP

SEQ ID NO: 1375918 - protein, 20 aa, Mycobacterium tuberculosis
EGRTAYLVMELVNGEPLNSV

SEQ ID NO: 1375919 - protein, 20 aa, Mycobacterium tuberculosis
EHRDGGAFIPKVAVTGSLAL

SEQ ID NO: 1375920 - protein, 18 aa, Mycobacterium tuberculosis
EKIEQRYSLGMVAATLAL

SEQ ID NO: 1375921 - protein, 26 aa, Mycobacterium tuberculosis
EKPPRLYRAAAWVVIVAGIVFTVAVI

SEQ ID NO: 1375922 - protein, 26 aa, Mycobacterium tuberculosis
ELTFRRIAAALGRPMVPIGSPVLRRV

SEQ ID NO: 1375923 - protein, 23 aa, Mycobacterium tuberculosis
ENLSCSVIKCVALTFDDGPGPYT

SEQ ID NO: 1375924 - protein, 25 aa, Mycobacterium tuberculosis
EPTTRLRKDLTWWDLVVFGVSVVIG

SEQ ID NO: 1375925 - protein, 24 aa, Mycobacterium tuberculosis
ERNLSVALNEVFAGFNPLDPRNLD

SEQ ID NO: 1375926 - protein, 18 aa, Mycobacterium tuberculosis
ETRLPLIVQNTHRYFFYI

SEQ ID NO: 1375927 - protein, 20 aa, Mycobacterium tuberculosis
EVRRQSRWRTAAFASAAAIA

SEQ ID NO: 1375928 - protein, 21 aa, Mycobacterium tuberculosis
FCGVAVCALIAYLVGQSKGYF

SEQ ID NO: 1375929 - protein, 18 aa, Mycobacterium tuberculosis
FDRLPRRLVERVTPKPGT

SEQ ID NO: 1375930 - protein, 17 aa, Mycobacterium tuberculosis
FFTAIFLRDLRIPAMAA

SEQ ID NO: 1375931 - protein, 17 aa, Mycobacterium tuberculosis
FGGLMLLGGRLGDTIGR

SEQ ID NO: 1375932 - protein, 20 aa, Mycobacterium tuberculosis
FGMLRYCLQLFPDPSTYFRP

SEQ ID NO: 1375933 - protein, 30 aa, Mycobacterium tuberculosis; identical to SEQ ID NO: 156814

SEQ ID NO: 1375934 - protein, 24 aa, Mycobacterium tuberculosis
FIGGLLCVIPGLIFGFVAQFAVAF

SEQ ID NO: 1375935 - protein, 17 aa, Mycobacterium tuberculosis
FLMFSWMQVFTASGFAF

SEQ ID NO: 1375936 - protein, 23 aa, Mycobacterium tuberculosis
FPDLEVCVYAAPTQTVIGGPPEQ

SEQ ID NO: 1375937 - protein, 25 aa, Mycobacterium tuberculosis
FPGKRAPTVQLCRDPRGYVPVGTNP

SEQ ID NO: 1375938 - protein, 19 aa, Mycobacterium tuberculosis
FPMNAMTPMVLFIKSPRDL

SEQ ID NO: 1375939 - protein, 20 aa, Mycobacterium tuberculosis
FPVVVATLFGLIIAMPLGIW

SEQ ID NO: 1375940 - protein, 17 aa, Mycobacterium tuberculosis
FRGARGAIQATLDRDLP

SEQ ID NO: 1375941 - protein, 17 aa, Mycobacterium tuberculosis
FRPQPVSVWASATATLL

SEQ ID NO: 1375942 - protein, 20 aa, Mycobacterium tuberculosis
FRSVWITVLLTRLAIVAAVA

SEQ ID NO: 1375943 - protein, 20 aa, Mycobacterium tuberculosis
FSRDEFKKGAQIFLSADGHA

SEQ ID NO: 1375944 - protein, 18 aa, Mycobacterium tuberculosis
GAAMAFSSFFVVSNSLRL

SEQ ID NO: 1375945 - protein, 27 aa, Mycobacterium tuberculosis
GAANRDGRRLMTVLLHGTRQPIPPWEQ

SEQ ID NO: 1375946 - protein, 22 aa, Mycobacterium tuberculosis
GAAQLPLAPAINYPPPCLTGFL

SEQ ID NO: 1375947 - protein, 21 aa, Mycobacterium tuberculosis
GAEGWECQRAMSVANNVVVDV

SEQ ID NO: 1375948 - protein, 17 aa, Mycobacterium tuberculosis
GAFFAAIVGVLGLMGGL

SEQ ID NO: 1375949 - protein, 17 aa, Mycobacterium tuberculosis
GAIASMWLGVHLVPISI

SEQ ID NO: 1375950 - protein, 18 aa, Mycobacterium tuberculosis
GALLIVIFATSGALEALV

SEQ ID NO: 1375951 - protein, 22 aa, Mycobacterium tuberculosis
GCSLRLPGIYPPQVYNGRLHVD

SEQ ID NO: 1375952 - protein, 23 aa, Mycobacterium tuberculosis
GDHFGEACLLGGMRRIATVRACE

SEQ ID NO: 1375953 - protein, 23 aa, Mycobacterium tuberculosis
GEYTRLGLCTVPAALAMAVLALW

SEQ ID NO: 1375954 - protein, 20 aa, Mycobacterium tuberculosis
GFSVWSLWSVMVLFMPTSVY

SEQ ID NO: 1375955 - protein, 19 aa, Mycobacterium tuberculosis
GFTGLPRRASTVALVALVA

SEQ ID NO: 1375956 - protein, 19 aa, Mycobacterium tuberculosis
GGKILRAALNPDLSLSPIA

SEQ ID NO: 1375957 - protein, 19 aa, Mycobacterium tuberculosis
GGTTVSFPRGSTQVAQVED

SEQ ID NO: 1375958 - protein, 17 aa, Mycobacterium tuberculosis
GGVGLSLGQRQRLGLAR

SEQ ID NO: 1375959 - protein, 17 aa, Mycobacterium tuberculosis
GKSELFLSLVYGIALTH

SEQ ID NO: 1375960 - protein, 18 aa, Mycobacterium tuberculosis
GLLHWSVPMLVRRLITLG

SEQ ID NO: 1375961 - protein, 22 aa, Mycobacterium tuberculosis
GLTGPWLLRVGFGPDYQTGGAL

SEQ ID NO: 1375962 - protein, 23 aa, Mycobacterium tuberculosis
GMSEVHLARDLRLHRDVAVKVLR

SEQ ID NO: 1375963 - protein, 19 aa, Mycobacterium tuberculosis
GPKCLVKVIQKLSGLSINR

SEQ ID NO: 1375964 - protein, 17 aa, Mycobacterium tuberculosis
GPVAPGPGMGWVFGFPG

SEQ ID NO: 1375965 - protein, 29 aa, Mycobacterium tuberculosis
GRGLAARHYFTYRDVLGFLYAQAKFQLLG

SEQ ID NO: 1375966 - protein, 24 aa, Mycobacterium tuberculosis
GRHFSRARLNPEVLLIETDHDMRN

SEQ ID NO: 1375967 - protein, 19 aa, Mycobacterium tuberculosis
GSIVWSLPIGREIDAFHGI

SEQ ID NO: 1375968 - protein, 23 aa, Mycobacterium tuberculosis
GSMVFAILVLLGRYINYTLDLAG

SEQ ID NO: 1375969 - protein, 23 aa, Mycobacterium tuberculosis
GSQIPALVAYTVFTAALVFGVAT

SEQ ID NO: 1375970 - protein, 18 aa, Mycobacterium tuberculosis
GTVVRFDGAVPFVNLQVS

SEQ ID NO: 1375971 - protein, 17 aa, Mycobacterium tuberculosis
GTWRDGAVVPRIEFDDV

SEQ ID NO: 1375972 - protein, 17 aa, Mycobacterium tuberculosis
GVLLVFYTATGRYVAAF

SEQ ID NO: 1375973 - protein, 21 aa, Mycobacterium tuberculosis
GVMRRSRLIGVSFAVGLIVLL

SEQ ID NO: 1375974 - protein, 26 aa, Mycobacterium tuberculosis
GWALRAIVAALLEWQRKSELSGDRAG

SEQ ID NO: 1375975 - protein, 21 aa, Mycobacterium tuberculosis
GWLVKGRSDTRLYYTPEDPTY

SEQ ID NO: 1375976 - protein, 24 aa, Mycobacterium tuberculosis
HFFGCTPLGPVAWTGVFSATAGAT

SEQ ID NO: 1375977 - protein, 24 aa, Mycobacterium tuberculosis
HIVDVKRALAWVKENIAAYGGDPN

SEQ ID NO: 1375978 - protein, 26 aa, Mycobacterium tuberculosis
HLLGHSLPLFGLAGLPSYDRWDDTSI

SEQ ID NO: 1375979 - protein, 19 aa, Mycobacterium tuberculosis
HLLGRPLGRLVDRDNAVED

SEQ ID NO: 1375980 - protein, 24 aa, Mycobacterium tuberculosis
HMEVGSPYAVEYVWGRQVGDNTIN

SEQ ID NO: 1375981 - protein, 31 aa, Mycobacterium tuberculosis; identical to SEQ ID NO: 157287

SEQ ID NO: 1375982 - protein, 26 aa, Mycobacterium tuberculosis
HSPDLDWKSVWDHGWSAAAEAADKPV

SEQ ID NO: 1375983 - protein, 27 aa, Mycobacterium tuberculosis
IDHLRRHSLPLFGYAAMPAYDVVDGVS

SEQ ID NO: 1375984 - protein, 25 aa, Mycobacterium tuberculosis
IDWAPYVVLVGIGWVIMLVTQTSSC

SEQ ID NO: 1375985 - protein, 26 aa, Mycobacterium tuberculosis
IGALFFPWNLYFGFRIPDSSKTVFGL

SEQ ID NO: 1375986 - protein, 24 aa, Mycobacterium tuberculosis
IHLLNLPPAGLLPIAAALGPGDQW

SEQ ID NO: 1375987 - protein, 25 aa, Mycobacterium tuberculosis
ILDIFSRYVVGWMVASRESKVLAER

SEQ ID NO: 1375988 - protein, 17 aa, Mycobacterium tuberculosis
ILEGFDFGVGMLMAPFA

SEQ ID NO: 1375989 - protein, 19 aa, Mycobacterium tuberculosis
ILIDRYWWTALAVTLAITA

SEQ ID NO: 1375990 - protein, 22 aa, Mycobacterium tuberculosis
ILKVLRERDAMVAKTLADNKKS

SEQ ID NO: 1375991 - protein, 17 aa, Mycobacterium tuberculosis
INAYRPLARNGFASLWS

SEQ ID NO: 1375992 - protein, 17 aa, Mycobacterium tuberculosis
INSVVLRIACFYVGSTV

SEQ ID NO: 1375993 - protein, 19 aa, Mycobacterium tuberculosis
IRSLARAVVHAANLGVGVI

SEQ ID NO: 1375994 - protein, 17 aa, Mycobacterium tuberculosis
IRVHPLLAVGLNIVAVS

SEQ ID NO: 1375995 - protein, 21 aa, Mycobacterium tuberculosis
ITFGALWLLYRYYRTGDPLFW

SEQ ID NO: 1375996 - protein, 19 aa, Mycobacterium tuberculosis
ITGAEAWLVSSYALCTQVL

SEQ ID NO: 1375997 - protein, 22 aa, Mycobacterium tuberculosis
IVSALHRPVPLSGEGSDTDTVI

SEQ ID NO: 1375998 - protein, 17 aa, Mycobacterium tuberculosis
KIVGKLAQFGSGMLQQV

SEQ ID NO: 1375999 - protein, 17 aa, Mycobacterium tuberculosis
KRIPSVARGPAWRLMGV

SEQ ID NO: 1376000 - protein, 23 aa, Mycobacterium tuberculosis
KRTWSSGSLPGVFPVPLTISGDP

SEQ ID NO: 1376001 - protein, 20 aa, Mycobacterium tuberculosis
KSLHDMGEFYGRNIFMAETS

SEQ ID NO: 1376002 - protein, 19 aa, Mycobacterium tuberculosis
KTPWWEDRFQQEPKQPPAP

SEQ ID NO: 1376003 - protein, 27 aa, Mycobacterium tuberculosis
LAALIRARFPTLTARQVMQRIESTAHH

SEQ ID NO: 1376004 - protein, 29 aa, Mycobacterium tuberculosis
LALGGRALRWPRFPLVIEAAVAAVDHQPL

SEQ ID NO: 1376005 - protein, 18 aa, Mycobacterium tuberculosis
LALGSYWAMFILVPGTLV

SEQ ID NO: 1376006 - protein, 28 aa, Mycobacterium tuberculosis
LAPAAWWRQLSWLPQRPVLVPGTVRHNL

SEQ ID NO: 1376007 - protein, 27 aa, Mycobacterium tuberculosis
LASALAPPCIIAFLETRYWWAGIALAS

SEQ ID NO: 1376008 - protein, 18 aa, Mycobacterium tuberculosis
LAYFFGPVVVFWVLAGMA

SEQ ID NO: 1376009 - protein, 26 aa, Mycobacterium tuberculosis
LDELQAFDVFSSFWFTAIYVLLFVSL

SEQ ID NO: 1376010 - protein, 18 aa, Mycobacterium tuberculosis
LFAVVGLLFLGTVALTLA

SEQ ID NO: 1376011 - protein, 17 aa, Mycobacterium tuberculosis
LFDFNVGVMRWRWRVAF

SEQ ID NO: 1376012 - protein, 19 aa, Mycobacterium tuberculosis
LGAIGIWIAIRPKPVQPPQ

SEQ ID NO: 1376013 - protein, 17 aa, Mycobacterium tuberculosis
LGALAFVAGCSVLVRPE

SEQ ID NO: 1376014 - protein, 20 aa, Mycobacterium tuberculosis
LGALLMLPGVRGLGPGPVTT

SEQ ID NO: 1376015 - protein, 17 aa, Mycobacterium tuberculosis
LGHALSGHAVYRTMMMH

SEQ ID NO: 1376016 - protein, 26 aa, Mycobacterium tuberculosis
LGTTVGLLPAWQIVLILLLLGVLGLR

SEQ ID NO: 1376017 - protein, 18 aa, Mycobacterium tuberculosis
LGVHRIFLITVALALLTA

SEQ ID NO: 1376018 - protein, 20 aa, Mycobacterium tuberculosis
LIERRCMLYAGTTVVSGTAV

SEQ ID NO: 1376019 - protein, 19 aa, Mycobacterium tuberculosis
LKMPYPRFLAANVTGGICW

SEQ ID NO: 1376020 - protein, 24 aa, Mycobacterium tuberculosis
LKTVPKRLSALLNTSGLPAVLEPF

SEQ ID NO: 1376021 - protein, 17 aa, Mycobacterium tuberculosis
LLERAAAIGARYQQAFA

SEQ ID NO: 1376022 - protein, 22 aa, Mycobacterium tuberculosis
LLGPRLPRILAAVALGVLSLGS

SEQ ID NO: 1376023 - protein, 18 aa, Mycobacterium tuberculosis
LLRSLGISDPRELDVDRL

SEQ ID NO: 1376024 - protein, 36 aa, Mycobacterium tuberculosis; identical to SEQ ID NO: 160051

SEQ ID NO: 1376025 - protein, 24 aa, Mycobacterium tuberculosis
LLWTVGLCLYGLVMGSVVHGIGDQ

SEQ ID NO: 1376026 - protein, 19 aa, Mycobacterium tuberculosis
LLYRYYRTGDPLFWFTTSS

SEQ ID NO: 1376027 - protein, 17 aa, Mycobacterium tuberculosis
LMRSVLCSLAVFHNPRD

SEQ ID NO: 1376028 - protein, 25 aa, Mycobacterium tuberculosis
LMVDGLGWRSVFLVNVPLGAIVWLL

SEQ ID NO: 1376029 - protein, 20 aa, Mycobacterium tuberculosis
LPLVVAMVLAGLRVEAAMAS

SEQ ID NO: 1376030 - protein, 17 aa, Mycobacterium tuberculosis
LPPPGAGAPPWYADVLL

SEQ ID NO: 1376031 - protein, 18 aa, Mycobacterium tuberculosis
LPPSINFAGPSPYIDFDA

SEQ ID NO: 1376032 - protein, 17 aa, Mycobacterium tuberculosis
LPVPLPTHRLVLGAVLA

SEQ ID NO: 1376033 - protein, 28 aa, Mycobacterium tuberculosis
LRAHVMATYLSRDWARDWGSLRKFDTLV

SEQ ID NO: 1376034 - protein, 18 aa, Mycobacterium tuberculosis
LRALVAPIYLIGSVLISY

SEQ ID NO: 1376035 - protein, 17 aa, Mycobacterium tuberculosis
LRPLAEFEQTAAAIGAG

SEQ ID NO: 1376036 - protein, 20 aa, Mycobacterium tuberculosis
LRPWMTMSVPRGAKGMTVDT

SEQ ID NO: 1376037 - protein, 17 aa, Mycobacterium tuberculosis
LRQLWLKLTLRGTETAP

SEQ ID NO: 1376038 - protein, 17 aa, Mycobacterium tuberculosis
LRSLFRVGLDPRNVAVI

SEQ ID NO: 1376039 - protein, 17 aa, Mycobacterium tuberculosis
LRVFERFYRADSSRARA

SEQ ID NO: 1376040 - protein, 22 aa, Mycobacterium tuberculosis
LSGLSINRFIAIDFVGFARMVE

SEQ ID NO: 1376041 - protein, 23 aa, Mycobacterium tuberculosis
LSGYVMRHRRDLLLGFGAALAGT

SEQ ID NO: 1376042 - protein, 24 aa, Mycobacterium tuberculosis
LSVTAVAVLFGWGSWQRRWIADDG

SEQ ID NO: 1376043 - protein, 17 aa, Mycobacterium tuberculosis
LTFGGLMLLGGRLGDTI

SEQ ID NO: 1376044 - protein, 17 aa, Mycobacterium tuberculosis
LTLAAWGAWRPHYRAAS

SEQ ID NO: 1376045 - protein, 18 aa, Mycobacterium tuberculosis
LTTGRGMLTQAARVQLAV

SEQ ID NO: 1376046 - protein, 17 aa, Mycobacterium tuberculosis
LVASRWLLRPTAAEALS

SEQ ID NO: 1376047 - protein, 29 aa, Mycobacterium tuberculosis
LVAVAPRIGAWVVAAWLAGIILNLVTGPG

SEQ ID NO: 1376048 - protein, 27 aa, Mycobacterium tuberculosis
LVLTESGLRPGWHRVPGVSASGSDSAV

SEQ ID NO: 1376049 - protein, 26 aa, Mycobacterium tuberculosis
LVLYRRRRISLSPRPERGVVDRSGGY

SEQ ID NO: 1376050 - protein, 24 aa, Mycobacterium tuberculosis
LWQHILAIHLHWLVLAMSVIVLLA

SEQ ID NO: 1376051 - protein, 17 aa, Mycobacterium tuberculosis
MKVTFHYQNKYKVPANA

SEQ ID NO: 1376052 - protein, 24 aa, Mycobacterium tuberculosis
MLSVIRLALIPAFVYVVLSAHANG

SEQ ID NO: 1376053 - protein, 27 aa, Mycobacterium tuberculosis
MVARIAQLRWPVAIAVGPALTYGVVAL

SEQ ID NO: 1376054 - protein, 20 aa, Mycobacterium tuberculosis
MVVHVIRGDGLAGVSAPQLG

SEQ ID NO: 1376055 - protein, 17 aa, Mycobacterium tuberculosis
NAIWKAFDLFVGAIQAF

SEQ ID NO: 1376056 - protein, 21 aa, Mycobacterium tuberculosis
NIVAAVLCHRLVVLIGVTLIV

SEQ ID NO: 1376057 - protein, 26 aa, Mycobacterium tuberculosis
NLGQTARLYIRPVLNSMPAQPAAEEP

SEQ ID NO: 1376058 - protein, 19 aa, Mycobacterium tuberculosis
NLPLRTAMARRRYVETTNV

SEQ ID NO: 1376059 - protein, 18 aa, Mycobacterium tuberculosis
NLRGKWRVTPGVAATGNL

SEQ ID NO: 1376060 - protein, 29 aa, Mycobacterium tuberculosis
NPGSARPRTRFGAWLGRPMTSFHLIIAVA

SEQ ID NO: 1376061 - protein, 19 aa, Mycobacterium tuberculosis
NPRKSCLRNVDRFRPGLLD

SEQ ID NO: 1376062 - protein, 23 aa, Mycobacterium tuberculosis
NVGVMRWRWRVAFYALSALGTDR

SEQ ID NO: 1376063 - protein, 23 aa, Mycobacterium tuberculosis
PAAHLPFRSGRSFSASVSGTELT

SEQ ID NO: 1376064 - protein, 18 aa, Mycobacterium tuberculosis
PAHLRTAILDATKPEVRR

SEQ ID NO: 1376065 - protein, 23 aa, Mycobacterium tuberculosis
PAPLLRARGTFFAHADQLSIHRA

SEQ ID NO: 1376066 - protein, 18 aa, Mycobacterium tuberculosis
PAVFKALFLGFMFAFAIK

SEQ ID NO: 1376067 - protein, 24 aa, Mycobacterium tuberculosis
PDLQGADQLLVRWRQANDRINSYI

SEQ ID NO: 1376068 - protein, 17 aa, Mycobacterium tuberculosis
PEPRWPKSPPQDRRESG

SEQ ID NO: 1376069 - protein, 20 aa, Mycobacterium tuberculosis
PFNNGLRPEGIIALGSLVTY

SEQ ID NO: 1376070 - protein, 31 aa, Mycobacterium tuberculosis; identical to SEQ ID NO: 158296

SEQ ID NO: 1376071 - protein, 25 aa, Mycobacterium tuberculosis
PGSVTVTYPAHWGPAAVAALDSALR

SEQ ID NO: 1376072 - protein, 19 aa, Mycobacterium tuberculosis
PGTPLLKLVRELRADRGPV

SEQ ID NO: 1376073 - protein, 20 aa, Mycobacterium tuberculosis
PKLFRSLSIAFMSSADPIPA

SEQ ID NO: 1376074 - protein, 28 aa, Mycobacterium tuberculosis
PKSPPIPWYRLPAVIITGTTVAVLLVGA

SEQ ID NO: 1376075 - protein, 17 aa, Mycobacterium tuberculosis
PLADLSTLFAIVPSARV

SEQ ID NO: 1376076 - protein, 21 aa, Mycobacterium tuberculosis
PLRSFTYWERHCFDIPICWSM

SEQ ID NO: 1376077 - protein, 17 aa, Mycobacterium tuberculosis
PNVRELIEITLVKNPAM

SEQ ID NO: 1376078 - protein, 24 aa, Mycobacterium tuberculosis
PPAPEPRPAPPPAKPAPPAGPVDD

SEQ ID NO: 1376079 - protein, 19 aa, Mycobacterium tuberculosis
PPGPPGRRAWQADTESTAP

SEQ ID NO: 1376080 - protein, 22 aa, Mycobacterium tuberculosis
PPPCLTGFLPASEWRSPADTST

SEQ ID NO: 1376081 - protein, 21 aa, Mycobacterium tuberculosis
PPPIDERWLPESALPAPPRPT

SEQ ID NO: 1376082 - protein, 25 aa, Mycobacterium tuberculosis
PQLSRASVVIGSLVVVLALAAGIVG

SEQ ID NO: 1376083 - protein, 20 aa, Mycobacterium tuberculosis
PRPAPAHEWHAMSVEQVRKA

SEQ ID NO: 1376084 - protein, 29 aa, Mycobacterium tuberculosis
PRVLCTDDLRVARIRGCGADELSTAWNRA

SEQ ID NO: 1376085 - protein, 23 aa, Mycobacterium tuberculosis
PSPTCIIVGLPAGLRLAVDNAIA

SEQ ID NO: 1376086 - protein, 22 aa, Mycobacterium tuberculosis
PTTAGATAWRTGPNSTPVILRC

SEQ ID NO: 1376087 - protein, 24 aa, Mycobacterium tuberculosis
PVFGFGVIFGAIWAEEAWGRYWGW

SEQ ID NO: 1376088 - protein, 23 aa, Mycobacterium tuberculosis
PVPMLPGSWGPDLVGVAGDGGLV

SEQ ID NO: 1376089 - protein, 25 aa, Mycobacterium tuberculosis
PVQRSVARFALIQALSAVLVGAGTR

SEQ ID NO: 1376090 - protein, 17 aa, Mycobacterium tuberculosis
PVWSRRLVDRGCPKVLA

SEQ ID NO: 1376091 - protein, 24 aa, Mycobacterium tuberculosis
QFWLYCGFTAITMLGFGTFGLLSF

SEQ ID NO: 1376092 - protein, 26 aa, Mycobacterium tuberculosis
QGAGRSRAAVKFLLYNLFGGLIMLAA

SEQ ID NO: 1376093 - protein, 26 aa, Mycobacterium tuberculosis
QLTFSVLAAYAFARLQFRGRDALFWV

SEQ ID NO: 1376094 - protein, 26 aa, Mycobacterium tuberculosis
QQLWNAYTGFYGWMLQLIWQFLQDPI

SEQ ID NO: 1376095 - protein, 19 aa, Mycobacterium tuberculosis
QRYSLGMVAATLALIVIPL

SEQ ID NO: 1376096 - protein, 19 aa, Mycobacterium tuberculosis
QSMLLPAFVALFGIVAALF

SEQ ID NO: 1376097 - protein, 24 aa, Mycobacterium tuberculosis
QTLRTIYQNLGWAFGYNTAAIPLA

SEQ ID NO: 1376098 - protein, 22 aa, Mycobacterium tuberculosis
RAEELRPGDIIEVRTHEVVPAD

SEQ ID NO: 1376099 - protein, 20 aa, Mycobacterium tuberculosis
RASRQWCGGLAIGLTLVLKP

SEQ ID NO: 1376100 - protein, 23 aa, Mycobacterium tuberculosis
RDADKPAALWILTRGVHESVAPS

SEQ ID NO: 1376101 - protein, 21 aa, Mycobacterium tuberculosis
RDLGVAFGWSLFNWIADVACL

SEQ ID NO: 1376102 - protein, 18 aa, Mycobacterium tuberculosis
REAIKGTPLQGAAIYLGG

SEQ ID NO: 1376103 - protein, 20 aa, Mycobacterium tuberculosis
REVLPRDVVEKEPEPEPEPK

SEQ ID NO: 1376104 - protein, 19 aa, Mycobacterium tuberculosis
RGALATVIRAMGSLGMSSP

SEQ ID NO: 1376105 - protein, 18 aa, Mycobacterium tuberculosis
RGQMAITSQMIYARLVMT

SEQ ID NO: 1376106 - protein, 21 aa, Mycobacterium tuberculosis
RHFPQARMEPEVLMVEADHDL

SEQ ID NO: 1376107 - protein, 25 aa, Mycobacterium tuberculosis
RIALPLLAYFAIMWVGGYLLGAALR

SEQ ID NO: 1376108 - protein, 22 aa, Mycobacterium tuberculosis
RLFGELEFWASLIKVIALVTFL

SEQ ID NO: 1376109 - protein, 19 aa, Mycobacterium tuberculosis
RLIATGGMGQVWEAVDNRL

SEQ ID NO: 1376110 - protein, 26 aa, Mycobacterium tuberculosis
RLMTPLRVMFAIALVFLALGWSTKAA

SEQ ID NO: 1376111 - protein, 22 aa, Mycobacterium tuberculosis
RLRRLWLAVLIVAPATIWLEPI

SEQ ID NO: 1376112 - protein, 20 aa, Mycobacterium tuberculosis
RPAPTDGFVGVAPDARLLSL

SEQ ID NO: 1376113 - protein, 20 aa, Mycobacterium tuberculosis
RPDTAPALALAARSSASFPL

SEQ ID NO: 1376114 - protein, 20 aa, Mycobacterium tuberculosis
RPEGIIALGSLVTYVLIERS

SEQ ID NO: 1376115 - protein, 19 aa, Mycobacterium tuberculosis
RPPVTAGLVAARAAGDPRP

SEQ ID NO: 1376116 - protein, 20 aa, Mycobacterium tuberculosis
RPYAGERWWVLLLSLATAAV

SEQ ID NO: 1376117 - protein, 24 aa, Mycobacterium tuberculosis
RQVTRELLELFNIDEQTLNTQGLV

SEQ ID NO: 1376118 - protein, 18 aa, Mycobacterium tuberculosis
RRADRAAVLAAIKGAAHV

SEQ ID NO: 1376119 - protein, 23 aa, Mycobacterium tuberculosis
RRCRWLVFTGWLLALVPAVYLAM

SEQ ID NO: 1376120 - protein, 29 aa, Mycobacterium tuberculosis
RRQLRLIVSDRGYFVFLALLPFIMGALSM

SEQ ID NO: 1376121 - protein, 24 aa, Mycobacterium tuberculosis
RRRCRRATVGGVRFAAFLIASLGT

SEQ ID NO: 1376122 - protein, 26 aa, Mycobacterium tuberculosis
RRRMPDLRGALLLAVTLGLVTLGLVK

SEQ ID NO: 1376123 - protein, 17 aa, Mycobacterium tuberculosis
RRYGPIMTMPILSLGDV

SEQ ID NO: 1376124 - protein, 18 aa, Mycobacterium tuberculosis
RSWPRHRCCGWIMARIGF

SEQ ID NO: 1376125 - protein, 19 aa, Mycobacterium tuberculosis
RTTLAWTRTAFALLVNGVL

SEQ ID NO: 1376126 - protein, 18 aa, Mycobacterium tuberculosis
RVDMVCFDKTGTLSENRL

SEQ ID NO: 1376127 - protein, 19 aa, Mycobacterium tuberculosis
SALATVWRAGVRLWTPSLA

SEQ ID NO: 1376128 - protein, 25 aa, Mycobacterium tuberculosis
SAPPLRLLEDLPRRVRVSDAHQSGF

SEQ ID NO: 1376129 - protein, 21 aa, Mycobacterium tuberculosis
SDAIAAFLWTANWRFVAQNTD

SEQ ID NO: 1376130 - protein, 19 aa, Mycobacterium tuberculosis
SEALVADALLALAYTATGG

SEQ ID NO: 1376131 - protein, 19 aa, Mycobacterium tuberculosis
SEGLRASIVVPAITNDMPM

SEQ ID NO: 1376132 - protein, 19 aa, Mycobacterium tuberculosis
SERQRLRDLFGRYVGEDVA

SEQ ID NO: 1376133 - protein, 19 aa, Mycobacterium tuberculosis
SFGDMRSAFYAGYEEADRE

SEQ ID NO: 1376134 - protein, 27 aa, Mycobacterium tuberculosis
SFRRRLDEYIGFLVAWQRPLAGKKTLM

SEQ ID NO: 1376135 - protein, 24 aa, Mycobacterium tuberculosis
SGCSWSEALGIGWPEGITPEAHLN

SEQ ID NO: 1376136 - protein, 17 aa, Mycobacterium tuberculosis
SGGPFADAVAAVRAGRR

SEQ ID NO: 1376137 - protein, 20 aa, Mycobacterium tuberculosis
SGLAGRRIWDAALVAASPLV

SEQ ID NO: 1376138 - protein, 20 aa, Mycobacterium tuberculosis
SGLMRKAKELVIATKMSGEW

SEQ ID NO: 1376139 - protein, 18 aa, Mycobacterium tuberculosis
SGPAWRLIGTTAVGLLLL

SEQ ID NO: 1376140 - protein, 34 aa, Mycobacterium tuberculosis; identical to SEQ ID NO: 158992

SEQ ID NO: 1376141 - protein, 26 aa, Mycobacterium tuberculosis
SLGGVLAYACAIGLRRLGKDVRFVGL

SEQ ID NO: 1376142 - protein, 17 aa, Mycobacterium tuberculosis
SLQCRPDAAYLITGGLG

SEQ ID NO: 1376143 - protein, 19 aa, Mycobacterium tuberculosis
SPRVPAEPGGDFVDQAGNG

SEQ ID NO: 1376144 - protein, 18 aa, Mycobacterium tuberculosis
SQMAAGLLTHLAGDRIEV

SEQ ID NO: 1376145 - protein, 23 aa, Mycobacterium tuberculosis
SRPHAPWARWRYTRHPEKMRRAL

SEQ ID NO: 1376146 - protein, 19 aa, Mycobacterium tuberculosis
SSLLLNWVLGPALMFALAW

SEQ ID NO: 1376147 - protein, 25 aa, Mycobacterium tuberculosis
SSYFRNPWPALWAMMVGFFMIMLDS

SEQ ID NO: 1376148 - protein, 18 aa, Mycobacterium tuberculosis
STVPPLVLAMTFGLSMDY

SEQ ID NO: 1376149 - protein, 19 aa, Mycobacterium tuberculosis
TAPLVPLAVSAFLTSRKKA

SEQ ID NO: 1376150 - protein, 24 aa, Mycobacterium tuberculosis
TFAIGAAAVFAWLLAAFAVRPFKQ

SEQ ID NO: 1376151 - protein, 22 aa, Mycobacterium tuberculosis
TFGIDFKGGTTVSFPRGSTQVA

SEQ ID NO: 1376152 - protein, 18 aa, Mycobacterium tuberculosis
TGGPYVPADLRLYDYDDY

SEQ ID NO: 1376153 - protein, 24 aa, Mycobacterium tuberculosis
TGPGCKALLAALPQRLGEYRRAPV

SEQ ID NO: 1376154 - protein, 19 aa, Mycobacterium tuberculosis
TGTMGPRLVYTETKLNSAF

SEQ ID NO: 1376155 - protein, 25 aa, Mycobacterium tuberculosis
TIHALSLPIILFWVALTIVVNVVAP

SEQ ID NO: 1376156 - protein, 23 aa, Mycobacterium tuberculosis
TLASPCAIGLVTVMLASLTLAPA

SEQ ID NO: 1376157 - protein, 23 aa, Mycobacterium tuberculosis
TLMALMCSAATMYTPERVTFFCI

SEQ ID NO: 1376158 - protein, 18 aa, Mycobacterium tuberculosis
TPPARWPVTLHVLPTVRD

SEQ ID NO: 1376159 - protein, 19 aa, Mycobacterium tuberculosis
TPTLYRPAGGLSNDAVRQA

SEQ ID NO: 1376160 - protein, 20 aa, Mycobacterium tuberculosis
TPVLIRLFTKQGFGHQIRED

SEQ ID NO: 1376161 - protein, 26 aa, Mycobacterium tuberculosis
TQPVLLDWAVGLAFPCQQPMLHANGI

SEQ ID NO: 1376162 - protein, 30 aa, Mycobacterium tuberculosis; identical to SEQ ID NO: 159237

SEQ ID NO: 1376163 - protein, 23 aa, Mycobacterium tuberculosis
TRTSLKTSWYLLGPAFVAAIAYV

SEQ ID NO: 1376164 - protein, 23 aa, Mycobacterium tuberculosis
TTMIGRANWWPSELGRDPSTPPT

SEQ ID NO: 1376165 - protein, 23 aa, Mycobacterium tuberculosis
TTTGARYRATFAHNVDAYKSTAV

SEQ ID NO: 1376166 - protein, 24 aa, Mycobacterium tuberculosis
TTVIIRFWLLTAITCGLGVALFYG

SEQ ID NO: 1376167 - protein, 17 aa, Mycobacterium tuberculosis
TVAQVWFQDEESAARAF

SEQ ID NO: 1376168 - protein, 27 aa, Mycobacterium tuberculosis
TVLVWRRVSDGWAFMCTLIVVAAVVVL

SEQ ID NO: 1376169 - protein, 20 aa, Mycobacterium tuberculosis
TVTFYGRRITGWVAAVYAWL

SEQ ID NO: 1376170 - protein, 39 aa, Mycobacterium tuberculosis; identical to SEQ ID NO: 159289

SEQ ID NO: 1376171 - protein, 23 aa, Mycobacterium tuberculosis
VAAGRRKALAFIEGRSVAELVAL

SEQ ID NO: 1376172 - protein, 24 aa, Mycobacterium tuberculosis
VAAVAFFGWERFARTRLIDPAGVH

SEQ ID NO: 1376173 - protein, 22 aa, Mycobacterium tuberculosis
VAEERLSALLLNSSEVNAVMGS

SEQ ID NO: 1376174 - protein, 17 aa, Mycobacterium tuberculosis
VAFAGLLIAAYGYWLIS

SEQ ID NO: 1376175 - protein, 25 aa, Mycobacterium tuberculosis
VALPSRVFAWLALVFGVGFSMLALL

SEQ ID NO: 1376176 - protein, 21 aa, Mycobacterium tuberculosis
VAMLIGRFFLIIPVLAIAGSL

SEQ ID NO: 1376177 - protein, 17 aa, Mycobacterium tuberculosis
VAVSFWLTAPYLVAESI

SEQ ID NO: 1376178 - protein, 26 aa, Mycobacterium tuberculosis
VDPEGAHARWNWVLDGMVETKALSPN

SEQ ID NO: 1376179 - protein, 19 aa, Mycobacterium tuberculosis
VFSPLRRRATAALAVAGER

SEQ ID NO: 1376180 - protein, 17 aa, Mycobacterium tuberculosis
VGTGGVFAWVARRAPAA

SEQ ID NO: 1376181 - protein, 22 aa, Mycobacterium tuberculosis
VGTSRRSRWARLFDEGIGARTV

SEQ ID NO: 1376182 - protein, 18 aa, Mycobacterium tuberculosis
VGVASVIAEGFLVLPFSR

SEQ ID NO: 1376183 - protein, 31 aa, Mycobacterium tuberculosis; identical to SEQ ID NO: 159448

SEQ ID NO: 1376184 - protein, 25 aa, Mycobacterium tuberculosis
VIDGEIKQRYELFKSVGARDANDYE

SEQ ID NO: 1376185 - protein, 21 aa, Mycobacterium tuberculosis
VKSNIAFRIALRAESGDDSRE

SEQ ID NO: 1376186 - protein, 25 aa, Mycobacterium tuberculosis
VLDVAQPLAYCLPGVRSRVVVSEGT

SEQ ID NO: 1376187 - protein, 25 aa, Mycobacterium tuberculosis
VLKRTGRLSLRHALDMLEQTGRALQ

SEQ ID NO: 1376188 - protein, 18 aa, Mycobacterium tuberculosis
VLTVWRFDSLIGAAGVVL

SEQ ID NO: 1376189 - protein, 18 aa, Mycobacterium tuberculosis
VLVPGQLVSKEIIYFLAQ

SEQ ID NO: 1376190 - protein, 19 aa, Mycobacterium tuberculosis
VLVYTELWVGFTAVSALLI

SEQ ID NO: 1376191 - protein, 19 aa, Mycobacterium tuberculosis
VPADLRLYDYDDYEESSDL

SEQ ID NO: 1376192 - protein, 18 aa, Mycobacterium tuberculosis
VPLGLLLMTARRRPSFLR

SEQ ID NO: 1376193 - protein, 27 aa, Mycobacterium tuberculosis
VPLLLGALWASAAFARRADTAADKANT

SEQ ID NO: 1376194 - protein, 23 aa, Mycobacterium tuberculosis
VQERRLVFERFYRSASARALPGS

SEQ ID NO: 1376195 - protein, 20 aa, Mycobacterium tuberculosis
VQTGLLWPAIFVAAFAALGL

SEQ ID NO: 1376196 - protein, 23 aa, Mycobacterium tuberculosis
VQWRKRRLVIAIVSTGLVFAMTL

SEQ ID NO: 1376197 - protein, 18 aa, Mycobacterium tuberculosis
VRASVNFATRVATIDAVG

SEQ ID NO: 1376198 - protein, 26 aa, Mycobacterium tuberculosis
VRIPRSVEALGRVDMVCFDKTGTLSE

SEQ ID NO: 1376199 - protein, 21 aa, Mycobacterium tuberculosis
VVAEMRKVIWPNRKQMLTYTS

SEQ ID NO: 1376200 - protein, 21 aa, Mycobacterium tuberculosis
VVPTLWRGALVVLQSILAVAF

SEQ ID NO: 1376201 - protein, 21 aa, Mycobacterium tuberculosis
VVVFLVTWPLVYLASKSSLLA

SEQ ID NO: 1376202 - protein, 28 aa, Mycobacterium tuberculosis
VWRRDLRAIVRLLAWQGAALAAIPLLRG

SEQ ID NO: 1376203 - protein, 22 aa, Mycobacterium tuberculosis
WAAGVLGALAIIIAVLLVIKAP

SEQ ID NO: 1376204 - protein, 29 aa, Mycobacterium tuberculosis
WAGVTSVSIPSWWQPYVLSVASLTSAGQP

SEQ ID NO: 1376205 - protein, 18 aa, Mycobacterium tuberculosis
WAILAVVVIVLFGAKKLP

SEQ ID NO: 1376206 - protein, 25 aa, Mycobacterium tuberculosis
WETGRSLWWPLAIGILGIAVLVGSF

SEQ ID NO: 1376207 - protein, 18 aa, Mycobacterium tuberculosis
WGELEKGRRRYLRDLDTN

SEQ ID NO: 1376208 - protein, 25 aa, Mycobacterium tuberculosis
WHIVGLCIFGFLLAMLRGNHVGHVE

SEQ ID NO: 1376209 - protein, 23 aa, Mycobacterium tuberculosis
WKKGLRHSVYFTHGIRNAVDSGH

SEQ ID NO: 1376210 - protein, 17 aa, Mycobacterium tuberculosis
WKWNVVGLLAIALGAAI

SEQ ID NO: 1376211 - protein, 17 aa, Mycobacterium tuberculosis
WLSAATVAGWVLDAVTA

SEQ ID NO: 1376212 - protein, 21 aa, Mycobacterium tuberculosis
WLVFGGLWLALGYLLASLVCF

SEQ ID NO: 1376213 - protein, 36 aa, Mycobacterium tuberculosis; identical to SEQ ID NO: 159733

SEQ ID NO: 1376214 - protein, 25 aa, Mycobacterium tuberculosis
WQRNVRWARWLAWVSLAVLLTEGAV

SEQ ID NO: 1376215 - protein, 19 aa, Mycobacterium tuberculosis
WRDFCLRVADRIVLVAGDP

SEQ ID NO: 1376216 - protein, 17 aa, Mycobacterium tuberculosis
WRLMAVLAIAVGTYGVL

SEQ ID NO: 1376217 - protein, 17 aa, Mycobacterium tuberculosis
WRNLRFARAKMPADAVA

SEQ ID NO: 1376218 - protein, 22 aa, Mycobacterium tuberculosis
WSRLCDLEQMIPLMPGAQLIGH

SEQ ID NO: 1376219 - protein, 19 aa, Mycobacterium tuberculosis
WTLYAHRPARGIGISECTK

SEQ ID NO: 1376220 - protein, 18 aa, Mycobacterium tuberculosis
WVANYGHEYYLDKARKHE

SEQ ID NO: 1376221 - protein, 31 aa, Mycobacterium tuberculosis; identical to SEQ ID NO: 159781

SEQ ID NO: 1376222 - protein, 24 aa, Mycobacterium tuberculosis
YALACVLGECLTGAPPYRADSVER

SEQ ID NO: 1376223 - protein, 19 aa, Mycobacterium tuberculosis
YLPPEAFQNPDFQRGLKLF

SEQ ID NO: 1376224 - protein, 21 aa, Mycobacterium tuberculosis
YPDIPPRPDWEPTGAEPIAAA

SEQ ID NO: 1376225 - protein, 17 aa, Mycobacterium tuberculosis
YPVVVNGRIVWIVDAYT

SEQ ID NO: 1376226 - protein, 19 aa, Mycobacterium tuberculosis
YSTVLAFWLGWPTSEVPGV

SEQ ID NO: 1376227 - protein, 20 aa, Mycobacterium tuberculosis
YVPCAGPILAAIVVAGATAT

SEQ ID NO: 1376228 - protein, 18 aa, Mycobacterium tuberculosis
YWLFHGGTIGKFKDLLIN

SEQ ID NO: 1376229 - protein, 18 aa, Mycobacterium tuberculosis
YYRLMLKLNGGPQAVADA

SEQ ID NO: 1376230 - protein, 17 aa, Mycobacterium tuberculosis
AAARGLYMAFTVLAAAG

SEQ ID NO: 1376231 - protein, 27 aa, Mycobacterium tuberculosis
AADPVFLDWLVGLAFPCQRPFGHQYGV

SEQ ID NO: 1376232 - protein, 17 aa, Mycobacterium tuberculosis
AAGPFLGSIPFPDVDLA

SEQ ID NO: 1376233 - protein, 19 aa, Mycobacterium tuberculosis
AAGSWLPALLWGVAFAILV

SEQ ID NO: 1376234 - protein, 28 aa, Mycobacterium tuberculosis
AALQRLPGRCWPVAATATATWAALGGTS

SEQ ID NO: 1376235 - protein, 29 aa, Mycobacterium tuberculosis
AARGEHYWLKLFVFFFPFTDQIAAFKIIM

SEQ ID NO: 1376236 - protein, 19 aa, Mycobacterium tuberculosis
ADIHMLWWMVLIVGVVSII

SEQ ID NO: 1376237 - protein, 17 aa, Mycobacterium tuberculosis
ADLFAVVGLLFLGTVAL

SEQ ID NO: 1376238 - protein, 20 aa, Mycobacterium tuberculosis
ADWLADRGAHRLVLTGRTPL

SEQ ID NO: 1376239 - protein, 20 aa, Mycobacterium tuberculosis
AEWELPIVLDSAAGFGSTYA

SEQ ID NO: 1376240 - protein, 22 aa, Mycobacterium tuberculosis
AFARTEFQAVQFIPLVMVPQLL

SEQ ID NO: 1376241 - protein, 18 aa, Mycobacterium tuberculosis
AFQNPDFQRGLKLFLSPD

SEQ ID NO: 1376242 - protein, 17 aa, Mycobacterium tuberculosis
AFTAWRFGDHDVAVRGY

SEQ ID NO: 1376243 - protein, 21 aa, Mycobacterium tuberculosis
AGLGLELSRLIKGSAELAIDA

SEQ ID NO: 1376244 - protein, 20 aa, Mycobacterium tuberculosis
AGVVAVLAWIDRDRSPRLTA

SEQ ID NO: 1376245 - protein, 18 aa, Mycobacterium tuberculosis
ALGFLQDFFATAVFLGIT

SEQ ID NO: 1376246 - protein, 18 aa, Mycobacterium tuberculosis
ALGYMHAALAMFLGSTLV

SEQ ID NO: 1376247 - protein, 22 aa, Mycobacterium tuberculosis
ALLLLYWQWRTMPAVIWDVRQP

SEQ ID NO: 1376248 - protein, 26 aa, Mycobacterium tuberculosis
ALPTGCILAWILVRIINVRSFGWTLQ

SEQ ID NO: 1376249 - protein, 22 aa, Mycobacterium tuberculosis
AMGATVTGWVARLPAAPQTTRA

SEQ ID NO: 1376250 - protein, 19 aa, Mycobacterium tuberculosis
ANLACVVCAIGLGSVAGLS

SEQ ID NO: 1376251 - protein, 19 aa, Mycobacterium tuberculosis
ANQLGWQGPFWDWLGGLDL

SEQ ID NO: 1376252 - protein, 31 aa, Mycobacterium tuberculosis; identical to SEQ ID NO: 156260

SEQ ID NO: 1376253 - protein, 23 aa, Mycobacterium tuberculosis
ARILAWRPLVWLGTISYGVYLWH

SEQ ID NO: 1376254 - protein, 23 aa, Mycobacterium tuberculosis
ARYSSVFAPDWGREVELMAVSGD

SEQ ID NO: 1376255 - protein, 21 aa, Mycobacterium tuberculosis
ASLCLIFIIMLGITRSVVASA

SEQ ID NO: 1376256 - protein, 17 aa, Mycobacterium tuberculosis
ASQWRRLGGTFPTNSQL

SEQ ID NO: 1376257 - protein, 19 aa, Mycobacterium tuberculosis
ASVISWVSIVLIYVVVVYE

SEQ ID NO: 1376258 - protein, 31 aa, Mycobacterium tuberculosis; identical to SEQ ID NO: 156313

SEQ ID NO: 1376259 - protein, 17 aa, Mycobacterium tuberculosis
AVSPPPIDERWLPESAL

SEQ ID NO: 1376260 - protein, 20 aa, Mycobacterium tuberculosis
AVTGCTRGPTVTRYEVELGP

SEQ ID NO: 1376261 - protein, 19 aa, Mycobacterium tuberculosis
CAELSAPLIEVHISNVHAR

SEQ ID NO: 1376262 - protein, 25 aa, Mycobacterium tuberculosis
CHTMSLDWVAWRGLGLAADAQLVSE

SEQ ID NO: 1376263 - protein, 24 aa, Mycobacterium tuberculosis
CILLLEVLFLRWLLDGRASRQWCG

SEQ ID NO: 1376264 - protein, 21 aa, Mycobacterium tuberculosis
DACPYFPGVSYRNWKLPDPAG

SEQ ID NO: 1376265 - protein, 22 aa, Mycobacterium tuberculosis
DATRAICSRSHLMGEGEAMLFG

SEQ ID NO: 1376266 - protein, 21 aa, Mycobacterium tuberculosis
DAVACAIPLPPIARLLDDLDV

SEQ ID NO: 1376267 - protein, 17 aa, Mycobacterium tuberculosis
DAVRNISKWPGVRDAVM

SEQ ID NO: 1376268 - protein, 18 aa, Mycobacterium tuberculosis
DDGFKKKKIVDVLRESLY

SEQ ID NO: 1376269 - protein, 23 aa, Mycobacterium tuberculosis
DEPREFFTTNAFWSVPSDPTNDA

SEQ ID NO: 1376270 - protein, 23 aa, Mycobacterium tuberculosis
DIHAELPAKLVLVAIAVLCAVSF

SEQ ID NO: 1376271 - protein, 18 aa, Mycobacterium tuberculosis
DIQLKRLHQVAGPAGRSV

SEQ ID NO: 1376272 - protein, 26 aa, Mycobacterium tuberculosis
DITPSEAFTAWEFVDGYDVAQAVVVP

SEQ ID NO: 1376273 - protein, 25 aa, Mycobacterium tuberculosis
DLEPFRCFYLSAPFVVPKKKEVART

SEQ ID NO: 1376274 - protein, 18 aa, Mycobacterium tuberculosis
DQIERWARKLNNLAAQTA

SEQ ID NO: 1376275 - protein, 30 aa, Mycobacterium tuberculosis; identical to SEQ ID NO: 160317

SEQ ID NO: 1376276 - protein, 21 aa, Mycobacterium tuberculosis
DRLEAVVMLLAVTVSLLTIPF

SEQ ID NO: 1376277 - protein, 17 aa, Mycobacterium tuberculosis
DSQMFLGALAFVAGCSV

SEQ ID NO: 1376278 - protein, 25 aa, Mycobacterium tuberculosis
DVLPQTRWIPVVTFVQVSADMAVAT

SEQ ID NO: 1376279 - protein, 19 aa, Mycobacterium tuberculosis
DVLVALALTNYGAKTAAKT

SEQ ID NO: 1376280 - protein, 22 aa, Mycobacterium tuberculosis
EELLRINLSFADGLPRLATADI

SEQ ID NO: 1376281 - protein, 23 aa, Mycobacterium tuberculosis
EESNFPAIVKFLSEQVLSRATER

SEQ ID NO: 1376282 - protein, 22 aa, Mycobacterium tuberculosis
EGDQAFEVLAPFVVDGGPTVLV

SEQ ID NO: 1376283 - protein, 25 aa, Mycobacterium tuberculosis
EGEAMLFGEYIRLMALVEYSADEIR

SEQ ID NO: 1376284 - protein, 18 aa, Mycobacterium tuberculosis
EGYLVWAAAAAMCAPLTL

SEQ ID NO: 1376285 - protein, 18 aa, Mycobacterium tuberculosis
ELAVFVFFGPVAVLGTQY

SEQ ID NO: 1376286 - protein, 19 aa, Mycobacterium tuberculosis
ELIPARAPHSAEIRNTDVL

SEQ ID NO: 1376287 - protein, 20 aa, Mycobacterium tuberculosis
ESLAELMGGPDIAPPSSGLQ

SEQ ID NO: 1376288 - protein, 28 aa, Mycobacterium tuberculosis
ESPDGMTPPVRWRSGRRVHFDLDPLLPF

SEQ ID NO: 1376289 - protein, 22 aa, Mycobacterium tuberculosis
EVAMGLSFATVFLMAGTMSTSQ

SEQ ID NO: 1376290 - protein, 17 aa, Mycobacterium tuberculosis
EVYWPLRRVGVQFHAAA

SEQ ID NO: 1376291 - protein, 18 aa, Mycobacterium tuberculosis
FDHYRSGPITVQLYRGAA

SEQ ID NO: 1376292 - protein, 17 aa, Mycobacterium tuberculosis
FGVLMLWLPGNNLVVAF

SEQ ID NO: 1376293 - protein, 17 aa, Mycobacterium tuberculosis
FGYWSWANLACVVCAIG

SEQ ID NO: 1376294 - protein, 17 aa, Mycobacterium tuberculosis
FHDPPWSNTYLGVADAH

SEQ ID NO: 1376295 - protein, 28 aa, Mycobacterium tuberculosis
FIAFDQLWRWNSIVALVLSVMVILGLVV

SEQ ID NO: 1376296 - protein, 24 aa, Mycobacterium tuberculosis
FIDAIICFVGFLFPLWDAKRQTLA

SEQ ID NO: 1376297 - protein, 25 aa, Mycobacterium tuberculosis
FLAVPEMKELLASKDNKAWNLPITF

SEQ ID NO: 1376298 - protein, 18 aa, Mycobacterium tuberculosis
FLEKRFTGDYAHHNLLQR

SEQ ID NO: 1376299 - protein, 31 aa, Mycobacterium tuberculosis; identical to SEQ ID NO: 156841

SEQ ID NO: 1376300 - protein, 22 aa, Mycobacterium tuberculosis
FLNRKIKGISLFRTVVFLPLAI

SEQ ID NO: 1376301 - protein, 21 aa, Mycobacterium tuberculosis
FLRVWLPGQLLQGIGVGATLP

SEQ ID NO: 1376302 - protein, 18 aa, Mycobacterium tuberculosis
FLTFFVVAAFGALIVDRD

SEQ ID NO: 1376303 - protein, 17 aa, Mycobacterium tuberculosis
FLVTLGGTVAFYTYSVN

SEQ ID NO: 1376304 - protein, 19 aa, Mycobacterium tuberculosis
FSVLRAAALTHWVDTGGYA

SEQ ID NO: 1376305 - protein, 26 aa, Mycobacterium tuberculosis
FTDKSDLLEAIGMRLRDMLWAAIFPS

SEQ ID NO: 1376306 - protein, 24 aa, Mycobacterium tuberculosis
FVVPYPPGFPVLVPGQLVSKEIIY

SEQ ID NO: 1376307 - protein, 18 aa, Mycobacterium tuberculosis
FYGEKVAFVAGWMYFLNW

SEQ ID NO: 1376308 - protein, 20 aa, Mycobacterium tuberculosis
FYSNPGFSFTGFARAVKNNL

SEQ ID NO: 1376309 - protein, 18 aa, Mycobacterium tuberculosis
GAAAPRVVTPDVLVHTPQ

SEQ ID NO: 1376310 - protein, 31 aa, Mycobacterium tuberculosis; identical to SEQ ID NO: 156941

SEQ ID NO: 1376311 - protein, 23 aa, Mycobacterium tuberculosis
GAALCLPLARVLAAASCGPLSSK

SEQ ID NO: 1376312 - protein, 17 aa, Mycobacterium tuberculosis
GAEFERLTGRLLAGFEA

SEQ ID NO: 1376313 - protein, 20 aa, Mycobacterium tuberculosis
GAEKVCGVIGGRGHDAAPQV

SEQ ID NO: 1376314 - protein, 17 aa, Mycobacterium tuberculosis
GAIALGMSNWECVRRVT

SEQ ID NO: 1376315 - protein, 18 aa, Mycobacterium tuberculosis
GALLKLTVFAVGVMPYIT

SEQ ID NO: 1376316 - protein, 20 aa, Mycobacterium tuberculosis
GAVVPRIEFDDVAFGYDGGS

SEQ ID NO: 1376317 - protein, 21 aa, Mycobacterium tuberculosis
GEVASLGFLISLWAGSSAISA

SEQ ID NO: 1376318 - protein, 20 aa, Mycobacterium tuberculosis
GFNLSWRVRYALEPAAGASG

SEQ ID NO: 1376319 - protein, 21 aa, Mycobacterium tuberculosis
GGLSRIGDWWTQPIVYQKVIV

SEQ ID NO: 1376320 - protein, 20 aa, Mycobacterium tuberculosis
GGVRLLTMWSTVLVLALSVI

SEQ ID NO: 1376321 - protein, 39 aa, Mycobacterium tuberculosis; identical to SEQ ID NO: 157051

SEQ ID NO: 1376322 - protein, 17 aa, Mycobacterium tuberculosis
GLALPAGATRDVKFAKQ

SEQ ID NO: 1376323 - protein, 21 aa, Mycobacterium tuberculosis
GLANGLGFLAGTIVGYYILRR

SEQ ID NO: 1376324 - protein, 19 aa, Mycobacterium tuberculosis
GLLALAGWVSVPGTGRMRK

SEQ ID NO: 1376325 - protein, 23 aa, Mycobacterium tuberculosis
GLPLWPYLVCAALTGLGGGNFAS

SEQ ID NO: 1376326 - protein, 25 aa, Mycobacterium tuberculosis
GLVCAIGLSGGYAFSVFLQGVNPGA

SEQ ID NO: 1376327 - protein, 17 aa, Mycobacterium tuberculosis
GMFLVVLGLLWPHIDLP

SEQ ID NO: 1376328 - protein, 17 aa, Mycobacterium tuberculosis
GPAETPIAQVLRRQRRE

SEQ ID NO: 1376329 - protein, 21 aa, Mycobacterium tuberculosis
GPDRRPITAVALVAVGLTLAL

SEQ ID NO: 1376330 - protein, 17 aa, Mycobacterium tuberculosis
GQWLAALLFAGALLAER

SEQ ID NO: 1376331 - protein, 18 aa, Mycobacterium tuberculosis
GRGMARLAMKIHARPKLR

SEQ ID NO: 1376332 - protein, 30 aa, Mycobacterium tuberculosis; identical to SEQ ID NO: 157186

SEQ ID NO: 1376333 - protein, 17 aa, Mycobacterium tuberculosis
GSALGRRHAQIGIEALL

SEQ ID NO: 1376334 - protein, 23 aa, Mycobacterium tuberculosis
GSGLPSDIWKATMDGALKGTSNE

SEQ ID NO: 1376335 - protein, 19 aa, Mycobacterium tuberculosis
GSYTGLSGWFAISSPGPPS

SEQ ID NO: 1376336 - protein, 20 aa, Mycobacterium tuberculosis
GWQGPFWDWLGGLDLNTVGF

SEQ ID NO: 1376337 - protein, 23 aa, Mycobacterium tuberculosis
HAYPRTGSVVVWYSPRRADRAAV

SEQ ID NO: 1376338 - protein, 23 aa, Mycobacterium tuberculosis
HDPGQSWVLVFAITMMAGLLVSL

SEQ ID NO: 1376339 - protein, 21 aa, Mycobacterium tuberculosis
HELRTPLTTIRGFAELYRQGA

SEQ ID NO: 1376340 - protein, 24 aa, Mycobacterium tuberculosis
HFESAHFLRALLVAVVAALAAGMY

SEQ ID NO: 1376341 - protein, 18 aa, Mycobacterium tuberculosis
HGLHFAMAVAMAVMAWPW

SEQ ID NO: 1376342 - protein, 17 aa, Mycobacterium tuberculosis
HKLCGRDVVVVSASGEE

SEQ ID NO: 1376343 - protein, 24 aa, Mycobacterium tuberculosis
HMGRQAFAAVLGRGLANTGQLVLD

SEQ ID NO: 1376344 - protein, 17 aa, Mycobacterium tuberculosis
HPHWNRLIWPVVVLVLL

SEQ ID NO: 1376345 - protein, 23 aa, Mycobacterium tuberculosis
HRNPRLVKVSVLTMIAVTGHFVS

SEQ ID NO: 1376346 - protein, 20 aa, Mycobacterium tuberculosis
HSGRVCAMVGDGSNDAAAIR

SEQ ID NO: 1376347 - protein, 18 aa, Mycobacterium tuberculosis
HTRALLLAGEETRLRLLV

SEQ ID NO: 1376348 - protein, 20 aa, Mycobacterium tuberculosis
HVREDPIPPSARHEGLSADL

SEQ ID NO: 1376349 - protein, 32 aa, Mycobacterium tuberculosis; identical to SEQ ID NO: 157338

SEQ ID NO: 1376350 - protein, 19 aa, Mycobacterium tuberculosis
ICGLAGLVFLAVPALLPAA

SEQ ID NO: 1376351 - protein, 23 aa, Mycobacterium tuberculosis
IDRAREAGRIAAREALPQIMELV

SEQ ID NO: 1376352 - protein, 20 aa, Mycobacterium tuberculosis
IFNVIWTYVLVRGSAVNNGT

SEQ ID NO: 1376353 - protein, 27 aa, Mycobacterium tuberculosis
IGEPGLDWRWLVLWWESHAPHIANNLM

SEQ ID NO: 1376354 - protein, 20 aa, Mycobacterium tuberculosis
IGGFKPVFRALDPAKVNNIA

SEQ ID NO: 1376355 - protein, 18 aa, Mycobacterium tuberculosis
IGQLVQWLLSVGGLAYLV

SEQ ID NO: 1376356 - protein, 32 aa, Mycobacterium tuberculosis; identical to SEQ ID NO: 157420

SEQ ID NO: 1376357 - protein, 17 aa, Mycobacterium tuberculosis
IKGLRAVAAGKQAPNVF

SEQ ID NO: 1376358 - protein, 19 aa, Mycobacterium tuberculosis
ILLCLVLGVAIVTQVRQTD

SEQ ID NO: 1376359 - protein, 17 aa, Mycobacterium tuberculosis
ILLNSEFSGPQIKEVSD

SEQ ID NO: 1376360 - protein, 27 aa, Mycobacterium tuberculosis
ILLVLWGLRASIQWLQARLAQRGASAV

SEQ ID NO: 1376361 - protein, 17 aa, Mycobacterium tuberculosis
ILTGCLDIADGKPVTIA

SEQ ID NO: 1376362 - protein, 24 aa, Mycobacterium tuberculosis
IMAQLRIGYATVVWVTSAYLLAYA

SEQ ID NO: 1376363 - protein, 17 aa, Mycobacterium tuberculosis
IPLALGSYWAMFILVPG

SEQ ID NO: 1376364 - protein, 25 aa, Mycobacterium tuberculosis
IQAIKRVGQVFGEFDSDNAVTIVLE

SEQ ID NO: 1376365 - protein, 22 aa, Mycobacterium tuberculosis
IVGYYILRRALRPDGGQLIGVG

SEQ ID NO: 1376366 - protein, 17 aa, Mycobacterium tuberculosis
IVQLAVFTVIAVGVLAI

SEQ ID NO: 1376367 - protein, 24 aa, Mycobacterium tuberculosis
KFKDLLINCGYSLIERFPLMLGTA

SEQ ID NO: 1376368 - protein, 20 aa, Mycobacterium tuberculosis
KITVPARWVVNGIERSGEVN

SEQ ID NO: 1376369 - protein, 22 aa, Mycobacterium tuberculosis
KKPKQRRLRRKKTAKGDEAEPE

SEQ ID NO: 1376370 - protein, 18 aa, Mycobacterium tuberculosis
KLLLSSLLLNWVLGPALM

SEQ ID NO: 1376371 - protein, 25 aa, Mycobacterium tuberculosis
KLSTLDRFLPVWIGSAMAAGLLLGR

SEQ ID NO: 1376372 - protein, 27 aa, Mycobacterium tuberculosis
KQTWLGRFVSTYGWRAYALPVLMVLTT

SEQ ID NO: 1376373 - protein, 28 aa, Mycobacterium tuberculosis
KRRWRRIGTVVVRWPGPVLAATLLIALI

SEQ ID NO: 1376374 - protein, 21 aa, Mycobacterium tuberculosis
KSLADGLARFTWQLRAADPRL

SEQ ID NO: 1376375 - protein, 24 aa, Mycobacterium tuberculosis
KSLYLRNEVFAAWIEKVDALVQDE

SEQ ID NO: 1376376 - protein, 17 aa, Mycobacterium tuberculosis
KTNPWPLVAGAAAVVLV

SEQ ID NO: 1376377 - protein, 17 aa, Mycobacterium tuberculosis
KVVLDWDALPPVARIEL

SEQ ID NO: 1376378 - protein, 24 aa, Mycobacterium tuberculosis
KYTFRKRALIVMAVILVGSAAAAF

SEQ ID NO: 1376379 - protein, 25 aa, Mycobacterium tuberculosis
LAARLRASTGLGEVWRCLRCGDFAL

SEQ ID NO: 1376380 - protein, 20 aa, Mycobacterium tuberculosis
LAAWAVWEFRGARGAIQATL

SEQ ID NO: 1376381 - protein, 29 aa, Mycobacterium tuberculosis
LAFLLVFGLFVRKGWDIVIGLVVLFVYGG

SEQ ID NO: 1376382 - protein, 29 aa, Mycobacterium tuberculosis
LAITFLHFVRLPAMLFGVGRYTVTMELVE

SEQ ID NO: 1376383 - protein, 19 aa, Mycobacterium tuberculosis
LALPGYRPGYNDRYYLRAG

SEQ ID NO: 1376384 - protein, 17 aa, Mycobacterium tuberculosis
LALTASMTWEILWALIL

SEQ ID NO: 1376385 - protein, 19 aa, Mycobacterium tuberculosis
LASMPSWGLVVTMFAWGYL

SEQ ID NO: 1376386 - protein, 21 aa, Mycobacterium tuberculosis
LDGAPPMPPPRDPLEEVTAAL

SEQ ID NO: 1376387 - protein, 17 aa, Mycobacterium tuberculosis
LDNGAGLHEARTAALNL

SEQ ID NO: 1376388 - protein, 21 aa, Mycobacterium tuberculosis
LDRPAEFVVGSAIQVVDRVQW

SEQ ID NO: 1376389 - protein, 23 aa, Mycobacterium tuberculosis
LGLLWYAGLPLRVFLSSLAAVVV

SEQ ID NO: 1376390 - protein, 18 aa, Mycobacterium tuberculosis
LGQPHLSATLGLLPEADA

SEQ ID NO: 1376391 - protein, 28 aa, Mycobacterium tuberculosis
LGVPHLDPGPFLSYGIQWISFGILAPIG

SEQ ID NO: 1376392 - protein, 19 aa, Mycobacterium tuberculosis
LGVPTAWLVAPVEAGGKTQ

SEQ ID NO: 1376393 - protein, 18 aa, Mycobacterium tuberculosis
LIPLTGLTTPWMSYGGSS

SEQ ID NO: 1376394 - protein, 26 aa, Mycobacterium tuberculosis
LKAVAYWLDRYELLSSGRKEPTFTGA

SEQ ID NO: 1376395 - protein, 19 aa, Mycobacterium tuberculosis
LKFAMFMLAEYVNMTTVSA

SEQ ID NO: 1376396 - protein, 18 aa, Mycobacterium tuberculosis
LKGGSAVKPFAGVPHVSR

SEQ ID NO: 1376397 - protein, 18 aa, Mycobacterium tuberculosis
LKTGQLVGATPWKQQVAL

SEQ ID NO: 1376398 - protein, 26 aa, Mycobacterium tuberculosis
LLALLANLFLPWGIAGAAPTALDVLT

SEQ ID NO: 1376399 - protein, 23 aa, Mycobacterium tuberculosis
LLLARAVLSPARIVLLDEPVEHL

SEQ ID NO: 1376400 - protein, 17 aa, Mycobacterium tuberculosis
LNGWFFGVVYWLFDLSG

SEQ ID NO: 1376401 - protein, 17 aa, Mycobacterium tuberculosis
LPIALGLLIMMYPVLAK

SEQ ID NO: 1376402 - protein, 30 aa, Mycobacterium tuberculosis
LPVVTWAAWPFHRVAMRNARHHAASMETLI

SEQ ID NO: 1376403 - protein, 17 aa, Mycobacterium tuberculosis
LRRTRRAISELLRGNQD

SEQ ID NO: 1376404 - protein, 20 aa, Mycobacterium tuberculosis
LSGLAEFGLAVNMQAIVFMS

SEQ ID NO: 1376405 - protein, 19 aa, Mycobacterium tuberculosis
LSPEQWFAFTPPRVPVLES

SEQ ID NO: 1376406 - protein, 21 aa, Mycobacterium tuberculosis
LTSTLRPAGVDEWFICGPLAM

SEQ ID NO: 1376407 - protein, 18 aa, Mycobacterium tuberculosis
LVDVIGCSLRLPGIYPPQ

SEQ ID NO: 1376408 - protein, 26 aa, Mycobacterium tuberculosis
LVGATGVFLACRWAQADGADHAWLGY

SEQ ID NO: 1376409 - protein, 26 aa, Mycobacterium tuberculosis
LVIVGWLTLWPFLSWLTTHFVVTNRR

SEQ ID NO: 1376410 - protein, 18 aa, Mycobacterium tuberculosis
LVRELRADRGPVLLITAV

SEQ ID NO: 1376411 - protein, 19 aa, Mycobacterium tuberculosis
LVTRAAILVGLFLAAVALV

SEQ ID NO: 1376412 - protein, 17 aa, Mycobacterium tuberculosis
LWLAGWGAARLVATALP

SEQ ID NO: 1376413 - protein, 19 aa, Mycobacterium tuberculosis
LWTANWRFVAQNTDYFTQG

SEQ ID NO: 1376414 - protein, 22 aa, Mycobacterium tuberculosis
LYPPCLFKLLTGWNCPACGGLR

SEQ ID NO: 1376415 - protein, 17 aa, Mycobacterium tuberculosis
MAQLGLRNTFWALVLPF

SEQ ID NO: 1376416 - protein, 24 aa, Mycobacterium tuberculosis
MESEFPSELSVLFKNLETKGNPWG

SEQ ID NO: 1376417 - protein, 23 aa, Mycobacterium tuberculosis
MLNRRRPLLHLLTFLCGGYTMAG

SEQ ID NO: 1376418 - protein, 17 aa, Mycobacterium tuberculosis
MPEPVVERYRLGEQTIA

SEQ ID NO: 1376419 - protein, 17 aa, Mycobacterium tuberculosis
MPVLALATWQFRRASNW

SEQ ID NO: 1376420 - protein, 22 aa, Mycobacterium tuberculosis
MQWRKRRLVITIISTGLIFGMT

SEQ ID NO: 1376421 - protein, 19 aa, Mycobacterium tuberculosis
MRSAFYAGYEEADREYVQI

SEQ ID NO: 1376422 - protein, 20 aa, Mycobacterium tuberculosis
MSLNTSYYRLMLKLNGGPQA

SEQ ID NO: 1376423 - protein, 24 aa, Mycobacterium tuberculosis
MSREIAELPNIVMVRGLTRPNGEP

SEQ ID NO: 1376424 - protein, 19 aa, Mycobacterium tuberculosis
MTLVLTGLVNGFRVEAERT

SEQ ID NO: 1376425 - protein, 21 aa, Mycobacterium tuberculosis
MTSARLARIAPISREMVLNFV

SEQ ID NO: 1376426 - protein, 44 aa, Mycobacterium tuberculosis
NDYRPNLFVTYWSFRMMIGLMAIPVLFALIALWLTRGGQIPNQR

SEQ ID NO: 1376427 - protein, 17 aa, Mycobacterium tuberculosis
NEARWVRGAVPFEGDVG

SEQ ID NO: 1376428 - protein, 27 aa, Mycobacterium tuberculosis
NLHDELFDACGWRRLIFATPEELEAAL

SEQ ID NO: 1376429 - protein, 17 aa, Mycobacterium tuberculosis
NPETGKYGPIYDEKTGT

SEQ ID NO: 1376430 - protein, 17 aa, Mycobacterium tuberculosis
NSAGWVFTEMGRQPWVV

SEQ ID NO: 1376431 - protein, 23 aa, Mycobacterium tuberculosis
NTRNVFGPPAWAPVVNNVVAIAT

SEQ ID NO: 1376432 - protein, 28 aa, Mycobacterium tuberculosis
NVTLYLRLGDWVPVTAFVVMGAGFAVFL

SEQ ID NO: 1376433 - protein, 23 aa, Mycobacterium tuberculosis
PALAIGIAVSFLAAVTLLPAILV

SEQ ID NO: 1376434 - protein, 26 aa, Mycobacterium tuberculosis
PALSAWRFVTVFGVVGLLADVVYEGA

SEQ ID NO: 1376435 - protein, 26 aa, Mycobacterium tuberculosis
PARRRELSQLPVLRWVDNSGNRANRR

SEQ ID NO: 1376436 - protein, 22 aa, Mycobacterium tuberculosis
PATGARLRWAPAQGPSATPAQG

SEQ ID NO: 1376437 - protein, 31 aa, Mycobacterium tuberculosis
PGLPDIPGLPDFKWPPTPGSPLFPDLPSFPG

SEQ ID NO: 1376438 - protein, 21 aa, Mycobacterium tuberculosis
PGTPIWRLVLPFIALGVAGAF

SEQ ID NO: 1376439 - protein, 21 aa, Mycobacterium tuberculosis
PHHPHRFDWFGVGLSGAGMFL

SEQ ID NO: 1376440 - protein, 24 aa, Mycobacterium tuberculosis
PMAAVLRWLEIPQFSVFDEIFRGI

SEQ ID NO: 1376441 - protein, 20 aa, Mycobacterium tuberculosis
PNAADWPLILADASQPLTLE

SEQ ID NO: 1376442 - protein, 19 aa, Mycobacterium tuberculosis
PPPPFTSWMPPGYPPEPPQ

SEQ ID NO: 1376443 - protein, 23 aa, Mycobacterium tuberculosis
PQAKRVPGLVVYRYDAPLCFANA

SEQ ID NO: 1376444 - protein, 17 aa, Mycobacterium tuberculosis
PQPPWPHLAAAALTAVA

SEQ ID NO: 1376445 - protein, 26 aa, Mycobacterium tuberculosis
PRERHIASWLAALVVPSVICAITVAW

SEQ ID NO: 1376446 - protein, 17 aa, Mycobacterium tuberculosis
PRTLPNAIAPVVAGTGA

SEQ ID NO: 1376447 - protein, 20 aa, Mycobacterium tuberculosis
PSLLPRGPLFQGLVSGICGA

SEQ ID NO: 1376448 - protein, 24 aa, Mycobacterium tuberculosis
PSSTKLRNGFRIQRQNTRIGQDVA

SEQ ID NO: 1376449 - protein, 18 aa, Mycobacterium tuberculosis
PVLQEAFGRPFAGAESLQ

SEQ ID NO: 1376450 - protein, 26 aa, Mycobacterium tuberculosis
QEGDRGVSWLPFFHDMGLITVLLASV

SEQ ID NO: 1376451 - protein, 18 aa, Mycobacterium tuberculosis
QFMLRTAPFSHDGWLGDW

SEQ ID NO: 1376452 - protein, 17 aa, Mycobacterium tuberculosis
QIHHWAALMFAAAIMVH

SEQ ID NO: 1376453 - protein, 21 aa, Mycobacterium tuberculosis
QPIGFGMSVVRQLAHFIDAII

SEQ ID NO: 1376454 - protein, 25 aa, Mycobacterium tuberculosis
QTPKVFKAAAWVAIAAGTVFIVAVI

SEQ ID NO: 1376455 - protein, 17 aa, Mycobacterium tuberculosis
QTSWGIVGWSMGGTCAV

SEQ ID NO: 1376456 - protein, 30 aa, Mycobacterium tuberculosis
QVSGWRFLLRRLEHAIVRRDTRMFDDPLQF

SEQ ID NO: 1376457 - protein, 17 aa, Mycobacterium tuberculosis
QVVPLLWAASSGVPAVL

SEQ ID NO: 1376458 - protein, 18 aa, Mycobacterium tuberculosis
RETWLIMRLPVIGNTQAL

SEQ ID NO: 1376459 - protein, 17 aa, Mycobacterium tuberculosis
RGWLAILSLRLIPVVPF

SEQ ID NO: 1376460 - protein, 18 aa, Mycobacterium tuberculosis
RKLDIEPIYLLKREVVEL

SEQ ID NO: 1376461 - protein, 17 aa, Mycobacterium tuberculosis
RLLQGFAVGGEWAGSAL

SEQ ID NO: 1376462 - protein, 19 aa, Mycobacterium tuberculosis
RPIANSVMFGATFSAEDFK

SEQ ID NO: 1376463 - protein, 18 aa, Mycobacterium tuberculosis
RRAVEHRALMAIAFGDLG

SEQ ID NO: 1376464 - protein, 18 aa, Mycobacterium tuberculosis
RRTLGLIVVCCYVALVVT

SEQ ID NO: 1376465 - protein, 20 aa, Mycobacterium tuberculosis
RTAFTLAAGLLFGSVVGVFI

SEQ ID NO: 1376466 - protein, 18 aa, Mycobacterium tuberculosis
RTIREFIGAVLLVPTVIA

SEQ ID NO: 1376467 - protein, 22 aa, Mycobacterium tuberculosis
RTPAIVISVAWWLATVNLLLGL

SEQ ID NO: 1376468 - protein, 19 aa, Mycobacterium tuberculosis
RVANLFLTKTVYSVLLALL

SEQ ID NO: 1376469 - protein, 17 aa, Mycobacterium tuberculosis
RVEFEHVNFAYLPGTPV

SEQ ID NO: 1376470 - protein, 27 aa, Mycobacterium tuberculosis
RVGQINWKWIRRSLYLTAAVVILLPMV

SEQ ID NO: 1376471 - protein, 29 aa, Mycobacterium tuberculosis
SAWAVAGLGWLRRHTRAIQIFGGALLIAV

SEQ ID NO: 1376472 - protein, 21 aa, Mycobacterium tuberculosis
SELRPPVRSGFGSRIELRLAA

SEQ ID NO: 1376473 - protein, 18 aa, Mycobacterium tuberculosis
SFLRPVLAPDYGRVARAV

SEQ ID NO: 1376474 - protein, 34 aa, Mycobacterium tuberculosis; identical to SEQ ID NO: 158971

SEQ ID NO: 1376475 - protein, 20 aa, Mycobacterium tuberculosis
SGSAPRFTARMSKSGVPYGG

SEQ ID NO: 1376476 - protein, 18 aa, Mycobacterium tuberculosis
SGYDFRPQIVGVFTDLAG

SEQ ID NO: 1376477 - protein, 25 aa, Mycobacterium tuberculosis
SIHRAYRYARAMARWSPTSRSEVTD

SEQ ID NO: 1376478 - protein, 23 aa, Mycobacterium tuberculosis
SRETLGRNCWRGERRAWIEVRGL

SEQ ID NO: 1376479 - protein, 20 aa, Mycobacterium tuberculosis
STPGPSDRRALHTAFAGAAI

SEQ ID NO: 1376480 - protein, 26 aa, Mycobacterium tuberculosis
SVIRNWPAWLGVYGFMTLDRWLLFNW

SEQ ID NO: 1376481 - protein, 21 aa, Mycobacterium tuberculosis
SWTHHWVWLVPLMIWLIDGPA

SEQ ID NO: 1376482 - protein, 17 aa, Mycobacterium tuberculosis
TELGGQPGLWIPSSSIS

SEQ ID NO: 1376483 - protein, 30 aa, Mycobacterium tuberculosis; identical to SEQ ID NO: 159146

SEQ ID NO: 1376484 - protein, 24 aa, Mycobacterium tuberculosis
TFDVVLCGLALSILAAAIVIGRLR

SEQ ID NO: 1376485 - protein, 25 aa, Mycobacterium tuberculosis
TGFFPLMGIGAFSMLAFSGRFGRAR

SEQ ID NO: 1376486 - protein, 22 aa, Mycobacterium tuberculosis
TLPGIGTLAAWFAAAGEVVVFL

SEQ ID NO: 1376487 - protein, 17 aa, Mycobacterium tuberculosis
TLSTWATAAAWAFSLAM

SEQ ID NO: 1376488 - protein, 22 aa, Mycobacterium tuberculosis
TRLFPPSLAVVFSRSSSAPTES

SEQ ID NO: 1376489 - protein, 17 aa, Mycobacterium tuberculosis
TTFAAFTALIVFLVGIV

SEQ ID NO: 1376490 - protein, 26 aa, Mycobacterium tuberculosis
TVFGRGDIALGWAFLGAGIGSLVRPL

SEQ ID NO: 1376491 - protein, 19 aa, Mycobacterium tuberculosis
TVGITFLGMRFAKLGVFST

SEQ ID NO: 1376492 - protein, 31 aa, Mycobacterium tuberculosis; identical to SEQ ID NO: 160672

SEQ ID NO: 1376493 - protein, 23 aa, Mycobacterium tuberculosis
TVPGDAWERLGAALVNAYPTLTQ

SEQ ID NO: 1376494 - protein, 23 aa, Mycobacterium tuberculosis
TVTMELVEAGGLYRTGNVTYRGF

SEQ ID NO: 1376495 - protein, 23 aa, Mycobacterium tuberculosis
TVVVSSLIGGFVFGAAMVGMLAA

SEQ ID NO: 1376496 - protein, 19 aa, Mycobacterium tuberculosis
TYLLTYVRRYYGGRIAHLV

SEQ ID NO: 1376497 - protein, 27 aa, Mycobacterium tuberculosis
VARRGQLRAGTALVARGEFSLIIIGLA

SEQ ID NO: 1376498 - protein, 18 aa, Mycobacterium tuberculosis
VARTLPGKQFEAGRQLRV

SEQ ID NO: 1376499 - protein, 21 aa, Mycobacterium tuberculosis
VEASSLFRVSKLNCSITTSDG

SEQ ID NO: 1376500 - protein, 33 aa, Mycobacterium tuberculosis; identical to SEQ ID NO: 159382

SEQ ID NO: 1376501 - protein, 17 aa, Mycobacterium tuberculosis
VFGESLGSFGGEAPFMN

SEQ ID NO: 1376502 - protein, 20 aa, Mycobacterium tuberculosis
VGFYSTFFFFFFVAELLDTW

SEQ ID NO: 1376503 - protein, 20 aa, Mycobacterium tuberculosis
VGPVTSEFSGKVHFVEQDRN

SEQ ID NO: 1376504 - protein, 19 aa, Mycobacterium tuberculosis
VGSEPDFLRVWLPGQLLQG

SEQ ID NO: 1376505 - protein, 21 aa, Mycobacterium tuberculosis
VLAWRDSWEYWTHTLHHTDRI

SEQ ID NO: 1376506 - protein, 22 aa, Mycobacterium tuberculosis
VLTPRQPWAWLALLVAGLTVGL

SEQ ID NO: 1376507 - protein, 17 aa, Mycobacterium tuberculosis
VPKLTTALIHAYPAEHG

SEQ ID NO: 1376508 - protein, 21 aa, Mycobacterium tuberculosis
VPLSLLVTRAITRRSQPLFVA

SEQ ID NO: 1376509 - protein, 22 aa, Mycobacterium tuberculosis
VRARCFLQGDSLYVAGVSGLGA

SEQ ID NO: 1376510 - protein, 18 aa, Mycobacterium tuberculosis
VSGRLLFALLSFSVVGAV

SEQ ID NO: 1376511 - protein, 26 aa, Mycobacterium tuberculosis
VTAAGATAAWAIGRWTPGTERRTATM

SEQ ID NO: 1376512 - protein, 19 aa, Mycobacterium tuberculosis
VTCGLGAVIWGVIDALLIL

SEQ ID NO: 1376513 - protein, 18 aa, Mycobacterium tuberculosis
VVEPWALHRPFIPWLGWP

SEQ ID NO: 1376514 - protein, 25 aa, Mycobacterium tuberculosis
VVPPPWWWGVVFENWIVVASINGYA

SEQ ID NO: 1376515 - protein, 26 aa, Mycobacterium tuberculosis
VWRDREPALASPRRPQAPVVPIISSA

SEQ ID NO: 1376516 - protein, 19 aa, Mycobacterium tuberculosis
WAFLIWGMYAYLWAFVLYA

SEQ ID NO: 1376517 - protein, 19 aa, Mycobacterium tuberculosis
WFMVVQLPFAGIVFAVDGV

SEQ ID NO: 1376518 - protein, 17 aa, Mycobacterium tuberculosis
WLPESALPAPPRPTVQR

SEQ ID NO: 1376519 - protein, 23 aa, Mycobacterium tuberculosis
WNCPACGGLRMIHDLLHGELAAS

SEQ ID NO: 1376520 - protein, 19 aa, Mycobacterium tuberculosis
WQIAKSVLIFLGIPLLAGY

SEQ ID NO: 1376521 - protein, 22 aa, Mycobacterium tuberculosis
WRAYALPVLMVLTTVVVYQTVT

SEQ ID NO: 1376522 - protein, 20 aa, Mycobacterium tuberculosis
WRLDQLDGRGSIAQLLLRPF

SEQ ID NO: 1376523 - protein, 22 aa, Mycobacterium tuberculosis
WVRHPIMLGFVVAFWATPMMTA

SEQ ID NO: 1376524 - protein, 19 aa, Mycobacterium tuberculosis
WYAAMLFAVIPLRNALPDA

SEQ ID NO: 1376525 - protein, 28 aa, Mycobacterium tuberculosis
YALLVNRWPLPEAGVRSGLAPAERDTAG

SEQ ID NO: 1376526 - protein, 25 aa, Mycobacterium tuberculosis
YGVHLMCSAGGWIHGQRQSLLQNVT

SEQ ID NO: 1376527 - protein, 19 aa, Mycobacterium tuberculosis
YLAAPRKTRAFMAALQSWL

SEQ ID NO: 1376528 - protein, 17 aa, Mycobacterium tuberculosis
YRVLGLLTALSLVASGS

SEQ ID NO: 1376529 - protein, 24 aa, Mycobacterium tuberculosis
YTFTGTAMGLVFVWFSMTPSLLPR

SEQ ID NO: 1376530 - protein, 22 aa, Mycobacterium tuberculosis
YTPWSWLPRIVTQFAAGALACA

SEQ ID NO: 1376531 - protein, 19 aa, Mycobacterium tuberculosis
YVFARPPLLGTTGRTVATG

SEQ ID NO: 1376532 - protein, 17 aa, Mycobacterium tuberculosis
YWLGRLALERGTAIIYL

SEQ ID NO: 1376533 - protein, 22 aa, Mycobacterium tuberculosis
AAALGLRGTRKAEEAAESARLK

SEQ ID NO: 1376534 - protein, 23 aa, Mycobacterium tuberculosis
AAGARPARDLVRVAFGPGVVALG

SEQ ID NO: 1376535 - protein, 26 aa, Mycobacterium tuberculosis
AAGFALGVAMLLGGTWLTCVLAAVTS

SEQ ID NO: 1376536 - protein, 21 aa, Mycobacterium tuberculosis
AAGVVPEWLAYTVAVVLGVTS

SEQ ID NO: 1376537 - protein, 17 aa, Mycobacterium tuberculosis
AARLKREALAMAPAEDE

SEQ ID NO: 1376538 - protein, 23 aa, Mycobacterium tuberculosis
AARRAWRPVALIPSGATPVRLAE

SEQ ID NO: 1376539 - protein, 18 aa, Mycobacterium tuberculosis
ADGVIWARYNVPWQPAFV

SEQ ID NO: 1376540 - protein, 21 aa, Mycobacterium tuberculosis
ADTADGLGCYGPPQRALAVMR

SEQ ID NO: 1376541 - protein, 22 aa, Mycobacterium tuberculosis
AERRGRGDDRWCEIPVGAKPNG

SEQ ID NO: 1376542 - protein, 20 aa, Mycobacterium tuberculosis
AFHSPPGWVVAANAPFKSAT

SEQ ID NO: 1376543 - protein, 22 aa, Mycobacterium tuberculosis
AFSVMSFLLLYGIARFQGVLPF

SEQ ID NO: 1376544 - protein, 24 aa, Mycobacterium tuberculosis
AGAAMAFSSFFVVSNSLRLRNFGA

SEQ ID NO: 1376545 - protein, 20 aa, Mycobacterium tuberculosis
AGLAFTLGMVLTSTLMVRPV

SEQ ID NO: 1376546 - protein, 18 aa, Mycobacterium tuberculosis
AGLFAVGIVIGRKTNTTA

SEQ ID NO: 1376547 - protein, 23 aa, Mycobacterium tuberculosis
AGLKEFVDAAVIFGVVVINAIVG

SEQ ID NO: 1376548 - protein, 20 aa, Mycobacterium tuberculosis
AGVLGALAGVLAKRQHQTRV

SEQ ID NO: 1376549 - protein, 17 aa, Mycobacterium tuberculosis
AHCPAYFQLLVKALVLP

SEQ ID NO: 1376550 - protein, 17 aa, Mycobacterium tuberculosis
AHLRARHDLVLEAFTAV

SEQ ID NO: 1376551 - protein, 20 aa, Mycobacterium tuberculosis
ANYRIARYVAVVAGLLGAVL

SEQ ID NO: 1376552 - protein, 18 aa, Mycobacterium tuberculosis
AQTLPPGRGLLVGADGDV

SEQ ID NO: 1376553 - protein, 24 aa, Mycobacterium tuberculosis
ARFRRSELMLALATTAAVLGLGVF

SEQ ID NO: 1376554 - protein, 28 aa, Mycobacterium tuberculosis
ARSASWRRRLRVRLPRLSTIAMAAAVVI

SEQ ID NO: 1376555 - protein, 21 aa, Mycobacterium tuberculosis
ARSVNPIAFVYNYLKQVVAEM

SEQ ID NO: 1376556 - protein, 19 aa, Mycobacterium tuberculosis
ASATRRALLLTALGGLLIA

SEQ ID NO: 1376557 - protein, 22 aa, Mycobacterium tuberculosis
ASGTGLLAVWSRQTVAAGHPGP

SEQ ID NO: 1376558 - protein, 18 aa, Mycobacterium tuberculosis
ATAFPWVFLFPASILVLI

SEQ ID NO: 1376559 - protein, 25 aa, Mycobacterium tuberculosis
ATAPADRFGSCREFADAMNEQAGVA

SEQ ID NO: 1376560 - protein, 25 aa, Mycobacterium tuberculosis
ATLRPYRVIGGLVLSFGMVTLLGSA

SEQ ID NO: 1376561 - protein, 17 aa, Mycobacterium tuberculosis
ATTLPQVAAIPFSSERQ

SEQ ID NO: 1376562 - protein, 20 aa, Mycobacterium tuberculosis
AVGLRWDPYPFILLNLAFST

SEQ ID NO: 1376563 - protein, 23 aa, Mycobacterium tuberculosis
AVLLFARPRLRVGSAGLSVRNLL

SEQ ID NO: 1376564 - protein, 26 aa, Mycobacterium tuberculosis
AVLSGRVTAVLVCRRLVPAAHGSTLG

SEQ ID NO: 1376565 - protein, 17 aa, Mycobacterium tuberculosis
AVMNRFSPQQAQLTLID

SEQ ID NO: 1376566 - protein, 20 aa, Mycobacterium tuberculosis
AVSRTHWLASHLAMALAGSA

SEQ ID NO: 1376567 - protein, 19 aa, Mycobacterium tuberculosis
AYRTRPVFVPDADNDPVAR

SEQ ID NO: 1376568 - protein, 18 aa, Mycobacterium tuberculosis
CTALQLPLSVVLIDAGER

SEQ ID NO: 1376569 - protein, 20 aa, Mycobacterium tuberculosis
CTYIIGFRFYARLIEMKVVR

SEQ ID NO: 1376570 - protein, 25 aa, Mycobacterium tuberculosis
DDALELRGRILGAFEAAEVSTDHAE

SEQ ID NO: 1376571 - protein, 23 aa, Mycobacterium tuberculosis
DDYRRLGVRGQRLLALYYPFVAL

SEQ ID NO: 1376572 - protein, 25 aa, Mycobacterium tuberculosis
DLKSLRGKVVLIDFWAYSCINCQRA

SEQ ID NO: 1376573 - protein, 23 aa, Mycobacterium tuberculosis
DLPRSEALKVLAAELSRDLDFRA

SEQ ID NO: 1376574 - protein, 17 aa, Mycobacterium tuberculosis
DNVRRYQIEPALHDGDY

SEQ ID NO: 1376575 - protein, 28 aa, Mycobacterium tuberculosis
DPVRMTFRSSRLVYPMRLSVAAQEPQHV

SEQ ID NO: 1376576 - protein, 23 aa, Mycobacterium tuberculosis
DRLLRRVCPGDIVVLDVLDLDRI

SEQ ID NO: 1376577 - protein, 24 aa, Mycobacterium tuberculosis
DRSRIEFAITILLLVILLIIYGNP

SEQ ID NO: 1376578 - protein, 23 aa, Mycobacterium tuberculosis
DVLVLRRRVGLVAQAPVVLTDAV

SEQ ID NO: 1376579 - protein, 23 aa, Mycobacterium tuberculosis
EADGWRWVFLVNLPLGVFAVLAA

SEQ ID NO: 1376580 - protein, 21 aa, Mycobacterium tuberculosis
EAKTPKAAFRIAFAGPATSLA

SEQ ID NO: 1376581 - protein, 18 aa, Mycobacterium tuberculosis
ECDSVVAAVSRLTSAQAP

SEQ ID NO: 1376582 - protein, 24 aa, Mycobacterium tuberculosis
EEALRHGWALAAICFVAVGIGALS

SEQ ID NO: 1376583 - protein, 24 aa, Mycobacterium tuberculosis
EGRVTELLARLCLGQSAREAFLPH

SEQ ID NO: 1376584 - protein, 27 aa, Mycobacterium tuberculosis
ERRTWLPRVWLALPLGLLALGSSMFFG

SEQ ID NO: 1376585 - protein, 21 aa, Mycobacterium tuberculosis
ETERIWLPFTIWLTAAPALLP

SEQ ID NO: 1376586 - protein, 27 aa, Mycobacterium tuberculosis
EVIVNLGYGDPRFGYSTSPANVPTPFG

SEQ ID NO: 1376587 - protein, 17 aa, Mycobacterium tuberculosis
FARIGRLGQVPVIVASV

SEQ ID NO: 1376588 - protein, 24 aa, Mycobacterium tuberculosis
FASLAVAVAVTIRPTAASKPVEGH

SEQ ID NO: 1376589 - protein, 24 aa, Mycobacterium tuberculosis
FGFAALRIASYALWPFGRTIVEKP

SEQ ID NO: 1376590 - protein, 22 aa, Mycobacterium tuberculosis
FIEGRSVAELVALGEEIYDEII

SEQ ID NO: 1376591 - protein, 17 aa, Mycobacterium tuberculosis
FIIGHGRLFGFYVAFYC

SEQ ID NO: 1376592 - protein, 30 aa, Mycobacterium tuberculosis; identical to SEQ ID NO: 156829

SEQ ID NO: 1376593 - protein, 23 aa, Mycobacterium tuberculosis
FPAGLWRWLQRHPPPALHRLTRF

SEQ ID NO: 1376594 - protein, 17 aa, Mycobacterium tuberculosis
FPALFAAIITSAGGVPQ

SEQ ID NO: 1376595 - protein, 17 aa, Mycobacterium tuberculosis
FPIDIGPQPAWRNLRFP

SEQ ID NO: 1376596 - protein, 18 aa, Mycobacterium tuberculosis
FTPVAWGVLVGFIALYLL

SEQ ID NO: 1376597 - protein, 34 aa, Mycobacterium tuberculosis; identical to SEQ ID NO: 156916

SEQ ID NO: 1376598 - protein, 21 aa, Mycobacterium tuberculosis
FVRGEGAGVVVLKRLTDAQRD

SEQ ID NO: 1376599 - protein, 24 aa, Mycobacterium tuberculosis
FYLPPEVFDNPDFQRGLEQFLSPD

SEQ ID NO: 1376600 - protein, 19 aa, Mycobacterium tuberculosis
GALLAILAVVPWRQFASGE

SEQ ID NO: 1376601 - protein, 26 aa, Mycobacterium tuberculosis
GASAWRRLTKVILPMIKPAIVVALLF

SEQ ID NO: 1376602 - protein, 24 aa, Mycobacterium tuberculosis
GDQRVLGAALWYAATVKDAVIVAA

SEQ ID NO: 1376603 - protein, 20 aa, Mycobacterium tuberculosis
GELQRLALAAALAREPAMLI

SEQ ID NO: 1376604 - protein, 20 aa, Mycobacterium tuberculosis
GERRAWIEVRGLRSGGDDEL

SEQ ID NO: 1376605 - protein, 18 aa, Mycobacterium tuberculosis
GGVRLRYEQAITDASVAV

SEQ ID NO: 1376606 - protein, 22 aa, Mycobacterium tuberculosis
GHHSAARVVAWAIFATACITDR

SEQ ID NO: 1376607 - protein, 27 aa, Mycobacterium tuberculosis
GIARRSGTPISFWKFTRKGAVVTAVSL

SEQ ID NO: 1376608 - protein, 23 aa, Mycobacterium tuberculosis
GILVGVAFVHWLIFQSLYRIGAL

SEQ ID NO: 1376609 - protein, 18 aa, Mycobacterium tuberculosis
GISLPIALGLLIMMYPVL

SEQ ID NO: 1376610 - protein, 26 aa, Mycobacterium tuberculosis
GIVDPEFGYDIGFFVFDLPFYRSVLN

SEQ ID NO: 1376611 - protein, 17 aa, Mycobacterium tuberculosis
GLAGPFAPMAYVLAGIF

SEQ ID NO: 1376612 - protein, 19 aa, Mycobacterium tuberculosis
GLGAVVFYLALKYTSEFLL

SEQ ID NO: 1376613 - protein, 18 aa, Mycobacterium tuberculosis
GLVALYILMQLARQRRML

SEQ ID NO: 1376614 - protein, 25 aa, Mycobacterium tuberculosis
GPMSHAAVVAREFGFPCVVDAQGAT

SEQ ID NO: 1376615 - protein, 27 aa, Mycobacterium tuberculosis
GPTAFWACGLLLCVFIGPAQSSARALL

SEQ ID NO: 1376616 - protein, 18 aa, Mycobacterium tuberculosis
GQLLQGIGVGATLPVLSS

SEQ ID NO: 1376617 - protein, 22 aa, Mycobacterium tuberculosis
GQRALRLPFSRLLATLPISATP

SEQ ID NO: 1376618 - protein, 20 aa, Mycobacterium tuberculosis
GRIKDLVIIDGRNHYPQDLE

SEQ ID NO: 1376619 - protein, 20 aa, Mycobacterium tuberculosis
GWWSLVSLLAMNWIALISNF

SEQ ID NO: 1376620 - protein, 18 aa, Mycobacterium tuberculosis
IAMRTVAVFAHRLYGAIT

SEQ ID NO: 1376621 - protein, 20 aa, Mycobacterium tuberculosis
IATYLRGDWYRDWGSVEQYH

SEQ ID NO: 1376622 - protein, 29 aa, Mycobacterium tuberculosis
IDLHDPPPCMTGFLPPPLVRSPADESVRE

SEQ ID NO: 1376623 - protein, 20 aa, Mycobacterium tuberculosis
IEGLLTWLGGGHWRELGERH

SEQ ID NO: 1376624 - protein, 19 aa, Mycobacterium tuberculosis
IGVGATFPLLGSAALARLA

SEQ ID NO: 1376625 - protein, 18 aa, Mycobacterium tuberculosis
IILYWFSNNIWTFGQQHY

SEQ ID NO: 1376626 - protein, 17 aa, Mycobacterium tuberculosis
ILHGVWILLFASLFTNL

SEQ ID NO: 1376627 - protein, 25 aa, Mycobacterium tuberculosis
ILLFGGRRTDAWGHLLGCAAALAAF

SEQ ID NO: 1376628 - protein, 20 aa, Mycobacterium tuberculosis
ILLILCRLVQGFATGGEYGT

SEQ ID NO: 1376629 - protein, 19 aa, Mycobacterium tuberculosis
IPAALSAPSLNRGVGFTHA

SEQ ID NO: 1376630 - protein, 17 aa, Mycobacterium tuberculosis
IPAVASRSGDLPPAVTV

SEQ ID NO: 1376631 - protein, 22 aa, Mycobacterium tuberculosis
ISHMLPLFRRMQSLIDGINRVM

SEQ ID NO: 1376632 - protein, 30 aa, Mycobacterium tuberculosis; identical to SEQ ID NO: 157514

SEQ ID NO: 1376633 - protein, 26 aa, Mycobacterium tuberculosis
IVCTDAEAILGIGDWGVGGIQIAVGK

SEQ ID NO: 1376634 - protein, 17 aa, Mycobacterium tuberculosis
IVSEIFPVFSRKPIFGY

SEQ ID NO: 1376635 - protein, 17 aa, Mycobacterium tuberculosis
IVTAVAGALDYAHQRGL

SEQ ID NO: 1376636 - protein, 30 aa, Mycobacterium tuberculosis
IYYSPRLFAAMGFAGYFAMLALPAMVQVAG

SEQ ID NO: 1376637 - protein, 23 aa, Mycobacterium tuberculosis
KALRVGYAAAFSVPANQLPQTVF

SEQ ID NO: 1376638 - protein, 22 aa, Mycobacterium tuberculosis
KIFGWHGMGEWMVRGISTQDTN

SEQ ID NO: 1376639 - protein, 23 aa, Mycobacterium tuberculosis
KLRIECRKAKERLSSSTVTTLTD

SEQ ID NO: 1376640 - protein, 18 aa, Mycobacterium tuberculosis
KPKARSVNPIAFVYNYLK

SEQ ID NO: 1376641 - protein, 20 aa, Mycobacterium tuberculosis
KPPVGAALWKLMERARQVGL

SEQ ID NO: 1376642 - protein, 23 aa, Mycobacterium tuberculosis
KVHRHWGFGGGPHRCLGSHLARL

SEQ ID NO: 1376643 - protein, 19 aa, Mycobacterium tuberculosis
LAAVAMFLGFVAPALSLSP

SEQ ID NO: 1376644 - protein, 23 aa, Mycobacterium tuberculosis
LADQLRAASTMRVQTPDDPTFAL

SEQ ID NO: 1376645 - protein, 30 aa, Mycobacterium tuberculosis; identical to SEQ ID NO: 157630

SEQ ID NO: 1376646 - protein, 18 aa, Mycobacterium tuberculosis
LAKRLPRRALTVLRGESL

SEQ ID NO: 1376647 - protein, 20 aa, Mycobacterium tuberculosis
LAPDAKPYQGGHRFHQVEVV

SEQ ID NO: 1376648 - protein, 27 aa, Mycobacterium tuberculosis
LATLEAFLKRRVRTHGLLTASIAAAVH

SEQ ID NO: 1376649 - protein, 19 aa, Mycobacterium tuberculosis
LEPKRMARVRGWRKVGAAI

SEQ ID NO: 1376650 - protein, 23 aa, Mycobacterium tuberculosis
LEYELDAAKLLDFPVMTDMRDPL

SEQ ID NO: 1376651 - protein, 25 aa, Mycobacterium tuberculosis
LFVPAALPWYYSWPLAVAAPLAQAR

SEQ ID NO: 1376652 - protein, 17 aa, Mycobacterium tuberculosis
LGAVIWGVIDALLILTD

SEQ ID NO: 1376653 - protein, 26 aa, Mycobacterium tuberculosis
LGEDYLRLSALGSYGAFFNIYFCSVT

SEQ ID NO: 1376654 - protein, 22 aa, Mycobacterium tuberculosis
LGFAVARPRGWPEAAAAVPAAV

SEQ ID NO: 1376655 - protein, 23 aa, Mycobacterium tuberculosis
LGFVMPGDIPFQVQLPSTPLAPP

SEQ ID NO: 1376656 - protein, 20 aa, Mycobacterium tuberculosis
LGHRVADGWLVARAGSLQRR

SEQ ID NO: 1376657 - protein, 27 aa, Mycobacterium tuberculosis
LGIARRAGAPISFWEFTRKGAVVTAVS

SEQ ID NO: 1376658 - protein, 32 aa, Mycobacterium tuberculosis; identical to SEQ ID NO: 157764

SEQ ID NO: 1376659 - protein, 43 aa, Mycobacterium tuberculosis; identical to SEQ ID NO: 157769

SEQ ID NO: 1376660 - protein, 20 aa, Mycobacterium tuberculosis
LGVLRDGQKWVALAVPGYTL

SEQ ID NO: 1376661 - protein, 27 aa, Mycobacterium tuberculosis
LICLLAGTARLGFLASLLSRPVLVGYM

SEQ ID NO: 1376662 - protein, 25 aa, Mycobacterium tuberculosis
LILLWGSAGALGFVEQDLGFKIIFG

SEQ ID NO: 1376663 - protein, 18 aa, Mycobacterium tuberculosis
LLDSRYLVQAKIASGGTS

SEQ ID NO: 1376664 - protein, 32 aa, Mycobacterium tuberculosis; identical to SEQ ID NO: 157821

SEQ ID NO: 1376665 - protein, 18 aa, Mycobacterium tuberculosis
LLVCDRLGVNSTPFLVAE

SEQ ID NO: 1376666 - protein, 24 aa, Mycobacterium tuberculosis
LNKFEVIVVPVLLALMLSALLVPP

SEQ ID NO: 1376667 - protein, 20 aa, Mycobacterium tuberculosis
LNNRRVPVVDIYDAQRVHIG

SEQ ID NO: 1376668 - protein, 24 aa, Mycobacterium tuberculosis
LPIVNASGGPNCRGLPDIPTKQTG

SEQ ID NO: 1376669 - protein, 18 aa, Mycobacterium tuberculosis
LPMLAQIPVFLGLYHVLR

SEQ ID NO: 1376670 - protein, 18 aa, Mycobacterium tuberculosis
LQPTVPILLANLVSVGQV

SEQ ID NO: 1376671 - protein, 21 aa, Mycobacterium tuberculosis
LRALKPWEGPRHFVLIDDVQD

SEQ ID NO: 1376672 - protein, 17 aa, Mycobacterium tuberculosis
LRDFAVFKAIGTPTRSI

SEQ ID NO: 1376673 - protein, 19 aa, Mycobacterium tuberculosis
LRPLRRVAATAAEVATMPL

SEQ ID NO: 1376674 - protein, 17 aa, Mycobacterium tuberculosis
LSIAFAIGERHELGPVP

SEQ ID NO: 1376675 - protein, 22 aa, Mycobacterium tuberculosis
LSVLIWQHFVGLQVHWTIVAMS

SEQ ID NO: 1376676 - protein, 19 aa, Mycobacterium tuberculosis
LTARPGMLTAVIGPSGAGK

SEQ ID NO: 1376677 - protein, 19 aa, Mycobacterium tuberculosis
LTFLDCLYYAAVTLSTTGY

SEQ ID NO: 1376678 - protein, 17 aa, Mycobacterium tuberculosis
LTQELRFATTMTGGVSL

SEQ ID NO: 1376679 - protein, 17 aa, Mycobacterium tuberculosis
LVFPVLLGILTLLLSAC

SEQ ID NO: 1376680 - protein, 19 aa, Mycobacterium tuberculosis
LVGASRWYTQLPFLVEAML

SEQ ID NO: 1376681 - protein, 23 aa, Mycobacterium tuberculosis
LVGCGLTAIALEIEKWWRTGGQG

SEQ ID NO: 1376682 - protein, 18 aa, Mycobacterium tuberculosis
LWQARLAPDAKPYQGGHR

SEQ ID NO: 1376683 - protein, 19 aa, Mycobacterium tuberculosis
MEIGVPIFFVLSGFLLFRP

SEQ ID NO: 1376684 - protein, 17 aa, Mycobacterium tuberculosis
MGGGFIGVDAFFVLSGF

SEQ ID NO: 1376685 - protein, 18 aa, Mycobacterium tuberculosis
MGGTCAVDLTVMHPTLFS

SEQ ID NO: 1376686 - protein, 17 aa, Mycobacterium tuberculosis
MMAGLLVSLLVRRRRVW

SEQ ID NO: 1376687 - protein, 18 aa, Mycobacterium tuberculosis
MMLLNVLKPTGIVGDSAI

SEQ ID NO: 1376688 - protein, 17 aa, Mycobacterium tuberculosis
MPRAMPATAAFPPPAGP

SEQ ID NO: 1376689 - protein, 23 aa, Mycobacterium tuberculosis
MSRGELDRTLLLWMLPLLIAPPM

SEQ ID NO: 1376690 - protein, 18 aa, Mycobacterium tuberculosis
MVNSCLGLWQKIVFGRRV

SEQ ID NO: 1376691 - protein, 18 aa, Mycobacterium tuberculosis
NDAALVRDGTRWQIVGDP

SEQ ID NO: 1376692 - protein, 25 aa, Mycobacterium tuberculosis
NDVAKYFAIIPAMFVGLYPVLDKLN

SEQ ID NO: 1376693 - protein, 24 aa, Mycobacterium tuberculosis
NQNRIRWGNLLTLPVARGGLLYVE

SEQ ID NO: 1376694 - protein, 24 aa, Mycobacterium tuberculosis
NSFALRGRWALDYQGATSDGNDAA

SEQ ID NO: 1376695 - protein, 19 aa, Mycobacterium tuberculosis
PALVLYVSMLSKWPVGWVV

SEQ ID NO: 1376696 - protein, 26 aa, Mycobacterium tuberculosis
PATLLLLRYRWLRSEPLPVRRPASVR

SEQ ID NO: 1376697 - protein, 17 aa, Mycobacterium tuberculosis
PDHSIDVAFAIDRSYTL

SEQ ID NO: 1376698 - protein, 22 aa, Mycobacterium tuberculosis
PDPNLRPQIVGVFTDLTGPAPP

SEQ ID NO: 1376699 - protein, 19 aa, Mycobacterium tuberculosis
PELDRGQEAGFTLSAPLRS

SEQ ID NO: 1376700 - protein, 20 aa, Mycobacterium tuberculosis
PEMPAPCPTQRPPVTPRHNL

SEQ ID NO: 1376701 - protein, 18 aa, Mycobacterium tuberculosis
PGDGARLVTTMTRHPGGA

SEQ ID NO: 1376702 - protein, 28 aa, Mycobacterium tuberculosis
PLPTEIYWRRRGLALGIAVVVVGIAVAI

SEQ ID NO: 1376703 - protein, 23 aa, Mycobacterium tuberculosis
PMIVAVPVGAYLALPVAAIVIGL

SEQ ID NO: 1376704 - protein, 26 aa, Mycobacterium tuberculosis
PNGGGRLAPRPVFRPPVDPASRQAFG

SEQ ID NO: 1376705 - protein, 17 aa, Mycobacterium tuberculosis
PPVPVLLVIVDEYLELF

SEQ ID NO: 1376706 - protein, 24 aa, Mycobacterium tuberculosis
PRESDIWLLGAIGPRMVYSTNLDA

SEQ ID NO: 1376707 - protein, 33 aa, Mycobacterium tuberculosis; identical to SEQ ID NO: 158410

SEQ ID NO: 1376708 - protein, 18 aa, Mycobacterium tuberculosis
PSTLWIWVALTGAAATVL

SEQ ID NO: 1376709 - protein, 19 aa, Mycobacterium tuberculosis
PYMRERMADMLTMSDEMLV

SEQ ID NO: 1376710 - protein, 24 aa, Mycobacterium tuberculosis
QAAEQRASALWSHPDPTALASVPG

SEQ ID NO: 1376711 - protein, 20 aa, Mycobacterium tuberculosis
QAPAMYRIVRELATSAHQPM

SEQ ID NO: 1376712 - protein, 23 aa, Mycobacterium tuberculosis
QEAALTWLLLVSVPILAVANYWI

SEQ ID NO: 1376713 - protein, 20 aa, Mycobacterium tuberculosis
QEDFRKAAVVANVYADAAGD

SEQ ID NO: 1376714 - protein, 22 aa, Mycobacterium tuberculosis
QEGRGANVFFMLGGQRLDLSSL

SEQ ID NO: 1376715 - protein, 22 aa, Mycobacterium tuberculosis
QHPGFPGWQALKVLSPAMAADD

SEQ ID NO: 1376716 - protein, 24 aa, Mycobacterium tuberculosis
QMQVGSLIAFLSYFAQILMAVLMA

SEQ ID NO: 1376717 - protein, 17 aa, Mycobacterium tuberculosis
QNAQPGKFMPLLPTQQQ

SEQ ID NO: 1376718 - protein, 20 aa, Mycobacterium tuberculosis
QPIRSTWWIRHYTFTGTAMG

SEQ ID NO: 1376719 - protein, 21 aa, Mycobacterium tuberculosis
QRARGKGGLVRVSWAEATEMI

SEQ ID NO: 1376720 - protein, 19 aa, Mycobacterium tuberculosis
RAPFSTWAVVAVVVVPAVV

SEQ ID NO: 1376721 - protein, 18 aa, Mycobacterium tuberculosis
RCAATVVLAGASWWLIEQ

SEQ ID NO: 1376722 - protein, 19 aa, Mycobacterium tuberculosis
REYRVVAALGDTPVPVART

SEQ ID NO: 1376723 - protein, 17 aa, Mycobacterium tuberculosis
RGDSCWRSLTCLYYHHE

SEQ ID NO: 1376724 - protein, 17 aa, Mycobacterium tuberculosis
RIGVPALADPGTGELVG

SEQ ID NO: 1376725 - protein, 26 aa, Mycobacterium tuberculosis
RLEFPGKRLLIGAALLITMFPSISLV

SEQ ID NO: 1376726 - protein, 20 aa, Mycobacterium tuberculosis
RLETSCYNPSFGGMDRQSRV

SEQ ID NO: 1376727 - protein, 19 aa, Mycobacterium tuberculosis
RLHIVIGVIMLLLAARMVA

SEQ ID NO: 1376728 - protein, 19 aa, Mycobacterium tuberculosis
RLNAFSFWLFVFGATIGAA

SEQ ID NO: 1376729 - protein, 22 aa, Mycobacterium tuberculosis
RLSRGLVLIKWWLLAIPHYLIL

SEQ ID NO: 1376730 - protein, 17 aa, Mycobacterium tuberculosis
RPGGWLRNFGPKIHYRA

SEQ ID NO: 1376731 - protein, 17 aa, Mycobacterium tuberculosis
RRAQLWQAFTLQRKEDK

SEQ ID NO: 1376732 - protein, 36 aa, Mycobacterium tuberculosis; identical to SEQ ID NO: 158781

SEQ ID NO: 1376733 - protein, 22 aa, Mycobacterium tuberculosis
RRPKRLRPAPPVELDADESSPP

SEQ ID NO: 1376734 - protein, 21 aa, Mycobacterium tuberculosis
RRRRATARRKAPVKAPSATRQ

SEQ ID NO: 1376735 - protein, 21 aa, Mycobacterium tuberculosis
RSADTRRSLVFAICGITTVAT

SEQ ID NO: 1376736 - protein, 26 aa, Mycobacterium tuberculosis
RSPLALRVDGLRSRWLGMPAGLRLTV

SEQ ID NO: 1376737 - protein, 20 aa, Mycobacterium tuberculosis
RTGMKVRRYFVGFGPTLWST

SEQ ID NO: 1376738 - protein, 33 aa, Mycobacterium tuberculosis
RTSTLVLIAAFLAVWWIYETYRPQAPGPGDSPP

SEQ ID NO: 1376739 - protein, 26 aa, Mycobacterium tuberculosis
RVVGRGRPADRPALLGAVKTNVGHLE

SEQ ID NO: 1376740 - protein, 24 aa, Mycobacterium tuberculosis
RYGGDAWVIREGRRSRIEPTNRAV

SEQ ID NO: 1376741 - protein, 19 aa, Mycobacterium tuberculosis
RYQIEPALHDGDYSGAAVA

SEQ ID NO: 1376742 - protein, 18 aa, Mycobacterium tuberculosis
SAWWLFEALRHPVRSRLA

SEQ ID NO: 1376743 - protein, 18 aa, Mycobacterium tuberculosis
SGRQAGLVDAVRAAESAL

SEQ ID NO: 1376744 - protein, 19 aa, Mycobacterium tuberculosis
SHSRWLRATQFLGYASMLG

SEQ ID NO: 1376745 - protein, 23 aa, Mycobacterium tuberculosis
SHSWAMAFATLISRITGFARIVL

SEQ ID NO: 1376746 - protein, 17 aa, Mycobacterium tuberculosis
SLGGWVAFELERRGRAR

SEQ ID NO: 1376747 - protein, 26 aa, Mycobacterium tuberculosis
SLNNGFHGKWPWQMTHPMDGAVQIDK

SEQ ID NO: 1376748 - protein, 23 aa, Mycobacterium tuberculosis
SPCILPVLPVIFFSGAQSVDAAQ

SEQ ID NO: 1376749 - protein, 27 aa, Mycobacterium tuberculosis
SPRSARRVAGVWTVFVLASAGWALGGQ

SEQ ID NO: 1376750 - protein, 20 aa, Mycobacterium tuberculosis
SRPASAVSRPSYRQCVQASA

SEQ ID NO: 1376751 - protein, 27 aa, Mycobacterium tuberculosis
SSQFSVRLLRTFLRDVPNQVVLAIFAC

SEQ ID NO: 1376752 - protein, 23 aa, Mycobacterium tuberculosis
STVRGARNYPCQEFPGKRAPTVQ

SEQ ID NO: 1376753 - protein, 17 aa, Mycobacterium tuberculosis
TEFPVVVATLFGLIIAM

SEQ ID NO: 1376754 - protein, 24 aa, Mycobacterium tuberculosis
TGLATSGLLAWARRRPVLAGVLIG

SEQ ID NO: 1376755 - protein, 17 aa, Mycobacterium tuberculosis
TIAHFTFGLALLAGLYV

SEQ ID NO: 1376756 - protein, 24 aa, Mycobacterium tuberculosis
TIALASLWLSGPLQLGLGAIQLVL

SEQ ID NO: 1376757 - protein, 26 aa, Mycobacterium tuberculosis
TITAIAVVVLLGWSFFYFSDDTRGYK

SEQ ID NO: 1376758 - protein, 25 aa, Mycobacterium tuberculosis
TPQPPDVNTWWAFRTSCTPTECLAA

SEQ ID NO: 1376759 - protein, 23 aa, Mycobacterium tuberculosis
TSSGVLLLWSWLVMSLAQGYYSM

SEQ ID NO: 1376760 - protein, 20 aa, Mycobacterium tuberculosis
TTRQLWKLMFIETGLMGGMA

SEQ ID NO: 1376761 - protein, 24 aa, Mycobacterium tuberculosis
TVLVGARLAVAVVRVATATRRRRA

SEQ ID NO: 1376762 - protein, 23 aa, Mycobacterium tuberculosis
TVSSPRAGLVMEKGAKVKYRGIQ

SEQ ID NO: 1376763 - protein, 19 aa, Mycobacterium tuberculosis
VAALPCEREPIALPAGQQE

SEQ ID NO: 1376764 - protein, 20 aa, Mycobacterium tuberculosis
VAQSYWARIQLFLHGGDFGV

SEQ ID NO: 1376765 - protein, 17 aa, Mycobacterium tuberculosis
VAVVGFRALFGAFLLGL

SEQ ID NO: 1376766 - protein, 17 aa, Mycobacterium tuberculosis
VAVVLFFVFGGVIAAGL

SEQ ID NO: 1376767 - protein, 25 aa, Mycobacterium tuberculosis
VCPPDACPLVPFGVNYYIYPVMWGG

SEQ ID NO: 1376768 - protein, 18 aa, Mycobacterium tuberculosis
VDVFVVRSGAAGPFLGSI

SEQ ID NO: 1376769 - protein, 17 aa, Mycobacterium tuberculosis
VEHRALMAIAFGDLGMA

SEQ ID NO: 1376770 - protein, 21 aa, Mycobacterium tuberculosis
VFPSATSRWVFEARPDLPTTV

SEQ ID NO: 1376771 - protein, 22 aa, Mycobacterium tuberculosis
VFTKLEVFSAVGPAIAVAITVS

SEQ ID NO: 1376772 - protein, 40 aa, Mycobacterium tuberculosis; identical to SEQ ID NO: 159401

SEQ ID NO: 1376773 - protein, 20 aa, Mycobacterium tuberculosis
VGVAVGRWLVDRQLAKAPVR

SEQ ID NO: 1376774 - protein, 25 aa, Mycobacterium tuberculosis
VHAYPRTASIVIWYSRAICDTAAIL

SEQ ID NO: 1376775 - protein, 18 aa, Mycobacterium tuberculosis
VIGRWDALGFLQDFFATA

SEQ ID NO: 1376776 - protein, 22 aa, Mycobacterium tuberculosis
VIVAGVAALFWRLPSDDTTRSR

SEQ ID NO: 1376777 - protein, 17 aa, Mycobacterium tuberculosis
VKGLGMAAGAKRPGAKK

SEQ ID NO: 1376778 - protein, 27 aa, Mycobacterium tuberculosis
VLAAGWRSRHWQRRWLPTAAAIGATLA

SEQ ID NO: 1376779 - protein, 17 aa, Mycobacterium tuberculosis
VLLIFTIGVTWSSVHYL

SEQ ID NO: 1376780 - protein, 18 aa, Mycobacterium tuberculosis
VLLTRLAIVAAVALVVAG

SEQ ID NO: 1376781 - protein, 20 aa, Mycobacterium tuberculosis
VLRIASRVGTGVGFAEDQVF

SEQ ID NO: 1376782 - protein, 17 aa, Mycobacterium tuberculosis
VLVGLLVLIRMTPTVAL

SEQ ID NO: 1376783 - protein, 17 aa, Mycobacterium tuberculosis
VMSELPGTGAFDPAGTS

SEQ ID NO: 1376784 - protein, 19 aa, Mycobacterium tuberculosis
VPGFAWWAAALNSLPMLAA

SEQ ID NO: 1376785 - protein, 17 aa, Mycobacterium tuberculosis
VPPYKTAGLGLVLVFAL

SEQ ID NO: 1376786 - protein, 23 aa, Mycobacterium tuberculosis
VRTMCSRPAIRQGSLENAADQLA

SEQ ID NO: 1376787 - protein, 25 aa, Mycobacterium tuberculosis
VVFGDFRFGPTTVYHATFTDASRLK

SEQ ID NO: 1376788 - protein, 17 aa, Mycobacterium tuberculosis
VVRLRYGALDFDTVPLS

SEQ ID NO: 1376789 - protein, 17 aa, Mycobacterium tuberculosis
VYATLTVTFLFGRLNGI

SEQ ID NO: 1376790 - protein, 24 aa, Mycobacterium tuberculosis
WAVRAYAWTDWRFTQLREWFHRQV

SEQ ID NO: 1376791 - protein, 18 aa, Mycobacterium tuberculosis
WCGGLAIGLTLVLKPLLG

SEQ ID NO: 1376792 - protein, 20 aa, Mycobacterium tuberculosis
WEALEHARIPASSLRGQAVG

SEQ ID NO: 1376793 - protein, 21 aa, Mycobacterium tuberculosis
WFSLPECVYYVVGIASIALGW

SEQ ID NO: 1376794 - protein, 17 aa, Mycobacterium tuberculosis
WFVRQAHQICPVGAVVA

SEQ ID NO: 1376795 - protein, 18 aa, Mycobacterium tuberculosis
WGQRPVHPVTVWRKRLAV

SEQ ID NO: 1376796 - protein, 17 aa, Mycobacterium tuberculosis
WLAWAAWAALGLGVVAL

SEQ ID NO: 1376797 - protein, 17 aa, Mycobacterium tuberculosis
WPLRAPRAAMVLWQAIA

SEQ ID NO: 1376798 - protein, 22 aa, Mycobacterium tuberculosis
WRQLAGMSYVWWALAVIVVAGL

SEQ ID NO: 1376799 - protein, 24 aa, Mycobacterium tuberculosis
YAPEEIFLVLSVAGLAAYSMAPLI

SEQ ID NO: 1376800 - protein, 22 aa, Mycobacterium tuberculosis
YLSALERLRDFAVFKAIGTPTR

SEQ ID NO: 1376801 - protein, 19 aa, Mycobacterium tuberculosis
YRLGWYVIIGTIPICILGL

SEQ ID NO: 1376802 - protein, 21 aa, Mycobacterium tuberculosis
AAAHRRVWRDREPALASPRRP

SEQ ID NO: 1376803 - protein, 17 aa, Mycobacterium tuberculosis
AAANAFLDGLVAYRRSR

SEQ ID NO: 1376804 - protein, 18 aa, Mycobacterium tuberculosis
AAGCMPVMIGWSAITGTI

SEQ ID NO: 1376805 - protein, 17 aa, Mycobacterium tuberculosis
AALLGFLAGLALPKDAA

SEQ ID NO: 1376806 - protein, 17 aa, Mycobacterium tuberculosis
AAPEVLAGQGFDGRADL

SEQ ID NO: 1376807 - protein, 19 aa, Mycobacterium tuberculosis
AATALPDWLHDSMRAAAAG

SEQ ID NO: 1376808 - protein, 17 aa, Mycobacterium tuberculosis
AAWYHFRMDYAGHTEVK

SEQ ID NO: 1376809 - protein, 25 aa, Mycobacterium tuberculosis
ADHPRSKVGPLRRTRLTEILRGGRS

SEQ ID NO: 1376810 - protein, 21 aa, Mycobacterium tuberculosis
AEMLHRVVGGVGLKAFWYHFA

SEQ ID NO: 1376811 - protein, 17 aa, Mycobacterium tuberculosis
AEWRAAGAAGTAAALSA

SEQ ID NO: 1376812 - protein, 24 aa, Mycobacterium tuberculosis
AFFNIYFCSVTIKINGPAGSDILL

SEQ ID NO: 1376813 - protein, 19 aa, Mycobacterium tuberculosis
AFSLLGLRQLYFLIDGLLD

SEQ ID NO: 1376814 - protein, 35 aa, Mycobacterium tuberculosis; identical to SEQ ID NO: 156074

SEQ ID NO: 1376815 - protein, 21 aa, Mycobacterium tuberculosis
AGITMFGPWGIIIGPVLMILI

SEQ ID NO: 1376816 - protein, 26 aa, Mycobacterium tuberculosis
AIAVAAAWTFLKILGPILRGIADAAV

SEQ ID NO: 1376817 - protein, 19 aa, Mycobacterium tuberculosis
AIGVPWWFMVVQLPFAGIV

SEQ ID NO: 1376818 - protein, 19 aa, Mycobacterium tuberculosis
ANDLLPPGGLIPLSRTSPA

SEQ ID NO: 1376819 - protein, 21 aa, Mycobacterium tuberculosis
APGYTAARPSLSFDHDAHAEP

SEQ ID NO: 1376820 - protein, 18 aa, Mycobacterium tuberculosis
APRTTVGVVEYVRRRKNG

SEQ ID NO: 1376821 - protein, 20 aa, Mycobacterium tuberculosis
ARLVTMVPAGWSLVEAAAVP

SEQ ID NO: 1376822 - protein, 17 aa, Mycobacterium tuberculosis
ARSGIRTAELVAIVSVG

SEQ ID NO: 1376823 - protein, 26 aa, Mycobacterium tuberculosis
ARSVTGIAPAGGWTRWSPVKFEVIAK

SEQ ID NO: 1376824 - protein, 17 aa, Mycobacterium tuberculosis
ATADIRGAIGFSSFGVL

SEQ ID NO: 1376825 - protein, 23 aa, Mycobacterium tuberculosis
ATMLQMLIIFGIVTVIALVAATT

SEQ ID NO: 1376826 - protein, 19 aa, Mycobacterium tuberculosis
ATSGRCFSAAPNFAFELAV

SEQ ID NO: 1376827 - protein, 18 aa, Mycobacterium tuberculosis
AVACVYTVIYLAARDLPP

SEQ ID NO: 1376828 - protein, 21 aa, Mycobacterium tuberculosis
AVAFFAVVVLIGFWVAGSHEV

SEQ ID NO: 1376829 - protein, 18 aa, Mycobacterium tuberculosis
AVDRCFTGLVISLVCGYV

SEQ ID NO: 1376830 - protein, 20 aa, Mycobacterium tuberculosis
AVTRSGWWTHSLRGVLPEQF

SEQ ID NO: 1376831 - protein, 18 aa, Mycobacterium tuberculosis
CAIFTPYRWMIEHVTTKR

SEQ ID NO: 1376832 - protein, 24 aa, Mycobacterium tuberculosis
CPEALWDFLCERRSSISQVPPQRW

SEQ ID NO: 1376833 - protein, 17 aa, Mycobacterium tuberculosis
CRIPMDASNVVRGARNN

SEQ ID NO: 1376834 - protein, 18 aa, Mycobacterium tuberculosis
CSALHIWADTGGAGADFM

SEQ ID NO: 1376835 - protein, 25 aa, Mycobacterium tuberculosis
CYLFTEFALRPVAAKALEAGRPPRR

SEQ ID NO: 1376836 - protein, 23 aa, Mycobacterium tuberculosis
DGLGRYRVLAAPSRNGHDVIVTG

SEQ ID NO: 1376837 - protein, 25 aa, Mycobacterium tuberculosis
DHIIDVKRALAWVKAHISEYGGDPD

SEQ ID NO: 1376838 - protein, 18 aa, Mycobacterium tuberculosis
DLRREPREAIIACYVAME

SEQ ID NO: 1376839 - protein, 25 aa, Mycobacterium tuberculosis
DPQQRLLLEVAWEALEHAGIPPGTL

SEQ ID NO: 1376840 - protein, 26 aa, Mycobacterium tuberculosis
DPQQRMALELTWEALEHARIPASSLR

SEQ ID NO: 1376841 - protein, 17 aa, Mycobacterium tuberculosis
DRHGYRFIVGIGALIWA

SEQ ID NO: 1376842 - protein, 28 aa, Mycobacterium tuberculosis
DRVELLKLAVLLALWAAVAGAFVSVLYR

SEQ ID NO: 1376843 - protein, 23 aa, Mycobacterium tuberculosis
DTLARQGISYVLVRNDLDPETSR

SEQ ID NO: 1376844 - protein, 17 aa, Mycobacterium tuberculosis
DVADGYQVLAARGYGYG

SEQ ID NO: 1376845 - protein, 17 aa, Mycobacterium tuberculosis
DVDAVKFTQVLRGYKTS

SEQ ID NO: 1376846 - protein, 18 aa, Mycobacterium tuberculosis
DVWRSVRSLPDFWRLLQV

SEQ ID NO: 1376847 - protein, 17 aa, Mycobacterium tuberculosis
EAARRTLNRPGFGLTES

SEQ ID NO: 1376848 - protein, 21 aa, Mycobacterium tuberculosis
EAPAVPGVVPAPVPIPVPIII

SEQ ID NO: 1376849 - protein, 17 aa, Mycobacterium tuberculosis
EDMDLSAFVVFSSMAGI

SEQ ID NO: 1376850 - protein, 17 aa, Mycobacterium tuberculosis
EDSRFFKKHYVTESHAF

SEQ ID NO: 1376851 - protein, 19 aa, Mycobacterium tuberculosis
EELAAEWELPIVLDSAAGF

SEQ ID NO: 1376852 - protein, 25 aa, Mycobacterium tuberculosis
EILRGGRSRLVFGTLAILLCLVLGV

SEQ ID NO: 1376853 - protein, 21 aa, Mycobacterium tuberculosis
EVIRLIRRLLPALVVVLAGCA

SEQ ID NO: 1376854 - protein, 20 aa, Mycobacterium tuberculosis
FKDHLYIAGRIKDLVIIDGR

SEQ ID NO: 1376855 - protein, 20 aa, Mycobacterium tuberculosis
FLEEPRLAARVAGARTRGGY

SEQ ID NO: 1376856 - protein, 21 aa, Mycobacterium tuberculosis
FLLWSGPGRWSLDRRLSKRAT

SEQ ID NO: 1376857 - protein, 23 aa, Mycobacterium tuberculosis
FLTGTGIGWVLARGWRRPTALAP

SEQ ID NO: 1376858 - protein, 26 aa, Mycobacterium tuberculosis
FNEPICPPCGSFIRSYASDIDTAVAD

SEQ ID NO: 1376859 - protein, 33 aa, Mycobacterium tuberculosis; identical to SEQ ID NO: 156864

SEQ ID NO: 1376860 - protein, 17 aa, Mycobacterium tuberculosis
FPILSVFGFVVMFGGVV

SEQ ID NO: 1376861 - protein, 17 aa, Mycobacterium tuberculosis
FTAAGLVALVGGGLFAS

SEQ ID NO: 1376862 - protein, 22 aa, Mycobacterium tuberculosis
FVVGDLMFVPGVPGVAQGAIQG

SEQ ID NO: 1376863 - protein, 27 aa, Mycobacterium tuberculosis
GAAARRRLVKLGAWVAAQLPTTRTAVR

SEQ ID NO: 1376864 - protein, 19 aa, Mycobacterium tuberculosis
GAASLGLYVLFLFTQTVRH

SEQ ID NO: 1376865 - protein, 19 aa, Mycobacterium tuberculosis
GALKKAVMLLGVLAVLVAM

SEQ ID NO: 1376866 - protein, 20 aa, Mycobacterium tuberculosis
GALLIGWAAYRGIPHWQSIP

SEQ ID NO: 1376867 - protein, 17 aa, Mycobacterium tuberculosis
GALNAAWDKLGSSGGVL

SEQ ID NO: 1376868 - protein, 24 aa, Mycobacterium tuberculosis
GASKLPMYLNIAVAVLGLAAYFAS

SEQ ID NO: 1376869 - protein, 19 aa, Mycobacterium tuberculosis
GDTGLPVGVALLAALLAGV

SEQ ID NO: 1376870 - protein, 25 aa, Mycobacterium tuberculosis
GEWLPGQILQGIGVGATFPLLGSAA

SEQ ID NO: 1376871 - protein, 21 aa, Mycobacterium tuberculosis
GGPRRKGRIISEQEKKITAYH

SEQ ID NO: 1376872 - protein, 17 aa, Mycobacterium tuberculosis
GITTMWITATAFGLSIL

SEQ ID NO: 1376873 - protein, 18 aa, Mycobacterium tuberculosis
GLDGLRPYFTGYLPTLLL

SEQ ID NO: 1376874 - protein, 24 aa, Mycobacterium tuberculosis
GLDPRYPLKGVFHAAGVLDDAVIT

SEQ ID NO: 1376875 - protein, 20 aa, Mycobacterium tuberculosis
GLNSLMAMAIRREAEQFVGI

SEQ ID NO: 1376876 - protein, 24 aa, Mycobacterium tuberculosis
GLPLGAGFVSEWLLVQSLIHAAPG

SEQ ID NO: 1376877 - protein, 23 aa, Mycobacterium tuberculosis
GLRPGEEKLVFSRFWRSDPSRVR

SEQ ID NO: 1376878 - protein, 17 aa, Mycobacterium tuberculosis
GLVGAVLVVVRPEVLII

SEQ ID NO: 1376879 - protein, 19 aa, Mycobacterium tuberculosis
GPALDAVYLPPGRSAYVAA

SEQ ID NO: 1376880 - protein, 28 aa, Mycobacterium tuberculosis
GRPGCAPGPDGVRCAASMALAPEEPANL

SEQ ID NO: 1376881 - protein, 21 aa, Mycobacterium tuberculosis
GRPRGPVRGSASWPGEQNRRE

SEQ ID NO: 1376882 - protein, 19 aa, Mycobacterium tuberculosis
GSKTPWLILAGLAVLGVIL

SEQ ID NO: 1376883 - protein, 17 aa, Mycobacterium tuberculosis
GTALSWVKLSPIWHVFS

SEQ ID NO: 1376884 - protein, 18 aa, Mycobacterium tuberculosis
GTQNLGLLILRVGLGAVL

SEQ ID NO: 1376885 - protein, 23 aa, Mycobacterium tuberculosis
GVRVGGLFAALGVTSVVIGLMLQ

SEQ ID NO: 1376886 - protein, 23 aa, Mycobacterium tuberculosis
GVSSFGFGGANAHVVVREVLPRD

SEQ ID NO: 1376887 - protein, 22 aa, Mycobacterium tuberculosis
HAFTAWDVFLGYELPQPPTIAR

SEQ ID NO: 1376888 - protein, 28 aa, Mycobacterium tuberculosis
HLVDTLSLFVGWLWPLWDSRRRTFADLL

SEQ ID NO: 1376889 - protein, 35 aa, Mycobacterium tuberculosis
HPIIPRTIRLAAIPILLCWLGFTVFVSVAVPPLEA

SEQ ID NO: 1376890 - protein, 26 aa, Mycobacterium tuberculosis
HRCERALREHVEWSLLDVLRGAPGAP

SEQ ID NO: 1376891 - protein, 24 aa, Mycobacterium tuberculosis
HVATVRRFIERFAPYNLSPTAIRP

SEQ ID NO: 1376892 - protein, 23 aa, Mycobacterium tuberculosis
IANETDGGFGPSSRIVRFSAADK

SEQ ID NO: 1376893 - protein, 25 aa, Mycobacterium tuberculosis
IDGVKEFPGPWALVPVGATMLMILA

SEQ ID NO: 1376894 - protein, 19 aa, Mycobacterium tuberculosis
IEMIPPRYVEYRGARFPEL

SEQ ID NO: 1376895 - protein, 23 aa, Mycobacterium tuberculosis
IETRSDVKAVRFLNRQQAYDDAI

SEQ ID NO: 1376896 - protein, 17 aa, Mycobacterium tuberculosis
IFLVGFAVLTARGFLYT

SEQ ID NO: 1376897 - protein, 23 aa, Mycobacterium tuberculosis
IGPDWRLVLRGGPAEVVLDRATL

SEQ ID NO: 1376898 - protein, 22 aa, Mycobacterium tuberculosis
IGRPWYLAWAGLVYVVATLATL

SEQ ID NO: 1376899 - protein, 17 aa, Mycobacterium tuberculosis
ILSVFGFVVMFGGVVYA

SEQ ID NO: 1376900 - protein, 18 aa, Mycobacterium tuberculosis
INAILGVLLLIVLATGSL

SEQ ID NO: 1376901 - protein, 23 aa, Mycobacterium tuberculosis
IPLLGHLWSWELAIPMSGIAMAV

SEQ ID NO: 1376902 - protein, 17 aa, Mycobacterium tuberculosis
IPLSFLVLIWVFGGLLA

SEQ ID NO: 1376903 - protein, 17 aa, Mycobacterium tuberculosis
ISDGELFIMGRIKDLLI

SEQ ID NO: 1376904 - protein, 25 aa, Mycobacterium tuberculosis
ISPTPRPASVITIARPGTSLSESDR

SEQ ID NO: 1376905 - protein, 28 aa, Mycobacterium tuberculosis
ITTPTDWPRYGGYALAGVSSFGFGGANA

SEQ ID NO: 1376906 - protein, 24 aa, Mycobacterium tuberculosis
IWRRCGGRTVTLFRSEWRRPVELS

SEQ ID NO: 1376907 - protein, 18 aa, Mycobacterium tuberculosis
KERPRVIAVDAVPTEVAA

SEQ ID NO: 1376908 - protein, 17 aa, Mycobacterium tuberculosis
KIGRKPLLLWFGVGGLI

SEQ ID NO: 1376909 - protein, 21 aa, Mycobacterium tuberculosis
KLVAPLKYPSLYAGDEDGKVT

SEQ ID NO: 1376910 - protein, 21 aa, Mycobacterium tuberculosis
KPVERPAHRWVVVNTDGRSAP

SEQ ID NO: 1376911 - protein, 18 aa, Mycobacterium tuberculosis
KPWLIAGVVFLLAAAAFP

SEQ ID NO: 1376912 - protein, 17 aa, Mycobacterium tuberculosis
LAAGGRYCRLWDTGQGS

SEQ ID NO: 1376913 - protein, 18 aa, Mycobacterium tuberculosis
LAGIACWLIVSRFVLRRL

SEQ ID NO: 1376914 - protein, 20 aa, Mycobacterium tuberculosis
LAGWRWFPRDVHTAGSDLSE

SEQ ID NO: 1376915 - protein, 18 aa, Mycobacterium tuberculosis
LARATWPLRAPRAAMVLW

SEQ ID NO: 1376916 - protein, 21 aa, Mycobacterium tuberculosis
LARSRGRLVRSLRPLILLPLV

SEQ ID NO: 1376917 - protein, 36 aa, Mycobacterium tuberculosis; identical to SEQ ID NO: 157676

SEQ ID NO: 1376918 - protein, 17 aa, Mycobacterium tuberculosis
LDALIGGFKPVFRALDP

SEQ ID NO: 1376919 - protein, 26 aa, Mycobacterium tuberculosis
LDATVVRMFLVPSVMKLLGDDCWWAP

SEQ ID NO: 1376920 - protein, 17 aa, Mycobacterium tuberculosis
LEVPVRVTPGPDDPAPP

SEQ ID NO: 1376921 - protein, 17 aa, Mycobacterium tuberculosis
LFTAITFGALWLLYRYY

SEQ ID NO: 1376922 - protein, 17 aa, Mycobacterium tuberculosis
LGQRQRLGLARALGSPA

SEQ ID NO: 1376923 - protein, 24 aa, Mycobacterium tuberculosis
LGYVAWRLFGHTPYRIDIDIYQMG

SEQ ID NO: 1376924 - protein, 18 aa, Mycobacterium tuberculosis
LHPVLNLTSARLIVGRPV

SEQ ID NO: 1376925 - protein, 24 aa, Mycobacterium tuberculosis
LLGPGPRWWGLALLAVGGTSALYG

SEQ ID NO: 1376926 - protein, 25 aa, Mycobacterium tuberculosis
LLPGRRMPIPQLPGATAGARSTDIE

SEQ ID NO: 1376927 - protein, 26 aa, Mycobacterium tuberculosis
LLTHPQHWNMYLAGWINDLVPGTADQ

SEQ ID NO: 1376928 - protein, 30 aa, Mycobacterium tuberculosis
LNSLPMLAALAWVCADAILLVRTGNHRYAV

SEQ ID NO: 1376929 - protein, 19 aa, Mycobacterium tuberculosis
LPKRARLLVTAGMGMLALL

SEQ ID NO: 1376930 - protein, 20 aa, Mycobacterium tuberculosis
LPRRRREWLVAGAGAFVAHA

SEQ ID NO: 1376931 - protein, 25 aa, Mycobacterium tuberculosis
LPTYAFARQRFWLDGLGAVGGDLGG

SEQ ID NO: 1376932 - protein, 25 aa, Mycobacterium tuberculosis
LQADRAVVVAARLDRAALAGAGAAL

SEQ ID NO: 1376933 - protein, 17 aa, Mycobacterium tuberculosis
LQGQPPLGPVLMTADAR

SEQ ID NO: 1376934 - protein, 27 aa, Mycobacterium tuberculosis
LRFMLREISCIFVAWFVLYLVLVLRAV

SEQ ID NO: 1376935 - protein, 23 aa, Mycobacterium tuberculosis
LRYFPDLVVVLALLAAVALQAPN

SEQ ID NO: 1376936 - protein, 24 aa, Mycobacterium tuberculosis
LTALREIALLWLADQVDAALEKYR

SEQ ID NO: 1376937 - protein, 17 aa, Mycobacterium tuberculosis
LTVEVLFLGLAVALRLA

SEQ ID NO: 1376938 - protein, 18 aa, Mycobacterium tuberculosis
LVEDLLLLARLDSGRPLE

SEQ ID NO: 1376939 - protein, 25 aa, Mycobacterium tuberculosis
LVGVPRGRVGIGLKLTGGRTAQAWA

SEQ ID NO: 1376940 - protein, 21 aa, Mycobacterium tuberculosis
MGAQLCATAPVFAEHIHRCER

SEQ ID NO: 1376941 - protein, 17 aa, Mycobacterium tuberculosis
MIVRSALPQSLRKLAPR

SEQ ID NO: 1376942 - protein, 22 aa, Mycobacterium tuberculosis
MLTTLPKFPGLPGLPSLPDIID

SEQ ID NO: 1376943 - protein, 22 aa, Mycobacterium tuberculosis
NFSGQSALNWAQRTTRTSELGN

SEQ ID NO: 1376944 - protein, 18 aa, Mycobacterium tuberculosis
NGPRMPMVPGTWEQGSNE

SEQ ID NO: 1376945 - protein, 18 aa, Mycobacterium tuberculosis
NHYFARDPLKPEVTFADY

SEQ ID NO: 1376946 - protein, 23 aa, Mycobacterium tuberculosis
NISRFRTLLVKWAVMVVLALLTS

SEQ ID NO: 1376947 - protein, 20 aa, Mycobacterium tuberculosis
NTYSRLALGIGIHDITAGYR

SEQ ID NO: 1376948 - protein, 18 aa, Mycobacterium tuberculosis
PAGVHFRPFLSALGASVA

SEQ ID NO: 1376949 - protein, 25 aa, Mycobacterium tuberculosis
PASRERVVAVSFPRDLAITPIQCEA

SEQ ID NO: 1376950 - protein, 25 aa, Mycobacterium tuberculosis
PELDSRWGYPTVIGGMVLICLFLYH

SEQ ID NO: 1376951 - protein, 19 aa, Mycobacterium tuberculosis
PETFNVIFVDMKFESAAQD

SEQ ID NO: 1376952 - protein, 20 aa, Mycobacterium tuberculosis
PEVLAGQGFDGRADLYSLGC

SEQ ID NO: 1376953 - protein, 19 aa, Mycobacterium tuberculosis
PFAELGLNSLMAMAIRREA

SEQ ID NO: 1376954 - protein, 20 aa, Mycobacterium tuberculosis
PFLGRWLLLTAVAFGISAAA

SEQ ID NO: 1376955 - protein, 18 aa, Mycobacterium tuberculosis
PGKFMPLLPTQQQAPVPP

SEQ ID NO: 1376956 - protein, 19 aa, Mycobacterium tuberculosis
PGPLSWFFHHLPKPLHRIE

SEQ ID NO: 1376957 - protein, 19 aa, Mycobacterium tuberculosis
PIVGYLWSWLSGRDRAWRD

SEQ ID NO: 1376958 - protein, 18 aa, Mycobacterium tuberculosis
PLSPFSGYLTLAFLAGVL

SEQ ID NO: 1376959 - protein, 18 aa, Mycobacterium tuberculosis
PLTRTFIRFWTVSFPVVA

SEQ ID NO: 1376960 - protein, 27 aa, Mycobacterium tuberculosis
PMIKPAIVVALLFRTLDAFRIFDNIYV

SEQ ID NO: 1376961 - protein, 19 aa, Mycobacterium tuberculosis
PPPTMPATAMAPRQPPAPP

SEQ ID NO: 1376962 - protein, 21 aa, Mycobacterium tuberculosis
PRPSSLAFLGGWLLGLAVVTA

SEQ ID NO: 1376963 - protein, 20 aa, Mycobacterium tuberculosis
PTPGAARWSPGDSATVAGPL

SEQ ID NO: 1376964 - protein, 18 aa, Mycobacterium tuberculosis
QAVRRAGYQADLCTDDGR

SEQ ID NO: 1376965 - protein, 19 aa, Mycobacterium tuberculosis
QHVFEKLASILGLVAAPLM

SEQ ID NO: 1376966 - protein, 17 aa, Mycobacterium tuberculosis
QKNLNVYGFTKFSQASV

SEQ ID NO: 1376967 - protein, 32 aa, Mycobacterium tuberculosis
QLALTELWCSYGVRPDLVIGHSMGEVAAAVVA

SEQ ID NO: 1376968 - protein, 28 aa, Mycobacterium tuberculosis
QQTMLPFSWQGVCLHASGAARVRVRLAP

SEQ ID NO: 1376969 - protein, 17 aa, Mycobacterium tuberculosis
QRCLRHVHIGFERTLQQ

SEQ ID NO: 1376970 - protein, 34 aa, Mycobacterium tuberculosis; identical to SEQ ID NO: 158536

SEQ ID NO: 1376971 - protein, 19 aa, Mycobacterium tuberculosis
RASLREMLIPLVPAAVVAL

SEQ ID NO: 1376972 - protein, 28 aa, Mycobacterium tuberculosis
READAAASLWHPHIVAVHDRGEFDGQLW

SEQ ID NO: 1376973 - protein, 19 aa, Mycobacterium tuberculosis
REVLPRLGPAVEASKPAYW

SEQ ID NO: 1376974 - protein, 24 aa, Mycobacterium tuberculosis
RHIVRLVVFAGFLVGMFYLVAATD

SEQ ID NO: 1376975 - protein, 17 aa, Mycobacterium tuberculosis
RIACFYVGSTVLLALLL

SEQ ID NO: 1376976 - protein, 19 aa, Mycobacterium tuberculosis
RILIMIALGVIVLLLAGPR

SEQ ID NO: 1376977 - protein, 20 aa, Mycobacterium tuberculosis
RMAPFHHHFELVGWAETTVI

SEQ ID NO: 1376978 - protein, 21 aa, Mycobacterium tuberculosis
RQAFGRPSGVQGSFVAERVRP

SEQ ID NO: 1376979 - protein, 18 aa, Mycobacterium tuberculosis
RQFHHPLIYVLLVAGTIT

SEQ ID NO: 1376980 - protein, 19 aa, Mycobacterium tuberculosis
RRGPYRWMRHPNYVAVVAE

SEQ ID NO: 1376981 - protein, 25 aa, Mycobacterium tuberculosis
RSAPLSRRSLLIGNAVVAFAVIGFA

SEQ ID NO: 1376982 - protein, 17 aa, Mycobacterium tuberculosis
RSLGHRVADGWLVARAG

SEQ ID NO: 1376983 - protein, 17 aa, Mycobacterium tuberculosis
RSRWLGMPAGLRLTVPV

SEQ ID NO: 1376984 - protein, 20 aa, Mycobacterium tuberculosis
RTDLSMLLGLIFLLWSGPGR

SEQ ID NO: 1376985 - protein, 26 aa, Mycobacterium tuberculosis
SGNQARLKLAIDSGEMGFIPSNATVR

SEQ ID NO: 1376986 - protein, 30 aa, Mycobacterium tuberculosis; identical to SEQ ID NO: 14421

SEQ ID NO: 1376987 - protein, 17 aa, Mycobacterium tuberculosis
SKILLLIFFSAVLVAKR

SEQ ID NO: 1376988 - protein, 27 aa, Mycobacterium tuberculosis
SLDEPIAVVGMGCRFPGGISCPEALWD

SEQ ID NO: 1376989 - protein, 17 aa, Mycobacterium tuberculosis
SLIPVVTFLGADLGALM

SEQ ID NO: 1376990 - protein, 17 aa, Mycobacterium tuberculosis
SMMLFPFLMTVVLPNSV

SEQ ID NO: 1376991 - protein, 37 aa, Mycobacterium tuberculosis
SPLFPDLPSFPGFPGFPEFPAIPGFPALPGLPSIPNL

SEQ ID NO: 1376992 - protein, 26 aa, Mycobacterium tuberculosis
SRAKWDTLRAMGFDDIHISDSRSLEF

SEQ ID NO: 1376993 - protein, 17 aa, Mycobacterium tuberculosis
SRFTRHIAITVGALCVL

SEQ ID NO: 1376994 - protein, 19 aa, Mycobacterium tuberculosis
SSSLVAIHLACQSLRTQDC

SEQ ID NO: 1376995 - protein, 20 aa, Mycobacterium tuberculosis
STEILKRWTRGVMSTVGDVA

SEQ ID NO: 1376996 - protein, 18 aa, Mycobacterium tuberculosis
STIARRQLRLIVSDRGYF

SEQ ID NO: 1376997 - protein, 24 aa, Mycobacterium tuberculosis
SVLVLCGLIIVRLPLAPRDGGLAK

SEQ ID NO: 1376998 - protein, 24 aa, Mycobacterium tuberculosis
SVVGFLCVIMAWVSPATVFVFLLN

SEQ ID NO: 1376999 - protein, 19 aa, Mycobacterium tuberculosis
SVVVGLWGAMTFGPFIAHH

SEQ ID NO: 1377000 - protein, 24 aa, Mycobacterium tuberculosis
TAPLPKGTYCRIPMDASNVVRGAR

SEQ ID NO: 1377001 - protein, 27 aa, Mycobacterium tuberculosis
TASLVAAWAYPLWPVVLGLKALALAVG

SEQ ID NO: 1377002 - protein, 18 aa, Mycobacterium tuberculosis
TAVVLCYGLWAFERDGYS

SEQ ID NO: 1377003 - protein, 23 aa, Mycobacterium tuberculosis
TDPDELIALLGPVLADRPAFTGQ

SEQ ID NO: 1377004 - protein, 19 aa, Mycobacterium tuberculosis
TDRVARLALVDSAAPGTVI

SEQ ID NO: 1377005 - protein, 26 aa, Mycobacterium tuberculosis
TGHPRRAGVSSFGFGGTNAHVVIEQG

SEQ ID NO: 1377006 - protein, 23 aa, Mycobacterium tuberculosis
THLYDRSSFHRIPGAVEMAIAVE

SEQ ID NO: 1377007 - protein, 32 aa, Mycobacterium tuberculosis; identical to SEQ ID NO: 159195

SEQ ID NO: 1377008 - protein, 29 aa, Mycobacterium tuberculosis
TLSAPLIEHQRHWSLRRGVGASGPQEAAA

SEQ ID NO: 1377009 - protein, 17 aa, Mycobacterium tuberculosis
TPGPLRMLRIYRDYAHD

SEQ ID NO: 1377010 - protein, 18 aa, Mycobacterium tuberculosis
TSEVDWVLERLGRELEAL

SEQ ID NO: 1377011 - protein, 19 aa, Mycobacterium tuberculosis
TTLCVTWTPAQPGAARVAF

SEQ ID NO: 1377012 - protein, 41 aa, Mycobacterium tuberculosis; identical to SEQ ID NO: 159265

SEQ ID NO: 1377013 - protein, 33 aa, Mycobacterium tuberculosis; identical to SEQ ID NO: 159276

SEQ ID NO: 1377014 - protein, 24 aa, Mycobacterium tuberculosis
TYSQRAVTMLRVRQGASTGETVAC

SEQ ID NO: 1377015 - protein, 23 aa, Mycobacterium tuberculosis
VAHDLELIGYVGLADTARSSSRP

SEQ ID NO: 1377016 - protein, 18 aa, Mycobacterium tuberculosis
VDAAVCGIRVVKAFGQEE

SEQ ID NO: 1377017 - protein, 20 aa, Mycobacterium tuberculosis
VELRNRLKTATGLTLSPTLI

SEQ ID NO: 1377018 - protein, 24 aa, Mycobacterium tuberculosis
VGYLALVVYFDWGFSLAAGVLVLS

SEQ ID NO: 1377019 - protein, 24 aa, Mycobacterium tuberculosis
VHAYPRTASVVIWYSPELGDTAAV

SEQ ID NO: 1377020 - protein, 19 aa, Mycobacterium tuberculosis
VHVYRLVWRQMIFFAHNIV

SEQ ID NO: 1377021 - protein, 18 aa, Mycobacterium tuberculosis
VIGCAGLGPASYLLGSVP

SEQ ID NO: 1377022 - protein, 23 aa, Mycobacterium tuberculosis
VIIKRALAPLRRVAQTASEVVDL

SEQ ID NO: 1377023 - protein, 18 aa, Mycobacterium tuberculosis
VLCCAAIAYIALTAPHRP

SEQ ID NO: 1377024 - protein, 17 aa, Mycobacterium tuberculosis
VLLRRGRVAGLASGPAW

SEQ ID NO: 1377025 - protein, 18 aa, Mycobacterium tuberculosis
VLVHEFTEVIVIANGVRA

SEQ ID NO: 1377026 - protein, 25 aa, Mycobacterium tuberculosis
VQNVVPRPGTSPGVGGTPASPAPEA

SEQ ID NO: 1377027 - protein, 21 aa, Mycobacterium tuberculosis
VRGARNIPCVDVPGKRAATPK

SEQ ID NO: 1377028 - protein, 19 aa, Mycobacterium tuberculosis
VRIAERVYPSPLPDEPLKI

SEQ ID NO: 1377029 - protein, 24 aa, Mycobacterium tuberculosis
VSNASGRMRVCVTGFNVDAVRAVA

SEQ ID NO: 1377030 - protein, 28 aa, Mycobacterium tuberculosis
VSQISAPRAKLFAALFLILALVVVGEVA

SEQ ID NO: 1377031 - protein, 22 aa, Mycobacterium tuberculosis
VSRRGEMSYSFADLKANGLSLV

SEQ ID NO: 1377032 - protein, 22 aa, Mycobacterium tuberculosis
VTLFRSEWRRPVELSTSVPEVV

SEQ ID NO: 1377033 - protein, 18 aa, Mycobacterium tuberculosis
VVCGHSSCAAMTALLEDD

SEQ ID NO: 1377034 - protein, 18 aa, Mycobacterium tuberculosis
VVGAVAFALSPRVLTTLG

SEQ ID NO: 1377035 - protein, 21 aa, Mycobacterium tuberculosis
VVIDDAMSWLRGAAVPPAGFD

SEQ ID NO: 1377036 - protein, 36 aa, Mycobacterium tuberculosis; identical to SEQ ID NO: 159637

SEQ ID NO: 1377037 - protein, 19 aa, Mycobacterium tuberculosis
VVRRGRVYAARLAPVAAGL

SEQ ID NO: 1377038 - protein, 17 aa, Mycobacterium tuberculosis
WAEYVRLMFTNPAASSA

SEQ ID NO: 1377039 - protein, 17 aa, Mycobacterium tuberculosis
WGLSYVFAQPSVLAAAA

SEQ ID NO: 1377040 - protein, 18 aa, Mycobacterium tuberculosis
WKGLSEEMLTRAIKTQLV

SEQ ID NO: 1377041 - protein, 17 aa, Mycobacterium tuberculosis
WLLDGRASRQWCGGLAI

SEQ ID NO: 1377042 - protein, 18 aa, Mycobacterium tuberculosis
WPEDCAAAHMVPETLTVR

SEQ ID NO: 1377043 - protein, 18 aa, Mycobacterium tuberculosis
WSRCTAALAGPRVAVAIA

SEQ ID NO: 1377044 - protein, 18 aa, Mycobacterium tuberculosis
WWAVHPQPPWPHLAAAAL

SEQ ID NO: 1377045 - protein, 22 aa, Mycobacterium tuberculosis
WYSRAICDTAAILSAIIDAETV

SEQ ID NO: 1377046 - protein, 18 aa, Mycobacterium tuberculosis
YFNIRFVQQYAHGAANPL

SEQ ID NO: 1377047 - protein, 21 aa, Mycobacterium tuberculosis
YRAVLNFRRGWDIYNEHFDYV

SEQ ID NO: 1377048 - protein, 19 aa, Mycobacterium tuberculosis
YRFRGHFWLATIVVLTIQY

SEQ ID NO: 1377049 - protein, 19 aa, Mycobacterium tuberculosis
YRPGYNDRYYLRAGTPVNR

SEQ ID NO: 1377050 - protein, 27 aa, Mycobacterium tuberculosis
YTLYAELPRSGGLYRTANVTYRGITIG

SEQ ID NO: 1377051 - protein, 25 aa, Mycobacterium tuberculosis
AAALAVAVLARWRFRRRPAPARLPL

SEQ ID NO: 1377052 - protein, 18 aa, Mycobacterium tuberculosis
AADTGARIILACGFDSIP

SEQ ID NO: 1377053 - protein, 26 aa, Mycobacterium tuberculosis
AAGLGVLWLPAGWLAHRLLSVPVTTC

SEQ ID NO: 1377054 - protein, 18 aa, Mycobacterium tuberculosis
AAGSWIYTAFFAMLAAST

SEQ ID NO: 1377055 - protein, 25 aa, Mycobacterium tuberculosis
AAHRFRFVLDHGLQLGRFDRVIALW

SEQ ID NO: 1377056 - protein, 17 aa, Mycobacterium tuberculosis
ADAGLRKAVMKAITPKA

SEQ ID NO: 1377057 - protein, 17 aa, Mycobacterium tuberculosis
ADGRCKAYAGAADGTAF

SEQ ID NO: 1377058 - protein, 23 aa, Mycobacterium tuberculosis
AELRPEDKAHLVAQLRARQPTAM

SEQ ID NO: 1377059 - protein, 24 aa, Mycobacterium tuberculosis
AFHNEFTQRLAAAANAFVNAEATN

SEQ ID NO: 1377060 - protein, 17 aa, Mycobacterium tuberculosis
AGDAVACAIPLPPIARL

SEQ ID NO: 1377061 - protein, 27 aa, Mycobacterium tuberculosis
AGLQTGSSFKVFALVAALEQGIGLGYQ

SEQ ID NO: 1377062 - protein, 18 aa, Mycobacterium tuberculosis
AGYRIERMLGAGGMGTVY

SEQ ID NO: 1377063 - protein, 25 aa, Mycobacterium tuberculosis
AIAAPRRIIGFAVFVFIAAAVFGVP

SEQ ID NO: 1377064 - protein, 20 aa, Mycobacterium tuberculosis
AKELVIATKMSGEWSKDDVL

SEQ ID NO: 1377065 - protein, 17 aa, Mycobacterium tuberculosis
AKNIEVVQGYALTESCG

SEQ ID NO: 1377066 - protein, 22 aa, Mycobacterium tuberculosis
ALSAAALWLLFANRMGYPVSTT

SEQ ID NO: 1377067 - protein, 17 aa, Mycobacterium tuberculosis
AMAEGRGKAQAAALRKV

SEQ ID NO: 1377068 - protein, 17 aa, Mycobacterium tuberculosis
APASMRAGMAIAAGACL

SEQ ID NO: 1377069 - protein, 25 aa, Mycobacterium tuberculosis
APERVSVTFVDRLPGWNVDISGVGD

SEQ ID NO: 1377070 - protein, 20 aa, Mycobacterium tuberculosis
ARIRELERPLADVARASELG

SEQ ID NO: 1377071 - protein, 17 aa, Mycobacterium tuberculosis
ARPSLSFDHDAHAEPEP

SEQ ID NO: 1377072 - protein, 28 aa, Mycobacterium tuberculosis
ARRQRVLTITAWLAVVVTGSFALMQLAT

SEQ ID NO: 1377073 - protein, 22 aa, Mycobacterium tuberculosis
ARRRTEVLAYAWLMPVSTVVQA

SEQ ID NO: 1377074 - protein, 18 aa, Mycobacterium tuberculosis
ASQIRRLRAPRPQVERGG

SEQ ID NO: 1377075 - protein, 29 aa, Mycobacterium tuberculosis
AYWLGAQWWHPLVVVGLIALVAIMIAAAT

SEQ ID NO: 1377076 - protein, 24 aa, Mycobacterium tuberculosis
CESDEPYLPLNDGYNWKGDPNATV

SEQ ID NO: 1377077 - protein, 17 aa, Mycobacterium tuberculosis
DDIDGLRFHRGSWARAT

SEQ ID NO: 1377078 - protein, 17 aa, Mycobacterium tuberculosis
DGVKRVGGRMVVQQADR

SEQ ID NO: 1377079 - protein, 23 aa, Mycobacterium tuberculosis
DKVVYRRGFVTRHQVTGWRFVMR

SEQ ID NO: 1377080 - protein, 24 aa, Mycobacterium tuberculosis
DLDLLGGLARRMPATTVFFGVAAL

SEQ ID NO: 1377081 - protein, 17 aa, Mycobacterium tuberculosis
EAFTGFFAALINVRIAG

SEQ ID NO: 1377082 - protein, 22 aa, Mycobacterium tuberculosis
EALDRVGLCGWLAGLPEGLSTV

SEQ ID NO: 1377083 - protein, 20 aa, Mycobacterium tuberculosis
EDFTWKGMLDFATCTECGRC

SEQ ID NO: 1377084 - protein, 20 aa, Mycobacterium tuberculosis
EGATMITFRLRLPCRTILRV

SEQ ID NO: 1377085 - protein, 21 aa, Mycobacterium tuberculosis
EKVAFVAGWMYFLNWAMTGIV

SEQ ID NO: 1377086 - protein, 30 aa, Mycobacterium tuberculosis; identical to SEQ ID NO: 156710

SEQ ID NO: 1377087 - protein, 23 aa, Mycobacterium tuberculosis
ETLVLCVIALFATNVVLTTIGVR

SEQ ID NO: 1377088 - protein, 18 aa, Mycobacterium tuberculosis
EVAHDGRLLAAHMVNGIV

SEQ ID NO: 1377089 - protein, 23 aa, Mycobacterium tuberculosis
FAIPCFLLLLILEWTAARKLESI

SEQ ID NO: 1377090 - protein, 22 aa, Mycobacterium tuberculosis
FFWLWCATNLLAGVLALVTVAF

SEQ ID NO: 1377091 - protein, 39 aa, Mycobacterium tuberculosis; identical to SEQ ID NO: 156801

SEQ ID NO: 1377092 - protein, 18 aa, Mycobacterium tuberculosis
FLVGRSAEHTTVLADQLR

SEQ ID NO: 1377093 - protein, 18 aa, Mycobacterium tuberculosis
FPVIGAFPFTGRMPTVLV

SEQ ID NO: 1377094 - protein, 25 aa, Mycobacterium tuberculosis
FRKGANFTAAMAFEIGSTNLVVELG

SEQ ID NO: 1377095 - protein, 17 aa, Mycobacterium tuberculosis
FRPIAAGVVPEWLAYTV

SEQ ID NO: 1377096 - protein, 20 aa, Mycobacterium tuberculosis
FTDLRMKVVDTQTEWPATGH

SEQ ID NO: 1377097 - protein, 18 aa, Mycobacterium tuberculosis
FVRWVVRTPWPLFSLSML

SEQ ID NO: 1377098 - protein, 23 aa, Mycobacterium tuberculosis
FVVGELAALVMFSGAIDRRLDEQ

SEQ ID NO: 1377099 - protein, 24 aa, Mycobacterium tuberculosis
GAALAAHCVHRFGGVTGDVLGSAI

SEQ ID NO: 1377100 - protein, 18 aa, Mycobacterium tuberculosis
GAEAISIDGVRIGPNVTI

SEQ ID NO: 1377101 - protein, 25 aa, Mycobacterium tuberculosis
GDIFGLRRWYVITFLMGLFFVLGQA

SEQ ID NO: 1377102 - protein, 22 aa, Mycobacterium tuberculosis
GDNGRAAWRVARNAGITDVRAA

SEQ ID NO: 1377103 - protein, 26 aa, Mycobacterium tuberculosis
GGPPGLPAPRGFRAAFAAAYAVAYLA

SEQ ID NO: 1377104 - protein, 20 aa, Mycobacterium tuberculosis
GIRTAELVAIVSVGGGANIP

SEQ ID NO: 1377105 - protein, 22 aa, Mycobacterium tuberculosis
GLGIALTLSRLVAGLTPGLAAS

SEQ ID NO: 1377106 - protein, 31 aa, Mycobacterium tuberculosis; identical to SEQ ID NO: 157106

SEQ ID NO: 1377107 - protein, 22 aa, Mycobacterium tuberculosis
GNRSERRIMLALLVPVLPFAFS

SEQ ID NO: 1377108 - protein, 19 aa, Mycobacterium tuberculosis
GNWLKARIGVGTTTYSSTA

SEQ ID NO: 1377109 - protein, 23 aa, Mycobacterium tuberculosis
GPPRVESLGSLGAYQVDSSAAGA

SEQ ID NO: 1377110 - protein, 32 aa, Mycobacterium tuberculosis
GPVARLWRGLLVFFSRWWQLETLYRSNMKYQP

SEQ ID NO: 1377111 - protein, 17 aa, Mycobacterium tuberculosis
GQNWLVEMEMFRAENRY

SEQ ID NO: 1377112 - protein, 24 aa, Mycobacterium tuberculosis
GQRPADRPLWLGSIKSNIGHTSAA

SEQ ID NO: 1377113 - protein, 26 aa, Mycobacterium tuberculosis
GSAQRWKAIRGEAGWMTTYAYPAEAI

SEQ ID NO: 1377114 - protein, 18 aa, Mycobacterium tuberculosis
GVAIGLVVAIVFLLVRVV

SEQ ID NO: 1377115 - protein, 18 aa, Mycobacterium tuberculosis
GYGPAFRGLQALWRRGAE

SEQ ID NO: 1377116 - protein, 24 aa, Mycobacterium tuberculosis
GYLREFGNLVFHFALLGLLVAVAV

SEQ ID NO: 1377117 - protein, 18 aa, Mycobacterium tuberculosis
HAVLPLRPESLRRLDRVD

SEQ ID NO: 1377118 - protein, 18 aa, Mycobacterium tuberculosis
HPPIPTTPWQHTRHWITT

SEQ ID NO: 1377119 - protein, 21 aa, Mycobacterium tuberculosis
HPVPGDWLYFVTIDSQGTTLF

SEQ ID NO: 1377120 - protein, 24 aa, Mycobacterium tuberculosis
HRRFLPARWWSTGGLDTLVIAVLV

SEQ ID NO: 1377121 - protein, 20 aa, Mycobacterium tuberculosis
IACWLIVSRFVLRRLGPGPG

SEQ ID NO: 1377122 - protein, 21 aa, Mycobacterium tuberculosis
IATKMSGEWSKDDVLQAYLNI

SEQ ID NO: 1377123 - protein, 21 aa, Mycobacterium tuberculosis
IGLAVILSYIWGVRVGGLFAA

SEQ ID NO: 1377124 - protein, 20 aa, Mycobacterium tuberculosis
IHFLVVGYLFYWAIIGIDPG

SEQ ID NO: 1377125 - protein, 19 aa, Mycobacterium tuberculosis
IRSYFYWEKHCFDVPLCWS

SEQ ID NO: 1377126 - protein, 21 aa, Mycobacterium tuberculosis
ISPARLTAWIAASALILLTGT

SEQ ID NO: 1377127 - protein, 21 aa, Mycobacterium tuberculosis
ISQVPPQRWQPFEGGPPEVAA

SEQ ID NO: 1377128 - protein, 18 aa, Mycobacterium tuberculosis
IVDDIRAAIAVGHGVTVR

SEQ ID NO: 1377129 - protein, 26 aa, Mycobacterium tuberculosis
IYNYTWLVLMLPFGMIGVTVLTVVMP

SEQ ID NO: 1377130 - protein, 30 aa, Mycobacterium tuberculosis; identical to SEQ ID NO: 160019

SEQ ID NO: 1377131 - protein, 18 aa, Mycobacterium tuberculosis
KVLECYRTGMADAGVRFQ

SEQ ID NO: 1377132 - protein, 17 aa, Mycobacterium tuberculosis
LAATLAVVLSVVMIVVS

SEQ ID NO: 1377133 - protein, 24 aa, Mycobacterium tuberculosis
LALLPLLALLAFWRTGRRQLADRP

SEQ ID NO: 1377134 - protein, 18 aa, Mycobacterium tuberculosis
LAVRPELQQALANQNWAA

SEQ ID NO: 1377135 - protein, 25 aa, Mycobacterium tuberculosis
LFVVDWRVALVLFGPVLVYLTITSS

SEQ ID NO: 1377136 - protein, 17 aa, Mycobacterium tuberculosis
LGAAWRVLHAIPAARAA

SEQ ID NO: 1377137 - protein, 19 aa, Mycobacterium tuberculosis
LGLYVLFLFTQTVRHRDFF

SEQ ID NO: 1377138 - protein, 29 aa, Mycobacterium tuberculosis
LGPAAGFFVGWSYWFAWVVTGIADLVAIT

SEQ ID NO: 1377139 - protein, 17 aa, Mycobacterium tuberculosis
LGQLLGEVQASSWQGTA

SEQ ID NO: 1377140 - protein, 17 aa, Mycobacterium tuberculosis
LGRVPMAVVPLFVAAML

SEQ ID NO: 1377141 - protein, 35 aa, Mycobacterium tuberculosis; identical to SEQ ID NO: 160043

SEQ ID NO: 1377142 - protein, 18 aa, Mycobacterium tuberculosis
LIALGGWLLLGRGLTALT

SEQ ID NO: 1377143 - protein, 19 aa, Mycobacterium tuberculosis
LIVSRQWKLLGAYAAAGLM

SEQ ID NO: 1377144 - protein, 26 aa, Mycobacterium tuberculosis
LLDSSRLAAGVIRPQLRRAYLEEAVQ

SEQ ID NO: 1377145 - protein, 17 aa, Mycobacterium tuberculosis
LLHSIQITRDIAEQVIT

SEQ ID NO: 1377146 - protein, 22 aa, Mycobacterium tuberculosis
LLPLLNRQWRALVAAVVVPVVV

SEQ ID NO: 1377147 - protein, 22 aa, Mycobacterium tuberculosis
LLRDRWGFQPAWNAEECLEDFT

SEQ ID NO: 1377148 - protein, 20 aa, Mycobacterium tuberculosis
LLVVFGISVLLTFYPGWVTI

SEQ ID NO: 1377149 - protein, 18 aa, Mycobacterium tuberculosis
LMAIASLILVLSEHARPQ

SEQ ID NO: 1377150 - protein, 23 aa, Mycobacterium tuberculosis
LMYGEIFTITAIVCVFGAVLGLL

SEQ ID NO: 1377151 - protein, 22 aa, Mycobacterium tuberculosis
LPLWACGAADLTVRMQYTATSF

SEQ ID NO: 1377152 - protein, 25 aa, Mycobacterium tuberculosis
LPLYHDMGLILGICAPLVARRRAML

SEQ ID NO: 1377153 - protein, 17 aa, Mycobacterium tuberculosis
LRTGKLVRIAGVEVGKV

SEQ ID NO: 1377154 - protein, 19 aa, Mycobacterium tuberculosis
LSAFVVFSSMAGIVGTPAQ

SEQ ID NO: 1377155 - protein, 24 aa, Mycobacterium tuberculosis
LSAVYMLWLYQRVMTGPVAEGNER

SEQ ID NO: 1377156 - protein, 18 aa, Mycobacterium tuberculosis
LSELPDLRAANYPRADHA

SEQ ID NO: 1377157 - protein, 25 aa, Mycobacterium tuberculosis
LSQRFSRRYTIVFCAALGLPIVPLF

SEQ ID NO: 1377158 - protein, 24 aa, Mycobacterium tuberculosis
LTELPVIMVIVALVTQWARQDRRV

SEQ ID NO: 1377159 - protein, 25 aa, Mycobacterium tuberculosis
LTLPRPTVVTGLRLAASRSMLPAHP

SEQ ID NO: 1377160 - protein, 37 aa, Mycobacterium tuberculosis
LVHWSRRPASTQSWFWSRWVGWVMRRPWITALAASTV

SEQ ID NO: 1377161 - protein, 17 aa, Mycobacterium tuberculosis
LWVAFWFFLAQLNLILA

SEQ ID NO: 1377162 - protein, 24 aa, Mycobacterium tuberculosis
MDGARWWQLLLRVVLPMSRPTMVA

SEQ ID NO: 1377163 - protein, 21 aa, Mycobacterium tuberculosis
MREIAYGVARTRLMHAGASES

SEQ ID NO: 1377164 - protein, 17 aa, Mycobacterium tuberculosis
MRITVQRVGDRVKVSDV

SEQ ID NO: 1377165 - protein, 18 aa, Mycobacterium tuberculosis
MRLRDMLWAAIFPSLDLA

SEQ ID NO: 1377166 - protein, 25 aa, Mycobacterium tuberculosis
MYGDFFAFYLCDVVLKVNGKGGQPV

SEQ ID NO: 1377167 - protein, 17 aa, Mycobacterium tuberculosis
NALRYAPDCVVRVNAGR

SEQ ID NO: 1377168 - protein, 21 aa, Mycobacterium tuberculosis
NSLHIAPLISYEMTFSDLTRH

SEQ ID NO: 1377169 - protein, 19 aa, Mycobacterium tuberculosis
NVSNLRTGKLVRIAGVEVG

SEQ ID NO: 1377170 - protein, 22 aa, Mycobacterium tuberculosis
PDDVFWSFLEALIITAIVMVSH

SEQ ID NO: 1377171 - protein, 23 aa, Mycobacterium tuberculosis
PESLRRLDRVDAIVIDPRVLCTD

SEQ ID NO: 1377172 - protein, 20 aa, Mycobacterium tuberculosis
PKRLSCQLRPGPTPPATITV

SEQ ID NO: 1377173 - protein, 22 aa, Mycobacterium tuberculosis
PLTWPPAFFSWFAAGMLLAEWA

SEQ ID NO: 1377174 - protein, 18 aa, Mycobacterium tuberculosis
PPERAQVRAGLPAGTLDD

SEQ ID NO: 1377175 - protein, 17 aa, Mycobacterium tuberculosis
PPGTLRRSATGVFAGAC

SEQ ID NO: 1377176 - protein, 22 aa, Mycobacterium tuberculosis
PQDAIRWAALVALVAIGAGLIF

SEQ ID NO: 1377177 - protein, 21 aa, Mycobacterium tuberculosis
PRPWALPAQFWLYCGFTAITM

SEQ ID NO: 1377178 - protein, 18 aa, Mycobacterium tuberculosis
PSPYPARALAGGLHTAKR

SEQ ID NO: 1377179 - protein, 28 aa, Mycobacterium tuberculosis
PSTTPRSPGRWSLVAALALAVVSLGVGI

SEQ ID NO: 1377180 - protein, 18 aa, Mycobacterium tuberculosis
PTFALARGAAMAAGAATM

SEQ ID NO: 1377181 - protein, 18 aa, Mycobacterium tuberculosis
PVIGTWLHWALFGGDFPG

SEQ ID NO: 1377182 - protein, 17 aa, Mycobacterium tuberculosis
QLRPGRVPPALDQVIAK

SEQ ID NO: 1377183 - protein, 27 aa, Mycobacterium tuberculosis
QQIRRRRRVAGGFALSLLVVVVVVAVV

SEQ ID NO: 1377184 - protein, 20 aa, Mycobacterium tuberculosis
QTVLPFTGIDFRLSPSGVAV

SEQ ID NO: 1377185 - protein, 23 aa, Mycobacterium tuberculosis
QVPGGAWVLGWRRPQAYPLMSHL

SEQ ID NO: 1377186 - protein, 20 aa, Mycobacterium tuberculosis
RANGIRRIVMLTGDHPEIAQ

SEQ ID NO: 1377187 - protein, 17 aa, Mycobacterium tuberculosis
RGLLPVAGHWVSVLTGL

SEQ ID NO: 1377188 - protein, 17 aa, Mycobacterium tuberculosis
RGLLSWPEDCAAAHMVP

SEQ ID NO: 1377189 - protein, 26 aa, Mycobacterium tuberculosis
RGLQALWRRGAEVFADVTLPEGVPIR

SEQ ID NO: 1377190 - protein, 21 aa, Mycobacterium tuberculosis
RGNSWPVGRLIAWLTGCAALV

SEQ ID NO: 1377191 - protein, 17 aa, Mycobacterium tuberculosis
RIGLRGGGWAGLVCLLV

SEQ ID NO: 1377192 - protein, 27 aa, Mycobacterium tuberculosis
RLDVSGMSCAACASRVETKLNKIPGVR

SEQ ID NO: 1377193 - protein, 20 aa, Mycobacterium tuberculosis
RLSYFLDLRGPSVAVDTACS

SEQ ID NO: 1377194 - protein, 36 aa, Mycobacterium tuberculosis; identical to SEQ ID NO: 158731

SEQ ID NO: 1377195 - protein, 31 aa, Mycobacterium tuberculosis
RPLARNGFASLWSWFIGLVVTEFPLPTLASQ

SEQ ID NO: 1377196 - protein, 27 aa, Mycobacterium tuberculosis
RPWHVPGRPRRAGVSSFGISGTNAHVI

SEQ ID NO: 1377197 - protein, 23 aa, Mycobacterium tuberculosis
RRIECACKVWAAGVAASPLGKMI

SEQ ID NO: 1377198 - protein, 18 aa, Mycobacterium tuberculosis
RSEPLPVRRPASVRRLPP

SEQ ID NO: 1377199 - protein, 23 aa, Mycobacterium tuberculosis
RTDDLRPIPVFGSDELARLTEAF

SEQ ID NO: 1377200 - protein, 22 aa, Mycobacterium tuberculosis
RTFADLLLRTEVRRVEPVQRPA

SEQ ID NO: 1377201 - protein, 21 aa, Mycobacterium tuberculosis
RVDTVLRAKVDGAWNLHELTE

SEQ ID NO: 1377202 - protein, 21 aa, Mycobacterium tuberculosis
RVHCDRFFGWYNHEHKHSGIG

SEQ ID NO: 1377203 - protein, 23 aa, Mycobacterium tuberculosis
TALMVSTSLAWTGRVAPPGTFGA

SEQ ID NO: 1377204 - protein, 31 aa, Mycobacterium tuberculosis
TDEPRPAKRSTLREFAVLAVIAVVLYYVMLT

SEQ ID NO: 1377205 - protein, 22 aa, Mycobacterium tuberculosis
TGAETLRFKGYLIMSRNSSHDY

SEQ ID NO: 1377206 - protein, 17 aa, Mycobacterium tuberculosis
TGFVELALRAGDEVGCS

SEQ ID NO: 1377207 - protein, 23 aa, Mycobacterium tuberculosis
TGVFAGACLSEYGAMASADLSQV

SEQ ID NO: 1377208 - protein, 18 aa, Mycobacterium tuberculosis
TIERCLRSILEQEGVEFE

SEQ ID NO: 1377209 - protein, 23 aa, Mycobacterium tuberculosis
TKFTLLMALPWLSAVAAVYVVFR

SEQ ID NO: 1377210 - protein, 19 aa, Mycobacterium tuberculosis
TPAPYGPLFLWIGRGISSL

SEQ ID NO: 1377211 - protein, 18 aa, Mycobacterium tuberculosis
TPNDPRFQPGFEEADTRV

SEQ ID NO: 1377212 - protein, 26 aa, Mycobacterium tuberculosis
TRHVERFFAESWARLTAGRTARVVLL

SEQ ID NO: 1377213 - protein, 20 aa, Mycobacterium tuberculosis
TSDAIAAWAAQLAAVTGQLQ

SEQ ID NO: 1377214 - protein, 28 aa, Mycobacterium tuberculosis
TVKMTTEWLHVPFLPVPIPVPIPQNPGA

SEQ ID NO: 1377215 - protein, 24 aa, Mycobacterium tuberculosis
VAGVGVDWRAAFADLGGRRVELPT

SEQ ID NO: 1377216 - protein, 25 aa, Mycobacterium tuberculosis
VAIHLLASMTMVWLAVLLYVKIGQP

SEQ ID NO: 1377217 - protein, 18 aa, Mycobacterium tuberculosis
VAPMVRRAAATLPAAQAV

SEQ ID NO: 1377218 - protein, 25 aa, Mycobacterium tuberculosis
VDLQFKGPAANIWADYTAAHIGTQT

SEQ ID NO: 1377219 - protein, 18 aa, Mycobacterium tuberculosis
VDSGTWLAWAAWAALGLG

SEQ ID NO: 1377220 - protein, 19 aa, Mycobacterium tuberculosis
VFGVLRWFFTTYRIDDENV

SEQ ID NO: 1377221 - protein, 20 aa, Mycobacterium tuberculosis
VFRGPPSWNVGYKSIRSHNV

SEQ ID NO: 1377222 - protein, 17 aa, Mycobacterium tuberculosis
VGARLAWTYLAPNGANF

SEQ ID NO: 1377223 - protein, 17 aa, Mycobacterium tuberculosis
VGLLDFGGSATYVTLVE

SEQ ID NO: 1377224 - protein, 25 aa, Mycobacterium tuberculosis
VGPVIRLPLVLGLAQLLSRVPLPGS

SEQ ID NO: 1377225 - protein, 27 aa, Mycobacterium tuberculosis
VGYALLPVLWIFSLSLKPTSTVKDGKL

SEQ ID NO: 1377226 - protein, 18 aa, Mycobacterium tuberculosis
VGYLFYWAIIGIDPGPRR

SEQ ID NO: 1377227 - protein, 21 aa, Mycobacterium tuberculosis
VHPVTVWRKRLAVALDALQTT

SEQ ID NO: 1377228 - protein, 17 aa, Mycobacterium tuberculosis
VIPRLFVWPPARSIAQV

SEQ ID NO: 1377229 - protein, 18 aa, Mycobacterium tuberculosis
VKDGQPFIPADCLAKGGN

SEQ ID NO: 1377230 - protein, 17 aa, Mycobacterium tuberculosis
VKGLGIAAGAKRPGAKK

SEQ ID NO: 1377231 - protein, 18 aa, Mycobacterium tuberculosis
VLMPLALFGILGLAAVVL

SEQ ID NO: 1377232 - protein, 23 aa, Mycobacterium tuberculosis
VMVSLAELWRSVGVVPDAVIGHS

SEQ ID NO: 1377233 - protein, 23 aa, Mycobacterium tuberculosis
VNFRDVLVALGMYPGGGELGVDG

SEQ ID NO: 1377234 - protein, 24 aa, Mycobacterium tuberculosis
VRYRDRLLLPLPMFHVAALTTVIF

SEQ ID NO: 1377235 - protein, 17 aa, Mycobacterium tuberculosis
VTPLRLALERDTRAVDP

SEQ ID NO: 1377236 - protein, 26 aa, Mycobacterium tuberculosis
VVGVFALRRVWWLYKLVMSGQPASGR

SEQ ID NO: 1377237 - protein, 25 aa, Mycobacterium tuberculosis
VVLTGRISVVAAPWLADHAVGPVVL

SEQ ID NO: 1377238 - protein, 24 aa, Mycobacterium tuberculosis
WDSAACKAWLLAQPYLVAGVLLVF

SEQ ID NO: 1377239 - protein, 18 aa, Mycobacterium tuberculosis
YGQYGQYGVQPGGYYGQQ

SEQ ID NO: 1377240 - protein, 23 aa, Mycobacterium tuberculosis
YRRVDIARVPDCAVVGAAAGGVI

SEQ ID NO: 1377241 - protein, 17 aa, Mycobacterium tuberculosis
YVFPLGVVVGGPFLPLA

SEQ ID NO: 1377242 - protein, 18 aa, Mycobacterium tuberculosis
AAPGWEADQVLALAATVE

SEQ ID NO: 1377243 - protein, 21 aa, Mycobacterium tuberculosis
ACGVAVATVWFALRDTARAEA

SEQ ID NO: 1377244 - protein, 24 aa, Mycobacterium tuberculosis
AEATRVGKRFLIIDLKRQKPLSFT

SEQ ID NO: 1377245 - protein, 17 aa, Mycobacterium tuberculosis
AGAAILLFGGRRTDAWG

SEQ ID NO: 1377246 - protein, 48 aa, Mycobacterium tuberculosis; identical to SEQ ID NO: 156071

SEQ ID NO: 1377247 - protein, 26 aa, Mycobacterium tuberculosis
AGYAKIVGCALGFPVINIARSSAKLL

SEQ ID NO: 1377248 - protein, 17 aa, Mycobacterium tuberculosis
ALASCASLAHFNYDDRK

SEQ ID NO: 1377249 - protein, 17 aa, Mycobacterium tuberculosis
ALHFLRITALSVVLLAL

SEQ ID NO: 1377250 - protein, 24 aa, Mycobacterium tuberculosis
ALWKGRRIGPLVAEELPVVIRASE

SEQ ID NO: 1377251 - protein, 18 aa, Mycobacterium tuberculosis
ANCGMAWVVAVASDIGFN

SEQ ID NO: 1377252 - protein, 17 aa, Mycobacterium tuberculosis
ANRGRYHGIWSMTPVVA

SEQ ID NO: 1377253 - protein, 23 aa, Mycobacterium tuberculosis
ARFPELDVEAVLRRHPQVVLVDE

SEQ ID NO: 1377254 - protein, 18 aa, Mycobacterium tuberculosis
ASARAKVANREWVARSAR

SEQ ID NO: 1377255 - protein, 26 aa, Mycobacterium tuberculosis
ASCQPGASHLGVWFGHFPGWIPLGAM

SEQ ID NO: 1377256 - protein, 17 aa, Mycobacterium tuberculosis
ASGRVAYVLGLQGPAVS

SEQ ID NO: 1377257 - protein, 18 aa, Mycobacterium tuberculosis
ATAIRSGLAVPRPLPAVI

SEQ ID NO: 1377258 - protein, 25 aa, Mycobacterium tuberculosis
ATTVLACAVAMGFWMGSGAQFGLGG

SEQ ID NO: 1377259 - protein, 18 aa, Mycobacterium tuberculosis
AVGAGVWQGPSAELFVAA

SEQ ID NO: 1377260 - protein, 19 aa, Mycobacterium tuberculosis
AVGSYRKTRLVPFGEYVPL

SEQ ID NO: 1377261 - protein, 21 aa, Mycobacterium tuberculosis
AWIAIVAMGGFFMMMKLIHRH

SEQ ID NO: 1377262 - protein, 22 aa, Mycobacterium tuberculosis
CGFAMLPAYLLLVVYGQDSAGR

SEQ ID NO: 1377263 - protein, 18 aa, Mycobacterium tuberculosis
CIGLVGIYVSKVFIETKQ

SEQ ID NO: 1377264 - protein, 26 aa, Mycobacterium tuberculosis
DAVSEFPADRGWDVAGLFDPDPDAVG

SEQ ID NO: 1377265 - protein, 18 aa, Mycobacterium tuberculosis
DFRISLVSPTTVRGGCGY

SEQ ID NO: 1377266 - protein, 18 aa, Mycobacterium tuberculosis
DGLPRLATADIQVGDVLV

SEQ ID NO: 1377267 - protein, 22 aa, Mycobacterium tuberculosis
DLATRPATFLWLIAATGTLLVA

SEQ ID NO: 1377268 - protein, 25 aa, Mycobacterium tuberculosis
DPQQRLLLEVSWEALERAGIDPITL

SEQ ID NO: 1377269 - protein, 17 aa, Mycobacterium tuberculosis
DRFRPQPVSVWASATAT

SEQ ID NO: 1377270 - protein, 27 aa, Mycobacterium tuberculosis
DTRGRRLAWCSAEFNGAIVVNVPLASN

SEQ ID NO: 1377271 - protein, 17 aa, Mycobacterium tuberculosis
DVRLDRPVALKVMDSRY

SEQ ID NO: 1377272 - protein, 18 aa, Mycobacterium tuberculosis
EAASAYFAGGLSLRDATR

SEQ ID NO: 1377273 - protein, 22 aa, Mycobacterium tuberculosis
EALFRPMHDRLASAVVAEAHRT

SEQ ID NO: 1377274 - protein, 20 aa, Mycobacterium tuberculosis
EPVAVVGMGCRYPGGVDSPE

SEQ ID NO: 1377275 - protein, 21 aa, Mycobacterium tuberculosis
ETYTRRRRNLLIGIGAGAAVL

SEQ ID NO: 1377276 - protein, 19 aa, Mycobacterium tuberculosis
FADRRGRRAALTFSVSLMA

SEQ ID NO: 1377277 - protein, 17 aa, Mycobacterium tuberculosis
FAPNFTVLVILRLLYGI

SEQ ID NO: 1377278 - protein, 17 aa, Mycobacterium tuberculosis
FDNPDFQRGLKLFLSAD

SEQ ID NO: 1377279 - protein, 33 aa, Mycobacterium tuberculosis
FFNLVGWPTWGMILSSPFLLPAGLGLGLAAIAF

SEQ ID NO: 1377280 - protein, 17 aa, Mycobacterium tuberculosis
FGQMRFDRTNGYTAEFS

SEQ ID NO: 1377281 - protein, 27 aa, Mycobacterium tuberculosis
FGSSALLCPLLVYGWLGLPRWGLTGSA

SEQ ID NO: 1377282 - protein, 20 aa, Mycobacterium tuberculosis
FLETRYWWAGIALASLGVIV

SEQ ID NO: 1377283 - protein, 20 aa, Mycobacterium tuberculosis
FLWILSVAFASMIALATLLT

SEQ ID NO: 1377284 - protein, 22 aa, Mycobacterium tuberculosis
FPAPSWWWLAWFGLVPLLLVVR

SEQ ID NO: 1377285 - protein, 19 aa, Mycobacterium tuberculosis
FRAAAVWLAGAVVGIVASW

SEQ ID NO: 1377286 - protein, 23 aa, Mycobacterium tuberculosis
FVVKAGAAGPFLGSTPFAQIDLP

SEQ ID NO: 1377287 - protein, 17 aa, Mycobacterium tuberculosis
GALWWCVARRSWHAPRL

SEQ ID NO: 1377288 - protein, 19 aa, Mycobacterium tuberculosis
GGARGFAHLGVLDELERVG

SEQ ID NO: 1377289 - protein, 19 aa, Mycobacterium tuberculosis
GGVKRCLGANFSMRELITV

SEQ ID NO: 1377290 - protein, 17 aa, Mycobacterium tuberculosis
GLFGLFAYTGMRIASRS

SEQ ID NO: 1377291 - protein, 26 aa, Mycobacterium tuberculosis
GLSSLRAGMIAGAIGLLLVLVYSLLY

SEQ ID NO: 1377292 - protein, 22 aa, Mycobacterium tuberculosis
GRDRSGHIVAIFQAPAGKTVDD

SEQ ID NO: 1377293 - protein, 17 aa, Mycobacterium tuberculosis
GRLERLRGRLARSQNAL

SEQ ID NO: 1377294 - protein, 22 aa, Mycobacterium tuberculosis
GSWRELLSRYLGTSIVLAGGVA

SEQ ID NO: 1377295 - protein, 17 aa, Mycobacterium tuberculosis
GWSAITGTIAWPALAMF

SEQ ID NO: 1377296 - protein, 24 aa, Mycobacterium tuberculosis
HASDPIAWWTPRLLFREPDWLREQ

SEQ ID NO: 1377297 - protein, 17 aa, Mycobacterium tuberculosis
HGPVVAVAGRFVHTSIR

SEQ ID NO: 1377298 - protein, 30 aa, Mycobacterium tuberculosis
HNSSPPPPRWAWPPLIAVGAVGMVGMAVQF

SEQ ID NO: 1377299 - protein, 19 aa, Mycobacterium tuberculosis
HVTFGYRPGVPVIQDVSLT

SEQ ID NO: 1377300 - protein, 22 aa, Mycobacterium tuberculosis
IAFLPIVLAPAVIPPASTPLAA

SEQ ID NO: 1377301 - protein, 22 aa, Mycobacterium tuberculosis
IDGLPFSWTVASWTQHSSNLTV

SEQ ID NO: 1377302 - protein, 30 aa, Mycobacterium tuberculosis; identical to SEQ ID NO: 157367

SEQ ID NO: 1377303 - protein, 20 aa, Mycobacterium tuberculosis
IPVAALIHVYTYRKLSGGQV

SEQ ID NO: 1377304 - protein, 18 aa, Mycobacterium tuberculosis
IQLLRTAVVVGLVLLQTG

SEQ ID NO: 1377305 - protein, 27 aa, Mycobacterium tuberculosis
IRSGLAVPRPLPAVIADAAARTEPPEP

SEQ ID NO: 1377306 - protein, 26 aa, Mycobacterium tuberculosis
IVFGLSGIVPWWFVLTLLTRDALLAG

SEQ ID NO: 1377307 - protein, 19 aa, Mycobacterium tuberculosis
IYLTQRFIIAWRVWLTHHL

SEQ ID NO: 1377308 - protein, 18 aa, Mycobacterium tuberculosis
KALFLGFMFAFAIKAPLW

SEQ ID NO: 1377309 - protein, 20 aa, Mycobacterium tuberculosis
KAVASWVANYGHEYYLDKAR

SEQ ID NO: 1377310 - protein, 24 aa, Mycobacterium tuberculosis
KDFLELLRYLAVELLPGPLGDLIA

SEQ ID NO: 1377311 - protein, 19 aa, Mycobacterium tuberculosis
KGRALPAVLTRPSDDESVE

SEQ ID NO: 1377312 - protein, 24 aa, Mycobacterium tuberculosis
KLPDWSPTSSRTWATKVLAAHPGD

SEQ ID NO: 1377313 - protein, 25 aa, Mycobacterium tuberculosis
KPLRRGHKMIIGMRGSYGGVVMIGM

SEQ ID NO: 1377314 - protein, 19 aa, Mycobacterium tuberculosis
KSTLARLVAGYTHPTDGTV

SEQ ID NO: 1377315 - protein, 22 aa, Mycobacterium tuberculosis
LADHAVGPVVLFPGTGFVELAL

SEQ ID NO: 1377316 - protein, 20 aa, Mycobacterium tuberculosis
LAGVVLMRWTPIDLLPQHRE

SEQ ID NO: 1377317 - protein, 21 aa, Mycobacterium tuberculosis
LALFALWPFTRLVHAFSAPIG

SEQ ID NO: 1377318 - protein, 17 aa, Mycobacterium tuberculosis
LALLGVRRYVFARPPLL

SEQ ID NO: 1377319 - protein, 19 aa, Mycobacterium tuberculosis
LAVTLTASWQKIFSADPSV

SEQ ID NO: 1377320 - protein, 18 aa, Mycobacterium tuberculosis
LCIVFTALSSALCDQLGR

SEQ ID NO: 1377321 - protein, 17 aa, Mycobacterium tuberculosis
LDRVRVVVIDGAALRGD

SEQ ID NO: 1377322 - protein, 22 aa, Mycobacterium tuberculosis
LDRWLLFNWMRWGRALEYLKIT

SEQ ID NO: 1377323 - protein, 17 aa, Mycobacterium tuberculosis
LGYQIFFNLVGWPTWGM

SEQ ID NO: 1377324 - protein, 20 aa, Mycobacterium tuberculosis
LIAKVCVYTVLAVVQSAIVT

SEQ ID NO: 1377325 - protein, 17 aa, Mycobacterium tuberculosis
LIIGTGIGIAWPHLTVR

SEQ ID NO: 1377326 - protein, 28 aa, Mycobacterium tuberculosis
LLVVPGDCWLDWGMNIGRHCFSDYAMVA

SEQ ID NO: 1377327 - protein, 31 aa, Mycobacterium tuberculosis; identical to SEQ ID NO: 296727

SEQ ID NO: 1377328 - protein, 22 aa, Mycobacterium tuberculosis
LTSCYGGALVRFRAEGRTITVV

SEQ ID NO: 1377329 - protein, 18 aa, Mycobacterium tuberculosis
LVAIGAGLIFPRFEQLLE

SEQ ID NO: 1377330 - protein, 33 aa, Mycobacterium tuberculosis
LVSGICGAFGYGLGVFAVWLVRYMRSHNSSPPP

SEQ ID NO: 1377331 - protein, 17 aa, Mycobacterium tuberculosis
LVVLWLFVLVPMLISKR

SEQ ID NO: 1377332 - protein, 19 aa, Mycobacterium tuberculosis
LWISLVVLWLFVLVPMLIS

SEQ ID NO: 1377333 - protein, 26 aa, Mycobacterium tuberculosis
MAIALICAAAVFSAIALRDLRIPAIG

SEQ ID NO: 1377334 - protein, 26 aa, Mycobacterium tuberculosis
MHWSLPGLSFILLVAIGADYNMLLIS

SEQ ID NO: 1377335 - protein, 17 aa, Mycobacterium tuberculosis
NFPDTNFAWSFVLALLA

SEQ ID NO: 1377336 - protein, 22 aa, Mycobacterium tuberculosis
NHEVGHAIGYLRHEPCDQQGGL

SEQ ID NO: 1377337 - protein, 17 aa, Mycobacterium tuberculosis
NPSQFKTTVVFNDGKEV

SEQ ID NO: 1377338 - protein, 24 aa, Mycobacterium tuberculosis
NVVQRRPFFAILRCLGVTREQLFW

SEQ ID NO: 1377339 - protein, 21 aa, Mycobacterium tuberculosis
PDTNFAWSFVLALLAAALTAR

SEQ ID NO: 1377340 - protein, 19 aa, Mycobacterium tuberculosis
PGTILIPRLYALHILLLPG

SEQ ID NO: 1377341 - protein, 19 aa, Mycobacterium tuberculosis
PHIPFTDLRMKVVDTQTEW

SEQ ID NO: 1377342 - protein, 19 aa, Mycobacterium tuberculosis
PHLFDRDGVDFATDPPPPA

SEQ ID NO: 1377343 - protein, 25 aa, Mycobacterium tuberculosis
PIRRASVTVMEWGLRGTRRAEAAAE

SEQ ID NO: 1377344 - protein, 24 aa, Mycobacterium tuberculosis
PIVCAAGLCRAAKALFGRYVVQRS

SEQ ID NO: 1377345 - protein, 22 aa, Mycobacterium tuberculosis
PLTAKLAWFSKFLTIAILGLAA

SEQ ID NO: 1377346 - protein, 26 aa, Mycobacterium tuberculosis
PNYFGDACVWWGLWLITINDWAPLAT

SEQ ID NO: 1377347 - protein, 18 aa, Mycobacterium tuberculosis
PQPVSVWASATATLLIGA

SEQ ID NO: 1377348 - protein, 43 aa, Mycobacterium tuberculosis
PSVLTMRGRCRRLWPRSAPMLAAWAVVEGCLMAVFFVTDGGEV

SEQ ID NO: 1377349 - protein, 21 aa, Mycobacterium tuberculosis
QFDALHFAKPIFGPAARALAQ

SEQ ID NO: 1377350 - protein, 25 aa, Mycobacterium tuberculosis
QLEPPYRGGPVLADNAVIPVERTQV

SEQ ID NO: 1377351 - protein, 18 aa, Mycobacterium tuberculosis
QRFWRITLPMLRPTMFFV

SEQ ID NO: 1377352 - protein, 25 aa, Mycobacterium tuberculosis
RDGSQTRLATWLAEPGHTATPAGSI

SEQ ID NO: 1377353 - protein, 27 aa, Mycobacterium tuberculosis
RDLIPDLAELLAMRGIDGLPFSWTVAS

SEQ ID NO: 1377354 - protein, 18 aa, Mycobacterium tuberculosis
RGSTGFARPWAIPLVTTG

SEQ ID NO: 1377355 - protein, 20 aa, Mycobacterium tuberculosis
RMQFATGVLIISMVTLVFGF

SEQ ID NO: 1377356 - protein, 23 aa, Mycobacterium tuberculosis
RPHPYPRWLATAGAAGFALGVAM

SEQ ID NO: 1377357 - protein, 19 aa, Mycobacterium tuberculosis
RRITGWVAAVYAWLRRRRR

SEQ ID NO: 1377358 - protein, 18 aa, Mycobacterium tuberculosis
RRLLAWVGADENVRPLDV

SEQ ID NO: 1377359 - protein, 24 aa, Mycobacterium tuberculosis
RSPRLTNLLVVAAWVAAAVIANLL

SEQ ID NO: 1377360 - protein, 22 aa, Mycobacterium tuberculosis
RSRVARIMPAYVVAVVVILSLL

SEQ ID NO: 1377361 - protein, 28 aa, Mycobacterium tuberculosis
RVPLPGSAPRPAWLRAFAHPERDKRVAV

SEQ ID NO: 1377362 - protein, 17 aa, Mycobacterium tuberculosis
SARDLRDPAALIAINQV

SEQ ID NO: 1377363 - protein, 17 aa, Mycobacterium tuberculosis
SDTVPLYGAELLSQGKF

SEQ ID NO: 1377364 - protein, 19 aa, Mycobacterium tuberculosis
SGAARPARRSVAEVHAAND

SEQ ID NO: 1377365 - protein, 24 aa, Mycobacterium tuberculosis
SINPAECWPAVGGGVPSAYDLGTV

SEQ ID NO: 1377366 - protein, 17 aa, Mycobacterium tuberculosis
SLQPGVYAVHWYAGEHA

SEQ ID NO: 1377367 - protein, 21 aa, Mycobacterium tuberculosis
SLRLRKFGRYPLGCGTVGGPQ

SEQ ID NO: 1377368 - protein, 22 aa, Mycobacterium tuberculosis
SSFPDPTKLILQLLKDFLELLR

SEQ ID NO: 1377369 - protein, 19 aa, Mycobacterium tuberculosis
SSLVEVLRGTDSWTPFVAP

SEQ ID NO: 1377370 - protein, 19 aa, Mycobacterium tuberculosis
STIGLFLMVVAGSLITSRR

SEQ ID NO: 1377371 - protein, 17 aa, Mycobacterium tuberculosis
TAHAGSVGSLLRLSVLA

SEQ ID NO: 1377372 - protein, 25 aa, Mycobacterium tuberculosis
TFRLRLPCRTILRVFSRNPLVRGTD

SEQ ID NO: 1377373 - protein, 19 aa, Mycobacterium tuberculosis
TGPNSTPVILRCGLDRPAE

SEQ ID NO: 1377374 - protein, 17 aa, Mycobacterium tuberculosis
TLFGLMAGLIACYKGMS

SEQ ID NO: 1377375 - protein, 19 aa, Mycobacterium tuberculosis
TMDAFDYFLVVLVYADIAT

SEQ ID NO: 1377376 - protein, 19 aa, Mycobacterium tuberculosis
TPIAQVLRRQRREIVLAAG

SEQ ID NO: 1377377 - protein, 18 aa, Mycobacterium tuberculosis
TPSECRVILLDAAPAVLP

SEQ ID NO: 1377378 - protein, 27 aa, Mycobacterium tuberculosis
TRLVHAFSAPIGYLFRPYIIYRSREEL

SEQ ID NO: 1377379 - protein, 23 aa, Mycobacterium tuberculosis
TRRFWRSSGVHIVRRPKTHLLAS

SEQ ID NO: 1377380 - protein, 17 aa, Mycobacterium tuberculosis
VADGRRVVLGAADTFRA

SEQ ID NO: 1377381 - protein, 17 aa, Mycobacterium tuberculosis
VERSIDSARRWLIEGPA

SEQ ID NO: 1377382 - protein, 27 aa, Mycobacterium tuberculosis
VGGRLFGRFDLAVAVFFAVSGFLLWRG

SEQ ID NO: 1377383 - protein, 19 aa, Mycobacterium tuberculosis
VGGSGDWGPSLGPTVGGRG

SEQ ID NO: 1377384 - protein, 24 aa, Mycobacterium tuberculosis
VGVLLSMAPLWFSSYILQLRVPTV

SEQ ID NO: 1377385 - protein, 18 aa, Mycobacterium tuberculosis
VNVPGLVVAAVWAVGLVA

SEQ ID NO: 1377386 - protein, 20 aa, Mycobacterium tuberculosis
VPEARAALDAVRARIRSRRL

SEQ ID NO: 1377387 - protein, 19 aa, Mycobacterium tuberculosis
VPSAAWGWSRIDHRTWHIV

SEQ ID NO: 1377388 - protein, 17 aa, Mycobacterium tuberculosis
VPVDCAAPHAMEVSGTV

SEQ ID NO: 1377389 - protein, 20 aa, Mycobacterium tuberculosis
VRPAPGQGLSPAVSTLVVAG

SEQ ID NO: 1377390 - protein, 17 aa, Mycobacterium tuberculosis
VRQRFFALFLYVVMLVF

SEQ ID NO: 1377391 - protein, 21 aa, Mycobacterium tuberculosis
VSKEIIYFLAQLDVKEIHGYN

SEQ ID NO: 1377392 - protein, 21 aa, Mycobacterium tuberculosis
VSPLPSLAKRAADILRQDVGG

SEQ ID NO: 1377393 - protein, 17 aa, Mycobacterium tuberculosis
VTGPGFYDIALRDFGLL

SEQ ID NO: 1377394 - protein, 17 aa, Mycobacterium tuberculosis
VVDARLVTMVPAGWSLV

SEQ ID NO: 1377395 - protein, 27 aa, Mycobacterium tuberculosis
VVVSLAGSGWCGWVLFEKHQTDVAAGQ

SEQ ID NO: 1377396 - protein, 19 aa, Mycobacterium tuberculosis
VYSLLYYRVLGLLTALSLV

SEQ ID NO: 1377397 - protein, 20 aa, Mycobacterium tuberculosis
WEALERAGIDPITLRGSQTG

SEQ ID NO: 1377398 - protein, 26 aa, Mycobacterium tuberculosis
YDVVPSRLRRPGAVVLEIDDEDPIFT

SEQ ID NO: 1377399 - protein, 17 aa, Mycobacterium tuberculosis
YLAAKLTVLLAISLFVA

SEQ ID NO: 1377400 - protein, 19 aa, Mycobacterium tuberculosis
YLAFGLMAALLLDATVVRM

SEQ ID NO: 1377401 - protein, 18 aa, Mycobacterium tuberculosis
YNPSFGGMDRQSRVFINE

SEQ ID NO: 1377402 - protein, 21 aa, Mycobacterium tuberculosis
YPERRRLAPPRGKSVVHEPIR

SEQ ID NO: 1377403 - protein, 17 aa, Mycobacterium tuberculosis
YRNGIARAISWGQRPVH

SEQ ID NO: 1377404 - protein, 21 aa, Mycobacterium tuberculosis
AAFCYAAAVVTELGGPMSHAA

SEQ ID NO: 1377405 - protein, 22 aa, Mycobacterium tuberculosis
AAGMYPAWRLGRMTIRTAIREE

SEQ ID NO: 1377406 - protein, 17 aa, Mycobacterium tuberculosis
ADRVFAAALPWLAGQLA

SEQ ID NO: 1377407 - protein, 17 aa, Mycobacterium tuberculosis
AELPRPVADELQLDAPA

SEQ ID NO: 1377408 - protein, 24 aa, Mycobacterium tuberculosis
AELSVWPPVGARAMDVADGYQVLA

SEQ ID NO: 1377409 - protein, 17 aa, Mycobacterium tuberculosis
AGFCAQATLLGALAGVD

SEQ ID NO: 1377410 - protein, 17 aa, Mycobacterium tuberculosis
AGSSPLWSGRVFAEARW

SEQ ID NO: 1377411 - protein, 17 aa, Mycobacterium tuberculosis
AINRLRAPLKVTSDYSP

SEQ ID NO: 1377412 - protein, 21 aa, Mycobacterium tuberculosis
ALFPMYFLKSFAYAGVATVAF

SEQ ID NO: 1377413 - protein, 17 aa, Mycobacterium tuberculosis
ALTMAVISPAIWAARGA

SEQ ID NO: 1377414 - protein, 25 aa, Mycobacterium tuberculosis
ANWIVRRLGIEPAEELRSARTPQEL

SEQ ID NO: 1377415 - protein, 18 aa, Mycobacterium tuberculosis
APARLPLWACGAADLTVR

SEQ ID NO: 1377416 - protein, 19 aa, Mycobacterium tuberculosis
APFYRCYETSDGKYMAVGA

SEQ ID NO: 1377417 - protein, 18 aa, Mycobacterium tuberculosis
ARAAAPLSEAMRVAGVNW

SEQ ID NO: 1377418 - protein, 21 aa, Mycobacterium tuberculosis
ASLFAAIIGSISFWGSIVAFG

SEQ ID NO: 1377419 - protein, 21 aa, Mycobacterium tuberculosis
ASMTWEILWALILGFALSAVV

SEQ ID NO: 1377420 - protein, 34 aa, Mycobacterium tuberculosis
ATFIAVLVLWDLFGQLPLPLGVVGHEGSTVLVAL

SEQ ID NO: 1377421 - protein, 25 aa, Mycobacterium tuberculosis
AVMVLCGLVVWQIYRPGRDLVRTGG

SEQ ID NO: 1377422 - protein, 23 aa, Mycobacterium tuberculosis
AWMTIDALVWVPRMYYLYGNPSR

SEQ ID NO: 1377423 - protein, 19 aa, Mycobacterium tuberculosis
DAARVRPATPLLQIDTQQV

SEQ ID NO: 1377424 - protein, 23 aa, Mycobacterium tuberculosis
DEDELRSAVSFFAEDAHIFATTV

SEQ ID NO: 1377425 - protein, 22 aa, Mycobacterium tuberculosis
DKLPWQPPTVFLMRHGAHNSYT

SEQ ID NO: 1377426 - protein, 18 aa, Mycobacterium tuberculosis
DLATAVLAIWLRFNMATE

SEQ ID NO: 1377427 - protein, 19 aa, Mycobacterium tuberculosis
DLDQVWRLTRGAGQRVAVI

SEQ ID NO: 1377428 - protein, 24 aa, Mycobacterium tuberculosis
DLVRELVTILPIVLVIAAVAAYLL

SEQ ID NO: 1377429 - protein, 17 aa, Mycobacterium tuberculosis
DMARLAVSFNDMAESLS

SEQ ID NO: 1377430 - protein, 19 aa, Mycobacterium tuberculosis
DTAIAIKRAEVRRAAEIMW

SEQ ID NO: 1377431 - protein, 17 aa, Mycobacterium tuberculosis
EAIKGLRAVAAGKQAPN

SEQ ID NO: 1377432 - protein, 24 aa, Mycobacterium tuberculosis
EAPTLAGHALRFDEFGNIITDSAV

SEQ ID NO: 1377433 - protein, 22 aa, Mycobacterium tuberculosis
EASRRIELHVGRDLQFIRINGT

SEQ ID NO: 1377434 - protein, 25 aa, Mycobacterium tuberculosis
ERRPSRLRRGWLVGIAATLLALAGG

SEQ ID NO: 1377435 - protein, 21 aa, Mycobacterium tuberculosis
EVPDAMRAMFGTRLLPREYAD

SEQ ID NO: 1377436 - protein, 25 aa, Mycobacterium tuberculosis
EYWYRSIRQPVQFERAVRNAFDGGY

SEQ ID NO: 1377437 - protein, 23 aa, Mycobacterium tuberculosis
FAVAAVFWACRFVMERRQEATQS

SEQ ID NO: 1377438 - protein, 21 aa, Mycobacterium tuberculosis
FAVHHSRWHFAVLYTFLSMVN

SEQ ID NO: 1377439 - protein, 18 aa, Mycobacterium tuberculosis
FLVRGGPNYFSIALIVIT

SEQ ID NO: 1377440 - protein, 31 aa, Mycobacterium tuberculosis; identical to SEQ ID NO: 156860

SEQ ID NO: 1377441 - protein, 21 aa, Mycobacterium tuberculosis
FNFGFGSLVWVYAAESFPSRL

SEQ ID NO: 1377442 - protein, 17 aa, Mycobacterium tuberculosis
FNTLASPCAIGLVTVML

SEQ ID NO: 1377443 - protein, 17 aa, Mycobacterium tuberculosis
FTVMIIVVFGQVRFHHT

SEQ ID NO: 1377444 - protein, 26 aa, Mycobacterium tuberculosis
GATYCLSFARLTLFHTMGPPLAIGML

SEQ ID NO: 1377445 - protein, 31 aa, Mycobacterium tuberculosis
GCQDGILTIVGFAWRGDHVQILDSLPELFDA

SEQ ID NO: 1377446 - protein, 22 aa, Mycobacterium tuberculosis
GEVVLLLFLPAILYWESMNTSF

SEQ ID NO: 1377447 - protein, 22 aa, Mycobacterium tuberculosis
GGLAVLRPGHTIPLARTQPALD

SEQ ID NO: 1377448 - protein, 22 aa, Mycobacterium tuberculosis
GISALCLIFIIMLITTRSVVAA

SEQ ID NO: 1377449 - protein, 26 aa, Mycobacterium tuberculosis
GLLVSLLVRRRRVWARITPTTAGTVN

SEQ ID NO: 1377450 - protein, 28 aa, Mycobacterium tuberculosis
GMAGLRRWLGPLSILLVLWGLRASIQWL

SEQ ID NO: 1377451 - protein, 19 aa, Mycobacterium tuberculosis
GMLALLLFGPRLVDIYVDW

SEQ ID NO: 1377452 - protein, 22 aa, Mycobacterium tuberculosis
GRANWLPTFVLLILLAAVTAVY

SEQ ID NO: 1377453 - protein, 22 aa, Mycobacterium tuberculosis
GRARKITWGELEKGRRRYLRDL

SEQ ID NO: 1377454 - protein, 24 aa, Mycobacterium tuberculosis
GRGRLTRSVIGWVGAVAVVVSLAG

SEQ ID NO: 1377455 - protein, 17 aa, Mycobacterium tuberculosis
GRLQPFFATPAAWRILD

SEQ ID NO: 1377456 - protein, 20 aa, Mycobacterium tuberculosis
GTMRRFSWSGSAPVLDPLPR

SEQ ID NO: 1377457 - protein, 17 aa, Mycobacterium tuberculosis
HALALTASMTWEILWAL

SEQ ID NO: 1377458 - protein, 24 aa, Mycobacterium tuberculosis
HSHRRVVLIIYLWVGIVAFGAASS

SEQ ID NO: 1377459 - protein, 22 aa, Mycobacterium tuberculosis
HVSGLRAGQFVRAAGVEVGKVA

SEQ ID NO: 1377460 - protein, 21 aa, Mycobacterium tuberculosis
IDEFQVLYAARRLRPKRMPPS

SEQ ID NO: 1377461 - protein, 19 aa, Mycobacterium tuberculosis
IDRDIPFQISAVAARSVQG

SEQ ID NO: 1377462 - protein, 23 aa, Mycobacterium tuberculosis
IEGPPGLRRAVGRVVRLQPAKSQ

SEQ ID NO: 1377463 - protein, 22 aa, Mycobacterium tuberculosis
IGAGLIFPRFEQLLEKPFSRIP

SEQ ID NO: 1377464 - protein, 25 aa, Mycobacterium tuberculosis
INYPPPCLTGFLPASEWRSPADTSP

SEQ ID NO: 1377465 - protein, 23 aa, Mycobacterium tuberculosis
IRWRLTLVFSAAMALVLAAAGAV

SEQ ID NO: 1377466 - protein, 17 aa, Mycobacterium tuberculosis
ITAPWGIAVDEAGTVYV

SEQ ID NO: 1377467 - protein, 17 aa, Mycobacterium tuberculosis
ITFTAAGLVALVGGGLF

SEQ ID NO: 1377468 - protein, 25 aa, Mycobacterium tuberculosis
ITLKRAKGPLVFDLGICLVLITLPT

SEQ ID NO: 1377469 - protein, 23 aa, Mycobacterium tuberculosis
IWAEEAWGRYWGWDPKETVSFVA

SEQ ID NO: 1377470 - protein, 23 aa, Mycobacterium tuberculosis
LADVVGCSMRLPFLYAPLPYGGT

SEQ ID NO: 1377471 - protein, 17 aa, Mycobacterium tuberculosis
LALYSGGDYLLRRLTAE

SEQ ID NO: 1377472 - protein, 17 aa, Mycobacterium tuberculosis
LAWELMAIASLILVLSE

SEQ ID NO: 1377473 - protein, 21 aa, Mycobacterium tuberculosis
LDWFISFVSGPVFTFLAYLVL

SEQ ID NO: 1377474 - protein, 17 aa, Mycobacterium tuberculosis
LEIAPGVVTTWMKLAIR

SEQ ID NO: 1377475 - protein, 19 aa, Mycobacterium tuberculosis
LEPPIPQPAAAPIEHWAAG

SEQ ID NO: 1377476 - protein, 17 aa, Mycobacterium tuberculosis
LGLRLELRLHDARDSNV

SEQ ID NO: 1377477 - protein, 17 aa, Mycobacterium tuberculosis
LHQVAGPAGRSVVMAGV

SEQ ID NO: 1377478 - protein, 21 aa, Mycobacterium tuberculosis
LIEQPIRRWRPARVPLLPLAA

SEQ ID NO: 1377479 - protein, 26 aa, Mycobacterium tuberculosis
LQWPLFAWFCVYAYRNFVRYEETPPQ

SEQ ID NO: 1377480 - protein, 18 aa, Mycobacterium tuberculosis
LRDLHAPGYVRAYAYDQD

SEQ ID NO: 1377481 - protein, 23 aa, Mycobacterium tuberculosis
LRKAAMSYRGNWRDIVLLVCVLL

SEQ ID NO: 1377482 - protein, 24 aa, Mycobacterium tuberculosis
LSAGCGPGSLLVAAQQWQELSDQY

SEQ ID NO: 1377483 - protein, 17 aa, Mycobacterium tuberculosis
LTDVAGFDAEFFGIAPS

SEQ ID NO: 1377484 - protein, 22 aa, Mycobacterium tuberculosis
LTLADGRVVIWGTTDRCEEKAE

SEQ ID NO: 1377485 - protein, 17 aa, Mycobacterium tuberculosis
LTMLSARAGLVMDPGSK

SEQ ID NO: 1377486 - protein, 24 aa, Mycobacterium tuberculosis
LTPSLAPWVALRLLPQGPTLSRAD

SEQ ID NO: 1377487 - protein, 21 aa, Mycobacterium tuberculosis
MAMSACASGVYLVDVRPKLLE

SEQ ID NO: 1377488 - protein, 17 aa, Mycobacterium tuberculosis
MLTRLQRALAHEQQFVA

SEQ ID NO: 1377489 - protein, 21 aa, Mycobacterium tuberculosis
MRRGLALRGTLLGARQRRHAA

SEQ ID NO: 1377490 - protein, 18 aa, Mycobacterium tuberculosis
MRRSLQFGALTAEELMTP

SEQ ID NO: 1377491 - protein, 46 aa, Mycobacterium tuberculosis
MTPSIAALLGRWFWWPLRVRPRPASQMLRPFAPRRLVRALLLPSGQ

SEQ ID NO: 1377492 - protein, 35 aa, Mycobacterium tuberculosis
MVVVPAFMHVTGRWNWWAPRPLAWLHERFGVSEAA

SEQ ID NO: 1377493 - protein, 23 aa, Mycobacterium tuberculosis
PFGWYYDLLALWAHVSTASIWMR

SEQ ID NO: 1377494 - protein, 21 aa, Mycobacterium tuberculosis
PFLLIMGGFMYFASRRQRRAM

SEQ ID NO: 1377495 - protein, 22 aa, Mycobacterium tuberculosis
PHIPGVPWWAAILIAVTATAIG

SEQ ID NO: 1377496 - protein, 17 aa, Mycobacterium tuberculosis
PLLTMGWLLARALTGEP

SEQ ID NO: 1377497 - protein, 18 aa, Mycobacterium tuberculosis
PLRFLARATNLWNSDLPF

SEQ ID NO: 1377498 - protein, 26 aa, Mycobacterium tuberculosis
PPAPGGSWPTAWLVALVVLACVAAAV

SEQ ID NO: 1377499 - protein, 18 aa, Mycobacterium tuberculosis
PPARSGPEVLVRTPDGTA

SEQ ID NO: 1377500 - protein, 17 aa, Mycobacterium tuberculosis
PPFGTWYAAMLFAVVPL

SEQ ID NO: 1377501 - protein, 20 aa, Mycobacterium tuberculosis
PPFYPPGWFWIGGRAAALTG

SEQ ID NO: 1377502 - protein, 18 aa, Mycobacterium tuberculosis
PRMKARAISNWMAIGMVG

SEQ ID NO: 1377503 - protein, 24 aa, Mycobacterium tuberculosis
PSRQSWPAATGVTLVGTNPAALVT

SEQ ID NO: 1377504 - protein, 17 aa, Mycobacterium tuberculosis
PWFNLDWITSAKLVAVV

SEQ ID NO: 1377505 - protein, 18 aa, Mycobacterium tuberculosis
QQGFFKGTTCHRLTTSPM

SEQ ID NO: 1377506 - protein, 27 aa, Mycobacterium tuberculosis
QRSEALADDVARSFADAGLDSVLSAEL

SEQ ID NO: 1377507 - protein, 22 aa, Mycobacterium tuberculosis
QTHGAHVCSLCLSTDKQAEHVL

SEQ ID NO: 1377508 - protein, 17 aa, Mycobacterium tuberculosis
RDKRVAVAVVALTALMV

SEQ ID NO: 1377509 - protein, 26 aa, Mycobacterium tuberculosis
RETVSVWFRSVWVLQPRGDLMAEAPL

SEQ ID NO: 1377510 - protein, 19 aa, Mycobacterium tuberculosis
RFSAADKPVIFWTPDHGAF

SEQ ID NO: 1377511 - protein, 20 aa, Mycobacterium tuberculosis
RGRLVTMLLVGVVLLAVGHR

SEQ ID NO: 1377512 - protein, 17 aa, Mycobacterium tuberculosis
RKLAPRVQARNPVMLVV

SEQ ID NO: 1377513 - protein, 21 aa, Mycobacterium tuberculosis
RLSVLMLVGGILFQIVTGVLN

SEQ ID NO: 1377514 - protein, 20 aa, Mycobacterium tuberculosis
RNPEVWAWMVWLPHNLHDEL

SEQ ID NO: 1377515 - protein, 24 aa, Mycobacterium tuberculosis
RNTQPGWVVAPGMQGVQVGPITQG

SEQ ID NO: 1377516 - protein, 19 aa, Mycobacterium tuberculosis
RPASRMLRPYGPRPVVREL

SEQ ID NO: 1377517 - protein, 26 aa, Mycobacterium tuberculosis
RPVFPYEPMVRVSLWLSVTAVAVLFG

SEQ ID NO: 1377518 - protein, 19 aa, Mycobacterium tuberculosis
RPVSVTPMVWVRPRQGPKL

SEQ ID NO: 1377519 - protein, 22 aa, Mycobacterium tuberculosis
RSALPQSLRKLAPRVQARNPVM

SEQ ID NO: 1377520 - protein, 21 aa, Mycobacterium tuberculosis
RVMLTAAEWTAVLINMNADNI

SEQ ID NO: 1377521 - protein, 27 aa, Mycobacterium tuberculosis
RWFFGAGAWAASVVWFAVLGFSAGRLQ

SEQ ID NO: 1377522 - protein, 25 aa, Mycobacterium tuberculosis
RWVNGLFGRLAWLFVGPVVAFPAFG

SEQ ID NO: 1377523 - protein, 18 aa, Mycobacterium tuberculosis
SAQAAFWSALSLPPLLLG

SEQ ID NO: 1377524 - protein, 38 aa, Mycobacterium tuberculosis; identical to SEQ ID NO: 234924

SEQ ID NO: 1377525 - protein, 17 aa, Mycobacterium tuberculosis
SELFLSLVYGIALTHSP

SEQ ID NO: 1377526 - protein, 24 aa, Mycobacterium tuberculosis
SELWAEAGKLGFLGVNLPEEYGGG

SEQ ID NO: 1377527 - protein, 18 aa, Mycobacterium tuberculosis
SFEAKKDIIAYVKVATEA

SEQ ID NO: 1377528 - protein, 17 aa, Mycobacterium tuberculosis
SNGWWIDPAIGLAIAGI

SEQ ID NO: 1377529 - protein, 20 aa, Mycobacterium tuberculosis
SPFESIWILALVVGIWLVVI

SEQ ID NO: 1377530 - protein, 23 aa, Mycobacterium tuberculosis
SPMSFLRRPARWMQLLATSGRCF

SEQ ID NO: 1377531 - protein, 25 aa, Mycobacterium tuberculosis
SRMWRRSGVRIVRRSTIHLVGSLIV

SEQ ID NO: 1377532 - protein, 20 aa, Mycobacterium tuberculosis
SSKFVMRRWLPVGTAVVALL

SEQ ID NO: 1377533 - protein, 23 aa, Mycobacterium tuberculosis
SSSCSYAAVALARSLFRKGANFT

SEQ ID NO: 1377534 - protein, 33 aa, Mycobacterium tuberculosis
TAAEWWRLGLMFAVIVALHLVGWLTVTLLVEPA

SEQ ID NO: 1377535 - protein, 20 aa, Mycobacterium tuberculosis
TAILMLYTIVIIRGLRTAIA

SEQ ID NO: 1377536 - protein, 22 aa, Mycobacterium tuberculosis
TATPRAYPFTNLIGPASTNDIV

SEQ ID NO: 1377537 - protein, 44 aa, Mycobacterium tuberculosis
TGMRLHHFGAFYKRSWRANDWMWGRLDGAGWLVHVLLDPRRVRW

SEQ ID NO: 1377538 - protein, 20 aa, Mycobacterium tuberculosis
TGYECLAPHHFLLTEWFAPY

SEQ ID NO: 1377539 - protein, 30 aa, Mycobacterium tuberculosis
TVPGRYTYLKWWKFVLVVLGVWIGAGEVGL

SEQ ID NO: 1377540 - protein, 23 aa, Mycobacterium tuberculosis
TYEHYFRTFLRPEDVGWSVVEVV

SEQ ID NO: 1377541 - protein, 26 aa, Mycobacterium tuberculosis
VAFLVVVTCVMWTLALTRPPDVREAA

SEQ ID NO: 1377542 - protein, 22 aa, Mycobacterium tuberculosis
VAGRMPGHMNVLLAEAEVDYDA

SEQ ID NO: 1377543 - protein, 18 aa, Mycobacterium tuberculosis
VAVAGRFVHTSIRTTVGA

SEQ ID NO: 1377544 - protein, 17 aa, Mycobacterium tuberculosis
VDGQMFLEMRLVEGTDL

SEQ ID NO: 1377545 - protein, 20 aa, Mycobacterium tuberculosis
VGGFAVWFSLFFAMATDGCH

SEQ ID NO: 1377546 - protein, 21 aa, Mycobacterium tuberculosis
VGTNPWRGPPIPYGTEVTDGR

SEQ ID NO: 1377547 - protein, 21 aa, Mycobacterium tuberculosis
VLLACGWAFLIWGMYAYLWAF

SEQ ID NO: 1377548 - protein, 22 aa, Mycobacterium tuberculosis
VQTEGFSGPALIIGTPTLSRVA

SEQ ID NO: 1377549 - protein, 20 aa, Mycobacterium tuberculosis
VRSAGLWYAVMTQLGFIAIL

SEQ ID NO: 1377550 - protein, 20 aa, Mycobacterium tuberculosis
VTLLPRRTPGSSGIADVPAQ

SEQ ID NO: 1377551 - protein, 22 aa, Mycobacterium tuberculosis
VVALRSRLLVRLGGAGGMVSLA

SEQ ID NO: 1377552 - protein, 22 aa, Mycobacterium tuberculosis
VVLACVAAAVVAYAGMHRVRPG

SEQ ID NO: 1377553 - protein, 24 aa, Mycobacterium tuberculosis
VVLAVRLNVLFSYQGNDMYTALQK

SEQ ID NO: 1377554 - protein, 25 aa, Mycobacterium tuberculosis
WGAVDRRWGRWAALVVTTVVFALAH

SEQ ID NO: 1377555 - protein, 18 aa, Mycobacterium tuberculosis
WPVMANFAVDSAMAVALA

SEQ ID NO: 1377556 - protein, 18 aa, Mycobacterium tuberculosis
WYAAMLFAVVPLRTILPG

SEQ ID NO: 1377557 - protein, 17 aa, Mycobacterium tuberculosis
YALAARALAPGGLMVVQ

SEQ ID NO: 1377558 - protein, 17 aa, Mycobacterium tuberculosis
YAVDVFSTLLVVPGDCW

SEQ ID NO: 1377559 - protein, 27 aa, Mycobacterium tuberculosis
YPLMSHLAARGWVCVSLNYRVSPRHTW

SEQ ID NO: 1377560 - protein, 21 aa, Mycobacterium tuberculosis
YYGARMMLVLLGTFYASMVVA

SEQ ID NO: 1377561 - protein, 20 aa, Mycobacterium tuberculosis
AEDAYGFPAGLWRWLQRHPP

SEQ ID NO: 1377562 - protein, 21 aa, Mycobacterium tuberculosis
AGICVVCAVPLAIGYRRASTH

SEQ ID NO: 1377563 - protein, 19 aa, Mycobacterium tuberculosis
AGWAADRFGTRRLFMGSVL

SEQ ID NO: 1377564 - protein, 17 aa, Mycobacterium tuberculosis
ALALRFTGRRLGIYTTI

SEQ ID NO: 1377565 - protein, 27 aa, Mycobacterium tuberculosis
ALLGDRYGRRRSFVFGVTLFVVSSIVC

SEQ ID NO: 1377566 - protein, 17 aa, Mycobacterium tuberculosis
ALVLLQLRVFYAREQPW

SEQ ID NO: 1377567 - protein, 20 aa, Mycobacterium tuberculosis
AMSAREIVIIGIGAVSREEV

SEQ ID NO: 1377568 - protein, 17 aa, Mycobacterium tuberculosis
APARLRRLWLAVLIVAP

SEQ ID NO: 1377569 - protein, 23 aa, Mycobacterium tuberculosis
ATVVRWRLAWLSKPETWRRRKRR

SEQ ID NO: 1377570 - protein, 19 aa, Mycobacterium tuberculosis
AVAVICLLAWSLSGLVGPS

SEQ ID NO: 1377571 - protein, 29 aa, Mycobacterium tuberculosis
AVLAFRHFGDAVLLLAIWIGIGFIFRGVA

SEQ ID NO: 1377572 - protein, 17 aa, Mycobacterium tuberculosis
AVVPLRTILPGSPPAGA

SEQ ID NO: 1377573 - protein, 19 aa, Mycobacterium tuberculosis
DDFWRPLRSFTYWERHCFD

SEQ ID NO: 1377574 - protein, 23 aa, Mycobacterium tuberculosis
DFLCPACGIFERGFGPTVSKLVD

SEQ ID NO: 1377575 - protein, 21 aa, Mycobacterium tuberculosis
DGHRPLAVGFFFSLGHSTVVF

SEQ ID NO: 1377576 - protein, 21 aa, Mycobacterium tuberculosis
DPDMRAAVVSIDPHNGAVRAY

SEQ ID NO: 1377577 - protein, 19 aa, Mycobacterium tuberculosis
DPFVRDGFQQVYSINTGQV

SEQ ID NO: 1377578 - protein, 23 aa, Mycobacterium tuberculosis
DVRLDRGGSLVITGRSGAGKTTL

SEQ ID NO: 1377579 - protein, 35 aa, Mycobacterium tuberculosis
DYIFGFSFYTGHYFGAWVFIAGFLLHIVVKIPHMV

SEQ ID NO: 1377580 - protein, 18 aa, Mycobacterium tuberculosis
EGSLGRLVVELEPDADSD

SEQ ID NO: 1377581 - protein, 22 aa, Mycobacterium tuberculosis
EGVELVQAIAIFFSTGLVPLNS

SEQ ID NO: 1377582 - protein, 26 aa, Mycobacterium tuberculosis
EPALTRSGAEWMPNFIELLQRKLSRI

SEQ ID NO: 1377583 - protein, 28 aa, Mycobacterium tuberculosis
EPYPEQRPPWGVPPPGWDGSSRPAPSTT

SEQ ID NO: 1377584 - protein, 29 aa, Mycobacterium tuberculosis
ERGPRLGPPPVMPPSLAWWASSLQLSGLT

SEQ ID NO: 1377585 - protein, 17 aa, Mycobacterium tuberculosis
FAIGRRIGRYNVVDVVW

SEQ ID NO: 1377586 - protein, 27 aa, Mycobacterium tuberculosis
FALRLAVGVGCGAIIGLERQWRARMAG

SEQ ID NO: 1377587 - protein, 18 aa, Mycobacterium tuberculosis
FDLGICLVLITLPTLALF

SEQ ID NO: 1377588 - protein, 28 aa, Mycobacterium tuberculosis
FPLGVVVGGPFLPLAIILYWFSNNIWTF

SEQ ID NO: 1377589 - protein, 21 aa, Mycobacterium tuberculosis
GCLALGWWQWTRFQSTSGTFQ

SEQ ID NO: 1377590 - protein, 24 aa, Mycobacterium tuberculosis
GGPARLGFAGAVLITAGGLGAGSV

SEQ ID NO: 1377591 - protein, 18 aa, Mycobacterium tuberculosis
GGVTRLIPLTGLTTPWMS

SEQ ID NO: 1377592 - protein, 25 aa, Mycobacterium tuberculosis
GIAERLRPSGVIQREIAMRTVAVFA

SEQ ID NO: 1377593 - protein, 25 aa, Mycobacterium tuberculosis
GNVFPRKISFLAAMRYYAGNWDTTL

SEQ ID NO: 1377594 - protein, 18 aa, Mycobacterium tuberculosis
GPWLRTGDLGVISDGELF

SEQ ID NO: 1377595 - protein, 23 aa, Mycobacterium tuberculosis
GQRRIPVQYAKRMVGRRMYGGTS

SEQ ID NO: 1377596 - protein, 19 aa, Mycobacterium tuberculosis
GSAPFPISALISGLVNAAL

SEQ ID NO: 1377597 - protein, 21 aa, Mycobacterium tuberculosis
GTLPATVFVAFQLMFAIITVA

SEQ ID NO: 1377598 - protein, 21 aa, Mycobacterium tuberculosis
GVIDIVVEWVIGNLFGVVPLL

SEQ ID NO: 1377599 - protein, 24 aa, Mycobacterium tuberculosis
GVNLLLSPAVFRGFDQVGALSPTG

SEQ ID NO: 1377600 - protein, 21 aa, Mycobacterium tuberculosis
HELRTPLTTVRMAADLIYDHS

SEQ ID NO: 1377601 - protein, 17 aa, Mycobacterium tuberculosis
IAQIALGTVQGFGLDVG

SEQ ID NO: 1377602 - protein, 25 aa, Mycobacterium tuberculosis
IGVMVALCLGGGVFGLSLGKHVTQS

SEQ ID NO: 1377603 - protein, 23 aa, Mycobacterium tuberculosis
IPLAAWATRPGFRVAAILATLIV

SEQ ID NO: 1377604 - protein, 18 aa, Mycobacterium tuberculosis
IRPRQWVKNVLVLAAPLA

SEQ ID NO: 1377605 - protein, 19 aa, Mycobacterium tuberculosis
ISMRAGRRVAISAGSLAVL

SEQ ID NO: 1377606 - protein, 21 aa, Mycobacterium tuberculosis
ITLAIGMARMAKRRAVIRRLP

SEQ ID NO: 1377607 - protein, 17 aa, Mycobacterium tuberculosis
IVLNLFAVGLRWDPYPF

SEQ ID NO: 1377608 - protein, 17 aa, Mycobacterium tuberculosis
KLNEPVIYPRGTLAMAN

SEQ ID NO: 1377609 - protein, 21 aa, Mycobacterium tuberculosis
KPVWQSLRHADTWIMSLLYIG

SEQ ID NO: 1377610 - protein, 21 aa, Mycobacterium tuberculosis
LAEQGLRVLAVAQRTWDNGTT

SEQ ID NO: 1377611 - protein, 31 aa, Mycobacterium tuberculosis; identical to SEQ ID NO: 160440

SEQ ID NO: 1377612 - protein, 27 aa, Mycobacterium tuberculosis
LGSALALAGVSAWLITRAWQMPPVLDL

SEQ ID NO: 1377613 - protein, 20 aa, Mycobacterium tuberculosis
LIAQVLDWFISFVSGPVFTF

SEQ ID NO: 1377614 - protein, 18 aa, Mycobacterium tuberculosis
LLEGIEMIPPRYVEYRGA

SEQ ID NO: 1377615 - protein, 19 aa, Mycobacterium tuberculosis
LLLVEALDAMVLTAGADAS

SEQ ID NO: 1377616 - protein, 26 aa, Mycobacterium tuberculosis
LNAAFRYALVRLRDAAEAVGFYRGER

SEQ ID NO: 1377617 - protein, 20 aa, Mycobacterium tuberculosis
LPKVGPWALYGLLFTIVILF

SEQ ID NO: 1377618 - protein, 17 aa, Mycobacterium tuberculosis
LPVPFILNQPPPPPGPV

SEQ ID NO: 1377619 - protein, 17 aa, Mycobacterium tuberculosis
LVAFSIFLTRAHTSRTR

SEQ ID NO: 1377620 - protein, 19 aa, Mycobacterium tuberculosis
LVKRGWMVRSVFDTIDGID

SEQ ID NO: 1377621 - protein, 17 aa, Mycobacterium tuberculosis
LVPAPARLRRLWLAVLI

SEQ ID NO: 1377622 - protein, 17 aa, Mycobacterium tuberculosis
LVSCKRDVGAAVLAAYV

SEQ ID NO: 1377623 - protein, 17 aa, Mycobacterium tuberculosis
LVVSVSLLVTRPHTSKL

SEQ ID NO: 1377624 - protein, 24 aa, Mycobacterium tuberculosis
LYLNYVWHYSLLKAGFAIAPAAVV

SEQ ID NO: 1377625 - protein, 21 aa, Mycobacterium tuberculosis
MGVEHLRWYDYPLAAALSLVV

SEQ ID NO: 1377626 - protein, 17 aa, Mycobacterium tuberculosis
PARGRLVTMLLVGVVLL

SEQ ID NO: 1377627 - protein, 31 aa, Mycobacterium tuberculosis
PATRFRPIIRLTVEWLEVLAMIALLPAAAAL

SEQ ID NO: 1377628 - protein, 20 aa, Mycobacterium tuberculosis
PELFGMTALVAFSIFLTRAH

SEQ ID NO: 1377629 - protein, 23 aa, Mycobacterium tuberculosis
PFADPGNPLAILVPLTAAAMDLV

SEQ ID NO: 1377630 - protein, 32 aa, Mycobacterium tuberculosis; identical to SEQ ID NO: 158288

SEQ ID NO: 1377631 - protein, 23 aa, Mycobacterium tuberculosis
PIKLRESPGLMILGRQGCGKTTA

SEQ ID NO: 1377632 - protein, 25 aa, Mycobacterium tuberculosis
PIPEIPQLPPGIPQVPGIGQFSAIS

SEQ ID NO: 1377633 - protein, 17 aa, Mycobacterium tuberculosis
PLVWLSLAYGWGLAGIW

SEQ ID NO: 1377634 - protein, 25 aa, Mycobacterium tuberculosis
PMEFICSSIQAGSRLGYQESAELCA

SEQ ID NO: 1377635 - protein, 18 aa, Mycobacterium tuberculosis
PRFQPGFEEADTRVQAAV

SEQ ID NO: 1377636 - protein, 27 aa, Mycobacterium tuberculosis
PSAELFVAAYVPYVAWLVQASADSAAA

SEQ ID NO: 1377637 - protein, 17 aa, Mycobacterium tuberculosis
QHDKLPPSINFAGPSPY

SEQ ID NO: 1377638 - protein, 25 aa, Mycobacterium tuberculosis
QVGMCVGVSLVLPAAVWGVLTPRQP

SEQ ID NO: 1377639 - protein, 25 aa, Mycobacterium tuberculosis
QWRDDLRWPPASALVSQDEAVAALR

SEQ ID NO: 1377640 - protein, 17 aa, Mycobacterium tuberculosis
RIAGFVVNVHWSVLVIL

SEQ ID NO: 1377641 - protein, 25 aa, Mycobacterium tuberculosis
RITGFARIVLLAAILGAALASSFSV

SEQ ID NO: 1377642 - protein, 19 aa, Mycobacterium tuberculosis
RKPLLLWFGVGGLIYTYVL

SEQ ID NO: 1377643 - protein, 25 aa, Mycobacterium tuberculosis
RLDSLFRLDHLAARLRRNSANLLVL

SEQ ID NO: 1377644 - protein, 19 aa, Mycobacterium tuberculosis
RLPPLAVGMGMYLSAALTL

SEQ ID NO: 1377645 - protein, 29 aa, Mycobacterium tuberculosis
RLPTLAMALTCWWVISREVIPRLGHAVKT

SEQ ID NO: 1377646 - protein, 20 aa, Mycobacterium tuberculosis
RLRRRLRQHRFEFLADDGRL

SEQ ID NO: 1377647 - protein, 18 aa, Mycobacterium tuberculosis
RNDILFDVEVIGWQVYGD

SEQ ID NO: 1377648 - protein, 18 aa, Mycobacterium tuberculosis
RPLDVGWSLVNTRSLFDH

SEQ ID NO: 1377649 - protein, 24 aa, Mycobacterium tuberculosis
RRETLRLVAEIGMGTGAMAVVGGT

SEQ ID NO: 1377650 - protein, 17 aa, Mycobacterium tuberculosis
RSALRTALIPAIDSTKV

SEQ ID NO: 1377651 - protein, 18 aa, Mycobacterium tuberculosis
RSVAGLSALRAELLAQTM

SEQ ID NO: 1377652 - protein, 21 aa, Mycobacterium tuberculosis
SALCFVGAVVLLYVDIDRRRG

SEQ ID NO: 1377653 - protein, 20 aa, Mycobacterium tuberculosis
SDPSRPVACIVRVRATNGSE

SEQ ID NO: 1377654 - protein, 23 aa, Mycobacterium tuberculosis
SLWVLPLRWSMVEYFYIKYYLPR

SEQ ID NO: 1377655 - protein, 23 aa, Mycobacterium tuberculosis
SVGNSWTPLAPVVEPPTPPTPAS

SEQ ID NO: 1377656 - protein, 28 aa, Mycobacterium tuberculosis
TEGFTRLWPTVGCLVGYGIAFALLALSI

SEQ ID NO: 1377657 - protein, 41 aa, Mycobacterium tuberculosis; identical to SEQ ID NO: 159151

SEQ ID NO: 1377658 - protein, 18 aa, Mycobacterium tuberculosis
TFLSHPITAFVLFVASPY

SEQ ID NO: 1377659 - protein, 30 aa, Mycobacterium tuberculosis; identical to SEQ ID NO: 159157

SEQ ID NO: 1377660 - protein, 20 aa, Mycobacterium tuberculosis
TGLIGSFVFSLIRPNGQAGS

SEQ ID NO: 1377661 - protein, 18 aa, Mycobacterium tuberculosis
TICTVFFAVYGMLLLTTQ

SEQ ID NO: 1377662 - protein, 22 aa, Mycobacterium tuberculosis
TILHRRSRRFGVLPLVAPILAA

SEQ ID NO: 1377663 - protein, 21 aa, Mycobacterium tuberculosis
TIVPLPWVIQAPRLFAGQIDF

SEQ ID NO: 1377664 - protein, 20 aa, Mycobacterium tuberculosis
TLVVRRFLRNRAAVASLAAL

SEQ ID NO: 1377665 - protein, 22 aa, Mycobacterium tuberculosis
TRSEGGGMLVLKRVDDARRDGD

SEQ ID NO: 1377666 - protein, 22 aa, Mycobacterium tuberculosis
TSRQAYKIQRWRSRVRNHTVVI

SEQ ID NO: 1377667 - protein, 18 aa, Mycobacterium tuberculosis
TWGLRLSWHMYRKTAGQG

SEQ ID NO: 1377668 - protein, 20 aa, Mycobacterium tuberculosis
VAQRRRARRSLAAVGSVAAA

SEQ ID NO: 1377669 - protein, 24 aa, Mycobacterium tuberculosis
VGIMWPSLLVILLLVAVVALLFTG

SEQ ID NO: 1377670 - protein, 17 aa, Mycobacterium tuberculosis
VHHFGLFAAVGAAMAAL

SEQ ID NO: 1377671 - protein, 23 aa, Mycobacterium tuberculosis
VIASLEMQHLISLGPNAPSPSQL

SEQ ID NO: 1377672 - protein, 19 aa, Mycobacterium tuberculosis
VRGAMVAAWDKLRGPNGKL

SEQ ID NO: 1377673 - protein, 17 aa, Mycobacterium tuberculosis
VRIGLVVLMLNRRRPLL

SEQ ID NO: 1377674 - protein, 18 aa, Mycobacterium tuberculosis
VSGIEGLLTWLGGGHWRE

SEQ ID NO: 1377675 - protein, 17 aa, Mycobacterium tuberculosis
VSVSLLVTRPHTSKLAT

SEQ ID NO: 1377676 - protein, 17 aa, Mycobacterium tuberculosis
VTLLPAILVLASPRGWV

SEQ ID NO: 1377677 - protein, 21 aa, Mycobacterium tuberculosis
VVLGFRFRQGLIPSLMWISVP

SEQ ID NO: 1377678 - protein, 34 aa, Mycobacterium tuberculosis
VVRLGVFLAVCLLTAFLLIAVFGEVRFGDGKTYY

SEQ ID NO: 1377679 - protein, 21 aa, Mycobacterium tuberculosis
VWDRPERRSGIPALDGLRAIA

SEQ ID NO: 1377680 - protein, 19 aa, Mycobacterium tuberculosis
WEALEHAGIPPGTLRRSAT

SEQ ID NO: 1377681 - protein, 17 aa, Mycobacterium tuberculosis
WGLAGIWSGLGTFIVLR

SEQ ID NO: 1377682 - protein, 27 aa, Mycobacterium tuberculosis
WGLVTALLAAWGWFTSLLVITGTIAVT

SEQ ID NO: 1377683 - protein, 23 aa, Mycobacterium tuberculosis
WIATACALTAWYVLYRSPDRRGV

SEQ ID NO: 1377684 - protein, 24 aa, Mycobacterium tuberculosis
WRITLPMLRPTMFFVLVTGIISAA

SEQ ID NO: 1377685 - protein, 17 aa, Mycobacterium tuberculosis
WSNLDCAPSNETLVKTF

SEQ ID NO: 1377686 - protein, 26 aa, Mycobacterium tuberculosis
WTIWQLWLVVLLVALWKGRRIGPLVA

SEQ ID NO: 1377687 - protein, 20 aa, Mycobacterium tuberculosis
YERDMRLIVAVTVVVVILIL

SEQ ID NO: 1377688 - protein, 18 aa, Mycobacterium tuberculosis
YKVPREVIFLDELPRNPT

SEQ ID NO: 1377689 - protein, 17 aa, Mycobacterium tuberculosis
YLLPARNWSVMAATEVR

SEQ ID NO: 1377690 - protein, 25 aa, Mycobacterium tuberculosis
AAAAEYPSEHPLGAAIVKAAQSRRI

SEQ ID NO: 1377691 - protein, 26 aa, Mycobacterium tuberculosis
AAAAEYPSEHPLGAAIVKAAQSRRIR

SEQ ID NO: 1377692 - protein, 25 aa, Mycobacterium tuberculosis
AAGNRGLDALGFAGTIPKSAPGSAT

SEQ ID NO: 1377693 - protein, 18 aa, Mycobacterium tuberculosis
AAGSVWPAVSMAVTGAGT

SEQ ID NO: 1377694 - protein, 17 aa, Mycobacterium tuberculosis
AALRPVDRIRAAAQTLT

SEQ ID NO: 1377695 - protein, 18 aa, Mycobacterium tuberculosis
AIALRDLRIPAIGLVLLL

SEQ ID NO: 1377696 - protein, 21 aa, Mycobacterium tuberculosis
ALDRMKAIVAQAVLDHVTDEE

SEQ ID NO: 1377697 - protein, 32 aa, Mycobacterium tuberculosis
ALLVAVFVVVDWRIHAAVLPPSVFGSGPLKWI

SEQ ID NO: 1377698 - protein, 21 aa, Mycobacterium tuberculosis
ALVEPTILLAVFALSIPAGSA

SEQ ID NO: 1377699 - protein, 23 aa, Mycobacterium tuberculosis
APIPGRLFAGPGLSQPSDVLPAD

SEQ ID NO: 1377700 - protein, 17 aa, Mycobacterium tuberculosis
APPTMVAVAPVAGADAT

SEQ ID NO: 1377701 - protein, 21 aa, Mycobacterium tuberculosis
AQARLAALSILVGAVGATGPG

SEQ ID NO: 1377702 - protein, 18 aa, Mycobacterium tuberculosis
ARHDLVLEAFTAVHAAFP

SEQ ID NO: 1377703 - protein, 17 aa, Mycobacterium tuberculosis
ARTAAAIAKQVGIEKVL

SEQ ID NO: 1377704 - protein, 20 aa, Mycobacterium tuberculosis
ASGDCRTWVGLTVVADDNLA

SEQ ID NO: 1377705 - protein, 17 aa, Mycobacterium tuberculosis
ASVTDWFLAAVIPLAIM

SEQ ID NO: 1377706 - protein, 24 aa, Mycobacterium tuberculosis
AVGIWKAGMFHTLIAVAVILTVIR

SEQ ID NO: 1377707 - protein, 25 aa, Mycobacterium tuberculosis
DALRTATLQRLRPRLGVGAGAPAPA

SEQ ID NO: 1377708 - protein, 23 aa, Mycobacterium tuberculosis
DASHELRTPLALLTTELELRCAG

SEQ ID NO: 1377709 - protein, 18 aa, Mycobacterium tuberculosis
DAVAALTWQLPAEPGGGA

SEQ ID NO: 1377710 - protein, 30 aa, Mycobacterium tuberculosis; identical to SEQ ID NO: 159928

SEQ ID NO: 1377711 - protein, 18 aa, Mycobacterium tuberculosis
DKWKNCAGKTVTVTNKAK

SEQ ID NO: 1377712 - protein, 26 aa, Mycobacterium tuberculosis
DNGLRPEPIIALGILLTWCSVERAVA

SEQ ID NO: 1377713 - protein, 22 aa, Mycobacterium tuberculosis
DVRLDRGGSLVITGRSGAGKTT

SEQ ID NO: 1377714 - protein, 22 aa, Mycobacterium tuberculosis
DYLRMWIQAATVMSHYQAVAHE

SEQ ID NO: 1377715 - protein, 22 aa, Mycobacterium tuberculosis
DYQTGGALLAWLTAAAVAIAML

SEQ ID NO: 1377716 - protein, 23 aa, Mycobacterium tuberculosis
EEYLRELTIWSGRYGSVAGVPAR

SEQ ID NO: 1377717 - protein, 20 aa, Mycobacterium tuberculosis
FAALDARRAALSALISGIDD

SEQ ID NO: 1377718 - protein, 23 aa, Mycobacterium tuberculosis
FAPRGAGEGRLIRALTTAPVPIV

SEQ ID NO: 1377719 - protein, 17 aa, Mycobacterium tuberculosis
FLVDRSVARRLARTFPY

SEQ ID NO: 1377720 - protein, 18 aa, Mycobacterium tuberculosis
GAGGYPQMLLRVGWAPIN

SEQ ID NO: 1377721 - protein, 23 aa, Mycobacterium tuberculosis
GALVWAGSLVWYLQRVGSEPDFL

SEQ ID NO: 1377722 - protein, 25 aa, Mycobacterium tuberculosis
GGAIAGILLKMCWPAAPRSVGVPLY

SEQ ID NO: 1377723 - protein, 18 aa, Mycobacterium tuberculosis
GHPNVFVVGDLMFVPGVP

SEQ ID NO: 1377724 - protein, 20 aa, Mycobacterium tuberculosis
GICVVCAVPLAIGYRRASTH

SEQ ID NO: 1377725 - protein, 17 aa, Mycobacterium tuberculosis
GLAVNMQAIVFMSAVMI

SEQ ID NO: 1377726 - protein, 19 aa, Mycobacterium tuberculosis
GLIGSFVFSLIRPNGQAGS

SEQ ID NO: 1377727 - protein, 19 aa, Mycobacterium tuberculosis
GLLARLWVLPVHRASGLIS

SEQ ID NO: 1377728 - protein, 20 aa, Mycobacterium tuberculosis
GLLARLWVLPVHRASGLISR

SEQ ID NO: 1377729 - protein, 26 aa, Mycobacterium tuberculosis
GLVTALLAAWGWFTSLLVITGTIAVT

SEQ ID NO: 1377730 - protein, 20 aa, Mycobacterium tuberculosis
GPKRLGRVMAVVGIPMLLGP

SEQ ID NO: 1377731 - protein, 23 aa, Mycobacterium tuberculosis
GQPSKFSMPGPWVGIAAPGENIA

SEQ ID NO: 1377732 - protein, 22 aa, Mycobacterium tuberculosis
GQRRIPVQYAKRMVGRRMYGGT

SEQ ID NO: 1377733 - protein, 19 aa, Mycobacterium tuberculosis
GRVYAARLAPVAAGLTLPS

SEQ ID NO: 1377734 - protein, 25 aa, Mycobacterium tuberculosis
GTANALCGIAIFALVVFVTGLPLAY

SEQ ID NO: 1377735 - protein, 20 aa, Mycobacterium tuberculosis
GTSYRSVLMYPEKMPRPPWR

SEQ ID NO: 1377736 - protein, 20 aa, Mycobacterium tuberculosis
GVEHLRWYDYPLAAALSLVV

SEQ ID NO: 1377737 - protein, 18 aa, Mycobacterium tuberculosis
GVELVQAIAIFFSTGLVP

SEQ ID NO: 1377738 - protein, 17 aa, Mycobacterium tuberculosis
HEFTEVIVIANGVRAGR

SEQ ID NO: 1377739 - protein, 18 aa, Mycobacterium tuberculosis
HGLVLSSILLWTGVGVML

SEQ ID NO: 1377740 - protein, 21 aa, Mycobacterium tuberculosis
HPSVPFYRYLRTWRRNEEAYL

SEQ ID NO: 1377741 - protein, 20 aa, Mycobacterium tuberculosis
HVIEVVDWWGTPAIAEVARS

SEQ ID NO: 1377742 - protein, 17 aa, Mycobacterium tuberculosis
IAAMRGFAMGGPVLSPM

SEQ ID NO: 1377743 - protein, 20 aa, Mycobacterium tuberculosis
ILTDPNMRAVLDYFVSPNGH

SEQ ID NO: 1377744 - protein, 25 aa, Mycobacterium tuberculosis
ITDLPDGRWSEFLEEPRLAARVAGA

SEQ ID NO: 1377745 - protein, 27 aa, Mycobacterium tuberculosis
KMQFGEGWWTSGWFLSFWVTGTSILLV

SEQ ID NO: 1377746 - protein, 18 aa, Mycobacterium tuberculosis
KYPTGYAVDLFNALSAKN

SEQ ID NO: 1377747 - protein, 17 aa, Mycobacterium tuberculosis
LAAPLLVRLMLGTNPQV

SEQ ID NO: 1377748 - protein, 20 aa, Mycobacterium tuberculosis
LEFYRRARAAADKITPDVEI

SEQ ID NO: 1377749 - protein, 17 aa, Mycobacterium tuberculosis
LERPLADVARASELGGS

SEQ ID NO: 1377750 - protein, 26 aa, Mycobacterium tuberculosis
LESIHMSWLRFGHGLVLSSILLWTGV

SEQ ID NO: 1377751 - protein, 18 aa, Mycobacterium tuberculosis
LLVVSALATLSGLGTPVA

SEQ ID NO: 1377752 - protein, 21 aa, Mycobacterium tuberculosis
LNAAFRYALVRLRDAAEAVGF

SEQ ID NO: 1377753 - protein, 18 aa, Mycobacterium tuberculosis
LPVVGAVALALTFAQSPG

SEQ ID NO: 1377754 - protein, 19 aa, Mycobacterium tuberculosis
LQLWGLLALVLDSLAIAAQ

SEQ ID NO: 1377755 - protein, 18 aa, Mycobacterium tuberculosis
LTAIPMGVPLEWNVFMIF

SEQ ID NO: 1377756 - protein, 21 aa, Mycobacterium tuberculosis
LTELRTRLLISLAAILVTTIF

SEQ ID NO: 1377757 - protein, 18 aa, Mycobacterium tuberculosis
LTEPRPWHVPGRPRRAGV

SEQ ID NO: 1377758 - protein, 18 aa, Mycobacterium tuberculosis
LVAEIGMGTGAMAVVGGT

SEQ ID NO: 1377759 - protein, 17 aa, Mycobacterium tuberculosis
LVICLGALLWSFISPSG

SEQ ID NO: 1377760 - protein, 19 aa, Mycobacterium tuberculosis
LVICLGALLWSFISPSGQL

SEQ ID NO: 1377761 - protein, 17 aa, Mycobacterium tuberculosis
LWAARRPGDTSATVLTA

SEQ ID NO: 1377762 - protein, 18 aa, Mycobacterium tuberculosis
LWAGCLLPMVNLLWAPLY

SEQ ID NO: 1377763 - protein, 25 aa, Mycobacterium tuberculosis
MGILTWIFVDGHFSKWLNFTPTPLT

SEQ ID NO: 1377764 - protein, 19 aa, Mycobacterium tuberculosis
MRYRSGGPFADAVAAVRAG

SEQ ID NO: 1377765 - protein, 26 aa, Mycobacterium tuberculosis
MYPEKMPRPPWRHETHNYIRSGPGPR

SEQ ID NO: 1377766 - protein, 20 aa, Mycobacterium tuberculosis
NAVVAFAVIGFASLAVAVAV

SEQ ID NO: 1377767 - protein, 18 aa, Mycobacterium tuberculosis
NGGAWLVLLMIFNVIWTY

SEQ ID NO: 1377768 - protein, 23 aa, Mycobacterium tuberculosis
NRFPDPKDRCHLATIGVQPLVPD

SEQ ID NO: 1377769 - protein, 23 aa, Mycobacterium tuberculosis
PDYQTGGALLAWLTAAAVAIAML

SEQ ID NO: 1377770 - protein, 31 aa, Mycobacterium tuberculosis
PENVHWTIWQLWLVVLLVALWKGRRIGPLVA

SEQ ID NO: 1377771 - protein, 33 aa, Mycobacterium tuberculosis
PFMFGSPYAIFLLREHFRLIPDDLINAARLDGA

SEQ ID NO: 1377772 - protein, 17 aa, Mycobacterium tuberculosis
PGVDKPLKASRCGGRPR

SEQ ID NO: 1377773 - protein, 19 aa, Mycobacterium tuberculosis
PQRVRPRPASRMLRPYGPR

SEQ ID NO: 1377774 - protein, 20 aa, Mycobacterium tuberculosis
PRRMLLFGLVVVVALAVLLC

SEQ ID NO: 1377775 - protein, 19 aa, Mycobacterium tuberculosis
PVSYAIAAMRGFAMGGPVL

SEQ ID NO: 1377776 - protein, 22 aa, Mycobacterium tuberculosis
PVSYAIAAMRGFAMGGPVLSPM

SEQ ID NO: 1377777 - protein, 27 aa, Mycobacterium tuberculosis
QALKAAECRAGARAWRRHEPQLALHAD

SEQ ID NO: 1377778 - protein, 18 aa, Mycobacterium tuberculosis
QGLIPSLMWISVPVILGI

SEQ ID NO: 1377779 - protein, 20 aa, Mycobacterium tuberculosis
QPAAAPIEHWAAGDADPLGN

SEQ ID NO: 1377780 - protein, 17 aa, Mycobacterium tuberculosis
QQPGWVGTHAYWLGAQW

SEQ ID NO: 1377781 - protein, 21 aa, Mycobacterium tuberculosis
QTRAGLRFAAPLIAAGLRALF

SEQ ID NO: 1377782 - protein, 17 aa, Mycobacterium tuberculosis
RAGLVMDPGSKVTYNGV

SEQ ID NO: 1377783 - protein, 24 aa, Mycobacterium tuberculosis
RALEYLKITYGWSLLLIVTFTVLY

SEQ ID NO: 1377784 - protein, 19 aa, Mycobacterium tuberculosis
RDSRHVIEVVDWWGTPAIA

SEQ ID NO: 1377785 - protein, 32 aa, Mycobacterium tuberculosis; identical to SEQ ID NO: 158640

SEQ ID NO: 1377786 - protein, 18 aa, Mycobacterium tuberculosis
RNTDYRLGWYVIIGTIPI

SEQ ID NO: 1377787 - protein, 19 aa, Mycobacterium tuberculosis
RNTDYRLGWYVIIGTIPIC

SEQ ID NO: 1377788 - protein, 23 aa, Mycobacterium tuberculosis
RRSRGLAGLSVAWGLWEQASAMT

SEQ ID NO: 1377789 - protein, 18 aa, Mycobacterium tuberculosis
RSASRIAERFAEGHLSER

SEQ ID NO: 1377790 - protein, 24 aa, Mycobacterium tuberculosis
RTMPTESYTPWITRVLAAFIDWAP

SEQ ID NO: 1377791 - protein, 17 aa, Mycobacterium tuberculosis
RYLLVQVLFGSVVLGSS

SEQ ID NO: 1377792 - protein, 19 aa, Mycobacterium tuberculosis
SAGDVFDIFDPLRRFVAAI

SEQ ID NO: 1377793 - protein, 17 aa, Mycobacterium tuberculosis
SAPRAGTLLGQHTTVAT

SEQ ID NO: 1377794 - protein, 17 aa, Mycobacterium tuberculosis
SDFAYLVDFGIARAASD

SEQ ID NO: 1377795 - protein, 18 aa, Mycobacterium tuberculosis
SIFAVFWGALGIATGATH

SEQ ID NO: 1377796 - protein, 18 aa, Mycobacterium tuberculosis
SNEDGRTAVALGIGAGIG

SEQ ID NO: 1377797 - protein, 25 aa, Mycobacterium tuberculosis
SPRSSSGNRAWWILAAVVVVGVLVL

SEQ ID NO: 1377798 - protein, 26 aa, Mycobacterium tuberculosis
SPRSSSGNRAWWILAAVVVVGVLVLV

SEQ ID NO: 1377799 - protein, 23 aa, Mycobacterium tuberculosis
TAKGGIVFRVQQELGVPVKLVGL

SEQ ID NO: 1377800 - protein, 19 aa, Mycobacterium tuberculosis
TDFGRLKALGRMESKPLRR

SEQ ID NO: 1377801 - protein, 18 aa, Mycobacterium tuberculosis
TIGGGYLLFGAMLYGSFF

SEQ ID NO: 1377802 - protein, 19 aa, Mycobacterium tuberculosis
TIGGGYLLFGAMLYGSFFM

SEQ ID NO: 1377803 - protein, 19 aa, Mycobacterium tuberculosis
TITPFPWHEIVQFLEETFA

SEQ ID NO: 1377804 - protein, 23 aa, Mycobacterium tuberculosis
TSRQAYKIQRWRSRVRNHTVVIG

SEQ ID NO: 1377805 - protein, 26 aa, Mycobacterium tuberculosis
VAAALARTTRWGSFLPDIDAFDAEFF

SEQ ID NO: 1377806 - protein, 17 aa, Mycobacterium tuberculosis
VAVTLVLLSGFAVLGGI

SEQ ID NO: 1377807 - protein, 25 aa, Mycobacterium tuberculosis
VDNKLGYGLVDPVAALTFNIPSGDR

SEQ ID NO: 1377808 - protein, 22 aa, Mycobacterium tuberculosis
VIPFLIISVLFYFTVVVQEKML

SEQ ID NO: 1377809 - protein, 28 aa, Mycobacterium tuberculosis
VLAFRHFGDAVLLLAIWIGIGFIFRGVA

SEQ ID NO: 1377810 - protein, 20 aa, Mycobacterium tuberculosis
VLGFRFRQGLIPSLMWISVP

SEQ ID NO: 1377811 - protein, 18 aa, Mycobacterium tuberculosis
VLIAYVFSLLGYDWLAHT

SEQ ID NO: 1377812 - protein, 18 aa, Mycobacterium tuberculosis
VMGLLGLVGSEAVVDARL

SEQ ID NO: 1377813 - protein, 23 aa, Mycobacterium tuberculosis
VPPEVPSAWLSTGMGPGPLLAAA

SEQ ID NO: 1377814 - protein, 18 aa, Mycobacterium tuberculosis
VVGGTVRTVGRTVSGAAT

SEQ ID NO: 1377815 - protein, 23 aa, Mycobacterium tuberculosis
VVTAGSLVVHWATMQELYGITDS

SEQ ID NO: 1377816 - protein, 40 aa, Mycobacterium tuberculosis; identical to SEQ ID NO: 159648

SEQ ID NO: 1377817 - protein, 19 aa, Mycobacterium tuberculosis
VWFGHFPGWIPLGAMVLPF

SEQ ID NO: 1377818 - protein, 17 aa, Mycobacterium tuberculosis
WFLSFWVTGTSILLVSG

SEQ ID NO: 1377819 - protein, 26 aa, Mycobacterium tuberculosis
WGTANALCGIAIFALVVFVTGLPLAY

SEQ ID NO: 1377820 - protein, 21 aa, Mycobacterium tuberculosis
WRPGAWACSLVVVAAWGSILL

SEQ ID NO: 1377821 - protein, 21 aa, Mycobacterium tuberculosis
YERDMRLIVAVTVVVVILILM

SEQ ID NO: 1377822 - protein, 19 aa, Mycobacterium tuberculosis
YFRMGWWSIIGYAAAAIIG

SEQ ID NO: 1377823 - protein, 19 aa, Mycobacterium tuberculosis
YKVPREVIFLDELPRNPTG

SEQ ID NO: 1377824 - protein, 17 aa, Mycobacterium tuberculosis
YPTGYAVDLFNALSAKN

SEQ ID NO: 1377825 - protein, 17 aa, Mycobacterium tuberculosis
YSCWPVPGGDIALMAAR

SEQ ID NO: 1377826 - protein, 32 aa, Mycobacterium tuberculosis
YTAIWAAKRARGSPLRIMILLVLVSALASALL

SEQ ID NO: 1377827 - protein, 17 aa, Mycobacterium tuberculosis
YTALLVTFVGDYVTAGG

SEQ ID NO: 1377828 - protein, 18 aa, Mycobacterium tuberculosis
AALARVTSAIGVVAGLGM

SEQ ID NO: 1377829 - protein, 17 aa, Mycobacterium tuberculosis
ADAPPFFVLHGRHDSLI

SEQ ID NO: 1377830 - protein, 19 aa, Mycobacterium tuberculosis
AEDAYGFPAGLWRWLQRHP

SEQ ID NO: 1377831 - protein, 18 aa, Mycobacterium tuberculosis
AFQDASCPDVQMISVPGT

SEQ ID NO: 1377832 - protein, 24 aa, Mycobacterium tuberculosis
AGPDRIAAMLSEVVGLLAAGVLAR

SEQ ID NO: 1377833 - protein, 19 aa, Mycobacterium tuberculosis
AMAIRREAEQFVGIELSAT

SEQ ID NO: 1377834 - protein, 25 aa, Mycobacterium tuberculosis
APIAIPLRVGGPIAIDGDPTKVRGL

SEQ ID NO: 1377835 - protein, 17 aa, Mycobacterium tuberculosis
APLLLWQVATRHFTNIS

SEQ ID NO: 1377836 - protein, 18 aa, Mycobacterium tuberculosis
ASDFAYLVDFGIARAASD

SEQ ID NO: 1377837 - protein, 20 aa, Mycobacterium tuberculosis
ASLFAAIIGSISFWGSIVAF

SEQ ID NO: 1377838 - protein, 24 aa, Mycobacterium tuberculosis
ASSSCSYAAVALARSLFRKGANFT

SEQ ID NO: 1377839 - protein, 24 aa, Mycobacterium tuberculosis
ATGVLVGGLWAWIAPPIHAVVAIT

SEQ ID NO: 1377840 - protein, 17 aa, Mycobacterium tuberculosis
ATSGLAGRRIWDAALVA

SEQ ID NO: 1377841 - protein, 22 aa, Mycobacterium tuberculosis
AVAAVFWACRFVMERRQEATQS

SEQ ID NO: 1377842 - protein, 17 aa, Mycobacterium tuberculosis
AVVVFVVRYVLLVINRN

SEQ ID NO: 1377843 - protein, 18 aa, Mycobacterium tuberculosis
DAARVRPATPLLQIDTQQ

SEQ ID NO: 1377844 - protein, 20 aa, Mycobacterium tuberculosis
DEFQVLYAARRLRPKRMPPS

SEQ ID NO: 1377845 - protein, 17 aa, Mycobacterium tuberculosis
DGLTAWIAAPLLFIGAL

SEQ ID NO: 1377846 - protein, 24 aa, Mycobacterium tuberculosis
DGRHPFLVMELIEGGTLRELLIER

SEQ ID NO: 1377847 - protein, 21 aa, Mycobacterium tuberculosis
DPATLWTLIGGPRMWERRPGA

SEQ ID NO: 1377848 - protein, 17 aa, Mycobacterium tuberculosis
DRYYLRAGTPVNRGYAA

SEQ ID NO: 1377849 - protein, 17 aa, Mycobacterium tuberculosis
DSEAFAAVASFSRALVL

SEQ ID NO: 1377850 - protein, 17 aa, Mycobacterium tuberculosis
DYVRMWLQAAAVMGLYQ

SEQ ID NO: 1377851 - protein, 19 aa, Mycobacterium tuberculosis
EFVDVFLAIGRVGRSLGMH

SEQ ID NO: 1377852 - protein, 17 aa, Mycobacterium tuberculosis
ELIEITLVKNPAMRYRS

SEQ ID NO: 1377853 - protein, 26 aa, Mycobacterium tuberculosis
ERDPLRTGIFGLVLVICVVLIAFGYS

SEQ ID NO: 1377854 - protein, 17 aa, Mycobacterium tuberculosis
FAMFLIGRYHERRRQHI

SEQ ID NO: 1377855 - protein, 18 aa, Mycobacterium tuberculosis
FAVVPLRTILPGSPPAGA

SEQ ID NO: 1377856 - protein, 19 aa, Mycobacterium tuberculosis
FDLGICLVLITLPTLALFV

SEQ ID NO: 1377857 - protein, 19 aa, Mycobacterium tuberculosis
FDPLRRFVAAIPECRANPV

SEQ ID NO: 1377858 - protein, 17 aa, Mycobacterium tuberculosis
FGLSVLIWQHFVGLQVH

SEQ ID NO: 1377859 - protein, 17 aa, Mycobacterium tuberculosis
FGPPGTVADISYFDVNS

SEQ ID NO: 1377860 - protein, 19 aa, Mycobacterium tuberculosis
FGSWPGWYAGVIELVAGLL

SEQ ID NO: 1377861 - protein, 22 aa, Mycobacterium tuberculosis
FNVRGARNIPCETVPGKRAPTV

SEQ ID NO: 1377862 - protein, 17 aa, Mycobacterium tuberculosis
FQDASCPDVQMISVPGT

SEQ ID NO: 1377863 - protein, 23 aa, Mycobacterium tuberculosis
FTRISVVQIGWALRRYRRETLRL

SEQ ID NO: 1377864 - protein, 19 aa, Mycobacterium tuberculosis
FYNRRLRAATTRFSVRMKH

SEQ ID NO: 1377865 - protein, 20 aa, Mycobacterium tuberculosis
FYNRRLRAATTRFSVRMKHD

SEQ ID NO: 1377866 - protein, 22 aa, Mycobacterium tuberculosis
GAEIGTQFGAFVVFTLLVLAVI

SEQ ID NO: 1377867 - protein, 17 aa, Mycobacterium tuberculosis
GAISRILGHDAGFGPLV

SEQ ID NO: 1377868 - protein, 21 aa, Mycobacterium tuberculosis
GALDATITWSSEGIKESVQNA

SEQ ID NO: 1377869 - protein, 23 aa, Mycobacterium tuberculosis
GGPARLGFAGAVLITAGGLGAGS

SEQ ID NO: 1377870 - protein, 27 aa, Mycobacterium tuberculosis
GMAGLRRWLGPLSILLVLWGLRASIQW

SEQ ID NO: 1377871 - protein, 19 aa, Mycobacterium tuberculosis
GMGEVYLARHPRLPRQDAL

SEQ ID NO: 1377872 - protein, 20 aa, Mycobacterium tuberculosis
GNDPVAVPWVLSARSAQALT

SEQ ID NO: 1377873 - protein, 20 aa, Mycobacterium tuberculosis
GQSLKLQWGVTGPDGRIQPL

SEQ ID NO: 1377874 - protein, 20 aa, Mycobacterium tuberculosis
GRGRVTLVLLAVVPVALAYP

SEQ ID NO: 1377875 - protein, 18 aa, Mycobacterium tuberculosis
GSRIELRLADPADSELDR

SEQ ID NO: 1377876 - protein, 22 aa, Mycobacterium tuberculosis
GVAVTAGMMWSHIIAGAVVAVL

SEQ ID NO: 1377877 - protein, 24 aa, Mycobacterium tuberculosis
GVSIPRAMFWTVLVYVFVATVISF

SEQ ID NO: 1377878 - protein, 17 aa, Mycobacterium tuberculosis
HGGLSFGSVLLAAGVCL

SEQ ID NO: 1377879 - protein, 29 aa, Mycobacterium tuberculosis
HLVLDVCIILGVLIAYVFSLLGYDWLAHT

SEQ ID NO: 1377880 - protein, 17 aa, Mycobacterium tuberculosis
HVVSLAGVLAFVALVIV

SEQ ID NO: 1377881 - protein, 17 aa, Mycobacterium tuberculosis
ICLGALLWSFISPSGQL

SEQ ID NO: 1377882 - protein, 18 aa, Mycobacterium tuberculosis
IDHTVIGCSLVRGTPYRY

SEQ ID NO: 1377883 - protein, 17 aa, Mycobacterium tuberculosis
IIPLRPLTLSDIFNGAV

SEQ ID NO: 1377884 - protein, 17 aa, Mycobacterium tuberculosis
IRPRQWVKNVLVLAAPL

SEQ ID NO: 1377885 - protein, 26 aa, Mycobacterium tuberculosis
ITLKRAKGPLVFDLGICLVLITLPTL

SEQ ID NO: 1377886 - protein, 23 aa, Mycobacterium tuberculosis
ITPFPFGELAKFLEMAAQAFTEV

SEQ ID NO: 1377887 - protein, 29 aa, Mycobacterium tuberculosis
IWQHILHMPLHWLVLPMAIIVMLAVGSDY

SEQ ID NO: 1377888 - protein, 18 aa, Mycobacterium tuberculosis
KLGLHIPLWAGYACSTLI

SEQ ID NO: 1377889 - protein, 18 aa, Mycobacterium tuberculosis
KPLLLWFGVGGLIYTYVL

SEQ ID NO: 1377890 - protein, 21 aa, Mycobacterium tuberculosis
KSELLRTIALGMMARNSPEVL

SEQ ID NO: 1377891 - protein, 22 aa, Mycobacterium tuberculosis
KYYGARMMLVLLGTFYASMVVA

SEQ ID NO: 1377892 - protein, 20 aa, Mycobacterium tuberculosis
LAEQGLRVLAVAQRTWDNGT

SEQ ID NO: 1377893 - protein, 17 aa, Mycobacterium tuberculosis
LCGIVPLLPVNQTTATI

SEQ ID NO: 1377894 - protein, 30 aa, Mycobacterium tuberculosis
LESIHMSWLRFGHGLVLSSILLWTGVGVML

SEQ ID NO: 1377895 - protein, 21 aa, Mycobacterium tuberculosis
LHRAKGGGLSTLFGGGVQSSL

SEQ ID NO: 1377896 - protein, 37 aa, Mycobacterium tuberculosis
LLLFGPRLVDIYVDWLWFGEVGFRSVWITVLLTRLAI

SEQ ID NO: 1377897 - protein, 20 aa, Mycobacterium tuberculosis
LLNGVVLKFAMNSMNSTFAA

SEQ ID NO: 1377898 - protein, 19 aa, Mycobacterium tuberculosis
LLVVFPALFAAIITSAGGV

SEQ ID NO: 1377899 - protein, 17 aa, Mycobacterium tuberculosis
LNGKRPKLRRILSDPDA

SEQ ID NO: 1377900 - protein, 17 aa, Mycobacterium tuberculosis
LQLWGLLALVLDSLAIA

SEQ ID NO: 1377901 - protein, 18 aa, Mycobacterium tuberculosis
LRPGYLLLRDAVSTPRSY

SEQ ID NO: 1377902 - protein, 17 aa, Mycobacterium tuberculosis
LRQLPVLIGSVVLGSAT

SEQ ID NO: 1377903 - protein, 18 aa, Mycobacterium tuberculosis
LRQLPVLIGSVVLGSATG

SEQ ID NO: 1377904 - protein, 21 aa, Mycobacterium tuberculosis
LRYAPDCVVRVNAGRVRERVL

SEQ ID NO: 1377905 - protein, 19 aa, Mycobacterium tuberculosis
LSLTAAFGALVWIFQEGHF

SEQ ID NO: 1377906 - protein, 17 aa, Mycobacterium tuberculosis
LSPRTGRRPETPAYGSW

SEQ ID NO: 1377907 - protein, 23 aa, Mycobacterium tuberculosis
LTPSLAPWVALRLLPQGPTLSRA

SEQ ID NO: 1377908 - protein, 23 aa, Mycobacterium tuberculosis
LTRYRPRVRVGFASRLADAAVIA

SEQ ID NO: 1377909 - protein, 18 aa, Mycobacterium tuberculosis
LVAAAGFYCYGLTHVLYL

SEQ ID NO: 1377910 - protein, 34 aa, Mycobacterium tuberculosis
LVVARCEYHPTPACPQTRITGVPGRGPETRTANQ

SEQ ID NO: 1377911 - protein, 18 aa, Mycobacterium tuberculosis
LVVFPALFAAIITSAGGV

SEQ ID NO: 1377912 - protein, 17 aa, Mycobacterium tuberculosis
LWGLLALVLDSLAIAAQ

SEQ ID NO: 1377913 - protein, 21 aa, Mycobacterium tuberculosis
LYAFLCATALMVVRIEERHTR

SEQ ID NO: 1377914 - protein, 22 aa, Mycobacterium tuberculosis
LYAFLCATALMVVRIEERHTRS

SEQ ID NO: 1377915 - protein, 23 aa, Mycobacterium tuberculosis
LYLNYVWHYSLLKAGFAIAPAAV

SEQ ID NO: 1377916 - protein, 17 aa, Mycobacterium tuberculosis
LYYQIHVLIGLALFALW

SEQ ID NO: 1377917 - protein, 20 aa, Mycobacterium tuberculosis
MEVLALPLVAVVLFFVFGGV

SEQ ID NO: 1377918 - protein, 18 aa, Mycobacterium tuberculosis
MLIAIIVALWVSRTDGVV

SEQ ID NO: 1377919 - protein, 27 aa, Mycobacterium tuberculosis
MPVLLFCIAFGLSMDYEVFLVSRIREY

SEQ ID NO: 1377920 - protein, 26 aa, Mycobacterium tuberculosis
MSATALFPMYFLKSFAYAGVATVAFV

SEQ ID NO: 1377921 - protein, 22 aa, Mycobacterium tuberculosis
PDQPLLTGWLVRRTLLVSTLLV

SEQ ID NO: 1377922 - protein, 17 aa, Mycobacterium tuberculosis
PEVLNLLLVDFKGGATF

SEQ ID NO: 1377923 - protein, 18 aa, Mycobacterium tuberculosis
PFYRCYETSDGKYMAVGA

SEQ ID NO: 1377924 - protein, 17 aa, Mycobacterium tuberculosis
PGLIGIARVDRNIDRLL

SEQ ID NO: 1377925 - protein, 22 aa, Mycobacterium tuberculosis
PKHFRCVSVDLLARRPVVHRQG

SEQ ID NO: 1377926 - protein, 23 aa, Mycobacterium tuberculosis
PLRRASPSAVHPVAPPSVRPFTT

SEQ ID NO: 1377927 - protein, 18 aa, Mycobacterium tuberculosis
PPFGTWYAAMLFAVVPLR

SEQ ID NO: 1377928 - protein, 24 aa, Mycobacterium tuberculosis
PRSVGVPLYLLLGWVAVWYTATIL

SEQ ID NO: 1377929 - protein, 19 aa, Mycobacterium tuberculosis
PSVPFYRYLRTWRRNEEAY

SEQ ID NO: 1377930 - protein, 17 aa, Mycobacterium tuberculosis
PVARGGLLYVEPVYASP

SEQ ID NO: 1377931 - protein, 18 aa, Mycobacterium tuberculosis
PWFNLDWITSAKLVAVVG

SEQ ID NO: 1377932 - protein, 17 aa, Mycobacterium tuberculosis
PWLLSFAQPSIWQIGRP

SEQ ID NO: 1377933 - protein, 17 aa, Mycobacterium tuberculosis
QPSMIGQLVQWLLSVGG

SEQ ID NO: 1377934 - protein, 22 aa, Mycobacterium tuberculosis
QPVIGCAAALVFGGLPALAFPA

SEQ ID NO: 1377935 - protein, 33 aa, Mycobacterium tuberculosis; identical to SEQ ID NO: 158535

SEQ ID NO: 1377936 - protein, 24 aa, Mycobacterium tuberculosis
QVGMCVGVSLVLPAAVWGVLTPRQ

SEQ ID NO: 1377937 - protein, 17 aa, Mycobacterium tuberculosis
RAEVRRAAEIMWAEHQL

SEQ ID NO: 1377938 - protein, 20 aa, Mycobacterium tuberculosis
RGAGEGRLIRALTTAPVPIV

SEQ ID NO: 1377939 - protein, 21 aa, Mycobacterium tuberculosis
RGDQLGGRRRPPGPPGPPGSS

SEQ ID NO: 1377940 - protein, 20 aa, Mycobacterium tuberculosis
RGSQWAGMGRQLLADEPAFA

SEQ ID NO: 1377941 - protein, 18 aa, Mycobacterium tuberculosis
RGSYGGVVMIGMLSSVVG

SEQ ID NO: 1377942 - protein, 19 aa, Mycobacterium tuberculosis
RGSYGGVVMIGMLSSVVGL

SEQ ID NO: 1377943 - protein, 20 aa, Mycobacterium tuberculosis
RGTRAVIRYDNLFGDRYLAL

SEQ ID NO: 1377944 - protein, 18 aa, Mycobacterium tuberculosis
RIAGFVVNVHWSVLVILW

SEQ ID NO: 1377945 - protein, 18 aa, Mycobacterium tuberculosis
RLHQVAGPAGRSVVMAGV

SEQ ID NO: 1377946 - protein, 30 aa, Mycobacterium tuberculosis
RLPTLAMALTCWWVISREVIPRLGHAVKTS

SEQ ID NO: 1377947 - protein, 24 aa, Mycobacterium tuberculosis
RRDPLTVFLVLIIVFSLVLAGLIG

SEQ ID NO: 1377948 - protein, 22 aa, Mycobacterium tuberculosis
RRGGRRPGWVLLTALLVLAIGA

SEQ ID NO: 1377949 - protein, 20 aa, Mycobacterium tuberculosis
RRGLALRGTLLGARQRRHAA

SEQ ID NO: 1377950 - protein, 20 aa, Mycobacterium tuberculosis
RSARELWAGCLLPMVNLLWA

SEQ ID NO: 1377951 - protein, 22 aa, Mycobacterium tuberculosis
RSELPDCIVISVSHRPALERLH

SEQ ID NO: 1377952 - protein, 22 aa, Mycobacterium tuberculosis
RSSKFVMRRWLPVGTAVVALLV

SEQ ID NO: 1377953 - protein, 22 aa, Mycobacterium tuberculosis
RTFIRGSGWAELVGIGDVAAFD

SEQ ID NO: 1377954 - protein, 27 aa, Mycobacterium tuberculosis
SALLSELPAVAWVWFQLFVDILGFNII

SEQ ID NO: 1377955 - protein, 30 aa, Mycobacterium tuberculosis; identical to SEQ ID NO: 158907

SEQ ID NO: 1377956 - protein, 19 aa, Mycobacterium tuberculosis
SAVRFREAFFRDHGIDSVA

SEQ ID NO: 1377957 - protein, 17 aa, Mycobacterium tuberculosis
SGLAALIRARFPTLTAR

SEQ ID NO: 1377958 - protein, 23 aa, Mycobacterium tuberculosis
SHELRTPLTTVRMAADLIYDHSA

SEQ ID NO: 1377959 - protein, 17 aa, Mycobacterium tuberculosis
SLVALHLAVQSLRLGEC

SEQ ID NO: 1377960 - protein, 17 aa, Mycobacterium tuberculosis
SNRKAGVVQKIIDWSTR

SEQ ID NO: 1377961 - protein, 19 aa, Mycobacterium tuberculosis
SPFESIWILALVVGIWLVV

SEQ ID NO: 1377962 - protein, 17 aa, Mycobacterium tuberculosis
SVAQEVVQWANTVTESC

SEQ ID NO: 1377963 - protein, 26 aa, Mycobacterium tuberculosis
SVGSLLRLSVLALIMLPILAAVTLCA

SEQ ID NO: 1377964 - protein, 24 aa, Mycobacterium tuberculosis
SVLPGPLVATVFDLVFQPGKLPDS

SEQ ID NO: 1377965 - protein, 22 aa, Mycobacterium tuberculosis
TASMTWEILWALILGFALSAVV

SEQ ID NO: 1377966 - protein, 20 aa, Mycobacterium tuberculosis
TIVPLPWVIQAPRLFAGQID

SEQ ID NO: 1377967 - protein, 28 aa, Mycobacterium tuberculosis
TPMVWVRPRQGPKLADLIAAPSTTRASG

SEQ ID NO: 1377968 - protein, 17 aa, Mycobacterium tuberculosis
TSVIRAFAATGMVVTAA

SEQ ID NO: 1377969 - protein, 17 aa, Mycobacterium tuberculosis
VAGAFVFSDLVMMKYLA

SEQ ID NO: 1377970 - protein, 21 aa, Mycobacterium tuberculosis
VAGRMPGHMNVLLAEAEVDYD

SEQ ID NO: 1377971 - protein, 21 aa, Mycobacterium tuberculosis
VASELLMPWPSAAASGVVGWR

SEQ ID NO: 1377972 - protein, 23 aa, Mycobacterium tuberculosis
VIPFLIISVLFYFTVVVQEKMLQ

SEQ ID NO: 1377973 - protein, 18 aa, Mycobacterium tuberculosis
VLLFTIIWWNVNHGRANW

SEQ ID NO: 1377974 - protein, 27 aa, Mycobacterium tuberculosis
VLNLLLVDFKGGATFLDLAGAPHVAAV

SEQ ID NO: 1377975 - protein, 20 aa, Mycobacterium tuberculosis
VQNAIPILGAFVTSSVVTHP

SEQ ID NO: 1377976 - protein, 23 aa, Mycobacterium tuberculosis
VQTEGFSGPALIIGTPTLSRVAN

SEQ ID NO: 1377977 - protein, 26 aa, Mycobacterium tuberculosis
VSDRNRAHWDWLKWLPHNQHPNACDA

SEQ ID NO: 1377978 - protein, 22 aa, Mycobacterium tuberculosis
VSLGVGIVGWFHRQPHDKPSPA

SEQ ID NO: 1377979 - protein, 22 aa, Mycobacterium tuberculosis
VSLPDCQGALYTSQDPVYAGTG

SEQ ID NO: 1377980 - protein, 18 aa, Mycobacterium tuberculosis
VSQPVAVAAPAKRSLLRT

SEQ ID NO: 1377981 - protein, 22 aa, Mycobacterium tuberculosis
VVTAGSLVVHWATMQELYGITD

SEQ ID NO: 1377982 - protein, 19 aa, Mycobacterium tuberculosis
WFREGTLPVPAERVGRLIL

SEQ ID NO: 1377983 - protein, 17 aa, Mycobacterium tuberculosis
WRFRRRPAPARLPLWAC

SEQ ID NO: 1377984 - protein, 19 aa, Mycobacterium tuberculosis
WYAAMLFAVVPLRTILPGS

SEQ ID NO: 1377985 - protein, 20 aa, Mycobacterium tuberculosis
YALVRLRDAAEAVGFYRGER

SEQ ID NO: 1377986 - protein, 24 aa, Mycobacterium tuberculosis
YAVRWPDPWPTTFGYHEFFHACTA

SEQ ID NO: 1377987 - protein, 22 aa, Mycobacterium tuberculosis
YEHYFRTFLRPEDVGWSVVEVV

SEQ ID NO: 1377988 - protein, 20 aa, Mycobacterium tuberculosis
YPQMLLRVGWAPINADPLPP

SEQ ID NO: 1377989 - protein, 20 aa, Mycobacterium tuberculosis
YSIGGILYAVRWPDPWPTTF

SEQ ID NO: 1377990 - protein, 17 aa, Mycobacterium tuberculosis
YWLESGAARPARRSVAE

SEQ ID NO: 1377991 - protein, 17 aa, Mycobacterium tuberculosis
AAGTYLGGWRIIRTLGK

SEQ ID NO: 1377992 - protein, 17 aa, Mycobacterium tuberculosis
AALTFNIPSGDRMAPGA

SEQ ID NO: 1377993 - protein, 17 aa, Mycobacterium tuberculosis
AEAVARFLSWVYATNPP

SEQ ID NO: 1377994 - protein, 17 aa, Mycobacterium tuberculosis
AGIPPGTLRRSATGVFA

SEQ ID NO: 1377995 - protein, 25 aa, Mycobacterium tuberculosis
AIALICAAAVFSAIALRDLRIPAIG

SEQ ID NO: 1377996 - protein, 20 aa, Mycobacterium tuberculosis
AITGTIAWPALAMFAIIFFW

SEQ ID NO: 1377997 - protein, 18 aa, Mycobacterium tuberculosis
ALASCASLAHFNYDDRKQ

SEQ ID NO: 1377998 - protein, 31 aa, Mycobacterium tuberculosis; identical to SEQ ID NO: 156181

SEQ ID NO: 1377999 - protein, 28 aa, Mycobacterium tuberculosis
ALVGVLCCIGSIVGIVFGAIAINQIKQT

SEQ ID NO: 1378000 - protein, 20 aa, Mycobacterium tuberculosis
ALWKGRRIGPLVAEELPVVI

SEQ ID NO: 1378001 - protein, 24 aa, Mycobacterium tuberculosis
APFGWYYDLLALWAHVSTASIWMR

SEQ ID NO: 1378002 - protein, 20 aa, Mycobacterium tuberculosis
APRLACAFVPTNAQRRATAK

SEQ ID NO: 1378003 - protein, 17 aa, Mycobacterium tuberculosis
AQAAFWSALSLPPLLLG

SEQ ID NO: 1378004 - protein, 30 aa, Mycobacterium tuberculosis
ASCQPGASHLGVWFGHFPGWIPLGAMVLPF

SEQ ID NO: 1378005 - protein, 22 aa, Mycobacterium tuberculosis
AVPTRNALALGLTLTVISFFWL

SEQ ID NO: 1378006 - protein, 28 aa, Mycobacterium tuberculosis
CALLGDRYGRRRSFVFGVTLFVVSSIVC

SEQ ID NO: 1378007 - protein, 23 aa, Mycobacterium tuberculosis
CQTHGAHVCSLCLSTDKQAEHVL

SEQ ID NO: 1378008 - protein, 22 aa, Mycobacterium tuberculosis
DGHRPLAVGFFFSLGHSTVVFG

SEQ ID NO: 1378009 - protein, 24 aa, Mycobacterium tuberculosis
DGSQTRLATWLAEPGHTATPAGSI

SEQ ID NO: 1378010 - protein, 25 aa, Mycobacterium tuberculosis
DLVRELVTILPIVLVIAAVAAYLLS

SEQ ID NO: 1378011 - protein, 17 aa, Mycobacterium tuberculosis
DPARLDSLFRLDHLAAR

SEQ ID NO: 1378012 - protein, 20 aa, Mycobacterium tuberculosis
DQPQSLWPRPARSTQPVQRS

SEQ ID NO: 1378013 - protein, 19 aa, Mycobacterium tuberculosis
DRPTPPWRPGAWAAAGVLA

SEQ ID NO: 1378014 - protein, 23 aa, Mycobacterium tuberculosis
EASRRIELHVGRDLQFIRINGTV

SEQ ID NO: 1378015 - protein, 19 aa, Mycobacterium tuberculosis
ENLPAVLPTVVAPPLTSRR

SEQ ID NO: 1378016 - protein, 20 aa, Mycobacterium tuberculosis
ESGAARPARRSVAEVHAAND

SEQ ID NO: 1378017 - protein, 21 aa, Mycobacterium tuberculosis
EVVLLLFLPAILYWESMNTSF

SEQ ID NO: 1378018 - protein, 19 aa, Mycobacterium tuberculosis
FFNFYLCDISLKVNGLQPG

SEQ ID NO: 1378019 - protein, 18 aa, Mycobacterium tuberculosis
FGSWPGWYAGVIELVAGL

SEQ ID NO: 1378020 - protein, 20 aa, Mycobacterium tuberculosis
FPGTILIPRLYALHILLLPG

SEQ ID NO: 1378021 - protein, 22 aa, Mycobacterium tuberculosis
FQTRAGLRFAAPLIAAGLRALF

SEQ ID NO: 1378022 - protein, 18 aa, Mycobacterium tuberculosis
FTVMIIVVFGQVRFHHTT

SEQ ID NO: 1378023 - protein, 41 aa, Mycobacterium tuberculosis
FVVVEAFYLFSCRSLTRSAWRLGMFANRWIILGVSAQAIAQ

SEQ ID NO: 1378024 - protein, 24 aa, Mycobacterium tuberculosis
GIAERLRPSGVIQREIAMRTVAVF

SEQ ID NO: 1378025 - protein, 23 aa, Mycobacterium tuberculosis
GISALCLIFIIMLIITRSVVAAA

SEQ ID NO: 1378026 - protein, 23 aa, Mycobacterium tuberculosis
GLETHLSYRMCLKTWSASESRNV

SEQ ID NO: 1378027 - protein, 24 aa, Mycobacterium tuberculosis
GNVFPRKISFLAAMRYYAGNWDTT

SEQ ID NO: 1378028 - protein, 19 aa, Mycobacterium tuberculosis
GPKRLGRVMAVVGIPMLLG

SEQ ID NO: 1378029 - protein, 21 aa, Mycobacterium tuberculosis
GPRLDALDVRRLVRRLLGRPD

SEQ ID NO: 1378030 - protein, 18 aa, Mycobacterium tuberculosis
GRALPAVLTRPSDDESVE

SEQ ID NO: 1378031 - protein, 23 aa, Mycobacterium tuberculosis
GRDRSGHIVAIFQAPAGKTVDDP

SEQ ID NO: 1378032 - protein, 17 aa, Mycobacterium tuberculosis
GSITGRDLFARRAGMPV

SEQ ID NO: 1378033 - protein, 31 aa, Mycobacterium tuberculosis
GTFVAFWACLTLLARPACDLAGMLTIAQQAR

SEQ ID NO: 1378034 - protein, 18 aa, Mycobacterium tuberculosis
GWAADRFGTRRLFMGSVL

SEQ ID NO: 1378035 - protein, 17 aa, Mycobacterium tuberculosis
HAAFKSLAFMAAGSVLA

SEQ ID NO: 1378036 - protein, 18 aa, Mycobacterium tuberculosis
HHSRWHFAVLYTFLSMVN

SEQ ID NO: 1378037 - protein, 29 aa, Mycobacterium tuberculosis
HNSSPPPPRWAWPPLIAVGAVGMVGMAVQ

SEQ ID NO: 1378038 - protein, 23 aa, Mycobacterium tuberculosis
HVSGLRAGQFVRAAGVEVGKVAK

SEQ ID NO: 1378039 - protein, 23 aa, Mycobacterium tuberculosis
IANRVSYFYDFHGPSVTIDTACS

SEQ ID NO: 1378040 - protein, 19 aa, Mycobacterium tuberculosis
IAPGVVTTWMKLAIRDRIL

SEQ ID NO: 1378041 - protein, 17 aa, Mycobacterium tuberculosis
IDHTVIGCSLVRGTPYR

SEQ ID NO: 1378042 - protein, 18 aa, Mycobacterium tuberculosis
IMRFLAIFGPVHYFAQPV

SEQ ID NO: 1378043 - protein, 17 aa, Mycobacterium tuberculosis
IRANPKATLGLTAMVVV

SEQ ID NO: 1378044 - protein, 24 aa, Mycobacterium tuberculosis
ITGFARIVLLAAILGAALASSFSV

SEQ ID NO: 1378045 - protein, 18 aa, Mycobacterium tuberculosis
IVLVIAAVAAYLLSRAAL

SEQ ID NO: 1378046 - protein, 18 aa, Mycobacterium tuberculosis
IYLTQRFIIAWRVWLTHH

SEQ ID NO: 1378047 - protein, 19 aa, Mycobacterium tuberculosis
KAVASWVANYGHEYYLDKA

SEQ ID NO: 1378048 - protein, 18 aa, Mycobacterium tuberculosis
KDFGGFGFHSVVIGTSGS

SEQ ID NO: 1378049 - protein, 19 aa, Mycobacterium tuberculosis
KDFGGFGFHSVVIGTSGSG

SEQ ID NO: 1378050 - protein, 20 aa, Mycobacterium tuberculosis
KDPFVRDGFQQVYSINTGQV

SEQ ID NO: 1378051 - protein, 17 aa, Mycobacterium tuberculosis
KRRARRDPLTVFLVLII

SEQ ID NO: 1378052 - protein, 22 aa, Mycobacterium tuberculosis
LAAPLLRPGYLLLRDAVSTPRS

SEQ ID NO: 1378053 - protein, 20 aa, Mycobacterium tuberculosis
LALGWWQWTRFQSTSGTFQN

SEQ ID NO: 1378054 - protein, 23 aa, Mycobacterium tuberculosis
LDKLPWQPPTVFLMRHGAHNSYT

SEQ ID NO: 1378055 - protein, 18 aa, Mycobacterium tuberculosis
LEPPIPQPAAAPIEHWAA

SEQ ID NO: 1378056 - protein, 26 aa, Mycobacterium tuberculosis
LGSALALAGVSAWLITRAWQMPPVLD

SEQ ID NO: 1378057 - protein, 17 aa, Mycobacterium tuberculosis
LHLRVGINTGDVISGLV

SEQ ID NO: 1378058 - protein, 32 aa, Mycobacterium tuberculosis
LIRTMALRGARCCFRRSPWRCRCRRLRCSRCT

SEQ ID NO: 1378059 - protein, 24 aa, Mycobacterium tuberculosis
LLGADRPLLHSSFGHLEGIQQPLI

SEQ ID NO: 1378060 - protein, 17 aa, Mycobacterium tuberculosis
LLRAMICQLAVWHSPEE

SEQ ID NO: 1378061 - protein, 17 aa, Mycobacterium tuberculosis
LMSCALLGDRYGRRRSF

SEQ ID NO: 1378062 - protein, 28 aa, Mycobacterium tuberculosis
LQTNRLLTRWARDYITVIGAIVLPILFM

SEQ ID NO: 1378063 - protein, 18 aa, Mycobacterium tuberculosis
LRPRLGVGAGAPAPAVVT

SEQ ID NO: 1378064 - protein, 26 aa, Mycobacterium tuberculosis
LSALSRAVAVAWRRSLQLRVVALTLG

SEQ ID NO: 1378065 - protein, 22 aa, Mycobacterium tuberculosis
LSLAGVVLMRWTPIDLLPQHRE

SEQ ID NO: 1378066 - protein, 20 aa, Mycobacterium tuberculosis
LSLTAAFGALVWIFQEGHFG

SEQ ID NO: 1378067 - protein, 17 aa, Mycobacterium tuberculosis
LTVEVGKALAALPTKVG

SEQ ID NO: 1378068 - protein, 25 aa, Mycobacterium tuberculosis
LVHAFSAPIAYLFRPYIVYRSREVA

SEQ ID NO: 1378069 - protein, 32 aa, Mycobacterium tuberculosis; identical to SEQ ID NO: 158052

SEQ ID NO: 1378070 - protein, 26 aa, Mycobacterium tuberculosis
LWGAVDRRWGRWAALVVTTVVFALAH

SEQ ID NO: 1378071 - protein, 22 aa, Mycobacterium tuberculosis
LWVLPLRWSMVEYFYIKYYLPR

SEQ ID NO: 1378072 - protein, 22 aa, Mycobacterium tuberculosis
MAMSACASGVYLVDVRPKLLEI

SEQ ID NO: 1378073 - protein, 18 aa, Mycobacterium tuberculosis
MDAFDYFLVVLVYADIAT

SEQ ID NO: 1378074 - protein, 24 aa, Mycobacterium tuberculosis
MKSAEAWAVGFVELITGLVNFEPW

SEQ ID NO: 1378075 - protein, 26 aa, Mycobacterium tuberculosis
MPVLLFCIAFGLSMDYEVFLVSRIRE

SEQ ID NO: 1378076 - protein, 26 aa, Mycobacterium tuberculosis
MQFGEGWWTSVWFLSFWVTGTSILLV

SEQ ID NO: 1378077 - protein, 19 aa, Mycobacterium tuberculosis
MSAREIVIIGIGAVSREEV

SEQ ID NO: 1378078 - protein, 36 aa, Mycobacterium tuberculosis; identical to SEQ ID NO: 158154

SEQ ID NO: 1378079 - protein, 22 aa, Mycobacterium tuberculosis
NAELLLLCFAAVITFAALLVVQ

SEQ ID NO: 1378080 - protein, 19 aa, Mycobacterium tuberculosis
NPRMKARAISNWMAIGMVG

SEQ ID NO: 1378081 - protein, 21 aa, Mycobacterium tuberculosis
PADLRLVRQTGLSVNESALTG

SEQ ID NO: 1378082 - protein, 19 aa, Mycobacterium tuberculosis
PFYPPGWFWIGGRAAALTG

SEQ ID NO: 1378083 - protein, 20 aa, Mycobacterium tuberculosis
PHLFDRDGVDFATDPPPPAL

SEQ ID NO: 1378084 - protein, 21 aa, Mycobacterium tuberculosis
PNSVRVWLMLGVLLLSVVLAV

SEQ ID NO: 1378085 - protein, 17 aa, Mycobacterium tuberculosis
PPMLGALLRDAEPAQAE

SEQ ID NO: 1378086 - protein, 17 aa, Mycobacterium tuberculosis
PQWGPPAGRVLATLLAE

SEQ ID NO: 1378087 - protein, 21 aa, Mycobacterium tuberculosis
PTGYECLAPHHFLLTEWFAPY

SEQ ID NO: 1378088 - protein, 21 aa, Mycobacterium tuberculosis
PVPRAWRMRITVQRVGDRVKV

SEQ ID NO: 1378089 - protein, 17 aa, Mycobacterium tuberculosis
QGFFKGTTCHRLTTSPM

SEQ ID NO: 1378090 - protein, 19 aa, Mycobacterium tuberculosis
RELIEITLVKNPAMRYRSG

SEQ ID NO: 1378091 - protein, 17 aa, Mycobacterium tuberculosis
RFQPGFEEADTRVQAAV

SEQ ID NO: 1378092 - protein, 17 aa, Mycobacterium tuberculosis
RFTDDELLRLAAAAEYP

SEQ ID NO: 1378093 - protein, 25 aa, Mycobacterium tuberculosis
RHTAYRWFREGTLPVPAERVGRLIL

SEQ ID NO: 1378094 - protein, 23 aa, Mycobacterium tuberculosis
RPGAADFCRIRVGVGSAPLATRL

SEQ ID NO: 1378095 - protein, 21 aa, Mycobacterium tuberculosis
RRFVAAIPECRANPVCSVAQE

SEQ ID NO: 1378096 - protein, 19 aa, Mycobacterium tuberculosis
RRIGPLVAEELPVVIRASE

SEQ ID NO: 1378097 - protein, 19 aa, Mycobacterium tuberculosis
RRMLLFGLVVVVALAVLLC

SEQ ID NO: 1378098 - protein, 18 aa, Mycobacterium tuberculosis
RRWLLLALVSTWGLRLSW

SEQ ID NO: 1378099 - protein, 19 aa, Mycobacterium tuberculosis
SNEDGRTAVALGIGAGIGA

SEQ ID NO: 1378100 - protein, 23 aa, Mycobacterium tuberculosis
SPRLTNLLVVAAWVAAAVIANLL

SEQ ID NO: 1378101 - protein, 21 aa, Mycobacterium tuberculosis
TASGDCRTWVGLTVVADDNLA

SEQ ID NO: 1378102 - protein, 19 aa, Mycobacterium tuberculosis
TELGRNLLLEQLHYRHEVL

SEQ ID NO: 1378103 - protein, 18 aa, Mycobacterium tuberculosis
TIGLFLMVVAGSLITSRR

SEQ ID NO: 1378104 - protein, 17 aa, Mycobacterium tuberculosis
TLAELAANHVIHTVLVA

SEQ ID NO: 1378105 - protein, 22 aa, Mycobacterium tuberculosis
TPTKWVHHFGLFAAVGAAMAAL

SEQ ID NO: 1378106 - protein, 19 aa, Mycobacterium tuberculosis
TRAERLNVVFLLAASQLVE

SEQ ID NO: 1378107 - protein, 22 aa, Mycobacterium tuberculosis
TRRFWRSSGVHIVRRPKTHLLA

SEQ ID NO: 1378108 - protein, 20 aa, Mycobacterium tuberculosis
TSCYGGALVRFRAEGRTITV

SEQ ID NO: 1378109 - protein, 23 aa, Mycobacterium tuberculosis
TVSLPDCQGALYTSQDPVYAGTG

SEQ ID NO: 1378110 - protein, 20 aa, Mycobacterium tuberculosis
VAPSHRWGLGAFLVVELVFL

SEQ ID NO: 1378111 - protein, 17 aa, Mycobacterium tuberculosis
VASAGLLVWFWPHLGKD

SEQ ID NO: 1378112 - protein, 18 aa, Mycobacterium tuberculosis
VASAGLLVWFWPHLGKDN

SEQ ID NO: 1378113 - protein, 21 aa, Mycobacterium tuberculosis
VAVTAGMMWSHIIAGAVVAVL

SEQ ID NO: 1378114 - protein, 24 aa, Mycobacterium tuberculosis
VGALVWAGSLVWYLQRVGSEPDFL

SEQ ID NO: 1378115 - protein, 23 aa, Mycobacterium tuberculosis
VGIWKAGMFHTLIAVAVILTVIR

SEQ ID NO: 1378116 - protein, 17 aa, Mycobacterium tuberculosis
VGPHLARALGQIVSRYG

SEQ ID NO: 1378117 - protein, 25 aa, Mycobacterium tuberculosis
VGSLLRLSVLALIMLPILAAVTLCA

SEQ ID NO: 1378118 - protein, 21 aa, Mycobacterium tuberculosis
VIASLEMQHLISLGPNAPSPS

SEQ ID NO: 1378119 - protein, 24 aa, Mycobacterium tuberculosis
VLASLRDLGCRALLMSGRPDEGAL

SEQ ID NO: 1378120 - protein, 35 aa, Mycobacterium tuberculosis; identical to SEQ ID NO: 159487

SEQ ID NO: 1378121 - protein, 20 aa, Mycobacterium tuberculosis
VRGAMVAAWDKLRGPNGKLG

SEQ ID NO: 1378122 - protein, 17 aa, Mycobacterium tuberculosis
WLRNFGPKIHYRASALL

SEQ ID NO: 1378123 - protein, 20 aa, Mycobacterium tuberculosis
WRPGAWACSLVVVAAWGSIL

SEQ ID NO: 1378124 - protein, 24 aa, Mycobacterium tuberculosis
YLLSRAALRPVDRIRAAAQTLTTT

SEQ ID NO: 1378125 - protein, 19 aa, Mycobacterium tuberculosis
YTAIWAAKRARGSPLRIMI

SEQ ID NO: 1378126 - protein, 18 aa, Mycobacterium tuberculosis
AALALRFTGRRLGIYTTI

SEQ ID NO: 1378127 - protein, 17 aa, Mycobacterium tuberculosis
AALWLVAPCTELYHDSR

SEQ ID NO: 1378128 - protein, 17 aa, Mycobacterium tuberculosis
AAPGWEADQVLALAATV

SEQ ID NO: 1378129 - protein, 20 aa, Mycobacterium tuberculosis
ACGVAVATVWFALRDTARAE

SEQ ID NO: 1378130 - protein, 20 aa, Mycobacterium tuberculosis
AEKLAALLTQPGRTYDVSSP

SEQ ID NO: 1378131 - protein, 24 aa, Mycobacterium tuberculosis
AELFVAAYVPYVAWLVQASADSAA

SEQ ID NO: 1378132 - protein, 18 aa, Mycobacterium tuberculosis
AFAIGRRIGRYNVVDVVW

SEQ ID NO: 1378133 - protein, 17 aa, Mycobacterium tuberculosis
AGGLGRLGDTAVTEPPG

SEQ ID NO: 1378134 - protein, 21 aa, Mycobacterium tuberculosis
AGTMRRFSWSGSAPVLDPLPR

SEQ ID NO: 1378135 - protein, 25 aa, Mycobacterium tuberculosis
AGYAKIVGCALGFPVINIARSSAKL

SEQ ID NO: 1378136 - protein, 24 aa, Mycobacterium tuberculosis
AIHLLASMTMVWLAVLLYVKIGQP

SEQ ID NO: 1378137 - protein, 17 aa, Mycobacterium tuberculosis
AISEVWLSLDAAGQWLF

SEQ ID NO: 1378138 - protein, 26 aa, Mycobacterium tuberculosis
ALKAAECRAGARAWRRHEPQLALHAD

SEQ ID NO: 1378139 - protein, 18 aa, Mycobacterium tuberculosis
ALVAFSIFLTRAHTSRTR

SEQ ID NO: 1378140 - protein, 20 aa, Mycobacterium tuberculosis
AMRYRSGGPFADAVAAVRAG

SEQ ID NO: 1378141 - protein, 21 aa, Mycobacterium tuberculosis
ASDPIAWWTPRLLFREPDWLR

SEQ ID NO: 1378142 - protein, 20 aa, Mycobacterium tuberculosis
AYFRMGWWSIIGYAAAAIIG

SEQ ID NO: 1378143 - protein, 18 aa, Mycobacterium tuberculosis
CAAAASALFGSWSLFHTP

SEQ ID NO: 1378144 - protein, 26 aa, Mycobacterium tuberculosis
CYLFTEFALRPVAAKALEAGRPPRRF

SEQ ID NO: 1378145 - protein, 24 aa, Mycobacterium tuberculosis
DASHELRTPLALLTTELELRCAGP

SEQ ID NO: 1378146 - protein, 31 aa, Mycobacterium tuberculosis
DKHGRPFRRRNPRPAIVVVAFLVVVTCVMWT

SEQ ID NO: 1378147 - protein, 27 aa, Mycobacterium tuberculosis
DNGLRPEPIIALGILLTWCSVERAVAT

SEQ ID NO: 1378148 - protein, 17 aa, Mycobacterium tuberculosis
DPKAIRPSYGMAEATVY

SEQ ID NO: 1378149 - protein, 18 aa, Mycobacterium tuberculosis
DRDIPFQISAVAARSVQG

SEQ ID NO: 1378150 - protein, 18 aa, Mycobacterium tuberculosis
DTAIAIKRAEVRRAAEIM

SEQ ID NO: 1378151 - protein, 18 aa, Mycobacterium tuberculosis
DYVRMWLQAAAVMGLYQA

SEQ ID NO: 1378152 - protein, 18 aa, Mycobacterium tuberculosis
EKLAALLTQPGRTYDVSS

SEQ ID NO: 1378153 - protein, 22 aa, Mycobacterium tuberculosis
ELRPEDKAHLVAQLRARQPTAM

SEQ ID NO: 1378154 - protein, 21 aa, Mycobacterium tuberculosis
ELSGLLGAVPGWAWQGPSAEW

SEQ ID NO: 1378155 - protein, 17 aa, Mycobacterium tuberculosis
EMRQWLRNWVGKAVGKA

SEQ ID NO: 1378156 - protein, 30 aa, Mycobacterium tuberculosis
ERGPRLGPPPVMPPSLAWWASSLQLSGLTA

SEQ ID NO: 1378157 - protein, 25 aa, Mycobacterium tuberculosis
ETVSVWFRSVWVLQPRGDLMAEAPL

SEQ ID NO: 1378158 - protein, 22 aa, Mycobacterium tuberculosis
FGSPRRTAAVIAYVQTWAMVAL

SEQ ID NO: 1378159 - protein, 17 aa, Mycobacterium tuberculosis
FLSHPITAFVLFVASPY

SEQ ID NO: 1378160 - protein, 17 aa, Mycobacterium tuberculosis
FQFLLGQEMHWSIPGLT

SEQ ID NO: 1378161 - protein, 18 aa, Mycobacterium tuberculosis
FRAAAVWLAGAVVGIVAS

SEQ ID NO: 1378162 - protein, 24 aa, Mycobacterium tuberculosis
FRKGANFTAAMAFEIGSTNLVVEL

SEQ ID NO: 1378163 - protein, 18 aa, Mycobacterium tuberculosis
FRPIAAGVVPEWLAYTVA

SEQ ID NO: 1378164 - protein, 26 aa, Mycobacterium tuberculosis
FVTRPVGSWFFGRFADRRGRRAALTF

SEQ ID NO: 1378165 - protein, 19 aa, Mycobacterium tuberculosis
GAAGSWIYTAFFAMLAAST

SEQ ID NO: 1378166 - protein, 19 aa, Mycobacterium tuberculosis
GAEAISIDGVRIGPNVTIR

SEQ ID NO: 1378167 - protein, 18 aa, Mycobacterium tuberculosis
GHVVSLAGVLAFVALVIV

SEQ ID NO: 1378168 - protein, 23 aa, Mycobacterium tuberculosis
GNRSERRIMLALLVPVLPFAFSY

SEQ ID NO: 1378169 - protein, 24 aa, Mycobacterium tuberculosis
GQPSKFSMPGPWVGIAAPGENIAS

SEQ ID NO: 1378170 - protein, 17 aa, Mycobacterium tuberculosis
GQRALLWAAGVLGALAI

SEQ ID NO: 1378171 - protein, 27 aa, Mycobacterium tuberculosis
GRYTYLKWWKFVLVVLGVWIGAGEVGL

SEQ ID NO: 1378172 - protein, 19 aa, Mycobacterium tuberculosis
GVGLLGMFGPVRVVHVGWL

SEQ ID NO: 1378173 - protein, 22 aa, Mycobacterium tuberculosis
GVLVGGLWAWIAPPIHAVVAIT

SEQ ID NO: 1378174 - protein, 26 aa, Mycobacterium tuberculosis
HKNVLRRRPRFRASIQSKLMVLLLLT

SEQ ID NO: 1378175 - protein, 19 aa, Mycobacterium tuberculosis
HNGGAWLVLLMIFNVIWTY

SEQ ID NO: 1378176 - protein, 21 aa, Mycobacterium tuberculosis
HPELFGMTALVAFSIFLTRAH

SEQ ID NO: 1378177 - protein, 20 aa, Mycobacterium tuberculosis
HPVTVWRKRLAVALDALQTT

SEQ ID NO: 1378178 - protein, 25 aa, Mycobacterium tuberculosis
HSHRRVVLIIYLWVGIVAFGAASSI

SEQ ID NO: 1378179 - protein, 18 aa, Mycobacterium tuberculosis
HVTFGYRPGVPVIQDVSL

SEQ ID NO: 1378180 - protein, 25 aa, Mycobacterium tuberculosis
IAEATRVGKRFLIIDLKRQKPLSFT

SEQ ID NO: 1378181 - protein, 19 aa, Mycobacterium tuberculosis
IAVVVFVVRYVLLVINRNT

SEQ ID NO: 1378182 - protein, 17 aa, Mycobacterium tuberculosis
IFRGDLFSSALINSIGI

SEQ ID NO: 1378183 - protein, 17 aa, Mycobacterium tuberculosis
IGLVGIYVSKVFIETKQ

SEQ ID NO: 1378184 - protein, 19 aa, Mycobacterium tuberculosis
IGTQLGAFVVFTLLVLAVI

SEQ ID NO: 1378185 - protein, 24 aa, Mycobacterium tuberculosis
IIPLAAWATRPGFRVAAILATLIV

SEQ ID NO: 1378186 - protein, 21 aa, Mycobacterium tuberculosis
ILHRRSRRFGVLPLVAPILAA

SEQ ID NO: 1378187 - protein, 23 aa, Mycobacterium tuberculosis
INPAECWPAVGGGVPSAYDLGTV

SEQ ID NO: 1378188 - protein, 22 aa, Mycobacterium tuberculosis
ISPARLTAWIAASALILLTGTE

SEQ ID NO: 1378189 - protein, 19 aa, Mycobacterium tuberculosis
ITGTIAWPALAMFAIIFFW

SEQ ID NO: 1378190 - protein, 17 aa, Mycobacterium tuberculosis
IVFQFLLGQEMHWSIPG

SEQ ID NO: 1378191 - protein, 17 aa, Mycobacterium tuberculosis
IVLLVRWLVARRAAAFM

SEQ ID NO: 1378192 - protein, 17 aa, Mycobacterium tuberculosis
KWKNCAGKTVTVTNKAK

SEQ ID NO: 1378193 - protein, 17 aa, Mycobacterium tuberculosis
LAGCLPAVLSLFRLVYG

SEQ ID NO: 1378194 - protein, 17 aa, Mycobacterium tuberculosis
LAILMLLPLSAFEATVA

SEQ ID NO: 1378195 - protein, 20 aa, Mycobacterium tuberculosis
LAILMLLPLSAFEATVALPA

SEQ ID NO: 1378196 - protein, 20 aa, Mycobacterium tuberculosis
LDAVAALTWQLPAEPGGGAA

SEQ ID NO: 1378197 - protein, 18 aa, Mycobacterium tuberculosis
LDRYGGGTARRLERTGTF

SEQ ID NO: 1378198 - protein, 24 aa, Mycobacterium tuberculosis
LFAIPCFLLLLILEWTAARKLESI

SEQ ID NO: 1378199 - protein, 17 aa, Mycobacterium tuberculosis
LIAIIVALWVSRTDGVV

SEQ ID NO: 1378200 - protein, 19 aa, Mycobacterium tuberculosis
LLACGWAFLIWGMYAYLWA

SEQ ID NO: 1378201 - protein, 18 aa, Mycobacterium tuberculosis
LLLDALAEREEVDFADPR

SEQ ID NO: 1378202 - protein, 17 aa, Mycobacterium tuberculosis
LMLFLDFVVHDRDIKWL

SEQ ID NO: 1378203 - protein, 17 aa, Mycobacterium tuberculosis
LPRGLDTVLGRGGVGLS

SEQ ID NO: 1378204 - protein, 24 aa, Mycobacterium tuberculosis
LTHPQHWNMYLAGWINDLVPGTAD

SEQ ID NO: 1378205 - protein, 24 aa, Mycobacterium tuberculosis
LTRYRPRVRVGFASRLADAAVIAT

SEQ ID NO: 1378206 - protein, 25 aa, Mycobacterium tuberculosis
LVAIGAGLIFPRFEQLLEKPFSRIP

SEQ ID NO: 1378207 - protein, 19 aa, Mycobacterium tuberculosis
LWIFSLSLKPTSTVKDGKL

SEQ ID NO: 1378208 - protein, 18 aa, Mycobacterium tuberculosis
LWVAFWFFLAQLNLILAA

SEQ ID NO: 1378209 - protein, 18 aa, Mycobacterium tuberculosis
LWVLPVHRASGLISRILA

SEQ ID NO: 1378210 - protein, 21 aa, Mycobacterium tuberculosis
MAAVSLARYWGAEVFVTASRA

SEQ ID NO: 1378211 - protein, 24 aa, Mycobacterium tuberculosis
MEFICSSIQAGSRLGYQESAELCA

SEQ ID NO: 1378212 - protein, 18 aa, Mycobacterium tuberculosis
MLDWPQRGQLGSVTAPLI

SEQ ID NO: 1378213 - protein, 19 aa, Mycobacterium tuberculosis
MRLRDMLWAAIFPSLDLAT

SEQ ID NO: 1378214 - protein, 17 aa, Mycobacterium tuberculosis
MRRSLQFGALTAEELMT

SEQ ID NO: 1378215 - protein, 17 aa, Mycobacterium tuberculosis
MVTSILILIAFPLLTAA

SEQ ID NO: 1378216 - protein, 18 aa, Mycobacterium tuberculosis
NIGVEAFTGFFAALANTR

SEQ ID NO: 1378217 - protein, 24 aa, Mycobacterium tuberculosis
NWIVRRLGIEPAEELRSARTPQEL

SEQ ID NO: 1378218 - protein, 20 aa, Mycobacterium tuberculosis
PADLRLVRQTGLSVNESALT

SEQ ID NO: 1378219 - protein, 18 aa, Mycobacterium tuberculosis
PASRMLRPYGPRPVVREL

SEQ ID NO: 1378220 - protein, 34 aa, Mycobacterium tuberculosis
PDARYGRPRLSRRARRRVAIALGVLVAAAGIVIA

SEQ ID NO: 1378221 - protein, 18 aa, Mycobacterium tuberculosis
PERLLQVLTGLLFLLFGL

SEQ ID NO: 1378222 - protein, 19 aa, Mycobacterium tuberculosis
PGLVVAAVWAVGLVAGLVA

SEQ ID NO: 1378223 - protein, 18 aa, Mycobacterium tuberculosis
PIADAVIFGTAFSAEDFK

SEQ ID NO: 1378224 - protein, 17 aa, Mycobacterium tuberculosis
PPCTTGFLPAQQRRIPT

SEQ ID NO: 1378225 - protein, 22 aa, Mycobacterium tuberculosis
PPRVESLGSLGAYQVDSSAAGA

SEQ ID NO: 1378226 - protein, 17 aa, Mycobacterium tuberculosis
PVGAYYGALPLIVGTLA

SEQ ID NO: 1378227 - protein, 20 aa, Mycobacterium tuberculosis
QFDALHFAKPIFGPAARALA

SEQ ID NO: 1378228 - protein, 22 aa, Mycobacterium tuberculosis
QLPCLPILFIVVDEFSELLSQH

SEQ ID NO: 1378229 - protein, 19 aa, Mycobacterium tuberculosis
QSLKLQWGVTGPDGRIQPL

SEQ ID NO: 1378230 - protein, 21 aa, Mycobacterium tuberculosis
RARKITWGELEKGRRRYLRDL

SEQ ID NO: 1378231 - protein, 20 aa, Mycobacterium tuberculosis
RFSAADKPVIFWTPDHGAFV

SEQ ID NO: 1378232 - protein, 24 aa, Mycobacterium tuberculosis
RIEGPPGLRRAVGRVVRLQPAKSQ

SEQ ID NO: 1378233 - protein, 19 aa, Mycobacterium tuberculosis
RKVLECYRTGMADAGVRFQ

SEQ ID NO: 1378234 - protein, 28 aa, Mycobacterium tuberculosis
RLPDLAAGLVCWLLLSREVLPRLGPAVE

SEQ ID NO: 1378235 - protein, 29 aa, Mycobacterium tuberculosis
RLPDLAAGLVCWLLLSREVLPRLGPAVEA

SEQ ID NO: 1378236 - protein, 21 aa, Mycobacterium tuberculosis
RLRSWALAVWHFVSNAPLTYA

SEQ ID NO: 1378237 - protein, 26 aa, Mycobacterium tuberculosis
RLVHAFSAPIAYLFRPYIVYRSREVA

SEQ ID NO: 1378238 - protein, 20 aa, Mycobacterium tuberculosis
RMQFATGVLIISMVTLVLGF

SEQ ID NO: 1378239 - protein, 18 aa, Mycobacterium tuberculosis
RPFAPRRLVRALLLPSGQ

SEQ ID NO: 1378240 - protein, 22 aa, Mycobacterium tuberculosis
RPHPYPRWLATAGAAGFALGVA

SEQ ID NO: 1378241 - protein, 17 aa, Mycobacterium tuberculosis
RRLTATAHRGARESSNI

SEQ ID NO: 1378242 - protein, 18 aa, Mycobacterium tuberculosis
RRRPWRGVLLTLAAVAVV

SEQ ID NO: 1378243 - protein, 21 aa, Mycobacterium tuberculosis
RRRTEVLAYAWLMPVSTVVQA

SEQ ID NO: 1378244 - protein, 20 aa, Mycobacterium tuberculosis
RTFADLLLRTEVRRVEPVQR

SEQ ID NO: 1378245 - protein, 19 aa, Mycobacterium tuberculosis
RWMQLLATSGRCFSAAPNF

SEQ ID NO: 1378246 - protein, 21 aa, Mycobacterium tuberculosis
RYAGIPRWGLTDHVDQAPVPA

SEQ ID NO: 1378247 - protein, 18 aa, Mycobacterium tuberculosis
SAPFPISALISGLVNAAL

SEQ ID NO: 1378248 - protein, 28 aa, Mycobacterium tuberculosis
SATLIGGFLLMWIMSWLTAAPVRVVRAA

SEQ ID NO: 1378249 - protein, 17 aa, Mycobacterium tuberculosis
SEPLPVRRPASVRRLPP

SEQ ID NO: 1378250 - protein, 20 aa, Mycobacterium tuberculosis
SLRLRKFGRYPLGCGTVGGP

SEQ ID NO: 1378251 - protein, 17 aa, Mycobacterium tuberculosis
SQMIYARLVMTLMEQQA

SEQ ID NO: 1378252 - protein, 18 aa, Mycobacterium tuberculosis
SQPSMIGQLVQWLLSVGG

SEQ ID NO: 1378253 - protein, 19 aa, Mycobacterium tuberculosis
SRAAAAAYCVADESIEAFR

SEQ ID NO: 1378254 - protein, 20 aa, Mycobacterium tuberculosis
SSRAAAAAYCVADESIEAFR

SEQ ID NO: 1378255 - protein, 22 aa, Mycobacterium tuberculosis
STWGLRLSWHMYRKTAGQGEDP

SEQ ID NO: 1378256 - protein, 22 aa, Mycobacterium tuberculosis
TDDLRPIPVFGSDELARLTEAF

SEQ ID NO: 1378257 - protein, 18 aa, Mycobacterium tuberculosis
TGILCSIGVLAVGLAALT

SEQ ID NO: 1378258 - protein, 32 aa, Mycobacterium tuberculosis; identical to SEQ ID NO: 159167

SEQ ID NO: 1378259 - protein, 38 aa, Mycobacterium tuberculosis
TISAICVLAILVLLRYLTPWGRQFWRITRAYFVGPNSV

SEQ ID NO: 1378260 - protein, 26 aa, Mycobacterium tuberculosis
TLSQRFSRRYTIVFCAALGLPIVPLF

SEQ ID NO: 1378261 - protein, 23 aa, Mycobacterium tuberculosis
TLTLADGRVVIWGTTDRCEEKAE

SEQ ID NO: 1378262 - protein, 22 aa, Mycobacterium tuberculosis
TLVLCVIALFATNVVLTTIGVR

SEQ ID NO: 1378263 - protein, 23 aa, Mycobacterium tuberculosis
TMPTESYTPWITRVLAAFIDWAP

SEQ ID NO: 1378264 - protein, 23 aa, Mycobacterium tuberculosis
TPPRLPPGFRWIAVRPGAAPPPR

SEQ ID NO: 1378265 - protein, 20 aa, Mycobacterium tuberculosis
TPTWCRHTAELVGPACQQVI

SEQ ID NO: 1378266 - protein, 18 aa, Mycobacterium tuberculosis
TSLEILFDADLEHRPALG

SEQ ID NO: 1378267 - protein, 18 aa, Mycobacterium tuberculosis
TVPGRYTYLKWWKFVLVV

SEQ ID NO: 1378268 - protein, 24 aa, Mycobacterium tuberculosis
VDNKLGYGLVDPVAALTFNIPSGD

SEQ ID NO: 1378269 - protein, 17 aa, Mycobacterium tuberculosis
VEPTGRVLARWQSSWLR

SEQ ID NO: 1378270 - protein, 26 aa, Mycobacterium tuberculosis
VERRPSRLRRGWLVGIAATLLALAGG

SEQ ID NO: 1378271 - protein, 19 aa, Mycobacterium tuberculosis
VGGFAVWFSLFFAMATDGC

SEQ ID NO: 1378272 - protein, 19 aa, Mycobacterium tuberculosis
VGGVTRLIPLTGLTTPWMS

SEQ ID NO: 1378273 - protein, 19 aa, Mycobacterium tuberculosis
VGVLLSMAPLWFSSYILQL

SEQ ID NO: 1378274 - protein, 22 aa, Mycobacterium tuberculosis
VLAVRLNVLFSYQGNDMYTALQ

SEQ ID NO: 1378275 - protein, 22 aa, Mycobacterium tuberculosis
VNVPGLVVAAVWAVGLVAGLVA

SEQ ID NO: 1378276 - protein, 19 aa, Mycobacterium tuberculosis
VRRWLLLALVSTWGLRLSW

SEQ ID NO: 1378277 - protein, 18 aa, Mycobacterium tuberculosis
VTAALRFGGMVGTSQAGE

SEQ ID NO: 1378278 - protein, 17 aa, Mycobacterium tuberculosis
WAPARIPYAIFGLPSHW

SEQ ID NO: 1378279 - protein, 25 aa, Mycobacterium tuberculosis
WILMSICTGLGRLASLVIAVLTGRR

SEQ ID NO: 1378280 - protein, 18 aa, Mycobacterium tuberculosis
WMQLLATSGRCFSAAPNF

SEQ ID NO: 1378281 - protein, 17 aa, Mycobacterium tuberculosis
WRTGPNSTPVILRCGLD

SEQ ID NO: 1378282 - protein, 18 aa, Mycobacterium tuberculosis
WSVLPIAFVLLISVGSAY

SEQ ID NO: 1378283 - protein, 17 aa, Mycobacterium tuberculosis
YALQWPLFAWFCVYAYR

SEQ ID NO: 1378284 - protein, 29 aa, Mycobacterium tuberculosis
YALQWPLFAWFCVYAYRNFVRYEETPPQP

SEQ ID NO: 1378285 - protein, 29 aa, Mycobacterium tuberculosis
ADALRTATLQRLRPRLGVGAGAPAPAVVT

SEQ ID NO: 1378286 - protein, 17 aa, Mycobacterium tuberculosis
ADRSWGQRIREYTKPLV

SEQ ID NO: 1378287 - protein, 17 aa, Mycobacterium tuberculosis
AEMLHRVVGGVGLKAFW

SEQ ID NO: 1378288 - protein, 18 aa, Mycobacterium tuberculosis
AFGLSVLIWQHFVGLQVH

SEQ ID NO: 1378289 - protein, 18 aa, Mycobacterium tuberculosis
AGDVLELMTPTGRFGTPL

SEQ ID NO: 1378290 - protein, 18 aa, Mycobacterium tuberculosis
AGLVGAVLVVVRPEVLII

SEQ ID NO: 1378291 - protein, 24 aa, Mycobacterium tuberculosis
AIAAPRRIIGFAVFVFIAAAVFGV

SEQ ID NO: 1378292 - protein, 20 aa, Mycobacterium tuberculosis
ALFALWPFTRLVHAFSAPIG

SEQ ID NO: 1378293 - protein, 24 aa, Mycobacterium tuberculosis
ALSRLPLLSIDGYRRLQVRSGHTL

SEQ ID NO: 1378294 - protein, 20 aa, Mycobacterium tuberculosis
ALVEPTILLAVFALSIPAGS

SEQ ID NO: 1378295 - protein, 26 aa, Mycobacterium tuberculosis
APAPPRRLRMLLSVAVVVLTLDIVTK

SEQ ID NO: 1378296 - protein, 18 aa, Mycobacterium tuberculosis
AREVLVALGQLAAAVVVA

SEQ ID NO: 1378297 - protein, 37 aa, Mycobacterium tuberculosis
ARRVAVWAFVMVLAFSRHLFVRPVIRMDQTAWCACHV

SEQ ID NO: 1378298 - protein, 17 aa, Mycobacterium tuberculosis
ARTAGDVVQIFAGNDVV

SEQ ID NO: 1378299 - protein, 20 aa, Mycobacterium tuberculosis
ARVLTKPRFRGWIHVYSAGT

SEQ ID NO: 1378300 - protein, 30 aa, Mycobacterium tuberculosis
ATAIRSGLAVPRPLPAVIADAAARTEPPEP

SEQ ID NO: 1378301 - protein, 17 aa, Mycobacterium tuberculosis
AVANLRQYGGAAARGLD

SEQ ID NO: 1378302 - protein, 21 aa, Mycobacterium tuberculosis
AVIVALHLVGWLTVTLLVEPA

SEQ ID NO: 1378303 - protein, 24 aa, Mycobacterium tuberculosis
AVMVLCGLVVWQIYRPGRDLVRTG

SEQ ID NO: 1378304 - protein, 21 aa, Mycobacterium tuberculosis
AVSMRGLLPVAGHWVSVLTGL

SEQ ID NO: 1378305 - protein, 18 aa, Mycobacterium tuberculosis
AVTLTASWQKIFSADPSV

SEQ ID NO: 1378306 - protein, 32 aa, Mycobacterium tuberculosis
AVVADARPGDLLYGLHAMMFNRSRVSDDQIVL

SEQ ID NO: 1378307 - protein, 22 aa, Mycobacterium tuberculosis
CHVAAFEFFDGVPARLVCDNLR

SEQ ID NO: 1378308 - protein, 24 aa, Mycobacterium tuberculosis
CPPDACPLVPFGVNYYIYPVMWGG

SEQ ID NO: 1378309 - protein, 20 aa, Mycobacterium tuberculosis
DDFWRPLRSFTYWERHCFDI

SEQ ID NO: 1378310 - protein, 19 aa, Mycobacterium tuberculosis
DDMARLAVSFNDMAESLSR

SEQ ID NO: 1378311 - protein, 21 aa, Mycobacterium tuberculosis
DDVFWSFLEALIITAIVMVSH

SEQ ID NO: 1378312 - protein, 24 aa, Mycobacterium tuberculosis
DGLGRYRVLAAPSRNGHDVIVTGL

SEQ ID NO: 1378313 - protein, 25 aa, Mycobacterium tuberculosis
DGRHPFLVMELIEGGTLRELLIERG

SEQ ID NO: 1378314 - protein, 33 aa, Mycobacterium tuberculosis; identical to SEQ ID NO: 160313

SEQ ID NO: 1378315 - protein, 27 aa, Mycobacterium tuberculosis
DMSPIPRIVSVSLAWAAAIGLMVPIGL

SEQ ID NO: 1378316 - protein, 21 aa, Mycobacterium tuberculosis
DQPLLTGWLVRRTLLVSTLLV

SEQ ID NO: 1378317 - protein, 19 aa, Mycobacterium tuberculosis
ENVHWTIWQLWLVVLLVAL

SEQ ID NO: 1378318 - protein, 22 aa, Mycobacterium tuberculosis
ETRSDVKAVRFLNRQQAYDDAI

SEQ ID NO: 1378319 - protein, 26 aa, Mycobacterium tuberculosis
FALRLAVGVGCGAIIGLERQWRARMA

SEQ ID NO: 1378320 - protein, 18 aa, Mycobacterium tuberculosis
FGLAVNMQAIVFMSAVMI

SEQ ID NO: 1378321 - protein, 25 aa, Mycobacterium tuberculosis
FGVSIPRAMFWTVLVYVFVATVISF

SEQ ID NO: 1378322 - protein, 19 aa, Mycobacterium tuberculosis
FLETRYWWAGIALASLGVI

SEQ ID NO: 1378323 - protein, 30 aa, Mycobacterium tuberculosis; identical to SEQ ID NO: 162323

SEQ ID NO: 1378324 - protein, 26 aa, Mycobacterium tuberculosis
FTANPKLPGAMLRDLAALRWLDAGES

SEQ ID NO: 1378325 - protein, 18 aa, Mycobacterium tuberculosis
FVVKAGAAGPFLGSTPFA

SEQ ID NO: 1378326 - protein, 23 aa, Mycobacterium tuberculosis
GAASLGLYVLFLFTQTVRHRDFF

SEQ ID NO: 1378327 - protein, 19 aa, Mycobacterium tuberculosis
GALHFLRITALSVVLLALG

SEQ ID NO: 1378328 - protein, 24 aa, Mycobacterium tuberculosis
GARFPELDVEAVLRRHPQVVLVDE

SEQ ID NO: 1378329 - protein, 22 aa, Mycobacterium tuberculosis
GCILLAGLVGMCSFQLGGTKRG

SEQ ID NO: 1378330 - protein, 26 aa, Mycobacterium tuberculosis
GDIFGLRRWYVITFLMGLFFVLGQAY

SEQ ID NO: 1378331 - protein, 21 aa, Mycobacterium tuberculosis
GDNGRAAWRVARNAGITDVRA

SEQ ID NO: 1378332 - protein, 27 aa, Mycobacterium tuberculosis
GELFIMGRIKDLLIVDGRNHYPDDIEA

SEQ ID NO: 1378333 - protein, 24 aa, Mycobacterium tuberculosis
GILTWIFVDGHFSKWLNFTPTPLT

SEQ ID NO: 1378334 - protein, 18 aa, Mycobacterium tuberculosis
GLGLRLELRLHDARDSNV

SEQ ID NO: 1378335 - protein, 22 aa, Mycobacterium tuberculosis
GLRPGEEKLVFSRFWRSDPSRV

SEQ ID NO: 1378336 - protein, 18 aa, Mycobacterium tuberculosis
GPLISALLNPGARNAAPL

SEQ ID NO: 1378337 - protein, 19 aa, Mycobacterium tuberculosis
GRGRVTLVLLAVVPVALAY

SEQ ID NO: 1378338 - protein, 21 aa, Mycobacterium tuberculosis
GSWRELLSRYLGTSIVLAGGV

SEQ ID NO: 1378339 - protein, 18 aa, Mycobacterium tuberculosis
GTALSWVKLSPIWHVFSF

SEQ ID NO: 1378340 - protein, 27 aa, Mycobacterium tuberculosis
HLVDTLSLFVGWLWPLWDSRRRTFADL

SEQ ID NO: 1378341 - protein, 23 aa, Mycobacterium tuberculosis
HTRAGGLVVAEWIRGGSLQEVAD

SEQ ID NO: 1378342 - protein, 24 aa, Mycobacterium tuberculosis
HTRAGGLVVAEWIRGGSLQEVADT

SEQ ID NO: 1378343 - protein, 17 aa, Mycobacterium tuberculosis
IAERFAEGHLSERMPVR

SEQ ID NO: 1378344 - protein, 19 aa, Mycobacterium tuberculosis
IAIVAMGGFFMMMKLIHRH

SEQ ID NO: 1378345 - protein, 26 aa, Mycobacterium tuberculosis
IDGYRRLQVRSGHTLFRQGERADHFF

SEQ ID NO: 1378346 - protein, 18 aa, Mycobacterium tuberculosis
IRSYFYWEKHCFDVPLCW

SEQ ID NO: 1378347 - protein, 19 aa, Mycobacterium tuberculosis
ITFTAAGLVALVGGGLFAS

SEQ ID NO: 1378348 - protein, 24 aa, Mycobacterium tuberculosis
IVIIKRALAPLRRVAQTASEVVDL

SEQ ID NO: 1378349 - protein, 22 aa, Mycobacterium tuberculosis
IWAEEAWGRYWGWDPKETVSFV

SEQ ID NO: 1378350 - protein, 21 aa, Mycobacterium tuberculosis
KLLVVFGISVLLTFYPGWVTI

SEQ ID NO: 1378351 - protein, 18 aa, Mycobacterium tuberculosis
LAATLAVVLSVVMIVVSG

SEQ ID NO: 1378352 - protein, 17 aa, Mycobacterium tuberculosis
LATAVLAIWLRFNMATE

SEQ ID NO: 1378353 - protein, 21 aa, Mycobacterium tuberculosis
LATRPATFLWLIAATGTLLVA

SEQ ID NO: 1378354 - protein, 37 aa, Mycobacterium tuberculosis
LAVIAVVVLGWYFLRIPSLVGIGRYTLYAELPRSGGL

SEQ ID NO: 1378355 - protein, 17 aa, Mycobacterium tuberculosis
LCIVFTALSSALCDQLG

SEQ ID NO: 1378356 - protein, 18 aa, Mycobacterium tuberculosis
LDHLAARLRRNSANLLVL

SEQ ID NO: 1378357 - protein, 23 aa, Mycobacterium tuberculosis
LGPRLDALDVRRLVRRLLGRPDP

SEQ ID NO: 1378358 - protein, 19 aa, Mycobacterium tuberculosis
LLLLCFAAVITFAALLVVQ

SEQ ID NO: 1378359 - protein, 18 aa, Mycobacterium tuberculosis
LLVEALDAMVLTAGADAS

SEQ ID NO: 1378360 - protein, 20 aa, Mycobacterium tuberculosis
LLWSGPGRWSLDRRLSKRAT

SEQ ID NO: 1378361 - protein, 23 aa, Mycobacterium tuberculosis
LNLPPRCTTGFLPAQQRRIPTFE

SEQ ID NO: 1378362 - protein, 18 aa, Mycobacterium tuberculosis
LPGSGLGLAIVKQVVLNH

SEQ ID NO: 1378363 - protein, 21 aa, Mycobacterium tuberculosis
LPKRLSCQLRPGPTPPATITV

SEQ ID NO: 1378364 - protein, 18 aa, Mycobacterium tuberculosis
LRKLAPRVQARNPVMLVV

SEQ ID NO: 1378365 - protein, 20 aa, Mycobacterium tuberculosis
LRLLVVSALATLSGLGTPVA

SEQ ID NO: 1378366 - protein, 21 aa, Mycobacterium tuberculosis
LSAAALWLLFANRMGYPVSTT

SEQ ID NO: 1378367 - protein, 23 aa, Mycobacterium tuberculosis
LSAGCGPGSLLVAAQQWQELSDQ

SEQ ID NO: 1378368 - protein, 19 aa, Mycobacterium tuberculosis
LSMAPLWFSSYILQLRVPT

SEQ ID NO: 1378369 - protein, 23 aa, Mycobacterium tuberculosis
LTELPVIMVIVALVTQWARQDRR

SEQ ID NO: 1378370 - protein, 17 aa, Mycobacterium tuberculosis
LTRTFIRFWTVSFPVVA

SEQ ID NO: 1378371 - protein, 23 aa, Mycobacterium tuberculosis
LYSVPWRLIGQRLHARTAGDVVQ

SEQ ID NO: 1378372 - protein, 18 aa, Mycobacterium tuberculosis
MAIRREAEQFVGIELSAT

SEQ ID NO: 1378373 - protein, 19 aa, Mycobacterium tuberculosis
MLHRVVGGVGLKAFWYHFA

SEQ ID NO: 1378374 - protein, 17 aa, Mycobacterium tuberculosis
MQHLISLGPNAPSPSQL

SEQ ID NO: 1378375 - protein, 23 aa, Mycobacterium tuberculosis
NFPDTNFAWSFVLALLAAALTAR

SEQ ID NO: 1378376 - protein, 23 aa, Mycobacterium tuberculosis
NVVQRRPFFAILRCLGVTREQLF

SEQ ID NO: 1378377 - protein, 19 aa, Mycobacterium tuberculosis
PAAAPIEHWAAGDADPLGN

SEQ ID NO: 1378378 - protein, 20 aa, Mycobacterium tuberculosis
PDMRAAVVSIDPHNGAVRAY

SEQ ID NO: 1378379 - protein, 26 aa, Mycobacterium tuberculosis
PELDSRWGYPTVIGGMVLICLFLYHV

SEQ ID NO: 1378380 - protein, 19 aa, Mycobacterium tuberculosis
PFLGRWLLLTAVAFGISAA

SEQ ID NO: 1378381 - protein, 21 aa, Mycobacterium tuberculosis
PKHFRCVSVDLLARRPVVHRQ

SEQ ID NO: 1378382 - protein, 21 aa, Mycobacterium tuberculosis
PQDAIRWAALVALVAIGAGLI

SEQ ID NO: 1378383 - protein, 22 aa, Mycobacterium tuberculosis
PRGDQLGGRRRPPGPPGPPGSS

SEQ ID NO: 1378384 - protein, 21 aa, Mycobacterium tuberculosis
PRSRTVRWSWDTGHVTAEPQP

SEQ ID NO: 1378385 - protein, 31 aa, Mycobacterium tuberculosis; identical to SEQ ID NO: 158446

SEQ ID NO: 1378386 - protein, 19 aa, Mycobacterium tuberculosis
PVPGDWLYFVTIDSQGTTL

SEQ ID NO: 1378387 - protein, 17 aa, Mycobacterium tuberculosis
PWRGPPIPYGTEVTDGR

SEQ ID NO: 1378388 - protein, 23 aa, Mycobacterium tuberculosis
QFSRGEGQLVAIIDTGVQPGPRL

SEQ ID NO: 1378389 - protein, 26 aa, Mycobacterium tuberculosis
QIRRRRRVAGGFALSLLVVVVVVAVV

SEQ ID NO: 1378390 - protein, 20 aa, Mycobacterium tuberculosis
QLINSIKWARDETGIIPTAG

SEQ ID NO: 1378391 - protein, 18 aa, Mycobacterium tuberculosis
QRCLRHVHIGFERTLQQD

SEQ ID NO: 1378392 - protein, 26 aa, Mycobacterium tuberculosis
QRSEALADDVARSFADAGLDSVLSAE

SEQ ID NO: 1378393 - protein, 20 aa, Mycobacterium tuberculosis
RASLREMLIPLVPAAVVALA

SEQ ID NO: 1378394 - protein, 17 aa, Mycobacterium tuberculosis
RGALFRAAAVWLAGAVV

SEQ ID NO: 1378395 - protein, 18 aa, Mycobacterium tuberculosis
RGPYRWMRHPNYVAVVAE

SEQ ID NO: 1378396 - protein, 26 aa, Mycobacterium tuberculosis
RLVHAFSAPIGYLFRPYIIYRSREEL

SEQ ID NO: 1378397 - protein, 21 aa, Mycobacterium tuberculosis
RSALPQSLRKLAPRVQARNPV

SEQ ID NO: 1378398 - protein, 18 aa, Mycobacterium tuberculosis
RTDLSMLLGLIFLLWSGP

SEQ ID NO: 1378399 - protein, 29 aa, Mycobacterium tuberculosis
RYTLYAELPRSGGLYRTANVTYRGITIGK

SEQ ID NO: 1378400 - protein, 21 aa, Mycobacterium tuberculosis
SNRAPNNWYGLFPNPVVAESL

SEQ ID NO: 1378401 - protein, 23 aa, Mycobacterium tuberculosis
SPRMRRVRIQGMLTVAILVTNVI

SEQ ID NO: 1378402 - protein, 27 aa, Mycobacterium tuberculosis
SRMWRRSGVRIVRRPTIHLVGSLIVLV

SEQ ID NO: 1378403 - protein, 21 aa, Mycobacterium tuberculosis
SSRAAAAAYCVADESIEAFRR

SEQ ID NO: 1378404 - protein, 20 aa, Mycobacterium tuberculosis
TAFSLLGLRQLYFLIDGLLD

SEQ ID NO: 1378405 - protein, 19 aa, Mycobacterium tuberculosis
TAILMLYTIVIIRGLRTAI

SEQ ID NO: 1378406 - protein, 20 aa, Mycobacterium tuberculosis
TELGRNLLLEQLHYRHEVLY

SEQ ID NO: 1378407 - protein, 33 aa, Mycobacterium tuberculosis; identical to SEQ ID NO: 159154

SEQ ID NO: 1378408 - protein, 26 aa, Mycobacterium tuberculosis
TGMGPGPLLAAARAWHALAAQYTEIA

SEQ ID NO: 1378409 - protein, 43 aa, Mycobacterium tuberculosis
TGMRLHHFGAFYKRSWRANDWMWGRLDGAGWLVHVLLDPRRVR

SEQ ID NO: 1378410 - protein, 17 aa, Mycobacterium tuberculosis
TKPLVLILDDFAMREHT

SEQ ID NO: 1378411 - protein, 21 aa, Mycobacterium tuberculosis
TLLNGVVLKFAMNSMNSTFAA

SEQ ID NO: 1378412 - protein, 19 aa, Mycobacterium tuberculosis
TPTKWVHHFGLFAAVGAAM

SEQ ID NO: 1378413 - protein, 22 aa, Mycobacterium tuberculosis
TQLHPPDGLHVFVTGPGATIVD

SEQ ID NO: 1378414 - protein, 18 aa, Mycobacterium tuberculosis
TRAERLNVVFLLAASQLV

SEQ ID NO: 1378415 - protein, 17 aa, Mycobacterium tuberculosis
VASFAQWVSGARPRTLP

SEQ ID NO: 1378416 - protein, 18 aa, Mycobacterium tuberculosis
VFGVLRWFFTTYRIDDEN

SEQ ID NO: 1378417 - protein, 17 aa, Mycobacterium tuberculosis
VGAGVWQGPSAELFVAA

SEQ ID NO: 1378418 - protein, 19 aa, Mycobacterium tuberculosis
VGTNPWRGPPIPYGTEVTD

SEQ ID NO: 1378419 - protein, 20 aa, Mycobacterium tuberculosis
VMLTAAEWTAVLINMNADNI

SEQ ID NO: 1378420 - protein, 18 aa, Mycobacterium tuberculosis
VNQHDRLRVPIGVTPDGT

SEQ ID NO: 1378421 - protein, 19 aa, Mycobacterium tuberculosis
VTRSGWWTHSLRGVLPEQF

SEQ ID NO: 1378422 - protein, 26 aa, Mycobacterium tuberculosis
WFFGAGAWAASVVWFAVLGFSAGRLQ

SEQ ID NO: 1378423 - protein, 17 aa, Mycobacterium tuberculosis
WPVMANFAVDSAMAVAL

SEQ ID NO: 1378424 - protein, 27 aa, Mycobacterium tuberculosis
YAPLWRTAWRRLRQRPFQYILLVLGIA

SEQ ID NO: 1378425 - protein, 20 aa, Mycobacterium tuberculosis
AAFCYAAAVVTELGGPMSHA

SEQ ID NO: 1378426 - protein, 24 aa, Mycobacterium tuberculosis
AAHRFRFVLDHGLQLGRFDRVIAL

SEQ ID NO: 1378427 - protein, 22 aa, Mycobacterium tuberculosis
AAPEVLAGQGFDGRADLYSLGC

SEQ ID NO: 1378428 - protein, 18 aa, Mycobacterium tuberculosis
AARLKREALAMAPAEDEN

SEQ ID NO: 1378429 - protein, 20 aa, Mycobacterium tuberculosis
ADRPTPPWRPGAWAAAGVLA

SEQ ID NO: 1378430 - protein, 25 aa, Mycobacterium tuberculosis
AEAPTLAGHALRFDEFGNIITDSAV

SEQ ID NO: 1378431 - protein, 25 aa, Mycobacterium tuberculosis
AFGLSVLIWQHFVGLQVHWTIVAMS

SEQ ID NO: 1378432 - protein, 20 aa, Mycobacterium tuberculosis
AGITMFGPWGIIIGPVLMIL

SEQ ID NO: 1378433 - protein, 17 aa, Mycobacterium tuberculosis
AHLLQPLVMGRAVSIHP

SEQ ID NO: 1378434 - protein, 17 aa, Mycobacterium tuberculosis
AIALRDLRIPAIGLVLL

SEQ ID NO: 1378435 - protein, 18 aa, Mycobacterium tuberculosis
AKNIEVVQGYALTESCGG

SEQ ID NO: 1378436 - protein, 26 aa, Mycobacterium tuberculosis
AKRARGSPLRIMILLVLVSALASALL

SEQ ID NO: 1378437 - protein, 17 aa, Mycobacterium tuberculosis
AKRLPRRALTVLRGESL

SEQ ID NO: 1378438 - protein, 18 aa, Mycobacterium tuberculosis
ALLAILAVVPWRQFASGE

SEQ ID NO: 1378439 - protein, 22 aa, Mycobacterium tuberculosis
ALRIRTRLVADVAVPLVNIRAV

SEQ ID NO: 1378440 - protein, 35 aa, Mycobacterium tuberculosis
ALSRLPLLSIDGYRRLQVRSGYTLFRQGERADHFF

SEQ ID NO: 1378441 - protein, 23 aa, Mycobacterium tuberculosis
AMKRIGKVFHEFDSDSAAMIVLE

SEQ ID NO: 1378442 - protein, 20 aa, Mycobacterium tuberculosis
ANAILRLVGVQPKDELDIAV

SEQ ID NO: 1378443 - protein, 19 aa, Mycobacterium tuberculosis
APLWITFVAGPAYTVIGMA

SEQ ID NO: 1378444 - protein, 17 aa, Mycobacterium tuberculosis
ARAALDAVRARIRSRRL

SEQ ID NO: 1378445 - protein, 17 aa, Mycobacterium tuberculosis
ARHDLVLEAFTAVHAAF

SEQ ID NO: 1378446 - protein, 24 aa, Mycobacterium tuberculosis
ATTVLACAVAMGFWMGSGAQFGLG

SEQ ID NO: 1378447 - protein, 39 aa, Mycobacterium tuberculosis; identical to SEQ ID NO: 160288

SEQ ID NO: 1378448 - protein, 25 aa, Mycobacterium tuberculosis
ATYCLSFARLTLFHTMGPPLAIGML

SEQ ID NO: 1378449 - protein, 19 aa, Mycobacterium tuberculosis
AVACVYTVIYLAARDLPPA

SEQ ID NO: 1378450 - protein, 21 aa, Mycobacterium tuberculosis
AVVVLLGWSFFYFSDDTRGYK

SEQ ID NO: 1378451 - protein, 17 aa, Mycobacterium tuberculosis
AWWLFEALRHPVRSRLA

SEQ ID NO: 1378452 - protein, 25 aa, Mycobacterium tuberculosis
AYAPEEIFLVLSVAGLAAYSMAPLI

SEQ ID NO: 1378453 - protein, 29 aa, Mycobacterium tuberculosis
AYWLGAQWWHPLVVVGLIALVAIMIAAAN

SEQ ID NO: 1378454 - protein, 24 aa, Mycobacterium tuberculosis
CYMLTEFALRPVAAQALEAGLPPG

SEQ ID NO: 1378455 - protein, 24 aa, Mycobacterium tuberculosis
DATMLQMLIIFGIVTVIALVAATT

SEQ ID NO: 1378456 - protein, 22 aa, Mycobacterium tuberculosis
DFLCPACGIFERGFGPTVSKLV

SEQ ID NO: 1378457 - protein, 17 aa, Mycobacterium tuberculosis
DGLPRLATADIQVGDVL

SEQ ID NO: 1378458 - protein, 23 aa, Mycobacterium tuberculosis
DGRHPFLVMELIEGGTLRELLIE

SEQ ID NO: 1378459 - protein, 18 aa, Mycobacterium tuberculosis
DHLYIAGRIKDLVIIDGR

SEQ ID NO: 1378460 - protein, 24 aa, Mycobacterium tuberculosis
DLQFKGPAANIWADYTAAHIGTQT

SEQ ID NO: 1378461 - protein, 26 aa, Mycobacterium tuberculosis
DMFWSLAPLVVGCILLAGLVGMCSFQ

SEQ ID NO: 1378462 - protein, 18 aa, Mycobacterium tuberculosis
DRGGRFIGYLHIKDVLTL

SEQ ID NO: 1378463 - protein, 24 aa, Mycobacterium tuberculosis
DRSRIEFAITILLLVILLIIYRNP

SEQ ID NO: 1378464 - protein, 22 aa, Mycobacterium tuberculosis
EAGLPPGRFALGIIGRTMVVWL

SEQ ID NO: 1378465 - protein, 18 aa, Mycobacterium tuberculosis
EIGVPIFFVLSGFLLFRP

SEQ ID NO: 1378466 - protein, 17 aa, Mycobacterium tuberculosis
ERLLQVLTGLLFLLFGL

SEQ ID NO: 1378467 - protein, 22 aa, Mycobacterium tuberculosis
FADPGNPLAILVPLTAAAMDLV

SEQ ID NO: 1378468 - protein, 18 aa, Mycobacterium tuberculosis
FAPRGAGEGRLIRALTTA

SEQ ID NO: 1378469 - protein, 17 aa, Mycobacterium tuberculosis
FAVLAVIAVVLYYVMLT

SEQ ID NO: 1378470 - protein, 24 aa, Mycobacterium tuberculosis
FDEDELRSAVSFFAEDAHIFATTV

SEQ ID NO: 1378471 - protein, 26 aa, Mycobacterium tuberculosis
FGVSIPRAMFWTVLVYVFVATVISFI

SEQ ID NO: 1378472 - protein, 19 aa, Mycobacterium tuberculosis
FKALFLGFMFAFAIKAPLW

SEQ ID NO: 1378473 - protein, 19 aa, Mycobacterium tuberculosis
FNFGFGSLVWVYAAESFPS

SEQ ID NO: 1378474 - protein, 19 aa, Mycobacterium tuberculosis
FRGPPSWNVGYKSIRSHNV

SEQ ID NO: 1378475 - protein, 21 aa, Mycobacterium tuberculosis
FSGQSALNWAQRTTRTSELGN

SEQ ID NO: 1378476 - protein, 17 aa, Mycobacterium tuberculosis
FSKQLINSIKWARDETG

SEQ ID NO: 1378477 - protein, 22 aa, Mycobacterium tuberculosis
FSRHLFVRPVIRMDQTAWCACH

SEQ ID NO: 1378478 - protein, 22 aa, Mycobacterium tuberculosis
FVVGELAALVMFSGAIDRRLDE

SEQ ID NO: 1378479 - protein, 18 aa, Mycobacterium tuberculosis
GGALWWCVARRSWHAPRL

SEQ ID NO: 1378480 - protein, 20 aa, Mycobacterium tuberculosis
GGGVKRCLGANFSMRELITV

SEQ ID NO: 1378481 - protein, 18 aa, Mycobacterium tuberculosis
GIVSEIFPVFSRKPIFGY

SEQ ID NO: 1378482 - protein, 20 aa, Mycobacterium tuberculosis
GMGEVYLARHPRLPRQDALK

SEQ ID NO: 1378483 - protein, 20 aa, Mycobacterium tuberculosis
GNWLKARIGVGTTTYSSTAQ

SEQ ID NO: 1378484 - protein, 23 aa, Mycobacterium tuberculosis
GPDRIAAMLSEVVGLLAAGVLAR

SEQ ID NO: 1378485 - protein, 18 aa, Mycobacterium tuberculosis
GPLSWFFHHLPKPLHRIE

SEQ ID NO: 1378486 - protein, 24 aa, Mycobacterium tuberculosis
GQVPPDDRLTAILPPVTDDRSAPH

SEQ ID NO: 1378487 - protein, 20 aa, Mycobacterium tuberculosis
GRLHIVIGVIMLLLAARMVA

SEQ ID NO: 1378488 - protein, 18 aa, Mycobacterium tuberculosis
GSKTPWLILAGLAVLGVI

SEQ ID NO: 1378489 - protein, 17 aa, Mycobacterium tuberculosis
GSLGRLVVELEPDADSD

SEQ ID NO: 1378490 - protein, 22 aa, Mycobacterium tuberculosis
GTLPATVFVAFQLMFAIITVAL

SEQ ID NO: 1378491 - protein, 17 aa, Mycobacterium tuberculosis
GYLFYWAIIGIDPGPRR

SEQ ID NO: 1378492 - protein, 18 aa, Mycobacterium tuberculosis
HAAFKSLAFMAAGSVLAA

SEQ ID NO: 1378493 - protein, 19 aa, Mycobacterium tuberculosis
HRGSTGFARPWAIPLVTTG

SEQ ID NO: 1378494 - protein, 19 aa, Mycobacterium tuberculosis
HRYAIWIVGVWALAAIIGN

SEQ ID NO: 1378495 - protein, 17 aa, Mycobacterium tuberculosis
HVVKLLNRFFAIVVNEV

SEQ ID NO: 1378496 - protein, 23 aa, Mycobacterium tuberculosis
HWSLPGLSFILLVAIGADYNMLL

SEQ ID NO: 1378497 - protein, 18 aa, Mycobacterium tuberculosis
IDEPRPITSMPGVVQHTR

SEQ ID NO: 1378498 - protein, 22 aa, Mycobacterium tuberculosis
IGGPRRKGRIISEQEKKITAYH

SEQ ID NO: 1378499 - protein, 17 aa, Mycobacterium tuberculosis
IMRFLAIFGPVHYFAQP

SEQ ID NO: 1378500 - protein, 17 aa, Mycobacterium tuberculosis
IQLLRTAVVVGLVLLQT

SEQ ID NO: 1378501 - protein, 20 aa, Mycobacterium tuberculosis
IRSYFYWEKHCYDIPSCWAL

SEQ ID NO: 1378502 - protein, 21 aa, Mycobacterium tuberculosis
ISHMLPLFRRMQSLIDGINRV

SEQ ID NO: 1378503 - protein, 24 aa, Mycobacterium tuberculosis
ITDLPDGRWSEFLEEPRLAARVAG

SEQ ID NO: 1378504 - protein, 19 aa, Mycobacterium tuberculosis
IVDDIRAAIAVGHGVTVRD

SEQ ID NO: 1378505 - protein, 18 aa, Mycobacterium tuberculosis
IVLLVRWLVARRAAAFMH

SEQ ID NO: 1378506 - protein, 31 aa, Mycobacterium tuberculosis
IWRRCGGRTVTLFRSEWRRPVELSTSVPEVV

SEQ ID NO: 1378507 - protein, 25 aa, Mycobacterium tuberculosis
IYNYTWLVLMLPFGMIGVTVLTVVM

SEQ ID NO: 1378508 - protein, 19 aa, Mycobacterium tuberculosis
KARFVPGNENFQMGAYLKS

SEQ ID NO: 1378509 - protein, 17 aa, Mycobacterium tuberculosis
KLGLHIPLWAGYACSTL

SEQ ID NO: 1378510 - protein, 24 aa, Mycobacterium tuberculosis
KPKARSVNPIAFVYNYLKQVVAEM

SEQ ID NO: 1378511 - protein, 18 aa, Mycobacterium tuberculosis
KRAEVRRAAEIMWAEHQL

SEQ ID NO: 1378512 - protein, 22 aa, Mycobacterium tuberculosis
KVVYRRGFVTRHQVTGWRFVMR

SEQ ID NO: 1378513 - protein, 17 aa, Mycobacterium tuberculosis
LAMVFPVIGAFPFTGRM

SEQ ID NO: 1378514 - protein, 17 aa, Mycobacterium tuberculosis
LAQRAVQVLRRLYDRVG

SEQ ID NO: 1378515 - protein, 20 aa, Mycobacterium tuberculosis
LAYRTRPVFVPDADNDPVAR

SEQ ID NO: 1378516 - protein, 17 aa, Mycobacterium tuberculosis
LCEMAPGTPIWRLVLPF

SEQ ID NO: 1378517 - protein, 19 aa, Mycobacterium tuberculosis
LCVIMAWVSPATVFVFLLN

SEQ ID NO: 1378518 - protein, 17 aa, Mycobacterium tuberculosis
LDGLRPYFTGYLPTLLL

SEQ ID NO: 1378519 - protein, 25 aa, Mycobacterium tuberculosis
LEFPGKRLLIGAALLITMFPSISLV

SEQ ID NO: 1378520 - protein, 24 aa, Mycobacterium tuberculosis
LEPPYRGGPVLADNAVIPVERTQV

SEQ ID NO: 1378521 - protein, 21 aa, Mycobacterium tuberculosis
LGIALTLSRLVAGLTPGLAAS

SEQ ID NO: 1378522 - protein, 26 aa, Mycobacterium tuberculosis
LGIARRAGAPISFWEFTRKGAVVTAV

SEQ ID NO: 1378523 - protein, 21 aa, Mycobacterium tuberculosis
LIAKVCVYTVLAVVQSAIVTV

SEQ ID NO: 1378524 - protein, 24 aa, Mycobacterium tuberculosis
LILLWGSAGALGFVEQDLGFKIIF

SEQ ID NO: 1378525 - protein, 18 aa, Mycobacterium tuberculosis
LIVSRQWKLLGAYAAAGL

SEQ ID NO: 1378526 - protein, 30 aa, Mycobacterium tuberculosis
LIWQHILHMPLHWLVLPMAIIVMLAVGSDY

SEQ ID NO: 1378527 - protein, 17 aa, Mycobacterium tuberculosis
LKALGRMESKPLRRGHK

SEQ ID NO: 1378528 - protein, 27 aa, Mycobacterium tuberculosis
LLDSSRLAAGVIRPQLRRAYLEEAVQR

SEQ ID NO: 1378529 - protein, 36 aa, Mycobacterium tuberculosis; identical to SEQ ID NO: 157830

SEQ ID NO: 1378530 - protein, 27 aa, Mycobacterium tuberculosis
LLVVPGDCWLDWGMNIGRHCFSDYAMV

SEQ ID NO: 1378531 - protein, 24 aa, Mycobacterium tuberculosis
LMYGEIFTITAIVCVFGAVLGLLI

SEQ ID NO: 1378532 - protein, 29 aa, Mycobacterium tuberculosis
LNSLPMLAALAWVCADAILLVRTGNHRYA

SEQ ID NO: 1378533 - protein, 22 aa, Mycobacterium tuberculosis
LRYFPDLVVVLALLAAVALQAP

SEQ ID NO: 1378534 - protein, 18 aa, Mycobacterium tuberculosis
LTAHAGSVGSLLRLSVLA

SEQ ID NO: 1378535 - protein, 18 aa, Mycobacterium tuberculosis
LTNQARRLLAWVGADENV

SEQ ID NO: 1378536 - protein, 36 aa, Mycobacterium tuberculosis; identical to SEQ ID NO: 158036

SEQ ID NO: 1378537 - protein, 24 aa, Mycobacterium tuberculosis
LVKRGWMVLVAVAVVAVAGFSVYR

SEQ ID NO: 1378538 - protein, 18 aa, Mycobacterium tuberculosis
LVPAPARLRRLWLAVLIV

SEQ ID NO: 1378539 - protein, 18 aa, Mycobacterium tuberculosis
MGEVYLARHPRLPRQDAL

SEQ ID NO: 1378540 - protein, 30 aa, Mycobacterium tuberculosis; identical to SEQ ID NO: 158144

SEQ ID NO: 1378541 - protein, 17 aa, Mycobacterium tuberculosis
MTYVRDSFWKGREFDSL

SEQ ID NO: 1378542 - protein, 23 aa, Mycobacterium tuberculosis
NAELLLLCFAAVITFAALLVVQA

SEQ ID NO: 1378543 - protein, 23 aa, Mycobacterium tuberculosis
NALRYAPDCVVRVNAGRVRERVL

SEQ ID NO: 1378544 - protein, 19 aa, Mycobacterium tuberculosis
NAVVAFAVIGFASLAVAVA

SEQ ID NO: 1378545 - protein, 23 aa, Mycobacterium tuberculosis
NQNRIRWGNLLTLPVAQGGLLYV

SEQ ID NO: 1378546 - protein, 17 aa, Mycobacterium tuberculosis
NRKEFGPALSKLNLVLA

SEQ ID NO: 1378547 - protein, 18 aa, Mycobacterium tuberculosis
NSLYRASLAIGLALLPLL

SEQ ID NO: 1378548 - protein, 23 aa, Mycobacterium tuberculosis
NTQPGWVVAPGMQGVQVGPITQG

SEQ ID NO: 1378549 - protein, 23 aa, Mycobacterium tuberculosis
NYAELRHRIGFVPQDDILHTPLT

SEQ ID NO: 1378550 - protein, 24 aa, Mycobacterium tuberculosis
NYPPPCLTGFLPASEWRSPADTSP

SEQ ID NO: 1378551 - protein, 24 aa, Mycobacterium tuberculosis
PALTRSGAEWMPNFIELLQRKLSR

SEQ ID NO: 1378552 - protein, 25 aa, Mycobacterium tuberculosis
PALTRSGAEWMPNFIELLQRKLSRI

SEQ ID NO: 1378553 - protein, 25 aa, Mycobacterium tuberculosis
PATLLLLRYRWLRSEPLPVRRPASV

SEQ ID NO: 1378554 - protein, 30 aa, Mycobacterium tuberculosis; identical to SEQ ID NO: 158236

SEQ ID NO: 1378555 - protein, 19 aa, Mycobacterium tuberculosis
PKVGPWALYGLLFTIVILF

SEQ ID NO: 1378556 - protein, 26 aa, Mycobacterium tuberculosis
PLMSHLAARGWVCVSLNYRVSPRHTW

SEQ ID NO: 1378557 - protein, 26 aa, Mycobacterium tuberculosis
PMIKPAIVVALLFRTLDAFRIFDNIY

SEQ ID NO: 1378558 - protein, 17 aa, Mycobacterium tuberculosis
PPARSGPEVLVRTPDGT

SEQ ID NO: 1378559 - protein, 20 aa, Mycobacterium tuberculosis
PSLRVQRVIAAIVILTQGGI

SEQ ID NO: 1378560 - protein, 21 aa, Mycobacterium tuberculosis
PVIGCAAALVFGGLPALAFPA

SEQ ID NO: 1378561 - protein, 22 aa, Mycobacterium tuberculosis
PVPRAWRMRITVQRVGDRVKVS

SEQ ID NO: 1378562 - protein, 30 aa, Mycobacterium tuberculosis; identical to SEQ ID NO: 158463

SEQ ID NO: 1378563 - protein, 18 aa, Mycobacterium tuberculosis
PWTPRIATQLSVLACAAF

SEQ ID NO: 1378564 - protein, 22 aa, Mycobacterium tuberculosis
QEAALTWLLLVSVPILAVANYW

SEQ ID NO: 1378565 - protein, 23 aa, Mycobacterium tuberculosis
QMQVGSLIAFLSYFAQILMAVLM

SEQ ID NO: 1378566 - protein, 18 aa, Mycobacterium tuberculosis
QPQSLWPRPARSTQPVQR

SEQ ID NO: 1378567 - protein, 27 aa, Mycobacterium tuberculosis
QRFWRITLPMLRPTMFFVLVTGIISAA

SEQ ID NO: 1378568 - protein, 21 aa, Mycobacterium tuberculosis
QVLDTTLPWSYTITTTLPAVF

SEQ ID NO: 1378569 - protein, 17 aa, Mycobacterium tuberculosis
RAALTFSVSLMAACSLI

SEQ ID NO: 1378570 - protein, 25 aa, Mycobacterium tuberculosis
RALEYLKITYGWSLLLIVTFTVLYF

SEQ ID NO: 1378571 - protein, 18 aa, Mycobacterium tuberculosis
RAPFSTWAVVAVVVVPAV

SEQ ID NO: 1378572 - protein, 30 aa, Mycobacterium tuberculosis
RCVGALALVCAACWLIALLAGDYRHAQWAV

SEQ ID NO: 1378573 - protein, 18 aa, Mycobacterium tuberculosis
RERSCQLVAVPADPRPKR

SEQ ID NO: 1378574 - protein, 18 aa, Mycobacterium tuberculosis
RFPVVDRGGRFIGYLHIK

SEQ ID NO: 1378575 - protein, 17 aa, Mycobacterium tuberculosis
RFRGHFWLATIVVLTIQ

SEQ ID NO: 1378576 - protein, 24 aa, Mycobacterium tuberculosis
RGLPRAVAVTLVLLSGFAVLGGIL

SEQ ID NO: 1378577 - protein, 20 aa, Mycobacterium tuberculosis
RGNSWPVGRLIAWLTGCAAL

SEQ ID NO: 1378578 - protein, 24 aa, Mycobacterium tuberculosis
RHAILRRTGNRWELSDNASANGTY

SEQ ID NO: 1378579 - protein, 25 aa, Mycobacterium tuberculosis
RHLVLPMFVADGIDEPRPITSMPGV

SEQ ID NO: 1378580 - protein, 18 aa, Mycobacterium tuberculosis
RIAERVYPSPLPDEPLKI

SEQ ID NO: 1378581 - protein, 26 aa, Mycobacterium tuberculosis
RIATQLSVLACAAFIYVTAEILPVGA

SEQ ID NO: 1378582 - protein, 20 aa, Mycobacterium tuberculosis
RILIMIALGVIVLLLAGPRL

SEQ ID NO: 1378583 - protein, 19 aa, Mycobacterium tuberculosis
RIRELERPLADVARASELG

SEQ ID NO: 1378584 - protein, 24 aa, Mycobacterium tuberculosis
RLAVWDRPERRSGIPALDGLRAIA

SEQ ID NO: 1378585 - protein, 21 aa, Mycobacterium tuberculosis
RLDSLFRLDHLAARLRRNSAN

SEQ ID NO: 1378586 - protein, 18 aa, Mycobacterium tuberculosis
RLNAFSFWLFVFGATIGA

SEQ ID NO: 1378587 - protein, 18 aa, Mycobacterium tuberculosis
RLPPLAVGMGMYLPAALT

SEQ ID NO: 1378588 - protein, 20 aa, Mycobacterium tuberculosis
RLTFLDCLYYAAVTLSTTGY

SEQ ID NO: 1378589 - protein, 20 aa, Mycobacterium tuberculosis
RLVEDLLLLARLDSGRPLER

SEQ ID NO: 1378590 - protein, 22 aa, Mycobacterium tuberculosis
RPEDLPRVWALINATRADSLAP

SEQ ID NO: 1378591 - protein, 18 aa, Mycobacterium tuberculosis
RRAALTFSVSLMAACSLI

SEQ ID NO: 1378592 - protein, 18 aa, Mycobacterium tuberculosis
RRAQLWQAFTLQRKEDKR

SEQ ID NO: 1378593 - protein, 27 aa, Mycobacterium tuberculosis
RSASWRRRLRVRLPRLSTIAMAAAVVI

SEQ ID NO: 1378594 - protein, 18 aa, Mycobacterium tuberculosis
RVLTKPRFRGWIHVYSAG

SEQ ID NO: 1378595 - protein, 19 aa, Mycobacterium tuberculosis
RVSQPVAVAAPAKRSLLRT

SEQ ID NO: 1378596 - protein, 19 aa, Mycobacterium tuberculosis
SAIALRDLRIPAIGLVLLL

SEQ ID NO: 1378597 - protein, 20 aa, Mycobacterium tuberculosis
SALCFVGAVVLLYVDIDRRR

SEQ ID NO: 1378598 - protein, 23 aa, Mycobacterium tuberculosis
SAQARLAALSILVGAVGATGPGV

SEQ ID NO: 1378599 - protein, 19 aa, Mycobacterium tuberculosis
SATAFPWVFLFPASILVLI

SEQ ID NO: 1378600 - protein, 23 aa, Mycobacterium tuberculosis
SAVYMLWLYQRVMTGPVAEGNER

SEQ ID NO: 1378601 - protein, 21 aa, Mycobacterium tuberculosis
SELPDCIVVSVSHRPALERLH

SEQ ID NO: 1378602 - protein, 28 aa, Mycobacterium tuberculosis
SGPTAFWACGLLLCVFIGPAQSSARALL

SEQ ID NO: 1378603 - protein, 29 aa, Mycobacterium tuberculosis
SGPWLPARWRHWWWALLLAFVPIHLVVSA

SEQ ID NO: 1378604 - protein, 19 aa, Mycobacterium tuberculosis
SGSAPRFTARMSKSGVPYG

SEQ ID NO: 1378605 - protein, 18 aa, Mycobacterium tuberculosis
SLAPSVLILGSRFGCFEP

SEQ ID NO: 1378606 - protein, 18 aa, Mycobacterium tuberculosis
SNRKAGVVQKIIDWSTRT

SEQ ID NO: 1378607 - protein, 18 aa, Mycobacterium tuberculosis
SQLRPGRVPPALDQVIAK

SEQ ID NO: 1378608 - protein, 19 aa, Mycobacterium tuberculosis
SVLILGSRFGCFEPKRRMR

SEQ ID NO: 1378609 - protein, 20 aa, Mycobacterium tuberculosis
SVVGFLCVIMAWVSPATVFV

SEQ ID NO: 1378610 - protein, 20 aa, Mycobacterium tuberculosis
SVVVGLWGAMTFGPFIAHHI

SEQ ID NO: 1378611 - protein, 17 aa, Mycobacterium tuberculosis
SVWTLWPVLELLMPQDV

SEQ ID NO: 1378612 - protein, 18 aa, Mycobacterium tuberculosis
TAEAVARFLSWVYATNPP

SEQ ID NO: 1378613 - protein, 17 aa, Mycobacterium tuberculosis
TAGDVVQIFAGNDVVAT

SEQ ID NO: 1378614 - protein, 23 aa, Mycobacterium tuberculosis
TALREIALLWLADQVDAALEKYR

SEQ ID NO: 1378615 - protein, 17 aa, Mycobacterium tuberculosis
TAVVLCYGLWAFERDGY

SEQ ID NO: 1378616 - protein, 19 aa, Mycobacterium tuberculosis
TICTVFFAVYGMLLLTTQF

SEQ ID NO: 1378617 - protein, 19 aa, Mycobacterium tuberculosis
TLVAAAGFYCYGLTHVLYL

SEQ ID NO: 1378618 - protein, 22 aa, Mycobacterium tuberculosis
TMLTRLQRALAHEQQFVADASH

SEQ ID NO: 1378619 - protein, 18 aa, Mycobacterium tuberculosis
TPIAQVLRRQRREIVLAA

SEQ ID NO: 1378620 - protein, 17 aa, Mycobacterium tuberculosis
TPNDPRFQPGFEEADTR

SEQ ID NO: 1378621 - protein, 18 aa, Mycobacterium tuberculosis
TTLCVTWTPAQPGAARVA

SEQ ID NO: 1378622 - protein, 30 aa, Mycobacterium tuberculosis; identical to SEQ ID NO: 159268

SEQ ID NO: 1378623 - protein, 19 aa, Mycobacterium tuberculosis
VAAGSVWPAVSMAVTGAGT

SEQ ID NO: 1378624 - protein, 24 aa, Mycobacterium tuberculosis
VAGFSVYRLHGIFGSHDTTSTAGG

SEQ ID NO: 1378625 - protein, 26 aa, Mycobacterium tuberculosis
VALTVLWLLNIGEYLQDLTLRRTRRA

SEQ ID NO: 1378626 - protein, 18 aa, Mycobacterium tuberculosis
VAVVGFRALFGAFLLGLL

SEQ ID NO: 1378627 - protein, 18 aa, Mycobacterium tuberculosis
VFGAPGTVATINYLDVDA

SEQ ID NO: 1378628 - protein, 23 aa, Mycobacterium tuberculosis
VGIMWPSLLVILLLVAVVALLFT

SEQ ID NO: 1378629 - protein, 18 aa, Mycobacterium tuberculosis
VGLLGMFGPVRVVHVGWL

SEQ ID NO: 1378630 - protein, 25 aa, Mycobacterium tuberculosis
VGYLALVVYFDWGFSLAAGVLVLSV

SEQ ID NO: 1378631 - protein, 25 aa, Mycobacterium tuberculosis
VHTRAGGLVVAEWIRGGSLQEVADT

SEQ ID NO: 1378632 - protein, 18 aa, Mycobacterium tuberculosis
VHVYRLVWRQMIFFAHNI

SEQ ID NO: 1378633 - protein, 29 aa, Mycobacterium tuberculosis
VLPWICAPLAIAVMWRWILAPTDGAISTV

SEQ ID NO: 1378634 - protein, 19 aa, Mycobacterium tuberculosis
VLSLFRLVYGLLFAGYGSM

SEQ ID NO: 1378635 - protein, 18 aa, Mycobacterium tuberculosis
VQVLRRLYDRVGDRLALI

SEQ ID NO: 1378636 - protein, 18 aa, Mycobacterium tuberculosis
VRYRDRLLLPLPMFHVAA

SEQ ID NO: 1378637 - protein, 17 aa, Mycobacterium tuberculosis
VSQPVAVAAPAKRSLLR

SEQ ID NO: 1378638 - protein, 17 aa, Mycobacterium tuberculosis
VVLQLWGLLALVLDSLA

SEQ ID NO: 1378639 - protein, 17 aa, Mycobacterium tuberculosis
VWRSVRSLPDFWRLLQV

SEQ ID NO: 1378640 - protein, 33 aa, Mycobacterium tuberculosis; identical to SEQ ID NO: 160217

SEQ ID NO: 1378641 - protein, 17 aa, Mycobacterium tuberculosis
WAAAIGLMVPIGLAPPA

SEQ ID NO: 1378642 - protein, 17 aa, Mycobacterium tuberculosis
WAAKRARGSPLRIMILL

SEQ ID NO: 1378643 - protein, 22 aa, Mycobacterium tuberculosis
WIATACALTAWYVLYRSPDRRG

SEQ ID NO: 1378644 - protein, 17 aa, Mycobacterium tuberculosis
WMLMAGRKLAARDRRVL

SEQ ID NO: 1378645 - protein, 22 aa, Mycobacterium tuberculosis
WMTIDALVWVPRMYYLYGNPSR

SEQ ID NO: 1378646 - protein, 21 aa, Mycobacterium tuberculosis
WRQLAGMSYVWWALAVIVVAG

SEQ ID NO: 1378647 - protein, 17 aa, Mycobacterium tuberculosis
WSRCTAALAGPRVAVAI

SEQ ID NO: 1378648 - protein, 24 aa, Mycobacterium tuberculosis
WVNGLFGRLAWLFVGPVVAFPAFG

SEQ ID NO: 1378649 - protein, 19 aa, Mycobacterium tuberculosis
WWQLLLRVVLPMSRPTMVA

SEQ ID NO: 1378650 - protein, 25 aa, Mycobacterium tuberculosis
YDVVPSRLRRPGAVVLEIDDEDPIF

SEQ ID NO: 1378651 - protein, 17 aa, Mycobacterium tuberculosis
YFNIRFVQQYAHGAANP

SEQ ID NO: 1378652 - protein, 18 aa, Mycobacterium tuberculosis
YFNTLASPCAIGLVTVML

SEQ ID NO: 1378653 - protein, 34 aa, Mycobacterium tuberculosis; identical to SEQ ID NO: 159804

SEQ ID NO: 1378654 - protein, 18 aa, Mycobacterium tuberculosis
YRRVDIARVPDCAVVGAA

SEQ ID NO: 1378655 - protein, 17 aa, Mycobacterium tuberculosis
YRVVAALGDTPVPVART

SEQ ID NO: 1378656 - protein, 17 aa, Mycobacterium tuberculosis
YSLLYYRVLGLLTALSL

SEQ ID NO: 1378657 - protein, 30 aa, Mycobacterium tuberculosis
YVFPLGVVVGGPFLPLAIILYWFSNNIWTF

SEQ ID NO: 1378658 - protein, 23 aa, Mycobacterium tuberculosis
YVRDSFWKGREFDSLAQMQQAAV

SEQ ID NO: 1378659 - protein, 28 aa, Mycobacterium tuberculosis
YWEKHCYDIPSCWALRSVFDTIDGIDQL

SEQ ID NO: 1378660 - protein, 23 aa, Mycobacterium tuberculosis
AAEQRASALWSHPDPTALASVPG

SEQ ID NO: 1378661 - protein, 18 aa, Mycobacterium tuberculosis
AALPDWVPFATLFTVAAG

SEQ ID NO: 1378662 - protein, 26 aa, Mycobacterium tuberculosis
AARGEHYWLKLFVFFFPFTDQIAAFK

SEQ ID NO: 1378663 - protein, 24 aa, Mycobacterium tuberculosis
AARLRASTGLGEVWRCLRCGDFAL

SEQ ID NO: 1378664 - protein, 22 aa, Mycobacterium tuberculosis
AARRAWRPVALIPSGATPVRLA

SEQ ID NO: 1378665 - protein, 17 aa, Mycobacterium tuberculosis
AASAYFAGGLSLRDATR

SEQ ID NO: 1378666 - protein, 19 aa, Mycobacterium tuberculosis
AAVSLARYWGAEVFVTASR

SEQ ID NO: 1378667 - protein, 18 aa, Mycobacterium tuberculosis
ADIHMLWWMVLIVGVVSI

SEQ ID NO: 1378668 - protein, 22 aa, Mycobacterium tuberculosis
ADTADGLGCYGPPQRALAVMRD

SEQ ID NO: 1378669 - protein, 22 aa, Mycobacterium tuberculosis
ADVVGCSMRLPFLYAPLPYGGT

SEQ ID NO: 1378670 - protein, 18 aa, Mycobacterium tuberculosis
AEHTCCRETPAAIPTGPD

SEQ ID NO: 1378671 - protein, 18 aa, Mycobacterium tuberculosis
AELSAPLIEVHISNVHAR

SEQ ID NO: 1378672 - protein, 23 aa, Mycobacterium tuberculosis
AFAQFAILCRRYLAVIAADRQYA

SEQ ID NO: 1378673 - protein, 19 aa, Mycobacterium tuberculosis
AFHSPPGWVVAANAPFKSA

SEQ ID NO: 1378674 - protein, 21 aa, Mycobacterium tuberculosis
AFTAWDVFLGYELPQPPTIAR

SEQ ID NO: 1378675 - protein, 19 aa, Mycobacterium tuberculosis
AGAAGPFLGSTPFAQIDLP

SEQ ID NO: 1378676 - protein, 18 aa, Mycobacterium tuberculosis
AGAMPVLTLYGIPHRDCG

SEQ ID NO: 1378677 - protein, 17 aa, Mycobacterium tuberculosis
AGDVLELMTPTGRFGTP

SEQ ID NO: 1378678 - protein, 25 aa, Mycobacterium tuberculosis
AGFALGVAMLLGGTWLTCVLAAVTS

SEQ ID NO: 1378679 - protein, 23 aa, Mycobacterium tuberculosis
AGHSRWLSAEAMAARLNDVGVGR

SEQ ID NO: 1378680 - protein, 18 aa, Mycobacterium tuberculosis
AGSWLPALLWGVAFAILV

SEQ ID NO: 1378681 - protein, 27 aa, Mycobacterium tuberculosis
AIAVAAAWTFLKILGPILRGIADAAVS

SEQ ID NO: 1378682 - protein, 20 aa, Mycobacterium tuberculosis
AKTPKAAFRIAFAGPATSLA

SEQ ID NO: 1378683 - protein, 21 aa, Mycobacterium tuberculosis
ALAAWAVWEFRGARGAIQATL

SEQ ID NO: 1378684 - protein, 17 aa, Mycobacterium tuberculosis
ALARVTSAIGVVAGLGM

SEQ ID NO: 1378685 - protein, 17 aa, Mycobacterium tuberculosis
ALGYMHAALAMFLGSTL

SEQ ID NO: 1378686 - protein, 19 aa, Mycobacterium tuberculosis
ALLDSRYLVQAKIASGGTS

SEQ ID NO: 1378687 - protein, 18 aa, Mycobacterium tuberculosis
ALVLYVSMLSKWPVGWVV

SEQ ID NO: 1378688 - protein, 25 aa, Mycobacterium tuberculosis
ANSFALRGRWALDYQGATSDGNDAA

SEQ ID NO: 1378689 - protein, 19 aa, Mycobacterium tuberculosis
APAMYRIVRELATSAHQPM

SEQ ID NO: 1378690 - protein, 17 aa, Mycobacterium tuberculosis
ARAAAPLSEAMRVAGVN

SEQ ID NO: 1378691 - protein, 23 aa, Mycobacterium tuberculosis
ARFRRSELMLALATTAAVLGLGV

SEQ ID NO: 1378692 - protein, 25 aa, Mycobacterium tuberculosis
ARRRELSQLPVLRWVDNSGNRANRR

SEQ ID NO: 1378693 - protein, 20 aa, Mycobacterium tuberculosis
ARSRGRLVRSLRPLILLPLV

SEQ ID NO: 1378694 - protein, 24 aa, Mycobacterium tuberculosis
ARTADRLKAAGFTVTDVGNLSLPD

SEQ ID NO: 1378695 - protein, 17 aa, Mycobacterium tuberculosis
ARTLPGKQFEAGRQLRV

SEQ ID NO: 1378696 - protein, 24 aa, Mycobacterium tuberculosis
ARVPQRFVPDLTKYQYWNGDSNSW

SEQ ID NO: 1378697 - protein, 17 aa, Mycobacterium tuberculosis
ASQIRRLRAPRPQVERG

SEQ ID NO: 1378698 - protein, 18 aa, Mycobacterium tuberculosis
ASVISWVSIVLIYVVVVY

SEQ ID NO: 1378699 - protein, 18 aa, Mycobacterium tuberculosis
ATALPDWLHDSMRAAAAG

SEQ ID NO: 1378700 - protein, 20 aa, Mycobacterium tuberculosis
ATICTVFFAVYGMLLLTTQF

SEQ ID NO: 1378701 - protein, 22 aa, Mycobacterium tuberculosis
ATLADLYGRRRWYLIGVSLFTL

SEQ ID NO: 1378702 - protein, 26 aa, Mycobacterium tuberculosis
ATLEAFLKRRVRTHGLLTASIAAAVH

SEQ ID NO: 1378703 - protein, 20 aa, Mycobacterium tuberculosis
AVAFFAVVVLIGFWVAGSHE

SEQ ID NO: 1378704 - protein, 21 aa, Mycobacterium tuberculosis
AVAGRLGWSLTVLAAVAFIAR

SEQ ID NO: 1378705 - protein, 17 aa, Mycobacterium tuberculosis
AVDRCFTGLVISLVCGY

SEQ ID NO: 1378706 - protein, 25 aa, Mycobacterium tuberculosis
AVLSGRVTAVLVCRRSVPAAHGSTL

SEQ ID NO: 1378707 - protein, 32 aa, Mycobacterium tuberculosis
AVPGWAWQGPSAEWYVAAHLPYVAWLTQASAD

SEQ ID NO: 1378708 - protein, 17 aa, Mycobacterium tuberculosis
AVRPELQQALANQNWAA

SEQ ID NO: 1378709 - protein, 17 aa, Mycobacterium tuberculosis
AVRRAGYQADLCTDDGR

SEQ ID NO: 1378710 - protein, 23 aa, Mycobacterium tuberculosis
AVRWPDPWPTTFGYHEFFHACTA

SEQ ID NO: 1378711 - protein, 19 aa, Mycobacterium tuberculosis
AVVEGCLMAVFFVTDGGEV

SEQ ID NO: 1378712 - protein, 19 aa, Mycobacterium tuberculosis
AYVAAHLPYLAWLTKSSAD

SEQ ID NO: 1378713 - protein, 18 aa, Mycobacterium tuberculosis
CGALSGFHALICSGTTPK

SEQ ID NO: 1378714 - protein, 21 aa, Mycobacterium tuberculosis
CGFAMLPAYLLLVVHGQDSAG

SEQ ID NO: 1378715 - protein, 18 aa, Mycobacterium tuberculosis
CGLAGLVFLAVPALLPAA

SEQ ID NO: 1378716 - protein, 19 aa, Mycobacterium tuberculosis
CLPMLAQIPVFLGLYHVLR

SEQ ID NO: 1378717 - protein, 19 aa, Mycobacterium tuberculosis
CVASAGLLVWFWPHLGKDN

SEQ ID NO: 1378718 - protein, 17 aa, Mycobacterium tuberculosis
DAAVCGIRVVKAFGQEE

SEQ ID NO: 1378719 - protein, 22 aa, Mycobacterium tuberculosis
DDYRRLGVRGQRLLALYYPFVA

SEQ ID NO: 1378720 - protein, 18 aa, Mycobacterium tuberculosis
DEAIKGLRAVAAGKQAPN

SEQ ID NO: 1378721 - protein, 18 aa, Mycobacterium tuberculosis
DGARWWQLLLRVVLPMSR

SEQ ID NO: 1378722 - protein, 24 aa, Mycobacterium tuberculosis
DGVKEFPGPWALVPVGATMLMILA

SEQ ID NO: 1378723 - protein, 29 aa, Mycobacterium tuberculosis
DIGPQPAWRNLRFPLAWAPPEADVARIVA

SEQ ID NO: 1378724 - protein, 19 aa, Mycobacterium tuberculosis
DIQLKRLHQVAGPAGRSVV

SEQ ID NO: 1378725 - protein, 18 aa, Mycobacterium tuberculosis
DKIGRKPLLLWFGVGGLI

SEQ ID NO: 1378726 - protein, 17 aa, Mycobacterium tuberculosis
DLVGGLLLALALGLAVI

SEQ ID NO: 1378727 - protein, 29 aa, Mycobacterium tuberculosis
DRDRSIGSVGRWVAVVAVLAVLTVVVTIA

SEQ ID NO: 1378728 - protein, 20 aa, Mycobacterium tuberculosis
DRLLLPLPMFHVAALTTVIF

SEQ ID NO: 1378729 - protein, 22 aa, Mycobacterium tuberculosis
DRLLRRVCPGDIVVLDVLDLDR

SEQ ID NO: 1378730 - protein, 22 aa, Mycobacterium tuberculosis
DRLRDPPAYGSWLLGWVSERPL

SEQ ID NO: 1378731 - protein, 18 aa, Mycobacterium tuberculosis
DRYYLRAGTPVNRGYAAA

SEQ ID NO: 1378732 - protein, 23 aa, Mycobacterium tuberculosis
DSAACKAWLLAQPYLVAGVLLVF

SEQ ID NO: 1378733 - protein, 24 aa, Mycobacterium tuberculosis
DVLPQTRWIPVVTFVQVSADMAVA

SEQ ID NO: 1378734 - protein, 19 aa, Mycobacterium tuberculosis
ECDSVVAAVSRLTSAQAPP

SEQ ID NO: 1378735 - protein, 19 aa, Mycobacterium tuberculosis
EQTSWGIVGWSMGGTCAVD

SEQ ID NO: 1378736 - protein, 20 aa, Mycobacterium tuberculosis
ETERIWLPFTIWLTAAPALL

SEQ ID NO: 1378737 - protein, 20 aa, Mycobacterium tuberculosis
ETYTRRRRNLLIGIGAGAAV

SEQ ID NO: 1378738 - protein, 20 aa, Mycobacterium tuberculosis
EVPDAMRAMFGTRLLPREYA

SEQ ID NO: 1378739 - protein, 20 aa, Mycobacterium tuberculosis
FADRVFAAALPWLAGQLATP

SEQ ID NO: 1378740 - protein, 18 aa, Mycobacterium tuberculosis
FAGYFAMLALPAMVQVAG

SEQ ID NO: 1378741 - protein, 21 aa, Mycobacterium tuberculosis
FARTEFQAVQFIPLVMVPQLL

SEQ ID NO: 1378742 - protein, 19 aa, Mycobacterium tuberculosis
FDLAVAVFFAVSGFLLWRG

SEQ ID NO: 1378743 - protein, 26 aa, Mycobacterium tuberculosis
FGGKVSYLALGILVAIALVIGGIGGV

SEQ ID NO: 1378744 - protein, 26 aa, Mycobacterium tuberculosis
FGSSALLCPLLVYGWLGLPRWGLTGS

SEQ ID NO: 1378745 - protein, 18 aa, Mycobacterium tuberculosis
FIIGHGRLFGFYVAFYCA

SEQ ID NO: 1378746 - protein, 17 aa, Mycobacterium tuberculosis
FILLVAIGADYNMLLIS

SEQ ID NO: 1378747 - protein, 23 aa, Mycobacterium tuberculosis
FKDLLINCGYSLIERFPLMLGTA

SEQ ID NO: 1378748 - protein, 21 aa, Mycobacterium tuberculosis
FLCPACGIFERGFGPTVSKLV

SEQ ID NO: 1378749 - protein, 21 aa, Mycobacterium tuberculosis
FLNRKIKGISLFRTVVFLPLA

SEQ ID NO: 1378750 - protein, 17 aa, Mycobacterium tuberculosis
FLVRGGPNYFSIALIVI

SEQ ID NO: 1378751 - protein, 17 aa, Mycobacterium tuberculosis
FLVTRSFVRFIHRRAAD

SEQ ID NO: 1378752 - protein, 25 aa, Mycobacterium tuberculosis
FNEPICPPCGSFIRSYASDIDTAVA

SEQ ID NO: 1378753 - protein, 17 aa, Mycobacterium tuberculosis
FPVIGAFPFTGRMPTVL

SEQ ID NO: 1378754 - protein, 21 aa, Mycobacterium tuberculosis
FSVMSFLLLYGIARFQGVLPF

SEQ ID NO: 1378755 - protein, 17 aa, Mycobacterium tuberculosis
FTTVPAVLAEQLKGLQV

SEQ ID NO: 1378756 - protein, 26 aa, Mycobacterium tuberculosis
FVTRPVGSWFLGRFADRRGRRAALTF

SEQ ID NO: 1378757 - protein, 23 aa, Mycobacterium tuberculosis
FVVDWRVALVLFGPVLVYLTITS

SEQ ID NO: 1378758 - protein, 21 aa, Mycobacterium tuberculosis
FYLPPEVFDNPDFQRGLEQFL

SEQ ID NO: 1378759 - protein, 19 aa, Mycobacterium tuberculosis
GAEKVCGVIGGRGHDAAPQ

SEQ ID NO: 1378760 - protein, 17 aa, Mycobacterium tuberculosis
GAGVLLGLACATKWSGV

SEQ ID NO: 1378761 - protein, 17 aa, Mycobacterium tuberculosis
GALLKLTVFAVGVMPYI

SEQ ID NO: 1378762 - protein, 17 aa, Mycobacterium tuberculosis
GAQLGIFIKGYRALETI

SEQ ID NO: 1378763 - protein, 25 aa, Mycobacterium tuberculosis
GASAWRRLTKVILPMIKPAIVVALL

SEQ ID NO: 1378764 - protein, 18 aa, Mycobacterium tuberculosis
GASGLVWTLTIVLIAGLM

SEQ ID NO: 1378765 - protein, 29 aa, Mycobacterium tuberculosis
GASQRLADCIARPLVPSIMIAAALIAGTG

SEQ ID NO: 1378766 - protein, 21 aa, Mycobacterium tuberculosis
GCGLTAIALEIEKWWRTGGQG

SEQ ID NO: 1378767 - protein, 17 aa, Mycobacterium tuberculosis
GDIPFQVQLPSTPLAPP

SEQ ID NO: 1378768 - protein, 21 aa, Mycobacterium tuberculosis
GDQAFEVLAPFVVDGGPTVLV

SEQ ID NO: 1378769 - protein, 19 aa, Mycobacterium tuberculosis
GFYSTFFFFFFVAELLDTW

SEQ ID NO: 1378770 - protein, 18 aa, Mycobacterium tuberculosis
GGARGFAHLGVLDELERV

SEQ ID NO: 1378771 - protein, 21 aa, Mycobacterium tuberculosis
GGTSYRSVLMYPEKMPRPPWR

SEQ ID NO: 1378772 - protein, 18 aa, Mycobacterium tuberculosis
GHALALTASMTWEILWAL

SEQ ID NO: 1378773 - protein, 20 aa, Mycobacterium tuberculosis
GHALALTASMTWEILWALIL

SEQ ID NO: 1378774 - protein, 26 aa, Mycobacterium tuberculosis
GIARRSGTPISFWKFTRKGAVVTAVS

SEQ ID NO: 1378775 - protein, 18 aa, Mycobacterium tuberculosis
GIILNLVTGPGFYDIALR

SEQ ID NO: 1378776 - protein, 20 aa, Mycobacterium tuberculosis
GLAVILSYIWGVRVGGLFAA

SEQ ID NO: 1378777 - protein, 17 aa, Mycobacterium tuberculosis
GLFAVGIVIGRKTNTTA

SEQ ID NO: 1378778 - protein, 18 aa, Mycobacterium tuberculosis
GLLALAGWVSVPGTGRMR

SEQ ID NO: 1378779 - protein, 25 aa, Mycobacterium tuberculosis
GLLVSLLVRRRRVWARITPTTAGTV

SEQ ID NO: 1378780 - protein, 30 aa, Mycobacterium tuberculosis
GLPVMVGGLCIAGALGIMRFLAIFGPVHYF

SEQ ID NO: 1378781 - protein, 25 aa, Mycobacterium tuberculosis
GLSSLRAGMIAGAIGLLLVLVYSLL

SEQ ID NO: 1378782 - protein, 17 aa, Mycobacterium tuberculosis
GLVALYILMQLARQRRM

SEQ ID NO: 1378783 - protein, 34 aa, Mycobacterium tuberculosis
GPRTDLRLRWSWRGLRLGLMFGFGGMLVTIPASL

SEQ ID NO: 1378784 - protein, 19 aa, Mycobacterium tuberculosis
GRIKDLVIIDGRNHYPQDL

SEQ ID NO: 1378785 - protein, 17 aa, Mycobacterium tuberculosis
GRQAGLVDAVRAAESAL

SEQ ID NO: 1378786 - protein, 19 aa, Mycobacterium tuberculosis
GRTIREFIGAVLLVPTVIA

SEQ ID NO: 1378787 - protein, 23 aa, Mycobacterium tuberculosis
GRVTELLARLCLGQSAREAFLPH

SEQ ID NO: 1378788 - protein, 20 aa, Mycobacterium tuberculosis
GRYGQYGQYGVQPGGYYGQQ

SEQ ID NO: 1378789 - protein, 19 aa, Mycobacterium tuberculosis
GSAYLARVPQRFVPDLTKY

SEQ ID NO: 1378790 - protein, 17 aa, Mycobacterium tuberculosis
GVLPPYWAAKAFWVASD

SEQ ID NO: 1378791 - protein, 17 aa, Mycobacterium tuberculosis
GVRLRYEQAITDASVAV

SEQ ID NO: 1378792 - protein, 17 aa, Mycobacterium tuberculosis
HGLHFAMAVAMAVMAWP

SEQ ID NO: 1378793 - protein, 20 aa, Mycobacterium tuberculosis
HHSAARVVAWAIFATACITD

SEQ ID NO: 1378794 - protein, 24 aa, Mycobacterium tuberculosis
HIIDVKRALAWVKAHISEYGGDPD

SEQ ID NO: 1378795 - protein, 22 aa, Mycobacterium tuberculosis
HLYDRSSFHRIPGAVEMAIAVE

SEQ ID NO: 1378796 - protein, 25 aa, Mycobacterium tuberculosis
HRRFLPARWWSIGGLDTLVIAVLVW

SEQ ID NO: 1378797 - protein, 17 aa, Mycobacterium tuberculosis
IAALAWGVTALVMQNRD

SEQ ID NO: 1378798 - protein, 20 aa, Mycobacterium tuberculosis
IAFLPIVLAPAVIPPASTPL

SEQ ID NO: 1378799 - protein, 17 aa, Mycobacterium tuberculosis
IAGSRTPLTLDLDGLGR

SEQ ID NO: 1378800 - protein, 17 aa, Mycobacterium tuberculosis
IALGGWLLLGRGLTALT

SEQ ID NO: 1378801 - protein, 22 aa, Mycobacterium tuberculosis
IANETDGGFGPSSRIVRFSAAD

SEQ ID NO: 1378802 - protein, 22 aa, Mycobacterium tuberculosis
IANRVSYFYDFHGPSVTIDTAC

SEQ ID NO: 1378803 - protein, 21 aa, Mycobacterium tuberculosis
IFGWHGMGEWMVRGISTQDTN

SEQ ID NO: 1378804 - protein, 18 aa, Mycobacterium tuberculosis
IGVPWWFMVVQLPFAGIV

SEQ ID NO: 1378805 - protein, 19 aa, Mycobacterium tuberculosis
IHFLVVGYLFYWAIIGIDP

SEQ ID NO: 1378806 - protein, 24 aa, Mycobacterium tuberculosis
ILLFGGRRTDAWGHLLGCAAALAA

SEQ ID NO: 1378807 - protein, 28 aa, Mycobacterium tuberculosis
ILLVLWGLRASIQWLQARLAQRGASAVI

SEQ ID NO: 1378808 - protein, 23 aa, Mycobacterium tuberculosis
ILTWIFVDGHFSKWLNFTPTPLT

SEQ ID NO: 1378809 - protein, 17 aa, Mycobacterium tuberculosis
ILWRIHAAPALLMMPQT

SEQ ID NO: 1378810 - protein, 17 aa, Mycobacterium tuberculosis
INAILGVLLLIVLATGS

SEQ ID NO: 1378811 - protein, 17 aa, Mycobacterium tuberculosis
IPPRGTQAVVLKVYQNA

SEQ ID NO: 1378812 - protein, 17 aa, Mycobacterium tuberculosis
IRPDIVIAMVVGIPSAI

SEQ ID NO: 1378813 - protein, 22 aa, Mycobacterium tuberculosis
ISRFRTLLVKWAVMVVLALLTS

SEQ ID NO: 1378814 - protein, 22 aa, Mycobacterium tuberculosis
ISWTHHWVWLVPLMIWLIDGPA

SEQ ID NO: 1378815 - protein, 25 aa, Mycobacterium tuberculosis
IVFGLSGIVPWWFVLTLLTRDALLA

SEQ ID NO: 1378816 - protein, 17 aa, Mycobacterium tuberculosis
IVLAPAVIPPASTPLAA

SEQ ID NO: 1378817 - protein, 28 aa, Mycobacterium tuberculosis
IWQHILHMPLHWLVLPMAIIVMLAVGSD

SEQ ID NO: 1378818 - protein, 27 aa, Mycobacterium tuberculosis
IYYSPRLFAAMGFAGYFAMLALPAMVQ

SEQ ID NO: 1378819 - protein, 17 aa, Mycobacterium tuberculosis
KERPRVIAVDAVPTEVA

SEQ ID NO: 1378820 - protein, 30 aa, Mycobacterium tuberculosis
KHGRPFRRRNPRPAIVVVAFLVVVTCVMWT

SEQ ID NO: 1378821 - protein, 21 aa, Mycobacterium tuberculosis
KKPKQRRLRRKKTAKGDEAEP

SEQ ID NO: 1378822 - protein, 20 aa, Mycobacterium tuberculosis
KLVAPLKYPSLYAGDEDGKV

SEQ ID NO: 1378823 - protein, 20 aa, Mycobacterium tuberculosis
KPSMPYRLRVIVHEDENGRM

SEQ ID NO: 1378824 - protein, 18 aa, Mycobacterium tuberculosis
KSTLARLVAGYTHPTDGT

SEQ ID NO: 1378825 - protein, 17 aa, Mycobacterium tuberculosis
KTGQLVGATPWKQQVAL

SEQ ID NO: 1378826 - protein, 20 aa, Mycobacterium tuberculosis
KVAFVAGWMYFLNWAMTGIV

SEQ ID NO: 1378827 - protein, 17 aa, Mycobacterium tuberculosis
LAAPRKTRAFMAALQSW

SEQ ID NO: 1378828 - protein, 19 aa, Mycobacterium tuberculosis
LAFLLVFGLFVRKGWDIVI

SEQ ID NO: 1378829 - protein, 20 aa, Mycobacterium tuberculosis
LAGWRWFPRDVHTAGSDAKR

SEQ ID NO: 1378830 - protein, 19 aa, Mycobacterium tuberculosis
LEFYRRARAAADKITPDVE

SEQ ID NO: 1378831 - protein, 40 aa, Mycobacterium tuberculosis
LEPKRMARVRGWRKVGAAIVRWPGPILVGAVALALVGLLT

SEQ ID NO: 1378832 - protein, 18 aa, Mycobacterium tuberculosis
LERPLADVARASELGGSQ

SEQ ID NO: 1378833 - protein, 17 aa, Mycobacterium tuberculosis
LEYELDAAKLLDFPVMT

SEQ ID NO: 1378834 - protein, 24 aa, Mycobacterium tuberculosis
LFALSEMRWAALALGLFSAGLLTQ

SEQ ID NO: 1378835 - protein, 25 aa, Mycobacterium tuberculosis
LFIMGRIKDLLIVDGRNHYPDDIEA

SEQ ID NO: 1378836 - protein, 25 aa, Mycobacterium tuberculosis
LFLIPPEHAHKLVFAVLRGVAAVAP

SEQ ID NO: 1378837 - protein, 25 aa, Mycobacterium tuberculosis
LFVPAALPWYYSWPLAVAAPLAQSR

SEQ ID NO: 1378838 - protein, 21 aa, Mycobacterium tuberculosis
LGALLIGWAAYRGIPHWQSIP

SEQ ID NO: 1378839 - protein, 30 aa, Mycobacterium tuberculosis
LGPAAGFFVGWSYWFAWVVTGIADLVAITG

SEQ ID NO: 1378840 - protein, 27 aa, Mycobacterium tuberculosis
LGVPHLDPGPFLSYGIQWISFGILAPI

SEQ ID NO: 1378841 - protein, 20 aa, Mycobacterium tuberculosis
LGYVAWRLFGHTPYRIDIDI

SEQ ID NO: 1378842 - protein, 31 aa, Mycobacterium tuberculosis
LILGWRSARWWRRGASLLAVPLCLLSATLTL

SEQ ID NO: 1378843 - protein, 18 aa, Mycobacterium tuberculosis
LLCCSGVATAAPKTYCEE

SEQ ID NO: 1378844 - protein, 21 aa, Mycobacterium tuberculosis
LLFARPRLRVGSAGLSVRNLL

SEQ ID NO: 1378845 - protein, 22 aa, Mycobacterium tuberculosis
LLHRAKGGGLSTLFGGGVQSSL

SEQ ID NO: 1378846 - protein, 21 aa, Mycobacterium tuberculosis
LLLLYWQWRTMPAVIWDVRQP

SEQ ID NO: 1378847 - protein, 23 aa, Mycobacterium tuberculosis
LLRDRWGFQPAWNAEECLEDFTL

SEQ ID NO: 1378848 - protein, 19 aa, Mycobacterium tuberculosis
LLTEPRPWHVPGRPRRAGV

SEQ ID NO: 1378849 - protein, 17 aa, Mycobacterium tuberculosis
LLVCDRLGVNSTPFLVA

SEQ ID NO: 1378850 - protein, 19 aa, Mycobacterium tuberculosis
LPRRRREWLVAGAGAFVAH

SEQ ID NO: 1378851 - protein, 20 aa, Mycobacterium tuberculosis
LRYAPDCVVRVNAGRVRERV

SEQ ID NO: 1378852 - protein, 28 aa, Mycobacterium tuberculosis
LSAPLIEHQRHWSLRRGVGASGPQEAAA

SEQ ID NO: 1378853 - protein, 17 aa, Mycobacterium tuberculosis
LSLAGVVLMRWTPIDLL

SEQ ID NO: 1378854 - protein, 20 aa, Mycobacterium tuberculosis
LTARPGMLTAVIGPSGAGKS

SEQ ID NO: 1378855 - protein, 19 aa, Mycobacterium tuberculosis
LTNQARRLLAWVGADENVR

SEQ ID NO: 1378856 - protein, 20 aa, Mycobacterium tuberculosis
LTRAERLNVVFLLAASQLVE

SEQ ID NO: 1378857 - protein, 24 aa, Mycobacterium tuberculosis
LVCAIGLSGGYAFSVFLQGVNPGA

SEQ ID NO: 1378858 - protein, 17 aa, Mycobacterium tuberculosis
LVGCGLTAIALEIEKWW

SEQ ID NO: 1378859 - protein, 24 aa, Mycobacterium tuberculosis
LVHAFSAPIAYLFRPYIVYRSREV

SEQ ID NO: 1378860 - protein, 17 aa, Mycobacterium tuberculosis
LVRNHTRRVLKRRNSGS

SEQ ID NO: 1378861 - protein, 27 aa, Mycobacterium tuberculosis
LVSSWQMPGGIYAPMMHPWSTGKDVYF

SEQ ID NO: 1378862 - protein, 17 aa, Mycobacterium tuberculosis
LVTRAAILVGLFLAAVA

SEQ ID NO: 1378863 - protein, 18 aa, Mycobacterium tuberculosis
LWISLVVLWLFVLVPMLI

SEQ ID NO: 1378864 - protein, 20 aa, Mycobacterium tuberculosis
MAVAVICLLAWSLSGLVGPS

SEQ ID NO: 1378865 - protein, 17 aa, Mycobacterium tuberculosis
MLDWPQRGQLGSVTAPL

SEQ ID NO: 1378866 - protein, 22 aa, Mycobacterium tuberculosis
MLNRRRPLLHLLTFLCGGYTMA

SEQ ID NO: 1378867 - protein, 17 aa, Mycobacterium tuberculosis
MPGDIPFQVQLPSTPLA

SEQ ID NO: 1378868 - protein, 24 aa, Mycobacterium tuberculosis
MSSAIGSVARWIVPLLGVAAVASI

SEQ ID NO: 1378869 - protein, 20 aa, Mycobacterium tuberculosis
MTSARLARIAPISREMVLNF

SEQ ID NO: 1378870 - protein, 17 aa, Mycobacterium tuberculosis
MVNSCLGLWQKIVFGRR

SEQ ID NO: 1378871 - protein, 25 aa, Mycobacterium tuberculosis
MYPEKMPRPPWRRETHNYIRSGPGP

SEQ ID NO: 1378872 - protein, 19 aa, Mycobacterium tuberculosis
NDPVAVPWVLSARSAQALT

SEQ ID NO: 1378873 - protein, 43 aa, Mycobacterium tuberculosis; identical to SEQ ID NO: 158168

SEQ ID NO: 1378874 - protein, 17 aa, Mycobacterium tuberculosis
NHYFARDPLKPEVTFAD

SEQ ID NO: 1378875 - protein, 32 aa, Mycobacterium tuberculosis
NNGLRPEPLIALGVLVTWVLVERSIALGRLAP

SEQ ID NO: 1378876 - protein, 18 aa, Mycobacterium tuberculosis
NSLIPVVTFLGADLGALM

SEQ ID NO: 1378877 - protein, 19 aa, Mycobacterium tuberculosis
NTYSRLALGIGIHDITAGY

SEQ ID NO: 1378878 - protein, 21 aa, Mycobacterium tuberculosis
PAPSWWWLAWFGLVPLLLVVR

SEQ ID NO: 1378879 - protein, 17 aa, Mycobacterium tuberculosis
PEARAALDAVRARIRSR

SEQ ID NO: 1378880 - protein, 20 aa, Mycobacterium tuberculosis
PENVHWTIWQLWLVVLLVAL

SEQ ID NO: 1378881 - protein, 17 aa, Mycobacterium tuberculosis
PERAQVRAGLPAGTLDD

SEQ ID NO: 1378882 - protein, 18 aa, Mycobacterium tuberculosis
PLAFALAALIAFEVNLGV

SEQ ID NO: 1378883 - protein, 30 aa, Mycobacterium tuberculosis; identical to SEQ ID NO: 158337

SEQ ID NO: 1378884 - protein, 21 aa, Mycobacterium tuberculosis
PLTAKLAWFSKFLTIAILGLA

SEQ ID NO: 1378885 - protein, 19 aa, Mycobacterium tuberculosis
PLTWPPAFFSWFAAGMLLA

SEQ ID NO: 1378886 - protein, 22 aa, Mycobacterium tuberculosis
PMAAVLRWLEIPQFSVFDEIFR

SEQ ID NO: 1378887 - protein, 26 aa, Mycobacterium tuberculosis
PMVWVRPRQGPKLADLIAAPSTTRAS

SEQ ID NO: 1378888 - protein, 18 aa, Mycobacterium tuberculosis
PPAFFSWFAAGMLLAEWA

SEQ ID NO: 1378889 - protein, 21 aa, Mycobacterium tuberculosis
PPTPGAARWSPGDSATVAGPL

SEQ ID NO: 1378890 - protein, 24 aa, Mycobacterium tuberculosis
PQPPDVNTWWAFRTSCTPTECLAA

SEQ ID NO: 1378891 - protein, 18 aa, Mycobacterium tuberculosis
PQRVRPRPASRMLRPYGP

SEQ ID NO: 1378892 - protein, 17 aa, Mycobacterium tuberculosis
PSAAWGWSRIDHRTWHI

SEQ ID NO: 1378893 - protein, 39 aa, Mycobacterium tuberculosis; identical to SEQ ID NO: 158430

SEQ ID NO: 1378894 - protein, 24 aa, Mycobacterium tuberculosis
PVPRAWRMRITVQRVGDRVKVSDV

SEQ ID NO: 1378895 - protein, 27 aa, Mycobacterium tuberculosis
PVRMTFRSSRLVYPMRLSVAAQEPQHV

SEQ ID NO: 1378896 - protein, 19 aa, Mycobacterium tuberculosis
PVWQSLRHADTWIMSLLYI

SEQ ID NO: 1378897 - protein, 18 aa, Mycobacterium tuberculosis
PYMRERMADMLTMSDEML

SEQ ID NO: 1378898 - protein, 18 aa, Mycobacterium tuberculosis
QKNLNVYGFTKFSQASVD

SEQ ID NO: 1378899 - protein, 22 aa, Mycobacterium tuberculosis
QKPVERPAHRWVVVNTDGRSAP

SEQ ID NO: 1378900 - protein, 25 aa, Mycobacterium tuberculosis
QPRPSSLAFLGGWLLGLAVVTAVFV

SEQ ID NO: 1378901 - protein, 17 aa, Mycobacterium tuberculosis
QPVSVWASATATLLIGA

SEQ ID NO: 1378902 - protein, 25 aa, Mycobacterium tuberculosis
QRPRRLRSTVAMRRLVAQTSLEPRH

SEQ ID NO: 1378903 - protein, 18 aa, Mycobacterium tuberculosis
QRVRPRPASRMLRPYGPR

SEQ ID NO: 1378904 - protein, 19 aa, Mycobacterium tuberculosis
QTVLPFTGIDFRLSPSGVA

SEQ ID NO: 1378905 - protein, 21 aa, Mycobacterium tuberculosis
RANGIRRIVMLTGDHPEIAQV

SEQ ID NO: 1378906 - protein, 18 aa, Mycobacterium tuberculosis
RDALCLSSTQISRQSNLP

SEQ ID NO: 1378907 - protein, 34 aa, Mycobacterium tuberculosis
RDMFWSLAPLVVGCILLAGLVGMCSFQLGGTKRG

SEQ ID NO: 1378908 - protein, 18 aa, Mycobacterium tuberculosis
RENVVALTVLWLLNIGEY

SEQ ID NO: 1378909 - protein, 20 aa, Mycobacterium tuberculosis
RFADRRGRRAALTFSVSLMA

SEQ ID NO: 1378910 - protein, 22 aa, Mycobacterium tuberculosis
RGEVASLGFLISLWAGSSAISA

SEQ ID NO: 1378911 - protein, 19 aa, Mycobacterium tuberculosis
RGSQWAGMGRQLLADEPAF

SEQ ID NO: 1378912 - protein, 17 aa, Mycobacterium tuberculosis
RGTRAVIRYDNLFGDRY

SEQ ID NO: 1378913 - protein, 22 aa, Mycobacterium tuberculosis
RHGSYTGLSGWFAISSPGPPSP

SEQ ID NO: 1378914 - protein, 21 aa, Mycobacterium tuberculosis
RIECACKVWAAGVAASPLGKM

SEQ ID NO: 1378915 - protein, 18 aa, Mycobacterium tuberculosis
RISRAVIGPTDIVGIGHQ

SEQ ID NO: 1378916 - protein, 18 aa, Mycobacterium tuberculosis
RITGWVAAVYAWLRRRRR

SEQ ID NO: 1378917 - protein, 17 aa, Mycobacterium tuberculosis
RLFGHTPYRIDIDIYQM

SEQ ID NO: 1378918 - protein, 18 aa, Mycobacterium tuberculosis
RLGWYVIIGTIPICILGL

SEQ ID NO: 1378919 - protein, 29 aa, Mycobacterium tuberculosis
RLPDLAAGLVCWLLLSREVLPRLGPAVAA

SEQ ID NO: 1378920 - protein, 18 aa, Mycobacterium tuberculosis
RLPPLAVGMGMYLSAALT

SEQ ID NO: 1378921 - protein, 18 aa, Mycobacterium tuberculosis
RLQRRLGAVPDIDSHAAS

SEQ ID NO: 1378922 - protein, 19 aa, Mycobacterium tuberculosis
RNPEVWAWMVWLPHNLHDE

SEQ ID NO: 1378923 - protein, 19 aa, Mycobacterium tuberculosis
RPASAVSRPSYRQCVQASA

SEQ ID NO: 1378924 - protein, 18 aa, Mycobacterium tuberculosis
RPGESDGTCGRGEPQAGR

SEQ ID NO: 1378925 - protein, 20 aa, Mycobacterium tuberculosis
RPWALPAQFWLYCGFTAITM

SEQ ID NO: 1378926 - protein, 18 aa, Mycobacterium tuberculosis
RQHDRLRDPPAYGSWLLG

SEQ ID NO: 1378927 - protein, 19 aa, Mycobacterium tuberculosis
RRLGAVPDIDSHAASAHLD

SEQ ID NO: 1378928 - protein, 26 aa, Mycobacterium tuberculosis
RRNFDVRIKIFMLVTAVVLLCCSGVA

SEQ ID NO: 1378929 - protein, 21 aa, Mycobacterium tuberculosis
RRPKRLRPAPPVELDADESSP

SEQ ID NO: 1378930 - protein, 22 aa, Mycobacterium tuberculosis
RRSRGLAGLSVAWGLWEQASAM

SEQ ID NO: 1378931 - protein, 28 aa, Mycobacterium tuberculosis
RRTKLFALSEMRWAALALGLFSAGLLTQ

SEQ ID NO: 1378932 - protein, 24 aa, Mycobacterium tuberculosis
RSARELWAGCLLPMVNLLWAPLYV

SEQ ID NO: 1378933 - protein, 19 aa, Mycobacterium tuberculosis
RTAFTLAAGLLFGSVVGVF

SEQ ID NO: 1378934 - protein, 21 aa, Mycobacterium tuberculosis
RTGMKVRRYFVGFGPTLWSTR

SEQ ID NO: 1378935 - protein, 23 aa, Mycobacterium tuberculosis
RTLPRWQRIVALTMIGISTALIG

SEQ ID NO: 1378936 - protein, 17 aa, Mycobacterium tuberculosis
RTSIATSSPGRCDMSPI

SEQ ID NO: 1378937 - protein, 19 aa, Mycobacterium tuberculosis
RTSTLVLIAAFLAVWWIYE

SEQ ID NO: 1378938 - protein, 20 aa, Mycobacterium tuberculosis
RVARIMPAYVVAVVVILSLL

SEQ ID NO: 1378939 - protein, 25 aa, Mycobacterium tuberculosis
RVTSPPARETRAAVLLLVLSVGARL

SEQ ID NO: 1378940 - protein, 18 aa, Mycobacterium tuberculosis
RVYAARLAPVAAGLTLPS

SEQ ID NO: 1378941 - protein, 20 aa, Mycobacterium tuberculosis
SADTRRSLVFAICGITTVAT

SEQ ID NO: 1378942 - protein, 21 aa, Mycobacterium tuberculosis
SELPDCIVISVSHRPALERLH

SEQ ID NO: 1378943 - protein, 17 aa, Mycobacterium tuberculosis
SELPDLRAANYPRADHA

SEQ ID NO: 1378944 - protein, 24 aa, Mycobacterium tuberculosis
SELWAEAGKLGFLGVNLTEEYGGG

SEQ ID NO: 1378945 - protein, 20 aa, Mycobacterium tuberculosis
SGDTGLPVGVALLAALLAGV

SEQ ID NO: 1378946 - protein, 17 aa, Mycobacterium tuberculosis
SGIEGLLTWLGGGHWRE

SEQ ID NO: 1378947 - protein, 27 aa, Mycobacterium tuberculosis
SQISAPRAKLFAALFLILALVVVGEVA

SEQ ID NO: 1378948 - protein, 17 aa, Mycobacterium tuberculosis
SRIAERFAEGHLSERMP

SEQ ID NO: 1378949 - protein, 17 aa, Mycobacterium tuberculosis
STIARRQLRLIVSDRGY

SEQ ID NO: 1378950 - protein, 18 aa, Mycobacterium tuberculosis
SVILPWPSVEVAVAVVAV

SEQ ID NO: 1378951 - protein, 27 aa, Mycobacterium tuberculosis
TAAEWWRLGLMFAVIVALHLVGWLTVT

SEQ ID NO: 1378952 - protein, 17 aa, Mycobacterium tuberculosis
TAIPMGVPLEWNVFMIF

SEQ ID NO: 1378953 - protein, 17 aa, Mycobacterium tuberculosis
TALQLPLSVVLIDAGER

SEQ ID NO: 1378954 - protein, 24 aa, Mycobacterium tuberculosis
TAPADRFGSCREFADAMNEQAGVA

SEQ ID NO: 1378955 - protein, 29 aa, Mycobacterium tuberculosis
TDEPRPAKRSTLREFAVLAVIAVVLYYVM

SEQ ID NO: 1378956 - protein, 24 aa, Mycobacterium tuberculosis
TDKSDLLEAIGMRLRDMLWAAIFP

SEQ ID NO: 1378957 - protein, 24 aa, Mycobacterium tuberculosis
TDPDELIALLGPVLADRPAFTGQP

SEQ ID NO: 1378958 - protein, 21 aa, Mycobacterium tuberculosis
TGAETLRFKGYLIMSRNSSHD

SEQ ID NO: 1378959 - protein, 22 aa, Mycobacterium tuberculosis
TGRLRPGEPAGHIQEPVSPPTQ

SEQ ID NO: 1378960 - protein, 25 aa, Mycobacterium tuberculosis
TIALASLWLSGPLQLGLGAIQLVLL

SEQ ID NO: 1378961 - protein, 23 aa, Mycobacterium tuberculosis
TKALRVGYVAAFSVPANQLPQTV

SEQ ID NO: 1378962 - protein, 22 aa, Mycobacterium tuberculosis
TKFTLLMALPWLSAVAAVYVVF

SEQ ID NO: 1378963 - protein, 21 aa, Mycobacterium tuberculosis
TLADLYGRRRWYLIGVSLFTL

SEQ ID NO: 1378964 - protein, 28 aa, Mycobacterium tuberculosis
TLLPAILTLTGRRGWIKPRRDLTSRMWR

SEQ ID NO: 1378965 - protein, 20 aa, Mycobacterium tuberculosis
TLPATVFVAFQLMFAIITVA

SEQ ID NO: 1378966 - protein, 18 aa, Mycobacterium tuberculosis
TPAPYGPLFLWIGRGISS

SEQ ID NO: 1378967 - protein, 17 aa, Mycobacterium tuberculosis
TPARAGLVGAVLVVVRP

SEQ ID NO: 1378968 - protein, 17 aa, Mycobacterium tuberculosis
TQYTRHVERFFAESWAR

SEQ ID NO: 1378969 - protein, 18 aa, Mycobacterium tuberculosis
TRAVIRYDNLFGDRYLAL

SEQ ID NO: 1378970 - protein, 23 aa, Mycobacterium tuberculosis
TRPVGSWFLGRFADRRGRRAALT

SEQ ID NO: 1378971 - protein, 20 aa, Mycobacterium tuberculosis
TSSPGRCDMSPIPRIVSVSL

SEQ ID NO: 1378972 - protein, 20 aa, Mycobacterium tuberculosis
TTIALLVRWLVARRAAAFMH

SEQ ID NO: 1378973 - protein, 18 aa, Mycobacterium tuberculosis
TTRRARRKASRPAGPAEG

SEQ ID NO: 1378974 - protein, 25 aa, Mycobacterium tuberculosis
TVFGRGDIALGWAFLGAGIGSLVRP

SEQ ID NO: 1378975 - protein, 30 aa, Mycobacterium tuberculosis; identical to SEQ ID NO: 160187

SEQ ID NO: 1378976 - protein, 19 aa, Mycobacterium tuberculosis
VAHCAWVRGRNDHINIDGT

SEQ ID NO: 1378977 - protein, 17 aa, Mycobacterium tuberculosis
VAMVAYLVMLGRVAVAM

SEQ ID NO: 1378978 - protein, 19 aa, Mycobacterium tuberculosis
VAQSYWARIQLFLHGGDFG

SEQ ID NO: 1378979 - protein, 17 aa, Mycobacterium tuberculosis
VARLEFPGKRLLIGAAL

SEQ ID NO: 1378980 - protein, 27 aa, Mycobacterium tuberculosis
VAVAPRIGAWVVAAWLAGIILNLVTGP

SEQ ID NO: 1378981 - protein, 18 aa, Mycobacterium tuberculosis
VAVICLLAWSLSGLVGPS

SEQ ID NO: 1378982 - protein, 17 aa, Mycobacterium tuberculosis
VCGHSSCAAMTALLEDD

SEQ ID NO: 1378983 - protein, 19 aa, Mycobacterium tuberculosis
VDIARVPDCAVVGAAAGGV

SEQ ID NO: 1378984 - protein, 18 aa, Mycobacterium tuberculosis
VDNVRRYQIEPALHDGDY

SEQ ID NO: 1378985 - protein, 18 aa, Mycobacterium tuberculosis
VFDNPDFQRGLEQFLSPD

SEQ ID NO: 1378986 - protein, 18 aa, Mycobacterium tuberculosis
VGASRWYTQLPFLVEAML

SEQ ID NO: 1378987 - protein, 41 aa, Mycobacterium tuberculosis
VGCLAGLVGIGWLWRHGRFRRLARLGGLVLVSAFTVVTLGM

SEQ ID NO: 1378988 - protein, 23 aa, Mycobacterium tuberculosis
VGGRLFGRFDLAVAVFFAVSGFL

SEQ ID NO: 1378989 - protein, 18 aa, Mycobacterium tuberculosis
VGSYRKTRLVPFGEYVPL

SEQ ID NO: 1378990 - protein, 19 aa, Mycobacterium tuberculosis
VGVAVGRWLVDRQLAKAPV

SEQ ID NO: 1378991 - protein, 24 aa, Mycobacterium tuberculosis
VGVPRGRVGIGLKLTGGRTAQAWA

SEQ ID NO: 1378992 - protein, 25 aa, Mycobacterium tuberculosis
VIVGWLTLWPFLSWLTTHFVVTNRR

SEQ ID NO: 1378993 - protein, 17 aa, Mycobacterium tuberculosis
VKDGQPFIPADCLAKGG

SEQ ID NO: 1378994 - protein, 20 aa, Mycobacterium tuberculosis
VLAWRDSWEYWTHTLHHTDR

SEQ ID NO: 1378995 - protein, 18 aa, Mycobacterium tuberculosis
VLHRAWVGPMVLVVLDDP

SEQ ID NO: 1378996 - protein, 30 aa, Mycobacterium tuberculosis
VLPWICAPLAIAVMWRWIVAPTDGAISTVL

SEQ ID NO: 1378997 - protein, 18 aa, Mycobacterium tuberculosis
VLVALALTNYGAKTAAKT

SEQ ID NO: 1378998 - protein, 22 aa, Mycobacterium tuberculosis
VLVLRRRVGLVAQAPVVLTDAV

SEQ ID NO: 1378999 - protein, 20 aa, Mycobacterium tuberculosis
VLWCLLWLLAGVALGYVAWR

SEQ ID NO: 1379000 - protein, 22 aa, Mycobacterium tuberculosis
VMGGVVIWGRVKPVRLMGSMVS

SEQ ID NO: 1379001 - protein, 19 aa, Mycobacterium tuberculosis
VPDAMRAVFGTRLLPREYA

SEQ ID NO: 1379002 - protein, 20 aa, Mycobacterium tuberculosis
VPLSLLVTRAITRRSQPLFV

SEQ ID NO: 1379003 - protein, 19 aa, Mycobacterium tuberculosis
VPWLLSFAQPSIWQIGRPW

SEQ ID NO: 1379004 - protein, 20 aa, Mycobacterium tuberculosis
VRARCFLQGDSLYVAGVSGL

SEQ ID NO: 1379005 - protein, 20 aa, Mycobacterium tuberculosis
VRGARNIPCETVPGKRAPTV

SEQ ID NO: 1379006 - protein, 21 aa, Mycobacterium tuberculosis
VRHPIMLGFVVAFWATPMMTA

SEQ ID NO: 1379007 - protein, 29 aa, Mycobacterium tuberculosis
VSGWRFLLRRLEHAIVRRDTRMFDDPLQF

SEQ ID NO: 1379008 - protein, 20 aa, Mycobacterium tuberculosis
VSKEIIYFLAQLDVKEIHGY

SEQ ID NO: 1379009 - protein, 20 aa, Mycobacterium tuberculosis
VSPLPSLAKRAADILRQDVG

SEQ ID NO: 1379010 - protein, 21 aa, Mycobacterium tuberculosis
VSRRGEMSYSFADLKANGLSL

SEQ ID NO: 1379011 - protein, 19 aa, Mycobacterium tuberculosis
VTGCTRGPTVTRYEVELGP

SEQ ID NO: 1379012 - protein, 27 aa, Mycobacterium tuberculosis
VTLYLRLGDWVPVTAFVVMGAGFAVFL

SEQ ID NO: 1379013 - protein, 31 aa, Mycobacterium tuberculosis; identical to SEQ ID NO: 159610

SEQ ID NO: 1379014 - protein, 33 aa, Mycobacterium tuberculosis; identical to SEQ ID NO: 159615

SEQ ID NO: 1379015 - protein, 23 aa, Mycobacterium tuberculosis
VVSLGVGIVGWFHRQPHDKPSPA

SEQ ID NO: 1379016 - protein, 24 aa, Mycobacterium tuberculosis
VYRAVLNFRRGWDIYNEHFDYVDP

SEQ ID NO: 1379017 - protein, 18 aa, Mycobacterium tuberculosis
WAFLIWGMYAYLWAFVLY

SEQ ID NO: 1379018 - protein, 20 aa, Mycobacterium tuberculosis
WFSLPECVYYVVGIASIALG

SEQ ID NO: 1379019 - protein, 20 aa, Mycobacterium tuberculosis
WLSPSRWAYAMAAATVDLND

SEQ ID NO: 1379020 - protein, 24 aa, Mycobacterium tuberculosis
WQIGRPWYLAWAGLVYVVATLATL

SEQ ID NO: 1379021 - protein, 19 aa, Mycobacterium tuberculosis
WWSLVSLLAMNWIALISNF

SEQ ID NO: 1379022 - protein, 18 aa, Mycobacterium tuberculosis
WYAAMLFAVIPLRNALPD

SEQ ID NO: 1379023 - protein, 19 aa, Mycobacterium tuberculosis
YAWTDWRFTQLREWFHRQV

SEQ ID NO: 1379024 - protein, 21 aa, Mycobacterium tuberculosis
YELDAAKLLDFPVMTDMRDPL

SEQ ID NO: 1379025 - protein, 17 aa, Mycobacterium tuberculosis
YLPPGRSAYVAARSLSG

SEQ ID NO: 1379026 - protein, 20 aa, Mycobacterium tuberculosis
YPERRRLAPPRGKSVVHEPI

SEQ ID NO: 1379027 - protein, 25 aa, Mycobacterium tuberculosis
YPIVCAAGLCWAAKALFGRYVVQRS

SEQ ID NO: 1379028 - protein, 18 aa, Mycobacterium tuberculosis
YQIEPALHDGDYSGAAVA

SEQ ID NO: 1379029 - protein, 18 aa, Mycobacterium tuberculosis
YRPGYNDRYYLRAGTPVN

SEQ ID NO: 1379030 - protein, 23 aa, Mycobacterium tuberculosis
YTRSEGGGMLVLKRVDDARRDGD

SEQ ID NO: 1379031 - protein, 30 aa, Mycobacterium tuberculosis; identical to SEQ ID NO: 160237

SEQ ID NO: 1379032 - protein, 31 aa, Mycobacterium tuberculosis
YVLPWICAPLAIAVMWRWIVAPTDGAISTVL

SEQ ID NO: 1379033 - protein, 25 aa, Mycobacterium tuberculosis
AAALARTTRWGSFLPDIDAFDAEFF

SEQ ID NO: 1379034 - protein, 19 aa, Mycobacterium tuberculosis
AAAVGARLMQLRGRRSATS

SEQ ID NO: 1379035 - protein, 17 aa, Mycobacterium tuberculosis
AADVGLHVIFTRTFGGW

SEQ ID NO: 1379036 - protein, 20 aa, Mycobacterium tuberculosis
AAGVVPEWLAYTVAVVLGVT

SEQ ID NO: 1379037 - protein, 26 aa, Mycobacterium tuberculosis
ADAAASLWHPHIVAVHDRGEFDGQLW

SEQ ID NO: 1379038 - protein, 21 aa, Mycobacterium tuberculosis
ADRPTPPWRPGAWAAAGVLAA

SEQ ID NO: 1379039 - protein, 17 aa, Mycobacterium tuberculosis
ADTGARIILACGFDSIP

SEQ ID NO: 1379040 - protein, 20 aa, Mycobacterium tuberculosis
AEPKRYVVVPGVGHNDPELL

SEQ ID NO: 1379041 - protein, 27 aa, Mycobacterium tuberculosis
AEWQRNVRWARWLAWVSLAVLLTEGAV

SEQ ID NO: 1379042 - protein, 25 aa, Mycobacterium tuberculosis
AFHNEFTQRLAAAAKAFVNAEATNT

SEQ ID NO: 1379043 - protein, 24 aa, Mycobacterium tuberculosis
AFTSARAREVLVALGQLAAAVVVA

SEQ ID NO: 1379044 - protein, 24 aa, Mycobacterium tuberculosis
AGLGVLWLPAGWLAHRLLSVPVTT

SEQ ID NO: 1379045 - protein, 26 aa, Mycobacterium tuberculosis
AGLQTGSSFKVFALVAALEQGIGLGY

SEQ ID NO: 1379046 - protein, 18 aa, Mycobacterium tuberculosis
AHKLCGRDVVVVSASGEE

SEQ ID NO: 1379047 - protein, 37 aa, Mycobacterium tuberculosis
AKAGGLFDRIGNFVVRWPLIVIGCWIAVAAALTLLLP

SEQ ID NO: 1379048 - protein, 26 aa, Mycobacterium tuberculosis
AKELVIATKMSGEWSKDDVLQAYLNI

SEQ ID NO: 1379049 - protein, 36 aa, Mycobacterium tuberculosis
ALANAKRWGVLHVIWRQGYYPGIGAPSWTADYGSET

SEQ ID NO: 1379050 - protein, 20 aa, Mycobacterium tuberculosis
ALRPLRRVAATAAEVATMPL

SEQ ID NO: 1379051 - protein, 17 aa, Mycobacterium tuberculosis
ANHAIHGVLIATNFFGI

SEQ ID NO: 1379052 - protein, 21 aa, Mycobacterium tuberculosis
APLPKGTYCRIPMDASNVVRG

SEQ ID NO: 1379053 - protein, 18 aa, Mycobacterium tuberculosis
ARARLVDLDILLLDEATV

SEQ ID NO: 1379054 - protein, 26 aa, Mycobacterium tuberculosis
ARDLQRPDAPWGRPWVVYLQHASDPI

SEQ ID NO: 1379055 - protein, 24 aa, Mycobacterium tuberculosis
ASRERVVAVSFPRDLAITPIQCEA

SEQ ID NO: 1379056 - protein, 28 aa, Mycobacterium tuberculosis
ASSQFSVRLLRTFLRDVPNQVVLAIFAC

SEQ ID NO: 1379057 - protein, 23 aa, Mycobacterium tuberculosis
ATLPGIGTLAAWFAAAGEVVVFL

SEQ ID NO: 1379058 - protein, 21 aa, Mycobacterium tuberculosis
AVPTRNALALGLTLTVISFFW

SEQ ID NO: 1379059 - protein, 17 aa, Mycobacterium tuberculosis
AVSYGNEAPKFFNSKGE

SEQ ID NO: 1379060 - protein, 17 aa, Mycobacterium tuberculosis
AVVPRIEFDDVAFGYDG

SEQ ID NO: 1379061 - protein, 20 aa, Mycobacterium tuberculosis
CGVAVCALIAYLVGQSKGYF

SEQ ID NO: 1379062 - protein, 25 aa, Mycobacterium tuberculosis
CLTLKGFTYSQMRLPGGDTVDVYNL

SEQ ID NO: 1379063 - protein, 20 aa, Mycobacterium tuberculosis
DAPLNWCNPSGRALGAPPTT

SEQ ID NO: 1379064 - protein, 20 aa, Mycobacterium tuberculosis
DDLLNALIDFLAAVRNGLVP

SEQ ID NO: 1379065 - protein, 17 aa, Mycobacterium tuberculosis
DFGRLKALGRMESKPLR

SEQ ID NO: 1379066 - protein, 21 aa, Mycobacterium tuberculosis
DGLPFSWTVASWTQHSSNLTV

SEQ ID NO: 1379067 - protein, 17 aa, Mycobacterium tuberculosis
DGVIWARYNVPWQPAFV

SEQ ID NO: 1379068 - protein, 18 aa, Mycobacterium tuberculosis
DKRLLPYMIGAFLLIVGA

SEQ ID NO: 1379069 - protein, 28 aa, Mycobacterium tuberculosis
DMSTAAVLRARFPRAVANLRQYGGAAAR

SEQ ID NO: 1379070 - protein, 19 aa, Mycobacterium tuberculosis
DNLRGKWRVTPGVAATGNL

SEQ ID NO: 1379071 - protein, 20 aa, Mycobacterium tuberculosis
DQPLLTGWLVRRTLLVSTLL

SEQ ID NO: 1379072 - protein, 19 aa, Mycobacterium tuberculosis
DQPQSLWPRPARSTQPVQR

SEQ ID NO: 1379073 - protein, 17 aa, Mycobacterium tuberculosis
DRMVRAIWVLRALLREY

SEQ ID NO: 1379074 - protein, 27 aa, Mycobacterium tuberculosis
DRVELLKLAVLLALWAAVAGAFVSVLY

SEQ ID NO: 1379075 - protein, 28 aa, Mycobacterium tuberculosis
DTRGRRLAWCSAEFNGAIVVNVPLASNV

SEQ ID NO: 1379076 - protein, 24 aa, Mycobacterium tuberculosis
DVAKYFAIIPAMFVGLYPVLDKLN

SEQ ID NO: 1379077 - protein, 21 aa, Mycobacterium tuberculosis
EALFRPMHDRLASAVVAEAHR

SEQ ID NO: 1379078 - protein, 19 aa, Mycobacterium tuberculosis
EDFTWKGMLDFATCTECGR

SEQ ID NO: 1379079 - protein, 18 aa, Mycobacterium tuberculosis
EELAAEWELPIVLDSAAG

SEQ ID NO: 1379080 - protein, 17 aa, Mycobacterium tuberculosis
EEVSAWAVTAFTTAATG

SEQ ID NO: 1379081 - protein, 27 aa, Mycobacterium tuberculosis
EGFTRLWPTVGCLVGYGIAFALLALSI

SEQ ID NO: 1379082 - protein, 20 aa, Mycobacterium tuberculosis
EGGTVGPVRFDACDPDGNRM

SEQ ID NO: 1379083 - protein, 19 aa, Mycobacterium tuberculosis
EKIEQRYSLGMVAATLALI

SEQ ID NO: 1379084 - protein, 19 aa, Mycobacterium tuberculosis
EKLAALLTQPGRTYDVSSP

SEQ ID NO: 1379085 - protein, 17 aa, Mycobacterium tuberculosis
ELLRPGVLLMSASSSDR

SEQ ID NO: 1379086 - protein, 25 aa, Mycobacterium tuberculosis
EPPTLLWPIGVPFSDGLNTLSEFKV

SEQ ID NO: 1379087 - protein, 21 aa, Mycobacterium tuberculosis
EVAMGLSFATVFLMAGTMSTS

SEQ ID NO: 1379088 - protein, 28 aa, Mycobacterium tuberculosis
EVIVNLGYGDPRFGYSTSPANVPTPFGL

SEQ ID NO: 1379089 - protein, 17 aa, Mycobacterium tuberculosis
FDHYRSGPITVQLYRGA

SEQ ID NO: 1379090 - protein, 34 aa, Mycobacterium tuberculosis
FGPRLVDIYVDWLWFGEVGFRSVWITVLLTRLAI

SEQ ID NO: 1379091 - protein, 24 aa, Mycobacterium tuberculosis
FIMGRIKDLLIVDGRNHYPDDIEA

SEQ ID NO: 1379092 - protein, 17 aa, Mycobacterium tuberculosis
FKDHLYIAGRIKDLVII

SEQ ID NO: 1379093 - protein, 22 aa, Mycobacterium tuberculosis
FLTGTGIGWVLARGWRRPTALA

SEQ ID NO: 1379094 - protein, 17 aa, Mycobacterium tuberculosis
FPWVFLFPASILVLILV

SEQ ID NO: 1379095 - protein, 17 aa, Mycobacterium tuberculosis
FQRVFGAGIATLVAVAA

SEQ ID NO: 1379096 - protein, 17 aa, Mycobacterium tuberculosis
FRISLVSPTTVRGGCGY

SEQ ID NO: 1379097 - protein, 18 aa, Mycobacterium tuberculosis
FSDGLNTLSEFKVQRLDR

SEQ ID NO: 1379098 - protein, 19 aa, Mycobacterium tuberculosis
FSVLSLPTTLIFDVDGRQR

SEQ ID NO: 1379099 - protein, 18 aa, Mycobacterium tuberculosis
FVFFFPFTDQIAAFKIIM

SEQ ID NO: 1379100 - protein, 17 aa, Mycobacterium tuberculosis
FWRTGRRQLADRPTPPW

SEQ ID NO: 1379101 - protein, 26 aa, Mycobacterium tuberculosis
GAAARRRLVKLGAWVAAQLPTTRTAV

SEQ ID NO: 1379102 - protein, 25 aa, Mycobacterium tuberculosis
GAALAAHCVHRFGGVTGDVLGSAIE

SEQ ID NO: 1379103 - protein, 23 aa, Mycobacterium tuberculosis
GAALEHRGFESLFLAEHTHIPVN

SEQ ID NO: 1379104 - protein, 26 aa, Mycobacterium tuberculosis
GAANRDGRRLMTVLLHGTRQPIPPWE

SEQ ID NO: 1379105 - protein, 17 aa, Mycobacterium tuberculosis
GAVALAVIAALAVLVTV

SEQ ID NO: 1379106 - protein, 17 aa, Mycobacterium tuberculosis
GDCPRSRTVRWSWDTGH

SEQ ID NO: 1379107 - protein, 17 aa, Mycobacterium tuberculosis
GDGARLVTTMTRHPGGA

SEQ ID NO: 1379108 - protein, 25 aa, Mycobacterium tuberculosis
GDQRVLGAALWYAATVKDAVIVAAA

SEQ ID NO: 1379109 - protein, 21 aa, Mycobacterium tuberculosis
GEHRDGGAFIPKVAVTGSLAL

SEQ ID NO: 1379110 - protein, 18 aa, Mycobacterium tuberculosis
GELQRLALAAALAREPAM

SEQ ID NO: 1379111 - protein, 22 aa, Mycobacterium tuberculosis
GGLSRIGDWWTQPIVYQKVIVF

SEQ ID NO: 1379112 - protein, 18 aa, Mycobacterium tuberculosis
GHLWSWELAIPMSGIAMA

SEQ ID NO: 1379113 - protein, 31 aa, Mycobacterium tuberculosis
GHVHMAGLPGWRAMFVIEALAALLLAPLLRR

SEQ ID NO: 1379114 - protein, 22 aa, Mycobacterium tuberculosis
GILVGVAFVHWLIFQSLYRIGA

SEQ ID NO: 1379115 - protein, 21 aa, Mycobacterium tuberculosis
GIPVAALIHVYTYRKLSGGQV

SEQ ID NO: 1379116 - protein, 25 aa, Mycobacterium tuberculosis
GIVDPEFGYDIGFFVFDLPFYRSVL

SEQ ID NO: 1379117 - protein, 18 aa, Mycobacterium tuberculosis
GKILRAALNPDLSLSPIA

SEQ ID NO: 1379118 - protein, 18 aa, Mycobacterium tuberculosis
GLCRAAKALFGRYVVQRS

SEQ ID NO: 1379119 - protein, 18 aa, Mycobacterium tuberculosis
GLGAVVFYLALKYTSEFL

SEQ ID NO: 1379120 - protein, 17 aa, Mycobacterium tuberculosis
GLLHWSVPMLVRRLITL

SEQ ID NO: 1379121 - protein, 25 aa, Mycobacterium tuberculosis
GLPGFPEFPAIPGFPALPGLPSIPN

SEQ ID NO: 1379122 - protein, 24 aa, Mycobacterium tuberculosis
GLPLWPYLVCAALTGLGGGNFASS

SEQ ID NO: 1379123 - protein, 19 aa, Mycobacterium tuberculosis
GLQVKTIWVARAVSVLFPQ

SEQ ID NO: 1379124 - protein, 19 aa, Mycobacterium tuberculosis
GLSCKELTGDIARRPIADA

SEQ ID NO: 1379125 - protein, 18 aa, Mycobacterium tuberculosis
GLVVAAVWAVGLVAGLVA

SEQ ID NO: 1379126 - protein, 17 aa, Mycobacterium tuberculosis
GLVVRWVVASALGGPLL

SEQ ID NO: 1379127 - protein, 18 aa, Mycobacterium tuberculosis
GPALDAVYLPPGRSAYVA

SEQ ID NO: 1379128 - protein, 17 aa, Mycobacterium tuberculosis
GRGMARLAMKIHARPKL

SEQ ID NO: 1379129 - protein, 19 aa, Mycobacterium tuberculosis
GRGQRRCGTITVSMSTHND

SEQ ID NO: 1379130 - protein, 29 aa, Mycobacterium tuberculosis
GRPGCAPGPDGVRCAASMALAPEEPANLS

SEQ ID NO: 1379131 - protein, 22 aa, Mycobacterium tuberculosis
GSQIPALVAYTVFTAALVFGVA

SEQ ID NO: 1379132 - protein, 17 aa, Mycobacterium tuberculosis
GSWPGWYAGVIELVAGL

SEQ ID NO: 1379133 - protein, 26 aa, Mycobacterium tuberculosis
GTATVTRLALAIAAIASAANRPLRRV

SEQ ID NO: 1379134 - protein, 19 aa, Mycobacterium tuberculosis
GVAIGLVVAIVFLLVRVVR

SEQ ID NO: 1379135 - protein, 17 aa, Mycobacterium tuberculosis
GVLPVLALMVVAVWLLG

SEQ ID NO: 1379136 - protein, 22 aa, Mycobacterium tuberculosis
GVRVGGLFAALGVTSVVIGLML

SEQ ID NO: 1379137 - protein, 25 aa, Mycobacterium tuberculosis
GWVTQRLWWAVLLTVGFWGLLRVAE

SEQ ID NO: 1379138 - protein, 23 aa, Mycobacterium tuberculosis
GYLREFGNLVFHFALLGLLVAVA

SEQ ID NO: 1379139 - protein, 17 aa, Mycobacterium tuberculosis
HAVLPLRPESLRRLDRV

SEQ ID NO: 1379140 - protein, 21 aa, Mycobacterium tuberculosis
HEVGHAIGYLRHEPCDQQGGL

SEQ ID NO: 1379141 - protein, 23 aa, Mycobacterium tuberculosis
HGPVVAVAGRFVHTSIRTTVGAL

SEQ ID NO: 1379142 - protein, 20 aa, Mycobacterium tuberculosis
HRYAIWIVGVWALAAIIGNN

SEQ ID NO: 1379143 - protein, 19 aa, Mycobacterium tuberculosis
HSGRVCAMVGDGSNDAAAI

SEQ ID NO: 1379144 - protein, 21 aa, Mycobacterium tuberculosis
HVREDPIPPSARHEGLSADLD

SEQ ID NO: 1379145 - protein, 18 aa, Mycobacterium tuberculosis
IADAALAALGLWLSVAAV

SEQ ID NO: 1379146 - protein, 17 aa, Mycobacterium tuberculosis
IAGIAVWQGIRTWRGHG

SEQ ID NO: 1379147 - protein, 18 aa, Mycobacterium tuberculosis
IAPGVVTTWMKLAIRDRI

SEQ ID NO: 1379148 - protein, 21 aa, Mycobacterium tuberculosis
IDAIICFVGFLFPLWDAKRQT

SEQ ID NO: 1379149 - protein, 26 aa, Mycobacterium tuberculosis
IDDALELRGRILGAFEAAEVSTDHAE

SEQ ID NO: 1379150 - protein, 26 aa, Mycobacterium tuberculosis
IDGYRRLQVRSGYTLFRQGERADHFF

SEQ ID NO: 1379151 - protein, 26 aa, Mycobacterium tuberculosis
IGVLIITVMVCWLLLAVLRGRLHPIG

SEQ ID NO: 1379152 - protein, 24 aa, Mycobacterium tuberculosis
IIGRIKDLLIVYGRNHSPDDIEAT

SEQ ID NO: 1379153 - protein, 17 aa, Mycobacterium tuberculosis
IILYWFSNNIWTFGQQH

SEQ ID NO: 1379154 - protein, 18 aa, Mycobacterium tuberculosis
ILEGFDFGVGMLMAPFAH

SEQ ID NO: 1379155 - protein, 18 aa, Mycobacterium tuberculosis
ILMLLPLSAFEATVALPA

SEQ ID NO: 1379156 - protein, 27 aa, Mycobacterium tuberculosis
ILVAIALVIGGIGGVIGRKTAEVVDAF

SEQ ID NO: 1379157 - protein, 28 aa, Mycobacterium tuberculosis
ILVAIALVIGGIGGVIGRKTAEVVDAFT

SEQ ID NO: 1379158 - protein, 19 aa, Mycobacterium tuberculosis
INEARWVRGAVPFEGDVGS

SEQ ID NO: 1379159 - protein, 24 aa, Mycobacterium tuberculosis
INHEVGHAIGYLRHEPCDQQGGLA

SEQ ID NO: 1379160 - protein, 18 aa, Mycobacterium tuberculosis
IPLLGHLWSWELAIPMSG

SEQ ID NO: 1379161 - protein, 19 aa, Mycobacterium tuberculosis
IPVAALIHVYTYRKLSGGQ

SEQ ID NO: 1379162 - protein, 19 aa, Mycobacterium tuberculosis
IRTAELVAIVSVGGGANIP

SEQ ID NO: 1379163 - protein, 17 aa, Mycobacterium tuberculosis
KGGSAVKPFAGVPHVSR

SEQ ID NO: 1379164 - protein, 19 aa, Mycobacterium tuberculosis
KLLEGIEMIPPRYVEYRGA

SEQ ID NO: 1379165 - protein, 20 aa, Mycobacterium tuberculosis
KMMIAPVIFCTIVLGIGSVR

SEQ ID NO: 1379166 - protein, 21 aa, Mycobacterium tuberculosis
KRIGQVGALAVVLGVGAAVTT

SEQ ID NO: 1379167 - protein, 18 aa, Mycobacterium tuberculosis
KTNPWPFVAVAAAVVLVL

SEQ ID NO: 1379168 - protein, 18 aa, Mycobacterium tuberculosis
KVPPDFGERGRRDLYHFT

SEQ ID NO: 1379169 - protein, 25 aa, Mycobacterium tuberculosis
LAAGWRSRHWQRRWLPTAAAIGATL

SEQ ID NO: 1379170 - protein, 23 aa, Mycobacterium tuberculosis
LAAPLLRPGYLLLRDAVSTPRSY

SEQ ID NO: 1379171 - protein, 18 aa, Mycobacterium tuberculosis
LAAVAMFLGFVAPALSLS

SEQ ID NO: 1379172 - protein, 17 aa, Mycobacterium tuberculosis
LAFGLMAALLLDATVVR

SEQ ID NO: 1379173 - protein, 21 aa, Mycobacterium tuberculosis
LAIGIAVSFLAAVTLLPAILV

SEQ ID NO: 1379174 - protein, 25 aa, Mycobacterium tuberculosis
LALLPLLALLAFWRTGRRQLADRPT

SEQ ID NO: 1379175 - protein, 18 aa, Mycobacterium tuberculosis
LALPGYRPGYNDRYYLRA

SEQ ID NO: 1379176 - protein, 18 aa, Mycobacterium tuberculosis
LALYGSDWITSTGRRFAG

SEQ ID NO: 1379177 - protein, 17 aa, Mycobacterium tuberculosis
LANRLFIPQVMFSTLFC

SEQ ID NO: 1379178 - protein, 24 aa, Mycobacterium tuberculosis
LAVPEMKELLASKDNKAWNLPITF

SEQ ID NO: 1379179 - protein, 20 aa, Mycobacterium tuberculosis
LDKIFYRSGQGVTLQAVSYG

SEQ ID NO: 1379180 - protein, 17 aa, Mycobacterium tuberculosis
LDRVDAIVIDPRVLCTD

SEQ ID NO: 1379181 - protein, 18 aa, Mycobacterium tuberculosis
LDRVRVVVIDGAALRGDN

SEQ ID NO: 1379182 - protein, 23 aa, Mycobacterium tuberculosis
LDRWLLFNWMRWGRALEYLKITY

SEQ ID NO: 1379183 - protein, 29 aa, Mycobacterium tuberculosis
LFKGIARGVKEFAPLIGVRKAGLFTSSSF

SEQ ID NO: 1379184 - protein, 18 aa, Mycobacterium tuberculosis
LGAAWRVLHAIPAARAAR

SEQ ID NO: 1379185 - protein, 19 aa, Mycobacterium tuberculosis
LGFVMPGDIPFQVQLPSTP

SEQ ID NO: 1379186 - protein, 25 aa, Mycobacterium tuberculosis
LHDELFDACGWRRLIFATPEELEAA

SEQ ID NO: 1379187 - protein, 20 aa, Mycobacterium tuberculosis
LHRAKGGGLSTLFGGGVQSS

SEQ ID NO: 1379188 - protein, 31 aa, Mycobacterium tuberculosis
LIRTMALRGARCCFRRSPWRCRCRRLRCSRC

SEQ ID NO: 1379189 - protein, 17 aa, Mycobacterium tuberculosis
LKALGRMESKPLRRGQK

SEQ ID NO: 1379190 - protein, 21 aa, Mycobacterium tuberculosis
LKVLRERDAMVAKTLADNKKS

SEQ ID NO: 1379191 - protein, 19 aa, Mycobacterium tuberculosis
LLFVYRSVVTMVLVLITVL

SEQ ID NO: 1379192 - protein, 17 aa, Mycobacterium tuberculosis
LLLRTEVRRVEPVQRPA

SEQ ID NO: 1379193 - protein, 19 aa, Mycobacterium tuberculosis
LLNGVVLKFAMNSMNSTFA

SEQ ID NO: 1379194 - protein, 21 aa, Mycobacterium tuberculosis
LNGLRLLRHTAWRRAAGTAHR

SEQ ID NO: 1379195 - protein, 19 aa, Mycobacterium tuberculosis
LNLPPPCTTGFLPAQQRRI

SEQ ID NO: 1379196 - protein, 23 aa, Mycobacterium tuberculosis
LPDWSPTSSRTWATKVLAAHPGD

SEQ ID NO: 1379197 - protein, 17 aa, Mycobacterium tuberculosis
LPLRRLLLDHYPSIERI

SEQ ID NO: 1379198 - protein, 22 aa, Mycobacterium tuberculosis
LPRSEALKVLAAELSRDLDFRA

SEQ ID NO: 1379199 - protein, 28 aa, Mycobacterium tuberculosis
LPVVTWAAWPFHRVAMRNARHHAASMET

SEQ ID NO: 1379200 - protein, 19 aa, Mycobacterium tuberculosis
LRDPPAYGSWLLGWVSERP

SEQ ID NO: 1379201 - protein, 19 aa, Mycobacterium tuberculosis
LRIASRVGTGVGFAEDQVF

SEQ ID NO: 1379202 - protein, 19 aa, Mycobacterium tuberculosis
LRPWMTMSVPRGAKGMTVD

SEQ ID NO: 1379203 - protein, 17 aa, Mycobacterium tuberculosis
LRREPREAIIACYVAME

SEQ ID NO: 1379204 - protein, 17 aa, Mycobacterium tuberculosis
LSPFSGYLTLAFLAGVL

SEQ ID NO: 1379205 - protein, 23 aa, Mycobacterium tuberculosis
LSRLPLLSIDGYRRLQVRSGYTL

SEQ ID NO: 1379206 - protein, 20 aa, Mycobacterium tuberculosis
LSVLMLVGGILFQIVTGVLN

SEQ ID NO: 1379207 - protein, 25 aa, Mycobacterium tuberculosis
LTFSVLAAYAFARLQFRGRDALFWV

SEQ ID NO: 1379208 - protein, 18 aa, Mycobacterium tuberculosis
LTLAAWGAWRPHYRAASY

SEQ ID NO: 1379209 - protein, 20 aa, Mycobacterium tuberculosis
LTPRQPWAWLALLVAGLTVG

SEQ ID NO: 1379210 - protein, 25 aa, Mycobacterium tuberculosis
LVFGLFVRKGWDIVIGLVVLFVYGG

SEQ ID NO: 1379211 - protein, 17 aa, Mycobacterium tuberculosis
LVSQGRFRFGVGVGWLR

SEQ ID NO: 1379212 - protein, 18 aa, Mycobacterium tuberculosis
LVYTELWVGFTAVSALLI

SEQ ID NO: 1379213 - protein, 19 aa, Mycobacterium tuberculosis
MEVLALPLVAVVLFFVFGG

SEQ ID NO: 1379214 - protein, 17 aa, Mycobacterium tuberculosis
MGLLGLVGSEAVVDARL

SEQ ID NO: 1379215 - protein, 17 aa, Mycobacterium tuberculosis
MGRLEPFAFTAVDVLIL

SEQ ID NO: 1379216 - protein, 21 aa, Mycobacterium tuberculosis
MLTTLPKFPGLPGLPSLPDII

SEQ ID NO: 1379217 - protein, 19 aa, Mycobacterium tuberculosis
MMLLNVLKPTGIVGDSAII

SEQ ID NO: 1379218 - protein, 23 aa, Mycobacterium tuberculosis
NADRGMPLLVLVVMAQLVLCGGM

SEQ ID NO: 1379219 - protein, 17 aa, Mycobacterium tuberculosis
NLIKMMIAPVIFCTIVL

SEQ ID NO: 1379220 - protein, 18 aa, Mycobacterium tuberculosis
NLPPPCTTGFLPAQQRRI

SEQ ID NO: 1379221 - protein, 26 aa, Mycobacterium tuberculosis
PAGRLRGGCYFAFMGVAWVLLAISAI

SEQ ID NO: 1379222 - protein, 17 aa, Mycobacterium tuberculosis
PAGVHFRPFLSALGASV

SEQ ID NO: 1379223 - protein, 17 aa, Mycobacterium tuberculosis
PALAIGIAVSFLAAVTL

SEQ ID NO: 1379224 - protein, 21 aa, Mycobacterium tuberculosis
PDFRISLVSPTTVRGGCGYEF

SEQ ID NO: 1379225 - protein, 17 aa, Mycobacterium tuberculosis
PDGLHVFVTGPGATIVD

SEQ ID NO: 1379226 - protein, 18 aa, Mycobacterium tuberculosis
PELDRGQEAGFTLSAPLR

SEQ ID NO: 1379227 - protein, 17 aa, Mycobacterium tuberculosis
PERVSVTFVDRLPGWNV

SEQ ID NO: 1379228 - protein, 21 aa, Mycobacterium tuberculosis
PESLRRLDRVDAIVIDPRVLC

SEQ ID NO: 1379229 - protein, 18 aa, Mycobacterium tuberculosis
PFGYWSWANLACVVCAIG

SEQ ID NO: 1379230 - protein, 19 aa, Mycobacterium tuberculosis
PFLEKRFTGDYAHHNLLQR

SEQ ID NO: 1379231 - protein, 18 aa, Mycobacterium tuberculosis
PGTKSGDRVGIWVDSAGQ

SEQ ID NO: 1379232 - protein, 20 aa, Mycobacterium tuberculosis
PGTPIWRLVLPFIALGVAGA

SEQ ID NO: 1379233 - protein, 22 aa, Mycobacterium tuberculosis
PHHPHRFDWFGVGLSGAGMFLI

SEQ ID NO: 1379234 - protein, 36 aa, Mycobacterium tuberculosis
PHPIIPRTIRLAAIPILLCWLGFTVFVSVAVPPLEA

SEQ ID NO: 1379235 - protein, 21 aa, Mycobacterium tuberculosis
PILLILCRLVQGFATGGEYGT

SEQ ID NO: 1379236 - protein, 21 aa, Mycobacterium tuberculosis
PIVCAAGLCRAAKALFGRYVV

SEQ ID NO: 1379237 - protein, 19 aa, Mycobacterium tuberculosis
PIVGYLWSWLSRRDRAWRD

SEQ ID NO: 1379238 - protein, 20 aa, Mycobacterium tuberculosis
PLRRGQKMIIGMRGSYGGVV

SEQ ID NO: 1379239 - protein, 21 aa, Mycobacterium tuberculosis
PPCLTGFLPASEWRSPADTST

SEQ ID NO: 1379240 - protein, 18 aa, Mycobacterium tuberculosis
PPPTMPATAMAPRQPPAP

SEQ ID NO: 1379241 - protein, 20 aa, Mycobacterium tuberculosis
PRLDALDVRRLVRRLLGRPD

SEQ ID NO: 1379242 - protein, 36 aa, Mycobacterium tuberculosis
PRPDARYGRPRLSRRARRRVAIALGVLVAAAGIVIA

SEQ ID NO: 1379243 - protein, 20 aa, Mycobacterium tuberculosis
PRTLAASGFTQWSSEPAARA

SEQ ID NO: 1379244 - protein, 25 aa, Mycobacterium tuberculosis
PVLLFCIAFGLSMDYEVFLVSRIRE

SEQ ID NO: 1379245 - protein, 18 aa, Mycobacterium tuberculosis
PVPGAEPVVGGWTGGRIT

SEQ ID NO: 1379246 - protein, 20 aa, Mycobacterium tuberculosis
PVWQSLRHADTWIMSLLYIG

SEQ ID NO: 1379247 - protein, 23 aa, Mycobacterium tuberculosis
QAIKRVGQVFGEFDSDNAVTIVL

SEQ ID NO: 1379248 - protein, 23 aa, Mycobacterium tuberculosis
QDGMRLGGWYFPHTSGGSGPAVL

SEQ ID NO: 1379249 - protein, 18 aa, Mycobacterium tuberculosis
QDGVKRVGGRMVVQQADR

SEQ ID NO: 1379250 - protein, 26 aa, Mycobacterium tuberculosis
QESDRGVSWLPFFHDMGLITVLLASV

SEQ ID NO: 1379251 - protein, 19 aa, Mycobacterium tuberculosis
QFMLRTAPFSHDGWLGDWT

SEQ ID NO: 1379252 - protein, 21 aa, Mycobacterium tuberculosis
QHPGFPGWQALKVLSPAMAAD

SEQ ID NO: 1379253 - protein, 17 aa, Mycobacterium tuberculosis
QKMIIGMRGSYGGVVMI

SEQ ID NO: 1379254 - protein, 19 aa, Mycobacterium tuberculosis
QPIGFGMSVVRQLAHFIDA

SEQ ID NO: 1379255 - protein, 17 aa, Mycobacterium tuberculosis
QRLALAAALAREPAMLI

SEQ ID NO: 1379256 - protein, 20 aa, Mycobacterium tuberculosis
QRPPAALVLRSPFTSLAEVG

SEQ ID NO: 1379257 - protein, 33 aa, Mycobacterium tuberculosis
QTMLNLPAAWQFSRGEGQLVAIIDTGVQPGPRL

SEQ ID NO: 1379258 - protein, 24 aa, Mycobacterium tuberculosis
QVVAEMRKVIWPNRKQTLTYTSVV

SEQ ID NO: 1379259 - protein, 20 aa, Mycobacterium tuberculosis
RAMRAVWMMAAKGTGGAARS

SEQ ID NO: 1379260 - protein, 28 aa, Mycobacterium tuberculosis
RDLIPDLAELLAMRGIDGLPFSWTVASW

SEQ ID NO: 1379261 - protein, 17 aa, Mycobacterium tuberculosis
READAAASLWHPHIVAV

SEQ ID NO: 1379262 - protein, 21 aa, Mycobacterium tuberculosis
REVLPRLGPAVAASKPAYWAA

SEQ ID NO: 1379263 - protein, 17 aa, Mycobacterium tuberculosis
RGQIDKMFALRSYGPDK

SEQ ID NO: 1379264 - protein, 19 aa, Mycobacterium tuberculosis
RGVAVSFWLTAPYLVAESI

SEQ ID NO: 1379265 - protein, 25 aa, Mycobacterium tuberculosis
RHVERFFAESWARLTAGRTARVVLL

SEQ ID NO: 1379266 - protein, 17 aa, Mycobacterium tuberculosis
RKLDIEPIYLLKREVVE

SEQ ID NO: 1379267 - protein, 25 aa, Mycobacterium tuberculosis
RKYTFRKRALIVMAVILVGSAAAAF

SEQ ID NO: 1379268 - protein, 17 aa, Mycobacterium tuberculosis
RLAFMLVAPAAMLMVAV

SEQ ID NO: 1379269 - protein, 23 aa, Mycobacterium tuberculosis
RLARHRPEIPIGVNIGKTKKTPA

SEQ ID NO: 1379270 - protein, 24 aa, Mycobacterium tuberculosis
RLETSCYNPSFGGMDRQSRVFINE

SEQ ID NO: 1379271 - protein, 22 aa, Mycobacterium tuberculosis
RNPRLVKVSVLTMIAVTGHFVS

SEQ ID NO: 1379272 - protein, 33 aa, Mycobacterium tuberculosis
RPVSVTPMVWVRPRQGPKLADLIAAPSTTRASG

SEQ ID NO: 1379273 - protein, 23 aa, Mycobacterium tuberculosis
RQPVIGCAAALVFGGLPALAFPA

SEQ ID NO: 1379274 - protein, 17 aa, Mycobacterium tuberculosis
RRALAATALPDWLHDSM

SEQ ID NO: 1379275 - protein, 19 aa, Mycobacterium tuberculosis
RSRLVFGTLAILLCLVLGV

SEQ ID NO: 1379276 - protein, 17 aa, Mycobacterium tuberculosis
RSRVARIMPAYVVAVVV

SEQ ID NO: 1379277 - protein, 17 aa, Mycobacterium tuberculosis
RTLGLIVVCCYVALVVT

SEQ ID NO: 1379278 - protein, 23 aa, Mycobacterium tuberculosis
RTPAIVISVAWWLATVNLLLGLF

SEQ ID NO: 1379279 - protein, 25 aa, Mycobacterium tuberculosis
RYGGDAWVIREGRRSRIEPTNRAVL

SEQ ID NO: 1379280 - protein, 18 aa, Mycobacterium tuberculosis
RYSLGMVAATLALIVIPL

SEQ ID NO: 1379281 - protein, 18 aa, Mycobacterium tuberculosis
SASLQEWEPQGWKSEERA

SEQ ID NO: 1379282 - protein, 18 aa, Mycobacterium tuberculosis
SCSWKIYVKDGIITWETQ

SEQ ID NO: 1379283 - protein, 24 aa, Mycobacterium tuberculosis
SDYSPVFGCLFKGIARGVKEFAPL

SEQ ID NO: 1379284 - protein, 18 aa, Mycobacterium tuberculosis
SEGLRASIVVPAITNDMP

SEQ ID NO: 1379285 - protein, 20 aa, Mycobacterium tuberculosis
SELRPPVRSGFGSRIELRLA

SEQ ID NO: 1379286 - protein, 23 aa, Mycobacterium tuberculosis
SELWAEAGKLGFLGVNLPEEYGG

SEQ ID NO: 1379287 - protein, 17 aa, Mycobacterium tuberculosis
SFEAKKDIIAYVKVATE

SEQ ID NO: 1379288 - protein, 17 aa, Mycobacterium tuberculosis
SGSPEWNHAYGIAALRA

SEQ ID NO: 1379289 - protein, 18 aa, Mycobacterium tuberculosis
SLTAAFGALVWIFQEGHF

SEQ ID NO: 1379290 - protein, 20 aa, Mycobacterium tuberculosis
SMGGTCAVDLTVMHPTLFSA

SEQ ID NO: 1379291 - protein, 23 aa, Mycobacterium tuberculosis
SMQKIIECGTGDFGAQASLYTST

SEQ ID NO: 1379292 - protein, 25 aa, Mycobacterium tuberculosis
SPLALRVDGLRSRWLGMPAGLRLTV

SEQ ID NO: 1379293 - protein, 18 aa, Mycobacterium tuberculosis
SPWARPGDQGPLARPPAS

SEQ ID NO: 1379294 - protein, 17 aa, Mycobacterium tuberculosis
SPYPARALAGGLHTAKR

SEQ ID NO: 1379295 - protein, 19 aa, Mycobacterium tuberculosis
SRIAERFAEGHLSERMPVR

SEQ ID NO: 1379296 - protein, 22 aa, Mycobacterium tuberculosis
SRPHAPWARWRYTRHPEKMRRA

SEQ ID NO: 1379297 - protein, 19 aa, Mycobacterium tuberculosis
TAEAVARFLSWVYATNPPA

SEQ ID NO: 1379298 - protein, 22 aa, Mycobacterium tuberculosis
TAKGGIVFRVQQELGVPVKLVG

SEQ ID NO: 1379299 - protein, 23 aa, Mycobacterium tuberculosis
TDAEAILGIGDWGVGGIQIAVGK

SEQ ID NO: 1379300 - protein, 23 aa, Mycobacterium tuberculosis
TDRLEAVVMLLAVTVSLLTIPFA

SEQ ID NO: 1379301 - protein, 20 aa, Mycobacterium tuberculosis
TELRTRLLISLAAILVTTIF

SEQ ID NO: 1379302 - protein, 18 aa, Mycobacterium tuberculosis
TGPNSTPVILRCGLDRPA

SEQ ID NO: 1379303 - protein, 23 aa, Mycobacterium tuberculosis
TGVLVGGLWAWIAPPIHAVVAIT

SEQ ID NO: 1379304 - protein, 22 aa, Mycobacterium tuberculosis
TGVMRRSRLIGVSFAVGLIVLL

SEQ ID NO: 1379305 - protein, 20 aa, Mycobacterium tuberculosis
TIARWLLTRRSVILREVGPE

SEQ ID NO: 1379306 - protein, 22 aa, Mycobacterium tuberculosis
TITLAIGMARMAKRRAVIRRLP

SEQ ID NO: 1379307 - protein, 21 aa, Mycobacterium tuberculosis
TKITVPARWVVNGIERSGEVN

SEQ ID NO: 1379308 - protein, 27 aa, Mycobacterium tuberculosis
TLTLPRPTVVTGLRLAASRSMLPAHPT

SEQ ID NO: 1379309 - protein, 17 aa, Mycobacterium tuberculosis
TNQARRLLAWVGADENV

SEQ ID NO: 1379310 - protein, 19 aa, Mycobacterium tuberculosis
TPIAVNGWQQAWVVPAGNP

SEQ ID NO: 1379311 - protein, 17 aa, Mycobacterium tuberculosis
TPSECRVILLDAAPAVL

SEQ ID NO: 1379312 - protein, 17 aa, Mycobacterium tuberculosis
TPVAWGVLVGFIALYLL

SEQ ID NO: 1379313 - protein, 21 aa, Mycobacterium tuberculosis
TPVLIRLFTKQGFGHQIREDG

SEQ ID NO: 1379314 - protein, 20 aa, Mycobacterium tuberculosis
TQLHPPDGLHVFVTGPGATI

SEQ ID NO: 1379315 - protein, 18 aa, Mycobacterium tuberculosis
TRGRRLAWCSAEFNGAIV

SEQ ID NO: 1379316 - protein, 34 aa, Mycobacterium tuberculosis; identical to SEQ ID NO: 159236

SEQ ID NO: 1379317 - protein, 23 aa, Mycobacterium tuberculosis
TRLFPPSLAVVFSRSSSAPTESS

SEQ ID NO: 1379318 - protein, 17 aa, Mycobacterium tuberculosis
TRLPLIVQNTHRYFFYI

SEQ ID NO: 1379319 - protein, 18 aa, Mycobacterium tuberculosis
TVGITFLGMRFAKLGVFS

SEQ ID NO: 1379320 - protein, 19 aa, Mycobacterium tuberculosis
TVLMPLALFGILGLAAVVL

SEQ ID NO: 1379321 - protein, 20 aa, Mycobacterium tuberculosis
TVLMPLALFGILGLAAVVLV

SEQ ID NO: 1379322 - protein, 17 aa, Mycobacterium tuberculosis
TYCRIPMDASNVVRGAR

SEQ ID NO: 1379323 - protein, 25 aa, Mycobacterium tuberculosis
TYSQRAVTMLRVRQGASTGETVACV

SEQ ID NO: 1379324 - protein, 28 aa, Mycobacterium tuberculosis
VARRGQLRAGTALVARGEFSLIIIGLAG

SEQ ID NO: 1379325 - protein, 22 aa, Mycobacterium tuberculosis
VEASSLFRVSKLNCSITTSDGT

SEQ ID NO: 1379326 - protein, 24 aa, Mycobacterium tuberculosis
VFGLSGIVPWWFVLTLLTRDALLA

SEQ ID NO: 1379327 - protein, 25 aa, Mycobacterium tuberculosis
VGATGVFLACRWAQADGADHAWLGY

SEQ ID NO: 1379328 - protein, 17 aa, Mycobacterium tuberculosis
VGGRMVVQQADRVDVTA

SEQ ID NO: 1379329 - protein, 20 aa, Mycobacterium tuberculosis
VHCDRFFGWYNHEHKHSGIG

SEQ ID NO: 1379330 - protein, 32 aa, Mycobacterium tuberculosis
VIARPYQWWRLALVLASGLAYVVIFSLPLARE

SEQ ID NO: 1379331 - protein, 20 aa, Mycobacterium tuberculosis
VIDDAMSWLRGAAVPPAGFD

SEQ ID NO: 1379332 - protein, 17 aa, Mycobacterium tuberculosis
VIGTWLHWALFGGDFPG

SEQ ID NO: 1379333 - protein, 18 aa, Mycobacterium tuberculosis
VKGLGIAAGAKRPGAKKT

SEQ ID NO: 1379334 - protein, 23 aa, Mycobacterium tuberculosis
VKGSLWWDIWSLGLLVLIPAVVY

SEQ ID NO: 1379335 - protein, 27 aa, Mycobacterium tuberculosis
VKMTTEWLHVPFLPVPIPVPIPQNPGA

SEQ ID NO: 1379336 - protein, 17 aa, Mycobacterium tuberculosis
VLALPLVAVVLFFVFGG

SEQ ID NO: 1379337 - protein, 24 aa, Mycobacterium tuberculosis
VLANGRGRWLAIAASLVVSAAILY

SEQ ID NO: 1379338 - protein, 36 aa, Mycobacterium tuberculosis; identical to SEQ ID NO: 160695

SEQ ID NO: 1379339 - protein, 27 aa, Mycobacterium tuberculosis
VLIAAFLAVWWIYETYRPQAPGPGDSP

SEQ ID NO: 1379340 - protein, 17 aa, Mycobacterium tuberculosis
VLLGALVTFVIFGRRAQ

SEQ ID NO: 1379341 - protein, 25 aa, Mycobacterium tuberculosis
VLNKFEVIVVPVLLALMLSALLVPP

SEQ ID NO: 1379342 - protein, 26 aa, Mycobacterium tuberculosis
VLVWRRVSDGWAFMCTLIVVAAVVVL

SEQ ID NO: 1379343 - protein, 21 aa, Mycobacterium tuberculosis
VPAMIKEIFAPHSHDAADSVD

SEQ ID NO: 1379344 - protein, 33 aa, Mycobacterium tuberculosis
VPDSSGLPLRAMVMVLLFLGVVFLLLVWQALGS

SEQ ID NO: 1379345 - protein, 26 aa, Mycobacterium tuberculosis
VPLLLGALWASAAFARRADTAADKAN

SEQ ID NO: 1379346 - protein, 17 aa, Mycobacterium tuberculosis
VPRIEFDDVAFGYDGGS

SEQ ID NO: 1379347 - protein, 19 aa, Mycobacterium tuberculosis
VQEDFAYHQFLIKKSKMPS

SEQ ID NO: 1379348 - protein, 24 aa, Mycobacterium tuberculosis
VQVPGGAWVLGWRRPQAYPLMSHL

SEQ ID NO: 1379349 - protein, 17 aa, Mycobacterium tuberculosis
VRNRKCLLCRMSALISA

SEQ ID NO: 1379350 - protein, 17 aa, Mycobacterium tuberculosis
VRWVVRTPWPLFSLSML

SEQ ID NO: 1379351 - protein, 17 aa, Mycobacterium tuberculosis
VTLEVFGAPGTVATINY

SEQ ID NO: 1379352 - protein, 19 aa, Mycobacterium tuberculosis
VTLLPRRTPGSSGIADVPA

SEQ ID NO: 1379353 - protein, 17 aa, Mycobacterium tuberculosis
VVGDLTFVPGVPGVAQG

SEQ ID NO: 1379354 - protein, 28 aa, Mycobacterium tuberculosis
WAAKRARGSPLRIMILLVLVSALASALL

SEQ ID NO: 1379355 - protein, 20 aa, Mycobacterium tuberculosis
WAVRAYAWTDWRFTQLREWF

SEQ ID NO: 1379356 - protein, 18 aa, Mycobacterium tuberculosis
WEALEHAGIPPGTLRRSA

SEQ ID NO: 1379357 - protein, 17 aa, Mycobacterium tuberculosis
WLEIPQFSVFDEIFRGI

SEQ ID NO: 1379358 - protein, 17 aa, Mycobacterium tuberculosis
WPEDCAAAHMVPETLTV

SEQ ID NO: 1379359 - protein, 23 aa, Mycobacterium tuberculosis
WRDDLRWPPASALVSQDEAVAAL

SEQ ID NO: 1379360 - protein, 23 aa, Mycobacterium tuberculosis
WRITLPMLRPTMFFVLVTGIISA

SEQ ID NO: 1379361 - protein, 26 aa, Mycobacterium tuberculosis
WSEACDRGGPGLLLRAKHAVFDRLVY

SEQ ID NO: 1379362 - protein, 18 aa, Mycobacterium tuberculosis
WSNGWWIDPAIGLAIAGI

SEQ ID NO: 1379363 - protein, 17 aa, Mycobacterium tuberculosis
WVANYGHEYYLDKARKH

SEQ ID NO: 1379364 - protein, 19 aa, Mycobacterium tuberculosis
YALPVLMVLTTVVVYQTVT

SEQ ID NO: 1379365 - protein, 21 aa, Mycobacterium tuberculosis
YGNEAPKFFNSKGEPLSDHSP

SEQ ID NO: 1379366 - protein, 19 aa, Mycobacterium tuberculosis
YIFGFSFYTGHYFGAWVFI

SEQ ID NO: 1379367 - protein, 18 aa, Mycobacterium tuberculosis
YLLPARNWSVMAATEVRS

SEQ ID NO: 1379368 - protein, 23 aa, Mycobacterium tuberculosis
YLVYVRLARPFIAFYNNCANAIL

SEQ ID NO: 1379369 - protein, 17 aa, Mycobacterium tuberculosis
YNPSFGGMDRQSRVFIN

SEQ ID NO: 1379370 - protein, 18 aa, Mycobacterium tuberculosis
YSVWTLWPVLELLMPQDV

SEQ ID NO: 1379371 - protein, 17 aa, Mycobacterium tuberculosis
AAAPRVVTPDVLVHTPQ

SEQ ID NO: 1379372 - protein, 25 aa, Mycobacterium tuberculosis
AAELSVWPPVGARAMDVADGYQVLA

SEQ ID NO: 1379373 - protein, 34 aa, Mycobacterium tuberculosis
AAFACLAATVVVAGWWTPPAWAIGPPVVDAAAQP

SEQ ID NO: 1379374 - protein, 18 aa, Mycobacterium tuberculosis
AAGLWAFLRTYRVWRAEG

SEQ ID NO: 1379375 - protein, 26 aa, Mycobacterium tuberculosis
AALIRARFPTLTARQVMQRIESTAHH

SEQ ID NO: 1379376 - protein, 19 aa, Mycobacterium tuberculosis
AAMKYFLLGAFSSAFFLYG

SEQ ID NO: 1379377 - protein, 29 aa, Mycobacterium tuberculosis
ADALRTASLQRLRPRLGVGAGAPAPAVVT

SEQ ID NO: 1379378 - protein, 23 aa, Mycobacterium tuberculosis
ADDAKTRVIAFLRKPIVTVSLVG

SEQ ID NO: 1379379 - protein, 23 aa, Mycobacterium tuberculosis
AERSVAVWLLLGGVFGLALLLIF

SEQ ID NO: 1379380 - protein, 21 aa, Mycobacterium tuberculosis
AEWELPIVLDSAAGFGSTYAD

SEQ ID NO: 1379381 - protein, 19 aa, Mycobacterium tuberculosis
AGAAMAFSSFFVVSNSLRL

SEQ ID NO: 1379382 - protein, 25 aa, Mycobacterium tuberculosis
AGFYLTCVVFVFGVLGVLLRIVSGL

SEQ ID NO: 1379383 - protein, 24 aa, Mycobacterium tuberculosis
AGNRGLDALGFAGTIPKSAPGSAT

SEQ ID NO: 1379384 - protein, 25 aa, Mycobacterium tuberculosis
AGQLHRVRMLLLTNCTFDGVVYNPR

SEQ ID NO: 1379385 - protein, 17 aa, Mycobacterium tuberculosis
AGSELGRILRVVVGLVL

SEQ ID NO: 1379386 - protein, 19 aa, Mycobacterium tuberculosis
AGTVVRFDGAVPFVNLQVS

SEQ ID NO: 1379387 - protein, 25 aa, Mycobacterium tuberculosis
AIGWPETIFRFALYAFLCATALMVV

SEQ ID NO: 1379388 - protein, 20 aa, Mycobacterium tuberculosis
AILLCLVLGVAIVTQVRQTD

SEQ ID NO: 1379389 - protein, 26 aa, Mycobacterium tuberculosis
ALLSELPAVAWVWFQLFVDILGFNII

SEQ ID NO: 1379390 - protein, 20 aa, Mycobacterium tuberculosis
ALPVRVGVAVIGALIVFGLI

SEQ ID NO: 1379391 - protein, 34 aa, Mycobacterium tuberculosis
ALRPVKPPPRRPAHRVLVGWLSLAAGLLAIAALA

SEQ ID NO: 1379392 - protein, 29 aa, Mycobacterium tuberculosis
ALTVPPGSAWRWLCACLLGLTILLLAVNR

SEQ ID NO: 1379393 - protein, 18 aa, Mycobacterium tuberculosis
ANDLLPPGGLIPLSRTSP

SEQ ID NO: 1379394 - protein, 20 aa, Mycobacterium tuberculosis
ANLACVVCAIGLGSVAGLSR

SEQ ID NO: 1379395 - protein, 17 aa, Mycobacterium tuberculosis
ANPKATLGLTAMVVVTL

SEQ ID NO: 1379396 - protein, 24 aa, Mycobacterium tuberculosis
ANQLGWQGPFWDWLGGLDLNTVGF

SEQ ID NO: 1379397 - protein, 24 aa, Mycobacterium tuberculosis
APERVSVTFVDRLPGWNVDISGVG

SEQ ID NO: 1379398 - protein, 18 aa, Mycobacterium tuberculosis
APYLPLNDGYNWKGDPNA

SEQ ID NO: 1379399 - protein, 19 aa, Mycobacterium tuberculosis
ARCAATVVLAGASWWLIEQ

SEQ ID NO: 1379400 - protein, 24 aa, Mycobacterium tuberculosis
ARILAWRPLVWLGTISYGVYLWHW

SEQ ID NO: 1379401 - protein, 26 aa, Mycobacterium tuberculosis
ARLGHFYRGAGLTIYEGYGLSETSGG

SEQ ID NO: 1379402 - protein, 23 aa, Mycobacterium tuberculosis
ARLRRLWLAVLIVAPATIWLEPI

SEQ ID NO: 1379403 - protein, 20 aa, Mycobacterium tuberculosis
ARPGDLLYGLHAMMFNRSRV

SEQ ID NO: 1379404 - protein, 18 aa, Mycobacterium tuberculosis
ARTAAAIAKQVGIEKVLA

SEQ ID NO: 1379405 - protein, 21 aa, Mycobacterium tuberculosis
ASGTGLLAVWSRQTVAAGHPG

SEQ ID NO: 1379406 - protein, 22 aa, Mycobacterium tuberculosis
ASHELRTPLALLTTELELRCAG

SEQ ID NO: 1379407 - protein, 21 aa, Mycobacterium tuberculosis
ASLFIADAMGHRLTWGEQIAL

SEQ ID NO: 1379408 - protein, 18 aa, Mycobacterium tuberculosis
ASLVCFLLIITIPFGFAA

SEQ ID NO: 1379409 - protein, 18 aa, Mycobacterium tuberculosis
ATKRRYRFARGLMAGLLG

SEQ ID NO: 1379410 - protein, 17 aa, Mycobacterium tuberculosis
ATVVLAGASWWLIEQPI

SEQ ID NO: 1379411 - protein, 19 aa, Mycobacterium tuberculosis
AVAFAGLLIAAYGYWLISH

SEQ ID NO: 1379412 - protein, 17 aa, Mycobacterium tuberculosis
AVGLRWDPYPFILLYLA

SEQ ID NO: 1379413 - protein, 18 aa, Mycobacterium tuberculosis
AVPGSPWWQHPVGSVTAL

SEQ ID NO: 1379414 - protein, 17 aa, Mycobacterium tuberculosis
AVPGWAWQGPSAEWYVA

SEQ ID NO: 1379415 - protein, 22 aa, Mycobacterium tuberculosis
AVRPEALSVVGWYLVAATAAAA

SEQ ID NO: 1379416 - protein, 21 aa, Mycobacterium tuberculosis
CGFAMLPAYLLLVVYGQDSAG

SEQ ID NO: 1379417 - protein, 31 aa, Mycobacterium tuberculosis; identical to SEQ ID NO: 159922

SEQ ID NO: 1379418 - protein, 25 aa, Mycobacterium tuberculosis
CYMLTEFALRPVAAQALEAGLPPGR

SEQ ID NO: 1379419 - protein, 25 aa, Mycobacterium tuberculosis
DATVVRMFLVPSVMKLLGDDCWWAP

SEQ ID NO: 1379420 - protein, 18 aa, Mycobacterium tuberculosis
DCHADLRVADGSVDATLL

SEQ ID NO: 1379421 - protein, 23 aa, Mycobacterium tuberculosis
DEPREFFTTNAFWSVPSDPTNNA

SEQ ID NO: 1379422 - protein, 26 aa, Mycobacterium tuberculosis
DFCDPEVVEALKFHLRDLAVTFRFGE

SEQ ID NO: 1379423 - protein, 18 aa, Mycobacterium tuberculosis
DLAVTFRFGEEVTAVDVG

SEQ ID NO: 1379424 - protein, 28 aa, Mycobacterium tuberculosis
DLHDPPPCMTGFLPPPLVRSPADESVRE

SEQ ID NO: 1379425 - protein, 24 aa, Mycobacterium tuberculosis
DLKSLRGKVVLIDFWAYSCINCQR

SEQ ID NO: 1379426 - protein, 22 aa, Mycobacterium tuberculosis
EADGWRWVFLVNLPLGVFAVLA

SEQ ID NO: 1379427 - protein, 20 aa, Mycobacterium tuberculosis
EGVAIGLVVAIVFLLVRVVR

SEQ ID NO: 1379428 - protein, 21 aa, Mycobacterium tuberculosis
ELLRSLGISDPGNWMSIGCGP

SEQ ID NO: 1379429 - protein, 22 aa, Mycobacterium tuberculosis
ELLVRGGVVFSGYWRNEQATTE

SEQ ID NO: 1379430 - protein, 19 aa, Mycobacterium tuberculosis
ELRTRLLISLAAILVTTIF

SEQ ID NO: 1379431 - protein, 17 aa, Mycobacterium tuberculosis
ENLPAVLPTVVAPPLTS

SEQ ID NO: 1379432 - protein, 24 aa, Mycobacterium tuberculosis
EPTTRLRKDLTWWDLVVFGVSVVI

SEQ ID NO: 1379433 - protein, 18 aa, Mycobacterium tuberculosis
EPVVGGWTGGRITVSSSS

SEQ ID NO: 1379434 - protein, 27 aa, Mycobacterium tuberculosis
EPYPEQRPPWGVPPPGWDGSSRPAPST

SEQ ID NO: 1379435 - protein, 19 aa, Mycobacterium tuberculosis
EQDLGFKIIFGLPGIVLGS

SEQ ID NO: 1379436 - protein, 19 aa, Mycobacterium tuberculosis
ESIRKFRILPVDFTEDTGE

SEQ ID NO: 1379437 - protein, 32 aa, Mycobacterium tuberculosis
EVIKVGSLSPWHWAILAVVVIVLFGAKKLPDA

SEQ ID NO: 1379438 - protein, 22 aa, Mycobacterium tuberculosis
EVIRLIRRLLPALVVVLAGCAL

SEQ ID NO: 1379439 - protein, 18 aa, Mycobacterium tuberculosis
EVYWPLRRVGVQFHAAAD

SEQ ID NO: 1379440 - protein, 24 aa, Mycobacterium tuberculosis
EWWRLGLMFAVIVALHLVGWLTVT

SEQ ID NO: 1379441 - protein, 25 aa, Mycobacterium tuberculosis
EYWYRSIRQPVQFARAVRNAFDGGY

SEQ ID NO: 1379442 - protein, 23 aa, Mycobacterium tuberculosis
FAALRAGQLVAAWTTTADPDIPA

SEQ ID NO: 1379443 - protein, 20 aa, Mycobacterium tuberculosis
FADRRGRRAALTFSVSLMAA

SEQ ID NO: 1379444 - protein, 20 aa, Mycobacterium tuberculosis
FFPLMGIGAFSMLAFSGRFG

SEQ ID NO: 1379445 - protein, 39 aa, Mycobacterium tuberculosis
FFVIGHLLGVPGWVTQRLWWAVLLTVGFWGLLRVAEALG

SEQ ID NO: 1379446 - protein, 24 aa, Mycobacterium tuberculosis
FGADLRPVLLHAMTFMIVASPCAV

SEQ ID NO: 1379447 - protein, 23 aa, Mycobacterium tuberculosis
FIEGRSVAELVALGEEIYDEIIA

SEQ ID NO: 1379448 - protein, 20 aa, Mycobacterium tuberculosis
FLRVWLPGQLLQGIGVGATL

SEQ ID NO: 1379449 - protein, 17 aa, Mycobacterium tuberculosis
FLTFFVVAAFGALIVDR

SEQ ID NO: 1379450 - protein, 18 aa, Mycobacterium tuberculosis
FLVTLGGTVAFYTYSVNA

SEQ ID NO: 1379451 - protein, 19 aa, Mycobacterium tuberculosis
FLWILSVAFASMIALATLL

SEQ ID NO: 1379452 - protein, 20 aa, Mycobacterium tuberculosis
FNFGFGSLVWVYAAESFPSR

SEQ ID NO: 1379453 - protein, 25 aa, Mycobacterium tuberculosis
FNLVGWPTWGMILSSPFLLPAGLGL

SEQ ID NO: 1379454 - protein, 32 aa, Mycobacterium tuberculosis; identical to SEQ ID NO: 156863

SEQ ID NO: 1379455 - protein, 22 aa, Mycobacterium tuberculosis
FPAGLWRWLQRHPPPALHRLTR

SEQ ID NO: 1379456 - protein, 22 aa, Mycobacterium tuberculosis
FSEAYKNAALDVMNKMRALNQF

SEQ ID NO: 1379457 - protein, 20 aa, Mycobacterium tuberculosis
FSVLRAAALTHWVDTGGYAK

SEQ ID NO: 1379458 - protein, 18 aa, Mycobacterium tuberculosis
FVIGHLLGVPGWVTQRLW

SEQ ID NO: 1379459 - protein, 19 aa, Mycobacterium tuberculosis
FVLCCAAIAYIALTAPHRP

SEQ ID NO: 1379460 - protein, 17 aa, Mycobacterium tuberculosis
FYRRARAAADKITPDVE

SEQ ID NO: 1379461 - protein, 23 aa, Mycobacterium tuberculosis
FYTPWSWLPRIVTQFAAGALACA

SEQ ID NO: 1379462 - protein, 22 aa, Mycobacterium tuberculosis
GAALCLPLARVLAAASCGPLSS

SEQ ID NO: 1379463 - protein, 20 aa, Mycobacterium tuberculosis
GAIAGILLKMCWPAAPRSVG

SEQ ID NO: 1379464 - protein, 24 aa, Mycobacterium tuberculosis
GALIWAASLLWYLKVVGSQPDFLG

SEQ ID NO: 1379465 - protein, 17 aa, Mycobacterium tuberculosis
GALSGFHALICSGTTPK

SEQ ID NO: 1379466 - protein, 17 aa, Mycobacterium tuberculosis
GARLAWTYLAPNGANFV

SEQ ID NO: 1379467 - protein, 27 aa, Mycobacterium tuberculosis
GATYCLSFARLTLFHTMGPPLAIGMLV

SEQ ID NO: 1379468 - protein, 21 aa, Mycobacterium tuberculosis
GAVSRTHWLASHLAMALAGSA

SEQ ID NO: 1379469 - protein, 25 aa, Mycobacterium tuberculosis
GCILLLEVLFLRWLLDGRASRQWCG

SEQ ID NO: 1379470 - protein, 23 aa, Mycobacterium tuberculosis
GCLPAVIWWACHRPNRLWWRYTA

SEQ ID NO: 1379471 - protein, 18 aa, Mycobacterium tuberculosis
GDCPRSRTVRWSWDTGHV

SEQ ID NO: 1379472 - protein, 25 aa, Mycobacterium tuberculosis
GEGACFRLTLPMVRGHKVTTSPLPM

SEQ ID NO: 1379473 - protein, 27 aa, Mycobacterium tuberculosis
GFATLIRTPALYAWILVLPIGLMLQQS

SEQ ID NO: 1379474 - protein, 21 aa, Mycobacterium tuberculosis
GFTGLPRRASTVALVALVAAQ

SEQ ID NO: 1379475 - protein, 24 aa, Mycobacterium tuberculosis
GGVRASWPWALVVFLVVVFVAPLC

SEQ ID NO: 1379476 - protein, 21 aa, Mycobacterium tuberculosis
GHLLGVPGWVTQRLWWAVLLT

SEQ ID NO: 1379477 - protein, 23 aa, Mycobacterium tuberculosis
GLATSGLLAWARRRPVLAGVLIG

SEQ ID NO: 1379478 - protein, 17 aa, Mycobacterium tuberculosis
GLHPLIFFLPVRQGANW

SEQ ID NO: 1379479 - protein, 34 aa, Mycobacterium tuberculosis
GLPVMVGGLCIAGALGIMRFLAIFGPVHYFAQPV

SEQ ID NO: 1379480 - protein, 20 aa, Mycobacterium tuberculosis
GLSCKELTGDIARRPIADAV

SEQ ID NO: 1379481 - protein, 25 aa, Mycobacterium tuberculosis
GMGPGPLLAAARAWHALAAQYTEIA

SEQ ID NO: 1379482 - protein, 19 aa, Mycobacterium tuberculosis
GPMSHAAVVAREFGFPCVV

SEQ ID NO: 1379483 - protein, 17 aa, Mycobacterium tuberculosis
GQLLQGIGVGATLPVLS

SEQ ID NO: 1379484 - protein, 25 aa, Mycobacterium tuberculosis
GRASRQWCGGLAIGLTLVLKPLLGP

SEQ ID NO: 1379485 - protein, 18 aa, Mycobacterium tuberculosis
GRILRVVVGLVLVIAAYV

SEQ ID NO: 1379486 - protein, 18 aa, Mycobacterium tuberculosis
GRLDGVVRAIELSRQTLR

SEQ ID NO: 1379487 - protein, 19 aa, Mycobacterium tuberculosis
GSVEYLVDAVFNYPTFSEA

SEQ ID NO: 1379488 - protein, 17 aa, Mycobacterium tuberculosis
GSVLSWLAQLTAVLVGE

SEQ ID NO: 1379489 - protein, 23 aa, Mycobacterium tuberculosis
GTRDRYLLMPSFTFVGVAQAALW

SEQ ID NO: 1379490 - protein, 24 aa, Mycobacterium tuberculosis
GVDSGTWLAWVAWAALGLGVVALV

SEQ ID NO: 1379491 - protein, 38 aa, Mycobacterium tuberculosis
GVLLRIVSGLSIFRLLRYLAREYLLIFATSSSEVVLPR

SEQ ID NO: 1379492 - protein, 19 aa, Mycobacterium tuberculosis
GVLRDGQKWVALAVPGYTL

SEQ ID NO: 1379493 - protein, 29 aa, Mycobacterium tuberculosis
GWAWQGPSAEWYVAAHLPYVAWLTQASAD

SEQ ID NO: 1379494 - protein, 24 aa, Mycobacterium tuberculosis
GWNCPACGGLRMIHDLLHGELAAS

SEQ ID NO: 1379495 - protein, 21 aa, Mycobacterium tuberculosis
HAAVVAREFGFPCVVDAQGAT

SEQ ID NO: 1379496 - protein, 24 aa, Mycobacterium tuberculosis
HDPGQSWVLVFAITMMAGLLVSLL

SEQ ID NO: 1379497 - protein, 18 aa, Mycobacterium tuberculosis
HELLRPGVLLMSASSSDR

SEQ ID NO: 1379498 - protein, 20 aa, Mycobacterium tuberculosis
HELRTPLTTIRGFAELYRQG

SEQ ID NO: 1379499 - protein, 20 aa, Mycobacterium tuberculosis
HLLGRPLGRLVDRDNAVEDE

SEQ ID NO: 1379500 - protein, 20 aa, Mycobacterium tuberculosis
HLLGVPGWVTQRLWWAVLLT

SEQ ID NO: 1379501 - protein, 22 aa, Mycobacterium tuberculosis
HLTELRTRLLISLAAILVTTIF

SEQ ID NO: 1379502 - protein, 17 aa, Mycobacterium tuberculosis
HPNVFVVGDLMFVPGVP

SEQ ID NO: 1379503 - protein, 29 aa, Mycobacterium tuberculosis
HPTTTYKAFDWDQAYRKPITYDTLWQADT

SEQ ID NO: 1379504 - protein, 21 aa, Mycobacterium tuberculosis
HTSDAIAAWAAQLAAVTGQLQ

SEQ ID NO: 1379505 - protein, 25 aa, Mycobacterium tuberculosis
IAALLGKWFWWPQVVRQRPIPQPWP

SEQ ID NO: 1379506 - protein, 21 aa, Mycobacterium tuberculosis
IATACALTAWYVLYRSPDRRG

SEQ ID NO: 1379507 - protein, 26 aa, Mycobacterium tuberculosis
ICLLAGTARLGFLASLLSRPVLVGYM

SEQ ID NO: 1379508 - protein, 20 aa, Mycobacterium tuberculosis
IEQPIRRWRPARVPLLPLAA

SEQ ID NO: 1379509 - protein, 21 aa, Mycobacterium tuberculosis
IGSAPFPISALISGLVNAALV

SEQ ID NO: 1379510 - protein, 18 aa, Mycobacterium tuberculosis
IGTQLGAFVVFTLLVLAV

SEQ ID NO: 1379511 - protein, 33 aa, Mycobacterium tuberculosis
IGYRSPRYLRFGWAAARLDDWANYVGARATAVL

SEQ ID NO: 1379512 - protein, 22 aa, Mycobacterium tuberculosis
IHAELPAKLVLVAIAVLCAVSF

SEQ ID NO: 1379513 - protein, 23 aa, Mycobacterium tuberculosis
IHRAYRYARAMARWSPTSRSEVT

SEQ ID NO: 1379514 - protein, 24 aa, Mycobacterium tuberculosis
IIANRVSYFYDFHGPSVTIDTACS

SEQ ID NO: 1379515 - protein, 17 aa, Mycobacterium tuberculosis
IIGFRFYARLIEMKVVR

SEQ ID NO: 1379516 - protein, 19 aa, Mycobacterium tuberculosis
IKVLLEVFPQAKFIHIVRD

SEQ ID NO: 1379517 - protein, 20 aa, Mycobacterium tuberculosis
ILIDRYWWTALAVTLAITAV

SEQ ID NO: 1379518 - protein, 17 aa, Mycobacterium tuberculosis
ILLAVALVFDLPAALQR

SEQ ID NO: 1379519 - protein, 18 aa, Mycobacterium tuberculosis
ILQDWRVVVRNRPFLTLA

SEQ ID NO: 1379520 - protein, 25 aa, Mycobacterium tuberculosis
IMAQLRIGYATVVWVTSAYLLAYAV

SEQ ID NO: 1379521 - protein, 19 aa, Mycobacterium tuberculosis
IPAANAFTAVAGHGVRAQV

SEQ ID NO: 1379522 - protein, 22 aa, Mycobacterium tuberculosis
IPRTVDFALEMRRIVDRFNCQT

SEQ ID NO: 1379523 - protein, 18 aa, Mycobacterium tuberculosis
ISDPGNWMSIGCGPSGAV

SEQ ID NO: 1379524 - protein, 17 aa, Mycobacterium tuberculosis
ITLSVMAIFYLRLPATF

SEQ ID NO: 1379525 - protein, 18 aa, Mycobacterium tuberculosis
ITPFPWHEIVQFLEETFA

SEQ ID NO: 1379526 - protein, 18 aa, Mycobacterium tuberculosis
KLVFKVLVMVLWLAPIGA

SEQ ID NO: 1379527 - protein, 17 aa, Mycobacterium tuberculosis
KSLHDMGEFYGRNIFMA

SEQ ID NO: 1379528 - protein, 29 aa, Mycobacterium tuberculosis
KTRLVPFGEYVLRCARFSAGSPATARPPQ

SEQ ID NO: 1379529 - protein, 22 aa, Mycobacterium tuberculosis
KVHRHWAFGGGPHRCLGSHLAR

SEQ ID NO: 1379530 - protein, 18 aa, Mycobacterium tuberculosis
LAFGLMAALLLDATVVRM

SEQ ID NO: 1379531 - protein, 17 aa, Mycobacterium tuberculosis
LAHLCFIGALLPLARQA

SEQ ID NO: 1379532 - protein, 24 aa, Mycobacterium tuberculosis
LALLANLFLPWGIAGAAPTALDVL

SEQ ID NO: 1379533 - protein, 19 aa, Mycobacterium tuberculosis
LDRYGGGTARRLERTGTFA

SEQ ID NO: 1379534 - protein, 26 aa, Mycobacterium tuberculosis
LDVLGMSCAACASRVETKLNKIPGVR

SEQ ID NO: 1379535 - protein, 31 aa, Mycobacterium tuberculosis
LGPPIGGLLVEWAGWRWVLLVNVPLGIVAAI

SEQ ID NO: 1379536 - protein, 22 aa, Mycobacterium tuberculosis
LGRIKTILCGSERVHPATLKRF

SEQ ID NO: 1379537 - protein, 18 aa, Mycobacterium tuberculosis
LHDMGEFYGRNIFMAETS

SEQ ID NO: 1379538 - protein, 25 aa, Mycobacterium tuberculosis
LIHLPNLPPAGLLPIAAALGPGDQW

SEQ ID NO: 1379539 - protein, 30 aa, Mycobacterium tuberculosis
LITALCLFTAVFIMLRRKRIPSVARGPAWR

SEQ ID NO: 1379540 - protein, 18 aa, Mycobacterium tuberculosis
LITKMKHLGVQSSTVGVV

SEQ ID NO: 1379541 - protein, 18 aa, Mycobacterium tuberculosis
LIVITGLIGSFVFSLIRP

SEQ ID NO: 1379542 - protein, 18 aa, Mycobacterium tuberculosis
LKFAMFMLAEYVNMTTVS

SEQ ID NO: 1379543 - protein, 19 aa, Mycobacterium tuberculosis
LKITYGWSLLLIVTFTVLY

SEQ ID NO: 1379544 - protein, 21 aa, Mycobacterium tuberculosis
LLAGIALLVSRQVVVPVRSAS

SEQ ID NO: 1379545 - protein, 24 aa, Mycobacterium tuberculosis
LLASSCTWQLSLFITDGVPPPPGD

SEQ ID NO: 1379546 - protein, 25 aa, Mycobacterium tuberculosis
LLAVLRGRLHPIGGLGVALAVTVLL

SEQ ID NO: 1379547 - protein, 17 aa, Mycobacterium tuberculosis
LLFTIIWWNVNHGRANW

SEQ ID NO: 1379548 - protein, 24 aa, Mycobacterium tuberculosis
LLGLLWYAGLPLRVFLSSLAAVVV

SEQ ID NO: 1379549 - protein, 25 aa, Mycobacterium tuberculosis
LLLLPLLNRQWRALVAAVVVPVVVN

SEQ ID NO: 1379550 - protein, 18 aa, Mycobacterium tuberculosis
LLSQLVPWLLTPLLMLGA

SEQ ID NO: 1379551 - protein, 23 aa, Mycobacterium tuberculosis
LLWTVGLCLYGLVMGSVVHGIGD

SEQ ID NO: 1379552 - protein, 17 aa, Mycobacterium tuberculosis
LMLLPLSAFEATVALPA

SEQ ID NO: 1379553 - protein, 19 aa, Mycobacterium tuberculosis
LNNRRVPVVDIYDAQRVHI

SEQ ID NO: 1379554 - protein, 17 aa, Mycobacterium tuberculosis
LPAVLPTVVAPPLTSRR

SEQ ID NO: 1379555 - protein, 22 aa, Mycobacterium tuberculosis
LPDWSPTSSRTWATKVLAAHPG

SEQ ID NO: 1379556 - protein, 24 aa, Mycobacterium tuberculosis
LPGRRMPIPQLPGATAGARSTDIE

SEQ ID NO: 1379557 - protein, 19 aa, Mycobacterium tuberculosis
LPVVGAVALALTFAQSPGQ

SEQ ID NO: 1379558 - protein, 27 aa, Mycobacterium tuberculosis
LQTNRLLTRWARDYITVIGAIVLPILF

SEQ ID NO: 1379559 - protein, 17 aa, Mycobacterium tuberculosis
LRPLFGWITRYSKAAAK

SEQ ID NO: 1379560 - protein, 17 aa, Mycobacterium tuberculosis
LRTAVVVGLVLLQTGCG

SEQ ID NO: 1379561 - protein, 19 aa, Mycobacterium tuberculosis
LSEAMRVVGVNWLIPVVQI

SEQ ID NO: 1379562 - protein, 21 aa, Mycobacterium tuberculosis
LSERQRLRDLFGRYVGEDVAR

SEQ ID NO: 1379563 - protein, 23 aa, Mycobacterium tuberculosis
LSTLDRFLPVWIGSAMAAGLLLG

SEQ ID NO: 1379564 - protein, 28 aa, Mycobacterium tuberculosis
LSVMAIFYLRLPATFGIGTYGVSADFVA

SEQ ID NO: 1379565 - protein, 17 aa, Mycobacterium tuberculosis
LTARLAALRSTDPATLI

SEQ ID NO: 1379566 - protein, 28 aa, Mycobacterium tuberculosis
LTASLVAAWAYPLWPVVLGLKALALAVG

SEQ ID NO: 1379567 - protein, 22 aa, Mycobacterium tuberculosis
LTDRAAGLVARFAGGEPLADFA

SEQ ID NO: 1379568 - protein, 19 aa, Mycobacterium tuberculosis
LTFGGLMLLGGRLGDTIGR

SEQ ID NO: 1379569 - protein, 21 aa, Mycobacterium tuberculosis
LTGPWLLRVGFGPDYQTGGAL

SEQ ID NO: 1379570 - protein, 20 aa, Mycobacterium tuberculosis
LTSTLRPAGVDEWFICGPLA

SEQ ID NO: 1379571 - protein, 23 aa, Mycobacterium tuberculosis
LTWGEQIALLAFMIIASKGAAGV

SEQ ID NO: 1379572 - protein, 17 aa, Mycobacterium tuberculosis
LVAAAGFYCYGLTHVLY

SEQ ID NO: 1379573 - protein, 25 aa, Mycobacterium tuberculosis
LVLYRRRRISLSPRPERGVVDRSGG

SEQ ID NO: 1379574 - protein, 33 aa, Mycobacterium tuberculosis
LVVARCEYHPTPACPQTRITGGPGRGPETRTAN

SEQ ID NO: 1379575 - protein, 35 aa, Mycobacterium tuberculosis
LVVARCEYHPTPACPQTRITGVPGRGPETRTANQL

SEQ ID NO: 1379576 - protein, 17 aa, Mycobacterium tuberculosis
LYGLHAMMFNRSRVSDD

SEQ ID NO: 1379577 - protein, 21 aa, Mycobacterium tuberculosis
LYVPCAGPILAAIVVAGATAT

SEQ ID NO: 1379578 - protein, 20 aa, Mycobacterium tuberculosis
MAAVSLARYWGAEVFVTASR

SEQ ID NO: 1379579 - protein, 22 aa, Mycobacterium tuberculosis
MILSSPFLLPAGLGLGLAAIAF

SEQ ID NO: 1379580 - protein, 18 aa, Mycobacterium tuberculosis
MLALLLFGPRLVDIYVDW

SEQ ID NO: 1379581 - protein, 19 aa, Mycobacterium tuberculosis
MLRQLPVLIGSVVLGSATG

SEQ ID NO: 1379582 - protein, 19 aa, Mycobacterium tuberculosis
MMPEPVVERYRLGEQTIAQ

SEQ ID NO: 1379583 - protein, 25 aa, Mycobacterium tuberculosis
MNLAGNRPRLVWYAPDHIEGEMSSP

SEQ ID NO: 1379584 - protein, 18 aa, Mycobacterium tuberculosis
MPVLALATWQFRRASNWT

SEQ ID NO: 1379585 - protein, 25 aa, Mycobacterium tuberculosis
MTWTLPVLGVWVIFSPWVLPGVAVT

SEQ ID NO: 1379586 - protein, 18 aa, Mycobacterium tuberculosis
MVRPIRRLEVGTQKISAG

SEQ ID NO: 1379587 - protein, 18 aa, Mycobacterium tuberculosis
NAMPARFSAQIQNEDEVT

SEQ ID NO: 1379588 - protein, 19 aa, Mycobacterium tuberculosis
NDLHLRVGINTGDVISGLV

SEQ ID NO: 1379589 - protein, 18 aa, Mycobacterium tuberculosis
NDSEAFAAVASFSRALVL

SEQ ID NO: 1379590 - protein, 18 aa, Mycobacterium tuberculosis
NEFFRVVVETVARHGGFV

SEQ ID NO: 1379591 - protein, 24 aa, Mycobacterium tuberculosis
NTECPPGTIGEIWVHGDNVAGGYW

SEQ ID NO: 1379592 - protein, 22 aa, Mycobacterium tuberculosis
PADLRLVRQTGLSVNESALTGE

SEQ ID NO: 1379593 - protein, 29 aa, Mycobacterium tuberculosis
PATRFRPIIRLTVEWLEVLAMIALLPAAA

SEQ ID NO: 1379594 - protein, 24 aa, Mycobacterium tuberculosis
PDLQGADQLLVRWRQANDRINSDI

SEQ ID NO: 1379595 - protein, 21 aa, Mycobacterium tuberculosis
PDPNLRPQIVGVFTDLTGPAP

SEQ ID NO: 1379596 - protein, 17 aa, Mycobacterium tuberculosis
PDQVLGWAGYLRASQAT

SEQ ID NO: 1379597 - protein, 20 aa, Mycobacterium tuberculosis
PDSDLHWSILATRNDSEAFA

SEQ ID NO: 1379598 - protein, 17 aa, Mycobacterium tuberculosis
PFVPRLVVLVIVALVIT

SEQ ID NO: 1379599 - protein, 23 aa, Mycobacterium tuberculosis
PGVAVTAGMMWSHIIAGAVVAVL

SEQ ID NO: 1379600 - protein, 24 aa, Mycobacterium tuberculosis
PIKLRESPGLMILGRQGCGKTTAL

SEQ ID NO: 1379601 - protein, 18 aa, Mycobacterium tuberculosis
PIVGYLWSWLSGRDRAWR

SEQ ID NO: 1379602 - protein, 17 aa, Mycobacterium tuberculosis
PLDAPRPMPPEVADHVA

SEQ ID NO: 1379603 - protein, 27 aa, Mycobacterium tuberculosis
PLRVRPRPASQMLRPFAPRRLVRALLL

SEQ ID NO: 1379604 - protein, 28 aa, Mycobacterium tuberculosis
PLRVRPRPASQMLRPFAPRRLVRALLLP

SEQ ID NO: 1379605 - protein, 17 aa, Mycobacterium tuberculosis
PLWITFVAGPAYTVIGM

SEQ ID NO: 1379606 - protein, 18 aa, Mycobacterium tuberculosis
PPGVGGIGEDFIDALRSK

SEQ ID NO: 1379607 - protein, 21 aa, Mycobacterium tuberculosis
PQLGVPTAWLVAPVEAGGKTQ

SEQ ID NO: 1379608 - protein, 27 aa, Mycobacterium tuberculosis
PRERHIASWLAALVVPSVICAITVAWL

SEQ ID NO: 1379609 - protein, 20 aa, Mycobacterium tuberculosis
PRLAQQKVLLFGIAFALVTR

SEQ ID NO: 1379610 - protein, 17 aa, Mycobacterium tuberculosis
PRYPAIEIYRVSAPANP

SEQ ID NO: 1379611 - protein, 19 aa, Mycobacterium tuberculosis
PSLLPRGPLFQGLVSGICG

SEQ ID NO: 1379612 - protein, 18 aa, Mycobacterium tuberculosis
PTVVVSVPRVFEKVYNTA

SEQ ID NO: 1379613 - protein, 18 aa, Mycobacterium tuberculosis
PVEPTGRVLARWQSSWLR

SEQ ID NO: 1379614 - protein, 19 aa, Mycobacterium tuberculosis
PWKWNVVGLLAIALGAAIL

SEQ ID NO: 1379615 - protein, 25 aa, Mycobacterium tuberculosis
QAHRPELLDGVGLIVGIDRFMSEAR

SEQ ID NO: 1379616 - protein, 23 aa, Mycobacterium tuberculosis
QFWLYCGFTAITMLGFGTFGLLS

SEQ ID NO: 1379617 - protein, 24 aa, Mycobacterium tuberculosis
QLADLDQVWRLARGAGQRVAVIDT

SEQ ID NO: 1379618 - protein, 24 aa, Mycobacterium tuberculosis
QLWNAYTGFYGWMLQLIWQFLQDP

SEQ ID NO: 1379619 - protein, 25 aa, Mycobacterium tuberculosis
QPAAHVVKLLNWFFAIVVNEVDRHH

SEQ ID NO: 1379620 - protein, 18 aa, Mycobacterium tuberculosis
QPQTRWEAFANQSLASLG

SEQ ID NO: 1379621 - protein, 20 aa, Mycobacterium tuberculosis
QRARGKGGLVRVSWAEATEM

SEQ ID NO: 1379622 - protein, 17 aa, Mycobacterium tuberculosis
QRFWRITLPMLRPTMFF

SEQ ID NO: 1379623 - protein, 19 aa, Mycobacterium tuberculosis
QRGACSVSGVIPGTDPGVP

SEQ ID NO: 1379624 - protein, 25 aa, Mycobacterium tuberculosis
QRWASPFWQTWDLLLLWLAQLHGGN

SEQ ID NO: 1379625 - protein, 20 aa, Mycobacterium tuberculosis
QSMLLPAFVALFGIVAALFL

SEQ ID NO: 1379626 - protein, 19 aa, Mycobacterium tuberculosis
QTGLLWPAIFVAAFAALGL

SEQ ID NO: 1379627 - protein, 25 aa, Mycobacterium tuberculosis
QVFFCSLAGYAFARLQFRGRDTLFV

SEQ ID NO: 1379628 - protein, 23 aa, Mycobacterium tuberculosis
RAALLPEQKFEVVRNLQAGGHQV

SEQ ID NO: 1379629 - protein, 26 aa, Mycobacterium tuberculosis
RAIGLFDTWPGLILPYITFALPLAIY

SEQ ID NO: 1379630 - protein, 18 aa, Mycobacterium tuberculosis
RAKHAVFDRLVYRKLRAA

SEQ ID NO: 1379631 - protein, 20 aa, Mycobacterium tuberculosis
RASQIRRLRAPRPQVERGGD

SEQ ID NO: 1379632 - protein, 17 aa, Mycobacterium tuberculosis
RAVEHRALMAIAFGDLG

SEQ ID NO: 1379633 - protein, 18 aa, Mycobacterium tuberculosis
RDDFAYLVDFGIASATTD

SEQ ID NO: 1379634 - protein, 22 aa, Mycobacterium tuberculosis
RDDLRWPPASALVSQDEAVAAL

SEQ ID NO: 1379635 - protein, 30 aa, Mycobacterium tuberculosis; identical to SEQ ID NO: 160589

SEQ ID NO: 1379636 - protein, 17 aa, Mycobacterium tuberculosis
RDPLPVAGRRSRTSGGI

SEQ ID NO: 1379637 - protein, 24 aa, Mycobacterium tuberculosis
REHISLRPLWGIDQRLKRFGAMAA

SEQ ID NO: 1379638 - protein, 22 aa, Mycobacterium tuberculosis
REIAELPNIVMVRGLTRPNGEP

SEQ ID NO: 1379639 - protein, 18 aa, Mycobacterium tuberculosis
RFGVAVAVMALVLSASLL

SEQ ID NO: 1379640 - protein, 18 aa, Mycobacterium tuberculosis
RFTDDELLRLAAAAEYPS

SEQ ID NO: 1379641 - protein, 23 aa, Mycobacterium tuberculosis
RGRPLSVRWLLEPVVGRGRVEGA

SEQ ID NO: 1379642 - protein, 21 aa, Mycobacterium tuberculosis
RGVGWKTLRDAGPVVFMNGWY

SEQ ID NO: 1379643 - protein, 17 aa, Mycobacterium tuberculosis
RIARYVAVVAGLLGAVL

SEQ ID NO: 1379644 - protein, 24 aa, Mycobacterium tuberculosis
RIFDPKVFVVSFVFNVLVAALIVY

SEQ ID NO: 1379645 - protein, 17 aa, Mycobacterium tuberculosis
RKIVLKTAMPGIVTGML

SEQ ID NO: 1379646 - protein, 22 aa, Mycobacterium tuberculosis
RLAWCSAEFNGAIVVNVPLASN

SEQ ID NO: 1379647 - protein, 26 aa, Mycobacterium tuberculosis
RLDVSSMSCAACASRVETKLNKIPGV

SEQ ID NO: 1379648 - protein, 27 aa, Mycobacterium tuberculosis
RLMTPLRVMFAIALVFLALGWSTKAAC

SEQ ID NO: 1379649 - protein, 21 aa, Mycobacterium tuberculosis
RNVFGPPAWAPVVNNVVAIAT

SEQ ID NO: 1379650 - protein, 19 aa, Mycobacterium tuberculosis
RPLDVGWSLVNTRSLFDHR

SEQ ID NO: 1379651 - protein, 18 aa, Mycobacterium tuberculosis
RPMPPEVADHVAAVTLFG

SEQ ID NO: 1379652 - protein, 31 aa, Mycobacterium tuberculosis
RPSSQAPVMWALSASLGWILPVIAQLVWWAV

SEQ ID NO: 1379653 - protein, 30 aa, Mycobacterium tuberculosis
RRQLRLIVSDRGYFVFLALLPFIMGALSMS

SEQ ID NO: 1379654 - protein, 17 aa, Mycobacterium tuberculosis
RRRVRIQIILTIALITA

SEQ ID NO: 1379655 - protein, 22 aa, Mycobacterium tuberculosis
RRVAVWAFVMVLAFSRHLFVRP

SEQ ID NO: 1379656 - protein, 26 aa, Mycobacterium tuberculosis
RRVAVWAFVMVLAFSRHLFVRPVIRM

SEQ ID NO: 1379657 - protein, 23 aa, Mycobacterium tuberculosis
RSARELWAGCLLPMVNLLWAPLY

SEQ ID NO: 1379658 - protein, 22 aa, Mycobacterium tuberculosis
RSGLPVVVSVVGLVHTPGLVTL

SEQ ID NO: 1379659 - protein, 33 aa, Mycobacterium tuberculosis
RSIPDATKAAARWIRPLVPPFVARMLDNTTAPL

SEQ ID NO: 1379660 - protein, 22 aa, Mycobacterium tuberculosis
RSLGHRVADGWLVARAGSLQRR

SEQ ID NO: 1379661 - protein, 21 aa, Mycobacterium tuberculosis
RSVGVPLYLLLGWVAVWYTAT

SEQ ID NO: 1379662 - protein, 20 aa, Mycobacterium tuberculosis
RTAVIFTRRRSMLTLADRVA

SEQ ID NO: 1379663 - protein, 21 aa, Mycobacterium tuberculosis
RTWSSGSLPGVFPVPLTISGD

SEQ ID NO: 1379664 - protein, 18 aa, Mycobacterium tuberculosis
RVANLFLTKTVYSVLLAL

SEQ ID NO: 1379665 - protein, 19 aa, Mycobacterium tuberculosis
RVGVASVIAEGFLVLPFSR

SEQ ID NO: 1379666 - protein, 19 aa, Mycobacterium tuberculosis
RYMTISAITAMLFDLTVTA

SEQ ID NO: 1379667 - protein, 23 aa, Mycobacterium tuberculosis
SAGRAVIVTGDFNARYSDDQSAL

SEQ ID NO: 1379668 - protein, 17 aa, Mycobacterium tuberculosis
SALHIWADTGGAGADFM

SEQ ID NO: 1379669 - protein, 17 aa, Mycobacterium tuberculosis
SARAKVANREWVARSAR

SEQ ID NO: 1379670 - protein, 17 aa, Mycobacterium tuberculosis
SASGLGFAIPVNEMKLV

SEQ ID NO: 1379671 - protein, 29 aa, Mycobacterium tuberculosis
SFREIRWNLRVIVMFSIGLVIATAVAVSW

SEQ ID NO: 1379672 - protein, 24 aa, Mycobacterium tuberculosis
SGKVRRAECVKLYRHNEFTRLDAK

SEQ ID NO: 1379673 - protein, 18 aa, Mycobacterium tuberculosis
SHGIAGFIQQIIPRSLPS

SEQ ID NO: 1379674 - protein, 24 aa, Mycobacterium tuberculosis
SLYPPCLFKLLTGWNCPACGGLRM

SEQ ID NO: 1379675 - protein, 24 aa, Mycobacterium tuberculosis
SMEQGRLAAYHAFGEPTDGITELQ

SEQ ID NO: 1379676 - protein, 21 aa, Mycobacterium tuberculosis
SMQKIIECGTGDFGAQASLYT

SEQ ID NO: 1379677 - protein, 17 aa, Mycobacterium tuberculosis
SNWTYRRARHRLGTVTA

SEQ ID NO: 1379678 - protein, 21 aa, Mycobacterium tuberculosis
SPELLPSLLAAVHRRRRRTRL

SEQ ID NO: 1379679 - protein, 24 aa, Mycobacterium tuberculosis
SPRMRRVRIQGMLTVAILVTNVIG

SEQ ID NO: 1379680 - protein, 18 aa, Mycobacterium tuberculosis
SQIPGVAMVRGVTRPNGE

SEQ ID NO: 1379681 - protein, 19 aa, Mycobacterium tuberculosis
SRPAVLVLGVLTWVNVWND

SEQ ID NO: 1379682 - protein, 17 aa, Mycobacterium tuberculosis
SRSYLVPTINAFTAQLS

SEQ ID NO: 1379683 - protein, 17 aa, Mycobacterium tuberculosis
SRYDVLLMIAISVIAVL

SEQ ID NO: 1379684 - protein, 19 aa, Mycobacterium tuberculosis
SSAEQVRWVLQDSEAVVLF

SEQ ID NO: 1379685 - protein, 17 aa, Mycobacterium tuberculosis
STIATYLRGDWYRDWGS

SEQ ID NO: 1379686 - protein, 26 aa, Mycobacterium tuberculosis
TAPLPKGTYCRIPMDASNVVRGARNN

SEQ ID NO: 1379687 - protein, 17 aa, Mycobacterium tuberculosis
TAVPWARQRTAMIAAER

SEQ ID NO: 1379688 - protein, 28 aa, Mycobacterium tuberculosis
TDVDFAVRICTEITGLVRTLAERDADKP

SEQ ID NO: 1379689 - protein, 17 aa, Mycobacterium tuberculosis
TDWTGRFNASPLREALI

SEQ ID NO: 1379690 - protein, 22 aa, Mycobacterium tuberculosis
TEDLKLLGVHIFGTSATEMVHI

SEQ ID NO: 1379691 - protein, 17 aa, Mycobacterium tuberculosis
TGIPLALGSYWAMFILV

SEQ ID NO: 1379692 - protein, 23 aa, Mycobacterium tuberculosis
TGIPLALGSYWAMFILVPGTLVL

SEQ ID NO: 1379693 - protein, 33 aa, Mycobacterium tuberculosis; identical to SEQ ID NO: 163850

SEQ ID NO: 1379694 - protein, 20 aa, Mycobacterium tuberculosis
TKVCSHLGCPSSLYEQQSYR

SEQ ID NO: 1379695 - protein, 21 aa, Mycobacterium tuberculosis
TLAILMLLPLSAFEATVALPA

SEQ ID NO: 1379696 - protein, 17 aa, Mycobacterium tuberculosis
TLYAHRPARGIGISECT

SEQ ID NO: 1379697 - protein, 20 aa, Mycobacterium tuberculosis
TMLTRLQRALAHEQQFVADA

SEQ ID NO: 1379698 - protein, 18 aa, Mycobacterium tuberculosis
TPPARWPVTLHVLPTVWD

SEQ ID NO: 1379699 - protein, 20 aa, Mycobacterium tuberculosis
TPPGHGWPPGLPPLPRRPRR

SEQ ID NO: 1379700 - protein, 21 aa, Mycobacterium tuberculosis
TPTWCRHTAELVGPASQQVIA

SEQ ID NO: 1379701 - protein, 20 aa, Mycobacterium tuberculosis
TRAGLRFAAPLIAAGLRALF

SEQ ID NO: 1379702 - protein, 17 aa, Mycobacterium tuberculosis
TRNALALGLTLTVISFF

SEQ ID NO: 1379703 - protein, 17 aa, Mycobacterium tuberculosis
TSIPFIISMQGVNSSEQ

SEQ ID NO: 1379704 - protein, 22 aa, Mycobacterium tuberculosis
TVRGARNYPCQEFPGKRAPTVQ

SEQ ID NO: 1379705 - protein, 24 aa, Mycobacterium tuberculosis
TVVVSSLIGGFVFGAAMVGMLAAM

SEQ ID NO: 1379706 - protein, 40 aa, Mycobacterium tuberculosis
TWNYLDRMGRSWSVRANLHFLWLRLARVWPVYLVTLHLAA

SEQ ID NO: 1379707 - protein, 19 aa, Mycobacterium tuberculosis
TYTRRRRNLLIGIGAGAAV

SEQ ID NO: 1379708 - protein, 23 aa, Mycobacterium tuberculosis
VAHDLELIGYVGLADTARPSSRP

SEQ ID NO: 1379709 - protein, 22 aa, Mycobacterium tuberculosis
VAMLIGRFFLIIPVLAIAGSLA

SEQ ID NO: 1379710 - protein, 19 aa, Mycobacterium tuberculosis
VDSGTWLAWAAWAALGLGV

SEQ ID NO: 1379711 - protein, 23 aa, Mycobacterium tuberculosis
VFALRRVWWLYKLVMSGQPASGR

SEQ ID NO: 1379712 - protein, 20 aa, Mycobacterium tuberculosis
VFPSATSRWVFEARPDLPTT

SEQ ID NO: 1379713 - protein, 19 aa, Mycobacterium tuberculosis
VGARRATYWAVLDTLVVGY

SEQ ID NO: 1379714 - protein, 18 aa, Mycobacterium tuberculosis
VGSEPDFLRVWLPGQLLQ

SEQ ID NO: 1379715 - protein, 18 aa, Mycobacterium tuberculosis
VGSYRKTRLVPFGEYVLR

SEQ ID NO: 1379716 - protein, 20 aa, Mycobacterium tuberculosis
VGYYILRRALRPDGGQLIGV

SEQ ID NO: 1379717 - protein, 31 aa, Mycobacterium tuberculosis; identical to SEQ ID NO: 207827

SEQ ID NO: 1379718 - protein, 17 aa, Mycobacterium tuberculosis
VHPQPPWPHLAAAALTA

SEQ ID NO: 1379719 - protein, 18 aa, Mycobacterium tuberculosis
VIQAPRLFAGQIDFGDVG

SEQ ID NO: 1379720 - protein, 19 aa, Mycobacterium tuberculosis
VIRLIRRLLPALVVVLAGC

SEQ ID NO: 1379721 - protein, 24 aa, Mycobacterium tuberculosis
VLLIGLVRWYLGTALFDSIARKLS

SEQ ID NO: 1379722 - protein, 23 aa, Mycobacterium tuberculosis
VNLLLSPAVFRGFDQVGALSPTG

SEQ ID NO: 1379723 - protein, 19 aa, Mycobacterium tuberculosis
VNQHDRLRVPIGVTPDGTA

SEQ ID NO: 1379724 - protein, 20 aa, Mycobacterium tuberculosis
VPGFAWWAAALNSLPMLAAL

SEQ ID NO: 1379725 - protein, 19 aa, Mycobacterium tuberculosis
VPWWWWPLAFALAALIAFE

SEQ ID NO: 1379726 - protein, 17 aa, Mycobacterium tuberculosis
VRASVNFATRVATIDAV

SEQ ID NO: 1379727 - protein, 20 aa, Mycobacterium tuberculosis
VRPAPGQGLSPAVSTLVVAS

SEQ ID NO: 1379728 - protein, 20 aa, Mycobacterium tuberculosis
VSVTFVDRLPGWNVDISGVG

SEQ ID NO: 1379729 - protein, 25 aa, Mycobacterium tuberculosis
VTAAGATAAWAIGRWTPGTERRTAT

SEQ ID NO: 1379730 - protein, 19 aa, Mycobacterium tuberculosis
VTAALRFGGMVGTSQAGES

SEQ ID NO: 1379731 - protein, 42 aa, Mycobacterium tuberculosis
VTTTLSGRFCVPVVRTPRPQLTAAFGGALWAARRPGDTSATV

SEQ ID NO: 1379732 - protein, 23 aa, Mycobacterium tuberculosis
VVHDLELIGYVGLADTARPSSRP

SEQ ID NO: 1379733 - protein, 18 aa, Mycobacterium tuberculosis
VVLPRLITKMKHLGVQSS

SEQ ID NO: 1379734 - protein, 19 aa, Mycobacterium tuberculosis
VVLVHEFTEVIVIANGVRA

SEQ ID NO: 1379735 - protein, 24 aa, Mycobacterium tuberculosis
VVLVHEFTEVIVIANGVRAGRIKP

SEQ ID NO: 1379736 - protein, 34 aa, Mycobacterium tuberculosis
VVRLGVSLAVCLLTAFLLIAVFGEVRFGDGKTYY

SEQ ID NO: 1379737 - protein, 20 aa, Mycobacterium tuberculosis
VVVAQRLVAIAGLAGLGIAN

SEQ ID NO: 1379738 - protein, 18 aa, Mycobacterium tuberculosis
WASVQLLALISVSVVAAS

SEQ ID NO: 1379739 - protein, 19 aa, Mycobacterium tuberculosis
WCVARRSWHAPRLGSISAG

SEQ ID NO: 1379740 - protein, 18 aa, Mycobacterium tuberculosis
WFGHFPGWIPLGAMVLPF

SEQ ID NO: 1379741 - protein, 20 aa, Mycobacterium tuberculosis
WFMVVQLPFAGIVFAVDGVL

SEQ ID NO: 1379742 - protein, 26 aa, Mycobacterium tuberculosis
WGIDQRLKRFGAMAAAMVLYVLISQL

SEQ ID NO: 1379743 - protein, 22 aa, Mycobacterium tuberculosis
WRILLPHSRPAVLVLGVLTWVN

SEQ ID NO: 1379744 - protein, 21 aa, Mycobacterium tuberculosis
WSNEAKLTLSDVFGDPATIED

SEQ ID NO: 1379745 - protein, 19 aa, Mycobacterium tuberculosis
WVTPARWGFAASAATVDLI

SEQ ID NO: 1379746 - protein, 18 aa, Mycobacterium tuberculosis
YFLLAPMLIVFSVAVAGV

SEQ ID NO: 1379747 - protein, 41 aa, Mycobacterium tuberculosis
YNIAGLPFPLSSAILPRFFYTKEIGKRLNAYYVANVQEDFA

SEQ ID NO: 1379748 - protein, 19 aa, Mycobacterium tuberculosis
YSDTVPLYGAELLSQGKFP

SEQ ID NO: 1379749 - protein, 20 aa, Mycobacterium tuberculosis
YSVPWRLIGQRLHARTAGDV

SEQ ID NO: 1379750 - protein, 27 aa, Mycobacterium tuberculosis
YWEKHCYDIPVCWSLRSVFDTLDGIDV

SEQ ID NO: 1379751 - protein, 19 aa, Mycobacterium tuberculosis
YWLFHGGTIGKFKDLLINC

SEQ ID NO: 1379752 - protein, 18 aa, Mycobacterium tuberculosis
YYQLCYSDTVPLYGAELL

SEQ ID NO: 1379753 - protein, 17 aa, Mycobacterium tuberculosis
AAFIDWAPYVVLVGIGW

SEQ ID NO: 1379754 - protein, 23 aa, Mycobacterium tuberculosis
AAGRARTLIYHRLAHGPAAAAVG

SEQ ID NO: 1379755 - protein, 20 aa, Mycobacterium tuberculosis
AAHRRVWRDREPALASPRRP

SEQ ID NO: 1379756 - protein, 23 aa, Mycobacterium tuberculosis
AALAAHCVHRFGGVTGDVLGSAI

SEQ ID NO: 1379757 - protein, 19 aa, Mycobacterium tuberculosis
AALALRFTGRRLGIYTTIV

SEQ ID NO: 1379758 - protein, 18 aa, Mycobacterium tuberculosis
AALPHFLGSAGVRLLLVS

SEQ ID NO: 1379759 - protein, 21 aa, Mycobacterium tuberculosis
AALQRCGRVTAMVGDGANDAA

SEQ ID NO: 1379760 - protein, 28 aa, Mycobacterium tuberculosis
AALSAAGYLCWRGKDLATPRGWITALRA

SEQ ID NO: 1379761 - protein, 18 aa, Mycobacterium tuberculosis
AALTHWVDTGGYAKVIAG

SEQ ID NO: 1379762 - protein, 29 aa, Mycobacterium tuberculosis
AAMSSCVACAGFIAACWIIGLSWANAGKP

SEQ ID NO: 1379763 - protein, 24 aa, Mycobacterium tuberculosis
AAQHWLERFSWIALVIAVIAGITA

SEQ ID NO: 1379764 - protein, 18 aa, Mycobacterium tuberculosis
AARALGRKVPKSRRAVSL

SEQ ID NO: 1379765 - protein, 17 aa, Mycobacterium tuberculosis
AAVHPRFKVPFRAELVV

SEQ ID NO: 1379766 - protein, 17 aa, Mycobacterium tuberculosis
AAVITFAALLVVQANQD

SEQ ID NO: 1379767 - protein, 21 aa, Mycobacterium tuberculosis
ADAAASLWHPHIVAVHDRGEF

SEQ ID NO: 1379768 - protein, 20 aa, Mycobacterium tuberculosis
ADGWRWVFLVNLPLGVFAVL

SEQ ID NO: 1379769 - protein, 21 aa, Mycobacterium tuberculosis
ADLVLAVGFFLLGDLAAIKLE

SEQ ID NO: 1379770 - protein, 26 aa, Mycobacterium tuberculosis
ADPLFLDWLVGLAFPCQRPFGHQYGV

SEQ ID NO: 1379771 - protein, 21 aa, Mycobacterium tuberculosis
ADRGMPLLVLVVMAQLVLCGG

SEQ ID NO: 1379772 - protein, 20 aa, Mycobacterium tuberculosis
ADTAIAIKRAEVRRAAEIMW

SEQ ID NO: 1379773 - protein, 18 aa, Mycobacterium tuberculosis
ADVRMVLKSAAKLKRLAP

SEQ ID NO: 1379774 - protein, 19 aa, Mycobacterium tuberculosis
ADWLADRGAHRLVLTGRTP

SEQ ID NO: 1379775 - protein, 20 aa, Mycobacterium tuberculosis
AEALCWDVGEVVELRGRAAP

SEQ ID NO: 1379776 - protein, 20 aa, Mycobacterium tuberculosis
AEGALLIVIFATSGALEALV

SEQ ID NO: 1379777 - protein, 21 aa, Mycobacterium tuberculosis
AEIGTQFGAFVVFTLLVLAVI

SEQ ID NO: 1379778 - protein, 21 aa, Mycobacterium tuberculosis
AEPKSSAGPMFSTYGIASTLL

SEQ ID NO: 1379779 - protein, 25 aa, Mycobacterium tuberculosis
AGAAICLLALMATLATASRRLRPRR

SEQ ID NO: 1379780 - protein, 23 aa, Mycobacterium tuberculosis
AGDAVACAIPLPPIARLLDDLDV

SEQ ID NO: 1379781 - protein, 20 aa, Mycobacterium tuberculosis
AGLPPGRFALGIIGRTMVVW

SEQ ID NO: 1379782 - protein, 17 aa, Mycobacterium tuberculosis
AGLPWYAILCLPVLFAA

SEQ ID NO: 1379783 - protein, 17 aa, Mycobacterium tuberculosis
AGMAAGMLNLQRSLGGI

SEQ ID NO: 1379784 - protein, 21 aa, Mycobacterium tuberculosis
AGPKRLGRVMAVVGIPMLLGP

SEQ ID NO: 1379785 - protein, 30 aa, Mycobacterium tuberculosis
AGPLGLCFLPAFLCVGIVPLVVGLAGDVLQ

SEQ ID NO: 1379786 - protein, 19 aa, Mycobacterium tuberculosis
AGPWLRTGDSGFLSEGELF

SEQ ID NO: 1379787 - protein, 17 aa, Mycobacterium tuberculosis
AGPYPPGPPPPGPGSKT

SEQ ID NO: 1379788 - protein, 17 aa, Mycobacterium tuberculosis
AGVDEWFICGPLAMATA

SEQ ID NO: 1379789 - protein, 18 aa, Mycobacterium tuberculosis
AGVILLFAGLAGRGVPAL

SEQ ID NO: 1379790 - protein, 19 aa, Mycobacterium tuberculosis
AGVVPEWLAYTVAVVLGVT

SEQ ID NO: 1379791 - protein, 25 aa, Mycobacterium tuberculosis
AHGLGMPIPLGWQVWLYGVFAIIAV

SEQ ID NO: 1379792 - protein, 25 aa, Mycobacterium tuberculosis
AHRRKRSESGVGIRGYRDEFLDATA

SEQ ID NO: 1379793 - protein, 25 aa, Mycobacterium tuberculosis
AIGPDWRLVLCGGPAEVVLDRATLA

SEQ ID NO: 1379794 - protein, 17 aa, Mycobacterium tuberculosis
AIITILGLIIAYIFRPA

SEQ ID NO: 1379795 - protein, 28 aa, Mycobacterium tuberculosis
AILQRMSPFWQRMFLTIGILIAVFGMRL

SEQ ID NO: 1379796 - protein, 18 aa, Mycobacterium tuberculosis
AIPLSFLVLIWVFGGLLA

SEQ ID NO: 1379797 - protein, 17 aa, Mycobacterium tuberculosis
AITGLVASAAWTIGSNL

SEQ ID NO: 1379798 - protein, 17 aa, Mycobacterium tuberculosis
AKVWPYFLRRRPQQPPP

SEQ ID NO: 1379799 - protein, 18 aa, Mycobacterium tuberculosis
ALHFLRITALSVVLLALG

SEQ ID NO: 1379800 - protein, 18 aa, Mycobacterium tuberculosis
ALKKAVMLLGVLAVLVAM

SEQ ID NO: 1379801 - protein, 20 aa, Mycobacterium tuberculosis
ALKMPYPRFLAANVTGGICW

SEQ ID NO: 1379802 - protein, 26 aa, Mycobacterium tuberculosis
ALLGDRYGRRRSFVFGVTLFVVSSIV

SEQ ID NO: 1379803 - protein, 26 aa, Mycobacterium tuberculosis
ALLVAVFVVVDWRIHAAVLPPSVFGS

SEQ ID NO: 1379804 - protein, 25 aa, Mycobacterium tuberculosis
ALLVNRWPLPEAGVRSGLAPAERDT

SEQ ID NO: 1379805 - protein, 19 aa, Mycobacterium tuberculosis
ALMLDPRLAKSVAAAAITS

SEQ ID NO: 1379806 - protein, 18 aa, Mycobacterium tuberculosis
ALPRLAKVWPYFLRRRPQ

SEQ ID NO: 1379807 - protein, 19 aa, Mycobacterium tuberculosis
ALPVPLPTHRLVLGAVLAI

SEQ ID NO: 1379808 - protein, 23 aa, Mycobacterium tuberculosis
ALTRPRWPTMGPRGDRNRREQVI

SEQ ID NO: 1379809 - protein, 18 aa, Mycobacterium tuberculosis
ALVLLQLRVFYAREQPWT

SEQ ID NO: 1379810 - protein, 21 aa, Mycobacterium tuberculosis
ALVWAGSLVWYLQRVGSEPDF

SEQ ID NO: 1379811 - protein, 27 aa, Mycobacterium tuberculosis
AMPGAGRPRWQCGVAALGSALVGALPW

SEQ ID NO: 1379812 - protein, 18 aa, Mycobacterium tuberculosis
ANLMLGFAAIFVGTVCAL

SEQ ID NO: 1379813 - protein, 24 aa, Mycobacterium tuberculosis
APGLRLAVVFLCAAAISAAVVTGY

SEQ ID NO: 1379814 - protein, 23 aa, Mycobacterium tuberculosis
APGYTAARPSLSFDHDAHAEPEP

SEQ ID NO: 1379815 - protein, 23 aa, Mycobacterium tuberculosis
APLPVVAEVVMFFNVAAFGLALA

SEQ ID NO: 1379816 - protein, 27 aa, Mycobacterium tuberculosis
APLVVGCILLAGLVGMCSFQLGGTKRG

SEQ ID NO: 1379817 - protein, 23 aa, Mycobacterium tuberculosis
APPLRLLEDLPRRVRVSDAHQSG

SEQ ID NO: 1379818 - protein, 19 aa, Mycobacterium tuberculosis
APRGFRAAFAAAYAVAYLA

SEQ ID NO: 1379819 - protein, 20 aa, Mycobacterium tuberculosis
APSAGTPVGPWLRTGDSGFV

SEQ ID NO: 1379820 - protein, 37 aa, Mycobacterium tuberculosis
APVIGMAMRAWWETGRSLWWPLAIGILGIAVLVGSFV

SEQ ID NO: 1379821 - protein, 25 aa, Mycobacterium tuberculosis
APVPMLPGSWGPDLVGVAGDGGLVS

SEQ ID NO: 1379822 - protein, 18 aa, Mycobacterium tuberculosis
APVWSRRLVDRGCPKVLA

SEQ ID NO: 1379823 - protein, 19 aa, Mycobacterium tuberculosis
AQARLAALSILVGAVGATG

SEQ ID NO: 1379824 - protein, 17 aa, Mycobacterium tuberculosis
AQGLRVLLLAAGSVAVD

SEQ ID NO: 1379825 - protein, 23 aa, Mycobacterium tuberculosis
AQLPCLPILFIVVDEFSELLSQH

SEQ ID NO: 1379826 - protein, 18 aa, Mycobacterium tuberculosis
AQTPRKTNPWPFVAVAAA

SEQ ID NO: 1379827 - protein, 17 aa, Mycobacterium tuberculosis
AQVPLWIGPILLYVLLP

SEQ ID NO: 1379828 - protein, 18 aa, Mycobacterium tuberculosis
ARAAAPLSEAMRVVGVNW

SEQ ID NO: 1379829 - protein, 21 aa, Mycobacterium tuberculosis
ARARRYATAYLDLHYETESAE

SEQ ID NO: 1379830 - protein, 30 aa, Mycobacterium tuberculosis
ARHMGLFVVGRLAGRHGIRVGLRGPVTGEQ

SEQ ID NO: 1379831 - protein, 26 aa, Mycobacterium tuberculosis
ARIKYKVGPTIAWYQDFLRYYFLTVE

SEQ ID NO: 1379832 - protein, 17 aa, Mycobacterium tuberculosis
ARYATTVIKHMVKGNDD

SEQ ID NO: 1379833 - protein, 18 aa, Mycobacterium tuberculosis
ASAWVGALVTGWWIGVLA

SEQ ID NO: 1379834 - protein, 25 aa, Mycobacterium tuberculosis
ASEMARGWIVAAICALVVATALRLY

SEQ ID NO: 1379835 - protein, 20 aa, Mycobacterium tuberculosis
ASISMSGYPVMLRDIRDYYE

SEQ ID NO: 1379836 - protein, 17 aa, Mycobacterium tuberculosis
ASLVCFLLIITIPFGFA

SEQ ID NO: 1379837 - protein, 19 aa, Mycobacterium tuberculosis
ASRWAVFRRVLLPQLRPTT

SEQ ID NO: 1379838 - protein, 22 aa, Mycobacterium tuberculosis
ATAVLPRSATPVLLPDVVAAAP

SEQ ID NO: 1379839 - protein, 26 aa, Mycobacterium tuberculosis
ATDLAEWLVRQGVPFRSAHEAAGAAV

SEQ ID NO: 1379840 - protein, 30 aa, Mycobacterium tuberculosis
ATEGAVGRSVRWYLVFSQPAAVNVAEQVVL

SEQ ID NO: 1379841 - protein, 19 aa, Mycobacterium tuberculosis
ATESVRMLAPIPGKSAVGI

SEQ ID NO: 1379842 - protein, 17 aa, Mycobacterium tuberculosis
ATGRAPASYYRAHSKRL

SEQ ID NO: 1379843 - protein, 22 aa, Mycobacterium tuberculosis
ATSAFWAFGVFYLVASVLTWAI

SEQ ID NO: 1379844 - protein, 18 aa, Mycobacterium tuberculosis
ATTWLHVSGYRFLLRRIE

SEQ ID NO: 1379845 - protein, 20 aa, Mycobacterium tuberculosis
ATVIGLLTILGFSLYDTVIV

SEQ ID NO: 1379846 - protein, 19 aa, Mycobacterium tuberculosis
ATYLRGDWYRDWGSVEQYH

SEQ ID NO: 1379847 - protein, 19 aa, Mycobacterium tuberculosis
AVAAGRIRSLLSTRTPSSP

SEQ ID NO: 1379848 - protein, 24 aa, Mycobacterium tuberculosis
AVAFFAVVVLIGFWVAGSHEVQSA

SEQ ID NO: 1379849 - protein, 22 aa, Mycobacterium tuberculosis
AVALPLASLVGWLVSQISSGRG

SEQ ID NO: 1379850 - protein, 23 aa, Mycobacterium tuberculosis
AVFFFLGCFTIVGTRQFAIMTTF

SEQ ID NO: 1379851 - protein, 23 aa, Mycobacterium tuberculosis
AVGGRHRVVIIGSGFGGLNAAKA

SEQ ID NO: 1379852 - protein, 17 aa, Mycobacterium tuberculosis
AVIGKCYSTHPGVVDAM

SEQ ID NO: 1379853 - protein, 17 aa, Mycobacterium tuberculosis
AVLAILVWWALRHRNRC

SEQ ID NO: 1379854 - protein, 22 aa, Mycobacterium tuberculosis
AVLVTLAGRRLWHRFRGQPDRA

SEQ ID NO: 1379855 - protein, 19 aa, Mycobacterium tuberculosis
AVLVWWHFVGANTSDDGYI

SEQ ID NO: 1379856 - protein, 20 aa, Mycobacterium tuberculosis
AVQLPAVWLLSAVTVGLFGL

SEQ ID NO: 1379857 - protein, 17 aa, Mycobacterium tuberculosis
AVVCTLAAVASVLGIVD

SEQ ID NO: 1379858 - protein, 20 aa, Mycobacterium tuberculosis
AWWFDWLPHHGLEDTQRSNR

SEQ ID NO: 1379859 - protein, 22 aa, Mycobacterium tuberculosis
AWYQDFLRYYFLTVESNVEGSM

SEQ ID NO: 1379860 - protein, 17 aa, Mycobacterium tuberculosis
AYLGLANGLGFLAGTIV

SEQ ID NO: 1379861 - protein, 19 aa, Mycobacterium tuberculosis
AYLLPARNWSVMAATEVRS

SEQ ID NO: 1379862 - protein, 24 aa, Mycobacterium tuberculosis
CGTAPDLKGITGWLNTPGNKPIDL

SEQ ID NO: 1379863 - protein, 18 aa, Mycobacterium tuberculosis
CLAAAVFAVGTGIGLPTA

SEQ ID NO: 1379864 - protein, 18 aa, Mycobacterium tuberculosis
CPGEGPSPDGWHYNQTPD

SEQ ID NO: 1379865 - protein, 17 aa, Mycobacterium tuberculosis
CPSRTDVLGAALANVVG

SEQ ID NO: 1379866 - protein, 18 aa, Mycobacterium tuberculosis
CWLIVSRFVLRRLGPGPG

SEQ ID NO: 1379867 - protein, 17 aa, Mycobacterium tuberculosis
DAALVRDGTRWQIVGDP

SEQ ID NO: 1379868 - protein, 22 aa, Mycobacterium tuberculosis
DADKPAALWILTRGVHESVAPS

SEQ ID NO: 1379869 - protein, 18 aa, Mycobacterium tuberculosis
DAGARFGVEDSKEARDAL

SEQ ID NO: 1379870 - protein, 27 aa, Mycobacterium tuberculosis
DAPPGRLPSWLRPRLGDEHARERTPDA

SEQ ID NO: 1379871 - protein, 25 aa, Mycobacterium tuberculosis
DDDERKKRLGVMLATGLIVGESLYG

SEQ ID NO: 1379872 - protein, 27 aa, Mycobacterium tuberculosis
DDGLRPEPIIALGILLTWCSVERAVAT

SEQ ID NO: 1379873 - protein, 18 aa, Mycobacterium tuberculosis
DMARLAVSFNDMAESLSR

SEQ ID NO: 1379874 - protein, 24 aa, Mycobacterium tuberculosis
DNALRYAPDCVVRVNAGRVRERVL

SEQ ID NO: 1379875 - protein, 24 aa, Mycobacterium tuberculosis
DPEGAHARWNWVLDGMVETKALSP

SEQ ID NO: 1379876 - protein, 20 aa, Mycobacterium tuberculosis
DPSPGFPLTRAERLNVVFLL

SEQ ID NO: 1379877 - protein, 20 aa, Mycobacterium tuberculosis
DPSYRHVRESMFSSDGTATR

SEQ ID NO: 1379878 - protein, 24 aa, Mycobacterium tuberculosis
DQVTSHAVLIGWRAVPRRHGGELP

SEQ ID NO: 1379879 - protein, 19 aa, Mycobacterium tuberculosis
DRLPMVLGLIAAITYVLLF

SEQ ID NO: 1379880 - protein, 18 aa, Mycobacterium tuberculosis
DSEAMLLAAIYVAALRSY

SEQ ID NO: 1379881 - protein, 20 aa, Mycobacterium tuberculosis
DTNVAPAYRSSVSASVSASA

SEQ ID NO: 1379882 - protein, 18 aa, Mycobacterium tuberculosis
DVVPRVTPPPGIASPPTV

SEQ ID NO: 1379883 - protein, 24 aa, Mycobacterium tuberculosis
DVVPSRLRRPGAVVLEIDDEDPIF

SEQ ID NO: 1379884 - protein, 19 aa, Mycobacterium tuberculosis
DWAPYVVLVGIGWVIMLVT

SEQ ID NO: 1379885 - protein, 20 aa, Mycobacterium tuberculosis
DWAPYVVLVGIGWVIMLVTQ

SEQ ID NO: 1379886 - protein, 19 aa, Mycobacterium tuberculosis
DYVRMWLQAAAVMGLYQAA

SEQ ID NO: 1379887 - protein, 18 aa, Mycobacterium tuberculosis
EAFTGFFAALINVRIAGP

SEQ ID NO: 1379888 - protein, 21 aa, Mycobacterium tuberculosis
EAGLPPGRFALGIIGRTMVVW

SEQ ID NO: 1379889 - protein, 21 aa, Mycobacterium tuberculosis
EARAGDRYLLCSDGLSDPVSD

SEQ ID NO: 1379890 - protein, 25 aa, Mycobacterium tuberculosis
EATEASVRWRAVLLAAVAACAACGL

SEQ ID NO: 1379891 - protein, 17 aa, Mycobacterium tuberculosis
ECGTGDFGAQASLYTSM

SEQ ID NO: 1379892 - protein, 24 aa, Mycobacterium tuberculosis
EESNFPAIVKFLSEQVLSRATERV

SEQ ID NO: 1379893 - protein, 17 aa, Mycobacterium tuberculosis
EFFRVVVETVARHGGFV

SEQ ID NO: 1379894 - protein, 19 aa, Mycobacterium tuberculosis
EGFALPLVHTAWLTTLVFT

SEQ ID NO: 1379895 - protein, 24 aa, Mycobacterium tuberculosis
EGKKAVLWTSGWTPRYQGETIYLA

SEQ ID NO: 1379896 - protein, 21 aa, Mycobacterium tuberculosis
EGRGANVFFMLGGQRLDLSSL

SEQ ID NO: 1379897 - protein, 18 aa, Mycobacterium tuberculosis
EITGEIRALTGLRIVAAV

SEQ ID NO: 1379898 - protein, 18 aa, Mycobacterium tuberculosis
ELFCTIRNFYDADPLAKA

SEQ ID NO: 1379899 - protein, 27 aa, Mycobacterium tuberculosis
EMHWSLPGLSFILLVAIGADYNMLLIS

SEQ ID NO: 1379900 - protein, 17 aa, Mycobacterium tuberculosis
ENPDFKRGLKMFLSPDG

SEQ ID NO: 1379901 - protein, 28 aa, Mycobacterium tuberculosis
EPEVVQWKLKPGVVSTMSAQARYTDPNT

SEQ ID NO: 1379902 - protein, 18 aa, Mycobacterium tuberculosis
EPLYRSVLIVYFVVMSCF

SEQ ID NO: 1379903 - protein, 19 aa, Mycobacterium tuberculosis
EPRNIWVMIGVPALIVALI

SEQ ID NO: 1379904 - protein, 21 aa, Mycobacterium tuberculosis
EPRYTWTIAEPDAAVTEFVLL

SEQ ID NO: 1379905 - protein, 22 aa, Mycobacterium tuberculosis
EPSSLKIAFPAAHLSNGKRVTS

SEQ ID NO: 1379906 - protein, 23 aa, Mycobacterium tuberculosis
EQPLPGPRWPRALRASATRRALL

SEQ ID NO: 1379907 - protein, 19 aa, Mycobacterium tuberculosis
ERRGRGDDRWCEIPVGAKP

SEQ ID NO: 1379908 - protein, 17 aa, Mycobacterium tuberculosis
ETFNVIFVDMKFESAAQ

SEQ ID NO: 1379909 - protein, 26 aa, Mycobacterium tuberculosis
ETYSQRAVTMLRVRQGASTGETVACV

SEQ ID NO: 1379910 - protein, 29 aa, Mycobacterium tuberculosis
EVADALRIGAYRSTCLAGLDDQVSHLCLG

SEQ ID NO: 1379911 - protein, 19 aa, Mycobacterium tuberculosis
EVIQPYLPIAVVAALDAVF

SEQ ID NO: 1379912 - protein, 18 aa, Mycobacterium tuberculosis
EVLALPLVAVVLFFVFGG

SEQ ID NO: 1379913 - protein, 19 aa, Mycobacterium tuberculosis
EWELPIVLDSAAGFGSTYA

SEQ ID NO: 1379914 - protein, 26 aa, Mycobacterium tuberculosis
FDGSPMCGDASMALTMALLAAAVLYA

SEQ ID NO: 1379915 - protein, 17 aa, Mycobacterium tuberculosis
FDRTNGYTAEFSNVSGL

SEQ ID NO: 1379916 - protein, 19 aa, Mycobacterium tuberculosis
FFALFLYVVMLVFLVATAP

SEQ ID NO: 1379917 - protein, 25 aa, Mycobacterium tuberculosis
FGGKVSYLALGILVAIALVIGGIGG

SEQ ID NO: 1379918 - protein, 24 aa, Mycobacterium tuberculosis
FGGMVVVCMIWRLFMQDSVTRPTT

SEQ ID NO: 1379919 - protein, 24 aa, Mycobacterium tuberculosis
FGHMLSGMAIRIVDVFRITRKVGV

SEQ ID NO: 1379920 - protein, 19 aa, Mycobacterium tuberculosis
FGIDFKGGTTVSFPRGSTQ

SEQ ID NO: 1379921 - protein, 18 aa, Mycobacterium tuberculosis
FGLALAWLTTVWATSGLA

SEQ ID NO: 1379922 - protein, 20 aa, Mycobacterium tuberculosis
FGPYRLRRLVGRGGMGDVYE

SEQ ID NO: 1379923 - protein, 17 aa, Mycobacterium tuberculosis
FGSFIGFSFAFGQVLQI

SEQ ID NO: 1379924 - protein, 17 aa, Mycobacterium tuberculosis
FGVLRWFFTTYRIDDEN

SEQ ID NO: 1379925 - protein, 19 aa, Mycobacterium tuberculosis
FIDHTVIGCSLVRGTPYRY

SEQ ID NO: 1379926 - protein, 17 aa, Mycobacterium tuberculosis
FKGGTTVSFPRGSTQVA

SEQ ID NO: 1379927 - protein, 17 aa, Mycobacterium tuberculosis
FKKGAQIFLSADGHAAR

SEQ ID NO: 1379928 - protein, 18 aa, Mycobacterium tuberculosis
FKKGAQIFLSADGHAARY

SEQ ID NO: 1379929 - protein, 17 aa, Mycobacterium tuberculosis
FKSLAFMAAGSVLAATG

SEQ ID NO: 1379930 - protein, 17 aa, Mycobacterium tuberculosis
FKVLVMVLWLAPIGAFG

SEQ ID NO: 1379931 - protein, 19 aa, Mycobacterium tuberculosis
FLLIITIPFGFAALRIAAS

SEQ ID NO: 1379932 - protein, 24 aa, Mycobacterium tuberculosis
FLTGPRTQIGFAVLVIVVVAVLAL

SEQ ID NO: 1379933 - protein, 17 aa, Mycobacterium tuberculosis
FLVGRSAEHTTVLADQL

SEQ ID NO: 1379934 - protein, 17 aa, Mycobacterium tuberculosis
FNVRGARNIPCETVPGK

SEQ ID NO: 1379935 - protein, 23 aa, Mycobacterium tuberculosis
FPAHRRGVALGAWGTVASVASLV

SEQ ID NO: 1379936 - protein, 28 aa, Mycobacterium tuberculosis
FPLGVVVGGPFLPLAIVLYWFSNNIWTF

SEQ ID NO: 1379937 - protein, 18 aa, Mycobacterium tuberculosis
FPQARMEPEVLMVEADHD

SEQ ID NO: 1379938 - protein, 19 aa, Mycobacterium tuberculosis
FPSATSRWVFEARPDLPTT

SEQ ID NO: 1379939 - protein, 17 aa, Mycobacterium tuberculosis
FRMGWWSIIGYAAAAII

SEQ ID NO: 1379940 - protein, 23 aa, Mycobacterium tuberculosis
FRPIRSYFYWEKHCYDIPVCWSL

SEQ ID NO: 1379941 - protein, 22 aa, Mycobacterium tuberculosis
FTMMMRLPWLYRVPVHTIHKFG

SEQ ID NO: 1379942 - protein, 27 aa, Mycobacterium tuberculosis
FTSDIKNLLPMLAVFKPTVVVSVPRVF

SEQ ID NO: 1379943 - protein, 17 aa, Mycobacterium tuberculosis
FVIGHLLGVPGWVTQRL

SEQ ID NO: 1379944 - protein, 17 aa, Mycobacterium tuberculosis
FVLFSWWAFDYAGSGAN

SEQ ID NO: 1379945 - protein, 19 aa, Mycobacterium tuberculosis
FVMVLAFSRHLFVRPVIRM

SEQ ID NO: 1379946 - protein, 17 aa, Mycobacterium tuberculosis
FVREADVAAGLDHPNIV

SEQ ID NO: 1379947 - protein, 17 aa, Mycobacterium tuberculosis
FVTRPVGSWFLGRFADR

SEQ ID NO: 1379948 - protein, 18 aa, Mycobacterium tuberculosis
FWSLAPLVVGCILLAGLV

SEQ ID NO: 1379949 - protein, 21 aa, Mycobacterium tuberculosis
FYTLLRITRLIGIVIIAVSLP

SEQ ID NO: 1379950 - protein, 18 aa, Mycobacterium tuberculosis
FYWAVGIAIGLPAGLIVL

SEQ ID NO: 1379951 - protein, 18 aa, Mycobacterium tuberculosis
GAADLSFGDAPVVLTAGY

SEQ ID NO: 1379952 - protein, 17 aa, Mycobacterium tuberculosis
GAAEPAAHLPFRSGRSF

SEQ ID NO: 1379953 - protein, 24 aa, Mycobacterium tuberculosis
GAALCLPLARVLAAASCGPLSSKE

SEQ ID NO: 1379954 - protein, 17 aa, Mycobacterium tuberculosis
GAAQCPPQAPGVTRDSV

SEQ ID NO: 1379955 - protein, 18 aa, Mycobacterium tuberculosis
GAEFERLTGRLLAGFEAR

SEQ ID NO: 1379956 - protein, 20 aa, Mycobacterium tuberculosis
GAETLRFKGYLIMSRNSSHD

SEQ ID NO: 1379957 - protein, 25 aa, Mycobacterium tuberculosis
GAFTAFSRFCCALAISALAYEPPPA

SEQ ID NO: 1379958 - protein, 24 aa, Mycobacterium tuberculosis
GAIAGILLKMCWPAAPRSVGVPLY

SEQ ID NO: 1379959 - protein, 18 aa, Mycobacterium tuberculosis
GALATVIRAMGSLGMSSP

SEQ ID NO: 1379960 - protein, 21 aa, Mycobacterium tuberculosis
GALKKAVMLLGVLAVLVAMVG

SEQ ID NO: 1379961 - protein, 17 aa, Mycobacterium tuberculosis
GASWWLIEQPIRRWRPA

SEQ ID NO: 1379962 - protein, 29 aa, Mycobacterium tuberculosis
GCILLLEVLFLRWLLDGRASRQWCGGLAI

SEQ ID NO: 1379963 - protein, 24 aa, Mycobacterium tuberculosis
GCLPAVIWWACHRPNRLWWRYTAW

SEQ ID NO: 1379964 - protein, 19 aa, Mycobacterium tuberculosis
GCSALHIWADTGGAGADFM

SEQ ID NO: 1379965 - protein, 20 aa, Mycobacterium tuberculosis
GDFWPWALQFVATLWVSTFL

SEQ ID NO: 1379966 - protein, 19 aa, Mycobacterium tuberculosis
GDIGIEALIGFLSAFLNVR

SEQ ID NO: 1379967 - protein, 30 aa, Mycobacterium tuberculosis
GDVGWLRLPAFTWPTRPSWLYRLTQGLHVG

SEQ ID NO: 1379968 - protein, 17 aa, Mycobacterium tuberculosis
GELFIMGRIKDLLIVDG

SEQ ID NO: 1379969 - protein, 19 aa, Mycobacterium tuberculosis
GERRAWIEVRGLRSGGDDE

SEQ ID NO: 1379970 - protein, 26 aa, Mycobacterium tuberculosis
GFAALRIAASYALWPFGRTIVEKPTA

SEQ ID NO: 1379971 - protein, 23 aa, Mycobacterium tuberculosis
GFGAVLCCTRHWPPLTLGGLGRL

SEQ ID NO: 1379972 - protein, 23 aa, Mycobacterium tuberculosis
GFLQRPARWIQMLASNTLAFTAA

SEQ ID NO: 1379973 - protein, 30 aa, Mycobacterium tuberculosis
GGAAGRPNWRVLLLGLGTILAWLLIAILLA

SEQ ID NO: 1379974 - protein, 20 aa, Mycobacterium tuberculosis
GGGARGFAHLGVLDELERVG

SEQ ID NO: 1379975 - protein, 20 aa, Mycobacterium tuberculosis
GGGMTTRLQAPVAVTPPLPT

SEQ ID NO: 1379976 - protein, 22 aa, Mycobacterium tuberculosis
GGLLCVIPGLIFGFVAQFAVAF

SEQ ID NO: 1379977 - protein, 17 aa, Mycobacterium tuberculosis
GGTRWVVYEGSDENGAV

SEQ ID NO: 1379978 - protein, 24 aa, Mycobacterium tuberculosis
GGVSSFGFGGANAHVVVREVLPRD

SEQ ID NO: 1379979 - protein, 25 aa, Mycobacterium tuberculosis
GHWSLLVGYGCLPWVATAMLTMRTT

SEQ ID NO: 1379980 - protein, 17 aa, Mycobacterium tuberculosis
GILCSIGVLAVGLAALT

SEQ ID NO: 1379981 - protein, 20 aa, Mycobacterium tuberculosis
GIMWPSLLVILLLVAVVALL

SEQ ID NO: 1379982 - protein, 18 aa, Mycobacterium tuberculosis
GITTMWITATAFGLSILA

SEQ ID NO: 1379983 - protein, 18 aa, Mycobacterium tuberculosis
GLANRLFIPQVMFSTLFC

SEQ ID NO: 1379984 - protein, 19 aa, Mycobacterium tuberculosis
GLASWRPVTVAGLATGLLG

SEQ ID NO: 1379985 - protein, 21 aa, Mycobacterium tuberculosis
GLAVLRPGHTIPLARTQPALD

SEQ ID NO: 1379986 - protein, 19 aa, Mycobacterium tuberculosis
GLGTFAFGVARQADYLPIL

SEQ ID NO: 1379987 - protein, 17 aa, Mycobacterium tuberculosis
GLKKAPMPDGGHRHRAQ

SEQ ID NO: 1379988 - protein, 26 aa, Mycobacterium tuberculosis
GLMVDGLGWRSVFLVNVPLGAIVWLL

SEQ ID NO: 1379989 - protein, 27 aa, Mycobacterium tuberculosis
GLMVDGLGWRSVFLVNVPLGAIVWLLT

SEQ ID NO: 1379990 - protein, 24 aa, Mycobacterium tuberculosis
GLSSLRAGMIAGAIGLLLVLVYSL

SEQ ID NO: 1379991 - protein, 18 aa, Mycobacterium tuberculosis
GLVNGFRVEAERTVDSMG

SEQ ID NO: 1379992 - protein, 17 aa, Mycobacterium tuberculosis
GLVVAAVWAVGLVAGLV

SEQ ID NO: 1379993 - protein, 18 aa, Mycobacterium tuberculosis
GNPRWPADLRRRTFSSRE

SEQ ID NO: 1379994 - protein, 22 aa, Mycobacterium tuberculosis
GNSRYHWVPAAAGWTVGVIATL

SEQ ID NO: 1379995 - protein, 28 aa, Mycobacterium tuberculosis
GPAAGFFVGWSYWFAWVVTGIADLVAIT

SEQ ID NO: 1379996 - protein, 19 aa, Mycobacterium tuberculosis
GPAKIVLVGIMLIAAGLGT

SEQ ID NO: 1379997 - protein, 23 aa, Mycobacterium tuberculosis
GPAPEGMAMWIIGMVAAIGLALW

SEQ ID NO: 1379998 - protein, 22 aa, Mycobacterium tuberculosis
GPARLGFAGAVLITAGGLGAGS

SEQ ID NO: 1379999 - protein, 23 aa, Mycobacterium tuberculosis
GPNSVRVWLMLGVLLLSVVLAVR

SEQ ID NO: 1380000 - protein, 24 aa, Mycobacterium tuberculosis
GPRRRRRATARRKAPVKAPSATRQ

SEQ ID NO: 1380001 - protein, 23 aa, Mycobacterium tuberculosis
GPVIRLPLVLGLAQLLSRVPLPG

SEQ ID NO: 1380002 - protein, 24 aa, Mycobacterium tuberculosis
GQINWKWIRRSLYLTAAVVILLPM

SEQ ID NO: 1380003 - protein, 17 aa, Mycobacterium tuberculosis
GQMAITSQMIYARLVMT

SEQ ID NO: 1380004 - protein, 17 aa, Mycobacterium tuberculosis
GQRPVHPVTVWRKRLAV

SEQ ID NO: 1380005 - protein, 19 aa, Mycobacterium tuberculosis
GRLFTPFFITVGLVEAAYF

SEQ ID NO: 1380006 - protein, 24 aa, Mycobacterium tuberculosis
GRRFSRARLNPEVLLIETDHDMRN

SEQ ID NO: 1380007 - protein, 20 aa, Mycobacterium tuberculosis
GRYLEAAGISIAFSTAAVVL

SEQ ID NO: 1380008 - protein, 20 aa, Mycobacterium tuberculosis
GRYRLLIFHGGVPPLQFWQA

SEQ ID NO: 1380009 - protein, 30 aa, Mycobacterium tuberculosis
GSAWAVAGLGWLRRHTRAIQIFGGALLIAV

SEQ ID NO: 1380010 - protein, 31 aa, Mycobacterium tuberculosis; identical to SEQ ID NO: 200397

SEQ ID NO: 1380011 - protein, 31 aa, Mycobacterium tuberculosis
GSLVMVFQWGWARGLGFPALHSIDSTVPPLV

SEQ ID NO: 1380012 - protein, 20 aa, Mycobacterium tuberculosis
GTSRRSRWARLFDEGIGART

SEQ ID NO: 1380013 - protein, 25 aa, Mycobacterium tuberculosis
GTTVGLLPAWQIVLILLLLGVLGLR

SEQ ID NO: 1380014 - protein, 20 aa, Mycobacterium tuberculosis
GVAAVFRLAATLAVVLSVVM

SEQ ID NO: 1380015 - protein, 22 aa, Mycobacterium tuberculosis
GVGALSGMWGIPAVVAVATVGV

SEQ ID NO: 1380016 - protein, 17 aa, Mycobacterium tuberculosis
GVIDIVVEWVIGNLFGV

SEQ ID NO: 1380017 - protein, 19 aa, Mycobacterium tuberculosis
GVLIAYVFSLLGYDWLAHT

SEQ ID NO: 1380018 - protein, 17 aa, Mycobacterium tuberculosis
GVLRDGQKWVALAVPGY

SEQ ID NO: 1380019 - protein, 18 aa, Mycobacterium tuberculosis
GVSALLAVLFSWLTYGNL

SEQ ID NO: 1380020 - protein, 19 aa, Mycobacterium tuberculosis
GWIKPRRDLTSRMWRRSGV

SEQ ID NO: 1380021 - protein, 20 aa, Mycobacterium tuberculosis
GWPPRSSHRPSYSGEPAPTY

SEQ ID NO: 1380022 - protein, 18 aa, Mycobacterium tuberculosis
GWTYALSVVLLWVTCTAY

SEQ ID NO: 1380023 - protein, 24 aa, Mycobacterium tuberculosis
GWVTQRLWWAVLLTVGFWGLLRVA

SEQ ID NO: 1380024 - protein, 17 aa, Mycobacterium tuberculosis
HAARLGAALLVYQSSTS

SEQ ID NO: 1380025 - protein, 24 aa, Mycobacterium tuberculosis
HAMLRSLFRVGLDPRNVAVIGKCY

SEQ ID NO: 1380026 - protein, 18 aa, Mycobacterium tuberculosis
HARPMAAVLRWLEIPQFS

SEQ ID NO: 1380027 - protein, 17 aa, Mycobacterium tuberculosis
HDYGEVDGQMFLEMRLV

SEQ ID NO: 1380028 - protein, 25 aa, Mycobacterium tuberculosis
HGGELPRRGALALGCIALLLMGIVG

SEQ ID NO: 1380029 - protein, 20 aa, Mycobacterium tuberculosis
HLYDRSSFHRIPGAVEMAIA

SEQ ID NO: 1380030 - protein, 23 aa, Mycobacterium tuberculosis
HMEVGSPYAVEYVWGRQVGDNTI

SEQ ID NO: 1380031 - protein, 32 aa, Mycobacterium tuberculosis
HPARYLSVFLVMLIGIYLLVFFTGDKHTAPKL

SEQ ID NO: 1380032 - protein, 21 aa, Mycobacterium tuberculosis
HPELFGMTALVAFSIFLNRAH

SEQ ID NO: 1380033 - protein, 28 aa, Mycobacterium tuberculosis
HPTTTYKAFDWDQAYRKPITYDTLWQAD

SEQ ID NO: 1380034 - protein, 23 aa, Mycobacterium tuberculosis
HSHRRVVLIIYLWVGIGAFGAAS

SEQ ID NO: 1380035 - protein, 22 aa, Mycobacterium tuberculosis
HSWAMAFATLISRITGFARIVL

SEQ ID NO: 1380036 - protein, 24 aa, Mycobacterium tuberculosis
HTAYRWFREGTLPVPAERVGRLIL

SEQ ID NO: 1380037 - protein, 17 aa, Mycobacterium tuberculosis
HTLVMSMSLTAGRGPGR

SEQ ID NO: 1380038 - protein, 21 aa, Mycobacterium tuberculosis
HTRAGGLVVAEWIRGGSLQEV

SEQ ID NO: 1380039 - protein, 20 aa, Mycobacterium tuberculosis
HVAAFEFFDGVPARLVCDNL

SEQ ID NO: 1380040 - protein, 17 aa, Mycobacterium tuberculosis
HVAVRWQGEFLVAVIEL

SEQ ID NO: 1380041 - protein, 17 aa, Mycobacterium tuberculosis
IADRTAVIFTRRRSMLT

SEQ ID NO: 1380042 - protein, 27 aa, Mycobacterium tuberculosis
IAFDQLWRWNSIVALVLSVMVILGLVV

SEQ ID NO: 1380043 - protein, 19 aa, Mycobacterium tuberculosis
IAMRTVAVFAHRLYGAITS

SEQ ID NO: 1380044 - protein, 20 aa, Mycobacterium tuberculosis
IATACALTAWYVLYRSPDRR

SEQ ID NO: 1380045 - protein, 27 aa, Mycobacterium tuberculosis
IAVMVLCGLVVWQIYRPGRDLVRTGGP

SEQ ID NO: 1380046 - protein, 25 aa, Mycobacterium tuberculosis
ICLLAGTARLGFLASLRSRPVLVGY

SEQ ID NO: 1380047 - protein, 17 aa, Mycobacterium tuberculosis
ICVTDPLAFTGCGCDGK

SEQ ID NO: 1380048 - protein, 26 aa, Mycobacterium tuberculosis
IDHLRRHSLPLFGYAAMPAYDVVDGV

SEQ ID NO: 1380049 - protein, 24 aa, Mycobacterium tuberculosis
IEALDRVGLCGWLAGLPEGLSTVL

SEQ ID NO: 1380050 - protein, 18 aa, Mycobacterium tuberculosis
IEMIPPRYVEYRGARFPE

SEQ ID NO: 1380051 - protein, 19 aa, Mycobacterium tuberculosis
IEQPIRRWRPARVPLLPLA

SEQ ID NO: 1380052 - protein, 24 aa, Mycobacterium tuberculosis
IFHGGVPPLQFWQALDTALDRQVA

SEQ ID NO: 1380053 - protein, 21 aa, Mycobacterium tuberculosis
IFNVIWTYVLVRGSAVNNGTL

SEQ ID NO: 1380054 - protein, 21 aa, Mycobacterium tuberculosis
IFSRDEFKKGAQIFLSADGHA

SEQ ID NO: 1380055 - protein, 32 aa, Mycobacterium tuberculosis
IGAIGVAGLVDWPILLAVGGGALLLRKLNRTP

SEQ ID NO: 1380056 - protein, 19 aa, Mycobacterium tuberculosis
IGALRGRVVSPRRWLRAVA

SEQ ID NO: 1380057 - protein, 29 aa, Mycobacterium tuberculosis
IGEPGLDWRWLVLWWKSHAPHIANNLMND

SEQ ID NO: 1380058 - protein, 20 aa, Mycobacterium tuberculosis
IGGFKPVFRALDPAKVNNIV

SEQ ID NO: 1380059 - protein, 20 aa, Mycobacterium tuberculosis
IGGVRFRWAPNRTASCRTSS

SEQ ID NO: 1380060 - protein, 17 aa, Mycobacterium tuberculosis
IGRPWYLAWAGLVYVVA

SEQ ID NO: 1380061 - protein, 17 aa, Mycobacterium tuberculosis
IGVEAFTGFFAALANTR

SEQ ID NO: 1380062 - protein, 23 aa, Mycobacterium tuberculosis
IGVMVALCLGGGVFGLSLGKHVT

SEQ ID NO: 1380063 - protein, 17 aa, Mycobacterium tuberculosis
IKDEIREGRSFRSAVPR

SEQ ID NO: 1380064 - protein, 22 aa, Mycobacterium tuberculosis
IKLRESPGLMILGRQGCGKTTA

SEQ ID NO: 1380065 - protein, 24 aa, Mycobacterium tuberculosis
ILDIFSRYVVGWMVASRESKVLAE

SEQ ID NO: 1380066 - protein, 20 aa, Mycobacterium tuberculosis
ILHRRSRRFGVLPLVAPILA

SEQ ID NO: 1380067 - protein, 19 aa, Mycobacterium tuberculosis
ILLLPGIILALIGLHLALV

SEQ ID NO: 1380068 - protein, 19 aa, Mycobacterium tuberculosis
ILVGVAFVHWLIFQSLYRI

SEQ ID NO: 1380069 - protein, 21 aa, Mycobacterium tuberculosis
ILVPRDARLNSALMLLSVFAG

SEQ ID NO: 1380070 - protein, 27 aa, Mycobacterium tuberculosis
IPFGFAALRIASYALWPFGRTIVEKPT

SEQ ID NO: 1380071 - protein, 17 aa, Mycobacterium tuberculosis
IPFQISAVAARSVQGDG

SEQ ID NO: 1380072 - protein, 17 aa, Mycobacterium tuberculosis
IPLAAWATRPGFRVAAI

SEQ ID NO: 1380073 - protein, 17 aa, Mycobacterium tuberculosis
IPLALAVCTVVITMGLV

SEQ ID NO: 1380074 - protein, 20 aa, Mycobacterium tuberculosis
IPVLIVGTVVWVGITNDRKE

SEQ ID NO: 1380075 - protein, 20 aa, Mycobacterium tuberculosis
IRIVDVFRITRKVGVEESYG

SEQ ID NO: 1380076 - protein, 24 aa, Mycobacterium tuberculosis
IRLARHRPEIPIGVNIGKTKKTPA

SEQ ID NO: 1380077 - protein, 21 aa, Mycobacterium tuberculosis
IRPSYGMAEATVYVATRKAGQ

SEQ ID NO: 1380078 - protein, 17 aa, Mycobacterium tuberculosis
ISKWPGVRDAVMARYSS

SEQ ID NO: 1380079 - protein, 17 aa, Mycobacterium tuberculosis
ISLPIALGLLIMMYPVL

SEQ ID NO: 1380080 - protein, 21 aa, Mycobacterium tuberculosis
ISRGVLHYCERLATHDTALRA

SEQ ID NO: 1380081 - protein, 17 aa, Mycobacterium tuberculosis
ITSQMIYARLVMTLMEQ

SEQ ID NO: 1380082 - protein, 28 aa, Mycobacterium tuberculosis
ITTPTDWPRYGGYALGGVSSFGFGGANA

SEQ ID NO: 1380083 - protein, 18 aa, Mycobacterium tuberculosis
IVAEARRRGIAIPPAKDF

SEQ ID NO: 1380084 - protein, 18 aa, Mycobacterium tuberculosis
IVLYWFSNNIWTFGQQHY

SEQ ID NO: 1380085 - protein, 20 aa, Mycobacterium tuberculosis
KAGAAGPFLGSTPFAQIDLP

SEQ ID NO: 1380086 - protein, 24 aa, Mycobacterium tuberculosis
KAVAYWLDRYELLSSGRKEPTFTG

SEQ ID NO: 1380087 - protein, 24 aa, Mycobacterium tuberculosis
KIPLLGHLWSWELAIPMSGIAMAV

SEQ ID NO: 1380088 - protein, 17 aa, Mycobacterium tuberculosis
KLAALLTQPGRTYDVSS

SEQ ID NO: 1380089 - protein, 17 aa, Mycobacterium tuberculosis
KLLLSSLLLNWVLGPAL

SEQ ID NO: 1380090 - protein, 20 aa, Mycobacterium tuberculosis
KQYVVRFGLGYREEVHPDLQ

SEQ ID NO: 1380091 - protein, 27 aa, Mycobacterium tuberculosis
KRRWRRIGTVVVRWPGPVLAATLLIAL

SEQ ID NO: 1380092 - protein, 17 aa, Mycobacterium tuberculosis
KSHGLSVADLVLVSPGS

SEQ ID NO: 1380093 - protein, 20 aa, Mycobacterium tuberculosis
KSLADGLARFTWQLRAADPR

SEQ ID NO: 1380094 - protein, 18 aa, Mycobacterium tuberculosis
KTNPWPLVAGAAAVVLVL

SEQ ID NO: 1380095 - protein, 31 aa, Mycobacterium tuberculosis
KTRGWRRVGTAVVRWPGPILATSVALALVGL

SEQ ID NO: 1380096 - protein, 17 aa, Mycobacterium tuberculosis
LAALRLAIGEVPTRDYL

SEQ ID NO: 1380097 - protein, 17 aa, Mycobacterium tuberculosis
LAALSILVGAVGATGPG

SEQ ID NO: 1380098 - protein, 17 aa, Mycobacterium tuberculosis
LAGAVSRTHWLASHLAM

SEQ ID NO: 1380099 - protein, 18 aa, Mycobacterium tuberculosis
LAGLVGFIGNEWVALYRI

SEQ ID NO: 1380100 - protein, 19 aa, Mycobacterium tuberculosis
LALLTRRWALAWVALAGSA

SEQ ID NO: 1380101 - protein, 19 aa, Mycobacterium tuberculosis
LANGLGFLAGTIVGYYILR

SEQ ID NO: 1380102 - protein, 19 aa, Mycobacterium tuberculosis
LAQFEPMHQVFLGVRSLLY

SEQ ID NO: 1380103 - protein, 19 aa, Mycobacterium tuberculosis
LARLMMRGWRRRSERQAEL

SEQ ID NO: 1380104 - protein, 26 aa, Mycobacterium tuberculosis
LASALAPPCIIAFLETRYWWAGIALA

SEQ ID NO: 1380105 - protein, 19 aa, Mycobacterium tuberculosis
LAVAAAVCAFLFMNNLTEA

SEQ ID NO: 1380106 - protein, 17 aa, Mycobacterium tuberculosis
LCLPMCIGTCQFVQRPR

SEQ ID NO: 1380107 - protein, 26 aa, Mycobacterium tuberculosis
LDAWRGLRRRPKFVIAAALILLILVV

SEQ ID NO: 1380108 - protein, 31 aa, Mycobacterium tuberculosis
LDLFIMSWLPFYHDMGLVLGVCAPIIVGCGA

SEQ ID NO: 1380109 - protein, 24 aa, Mycobacterium tuberculosis
LDPRNVAVIGKCYSTHPGVVDAMR

SEQ ID NO: 1380110 - protein, 17 aa, Mycobacterium tuberculosis
LDQLDGRGSIAQLLLRP

SEQ ID NO: 1380111 - protein, 17 aa, Mycobacterium tuberculosis
LEIDASIDPLQSHEAVL

SEQ ID NO: 1380112 - protein, 20 aa, Mycobacterium tuberculosis
LEVFPQAKFIHIVRDPYVVY

SEQ ID NO: 1380113 - protein, 19 aa, Mycobacterium tuberculosis
LFALWPFTRLVHAFSAPIG

SEQ ID NO: 1380114 - protein, 21 aa, Mycobacterium tuberculosis
LFVLCCAAIAYIALTAPHRPR

SEQ ID NO: 1380115 - protein, 24 aa, Mycobacterium tuberculosis
LFVVDWRVALVLFGPVLVYLTITS

SEQ ID NO: 1380116 - protein, 17 aa, Mycobacterium tuberculosis
LGAGALVMIGGTVGVAA

SEQ ID NO: 1380117 - protein, 17 aa, Mycobacterium tuberculosis
LGCTPLDPLGWAQATAA

SEQ ID NO: 1380118 - protein, 17 aa, Mycobacterium tuberculosis
LGGGVFGLSLGKHVTQS

SEQ ID NO: 1380119 - protein, 22 aa, Mycobacterium tuberculosis
LGLANGLGFLAGTIVGYYILRR

SEQ ID NO: 1380120 - protein, 19 aa, Mycobacterium tuberculosis
LGLFGLFAYTGMRIASRSA

SEQ ID NO: 1380121 - protein, 17 aa, Mycobacterium tuberculosis
LGLIVGSAMGYEPEDLP

SEQ ID NO: 1380122 - protein, 22 aa, Mycobacterium tuberculosis
LGLLWYAGLPLRVFLSSLAAVV

SEQ ID NO: 1380123 - protein, 21 aa, Mycobacterium tuberculosis
LGNWLKARIGVGTTTYSSTAQ

SEQ ID NO: 1380124 - protein, 20 aa, Mycobacterium tuberculosis
LGPRLPRILAAVALGVLSLG

SEQ ID NO: 1380125 - protein, 18 aa, Mycobacterium tuberculosis
LGRVPMAVVPLFVAAMLL

SEQ ID NO: 1380126 - protein, 17 aa, Mycobacterium tuberculosis
LGSMYGYGISYAVASLS

SEQ ID NO: 1380127 - protein, 26 aa, Mycobacterium tuberculosis
LGSTLVLRRRFKPALVLEDIEKHKAT

SEQ ID NO: 1380128 - protein, 19 aa, Mycobacterium tuberculosis
LGTILAWLLIAILLARLFV

SEQ ID NO: 1380129 - protein, 17 aa, Mycobacterium tuberculosis
LGYAANRVVGFALADPD

SEQ ID NO: 1380130 - protein, 23 aa, Mycobacterium tuberculosis
LGYVAWRLFGHTPYRIDIDIYQM

SEQ ID NO: 1380131 - protein, 18 aa, Mycobacterium tuberculosis
LHIAPLISYEMTFSDLTR

SEQ ID NO: 1380132 - protein, 17 aa, Mycobacterium tuberculosis
LHIFLAPINVTFKRLPD

SEQ ID NO: 1380133 - protein, 17 aa, Mycobacterium tuberculosis
LIAQIGMGTGAMAVVGG

SEQ ID NO: 1380134 - protein, 24 aa, Mycobacterium tuberculosis
LIEQPIRRWRPARVPLLPLAAATV

SEQ ID NO: 1380135 - protein, 17 aa, Mycobacterium tuberculosis
LIPLTGLTTPWMSYGGS

SEQ ID NO: 1380136 - protein, 18 aa, Mycobacterium tuberculosis
LIRVHPLLAVGLNIVAVS

SEQ ID NO: 1380137 - protein, 17 aa, Mycobacterium tuberculosis
LKMCWPAAPRSVGVPLY

SEQ ID NO: 1380138 - protein, 19 aa, Mycobacterium tuberculosis
LKTSWYLLGPAFVAAIAYV

SEQ ID NO: 1380139 - protein, 18 aa, Mycobacterium tuberculosis
LLAAGGRYCRLWDTGQGS

SEQ ID NO: 1380140 - protein, 19 aa, Mycobacterium tuberculosis
LLALFAGSVLRGADLATLL

SEQ ID NO: 1380141 - protein, 25 aa, Mycobacterium tuberculosis
LLALLANLFLPWGIAGAAPTALDVL

SEQ ID NO: 1380142 - protein, 18 aa, Mycobacterium tuberculosis
LLAWELMAIASLILVLSE

SEQ ID NO: 1380143 - protein, 17 aa, Mycobacterium tuberculosis
LLELFNIDEQTLNTQGL

SEQ ID NO: 1380144 - protein, 18 aa, Mycobacterium tuberculosis
LLFVYRSVVTMVLVLITV

SEQ ID NO: 1380145 - protein, 31 aa, Mycobacterium tuberculosis
LLGDDCWWAPRWARRLQTRIGLGEIHLPDER

SEQ ID NO: 1380146 - protein, 24 aa, Mycobacterium tuberculosis
LLGPRLDALDVRRLVRRLLGRPDP

SEQ ID NO: 1380147 - protein, 18 aa, Mycobacterium tuberculosis
LLHSIQITRDIAEQVITD

SEQ ID NO: 1380148 - protein, 20 aa, Mycobacterium tuberculosis
LLLCGIVPLLPVNQTTATIF

SEQ ID NO: 1380149 - protein, 17 aa, Mycobacterium tuberculosis
LLLHIGVMLAFLILVLH

SEQ ID NO: 1380150 - protein, 20 aa, Mycobacterium tuberculosis
LLLVEALDAMVLTAGADASS

SEQ ID NO: 1380151 - protein, 19 aa, Mycobacterium tuberculosis
LLNRQWRALVAAVVVPVVV

SEQ ID NO: 1380152 - protein, 17 aa, Mycobacterium tuberculosis
LLPRGPLFQGLVSGICG

SEQ ID NO: 1380153 - protein, 17 aa, Mycobacterium tuberculosis
LLTIAIQPQTRWEAFAN

SEQ ID NO: 1380154 - protein, 18 aa, Mycobacterium tuberculosis
LMLLGGRLGDTIGRKRTF

SEQ ID NO: 1380155 - protein, 18 aa, Mycobacterium tuberculosis
LNGKRPKLRRILSDPDAR

SEQ ID NO: 1380156 - protein, 21 aa, Mycobacterium tuberculosis
LNLPPPCTTGFLPAQQRRIPT

SEQ ID NO: 1380157 - protein, 19 aa, Mycobacterium tuberculosis
LPGSWGPDLVGVAGDGGLV

SEQ ID NO: 1380158 - protein, 21 aa, Mycobacterium tuberculosis
LPLLNRQWRALVAAVVVPVVV

SEQ ID NO: 1380159 - protein, 24 aa, Mycobacterium tuberculosis
LPLYHDMGLILGICAPLVARRRAM

SEQ ID NO: 1380160 - protein, 18 aa, Mycobacterium tuberculosis
LQGQPPLGPVLMTADARA

SEQ ID NO: 1380161 - protein, 17 aa, Mycobacterium tuberculosis
LQRALAHEQQFVADASH

SEQ ID NO: 1380162 - protein, 18 aa, Mycobacterium tuberculosis
LQRALSIVGSTGVRVMVT

SEQ ID NO: 1380163 - protein, 19 aa, Mycobacterium tuberculosis
LQRPARWLQLMAREGQAFS

SEQ ID NO: 1380164 - protein, 18 aa, Mycobacterium tuberculosis
LRDLFGRYVGEDVARRAL

SEQ ID NO: 1380165 - protein, 20 aa, Mycobacterium tuberculosis
LRGALATVIRAMGSLGMSSP

SEQ ID NO: 1380166 - protein, 18 aa, Mycobacterium tuberculosis
LRIACFYVGSTVLLALLL

SEQ ID NO: 1380167 - protein, 18 aa, Mycobacterium tuberculosis
LRIGDIVLVRPGERISAD

SEQ ID NO: 1380168 - protein, 17 aa, Mycobacterium tuberculosis
LRQQRIWGASTVVASWQ

SEQ ID NO: 1380169 - protein, 23 aa, Mycobacterium tuberculosis
LRRGWAMAAICFIAVAVAAAVLG

SEQ ID NO: 1380170 - protein, 19 aa, Mycobacterium tuberculosis
LRTSIATSSPGRCDMSPIP

SEQ ID NO: 1380171 - protein, 19 aa, Mycobacterium tuberculosis
LRWRASQLTLAIATCAGVA

SEQ ID NO: 1380172 - protein, 24 aa, Mycobacterium tuberculosis
LSALERLRDFAVFKAIGVPTRSIL

SEQ ID NO: 1380173 - protein, 17 aa, Mycobacterium tuberculosis
LSDAALVSHSWAMAFAT

SEQ ID NO: 1380174 - protein, 24 aa, Mycobacterium tuberculosis
LSELPSHCRGLLVGRVAGAHTPAA

SEQ ID NO: 1380175 - protein, 22 aa, Mycobacterium tuberculosis
LSGRYRLQRLIATGGMGQVWEA

SEQ ID NO: 1380176 - protein, 17 aa, Mycobacterium tuberculosis
LSLFRLVYGLLFAGYGS

SEQ ID NO: 1380177 - protein, 18 aa, Mycobacterium tuberculosis
LSLQPGVYAVHWYAGEHA

SEQ ID NO: 1380178 - protein, 17 aa, Mycobacterium tuberculosis
LSMVFGELVPKYLAVAR

SEQ ID NO: 1380179 - protein, 18 aa, Mycobacterium tuberculosis
LSPSRWAYAMAAATVDLN

SEQ ID NO: 1380180 - protein, 34 aa, Mycobacterium tuberculosis
LSRLPLLSIDGYRRLQVRSGYTLFRQGERADHFF

SEQ ID NO: 1380181 - protein, 18 aa, Mycobacterium tuberculosis
LSVLMLVGGILFQIVTGV

SEQ ID NO: 1380182 - protein, 19 aa, Mycobacterium tuberculosis
LSVLMLVGGILFQIVTGVL

SEQ ID NO: 1380183 - protein, 40 aa, Mycobacterium tuberculosis
LTMRGRCRRLWPRSAPMLAAWAVVEGCLMAVFFVTDGGEV

SEQ ID NO: 1380184 - protein, 23 aa, Mycobacterium tuberculosis
LTRAERLNVVFLLAASQLVEILV

SEQ ID NO: 1380185 - protein, 24 aa, Mycobacterium tuberculosis
LTRNPRWWGARPRLDSITYLVLDD

SEQ ID NO: 1380186 - protein, 24 aa, Mycobacterium tuberculosis
LTTMIGRANWWPSELGRDPSTPPT

SEQ ID NO: 1380187 - protein, 17 aa, Mycobacterium tuberculosis
LTVASFLLVNKVWSPQF

SEQ ID NO: 1380188 - protein, 25 aa, Mycobacterium tuberculosis
LVAAVAFFGWERFARTRLIDPAGVH

SEQ ID NO: 1380189 - protein, 22 aa, Mycobacterium tuberculosis
LVALLAIRARLVLLIFTTMPVL

SEQ ID NO: 1380190 - protein, 17 aa, Mycobacterium tuberculosis
LVAYFIFEHVRLRVQTW

SEQ ID NO: 1380191 - protein, 18 aa, Mycobacterium tuberculosis
LVGVAAFALVVTFLKDHR

SEQ ID NO: 1380192 - protein, 17 aa, Mycobacterium tuberculosis
LVLGAIGIWIAIRPKPV

SEQ ID NO: 1380193 - protein, 19 aa, Mycobacterium tuberculosis
LVLGAIGIWIANRPDDNPK

SEQ ID NO: 1380194 - protein, 25 aa, Mycobacterium tuberculosis
LVLGVCAPIIVGCGAVLTSPVAFLQ

SEQ ID NO: 1380195 - protein, 18 aa, Mycobacterium tuberculosis
LVVAMVLAGLRVEAAMAS

SEQ ID NO: 1380196 - protein, 19 aa, Mycobacterium tuberculosis
LVVAMVLAGLRVEAAMAST

SEQ ID NO: 1380197 - protein, 25 aa, Mycobacterium tuberculosis
LVWQHLLGIQLYWIVLALAVILLLA

SEQ ID NO: 1380198 - protein, 22 aa, Mycobacterium tuberculosis
LVYVRLARPFIAFYNNCANAIL

SEQ ID NO: 1380199 - protein, 21 aa, Mycobacterium tuberculosis
LWVLPLRWSMVEYFYIKYYLP

SEQ ID NO: 1380200 - protein, 18 aa, Mycobacterium tuberculosis
LYTGTGAFEVVGRRRLWF

SEQ ID NO: 1380201 - protein, 24 aa, Mycobacterium tuberculosis
MARYSSVFAPDWGREVELMAVSGD

SEQ ID NO: 1380202 - protein, 25 aa, Mycobacterium tuberculosis
MDGARWWQLLLRVVLPMSRPTMVAV

SEQ ID NO: 1380203 - protein, 17 aa, Mycobacterium tuberculosis
MGGTCAVDLTVMHPTLF

SEQ ID NO: 1380204 - protein, 30 aa, Mycobacterium tuberculosis
MLAALWAVYTPRWWLSGLLVGVASGVKLTP

SEQ ID NO: 1380205 - protein, 18 aa, Mycobacterium tuberculosis
MLAIAMLLMLVPLATGCL

SEQ ID NO: 1380206 - protein, 18 aa, Mycobacterium tuberculosis
MLTAAEWTAVLINMNADN

SEQ ID NO: 1380207 - protein, 18 aa, Mycobacterium tuberculosis
MMAGLLVSLLVRRRRVWA

SEQ ID NO: 1380208 - protein, 29 aa, Mycobacterium tuberculosis
MMAGLLVSLLVRRRRVWARITPTTAGTVN

SEQ ID NO: 1380209 - protein, 25 aa, Mycobacterium tuberculosis
MMESEFPSELSVLFKNLETKGNPWG

SEQ ID NO: 1380210 - protein, 20 aa, Mycobacterium tuberculosis
MPPGPPGRRAWQADTESTAP

SEQ ID NO: 1380211 - protein, 19 aa, Mycobacterium tuberculosis
MPVLALATWQFRRASNWTY

SEQ ID NO: 1380212 - protein, 25 aa, Mycobacterium tuberculosis
MQFGEGWWTSVWFLSFWVTGTSILL

SEQ ID NO: 1380213 - protein, 24 aa, Mycobacterium tuberculosis
MQFISETWRLYGVAARNDGIANVD

SEQ ID NO: 1380214 - protein, 17 aa, Mycobacterium tuberculosis
MSAREIVIIGIGAVSRE

SEQ ID NO: 1380215 - protein, 18 aa, Mycobacterium tuberculosis
MSRRARRIVVANLIVAVT

SEQ ID NO: 1380216 - protein, 21 aa, Mycobacterium tuberculosis
MTLVLTGLVNGFRVEAERTVD

SEQ ID NO: 1380217 - protein, 43 aa, Mycobacterium tuberculosis
MTPSIAALLGRWFWWPLRVRPRPASQMLRPFAPRRLVRALLLP

SEQ ID NO: 1380218 - protein, 26 aa, Mycobacterium tuberculosis
MVVTRNREVWAWMVWLPHNLHDELFD

SEQ ID NO: 1380219 - protein, 22 aa, Mycobacterium tuberculosis
NADRGMPLLVLVVMAQLVLCGG

SEQ ID NO: 1380220 - protein, 32 aa, Mycobacterium tuberculosis
NGRYRLLIFHGGVPPLQFWQALDTALDRQVAL

SEQ ID NO: 1380221 - protein, 18 aa, Mycobacterium tuberculosis
NIGVEAFTGFFAALINVR

SEQ ID NO: 1380222 - protein, 18 aa, Mycobacterium tuberculosis
NISKWPGVRDAVMARYSS

SEQ ID NO: 1380223 - protein, 18 aa, Mycobacterium tuberculosis
NPEVWAWMVWLPHNLHDE

SEQ ID NO: 1380224 - protein, 18 aa, Mycobacterium tuberculosis
NPRKSCLRNVDRFRPGLL

SEQ ID NO: 1380225 - protein, 18 aa, Mycobacterium tuberculosis
NRDCPSRTDVLGAALANV

SEQ ID NO: 1380226 - protein, 23 aa, Mycobacterium tuberculosis
NRIRELQRQLGILSQVNDNLAGL

SEQ ID NO: 1380227 - protein, 22 aa, Mycobacterium tuberculosis
NRWVATRSRRHTYQWITDHKSP

SEQ ID NO: 1380228 - protein, 17 aa, Mycobacterium tuberculosis
NSLHIAPLISYEMTFSD

SEQ ID NO: 1380229 - protein, 20 aa, Mycobacterium tuberculosis
NSLHIAPLISYEMTFSDLTR

SEQ ID NO: 1380230 - protein, 23 aa, Mycobacterium tuberculosis
NTRSFTGAGIWLGIAAFAAAGVV

SEQ ID NO: 1380231 - protein, 25 aa, Mycobacterium tuberculosis
PAAARPRSSPGWSLGVNPGSRPSTW

SEQ ID NO: 1380232 - protein, 24 aa, Mycobacterium tuberculosis
PAAHLPFRSGRSFSASVSGTELTV

SEQ ID NO: 1380233 - protein, 17 aa, Mycobacterium tuberculosis
PAHDGRVVLSIVWGGAI

SEQ ID NO: 1380234 - protein, 19 aa, Mycobacterium tuberculosis
PAHGGRYHGIWSMAVAASS

SEQ ID NO: 1380235 - protein, 18 aa, Mycobacterium tuberculosis
PAHLRTAILDATKPDVRR

SEQ ID NO: 1380236 - protein, 17 aa, Mycobacterium tuberculosis
PALDAVYLPPGRSAYVA

SEQ ID NO: 1380237 - protein, 26 aa, Mycobacterium tuberculosis
PALSAWRFATVFGVVSLLADVVYEGA

SEQ ID NO: 1380238 - protein, 22 aa, Mycobacterium tuberculosis
PAPLLRARGTFFAHADQLSIHR

SEQ ID NO: 1380239 - protein, 17 aa, Mycobacterium tuberculosis
PARSRCDQVTSHAVLIG

SEQ ID NO: 1380240 - protein, 33 aa, Mycobacterium tuberculosis
PATLKRFVDRFSRFNLREFAIRPAYGLAEATVY

SEQ ID NO: 1380241 - protein, 19 aa, Mycobacterium tuberculosis
PCRTILRVFSRNPLVRGTD

SEQ ID NO: 1380242 - protein, 26 aa, Mycobacterium tuberculosis
PDFGERGRRDLYHFTHLAVEHPVFTP

SEQ ID NO: 1380243 - protein, 20 aa, Mycobacterium tuberculosis
PDIPPRPDWEPTGAEPIAAA

SEQ ID NO: 1380244 - protein, 20 aa, Mycobacterium tuberculosis
PDRPPSRFYVRVISPDGQSY

SEQ ID NO: 1380245 - protein, 21 aa, Mycobacterium tuberculosis
PDRRIMLADFGIAGWVDDPSG

SEQ ID NO: 1380246 - protein, 17 aa, Mycobacterium tuberculosis
PDVSTLTYAEAVKKLTA

SEQ ID NO: 1380247 - protein, 18 aa, Mycobacterium tuberculosis
PERRRLAPPRGKSVVHEP

SEQ ID NO: 1380248 - protein, 22 aa, Mycobacterium tuberculosis
PESYSLPLRRLLGLVAAGLDVS

SEQ ID NO: 1380249 - protein, 26 aa, Mycobacterium tuberculosis
PFGFAALRIASYALWPFGRTIVEKPT

SEQ ID NO: 1380250 - protein, 20 aa, Mycobacterium tuberculosis
PGDLRPGLLSRIVAHVSTVI

SEQ ID NO: 1380251 - protein, 30 aa, Mycobacterium tuberculosis; identical to SEQ ID NO: 158303

SEQ ID NO: 1380252 - protein, 18 aa, Mycobacterium tuberculosis
PGWVNLPAVILIGLCALL

SEQ ID NO: 1380253 - protein, 24 aa, Mycobacterium tuberculosis
PHIPFTDLRMKVVDTQTEWPATGH

SEQ ID NO: 1380254 - protein, 17 aa, Mycobacterium tuberculosis
PHRPRVAQLTFLTVASF

SEQ ID NO: 1380255 - protein, 18 aa, Mycobacterium tuberculosis
PHRRILLAWMTIDALVWV

SEQ ID NO: 1380256 - protein, 17 aa, Mycobacterium tuberculosis
PIAQVLRRQRREIVLAA

SEQ ID NO: 1380257 - protein, 18 aa, Mycobacterium tuberculosis
PIAVNGWQQAWVVPAGNP

SEQ ID NO: 1380258 - protein, 24 aa, Mycobacterium tuberculosis
PLATGCLRVRASITISPDDLVSGE

SEQ ID NO: 1380259 - protein, 21 aa, Mycobacterium tuberculosis
PLEAVPAFFRWLAQFEPMHQV

SEQ ID NO: 1380260 - protein, 26 aa, Mycobacterium tuberculosis
PLPGSAPRPAWLRAFAHPERDKRVAV

SEQ ID NO: 1380261 - protein, 23 aa, Mycobacterium tuberculosis
PLRQLRWALSEVQRGNYNAHMQI

SEQ ID NO: 1380262 - protein, 20 aa, Mycobacterium tuberculosis
PLRSFTYWERHCFDIPICWS

SEQ ID NO: 1380263 - protein, 18 aa, Mycobacterium tuberculosis
PMALVLARSRGRLVRSLR

SEQ ID NO: 1380264 - protein, 18 aa, Mycobacterium tuberculosis
PMNAMTPMVLFIKSPRDL

SEQ ID NO: 1380265 - protein, 19 aa, Mycobacterium tuberculosis
PNSIWVNAVAMVDCGQNTN

SEQ ID NO: 1380266 - protein, 21 aa, Mycobacterium tuberculosis
PPCPERLATAVLPRSATPVLL

SEQ ID NO: 1380267 - protein, 17 aa, Mycobacterium tuberculosis
PPMTTWYAAMLFAVIPL

SEQ ID NO: 1380268 - protein, 23 aa, Mycobacterium tuberculosis
PPPAFPVWPLWYAALAWLHVRQA

SEQ ID NO: 1380269 - protein, 17 aa, Mycobacterium tuberculosis
PQSLFTLDHRLIEQGRL

SEQ ID NO: 1380270 - protein, 18 aa, Mycobacterium tuberculosis
PQTVHWNLRLDVSDVDGK

SEQ ID NO: 1380271 - protein, 24 aa, Mycobacterium tuberculosis
PRRRRRATARRKAPVKAPSATRQT

SEQ ID NO: 1380272 - protein, 17 aa, Mycobacterium tuberculosis
PSAELFVAAYVPYVAWL

SEQ ID NO: 1380273 - protein, 22 aa, Mycobacterium tuberculosis
PSANLGANCQYPPSPDKAVKPV

SEQ ID NO: 1380274 - protein, 19 aa, Mycobacterium tuberculosis
PSFLRPVLAPDYGRVARAV

SEQ ID NO: 1380275 - protein, 18 aa, Mycobacterium tuberculosis
PSNLIIPEYLFIQSSTDL

SEQ ID NO: 1380276 - protein, 26 aa, Mycobacterium tuberculosis
PSNTESRWRLGLYAAGRASQIRRLRA

SEQ ID NO: 1380277 - protein, 23 aa, Mycobacterium tuberculosis
PSSTKLRNGFRIQRQNTRIGQDV

SEQ ID NO: 1380278 - protein, 18 aa, Mycobacterium tuberculosis
PSTLFGMSAALGAGSPDT

SEQ ID NO: 1380279 - protein, 20 aa, Mycobacterium tuberculosis
PSVPFYRYLRTWRRNEEAYL

SEQ ID NO: 1380280 - protein, 20 aa, Mycobacterium tuberculosis
PTLAELAANHVIHTVLVATN

SEQ ID NO: 1380281 - protein, 21 aa, Mycobacterium tuberculosis
PVAALPCEREPIALPAGQQEL

SEQ ID NO: 1380282 - protein, 25 aa, Mycobacterium tuberculosis
PVFPYEPMVRVSLWLSVTAVAVLFG

SEQ ID NO: 1380283 - protein, 25 aa, Mycobacterium tuberculosis
PVLTLMVVAVWLLGVGTLKDLALVQ

SEQ ID NO: 1380284 - protein, 18 aa, Mycobacterium tuberculosis
PVTIRLALIALAVEAVLG

SEQ ID NO: 1380285 - protein, 20 aa, Mycobacterium tuberculosis
PVVAVAGRFVHTSIRTTVGA

SEQ ID NO: 1380286 - protein, 19 aa, Mycobacterium tuberculosis
PWALPAQFWLYCGFTAITM

SEQ ID NO: 1380287 - protein, 24 aa, Mycobacterium tuberculosis
QADGRNTLLLPFRVAAVHLILWDI

SEQ ID NO: 1380288 - protein, 22 aa, Mycobacterium tuberculosis
QAKRVPGLVVYRYDAPLCFANA

SEQ ID NO: 1380289 - protein, 24 aa, Mycobacterium tuberculosis
QEITRGRCAAIAVPSNGVEKLVAI

SEQ ID NO: 1380290 - protein, 27 aa, Mycobacterium tuberculosis
QFAFFGWRWSLPLGVAILLAAVGGGLI

SEQ ID NO: 1380291 - protein, 25 aa, Mycobacterium tuberculosis
QGAGRSRAAVKFLLYNLFGGLIMLA

SEQ ID NO: 1380292 - protein, 18 aa, Mycobacterium tuberculosis
QIHHWAALMFAAAIMVHL

SEQ ID NO: 1380293 - protein, 19 aa, Mycobacterium tuberculosis
QLDGWRYGWVLNIGAAITG

SEQ ID NO: 1380294 - protein, 24 aa, Mycobacterium tuberculosis
QLSRASVVIGSLVVVLALAAGIVG

SEQ ID NO: 1380295 - protein, 21 aa, Mycobacterium tuberculosis
QPAAAPIEHWAAGDADPLGNL

SEQ ID NO: 1380296 - protein, 26 aa, Mycobacterium tuberculosis
QRIQLRISGMSCSACAHRVESTLNKL

SEQ ID NO: 1380297 - protein, 24 aa, Mycobacterium tuberculosis
QRLHPCALDGFLVEEAGVEVADAL

SEQ ID NO: 1380298 - protein, 33 aa, Mycobacterium tuberculosis
QRRLLKWSIPGLAHFFTMWGFFILLTVYIEAYG

SEQ ID NO: 1380299 - protein, 23 aa, Mycobacterium tuberculosis
QTRLRSGSPILFYPAGALAITVL

SEQ ID NO: 1380300 - protein, 29 aa, Mycobacterium tuberculosis
QVIMPSIPQSLLWISLVVLWLFVLVPMLI

SEQ ID NO: 1380301 - protein, 21 aa, Mycobacterium tuberculosis
RAEMIPAITKYMSALDVAVLA

SEQ ID NO: 1380302 - protein, 23 aa, Mycobacterium tuberculosis
RAHLRARHDLVLEAFTAVHAAFP

SEQ ID NO: 1380303 - protein, 20 aa, Mycobacterium tuberculosis
RALEYLKITYGWSLLLIVTF

SEQ ID NO: 1380304 - protein, 19 aa, Mycobacterium tuberculosis
RALTLSMGIPVTARPTPIS

SEQ ID NO: 1380305 - protein, 19 aa, Mycobacterium tuberculosis
RAPGPSWYHFTLNGAPGSI

SEQ ID NO: 1380306 - protein, 18 aa, Mycobacterium tuberculosis
RASLLARILRQFHHPLIY

SEQ ID NO: 1380307 - protein, 31 aa, Mycobacterium tuberculosis
RDDPNSLLPRWLPDTSRGQGWADRIRADPGR

SEQ ID NO: 1380308 - protein, 17 aa, Mycobacterium tuberculosis
RDLFGRYVGEDVARRAL

SEQ ID NO: 1380309 - protein, 17 aa, Mycobacterium tuberculosis
REAIKGTPLQGAAIYLG

SEQ ID NO: 1380310 - protein, 19 aa, Mycobacterium tuberculosis
REEVLRCAAHAAPASNGPQ

SEQ ID NO: 1380311 - protein, 17 aa, Mycobacterium tuberculosis
RELWIGAVIASLAVGVI

SEQ ID NO: 1380312 - protein, 25 aa, Mycobacterium tuberculosis
RERHIASWLAALVVPSVICAITVAW

SEQ ID NO: 1380313 - protein, 17 aa, Mycobacterium tuberculosis
RETLRLVAEIGMGTGAM

SEQ ID NO: 1380314 - protein, 17 aa, Mycobacterium tuberculosis
RGDDRWCEIPVGAKPNG

SEQ ID NO: 1380315 - protein, 17 aa, Mycobacterium tuberculosis
RGLAIPAANAFTAVAGH

SEQ ID NO: 1380316 - protein, 24 aa, Mycobacterium tuberculosis
RGRLPLLCCLVAFVLTFLVTRSFV

SEQ ID NO: 1380317 - protein, 17 aa, Mycobacterium tuberculosis
RGSTGFARPWAIPLVTT

SEQ ID NO: 1380318 - protein, 17 aa, Mycobacterium tuberculosis
RGVPAMIKEIFAPHSHD

SEQ ID NO: 1380319 - protein, 27 aa, Mycobacterium tuberculosis
RHGGELPRRGALALGCIALLLMGIVGC

SEQ ID NO: 1380320 - protein, 17 aa, Mycobacterium tuberculosis
RIEFDDVAFGYDGGSGP

SEQ ID NO: 1380321 - protein, 18 aa, Mycobacterium tuberculosis
RIGLRGGGWAGLVCLLVG

SEQ ID NO: 1380322 - protein, 20 aa, Mycobacterium tuberculosis
RIPAALSAPSLNRGVGFTHA

SEQ ID NO: 1380323 - protein, 22 aa, Mycobacterium tuberculosis
RKAKAPKLVRPTPMERLAARLT

SEQ ID NO: 1380324 - protein, 23 aa, Mycobacterium tuberculosis
RKGQESFNFGEFFAFTKVCSHLG

SEQ ID NO: 1380325 - protein, 21 aa, Mycobacterium tuberculosis
RKLQNPSWRPGAWACRLVVVA

SEQ ID NO: 1380326 - protein, 20 aa, Mycobacterium tuberculosis
RKTNPWPFVAVAAAVVLVLV

SEQ ID NO: 1380327 - protein, 26 aa, Mycobacterium tuberculosis
RLAAIPILLCWLGFTVFVSVAVPPLE

SEQ ID NO: 1380328 - protein, 25 aa, Mycobacterium tuberculosis
RLALWSRVLPITFTAAGLVALVGGG

SEQ ID NO: 1380329 - protein, 18 aa, Mycobacterium tuberculosis
RLALYSGGDYLLRRLTAE

SEQ ID NO: 1380330 - protein, 25 aa, Mycobacterium tuberculosis
RLFRVPELLAGSFLLALLAVTAANF

SEQ ID NO: 1380331 - protein, 23 aa, Mycobacterium tuberculosis
RLGKLHFWLTFIGFHTTFLVQHW

SEQ ID NO: 1380332 - protein, 19 aa, Mycobacterium tuberculosis
RLHDAWWTLILFAVIGVAV

SEQ ID NO: 1380333 - protein, 17 aa, Mycobacterium tuberculosis
RLIELALRGGGPDNVTV

SEQ ID NO: 1380334 - protein, 17 aa, Mycobacterium tuberculosis
RLLGRGGMGEVYEAEHT

SEQ ID NO: 1380335 - protein, 17 aa, Mycobacterium tuberculosis
RLLHRLLGLTVLRVGTG

SEQ ID NO: 1380336 - protein, 20 aa, Mycobacterium tuberculosis
RLPRLCRKYLLTPSRQAKER

SEQ ID NO: 1380337 - protein, 25 aa, Mycobacterium tuberculosis
RLPYPGRIGLLFAVMPFHAFFGIAL

SEQ ID NO: 1380338 - protein, 22 aa, Mycobacterium tuberculosis
RLRSWALAVWHFVSNAPLTYAW

SEQ ID NO: 1380339 - protein, 20 aa, Mycobacterium tuberculosis
RLVDVIGCSLRLPGIYPPQV

SEQ ID NO: 1380340 - protein, 21 aa, Mycobacterium tuberculosis
RMAPFHHHFELVGWAETTVII

SEQ ID NO: 1380341 - protein, 23 aa, Mycobacterium tuberculosis
RNYLYDAWAARFLVTARLNNSLP

SEQ ID NO: 1380342 - protein, 20 aa, Mycobacterium tuberculosis
RPDILAGAGVWVTLCMAAAG

SEQ ID NO: 1380343 - protein, 19 aa, Mycobacterium tuberculosis
RPGDLLYGLHAMMFNRSRV

SEQ ID NO: 1380344 - protein, 34 aa, Mycobacterium tuberculosis
RPNRLWWRYTAWWLLAMALATLWWVMALTQLHGV

SEQ ID NO: 1380345 - protein, 17 aa, Mycobacterium tuberculosis
RPRLGVGAGAPAPAVVT

SEQ ID NO: 1380346 - protein, 20 aa, Mycobacterium tuberculosis
RPVSVTPMVWVRPRQGPKLA

SEQ ID NO: 1380347 - protein, 20 aa, Mycobacterium tuberculosis
RPWYLAWAGLVYVVATLATL

SEQ ID NO: 1380348 - protein, 19 aa, Mycobacterium tuberculosis
RQFHHPLIYVLLVAGTITA

SEQ ID NO: 1380349 - protein, 21 aa, Mycobacterium tuberculosis
RQVTRELLELFNIDEQTLNTQ

SEQ ID NO: 1380350 - protein, 19 aa, Mycobacterium tuberculosis
RRFTDDELLRLAAAAEYPS

SEQ ID NO: 1380351 - protein, 21 aa, Mycobacterium tuberculosis
RRGGRRPGWVLLTALLVLAIG

SEQ ID NO: 1380352 - protein, 25 aa, Mycobacterium tuberculosis
RRRCRRATVGGVRFAAFLIASLGTM

SEQ ID NO: 1380353 - protein, 25 aa, Mycobacterium tuberculosis
RRRMPDLRGALLLAVTLGLVTLGLV

SEQ ID NO: 1380354 - protein, 20 aa, Mycobacterium tuberculosis
RSALATVWRAGVRLWTPSLA

SEQ ID NO: 1380355 - protein, 18 aa, Mycobacterium tuberculosis
RSEALLANMLPASIAERL

SEQ ID NO: 1380356 - protein, 26 aa, Mycobacterium tuberculosis
RSEMNRWVATRSRRHTYQWITDHKSP

SEQ ID NO: 1380357 - protein, 23 aa, Mycobacterium tuberculosis
RSGLPVVVSVVGLVHTPGLVTLA

SEQ ID NO: 1380358 - protein, 24 aa, Mycobacterium tuberculosis
RSTPGPSDRRALHTAFAGAAICLL

SEQ ID NO: 1380359 - protein, 23 aa, Mycobacterium tuberculosis
RSVGVPLYLLLGWVAVWYTATIL

SEQ ID NO: 1380360 - protein, 19 aa, Mycobacterium tuberculosis
RSVWITVLLTRLAIVAAVA

SEQ ID NO: 1380361 - protein, 22 aa, Mycobacterium tuberculosis
RTMCSRPAIRQGSLENAADQLA

SEQ ID NO: 1380362 - protein, 23 aa, Mycobacterium tuberculosis
RTQSRAVLMGVLIVITGLIGSFV

SEQ ID NO: 1380363 - protein, 17 aa, Mycobacterium tuberculosis
RVANLFLTKTVYSVLLA

SEQ ID NO: 1380364 - protein, 26 aa, Mycobacterium tuberculosis
RVELLKLAVLLALWAAVAGAFVSVLY

SEQ ID NO: 1380365 - protein, 24 aa, Mycobacterium tuberculosis
RVHVVIDDAMSWLRGAAVPPAGFD

SEQ ID NO: 1380366 - protein, 21 aa, Mycobacterium tuberculosis
RVSVTFVDRLPGWNVDISGVG

SEQ ID NO: 1380367 - protein, 18 aa, Mycobacterium tuberculosis
RWLLDGRASRQWCGGLAI

SEQ ID NO: 1380368 - protein, 17 aa, Mycobacterium tuberculosis
RWLLLALVSTWGLRLSW

SEQ ID NO: 1380369 - protein, 17 aa, Mycobacterium tuberculosis
RWLRGDVLAVLTVAAYL

SEQ ID NO: 1380370 - protein, 19 aa, Mycobacterium tuberculosis
RWPVAIAVGPALTYGVVAL

SEQ ID NO: 1380371 - protein, 25 aa, Mycobacterium tuberculosis
RWVNGLFGRLAWLFVGPVVAFPAFE

SEQ ID NO: 1380372 - protein, 18 aa, Mycobacterium tuberculosis
RYHGIWSMAVAASSVAAP

SEQ ID NO: 1380373 - protein, 24 aa, Mycobacterium tuberculosis
RYLTPWGRQFWRITRAYFVGPNSV

SEQ ID NO: 1380374 - protein, 24 aa, Mycobacterium tuberculosis
RYRHARIGLPLALVSKLSTAARRL

SEQ ID NO: 1380375 - protein, 24 aa, Mycobacterium tuberculosis
SAAKLYPLLFLYPLLLLGIRAGRL

SEQ ID NO: 1380376 - protein, 17 aa, Mycobacterium tuberculosis
SAFTLAGPWVDVAATGE

SEQ ID NO: 1380377 - protein, 29 aa, Mycobacterium tuberculosis
SALVGVLCCIGSIVGIVFGAIAINQIKQT

SEQ ID NO: 1380378 - protein, 17 aa, Mycobacterium tuberculosis
SATARNWMKRADHSMIF

SEQ ID NO: 1380379 - protein, 17 aa, Mycobacterium tuberculosis
SATPVLLPDVVAAAPGM

SEQ ID NO: 1380380 - protein, 17 aa, Mycobacterium tuberculosis
SATRRALLLTALGGLLI

SEQ ID NO: 1380381 - protein, 18 aa, Mycobacterium tuberculosis
SATRRALLLTALGGLLIA

SEQ ID NO: 1380382 - protein, 22 aa, Mycobacterium tuberculosis
SCVSGRCGWSQRSAVSTIRSGQ

SEQ ID NO: 1380383 - protein, 23 aa, Mycobacterium tuberculosis
SDGHRPLAVGFFFSLGHSTVVFG

SEQ ID NO: 1380384 - protein, 27 aa, Mycobacterium tuberculosis
SDHSRRLWTMLIFMLWHAIFVEHSVVP

SEQ ID NO: 1380385 - protein, 18 aa, Mycobacterium tuberculosis
SENFDYMGLLLLSPGLAT

SEQ ID NO: 1380386 - protein, 17 aa, Mycobacterium tuberculosis
SFLRPVLAPDYGRVARA

SEQ ID NO: 1380387 - protein, 28 aa, Mycobacterium tuberculosis
SFRRRLDEYIGFLVAWQRPLAGKKTLMD

SEQ ID NO: 1380388 - protein, 34 aa, Mycobacterium tuberculosis; identical to SEQ ID NO: 328902

SEQ ID NO: 1380389 - protein, 23 aa, Mycobacterium tuberculosis
SGCSWSEALGIGWPEGITPEAHL

SEQ ID NO: 1380390 - protein, 21 aa, Mycobacterium tuberculosis
SGDTGLPVGVALLAALLAGVA

SEQ ID NO: 1380391 - protein, 17 aa, Mycobacterium tuberculosis
SGGPSPWAQTPRKTNPW

SEQ ID NO: 1380392 - protein, 18 aa, Mycobacterium tuberculosis
SGLAEFGLAVNMQAIVFM

SEQ ID NO: 1380393 - protein, 17 aa, Mycobacterium tuberculosis
SGLRGALATVIRAMGSL

SEQ ID NO: 1380394 - protein, 22 aa, Mycobacterium tuberculosis
SGLRTLPMVIGLLIASTGTGVL

SEQ ID NO: 1380395 - protein, 19 aa, Mycobacterium tuberculosis
SGTGLLAVWSRQTVAAGHP

SEQ ID NO: 1380396 - protein, 18 aa, Mycobacterium tuberculosis
SGVPRWDRSPGRASSAPR

SEQ ID NO: 1380397 - protein, 17 aa, Mycobacterium tuberculosis
SGYDFRPQIVGVFTDLA

SEQ ID NO: 1380398 - protein, 25 aa, Mycobacterium tuberculosis
SISREVFRQTPLIQIEAALALGATK

SEQ ID NO: 1380399 - protein, 18 aa, Mycobacterium tuberculosis
SLATRCYDVTQGAVRIGG

SEQ ID NO: 1380400 - protein, 34 aa, Mycobacterium tuberculosis
SLLASVSPLIRWIIKVPREFINDYLFNFPDTNFA

SEQ ID NO: 1380401 - protein, 18 aa, Mycobacterium tuberculosis
SLLERAAAIGARYQQAFA

SEQ ID NO: 1380402 - protein, 17 aa, Mycobacterium tuberculosis
SLVEVLRGTDSWTPFVA

SEQ ID NO: 1380403 - protein, 19 aa, Mycobacterium tuberculosis
SLVSPRLPAPWRIPLQAGL

SEQ ID NO: 1380404 - protein, 18 aa, Mycobacterium tuberculosis
SMGVLRLFANHSVVENNI

SEQ ID NO: 1380405 - protein, 33 aa, Mycobacterium tuberculosis
SMSRRFAVLVLLFCLFGVLFVLLRRGRVAGLAS

SEQ ID NO: 1380406 - protein, 18 aa, Mycobacterium tuberculosis
SNPPRPPLPPAPPGAPLP

SEQ ID NO: 1380407 - protein, 23 aa, Mycobacterium tuberculosis
SPKPRPLLAPVMIASFPERSGTV

SEQ ID NO: 1380408 - protein, 26 aa, Mycobacterium tuberculosis
SPLFPDLPSFPGFPGFPSLPGFPGLP

SEQ ID NO: 1380409 - protein, 27 aa, Mycobacterium tuberculosis
SPLFPDLPSFPGFPGFPSLPGFPGLPG

SEQ ID NO: 1380410 - protein, 24 aa, Mycobacterium tuberculosis
SPMSFLRRPARWMQLLATSGRCFS

SEQ ID NO: 1380411 - protein, 21 aa, Mycobacterium tuberculosis
SPRRWLRAVAVIGATAMLLAS

SEQ ID NO: 1380412 - protein, 23 aa, Mycobacterium tuberculosis
SPTSGRPSSVWVGAFTAFSRFCC

SEQ ID NO: 1380413 - protein, 20 aa, Mycobacterium tuberculosis
SPVTLCWLLISYGFAASVLP

SEQ ID NO: 1380414 - protein, 22 aa, Mycobacterium tuberculosis
SRGKLDRTLLLWMLPLLIAPPM

SEQ ID NO: 1380415 - protein, 24 aa, Mycobacterium tuberculosis
SRPWTQTRYWAFALLTPLVVAMVL

SEQ ID NO: 1380416 - protein, 26 aa, Mycobacterium tuberculosis
SSLRLWPDRRLSRRGVEIISRRAPRG

SEQ ID NO: 1380417 - protein, 18 aa, Mycobacterium tuberculosis
SSVYRGAADLSFGDAPVV

SEQ ID NO: 1380418 - protein, 19 aa, Mycobacterium tuberculosis
STEILKRWTRGVMSTVGDV

SEQ ID NO: 1380419 - protein, 17 aa, Mycobacterium tuberculosis
STLARLVAGYTHPTDGT

SEQ ID NO: 1380420 - protein, 26 aa, Mycobacterium tuberculosis
SVGRRPCFRGGGGVGLAAHFACCLVL

SEQ ID NO: 1380421 - protein, 27 aa, Mycobacterium tuberculosis
SVGSLLRLSVLALIMLPILAAVTLCAR

SEQ ID NO: 1380422 - protein, 17 aa, Mycobacterium tuberculosis
SVLPIAFVLLISVGSAY

SEQ ID NO: 1380423 - protein, 20 aa, Mycobacterium tuberculosis
SWRPGAWACRLVVVAAWGSI

SEQ ID NO: 1380424 - protein, 31 aa, Mycobacterium tuberculosis
SYREAAEALGLPAGWALRKIVLKTAMPGIVT

SEQ ID NO: 1380425 - protein, 24 aa, Mycobacterium tuberculosis
TAGLKEFVDAAVIFGVVVINAIVG

SEQ ID NO: 1380426 - protein, 21 aa, Mycobacterium tuberculosis
TALCGYAVIYLAARNLAPNGF

SEQ ID NO: 1380427 - protein, 20 aa, Mycobacterium tuberculosis
TARWYLLKGRIADARSALRR

SEQ ID NO: 1380428 - protein, 24 aa, Mycobacterium tuberculosis
TATVVIRWVVQWGSAMVAGYTGEQ

SEQ ID NO: 1380429 - protein, 21 aa, Mycobacterium tuberculosis
TAYFRMGWWSIIGYAAAAIIG

SEQ ID NO: 1380430 - protein, 19 aa, Mycobacterium tuberculosis
TAYISGWIPFWVTIPVNAA

SEQ ID NO: 1380431 - protein, 29 aa, Mycobacterium tuberculosis
TDVDFAVRICTEITGLVRTLAERDADKPA

SEQ ID NO: 1380432 - protein, 20 aa, Mycobacterium tuberculosis
TDVFLGLPLLLAAIVLMQVM

SEQ ID NO: 1380433 - protein, 19 aa, Mycobacterium tuberculosis
TDWTGRFNASPLREALIGH

SEQ ID NO: 1380434 - protein, 27 aa, Mycobacterium tuberculosis
TFVTRPVGSWFFGRFADRRGRRAALTF

SEQ ID NO: 1380435 - protein, 27 aa, Mycobacterium tuberculosis
TGLATSGLLAWARRRPVLAGVLIGLGS

SEQ ID NO: 1380436 - protein, 31 aa, Mycobacterium tuberculosis
TGLDIRPNPGIGHPCWANYFPVTRAVPEPPS

SEQ ID NO: 1380437 - protein, 27 aa, Mycobacterium tuberculosis
TIQAAQLSALWARFPLPVIPAPGDPTP

SEQ ID NO: 1380438 - protein, 23 aa, Mycobacterium tuberculosis
TIVGYYILRRALRPDGGQLIGVG

SEQ ID NO: 1380439 - protein, 19 aa, Mycobacterium tuberculosis
TKMSGEWSKDDVLQAYLNI

SEQ ID NO: 1380440 - protein, 17 aa, Mycobacterium tuberculosis
TKWVHHFGLFAAVGAAM

SEQ ID NO: 1380441 - protein, 18 aa, Mycobacterium tuberculosis
TLAELAANHVIHTVLVAT

SEQ ID NO: 1380442 - protein, 18 aa, Mycobacterium tuberculosis
TLRRWLRPATAAVVCCLA

SEQ ID NO: 1380443 - protein, 18 aa, Mycobacterium tuberculosis
TLVIAVLVWWHFVGANTS

SEQ ID NO: 1380444 - protein, 18 aa, Mycobacterium tuberculosis
TMPSEYRDLLGGLNVDQL

SEQ ID NO: 1380445 - protein, 20 aa, Mycobacterium tuberculosis
TPGDCWARYRNRIRPVVADR

SEQ ID NO: 1380446 - protein, 23 aa, Mycobacterium tuberculosis
TPLTAKLAWFSKFLTIAILGLAA

SEQ ID NO: 1380447 - protein, 19 aa, Mycobacterium tuberculosis
TPSECRVILLDAAPAVLPP

SEQ ID NO: 1380448 - protein, 17 aa, Mycobacterium tuberculosis
TPTKWTHHFGVFAGLAG

SEQ ID NO: 1380449 - protein, 17 aa, Mycobacterium tuberculosis
TPTKWVHHFGLFAAVGA

SEQ ID NO: 1380450 - protein, 20 aa, Mycobacterium tuberculosis
TPTKWVHHFGLFAAVGAAMA

SEQ ID NO: 1380451 - protein, 19 aa, Mycobacterium tuberculosis
TPTWCRHTAELVGPACQQV

SEQ ID NO: 1380452 - protein, 18 aa, Mycobacterium tuberculosis
TQYTRHVERFFAESWARL

SEQ ID NO: 1380453 - protein, 17 aa, Mycobacterium tuberculosis
TRALLLAGEETRLRLLV

SEQ ID NO: 1380454 - protein, 28 aa, Mycobacterium tuberculosis
TRHVERFFAESWARLTAGRTARVVLLDD

SEQ ID NO: 1380455 - protein, 17 aa, Mycobacterium tuberculosis
TRMTDAYLAPRKLRTTT

SEQ ID NO: 1380456 - protein, 24 aa, Mycobacterium tuberculosis
TRPVGSWFLGRFADRRGRRAALTF

SEQ ID NO: 1380457 - protein, 19 aa, Mycobacterium tuberculosis
TRRRSMLTLADRVAVLDSG

SEQ ID NO: 1380458 - protein, 27 aa, Mycobacterium tuberculosis
TRRWRRVGTAIVRWPGPVLAATCLVAS

SEQ ID NO: 1380459 - protein, 31 aa, Mycobacterium tuberculosis; identical to SEQ ID NO: 332046

SEQ ID NO: 1380460 - protein, 21 aa, Mycobacterium tuberculosis
TSREFRAAGLTHLTAVSGANV

SEQ ID NO: 1380461 - protein, 22 aa, Mycobacterium tuberculosis
TSSGVLLLWSWLVMSLAQGYYS

SEQ ID NO: 1380462 - protein, 21 aa, Mycobacterium tuberculosis
TSSPGRCDMSPIPRIVSVSLA

SEQ ID NO: 1380463 - protein, 32 aa, Mycobacterium tuberculosis
TVLILGWRSARWWRRGASLLAVPLCLLSATLT

SEQ ID NO: 1380464 - protein, 21 aa, Mycobacterium tuberculosis
TVPGDAWERLGAALVNAYPTL

SEQ ID NO: 1380465 - protein, 17 aa, Mycobacterium tuberculosis
TVVVPLSAFVALPAIAT

SEQ ID NO: 1380466 - protein, 22 aa, Mycobacterium tuberculosis
TWAIYVRRGLKSAGELVPATTA

SEQ ID NO: 1380467 - protein, 17 aa, Mycobacterium tuberculosis
TYIIGFRFYARLIEMKV

SEQ ID NO: 1380468 - protein, 23 aa, Mycobacterium tuberculosis
VAACAACGLVYELALLTLAASLN

SEQ ID NO: 1380469 - protein, 18 aa, Mycobacterium tuberculosis
VAAFEFFDGVPARLVCDN

SEQ ID NO: 1380470 - protein, 20 aa, Mycobacterium tuberculosis
VAAGSVWPAVSMAVTGAGTA

SEQ ID NO: 1380471 - protein, 17 aa, Mycobacterium tuberculosis
VAFVHWLIFQSLYRIGA

SEQ ID NO: 1380472 - protein, 21 aa, Mycobacterium tuberculosis
VAGVAALFWRLPSDDTTRSRA

SEQ ID NO: 1380473 - protein, 18 aa, Mycobacterium tuberculosis
VAIACIIGALTLFSGPTG

SEQ ID NO: 1380474 - protein, 17 aa, Mycobacterium tuberculosis
VALLCSLATTLVLLDGA

SEQ ID NO: 1380475 - protein, 19 aa, Mycobacterium tuberculosis
VALTMAVISPAIWAARGAR

SEQ ID NO: 1380476 - protein, 17 aa, Mycobacterium tuberculosis
VAMRNARHHAASMETLI

SEQ ID NO: 1380477 - protein, 19 aa, Mycobacterium tuberculosis
VAPSHRWGLGAFLVVELVF

SEQ ID NO: 1380478 - protein, 18 aa, Mycobacterium tuberculosis
VAQLTFLTVASFLLVNKV

SEQ ID NO: 1380479 - protein, 20 aa, Mycobacterium tuberculosis
VASGDCLMWPDGTPESAAIV

SEQ ID NO: 1380480 - protein, 22 aa, Mycobacterium tuberculosis
VASLCLIFIIMLGITRSVVASA

SEQ ID NO: 1380481 - protein, 19 aa, Mycobacterium tuberculosis
VAVDRCFTGLVISLVCGYV

SEQ ID NO: 1380482 - protein, 31 aa, Mycobacterium tuberculosis
VCGFRSRLYAERWCAWALLAATVAIPTGLTA

SEQ ID NO: 1380483 - protein, 25 aa, Mycobacterium tuberculosis
VDALWWAACVCCLAVVITPTLWMLI

SEQ ID NO: 1380484 - protein, 18 aa, Mycobacterium tuberculosis
VDAVRNISKWPGVRDAVM

SEQ ID NO: 1380485 - protein, 25 aa, Mycobacterium tuberculosis
VDIREHPSTCWWWERTAGENRARVR

SEQ ID NO: 1380486 - protein, 20 aa, Mycobacterium tuberculosis
VDRHGLCLPMCIGTCQFVQR

SEQ ID NO: 1380487 - protein, 29 aa, Mycobacterium tuberculosis
VEPSWMPLWAFVIAMVLLRSSLAGFGHYA

SEQ ID NO: 1380488 - protein, 21 aa, Mycobacterium tuberculosis
VEPWYALVGERERVLGLMRAI

SEQ ID NO: 1380489 - protein, 32 aa, Mycobacterium tuberculosis
VEQMLADCGLEWVAVRCALIFGRNVDNWVQRL

SEQ ID NO: 1380490 - protein, 18 aa, Mycobacterium tuberculosis
VGARLAWTYLAPNGANFV

SEQ ID NO: 1380491 - protein, 24 aa, Mycobacterium tuberculosis
VGAVVPHVRWPMWLRTAVATAALA

SEQ ID NO: 1380492 - protein, 18 aa, Mycobacterium tuberculosis
VGGSGDWGPSLGPTVGGR

SEQ ID NO: 1380493 - protein, 18 aa, Mycobacterium tuberculosis
VGGTRWVVYEGSDENGAV

SEQ ID NO: 1380494 - protein, 23 aa, Mycobacterium tuberculosis
VGLSAAGGWFYWDRVQTGGEASA

SEQ ID NO: 1380495 - protein, 19 aa, Mycobacterium tuberculosis
VGPVTSEFSGKVHFVEQDR

SEQ ID NO: 1380496 - protein, 35 aa, Mycobacterium tuberculosis
VGQANWWLPSSWRPETWWPLGRRRGRAQRTKRKPL

SEQ ID NO: 1380497 - protein, 19 aa, Mycobacterium tuberculosis
VGTKPQWWHTLVMSMSLTA

SEQ ID NO: 1380498 - protein, 20 aa, Mycobacterium tuberculosis
VGVGLLGMFGPVRVVHVGWL

SEQ ID NO: 1380499 - protein, 22 aa, Mycobacterium tuberculosis
VGVMRWRWRVAFYALSALGTDR

SEQ ID NO: 1380500 - protein, 17 aa, Mycobacterium tuberculosis
VHSALLSAGPGPASLQA

SEQ ID NO: 1380501 - protein, 17 aa, Mycobacterium tuberculosis
VHYPWLPLRRLLLDHYP

SEQ ID NO: 1380502 - protein, 24 aa, Mycobacterium tuberculosis
VIRNWPAWLGVYGFMTLDRWLLFN

SEQ ID NO: 1380503 - protein, 25 aa, Mycobacterium tuberculosis
VIRNWPAWLGVYGFMTLDRWLLFNW

SEQ ID NO: 1380504 - protein, 21 aa, Mycobacterium tuberculosis
VKEFPGPWALVPVGATMLMIL

SEQ ID NO: 1380505 - protein, 22 aa, Mycobacterium tuberculosis
VLALATPVVREWLFGTQQQPGW

SEQ ID NO: 1380506 - protein, 25 aa, Mycobacterium tuberculosis
VLASDRGAGVLGFAGTAGKESVGRP

SEQ ID NO: 1380507 - protein, 17 aa, Mycobacterium tuberculosis
VLATMPPLLAAIANAGR

SEQ ID NO: 1380508 - protein, 17 aa, Mycobacterium tuberculosis
VLLTVGFWGLLRVAEAL

SEQ ID NO: 1380509 - protein, 38 aa, Mycobacterium tuberculosis
VLLVIGALVVWWGWRERRDLFSGFGWLAVVLLAVAAAC

SEQ ID NO: 1380510 - protein, 18 aa, Mycobacterium tuberculosis
VLRLARRSAASGAALADG

SEQ ID NO: 1380511 - protein, 21 aa, Mycobacterium tuberculosis
VLVGARLAVAVVRVATATRRR

SEQ ID NO: 1380512 - protein, 25 aa, Mycobacterium tuberculosis
VLVGELLCFVGMLIGIPVAALIHVY

SEQ ID NO: 1380513 - protein, 25 aa, Mycobacterium tuberculosis
VMAIFYLRLPATFGIGTYGVSADFV

SEQ ID NO: 1380514 - protein, 17 aa, Mycobacterium tuberculosis
VMLLGVLAVLVAMVGLA

SEQ ID NO: 1380515 - protein, 25 aa, Mycobacterium tuberculosis
VNLKLLMPVFRWQRRDNLLTEPDPA

SEQ ID NO: 1380516 - protein, 21 aa, Mycobacterium tuberculosis
VPAALLRWGVSQFDAEVRPVR

SEQ ID NO: 1380517 - protein, 20 aa, Mycobacterium tuberculosis
VPKLRRWLATAVRPKLREVT

SEQ ID NO: 1380518 - protein, 18 aa, Mycobacterium tuberculosis
VPKLTTALIHAYPAEHGS

SEQ ID NO: 1380519 - protein, 23 aa, Mycobacterium tuberculosis
VPKSRRAVSLSVLIGAVIAALAG

SEQ ID NO: 1380520 - protein, 17 aa, Mycobacterium tuberculosis
VPLPRWYWIGLAVGILV

SEQ ID NO: 1380521 - protein, 18 aa, Mycobacterium tuberculosis
VPMLPGSWGPDLVGVAGD

SEQ ID NO: 1380522 - protein, 17 aa, Mycobacterium tuberculosis
VPPDFGERGRRDLYHFT

SEQ ID NO: 1380523 - protein, 18 aa, Mycobacterium tuberculosis
VPQVQFYLSPAMLILLAL

SEQ ID NO: 1380524 - protein, 29 aa, Mycobacterium tuberculosis
VPSVICAITVAWLDRFMGIGGESALFFIG

SEQ ID NO: 1380525 - protein, 20 aa, Mycobacterium tuberculosis
VPTLWRGALVVLQSILAVAF

SEQ ID NO: 1380526 - protein, 17 aa, Mycobacterium tuberculosis
VPTRNALALGLTLTVIS

SEQ ID NO: 1380527 - protein, 17 aa, Mycobacterium tuberculosis
VPVLASWVLLRRRHGDL

SEQ ID NO: 1380528 - protein, 18 aa, Mycobacterium tuberculosis
VPWWWWPLAFALAALIAF

SEQ ID NO: 1380529 - protein, 18 aa, Mycobacterium tuberculosis
VRAGETLAVVGAPGSGKS

SEQ ID NO: 1380530 - protein, 22 aa, Mycobacterium tuberculosis
VRGARNIPCVDVLGKRAATPKE

SEQ ID NO: 1380531 - protein, 29 aa, Mycobacterium tuberculosis
VRIPRSVEALGRVDMVCFDKTGTLSENRL

SEQ ID NO: 1380532 - protein, 19 aa, Mycobacterium tuberculosis
VRQRFFALFLYVVMLVFLV

SEQ ID NO: 1380533 - protein, 19 aa, Mycobacterium tuberculosis
VRRQSRWRTAAFASAAAIA

SEQ ID NO: 1380534 - protein, 21 aa, Mycobacterium tuberculosis
VRSAGLWYAVMTQLGFIAILV

SEQ ID NO: 1380535 - protein, 20 aa, Mycobacterium tuberculosis
VSALHRPVPLSGEGSDTDTV

SEQ ID NO: 1380536 - protein, 17 aa, Mycobacterium tuberculosis
VSEDKFFIIGRIKDLLI

SEQ ID NO: 1380537 - protein, 23 aa, Mycobacterium tuberculosis
VSGIEGLLTWLGGGHWRELGERH

SEQ ID NO: 1380538 - protein, 18 aa, Mycobacterium tuberculosis
VSGLAALIRARFPTLTAR

SEQ ID NO: 1380539 - protein, 17 aa, Mycobacterium tuberculosis
VSGRLLFALLSFSVVGA

SEQ ID NO: 1380540 - protein, 21 aa, Mycobacterium tuberculosis
VSKGLKWLSNINMALAAALAL

SEQ ID NO: 1380541 - protein, 17 aa, Mycobacterium tuberculosis
VTGQALRDFILEQRKIR

SEQ ID NO: 1380542 - protein, 18 aa, Mycobacterium tuberculosis
VTLEVFGAPGTVATINYL

SEQ ID NO: 1380543 - protein, 17 aa, Mycobacterium tuberculosis
VTLTASWQKIFSADPSV

SEQ ID NO: 1380544 - protein, 18 aa, Mycobacterium tuberculosis
VTRLCGWTYALSVVLLWV

SEQ ID NO: 1380545 - protein, 23 aa, Mycobacterium tuberculosis
VVALRSRLLVRLGGAGGMVSLAC

SEQ ID NO: 1380546 - protein, 18 aa, Mycobacterium tuberculosis
VVDARLVTMVPAGWSLVE

SEQ ID NO: 1380547 - protein, 19 aa, Mycobacterium tuberculosis
VVHVIRGDGLAGVSAPQLG

SEQ ID NO: 1380548 - protein, 24 aa, Mycobacterium tuberculosis
VWTVIAILALFGWPQVARIARGAV

SEQ ID NO: 1380549 - protein, 25 aa, Mycobacterium tuberculosis
WALRAIVAALLEWQRKSELSGDRAG

SEQ ID NO: 1380550 - protein, 23 aa, Mycobacterium tuberculosis
WATSGLAGRRIWDAALVAASPLV

SEQ ID NO: 1380551 - protein, 23 aa, Mycobacterium tuberculosis
WAVGQLLCGWLVDRVGARVTLVS

SEQ ID NO: 1380552 - protein, 17 aa, Mycobacterium tuberculosis
WCGGLAIGLTLVLKPLL

SEQ ID NO: 1380553 - protein, 17 aa, Mycobacterium tuberculosis
WERLGAALVNAYPTLTQ

SEQ ID NO: 1380554 - protein, 18 aa, Mycobacterium tuberculosis
WHAPWPLNMWASANTGWW

SEQ ID NO: 1380555 - protein, 24 aa, Mycobacterium tuberculosis
WHIVGLCIFGFLLAMLRGNHVGHV

SEQ ID NO: 1380556 - protein, 20 aa, Mycobacterium tuberculosis
WIAIVAMGGFFMMMKLIHRH

SEQ ID NO: 1380557 - protein, 17 aa, Mycobacterium tuberculosis
WIKPRRDLTSRMWRRSG

SEQ ID NO: 1380558 - protein, 17 aa, Mycobacterium tuberculosis
WIPMVIVIVVAVAAVTV

SEQ ID NO: 1380559 - protein, 23 aa, Mycobacterium tuberculosis
WPNLDYPGLHALSTVPQCVPNAA

SEQ ID NO: 1380560 - protein, 37 aa, Mycobacterium tuberculosis
WPSLNRGWCLIRTRWGRRIARLLPFVGLAGLAVTTHV

SEQ ID NO: 1380561 - protein, 17 aa, Mycobacterium tuberculosis
WQFGITTVYHFIFVPLT

SEQ ID NO: 1380562 - protein, 20 aa, Mycobacterium tuberculosis
WRIHAAVLPPSVFGSGPLKW

SEQ ID NO: 1380563 - protein, 18 aa, Mycobacterium tuberculosis
WRPGAWAAAGVLAAGAVI

SEQ ID NO: 1380564 - protein, 17 aa, Mycobacterium tuberculosis
WRVAGSAALFVAGFTTV

SEQ ID NO: 1380565 - protein, 28 aa, Mycobacterium tuberculosis
WSLGGVLAYACAIGLRRLGKDVRFVGLI

SEQ ID NO: 1380566 - protein, 22 aa, Mycobacterium tuberculosis
WSNEAKLTLSDVFGDPATIEDL

SEQ ID NO: 1380567 - protein, 26 aa, Mycobacterium tuberculosis
WVDAEPRLRALGWTGMLDKGADVDAG

SEQ ID NO: 1380568 - protein, 17 aa, Mycobacterium tuberculosis
WVLPVHRASGLISRILA

SEQ ID NO: 1380569 - protein, 24 aa, Mycobacterium tuberculosis
WVNGLFGRLAWLFVGPVVAFPAFE

SEQ ID NO: 1380570 - protein, 17 aa, Mycobacterium tuberculosis
WVPFGGGVKRCLGANFS

SEQ ID NO: 1380571 - protein, 26 aa, Mycobacterium tuberculosis
WWETGRSLWWPLAIGILGIAVLVGSF

SEQ ID NO: 1380572 - protein, 17 aa, Mycobacterium tuberculosis
WWVTFGVAPAYATLALA

SEQ ID NO: 1380573 - protein, 20 aa, Mycobacterium tuberculosis
YAFLCATALMVVRIEERHTR

SEQ ID NO: 1380574 - protein, 25 aa, Mycobacterium tuberculosis
YALACVLGECLTGAPPYRADSVERL

SEQ ID NO: 1380575 - protein, 28 aa, Mycobacterium tuberculosis
YALQWPLFAWFCVYAYRNFVRYEETPPQ

SEQ ID NO: 1380576 - protein, 17 aa, Mycobacterium tuberculosis
YGEKVAFVAGWMYFLNW

SEQ ID NO: 1380577 - protein, 23 aa, Mycobacterium tuberculosis
YGGDAWVIREGRRSRIEPTNRAV

SEQ ID NO: 1380578 - protein, 28 aa, Mycobacterium tuberculosis
YGIFIVWLLHDWRDVFWINVPLTAIAMV

SEQ ID NO: 1380579 - protein, 21 aa, Mycobacterium tuberculosis
YGQSLKLQWGVTGPDGRIQPL

SEQ ID NO: 1380580 - protein, 21 aa, Mycobacterium tuberculosis
YKADFDPYQFLLIPLARITGI

SEQ ID NO: 1380581 - protein, 24 aa, Mycobacterium tuberculosis
YLPPEAFQNPDFQRGLKLFLSPDG

SEQ ID NO: 1380582 - protein, 23 aa, Mycobacterium tuberculosis
YLREFGNLVFHFALLGLLVAVAV

SEQ ID NO: 1380583 - protein, 18 aa, Mycobacterium tuberculosis
YNMALVFRHRVRKDRLIS

SEQ ID NO: 1380584 - protein, 19 aa, Mycobacterium tuberculosis
YPERRRLAPPRGKSVVHEP

SEQ ID NO: 1380585 - protein, 18 aa, Mycobacterium tuberculosis
YPGIPGYIDQQWVTQAEA

SEQ ID NO: 1380586 - protein, 17 aa, Mycobacterium tuberculosis
YPLAAALSLVVLFTLVE

SEQ ID NO: 1380587 - protein, 17 aa, Mycobacterium tuberculosis
YPVGFLFGLGFDTATEI

SEQ ID NO: 1380588 - protein, 20 aa, Mycobacterium tuberculosis
YQTSRISSDFTFGNAPNDDP

SEQ ID NO: 1380589 - protein, 17 aa, Mycobacterium tuberculosis
YRLTKFFGKLFLINFAI

SEQ ID NO: 1380590 - protein, 17 aa, Mycobacterium tuberculosis
YRPGRDLVRTGGPGALP

SEQ ID NO: 1380591 - protein, 18 aa, Mycobacterium tuberculosis
YSIGGILYAVRWPDPWPT

SEQ ID NO: 1380592 - protein, 19 aa, Mycobacterium tuberculosis
YSIGGILYAVRWPDPWPTT

SEQ ID NO: 1380593 - protein, 21 aa, Mycobacterium tuberculosis
YSVPWRLIGQRLHARTAGDVV

SEQ ID NO: 1380594 - protein, 24 aa, Mycobacterium tuberculosis
YTLRLAPRSYRRWPPAVVGISALG

SEQ ID NO: 1380595 - protein, 18 aa, Mycobacterium tuberculosis
YTSEFLLGYLADYQIPTP

SEQ ID NO: 1380596 - protein, 18 aa, Mycobacterium tuberculosis
YVFARPPLLGTTGRTVAT

SEQ ID NO: 1380597 - protein, 31 aa, Mycobacterium tuberculosis; identical to SEQ ID NO: 338529

SEQ ID NO: 1380598 - protein, 20 aa, Mycobacterium tuberculosis
YVLVGWSLGGVLAYACAIGL

SEQ ID NO: 1380599 - protein, 23 aa, Mycobacterium tuberculosis
YVLVSTWLVVWGIWHVYFVEAVF

SEQ ID NO: 1380600 - protein, 19 aa, Mycobacterium tuberculosis
YVRKRLRCGNRHPLQRVKR

SEQ ID NO: 1380601 - protein, 25 aa, Mycobacterium tuberculosis
YWLGAQWWHPLVVVGLIALVAIMIA

SEQ ID NO: 1380602 - protein, 24 aa, Mycobacterium tuberculosis
AAAEYPSEHPLGAAIVKAAQSRRI

SEQ ID NO: 1380603 - protein, 24 aa, Mycobacterium tuberculosis
AAAITGKSTHRWVSGPAGVDQQLY

SEQ ID NO: 1380604 - protein, 19 aa, Mycobacterium tuberculosis
AAAKRSALVHWSRRPASTQ

SEQ ID NO: 1380605 - protein, 24 aa, Mycobacterium tuberculosis
AAALARTTRWGSFLPDIDAFDAEF

SEQ ID NO: 1380606 - protein, 17 aa, Mycobacterium tuberculosis
AAARGLYMAFMVLAAAG

SEQ ID NO: 1380607 - protein, 29 aa, Mycobacterium tuberculosis
AAARLPVTWEMSFLYAIVFGGFVAFSNYL

SEQ ID NO: 1380608 - protein, 24 aa, Mycobacterium tuberculosis
AAARSSALPAYWERLAVWWQLGSD

SEQ ID NO: 1380609 - protein, 23 aa, Mycobacterium tuberculosis
AAARSSALPAYWSGSRLLQLGSD

SEQ ID NO: 1380610 - protein, 26 aa, Mycobacterium tuberculosis
AAAVLTWKVYDRRSGHRHGDVAGGIG

SEQ ID NO: 1380611 - protein, 18 aa, Mycobacterium tuberculosis
AAAVPYVAWMRATAASAE

SEQ ID NO: 1380612 - protein, 17 aa, Mycobacterium tuberculosis
AAAWLHAAVWWKALLAL

SEQ ID NO: 1380613 - protein, 18 aa, Mycobacterium tuberculosis
AADALPVRVGVAVIGALI

SEQ ID NO: 1380614 - protein, 24 aa, Mycobacterium tuberculosis
AADALPVRVGVAVIGALIVFGLIM

SEQ ID NO: 1380615 - protein, 18 aa, Mycobacterium tuberculosis
AADGDWPPDEDFGSEHFR

SEQ ID NO: 1380616 - protein, 20 aa, Mycobacterium tuberculosis
AADTRLDVLSSIGQLIRDIL

SEQ ID NO: 1380617 - protein, 18 aa, Mycobacterium tuberculosis
AAEAVGFYRGERVEGTQL

SEQ ID NO: 1380618 - protein, 17 aa, Mycobacterium tuberculosis
AAFEFFDGVPARLVCDN

SEQ ID NO: 1380619 - protein, 17 aa, Mycobacterium tuberculosis
AAFPGWYATVFSALYLP

SEQ ID NO: 1380620 - protein, 21 aa, Mycobacterium tuberculosis
AAGARPARDLVRVAFGPGVVA

SEQ ID NO: 1380621 - protein, 19 aa, Mycobacterium tuberculosis
AAGLGRRRAGCFADPRHGL

SEQ ID NO: 1380622 - protein, 27 aa, Mycobacterium tuberculosis
AAGLGVLWLPAGWLAHRLLSVPVTTCR

SEQ ID NO: 1380623 - protein, 28 aa, Mycobacterium tuberculosis
AAGLGVLWLPAGWLAHRLLSVPVTTCRV

SEQ ID NO: 1380624 - protein, 17 aa, Mycobacterium tuberculosis
AAGLWASIAPLAIYALL

SEQ ID NO: 1380625 - protein, 20 aa, Mycobacterium tuberculosis
AAGMYPAWRLGRMTIRTAIR

SEQ ID NO: 1380626 - protein, 22 aa, Mycobacterium tuberculosis
AAGRARTLIYHRLAHGPAAAAV

SEQ ID NO: 1380627 - protein, 17 aa, Mycobacterium tuberculosis
AAGRSARRSWRQTRSPT

SEQ ID NO: 1380628 - protein, 17 aa, Mycobacterium tuberculosis
AAGSVWPAVSMAVTGAG

SEQ ID NO: 1380629 - protein, 17 aa, Mycobacterium tuberculosis
AAGSVWPAVSMTVMGAG

SEQ ID NO: 1380630 - protein, 21 aa, Mycobacterium tuberculosis
AAGVLGALAIIIAVLLVIKAP

SEQ ID NO: 1380631 - protein, 19 aa, Mycobacterium tuberculosis
AAHRFRFVLDHGLQLGRFD

SEQ ID NO: 1380632 - protein, 19 aa, Mycobacterium tuberculosis
AAHYVHRFGGVTGDVLGSA

SEQ ID NO: 1380633 - protein, 18 aa, Mycobacterium tuberculosis
AAIPAPWPVLATLPSGPE

SEQ ID NO: 1380634 - protein, 17 aa, Mycobacterium tuberculosis
AAKGYRSSWPIERLTMF

SEQ ID NO: 1380635 - protein, 18 aa, Mycobacterium tuberculosis
AALASGAARGTRAADAAG

SEQ ID NO: 1380636 - protein, 23 aa, Mycobacterium tuberculosis
AALAVAVLARWRFRRRPAPARLP

SEQ ID NO: 1380637 - protein, 25 aa, Mycobacterium tuberculosis
AALDPYVRDGWAFVAIRLTSTDLIV

SEQ ID NO: 1380638 - protein, 29 aa, Mycobacterium tuberculosis
AALHRAYSLGLGWCDGWVGLVAAAAAVLG

SEQ ID NO: 1380639 - protein, 17 aa, Mycobacterium tuberculosis
AALPFGLDPARTPVMGS

SEQ ID NO: 1380640 - protein, 27 aa, Mycobacterium tuberculosis
AALQRLPGRCWPVSATATATWAALGGT

SEQ ID NO: 1380641 - protein, 19 aa, Mycobacterium tuberculosis
AALRLAFVVSVVWGAPTGI

SEQ ID NO: 1380642 - protein, 23 aa, Mycobacterium tuberculosis
AALRLAFVVSVVWGAPTGIRLGW

SEQ ID NO: 1380643 - protein, 25 aa, Mycobacterium tuberculosis
AALSAAGYLCWRGKDLATPRGWITA

SEQ ID NO: 1380644 - protein, 18 aa, Mycobacterium tuberculosis
AALSNLVAGWIVVVAGYD

SEQ ID NO: 1380645 - protein, 23 aa, Mycobacterium tuberculosis
AAMGCAFVALLRPQSALGQAPIV

SEQ ID NO: 1380646 - protein, 24 aa, Mycobacterium tuberculosis
AANFRDIMITLGMFTHDALLGGEG

SEQ ID NO: 1380647 - protein, 18 aa, Mycobacterium tuberculosis
AANHAIHGVLIATNFFGI

SEQ ID NO: 1380648 - protein, 18 aa, Mycobacterium tuberculosis
AANRVVGFALADPDLFTG

SEQ ID NO: 1380649 - protein, 18 aa, Mycobacterium tuberculosis
AAPAKRSLLRTAVIVPAV

SEQ ID NO: 1380650 - protein, 17 aa, Mycobacterium tuberculosis
AAPEVLAGQGFDGLADL

SEQ ID NO: 1380651 - protein, 27 aa, Mycobacterium tuberculosis
AAPRSVGVPLYLLLGWVAVWYTATILH

SEQ ID NO: 1380652 - protein, 23 aa, Mycobacterium tuberculosis
AAPTTPGRLIWPSTAIRPLPGRP

SEQ ID NO: 1380653 - protein, 18 aa, Mycobacterium tuberculosis
AAQARKAVGTGVRKKTPE

SEQ ID NO: 1380654 - protein, 19 aa, Mycobacterium tuberculosis
AARRGLPTLRRPWRRSPGA

SEQ ID NO: 1380655 - protein, 22 aa, Mycobacterium tuberculosis
AASCITAGGGLMLVRNALGTNV

SEQ ID NO: 1380656 - protein, 18 aa, Mycobacterium tuberculosis
AASRYTALLVTFVGDYVT

SEQ ID NO: 1380657 - protein, 31 aa, Mycobacterium tuberculosis
AASSRCLSSWMTPYGLRRVCDGFATVRRPGS

SEQ ID NO: 1380658 - protein, 26 aa, Mycobacterium tuberculosis
AATIKRFADRFARFNLQERVIRPSYG

SEQ ID NO: 1380659 - protein, 35 aa, Mycobacterium tuberculosis
AATPILAVAMPWLFLRLRFCRRKWTVPTLAATPAG

SEQ ID NO: 1380660 - protein, 25 aa, Mycobacterium tuberculosis
AATVSVAAWGIRLAREAERKAGESA

SEQ ID NO: 1380661 - protein, 17 aa, Mycobacterium tuberculosis
AAVAMFLGFVAPALSLS

SEQ ID NO: 1380662 - protein, 20 aa, Mycobacterium tuberculosis
AAVGCALFVWLERRSSNPMM

SEQ ID NO: 1380663 - protein, 18 aa, Mycobacterium tuberculosis
AAVLARPVGGWLSDRIAP

SEQ ID NO: 1380664 - protein, 18 aa, Mycobacterium tuberculosis
AAVLFDIDGVLVLSWRAI

SEQ ID NO: 1380665 - protein, 17 aa, Mycobacterium tuberculosis
AAVLLAMALWLGAGPSV

SEQ ID NO: 1380666 - protein, 17 aa, Mycobacterium tuberculosis
AAVLLHLGPGLGNGLAN

SEQ ID NO: 1380667 - protein, 17 aa, Mycobacterium tuberculosis
AAVLLLSYWPARNLLSS

SEQ ID NO: 1380668 - protein, 23 aa, Mycobacterium tuberculosis
AAVPLDWRWRRRGFFGDHGGRWC

SEQ ID NO: 1380669 - protein, 21 aa, Mycobacterium tuberculosis
AAVQLPAVWLLSAVTVGLFGW

SEQ ID NO: 1380670 - protein, 24 aa, Mycobacterium tuberculosis
AAVVLACTLVGFAVAVLGDPVMLR

SEQ ID NO: 1380671 - protein, 27 aa, Mycobacterium tuberculosis
AAWRWRLPRCWVTWWRPRRWRVRRAWF

SEQ ID NO: 1380672 - protein, 26 aa, Mycobacterium tuberculosis
AAYLAGFAWGLSREYSVLVEMDADGS

SEQ ID NO: 1380673 - protein, 19 aa, Mycobacterium tuberculosis
ACARSCRRTATPGCGHTTR

SEQ ID NO: 1380674 - protein, 22 aa, Mycobacterium tuberculosis
ACASGRAPSRCVGRRRSQHGAP

SEQ ID NO: 1380675 - protein, 17 aa, Mycobacterium tuberculosis
ACATKWSGVYFVLFFGA

SEQ ID NO: 1380676 - protein, 17 aa, Mycobacterium tuberculosis
ADALLAHDTLVPDSRPA

SEQ ID NO: 1380677 - protein, 29 aa, Mycobacterium tuberculosis
ADALRTATLQRLRPRLGVGAAAPAPAVVT

SEQ ID NO: 1380678 - protein, 17 aa, Mycobacterium tuberculosis
ADARPGDLLYGLHAMMF

SEQ ID NO: 1380679 - protein, 25 aa, Mycobacterium tuberculosis
ADARPGDLLYGLHAMMFNRSRVSDD

SEQ ID NO: 1380680 - protein, 18 aa, Mycobacterium tuberculosis
ADAWLTSLLAAFAASATI

SEQ ID NO: 1380681 - protein, 23 aa, Mycobacterium tuberculosis
ADDSRDAPTMAWKLFDLATTQRA

SEQ ID NO: 1380682 - protein, 19 aa, Mycobacterium tuberculosis
ADGLITFFALVIVTSLSMV

SEQ ID NO: 1380683 - protein, 19 aa, Mycobacterium tuberculosis
ADGLPRLATADIQVGDVLV

SEQ ID NO: 1380684 - protein, 23 aa, Mycobacterium tuberculosis
ADGRNTLLLPFRVAAVHLILWDI

SEQ ID NO: 1380685 - protein, 29 aa, Mycobacterium tuberculosis
ADHPRSKVGPLRWTRLTEILRGGRSRLVF

SEQ ID NO: 1380686 - protein, 18 aa, Mycobacterium tuberculosis
ADHSMIFVFIAGSYTPFA

SEQ ID NO: 1380687 - protein, 17 aa, Mycobacterium tuberculosis
ADIRGAIGFSSFGVLVY

SEQ ID NO: 1380688 - protein, 17 aa, Mycobacterium tuberculosis
ADKSGLTALTWPVMANF

SEQ ID NO: 1380689 - protein, 18 aa, Mycobacterium tuberculosis
ADLARLGREGVLALSTAE

SEQ ID NO: 1380690 - protein, 20 aa, Mycobacterium tuberculosis
ADLDQVWRLTRGAGQRVAVI

SEQ ID NO: 1380691 - protein, 27 aa, Mycobacterium tuberculosis
ADLEPTWSRPGWRHLKHFNGYATSFWV

SEQ ID NO: 1380692 - protein, 19 aa, Mycobacterium tuberculosis
ADLIARLGPAFPDLPTHRH

SEQ ID NO: 1380693 - protein, 18 aa, Mycobacterium tuberculosis
ADLPEYRTGLIIVGLARC

SEQ ID NO: 1380694 - protein, 24 aa, Mycobacterium tuberculosis
ADLPEYRTGLIIVGLARCIAMVII

SEQ ID NO: 1380695 - protein, 25 aa, Mycobacterium tuberculosis
ADLYSLGCALFRLLTGEAPFAAGAG

SEQ ID NO: 1380696 - protein, 28 aa, Mycobacterium tuberculosis
ADPAGRGRPRFSAWYGPCARRAASAAVA

SEQ ID NO: 1380697 - protein, 17 aa, Mycobacterium tuberculosis
ADPVLQEAFGRPFAGAE

SEQ ID NO: 1380698 - protein, 21 aa, Mycobacterium tuberculosis
ADPVLQEAFGRPFAGAESLQR

SEQ ID NO: 1380699 - protein, 18 aa, Mycobacterium tuberculosis
ADRRGRRAALTFSVSLMA

SEQ ID NO: 1380700 - protein, 24 aa, Mycobacterium tuberculosis
ADSACAPAAAGVPVVIPVVNDWPN

SEQ ID NO: 1380701 - protein, 24 aa, Mycobacterium tuberculosis
ADVKPVWQSLRHADTWIMSLLYIG

SEQ ID NO: 1380702 - protein, 19 aa, Mycobacterium tuberculosis
ADVLGGFDFTAQGVWAFAR

SEQ ID NO: 1380703 - protein, 17 aa, Mycobacterium tuberculosis
ADVRMVLKSAAKLKRLA

SEQ ID NO: 1380704 - protein, 26 aa, Mycobacterium tuberculosis
ADWLCVVGARRCCRRADHRDARLATA

SEQ ID NO: 1380705 - protein, 19 aa, Mycobacterium tuberculosis
ADYAAKALGGWAGFSVGWL

SEQ ID NO: 1380706 - protein, 22 aa, Mycobacterium tuberculosis
AEGLLPAITFVFSRAGCDAAVT

SEQ ID NO: 1380707 - protein, 17 aa, Mycobacterium tuberculosis
AELARLAGRLDDATAQR

SEQ ID NO: 1380708 - protein, 25 aa, Mycobacterium tuberculosis
AELFVAAYVPYVAWLVQASADSAAA

SEQ ID NO: 1380709 - protein, 24 aa, Mycobacterium tuberculosis
AELFVAAYVPYVAWLVQASSDSAA

SEQ ID NO: 1380710 - protein, 20 aa, Mycobacterium tuberculosis
AELIPARAPHSAEIRNTDVL

SEQ ID NO: 1380711 - protein, 19 aa, Mycobacterium tuberculosis
AEMIPAITKYMSALDVAVL

SEQ ID NO: 1380712 - protein, 24 aa, Mycobacterium tuberculosis
AENLSCSVIKCVALTFDDGPGPYT

SEQ ID NO: 1380713 - protein, 33 aa, Mycobacterium tuberculosis
AEPEPKSPPIPWYRLPAVIITGTTVAVLLVGAA

SEQ ID NO: 1380714 - protein, 20 aa, Mycobacterium tuberculosis
AESAFRSPLWSNQNIAELGG

SEQ ID NO: 1380715 - protein, 27 aa, Mycobacterium tuberculosis
AESASAMLRRNLLIYGLGGLVVPFIGI

SEQ ID NO: 1380716 - protein, 28 aa, Mycobacterium tuberculosis
AETLLVVLCGVGFYIGFVGSYQRMATIT

SEQ ID NO: 1380717 - protein, 21 aa, Mycobacterium tuberculosis
AEVPSAAWGRSRIDHRTWHIV

SEQ ID NO: 1380718 - protein, 17 aa, Mycobacterium tuberculosis
AFAPYGLKQTAVKPSYG

SEQ ID NO: 1380719 - protein, 24 aa, Mycobacterium tuberculosis
AFAQFAILCRRYLAVIAADRQYAV

SEQ ID NO: 1380720 - protein, 19 aa, Mycobacterium tuberculosis
AFCYAAAVVTELGGPMSHA

SEQ ID NO: 1380721 - protein, 17 aa, Mycobacterium tuberculosis
AFDNGWFRTGDIGEIDD

SEQ ID NO: 1380722 - protein, 18 aa, Mycobacterium tuberculosis
AFFCSVFLMHVSAGAWVT

SEQ ID NO: 1380723 - protein, 23 aa, Mycobacterium tuberculosis
AFFNIYFCSVTIKINGPAGSDIL

SEQ ID NO: 1380724 - protein, 19 aa, Mycobacterium tuberculosis
AFGVARQADYLPILPTGLA

SEQ ID NO: 1380725 - protein, 20 aa, Mycobacterium tuberculosis
AFHNEFTQRLAAATNAFVNA

SEQ ID NO: 1380726 - protein, 23 aa, Mycobacterium tuberculosis
AFHNEFTQRLAAATNAFVNAEAT

SEQ ID NO: 1380727 - protein, 22 aa, Mycobacterium tuberculosis
AFLQRPARWMQLLAKHRAQISS

SEQ ID NO: 1380728 - protein, 24 aa, Mycobacterium tuberculosis
AFLSRPFGAAVFGYFGDRLGRKKT

SEQ ID NO: 1380729 - protein, 24 aa, Mycobacterium tuberculosis
AFPAPSWWWLAWFGLVPLLLVVRA

SEQ ID NO: 1380730 - protein, 20 aa, Mycobacterium tuberculosis
AFTAWDVFLGYELPQPPTIA

SEQ ID NO: 1380731 - protein, 17 aa, Mycobacterium tuberculosis
AFVLTFLVTRSFVRFIH

SEQ ID NO: 1380732 - protein, 24 aa, Mycobacterium tuberculosis
AGAAICLLALMATLATASRRLRPR

SEQ ID NO: 1380733 - protein, 17 aa, Mycobacterium tuberculosis
AGALGLTVQVLWGQLTA

SEQ ID NO: 1380734 - protein, 26 aa, Mycobacterium tuberculosis
AGAMYCLGFTRLPYFNTLASPCAIGL

SEQ ID NO: 1380735 - protein, 18 aa, Mycobacterium tuberculosis
AGAVALAVIAALAVLVTV

SEQ ID NO: 1380736 - protein, 17 aa, Mycobacterium tuberculosis
AGAVGTLAAGSWQSAQY

SEQ ID NO: 1380737 - protein, 18 aa, Mycobacterium tuberculosis
AGCAYLLRRLFRGPRAPY

SEQ ID NO: 1380738 - protein, 20 aa, Mycobacterium tuberculosis
AGCAYLLRRLFRGPRAPYLR

SEQ ID NO: 1380739 - protein, 17 aa, Mycobacterium tuberculosis
AGCRSRPSPRCTDRTAR

SEQ ID NO: 1380740 - protein, 22 aa, Mycobacterium tuberculosis
AGDVRLLLPMPADWSYAEAAAI

SEQ ID NO: 1380741 - protein, 17 aa, Mycobacterium tuberculosis
AGEGRLIRALTTAPVPI

SEQ ID NO: 1380742 - protein, 19 aa, Mycobacterium tuberculosis
AGFAHPLCVLFPGRADVHV

SEQ ID NO: 1380743 - protein, 17 aa, Mycobacterium tuberculosis
AGFALAAVLARPVGGWL

SEQ ID NO: 1380744 - protein, 23 aa, Mycobacterium tuberculosis
AGFALGVAMLLGGTWLTCVLAAV

SEQ ID NO: 1380745 - protein, 17 aa, Mycobacterium tuberculosis
AGFRRAAVVTALMTAVI

SEQ ID NO: 1380746 - protein, 17 aa, Mycobacterium tuberculosis
AGFTIGIGIVLDTFLVR

SEQ ID NO: 1380747 - protein, 21 aa, Mycobacterium tuberculosis
AGGCRRPVWVTLIGNLLSLGV

SEQ ID NO: 1380748 - protein, 17 aa, Mycobacterium tuberculosis
AGGGAPVGNPADLQSLL

SEQ ID NO: 1380749 - protein, 26 aa, Mycobacterium tuberculosis
AGGGFRGRRHLVLQGGRRFHLRPVPE

SEQ ID NO: 1380750 - protein, 26 aa, Mycobacterium tuberculosis
AGGGGRGMRVVHELSALPAEVEAARR

SEQ ID NO: 1380751 - protein, 34 aa, Mycobacterium tuberculosis
AGGLFDRIGNFVVRWPLIVIGCWIAVAAALTLLL

SEQ ID NO: 1380752 - protein, 23 aa, Mycobacterium tuberculosis
AGGLGIALAHPWRSSGPRTSAPP

SEQ ID NO: 1380753 - protein, 20 aa, Mycobacterium tuberculosis
AGGNGGWLYGNGGPGGLGPG

SEQ ID NO: 1380754 - protein, 19 aa, Mycobacterium tuberculosis
AGHYGMCGRAYDPRFLFAW

SEQ ID NO: 1380755 - protein, 18 aa, Mycobacterium tuberculosis
AGLAARGAPRRPRLQPPR

SEQ ID NO: 1380756 - protein, 19 aa, Mycobacterium tuberculosis
AGLAFTLGMVLTSTLMVRP

SEQ ID NO: 1380757 - protein, 20 aa, Mycobacterium tuberculosis
AGLFAVGIVIGRKTNTTATE

SEQ ID NO: 1380758 - protein, 20 aa, Mycobacterium tuberculosis
AGLGAVVFYLALKYTSEFLL

SEQ ID NO: 1380759 - protein, 19 aa, Mycobacterium tuberculosis
AGLGGRFGLPVPAADAARQ

SEQ ID NO: 1380760 - protein, 20 aa, Mycobacterium tuberculosis
AGLLIGRAIIRSNYYVADYA

SEQ ID NO: 1380761 - protein, 17 aa, Mycobacterium tuberculosis
AGLPEGLSTVLIGGAQA

SEQ ID NO: 1380762 - protein, 18 aa, Mycobacterium tuberculosis
AGLPEGLSTVLIGGAQAV

SEQ ID NO: 1380763 - protein, 31 aa, Mycobacterium tuberculosis
AGLVGWSLVSPRLPAPWRIPLQAGLGSVLVL

SEQ ID NO: 1380764 - protein, 19 aa, Mycobacterium tuberculosis
AGLWRWLQRHPPPALHRLT

SEQ ID NO: 1380765 - protein, 28 aa, Mycobacterium tuberculosis
AGPGQFWPRRSRLPWWDCSHYRATGPAI

SEQ ID NO: 1380766 - protein, 23 aa, Mycobacterium tuberculosis
AGRARCCACPGANPGPDHHSPVP

SEQ ID NO: 1380767 - protein, 25 aa, Mycobacterium tuberculosis
AGRRFSRARLNPEVLLIETDHDMRN

SEQ ID NO: 1380768 - protein, 20 aa, Mycobacterium tuberculosis
AGRRKALAFIEGRSVAELVA

SEQ ID NO: 1380769 - protein, 22 aa, Mycobacterium tuberculosis
AGRVCAAVALVAFVILVQPTAS

SEQ ID NO: 1380770 - protein, 29 aa, Mycobacterium tuberculosis
AGSGHRCPWCSPLGWSLQVRPYAGERWWV

SEQ ID NO: 1380771 - protein, 17 aa, Mycobacterium tuberculosis
AGTALVARGEFSLIIIG

SEQ ID NO: 1380772 - protein, 17 aa, Mycobacterium tuberculosis
AGVAFGTFLMRNHFLSL

SEQ ID NO: 1380773 - protein, 23 aa, Mycobacterium tuberculosis
AGVGVDWRAAFADLGGRRVELPT

SEQ ID NO: 1380774 - protein, 19 aa, Mycobacterium tuberculosis
AGVILLFAGLAGRGVPALA

SEQ ID NO: 1380775 - protein, 19 aa, Mycobacterium tuberculosis
AGVLGALAGVLAKRQHQTR

SEQ ID NO: 1380776 - protein, 24 aa, Mycobacterium tuberculosis
AGVPVGVATCWEVIFDRAPRKSIL

SEQ ID NO: 1380777 - protein, 27 aa, Mycobacterium tuberculosis
AGVTGRASVAVAVGFVVGELAALVMFS

SEQ ID NO: 1380778 - protein, 17 aa, Mycobacterium tuberculosis
AGVWAFGALVDPLEPQA

SEQ ID NO: 1380779 - protein, 25 aa, Mycobacterium tuberculosis
AGWRVVELDVSYGPRTGGKSKVSGS

SEQ ID NO: 1380780 - protein, 17 aa, Mycobacterium tuberculosis
AGWSLDRINGAYEAILN

SEQ ID NO: 1380781 - protein, 17 aa, Mycobacterium tuberculosis
AGYWVRRHLHHCEDTPA

SEQ ID NO: 1380782 - protein, 32 aa, Mycobacterium tuberculosis
AHCHAGRGLSRCAERLDRSRFCDSSRPGQAHR

SEQ ID NO: 1380783 - protein, 17 aa, Mycobacterium tuberculosis
AHLNMCDRLLILAPGGR

SEQ ID NO: 1380784 - protein, 17 aa, Mycobacterium tuberculosis
AHLRARHDPVLEAFTAV

SEQ ID NO: 1380785 - protein, 21 aa, Mycobacterium tuberculosis
AHQGLTWAAGLLYPAFCIGAI

SEQ ID NO: 1380786 - protein, 21 aa, Mycobacterium tuberculosis
AHRHSVGYARRSRQLRRATAV

SEQ ID NO: 1380787 - protein, 17 aa, Mycobacterium tuberculosis
AHRLIELALRGGGPDNV

SEQ ID NO: 1380788 - protein, 32 aa, Mycobacterium tuberculosis
AHRPSSRAPVMWALSASLGWILPVIAQLVWWA

SEQ ID NO: 1380789 - protein, 17 aa, Mycobacterium tuberculosis
AHSWYRTEHPLIDMRLF

SEQ ID NO: 1380790 - protein, 17 aa, Mycobacterium tuberculosis
AHVAGGLLLKVGSSGVV

SEQ ID NO: 1380791 - protein, 18 aa, Mycobacterium tuberculosis
AHVAGGLLLKVGSSGVVF

SEQ ID NO: 1380792 - protein, 18 aa, Mycobacterium tuberculosis
AHVVKLLNRFFAIVVNEV

SEQ ID NO: 1380793 - protein, 24 aa, Mycobacterium tuberculosis
AIAFLIFAVWVWREDTASDSETSP

SEQ ID NO: 1380794 - protein, 23 aa, Mycobacterium tuberculosis
AIAFLPIVLAPAVIPPASTPLAA

SEQ ID NO: 1380795 - protein, 19 aa, Mycobacterium tuberculosis
AIAGILLKMCWPAAPRSVG

SEQ ID NO: 1380796 - protein, 24 aa, Mycobacterium tuberculosis
AIATACPFCRVMVTDGVNDRQEEA

SEQ ID NO: 1380797 - protein, 22 aa, Mycobacterium tuberculosis
AIAVAAAWTFLKILGPILRGIA

SEQ ID NO: 1380798 - protein, 24 aa, Mycobacterium tuberculosis
AIAVAKRGATVFALARNGNALDEL

SEQ ID NO: 1380799 - protein, 27 aa, Mycobacterium tuberculosis
AIAVTAAWTFLKILGPILRGIADAAVS

SEQ ID NO: 1380800 - protein, 25 aa, Mycobacterium tuberculosis
AIAVWCVTAIIGAFAARRWYRKWRA

SEQ ID NO: 1380801 - protein, 17 aa, Mycobacterium tuberculosis
AIGMRIAPFVLPLAVTI

SEQ ID NO: 1380802 - protein, 26 aa, Mycobacterium tuberculosis
AIGPDWRLVLCGGPAEVVLDRATLAG

SEQ ID NO: 1380803 - protein, 24 aa, Mycobacterium tuberculosis
AIGPDWRLVLRGGPAEVVLDRATL

SEQ ID NO: 1380804 - protein, 19 aa, Mycobacterium tuberculosis
AIHRAWRPTASSDLSVLVR

SEQ ID NO: 1380805 - protein, 17 aa, Mycobacterium tuberculosis
AILGFALLWLTATAIWL

SEQ ID NO: 1380806 - protein, 19 aa, Mycobacterium tuberculosis
AILGIGDWGVGGIQIAVGK

SEQ ID NO: 1380807 - protein, 18 aa, Mycobacterium tuberculosis
AILMLYTIVIIRGLRTAI

SEQ ID NO: 1380808 - protein, 19 aa, Mycobacterium tuberculosis
AIQVLRIRYILTSTPTVRG

SEQ ID NO: 1380809 - protein, 17 aa, Mycobacterium tuberculosis
AIRDAVLVLAAIATAIV

SEQ ID NO: 1380810 - protein, 23 aa, Mycobacterium tuberculosis
AIRVTPKFTRMVVAALFGVLVLM

SEQ ID NO: 1380811 - protein, 29 aa, Mycobacterium tuberculosis
AISAMLIYRLISWLLIAAIGWVVFFFMFR

SEQ ID NO: 1380812 - protein, 25 aa, Mycobacterium tuberculosis
AISGWRAGALGSMLSFGGVLLGATA

SEQ ID NO: 1380813 - protein, 22 aa, Mycobacterium tuberculosis
AISRGVLHYCERLATHDTALRA

SEQ ID NO: 1380814 - protein, 21 aa, Mycobacterium tuberculosis
AITGGVGWWYILVATGFVVFA

SEQ ID NO: 1380815 - protein, 23 aa, Mycobacterium tuberculosis
AIVPLLHRFGGLVAPLTFIGTAY

SEQ ID NO: 1380816 - protein, 29 aa, Mycobacterium tuberculosis
AIVVLGWYYLRIPSLVGIGQYTLKADLPA

SEQ ID NO: 1380817 - protein, 17 aa, Mycobacterium tuberculosis
AIWAAKRARGSPLRIMI

SEQ ID NO: 1380818 - protein, 31 aa, Mycobacterium tuberculosis
AIWAAKRARGSPLRIMILLVLVSALASALLD

SEQ ID NO: 1380819 - protein, 36 aa, Mycobacterium tuberculosis
AKAGGLFDRIGNFVVRWPLIVIGCWIAVAAALTLLL

SEQ ID NO: 1380820 - protein, 21 aa, Mycobacterium tuberculosis
AKASAWVGALVTGWWIGVLAY

SEQ ID NO: 1380821 - protein, 17 aa, Mycobacterium tuberculosis
AKDVPVKPGRGMVAVNY

SEQ ID NO: 1380822 - protein, 21 aa, Mycobacterium tuberculosis
AKGGIVFRVQQELGVPVKLVG

SEQ ID NO: 1380823 - protein, 19 aa, Mycobacterium tuberculosis
AKLAADMQVFARVSPEQRF

SEQ ID NO: 1380824 - protein, 20 aa, Mycobacterium tuberculosis
AKLIIWYPHYAWLLLSVYLT

SEQ ID NO: 1380825 - protein, 17 aa, Mycobacterium tuberculosis
AKLRLFRVPELLAGSFL

SEQ ID NO: 1380826 - protein, 18 aa, Mycobacterium tuberculosis
AKLRLFRVPELLAGSFLL

SEQ ID NO: 1380827 - protein, 18 aa, Mycobacterium tuberculosis
AKLYPLLFLYPLLLLGIR

SEQ ID NO: 1380828 - protein, 19 aa, Mycobacterium tuberculosis
AKTPKAAFRIAFAGPATSL

SEQ ID NO: 1380829 - protein, 23 aa, Mycobacterium tuberculosis
AKTRRRAAPRIKSVEAGSNHAAD

SEQ ID NO: 1380830 - protein, 18 aa, Mycobacterium tuberculosis
ALAGLLIVIGAQLVKLAH

SEQ ID NO: 1380831 - protein, 19 aa, Mycobacterium tuberculosis
ALAYFFGPVVVFWVLAGMA

SEQ ID NO: 1380832 - protein, 19 aa, Mycobacterium tuberculosis
ALEYLKITYGWSLLLIVTF

SEQ ID NO: 1380833 - protein, 29 aa, Mycobacterium tuberculosis
ALFGEAPQRAWLWLGWLSAATVAGWVLDA

SEQ ID NO: 1380834 - protein, 25 aa, Mycobacterium tuberculosis
ALGEGCCFRVSLPRVSDVDQLSLTP

SEQ ID NO: 1380835 - protein, 23 aa, Mycobacterium tuberculosis
ALGERLRVLDGWRERGHGDFRDI

SEQ ID NO: 1380836 - protein, 17 aa, Mycobacterium tuberculosis
ALKKAVMLLGVLAVLVA

SEQ ID NO: 1380837 - protein, 21 aa, Mycobacterium tuberculosis
ALLACGWAFLIWGMYAYLWAF

SEQ ID NO: 1380838 - protein, 17 aa, Mycobacterium tuberculosis
ALLDGFLTFFVVAAFGA

SEQ ID NO: 1380839 - protein, 23 aa, Mycobacterium tuberculosis
ALLDGFLTFFVVAAFGALIVDRD

SEQ ID NO: 1380840 - protein, 19 aa, Mycobacterium tuberculosis
ALLGRPLIGDGADGTAPGQ

SEQ ID NO: 1380841 - protein, 22 aa, Mycobacterium tuberculosis
ALLLIFLFWPWEFKAADGESDF

SEQ ID NO: 1380842 - protein, 19 aa, Mycobacterium tuberculosis
ALLSAIGIAGMDRLVQHNA

SEQ ID NO: 1380843 - protein, 25 aa, Mycobacterium tuberculosis
ALLYLLPLILRLWRGDTTHDRHAAA

SEQ ID NO: 1380844 - protein, 26 aa, Mycobacterium tuberculosis
ALMDRWDRRWVLVGANTGRLALIAGV

SEQ ID NO: 1380845 - protein, 25 aa, Mycobacterium tuberculosis
ALMWQWREHRGPQMVAGLSIGLTTA

SEQ ID NO: 1380846 - protein, 18 aa, Mycobacterium tuberculosis
ALNVVKFGGAAFLIGYGL

SEQ ID NO: 1380847 - protein, 20 aa, Mycobacterium tuberculosis
ALPSRVFAWLALVFGVGFSM

SEQ ID NO: 1380848 - protein, 25 aa, Mycobacterium tuberculosis
ALPTGCILAWILVRIINVRSFGWTL

SEQ ID NO: 1380849 - protein, 18 aa, Mycobacterium tuberculosis
ALRPEARLVSAVAPAPAG

SEQ ID NO: 1380850 - protein, 21 aa, Mycobacterium tuberculosis
ALRRRCLYHWIDYPEPDRAAA

SEQ ID NO: 1380851 - protein, 42 aa, Mycobacterium tuberculosis
ALRSSSRLSRWREWAAPLWVGCNFSAWMRLLIRNRFAVHHSR

SEQ ID NO: 1380852 - protein, 25 aa, Mycobacterium tuberculosis
ALSAFFTPQFVRWFGLFTTHAIVAA

SEQ ID NO: 1380853 - protein, 26 aa, Mycobacterium tuberculosis
ALSAFFTPQFVRWFGLFTTHAIVAAA

SEQ ID NO: 1380854 - protein, 23 aa, Mycobacterium tuberculosis
ALSDRFGRRPVLLASLLGATIDY

SEQ ID NO: 1380855 - protein, 18 aa, Mycobacterium tuberculosis
ALSLPPLLLGMLGSLAYV

SEQ ID NO: 1380856 - protein, 18 aa, Mycobacterium tuberculosis
ALSWAWGWLPLDAGSGIN

SEQ ID NO: 1380857 - protein, 24 aa, Mycobacterium tuberculosis
ALTAMIGRANWWPSELGRDPSTPP

SEQ ID NO: 1380858 - protein, 26 aa, Mycobacterium tuberculosis
ALTLWLHVIDARFARALRLRLLSKLS

SEQ ID NO: 1380859 - protein, 18 aa, Mycobacterium tuberculosis
ALVAFSIFLNRAHTSRTR

SEQ ID NO: 1380860 - protein, 18 aa, Mycobacterium tuberculosis
ALVFRLVLFLAPTLNGWF

SEQ ID NO: 1380861 - protein, 22 aa, Mycobacterium tuberculosis
ALVGGLAWPFLLLPQLGMIRGA

SEQ ID NO: 1380862 - protein, 23 aa, Mycobacterium tuberculosis
ALVGVLCCIGSIVGIVFGAIAIN

SEQ ID NO: 1380863 - protein, 19 aa, Mycobacterium tuberculosis
ALVRLRDAAEAVGFYRGER

SEQ ID NO: 1380864 - protein, 17 aa, Mycobacterium tuberculosis
ALVTKFLAGAWIAIVAM

SEQ ID NO: 1380865 - protein, 22 aa, Mycobacterium tuberculosis
AMGAIRLNGLHFFTATEWNPGN

SEQ ID NO: 1380866 - protein, 18 aa, Mycobacterium tuberculosis
AMGVGRRRCWPGGRPGMR

SEQ ID NO: 1380867 - protein, 22 aa, Mycobacterium tuberculosis
AMLRSLFRVGLDPRNVAVIGKC

SEQ ID NO: 1380868 - protein, 20 aa, Mycobacterium tuberculosis
AMLVAAAWLALLGLPLLLVA

SEQ ID NO: 1380869 - protein, 20 aa, Mycobacterium tuberculosis
AMNRFKRDYLAAYISASSDP

SEQ ID NO: 1380870 - protein, 24 aa, Mycobacterium tuberculosis
AMSQSMLLPAFVALFGIVAALFLV

SEQ ID NO: 1380871 - protein, 17 aa, Mycobacterium tuberculosis
ANAERWNLPIILMVLVA

SEQ ID NO: 1380872 - protein, 21 aa, Mycobacterium tuberculosis
ANALCALGRANGIYCAVVHNR

SEQ ID NO: 1380873 - protein, 23 aa, Mycobacterium tuberculosis
ANCGWPWPWLILRLVMSMCSRTG

SEQ ID NO: 1380874 - protein, 21 aa, Mycobacterium tuberculosis
ANEALYDWNYQRQLLSIRLAE

SEQ ID NO: 1380875 - protein, 18 aa, Mycobacterium tuberculosis
ANLACVVCAIGLGSVAGL

SEQ ID NO: 1380876 - protein, 23 aa, Mycobacterium tuberculosis
ANLEGVFDMLKRYHAGVEQMWCF

SEQ ID NO: 1380877 - protein, 21 aa, Mycobacterium tuberculosis
ANTYSRLALGIGIHDITAGYR

SEQ ID NO: 1380878 - protein, 26 aa, Mycobacterium tuberculosis
APADSACAPAAAGVPVVIPVVNDWPN

SEQ ID NO: 1380879 - protein, 24 aa, Mycobacterium tuberculosis
APAGPPSRCPRGYSPGWSLVFGVG

SEQ ID NO: 1380880 - protein, 18 aa, Mycobacterium tuberculosis
APAMYRIVRELATSAHQP

SEQ ID NO: 1380881 - protein, 18 aa, Mycobacterium tuberculosis
APARLPLWACGAAELTVR

SEQ ID NO: 1380882 - protein, 17 aa, Mycobacterium tuberculosis
APASMRAGMAIAAGPCL

SEQ ID NO: 1380883 - protein, 24 aa, Mycobacterium tuberculosis
APATRWCAACAAELSVAAGEPHVV

SEQ ID NO: 1380884 - protein, 18 aa, Mycobacterium tuberculosis
APATVVFDHVTFGYRPGV

SEQ ID NO: 1380885 - protein, 18 aa, Mycobacterium tuberculosis
APDAICVTDPLAFTGCGC

SEQ ID NO: 1380886 - protein, 18 aa, Mycobacterium tuberculosis
APERVSVTFVDRLPGWNV

SEQ ID NO: 1380887 - protein, 17 aa, Mycobacterium tuberculosis
APFDWYTSVLAQLAAVS

SEQ ID NO: 1380888 - protein, 34 aa, Mycobacterium tuberculosis
APGAACRWPSWRCWRACRRRARHGLHRCSAAGRS

SEQ ID NO: 1380889 - protein, 17 aa, Mycobacterium tuberculosis
APGGAVWGEHHTGCRSG

SEQ ID NO: 1380890 - protein, 18 aa, Mycobacterium tuberculosis
APGPARCDSHAAAVTGAL

SEQ ID NO: 1380891 - protein, 19 aa, Mycobacterium tuberculosis
APGPARCDSHAAAVTGALS

SEQ ID NO: 1380892 - protein, 19 aa, Mycobacterium tuberculosis
APGRPRGAGGILWGNGGAG

SEQ ID NO: 1380893 - protein, 17 aa, Mycobacterium tuberculosis
APIGSRLVAAVRPAPVS

SEQ ID NO: 1380894 - protein, 17 aa, Mycobacterium tuberculosis
APIIVGCGAVLTSPVAF

SEQ ID NO: 1380895 - protein, 21 aa, Mycobacterium tuberculosis
APLLRARGTFFAHADQLSIHR

SEQ ID NO: 1380896 - protein, 19 aa, Mycobacterium tuberculosis
APLNWCNPSGRALGAPPTT

SEQ ID NO: 1380897 - protein, 19 aa, Mycobacterium tuberculosis
APLTYAWLVVLVITTIIQN

SEQ ID NO: 1380898 - protein, 20 aa, Mycobacterium tuberculosis
APLVVGCILLAGLVGMCSFQ

SEQ ID NO: 1380899 - protein, 17 aa, Mycobacterium tuberculosis
APPDVIRAIEAQVWDGG

SEQ ID NO: 1380900 - protein, 24 aa, Mycobacterium tuberculosis
APPSRVFAWLALVFGVGFSMLALL

SEQ ID NO: 1380901 - protein, 26 aa, Mycobacterium tuberculosis
APPVRRLPARFGVEQVRELASRDTRQ

SEQ ID NO: 1380902 - protein, 17 aa, Mycobacterium tuberculosis
APPYRADSVERLIAAHL

SEQ ID NO: 1380903 - protein, 22 aa, Mycobacterium tuberculosis
APQPGPGRWWWFPRPAPSGPTR

SEQ ID NO: 1380904 - protein, 28 aa, Mycobacterium tuberculosis
APQQSWRKRLPAIFVDVALFALIGIGLA

SEQ ID NO: 1380905 - protein, 28 aa, Mycobacterium tuberculosis
APQSIEPSRRWGLPLALTASAVVMAAAI

SEQ ID NO: 1380906 - protein, 17 aa, Mycobacterium tuberculosis
APRRPRLQPPRPEPAEP

SEQ ID NO: 1380907 - protein, 18 aa, Mycobacterium tuberculosis
APSCMRIDYELITQNHRA

SEQ ID NO: 1380908 - protein, 29 aa, Mycobacterium tuberculosis
APSRIRQPRCCPIRLVGPPSRSAAMKAAP

SEQ ID NO: 1380909 - protein, 25 aa, Mycobacterium tuberculosis
APSSGIGIVEGWRGTIVHRVEIDVD

SEQ ID NO: 1380910 - protein, 20 aa, Mycobacterium tuberculosis
APTAHCGRWTAPPCCVLPKC

SEQ ID NO: 1380911 - protein, 31 aa, Mycobacterium tuberculosis
APTQLWLDYSLIVYFVFVFPLSVLLTTVNFF

SEQ ID NO: 1380912 - protein, 17 aa, Mycobacterium tuberculosis
APVPLPWMAVLIANDRP

SEQ ID NO: 1380913 - protein, 23 aa, Mycobacterium tuberculosis
APYHLRLDWLMWFAAISPGYALT

SEQ ID NO: 1380914 - protein, 20 aa, Mycobacterium tuberculosis
APYNVRRRPPPVVEPGPDRR

SEQ ID NO: 1380915 - protein, 22 aa, Mycobacterium tuberculosis
AQARLAALSILVGAVGATGPGV

SEQ ID NO: 1380916 - protein, 31 aa, Mycobacterium tuberculosis
AQDLRVGSMFGPYHLKRLLGRGGMGEVYEAE

SEQ ID NO: 1380917 - protein, 22 aa, Mycobacterium tuberculosis
AQEARRRRFLGRGHARGQACAH

SEQ ID NO: 1380918 - protein, 21 aa, Mycobacterium tuberculosis
AQLDGWRYGWVLNIGAAITGG

SEQ ID NO: 1380919 - protein, 25 aa, Mycobacterium tuberculosis
AQLISDITVAVWTTLWMLVGLAVHD

SEQ ID NO: 1380920 - protein, 22 aa, Mycobacterium tuberculosis
AQLRVARLNAHFGPLLQTLPAL

SEQ ID NO: 1380921 - protein, 29 aa, Mycobacterium tuberculosis
AQRWGRYPIRARVAVVARGGLLMGAGTVD

SEQ ID NO: 1380922 - protein, 30 aa, Mycobacterium tuberculosis
AQRWGRYPIRARVAVVARGGLLMGAGTVDA

SEQ ID NO: 1380923 - protein, 19 aa, Mycobacterium tuberculosis
ARAAAPLSEAMRVVGVNWL

SEQ ID NO: 1380924 - protein, 22 aa, Mycobacterium tuberculosis
ARADLGMAIGRGADVAIGAADI

SEQ ID NO: 1380925 - protein, 27 aa, Mycobacterium tuberculosis
ARAQAGALPALFSGLARRPRRRQIDDT

SEQ ID NO: 1380926 - protein, 18 aa, Mycobacterium tuberculosis
ARCGPARRPTLRLRVRWE

SEQ ID NO: 1380927 - protein, 20 aa, Mycobacterium tuberculosis
ARCWLRWERPDWWSESSPAS

SEQ ID NO: 1380928 - protein, 17 aa, Mycobacterium tuberculosis
AREIVIIGIGAVSREEV

SEQ ID NO: 1380929 - protein, 26 aa, Mycobacterium tuberculosis
ARFALGVAEGGFFPGVIAYLTVCFRA

SEQ ID NO: 1380930 - protein, 19 aa, Mycobacterium tuberculosis
ARGAPRYRPVGCGGSDRGW

SEQ ID NO: 1380931 - protein, 17 aa, Mycobacterium tuberculosis
ARGGIKTNWVISMPPGQ

SEQ ID NO: 1380932 - protein, 33 aa, Mycobacterium tuberculosis
ARGGKTRARRSRGRRLAITVGVAAALFVGSAAF

SEQ ID NO: 1380933 - protein, 21 aa, Mycobacterium tuberculosis
ARGKLTPRERIELLVDPDSPF

SEQ ID NO: 1380934 - protein, 20 aa, Mycobacterium tuberculosis
ARGLGFPALHSIDSTVPPLV

SEQ ID NO: 1380935 - protein, 34 aa, Mycobacterium tuberculosis
ARIKYKVGPTIAWYQDFLRYYFLTVESNVEGSMS

SEQ ID NO: 1380936 - protein, 18 aa, Mycobacterium tuberculosis
ARIMPAYVVAVVVILSLL

SEQ ID NO: 1380937 - protein, 20 aa, Mycobacterium tuberculosis
ARIREAIRLSGPDIYGDPEP

SEQ ID NO: 1380938 - protein, 22 aa, Mycobacterium tuberculosis
ARIRELERPLADVARASELGGS

SEQ ID NO: 1380939 - protein, 23 aa, Mycobacterium tuberculosis
ARIRELERPLADVARASELGGSQ

SEQ ID NO: 1380940 - protein, 19 aa, Mycobacterium tuberculosis
ARKITWGELEKGRRRYLRD

SEQ ID NO: 1380941 - protein, 26 aa, Mycobacterium tuberculosis
ARLDSLFRLDHLVARLRRNSANLLVL

SEQ ID NO: 1380942 - protein, 24 aa, Mycobacterium tuberculosis
ARLGPARTAGICAISPALFTSFTG

SEQ ID NO: 1380943 - protein, 25 aa, Mycobacterium tuberculosis
ARLISSLCGLLCTFTVSRVIVGRRP

SEQ ID NO: 1380944 - protein, 25 aa, Mycobacterium tuberculosis
ARLLKRGGPAAGHRWGYLPPEGQGD

SEQ ID NO: 1380945 - protein, 17 aa, Mycobacterium tuberculosis
ARLPLACVEGWSAVRTW

SEQ ID NO: 1380946 - protein, 17 aa, Mycobacterium tuberculosis
ARLPREVAVGAVLTYVR

SEQ ID NO: 1380947 - protein, 17 aa, Mycobacterium tuberculosis
ARMAFDYAARSQLWLSL

SEQ ID NO: 1380948 - protein, 29 aa, Mycobacterium tuberculosis
ARPAVAAVRRGACRLTRAPAFGVAAIAPL

SEQ ID NO: 1380949 - protein, 21 aa, Mycobacterium tuberculosis
ARPDTAPALALAARSSASFPL

SEQ ID NO: 1380950 - protein, 21 aa, Mycobacterium tuberculosis
ARPGDLLYGLHAMMFNRSRVS

SEQ ID NO: 1380951 - protein, 26 aa, Mycobacterium tuberculosis
ARPGTVWWRVTLPLLLPGVVSGSVLA

SEQ ID NO: 1380952 - protein, 18 aa, Mycobacterium tuberculosis
ARPLGAWVDALLRTFIGS

SEQ ID NO: 1380953 - protein, 21 aa, Mycobacterium tuberculosis
ARPRRRCGLAQLTTGSQQRHT

SEQ ID NO: 1380954 - protein, 19 aa, Mycobacterium tuberculosis
ARPSCCVRSALATPGNWMS

SEQ ID NO: 1380955 - protein, 17 aa, Mycobacterium tuberculosis
ARQGISYVLVRNDLDPE

SEQ ID NO: 1380956 - protein, 19 aa, Mycobacterium tuberculosis
ARRLLAWVGADENVRPLDV

SEQ ID NO: 1380957 - protein, 24 aa, Mycobacterium tuberculosis
ARRQRRYWRYWAPAVLTAVAVFSP

SEQ ID NO: 1380958 - protein, 27 aa, Mycobacterium tuberculosis
ARRQRVLTITAWLAVVVTGSFALMQLA

SEQ ID NO: 1380959 - protein, 22 aa, Mycobacterium tuberculosis
ARRRFEHPAMLSADRAFAAVPA

SEQ ID NO: 1380960 - protein, 23 aa, Mycobacterium tuberculosis
ARRRFEHPAMLSADRAFAAVPAA

SEQ ID NO: 1380961 - protein, 20 aa, Mycobacterium tuberculosis
ARRRVAIALGVLVAAAGIVI

SEQ ID NO: 1380962 - protein, 26 aa, Mycobacterium tuberculosis
ARRSRGRRLAITVGVAAALFVGSAAF

SEQ ID NO: 1380963 - protein, 23 aa, Mycobacterium tuberculosis
ARRTRPELARMLLLGTLIGLVWE

SEQ ID NO: 1380964 - protein, 18 aa, Mycobacterium tuberculosis
ARSGIRTAELVAIVSVGG

SEQ ID NO: 1380965 - protein, 19 aa, Mycobacterium tuberculosis
ARSRGRLVRSLRPLILLPL

SEQ ID NO: 1380966 - protein, 23 aa, Mycobacterium tuberculosis
ARVLTKPRFRGWIHVYSAGTAVL

SEQ ID NO: 1380967 - protein, 23 aa, Mycobacterium tuberculosis
ARVPQRFVPDLTKYQYWNGDSNS

SEQ ID NO: 1380968 - protein, 23 aa, Mycobacterium tuberculosis
ARYPASGGTYVYGRMRLGDFWGY

SEQ ID NO: 1380969 - protein, 25 aa, Mycobacterium tuberculosis
ASALFPAAVGVLWQSGLRDPTPPGG

SEQ ID NO: 1380970 - protein, 24 aa, Mycobacterium tuberculosis
ASANTGWWPLIWFTAKVWGFLFIY

SEQ ID NO: 1380971 - protein, 19 aa, Mycobacterium tuberculosis
ASARAKVANREWVARSARN

SEQ ID NO: 1380972 - protein, 23 aa, Mycobacterium tuberculosis
ASARRLSHFGALVRIPRSVEALG

SEQ ID NO: 1380973 - protein, 24 aa, Mycobacterium tuberculosis
ASASTWNGLAWIVGAALYLVCLPA

SEQ ID NO: 1380974 - protein, 23 aa, Mycobacterium tuberculosis
ASAWWFDMAIDAVNPCNALWPAK

SEQ ID NO: 1380975 - protein, 24 aa, Mycobacterium tuberculosis
ASAWWFDMAMLVALSVIYVGFVRW

SEQ ID NO: 1380976 - protein, 24 aa, Mycobacterium tuberculosis
ASDPEGWIRCQLDGVPTEQSLRFT

SEQ ID NO: 1380977 - protein, 25 aa, Mycobacterium tuberculosis
ASEEERARWSLGRHVKLRGHDQPVR

SEQ ID NO: 1380978 - protein, 17 aa, Mycobacterium tuberculosis
ASEMPECQAGIGVAAGQ

SEQ ID NO: 1380979 - protein, 21 aa, Mycobacterium tuberculosis
ASGNFSWLNWLTILLACSAID

SEQ ID NO: 1380980 - protein, 19 aa, Mycobacterium tuberculosis
ASGPAWRLIGTTAVGLLLL

SEQ ID NO: 1380981 - protein, 20 aa, Mycobacterium tuberculosis
ASGRMRVCVTGFNVDAVRAV

SEQ ID NO: 1380982 - protein, 17 aa, Mycobacterium tuberculosis
ASIWRWRCSSPCRDSCC

SEQ ID NO: 1380983 - protein, 17 aa, Mycobacterium tuberculosis
ASLILAVLAFRHFGDAV

SEQ ID NO: 1380984 - protein, 20 aa, Mycobacterium tuberculosis
ASLLAGRAVNKWGPQLPVLT

SEQ ID NO: 1380985 - protein, 26 aa, Mycobacterium tuberculosis
ASLVAAWAYPLWPVVLGLKALALAVG

SEQ ID NO: 1380986 - protein, 18 aa, Mycobacterium tuberculosis
ASPQSYRGAPLAELAPLL

SEQ ID NO: 1380987 - protein, 27 aa, Mycobacterium tuberculosis
ASPTRRRPRRILVGAVAVLLLAGLFAV

SEQ ID NO: 1380988 - protein, 21 aa, Mycobacterium tuberculosis
ASQWRRLGGTFPTNSQLTNES

SEQ ID NO: 1380989 - protein, 25 aa, Mycobacterium tuberculosis
ASRTLPELWSLLGHIDAVHGLYYLL

SEQ ID NO: 1380990 - protein, 17 aa, Mycobacterium tuberculosis
ASSDLSVLVRTMCSRPA

SEQ ID NO: 1380991 - protein, 18 aa, Mycobacterium tuberculosis
ASSGFPYWSGRTFWVSSC

SEQ ID NO: 1380992 - protein, 28 aa, Mycobacterium tuberculosis
ASSGPAKARRPVRCWSSPTSWRAHWPRS

SEQ ID NO: 1380993 - protein, 28 aa, Mycobacterium tuberculosis
ASSGPCWPDDLWRGSRRLRHTAVASWND

SEQ ID NO: 1380994 - protein, 29 aa, Mycobacterium tuberculosis
ASSQFSVRLLRTFLRDVPNQVVLAIFACT

SEQ ID NO: 1380995 - protein, 17 aa, Mycobacterium tuberculosis
ASVQLLALISVSVVAAS

SEQ ID NO: 1380996 - protein, 30 aa, Mycobacterium tuberculosis
ASVSPLIRWIIKVPREFINDYLFNFPDTNF

SEQ ID NO: 1380997 - protein, 25 aa, Mycobacterium tuberculosis
ATAGAARPGLARAHRRKRSESGVGI

SEQ ID NO: 1380998 - protein, 17 aa, Mycobacterium tuberculosis
ATARPSALWNQATWWQS

SEQ ID NO: 1380999 - protein, 25 aa, Mycobacterium tuberculosis
ATARRRPLLVAVSWAIFALVLAVVI

SEQ ID NO: 1381000 - protein, 25 aa, Mycobacterium tuberculosis
ATFCLSFTRLPYFQTLGVPLAIGMV

SEQ ID NO: 1381001 - protein, 26 aa, Mycobacterium tuberculosis
ATFCLSFTRLPYFQTLGVPLAIGMVI

SEQ ID NO: 1381002 - protein, 23 aa, Mycobacterium tuberculosis
ATGIAGWMFGWLADRSGSLAAPL

SEQ ID NO: 1381003 - protein, 18 aa, Mycobacterium tuberculosis
ATIGFGWTLLVLLATFVL

SEQ ID NO: 1381004 - protein, 18 aa, Mycobacterium tuberculosis
ATIMVCFHLGILTAVPMG

SEQ ID NO: 1381005 - protein, 19 aa, Mycobacterium tuberculosis
ATIMVCFHLGILTAVPMGV

SEQ ID NO: 1381006 - protein, 20 aa, Mycobacterium tuberculosis
ATKMSGEWSKDDVLQAYLNI

SEQ ID NO: 1381007 - protein, 21 aa, Mycobacterium tuberculosis
ATKRRYRFARGLMAGLLGTMA

SEQ ID NO: 1381008 - protein, 23 aa, Mycobacterium tuberculosis
ATLADLYGRRRWYLIGVSLFTLG

SEQ ID NO: 1381009 - protein, 18 aa, Mycobacterium tuberculosis
ATLCRLPAGGDLVGLSPA

SEQ ID NO: 1381010 - protein, 19 aa, Mycobacterium tuberculosis
ATLFGLMAGLIACYKGMSV

SEQ ID NO: 1381011 - protein, 27 aa, Mycobacterium tuberculosis
ATLGLRVYLAWITRTGYTYGALATPIA

SEQ ID NO: 1381012 - protein, 18 aa, Mycobacterium tuberculosis
ATLRRFTERFAPFNLSET

SEQ ID NO: 1381013 - protein, 28 aa, Mycobacterium tuberculosis
ATMGLWPPRLWAGLRLGWAAGAAAATAI

SEQ ID NO: 1381014 - protein, 18 aa, Mycobacterium tuberculosis
ATPEGWVLVNLSTNGTFV

SEQ ID NO: 1381015 - protein, 18 aa, Mycobacterium tuberculosis
ATPPKRCSPFSHLVQHNT

SEQ ID NO: 1381016 - protein, 24 aa, Mycobacterium tuberculosis
ATPRPRALGTPALAAPAPHGALAG

SEQ ID NO: 1381017 - protein, 20 aa, Mycobacterium tuberculosis
ATRPATFLWLIAATGTLLVA

SEQ ID NO: 1381018 - protein, 28 aa, Mycobacterium tuberculosis
ATRSSALPAYWERLGVCWQLGSDHGLAI

SEQ ID NO: 1381019 - protein, 30 aa, Mycobacterium tuberculosis
ATRVRPIIRLTVEWLEVLAMIALLPAAAAL

SEQ ID NO: 1381020 - protein, 21 aa, Mycobacterium tuberculosis
ATSAFWAFGVFYLVASVLTWA

SEQ ID NO: 1381021 - protein, 24 aa, Mycobacterium tuberculosis
ATTTSRCCRWWAPRSPSTPTPACA

SEQ ID NO: 1381022 - protein, 18 aa, Mycobacterium tuberculosis
ATTTWCLWCVMSRWSPPR

SEQ ID NO: 1381023 - protein, 28 aa, Mycobacterium tuberculosis
ATVFTVAQWRWRWFRAAMCKTMAVAVIC

SEQ ID NO: 1381024 - protein, 18 aa, Mycobacterium tuberculosis
ATVIGLLTILGFSLYDTV

SEQ ID NO: 1381025 - protein, 24 aa, Mycobacterium tuberculosis
ATVSVAAWGIRLAREAERKAGESA

SEQ ID NO: 1381026 - protein, 18 aa, Mycobacterium tuberculosis
ATVVRWRLAWLSKPETWR

SEQ ID NO: 1381027 - protein, 24 aa, Mycobacterium tuberculosis
AVAAVPRRHRLFIIVSCLAVLAGV

SEQ ID NO: 1381028 - protein, 26 aa, Mycobacterium tuberculosis
AVACQVPIFLMRSSPFTALELAQTLR

SEQ ID NO: 1381029 - protein, 22 aa, Mycobacterium tuberculosis
AVADWLYWQYVTGLLDRALAAA

SEQ ID NO: 1381030 - protein, 25 aa, Mycobacterium tuberculosis
AVALVLWWRMIRFEYALLVTVATAA

SEQ ID NO: 1381031 - protein, 17 aa, Mycobacterium tuberculosis
AVCGVECMIVANDPTVK

SEQ ID NO: 1381032 - protein, 18 aa, Mycobacterium tuberculosis
AVCLGVGTGGVFAWVARR

SEQ ID NO: 1381033 - protein, 23 aa, Mycobacterium tuberculosis
AVEAPEFHSAVLTELTLIGHRGP

SEQ ID NO: 1381034 - protein, 17 aa, Mycobacterium tuberculosis
AVGAPLGLRSTVTQGIV

SEQ ID NO: 1381035 - protein, 20 aa, Mycobacterium tuberculosis
AVGGALAWLAGETVQPLAYA

SEQ ID NO: 1381036 - protein, 22 aa, Mycobacterium tuberculosis
AVGGRHRVVIIGSGFGGLNAAK

SEQ ID NO: 1381037 - protein, 18 aa, Mycobacterium tuberculosis
AVGKGRRAGFGLLSNDVI

SEQ ID NO: 1381038 - protein, 19 aa, Mycobacterium tuberculosis
AVGLRWDPYPFILLNLAFS

SEQ ID NO: 1381039 - protein, 18 aa, Mycobacterium tuberculosis
AVGLRWDPYPFILLYLAF

SEQ ID NO: 1381040 - protein, 26 aa, Mycobacterium tuberculosis
AVGQQCARRALPFVAAMAKLLVAAVA

SEQ ID NO: 1381041 - protein, 23 aa, Mycobacterium tuberculosis
AVGSWWRYRYDKFGWTTRSSQLY

SEQ ID NO: 1381042 - protein, 22 aa, Mycobacterium tuberculosis
AVHPQPPWPHLAAAALTAVAMV

SEQ ID NO: 1381043 - protein, 17 aa, Mycobacterium tuberculosis
AVIRRGVIPASWGGKLK

SEQ ID NO: 1381044 - protein, 20 aa, Mycobacterium tuberculosis
AVIVALHLVGWLTVTLLVEP

SEQ ID NO: 1381045 - protein, 24 aa, Mycobacterium tuberculosis
AVLALATPVVREWLFGTQQQPGWV

SEQ ID NO: 1381046 - protein, 23 aa, Mycobacterium tuberculosis
AVLCARGLVAQGLMSSTRPPSRG

SEQ ID NO: 1381047 - protein, 20 aa, Mycobacterium tuberculosis
AVLGFFGFYLSFVAELPAPP

SEQ ID NO: 1381048 - protein, 17 aa, Mycobacterium tuberculosis
AVLVVRCTVLVTVLAIA

SEQ ID NO: 1381049 - protein, 18 aa, Mycobacterium tuberculosis
AVPTRNALALGLTLTVIS

SEQ ID NO: 1381050 - protein, 30 aa, Mycobacterium tuberculosis
AVQTCAGLLPPLLIRHGIDVGIHRHVLSAL

SEQ ID NO: 1381051 - protein, 19 aa, Mycobacterium tuberculosis
AVRRGELLLTQGAAGSVLA

SEQ ID NO: 1381052 - protein, 17 aa, Mycobacterium tuberculosis
AVRRTVITAGRTVTFSA

SEQ ID NO: 1381053 - protein, 20 aa, Mycobacterium tuberculosis
AVSLPLLWWRFRRDDRAALT

SEQ ID NO: 1381054 - protein, 19 aa, Mycobacterium tuberculosis
AVSRTHWLASHLAMALAGS

SEQ ID NO: 1381055 - protein, 19 aa, Mycobacterium tuberculosis
AVTAGMMWSHIIAGAVVAV

SEQ ID NO: 1381056 - protein, 29 aa, Mycobacterium tuberculosis
AVTLCARVPEAWAALDAVRARIRSRRLKT

SEQ ID NO: 1381057 - protein, 19 aa, Mycobacterium tuberculosis
AVTVPELGTFLAECPPMAV

SEQ ID NO: 1381058 - protein, 18 aa, Mycobacterium tuberculosis
AVVCAAVALVAFVILVQP

SEQ ID NO: 1381059 - protein, 21 aa, Mycobacterium tuberculosis
AVVCAAVALVAFVILVQPTAS

SEQ ID NO: 1381060 - protein, 24 aa, Mycobacterium tuberculosis
AVVCVLTLTIARPVRTYFAQRAEM

SEQ ID NO: 1381061 - protein, 18 aa, Mycobacterium tuberculosis
AVVFALAATIGFGWTLLV

SEQ ID NO: 1381062 - protein, 23 aa, Mycobacterium tuberculosis
AVVLACTLVGFAVAVLGDPVMLR

SEQ ID NO: 1381063 - protein, 19 aa, Mycobacterium tuberculosis
AWAAAIGLMVPIGLAPPAM

SEQ ID NO: 1381064 - protein, 22 aa, Mycobacterium tuberculosis
AWEAGNKFIARRNLIWSVAAEH

SEQ ID NO: 1381065 - protein, 20 aa, Mycobacterium tuberculosis
AWGVLASFFVSTLLRVAFPD

SEQ ID NO: 1381066 - protein, 32 aa, Mycobacterium tuberculosis
AYDLAKGCALTVIRAAFQLARSDADIAALAEV

SEQ ID NO: 1381067 - protein, 17 aa, Mycobacterium tuberculosis
AYIASLIMPASRLVRQV

SEQ ID NO: 1381068 - protein, 17 aa, Mycobacterium tuberculosis
AYLAPRKLRTTTLTLIY

SEQ ID NO: 1381069 - protein, 27 aa, Mycobacterium tuberculosis
AYPPQKYPPGWPAGPYPPGPPPPGPGS

SEQ ID NO: 1381070 - protein, 19 aa, Mycobacterium tuberculosis
AYSSMEHMGLIAIAAAAGT

SEQ ID NO: 1381071 - protein, 18 aa, Mycobacterium tuberculosis
CAAATMLGLSLASSSASA

SEQ ID NO: 1381072 - protein, 33 aa, Mycobacterium tuberculosis
CAASSRCLSSWMTPYGLRRVCDGFATARRPGSS

SEQ ID NO: 1381073 - protein, 17 aa, Mycobacterium tuberculosis
CAAVALVAFVILVQPTA

SEQ ID NO: 1381074 - protein, 22 aa, Mycobacterium tuberculosis
CAGSPRPPPRSPPCHLPMTTTR

SEQ ID NO: 1381075 - protein, 19 aa, Mycobacterium tuberculosis
CALGLAIPTAIMVGTGRGA

SEQ ID NO: 1381076 - protein, 23 aa, Mycobacterium tuberculosis
CANPASSRSCRWNSTPRSSNWRA

SEQ ID NO: 1381077 - protein, 20 aa, Mycobacterium tuberculosis
CAQAAATVLVWRRVSDGWAF

SEQ ID NO: 1381078 - protein, 18 aa, Mycobacterium tuberculosis
CAQRARAVATFLLAIPVA

SEQ ID NO: 1381079 - protein, 17 aa, Mycobacterium tuberculosis
CASAEWRAAGAAGTAAA

SEQ ID NO: 1381080 - protein, 17 aa, Mycobacterium tuberculosis
CAVAMGFWMGSGAQFGL

SEQ ID NO: 1381081 - protein, 24 aa, Mycobacterium tuberculosis
CAVAPNILLLIIFRVVQGFGGGML

SEQ ID NO: 1381082 - protein, 20 aa, Mycobacterium tuberculosis
CCVRSALATPGNWMSIGCGP

SEQ ID NO: 1381083 - protein, 17 aa, Mycobacterium tuberculosis
CDGCQDGILTIVGFAWR

SEQ ID NO: 1381084 - protein, 26 aa, Mycobacterium tuberculosis
CDLTPQCVRRGWAPVVNNVRRIATLA

SEQ ID NO: 1381085 - protein, 19 aa, Mycobacterium tuberculosis
CFGVEVWFLAALAAPLLTA

SEQ ID NO: 1381086 - protein, 26 aa, Mycobacterium tuberculosis
CFLWDEAWYAFATAVPWARQRTAMIA

SEQ ID NO: 1381087 - protein, 30 aa, Mycobacterium tuberculosis
CGFRSRLYAERWCAWALLAATVAIPTGLTA

SEQ ID NO: 1381088 - protein, 17 aa, Mycobacterium tuberculosis
CGGCGAPATRWCAACAA

SEQ ID NO: 1381089 - protein, 24 aa, Mycobacterium tuberculosis
CGGLPNRVCGGIVPGGQGAIRPLC

SEQ ID NO: 1381090 - protein, 25 aa, Mycobacterium tuberculosis
CGLPLGAGFVSEWLLVQSLIHAAPG

SEQ ID NO: 1381091 - protein, 18 aa, Mycobacterium tuberculosis
CGVGSVLGWAVRMTLEHL

SEQ ID NO: 1381092 - protein, 37 aa, Mycobacterium tuberculosis
CHRPNRLWWRYTAWWLLAMALATLWWVMALTQLHGVS

SEQ ID NO: 1381093 - protein, 26 aa, Mycobacterium tuberculosis
CHTMSLDWVAWRGLGLAADAQLVSEE

SEQ ID NO: 1381094 - protein, 21 aa, Mycobacterium tuberculosis
CIECPDGTVGEIWVHGDNVAN

SEQ ID NO: 1381095 - protein, 26 aa, Mycobacterium tuberculosis
CINCQRAIPHVVGWYQAYKDSGLAVI

SEQ ID NO: 1381096 - protein, 17 aa, Mycobacterium tuberculosis
CITDRFDGLLARNYGMA

SEQ ID NO: 1381097 - protein, 19 aa, Mycobacterium tuberculosis
CLALGWWQWTRFQSTSGTF

SEQ ID NO: 1381098 - protein, 23 aa, Mycobacterium tuberculosis
CLGLWQKIVFGRRVAETVIADPP

SEQ ID NO: 1381099 - protein, 20 aa, Mycobacterium tuberculosis
CPGCGSLRIQCSLIHADLLA

SEQ ID NO: 1381100 - protein, 24 aa, Mycobacterium tuberculosis
CPPDACPLIPFGVNYYIYPVMWGG

SEQ ID NO: 1381101 - protein, 23 aa, Mycobacterium tuberculosis
CRGPPRPTCPDVCACKSDGAERP

SEQ ID NO: 1381102 - protein, 17 aa, Mycobacterium tuberculosis
CRNFIRKSADPAKPIAG

SEQ ID NO: 1381103 - protein, 18 aa, Mycobacterium tuberculosis
CRQVPVHHSFAYRSYSWY

SEQ ID NO: 1381104 - protein, 25 aa, Mycobacterium tuberculosis
CRRHGWPARCGPILGAARVLGAARG

SEQ ID NO: 1381105 - protein, 20 aa, Mycobacterium tuberculosis
CRRWVTIGWYSPALPRLGIP

SEQ ID NO: 1381106 - protein, 29 aa, Mycobacterium tuberculosis
CRSLTRSAWRLGMFANRWIILGVSAQAIA

SEQ ID NO: 1381107 - protein, 17 aa, Mycobacterium tuberculosis
CRVREGFVMRLAIVGTA

SEQ ID NO: 1381108 - protein, 18 aa, Mycobacterium tuberculosis
CSIGATLGNGGWATLVNS

SEQ ID NO: 1381109 - protein, 21 aa, Mycobacterium tuberculosis
CSLRLPGIYPSPGLQRSTACG

SEQ ID NO: 1381110 - protein, 20 aa, Mycobacterium tuberculosis
CSTVAAFAAIASRPASPGGA

SEQ ID NO: 1381111 - protein, 25 aa, Mycobacterium tuberculosis
CTFAIGAAAVFAWLLAAFAVRPFKQ

SEQ ID NO: 1381112 - protein, 18 aa, Mycobacterium tuberculosis
CTYIIGFRFYARLIEMKV

SEQ ID NO: 1381113 - protein, 21 aa, Mycobacterium tuberculosis
CTYIIGFRFYARLIEMKVVRP

SEQ ID NO: 1381114 - protein, 21 aa, Mycobacterium tuberculosis
CVIGCAGLGPASYLLGSVPVG

SEQ ID NO: 1381115 - protein, 21 aa, Mycobacterium tuberculosis
CVKAEMLVGTPAMWWLAVPVL

SEQ ID NO: 1381116 - protein, 28 aa, Mycobacterium tuberculosis
CVMYWLRATFGVVPGRWPARSSSLRWAA

SEQ ID NO: 1381117 - protein, 30 aa, Mycobacterium tuberculosis
CVSPIAWCWWPATRPCLWPRCRPERPAPTW

SEQ ID NO: 1381118 - protein, 17 aa, Mycobacterium tuberculosis
DAARALDNFATRWRHGG

SEQ ID NO: 1381119 - protein, 20 aa, Mycobacterium tuberculosis
DAARGPIAFDALREPDRESS

SEQ ID NO: 1381120 - protein, 21 aa, Mycobacterium tuberculosis
DAARGPIAFDALREPDRESSA

SEQ ID NO: 1381121 - protein, 21 aa, Mycobacterium tuberculosis
DAEALCWDVGEVVELRGRAAP

SEQ ID NO: 1381122 - protein, 21 aa, Mycobacterium tuberculosis
DAGVLGALAGVLAKRQHQTRV

SEQ ID NO: 1381123 - protein, 20 aa, Mycobacterium tuberculosis
DAIAAFLWTANWRFVAQNTD

SEQ ID NO: 1381124 - protein, 20 aa, Mycobacterium tuberculosis
DALGFLQDFFATAVFLGITT

SEQ ID NO: 1381125 - protein, 28 aa, Mycobacterium tuberculosis
DALRTASLQRLRPRLGVGAGAPAPAVVT

SEQ ID NO: 1381126 - protein, 24 aa, Mycobacterium tuberculosis
DALWWAACVCCLAVVITPTLWMLI

SEQ ID NO: 1381127 - protein, 22 aa, Mycobacterium tuberculosis
DANRFVQCRVVATGNSVDAVWK

SEQ ID NO: 1381128 - protein, 25 aa, Mycobacterium tuberculosis
DAPGLRLAVVFLCAAAISAAVVTGY

SEQ ID NO: 1381129 - protein, 17 aa, Mycobacterium tuberculosis
DARCAPAAYRFVSLARH

SEQ ID NO: 1381130 - protein, 17 aa, Mycobacterium tuberculosis
DARCAPAAYRFVSQARH

SEQ ID NO: 1381131 - protein, 24 aa, Mycobacterium tuberculosis
DASLRLVAPGGVFLEMGKTDIRDP

SEQ ID NO: 1381132 - protein, 24 aa, Mycobacterium tuberculosis
DATMLQMLIIFGIVTVIAVVAATT

SEQ ID NO: 1381133 - protein, 21 aa, Mycobacterium tuberculosis
DATRAICSRSHLMGEGEAMLF

SEQ ID NO: 1381134 - protein, 24 aa, Mycobacterium tuberculosis
DATVVRMFLVPSVMKLLGDDCWWA

SEQ ID NO: 1381135 - protein, 18 aa, Mycobacterium tuberculosis
DAVPLLAPHSGYLQTVDV

SEQ ID NO: 1381136 - protein, 23 aa, Mycobacterium tuberculosis
DAVPRMRGMLTLFEGVATGAADG

SEQ ID NO: 1381137 - protein, 24 aa, Mycobacterium tuberculosis
DAVRATREFLVWAVNDAIERGELA

SEQ ID NO: 1381138 - protein, 18 aa, Mycobacterium tuberculosis
DDFWRPLRSFTYWERHCF

SEQ ID NO: 1381139 - protein, 23 aa, Mycobacterium tuberculosis
DDGFVRVIYRWSRTGDLAAALAA

SEQ ID NO: 1381140 - protein, 26 aa, Mycobacterium tuberculosis
DDGLRPEPIIALGILLTWCSVERAVA

SEQ ID NO: 1381141 - protein, 17 aa, Mycobacterium tuberculosis
DDIDGLRFHRGSWGARN

SEQ ID NO: 1381142 - protein, 18 aa, Mycobacterium tuberculosis
DDMSEEFCRWEERIRLDQ

SEQ ID NO: 1381143 - protein, 26 aa, Mycobacterium tuberculosis
DDQKKRWLPGIADGSLTMAFAITEPD

SEQ ID NO: 1381144 - protein, 17 aa, Mycobacterium tuberculosis
DDWNDALVVARCEYHPT

SEQ ID NO: 1381145 - protein, 23 aa, Mycobacterium tuberculosis
DDYRRLGVRGQRLLALYYPFVAF

SEQ ID NO: 1381146 - protein, 22 aa, Mycobacterium tuberculosis
DEDKRVAGAIARLGELKARGVD

SEQ ID NO: 1381147 - protein, 24 aa, Mycobacterium tuberculosis
DEGRPRRLIPLVGLIGCVVLAFAL

SEQ ID NO: 1381148 - protein, 17 aa, Mycobacterium tuberculosis
DEIREGRSFRSAVPRGW

SEQ ID NO: 1381149 - protein, 24 aa, Mycobacterium tuberculosis
DELDAIRIGRRIVARLNWIKQGPA

SEQ ID NO: 1381150 - protein, 22 aa, Mycobacterium tuberculosis
DELHTRALLLAGEETRIATAGQ

SEQ ID NO: 1381151 - protein, 22 aa, Mycobacterium tuberculosis
DELHTRALLLAGEETRLRLLVN

SEQ ID NO: 1381152 - protein, 20 aa, Mycobacterium tuberculosis
DEMGPRAGIPQDHLRLVVAV

SEQ ID NO: 1381153 - protein, 18 aa, Mycobacterium tuberculosis
DEMICGMAEVVKAGFIAD

SEQ ID NO: 1381154 - protein, 28 aa, Mycobacterium tuberculosis
DEPRPAKRSTLREFAVLAVIAVVLYYVM

SEQ ID NO: 1381155 - protein, 22 aa, Mycobacterium tuberculosis
DEVSAAIAALFGTHAQEYQALS

SEQ ID NO: 1381156 - protein, 17 aa, Mycobacterium tuberculosis
DFGGFGFHSVVIGTSGS

SEQ ID NO: 1381157 - protein, 18 aa, Mycobacterium tuberculosis
DFGRLKALGRMESKPLRR

SEQ ID NO: 1381158 - protein, 21 aa, Mycobacterium tuberculosis
DFWAYPCINCQRAIPHVVGWY

SEQ ID NO: 1381159 - protein, 21 aa, Mycobacterium tuberculosis
DGAVVPRIEFDDVAFGYDGGS

SEQ ID NO: 1381160 - protein, 22 aa, Mycobacterium tuberculosis
DGDPGPLVLWLFIWHLAPAGPG

SEQ ID NO: 1381161 - protein, 17 aa, Mycobacterium tuberculosis
DGFKKKKIVDVLRESLY

SEQ ID NO: 1381162 - protein, 18 aa, Mycobacterium tuberculosis
DGLTAWIAAPLLFIGALF

SEQ ID NO: 1381163 - protein, 17 aa, Mycobacterium tuberculosis
DGPGWLHPLVVARSLMV

SEQ ID NO: 1381164 - protein, 23 aa, Mycobacterium tuberculosis
DGPKLFRSLSIAFMSSADPIPAA

SEQ ID NO: 1381165 - protein, 19 aa, Mycobacterium tuberculosis
DGTGLLIYFWSRTDADELH

SEQ ID NO: 1381166 - protein, 18 aa, Mycobacterium tuberculosis
DGTYRIEIQRSKQTYDYT

SEQ ID NO: 1381167 - protein, 17 aa, Mycobacterium tuberculosis
DGVAHGFTVARHGPDVY

SEQ ID NO: 1381168 - protein, 23 aa, Mycobacterium tuberculosis
DGVLRPLPVTTFDVRCAPAALRY

SEQ ID NO: 1381169 - protein, 17 aa, Mycobacterium tuberculosis
DGVLVLSWRAIPGAAET

SEQ ID NO: 1381170 - protein, 25 aa, Mycobacterium tuberculosis
DHDAVWPVMIVLLLNLTAAYSATRF

SEQ ID NO: 1381171 - protein, 31 aa, Mycobacterium tuberculosis
DHDIRVVCSWCWVRSLRLFRSIYMIFSVFFF

SEQ ID NO: 1381172 - protein, 19 aa, Mycobacterium tuberculosis
DHGGRWCRHRSLQRRLHRH

SEQ ID NO: 1381173 - protein, 27 aa, Mycobacterium tuberculosis
DHLRRAVWRAGAAVPECCRPDTGQRGS

SEQ ID NO: 1381174 - protein, 23 aa, Mycobacterium tuberculosis
DHPRSKVGPLRRTRLTEILRGGR

SEQ ID NO: 1381175 - protein, 28 aa, Mycobacterium tuberculosis
DHRRSAMATLRIAFLSALVLELLATLGV

SEQ ID NO: 1381176 - protein, 24 aa, Mycobacterium tuberculosis
DHSRRLWTMLIFMLWHAIFVEHSV

SEQ ID NO: 1381177 - protein, 36 aa, Mycobacterium tuberculosis
DIDDFRPLRSYFYWEHHCFDIPLCSATRSLFDTLDG

SEQ ID NO: 1381178 - protein, 30 aa, Mycobacterium tuberculosis
DIGPQPAWRNLRFPLAWAPPEPTWRALSPM

SEQ ID NO: 1381179 - protein, 19 aa, Mycobacterium tuberculosis
DIGRLRWQFERIARGVPVA

SEQ ID NO: 1381180 - protein, 17 aa, Mycobacterium tuberculosis
DILLKEYWNRPEATRDA

SEQ ID NO: 1381181 - protein, 24 aa, Mycobacterium tuberculosis
DIPGFADSLLRGWQAKKRTSTRIS

SEQ ID NO: 1381182 - protein, 19 aa, Mycobacterium tuberculosis
DKIGRKPLLLWFGVGGLIY

SEQ ID NO: 1381183 - protein, 21 aa, Mycobacterium tuberculosis
DKLPWQPPTVFLMRHGAHNSY

SEQ ID NO: 1381184 - protein, 24 aa, Mycobacterium tuberculosis
DKPPGVAETIDWVAALVALGVADL

SEQ ID NO: 1381185 - protein, 19 aa, Mycobacterium tuberculosis
DKWKNCAGKTVTVTNKAKT

SEQ ID NO: 1381186 - protein, 23 aa, Mycobacterium tuberculosis
DLADPRRGFGMFTFVAASDVLGT

SEQ ID NO: 1381187 - protein, 23 aa, Mycobacterium tuberculosis
DLATRPATFLWLIAATGTLLVAT

SEQ ID NO: 1381188 - protein, 23 aa, Mycobacterium tuberculosis
DLDLLGGLARRMPATTVFFGVAA

SEQ ID NO: 1381189 - protein, 18 aa, Mycobacterium tuberculosis
DLDQVWRLTRGAGQRVAV

SEQ ID NO: 1381190 - protein, 22 aa, Mycobacterium tuberculosis
DLDRPDLPTGKHAPQRRAVASR

SEQ ID NO: 1381191 - protein, 22 aa, Mycobacterium tuberculosis
DLFGQLPLPLGVVGHEGSTVLV

SEQ ID NO: 1381192 - protein, 23 aa, Mycobacterium tuberculosis
DLGALSSWYVWAALGLYPSTPGT

SEQ ID NO: 1381193 - protein, 20 aa, Mycobacterium tuberculosis
DLGVAFGWSLFNWIADVACL

SEQ ID NO: 1381194 - protein, 26 aa, Mycobacterium tuberculosis
DLKSLRGKVVLIDFWAYPCINCQRAI

SEQ ID NO: 1381195 - protein, 26 aa, Mycobacterium tuberculosis
DLKSLRGKVVLIDFWAYSCINCQRAI

SEQ ID NO: 1381196 - protein, 22 aa, Mycobacterium tuberculosis
DLPRSEALKVLAAELSRDLDFR

SEQ ID NO: 1381197 - protein, 23 aa, Mycobacterium tuberculosis
DLQFKGPAANIWADYTAAHIGTQ

SEQ ID NO: 1381198 - protein, 17 aa, Mycobacterium tuberculosis
DLSHAYAVVFVIATALV

SEQ ID NO: 1381199 - protein, 18 aa, Mycobacterium tuberculosis
DLVGGLLLALALGLAVIG

SEQ ID NO: 1381200 - protein, 17 aa, Mycobacterium tuberculosis
DLWSATMFEARRRLLPS

SEQ ID NO: 1381201 - protein, 21 aa, Mycobacterium tuberculosis
DMFWSLAPLVVGCILLAGLVG

SEQ ID NO: 1381202 - protein, 24 aa, Mycobacterium tuberculosis
DMTKGYCPGGRWGFGDLAVCDGEK

SEQ ID NO: 1381203 - protein, 20 aa, Mycobacterium tuberculosis
DNKLGYGLVDPVAALTFNIP

SEQ ID NO: 1381204 - protein, 23 aa, Mycobacterium tuberculosis
DNRDCPSRTDVLGAALANVVGGP

SEQ ID NO: 1381205 - protein, 18 aa, Mycobacterium tuberculosis
DNRKEFGPALSKLNLVLA

SEQ ID NO: 1381206 - protein, 17 aa, Mycobacterium tuberculosis
DNSYWLVGVQLLDGIGA

SEQ ID NO: 1381207 - protein, 17 aa, Mycobacterium tuberculosis
DNYVLLYVGWEGVGLAS

SEQ ID NO: 1381208 - protein, 18 aa, Mycobacterium tuberculosis
DPAAGRFAVDVVLHDPAG

SEQ ID NO: 1381209 - protein, 30 aa, Mycobacterium tuberculosis
DPAKPLPASIPWTALWLSQAWQQRVLEEEL

SEQ ID NO: 1381210 - protein, 17 aa, Mycobacterium tuberculosis
DPARLDSLFRLDHLVAR

SEQ ID NO: 1381211 - protein, 22 aa, Mycobacterium tuberculosis
DPDELIALLGPVLADRPAFTGQ

SEQ ID NO: 1381212 - protein, 25 aa, Mycobacterium tuberculosis
DPEGAHARWNWVLDGMVETKALSPN

SEQ ID NO: 1381213 - protein, 19 aa, Mycobacterium tuberculosis
DPNIAWSRPPDCRRAPTMR

SEQ ID NO: 1381214 - protein, 17 aa, Mycobacterium tuberculosis
DPPVRRSVHHGAGQRYA

SEQ ID NO: 1381215 - protein, 25 aa, Mycobacterium tuberculosis
DPQQRMALELTWEALEHARIPASSL

SEQ ID NO: 1381216 - protein, 20 aa, Mycobacterium tuberculosis
DPRSCWCWRQGGDHVTGNGG

SEQ ID NO: 1381217 - protein, 22 aa, Mycobacterium tuberculosis
DPSQSWVLVFAITMMAGLLVSL

SEQ ID NO: 1381218 - protein, 19 aa, Mycobacterium tuberculosis
DPSRPVACIVRVRATNGSE

SEQ ID NO: 1381219 - protein, 26 aa, Mycobacterium tuberculosis
DPVPFPSFKNGVGLMLQLPQAAVVGT

SEQ ID NO: 1381220 - protein, 17 aa, Mycobacterium tuberculosis
DQLGGRRRPPGPPGPPG

SEQ ID NO: 1381221 - protein, 23 aa, Mycobacterium tuberculosis
DQLGRRVHRVACDYQAVRTHFFD

SEQ ID NO: 1381222 - protein, 18 aa, Mycobacterium tuberculosis
DQLSGVRVVRAFTREGYE

SEQ ID NO: 1381223 - protein, 20 aa, Mycobacterium tuberculosis
DQLSMCFVLLISGVGSLIHI

SEQ ID NO: 1381224 - protein, 26 aa, Mycobacterium tuberculosis
DQRRWSSDLSMTWDLLCRSVTHGIVP

SEQ ID NO: 1381225 - protein, 33 aa, Mycobacterium tuberculosis
DQYLVRFCFPNFLRWLGFGFLFVDILGFNIIGF

SEQ ID NO: 1381226 - protein, 17 aa, Mycobacterium tuberculosis
DRAFSVTLGVLVIACPC

SEQ ID NO: 1381227 - protein, 20 aa, Mycobacterium tuberculosis
DRGAGALGFVGTAGKESVGQ

SEQ ID NO: 1381228 - protein, 20 aa, Mycobacterium tuberculosis
DRGAPALALVAAPRPDASYQ

SEQ ID NO: 1381229 - protein, 19 aa, Mycobacterium tuberculosis
DRGSVGLALGAAGGALAAL

SEQ ID NO: 1381230 - protein, 37 aa, Mycobacterium tuberculosis
DRHAARPFIPRMIRTFAVPIILGWLVTIAVLNVTVPQ

SEQ ID NO: 1381231 - protein, 22 aa, Mycobacterium tuberculosis
DRHFPQARMEPEVLMVEADHDL

SEQ ID NO: 1381232 - protein, 17 aa, Mycobacterium tuberculosis
DRIHGVGATAGRYRGAS

SEQ ID NO: 1381233 - protein, 21 aa, Mycobacterium tuberculosis
DRISSVFVPAVLVIAALTAAG

SEQ ID NO: 1381234 - protein, 17 aa, Mycobacterium tuberculosis
DRLWIRFIADTERRSQV

SEQ ID NO: 1381235 - protein, 18 aa, Mycobacterium tuberculosis
DRNLIIFVVSVVILVTVL

SEQ ID NO: 1381236 - protein, 17 aa, Mycobacterium tuberculosis
DRPALLGAVKTNVGHLE

SEQ ID NO: 1381237 - protein, 20 aa, Mycobacterium tuberculosis
DRPDLPTGKHAPQRRAVASR

SEQ ID NO: 1381238 - protein, 25 aa, Mycobacterium tuberculosis
DRSHPLCVLGFGFSVLAIAMTWLLC

SEQ ID NO: 1381239 - protein, 19 aa, Mycobacterium tuberculosis
DRWLLFNWMRWGRALEYLK

SEQ ID NO: 1381240 - protein, 21 aa, Mycobacterium tuberculosis
DRYRCEKCWVPTWLTPGRSRA

SEQ ID NO: 1381241 - protein, 21 aa, Mycobacterium tuberculosis
DSAACKAWLLAQPYLVAGVLL

SEQ ID NO: 1381242 - protein, 22 aa, Mycobacterium tuberculosis
DSAACKAWLLAQPYLVAGVLLV

SEQ ID NO: 1381243 - protein, 17 aa, Mycobacterium tuberculosis
DSARHMGLFVVGRLAGR

SEQ ID NO: 1381244 - protein, 25 aa, Mycobacterium tuberculosis
DSDFARLGLLAGVILTSVWLFDCWR

SEQ ID NO: 1381245 - protein, 31 aa, Mycobacterium tuberculosis
DSHIGPAPGYTAARPSLSFDHDAHAEPEPKS

SEQ ID NO: 1381246 - protein, 32 aa, Mycobacterium tuberculosis
DSHIGPAPGYTAARPSLSFDHDAHAEPEPKSP

SEQ ID NO: 1381247 - protein, 17 aa, Mycobacterium tuberculosis
DSLLAVVRPFFAKNREV

SEQ ID NO: 1381248 - protein, 19 aa, Mycobacterium tuberculosis
DSMLGYVPAEFGPVYRFAE

SEQ ID NO: 1381249 - protein, 20 aa, Mycobacterium tuberculosis
DTADGLGCYGPPQRALAVMR

SEQ ID NO: 1381250 - protein, 19 aa, Mycobacterium tuberculosis
DTALLVRRAWAIPSVALGW

SEQ ID NO: 1381251 - protein, 20 aa, Mycobacterium tuberculosis
DTARAAFRRPFQFREFLDQT

SEQ ID NO: 1381252 - protein, 30 aa, Mycobacterium tuberculosis; identical to SEQ ID NO: 1119680

SEQ ID NO: 1381253 - protein, 32 aa, Mycobacterium tuberculosis
DTELPRQFGYNMPLELVLTVIPFLIISVLFYF

SEQ ID NO: 1381254 - protein, 22 aa, Mycobacterium tuberculosis
DTGIDWDVIFLLVGMMIIVGVL

SEQ ID NO: 1381255 - protein, 25 aa, Mycobacterium tuberculosis
DTLWPRFLAGKGVMLSEPMVSRQHL

SEQ ID NO: 1381256 - protein, 21 aa, Mycobacterium tuberculosis
DTPPPARIVLFSDGKETMPTN

SEQ ID NO: 1381257 - protein, 17 aa, Mycobacterium tuberculosis
DTRDVVMLQDFVTTPPL

SEQ ID NO: 1381258 - protein, 24 aa, Mycobacterium tuberculosis
DTRTSLKTSWYLLGPAFVAAIAYV

SEQ ID NO: 1381259 - protein, 23 aa, Mycobacterium tuberculosis
DTSVWLRIGLGWMPPAEFWFSWP

SEQ ID NO: 1381260 - protein, 20 aa, Mycobacterium tuberculosis
DTTIGVAMLIGRFFLIIPVL

SEQ ID NO: 1381261 - protein, 18 aa, Mycobacterium tuberculosis
DTTISWSSVEEALGCLSH

SEQ ID NO: 1381262 - protein, 24 aa, Mycobacterium tuberculosis
DVAAGRRKALAFIEGRSVAELVAL

SEQ ID NO: 1381263 - protein, 23 aa, Mycobacterium tuberculosis
DVDFLKVRVGTGVQHAPDSVLSV

SEQ ID NO: 1381264 - protein, 24 aa, Mycobacterium tuberculosis
DVEKRPRLTMFDDFGGRIPSDKPP

SEQ ID NO: 1381265 - protein, 22 aa, Mycobacterium tuberculosis
DVFDRSAGLYRLRLLETSYGVG

SEQ ID NO: 1381266 - protein, 25 aa, Mycobacterium tuberculosis
DVGRWPRGDLRNHRRCEEKAEKLAA

SEQ ID NO: 1381267 - protein, 20 aa, Mycobacterium tuberculosis
DVIHAFWVPEFLFKRDVMPN

SEQ ID NO: 1381268 - protein, 17 aa, Mycobacterium tuberculosis
DVIYRRMLSEMVGDPHE

SEQ ID NO: 1381269 - protein, 17 aa, Mycobacterium tuberculosis
DVRLDRPVALKVIDSRY

SEQ ID NO: 1381270 - protein, 39 aa, Mycobacterium tuberculosis; identical to SEQ ID NO: 156588

SEQ ID NO: 1381271 - protein, 26 aa, Mycobacterium tuberculosis
DVVLRPHWTPLFAYAAAFLIALAHVA

SEQ ID NO: 1381272 - protein, 22 aa, Mycobacterium tuberculosis
DVVLRPHWTPLFAYAAAFLIAV

SEQ ID NO: 1381273 - protein, 26 aa, Mycobacterium tuberculosis
DWDRHLRPMLARRFEIATGHRQAKDP

SEQ ID NO: 1381274 - protein, 37 aa, Mycobacterium tuberculosis
DYIFGFSFYTGHYFGAWVFIAGFLLHIVVKIPHMVTG

SEQ ID NO: 1381275 - protein, 19 aa, Mycobacterium tuberculosis
EAAALKCVRVRLRDEFGFP

SEQ ID NO: 1381276 - protein, 17 aa, Mycobacterium tuberculosis
EAALQCPATRAVLNSVR

SEQ ID NO: 1381277 - protein, 18 aa, Mycobacterium tuberculosis
EAARRTLNRPGFGLTESL

SEQ ID NO: 1381278 - protein, 19 aa, Mycobacterium tuberculosis
EADYARMWIQAATTMSIYE

SEQ ID NO: 1381279 - protein, 20 aa, Mycobacterium tuberculosis
EAGFWGKLVNRVMKRPVLFA

SEQ ID NO: 1381280 - protein, 23 aa, Mycobacterium tuberculosis
EALDRVGLCGWLAGLPEGLSTVL

SEQ ID NO: 1381281 - protein, 17 aa, Mycobacterium tuberculosis
EALEMKDLLVVGDIPGF

SEQ ID NO: 1381282 - protein, 18 aa, Mycobacterium tuberculosis
EALERAGIDPTGLRGSAT

SEQ ID NO: 1381283 - protein, 23 aa, Mycobacterium tuberculosis
EALRHGWALAAICFVAVGIGALS

SEQ ID NO: 1381284 - protein, 19 aa, Mycobacterium tuberculosis
EALTGDMFLLMLGGGALAA

SEQ ID NO: 1381285 - protein, 17 aa, Mycobacterium tuberculosis
EALVADALLALAYTATG

SEQ ID NO: 1381286 - protein, 20 aa, Mycobacterium tuberculosis
EAMLIPMYFLIGGFGQGAGR

SEQ ID NO: 1381287 - protein, 18 aa, Mycobacterium tuberculosis
EAPFDWYTSVLAQLAAVS

SEQ ID NO: 1381288 - protein, 18 aa, Mycobacterium tuberculosis
EARWLSVALLSIGLAGFC

SEQ ID NO: 1381289 - protein, 20 aa, Mycobacterium tuberculosis
EASSLFRVSKLNCSITTSDG

SEQ ID NO: 1381290 - protein, 19 aa, Mycobacterium tuberculosis
EATLWSVVFPLGMYGVGAY

SEQ ID NO: 1381291 - protein, 24 aa, Mycobacterium tuberculosis
EATLWSVVFPLGMYGVGAYRLGLA

SEQ ID NO: 1381292 - protein, 19 aa, Mycobacterium tuberculosis
EAVDRIWLRGTVVLTSAIG

SEQ ID NO: 1381293 - protein, 17 aa, Mycobacterium tuberculosis
ECGTGDFGAQASLYTST

SEQ ID NO: 1381294 - protein, 26 aa, Mycobacterium tuberculosis
EDDTEWLHVPFLPVPIPVPIPQNPGA

SEQ ID NO: 1381295 - protein, 18 aa, Mycobacterium tuberculosis
EDGARPAPPDVIRAIEAQ

SEQ ID NO: 1381296 - protein, 20 aa, Mycobacterium tuberculosis
EDGARPAPPDVIRAIEAQVW

SEQ ID NO: 1381297 - protein, 23 aa, Mycobacterium tuberculosis
EDGARPAPPDVIRAIEGQVWDGG

SEQ ID NO: 1381298 - protein, 17 aa, Mycobacterium tuberculosis
EDIIALGSLVTYVLIER

SEQ ID NO: 1381299 - protein, 19 aa, Mycobacterium tuberculosis
EDPAHGWQPQAGVMHTIEV

SEQ ID NO: 1381300 - protein, 20 aa, Mycobacterium tuberculosis
EDRYVVSVSRRGEMSYSFAD

SEQ ID NO: 1381301 - protein, 25 aa, Mycobacterium tuberculosis
EDVFARGGPYLARAAADLVPTATLL

SEQ ID NO: 1381302 - protein, 25 aa, Mycobacterium tuberculosis
EEALRHGWALAAICFVAVGIGALSL

SEQ ID NO: 1381303 - protein, 17 aa, Mycobacterium tuberculosis
EELAAEWELPIVLDSAA

SEQ ID NO: 1381304 - protein, 21 aa, Mycobacterium tuberculosis
EELLRINLSFADGLPRLATAD

SEQ ID NO: 1381305 - protein, 18 aa, Mycobacterium tuberculosis
EEPLAMVGDGFRFASQPL

SEQ ID NO: 1381306 - protein, 17 aa, Mycobacterium tuberculosis
EEVSAWAVMAFTTAATG

SEQ ID NO: 1381307 - protein, 20 aa, Mycobacterium tuberculosis
EFALRPFAAQALEAGPPPRR

SEQ ID NO: 1381308 - protein, 17 aa, Mycobacterium tuberculosis
EFFRVVVETVARHSGFV

SEQ ID NO: 1381309 - protein, 38 aa, Mycobacterium tuberculosis; identical to SEQ ID NO: 233359

SEQ ID NO: 1381310 - protein, 29 aa, Mycobacterium tuberculosis
EFLVLLGTFSRYWLAAAFGVTALVLSAVY

SEQ ID NO: 1381311 - protein, 23 aa, Mycobacterium tuberculosis
EFQPPAKLKPCWLSPDRPIPMLL

SEQ ID NO: 1381312 - protein, 24 aa, Mycobacterium tuberculosis
EFQPPAKLKPCWLSPDSPMPMLLL

SEQ ID NO: 1381313 - protein, 24 aa, Mycobacterium tuberculosis
EGAEGWECQRAMSVANNVVVDVNA

SEQ ID NO: 1381314 - protein, 19 aa, Mycobacterium tuberculosis
EGALLIVIFATSGALEALV

SEQ ID NO: 1381315 - protein, 20 aa, Mycobacterium tuberculosis
EGATMITFRLRLPCRTILRG

SEQ ID NO: 1381316 - protein, 26 aa, Mycobacterium tuberculosis
EGEAMLFGEYIRLMALVEYSADEIRE

SEQ ID NO: 1381317 - protein, 23 aa, Mycobacterium tuberculosis
EGEGCGTCSVEVITQRTNLPTTD

SEQ ID NO: 1381318 - protein, 23 aa, Mycobacterium tuberculosis
EGKKAVLWTSGWTPCYQGETIYL

SEQ ID NO: 1381319 - protein, 18 aa, Mycobacterium tuberculosis
EGLLTWLGGGHWRELGER

SEQ ID NO: 1381320 - protein, 21 aa, Mycobacterium tuberculosis
EGLSCKELTGDIARRPIADAV

SEQ ID NO: 1381321 - protein, 21 aa, Mycobacterium tuberculosis
EGPWLRTGDLGVIFEGELFIT

SEQ ID NO: 1381322 - protein, 17 aa, Mycobacterium tuberculosis
EGVAGLARYLVASATRI

SEQ ID NO: 1381323 - protein, 21 aa, Mycobacterium tuberculosis
EGVAIGLVVAIVFLLVRVVRA

SEQ ID NO: 1381324 - protein, 24 aa, Mycobacterium tuberculosis
EHAPELRVAGALRNVIAVLTTAPT

SEQ ID NO: 1381325 - protein, 17 aa, Mycobacterium tuberculosis
EHCIGWLILALLGAIAL

SEQ ID NO: 1381326 - protein, 30 aa, Mycobacterium tuberculosis
EHGPRLGPPPVMPPSLAWWASSLQLSGLTA

SEQ ID NO: 1381327 - protein, 18 aa, Mycobacterium tuberculosis
EIAPKAKIVASIREAENQ

SEQ ID NO: 1381328 - protein, 23 aa, Mycobacterium tuberculosis
EIGQFIRWLFRFLVGQVDRIAPF

SEQ ID NO: 1381329 - protein, 22 aa, Mycobacterium tuberculosis
EITRGRCAAISVPGDRSTEKLV

SEQ ID NO: 1381330 - protein, 17 aa, Mycobacterium tuberculosis
EKAEKLAALLTQPGRTY

SEQ ID NO: 1381331 - protein, 25 aa, Mycobacterium tuberculosis
EKPPRLYLAAAWVVIVAGIVFTVAV

SEQ ID NO: 1381332 - protein, 18 aa, Mycobacterium tuberculosis
ELAPPCRKLAIGRHSRTS

SEQ ID NO: 1381333 - protein, 17 aa, Mycobacterium tuberculosis
ELDRVRWAHQLRSYRIA

SEQ ID NO: 1381334 - protein, 21 aa, Mycobacterium tuberculosis
ELEASLLLYFGGVSRLSSEVI

SEQ ID NO: 1381335 - protein, 21 aa, Mycobacterium tuberculosis
ELGQPMFTEYVWGRQYGENTI

SEQ ID NO: 1381336 - protein, 17 aa, Mycobacterium tuberculosis
ELHRRWLQDTSITPPGG

SEQ ID NO: 1381337 - protein, 17 aa, Mycobacterium tuberculosis
ELIKFAIVGGTTFIIDT

SEQ ID NO: 1381338 - protein, 18 aa, Mycobacterium tuberculosis
ELIKFAIVGGTTFIIDTA

SEQ ID NO: 1381339 - protein, 18 aa, Mycobacterium tuberculosis
ELIPARAPHSAEIRNTDV

SEQ ID NO: 1381340 - protein, 20 aa, Mycobacterium tuberculosis
ELLAAGGRYCRLWDTGQGSR

SEQ ID NO: 1381341 - protein, 18 aa, Mycobacterium tuberculosis
ELLALILHDRRLVLAGSG

SEQ ID NO: 1381342 - protein, 17 aa, Mycobacterium tuberculosis
ELLMPWPSAAASGVVGW

SEQ ID NO: 1381343 - protein, 17 aa, Mycobacterium tuberculosis
ELLRINLSFADGLPRLA

SEQ ID NO: 1381344 - protein, 18 aa, Mycobacterium tuberculosis
ELPHEVHRLRALIVELER

SEQ ID NO: 1381345 - protein, 20 aa, Mycobacterium tuberculosis
ELPLREILPAVQRLVVPSAQ

SEQ ID NO: 1381346 - protein, 17 aa, Mycobacterium tuberculosis
ELQRLALAAALAREPAM

SEQ ID NO: 1381347 - protein, 24 aa, Mycobacterium tuberculosis
ELREMLPHNAVEYFVSYYDYYQPE

SEQ ID NO: 1381348 - protein, 19 aa, Mycobacterium tuberculosis
ELRRSATRFLFDFADDLQH

SEQ ID NO: 1381349 - protein, 20 aa, Mycobacterium tuberculosis
ELSGLLGAVPGWAWQGPSAE

SEQ ID NO: 1381350 - protein, 17 aa, Mycobacterium tuberculosis
ELSRLRKDPAYSHVSDE

SEQ ID NO: 1381351 - protein, 17 aa, Mycobacterium tuberculosis
EMIPAITKYMSALDVAV

SEQ ID NO: 1381352 - protein, 25 aa, Mycobacterium tuberculosis
EMLTTLPKFPGLPGLPSLPDIIDGL

SEQ ID NO: 1381353 - protein, 18 aa, Mycobacterium tuberculosis
EMVRRPYLRATLFVIALG

SEQ ID NO: 1381354 - protein, 22 aa, Mycobacterium tuberculosis
ENLPRVNARGGPGGAAGCWQPI

SEQ ID NO: 1381355 - protein, 18 aa, Mycobacterium tuberculosis
ENPEWTNTAIVWNPGTGP

SEQ ID NO: 1381356 - protein, 19 aa, Mycobacterium tuberculosis
ENYILLEWGIDRDFEHYRK

SEQ ID NO: 1381357 - protein, 31 aa, Mycobacterium tuberculosis
EPEPKSPPIPWYRLPAVIITGTTVAVLLVGA

SEQ ID NO: 1381358 - protein, 19 aa, Mycobacterium tuberculosis
EPGQILVLLNVGAVFMGTA

SEQ ID NO: 1381359 - protein, 17 aa, Mycobacterium tuberculosis
EPPIPQPAAAPIEHWAA

SEQ ID NO: 1381360 - protein, 25 aa, Mycobacterium tuberculosis
EPPTTRLAACRSVRAVASIHAATKP

SEQ ID NO: 1381361 - protein, 21 aa, Mycobacterium tuberculosis
EPSRLAELMQRAFTELQTEAG

SEQ ID NO: 1381362 - protein, 19 aa, Mycobacterium tuberculosis
EQIMPLLVVAVMSQLVFSG

SEQ ID NO: 1381363 - protein, 24 aa, Mycobacterium tuberculosis
EQKPVERPAHRWVVVNTDGRSAPA

SEQ ID NO: 1381364 - protein, 26 aa, Mycobacterium tuberculosis
EQLELLVGLVCLQAAAVLGRPSAEDV

SEQ ID NO: 1381365 - protein, 27 aa, Mycobacterium tuberculosis
ERDPLRTGIFGLVLVICVVLIAFGYSG

SEQ ID NO: 1381366 - protein, 28 aa, Mycobacterium tuberculosis
ERDRLALWSRVLPITFTAAGLVALVGGG

SEQ ID NO: 1381367 - protein, 19 aa, Mycobacterium tuberculosis
ERDSPSWSPRFIDHLVGDR

SEQ ID NO: 1381368 - protein, 20 aa, Mycobacterium tuberculosis
ERGLAIPAANAFTAVAGHGV

SEQ ID NO: 1381369 - protein, 28 aa, Mycobacterium tuberculosis
ERIAEVLWCGRGQLVRLAAERARTAKIR

SEQ ID NO: 1381370 - protein, 17 aa, Mycobacterium tuberculosis
ERIWLPFTIWLTAAPAL

SEQ ID NO: 1381371 - protein, 25 aa, Mycobacterium tuberculosis
ERLGKLHFWLTFIGFTPRSWCSTGW

SEQ ID NO: 1381372 - protein, 24 aa, Mycobacterium tuberculosis
ERLKSWRRGLIFAMFVFAAIFTPG

SEQ ID NO: 1381373 - protein, 25 aa, Mycobacterium tuberculosis
ERNLSVALNEVFAGFNPLDPRNLDV

SEQ ID NO: 1381374 - protein, 24 aa, Mycobacterium tuberculosis
ERNLSVALNEVFAGFNRWTRETST

SEQ ID NO: 1381375 - protein, 26 aa, Mycobacterium tuberculosis
ERRERYRWLFGAAVSVGLVFAAELAR

SEQ ID NO: 1381376 - protein, 24 aa, Mycobacterium tuberculosis
ERRPSRLRRGWLVGIAATLLALAG

SEQ ID NO: 1381377 - protein, 26 aa, Mycobacterium tuberculosis
ERVLVHPRPRLSVMAVGGELVDISRT

SEQ ID NO: 1381378 - protein, 20 aa, Mycobacterium tuberculosis
ESAHFLRALLVAVVAALAAG

SEQ ID NO: 1381379 - protein, 21 aa, Mycobacterium tuberculosis
ESAHFLRALLVAVVAALAAGM

SEQ ID NO: 1381380 - protein, 21 aa, Mycobacterium tuberculosis
ESAQAAFWSALSLPPLLLGML

SEQ ID NO: 1381381 - protein, 25 aa, Mycobacterium tuberculosis
ESIHMSWLRFGHGLVLSSILLWTGV

SEQ ID NO: 1381382 - protein, 29 aa, Mycobacterium tuberculosis
ESLQRPSHRCRSAGSWRKTVPAPTSPTIR

SEQ ID NO: 1381383 - protein, 18 aa, Mycobacterium tuberculosis
ETARFGAPTLLTRSTNDV

SEQ ID NO: 1381384 - protein, 17 aa, Mycobacterium tuberculosis
ETARPADLLVLLDSLRQ

SEQ ID NO: 1381385 - protein, 24 aa, Mycobacterium tuberculosis
ETEHLPLLAPLRAIPVIGPPLAAL

SEQ ID NO: 1381386 - protein, 30 aa, Mycobacterium tuberculosis
ETENVLLQVVPWRGALGSVISVGAQQQPAE

SEQ ID NO: 1381387 - protein, 20 aa, Mycobacterium tuberculosis
ETMPSEYRDLLGGLNVDQLK

SEQ ID NO: 1381388 - protein, 22 aa, Mycobacterium tuberculosis
ETPDFLPVVLEFAATVDPEAGR

SEQ ID NO: 1381389 - protein, 29 aa, Mycobacterium tuberculosis
ETTPAVPRPARWVAPGLLLSRLGLQSAAY

SEQ ID NO: 1381390 - protein, 18 aa, Mycobacterium tuberculosis
EVAQDGRLLAAHMVNGIV

SEQ ID NO: 1381391 - protein, 18 aa, Mycobacterium tuberculosis
EVGYSARNETEWQRLMVA

SEQ ID NO: 1381392 - protein, 20 aa, Mycobacterium tuberculosis
EVIRLIRRLLPALVVVLAGC

SEQ ID NO: 1381393 - protein, 20 aa, Mycobacterium tuberculosis
EVRGGLFVRQIHHWAALMFA

SEQ ID NO: 1381394 - protein, 24 aa, Mycobacterium tuberculosis
EWNHAYCIAVLRAALIALALLAIL

SEQ ID NO: 1381395 - protein, 19 aa, Mycobacterium tuberculosis
EWNHAYGIAALRAALIALA

SEQ ID NO: 1381396 - protein, 30 aa, Mycobacterium tuberculosis
EWWRLGLMFAVIVALHLVGWLTVTLLVEPA

SEQ ID NO: 1381397 - protein, 22 aa, Mycobacterium tuberculosis
EYTRLGLCTVPAALAMAVLALW

SEQ ID NO: 1381398 - protein, 19 aa, Mycobacterium tuberculosis
FAAIASRPASPGGAAVGGA

SEQ ID NO: 1381399 - protein, 17 aa, Mycobacterium tuberculosis
FAARCAATVVLAGASWW

SEQ ID NO: 1381400 - protein, 22 aa, Mycobacterium tuberculosis
FAEARWLPVALLSIGLAGFCLH

SEQ ID NO: 1381401 - protein, 17 aa, Mycobacterium tuberculosis
FAELGLNSLMAMAIRRE

SEQ ID NO: 1381402 - protein, 18 aa, Mycobacterium tuberculosis
FAELGLNSLMAMAIRREA

SEQ ID NO: 1381403 - protein, 20 aa, Mycobacterium tuberculosis
FAFGVARQADYLPILPTGLA

SEQ ID NO: 1381404 - protein, 18 aa, Mycobacterium tuberculosis
FAGALMDRWDRRWVLVGA

SEQ ID NO: 1381405 - protein, 24 aa, Mycobacterium tuberculosis
FAGFRRLRALFTHRRDNGLLRECT

SEQ ID NO: 1381406 - protein, 22 aa, Mycobacterium tuberculosis
FAGITMFGPWGIIIGPVLMILI

SEQ ID NO: 1381407 - protein, 28 aa, Mycobacterium tuberculosis
FAGRRSQLRLGLNVPYLLLVLAFVVFDA

SEQ ID NO: 1381408 - protein, 29 aa, Mycobacterium tuberculosis
FAGRRSQLRLGLNVPYLLLVLAFVVFDAI

SEQ ID NO: 1381409 - protein, 17 aa, Mycobacterium tuberculosis
FAGYFAMLALPAMVQVA

SEQ ID NO: 1381410 - protein, 27 aa, Mycobacterium tuberculosis
FAIARSQPWFRRYMTTYLLFVPISLGT

SEQ ID NO: 1381411 - protein, 22 aa, Mycobacterium tuberculosis
FAIGAAAVFAWLLAAFAVRPFK

SEQ ID NO: 1381412 - protein, 23 aa, Mycobacterium tuberculosis
FAIGAAAVFAWLLAAFAVRPFKQ

SEQ ID NO: 1381413 - protein, 19 aa, Mycobacterium tuberculosis
FAIVVDFAITVVTGISFSA

SEQ ID NO: 1381414 - protein, 17 aa, Mycobacterium tuberculosis
FAKMPLMVVILLTTTIV

SEQ ID NO: 1381415 - protein, 24 aa, Mycobacterium tuberculosis
FALKRGALMFGKLVPMGIGAIIGA

SEQ ID NO: 1381416 - protein, 18 aa, Mycobacterium tuberculosis
FAMFLIGRYHERRRQHIA

SEQ ID NO: 1381417 - protein, 22 aa, Mycobacterium tuberculosis
FAQFAILCRRYLAVIAADRQYA

SEQ ID NO: 1381418 - protein, 24 aa, Mycobacterium tuberculosis
FAVLCGAASYIAVPAVQRLAIPEA

SEQ ID NO: 1381419 - protein, 17 aa, Mycobacterium tuberculosis
FAVVGLLFLGTVALTLA

SEQ ID NO: 1381420 - protein, 19 aa, Mycobacterium tuberculosis
FCLIDCCRPGPPTPPMPTI

SEQ ID NO: 1381421 - protein, 23 aa, Mycobacterium tuberculosis
FDAARPLGAWVDALLRTFIGSAV

SEQ ID NO: 1381422 - protein, 18 aa, Mycobacterium tuberculosis
FDARCAPAAYRFVSQARH

SEQ ID NO: 1381423 - protein, 21 aa, Mycobacterium tuberculosis
FDDFWRPLRSFTYWERHCFDI

SEQ ID NO: 1381424 - protein, 41 aa, Mycobacterium tuberculosis
FDDFWRPLRSFTYWERHCFDIPICWSMRSLLNSMDNVDKLT

SEQ ID NO: 1381425 - protein, 21 aa, Mycobacterium tuberculosis
FDGYEYLFWVGCAGAYDDKAK

SEQ ID NO: 1381426 - protein, 18 aa, Mycobacterium tuberculosis
FDNAEFQQGMKLFLSPNG

SEQ ID NO: 1381427 - protein, 25 aa, Mycobacterium tuberculosis
FDPLRRFVAAIPECRANPVCSVAQE

SEQ ID NO: 1381428 - protein, 26 aa, Mycobacterium tuberculosis
FDYAARSQLWLSLLSWAVVVGCYLVT

SEQ ID NO: 1381429 - protein, 17 aa, Mycobacterium tuberculosis
FDYWQAWVFLAAFVSTT

SEQ ID NO: 1381430 - protein, 18 aa, Mycobacterium tuberculosis
FEAMGRIGMVFKEGDSDS

SEQ ID NO: 1381431 - protein, 17 aa, Mycobacterium tuberculosis
FEAPPVRRRWLPRRGPA

SEQ ID NO: 1381432 - protein, 20 aa, Mycobacterium tuberculosis
FEAVGDWQLWVFKSDPANRG

SEQ ID NO: 1381433 - protein, 22 aa, Mycobacterium tuberculosis
FESAHFLRALLVAVVAALAAGM

SEQ ID NO: 1381434 - protein, 23 aa, Mycobacterium tuberculosis
FESAHFLRALLVAVVAALAAGMY

SEQ ID NO: 1381435 - protein, 27 aa, Mycobacterium tuberculosis
FESSALLCPLLVYGWLGLPRWGLTGSA

SEQ ID NO: 1381436 - protein, 33 aa, Mycobacterium tuberculosis
FFFFFFFFFFSFFYFFFFFLFKKKKKKKKKKKK

SEQ ID NO: 1381437 - protein, 19 aa, Mycobacterium tuberculosis
FFFFFFLRFCRHPCYTRWV

SEQ ID NO: 1381438 - protein, 37 aa, Mycobacterium tuberculosis
FFGAYPWAGWLAFAATLPVQFVAGWPILRGAVQQARA

SEQ ID NO: 1381439 - protein, 34 aa, Mycobacterium tuberculosis
FFNLVGWPTWGMILSSPFLLPAGLGLGLAAIAFL

SEQ ID NO: 1381440 - protein, 17 aa, Mycobacterium tuberculosis
FGAIPVLAGPLLGALAA

SEQ ID NO: 1381441 - protein, 17 aa, Mycobacterium tuberculosis
FGCHARRPGGWLRNFGP

SEQ ID NO: 1381442 - protein, 20 aa, Mycobacterium tuberculosis
FGCRMGICQSCVVDLVEGHV

SEQ ID NO: 1381443 - protein, 22 aa, Mycobacterium tuberculosis
FGCVAVIAFIFIKLFGAAAPGG

SEQ ID NO: 1381444 - protein, 27 aa, Mycobacterium tuberculosis
FGDHGGCAWLIRARCAPRAQSWPARCC

SEQ ID NO: 1381445 - protein, 19 aa, Mycobacterium tuberculosis
FGEFEFWFAGVKVATIVGF

SEQ ID NO: 1381446 - protein, 18 aa, Mycobacterium tuberculosis
FGEFFAFTKVCSHLGCPS

SEQ ID NO: 1381447 - protein, 17 aa, Mycobacterium tuberculosis
FGELMVGQPVQFRARIS

SEQ ID NO: 1381448 - protein, 19 aa, Mycobacterium tuberculosis
FGEVIEAFADRAVRQGYAN

SEQ ID NO: 1381449 - protein, 22 aa, Mycobacterium tuberculosis
FGFGVMFGAIWAEEAWGRYWGW

SEQ ID NO: 1381450 - protein, 18 aa, Mycobacterium tuberculosis
FGGAAFLIGYGLLAARRA

SEQ ID NO: 1381451 - protein, 17 aa, Mycobacterium tuberculosis
FGGANAHVVVREVLPRD

SEQ ID NO: 1381452 - protein, 18 aa, Mycobacterium tuberculosis
FGGIGSIFPLFMMVGIMM

SEQ ID NO: 1381453 - protein, 21 aa, Mycobacterium tuberculosis
FGIDFKGGTMVSFPRGSTQVA

SEQ ID NO: 1381454 - protein, 25 aa, Mycobacterium tuberculosis
FGIDFKGGTTVSFPRGSTQVAQVED

SEQ ID NO: 1381455 - protein, 21 aa, Mycobacterium tuberculosis
FGMLRYCLQLFPDPSTYFRPL

SEQ ID NO: 1381456 - protein, 33 aa, Mycobacterium tuberculosis
FGPRLVDIYVDWLWFGEVGFRSVWITVLLTRLA

SEQ ID NO: 1381457 - protein, 25 aa, Mycobacterium tuberculosis
FGSPESRKWLCDMFADARMLAHDTG

SEQ ID NO: 1381458 - protein, 32 aa, Mycobacterium tuberculosis
FGSSALLCPLLVYGWLELPRWGLTGSAVANLV

SEQ ID NO: 1381459 - protein, 18 aa, Mycobacterium tuberculosis
FGSSSLWISWVSTLLGSL

SEQ ID NO: 1381460 - protein, 18 aa, Mycobacterium tuberculosis
FGTFLMRNHFLSLPAEII

SEQ ID NO: 1381461 - protein, 18 aa, Mycobacterium tuberculosis
FGTPYGFVEINDQRQPVP

SEQ ID NO: 1381462 - protein, 17 aa, Mycobacterium tuberculosis
FGTYLMRQFFRTLPTDL

SEQ ID NO: 1381463 - protein, 29 aa, Mycobacterium tuberculosis
FGVPWSNSFPKWRWSITTALLELTVLVLL

SEQ ID NO: 1381464 - protein, 29 aa, Mycobacterium tuberculosis
FGVPWSNSFPKWRWSLTTALLELTVLVLL

SEQ ID NO: 1381465 - protein, 17 aa, Mycobacterium tuberculosis
FGVRDLFMVTALSSITA

SEQ ID NO: 1381466 - protein, 29 aa, Mycobacterium tuberculosis
FIAFDQLWRWNSIVSLVLSVMVILGLVVS

SEQ ID NO: 1381467 - protein, 19 aa, Mycobacterium tuberculosis
FIEGRSVAELVALGEEIYD

SEQ ID NO: 1381468 - protein, 24 aa, Mycobacterium tuberculosis
FIGIGAFLGFFAMMVLSACDHRYG

SEQ ID NO: 1381469 - protein, 19 aa, Mycobacterium tuberculosis
FIVGIGALIWAASLLWYLK

SEQ ID NO: 1381470 - protein, 21 aa, Mycobacterium tuberculosis
FKLSGPEMRGVRQAVTRARRA

SEQ ID NO: 1381471 - protein, 27 aa, Mycobacterium tuberculosis
FKPLYGSSLVTGWARLHGYPLGILANA

SEQ ID NO: 1381472 - protein, 18 aa, Mycobacterium tuberculosis
FLCATALMVVRIEERHTR

SEQ ID NO: 1381473 - protein, 17 aa, Mycobacterium tuberculosis
FLEALIITAIVMVSHCY

SEQ ID NO: 1381474 - protein, 19 aa, Mycobacterium tuberculosis
FLECGLLTMVSNLLWLFLT

SEQ ID NO: 1381475 - protein, 19 aa, Mycobacterium tuberculosis
FLEEPRLAARVAGARTRGG

SEQ ID NO: 1381476 - protein, 17 aa, Mycobacterium tuberculosis
FLEKRFTGDYAHHNLLQ

SEQ ID NO: 1381477 - protein, 18 aa, Mycobacterium tuberculosis
FLGALAFVAGCSVLVRPE

SEQ ID NO: 1381478 - protein, 17 aa, Mycobacterium tuberculosis
FLGRIYDSWARWSGDDD

SEQ ID NO: 1381479 - protein, 18 aa, Mycobacterium tuberculosis
FLLWPRGFPGTIAQSIHG

SEQ ID NO: 1381480 - protein, 21 aa, Mycobacterium tuberculosis
FLRRFRPYNLMPAAVKPSYGM

SEQ ID NO: 1381481 - protein, 22 aa, Mycobacterium tuberculosis
FLRVWLPGQLLQGIGVGATLPV

SEQ ID NO: 1381482 - protein, 17 aa, Mycobacterium tuberculosis
FLTHAFTAWDVFLGYEL

SEQ ID NO: 1381483 - protein, 21 aa, Mycobacterium tuberculosis
FLYGGRSIWQYVTKAFPASVR

SEQ ID NO: 1381484 - protein, 17 aa, Mycobacterium tuberculosis
FMLRTAPFSHDGWLGDW

SEQ ID NO: 1381485 - protein, 32 aa, Mycobacterium tuberculosis
FMMRLSRNLRRCRWLVFTGWLLALVPAVYLAM

SEQ ID NO: 1381486 - protein, 33 aa, Mycobacterium tuberculosis
FMMRLSRNLRRCRWLVFTGWLLALVPAVYLAMT

SEQ ID NO: 1381487 - protein, 31 aa, Mycobacterium tuberculosis
FMTPSIAVLLGRWFWWPQRVRPRPASRMLRQ

SEQ ID NO: 1381488 - protein, 18 aa, Mycobacterium tuberculosis
FMVVQLPFAGIVFAVDGV

SEQ ID NO: 1381489 - protein, 18 aa, Mycobacterium tuberculosis
FNCTDFADLFTLLEHDTS

SEQ ID NO: 1381490 - protein, 19 aa, Mycobacterium tuberculosis
FNLSWRVRYALEPAAGASG

SEQ ID NO: 1381491 - protein, 33 aa, Mycobacterium tuberculosis
FNLVGWPTWGMILSSPFLLPAGLGLGLAAIAFL

SEQ ID NO: 1381492 - protein, 18 aa, Mycobacterium tuberculosis
FNNGLRPEDIIALGSLVT

SEQ ID NO: 1381493 - protein, 19 aa, Mycobacterium tuberculosis
FNNGLRPEGIIALGSLVTY

SEQ ID NO: 1381494 - protein, 19 aa, Mycobacterium tuberculosis
FNVIWTYVLVRGSAVNNGT

SEQ ID NO: 1381495 - protein, 29 aa, Mycobacterium tuberculosis
FPAPDSLIRMCLFLGALTFMYISARAVDD

SEQ ID NO: 1381496 - protein, 23 aa, Mycobacterium tuberculosis
FPAPSWWWLAWFGLVPLLLVVRA

SEQ ID NO: 1381497 - protein, 17 aa, Mycobacterium tuberculosis
FPATFPGAGSACVNPRT

SEQ ID NO: 1381498 - protein, 19 aa, Mycobacterium tuberculosis
FPELSAYQIINRLIHTARP

SEQ ID NO: 1381499 - protein, 20 aa, Mycobacterium tuberculosis
FPELTAYQVINRIVQSAHNP

SEQ ID NO: 1381500 - protein, 20 aa, Mycobacterium tuberculosis
FPFGELAKFLEMAAQAFTEV

SEQ ID NO: 1381501 - protein, 24 aa, Mycobacterium tuberculosis
FPGKRAPTVQLCRDPRGYVPVGTN

SEQ ID NO: 1381502 - protein, 32 aa, Mycobacterium tuberculosis
FPIDIGPQPAWRNLRFPLAWAPPEADVARIVA

SEQ ID NO: 1381503 - protein, 18 aa, Mycobacterium tuberculosis
FPLMGIGAFSMLAFSGRF

SEQ ID NO: 1381504 - protein, 17 aa, Mycobacterium tuberculosis
FPLRSSFAPSYNMTINL

SEQ ID NO: 1381505 - protein, 17 aa, Mycobacterium tuberculosis
FQNPDFQRGLKLFLSPD

SEQ ID NO: 1381506 - protein, 19 aa, Mycobacterium tuberculosis
FQSVVWGLTVGSWIGSSAG

SEQ ID NO: 1381507 - protein, 18 aa, Mycobacterium tuberculosis
FRAGERIGSLFSTHPPIE

SEQ ID NO: 1381508 - protein, 21 aa, Mycobacterium tuberculosis
FRDVLVALVMYPGGGELGVDG

SEQ ID NO: 1381509 - protein, 17 aa, Mycobacterium tuberculosis
FRFVLDHGLQLGRFDRV

SEQ ID NO: 1381510 - protein, 25 aa, Mycobacterium tuberculosis
FRIEGPPGLRRAVGRVVRLQPAKSQ

SEQ ID NO: 1381511 - protein, 17 aa, Mycobacterium tuberculosis
FRPIRSYFYWEKHCYDI

SEQ ID NO: 1381512 - protein, 18 aa, Mycobacterium tuberculosis
FRPRFIKRMFFKKFPGDL

SEQ ID NO: 1381513 - protein, 17 aa, Mycobacterium tuberculosis
FRSALCPTSPSTSTGTA

SEQ ID NO: 1381514 - protein, 21 aa, Mycobacterium tuberculosis
FRSAVPRGWARARKTIVSGNA

SEQ ID NO: 1381515 - protein, 18 aa, Mycobacterium tuberculosis
FRWLTACRPGGFQDPRSE

SEQ ID NO: 1381516 - protein, 17 aa, Mycobacterium tuberculosis
FSAADKPVIFWTPDHGA

SEQ ID NO: 1381517 - protein, 18 aa, Mycobacterium tuberculosis
FSAASAFQSVVWGLTVGS

SEQ ID NO: 1381518 - protein, 17 aa, Mycobacterium tuberculosis
FSAGRLQPFFATPAAWR

SEQ ID NO: 1381519 - protein, 17 aa, Mycobacterium tuberculosis
FSDGRTAPFTVVGADPT

SEQ ID NO: 1381520 - protein, 30 aa, Mycobacterium tuberculosis
FSFYTGHYFGAWVFIAGFLLHIVVKIPHMV

SEQ ID NO: 1381521 - protein, 27 aa, Mycobacterium tuberculosis
FSFYTGHYFGAWVFIAGFPVAYRGQDP

SEQ ID NO: 1381522 - protein, 18 aa, Mycobacterium tuberculosis
FSKILLLIFFSAVLVAKR

SEQ ID NO: 1381523 - protein, 17 aa, Mycobacterium tuberculosis
FSPRAGGLGRLGDTAVT

SEQ ID NO: 1381524 - protein, 19 aa, Mycobacterium tuberculosis
FSRDEFKKGAQIFLSADGH

SEQ ID NO: 1381525 - protein, 18 aa, Mycobacterium tuberculosis
FSVWSLWSVMVLFMPTSV

SEQ ID NO: 1381526 - protein, 19 aa, Mycobacterium tuberculosis
FSVWSLWSVMVRFMPTSVY

SEQ ID NO: 1381527 - protein, 17 aa, Mycobacterium tuberculosis
FTGDEVTYRADIYALAC

SEQ ID NO: 1381528 - protein, 24 aa, Mycobacterium tuberculosis
FTKFTLLMALPWLSAVAAVYVVFR

SEQ ID NO: 1381529 - protein, 21 aa, Mycobacterium tuberculosis
FTKLEVFSAVGPAIAVAITVS

SEQ ID NO: 1381530 - protein, 23 aa, Mycobacterium tuberculosis
FTKLRIPGARVIPTIYFLRHSTD

SEQ ID NO: 1381531 - protein, 18 aa, Mycobacterium tuberculosis
FTQRLAAATNAFVNAEAT

SEQ ID NO: 1381532 - protein, 23 aa, Mycobacterium tuberculosis
FTRVSVVQIGWALRRYRRETLRL

SEQ ID NO: 1381533 - protein, 17 aa, Mycobacterium tuberculosis
FTWKGMLDFATCTECGR

SEQ ID NO: 1381534 - protein, 25 aa, Mycobacterium tuberculosis
FVAFWACLTLLARPACDLAGMLTIA

SEQ ID NO: 1381535 - protein, 17 aa, Mycobacterium tuberculosis
FVARFPLLKPLDMSDAI

SEQ ID NO: 1381536 - protein, 17 aa, Mycobacterium tuberculosis
FVAWFVLYLMLVLRAVG

SEQ ID NO: 1381537 - protein, 17 aa, Mycobacterium tuberculosis
FVFFFPFTDQIAAFKII

SEQ ID NO: 1381538 - protein, 18 aa, Mycobacterium tuberculosis
FVLDHGLQLGRFDRVIAL

SEQ ID NO: 1381539 - protein, 27 aa, Mycobacterium tuberculosis
FVLVFFCVLDVFLFFVVFLFFFFFFFF

SEQ ID NO: 1381540 - protein, 18 aa, Mycobacterium tuberculosis
FVMVLAFSRHLFVRPVIR

SEQ ID NO: 1381541 - protein, 24 aa, Mycobacterium tuberculosis
FVPAALPWYYSWPLAVAAPLAQSR

SEQ ID NO: 1381542 - protein, 33 aa, Mycobacterium tuberculosis
FVQWWGQPAWSWAVLGLRGRRPVKWNDPITLAN

SEQ ID NO: 1381543 - protein, 34 aa, Mycobacterium tuberculosis
FVQWWGQPAWSWAVLGLRGRRPVKWNDSITLANN

SEQ ID NO: 1381544 - protein, 17 aa, Mycobacterium tuberculosis
FVTARTALLDGFLTFFV

SEQ ID NO: 1381545 - protein, 25 aa, Mycobacterium tuberculosis
FVTRPVGSWFLGRFADRRGRRAALT

SEQ ID NO: 1381546 - protein, 20 aa, Mycobacterium tuberculosis
FVVGDLMFVPGVPGVAQGAI

SEQ ID NO: 1381547 - protein, 20 aa, Mycobacterium tuberculosis
FVVGELAALVMFSGAIDRRL

SEQ ID NO: 1381548 - protein, 17 aa, Mycobacterium tuberculosis
FVVGRLAGRHGIRVGLR

SEQ ID NO: 1381549 - protein, 19 aa, Mycobacterium tuberculosis
FWASLFPAVWSFCLALRSR

SEQ ID NO: 1381550 - protein, 18 aa, Mycobacterium tuberculosis
FWRRGRRPLETKVVLDWD

SEQ ID NO: 1381551 - protein, 18 aa, Mycobacterium tuberculosis
FWRTPSIFHFRYSDRVFA

SEQ ID NO: 1381552 - protein, 19 aa, Mycobacterium tuberculosis
FWSRCTAALAGPRVAVAIA

SEQ ID NO: 1381553 - protein, 18 aa, Mycobacterium tuberculosis
FWVPEFLFKRDVMPNPVA

SEQ ID NO: 1381554 - protein, 17 aa, Mycobacterium tuberculosis
FWVSSCTGWCGDVGDPA

SEQ ID NO: 1381555 - protein, 17 aa, Mycobacterium tuberculosis
FYFLEMNTRLQVEHPVT

SEQ ID NO: 1381556 - protein, 25 aa, Mycobacterium tuberculosis
FYLPPEAFQNPDFQRGLKLFLSPDG

SEQ ID NO: 1381557 - protein, 18 aa, Mycobacterium tuberculosis
FYNRRLRAATTRFSVRMK

SEQ ID NO: 1381558 - protein, 18 aa, Mycobacterium tuberculosis
FYRRARAAADKITPDVEI

SEQ ID NO: 1381559 - protein, 20 aa, Mycobacterium tuberculosis
GAAICLLALMATLATASRRL

SEQ ID NO: 1381560 - protein, 19 aa, Mycobacterium tuberculosis
GAAILIGHCLTNLWRGLAP

SEQ ID NO: 1381561 - protein, 18 aa, Mycobacterium tuberculosis
GAALAAHYVHRFGGVTGD

SEQ ID NO: 1381562 - protein, 25 aa, Mycobacterium tuberculosis
GADANRFVQCRVVATGNSVDAVWKP

SEQ ID NO: 1381563 - protein, 25 aa, Mycobacterium tuberculosis
GADEVSVAISALFGSHAQGYQTLSA

SEQ ID NO: 1381564 - protein, 19 aa, Mycobacterium tuberculosis
GAETLRFKGYLIMSRNSSH

SEQ ID NO: 1381565 - protein, 22 aa, Mycobacterium tuberculosis
GAFFCSVFLMHVSAGAWVTGLT

SEQ ID NO: 1381566 - protein, 20 aa, Mycobacterium tuberculosis
GAGGACGWLSGNGGARRQRR

SEQ ID NO: 1381567 - protein, 25 aa, Mycobacterium tuberculosis
GAGRYPCPPRHFLCAGTQRSGSRDV

SEQ ID NO: 1381568 - protein, 19 aa, Mycobacterium tuberculosis
GAGTIGCRRHGWPARCGPI

SEQ ID NO: 1381569 - protein, 18 aa, Mycobacterium tuberculosis
GAGTLGFAGTTHKASPGQ

SEQ ID NO: 1381570 - protein, 29 aa, Mycobacterium tuberculosis
GAHARSGGRRWIRCERLPIAGAELVGDGS

SEQ ID NO: 1381571 - protein, 18 aa, Mycobacterium tuberculosis
GAIASMWLGVHLVPISIG

SEQ ID NO: 1381572 - protein, 18 aa, Mycobacterium tuberculosis
GAKAGLFPFHTWLADAHS

SEQ ID NO: 1381573 - protein, 17 aa, Mycobacterium tuberculosis
GALCAGWTPVPLPEPLG

SEQ ID NO: 1381574 - protein, 25 aa, Mycobacterium tuberculosis
GALFFPWNLYFGFRIPDSSKTVFGL

SEQ ID NO: 1381575 - protein, 19 aa, Mycobacterium tuberculosis
GALKKAMMLLGVLAVLVAM

SEQ ID NO: 1381576 - protein, 17 aa, Mycobacterium tuberculosis
GALLIVIFATSGALEAL

SEQ ID NO: 1381577 - protein, 17 aa, Mycobacterium tuberculosis
GALRGRVVSPRRWLRAV

SEQ ID NO: 1381578 - protein, 18 aa, Mycobacterium tuberculosis
GALSGMWGIPAVVAVATV

SEQ ID NO: 1381579 - protein, 27 aa, Mycobacterium tuberculosis
GAQLVKLAHIKLAWRTGNFVIYAITIV

SEQ ID NO: 1381580 - protein, 25 aa, Mycobacterium tuberculosis
GARLGPARTAGICAISPALFTSFTG

SEQ ID NO: 1381581 - protein, 28 aa, Mycobacterium tuberculosis
GARPGTVWWRVTLPLLLPGVVSGSVLAF

SEQ ID NO: 1381582 - protein, 22 aa, Mycobacterium tuberculosis
GASAWRRLTKVILPMIKPAIVV

SEQ ID NO: 1381583 - protein, 20 aa, Mycobacterium tuberculosis
GAVAFSIVRRSSRPGAVAPT

SEQ ID NO: 1381584 - protein, 24 aa, Mycobacterium tuberculosis
GAVDRRWGRWAALVVTTVVFALAH

SEQ ID NO: 1381585 - protein, 26 aa, Mycobacterium tuberculosis
GAVGIWKAGMFHTLIAVAVILTVIRH

SEQ ID NO: 1381586 - protein, 17 aa, Mycobacterium tuberculosis
GAVGLLTLFFEIFSASP

SEQ ID NO: 1381587 - protein, 18 aa, Mycobacterium tuberculosis
GAVICSAVALGIALHSGD

SEQ ID NO: 1381588 - protein, 18 aa, Mycobacterium tuberculosis
GAVPLVIVGVISSGVAAY

SEQ ID NO: 1381589 - protein, 19 aa, Mycobacterium tuberculosis
GAVQNRWVATRSRRHTYQW

SEQ ID NO: 1381590 - protein, 17 aa, Mycobacterium tuberculosis
GAVTLLFGAIIGCAKDD

SEQ ID NO: 1381591 - protein, 19 aa, Mycobacterium tuberculosis
GAWEGLTFAEAAERDPELH

SEQ ID NO: 1381592 - protein, 19 aa, Mycobacterium tuberculosis
GAWVVAAWLAGIILNLVTG

SEQ ID NO: 1381593 - protein, 17 aa, Mycobacterium tuberculosis
GCEIVFDTIDGIDQLGE

SEQ ID NO: 1381594 - protein, 28 aa, Mycobacterium tuberculosis
GCGAPATRWCAACAAELSVAAGEPHVVS

SEQ ID NO: 1381595 - protein, 21 aa, Mycobacterium tuberculosis
GCGPGSLLVAAQQWQELSDQY

SEQ ID NO: 1381596 - protein, 26 aa, Mycobacterium tuberculosis
GCHIYLFPTIFRWSNTSPTRWRSCLP

SEQ ID NO: 1381597 - protein, 27 aa, Mycobacterium tuberculosis
GCHIYLFPTIFRWSNTSPTRWRSCLPV

SEQ ID NO: 1381598 - protein, 26 aa, Mycobacterium tuberculosis
GCILLLEVLFLRWLLDGRASRQWCGG

SEQ ID NO: 1381599 - protein, 23 aa, Mycobacterium tuberculosis
GCSEPAGLVRPAGFPRKMMAGRV

SEQ ID NO: 1381600 - protein, 20 aa, Mycobacterium tuberculosis
GCVQDYLVLWISVRRRGRSL

SEQ ID NO: 1381601 - protein, 31 aa, Mycobacterium tuberculosis
GDAAWLLAAVWWKALLALAVAVALVIGVNYA

SEQ ID NO: 1381602 - protein, 23 aa, Mycobacterium tuberculosis
GDACPYFPGVSYRNWKLPDPAGQ

SEQ ID NO: 1381603 - protein, 27 aa, Mycobacterium tuberculosis
GDDDERKKRLGVMLATGLIVGESLYGV

SEQ ID NO: 1381604 - protein, 19 aa, Mycobacterium tuberculosis
GDERHMLWFELMKPMTSTA

SEQ ID NO: 1381605 - protein, 17 aa, Mycobacterium tuberculosis
GDFASRRGPPTGAAASP

SEQ ID NO: 1381606 - protein, 21 aa, Mycobacterium tuberculosis
GDIFGLRRWYVITFLMGLFFV

SEQ ID NO: 1381607 - protein, 19 aa, Mycobacterium tuberculosis
GDQLGGRRRPPGPPGPPGS

SEQ ID NO: 1381608 - protein, 17 aa, Mycobacterium tuberculosis
GDVGFGFPNPMGDAPNE

SEQ ID NO: 1381609 - protein, 29 aa, Mycobacterium tuberculosis
GDVGWLRLPAFTWPTRPSWLYRLTQGLHV

SEQ ID NO: 1381610 - protein, 17 aa, Mycobacterium tuberculosis
GDVKRMLAYSSMEHMGL

SEQ ID NO: 1381611 - protein, 18 aa, Mycobacterium tuberculosis
GDVLPELIRRAITVKAEV

SEQ ID NO: 1381612 - protein, 25 aa, Mycobacterium tuberculosis
GEETRLRLLVNEMFETMSRRSRSLV

SEQ ID NO: 1381613 - protein, 20 aa, Mycobacterium tuberculosis
GELAVFVFFGPVAVLGTQYT

SEQ ID NO: 1381614 - protein, 26 aa, Mycobacterium tuberculosis
GELLVRGGVVFQRLLAQRAGYHRGHS

SEQ ID NO: 1381615 - protein, 29 aa, Mycobacterium tuberculosis
GERMATFWRRAGTRIVRRPKAYLGASLIG

SEQ ID NO: 1381616 - protein, 17 aa, Mycobacterium tuberculosis
GEWLPGQILQGIGVGAT

SEQ ID NO: 1381617 - protein, 19 aa, Mycobacterium tuberculosis
GEWLPGQILQGIGVGATFP

SEQ ID NO: 1381618 - protein, 24 aa, Mycobacterium tuberculosis
GEWLPGQILQGIGVGATFPLLGSA

SEQ ID NO: 1381619 - protein, 24 aa, Mycobacterium tuberculosis
GEYTRLGLCTVPAALAMAVLALWA

SEQ ID NO: 1381620 - protein, 22 aa, Mycobacterium tuberculosis
GFFPLMGIGAFSMLAFSGRFGR

SEQ ID NO: 1381621 - protein, 17 aa, Mycobacterium tuberculosis
GFHHGFFIFAIVLTALS

SEQ ID NO: 1381622 - protein, 23 aa, Mycobacterium tuberculosis
GFKTKITTLLSWTVTFLSTRRGQ

SEQ ID NO: 1381623 - protein, 24 aa, Mycobacterium tuberculosis
GFLPAVIWWACHRPNRLWWRYTAW

SEQ ID NO: 1381624 - protein, 23 aa, Mycobacterium tuberculosis
GFSVGWLYWYFWVIVVGFEAVAG

SEQ ID NO: 1381625 - protein, 25 aa, Mycobacterium tuberculosis
GFTPRSWCSTGWATRVCRVATPTTY

SEQ ID NO: 1381626 - protein, 18 aa, Mycobacterium tuberculosis
GFTRKAALLLPRGRVVSP

SEQ ID NO: 1381627 - protein, 18 aa, Mycobacterium tuberculosis
GFVMPGDIPFQVQLPSTP

SEQ ID NO: 1381628 - protein, 23 aa, Mycobacterium tuberculosis
GGADALRYPARYLFVFLDHHGML

SEQ ID NO: 1381629 - protein, 17 aa, Mycobacterium tuberculosis
GGAEMHALISGLADYFA

SEQ ID NO: 1381630 - protein, 19 aa, Mycobacterium tuberculosis
GGAGGLLWGNGGNGGSGAA

SEQ ID NO: 1381631 - protein, 22 aa, Mycobacterium tuberculosis
GGALRLPSSVVSWLPLYHDMGL

SEQ ID NO: 1381632 - protein, 26 aa, Mycobacterium tuberculosis
GGALTEVSWRWAFLVNVPIGLVMIYL

SEQ ID NO: 1381633 - protein, 18 aa, Mycobacterium tuberculosis
GGFAVWFSLFFAMATDGC

SEQ ID NO: 1381634 - protein, 18 aa, Mycobacterium tuberculosis
GGFIARRSDPSWTTSGTT

SEQ ID NO: 1381635 - protein, 18 aa, Mycobacterium tuberculosis
GGGGVAWMGVLCVCDVRQ

SEQ ID NO: 1381636 - protein, 24 aa, Mycobacterium tuberculosis
GGGLARRPARRFGAGRSPALARTD

SEQ ID NO: 1381637 - protein, 22 aa, Mycobacterium tuberculosis
GGIRLSGRTGALSRSARLQLVS

SEQ ID NO: 1381638 - protein, 24 aa, Mycobacterium tuberculosis
GGKVSYLALGILVAIALVIGGIGG

SEQ ID NO: 1381639 - protein, 18 aa, Mycobacterium tuberculosis
GGLAWPFLLLPQLGMIRG

SEQ ID NO: 1381640 - protein, 21 aa, Mycobacterium tuberculosis
GGLLCVIPGLIFGFVAQFAVA

SEQ ID NO: 1381641 - protein, 20 aa, Mycobacterium tuberculosis
GGPRRKGRIISEQEKKITAY

SEQ ID NO: 1381642 - protein, 21 aa, Mycobacterium tuberculosis
GGRAFGAARCRTGAIRARRAR

SEQ ID NO: 1381643 - protein, 17 aa, Mycobacterium tuberculosis
GGRGAGRARPHRGVRRP

SEQ ID NO: 1381644 - protein, 17 aa, Mycobacterium tuberculosis
GGSRRVHCAGGPQRHAA

SEQ ID NO: 1381645 - protein, 18 aa, Mycobacterium tuberculosis
GGTGIRWSGRQVVRRRGT

SEQ ID NO: 1381646 - protein, 26 aa, Mycobacterium tuberculosis
GGTVRNWPWRRLVLSKTANTYSRLAL

SEQ ID NO: 1381647 - protein, 20 aa, Mycobacterium tuberculosis
GGVAAVYAWLRRRRRPPDSS

SEQ ID NO: 1381648 - protein, 33 aa, Mycobacterium tuberculosis
GGVFPRLGRLIVRRPWVVIAFWVALAGLLAPTV

SEQ ID NO: 1381649 - protein, 28 aa, Mycobacterium tuberculosis
GGVGARVPRPGCFEVILVAPRPAATSPG

SEQ ID NO: 1381650 - protein, 18 aa, Mycobacterium tuberculosis
GGVGLSLGQRQRLGLARA

SEQ ID NO: 1381651 - protein, 18 aa, Mycobacterium tuberculosis
GGVRFRWAPNRTASCRTS

SEQ ID NO: 1381652 - protein, 19 aa, Mycobacterium tuberculosis
GGVRFRWAPNRTASCRTSS

SEQ ID NO: 1381653 - protein, 21 aa, Mycobacterium tuberculosis
GGVRPLGGLLYFLVFFFFFFF

SEQ ID NO: 1381654 - protein, 17 aa, Mycobacterium tuberculosis
GHIGLGGTIGWADPETG

SEQ ID NO: 1381655 - protein, 25 aa, Mycobacterium tuberculosis
GHLHRRPGAVGPFWAAAAATGCGGS

SEQ ID NO: 1381656 - protein, 17 aa, Mycobacterium tuberculosis
GHLRWLTVGLTAHIGAT

SEQ ID NO: 1381657 - protein, 22 aa, Mycobacterium tuberculosis
GHPESLVNWDALAALTGTIVLL

SEQ ID NO: 1381658 - protein, 25 aa, Mycobacterium tuberculosis
GHPRRAGVSSFGFGGTNAHVVIEQG

SEQ ID NO: 1381659 - protein, 40 aa, Mycobacterium tuberculosis
GHVHMAGLPGWRAMFVIEALPALLLAPLLRRLLPDNPQRA

SEQ ID NO: 1381660 - protein, 19 aa, Mycobacterium tuberculosis
GIAAVCLVFIVMLMITQSL

SEQ ID NO: 1381661 - protein, 20 aa, Mycobacterium tuberculosis
GIAAVCLVFIVMLMITQSLI

SEQ ID NO: 1381662 - protein, 21 aa, Mycobacterium tuberculosis
GIALWLPWLIAAGVAFILASA

SEQ ID NO: 1381663 - protein, 24 aa, Mycobacterium tuberculosis
GIERPAGTIGEIWVHGDNVAIGYW

SEQ ID NO: 1381664 - protein, 19 aa, Mycobacterium tuberculosis
GIMWPSLLVILLLVAVVAL

SEQ ID NO: 1381665 - protein, 18 aa, Mycobacterium tuberculosis
GIQKSAWLTRSIVAVVLV

SEQ ID NO: 1381666 - protein, 22 aa, Mycobacterium tuberculosis
GISALCLIFIIMLIITRSVVAA

SEQ ID NO: 1381667 - protein, 20 aa, Mycobacterium tuberculosis
GISLPIALGLLIMMYPVLAK

SEQ ID NO: 1381668 - protein, 17 aa, Mycobacterium tuberculosis
GITRISLNFAVFRAAFE

SEQ ID NO: 1381669 - protein, 25 aa, Mycobacterium tuberculosis
GIVPGYCVLAFILGTYWLTRQTARA

SEQ ID NO: 1381670 - protein, 23 aa, Mycobacterium tuberculosis
GIVTIPFGIGMIFYGNIAGGIFV

SEQ ID NO: 1381671 - protein, 26 aa, Mycobacterium tuberculosis
GIVTIPFGIGMIFYGNIAWGIFVLLW

SEQ ID NO: 1381672 - protein, 19 aa, Mycobacterium tuberculosis
GIWAPECAYAPGMEVDYAT

SEQ ID NO: 1381673 - protein, 21 aa, Mycobacterium tuberculosis
GKDPFVRDGFQQVYSINTGQV

SEQ ID NO: 1381674 - protein, 17 aa, Mycobacterium tuberculosis
GKFMPLLPTQQQAPVPP

SEQ ID NO: 1381675 - protein, 33 aa, Mycobacterium tuberculosis
GKPAVLWFWTPWCPFCNAEAPSLSQVAAANPAV

SEQ ID NO: 1381676 - protein, 20 aa, Mycobacterium tuberculosis
GKTGIGWLGYIVIGGIAGWL

SEQ ID NO: 1381677 - protein, 17 aa, Mycobacterium tuberculosis
GLALAYRTRPVFVPDAD

SEQ ID NO: 1381678 - protein, 24 aa, Mycobacterium tuberculosis
GLDRELAARFGFLLAIPAVFASGL

SEQ ID NO: 1381679 - protein, 24 aa, Mycobacterium tuberculosis
GLDSRAYRLPWPTRTVVYEIDQPK

SEQ ID NO: 1381680 - protein, 22 aa, Mycobacterium tuberculosis
GLETHLSYRMCLKTWSASESRN

SEQ ID NO: 1381681 - protein, 18 aa, Mycobacterium tuberculosis
GLFLGAISFVLANFTVAS

SEQ ID NO: 1381682 - protein, 23 aa, Mycobacterium tuberculosis
GLLARLWVLPVHRASGLISRILA

SEQ ID NO: 1381683 - protein, 17 aa, Mycobacterium tuberculosis
GLLEGYGHIGLGGTIGW

SEQ ID NO: 1381684 - protein, 18 aa, Mycobacterium tuberculosis
GLLRAMICQLAVWHSPEE

SEQ ID NO: 1381685 - protein, 23 aa, Mycobacterium tuberculosis
GLLWWMMVCWSQPLRARPDSQMF

SEQ ID NO: 1381686 - protein, 18 aa, Mycobacterium tuberculosis
GLPGRVGPIVLLFRRNAG

SEQ ID NO: 1381687 - protein, 20 aa, Mycobacterium tuberculosis
GLPRRLRWVSPLVPLVAGPL

SEQ ID NO: 1381688 - protein, 23 aa, Mycobacterium tuberculosis
GLPTLRRPWRRSPGATIIVVPPS

SEQ ID NO: 1381689 - protein, 20 aa, Mycobacterium tuberculosis
GLQVKTIWVARAVSVLFPQI

SEQ ID NO: 1381690 - protein, 25 aa, Mycobacterium tuberculosis
GLRGRRARRGWSTGKCRRCAGRPGR

SEQ ID NO: 1381691 - protein, 28 aa, Mycobacterium tuberculosis
GLRRRRWRLSIRRSCVMYWLRATFGVVP

SEQ ID NO: 1381692 - protein, 17 aa, Mycobacterium tuberculosis
GLRSIPMREVLGTNVAD

SEQ ID NO: 1381693 - protein, 34 aa, Mycobacterium tuberculosis
GLRTDLRLRWSWRGLRLGLMFGFGGMLVTIPASL

SEQ ID NO: 1381694 - protein, 17 aa, Mycobacterium tuberculosis
GLSLFYWWYHTLDKTAA

SEQ ID NO: 1381695 - protein, 17 aa, Mycobacterium tuberculosis
GLVSLHWLVYLRCRSRG

SEQ ID NO: 1381696 - protein, 19 aa, Mycobacterium tuberculosis
GMAAVQLARQWGVEVFVTA

SEQ ID NO: 1381697 - protein, 22 aa, Mycobacterium tuberculosis
GMALGFLTVFGIFGALTISAAT

SEQ ID NO: 1381698 - protein, 18 aa, Mycobacterium tuberculosis
GMGGGFIGVDAFFVLSGF

SEQ ID NO: 1381699 - protein, 19 aa, Mycobacterium tuberculosis
GMLRYCLQLFPDPSTYFRP

SEQ ID NO: 1381700 - protein, 21 aa, Mycobacterium tuberculosis
GMPPGPPGRRAWQADTESTAP

SEQ ID NO: 1381701 - protein, 24 aa, Mycobacterium tuberculosis
GMSEVHLARDLRLHRDVAVKVLRA

SEQ ID NO: 1381702 - protein, 20 aa, Mycobacterium tuberculosis
GMVRQRPRAGMLAIGAVTIA

SEQ ID NO: 1381703 - protein, 18 aa, Mycobacterium tuberculosis
GMVTRAGLRPVGRLTEAA

SEQ ID NO: 1381704 - protein, 18 aa, Mycobacterium tuberculosis
GNATCCRGSLGSPSLRRA

SEQ ID NO: 1381705 - protein, 19 aa, Mycobacterium tuberculosis
GNFSWLNWLTILLACSAID

SEQ ID NO: 1381706 - protein, 27 aa, Mycobacterium tuberculosis
GNLLQMAFRFWAFRRWVFPDEFARNPD

SEQ ID NO: 1381707 - protein, 18 aa, Mycobacterium tuberculosis
GNPLVWIERALVVLVAAA

SEQ ID NO: 1381708 - protein, 21 aa, Mycobacterium tuberculosis
GNPSQYWGLKGLIGVNAVAAD

SEQ ID NO: 1381709 - protein, 17 aa, Mycobacterium tuberculosis
GNRPRWLGADIGQRQFY

SEQ ID NO: 1381710 - protein, 19 aa, Mycobacterium tuberculosis
GNRPRWLGRRHRAAPVLSG

SEQ ID NO: 1381711 - protein, 26 aa, Mycobacterium tuberculosis
GNSLITSWRALGWIGPEAAEAAAAAP

SEQ ID NO: 1381712 - protein, 21 aa, Mycobacterium tuberculosis
GNVVIGWPFVGLLALGLVYVA

SEQ ID NO: 1381713 - protein, 29 aa, Mycobacterium tuberculosis
GPAAGFFVGWSYWFAWVVTGIADLVAITG

SEQ ID NO: 1381714 - protein, 17 aa, Mycobacterium tuberculosis
GPDQPMRRSNSCSTPIT

SEQ ID NO: 1381715 - protein, 24 aa, Mycobacterium tuberculosis
GPDRPWHLSFSLLLAGSFVLFSWW

SEQ ID NO: 1381716 - protein, 18 aa, Mycobacterium tuberculosis
GPDRRTASAGLWRRPAGG

SEQ ID NO: 1381717 - protein, 27 aa, Mycobacterium tuberculosis
GPGGSPGLFGQRHVRRDPVGPFYTLTA

SEQ ID NO: 1381718 - protein, 18 aa, Mycobacterium tuberculosis
GPGPRWWGACAAGRGRHV

SEQ ID NO: 1381719 - protein, 26 aa, Mycobacterium tuberculosis
GPGRYGLDAARGWAHRPFIGSFVALL

SEQ ID NO: 1381720 - protein, 25 aa, Mycobacterium tuberculosis
GPLTPPRAVAIITQIASALDAAHAD

SEQ ID NO: 1381721 - protein, 17 aa, Mycobacterium tuberculosis
GPNSTPVILRCGLDRPA

SEQ ID NO: 1381722 - protein, 17 aa, Mycobacterium tuberculosis
GPPAHRSSSTYPRPVTA

SEQ ID NO: 1381723 - protein, 26 aa, Mycobacterium tuberculosis
GPRNRRTLVCWALWMISSVLRSSRID

SEQ ID NO: 1381724 - protein, 17 aa, Mycobacterium tuberculosis
GPSQAWYTENLRYYYLI

SEQ ID NO: 1381725 - protein, 20 aa, Mycobacterium tuberculosis
GPSSWVRRCSRSCGTSSRAG

SEQ ID NO: 1381726 - protein, 17 aa, Mycobacterium tuberculosis
GPTQFGCLLGRIRSRSP

SEQ ID NO: 1381727 - protein, 17 aa, Mycobacterium tuberculosis
GPVRVARKVHGATVSAP

SEQ ID NO: 1381728 - protein, 18 aa, Mycobacterium tuberculosis
GQAFGRPSGVQGSFVAER

SEQ ID NO: 1381729 - protein, 22 aa, Mycobacterium tuberculosis
GQGCACALPVRLGGGGSGDQCR

SEQ ID NO: 1381730 - protein, 25 aa, Mycobacterium tuberculosis
GQINWKWIRRSLYLTAAVVILLPMV

SEQ ID NO: 1381731 - protein, 19 aa, Mycobacterium tuberculosis
GQLLQGIGVGATLPVLSSA

SEQ ID NO: 1381732 - protein, 17 aa, Mycobacterium tuberculosis
GQPGGAGGLLWGNGGNG

SEQ ID NO: 1381733 - protein, 21 aa, Mycobacterium tuberculosis
GQRTAQRRCCAAVHGGRVVWA

SEQ ID NO: 1381734 - protein, 24 aa, Mycobacterium tuberculosis
GQTVLPFTGIDFRLSPSGVAVDSA

SEQ ID NO: 1381735 - protein, 23 aa, Mycobacterium tuberculosis
GQYGRYGQYGQYGVQPGGYYGQQ

SEQ ID NO: 1381736 - protein, 24 aa, Mycobacterium tuberculosis
GRASRQWCGGLAIGLTLVLKPLLG

SEQ ID NO: 1381737 - protein, 25 aa, Mycobacterium tuberculosis
GRASRQWCGGLAIGLTWFSNPCSVR

SEQ ID NO: 1381738 - protein, 19 aa, Mycobacterium tuberculosis
GRAVNKWGPQLPVLTCLAA

SEQ ID NO: 1381739 - protein, 25 aa, Mycobacterium tuberculosis
GRAYDPRFLFAWPSAKSAVMGGAQL

SEQ ID NO: 1381740 - protein, 21 aa, Mycobacterium tuberculosis
GRDLRAAIVVGLSIGLVLIAV

SEQ ID NO: 1381741 - protein, 22 aa, Mycobacterium tuberculosis
GREAAHLRAFRAYAAHSQEIAL

SEQ ID NO: 1381742 - protein, 17 aa, Mycobacterium tuberculosis
GREMLAFAQTYRSTDVA

SEQ ID NO: 1381743 - protein, 25 aa, Mycobacterium tuberculosis
GRFEREMADLYGIRPVGHPKPRRLV

SEQ ID NO: 1381744 - protein, 18 aa, Mycobacterium tuberculosis
GRGLAARHYFTYRDVLGF

SEQ ID NO: 1381745 - protein, 30 aa, Mycobacterium tuberculosis
GRGLAARHYFTYRDVLGFLYAQAKFQLLGK

SEQ ID NO: 1381746 - protein, 18 aa, Mycobacterium tuberculosis
GRGNPGLNEVGWRQVGAA

SEQ ID NO: 1381747 - protein, 22 aa, Mycobacterium tuberculosis
GRGRWELCLVDGAPLRATQSLT

SEQ ID NO: 1381748 - protein, 21 aa, Mycobacterium tuberculosis
GRGSQWAGMGRQLLADEPAFA

SEQ ID NO: 1381749 - protein, 17 aa, Mycobacterium tuberculosis
GRICRWIMATRPASSFP

SEQ ID NO: 1381750 - protein, 20 aa, Mycobacterium tuberculosis
GRIYDSWARWSGDDDERKKR

SEQ ID NO: 1381751 - protein, 18 aa, Mycobacterium tuberculosis
GRLFGRFDLAVAVFFAVS

SEQ ID NO: 1381752 - protein, 18 aa, Mycobacterium tuberculosis
GRLQPFFATPAAWRILDA

SEQ ID NO: 1381753 - protein, 18 aa, Mycobacterium tuberculosis
GRLRRIFGDADLDKLREL

SEQ ID NO: 1381754 - protein, 17 aa, Mycobacterium tuberculosis
GRLTPVYGNDLAQQITS

SEQ ID NO: 1381755 - protein, 21 aa, Mycobacterium tuberculosis
GRPAPTDGFVGVAPDARLLSL

SEQ ID NO: 1381756 - protein, 22 aa, Mycobacterium tuberculosis
GRPLSVRWLLEPVVGRGRVEGA

SEQ ID NO: 1381757 - protein, 22 aa, Mycobacterium tuberculosis
GRPMLRILVRRHRLVGTLPLVS

SEQ ID NO: 1381758 - protein, 20 aa, Mycobacterium tuberculosis
GRPRGPVRGSASWPGEQNRR

SEQ ID NO: 1381759 - protein, 24 aa, Mycobacterium tuberculosis
GRRDLGVAFGWSLFNWIADVACLG

SEQ ID NO: 1381760 - protein, 19 aa, Mycobacterium tuberculosis
GRRIPPVMVGIVLLATATF

SEQ ID NO: 1381761 - protein, 31 aa, Mycobacterium tuberculosis
GRRRCRWSWRTGWVCLYFSVVFDGWPRPGRP

SEQ ID NO: 1381762 - protein, 29 aa, Mycobacterium tuberculosis
GRRRCWPGGRPGMRGCLRGEFGRTAYPAK

SEQ ID NO: 1381763 - protein, 19 aa, Mycobacterium tuberculosis
GRTAYLVMELVNGEPLNSV

SEQ ID NO: 1381764 - protein, 25 aa, Mycobacterium tuberculosis
GRVLARWQSSWLRYAPLSFSGLVMI

SEQ ID NO: 1381765 - protein, 20 aa, Mycobacterium tuberculosis
GRWLCRCAAAAAAVGGTTFG

SEQ ID NO: 1381766 - protein, 20 aa, Mycobacterium tuberculosis
GRYRLQRLIATGGMGQVWEA

SEQ ID NO: 1381767 - protein, 17 aa, Mycobacterium tuberculosis
GSAFGYVHNRLLTLLLF

SEQ ID NO: 1381768 - protein, 18 aa, Mycobacterium tuberculosis
GSALFGHGGINGDGGTGG

SEQ ID NO: 1381769 - protein, 18 aa, Mycobacterium tuberculosis
GSAPRAGTLLGQHTTVAT

SEQ ID NO: 1381770 - protein, 18 aa, Mycobacterium tuberculosis
GSAYLARVPQRFVPDLTK

SEQ ID NO: 1381771 - protein, 17 aa, Mycobacterium tuberculosis
GSFGVLMLWLPGNNLVV

SEQ ID NO: 1381772 - protein, 20 aa, Mycobacterium tuberculosis
GSFGVLMLWLPGNNLVVAFV

SEQ ID NO: 1381773 - protein, 17 aa, Mycobacterium tuberculosis
GSGKLGVRDVLFGGKVS

SEQ ID NO: 1381774 - protein, 18 aa, Mycobacterium tuberculosis
GSGKLGVRDVLFGGKVSY

SEQ ID NO: 1381775 - protein, 19 aa, Mycobacterium tuberculosis
GSGRPGFYRPPGRPEVIAK

SEQ ID NO: 1381776 - protein, 27 aa, Mycobacterium tuberculosis
GSGTLSWCSPLGWSLQVRPYAGERWWV

SEQ ID NO: 1381777 - protein, 23 aa, Mycobacterium tuberculosis
GSLCKELSADIARRPMAKPVDFG

SEQ ID NO: 1381778 - protein, 23 aa, Mycobacterium tuberculosis
GSLLRLSVLALIMLPILAAVTLC

SEQ ID NO: 1381779 - protein, 19 aa, Mycobacterium tuberculosis
GSLTMAFAITEPDAGSNSH

SEQ ID NO: 1381780 - protein, 18 aa, Mycobacterium tuberculosis
GSLVLLAWGAANRDPRQY

SEQ ID NO: 1381781 - protein, 18 aa, Mycobacterium tuberculosis
GSLVVHWATMQELYGITD

SEQ ID NO: 1381782 - protein, 24 aa, Mycobacterium tuberculosis
GSMASGVRSSRGWQAAVYLPMCAV

SEQ ID NO: 1381783 - protein, 23 aa, Mycobacterium tuberculosis
GSMLWRQINRLFGVRGLLLGSAL

SEQ ID NO: 1381784 - protein, 24 aa, Mycobacterium tuberculosis
GSPLLAGDFVRWCRQVLDLLDQVR

SEQ ID NO: 1381785 - protein, 20 aa, Mycobacterium tuberculosis
GSPRECCWRSGPTARSGCRI

SEQ ID NO: 1381786 - protein, 18 aa, Mycobacterium tuberculosis
GSQWAGMGRQLLADEPAF

SEQ ID NO: 1381787 - protein, 24 aa, Mycobacterium tuberculosis
GSRGLRYATVIALVAALVGGVYVL

SEQ ID NO: 1381788 - protein, 25 aa, Mycobacterium tuberculosis
GSSALLCPLLVYGWLGLPRWGLTGS

SEQ ID NO: 1381789 - protein, 23 aa, Mycobacterium tuberculosis
GSTGRRGAARSGYADPRVRLFSD

SEQ ID NO: 1381790 - protein, 18 aa, Mycobacterium tuberculosis
GSVLSWLAQLTAVLVGEL

SEQ ID NO: 1381791 - protein, 18 aa, Mycobacterium tuberculosis
GTGAARARVSALSAAAAR

SEQ ID NO: 1381792 - protein, 18 aa, Mycobacterium tuberculosis
GTGFVELALRAGDEVGCS

SEQ ID NO: 1381793 - protein, 24 aa, Mycobacterium tuberculosis
GTIPICILGLFFKDDIRSGVRNLW

SEQ ID NO: 1381794 - protein, 20 aa, Mycobacterium tuberculosis
GTLKLGKGVGMFTIVGVIVA

SEQ ID NO: 1381795 - protein, 21 aa, Mycobacterium tuberculosis
GTLKLGKGVGMFTIVGVIVAL

SEQ ID NO: 1381796 - protein, 18 aa, Mycobacterium tuberculosis
GTMGPRLVYTETKLNSAF

SEQ ID NO: 1381797 - protein, 24 aa, Mycobacterium tuberculosis
GTPLQGAAIYLVWHRGDVQRIFER

SEQ ID NO: 1381798 - protein, 20 aa, Mycobacterium tuberculosis
GTPQLALSMRIWSIMAHVLA

SEQ ID NO: 1381799 - protein, 18 aa, Mycobacterium tuberculosis
GTVGEIWVQGDNVGLGYW

SEQ ID NO: 1381800 - protein, 23 aa, Mycobacterium tuberculosis
GTVRNWPWRRLVLSKTANTYSRL

SEQ ID NO: 1381801 - protein, 20 aa, Mycobacterium tuberculosis
GVAALSAWGLYRFNQILAGL

SEQ ID NO: 1381802 - protein, 24 aa, Mycobacterium tuberculosis
GVALAGRRRPGWPVPSMSNPPPIT

SEQ ID NO: 1381803 - protein, 18 aa, Mycobacterium tuberculosis
GVALFGMTVSQHLFENPT

SEQ ID NO: 1381804 - protein, 18 aa, Mycobacterium tuberculosis
GVAVGRWLVDRQLAKAPV

SEQ ID NO: 1381805 - protein, 22 aa, Mycobacterium tuberculosis
GVFAGACLSEYGAMASADLSQV

SEQ ID NO: 1381806 - protein, 23 aa, Mycobacterium tuberculosis
GVFALRRVWWLYKLVMSGQPASG

SEQ ID NO: 1381807 - protein, 24 aa, Mycobacterium tuberculosis
GVFALRRVWWLYKLVMSGQPASGR

SEQ ID NO: 1381808 - protein, 29 aa, Mycobacterium tuberculosis
GVGGRLFGRFDLAVAVFFAVSGFLLWRGH

SEQ ID NO: 1381809 - protein, 26 aa, Mycobacterium tuberculosis
GVIAAEHPELWGGLVDLAINDDLGEF

SEQ ID NO: 1381810 - protein, 23 aa, Mycobacterium tuberculosis
GVILRLMLAWIPSTGVPLLAIVL

SEQ ID NO: 1381811 - protein, 27 aa, Mycobacterium tuberculosis
GVLDRLRARFGWLDHVVRAFTRFNDRN

SEQ ID NO: 1381812 - protein, 20 aa, Mycobacterium tuberculosis
GVLGWWRWHHNTWLTTIYTA

SEQ ID NO: 1381813 - protein, 19 aa, Mycobacterium tuberculosis
GVLLLWSWLVMSLAQGYYS

SEQ ID NO: 1381814 - protein, 25 aa, Mycobacterium tuberculosis
GVNLLLSPAVFRGFDQVGALSPTGQ

SEQ ID NO: 1381815 - protein, 25 aa, Mycobacterium tuberculosis
GVPLALPLASLVFFGAFIPLIGAVV

SEQ ID NO: 1381816 - protein, 18 aa, Mycobacterium tuberculosis
GVPVLASWVLLRRRHGDL

SEQ ID NO: 1381817 - protein, 29 aa, Mycobacterium tuberculosis
GVPWSNSFPKWRWSLTTALLELTVLVLLL

SEQ ID NO: 1381818 - protein, 18 aa, Mycobacterium tuberculosis
GVRSSVVADGRWVVHRVG

SEQ ID NO: 1381819 - protein, 21 aa, Mycobacterium tuberculosis
GVRVGGLFAALGVTSVVIGLM

SEQ ID NO: 1381820 - protein, 19 aa, Mycobacterium tuberculosis
GVRWWRFGAGVLLGLACAT

SEQ ID NO: 1381821 - protein, 21 aa, Mycobacterium tuberculosis
GVSSFGFGGANAHVVVREVLP

SEQ ID NO: 1381822 - protein, 25 aa, Mycobacterium tuberculosis
GVYLWHWPIFLALNGQRTGWSGPAL

SEQ ID NO: 1381823 - protein, 24 aa, Mycobacterium tuberculosis
GWADPETGSAFGYVHNRLLTLLLF

SEQ ID NO: 1381824 - protein, 28 aa, Mycobacterium tuberculosis
GWDLHCGAPWCGIVVMKIMFISPLWCLR

SEQ ID NO: 1381825 - protein, 17 aa, Mycobacterium tuberculosis
GWIVTGLITLLATVTRF

SEQ ID NO: 1381826 - protein, 21 aa, Mycobacterium tuberculosis
GWPPGLPPLPRRPRRYRRGVA

SEQ ID NO: 1381827 - protein, 20 aa, Mycobacterium tuberculosis
GWRDFCLRVADRIVLVAGDP

SEQ ID NO: 1381828 - protein, 18 aa, Mycobacterium tuberculosis
GWRWFPRDVHTAGSDAKR

SEQ ID NO: 1381829 - protein, 18 aa, Mycobacterium tuberculosis
GWRWFPRDVHTAGSDLSE

SEQ ID NO: 1381830 - protein, 17 aa, Mycobacterium tuberculosis
GWVPPSPAPHVISQGAV

SEQ ID NO: 1381831 - protein, 25 aa, Mycobacterium tuberculosis
GYGHIGLGGTIGWADPETGSAFGYV

SEQ ID NO: 1381832 - protein, 19 aa, Mycobacterium tuberculosis
GYIVIGGIAGWLASKIVKG

SEQ ID NO: 1381833 - protein, 17 aa, Mycobacterium tuberculosis
GYLVWAAAAAMCAPLTL

SEQ ID NO: 1381834 - protein, 24 aa, Mycobacterium tuberculosis
GYLYIKDRLKDMIISGGENVYPAE

SEQ ID NO: 1381835 - protein, 19 aa, Mycobacterium tuberculosis
GYQDWVPAGGIAFGLFIVT

SEQ ID NO: 1381836 - protein, 17 aa, Mycobacterium tuberculosis
GYRIERMLGAGGMGTVY

SEQ ID NO: 1381837 - protein, 18 aa, Mycobacterium tuberculosis
GYTAARPSLSFDHDAHAE

SEQ ID NO: 1381838 - protein, 18 aa, Mycobacterium tuberculosis
HAGLMFPAVVCTLAAVAS

SEQ ID NO: 1381839 - protein, 24 aa, Mycobacterium tuberculosis
HAGVEQMWCFLPQGARDRTDRTHA

SEQ ID NO: 1381840 - protein, 19 aa, Mycobacterium tuberculosis
HAPAPIPEVIVIRAASDDP

SEQ ID NO: 1381841 - protein, 23 aa, Mycobacterium tuberculosis
HASDPIAWWTPRLLFREPDWLRE

SEQ ID NO: 1381842 - protein, 17 aa, Mycobacterium tuberculosis
HAVAVPPMFSDLASAPT

SEQ ID NO: 1381843 - protein, 21 aa, Mycobacterium tuberculosis
HAVGPVVPFPGTGFVELALRA

SEQ ID NO: 1381844 - protein, 24 aa, Mycobacterium tuberculosis
HAYPKRMPVALIWLIAALVLVGAE

SEQ ID NO: 1381845 - protein, 17 aa, Mycobacterium tuberculosis
HAYPRTASVVIWYSPEL

SEQ ID NO: 1381846 - protein, 18 aa, Mycobacterium tuberculosis
HAYPRTGSVVVWYSPRRA

SEQ ID NO: 1381847 - protein, 17 aa, Mycobacterium tuberculosis
HCLTNLWRGLAPQVHRL

SEQ ID NO: 1381848 - protein, 19 aa, Mycobacterium tuberculosis
HDAVWPVMIVLLLNLTAAY

SEQ ID NO: 1381849 - protein, 19 aa, Mycobacterium tuberculosis
HDLSHAYAVVFVIATALVV

SEQ ID NO: 1381850 - protein, 23 aa, Mycobacterium tuberculosis
HDYGEINGQFFVEMRMIDGTSLR

SEQ ID NO: 1381851 - protein, 23 aa, Mycobacterium tuberculosis
HEAGIDWDVIFLLLGMMIIVSVL

SEQ ID NO: 1381852 - protein, 25 aa, Mycobacterium tuberculosis
HEIKGARAYHPTLLRKGERLLVFLP

SEQ ID NO: 1381853 - protein, 22 aa, Mycobacterium tuberculosis
HELRTPLTTVRMAADLIYDHSA

SEQ ID NO: 1381854 - protein, 22 aa, Mycobacterium tuberculosis
HEVHRLRALIVELERLYNHAAD

SEQ ID NO: 1381855 - protein, 17 aa, Mycobacterium tuberculosis
HFLVVGYLFYWAIIGID

SEQ ID NO: 1381856 - protein, 18 aa, Mycobacterium tuberculosis
HFLVVGYLFYWAIIGIDP

SEQ ID NO: 1381857 - protein, 17 aa, Mycobacterium tuberculosis
HGAIERWQTGGWQPYID

SEQ ID NO: 1381858 - protein, 17 aa, Mycobacterium tuberculosis
HGGDCRRDQPPPQAAPA

SEQ ID NO: 1381859 - protein, 32 aa, Mycobacterium tuberculosis
HGGPGGRPGCWQTITRELWPAPYLVMDTGASL

SEQ ID NO: 1381860 - protein, 17 aa, Mycobacterium tuberculosis
HGHAPVFVLFGSAIYLA

SEQ ID NO: 1381861 - protein, 18 aa, Mycobacterium tuberculosis
HGHRRWESIVTRRRGDHG

SEQ ID NO: 1381862 - protein, 21 aa, Mycobacterium tuberculosis
HGSYSISPRRSARCSRPTQRS

SEQ ID NO: 1381863 - protein, 19 aa, Mycobacterium tuberculosis
HGYDFSAPVIEGYVLARGL

SEQ ID NO: 1381864 - protein, 19 aa, Mycobacterium tuberculosis
HHGMLSVFGSPTWRTVTGG

SEQ ID NO: 1381865 - protein, 17 aa, Mycobacterium tuberculosis
HHRCTPREWNWAVLLAG

SEQ ID NO: 1381866 - protein, 19 aa, Mycobacterium tuberculosis
HHSPVPGLAAWNADHPHRT

SEQ ID NO: 1381867 - protein, 18 aa, Mycobacterium tuberculosis
HIDAPALHPAVFATAVML

SEQ ID NO: 1381868 - protein, 17 aa, Mycobacterium tuberculosis
HIELDRLGGFFMALTGA

SEQ ID NO: 1381869 - protein, 23 aa, Mycobacterium tuberculosis
HIIDVKRALAWVKAHISEYGGDP

SEQ ID NO: 1381870 - protein, 22 aa, Mycobacterium tuberculosis
HILHMPLHWLVLPMAIIVMLAV

SEQ ID NO: 1381871 - protein, 21 aa, Mycobacterium tuberculosis
HILLLPGIILALIGLHLALVW

SEQ ID NO: 1381872 - protein, 17 aa, Mycobacterium tuberculosis
HISELRTSIATSSPGRC

SEQ ID NO: 1381873 - protein, 29 aa, Mycobacterium tuberculosis
HLLGHSLPLFGLAGLPSYDRWDDTSIGEP

SEQ ID NO: 1381874 - protein, 17 aa, Mycobacterium tuberculosis
HLRERRGYRAGPGVPGS

SEQ ID NO: 1381875 - protein, 23 aa, Mycobacterium tuberculosis
HLTELRTRLLISLAAILVTTIFG

SEQ ID NO: 1381876 - protein, 26 aa, Mycobacterium tuberculosis
HLVLAGARSPVSFFAYPGMPSDLVPA

SEQ ID NO: 1381877 - protein, 23 aa, Mycobacterium tuberculosis
HMEVGSPYAVEYIWGRQVGDNTI

SEQ ID NO: 1381878 - protein, 22 aa, Mycobacterium tuberculosis
HNALRELAQVAGRLGDSRGDIF

SEQ ID NO: 1381879 - protein, 23 aa, Mycobacterium tuberculosis
HNGGAWLVLLMIFNVIWTYVLVR

SEQ ID NO: 1381880 - protein, 30 aa, Mycobacterium tuberculosis
HPARYLSVFLVMLIGIYLLVFFTGDKHTAP

SEQ ID NO: 1381881 - protein, 18 aa, Mycobacterium tuberculosis
HPPIPTTPWQHTRHWITS

SEQ ID NO: 1381882 - protein, 30 aa, Mycobacterium tuberculosis
HPPPLPPPPHKIFFIFFFFYFLKKKKKKKK

SEQ ID NO: 1381883 - protein, 19 aa, Mycobacterium tuberculosis
HPRCRGVGAGHRRHIGDCA

SEQ ID NO: 1381884 - protein, 23 aa, Mycobacterium tuberculosis
HPRGAVLRLVVRFAEPLPPSPSG

SEQ ID NO: 1381885 - protein, 24 aa, Mycobacterium tuberculosis
HPRGAVLRLVVRFAEPLPPSPSGS

SEQ ID NO: 1381886 - protein, 18 aa, Mycobacterium tuberculosis
HPVLNLATARFFFFFFFS

SEQ ID NO: 1381887 - protein, 20 aa, Mycobacterium tuberculosis
HPYPRWLATAGAAGFALGVA

SEQ ID NO: 1381888 - protein, 19 aa, Mycobacterium tuberculosis
HQGLTWAAGLLYPAFCIGA

SEQ ID NO: 1381889 - protein, 39 aa, Mycobacterium tuberculosis
HQPNSVWSWDITKLRGPAKWSYYYLYVILDIFSRYVVGW

SEQ ID NO: 1381890 - protein, 23 aa, Mycobacterium tuberculosis
HRDGPRPTLCVIHGFMGSSYLLN

SEQ ID NO: 1381891 - protein, 24 aa, Mycobacterium tuberculosis
HRDPCGGAGCAVRRRDHLGGVANP

SEQ ID NO: 1381892 - protein, 23 aa, Mycobacterium tuberculosis
HRDPLRLVLGALFVAEITSMVLQ

SEQ ID NO: 1381893 - protein, 24 aa, Mycobacterium tuberculosis
HRFRCRRLRRGGAVWQASDGSDDQ

SEQ ID NO: 1381894 - protein, 23 aa, Mycobacterium tuberculosis
HRLGIRRWLRRRASGRGAHARSG

SEQ ID NO: 1381895 - protein, 17 aa, Mycobacterium tuberculosis
HRLSPRMLLVHPVHEML

SEQ ID NO: 1381896 - protein, 20 aa, Mycobacterium tuberculosis
HRLSPRMLLVHPVHEMLRQL

SEQ ID NO: 1381897 - protein, 25 aa, Mycobacterium tuberculosis
HRMLKGFKEFLARGNIVDLAVAVVI

SEQ ID NO: 1381898 - protein, 35 aa, Mycobacterium tuberculosis
HRPNRLWWRYTAWWLLAMALATLWWVMALTQLHGV

SEQ ID NO: 1381899 - protein, 36 aa, Mycobacterium tuberculosis
HRPNRLWWRYTAWWLLAMALATLWWVMALTQLHGVS

SEQ ID NO: 1381900 - protein, 24 aa, Mycobacterium tuberculosis
HRQRRAGVVLIRLGVAAAGDRLPD

SEQ ID NO: 1381901 - protein, 22 aa, Mycobacterium tuberculosis
HRRAHGLPAISLGWGLWDQASA

SEQ ID NO: 1381902 - protein, 23 aa, Mycobacterium tuberculosis
HRRSWCRWCVVPRAAAHSMTPRR

SEQ ID NO: 1381903 - protein, 25 aa, Mycobacterium tuberculosis
HRSRLQSTAGRRCLNDSASIGARPS

SEQ ID NO: 1381904 - protein, 19 aa, Mycobacterium tuberculosis
HRVNWKSATARNWMKRADH

SEQ ID NO: 1381905 - protein, 17 aa, Mycobacterium tuberculosis
HRWFGRRPPVVTGRANA

SEQ ID NO: 1381906 - protein, 19 aa, Mycobacterium tuberculosis
HTMMFQEMVNRVGADVPGL

SEQ ID NO: 1381907 - protein, 23 aa, Mycobacterium tuberculosis
HTMSLDWVAWRGLGLAADAQLVS

SEQ ID NO: 1381908 - protein, 27 aa, Mycobacterium tuberculosis
HTRAGGLVVAEWIRGRFVTGSRRHPPP

SEQ ID NO: 1381909 - protein, 21 aa, Mycobacterium tuberculosis
HVAAFEFFDGVPARLVCDNLR

SEQ ID NO: 1381910 - protein, 17 aa, Mycobacterium tuberculosis
HVCSLCLSTDKQAEHVL

SEQ ID NO: 1381911 - protein, 20 aa, Mycobacterium tuberculosis
HVTFGYRPGVPVIQDVSLTL

SEQ ID NO: 1381912 - protein, 18 aa, Mycobacterium tuberculosis
HWAQVVWSRTIVQLAAEE

SEQ ID NO: 1381913 - protein, 19 aa, Mycobacterium tuberculosis
HWAQVVWSRTIVQLAAEER

SEQ ID NO: 1381914 - protein, 18 aa, Mycobacterium tuberculosis
HYPDRGAPALALVAAPRP

SEQ ID NO: 1381915 - protein, 20 aa, Mycobacterium tuberculosis
IAAAGPRHRVACHRNVDFPG

SEQ ID NO: 1381916 - protein, 19 aa, Mycobacterium tuberculosis
IAAIGWVVFFFMFRTESTA

SEQ ID NO: 1381917 - protein, 26 aa, Mycobacterium tuberculosis
IAAVGLRGVIWSGVVSKVIVPAVVAA

SEQ ID NO: 1381918 - protein, 18 aa, Mycobacterium tuberculosis
IADAGLRKAVMKAITPKA

SEQ ID NO: 1381919 - protein, 22 aa, Mycobacterium tuberculosis
IAEVWKTTPFMSLLLLAGLALV

SEQ ID NO: 1381920 - protein, 23 aa, Mycobacterium tuberculosis
IAFLPIVLAPAVIPPASTPLAAA

SEQ ID NO: 1381921 - protein, 19 aa, Mycobacterium tuberculosis
IAFSFKRTHKVTVNAEGSD

SEQ ID NO: 1381922 - protein, 17 aa, Mycobacterium tuberculosis
IAGLAGAAWLVSGAGAD

SEQ ID NO: 1381923 - protein, 37 aa, Mycobacterium tuberculosis
IAGLPCLPWFISSNWNLAFGVLPPYWLPRHFGRSDHG

SEQ ID NO: 1381924 - protein, 20 aa, Mycobacterium tuberculosis
IAGSLARKGTTPVTAATFPT

SEQ ID NO: 1381925 - protein, 20 aa, Mycobacterium tuberculosis
IAILLARLFVPDDVGPAAPI

SEQ ID NO: 1381926 - protein, 18 aa, Mycobacterium tuberculosis
IAKVCVYTVLAVVQSAIV

SEQ ID NO: 1381927 - protein, 19 aa, Mycobacterium tuberculosis
IAKVCVYTVLAVVQSAIVT

SEQ ID NO: 1381928 - protein, 19 aa, Mycobacterium tuberculosis
IALPFLVWVWLRHLRERRG

SEQ ID NO: 1381929 - protein, 21 aa, Mycobacterium tuberculosis
IALPFLVWVWLRHLRERRGYR

SEQ ID NO: 1381930 - protein, 19 aa, Mycobacterium tuberculosis
IALPLLAYFAIMWVGGYLL

SEQ ID NO: 1381931 - protein, 17 aa, Mycobacterium tuberculosis
IALWRLDQLDGRGSIAQ

SEQ ID NO: 1381932 - protein, 25 aa, Mycobacterium tuberculosis
IANQLGWQGPFWDWLGGLDLNTVGF

SEQ ID NO: 1381933 - protein, 17 aa, Mycobacterium tuberculosis
IAPPLTRFVMLRLAPGL

SEQ ID NO: 1381934 - protein, 17 aa, Mycobacterium tuberculosis
IAQFAITYLPAMNMVFD

SEQ ID NO: 1381935 - protein, 19 aa, Mycobacterium tuberculosis
IAQVLDWFISFVSGPVFTF

SEQ ID NO: 1381936 - protein, 17 aa, Mycobacterium tuberculosis
IARVPDCAVVGAAAGGV

SEQ ID NO: 1381937 - protein, 18 aa, Mycobacterium tuberculosis
IASPMFHFGILVVIVGHG

SEQ ID NO: 1381938 - protein, 21 aa, Mycobacterium tuberculosis
IATYLRGDWYRDWGSVEQYHR

SEQ ID NO: 1381939 - protein, 17 aa, Mycobacterium tuberculosis
IAVAFLGTVLLYFAARD

SEQ ID NO: 1381940 - protein, 19 aa, Mycobacterium tuberculosis
IAVAFLGTVLLYFAARDSG

SEQ ID NO: 1381941 - protein, 17 aa, Mycobacterium tuberculosis
IAVGALAWLVAAVAAFV

SEQ ID NO: 1381942 - protein, 22 aa, Mycobacterium tuberculosis
IAVSLPLLWWRFRRDDRAALTG

SEQ ID NO: 1381943 - protein, 20 aa, Mycobacterium tuberculosis
IDELGWPMLCLMTIAAGALQ

SEQ ID NO: 1381944 - protein, 17 aa, Mycobacterium tuberculosis
IDGCRELIQNAAQAANG

SEQ ID NO: 1381945 - protein, 23 aa, Mycobacterium tuberculosis
IDGLPFSWTVASWTQHSSNLTVA

SEQ ID NO: 1381946 - protein, 28 aa, Mycobacterium tuberculosis
IDHLRRHSLPLFGYAAMPAYDVVDGVSK

SEQ ID NO: 1381947 - protein, 18 aa, Mycobacterium tuberculosis
IDIVVEWVIGNLFGVVPL

SEQ ID NO: 1381948 - protein, 19 aa, Mycobacterium tuberculosis
IDIVVEWVIGNLFGVVPLL

SEQ ID NO: 1381949 - protein, 18 aa, Mycobacterium tuberculosis
IDNARRAELIERFGLDPT

SEQ ID NO: 1381950 - protein, 22 aa, Mycobacterium tuberculosis
IDPARLGLAVVMLSRRRPMLNL

SEQ ID NO: 1381951 - protein, 22 aa, Mycobacterium tuberculosis
IDPSAAINMAWRAAGGAAGPLG

SEQ ID NO: 1381952 - protein, 20 aa, Mycobacterium tuberculosis
IDSARRWLIEGPAHLRGEQI

SEQ ID NO: 1381953 - protein, 21 aa, Mycobacterium tuberculosis
IDTVLRAKVDAAWNLHQATSD

SEQ ID NO: 1381954 - protein, 25 aa, Mycobacterium tuberculosis
IEALDRVGLCGWLAGLPEGLSTVLI

SEQ ID NO: 1381955 - protein, 21 aa, Mycobacterium tuberculosis
IEDFTWKGMLDFATCTECGRC

SEQ ID NO: 1381956 - protein, 22 aa, Mycobacterium tuberculosis
IEDFTWKGMLDFATCTECGRCQ

SEQ ID NO: 1381957 - protein, 19 aa, Mycobacterium tuberculosis
IEGLLTWLGGGHWRELGER

SEQ ID NO: 1381958 - protein, 22 aa, Mycobacterium tuberculosis
IELPPGYLPLRVPIEVNFTQRV

SEQ ID NO: 1381959 - protein, 23 aa, Mycobacterium tuberculosis
IFGEDRFRWSATMIGLSLAVFGI

SEQ ID NO: 1381960 - protein, 20 aa, Mycobacterium tuberculosis
IFGWHGMGEWMVRGISTQDT

SEQ ID NO: 1381961 - protein, 21 aa, Mycobacterium tuberculosis
IGAGLIFPRFEQLLEKPFSRI

SEQ ID NO: 1381962 - protein, 17 aa, Mycobacterium tuberculosis
IGASVLGVALLIVDALR

SEQ ID NO: 1381963 - protein, 21 aa, Mycobacterium tuberculosis
IGCSARCGRRATAALAVAGER

SEQ ID NO: 1381964 - protein, 23 aa, Mycobacterium tuberculosis
IGCSLRLPGIYPPQVYNGRLHVD

SEQ ID NO: 1381965 - protein, 26 aa, Mycobacterium tuberculosis
IGEPGLDWRWLVLWWESHAPHIANNL

SEQ ID NO: 1381966 - protein, 17 aa, Mycobacterium tuberculosis
IGGGYLLFGAMLYGSFF

SEQ ID NO: 1381967 - protein, 19 aa, Mycobacterium tuberculosis
IGGIAGWLASKIVKGGGSG

SEQ ID NO: 1381968 - protein, 17 aa, Mycobacterium tuberculosis
IGLALFALWPFTRLVHA

SEQ ID NO: 1381969 - protein, 17 aa, Mycobacterium tuberculosis
IGLLTILGFSLYDTVIV

SEQ ID NO: 1381970 - protein, 27 aa, Mycobacterium tuberculosis
IGLSMLGDLPWWVTVLILTRELGVTVL

SEQ ID NO: 1381971 - protein, 21 aa, Mycobacterium tuberculosis
IGPDWRLVLRGGPAEVVLDRA

SEQ ID NO: 1381972 - protein, 23 aa, Mycobacterium tuberculosis
IGPDWRLVLRVGPAEVVLYRATL

SEQ ID NO: 1381973 - protein, 19 aa, Mycobacterium tuberculosis
IGPSQAWYTENLRYYYLIL

SEQ ID NO: 1381974 - protein, 20 aa, Mycobacterium tuberculosis
IGSFPILSVFGFVVMFGSVV

SEQ ID NO: 1381975 - protein, 22 aa, Mycobacterium tuberculosis
IGSISFWGSIVAFGKLQEIISG

SEQ ID NO: 1381976 - protein, 20 aa, Mycobacterium tuberculosis
IGSVLRFLVDRSVARRLART

SEQ ID NO: 1381977 - protein, 20 aa, Mycobacterium tuberculosis
IGTPLFFQRVFGAGIATLVA

SEQ ID NO: 1381978 - protein, 24 aa, Mycobacterium tuberculosis
IGVMVALCLGGGVFGLSLGKHITQ

SEQ ID NO: 1381979 - protein, 17 aa, Mycobacterium tuberculosis
IGVPWWFMVVQLPFAGI

SEQ ID NO: 1381980 - protein, 21 aa, Mycobacterium tuberculosis
IGYTGAGTVEFLADDSPGREG

SEQ ID NO: 1381981 - protein, 23 aa, Mycobacterium tuberculosis
IHALSLPIILFWVALTIVVNVVA

SEQ ID NO: 1381982 - protein, 24 aa, Mycobacterium tuberculosis
IHRAYRYARAMARWSPTSRSEVTD

SEQ ID NO: 1381983 - protein, 19 aa, Mycobacterium tuberculosis
IIMLCLWWGAATSKLNHHF

SEQ ID NO: 1381984 - protein, 17 aa, Mycobacterium tuberculosis
IKATTVFGGKYVSLTTP

SEQ ID NO: 1381985 - protein, 20 aa, Mycobacterium tuberculosis
IKPGDVMPATYVGIWQTFAD

SEQ ID NO: 1381986 - protein, 21 aa, Mycobacterium tuberculosis
IKVPREFINDYLFNFPDTNFA

SEQ ID NO: 1381987 - protein, 20 aa, Mycobacterium tuberculosis
IKYYLPRGRSRPVIEVAETL

SEQ ID NO: 1381988 - protein, 20 aa, Mycobacterium tuberculosis
ILAAMPAFWSRCTAALAGPR

SEQ ID NO: 1381989 - protein, 22 aa, Mycobacterium tuberculosis
ILADKALRLAIAKGIDRYTIAR

SEQ ID NO: 1381990 - protein, 32 aa, Mycobacterium tuberculosis
ILFGACRLGSLIRYVPHPVIFWIHGGNRDPHH

SEQ ID NO: 1381991 - protein, 19 aa, Mycobacterium tuberculosis
ILFTAITFGALWLLYRYYR

SEQ ID NO: 1381992 - protein, 31 aa, Mycobacterium tuberculosis
ILFTAITFGALWLLYRYYRTGDPAVFVHHLV

SEQ ID NO: 1381993 - protein, 29 aa, Mycobacterium tuberculosis
ILGGWLIGAYGWRWIFLVNLPVGLSALVL

SEQ ID NO: 1381994 - protein, 21 aa, Mycobacterium tuberculosis
ILGHATDLLFNGVIGRGLPGG

SEQ ID NO: 1381995 - protein, 28 aa, Mycobacterium tuberculosis
ILLAWMTIDALVWVPRMYYLYGNPSRSL

SEQ ID NO: 1381996 - protein, 33 aa, Mycobacterium tuberculosis; identical to SEQ ID NO: 160420

SEQ ID NO: 1381997 - protein, 25 aa, Mycobacterium tuberculosis
ILPNPRLPAPIFPKPRLCAPRLAAP

SEQ ID NO: 1381998 - protein, 17 aa, Mycobacterium tuberculosis
ILRGGRSRLVFGTLAIL

SEQ ID NO: 1381999 - protein, 17 aa, Mycobacterium tuberculosis
ILSVFGFVVMFGSVVYA

SEQ ID NO: 1382000 - protein, 17 aa, Mycobacterium tuberculosis
IMFHPLNTITAYKGQII

SEQ ID NO: 1382001 - protein, 18 aa, Mycobacterium tuberculosis
IMGIELLALILHDRRLVL

SEQ ID NO: 1382002 - protein, 17 aa, Mycobacterium tuberculosis
IMLRRKRIPSVARGPAW

SEQ ID NO: 1382003 - protein, 23 aa, Mycobacterium tuberculosis
IMQRPRFRMPFSPYSGYLTLLFL

SEQ ID NO: 1382004 - protein, 22 aa, Mycobacterium tuberculosis
IMYCVACISFFFIGGLLALLMR

SEQ ID NO: 1382005 - protein, 18 aa, Mycobacterium tuberculosis
INAVPLRVAVFYIGALLA

SEQ ID NO: 1382006 - protein, 24 aa, Mycobacterium tuberculosis
INGSGPRFTAPMSKTGVPYGGILL

SEQ ID NO: 1382007 - protein, 25 aa, Mycobacterium tuberculosis
INGSGPRFTAPMSKTGVPYGGILLT

SEQ ID NO: 1382008 - protein, 18 aa, Mycobacterium tuberculosis
INLLPLLPFDGGHIAVAV

SEQ ID NO: 1382009 - protein, 17 aa, Mycobacterium tuberculosis
INSLRMFIGAGTAPMLA

SEQ ID NO: 1382010 - protein, 18 aa, Mycobacterium tuberculosis
INSVVLRIACFYVGSTVL

SEQ ID NO: 1382011 - protein, 19 aa, Mycobacterium tuberculosis
INSVVLRIACFYVGSTVLL

SEQ ID NO: 1382012 - protein, 26 aa, Mycobacterium tuberculosis
INVLRVWPEIVGAIVLLVIAAMGIGH

SEQ ID NO: 1382013 - protein, 23 aa, Mycobacterium tuberculosis
INWKWIRRSLYLTAAVVILLPMV

SEQ ID NO: 1382014 - protein, 19 aa, Mycobacterium tuberculosis
IPAALSAPSLNRGVGFTHV

SEQ ID NO: 1382015 - protein, 20 aa, Mycobacterium tuberculosis
IPFLIISVLFYFTVVVQEKM

SEQ ID NO: 1382016 - protein, 17 aa, Mycobacterium tuberculosis
IPFTDLRMKVVDTQTEW

SEQ ID NO: 1382017 - protein, 22 aa, Mycobacterium tuberculosis
IPLAAWATRPGFRVAAILATLI

SEQ ID NO: 1382018 - protein, 21 aa, Mycobacterium tuberculosis
IPLTSGFVSKFAVFRAAASAG

SEQ ID NO: 1382019 - protein, 21 aa, Mycobacterium tuberculosis
IPMKKMHAVSVPSNYAAALLA

SEQ ID NO: 1382020 - protein, 19 aa, Mycobacterium tuberculosis
IPNGLSRCDTRILGAGVLV

SEQ ID NO: 1382021 - protein, 17 aa, Mycobacterium tuberculosis
IPPQIFSRDEFKKGAQI

SEQ ID NO: 1382022 - protein, 19 aa, Mycobacterium tuberculosis
IPPRARCSSWPPRPASTRS

SEQ ID NO: 1382023 - protein, 22 aa, Mycobacterium tuberculosis
IPQDHLRLVVAVDRDVYRALFP

SEQ ID NO: 1382024 - protein, 17 aa, Mycobacterium tuberculosis
IPRAIPLALGITLAVYA

SEQ ID NO: 1382025 - protein, 17 aa, Mycobacterium tuberculosis
IPVLIVGTVVWVGITND

SEQ ID NO: 1382026 - protein, 17 aa, Mycobacterium tuberculosis
IQPYLPIAVVAALDAVF

SEQ ID NO: 1382027 - protein, 28 aa, Mycobacterium tuberculosis
IRADPGIPARGIVAVCDFGGSGTGITLV

SEQ ID NO: 1382028 - protein, 19 aa, Mycobacterium tuberculosis
IRALTGLRIVAAVWVVLFH

SEQ ID NO: 1382029 - protein, 25 aa, Mycobacterium tuberculosis
IRARSRLQAHAFWDIATFLINGSLW

SEQ ID NO: 1382030 - protein, 27 aa, Mycobacterium tuberculosis
IREGRSFRSAVPRGWARARKTIVSGNA

SEQ ID NO: 1382031 - protein, 18 aa, Mycobacterium tuberculosis
IRGAIGFSSFGVLVYYAI

SEQ ID NO: 1382032 - protein, 28 aa, Mycobacterium tuberculosis
IRGATPRPRPRWGTPALAAPAPHGALAG

SEQ ID NO: 1382033 - protein, 18 aa, Mycobacterium tuberculosis
IRHVIGIGTPKAVDLWLD

SEQ ID NO: 1382034 - protein, 21 aa, Mycobacterium tuberculosis
IRIPAVASRSGDLPPAVTVPD

SEQ ID NO: 1382035 - protein, 27 aa, Mycobacterium tuberculosis
IRLAAIPILLCWLGFTVFVSVAVPPLE

SEQ ID NO: 1382036 - protein, 25 aa, Mycobacterium tuberculosis
IRNRFAVHHSRWHFAVLYTFLSMVN

SEQ ID NO: 1382037 - protein, 29 aa, Mycobacterium tuberculosis
IRRAARGWVRSRFTFARIGLHSRRNLTLY

SEQ ID NO: 1382038 - protein, 25 aa, Mycobacterium tuberculosis
IRRRLRGRRVIKMVQAMRHGVLPKT

SEQ ID NO: 1382039 - protein, 19 aa, Mycobacterium tuberculosis
IRRRRRVAGGFALSLLVVV

SEQ ID NO: 1382040 - protein, 18 aa, Mycobacterium tuberculosis
IRRSACVERYRSDGFKRL

SEQ ID NO: 1382041 - protein, 18 aa, Mycobacterium tuberculosis
IRTAELVAIVSVGGGANI

SEQ ID NO: 1382042 - protein, 18 aa, Mycobacterium tuberculosis
IRTVRFWMAPIATTLALM

SEQ ID NO: 1382043 - protein, 17 aa, Mycobacterium tuberculosis
IRVGHRIGSAALIADGL

SEQ ID NO: 1382044 - protein, 18 aa, Mycobacterium tuberculosis
IRVHPLLAVGLNIVAVSG

SEQ ID NO: 1382045 - protein, 34 aa, Mycobacterium tuberculosis
ISGLVGRSSVVYDMWGAAVSLVYQMHSGSPQPGI

SEQ ID NO: 1382046 - protein, 24 aa, Mycobacterium tuberculosis
ISRKRNLVEYGFRLPSACDNRPLT

SEQ ID NO: 1382047 - protein, 17 aa, Mycobacterium tuberculosis
ISSRVTVAWNIVGYLVY

SEQ ID NO: 1382048 - protein, 20 aa, Mycobacterium tuberculosis
ISTISFGTPYGFVEINDQRQ

SEQ ID NO: 1382049 - protein, 19 aa, Mycobacterium tuberculosis
ITAEALAPTGGWCCVAGLR

SEQ ID NO: 1382050 - protein, 17 aa, Mycobacterium tuberculosis
ITFEAVGDWQLWVFKSD

SEQ ID NO: 1382051 - protein, 20 aa, Mycobacterium tuberculosis
ITFGALWLLYRYYRTGDPLF

SEQ ID NO: 1382052 - protein, 26 aa, Mycobacterium tuberculosis
ITFGALWLLYRYYRTGDPLFWFTTSS

SEQ ID NO: 1382053 - protein, 21 aa, Mycobacterium tuberculosis
ITGFARIVLLAAILGAALASS

SEQ ID NO: 1382054 - protein, 24 aa, Mycobacterium tuberculosis
ITGFARIVLLSAILGAALASSFSV

SEQ ID NO: 1382055 - protein, 23 aa, Mycobacterium tuberculosis
ITGGVAAVYAWLRRRRRPPDSSS

SEQ ID NO: 1382056 - protein, 18 aa, Mycobacterium tuberculosis
ITGRIKELLVVDGANHYP

SEQ ID NO: 1382057 - protein, 22 aa, Mycobacterium tuberculosis
ITLLNGVVLKFAMNSMNSTFAA

SEQ ID NO: 1382058 - protein, 25 aa, Mycobacterium tuberculosis
ITPATPWTVPKFYWTVLGLSALISG

SEQ ID NO: 1382059 - protein, 18 aa, Mycobacterium tuberculosis
ITPFPFGELAKFLEMAAQ

SEQ ID NO: 1382060 - protein, 24 aa, Mycobacterium tuberculosis
ITPSEAFTAWEFVDGYDVAQAVVV

SEQ ID NO: 1382061 - protein, 24 aa, Mycobacterium tuberculosis
ITTRIVRASIRWAIEERAPSQADG

SEQ ID NO: 1382062 - protein, 17 aa, Mycobacterium tuberculosis
ITTVCGFRSRLYAERWC

SEQ ID NO: 1382063 - protein, 18 aa, Mycobacterium tuberculosis
ITYRIKLEVSFKMRPAQP

SEQ ID NO: 1382064 - protein, 20 aa, Mycobacterium tuberculosis
ITYRWCIGLQRSDRSVLEHG

SEQ ID NO: 1382065 - protein, 26 aa, Mycobacterium tuberculosis
IVAAAGYLVLRPSWSPTQASGQTVLP

SEQ ID NO: 1382066 - protein, 19 aa, Mycobacterium tuberculosis
IVAAVLCHRLVVLIGVTLI

SEQ ID NO: 1382067 - protein, 20 aa, Mycobacterium tuberculosis
IVAAVLCHRLVVLIGVTLIV

SEQ ID NO: 1382068 - protein, 25 aa, Mycobacterium tuberculosis
IVAQSCWARIQLFLHGGDFGVRDPQ

SEQ ID NO: 1382069 - protein, 22 aa, Mycobacterium tuberculosis
IVATARPSALWNQATWWQSIAV

SEQ ID NO: 1382070 - protein, 22 aa, Mycobacterium tuberculosis
IVDEPFLAPARIDLTALRAHAV

SEQ ID NO: 1382071 - protein, 31 aa, Mycobacterium tuberculosis
IVFAGLFAWLYQRTRVTASYRLTAPAASSKP

SEQ ID NO: 1382072 - protein, 25 aa, Mycobacterium tuberculosis
IVGHDRLRLALLLCAVRPEIGGALI

SEQ ID NO: 1382073 - protein, 22 aa, Mycobacterium tuberculosis
IVGIAAVCLVFIVMLMITQSLI

SEQ ID NO: 1382074 - protein, 17 aa, Mycobacterium tuberculosis
IVGIGALIWAASLLWYL

SEQ ID NO: 1382075 - protein, 18 aa, Mycobacterium tuberculosis
IVGIGALIWAASLLWYLK

SEQ ID NO: 1382076 - protein, 20 aa, Mycobacterium tuberculosis
IVGRTMLVWLLCSGVPNVGV

SEQ ID NO: 1382077 - protein, 21 aa, Mycobacterium tuberculosis
IVSALHRPVPLSGEGSDTDTV

SEQ ID NO: 1382078 - protein, 21 aa, Mycobacterium tuberculosis
IWKAGMFHTLIAVAVILTVIR

SEQ ID NO: 1382079 - protein, 23 aa, Mycobacterium tuberculosis
IWQHILGIELHWLVLAMAVIILL

SEQ ID NO: 1382080 - protein, 17 aa, Mycobacterium tuberculosis
IYAEAFGAAAIGRASVM

SEQ ID NO: 1382081 - protein, 18 aa, Mycobacterium tuberculosis
IYTDAPWWVTFGVAPAYA

SEQ ID NO: 1382082 - protein, 19 aa, Mycobacterium tuberculosis
IYYPRYLILTAPAAAVILA

SEQ ID NO: 1382083 - protein, 18 aa, Mycobacterium tuberculosis
IYYPVSWIMWVWYRLFAF

SEQ ID NO: 1382084 - protein, 26 aa, Mycobacterium tuberculosis
IYYSPRLFAAMGFAGYFAMLALPAMV

SEQ ID NO: 1382085 - protein, 18 aa, Mycobacterium tuberculosis
KAIELITLRGFHRDRDLA

SEQ ID NO: 1382086 - protein, 24 aa, Mycobacterium tuberculosis
KAKTYRWTFADVKGSPPTITVIDT

SEQ ID NO: 1382087 - protein, 25 aa, Mycobacterium tuberculosis
KANVRRFVDDISFVVSKQSRDRLKM

SEQ ID NO: 1382088 - protein, 18 aa, Mycobacterium tuberculosis
KCVRVRLRDEFGFPKSEI

SEQ ID NO: 1382089 - protein, 21 aa, Mycobacterium tuberculosis
KDPFVRDGFQQVYSINTGQVA

SEQ ID NO: 1382090 - protein, 18 aa, Mycobacterium tuberculosis
KDRIYDILVQVAAMNTSI

SEQ ID NO: 1382091 - protein, 17 aa, Mycobacterium tuberculosis
KDVRFVGLIDAVRAGEE

SEQ ID NO: 1382092 - protein, 19 aa, Mycobacterium tuberculosis
KEFPGPWALVPVGATMLMI

SEQ ID NO: 1382093 - protein, 18 aa, Mycobacterium tuberculosis
KELVIATKMSGEWSKDDV

SEQ ID NO: 1382094 - protein, 19 aa, Mycobacterium tuberculosis
KERPRVIAVDAVPTEVAAT

SEQ ID NO: 1382095 - protein, 17 aa, Mycobacterium tuberculosis
KFAALRFADERTARADL

SEQ ID NO: 1382096 - protein, 18 aa, Mycobacterium tuberculosis
KFRMPLSPFSGYLTLAFL

SEQ ID NO: 1382097 - protein, 31 aa, Mycobacterium tuberculosis
KGASQRLADCIARPLVPSIMIAAALIAGTGS

SEQ ID NO: 1382098 - protein, 22 aa, Mycobacterium tuberculosis
KGISPLGCWPGSSALLTIAVPG

SEQ ID NO: 1382099 - protein, 17 aa, Mycobacterium tuberculosis
KGNPRLDALGVTQQTTV

SEQ ID NO: 1382100 - protein, 19 aa, Mycobacterium tuberculosis
KGVQTGLLWACDLRRGLSP

SEQ ID NO: 1382101 - protein, 17 aa, Mycobacterium tuberculosis
KGVQTGLLWPAIFVAAF

SEQ ID NO: 1382102 - protein, 25 aa, Mycobacterium tuberculosis
KGYRSSWPIERLTMFSDHDSGSHLS

SEQ ID NO: 1382103 - protein, 34 aa, Mycobacterium tuberculosis
KIGPPRLPCGLPRPAACAVAWVPRRSSPLRTEDP

SEQ ID NO: 1382104 - protein, 22 aa, Mycobacterium tuberculosis
KIRPIVRSCCTFGECSALRLVQ

SEQ ID NO: 1382105 - protein, 22 aa, Mycobacterium tuberculosis
KIVVTCPHCFNTIGKEYRQLGA

SEQ ID NO: 1382106 - protein, 18 aa, Mycobacterium tuberculosis
KKDCKQNPIFDPLQPDDP

SEQ ID NO: 1382107 - protein, 21 aa, Mycobacterium tuberculosis
KKKKKNFFFFFFFFFFIFFFF

SEQ ID NO: 1382108 - protein, 18 aa, Mycobacterium tuberculosis
KLGIVWLVLSVFTVMIIV

SEQ ID NO: 1382109 - protein, 27 aa, Mycobacterium tuberculosis
KLLVVFGISVLLTFYPGWVTIGMMAAL

SEQ ID NO: 1382110 - protein, 25 aa, Mycobacterium tuberculosis
KLTRRSRILIMIALGVIVLLLAGPR

SEQ ID NO: 1382111 - protein, 19 aa, Mycobacterium tuberculosis
KPAAVPLEVPVRVTPGPDD

SEQ ID NO: 1382112 - protein, 24 aa, Mycobacterium tuberculosis
KPSYGMAEAVVYLATTKAGSPPTS

SEQ ID NO: 1382113 - protein, 17 aa, Mycobacterium tuberculosis
KPVIFWTPDHGAFVVRG

SEQ ID NO: 1382114 - protein, 19 aa, Mycobacterium tuberculosis
KQLGRGYEYLDLDPETGHD

SEQ ID NO: 1382115 - protein, 17 aa, Mycobacterium tuberculosis
KRAPTVKLCESDAPYLP

SEQ ID NO: 1382116 - protein, 18 aa, Mycobacterium tuberculosis
KRFGPLTPPRAVAIITQI

SEQ ID NO: 1382117 - protein, 28 aa, Mycobacterium tuberculosis
KRLPRLTRMQRFWISLYFPLTMRSLCNA

SEQ ID NO: 1382118 - protein, 18 aa, Mycobacterium tuberculosis
KRLSALLNTSGLPAVLEP

SEQ ID NO: 1382119 - protein, 17 aa, Mycobacterium tuberculosis
KRMGRPARLAYWAQAEI

SEQ ID NO: 1382120 - protein, 24 aa, Mycobacterium tuberculosis
KRPSRWRHVPAILLVLSLLLFTIA

SEQ ID NO: 1382121 - protein, 18 aa, Mycobacterium tuberculosis
KRRARRDPLTVFLVLIIV

SEQ ID NO: 1382122 - protein, 23 aa, Mycobacterium tuberculosis
KRRLKTRAGVVWVPQSCAGPGQF

SEQ ID NO: 1382123 - protein, 18 aa, Mycobacterium tuberculosis
KRVAVLFAGPGMNLAICL

SEQ ID NO: 1382124 - protein, 19 aa, Mycobacterium tuberculosis
KRVNLRAGQQVRIDQGPAA

SEQ ID NO: 1382125 - protein, 23 aa, Mycobacterium tuberculosis
KRWRVDIDGTLSFLLLPRLTTVL

SEQ ID NO: 1382126 - protein, 20 aa, Mycobacterium tuberculosis
KSATTAWLIERLQRPTLVMA

SEQ ID NO: 1382127 - protein, 25 aa, Mycobacterium tuberculosis
KSNQRLKRFGAMAARDGALCADQPA

SEQ ID NO: 1382128 - protein, 26 aa, Mycobacterium tuberculosis
KSPPIPWYRLPAVIITGTTVAVLLVG

SEQ ID NO: 1382129 - protein, 20 aa, Mycobacterium tuberculosis
KTAEVVDAFTTSKVTLSTTG

SEQ ID NO: 1382130 - protein, 22 aa, Mycobacterium tuberculosis
KTPEFRRGMLYAINPVGFGSLL

SEQ ID NO: 1382131 - protein, 32 aa, Mycobacterium tuberculosis
KTRGWRRVGTAVVRWPGPILATSVALALVGLL

SEQ ID NO: 1382132 - protein, 20 aa, Mycobacterium tuberculosis
KVHRHWAFGGGPHRCLGSHL

SEQ ID NO: 1382133 - protein, 22 aa, Mycobacterium tuberculosis
KVHRHWGFGGGPHRCLGSHLAR

SEQ ID NO: 1382134 - protein, 23 aa, Mycobacterium tuberculosis
KVKSCATCRPVVTRCCSSATAST

SEQ ID NO: 1382135 - protein, 22 aa, Mycobacterium tuberculosis
KVNLRGVPTFAIMGSSVVGFLC

SEQ ID NO: 1382136 - protein, 24 aa, Mycobacterium tuberculosis
KVNQAGVIPVIFASSLIYIPNLIT

SEQ ID NO: 1382137 - protein, 19 aa, Mycobacterium tuberculosis
KVPTPLLDFIAPKVAGLSF

SEQ ID NO: 1382138 - protein, 18 aa, Mycobacterium tuberculosis
KVVLDWDALPPVARIELM

SEQ ID NO: 1382139 - protein, 21 aa, Mycobacterium tuberculosis
KVVYRRGFVTRHQVTGWRFVM

SEQ ID NO: 1382140 - protein, 17 aa, Mycobacterium tuberculosis
KVWAVVGAAAIVLVAIV

SEQ ID NO: 1382141 - protein, 26 aa, Mycobacterium tuberculosis
KYFLEFFEQFGFSPAVTVVLALVALQ

SEQ ID NO: 1382142 - protein, 20 aa, Mycobacterium tuberculosis
KYPDGSFWHQWMQTWFTGPQ

SEQ ID NO: 1382143 - protein, 19 aa, Mycobacterium tuberculosis
KYQPEWVPRYACYEDARVI

SEQ ID NO: 1382144 - protein, 17 aa, Mycobacterium tuberculosis
KYRPDFPKRFESIEAAR

SEQ ID NO: 1382145 - protein, 24 aa, Mycobacterium tuberculosis
KYTGLKLGGVYGFYPRFTGPQRST

SEQ ID NO: 1382146 - protein, 19 aa, Mycobacterium tuberculosis
LAAAIAWAGAQVFGPSSPL

SEQ ID NO: 1382147 - protein, 26 aa, Mycobacterium tuberculosis
LAAALAVAVLARWRFRRRPAPARLPL

SEQ ID NO: 1382148 - protein, 17 aa, Mycobacterium tuberculosis
LAAERARTAKIRPIVRS

SEQ ID NO: 1382149 - protein, 17 aa, Mycobacterium tuberculosis
LAALVMFSGAIDRRLDE

SEQ ID NO: 1382150 - protein, 23 aa, Mycobacterium tuberculosis
LAARHYFTYRDVLGFLYAQAKFQ

SEQ ID NO: 1382151 - protein, 25 aa, Mycobacterium tuberculosis
LAARRAWRPVALIPSGATPVRLAEV

SEQ ID NO: 1382152 - protein, 20 aa, Mycobacterium tuberculosis
LAAWATRPGFRVAAILATLI

SEQ ID NO: 1382153 - protein, 21 aa, Mycobacterium tuberculosis
LAAWATRPGFRVAAILATLIV

SEQ ID NO: 1382154 - protein, 18 aa, Mycobacterium tuberculosis
LAAWYHFRMDYAGHTEVK

SEQ ID NO: 1382155 - protein, 20 aa, Mycobacterium tuberculosis
LACATKWSGVYFVLFFGAMA

SEQ ID NO: 1382156 - protein, 18 aa, Mycobacterium tuberculosis
LADHAVGPVVPFPGTGFV

SEQ ID NO: 1382157 - protein, 23 aa, Mycobacterium tuberculosis
LADLDQVWRLARGAGQRVAVIDT

SEQ ID NO: 1382158 - protein, 22 aa, Mycobacterium tuberculosis
LADPRRGFGMFTFVAASDVLGT

SEQ ID NO: 1382159 - protein, 17 aa, Mycobacterium tuberculosis
LADWDFNIRCFSNPALV

SEQ ID NO: 1382160 - protein, 17 aa, Mycobacterium tuberculosis
LAEPQLRSAMVTLAGTE

SEQ ID NO: 1382161 - protein, 23 aa, Mycobacterium tuberculosis
LAERGVHAGLMFSRRRVHVGRGG

SEQ ID NO: 1382162 - protein, 23 aa, Mycobacterium tuberculosis
LAEVSAWLITRAWQMPPVLDLSV

SEQ ID NO: 1382163 - protein, 25 aa, Mycobacterium tuberculosis
LAFATRGWMAFPIMILLASGGIGMP

SEQ ID NO: 1382164 - protein, 19 aa, Mycobacterium tuberculosis
LAFVVSVVWGAPTGIRLGW

SEQ ID NO: 1382165 - protein, 28 aa, Mycobacterium tuberculosis
LAGEETRLRLLVNEMFETMSRRSRSLVD

SEQ ID NO: 1382166 - protein, 17 aa, Mycobacterium tuberculosis
LAGFGWMISSRMVRGMT

SEQ ID NO: 1382167 - protein, 21 aa, Mycobacterium tuberculosis
LAGLAFTLGMVLTSTLMVRPV

SEQ ID NO: 1382168 - protein, 19 aa, Mycobacterium tuberculosis
LAGLPEGLSTVLIGGAQAV

SEQ ID NO: 1382169 - protein, 17 aa, Mycobacterium tuberculosis
LAGLPSYDRWDDTSIGE

SEQ ID NO: 1382170 - protein, 17 aa, Mycobacterium tuberculosis
LAGQWGDRVRPLVGDLT

SEQ ID NO: 1382171 - protein, 17 aa, Mycobacterium tuberculosis
LAGRRIWDAALVAASPL

SEQ ID NO: 1382172 - protein, 23 aa, Mycobacterium tuberculosis
LAGVAFGTFLMRNHFLSLPAEII

SEQ ID NO: 1382173 - protein, 20 aa, Mycobacterium tuberculosis
LAIGIAVSFLAAVTLLPAIL

SEQ ID NO: 1382174 - protein, 29 aa, Mycobacterium tuberculosis
LAKLRLFRVPELLAGSFLLALLAVTAANF

SEQ ID NO: 1382175 - protein, 18 aa, Mycobacterium tuberculosis
LAKRAFAIWGAYLQVAGC

SEQ ID NO: 1382176 - protein, 17 aa, Mycobacterium tuberculosis
LALDAGSGVFFFFFFFI

SEQ ID NO: 1382177 - protein, 18 aa, Mycobacterium tuberculosis
LALGIGIHDITAGYRAYR

SEQ ID NO: 1382178 - protein, 19 aa, Mycobacterium tuberculosis
LALGWWQWTRFQSTSGTFQ

SEQ ID NO: 1382179 - protein, 21 aa, Mycobacterium tuberculosis
LALLRRASLRQAVADGVAIAV

SEQ ID NO: 1382180 - protein, 17 aa, Mycobacterium tuberculosis
LALPLASLVFFGAFIPL

SEQ ID NO: 1382181 - protein, 17 aa, Mycobacterium tuberculosis
LALVDSAAPGTVIDQFV

SEQ ID NO: 1382182 - protein, 18 aa, Mycobacterium tuberculosis
LALVGLLNLPGYRTNYND

SEQ ID NO: 1382183 - protein, 18 aa, Mycobacterium tuberculosis
LAMVFPVIGAFPFTGRMP

SEQ ID NO: 1382184 - protein, 34 aa, Mycobacterium tuberculosis
LANAKRWGVLHVIWRQGYYPGIGAPSWTADYGSE

SEQ ID NO: 1382185 - protein, 20 aa, Mycobacterium tuberculosis
LANGLGFLAGTIVGYYILRR

SEQ ID NO: 1382186 - protein, 26 aa, Mycobacterium tuberculosis
LAPAAWWRQLSWLPQRPVLVPGTVRH

SEQ ID NO: 1382187 - protein, 18 aa, Mycobacterium tuberculosis
LAPLFPMTVVLPLSAFVA

SEQ ID NO: 1382188 - protein, 20 aa, Mycobacterium tuberculosis
LAPRSYRRWPPAVVGISALG

SEQ ID NO: 1382189 - protein, 19 aa, Mycobacterium tuberculosis
LARATWPLRAPRAAMVLWQ

SEQ ID NO: 1382190 - protein, 32 aa, Mycobacterium tuberculosis
LARERGWEIRDFRIARKAARIGVPSALALGAA

SEQ ID NO: 1382191 - protein, 18 aa, Mycobacterium tuberculosis
LARPACDLAGMLTIAQQA

SEQ ID NO: 1382192 - protein, 26 aa, Mycobacterium tuberculosis
LARSRGRLVRSLRPLILLPLVLPPVV

SEQ ID NO: 1382193 - protein, 18 aa, Mycobacterium tuberculosis
LASDRGAGALGFVGTAGK

SEQ ID NO: 1382194 - protein, 25 aa, Mycobacterium tuberculosis
LASDRGAGALGFVVIFWQGVGWAAG

SEQ ID NO: 1382195 - protein, 19 aa, Mycobacterium tuberculosis
LASEMPECQAGIGVAAGQV

SEQ ID NO: 1382196 - protein, 26 aa, Mycobacterium tuberculosis
LASGGVGLLGWAWVVAGAVDLLTTGD

SEQ ID NO: 1382197 - protein, 21 aa, Mycobacterium tuberculosis
LASPCAIGLVTVMLASLTLAP

SEQ ID NO: 1382198 - protein, 22 aa, Mycobacterium tuberculosis
LASPCAIGLVTVMLASLTLAPA

SEQ ID NO: 1382199 - protein, 30 aa, Mycobacterium tuberculosis
LATHYWKPLLLCFLVTLGGTVAFYTYSVNA

SEQ ID NO: 1382200 - protein, 17 aa, Mycobacterium tuberculosis
LAVFVFFGPVAVLGTQY

SEQ ID NO: 1382201 - protein, 19 aa, Mycobacterium tuberculosis
LAVILSYIWGVRVGGLFAA

SEQ ID NO: 1382202 - protein, 18 aa, Mycobacterium tuberculosis
LAVLAILVWWALRHRNRC

SEQ ID NO: 1382203 - protein, 24 aa, Mycobacterium tuberculosis
LAVLSGRVTPYWSVAGRCPAAHGQ

SEQ ID NO: 1382204 - protein, 24 aa, Mycobacterium tuberculosis
LAVPHLPPPLVFAAEPAKTGADVV

SEQ ID NO: 1382205 - protein, 27 aa, Mycobacterium tuberculosis
LAVVFALAATIGFDWTLLVLLATFVLG

SEQ ID NO: 1382206 - protein, 20 aa, Mycobacterium tuberculosis
LAVVFALAATIGFGWTLLVL

SEQ ID NO: 1382207 - protein, 17 aa, Mycobacterium tuberculosis
LAWELMAIASLIPGALR

SEQ ID NO: 1382208 - protein, 17 aa, Mycobacterium tuberculosis
LAWVLGAALLLIAIGFT

SEQ ID NO: 1382209 - protein, 27 aa, Mycobacterium tuberculosis
LAYAGWRMFVRRDWRYAVVLVGYCAGW

SEQ ID NO: 1382210 - protein, 17 aa, Mycobacterium tuberculosis
LAYFFGPVVVFWVLAGM

SEQ ID NO: 1382211 - protein, 18 aa, Mycobacterium tuberculosis
LCSARADVLAAVRDILAE

SEQ ID NO: 1382212 - protein, 17 aa, Mycobacterium tuberculosis
LCVVGARIASGSLSAVL

SEQ ID NO: 1382213 - protein, 21 aa, Mycobacterium tuberculosis
LDAPHWVSFGIVPGYCVLAFI

SEQ ID NO: 1382214 - protein, 26 aa, Mycobacterium tuberculosis
LDEGRPRRLIPLLGLIGCVVLAFALP

SEQ ID NO: 1382215 - protein, 17 aa, Mycobacterium tuberculosis
LDGGRLVRAYLWRRHGD

SEQ ID NO: 1382216 - protein, 21 aa, Mycobacterium tuberculosis
LDGRVVRLGRPGWLDVAELAD

SEQ ID NO: 1382217 - protein, 19 aa, Mycobacterium tuberculosis
LDIFSRYVVGWMVASRESK

SEQ ID NO: 1382218 - protein, 26 aa, Mycobacterium tuberculosis
LDLPVDWEPLGAIAIGYADERQRKAQ

SEQ ID NO: 1382219 - protein, 20 aa, Mycobacterium tuberculosis
LDPALSRWQWLVKCFLAIPH

SEQ ID NO: 1382220 - protein, 27 aa, Mycobacterium tuberculosis
LDPALSRWQWLVKWFLAIPHYIVLFFL

SEQ ID NO: 1382221 - protein, 28 aa, Mycobacterium tuberculosis
LDPALSRWQWLVKWFLAIPHYIVLFFLH

SEQ ID NO: 1382222 - protein, 19 aa, Mycobacterium tuberculosis
LDPRNVAVIGKCYSTHPGV

SEQ ID NO: 1382223 - protein, 17 aa, Mycobacterium tuberculosis
LDQMSWVTPARWGFAAS

SEQ ID NO: 1382224 - protein, 17 aa, Mycobacterium tuberculosis
LDQVWRLTRGAGQRVAV

SEQ ID NO: 1382225 - protein, 20 aa, Mycobacterium tuberculosis
LDRPAEFVVGSAIQVVDRVQ

SEQ ID NO: 1382226 - protein, 18 aa, Mycobacterium tuberculosis
LDRVCMIDGLRIIVLDTS

SEQ ID NO: 1382227 - protein, 21 aa, Mycobacterium tuberculosis
LDRWLLFNWMRWGRALEYLKI

SEQ ID NO: 1382228 - protein, 20 aa, Mycobacterium tuberculosis
LDRWPKGAVIVGMTGLTAAF

SEQ ID NO: 1382229 - protein, 18 aa, Mycobacterium tuberculosis
LDVFWAHFGAALGDIAVA

SEQ ID NO: 1382230 - protein, 17 aa, Mycobacterium tuberculosis
LDVLSSIGQLIRDILDF

SEQ ID NO: 1382231 - protein, 19 aa, Mycobacterium tuberculosis
LDVNPRYISLIPVNVVADI

SEQ ID NO: 1382232 - protein, 22 aa, Mycobacterium tuberculosis
LEAGRPPRRFAPGIMGRTMTVW

SEQ ID NO: 1382233 - protein, 23 aa, Mycobacterium tuberculosis
LEAHLLQPLVMGRAVSIHPLAVV

SEQ ID NO: 1382234 - protein, 17 aa, Mycobacterium tuberculosis
LEFRERFGIEVEELDEY

SEQ ID NO: 1382235 - protein, 20 aa, Mycobacterium tuberculosis
LEMKDLLVVGDIPGFADSLL

SEQ ID NO: 1382236 - protein, 24 aa, Mycobacterium tuberculosis
LEPFRCFYLSAPFVVPKKKEVART

SEQ ID NO: 1382237 - protein, 20 aa, Mycobacterium tuberculosis
LEQELACFLGKPAAVLCSTG

SEQ ID NO: 1382238 - protein, 24 aa, Mycobacterium tuberculosis
LERQWRARMAGLRTNILVATGATL

SEQ ID NO: 1382239 - protein, 25 aa, Mycobacterium tuberculosis
LESIHMSWLRFGHGLVLSSILLWTG

SEQ ID NO: 1382240 - protein, 18 aa, Mycobacterium tuberculosis
LETARPADLLVLLDSLRQ

SEQ ID NO: 1382241 - protein, 23 aa, Mycobacterium tuberculosis
LETARPADLLVLLDSLRQREATL

SEQ ID NO: 1382242 - protein, 19 aa, Mycobacterium tuberculosis
LEVFPQAKFIHIVRDPYVV

SEQ ID NO: 1382243 - protein, 18 aa, Mycobacterium tuberculosis
LFAGPGMNLAICLVLIYA

SEQ ID NO: 1382244 - protein, 23 aa, Mycobacterium tuberculosis
LFALSEMRWAALALGLFSAGLLT

SEQ ID NO: 1382245 - protein, 18 aa, Mycobacterium tuberculosis
LFALWPFTDWCTRSARRS

SEQ ID NO: 1382246 - protein, 19 aa, Mycobacterium tuberculosis
LFALWPFTRLVHAFSAPIA

SEQ ID NO: 1382247 - protein, 24 aa, Mycobacterium tuberculosis
LFANHKKWIGLIIHIGQEGRGANV

SEQ ID NO: 1382248 - protein, 50 aa, Mycobacterium tuberculosis
LFDPKRLLKVRGWRRVGTVVVRWPLPVLVATCAIALVGLLALPGYKTSYN

SEQ ID NO: 1382249 - protein, 20 aa, Mycobacterium tuberculosis
LFGELEFWASLIKVIALVTF

SEQ ID NO: 1382250 - protein, 29 aa, Mycobacterium tuberculosis
LFIAFDQLWRWNSIVALVLSVMVILGLVV

SEQ ID NO: 1382251 - protein, 19 aa, Mycobacterium tuberculosis
LFIMSWLPFYHDMGLVLGV

SEQ ID NO: 1382252 - protein, 24 aa, Mycobacterium tuberculosis
LFLIPPEHAHKLVFAVLRGVAAVA

SEQ ID NO: 1382253 - protein, 18 aa, Mycobacterium tuberculosis
LFPDWVIADGPWVKWYPG

SEQ ID NO: 1382254 - protein, 19 aa, Mycobacterium tuberculosis
LFRGPRAPYLRTMFVVLLS

SEQ ID NO: 1382255 - protein, 18 aa, Mycobacterium tuberculosis
LFTAITFGALWLLYRYYR

SEQ ID NO: 1382256 - protein, 17 aa, Mycobacterium tuberculosis
LFTKQGFGHQIREDGPP

SEQ ID NO: 1382257 - protein, 21 aa, Mycobacterium tuberculosis
LFVAAYVPYVAWLVQASADSA

SEQ ID NO: 1382258 - protein, 25 aa, Mycobacterium tuberculosis
LFVRHEHRAAFPLVDLKLFAEPLYR

SEQ ID NO: 1382259 - protein, 18 aa, Mycobacterium tuberculosis
LGAIVFAGLFAWLYQRTR

SEQ ID NO: 1382260 - protein, 34 aa, Mycobacterium tuberculosis
LGAIVFAGLLAWLYQRTRVTASYRLAAPAGSSKP

SEQ ID NO: 1382261 - protein, 29 aa, Mycobacterium tuberculosis
LGAKGVVGWPVGRGWPVSRSCRRLIRSPT

SEQ ID NO: 1382262 - protein, 27 aa, Mycobacterium tuberculosis
LGAVARRFALSPIPVYLLAGLSLGNGG

SEQ ID NO: 1382263 - protein, 18 aa, Mycobacterium tuberculosis
LGAVIWGVIDALLILTDK

SEQ ID NO: 1382264 - protein, 23 aa, Mycobacterium tuberculosis
LGFAVARPRGWPEAAAAVPAAVI

SEQ ID NO: 1382265 - protein, 17 aa, Mycobacterium tuberculosis
LGGLMVDGLGWRSVFLV

SEQ ID NO: 1382266 - protein, 23 aa, Mycobacterium tuberculosis
LGGLSRIGDWWTQPIVYQKVIVF

SEQ ID NO: 1382267 - protein, 18 aa, Mycobacterium tuberculosis
LGGTIGWADPETGSAFGY

SEQ ID NO: 1382268 - protein, 23 aa, Mycobacterium tuberculosis
LGGTRPGLIPGVIPTMTPPPGMV

SEQ ID NO: 1382269 - protein, 23 aa, Mycobacterium tuberculosis
LGGVLAYACAIGLRRLGKDVRFV

SEQ ID NO: 1382270 - protein, 21 aa, Mycobacterium tuberculosis
LGGWQLGRRLLWLRSGLAEPR

SEQ ID NO: 1382271 - protein, 22 aa, Mycobacterium tuberculosis
LGGWQLGRRLLWLRSGLAEPRS

SEQ ID NO: 1382272 - protein, 22 aa, Mycobacterium tuberculosis
LGHRHGPGWPSAARSFDVYPPW

SEQ ID NO: 1382273 - protein, 19 aa, Mycobacterium tuberculosis
LGHRVADGWLVARAGSLQR

SEQ ID NO: 1382274 - protein, 22 aa, Mycobacterium tuberculosis
LGIGAPPRWRSPPRATTSSWAS

SEQ ID NO: 1382275 - protein, 19 aa, Mycobacterium tuberculosis
LGIPRGRRRLGSAGGPAPW

SEQ ID NO: 1382276 - protein, 19 aa, Mycobacterium tuberculosis
LGLFGSFLLLPSYLQQVLH

SEQ ID NO: 1382277 - protein, 19 aa, Mycobacterium tuberculosis
LGLVRLHIATVLGNITPEA

SEQ ID NO: 1382278 - protein, 20 aa, Mycobacterium tuberculosis
LGLWQKIVFGRRVAETVIAD

SEQ ID NO: 1382279 - protein, 17 aa, Mycobacterium tuberculosis
LGLYVLFLFTQTVRHRD

SEQ ID NO: 1382280 - protein, 22 aa, Mycobacterium tuberculosis
LGPRLDALDVRRLVRRLLGRPD

SEQ ID NO: 1382281 - protein, 18 aa, Mycobacterium tuberculosis
LGQMAVFALGGWMAAQGS

SEQ ID NO: 1382282 - protein, 17 aa, Mycobacterium tuberculosis
LGQPHLSATLGLLPEAD

SEQ ID NO: 1382283 - protein, 25 aa, Mycobacterium tuberculosis
LGQTARLYIRPVLNSMPAQPAAEEP

SEQ ID NO: 1382284 - protein, 20 aa, Mycobacterium tuberculosis
LGRGRLMFRATVQRLRDDET

SEQ ID NO: 1382285 - protein, 25 aa, Mycobacterium tuberculosis
LGRRDLGVAFGWSLFNWIADVACLG

SEQ ID NO: 1382286 - protein, 20 aa, Mycobacterium tuberculosis
LGRRIPPVMVGIVLLATATF

SEQ ID NO: 1382287 - protein, 25 aa, Mycobacterium tuberculosis
LGSALALAGVSAWLITRAWQMPPVL

SEQ ID NO: 1382288 - protein, 17 aa, Mycobacterium tuberculosis
LGSMYGYGISYAVLRCS

SEQ ID NO: 1382289 - protein, 23 aa, Mycobacterium tuberculosis
LGVAELWALLRIYQYQRLFEAVR

SEQ ID NO: 1382290 - protein, 19 aa, Mycobacterium tuberculosis
LGVAFGWSLFNWIADVACL

SEQ ID NO: 1382291 - protein, 27 aa, Mycobacterium tuberculosis
LGVFLAVCLLTAFLLIAVFGEVRFGDG

SEQ ID NO: 1382292 - protein, 20 aa, Mycobacterium tuberculosis
LGVGTGGVFAWVARRAPAAS

SEQ ID NO: 1382293 - protein, 24 aa, Mycobacterium tuberculosis
LGVLSAFGLVFVRFPGRTAVFLVI

SEQ ID NO: 1382294 - protein, 18 aa, Mycobacterium tuberculosis
LGVPTAWLVAPVEAGGKT

SEQ ID NO: 1382295 - protein, 18 aa, Mycobacterium tuberculosis
LGVTVLRLAVIRRGVIPA

SEQ ID NO: 1382296 - protein, 22 aa, Mycobacterium tuberculosis
LGYAANRVVGFALADPDLFTGR

SEQ ID NO: 1382297 - protein, 25 aa, Mycobacterium tuberculosis
LGYIVIGGIAGWLASKIVKGGGSGI

SEQ ID NO: 1382298 - protein, 26 aa, Mycobacterium tuberculosis
LHAAVWWKALLALAVAVALVIGVNYA

SEQ ID NO: 1382299 - protein, 17 aa, Mycobacterium tuberculosis
LHLRAAGRLSVRQPRRA

SEQ ID NO: 1382300 - protein, 23 aa, Mycobacterium tuberculosis
LHRAKGGGLSTLFGGCVQSSLSG

SEQ ID NO: 1382301 - protein, 18 aa, Mycobacterium tuberculosis
LHSKHLHIFLAPINVTFK

SEQ ID NO: 1382302 - protein, 27 aa, Mycobacterium tuberculosis
LHTHLPWLAHHGRWPVGEEWLYQSWAA

SEQ ID NO: 1382303 - protein, 17 aa, Mycobacterium tuberculosis
LHTKVGLMDELDKVKRV

SEQ ID NO: 1382304 - protein, 19 aa, Mycobacterium tuberculosis
LHTRALLLAGEETRLRLLV

SEQ ID NO: 1382305 - protein, 38 aa, Mycobacterium tuberculosis
LIAGLPCLPWFISSNWNLAFGVLPPYWAAKAFWVASDH

SEQ ID NO: 1382306 - protein, 26 aa, Mycobacterium tuberculosis
LIAQVLDWFISFVSGPVFTFLAYLVL

SEQ ID NO: 1382307 - protein, 18 aa, Mycobacterium tuberculosis
LIATGGMGQVWEAVDNRL

SEQ ID NO: 1382308 - protein, 26 aa, Mycobacterium tuberculosis
LICLLAGTARLGFLASLRSRPVLVGY

SEQ ID NO: 1382309 - protein, 18 aa, Mycobacterium tuberculosis
LIDRYWWTALAVTLAITA

SEQ ID NO: 1382310 - protein, 26 aa, Mycobacterium tuberculosis
LIEPDLRAIIELGYDRTGYADVPTPA

SEQ ID NO: 1382311 - protein, 22 aa, Mycobacterium tuberculosis
LIEQPIRRWRPARVPLLPLAAA

SEQ ID NO: 1382312 - protein, 24 aa, Mycobacterium tuberculosis
LIEQPIRRWRPARVSLLPLAAATV

SEQ ID NO: 1382313 - protein, 19 aa, Mycobacterium tuberculosis
LIERLQRPTLVMAPNKTLA

SEQ ID NO: 1382314 - protein, 25 aa, Mycobacterium tuberculosis
LIFHGGVPPLQFWQALDTALDRQVA

SEQ ID NO: 1382315 - protein, 18 aa, Mycobacterium tuberculosis
LIGLALFALWPFTRLVHA

SEQ ID NO: 1382316 - protein, 26 aa, Mycobacterium tuberculosis
LIHDCPKLLQLRTFPTIAIGGDLAGA

SEQ ID NO: 1382317 - protein, 17 aa, Mycobacterium tuberculosis
LIPSSRTSPALDLDALI

SEQ ID NO: 1382318 - protein, 19 aa, Mycobacterium tuberculosis
LIRLQCYEGLTANEALYDW

SEQ ID NO: 1382319 - protein, 24 aa, Mycobacterium tuberculosis
LITALCLFTAVFIMLRRKRIPSVA

SEQ ID NO: 1382320 - protein, 18 aa, Mycobacterium tuberculosis
LITTVCGFRSRLYAERWC

SEQ ID NO: 1382321 - protein, 17 aa, Mycobacterium tuberculosis
LIVELERLYNHAADLGA

SEQ ID NO: 1382322 - protein, 20 aa, Mycobacterium tuberculosis
LIVGGLTFFPALALGPIVEQ

SEQ ID NO: 1382323 - protein, 19 aa, Mycobacterium tuberculosis
LIVVCCYVALVVTNFAWLY

SEQ ID NO: 1382324 - protein, 23 aa, Mycobacterium tuberculosis
LIVVCCYVALVVTNFAWLYPVLT

SEQ ID NO: 1382325 - protein, 17 aa, Mycobacterium tuberculosis
LIYGTAAALVFPTVFFP

SEQ ID NO: 1382326 - protein, 25 aa, Mycobacterium tuberculosis
LKAVAYWLDRYELLSSGRKEPTFTG

SEQ ID NO: 1382327 - protein, 17 aa, Mycobacterium tuberculosis
LKFAMFMLAEYVNMTTV

SEQ ID NO: 1382328 - protein, 21 aa, Mycobacterium tuberculosis
LKIVGKLAQFGSGMLQQVSEK

SEQ ID NO: 1382329 - protein, 23 aa, Mycobacterium tuberculosis
LKMPHPRFLAANVTGGICWAGGT

SEQ ID NO: 1382330 - protein, 19 aa, Mycobacterium tuberculosis
LKMPYPRFLAANITGGICW

SEQ ID NO: 1382331 - protein, 39 aa, Mycobacterium tuberculosis
LKRQCSRIGRGFRCCWSAALARPAIGCADTYTTAKTRRR

SEQ ID NO: 1382332 - protein, 21 aa, Mycobacterium tuberculosis
LKTATGLTLPPTVIFDHPTPT

SEQ ID NO: 1382333 - protein, 18 aa, Mycobacterium tuberculosis
LKTSLEFRERFGIEVEEL

SEQ ID NO: 1382334 - protein, 20 aa, Mycobacterium tuberculosis
LKTVPKRLSALLNTSGLPAV

SEQ ID NO: 1382335 - protein, 23 aa, Mycobacterium tuberculosis
LKTVPKRLSALLNTSGLPTVLEP

SEQ ID NO: 1382336 - protein, 17 aa, Mycobacterium tuberculosis
LLAGPGWVAFGATKQII

SEQ ID NO: 1382337 - protein, 17 aa, Mycobacterium tuberculosis
LLANMLPASIAERLKEP

SEQ ID NO: 1382338 - protein, 17 aa, Mycobacterium tuberculosis
LLARAPRALILDEPLAG

SEQ ID NO: 1382339 - protein, 18 aa, Mycobacterium tuberculosis
LLATLGVGPGRGGHRATA

SEQ ID NO: 1382340 - protein, 17 aa, Mycobacterium tuberculosis
LLDPEARVRTRYLDLAV

SEQ ID NO: 1382341 - protein, 17 aa, Mycobacterium tuberculosis
LLDSRYLVQAKIASGGT

SEQ ID NO: 1382342 - protein, 25 aa, Mycobacterium tuberculosis
LLDSSRLAAGVIRPQLRRAYLEEAV

SEQ ID NO: 1382343 - protein, 26 aa, Mycobacterium tuberculosis
LLDSSRLAAGVIRPQLRRAYLEETVQ

SEQ ID NO: 1382344 - protein, 31 aa, Mycobacterium tuberculosis
LLESIHMSWLRFGHGLVLSSILLWTGVGVML

SEQ ID NO: 1382345 - protein, 24 aa, Mycobacterium tuberculosis
LLEVSARMAVLLAGLSPRLPPALN

SEQ ID NO: 1382346 - protein, 19 aa, Mycobacterium tuberculosis
LLFADLCAIFTPYRWMIEH

SEQ ID NO: 1382347 - protein, 17 aa, Mycobacterium tuberculosis
LLFYVFFEAMLIPMYFL

SEQ ID NO: 1382348 - protein, 23 aa, Mycobacterium tuberculosis
LLGCTPLDPFGWAQATAAATAAT

SEQ ID NO: 1382349 - protein, 18 aa, Mycobacterium tuberculosis
LLGCTPLDPLGWAQATAA

SEQ ID NO: 1382350 - protein, 32 aa, Mycobacterium tuberculosis
LLGDDCWWAPRWARRLQTRIGLGRDPPARRAQ

SEQ ID NO: 1382351 - protein, 17 aa, Mycobacterium tuberculosis
LLGGLPITGVIVRSSAN

SEQ ID NO: 1382352 - protein, 31 aa, Mycobacterium tuberculosis
LLGGWLTDYLSWRWAFWINVPVSISVLTVAA

SEQ ID NO: 1382353 - protein, 17 aa, Mycobacterium tuberculosis
LLGMLVTACFTRPARWT

SEQ ID NO: 1382354 - protein, 21 aa, Mycobacterium tuberculosis
LLGPRLPRILAAVALGVLSLG

SEQ ID NO: 1382355 - protein, 24 aa, Mycobacterium tuberculosis
LLHRAKGGGLSTLFGGGVQSSLSG

SEQ ID NO: 1382356 - protein, 19 aa, Mycobacterium tuberculosis
LLIFLFWPWEFKAADGESD

SEQ ID NO: 1382357 - protein, 17 aa, Mycobacterium tuberculosis
LLLALSIALVSGLVGHS

SEQ ID NO: 1382358 - protein, 24 aa, Mycobacterium tuberculosis
LLLARAVLSPARIVLLDEPVEHLD

SEQ ID NO: 1382359 - protein, 19 aa, Mycobacterium tuberculosis
LLLCGIVPLLPVNQTTATI

SEQ ID NO: 1382360 - protein, 17 aa, Mycobacterium tuberculosis
LLLGMLGSLAYVAPLFG

SEQ ID NO: 1382361 - protein, 20 aa, Mycobacterium tuberculosis
LLLIFLFWPWEFKAADGESD

SEQ ID NO: 1382362 - protein, 17 aa, Mycobacterium tuberculosis
LLLLPVAWYLIVGSHQP

SEQ ID NO: 1382363 - protein, 23 aa, Mycobacterium tuberculosis
LLLPLLNRQWRALVAAVVVPVVV

SEQ ID NO: 1382364 - protein, 17 aa, Mycobacterium tuberculosis
LLLPTITGWSLGRALTG

SEQ ID NO: 1382365 - protein, 18 aa, Mycobacterium tuberculosis
LLLSRLGLQSAAYVELAA

SEQ ID NO: 1382366 - protein, 17 aa, Mycobacterium tuberculosis
LLLVYRSIITVVLLLIT

SEQ ID NO: 1382367 - protein, 25 aa, Mycobacterium tuberculosis
LLLWTVGLCLYGLVMGSVVHGIGDQ

SEQ ID NO: 1382368 - protein, 19 aa, Mycobacterium tuberculosis
LLPPRSHRLWLAVNAAGAL

SEQ ID NO: 1382369 - protein, 18 aa, Mycobacterium tuberculosis
LLQGHWSLLVGYGCLPWV

SEQ ID NO: 1382370 - protein, 20 aa, Mycobacterium tuberculosis
LLRVGARSSYLMGLAVFGLA

SEQ ID NO: 1382371 - protein, 17 aa, Mycobacterium tuberculosis
LLSAIGIAGMDRLVQHN

SEQ ID NO: 1382372 - protein, 18 aa, Mycobacterium tuberculosis
LLSVGGLAYLVWNYGYRQ

SEQ ID NO: 1382373 - protein, 17 aa, Mycobacterium tuberculosis
LLTILGFSLYDTVIVFD

SEQ ID NO: 1382374 - protein, 18 aa, Mycobacterium tuberculosis
LLTILGFSLYDTVIVFDK

SEQ ID NO: 1382375 - protein, 19 aa, Mycobacterium tuberculosis
LLTLFFEIFSASPLLLALI

SEQ ID NO: 1382376 - protein, 18 aa, Mycobacterium tuberculosis
LLTLLLFDIGSFAGLAAL

SEQ ID NO: 1382377 - protein, 25 aa, Mycobacterium tuberculosis
LLVASAWWLFAWELDNGAGLHEART

SEQ ID NO: 1382378 - protein, 34 aa, Mycobacterium tuberculosis
LLVGIECLIAIPLRRDPLLFPFQPIHVTIATWFT

SEQ ID NO: 1382379 - protein, 24 aa, Mycobacterium tuberculosis
LLVIPCLLLAWAVSHPSLPFAVLV

SEQ ID NO: 1382380 - protein, 24 aa, Mycobacterium tuberculosis
LLVSLLVRRRRVWARITPTTAGTV

SEQ ID NO: 1382381 - protein, 26 aa, Mycobacterium tuberculosis
LLVVPGDCWLDWGMNIGRHCFSDYAM

SEQ ID NO: 1382382 - protein, 17 aa, Mycobacterium tuberculosis
LLVVSALATLSGLGTPV

SEQ ID NO: 1382383 - protein, 25 aa, Mycobacterium tuberculosis
LLWQHILAIYLHWLVLAMSVIVLLA

SEQ ID NO: 1382384 - protein, 21 aa, Mycobacterium tuberculosis
LLWWMMVCWSQPLRARPDSQM

SEQ ID NO: 1382385 - protein, 36 aa, Mycobacterium tuberculosis
LLYASFPPRNCWWAAVVALALLAWVLTHRATTPVGG

SEQ ID NO: 1382386 - protein, 24 aa, Mycobacterium tuberculosis
LLYGIARFQGVLPFNPTDKPAVTD

SEQ ID NO: 1382387 - protein, 23 aa, Mycobacterium tuberculosis
LLYLLPLILRLWRGDTTHDRHAA

SEQ ID NO: 1382388 - protein, 18 aa, Mycobacterium tuberculosis
LLYRYYRTGDPLFWFTTS

SEQ ID NO: 1382389 - protein, 19 aa, Mycobacterium tuberculosis
LMIANPFRAGERIGSLFST

SEQ ID NO: 1382390 - protein, 23 aa, Mycobacterium tuberculosis
LMLISGGATGWLYLEQYRPDQQT

SEQ ID NO: 1382391 - protein, 24 aa, Mycobacterium tuberculosis
LMLISGGATGWLYLEQYRPDQQTD

SEQ ID NO: 1382392 - protein, 18 aa, Mycobacterium tuberculosis
LMVFGGQISFCLYMVHEL

SEQ ID NO: 1382393 - protein, 26 aa, Mycobacterium tuberculosis
LMYGEIFTITAIVCVFGAVLGLLISG

SEQ ID NO: 1382394 - protein, 21 aa, Mycobacterium tuberculosis
LNALRLLRHTAWRRAAGTAHR

SEQ ID NO: 1382395 - protein, 19 aa, Mycobacterium tuberculosis
LNARPVFGCMSTRTSCIRA

SEQ ID NO: 1382396 - protein, 23 aa, Mycobacterium tuberculosis
LNERELRAVLGHELSHVYNRDIL

SEQ ID NO: 1382397 - protein, 18 aa, Mycobacterium tuberculosis
LNGVVLKFAMNSMNSTFA

SEQ ID NO: 1382398 - protein, 18 aa, Mycobacterium tuberculosis
LNGWFFGVVYWLFDLSGV

SEQ ID NO: 1382399 - protein, 23 aa, Mycobacterium tuberculosis
LNKFEVIVVPVLLVLMLSALLVP

SEQ ID NO: 1382400 - protein, 25 aa, Mycobacterium tuberculosis
LNLATARFFFFFFFSTRTGCPKSEL

SEQ ID NO: 1382401 - protein, 17 aa, Mycobacterium tuberculosis
LNLLEGVAIGLVVAIVF

SEQ ID NO: 1382402 - protein, 17 aa, Mycobacterium tuberculosis
LNMWASANTGWWPLIWF

SEQ ID NO: 1382403 - protein, 18 aa, Mycobacterium tuberculosis
LNMWASANTGWWPLIWFT

SEQ ID NO: 1382404 - protein, 25 aa, Mycobacterium tuberculosis
LNNGFHGKWPWQMTHPMDGAVQIDK

SEQ ID NO: 1382405 - protein, 21 aa, Mycobacterium tuberculosis
LNNRRVPVVDIYDAQRVHIGN

SEQ ID NO: 1382406 - protein, 18 aa, Mycobacterium tuberculosis
LNSLMAMAIRREAEQFVG

SEQ ID NO: 1382407 - protein, 19 aa, Mycobacterium tuberculosis
LNSLMAMAIRREAEQFVGI

SEQ ID NO: 1382408 - protein, 17 aa, Mycobacterium tuberculosis
LNVLFSYQGNDMYTALQ

SEQ ID NO: 1382409 - protein, 18 aa, Mycobacterium tuberculosis
LPAGSPVRLCMAAVNRDG

SEQ ID NO: 1382410 - protein, 17 aa, Mycobacterium tuberculosis
LPAILVLASPRGWVAPR

SEQ ID NO: 1382411 - protein, 23 aa, Mycobacterium tuberculosis
LPANHRYLGPVLWSPDVKPPTWW

SEQ ID NO: 1382412 - protein, 20 aa, Mycobacterium tuberculosis
LPAPSFPADATVAAVGAGAA

SEQ ID NO: 1382413 - protein, 18 aa, Mycobacterium tuberculosis
LPAPWRIPLQAGLGSVLV

SEQ ID NO: 1382414 - protein, 22 aa, Mycobacterium tuberculosis
LPDDLLSGLGLRAALSSITLGM

SEQ ID NO: 1382415 - protein, 25 aa, Mycobacterium tuberculosis
LPDLAAGLVCWLLLSREVLPRLGPA

SEQ ID NO: 1382416 - protein, 26 aa, Mycobacterium tuberculosis
LPDTRGRIVLRWLRIAVLIVTGLVTL

SEQ ID NO: 1382417 - protein, 18 aa, Mycobacterium tuberculosis
LPDWSPTSSRTWATKVLA

SEQ ID NO: 1382418 - protein, 17 aa, Mycobacterium tuberculosis
LPFTGLNTPLAVAVDSD

SEQ ID NO: 1382419 - protein, 21 aa, Mycobacterium tuberculosis
LPFVILIGLIVSRQWKLLGAY

SEQ ID NO: 1382420 - protein, 21 aa, Mycobacterium tuberculosis
LPFYHDMGLVLGVCAPIIVGC

SEQ ID NO: 1382421 - protein, 18 aa, Mycobacterium tuberculosis
LPGSWGPDLVGVAGDGGL

SEQ ID NO: 1382422 - protein, 24 aa, Mycobacterium tuberculosis
LPLACCLDGRPPIVPHRRRRRIAA

SEQ ID NO: 1382423 - protein, 25 aa, Mycobacterium tuberculosis
LPLACCLDGRPPIVPHRRRRRIAAL

SEQ ID NO: 1382424 - protein, 17 aa, Mycobacterium tuberculosis
LPLACVEGWSAVRTWSG

SEQ ID NO: 1382425 - protein, 18 aa, Mycobacterium tuberculosis
LPLLFVLYVINFVDRANI

SEQ ID NO: 1382426 - protein, 17 aa, Mycobacterium tuberculosis
LPLPKATRSHRRTLRAV

SEQ ID NO: 1382427 - protein, 21 aa, Mycobacterium tuberculosis
LPLWACGAADLTVRMQYTATS

SEQ ID NO: 1382428 - protein, 20 aa, Mycobacterium tuberculosis
LPMLRMMGGSLDAPHDHHDR

SEQ ID NO: 1382429 - protein, 20 aa, Mycobacterium tuberculosis
LPPGTPPSRRPAVPRGGRRV

SEQ ID NO: 1382430 - protein, 32 aa, Mycobacterium tuberculosis
LPPILPRLIRQFAVVIVLLWLGFTAFVNLAVP

SEQ ID NO: 1382431 - protein, 17 aa, Mycobacterium tuberculosis
LPPPCTTGFLPAQQRRI

SEQ ID NO: 1382432 - protein, 18 aa, Mycobacterium tuberculosis
LPPTRLCASVGVNPTGGL

SEQ ID NO: 1382433 - protein, 20 aa, Mycobacterium tuberculosis
LPREVAVGAVLTYVRAIRTR

SEQ ID NO: 1382434 - protein, 18 aa, Mycobacterium tuberculosis
LPRGLDTVLGRGGVGLSL

SEQ ID NO: 1382435 - protein, 34 aa, Mycobacterium tuberculosis
LPRLRYDQFMALGWKLLIPVSLVWVMVAAIIRSL

SEQ ID NO: 1382436 - protein, 27 aa, Mycobacterium tuberculosis
LPRQFGYNMPLELVLTVIPFLIISVLF

SEQ ID NO: 1382437 - protein, 19 aa, Mycobacterium tuberculosis
LPSDIWKATMDGALKGHVE

SEQ ID NO: 1382438 - protein, 19 aa, Mycobacterium tuberculosis
LPSLGNPLTFLSPANIAFA

SEQ ID NO: 1382439 - protein, 22 aa, Mycobacterium tuberculosis
LPTGCILAWILVRIINVRSFGW

SEQ ID NO: 1382440 - protein, 23 aa, Mycobacterium tuberculosis
LPTGCILAWILVRIINVRSFGWT

SEQ ID NO: 1382441 - protein, 21 aa, Mycobacterium tuberculosis
LPTGCILVWILVRIINVRSFG

SEQ ID NO: 1382442 - protein, 18 aa, Mycobacterium tuberculosis
LPTVCPVCVAGLWSAKAH

SEQ ID NO: 1382443 - protein, 17 aa, Mycobacterium tuberculosis
LPVGLAVTAAVVAPRRF

SEQ ID NO: 1382444 - protein, 22 aa, Mycobacterium tuberculosis
LPVLTCLAAMFIGLAIFAISMD

SEQ ID NO: 1382445 - protein, 17 aa, Mycobacterium tuberculosis
LPVVGAVALALTFAQSP

SEQ ID NO: 1382446 - protein, 21 aa, Mycobacterium tuberculosis
LPWWLRPFARFHADDHFADPF

SEQ ID NO: 1382447 - protein, 20 aa, Mycobacterium tuberculosis
LPYMRERMADMLTMSDEMLV

SEQ ID NO: 1382448 - protein, 21 aa, Mycobacterium tuberculosis
LPYVMGGAMLGMIAIMVAGGT

SEQ ID NO: 1382449 - protein, 18 aa, Mycobacterium tuberculosis
LQAAGLLFFAFAGYARIA

SEQ ID NO: 1382450 - protein, 17 aa, Mycobacterium tuberculosis
LQGGRRFHLRPVPETAV

SEQ ID NO: 1382451 - protein, 17 aa, Mycobacterium tuberculosis
LQGHWSLLVGYGCLPWV

SEQ ID NO: 1382452 - protein, 18 aa, Mycobacterium tuberculosis
LQMPPRPITLMTDSGPQT

SEQ ID NO: 1382453 - protein, 19 aa, Mycobacterium tuberculosis
LQPTVPILLANLVSVGQVA

SEQ ID NO: 1382454 - protein, 17 aa, Mycobacterium tuberculosis
LQQALANQNWAALPGLQ

SEQ ID NO: 1382455 - protein, 19 aa, Mycobacterium tuberculosis
LQSFLPPPFDAIPNPIEDL

SEQ ID NO: 1382456 - protein, 20 aa, Mycobacterium tuberculosis
LRAAIELPLAATIGLAALGG

SEQ ID NO: 1382457 - protein, 20 aa, Mycobacterium tuberculosis
LRAGELLEWAYATVGSSQAG

SEQ ID NO: 1382458 - protein, 24 aa, Mycobacterium tuberculosis
LRCSCTIGPFSRGYRGRACGAVRS

SEQ ID NO: 1382459 - protein, 18 aa, Mycobacterium tuberculosis
LRECTVLGKLATHAEQGR

SEQ ID NO: 1382460 - protein, 20 aa, Mycobacterium tuberculosis
LRENVVALTVLWLLNIGEYL

SEQ ID NO: 1382461 - protein, 27 aa, Mycobacterium tuberculosis
LRFMLREISCIFVAWFVLYLMLVLRAV

SEQ ID NO: 1382462 - protein, 28 aa, Mycobacterium tuberculosis
LRFMLREISCIFVAWFVLYLMLVLRAVG

SEQ ID NO: 1382463 - protein, 18 aa, Mycobacterium tuberculosis
LRGLFTFTETDLARPDTA

SEQ ID NO: 1382464 - protein, 17 aa, Mycobacterium tuberculosis
LRHLIFKVMTANVDGIA

SEQ ID NO: 1382465 - protein, 22 aa, Mycobacterium tuberculosis
LRIECRKAKERLSSSTVTTLTD

SEQ ID NO: 1382466 - protein, 23 aa, Mycobacterium tuberculosis
LRIECRKAKERRSSSTVTTLTDA

SEQ ID NO: 1382467 - protein, 19 aa, Mycobacterium tuberculosis
LRIGDIVLVRPGERISADA

SEQ ID NO: 1382468 - protein, 17 aa, Mycobacterium tuberculosis
LRINLSFADGLPRLATA

SEQ ID NO: 1382469 - protein, 17 aa, Mycobacterium tuberculosis
LRLLPSGGRFIELGKTD

SEQ ID NO: 1382470 - protein, 25 aa, Mycobacterium tuberculosis
LRLLSKLSRLPLGWFTSRGSGSIKK

SEQ ID NO: 1382471 - protein, 17 aa, Mycobacterium tuberculosis
LRLLVVSALATLSGLGT

SEQ ID NO: 1382472 - protein, 17 aa, Mycobacterium tuberculosis
LRLSWHMYRKTAGQGED

SEQ ID NO: 1382473 - protein, 18 aa, Mycobacterium tuberculosis
LRPLAEFEQTAAAIGAGQ

SEQ ID NO: 1382474 - protein, 18 aa, Mycobacterium tuberculosis
LRPLRRVAATAAEVATMP

SEQ ID NO: 1382475 - protein, 32 aa, Mycobacterium tuberculosis
LRPVKPPPRRPAHRVLVGWLSLAAGLLAIAAL

SEQ ID NO: 1382476 - protein, 33 aa, Mycobacterium tuberculosis
LRPVKPPPRRPAHRVLVGWLSLAAGLLAIAALA

SEQ ID NO: 1382477 - protein, 21 aa, Mycobacterium tuberculosis
LRRAGRWWAGYRVQHSALPAR

SEQ ID NO: 1382478 - protein, 18 aa, Mycobacterium tuberculosis
LRRFRSMVRLEPFAFTAV

SEQ ID NO: 1382479 - protein, 19 aa, Mycobacterium tuberculosis
LRRFRSMVRLEPFAFTAVD

SEQ ID NO: 1382480 - protein, 24 aa, Mycobacterium tuberculosis
LRRGLRIALRGRRDPLPVAGRRSR

SEQ ID NO: 1382481 - protein, 19 aa, Mycobacterium tuberculosis
LRRGQKMIIGMRGSYGGVV

SEQ ID NO: 1382482 - protein, 18 aa, Mycobacterium tuberculosis
LRRRLRQHRFEFLADDGR

SEQ ID NO: 1382483 - protein, 17 aa, Mycobacterium tuberculosis
LRSPGPLGIIFSLVCIG

SEQ ID NO: 1382484 - protein, 24 aa, Mycobacterium tuberculosis
LRSRVARIMPAYVVAVVVILSLLP

SEQ ID NO: 1382485 - protein, 18 aa, Mycobacterium tuberculosis
LRSSVGYAAMLLVVTLIA

SEQ ID NO: 1382486 - protein, 17 aa, Mycobacterium tuberculosis
LRSTVPVTLTADRSGLV

SEQ ID NO: 1382487 - protein, 18 aa, Mycobacterium tuberculosis
LRTPLAAIQGYAELTRQD

SEQ ID NO: 1382488 - protein, 18 aa, Mycobacterium tuberculosis
LRTRLLISLAAILVTTIF

SEQ ID NO: 1382489 - protein, 18 aa, Mycobacterium tuberculosis
LRVFERFYRADSSRAHAS

SEQ ID NO: 1382490 - protein, 18 aa, Mycobacterium tuberculosis
LSAFVVFSSMAGIVGTPA

SEQ ID NO: 1382491 - protein, 19 aa, Mycobacterium tuberculosis
LSAKGAKTFAVDAASAYCP

SEQ ID NO: 1382492 - protein, 30 aa, Mycobacterium tuberculosis
LSAKPMWPRGWIIPTSWRFISAASSRVGYG

SEQ ID NO: 1382493 - protein, 24 aa, Mycobacterium tuberculosis
LSALERLRDFAVFKAIGHANALDY

SEQ ID NO: 1382494 - protein, 26 aa, Mycobacterium tuberculosis
LSALLPNSLRWLGFGSSSLWISWVST

SEQ ID NO: 1382495 - protein, 27 aa, Mycobacterium tuberculosis
LSAPLIEHQRHWSLRRGVGASGPQEAA

SEQ ID NO: 1382496 - protein, 25 aa, Mycobacterium tuberculosis
LSAVYMLWLYQRVMTGPVAEGNERI

SEQ ID NO: 1382497 - protein, 22 aa, Mycobacterium tuberculosis
LSDDELFFFAVLLLVAGYESTA

SEQ ID NO: 1382498 - protein, 18 aa, Mycobacterium tuberculosis
LSDQYALACAELGQLLGE

SEQ ID NO: 1382499 - protein, 20 aa, Mycobacterium tuberculosis
LSERQRLRDLFGRYVGEDVA

SEQ ID NO: 1382500 - protein, 19 aa, Mycobacterium tuberculosis
LSFLPALALIFLNCVWVSL

SEQ ID NO: 1382501 - protein, 29 aa, Mycobacterium tuberculosis
LSGPGRYGLDAARGWAHRPFIGSFVALLG

SEQ ID NO: 1382502 - protein, 22 aa, Mycobacterium tuberculosis
LSGYVMRHRRDLLLGFGAALAG

SEQ ID NO: 1382503 - protein, 18 aa, Mycobacterium tuberculosis
LSIGCGLIVAALLVTIQA

SEQ ID NO: 1382504 - protein, 18 aa, Mycobacterium tuberculosis
LSLFRLVYGLLFAGYGSM

SEQ ID NO: 1382505 - protein, 17 aa, Mycobacterium tuberculosis
LSLHRWDLLGPLRYVGL

SEQ ID NO: 1382506 - protein, 19 aa, Mycobacterium tuberculosis
LSLQPGVYAVHWYAGEHAQ

SEQ ID NO: 1382507 - protein, 18 aa, Mycobacterium tuberculosis
LSLTDFPPNFNILHIDGN

SEQ ID NO: 1382508 - protein, 20 aa, Mycobacterium tuberculosis
LSMAPLWFSSYILQLRVPTV

SEQ ID NO: 1382509 - protein, 33 aa, Mycobacterium tuberculosis
LSNLPMGVPLEWNVFFIFSLCYLFGHYGAITAT

SEQ ID NO: 1382510 - protein, 24 aa, Mycobacterium tuberculosis
LSPANIAFALGYPMDIGSYVAFLS

SEQ ID NO: 1382511 - protein, 20 aa, Mycobacterium tuberculosis
LSPDGRCKAFAAAADGTGFS

SEQ ID NO: 1382512 - protein, 18 aa, Mycobacterium tuberculosis
LSPEQWFAFTPPRVPVLE

SEQ ID NO: 1382513 - protein, 19 aa, Mycobacterium tuberculosis
LSPHWGLAVALVVPATRFR

SEQ ID NO: 1382514 - protein, 24 aa, Mycobacterium tuberculosis
LSPYMLMMPLMMSVMMVGGLAGST

SEQ ID NO: 1382515 - protein, 23 aa, Mycobacterium tuberculosis
LSTICSTVWLSAAAYRLPPGGQG

SEQ ID NO: 1382516 - protein, 24 aa, Mycobacterium tuberculosis
LSTLDRFLPVWIGSAMAAGLLLGR

SEQ ID NO: 1382517 - protein, 20 aa, Mycobacterium tuberculosis
LSVGAGLILGRMAYKEDKQN

SEQ ID NO: 1382518 - protein, 17 aa, Mycobacterium tuberculosis
LSVLMLVGGILFQIVTG

SEQ ID NO: 1382519 - protein, 22 aa, Mycobacterium tuberculosis
LSVPHSWNLPPAVRQVAAMFPG

SEQ ID NO: 1382520 - protein, 19 aa, Mycobacterium tuberculosis
LSYFLDLRGPSVAVDTACS

SEQ ID NO: 1382521 - protein, 32 aa, Mycobacterium tuberculosis
LTAAATPGWLEWFINWYLPISQLFYNTVGLPY

SEQ ID NO: 1382522 - protein, 24 aa, Mycobacterium tuberculosis
LTAKLIIWYPHYAWLLLSVYLTVA

SEQ ID NO: 1382523 - protein, 25 aa, Mycobacterium tuberculosis
LTAKLIIWYPHYAWLLLSVYLTVAW

SEQ ID NO: 1382524 - protein, 25 aa, Mycobacterium tuberculosis
LTALMVSTSLAWTGRVAPPGTFGAL

SEQ ID NO: 1382525 - protein, 23 aa, Mycobacterium tuberculosis
LTDRAAGLVARFAGGEPLADFAA

SEQ ID NO: 1382526 - protein, 25 aa, Mycobacterium tuberculosis
LTFRRIAAALGRPMVPIGSPVLRRV

SEQ ID NO: 1382527 - protein, 45 aa, Mycobacterium tuberculosis
LTGMRLHHFGAFYKRSWRANDWMWGRLDGAGWLVHVLLDPRRVRW

SEQ ID NO: 1382528 - protein, 20 aa, Mycobacterium tuberculosis
LTGPWLLRVGFGPDYQTGGA

SEQ ID NO: 1382529 - protein, 17 aa, Mycobacterium tuberculosis
LTIAIQPQTRWEAFANQ

SEQ ID NO: 1382530 - protein, 21 aa, Mycobacterium tuberculosis
LTKHYPGRVVFLGVNLAIALI

SEQ ID NO: 1382531 - protein, 17 aa, Mycobacterium tuberculosis
LTKVILPMIKPAIVVAL

SEQ ID NO: 1382532 - protein, 24 aa, Mycobacterium tuberculosis
LTLAARRTTLIVAHGLAIAEHADR

SEQ ID NO: 1382533 - protein, 25 aa, Mycobacterium tuberculosis
LTLAARRTTLIVAHGLAIAEHADRI

SEQ ID NO: 1382534 - protein, 25 aa, Mycobacterium tuberculosis
LTLLRLVMVPVFLLALFYGGGHHSA

SEQ ID NO: 1382535 - protein, 17 aa, Mycobacterium tuberculosis
LTLPPTVIFDHPTPTAV

SEQ ID NO: 1382536 - protein, 20 aa, Mycobacterium tuberculosis
LTLVAAAGFYCYGLTHVLYL

SEQ ID NO: 1382537 - protein, 24 aa, Mycobacterium tuberculosis
LTLWLHVIDARFARALRLRLLSKL

SEQ ID NO: 1382538 - protein, 20 aa, Mycobacterium tuberculosis
LTMLTRWAPRAPGPIIAVLA

SEQ ID NO: 1382539 - protein, 20 aa, Mycobacterium tuberculosis
LTQACPAVHVLVVDDSSPDG

SEQ ID NO: 1382540 - protein, 21 aa, Mycobacterium tuberculosis
LTRDRTVLVIAHRLHTITRAD

SEQ ID NO: 1382541 - protein, 22 aa, Mycobacterium tuberculosis
LTRDRTVLVIAHRLHTITRADQ

SEQ ID NO: 1382542 - protein, 25 aa, Mycobacterium tuberculosis
LTRYRPRVRVGFASRLADAAVIAHL

SEQ ID NO: 1382543 - protein, 25 aa, Mycobacterium tuberculosis
LTRYRPRVRVGFASRLADAAVIATL

SEQ ID NO: 1382544 - protein, 17 aa, Mycobacterium tuberculosis
LTVLWLLNIGEYLQDPT

SEQ ID NO: 1382545 - protein, 18 aa, Mycobacterium tuberculosis
LVAARFIQLTPVYTGGAV

SEQ ID NO: 1382546 - protein, 28 aa, Mycobacterium tuberculosis
LVAECLRTGAWEGLKPAELAGVVSAVVY

SEQ ID NO: 1382547 - protein, 17 aa, Mycobacterium tuberculosis
LVAFSIFLNRAHTSRTR

SEQ ID NO: 1382548 - protein, 18 aa, Mycobacterium tuberculosis
LVASRWLLRPTAAEALST

SEQ ID NO: 1382549 - protein, 25 aa, Mycobacterium tuberculosis
LVDQWGWRSIFYVNLPMGALVLFLT

SEQ ID NO: 1382550 - protein, 17 aa, Mycobacterium tuberculosis
LVDVIGCSLRLPGIYPS

SEQ ID NO: 1382551 - protein, 18 aa, Mycobacterium tuberculosis
LVEPTILLAVFALSIPAG

SEQ ID NO: 1382552 - protein, 19 aa, Mycobacterium tuberculosis
LVEPTILLAVFALSIPAGS

SEQ ID NO: 1382553 - protein, 20 aa, Mycobacterium tuberculosis
LVFVPRVWVAIVAVATLVAT

SEQ ID NO: 1382554 - protein, 27 aa, Mycobacterium tuberculosis
LVGAVVPHVRWPMWAAHRGGHRRAGGD

SEQ ID NO: 1382555 - protein, 27 aa, Mycobacterium tuberculosis
LVGAVVPHVRWPMWLRTAVATAALAAI

SEQ ID NO: 1382556 - protein, 17 aa, Mycobacterium tuberculosis
LVGPMRVLRDGALKVAH

SEQ ID NO: 1382557 - protein, 17 aa, Mycobacterium tuberculosis
LVGREMIVVAPLIALLL

SEQ ID NO: 1382558 - protein, 19 aa, Mycobacterium tuberculosis
LVGSAIEFYDFLIYGTAAA

SEQ ID NO: 1382559 - protein, 41 aa, Mycobacterium tuberculosis
LVGTPAMWWLAVPVLAYAGWRMFVRRDWRYAVVLVGYCAGW

SEQ ID NO: 1382560 - protein, 22 aa, Mycobacterium tuberculosis
LVGVLCCIGSIVGIVFGAIAIN

SEQ ID NO: 1382561 - protein, 22 aa, Mycobacterium tuberculosis
LVGYCAGWLPWFADIDRQMYFF

SEQ ID NO: 1382562 - protein, 26 aa, Mycobacterium tuberculosis
LVGYRNRIAALFAWGISFMGRARGQM

SEQ ID NO: 1382563 - protein, 24 aa, Mycobacterium tuberculosis
LVHAFSAPIGYLFRPYIIYRSREE

SEQ ID NO: 1382564 - protein, 22 aa, Mycobacterium tuberculosis
LVICLGALLWSFISPSGQLNES

SEQ ID NO: 1382565 - protein, 24 aa, Mycobacterium tuberculosis
LVILLRALVAPIYLIGSVLISYLS

SEQ ID NO: 1382566 - protein, 19 aa, Mycobacterium tuberculosis
LVKDGQPFIPADCLAKGGN

SEQ ID NO: 1382567 - protein, 18 aa, Mycobacterium tuberculosis
LVKRGWMVRSVFDTIDGI

SEQ ID NO: 1382568 - protein, 17 aa, Mycobacterium tuberculosis
LVLELLATLGVALVAVG

SEQ ID NO: 1382569 - protein, 17 aa, Mycobacterium tuberculosis
LVLELLATLGVGPGRGG

SEQ ID NO: 1382570 - protein, 19 aa, Mycobacterium tuberculosis
LVLFLAPTLNGWFFGVVYW

SEQ ID NO: 1382571 - protein, 21 aa, Mycobacterium tuberculosis
LVLGAIGIWIAIRPKPVQPPQ

SEQ ID NO: 1382572 - protein, 17 aa, Mycobacterium tuberculosis
LVLIKWWLLAIPHYLIL

SEQ ID NO: 1382573 - protein, 26 aa, Mycobacterium tuberculosis
LVNRVMKRPVLFAAPIVIIMILLIIP

SEQ ID NO: 1382574 - protein, 19 aa, Mycobacterium tuberculosis
LVPELNRPLLPLPEFQPPA

SEQ ID NO: 1382575 - protein, 17 aa, Mycobacterium tuberculosis
LVQHNALATSGRAVEAA

SEQ ID NO: 1382576 - protein, 17 aa, Mycobacterium tuberculosis
LVRELRADRGPVLLITA

SEQ ID NO: 1382577 - protein, 20 aa, Mycobacterium tuberculosis
LVRHVEKWAKVRGDKLAYRF

SEQ ID NO: 1382578 - protein, 32 aa, Mycobacterium tuberculosis
LVSLVGVLVLLKAVAYWLDRYELLSHTRGGKP

SEQ ID NO: 1382579 - protein, 26 aa, Mycobacterium tuberculosis
LVSSWQMPGGIYAPMMHPWSTGKDVY

SEQ ID NO: 1382580 - protein, 22 aa, Mycobacterium tuberculosis
LVTSPRRWGQPKAGSLSSKEPL

SEQ ID NO: 1382581 - protein, 25 aa, Mycobacterium tuberculosis
LVVPGDCWLDWGMNIGRHCFSDYAM

SEQ ID NO: 1382582 - protein, 17 aa, Mycobacterium tuberculosis
LVVPYPPGFPVLVPGQL

SEQ ID NO: 1382583 - protein, 23 aa, Mycobacterium tuberculosis
LWACDLRRGLSPHWGLAVALVVP

SEQ ID NO: 1382584 - protein, 24 aa, Mycobacterium tuberculosis
LWADSFRLALVAAHDDGDSLRVVY

SEQ ID NO: 1382585 - protein, 17 aa, Mycobacterium tuberculosis
LWARSRPGTVGRHLHHR

SEQ ID NO: 1382586 - protein, 18 aa, Mycobacterium tuberculosis
LWDGKRSPIDLADHAVTS

SEQ ID NO: 1382587 - protein, 19 aa, Mycobacterium tuberculosis
LWHPHIVAVHDRGEFDGQL

SEQ ID NO: 1382588 - protein, 20 aa, Mycobacterium tuberculosis
LWHPHIVAVHDRGEFDGQLW

SEQ ID NO: 1382589 - protein, 22 aa, Mycobacterium tuberculosis
LWISLVVLWLFVLVPMLISKRD

SEQ ID NO: 1382590 - protein, 18 aa, Mycobacterium tuberculosis
LWLHLGWQDIKQRYRRSV

SEQ ID NO: 1382591 - protein, 18 aa, Mycobacterium tuberculosis
LWMLPLLIAPPMYSKDVY

SEQ ID NO: 1382592 - protein, 18 aa, Mycobacterium tuberculosis
LWPAPYLVMDTGASLAPY

SEQ ID NO: 1382593 - protein, 23 aa, Mycobacterium tuberculosis
LWQHILAIHLHWLVLAMSVIVLL

SEQ ID NO: 1382594 - protein, 20 aa, Mycobacterium tuberculosis
LWRRCPAGAWWSRCSPGAIC

SEQ ID NO: 1382595 - protein, 17 aa, Mycobacterium tuberculosis
LWYPYYASYGLLLLPFF

SEQ ID NO: 1382596 - protein, 30 aa, Mycobacterium tuberculosis
LYALLVNRWPLPEAGVRSGLAPAERDTAGQ

SEQ ID NO: 1382597 - protein, 24 aa, Mycobacterium tuberculosis
LYFWLPCLACLLAVAELQLRSLRL

SEQ ID NO: 1382598 - protein, 22 aa, Mycobacterium tuberculosis
LYLRNEVFAAWIEKVDALVQDE

SEQ ID NO: 1382599 - protein, 21 aa, Mycobacterium tuberculosis
LYSIGGILYAVRWPDPWPTTF

SEQ ID NO: 1382600 - protein, 17 aa, Mycobacterium tuberculosis
LYVLFLFTQTVRHRDFF

SEQ ID NO: 1382601 - protein, 31 aa, Mycobacterium tuberculosis
LYVLPWICAPLAIAVMWRWILAPTDGAISTV

SEQ ID NO: 1382602 - protein, 18 aa, Mycobacterium tuberculosis
MAAAAPGCGVSWNLLAGI

SEQ ID NO: 1382603 - protein, 28 aa, Mycobacterium tuberculosis
MAAGIVLACPVWFYQLWAFITPGLYQRE

SEQ ID NO: 1382604 - protein, 21 aa, Mycobacterium tuberculosis
MAAGLLLGRWIPGLHTALEGV

SEQ ID NO: 1382605 - protein, 22 aa, Mycobacterium tuberculosis
MAAGLLLGRWIPGLHTALEGVQ

SEQ ID NO: 1382606 - protein, 21 aa, Mycobacterium tuberculosis
MAALCAVTAIISVVVPFAAGL

SEQ ID NO: 1382607 - protein, 17 aa, Mycobacterium tuberculosis
MAIASLILVLSEHARPQ

SEQ ID NO: 1382608 - protein, 17 aa, Mycobacterium tuberculosis
MALKYLLDTSVIKRLSR

SEQ ID NO: 1382609 - protein, 21 aa, Mycobacterium tuberculosis
MAMAIRREAEQFVGIELSATM

SEQ ID NO: 1382610 - protein, 18 aa, Mycobacterium tuberculosis
MAPTLTWLFAFVVILALS

SEQ ID NO: 1382611 - protein, 20 aa, Mycobacterium tuberculosis
MARVRCWCSVAATDWQPANC

SEQ ID NO: 1382612 - protein, 35 aa, Mycobacterium tuberculosis
MARVRGWRKVGAAIVRWPGPILVGAVALALVGLLN

SEQ ID NO: 1382613 - protein, 35 aa, Mycobacterium tuberculosis
MARVRGWRKVGAAIVRWPGPILVGAVALALVGLLT

SEQ ID NO: 1382614 - protein, 20 aa, Mycobacterium tuberculosis
MAVFALGGWMAAQGSITVGT

SEQ ID NO: 1382615 - protein, 20 aa, Mycobacterium tuberculosis
MCDLWCLRRAVPGGYRTCRS

SEQ ID NO: 1382616 - protein, 17 aa, Mycobacterium tuberculosis
MCPMRSTWCAAAACKSS

SEQ ID NO: 1382617 - protein, 21 aa, Mycobacterium tuberculosis
MDGARWWQLLLRVVLPMLRPT

SEQ ID NO: 1382618 - protein, 20 aa, Mycobacterium tuberculosis
MDGARWWQLLLRVVLPMSRP

SEQ ID NO: 1382619 - protein, 17 aa, Mycobacterium tuberculosis
MDIGSYVAFLSQTFAFI

SEQ ID NO: 1382620 - protein, 26 aa, Mycobacterium tuberculosis
MDPQQRMLLELSWEALERAGIDPTGL

SEQ ID NO: 1382621 - protein, 23 aa, Mycobacterium tuberculosis
MESEFPSELSVLFKNLETKGNPW

SEQ ID NO: 1382622 - protein, 20 aa, Mycobacterium tuberculosis
MFFRGALYTALGRRYPVTIS

SEQ ID NO: 1382623 - protein, 19 aa, Mycobacterium tuberculosis
MFGPPAWAPVVNNVVAIAT

SEQ ID NO: 1382624 - protein, 19 aa, Mycobacterium tuberculosis
MGAGDVKLAIGLGGLTGCF

SEQ ID NO: 1382625 - protein, 22 aa, Mycobacterium tuberculosis
MGAPKASPVERLKEINAATTRA

SEQ ID NO: 1382626 - protein, 17 aa, Mycobacterium tuberculosis
MGFAIARSQPWFRRYMT

SEQ ID NO: 1382627 - protein, 25 aa, Mycobacterium tuberculosis
MGGQGGAGGNGWAAEGITVGIGEQG

SEQ ID NO: 1382628 - protein, 24 aa, Mycobacterium tuberculosis
MGKLFAGACVVWFFVLFDMLDGAM

SEQ ID NO: 1382629 - protein, 19 aa, Mycobacterium tuberculosis
MGLMVGLFIPLFVGCPVIL

SEQ ID NO: 1382630 - protein, 20 aa, Mycobacterium tuberculosis
MGLVIGICAPILGGYPAVLT

SEQ ID NO: 1382631 - protein, 19 aa, Mycobacterium tuberculosis
MGVPLEWNVFMISASCRCR

SEQ ID NO: 1382632 - protein, 17 aa, Mycobacterium tuberculosis
MHQVFLGVRSLLYLNGN

SEQ ID NO: 1382633 - protein, 21 aa, Mycobacterium tuberculosis
MHRSQWWPPNCAGHCRHGYVL

SEQ ID NO: 1382634 - protein, 22 aa, Mycobacterium tuberculosis
MIAGVFCPKMFVAINTISWARL

SEQ ID NO: 1382635 - protein, 23 aa, Mycobacterium tuberculosis
MIGSFPILSVFGFVVMFGGVVYA

SEQ ID NO: 1382636 - protein, 29 aa, Mycobacterium tuberculosis
MITTPTDWPRYGGYALAGVSSFGFGGANA

SEQ ID NO: 1382637 - protein, 17 aa, Mycobacterium tuberculosis
MIVRSALPQSLRKLPPR

SEQ ID NO: 1382638 - protein, 25 aa, Mycobacterium tuberculosis
MIVSFSASCVVVFLIFQNSIRLTCE

SEQ ID NO: 1382639 - protein, 23 aa, Mycobacterium tuberculosis
MKSAEAWAVGFVELITGLVNFEP

SEQ ID NO: 1382640 - protein, 23 aa, Mycobacterium tuberculosis
MKSAEAWAVGFVELIVDILGFNI

SEQ ID NO: 1382641 - protein, 27 aa, Mycobacterium tuberculosis
MKTQGPGAWPKCSSCSQGDAPLGSLTH

SEQ ID NO: 1382642 - protein, 17 aa, Mycobacterium tuberculosis
MLHLTPLVVIVLIALIA

SEQ ID NO: 1382643 - protein, 18 aa, Mycobacterium tuberculosis
MLIPLVPAAVVALALIVA

SEQ ID NO: 1382644 - protein, 17 aa, Mycobacterium tuberculosis
MLLGGRLGDTIGRKRTF

SEQ ID NO: 1382645 - protein, 17 aa, Mycobacterium tuberculosis
MLLPRWLLGSGDEGASA

SEQ ID NO: 1382646 - protein, 27 aa, Mycobacterium tuberculosis
MLLRVGARSSYLMGLAVFGLASLVCAA

SEQ ID NO: 1382647 - protein, 18 aa, Mycobacterium tuberculosis
MLVAAAWLALLGLPLLLV

SEQ ID NO: 1382648 - protein, 19 aa, Mycobacterium tuberculosis
MLVAGRLGDRFGPKNLYLI

SEQ ID NO: 1382649 - protein, 30 aa, Mycobacterium tuberculosis
MMAGLLVSLLVRRRRVWARITPTTAGTVNV

SEQ ID NO: 1382650 - protein, 17 aa, Mycobacterium tuberculosis
MPFHAFFGIALMTMSST

SEQ ID NO: 1382651 - protein, 17 aa, Mycobacterium tuberculosis
MPLHPVAIELLREVGPM

SEQ ID NO: 1382652 - protein, 20 aa, Mycobacterium tuberculosis
MPLSPFSGYLTLAFLAGVLI

SEQ ID NO: 1382653 - protein, 27 aa, Mycobacterium tuberculosis
MPVCGCLSSVRSSRRWCTPVRGLVSMS

SEQ ID NO: 1382654 - protein, 17 aa, Mycobacterium tuberculosis
MQAAAAWQRLANELTAT

SEQ ID NO: 1382655 - protein, 17 aa, Mycobacterium tuberculosis
MQFATGVLIISMVTLVF

SEQ ID NO: 1382656 - protein, 18 aa, Mycobacterium tuberculosis
MQKIIECGTGDFGAQASL

SEQ ID NO: 1382657 - protein, 17 aa, Mycobacterium tuberculosis
MRFDRTNGYTAEFSNVS

SEQ ID NO: 1382658 - protein, 18 aa, Mycobacterium tuberculosis
MRLLQGFAVGGEWAGSAL

SEQ ID NO: 1382659 - protein, 35 aa, Mycobacterium tuberculosis
MRMGWRRIGTAIVRWPGPILAVACAIAVVGLLALP

SEQ ID NO: 1382660 - protein, 19 aa, Mycobacterium tuberculosis
MRSAFYAGYEEADREYMQI

SEQ ID NO: 1382661 - protein, 17 aa, Mycobacterium tuberculosis
MRYRSGGPFADAVAAVR

SEQ ID NO: 1382662 - protein, 26 aa, Mycobacterium tuberculosis
MSGPLHLGGICWRGRNQRPVITGTTV

SEQ ID NO: 1382663 - protein, 24 aa, Mycobacterium tuberculosis
MSGSGAWRRSPPLTARRSSRLRTH

SEQ ID NO: 1382664 - protein, 23 aa, Mycobacterium tuberculosis
MSLHQPYLMGCLSPRNELSQISY

SEQ ID NO: 1382665 - protein, 19 aa, Mycobacterium tuberculosis
MSLNTSYYRLMLKLNGGPQ

SEQ ID NO: 1382666 - protein, 25 aa, Mycobacterium tuberculosis
MSPMSFLRRPARWMQLLATSGRCFS

SEQ ID NO: 1382667 - protein, 17 aa, Mycobacterium tuberculosis
MSREIAELPNIVMVRGL

SEQ ID NO: 1382668 - protein, 23 aa, Mycobacterium tuberculosis
MSRGKLDRTLLLWMLPLLIAPPM

SEQ ID NO: 1382669 - protein, 21 aa, Mycobacterium tuberculosis
MTIDALVWVPRMYYLYGNPSR

SEQ ID NO: 1382670 - protein, 18 aa, Mycobacterium tuberculosis
MTMQEILVTRGADLAEPQ

SEQ ID NO: 1382671 - protein, 19 aa, Mycobacterium tuberculosis
MTPPPGMVRQRPRAGMLAI

SEQ ID NO: 1382672 - protein, 29 aa, Mycobacterium tuberculosis
MTPSIAALMGRWFWWPLRVRSRPARTPTV

SEQ ID NO: 1382673 - protein, 19 aa, Mycobacterium tuberculosis
MTVVLPLSAFVALPAIATV

SEQ ID NO: 1382674 - protein, 21 aa, Mycobacterium tuberculosis
MTWSQLYSRVTAVSAYLISYG

SEQ ID NO: 1382675 - protein, 22 aa, Mycobacterium tuberculosis
MVFASGLLAMFPIAALGALVVY

SEQ ID NO: 1382676 - protein, 25 aa, Mycobacterium tuberculosis
MVHLARIFFTGAFRRPRETNWVIGS

SEQ ID NO: 1382677 - protein, 17 aa, Mycobacterium tuberculosis
MVRLEPFAFTAVDVLIL

SEQ ID NO: 1382678 - protein, 18 aa, Mycobacterium tuberculosis
MVRLEPFAFTAVDVLILT

SEQ ID NO: 1382679 - protein, 22 aa, Mycobacterium tuberculosis
MVSLAELWRSVGVVPDAVIGHS

SEQ ID NO: 1382680 - protein, 17 aa, Mycobacterium tuberculosis
MWLQAAAVMGLYQAASG

SEQ ID NO: 1382681 - protein, 18 aa, Mycobacterium tuberculosis
MWLWRLGYSTVGAGARLL

SEQ ID NO: 1382682 - protein, 25 aa, Mycobacterium tuberculosis
NAFIPRFLFAVSFCGVLVATATYLH

SEQ ID NO: 1382683 - protein, 18 aa, Mycobacterium tuberculosis
NAISSARLAARYPASGGT

SEQ ID NO: 1382684 - protein, 38 aa, Mycobacterium tuberculosis
NDALVVARCEYHPTPACPQTRITGVPGRGPETRTANQL

SEQ ID NO: 1382685 - protein, 17 aa, Mycobacterium tuberculosis
NDEFATFAPGMKTIDDA

SEQ ID NO: 1382686 - protein, 20 aa, Mycobacterium tuberculosis
NDPVAVPWGLSARSAQALTN

SEQ ID NO: 1382687 - protein, 20 aa, Mycobacterium tuberculosis
NDRYYLRAGTPVNRGYAAAD

SEQ ID NO: 1382688 - protein, 20 aa, Mycobacterium tuberculosis
NDRYYLRAGTPVNRGYEAAD

SEQ ID NO: 1382689 - protein, 17 aa, Mycobacterium tuberculosis
NEDGRTAVALGIGAGIG

SEQ ID NO: 1382690 - protein, 19 aa, Mycobacterium tuberculosis
NETDGGFGPSSRIVRFSAA

SEQ ID NO: 1382691 - protein, 20 aa, Mycobacterium tuberculosis
NEWNEYLWPFLMSDDESVAP

SEQ ID NO: 1382692 - protein, 20 aa, Mycobacterium tuberculosis
NGCYGRWPSRRCAAVCRKTS

SEQ ID NO: 1382693 - protein, 23 aa, Mycobacterium tuberculosis
NGFHGKWPWQMTHPMDGAVQIDK

SEQ ID NO: 1382694 - protein, 25 aa, Mycobacterium tuberculosis
NGGGCRRPAAIGATLAWGTRWYVTG

SEQ ID NO: 1382695 - protein, 28 aa, Mycobacterium tuberculosis
NHAILRLLARLAWPPALAGDLGEHHPSG

SEQ ID NO: 1382696 - protein, 20 aa, Mycobacterium tuberculosis
NIVAAVLCHRLVVLIGVTLI

SEQ ID NO: 1382697 - protein, 24 aa, Mycobacterium tuberculosis
NKAWKVTTTYTFRRKVATLVDNVT

SEQ ID NO: 1382698 - protein, 17 aa, Mycobacterium tuberculosis
NKLGYGLVDPVAALTFN

SEQ ID NO: 1382699 - protein, 19 aa, Mycobacterium tuberculosis
NLAPAAWWRQLYVAAAAAG

SEQ ID NO: 1382700 - protein, 17 aa, Mycobacterium tuberculosis
NLEGKEVRFGVGASGLW

SEQ ID NO: 1382701 - protein, 26 aa, Mycobacterium tuberculosis
NLGQTARLYIRPVLNSMPAQLAAEEP

SEQ ID NO: 1382702 - protein, 27 aa, Mycobacterium tuberculosis
NLGQTARLYIRPVLNSMPAQPAAEEPQ

SEQ ID NO: 1382703 - protein, 26 aa, Mycobacterium tuberculosis
NLHDELFDACGWRRLIFATPEELEAA

SEQ ID NO: 1382704 - protein, 26 aa, Mycobacterium tuberculosis
NLLQMAFRFWAFRRWVFPDEFARNPD

SEQ ID NO: 1382705 - protein, 17 aa, Mycobacterium tuberculosis
NLLTLVAAAGFYCYGLT

SEQ ID NO: 1382706 - protein, 22 aa, Mycobacterium tuberculosis
NLPRVNAHGGPGGRPGCWQTIT

SEQ ID NO: 1382707 - protein, 39 aa, Mycobacterium tuberculosis
NLPRVNARGGPGGAPGCWQPITRDLWPAPYLVMDTGASL

SEQ ID NO: 1382708 - protein, 18 aa, Mycobacterium tuberculosis
NLWLPQLSRASVVIGSLV

SEQ ID NO: 1382709 - protein, 20 aa, Mycobacterium tuberculosis
NLYLRYCTRLLGKVKAAHAG

SEQ ID NO: 1382710 - protein, 32 aa, Mycobacterium tuberculosis
NNGLRPESLIALGVLVTWVLVERSIALGRLAP

SEQ ID NO: 1382711 - protein, 19 aa, Mycobacterium tuberculosis
NPEYTCFLQGAKWYLDNGG

SEQ ID NO: 1382712 - protein, 22 aa, Mycobacterium tuberculosis
NPIARLVWRLCKIDGKPSRYRS

SEQ ID NO: 1382713 - protein, 24 aa, Mycobacterium tuberculosis
NPLTWPPAFFSWFAAGMSVGAPPR

SEQ ID NO: 1382714 - protein, 22 aa, Mycobacterium tuberculosis
NPVQFICGGSFDTAAGPSAPDY

SEQ ID NO: 1382715 - protein, 29 aa, Mycobacterium tuberculosis
NQSALRLKGRLLFMPGVMVTSVPWQLTSS

SEQ ID NO: 1382716 - protein, 20 aa, Mycobacterium tuberculosis
NRFPDPKDRCHLATIGVQPL

SEQ ID NO: 1382717 - protein, 19 aa, Mycobacterium tuberculosis
NRGPAFLILFATLMAAAGD

SEQ ID NO: 1382718 - protein, 19 aa, Mycobacterium tuberculosis
NRPYALWVRWCCRCRWDCC

SEQ ID NO: 1382719 - protein, 23 aa, Mycobacterium tuberculosis
NRRAWLYVEGVVLLLVGALVLVL

SEQ ID NO: 1382720 - protein, 22 aa, Mycobacterium tuberculosis
NRWWTWTLLAGPGWVAFGATKQ

SEQ ID NO: 1382721 - protein, 17 aa, Mycobacterium tuberculosis
NSPEVLNLLLVDFKGGA

SEQ ID NO: 1382722 - protein, 19 aa, Mycobacterium tuberculosis
NSSRGNVVIGWPFVGLLAL

SEQ ID NO: 1382723 - protein, 20 aa, Mycobacterium tuberculosis
NSVDAVWKPLLPGYTRPHMR

SEQ ID NO: 1382724 - protein, 17 aa, Mycobacterium tuberculosis
NTRNVFGPPAWAPVVNN

SEQ ID NO: 1382725 - protein, 24 aa, Mycobacterium tuberculosis
NTRSFTGAGIWLGIAAFAAAGVVA

SEQ ID NO: 1382726 - protein, 18 aa, Mycobacterium tuberculosis
NTYSRLALGIGIHDITAG

SEQ ID NO: 1382727 - protein, 17 aa, Mycobacterium tuberculosis
NVAPAYRSSVSASVSGF

SEQ ID NO: 1382728 - protein, 20 aa, Mycobacterium tuberculosis
NVAVIGKCYSTHPGVVDAMR

SEQ ID NO: 1382729 - protein, 17 aa, Mycobacterium tuberculosis
NVFTRINAILGVLLLIV

SEQ ID NO: 1382730 - protein, 18 aa, Mycobacterium tuberculosis
NVIPTAFKWVARVTPSGA

SEQ ID NO: 1382731 - protein, 29 aa, Mycobacterium tuberculosis
NVNAPGVILRLMLAWIPSTGVPLLAIVLA

SEQ ID NO: 1382732 - protein, 22 aa, Mycobacterium tuberculosis
NWIVRRLGIEPAEELRSARTPQ

SEQ ID NO: 1382733 - protein, 18 aa, Mycobacterium tuberculosis
PAAAPIEHWAAGDADPLG

SEQ ID NO: 1382734 - protein, 23 aa, Mycobacterium tuberculosis
PAAWWRQLSCCAAAGAGPRNRRT

SEQ ID NO: 1382735 - protein, 17 aa, Mycobacterium tuberculosis
PADLLVLLDSLRQREAT

SEQ ID NO: 1382736 - protein, 25 aa, Mycobacterium tuberculosis
PADSACAPAAAGVPVVIPVVNDWPN

SEQ ID NO: 1382737 - protein, 20 aa, Mycobacterium tuberculosis
PADVCRRTESAFELAPPCRK

SEQ ID NO: 1382738 - protein, 17 aa, Mycobacterium tuberculosis
PAELAGVVSAVVYETRG

SEQ ID NO: 1382739 - protein, 17 aa, Mycobacterium tuberculosis
PAGGIAFGLFIVTNAAK

SEQ ID NO: 1382740 - protein, 18 aa, Mycobacterium tuberculosis
PAGGIAFGLFIVTNAAKL

SEQ ID NO: 1382741 - protein, 19 aa, Mycobacterium tuberculosis
PAGLGVVFGLAFFQVLLVA

SEQ ID NO: 1382742 - protein, 20 aa, Mycobacterium tuberculosis
PAGLWRWLQRHPPPALHRLT

SEQ ID NO: 1382743 - protein, 21 aa, Mycobacterium tuberculosis
PAGLWRWLQRHPPPALHRLTR

SEQ ID NO: 1382744 - protein, 22 aa, Mycobacterium tuberculosis
PAGNKRKVWAVVGAAAIVLVAI

SEQ ID NO: 1382745 - protein, 19 aa, Mycobacterium tuberculosis
PAGVDEWFICGPLAMATAV

SEQ ID NO: 1382746 - protein, 27 aa, Mycobacterium tuberculosis
PALATLLGRWFWWPRRVDRLARQPQVL

SEQ ID NO: 1382747 - protein, 35 aa, Mycobacterium tuberculosis
PALKYLSYRLFMKRYDARWLVTRMTTITSLDLTPQ

SEQ ID NO: 1382748 - protein, 18 aa, Mycobacterium tuberculosis
PALPRLGIPRGRRRLGSA

SEQ ID NO: 1382749 - protein, 17 aa, Mycobacterium tuberculosis
PALPVGLAVTAAVVAPR

SEQ ID NO: 1382750 - protein, 26 aa, Mycobacterium tuberculosis
PALSAWRFVTVFGVVSLLADVVYEGA

SEQ ID NO: 1382751 - protein, 34 aa, Mycobacterium tuberculosis
PAMGVGRRRCWPGGRPGMRGCLRGEFGRTAYPAK

SEQ ID NO: 1382752 - protein, 18 aa, Mycobacterium tuberculosis
PANPCRRAHHTRGERVHE

SEQ ID NO: 1382753 - protein, 28 aa, Mycobacterium tuberculosis
PAPDSLIRMCLFLGALTFMYISARAVDD

SEQ ID NO: 1382754 - protein, 24 aa, Mycobacterium tuberculosis
PAPEFTDTGAFPFLAVEGPGVYEI

SEQ ID NO: 1382755 - protein, 18 aa, Mycobacterium tuberculosis
PAPPDVIRAIEAQVWDGG

SEQ ID NO: 1382756 - protein, 24 aa, Mycobacterium tuberculosis
PAPSHSPVPLIVAVTLSLLALLLI

SEQ ID NO: 1382757 - protein, 25 aa, Mycobacterium tuberculosis
PAPTACSPQGWALRPPGAAPSSAGC

SEQ ID NO: 1382758 - protein, 17 aa, Mycobacterium tuberculosis
PAPYGPLFLWIGRGISS

SEQ ID NO: 1382759 - protein, 20 aa, Mycobacterium tuberculosis
PARLGLAVVMLSRRRPMLNL

SEQ ID NO: 1382760 - protein, 21 aa, Mycobacterium tuberculosis
PARLGLAVVMLSRRRPMLNLF

SEQ ID NO: 1382761 - protein, 17 aa, Mycobacterium tuberculosis
PARLPLWACGAADLTVR

SEQ ID NO: 1382762 - protein, 26 aa, Mycobacterium tuberculosis
PARRPTLRLRVRWETRGLRWLQSSSR

SEQ ID NO: 1382763 - protein, 17 aa, Mycobacterium tuberculosis
PARTIPRAIPLALGITL

SEQ ID NO: 1382764 - protein, 17 aa, Mycobacterium tuberculosis
PASCPGCRWVGVAADDL

SEQ ID NO: 1382765 - protein, 18 aa, Mycobacterium tuberculosis
PASRMLRQYGPRPKISEL

SEQ ID NO: 1382766 - protein, 18 aa, Mycobacterium tuberculosis
PASSFPHCPVCTTRNGSL

SEQ ID NO: 1382767 - protein, 28 aa, Mycobacterium tuberculosis
PATAQRTKWWPSWAVVRWSGSSGCCSMR

SEQ ID NO: 1382768 - protein, 27 aa, Mycobacterium tuberculosis
PATLKRFVDRFSRFNLREFAIRPAYGL

SEQ ID NO: 1382769 - protein, 26 aa, Mycobacterium tuberculosis
PATPPVCSRLTCPRSPVRHHHSATRT

SEQ ID NO: 1382770 - protein, 17 aa, Mycobacterium tuberculosis
PATRAQLRIAVKHIPGG

SEQ ID NO: 1382771 - protein, 17 aa, Mycobacterium tuberculosis
PAVCFCYQRKKACFSHP

SEQ ID NO: 1382772 - protein, 17 aa, Mycobacterium tuberculosis
PAVFKALFLGFMFAFAI

SEQ ID NO: 1382773 - protein, 23 aa, Mycobacterium tuberculosis
PAVFKALFLGFMFTFAIKAPLWP

SEQ ID NO: 1382774 - protein, 17 aa, Mycobacterium tuberculosis
PAYGWPEAVDCKEPSAR

SEQ ID NO: 1382775 - protein, 22 aa, Mycobacterium tuberculosis
PDARYGRPRLSRRARRRVAIAL

SEQ ID NO: 1382776 - protein, 26 aa, Mycobacterium tuberculosis
PDGDYAVAVARIFSTDVRFIGAGAIA

SEQ ID NO: 1382777 - protein, 17 aa, Mycobacterium tuberculosis
PDGRHVWEYAPRDGNVD

SEQ ID NO: 1382778 - protein, 17 aa, Mycobacterium tuberculosis
PDICFLWDEAWYAFATA

SEQ ID NO: 1382779 - protein, 19 aa, Mycobacterium tuberculosis
PDPNLRPQIVGVFTDLTGP

SEQ ID NO: 1382780 - protein, 23 aa, Mycobacterium tuberculosis
PDRPWHLSFSLLLAGSFVLFSWW

SEQ ID NO: 1382781 - protein, 17 aa, Mycobacterium tuberculosis
PDRVDVVLRSKVDAAWH

SEQ ID NO: 1382782 - protein, 20 aa, Mycobacterium tuberculosis
PDRWDVIGALGCMAGVAVIM

SEQ ID NO: 1382783 - protein, 30 aa, Mycobacterium tuberculosis
PDSSGLPLRAMVMVLLFLGVVFLLLVWQAL

SEQ ID NO: 1382784 - protein, 20 aa, Mycobacterium tuberculosis
PDTNFAWSFVLALLAAALTA

SEQ ID NO: 1382785 - protein, 24 aa, Mycobacterium tuberculosis
PDYQTGGALLAWLTAAAVAIAMLT

SEQ ID NO: 1382786 - protein, 23 aa, Mycobacterium tuberculosis
PEAFIRKPARWMQLLAKHQAPFS

SEQ ID NO: 1382787 - protein, 22 aa, Mycobacterium tuberculosis
PEAPAVPGVVPAPVPIPVPIII

SEQ ID NO: 1382788 - protein, 22 aa, Mycobacterium tuberculosis
PEDVFWSFLEALIITAIVMVSH

SEQ ID NO: 1382789 - protein, 25 aa, Mycobacterium tuberculosis
PEFATYAPGLWRYWAEHLDPDRARR

SEQ ID NO: 1382790 - protein, 21 aa, Mycobacterium tuberculosis
PEGFLSTHLVAGVKPGTIVRL

SEQ ID NO: 1382791 - protein, 18 aa, Mycobacterium tuberculosis
PEGIIALGSLVTYVLIER

SEQ ID NO: 1382792 - protein, 19 aa, Mycobacterium tuberculosis
PELFGMTALVAFSIFLNRA

SEQ ID NO: 1382793 - protein, 18 aa, Mycobacterium tuberculosis
PELGTFLAECPPMAVLTS

SEQ ID NO: 1382794 - protein, 20 aa, Mycobacterium tuberculosis
PELIEGIGRRVLSWANSVRG

SEQ ID NO: 1382795 - protein, 21 aa, Mycobacterium tuberculosis
PEPPGAYSAARGRFNDDITTQ

SEQ ID NO: 1382796 - protein, 20 aa, Mycobacterium tuberculosis
PERFRQALFRALASVVEIWM

SEQ ID NO: 1382797 - protein, 19 aa, Mycobacterium tuberculosis
PEVLRPVARPQPPNAHPVA

SEQ ID NO: 1382798 - protein, 20 aa, Mycobacterium tuberculosis
PEYRTGLIIVGLARCIAMVI

SEQ ID NO: 1382799 - protein, 19 aa, Mycobacterium tuberculosis
PEYWLGRLALERGTAIIYL

SEQ ID NO: 1382800 - protein, 25 aa, Mycobacterium tuberculosis
PFAELGLNSLMAMAIRREAEQFVGI

SEQ ID NO: 1382801 - protein, 18 aa, Mycobacterium tuberculosis
PFISEFLVLLGTFSRYWL

SEQ ID NO: 1382802 - protein, 34 aa, Mycobacterium tuberculosis
PFISEFLVLLGTFSRYWLAAAFGVTALVLSAVYM

SEQ ID NO: 1382803 - protein, 24 aa, Mycobacterium tuberculosis
PFLTGTGIGWVLARGWRRPTALAP

SEQ ID NO: 1382804 - protein, 20 aa, Mycobacterium tuberculosis
PFNNGLRPEGIIALGSLGHP

SEQ ID NO: 1382805 - protein, 21 aa, Mycobacterium tuberculosis
PFTDITAPWGIAVDEAGTVYV

SEQ ID NO: 1382806 - protein, 18 aa, Mycobacterium tuberculosis
PFYHDMGLVIGICAPILG

SEQ ID NO: 1382807 - protein, 18 aa, Mycobacterium tuberculosis
PFYPPGWFWIGGRAAALT

SEQ ID NO: 1382808 - protein, 23 aa, Mycobacterium tuberculosis
PGCGVSWNLLAGIGRIESMHANG

SEQ ID NO: 1382809 - protein, 18 aa, Mycobacterium tuberculosis
PGDIVLIDRNCHKSHHYG

SEQ ID NO: 1382810 - protein, 17 aa, Mycobacterium tuberculosis
PGGIYAPMMHPWSTGKD

SEQ ID NO: 1382811 - protein, 23 aa, Mycobacterium tuberculosis
PGIPAWRRILDDLSYEPVMAPLR

SEQ ID NO: 1382812 - protein, 18 aa, Mycobacterium tuberculosis
PGIPKAFDAVVARGMAKK

SEQ ID NO: 1382813 - protein, 32 aa, Mycobacterium tuberculosis
PGLPDIPGLPDFKWPPTPGSPLFPAIPGFPAL

SEQ ID NO: 1382814 - protein, 27 aa, Mycobacterium tuberculosis
PGMNLAICLVLIYAIALVWGLPNLHPP

SEQ ID NO: 1382815 - protein, 18 aa, Mycobacterium tuberculosis
PGMRAKLFDAARLAASAI

SEQ ID NO: 1382816 - protein, 22 aa, Mycobacterium tuberculosis
PGPDRRPITAVALVAVGLTLAL

SEQ ID NO: 1382817 - protein, 19 aa, Mycobacterium tuberculosis
PGPGMGWVFGFPGGPPPPG

SEQ ID NO: 1382818 - protein, 19 aa, Mycobacterium tuberculosis
PGQILQGIGVGATFPLLGS

SEQ ID NO: 1382819 - protein, 20 aa, Mycobacterium tuberculosis
PGQILQGIGVGATFPLLGSA

SEQ ID NO: 1382820 - protein, 19 aa, Mycobacterium tuberculosis
PGRIVRLGAQQMIRSRICV

SEQ ID NO: 1382821 - protein, 20 aa, Mycobacterium tuberculosis
PGRMAPIPGRRTRNGSVNGH

SEQ ID NO: 1382822 - protein, 23 aa, Mycobacterium tuberculosis
PGRPHPATGAGIFDRHRTATRVA

SEQ ID NO: 1382823 - protein, 17 aa, Mycobacterium tuberculosis
PGRRRLAKWAGMVVSVL

SEQ ID NO: 1382824 - protein, 17 aa, Mycobacterium tuberculosis
PGSAEWSPPGPPRSASA

SEQ ID NO: 1382825 - protein, 17 aa, Mycobacterium tuberculosis
PGSCWREHWSALWCPMC

SEQ ID NO: 1382826 - protein, 18 aa, Mycobacterium tuberculosis
PGSWAEYVRLMFTNPAAS

SEQ ID NO: 1382827 - protein, 24 aa, Mycobacterium tuberculosis
PGVTVTIGIACHRTGPNAPCVELS

SEQ ID NO: 1382828 - protein, 30 aa, Mycobacterium tuberculosis
PGWAWQGPSAEWYVAAHLPYVAWLTQASAD

SEQ ID NO: 1382829 - protein, 20 aa, Mycobacterium tuberculosis
PGYTAARPSLSFDHDAHAEP

SEQ ID NO: 1382830 - protein, 27 aa, Mycobacterium tuberculosis
PHCAGRAASLPSYIVFLTLQTADGVTI

SEQ ID NO: 1382831 - protein, 23 aa, Mycobacterium tuberculosis
PHDWHRLSPRMLLVHPVHEMLRQ

SEQ ID NO: 1382832 - protein, 19 aa, Mycobacterium tuberculosis
PHIDLPEAWQVIAVALIVY

SEQ ID NO: 1382833 - protein, 19 aa, Mycobacterium tuberculosis
PHPPIPTTPWQHTRHWITT

SEQ ID NO: 1382834 - protein, 21 aa, Mycobacterium tuberculosis
PHTIYSPLFRKFVEWIEYLCL

SEQ ID NO: 1382835 - protein, 18 aa, Mycobacterium tuberculosis
PIAIVGMACRYPGGVNSP

SEQ ID NO: 1382836 - protein, 24 aa, Mycobacterium tuberculosis
PIDLRADWPTALQAAGFDSAAPTA

SEQ ID NO: 1382837 - protein, 19 aa, Mycobacterium tuberculosis
PIFLVGFAVLTARGFLYTL

SEQ ID NO: 1382838 - protein, 22 aa, Mycobacterium tuberculosis
PILLILCRLVQGFATGGEYGTS

SEQ ID NO: 1382839 - protein, 24 aa, Mycobacterium tuberculosis
PIPEIPQLPPGIPQVPGIGQFSAI

SEQ ID NO: 1382840 - protein, 17 aa, Mycobacterium tuberculosis
PIPEIPQLPSRNTSGSR

SEQ ID NO: 1382841 - protein, 23 aa, Mycobacterium tuberculosis
PIPWRLRLRRPTIVLGSVVALLG

SEQ ID NO: 1382842 - protein, 24 aa, Mycobacterium tuberculosis
PIQLLRTAVVVGLVLLQTGCGVGS

SEQ ID NO: 1382843 - protein, 25 aa, Mycobacterium tuberculosis
PIQLLRTAVVVGLVLLQTGCGVGSV

SEQ ID NO: 1382844 - protein, 20 aa, Mycobacterium tuberculosis
PIRHWLRAGELLEWAYATVG

SEQ ID NO: 1382845 - protein, 24 aa, Mycobacterium tuberculosis
PIRRASVTVMEWGLRGTRRAEAAA

SEQ ID NO: 1382846 - protein, 21 aa, Mycobacterium tuberculosis
PIRSYFYWEKHCYDIPVCWSL

SEQ ID NO: 1382847 - protein, 17 aa, Mycobacterium tuberculosis
PIVWAFNCALNVVSTTP

SEQ ID NO: 1382848 - protein, 19 aa, Mycobacterium tuberculosis
PKAETYVRAHIVQRTSSND

SEQ ID NO: 1382849 - protein, 18 aa, Mycobacterium tuberculosis
PKCLVKVIQKLSGLSINR

SEQ ID NO: 1382850 - protein, 17 aa, Mycobacterium tuberculosis
PKDRCHLATIGVQPLVP

SEQ ID NO: 1382851 - protein, 19 aa, Mycobacterium tuberculosis
PKETVSFVAWVVYAAYLHA

SEQ ID NO: 1382852 - protein, 24 aa, Mycobacterium tuberculosis
PKHFRCVSVDLLARRPVVHRQGPL

SEQ ID NO: 1382853 - protein, 20 aa, Mycobacterium tuberculosis
PLALPLASLVFFGAFIPLIG

SEQ ID NO: 1382854 - protein, 26 aa, Mycobacterium tuberculosis
PLARNGFASLWSWFIGLVVTEFPLPT

SEQ ID NO: 1382855 - protein, 27 aa, Mycobacterium tuberculosis
PLARNGFASLWSWFIGLVVTEFPLPTL

SEQ ID NO: 1382856 - protein, 29 aa, Mycobacterium tuberculosis
PLARNGFASLWSWFIGLVVTEFPLPTLAS

SEQ ID NO: 1382857 - protein, 17 aa, Mycobacterium tuberculosis
PLDVGWSLVNTRSLFDH

SEQ ID NO: 1382858 - protein, 21 aa, Mycobacterium tuberculosis
PLGGFCDIAGMTPVEELDPDE

SEQ ID NO: 1382859 - protein, 27 aa, Mycobacterium tuberculosis
PLGLCFLPAFLCVGIVPLVVGLAGDVL

SEQ ID NO: 1382860 - protein, 23 aa, Mycobacterium tuberculosis
PLGRANLYSVCFDLATTDRKLTP

SEQ ID NO: 1382861 - protein, 27 aa, Mycobacterium tuberculosis
PLGVVVGGPFLPLAIILYWFSNNIWTF

SEQ ID NO: 1382862 - protein, 18 aa, Mycobacterium tuberculosis
PLLAHAAIAFIAVEAVLG

SEQ ID NO: 1382863 - protein, 18 aa, Mycobacterium tuberculosis
PLLGRASDRFGRKLMLQV

SEQ ID NO: 1382864 - protein, 19 aa, Mycobacterium tuberculosis
PLLGRASDRFGRKLMLQVS

SEQ ID NO: 1382865 - protein, 22 aa, Mycobacterium tuberculosis
PLLGRASDRFGRKLMLQVSLAG

SEQ ID NO: 1382866 - protein, 18 aa, Mycobacterium tuberculosis
PLLQPLRGIVPEPLLDLI

SEQ ID NO: 1382867 - protein, 24 aa, Mycobacterium tuberculosis
PLMSHLAELGWICVAINYRHSPRN

SEQ ID NO: 1382868 - protein, 25 aa, Mycobacterium tuberculosis
PLMSHLAELGWICVAINYRHSPRNT

SEQ ID NO: 1382869 - protein, 27 aa, Mycobacterium tuberculosis
PLPTEIYWRRRGLALGIAVVVVGIAVA

SEQ ID NO: 1382870 - protein, 19 aa, Mycobacterium tuberculosis
PLRECLRSRCRVRHSRSPV

SEQ ID NO: 1382871 - protein, 18 aa, Mycobacterium tuberculosis
PLRWPRTGPTRRSLMVRP

SEQ ID NO: 1382872 - protein, 17 aa, Mycobacterium tuberculosis
PLRYGAGRIGDLFRIEG

SEQ ID NO: 1382873 - protein, 19 aa, Mycobacterium tuberculosis
PLSPFSGYLTLAFLAGVLI

SEQ ID NO: 1382874 - protein, 20 aa, Mycobacterium tuberculosis
PLWACGAAELTVRMQYTATS

SEQ ID NO: 1382875 - protein, 21 aa, Mycobacterium tuberculosis
PLWTDILLPIVMWALYAWSWH

SEQ ID NO: 1382876 - protein, 18 aa, Mycobacterium tuberculosis
PLYHDMGLMVGLFIPLFV

SEQ ID NO: 1382877 - protein, 19 aa, Mycobacterium tuberculosis
PMFVALRLLPRFVWRRMPR

SEQ ID NO: 1382878 - protein, 26 aa, Mycobacterium tuberculosis
PMGKLFAGACVVWFFVLFDMLDGAMA

SEQ ID NO: 1382879 - protein, 18 aa, Mycobacterium tuberculosis
PMHQVFLGVRSLLYLNGN

SEQ ID NO: 1382880 - protein, 20 aa, Mycobacterium tuberculosis
PMKKMHAVSVPPNYAAALLA

SEQ ID NO: 1382881 - protein, 17 aa, Mycobacterium tuberculosis
PMLAQIPVFLGLYHVLR

SEQ ID NO: 1382882 - protein, 20 aa, Mycobacterium tuberculosis
PMLPGRGWSIFVGVISLIAG

SEQ ID NO: 1382883 - protein, 19 aa, Mycobacterium tuberculosis
PNAADWPLILADASQPLTL

SEQ ID NO: 1382884 - protein, 20 aa, Mycobacterium tuberculosis
PNEDLPLLQPLRGIVPEPLL

SEQ ID NO: 1382885 - protein, 26 aa, Mycobacterium tuberculosis
PNGGGRLAPRPVFRPPVDPASGQAFG

SEQ ID NO: 1382886 - protein, 19 aa, Mycobacterium tuberculosis
PPARSGPEVLVRTPDGTAT

SEQ ID NO: 1382887 - protein, 22 aa, Mycobacterium tuberculosis
PPARSGPEVLVRTPDGTATLGG

SEQ ID NO: 1382888 - protein, 17 aa, Mycobacterium tuberculosis
PPCDFGHRAAGPATTPS

SEQ ID NO: 1382889 - protein, 23 aa, Mycobacterium tuberculosis
PPDLRIPFDPREVIARIVDGSEF

SEQ ID NO: 1382890 - protein, 18 aa, Mycobacterium tuberculosis
PPGPPGRRAWQADTESTA

SEQ ID NO: 1382891 - protein, 24 aa, Mycobacterium tuberculosis
PPGRLPSWLRPRLGDEHARERTPD

SEQ ID NO: 1382892 - protein, 19 aa, Mycobacterium tuberculosis
PPIDERWLPESALPAPPRP

SEQ ID NO: 1382893 - protein, 26 aa, Mycobacterium tuberculosis
PPIPEIPQLPPGIPQVPGIGQFSAIS

SEQ ID NO: 1382894 - protein, 19 aa, Mycobacterium tuberculosis
PPLLKKLRIDPAIVSGPMI

SEQ ID NO: 1382895 - protein, 20 aa, Mycobacterium tuberculosis
PPLPRRPRRYRRGVAAVAAV

SEQ ID NO: 1382896 - protein, 22 aa, Mycobacterium tuberculosis
PPNCAGHCRHGYVLSPPAGSTA

SEQ ID NO: 1382897 - protein, 17 aa, Mycobacterium tuberculosis
PPNSSWPNLDYPGLHAL

SEQ ID NO: 1382898 - protein, 24 aa, Mycobacterium tuberculosis
PPPDHRARNIAIGFVGAVATGVLA

SEQ ID NO: 1382899 - protein, 22 aa, Mycobacterium tuberculosis
PPPEGKPWWLIVVGVVVVGLLG

SEQ ID NO: 1382900 - protein, 22 aa, Mycobacterium tuberculosis
PPPFELPPPFGPGTTTPTPPAP

SEQ ID NO: 1382901 - protein, 23 aa, Mycobacterium tuberculosis
PPPPAECGRVPRSQRRCLCGYLG

SEQ ID NO: 1382902 - protein, 19 aa, Mycobacterium tuberculosis
PPPPPPFFFFFFFFFFFFF

SEQ ID NO: 1382903 - protein, 25 aa, Mycobacterium tuberculosis
PPPVPIPWSVLSLFVPGPTLSRADA

SEQ ID NO: 1382904 - protein, 38 aa, Mycobacterium tuberculosis
PPSRRPAVPRGGRRVSHTWPTARSAARRGLPTLRRPWR

SEQ ID NO: 1382905 - protein, 30 aa, Mycobacterium tuberculosis
PPSSPWRSASAWAPAACSRGWPAAPRPHRS

SEQ ID NO: 1382906 - protein, 25 aa, Mycobacterium tuberculosis
PPVKFTRAAAVWSALIVGFLILILL

SEQ ID NO: 1382907 - protein, 24 aa, Mycobacterium tuberculosis
PQAKRVPGLVVYRYDAPLCFANAE

SEQ ID NO: 1382908 - protein, 17 aa, Mycobacterium tuberculosis
PQLRSAMVTLAGTEPST

SEQ ID NO: 1382909 - protein, 24 aa, Mycobacterium tuberculosis
PQLSRASVVIGSLVVVLALAAGIV

SEQ ID NO: 1382910 - protein, 19 aa, Mycobacterium tuberculosis
PQPVPEPAFKAAIAQATQA

SEQ ID NO: 1382911 - protein, 24 aa, Mycobacterium tuberculosis
PRACRGGPQTHGWAPTPSPGAGPK

SEQ ID NO: 1382912 - protein, 19 aa, Mycobacterium tuberculosis
PRAGGLGRLGDTAVTEPPG

SEQ ID NO: 1382913 - protein, 18 aa, Mycobacterium tuberculosis
PRAPYLRTMFVVLLSTLT

SEQ ID NO: 1382914 - protein, 19 aa, Mycobacterium tuberculosis
PRAPYLRTMFVVLLSTLTL

SEQ ID NO: 1382915 - protein, 19 aa, Mycobacterium tuberculosis
PRDGRRLCTDTNDLKIEAT

SEQ ID NO: 1382916 - protein, 18 aa, Mycobacterium tuberculosis
PRGNLIGIPGAPERMVQN

SEQ ID NO: 1382917 - protein, 18 aa, Mycobacterium tuberculosis
PRIPQVPGIGQFSAISGS

SEQ ID NO: 1382918 - protein, 17 aa, Mycobacterium tuberculosis
PRLACGGAGAAGAATVL

SEQ ID NO: 1382919 - protein, 18 aa, Mycobacterium tuberculosis
PRLARYKLPKKVIFAEAI

SEQ ID NO: 1382920 - protein, 18 aa, Mycobacterium tuberculosis
PRLCAPRLAAPRLTSPTL

SEQ ID NO: 1382921 - protein, 17 aa, Mycobacterium tuberculosis
PRLPLPKATRSHRRTLR

SEQ ID NO: 1382922 - protein, 27 aa, Mycobacterium tuberculosis
PRLSRRARRRVAIALGVLVAAAGIVIA

SEQ ID NO: 1382923 - protein, 17 aa, Mycobacterium tuberculosis
PRMKARAISNWMAIGMV

SEQ ID NO: 1382924 - protein, 17 aa, Mycobacterium tuberculosis
PRPGLPGCVLPRRADDL

SEQ ID NO: 1382925 - protein, 17 aa, Mycobacterium tuberculosis
PRPGYGSAVHAGVLAAT

SEQ ID NO: 1382926 - protein, 25 aa, Mycobacterium tuberculosis
PRPQLTAAFGGALWAARRPGDTSAT

SEQ ID NO: 1382927 - protein, 23 aa, Mycobacterium tuberculosis
PRPSSLAFLGGWLLGLAVVTAVF

SEQ ID NO: 1382928 - protein, 20 aa, Mycobacterium tuberculosis
PRPVVRELLLREGNDDPRTQ

SEQ ID NO: 1382929 - protein, 28 aa, Mycobacterium tuberculosis
PRQWAPYHLRLDWLMWFAAISPGYALPW

SEQ ID NO: 1382930 - protein, 23 aa, Mycobacterium tuberculosis
PRRLRSTVAMRRLVAQTSLEPRH

SEQ ID NO: 1382931 - protein, 19 aa, Mycobacterium tuberculosis
PRRRREWLVAGAGEFVAHA

SEQ ID NO: 1382932 - protein, 17 aa, Mycobacterium tuberculosis
PRRVDRLARQPQVLGPR

SEQ ID NO: 1382933 - protein, 17 aa, Mycobacterium tuberculosis
PRSSNWRAPPCATSTPV

SEQ ID NO: 1382934 - protein, 20 aa, Mycobacterium tuberculosis
PRTGSVVVWYSPRRADRAAV

SEQ ID NO: 1382935 - protein, 20 aa, Mycobacterium tuberculosis
PRTQIGFAVLVIVVVAVLAL

SEQ ID NO: 1382936 - protein, 20 aa, Mycobacterium tuberculosis
PRVLEAIQVLRIRYILTSTP

SEQ ID NO: 1382937 - protein, 18 aa, Mycobacterium tuberculosis
PRVPAEPGGDFVDQAGNG

SEQ ID NO: 1382938 - protein, 18 aa, Mycobacterium tuberculosis
PRVSWPRGAGAAVGDAEH

SEQ ID NO: 1382939 - protein, 17 aa, Mycobacterium tuberculosis
PRWPKSPPQDRRESGPE

SEQ ID NO: 1382940 - protein, 18 aa, Mycobacterium tuberculosis
PSAGTPVGPWLRTGDSGF

SEQ ID NO: 1382941 - protein, 25 aa, Mycobacterium tuberculosis
PSARFTRAVAFAVLGTAFALRAIGD

SEQ ID NO: 1382942 - protein, 17 aa, Mycobacterium tuberculosis
PSATSRWVFEARPDLPT

SEQ ID NO: 1382943 - protein, 19 aa, Mycobacterium tuberculosis
PSGDCRTWVGLTVVADDNL

SEQ ID NO: 1382944 - protein, 27 aa, Mycobacterium tuberculosis
PSIAVRIPPRFWWPQRVRPRPASRMLR

SEQ ID NO: 1382945 - protein, 21 aa, Mycobacterium tuberculosis
PSLDAPLLRQIVNRGVVTAAG

SEQ ID NO: 1382946 - protein, 25 aa, Mycobacterium tuberculosis
PSNTESRWRLGLYAAGRASQIRRLR

SEQ ID NO: 1382947 - protein, 18 aa, Mycobacterium tuberculosis
PSPGFPLTRAERLNVVFL

SEQ ID NO: 1382948 - protein, 22 aa, Mycobacterium tuberculosis
PSPTCIIVGLPAGLAPGRRQRH

SEQ ID NO: 1382949 - protein, 22 aa, Mycobacterium tuberculosis
PSPTCIIVGLPAGLRLAVDNAI

SEQ ID NO: 1382950 - protein, 23 aa, Mycobacterium tuberculosis
PSRPGEKNMPFWGTSFSAAYVSG

SEQ ID NO: 1382951 - protein, 23 aa, Mycobacterium tuberculosis
PSRQSWPAATGVTLVGTNPAALV

SEQ ID NO: 1382952 - protein, 26 aa, Mycobacterium tuberculosis
PSRYYPTWLPSRSFIAAVIAIGGMQL

SEQ ID NO: 1382953 - protein, 29 aa, Mycobacterium tuberculosis
PSSQAPVMWALSASLGWILPVIAQLVWWA

SEQ ID NO: 1382954 - protein, 19 aa, Mycobacterium tuberculosis
PSTLWIWVALTGAAATVLI

SEQ ID NO: 1382955 - protein, 37 aa, Mycobacterium tuberculosis
PSVLRWSRNRMAFLAALFFLLALCWATTNGWWYVSSY

SEQ ID NO: 1382956 - protein, 20 aa, Mycobacterium tuberculosis
PTAPGTPQRPGVTTTAAPPP

SEQ ID NO: 1382957 - protein, 17 aa, Mycobacterium tuberculosis
PTASSDLSVLVRTMCSR

SEQ ID NO: 1382958 - protein, 18 aa, Mycobacterium tuberculosis
PTELGGQPGLWIPSSSIS

SEQ ID NO: 1382959 - protein, 25 aa, Mycobacterium tuberculosis
PTELWSRLPSCLAIGAAAAGVVVFA

SEQ ID NO: 1382960 - protein, 20 aa, Mycobacterium tuberculosis
PTFGDWGFALARLTDIAPTP

SEQ ID NO: 1382961 - protein, 26 aa, Mycobacterium tuberculosis
PTGFSLRRCHGWPANWPLRECLRSRC

SEQ ID NO: 1382962 - protein, 18 aa, Mycobacterium tuberculosis
PTLAAAMKHSWWCTGRCQ

SEQ ID NO: 1382963 - protein, 19 aa, Mycobacterium tuberculosis
PTLAELAANHVIHTVLVAT

SEQ ID NO: 1382964 - protein, 17 aa, Mycobacterium tuberculosis
PTLLRKGERLLVFLPLA

SEQ ID NO: 1382965 - protein, 18 aa, Mycobacterium tuberculosis
PTLPRPGTPAVRPELPTP

SEQ ID NO: 1382966 - protein, 23 aa, Mycobacterium tuberculosis
PTQKEIFIPGGQMFRDLTRLSAA

SEQ ID NO: 1382967 - protein, 28 aa, Mycobacterium tuberculosis
PTRPTRPTCGGARGAPRAASTAGAAGAA

SEQ ID NO: 1382968 - protein, 17 aa, Mycobacterium tuberculosis
PTSSRTWATKVLAAHPG

SEQ ID NO: 1382969 - protein, 17 aa, Mycobacterium tuberculosis
PTTLGWVLAEGHGADGA

SEQ ID NO: 1382970 - protein, 23 aa, Mycobacterium tuberculosis
PTTRLRKDLTWWDLVVFGVSVVI

SEQ ID NO: 1382971 - protein, 17 aa, Mycobacterium tuberculosis
PVAALTWDVPKGPAEPP

SEQ ID NO: 1382972 - protein, 23 aa, Mycobacterium tuberculosis
PVAEERLSALLLNSSEVNAVMGS

SEQ ID NO: 1382973 - protein, 17 aa, Mycobacterium tuberculosis
PVAKARGDEVFAGTVNG

SEQ ID NO: 1382974 - protein, 30 aa, Mycobacterium tuberculosis
PVARLWRGLLVFFSRWWQLETLYRSNMKYQ

SEQ ID NO: 1382975 - protein, 19 aa, Mycobacterium tuberculosis
PVGHPKPRRLVRHAHWPDW

SEQ ID NO: 1382976 - protein, 17 aa, Mycobacterium tuberculosis
PVGPWLRTGDSGFVSED

SEQ ID NO: 1382977 - protein, 18 aa, Mycobacterium tuberculosis
PVGPWLRTGDSGFVSEDK

SEQ ID NO: 1382978 - protein, 24 aa, Mycobacterium tuberculosis
PVIGMAMRAWWETGRSLWWPLAIG

SEQ ID NO: 1382979 - protein, 20 aa, Mycobacterium tuberculosis
PVIGRWDALGFLQDFFATAV

SEQ ID NO: 1382980 - protein, 25 aa, Mycobacterium tuberculosis
PVPFPSFKNGVGLMLQLPQATVVGT

SEQ ID NO: 1382981 - protein, 17 aa, Mycobacterium tuberculosis
PVPRRSTPGPSDRRALH

SEQ ID NO: 1382982 - protein, 18 aa, Mycobacterium tuberculosis
PVPRRSTPGPSDRRALHT

SEQ ID NO: 1382983 - protein, 24 aa, Mycobacterium tuberculosis
PVRQRFFALFLYVVMLVFLVATAP

SEQ ID NO: 1382984 - protein, 24 aa, Mycobacterium tuberculosis
PVRRRWLPRRGPATSRNAPPPSTA

SEQ ID NO: 1382985 - protein, 32 aa, Mycobacterium tuberculosis; identical to SEQ ID NO: 204527

SEQ ID NO: 1382986 - protein, 51 aa, Mycobacterium tuberculosis
PVSILYRLYRPLIFALYCLPLNWLRRKHGLSSLGWDLCRIFTDGDYTLYAD

SEQ ID NO: 1382987 - protein, 26 aa, Mycobacterium tuberculosis
PVSSCAARPTWPPAPEPGCRRSCTEC

SEQ ID NO: 1382988 - protein, 18 aa, Mycobacterium tuberculosis
PVSWKRTSAIWGPIQGVP

SEQ ID NO: 1382989 - protein, 17 aa, Mycobacterium tuberculosis
PVSWLPFYHDMGLMLGI

SEQ ID NO: 1382990 - protein, 23 aa, Mycobacterium tuberculosis
PVSYAIAAMRGFAMGGPVLSPMI

SEQ ID NO: 1382991 - protein, 17 aa, Mycobacterium tuberculosis
PVVGGWTGGRITVSSSS

SEQ ID NO: 1382992 - protein, 18 aa, Mycobacterium tuberculosis
PVVNDWPNDCGDNGAVAA

SEQ ID NO: 1382993 - protein, 18 aa, Mycobacterium tuberculosis
PWALPAQFWLYCGFTAIT

SEQ ID NO: 1382994 - protein, 17 aa, Mycobacterium tuberculosis
PWARPGDQGPLARPPAS

SEQ ID NO: 1382995 - protein, 28 aa, Mycobacterium tuberculosis
PWICAPLAIAVMWRWIVAPTDGAISTVL

SEQ ID NO: 1382996 - protein, 23 aa, Mycobacterium tuberculosis
PWQLSAHRWYTWVIAIVGVDLLY

SEQ ID NO: 1382997 - protein, 29 aa, Mycobacterium tuberculosis
PWVARVGTVVMSWRLRTRHRLPVHDIAPM

SEQ ID NO: 1382998 - protein, 17 aa, Mycobacterium tuberculosis
PWYYRSGYDVLLYTLPF

SEQ ID NO: 1382999 - protein, 18 aa, Mycobacterium tuberculosis
PYAGERWWVLLLSLATAA

SEQ ID NO: 1383000 - protein, 27 aa, Mycobacterium tuberculosis
PYFNTLASPCAIGLVTVMLASLTLAPA

SEQ ID NO: 1383001 - protein, 17 aa, Mycobacterium tuberculosis
PYLTIAFPNRPPQYEEY

SEQ ID NO: 1383002 - protein, 24 aa, Mycobacterium tuberculosis
PYPARTGPKGSLVYKLITTTDHKM

SEQ ID NO: 1383003 - protein, 21 aa, Mycobacterium tuberculosis
PYPPGFPVLVPGQLVSKEIIY

SEQ ID NO: 1383004 - protein, 22 aa, Mycobacterium tuberculosis
PYVLEFYRRARAAADKITPDVE

SEQ ID NO: 1383005 - protein, 23 aa, Mycobacterium tuberculosis
PYVLEFYRRARAAADKITPDVEI

SEQ ID NO: 1383006 - protein, 24 aa, Mycobacterium tuberculosis
QAGDAVACAIPLPAISRLLDDLDV

SEQ ID NO: 1383007 - protein, 24 aa, Mycobacterium tuberculosis
QAGDAVACAIPLPPIARLLDDLDV

SEQ ID NO: 1383008 - protein, 18 aa, Mycobacterium tuberculosis
QAGFTIGIGIVLDTFLVR

SEQ ID NO: 1383009 - protein, 23 aa, Mycobacterium tuberculosis
QAQAAGMLLWFLIALPIGAVTGG

SEQ ID NO: 1383010 - protein, 19 aa, Mycobacterium tuberculosis
QASSILLTLALTVSIVNAM

SEQ ID NO: 1383011 - protein, 32 aa, Mycobacterium tuberculosis
QATGARWLCETFPTCLERGAGIPAVERLAYFA

SEQ ID NO: 1383012 - protein, 17 aa, Mycobacterium tuberculosis
QDVDLRGLFTFTETDLA

SEQ ID NO: 1383013 - protein, 17 aa, Mycobacterium tuberculosis
QDYLVLWISVRRRGRSL

SEQ ID NO: 1383014 - protein, 23 aa, Mycobacterium tuberculosis
QEITRGRCAAIAVPSNGVEKLVA

SEQ ID NO: 1383015 - protein, 21 aa, Mycobacterium tuberculosis
QELRHWLVVLVLTVVGWMLAA

SEQ ID NO: 1383016 - protein, 19 aa, Mycobacterium tuberculosis
QFFARRIGRNEAFNHAGNA

SEQ ID NO: 1383017 - protein, 23 aa, Mycobacterium tuberculosis
QFISETWRLYGVAARNDGIANVD

SEQ ID NO: 1383018 - protein, 21 aa, Mycobacterium tuberculosis
QFMLRLKVGMAAGIVLACPVW

SEQ ID NO: 1383019 - protein, 26 aa, Mycobacterium tuberculosis
QFRRCRRGRGRLGVGRALLVYVRRMG

SEQ ID NO: 1383020 - protein, 22 aa, Mycobacterium tuberculosis
QFWLYCGFTAITMLGFGTFGLL

SEQ ID NO: 1383021 - protein, 19 aa, Mycobacterium tuberculosis
QGCCGAHARPVRHRDGRRR

SEQ ID NO: 1383022 - protein, 22 aa, Mycobacterium tuberculosis
QGGARMGFGFGKSRAKQLSKDM

SEQ ID NO: 1383023 - protein, 17 aa, Mycobacterium tuberculosis
QGISYVLVRNDLDPETS

SEQ ID NO: 1383024 - protein, 19 aa, Mycobacterium tuberculosis
QGLAHPLAQCHIEVELAKL

SEQ ID NO: 1383025 - protein, 17 aa, Mycobacterium tuberculosis
QGLIPSLMWISVPVILG

SEQ ID NO: 1383026 - protein, 23 aa, Mycobacterium tuberculosis
QGRACPRWREPSRGLGIQRSGYG

SEQ ID NO: 1383027 - protein, 17 aa, Mycobacterium tuberculosis
QHDRLRDPPAYGSWLLG

SEQ ID NO: 1383028 - protein, 19 aa, Mycobacterium tuberculosis
QHGAWPWAVLLVVLVVGAF

SEQ ID NO: 1383029 - protein, 24 aa, Mycobacterium tuberculosis
QHGKLAYHAVTYGWLLSGLARAVT

SEQ ID NO: 1383030 - protein, 23 aa, Mycobacterium tuberculosis
QHGRRVALALSFGLRTALAVVLI

SEQ ID NO: 1383031 - protein, 17 aa, Mycobacterium tuberculosis
QHLAQAWRKHIGPPRQL

SEQ ID NO: 1383032 - protein, 20 aa, Mycobacterium tuberculosis
QHPGFPGWQALKVLSPAMAA

SEQ ID NO: 1383033 - protein, 18 aa, Mycobacterium tuberculosis
QIAKSVLIFLGIPLLAGY

SEQ ID NO: 1383034 - protein, 17 aa, Mycobacterium tuberculosis
QIERWARKLNNLAAQTA

SEQ ID NO: 1383035 - protein, 19 aa, Mycobacterium tuberculosis
QKNLNVYGFTKFSQASVDS

SEQ ID NO: 1383036 - protein, 20 aa, Mycobacterium tuberculosis
QKNLNVYGFTKFSQASVDSP

SEQ ID NO: 1383037 - protein, 23 aa, Mycobacterium tuberculosis
QKPVERPAHRWVVVNTDGRSAPA

SEQ ID NO: 1383038 - protein, 24 aa, Mycobacterium tuberculosis
QLALTELWCSYGVQPDLVIGHSMG

SEQ ID NO: 1383039 - protein, 20 aa, Mycobacterium tuberculosis
QLGVPTAWLVAPVEAGGKTQ

SEQ ID NO: 1383040 - protein, 22 aa, Mycobacterium tuberculosis
QLPPPEYLRFPGIGQFSAISGS

SEQ ID NO: 1383041 - protein, 23 aa, Mycobacterium tuberculosis
QLSRASVVIGSLVVVLALAAGIV

SEQ ID NO: 1383042 - protein, 17 aa, Mycobacterium tuberculosis
QMFLGALAFVAGCSVLV

SEQ ID NO: 1383043 - protein, 24 aa, Mycobacterium tuberculosis
QMLKVELPLSIPVLVAGLRVVAVT

SEQ ID NO: 1383044 - protein, 21 aa, Mycobacterium tuberculosis
QPIRSTWWIRHYTFTGTAMGL

SEQ ID NO: 1383045 - protein, 25 aa, Mycobacterium tuberculosis
QPLLAPRLREFALREGLADAQLRLA

SEQ ID NO: 1383046 - protein, 18 aa, Mycobacterium tuberculosis
QPLLTGWLVRRTLLVSTL

SEQ ID NO: 1383047 - protein, 24 aa, Mycobacterium tuberculosis
QPPPEVWSAATFITLAVCLGVGTG

SEQ ID NO: 1383048 - protein, 24 aa, Mycobacterium tuberculosis
QPRPSSLAFLGGWLLGLAVVTAVF

SEQ ID NO: 1383049 - protein, 20 aa, Mycobacterium tuberculosis
QPSAIRPGIPKAFDAVVARG

SEQ ID NO: 1383050 - protein, 18 aa, Mycobacterium tuberculosis
QPYLVAGVLLVFYTATGR

SEQ ID NO: 1383051 - protein, 17 aa, Mycobacterium tuberculosis
QQFDWRYPPSPPPQPTQ

SEQ ID NO: 1383052 - protein, 20 aa, Mycobacterium tuberculosis
QQGAVIRIPAVASRSGDLPP

SEQ ID NO: 1383053 - protein, 18 aa, Mycobacterium tuberculosis
QQQPGWVGTHAYWLGAQW

SEQ ID NO: 1383054 - protein, 18 aa, Mycobacterium tuberculosis
QRDLRPGRPDLCGPGTGV

SEQ ID NO: 1383055 - protein, 24 aa, Mycobacterium tuberculosis
QRERLRFFWITAVTTDGSIVVANS

SEQ ID NO: 1383056 - protein, 17 aa, Mycobacterium tuberculosis
QRLAIARAVIRRPAIYV

SEQ ID NO: 1383057 - protein, 34 aa, Mycobacterium tuberculosis
QRRLLKWSIPGLAHFFTMWGFFILLTVYIEDYGL

SEQ ID NO: 1383058 - protein, 20 aa, Mycobacterium tuberculosis
QRSPIVGVMLSMFLLAFAGI

SEQ ID NO: 1383059 - protein, 23 aa, Mycobacterium tuberculosis
QRVLTITAWLAVVVTGSFALMQL

SEQ ID NO: 1383060 - protein, 17 aa, Mycobacterium tuberculosis
QRVRPRPASRMLRQYGP

SEQ ID NO: 1383061 - protein, 31 aa, Mycobacterium tuberculosis
QRYLDILRPLGFRPALGFSRVDTTISWSSVE

SEQ ID NO: 1383062 - protein, 25 aa, Mycobacterium tuberculosis
QSARAGDPFQHWIGRRFDAVATDKP

SEQ ID NO: 1383063 - protein, 23 aa, Mycobacterium tuberculosis
QSGGPLDCHLMKLEDLRPPGART

SEQ ID NO: 1383064 - protein, 19 aa, Mycobacterium tuberculosis
QSLKLQWGVIGPDGRIQPL

SEQ ID NO: 1383065 - protein, 25 aa, Mycobacterium tuberculosis
QSSGFSVGDAISWSWNRFTQNAVTL

SEQ ID NO: 1383066 - protein, 18 aa, Mycobacterium tuberculosis
QSSMLLPPCPFRDRDGRA

SEQ ID NO: 1383067 - protein, 21 aa, Mycobacterium tuberculosis
QTGSSFKVFALVAALEQGIGL

SEQ ID NO: 1383068 - protein, 22 aa, Mycobacterium tuberculosis
QTGSSFKVFALVAALEQGIGLG

SEQ ID NO: 1383069 - protein, 23 aa, Mycobacterium tuberculosis
QTGSSFKVFALVAALEQGIGLGY

SEQ ID NO: 1383070 - protein, 25 aa, Mycobacterium tuberculosis
QTLRTIYQNLGWAFGYNTAAIPLAA

SEQ ID NO: 1383071 - protein, 25 aa, Mycobacterium tuberculosis
QTLRYFPDLVVVLALLAAVALQAPN

SEQ ID NO: 1383072 - protein, 29 aa, Mycobacterium tuberculosis
QTRSPTPMRCWRCGSTGRICRWIMATRPA

SEQ ID NO: 1383073 - protein, 23 aa, Mycobacterium tuberculosis
QTVLPFTGIDFRLSPSGVAVDSA

SEQ ID NO: 1383074 - protein, 31 aa, Mycobacterium tuberculosis
QVGDVLVRKGSWCWCCSRAPTSIPSTSLTRA

SEQ ID NO: 1383075 - protein, 25 aa, Mycobacterium tuberculosis
QVLVVGSGYLCRWSTTTTWLRSHRA

SEQ ID NO: 1383076 - protein, 26 aa, Mycobacterium tuberculosis
QVRPYAGERWWVLLLSLATRGRAYRA

SEQ ID NO: 1383077 - protein, 19 aa, Mycobacterium tuberculosis
QVSGRLLFALLSFSVVGAV

SEQ ID NO: 1383078 - protein, 24 aa, Mycobacterium tuberculosis
QVTGWRFVMRRIAAGIALHDTRML

SEQ ID NO: 1383079 - protein, 17 aa, Mycobacterium tuberculosis
QVYFRRRKTVILKNPTH

SEQ ID NO: 1383080 - protein, 24 aa, Mycobacterium tuberculosis
QWAVRAYAWTDWRFTQLREGFHRQ

SEQ ID NO: 1383081 - protein, 21 aa, Mycobacterium tuberculosis
QWMMQAEVAITNFVTTMDVAA

SEQ ID NO: 1383082 - protein, 17 aa, Mycobacterium tuberculosis
QYGEMWAQDIVAMEGYA

SEQ ID NO: 1383083 - protein, 24 aa, Mycobacterium tuberculosis
QYVSELMFRLEVEFTGGGRHRHRA

SEQ ID NO: 1383084 - protein, 18 aa, Mycobacterium tuberculosis
RAAACLLEAIPRPGQTLA

SEQ ID NO: 1383085 - protein, 20 aa, Mycobacterium tuberculosis
RAAAIGARYQQAFALMYGEI

SEQ ID NO: 1383086 - protein, 25 aa, Mycobacterium tuberculosis
RAAEHPRPDYVLLHISDTHLIGGDR

SEQ ID NO: 1383087 - protein, 23 aa, Mycobacterium tuberculosis
RAALLPEQKFEVVRNLQAGGHQC

SEQ ID NO: 1383088 - protein, 17 aa, Mycobacterium tuberculosis
RAAMCKTMAVAVICLLA

SEQ ID NO: 1383089 - protein, 19 aa, Mycobacterium tuberculosis
RAATTRFSVRMKHDDRKQT

SEQ ID NO: 1383090 - protein, 22 aa, Mycobacterium tuberculosis
RADAWGRKPIFLVGFAVLTARG

SEQ ID NO: 1383091 - protein, 26 aa, Mycobacterium tuberculosis
RADGCAAGRPCGRDRLAATKTAPIRS

SEQ ID NO: 1383092 - protein, 19 aa, Mycobacterium tuberculosis
RADSVERLIAAHLMDPAPQ

SEQ ID NO: 1383093 - protein, 21 aa, Mycobacterium tuberculosis
RAELRRWLATRASKLREVTND

SEQ ID NO: 1383094 - protein, 21 aa, Mycobacterium tuberculosis
RAGLTFNDFMLHLTPLVVIVL

SEQ ID NO: 1383095 - protein, 17 aa, Mycobacterium tuberculosis
RAHAVAVPPMFSDLASA

SEQ ID NO: 1383096 - protein, 27 aa, Mycobacterium tuberculosis
RAHVMATYLSRDWARDWGSLRKFDTLV

SEQ ID NO: 1383097 - protein, 23 aa, Mycobacterium tuberculosis
RAITARFGKRWDRTISTLHRPKA

SEQ ID NO: 1383098 - protein, 27 aa, Mycobacterium tuberculosis
RAKARKAKAPKLVRPTPMERLAARLTS

SEQ ID NO: 1383099 - protein, 19 aa, Mycobacterium tuberculosis
RAKCKCCWIIHAWTRAARP

SEQ ID NO: 1383100 - protein, 17 aa, Mycobacterium tuberculosis
RALVAPIYLIGSVLISY

SEQ ID NO: 1383101 - protein, 21 aa, Mycobacterium tuberculosis
RALVLPWLLARAVGAEAAAQR

SEQ ID NO: 1383102 - protein, 28 aa, Mycobacterium tuberculosis
RALVPDDLRPEWVLPRADEIAFGYSDDG

SEQ ID NO: 1383103 - protein, 24 aa, Mycobacterium tuberculosis
RARHFGLMSACFGVGMVAGPVAGG

SEQ ID NO: 1383104 - protein, 20 aa, Mycobacterium tuberculosis
RARKITWGELEKGRRRYLRD

SEQ ID NO: 1383105 - protein, 23 aa, Mycobacterium tuberculosis
RARSRLQAHAFWDIATFLINGSL

SEQ ID NO: 1383106 - protein, 23 aa, Mycobacterium tuberculosis
RASGQCLGGFVDETENVLLQVVP

SEQ ID NO: 1383107 - protein, 21 aa, Mycobacterium tuberculosis
RASVAVAVGFVVGRTRCAGHV

SEQ ID NO: 1383108 - protein, 19 aa, Mycobacterium tuberculosis
RAVAIEWRGKIDDPKWRTG

SEQ ID NO: 1383109 - protein, 17 aa, Mycobacterium tuberculosis
RAVEHRALMAIVFGDLG

SEQ ID NO: 1383110 - protein, 20 aa, Mycobacterium tuberculosis
RAVIVTGDFNARYSDDQSAL

SEQ ID NO: 1383111 - protein, 22 aa, Mycobacterium tuberculosis
RAYRREALEAIDLDGVDSKGYC

SEQ ID NO: 1383112 - protein, 17 aa, Mycobacterium tuberculosis
RCAATVVLAGASWWLIE

SEQ ID NO: 1383113 - protein, 23 aa, Mycobacterium tuberculosis
RCAPRAQSWPARCCSHCCSPRPS

SEQ ID NO: 1383114 - protein, 25 aa, Mycobacterium tuberculosis
RCATYPVLAVQAWAAFHDMTLRAVI

SEQ ID NO: 1383115 - protein, 28 aa, Mycobacterium tuberculosis
RCGRCGMPRWPGCTCVRPVRCWLWAWRS

SEQ ID NO: 1383116 - protein, 29 aa, Mycobacterium tuberculosis
RCSRSHANAGPWLGRDGDSRWRRKQRPAA

SEQ ID NO: 1383117 - protein, 34 aa, Mycobacterium tuberculosis
RCVRPRNICGMAVLPACRLGLVVCVATAVITATM

SEQ ID NO: 1383118 - protein, 19 aa, Mycobacterium tuberculosis
RDGLLRLLVDVQYTRNDMS

SEQ ID NO: 1383119 - protein, 24 aa, Mycobacterium tuberculosis
RDGRLSFEVFVVFVVARVEVVVGV

SEQ ID NO: 1383120 - protein, 17 aa, Mycobacterium tuberculosis
RDGVPTFLLPANPVSAL

SEQ ID NO: 1383121 - protein, 18 aa, Mycobacterium tuberculosis
RDKRVAVAVVALTALMVS

SEQ ID NO: 1383122 - protein, 26 aa, Mycobacterium tuberculosis
RDLDLLGGLARRMPATTVFFGVAALG

SEQ ID NO: 1383123 - protein, 26 aa, Mycobacterium tuberculosis
RDLIPDLAELLAMRGIDGLPFSWTVA

SEQ ID NO: 1383124 - protein, 17 aa, Mycobacterium tuberculosis
RDMPVGVLVGSWHTIEG

SEQ ID NO: 1383125 - protein, 17 aa, Mycobacterium tuberculosis
RDPSFYLRFRREAQNAA

SEQ ID NO: 1383126 - protein, 23 aa, Mycobacterium tuberculosis
RDRHLPRWLAAVHPRFKVPFRAE

SEQ ID NO: 1383127 - protein, 21 aa, Mycobacterium tuberculosis
RDRLLLPLPMFHVAALTTVIF

SEQ ID NO: 1383128 - protein, 18 aa, Mycobacterium tuberculosis
RDSFWKGREFDSLAQMQQ

SEQ ID NO: 1383129 - protein, 26 aa, Mycobacterium tuberculosis
RDTDLCGVTWVYHYAVAVYRYDRGCG

SEQ ID NO: 1383130 - protein, 18 aa, Mycobacterium tuberculosis
RDTRMFDDPLQFYSRSIA

SEQ ID NO: 1383131 - protein, 19 aa, Mycobacterium tuberculosis
RDTWLLSLLYLGTFGSFIG

SEQ ID NO: 1383132 - protein, 18 aa, Mycobacterium tuberculosis
REAIKGTPLQGAAIYLVW

SEQ ID NO: 1383133 - protein, 20 aa, Mycobacterium tuberculosis
REGRSFRSAVPRGWARARKT

SEQ ID NO: 1383134 - protein, 35 aa, Mycobacterium tuberculosis; identical to SEQ ID NO: 325569

SEQ ID NO: 1383135 - protein, 20 aa, Mycobacterium tuberculosis
RELGVTVLRLAVIRRGVIPA

SEQ ID NO: 1383136 - protein, 28 aa, Mycobacterium tuberculosis
RELPASVPVWLVWHIPGGTVWAEEAAFR

SEQ ID NO: 1383137 - protein, 18 aa, Mycobacterium tuberculosis
REPDLPRGFKVPGYPVTP

SEQ ID NO: 1383138 - protein, 20 aa, Mycobacterium tuberculosis
REPEQLWQVAKLRRAAFSGV

SEQ ID NO: 1383139 - protein, 17 aa, Mycobacterium tuberculosis
REPSRGLGIQRSGYGGP

SEQ ID NO: 1383140 - protein, 17 aa, Mycobacterium tuberculosis
REQLNLGGIVNAQNAQL

SEQ ID NO: 1383141 - protein, 22 aa, Mycobacterium tuberculosis
RERLRAPAAWRVATRRTVSAGR

SEQ ID NO: 1383142 - protein, 22 aa, Mycobacterium tuberculosis
RESDIWLLGAIGPRMVYSTNLD

SEQ ID NO: 1383143 - protein, 20 aa, Mycobacterium tuberculosis
REVLPRLGPAVAASKPAYWA

SEQ ID NO: 1383144 - protein, 17 aa, Mycobacterium tuberculosis
REVLPRLGPAVEASKPA

SEQ ID NO: 1383145 - protein, 19 aa, Mycobacterium tuberculosis
REVVLVTGPWLAGVSGVRA

SEQ ID NO: 1383146 - protein, 20 aa, Mycobacterium tuberculosis
REYPPVRGVIHAAGVLDDAV

SEQ ID NO: 1383147 - protein, 17 aa, Mycobacterium tuberculosis
REYRVVAALGDTPVPVA

SEQ ID NO: 1383148 - protein, 17 aa, Mycobacterium tuberculosis
RFGFLITALCLFTAVFI

SEQ ID NO: 1383149 - protein, 21 aa, Mycobacterium tuberculosis
RFNLREFAIRPAYGLAEATVY

SEQ ID NO: 1383150 - protein, 18 aa, Mycobacterium tuberculosis
RFRGHFWLATIVVLTIQY

SEQ ID NO: 1383151 - protein, 21 aa, Mycobacterium tuberculosis
RFVAAIPECRANPVCSVAQEV

SEQ ID NO: 1383152 - protein, 25 aa, Mycobacterium tuberculosis
RFVMLRLAPGLGRLLGPIGRMAPRN

SEQ ID NO: 1383153 - protein, 17 aa, Mycobacterium tuberculosis
RGAMVAAWDKLRGPNGK

SEQ ID NO: 1383154 - protein, 19 aa, Mycobacterium tuberculosis
RGAPALALVAAPRPDASYQ

SEQ ID NO: 1383155 - protein, 18 aa, Mycobacterium tuberculosis
RGATMVGYFVCFVALFVL

SEQ ID NO: 1383156 - protein, 25 aa, Mycobacterium tuberculosis
RGDGKCHPVILPPLFGCNDRAMPDG

SEQ ID NO: 1383157 - protein, 18 aa, Mycobacterium tuberculosis
RGDHGVLHRSRRRTGHRR

SEQ ID NO: 1383158 - protein, 20 aa, Mycobacterium tuberculosis
RGDQLGGRRRPPGPPGPPGS

SEQ ID NO: 1383159 - protein, 28 aa, Mycobacterium tuberculosis
RGEIARRVFATCRRLGLGTVAVYTDPDA

SEQ ID NO: 1383160 - protein, 20 aa, Mycobacterium tuberculosis
RGEIGDWILNRGLRIVMLLI

SEQ ID NO: 1383161 - protein, 17 aa, Mycobacterium tuberculosis
RGFSTGVFGMGMVGTAL

SEQ ID NO: 1383162 - protein, 19 aa, Mycobacterium tuberculosis
RGGGAGHCRQRGCPRTVRV

SEQ ID NO: 1383163 - protein, 21 aa, Mycobacterium tuberculosis
RGGKTRARRSRGRRLAITVGV

SEQ ID NO: 1383164 - protein, 32 aa, Mycobacterium tuberculosis
RGGPGGAAGCWQPITRDLWPAPYLVMDTGASL

SEQ ID NO: 1383165 - protein, 20 aa, Mycobacterium tuberculosis
RGGRRPGWVLLTALLVLAIG

SEQ ID NO: 1383166 - protein, 17 aa, Mycobacterium tuberculosis
RGIAIPPAKDFRAVPGC

SEQ ID NO: 1383167 - protein, 19 aa, Mycobacterium tuberculosis
RGIGNGMSLLIFVGIAARI

SEQ ID NO: 1383168 - protein, 17 aa, Mycobacterium tuberculosis
RGIVGRTMLVWLLCSGV

SEQ ID NO: 1383169 - protein, 23 aa, Mycobacterium tuberculosis
RGLLELGVGLGLQSARSTAAGLR

SEQ ID NO: 1383170 - protein, 27 aa, Mycobacterium tuberculosis
RGLQALWRRGAEVFADVTLPEGVPIRG

SEQ ID NO: 1383171 - protein, 33 aa, Mycobacterium tuberculosis
RGLRRPWLYFVSSLFTSFAFAFAFYFATIERQH

SEQ ID NO: 1383172 - protein, 17 aa, Mycobacterium tuberculosis
RGNLIGIPGAPERMVQN

SEQ ID NO: 1383173 - protein, 17 aa, Mycobacterium tuberculosis
RGPRAPYLRTMFVVLLS

SEQ ID NO: 1383174 - protein, 17 aa, Mycobacterium tuberculosis
RGPVHLVALSRFPEPSS

SEQ ID NO: 1383175 - protein, 17 aa, Mycobacterium tuberculosis
RGPWPAGAAILIGHCLT

SEQ ID NO: 1383176 - protein, 17 aa, Mycobacterium tuberculosis
RGRLARSQECPRARPVG

SEQ ID NO: 1383177 - protein, 21 aa, Mycobacterium tuberculosis
RGRLIRRVLITVAASLRSEDM

SEQ ID NO: 1383178 - protein, 22 aa, Mycobacterium tuberculosis
RGRLTRSVIGWVGAVAVVVSLA

SEQ ID NO: 1383179 - protein, 20 aa, Mycobacterium tuberculosis
RGRLVTMLLVGVVLLTVGHR

SEQ ID NO: 1383180 - protein, 18 aa, Mycobacterium tuberculosis
RGRVARVTLVLRYAARSD

SEQ ID NO: 1383181 - protein, 20 aa, Mycobacterium tuberculosis
RGRVGIGLKLTGGRTAQAWA

SEQ ID NO: 1383182 - protein, 19 aa, Mycobacterium tuberculosis
RGVLHYCERLATHDTALRA

SEQ ID NO: 1383183 - protein, 22 aa, Mycobacterium tuberculosis
RGVTFSRGWLPFLPTSDPPAHT

SEQ ID NO: 1383184 - protein, 18 aa, Mycobacterium tuberculosis
RHAARLGAALLVYQSSTS

SEQ ID NO: 1383185 - protein, 20 aa, Mycobacterium tuberculosis
RHLRAGRLTPVYGNDLAQQI

SEQ ID NO: 1383186 - protein, 17 aa, Mycobacterium tuberculosis
RHVLSALWWAALAGTAT

SEQ ID NO: 1383187 - protein, 19 aa, Mycobacterium tuberculosis
RHVLSALWWAALAGTATVV

SEQ ID NO: 1383188 - protein, 20 aa, Mycobacterium tuberculosis
RHVLSALWWAALAGTATVVI

SEQ ID NO: 1383189 - protein, 18 aa, Mycobacterium tuberculosis
RIAAPRWHFDLSDRLATL

SEQ ID NO: 1383190 - protein, 19 aa, Mycobacterium tuberculosis
RIAAVAVHRVGAHRELVIF

SEQ ID NO: 1383191 - protein, 20 aa, Mycobacterium tuberculosis
RIAGRPAAVLLHLGPGLGNG

SEQ ID NO: 1383192 - protein, 26 aa, Mycobacterium tuberculosis
RIASCLRPRPAGWGGRHQGMSRKSMS

SEQ ID NO: 1383193 - protein, 20 aa, Mycobacterium tuberculosis
RIECACKVWAAGVAASPLGK

SEQ ID NO: 1383194 - protein, 19 aa, Mycobacterium tuberculosis
RIGSGPKRSPIDVMGVIVR

SEQ ID NO: 1383195 - protein, 35 aa, Mycobacterium tuberculosis; identical to SEQ ID NO: 296937

SEQ ID NO: 1383196 - protein, 22 aa, Mycobacterium tuberculosis
RILAWRPLVWLGTISYGVYLWH

SEQ ID NO: 1383197 - protein, 18 aa, Mycobacterium tuberculosis
RILEFRWRTGDRVDVELG

SEQ ID NO: 1383198 - protein, 20 aa, Mycobacterium tuberculosis
RILGHATDLLFNGVIGPGLP

SEQ ID NO: 1383199 - protein, 29 aa, Mycobacterium tuberculosis
RILLAWMTIDALVWVPRMYYLYGNPSRSL

SEQ ID NO: 1383200 - protein, 17 aa, Mycobacterium tuberculosis
RIRDVMGNPAIVRRFVY

SEQ ID NO: 1383201 - protein, 26 aa, Mycobacterium tuberculosis
RIRTKPSTGRACRNFIRKSADPAKPI

SEQ ID NO: 1383202 - protein, 20 aa, Mycobacterium tuberculosis
RISRAVIGPTDIVGIGHQLL

SEQ ID NO: 1383203 - protein, 20 aa, Mycobacterium tuberculosis
RIVPEPGVRPGSGARVLVVS

SEQ ID NO: 1383204 - protein, 18 aa, Mycobacterium tuberculosis
RIVVCLVAGVVVGGIVFG

SEQ ID NO: 1383205 - protein, 23 aa, Mycobacterium tuberculosis
RKANLYRAALMLSLKDAISRDKR

SEQ ID NO: 1383206 - protein, 18 aa, Mycobacterium tuberculosis
RKAYNWTVATLKADIQAW

SEQ ID NO: 1383207 - protein, 24 aa, Mycobacterium tuberculosis
RKDAAAAVMKWVRDHGGHPTEEVG

SEQ ID NO: 1383208 - protein, 23 aa, Mycobacterium tuberculosis
RKGAAAAVMKWVRDHGGHPTEEV

SEQ ID NO: 1383209 - protein, 28 aa, Mycobacterium tuberculosis
RKLCYAAGVPYRTQWDAGAVVLELYEHL

SEQ ID NO: 1383210 - protein, 24 aa, Mycobacterium tuberculosis
RKLLLSSLLLNWVLGPALMFALAW

SEQ ID NO: 1383211 - protein, 17 aa, Mycobacterium tuberculosis
RKLPPRVQARNPVMLVV

SEQ ID NO: 1383212 - protein, 26 aa, Mycobacterium tuberculosis
RKLQNPSWRPGAWACRLVVVAAWGSI

SEQ ID NO: 1383213 - protein, 19 aa, Mycobacterium tuberculosis
RKPWLIAGVVFLLAAAAFP

SEQ ID NO: 1383214 - protein, 18 aa, Mycobacterium tuberculosis
RKRLAGKGVDAHRIEIPD

SEQ ID NO: 1383215 - protein, 21 aa, Mycobacterium tuberculosis
RKYLTLMAFRVPALILAAIAY

SEQ ID NO: 1383216 - protein, 19 aa, Mycobacterium tuberculosis
RLAKWAGMVVSVLTLAVSI

SEQ ID NO: 1383217 - protein, 17 aa, Mycobacterium tuberculosis
RLCAQRRTFPDGRRAID

SEQ ID NO: 1383218 - protein, 19 aa, Mycobacterium tuberculosis
RLCELAKSYPSRLLASSQT

SEQ ID NO: 1383219 - protein, 20 aa, Mycobacterium tuberculosis
RLDGRVVRLGRPGWLDAAEL

SEQ ID NO: 1383220 - protein, 20 aa, Mycobacterium tuberculosis
RLDSLFRLDHLAARLRRNSA

SEQ ID NO: 1383221 - protein, 26 aa, Mycobacterium tuberculosis
RLDSLFRLDHLAARLRRNSANLLVLA

SEQ ID NO: 1383222 - protein, 26 aa, Mycobacterium tuberculosis
RLDVSGMSCAACASRVETKLNKIPGV

SEQ ID NO: 1383223 - protein, 21 aa, Mycobacterium tuberculosis
RLETSCYNPSFGGMDRQSRVF

SEQ ID NO: 1383224 - protein, 24 aa, Mycobacterium tuberculosis
RLFRGPRAPYLRTMFVVLLSTLTL

SEQ ID NO: 1383225 - protein, 25 aa, Mycobacterium tuberculosis
RLGHFYRGAGLTIYEGYGLSETSGG

SEQ ID NO: 1383226 - protein, 19 aa, Mycobacterium tuberculosis
RLIPLTGLTTSWMSYGGSS

SEQ ID NO: 1383227 - protein, 21 aa, Mycobacterium tuberculosis
RLKTFLLLVGMSALIVAVGAL

SEQ ID NO: 1383228 - protein, 25 aa, Mycobacterium tuberculosis
RLLAPLKLPLVLSGVLAALVTLAQL

SEQ ID NO: 1383229 - protein, 27 aa, Mycobacterium tuberculosis
RLLETRFGVPVPNLTAWRRSVTGDMTS

SEQ ID NO: 1383230 - protein, 28 aa, Mycobacterium tuberculosis
RLLETRFGVPVPNLTAWRRSVTGDMTST

SEQ ID NO: 1383231 - protein, 25 aa, Mycobacterium tuberculosis
RLLFKRNICHQAIFYRRGLFGTIGP

SEQ ID NO: 1383232 - protein, 18 aa, Mycobacterium tuberculosis
RLLLVVAVSAAIFGVARL

SEQ ID NO: 1383233 - protein, 17 aa, Mycobacterium tuberculosis
RLLPLLFVLYVINFVDR

SEQ ID NO: 1383234 - protein, 21 aa, Mycobacterium tuberculosis
RLLRRVCPGDIVVLDVLDLDR

SEQ ID NO: 1383235 - protein, 25 aa, Mycobacterium tuberculosis
RLLRVTRWDVGLAMLIAGGVNAAML

SEQ ID NO: 1383236 - protein, 17 aa, Mycobacterium tuberculosis
RLPGGPVLKPAIGGLLV

SEQ ID NO: 1383237 - protein, 19 aa, Mycobacterium tuberculosis
RLPRQDALKVLRADVSADG

SEQ ID NO: 1383238 - protein, 28 aa, Mycobacterium tuberculosis
RLQNFSGRARMSSMLWTFQVNQADGVAC

SEQ ID NO: 1383239 - protein, 21 aa, Mycobacterium tuberculosis
RLRRLWLAVLIVAPATIWLEP

SEQ ID NO: 1383240 - protein, 19 aa, Mycobacterium tuberculosis
RLRRRLRQHRFEFLADDGR

SEQ ID NO: 1383241 - protein, 20 aa, Mycobacterium tuberculosis
RLRSWALAVWHFVSNAPLTY

SEQ ID NO: 1383242 - protein, 19 aa, Mycobacterium tuberculosis
RLSLTDFPPNFNILHIDGN

SEQ ID NO: 1383243 - protein, 17 aa, Mycobacterium tuberculosis
RLSRGLVLIKWWLLAIP

SEQ ID NO: 1383244 - protein, 23 aa, Mycobacterium tuberculosis
RLSRGLVLIKWWLLAIPHYLILA

SEQ ID NO: 1383245 - protein, 20 aa, Mycobacterium tuberculosis
RLTARGALVRSPRTIEALGR

SEQ ID NO: 1383246 - protein, 20 aa, Mycobacterium tuberculosis
RLTGELPPGAVRIGRANDND

SEQ ID NO: 1383247 - protein, 29 aa, Mycobacterium tuberculosis
RLTHHRCTPREWMWAVLLAGAVAVIVMSG

SEQ ID NO: 1383248 - protein, 17 aa, Mycobacterium tuberculosis
RLVAELSLQPGVYAVHW

SEQ ID NO: 1383249 - protein, 19 aa, Mycobacterium tuberculosis
RLVEDLLLLARLDSGRPLE

SEQ ID NO: 1383250 - protein, 25 aa, Mycobacterium tuberculosis
RLVHAFSAPIGYLFRPYIIYRSREE

SEQ ID NO: 1383251 - protein, 23 aa, Mycobacterium tuberculosis
RLVKEGKPAFAVVGVDGGNTYWH

SEQ ID NO: 1383252 - protein, 19 aa, Mycobacterium tuberculosis
RMAPFHHHFELVGWAETTV

SEQ ID NO: 1383253 - protein, 17 aa, Mycobacterium tuberculosis
RMLRTRGADGLQTPSPG

SEQ ID NO: 1383254 - protein, 27 aa, Mycobacterium tuberculosis
RMRAISIPRWPTSSWRCATTCSTSSTT

SEQ ID NO: 1383255 - protein, 25 aa, Mycobacterium tuberculosis
RMSRGELDRTLLLWMLPLLIAPPMY

SEQ ID NO: 1383256 - protein, 21 aa, Mycobacterium tuberculosis
RNAGLPGKWLGMGVLHDDRGH

SEQ ID NO: 1383257 - protein, 17 aa, Mycobacterium tuberculosis
RNLASGYQVKTYRDDAD

SEQ ID NO: 1383258 - protein, 17 aa, Mycobacterium tuberculosis
RNLGWLFLFKQGNVSLA

SEQ ID NO: 1383259 - protein, 20 aa, Mycobacterium tuberculosis
RNPVTMLLPLVTIGASLMTA

SEQ ID NO: 1383260 - protein, 17 aa, Mycobacterium tuberculosis
RPALTALTLGAGIIALG

SEQ ID NO: 1383261 - protein, 19 aa, Mycobacterium tuberculosis
RPAPGGGVGARVPRPGCFE

SEQ ID NO: 1383262 - protein, 20 aa, Mycobacterium tuberculosis
RPARIHPSWGQQRRRDPRWH

SEQ ID NO: 1383263 - protein, 18 aa, Mycobacterium tuberculosis
RPDLQRGCTAPWVPLLPI

SEQ ID NO: 1383264 - protein, 22 aa, Mycobacterium tuberculosis
RPGAADFCRIRVGVGSAPLATR

SEQ ID NO: 1383265 - protein, 18 aa, Mycobacterium tuberculosis
RPGDLLYGLHAMMFNRSR

SEQ ID NO: 1383266 - protein, 20 aa, Mycobacterium tuberculosis
RPGIPVAFDAVIARGMAKNP

SEQ ID NO: 1383267 - protein, 22 aa, Mycobacterium tuberculosis
RPKLGFPVPIRHWLRAGELLEW

SEQ ID NO: 1383268 - protein, 20 aa, Mycobacterium tuberculosis
RPLELCRVDLLALASDAAHD

SEQ ID NO: 1383269 - protein, 19 aa, Mycobacterium tuberculosis
RPLPGGCWWSRAPRSPPRC

SEQ ID NO: 1383270 - protein, 35 aa, Mycobacterium tuberculosis
RPNRLWWRYTAWWLLAMALATLWWVMALTQLHGVS

SEQ ID NO: 1383271 - protein, 17 aa, Mycobacterium tuberculosis
RPNSVWVGALIALSTIC

SEQ ID NO: 1383272 - protein, 23 aa, Mycobacterium tuberculosis
RPPGAREWLTWLLHSRVTTFLSH

SEQ ID NO: 1383273 - protein, 19 aa, Mycobacterium tuberculosis
RPQLEPRYPAGVRADVWQR

SEQ ID NO: 1383274 - protein, 18 aa, Mycobacterium tuberculosis
RPQSLFTLDHRLIEQGRL

SEQ ID NO: 1383275 - protein, 18 aa, Mycobacterium tuberculosis
RPRETNWVIGFAVVDPGD

SEQ ID NO: 1383276 - protein, 22 aa, Mycobacterium tuberculosis
RPRHLGCAGLVHLRGVRSSVVA

SEQ ID NO: 1383277 - protein, 17 aa, Mycobacterium tuberculosis
RPSALWNQATWWQSIAV

SEQ ID NO: 1383278 - protein, 18 aa, Mycobacterium tuberculosis
RPTGASVRGGRSIGPGHP

SEQ ID NO: 1383279 - protein, 28 aa, Mycobacterium tuberculosis
RPWHVPGRPRRAGVSSFGISGTNAHVIL

SEQ ID NO: 1383280 - protein, 19 aa, Mycobacterium tuberculosis
RPYAGERWWVLLLSLATAA

SEQ ID NO: 1383281 - protein, 19 aa, Mycobacterium tuberculosis
RPYGPRPVVRELLLREGND

SEQ ID NO: 1383282 - protein, 19 aa, Mycobacterium tuberculosis
RPYGYDQTARWVPRLWRRD

SEQ ID NO: 1383283 - protein, 20 aa, Mycobacterium tuberculosis
RQAFGRPSGVQGSFVAERVR

SEQ ID NO: 1383284 - protein, 17 aa, Mycobacterium tuberculosis
RQGCGKTTALVAIGEAV

SEQ ID NO: 1383285 - protein, 21 aa, Mycobacterium tuberculosis
RQGWAVLAIMGIIWMGMSVAA

SEQ ID NO: 1383286 - protein, 21 aa, Mycobacterium tuberculosis
RQPRRANAMGLALCIYIGSLL

SEQ ID NO: 1383287 - protein, 17 aa, Mycobacterium tuberculosis
RQPWPWLALLVAGLTVG

SEQ ID NO: 1383288 - protein, 17 aa, Mycobacterium tuberculosis
RQRFPDLTPAQIIHRIT

SEQ ID NO: 1383289 - protein, 19 aa, Mycobacterium tuberculosis
RQRSRRGATPAARAAAGAR

SEQ ID NO: 1383290 - protein, 30 aa, Mycobacterium tuberculosis
RQSLRPRYLCMLAEILRFHRAAARLLREET

SEQ ID NO: 1383291 - protein, 23 aa, Mycobacterium tuberculosis
RQVTRELLELFNIDEQTLNTQGL

SEQ ID NO: 1383292 - protein, 26 aa, Mycobacterium tuberculosis
RQWAPYHLRLDWLMWFAAISPGYALP

SEQ ID NO: 1383293 - protein, 27 aa, Mycobacterium tuberculosis
RQYGPRPKISELFLREGKDDPRTQETT

SEQ ID NO: 1383294 - protein, 18 aa, Mycobacterium tuberculosis
RRADRAAVLAAIKAAAHV

SEQ ID NO: 1383295 - protein, 22 aa, Mycobacterium tuberculosis
RRAELIERFGLDPTKKARTYSK

SEQ ID NO: 1383296 - protein, 19 aa, Mycobacterium tuberculosis
RRAGFKHGSYRIGHDDDQR

SEQ ID NO: 1383297 - protein, 23 aa, Mycobacterium tuberculosis
RRALFRPMHDRLASAVVAEAHRT

SEQ ID NO: 1383298 - protein, 17 aa, Mycobacterium tuberculosis
RRALGIQRLLAARSQRG

SEQ ID NO: 1383299 - protein, 19 aa, Mycobacterium tuberculosis
RRALLRWGAGAGAGAAGVW

SEQ ID NO: 1383300 - protein, 17 aa, Mycobacterium tuberculosis
RRAMLMSPMSFLRRPAR

SEQ ID NO: 1383301 - protein, 18 aa, Mycobacterium tuberculosis
RRASAYGVFAAGLGAATA

SEQ ID NO: 1383302 - protein, 22 aa, Mycobacterium tuberculosis
RRCRWLVFTGWLLALVPAVYLA

SEQ ID NO: 1383303 - protein, 24 aa, Mycobacterium tuberculosis
RRCRWLVFTGWLLALVPAVYLAMT

SEQ ID NO: 1383304 - protein, 35 aa, Mycobacterium tuberculosis
RREHISLRPLWGIDQRLKRFGAMATAMVLYVLISQ

SEQ ID NO: 1383305 - protein, 22 aa, Mycobacterium tuberculosis
RRFHLRPVPETAVGRHRPGRPH

SEQ ID NO: 1383306 - protein, 22 aa, Mycobacterium tuberculosis
RRFLPARWWSTGGLDTLVIAVL

SEQ ID NO: 1383307 - protein, 23 aa, Mycobacterium tuberculosis
RRFLPARWWSTGGLDTLVIAVLV

SEQ ID NO: 1383308 - protein, 17 aa, Mycobacterium tuberculosis
RRFRSMGRLEPFAFTAV

SEQ ID NO: 1383309 - protein, 19 aa, Mycobacterium tuberculosis
RRFTTPSCCYWRALPAASW

SEQ ID NO: 1383310 - protein, 17 aa, Mycobacterium tuberculosis
RRGATPAARAAAGARAH

SEQ ID NO: 1383311 - protein, 24 aa, Mycobacterium tuberculosis
RRGLRIALRGRRDPLPVAGRRSRT

SEQ ID NO: 1383312 - protein, 26 aa, Mycobacterium tuberculosis
RRGNVFGLRRSRVVALARHVPHHRIA

SEQ ID NO: 1383313 - protein, 18 aa, Mycobacterium tuberculosis
RRGQIDKMFALRSYGPDK

SEQ ID NO: 1383314 - protein, 17 aa, Mycobacterium tuberculosis
RRGRDRIIVGYEGATVL

SEQ ID NO: 1383315 - protein, 19 aa, Mycobacterium tuberculosis
RRIGPVWLTAAGYAVACQV

SEQ ID NO: 1383316 - protein, 17 aa, Mycobacterium tuberculosis
RRIHAFVRWVVRTPWPL

SEQ ID NO: 1383317 - protein, 18 aa, Mycobacterium tuberculosis
RRISLSPRPERGVVDRSG

SEQ ID NO: 1383318 - protein, 23 aa, Mycobacterium tuberculosis
RRLAWCSAEFNGAIVVNVPLASN

SEQ ID NO: 1383319 - protein, 17 aa, Mycobacterium tuberculosis
RRLGLTGALGTVAESVD

SEQ ID NO: 1383320 - protein, 17 aa, Mycobacterium tuberculosis
RRLGLWSDPMVVGQSLR

SEQ ID NO: 1383321 - protein, 17 aa, Mycobacterium tuberculosis
RRLLAWVGADENVRPLD

SEQ ID NO: 1383322 - protein, 20 aa, Mycobacterium tuberculosis
RRLLKWSIPGLAHFFTMWGF

SEQ ID NO: 1383323 - protein, 23 aa, Mycobacterium tuberculosis
RRLRWRLMAVLAIAVGTYGVLSA

SEQ ID NO: 1383324 - protein, 21 aa, Mycobacterium tuberculosis
RRMALRRMKVVAVGFLVGATG

SEQ ID NO: 1383325 - protein, 36 aa, Mycobacterium tuberculosis
RRMRTRRWCRIVTAIVRWPLPILAMACAIAVVGLLA

SEQ ID NO: 1383326 - protein, 25 aa, Mycobacterium tuberculosis
RRNAELLLLCFAAVITFAALLVVQA

SEQ ID NO: 1383327 - protein, 20 aa, Mycobacterium tuberculosis
RRNDPLLGRHVIITGASSGI

SEQ ID NO: 1383328 - protein, 20 aa, Mycobacterium tuberculosis
RRPGCAHRPIGLAHPIPKTH

SEQ ID NO: 1383329 - protein, 18 aa, Mycobacterium tuberculosis
RRPILLSGIATMITADAV

SEQ ID NO: 1383330 - protein, 20 aa, Mycobacterium tuberculosis
RRPMPLRAFNPVSSFRWARG

SEQ ID NO: 1383331 - protein, 24 aa, Mycobacterium tuberculosis
RRPRRPGCGCARGSGHGQRRRRGR

SEQ ID NO: 1383332 - protein, 19 aa, Mycobacterium tuberculosis
RRPRRPVRRRPAASSNPPR

SEQ ID NO: 1383333 - protein, 24 aa, Mycobacterium tuberculosis
RRQPVIGCAAALVFGGLPALAFPA

SEQ ID NO: 1383334 - protein, 17 aa, Mycobacterium tuberculosis
RRRCARRGVGGSRPRAV

SEQ ID NO: 1383335 - protein, 17 aa, Mycobacterium tuberculosis
RRRCCGRAARSSRMPTS

SEQ ID NO: 1383336 - protein, 18 aa, Mycobacterium tuberculosis
RRRFFGYLNLFLASMLLL

SEQ ID NO: 1383337 - protein, 17 aa, Mycobacterium tuberculosis
RRRGLRQAVASGIAVTV

SEQ ID NO: 1383338 - protein, 21 aa, Mycobacterium tuberculosis
RRRGRGRSAARHGATGSHDHR

SEQ ID NO: 1383339 - protein, 18 aa, Mycobacterium tuberculosis
RRRGRPDARSSGGAATAK

SEQ ID NO: 1383340 - protein, 26 aa, Mycobacterium tuberculosis
RRRHVLRLALFAGILLGLFYLVAVAR

SEQ ID NO: 1383341 - protein, 18 aa, Mycobacterium tuberculosis
RRRPKIKQLGRGYEYLDL

SEQ ID NO: 1383342 - protein, 23 aa, Mycobacterium tuberculosis
RRRPVAGLHWPWVARVGTVVMSW

SEQ ID NO: 1383343 - protein, 18 aa, Mycobacterium tuberculosis
RRRRPAGPCYVCDTRILE

SEQ ID NO: 1383344 - protein, 23 aa, Mycobacterium tuberculosis
RRRRRATARRKAPVKAPSATRQT

SEQ ID NO: 1383345 - protein, 25 aa, Mycobacterium tuberculosis
RRRRRAVAPRGRRPGGAGDAGGPLA

SEQ ID NO: 1383346 - protein, 18 aa, Mycobacterium tuberculosis
RRRSGLHRHHRWFGRRPP

SEQ ID NO: 1383347 - protein, 21 aa, Mycobacterium tuberculosis
RRRSRSQLYRGAAHAPERVSV

SEQ ID NO: 1383348 - protein, 29 aa, Mycobacterium tuberculosis
RRSGYPLELLVRAAAAGWRVVELDVSYGP

SEQ ID NO: 1383349 - protein, 19 aa, Mycobacterium tuberculosis
RRSWPRHRCCGWIMARTGF

SEQ ID NO: 1383350 - protein, 19 aa, Mycobacterium tuberculosis
RRTASAGLWRRPAGGGTAK

SEQ ID NO: 1383351 - protein, 24 aa, Mycobacterium tuberculosis
RRTPGESSFYWLALALAAVWIAGA

SEQ ID NO: 1383352 - protein, 25 aa, Mycobacterium tuberculosis
RRTWLPRVWLALPLGLLALGSSMFF

SEQ ID NO: 1383353 - protein, 17 aa, Mycobacterium tuberculosis
RRTWLVLRMNPQRNVAA

SEQ ID NO: 1383354 - protein, 23 aa, Mycobacterium tuberculosis
RRVPDVRGAVLLAFALGLLTLGL

SEQ ID NO: 1383355 - protein, 23 aa, Mycobacterium tuberculosis
RRWASEVWVVWVGPVRVRRWAWG

SEQ ID NO: 1383356 - protein, 19 aa, Mycobacterium tuberculosis
RRWYVITFLMGLFFVLGQA

SEQ ID NO: 1383357 - protein, 17 aa, Mycobacterium tuberculosis
RRYRFARGLMAGLLGTM

SEQ ID NO: 1383358 - protein, 18 aa, Mycobacterium tuberculosis
RSAATVWGPRVGVRWWRF

SEQ ID NO: 1383359 - protein, 17 aa, Mycobacterium tuberculosis
RSAFLVPLRVTLAVLFL

SEQ ID NO: 1383360 - protein, 19 aa, Mycobacterium tuberculosis
RSAGLWYAVMTQLGFIAIL

SEQ ID NO: 1383361 - protein, 19 aa, Mycobacterium tuberculosis
RSAILSAVIFNALVIVALI

SEQ ID NO: 1383362 - protein, 24 aa, Mycobacterium tuberculosis
RSAPLSRRSLLIGNAVVAFAVIGF

SEQ ID NO: 1383363 - protein, 17 aa, Mycobacterium tuberculosis
RSARAAAAAAIMASPAQ

SEQ ID NO: 1383364 - protein, 23 aa, Mycobacterium tuberculosis
RSGPRPGEAVRHIWHEFRSALCP

SEQ ID NO: 1383365 - protein, 17 aa, Mycobacterium tuberculosis
RSHRLWLAVNAAGALLL

SEQ ID NO: 1383366 - protein, 25 aa, Mycobacterium tuberculosis
RSLAELWPYASGTLHRPGGENETMF

SEQ ID NO: 1383367 - protein, 18 aa, Mycobacterium tuberculosis
RSLARAVVHAANLGVGVI

SEQ ID NO: 1383368 - protein, 18 aa, Mycobacterium tuberculosis
RSLAYLSFPAGRFEREMA

SEQ ID NO: 1383369 - protein, 19 aa, Mycobacterium tuberculosis
RSLLRTAVIVPAVLAMLLV

SEQ ID NO: 1383370 - protein, 17 aa, Mycobacterium tuberculosis
RSLRVGGTYGFGSDEPV

SEQ ID NO: 1383371 - protein, 24 aa, Mycobacterium tuberculosis
RSNSPRPPRVLWRGPTATAPQTPP

SEQ ID NO: 1383372 - protein, 17 aa, Mycobacterium tuberculosis
RSPGPRCWRSPRRCSRR

SEQ ID NO: 1383373 - protein, 19 aa, Mycobacterium tuberculosis
RSRHWQRRWLPTAAAIGAT

SEQ ID NO: 1383374 - protein, 17 aa, Mycobacterium tuberculosis
RSRLVFGTLAILLCLVL

SEQ ID NO: 1383375 - protein, 26 aa, Mycobacterium tuberculosis
RSRLYAERWCAWALLAATVAIPTGLT

SEQ ID NO: 1383376 - protein, 23 aa, Mycobacterium tuberculosis
RSRVARIMPAYVVAVVVILSLLP

SEQ ID NO: 1383377 - protein, 19 aa, Mycobacterium tuberculosis
RSSMFTRRFAASMVGTTLT

SEQ ID NO: 1383378 - protein, 20 aa, Mycobacterium tuberculosis
RSSYLMGLAVFGLASLVCAA

SEQ ID NO: 1383379 - protein, 17 aa, Mycobacterium tuberculosis
RSVAELVALGEEIYDEI

SEQ ID NO: 1383380 - protein, 25 aa, Mycobacterium tuberculosis
RSVTGIAPAGGWTRWSPVKFEVIAK

SEQ ID NO: 1383381 - protein, 18 aa, Mycobacterium tuberculosis
RSVVRSRAPKSLQRHPID

SEQ ID NO: 1383382 - protein, 17 aa, Mycobacterium tuberculosis
RSWPRHRCCGWIMARIG

SEQ ID NO: 1383383 - protein, 19 aa, Mycobacterium tuberculosis
RSWPRSCATTTRCLTPRTY

SEQ ID NO: 1383384 - protein, 19 aa, Mycobacterium tuberculosis
RTANWWWALLGLAVSALTY

SEQ ID NO: 1383385 - protein, 18 aa, Mycobacterium tuberculosis
RTASVVIWYSPELGDTAA

SEQ ID NO: 1383386 - protein, 19 aa, Mycobacterium tuberculosis
RTASVVIWYSPELGDTAAV

SEQ ID NO: 1383387 - protein, 22 aa, Mycobacterium tuberculosis
RTEATWCWPRSPGPRCWRSPRR

SEQ ID NO: 1383388 - protein, 18 aa, Mycobacterium tuberculosis
RTEHPLIDMRLFQNRAVA

SEQ ID NO: 1383389 - protein, 26 aa, Mycobacterium tuberculosis
RTFLAPWRVAVGHLMFWGVGTALLTT

SEQ ID NO: 1383390 - protein, 19 aa, Mycobacterium tuberculosis
RTGDPLFWFTTSSGVLLLW

SEQ ID NO: 1383391 - protein, 17 aa, Mycobacterium tuberculosis
RTGPYLRSRVARIMPAY

SEQ ID NO: 1383392 - protein, 18 aa, Mycobacterium tuberculosis
RTHRMKIANEFTVSAPIE

SEQ ID NO: 1383393 - protein, 17 aa, Mycobacterium tuberculosis
RTPCTRLMWAWDSPQLT

SEQ ID NO: 1383394 - protein, 24 aa, Mycobacterium tuberculosis
RTPRPRWQPAPARRHQNPSRAQLT

SEQ ID NO: 1383395 - protein, 27 aa, Mycobacterium tuberculosis
RTRQHPLFRARWAKCPSNTTPTSSNTW

SEQ ID NO: 1383396 - protein, 26 aa, Mycobacterium tuberculosis
RTRRRLRRRLSGGVLLLIALTIAGGL

SEQ ID NO: 1383397 - protein, 17 aa, Mycobacterium tuberculosis
RTSCIRAAAAQKFGGPH

SEQ ID NO: 1383398 - protein, 18 aa, Mycobacterium tuberculosis
RTTLAWTRTAFALLVNGV

SEQ ID NO: 1383399 - protein, 19 aa, Mycobacterium tuberculosis
RVAGGFALSLLVVVVVVAV

SEQ ID NO: 1383400 - protein, 17 aa, Mycobacterium tuberculosis
RVAGLASGPAWRLIGTT

SEQ ID NO: 1383401 - protein, 21 aa, Mycobacterium tuberculosis
RVARIMPAYVVAVVVILSLLP

SEQ ID NO: 1383402 - protein, 18 aa, Mycobacterium tuberculosis
RVAYIAHGQHRVCGETLR

SEQ ID NO: 1383403 - protein, 22 aa, Mycobacterium tuberculosis
RVDTVLRAKVDGAWNLHELTED

SEQ ID NO: 1383404 - protein, 19 aa, Mycobacterium tuberculosis
RVFAGVCWLGAVLSAAVVA

SEQ ID NO: 1383405 - protein, 21 aa, Mycobacterium tuberculosis
RVFHASVAITRRLPGGPVLKP

SEQ ID NO: 1383406 - protein, 23 aa, Mycobacterium tuberculosis
RVGAKADLFGGVRCLDRSRVPLH

SEQ ID NO: 1383407 - protein, 20 aa, Mycobacterium tuberculosis
RVGSEPDFLRVWLPGQLLQG

SEQ ID NO: 1383408 - protein, 23 aa, Mycobacterium tuberculosis
RVGVRWWRFGAGVLLGLACATKW

SEQ ID NO: 1383409 - protein, 19 aa, Mycobacterium tuberculosis
RVHAAPGLHKLVYVGWTAI

SEQ ID NO: 1383410 - protein, 17 aa, Mycobacterium tuberculosis
RVIPRVGVASVIAEGFL

SEQ ID NO: 1383411 - protein, 19 aa, Mycobacterium tuberculosis
RVLLPQLRPTTFFLSITVL

SEQ ID NO: 1383412 - protein, 24 aa, Mycobacterium tuberculosis
RVLLPQLRPTTFFLSITVLINSLQ

SEQ ID NO: 1383413 - protein, 19 aa, Mycobacterium tuberculosis
RVLTVWRFDSLIGAAGVVL

SEQ ID NO: 1383414 - protein, 25 aa, Mycobacterium tuberculosis
RVPILAGLCMLMLGLLMLIFSEHRS

SEQ ID NO: 1383415 - protein, 28 aa, Mycobacterium tuberculosis
RVPLPGSAPRPAWLRAFAHPERDKQVAV

SEQ ID NO: 1383416 - protein, 25 aa, Mycobacterium tuberculosis
RVRAGPKRRSGWYVDAEAANAALVD

SEQ ID NO: 1383417 - protein, 24 aa, Mycobacterium tuberculosis
RVRRGGRRPGWVLLTALLVLAIGA

SEQ ID NO: 1383418 - protein, 32 aa, Mycobacterium tuberculosis
RVRRRPACAPAWRSRRDACLGAGGGTAAGRTH

SEQ ID NO: 1383419 - protein, 17 aa, Mycobacterium tuberculosis
RVRVVSRPTIPVAATEM

SEQ ID NO: 1383420 - protein, 19 aa, Mycobacterium tuberculosis
RVVATGNSVDAVWKPLLPG

SEQ ID NO: 1383421 - protein, 20 aa, Mycobacterium tuberculosis
RWIRCQGAHYDAPIWFASPP

SEQ ID NO: 1383422 - protein, 18 aa, Mycobacterium tuberculosis
RWLCRCAAAAASAAAVGG

SEQ ID NO: 1383423 - protein, 18 aa, Mycobacterium tuberculosis
RWLRGDVLAVLTVAAYLI

SEQ ID NO: 1383424 - protein, 17 aa, Mycobacterium tuberculosis
RWRASQLTLAIATCAGV

SEQ ID NO: 1383425 - protein, 20 aa, Mycobacterium tuberculosis
RYADRLEILHVLSSEPLHTP

SEQ ID NO: 1383426 - protein, 21 aa, Mycobacterium tuberculosis
RYANLTGALLLSFGASIATGA

SEQ ID NO: 1383427 - protein, 17 aa, Mycobacterium tuberculosis
RYCQGFIENLSRPGADS

SEQ ID NO: 1383428 - protein, 27 aa, Mycobacterium tuberculosis
RYFAEGLQYWPWVLLGYFNIGIMIVSL

SEQ ID NO: 1383429 - protein, 19 aa, Mycobacterium tuberculosis
RYGQYGQYGVQPGGYYGQQ

SEQ ID NO: 1383430 - protein, 18 aa, Mycobacterium tuberculosis
RYRLLIFHGGVPPLQFWQ

SEQ ID NO: 1383431 - protein, 18 aa, Mycobacterium tuberculosis
RYRPAGCGSDSPAGSLTQ

SEQ ID NO: 1383432 - protein, 17 aa, Mycobacterium tuberculosis
RYRYDKFGWTTRSSQLY

SEQ ID NO: 1383433 - protein, 19 aa, Mycobacterium tuberculosis
RYVTCGDLSAAAHAALATA

SEQ ID NO: 1383434 - protein, 20 aa, Mycobacterium tuberculosis
SAAIASLFSGYARDYQALSA

SEQ ID NO: 1383435 - protein, 19 aa, Mycobacterium tuberculosis
SAAPNFAFDLAVAKTSEED

SEQ ID NO: 1383436 - protein, 17 aa, Mycobacterium tuberculosis
SAARSFDVYPPWETLGS

SEQ ID NO: 1383437 - protein, 18 aa, Mycobacterium tuberculosis
SAEQVRWVLQDSEAVVLF

SEQ ID NO: 1383438 - protein, 22 aa, Mycobacterium tuberculosis
SAGIRWPHYRARTSRTGASHRW

SEQ ID NO: 1383439 - protein, 18 aa, Mycobacterium tuberculosis
SAGRAVIVTGDFNARYSD

SEQ ID NO: 1383440 - protein, 21 aa, Mycobacterium tuberculosis
SAGYLRKWFLLGITIGVIAGL

SEQ ID NO: 1383441 - protein, 25 aa, Mycobacterium tuberculosis
SAIAFLIFAVWVWREDTASDSETSP

SEQ ID NO: 1383442 - protein, 18 aa, Mycobacterium tuberculosis
SALATVWRAGVRLWTPSL

SEQ ID NO: 1383443 - protein, 19 aa, Mycobacterium tuberculosis
SALPQSLRKLAPRVQARNP

SEQ ID NO: 1383444 - protein, 20 aa, Mycobacterium tuberculosis
SALPQSLRKLPPRVQARNPV

SEQ ID NO: 1383445 - protein, 22 aa, Mycobacterium tuberculosis
SAMATLRIAFLSALVLELLATL

SEQ ID NO: 1383446 - protein, 17 aa, Mycobacterium tuberculosis
SAMRLSIVTTMYMSEPY

SEQ ID NO: 1383447 - protein, 31 aa, Mycobacterium tuberculosis
SAPDQRVTCGLKWPRKWTLKRTTRTSGSSFP

SEQ ID NO: 1383448 - protein, 39 aa, Mycobacterium tuberculosis; identical to SEQ ID NO: 234213

SEQ ID NO: 1383449 - protein, 18 aa, Mycobacterium tuberculosis
SAPPDWPMAAADRLHQQL

SEQ ID NO: 1383450 - protein, 24 aa, Mycobacterium tuberculosis
SAPPLRLLEDLPRRVRVSDAHQSG

SEQ ID NO: 1383451 - protein, 20 aa, Mycobacterium tuberculosis
SAPPQWFAGLVVVFTAAVLL

SEQ ID NO: 1383452 - protein, 23 aa, Mycobacterium tuberculosis
SAQARLAALSILVGAVGTTGPGV

SEQ ID NO: 1383453 - protein, 29 aa, Mycobacterium tuberculosis
SAQFAFFGWRWSLPLGVAILLAAVGGGLI

SEQ ID NO: 1383454 - protein, 19 aa, Mycobacterium tuberculosis
SAQRWKAIRGEAGWMTTYA

SEQ ID NO: 1383455 - protein, 25 aa, Mycobacterium tuberculosis
SAQRWKAIRGEAGWMTTYAYPAEAI

SEQ ID NO: 1383456 - protein, 21 aa, Mycobacterium tuberculosis
SARCRSLWRIAGKALAFMGQT

SEQ ID NO: 1383457 - protein, 19 aa, Mycobacterium tuberculosis
SARELWAGCLLPMVNLLWA

SEQ ID NO: 1383458 - protein, 17 aa, Mycobacterium tuberculosis
SARGVTFSRGWLPFLPT

SEQ ID NO: 1383459 - protein, 22 aa, Mycobacterium tuberculosis
SARRLSHFGALVRIPRSVEALG

SEQ ID NO: 1383460 - protein, 26 aa, Mycobacterium tuberculosis
SASFGASLLVSWLAGVLLSGMLTVIV

SEQ ID NO: 1383461 - protein, 21 aa, Mycobacterium tuberculosis
SATAWALAVVYVNEWQTDHTR

SEQ ID NO: 1383462 - protein, 17 aa, Mycobacterium tuberculosis
SATFLLRQQRIWGASTV

SEQ ID NO: 1383463 - protein, 18 aa, Mycobacterium tuberculosis
SATLFYLVAYSFSTMGAF

SEQ ID NO: 1383464 - protein, 26 aa, Mycobacterium tuberculosis
SATLIGGFLLMWILAWLTAAPVRVVR

SEQ ID NO: 1383465 - protein, 27 aa, Mycobacterium tuberculosis
SATLIGGFLLMWIMSWLTAAPVRVVRA

SEQ ID NO: 1383466 - protein, 28 aa, Mycobacterium tuberculosis
SAVAAVYVVFRWFFARDLRVVPERQQLK

SEQ ID NO: 1383467 - protein, 19 aa, Mycobacterium tuberculosis
SAWAVAGLGWLRRHTRAIQ

SEQ ID NO: 1383468 - protein, 22 aa, Mycobacterium tuberculosis
SAWWFDMAMLVALSVIYVGFVR

SEQ ID NO: 1383469 - protein, 19 aa, Mycobacterium tuberculosis
SCASAEWRAAGAAGTAAAL

SEQ ID NO: 1383470 - protein, 36 aa, Mycobacterium tuberculosis
SCEITATALLVVFIRYHFSMVWGLYLAAGIMVLASF

SEQ ID NO: 1383471 - protein, 31 aa, Mycobacterium tuberculosis
SCRSLTRSAWRLGMFANRWIILGVSAQAIAQ

SEQ ID NO: 1383472 - protein, 24 aa, Mycobacterium tuberculosis
SCTPEALRAFGIRECADAARALDN

SEQ ID NO: 1383473 - protein, 18 aa, Mycobacterium tuberculosis
SDHGTWWPYLVGGAVYNL

SEQ ID NO: 1383474 - protein, 19 aa, Mycobacterium tuberculosis
SDILLKEYWNRPEATRDAF

SEQ ID NO: 1383475 - protein, 25 aa, Mycobacterium tuberculosis
SDLAVLGYYEWREGLLRGLAAHHAG

SEQ ID NO: 1383476 - protein, 17 aa, Mycobacterium tuberculosis
SDLLWSFMQAIAMSIAV

SEQ ID NO: 1383477 - protein, 19 aa, Mycobacterium tuberculosis
SDLLWSFMQAIAMSIAVML

SEQ ID NO: 1383478 - protein, 17 aa, Mycobacterium tuberculosis
SDRLATLLAQFLDDPRW

SEQ ID NO: 1383479 - protein, 17 aa, Mycobacterium tuberculosis
SEAMLLAAIYVAALRSY

SEQ ID NO: 1383480 - protein, 17 aa, Mycobacterium tuberculosis
SEIQQFMMRLSRNLRRC

SEQ ID NO: 1383481 - protein, 18 aa, Mycobacterium tuberculosis
SEIQQFMMRLSRNLRRCR

SEQ ID NO: 1383482 - protein, 20 aa, Mycobacterium tuberculosis
SELPDCIVISVSHRPALERL

SEQ ID NO: 1383483 - protein, 23 aa, Mycobacterium tuberculosis
SELPSHCRGLLVGRVAGAHTPAA

SEQ ID NO: 1383484 - protein, 25 aa, Mycobacterium tuberculosis
SENECARWSLGETVTLRGHDQPIRL

SEQ ID NO: 1383485 - protein, 20 aa, Mycobacterium tuberculosis
SFGEFEFWFAGVKVATIVGF

SEQ ID NO: 1383486 - protein, 20 aa, Mycobacterium tuberculosis
SFLRRPARWMQLLATSGRCF

SEQ ID NO: 1383487 - protein, 27 aa, Mycobacterium tuberculosis
SFRRRLDEYIGFLVAWQRPLAGKKTCM

SEQ ID NO: 1383488 - protein, 28 aa, Mycobacterium tuberculosis
SFRRRLNEYIGFLVAWQRPLAGKKTLMD

SEQ ID NO: 1383489 - protein, 19 aa, Mycobacterium tuberculosis
SFTTLRLIYQEMLANYRVG

SEQ ID NO: 1383490 - protein, 21 aa, Mycobacterium tuberculosis
SFYTGHYFGAWVFIAGFLLHI

SEQ ID NO: 1383491 - protein, 27 aa, Mycobacterium tuberculosis
SFYTGHYFGAWVFIAGFLLHIVVKIPH

SEQ ID NO: 1383492 - protein, 17 aa, Mycobacterium tuberculosis
SGIPMKKMHAVSVPSNY

SEQ ID NO: 1383493 - protein, 23 aa, Mycobacterium tuberculosis
SGKMTSRSRLEVVDPSAAAQLAD

SEQ ID NO: 1383494 - protein, 22 aa, Mycobacterium tuberculosis
SGKSEFLRTLILSLVAMTHPDQ

SEQ ID NO: 1383495 - protein, 19 aa, Mycobacterium tuberculosis
SGLAEFGLAVNMQAIVFMS

SEQ ID NO: 1383496 - protein, 21 aa, Mycobacterium tuberculosis
SGLSINRFIAIDFVGFARMVE

SEQ ID NO: 1383497 - protein, 20 aa, Mycobacterium tuberculosis
SGLTGDDWLGPSALSMAAAA

SEQ ID NO: 1383498 - protein, 17 aa, Mycobacterium tuberculosis
SGPAWRLIGTTAVGLLL

SEQ ID NO: 1383499 - protein, 26 aa, Mycobacterium tuberculosis
SGPLTGRFWPPIGASFIGCGPTQFGC

SEQ ID NO: 1383500 - protein, 18 aa, Mycobacterium tuberculosis
SGRACITYRVEVGVCLAS

SEQ ID NO: 1383501 - protein, 28 aa, Mycobacterium tuberculosis
SGRSARPGLRCCASRPGWAPVWGSPRTR

SEQ ID NO: 1383502 - protein, 19 aa, Mycobacterium tuberculosis
SGRTFWVSSCTGWCGDVGD

SEQ ID NO: 1383503 - protein, 18 aa, Mycobacterium tuberculosis
SGVAAYFYVRVIVSMFFT

SEQ ID NO: 1383504 - protein, 23 aa, Mycobacterium tuberculosis
SGVPGTGWWGWHSPANAPFGHQY

SEQ ID NO: 1383505 - protein, 17 aa, Mycobacterium tuberculosis
SGWVCCMMIAVIASDVG

SEQ ID NO: 1383506 - protein, 20 aa, Mycobacterium tuberculosis
SHPMLSLGLPMLFIALGGIG

SEQ ID NO: 1383507 - protein, 18 aa, Mycobacterium tuberculosis
SHSRWLRATQFLGYASML

SEQ ID NO: 1383508 - protein, 25 aa, Mycobacterium tuberculosis
SIDWSRAFPDSVYWVGKAWTISAIC

SEQ ID NO: 1383509 - protein, 17 aa, Mycobacterium tuberculosis
SIGGILYAVRWPDPWPT

SEQ ID NO: 1383510 - protein, 24 aa, Mycobacterium tuberculosis
SILADKALRLAIAKGIDRYTIARV

SEQ ID NO: 1383511 - protein, 19 aa, Mycobacterium tuberculosis
SILIRGLMNYTFWMPNGSP

SEQ ID NO: 1383512 - protein, 26 aa, Mycobacterium tuberculosis
SIPGLAHFFTMWGFFILLTVYIEAYG

SEQ ID NO: 1383513 - protein, 17 aa, Mycobacterium tuberculosis
SITRRWGLRSTTRRSRF

SEQ ID NO: 1383514 - protein, 18 aa, Mycobacterium tuberculosis
SIVWSLPIGREIDAFHGI

SEQ ID NO: 1383515 - protein, 19 aa, Mycobacterium tuberculosis
SKDARRCRRGPGGGRGSVA

SEQ ID NO: 1383516 - protein, 19 aa, Mycobacterium tuberculosis
SKHHLWIFAGIAAAILAGG

SEQ ID NO: 1383517 - protein, 26 aa, Mycobacterium tuberculosis
SKPLRRGHKMIIGMRGSYGGVVMIGM

SEQ ID NO: 1383518 - protein, 17 aa, Mycobacterium tuberculosis
SLADARAGGPAVIASAA

SEQ ID NO: 1383519 - protein, 17 aa, Mycobacterium tuberculosis
SLAELMGGPDIAPPSSG

SEQ ID NO: 1383520 - protein, 18 aa, Mycobacterium tuberculosis
SLANERLAWVLGAALLLI

SEQ ID NO: 1383521 - protein, 19 aa, Mycobacterium tuberculosis
SLANERLAWVLGAALLLIA

SEQ ID NO: 1383522 - protein, 20 aa, Mycobacterium tuberculosis
SLCLIFIIMLGITRSVVASA

SEQ ID NO: 1383523 - protein, 25 aa, Mycobacterium tuberculosis
SLGGVLAYACAIGLRRLGKDVRFVG

SEQ ID NO: 1383524 - protein, 17 aa, Mycobacterium tuberculosis
SLLAGRAVNKWGSSAPG

SEQ ID NO: 1383525 - protein, 19 aa, Mycobacterium tuberculosis
SLLERAAAIGARYQQAFAL

SEQ ID NO: 1383526 - protein, 26 aa, Mycobacterium tuberculosis
SLLGAICLLGTLWLVMRARSSAPAGA

SEQ ID NO: 1383527 - protein, 17 aa, Mycobacterium tuberculosis
SLLLNWVLGPALMFALA

SEQ ID NO: 1383528 - protein, 18 aa, Mycobacterium tuberculosis
SLLLNWVLGPALMFALAW

SEQ ID NO: 1383529 - protein, 26 aa, Mycobacterium tuberculosis
SLNNGFHGKWPWQMTHPMDDAVQIDK

SEQ ID NO: 1383530 - protein, 27 aa, Mycobacterium tuberculosis
SLNNGFHGKWPWQMTHPMDGAVQIDKY

SEQ ID NO: 1383531 - protein, 18 aa, Mycobacterium tuberculosis
SLNPRLPVVPGGDYIMGE

SEQ ID NO: 1383532 - protein, 21 aa, Mycobacterium tuberculosis
SLPTDRPIIYATLGSSGGKNL

SEQ ID NO: 1383533 - protein, 19 aa, Mycobacterium tuberculosis
SLRDKRTGLAVLDCAADVV

SEQ ID NO: 1383534 - protein, 19 aa, Mycobacterium tuberculosis
SLRIFPATHYVAGPERMAH

SEQ ID NO: 1383535 - protein, 20 aa, Mycobacterium tuberculosis
SLSNLLWRGVLRRHNVDASV

SEQ ID NO: 1383536 - protein, 21 aa, Mycobacterium tuberculosis
SLTYLDVCDQVLLLAPGGKTA

SEQ ID NO: 1383537 - protein, 21 aa, Mycobacterium tuberculosis
SLVAAWAYPLWPVVLGLKALA

SEQ ID NO: 1383538 - protein, 18 aa, Mycobacterium tuberculosis
SMAPLWFSSYILQLRVPT

SEQ ID NO: 1383539 - protein, 25 aa, Mycobacterium tuberculosis
SMLQRKLRVGFAKAGRLMDLMETRA

SEQ ID NO: 1383540 - protein, 17 aa, Mycobacterium tuberculosis
SMSLSVFRALHKGAGRW

SEQ ID NO: 1383541 - protein, 21 aa, Mycobacterium tuberculosis
SMVFAILVLLGRYINYTLDLA

SEQ ID NO: 1383542 - protein, 22 aa, Mycobacterium tuberculosis
SMVFAILVLLGRYINYTLDLAG

SEQ ID NO: 1383543 - protein, 25 aa, Mycobacterium tuberculosis
SMVFGELVPKCLAVARPLRTARSVV

SEQ ID NO: 1383544 - protein, 19 aa, Mycobacterium tuberculosis
SPAAPSLRRLGGSRHITHW

SEQ ID NO: 1383545 - protein, 43 aa, Mycobacterium tuberculosis
SPACLHHFGAFYKRSWRANDWMWGRLDGAGWLVHVLLDPRRVR

SEQ ID NO: 1383546 - protein, 19 aa, Mycobacterium tuberculosis
SPARLTAWIAASALILLTG

SEQ ID NO: 1383547 - protein, 18 aa, Mycobacterium tuberculosis
SPGPLGIIFSLVCIGIAA

SEQ ID NO: 1383548 - protein, 18 aa, Mycobacterium tuberculosis
SPHGIRIGVIRTVGSTGG

SEQ ID NO: 1383549 - protein, 19 aa, Mycobacterium tuberculosis
SPIPPAARPSCCVRSALAT

SEQ ID NO: 1383550 - protein, 25 aa, Mycobacterium tuberculosis
SPLPRSARQPWLWVGVAVAVVVALA

SEQ ID NO: 1383551 - protein, 18 aa, Mycobacterium tuberculosis
SPLWSGRVFAEARWLPVA

SEQ ID NO: 1383552 - protein, 18 aa, Mycobacterium tuberculosis
SPPSIRWAAGRDQRGAAS

SEQ ID NO: 1383553 - protein, 25 aa, Mycobacterium tuberculosis
SPRHRLPGLYGYRVARHDEAKAGGL

SEQ ID NO: 1383554 - protein, 17 aa, Mycobacterium tuberculosis
SPRPRIVSMRGQAANLV

SEQ ID NO: 1383555 - protein, 21 aa, Mycobacterium tuberculosis
SPRRTRCGPFGRTIVEKPTAG

SEQ ID NO: 1383556 - protein, 20 aa, Mycobacterium tuberculosis
SPRRWLRAVAVIGATAMLLA

SEQ ID NO: 1383557 - protein, 26 aa, Mycobacterium tuberculosis
SPRSARRVAGVWTVFVLASAGWALDG

SEQ ID NO: 1383558 - protein, 27 aa, Mycobacterium tuberculosis
SPRSSSGNRAWWILAAVVVVGVLVLVG

SEQ ID NO: 1383559 - protein, 19 aa, Mycobacterium tuberculosis
SPVSLGRGRLMFRATVQRL

SEQ ID NO: 1383560 - protein, 25 aa, Mycobacterium tuberculosis
SPVSLGRGRLMFRATVQRLRDDETS

SEQ ID NO: 1383561 - protein, 18 aa, Mycobacterium tuberculosis
SQARMKPEILMIESDHDM

SEQ ID NO: 1383562 - protein, 22 aa, Mycobacterium tuberculosis
SQFDALHFAKPIFGPAARALAQ

SEQ ID NO: 1383563 - protein, 24 aa, Mycobacterium tuberculosis
SQPSMIGQLVQWLLSVGGLAYLVW

SEQ ID NO: 1383564 - protein, 25 aa, Mycobacterium tuberculosis
SQRRASYLLPSWVGCGRRSRRICRR

SEQ ID NO: 1383565 - protein, 24 aa, Mycobacterium tuberculosis
SQTLRLSYMALFSVPVVAPLLLRV

SEQ ID NO: 1383566 - protein, 20 aa, Mycobacterium tuberculosis
SQVPPQRWQPFEGGPPEVAA

SEQ ID NO: 1383567 - protein, 22 aa, Mycobacterium tuberculosis
SRAVAVAWRRSLQLRVVALTLG

SEQ ID NO: 1383568 - protein, 19 aa, Mycobacterium tuberculosis
SREGTQFGPYRLRRLVGRG

SEQ ID NO: 1383569 - protein, 23 aa, Mycobacterium tuberculosis
SRETLGRTCWRGERRAWIEVRGL

SEQ ID NO: 1383570 - protein, 23 aa, Mycobacterium tuberculosis
SRFLPKVGPWALYGLLFTIVILF

SEQ ID NO: 1383571 - protein, 18 aa, Mycobacterium tuberculosis
SRFSCSAGDFASRRGPPT

SEQ ID NO: 1383572 - protein, 23 aa, Mycobacterium tuberculosis
SRGKWDTLRAMGFDDDHIGDSRT

SEQ ID NO: 1383573 - protein, 20 aa, Mycobacterium tuberculosis
SRGLVLIKWWLLAIPHYLIL

SEQ ID NO: 1383574 - protein, 21 aa, Mycobacterium tuberculosis
SRLCDLEQMIPLMPGAQLIGH

SEQ ID NO: 1383575 - protein, 18 aa, Mycobacterium tuberculosis
SRLLRIASPMFHFGILVV

SEQ ID NO: 1383576 - protein, 17 aa, Mycobacterium tuberculosis
SRLLVRLGGAGGMVSLA

SEQ ID NO: 1383577 - protein, 25 aa, Mycobacterium tuberculosis
SRMWRRSGVRIVRRPTIHLVGSLIV

SEQ ID NO: 1383578 - protein, 26 aa, Mycobacterium tuberculosis
SRMWRRSGVRIVRRPTIHLVGSLIVL

SEQ ID NO: 1383579 - protein, 17 aa, Mycobacterium tuberculosis
SRPELIEGIGRRVLSWA

SEQ ID NO: 1383580 - protein, 19 aa, Mycobacterium tuberculosis
SRPGWAPVWGSPRTRSSRW

SEQ ID NO: 1383581 - protein, 18 aa, Mycobacterium tuberculosis
SRRARRRVAIALGVLVAA

SEQ ID NO: 1383582 - protein, 26 aa, Mycobacterium tuberculosis
SRRPPWWLWSCFVMHPTFGPTPTRCC

SEQ ID NO: 1383583 - protein, 29 aa, Mycobacterium tuberculosis
SRRPRPPRICWCGSLPWEPPTERVKPTSR

SEQ ID NO: 1383584 - protein, 35 aa, Mycobacterium tuberculosis
SRRRRRDRWFGGWDRRQPGCGLGTAATAARAAPAV

SEQ ID NO: 1383585 - protein, 17 aa, Mycobacterium tuberculosis
SRRSFGFHCQVVGVGQQ

SEQ ID NO: 1383586 - protein, 18 aa, Mycobacterium tuberculosis
SRTLRLLVVSALATLSGL

SEQ ID NO: 1383587 - protein, 22 aa, Mycobacterium tuberculosis
SRTLRLLVVSALATLSGLGTPV

SEQ ID NO: 1383588 - protein, 28 aa, Mycobacterium tuberculosis
SSARLKATMLAHWAWLSMLLVGGAGAAG

SEQ ID NO: 1383589 - protein, 18 aa, Mycobacterium tuberculosis
SSCTGWCGDVGDPAPGGG

SEQ ID NO: 1383590 - protein, 29 aa, Mycobacterium tuberculosis
SSDHSRRLWTMLIFMLWHAIFVEHSVVPQ

SEQ ID NO: 1383591 - protein, 18 aa, Mycobacterium tuberculosis
SSLVALHMAVGSLRSGEC

SEQ ID NO: 1383592 - protein, 26 aa, Mycobacterium tuberculosis
SSQFSVRLLRTFLRDVPNQVVLAIFA

SEQ ID NO: 1383593 - protein, 22 aa, Mycobacterium tuberculosis
SSRVGYGLRCSSSMAGTLSHAL

SEQ ID NO: 1383594 - protein, 35 aa, Mycobacterium tuberculosis
SSVGVFLFINVFFFICFFFFFYYYFYFIVITFFFF

SEQ ID NO: 1383595 - protein, 19 aa, Mycobacterium tuberculosis
STALRPLALLMLAAAVAAL

SEQ ID NO: 1383596 - protein, 19 aa, Mycobacterium tuberculosis
STASHHRRALGIQRLLAAR

SEQ ID NO: 1383597 - protein, 27 aa, Mycobacterium tuberculosis
STGMGPGPLLAAARAWHALAAQYTEIA

SEQ ID NO: 1383598 - protein, 17 aa, Mycobacterium tuberculosis
STGMRIYVEYNKRDPNL

SEQ ID NO: 1383599 - protein, 27 aa, Mycobacterium tuberculosis
STGRWSGRAARTWCPDCSAGCPSPVSS

SEQ ID NO: 1383600 - protein, 33 aa, Mycobacterium tuberculosis
STHSWRCAAILLFGGRRTDAWGHLLGCAAALAA

SEQ ID NO: 1383601 - protein, 23 aa, Mycobacterium tuberculosis
STLPGIGTLAAWFAAAGEVVVFL

SEQ ID NO: 1383602 - protein, 17 aa, Mycobacterium tuberculosis
STRAMCPMRSTWCAAAA

SEQ ID NO: 1383603 - protein, 18 aa, Mycobacterium tuberculosis
STSKWPSRRRSTVTDTSF

SEQ ID NO: 1383604 - protein, 19 aa, Mycobacterium tuberculosis
STVLFAIVVDFAITVVTGI

SEQ ID NO: 1383605 - protein, 17 aa, Mycobacterium tuberculosis
STVPPLVLAMTFGLSMD

SEQ ID NO: 1383606 - protein, 17 aa, Mycobacterium tuberculosis
STVRPGIPVAFDAVIAR

SEQ ID NO: 1383607 - protein, 18 aa, Mycobacterium tuberculosis
SVAQEVVQWANTVTESCA

SEQ ID NO: 1383608 - protein, 26 aa, Mycobacterium tuberculosis
SVFRALHKGAGRWHGRGHVTMFARPT

SEQ ID NO: 1383609 - protein, 24 aa, Mycobacterium tuberculosis
SVGVLTWIVLNLFAVGLRWDPYPF

SEQ ID NO: 1383610 - protein, 19 aa, Mycobacterium tuberculosis
SVIPRLFVWPPARSIAQVL

SEQ ID NO: 1383611 - protein, 17 aa, Mycobacterium tuberculosis
SVLHLARTIAGPGGDKL

SEQ ID NO: 1383612 - protein, 19 aa, Mycobacterium tuberculosis
SVPLGLLLMTARRRPSFLR

SEQ ID NO: 1383613 - protein, 20 aa, Mycobacterium tuberculosis
SVPLGLLLMTARRRPSFLRP

SEQ ID NO: 1383614 - protein, 21 aa, Mycobacterium tuberculosis
SVRSLPDFWRLLQVRVASQFG

SEQ ID NO: 1383615 - protein, 17 aa, Mycobacterium tuberculosis
SVTAVAVLFGWGSWQRR

SEQ ID NO: 1383616 - protein, 23 aa, Mycobacterium tuberculosis
SVTAVAVLFGWGSWQRRWIADDG

SEQ ID NO: 1383617 - protein, 20 aa, Mycobacterium tuberculosis
SVTMPGKFAALRFADERTAR

SEQ ID NO: 1383618 - protein, 22 aa, Mycobacterium tuberculosis
SVVAGLAWYLTHDVFNHPQAFF

SEQ ID NO: 1383619 - protein, 19 aa, Mycobacterium tuberculosis
SVVGLGLFNPLSVGAGLIL

SEQ ID NO: 1383620 - protein, 18 aa, Mycobacterium tuberculosis
SVVIGLMLQNSVGQIVSG

SEQ ID NO: 1383621 - protein, 23 aa, Mycobacterium tuberculosis
SVVVGLWGAMTFGPFIAHHIAPV

SEQ ID NO: 1383622 - protein, 20 aa, Mycobacterium tuberculosis
SWAMAFATLISRITGFARIV

SEQ ID NO: 1383623 - protein, 21 aa, Mycobacterium tuberculosis
SWAMAFATLISRITGFARIVL

SEQ ID NO: 1383624 - protein, 18 aa, Mycobacterium tuberculosis
SWRRLSRRRTTACSGPSE

SEQ ID NO: 1383625 - protein, 21 aa, Mycobacterium tuberculosis
SWSEALGIGWPEGITPEAHLN

SEQ ID NO: 1383626 - protein, 26 aa, Mycobacterium tuberculosis
SWVGCGRRSRRICRRSATSPPALGVE

SEQ ID NO: 1383627 - protein, 17 aa, Mycobacterium tuberculosis
SWWCTGRCQTRRRADGC

SEQ ID NO: 1383628 - protein, 18 aa, Mycobacterium tuberculosis
SYKPSMALIVGSMMNALL

SEQ ID NO: 1383629 - protein, 18 aa, Mycobacterium tuberculosis
SYLKDDWFRDWGALQRLT

SEQ ID NO: 1383630 - protein, 27 aa, Mycobacterium tuberculosis
SYSGNHARLKLAIDSGEMGFIPSNATV

SEQ ID NO: 1383631 - protein, 19 aa, Mycobacterium tuberculosis
TAAALWLVAPCTELYHDSR

SEQ ID NO: 1383632 - protein, 24 aa, Mycobacterium tuberculosis
TAASKCYVVPPSARGWVHAYSVTA

SEQ ID NO: 1383633 - protein, 20 aa, Mycobacterium tuberculosis
TADICSRIVSLPVHDHMAPD

SEQ ID NO: 1383634 - protein, 17 aa, Mycobacterium tuberculosis
TAFAFGLLPGHGMDFSN

SEQ ID NO: 1383635 - protein, 22 aa, Mycobacterium tuberculosis
TAGHVGNCCNGFYDGSSSVGVF

SEQ ID NO: 1383636 - protein, 20 aa, Mycobacterium tuberculosis
TAILMLYSIVIIRGLRTAIA

SEQ ID NO: 1383637 - protein, 17 aa, Mycobacterium tuberculosis
TAIRRWGRYATANGALA

SEQ ID NO: 1383638 - protein, 24 aa, Mycobacterium tuberculosis
TAKGGIVFRVQQELGVPVKLVGLG

SEQ ID NO: 1383639 - protein, 22 aa, Mycobacterium tuberculosis
TAKLIIWYPHYAWLLLSVYLTV

SEQ ID NO: 1383640 - protein, 17 aa, Mycobacterium tuberculosis
TALCALAAALGLIATLL

SEQ ID NO: 1383641 - protein, 18 aa, Mycobacterium tuberculosis
TALCALAAALGLIATLLV

SEQ ID NO: 1383642 - protein, 19 aa, Mycobacterium tuberculosis
TALMSSCIVAAQVVMVPVA

SEQ ID NO: 1383643 - protein, 25 aa, Mycobacterium tuberculosis
TAPIRRIPALTARCYVLTIRYRGPC

SEQ ID NO: 1383644 - protein, 23 aa, Mycobacterium tuberculosis
TASCKHPMIFPLSNPTSRMEAIP

SEQ ID NO: 1383645 - protein, 24 aa, Mycobacterium tuberculosis
TASITWGVLASFFVSTLLRVAFPD

SEQ ID NO: 1383646 - protein, 24 aa, Mycobacterium tuberculosis
TASKGKWDTLRAMGFDDDHISDSR

SEQ ID NO: 1383647 - protein, 21 aa, Mycobacterium tuberculosis
TAVAVLFGWGSWQRRWIADDG

SEQ ID NO: 1383648 - protein, 22 aa, Mycobacterium tuberculosis
TAVMPACYTAPVGPAEPAGSAG

SEQ ID NO: 1383649 - protein, 18 aa, Mycobacterium tuberculosis
TCAGPVRVARKVHGATVS

SEQ ID NO: 1383650 - protein, 18 aa, Mycobacterium tuberculosis
TCALARLSTAGMRPPTGT

SEQ ID NO: 1383651 - protein, 18 aa, Mycobacterium tuberculosis
TCATGCSWSGWRRCWWRC

SEQ ID NO: 1383652 - protein, 21 aa, Mycobacterium tuberculosis
TCRSHRRYAPLPGDDGVGVPL

SEQ ID NO: 1383653 - protein, 18 aa, Mycobacterium tuberculosis
TCSARWRGSRRCCSTWSR

SEQ ID NO: 1383654 - protein, 20 aa, Mycobacterium tuberculosis
TDADGCAAATMLGLSLASSS

SEQ ID NO: 1383655 - protein, 19 aa, Mycobacterium tuberculosis
TDAEAILGIGDWGVGGIQI

SEQ ID NO: 1383656 - protein, 20 aa, Mycobacterium tuberculosis
TDFGRLKALGRMESKPLRRG

SEQ ID NO: 1383657 - protein, 22 aa, Mycobacterium tuberculosis
TDFGRLKALGRMESKPLRRGHK

SEQ ID NO: 1383658 - protein, 17 aa, Mycobacterium tuberculosis
TDITAPWGIAVDEAGTV

SEQ ID NO: 1383659 - protein, 17 aa, Mycobacterium tuberculosis
TDLLLDALAEREEVDFA

SEQ ID NO: 1383660 - protein, 23 aa, Mycobacterium tuberculosis
TDMFPALAVAVTSQFAEPDDAEY

SEQ ID NO: 1383661 - protein, 18 aa, Mycobacterium tuberculosis
TDRVARLALVDSAAPGTV

SEQ ID NO: 1383662 - protein, 27 aa, Mycobacterium tuberculosis
TDVDFAVRICTEITGLVRTLAERDADK

SEQ ID NO: 1383663 - protein, 18 aa, Mycobacterium tuberculosis
TDWTGRFNASPLREALIG

SEQ ID NO: 1383664 - protein, 17 aa, Mycobacterium tuberculosis
TEAFNLMLRALAESRER

SEQ ID NO: 1383665 - protein, 26 aa, Mycobacterium tuberculosis
TEILRGGRSRLVFGTLAILLCLVLGV

SEQ ID NO: 1383666 - protein, 21 aa, Mycobacterium tuberculosis
TELFPLAMLSVGGMMVFPASN

SEQ ID NO: 1383667 - protein, 17 aa, Mycobacterium tuberculosis
TELRTRLLISLAAILVT

SEQ ID NO: 1383668 - protein, 17 aa, Mycobacterium tuberculosis
TEQIPFWTFLRNSLIIT

SEQ ID NO: 1383669 - protein, 20 aa, Mycobacterium tuberculosis
TEQSLRFTAALDELLAPLAE

SEQ ID NO: 1383670 - protein, 18 aa, Mycobacterium tuberculosis
TERIWLPFTIWLTAAPAL

SEQ ID NO: 1383671 - protein, 25 aa, Mycobacterium tuberculosis
TFDVVLCGLALSILAAAIVIGRLRQ

SEQ ID NO: 1383672 - protein, 17 aa, Mycobacterium tuberculosis
TFHAQFVQTLSAGAGAY

SEQ ID NO: 1383673 - protein, 32 aa, Mycobacterium tuberculosis
TFIAVLVLWDLFGQLPLPLGVVGHEGSTVLVA

SEQ ID NO: 1383674 - protein, 26 aa, Mycobacterium tuberculosis
TFRLRLPCRTILRGVSRNPLVRGTDR

SEQ ID NO: 1383675 - protein, 25 aa, Mycobacterium tuberculosis
TFRLRLPCRTILRVFSRNSLVRGTD

SEQ ID NO: 1383676 - protein, 23 aa, Mycobacterium tuberculosis
TGDNGRAAWRVARNAGITDVRAA

SEQ ID NO: 1383677 - protein, 20 aa, Mycobacterium tuberculosis
TGGAEWGRWGSLSTCSPLYL

SEQ ID NO: 1383678 - protein, 18 aa, Mycobacterium tuberculosis
TGGETIDLLARMRGGIDN

SEQ ID NO: 1383679 - protein, 28 aa, Mycobacterium tuberculosis
TGGLFAQLGLWRWAFGVMTLLTALMAML

SEQ ID NO: 1383680 - protein, 18 aa, Mycobacterium tuberculosis
TGGQRWLSVALEPTTADD

SEQ ID NO: 1383681 - protein, 22 aa, Mycobacterium tuberculosis
TGGVAAVYAWLRRRRRPPDSSS

SEQ ID NO: 1383682 - protein, 22 aa, Mycobacterium tuberculosis
TGIPLALGSYWAMFILVPGTLV

SEQ ID NO: 1383683 - protein, 26 aa, Mycobacterium tuberculosis
TGKSELWPDLNLGLPFTYHQGYQSSP

SEQ ID NO: 1383684 - protein, 19 aa, Mycobacterium tuberculosis
TGMKVRRYFVGFGPTLWST

SEQ ID NO: 1383685 - protein, 23 aa, Mycobacterium tuberculosis
TGRTPLPPRRDWQLDTLDTELRR

SEQ ID NO: 1383686 - protein, 17 aa, Mycobacterium tuberculosis
TGSVVVWYSPRRADRAA

SEQ ID NO: 1383687 - protein, 17 aa, Mycobacterium tuberculosis
THHFGVFAGLAGSLGAL

SEQ ID NO: 1383688 - protein, 18 aa, Mycobacterium tuberculosis
THHFGVFAGLAGSLGALA

SEQ ID NO: 1383689 - protein, 23 aa, Mycobacterium tuberculosis
TIALASLWLSGPLQLGLGAIQLV

SEQ ID NO: 1383690 - protein, 27 aa, Mycobacterium tuberculosis
TIKRWFPGFMTFRFLECGLLTMVSNLL

SEQ ID NO: 1383691 - protein, 17 aa, Mycobacterium tuberculosis
TIMVCFHLGILTAVPMG

SEQ ID NO: 1383692 - protein, 21 aa, Mycobacterium tuberculosis
TITLAIGMARMAKRRAVIRRL

SEQ ID NO: 1383693 - protein, 24 aa, Mycobacterium tuberculosis
TKKGQRAGGVAVIVTFFCLIDCCR

SEQ ID NO: 1383694 - protein, 19 aa, Mycobacterium tuberculosis
TKLEVFSAVGPAIAVAITV

SEQ ID NO: 1383695 - protein, 29 aa, Mycobacterium tuberculosis
TKRRWRRIGTVVVRWPGPVLAATLLIALI

SEQ ID NO: 1383696 - protein, 23 aa, Mycobacterium tuberculosis
TLAARRTTLIVAHGLAIAEHADR

SEQ ID NO: 1383697 - protein, 20 aa, Mycobacterium tuberculosis
TLADLYGRRRWYLIGVSLFT

SEQ ID NO: 1383698 - protein, 26 aa, Mycobacterium tuberculosis
TLFHLSLRHALWWLGSLAAVASFTLQ

SEQ ID NO: 1383699 - protein, 17 aa, Mycobacterium tuberculosis
TLFPMGKLFAGACVVWF

SEQ ID NO: 1383700 - protein, 17 aa, Mycobacterium tuberculosis
TLGARPGTVWWRVTLPL

SEQ ID NO: 1383701 - protein, 30 aa, Mycobacterium tuberculosis
TLGARPGTVWWRVTLPLLLPGVVSGSVLAF

SEQ ID NO: 1383702 - protein, 25 aa, Mycobacterium tuberculosis
TLLAGAISRTHWLASHLAMALAGSA

SEQ ID NO: 1383703 - protein, 19 aa, Mycobacterium tuberculosis
TLLGRPLIGNGADGGPGQN

SEQ ID NO: 1383704 - protein, 22 aa, Mycobacterium tuberculosis
TLRDWLTRYRPAGCGSDSPAGS

SEQ ID NO: 1383705 - protein, 17 aa, Mycobacterium tuberculosis
TLRRWLRPATAAVVCCL

SEQ ID NO: 1383706 - protein, 26 aa, Mycobacterium tuberculosis
TLSAPLIEHQRHWSLRRSVGASGPQE

SEQ ID NO: 1383707 - protein, 28 aa, Mycobacterium tuberculosis
TLSGRFCVPVVRTPRPQLTAAFGGALWA

SEQ ID NO: 1383708 - protein, 18 aa, Mycobacterium tuberculosis
TLTLPGIRDALAARTDDS

SEQ ID NO: 1383709 - protein, 23 aa, Mycobacterium tuberculosis
TLVGACLRFPYTLPPQSSGGATG

SEQ ID NO: 1383710 - protein, 18 aa, Mycobacterium tuberculosis
TLVLTGLVNGFRVEAERT

SEQ ID NO: 1383711 - protein, 23 aa, Mycobacterium tuberculosis
TLWPRFLAGKGVMLSEPMVSRQH

SEQ ID NO: 1383712 - protein, 18 aa, Mycobacterium tuberculosis
TMRRFSWSGSAPVLDPLP

SEQ ID NO: 1383713 - protein, 20 aa, Mycobacterium tuberculosis
TNFRWGGAFDLDRLLFKRNI

SEQ ID NO: 1383714 - protein, 17 aa, Mycobacterium tuberculosis
TPADVLGGFDFTAQGVW

SEQ ID NO: 1383715 - protein, 29 aa, Mycobacterium tuberculosis
TPALATLLGRWFWWPRRVDRLARQPQVLG

SEQ ID NO: 1383716 - protein, 18 aa, Mycobacterium tuberculosis
TPAPYGPLFLWIVGGNLR

SEQ ID NO: 1383717 - protein, 18 aa, Mycobacterium tuberculosis
TPGPSDRRALHTAFAGAA

SEQ ID NO: 1383718 - protein, 25 aa, Mycobacterium tuberculosis
TPIAAGPRRARSGAGTGLAGVAAVA

SEQ ID NO: 1383719 - protein, 20 aa, Mycobacterium tuberculosis
TPIKMLLRLALDAGSGVFFF

SEQ ID NO: 1383720 - protein, 24 aa, Mycobacterium tuberculosis
TPLTAKLAWFSKFLTIAILGLAAL

SEQ ID NO: 1383721 - protein, 35 aa, Mycobacterium tuberculosis
TPQPPDVNTWWAFRTSCTPTECLAAATMLDDNDHT

SEQ ID NO: 1383722 - protein, 18 aa, Mycobacterium tuberculosis
TPREWNWAVLLAGAVAVI

SEQ ID NO: 1383723 - protein, 20 aa, Mycobacterium tuberculosis
TPSDEAFVFMDYDTKTGDQI

SEQ ID NO: 1383724 - protein, 28 aa, Mycobacterium tuberculosis
TPSIAALLGRWFWWPLRVRSRPARTPTV

SEQ ID NO: 1383725 - protein, 18 aa, Mycobacterium tuberculosis
TPSNRYRYCQGFIENLSR

SEQ ID NO: 1383726 - protein, 20 aa, Mycobacterium tuberculosis
TPTLYRPAGGLSNDAVRQAA

SEQ ID NO: 1383727 - protein, 21 aa, Mycobacterium tuberculosis
TPWSWLPRIVTQFAAGALACA

SEQ ID NO: 1383728 - protein, 18 aa, Mycobacterium tuberculosis
TPWWEDRFQQEPKQPPAP

SEQ ID NO: 1383729 - protein, 17 aa, Mycobacterium tuberculosis
TPYELAATIARRLGLTG

SEQ ID NO: 1383730 - protein, 28 aa, Mycobacterium tuberculosis
TPYELAATIARRLGLTGALGTVAESVDG

SEQ ID NO: 1383731 - protein, 17 aa, Mycobacterium tuberculosis
TQEGVKWLIPWLEDSVR

SEQ ID NO: 1383732 - protein, 21 aa, Mycobacterium tuberculosis
TQLWLGRPLIGDGVHGAPGTG

SEQ ID NO: 1383733 - protein, 25 aa, Mycobacterium tuberculosis
TQPVLLDWAVGLAFPCQQPMLHANG

SEQ ID NO: 1383734 - protein, 18 aa, Mycobacterium tuberculosis
TQTVLPFTGLNDPDGVAV

SEQ ID NO: 1383735 - protein, 22 aa, Mycobacterium tuberculosis
TRADAWGRKPIFLVGFAVLTAR

SEQ ID NO: 1383736 - protein, 26 aa, Mycobacterium tuberculosis
TRADGLPDRRVMWLPASLRRRHPGVP

SEQ ID NO: 1383737 - protein, 26 aa, Mycobacterium tuberculosis
TRAGVLRFVVLDGLAKPGRMVGPDPG

SEQ ID NO: 1383738 - protein, 25 aa, Mycobacterium tuberculosis
TRETSTCPRCLPLAKRAADILRQDV

SEQ ID NO: 1383739 - protein, 25 aa, Mycobacterium tuberculosis
TRGDGKCHPAILPPLFGCNDRAMPD

SEQ ID NO: 1383740 - protein, 26 aa, Mycobacterium tuberculosis
TRGDGKCHPAILPPLFGCNDRAMPDG

SEQ ID NO: 1383741 - protein, 18 aa, Mycobacterium tuberculosis
TRGIPRLASVAPLDPNVV

SEQ ID NO: 1383742 - protein, 26 aa, Mycobacterium tuberculosis
TRGRRLAWCSAEFNGAIVVNVPLASN

SEQ ID NO: 1383743 - protein, 27 aa, Mycobacterium tuberculosis
TRHVERFFAESWARLTAGRTARVVLLD

SEQ ID NO: 1383744 - protein, 20 aa, Mycobacterium tuberculosis
TRISLNFAVFRAAFEQGAQL

SEQ ID NO: 1383745 - protein, 20 aa, Mycobacterium tuberculosis
TRLGLCTVPAALAMAVLALV

SEQ ID NO: 1383746 - protein, 20 aa, Mycobacterium tuberculosis
TRPWNIKPGDVMPATYVGIW

SEQ ID NO: 1383747 - protein, 18 aa, Mycobacterium tuberculosis
TRQLWKLMFIETGLMGGM

SEQ ID NO: 1383748 - protein, 17 aa, Mycobacterium tuberculosis
TRRGLRALLSLVPDQAT

SEQ ID NO: 1383749 - protein, 19 aa, Mycobacterium tuberculosis
TRSACPVTWTVRRFYRHDL

SEQ ID NO: 1383750 - protein, 24 aa, Mycobacterium tuberculosis
TRSGWRQLCRKWQPYRSVPSGNTW

SEQ ID NO: 1383751 - protein, 22 aa, Mycobacterium tuberculosis
TRYRPRVRVGFASRLADAAVIA

SEQ ID NO: 1383752 - protein, 25 aa, Mycobacterium tuberculosis
TSDIKNLLPMLAVFKPTVVVSVPRV

SEQ ID NO: 1383753 - protein, 26 aa, Mycobacterium tuberculosis
TSDIKNLLPMLAVFKPTVVVSVPRVF

SEQ ID NO: 1383754 - protein, 25 aa, Mycobacterium tuberculosis
TSELWAEAGKLGFLGVNLPEEYGGG

SEQ ID NO: 1383755 - protein, 29 aa, Mycobacterium tuberculosis
TSLWGNCTIKVMVGFLFLYPAFVAKAHEA

SEQ ID NO: 1383756 - protein, 17 aa, Mycobacterium tuberculosis
TSSGVLLLWSWLVMSLA

SEQ ID NO: 1383757 - protein, 25 aa, Mycobacterium tuberculosis
TTALGYRPSNPSARRSKPDTERPWG

SEQ ID NO: 1383758 - protein, 18 aa, Mycobacterium tuberculosis
TTGRVVVCRIVWGGAIAG

SEQ ID NO: 1383759 - protein, 17 aa, Mycobacterium tuberculosis
TTIFGFVWYSHSIFGLD

SEQ ID NO: 1383760 - protein, 18 aa, Mycobacterium tuberculosis
TTIGVAMLIGRFFLIIPV

SEQ ID NO: 1383761 - protein, 27 aa, Mycobacterium tuberculosis
TTIKRWFRWFLTFLFLECGFVTIVSNP

SEQ ID NO: 1383762 - protein, 22 aa, Mycobacterium tuberculosis
TTLAILMLLPLSAFEATVALPA

SEQ ID NO: 1383763 - protein, 29 aa, Mycobacterium tuberculosis
TTLLVEGRVALTIPADWSTQRVVSGPGSA

SEQ ID NO: 1383764 - protein, 19 aa, Mycobacterium tuberculosis
TTLWMLVGLAVHDAISIIG

SEQ ID NO: 1383765 - protein, 25 aa, Mycobacterium tuberculosis
TTRCVQRLRCYPGHRSRRTDAQPND

SEQ ID NO: 1383766 - protein, 19 aa, Mycobacterium tuberculosis
TTRQLWKLMFIETGLMGGM

SEQ ID NO: 1383767 - protein, 17 aa, Mycobacterium tuberculosis
TTSLALGCVLAIVAAMG

SEQ ID NO: 1383768 - protein, 17 aa, Mycobacterium tuberculosis
TTVGAGWFGLFGLAFWV

SEQ ID NO: 1383769 - protein, 17 aa, Mycobacterium tuberculosis
TTVGLLPAWQIVLILLL

SEQ ID NO: 1383770 - protein, 23 aa, Mycobacterium tuberculosis
TTVIIRFWLLTAITCGLGVALFY

SEQ ID NO: 1383771 - protein, 20 aa, Mycobacterium tuberculosis
TTVLACAVAMGFWMGSGAQF

SEQ ID NO: 1383772 - protein, 17 aa, Mycobacterium tuberculosis
TTVRGGCGYEFRLETSC

SEQ ID NO: 1383773 - protein, 22 aa, Mycobacterium tuberculosis
TVAWLRSWWSGRWLTSGAFHRS

SEQ ID NO: 1383774 - protein, 21 aa, Mycobacterium tuberculosis
TVIAILLMWSKLPAKVRIIPG

SEQ ID NO: 1383775 - protein, 18 aa, Mycobacterium tuberculosis
TVIIRFWLLTAITCGLGV

SEQ ID NO: 1383776 - protein, 23 aa, Mycobacterium tuberculosis
TVILAVLVKPQFVVLGVVLLAAR

SEQ ID NO: 1383777 - protein, 22 aa, Mycobacterium tuberculosis
TVLVGARLAVAVVRVATATRRR

SEQ ID NO: 1383778 - protein, 23 aa, Mycobacterium tuberculosis
TVLVGARLAVAVVRVATATRRRR

SEQ ID NO: 1383779 - protein, 25 aa, Mycobacterium tuberculosis
TVPGWGRPGPIRALPLHSARSRKKK

SEQ ID NO: 1383780 - protein, 24 aa, Mycobacterium tuberculosis
TVSVWFRSVWVLQPRGDLMAEAPL

SEQ ID NO: 1383781 - protein, 17 aa, Mycobacterium tuberculosis
TVTVTFMLVWLINHHGW

SEQ ID NO: 1383782 - protein, 17 aa, Mycobacterium tuberculosis
TVVMPRLSRNAAADDTP

SEQ ID NO: 1383783 - protein, 20 aa, Mycobacterium tuberculosis
TWAIALLVWHYGRVEERWTP

SEQ ID NO: 1383784 - protein, 26 aa, Mycobacterium tuberculosis
TWHIVGLCIFGFLLAMLRGNHVGHVE

SEQ ID NO: 1383785 - protein, 19 aa, Mycobacterium tuberculosis
TWLILFLRILFTAITFGAL

SEQ ID NO: 1383786 - protein, 30 aa, Mycobacterium tuberculosis
TWPPCIATGRIMWCWPRVLWSACSTCAAPR

SEQ ID NO: 1383787 - protein, 24 aa, Mycobacterium tuberculosis
TYCLSFARLTLFHTMGPPLAIGML

SEQ ID NO: 1383788 - protein, 18 aa, Mycobacterium tuberculosis
TYLDVCDQVLLLAPGGKT

SEQ ID NO: 1383789 - protein, 19 aa, Mycobacterium tuberculosis
TYLLTYVRRYYGGRIAHVV

SEQ ID NO: 1383790 - protein, 21 aa, Mycobacterium tuberculosis
TYLQRWTIFTVVPQWILALIA

SEQ ID NO: 1383791 - protein, 19 aa, Mycobacterium tuberculosis
TYTRRRRNLLIGIGAGAAS

SEQ ID NO: 1383792 - protein, 21 aa, Mycobacterium tuberculosis
VAAAPCALAIAVPVTVVASIG

SEQ ID NO: 1383793 - protein, 19 aa, Mycobacterium tuberculosis
VAAARGLYMAFTVLAAAGV

SEQ ID NO: 1383794 - protein, 19 aa, Mycobacterium tuberculosis
VAACSAPADSACAPAAAGV

SEQ ID NO: 1383795 - protein, 18 aa, Mycobacterium tuberculosis
VAAVAFFGWERFARTRLI

SEQ ID NO: 1383796 - protein, 23 aa, Mycobacterium tuberculosis
VAAVAFFGWERFARTRLIDPAGV

SEQ ID NO: 1383797 - protein, 19 aa, Mycobacterium tuberculosis
VACQVPIFLMRSSPFTALE

SEQ ID NO: 1383798 - protein, 20 aa, Mycobacterium tuberculosis
VACQVPIFLMRSSPFTALEL

SEQ ID NO: 1383799 - protein, 17 aa, Mycobacterium tuberculosis
VACVYTVIYLAARDLPP

SEQ ID NO: 1383800 - protein, 17 aa, Mycobacterium tuberculosis
VADALPLLGKLPSANVV

SEQ ID NO: 1383801 - protein, 22 aa, Mycobacterium tuberculosis
VADGLITFFALVIVTSLSMVFG

SEQ ID NO: 1383802 - protein, 20 aa, Mycobacterium tuberculosis
VAFFGWERFARTRLIDPAGV

SEQ ID NO: 1383803 - protein, 25 aa, Mycobacterium tuberculosis
VAGLGWLRRHTRAIQIFGGALLIAV

SEQ ID NO: 1383804 - protein, 20 aa, Mycobacterium tuberculosis
VAGVPADMGGSFIGPTQDAV

SEQ ID NO: 1383805 - protein, 18 aa, Mycobacterium tuberculosis
VAGVSFGNAVGGDGGNGG

SEQ ID NO: 1383806 - protein, 19 aa, Mycobacterium tuberculosis
VAINFWLLRRDSVTVGTDD

SEQ ID NO: 1383807 - protein, 27 aa, Mycobacterium tuberculosis
VAITGYARFWWPGLPIWVPALVTVALI

SEQ ID NO: 1383808 - protein, 20 aa, Mycobacterium tuberculosis
VALLMPNSVEFCCLFYGAAK

SEQ ID NO: 1383809 - protein, 18 aa, Mycobacterium tuberculosis
VALTMAVISPAIWAARGA

SEQ ID NO: 1383810 - protein, 24 aa, Mycobacterium tuberculosis
VAMLIGRFFLIIPVLAIAGSLARK

SEQ ID NO: 1383811 - protein, 21 aa, Mycobacterium tuberculosis
VAMSLPFFFFFFFLLFFFFSL

SEQ ID NO: 1383812 - protein, 17 aa, Mycobacterium tuberculosis
VANLRQYGVAAARGLDE

SEQ ID NO: 1383813 - protein, 22 aa, Mycobacterium tuberculosis
VAPCLFTKGGAVTWHIPESTAP

SEQ ID NO: 1383814 - protein, 23 aa, Mycobacterium tuberculosis
VAPGRRLAGLLALGADPNIARSR

SEQ ID NO: 1383815 - protein, 17 aa, Mycobacterium tuberculosis
VAPMVRRAAATLPAAQA

SEQ ID NO: 1383816 - protein, 32 aa, Mycobacterium tuberculosis
VARCEYHPTPACPQTRITGVPGRGPETRTANQ

SEQ ID NO: 1383817 - protein, 25 aa, Mycobacterium tuberculosis
VARVLTKPRFRGWIHVYSAGTAVLA

SEQ ID NO: 1383818 - protein, 18 aa, Mycobacterium tuberculosis
VASRAGLTFNDFMLHLTP

SEQ ID NO: 1383819 - protein, 18 aa, Mycobacterium tuberculosis
VATFAGWTLIAANPVAGM

SEQ ID NO: 1383820 - protein, 19 aa, Mycobacterium tuberculosis
VATRLCWPDQAKADELQHA

SEQ ID NO: 1383821 - protein, 22 aa, Mycobacterium tuberculosis
VATVRRFIERFAPYNLSPTAIR

SEQ ID NO: 1383822 - protein, 18 aa, Mycobacterium tuberculosis
VAVGIGLRLVFGEMSLTA

SEQ ID NO: 1383823 - protein, 18 aa, Mycobacterium tuberculosis
VAVYAWIRPLPDDWSQLP

SEQ ID NO: 1383824 - protein, 18 aa, Mycobacterium tuberculosis
VAWWICGSATGLTVLYLA

SEQ ID NO: 1383825 - protein, 17 aa, Mycobacterium tuberculosis
VCDTRILEFRWRTGDRV

SEQ ID NO: 1383826 - protein, 24 aa, Mycobacterium tuberculosis
VCHLWNHHRCNGIYRRRGSGSGTR

SEQ ID NO: 1383827 - protein, 17 aa, Mycobacterium tuberculosis
VCIVLLILIVLLRAIVA

SEQ ID NO: 1383828 - protein, 17 aa, Mycobacterium tuberculosis
VCVVFLNLLEGVAIGLV

SEQ ID NO: 1383829 - protein, 23 aa, Mycobacterium tuberculosis
VCYVSAAAVAARFGAAALAAHQV

SEQ ID NO: 1383830 - protein, 23 aa, Mycobacterium tuberculosis
VDASLRLLVRGGRFLEMGKTDIR

SEQ ID NO: 1383831 - protein, 19 aa, Mycobacterium tuberculosis
VDGQKRLKNARVLVIGAGG

SEQ ID NO: 1383832 - protein, 18 aa, Mycobacterium tuberculosis
VDLASSRPRSCAQLAHRR

SEQ ID NO: 1383833 - protein, 17 aa, Mycobacterium tuberculosis
VDLRGLFTFTETDLARP

SEQ ID NO: 1383834 - protein, 20 aa, Mycobacterium tuberculosis
VDLRTALFADPRFVVEDIGP

SEQ ID NO: 1383835 - protein, 19 aa, Mycobacterium tuberculosis
VDMRYARCAGSPRPPPRSP

SEQ ID NO: 1383836 - protein, 28 aa, Mycobacterium tuberculosis
VDRLYADRRIRLWVVYVENFSGQSALNW

SEQ ID NO: 1383837 - protein, 19 aa, Mycobacterium tuberculosis
VDSIGWEWIFFVNVPVGVI

SEQ ID NO: 1383838 - protein, 17 aa, Mycobacterium tuberculosis
VDSMGWVLSSWHEVTGV

SEQ ID NO: 1383839 - protein, 17 aa, Mycobacterium tuberculosis
VDVFVVRSGAAGPFLGS

SEQ ID NO: 1383840 - protein, 24 aa, Mycobacterium tuberculosis
VDVQAVIMSPNLVAARFIQLTPVY

SEQ ID NO: 1383841 - protein, 24 aa, Mycobacterium tuberculosis
VDVVLRSKVDAAWHLHELTRDLDV

SEQ ID NO: 1383842 - protein, 17 aa, Mycobacterium tuberculosis
VDYAKTRTLWGRNIGQF

SEQ ID NO: 1383843 - protein, 23 aa, Mycobacterium tuberculosis
VEAGIWGKLVNRVMKRPVLFAAP

SEQ ID NO: 1383844 - protein, 22 aa, Mycobacterium tuberculosis
VEAPEFHSAVLAELTLIGHRGP

SEQ ID NO: 1383845 - protein, 17 aa, Mycobacterium tuberculosis
VEDAGWRDFCLRVADRI

SEQ ID NO: 1383846 - protein, 23 aa, Mycobacterium tuberculosis
VEELLRINLSFADGLPRLATADI

SEQ ID NO: 1383847 - protein, 22 aa, Mycobacterium tuberculosis
VEGLAALIFSRYLWAFELTSAL

SEQ ID NO: 1383848 - protein, 20 aa, Mycobacterium tuberculosis
VEHRALMAIAFGDLGMANTT

SEQ ID NO: 1383849 - protein, 17 aa, Mycobacterium tuberculosis
VEHRALMAIVFGDLGMA

SEQ ID NO: 1383850 - protein, 24 aa, Mycobacterium tuberculosis
VELLKLAVLLALWAAVAGAFVSVL

SEQ ID NO: 1383851 - protein, 20 aa, Mycobacterium tuberculosis
VELRNRLKTATGLTLPPTVI

SEQ ID NO: 1383852 - protein, 24 aa, Mycobacterium tuberculosis
VELRRLPDVMLMGITRVLVANRGE

SEQ ID NO: 1383853 - protein, 18 aa, Mycobacterium tuberculosis
VEMKLAGGCRLDKLDSEA

SEQ ID NO: 1383854 - protein, 21 aa, Mycobacterium tuberculosis
VEMRNRLKSATGLSLSPTLIF

SEQ ID NO: 1383855 - protein, 17 aa, Mycobacterium tuberculosis
VEPRPGYGSAVHAGVLA

SEQ ID NO: 1383856 - protein, 21 aa, Mycobacterium tuberculosis
VFAFFPLFLLVVVWVSGFVVV

SEQ ID NO: 1383857 - protein, 18 aa, Mycobacterium tuberculosis
VFAWLALVFGVGFSMLAL

SEQ ID NO: 1383858 - protein, 22 aa, Mycobacterium tuberculosis
VFFAVSGFLLWRGHAAAARDLR

SEQ ID NO: 1383859 - protein, 23 aa, Mycobacterium tuberculosis
VFGFGVMFGAIWAEEAWGRYWGW

SEQ ID NO: 1383860 - protein, 24 aa, Mycobacterium tuberculosis
VFGLFVRKGWDIVIGLVVLFVYGG

SEQ ID NO: 1383861 - protein, 18 aa, Mycobacterium tuberculosis
VFGSPTWRTVTGGSANYV

SEQ ID NO: 1383862 - protein, 17 aa, Mycobacterium tuberculosis
VFLGYELPQPPTIARGA

SEQ ID NO: 1383863 - protein, 17 aa, Mycobacterium tuberculosis
VFRGFTFGIDFKGGTMV

SEQ ID NO: 1383864 - protein, 18 aa, Mycobacterium tuberculosis
VFRWQRRDNLLTEPDPAA

SEQ ID NO: 1383865 - protein, 23 aa, Mycobacterium tuberculosis
VGALGILVMVVWVGTALTISTTA

SEQ ID NO: 1383866 - protein, 20 aa, Mycobacterium tuberculosis
VGALSGMWGIPAVVAVATVG

SEQ ID NO: 1383867 - protein, 18 aa, Mycobacterium tuberculosis
VGARRATYWAVLDTLVVG

SEQ ID NO: 1383868 - protein, 39 aa, Mycobacterium tuberculosis
VGCLAGLVGIGWLWRHGRFRRLARLGGLVLVSAFTVVTL

SEQ ID NO: 1383869 - protein, 28 aa, Mycobacterium tuberculosis
VGGRLFGRFDLAVAVFFAVSGFLLWRGH

SEQ ID NO: 1383870 - protein, 18 aa, Mycobacterium tuberculosis
VGGTYGFGSDEPVRQPPH

SEQ ID NO: 1383871 - protein, 19 aa, Mycobacterium tuberculosis
VGGVTRLIPLTGLTTSWMS

SEQ ID NO: 1383872 - protein, 24 aa, Mycobacterium tuberculosis
VGIAFLRAPCRVVYVIDEPDVRGF

SEQ ID NO: 1383873 - protein, 22 aa, Mycobacterium tuberculosis
VGIALWLPWLIAAGVAFILASA

SEQ ID NO: 1383874 - protein, 24 aa, Mycobacterium tuberculosis
VGIMWPSLLVILLLVAVVALLFTS

SEQ ID NO: 1383875 - protein, 17 aa, Mycobacterium tuberculosis
VGITFLGMRFAKLGVFS

SEQ ID NO: 1383876 - protein, 17 aa, Mycobacterium tuberculosis
VGIVIGRKTNTTATEVA

SEQ ID NO: 1383877 - protein, 36 aa, Mycobacterium tuberculosis
VGKLEFAGYFAWLAWLVLHLVYLVGYRNRIAALFAW

SEQ ID NO: 1383878 - protein, 17 aa, Mycobacterium tuberculosis
VGLAVTAAVVAPRRFTK

SEQ ID NO: 1383879 - protein, 17 aa, Mycobacterium tuberculosis
VGLLGMFGPVRVVHVGW

SEQ ID NO: 1383880 - protein, 22 aa, Mycobacterium tuberculosis
VGLLPAWQIVLILLLLGVLGLR

SEQ ID NO: 1383881 - protein, 18 aa, Mycobacterium tuberculosis
VGLRWDPYPFILLNLAFS

SEQ ID NO: 1383882 - protein, 17 aa, Mycobacterium tuberculosis
VGLYPGDQVRVLGVPVG

SEQ ID NO: 1383883 - protein, 17 aa, Mycobacterium tuberculosis
VGNYRAATQVALGKGED

SEQ ID NO: 1383884 - protein, 20 aa, Mycobacterium tuberculosis
VGPVAPGPGMGWVFGFPGGP

SEQ ID NO: 1383885 - protein, 24 aa, Mycobacterium tuberculosis
VGPVIRLPLVLGLAQLLSRVPLPG

SEQ ID NO: 1383886 - protein, 17 aa, Mycobacterium tuberculosis
VGSAYNLLFALRIREES

SEQ ID NO: 1383887 - protein, 24 aa, Mycobacterium tuberculosis
VGSLLRLSVLALIMLPILAAVTLC

SEQ ID NO: 1383888 - protein, 21 aa, Mycobacterium tuberculosis
VGSLRSGECDLALAGGVTVNA

SEQ ID NO: 1383889 - protein, 26 aa, Mycobacterium tuberculosis
VGSMFGPYHLKRLLGRGGMGEVYEAE

SEQ ID NO: 1383890 - protein, 18 aa, Mycobacterium tuberculosis
VGSWWRYRYDKFGWTTRS

SEQ ID NO: 1383891 - protein, 20 aa, Mycobacterium tuberculosis
VGSWWRYRYDKFGWTTRSSQ

SEQ ID NO: 1383892 - protein, 28 aa, Mycobacterium tuberculosis
VGTPAMWWLAVPVLAYAGWRMFVRRDWR

SEQ ID NO: 1383893 - protein, 23 aa, Mycobacterium tuberculosis
VGTSRRSRWARLFDEGIGARTVQ

SEQ ID NO: 1383894 - protein, 17 aa, Mycobacterium tuberculosis
VGVASVIAEGFLVLPFS

SEQ ID NO: 1383895 - protein, 25 aa, Mycobacterium tuberculosis
VGVFALRRVWWLYKLVMSGQPASGR

SEQ ID NO: 1383896 - protein, 28 aa, Mycobacterium tuberculosis
VGVLVLLKAVAYWLDRYELLSHTRGGKP

SEQ ID NO: 1383897 - protein, 21 aa, Mycobacterium tuberculosis
VGVMRWRWRVAFYALSALGTD

SEQ ID NO: 1383898 - protein, 35 aa, Mycobacterium tuberculosis
VGVNPTGGLGCWPRPSTWPPAWHGRAIRPSITEPR

SEQ ID NO: 1383899 - protein, 18 aa, Mycobacterium tuberculosis
VGVPLYLLLGWVAVWYTA

SEQ ID NO: 1383900 - protein, 19 aa, Mycobacterium tuberculosis
VGVPRGRVGIGLKLTGGRT

SEQ ID NO: 1383901 - protein, 24 aa, Mycobacterium tuberculosis
VHAYPRTGSVVVWYSPRRADRAAV

SEQ ID NO: 1383902 - protein, 18 aa, Mycobacterium tuberculosis
VHCDRFFGWYNHEHKHSG

SEQ ID NO: 1383903 - protein, 19 aa, Mycobacterium tuberculosis
VHCDRFFGWYNHEHKHSGI

SEQ ID NO: 1383904 - protein, 23 aa, Mycobacterium tuberculosis
VHLARIFFTGAFRRPRETNWVIG

SEQ ID NO: 1383905 - protein, 24 aa, Mycobacterium tuberculosis
VHLARIFFTGAFRRPRETNWVIGF

SEQ ID NO: 1383906 - protein, 17 aa, Mycobacterium tuberculosis
VHNRLLTLLLFDIGSFA

SEQ ID NO: 1383907 - protein, 22 aa, Mycobacterium tuberculosis
VHPDTFWWALALSADFGGNLTA

SEQ ID NO: 1383908 - protein, 35 aa, Mycobacterium tuberculosis
VHWSRRPASTQSWFWSRWVGWVMRRPWITALAAST

SEQ ID NO: 1383909 - protein, 17 aa, Mycobacterium tuberculosis
VICSMLSPKAKRVGDVF

SEQ ID NO: 1383910 - protein, 17 aa, Mycobacterium tuberculosis
VIGLWAMIATLRAGFAY

SEQ ID NO: 1383911 - protein, 18 aa, Mycobacterium tuberculosis
VIGSLLLILAMSRAISAT

SEQ ID NO: 1383912 - protein, 18 aa, Mycobacterium tuberculosis
VIGVAVATFAGWTLIAAN

SEQ ID NO: 1383913 - protein, 17 aa, Mycobacterium tuberculosis
VILAVLVKPQFVVLGVV

SEQ ID NO: 1383914 - protein, 22 aa, Mycobacterium tuberculosis
VILLRALVAPIYLIGSVLISYL

SEQ ID NO: 1383915 - protein, 27 aa, Mycobacterium tuberculosis
VILTSVWLFDCWRLLVRPPHAGRRRGG

SEQ ID NO: 1383916 - protein, 20 aa, Mycobacterium tuberculosis
VISGLQMLLHQAFAQVEQFT

SEQ ID NO: 1383917 - protein, 23 aa, Mycobacterium tuberculosis
VIVAGVAALFWRLPSDDTTRSRA

SEQ ID NO: 1383918 - protein, 19 aa, Mycobacterium tuberculosis
VKAEMLVGTPAMWWLAVPV

SEQ ID NO: 1383919 - protein, 17 aa, Mycobacterium tuberculosis
VKLLNRFFAIVVNEVDR

SEQ ID NO: 1383920 - protein, 26 aa, Mycobacterium tuberculosis
VKMTTEWLHVPFLPVPIPVPIPQNPG

SEQ ID NO: 1383921 - protein, 18 aa, Mycobacterium tuberculosis
VKPPTWWHSLPTDRPIIY

SEQ ID NO: 1383922 - protein, 19 aa, Mycobacterium tuberculosis
VKPRPEWGPLAMLLAGSIL

SEQ ID NO: 1383923 - protein, 19 aa, Mycobacterium tuberculosis
VKSRPEWGPLAMLLAGSIL

SEQ ID NO: 1383924 - protein, 24 aa, Mycobacterium tuberculosis
VKVKVGPVTSEFSGKVHFVEQDRN

SEQ ID NO: 1383925 - protein, 22 aa, Mycobacterium tuberculosis
VLAICYRPLLFATVDPEVAAAR

SEQ ID NO: 1383926 - protein, 19 aa, Mycobacterium tuberculosis
VLAILAWRALDRSDRLGKL

SEQ ID NO: 1383927 - protein, 23 aa, Mycobacterium tuberculosis
VLANGRGRWLAIAASLVVSAAIL

SEQ ID NO: 1383928 - protein, 17 aa, Mycobacterium tuberculosis
VLAPERYRATLICVGST

SEQ ID NO: 1383929 - protein, 24 aa, Mycobacterium tuberculosis
VLASAIAVSGAWTPKHCVGMLARW

SEQ ID NO: 1383930 - protein, 25 aa, Mycobacterium tuberculosis
VLASDRGAGALGFVGTAGKESVGQP

SEQ ID NO: 1383931 - protein, 20 aa, Mycobacterium tuberculosis
VLAVRLNVLFSYQGNDMYTA

SEQ ID NO: 1383932 - protein, 17 aa, Mycobacterium tuberculosis
VLCCAAIAYIALTAPHR

SEQ ID NO: 1383933 - protein, 17 aa, Mycobacterium tuberculosis
VLFLPYSLLGPFAGALM

SEQ ID NO: 1383934 - protein, 19 aa, Mycobacterium tuberculosis
VLFSSLLWIDGRNLEPYLL

SEQ ID NO: 1383935 - protein, 19 aa, Mycobacterium tuberculosis
VLGFFGFYLSFVAELPPPP

SEQ ID NO: 1383936 - protein, 17 aa, Mycobacterium tuberculosis
VLGLALALVMHRTLIGK

SEQ ID NO: 1383937 - protein, 27 aa, Mycobacterium tuberculosis
VLIAAFLAVWWIYETYRPQAPGHGDSP

SEQ ID NO: 1383938 - protein, 18 aa, Mycobacterium tuberculosis
VLIVGTVVWVGITNDRKE

SEQ ID NO: 1383939 - protein, 17 aa, Mycobacterium tuberculosis
VLKRFGPLTPPRAVAII

SEQ ID NO: 1383940 - protein, 24 aa, Mycobacterium tuberculosis
VLKRTGRLSLRHALDMLEQTGRAL

SEQ ID NO: 1383941 - protein, 20 aa, Mycobacterium tuberculosis
VLLACGWAFLIWGMYAYLWA

SEQ ID NO: 1383942 - protein, 17 aa, Mycobacterium tuberculosis
VLLELAIQIARVHDKRK

SEQ ID NO: 1383943 - protein, 24 aa, Mycobacterium tuberculosis
VLLEVWPVIAVGALAWLVAAVAAF

SEQ ID NO: 1383944 - protein, 25 aa, Mycobacterium tuberculosis
VLLEVWPVIAVGALAWLVAAVAAFV

SEQ ID NO: 1383945 - protein, 18 aa, Mycobacterium tuberculosis
VLLGWPPVVGFDVLGVGA

SEQ ID NO: 1383946 - protein, 18 aa, Mycobacterium tuberculosis
VLLLWSWLVMSLAQGYYS

SEQ ID NO: 1383947 - protein, 24 aa, Mycobacterium tuberculosis
VLLMAVERIELFVDVLLKGGRTAD

SEQ ID NO: 1383948 - protein, 17 aa, Mycobacterium tuberculosis
VLLTRLAIVAAVALVVA

SEQ ID NO: 1383949 - protein, 37 aa, Mycobacterium tuberculosis
VLLVIGALVVWWGWRERRDLFSGFGWLAVVLLAVAAA

SEQ ID NO: 1383950 - protein, 24 aa, Mycobacterium tuberculosis
VLLYAVCVVLRLARYNALQDDGTQ

SEQ ID NO: 1383951 - protein, 17 aa, Mycobacterium tuberculosis
VLNPLVLIHLMGGVHNE

SEQ ID NO: 1383952 - protein, 19 aa, Mycobacterium tuberculosis
VLPFTGLNTPLAVAVDSDR

SEQ ID NO: 1383953 - protein, 26 aa, Mycobacterium tuberculosis
VLPLAAPWLRDLRAGSVSINRTVDYI

SEQ ID NO: 1383954 - protein, 17 aa, Mycobacterium tuberculosis
VLPMLRPTMVAVGVITV

SEQ ID NO: 1383955 - protein, 17 aa, Mycobacterium tuberculosis
VLPRLGPAVEASKPAYW

SEQ ID NO: 1383956 - protein, 21 aa, Mycobacterium tuberculosis
VLRIASRVGTGVGFAEDQVFE

SEQ ID NO: 1383957 - protein, 20 aa, Mycobacterium tuberculosis
VLRPVGALGDFFAMTLDTSV

SEQ ID NO: 1383958 - protein, 25 aa, Mycobacterium tuberculosis
VLSEFPADRGWDLAGLYNPDPDAAG

SEQ ID NO: 1383959 - protein, 18 aa, Mycobacterium tuberculosis
VLTFHWAQVVWSRTIVQL

SEQ ID NO: 1383960 - protein, 19 aa, Mycobacterium tuberculosis
VLTFHWAQVVWSRTIVQLA

SEQ ID NO: 1383961 - protein, 18 aa, Mycobacterium tuberculosis
VLTGRLRRIFGDADLDKL

SEQ ID NO: 1383962 - protein, 17 aa, Mycobacterium tuberculosis
VLTVWRFDSLIGAAGVV

SEQ ID NO: 1383963 - protein, 20 aa, Mycobacterium tuberculosis
VLVAFCARSPHGVSAGGSRL

SEQ ID NO: 1383964 - protein, 31 aa, Mycobacterium tuberculosis
VLVAIVAAAGYLVLRPSWSPTQASGQTVLPF

SEQ ID NO: 1383965 - protein, 24 aa, Mycobacterium tuberculosis
VLVGYCAGWLPWFADIDRQMYFFY

SEQ ID NO: 1383966 - protein, 20 aa, Mycobacterium tuberculosis
VLVKASAGGGGRGMRVVHEL

SEQ ID NO: 1383967 - protein, 17 aa, Mycobacterium tuberculosis
VLVLSWRAIPGAAETVR

SEQ ID NO: 1383968 - protein, 18 aa, Mycobacterium tuberculosis
VLVLWDLFGQLPLPLGVV

SEQ ID NO: 1383969 - protein, 18 aa, Mycobacterium tuberculosis
VMAPWCRVAYIAHGQHRV

SEQ ID NO: 1383970 - protein, 18 aa, Mycobacterium tuberculosis
VMIVLLLNLTAAYSARRF

SEQ ID NO: 1383971 - protein, 23 aa, Mycobacterium tuberculosis
VMLRFAACGAIGLGAALLIAALL

SEQ ID NO: 1383972 - protein, 23 aa, Mycobacterium tuberculosis
VMVFASGLLAMFPIAALGALVVY

SEQ ID NO: 1383973 - protein, 22 aa, Mycobacterium tuberculosis
VNLLLSPAVFRGFDQVGALSPT

SEQ ID NO: 1383974 - protein, 17 aa, Mycobacterium tuberculosis
VNPWQWLLALLQQLWNA

SEQ ID NO: 1383975 - protein, 18 aa, Mycobacterium tuberculosis
VNPWQWLLALLQQLWNAY

SEQ ID NO: 1383976 - protein, 22 aa, Mycobacterium tuberculosis
VNSLHIAPLISYEMTFSDLTRH

SEQ ID NO: 1383977 - protein, 30 aa, Mycobacterium tuberculosis
VPALAGGPWDWARWAPASPWATPPAVVMVL

SEQ ID NO: 1383978 - protein, 22 aa, Mycobacterium tuberculosis
VPAPRIIASGLFNAIPEAPPLT

SEQ ID NO: 1383979 - protein, 33 aa, Mycobacterium tuberculosis
VPAPVPIPVPIIIPPFPGWQPGMPTIPTAPPTT

SEQ ID NO: 1383980 - protein, 24 aa, Mycobacterium tuberculosis
VPDASPRLSPRWDAGLSVRRGLAS

SEQ ID NO: 1383981 - protein, 31 aa, Mycobacterium tuberculosis; identical to SEQ ID NO: 160201

SEQ ID NO: 1383982 - protein, 17 aa, Mycobacterium tuberculosis
VPGFAWWAAALNSLPML

SEQ ID NO: 1383983 - protein, 17 aa, Mycobacterium tuberculosis
VPGNENFQMGAYLKSND

SEQ ID NO: 1383984 - protein, 19 aa, Mycobacterium tuberculosis
VPGPARYWASAALGHVGKF

SEQ ID NO: 1383985 - protein, 21 aa, Mycobacterium tuberculosis
VPGSRRPTVAVTDQRASGQCL

SEQ ID NO: 1383986 - protein, 22 aa, Mycobacterium tuberculosis
VPLEAVPAFFRWLAQFEPMHQV

SEQ ID NO: 1383987 - protein, 20 aa, Mycobacterium tuberculosis
VPLLHRFGGLVAPLTFIGTA

SEQ ID NO: 1383988 - protein, 27 aa, Mycobacterium tuberculosis
VPLPGSAPRPAWLRAFAHPERDKRVAV

SEQ ID NO: 1383989 - protein, 20 aa, Mycobacterium tuberculosis
VPLRPLFGWITRYSKAAAKD

SEQ ID NO: 1383990 - protein, 17 aa, Mycobacterium tuberculosis
VPMPWVIQAPRLFAGQI

SEQ ID NO: 1383991 - protein, 23 aa, Mycobacterium tuberculosis
VPPGDGPWRLGLGSAGTFENLRL

SEQ ID NO: 1383992 - protein, 18 aa, Mycobacterium tuberculosis
VPPNSSWPNLDYPGLHAL

SEQ ID NO: 1383993 - protein, 18 aa, Mycobacterium tuberculosis
VPQGWSFAQAAAVPVVFL

SEQ ID NO: 1383994 - protein, 17 aa, Mycobacterium tuberculosis
VPQVQFYLSPAMLILLA

SEQ ID NO: 1383995 - protein, 25 aa, Mycobacterium tuberculosis
VPSRPPTGWCCMRPSATRGGGNSVC

SEQ ID NO: 1383996 - protein, 31 aa, Mycobacterium tuberculosis
VPSVICAITVAWLDRFMGIGGESALFFIGVL

SEQ ID NO: 1383997 - protein, 19 aa, Mycobacterium tuberculosis
VPTLWRGALVVLQSILAVA

SEQ ID NO: 1383998 - protein, 23 aa, Mycobacterium tuberculosis
VPTPAALFPVHIDPIAVPPQIGA

SEQ ID NO: 1383999 - protein, 25 aa, Mycobacterium tuberculosis
VPTPAALFPVHIDPIAVPPQIGAAI

SEQ ID NO: 1384000 - protein, 18 aa, Mycobacterium tuberculosis
VPVRRLRAIETLAQAIAP

SEQ ID NO: 1384001 - protein, 19 aa, Mycobacterium tuberculosis
VPWLYNYIGQPWKTQRTVD

SEQ ID NO: 1384002 - protein, 24 aa, Mycobacterium tuberculosis
VPWPAGAQVLIRFTGPEVWWVLRV

SEQ ID NO: 1384003 - protein, 22 aa, Mycobacterium tuberculosis
VPWTGVGVAAVFLATTGAGGVV

SEQ ID NO: 1384004 - protein, 17 aa, Mycobacterium tuberculosis
VPYVLPFLAEGRISGVT

SEQ ID NO: 1384005 - protein, 18 aa, Mycobacterium tuberculosis
VQIPRLVANNTRIWVYCG

SEQ ID NO: 1384006 - protein, 26 aa, Mycobacterium tuberculosis
VQNVVPRPGTSPGVGGTPASPVPEAP

SEQ ID NO: 1384007 - protein, 32 aa, Mycobacterium tuberculosis
VQPFGEYLPMPWLFRHLSGYADRAGHFVPGNG

SEQ ID NO: 1384008 - protein, 26 aa, Mycobacterium tuberculosis
VQVGMCVGVSLVLPAAVWGVLTPRQP

SEQ ID NO: 1384009 - protein, 33 aa, Mycobacterium tuberculosis
VQWWGQPAWSWAVLGLRGRRPVKWNDPITLANN

SEQ ID NO: 1384010 - protein, 17 aa, Mycobacterium tuberculosis
VQYYAVLPGRFAADFAG

SEQ ID NO: 1384011 - protein, 29 aa, Mycobacterium tuberculosis
VRAVVGLSLPGTVAWHAVPRWFARNKDRR

SEQ ID NO: 1384012 - protein, 19 aa, Mycobacterium tuberculosis
VRDLMGVEHLRWYDYPLAA

SEQ ID NO: 1384013 - protein, 22 aa, Mycobacterium tuberculosis
VRDSFWKGREFDSLAQMQQAAV

SEQ ID NO: 1384014 - protein, 18 aa, Mycobacterium tuberculosis
VRGAALLGFRAGRFRRWD

SEQ ID NO: 1384015 - protein, 19 aa, Mycobacterium tuberculosis
VRGARNIPCGTVPGKRAPT

SEQ ID NO: 1384016 - protein, 23 aa, Mycobacterium tuberculosis
VRGARNIPCVDVLGKRAATPKEC

SEQ ID NO: 1384017 - protein, 24 aa, Mycobacterium tuberculosis
VRGIVGRTMLVWLLCSGVPNVGVA

SEQ ID NO: 1384018 - protein, 19 aa, Mycobacterium tuberculosis
VRHVEKWAKVRGDKLAYRF

SEQ ID NO: 1384019 - protein, 18 aa, Mycobacterium tuberculosis
VRKRRIGPVWLTAAGYAV

SEQ ID NO: 1384020 - protein, 22 aa, Mycobacterium tuberculosis
VRKYLTLMAFRVPALILAAIAY

SEQ ID NO: 1384021 - protein, 27 aa, Mycobacterium tuberculosis
VRKYLTLMAFRVPALILAAIAYGAWHN

SEQ ID NO: 1384022 - protein, 17 aa, Mycobacterium tuberculosis
VRLKARLWFVHRGIEKL

SEQ ID NO: 1384023 - protein, 17 aa, Mycobacterium tuberculosis
VRMFRPVSMQVLAICVL

SEQ ID NO: 1384024 - protein, 26 aa, Mycobacterium tuberculosis
VRMTFRSSRLVYPMRLSVAAQEPQHV

SEQ ID NO: 1384025 - protein, 17 aa, Mycobacterium tuberculosis
VRPAGFPRKMMAGRVPV

SEQ ID NO: 1384026 - protein, 17 aa, Mycobacterium tuberculosis
VRPLRLFLQSNNYLAVV

SEQ ID NO: 1384027 - protein, 32 aa, Mycobacterium tuberculosis
VRPLRSYFYWEHHCFDIPLCSATRSLFDTLDG

SEQ ID NO: 1384028 - protein, 26 aa, Mycobacterium tuberculosis
VRRHLQWPRRRLLSPHAGNAPRTRRR

SEQ ID NO: 1384029 - protein, 21 aa, Mycobacterium tuberculosis
VRRSLRPLARIRADGRGDRRG

SEQ ID NO: 1384030 - protein, 28 aa, Mycobacterium tuberculosis
VRRSNALLDWAYGRRFRYSETMSVGSTV

SEQ ID NO: 1384031 - protein, 24 aa, Mycobacterium tuberculosis
VRRWASEVWVVWVGPVRVRRWAWG

SEQ ID NO: 1384032 - protein, 22 aa, Mycobacterium tuberculosis
VRRYHVVVCVQRFANYWSDRYH

SEQ ID NO: 1384033 - protein, 23 aa, Mycobacterium tuberculosis
VRSAAALWWIPAWLAMIVEVAVL

SEQ ID NO: 1384034 - protein, 23 aa, Mycobacterium tuberculosis
VRTMCSRPAIRQGSLENATDQLA

SEQ ID NO: 1384035 - protein, 18 aa, Mycobacterium tuberculosis
VRVGGLFAALGVTSVVIG

SEQ ID NO: 1384036 - protein, 19 aa, Mycobacterium tuberculosis
VRVGGLFAALGVTSVVIGL

SEQ ID NO: 1384037 - protein, 23 aa, Mycobacterium tuberculosis
VRWQGEFLVAVIELIPRPFTPTV

SEQ ID NO: 1384038 - protein, 19 aa, Mycobacterium tuberculosis
VRWRLAWLSKPETWRRRKR

SEQ ID NO: 1384039 - protein, 24 aa, Mycobacterium tuberculosis
VRYRDRLLLPLPMFHVAALATVIF

SEQ ID NO: 1384040 - protein, 20 aa, Mycobacterium tuberculosis
VSAAIAALFGTHAQEYQALS

SEQ ID NO: 1384041 - protein, 19 aa, Mycobacterium tuberculosis
VSALHRPVPLSGEGSDTDT

SEQ ID NO: 1384042 - protein, 21 aa, Mycobacterium tuberculosis
VSAPLRFPGCIAGSTMSAPIT

SEQ ID NO: 1384043 - protein, 17 aa, Mycobacterium tuberculosis
VSATAGMLADWMEGPGA

SEQ ID NO: 1384044 - protein, 17 aa, Mycobacterium tuberculosis
VSAVFVPAVIGVAVATF

SEQ ID NO: 1384045 - protein, 19 aa, Mycobacterium tuberculosis
VSFVTARTALLDGFLTFFV

SEQ ID NO: 1384046 - protein, 20 aa, Mycobacterium tuberculosis
VSGGDRGRCGVVDAAGVGDR

SEQ ID NO: 1384047 - protein, 21 aa, Mycobacterium tuberculosis
VSHPSLPFAVLVVIAATAGFG

SEQ ID NO: 1384048 - protein, 21 aa, Mycobacterium tuberculosis
VSLPDCQGALYTSQDPVYAGT

SEQ ID NO: 1384049 - protein, 22 aa, Mycobacterium tuberculosis
VSLTVAAIVVWSSLVAAVLPPL

SEQ ID NO: 1384050 - protein, 20 aa, Mycobacterium tuberculosis
VSMRGLLPVAGHWVSVLTGL

SEQ ID NO: 1384051 - protein, 18 aa, Mycobacterium tuberculosis
VSPASMRKFFEAFAPYGL

SEQ ID NO: 1384052 - protein, 22 aa, Mycobacterium tuberculosis
VSPLPSLAKRAADILRQDVGGQ

SEQ ID NO: 1384053 - protein, 23 aa, Mycobacterium tuberculosis
VSRRGEMSYSFADLKANGLSLVL

SEQ ID NO: 1384054 - protein, 18 aa, Mycobacterium tuberculosis
VSRTHWLASHLAMALAGS

SEQ ID NO: 1384055 - protein, 20 aa, Mycobacterium tuberculosis
VSSFRWARGMTIVAALMTVF

SEQ ID NO: 1384056 - protein, 22 aa, Mycobacterium tuberculosis
VSVWFRSVWVLQPRGDLMAEAP

SEQ ID NO: 1384057 - protein, 17 aa, Mycobacterium tuberculosis
VSWRAWTCDGHVSKSLL

SEQ ID NO: 1384058 - protein, 17 aa, Mycobacterium tuberculosis
VSWSHHWVWMLPAVLVI

SEQ ID NO: 1384059 - protein, 23 aa, Mycobacterium tuberculosis
VSYDYRCIFLVRGGPNYFSIALI

SEQ ID NO: 1384060 - protein, 23 aa, Mycobacterium tuberculosis
VTAGMPVIEWLYSRQLRRVVAPQ

SEQ ID NO: 1384061 - protein, 30 aa, Mycobacterium tuberculosis
VTAIAPRLVPRTPLAPVLPAPSFPADATVA

SEQ ID NO: 1384062 - protein, 25 aa, Mycobacterium tuberculosis
VTFAKPYAEWRGMFAGNGMLLPASM

SEQ ID NO: 1384063 - protein, 17 aa, Mycobacterium tuberculosis
VTLCGGWAAWPQSPVSP

SEQ ID NO: 1384064 - protein, 33 aa, Mycobacterium tuberculosis
VTLLPAILTLTGRRGWIKPRRDLTSRMWRRSGV

SEQ ID NO: 1384065 - protein, 20 aa, Mycobacterium tuberculosis
VTLLPAILVLASPRGWVAPR

SEQ ID NO: 1384066 - protein, 18 aa, Mycobacterium tuberculosis
VTMFARPTIPVAAAASDI

SEQ ID NO: 1384067 - protein, 17 aa, Mycobacterium tuberculosis
VTQRADAPVGIIALWAL

SEQ ID NO: 1384068 - protein, 23 aa, Mycobacterium tuberculosis
VTRNREVWAWMVWLPHNLHDELF

SEQ ID NO: 1384069 - protein, 18 aa, Mycobacterium tuberculosis
VTRSRLPGLLPPLDDVKN

SEQ ID NO: 1384070 - protein, 23 aa, Mycobacterium tuberculosis
VTSRPAAEVVMLLNRFFTVIVDE

SEQ ID NO: 1384071 - protein, 21 aa, Mycobacterium tuberculosis
VTVTYPAHWGPAAVAALDSAL

SEQ ID NO: 1384072 - protein, 17 aa, Mycobacterium tuberculosis
VTYLKMGCPLSTEEVPL

SEQ ID NO: 1384073 - protein, 25 aa, Mycobacterium tuberculosis
VTYREVRAGHQVRWTILLDGAVRIS

SEQ ID NO: 1384074 - protein, 24 aa, Mycobacterium tuberculosis
VVAALWRQHCCKSPQDPTEHADGA

SEQ ID NO: 1384075 - protein, 18 aa, Mycobacterium tuberculosis
VVADGRWVVHRVGATGVR

SEQ ID NO: 1384076 - protein, 19 aa, Mycobacterium tuberculosis
VVAGLAWYLTHDVFNHPQA

SEQ ID NO: 1384077 - protein, 20 aa, Mycobacterium tuberculosis
VVALRSRLLVRLGGAGGMVS

SEQ ID NO: 1384078 - protein, 24 aa, Mycobacterium tuberculosis
VVATALRLYTRWLGHVVLLVPTVL

SEQ ID NO: 1384079 - protein, 18 aa, Mycobacterium tuberculosis
VVCAIGLGSVAGLSRVFD

SEQ ID NO: 1384080 - protein, 19 aa, Mycobacterium tuberculosis
VVCGHSSCAAMTALLEDDP

SEQ ID NO: 1384081 - protein, 26 aa, Mycobacterium tuberculosis
VVDLADPAVVWALRLQGRVPHVVAQS

SEQ ID NO: 1384082 - protein, 19 aa, Mycobacterium tuberculosis
VVEAFYLFSCRSLTRSAWR

SEQ ID NO: 1384083 - protein, 19 aa, Mycobacterium tuberculosis
VVFLVTWPLVYLASKSSLL

SEQ ID NO: 1384084 - protein, 17 aa, Mycobacterium tuberculosis
VVGAVAFALSPRVLTTL

SEQ ID NO: 1384085 - protein, 24 aa, Mycobacterium tuberculosis
VVGFIWEVLGRIGIGRKDALVSLG

SEQ ID NO: 1384086 - protein, 17 aa, Mycobacterium tuberculosis
VVGGTVRTVGRTVSGAA

SEQ ID NO: 1384087 - protein, 25 aa, Mycobacterium tuberculosis
VVGRGRPADRPALLGAVKTNVGHLE

SEQ ID NO: 1384088 - protein, 19 aa, Mycobacterium tuberculosis
VVIGAVLAIMVWRSASGPR

SEQ ID NO: 1384089 - protein, 22 aa, Mycobacterium tuberculosis
VVKSFTGWRGFDPTLGFWEPPL

SEQ ID NO: 1384090 - protein, 23 aa, Mycobacterium tuberculosis
VVKSFTGWRGFDPTLGFWEPPLV

SEQ ID NO: 1384091 - protein, 22 aa, Mycobacterium tuberculosis
VVLAFLPFMVALVAGADLGLTK

SEQ ID NO: 1384092 - protein, 23 aa, Mycobacterium tuberculosis
VVLAVRLNVLFSYQGNDMYTALQ

SEQ ID NO: 1384093 - protein, 17 aa, Mycobacterium tuberculosis
VVLCVVGARIASGSLSA

SEQ ID NO: 1384094 - protein, 18 aa, Mycobacterium tuberculosis
VVLIALFVMTTRLHAVSQ

SEQ ID NO: 1384095 - protein, 25 aa, Mycobacterium tuberculosis
VVLTGRISVVAAPWLADHAVGPVVP

SEQ ID NO: 1384096 - protein, 21 aa, Mycobacterium tuberculosis
VVLVHEFTEVIVIANGVRAGR

SEQ ID NO: 1384097 - protein, 17 aa, Mycobacterium tuberculosis
VVNVHWSVLVILWLFTW

SEQ ID NO: 1384098 - protein, 25 aa, Mycobacterium tuberculosis
VVPGDCCLDWGMNIGRHCFSDYAMV

SEQ ID NO: 1384099 - protein, 22 aa, Mycobacterium tuberculosis
VVQRRPFFAILRCLGVTREQLF

SEQ ID NO: 1384100 - protein, 18 aa, Mycobacterium tuberculosis
VVRLGVFLAVCLLTAFLL

SEQ ID NO: 1384101 - protein, 25 aa, Mycobacterium tuberculosis
VVSLAGSGWCGWVLFEKHQTDVAAG

SEQ ID NO: 1384102 - protein, 27 aa, Mycobacterium tuberculosis
VVTFAKPYAEWRGMFAGNGMLLPASMT

SEQ ID NO: 1384103 - protein, 18 aa, Mycobacterium tuberculosis
VVTIAGLVFAFTMGSMVA

SEQ ID NO: 1384104 - protein, 23 aa, Mycobacterium tuberculosis
VVVEAFYLFSCRSLTRSAWRLGM

SEQ ID NO: 1384105 - protein, 18 aa, Mycobacterium tuberculosis
VVVLIGFWVAGSHEVQSA

SEQ ID NO: 1384106 - protein, 17 aa, Mycobacterium tuberculosis
VVWIPWALRPMFVALRL

SEQ ID NO: 1384107 - protein, 19 aa, Mycobacterium tuberculosis
VVYRRGFVTRHQVTGWRFV

SEQ ID NO: 1384108 - protein, 20 aa, Mycobacterium tuberculosis
VWDRPERRSGIPALDGLRAI

SEQ ID NO: 1384109 - protein, 29 aa, Mycobacterium tuberculosis
VWRRDLRAIVRLLAWQGAALAAIPLLRGI

SEQ ID NO: 1384110 - protein, 24 aa, Mycobacterium tuberculosis
VWTVIAILALFGWPQVARIARGAA

SEQ ID NO: 1384111 - protein, 19 aa, Mycobacterium tuberculosis
VWYLQRVGSEPDFLRVWLP

SEQ ID NO: 1384112 - protein, 18 aa, Mycobacterium tuberculosis
VYFITYRWCIGLQRSDRS

SEQ ID NO: 1384113 - protein, 17 aa, Mycobacterium tuberculosis
VYFSHALNKVWRRHMLR

SEQ ID NO: 1384114 - protein, 23 aa, Mycobacterium tuberculosis
VYLGLRVGLTFATSIPAAVISMG

SEQ ID NO: 1384115 - protein, 33 aa, Mycobacterium tuberculosis
VYRDRFIVIGVMVALCLGGGVFGLSLGKHVTQS

SEQ ID NO: 1384116 - protein, 31 aa, Mycobacterium tuberculosis
VYRYRFIVIGVMVALCLGGGVFGLSLGKHVT

SEQ ID NO: 1384117 - protein, 17 aa, Mycobacterium tuberculosis
WAAEGITVGIGEQGGQG

SEQ ID NO: 1384118 - protein, 20 aa, Mycobacterium tuberculosis
WADPETGSAFGYVHNRLLTL

SEQ ID NO: 1384119 - protein, 21 aa, Mycobacterium tuberculosis
WAEEAWGRYWGWDPKETVSFV

SEQ ID NO: 1384120 - protein, 17 aa, Mycobacterium tuberculosis
WAFGGGPHRCLGSHLAR

SEQ ID NO: 1384121 - protein, 19 aa, Mycobacterium tuberculosis
WAMAFATLISRITGFARIV

SEQ ID NO: 1384122 - protein, 23 aa, Mycobacterium tuberculosis
WASLGARGLVAWPRADGAFAAAD

SEQ ID NO: 1384123 - protein, 17 aa, Mycobacterium tuberculosis
WASRPSLWFDEGATISA

SEQ ID NO: 1384124 - protein, 22 aa, Mycobacterium tuberculosis
WAVAGRLGWSLTVLAAVAFIAR

SEQ ID NO: 1384125 - protein, 17 aa, Mycobacterium tuberculosis
WAVMVSLAELWRSVGVV

SEQ ID NO: 1384126 - protein, 19 aa, Mycobacterium tuberculosis
WAVRAYAWTDWRFTQLREW

SEQ ID NO: 1384127 - protein, 22 aa, Mycobacterium tuberculosis
WCMQGLPSPYLTIAFPNRPPQY

SEQ ID NO: 1384128 - protein, 26 aa, Mycobacterium tuberculosis
WCSSWQGPCHRRGCCGGAGSKLTDLA

SEQ ID NO: 1384129 - protein, 27 aa, Mycobacterium tuberculosis
WDEVKEGLTRLAADLSPAAGELQGPLG

SEQ ID NO: 1384130 - protein, 17 aa, Mycobacterium tuberculosis
WDLLLLWLAQLHGGNGL

SEQ ID NO: 1384131 - protein, 23 aa, Mycobacterium tuberculosis
WDVRCAPAAFRFMSQARHIGKVV

SEQ ID NO: 1384132 - protein, 20 aa, Mycobacterium tuberculosis
WELAGGRFAIHATMTTVAAI

SEQ ID NO: 1384133 - protein, 17 aa, Mycobacterium tuberculosis
WFAGLVVVFTAAVLLLS

SEQ ID NO: 1384134 - protein, 23 aa, Mycobacterium tuberculosis
WFCGWCVLGGVFFVLVFFCVLDV

SEQ ID NO: 1384135 - protein, 17 aa, Mycobacterium tuberculosis
WFDAARPLGAWVDALLR

SEQ ID NO: 1384136 - protein, 19 aa, Mycobacterium tuberculosis
WGAEFERLTGRLLAGFEAR

SEQ ID NO: 1384137 - protein, 24 aa, Mycobacterium tuberculosis
WGGAIAGILLRCVAGGAALGRGSA

SEQ ID NO: 1384138 - protein, 18 aa, Mycobacterium tuberculosis
WGSQWELVRLPDDHRDAD

SEQ ID NO: 1384139 - protein, 26 aa, Mycobacterium tuberculosis
WGTANALCGIAIFALMVFVTGLPLAY

SEQ ID NO: 1384140 - protein, 17 aa, Mycobacterium tuberculosis
WHGRGHVTMFARPTIPV

SEQ ID NO: 1384141 - protein, 18 aa, Mycobacterium tuberculosis
WHHTIPAPVWVAVIMGLV

SEQ ID NO: 1384142 - protein, 17 aa, Mycobacterium tuberculosis
WHWPLLIFWLSYTGHRH

SEQ ID NO: 1384143 - protein, 25 aa, Mycobacterium tuberculosis
WIDYPEPDRAAAIVRRTVPGATAPL

SEQ ID NO: 1384144 - protein, 17 aa, Mycobacterium tuberculosis
WIPSTGVPLLAIVLAVA

SEQ ID NO: 1384145 - protein, 19 aa, Mycobacterium tuberculosis
WKPLLPGYTRPHMRLFSGQ

SEQ ID NO: 1384146 - protein, 17 aa, Mycobacterium tuberculosis
WKSATARNWMKRADHSM

SEQ ID NO: 1384147 - protein, 20 aa, Mycobacterium tuberculosis
WKVYDRRTVTDMGMLQAALV

SEQ ID NO: 1384148 - protein, 23 aa, Mycobacterium tuberculosis
WLADHAVGPVVLFPGTGFVELAL

SEQ ID NO: 1384149 - protein, 17 aa, Mycobacterium tuberculosis
WLFAFVVILALSSTIVL

SEQ ID NO: 1384150 - protein, 36 aa, Mycobacterium tuberculosis
WLHVSGYRFLLRRIECALLFGDVCAATGALRARTTS

SEQ ID NO: 1384151 - protein, 18 aa, Mycobacterium tuberculosis
WLILFLRILFTAITFGAL

SEQ ID NO: 1384152 - protein, 25 aa, Mycobacterium tuberculosis
WLPFYHDMGLMLGIILPMINQDTAV

SEQ ID NO: 1384153 - protein, 17 aa, Mycobacterium tuberculosis
WLPQRPVLVPGTVRHNL

SEQ ID NO: 1384154 - protein, 20 aa, Mycobacterium tuberculosis
WLRHPYCALPQSARADISAD

SEQ ID NO: 1384155 - protein, 20 aa, Mycobacterium tuberculosis
WLSDRIAPRHVVLASLAGTA

SEQ ID NO: 1384156 - protein, 19 aa, Mycobacterium tuberculosis
WLSPSRWAYAMAAATVDLN

SEQ ID NO: 1384157 - protein, 18 aa, Mycobacterium tuberculosis
WLTPEERAELSARLTEDT

SEQ ID NO: 1384158 - protein, 22 aa, Mycobacterium tuberculosis
WLTSTLRPAGVDEWFICGPLAM

SEQ ID NO: 1384159 - protein, 20 aa, Mycobacterium tuberculosis
WLVKDGQPFIPADCLAKGGN

SEQ ID NO: 1384160 - protein, 17 aa, Mycobacterium tuberculosis
WLVLLMIFNVIWTYVLV

SEQ ID NO: 1384161 - protein, 20 aa, Mycobacterium tuberculosis
WLYQRTRVTASYRLAAPAGS

SEQ ID NO: 1384162 - protein, 18 aa, Mycobacterium tuberculosis
WNDFLWPLLMIQRNSLAT

SEQ ID NO: 1384163 - protein, 17 aa, Mycobacterium tuberculosis
WPANWPLRECLRSRCRV

SEQ ID NO: 1384164 - protein, 21 aa, Mycobacterium tuberculosis
WPCPRPAPGQSPAPSLPSPTR

SEQ ID NO: 1384165 - protein, 25 aa, Mycobacterium tuberculosis
WPGGRPGMRGCLRGEFGRTAYPAKP

SEQ ID NO: 1384166 - protein, 20 aa, Mycobacterium tuberculosis
WPMLCLMTIAAGALQIVFGL

SEQ ID NO: 1384167 - protein, 19 aa, Mycobacterium tuberculosis
WPPDEDFGSEHFRFRRPVP

SEQ ID NO: 1384168 - protein, 34 aa, Mycobacterium tuberculosis
WPSLNRGWCLIRTRWGRRIARLLPFVGLAGLAVT

SEQ ID NO: 1384169 - protein, 19 aa, Mycobacterium tuberculosis
WPTSRLVPAPARLRRLWLA

SEQ ID NO: 1384170 - protein, 17 aa, Mycobacterium tuberculosis
WPVMIVLLLNLTAAYSA

SEQ ID NO: 1384171 - protein, 18 aa, Mycobacterium tuberculosis
WQHILAIHLHWLVLAMSV

SEQ ID NO: 1384172 - protein, 20 aa, Mycobacterium tuberculosis
WQIAKSVLIFLGIPLLAGYL

SEQ ID NO: 1384173 - protein, 25 aa, Mycobacterium tuberculosis
WQPYRSVPSGNTWPPCIATGRIMWC

SEQ ID NO: 1384174 - protein, 17 aa, Mycobacterium tuberculosis
WQRLMVALSAFDLIEST

SEQ ID NO: 1384175 - protein, 24 aa, Mycobacterium tuberculosis
WRDDLRWPPASALVSQDEAVAALR

SEQ ID NO: 1384176 - protein, 19 aa, Mycobacterium tuberculosis
WRDFCLRVADRIVLVARDP

SEQ ID NO: 1384177 - protein, 17 aa, Mycobacterium tuberculosis
WREGLLRGLAAHHAGML

SEQ ID NO: 1384178 - protein, 19 aa, Mycobacterium tuberculosis
WRFVMRRIAAGIALHDTRM

SEQ ID NO: 1384179 - protein, 17 aa, Mycobacterium tuberculosis
WRGKDLATPRGWITALR

SEQ ID NO: 1384180 - protein, 25 aa, Mycobacterium tuberculosis
WRITLPMLRPTMFFVLVTGIISAAQ

SEQ ID NO: 1384181 - protein, 19 aa, Mycobacterium tuberculosis
WRLAVTVRHCCSPRFAEAN

SEQ ID NO: 1384182 - protein, 27 aa, Mycobacterium tuberculosis
WRRDLRAIVRLLAWQGAALAAIPLLRG

SEQ ID NO: 1384183 - protein, 21 aa, Mycobacterium tuberculosis
WRRWALLCVGIAQIALGTVQG

SEQ ID NO: 1384184 - protein, 19 aa, Mycobacterium tuberculosis
WRVARNAGITDVRAALLPE

SEQ ID NO: 1384185 - protein, 23 aa, Mycobacterium tuberculosis
WSDRYHHRPGLAVRHPRRALVHD

SEQ ID NO: 1384186 - protein, 25 aa, Mycobacterium tuberculosis
WSFAQAAAVPVVFLTAWYGLADLAE

SEQ ID NO: 1384187 - protein, 30 aa, Mycobacterium tuberculosis
WSNTSPTRWRSCLPVPLLSRATVRRSSAIR

SEQ ID NO: 1384188 - protein, 31 aa, Mycobacterium tuberculosis
WSNTSPTRWRSCLPVPLLSRATVRRSSAIRN

SEQ ID NO: 1384189 - protein, 19 aa, Mycobacterium tuberculosis
WSPSTTRGGTGIRWSGRQV

SEQ ID NO: 1384190 - protein, 24 aa, Mycobacterium tuberculosis
WSQLPKRLSCQLRPGPTPPATITV

SEQ ID NO: 1384191 - protein, 19 aa, Mycobacterium tuberculosis
WSSPTSWRAHWPRSGVTAA

SEQ ID NO: 1384192 - protein, 19 aa, Mycobacterium tuberculosis
WSVLPIAFVLLISVGSAYN

SEQ ID NO: 1384193 - protein, 19 aa, Mycobacterium tuberculosis
WSYAEAAAISAVFTTAYYA

SEQ ID NO: 1384194 - protein, 17 aa, Mycobacterium tuberculosis
WTANWRFVAQNTDYFTQ

SEQ ID NO: 1384195 - protein, 18 aa, Mycobacterium tuberculosis
WTANWRFVAQNTDYFTQG

SEQ ID NO: 1384196 - protein, 39 aa, Mycobacterium tuberculosis
WTISAICVLAILVLLRYLTPWGRQFWRITRAYFVGPNSV

SEQ ID NO: 1384197 - protein, 20 aa, Mycobacterium tuberculosis
WTPKHCVGMLARWLSSADVC

SEQ ID NO: 1384198 - protein, 17 aa, Mycobacterium tuberculosis
WTPLFAYAAAFLIAVAH

SEQ ID NO: 1384199 - protein, 19 aa, Mycobacterium tuberculosis
WTSCGSCGIDDRFAACRDP

SEQ ID NO: 1384200 - protein, 20 aa, Mycobacterium tuberculosis
WVAPRGERMATFWRRAGTRI

SEQ ID NO: 1384201 - protein, 20 aa, Mycobacterium tuberculosis
WVATRSRRHTYQWITDHKSP

SEQ ID NO: 1384202 - protein, 17 aa, Mycobacterium tuberculosis
WVCCMMIAVIASDVGGY

SEQ ID NO: 1384203 - protein, 27 aa, Mycobacterium tuberculosis
WVDAEPRLRALGWTGMLDKGADVDAGG

SEQ ID NO: 1384204 - protein, 17 aa, Mycobacterium tuberculosis
WVKLSPIWHVFSFAVDT

SEQ ID NO: 1384205 - protein, 21 aa, Mycobacterium tuberculosis
WVRIKRIVTVYIMTANLTGIV

SEQ ID NO: 1384206 - protein, 31 aa, Mycobacterium tuberculosis
WVRSGHRRLWWALAGVVAFLGLVGAGVVGTL

SEQ ID NO: 1384207 - protein, 19 aa, Mycobacterium tuberculosis
WWPECSKEAYADGIAGAVE

SEQ ID NO: 1384208 - protein, 18 aa, Mycobacterium tuberculosis
WYAVDVFSTLLVVPGDCW

SEQ ID NO: 1384209 - protein, 17 aa, Mycobacterium tuberculosis
WYRRYLLVQVLFGSVVL

SEQ ID NO: 1384210 - protein, 21 aa, Mycobacterium tuberculosis
WYSRAICDTAAILSAIIDAET

SEQ ID NO: 1384211 - protein, 20 aa, Mycobacterium tuberculosis
WYTENLRYYYLILPTVDGSL

SEQ ID NO: 1384212 - protein, 20 aa, Mycobacterium tuberculosis
YAAEGNWAAAIRHRLQAVAR

SEQ ID NO: 1384213 - protein, 17 aa, Mycobacterium tuberculosis
YAAMPAYDVVDGVSKPN

SEQ ID NO: 1384214 - protein, 19 aa, Mycobacterium tuberculosis
YADRLEILHVLSSEPLHTP

SEQ ID NO: 1384215 - protein, 24 aa, Mycobacterium tuberculosis
YAGALGARGLFACRQSLRPRYLCM

SEQ ID NO: 1384216 - protein, 24 aa, Mycobacterium tuberculosis
YAIERPHMYRLMFGSTSAHGINVP

SEQ ID NO: 1384217 - protein, 20 aa, Mycobacterium tuberculosis
YALACAELGQLLGEVQASSW

SEQ ID NO: 1384218 - protein, 27 aa, Mycobacterium tuberculosis
YALLVNRWPLPEAGVRSGLAPAERDTA

SEQ ID NO: 1384219 - protein, 29 aa, Mycobacterium tuberculosis
YALLVNRWPLPEAGVRSGLAPAERDTAGQ

SEQ ID NO: 1384220 - protein, 28 aa, Mycobacterium tuberculosis
YAPLWRTAWRRLRQRPFQYILLVLGIAL

SEQ ID NO: 1384221 - protein, 29 aa, Mycobacterium tuberculosis
YAPLWRTAWRRLRQRPFQYILLVLGIALG

SEQ ID NO: 1384222 - protein, 26 aa, Mycobacterium tuberculosis
YAPRDGNVDLAAWVRAAAAHVLPDAQ

SEQ ID NO: 1384223 - protein, 23 aa, Mycobacterium tuberculosis
YAQPTSWWPLRWYPQNYRTATEQ

SEQ ID NO: 1384224 - protein, 17 aa, Mycobacterium tuberculosis
YAVDVFSTLLVVPGDCC

SEQ ID NO: 1384225 - protein, 20 aa, Mycobacterium tuberculosis
YAVLPGRFAADFAGIGRQSL

SEQ ID NO: 1384226 - protein, 25 aa, Mycobacterium tuberculosis
YAVRWPDPWPTTFGYHEFLPRLHRG

SEQ ID NO: 1384227 - protein, 18 aa, Mycobacterium tuberculosis
YECLAPHHFLLTEWFAPY

SEQ ID NO: 1384228 - protein, 19 aa, Mycobacterium tuberculosis
YEGLTANEALYDWNYQRQL

SEQ ID NO: 1384229 - protein, 23 aa, Mycobacterium tuberculosis
YELAATIARRLGLTGALGTVAES

SEQ ID NO: 1384230 - protein, 26 aa, Mycobacterium tuberculosis
YERLKSWRRGLIFAMFVFAAIFTPGS

SEQ ID NO: 1384231 - protein, 34 aa, Mycobacterium tuberculosis
YETIKGDASVGWLRLGALALALAALAALLINRRL

SEQ ID NO: 1384232 - protein, 21 aa, Mycobacterium tuberculosis
YFGAWVFIAGFLLHIVVKIPH

SEQ ID NO: 1384233 - protein, 35 aa, Mycobacterium tuberculosis
YFGFLLNLLVVFGVSFEFPLLIVMLNLAGLLTYER

SEQ ID NO: 1384234 - protein, 25 aa, Mycobacterium tuberculosis
YFLTEPRYTWTIAEPDAAVTEFVLL

SEQ ID NO: 1384235 - protein, 17 aa, Mycobacterium tuberculosis
YFRKSLEDIIRFQAEFL

SEQ ID NO: 1384236 - protein, 18 aa, Mycobacterium tuberculosis
YFRMGWWSIIGYAAAAII

SEQ ID NO: 1384237 - protein, 22 aa, Mycobacterium tuberculosis
YGGIRAALPVTYATFDLAYLAI

SEQ ID NO: 1384238 - protein, 22 aa, Mycobacterium tuberculosis
YGLGGLRTGLLAARHLQVTLDE

SEQ ID NO: 1384239 - protein, 17 aa, Mycobacterium tuberculosis
YGQYGQYGVQPGGYYGQ

SEQ ID NO: 1384240 - protein, 25 aa, Mycobacterium tuberculosis
YHIAKPWRWGYLGVLLVIFGFPLIA

SEQ ID NO: 1384241 - protein, 20 aa, Mycobacterium tuberculosis
YHYAVAVYRYDRGCGQVSTI

SEQ ID NO: 1384242 - protein, 19 aa, Mycobacterium tuberculosis
YKQFRGEFTPKTELTMVAS

SEQ ID NO: 1384243 - protein, 18 aa, Mycobacterium tuberculosis
YLAALRRSGLTGEFNSDA

SEQ ID NO: 1384244 - protein, 17 aa, Mycobacterium tuberculosis
YLLTYVRRYYGGRIAHL

SEQ ID NO: 1384245 - protein, 17 aa, Mycobacterium tuberculosis
YLPPEVLDNPDFQRGLE

SEQ ID NO: 1384246 - protein, 18 aa, Mycobacterium tuberculosis
YLTAPRPGGAMAPTSTSS

SEQ ID NO: 1384247 - protein, 17 aa, Mycobacterium tuberculosis
YLTLAFLAGVLIVMYFD

SEQ ID NO: 1384248 - protein, 17 aa, Mycobacterium tuberculosis
YLWWVPHNVAGLVTALG

SEQ ID NO: 1384249 - protein, 22 aa, Mycobacterium tuberculosis
YMLTEFALRPVAAQALEAGLPP

SEQ ID NO: 1384250 - protein, 30 aa, Mycobacterium tuberculosis
YMMWTEGLARIWPPWEFYFWHHTIPAPVWV

SEQ ID NO: 1384251 - protein, 40 aa, Mycobacterium tuberculosis; identical to SEQ ID NO: 160739

SEQ ID NO: 1384252 - protein, 17 aa, Mycobacterium tuberculosis
YNLRYRVLADWDFNIRC

SEQ ID NO: 1384253 - protein, 20 aa, Mycobacterium tuberculosis
YNPEYTCFLQGAKWYLDNGG

SEQ ID NO: 1384254 - protein, 24 aa, Mycobacterium tuberculosis
YNVRRLPPPVVEPGPDRRPITAVV

SEQ ID NO: 1384255 - protein, 24 aa, Mycobacterium tuberculosis
YNVVKSFIGWRGFDPTLGFWEPPL

SEQ ID NO: 1384256 - protein, 17 aa, Mycobacterium tuberculosis
YPAFCIGAILGNSLSPL

SEQ ID NO: 1384257 - protein, 19 aa, Mycobacterium tuberculosis
YPASGGTYVYGRMRLGDFW

SEQ ID NO: 1384258 - protein, 22 aa, Mycobacterium tuberculosis
YPGVRYRAFDLFEAGPDRIAQI

SEQ ID NO: 1384259 - protein, 18 aa, Mycobacterium tuberculosis
YPIRSGIDPIVFGVVREL

SEQ ID NO: 1384260 - protein, 26 aa, Mycobacterium tuberculosis
YPPQQYPPGWPAGPYPPGPPPPGPGS

SEQ ID NO: 1384261 - protein, 19 aa, Mycobacterium tuberculosis
YPQMLLRVGWAPINADPLP

SEQ ID NO: 1384262 - protein, 20 aa, Mycobacterium tuberculosis
YPTLCRLFAELGVATQESEM

SEQ ID NO: 1384263 - protein, 18 aa, Mycobacterium tuberculosis
YQDWVPAGGIAFGLFIVT

SEQ ID NO: 1384264 - protein, 17 aa, Mycobacterium tuberculosis
YQLKFTHHMYLPMDVDA

SEQ ID NO: 1384265 - protein, 17 aa, Mycobacterium tuberculosis
YQPARRGFSTGVFGMGM

SEQ ID NO: 1384266 - protein, 18 aa, Mycobacterium tuberculosis
YQQAFALMYGEIFTITAI

SEQ ID NO: 1384267 - protein, 24 aa, Mycobacterium tuberculosis
YQRERRFAVAFVIPAAVLFVAGAV

SEQ ID NO: 1384268 - protein, 17 aa, Mycobacterium tuberculosis
YQYLSMAIAKTYTALSK

SEQ ID NO: 1384269 - protein, 22 aa, Mycobacterium tuberculosis
YRAVLNFRRGWDIYNEHFDYVD

SEQ ID NO: 1384270 - protein, 20 aa, Mycobacterium tuberculosis
YRDLRRKRARKWGDTVTQPD

SEQ ID NO: 1384271 - protein, 18 aa, Mycobacterium tuberculosis
YRDVLGFLYAQAKFQLLG

SEQ ID NO: 1384272 - protein, 20 aa, Mycobacterium tuberculosis
YRIDRVPRYELVRCGLDVPD

SEQ ID NO: 1384273 - protein, 17 aa, Mycobacterium tuberculosis
YRIRVGHRIGSAALIAD

SEQ ID NO: 1384274 - protein, 19 aa, Mycobacterium tuberculosis
YRIRVGHRIGSAALIADGL

SEQ ID NO: 1384275 - protein, 17 aa, Mycobacterium tuberculosis
YRPGYNDRYYLRAGTPV

SEQ ID NO: 1384276 - protein, 30 aa, Mycobacterium tuberculosis
YRSPRYLRFGWAAARLDDWANYVGARATAV

SEQ ID NO: 1384277 - protein, 22 aa, Mycobacterium tuberculosis
YSARNETEWQRLMVALSAFDLI

SEQ ID NO: 1384278 - protein, 19 aa, Mycobacterium tuberculosis
YSLIERFPLMLGTAAGVLL

SEQ ID NO: 1384279 - protein, 19 aa, Mycobacterium tuberculosis
YSNPGFSFTGFARAVKNNL

SEQ ID NO: 1384280 - protein, 23 aa, Mycobacterium tuberculosis
YSQRAVTMLRVRQGASTGETVAC

SEQ ID NO: 1384281 - protein, 21 aa, Mycobacterium tuberculosis
YSSVFAPDWGREVELMAVSGD

SEQ ID NO: 1384282 - protein, 22 aa, Mycobacterium tuberculosis
YSVIGFLCAFAPNFTVLVILRL

SEQ ID NO: 1384283 - protein, 26 aa, Mycobacterium tuberculosis
YSVLPGPLVATVFDLVFQPGKLPDSL

SEQ ID NO: 1384284 - protein, 22 aa, Mycobacterium tuberculosis
YSVPWRLIGQRLHARTAGDVVQ

SEQ ID NO: 1384285 - protein, 25 aa, Mycobacterium tuberculosis
YSWYLWHWPLLIFWLSYTGHRHANF

SEQ ID NO: 1384286 - protein, 33 aa, Mycobacterium tuberculosis
YTAIWAAKRARGSPLRIMILLVLVSALASALLD

SEQ ID NO: 1384287 - protein, 18 aa, Mycobacterium tuberculosis
YTALLVTFVGDYVTAGGL

SEQ ID NO: 1384288 - protein, 19 aa, Mycobacterium tuberculosis
YTENLRYYYLILPTVDGSL

SEQ ID NO: 1384289 - protein, 19 aa, Mycobacterium tuberculosis
YTLRLAPRSYRRWPPAVVG

SEQ ID NO: 1384290 - protein, 24 aa, Mycobacterium tuberculosis
YTRLRRPIVVWWIVWIVSNAISMF

SEQ ID NO: 1384291 - protein, 23 aa, Mycobacterium tuberculosis
YTYLKWWKFVLVVLGVWIGAGEV

SEQ ID NO: 1384292 - protein, 20 aa, Mycobacterium tuberculosis
YVHNRLLTLLLFDIGSFAGL

SEQ ID NO: 1384293 - protein, 19 aa, Mycobacterium tuberculosis
YVLVGWSLGGVLAYACAIG

SEQ ID NO: 1384294 - protein, 17 aa, Mycobacterium tuberculosis
YWASAALGHVGKFRPHD

SEQ ID NO: 1384295 - protein, 17 aa, Mycobacterium tuberculosis
YWLFHGGTIGKFKDLLI

SEQ ID NO: 1384296 - protein, 17 aa, Mycobacterium tuberculosis
YWVCAIYLVLLAVAGLG

SEQ ID NO: 1384297 - protein, 18 aa, Mycobacterium tuberculosis
YYRVLGLLTALSLVASGS

SEQ ID NO: 1384298 - protein, 22 aa, Mycobacterium tuberculosis
RTLPRWQRIVALTMIGISTALI

SEQ ID NO: 1384299 - protein, 19 aa, Mycobacterium tuberculosis
SRRSGCHLLLLAVLAAIAL

SEQ ID NO: 1384300 - protein, 25 aa, Mycobacterium tuberculosis
AAPLLGVLCSISWQRPVPVIQVHGD

SEQ ID NO: 1384301 - protein, 22 aa, Mycobacterium tuberculosis
ADRLPVVRLDWFTAENTATARQ

SEQ ID NO: 1384302 - protein, 24 aa, Mycobacterium tuberculosis
AGPRLIDAYVDWLWFGELGYRSVF

SEQ ID NO: 1384303 - protein, 19 aa, Mycobacterium tuberculosis
AILSLRLIPVVPFAAINYA

SEQ ID NO: 1384304 - protein, 23 aa, Mycobacterium tuberculosis
AMVARRAPRRWGVRSTVRDLDQQ

SEQ ID NO: 1384305 - protein, 21 aa, Mycobacterium tuberculosis
ARQHARRMVLVWVSVVLAITG

SEQ ID NO: 1384306 - protein, 18 aa, Mycobacterium tuberculosis
ATHYWKPLLLCFLVTLGG

SEQ ID NO: 1384307 - protein, 27 aa, Mycobacterium tuberculosis
ATLLGRASWWPGHPWQRCAPEEGQMSA

SEQ ID NO: 1384308 - protein, 18 aa, Mycobacterium tuberculosis
AVTARIGIELGFAVLNHT

SEQ ID NO: 1384309 - protein, 19 aa, Mycobacterium tuberculosis
AVYTPRWWLSGLLVGVASG

SEQ ID NO: 1384310 - protein, 18 aa, Mycobacterium tuberculosis
DGHPWRWFLIGFMVLFHL

SEQ ID NO: 1384311 - protein, 20 aa, Mycobacterium tuberculosis
EVWRCLRCGDFALGGPQGRG

SEQ ID NO: 1384312 - protein, 19 aa, Mycobacterium tuberculosis
FSGFIAWLIWLVLHLAYLI

SEQ ID NO: 1384313 - protein, 18 aa, Mycobacterium tuberculosis
FVRHEHRAAFPLVDLKLF

SEQ ID NO: 1384314 - protein, 25 aa, Mycobacterium tuberculosis
GALPSVPRWLWIVLAIGFLTAALAG

SEQ ID NO: 1384315 - protein, 23 aa, Mycobacterium tuberculosis
GALTEVSWRWAFLVNVPIGLVMI

SEQ ID NO: 1384316 - protein, 18 aa, Mycobacterium tuberculosis
GAVGRIFVGNAFPFEGYT

SEQ ID NO: 1384317 - protein, 24 aa, Mycobacterium tuberculosis
GEAPQRAWLWLGWLSAATVAGWVL

SEQ ID NO: 1384318 - protein, 24 aa, Mycobacterium tuberculosis
GIARRAGAPISFWEFTRKGAVVTA

SEQ ID NO: 1384319 - protein, 18 aa, Mycobacterium tuberculosis
GIVPWWFVLTLLTRDALL

SEQ ID NO: 1384320 - protein, 19 aa, Mycobacterium tuberculosis
GLFYRYAWQNPVFADIVAT

SEQ ID NO: 1384321 - protein, 20 aa, Mycobacterium tuberculosis
GLLGWCWRRGTAPGAPGSDF

SEQ ID NO: 1384322 - protein, 18 aa, Mycobacterium tuberculosis
GLVGRSSVVYDMWGAAVS

SEQ ID NO: 1384323 - protein, 24 aa, Mycobacterium tuberculosis
GTMLLRLCMLPGLALLVWATPRLA

SEQ ID NO: 1384324 - protein, 18 aa, Mycobacterium tuberculosis
HRAAFPLVDLKLFAEPLY

SEQ ID NO: 1384325 - protein, 18 aa, Mycobacterium tuberculosis
IDGPLSFLSVDGVFGSLR

SEQ ID NO: 1384326 - protein, 22 aa, Mycobacterium tuberculosis
IDVVHWPGYLLIVAGVVGGVGA

SEQ ID NO: 1384327 - protein, 17 aa, Mycobacterium tuberculosis
IKFFNWIGTMWKGQLTF

SEQ ID NO: 1384328 - protein, 18 aa, Mycobacterium tuberculosis
ILYIISFSLFIYGLMGLT

SEQ ID NO: 1384329 - protein, 21 aa, Mycobacterium tuberculosis
KEVRFGVGASGLWAASTTGTS

SEQ ID NO: 1384330 - protein, 18 aa, Mycobacterium tuberculosis
KPLLLCFLVTLGGTVAFY

SEQ ID NO: 1384331 - protein, 18 aa, Mycobacterium tuberculosis
KPVPVILILLMLISGGAT

SEQ ID NO: 1384332 - protein, 18 aa, Mycobacterium tuberculosis
LAVAWPLAAVVRGHDWGT

SEQ ID NO: 1384333 - protein, 18 aa, Mycobacterium tuberculosis
LFVGWLWPLWDSRRRTFA

SEQ ID NO: 1384334 - protein, 17 aa, Mycobacterium tuberculosis
LFWFFGHPEVYIIALPF

SEQ ID NO: 1384335 - protein, 18 aa, Mycobacterium tuberculosis
LGGWRIIRTLGKGLVEIK

SEQ ID NO: 1384336 - protein, 24 aa, Mycobacterium tuberculosis
LLDTWIWRWVAFLLVFAIMVVVTA

SEQ ID NO: 1384337 - protein, 19 aa, Mycobacterium tuberculosis
LLGAICLLGTLWLVMRARS

SEQ ID NO: 1384338 - protein, 18 aa, Mycobacterium tuberculosis
LRKDLTWWDLVVFGVSVV

SEQ ID NO: 1384339 - protein, 20 aa, Mycobacterium tuberculosis
LTVVHLRLSLLPVLIGLMSA

SEQ ID NO: 1384340 - protein, 19 aa, Mycobacterium tuberculosis
LVLRRRFKPALVLEDIEKH

SEQ ID NO: 1384341 - protein, 24 aa, Mycobacterium tuberculosis
MGLPPWMVFCSWSLNLIYQFWVHT

SEQ ID NO: 1384342 - protein, 21 aa, Mycobacterium tuberculosis
MGRIKDLLIVYGRNHSPDDIE

SEQ ID NO: 1384343 - protein, 20 aa, Mycobacterium tuberculosis
MWQWREHRGPQMVAGLSIGL

SEQ ID NO: 1384344 - protein, 20 aa, Mycobacterium tuberculosis
NASSVALIWFGGLRIDSGQM

SEQ ID NO: 1384345 - protein, 19 aa, Mycobacterium tuberculosis
NLRCVCLAPPYASHDTLAM

SEQ ID NO: 1384346 - protein, 19 aa, Mycobacterium tuberculosis
PAILFCFGFFLLVFTGGGI

SEQ ID NO: 1384347 - protein, 19 aa, Mycobacterium tuberculosis
PATILGCWVALAATAGLLF

SEQ ID NO: 1384348 - protein, 26 aa, Mycobacterium tuberculosis
PLLPIAAVCACLWLMLNLTALTWIRF

SEQ ID NO: 1384349 - protein, 25 aa, Mycobacterium tuberculosis
PMGRRLAALLIDWLIAYGLALLGVE

SEQ ID NO: 1384350 - protein, 19 aa, Mycobacterium tuberculosis
PPGSAWRWLCACLLGLTIL

SEQ ID NO: 1384351 - protein, 17 aa, Mycobacterium tuberculosis
PSLSRYAWHRVRRIMPA

SEQ ID NO: 1384352 - protein, 19 aa, Mycobacterium tuberculosis
PVAPEAYALYGISRVLPQA

SEQ ID NO: 1384353 - protein, 27 aa, Mycobacterium tuberculosis
QTFWRITLPSIRWGLTYGIVLTVARTL

SEQ ID NO: 1384354 - protein, 24 aa, Mycobacterium tuberculosis
RELEIWKRTLFRFVQQVYFRRRKT

SEQ ID NO: 1384355 - protein, 21 aa, Mycobacterium tuberculosis
RHFGDAVLLLAIWIGIGFIFR

SEQ ID NO: 1384356 - protein, 19 aa, Mycobacterium tuberculosis
RKETLRLIAQIGMGTGAMA

SEQ ID NO: 1384357 - protein, 18 aa, Mycobacterium tuberculosis
RMQVTLKPVPVILILLML

SEQ ID NO: 1384358 - protein, 21 aa, Mycobacterium tuberculosis
RRLDEAAGFAIPFVPRGLDEI

SEQ ID NO: 1384359 - protein, 22 aa, Mycobacterium tuberculosis
RSRIGMVLQDTWLYDGTIAENI

SEQ ID NO: 1384360 - protein, 18 aa, Mycobacterium tuberculosis
RVLARWQSSWLRYAPLSF

SEQ ID NO: 1384361 - protein, 19 aa, Mycobacterium tuberculosis
RYPIRARVAVVARGGLLMG

SEQ ID NO: 1384362 - protein, 25 aa, Mycobacterium tuberculosis
SALRLKGRLLFMPGVMVTSVPWQLT

SEQ ID NO: 1384363 - protein, 24 aa, Mycobacterium tuberculosis
SFIIGRPLIWLSFRNEKLNAAFRY

SEQ ID NO: 1384364 - protein, 18 aa, Mycobacterium tuberculosis
SLAGYAFARLQFRGRDTL

SEQ ID NO: 1384365 - protein, 23 aa, Mycobacterium tuberculosis
SPPPPRWAWPPLIAVGAVGMVGM

SEQ ID NO: 1384366 - protein, 21 aa, Mycobacterium tuberculosis
SQTRLATWLAEPGHTATPAGS

SEQ ID NO: 1384367 - protein, 25 aa, Mycobacterium tuberculosis
TGTPAWEMFKPWAITSMAIAVAVAL

SEQ ID NO: 1384368 - protein, 17 aa, Mycobacterium tuberculosis
TKMTAMPQLVAFFNGVG

SEQ ID NO: 1384369 - protein, 18 aa, Mycobacterium tuberculosis
TPEFPWSALTIVLLIGVL

SEQ ID NO: 1384370 - protein, 23 aa, Mycobacterium tuberculosis
VLDRLRARFGWLDHVVRAFTRFN

SEQ ID NO: 1384371 - protein, 18 aa, Mycobacterium tuberculosis
VLVILRLLYGIGMGGEWG

SEQ ID NO: 1384372 - protein, 19 aa, Mycobacterium tuberculosis
VMNKLRWVLLIVGGIGVAV

SEQ ID NO: 1384373 - protein, 20 aa, Mycobacterium tuberculosis
WAKVRGRLLALFGLALLEAA

SEQ ID NO: 1384374 - protein, 17 aa, Mycobacterium tuberculosis
WGLTYGIVLTVARTLGE

SEQ ID NO: 1384375 - protein, 19 aa, Mycobacterium tuberculosis
WKLLIPVSLVWVMVAAIIR

SEQ ID NO: 1384376 - protein, 23 aa, Mycobacterium tuberculosis
WLIWLVLHLAYLIGFKTKITTLL

SEQ ID NO: 1384377 - protein, 24 aa, Mycobacterium tuberculosis
WRFLLRRLEHAIVRRDTRMFDDPL

SEQ ID NO: 1384378 - protein, 20 aa, Mycobacterium tuberculosis
YHTERLWSAIGLVPQRSYLF

SEQ ID NO: 1384379 - protein, 22 aa, Mycobacterium tuberculosis
YRIGALCPYCMVVWAVIATLLV

SEQ ID NO: 1384380 - protein, 21 aa, Mycobacterium tuberculosis
YRPNLFVTYWSFRMMIGLMAI

SEQ ID NO: 1384381 - protein, 23 aa, Mycobacterium tuberculosis
AAPRCWQARAVSWMWQALAATLV

SEQ ID NO: 1384382 - protein, 22 aa, Mycobacterium tuberculosis
AFWACGLLLCVFIGPAQSSARA

SEQ ID NO: 1384383 - protein, 19 aa, Mycobacterium tuberculosis
AGAARPGLARAHRRKRSES

SEQ ID NO: 1384384 - protein, 19 aa, Mycobacterium tuberculosis
AIPGRWRPAWIGWWVSLGL

SEQ ID NO: 1384385 - protein, 22 aa, Mycobacterium tuberculosis
ALAVGLKFKLGFDDSLDVVGVH

SEQ ID NO: 1384386 - protein, 20 aa, Mycobacterium tuberculosis
ALLAAWGWFTSLLVITGTIA

SEQ ID NO: 1384387 - protein, 24 aa, Mycobacterium tuberculosis
AMFDRWNWWLPRWLAHILPSVDFD

SEQ ID NO: 1384388 - protein, 24 aa, Mycobacterium tuberculosis
AQEWLKSILPFGGFPWGSVAFGQA

SEQ ID NO: 1384389 - protein, 23 aa, Mycobacterium tuberculosis
ARKRASTLGNFWVDLARTVLRIM

SEQ ID NO: 1384390 - protein, 28 aa, Mycobacterium tuberculosis
ARSAFLVPLRVALAVLFLWGAAAALWTI

SEQ ID NO: 1384391 - protein, 19 aa, Mycobacterium tuberculosis
ASVALELLTGPSLLILDEP

SEQ ID NO: 1384392 - protein, 18 aa, Mycobacterium tuberculosis
ATALAWFPLWFVLLAVGW

SEQ ID NO: 1384393 - protein, 23 aa, Mycobacterium tuberculosis
AVLCARGLVAQGLMFINQAAVSA

SEQ ID NO: 1384394 - protein, 21 aa, Mycobacterium tuberculosis
CAGLLPPLLIRHGIDVGIRRH

SEQ ID NO: 1384395 - protein, 18 aa, Mycobacterium tuberculosis
CGFTGLSGYIVWQHHEAT

SEQ ID NO: 1384396 - protein, 20 aa, Mycobacterium tuberculosis
CLSFARLTLFHTMGPPLAIG

SEQ ID NO: 1384397 - protein, 20 aa, Mycobacterium tuberculosis
CLSFTRLPYFQTLGVPLAIG

SEQ ID NO: 1384398 - protein, 22 aa, Mycobacterium tuberculosis
DATKAAARWIRPLVPPFVARML

SEQ ID NO: 1384399 - protein, 23 aa, Mycobacterium tuberculosis
DDERKKRLGVMLATGLIVGESLY

SEQ ID NO: 1384400 - protein, 28 aa, Mycobacterium tuberculosis
DELAAPRWPWVVGVAAIIAAVALVVSVS

SEQ ID NO: 1384401 - protein, 19 aa, Mycobacterium tuberculosis
DGDYAVAVARIFSTDVRFI

SEQ ID NO: 1384402 - protein, 23 aa, Mycobacterium tuberculosis
DLADPAVVWALRLQGRVPHVVAQ

SEQ ID NO: 1384403 - protein, 20 aa, Mycobacterium tuberculosis
DRLKIPFGHELKTGNVMYLD

SEQ ID NO: 1384404 - protein, 25 aa, Mycobacterium tuberculosis
DRLYADRRIRLWVVYVENFSGQSAL

SEQ ID NO: 1384405 - protein, 18 aa, Mycobacterium tuberculosis
EAWYAFATAVPWARQRTA

SEQ ID NO: 1384406 - protein, 24 aa, Mycobacterium tuberculosis
EKHCYDIPVCWSLRSVFDTLDGID

SEQ ID NO: 1384407 - protein, 19 aa, Mycobacterium tuberculosis
ENECARWSLGETVTLRGHD

SEQ ID NO: 1384408 - protein, 25 aa, Mycobacterium tuberculosis
ERHCFDIPICWSMRSLLNSMDNVDK

SEQ ID NO: 1384409 - protein, 19 aa, Mycobacterium tuberculosis
EYLPMPWLFRHLSGYADRA

SEQ ID NO: 1384410 - protein, 20 aa, Mycobacterium tuberculosis
FALRGRWALDYQGATSDGND

SEQ ID NO: 1384411 - protein, 19 aa, Mycobacterium tuberculosis
FKGGSTFLGMEKLPHTAAV

SEQ ID NO: 1384412 - protein, 19 aa, Mycobacterium tuberculosis
FLVCLCVFRPPSIFGAQRA

SEQ ID NO: 1384413 - protein, 17 aa, Mycobacterium tuberculosis
FWLPCLACLLAVAELQL

SEQ ID NO: 1384414 - protein, 19 aa, Mycobacterium tuberculosis
FWRRAGTRIVRRPKAYLGA

SEQ ID NO: 1384415 - protein, 18 aa, Mycobacterium tuberculosis
FYRTCVLTGKALVRRPFH

SEQ ID NO: 1384416 - protein, 17 aa, Mycobacterium tuberculosis
GAAWALTVVHLRLSLLP

SEQ ID NO: 1384417 - protein, 23 aa, Mycobacterium tuberculosis
GPMLGISVAVVFFAAVTLLPALM

SEQ ID NO: 1384418 - protein, 19 aa, Mycobacterium tuberculosis
GVPLEWNVFFIFSLCYLFG

SEQ ID NO: 1384419 - protein, 17 aa, Mycobacterium tuberculosis
HFGELEFWFALIKVAAI

SEQ ID NO: 1384420 - protein, 21 aa, Mycobacterium tuberculosis
HLDPGPFLSYGIQWISFGILA

SEQ ID NO: 1384421 - protein, 22 aa, Mycobacterium tuberculosis
HRRLWWALAGVVAFLGLVGAGV

SEQ ID NO: 1384422 - protein, 20 aa, Mycobacterium tuberculosis
HWPGYLFGRIRTSTLVLIAA

SEQ ID NO: 1384423 - protein, 17 aa, Mycobacterium tuberculosis
IAADLARPAETVRGWLR

SEQ ID NO: 1384424 - protein, 19 aa, Mycobacterium tuberculosis
IEHQRHWSLRRGVGASGPQ

SEQ ID NO: 1384425 - protein, 18 aa, Mycobacterium tuberculosis
IGIAWPHLTVRAMDSVAD

SEQ ID NO: 1384426 - protein, 21 aa, Mycobacterium tuberculosis
ILGWASGLGFGWINTLGTANV

SEQ ID NO: 1384427 - protein, 25 aa, Mycobacterium tuberculosis
ITRSFALVRHGFWRVLGIRLLTVLV

SEQ ID NO: 1384428 - protein, 19 aa, Mycobacterium tuberculosis
KDSFPASFIVKLENPEQHK

SEQ ID NO: 1384429 - protein, 24 aa, Mycobacterium tuberculosis
KHCFDVPLCWSIRSIFDMFDSVDQ

SEQ ID NO: 1384430 - protein, 17 aa, Mycobacterium tuberculosis
KRLAEAVGIVLELLAGI

SEQ ID NO: 1384431 - protein, 20 aa, Mycobacterium tuberculosis
KVSLLLSVALFFVWMITVAF

SEQ ID NO: 1384432 - protein, 17 aa, Mycobacterium tuberculosis
KYGKWTIILARFVPIAR

SEQ ID NO: 1384433 - protein, 17 aa, Mycobacterium tuberculosis
LAEAVGIVLELLAGIPS

SEQ ID NO: 1384434 - protein, 23 aa, Mycobacterium tuberculosis
LAGGPWDWARWAPASPWATPPAV

SEQ ID NO: 1384435 - protein, 18 aa, Mycobacterium tuberculosis
LAMQEIPQVFGYDYQTVE

SEQ ID NO: 1384436 - protein, 19 aa, Mycobacterium tuberculosis
LDVLRRVAIDLDRSQKAAS

SEQ ID NO: 1384437 - protein, 20 aa, Mycobacterium tuberculosis
LEAFLKRRVRTHGLLTASIA

SEQ ID NO: 1384438 - protein, 18 aa, Mycobacterium tuberculosis
LFGSPVFAVCCVLSFVVG

SEQ ID NO: 1384439 - protein, 20 aa, Mycobacterium tuberculosis
LGRLRFGALYAVSALGGSVL

SEQ ID NO: 1384440 - protein, 19 aa, Mycobacterium tuberculosis
LHQPYLMGCLSPRNELSQI

SEQ ID NO: 1384441 - protein, 18 aa, Mycobacterium tuberculosis
LLAGLIWLYNVVWKVPPD

SEQ ID NO: 1384442 - protein, 17 aa, Mycobacterium tuberculosis
LPARFGVEQVRELASRD

SEQ ID NO: 1384443 - protein, 18 aa, Mycobacterium tuberculosis
LPQTRWIPVVTFVQVSAD

SEQ ID NO: 1384444 - protein, 22 aa, Mycobacterium tuberculosis
LQADCYAGVWAYYASTVKQEST

SEQ ID NO: 1384445 - protein, 17 aa, Mycobacterium tuberculosis
LQGADQLLVRWRQANDR

SEQ ID NO: 1384446 - protein, 18 aa, Mycobacterium tuberculosis
LTAIHLFAGAPPVDRSHT

SEQ ID NO: 1384447 - protein, 19 aa, Mycobacterium tuberculosis
LVAEIGVACAVAIAVDATV

SEQ ID NO: 1384448 - protein, 22 aa, Mycobacterium tuberculosis
LVAVLYRWFPPITVWTGLSLLA

SEQ ID NO: 1384449 - protein, 18 aa, Mycobacterium tuberculosis
LVWRRVSDGWAFMCTLIV

SEQ ID NO: 1384450 - protein, 18 aa, Mycobacterium tuberculosis
LYLDGGLQFCTRDEYRYT

SEQ ID NO: 1384451 - protein, 23 aa, Mycobacterium tuberculosis
MLSVPRWAVGPVMELGTDHRRIE

SEQ ID NO: 1384452 - protein, 19 aa, Mycobacterium tuberculosis
MQGLPSPYLTIAFPNRPPQ

SEQ ID NO: 1384453 - protein, 23 aa, Mycobacterium tuberculosis
MSNWECVRRVTLPWVSSGIVGAV

SEQ ID NO: 1384454 - protein, 17 aa, Mycobacterium tuberculosis
MVALCLGGGVFGLSLGK

SEQ ID NO: 1384455 - protein, 17 aa, Mycobacterium tuberculosis
NRFVQCRVVATGNSVDA

SEQ ID NO: 1384456 - protein, 19 aa, Mycobacterium tuberculosis
NSVDAVWKPLLPGYTRPHM

SEQ ID NO: 1384457 - protein, 21 aa, Mycobacterium tuberculosis
NTAGWRPGPIRALLATRPAAF

SEQ ID NO: 1384458 - protein, 18 aa, Mycobacterium tuberculosis
PDVLRPDLTIAYTDTDGY

SEQ ID NO: 1384459 - protein, 19 aa, Mycobacterium tuberculosis
PHAPWARWRYTRHPEKMRR

SEQ ID NO: 1384460 - protein, 25 aa, Mycobacterium tuberculosis
PLVRKTAAWAWRFLVILAAMVALLW

SEQ ID NO: 1384461 - protein, 19 aa, Mycobacterium tuberculosis
PNGTHSWPYWNEQLVAMKA

SEQ ID NO: 1384462 - protein, 20 aa, Mycobacterium tuberculosis
PPRNCWWAAVVALALLAWVL

SEQ ID NO: 1384463 - protein, 18 aa, Mycobacterium tuberculosis
PRDLAPLLAAWVISVGVM

SEQ ID NO: 1384464 - protein, 17 aa, Mycobacterium tuberculosis
PRLPRLIPGGDYVMAGG

SEQ ID NO: 1384465 - protein, 18 aa, Mycobacterium tuberculosis
QRWFSWLALLTMPAPFLA

SEQ ID NO: 1384466 - protein, 23 aa, Mycobacterium tuberculosis
QWPLFAWFCVYAYRNFVRYEETP

SEQ ID NO: 1384467 - protein, 18 aa, Mycobacterium tuberculosis
RKFFEAFAPYGLKQTAVK

SEQ ID NO: 1384468 - protein, 24 aa, Mycobacterium tuberculosis
RKVGAAIVRWPGPILVGAVALALV

SEQ ID NO: 1384469 - protein, 20 aa, Mycobacterium tuberculosis
RLFAAMGFAGYFAMLALPAM

SEQ ID NO: 1384470 - protein, 18 aa, Mycobacterium tuberculosis
RLLIGIVVALALVSAMTA

SEQ ID NO: 1384471 - protein, 17 aa, Mycobacterium tuberculosis
RRIAADLARPAETVRGW

SEQ ID NO: 1384472 - protein, 22 aa, Mycobacterium tuberculosis
RVEVPNALPLMLGGLRSATLQV

SEQ ID NO: 1384473 - protein, 21 aa, Mycobacterium tuberculosis
RVIPPSLLRRALPYLIGILIV

SEQ ID NO: 1384474 - protein, 19 aa, Mycobacterium tuberculosis
RWALFMVTITYVWKNLGYT

SEQ ID NO: 1384475 - protein, 17 aa, Mycobacterium tuberculosis
SGICGAFGYGLGVFAVW

SEQ ID NO: 1384476 - protein, 20 aa, Mycobacterium tuberculosis
SHPLCVLGFGFSVLAIAMTW

SEQ ID NO: 1384477 - protein, 19 aa, Mycobacterium tuberculosis
SNALLDWAYGRRFRYSETM

SEQ ID NO: 1384478 - protein, 24 aa, Mycobacterium tuberculosis
SPLTAAMSLMWGWRLAAVCVTGAA

SEQ ID NO: 1384479 - protein, 23 aa, Mycobacterium tuberculosis
SQFSVRLLRTFLRDVPNQVVLAI

SEQ ID NO: 1384480 - protein, 22 aa, Mycobacterium tuberculosis
SSDPTVAAGYPWQQQPTQEATW

SEQ ID NO: 1384481 - protein, 24 aa, Mycobacterium tuberculosis
TCALAALCYAEFASTLPVAGSAYT

SEQ ID NO: 1384482 - protein, 23 aa, Mycobacterium tuberculosis
TGRAVSFLGPWLFSVFVDVFHTV

SEQ ID NO: 1384483 - protein, 17 aa, Mycobacterium tuberculosis
TIVRIVAPIAMPGIVSG

SEQ ID NO: 1384484 - protein, 19 aa, Mycobacterium tuberculosis
TMRTVKLNMVWAFGYNIAA

SEQ ID NO: 1384485 - protein, 18 aa, Mycobacterium tuberculosis
VAGLAWYLTHDVFNHPQA

SEQ ID NO: 1384486 - protein, 18 aa, Mycobacterium tuberculosis
VCVVLRLARYNALQDDGT

SEQ ID NO: 1384487 - protein, 22 aa, Mycobacterium tuberculosis
VGLGMSVARGFVEAMGGTISAT

SEQ ID NO: 1384488 - protein, 20 aa, Mycobacterium tuberculosis
VGQQCARRALPFVAAMAKLL

SEQ ID NO: 1384489 - protein, 18 aa, Mycobacterium tuberculosis
VLAAYAFARLQFRGRDAL

SEQ ID NO: 1384490 - protein, 18 aa, Mycobacterium tuberculosis
VLCAIGAVYLGSRTGAGF

SEQ ID NO: 1384491 - protein, 19 aa, Mycobacterium tuberculosis
VVCVLTLTIARPVRTYFAQ

SEQ ID NO: 1384492 - protein, 24 aa, Mycobacterium tuberculosis
VVFIRYHFSMVWGLYLAAGIMVLA

SEQ ID NO: 1384493 - protein, 19 aa, Mycobacterium tuberculosis
VVLRPHWTPLFAYAAAFLI

SEQ ID NO: 1384494 - protein, 24 aa, Mycobacterium tuberculosis
VVYDMWGAAVSLAYQMHSGSPQPG

SEQ ID NO: 1384495 - protein, 22 aa, Mycobacterium tuberculosis
VYLWHWPIFLALNGQRTGWSGP

SEQ ID NO: 1384496 - protein, 22 aa, Mycobacterium tuberculosis
WLGLSWRWLFGLSIIPALISLI

SEQ ID NO: 1384497 - protein, 17 aa, Mycobacterium tuberculosis
WPWAYAMLLGIHVVLLF

SEQ ID NO: 1384498 - protein, 18 aa, Mycobacterium tuberculosis
WSLLVGYGCLPWVATAML

SEQ ID NO: 1384499 - protein, 18 aa, Mycobacterium tuberculosis
WSTLKVSLLLSVALFFVW

SEQ ID NO: 1384500 - protein, 19 aa, Mycobacterium tuberculosis
WTVGLCLYGLVMGSVVHGI

SEQ ID NO: 1384501 - protein, 20 aa, Mycobacterium tuberculosis
WWAAVVALALLAWVLTHRAT

SEQ ID NO: 1384502 - protein, 20 aa, Mycobacterium tuberculosis
YDARWLVTRMTTITSLDLTP

SEQ ID NO: 1384503 - protein, 20 aa, Mycobacterium tuberculosis
AASVLPVWLLLAPRDYLSTF

SEQ ID NO: 1384504 - protein, 18 aa, Mycobacterium tuberculosis
ADLASIWRRCGGRTVTLF

SEQ ID NO: 1384505 - protein, 23 aa, Mycobacterium tuberculosis
AFIPRFLFAVSFCGVLVATATYL

SEQ ID NO: 1384506 - protein, 19 aa, Mycobacterium tuberculosis
AGATAAWAIGRWTPGTERR

SEQ ID NO: 1384507 - protein, 18 aa, Mycobacterium tuberculosis
AGLMAAVGFELFKQVGAI

SEQ ID NO: 1384508 - protein, 18 aa, Mycobacterium tuberculosis
AHCVHRFGGVTGDVLGSA

SEQ ID NO: 1384509 - protein, 24 aa, Mycobacterium tuberculosis
AHGLGMPIPLGWQVWLYGVFAIIA

SEQ ID NO: 1384510 - protein, 18 aa, Mycobacterium tuberculosis
AHIKLAWRTGNFVIYAIT

SEQ ID NO: 1384511 - protein, 24 aa, Mycobacterium tuberculosis
AIAIRVDWPRFWALITTPSSQTAL

SEQ ID NO: 1384512 - protein, 20 aa, Mycobacterium tuberculosis
AIGVLLGWPLWWVSTCSVLV

SEQ ID NO: 1384513 - protein, 17 aa, Mycobacterium tuberculosis
ALFPGIFGLFAVVVRLL

SEQ ID NO: 1384514 - protein, 24 aa, Mycobacterium tuberculosis
ALIRARFPTLTARQVMQRIESTAH

SEQ ID NO: 1384515 - protein, 23 aa, Mycobacterium tuberculosis
AMPPSSVVGLWTFDGREGRTEVP

SEQ ID NO: 1384516 - protein, 23 aa, Mycobacterium tuberculosis
APEAMWWTLYLACYLAGGWGSAW

SEQ ID NO: 1384517 - protein, 20 aa, Mycobacterium tuberculosis
APRLRLAKRSLFDPMIVRSA

SEQ ID NO: 1384518 - protein, 19 aa, Mycobacterium tuberculosis
ARKRIAWLVLLANMVLAAV

SEQ ID NO: 1384519 - protein, 26 aa, Mycobacterium tuberculosis
ARPYQWWRLALVLASGLAYVVIFSLP

SEQ ID NO: 1384520 - protein, 19 aa, Mycobacterium tuberculosis
ASAMLRRNLLIYGLGGLVV

SEQ ID NO: 1384521 - protein, 20 aa, Mycobacterium tuberculosis
AVLAVIWCWLLKRYIVEGPL

SEQ ID NO: 1384522 - protein, 20 aa, Mycobacterium tuberculosis
AVVPHVRWPMWLRTAVATAA

SEQ ID NO: 1384523 - protein, 22 aa, Mycobacterium tuberculosis
DLAAGLVCWLLLSREVLPRLGP

SEQ ID NO: 1384524 - protein, 24 aa, Mycobacterium tuberculosis
EDIIRFQAEFLWRDYFQPGVSIDG

SEQ ID NO: 1384525 - protein, 20 aa, Mycobacterium tuberculosis
EEERARWSLGRHVKLRGHDQ

SEQ ID NO: 1384526 - protein, 21 aa, Mycobacterium tuberculosis
ERPAGTIGEIWVHGDNVAIGY

SEQ ID NO: 1384527 - protein, 23 aa, Mycobacterium tuberculosis
ETTAPVWITMLWPLADRPRLAPG

SEQ ID NO: 1384528 - protein, 20 aa, Mycobacterium tuberculosis
FGPYHLKRLLGRGGMGEVYE

SEQ ID NO: 1384529 - protein, 17 aa, Mycobacterium tuberculosis
FRRSELMLALATTAAVL

SEQ ID NO: 1384530 - protein, 17 aa, Mycobacterium tuberculosis
FVQCRVVATGNSVDAVW

SEQ ID NO: 1384531 - protein, 24 aa, Mycobacterium tuberculosis
GAFLRLPYTFAIPIFGGRNWTTVS

SEQ ID NO: 1384532 - protein, 22 aa, Mycobacterium tuberculosis
GATGVFLACRWAQADGADHAWL

SEQ ID NO: 1384533 - protein, 18 aa, Mycobacterium tuberculosis
GDHRLRVIGVTWNAEASA

SEQ ID NO: 1384534 - protein, 19 aa, Mycobacterium tuberculosis
GFASLWSWFIGLVVTEFPL

SEQ ID NO: 1384535 - protein, 19 aa, Mycobacterium tuberculosis
GGPLPRGRGLLMAEDTGVF

SEQ ID NO: 1384536 - protein, 18 aa, Mycobacterium tuberculosis
GKLFAGACVVWFFVLFDM

SEQ ID NO: 1384537 - protein, 20 aa, Mycobacterium tuberculosis
GLRTRSEMIAQLVFAMGGRA

SEQ ID NO: 1384538 - protein, 25 aa, Mycobacterium tuberculosis
GPGRYGLDAARGWAHRPFIGSFVAL

SEQ ID NO: 1384539 - protein, 22 aa, Mycobacterium tuberculosis
GPLADRSRRFWAWTIAGYTLTV

SEQ ID NO: 1384540 - protein, 17 aa, Mycobacterium tuberculosis
GQANWWLPSSWRPATWW

SEQ ID NO: 1384541 - protein, 19 aa, Mycobacterium tuberculosis
GRNTLLLPFRVAAVHLILW

SEQ ID NO: 1384542 - protein, 19 aa, Mycobacterium tuberculosis
GRTAQAWARRHQQLRAALT

SEQ ID NO: 1384543 - protein, 20 aa, Mycobacterium tuberculosis
GSFMLCAAFNVLLRGLCGRD

SEQ ID NO: 1384544 - protein, 22 aa, Mycobacterium tuberculosis
GVALCAGLWFIGRRVIATVGHN

SEQ ID NO: 1384545 - protein, 22 aa, Mycobacterium tuberculosis
IAALLGRWFWWPLRVRPRPASQ

SEQ ID NO: 1384546 - protein, 27 aa, Mycobacterium tuberculosis
IAEGLRFVWNLRVLRTLGMIDLTVTAL

SEQ ID NO: 1384547 - protein, 23 aa, Mycobacterium tuberculosis
IARRSGTPISFWKFTRKGAVVTA

SEQ ID NO: 1384548 - protein, 23 aa, Mycobacterium tuberculosis
IGWPETIFRFALYAFLCATALMV

SEQ ID NO: 1384549 - protein, 17 aa, Mycobacterium tuberculosis
IILGWLVTIAVLNVTVP

SEQ ID NO: 1384550 - protein, 17 aa, Mycobacterium tuberculosis
IKPAIVVALLFRTLDAF

SEQ ID NO: 1384551 - protein, 17 aa, Mycobacterium tuberculosis
ILLPHSRPAVLVLGVLT

SEQ ID NO: 1384552 - protein, 24 aa, Mycobacterium tuberculosis
ILTSVWLFDCWRLLVRPPHAGRRR

SEQ ID NO: 1384553 - protein, 23 aa, Mycobacterium tuberculosis
ISGWRAGALGSMLSFGGVLLGAT

SEQ ID NO: 1384554 - protein, 18 aa, Mycobacterium tuberculosis
ITLPMLRPTMFFVLVTGI

SEQ ID NO: 1384555 - protein, 19 aa, Mycobacterium tuberculosis
KGANFTAAMAFEIGSTNLV

SEQ ID NO: 1384556 - protein, 25 aa, Mycobacterium tuberculosis
KRPSRWRHVPAILLVLSLLLFTIAM

SEQ ID NO: 1384557 - protein, 18 aa, Mycobacterium tuberculosis
LAELGWICVAINYRHSPR

SEQ ID NO: 1384558 - protein, 19 aa, Mycobacterium tuberculosis
LAKLARAGFRVSDVKPPSS

SEQ ID NO: 1384559 - protein, 17 aa, Mycobacterium tuberculosis
LELATPYALNAVSDDER

SEQ ID NO: 1384560 - protein, 19 aa, Mycobacterium tuberculosis
LFGQLPLPLGVVGHEGSTV

SEQ ID NO: 1384561 - protein, 29 aa, Mycobacterium tuberculosis
LGGWLTDYLSWRWAFWINVPVSIAVLTVA

SEQ ID NO: 1384562 - protein, 20 aa, Mycobacterium tuberculosis
LGIPCAVGMLVAVAVALTLG

SEQ ID NO: 1384563 - protein, 17 aa, Mycobacterium tuberculosis
LGTVIGFYGLTIDEPPT

SEQ ID NO: 1384564 - protein, 21 aa, Mycobacterium tuberculosis
LGYGDPRFGYSTSPANVPTPF

SEQ ID NO: 1384565 - protein, 18 aa, Mycobacterium tuberculosis
LLGVIAFRALVLANPEQR

SEQ ID NO: 1384566 - protein, 18 aa, Mycobacterium tuberculosis
LLLARWLLFRVEFGAGLI

SEQ ID NO: 1384567 - protein, 19 aa, Mycobacterium tuberculosis
LRSGSPILFYPAGALAITV

SEQ ID NO: 1384568 - protein, 18 aa, Mycobacterium tuberculosis
LRVTRWDVGLAMLIAGGV

SEQ ID NO: 1384569 - protein, 18 aa, Mycobacterium tuberculosis
LTAVPLWIAFALGAKPAT

SEQ ID NO: 1384570 - protein, 24 aa, Mycobacterium tuberculosis
LVAIAVLCAVSFFTAIFLRDLRIP

SEQ ID NO: 1384571 - protein, 23 aa, Mycobacterium tuberculosis
LVGELLCFVGMLIGIPVAALIHV

SEQ ID NO: 1384572 - protein, 19 aa, Mycobacterium tuberculosis
LVWLLWVVIARGWFAVTRS

SEQ ID NO: 1384573 - protein, 19 aa, Mycobacterium tuberculosis
LWSRLPSCLAIGAAAAGVV

SEQ ID NO: 1384574 - protein, 26 aa, Mycobacterium tuberculosis
LYRLLTCWLPVFAGWQVMHWLTRHEM

SEQ ID NO: 1384575 - protein, 18 aa, Mycobacterium tuberculosis
MDRWDRRWVLVGANTGRL

SEQ ID NO: 1384576 - protein, 20 aa, Mycobacterium tuberculosis
MFPALAVAVTSQFAEPDDAE

SEQ ID NO: 1384577 - protein, 23 aa, Mycobacterium tuberculosis
NCQRAIPHVVGWYQAYKDSGLAV

SEQ ID NO: 1384578 - protein, 22 aa, Mycobacterium tuberculosis
NEGGPCWSMRLNAVEPPKGPAW

SEQ ID NO: 1384579 - protein, 18 aa, Mycobacterium tuberculosis
PASQMLRPFAPRRLVRAL

SEQ ID NO: 1384580 - protein, 18 aa, Mycobacterium tuberculosis
PNSVWSWDITKLRGPAKW

SEQ ID NO: 1384581 - protein, 19 aa, Mycobacterium tuberculosis
PPVPIPWSVLSLFVPGPTL

SEQ ID NO: 1384582 - protein, 19 aa, Mycobacterium tuberculosis
PVSIALLWSLRFGPRVLGP

SEQ ID NO: 1384583 - protein, 23 aa, Mycobacterium tuberculosis
PWLPARWRHWWWALLLAFVPIHL

SEQ ID NO: 1384584 - protein, 19 aa, Mycobacterium tuberculosis
QVARLWKLTSALTIDDRTG

SEQ ID NO: 1384585 - protein, 17 aa, Mycobacterium tuberculosis
RAYPGFVRRVMTSAVPF

SEQ ID NO: 1384586 - protein, 17 aa, Mycobacterium tuberculosis
RLAIAAMGAVLVYGLVG

SEQ ID NO: 1384587 - protein, 20 aa, Mycobacterium tuberculosis
RLKATMLAHWAWLSMLLVGG

SEQ ID NO: 1384588 - protein, 18 aa, Mycobacterium tuberculosis
RLRYDQFMALGWKLLIPV

SEQ ID NO: 1384589 - protein, 21 aa, Mycobacterium tuberculosis
RMSPFWQRMFLTIGILIAVFG

SEQ ID NO: 1384590 - protein, 20 aa, Mycobacterium tuberculosis
RNRCSLLRVELQEHVAGLSR

SEQ ID NO: 1384591 - protein, 23 aa, Mycobacterium tuberculosis
RRMPDLRGALLLAVTLGLVTLGL

SEQ ID NO: 1384592 - protein, 22 aa, Mycobacterium tuberculosis
RRPSRLRRGWLVGIAATLLALA

SEQ ID NO: 1384593 - protein, 25 aa, Mycobacterium tuberculosis
RRWRRIGTVVVRWPGPVLAATLLIA

SEQ ID NO: 1384594 - protein, 20 aa, Mycobacterium tuberculosis
RVSDGWAFMCTLIVVAAVVV

SEQ ID NO: 1384595 - protein, 18 aa, Mycobacterium tuberculosis
RWGVAGRMVVAWLVTLPL

SEQ ID NO: 1384596 - protein, 19 aa, Mycobacterium tuberculosis
SGLAVPRPLPAVIADAAAR

SEQ ID NO: 1384597 - protein, 18 aa, Mycobacterium tuberculosis
SGTPFVWDGSMVVNYQDP

SEQ ID NO: 1384598 - protein, 19 aa, Mycobacterium tuberculosis
SKHHLWIFAGIAAAILAGG

SEQ ID NO: 1384599 - protein, 20 aa, Mycobacterium tuberculosis
SLYRAKWWWLLAAVAAAGAS

SEQ ID NO: 1384600 - protein, 19 aa, Mycobacterium tuberculosis
SPGTRWPQPTPWAGGAPPW

SEQ ID NO: 1384601 - protein, 17 aa, Mycobacterium tuberculosis
TPREWMWAVLLAGAVAV

SEQ ID NO: 1384602 - protein, 25 aa, Mycobacterium tuberculosis
TREAYRIGGDWVQYRSYPGIGTKQP

SEQ ID NO: 1384603 - protein, 17 aa, Mycobacterium tuberculosis
TVYQMWLLGGAKGPRSA

SEQ ID NO: 1384604 - protein, 19 aa, Mycobacterium tuberculosis
VAQAALWTGYRPWFIDIDA

SEQ ID NO: 1384605 - protein, 17 aa, Mycobacterium tuberculosis
VASRTGNLVTWWTGDAL

SEQ ID NO: 1384606 - protein, 27 aa, Mycobacterium tuberculosis
VDLARTVLRIMFPLSFVVAILLVSQGV

SEQ ID NO: 1384607 - protein, 27 aa, Mycobacterium tuberculosis
VEPPKGPAWRRIRVSQLLIGVSAVVAM

SEQ ID NO: 1384608 - protein, 23 aa, Mycobacterium tuberculosis
VFGRGDIALGWAFLGAGIGSLVR

SEQ ID NO: 1384609 - protein, 20 aa, Mycobacterium tuberculosis
VGPRQWRWPLGEIDRPFEMR

SEQ ID NO: 1384610 - protein, 19 aa, Mycobacterium tuberculosis
VLVGGLWAWIAPPIHAVVA

SEQ ID NO: 1384611 - protein, 18 aa, Mycobacterium tuberculosis
VPGYCVLAFILGTYWLTR

SEQ ID NO: 1384612 - protein, 31 aa, Mycobacterium tuberculosis; identical to SEQ ID NO: 161585

SEQ ID NO: 1384613 - protein, 18 aa, Mycobacterium tuberculosis
VQAAVPFYGVYDFTRLQD

SEQ ID NO: 1384614 - protein, 27 aa, Mycobacterium tuberculosis
WLPSSWRPATWWPLGRRRGRAQRTKRK

SEQ ID NO: 1384615 - protein, 20 aa, Mycobacterium tuberculosis
YETIGGLVLRELGHIPVAGE

SEQ ID NO: 1384616 - protein, 24 aa, Mycobacterium tuberculosis
YKYFLEFFEQFGFSPAVTVVLALV

SEQ ID NO: 1384617 - protein, 22 aa, Mycobacterium tuberculosis
YMRYPVFLGFDIVGGVAWGAGV

SEQ ID NO: 1384618 - protein, 18 aa, Mycobacterium tuberculosis
AATIARRLGLTGALGTVA

SEQ ID NO: 1384619 - protein, 24 aa, Mycobacterium tuberculosis
AEAFLPRRWRYGAQVTLALGGSAV

SEQ ID NO: 1384620 - protein, 19 aa, Mycobacterium tuberculosis
AFFGWRWSLPLGVAILLAA

SEQ ID NO: 1384621 - protein, 17 aa, Mycobacterium tuberculosis
AGMLLWFLIALPIGAVT

SEQ ID NO: 1384622 - protein, 18 aa, Mycobacterium tuberculosis
AGTARLGFLASLLSRPVL

SEQ ID NO: 1384623 - protein, 24 aa, Mycobacterium tuberculosis
ALATLLGRWFWWPRRVDRLARQPQ

SEQ ID NO: 1384624 - protein, 17 aa, Mycobacterium tuberculosis
ALWVVLAFIVFQAVAAV

SEQ ID NO: 1384625 - protein, 18 aa, Mycobacterium tuberculosis
ANLLRYGYYPALILGLTV

SEQ ID NO: 1384626 - protein, 23 aa, Mycobacterium tuberculosis
APSALRQSFLWGLAGVIAAEHPE

SEQ ID NO: 1384627 - protein, 21 aa, Mycobacterium tuberculosis
AQIPMYLGYAFRAMNSHGRAL

SEQ ID NO: 1384628 - protein, 22 aa, Mycobacterium tuberculosis
ARRRLVKLGAWVAAQLPTTRTA

SEQ ID NO: 1384629 - protein, 24 aa, Mycobacterium tuberculosis
ASALAPPCIIAFLETRYWWAGIAL

SEQ ID NO: 1384630 - protein, 18 aa, Mycobacterium tuberculosis
AVSSRAGVEIAIDDNGSG

SEQ ID NO: 1384631 - protein, 20 aa, Mycobacterium tuberculosis
EAAKFGVEWLPAKGFITDRL

SEQ ID NO: 1384632 - protein, 21 aa, Mycobacterium tuberculosis
EAEPAAWLRFWFPDPNGSNTE

SEQ ID NO: 1384633 - protein, 18 aa, Mycobacterium tuberculosis
EPDLRAIIELGYDRTGYA

SEQ ID NO: 1384634 - protein, 23 aa, Mycobacterium tuberculosis
EPICPPCGSFIRSYASDIDTAVA

SEQ ID NO: 1384635 - protein, 18 aa, Mycobacterium tuberculosis
EPPYRGGPVLADNAVIPV

SEQ ID NO: 1384636 - protein, 18 aa, Mycobacterium tuberculosis
ESRLRAAGFIGFAIGGPL

SEQ ID NO: 1384637 - protein, 18 aa, Mycobacterium tuberculosis
FASVNGWWYVSNFGVPWS

SEQ ID NO: 1384638 - protein, 17 aa, Mycobacterium tuberculosis
FLVILAAMVALLWVLNK

SEQ ID NO: 1384639 - protein, 22 aa, Mycobacterium tuberculosis
GAALCLPLARALRRPTPSAMTT

SEQ ID NO: 1384640 - protein, 18 aa, Mycobacterium tuberculosis
GGAPGCWQPITRDLWPAP

SEQ ID NO: 1384641 - protein, 25 aa, Mycobacterium tuberculosis
GLFDRIGNFVVRWPLIVIGCWIAVA

SEQ ID NO: 1384642 - protein, 24 aa, Mycobacterium tuberculosis
GQFEGRLWIAMQFVDGGNAEDALR

SEQ ID NO: 1384643 - protein, 17 aa, Mycobacterium tuberculosis
GQTARLYIRPVLNSMPA

SEQ ID NO: 1384644 - protein, 27 aa, Mycobacterium tuberculosis
GVAGLVDWPILLAVGGGALLLRKLNRT

SEQ ID NO: 1384645 - protein, 23 aa, Mycobacterium tuberculosis
GYAKIVGCALGFPVINIARSSAK

SEQ ID NO: 1384646 - protein, 22 aa, Mycobacterium tuberculosis
HEGGHTLAAWAMPDIEPIYKVT

SEQ ID NO: 1384647 - protein, 22 aa, Mycobacterium tuberculosis
HIVGLCIFGFLLAMLRGNHVGH

SEQ ID NO: 1384648 - protein, 22 aa, Mycobacterium tuberculosis
IAALLGRWFWWPLRVRSRPART

SEQ ID NO: 1384649 - protein, 20 aa, Mycobacterium tuberculosis
IAVFCGFAFAGMPLVAEIGV

SEQ ID NO: 1384650 - protein, 27 aa, Mycobacterium tuberculosis
ICGAFGYGLGVFAVWLVRYMRSHNSSP

SEQ ID NO: 1384651 - protein, 25 aa, Mycobacterium tuberculosis
IGRAWLRLFGVLPFDYDRLSIAELE

SEQ ID NO: 1384652 - protein, 17 aa, Mycobacterium tuberculosis
ILARFPGLYLQSLGLTF

SEQ ID NO: 1384653 - protein, 19 aa, Mycobacterium tuberculosis
IVDPEFGYDIGFFVFDLPF

SEQ ID NO: 1384654 - protein, 18 aa, Mycobacterium tuberculosis
IVRLLAWQGAALAAIPLL

SEQ ID NO: 1384655 - protein, 18 aa, Mycobacterium tuberculosis
KMTTEWLHVPFLPVPIPV

SEQ ID NO: 1384656 - protein, 17 aa, Mycobacterium tuberculosis
LALSFASVNGWWYVSNF

SEQ ID NO: 1384657 - protein, 20 aa, Mycobacterium tuberculosis
LAVLLCCWGFRVQRARHAQD

SEQ ID NO: 1384658 - protein, 25 aa, Mycobacterium tuberculosis
LGVVVGGPFLPLAIILYWFSNNIWT

SEQ ID NO: 1384659 - protein, 24 aa, Mycobacterium tuberculosis
LIRTPELYAWILVLPIGLMLQQSS

SEQ ID NO: 1384660 - protein, 17 aa, Mycobacterium tuberculosis
LPWLRIAILGTPAILVS

SEQ ID NO: 1384661 - protein, 19 aa, Mycobacterium tuberculosis
LRGRATLYLTYWTAGDTRN

SEQ ID NO: 1384662 - protein, 18 aa, Mycobacterium tuberculosis
LTALTWPVMANFAVDSAM

SEQ ID NO: 1384663 - protein, 20 aa, Mycobacterium tuberculosis
MAIFYLRLPATFGIGTYGVS

SEQ ID NO: 1384664 - protein, 20 aa, Mycobacterium tuberculosis
MCVGVSLVLPAAVWGVLTPR

SEQ ID NO: 1384665 - protein, 23 aa, Mycobacterium tuberculosis
PDSLIRMCLFLGALTFMYISARA

SEQ ID NO: 1384666 - protein, 24 aa, Mycobacterium tuberculosis
QISAPRAKLFAALFLILALVVVGE

SEQ ID NO: 1384667 - protein, 19 aa, Mycobacterium tuberculosis
QPVLLDWAVGLAFPCQQPM

SEQ ID NO: 1384668 - protein, 18 aa, Mycobacterium tuberculosis
RDLRAIVRLLAWQGAALA

SEQ ID NO: 1384669 - protein, 27 aa, Mycobacterium tuberculosis
REAAEALGLPAGWALRKIVLKTAMPGI

SEQ ID NO: 1384670 - protein, 17 aa, Mycobacterium tuberculosis
REEAAKFGVEWLPAKGF

SEQ ID NO: 1384671 - protein, 17 aa, Mycobacterium tuberculosis
RERFGLVGLFVGSALVS

SEQ ID NO: 1384672 - protein, 17 aa, Mycobacterium tuberculosis
RFVMRRIAAGIALHDTR

SEQ ID NO: 1384673 - protein, 30 aa, Mycobacterium tuberculosis; identical to SEQ ID NO: 161287

SEQ ID NO: 1384674 - protein, 19 aa, Mycobacterium tuberculosis
RHIASWLAALVVPSVICAI

SEQ ID NO: 1384675 - protein, 17 aa, Mycobacterium tuberculosis
RIVDVFRITRKVGVEES

SEQ ID NO: 1384676 - protein, 20 aa, Mycobacterium tuberculosis
RKRLPAIFVDVARFALIGIG

SEQ ID NO: 1384677 - protein, 23 aa, Mycobacterium tuberculosis
RLLREFRGPLALSLLLVAVQTCA

SEQ ID NO: 1384678 - protein, 17 aa, Mycobacterium tuberculosis
RRCRWLVFTGWLLALVP

SEQ ID NO: 1384679 - protein, 21 aa, Mycobacterium tuberculosis
RRVGTAIVRWPGPVLAATCLV

SEQ ID NO: 1384680 - protein, 17 aa, Mycobacterium tuberculosis
RVRERFGLVGLFVGSAL

SEQ ID NO: 1384681 - protein, 17 aa, Mycobacterium tuberculosis
SPLGWSLQVRPYAGERW

SEQ ID NO: 1384682 - protein, 24 aa, Mycobacterium tuberculosis
SPLPRSARQPWLWVGVAVAVVVAL

SEQ ID NO: 1384683 - protein, 24 aa, Mycobacterium tuberculosis
SSPTFMQWGWRIPFLVSAALIAVA

SEQ ID NO: 1384684 - protein, 24 aa, Mycobacterium tuberculosis
TMRTIRMNMIWAFGYNVAAIPIAA

SEQ ID NO: 1384685 - protein, 19 aa, Mycobacterium tuberculosis
TRGRIVLRWLRIAVLIVTG

SEQ ID NO: 1384686 - protein, 19 aa, Mycobacterium tuberculosis
TSLKTSWYLLGPAFVAAIA

SEQ ID NO: 1384687 - protein, 18 aa, Mycobacterium tuberculosis
VDCPLTWVERWARTKAAM

SEQ ID NO: 1384688 - protein, 24 aa, Mycobacterium tuberculosis
VELLKLAVLLALWAAVAGAFVSVL

SEQ ID NO: 1384689 - protein, 25 aa, Mycobacterium tuberculosis
VGYRNRIAALFAWGISFMGRARGQM

SEQ ID NO: 1384690 - protein, 23 aa, Mycobacterium tuberculosis
VLRRARYRPLWVFLLVPVLILLT

SEQ ID NO: 1384691 - protein, 19 aa, Mycobacterium tuberculosis
VRANLHFLWLRLARVWPVY

SEQ ID NO: 1384692 - protein, 29 aa, Mycobacterium tuberculosis
VSGYRFLLRRIECALLFGDVCAATGALRA

SEQ ID NO: 1384693 - protein, 18 aa, Mycobacterium tuberculosis
WDITKLRGPAKWSYYYLY

SEQ ID NO: 1384694 - protein, 22 aa, Mycobacterium tuberculosis
WLIGAYGWRWIFLVNLPVGLSA

SEQ ID NO: 1384695 - protein, 17 aa, Mycobacterium tuberculosis
WLRRHTRAIQIFGGALL

SEQ ID NO: 1384696 - protein, 20 aa, Mycobacterium tuberculosis
WSSDLSMTWDLLCRSVTHGI

SEQ ID NO: 1384697 - protein, 18 aa, Mycobacterium tuberculosis
WWLFAWELDNGAGLHEAR

SEQ ID NO: 1384698 - protein, 22 aa, Mycobacterium tuberculosis
YGGLRAALPVTFATFGLAYLAI

SEQ ID NO: 1384699 - protein, 18 aa, Mycobacterium tuberculosis
YNMPLELVLTVIPFLIIS

SEQ ID NO: 1384700 - protein, 17 aa, Mycobacterium tuberculosis
YRLISWLLIAAIGWVVF

SEQ ID NO: 1384701 - protein, 18 aa, Mycobacterium tuberculosis
ADEYRPVAATVRHQAFSG

SEQ ID NO: 1384702 - protein, 20 aa, Mycobacterium tuberculosis
ALLGKWFWWPQVVRQRPVPQ

SEQ ID NO: 1384703 - protein, 17 aa, Mycobacterium tuberculosis
AMGCAFVALLRPQSALG

SEQ ID NO: 1384704 - protein, 20 aa, Mycobacterium tuberculosis
ARSQLWLSLLSWAVVVGCYL

SEQ ID NO: 1384705 - protein, 17 aa, Mycobacterium tuberculosis
EFRCVSVDLLARRPVVH

SEQ ID NO: 1384706 - protein, 18 aa, Mycobacterium tuberculosis
EGRSFRSAVPRGWARARK

SEQ ID NO: 1384707 - protein, 18 aa, Mycobacterium tuberculosis
ELPNLTGRVEFEHVNFAY

SEQ ID NO: 1384708 - protein, 17 aa, Mycobacterium tuberculosis
FCGLLWWIAFHMRDRPL

SEQ ID NO: 1384709 - protein, 20 aa, Mycobacterium tuberculosis
FGAFAHRWLARRTRRRINPG

SEQ ID NO: 1384710 - protein, 17 aa, Mycobacterium tuberculosis
FLLALCWATTNGWWYVS

SEQ ID NO: 1384711 - protein, 18 aa, Mycobacterium tuberculosis
GAAICLLALMATLATASR

SEQ ID NO: 1384712 - protein, 20 aa, Mycobacterium tuberculosis
GFWIRRARRLLPALVLMVLT

SEQ ID NO: 1384713 - protein, 24 aa, Mycobacterium tuberculosis
GGRALRWPRFPLVIEAAVAAVDHQ

SEQ ID NO: 1384714 - protein, 17 aa, Mycobacterium tuberculosis
GPPPVMPPSLAWWASSL

SEQ ID NO: 1384715 - protein, 20 aa, Mycobacterium tuberculosis
GQEWRMVWDSALDRAEIGRG

SEQ ID NO: 1384716 - protein, 19 aa, Mycobacterium tuberculosis
GRTPLPPRRDWQLDTLDTE

SEQ ID NO: 1384717 - protein, 18 aa, Mycobacterium tuberculosis
GSSFKVFALVAALEQGIG

SEQ ID NO: 1384718 - protein, 17 aa, Mycobacterium tuberculosis
GVIWSGVVSKVIVPAVV

SEQ ID NO: 1384719 - protein, 19 aa, Mycobacterium tuberculosis
GVMRWRWRVAFYALSALGT

SEQ ID NO: 1384720 - protein, 21 aa, Mycobacterium tuberculosis
HMAGLPGWRAMFVIEALPALL

SEQ ID NO: 1384721 - protein, 22 aa, Mycobacterium tuberculosis
IAALLGRWFWWPNMIHSRPTVP

SEQ ID NO: 1384722 - protein, 22 aa, Mycobacterium tuberculosis
IATACPFCRVMVTDGVNDRQEE

SEQ ID NO: 1384723 - protein, 20 aa, Mycobacterium tuberculosis
IGALVVWWGWRERRDLFSGF

SEQ ID NO: 1384724 - protein, 22 aa, Mycobacterium tuberculosis
IGLSFLGLCHLWAGSPEAPESR

SEQ ID NO: 1384725 - protein, 19 aa, Mycobacterium tuberculosis
IPGLAHFFTMWGFFILLTV

SEQ ID NO: 1384726 - protein, 27 aa, Mycobacterium tuberculosis
IRLAAIPILLCWLGFTVFVSVAVPPLE

SEQ ID NO: 1384727 - protein, 20 aa, Mycobacterium tuberculosis
KHPRLRVRWVMRRDEKSLAE

SEQ ID NO: 1384728 - protein, 22 aa, Mycobacterium tuberculosis
KPPRLYRAAAWVVIVAGIVFTV

SEQ ID NO: 1384729 - protein, 21 aa, Mycobacterium tuberculosis
KVVNLRSAPGFSFVSEDLDRV

SEQ ID NO: 1384730 - protein, 17 aa, Mycobacterium tuberculosis
LALIPAFVYVVLSAHAN

SEQ ID NO: 1384731 - protein, 19 aa, Mycobacterium tuberculosis
LCTDDLRVARIRGCGADEL

SEQ ID NO: 1384732 - protein, 19 aa, Mycobacterium tuberculosis
LFDACGWRRLIFATPEELE

SEQ ID NO: 1384733 - protein, 19 aa, Mycobacterium tuberculosis
LKAAECRAGARAWRRHEPQ

SEQ ID NO: 1384734 - protein, 26 aa, Mycobacterium tuberculosis
LSAFFTPRFVRWFGLFTTHAIVAAAL

SEQ ID NO: 1384735 - protein, 22 aa, Mycobacterium tuberculosis
LVGACLRFPYTFATAKFGGRNW

SEQ ID NO: 1384736 - protein, 23 aa, Mycobacterium tuberculosis
LWRGLLVFFSRWWQLETLYRSNM

SEQ ID NO: 1384737 - protein, 19 aa, Mycobacterium tuberculosis
MAGLRRWLGPLSILLVLWG

SEQ ID NO: 1384738 - protein, 18 aa, Mycobacterium tuberculosis
MKELLASKDNKAWNLPIT

SEQ ID NO: 1384739 - protein, 21 aa, Mycobacterium tuberculosis
MVAGVILWRFFGDALSNRSHT

SEQ ID NO: 1384740 - protein, 24 aa, Mycobacterium tuberculosis
NGLRPEPIIALGILLTWCSVERAV

SEQ ID NO: 1384741 - protein, 21 aa, Mycobacterium tuberculosis
PEGAHARWNWVLDGMVETKAL

SEQ ID NO: 1384742 - protein, 19 aa, Mycobacterium tuberculosis
PFRCFYLSAPFVVPKKKEV

SEQ ID NO: 1384743 - protein, 21 aa, Mycobacterium tuberculosis
PGLDWRWLVLWWESHAPHIAN

SEQ ID NO: 1384744 - protein, 17 aa, Mycobacterium tuberculosis
PPLFRFGHRGPGDWQAG

SEQ ID NO: 1384745 - protein, 23 aa, Mycobacterium tuberculosis
QAAQLSALWARFPLPVIPAPGDP

SEQ ID NO: 1384746 - protein, 18 aa, Mycobacterium tuberculosis
QVTRELLELFNIDEQTLN

SEQ ID NO: 1384747 - protein, 24 aa, Mycobacterium tuberculosis
RAMRRAGKVFNEFDSNSIAMVVLE

SEQ ID NO: 1384748 - protein, 19 aa, Mycobacterium tuberculosis
RLRRPIVVWWIVWIVSNAI

SEQ ID NO: 1384749 - protein, 22 aa, Mycobacterium tuberculosis
RQHSPMTWRRWALLCVGIAQIA

SEQ ID NO: 1384750 - protein, 19 aa, Mycobacterium tuberculosis
RSGIALSIAALVPIGAALA

SEQ ID NO: 1384751 - protein, 17 aa, Mycobacterium tuberculosis
SAPGFSFVSEDLDRVRS

SEQ ID NO: 1384752 - protein, 18 aa, Mycobacterium tuberculosis
SLPLFGYAAMPAYDVVDG

SEQ ID NO: 1384753 - protein, 20 aa, Mycobacterium tuberculosis
SSALPAYWERLAVCWQLGSD

SEQ ID NO: 1384754 - protein, 17 aa, Mycobacterium tuberculosis
SSLRAGMIAGAIGLLLV

SEQ ID NO: 1384755 - protein, 21 aa, Mycobacterium tuberculosis
SVSIPSWWQPYVLSVASLTSA

SEQ ID NO: 1384756 - protein, 18 aa, Mycobacterium tuberculosis
TGTPRPPFDYMQQVYDRY

SEQ ID NO: 1384757 - protein, 24 aa, Mycobacterium tuberculosis
TMTGPRPGGFGALDGRTNEICAQG

SEQ ID NO: 1384758 - protein, 22 aa, Mycobacterium tuberculosis
TTRIVRASIRWAIEERAPSQAD

SEQ ID NO: 1384759 - protein, 20 aa, Mycobacterium tuberculosis
VGTAVVRWPGPILATSVALA

SEQ ID NO: 1384760 - protein, 19 aa, Mycobacterium tuberculosis
VQWRKRRLVIAIVSTGLVF

SEQ ID NO: 1384761 - protein, 19 aa, Mycobacterium tuberculosis
VRASWPWALVVFLVVVFVA

SEQ ID NO: 1384762 - protein, 20 aa, Mycobacterium tuberculosis
WCLIRTRWGRRIARLLPFVG

SEQ ID NO: 1384763 - protein, 19 aa, Mycobacterium tuberculosis
WEAGNKFIARRNLIWSVAA

SEQ ID NO: 1384764 - protein, 22 aa, Mycobacterium tuberculosis
WQRNVRWARWLAWVSLAVLLTE

SEQ ID NO: 1384765 - protein, 25 aa, Mycobacterium tuberculosis
AAEWWRLGLMFAVIVALHLVGWLTV

SEQ ID NO: 1384766 - protein, 19 aa, Mycobacterium tuberculosis
ADRFGSCREFADAMNEQAG

SEQ ID NO: 1384767 - protein, 17 aa, Mycobacterium tuberculosis
AHRRVWRDREPALASPR

SEQ ID NO: 1384768 - protein, 19 aa, Mycobacterium tuberculosis
AQLRIGYATVVWVTSAYLL

SEQ ID NO: 1384769 - protein, 18 aa, Mycobacterium tuberculosis
AREAGRIAAREALPQIME

SEQ ID NO: 1384770 - protein, 17 aa, Mycobacterium tuberculosis
ASTGLGEVWRCLRCGDF

SEQ ID NO: 1384771 - protein, 18 aa, Mycobacterium tuberculosis
AVVIFGFLLWHVIGANSS

SEQ ID NO: 1384772 - protein, 18 aa, Mycobacterium tuberculosis
CKGLEKIPLLGHLWSWEL

SEQ ID NO: 1384773 - protein, 29 aa, Mycobacterium tuberculosis
DLRLRWSWRGLRLGLMFGFGGMLVTIPAS

SEQ ID NO: 1384774 - protein, 24 aa, Mycobacterium tuberculosis
DPVFLDWLVGLAFPCQRPFGHQYG

SEQ ID NO: 1384775 - protein, 22 aa, Mycobacterium tuberculosis
ELPFYRLMLSYMLVSVFLAFVA

SEQ ID NO: 1384776 - protein, 17 aa, Mycobacterium tuberculosis
FATLGIIVAHGYAYVTN

SEQ ID NO: 1384777 - protein, 19 aa, Mycobacterium tuberculosis
FDQLWRWNSIVALVLSVMV

SEQ ID NO: 1384778 - protein, 33 aa, Mycobacterium tuberculosis
FFRMCVLTGKALFRWPFQWREFILQCWFIMRVG

SEQ ID NO: 1384779 - protein, 17 aa, Mycobacterium tuberculosis
FGWRIGFAVGGGAAIVV

SEQ ID NO: 1384780 - protein, 21 aa, Mycobacterium tuberculosis
FLTEPRYTWTIAEPDAAVTEF

SEQ ID NO: 1384781 - protein, 17 aa, Mycobacterium tuberculosis
FLWLRLARVWPVYLVTL

SEQ ID NO: 1384782 - protein, 18 aa, Mycobacterium tuberculosis
FVRLPAMLFGVGRYTVTM

SEQ ID NO: 1384783 - protein, 22 aa, Mycobacterium tuberculosis
GDRGVSWLPFFHDMGLITVLLA

SEQ ID NO: 1384784 - protein, 18 aa, Mycobacterium tuberculosis
GELLFWLPYPSFATYLHV

SEQ ID NO: 1384785 - protein, 22 aa, Mycobacterium tuberculosis
GFFVGWSYWFAWVVTGIADLVA

SEQ ID NO: 1384786 - protein, 19 aa, Mycobacterium tuberculosis
GGLFPTSWLPLLIVTSGVV

SEQ ID NO: 1384787 - protein, 18 aa, Mycobacterium tuberculosis
GRPRWQCGVAALGSALVG

SEQ ID NO: 1384788 - protein, 18 aa, Mycobacterium tuberculosis
HVIDARFARALRLRLLSK

SEQ ID NO: 1384789 - protein, 19 aa, Mycobacterium tuberculosis
IDQRLKRFGAMAAAMVLYV

SEQ ID NO: 1384790 - protein, 23 aa, Mycobacterium tuberculosis
IELTGQEAFVWIGLHEPDENQMQ

SEQ ID NO: 1384791 - protein, 20 aa, Mycobacterium tuberculosis
IGGLLVEWAGWRWVLLVNVP

SEQ ID NO: 1384792 - protein, 17 aa, Mycobacterium tuberculosis
IKYKVGPTIAWYQDFLR

SEQ ID NO: 1384793 - protein, 20 aa, Mycobacterium tuberculosis
KERRFHIALVGAMMVAALAL

SEQ ID NO: 1384794 - protein, 20 aa, Mycobacterium tuberculosis
KRSESGVGIRGYRDEFLDAT

SEQ ID NO: 1384795 - protein, 19 aa, Mycobacterium tuberculosis
LALATPVVREWLFGTQQQP

SEQ ID NO: 1384796 - protein, 19 aa, Mycobacterium tuberculosis
LCLMPIFPLALWLMNVYAA

SEQ ID NO: 1384797 - protein, 22 aa, Mycobacterium tuberculosis
LDPLLPFPRWHEHAAMVEEPVR

SEQ ID NO: 1384798 - protein, 23 aa, Mycobacterium tuberculosis
LGDWTIFYWGWWISWAPFVGMFI

SEQ ID NO: 1384799 - protein, 18 aa, Mycobacterium tuberculosis
LGFTRLPYFNTLASPCAI

SEQ ID NO: 1384800 - protein, 17 aa, Mycobacterium tuberculosis
LIFAVWVWREDTASDSE

SEQ ID NO: 1384801 - protein, 19 aa, Mycobacterium tuberculosis
LIGLVRWYLGTALFDSIAR

SEQ ID NO: 1384802 - protein, 17 aa, Mycobacterium tuberculosis
LKAFWYHFAIMFEALFI

SEQ ID NO: 1384803 - protein, 23 aa, Mycobacterium tuberculosis
LLQMAFRFWAFRRWVFPDEFARN

SEQ ID NO: 1384804 - protein, 24 aa, Mycobacterium tuberculosis
LPVTWEMSFLYAIVFGGFVAFSNY

SEQ ID NO: 1384805 - protein, 17 aa, Mycobacterium tuberculosis
LQFRGRDALFWVYVATL

SEQ ID NO: 1384806 - protein, 22 aa, Mycobacterium tuberculosis
LQRLPGRCWPVAATATATWAAL

SEQ ID NO: 1384807 - protein, 21 aa, Mycobacterium tuberculosis
LRLLYGIGMGGEWGLGAALSM

SEQ ID NO: 1384808 - protein, 17 aa, Mycobacterium tuberculosis
LRVAGALRNVIADSQRR

SEQ ID NO: 1384809 - protein, 18 aa, Mycobacterium tuberculosis
LWLPTYLAWFVGGMMLAV

SEQ ID NO: 1384810 - protein, 22 aa, Mycobacterium tuberculosis
LYLRLGDWVPVTAFVVMGAGFA

SEQ ID NO: 1384811 - protein, 18 aa, Mycobacterium tuberculosis
MQWRKRRLVITIISTGLI

SEQ ID NO: 1384812 - protein, 22 aa, Mycobacterium tuberculosis
PLGHWEFYMALAYFKLAIIAAG

SEQ ID NO: 1384813 - protein, 17 aa, Mycobacterium tuberculosis
PPCLFKLLTGWNCPACG

SEQ ID NO: 1384814 - protein, 17 aa, Mycobacterium tuberculosis
QLGCVRFALIFGLTAIN

SEQ ID NO: 1384815 - protein, 19 aa, Mycobacterium tuberculosis
RAALELAAFAAFGSAASAT

SEQ ID NO: 1384816 - protein, 20 aa, Mycobacterium tuberculosis
RAKGPLVFDLGICLVLITLP

SEQ ID NO: 1384817 - protein, 19 aa, Mycobacterium tuberculosis
RIAQLRWPVAIAVGPALTY

SEQ ID NO: 1384818 - protein, 17 aa, Mycobacterium tuberculosis
RPRVVTVHILRNSLIPV

SEQ ID NO: 1384819 - protein, 24 aa, Mycobacterium tuberculosis
RRSQLRLGLNVPYLLLVLAFVVFD

SEQ ID NO: 1384820 - protein, 18 aa, Mycobacterium tuberculosis
RSAARPGTWSLFDGGYTF

SEQ ID NO: 1384821 - protein, 17 aa, Mycobacterium tuberculosis
RSWSVRANLHFLWLRLA

SEQ ID NO: 1384822 - protein, 19 aa, Mycobacterium tuberculosis
SALERLRDFAVFKAIGVPT

SEQ ID NO: 1384823 - protein, 22 aa, Mycobacterium tuberculosis
SARPRTRFGAWLGRPMTSFHLI

SEQ ID NO: 1384824 - protein, 17 aa, Mycobacterium tuberculosis
SLVPTLLVSIPFTVLVA

SEQ ID NO: 1384825 - protein, 19 aa, Mycobacterium tuberculosis
SPIPRWLRFVLTSDRAGSA

SEQ ID NO: 1384826 - protein, 19 aa, Mycobacterium tuberculosis
SRIEFAITILLLVILLIIY

SEQ ID NO: 1384827 - protein, 21 aa, Mycobacterium tuberculosis
SRPGEKNMPFWGTSFSAAYVS

SEQ ID NO: 1384828 - protein, 20 aa, Mycobacterium tuberculosis
TPLRRLDLLAGYGTAFSIAA

SEQ ID NO: 1384829 - protein, 17 aa, Mycobacterium tuberculosis
TPPRAVAIITQIASALD

SEQ ID NO: 1384830 - protein, 19 aa, Mycobacterium tuberculosis
TPPVRWRSGRRVHFDLDPL

SEQ ID NO: 1384831 - protein, 17 aa, Mycobacterium tuberculosis
TRLRSGSPILFYPAGAL

SEQ ID NO: 1384832 - protein, 19 aa, Mycobacterium tuberculosis
VAPRIGAWVVAAWLAGIIL

SEQ ID NO: 1384833 - protein, 17 aa, Mycobacterium tuberculosis
VDFAVRICTEITGLVRT

SEQ ID NO: 1384834 - protein, 24 aa, Mycobacterium tuberculosis
VLRWSRNRMAFLAALFFLLALCWA

SEQ ID NO: 1384835 - protein, 25 aa, Mycobacterium tuberculosis
VMVGGLCIAGALGIMRFLAIFGPVH

SEQ ID NO: 1384836 - protein, 26 aa, Mycobacterium tuberculosis
VSPLIRWIIKVPREFINDYLFNFPDT

SEQ ID NO: 1384837 - protein, 17 aa, Mycobacterium tuberculosis
VYIPWSMTVTPISQSDV

SEQ ID NO: 1384838 - protein, 25 aa, Mycobacterium tuberculosis
WHKEYGSACNLVFPIGIIDRPYKHD

SEQ ID NO: 1384839 - protein, 22 aa, Mycobacterium tuberculosis
WLLKRWGEYFAVVATSIFLPLE

SEQ ID NO: 1384840 - protein, 23 aa, Mycobacterium tuberculosis
WWGQPAWSWAVLGLRGRRPVKWN

SEQ ID NO: 1384841 - protein, 18 aa, Mycobacterium tuberculosis
YLPPRLEAFRDRKRANPQ

SEQ ID NO: 1384842 - protein, 21 aa, Mycobacterium tuberculosis
AAEHPELWGGLVDLAINDDLG

SEQ ID NO: 1384843 - protein, 19 aa, Mycobacterium tuberculosis
ACGAYKIGSTWHRTTTPTV

SEQ ID NO: 1384844 - protein, 19 aa, Mycobacterium tuberculosis
ADCGLEWVAVRCALIFGRN

SEQ ID NO: 1384845 - protein, 20 aa, Mycobacterium tuberculosis
ADKPAALWILTRGVHESVAP

SEQ ID NO: 1384846 - protein, 21 aa, Mycobacterium tuberculosis
AEPRLALFTVVSSFALAELGD

SEQ ID NO: 1384847 - protein, 17 aa, Mycobacterium tuberculosis
AGCPECRGAVTELCGVP

SEQ ID NO: 1384848 - protein, 18 aa, Mycobacterium tuberculosis
AICYAELASAVPISGSAY

SEQ ID NO: 1384849 - protein, 17 aa, Mycobacterium tuberculosis
ALASLWLSGPLQLGLGA

SEQ ID NO: 1384850 - protein, 17 aa, Mycobacterium tuberculosis
ALELTWEALEHARIPAS

SEQ ID NO: 1384851 - protein, 24 aa, Mycobacterium tuberculosis
ALSAWRFVTVFGVVGLLADVVYEG

SEQ ID NO: 1384852 - protein, 18 aa, Mycobacterium tuberculosis
ALVLPWLLARAVGAEAAA

SEQ ID NO: 1384853 - protein, 19 aa, Mycobacterium tuberculosis
ARLSLEFQRVSFGYVADRP

SEQ ID NO: 1384854 - protein, 20 aa, Mycobacterium tuberculosis
ASVGLPGFLVGGVVRITRAS

SEQ ID NO: 1384855 - protein, 22 aa, Mycobacterium tuberculosis
ATDLRSPLLLAIVIAVVAVVIM

SEQ ID NO: 1384856 - protein, 19 aa, Mycobacterium tuberculosis
ATLPVQFVAGWPILRGAVQ

SEQ ID NO: 1384857 - protein, 17 aa, Mycobacterium tuberculosis
AVTLSLLALLLIRQLRR

SEQ ID NO: 1384858 - protein, 17 aa, Mycobacterium tuberculosis
AVVAREFGFPCVVDAQG

SEQ ID NO: 1384859 - protein, 19 aa, Mycobacterium tuberculosis
CWWAPRWARRLQTRIGLGE

SEQ ID NO: 1384860 - protein, 17 aa, Mycobacterium tuberculosis
DLARLDGVLSRALATAP

SEQ ID NO: 1384861 - protein, 23 aa, Mycobacterium tuberculosis
ECLIAIPLRRDPLLFPFQPIHVT

SEQ ID NO: 1384862 - protein, 23 aa, Mycobacterium tuberculosis
EGACFRLTLPLVRGHKVTTSPLP

SEQ ID NO: 1384863 - protein, 19 aa, Mycobacterium tuberculosis
EKRPRLTMFDDFGGRIPSD

SEQ ID NO: 1384864 - protein, 18 aa, Mycobacterium tuberculosis
ELPEFSFWAWLAMLFSAG

SEQ ID NO: 1384865 - protein, 18 aa, Mycobacterium tuberculosis
FAVIACRTYRDPIAGLTL

SEQ ID NO: 1384866 - protein, 21 aa, Mycobacterium tuberculosis
GFSVWMLWSIVVVQMTAAAPG

SEQ ID NO: 1384867 - protein, 18 aa, Mycobacterium tuberculosis
GNEIARWAANLNTLAAQT

SEQ ID NO: 1384868 - protein, 18 aa, Mycobacterium tuberculosis
GTFSRYWLAAAFGVTALV

SEQ ID NO: 1384869 - protein, 27 aa, Mycobacterium tuberculosis
IKKGRLKWAWIPGIPLLWDLAVTLTAS

SEQ ID NO: 1384870 - protein, 18 aa, Mycobacterium tuberculosis
IPICWSFRSIFDALDGID

SEQ ID NO: 1384871 - protein, 24 aa, Mycobacterium tuberculosis
ITAIAVVVLLGWSFFYFSDDTRGY

SEQ ID NO: 1384872 - protein, 19 aa, Mycobacterium tuberculosis
IVSLIGWWALSRLLERMRG

SEQ ID NO: 1384873 - protein, 17 aa, Mycobacterium tuberculosis
IWFAVGWAAQEWLKSIL

SEQ ID NO: 1384874 - protein, 18 aa, Mycobacterium tuberculosis
KIRRAQCVELYRQDEFTR

SEQ ID NO: 1384875 - protein, 18 aa, Mycobacterium tuberculosis
LAARFGFLLAIPAVFASG

SEQ ID NO: 1384876 - protein, 17 aa, Mycobacterium tuberculosis
LADRLRRILPFVNRISG

SEQ ID NO: 1384877 - protein, 18 aa, Mycobacterium tuberculosis
LDWVAWRGLGLAADAQLV

SEQ ID NO: 1384878 - protein, 17 aa, Mycobacterium tuberculosis
LIGKCLRPLPNKWKGLL

SEQ ID NO: 1384879 - protein, 21 aa, Mycobacterium tuberculosis
LLANLFLPWGIAGAAPTALDV

SEQ ID NO: 1384880 - protein, 17 aa, Mycobacterium tuberculosis
LLQLRTFPTIAIGGDLA

SEQ ID NO: 1384881 - protein, 17 aa, Mycobacterium tuberculosis
LNSAFSFGGPKCLVKVI

SEQ ID NO: 1384882 - protein, 17 aa, Mycobacterium tuberculosis
LQIDHFWWTAIWAAILL

SEQ ID NO: 1384883 - protein, 18 aa, Mycobacterium tuberculosis
LSAAAGWYVDAEAANAAL

SEQ ID NO: 1384884 - protein, 24 aa, Mycobacterium tuberculosis
LTGMFGRDAWRPAGVVVVGSDSEV

SEQ ID NO: 1384885 - protein, 18 aa, Mycobacterium tuberculosis
LVASAWWLFAWELDNGAG

SEQ ID NO: 1384886 - protein, 20 aa, Mycobacterium tuberculosis
MGLWPPRLWAGLRLGWAAGA

SEQ ID NO: 1384887 - protein, 25 aa, Mycobacterium tuberculosis
NGLRPEPLIALGVLVTWVLVERSIA

SEQ ID NO: 1384888 - protein, 27 aa, Mycobacterium tuberculosis
PLPTEIYWRRRGLALGIAVVVVGIAVA

SEQ ID NO: 1384889 - protein, 20 aa, Mycobacterium tuberculosis
PTGCILAWILVRIINVRSFG

SEQ ID NO: 1384890 - protein, 20 aa, Mycobacterium tuberculosis
PVVRTPRPQLTAAFGGALWA

SEQ ID NO: 1384891 - protein, 17 aa, Mycobacterium tuberculosis
QVHEFGWRIGFAVGGGA

SEQ ID NO: 1384892 - protein, 20 aa, Mycobacterium tuberculosis
RFVRALSAAAGWYVDAEAAN

SEQ ID NO: 1384893 - protein, 24 aa, Mycobacterium tuberculosis
RGLIRLARRVWPDSGWEELGPRPH

SEQ ID NO: 1384894 - protein, 20 aa, Mycobacterium tuberculosis
RGVKEFAPLIGVRKAGLFTS

SEQ ID NO: 1384895 - protein, 21 aa, Mycobacterium tuberculosis
RLFIPRFLFSMGVIGVVAATS

SEQ ID NO: 1384896 - protein, 23 aa, Mycobacterium tuberculosis
RLGDFWGYLAGWGFVVGKTASCA

SEQ ID NO: 1384897 - protein, 21 aa, Mycobacterium tuberculosis
RPQLTAAFGGALWAARRPGDT

SEQ ID NO: 1384898 - protein, 19 aa, Mycobacterium tuberculosis
RSYFYWEHHCFDIPLCSAT

SEQ ID NO: 1384899 - protein, 24 aa, Mycobacterium tuberculosis
RTWLPRVWLALPLGLLALGSSMFF

SEQ ID NO: 1384900 - protein, 17 aa, Mycobacterium tuberculosis
RVRLPRLSTIAMAAAVV

SEQ ID NO: 1384901 - protein, 19 aa, Mycobacterium tuberculosis
RWGRRIARLLPFVGLAGLA

SEQ ID NO: 1384902 - protein, 18 aa, Mycobacterium tuberculosis
RYGGYALAGVSSFGFGGA

SEQ ID NO: 1384903 - protein, 18 aa, Mycobacterium tuberculosis
SALCFVGAVVLLYVDIDR

SEQ ID NO: 1384904 - protein, 18 aa, Mycobacterium tuberculosis
SALERLRDFAVFKAIGTP

SEQ ID NO: 1384905 - protein, 19 aa, Mycobacterium tuberculosis
SGVSFRDHGNWVIGAPDVL

SEQ ID NO: 1384906 - protein, 19 aa, Mycobacterium tuberculosis
SPVFGCLFKGIARGVKEFA

SEQ ID NO: 1384907 - protein, 19 aa, Mycobacterium tuberculosis
TGAGFGRDLRSAMFEHIIT

SEQ ID NO: 1384908 - protein, 17 aa, Mycobacterium tuberculosis
TKLMPWLWVAWFGLGSF

SEQ ID NO: 1384909 - protein, 17 aa, Mycobacterium tuberculosis
TSGPYLRHGQTITTTTV

SEQ ID NO: 1384910 - protein, 26 aa, Mycobacterium tuberculosis
TSVCMFKPPFAWREYLLQCWFVARVS

SEQ ID NO: 1384911 - protein, 19 aa, Mycobacterium tuberculosis
TVVRMFLVPSVMKLLGDDC

SEQ ID NO: 1384912 - protein, 19 aa, Mycobacterium tuberculosis
VATRLCWPDQAKADELQHA

SEQ ID NO: 1384913 - protein, 22 aa, Mycobacterium tuberculosis
VICAITVAWLDRFMGIGGESAL

SEQ ID NO: 1384914 - protein, 22 aa, Mycobacterium tuberculosis
VRLLPGWPIWFAVGWAAQEWLK

SEQ ID NO: 1384915 - protein, 18 aa, Mycobacterium tuberculosis
VRSLPDFWRLLQVRVASQ

SEQ ID NO: 1384916 - protein, 18 aa, Mycobacterium tuberculosis
VSLPLLWWRFRRDDRAAL

SEQ ID NO: 1384917 - protein, 18 aa, Mycobacterium tuberculosis
VYVLPLLLLVGLFVMFSR

SEQ ID NO: 1384918 - protein, 17 aa, Mycobacterium tuberculosis
WAVLAIMGIIWIGMSVA

SEQ ID NO: 1384919 - protein, 17 aa, Mycobacterium tuberculosis
WLLRFLVRHNMYWFVGY

SEQ ID NO: 1384920 - protein, 18 aa, Mycobacterium tuberculosis
WNVFFIFSLCYLFGHYGA

SEQ ID NO: 1384921 - protein, 18 aa, Mycobacterium tuberculosis
YAILCLPVLFAAGMCLLD

SEQ ID NO: 1384922 - protein, 19 aa, Mycobacterium tuberculosis
YTLRYRWWVVLTGVAIAAF

SEQ ID NO: 1384923 - protein, 23 aa, Mycobacterium tuberculosis
YVISSWRPVLLIPLTFALFTPLA

SEQ ID NO: 1384924 - protein, 17 aa, Mycobacterium tuberculosis
AEIPLDIDATLISDGTG

SEQ ID NO: 1384925 - protein, 18 aa, Mycobacterium tuberculosis
APWHVRAGAFAIDVLPGL

SEQ ID NO: 1384926 - protein, 19 aa, Mycobacterium tuberculosis
ARVGEPFGSLVLAVAVTTI

SEQ ID NO: 1384927 - protein, 19 aa, Mycobacterium tuberculosis
AVLGLRGRRPVKWNDPITL

SEQ ID NO: 1384928 - protein, 20 aa, Mycobacterium tuberculosis
AVQAPWPLLRTFAAGPALSR

SEQ ID NO: 1384929 - protein, 20 aa, Mycobacterium tuberculosis
AWLRLCQTYGWAPGVMGASS

SEQ ID NO: 1384930 - protein, 22 aa, Mycobacterium tuberculosis
AWLVLHLVYLVGYRNRIAALFA

SEQ ID NO: 1384931 - protein, 23 aa, Mycobacterium tuberculosis
CERALREHVEWSLLDVLRGAPGA

SEQ ID NO: 1384932 - protein, 22 aa, Mycobacterium tuberculosis
ELPASVPVWLVWHIPGGTVWAE

SEQ ID NO: 1384933 - protein, 21 aa, Mycobacterium tuberculosis
EVVQWKLKPGVVSTMSAQARY

SEQ ID NO: 1384934 - protein, 17 aa, Mycobacterium tuberculosis
FDGQLWIDMDFVDGTDT

SEQ ID NO: 1384935 - protein, 17 aa, Mycobacterium tuberculosis
FFTMWGFFILLTVYIEA

SEQ ID NO: 1384936 - protein, 23 aa, Mycobacterium tuberculosis
FMLREISCIFVAWFVLYLVLVLR

SEQ ID NO: 1384937 - protein, 23 aa, Mycobacterium tuberculosis
FWLRLMLRSAVCFVPHELSVRRH

SEQ ID NO: 1384938 - protein, 27 aa, Mycobacterium tuberculosis
GLVGIGWLWRHGRFRRLARLGGLVLVS

SEQ ID NO: 1384939 - protein, 18 aa, Mycobacterium tuberculosis
GSLWWDIWSLGLLVLIPA

SEQ ID NO: 1384940 - protein, 18 aa, Mycobacterium tuberculosis
GWYYLRIPSLVGIGQYTL

SEQ ID NO: 1384941 - protein, 29 aa, Mycobacterium tuberculosis
GYILASLHWYTWLAFSGWVAVAVIFYLMW

SEQ ID NO: 1384942 - protein, 18 aa, Mycobacterium tuberculosis
KLQNPSWRPGAWACSLVV

SEQ ID NO: 1384943 - protein, 17 aa, Mycobacterium tuberculosis
LAVPVLAYAGWRMFVRR

SEQ ID NO: 1384944 - protein, 26 aa, Mycobacterium tuberculosis
LFGPRLVDIYVDWLWFGEVGFRSVWI

SEQ ID NO: 1384945 - protein, 22 aa, Mycobacterium tuberculosis
LFPDLPSFPGFPGFPEFPAIPG

SEQ ID NO: 1384946 - protein, 17 aa, Mycobacterium tuberculosis
LRLPATFGIGTYGVSAD

SEQ ID NO: 1384947 - protein, 18 aa, Mycobacterium tuberculosis
LSGMAIRIVDVFRITRKV

SEQ ID NO: 1384948 - protein, 21 aa, Mycobacterium tuberculosis
LSGRFCVPVVRTPRPQLTAAF

SEQ ID NO: 1384949 - protein, 19 aa, Mycobacterium tuberculosis
MPSSFSMHGPWVDVAAPAE

SEQ ID NO: 1384950 - protein, 17 aa, Mycobacterium tuberculosis
MTPAAFVRRPGRWIREL

SEQ ID NO: 1384951 - protein, 20 aa, Mycobacterium tuberculosis
PLLLLVGLFVMFSRMQGGAR

SEQ ID NO: 1384952 - protein, 20 aa, Mycobacterium tuberculosis
PRTASIVIWYSRAICDTAAI

SEQ ID NO: 1384953 - protein, 17 aa, Mycobacterium tuberculosis
PTPRPASVITIARPGTS

SEQ ID NO: 1384954 - protein, 18 aa, Mycobacterium tuberculosis
QFFARRIGRNEAFNHAGN

SEQ ID NO: 1384955 - protein, 19 aa, Mycobacterium tuberculosis
QINWKWIRRSLYLTAAVVI

SEQ ID NO: 1384956 - protein, 17 aa, Mycobacterium tuberculosis
QRLPGKYTYAAALREVR

SEQ ID NO: 1384957 - protein, 25 aa, Mycobacterium tuberculosis
RADPGIPARGIVAVCDFGGSGTGIT

SEQ ID NO: 1384958 - protein, 25 aa, Mycobacterium tuberculosis
REIRWNLRVIVMFSIGLVIATAVAV

SEQ ID NO: 1384959 - protein, 19 aa, Mycobacterium tuberculosis
RKAELDAGYILTCQSHPTT

SEQ ID NO: 1384960 - protein, 18 aa, Mycobacterium tuberculosis
RPRRAGVSSFGISGTNAH

SEQ ID NO: 1384961 - protein, 20 aa, Mycobacterium tuberculosis
RRDPLLFPFQPIHVTIAAWF

SEQ ID NO: 1384962 - protein, 18 aa, Mycobacterium tuberculosis
RRGAEVFADVTLPEGVPI

SEQ ID NO: 1384963 - protein, 22 aa, Mycobacterium tuberculosis
RRRLDEYIGFLVAWQRPLAGKK

SEQ ID NO: 1384964 - protein, 17 aa, Mycobacterium tuberculosis
RTNSEILSGIGISLLSP

SEQ ID NO: 1384965 - protein, 17 aa, Mycobacterium tuberculosis
RVRPRPASQMLRPFAPR

SEQ ID NO: 1384966 - protein, 20 aa, Mycobacterium tuberculosis
RVTAVLVCRRLVPAAHGSTL

SEQ ID NO: 1384967 - protein, 28 aa, Mycobacterium tuberculosis
TALEATWKYVVICSVGIAVAFLGTVLLY

SEQ ID NO: 1384968 - protein, 17 aa, Mycobacterium tuberculosis
TGGRTAQAWARRHQQLR

SEQ ID NO: 1384969 - protein, 23 aa, Mycobacterium tuberculosis
TRKRFGDTMGYRLVIYPEYASLD

SEQ ID NO: 1384970 - protein, 17 aa, Mycobacterium tuberculosis
VAGGFALSLLVVVVVVA

SEQ ID NO: 1384971 - protein, 17 aa, Mycobacterium tuberculosis
VIIRFWLLTAITCGLGV

SEQ ID NO: 1384972 - protein, 18 aa, Mycobacterium tuberculosis
VKRALAWVKAHISEYGGD

SEQ ID NO: 1384973 - protein, 17 aa, Mycobacterium tuberculosis
VLACTLVGFAVAVLGDP

SEQ ID NO: 1384974 - protein, 20 aa, Mycobacterium tuberculosis
AQLGLWRWAFGVMTLLTALM

SEQ ID NO: 1384975 - protein, 18 aa, Mycobacterium tuberculosis
ARSFGVLPVGGWALRAIV

SEQ ID NO: 1384976 - protein, 23 aa, Mycobacterium tuberculosis
ASQRLADCIARPLVPSIMIAAAL

SEQ ID NO: 1384977 - protein, 23 aa, Mycobacterium tuberculosis
DALELRGRILGAFEAAEVSTDHA

SEQ ID NO: 1384978 - protein, 19 aa, Mycobacterium tuberculosis
ESGLRPGWHRVPGVSASGS

SEQ ID NO: 1384979 - protein, 23 aa, Mycobacterium tuberculosis
FAEGLQYWPWVLLGYFNIGIMIV

SEQ ID NO: 1384980 - protein, 20 aa, Mycobacterium tuberculosis
FPGKRLLIGAALLITMFPSI

SEQ ID NO: 1384981 - protein, 21 aa, Mycobacterium tuberculosis
FRRIAAALGRPMVPIGSPVLR

SEQ ID NO: 1384982 - protein, 18 aa, Mycobacterium tuberculosis
FSWLRRRSGSLIAPIALH

SEQ ID NO: 1384983 - protein, 17 aa, Mycobacterium tuberculosis
FYWAVGIAIGLPAGLIV

SEQ ID NO: 1384984 - protein, 18 aa, Mycobacterium tuberculosis
GDFFAFYLCDVVLKVNGK

SEQ ID NO: 1384985 - protein, 21 aa, Mycobacterium tuberculosis
GQLRITRWFAVRWGAERSLVV

SEQ ID NO: 1384986 - protein, 18 aa, Mycobacterium tuberculosis
GRIGLLFAVMPFHAFFGI

SEQ ID NO: 1384987 - protein, 19 aa, Mycobacterium tuberculosis
GRWALCLVDGAPLRATQSL

SEQ ID NO: 1384988 - protein, 23 aa, Mycobacterium tuberculosis
HEVGYRLRVRMALDEGRYKIAKL

SEQ ID NO: 1384989 - protein, 18 aa, Mycobacterium tuberculosis
KHCYGIPICWSFRSIFDA

SEQ ID NO: 1384990 - protein, 19 aa, Mycobacterium tuberculosis
KKFTWHWWWLGAAALGVLL

SEQ ID NO: 1384991 - protein, 18 aa, Mycobacterium tuberculosis
LAELLAMRGIDGLPFSWT

SEQ ID NO: 1384992 - protein, 22 aa, Mycobacterium tuberculosis
LEFAGYFAWLAWLVLHLVYLVG

SEQ ID NO: 1384993 - protein, 20 aa, Mycobacterium tuberculosis
LLGDRYGRRRSFVFGVTLFV

SEQ ID NO: 1384994 - protein, 22 aa, Mycobacterium tuberculosis
LLGFRLTCYYYRKAYYRSVWQS

SEQ ID NO: 1384995 - protein, 17 aa, Mycobacterium tuberculosis
LLGTLWLVMRARSSAPA

SEQ ID NO: 1384996 - protein, 18 aa, Mycobacterium tuberculosis
LLLEVAWEALEHAGIPPG

SEQ ID NO: 1384997 - protein, 17 aa, Mycobacterium tuberculosis
LRVYLAWITRTGYTYGA

SEQ ID NO: 1384998 - protein, 17 aa, Mycobacterium tuberculosis
LRWPVAIAVGPALTYGV

SEQ ID NO: 1384999 - protein, 18 aa, Mycobacterium tuberculosis
MATLRIAFLSALVLELLA

SEQ ID NO: 1385000 - protein, 25 aa, Mycobacterium tuberculosis
MIHAFAVPIILGWLAVCVVVTVFVP

SEQ ID NO: 1385001 - protein, 17 aa, Mycobacterium tuberculosis
MLPFSWQGVCLHASGAA

SEQ ID NO: 1385002 - protein, 18 aa, Mycobacterium tuberculosis
MWEALRVAAADGFVQTDG

SEQ ID NO: 1385003 - protein, 18 aa, Mycobacterium tuberculosis
NVVPRPGTSPGVGGTPAS

SEQ ID NO: 1385004 - protein, 29 aa, Mycobacterium tuberculosis
PPILPRLIRRFAVVIVLLWLGFTAFVNLA

SEQ ID NO: 1385005 - protein, 17 aa, Mycobacterium tuberculosis
PRPASVITIARPGTSLS

SEQ ID NO: 1385006 - protein, 19 aa, Mycobacterium tuberculosis
PVVRIKLWLQYVIAGTPRM

SEQ ID NO: 1385007 - protein, 21 aa, Mycobacterium tuberculosis
QATFLRWVWYAARREGLHLDE

SEQ ID NO: 1385008 - protein, 17 aa, Mycobacterium tuberculosis
QWGWARGLGFPALHSID

SEQ ID NO: 1385009 - protein, 18 aa, Mycobacterium tuberculosis
RAVGRSCWRRSPTGCCAP

SEQ ID NO: 1385010 - protein, 29 aa, Mycobacterium tuberculosis
RRPASTQSWFWSRWVGWVMRRPWITALAA

SEQ ID NO: 1385011 - protein, 18 aa, Mycobacterium tuberculosis
SAVPRGWARARKTIVSGN

SEQ ID NO: 1385012 - protein, 24 aa, Mycobacterium tuberculosis
SDHDLRLIIAMTVCIVLLILIVLL

SEQ ID NO: 1385013 - protein, 19 aa, Mycobacterium tuberculosis
SLNRGWCLIRTRWGRRIAR

SEQ ID NO: 1385014 - protein, 22 aa, Mycobacterium tuberculosis
SMLGDLPWWVTVLILTRELGVT

SEQ ID NO: 1385015 - protein, 17 aa, Mycobacterium tuberculosis
TESRFTLIYGNRTKEST

SEQ ID NO: 1385016 - protein, 18 aa, Mycobacterium tuberculosis
TGNLVTWWTGDALLVFDA

SEQ ID NO: 1385017 - protein, 17 aa, Mycobacterium tuberculosis
VAAWAYPLWPVVLGLKA

SEQ ID NO: 1385018 - protein, 26 aa, Mycobacterium tuberculosis
VAMPWLFLRLRFCRRKWTVTTLAATP

SEQ ID NO: 1385019 - protein, 17 aa, Mycobacterium tuberculosis
VAVAFVWLGMVVAISFL

SEQ ID NO: 1385020 - protein, 18 aa, Mycobacterium tuberculosis
VAYWLDRYELLSSGRKEP

SEQ ID NO: 1385021 - protein, 18 aa, Mycobacterium tuberculosis
VKLNMVWAFGYNIAAIPV

SEQ ID NO: 1385022 - protein, 22 aa, Mycobacterium tuberculosis
VVAYRTWRWWLATAVAFFAVVV

SEQ ID NO: 1385023 - protein, 17 aa, Mycobacterium tuberculosis
VVMVAGVILWRFFGDAL

SEQ ID NO: 1385024 - protein, 24 aa, Mycobacterium tuberculosis
VVPGDCWLDWGMNIGRHCFSDYAM

SEQ ID NO: 1385025 - protein, 17 aa, Mycobacterium tuberculosis
VVVAARLDRAALAGAGA

SEQ ID NO: 1385026 - protein, 19 aa, Mycobacterium tuberculosis
VYVVFRWFFARDLRVVPDR

SEQ ID NO: 1385027 - protein, 25 aa, Mycobacterium tuberculosis
WGNCTIKVMVGFLFLYPAFVAKAHE

SEQ ID NO: 1385028 - protein, 20 aa, Mycobacterium tuberculosis
WLLHDWRDVFWINVPLTAIA

SEQ ID NO: 1385029 - protein, 20 aa, Mycobacterium tuberculosis
WRSRHWQRRWLPTAAAIGAT

SEQ ID NO: 1385030 - protein, 18 aa, Mycobacterium tuberculosis
WVTQRLWWAVLLTVGFWG

SEQ ID NO: 1385031 - protein, 18 aa, Mycobacterium tuberculosis
YRVIGGLVLSFGMVTLLG

SEQ ID NO: 1385032 - protein, 19 aa, Mycobacterium tuberculosis
ADDVARSFADAGLDSVLSA

SEQ ID NO: 1385033 - protein, 23 aa, Mycobacterium tuberculosis
AGNLRAAIELPLAATIGLAALGG

SEQ ID NO: 1385034 - protein, 22 aa, Mycobacterium tuberculosis
AGPQLPGPVPIPGAPGPMPAPP

SEQ ID NO: 1385035 - protein, 19 aa, Mycobacterium tuberculosis
ARSLLGLAVGWLVGALVVL

SEQ ID NO: 1385036 - protein, 21 aa, Mycobacterium tuberculosis
DFLELLRYLAVELLPGPLGDL

SEQ ID NO: 1385037 - protein, 23 aa, Mycobacterium tuberculosis
EIRKRWDRYAAFAEKTFNVTIPA

SEQ ID NO: 1385038 - protein, 18 aa, Mycobacterium tuberculosis
ELGEILGFGGMSEVHLAR

SEQ ID NO: 1385039 - protein, 19 aa, Mycobacterium tuberculosis
ESYSLPLRRLLGLVAAGLD

SEQ ID NO: 1385040 - protein, 30 aa, Mycobacterium tuberculosis
FGAFYKRSWRANDWMWGRLDGAGWLVHVLL

SEQ ID NO: 1385041 - protein, 17 aa, Mycobacterium tuberculosis
FLWILSVAFASMIALAT

SEQ ID NO: 1385042 - protein, 19 aa, Mycobacterium tuberculosis
FSVFGVFWGAFGLVTGAAN

SEQ ID NO: 1385043 - protein, 18 aa, Mycobacterium tuberculosis
FTQRLAAAANAFVNAEAT

SEQ ID NO: 1385044 - protein, 23 aa, Mycobacterium tuberculosis
FVVGRLAGRHGIRVGLRGPVTGE

SEQ ID NO: 1385045 - protein, 17 aa, Mycobacterium tuberculosis
GARLRWAPAQGPSATPA

SEQ ID NO: 1385046 - protein, 17 aa, Mycobacterium tuberculosis
HHFGAFYKRSWRANDWM

SEQ ID NO: 1385047 - protein, 18 aa, Mycobacterium tuberculosis
ILPVLPVIFFSGAQSVDA

SEQ ID NO: 1385048 - protein, 17 aa, Mycobacterium tuberculosis
IMIAVFCGFAFAGMPLV

SEQ ID NO: 1385049 - protein, 19 aa, Mycobacterium tuberculosis
KRGALMFGKLVPMGIGAII

SEQ ID NO: 1385050 - protein, 17 aa, Mycobacterium tuberculosis
LDWKSVWDHGWSAAAEA

SEQ ID NO: 1385051 - protein, 17 aa, Mycobacterium tuberculosis
LGGWLIGAYGWRWIFLV

SEQ ID NO: 1385052 - protein, 17 aa, Mycobacterium tuberculosis
LHVPFLPVPIPVPIPQN

SEQ ID NO: 1385053 - protein, 19 aa, Mycobacterium tuberculosis
LLLEVSWEALERAGIDPIT

SEQ ID NO: 1385054 - protein, 17 aa, Mycobacterium tuberculosis
LLLVVGVSLAYLYVVLL

SEQ ID NO: 1385055 - protein, 18 aa, Mycobacterium tuberculosis
LSVIRLALIPAFVYVVLS

SEQ ID NO: 1385056 - protein, 24 aa, Mycobacterium tuberculosis
MHVTGRWNWWAPRPLAWLHERFGV

SEQ ID NO: 1385057 - protein, 23 aa, Mycobacterium tuberculosis
NRVMKRPVLFAAPIVIIMILLII

SEQ ID NO: 1385058 - protein, 24 aa, Mycobacterium tuberculosis
NYFGDACVWWGLWLITINDWAPLA

SEQ ID NO: 1385059 - protein, 23 aa, Mycobacterium tuberculosis
PNSKFTISMLWPGDRAWRQAGER

SEQ ID NO: 1385060 - protein, 19 aa, Mycobacterium tuberculosis
PRPPFDYMQQVYDRYIAPH

SEQ ID NO: 1385061 - protein, 17 aa, Mycobacterium tuberculosis
PRWARAVGRSCWRRSPT

SEQ ID NO: 1385062 - protein, 19 aa, Mycobacterium tuberculosis
RSGAEWMPNFIELLQRKLS

SEQ ID NO: 1385063 - protein, 26 aa, Mycobacterium tuberculosis
SPRYLRFGWAAARLDDWANYVGARAT

SEQ ID NO: 1385064 - protein, 18 aa, Mycobacterium tuberculosis
VGFIPFVIAMGIGLGVSS

SEQ ID NO: 1385065 - protein, 19 aa, Mycobacterium tuberculosis
VLLFCIAFGLSMDYEVFLV

SEQ ID NO: 1385066 - protein, 24 aa, Mycobacterium tuberculosis
VSLAGSGWCGWVLFEKHQTDVAAG

SEQ ID NO: 1385067 - protein, 17 aa, Mycobacterium tuberculosis
WGLVFTAGCLLWGLVTA

SEQ ID NO: 1385068 - protein, 20 aa, Mycobacterium tuberculosis
YKVGPTIAWYQDFLRYYFLT

SEQ ID NO: 1385069 - protein, 18 aa, Mycobacterium tuberculosis
YMLWLYQRVMTGPVAEGN

SEQ ID NO: 1385070 - protein, 17 aa, Mycobacterium tuberculosis
YRGGPVLADNAVIPVER

SEQ ID NO: 1385071 - protein, 20 aa, Mycobacterium tuberculosis
YSEPRLQPPNGYKDTTVPGI

SEQ ID NO: 1385072 - protein, 17 aa, Mycobacterium tuberculosis
ACPVWFYQLWAFITPGL

SEQ ID NO: 1385073 - protein, 22 aa, Mycobacterium tuberculosis
ALFFPWNLYFGFRIPDSSKTVF

SEQ ID NO: 1385074 - protein, 17 aa, Mycobacterium tuberculosis
ALFPMYFLKSFAYAGVA

SEQ ID NO: 1385075 - protein, 18 aa, Mycobacterium tuberculosis
APLLRPGYLLLRDAVSTP

SEQ ID NO: 1385076 - protein, 19 aa, Mycobacterium tuberculosis
ATGCLRVRASITISPDDLV

SEQ ID NO: 1385077 - protein, 19 aa, Mycobacterium tuberculosis
CPQTRITGVPGRGPETRTA

SEQ ID NO: 1385078 - protein, 17 aa, Mycobacterium tuberculosis
FGAWLGRPMTSFHLIIA

SEQ ID NO: 1385079 - protein, 17 aa, Mycobacterium tuberculosis
FPADRGWDVAGLFDPDP

SEQ ID NO: 1385080 - protein, 17 aa, Mycobacterium tuberculosis
FPMYFLKSFAYAGVATV

SEQ ID NO: 1385081 - protein, 19 aa, Mycobacterium tuberculosis
GLARIWPPWEFYFWHHTIP

SEQ ID NO: 1385082 - protein, 19 aa, Mycobacterium tuberculosis
IAVSLIVYVFFIKNKADTY

SEQ ID NO: 1385083 - protein, 17 aa, Mycobacterium tuberculosis
IGAWVVAAWLAGIILNL

SEQ ID NO: 1385084 - protein, 19 aa, Mycobacterium tuberculosis
ILLAGLVGMCSFQLGGTKR

SEQ ID NO: 1385085 - protein, 21 aa, Mycobacterium tuberculosis
IRWRLTLVFSAAMALVLAAAG

SEQ ID NO: 1385086 - protein, 17 aa, Mycobacterium tuberculosis
ITPLRIAFLILLVGTTL

SEQ ID NO: 1385087 - protein, 23 aa, Mycobacterium tuberculosis
ITPSEAFTAWEFVDGYDVAQAVV

SEQ ID NO: 1385088 - protein, 18 aa, Mycobacterium tuberculosis
KHFRCVSVDLLARRPVVH

SEQ ID NO: 1385089 - protein, 17 aa, Mycobacterium tuberculosis
KLGIVWLVLSVFTVMII

SEQ ID NO: 1385090 - protein, 21 aa, Mycobacterium tuberculosis
LAVAVLARWRFRRRPAPARLP

SEQ ID NO: 1385091 - protein, 19 aa, Mycobacterium tuberculosis
LFRVPELLAGSFLLALLAV

SEQ ID NO: 1385092 - protein, 18 aa, Mycobacterium tuberculosis
LGWYFLRIPSLVGIGRYT

SEQ ID NO: 1385093 - protein, 18 aa, Mycobacterium tuberculosis
LLGVPGWVTQRLWWAVLL

SEQ ID NO: 1385094 - protein, 23 aa, Mycobacterium tuberculosis
LLSELPAVAWVWFQLFVDILGFN

SEQ ID NO: 1385095 - protein, 17 aa, Mycobacterium tuberculosis
LMRAIICQLAFSHGPDH

SEQ ID NO: 1385096 - protein, 23 aa, Mycobacterium tuberculosis
LPGSAPRPAWLRAFAHPERDKRV

SEQ ID NO: 1385097 - protein, 19 aa, Mycobacterium tuberculosis
LSYFARNRCSLLRVELQEH

SEQ ID NO: 1385098 - protein, 18 aa, Mycobacterium tuberculosis
LVTILPIVLVIAAVAAYL

SEQ ID NO: 1385099 - protein, 21 aa, Mycobacterium tuberculosis
LVVVTCVMWTLALTRPPDVRE

SEQ ID NO: 1385100 - protein, 21 aa, Mycobacterium tuberculosis
MMHLLRLARSFGVLPVGGWAL

SEQ ID NO: 1385101 - protein, 21 aa, Mycobacterium tuberculosis
NRLWWRYTAWWLLAMALATLW

SEQ ID NO: 1385102 - protein, 23 aa, Mycobacterium tuberculosis
PAPGGSWPTAWLVALVVLACVAA

SEQ ID NO: 1385103 - protein, 18 aa, Mycobacterium tuberculosis
PLPSGTYCKIPQDAQLQV

SEQ ID NO: 1385104 - protein, 20 aa, Mycobacterium tuberculosis
PPCMTGFLPPPLVRSPADES

SEQ ID NO: 1385105 - protein, 20 aa, Mycobacterium tuberculosis
PSAYDLGTVIGFYGLTIDEP

SEQ ID NO: 1385106 - protein, 17 aa, Mycobacterium tuberculosis
PTTGAGWTGRLSLPVSS

SEQ ID NO: 1385107 - protein, 18 aa, Mycobacterium tuberculosis
PVSHMWVVKFLRTHGLIH

SEQ ID NO: 1385108 - protein, 25 aa, Mycobacterium tuberculosis
QDGILTIVGFAWRGDHVQILDSLPE

SEQ ID NO: 1385109 - protein, 17 aa, Mycobacterium tuberculosis
RAPHAGGREVLRVEVGA

SEQ ID NO: 1385110 - protein, 19 aa, Mycobacterium tuberculosis
RFEKAWPLLWFVVIGLIAA

SEQ ID NO: 1385111 - protein, 23 aa, Mycobacterium tuberculosis
RLYAERWCAWALLAATVAIPTGL

SEQ ID NO: 1385112 - protein, 28 aa, Mycobacterium tuberculosis
RSLTRSAWRLGMFANRWIILGVSAQAIA

SEQ ID NO: 1385113 - protein, 20 aa, Mycobacterium tuberculosis
RTMALRGARCCFRRSPWRCR

SEQ ID NO: 1385114 - protein, 19 aa, Mycobacterium tuberculosis
SRQSWPAATGVTLVGTNPA

SEQ ID NO: 1385115 - protein, 25 aa, Mycobacterium tuberculosis
SSEIAIAVPAHWKPGAVHALRNGLR

SEQ ID NO: 1385116 - protein, 23 aa, Mycobacterium tuberculosis
TWLGRFVSTYGWRAYALPVLMVL

SEQ ID NO: 1385117 - protein, 20 aa, Mycobacterium tuberculosis
VDGLGWRSVFLVNVPLGAIV

SEQ ID NO: 1385118 - protein, 17 aa, Mycobacterium tuberculosis
YAARSQLWLSLLSWAVV

SEQ ID NO: 1385119 - protein, 17 aa, Mycobacterium tuberculosis
YGRRRSFVFGVTLFVVS

SEQ ID NO: 1385120 - protein, 22 aa, Mycobacterium tuberculosis
YWYRSIRQPVQFERAVRNAFDG

SEQ ID NO: 1385121 - protein, 20 aa, Mycobacterium tuberculosis
AGNRPRLVWYAPDHIEGEMS

SEQ ID NO: 1385122 - protein, 21 aa, Mycobacterium tuberculosis
AILTLTGRRGWIKPRRDLTSR

SEQ ID NO: 1385123 - protein, 20 aa, Mycobacterium tuberculosis
APQWVRWALFLACYATGGWE

SEQ ID NO: 1385124 - protein, 19 aa, Mycobacterium tuberculosis
ARLDGVLSRALATAPADRF

SEQ ID NO: 1385125 - protein, 20 aa, Mycobacterium tuberculosis
ESAHFLRALLVAVVAALAAG

SEQ ID NO: 1385126 - protein, 17 aa, Mycobacterium tuberculosis
FGDFRFGPTTVYHATFT

SEQ ID NO: 1385127 - protein, 24 aa, Mycobacterium tuberculosis
GEDYLRLSALGSYGAFFNIYFCSV

SEQ ID NO: 1385128 - protein, 23 aa, Mycobacterium tuberculosis
GGGRLAPRPVFRPPVDPASRQAF

SEQ ID NO: 1385129 - protein, 19 aa, Mycobacterium tuberculosis
GLGIALAHPWRSSGPRTSA

SEQ ID NO: 1385130 - protein, 22 aa, Mycobacterium tuberculosis
GSALALAGVSAWLITRAWQMPP

SEQ ID NO: 1385131 - protein, 18 aa, Mycobacterium tuberculosis
HGKWPWQMTHPMDGAVQI

SEQ ID NO: 1385132 - protein, 18 aa, Mycobacterium tuberculosis
KFGAWLLFAGLWATFVYF

SEQ ID NO: 1385133 - protein, 22 aa, Mycobacterium tuberculosis
LAMALTCWWVISREVIPRLGHA

SEQ ID NO: 1385134 - protein, 23 aa, Mycobacterium tuberculosis
LANWKISAAYLNWLADRLQRTKT

SEQ ID NO: 1385135 - protein, 17 aa, Mycobacterium tuberculosis
LDALGFAGTIPKSAPGS

SEQ ID NO: 1385136 - protein, 17 aa, Mycobacterium tuberculosis
LILGFWAPGFFVTTKLD

SEQ ID NO: 1385137 - protein, 18 aa, Mycobacterium tuberculosis
LLPVLWIFSLSLKPTSTV

SEQ ID NO: 1385138 - protein, 19 aa, Mycobacterium tuberculosis
LNGLRLLRHTAWRRAAGTA

SEQ ID NO: 1385139 - protein, 17 aa, Mycobacterium tuberculosis
LPATFGIGTYGVSADFV

SEQ ID NO: 1385140 - protein, 23 aa, Mycobacterium tuberculosis
NLKLLMPVFRWQRRDNLLTEPDP

SEQ ID NO: 1385141 - protein, 21 aa, Mycobacterium tuberculosis
NRLLTRWARDYITVIGAIVLP

SEQ ID NO: 1385142 - protein, 18 aa, Mycobacterium tuberculosis
QFIRWLFRFLVGQVDRIA

SEQ ID NO: 1385143 - protein, 20 aa, Mycobacterium tuberculosis
RDDLRWPPASALVSQDEAVA

SEQ ID NO: 1385144 - protein, 20 aa, Mycobacterium tuberculosis
RPTVVTGLRLAASRSMLPAH

SEQ ID NO: 1385145 - protein, 20 aa, Mycobacterium tuberculosis
RRRNPRPAIVVVAFLVVVTC

SEQ ID NO: 1385146 - protein, 18 aa, Mycobacterium tuberculosis
RRVAIALGVLVAAAGIVI

SEQ ID NO: 1385147 - protein, 21 aa, Mycobacterium tuberculosis
SELMFFAGLFAFYFSARAQAG

SEQ ID NO: 1385148 - protein, 20 aa, Mycobacterium tuberculosis
SIGSVGRWVAVVAVLAVLTV

SEQ ID NO: 1385149 - protein, 17 aa, Mycobacterium tuberculosis
SVVIGSLVVVLALAAGI

SEQ ID NO: 1385150 - protein, 18 aa, Mycobacterium tuberculosis
TGFARIVLLAAILGAALA

SEQ ID NO: 1385151 - protein, 19 aa, Mycobacterium tuberculosis
VLCCIGSIVGIVFGAIAIN

SEQ ID NO: 1385152 - protein, 18 aa, Mycobacterium tuberculosis
VVRLGVFLAVCLLTAFLL

SEQ ID NO: 1385153 - protein, 18 aa, Mycobacterium tuberculosis
WAASLLWYLKVVGSQPDF

SEQ ID NO: 1385154 - protein, 17 aa, Mycobacterium tuberculosis
WQSSWLRYAPLSFSGLV

SEQ ID NO: 1385155 - protein, 17 aa, Mycobacterium tuberculosis
WSLPLGVAILLAAVGGG

SEQ ID NO: 1385156 - protein, 19 aa, Mycobacterium tuberculosis
YAPLWRTAWRRLRQRPFQY

SEQ ID NO: 1385157 - protein, 18 aa, Mycobacterium tuberculosis
AELCAQYLAPVLDAIKFN

SEQ ID NO: 1385158 - protein, 19 aa, Mycobacterium tuberculosis
AQRWKAIRGEAGWMTTYAY

SEQ ID NO: 1385159 - protein, 17 aa, Mycobacterium tuberculosis
ATIGTWVRMVINYLVPF

SEQ ID NO: 1385160 - protein, 22 aa, Mycobacterium tuberculosis
DQRVLGAALWYAATVKDAVIVA

SEQ ID NO: 1385161 - protein, 19 aa, Mycobacterium tuberculosis
EMFFRGALYTALGRRYPVT

SEQ ID NO: 1385162 - protein, 35 aa, Mycobacterium tuberculosis
FDPKRLLKVRGWRRVGTVVVRWPLPVLVATCAIAL

SEQ ID NO: 1385163 - protein, 17 aa, Mycobacterium tuberculosis
FGALWLLYRYYRTGDPL

SEQ ID NO: 1385164 - protein, 24 aa, Mycobacterium tuberculosis
FLANWKISAAYLNWLADRLQRTKT

SEQ ID NO: 1385165 - protein, 20 aa, Mycobacterium tuberculosis
HAAVWWKALLALAVAVALVI

SEQ ID NO: 1385166 - protein, 22 aa, Mycobacterium tuberculosis
IGLFDTWPGLILPYITFALPLA

SEQ ID NO: 1385167 - protein, 26 aa, Mycobacterium tuberculosis
IPVPIIIPPFPGWQPGMPTIPTAPPT

SEQ ID NO: 1385168 - protein, 23 aa, Mycobacterium tuberculosis
IRNWPAWLGVYGFMTLDRWLLFN

SEQ ID NO: 1385169 - protein, 26 aa, Mycobacterium tuberculosis
LALTELWCSYGVRPDLVIGHSMGEVA

SEQ ID NO: 1385170 - protein, 17 aa, Mycobacterium tuberculosis
LAMALATLWWVMALTQL

SEQ ID NO: 1385171 - protein, 17 aa, Mycobacterium tuberculosis
LDNKRLWSNLDCAPSNE

SEQ ID NO: 1385172 - protein, 17 aa, Mycobacterium tuberculosis
LIWQHFVGLQVHWTIVA

SEQ ID NO: 1385173 - protein, 19 aa, Mycobacterium tuberculosis
LRPSWLPKLMAHGGGTTAE

SEQ ID NO: 1385174 - protein, 18 aa, Mycobacterium tuberculosis
LSQLPVLRWVDNSGNRAN

SEQ ID NO: 1385175 - protein, 17 aa, Mycobacterium tuberculosis
LWSAIGLVPQRSYLFSG

SEQ ID NO: 1385176 - protein, 22 aa, Mycobacterium tuberculosis
PEKMPRPPWRHETHNYIRSGPG

SEQ ID NO: 1385177 - protein, 19 aa, Mycobacterium tuberculosis
PEVPSAWLSTGMGPGPLLA

SEQ ID NO: 1385178 - protein, 18 aa, Mycobacterium tuberculosis
PILAGLCMLMLGLLMLIF

SEQ ID NO: 1385179 - protein, 17 aa, Mycobacterium tuberculosis
PQQRLLLEVAWEALEHA

SEQ ID NO: 1385180 - protein, 17 aa, Mycobacterium tuberculosis
PTWSRPGWRHLKHFNGY

SEQ ID NO: 1385181 - protein, 20 aa, Mycobacterium tuberculosis
QADRAVVVAARLDRAALAGA

SEQ ID NO: 1385182 - protein, 19 aa, Mycobacterium tuberculosis
RLWPTVGCLVGYGIAFALL

SEQ ID NO: 1385183 - protein, 18 aa, Mycobacterium tuberculosis
RRELSQLPVLRWVDNSGN

SEQ ID NO: 1385184 - protein, 21 aa, Mycobacterium tuberculosis
TALCLFTAVFIMLRRKRIPSV

SEQ ID NO: 1385185 - protein, 18 aa, Mycobacterium tuberculosis
TESRWRLGLYAAGRASQI

SEQ ID NO: 1385186 - protein, 19 aa, Mycobacterium tuberculosis
VDTLSLFVGWLWPLWDSRR

SEQ ID NO: 1385187 - protein, 18 aa, Mycobacterium tuberculosis
VSIPRAMFWTVLVYVFVA

SEQ ID NO: 1385188 - protein, 17 aa, Mycobacterium tuberculosis
WPPASALVSQDEAVAAL

SEQ ID NO: 1385189 - protein, 18 aa, Mycobacterium tuberculosis
AATIGTWVRMVINYLVPF

SEQ ID NO: 1385190 - protein, 21 aa, Mycobacterium tuberculosis
ATALFPMYFLKSFAYAGVATV

SEQ ID NO: 1385191 - protein, 20 aa, Mycobacterium tuberculosis
CIAVSLIVYVFFIKNKADTY

SEQ ID NO: 1385192 - protein, 23 aa, Mycobacterium tuberculosis
DRNRAHWDWLKWLPHNQHPNACD

SEQ ID NO: 1385193 - protein, 20 aa, Mycobacterium tuberculosis
DVCIILGVLIAYVFSLLGYD

SEQ ID NO: 1385194 - protein, 17 aa, Mycobacterium tuberculosis
GAGALGFVGTAGKESVG

SEQ ID NO: 1385195 - protein, 17 aa, Mycobacterium tuberculosis
GSPYAVEYVWGRQVGDN

SEQ ID NO: 1385196 - protein, 18 aa, Mycobacterium tuberculosis
HRYAIWIVGVWALAAIIG

SEQ ID NO: 1385197 - protein, 23 aa, Mycobacterium tuberculosis
IAVLLGRWFWWPQRVRPRPASRM

SEQ ID NO: 1385198 - protein, 18 aa, Mycobacterium tuberculosis
ITPLRIAFLILLVGTTLE

SEQ ID NO: 1385199 - protein, 21 aa, Mycobacterium tuberculosis
LAGNRPRLVWYAPDHIEGEMS

SEQ ID NO: 1385200 - protein, 21 aa, Mycobacterium tuberculosis
LAMALTCWWVISREVIPRLGH

SEQ ID NO: 1385201 - protein, 27 aa, Mycobacterium tuberculosis
LGVFLAVCLLTAFLLIAVFGEVRFGDG

SEQ ID NO: 1385202 - protein, 21 aa, Mycobacterium tuberculosis
LNEGRGDFFAVVRSLALFVNA

SEQ ID NO: 1385203 - protein, 18 aa, Mycobacterium tuberculosis
MFFRGALYTALGRRYPVT

SEQ ID NO: 1385204 - protein, 18 aa, Mycobacterium tuberculosis
PAALPWYYSWPLAVAAPL

SEQ ID NO: 1385205 - protein, 18 aa, Mycobacterium tuberculosis
PAKWSYYYLYVILDIFSR

SEQ ID NO: 1385206 - protein, 17 aa, Mycobacterium tuberculosis
PILAGLCMLMLGLLMLI

SEQ ID NO: 1385207 - protein, 18 aa, Mycobacterium tuberculosis
QRPPWGVPPPGWDGSSRP

SEQ ID NO: 1385208 - protein, 19 aa, Mycobacterium tuberculosis
RSPGRWSLVAALALAVVSL

SEQ ID NO: 1385209 - protein, 20 aa, Mycobacterium tuberculosis
SALLCPLLVYGWLGLPRWGL

SEQ ID NO: 1385210 - protein, 21 aa, Mycobacterium tuberculosis
SALLCPLLVYGWLGLPRWGLT

SEQ ID NO: 1385211 - protein, 24 aa, Mycobacterium tuberculosis
SIAVLLGRWFWWPQRVRPRPASRM

SEQ ID NO: 1385212 - protein, 21 aa, Mycobacterium tuberculosis
VDGLGWRSVFLVNVPLGAIVW

SEQ ID NO: 1385213 - protein, 17 aa, Mycobacterium tuberculosis
WWTSVWFLSFWVTGTSI

SEQ ID NO: 1385214 - protein, 17 aa, Mycobacterium tuberculosis
YCVLAFILGTYWLTRQT

SEQ ID NO: 1385215 - protein, 17 aa, Mycobacterium tuberculosis
ARLDGVLSRALATAPAD

SEQ ID NO: 1385216 - protein, 19 aa, Mycobacterium tuberculosis
AWWLLAMALATLWWVMALT

SEQ ID NO: 1385217 - protein, 22 aa, Mycobacterium tuberculosis
EIRKRWDRYAAFAEKTFNVTIP

SEQ ID NO: 1385218 - protein, 18 aa, Mycobacterium tuberculosis
EPTWSRPGWRHLKHFNGY

SEQ ID NO: 1385219 - protein, 19 aa, Mycobacterium tuberculosis
FAALRIASYALWPFGRTIV

SEQ ID NO: 1385220 - protein, 19 aa, Mycobacterium tuberculosis
FALSEMRWAALALGLFSAG

SEQ ID NO: 1385221 - protein, 17 aa, Mycobacterium tuberculosis
FGAWLLFAGLWATFVYF

SEQ ID NO: 1385222 - protein, 18 aa, Mycobacterium tuberculosis
FRVPELLAGSFLLALLAV

SEQ ID NO: 1385223 - protein, 18 aa, Mycobacterium tuberculosis
FSVFGVFWGAFGLVTGAA

SEQ ID NO: 1385224 - protein, 19 aa, Mycobacterium tuberculosis
GKLPDAYRIIGRAGGIYGD

SEQ ID NO: 1385225 - protein, 19 aa, Mycobacterium tuberculosis
GPAKWSYYYLYVILDIFSR

SEQ ID NO: 1385226 - protein, 17 aa, Mycobacterium tuberculosis
GPDWRLVLRGGPAEVVL

SEQ ID NO: 1385227 - protein, 20 aa, Mycobacterium tuberculosis
GPGPLLAAARAWHALAAQYT

SEQ ID NO: 1385228 - protein, 17 aa, Mycobacterium tuberculosis
GWLTLWPFLSWLTTHFV

SEQ ID NO: 1385229 - protein, 20 aa, Mycobacterium tuberculosis
HVRAGAFAIDVLPGLAVAAT

SEQ ID NO: 1385230 - protein, 19 aa, Mycobacterium tuberculosis
IGSVGRWVAVVAVLAVLTV

SEQ ID NO: 1385231 - protein, 17 aa, Mycobacterium tuberculosis
LDGVLSRALATAPADRF

SEQ ID NO: 1385232 - protein, 19 aa, Mycobacterium tuberculosis
LDQPRIYFGPVISNTSADY

SEQ ID NO: 1385233 - protein, 18 aa, Mycobacterium tuberculosis
LFVAAYVPYVAWLVQASA

SEQ ID NO: 1385234 - protein, 20 aa, Mycobacterium tuberculosis
LRYLTPWGRQFWRITRAYFV

SEQ ID NO: 1385235 - protein, 21 aa, Mycobacterium tuberculosis
LVDTLSLFVGWLWPLWDSRRR

SEQ ID NO: 1385236 - protein, 17 aa, Mycobacterium tuberculosis
LWWPLAIGILGIAVLVG

SEQ ID NO: 1385237 - protein, 21 aa, Mycobacterium tuberculosis
NSFPKWRWSLTTALLELTVLV

SEQ ID NO: 1385238 - protein, 17 aa, Mycobacterium tuberculosis
PFPSFKNGVGLMLQLPQ

SEQ ID NO: 1385239 - protein, 20 aa, Mycobacterium tuberculosis
PLHLGGICWRGRNQRPVITG

SEQ ID NO: 1385240 - protein, 18 aa, Mycobacterium tuberculosis
PLLLVVGVSLAYLYVVLL

SEQ ID NO: 1385241 - protein, 21 aa, Mycobacterium tuberculosis
QRVLGAALWYAATVKDAVIVA

SEQ ID NO: 1385242 - protein, 18 aa, Mycobacterium tuberculosis
RGALMFGKLVPMGIGAII

SEQ ID NO: 1385243 - protein, 18 aa, Mycobacterium tuberculosis
RLRLPCRTILRVFSRNPL

SEQ ID NO: 1385244 - protein, 17 aa, Mycobacterium tuberculosis
RSRGRRLAITVGVAAAL

SEQ ID NO: 1385245 - protein, 17 aa, Mycobacterium tuberculosis
SALSRAVAVAWRRSLQL

SEQ ID NO: 1385246 - protein, 17 aa, Mycobacterium tuberculosis
VGFIPFVIAMGIGLGVS

SEQ ID NO: 1385247 - protein, 20 aa, Mycobacterium tuberculosis
VLLFCIAFGLSMDYEVFLVS

SEQ ID NO: 1385248 - protein, 18 aa, Mycobacterium tuberculosis
YEPMVRVSLWLSVTAVAV

SEQ ID NO: 1385249 - protein, 25 aa, Mycobacterium tuberculosis
YRIIGRAGGIYGDFFNFYLCDISLK

SEQ ID NO: 1385250 - protein, 17 aa, Mycobacterium tuberculosis
AELCAQYLAPVLDAIKF

SEQ ID NO: 1385251 - protein, 20 aa, Mycobacterium tuberculosis
CLPAVIWWACHRPNRLWWRY

SEQ ID NO: 1385252 - protein, 29 aa, Mycobacterium tuberculosis
CRSLTRSAWRLGMFANRWIILGVSAQAIA

SEQ ID NO: 1385253 - protein, 19 aa, Mycobacterium tuberculosis
EPVSHMWVVKFLRTHGLIH

SEQ ID NO: 1385254 - protein, 18 aa, Mycobacterium tuberculosis
FAALRIASYALWPFGRTI

SEQ ID NO: 1385255 - protein, 17 aa, Mycobacterium tuberculosis
FSWLRRRSGSLIAPIAL

SEQ ID NO: 1385256 - protein, 21 aa, Mycobacterium tuberculosis
GAPQWVRWALFLACYATGGWE

SEQ ID NO: 1385257 - protein, 20 aa, Mycobacterium tuberculosis
GGLGIALAHPWRSSGPRTSA

SEQ ID NO: 1385258 - protein, 17 aa, Mycobacterium tuberculosis
GPGPRWWGLALLAVGGT

SEQ ID NO: 1385259 - protein, 22 aa, Mycobacterium tuberculosis
IAIAVPAHWKPGAVHALRNGLR

SEQ ID NO: 1385260 - protein, 18 aa, Mycobacterium tuberculosis
ILLAGLVGMCSFQLGGTK

SEQ ID NO: 1385261 - protein, 22 aa, Mycobacterium tuberculosis
KDRYQRCVDFARALGHRLGGAG

SEQ ID NO: 1385262 - protein, 23 aa, Mycobacterium tuberculosis
KDRYQRCVDFARALGHRLGGAGD

SEQ ID NO: 1385263 - protein, 19 aa, Mycobacterium tuberculosis
KVGPTIAWYQDFLRYYFLT

SEQ ID NO: 1385264 - protein, 18 aa, Mycobacterium tuberculosis
LDQPRIYFGPVISNTSAD

SEQ ID NO: 1385265 - protein, 18 aa, Mycobacterium tuberculosis
LLGTLWLVMRARSSAPAG

SEQ ID NO: 1385266 - protein, 17 aa, Mycobacterium tuberculosis
LPDFKWPPTPGSPLFPD

SEQ ID NO: 1385267 - protein, 17 aa, Mycobacterium tuberculosis
LRLIPVVPFAAINYAAG

SEQ ID NO: 1385268 - protein, 17 aa, Mycobacterium tuberculosis
MALATLWWVMALTQLHG

SEQ ID NO: 1385269 - protein, 20 aa, Mycobacterium tuberculosis
MMHLLRLARSFGVLPVGGWA

SEQ ID NO: 1385270 - protein, 19 aa, Mycobacterium tuberculosis
MVSTSLAWTGRVAPPGTFG

SEQ ID NO: 1385271 - protein, 22 aa, Mycobacterium tuberculosis
NSFPKWRWSLTTALLELTVLVL

SEQ ID NO: 1385272 - protein, 17 aa, Mycobacterium tuberculosis
PFGSLVLAVAVTTIEVA

SEQ ID NO: 1385273 - protein, 18 aa, Mycobacterium tuberculosis
PGCAPGPDGVRCAASMAL

SEQ ID NO: 1385274 - protein, 17 aa, Mycobacterium tuberculosis
PVIRLPLVLGLAQLLSR

SEQ ID NO: 1385275 - protein, 22 aa, Mycobacterium tuberculosis
RLYAERWCAWALLAATVAIPTG

SEQ ID NO: 1385276 - protein, 19 aa, Mycobacterium tuberculosis
RPGCAPGPDGVRCAASMAL

SEQ ID NO: 1385277 - protein, 29 aa, Mycobacterium tuberculosis
RQFRRLGTHVARWPAPILVASGVFVLIMM

SEQ ID NO: 1385278 - protein, 21 aa, Mycobacterium tuberculosis
RRELSQLPVLRWVDNSGNRAN

SEQ ID NO: 1385279 - protein, 23 aa, Mycobacterium tuberculosis
SDHDLRLIIAMTVCIVLLILIVL

SEQ ID NO: 1385280 - protein, 22 aa, Mycobacterium tuberculosis
SELMFFAGLFAFYFSARAQAGG

SEQ ID NO: 1385281 - protein, 20 aa, Mycobacterium tuberculosis
SLRDLGCRALLMSGRPDEGA

SEQ ID NO: 1385282 - protein, 18 aa, Mycobacterium tuberculosis
SYSLPLRRLLGLVAAGLD

SEQ ID NO: 1385283 - protein, 20 aa, Mycobacterium tuberculosis
TALCLFTAVFIMLRRKRIPS

SEQ ID NO: 1385284 - protein, 17 aa, Mycobacterium tuberculosis
TLPRPTVVTGLRLAASR

SEQ ID NO: 1385285 - protein, 26 aa, Mycobacterium tuberculosis
VLPALMVLLGRWLWWPRRSVSNRQVP

SEQ ID NO: 1385286 - protein, 20 aa, Mycobacterium tuberculosis
VSGMSCAACASRVETKLNKI

SEQ ID NO: 1385287 - protein, 21 aa, Mycobacterium tuberculosis
VSGMSCAACASRVETKLNKIP

SEQ ID NO: 1385288 - protein, 17 aa, Mycobacterium tuberculosis
WEALRVAAADGFVQTDG

SEQ ID NO: 1385289 - protein, 24 aa, Mycobacterium tuberculosis
WGNCTIKVMVGFLFLYPAFVAKAH

SEQ ID NO: 1385290 - protein, 17 aa, Mycobacterium tuberculosis
WWTSGWFLSFWVTGTSI

SEQ ID NO: 1385291 - protein, 17 aa, Mycobacterium tuberculosis
YDLGTVIGFYGLTIDEP

SEQ ID NO: 1385292 - protein, 17 aa, Mycobacterium tuberculosis
YFARNRCSLLRVELQEH

SEQ ID NO: 1385293 - protein, 22 aa, Mycobacterium tuberculosis
YRRLQVRSGYTLFRQGERADHF

SEQ ID NO: 1385294 - protein, 17 aa, Mycobacterium tuberculosis
AALAVAVLARWRFRRRP

SEQ ID NO: 1385295 - protein, 19 aa, Mycobacterium tuberculosis
AAVWWKALLALAVAVALVI

SEQ ID NO: 1385296 - protein, 18 aa, Mycobacterium tuberculosis
ADYLRGFIQERWIIRPKS

SEQ ID NO: 1385297 - protein, 18 aa, Mycobacterium tuberculosis
AGNLRAAIELPLAATIGL

SEQ ID NO: 1385298 - protein, 17 aa, Mycobacterium tuberculosis
AIAAFLWTANWRFVAQN

SEQ ID NO: 1385299 - protein, 22 aa, Mycobacterium tuberculosis
AILTLTGRRGWIKPRRDLTSRM

SEQ ID NO: 1385300 - protein, 18 aa, Mycobacterium tuberculosis
ARVGEPFGSLVLAVAVTT

SEQ ID NO: 1385301 - protein, 17 aa, Mycobacterium tuberculosis
ATLQRLRPRLGVGAGAP

SEQ ID NO: 1385302 - protein, 27 aa, Mycobacterium tuberculosis
AVAMPWLFLRLRFCRRKWTVTTLAATP

SEQ ID NO: 1385303 - protein, 21 aa, Mycobacterium tuberculosis
AWRNLRFPLAWAPPEADVARI

SEQ ID NO: 1385304 - protein, 19 aa, Mycobacterium tuberculosis
ESAHFLRALLVAVVAALAA

SEQ ID NO: 1385305 - protein, 18 aa, Mycobacterium tuberculosis
ETESRFTLIYGNRTKEST

SEQ ID NO: 1385306 - protein, 17 aa, Mycobacterium tuberculosis
FGEACLLGGMRRIATVR

SEQ ID NO: 1385307 - protein, 17 aa, Mycobacterium tuberculosis
FVAAYVPYVAWLVQASA

SEQ ID NO: 1385308 - protein, 21 aa, Mycobacterium tuberculosis
FWLRLMLRSAVCFVPHELSVR

SEQ ID NO: 1385309 - protein, 21 aa, Mycobacterium tuberculosis
GLFDTWPGLILPYITFALPLA

SEQ ID NO: 1385310 - protein, 26 aa, Mycobacterium tuberculosis
GLVGIGWLWRHGRFRRLARLGGLVLV

SEQ ID NO: 1385311 - protein, 17 aa, Mycobacterium tuberculosis
GTFINLRCVCLAPPYAS

SEQ ID NO: 1385312 - protein, 19 aa, Mycobacterium tuberculosis
HVRAGAFAIDVLPGLAVAA

SEQ ID NO: 1385313 - protein, 24 aa, Mycobacterium tuberculosis
IHAFAVPIILGWLAVCVVVTVFVP

SEQ ID NO: 1385314 - protein, 20 aa, Mycobacterium tuberculosis
LATGCLRVRASITISPDDLV

SEQ ID NO: 1385315 - protein, 19 aa, Mycobacterium tuberculosis
LHLGGICWRGRNQRPVITG

SEQ ID NO: 1385316 - protein, 17 aa, Mycobacterium tuberculosis
LIALLGPVLADRPAFTG

SEQ ID NO: 1385317 - protein, 21 aa, Mycobacterium tuberculosis
LPLLLLVGLFVMFSRMQGGAR

SEQ ID NO: 1385318 - protein, 20 aa, Mycobacterium tuberculosis
LRAAIELPLAATIGLAALGG

SEQ ID NO: 1385319 - protein, 18 aa, Mycobacterium tuberculosis
LRPSWLPKLMAHGGGTTA

SEQ ID NO: 1385320 - protein, 17 aa, Mycobacterium tuberculosis
LSGIGISLLSPLALATN

SEQ ID NO: 1385321 - protein, 17 aa, Mycobacterium tuberculosis
MATLRIAFLSALVLELL

SEQ ID NO: 1385322 - protein, 20 aa, Mycobacterium tuberculosis
MKRPVLFAAPIVIIMILLII

SEQ ID NO: 1385323 - protein, 21 aa, Mycobacterium tuberculosis
MLGDLPWWVTVLILTRELGVT

SEQ ID NO: 1385324 - protein, 23 aa, Mycobacterium tuberculosis
PAWRNLRFPLAWAPPEADVARIV

SEQ ID NO: 1385325 - protein, 18 aa, Mycobacterium tuberculosis
PCMTGFLPPPLVRSPADE

SEQ ID NO: 1385326 - protein, 20 aa, Mycobacterium tuberculosis
PPRRLRMLLSVAVVVLTLDI

SEQ ID NO: 1385327 - protein, 18 aa, Mycobacterium tuberculosis
PSAYDLGTVIGFYGLTID

SEQ ID NO: 1385328 - protein, 17 aa, Mycobacterium tuberculosis
QFGEGWWTSGWFLSFWV

SEQ ID NO: 1385329 - protein, 20 aa, Mycobacterium tuberculosis
RFEKAWPLLWFVVIGLIAAA

SEQ ID NO: 1385330 - protein, 17 aa, Mycobacterium tuberculosis
TESRWRLGLYAAGRASQ

SEQ ID NO: 1385331 - protein, 17 aa, Mycobacterium tuberculosis
VIVMFSIGLVIATAVAV

SEQ ID NO: 1385332 - protein, 17 aa, Mycobacterium tuberculosis
VLVTWVLVERSIALGRL

SEQ ID NO: 1385333 - protein, 23 aa, Mycobacterium tuberculosis
VVAYRTWRWWLATAVAFFAVVVL

SEQ ID NO: 1385334 - protein, 17 aa, Mycobacterium tuberculosis
AEPRLALFTVVSSFALA

SEQ ID NO: 1385335 - protein, 20 aa, Mycobacterium tuberculosis
ALFFPWNLYFGFRIPDSSKT

SEQ ID NO: 1385336 - protein, 18 aa, Mycobacterium tuberculosis
APLWRTAWRRLRQRPFQY

SEQ ID NO: 1385337 - protein, 23 aa, Mycobacterium tuberculosis
APWHVRAGAFAIDVLPGLAVAAT

SEQ ID NO: 1385338 - protein, 17 aa, Mycobacterium tuberculosis
ARSFGVLPVGGWALRAI

SEQ ID NO: 1385339 - protein, 22 aa, Mycobacterium tuberculosis
ASQRLADCIARPLVPSIMIAAA

SEQ ID NO: 1385340 - protein, 20 aa, Mycobacterium tuberculosis
ATDLRSPLLLAIVIAVVAVV

SEQ ID NO: 1385341 - protein, 20 aa, Mycobacterium tuberculosis
AVVVLLGWSFFYFSDDTRGY

SEQ ID NO: 1385342 - protein, 34 aa, Mycobacterium tuberculosis
DPKRLLKVRGWRRVGTVVVRWPLPVLVATCAIAL

SEQ ID NO: 1385343 - protein, 21 aa, Mycobacterium tuberculosis
DRYQRCVDFARALGHRLGGAG

SEQ ID NO: 1385344 - protein, 24 aa, Mycobacterium tuberculosis
EKHCYDIPSCWALRSVFDTIDGID

SEQ ID NO: 1385345 - protein, 20 aa, Mycobacterium tuberculosis
ELVTILPIVLVIAAVAAYLL

SEQ ID NO: 1385346 - protein, 22 aa, Mycobacterium tuberculosis
FAEGLQYWPWVLLGYFNIGIMI

SEQ ID NO: 1385347 - protein, 26 aa, Mycobacterium tuberculosis
FMHVTGRWNWWAPRPLAWLHERFGVS

SEQ ID NO: 1385348 - protein, 22 aa, Mycobacterium tuberculosis
FVVGRLAGRHGIRVGLRGPVTG

SEQ ID NO: 1385349 - protein, 18 aa, Mycobacterium tuberculosis
GFSVYRLHGIFGSHDTTS

SEQ ID NO: 1385350 - protein, 18 aa, Mycobacterium tuberculosis
GLFPTSWLPLLIVTSGVV

SEQ ID NO: 1385351 - protein, 19 aa, Mycobacterium tuberculosis
GNEIARWAANLNTLAAQTA

SEQ ID NO: 1385352 - protein, 21 aa, Mycobacterium tuberculosis
GPQLPGPVPIPGAPGPMPAPP

SEQ ID NO: 1385353 - protein, 17 aa, Mycobacterium tuberculosis
GRRGVSIGVIVALVAVV

SEQ ID NO: 1385354 - protein, 20 aa, Mycobacterium tuberculosis
GSALALAGVSAWLITRAWQM

SEQ ID NO: 1385355 - protein, 18 aa, Mycobacterium tuberculosis
GVLVTWVLVERSIALGRL

SEQ ID NO: 1385356 - protein, 24 aa, Mycobacterium tuberculosis
HEVGYRLRVRMALDEGRYKIAKLD

SEQ ID NO: 1385357 - protein, 21 aa, Mycobacterium tuberculosis
ICAPLAIAVMWRWILAPTDGA

SEQ ID NO: 1385358 - protein, 24 aa, Mycobacterium tuberculosis
ICAPLAIAVMWRWIVAPTDGAIST

SEQ ID NO: 1385359 - protein, 17 aa, Mycobacterium tuberculosis
IPLVWLLWVVIARGWFA

SEQ ID NO: 1385360 - protein, 17 aa, Mycobacterium tuberculosis
IPPEHAHKLVFAVLRGV

SEQ ID NO: 1385361 - protein, 25 aa, Mycobacterium tuberculosis
IPVPIIIPPFPGWQPGMPTIPTAPP

SEQ ID NO: 1385362 - protein, 22 aa, Mycobacterium tuberculosis
IRRLSLPILLFWVGVAAITNAA

SEQ ID NO: 1385363 - protein, 18 aa, Mycobacterium tuberculosis
KFTWHWWWLGAAALGVLL

SEQ ID NO: 1385364 - protein, 19 aa, Mycobacterium tuberculosis
KHCYGIPICWSFRSIFDAL

SEQ ID NO: 1385365 - protein, 26 aa, Mycobacterium tuberculosis
KKGRLKWAWIPGIPLLWDLAVTLTAS

SEQ ID NO: 1385366 - protein, 17 aa, Mycobacterium tuberculosis
LAARFGFLLAIPAVFAS

SEQ ID NO: 1385367 - protein, 17 aa, Mycobacterium tuberculosis
LCGIAIFALVVFVTGLP

SEQ ID NO: 1385368 - protein, 20 aa, Mycobacterium tuberculosis
LDQPRIYFGPVISNTSADYA

SEQ ID NO: 1385369 - protein, 23 aa, Mycobacterium tuberculosis
LDVAQPLAYCLPGVRSRVVVSEG

SEQ ID NO: 1385370 - protein, 22 aa, Mycobacterium tuberculosis
LNEGRGDFFAVVRSLALFVNAL

SEQ ID NO: 1385371 - protein, 19 aa, Mycobacterium tuberculosis
LPAVIWWACHRPNRLWWRY

SEQ ID NO: 1385372 - protein, 19 aa, Mycobacterium tuberculosis
MPGGIYAPMMHPWSTGKDV

SEQ ID NO: 1385373 - protein, 21 aa, Mycobacterium tuberculosis
PNSKFTISMLWPGDRAWRQAG

SEQ ID NO: 1385374 - protein, 19 aa, Mycobacterium tuberculosis
PRLALFTVVSSFALAELGD

SEQ ID NO: 1385375 - protein, 17 aa, Mycobacterium tuberculosis
PRPPFDYMQQVYDRYIA

SEQ ID NO: 1385376 - protein, 25 aa, Mycobacterium tuberculosis
PRYLRFGWAAARLDDWANYVGARAT

SEQ ID NO: 1385377 - protein, 20 aa, Mycobacterium tuberculosis
QATFLRWVWYAARREGLHLD

SEQ ID NO: 1385378 - protein, 17 aa, Mycobacterium tuberculosis
QKVLEGTGFVISPDRVM

SEQ ID NO: 1385379 - protein, 19 aa, Mycobacterium tuberculosis
QLGLWRWAFGVMTLLTALM

SEQ ID NO: 1385380 - protein, 19 aa, Mycobacterium tuberculosis
RRDPLLFPFQPIHVTIAAW

SEQ ID NO: 1385381 - protein, 21 aa, Mycobacterium tuberculosis
RRLDEYIGFLVAWQRPLAGKK

SEQ ID NO: 1385382 - protein, 28 aa, Mycobacterium tuberculosis
RRPASTQSWFWSRWVGWVMRRPWITALA

SEQ ID NO: 1385383 - protein, 18 aa, Mycobacterium tuberculosis
RTSGPYLRHGQTITTTTV

SEQ ID NO: 1385384 - protein, 17 aa, Mycobacterium tuberculosis
RVMKRPVLFAAPIVIIM

SEQ ID NO: 1385385 - protein, 17 aa, Mycobacterium tuberculosis
SPLLLAIVIAVVAVVIM

SEQ ID NO: 1385386 - protein, 18 aa, Mycobacterium tuberculosis
TGAGFGRDLRSAMFEHII

SEQ ID NO: 1385387 - protein, 17 aa, Mycobacterium tuberculosis
TGFARIVLLAAILGAAL

SEQ ID NO: 1385388 - protein, 23 aa, Mycobacterium tuberculosis
TLPRPTVVTGLRLAASRSMLPAH

SEQ ID NO: 1385389 - protein, 18 aa, Mycobacterium tuberculosis
TLRYRWWVVLTGVAIAAF

SEQ ID NO: 1385390 - protein, 20 aa, Mycobacterium tuberculosis
TRSGAEWMPNFIELLQRKLS

SEQ ID NO: 1385391 - protein, 25 aa, Mycobacterium tuberculosis
VGALALVCAACWLIALLAGDYRHAQ

SEQ ID NO: 1385392 - protein, 17 aa, Mycobacterium tuberculosis
VLLFCLFGVLFVLLRRG

SEQ ID NO: 1385393 - protein, 21 aa, Mycobacterium tuberculosis
VYRYRFIVIGVMVALCLGGGV

SEQ ID NO: 1385394 - protein, 17 aa, Mycobacterium tuberculosis
VYVLPLLLLVGLFVMFS

SEQ ID NO: 1385395 - protein, 17 aa, Mycobacterium tuberculosis
WNVFFIFSLCYLFGHYG

SEQ ID NO: 1385396 - protein, 18 aa, Mycobacterium tuberculosis
WSLPLGVAILLAAVGGGL

SEQ ID NO: 1385397 - protein, 21 aa, Mycobacterium tuberculosis
AAGMYPAWRLGRMTIRTAIRE

SEQ ID NO: 1385398 - protein, 18 aa, Mycobacterium tuberculosis
AALELAAFAAFGSAASAT

SEQ ID NO: 1385399 - protein, 17 aa, Mycobacterium tuberculosis
AASLLWYLKVVGSQPDF

SEQ ID NO: 1385400 - protein, 19 aa, Mycobacterium tuberculosis
AKGPLVFDLGICLVLITLP

SEQ ID NO: 1385401 - protein, 17 aa, Mycobacterium tuberculosis
ALIPLVWLLWVVIARGW

SEQ ID NO: 1385402 - protein, 19 aa, Mycobacterium tuberculosis
ANLFLPWGIAGAAPTALDV

SEQ ID NO: 1385403 - protein, 18 aa, Mycobacterium tuberculosis
ATQLSVLACAAFIYVTAE

SEQ ID NO: 1385404 - protein, 19 aa, Mycobacterium tuberculosis
AVQAPWPLLRTFAAGPALS

SEQ ID NO: 1385405 - protein, 17 aa, Mycobacterium tuberculosis
AWLRLCQTYGWAPGVMG

SEQ ID NO: 1385406 - protein, 23 aa, Mycobacterium tuberculosis
CAPLAIAVMWRWIVAPTDGAIST

SEQ ID NO: 1385407 - protein, 20 aa, Mycobacterium tuberculosis
CLSFTRLPYFQSLGIPASIG

SEQ ID NO: 1385408 - protein, 18 aa, Mycobacterium tuberculosis
CPQTRITGVPGRGPETRT

SEQ ID NO: 1385409 - protein, 18 aa, Mycobacterium tuberculosis
DDVARSFADAGLDSVLSA

SEQ ID NO: 1385410 - protein, 21 aa, Mycobacterium tuberculosis
DVAQPLAYCLPGVRSRVVVSE

SEQ ID NO: 1385411 - protein, 22 aa, Mycobacterium tuberculosis
DVAQPLAYCLPGVRSRVVVSEG

SEQ ID NO: 1385412 - protein, 23 aa, Mycobacterium tuberculosis
EDYLRLSALGSYGAFFNIYFCSV

SEQ ID NO: 1385413 - protein, 20 aa, Mycobacterium tuberculosis
EFAGYFAWLAWLVLHLVYLV

SEQ ID NO: 1385414 - protein, 21 aa, Mycobacterium tuberculosis
EFPGKRLLIGAALLITMFPSI

SEQ ID NO: 1385415 - protein, 22 aa, Mycobacterium tuberculosis
EIRWNLRVIVMFSIGLVIATAV

SEQ ID NO: 1385416 - protein, 18 aa, Mycobacterium tuberculosis
EKRPRLTMFDDFGGRIPS

SEQ ID NO: 1385417 - protein, 19 aa, Mycobacterium tuberculosis
ERRFHIALVGAMMVAALAL

SEQ ID NO: 1385418 - protein, 19 aa, Mycobacterium tuberculosis
FDVRIKIFMLVTAVVLLCC

SEQ ID NO: 1385419 - protein, 32 aa, Mycobacterium tuberculosis; identical to SEQ ID NO: 160906

SEQ ID NO: 1385420 - protein, 25 aa, Mycobacterium tuberculosis
FGPRLVDIYVDWLWFGEVGFRSVWI

SEQ ID NO: 1385421 - protein, 20 aa, Mycobacterium tuberculosis
FSVWMLWSIVVVQMTAAAPG

SEQ ID NO: 1385422 - protein, 29 aa, Mycobacterium tuberculosis
GAFYKRSWRANDWMWGRLDGAGWLVHVLL

SEQ ID NO: 1385423 - protein, 22 aa, Mycobacterium tuberculosis
GGGRLAPRPVFRPPVDPASRQA

SEQ ID NO: 1385424 - protein, 21 aa, Mycobacterium tuberculosis
GLPLRAMVMVLLFLGVVFLLL

SEQ ID NO: 1385425 - protein, 19 aa, Mycobacterium tuberculosis
GLWPPRLWAGLRLGWAAGA

SEQ ID NO: 1385426 - protein, 17 aa, Mycobacterium tuberculosis
GNLVTWWTGDALLVFDA

SEQ ID NO: 1385427 - protein, 28 aa, Mycobacterium tuberculosis
GYILASLHWYTWLAFSGWVAVAVIFYLM

SEQ ID NO: 1385428 - protein, 17 aa, Mycobacterium tuberculosis
HFRCVSVDLLARRPVVH

SEQ ID NO: 1385429 - protein, 20 aa, Mycobacterium tuberculosis
ICAPLAIAVMWRWILAPTDG

SEQ ID NO: 1385430 - protein, 18 aa, Mycobacterium tuberculosis
IGLVRWYLGTALFDSIAR

SEQ ID NO: 1385431 - protein, 22 aa, Mycobacterium tuberculosis
IRNWPAWLGVYGFMTLDRWLLF

SEQ ID NO: 1385432 - protein, 19 aa, Mycobacterium tuberculosis
KRWGEYFAVVATSIFLPLE

SEQ ID NO: 1385433 - protein, 17 aa, Mycobacterium tuberculosis
KTFLLLVGMSALIVAVG

SEQ ID NO: 1385434 - protein, 17 aa, Mycobacterium tuberculosis
LAGVSAWLITRAWQMPP

SEQ ID NO: 1385435 - protein, 25 aa, Mycobacterium tuberculosis
LALTELWCSYGVRPDLVIGHSMGEV

SEQ ID NO: 1385436 - protein, 17 aa, Mycobacterium tuberculosis
LARIWPPWEFYFWHHTI

SEQ ID NO: 1385437 - protein, 18 aa, Mycobacterium tuberculosis
LCLMPIFPLALWLMNVYA

SEQ ID NO: 1385438 - protein, 18 aa, Mycobacterium tuberculosis
LFIPRFLFSMGVIGVVAA

SEQ ID NO: 1385439 - protein, 22 aa, Mycobacterium tuberculosis
LGDFWGYLAGWGFVVGKTASCA

SEQ ID NO: 1385440 - protein, 19 aa, Mycobacterium tuberculosis
LIGGFLLMWIMSWLTAAPV

SEQ ID NO: 1385441 - protein, 21 aa, Mycobacterium tuberculosis
LLGFRLTCYYYRKAYYRSVWQ

SEQ ID NO: 1385442 - protein, 18 aa, Mycobacterium tuberculosis
LLHDWRDVFWINVPLTAI

SEQ ID NO: 1385443 - protein, 21 aa, Mycobacterium tuberculosis
LPASVPVWLVWHIPGGTVWAE

SEQ ID NO: 1385444 - protein, 17 aa, Mycobacterium tuberculosis
LPEFSFWAWLAMLFSAG

SEQ ID NO: 1385445 - protein, 21 aa, Mycobacterium tuberculosis
LPFYRLMLSYMLVSVFLAFVA

SEQ ID NO: 1385446 - protein, 17 aa, Mycobacterium tuberculosis
LRAGTALVARGEFSLII

SEQ ID NO: 1385447 - protein, 18 aa, Mycobacterium tuberculosis
LVAAWAYPLWPVVLGLKA

SEQ ID NO: 1385448 - protein, 17 aa, Mycobacterium tuberculosis
LVLPMFVADGIDEPRPI

SEQ ID NO: 1385449 - protein, 17 aa, Mycobacterium tuberculosis
LWLPTYLAWFVGGMMLA

SEQ ID NO: 1385450 - protein, 17 aa, Mycobacterium tuberculosis
MLWLYQRVMTGPVAEGN

SEQ ID NO: 1385451 - protein, 18 aa, Mycobacterium tuberculosis
MPSSFSMHGPWVDVAAPA

SEQ ID NO: 1385452 - protein, 22 aa, Mycobacterium tuberculosis
PAWRNLRFPLAWAPPEADVARI

SEQ ID NO: 1385453 - protein, 22 aa, Mycobacterium tuberculosis
PIVCAAGLCWAAKALFGRYVVQ

SEQ ID NO: 1385454 - protein, 21 aa, Mycobacterium tuberculosis
PLHLGGICWRGRNQRPVITGT

SEQ ID NO: 1385455 - protein, 26 aa, Mycobacterium tuberculosis
PPPRRPAHRVLVGWLSLAAGLLAIAA

SEQ ID NO: 1385456 - protein, 17 aa, Mycobacterium tuberculosis
PRFLFSMGVIGVVAATS

SEQ ID NO: 1385457 - protein, 17 aa, Mycobacterium tuberculosis
QGYYPGIGAPSWTADYG

SEQ ID NO: 1385458 - protein, 19 aa, Mycobacterium tuberculosis
QRPPWGVPPPGWDGSSRPA

SEQ ID NO: 1385459 - protein, 18 aa, Mycobacterium tuberculosis
QRWKAIRGEAGWMTTYAY

SEQ ID NO: 1385460 - protein, 21 aa, Mycobacterium tuberculosis
RASVGLPGFLVGGVVRITRAS

SEQ ID NO: 1385461 - protein, 17 aa, Mycobacterium tuberculosis
RKAELDAGYILTCQSHP

SEQ ID NO: 1385462 - protein, 20 aa, Mycobacterium tuberculosis
RLLYGIGMGGEWGLGAALSM

SEQ ID NO: 1385463 - protein, 17 aa, Mycobacterium tuberculosis
RLRLPCRTILRVFSRNP

SEQ ID NO: 1385464 - protein, 18 aa, Mycobacterium tuberculosis
RLSLEFQRVSFGYVADRP

SEQ ID NO: 1385465 - protein, 17 aa, Mycobacterium tuberculosis
RRLDLLAGYGTAFSIAA

SEQ ID NO: 1385466 - protein, 17 aa, Mycobacterium tuberculosis
RSAARPGTWSLFDGGYT

SEQ ID NO: 1385467 - protein, 17 aa, Mycobacterium tuberculosis
RSLPDFWRLLQVRVASQ

SEQ ID NO: 1385468 - protein, 18 aa, Mycobacterium tuberculosis
RSYFYWEHHCFDIPLCSA

SEQ ID NO: 1385469 - protein, 18 aa, Mycobacterium tuberculosis
RWALCLVDGAPLRATQSL

SEQ ID NO: 1385470 - protein, 17 aa, Mycobacterium tuberculosis
SEIAIAVPAHWKPGAVH

SEQ ID NO: 1385471 - protein, 18 aa, Mycobacterium tuberculosis
SGVSFRDHGNWVIGAPDV

SEQ ID NO: 1385472 - protein, 17 aa, Mycobacterium tuberculosis
SLLGLAVGWLVGALVVL

SEQ ID NO: 1385473 - protein, 18 aa, Mycobacterium tuberculosis
SLNRGWCLIRTRWGRRIA

SEQ ID NO: 1385474 - protein, 18 aa, Mycobacterium tuberculosis
SLWWPLAIGILGIAVLVG

SEQ ID NO: 1385475 - protein, 17 aa, Mycobacterium tuberculosis
TAPDLKGITGWLNTPGN

SEQ ID NO: 1385476 - protein, 23 aa, Mycobacterium tuberculosis
TGMFGRDAWRPAGVVVVGSDSEV

SEQ ID NO: 1385477 - protein, 18 aa, Mycobacterium tuberculosis
TPLRRLDLLAGYGTAFSI

SEQ ID NO: 1385478 - protein, 22 aa, Mycobacterium tuberculosis
TRKRFGDTMGYRLVIYPEYASL

SEQ ID NO: 1385479 - protein, 20 aa, Mycobacterium tuberculosis
TYKAFDWDQAYRKPITYDTL

SEQ ID NO: 1385480 - protein, 17 aa, Mycobacterium tuberculosis
VAYWLDRYELLSSGRKE

SEQ ID NO: 1385481 - protein, 18 aa, Mycobacterium tuberculosis
VLWCLLWLLAGVALGYVA

SEQ ID NO: 1385482 - protein, 18 aa, Mycobacterium tuberculosis
VPFPSFKNGVGLMLQLPQ

SEQ ID NO: 1385483 - protein, 23 aa, Mycobacterium tuberculosis
VPGDCWLDWGMNIGRHCFSDYAM

SEQ ID NO: 1385484 - protein, 21 aa, Mycobacterium tuberculosis
VRLLPGWPIWFAVGWAAQEWL

SEQ ID NO: 1385485 - protein, 18 aa, Mycobacterium tuberculosis
VSLIGWWALSRLLERMRG

SEQ ID NO: 1385486 - protein, 17 aa, Mycobacterium tuberculosis
VSLPLLWWRFRRDDRAA

SEQ ID NO: 1385487 - protein, 18 aa, Mycobacterium tuberculosis
VSTSLAWTGRVAPPGTFG

SEQ ID NO: 1385488 - protein, 18 aa, Mycobacterium tuberculosis
VVRIKLWLQYVIAGTPRM

SEQ ID NO: 1385489 - protein, 22 aa, Mycobacterium tuberculosis
VVVLGWYFLRIPSLVGIGRYTL

SEQ ID NO: 1385490 - protein, 18 aa, Mycobacterium tuberculosis
WLLKRWGEYFAVVATSIF

SEQ ID NO: 1385491 - protein, 17 aa, Mycobacterium tuberculosis
WNLYFGFRIPDSSKTVF

SEQ ID NO: 1385492 - protein, 17 aa, Mycobacterium tuberculosis
YGSREPLVLTALLQLLS

SEQ ID NO: 1385493 - protein, 17 aa, Mycobacterium tuberculosis
YLPPRLEAFRDRKRANP

SEQ ID NO: 1385494 - protein, 19 aa, Mycobacterium tuberculosis
YSEPRLQPPNGYKDTTVPG

SEQ ID NO: 1385495 - protein, 18 aa, Mycobacterium tuberculosis
YVVFRWFFARDLRVVPDR

SEQ ID NO: 1385496 - protein, 18 aa, Mycobacterium tuberculosis
ADRFGSCREFADAMNEQA

SEQ ID NO: 1385497 - protein, 17 aa, Mycobacterium tuberculosis
ADYLRGFIQERWIIRPK

SEQ ID NO: 1385498 - protein, 27 aa, Mycobacterium tuberculosis
ALEATWKYVVICSVGIAVAFLGTVLLY

SEQ ID NO: 1385499 - protein, 17 aa, Mycobacterium tuberculosis
ALVLPWLLARAVGAEAA

SEQ ID NO: 1385500 - protein, 18 aa, Mycobacterium tuberculosis
CGAYKIGSTWHRTTTPTV

SEQ ID NO: 1385501 - protein, 17 aa, Mycobacterium tuberculosis
CKGLEKIPLLGHLWSWE

SEQ ID NO: 1385502 - protein, 19 aa, Mycobacterium tuberculosis
CLGFTRLPYFNTLASPCAI

SEQ ID NO: 1385503 - protein, 22 aa, Mycobacterium tuberculosis
CLIAIPLRRDPLLFPFQPIHVT

SEQ ID NO: 1385504 - protein, 22 aa, Mycobacterium tuberculosis
DALELRGRILGAFEAAEVSTDH

SEQ ID NO: 1385505 - protein, 33 aa, Mycobacterium tuberculosis; identical to SEQ ID NO: 160867

SEQ ID NO: 1385506 - protein, 18 aa, Mycobacterium tuberculosis
DRGMPLLVLVVMAQLVLC

SEQ ID NO: 1385507 - protein, 18 aa, Mycobacterium tuberculosis
EACDRGGPGLLLRAKHAV

SEQ ID NO: 1385508 - protein, 22 aa, Mycobacterium tuberculosis
ELTGQEAFVWIGLHEPDENQMQ

SEQ ID NO: 1385509 - protein, 20 aa, Mycobacterium tuberculosis
ESGLRPGWHRVPGVSASGSD

SEQ ID NO: 1385510 - protein, 23 aa, Mycobacterium tuberculosis
EWWRLGLMFAVIVALHLVGWLTV

SEQ ID NO: 1385511 - protein, 20 aa, Mycobacterium tuberculosis
FAALRIASYALWPFGRTIVE

SEQ ID NO: 1385512 - protein, 17 aa, Mycobacterium tuberculosis
FFARRIGRNEAFNHAGN

SEQ ID NO: 1385513 - protein, 22 aa, Mycobacterium tuberculosis
FRRIAAALGRPMVPIGSPVLRR

SEQ ID NO: 1385514 - protein, 18 aa, Mycobacterium tuberculosis
FTQRLAAAAKAFVNAEAT

SEQ ID NO: 1385515 - protein, 17 aa, Mycobacterium tuberculosis
FVSTYGWRAYALPVLMV

SEQ ID NO: 1385516 - protein, 17 aa, Mycobacterium tuberculosis
GAGVLGFAGTAGKESVG

SEQ ID NO: 1385517 - protein, 18 aa, Mycobacterium tuberculosis
GPDGVRCAASMALAPEEP

SEQ ID NO: 1385518 - protein, 17 aa, Mycobacterium tuberculosis
GRGRWLAIAASLVVSAA

SEQ ID NO: 1385519 - protein, 17 aa, Mycobacterium tuberculosis
GRIGLLFAVMPFHAFFG

SEQ ID NO: 1385520 - protein, 17 aa, Mycobacterium tuberculosis
GRPRWQCGVAALGSALV

SEQ ID NO: 1385521 - protein, 19 aa, Mycobacterium tuberculosis
GTFSRYWLAAAFGVTALVL

SEQ ID NO: 1385522 - protein, 24 aa, Mycobacterium tuberculosis
HKEYGSACNLVFPIGIIDRPYKHD

SEQ ID NO: 1385523 - protein, 21 aa, Mycobacterium tuberculosis
HMAGLPGWRAMFVIEALAALL

SEQ ID NO: 1385524 - protein, 17 aa, Mycobacterium tuberculosis
HVIDARFARALRLRLLS

SEQ ID NO: 1385525 - protein, 17 aa, Mycobacterium tuberculosis
IGIELGFAVLNHTQHDV

SEQ ID NO: 1385526 - protein, 17 aa, Mycobacterium tuberculosis
KIRRAQCVELYRQDEFT

SEQ ID NO: 1385527 - protein, 18 aa, Mycobacterium tuberculosis
KMPRPPWRRETHNYIRSG

SEQ ID NO: 1385528 - protein, 17 aa, Mycobacterium tuberculosis
LAELLAMRGIDGLPFSW

SEQ ID NO: 1385529 - protein, 25 aa, Mycobacterium tuberculosis
LANAKRWGVLHVIWRQGYYPGIGAP

SEQ ID NO: 1385530 - protein, 23 aa, Mycobacterium tuberculosis
LAWLVLHLVYLVGYRNRIAALFA

SEQ ID NO: 1385531 - protein, 21 aa, Mycobacterium tuberculosis
LFPDLPSFPGFPGFPSLPGFP

SEQ ID NO: 1385532 - protein, 24 aa, Mycobacterium tuberculosis
LGDWTIFYWGWWISWAPFVGMFIA

SEQ ID NO: 1385533 - protein, 17 aa, Mycobacterium tuberculosis
LGEILGFGGMSEVHLAR

SEQ ID NO: 1385534 - protein, 19 aa, Mycobacterium tuberculosis
LGVLVTWVLVERSIALGRL

SEQ ID NO: 1385535 - protein, 17 aa, Mycobacterium tuberculosis
LGWYFLRIPSLVGIGRY

SEQ ID NO: 1385536 - protein, 19 aa, Mycobacterium tuberculosis
LGWYYLRIPSLVGIGQYTL

SEQ ID NO: 1385537 - protein, 22 aa, Mycobacterium tuberculosis
LIRLARRVWPDSGWEELGPRPH

SEQ ID NO: 1385538 - protein, 24 aa, Mycobacterium tuberculosis
LLGDRYGRRRSFVFGVTLFVVSSI

SEQ ID NO: 1385539 - protein, 17 aa, Mycobacterium tuberculosis
LLIMGGFMYFASRRQRR

SEQ ID NO: 1385540 - protein, 22 aa, Mycobacterium tuberculosis
LLQMAFRFWAFRRWVFPDEFAR

SEQ ID NO: 1385541 - protein, 17 aa, Mycobacterium tuberculosis
LPNLTGRVEFEHVNFAY

SEQ ID NO: 1385542 - protein, 17 aa, Mycobacterium tuberculosis
LQNPSWRPGAWACSLVV

SEQ ID NO: 1385543 - protein, 19 aa, Mycobacterium tuberculosis
LRITRWFAVRWGAERSLVV

SEQ ID NO: 1385544 - protein, 18 aa, Mycobacterium tuberculosis
LRLCQTYGWAPGVMGASS

SEQ ID NO: 1385545 - protein, 19 aa, Mycobacterium tuberculosis
LRLRWSWRGLRLGLMFGFG

SEQ ID NO: 1385546 - protein, 17 aa, Mycobacterium tuberculosis
LSASLGWILPVIAQLVW

SEQ ID NO: 1385547 - protein, 17 aa, Mycobacterium tuberculosis
LSGMAIRIVDVFRITRK

SEQ ID NO: 1385548 - protein, 24 aa, Mycobacterium tuberculosis
NLKLLMPVFRWQRRDNLLTEPDPA

SEQ ID NO: 1385549 - protein, 22 aa, Mycobacterium tuberculosis
NVLRRRPRFRASIQSKLMVLLL

SEQ ID NO: 1385550 - protein, 17 aa, Mycobacterium tuberculosis
PICWSFRSIFDALDGID

SEQ ID NO: 1385551 - protein, 18 aa, Mycobacterium tuberculosis
PIPRWLRFVLTSDRAGSA

SEQ ID NO: 1385552 - protein, 21 aa, Mycobacterium tuberculosis
PLGHWEFYMALAYFKLAIIAA

SEQ ID NO: 1385553 - protein, 20 aa, Mycobacterium tuberculosis
PRSPGRWSLVAALALAVVSL

SEQ ID NO: 1385554 - protein, 18 aa, Mycobacterium tuberculosis
PRWARAVGRSCWRRSPTG

SEQ ID NO: 1385555 - protein, 18 aa, Mycobacterium tuberculosis
QADRAVVVAARLDRAALA

SEQ ID NO: 1385556 - protein, 18 aa, Mycobacterium tuberculosis
RASWPWALVVFLVVVFVA

SEQ ID NO: 1385557 - protein, 17 aa, Mycobacterium tuberculosis
RAVVVAARLDRAALAGA

SEQ ID NO: 1385558 - protein, 27 aa, Mycobacterium tuberculosis
RGWRRIGTAIVRWPGPILAVACAIAVV

SEQ ID NO: 1385559 - protein, 18 aa, Mycobacterium tuberculosis
RLWPTVGCLVGYGIAFAL

SEQ ID NO: 1385560 - protein, 21 aa, Mycobacterium tuberculosis
RNWPAWLGVYGFMTLDRWLLF

SEQ ID NO: 1385561 - protein, 20 aa, Mycobacterium tuberculosis
RPGCAPGPDGVRCAASMALA

SEQ ID NO: 1385562 - protein, 17 aa, Mycobacterium tuberculosis
RPSWLPKLMAHGGGTTA

SEQ ID NO: 1385563 - protein, 17 aa, Mycobacterium tuberculosis
RRALPFVAAMAKLLVAA

SEQ ID NO: 1385564 - protein, 21 aa, Mycobacterium tuberculosis
RRLQVRSGYTLFRQGERADHF

SEQ ID NO: 1385565 - protein, 22 aa, Mycobacterium tuberculosis
RRRELSQLPVLRWVDNSGNRAN

SEQ ID NO: 1385566 - protein, 19 aa, Mycobacterium tuberculosis
RSLWWPLAIGILGIAVLVG

SEQ ID NO: 1385567 - protein, 19 aa, Mycobacterium tuberculosis
SAILPRFFYTKEIGKRLNA

SEQ ID NO: 1385568 - protein, 17 aa, Mycobacterium tuberculosis
SAVPRGWARARKTIVSG

SEQ ID NO: 1385569 - protein, 22 aa, Mycobacterium tuberculosis
SDIKNLLPMLAVFKPTVVVSVP

SEQ ID NO: 1385570 - protein, 22 aa, Mycobacterium tuberculosis
SDRGVSWLPFFHDMGLITVLLA

SEQ ID NO: 1385571 - protein, 20 aa, Mycobacterium tuberculosis
SFPKWRWSLTTALLELTVLV

SEQ ID NO: 1385572 - protein, 18 aa, Mycobacterium tuberculosis
SGAEWMPNFIELLQRKLS

SEQ ID NO: 1385573 - protein, 17 aa, Mycobacterium tuberculosis
SPCAIGLVTVMLASLTL

SEQ ID NO: 1385574 - protein, 20 aa, Mycobacterium tuberculosis
SRIEFAITILLLVILLIIYG

SEQ ID NO: 1385575 - protein, 17 aa, Mycobacterium tuberculosis
TAMGLVFVWFSMTPSLL

SEQ ID NO: 1385576 - protein, 22 aa, Mycobacterium tuberculosis
TPSEAFTAWEFVDGYDVAQAVV

SEQ ID NO: 1385577 - protein, 25 aa, Mycobacterium tuberculosis
TSVCMFKPPFAWREYLLQCWFVARV

SEQ ID NO: 1385578 - protein, 17 aa, Mycobacterium tuberculosis
VEYYPAGRLNFVDTAAD

SEQ ID NO: 1385579 - protein, 23 aa, Mycobacterium tuberculosis
VICAITVAWLDRFMGIGGESALF

SEQ ID NO: 1385580 - protein, 22 aa, Mycobacterium tuberculosis
VISSWRPVLLIPLTFALFTPLA

SEQ ID NO: 1385581 - protein, 17 aa, Mycobacterium tuberculosis
VKRALAWVKAHISEYGG

SEQ ID NO: 1385582 - protein, 25 aa, Mycobacterium tuberculosis
VNLKLLMPVFRWQRRDNLLTEPDPA

SEQ ID NO: 1385583 - protein, 17 aa, Mycobacterium tuberculosis
WLGRFVSTYGWRAYALP

SEQ ID NO: 1385584 - protein, 23 aa, Mycobacterium tuberculosis
WQRNVRWARWLAWVSLAVLLTEG

SEQ ID NO: 1385585 - protein, 17 aa, Mycobacterium tuberculosis
WRPAWIGWWVSLGLATA

SEQ ID NO: 1385586 - protein, 18 aa, Mycobacterium tuberculosis
ADCGLEWVAVRCALIFGR

SEQ ID NO: 1385587 - protein, 17 aa, Mycobacterium tuberculosis
ADLRPVLLHAMTFMIVA

SEQ ID NO: 1385588 - protein, 24 aa, Mycobacterium tuberculosis
ADPGIPARGIVAVCDFGGSGTGIT

SEQ ID NO: 1385589 - protein, 18 aa, Mycobacterium tuberculosis
AGLRRWLGPLSILLVLWG

SEQ ID NO: 1385590 - protein, 20 aa, Mycobacterium tuberculosis
ALLGKWFWWPQVVRQRPIPQ

SEQ ID NO: 1385591 - protein, 20 aa, Mycobacterium tuberculosis
AQLRIGYATVVWVTSAYLLA

SEQ ID NO: 1385592 - protein, 17 aa, Mycobacterium tuberculosis
ARGWIVAAICALVVATA

SEQ ID NO: 1385593 - protein, 18 aa, Mycobacterium tuberculosis
ASLQRLRPRLGVGAGAPA

SEQ ID NO: 1385594 - protein, 21 aa, Mycobacterium tuberculosis
AWWLLAMALATLWWVMALTQL

SEQ ID NO: 1385595 - protein, 17 aa, Mycobacterium tuberculosis
CDPEVVEALKFHLRDLA

SEQ ID NO: 1385596 - protein, 26 aa, Mycobacterium tuberculosis
CGAFGYGLGVFAVWLVRYMRSHNSSP

SEQ ID NO: 1385597 - protein, 24 aa, Mycobacterium tuberculosis
DGLRPEPIIALGILLTWCSVERAV

SEQ ID NO: 1385598 - protein, 23 aa, Mycobacterium tuberculosis
EAFLPRRWRYGAQVTLALGGSAV

SEQ ID NO: 1385599 - protein, 23 aa, Mycobacterium tuberculosis
EGACFRLTLPMVRGHKVTTSPLP

SEQ ID NO: 1385600 - protein, 19 aa, Mycobacterium tuberculosis
ELVTILPIVLVIAAVAAYL

SEQ ID NO: 1385601 - protein, 18 aa, Mycobacterium tuberculosis
FDQLWRWNSIVALVLSVM

SEQ ID NO: 1385602 - protein, 21 aa, Mycobacterium tuberculosis
FFVGWSYWFAWVVTGIADLVA

SEQ ID NO: 1385603 - protein, 19 aa, Mycobacterium tuberculosis
FHGKWPWQMTHPMDGAVQI

SEQ ID NO: 1385604 - protein, 22 aa, Mycobacterium tuberculosis
FLTEPRYTWTIAEPDAAVTEFV

SEQ ID NO: 1385605 - protein, 18 aa, Mycobacterium tuberculosis
FLWLRLARVWPVYLVTLH

SEQ ID NO: 1385606 - protein, 19 aa, Mycobacterium tuberculosis
FPGKRLLIGAALLITMFPS

SEQ ID NO: 1385607 - protein, 17 aa, Mycobacterium tuberculosis
FTGAGIWLGIAAFAAAG

SEQ ID NO: 1385608 - protein, 27 aa, Mycobacterium tuberculosis
FVLPALMVLLGRWLWWPRRSVSNRQVP

SEQ ID NO: 1385609 - protein, 22 aa, Mycobacterium tuberculosis
GACFRLTLPLVRGHKVTTSPLP

SEQ ID NO: 1385610 - protein, 19 aa, Mycobacterium tuberculosis
GFRLTCYYYRKAYYRSVWQ

SEQ ID NO: 1385611 - protein, 18 aa, Mycobacterium tuberculosis
GGVLAYACAIGLRRLGKD

SEQ ID NO: 1385612 - protein, 17 aa, Mycobacterium tuberculosis
GLMAAVGFELFKQVGAI

SEQ ID NO: 1385613 - protein, 18 aa, Mycobacterium tuberculosis
GPGPRWWGLALLAVGGTS

SEQ ID NO: 1385614 - protein, 22 aa, Mycobacterium tuberculosis
GQLRITRWFAVRWGAERSLVVG

SEQ ID NO: 1385615 - protein, 18 aa, Mycobacterium tuberculosis
GSALALAGVSAWLITRAW

SEQ ID NO: 1385616 - protein, 19 aa, Mycobacterium tuberculosis
GTAVVRWPGPILATSVALA

SEQ ID NO: 1385617 - protein, 26 aa, Mycobacterium tuberculosis
GVSLAVCLLTAFLLIAVFGEVRFGDG

SEQ ID NO: 1385618 - protein, 17 aa, Mycobacterium tuberculosis
HEFGWRIGFAVGGGAAI

SEQ ID NO: 1385619 - protein, 17 aa, Mycobacterium tuberculosis
HGKWPWQMTHPMDGAVQ

SEQ ID NO: 1385620 - protein, 17 aa, Mycobacterium tuberculosis
IAGALGIMRFLAIFGPV

SEQ ID NO: 1385621 - protein, 23 aa, Mycobacterium tuberculosis
IGPDWRLVLCGGPAEVVLDRATL

SEQ ID NO: 1385622 - protein, 24 aa, Mycobacterium tuberculosis
IGRAWLRLFGVLPFDYDRLSIAEL

SEQ ID NO: 1385623 - protein, 19 aa, Mycobacterium tuberculosis
ILPVLPVIFFSGAQSVDAA

SEQ ID NO: 1385624 - protein, 17 aa, Mycobacterium tuberculosis
KELLASKDNKAWNLPIT

SEQ ID NO: 1385625 - protein, 17 aa, Mycobacterium tuberculosis
KLRVGFAKAGRLMDLME

SEQ ID NO: 1385626 - protein, 18 aa, Mycobacterium tuberculosis
LCGIAIFALVVFVTGLPL

SEQ ID NO: 1385627 - protein, 19 aa, Mycobacterium tuberculosis
LGDRYGRRRSFVFGVTLFV

SEQ ID NO: 1385628 - protein, 18 aa, Mycobacterium tuberculosis
LLDGVGLIVGIDRFMSEA

SEQ ID NO: 1385629 - protein, 19 aa, Mycobacterium tuberculosis
LLVRGGVVFSGYWRNEQAT

SEQ ID NO: 1385630 - protein, 18 aa, Mycobacterium tuberculosis
LNGLRLLRHTAWRRAAGT

SEQ ID NO: 1385631 - protein, 20 aa, Mycobacterium tuberculosis
LNGLRLLRHTAWRRAAGTAH

SEQ ID NO: 1385632 - protein, 21 aa, Mycobacterium tuberculosis
LPFPLSSAILPRFFYTKEIGK

SEQ ID NO: 1385633 - protein, 18 aa, Mycobacterium tuberculosis
LPSHCRGLLVGRVAGAHT

SEQ ID NO: 1385634 - protein, 17 aa, Mycobacterium tuberculosis
LPVLWIFSLSLKPTSTV

SEQ ID NO: 1385635 - protein, 23 aa, Mycobacterium tuberculosis
LPVTWEMSFLYAIVFGGFVAFSN

SEQ ID NO: 1385636 - protein, 17 aa, Mycobacterium tuberculosis
LRPVLLHAMTFMIVASP

SEQ ID NO: 1385637 - protein, 22 aa, Mycobacterium tuberculosis
LRWSRNRMAFLAALFFLLALCW

SEQ ID NO: 1385638 - protein, 22 aa, Mycobacterium tuberculosis
LSGRFCVPVVRTPRPQLTAAFG

SEQ ID NO: 1385639 - protein, 17 aa, Mycobacterium tuberculosis
LSPWHWAILAVVVIVLF

SEQ ID NO: 1385640 - protein, 20 aa, Mycobacterium tuberculosis
NEGRGDFFAVVRSLALFVNA

SEQ ID NO: 1385641 - protein, 29 aa, Mycobacterium tuberculosis
NGLRPEPLIALGVLVTWVLVERSIALGRL

SEQ ID NO: 1385642 - protein, 21 aa, Mycobacterium tuberculosis
NVLRRRPRFRASIQSKLMVLL

SEQ ID NO: 1385643 - protein, 17 aa, Mycobacterium tuberculosis
PDGVRCAASMALAPEEP

SEQ ID NO: 1385644 - protein, 26 aa, Mycobacterium tuberculosis
PILPRLIRRFAVVIVLLWLGFTAFVN

SEQ ID NO: 1385645 - protein, 23 aa, Mycobacterium tuberculosis
PNSLLPRWLPDTSRGQGWADRIR

SEQ ID NO: 1385646 - protein, 18 aa, Mycobacterium tuberculosis
PRLWAGLRLGWAAGAAAA

SEQ ID NO: 1385647 - protein, 19 aa, Mycobacterium tuberculosis
PRWARAVGRSCWRRSPTGC

SEQ ID NO: 1385648 - protein, 22 aa, Mycobacterium tuberculosis
QAAQLSALWARFPLPVIPAPGD

SEQ ID NO: 1385649 - protein, 17 aa, Mycobacterium tuberculosis
QESFNFGEFFAFTKVCS

SEQ ID NO: 1385650 - protein, 17 aa, Mycobacterium tuberculosis
RAVGRSCWRRSPTGCCA

SEQ ID NO: 1385651 - protein, 26 aa, Mycobacterium tuberculosis
REAAEALGLPAGWALRKIVLKTAMPG

SEQ ID NO: 1385652 - protein, 23 aa, Mycobacterium tuberculosis
RFVRALSAAAGWYVDAEAANAAL

SEQ ID NO: 1385653 - protein, 17 aa, Mycobacterium tuberculosis
RHIASWLAALVVPSVIC

SEQ ID NO: 1385654 - protein, 17 aa, Mycobacterium tuberculosis
RHLRPMLARRFEIATGH

SEQ ID NO: 1385655 - protein, 21 aa, Mycobacterium tuberculosis
RKRSESGVGIRGYRDEFLDAT

SEQ ID NO: 1385656 - protein, 24 aa, Mycobacterium tuberculosis
RLLREFRGPLALSLLLVAVQTCAG

SEQ ID NO: 1385657 - protein, 24 aa, Mycobacterium tuberculosis
RLWRGLLVFFSRWWQLETLYRSNM

SEQ ID NO: 1385658 - protein, 18 aa, Mycobacterium tuberculosis
RPRVVTVHILRNSLIPVV

SEQ ID NO: 1385659 - protein, 19 aa, Mycobacterium tuberculosis
RVDCPLTWVERWARTKAAM

SEQ ID NO: 1385660 - protein, 18 aa, Mycobacterium tuberculosis
SALERLRDFAVFKAIGVP

SEQ ID NO: 1385661 - protein, 17 aa, Mycobacterium tuberculosis
SLWWDIWSLGLLVLIPA

SEQ ID NO: 1385662 - protein, 18 aa, Mycobacterium tuberculosis
SSEIAIAVPAHWKPGAVH

SEQ ID NO: 1385663 - protein, 19 aa, Mycobacterium tuberculosis
TANALCGIAIFALVVFVTG

SEQ ID NO: 1385664 - protein, 22 aa, Mycobacterium tuberculosis
TLIRTPALYAWILVLPIGLMLQ

SEQ ID NO: 1385665 - protein, 23 aa, Mycobacterium tuberculosis
TTRIVRASIRWAIEERAPSQADG

SEQ ID NO: 1385666 - protein, 17 aa, Mycobacterium tuberculosis
VARRLALYGSDWITSTG

SEQ ID NO: 1385667 - protein, 20 aa, Mycobacterium tuberculosis
VDTLSLFVGWLWPLWDSRRR

SEQ ID NO: 1385668 - protein, 18 aa, Mycobacterium tuberculosis
VFCGFAFAGMPLVAEIGV

SEQ ID NO: 1385669 - protein, 17 aa, Mycobacterium tuberculosis
VGVSLVLPAAVWGVLTP

SEQ ID NO: 1385670 - protein, 17 aa, Mycobacterium tuberculosis
VKLLNWFFAIVVNEVDR

SEQ ID NO: 1385671 - protein, 18 aa, Mycobacterium tuberculosis
VLGLRGRRPVKWNDPITL

SEQ ID NO: 1385672 - protein, 22 aa, Mycobacterium tuberculosis
VMVGGLCIAGALGIMRFLAIFG

SEQ ID NO: 1385673 - protein, 17 aa, Mycobacterium tuberculosis
VSLLVRRRRVWARITPT

SEQ ID NO: 1385674 - protein, 20 aa, Mycobacterium tuberculosis
VSSMSCAACASRVETKLNKI

SEQ ID NO: 1385675 - protein, 20 aa, Mycobacterium tuberculosis
VVQWKLKPGVVSTMSAQARY

SEQ ID NO: 1385676 - protein, 17 aa, Mycobacterium tuberculosis
WALSASLGWILPVIAQL

SEQ ID NO: 1385677 - protein, 17 aa, Mycobacterium tuberculosis
WAVGLAFPCQQPMLHAN

SEQ ID NO: 1385678 - protein, 24 aa, Mycobacterium tuberculosis
WSWRGLRLGLMFGFGGMLVTIPAS

SEQ ID NO: 1385679 - protein, 20 aa, Mycobacterium tuberculosis
YLRLGDWVPVTAFVVMGAGF

SEQ ID NO: 1385680 - protein, 19 aa, Mycobacterium tuberculosis
YPPCLFKLLTGWNCPACGG

SEQ ID NO: 1385681 - protein, 19 aa, Mycobacterium tuberculosis
AAGYLCWRGKDLATPRGWI

SEQ ID NO: 1385682 - protein, 19 aa, Mycobacterium tuberculosis
AAKFGVEWLPAKGFITDRL

SEQ ID NO: 1385683 - protein, 23 aa, Mycobacterium tuberculosis
AALAVAVLARWRFRRRPAPARLP

SEQ ID NO: 1385684 - protein, 20 aa, Mycobacterium tuberculosis
AEHPELWGGLVDLAINDDLG

SEQ ID NO: 1385685 - protein, 24 aa, Mycobacterium tuberculosis
AFFGWRWSLPLGVAILLAAVGGGL

SEQ ID NO: 1385686 - protein, 23 aa, Mycobacterium tuberculosis
AGRLRGGCYFAFMGVAWVLLAIS

SEQ ID NO: 1385687 - protein, 19 aa, Mycobacterium tuberculosis
AHIKLAWRTGNFVIYAITI

SEQ ID NO: 1385688 - protein, 17 aa, Mycobacterium tuberculosis
AHLPFRSGRSFSASVSG

SEQ ID NO: 1385689 - protein, 23 aa, Mycobacterium tuberculosis
AIATACPFCRVMVTDGVNDRQEE

SEQ ID NO: 1385690 - protein, 18 aa, Mycobacterium tuberculosis
AIFYLRLPATFGIGTYGV

SEQ ID NO: 1385691 - protein, 24 aa, Mycobacterium tuberculosis
ALSAWRFATVFGVVSLLADVVYEG

SEQ ID NO: 1385692 - protein, 18 aa, Mycobacterium tuberculosis
ALSEMRWAALALGLFSAG

SEQ ID NO: 1385693 - protein, 17 aa, Mycobacterium tuberculosis
APAAAGVPVVIPVVNDW

SEQ ID NO: 1385694 - protein, 18 aa, Mycobacterium tuberculosis
AQAALWTGYRPWFIDIDA

SEQ ID NO: 1385695 - protein, 19 aa, Mycobacterium tuberculosis
ASVLPVWLLLAPRDYLSTF

SEQ ID NO: 1385696 - protein, 20 aa, Mycobacterium tuberculosis
ATEASVRWRAVLLAAVAACA

SEQ ID NO: 1385697 - protein, 18 aa, Mycobacterium tuberculosis
ATLKRFVDRFSRFNLREF

SEQ ID NO: 1385698 - protein, 18 aa, Mycobacterium tuberculosis
AVVAREFGFPCVVDAQGA

SEQ ID NO: 1385699 - protein, 30 aa, Mycobacterium tuberculosis
CGYILASLHWYTWLAFSGWVAVAVIFYLMW

SEQ ID NO: 1385700 - protein, 21 aa, Mycobacterium tuberculosis
CLIAIPLRRDPLLFPFQPIHV

SEQ ID NO: 1385701 - protein, 17 aa, Mycobacterium tuberculosis
DAIICFVGFLFPLWDAK

SEQ ID NO: 1385702 - protein, 19 aa, Mycobacterium tuberculosis
DKPAALWILTRGVHESVAP

SEQ ID NO: 1385703 - protein, 23 aa, Mycobacterium tuberculosis
DLQRPDAPWGRPWVVYLQHASDP

SEQ ID NO: 1385704 - protein, 19 aa, Mycobacterium tuberculosis
DVAQPLAYCLPGVRSRVVV

SEQ ID NO: 1385705 - protein, 21 aa, Mycobacterium tuberculosis
ECPPGTIGEIWVHGDNVAGGY

SEQ ID NO: 1385706 - protein, 18 aa, Mycobacterium tuberculosis
EGAHARWNWVLDGMVETK

SEQ ID NO: 1385707 - protein, 19 aa, Mycobacterium tuberculosis
ELGEILGFGGMSEVHLARD

SEQ ID NO: 1385708 - protein, 26 aa, Mycobacterium tuberculosis
EPGLDWRWLVLWWKSHAPHIANNLMN

SEQ ID NO: 1385709 - protein, 19 aa, Mycobacterium tuberculosis
EPRYTWTIAEPDAAVTEFV

SEQ ID NO: 1385710 - protein, 17 aa, Mycobacterium tuberculosis
ERPAGTIGEIWVHGDNV

SEQ ID NO: 1385711 - protein, 17 aa, Mycobacterium tuberculosis
EVLFLRWLLDGRASRQW

SEQ ID NO: 1385712 - protein, 18 aa, Mycobacterium tuberculosis
EVLFLRWLLDGRASRQWC

SEQ ID NO: 1385713 - protein, 19 aa, Mycobacterium tuberculosis
EVVEALKFHLRDLAVTFRF

SEQ ID NO: 1385714 - protein, 18 aa, Mycobacterium tuberculosis
FCGLLWWIAFHMRDRPLV

SEQ ID NO: 1385715 - protein, 18 aa, Mycobacterium tuberculosis
FEKAWPLLWFVVIGLIAA

SEQ ID NO: 1385716 - protein, 19 aa, Mycobacterium tuberculosis
FGAFAHRWLARRTRRRINP

SEQ ID NO: 1385717 - protein, 17 aa, Mycobacterium tuberculosis
FGVPVPNLTAWRRSVTG

SEQ ID NO: 1385718 - protein, 17 aa, Mycobacterium tuberculosis
FIRWLFRFLVGQVDRIA

SEQ ID NO: 1385719 - protein, 23 aa, Mycobacterium tuberculosis
FMLREISCIFVAWFVLYLMLVLR

SEQ ID NO: 1385720 - protein, 18 aa, Mycobacterium tuberculosis
FSRFCCALAISALAYEPP

SEQ ID NO: 1385721 - protein, 19 aa, Mycobacterium tuberculosis
FVDRFSRFNLREFAIRPAY

SEQ ID NO: 1385722 - protein, 18 aa, Mycobacterium tuberculosis
FYLTCVVFVFGVLGVLLR

SEQ ID NO: 1385723 - protein, 19 aa, Mycobacterium tuberculosis
GAAICLLALMATLATASRR

SEQ ID NO: 1385724 - protein, 18 aa, Mycobacterium tuberculosis
GANFTAAMAFEIGSTNLV

SEQ ID NO: 1385725 - protein, 25 aa, Mycobacterium tuberculosis
GAVGRSVRWYLVFSQPAAVNVAEQV

SEQ ID NO: 1385726 - protein, 17 aa, Mycobacterium tuberculosis
GAVLRLVVRFAEPLPPS

SEQ ID NO: 1385727 - protein, 20 aa, Mycobacterium tuberculosis
GDCWLDWGMNIGRHCFSDYA

SEQ ID NO: 1385728 - protein, 17 aa, Mycobacterium tuberculosis
GFVSEWLLVQSLIHAAP

SEQ ID NO: 1385729 - protein, 17 aa, Mycobacterium tuberculosis
GGLRAALPVTFATFGLA

SEQ ID NO: 1385730 - protein, 19 aa, Mycobacterium tuberculosis
GKVRRAECVKLYRHNEFTR

SEQ ID NO: 1385731 - protein, 18 aa, Mycobacterium tuberculosis
GLARIWPPWEFYFWHHTI

SEQ ID NO: 1385732 - protein, 19 aa, Mycobacterium tuberculosis
GLDALGFAGTIPKSAPGSA

SEQ ID NO: 1385733 - protein, 20 aa, Mycobacterium tuberculosis
GLFDTWPGLILPYITFALPL

SEQ ID NO: 1385734 - protein, 18 aa, Mycobacterium tuberculosis
GPGPLLAAARAWHALAAQ

SEQ ID NO: 1385735 - protein, 20 aa, Mycobacterium tuberculosis
GPQLPGPVPIPGAPGPMPAP

SEQ ID NO: 1385736 - protein, 19 aa, Mycobacterium tuberculosis
GPYHLKRLLGRGGMGEVYE

SEQ ID NO: 1385737 - protein, 17 aa, Mycobacterium tuberculosis
GQANWWLPSSWRPETWW

SEQ ID NO: 1385738 - protein, 19 aa, Mycobacterium tuberculosis
GQEWRMVWDSALDRAEIGR

SEQ ID NO: 1385739 - protein, 20 aa, Mycobacterium tuberculosis
GRIKDLLIVYGRNHSPDDIE

SEQ ID NO: 1385740 - protein, 22 aa, Mycobacterium tuberculosis
GRLRGGCYFAFMGVAWVLLAIS

SEQ ID NO: 1385741 - protein, 20 aa, Mycobacterium tuberculosis
GSAPRPAWLRAFAHPERDKR

SEQ ID NO: 1385742 - protein, 17 aa, Mycobacterium tuberculosis
GTPRPPFDYMQQVYDRY

SEQ ID NO: 1385743 - protein, 26 aa, Mycobacterium tuberculosis
GVFLAVCLLTAFLLIAVFGEVRFGDG

SEQ ID NO: 1385744 - protein, 18 aa, Mycobacterium tuberculosis
GVIWSGVVSKVIVPAVVA

SEQ ID NO: 1385745 - protein, 17 aa, Mycobacterium tuberculosis
GVLAYACAIGLRRLGKD

SEQ ID NO: 1385746 - protein, 24 aa, Mycobacterium tuberculosis
GYAKIVGCALGFPVINIARSSAKL

SEQ ID NO: 1385747 - protein, 23 aa, Mycobacterium tuberculosis
HEGGHTLAAWAMPDIEPIYKVTI

SEQ ID NO: 1385748 - protein, 25 aa, Mycobacterium tuberculosis
HGGELPRRGALALGCIALLLMGIVG

SEQ ID NO: 1385749 - protein, 23 aa, Mycobacterium tuberculosis
HGLGMPIPLGWQVWLYGVFAIIA

SEQ ID NO: 1385750 - protein, 19 aa, Mycobacterium tuberculosis
HSLPLFGYAAMPAYDVVDG

SEQ ID NO: 1385751 - protein, 21 aa, Mycobacterium tuberculosis
ICAITVAWLDRFMGIGGESAL

SEQ ID NO: 1385752 - protein, 18 aa, Mycobacterium tuberculosis
IDALVWVPRMYYLYGNPS

SEQ ID NO: 1385753 - protein, 19 aa, Mycobacterium tuberculosis
IGGLLVEWAGWRWVLLVNV

SEQ ID NO: 1385754 - protein, 23 aa, Mycobacterium tuberculosis
IGLFDTWPGLILPYITFALPLAI

SEQ ID NO: 1385755 - protein, 18 aa, Mycobacterium tuberculosis
IGLSFLGLCHLWAGSPEA

SEQ ID NO: 1385756 - protein, 18 aa, Mycobacterium tuberculosis
IKVPREFINDYLFNFPDT

SEQ ID NO: 1385757 - protein, 17 aa, Mycobacterium tuberculosis
ILLLEVLFLRWLLDGRA

SEQ ID NO: 1385758 - protein, 18 aa, Mycobacterium tuberculosis
ILLPHSRPAVLVLGVLTW

SEQ ID NO: 1385759 - protein, 19 aa, Mycobacterium tuberculosis
IPQSLLWISLVVLWLFVLV

SEQ ID NO: 1385760 - protein, 20 aa, Mycobacterium tuberculosis
IRPNPGIGHPCWANYFPVTR

SEQ ID NO: 1385761 - protein, 22 aa, Mycobacterium tuberculosis
ITALCLFTAVFIMLRRKRIPSV

SEQ ID NO: 1385762 - protein, 19 aa, Mycobacterium tuberculosis
ITKLMPWLWVAWFGLGSFG

SEQ ID NO: 1385763 - protein, 19 aa, Mycobacterium tuberculosis
ITLPMLRPTMFFVLVTGII

SEQ ID NO: 1385764 - protein, 20 aa, Mycobacterium tuberculosis
IVGLCIFGFLLAMLRGNHVG

SEQ ID NO: 1385765 - protein, 19 aa, Mycobacterium tuberculosis
IVSGLSIFRLLRYLAREYL

SEQ ID NO: 1385766 - protein, 18 aa, Mycobacterium tuberculosis
IYQNLGWAFGYNTAAIPL

SEQ ID NO: 1385767 - protein, 19 aa, Mycobacterium tuberculosis
KPYAEWRGMFAGNGMLLPA

SEQ ID NO: 1385768 - protein, 19 aa, Mycobacterium tuberculosis
KVVNLRSAPGFSFVSEDLD

SEQ ID NO: 1385769 - protein, 19 aa, Mycobacterium tuberculosis
LANLLRYGYYPALILGLTV

SEQ ID NO: 1385770 - protein, 17 aa, Mycobacterium tuberculosis
LAPGLGRLLGPIGRMAP

SEQ ID NO: 1385771 - protein, 20 aa, Mycobacterium tuberculosis
LDAWRGLRRRPKFVIAAALI

SEQ ID NO: 1385772 - protein, 17 aa, Mycobacterium tuberculosis
LDGAGWLVHVLLDPRRV

SEQ ID NO: 1385773 - protein, 17 aa, Mycobacterium tuberculosis
LDWVAWRGLGLAADAQL

SEQ ID NO: 1385774 - protein, 26 aa, Mycobacterium tuberculosis
LEATWKYVVICSVGIAVAFLGTVLLY

SEQ ID NO: 1385775 - protein, 32 aa, Mycobacterium tuberculosis
LEPRGPLPTEIYWRRRGLALGIAVVVVGIAVA

SEQ ID NO: 1385776 - protein, 18 aa, Mycobacterium tuberculosis
LFDACGWRRLIFATPEEL

SEQ ID NO: 1385777 - protein, 24 aa, Mycobacterium tuberculosis
LFDRIGNFVVRWPLIVIGCWIAVA

SEQ ID NO: 1385778 - protein, 19 aa, Mycobacterium tuberculosis
LGLRVYLAWITRTGYTYGA

SEQ ID NO: 1385779 - protein, 18 aa, Mycobacterium tuberculosis
LGMSCAACASRVETKLNK

SEQ ID NO: 1385780 - protein, 17 aa, Mycobacterium tuberculosis
LGVPGWVTQRLWWAVLL

SEQ ID NO: 1385781 - protein, 25 aa, Mycobacterium tuberculosis
LGVVVGGPFLPLAIVLYWFSNNIWT

SEQ ID NO: 1385782 - protein, 17 aa, Mycobacterium tuberculosis
LHMPLHWLVLPMAIIVM

SEQ ID NO: 1385783 - protein, 21 aa, Mycobacterium tuberculosis
LIGAYGWRWIFLVNLPVGLSA

SEQ ID NO: 1385784 - protein, 17 aa, Mycobacterium tuberculosis
LKTSWYLLGPAFVAAIA

SEQ ID NO: 1385785 - protein, 17 aa, Mycobacterium tuberculosis
LLANLFLPWGIAGAAPT

SEQ ID NO: 1385786 - protein, 27 aa, Mycobacterium tuberculosis
LLYRLLTCWLPVFAGWQVMHWLTRHEM

SEQ ID NO: 1385787 - protein, 23 aa, Mycobacterium tuberculosis
LMTPLRVMFAIALVFLALGWSTK

SEQ ID NO: 1385788 - protein, 17 aa, Mycobacterium tuberculosis
LPSGTYCKIPQDAQLQV

SEQ ID NO: 1385789 - protein, 17 aa, Mycobacterium tuberculosis
LQNPSWRPGAWACRLVV

SEQ ID NO: 1385790 - protein, 19 aa, Mycobacterium tuberculosis
LRAALPVTFATFGLAYLAI

SEQ ID NO: 1385791 - protein, 17 aa, Mycobacterium tuberculosis
LRMSVRFMRRIAFSGFA

SEQ ID NO: 1385792 - protein, 18 aa, Mycobacterium tuberculosis
LRSLGISDPGNWMSIGCG

SEQ ID NO: 1385793 - protein, 20 aa, Mycobacterium tuberculosis
LSALERLRDFAVFKAIGVPT

SEQ ID NO: 1385794 - protein, 17 aa, Mycobacterium tuberculosis
LTALTWPVMANFAVDSA

SEQ ID NO: 1385795 - protein, 18 aa, Mycobacterium tuberculosis
LVWLLWVVIARGWFAVTR

SEQ ID NO: 1385796 - protein, 21 aa, Mycobacterium tuberculosis
LYAERWCAWALLAATVAIPTG

SEQ ID NO: 1385797 - protein, 18 aa, Mycobacterium tuberculosis
MEQGRLAAYHAFGEPTDG

SEQ ID NO: 1385798 - protein, 25 aa, Mycobacterium tuberculosis
MHVTGRWNWWAPRPLAWLHERFGVS

SEQ ID NO: 1385799 - protein, 21 aa, Mycobacterium tuberculosis
NTESRWRLGLYAAGRASQIRR

SEQ ID NO: 1385800 - protein, 19 aa, Mycobacterium tuberculosis
NTSPTRWRSCLPVPLLSRA

SEQ ID NO: 1385801 - protein, 19 aa, Mycobacterium tuberculosis
NVVPRPGTSPGVGGTPASP

SEQ ID NO: 1385802 - protein, 17 aa, Mycobacterium tuberculosis
PAGTIGEIWVHGDNVAI

SEQ ID NO: 1385803 - protein, 17 aa, Mycobacterium tuberculosis
PAKWSYYYLYVILDIFS

SEQ ID NO: 1385804 - protein, 17 aa, Mycobacterium tuberculosis
PGTCERLGIGPDDCASV

SEQ ID NO: 1385805 - protein, 17 aa, Mycobacterium tuberculosis
PLLAAARAWHALAAQYT

SEQ ID NO: 1385806 - protein, 23 aa, Mycobacterium tuberculosis
PLPRSARQPWLWVGVAVAVVVAL

SEQ ID NO: 1385807 - protein, 27 aa, Mycobacterium tuberculosis
PPILPRLIRRFAVVIVLLWLGFTAFVN

SEQ ID NO: 1385808 - protein, 30 aa, Mycobacterium tuberculosis; identical to SEQ ID NO: 161650

SEQ ID NO: 1385809 - protein, 19 aa, Mycobacterium tuberculosis
PRLRALGWTGMLDKGADVD

SEQ ID NO: 1385810 - protein, 19 aa, Mycobacterium tuberculosis
PSWLRPRLGDEHARERTPD

SEQ ID NO: 1385811 - protein, 21 aa, Mycobacterium tuberculosis
PTGCILAWILVRIINVRSFGW

SEQ ID NO: 1385812 - protein, 19 aa, Mycobacterium tuberculosis
PVVRTPRPQLTAAFGGALW

SEQ ID NO: 1385813 - protein, 19 aa, Mycobacterium tuberculosis
PYEPMVRVSLWLSVTAVAV

SEQ ID NO: 1385814 - protein, 20 aa, Mycobacterium tuberculosis
PYEPMVRVSLWLSVTAVAVL

SEQ ID NO: 1385815 - protein, 21 aa, Mycobacterium tuberculosis
QHSPMTWRRWALLCVGIAQIA

SEQ ID NO: 1385816 - protein, 21 aa, Mycobacterium tuberculosis
QRPDAPWGRPWVVYLQHASDP

SEQ ID NO: 1385817 - protein, 17 aa, Mycobacterium tuberculosis
RDLFSGFGWLAVVLLAV

SEQ ID NO: 1385818 - protein, 23 aa, Mycobacterium tuberculosis
REIRWNLRVIVMFSIGLVIATAV

SEQ ID NO: 1385819 - protein, 17 aa, Mycobacterium tuberculosis
RELWRAVGIRGATTAAA

SEQ ID NO: 1385820 - protein, 27 aa, Mycobacterium tuberculosis
RGDYRLRHFGVRITRILALLLAVLLAV

SEQ ID NO: 1385821 - protein, 17 aa, Mycobacterium tuberculosis
RIKDLLIVYGRNHSPDD

SEQ ID NO: 1385822 - protein, 19 aa, Mycobacterium tuberculosis
RKRLPAIFVDVARFALIGI

SEQ ID NO: 1385823 - protein, 17 aa, Mycobacterium tuberculosis
RLAAGVIRPQLRRAYLE

SEQ ID NO: 1385824 - protein, 20 aa, Mycobacterium tuberculosis
RLRRPIVVWWIVWIVSNAIS

SEQ ID NO: 1385825 - protein, 17 aa, Mycobacterium tuberculosis
RLWAGLRLGWAAGAAAA

SEQ ID NO: 1385826 - protein, 27 aa, Mycobacterium tuberculosis
RQFRRLGTHVARWPAPILVASGVFVLI

SEQ ID NO: 1385827 - protein, 20 aa, Mycobacterium tuberculosis
RRLWTMLIFMLWHAIFVEHS

SEQ ID NO: 1385828 - protein, 18 aa, Mycobacterium tuberculosis
RSLLGLAVGWLVGALVVL

SEQ ID NO: 1385829 - protein, 23 aa, Mycobacterium tuberculosis
RSWSVRANLHFLWLRLARVWPVY

SEQ ID NO: 1385830 - protein, 22 aa, Mycobacterium tuberculosis
RVMKRPVLFAAPIVIIMILLII

SEQ ID NO: 1385831 - protein, 17 aa, Mycobacterium tuberculosis
RVPMPIIAVSSLLRSHA

SEQ ID NO: 1385832 - protein, 19 aa, Mycobacterium tuberculosis
RWSLPLGVAILLAAVGGGL

SEQ ID NO: 1385833 - protein, 18 aa, Mycobacterium tuberculosis
RYGGYALGGVSSFGFGGA

SEQ ID NO: 1385834 - protein, 19 aa, Mycobacterium tuberculosis
RYLTPWGRQFWRITRAYFV

SEQ ID NO: 1385835 - protein, 17 aa, Mycobacterium tuberculosis
SAYDLGTVIGFYGLTID

SEQ ID NO: 1385836 - protein, 19 aa, Mycobacterium tuberculosis
SFLGLCHLWAGSPEAPESR

SEQ ID NO: 1385837 - protein, 25 aa, Mycobacterium tuberculosis
SGGIRGPIGLGFRVPCFVISPYSRG

SEQ ID NO: 1385838 - protein, 17 aa, Mycobacterium tuberculosis
SGIALSIAALVPIGAAL

SEQ ID NO: 1385839 - protein, 24 aa, Mycobacterium tuberculosis
SIAALLGRWFWWPNMIHSRPTVPE

SEQ ID NO: 1385840 - protein, 21 aa, Mycobacterium tuberculosis
SIGSVGRWVAVVAVLAVLTVV

SEQ ID NO: 1385841 - protein, 17 aa, Mycobacterium tuberculosis
SRLRAAGFIGFAIGGPL

SEQ ID NO: 1385842 - protein, 18 aa, Mycobacterium tuberculosis
SSCTWQLSLFITDGVPPP

SEQ ID NO: 1385843 - protein, 27 aa, Mycobacterium tuberculosis
SVSPLIRWIIKVPREFINDYLFNFPDT

SEQ ID NO: 1385844 - protein, 19 aa, Mycobacterium tuberculosis
TESRWRLGLYAAGRASQIR

SEQ ID NO: 1385845 - protein, 20 aa, Mycobacterium tuberculosis
TIEAMWWIRSRMLGVKPRVW

SEQ ID NO: 1385846 - protein, 23 aa, Mycobacterium tuberculosis
TMRTIRMNMIWAFGYNVAAIPIA

SEQ ID NO: 1385847 - protein, 18 aa, Mycobacterium tuberculosis
TPPRAVAIITQIASALDA

SEQ ID NO: 1385848 - protein, 17 aa, Mycobacterium tuberculosis
TRPRWPTMGPRGDRNRR

SEQ ID NO: 1385849 - protein, 21 aa, Mycobacterium tuberculosis
TRWRSCLPVPLLSRATVRRSS

SEQ ID NO: 1385850 - protein, 19 aa, Mycobacterium tuberculosis
TSGLLAWARRRPVLAGVLI

SEQ ID NO: 1385851 - protein, 17 aa, Mycobacterium tuberculosis
TTHWGLQIDHFWWTAIW

SEQ ID NO: 1385852 - protein, 17 aa, Mycobacterium tuberculosis
TVNRCPVYMPFDDVDIA

SEQ ID NO: 1385853 - protein, 25 aa, Mycobacterium tuberculosis
VAGLVDWPILLAVGGGALLLRKLNR

SEQ ID NO: 1385854 - protein, 20 aa, Mycobacterium tuberculosis
VAGVILWRFFGDALSNRSHT

SEQ ID NO: 1385855 - protein, 22 aa, Mycobacterium tuberculosis
VAGWWTPPAWAIGPPVVDAAAQ

SEQ ID NO: 1385856 - protein, 24 aa, Mycobacterium tuberculosis
VFGRGDIALGWAFLGAGIGSLVRP

SEQ ID NO: 1385857 - protein, 21 aa, Mycobacterium tuberculosis
VIGALVVWWGWRERRDLFSGF

SEQ ID NO: 1385858 - protein, 20 aa, Mycobacterium tuberculosis
VLALATPVVREWLFGTQQQP

SEQ ID NO: 1385859 - protein, 17 aa, Mycobacterium tuberculosis
VMRWRWRVAFYALSALG

SEQ ID NO: 1385860 - protein, 24 aa, Mycobacterium tuberculosis
VMVGGLCIAGALGIMRFLAIFGPV

SEQ ID NO: 1385861 - protein, 18 aa, Mycobacterium tuberculosis
VMVLCGLVVWQIYRPGRD

SEQ ID NO: 1385862 - protein, 17 aa, Mycobacterium tuberculosis
VSIPRAMFWTVLVYVFV

SEQ ID NO: 1385863 - protein, 17 aa, Mycobacterium tuberculosis
VVIRWVVQWGSAMVAGY

SEQ ID NO: 1385864 - protein, 18 aa, Mycobacterium tuberculosis
VVNLRSAPGFSFVSEDLD

SEQ ID NO: 1385865 - protein, 19 aa, Mycobacterium tuberculosis
VVPHVRWPMWLRTAVATAA

SEQ ID NO: 1385866 - protein, 19 aa, Mycobacterium tuberculosis
VYMLWLYQRVMTGPVAEGN

SEQ ID NO: 1385867 - protein, 18 aa, Mycobacterium tuberculosis
WALWVVLAFIVFQAVAAV

SEQ ID NO: 1385868 - protein, 26 aa, Mycobacterium tuberculosis
WCLIRTRWGRRIARLLPFVGLAGLAV

SEQ ID NO: 1385869 - protein, 18 aa, Mycobacterium tuberculosis
WGRRIARLLPFVGLAGLA

SEQ ID NO: 1385870 - protein, 17 aa, Mycobacterium tuberculosis
WGVAGRMVVAWLVTLPL

SEQ ID NO: 1385871 - protein, 17 aa, Mycobacterium tuberculosis
WPAPILVASGVFVLIMM

SEQ ID NO: 1385872 - protein, 19 aa, Mycobacterium tuberculosis
WSSDLSMTWDLLCRSVTHG

SEQ ID NO: 1385873 - protein, 18 aa, Mycobacterium tuberculosis
WWAPRWARRLQTRIGLGE

SEQ ID NO: 1385874 - protein, 18 aa, Mycobacterium tuberculosis
WWLLAMALATLWWVMALT

SEQ ID NO: 1385875 - protein, 28 aa, Mycobacterium tuberculosis
WWLPSSWRPETWWPLGRRRGRAQRTKRK

SEQ ID NO: 1385876 - protein, 22 aa, Mycobacterium tuberculosis
YAARSQLWLSLLSWAVVVGCYL

SEQ ID NO: 1385877 - protein, 19 aa, Mycobacterium tuberculosis
YGRRRSFVFGVTLFVVSSI

SEQ ID NO: 1385878 - protein, 17 aa, Mycobacterium tuberculosis
YRVIGGLVLSFGMVTLL

SEQ ID NO: 1385879 - protein, 21 aa, Mycobacterium tuberculosis
YWYRSIRQPVQFARAVRNAFD

SEQ ID NO: 1385880 - protein, 18 aa, Mycobacterium tuberculosis
AAARPRSSPGWSLGVNPG

SEQ ID NO: 1385881 - protein, 27 aa, Mycobacterium tuberculosis
AAATPGWLEWFINWYLPISQLFYNTVG

SEQ ID NO: 1385882 - protein, 18 aa, Mycobacterium tuberculosis
AAGYLCWRGKDLATPRGW

SEQ ID NO: 1385883 - protein, 21 aa, Mycobacterium tuberculosis
AAIGVLLGWPLWWVSTCSVLV

SEQ ID NO: 1385884 - protein, 19 aa, Mycobacterium tuberculosis
AATIGFDWTLLVLLATFVL

SEQ ID NO: 1385885 - protein, 18 aa, Mycobacterium tuberculosis
AAVWWKALLALAVAVALV

SEQ ID NO: 1385886 - protein, 19 aa, Mycobacterium tuberculosis
ACGLLLCVFIGPAQSSARA

SEQ ID NO: 1385887 - protein, 17 aa, Mycobacterium tuberculosis
ADGLGCYGPPQRALAVM

SEQ ID NO: 1385888 - protein, 17 aa, Mycobacterium tuberculosis
ADLASIWRRCGGRTVTL

SEQ ID NO: 1385889 - protein, 17 aa, Mycobacterium tuberculosis
ADLRLVRQTGLSVNESA

SEQ ID NO: 1385890 - protein, 17 aa, Mycobacterium tuberculosis
ADRAVVVAARLDRAALA

SEQ ID NO: 1385891 - protein, 17 aa, Mycobacterium tuberculosis
ADSFRLALVAAHDDGDS

SEQ ID NO: 1385892 - protein, 21 aa, Mycobacterium tuberculosis
AEGLQYWPWVLLGYFNIGIMI

SEQ ID NO: 1385893 - protein, 19 aa, Mycobacterium tuberculosis
AEHPELWGGLVDLAINDDL

SEQ ID NO: 1385894 - protein, 17 aa, Mycobacterium tuberculosis
AEHPRPDYVLLHISDTH

SEQ ID NO: 1385895 - protein, 17 aa, Mycobacterium tuberculosis
AELGWICVAINYRHSPR

SEQ ID NO: 1385896 - protein, 19 aa, Mycobacterium tuberculosis
AFFTPQFVRWFGLFTTHAI

SEQ ID NO: 1385897 - protein, 18 aa, Mycobacterium tuberculosis
AFIPRFLFAVSFCGVLVA

SEQ ID NO: 1385898 - protein, 18 aa, Mycobacterium tuberculosis
AFTAWEFVDGYDVAQAVV

SEQ ID NO: 1385899 - protein, 18 aa, Mycobacterium tuberculosis
AFWACGLLLCVFIGPAQS

SEQ ID NO: 1385900 - protein, 19 aa, Mycobacterium tuberculosis
AGDHRLRVIGVTWNAEASA

SEQ ID NO: 1385901 - protein, 23 aa, Mycobacterium tuberculosis
AGFFVGWSYWFAWVVTGIADLVA

SEQ ID NO: 1385902 - protein, 24 aa, Mycobacterium tuberculosis
AGIVLACPVWFYQLWAFITPGLYQ

SEQ ID NO: 1385903 - protein, 19 aa, Mycobacterium tuberculosis
AGMYPAWRLGRMTIRTAIR

SEQ ID NO: 1385904 - protein, 20 aa, Mycobacterium tuberculosis
AGMYPAWRLGRMTIRTAIRE

SEQ ID NO: 1385905 - protein, 17 aa, Mycobacterium tuberculosis
AGNKFIARRNLIWSVAA

SEQ ID NO: 1385906 - protein, 22 aa, Mycobacterium tuberculosis
AGRGRPRFSAWYGPCARRAASA

SEQ ID NO: 1385907 - protein, 19 aa, Mycobacterium tuberculosis
AGRPRWQCGVAALGSALVG

SEQ ID NO: 1385908 - protein, 18 aa, Mycobacterium tuberculosis
AGTARLGFLASLRSRPVL

SEQ ID NO: 1385909 - protein, 18 aa, Mycobacterium tuberculosis
AGVLRFVVLDGLAKPGRM

SEQ ID NO: 1385910 - protein, 17 aa, Mycobacterium tuberculosis
AGWRMFVRRDWRYAVVL

SEQ ID NO: 1385911 - protein, 27 aa, Mycobacterium tuberculosis
AIAPRLVPRTPLAPVLPAPSFPADATV

SEQ ID NO: 1385912 - protein, 20 aa, Mycobacterium tuberculosis
AILTLTGRRGWIKPRRDLTS

SEQ ID NO: 1385913 - protein, 17 aa, Mycobacterium tuberculosis
AKLAWFSKFLTIAILGL

SEQ ID NO: 1385914 - protein, 20 aa, Mycobacterium tuberculosis
ALATLLGRWFWWPRRVDRLA

SEQ ID NO: 1385915 - protein, 20 aa, Mycobacterium tuberculosis
ALELRGRILGAFEAAEVSTD

SEQ ID NO: 1385916 - protein, 21 aa, Mycobacterium tuberculosis
ALELRGRILGAFEAAEVSTDH

SEQ ID NO: 1385917 - protein, 19 aa, Mycobacterium tuberculosis
ALFFPWNLYFGFRIPDSSK

SEQ ID NO: 1385918 - protein, 23 aa, Mycobacterium tuberculosis
ALIRARFPTLTARQVMQRIESTA

SEQ ID NO: 1385919 - protein, 22 aa, Mycobacterium tuberculosis
ALLANLFLPWGIAGAAPTALDV

SEQ ID NO: 1385920 - protein, 19 aa, Mycobacterium tuberculosis
ALLCPLLVYGWLGLPRWGL

SEQ ID NO: 1385921 - protein, 17 aa, Mycobacterium tuberculosis
ALRAFGIRECADAARAL

SEQ ID NO: 1385922 - protein, 23 aa, Mycobacterium tuberculosis
ALSAWRFVTVFGVVGLLADVVYE

SEQ ID NO: 1385923 - protein, 23 aa, Mycobacterium tuberculosis
ALSAWRFVTVFGVVSLLADVVYE

SEQ ID NO: 1385924 - protein, 17 aa, Mycobacterium tuberculosis
ALTELWCSYGVQPDLVI

SEQ ID NO: 1385925 - protein, 19 aa, Mycobacterium tuberculosis
AMATLRIAFLSALVLELLA

SEQ ID NO: 1385926 - protein, 17 aa, Mycobacterium tuberculosis
AMQEIPQVFGYDYQTVE

SEQ ID NO: 1385927 - protein, 17 aa, Mycobacterium tuberculosis
ANWWLPSSWRPATWWPL

SEQ ID NO: 1385928 - protein, 26 aa, Mycobacterium tuberculosis
APDQRVTCGLKWPRKWTLKRTTRTSG

SEQ ID NO: 1385929 - protein, 25 aa, Mycobacterium tuberculosis
APDSLIRMCLFLGALTFMYISARAV

SEQ ID NO: 1385930 - protein, 22 aa, Mycobacterium tuberculosis
APEAMWWTLYLACYLAGGWGSA

SEQ ID NO: 1385931 - protein, 19 aa, Mycobacterium tuberculosis
APQWVRWALFLACYATGGW

SEQ ID NO: 1385932 - protein, 22 aa, Mycobacterium tuberculosis
APRCWQARAVSWMWQALAATLV

SEQ ID NO: 1385933 - protein, 24 aa, Mycobacterium tuberculosis
APRDGNVDLAAWVRAAAAHVLPDA

SEQ ID NO: 1385934 - protein, 19 aa, Mycobacterium tuberculosis
APSALRQSFLWGLAGVIAA

SEQ ID NO: 1385935 - protein, 23 aa, Mycobacterium tuberculosis
APTACSPQGWALRPPGAAPSSAG

SEQ ID NO: 1385936 - protein, 19 aa, Mycobacterium tuberculosis
APTWCWPDGPPAGSTDVPG

SEQ ID NO: 1385937 - protein, 17 aa, Mycobacterium tuberculosis
AQIPMYLGYAFRAMNSH

SEQ ID NO: 1385938 - protein, 17 aa, Mycobacterium tuberculosis
AQWRWRWFRAAMCKTMA

SEQ ID NO: 1385939 - protein, 19 aa, Mycobacterium tuberculosis
ARCWLRWERPDWWSESSPA

SEQ ID NO: 1385940 - protein, 18 aa, Mycobacterium tuberculosis
ARKRIAWLVLLANMVLAA

SEQ ID NO: 1385941 - protein, 19 aa, Mycobacterium tuberculosis
ARLKLAIDSGEMGFIPSNA

SEQ ID NO: 1385942 - protein, 20 aa, Mycobacterium tuberculosis
ARPFIPRMIRTFAVPIILGW

SEQ ID NO: 1385943 - protein, 25 aa, Mycobacterium tuberculosis
ARRGVWWAWWPRLWRCALPDRCDPG

SEQ ID NO: 1385944 - protein, 18 aa, Mycobacterium tuberculosis
ASAMLRRNLLIYGLGGLV

SEQ ID NO: 1385945 - protein, 17 aa, Mycobacterium tuberculosis
ASLQRLRPRLGVGAGAP

SEQ ID NO: 1385946 - protein, 20 aa, Mycobacterium tuberculosis
ATGVFLACRWAQADGADHAW

SEQ ID NO: 1385947 - protein, 17 aa, Mycobacterium tuberculosis
ATLPVQFVAGWPILRGA

SEQ ID NO: 1385948 - protein, 19 aa, Mycobacterium tuberculosis
ATQLSVLACAAFIYVTAEI

SEQ ID NO: 1385949 - protein, 17 aa, Mycobacterium tuberculosis
ATRPCLWPRCRPERPAP

SEQ ID NO: 1385950 - protein, 20 aa, Mycobacterium tuberculosis
AVAPRIGAWVVAAWLAGIIL

SEQ ID NO: 1385951 - protein, 25 aa, Mycobacterium tuberculosis
AVFSPVLVCLGVFFFFFYVLWFFFF

SEQ ID NO: 1385952 - protein, 21 aa, Mycobacterium tuberculosis
AVLAVIWCWLLKRYIVEGPLE

SEQ ID NO: 1385953 - protein, 19 aa, Mycobacterium tuberculosis
AVLGLRGRRPVKWNDSITL

SEQ ID NO: 1385954 - protein, 19 aa, Mycobacterium tuberculosis
AVLSGRVTPYWSVAGRCPA

SEQ ID NO: 1385955 - protein, 25 aa, Mycobacterium tuberculosis
AVVGLSLPGTVAWHAVPRWFARNKD

SEQ ID NO: 1385956 - protein, 18 aa, Mycobacterium tuberculosis
AWCSAEFNGAIVVNVPLA

SEQ ID NO: 1385957 - protein, 19 aa, Mycobacterium tuberculosis
AWRNLRFPLAWAPPEADVA

SEQ ID NO: 1385958 - protein, 19 aa, Mycobacterium tuberculosis
AWRNLRFPLAWAPPEPTWR

SEQ ID NO: 1385959 - protein, 22 aa, Mycobacterium tuberculosis
AYPKRMPVALIWLIAALVLVGA

SEQ ID NO: 1385960 - protein, 20 aa, Mycobacterium tuberculosis
CAAGRPCGRDRLAATKTAPI

SEQ ID NO: 1385961 - protein, 21 aa, Mycobacterium tuberculosis
CAGLLPPLLIRHGIDVGIHRH

SEQ ID NO: 1385962 - protein, 17 aa, Mycobacterium tuberculosis
CALAALCYAEFASTLPV

SEQ ID NO: 1385963 - protein, 19 aa, Mycobacterium tuberculosis
CAPAAAGVPVVIPVVNDWP

SEQ ID NO: 1385964 - protein, 18 aa, Mycobacterium tuberculosis
CAPLAIAVMWRWILAPTD

SEQ ID NO: 1385965 - protein, 18 aa, Mycobacterium tuberculosis
CATYPVLAVQAWAAFHDM

SEQ ID NO: 1385966 - protein, 17 aa, Mycobacterium tuberculosis
CGAYKIGSTWHRTTTPT

SEQ ID NO: 1385967 - protein, 17 aa, Mycobacterium tuberculosis
CGFTGLSGYIVWQHHEA

SEQ ID NO: 1385968 - protein, 17 aa, Mycobacterium tuberculosis
CGLVVWQIYRPGRDLVR

SEQ ID NO: 1385969 - protein, 17 aa, Mycobacterium tuberculosis
CGMPRWPGCTCVRPVRC

SEQ ID NO: 1385970 - protein, 19 aa, Mycobacterium tuberculosis
CGRKTPLLCMAMRLRRRAR

SEQ ID NO: 1385971 - protein, 18 aa, Mycobacterium tuberculosis
CLIRTRWGRRIARLLPFV

SEQ ID NO: 1385972 - protein, 18 aa, Mycobacterium tuberculosis
CLSSWMTPYGLRRVCDGF

SEQ ID NO: 1385973 - protein, 17 aa, Mycobacterium tuberculosis
CNFSAWMRLLIRNRFAV

SEQ ID NO: 1385974 - protein, 17 aa, Mycobacterium tuberculosis
CPQTRITGVPGRGPETR

SEQ ID NO: 1385975 - protein, 18 aa, Mycobacterium tuberculosis
CRSHRRYAPLPGDDGVGV

SEQ ID NO: 1385976 - protein, 28 aa, Mycobacterium tuberculosis
CSRIGRGFRCCWSAALARPAIGCADTYT

SEQ ID NO: 1385977 - protein, 18 aa, Mycobacterium tuberculosis
CTPREWMWAVLLAGAVAV

SEQ ID NO: 1385978 - protein, 18 aa, Mycobacterium tuberculosis
CVRRVTLPWVSSGIVGAV

SEQ ID NO: 1385979 - protein, 25 aa, Mycobacterium tuberculosis
DAAWLLAAVWWKALLALAVAVALVI

SEQ ID NO: 1385980 - protein, 20 aa, Mycobacterium tuberculosis
DASVGWLRLGALALALAALA

SEQ ID NO: 1385981 - protein, 22 aa, Mycobacterium tuberculosis
DAWLRLCQTYGWAPGVMGASSQ

SEQ ID NO: 1385982 - protein, 18 aa, Mycobacterium tuberculosis
DDLWRGSRRLRHTAVASW

SEQ ID NO: 1385983 - protein, 17 aa, Mycobacterium tuberculosis
DDVARSFADAGLDSVLS

SEQ ID NO: 1385984 - protein, 27 aa, Mycobacterium tuberculosis
DELAAPRWPWVVGVAAIIAAVALVVSV

SEQ ID NO: 1385985 - protein, 21 aa, Mycobacterium tuberculosis
DERKKRLGVMLATGLIVGESL

SEQ ID NO: 1385986 - protein, 22 aa, Mycobacterium tuberculosis
DERKKRLGVMLATGLIVGESLY

SEQ ID NO: 1385987 - protein, 18 aa, Mycobacterium tuberculosis
DGDYAVAVARIFSTDVRF

SEQ ID NO: 1385988 - protein, 25 aa, Mycobacterium tuberculosis
DHPRSKVGPLRWTRLTEILRGGRSR

SEQ ID NO: 1385989 - protein, 23 aa, Mycobacterium tuberculosis
DIIRFQAEFLWRDYFQPGVSIDG

SEQ ID NO: 1385990 - protein, 18 aa, Mycobacterium tuberculosis
DKPAALWILTRGVHESVA

SEQ ID NO: 1385991 - protein, 26 aa, Mycobacterium tuberculosis
DLARTVLRIMFPLSFVVAILLVSQGV

SEQ ID NO: 1385992 - protein, 23 aa, Mycobacterium tuberculosis
DLTPQCVRRGWAPVVNNVRRIAT

SEQ ID NO: 1385993 - protein, 23 aa, Mycobacterium tuberculosis
DPGIPARGIVAVCDFGGSGTGIT

SEQ ID NO: 1385994 - protein, 25 aa, Mycobacterium tuberculosis
DPKRLLKVRGWRRVGTVVVRWPLPV

SEQ ID NO: 1385995 - protein, 24 aa, Mycobacterium tuberculosis
DPLFLDWLVGLAFPCQRPFGHQYG

SEQ ID NO: 1385996 - protein, 18 aa, Mycobacterium tuberculosis
DPRSCWCWRQGGDHVTGN

SEQ ID NO: 1385997 - protein, 17 aa, Mycobacterium tuberculosis
DRLKIPFGHELKTGNVM

SEQ ID NO: 1385998 - protein, 21 aa, Mycobacterium tuberculosis
DRWNWWLPRWLAHILPSVDFD

SEQ ID NO: 1385999 - protein, 17 aa, Mycobacterium tuberculosis
DSLFRLDHLAARLRRNS

SEQ ID NO: 1386000 - protein, 17 aa, Mycobacterium tuberculosis
DVAQPLAYCLPGVRSRV

SEQ ID NO: 1386001 - protein, 20 aa, Mycobacterium tuberculosis
DVDFAVRICTEITGLVRTLA

SEQ ID NO: 1386002 - protein, 17 aa, Mycobacterium tuberculosis
DVLRPDLTIAYTDTDGY

SEQ ID NO: 1386003 - protein, 20 aa, Mycobacterium tuberculosis
DWLCVVGARRCCRRADHRDA

SEQ ID NO: 1386004 - protein, 18 aa, Mycobacterium tuberculosis
DWMWGRLDGAGWLVHVLL

SEQ ID NO: 1386005 - protein, 20 aa, Mycobacterium tuberculosis
EAEPAAWLRFWFPDPNGSNT

SEQ ID NO: 1386006 - protein, 24 aa, Mycobacterium tuberculosis
EATWKYVVICSVGIAVAFLGTVLL

SEQ ID NO: 1386007 - protein, 21 aa, Mycobacterium tuberculosis
EEERARWSLGRHVKLRGHDQP

SEQ ID NO: 1386008 - protein, 19 aa, Mycobacterium tuberculosis
EFAGYFAWLAWLVLHLVYL

SEQ ID NO: 1386009 - protein, 19 aa, Mycobacterium tuberculosis
EGAHARWNWVLDGMVETKA

SEQ ID NO: 1386010 - protein, 18 aa, Mycobacterium tuberculosis
EGGHTWPLGRCPISSRFI

SEQ ID NO: 1386011 - protein, 17 aa, Mycobacterium tuberculosis
EGRSFRSAVPRGWARAR

SEQ ID NO: 1386012 - protein, 18 aa, Mycobacterium tuberculosis
EIYWRRRGLALGIAVVVV

SEQ ID NO: 1386013 - protein, 23 aa, Mycobacterium tuberculosis
EKPPRLYLAAAWVVIVAGIVFTV

SEQ ID NO: 1386014 - protein, 22 aa, Mycobacterium tuberculosis
ELLKLAVLLALWAAVAGAFVSV

SEQ ID NO: 1386015 - protein, 23 aa, Mycobacterium tuberculosis
ELPASVPVWLVWHIPGGTVWAEE

SEQ ID NO: 1386016 - protein, 25 aa, Mycobacterium tuberculosis
ELPASVPVWLVWHIPGGTVWAEEAA

SEQ ID NO: 1386017 - protein, 21 aa, Mycobacterium tuberculosis
ELWSRLPSCLAIGAAAAGVVV

SEQ ID NO: 1386018 - protein, 20 aa, Mycobacterium tuberculosis
EPDLRAIIELGYDRTGYADV

SEQ ID NO: 1386019 - protein, 22 aa, Mycobacterium tuberculosis
EPICPPCGSFIRSYASDIDTAV

SEQ ID NO: 1386020 - protein, 17 aa, Mycobacterium tuberculosis
ERQRLRDLFGRYVGEDV

SEQ ID NO: 1386021 - protein, 19 aa, Mycobacterium tuberculosis
ETESRFTLIYGNRTKESTM

SEQ ID NO: 1386022 - protein, 18 aa, Mycobacterium tuberculosis
ETIFRFALYAFLCATALM

SEQ ID NO: 1386023 - protein, 17 aa, Mycobacterium tuberculosis
ETLGRTCWRGERRAWIE

SEQ ID NO: 1386024 - protein, 24 aa, Mycobacterium tuberculosis
ETLLVVLCGVGFYIGFVGSYQRMA

SEQ ID NO: 1386025 - protein, 22 aa, Mycobacterium tuberculosis
EVGYRLRVRMALDEGRYKIAKL

SEQ ID NO: 1386026 - protein, 17 aa, Mycobacterium tuberculosis
EVLAIKPDICFLWDEAW

SEQ ID NO: 1386027 - protein, 18 aa, Mycobacterium tuberculosis
EYVLRCARFSAGSPATAR

SEQ ID NO: 1386028 - protein, 18 aa, Mycobacterium tuberculosis
FAALRIAASYALWPFGRT

SEQ ID NO: 1386029 - protein, 23 aa, Mycobacterium tuberculosis
FAALRIAASYALWPFGRTIVEKP

SEQ ID NO: 1386030 - protein, 17 aa, Mycobacterium tuberculosis
FADSLLRGWQAKKRTST

SEQ ID NO: 1386031 - protein, 25 aa, Mycobacterium tuberculosis
FAFFGWRWSLPLGVAILLAAVGGGL

SEQ ID NO: 1386032 - protein, 17 aa, Mycobacterium tuberculosis
FAQAAAVPVVFLTAWYG

SEQ ID NO: 1386033 - protein, 17 aa, Mycobacterium tuberculosis
FASLWSWFIGLVVTEFP

SEQ ID NO: 1386034 - protein, 18 aa, Mycobacterium tuberculosis
FASLWSWFIGLVVTEFPL

SEQ ID NO: 1386035 - protein, 17 aa, Mycobacterium tuberculosis
FASVNGWWYVSNFGVPW

SEQ ID NO: 1386036 - protein, 19 aa, Mycobacterium tuberculosis
FAVIACRTYRDPIAGLTLS

SEQ ID NO: 1386037 - protein, 17 aa, Mycobacterium tuberculosis
FAVRICTEITGLVRTLA

SEQ ID NO: 1386038 - protein, 19 aa, Mycobacterium tuberculosis
FDQLWRWNSIVSLVLSVMV

SEQ ID NO: 1386039 - protein, 17 aa, Mycobacterium tuberculosis
FFFFFFFFFSFFYFFFF

SEQ ID NO: 1386040 - protein, 29 aa, Mycobacterium tuberculosis
FFFFFFFSFFYFFFFFLFKKKKKKKKKKK

SEQ ID NO: 1386041 - protein, 17 aa, Mycobacterium tuberculosis
FFTMWGFFILLTVYIED

SEQ ID NO: 1386042 - protein, 20 aa, Mycobacterium tuberculosis
FFVGWSYWFAWVVTGIADLV

SEQ ID NO: 1386043 - protein, 17 aa, Mycobacterium tuberculosis
FGALYAVSALGGSVLVY

SEQ ID NO: 1386044 - protein, 17 aa, Mycobacterium tuberculosis
FGQLPLPLGVVGHEGST

SEQ ID NO: 1386045 - protein, 17 aa, Mycobacterium tuberculosis
FGSPVFAVCCVLSFVVG

SEQ ID NO: 1386046 - protein, 18 aa, Mycobacterium tuberculosis
FGVRITRILALLLAVLLA

SEQ ID NO: 1386047 - protein, 18 aa, Mycobacterium tuberculosis
FIRKPARWMQLLAKHQAP

SEQ ID NO: 1386048 - protein, 20 aa, Mycobacterium tuberculosis
FKGPAANIWADYTAAHIGTQ

SEQ ID NO: 1386049 - protein, 17 aa, Mycobacterium tuberculosis
FKNGVGLMLQLPQATVV

SEQ ID NO: 1386050 - protein, 17 aa, Mycobacterium tuberculosis
FPSELSVLFKNLETKGN

SEQ ID NO: 1386051 - protein, 18 aa, Mycobacterium tuberculosis
FRRSELMLALATTAAVLG

SEQ ID NO: 1386052 - protein, 17 aa, Mycobacterium tuberculosis
FRSEWRRPVELSTSVPE

SEQ ID NO: 1386053 - protein, 21 aa, Mycobacterium tuberculosis
FSLRRCHGWPANWPLRECLRS

SEQ ID NO: 1386054 - protein, 17 aa, Mycobacterium tuberculosis
FVAAYVPYVAWLVQASS

SEQ ID NO: 1386055 - protein, 18 aa, Mycobacterium tuberculosis
FVMLRLAPGLGRLLGPIG

SEQ ID NO: 1386056 - protein, 18 aa, Mycobacterium tuberculosis
FVVLDGLAKPGRMVGPDP

SEQ ID NO: 1386057 - protein, 19 aa, Mycobacterium tuberculosis
FWIRRARRLLPALVLMVLT

SEQ ID NO: 1386058 - protein, 18 aa, Mycobacterium tuberculosis
FWRRAGTRIVRRPKAYLG

SEQ ID NO: 1386059 - protein, 22 aa, Mycobacterium tuberculosis
FYKRSWRANDWMWGRLDGAGWL

SEQ ID NO: 1386060 - protein, 19 aa, Mycobacterium tuberculosis
FYLTCVVFVFGVLGVLLRI

SEQ ID NO: 1386061 - protein, 17 aa, Mycobacterium tuberculosis
FYRTCVLTGKALVRRPF

SEQ ID NO: 1386062 - protein, 18 aa, Mycobacterium tuberculosis
FYTGHYFGAWVFIAGFLL

SEQ ID NO: 1386063 - protein, 17 aa, Mycobacterium tuberculosis
GAAGCWQPITRDLWPAP

SEQ ID NO: 1386064 - protein, 17 aa, Mycobacterium tuberculosis
GACVVWFFVLFDMLDGA

SEQ ID NO: 1386065 - protein, 18 aa, Mycobacterium tuberculosis
GAFAHRWLARRTRRRINP

SEQ ID NO: 1386066 - protein, 25 aa, Mycobacterium tuberculosis
GAFYKRSWRANDWMWGRLDGAGWLV

SEQ ID NO: 1386067 - protein, 18 aa, Mycobacterium tuberculosis
GAGALGFVGTAGKESVGQ

SEQ ID NO: 1386068 - protein, 18 aa, Mycobacterium tuberculosis
GAGALGFVVIFWQGVGWA

SEQ ID NO: 1386069 - protein, 18 aa, Mycobacterium tuberculosis
GAGGNGWAAEGITVGIGE

SEQ ID NO: 1386070 - protein, 24 aa, Mycobacterium tuberculosis
GARVPRPGCFEVILVAPRPAATSP

SEQ ID NO: 1386071 - protein, 17 aa, Mycobacterium tuberculosis
GCLRVRASITISPDDLV

SEQ ID NO: 1386072 - protein, 21 aa, Mycobacterium tuberculosis
GDCCLDWGMNIGRHCFSDYAM

SEQ ID NO: 1386073 - protein, 27 aa, Mycobacterium tuberculosis
GDVLVRKGSWCWCCSRAPTSIPSTSLT

SEQ ID NO: 1386074 - protein, 17 aa, Mycobacterium tuberculosis
GEKNMPFWGTSFSAAYV

SEQ ID NO: 1386075 - protein, 22 aa, Mycobacterium tuberculosis
GELPRRGALALGCIALLLMGIV

SEQ ID NO: 1386076 - protein, 17 aa, Mycobacterium tuberculosis
GGFLLMWILAWLTAAPV

SEQ ID NO: 1386077 - protein, 22 aa, Mycobacterium tuberculosis
GGGRLAPRPVFRPPVDPASGQA

SEQ ID NO: 1386078 - protein, 18 aa, Mycobacterium tuberculosis
GGPLPRGRGLLMAEDTGV

SEQ ID NO: 1386079 - protein, 28 aa, Mycobacterium tuberculosis
GGWLTDYLSWRWAFWINVPVSIAVLTVA

SEQ ID NO: 1386080 - protein, 18 aa, Mycobacterium tuberculosis
GIVEGWRGTIVHRVEIDV

SEQ ID NO: 1386081 - protein, 19 aa, Mycobacterium tuberculosis
GKCHPAILPPLFGCNDRAM

SEQ ID NO: 1386082 - protein, 19 aa, Mycobacterium tuberculosis
GKCHPVILPPLFGCNDRAM

SEQ ID NO: 1386083 - protein, 22 aa, Mycobacterium tuberculosis
GKSELWPDLNLGLPFTYHQGYQ

SEQ ID NO: 1386084 - protein, 18 aa, Mycobacterium tuberculosis
GKSTHRWVSGPAGVDQQL

SEQ ID NO: 1386085 - protein, 17 aa, Mycobacterium tuberculosis
GKVFNEFDSNSIAMVVL

SEQ ID NO: 1386086 - protein, 21 aa, Mycobacterium tuberculosis
GLARRPARRFGAGRSPALART

SEQ ID NO: 1386087 - protein, 19 aa, Mycobacterium tuberculosis
GLFDTWPGLILPYITFALP

SEQ ID NO: 1386088 - protein, 17 aa, Mycobacterium tuberculosis
GLGSLMSWMFYVGLIIT

SEQ ID NO: 1386089 - protein, 17 aa, Mycobacterium tuberculosis
GMYPAWRLGRMTIRTAI

SEQ ID NO: 1386090 - protein, 18 aa, Mycobacterium tuberculosis
GPDWRLVLRGGPAEVVLD

SEQ ID NO: 1386091 - protein, 24 aa, Mycobacterium tuberculosis
GPGRYGLDAARGWAHRPFIGSFVA

SEQ ID NO: 1386092 - protein, 21 aa, Mycobacterium tuberculosis
GPLHLGGICWRGRNQRPVITG

SEQ ID NO: 1386093 - protein, 22 aa, Mycobacterium tuberculosis
GPLHLGGICWRGRNQRPVITGT

SEQ ID NO: 1386094 - protein, 22 aa, Mycobacterium tuberculosis
GPMLGISVAVVFFAAVTLLPAL

SEQ ID NO: 1386095 - protein, 18 aa, Mycobacterium tuberculosis
GPRRARSGAGTGLAGVAA

SEQ ID NO: 1386096 - protein, 20 aa, Mycobacterium tuberculosis
GQPAWSWAVLGLRGRRPVKW

SEQ ID NO: 1386097 - protein, 18 aa, Mycobacterium tuberculosis
GQTARLYIRPVLNSMPAQ

SEQ ID NO: 1386098 - protein, 20 aa, Mycobacterium tuberculosis
GRAASLPSYIVFLTLQTADG

SEQ ID NO: 1386099 - protein, 29 aa, Mycobacterium tuberculosis
GRCRRLWPRSAPMLAAWAVVEGCLMAVFF

SEQ ID NO: 1386100 - protein, 18 aa, Mycobacterium tuberculosis
GRGDFFAVVRSLALFVNA

SEQ ID NO: 1386101 - protein, 18 aa, Mycobacterium tuberculosis
GRTAQAWARRHQQLRAAL

SEQ ID NO: 1386102 - protein, 18 aa, Mycobacterium tuberculosis
GRTPLPPRRDWQLDTLDT

SEQ ID NO: 1386103 - protein, 20 aa, Mycobacterium tuberculosis
GRVPVCKMLPFATRLISVFF

SEQ ID NO: 1386104 - protein, 21 aa, Mycobacterium tuberculosis
GRVTAVLVCRRLVPAAHGSTL

SEQ ID NO: 1386105 - protein, 17 aa, Mycobacterium tuberculosis
GRVTPYWSVAGRCPAAH

SEQ ID NO: 1386106 - protein, 23 aa, Mycobacterium tuberculosis
GRWSGRAARTWCPDCSAGCPSPV

SEQ ID NO: 1386107 - protein, 18 aa, Mycobacterium tuberculosis
GSGPRFTAPMSKTGVPYG

SEQ ID NO: 1386108 - protein, 19 aa, Mycobacterium tuberculosis
GTLSWCSPLGWSLQVRPYA

SEQ ID NO: 1386109 - protein, 21 aa, Mycobacterium tuberculosis
GVALCAGLWFIGRRVIATVGH

SEQ ID NO: 1386110 - protein, 20 aa, Mycobacterium tuberculosis
GVGLLGWAWVVAGAVDLLTT

SEQ ID NO: 1386111 - protein, 18 aa, Mycobacterium tuberculosis
GVPLEWNVFFIFSLCYLF

SEQ ID NO: 1386112 - protein, 17 aa, Mycobacterium tuberculosis
GVVLIRLGVAAAGDRLP

SEQ ID NO: 1386113 - protein, 24 aa, Mycobacterium tuberculosis
GVVVGGPFLPLAIILYWFSNNIWT

SEQ ID NO: 1386114 - protein, 20 aa, Mycobacterium tuberculosis
GYLVLRPSWSPTQASGQTVL

SEQ ID NO: 1386115 - protein, 17 aa, Mycobacterium tuberculosis
GYYEWREGLLRGLAAHH

SEQ ID NO: 1386116 - protein, 18 aa, Mycobacterium tuberculosis
HALSLPIILFWVALTIVV

SEQ ID NO: 1386117 - protein, 17 aa, Mycobacterium tuberculosis
HAPWARWRYTRHPEKMR

SEQ ID NO: 1386118 - protein, 18 aa, Mycobacterium tuberculosis
HCGAPWCGIVVMKIMFIS

SEQ ID NO: 1386119 - protein, 24 aa, Mycobacterium tuberculosis
HDIRVVCSWCWVRSLRLFRSIYMI

SEQ ID NO: 1386120 - protein, 18 aa, Mycobacterium tuberculosis
HGKWPWQMTHPMDDAVQI

SEQ ID NO: 1386121 - protein, 17 aa, Mycobacterium tuberculosis
HGPGWPSAARSFDVYPP

SEQ ID NO: 1386122 - protein, 17 aa, Mycobacterium tuberculosis
HKGAGRWHGRGHVTMFA

SEQ ID NO: 1386123 - protein, 20 aa, Mycobacterium tuberculosis
HKIFFIFFFFYFLKKKKKKK

SEQ ID NO: 1386124 - protein, 22 aa, Mycobacterium tuberculosis
HLDPGPFLSYGIQWISFGILAP

SEQ ID NO: 1386125 - protein, 18 aa, Mycobacterium tuberculosis
HRAKGGGLSTLFGGGVQS

SEQ ID NO: 1386126 - protein, 18 aa, Mycobacterium tuberculosis
HWSRRPASTQSWFWSAGS

SEQ ID NO: 1386127 - protein, 22 aa, Mycobacterium tuberculosis
IAAEHPELWGGLVDLAINDDLG

SEQ ID NO: 1386128 - protein, 18 aa, Mycobacterium tuberculosis
IAALFAWGISFMGRARGQ

SEQ ID NO: 1386129 - protein, 21 aa, Mycobacterium tuberculosis
IAALLGRWFWWPLRVRSRPAR

SEQ ID NO: 1386130 - protein, 21 aa, Mycobacterium tuberculosis
IAALMGRWFWWPLRVRSRPAR

SEQ ID NO: 1386131 - protein, 18 aa, Mycobacterium tuberculosis
IAQLRWPVAIAVGPALTY

SEQ ID NO: 1386132 - protein, 22 aa, Mycobacterium tuberculosis
IARRSGTPISFWKFTRKGAVVT

SEQ ID NO: 1386133 - protein, 21 aa, Mycobacterium tuberculosis
IARSQPWFRRYMTTYLLFVPI

SEQ ID NO: 1386134 - protein, 22 aa, Mycobacterium tuberculosis
IAVLLGRWFWWPQRVRPRPASR

SEQ ID NO: 1386135 - protein, 22 aa, Mycobacterium tuberculosis
IAVRIPPRFWWPQRVRPRPASR

SEQ ID NO: 1386136 - protein, 17 aa, Mycobacterium tuberculosis
ICYAELASAVPISGSAY

SEQ ID NO: 1386137 - protein, 18 aa, Mycobacterium tuberculosis
IDQRLKRFGAMAAAMVLY

SEQ ID NO: 1386138 - protein, 17 aa, Mycobacterium tuberculosis
IGLPLALVSKLSTAARR

SEQ ID NO: 1386139 - protein, 23 aa, Mycobacterium tuberculosis
IGLSFLGLCHLWAGSPEAPESRL

SEQ ID NO: 1386140 - protein, 32 aa, Mycobacterium tuberculosis
IGPPRLPCGLPRPAACAVAWVPRRSSPLRTED

SEQ ID NO: 1386141 - protein, 24 aa, Mycobacterium tuberculosis
IKRWFPGFMTFRFLECGLLTMVSN

SEQ ID NO: 1386142 - protein, 23 aa, Mycobacterium tuberculosis
IKRWFRWFLTFLFLECGFVTIVS

SEQ ID NO: 1386143 - protein, 20 aa, Mycobacterium tuberculosis
ILGWASGLGFGWINTLGTAN

SEQ ID NO: 1386144 - protein, 18 aa, Mycobacterium tuberculosis
ILLCWLGFTVFVSVAVPP

SEQ ID NO: 1386145 - protein, 19 aa, Mycobacterium tuberculosis
ILLLEVLFLRWLLDGRASR

SEQ ID NO: 1386146 - protein, 18 aa, Mycobacterium tuberculosis
ILTLTGRRGWIKPRRDLT

SEQ ID NO: 1386147 - protein, 19 aa, Mycobacterium tuberculosis
ILYRLYRPLIFALYCLPLN

SEQ ID NO: 1386148 - protein, 24 aa, Mycobacterium tuberculosis
INCQRAIPHVVGWYQAYKDSGLAV

SEQ ID NO: 1386149 - protein, 19 aa, Mycobacterium tuberculosis
INWKWIRRSLYLTAAVVIL

SEQ ID NO: 1386150 - protein, 17 aa, Mycobacterium tuberculosis
IPFALCFAFGKMVHDRR

SEQ ID NO: 1386151 - protein, 17 aa, Mycobacterium tuberculosis
IPMYLGYAFRAMNSHGR

SEQ ID NO: 1386152 - protein, 17 aa, Mycobacterium tuberculosis
IPVCWSLRSVFDTLDGI

SEQ ID NO: 1386153 - protein, 20 aa, Mycobacterium tuberculosis
IPVSIALLWSLRFGPRVLGP

SEQ ID NO: 1386154 - protein, 20 aa, Mycobacterium tuberculosis
IRLARRVWPDSGWEELGPRP

SEQ ID NO: 1386155 - protein, 22 aa, Mycobacterium tuberculosis
ISAPRAKLFAALFLILALVVVG

SEQ ID NO: 1386156 - protein, 24 aa, Mycobacterium tuberculosis
ITPSEAFTAWEFVDGYDVAQAVVV

SEQ ID NO: 1386157 - protein, 24 aa, Mycobacterium tuberculosis
ITRSFALVRHGFWRVLGIRLLTVL

SEQ ID NO: 1386158 - protein, 17 aa, Mycobacterium tuberculosis
ITRWFAVRWGAERSLVV

SEQ ID NO: 1386159 - protein, 20 aa, Mycobacterium tuberculosis
IVDPEFGYDIGFFVFDLPFY

SEQ ID NO: 1386160 - protein, 23 aa, Mycobacterium tuberculosis
IVSFSASCVVVFLIFQNSIRLTC

SEQ ID NO: 1386161 - protein, 19 aa, Mycobacterium tuberculosis
IVVALLFRPWTLSGFSTTS

SEQ ID NO: 1386162 - protein, 19 aa, Mycobacterium tuberculosis
KDSFPASFIVKLEKPRAAQ

SEQ ID NO: 1386163 - protein, 18 aa, Mycobacterium tuberculosis
KEGLTRLAADLSPAAGEL

SEQ ID NO: 1386164 - protein, 18 aa, Mycobacterium tuberculosis
KEKARAIGIWTAIASIGT

SEQ ID NO: 1386165 - protein, 18 aa, Mycobacterium tuberculosis
KGGSTFLGMEKLPHTAAV

SEQ ID NO: 1386166 - protein, 20 aa, Mycobacterium tuberculosis
KHCYDIPVCWSLRSVFDTLD

SEQ ID NO: 1386167 - protein, 18 aa, Mycobacterium tuberculosis
KKRWLPGIADGSLTMAFA

SEQ ID NO: 1386168 - protein, 18 aa, Mycobacterium tuberculosis
KLLQLRTFPTIAIGGDLA

SEQ ID NO: 1386169 - protein, 18 aa, Mycobacterium tuberculosis
KLQNPSWRPGAWACRLVV

SEQ ID NO: 1386170 - protein, 18 aa, Mycobacterium tuberculosis
KPLYGSSLVTGWARLHGY

SEQ ID NO: 1386171 - protein, 20 aa, Mycobacterium tuberculosis
KRFGDTMGYRLVIYPEYASL

SEQ ID NO: 1386172 - protein, 26 aa, Mycobacterium tuberculosis
KSPPIPWYRLPAVIITGTTVAVLLVG

SEQ ID NO: 1386173 - protein, 18 aa, Mycobacterium tuberculosis
KTIVRIVAPIAMPGIVSG

SEQ ID NO: 1386174 - protein, 23 aa, Mycobacterium tuberculosis
KYFLEFFEQFGFSPAVTVVLALV

SEQ ID NO: 1386175 - protein, 20 aa, Mycobacterium tuberculosis
LAAGLVCWLLLSREVLPRLG

SEQ ID NO: 1386176 - protein, 21 aa, Mycobacterium tuberculosis
LAALCYAEFASTLPVAGSAYT

SEQ ID NO: 1386177 - protein, 19 aa, Mycobacterium tuberculosis
LAATIARRLGLTGALGTVA

SEQ ID NO: 1386178 - protein, 17 aa, Mycobacterium tuberculosis
LAAYAFARLQFRGRDAL

SEQ ID NO: 1386179 - protein, 18 aa, Mycobacterium tuberculosis
LACCLDGRPPIVPHRRRR

SEQ ID NO: 1386180 - protein, 18 aa, Mycobacterium tuberculosis
LACPVWFYQLWAFITPGL

SEQ ID NO: 1386181 - protein, 18 aa, Mycobacterium tuberculosis
LAGCPECRGAVTELCGVP

SEQ ID NO: 1386182 - protein, 17 aa, Mycobacterium tuberculosis
LALAGVSAWLITRAWQM

SEQ ID NO: 1386183 - protein, 18 aa, Mycobacterium tuberculosis
LALATPVVREWLFGTQQQ

SEQ ID NO: 1386184 - protein, 17 aa, Mycobacterium tuberculosis
LALFAGILLGLFYLVAV

SEQ ID NO: 1386185 - protein, 26 aa, Mycobacterium tuberculosis
LANAKRWGVLHVIWRQGYYPGIGAPS

SEQ ID NO: 1386186 - protein, 18 aa, Mycobacterium tuberculosis
LAPGLGRLLGPIGRMAPR

SEQ ID NO: 1386187 - protein, 18 aa, Mycobacterium tuberculosis
LARIWPPWEFYFWHHTIP

SEQ ID NO: 1386188 - protein, 21 aa, Mycobacterium tuberculosis
LATGCLRVRASITISPDDLVS

SEQ ID NO: 1386189 - protein, 20 aa, Mycobacterium tuberculosis
LAVAVLARWRFRRRPAPARL

SEQ ID NO: 1386190 - protein, 19 aa, Mycobacterium tuberculosis
LCETFPTCLERGAGIPAVE

SEQ ID NO: 1386191 - protein, 18 aa, Mycobacterium tuberculosis
LCGLVVWQIYRPGRDLVR

SEQ ID NO: 1386192 - protein, 17 aa, Mycobacterium tuberculosis
LCLFTAVFIMLRRKRIP

SEQ ID NO: 1386193 - protein, 18 aa, Mycobacterium tuberculosis
LDSLFRLDHLVARLRRNS

SEQ ID NO: 1386194 - protein, 19 aa, Mycobacterium tuberculosis
LFAAMGFAGYFAMLALPAM

SEQ ID NO: 1386195 - protein, 17 aa, Mycobacterium tuberculosis
LFGVLFVLLRRGRVAGL

SEQ ID NO: 1386196 - protein, 17 aa, Mycobacterium tuberculosis
LFRARWAKCPSNTTPTS

SEQ ID NO: 1386197 - protein, 19 aa, Mycobacterium tuberculosis
LFVAAYVPYVAWLVQASAD

SEQ ID NO: 1386198 - protein, 17 aa, Mycobacterium tuberculosis
LGDRYGRRRSFVFGVTL

SEQ ID NO: 1386199 - protein, 18 aa, Mycobacterium tuberculosis
LGDWTIFYWGWWISWAPF

SEQ ID NO: 1386200 - protein, 17 aa, Mycobacterium tuberculosis
LGEASAFLLAMKDTATT

SEQ ID NO: 1386201 - protein, 17 aa, Mycobacterium tuberculosis
LGFPVPIRHWLRAGELL

SEQ ID NO: 1386202 - protein, 18 aa, Mycobacterium tuberculosis
LGGWLIGAYGWRWIFLVN

SEQ ID NO: 1386203 - protein, 29 aa, Mycobacterium tuberculosis
LGGWLTDYLSWRWAFWINVPVSISVLTVA

SEQ ID NO: 1386204 - protein, 17 aa, Mycobacterium tuberculosis
LGIALAHPWRSSGPRTS

SEQ ID NO: 1386205 - protein, 17 aa, Mycobacterium tuberculosis
LGLCTVPAALAMAVLAL

SEQ ID NO: 1386206 - protein, 17 aa, Mycobacterium tuberculosis
LGLMFGFGGMLVTIPAS

SEQ ID NO: 1386207 - protein, 21 aa, Mycobacterium tuberculosis
LGLSWRWLFGLSIIPALISLI

SEQ ID NO: 1386208 - protein, 17 aa, Mycobacterium tuberculosis
LGLWRWAFGVMTLLTAL

SEQ ID NO: 1386209 - protein, 20 aa, Mycobacterium tuberculosis
LGMSVARGFVEAMGGTISAT

SEQ ID NO: 1386210 - protein, 26 aa, Mycobacterium tuberculosis
LGRLIVRRPWVVIAFWVALAGLLAPT

SEQ ID NO: 1386211 - protein, 21 aa, Mycobacterium tuberculosis
LGTFSRYWLAAAFGVTALVLS

SEQ ID NO: 1386212 - protein, 19 aa, Mycobacterium tuberculosis
LGWYFLRIPSLVGIGRYTL

SEQ ID NO: 1386213 - protein, 18 aa, Mycobacterium tuberculosis
LHHFGAFYKRSWRANDWM

SEQ ID NO: 1386214 - protein, 34 aa, Mycobacterium tuberculosis
LHHFGAFYKRSWRANDWMWGRLDGAGWLVHVLLD

SEQ ID NO: 1386215 - protein, 18 aa, Mycobacterium tuberculosis
LKIPFGHELKTGNVMYLD

SEQ ID NO: 1386216 - protein, 17 aa, Mycobacterium tuberculosis
LKLAVLLALWAAVAGAF

SEQ ID NO: 1386217 - protein, 18 aa, Mycobacterium tuberculosis
LKTFLLLVGMSALIVAVG

SEQ ID NO: 1386218 - protein, 19 aa, Mycobacterium tuberculosis
LLAAWGWFTSLLVITGTIA

SEQ ID NO: 1386219 - protein, 17 aa, Mycobacterium tuberculosis
LLAGSFLLALLAVTAAN

SEQ ID NO: 1386220 - protein, 17 aa, Mycobacterium tuberculosis
LLEAIGMRLRDMLWAAI

SEQ ID NO: 1386221 - protein, 17 aa, Mycobacterium tuberculosis
LLELSWEALERAGIDPT

SEQ ID NO: 1386222 - protein, 19 aa, Mycobacterium tuberculosis
LLFKRNICHQAIFYRRGLF

SEQ ID NO: 1386223 - protein, 18 aa, Mycobacterium tuberculosis
LLGKWFWWPQVVRQRPVP

SEQ ID NO: 1386224 - protein, 19 aa, Mycobacterium tuberculosis
LLHDWRDVFWINVPLTAIA

SEQ ID NO: 1386225 - protein, 17 aa, Mycobacterium tuberculosis
LLIGIVVALALVSAMTA

SEQ ID NO: 1386226 - protein, 18 aa, Mycobacterium tuberculosis
LLKLAVLLALWAAVAGAF

SEQ ID NO: 1386227 - protein, 19 aa, Mycobacterium tuberculosis
LLLEVAWEALEHAGIPPGT

SEQ ID NO: 1386228 - protein, 20 aa, Mycobacterium tuberculosis
LLRVTRWDVGLAMLIAGGVN

SEQ ID NO: 1386229 - protein, 17 aa, Mycobacterium tuberculosis
LLVRGGVVFQRLLAQRA

SEQ ID NO: 1386230 - protein, 24 aa, Mycobacterium tuberculosis
LMTPLRVMFAIALVFLALGWSTKA

SEQ ID NO: 1386231 - protein, 20 aa, Mycobacterium tuberculosis
LMVSTSLAWTGRVAPPGTFG

SEQ ID NO: 1386232 - protein, 17 aa, Mycobacterium tuberculosis
LPDFKWPPTPGSPLFPA

SEQ ID NO: 1386233 - protein, 20 aa, Mycobacterium tuberculosis
LPFPLSSAILPRFFYTKEIG

SEQ ID NO: 1386234 - protein, 17 aa, Mycobacterium tuberculosis
LPGRCWPVSATATATWA

SEQ ID NO: 1386235 - protein, 23 aa, Mycobacterium tuberculosis
LPGSAPRPAWLRAFAHPERDKQV

SEQ ID NO: 1386236 - protein, 22 aa, Mycobacterium tuberculosis
LPGSAPRPAWLRAFAHPERDKR

SEQ ID NO: 1386237 - protein, 17 aa, Mycobacterium tuberculosis
LPLFGLAGLPSYDRWDD

SEQ ID NO: 1386238 - protein, 17 aa, Mycobacterium tuberculosis
LPLFGYAAMPAYDVVDG

SEQ ID NO: 1386239 - protein, 17 aa, Mycobacterium tuberculosis
LPPPLVFAAEPAKTGAD

SEQ ID NO: 1386240 - protein, 19 aa, Mycobacterium tuberculosis
LPQTRWIPVVTFVQVSADM

SEQ ID NO: 1386241 - protein, 22 aa, Mycobacterium tuberculosis
LPTFSARVFVLVAFNIYIVITF

SEQ ID NO: 1386242 - protein, 17 aa, Mycobacterium tuberculosis
LPVPRYLAGQSFWRTPS

SEQ ID NO: 1386243 - protein, 17 aa, Mycobacterium tuberculosis
LPVQFVAGWPILRGAVQ

SEQ ID NO: 1386244 - protein, 21 aa, Mycobacterium tuberculosis
LQMAFRFWAFRRWVFPDEFAR

SEQ ID NO: 1386245 - protein, 20 aa, Mycobacterium tuberculosis
LQVVPWRGALGSVISVGAQQ

SEQ ID NO: 1386246 - protein, 17 aa, Mycobacterium tuberculosis
LRFPLAWAPPEADVARI

SEQ ID NO: 1386247 - protein, 18 aa, Mycobacterium tuberculosis
LRGRATLYLTYWTAGDTR

SEQ ID NO: 1386248 - protein, 20 aa, Mycobacterium tuberculosis
LRGRRVIKMVQAMRHGVLPK

SEQ ID NO: 1386249 - protein, 18 aa, Mycobacterium tuberculosis
LRHGWALAAICFVAVGIG

SEQ ID NO: 1386250 - protein, 20 aa, Mycobacterium tuberculosis
LRIAASYALWPFGRTIVEKP

SEQ ID NO: 1386251 - protein, 17 aa, Mycobacterium tuberculosis
LRITRWFAVRWGAERSL

SEQ ID NO: 1386252 - protein, 19 aa, Mycobacterium tuberculosis
LRLAVVFLCAAAISAAVVT

SEQ ID NO: 1386253 - protein, 17 aa, Mycobacterium tuberculosis
LRLCQTYGWAPGVMGAS

SEQ ID NO: 1386254 - protein, 17 aa, Mycobacterium tuberculosis
LRLDWLMWFAAISPGYA

SEQ ID NO: 1386255 - protein, 19 aa, Mycobacterium tuberculosis
LRLPATFGIGTYGVSADFV

SEQ ID NO: 1386256 - protein, 28 aa, Mycobacterium tuberculosis
LRLRWSWRGLRLGLMFGFGGMLVTIPAS

SEQ ID NO: 1386257 - protein, 23 aa, Mycobacterium tuberculosis
LRPEPLIALGVLVTWVLVERSIA

SEQ ID NO: 1386258 - protein, 20 aa, Mycobacterium tuberculosis
LRPLGFRPALGFSRVDTTIS

SEQ ID NO: 1386259 - protein, 17 aa, Mycobacterium tuberculosis
LRRHSLPLFGYAAMPAY

SEQ ID NO: 1386260 - protein, 18 aa, Mycobacterium tuberculosis
LRRPIVVWWIVWIVSNAI

SEQ ID NO: 1386261 - protein, 17 aa, Mycobacterium tuberculosis
LRSLGISDPGNWMSIGC

SEQ ID NO: 1386262 - protein, 20 aa, Mycobacterium tuberculosis
LRSYFYWEHHCFDIPLCSAT

SEQ ID NO: 1386263 - protein, 19 aa, Mycobacterium tuberculosis
LRTRSEMIAQLVFAMGGRA

SEQ ID NO: 1386264 - protein, 17 aa, Mycobacterium tuberculosis
LRVAGALRNVIAVLTTA

SEQ ID NO: 1386265 - protein, 19 aa, Mycobacterium tuberculosis
LRVTRWDVGLAMLIAGGVN

SEQ ID NO: 1386266 - protein, 17 aa, Mycobacterium tuberculosis
LRYDQFMALGWKLLIPV

SEQ ID NO: 1386267 - protein, 18 aa, Mycobacterium tuberculosis
LSFARLTLFHTMGPPLAI

SEQ ID NO: 1386268 - protein, 19 aa, Mycobacterium tuberculosis
LSFTRLPYFQSLGIPASIG

SEQ ID NO: 1386269 - protein, 17 aa, Mycobacterium tuberculosis
LTAVPLWIAFALGAKPA

SEQ ID NO: 1386270 - protein, 21 aa, Mycobacterium tuberculosis
LTGQEAFVWIGLHEPDENQMQ

SEQ ID NO: 1386271 - protein, 17 aa, Mycobacterium tuberculosis
LTLTGRRGWIKPRRDLT

SEQ ID NO: 1386272 - protein, 19 aa, Mycobacterium tuberculosis
LTRMQRFWISLYFPLTMRS

SEQ ID NO: 1386273 - protein, 23 aa, Mycobacterium tuberculosis
LVFFCVLDVFLFFVVFLFFFFFF

SEQ ID NO: 1386274 - protein, 17 aa, Mycobacterium tuberculosis
LVGGLWAWIAPPIHAVV

SEQ ID NO: 1386275 - protein, 18 aa, Mycobacterium tuberculosis
LVIPCLLLAWAVSHPSLP

SEQ ID NO: 1386276 - protein, 17 aa, Mycobacterium tuberculosis
LVIVLVRRWPKVISRAM

SEQ ID NO: 1386277 - protein, 17 aa, Mycobacterium tuberculosis
LVLRPSWSPTQASGQTV

SEQ ID NO: 1386278 - protein, 23 aa, Mycobacterium tuberculosis
LVPDDLRPEWVLPRADEIAFGYS

SEQ ID NO: 1386279 - protein, 17 aa, Mycobacterium tuberculosis
LWPTVGCLVGYGIAFAL

SEQ ID NO: 1386280 - protein, 22 aa, Mycobacterium tuberculosis
LWRGLLVFFSRWWQLETLYRSN

SEQ ID NO: 1386281 - protein, 17 aa, Mycobacterium tuberculosis
LWWRYTAWWLLAMALAT

SEQ ID NO: 1386282 - protein, 20 aa, Mycobacterium tuberculosis
LYAERWCAWALLAATVAIPT

SEQ ID NO: 1386283 - protein, 17 aa, Mycobacterium tuberculosis
LYIRPVLNSMPAQPAAE

SEQ ID NO: 1386284 - protein, 21 aa, Mycobacterium tuberculosis
LYLRLGDWVPVTAFVVMGAGF

SEQ ID NO: 1386285 - protein, 24 aa, Mycobacterium tuberculosis
LYLRLGDWVPVTAFVVMGAGFAVF

SEQ ID NO: 1386286 - protein, 17 aa, Mycobacterium tuberculosis
LYQRTRVTASYRLTAPA

SEQ ID NO: 1386287 - protein, 19 aa, Mycobacterium tuberculosis
LYRAKWWWLLAAVAAAGAS

SEQ ID NO: 1386288 - protein, 20 aa, Mycobacterium tuberculosis
MAGLRRWLGPLSILLVLWGL

SEQ ID NO: 1386289 - protein, 17 aa, Mycobacterium tuberculosis
MDRWDRRWVLVGANTGR

SEQ ID NO: 1386290 - protein, 17 aa, Mycobacterium tuberculosis
MEQGRLAAYHAFGEPTD

SEQ ID NO: 1386291 - protein, 17 aa, Mycobacterium tuberculosis
MFFRGALYTALGRRYPV

SEQ ID NO: 1386292 - protein, 20 aa, Mycobacterium tuberculosis
MGKLFAGACVVWFFVLFDML

SEQ ID NO: 1386293 - protein, 24 aa, Mycobacterium tuberculosis
MGLWPPRLWAGLRLGWAAGAAAAT

SEQ ID NO: 1386294 - protein, 27 aa, Mycobacterium tuberculosis
MGWRRIGTAIVRWPGPILAVACAIAVV

SEQ ID NO: 1386295 - protein, 20 aa, Mycobacterium tuberculosis
MLGDLPWWVTVLILTRELGV

SEQ ID NO: 1386296 - protein, 20 aa, Mycobacterium tuberculosis
MLIYRLISWLLIAAIGWVVF

SEQ ID NO: 1386297 - protein, 18 aa, Mycobacterium tuberculosis
MLPFATRLISVFFIFYYY

SEQ ID NO: 1386298 - protein, 25 aa, Mycobacterium tuberculosis
MMRLSRNLRRCRWLVFTGWLLALVP

SEQ ID NO: 1386299 - protein, 17 aa, Mycobacterium tuberculosis
MPRPPWRRETHNYIRSG

SEQ ID NO: 1386300 - protein, 17 aa, Mycobacterium tuberculosis
MPSSFSMHGPWVDVAAP

SEQ ID NO: 1386301 - protein, 17 aa, Mycobacterium tuberculosis
MPVIEWLYARQLRRVVA

SEQ ID NO: 1386302 - protein, 18 aa, Mycobacterium tuberculosis
MQGLPSPYLTIAFPNRPP

SEQ ID NO: 1386303 - protein, 23 aa, Mycobacterium tuberculosis
MRLSRNLRRCRWLVFTGWLLALV

SEQ ID NO: 1386304 - protein, 18 aa, Mycobacterium tuberculosis
MRVVHELSALPAEVEAAR

SEQ ID NO: 1386305 - protein, 17 aa, Mycobacterium tuberculosis
MSHARFVPFTAETRMSG

SEQ ID NO: 1386306 - protein, 20 aa, Mycobacterium tuberculosis
MSNWECVRRVTLPWVSSGIV

SEQ ID NO: 1386307 - protein, 19 aa, Mycobacterium tuberculosis
MSPFWQRMFLTIGILIAVF

SEQ ID NO: 1386308 - protein, 20 aa, Mycobacterium tuberculosis
MSPFWQRMFLTIGILIAVFG

SEQ ID NO: 1386309 - protein, 23 aa, Mycobacterium tuberculosis
MTGPRPGGFGALDGRTNEICAQG

SEQ ID NO: 1386310 - protein, 17 aa, Mycobacterium tuberculosis
MVLICLFLYHVFRNRNW

SEQ ID NO: 1386311 - protein, 20 aa, Mycobacterium tuberculosis
MWALSASLGWILPVIAQLVW

SEQ ID NO: 1386312 - protein, 17 aa, Mycobacterium tuberculosis
MYLGYAFRAMNSHGRAL

SEQ ID NO: 1386313 - protein, 19 aa, Mycobacterium tuberculosis
NDWMWGRLDGAGWLVHVLL

SEQ ID NO: 1386314 - protein, 17 aa, Mycobacterium tuberculosis
NGLRPEPLIALGVLVTW

SEQ ID NO: 1386315 - protein, 17 aa, Mycobacterium tuberculosis
NGRAAWRVARNAGITDV

SEQ ID NO: 1386316 - protein, 22 aa, Mycobacterium tuberculosis
NLAGNRPRLVWYAPDHIEGEMS

SEQ ID NO: 1386317 - protein, 18 aa, Mycobacterium tuberculosis
NRCSLLRVELQEHVAGLS

SEQ ID NO: 1386318 - protein, 20 aa, Mycobacterium tuberculosis
NSKFTISMLWPGDRAWRQAG

SEQ ID NO: 1386319 - protein, 20 aa, Mycobacterium tuberculosis
NSLITSWRALGWIGPEAAEA

SEQ ID NO: 1386320 - protein, 17 aa, Mycobacterium tuberculosis
NWKWIRRSLYLTAAVVI

SEQ ID NO: 1386321 - protein, 17 aa, Mycobacterium tuberculosis
PAALFPVHIDPIAVPPQ

SEQ ID NO: 1386322 - protein, 17 aa, Mycobacterium tuberculosis
PAALPWYYSWPLAVAAP

SEQ ID NO: 1386323 - protein, 18 aa, Mycobacterium tuberculosis
PACAPAWRSRRDACLGAG

SEQ ID NO: 1386324 - protein, 17 aa, Mycobacterium tuberculosis
PDAPWGRPRVVYLQHAS

SEQ ID NO: 1386325 - protein, 17 aa, Mycobacterium tuberculosis
PDLRAIIELGYDRTGYA

SEQ ID NO: 1386326 - protein, 24 aa, Mycobacterium tuberculosis
PDSLIRMCLFLGALTFMYISARAV

SEQ ID NO: 1386327 - protein, 20 aa, Mycobacterium tuberculosis
PEPDRAAAIVRRTVPGATAP

SEQ ID NO: 1386328 - protein, 19 aa, Mycobacterium tuberculosis
PETIFRFALYAFLCATALM

SEQ ID NO: 1386329 - protein, 20 aa, Mycobacterium tuberculosis
PEVVEALKFHLRDLAVTFRF

SEQ ID NO: 1386330 - protein, 22 aa, Mycobacterium tuberculosis
PEVVQWKLKPGVVSTMSAQARY

SEQ ID NO: 1386331 - protein, 23 aa, Mycobacterium tuberculosis
PFGEYLPMPWLFRHLSGYADRAG

SEQ ID NO: 1386332 - protein, 19 aa, Mycobacterium tuberculosis
PGEKNMPFWGTSFSAAYVS

SEQ ID NO: 1386333 - protein, 19 aa, Mycobacterium tuberculosis
PGGAPGCWQPITRDLWPAP

SEQ ID NO: 1386334 - protein, 21 aa, Mycobacterium tuberculosis
PGSAPRPAWLRAFAHPERDKR

SEQ ID NO: 1386335 - protein, 17 aa, Mycobacterium tuberculosis
PGTRWPQPTPWAGGAPP

SEQ ID NO: 1386336 - protein, 24 aa, Mycobacterium tuberculosis
PGYTAARPSLSFDHDAHAEPEPKS

SEQ ID NO: 1386337 - protein, 17 aa, Mycobacterium tuberculosis
PHLPPPLVFAAEPAKTG

SEQ ID NO: 1386338 - protein, 19 aa, Mycobacterium tuberculosis
PILAGLCMLMLGLLMLIFS

SEQ ID NO: 1386339 - protein, 18 aa, Mycobacterium tuberculosis
PILPRLIRQFAVVIVLLW

SEQ ID NO: 1386340 - protein, 18 aa, Mycobacterium tuberculosis
PILPRLIRRFAVVIVLLW

SEQ ID NO: 1386341 - protein, 22 aa, Mycobacterium tuberculosis
PIPWYRLPAVIITGTTVAVLLV

SEQ ID NO: 1386342 - protein, 21 aa, Mycobacterium tuberculosis
PLADRSRRFWAWTIAGYTLTV

SEQ ID NO: 1386343 - protein, 17 aa, Mycobacterium tuberculosis
PLAYCLPGVRSRVVVSE

SEQ ID NO: 1386344 - protein, 21 aa, Mycobacterium tuberculosis
PLELLVRAAAAGWRVVELDVS

SEQ ID NO: 1386345 - protein, 23 aa, Mycobacterium tuberculosis
PLFLDWLVGLAFPCQRPFGHQYG

SEQ ID NO: 1386346 - protein, 19 aa, Mycobacterium tuberculosis
PLGHWEFYMALAYFKLAII

SEQ ID NO: 1386347 - protein, 17 aa, Mycobacterium tuberculosis
PLQGAAIYLVWHRGDVQ

SEQ ID NO: 1386348 - protein, 22 aa, Mycobacterium tuberculosis
PNSKFTISMLWPGDRAWRQAGE

SEQ ID NO: 1386349 - protein, 20 aa, Mycobacterium tuberculosis
PNSLLPRWLPDTSRGQGWAD

SEQ ID NO: 1386350 - protein, 22 aa, Mycobacterium tuberculosis
PNSLLPRWLPDTSRGQGWADRI

SEQ ID NO: 1386351 - protein, 26 aa, Mycobacterium tuberculosis
PPCIATGRIMWCWPRVLWSACSTCAA

SEQ ID NO: 1386352 - protein, 18 aa, Mycobacterium tuberculosis
PPGTIGEIWVHGDNVAGG

SEQ ID NO: 1386353 - protein, 19 aa, Mycobacterium tuberculosis
PPPPHKIFFIFFFFYFLKK

SEQ ID NO: 1386354 - protein, 19 aa, Mycobacterium tuberculosis
PQLPPRIPQVPGIGQFSAI

SEQ ID NO: 1386355 - protein, 19 aa, Mycobacterium tuberculosis
PQLTAAFGGALWAARRPGD

SEQ ID NO: 1386356 - protein, 20 aa, Mycobacterium tuberculosis
PQLTAAFGGALWAARRPGDT

SEQ ID NO: 1386357 - protein, 20 aa, Mycobacterium tuberculosis
PRFLFAVSFCGVLVATATYL

SEQ ID NO: 1386358 - protein, 22 aa, Mycobacterium tuberculosis
PRLIRQFAVVIVLLWLGFTAFV

SEQ ID NO: 1386359 - protein, 25 aa, Mycobacterium tuberculosis
PRLIRRFAVVIVLLWLGFTAFVNLA

SEQ ID NO: 1386360 - protein, 26 aa, Mycobacterium tuberculosis
PRNICGMAVLPACRLGLVVCVATAVI

SEQ ID NO: 1386361 - protein, 18 aa, Mycobacterium tuberculosis
PRPPFDYMQQVYDRYIAP

SEQ ID NO: 1386362 - protein, 24 aa, Mycobacterium tuberculosis
PRPPRICWCGSLPWEPPTERVKPT

SEQ ID NO: 1386363 - protein, 21 aa, Mycobacterium tuberculosis
PRPRWQPAPARRHQNPSRAQL

SEQ ID NO: 1386364 - protein, 17 aa, Mycobacterium tuberculosis
PRRAGVSSFGFGGTNAH

SEQ ID NO: 1386365 - protein, 24 aa, Mycobacterium tuberculosis
PRYLRFGWAAARLDDWANYVGARA

SEQ ID NO: 1386366 - protein, 20 aa, Mycobacterium tuberculosis
PSLNRGWCLIRTRWGRRIAR

SEQ ID NO: 1386367 - protein, 17 aa, Mycobacterium tuberculosis
PSSGIGIVEGWRGTIVH

SEQ ID NO: 1386368 - protein, 18 aa, Mycobacterium tuberculosis
PTGGLGCWPRPSTWPPAW

SEQ ID NO: 1386369 - protein, 18 aa, Mycobacterium tuberculosis
PTGWCCMRPSATRGGGNS

SEQ ID NO: 1386370 - protein, 19 aa, Mycobacterium tuberculosis
PTPMRCWRCGSTGRICRWI

SEQ ID NO: 1386371 - protein, 17 aa, Mycobacterium tuberculosis
PTTRLAACRSVRAVASI

SEQ ID NO: 1386372 - protein, 18 aa, Mycobacterium tuberculosis
PTVVTGLRLAASRSMLPA

SEQ ID NO: 1386373 - protein, 20 aa, Mycobacterium tuberculosis
PVDWEPLGAIAIGYADERQR

SEQ ID NO: 1386374 - protein, 17 aa, Mycobacterium tuberculosis
PVSHMWVVKFLRTHGLI

SEQ ID NO: 1386375 - protein, 20 aa, Mycobacterium tuberculosis
PVTWEMSFLYAIVFGGFVAF

SEQ ID NO: 1386376 - protein, 17 aa, Mycobacterium tuberculosis
PWHVRAGAFAIDVLPGL

SEQ ID NO: 1386377 - protein, 18 aa, Mycobacterium tuberculosis
PWRLRLRRPTIVLGSVVA

SEQ ID NO: 1386378 - protein, 20 aa, Mycobacterium tuberculosis
QAAAVPVVFLTAWYGLADLA

SEQ ID NO: 1386379 - protein, 22 aa, Mycobacterium tuberculosis
QAGALPALFSGLARRPRRRQID

SEQ ID NO: 1386380 - protein, 22 aa, Mycobacterium tuberculosis
QFEGRLWIAMQFVDGGNAEDAL

SEQ ID NO: 1386381 - protein, 23 aa, Mycobacterium tuberculosis
QFEGRLWIAMQFVDGGNAEDALR

SEQ ID NO: 1386382 - protein, 20 aa, Mycobacterium tuberculosis
QINWKWIRRSLYLTAAVVIL

SEQ ID NO: 1386383 - protein, 17 aa, Mycobacterium tuberculosis
QLILFAIVSVVAIVVLG

SEQ ID NO: 1386384 - protein, 26 aa, Mycobacterium tuberculosis
QLWLDYSLIVYFVFVFPLSVLLTTVN

SEQ ID NO: 1386385 - protein, 19 aa, Mycobacterium tuberculosis
QPPDVNTWWAFRTSCTPTE

SEQ ID NO: 1386386 - protein, 17 aa, Mycobacterium tuberculosis
QRLPGRCWPVSATATAT

SEQ ID NO: 1386387 - protein, 20 aa, Mycobacterium tuberculosis
QRVLGAALWYAATVKDAVIV

SEQ ID NO: 1386388 - protein, 19 aa, Mycobacterium tuberculosis
QRWFSWLALLTMPAPFLAN

SEQ ID NO: 1386389 - protein, 22 aa, Mycobacterium tuberculosis
QSIEPSRRWGLPLALTASAVVM

SEQ ID NO: 1386390 - protein, 17 aa, Mycobacterium tuberculosis
QWKLKPGVVSTMSAQAR

SEQ ID NO: 1386391 - protein, 24 aa, Mycobacterium tuberculosis
QYGPRPKISELFLREGKDDPRTQE

SEQ ID NO: 1386392 - protein, 17 aa, Mycobacterium tuberculosis
RAGAFAIDVLPGLAVAA

SEQ ID NO: 1386393 - protein, 20 aa, Mycobacterium tuberculosis
RAGDPFQHWIGRRFDAVATD

SEQ ID NO: 1386394 - protein, 20 aa, Mycobacterium tuberculosis
RAMRRAGKVFNEFDSNSIAM

SEQ ID NO: 1386395 - protein, 21 aa, Mycobacterium tuberculosis
RASYLLPSWVGCGRRSRRICR

SEQ ID NO: 1386396 - protein, 21 aa, Mycobacterium tuberculosis
RAVSFLGPWLFSVFVDVFHTV

SEQ ID NO: 1386397 - protein, 17 aa, Mycobacterium tuberculosis
RDLAPLLAAWVISVGVM

SEQ ID NO: 1386398 - protein, 17 aa, Mycobacterium tuberculosis
RDPCGGAGCAVRRRDHL

SEQ ID NO: 1386399 - protein, 22 aa, Mycobacterium tuberculosis
RERLRFFWITAVTTDGSIVVAN

SEQ ID NO: 1386400 - protein, 19 aa, Mycobacterium tuberculosis
RFADRFARFNLQERVIRPS

SEQ ID NO: 1386401 - protein, 25 aa, Mycobacterium tuberculosis
RFCFPNFLRWLGFGFLFVDILGFNI

SEQ ID NO: 1386402 - protein, 18 aa, Mycobacterium tuberculosis
RFLFAWPSAKSAVMGGAQ

SEQ ID NO: 1386403 - protein, 21 aa, Mycobacterium tuberculosis
RFRCRRLRRGGAVWQASDGSD

SEQ ID NO: 1386404 - protein, 19 aa, Mycobacterium tuberculosis
RGAGALGFVGTAGKESVGQ

SEQ ID NO: 1386405 - protein, 24 aa, Mycobacterium tuberculosis
RGATPRPRPRWGTPALAAPAPHGA

SEQ ID NO: 1386406 - protein, 23 aa, Mycobacterium tuberculosis
RGDYRLRHFGVRITRILALLLAV

SEQ ID NO: 1386407 - protein, 17 aa, Mycobacterium tuberculosis
RGGLFVRQIHHWAALMF

SEQ ID NO: 1386408 - protein, 17 aa, Mycobacterium tuberculosis
RGLIRLARRVWPDSGWE

SEQ ID NO: 1386409 - protein, 17 aa, Mycobacterium tuberculosis
RGMPLLVLVVMAQLVLC

SEQ ID NO: 1386410 - protein, 19 aa, Mycobacterium tuberculosis
RGVIWSGVVSKVIVPAVVA

SEQ ID NO: 1386411 - protein, 20 aa, Mycobacterium tuberculosis
RHFGELEFWFALIKVAAIVC

SEQ ID NO: 1386412 - protein, 22 aa, Mycobacterium tuberculosis
RHRLPGLYGYRVARHDEAKAGG

SEQ ID NO: 1386413 - protein, 17 aa, Mycobacterium tuberculosis
RHVLRLALFAGILLGLF

SEQ ID NO: 1386414 - protein, 20 aa, Mycobacterium tuberculosis
RIVSGLSIFRLLRYLAREYL

SEQ ID NO: 1386415 - protein, 18 aa, Mycobacterium tuberculosis
RKAELDAGYILTCQSHPT

SEQ ID NO: 1386416 - protein, 21 aa, Mycobacterium tuberculosis
RKRFGDTMGYRLVIYPEYASL

SEQ ID NO: 1386417 - protein, 19 aa, Mycobacterium tuberculosis
RKRLPAIFVDVALFALIGI

SEQ ID NO: 1386418 - protein, 25 aa, Mycobacterium tuberculosis
RLAAIPILLCWLGFTVFVSVAVPPL

SEQ ID NO: 1386419 - protein, 23 aa, Mycobacterium tuberculosis
RLFIPRFLFSMGVIGVVAATSCY

SEQ ID NO: 1386420 - protein, 24 aa, Mycobacterium tuberculosis
RLGDFWGYLAGWGFVVGKTASCAA

SEQ ID NO: 1386421 - protein, 21 aa, Mycobacterium tuberculosis
RLKATMLAHWAWLSMLLVGGA

SEQ ID NO: 1386422 - protein, 22 aa, Mycobacterium tuberculosis
RLKSWRRGLIFAMFVFAAIFTP

SEQ ID NO: 1386423 - protein, 17 aa, Mycobacterium tuberculosis
RLRALGWTGMLDKGADV

SEQ ID NO: 1386424 - protein, 17 aa, Mycobacterium tuberculosis
RLREFALREGLADAQLR

SEQ ID NO: 1386425 - protein, 18 aa, Mycobacterium tuberculosis
RLRLALLLCAVRPEIGGA

SEQ ID NO: 1386426 - protein, 22 aa, Mycobacterium tuberculosis
RLRLPCRTILRGVSRNPLVRGT

SEQ ID NO: 1386427 - protein, 17 aa, Mycobacterium tuberculosis
RLRLPCRTILRVFSRNS

SEQ ID NO: 1386428 - protein, 17 aa, Mycobacterium tuberculosis
RLRVRWVMRRDEKSLAE

SEQ ID NO: 1386429 - protein, 18 aa, Mycobacterium tuberculosis
RLSFEVFVVFVVARVEVV

SEQ ID NO: 1386430 - protein, 20 aa, Mycobacterium tuberculosis
RLWWRYTAWWLLAMALATLW

SEQ ID NO: 1386431 - protein, 26 aa, Mycobacterium tuberculosis
RMIRTFAVPIILGWLVTIAVLNVTVP

SEQ ID NO: 1386432 - protein, 17 aa, Mycobacterium tuberculosis
RNICHQAIFYRRGLFGT

SEQ ID NO: 1386433 - protein, 18 aa, Mycobacterium tuberculosis
RNTLLLPFRVAAVHLILW

SEQ ID NO: 1386434 - protein, 27 aa, Mycobacterium tuberculosis
RPASTQSWFWSRWVGWVMRRPWITALA

SEQ ID NO: 1386435 - protein, 22 aa, Mycobacterium tuberculosis
RPESLIALGVLVTWVLVERSIA

SEQ ID NO: 1386436 - protein, 20 aa, Mycobacterium tuberculosis
RPGEKNMPFWGTSFSAAYVS

SEQ ID NO: 1386437 - protein, 22 aa, Mycobacterium tuberculosis
RPQLTAAFGGALWAARRPGDTS

SEQ ID NO: 1386438 - protein, 19 aa, Mycobacterium tuberculosis
RPRRLIPLLGLIGCVVLAF

SEQ ID NO: 1386439 - protein, 22 aa, Mycobacterium tuberculosis
RPRRPGCGCARGSGHGQRRRRG

SEQ ID NO: 1386440 - protein, 20 aa, Mycobacterium tuberculosis
RPSHRCRSAGSWRKTVPAPT

SEQ ID NO: 1386441 - protein, 20 aa, Mycobacterium tuberculosis
RPSRLRRGWLVGIAATLLAL

SEQ ID NO: 1386442 - protein, 23 aa, Mycobacterium tuberculosis
RPSRWRHVPAILLVLSLLLFTIA

SEQ ID NO: 1386443 - protein, 26 aa, Mycobacterium tuberculosis
RPSSRAPVMWALSASLGWILPVIAQL

SEQ ID NO: 1386444 - protein, 20 aa, Mycobacterium tuberculosis
RPTRPTCGGARGAPRAASTA

SEQ ID NO: 1386445 - protein, 21 aa, Mycobacterium tuberculosis
RPWMAVMFFAGFLILYGLGVM

SEQ ID NO: 1386446 - protein, 24 aa, Mycobacterium tuberculosis
RPYQWWRLALVLASGLAYVVIFSL

SEQ ID NO: 1386447 - protein, 25 aa, Mycobacterium tuberculosis
RPYQWWRLALVLASGLAYVVIFSLP

SEQ ID NO: 1386448 - protein, 18 aa, Mycobacterium tuberculosis
RQRRAGVVLIRLGVAAAG

SEQ ID NO: 1386449 - protein, 18 aa, Mycobacterium tuberculosis
RQSWPAATGVTLVGTNPA

SEQ ID NO: 1386450 - protein, 18 aa, Mycobacterium tuberculosis
RRALPFVAAMAKLLVAAV

SEQ ID NO: 1386451 - protein, 19 aa, Mycobacterium tuberculosis
RRCRWLVFTGWLLALVPAV

SEQ ID NO: 1386452 - protein, 24 aa, Mycobacterium tuberculosis
RRCRWSWRTGWVCLYFSVVFDGWP

SEQ ID NO: 1386453 - protein, 18 aa, Mycobacterium tuberculosis
RRCWPGGRPGMRGCLRGE

SEQ ID NO: 1386454 - protein, 24 aa, Mycobacterium tuberculosis
RRCWPGGRPGMRGCLRGEFGRTAY

SEQ ID NO: 1386455 - protein, 20 aa, Mycobacterium tuberculosis
RRDPLLFPFQPIHVTIATWF

SEQ ID NO: 1386456 - protein, 19 aa, Mycobacterium tuberculosis
RRFTWAFGRSIVWRSFGSG

SEQ ID NO: 1386457 - protein, 19 aa, Mycobacterium tuberculosis
RRGACRLTRAPAFGVAAIA

SEQ ID NO: 1386458 - protein, 20 aa, Mycobacterium tuberculosis
RRIAAALGRPMVPIGSPVLR

SEQ ID NO: 1386459 - protein, 17 aa, Mycobacterium tuberculosis
RRIPALTARCYVLTIRY

SEQ ID NO: 1386460 - protein, 22 aa, Mycobacterium tuberculosis
RRKRSESGVGIRGYRDEFLDAT

SEQ ID NO: 1386461 - protein, 22 aa, Mycobacterium tuberculosis
RRLNEYIGFLVAWQRPLAGKKT

SEQ ID NO: 1386462 - protein, 19 aa, Mycobacterium tuberculosis
RRLWTMLIFMLWHAIFVEH

SEQ ID NO: 1386463 - protein, 17 aa, Mycobacterium tuberculosis
RRPGAVGPFWAAAAATG

SEQ ID NO: 1386464 - protein, 24 aa, Mycobacterium tuberculosis
RRPPWWLWSCFVMHPTFGPTPTRC

SEQ ID NO: 1386465 - protein, 19 aa, Mycobacterium tuberculosis
RRQPGCGLGTAATAARAAP

SEQ ID NO: 1386466 - protein, 21 aa, Mycobacterium tuberculosis
RRRNPRPAIVVVAFLVVVTCV

SEQ ID NO: 1386467 - protein, 18 aa, Mycobacterium tuberculosis
RRRRAVAPRGRRPGGAGD

SEQ ID NO: 1386468 - protein, 25 aa, Mycobacterium tuberculosis
RRRRDRWFGGWDRRQPGCGLGTAAT

SEQ ID NO: 1386469 - protein, 17 aa, Mycobacterium tuberculosis
RRRSFVFGVTLFVVSSI

SEQ ID NO: 1386470 - protein, 23 aa, Mycobacterium tuberculosis
RRSQLRLGLNVPYLLLVLAFVVF

SEQ ID NO: 1386471 - protein, 18 aa, Mycobacterium tuberculosis
RRSRRICRRSATSPPALG

SEQ ID NO: 1386472 - protein, 17 aa, Mycobacterium tuberculosis
RRVAIALGVLVAAAGIV

SEQ ID NO: 1386473 - protein, 21 aa, Mycobacterium tuberculosis
RRVSDGWAFMCTLIVVAAVVV

SEQ ID NO: 1386474 - protein, 27 aa, Mycobacterium tuberculosis
RSLTRSAWRLGMFANRWIILGVSAQAI

SEQ ID NO: 1386475 - protein, 18 aa, Mycobacterium tuberculosis
RSPGRWSLVAALALAVVS

SEQ ID NO: 1386476 - protein, 19 aa, Mycobacterium tuberculosis
RSRHWQRRWLPTAAAIGAT

SEQ ID NO: 1386477 - protein, 19 aa, Mycobacterium tuberculosis
RSWSVRANLHFLWLRLARV

SEQ ID NO: 1386478 - protein, 19 aa, Mycobacterium tuberculosis
RTASIVIWYSRAICDTAAI

SEQ ID NO: 1386479 - protein, 20 aa, Mycobacterium tuberculosis
RTIYQNLGWAFGYNTAAIPL

SEQ ID NO: 1386480 - protein, 22 aa, Mycobacterium tuberculosis
RTRRCLVCLPVVAVIRHLSHFY

SEQ ID NO: 1386481 - protein, 17 aa, Mycobacterium tuberculosis
RTSCTPTECLAAATMLD

SEQ ID NO: 1386482 - protein, 19 aa, Mycobacterium tuberculosis
RVGTAIVRWPGPVLAATCL

SEQ ID NO: 1386483 - protein, 20 aa, Mycobacterium tuberculosis
RVGTAIVRWPGPVLAATCLV

SEQ ID NO: 1386484 - protein, 25 aa, Mycobacterium tuberculosis
RWCRIVTAIVRWPLPILAMACAIAV

SEQ ID NO: 1386485 - protein, 23 aa, Mycobacterium tuberculosis
RYLRFGWAAARLDDWANYVGARA

SEQ ID NO: 1386486 - protein, 20 aa, Mycobacterium tuberculosis
SAFFTPQFVRWFGLFTTHAI

SEQ ID NO: 1386487 - protein, 24 aa, Mycobacterium tuberculosis
SAFFTPRFVRWFGLFTTHAIVAAA

SEQ ID NO: 1386488 - protein, 23 aa, Mycobacterium tuberculosis
SAKPMWPRGWIIPTSWRFISAAS

SEQ ID NO: 1386489 - protein, 23 aa, Mycobacterium tuberculosis
SALAPPCIIAFLETRYWWAGIAL

SEQ ID NO: 1386490 - protein, 18 aa, Mycobacterium tuberculosis
SALERLRDFAVFKAIGHA

SEQ ID NO: 1386491 - protein, 17 aa, Mycobacterium tuberculosis
SALFPAAVGVLWQSGLR

SEQ ID NO: 1386492 - protein, 22 aa, Mycobacterium tuberculosis
SALLCPLLVYGWLELPRWGLTG

SEQ ID NO: 1386493 - protein, 24 aa, Mycobacterium tuberculosis
SARPRTRFGAWLGRPMTSFHLIIA

SEQ ID NO: 1386494 - protein, 19 aa, Mycobacterium tuberculosis
SASAWAPAACSRGWPAAPR

SEQ ID NO: 1386495 - protein, 23 aa, Mycobacterium tuberculosis
SCVACAGFIAACWIIGLSWANAG

SEQ ID NO: 1386496 - protein, 24 aa, Mycobacterium tuberculosis
SCVACAGFIAACWIIGLSWANAGK

SEQ ID NO: 1386497 - protein, 25 aa, Mycobacterium tuberculosis
SGHRCPWCSPLGWSLQVRPYAGERW

SEQ ID NO: 1386498 - protein, 18 aa, Mycobacterium tuberculosis
SGIALSIAALVPIGAALA

SEQ ID NO: 1386499 - protein, 19 aa, Mycobacterium tuberculosis
SGNHARLKLAIDSGEMGFI

SEQ ID NO: 1386500 - protein, 25 aa, Mycobacterium tuberculosis
SGPAKARRPVRCWSSPTSWRAHWPR

SEQ ID NO: 1386501 - protein, 20 aa, Mycobacterium tuberculosis
SGRFCVPVVRTPRPQLTAAF

SEQ ID NO: 1386502 - protein, 19 aa, Mycobacterium tuberculosis
SGWRAGALGSMLSFGGVLL

SEQ ID NO: 1386503 - protein, 27 aa, Mycobacterium tuberculosis
SGYRFLLRRIECALLFGDVCAATGALR

SEQ ID NO: 1386504 - protein, 18 aa, Mycobacterium tuberculosis
SKFTISMLWPGDRAWRQA

SEQ ID NO: 1386505 - protein, 22 aa, Mycobacterium tuberculosis
SLAGSGWCGWVLFEKHQTDVAA

SEQ ID NO: 1386506 - protein, 17 aa, Mycobacterium tuberculosis
SLLVGYGCLPWVATAML

SEQ ID NO: 1386507 - protein, 19 aa, Mycobacterium tuberculosis
SLRDLGCRALLMSGRPDEG

SEQ ID NO: 1386508 - protein, 23 aa, Mycobacterium tuberculosis
SNSFPKWRWSITTALLELTVLVL

SEQ ID NO: 1386509 - protein, 18 aa, Mycobacterium tuberculosis
SPCAIGLVTVMLASLTLA

SEQ ID NO: 1386510 - protein, 17 aa, Mycobacterium tuberculosis
SPIPRIVSVSLAWAAAI

SEQ ID NO: 1386511 - protein, 22 aa, Mycobacterium tuberculosis
SPLIRWIIKVPREFINDYLFNF

SEQ ID NO: 1386512 - protein, 22 aa, Mycobacterium tuberculosis
SPTFMQWGWRIPFLVSAALIAV

SEQ ID NO: 1386513 - protein, 17 aa, Mycobacterium tuberculosis
SQLRLGLNVPYLLLVLA

SEQ ID NO: 1386514 - protein, 18 aa, Mycobacterium tuberculosis
SRGLRYATVIALVAALVG

SEQ ID NO: 1386515 - protein, 17 aa, Mycobacterium tuberculosis
SRHWQRRWLPTAAAIGA

SEQ ID NO: 1386516 - protein, 20 aa, Mycobacterium tuberculosis
SRIEFAITILLLVILLIIYR

SEQ ID NO: 1386517 - protein, 24 aa, Mycobacterium tuberculosis
SRIRQPRCCPIRLVGPPSRSAAMK

SEQ ID NO: 1386518 - protein, 17 aa, Mycobacterium tuberculosis
SRLPSCLAIGAAAAGVV

SEQ ID NO: 1386519 - protein, 23 aa, Mycobacterium tuberculosis
SRRLWTMLIFMLWHAIFVEHSVV

SEQ ID NO: 1386520 - protein, 17 aa, Mycobacterium tuberculosis
SRTGNLVTWWTGDALLV

SEQ ID NO: 1386521 - protein, 19 aa, Mycobacterium tuberculosis
SSALPAYWERLAVWWQLGS

SEQ ID NO: 1386522 - protein, 20 aa, Mycobacterium tuberculosis
SSALPAYWERLGVCWQLGSD

SEQ ID NO: 1386523 - protein, 23 aa, Mycobacterium tuberculosis
SSELMFFAGLFAFYFSARAQAGG

SEQ ID NO: 1386524 - protein, 18 aa, Mycobacterium tuberculosis
SSLVTGWARLHGYPLGIL

SEQ ID NO: 1386525 - protein, 24 aa, Mycobacterium tuberculosis
SSQFSVRLLRTFLRDVPNQVVLAI

SEQ ID NO: 1386526 - protein, 17 aa, Mycobacterium tuberculosis
SVDAVWKPLLPGYTRPH

SEQ ID NO: 1386527 - protein, 17 aa, Mycobacterium tuberculosis
SVIRLALIPAFVYVVLS

SEQ ID NO: 1386528 - protein, 18 aa, Mycobacterium tuberculosis
SWCSTGWATRVCRVATPT

SEQ ID NO: 1386529 - protein, 21 aa, Mycobacterium tuberculosis
SWRGLRLGLMFGFGGMLVTIP

SEQ ID NO: 1386530 - protein, 24 aa, Mycobacterium tuberculosis
TAQRTKWWPSWAVVRWSGSSGCCS

SEQ ID NO: 1386531 - protein, 20 aa, Mycobacterium tuberculosis
TARKRIAWLVLLANMVLAAV

SEQ ID NO: 1386532 - protein, 19 aa, Mycobacterium tuberculosis
TATVTRLALAIAAIASAAN

SEQ ID NO: 1386533 - protein, 19 aa, Mycobacterium tuberculosis
TFGALWLLYRYYRTGDPAV

SEQ ID NO: 1386534 - protein, 18 aa, Mycobacterium tuberculosis
TFGALWLLYRYYRTGDPL

SEQ ID NO: 1386535 - protein, 19 aa, Mycobacterium tuberculosis
TGNLVTWWTGDALLVFDAG

SEQ ID NO: 1386536 - protein, 19 aa, Mycobacterium tuberculosis
TICSTVWLSAAAYRLPPGG

SEQ ID NO: 1386537 - protein, 20 aa, Mycobacterium tuberculosis
TKAAARWIRPLVPPFVARML

SEQ ID NO: 1386538 - protein, 22 aa, Mycobacterium tuberculosis
TLGIPCAVGMLVAVAVALTLGP

SEQ ID NO: 1386539 - protein, 19 aa, Mycobacterium tuberculosis
TLLLARWLLFRVEFGAGLI

SEQ ID NO: 1386540 - protein, 18 aa, Mycobacterium tuberculosis
TPPVCSRLTCPRSPVRHH

SEQ ID NO: 1386541 - protein, 18 aa, Mycobacterium tuberculosis
TPSEAFTAWEFVDGYDVA

SEQ ID NO: 1386542 - protein, 17 aa, Mycobacterium tuberculosis
TPWCPFCNAEAPSLSQV

SEQ ID NO: 1386543 - protein, 17 aa, Mycobacterium tuberculosis
TQHNVYIPWSMTVTPIS

SEQ ID NO: 1386544 - protein, 17 aa, Mycobacterium tuberculosis
TQRLAAAANAFVNAEAT

SEQ ID NO: 1386545 - protein, 20 aa, Mycobacterium tuberculosis
TRGRIVLRWLRIAVLIVTGL

SEQ ID NO: 1386546 - protein, 20 aa, Mycobacterium tuberculosis
TRWGRRIARLLPFVGLAGLA

SEQ ID NO: 1386547 - protein, 18 aa, Mycobacterium tuberculosis
TTPTDWPRYGGYALAGVS

SEQ ID NO: 1386548 - protein, 19 aa, Mycobacterium tuberculosis
TTSRCCRWWAPRSPSTPTP

SEQ ID NO: 1386549 - protein, 17 aa, Mycobacterium tuberculosis
TVVRMFLVPSVMKLLGD

SEQ ID NO: 1386550 - protein, 18 aa, Mycobacterium tuberculosis
TVVRMFLVPSVMKLLGDD

SEQ ID NO: 1386551 - protein, 17 aa, Mycobacterium tuberculosis
TYPAHWGPAAVAALDSA

SEQ ID NO: 1386552 - protein, 18 aa, Mycobacterium tuberculosis
VAEIGVACAVAIAVDATV

SEQ ID NO: 1386553 - protein, 21 aa, Mycobacterium tuberculosis
VAGWWTPPAWAIGPPVVDAAA

SEQ ID NO: 1386554 - protein, 18 aa, Mycobacterium tuberculosis
VALAGRRRPGWPVPSMSN

SEQ ID NO: 1386555 - protein, 26 aa, Mycobacterium tuberculosis
VAMPWLFLRLRFCRRKWTVPTLAATP

SEQ ID NO: 1386556 - protein, 18 aa, Mycobacterium tuberculosis
VAPRGRRPGGAGDAGGPL

SEQ ID NO: 1386557 - protein, 18 aa, Mycobacterium tuberculosis
VARLWKLTSALTIDDRTG

SEQ ID NO: 1386558 - protein, 19 aa, Mycobacterium tuberculosis
VARVGTVVMSWRLRTRHRL

SEQ ID NO: 1386559 - protein, 18 aa, Mycobacterium tuberculosis
VAVLARWRFRRRPAPARL

SEQ ID NO: 1386560 - protein, 21 aa, Mycobacterium tuberculosis
VAYRTWRWWLATAVAFFAVVV

SEQ ID NO: 1386561 - protein, 21 aa, Mycobacterium tuberculosis
VEGRVALTIPADWSTQRVVSG

SEQ ID NO: 1386562 - protein, 20 aa, Mycobacterium tuberculosis
VEVPNALPLMLGGLRSATLQ

SEQ ID NO: 1386563 - protein, 17 aa, Mycobacterium tuberculosis
VFRWQRRDNLLTEPDPA

SEQ ID NO: 1386564 - protein, 20 aa, Mycobacterium tuberculosis
VGACLRFPYTFATAKFGGRN

SEQ ID NO: 1386565 - protein, 17 aa, Mycobacterium tuberculosis
VGCGRRSRRICRRSATS

SEQ ID NO: 1386566 - protein, 21 aa, Mycobacterium tuberculosis
VGELLCFVGMLIGIPVAALIH

SEQ ID NO: 1386567 - protein, 22 aa, Mycobacterium tuberculosis
VGELLCFVGMLIGIPVAALIHV

SEQ ID NO: 1386568 - protein, 19 aa, Mycobacterium tuberculosis
VGPRQWRWPLGEIDRPFEM

SEQ ID NO: 1386569 - protein, 18 aa, Mycobacterium tuberculosis
VGPTIAWYQDFLRYYFLT

SEQ ID NO: 1386570 - protein, 19 aa, Mycobacterium tuberculosis
VGQQCARRALPFVAAMAKL

SEQ ID NO: 1386571 - protein, 18 aa, Mycobacterium tuberculosis
VGSMFGPYHLKRLLGRGG

SEQ ID NO: 1386572 - protein, 24 aa, Mycobacterium tuberculosis
VGYRNRIAALFAWGISFMGRARGQ

SEQ ID NO: 1386573 - protein, 22 aa, Mycobacterium tuberculosis
VIGALVVWWGWRERRDLFSGFG

SEQ ID NO: 1386574 - protein, 19 aa, Mycobacterium tuberculosis
VISSWRPVLLIPLTFALFT

SEQ ID NO: 1386575 - protein, 18 aa, Mycobacterium tuberculosis
VIVALHLVGWLTVTLLVE

SEQ ID NO: 1386576 - protein, 17 aa, Mycobacterium tuberculosis
VKLNMVWAFGYNIAAIP

SEQ ID NO: 1386577 - protein, 19 aa, Mycobacterium tuberculosis
VKLNMVWAFGYNIAAIPVA

SEQ ID NO: 1386578 - protein, 17 aa, Mycobacterium tuberculosis
VLARWQSSWLRYAPLSF

SEQ ID NO: 1386579 - protein, 19 aa, Mycobacterium tuberculosis
VLAVIWCWLLKRYIVEGPL

SEQ ID NO: 1386580 - protein, 17 aa, Mycobacterium tuberculosis
VLCAIGAVYLGSRTGAG

SEQ ID NO: 1386581 - protein, 20 aa, Mycobacterium tuberculosis
VLGMSCAACASRVETKLNKI

SEQ ID NO: 1386582 - protein, 18 aa, Mycobacterium tuberculosis
VLILGFWAPGFFVTTKLD

SEQ ID NO: 1386583 - protein, 17 aa, Mycobacterium tuberculosis
VLIRLFTKQGFGHQIRE

SEQ ID NO: 1386584 - protein, 18 aa, Mycobacterium tuberculosis
VLLFCLFGVLFVLLRRGR

SEQ ID NO: 1386585 - protein, 20 aa, Mycobacterium tuberculosis
VLRRRPRFRASIQSKLMVLL

SEQ ID NO: 1386586 - protein, 22 aa, Mycobacterium tuberculosis
VLVHPRPRLSVMAVGGELVDIS

SEQ ID NO: 1386587 - protein, 19 aa, Mycobacterium tuberculosis
VLVVGSGYLCRWSTTTTWL

SEQ ID NO: 1386588 - protein, 18 aa, Mycobacterium tuberculosis
VMRRSRLIGVSFAVGLIV

SEQ ID NO: 1386589 - protein, 18 aa, Mycobacterium tuberculosis
VMRWRWRVAFYALSALGT

SEQ ID NO: 1386590 - protein, 17 aa, Mycobacterium tuberculosis
VMVRPLIRLSLGKRHPM

SEQ ID NO: 1386591 - protein, 19 aa, Mycobacterium tuberculosis
VPRPARWVAPGLLLSRLGL

SEQ ID NO: 1386592 - protein, 17 aa, Mycobacterium tuberculosis
VQRRPFFAILRCLGVTR

SEQ ID NO: 1386593 - protein, 18 aa, Mycobacterium tuberculosis
VQWKLKPGVVSTMSAQAR

SEQ ID NO: 1386594 - protein, 19 aa, Mycobacterium tuberculosis
VQWKLKPGVVSTMSAQARY

SEQ ID NO: 1386595 - protein, 18 aa, Mycobacterium tuberculosis
VRASIRWAIEERAPSQAD

SEQ ID NO: 1386596 - protein, 17 aa, Mycobacterium tuberculosis
VRLLLPMPADWSYAEAA

SEQ ID NO: 1386597 - protein, 19 aa, Mycobacterium tuberculosis
VSDGWAFMCTLIVVAAVVV

SEQ ID NO: 1386598 - protein, 20 aa, Mycobacterium tuberculosis
VSELMFRLEVEFTGGGRHRH

SEQ ID NO: 1386599 - protein, 28 aa, Mycobacterium tuberculosis
VSGYRFLLRRIECALLFGDVCAATGALR

SEQ ID NO: 1386600 - protein, 18 aa, Mycobacterium tuberculosis
VSIALLWSLRFGPRVLGP

SEQ ID NO: 1386601 - protein, 17 aa, Mycobacterium tuberculosis
VSTSLAWTGRVAPPGTF

SEQ ID NO: 1386602 - protein, 20 aa, Mycobacterium tuberculosis
VSVAISALFGSHAQGYQTLS

SEQ ID NO: 1386603 - protein, 19 aa, Mycobacterium tuberculosis
VTFSRGWLPFLPTSDPPAH

SEQ ID NO: 1386604 - protein, 17 aa, Mycobacterium tuberculosis
VTTTYTFRRKVATLVDN

SEQ ID NO: 1386605 - protein, 17 aa, Mycobacterium tuberculosis
VVFALAATIGFDWTLLV

SEQ ID NO: 1386606 - protein, 17 aa, Mycobacterium tuberculosis
VVIFGFLLWHVIGANSS

SEQ ID NO: 1386607 - protein, 18 aa, Mycobacterium tuberculosis
VVIVLLWLGFTAFVNLAV

SEQ ID NO: 1386608 - protein, 20 aa, Mycobacterium tuberculosis
VVPHVRWPMWAAHRGGHRRA

SEQ ID NO: 1386609 - protein, 18 aa, Mycobacterium tuberculosis
VVRTPRPQLTAAFGGALW

SEQ ID NO: 1386610 - protein, 18 aa, Mycobacterium tuberculosis
VVVLGWYFLRIPSLVGIG

SEQ ID NO: 1386611 - protein, 25 aa, Mycobacterium tuberculosis
VVYDMWGAAVSLVYQMHSGSPQPGI

SEQ ID NO: 1386612 - protein, 17 aa, Mycobacterium tuberculosis
VWRRVSDGWAFMCTLIV

SEQ ID NO: 1386613 - protein, 20 aa, Mycobacterium tuberculosis
VYMLWLYQRVMTGPVAEGNE

SEQ ID NO: 1386614 - protein, 20 aa, Mycobacterium tuberculosis
VYRYRFIVIGVMVALCLGGG

SEQ ID NO: 1386615 - protein, 19 aa, Mycobacterium tuberculosis
VYVVFRWFFARDLRVVPER

SEQ ID NO: 1386616 - protein, 17 aa, Mycobacterium tuberculosis
WAFSLAMIDGWQRGFAG

SEQ ID NO: 1386617 - protein, 17 aa, Mycobacterium tuberculosis
WALFLACYATGGWEPGL

SEQ ID NO: 1386618 - protein, 18 aa, Mycobacterium tuberculosis
WAPYVVLVGIGWVIMLVT

SEQ ID NO: 1386619 - protein, 20 aa, Mycobacterium tuberculosis
WCSPLGWSLQVRPYAGERWW

SEQ ID NO: 1386620 - protein, 17 aa, Mycobacterium tuberculosis
WDITKLRGPAKWSYYYL

SEQ ID NO: 1386621 - protein, 17 aa, Mycobacterium tuberculosis
WDVGLAMLIAGGVNAAM

SEQ ID NO: 1386622 - protein, 17 aa, Mycobacterium tuberculosis
WEAGNKFIARRNLIWSV

SEQ ID NO: 1386623 - protein, 17 aa, Mycobacterium tuberculosis
WEFYMALAYFKLAIIAA

SEQ ID NO: 1386624 - protein, 21 aa, Mycobacterium tuberculosis
WFCGWCVLGGVFFVLVFFCVL

SEQ ID NO: 1386625 - protein, 19 aa, Mycobacterium tuberculosis
WLAVPVLAYAGWRMFVRRD

SEQ ID NO: 1386626 - protein, 22 aa, Mycobacterium tuberculosis
WLGRFVSTYGWRAYALPVLMVL

SEQ ID NO: 1386627 - protein, 22 aa, Mycobacterium tuberculosis
WLPARWRHWWWALLLAFVPIHL

SEQ ID NO: 1386628 - protein, 25 aa, Mycobacterium tuberculosis
WLRRKHGLSSLGWDLCRIFTDGDYT

SEQ ID NO: 1386629 - protein, 20 aa, Mycobacterium tuberculosis
WLVLHLVYLVGYRNRIAALF

SEQ ID NO: 1386630 - protein, 17 aa, Mycobacterium tuberculosis
WMTPYGLRRVCDGFATA

SEQ ID NO: 1386631 - protein, 17 aa, Mycobacterium tuberculosis
WPAWLGVYGFMTLDRWL

SEQ ID NO: 1386632 - protein, 18 aa, Mycobacterium tuberculosis
WPCPRPAPGQSPAPSLPS

SEQ ID NO: 1386633 - protein, 21 aa, Mycobacterium tuberculosis
WPGGRPGMRGCLRGEFGRTAY

SEQ ID NO: 1386634 - protein, 22 aa, Mycobacterium tuberculosis
WPGGRPGMRGCLRGEFGRTAYP

SEQ ID NO: 1386635 - protein, 21 aa, Mycobacterium tuberculosis
WPLFAWFCVYAYRNFVRYEET

SEQ ID NO: 1386636 - protein, 18 aa, Mycobacterium tuberculosis
WPRGDLRNHRRCEEKAEK

SEQ ID NO: 1386637 - protein, 21 aa, Mycobacterium tuberculosis
WPSWRCWRACRRRARHGLHRC

SEQ ID NO: 1386638 - protein, 17 aa, Mycobacterium tuberculosis
WQGEFLVAVIELIPRPF

SEQ ID NO: 1386639 - protein, 17 aa, Mycobacterium tuberculosis
WRPVLLIPLTFALFTPL

SEQ ID NO: 1386640 - protein, 23 aa, Mycobacterium tuberculosis
WRRVGTVVVRWPLPVLVATCAIA

SEQ ID NO: 1386641 - protein, 18 aa, Mycobacterium tuberculosis
WRVVELDVSYGPRTGGKS

SEQ ID NO: 1386642 - protein, 22 aa, Mycobacterium tuberculosis
WRWRLPRCWVTWWRPRRWRVRR

SEQ ID NO: 1386643 - protein, 17 aa, Mycobacterium tuberculosis
WRWRWFRAAMCKTMAVA

SEQ ID NO: 1386644 - protein, 17 aa, Mycobacterium tuberculosis
WSRNRMAFLAALFFLLA

SEQ ID NO: 1386645 - protein, 17 aa, Mycobacterium tuberculosis
WSVRANLHFLWLRLARV

SEQ ID NO: 1386646 - protein, 17 aa, Mycobacterium tuberculosis
WTALWLSQAWQQRVLEE

SEQ ID NO: 1386647 - protein, 20 aa, Mycobacterium tuberculosis
WTIFYWGWWISWAPFVGMFI

SEQ ID NO: 1386648 - protein, 17 aa, Mycobacterium tuberculosis
WTVGLCLYGLVMGSVVH

SEQ ID NO: 1386649 - protein, 17 aa, Mycobacterium tuberculosis
WVAVVAVLAVLTVVVTI

SEQ ID NO: 1386650 - protein, 18 aa, Mycobacterium tuberculosis
WWAPRWARRLQTRIGLGR

SEQ ID NO: 1386651 - protein, 22 aa, Mycobacterium tuberculosis
WWGQPAWSWAVLGLRGRRPVKW

SEQ ID NO: 1386652 - protein, 17 aa, Mycobacterium tuberculosis
WWMMVCWSQPLRARPDS

SEQ ID NO: 1386653 - protein, 17 aa, Mycobacterium tuberculosis
YAAGVPYRTQWDAGAVV

SEQ ID NO: 1386654 - protein, 17 aa, Mycobacterium tuberculosis
YAILCLPVLFAAGMCLL

SEQ ID NO: 1386655 - protein, 20 aa, Mycobacterium tuberculosis
YAPLWRTAWRRLRQRPFQYI

SEQ ID NO: 1386656 - protein, 21 aa, Mycobacterium tuberculosis
YAPLWRTAWRRLRQRPFQYIL

SEQ ID NO: 1386657 - protein, 19 aa, Mycobacterium tuberculosis
YDARWLVTRMTTITSLDLT

SEQ ID NO: 1386658 - protein, 20 aa, Mycobacterium tuberculosis
YGLDAARGWAHRPFIGSFVA

SEQ ID NO: 1386659 - protein, 23 aa, Mycobacterium tuberculosis
YMRYPVFLGFDIVGGVAWGAGVT

SEQ ID NO: 1386660 - protein, 17 aa, Mycobacterium tuberculosis
YNMPLELVLTVIPFLII

SEQ ID NO: 1386661 - protein, 17 aa, Mycobacterium tuberculosis
YRPVAATVRHQAFSGDL

SEQ ID NO: 1386662 - protein, 19 aa, Mycobacterium tuberculosis
YRRAEICRERLGPVLRRLT

SEQ ID NO: 1386663 - protein, 19 aa, Mycobacterium tuberculosis
YRSSWPIERLTMFSDHDSG

SEQ ID NO: 1386664 - protein, 18 aa, Mycobacterium tuberculosis
YWLAAAFGVTALVLSAVY

SEQ ID NO: 1386665 - protein, 20 aa, Mycobacterium tuberculosis
YWYRSIRQPVQFARAVRNAF

SEQ ID NO: 1386666 - protein, 18 aa, Mycobacterium tuberculosis
QLLPLLDDYRHASTEYAL

SEQ ID NO: 1386667 - protein, 22 aa, Mycobacterium tuberculosis
RGFHRLKQWRGIATRYDKYALT

SEQ ID NO: 1386668 - protein, 18 aa, Mycobacterium tuberculosis
GDCLAPPRPVLRAALSPG

SEQ ID NO: 1386669 - protein, 19 aa, Mycobacterium tuberculosis
YDKYALTYLGGVLLACAVI

SEQ ID NO: 1386670 - protein, 17 aa, Mycobacterium tuberculosis
RTLPRWQRIVALTMIGI

SEQ ID NO: 1386671 - protein, 19 aa, Mycobacterium tuberculosis
FPTSWLPLLIVTSGVVFAY

SEQ ID NO: 1386672 - protein, 26 aa, Mycobacterium tuberculosis
GELEFWAALIKVLALMAFLVVGTVFL

SEQ ID NO: 1386673 - protein, 17 aa, Mycobacterium tuberculosis
GPGLFLVYGVCGVFVFL

SEQ ID NO: 1386674 - protein, 23 aa, Mycobacterium tuberculosis
GSVALLALLLPYTAYKAGESPFV

SEQ ID NO: 1386675 - protein, 19 aa, Mycobacterium tuberculosis
LVYGVCGVFVFLILRALGE

SEQ ID NO: 1386676 - protein, 35 aa, Mycobacterium tuberculosis; identical to SEQ ID NO: 163445

SEQ ID NO: 1386677 - protein, 29 aa, Mycobacterium tuberculosis
AAAILPPRLFGSPVFAVCCVLSFVVGFAM

SEQ ID NO: 1386678 - protein, 24 aa, Mycobacterium tuberculosis
AAALLGFPLLLVVGVSLAYLYVVL

SEQ ID NO: 1386679 - protein, 34 aa, Mycobacterium tuberculosis; identical to SEQ ID NO: 161714

SEQ ID NO: 1386680 - protein, 24 aa, Mycobacterium tuberculosis
AAAPVNYLKLLPATYVVLVLVVGY

SEQ ID NO: 1386681 - protein, 26 aa, Mycobacterium tuberculosis
AAGLPWYAILCLPVLFAAGMCLLDTI

SEQ ID NO: 1386682 - protein, 28 aa, Mycobacterium tuberculosis
AAGLTYYTIFAIFPLLMVGFGVGGFALS

SEQ ID NO: 1386683 - protein, 28 aa, Mycobacterium tuberculosis
AAGVLLIGLVRWYLGTALFDSIARKLSS

SEQ ID NO: 1386684 - protein, 19 aa, Mycobacterium tuberculosis
AALCLPLARVLAAASCGPL

SEQ ID NO: 1386685 - protein, 20 aa, Mycobacterium tuberculosis
AALEKINLLAAKLGGRDTRV

SEQ ID NO: 1386686 - protein, 24 aa, Mycobacterium tuberculosis
AALWAVYTPRWWLSGLLVGVASGV

SEQ ID NO: 1386687 - protein, 42 aa, Mycobacterium tuberculosis; identical to SEQ ID NO: 161741

SEQ ID NO: 1386688 - protein, 32 aa, Mycobacterium tuberculosis; identical to SEQ ID NO: 161743

SEQ ID NO: 1386689 - protein, 24 aa, Mycobacterium tuberculosis
AASVLPVWLLLAPRDYLSTFMKVG

SEQ ID NO: 1386690 - protein, 27 aa, Mycobacterium tuberculosis
AATVGITFLGMRFAKLGVFSTVGPALA

SEQ ID NO: 1386691 - protein, 28 aa, Mycobacterium tuberculosis
AAVLAICMLPIIGMRWGVAENPTRQGGA

SEQ ID NO: 1386692 - protein, 28 aa, Mycobacterium tuberculosis
ADFDDFFRPIRSYFYWEKHCYDIPVCWS

SEQ ID NO: 1386693 - protein, 21 aa, Mycobacterium tuberculosis
AFVVFTLLVLAVIEIPLVAYL

SEQ ID NO: 1386694 - protein, 36 aa, Mycobacterium tuberculosis; identical to SEQ ID NO: 161791

SEQ ID NO: 1386695 - protein, 23 aa, Mycobacterium tuberculosis
AGGRLHIVIGVIMLLLAARMVAR

SEQ ID NO: 1386696 - protein, 20 aa, Mycobacterium tuberculosis
AGSWIYTAFFAMLAASTVAI

SEQ ID NO: 1386697 - protein, 23 aa, Mycobacterium tuberculosis
AGSWLPALLWGVAFAILVRGLPV

SEQ ID NO: 1386698 - protein, 25 aa, Mycobacterium tuberculosis
AGTVFIVAVIFFTGYILGKHAGHGG

SEQ ID NO: 1386699 - protein, 30 aa, Mycobacterium tuberculosis; identical to SEQ ID NO: 161830

SEQ ID NO: 1386700 - protein, 27 aa, Mycobacterium tuberculosis
AIAGAFAVLFLPYSLLGPFAGALMDRW

SEQ ID NO: 1386701 - protein, 37 aa, Mycobacterium tuberculosis; identical to SEQ ID NO: 161839

SEQ ID NO: 1386702 - protein, 24 aa, Mycobacterium tuberculosis
AIGLVVAIVFLLVRVVRAPVEVKP

SEQ ID NO: 1386703 - protein, 46 aa, Mycobacterium tuberculosis; identical to SEQ ID NO: 161842

SEQ ID NO: 1386704 - protein, 20 aa, Mycobacterium tuberculosis
AILVMGFPVLLKLTSNELGA

SEQ ID NO: 1386705 - protein, 19 aa, Mycobacterium tuberculosis
AISSIRWVNGLFGRLAWLF

SEQ ID NO: 1386706 - protein, 51 aa, Mycobacterium tuberculosis; identical to SEQ ID NO: 164322

SEQ ID NO: 1386707 - protein, 25 aa, Mycobacterium tuberculosis
AKTRVIAFLRKPIVTVSLVGIGSVV

SEQ ID NO: 1386708 - protein, 27 aa, Mycobacterium tuberculosis
ALAAALALFVLLLGPTLFLLQSWVQNL

SEQ ID NO: 1386709 - protein, 30 aa, Mycobacterium tuberculosis; identical to SEQ ID NO: 161871

SEQ ID NO: 1386710 - protein, 25 aa, Mycobacterium tuberculosis
ALGVRTLFRVPFLANWKISAAYLNW

SEQ ID NO: 1386711 - protein, 22 aa, Mycobacterium tuberculosis
ALGYVFVLLIVPVALILWRTFE

SEQ ID NO: 1386712 - protein, 32 aa, Mycobacterium tuberculosis; identical to SEQ ID NO: 161887

SEQ ID NO: 1386713 - protein, 33 aa, Mycobacterium tuberculosis; identical to SEQ ID NO: 161896

SEQ ID NO: 1386714 - protein, 18 aa, Mycobacterium tuberculosis
AMLYGSFFMHRGVPYFPN

SEQ ID NO: 1386715 - protein, 20 aa, Mycobacterium tuberculosis
APLLGVLCSISWQRPVPVIQ

SEQ ID NO: 1386716 - protein, 28 aa, Mycobacterium tuberculosis
APMGRRLAALLIDWLIAYGLALLGVEFG

SEQ ID NO: 1386717 - protein, 18 aa, Mycobacterium tuberculosis
AQLLDWIHQAADAAEPVI

SEQ ID NO: 1386718 - protein, 25 aa, Mycobacterium tuberculosis
AQPGYALVGVLRIPQRRASPARVIS

SEQ ID NO: 1386719 - protein, 26 aa, Mycobacterium tuberculosis
ARRFALSPIPVYLLAGLSLGNGGILG

SEQ ID NO: 1386720 - protein, 24 aa, Mycobacterium tuberculosis
ASALAWVMFAILLVLTVLQLRITH

SEQ ID NO: 1386721 - protein, 26 aa, Mycobacterium tuberculosis
ASATAFPWVFLFPASILVLILVCANL

SEQ ID NO: 1386722 - protein, 26 aa, Mycobacterium tuberculosis
ASGLIFGWLAFLLVFGLFVRKGWDIV

SEQ ID NO: 1386723 - protein, 38 aa, Mycobacterium tuberculosis; identical to SEQ ID NO: 161955

SEQ ID NO: 1386724 - protein, 24 aa, Mycobacterium tuberculosis
ASMTMVWLAVLLYVKIGQPDDGVV

SEQ ID NO: 1386725 - protein, 23 aa, Mycobacterium tuberculosis
ATLKILIFSLLAGALLPGLFAVG

SEQ ID NO: 1386726 - protein, 24 aa, Mycobacterium tuberculosis
ATNQLYVLLSGQLHPVYNLTSARL

SEQ ID NO: 1386727 - protein, 25 aa, Mycobacterium tuberculosis
ATPIAFLLFAFFGGFAIMLGAELNA

SEQ ID NO: 1386728 - protein, 35 aa, Mycobacterium tuberculosis; identical to SEQ ID NO: 161991

SEQ ID NO: 1386729 - protein, 26 aa, Mycobacterium tuberculosis
ATVEPIYYPRYLILTAPAAAVILAVC

SEQ ID NO: 1386730 - protein, 23 aa, Mycobacterium tuberculosis
AVAYFWMHQPYALWPIGGPPDGN

SEQ ID NO: 1386731 - protein, 48 aa, Mycobacterium tuberculosis; identical to SEQ ID NO: 162003

SEQ ID NO: 1386732 - protein, 34 aa, Mycobacterium tuberculosis; identical to SEQ ID NO: 162006

SEQ ID NO: 1386733 - protein, 35 aa, Mycobacterium tuberculosis
AVIWGIWLVIVGWLTLWPFLSWLTTHFVVTNRRVM

SEQ ID NO: 1386734 - protein, 21 aa, Mycobacterium tuberculosis
AVLAILVWWALRHRNRCSVNA

SEQ ID NO: 1386735 - protein, 27 aa, Mycobacterium tuberculosis
AVLPAKLILMAIALICAAAVFSAIALR

SEQ ID NO: 1386736 - protein, 24 aa, Mycobacterium tuberculosis
AVLTSPIGFLQRPARWIQMLASNT

SEQ ID NO: 1386737 - protein, 33 aa, Mycobacterium tuberculosis; identical to SEQ ID NO: 162031

SEQ ID NO: 1386738 - protein, 27 aa, Mycobacterium tuberculosis
AVVAGRWQLIAFAAPLLGVLCSISWQR

SEQ ID NO: 1386739 - protein, 26 aa, Mycobacterium tuberculosis
AVVGIGLGLALYFTPAMSAREIVIIG

SEQ ID NO: 1386740 - protein, 21 aa, Mycobacterium tuberculosis
AVVVFMLFPLGFSLYMSFQKW

SEQ ID NO: 1386741 - protein, 26 aa, Mycobacterium tuberculosis
AWIDRAVVIWVLIALAAAMVVYIVAW

SEQ ID NO: 1386742 - protein, 21 aa, Mycobacterium tuberculosis
AWLYHAIERLILARRISTVRT

SEQ ID NO: 1386743 - protein, 21 aa, Mycobacterium tuberculosis
AYGAGLWYGVVRERNIGALKP

SEQ ID NO: 1386744 - protein, 44 aa, Mycobacterium tuberculosis; identical to SEQ ID NO: 162066

SEQ ID NO: 1386745 - protein, 17 aa, Mycobacterium tuberculosis
CGHMWVARRTGMKVRRY

SEQ ID NO: 1386746 - protein, 23 aa, Mycobacterium tuberculosis
CSPWQIYWRILLPHSRPAVLVLG

SEQ ID NO: 1386747 - protein, 20 aa, Mycobacterium tuberculosis
DAAPAVLPPMGAKLGQRAAA

SEQ ID NO: 1386748 - protein, 25 aa, Mycobacterium tuberculosis
DDASSWLVRRPPLHGLTPSAHDMAR

SEQ ID NO: 1386749 - protein, 20 aa, Mycobacterium tuberculosis
DEFVVAVRQLAIGQDAPIEV

SEQ ID NO: 1386750 - protein, 26 aa, Mycobacterium tuberculosis
DESIEAFRRFHAALFSKDIQPAELGK

SEQ ID NO: 1386751 - protein, 25 aa, Mycobacterium tuberculosis
DEWTPPLLQSLYLVVLGAGIGLSMQ

SEQ ID NO: 1386752 - protein, 26 aa, Mycobacterium tuberculosis
DGAALTFPMLQFSLLGAICLLGTLWL

SEQ ID NO: 1386753 - protein, 23 aa, Mycobacterium tuberculosis
DGRHPFLVMELIEGGTLRELLIE

SEQ ID NO: 1386754 - protein, 19 aa, Mycobacterium tuberculosis
DIEPIYLLKREVVELRRCV

SEQ ID NO: 1386755 - protein, 24 aa, Mycobacterium tuberculosis
DKKRYLWLMGLIAPTALVVMLPLI

SEQ ID NO: 1386756 - protein, 37 aa, Mycobacterium tuberculosis; identical to SEQ ID NO: 162123

SEQ ID NO: 1386757 - protein, 26 aa, Mycobacterium tuberculosis
DLSMLLGLIFLLWSGPGRWSLDRRLS

SEQ ID NO: 1386758 - protein, 17 aa, Mycobacterium tuberculosis
DPPIFIVGHWRTGTTLL

SEQ ID NO: 1386759 - protein, 23 aa, Mycobacterium tuberculosis
DPRYLWAGLVLLAATAASSDLSS

SEQ ID NO: 1386760 - protein, 50 aa, Mycobacterium tuberculosis; identical to SEQ ID NO: 162140

SEQ ID NO: 1386761 - protein, 20 aa, Mycobacterium tuberculosis
DRNIDRLLRRVCPGDIVVLD

SEQ ID NO: 1386762 - protein, 19 aa, Mycobacterium tuberculosis
DRTLMWVVDLLLVVPSFIL

SEQ ID NO: 1386763 - protein, 25 aa, Mycobacterium tuberculosis
DTHPGWVNLPAVILIGLCALLLIRG

SEQ ID NO: 1386764 - protein, 23 aa, Mycobacterium tuberculosis
DVRQILFLVQMTATVLVTAPIMC

SEQ ID NO: 1386765 - protein, 24 aa, Mycobacterium tuberculosis
DVTPRRGWLESLLGHFCDPTVALV

SEQ ID NO: 1386766 - protein, 23 aa, Mycobacterium tuberculosis
EAEQPLPGPRWPRALRASATRRA

SEQ ID NO: 1386767 - protein, 29 aa, Mycobacterium tuberculosis
EAIGMRLRDMLWAAIFPSLDLATDSAREV

SEQ ID NO: 1386768 - protein, 18 aa, Mycobacterium tuberculosis
EDFLCPACGIFERGFGPT

SEQ ID NO: 1386769 - protein, 31 aa, Mycobacterium tuberculosis; identical to SEQ ID NO: 162199

SEQ ID NO: 1386770 - protein, 22 aa, Mycobacterium tuberculosis
EGQRLLARLDVLSLAAASAPVV

SEQ ID NO: 1386771 - protein, 25 aa, Mycobacterium tuberculosis
EHPSLVLQVILFVAVVFGTLNVIGG

SEQ ID NO: 1386772 - protein, 23 aa, Mycobacterium tuberculosis
EHVTPWFNLDWITSAKLVAVVGF

SEQ ID NO: 1386773 - protein, 19 aa, Mycobacterium tuberculosis
EIWKRTLFRFVQQVYFRRR

SEQ ID NO: 1386774 - protein, 23 aa, Mycobacterium tuberculosis
EMHWSIPGLTFVILVAVGADYNM

SEQ ID NO: 1386775 - protein, 29 aa, Mycobacterium tuberculosis
EMKLVTLYILAMPIALLSFAAASVLISSA

SEQ ID NO: 1386776 - protein, 24 aa, Mycobacterium tuberculosis
EPIGPLTYLVLKRVDDLAYGAGLW

SEQ ID NO: 1386777 - protein, 25 aa, Mycobacterium tuberculosis
EPVRIGLVVLMLNRRRPLLHLLTFL

SEQ ID NO: 1386778 - protein, 19 aa, Mycobacterium tuberculosis
ERLWSAIGLVPQRSYLFSG

SEQ ID NO: 1386779 - protein, 25 aa, Mycobacterium tuberculosis
ERSFGLLARLWVLPVHRASGLISRI

SEQ ID NO: 1386780 - protein, 22 aa, Mycobacterium tuberculosis
ESAAWPAGVPWTDASLSSAAGR

SEQ ID NO: 1386781 - protein, 25 aa, Mycobacterium tuberculosis
EYLCLMPIFPLALWLMNVYAAIRYR

SEQ ID NO: 1386782 - protein, 18 aa, Mycobacterium tuberculosis
FAFILVSAGVVVLRRTRP

SEQ ID NO: 1386783 - protein, 27 aa, Mycobacterium tuberculosis
FAIMHLLTHGFFKAGLFLGSGAVIHAM

SEQ ID NO: 1386784 - protein, 30 aa, Mycobacterium tuberculosis; identical to SEQ ID NO: 162280

SEQ ID NO: 1386785 - protein, 17 aa, Mycobacterium tuberculosis
FEHVNFAYLPGTPVIRD

SEQ ID NO: 1386786 - protein, 17 aa, Mycobacterium tuberculosis
FFALTDQVSIAEAEEFA

SEQ ID NO: 1386787 - protein, 30 aa, Mycobacterium tuberculosis; identical to SEQ ID NO: 162290

SEQ ID NO: 1386788 - protein, 25 aa, Mycobacterium tuberculosis
FGITTVYHFIFVPLTIGLAPLIAVM

SEQ ID NO: 1386789 - protein, 18 aa, Mycobacterium tuberculosis
FGLIAGLVGCYRGLTTKG

SEQ ID NO: 1386790 - protein, 23 aa, Mycobacterium tuberculosis
FGSPYAIFLLREHFRLIPDDLIN

SEQ ID NO: 1386791 - protein, 19 aa, Mycobacterium tuberculosis
FIQYIRQFNMPLSQLAGMY

SEQ ID NO: 1386792 - protein, 33 aa, Mycobacterium tuberculosis; identical to SEQ ID NO: 161705

SEQ ID NO: 1386793 - protein, 19 aa, Mycobacterium tuberculosis
FLGPWLFSVFVDVFHTVRA

SEQ ID NO: 1386794 - protein, 33 aa, Mycobacterium tuberculosis; identical to SEQ ID NO: 162344

SEQ ID NO: 1386795 - protein, 21 aa, Mycobacterium tuberculosis
FVVGFAMLGALTFVPIYLGYV

SEQ ID NO: 1386796 - protein, 25 aa, Mycobacterium tuberculosis
GARLLYQWRWSLATLWFTTVFLLIM

SEQ ID NO: 1386797 - protein, 28 aa, Mycobacterium tuberculosis
GEAPQRAWLWLGWLSAATVAGWVLDAVT

SEQ ID NO: 1386798 - protein, 17 aa, Mycobacterium tuberculosis
GETVAVLVILRSAARPG

SEQ ID NO: 1386799 - protein, 19 aa, Mycobacterium tuberculosis
GFKRWWTRFVPPSIERSTY

SEQ ID NO: 1386800 - protein, 29 aa, Mycobacterium tuberculosis
GGIVVALLVSAWWLFEALRHPVRSRLADL

SEQ ID NO: 1386801 - protein, 28 aa, Mycobacterium tuberculosis
GGTTIVVVFAVVLVFYIVTSRDDKKDGV

SEQ ID NO: 1386802 - protein, 19 aa, Mycobacterium tuberculosis
GIGLLLAALVLTTIANPPA

SEQ ID NO: 1386803 - protein, 23 aa, Mycobacterium tuberculosis
GINTLFPLFGIANQLLAGIALTV

SEQ ID NO: 1386804 - protein, 25 aa, Mycobacterium tuberculosis
GLRNTFWALVLPFMFGSPYAIFLLR

SEQ ID NO: 1386805 - protein, 21 aa, Mycobacterium tuberculosis
GMNLAICLVLIYAIALVWGLP

SEQ ID NO: 1386806 - protein, 27 aa, Mycobacterium tuberculosis
GNFVENWAILIIPFALCFAFGKMVHDR

SEQ ID NO: 1386807 - protein, 27 aa, Mycobacterium tuberculosis
GPRLIDAYVDWLWFGELGYRSVFTTML

SEQ ID NO: 1386808 - protein, 24 aa, Mycobacterium tuberculosis
GPTAFWACGLLLCVFIGPAQSSAR

SEQ ID NO: 1386809 - protein, 26 aa, Mycobacterium tuberculosis
GPVLGLMVFAFVTAWLILFATAWAAT

SEQ ID NO: 1386810 - protein, 43 aa, Mycobacterium tuberculosis; identical to SEQ ID NO: 162527

SEQ ID NO: 1386811 - protein, 25 aa, Mycobacterium tuberculosis
GRMVVAWLVTLPLAGLVGAFTYGLV

SEQ ID NO: 1386812 - protein, 24 aa, Mycobacterium tuberculosis
GSGGVPLGGWLARSVFAAKFAERN

SEQ ID NO: 1386813 - protein, 43 aa, Mycobacterium tuberculosis; identical to SEQ ID NO: 162554

SEQ ID NO: 1386814 - protein, 26 aa, Mycobacterium tuberculosis
GVGLKAFWYHFAIMFEALFILTTVDA

SEQ ID NO: 1386815 - protein, 18 aa, Mycobacterium tuberculosis
GVMYSIPLRRALVTGSDL

SEQ ID NO: 1386816 - protein, 28 aa, Mycobacterium tuberculosis
GVPIFFVLSGFLLFRPWVKSAATGGPPP

SEQ ID NO: 1386817 - protein, 24 aa, Mycobacterium tuberculosis
GVRILSFAWATLAGLLPGTAAVVI

SEQ ID NO: 1386818 - protein, 27 aa, Mycobacterium tuberculosis
GVSLAYLYVVLLFAPVLIVLERLPIVE

SEQ ID NO: 1386819 - protein, 33 aa, Mycobacterium tuberculosis; identical to SEQ ID NO: 162591

SEQ ID NO: 1386820 - protein, 31 aa, Mycobacterium tuberculosis; identical to SEQ ID NO: 162595

SEQ ID NO: 1386821 - protein, 26 aa, Mycobacterium tuberculosis
GYFTTRLLERLPLSSYRRPLLGTGLC

SEQ ID NO: 1386822 - protein, 43 aa, Mycobacterium tuberculosis; identical to SEQ ID NO: 162607

SEQ ID NO: 1386823 - protein, 31 aa, Mycobacterium tuberculosis; identical to SEQ ID NO: 162625

SEQ ID NO: 1386824 - protein, 20 aa, Mycobacterium tuberculosis
HMWVARRTGMKVRRYFVGFG

SEQ ID NO: 1386825 - protein, 18 aa, Mycobacterium tuberculosis
HSSLLVAYLALLIGLGFG

SEQ ID NO: 1386826 - protein, 25 aa, Mycobacterium tuberculosis
IAAFKIIMLCLWWGAATSKLNHHFP

SEQ ID NO: 1386827 - protein, 35 aa, Mycobacterium tuberculosis; identical to SEQ ID NO: 162657

SEQ ID NO: 1386828 - protein, 19 aa, Mycobacterium tuberculosis
IASIIGLLFYLLRSRRSAR

SEQ ID NO: 1386829 - protein, 20 aa, Mycobacterium tuberculosis
IASLWFTIFGDSALLRQRNN

SEQ ID NO: 1386830 - protein, 24 aa, Mycobacterium tuberculosis
IEPTNRAVLLPLGLTPEQVSQARP

SEQ ID NO: 1386831 - protein, 18 aa, Mycobacterium tuberculosis
IFAASMSGLLFSSIGTVV

SEQ ID NO: 1386832 - protein, 25 aa, Mycobacterium tuberculosis
IGAAVALGFFVWLEGRAAAAILPPR

SEQ ID NO: 1386833 - protein, 25 aa, Mycobacterium tuberculosis
IGHGRLFGFYVAFYCAGRFCVELLR

SEQ ID NO: 1386834 - protein, 25 aa, Mycobacterium tuberculosis
IGMGLLFDTLIVRSFMTPSIAALLG

SEQ ID NO: 1386835 - protein, 23 aa, Mycobacterium tuberculosis
IGTGIFFVLAQAVPEAGPGVIVS

SEQ ID NO: 1386836 - protein, 27 aa, Mycobacterium tuberculosis
IGVAMLIGRFFLIIPVLAIAGSLARKG

SEQ ID NO: 1386837 - protein, 25 aa, Mycobacterium tuberculosis
IHDCPKLLQLRTFPTIAIGGDLAGA

SEQ ID NO: 1386838 - protein, 25 aa, Mycobacterium tuberculosis
ILAGAALLAYFKPQGKLGGTSLFTD

SEQ ID NO: 1386839 - protein, 18 aa, Mycobacterium tuberculosis
ILVRLAVLLALVATQAAV

SEQ ID NO: 1386840 - protein, 25 aa, Mycobacterium tuberculosis
ILYIISFSLFIYGLMGLTGPKTAVR

SEQ ID NO: 1386841 - protein, 18 aa, Mycobacterium tuberculosis
IMIAVFCGFAFAGMPLVA

SEQ ID NO: 1386842 - protein, 24 aa, Mycobacterium tuberculosis
IMLGWLGIGPIPWLIEPRWAMVSL

SEQ ID NO: 1386843 - protein, 20 aa, Mycobacterium tuberculosis
IPVLFALIALWLTRGGQIPN

SEQ ID NO: 1386844 - protein, 19 aa, Mycobacterium tuberculosis
IRPVAPEAYALYGISRVLP

SEQ ID NO: 1386845 - protein, 38 aa, Mycobacterium tuberculosis; identical to SEQ ID NO: 162744

SEQ ID NO: 1386846 - protein, 19 aa, Mycobacterium tuberculosis
ISGAFLYLIGILNVIVLVG

SEQ ID NO: 1386847 - protein, 24 aa, Mycobacterium tuberculosis
ISGATIFFFLFVHVLDAAMLRVSP

SEQ ID NO: 1386848 - protein, 19 aa, Mycobacterium tuberculosis
ISLTILIGVGFLFLYQGVT

SEQ ID NO: 1386849 - protein, 23 aa, Mycobacterium tuberculosis
ITGGVGWWYILVATGFVVFALYC

SEQ ID NO: 1386850 - protein, 23 aa, Mycobacterium tuberculosis
ITGPAIWISFLIAAATCALAALC

SEQ ID NO: 1386851 - protein, 17 aa, Mycobacterium tuberculosis
IVALWVSRTDGVVLHWI

SEQ ID NO: 1386852 - protein, 40 aa, Mycobacterium tuberculosis; identical to SEQ ID NO: 162768

SEQ ID NO: 1386853 - protein, 22 aa, Mycobacterium tuberculosis
IVHAQAAWTSPLLPAADELADR

SEQ ID NO: 1386854 - protein, 24 aa, Mycobacterium tuberculosis
IVPVALILWRTFEPGFGQFYAWIS

SEQ ID NO: 1386855 - protein, 25 aa, Mycobacterium tuberculosis
IVSTPLRFWEYLAAKLTVLLAISLF

SEQ ID NO: 1386856 - protein, 25 aa, Mycobacterium tuberculosis
IWQIGRPWYLAWAGLVYVVATLATL

SEQ ID NO: 1386857 - protein, 23 aa, Mycobacterium tuberculosis
KADPPFVAYHLFGPAPATDNDLL

SEQ ID NO: 1386858 - protein, 24 aa, Mycobacterium tuberculosis
KDGKAWILPIGLAGDLGTPKSYHA

SEQ ID NO: 1386859 - protein, 23 aa, Mycobacterium tuberculosis
KGISLFRTVVFLPLAISSVVMAV

SEQ ID NO: 1386860 - protein, 20 aa, Mycobacterium tuberculosis
KNFYYFPDQLSIDRYLDRNG

SEQ ID NO: 1386861 - protein, 25 aa, Mycobacterium tuberculosis
KQLITIARAFLARPQLLILDEATSS

SEQ ID NO: 1386862 - protein, 26 aa, Mycobacterium tuberculosis
KVTTSPLPMKPIPQPVLQPVAQPNPQ

SEQ ID NO: 1386863 - protein, 18 aa, Mycobacterium tuberculosis
LAGWGIVLGLIGLVAVWR

SEQ ID NO: 1386864 - protein, 20 aa, Mycobacterium tuberculosis
LAITGLVASAAWTIGSNLSG

SEQ ID NO: 1386865 - protein, 18 aa, Mycobacterium tuberculosis
LALLIGVVAGLRSLTAPA

SEQ ID NO: 1386866 - protein, 19 aa, Mycobacterium tuberculosis
LAMPLTLVGALGGLALVLV

SEQ ID NO: 1386867 - protein, 18 aa, Mycobacterium tuberculosis
LAQFLFGVQLEIAPVTVG

SEQ ID NO: 1386868 - protein, 24 aa, Mycobacterium tuberculosis
LAVLIRQWLLDHLAVAPGLKRQPD

SEQ ID NO: 1386869 - protein, 27 aa, Mycobacterium tuberculosis
LAVSIPLTVLIIFTLNILLAEFGAADI

SEQ ID NO: 1386870 - protein, 18 aa, Mycobacterium tuberculosis
LAYLLLVLVCRRRWQPRL

SEQ ID NO: 1386871 - protein, 24 aa, Mycobacterium tuberculosis
LDHAYTYGLLWVAGAAIIVGGMAL

SEQ ID NO: 1386872 - protein, 29 aa, Mycobacterium tuberculosis
LEGAFFAFILAGVFQILFGACRLGSLIRY

SEQ ID NO: 1386873 - protein, 21 aa, Mycobacterium tuberculosis
LFVTYWSFRMMIGLMAIPVLF

SEQ ID NO: 1386874 - protein, 23 aa, Mycobacterium tuberculosis
LGDRLQHLILPSLTLALAAAAGF

SEQ ID NO: 1386875 - protein, 17 aa, Mycobacterium tuberculosis
LGIQGYLLALRYLAEHV

SEQ ID NO: 1386876 - protein, 26 aa, Mycobacterium tuberculosis
LGSGWWQTFWRITLPSIRWGLTYGIV

SEQ ID NO: 1386877 - protein, 19 aa, Mycobacterium tuberculosis
LGVLGMFMIIAFSAYSADH

SEQ ID NO: 1386878 - protein, 26 aa, Mycobacterium tuberculosis
LIATGLGLFMIFLDALIVNVALPDIQ

SEQ ID NO: 1386879 - protein, 20 aa, Mycobacterium tuberculosis
LKGRLLFMPGVMVTSVPWQL

SEQ ID NO: 1386880 - protein, 20 aa, Mycobacterium tuberculosis
LKVELPLSIPVLVAGLRVVA

SEQ ID NO: 1386881 - protein, 21 aa, Mycobacterium tuberculosis
LLGMQIPGQLLFSIASQLALI

SEQ ID NO: 1386882 - protein, 17 aa, Mycobacterium tuberculosis
LLHYRAWAIPVAFVIAQ

SEQ ID NO: 1386883 - protein, 20 aa, Mycobacterium tuberculosis
LLMLGIIAVSMFMGMIVLAV

SEQ ID NO: 1386884 - protein, 26 aa, Mycobacterium tuberculosis
LLNYLVLLALASFLTYCLTSLAFSPL

SEQ ID NO: 1386885 - protein, 23 aa, Mycobacterium tuberculosis
LLSISFIVLLILRVVGARAAKRE

SEQ ID NO: 1386886 - protein, 23 aa, Mycobacterium tuberculosis
LNQPPPCLTGFLPASEWRSPADT

SEQ ID NO: 1386887 - protein, 35 aa, Mycobacterium tuberculosis; identical to SEQ ID NO: 163003

SEQ ID NO: 1386888 - protein, 25 aa, Mycobacterium tuberculosis
LPEFSFWAWLAMLFSAGMGIGLVFY

SEQ ID NO: 1386889 - protein, 20 aa, Mycobacterium tuberculosis
LPRLVHLACIWIVAIAVNVS

SEQ ID NO: 1386890 - protein, 27 aa, Mycobacterium tuberculosis
LPSVPRWLWIVLAIGFLTAALAGGTPV

SEQ ID NO: 1386891 - protein, 17 aa, Mycobacterium tuberculosis
LPTITGWSLGRALTGIR

SEQ ID NO: 1386892 - protein, 17 aa, Mycobacterium tuberculosis
LPTLAVSIPLTVLIIFT

SEQ ID NO: 1386893 - protein, 17 aa, Mycobacterium tuberculosis
LRDWIARKAFYGGSAAP

SEQ ID NO: 1386894 - protein, 25 aa, Mycobacterium tuberculosis
LRWRRTMWLHVPAVIWGIGIAAKRV

SEQ ID NO: 1386895 - protein, 25 aa, Mycobacterium tuberculosis
LSEGELFIMGRIKDLLIVYGRNHSP

SEQ ID NO: 1386896 - protein, 19 aa, Mycobacterium tuberculosis
LSMMPEPVVERYRLGEQTI

SEQ ID NO: 1386897 - protein, 21 aa, Mycobacterium tuberculosis
LSRFVWATAIIWILGGLGTWL

SEQ ID NO: 1386898 - protein, 35 aa, Mycobacterium tuberculosis; identical to SEQ ID NO: 163049

SEQ ID NO: 1386899 - protein, 25 aa, Mycobacterium tuberculosis
LSTVVLVIWLLLGVAAVRLFGFTPG

SEQ ID NO: 1386900 - protein, 38 aa, Mycobacterium tuberculosis; identical to SEQ ID NO: 163060

SEQ ID NO: 1386901 - protein, 21 aa, Mycobacterium tuberculosis
LTVIIIVLLITTAASFWSARG

SEQ ID NO: 1386902 - protein, 24 aa, Mycobacterium tuberculosis
LVPTLLVSIPFTVLVAFTLNILLR

SEQ ID NO: 1386903 - protein, 26 aa, Mycobacterium tuberculosis
LVQPPLILFCAVPGAYWLFHGGTIGK

SEQ ID NO: 1386904 - protein, 24 aa, Mycobacterium tuberculosis
LVSVLVSWVLFTWMIGRLPREPVG

SEQ ID NO: 1386905 - protein, 19 aa, Mycobacterium tuberculosis
LVVELFGLLLSPISWTHHW

SEQ ID NO: 1386906 - protein, 24 aa, Mycobacterium tuberculosis
LVVMLPLIWGMNQLGWHAAAQVPL

SEQ ID NO: 1386907 - protein, 29 aa, Mycobacterium tuberculosis
LVYIGIYFGLIIFFTYFYVSITFNPDERA

SEQ ID NO: 1386908 - protein, 25 aa, Mycobacterium tuberculosis
LWTSITVWLIALAVVVWLILSTGNR

SEQ ID NO: 1386909 - protein, 23 aa, Mycobacterium tuberculosis
LYDNYAWWFRVSGLAVLAILVWW

SEQ ID NO: 1386910 - protein, 19 aa, Mycobacterium tuberculosis
MAIAVAVALVLWWRMIRFE

SEQ ID NO: 1386911 - protein, 19 aa, Mycobacterium tuberculosis
MFDDPLQFYSRSIALGIVV

SEQ ID NO: 1386912 - protein, 21 aa, Mycobacterium tuberculosis
MFLLMLFLDFVVHDRDIKWLK

SEQ ID NO: 1386913 - protein, 19 aa, Mycobacterium tuberculosis
MILVLAVLFRLFVGARLID

SEQ ID NO: 1386914 - protein, 23 aa, Mycobacterium tuberculosis
MISLTYFPPLWRKVMDHRVLEHY

SEQ ID NO: 1386915 - protein, 27 aa, Mycobacterium tuberculosis
MLNRRRPLLHLLTFLCGGYTMAGGVAM

SEQ ID NO: 1386916 - protein, 28 aa, Mycobacterium tuberculosis
MLSGLISLVLLLLFAIGGVVWGVMDGRA

SEQ ID NO: 1386917 - protein, 31 aa, Mycobacterium tuberculosis; identical to SEQ ID NO: 163158

SEQ ID NO: 1386918 - protein, 26 aa, Mycobacterium tuberculosis
MVSIPLTVLLIFTLNILLAQFGAADI

SEQ ID NO: 1386919 - protein, 26 aa, Mycobacterium tuberculosis
NAERWNLPIILMVLVAVFGSLAAAAI

SEQ ID NO: 1386920 - protein, 23 aa, Mycobacterium tuberculosis
NANRWWTWTLLAGPGWVAFGATK

SEQ ID NO: 1386921 - protein, 26 aa, Mycobacterium tuberculosis
NAVDFTWITDFKPYQPQLGVPTAWLV

SEQ ID NO: 1386922 - protein, 29 aa, Mycobacterium tuberculosis
NCTIKVMVGFLFLYPAFVAKAHEANGWVQ

SEQ ID NO: 1386923 - protein, 19 aa, Mycobacterium tuberculosis
NDRLLLSMMPEPVVERYRL

SEQ ID NO: 1386924 - protein, 19 aa, Mycobacterium tuberculosis
NGMFLVVLGLLWPHIDLPE

SEQ ID NO: 1386925 - protein, 33 aa, Mycobacterium tuberculosis; identical to SEQ ID NO: 163204

SEQ ID NO: 1386926 - protein, 38 aa, Mycobacterium tuberculosis; identical to SEQ ID NO: 163206

SEQ ID NO: 1386927 - protein, 26 aa, Mycobacterium tuberculosis
NLILAAINLLPLLPFDGGHIAVAVFE

SEQ ID NO: 1386928 - protein, 24 aa, Mycobacterium tuberculosis
NPHTTWVLYAVIVVSALVIVGAIP

SEQ ID NO: 1386929 - protein, 24 aa, Mycobacterium tuberculosis
NSANIMFLVLLLAGFGWMISSRMV

SEQ ID NO: 1386930 - protein, 35 aa, Mycobacterium tuberculosis; identical to SEQ ID NO: 163225

SEQ ID NO: 1386931 - protein, 20 aa, Mycobacterium tuberculosis
NVGTLFAFILVSAGVVVLRR

SEQ ID NO: 1386932 - protein, 25 aa, Mycobacterium tuberculosis
PAAGFFVGWSYWFAWVVTGIADLVA

SEQ ID NO: 1386933 - protein, 18 aa, Mycobacterium tuberculosis
PATILGCWVALAATAGLL

SEQ ID NO: 1386934 - protein, 17 aa, Mycobacterium tuberculosis
PDGARLWLPTYLAWFVG

SEQ ID NO: 1386935 - protein, 19 aa, Mycobacterium tuberculosis
PDPARWPWPTFTVNVVGAF

SEQ ID NO: 1386936 - protein, 31 aa, Mycobacterium tuberculosis; identical to SEQ ID NO: 163268

SEQ ID NO: 1386937 - protein, 24 aa, Mycobacterium tuberculosis
PEHGHAPVFVLFGSAIYLAGLVVH

SEQ ID NO: 1386938 - protein, 40 aa, Mycobacterium tuberculosis; identical to SEQ ID NO: 163300

SEQ ID NO: 1386939 - protein, 21 aa, Mycobacterium tuberculosis
PGTVWWRVTLPLLLPGVVSGS

SEQ ID NO: 1386940 - protein, 22 aa, Mycobacterium tuberculosis
PIGLNLPFTYPPLAAVLFSPFA

SEQ ID NO: 1386941 - protein, 27 aa, Mycobacterium tuberculosis
PIGRAWLRLFGVLPFDYDRLSIAELEP

SEQ ID NO: 1386942 - protein, 20 aa, Mycobacterium tuberculosis
PIIVFVLIFQRRIVAGLTSG

SEQ ID NO: 1386943 - protein, 27 aa, Mycobacterium tuberculosis
PLMGLPPWMVFCSWSLNLIYQFWVHTE

SEQ ID NO: 1386944 - protein, 22 aa, Mycobacterium tuberculosis
PQVPVFALGRYAGVRRQAILAM

SEQ ID NO: 1386945 - protein, 31 aa, Mycobacterium tuberculosis; identical to SEQ ID NO: 164486

SEQ ID NO: 1386946 - protein, 17 aa, Mycobacterium tuberculosis
PSPYLTIAFPNRPPQYE

SEQ ID NO: 1386947 - protein, 19 aa, Mycobacterium tuberculosis
PSTLFAPAGLIPTAAERKL

SEQ ID NO: 1386948 - protein, 31 aa, Mycobacterium tuberculosis; identical to SEQ ID NO: 163363

SEQ ID NO: 1386949 - protein, 27 aa, Mycobacterium tuberculosis
PTLGVLLLGVLLFGLGLGPPLVALMLL

SEQ ID NO: 1386950 - protein, 27 aa, Mycobacterium tuberculosis
PTTAQWVILALLAVALPLASLVGWLVS

SEQ ID NO: 1386951 - protein, 23 aa, Mycobacterium tuberculosis
PVKFSTFYISGPYMPPAAGVETN

SEQ ID NO: 1386952 - protein, 19 aa, Mycobacterium tuberculosis
PVMAPTLTWLFAFVVILAL

SEQ ID NO: 1386953 - protein, 18 aa, Mycobacterium tuberculosis
QATLACIVAFWFLGFDTA

SEQ ID NO: 1386954 - protein, 26 aa, Mycobacterium tuberculosis
QEAAMKYFLLGAFSSAFFLYGVALLY

SEQ ID NO: 1386955 - protein, 18 aa, Mycobacterium tuberculosis
QFRGRDALFWVYVATLMV

SEQ ID NO: 1386956 - protein, 25 aa, Mycobacterium tuberculosis
QGDRLTFLDCLYYAAVTLSTTGYGD

SEQ ID NO: 1386957 - protein, 24 aa, Mycobacterium tuberculosis
QLRITRWFAVRWGAERSLVVGATI

SEQ ID NO: 1386958 - protein, 32 aa, Mycobacterium tuberculosis; identical to SEQ ID NO: 163435

SEQ ID NO: 1386959 - protein, 25 aa, Mycobacterium tuberculosis
QPPDVNTWWAFRTSCTPTECLAAAT

SEQ ID NO: 1386960 - protein, 18 aa, Mycobacterium tuberculosis
QQGKNFYYFPDQLSIDRY

SEQ ID NO: 1386961 - protein, 25 aa, Mycobacterium tuberculosis
QRNVRWARWLAWVSLAVLLTEGAVG

SEQ ID NO: 1386962 - protein, 25 aa, Mycobacterium tuberculosis
QRRRLLRVTRWDVGLAMLIAGGVNA

SEQ ID NO: 1386963 - protein, 33 aa, Mycobacterium tuberculosis; identical to SEQ ID NO: 163480

SEQ ID NO: 1386964 - protein, 30 aa, Mycobacterium tuberculosis; identical to SEQ ID NO: 163482

SEQ ID NO: 1386965 - protein, 18 aa, Mycobacterium tuberculosis
RDRTSFIIAHRLSTIRDA

SEQ ID NO: 1386966 - protein, 25 aa, Mycobacterium tuberculosis
REAGYLIPVIPLLIGGQAAVWLTWP

SEQ ID NO: 1386967 - protein, 19 aa, Mycobacterium tuberculosis
RERRWLVPALLLSATGDWL

SEQ ID NO: 1386968 - protein, 24 aa, Mycobacterium tuberculosis
RFGFLLAIPAVFASGLFSLPDAFH

SEQ ID NO: 1386969 - protein, 19 aa, Mycobacterium tuberculosis
RFRQGLIPSLMWISVPVIL

SEQ ID NO: 1386970 - protein, 22 aa, Mycobacterium tuberculosis
RGRDTLFVLYLSTLMVPLTVTV

SEQ ID NO: 1386971 - protein, 30 aa, Mycobacterium tuberculosis; identical to SEQ ID NO: 163512

SEQ ID NO: 1386972 - protein, 26 aa, Mycobacterium tuberculosis
RHPHWNRLIWPVVVLVLLTGLAAFGS

SEQ ID NO: 1386973 - protein, 41 aa, Mycobacterium tuberculosis; identical to SEQ ID NO: 163520

SEQ ID NO: 1386974 - protein, 27 aa, Mycobacterium tuberculosis
RILGGLVVIMPLYALALDMAFTSGQVV

SEQ ID NO: 1386975 - protein, 24 aa, Mycobacterium tuberculosis
RKDLTWWDLVVFGVSVVIGAGIFT

SEQ ID NO: 1386976 - protein, 30 aa, Mycobacterium tuberculosis; identical to SEQ ID NO: 163534

SEQ ID NO: 1386977 - protein, 23 aa, Mycobacterium tuberculosis
RLKTFLLLVGMSALIVAVGALFG

SEQ ID NO: 1386978 - protein, 29 aa, Mycobacterium tuberculosis
RLRERGWLAILSLRLIPVVPFAAINYAAG

SEQ ID NO: 1386979 - protein, 18 aa, Mycobacterium tuberculosis
RLWLPTYLAWFVGGMMLA

SEQ ID NO: 1386980 - protein, 17 aa, Mycobacterium tuberculosis
RPHYVVMVILHTALLLG

SEQ ID NO: 1386981 - protein, 23 aa, Mycobacterium tuberculosis
RQDLAMTWLLAGLVAGALSGAVA

SEQ ID NO: 1386982 - protein, 23 aa, Mycobacterium tuberculosis
RQHARRMVLVWVSVVLAITGLVA

SEQ ID NO: 1386983 - protein, 24 aa, Mycobacterium tuberculosis
RRHKRLLIGIVVALALVSAMTAAI

SEQ ID NO: 1386984 - protein, 23 aa, Mycobacterium tuberculosis
RRRRALRWGLVFTAGCLLWGLVT

SEQ ID NO: 1386985 - protein, 18 aa, Mycobacterium tuberculosis
RSAGLYRLRLLETSYGVG

SEQ ID NO: 1386986 - protein, 29 aa, Mycobacterium tuberculosis
RSSSGNRAWWILAAVVVVGVLVLVGGIAA

SEQ ID NO: 1386987 - protein, 24 aa, Mycobacterium tuberculosis
RTTHHLFQPLLYQVATGIISEGEI

SEQ ID NO: 1386988 - protein, 19 aa, Mycobacterium tuberculosis
RVGDRLYPALNLASARLIT

SEQ ID NO: 1386989 - protein, 24 aa, Mycobacterium tuberculosis
RVTAVFLVDVLILAVASHCPDSWQ

SEQ ID NO: 1386990 - protein, 19 aa, Mycobacterium tuberculosis
RWPWPTFTVNVVGAFLVGY

SEQ ID NO: 1386991 - protein, 32 aa, Mycobacterium tuberculosis; identical to SEQ ID NO: 163663

SEQ ID NO: 1386992 - protein, 30 aa, Mycobacterium tuberculosis; identical to SEQ ID NO: 163683

SEQ ID NO: 1386993 - protein, 25 aa, Mycobacterium tuberculosis
SGAVAWLISLFYKAIYTGGPINELT

SEQ ID NO: 1386994 - protein, 25 aa, Mycobacterium tuberculosis
SGEILMWVPLPLMGLPPWMVFCSWS

SEQ ID NO: 1386995 - protein, 24 aa, Mycobacterium tuberculosis
SGEPWGTFINLRCVCLAPPYASHD

SEQ ID NO: 1386996 - protein, 30 aa, Mycobacterium tuberculosis; identical to SEQ ID NO: 163692

SEQ ID NO: 1386997 - protein, 18 aa, Mycobacterium tuberculosis
SGLAVLAILVWWALRHRN

SEQ ID NO: 1386998 - protein, 17 aa, Mycobacterium tuberculosis
SGLRRLVTSLRGLRVIV

SEQ ID NO: 1386999 - protein, 24 aa, Mycobacterium tuberculosis
SGNFSWLNWLTILLACSAIDTSSA

SEQ ID NO: 1387000 - protein, 31 aa, Mycobacterium tuberculosis; identical to SEQ ID NO: 163716

SEQ ID NO: 1387001 - protein, 22 aa, Mycobacterium tuberculosis
SIYALGVGAWLYHAIERLILAR

SEQ ID NO: 1387002 - protein, 23 aa, Mycobacterium tuberculosis
SLGLYVLFLFTQTVRHRDFFLPV

SEQ ID NO: 1387003 - protein, 26 aa, Mycobacterium tuberculosis
SLIFAAVLVMLIAVLARLMMRGWRRR

SEQ ID NO: 1387004 - protein, 28 aa, Mycobacterium tuberculosis
SLSPVTLCWLLISYGFAASVLPVWLLLA

SEQ ID NO: 1387005 - protein, 25 aa, Mycobacterium tuberculosis
SMDYEIFLLTRIRERFLQTGQTRDA

SEQ ID NO: 1387006 - protein, 22 aa, Mycobacterium tuberculosis
SMLKGWYMSFWPIISIAVITVT

SEQ ID NO: 1387007 - protein, 19 aa, Mycobacterium tuberculosis
SQQIILDRDLQLVVNSLWE

SEQ ID NO: 1387008 - protein, 26 aa, Mycobacterium tuberculosis
STIVIAILLIAIFLLVRAVPSLRANH

SEQ ID NO: 1387009 - protein, 30 aa, Mycobacterium tuberculosis; identical to SEQ ID NO: 163779

SEQ ID NO: 1387010 - protein, 27 aa, Mycobacterium tuberculosis
SVDAVWKPLLPGYTRPHMRLFSGQVGT

SEQ ID NO: 1387011 - protein, 23 aa, Mycobacterium tuberculosis
SVGVLVYELLTGHTPFTGDSALS

SEQ ID NO: 1387012 - protein, 24 aa, Mycobacterium tuberculosis
SVLLTFYPGWVTIGMMAALVLAAA

SEQ ID NO: 1387013 - protein, 25 aa, Mycobacterium tuberculosis
SWNYTTWLNVIFLVIAAALVVRFIT

SEQ ID NO: 1387014 - protein, 24 aa, Mycobacterium tuberculosis
SWQADHHVAWWVGVGVAAVVTLLS

SEQ ID NO: 1387015 - protein, 24 aa, Mycobacterium tuberculosis
SWSHHWVWMLPAVLVIGLLGWRRR

SEQ ID NO: 1387016 - protein, 27 aa, Mycobacterium tuberculosis
TAVAWLLRFLVRHNMYWFVGYRVLVGT

SEQ ID NO: 1387017 - protein, 19 aa, Mycobacterium tuberculosis
TFWRRAGTRIVRRPKAYLG

SEQ ID NO: 1387018 - protein, 23 aa, Mycobacterium tuberculosis
TINASSVALIWFGGLRIDSGQMQ

SEQ ID NO: 1387019 - protein, 17 aa, Mycobacterium tuberculosis
TIPFLPSYIPQDVDMTA

SEQ ID NO: 1387020 - protein, 17 aa, Mycobacterium tuberculosis
TIPIIVFVLIFQRRIVA

SEQ ID NO: 1387021 - protein, 22 aa, Mycobacterium tuberculosis
TLVLTIPLAWLLHRFTRVQGDR

SEQ ID NO: 1387022 - protein, 25 aa, Mycobacterium tuberculosis
TPSVTGLMILPFSAAVAIVSPLVGH

SEQ ID NO: 1387023 - protein, 29 aa, Mycobacterium tuberculosis
TRAGFLMLLWVFIWSVLRILKTDIYAPTG

SEQ ID NO: 1387024 - protein, 33 aa, Mycobacterium tuberculosis; identical to SEQ ID NO: 163925

SEQ ID NO: 1387025 - protein, 26 aa, Mycobacterium tuberculosis
TSPAWASWLRVVLGSALIVFGVLRWL

SEQ ID NO: 1387026 - protein, 24 aa, Mycobacterium tuberculosis
TSTFVFIGAVVYIILAPKGREAPG

SEQ ID NO: 1387027 - protein, 17 aa, Mycobacterium tuberculosis
TVVHLRLSLLPVLIGLM

SEQ ID NO: 1387028 - protein, 23 aa, Mycobacterium tuberculosis
TYEHYFRTFLRPEDVGWSVVEVV

SEQ ID NO: 1387029 - protein, 25 aa, Mycobacterium tuberculosis
TYRDPLLVMLVIAPVIWTTGVALLT

SEQ ID NO: 1387030 - protein, 38 aa, Mycobacterium tuberculosis; identical to SEQ ID NO: 163973

SEQ ID NO: 1387031 - protein, 24 aa, Mycobacterium tuberculosis
VAELWALLRIYQYQRLFEAVRLTD

SEQ ID NO: 1387032 - protein, 24 aa, Mycobacterium tuberculosis
VAGFVFSWLRRRSGSLIAPIALHW

SEQ ID NO: 1387033 - protein, 26 aa, Mycobacterium tuberculosis
VAKVPLPRWYWIGLAVGILVGVAFVH

SEQ ID NO: 1387034 - protein, 25 aa, Mycobacterium tuberculosis
VALTCAMFLIRDDPRYLWAGLVLLA

SEQ ID NO: 1387035 - protein, 22 aa, Mycobacterium tuberculosis
VALWALFWLGWATVLTSTFMIN

SEQ ID NO: 1387036 - protein, 24 aa, Mycobacterium tuberculosis
VASGLSPELLPSLLAAVHRRRRRT

SEQ ID NO: 1387037 - protein, 28 aa, Mycobacterium tuberculosis
VASLAALLLLFVSAYALPPLLPYSYDDL

SEQ ID NO: 1387038 - protein, 23 aa, Mycobacterium tuberculosis
VASYSWYYAWTPGTGYLANLLPY

SEQ ID NO: 1387039 - protein, 18 aa, Mycobacterium tuberculosis
VATLIAFVLGLTAVAWLL

SEQ ID NO: 1387040 - protein, 26 aa, Mycobacterium tuberculosis
VDFATDPPPPALPYFDVDNPGPSDPT

SEQ ID NO: 1387041 - protein, 18 aa, Mycobacterium tuberculosis
VEMAIFMLTVFVAYAYVW

SEQ ID NO: 1387042 - protein, 24 aa, Mycobacterium tuberculosis
VFALMPFWRMFFNTVLYAGCVTAG

SEQ ID NO: 1387043 - protein, 18 aa, Mycobacterium tuberculosis
VFLLYFLLRRDGRAALTA

SEQ ID NO: 1387044 - protein, 26 aa, Mycobacterium tuberculosis
VFVMEWLAILRDLILGLLIAGAIAAW

SEQ ID NO: 1387045 - protein, 18 aa, Mycobacterium tuberculosis
VGGFFRMCVLTGKALFRW

SEQ ID NO: 1387046 - protein, 19 aa, Mycobacterium tuberculosis
VGIGWLWRHGRFRRLARLG

SEQ ID NO: 1387047 - protein, 25 aa, Mycobacterium tuberculosis
VGLASYLLIGFWYHKPSAATAAKKA

SEQ ID NO: 1387048 - protein, 24 aa, Mycobacterium tuberculosis
VGVAFVHWLIFQSLYRIGALCPYC

SEQ ID NO: 1387049 - protein, 23 aa, Mycobacterium tuberculosis
VHRRRRRTRLITWVASSAAAAVL

SEQ ID NO: 1387050 - protein, 28 aa, Mycobacterium tuberculosis
VISFIIGRPLIWLSFRNEKLNAAFRYAL

SEQ ID NO: 1387051 - protein, 27 aa, Mycobacterium tuberculosis
VLFAIPCFLLLLILEWTAARKLESIET

SEQ ID NO: 1387052 - protein, 27 aa, Mycobacterium tuberculosis
VLLASVALLLLYWQWRTMPAVIWDVRQ

SEQ ID NO: 1387053 - protein, 36 aa, Mycobacterium tuberculosis; identical to SEQ ID NO: 164099

SEQ ID NO: 1387054 - protein, 18 aa, Mycobacterium tuberculosis
VMHFAFIAYVLAGGFLAL

SEQ ID NO: 1387055 - protein, 24 aa, Mycobacterium tuberculosis
VMIRHTSQWPLIIAGLVVGVVLGV

SEQ ID NO: 1387056 - protein, 23 aa, Mycobacterium tuberculosis
VNWIGTVGFAVAAVFWACRFVME

SEQ ID NO: 1387057 - protein, 29 aa, Mycobacterium tuberculosis
VPAPARLRRLWLAVLIVAPATIWLEPISS

SEQ ID NO: 1387058 - protein, 25 aa, Mycobacterium tuberculosis
VPLVSFAVLASCGVPYLVAGIKAGR

SEQ ID NO: 1387059 - protein, 26 aa, Mycobacterium tuberculosis
VPSIVAALFVFSLWIATLGFQQSAFA

SEQ ID NO: 1387060 - protein, 27 aa, Mycobacterium tuberculosis
VPTTGPAVFFLLAAVWFGATAVVAVRG

SEQ ID NO: 1387061 - protein, 20 aa, Mycobacterium tuberculosis
VQVSGWRFLLRRLEHAIVRR

SEQ ID NO: 1387062 - protein, 33 aa, Mycobacterium tuberculosis; identical to SEQ ID NO: 164136

SEQ ID NO: 1387063 - protein, 33 aa, Mycobacterium tuberculosis; identical to SEQ ID NO: 164145

SEQ ID NO: 1387064 - protein, 18 aa, Mycobacterium tuberculosis
VSIVLIYVVVVYEVIDVL

SEQ ID NO: 1387065 - protein, 24 aa, Mycobacterium tuberculosis
VTAAILVFIFAWNDLLLALSLTAT

SEQ ID NO: 1387066 - protein, 42 aa, Mycobacterium tuberculosis; identical to SEQ ID NO: 164161

SEQ ID NO: 1387067 - protein, 21 aa, Mycobacterium tuberculosis
VTIFVFILISNWLAVLPVQYT

SEQ ID NO: 1387068 - protein, 27 aa, Mycobacterium tuberculosis
VTVAAVIAVLLLLRARLSVRAAAIVLL

SEQ ID NO: 1387069 - protein, 17 aa, Mycobacterium tuberculosis
VTWLANRVTRRLDLGFT

SEQ ID NO: 1387070 - protein, 17 aa, Mycobacterium tuberculosis
VVFALYCGISRIGTIRL

SEQ ID NO: 1387071 - protein, 17 aa, Mycobacterium tuberculosis
VVGFILALLLREVPLTD

SEQ ID NO: 1387072 - protein, 42 aa, Mycobacterium tuberculosis; identical to SEQ ID NO: 164180

SEQ ID NO: 1387073 - protein, 29 aa, Mycobacterium tuberculosis
VVGVALASLLWQLLLVSAGAFLRSRATAR

SEQ ID NO: 1387074 - protein, 19 aa, Mycobacterium tuberculosis
VVLGLLWPHIDLPEAWQVI

SEQ ID NO: 1387075 - protein, 22 aa, Mycobacterium tuberculosis
VVYAFICLFVINVVMTAIGVRI

SEQ ID NO: 1387076 - protein, 28 aa, Mycobacterium tuberculosis
WAKSLGAWFPLAFLLVHTVVTVPPFPRT

SEQ ID NO: 1387077 - protein, 23 aa, Mycobacterium tuberculosis
WALHRPFIPWLGWPMLAVVVASQ

SEQ ID NO: 1387078 - protein, 18 aa, Mycobacterium tuberculosis
WGAAWFSLSPVTLCWLLI

SEQ ID NO: 1387079 - protein, 19 aa, Mycobacterium tuberculosis
WGMLENPLTMVPAPTRRWA

SEQ ID NO: 1387080 - protein, 24 aa, Mycobacterium tuberculosis
WKTTPFMSLLLLAGLALVPEDLLR

SEQ ID NO: 1387081 - protein, 20 aa, Mycobacterium tuberculosis
WNNFMWPLVITSGHKWRVLT

SEQ ID NO: 1387082 - protein, 18 aa, Mycobacterium tuberculosis
WSAFAFSLPIPPVVLTVA

SEQ ID NO: 1387083 - protein, 18 aa, Mycobacterium tuberculosis
WSRQLFVEGRWLSVGLLS

SEQ ID NO: 1387084 - protein, 24 aa, Mycobacterium tuberculosis
WTHHWVWLVPLMIWLIDGPARERP

SEQ ID NO: 1387085 - protein, 24 aa, Mycobacterium tuberculosis
YAFGTFGVPLWQMAVGAFIGSAPR

SEQ ID NO: 1387086 - protein, 20 aa, Mycobacterium tuberculosis
YAVFLISRYHEYVRLGEHPE

SEQ ID NO: 1387087 - protein, 26 aa, Mycobacterium tuberculosis
YDDVALPPLLLVVVSAIAVGAAGGAV

SEQ ID NO: 1387088 - protein, 28 aa, Mycobacterium tuberculosis
YECLAPHHFLLTEWFAPYVEFLVSKHRA

SEQ ID NO: 1387089 - protein, 27 aa, Mycobacterium tuberculosis
YLAALGVSIALWQHLLDRELNALVPLV

SEQ ID NO: 1387090 - protein, 17 aa, Mycobacterium tuberculosis
YLGASLIGLVALASCAS

SEQ ID NO: 1387091 - protein, 18 aa, Mycobacterium tuberculosis
YMTRVMLMTFFGEKRWTP

SEQ ID NO: 1387092 - protein, 17 aa, Mycobacterium tuberculosis
YRLTKFFGKLFLINFAI

SEQ ID NO: 1387093 - protein, 32 aa, Mycobacterium tuberculosis; identical to SEQ ID NO: 164304

SEQ ID NO: 1387094 - protein, 20 aa, Mycobacterium tuberculosis
YYRYCTYIYIPFQYLSVVLG

SEQ ID NO: 1387095 - protein, 25 aa, Mycobacterium tuberculosis
AAGMLLWFLIALPIGAVTGGWIATR

SEQ ID NO: 1387096 - protein, 18 aa, Mycobacterium tuberculosis
AAQIAFLGPLLGSLSRIY

SEQ ID NO: 1387097 - protein, 24 aa, Mycobacterium tuberculosis
AAVCLVFIVMLMITQSLIASLVIV

SEQ ID NO: 1387098 - protein, 28 aa, Mycobacterium tuberculosis
AAVGIALWLPWLIAAGVAFILASAAGLV

SEQ ID NO: 1387099 - protein, 27 aa, Mycobacterium tuberculosis
ADALTAVPLWIAFALGAKPATRRYTYG

SEQ ID NO: 1387100 - protein, 29 aa, Mycobacterium tuberculosis
ADGVIWARYNVPWQPAFVFYRADGTSTFV

SEQ ID NO: 1387101 - protein, 25 aa, Mycobacterium tuberculosis
ADVAFYYLVFVLPIAALVARDPNGP

SEQ ID NO: 1387102 - protein, 52 aa, Mycobacterium tuberculosis; identical to SEQ ID NO: 161775

SEQ ID NO: 1387103 - protein, 26 aa, Mycobacterium tuberculosis
AEELLSRSWWSGPEIFLIVDDIQQLP

SEQ ID NO: 1387104 - protein, 19 aa, Mycobacterium tuberculosis
AFLPHQRSALRTALIPAID

SEQ ID NO: 1387105 - protein, 27 aa, Mycobacterium tuberculosis
AFVIDEGPLYFWLPCLACLLAVAELQL

SEQ ID NO: 1387106 - protein, 40 aa, Mycobacterium tuberculosis; identical to SEQ ID NO: 161792

SEQ ID NO: 1387107 - protein, 26 aa, Mycobacterium tuberculosis
AGAQLLWQLPLLSIGCGLIVAALLVT

SEQ ID NO: 1387108 - protein, 22 aa, Mycobacterium tuberculosis
AGAVAWVSLSSLLPAGAEEVSA

SEQ ID NO: 1387109 - protein, 24 aa, Mycobacterium tuberculosis
AGEPPLPLVVPPTPVGGNALGGCG

SEQ ID NO: 1387110 - protein, 26 aa, Mycobacterium tuberculosis
AGIRTVKISLLVLGLTALIQIVIVVM

SEQ ID NO: 1387111 - protein, 28 aa, Mycobacterium tuberculosis
AGQGGRFLCTFPFSFEITEGEDRYVVSV

SEQ ID NO: 1387112 - protein, 39 aa, Mycobacterium tuberculosis; identical to SEQ ID NO: 161814

SEQ ID NO: 1387113 - protein, 25 aa, Mycobacterium tuberculosis
AGWASVIVSIWMLGGVTIFCIGLVG

SEQ ID NO: 1387114 - protein, 19 aa, Mycobacterium tuberculosis
AGWMFGWLADRSGSLAAPL

SEQ ID NO: 1387115 - protein, 23 aa, Mycobacterium tuberculosis
AIATWLLVLFEVVSLTQAMISQY

SEQ ID NO: 1387116 - protein, 33 aa, Mycobacterium tuberculosis; identical to SEQ ID NO: 164620

SEQ ID NO: 1387117 - protein, 20 aa, Mycobacterium tuberculosis
AIVVTVVGLAWLAFEHRRIR

SEQ ID NO: 1387118 - protein, 27 aa, Mycobacterium tuberculosis
ALAFVSIAALIYFLHHLMHSIQIDTIM

SEQ ID NO: 1387119 - protein, 27 aa, Mycobacterium tuberculosis
ALGSYWAMFILVPGTLVLVFRILDEEK

SEQ ID NO: 1387120 - protein, 20 aa, Mycobacterium tuberculosis
ALIGLLALVFAVVTSNQLVA

SEQ ID NO: 1387121 - protein, 18 aa, Mycobacterium tuberculosis
ALVLPMAVPSLAEMAQRH

SEQ ID NO: 1387122 - protein, 19 aa, Mycobacterium tuberculosis
ALWNQATWWQSIAVWFVAA

SEQ ID NO: 1387123 - protein, 26 aa, Mycobacterium tuberculosis
AMLAAVAMFLGFVAPALSLSPVTYRT

SEQ ID NO: 1387124 - protein, 29 aa, Mycobacterium tuberculosis
AMLPLLSLPILIFGLLSIGLMPLKLFPHW

SEQ ID NO: 1387125 - protein, 33 aa, Mycobacterium tuberculosis; identical to SEQ ID NO: 161912

SEQ ID NO: 1387126 - protein, 23 aa, Mycobacterium tuberculosis
ANNVLAFPGIGLGVIVAGARLIT

SEQ ID NO: 1387127 - protein, 39 aa, Mycobacterium tuberculosis; identical to SEQ ID NO: 161915

SEQ ID NO: 1387128 - protein, 34 aa, Mycobacterium tuberculosis
APAKRSLLRTAVIVPAVLAMLLVMAVAVAVREFQ

SEQ ID NO: 1387129 - protein, 17 aa, Mycobacterium tuberculosis
APIALHWSLNGMGALAA

SEQ ID NO: 1387130 - protein, 24 aa, Mycobacterium tuberculosis
AQFAFFGWRWSLPLGVAILLAAVG

SEQ ID NO: 1387131 - protein, 17 aa, Mycobacterium tuberculosis
ARLDGVLSRALATAPAD

SEQ ID NO: 1387132 - protein, 25 aa, Mycobacterium tuberculosis
ARTVLRIMFPLSFVVAILLVSQGVI

SEQ ID NO: 1387133 - protein, 27 aa, Mycobacterium tuberculosis
ARYGPRAPQLWLPPLDETIPLSAALAR

SEQ ID NO: 1387134 - protein, 25 aa, Mycobacterium tuberculosis
ASCKHPMIFPLSNPTSRMEAIPADV

SEQ ID NO: 1387135 - protein, 18 aa, Mycobacterium tuberculosis
ASFGLLEVSARMAVLLAG

SEQ ID NO: 1387136 - protein, 26 aa, Mycobacterium tuberculosis
ASGQTVLPFTGIDFRLSPSGVAVDSA

SEQ ID NO: 1387137 - protein, 26 aa, Mycobacterium tuberculosis
ASPVGLLVIVLLVIATLFLVRSMNQQ

SEQ ID NO: 1387138 - protein, 23 aa, Mycobacterium tuberculosis
ASRSQGRGLIRLARRVWPDSGWE

SEQ ID NO: 1387139 - protein, 47 aa, Mycobacterium tuberculosis; identical to SEQ ID NO: 161961

SEQ ID NO: 1387140 - protein, 23 aa, Mycobacterium tuberculosis
ASVGWLRLGALALALAALAALLI

SEQ ID NO: 1387141 - protein, 30 aa, Mycobacterium tuberculosis; identical to SEQ ID NO: 161964

SEQ ID NO: 1387142 - protein, 30 aa, Mycobacterium tuberculosis; identical to SEQ ID NO: 161965

SEQ ID NO: 1387143 - protein, 31 aa, Mycobacterium tuberculosis; identical to SEQ ID NO: 161967

SEQ ID NO: 1387144 - protein, 25 aa, Mycobacterium tuberculosis
ASVVFWAFGPWLIPPLVAASIWKHV

SEQ ID NO: 1387145 - protein, 18 aa, Mycobacterium tuberculosis
ATDLLFNGVIGRGLPGGI

SEQ ID NO: 1387146 - protein, 25 aa, Mycobacterium tuberculosis
ATFCLSFTRLPYFQTLGVPLAIGMV

SEQ ID NO: 1387147 - protein, 21 aa, Mycobacterium tuberculosis
ATIEAMWWIRSRMLGVKPRVW

SEQ ID NO: 1387148 - protein, 26 aa, Mycobacterium tuberculosis
ATKAAARWIRPLVPPFVARMLDNTTA

SEQ ID NO: 1387149 - protein, 19 aa, Mycobacterium tuberculosis
ATMPRGPLVGIPGAPSSFS

SEQ ID NO: 1387150 - protein, 35 aa, Mycobacterium tuberculosis; identical to SEQ ID NO: 161990

SEQ ID NO: 1387151 - protein, 18 aa, Mycobacterium tuberculosis
AVAIGLFVLPLSGPLHVA

SEQ ID NO: 1387152 - protein, 25 aa, Mycobacterium tuberculosis
AVAPNILLLIIFRVVQGFGGGMLTP

SEQ ID NO: 1387153 - protein, 26 aa, Mycobacterium tuberculosis
AVASGFCLVLLAHSWWSLVSGSALGL

SEQ ID NO: 1387154 - protein, 20 aa, Mycobacterium tuberculosis
AVAWLLMLMASPTARSAASL

SEQ ID NO: 1387155 - protein, 20 aa, Mycobacterium tuberculosis
AVELAFVGPLLAAVARIYGG

SEQ ID NO: 1387156 - protein, 25 aa, Mycobacterium tuberculosis
AVFAQLLLLPVAWYLIVGSHQPAIG

SEQ ID NO: 1387157 - protein, 25 aa, Mycobacterium tuberculosis
AVFGGFYLGFLLIAAVTALILVLAA

SEQ ID NO: 1387158 - protein, 26 aa, Mycobacterium tuberculosis
AVFLGRFIALLRIFAGPLAGALKMPY

SEQ ID NO: 1387159 - protein, 22 aa, Mycobacterium tuberculosis
AVIAFIFIKLFGAAAPGGEPSG

SEQ ID NO: 1387160 - protein, 24 aa, Mycobacterium tuberculosis
AVLLPFFSFMTYLIAVPTGIKFFN

SEQ ID NO: 1387161 - protein, 22 aa, Mycobacterium tuberculosis
AVRSVFTVMLRAVDPDPVMPDA

SEQ ID NO: 1387162 - protein, 22 aa, Mycobacterium tuberculosis
AVTAVLLLGWRAAVALMAPHRA

SEQ ID NO: 1387163 - protein, 21 aa, Mycobacterium tuberculosis
AVYLALLVSSVLHLARTIAGP

SEQ ID NO: 1387164 - protein, 21 aa, Mycobacterium tuberculosis
AYERYWLYPGAQNLATFRAHL

SEQ ID NO: 1387165 - protein, 23 aa, Mycobacterium tuberculosis
CKQNPIFDPLQPDDPRAWNAVTT

SEQ ID NO: 1387166 - protein, 17 aa, Mycobacterium tuberculosis
CSVVFQHPYLFHGTIRD

SEQ ID NO: 1387167 - protein, 30 aa, Mycobacterium tuberculosis; identical to SEQ ID NO: 164347

SEQ ID NO: 1387168 - protein, 26 aa, Mycobacterium tuberculosis
DAVWPVMIVLLLNLTAAYSATRFAPA

SEQ ID NO: 1387169 - protein, 20 aa, Mycobacterium tuberculosis
DAWGHLLGCAAALAAFGVGA

SEQ ID NO: 1387170 - protein, 24 aa, Mycobacterium tuberculosis
DDQKKRWLPGIADGSLTMAFAITE

SEQ ID NO: 1387171 - protein, 17 aa, Mycobacterium tuberculosis
DDWSQLPKRLSCQLRPG

SEQ ID NO: 1387172 - protein, 17 aa, Mycobacterium tuberculosis
DERGLLYVSGRDDEMIV

SEQ ID NO: 1387173 - protein, 27 aa, Mycobacterium tuberculosis
DGRNTLLLPFRVAAVHLILWDIGGALL

SEQ ID NO: 1387174 - protein, 27 aa, Mycobacterium tuberculosis
DHRARLIGFALLAFCSVVARAVGTVLL

SEQ ID NO: 1387175 - protein, 23 aa, Mycobacterium tuberculosis
DKLTKPVWLVILGAAVALASILY

SEQ ID NO: 1387176 - protein, 17 aa, Mycobacterium tuberculosis
DLDFRARFVREADVAAG

SEQ ID NO: 1387177 - protein, 21 aa, Mycobacterium tuberculosis
DLSGQLLFIVAVGALVYAVIE

SEQ ID NO: 1387178 - protein, 20 aa, Mycobacterium tuberculosis
DPFLVQYLRYLGGILHGDLG

SEQ ID NO: 1387179 - protein, 28 aa, Mycobacterium tuberculosis
DPLTAIRYQIVVMYLLLAATAVAALTCA

SEQ ID NO: 1387180 - protein, 26 aa, Mycobacterium tuberculosis
DPVFAKALAKQPKDRYQRCVDFARAL

SEQ ID NO: 1387181 - protein, 20 aa, Mycobacterium tuberculosis
DQRELWRAVGIRGATTAAAA

SEQ ID NO: 1387182 - protein, 31 aa, Mycobacterium tuberculosis; identical to SEQ ID NO: 162152

SEQ ID NO: 1387183 - protein, 27 aa, Mycobacterium tuberculosis
DVYSLGCVLYEVLTGEPPFTGDSPVSV

SEQ ID NO: 1387184 - protein, 27 aa, Mycobacterium tuberculosis
DYGTYFKDHLYIAGRIKDLVIIDGRNH

SEQ ID NO: 1387185 - protein, 24 aa, Mycobacterium tuberculosis
EAIALIVVMVRYLEPFTAVSELAP

SEQ ID NO: 1387186 - protein, 27 aa, Mycobacterium tuberculosis
EAVMNKLRWVLLIVGGIGVAVAAVAGG

SEQ ID NO: 1387187 - protein, 26 aa, Mycobacterium tuberculosis
ECLALIAMVPLTAWLCGAYSAVRHLD

SEQ ID NO: 1387188 - protein, 24 aa, Mycobacterium tuberculosis
EDEFVWCMQGLPSPYLTIAFPNRP

SEQ ID NO: 1387189 - protein, 24 aa, Mycobacterium tuberculosis
EGRDWNWLKWLPHVDIPGRLDALG

SEQ ID NO: 1387190 - protein, 19 aa, Mycobacterium tuberculosis
EHNALHLVYITMTGSAIAA

SEQ ID NO: 1387191 - protein, 26 aa, Mycobacterium tuberculosis
ELDAELWIAALIFPAFTAGGAIGNVV

SEQ ID NO: 1387192 - protein, 30 aa, Mycobacterium tuberculosis; identical to SEQ ID NO: 162228

SEQ ID NO: 1387193 - protein, 25 aa, Mycobacterium tuberculosis
EPDDPDWSWLKWLPHVQHQTETDAA

SEQ ID NO: 1387194 - protein, 18 aa, Mycobacterium tuberculosis
EPFLGRWLLLTAVAFGIS

SEQ ID NO: 1387195 - protein, 26 aa, Mycobacterium tuberculosis
EQAVSQIWPIDRPGLLFDDMDDLRDF

SEQ ID NO: 1387196 - protein, 29 aa, Mycobacterium tuberculosis
ETATALAWFPLWFVLLAVGWLVTQRRQSR

SEQ ID NO: 1387197 - protein, 31 aa, Mycobacterium tuberculosis; identical to SEQ ID NO: 20533

SEQ ID NO: 1387198 - protein, 21 aa, Mycobacterium tuberculosis
EWVALYRIRVGHRIGSAALIA

SEQ ID NO: 1387199 - protein, 19 aa, Mycobacterium tuberculosis
FAAGRLYTTLSVADAAAAT

SEQ ID NO: 1387200 - protein, 19 aa, Mycobacterium tuberculosis
FAALIAVLLLTAPALGGYL

SEQ ID NO: 1387201 - protein, 25 aa, Mycobacterium tuberculosis
FAEARWLSVALLSIGLAGFCLHATL

SEQ ID NO: 1387202 - protein, 28 aa, Mycobacterium tuberculosis
FALSMAGLILLWRLLRRESARPVVAGFC

SEQ ID NO: 1387203 - protein, 24 aa, Mycobacterium tuberculosis
FASQPLGAIVFAGLLAWLYQRTRV

SEQ ID NO: 1387204 - protein, 31 aa, Mycobacterium tuberculosis; identical to SEQ ID NO: 162297

SEQ ID NO: 1387205 - protein, 17 aa, Mycobacterium tuberculosis
FISSNWNLAFGVLPPYW

SEQ ID NO: 1387206 - protein, 19 aa, Mycobacterium tuberculosis
FLTKTVYSVLLALLVGIEC

SEQ ID NO: 1387207 - protein, 25 aa, Mycobacterium tuberculosis
FPSNLIIPEYLFIQSSTDLRTPKAL

SEQ ID NO: 1387208 - protein, 19 aa, Mycobacterium tuberculosis
FQPPMTTWYAAMLFAVIPL

SEQ ID NO: 1387209 - protein, 33 aa, Mycobacterium tuberculosis; identical to SEQ ID NO: 162335

SEQ ID NO: 1387210 - protein, 17 aa, Mycobacterium tuberculosis
FRRFFSRLQRPVDNFGE

SEQ ID NO: 1387211 - protein, 17 aa, Mycobacterium tuberculosis
FSKDPVFRERMKREARI

SEQ ID NO: 1387212 - protein, 19 aa, Mycobacterium tuberculosis
FSVTLGVLVIACPCALGLA

SEQ ID NO: 1387213 - protein, 26 aa, Mycobacterium tuberculosis
FTRINAILGVLLLIVLATGSLINGMF

SEQ ID NO: 1387214 - protein, 19 aa, Mycobacterium tuberculosis
FVEGRWLSVGLLSVGVAGF

SEQ ID NO: 1387215 - protein, 20 aa, Mycobacterium tuberculosis
FVIYAITIVCVVFLNLLEGV

SEQ ID NO: 1387216 - protein, 31 aa, Mycobacterium tuberculosis; identical to SEQ ID NO: 162356

SEQ ID NO: 1387217 - protein, 25 aa, Mycobacterium tuberculosis
GAGVLYFYFVLPRWPELMGDTGHSL

SEQ ID NO: 1387218 - protein, 25 aa, Mycobacterium tuberculosis
GAIEPQFFAALLSGLGLSAADVPTQ

SEQ ID NO: 1387219 - protein, 20 aa, Mycobacterium tuberculosis
GAQLGIFIKGYRALETIRSI

SEQ ID NO: 1387220 - protein, 19 aa, Mycobacterium tuberculosis
GDVYLVIDNYRALAEENEV

SEQ ID NO: 1387221 - protein, 24 aa, Mycobacterium tuberculosis
GEFDGQLWIAMDYVDGIDATQHMA

SEQ ID NO: 1387222 - protein, 23 aa, Mycobacterium tuberculosis
GELEFWFALIKVAAIVCLIAVGA

SEQ ID NO: 1387223 - protein, 17 aa, Mycobacterium tuberculosis
GFILALLLREVPLTDIH

SEQ ID NO: 1387224 - protein, 24 aa, Mycobacterium tuberculosis
GFNTACLVLLGLFPLFVMFVITAI

SEQ ID NO: 1387225 - protein, 25 aa, Mycobacterium tuberculosis
GGAAVTALALLRRASLRQAVADGVA

SEQ ID NO: 1387226 - protein, 23 aa, Mycobacterium tuberculosis
GGAIALRIMFNLPLPIGGIITGV

SEQ ID NO: 1387227 - protein, 21 aa, Mycobacterium tuberculosis
GGGPHAVYLLDGLRAQDDYNG

SEQ ID NO: 1387228 - protein, 29 aa, Mycobacterium tuberculosis
GGIGSIFPLFMMVGIMMMMFRGMGGGQQQ

SEQ ID NO: 1387229 - protein, 29 aa, Mycobacterium tuberculosis
GGLFAQLGLWRWAFGVMTLLTALMAMLVP

SEQ ID NO: 1387230 - protein, 25 aa, Mycobacterium tuberculosis
GGQAAVWLTWPFGAVGALAGFGGMV

SEQ ID NO: 1387231 - protein, 40 aa, Mycobacterium tuberculosis; identical to SEQ ID NO: 162440

SEQ ID NO: 1387232 - protein, 27 aa, Mycobacterium tuberculosis
GGVLLWQHLFWFFGHPEVYIIALPFFG

SEQ ID NO: 1387233 - protein, 28 aa, Mycobacterium tuberculosis
GGVLSGAWLGLFIGLVLGFFSPNPWSAL

SEQ ID NO: 1387234 - protein, 27 aa, Mycobacterium tuberculosis
GGVVVKALLLLGLWLAGWGAARLVATA

SEQ ID NO: 1387235 - protein, 22 aa, Mycobacterium tuberculosis
GGYPAVVYWLLGAGGAVMLLAS

SEQ ID NO: 1387236 - protein, 19 aa, Mycobacterium tuberculosis
GIIIGPVLMILIVTTIDVY

SEQ ID NO: 1387237 - protein, 23 aa, Mycobacterium tuberculosis
GKAFALSAFIVGGLWIITTQHVN

SEQ ID NO: 1387238 - protein, 22 aa, Mycobacterium tuberculosis
GKWTIILARFVPIARTFVPVIA

SEQ ID NO: 1387239 - protein, 26 aa, Mycobacterium tuberculosis
GLAIVFSILLFPPDPVVMLCSARADV

SEQ ID NO: 1387240 - protein, 31 aa, Mycobacterium tuberculosis; identical to SEQ ID NO: 162468

SEQ ID NO: 1387241 - protein, 28 aa, Mycobacterium tuberculosis
GLASMVIAFLPPLPVIMVLCAVVGLVYG

SEQ ID NO: 1387242 - protein, 19 aa, Mycobacterium tuberculosis
GLFTNPGSWRILDGLIAVM

SEQ ID NO: 1387243 - protein, 24 aa, Mycobacterium tuberculosis
GLGLALLILPVIGLWAMIATLRAG

SEQ ID NO: 1387244 - protein, 26 aa, Mycobacterium tuberculosis
GLLPAWQIVLILLLLGVLGLRDKVIF

SEQ ID NO: 1387245 - protein, 34 aa, Mycobacterium tuberculosis; identical to SEQ ID NO: 162489

SEQ ID NO: 1387246 - protein, 24 aa, Mycobacterium tuberculosis
GLTSWLTGMFGRDAWRPAGVVVVG

SEQ ID NO: 1387247 - protein, 17 aa, Mycobacterium tuberculosis
GMALIVATFFRFVARRL

SEQ ID NO: 1387248 - protein, 33 aa, Mycobacterium tuberculosis; identical to SEQ ID NO: 162496

SEQ ID NO: 1387249 - protein, 17 aa, Mycobacterium tuberculosis
GNEWVALYRIRVGHRIG

SEQ ID NO: 1387250 - protein, 25 aa, Mycobacterium tuberculosis
GQFEGRLWIAMQFVDGGNAEDALRA

SEQ ID NO: 1387251 - protein, 28 aa, Mycobacterium tuberculosis
GQIPNQRWFSWLALLTMPAPFLANSAGW

SEQ ID NO: 1387252 - protein, 33 aa, Mycobacterium tuberculosis; identical to SEQ ID NO: 162524

SEQ ID NO: 1387253 - protein, 29 aa, Mycobacterium tuberculosis
GRALGVMPLLPVLLMVWATARSTARATSP

SEQ ID NO: 1387254 - protein, 25 aa, Mycobacterium tuberculosis
GSACNLVFPIGIIDRPYKHDQPPWT

SEQ ID NO: 1387255 - protein, 20 aa, Mycobacterium tuberculosis
GSFFMHRGVPYFPNLVMPIV

SEQ ID NO: 1387256 - protein, 17 aa, Mycobacterium tuberculosis
GSIVLIGLGGLFAAIDA

SEQ ID NO: 1387257 - protein, 25 aa, Mycobacterium tuberculosis
GSMLVLLGIVVALYERERSGVGQVV

SEQ ID NO: 1387258 - protein, 24 aa, Mycobacterium tuberculosis
GTVRNWPWRRLVLSKTANTYSRLA

SEQ ID NO: 1387259 - protein, 28 aa, Mycobacterium tuberculosis
GVAILARNHRWFVIANYGAARVGARIIL

SEQ ID NO: 1387260 - protein, 18 aa, Mycobacterium tuberculosis
GVFVPVVFVIAGLAGAAW

SEQ ID NO: 1387261 - protein, 35 aa, Mycobacterium tuberculosis; identical to SEQ ID NO: 162569

SEQ ID NO: 1387262 - protein, 24 aa, Mycobacterium tuberculosis
GVIAALFLGFFILEGFDFGVGMLM

SEQ ID NO: 1387263 - protein, 26 aa, Mycobacterium tuberculosis
GVVHGWVYFTYLLLTLNLAVKVRWPL

SEQ ID NO: 1387264 - protein, 17 aa, Mycobacterium tuberculosis
GVVTVLWALYGYSIAFG

SEQ ID NO: 1387265 - protein, 19 aa, Mycobacterium tuberculosis
GWAVLAIMGIIWIGMSVAA

SEQ ID NO: 1387266 - protein, 22 aa, Mycobacterium tuberculosis
GYDRATLKLVFSMDLGMCLNRF

SEQ ID NO: 1387267 - protein, 27 aa, Mycobacterium tuberculosis
HIRPYRRLVAMLMMLQLVSTLASLYLP

SEQ ID NO: 1387268 - protein, 20 aa, Mycobacterium tuberculosis
HLDVRWVVALIVINLAFTFL

SEQ ID NO: 1387269 - protein, 25 aa, Mycobacterium tuberculosis
HNQVLAMLSLVPWGTTGVSLDLMRR

SEQ ID NO: 1387270 - protein, 18 aa, Mycobacterium tuberculosis
HPGFPGWQALKVLSPAMA

SEQ ID NO: 1387271 - protein, 17 aa, Mycobacterium tuberculosis
HPVLNLTSARLIVGRPV

SEQ ID NO: 1387272 - protein, 18 aa, Mycobacterium tuberculosis
HTGPLQPPKLSAFRPDLA

SEQ ID NO: 1387273 - protein, 27 aa, Mycobacterium tuberculosis
HTGQRWLPLILAGFTSGFLLLRGRSYV

SEQ ID NO: 1387274 - protein, 29 aa, Mycobacterium tuberculosis
HTHPALDLDALLGGFRPLFQTLDPDKVNS

SEQ ID NO: 1387275 - protein, 18 aa, Mycobacterium tuberculosis
HTRKVLDLTIRLAEVMLS

SEQ ID NO: 1387276 - protein, 17 aa, Mycobacterium tuberculosis
HYVVMVILHTALLLGCV

SEQ ID NO: 1387277 - protein, 38 aa, Mycobacterium tuberculosis; identical to SEQ ID NO: 162661

SEQ ID NO: 1387278 - protein, 26 aa, Mycobacterium tuberculosis
ICTALQLPLSVVLIDAGERMARQERL

SEQ ID NO: 1387279 - protein, 17 aa, Mycobacterium tuberculosis
IDTAIFYTLKLTVLEPK

SEQ ID NO: 1387280 - protein, 18 aa, Mycobacterium tuberculosis
IDVVHWPGYLLIVAGVVG

SEQ ID NO: 1387281 - protein, 25 aa, Mycobacterium tuberculosis
IETAQRLFPRAILHFEDFGPANARK

SEQ ID NO: 1387282 - protein, 29 aa, Mycobacterium tuberculosis
IGDWILNRGLRIVMLLIAAVLAARFVTWL

SEQ ID NO: 1387283 - protein, 27 aa, Mycobacterium tuberculosis
IHIVAMVVLLSLIPIGWLLADFTDGTP

SEQ ID NO: 1387284 - protein, 17 aa, Mycobacterium tuberculosis
ILSLVAMTHPDQVNLLL

SEQ ID NO: 1387285 - protein, 18 aa, Mycobacterium tuberculosis
IPELFATSYRYTGSALAA

SEQ ID NO: 1387286 - protein, 26 aa, Mycobacterium tuberculosis
IPGRWRPAWIGWWVSLGLATATIGGG

SEQ ID NO: 1387287 - protein, 18 aa, Mycobacterium tuberculosis
IQPGFYRMRTEISAASAV

SEQ ID NO: 1387288 - protein, 26 aa, Mycobacterium tuberculosis
ISYVRQILLVQLWFQPYFDGSSWDGP

SEQ ID NO: 1387289 - protein, 34 aa, Mycobacterium tuberculosis; identical to SEQ ID NO: 162750

SEQ ID NO: 1387290 - protein, 25 aa, Mycobacterium tuberculosis
ITAYVLTFGGLMLLGGRLGDTIGRK

SEQ ID NO: 1387291 - protein, 19 aa, Mycobacterium tuberculosis
IVFGLSRMARAALAIAPVV

SEQ ID NO: 1387292 - protein, 35 aa, Mycobacterium tuberculosis; identical to SEQ ID NO: 162770

SEQ ID NO: 1387293 - protein, 17 aa, Mycobacterium tuberculosis
IVLLLAGPRLIDAYVDW

SEQ ID NO: 1387294 - protein, 22 aa, Mycobacterium tuberculosis
KAGEVTLLPSPMFHALGYMHAA

SEQ ID NO: 1387295 - protein, 26 aa, Mycobacterium tuberculosis
KAQQPINLLLLAVAVAAAVVIGLHAH

SEQ ID NO: 1387296 - protein, 23 aa, Mycobacterium tuberculosis
KGRSFRIHILFASQTLDVGKIKD

SEQ ID NO: 1387297 - protein, 20 aa, Mycobacterium tuberculosis
KGYCFQIDLTWRTVSNGFVV

SEQ ID NO: 1387298 - protein, 19 aa, Mycobacterium tuberculosis
KIPKGVLLYGPPGTGKTLL

SEQ ID NO: 1387299 - protein, 17 aa, Mycobacterium tuberculosis
KKLPAKKAAKKAPARKT

SEQ ID NO: 1387300 - protein, 17 aa, Mycobacterium tuberculosis
KLFLINFAIGVATGIVQ

SEQ ID NO: 1387301 - protein, 18 aa, Mycobacterium tuberculosis
KLVFSMDLGMCLNRFTYD

SEQ ID NO: 1387302 - protein, 27 aa, Mycobacterium tuberculosis
KRARGSPLRIMILLVLVSALASALLDN

SEQ ID NO: 1387303 - protein, 23 aa, Mycobacterium tuberculosis
KSTLAWIMAGLTIPTTGACLLDG

SEQ ID NO: 1387304 - protein, 18 aa, Mycobacterium tuberculosis
KTSINSVLLIFTIGVTWS

SEQ ID NO: 1387305 - protein, 24 aa, Mycobacterium tuberculosis
KVEDWLGYFLLHASFVLGAAAGGA

SEQ ID NO: 1387306 - protein, 26 aa, Mycobacterium tuberculosis
LAATSFPLQVPWLPLAAPLAVLATYV

SEQ ID NO: 1387307 - protein, 21 aa, Mycobacterium tuberculosis
LACIVAFWFLGFDTAGSPVWV

SEQ ID NO: 1387308 - protein, 25 aa, Mycobacterium tuberculosis
LACPVWFYQLWAFITPGLYQRERRF

SEQ ID NO: 1387309 - protein, 24 aa, Mycobacterium tuberculosis
LADPAVVWALRLQGRVPHVVAQSL

SEQ ID NO: 1387310 - protein, 20 aa, Mycobacterium tuberculosis
LALSWPRVTAVFLVDVLILA

SEQ ID NO: 1387311 - protein, 17 aa, Mycobacterium tuberculosis
LARIRFTVGYVAALASV

SEQ ID NO: 1387312 - protein, 22 aa, Mycobacterium tuberculosis
LAVANLMWFVFAGFGALTLESN

SEQ ID NO: 1387313 - protein, 20 aa, Mycobacterium tuberculosis
LAYLAIIGVPPFAGFFSKDA

SEQ ID NO: 1387314 - protein, 17 aa, Mycobacterium tuberculosis
LDTFLVRTVTVPAIAVL

SEQ ID NO: 1387315 - protein, 27 aa, Mycobacterium tuberculosis
LEDIIRFQAEFLWRDYFQPGVSIDGEE

SEQ ID NO: 1387316 - protein, 25 aa, Mycobacterium tuberculosis
LFSVKTLTFLGFIGVLLAINLFGNR

SEQ ID NO: 1387317 - protein, 18 aa, Mycobacterium tuberculosis
LFWVSYILSITVAAALIP

SEQ ID NO: 1387318 - protein, 20 aa, Mycobacterium tuberculosis
LGFLAGLALPKDAALLAGTG

SEQ ID NO: 1387319 - protein, 21 aa, Mycobacterium tuberculosis
LGSLLALILGVSRTTLAMARD

SEQ ID NO: 1387320 - protein, 24 aa, Mycobacterium tuberculosis
LGSVAAVLVVPWPAGAQVLIRFTG

SEQ ID NO: 1387321 - protein, 28 aa, Mycobacterium tuberculosis
LGYVGYLALVVYFDWGFSLAAGVLVLSV

SEQ ID NO: 1387322 - protein, 22 aa, Mycobacterium tuberculosis
LIALAIITRLRHPLPVAPSAGE

SEQ ID NO: 1387323 - protein, 35 aa, Mycobacterium tuberculosis; identical to SEQ ID NO: 162959

SEQ ID NO: 1387324 - protein, 27 aa, Mycobacterium tuberculosis
LIPRLYALHILLLPGIILALIGLHLAL

SEQ ID NO: 1387325 - protein, 19 aa, Mycobacterium tuberculosis
LLAAAFVASVLLGVGIGWG

SEQ ID NO: 1387326 - protein, 21 aa, Mycobacterium tuberculosis
LLAIWIGIGFIFRGVATTVSA

SEQ ID NO: 1387327 - protein, 20 aa, Mycobacterium tuberculosis
LLASGRFIKAIPPSLLVLVL

SEQ ID NO: 1387328 - protein, 23 aa, Mycobacterium tuberculosis
LLERVLANLIDNALRYAPDCVVR

SEQ ID NO: 1387329 - protein, 19 aa, Mycobacterium tuberculosis
LLLARWLLFRVEFGAGLIK

SEQ ID NO: 1387330 - protein, 27 aa, Mycobacterium tuberculosis
LLLSVALFFVWMITVAFLYLVLGGMGV

SEQ ID NO: 1387331 - protein, 19 aa, Mycobacterium tuberculosis
LLMTSPLLRRFNDLQATTL

SEQ ID NO: 1387332 - protein, 18 aa, Mycobacterium tuberculosis
LLSPLALATNGAAIGIGL

SEQ ID NO: 1387333 - protein, 18 aa, Mycobacterium tuberculosis
LMTVLLHGTRQPIPPWEQ

SEQ ID NO: 1387334 - protein, 35 aa, Mycobacterium tuberculosis
LPERLLQVLTGLLFLLFGLWLLFDDALGFRSVAIA

SEQ ID NO: 1387335 - protein, 25 aa, Mycobacterium tuberculosis
LPVLTCLAAMFIGLAIFAISMDHAH

SEQ ID NO: 1387336 - protein, 25 aa, Mycobacterium tuberculosis
LQRPARWIQMLASNTLAFTAAPNFA

SEQ ID NO: 1387337 - protein, 35 aa, Mycobacterium tuberculosis; identical to SEQ ID NO: 163032

SEQ ID NO: 1387338 - protein, 27 aa, Mycobacterium tuberculosis
LSMLGDLPWWVTVLILTRELGVTVLRL

SEQ ID NO: 1387339 - protein, 44 aa, Mycobacterium tuberculosis; identical to SEQ ID NO: 163044

SEQ ID NO: 1387340 - protein, 28 aa, Mycobacterium tuberculosis
LSPWPTITAVLWWIIGLAGLWLGLLGIA

SEQ ID NO: 1387341 - protein, 23 aa, Mycobacterium tuberculosis
LTALIQLYIVGVFISFTMSQVGM

SEQ ID NO: 1387342 - protein, 26 aa, Mycobacterium tuberculosis
LTERPHPYPRWLATAGAAGFALGVAM

SEQ ID NO: 1387343 - protein, 29 aa, Mycobacterium tuberculosis
LTEVSWRWAFLVNVPIGLVMIYLARTALR

SEQ ID NO: 1387344 - protein, 23 aa, Mycobacterium tuberculosis
LTSTGSVLATLAYAAPEVLAGQG

SEQ ID NO: 1387345 - protein, 24 aa, Mycobacterium tuberculosis
LVAGFLMVNLLTPGDLRRLVFIDR

SEQ ID NO: 1387346 - protein, 25 aa, Mycobacterium tuberculosis
LVDSGAGTWLLWDGKRSPIDLADHA

SEQ ID NO: 1387347 - protein, 28 aa, Mycobacterium tuberculosis
LVEPSWMPLWAFVIAMVLLRSSLAGFGH

SEQ ID NO: 1387348 - protein, 24 aa, Mycobacterium tuberculosis
LVGATGVFLACRWAQADGADHAWL

SEQ ID NO: 1387349 - protein, 23 aa, Mycobacterium tuberculosis
LVGGVWLAFIGWFIFAAAREEET

SEQ ID NO: 1387350 - protein, 17 aa, Mycobacterium tuberculosis
LVLLFSPPSIRWAAGRD

SEQ ID NO: 1387351 - protein, 21 aa, Mycobacterium tuberculosis
LVRHVYNMALVFRHRVRKDRL

SEQ ID NO: 1387352 - protein, 21 aa, Mycobacterium tuberculosis
LVRWTAHWPRRRALVVSLVCL

SEQ ID NO: 1387353 - protein, 26 aa, Mycobacterium tuberculosis
LVTGWWIGVLAYFLPRRSWLRAAAED

SEQ ID NO: 1387354 - protein, 17 aa, Mycobacterium tuberculosis
LVVAAGALWMAARLPWV

SEQ ID NO: 1387355 - protein, 29 aa, Mycobacterium tuberculosis
MADLANLFPFQLFLVLYGLPLEDRDRLIG

SEQ ID NO: 1387356 - protein, 19 aa, Mycobacterium tuberculosis
MALRRMKVVAVGFLVGATG

SEQ ID NO: 1387357 - protein, 23 aa, Mycobacterium tuberculosis
MDANYRWFHPAPNTLAAAVGSPR

SEQ ID NO: 1387358 - protein, 25 aa, Mycobacterium tuberculosis
MFALTWAIALLVWHYGRVEERWTPA

SEQ ID NO: 1387359 - protein, 25 aa, Mycobacterium tuberculosis
MIGSFPILSVFGFVVMFGGVVYAIT

SEQ ID NO: 1387360 - protein, 29 aa, Mycobacterium tuberculosis
MNKMEALTPQFLALLPPMITTMKTMRTMM

SEQ ID NO: 1387361 - protein, 22 aa, Mycobacterium tuberculosis
MPDIEPIYKVTILARGRTGGHA

SEQ ID NO: 1387362 - protein, 22 aa, Mycobacterium tuberculosis
MRGVTLISMPQFDATKVWSLIV

SEQ ID NO: 1387363 - protein, 19 aa, Mycobacterium tuberculosis
MRRHLPLPRHPTPGYLAVG

SEQ ID NO: 1387364 - protein, 29 aa, Mycobacterium tuberculosis
MRSHNSSPPPPRWAWPPLIAVGAVGMVGM

SEQ ID NO: 1387365 - protein, 32 aa, Mycobacterium tuberculosis; identical to SEQ ID NO: 163169

SEQ ID NO: 1387366 - protein, 27 aa, Mycobacterium tuberculosis
MTTWYAAMLFAVIPLRNALPDAPPIGF

SEQ ID NO: 1387367 - protein, 32 aa, Mycobacterium tuberculosis; identical to SEQ ID NO: 163172

SEQ ID NO: 1387368 - protein, 24 aa, Mycobacterium tuberculosis
MVGVAVYAWIRPLPDDWSQLPKRL

SEQ ID NO: 1387369 - protein, 26 aa, Mycobacterium tuberculosis
NEAWRSDQFVLDPTRLTLFIGATGMN

SEQ ID NO: 1387370 - protein, 25 aa, Mycobacterium tuberculosis
NFNSAFYLFGLVLLVMAGNLARPTG

SEQ ID NO: 1387371 - protein, 20 aa, Mycobacterium tuberculosis
NGTHSWPYWNEQLVAMKADI

SEQ ID NO: 1387372 - protein, 20 aa, Mycobacterium tuberculosis
NLIAVLHDGVVIGSAVFSED

SEQ ID NO: 1387373 - protein, 24 aa, Mycobacterium tuberculosis
NNEPWYTALWHTIADDPHLPPAAP

SEQ ID NO: 1387374 - protein, 20 aa, Mycobacterium tuberculosis
NPLTMVPAPTRRWAARRRGG

SEQ ID NO: 1387375 - protein, 26 aa, Mycobacterium tuberculosis
NRPDILDPALLRPGRFDRQIPVSNPD

SEQ ID NO: 1387376 - protein, 20 aa, Mycobacterium tuberculosis
NSYWLVGVQLLDGIGAGIFG

SEQ ID NO: 1387377 - protein, 25 aa, Mycobacterium tuberculosis
NTNSSQFFMVYRDSKLPPQYTVFGT

SEQ ID NO: 1387378 - protein, 29 aa, Mycobacterium tuberculosis
NVDATMLQMLIIFGIVTVIALVAATTAGI

SEQ ID NO: 1387379 - protein, 26 aa, Mycobacterium tuberculosis
NVFTMMMRLPWLYRVPVHTIHKFGHM

SEQ ID NO: 1387380 - protein, 24 aa, Mycobacterium tuberculosis
NVVNPGIFALISRATCVDLDGTQR

SEQ ID NO: 1387381 - protein, 37 aa, Mycobacterium tuberculosis; identical to SEQ ID NO: 163237

SEQ ID NO: 1387382 - protein, 24 aa, Mycobacterium tuberculosis
PAVARRNMLRAWESRLLMVARRFD

SEQ ID NO: 1387383 - protein, 18 aa, Mycobacterium tuberculosis
PCLPWFISSNWNLAFGVL

SEQ ID NO: 1387384 - protein, 34 aa, Mycobacterium tuberculosis; identical to SEQ ID NO: 163258

SEQ ID NO: 1387385 - protein, 53 aa, Mycobacterium tuberculosis; identical to SEQ ID NO: 163263

SEQ ID NO: 1387386 - protein, 17 aa, Mycobacterium tuberculosis
PDPVVMLCSARADVLAA

SEQ ID NO: 1387387 - protein, 23 aa, Mycobacterium tuberculosis
PDSLIRMCLFLGALTFMYISARA

SEQ ID NO: 1387388 - protein, 34 aa, Mycobacterium tuberculosis; identical to SEQ ID NO: 163270

SEQ ID NO: 1387389 - protein, 22 aa, Mycobacterium tuberculosis
PEAPPLTAPIIPDAGNPASFGV

SEQ ID NO: 1387390 - protein, 38 aa, Mycobacterium tuberculosis; identical to SEQ ID NO: 163279

SEQ ID NO: 1387391 - protein, 25 aa, Mycobacterium tuberculosis
PFLSYGIQWISFGILAPIGLGYFAY

SEQ ID NO: 1387392 - protein, 24 aa, Mycobacterium tuberculosis
PGMAAPPVRLLPTNLAPHAVGELY

SEQ ID NO: 1387393 - protein, 22 aa, Mycobacterium tuberculosis
PGMPLPILVAVSGAALSGVCLT

SEQ ID NO: 1387394 - protein, 20 aa, Mycobacterium tuberculosis
PGNPLPVVPLAFDPPEHTRY

SEQ ID NO: 1387395 - protein, 38 aa, Mycobacterium tuberculosis
PGSTVVSWLPFYHDMGFVLGLILPILAGIPAVLTSPIG

SEQ ID NO: 1387396 - protein, 24 aa, Mycobacterium tuberculosis
PHEVSFYCLDYGGGQLRALQDLAH

SEQ ID NO: 1387397 - protein, 31 aa, Mycobacterium tuberculosis; identical to SEQ ID NO: 163316

SEQ ID NO: 1387398 - protein, 18 aa, Mycobacterium tuberculosis
PLHDQWRPVLWAIAILTM

SEQ ID NO: 1387399 - protein, 27 aa, Mycobacterium tuberculosis
PLNTRQLLLVNMLTDALPAAALAVSKP

SEQ ID NO: 1387400 - protein, 33 aa, Mycobacterium tuberculosis; identical to SEQ ID NO: 164479

SEQ ID NO: 1387401 - protein, 31 aa, Mycobacterium tuberculosis; identical to SEQ ID NO: 163328

SEQ ID NO: 1387402 - protein, 30 aa, Mycobacterium tuberculosis
PNSVRSAAALWWIPAWLAMIVEVAVLGPQR

SEQ ID NO: 1387403 - protein, 24 aa, Mycobacterium tuberculosis
PNVALLLLFVYRPLADNIRLSFFD

SEQ ID NO: 1387404 - protein, 40 aa, Mycobacterium tuberculosis; identical to SEQ ID NO: 163336

SEQ ID NO: 1387405 - protein, 27 aa, Mycobacterium tuberculosis
PPQAATAPPLPPFKPSANLGANCQYPP

SEQ ID NO: 1387406 - protein, 31 aa, Mycobacterium tuberculosis; identical to SEQ ID NO: 163354

SEQ ID NO: 1387407 - protein, 39 aa, Mycobacterium tuberculosis; identical to SEQ ID NO: 163356

SEQ ID NO: 1387408 - protein, 23 aa, Mycobacterium tuberculosis
PTHKPLFVGLVIGVVLIVGGLTF

SEQ ID NO: 1387409 - protein, 20 aa, Mycobacterium tuberculosis
PVLGRLYSTEFYALAARALA

SEQ ID NO: 1387410 - protein, 21 aa, Mycobacterium tuberculosis
PVRMTFRSSRLVYPMRLSVAA

SEQ ID NO: 1387411 - protein, 31 aa, Mycobacterium tuberculosis; identical to SEQ ID NO: 22636

SEQ ID NO: 1387412 - protein, 27 aa, Mycobacterium tuberculosis
QAEGPLLPLVQLGGVALLSTGVALVGC

SEQ ID NO: 1387413 - protein, 24 aa, Mycobacterium tuberculosis
QEAFIQLLADRAFQWSLNAGVVIQ

SEQ ID NO: 1387414 - protein, 21 aa, Mycobacterium tuberculosis
QFMALGWKLLIPVSLVWVMVA

SEQ ID NO: 1387415 - protein, 25 aa, Mycobacterium tuberculosis
QLIPATNIALLVFAAGIPAVAAVAI

SEQ ID NO: 1387416 - protein, 24 aa, Mycobacterium tuberculosis
QLQPKYMEMLNLNEAWQFGRGDGV

SEQ ID NO: 1387417 - protein, 30 aa, Mycobacterium tuberculosis; identical to SEQ ID NO: 163427

SEQ ID NO: 1387418 - protein, 23 aa, Mycobacterium tuberculosis
QLVKLAHIKLAWRTGNFVIYAIT

SEQ ID NO: 1387419 - protein, 26 aa, Mycobacterium tuberculosis
QNYTYKWETFLTREMPAWLQANKGVS

SEQ ID NO: 1387420 - protein, 24 aa, Mycobacterium tuberculosis
QSKGYFLLGIWMSLLWAVVFTLSI

SEQ ID NO: 1387421 - protein, 17 aa, Mycobacterium tuberculosis
QVWLVDPRRQLLTALGS

SEQ ID NO: 1387422 - protein, 30 aa, Mycobacterium tuberculosis; identical to SEQ ID NO: 163465

SEQ ID NO: 1387423 - protein, 35 aa, Mycobacterium tuberculosis; identical to SEQ ID NO: 163467

SEQ ID NO: 1387424 - protein, 33 aa, Mycobacterium tuberculosis; identical to SEQ ID NO: 163468

SEQ ID NO: 1387425 - protein, 26 aa, Mycobacterium tuberculosis
RANAAPLRIMILLVLVTALGSALLDN

SEQ ID NO: 1387426 - protein, 28 aa, Mycobacterium tuberculosis
RDRAGELLFWLPYPSFATYLHVGCAQIR

SEQ ID NO: 1387427 - protein, 18 aa, Mycobacterium tuberculosis
RFGLRQMVDIALRALSPA

SEQ ID NO: 1387428 - protein, 27 aa, Mycobacterium tuberculosis
RFSAADKPVIFWTPDHGAFVVRGAMVA

SEQ ID NO: 1387429 - protein, 18 aa, Mycobacterium tuberculosis
RGALFRAAAVWLAGAVVG

SEQ ID NO: 1387430 - protein, 24 aa, Mycobacterium tuberculosis
RHADTWIMSLLYIGTFGSFIGYSA

SEQ ID NO: 1387431 - protein, 24 aa, Mycobacterium tuberculosis
RHHEALLFFAFSGVGVLLSMAPLW

SEQ ID NO: 1387432 - protein, 21 aa, Mycobacterium tuberculosis
RHIASWLAALVVPSVICAITV

SEQ ID NO: 1387433 - protein, 25 aa, Mycobacterium tuberculosis
RILIMIALGVIVLLLAGPRLIDAYV

SEQ ID NO: 1387434 - protein, 27 aa, Mycobacterium tuberculosis
RIVRRSNALLDWAYGRRFRYSETMSVG

SEQ ID NO: 1387435 - protein, 19 aa, Mycobacterium tuberculosis
RLSLLPVLIGLMSAVPLGL

SEQ ID NO: 1387436 - protein, 17 aa, Mycobacterium tuberculosis
RMLLLGTLIGLVWELPV

SEQ ID NO: 1387437 - protein, 18 aa, Mycobacterium tuberculosis
RPFLMQFGEGQWKSRPET

SEQ ID NO: 1387438 - protein, 20 aa, Mycobacterium tuberculosis
RPGWLALALVVVAFTYLCFT

SEQ ID NO: 1387439 - protein, 31 aa, Mycobacterium tuberculosis; identical to SEQ ID NO: 163571

SEQ ID NO: 1387440 - protein, 19 aa, Mycobacterium tuberculosis
RPVLWAIAILTMTVGTVTA

SEQ ID NO: 1387441 - protein, 23 aa, Mycobacterium tuberculosis
RQFQVFLDDVRLPADALVGAEDA

SEQ ID NO: 1387442 - protein, 17 aa, Mycobacterium tuberculosis
RQKPLSFTLSSVLLLPL

SEQ ID NO: 1387443 - protein, 21 aa, Mycobacterium tuberculosis
RRRTWLVLRMNPQRNVAAVAC

SEQ ID NO: 1387444 - protein, 18 aa, Mycobacterium tuberculosis
RRSQPLFVAHWTSTGRLN

SEQ ID NO: 1387445 - protein, 25 aa, Mycobacterium tuberculosis
RRTFLAPWRVAVGHLMFWGVGTALL

SEQ ID NO: 1387446 - protein, 37 aa, Mycobacterium tuberculosis; identical to SEQ ID NO: 163600

SEQ ID NO: 1387447 - protein, 22 aa, Mycobacterium tuberculosis
RSTFLMFSWMQVFTASGFAFSH

SEQ ID NO: 1387448 - protein, 24 aa, Mycobacterium tuberculosis
RSVSVWFRSIWMLAPRGDLMAQAT

SEQ ID NO: 1387449 - protein, 20 aa, Mycobacterium tuberculosis
RTFIGSAVVMLPLVAAAVAV

SEQ ID NO: 1387450 - protein, 18 aa, Mycobacterium tuberculosis
RTSTLVLIAAFLAVWWIY

SEQ ID NO: 1387451 - protein, 24 aa, Mycobacterium tuberculosis
RTVKLNMVWAFGYNIAAIPVAAAG

SEQ ID NO: 1387452 - protein, 24 aa, Mycobacterium tuberculosis
RVAPNPPIALPEREPRNIWVMIGV

SEQ ID NO: 1387453 - protein, 28 aa, Mycobacterium tuberculosis
RVDIDGTLSFLLLPRLTTVLSKLPEGSE

SEQ ID NO: 1387454 - protein, 26 aa, Mycobacterium tuberculosis
RVGKRFLIIDLKRQKPLSFTLSSVLL

SEQ ID NO: 1387455 - protein, 22 aa, Mycobacterium tuberculosis
RVPELTPLDPVFAKALAKQPKD

SEQ ID NO: 1387456 - protein, 21 aa, Mycobacterium tuberculosis
RYVNLVVLLRTSCEITATALL

SEQ ID NO: 1387457 - protein, 30 aa, Mycobacterium tuberculosis; identical to SEQ ID NO: 163654

SEQ ID NO: 1387458 - protein, 25 aa, Mycobacterium tuberculosis
SANWQPWIWAVIVGGIGFMSLFVYW

SEQ ID NO: 1387459 - protein, 34 aa, Mycobacterium tuberculosis; identical to SEQ ID NO: 163665

SEQ ID NO: 1387460 - protein, 22 aa, Mycobacterium tuberculosis
SAWQRFWRITLPMLRPTMFFVL

SEQ ID NO: 1387461 - protein, 24 aa, Mycobacterium tuberculosis
SDLDQWDWVKWLPHFGDSRRHDAA

SEQ ID NO: 1387462 - protein, 18 aa, Mycobacterium tuberculosis
SDLLWSFMQAIAMSIAVM

SEQ ID NO: 1387463 - protein, 26 aa, Mycobacterium tuberculosis
SDWRNRPVLVFVLDAGMPGLTQGKPF

SEQ ID NO: 1387464 - protein, 25 aa, Mycobacterium tuberculosis
SEPHTWVISLLYIGTFGSFIGFSFA

SEQ ID NO: 1387465 - protein, 38 aa, Mycobacterium tuberculosis; identical to SEQ ID NO: 163682

SEQ ID NO: 1387466 - protein, 24 aa, Mycobacterium tuberculosis
SGKTTLMLILAGRAPTSGTVDRPG

SEQ ID NO: 1387467 - protein, 43 aa, Mycobacterium tuberculosis; identical to SEQ ID NO: 163710

SEQ ID NO: 1387468 - protein, 29 aa, Mycobacterium tuberculosis
SIVTVLVLIYLITNLLVDLLYAALDPRIR

SEQ ID NO: 1387469 - protein, 25 aa, Mycobacterium tuberculosis
SLLVLVTVVLLLASGRFIKAIPPSL

SEQ ID NO: 1387470 - protein, 19 aa, Mycobacterium tuberculosis
SLPPIPTLFVVADEFTLML

SEQ ID NO: 1387471 - protein, 28 aa, Mycobacterium tuberculosis
SLQGKPAVLWFWTPWCPFCNAEAPSLSQ

SEQ ID NO: 1387472 - protein, 41 aa, Mycobacterium tuberculosis; identical to SEQ ID NO: 163745

SEQ ID NO: 1387473 - protein, 35 aa, Mycobacterium tuberculosis; identical to SEQ ID NO: 163748

SEQ ID NO: 1387474 - protein, 18 aa, Mycobacterium tuberculosis
SRAQLLIASGSLAADPGK

SEQ ID NO: 1387475 - protein, 24 aa, Mycobacterium tuberculosis
SRGRRLAITVGVAAALFVGSAAFA

SEQ ID NO: 1387476 - protein, 35 aa, Mycobacterium tuberculosis; identical to SEQ ID NO: 163767

SEQ ID NO: 1387477 - protein, 18 aa, Mycobacterium tuberculosis
SSVHYLLDVLRRVAIDLD

SEQ ID NO: 1387478 - protein, 24 aa, Mycobacterium tuberculosis
STHKVPVWSLLLMGAAALAISVAA

SEQ ID NO: 1387479 - protein, 20 aa, Mycobacterium tuberculosis
STQPDYGAPAGWHAPGWPPR

SEQ ID NO: 1387480 - protein, 23 aa, Mycobacterium tuberculosis
SVEWDTLLFFAGLFVMVGALVKT

SEQ ID NO: 1387481 - protein, 27 aa, Mycobacterium tuberculosis
SVLAFSVMSFLLLYGIARFQGVLPFNP

SEQ ID NO: 1387482 - protein, 19 aa, Mycobacterium tuberculosis
SWLEVPLAMRDGLGLRLEL

SEQ ID NO: 1387483 - protein, 24 aa, Mycobacterium tuberculosis
SYTSTYLRFVWTLSATAVVLCYGL

SEQ ID NO: 1387484 - protein, 19 aa, Mycobacterium tuberculosis
TAAGLRRRYREGRLAREVA

SEQ ID NO: 1387485 - protein, 27 aa, Mycobacterium tuberculosis
TAALTVWVVGYALRPLRRVAATAAEVA

SEQ ID NO: 1387486 - protein, 35 aa, Mycobacterium tuberculosis; identical to SEQ ID NO: 163815

SEQ ID NO: 1387487 - protein, 23 aa, Mycobacterium tuberculosis
TALLGYRIMAWTTGLWLIALCYE

SEQ ID NO: 1387488 - protein, 22 aa, Mycobacterium tuberculosis
TASLALAFPLALRFDNLHLTGL

SEQ ID NO: 1387489 - protein, 19 aa, Mycobacterium tuberculosis
TDFFQVLVTQFGSSGGPFA

SEQ ID NO: 1387490 - protein, 17 aa, Mycobacterium tuberculosis
TDYAVFLISRYHEYVRL

SEQ ID NO: 1387491 - protein, 40 aa, Mycobacterium tuberculosis; identical to SEQ ID NO: 163834

SEQ ID NO: 1387492 - protein, 19 aa, Mycobacterium tuberculosis
TGEIMIFVGKDFVVTVRHG

SEQ ID NO: 1387493 - protein, 26 aa, Mycobacterium tuberculosis
TGKLRPALFVVPTDAPGFSYTPIEME

SEQ ID NO: 1387494 - protein, 24 aa, Mycobacterium tuberculosis
TGLATLEAFLKRRVRTHGLLTASI

SEQ ID NO: 1387495 - protein, 35 aa, Mycobacterium tuberculosis
TGPLLGGWLTDYLSWRWAFWINVPVSIAVLTVAAT

SEQ ID NO: 1387496 - protein, 18 aa, Mycobacterium tuberculosis
THGSAAQRQKWFTVGYQT

SEQ ID NO: 1387497 - protein, 29 aa, Mycobacterium tuberculosis
THINTYSMDLFLRIAPELYLKRLCVGGVE

SEQ ID NO: 1387498 - protein, 24 aa, Mycobacterium tuberculosis
TLAVRALPIVLLTALVFFNTYVWL

SEQ ID NO: 1387499 - protein, 27 aa, Mycobacterium tuberculosis
TLYGLINNAFIPRFLFAVSFCGVLVAT

SEQ ID NO: 1387500 - protein, 24 aa, Mycobacterium tuberculosis
TMHGTIMLLFYATPIVFGFANLVL

SEQ ID NO: 1387501 - protein, 26 aa, Mycobacterium tuberculosis
TMRTIRMNMIWAFGYNVAAIPIAAAG

SEQ ID NO: 1387502 - protein, 21 aa, Mycobacterium tuberculosis
TMVAVLAMMVSISGLLALITL

SEQ ID NO: 1387503 - protein, 20 aa, Mycobacterium tuberculosis
TPHPRLPRLIPGGDYVMAGG

SEQ ID NO: 1387504 - protein, 23 aa, Mycobacterium tuberculosis
TPPLGPAWVALLIVGASSGVAVG

SEQ ID NO: 1387505 - protein, 25 aa, Mycobacterium tuberculosis
TPPTLAPIGGILSHVPFKAGEVTLL

SEQ ID NO: 1387506 - protein, 19 aa, Mycobacterium tuberculosis
TQTVLPFTGLNDPDGVAVD

SEQ ID NO: 1387507 - protein, 30 aa, Mycobacterium tuberculosis; identical to SEQ ID NO: 163912

SEQ ID NO: 1387508 - protein, 31 aa, Mycobacterium tuberculosis; identical to SEQ ID NO: 163915

SEQ ID NO: 1387509 - protein, 23 aa, Mycobacterium tuberculosis
TRQPIPPWEQAAHLLDYGFNTPA

SEQ ID NO: 1387510 - protein, 22 aa, Mycobacterium tuberculosis
TSMVLYILCWWWHLKPDVDETM

SEQ ID NO: 1387511 - protein, 23 aa, Mycobacterium tuberculosis
TTAGWLAVVLALAVAATPILAVA

SEQ ID NO: 1387512 - protein, 25 aa, Mycobacterium tuberculosis
TTASIRYLNLIGDRYLELGRGHSGQ

SEQ ID NO: 1387513 - protein, 24 aa, Mycobacterium tuberculosis
TTMGLLLLVPPIRALARPGLTAIA

SEQ ID NO: 1387514 - protein, 29 aa, Mycobacterium tuberculosis
TVGAGWFGLFGLAFWVALAGLTPSGLLLA

SEQ ID NO: 1387515 - protein, 17 aa, Mycobacterium tuberculosis
TVLLIAPVTLLVCDRLN

SEQ ID NO: 1387516 - protein, 28 aa, Mycobacterium tuberculosis
TVLLTHPGLPLWPYLVCAALTGLGGGNF

SEQ ID NO: 1387517 - protein, 17 aa, Mycobacterium tuberculosis
TVRGWLRRFAERAEAVR

SEQ ID NO: 1387518 - protein, 28 aa, Mycobacterium tuberculosis
TVSSLLFMFVWAMIIISYLVYRRRHPQR

SEQ ID NO: 1387519 - protein, 18 aa, Mycobacterium tuberculosis
VADRRRTWLVLRMNPQRN

SEQ ID NO: 1387520 - protein, 24 aa, Mycobacterium tuberculosis
VAETLVMMTLFLTGLIVAIVTGNF

SEQ ID NO: 1387521 - protein, 23 aa, Mycobacterium tuberculosis
VAFRPVRLFFINVGLAAVAMLVA

SEQ ID NO: 1387522 - protein, 25 aa, Mycobacterium tuberculosis
VAGLVALYILMQLARQRRMLRFANM

SEQ ID NO: 1387523 - protein, 24 aa, Mycobacterium tuberculosis
VAGSVLFGLWHIATSLGLTSSNVG

SEQ ID NO: 1387524 - protein, 18 aa, Mycobacterium tuberculosis
VCMIWRLFMQDSVTRPTT

SEQ ID NO: 1387525 - protein, 21 aa, Mycobacterium tuberculosis
VDGQMFLEMRLVEGTDLDSVL

SEQ ID NO: 1387526 - protein, 27 aa, Mycobacterium tuberculosis
VDVNHGGYWFTFFVALGGAVVLLWIVG

SEQ ID NO: 1387527 - protein, 19 aa, Mycobacterium tuberculosis
VEKWAKVRGDKLAYRFLDF

SEQ ID NO: 1387528 - protein, 19 aa, Mycobacterium tuberculosis
VFGVLRWLTRHRHTEMPGW

SEQ ID NO: 1387529 - protein, 20 aa, Mycobacterium tuberculosis
VFNHPQAFFAPISAVVCMSA

SEQ ID NO: 1387530 - protein, 25 aa, Mycobacterium tuberculosis
VFVAFQLMFAIITVALISGAVADRL

SEQ ID NO: 1387531 - protein, 19 aa, Mycobacterium tuberculosis
VGAEWLFTPVLLSQNYHLV

SEQ ID NO: 1387532 - protein, 26 aa, Mycobacterium tuberculosis
VGALGILVMVVWVGTALTISTTASRS

SEQ ID NO: 1387533 - protein, 20 aa, Mycobacterium tuberculosis
VGLFVMFSRMQGGARMGFGF

SEQ ID NO: 1387534 - protein, 33 aa, Mycobacterium tuberculosis; identical to SEQ ID NO: 164049

SEQ ID NO: 1387535 - protein, 29 aa, Mycobacterium tuberculosis
VGVGIGAAILLGWFTLAHRHPDQPGAAAT

SEQ ID NO: 1387536 - protein, 22 aa, Mycobacterium tuberculosis
VHSIDYIRPQLFTNSFTPLEVS

SEQ ID NO: 1387537 - protein, 22 aa, Mycobacterium tuberculosis
VIGTFVVPPILKVLRERDAMVA

SEQ ID NO: 1387538 - protein, 18 aa, Mycobacterium tuberculosis
VIGWPFVGLLALGLVYVA

SEQ ID NO: 1387539 - protein, 22 aa, Mycobacterium tuberculosis
VLAEAFLPRRWRYGAQVTLALG

SEQ ID NO: 1387540 - protein, 33 aa, Mycobacterium tuberculosis; identical to SEQ ID NO: 164079

SEQ ID NO: 1387541 - protein, 31 aa, Mycobacterium tuberculosis; identical to SEQ ID NO: 164100

SEQ ID NO: 1387542 - protein, 24 aa, Mycobacterium tuberculosis
VLVALNFLICLAYIFFSLTQHAAA

SEQ ID NO: 1387543 - protein, 26 aa, Mycobacterium tuberculosis
VLVVMIALIGLLPWLLGSVTAEPDRV

SEQ ID NO: 1387544 - protein, 34 aa, Mycobacterium tuberculosis; identical to SEQ ID NO: 164112

SEQ ID NO: 1387545 - protein, 30 aa, Mycobacterium tuberculosis; identical to SEQ ID NO: 164116

SEQ ID NO: 1387546 - protein, 31 aa, Mycobacterium tuberculosis; identical to SEQ ID NO: 164127

SEQ ID NO: 1387547 - protein, 28 aa, Mycobacterium tuberculosis
VQPFGEYLPMPWLFRHLSGYADRAGHFV

SEQ ID NO: 1387548 - protein, 24 aa, Mycobacterium tuberculosis
VRASWPWALVVFLVVVFVAPLCEE

SEQ ID NO: 1387549 - protein, 28 aa, Mycobacterium tuberculosis
VRMVVVPAFMHVTGRWNWWAPRPLAWLH

SEQ ID NO: 1387550 - protein, 25 aa, Mycobacterium tuberculosis
VRSAGFGYPFLAYHVAGRGHGAGAV

SEQ ID NO: 1387551 - protein, 20 aa, Mycobacterium tuberculosis
VSGWRLIGKCLRPLPNKWKG

SEQ ID NO: 1387552 - protein, 20 aa, Mycobacterium tuberculosis
VSLLIVALTVWYYKLNVNPP

SEQ ID NO: 1387553 - protein, 20 aa, Mycobacterium tuberculosis
VSMIPFTIAILRYAVDVDGG

SEQ ID NO: 1387554 - protein, 23 aa, Mycobacterium tuberculosis
VTFGVALCAGLWFIGRRVIATVG

SEQ ID NO: 1387555 - protein, 24 aa, Mycobacterium tuberculosis
VTHGLLWAVIAPIATRLVPPSHAG

SEQ ID NO: 1387556 - protein, 37 aa, Mycobacterium tuberculosis; identical to SEQ ID NO: 164166

SEQ ID NO: 1387557 - protein, 21 aa, Mycobacterium tuberculosis
VTRAAILVGLFLAAVALVWLL

SEQ ID NO: 1387558 - protein, 19 aa, Mycobacterium tuberculosis
VVFQHPYLFHGTIRDNVFA

SEQ ID NO: 1387559 - protein, 23 aa, Mycobacterium tuberculosis
VVHIGVVPLWRYRVHRWEISPQA

SEQ ID NO: 1387560 - protein, 25 aa, Mycobacterium tuberculosis
VVVAFTYLCFTVLAPWQLGKNAKTS

SEQ ID NO: 1387561 - protein, 21 aa, Mycobacterium tuberculosis
VVVALMIMLVCTYYGYAAHGG

SEQ ID NO: 1387562 - protein, 25 aa, Mycobacterium tuberculosis
VYHPQPLVLTLLLATIAGVLSVVGT

SEQ ID NO: 1387563 - protein, 27 aa, Mycobacterium tuberculosis
WAAQEWLKSILPFGGFPWGSVAFGQAE

SEQ ID NO: 1387564 - protein, 21 aa, Mycobacterium tuberculosis
WAVLVFFAFVIWTLTTETETA

SEQ ID NO: 1387565 - protein, 25 aa, Mycobacterium tuberculosis
WGMLQAAGLLFFAFAGYARIATLGE

SEQ ID NO: 1387566 - protein, 19 aa, Mycobacterium tuberculosis
WLGAPRLGLICYLVALTMA

SEQ ID NO: 1387567 - protein, 20 aa, Mycobacterium tuberculosis
WPGYLFGRIRTSTLVLIAAF

SEQ ID NO: 1387568 - protein, 25 aa, Mycobacterium tuberculosis
WSTALLPLALLMLAAAVAALAVRGW

SEQ ID NO: 1387569 - protein, 32 aa, Mycobacterium tuberculosis; identical to SEQ ID NO: 164242

SEQ ID NO: 1387570 - protein, 18 aa, Mycobacterium tuberculosis
WVGQLTLIPAVALIAYTI

SEQ ID NO: 1387571 - protein, 17 aa, Mycobacterium tuberculosis
WVPLFCSFGAMLVYPEN

SEQ ID NO: 1387572 - protein, 26 aa, Mycobacterium tuberculosis
YAQPTSWWPLRWYPQNYRTATEQIPF

SEQ ID NO: 1387573 - protein, 20 aa, Mycobacterium tuberculosis
YDARWLVTRMTTITSLDLTP

SEQ ID NO: 1387574 - protein, 23 aa, Mycobacterium tuberculosis
YDHYFNTFLIPSDLLWSFMQAIA

SEQ ID NO: 1387575 - protein, 23 aa, Mycobacterium tuberculosis
YDHYFNTFLRPTDVLWSSVEVVV

SEQ ID NO: 1387576 - protein, 19 aa, Mycobacterium tuberculosis
YFTAFGWGVLFAESALAVL

SEQ ID NO: 1387577 - protein, 20 aa, Mycobacterium tuberculosis
YGFDLVGYYPLILTAFLLLT

SEQ ID NO: 1387578 - protein, 17 aa, Mycobacterium tuberculosis
YGSTQPDYGAPAGWHAP

SEQ ID NO: 1387579 - protein, 22 aa, Mycobacterium tuberculosis
YHTILIDRYWWTALAVTLAITA

SEQ ID NO: 1387580 - protein, 24 aa, Mycobacterium tuberculosis
YISGWIPFWVTIPVNAAVTFVMFT

SEQ ID NO: 1387581 - protein, 26 aa, Mycobacterium tuberculosis
YLLVAVLYRWFPPITVWTGLSLLAVA

SEQ ID NO: 1387582 - protein, 21 aa, Mycobacterium tuberculosis
YSSIFFATPLLVTLRERTELV

SEQ ID NO: 1387583 - protein, 30 aa, Mycobacterium tuberculosis; identical to SEQ ID NO: 164298

SEQ ID NO: 1387584 - protein, 20 aa, Mycobacterium tuberculosis
YVVICSVGIAVAFLGTVLLY

SEQ ID NO: 1387585 - protein, 25 aa, Mycobacterium tuberculosis
AAALPWLRIAILGTPAILVSLAGNG

SEQ ID NO: 1387586 - protein, 35 aa, Mycobacterium tuberculosis; identical to SEQ ID NO: 161712

SEQ ID NO: 1387587 - protein, 25 aa, Mycobacterium tuberculosis
AADIHMLWWMVLIVGVVSIIGAGYH

SEQ ID NO: 1387588 - protein, 19 aa, Mycobacterium tuberculosis
AAGYLVLRPSWSPTQASGQ

SEQ ID NO: 1387589 - protein, 18 aa, Mycobacterium tuberculosis
AAIAILGTVLLTRGKHSK

SEQ ID NO: 1387590 - protein, 27 aa, Mycobacterium tuberculosis
AALGTPALAAPAPHGALAGSGKLGVRD

SEQ ID NO: 1387591 - protein, 24 aa, Mycobacterium tuberculosis
AALLVIPCLLLAWAVSHPSLPFAV

SEQ ID NO: 1387592 - protein, 17 aa, Mycobacterium tuberculosis
AATAFHLLTGSPPFQHA

SEQ ID NO: 1387593 - protein, 17 aa, Mycobacterium tuberculosis
AAVLVTLAGRRLWHRFR

SEQ ID NO: 1387594 - protein, 26 aa, Mycobacterium tuberculosis
ADAPVGIIALWALALLIIGTGIGIAW

SEQ ID NO: 1387595 - protein, 17 aa, Mycobacterium tuberculosis
ADDFAYLVDFGIASATT

SEQ ID NO: 1387596 - protein, 22 aa, Mycobacterium tuberculosis
ADFEDFFRPIRSYFYWEKHCFD

SEQ ID NO: 1387597 - protein, 31 aa, Mycobacterium tuberculosis; identical to SEQ ID NO: 161764

SEQ ID NO: 1387598 - protein, 19 aa, Mycobacterium tuberculosis
ADLSFLPALALIFLNCVWV

SEQ ID NO: 1387599 - protein, 31 aa, Mycobacterium tuberculosis; identical to SEQ ID NO: 161771

SEQ ID NO: 1387600 - protein, 19 aa, Mycobacterium tuberculosis
AECWPAVGGGVPSAYDLGT

SEQ ID NO: 1387601 - protein, 19 aa, Mycobacterium tuberculosis
AFGGYFYWDDLILVGRAGT

SEQ ID NO: 1387602 - protein, 19 aa, Mycobacterium tuberculosis
AFLILFATLMAAAGDGVSI

SEQ ID NO: 1387603 - protein, 27 aa, Mycobacterium tuberculosis
AGEVGLSLFYWWYHTLDKTAAVFVVLV

SEQ ID NO: 1387604 - protein, 26 aa, Mycobacterium tuberculosis
AGGCRRPVWVTLIGNLLSLGVVMVYT

SEQ ID NO: 1387605 - protein, 26 aa, Mycobacterium tuberculosis
AGKGDFLLGLLLPHGLLELTAVFLAA

SEQ ID NO: 1387606 - protein, 18 aa, Mycobacterium tuberculosis
AGMIAFLIAGLGGFMGVV

SEQ ID NO: 1387607 - protein, 17 aa, Mycobacterium tuberculosis
AGPPLFGSLITTAAYPT

SEQ ID NO: 1387608 - protein, 34 aa, Mycobacterium tuberculosis; identical to SEQ ID NO: 161811

SEQ ID NO: 1387609 - protein, 23 aa, Mycobacterium tuberculosis
AGVLLFIIGFNFGFGSLVWVYAA

SEQ ID NO: 1387610 - protein, 28 aa, Mycobacterium tuberculosis
AIGLGAALLIAALLLSTYTTSRIAEIPL

SEQ ID NO: 1387611 - protein, 18 aa, Mycobacterium tuberculosis
ALAERLFNRWGVRAVFLG

SEQ ID NO: 1387612 - protein, 21 aa, Mycobacterium tuberculosis
ALAILTLIALLFGAYFLRNYF

SEQ ID NO: 1387613 - protein, 34 aa, Mycobacterium tuberculosis; identical to SEQ ID NO: 161865

SEQ ID NO: 1387614 - protein, 32 aa, Mycobacterium tuberculosis; identical to SEQ ID NO: 161874

SEQ ID NO: 1387615 - protein, 18 aa, Mycobacterium tuberculosis
ALHFAKPIFGPAARALAQ

SEQ ID NO: 1387616 - protein, 18 aa, Mycobacterium tuberculosis
ALRAALIALALLAILAVI

SEQ ID NO: 1387617 - protein, 19 aa, Mycobacterium tuberculosis
ALSFQIYLALPMQASILMP

SEQ ID NO: 1387618 - protein, 25 aa, Mycobacterium tuberculosis
ALVGFLPLVWLSLAYGWGLAGIWSG

SEQ ID NO: 1387619 - protein, 21 aa, Mycobacterium tuberculosis
ALVYLQFRGEFTPKTQLTMLS

SEQ ID NO: 1387620 - protein, 22 aa, Mycobacterium tuberculosis
ALWARFPLPVIPAPGDPTPSAP

SEQ ID NO: 1387621 - protein, 29 aa, Mycobacterium tuberculosis
AMGYEPEDLPWEVPLIELGLDSLMAVRIK

SEQ ID NO: 1387622 - protein, 17 aa, Mycobacterium tuberculosis
AMLPILLVFIALQRQMI

SEQ ID NO: 1387623 - protein, 17 aa, Mycobacterium tuberculosis
ANSLIKDGKIVHPTLGI

SEQ ID NO: 1387624 - protein, 33 aa, Mycobacterium tuberculosis; identical to SEQ ID NO: 161917

SEQ ID NO: 1387625 - protein, 40 aa, Mycobacterium tuberculosis; identical to SEQ ID NO: 164328

SEQ ID NO: 1387626 - protein, 24 aa, Mycobacterium tuberculosis
ARSVNPIAFVYNYLKQVVAEMRKV

SEQ ID NO: 1387627 - protein, 30 aa, Mycobacterium tuberculosis; identical to SEQ ID NO: 161702

SEQ ID NO: 1387628 - protein, 25 aa, Mycobacterium tuberculosis
ARWQSSWLRYAPLSFSGLVMIGAVI

SEQ ID NO: 1387629 - protein, 20 aa, Mycobacterium tuberculosis
ASLVVFLVALPLSLGIAIAS

SEQ ID NO: 1387630 - protein, 26 aa, Mycobacterium tuberculosis
ASRTGNLVTWWTGDALLVFDAGNLTQ

SEQ ID NO: 1387631 - protein, 27 aa, Mycobacterium tuberculosis
ASVHSLLWIGVFLFLGGMAAGGCNSAG

SEQ ID NO: 1387632 - protein, 25 aa, Mycobacterium tuberculosis
ASVPPLWVIVSCAVAMAAGTYLGGW

SEQ ID NO: 1387633 - protein, 27 aa, Mycobacterium tuberculosis
ATAGACIGFLWWNAAPAKIFMGDTGSL

SEQ ID NO: 1387634 - protein, 25 aa, Mycobacterium tuberculosis
ATIGFGWTLLVLLATFVLGFGLLAP

SEQ ID NO: 1387635 - protein, 26 aa, Mycobacterium tuberculosis
ATLFGAFLRMPYALASAIFGGRNWAT

SEQ ID NO: 1387636 - protein, 20 aa, Mycobacterium tuberculosis
ATYCLSFARLTLFHTMGPPL

SEQ ID NO: 1387637 - protein, 20 aa, Mycobacterium tuberculosis
AVAFIAAISGWRAGALGSML

SEQ ID NO: 1387638 - protein, 21 aa, Mycobacterium tuberculosis
AVLVLAPFWLIPTSLDVHLSM

SEQ ID NO: 1387639 - protein, 27 aa, Mycobacterium tuberculosis
AVVASLCLIFIIMLGITRSVVASAVIV

SEQ ID NO: 1387640 - protein, 27 aa, Mycobacterium tuberculosis
AVVVAVAASLIWWTSDARATISRPAAV

SEQ ID NO: 1387641 - protein, 28 aa, Mycobacterium tuberculosis
AVVVMVAGVILWRFFGDALSNRSHTAAA

SEQ ID NO: 1387642 - protein, 25 aa, Mycobacterium tuberculosis
AWVSLYRAKWWWLLAAVAAAGASMH

SEQ ID NO: 1387643 - protein, 21 aa, Mycobacterium tuberculosis
AYDLTLFVNQLAAGNLRAAIE

SEQ ID NO: 1387644 - protein, 18 aa, Mycobacterium tuberculosis
CEEIIYRGLLWGAVDRRW

SEQ ID NO: 1387645 - protein, 17 aa, Mycobacterium tuberculosis
CVASAMLGLALSAIAKS

SEQ ID NO: 1387646 - protein, 29 aa, Mycobacterium tuberculosis
CWQPITRDLWPAPYLVMDTGASLAPYNHM

SEQ ID NO: 1387647 - protein, 25 aa, Mycobacterium tuberculosis
DAAGLHATFLALALPIVCTGLVAIR

SEQ ID NO: 1387648 - protein, 25 aa, Mycobacterium tuberculosis
DAENTLGSWLPPGPAAVADYPTVLL

SEQ ID NO: 1387649 - protein, 21 aa, Mycobacterium tuberculosis
DRHLRPMLARRFEIATGHRQA

SEQ ID NO: 1387650 - protein, 23 aa, Mycobacterium tuberculosis
DRQRILTWLIVDPLSPNSVRSAA

SEQ ID NO: 1387651 - protein, 19 aa, Mycobacterium tuberculosis
DTPVLYWINGIGCAIFAGL

SEQ ID NO: 1387652 - protein, 24 aa, Mycobacterium tuberculosis
DTRGRIVLRWLRIAVLIVTGLVTL

SEQ ID NO: 1387653 - protein, 22 aa, Mycobacterium tuberculosis
DTRLELWRSDMVRMLAYGEIDA

SEQ ID NO: 1387654 - protein, 31 aa, Mycobacterium tuberculosis; identical to SEQ ID NO: 162164

SEQ ID NO: 1387655 - protein, 30 aa, Mycobacterium tuberculosis; identical to SEQ ID NO: 162165

SEQ ID NO: 1387656 - protein, 27 aa, Mycobacterium tuberculosis
DVVLRPHWTPLFAYAAAFLIAVAHVAG

SEQ ID NO: 1387657 - protein, 19 aa, Mycobacterium tuberculosis
EAHLNRELWIGAVIASLAV

SEQ ID NO: 1387658 - protein, 35 aa, Mycobacterium tuberculosis; identical to SEQ ID NO: 162186

SEQ ID NO: 1387659 - protein, 24 aa, Mycobacterium tuberculosis
EGMGTTLTAILFAGNRLGLVHIGD

SEQ ID NO: 1387660 - protein, 20 aa, Mycobacterium tuberculosis
EIDGQLYVDMRLINGVDLAA

SEQ ID NO: 1387661 - protein, 18 aa, Mycobacterium tuberculosis
EKISFLPAMRYYAGNWAT

SEQ ID NO: 1387662 - protein, 23 aa, Mycobacterium tuberculosis
EKKTYPYFDPIAQKAFDANYEGE

SEQ ID NO: 1387663 - protein, 18 aa, Mycobacterium tuberculosis
EKQKLELLRSLLTYFHYA

SEQ ID NO: 1387664 - protein, 26 aa, Mycobacterium tuberculosis
ELLVVMLPLIGVLYVGIKALSSFTRR

SEQ ID NO: 1387665 - protein, 26 aa, Mycobacterium tuberculosis
EPKREALLTLLPLERAMVLRGLLSWP

SEQ ID NO: 1387666 - protein, 25 aa, Mycobacterium tuberculosis
EPPKGPAWRRIRVSQLLIGVSAVVA

SEQ ID NO: 1387667 - protein, 22 aa, Mycobacterium tuberculosis
EQIMPLLVVAVMSQLVFSGGMI

SEQ ID NO: 1387668 - protein, 26 aa, Mycobacterium tuberculosis
ERRPSPLPTPIVPGLAPMPPGSVVPS

SEQ ID NO: 1387669 - protein, 39 aa, Mycobacterium tuberculosis; identical to SEQ ID NO: 162249

SEQ ID NO: 1387670 - protein, 24 aa, Mycobacterium tuberculosis
ETVVFAFIVLFVINIVVTAVGIPF

SEQ ID NO: 1387671 - protein, 17 aa, Mycobacterium tuberculosis
FATFGLAYLAIIGVPPF

SEQ ID NO: 1387672 - protein, 17 aa, Mycobacterium tuberculosis
FGAFIPLIGAVVAGFLA

SEQ ID NO: 1387673 - protein, 18 aa, Mycobacterium tuberculosis
FGPYRLRRLVGRGGMGDV

SEQ ID NO: 1387674 - protein, 25 aa, Mycobacterium tuberculosis
FIANPYKYFLEFFEQFGFSPAVTVV

SEQ ID NO: 1387675 - protein, 20 aa, Mycobacterium tuberculosis
FIGLMLIGLIWLMVFQLAAI

SEQ ID NO: 1387676 - protein, 25 aa, Mycobacterium tuberculosis
FSRGQLIQLVLIGALVYVAYPFIST

SEQ ID NO: 1387677 - protein, 19 aa, Mycobacterium tuberculosis
FTPKTQLTMLSARAGLVMD

SEQ ID NO: 1387678 - protein, 20 aa, Mycobacterium tuberculosis
FYWAVGIAIGLPAGLIVLTE

SEQ ID NO: 1387679 - protein, 24 aa, Mycobacterium tuberculosis
GAGALLIKPLLAHAAIAFIAVEAV

SEQ ID NO: 1387680 - protein, 28 aa, Mycobacterium tuberculosis
GALAYFFGPVVVFWVLAGMALISVLATL

SEQ ID NO: 1387681 - protein, 18 aa, Mycobacterium tuberculosis
GALQIVFGLSRMARAALA

SEQ ID NO: 1387682 - protein, 28 aa, Mycobacterium tuberculosis
GALYARIDGRLYPALNLTSARLATGTAG

SEQ ID NO: 1387683 - protein, 17 aa, Mycobacterium tuberculosis
GAPARLDNARFLLPVVG

SEQ ID NO: 1387684 - protein, 24 aa, Mycobacterium tuberculosis
GAVTLLPAILTLTGRRGWIKPRRD

SEQ ID NO: 1387685 - protein, 25 aa, Mycobacterium tuberculosis
GAVVPHVRWPMWLRTAVATAALAAI

SEQ ID NO: 1387686 - protein, 27 aa, Mycobacterium tuberculosis
GEHYWLKLFVFFFPFTDQIAAFKIIML

SEQ ID NO: 1387687 - protein, 27 aa, Mycobacterium tuberculosis
GFALGVAMLLGGTWLTCVLAAVTSGVI

SEQ ID NO: 1387688 - protein, 23 aa, Mycobacterium tuberculosis
GFFPGVIAYLTVWFPCAQRARAV

SEQ ID NO: 1387689 - protein, 34 aa, Mycobacterium tuberculosis; identical to SEQ ID NO: 162414

SEQ ID NO: 1387690 - protein, 25 aa, Mycobacterium tuberculosis
GFIGKWPTELGGQPGLWIPSSSISA

SEQ ID NO: 1387691 - protein, 28 aa, Mycobacterium tuberculosis
GFSMLALLTRRWALAWVALAGSAMASGT

SEQ ID NO: 1387692 - protein, 29 aa, Mycobacterium tuberculosis
GGATVFTVAQWRWRWFRAAMCKTMAVAVI

SEQ ID NO: 1387693 - protein, 33 aa, Mycobacterium tuberculosis; identical to SEQ ID NO: 162424

SEQ ID NO: 1387694 - protein, 30 aa, Mycobacterium tuberculosis; identical to SEQ ID NO: 162428

SEQ ID NO: 1387695 - protein, 24 aa, Mycobacterium tuberculosis
GGGSQFYVLLPDGVQKISSFVADL

SEQ ID NO: 1387696 - protein, 18 aa, Mycobacterium tuberculosis
GIAAGIAVWVLLNGANPL

SEQ ID NO: 1387697 - protein, 25 aa, Mycobacterium tuberculosis
GIALPFLVWVWLRHLRERRGYRPVQ

SEQ ID NO: 1387698 - protein, 18 aa, Mycobacterium tuberculosis
GIALTLSRLVAGLTPGLA

SEQ ID NO: 1387699 - protein, 33 aa, Mycobacterium tuberculosis; identical to SEQ ID NO: 162455

SEQ ID NO: 1387700 - protein, 25 aa, Mycobacterium tuberculosis
GIVGTFLFVPKLRRWLATAVRPKLR

SEQ ID NO: 1387701 - protein, 24 aa, Mycobacterium tuberculosis
GLPTAAIPAPWPVLATLPSGPELS

SEQ ID NO: 1387702 - protein, 24 aa, Mycobacterium tuberculosis
GLVLAGAVLLFARPRLRVGSAGLS

SEQ ID NO: 1387703 - protein, 31 aa, Mycobacterium tuberculosis; identical to SEQ ID NO: 164719

SEQ ID NO: 1387704 - protein, 17 aa, Mycobacterium tuberculosis
GMMSSPTGELFFDNVRL

SEQ ID NO: 1387705 - protein, 23 aa, Mycobacterium tuberculosis
GNKRKVWAVVGAAAIVLVAIVAA

SEQ ID NO: 1387706 - protein, 35 aa, Mycobacterium tuberculosis; identical to SEQ ID NO: 20695

SEQ ID NO: 1387707 - protein, 29 aa, Mycobacterium tuberculosis
GPDPLRRLLREFRGPLALSLLLVAVQTCA

SEQ ID NO: 1387708 - protein, 23 aa, Mycobacterium tuberculosis
GPEVWWVLRVAHWASGVPAATVP

SEQ ID NO: 1387709 - protein, 25 aa, Mycobacterium tuberculosis
GPFLPLAIILYWFSNNIWTFGQQHY

SEQ ID NO: 1387710 - protein, 31 aa, Mycobacterium tuberculosis; identical to SEQ ID NO: 162511

SEQ ID NO: 1387711 - protein, 24 aa, Mycobacterium tuberculosis
GPNYFSIALIVITFIVVPAMAYLH

SEQ ID NO: 1387712 - protein, 26 aa, Mycobacterium tuberculosis
GQIELPPGYLPLRVPIEVNFTQRVAV

SEQ ID NO: 1387713 - protein, 25 aa, Mycobacterium tuberculosis
GQIFDGALLIVIFATSGALDDIATR

SEQ ID NO: 1387714 - protein, 34 aa, Mycobacterium tuberculosis; identical to SEQ ID NO: 162550

SEQ ID NO: 1387715 - protein, 24 aa, Mycobacterium tuberculosis
GSYALLVFFGLFLGVAGTIFAVGI

SEQ ID NO: 1387716 - protein, 26 aa, Mycobacterium tuberculosis
GTQNLGLLILRVGLGAVLIAHGLQKL

SEQ ID NO: 1387717 - protein, 25 aa, Mycobacterium tuberculosis
GVEWLPAKGFITDRLPRLCRKYLLT

SEQ ID NO: 1387718 - protein, 24 aa, Mycobacterium tuberculosis
GVLASFFVSTLLRVAFPDKAWADA

SEQ ID NO: 1387719 - protein, 21 aa, Mycobacterium tuberculosis
GVLMTIPWAVISGFLFNVLLT

SEQ ID NO: 1387720 - protein, 25 aa, Mycobacterium tuberculosis
GVPLEWNVFFIFSLCYLFGHYGAIT

SEQ ID NO: 1387721 - protein, 21 aa, Mycobacterium tuberculosis
GVRGPNLAWLLAAYGVAGLVS

SEQ ID NO: 1387722 - protein, 17 aa, Mycobacterium tuberculosis
GVRPAIHLPLEDPYQMP

SEQ ID NO: 1387723 - protein, 24 aa, Mycobacterium tuberculosis
GVVRGLKALLATVVLAVVGIGLGL

SEQ ID NO: 1387724 - protein, 18 aa, Mycobacterium tuberculosis
GWRHLKHFNGYATSFWVT

SEQ ID NO: 1387725 - protein, 22 aa, Mycobacterium tuberculosis
GWRSVFLVNVPLGAIVWLLTLV

SEQ ID NO: 1387726 - protein, 24 aa, Mycobacterium tuberculosis
GYLRKWFLLGITIGVIAGLGAVVF

SEQ ID NO: 1387727 - protein, 33 aa, Mycobacterium tuberculosis; identical to SEQ ID NO: 162604

SEQ ID NO: 1387728 - protein, 27 aa, Mycobacterium tuberculosis
HASDPIAWWTPRLLFREPDWLREQRGY

SEQ ID NO: 1387729 - protein, 27 aa, Mycobacterium tuberculosis
HFGEHCIGWLILALLGAIALPRRRREW

SEQ ID NO: 1387730 - protein, 18 aa, Mycobacterium tuberculosis
HHSFLSRLYTGTGAFEVV

SEQ ID NO: 1387731 - protein, 17 aa, Mycobacterium tuberculosis
HLLASALVLVILAGCAG

SEQ ID NO: 1387732 - protein, 17 aa, Mycobacterium tuberculosis
HPVSPGTRWPQPTPWAG

SEQ ID NO: 1387733 - protein, 26 aa, Mycobacterium tuberculosis
HRCTPREWMWAVLLAGAVAVIVMSGN

SEQ ID NO: 1387734 - protein, 18 aa, Mycobacterium tuberculosis
HRRDGIALVLLGLAVVVA

SEQ ID NO: 1387735 - protein, 22 aa, Mycobacterium tuberculosis
HVHPDTFWWALALSADFGGNLT

SEQ ID NO: 1387736 - protein, 32 aa, Mycobacterium tuberculosis; identical to SEQ ID NO: 162655

SEQ ID NO: 1387737 - protein, 23 aa, Mycobacterium tuberculosis
IALLFGAYFLRNYFVLIVVAAVG

SEQ ID NO: 1387738 - protein, 26 aa, Mycobacterium tuberculosis
IAVIAIMLFIAYRSLSAALIMLLTVG

SEQ ID NO: 1387739 - protein, 36 aa, Mycobacterium tuberculosis; identical to SEQ ID NO: 162666

SEQ ID NO: 1387740 - protein, 31 aa, Mycobacterium tuberculosis; identical to SEQ ID NO: 162667

SEQ ID NO: 1387741 - protein, 32 aa, Mycobacterium tuberculosis; identical to SEQ ID NO: 162670

SEQ ID NO: 1387742 - protein, 20 aa, Mycobacterium tuberculosis
IDDRWGLDALTKFAGQITAA

SEQ ID NO: 1387743 - protein, 29 aa, Mycobacterium tuberculosis
IETEHLPLLAPLRAIPVIGPPLAALVEPN

SEQ ID NO: 1387744 - protein, 21 aa, Mycobacterium tuberculosis
IFTVVPQWILALIALTVVLSM

SEQ ID NO: 1387745 - protein, 23 aa, Mycobacterium tuberculosis
IGGQVARLWKLTSALTIDDRTGL

SEQ ID NO: 1387746 - protein, 27 aa, Mycobacterium tuberculosis
IGLFGFWRGLYFTTIARRGLAILRRRR

SEQ ID NO: 1387747 - protein, 24 aa, Mycobacterium tuberculosis
IGTMLVWGLFRIFVLGNPVRAESA

SEQ ID NO: 1387748 - protein, 27 aa, Mycobacterium tuberculosis
IGTWVRMVINYLVPFLVASVGYLGARR

SEQ ID NO: 1387749 - protein, 20 aa, Mycobacterium tuberculosis
IGVPLWTDILLPIVMWALYA

SEQ ID NO: 1387750 - protein, 17 aa, Mycobacterium tuberculosis
IGYALITVGLLIAVNQL

SEQ ID NO: 1387751 - protein, 19 aa, Mycobacterium tuberculosis
IIALPFFGIVSEIFPVFSR

SEQ ID NO: 1387752 - protein, 18 aa, Mycobacterium tuberculosis
IIGLLLGGFITHLYDRSS

SEQ ID NO: 1387753 - protein, 17 aa, Mycobacterium tuberculosis
IIGVPPFAGFFSKDAII

SEQ ID NO: 1387754 - protein, 21 aa, Mycobacterium tuberculosis
IILGWLVTIAVLNVTVPQLET

SEQ ID NO: 1387755 - protein, 37 aa, Mycobacterium tuberculosis; identical to SEQ ID NO: 162713

SEQ ID NO: 1387756 - protein, 17 aa, Mycobacterium tuberculosis
ILPAPTRLFPPSLAVVF

SEQ ID NO: 1387757 - protein, 20 aa, Mycobacterium tuberculosis
ILTHFVWGLIMVFALPPLFA

SEQ ID NO: 1387758 - protein, 17 aa, Mycobacterium tuberculosis
ILVLLPAAGMAAAAHVP

SEQ ID NO: 1387759 - protein, 28 aa, Mycobacterium tuberculosis
INRREVVLVTGPWLAGVSGVRAALAERL

SEQ ID NO: 1387760 - protein, 26 aa, Mycobacterium tuberculosis
ISDGAVFCGLLWWIAFHMRDRPLVIA

SEQ ID NO: 1387761 - protein, 26 aa, Mycobacterium tuberculosis
ITVSTIFFALFAIAAGYAAWLHFAPR

SEQ ID NO: 1387762 - protein, 24 aa, Mycobacterium tuberculosis
IVAAKLVFLVIWIGAATSKLNRHF

SEQ ID NO: 1387763 - protein, 27 aa, Mycobacterium tuberculosis
IVAAMGCAFVALLRPQSALGQAPIVMG

SEQ ID NO: 1387764 - protein, 28 aa, Mycobacterium tuberculosis
IVAGVLLVLGLFTPLAAAGALAFLINGL

SEQ ID NO: 1387765 - protein, 26 aa, Mycobacterium tuberculosis
IVGVMLSMFLLAFAGIPLTSGFVSKF

SEQ ID NO: 1387766 - protein, 21 aa, Mycobacterium tuberculosis
IVSMQYSFLPSWLSFLVDKEN

SEQ ID NO: 1387767 - protein, 29 aa, Mycobacterium tuberculosis
IWPPWEFYFWHHTIPAPVWVAVIMGLVFV

SEQ ID NO: 1387768 - protein, 26 aa, Mycobacterium tuberculosis
KAIRTVRFWMAPIATTLALMSALAAL

SEQ ID NO: 1387769 - protein, 26 aa, Mycobacterium tuberculosis
KATMLAHWAWLSMLLVGGAGAAGYWV

SEQ ID NO: 1387770 - protein, 19 aa, Mycobacterium tuberculosis
KDPVFRERMKREARIAGRL

SEQ ID NO: 1387771 - protein, 30 aa, Mycobacterium tuberculosis; identical to SEQ ID NO: 162797

SEQ ID NO: 1387772 - protein, 24 aa, Mycobacterium tuberculosis
KIEAFAMFNVFYQSGILLGPLVGL

SEQ ID NO: 1387773 - protein, 26 aa, Mycobacterium tuberculosis
KIGRKPLLLWFGVGGLIYTYVLVTYL

SEQ ID NO: 1387774 - protein, 18 aa, Mycobacterium tuberculosis
KQLAVRYHLLNFLDDQSH

SEQ ID NO: 1387775 - protein, 19 aa, Mycobacterium tuberculosis
KTMGVIFLALMSYGAVSTT

SEQ ID NO: 1387776 - protein, 29 aa, Mycobacterium tuberculosis
KVDYADILFITPWLLLLGVAMSGLTAYLT

SEQ ID NO: 1387777 - protein, 21 aa, Mycobacterium tuberculosis
KVGAAIVRWPGPILVGAVALA

SEQ ID NO: 1387778 - protein, 20 aa, Mycobacterium tuberculosis
LAFAIPTYAFIAGIGTMLVW

SEQ ID NO: 1387779 - protein, 28 aa, Mycobacterium tuberculosis
LAIRARLVLLIFTTMPVLALATWQFRRA

SEQ ID NO: 1387780 - protein, 24 aa, Mycobacterium tuberculosis
LALPLASLVFFGAFIPLIGAVVAG

SEQ ID NO: 1387781 - protein, 22 aa, Mycobacterium tuberculosis
LAPQHWIALTPPRIPRVRTLQN

SEQ ID NO: 1387782 - protein, 25 aa, Mycobacterium tuberculosis
LASVVEIWMLLGSPAVICSMLSPKA

SEQ ID NO: 1387783 - protein, 23 aa, Mycobacterium tuberculosis
LAVFRAVFAFAVNDTPDGGLTQL

SEQ ID NO: 1387784 - protein, 26 aa, Mycobacterium tuberculosis
LAVGVIVWGLIFWSAVFHRKKNTDTE

SEQ ID NO: 1387785 - protein, 24 aa, Mycobacterium tuberculosis
LAVILSYIWGVRVGGLFAALGVTS

SEQ ID NO: 1387786 - protein, 25 aa, Mycobacterium tuberculosis
LAYVVIFSLPLAREKFLLDASNLAT

SEQ ID NO: 1387787 - protein, 22 aa, Mycobacterium tuberculosis
LCGVTWVYHYAVAVYRYDRGCG

SEQ ID NO: 1387788 - protein, 26 aa, Mycobacterium tuberculosis
LCPQNLDYLISFFGALYSGRIAVPLF

SEQ ID NO: 1387789 - protein, 19 aa, Mycobacterium tuberculosis
LCSESTMYRLLRERGQTGD

SEQ ID NO: 1387790 - protein, 19 aa, Mycobacterium tuberculosis
LDYVVSFIASLQAGIVAVP

SEQ ID NO: 1387791 - protein, 22 aa, Mycobacterium tuberculosis
LEPVSHMWVVKFLRTHGLIHDC

SEQ ID NO: 1387792 - protein, 19 aa, Mycobacterium tuberculosis
LFILMRYREELRCGRRPPD

SEQ ID NO: 1387793 - protein, 34 aa, Mycobacterium tuberculosis; identical to SEQ ID NO: 162923

SEQ ID NO: 1387794 - protein, 18 aa, Mycobacterium tuberculosis
LGAMLWRSLEPNAAPRTQ

SEQ ID NO: 1387795 - protein, 31 aa, Mycobacterium tuberculosis; identical to SEQ ID NO: 162933

SEQ ID NO: 1387796 - protein, 29 aa, Mycobacterium tuberculosis
LGNLRSLPVPFILNQPPPPPGPVPAPGPA

SEQ ID NO: 1387797 - protein, 17 aa, Mycobacterium tuberculosis
LGTVPTGLLAYRYRLRV

SEQ ID NO: 1387798 - protein, 18 aa, Mycobacterium tuberculosis
LGVGTLKDLALVQLIGII

SEQ ID NO: 1387799 - protein, 25 aa, Mycobacterium tuberculosis
LIAAYGYWLISHWPVDLLADRHNIL

SEQ ID NO: 1387800 - protein, 17 aa, Mycobacterium tuberculosis
LILVVAAFPSLFTAADP

SEQ ID NO: 1387801 - protein, 26 aa, Mycobacterium tuberculosis
LIQDPLTGFIYAFDDMLARHNASWAD

SEQ ID NO: 1387802 - protein, 20 aa, Mycobacterium tuberculosis
LIRFTGPEVWWVLRVAHWAS

SEQ ID NO: 1387803 - protein, 18 aa, Mycobacterium tuberculosis
LKIMTWVTAFFAPLTVAY

SEQ ID NO: 1387804 - protein, 28 aa, Mycobacterium tuberculosis
LLAGWAVALPWSLLVMPLIDSGSPSLFA

SEQ ID NO: 1387805 - protein, 17 aa, Mycobacterium tuberculosis
LLFLAGLVAQLNGAPEA

SEQ ID NO: 1387806 - protein, 18 aa, Mycobacterium tuberculosis
LLILCRLVQGFATGGEYG

SEQ ID NO: 1387807 - protein, 26 aa, Mycobacterium tuberculosis
LLLNMWALYVVGPPLEMWLGRLRFGA

SEQ ID NO: 1387808 - protein, 19 aa, Mycobacterium tuberculosis
LLVGWWSLVSLLAMNWIAL

SEQ ID NO: 1387809 - protein, 30 aa, Mycobacterium tuberculosis; identical to SEQ ID NO: 162999

SEQ ID NO: 1387810 - protein, 27 aa, Mycobacterium tuberculosis
LNRIGTPLFFQRVFGAGIATLVAVAAY

SEQ ID NO: 1387811 - protein, 25 aa, Mycobacterium tuberculosis
LQDAMHPMMLPLLERMVVKQPRTAN

SEQ ID NO: 1387812 - protein, 18 aa, Mycobacterium tuberculosis
LQRKLRVGFAKAGRLMDL

SEQ ID NO: 1387813 - protein, 26 aa, Mycobacterium tuberculosis
LQRMSPFWQRMFLTIGILIAVFGMRL

SEQ ID NO: 1387814 - protein, 37 aa, Mycobacterium tuberculosis; identical to SEQ ID NO: 163030

SEQ ID NO: 1387815 - protein, 24 aa, Mycobacterium tuberculosis
LSMTLPILIPFVYFSHALNKVWRR

SEQ ID NO: 1387816 - protein, 26 aa, Mycobacterium tuberculosis
LSTRDTWLLSLLYLGTFGSFIGFSFV

SEQ ID NO: 1387817 - protein, 18 aa, Mycobacterium tuberculosis
LSTTAYLIAKVCVYTVLA

SEQ ID NO: 1387818 - protein, 17 aa, Mycobacterium tuberculosis
LTGRRGWIAPRRDLTRR

SEQ ID NO: 1387819 - protein, 38 aa, Mycobacterium tuberculosis; identical to SEQ ID NO: 163065

SEQ ID NO: 1387820 - protein, 19 aa, Mycobacterium tuberculosis
LTVEVLFLGLAVALRLAGS

SEQ ID NO: 1387821 - protein, 26 aa, Mycobacterium tuberculosis
LVDSHAWLVVLTALGSLAALATLISI

SEQ ID NO: 1387822 - protein, 23 aa, Mycobacterium tuberculosis
LVGQWLAALLFAGALLAERVSLR

SEQ ID NO: 1387823 - protein, 22 aa, Mycobacterium tuberculosis
LVSAWYLLPKPDDGHPLVVVTA

SEQ ID NO: 1387824 - protein, 18 aa, Mycobacterium tuberculosis
LVSTRILGGLVVIMPLYA

SEQ ID NO: 1387825 - protein, 39 aa, Mycobacterium tuberculosis; identical to SEQ ID NO: 163112

SEQ ID NO: 1387826 - protein, 18 aa, Mycobacterium tuberculosis
LYVDMRLINGVDLAAMLR

SEQ ID NO: 1387827 - protein, 26 aa, Mycobacterium tuberculosis
MAAALLVLSAILVGGLWPLLMEQFSV

SEQ ID NO: 1387828 - protein, 21 aa, Mycobacterium tuberculosis
MGIKSISFLVSTRILGGLVVI

SEQ ID NO: 1387829 - protein, 33 aa, Mycobacterium tuberculosis; identical to SEQ ID NO: 163147

SEQ ID NO: 1387830 - protein, 26 aa, Mycobacterium tuberculosis
MLVGTPAMWWLAVPVLAYAGWRMFVR

SEQ ID NO: 1387831 - protein, 18 aa, Mycobacterium tuberculosis
MLVPLATGCLRVRASITI

SEQ ID NO: 1387832 - protein, 26 aa, Mycobacterium tuberculosis
MQQVYDRYIAPHYLGYAFSGLYTPAQ

SEQ ID NO: 1387833 - protein, 24 aa, Mycobacterium tuberculosis
MSVRFMRRIAFSGFAITIVMLVLV

SEQ ID NO: 1387834 - protein, 26 aa, Mycobacterium tuberculosis
MVFASGLLAMFPIAALGALVVYAALR

SEQ ID NO: 1387835 - protein, 25 aa, Mycobacterium tuberculosis
MVVVLMSFAVYAVISAALYSDIDNQ

SEQ ID NO: 1387836 - protein, 21 aa, Mycobacterium tuberculosis
NAIFGLFGAFALIGAAIVLFL

SEQ ID NO: 1387837 - protein, 30 aa, Mycobacterium tuberculosis; identical to SEQ ID NO: 163199

SEQ ID NO: 1387838 - protein, 32 aa, Mycobacterium tuberculosis
NGKRVVWIPWALRPMFVALRLLPRFVWRRMPR

SEQ ID NO: 1387839 - protein, 24 aa, Mycobacterium tuberculosis
NGYEFRLLQIKFATLNITGDCFLL

SEQ ID NO: 1387840 - protein, 24 aa, Mycobacterium tuberculosis
NPFSLLFTLGGFVTLLLLAQAVAS

SEQ ID NO: 1387841 - protein, 30 aa, Mycobacterium tuberculosis; identical to SEQ ID NO: 163213

SEQ ID NO: 1387842 - protein, 25 aa, Mycobacterium tuberculosis
NTADAQVVPLLWAASSGVPAVLGYR

SEQ ID NO: 1387843 - protein, 19 aa, Mycobacterium tuberculosis
NVTTLGLPFYGATPDNPYP

SEQ ID NO: 1387844 - protein, 17 aa, Mycobacterium tuberculosis
PAALSLSLYVSSDYGGG

SEQ ID NO: 1387845 - protein, 25 aa, Mycobacterium tuberculosis
PAEFSKILLLIFFSAVLVAKRGLFT

SEQ ID NO: 1387846 - protein, 25 aa, Mycobacterium tuberculosis
PAFYSVMTVLFLALFVLNVCTHGST

SEQ ID NO: 1387847 - protein, 21 aa, Mycobacterium tuberculosis
PALDAVYLPPGRSAYVAARSL

SEQ ID NO: 1387848 - protein, 26 aa, Mycobacterium tuberculosis
PDVAFPRLNAFSFWLFVFGATIGAAG

SEQ ID NO: 1387849 - protein, 30 aa, Mycobacterium tuberculosis; identical to SEQ ID NO: 164475

SEQ ID NO: 1387850 - protein, 23 aa, Mycobacterium tuberculosis
PESLANLLRYGYYPALILGLTVG

SEQ ID NO: 1387851 - protein, 18 aa, Mycobacterium tuberculosis
PFGLFPDVPASVVADALV

SEQ ID NO: 1387852 - protein, 33 aa, Mycobacterium tuberculosis
PGILIIVFIETGLLFPLLPGESLLFTGGLLSAS

SEQ ID NO: 1387853 - protein, 19 aa, Mycobacterium tuberculosis
PGYVLLALALGSYALTRQT

SEQ ID NO: 1387854 - protein, 17 aa, Mycobacterium tuberculosis
PILLITLINGIAEEMFF

SEQ ID NO: 1387855 - protein, 30 aa, Mycobacterium tuberculosis; identical to SEQ ID NO: 163321

SEQ ID NO: 1387856 - protein, 23 aa, Mycobacterium tuberculosis
PLPTEIYWRRRGLALGIAVVVVG

SEQ ID NO: 1387857 - protein, 18 aa, Mycobacterium tuberculosis
PMLAPGQEWRMVWDSALD

SEQ ID NO: 1387858 - protein, 35 aa, Mycobacterium tuberculosis; identical to SEQ ID NO: 163333

SEQ ID NO: 1387859 - protein, 28 aa, Mycobacterium tuberculosis
PPSRGTVYQMWLLGGAKGPRSAGTMGTA

SEQ ID NO: 1387860 - protein, 24 aa, Mycobacterium tuberculosis
PRRIIGFAVFVFIAAAVFGVPVAD

SEQ ID NO: 1387861 - protein, 36 aa, Mycobacterium tuberculosis; identical to SEQ ID NO: 163355

SEQ ID NO: 1387862 - protein, 24 aa, Mycobacterium tuberculosis
PTAIPLRHDGLSYRFPFHTEKKTY

SEQ ID NO: 1387863 - protein, 25 aa, Mycobacterium tuberculosis
PTFMQWGWRIPFLVSAALIAVALYV

SEQ ID NO: 1387864 - protein, 22 aa, Mycobacterium tuberculosis
PTMLSVPRWAVGPVMELGTDHR

SEQ ID NO: 1387865 - protein, 25 aa, Mycobacterium tuberculosis
PTPSAPPLRLLEDLPRRVRVSDAHQ

SEQ ID NO: 1387866 - protein, 22 aa, Mycobacterium tuberculosis
PWESKPWTWPMSLRPVLYAIDQ

SEQ ID NO: 1387867 - protein, 26 aa, Mycobacterium tuberculosis
QAMTATWINLVGLILLMMLQPIGGMI

SEQ ID NO: 1387868 - protein, 23 aa, Mycobacterium tuberculosis
QEAGFTLSAPLRSLTRPSLAVNQ

SEQ ID NO: 1387869 - protein, 21 aa, Mycobacterium tuberculosis
QERWVPTLVTLEKIAAWAITE

SEQ ID NO: 1387870 - protein, 21 aa, Mycobacterium tuberculosis
QIPFWTFLRNSLIITSVLAVV

SEQ ID NO: 1387871 - protein, 30 aa, Mycobacterium tuberculosis; identical to SEQ ID NO: 163419

SEQ ID NO: 1387872 - protein, 31 aa, Mycobacterium tuberculosis; identical to SEQ ID NO: 163421

SEQ ID NO: 1387873 - protein, 18 aa, Mycobacterium tuberculosis
QLPKRLSCQLRPGPTPPA

SEQ ID NO: 1387874 - protein, 23 aa, Mycobacterium tuberculosis
QMSWVTPARWGFAASAATVDLIK

SEQ ID NO: 1387875 - protein, 24 aa, Mycobacterium tuberculosis
QRRAQLDGWRYGWVLNIGAAITGG

SEQ ID NO: 1387876 - protein, 24 aa, Mycobacterium tuberculosis
QVMHHRTVWTVIAILALFGWPQVA

SEQ ID NO: 1387877 - protein, 25 aa, Mycobacterium tuberculosis
RAAVKFLLYNLFGGLIMLAAVIGLY

SEQ ID NO: 1387878 - protein, 30 aa, Mycobacterium tuberculosis; identical to SEQ ID NO: 163473

SEQ ID NO: 1387879 - protein, 31 aa, Mycobacterium tuberculosis; identical to SEQ ID NO: 163475

SEQ ID NO: 1387880 - protein, 18 aa, Mycobacterium tuberculosis
RAVAIVRQIAAALDAAHA

SEQ ID NO: 1387881 - protein, 34 aa, Mycobacterium tuberculosis; identical to SEQ ID NO: 163481

SEQ ID NO: 1387882 - protein, 34 aa, Mycobacterium tuberculosis; identical to SEQ ID NO: 163488

SEQ ID NO: 1387883 - protein, 24 aa, Mycobacterium tuberculosis
RFGDTMGYRLVIYPEYASLDRVDP

SEQ ID NO: 1387884 - protein, 19 aa, Mycobacterium tuberculosis
RFRRSELMLALATTAAVLG

SEQ ID NO: 1387885 - protein, 19 aa, Mycobacterium tuberculosis
RGADLPPLPTLFVVVDEFA

SEQ ID NO: 1387886 - protein, 18 aa, Mycobacterium tuberculosis
RGERFARLPAGRAILLTD

SEQ ID NO: 1387887 - protein, 19 aa, Mycobacterium tuberculosis
RGLLRLLEDLRRARGLTVV

SEQ ID NO: 1387888 - protein, 22 aa, Mycobacterium tuberculosis
RHEGRYFVAGQPTDLVREGDAE

SEQ ID NO: 1387889 - protein, 23 aa, Mycobacterium tuberculosis
RIALLLLACLPLNAIMTIAAKSV

SEQ ID NO: 1387890 - protein, 18 aa, Mycobacterium tuberculosis
RKRRIGPVWLTAAGYAVA

SEQ ID NO: 1387891 - protein, 21 aa, Mycobacterium tuberculosis
RMAVLLAGLSPRLPPALNPDD

SEQ ID NO: 1387892 - protein, 19 aa, Mycobacterium tuberculosis
RMLRIYRDYAHDGDISYGE

SEQ ID NO: 1387893 - protein, 18 aa, Mycobacterium tuberculosis
RMVLKSAAKLKRLAPDAI

SEQ ID NO: 1387894 - protein, 25 aa, Mycobacterium tuberculosis
RRCGGRTVTLFRSEWRRPVELSTSV

SEQ ID NO: 1387895 - protein, 29 aa, Mycobacterium tuberculosis
RRCRWLVFTGWLLALVPAVYLAMTQSGNL

SEQ ID NO: 1387896 - protein, 26 aa, Mycobacterium tuberculosis
RRGLRRPWLYFVSSLFTSFAFAFAFY

SEQ ID NO: 1387897 - protein, 20 aa, Mycobacterium tuberculosis
RRLSPRVVAAPFDPAVGAAL

SEQ ID NO: 1387898 - protein, 19 aa, Mycobacterium tuberculosis
RSPLALRVDGLRSRWLGMP

SEQ ID NO: 1387899 - protein, 25 aa, Mycobacterium tuberculosis
RSRGPLWLIVVGFSAGVAVLVALRR

SEQ ID NO: 1387900 - protein, 25 aa, Mycobacterium tuberculosis
RSRWLGMPAGLRLTVPVAAVLTMVG

SEQ ID NO: 1387901 - protein, 28 aa, Mycobacterium tuberculosis
RSVVAGQVLFSLLLTPAIRLTNGAANWI

SEQ ID NO: 1387902 - protein, 20 aa, Mycobacterium tuberculosis
RSWHAPRLGSISAGLVAVGM

SEQ ID NO: 1387903 - protein, 23 aa, Mycobacterium tuberculosis
RTDLRLRWSWRGLRLGLMFGFGG

SEQ ID NO: 1387904 - protein, 18 aa, Mycobacterium tuberculosis
RTELLRRGIVFAMARVKQ

SEQ ID NO: 1387905 - protein, 24 aa, Mycobacterium tuberculosis
RTLVHRTCVTPLPFAQADLDALQR

SEQ ID NO: 1387906 - protein, 17 aa, Mycobacterium tuberculosis
RVDDVWHPVLNLASARL

SEQ ID NO: 1387907 - protein, 30 aa, Mycobacterium tuberculosis; identical to SEQ ID NO: 163633

SEQ ID NO: 1387908 - protein, 17 aa, Mycobacterium tuberculosis
RVILLDAAPAVLPPMGA

SEQ ID NO: 1387909 - protein, 19 aa, Mycobacterium tuberculosis
SAILSAVIFNALVIVALIP

SEQ ID NO: 1387910 - protein, 27 aa, Mycobacterium tuberculosis
SALLSGMLLNYFLTEPRYTWTIAEPDA

SEQ ID NO: 1387911 - protein, 23 aa, Mycobacterium tuberculosis
SAMATLRIAFLSALVLELLATLG

SEQ ID NO: 1387912 - protein, 27 aa, Mycobacterium tuberculosis
SAVIFNALVIVALIPLALRGVRFRAES

SEQ ID NO: 1387913 - protein, 25 aa, Mycobacterium tuberculosis
SDFPFVPWPPALSVGMWLLAVASVI

SEQ ID NO: 1387914 - protein, 38 aa, Mycobacterium tuberculosis; identical to SEQ ID NO: 163670

SEQ ID NO: 1387915 - protein, 20 aa, Mycobacterium tuberculosis
SFTLVYDALVSRAGSESVLP

SEQ ID NO: 1387916 - protein, 18 aa, Mycobacterium tuberculosis
SGLIWLAVLLPMPVSLRP

SEQ ID NO: 1387917 - protein, 23 aa, Mycobacterium tuberculosis
SGLYTPAQFQPWTGIPSLTYDQS

SEQ ID NO: 1387918 - protein, 23 aa, Mycobacterium tuberculosis
SGPLKWIYLTMSVQMIAAMVDTY

SEQ ID NO: 1387919 - protein, 26 aa, Mycobacterium tuberculosis
SGVGAFLRLPYTFAIPIFGGRNWTTV

SEQ ID NO: 1387920 - protein, 23 aa, Mycobacterium tuberculosis
SHGWRAMFGLAAAPATLLLPLLW

SEQ ID NO: 1387921 - protein, 19 aa, Mycobacterium tuberculosis
SIALGIVVAVLILAGAALL

SEQ ID NO: 1387922 - protein, 41 aa, Mycobacterium tuberculosis; identical to SEQ ID NO: 163720

SEQ ID NO: 1387923 - protein, 21 aa, Mycobacterium tuberculosis
SLLGMSLHQPYLMGCLSPRNE

SEQ ID NO: 1387924 - protein, 25 aa, Mycobacterium tuberculosis
SMGLLVSMLIFVILGLPSAGATVPL

SEQ ID NO: 1387925 - protein, 27 aa, Mycobacterium tuberculosis
SPASMRKFFEAFAPYGLKQTAVKPSYG

SEQ ID NO: 1387926 - protein, 25 aa, Mycobacterium tuberculosis
SPITLRHKIFFVAVAVIGALAWTVV

SEQ ID NO: 1387927 - protein, 32 aa, Mycobacterium tuberculosis; identical to SEQ ID NO: 163746

SEQ ID NO: 1387928 - protein, 17 aa, Mycobacterium tuberculosis
SQRGLLRLLEDLRRARG

SEQ ID NO: 1387929 - protein, 20 aa, Mycobacterium tuberculosis
SRAGLFFVPLAVAAAVCAFL

SEQ ID NO: 1387930 - protein, 18 aa, Mycobacterium tuberculosis
SRESLFWVSGNGVRFGIA

SEQ ID NO: 1387931 - protein, 25 aa, Mycobacterium tuberculosis
SRFRTLLVKWAVMVVLALLTSGVYL

SEQ ID NO: 1387932 - protein, 21 aa, Mycobacterium tuberculosis
SRWVAMNDLTLASAGALTARM

SEQ ID NO: 1387933 - protein, 22 aa, Mycobacterium tuberculosis
SSWFDAARPLGAWVDALLRTFI

SEQ ID NO: 1387934 - protein, 29 aa, Mycobacterium tuberculosis
STDGIYPLLIMILLPVLVGLDVSTRRAAV

SEQ ID NO: 1387935 - protein, 18 aa, Mycobacterium tuberculosis
STEFYALAARALAPGGLM

SEQ ID NO: 1387936 - protein, 33 aa, Mycobacterium tuberculosis; identical to SEQ ID NO: 163780

SEQ ID NO: 1387937 - protein, 28 aa, Mycobacterium tuberculosis
SVGALVTYLLYIELLYTPIGELAQMFDD

SEQ ID NO: 1387938 - protein, 30 aa, Mycobacterium tuberculosis; identical to SEQ ID NO: 163793

SEQ ID NO: 1387939 - protein, 26 aa, Mycobacterium tuberculosis
SVRANLHFLWLRLARVWPVYLVTLHL

SEQ ID NO: 1387940 - protein, 19 aa, Mycobacterium tuberculosis
SWVLLRRRHGDLALPIPVM

SEQ ID NO: 1387941 - protein, 34 aa, Mycobacterium tuberculosis; identical to SEQ ID NO: 163807

SEQ ID NO: 1387942 - protein, 17 aa, Mycobacterium tuberculosis
TATAIWLRSRRAPIDHT

SEQ ID NO: 1387943 - protein, 17 aa, Mycobacterium tuberculosis
TAVIAALVVIAALTLGL

SEQ ID NO: 1387944 - protein, 17 aa, Mycobacterium tuberculosis
TEQIPFWTFLRNSLIIT

SEQ ID NO: 1387945 - protein, 23 aa, Mycobacterium tuberculosis
TEQPTFYIDFPTSVSPLTRPHRS

SEQ ID NO: 1387946 - protein, 21 aa, Mycobacterium tuberculosis
TLRYFPDLVVVLALLAAVALQ

SEQ ID NO: 1387947 - protein, 27 aa, Mycobacterium tuberculosis
TLVLIAAFLAVWWIYETYRPQAPGPGD

SEQ ID NO: 1387948 - protein, 25 aa, Mycobacterium tuberculosis
TLWGRNIGQFQLIQLKLAKMEVARI

SEQ ID NO: 1387949 - protein, 23 aa, Mycobacterium tuberculosis
TMGLWPPRLWAGLRLGWAAGAAA

SEQ ID NO: 1387950 - protein, 24 aa, Mycobacterium tuberculosis
TNQADLRLVLLRPGKEDDEPIQRI

SEQ ID NO: 1387951 - protein, 21 aa, Mycobacterium tuberculosis
TPEAPFGWYYDLLALWAHVST

SEQ ID NO: 1387952 - protein, 30 aa, Mycobacterium tuberculosis; identical to SEQ ID NO: 163892

SEQ ID NO: 1387953 - protein, 24 aa, Mycobacterium tuberculosis
TQYVAAHGPYLAWLEQTAINSAVT

SEQ ID NO: 1387954 - protein, 25 aa, Mycobacterium tuberculosis
TRDRLPLPNRLLATAPLVALGAMAY

SEQ ID NO: 1387955 - protein, 24 aa, Mycobacterium tuberculosis
TRGGLGGWIPTSFGGSSNAPGSSP

SEQ ID NO: 1387956 - protein, 26 aa, Mycobacterium tuberculosis
TRPVRAVSWLVAAFSALGLLNLSRAG

SEQ ID NO: 1387957 - protein, 22 aa, Mycobacterium tuberculosis
TRSRLPGLLPPLDDVKNFVGIQ

SEQ ID NO: 1387958 - protein, 20 aa, Mycobacterium tuberculosis
TRYYAAQRTFWVDPVSGTIV

SEQ ID NO: 1387959 - protein, 37 aa, Mycobacterium tuberculosis; identical to SEQ ID NO: 163929

SEQ ID NO: 1387960 - protein, 17 aa, Mycobacterium tuberculosis
TTDPANLAPLLSGLQVS

SEQ ID NO: 1387961 - protein, 26 aa, Mycobacterium tuberculosis
TVFSALYLPLLAILFGMILRAVAIEW

SEQ ID NO: 1387962 - protein, 26 aa, Mycobacterium tuberculosis
TVGTFVAFWACLTLLARPACDLAGML

SEQ ID NO: 1387963 - protein, 44 aa, Mycobacterium tuberculosis; identical to SEQ ID NO: 163948

SEQ ID NO: 1387964 - protein, 19 aa, Mycobacterium tuberculosis
TVLLVPLMAALFGEAPQRA

SEQ ID NO: 1387965 - protein, 33 aa, Mycobacterium tuberculosis; identical to SEQ ID NO: 163958

SEQ ID NO: 1387966 - protein, 18 aa, Mycobacterium tuberculosis
VAALLLAAGVLLWLFVRH

SEQ ID NO: 1387967 - protein, 30 aa, Mycobacterium tuberculosis; identical to SEQ ID NO: 163971

SEQ ID NO: 1387968 - protein, 27 aa, Mycobacterium tuberculosis
VAGCAYLLRRLFRGPRAPYLRTMFVVL

SEQ ID NO: 1387969 - protein, 22 aa, Mycobacterium tuberculosis
VARLNAHFGPLLQTLPALGQMA

SEQ ID NO: 1387970 - protein, 23 aa, Mycobacterium tuberculosis
VAVWTTLWMLVGLAVHDAISIIG

SEQ ID NO: 1387971 - protein, 30 aa, Mycobacterium tuberculosis
VCMFKPPFAWREYLLQCWFVARVSTLPGVL

SEQ ID NO: 1387972 - protein, 22 aa, Mycobacterium tuberculosis
VDLAAMLRRQGPLAPPRAVAIV

SEQ ID NO: 1387973 - protein, 25 aa, Mycobacterium tuberculosis
VDSMGWEWIFFVNVPVGVIGLILAA

SEQ ID NO: 1387974 - protein, 24 aa, Mycobacterium tuberculosis
VGAEVPLLMTLLQRGRVAGAADAG

SEQ ID NO: 1387975 - protein, 24 aa, Mycobacterium tuberculosis
VGASRWYTQLPFLVEAMLAATMGV

SEQ ID NO: 1387976 - protein, 24 aa, Mycobacterium tuberculosis
VGAYLFTPLFKWFTKRFNTGLSAA

SEQ ID NO: 1387977 - protein, 18 aa, Mycobacterium tuberculosis
VGGLTFFPALALGPIVEQ

SEQ ID NO: 1387978 - protein, 17 aa, Mycobacterium tuberculosis
VGTVLLVPLMAALFGEA

SEQ ID NO: 1387979 - protein, 28 aa, Mycobacterium tuberculosis
VLAAIGVPWWFMVVQLPFAGIVFAVDGV

SEQ ID NO: 1387980 - protein, 17 aa, Mycobacterium tuberculosis
VLLPMLHSRFTRHIAIT

SEQ ID NO: 1387981 - protein, 20 aa, Mycobacterium tuberculosis
VLQLWGLLALVLDSLAIAAQ

SEQ ID NO: 1387982 - protein, 24 aa, Mycobacterium tuberculosis
VPAALVSWIVTAAGIVWPIGNVCA

SEQ ID NO: 1387983 - protein, 22 aa, Mycobacterium tuberculosis
VPLEWNVFMIFGVLSLFVGHAC

SEQ ID NO: 1387984 - protein, 25 aa, Mycobacterium tuberculosis
VPLWATMLIWLTLWVLYLSIVNVGQ

SEQ ID NO: 1387985 - protein, 18 aa, Mycobacterium tuberculosis
VQVIVHLVLLILFSALAG

SEQ ID NO: 1387986 - protein, 26 aa, Mycobacterium tuberculosis
VRQRFFALFLYVVMLVFLVATAPVMV

SEQ ID NO: 1387987 - protein, 24 aa, Mycobacterium tuberculosis
VSPGTRWPQPTPWAGGAPPWGPPS

SEQ ID NO: 1387988 - protein, 18 aa, Mycobacterium tuberculosis
VSTASIWMRLPTLAMALT

SEQ ID NO: 1387989 - protein, 28 aa, Mycobacterium tuberculosis
VSVPAGPRPWQGPIAVLVAVTAGAALAA

SEQ ID NO: 1387990 - protein, 23 aa, Mycobacterium tuberculosis
VTAAYVLITFWQYRNACVTAPGL

SEQ ID NO: 1387991 - protein, 19 aa, Mycobacterium tuberculosis
VTLAGRRLWHRFRGQPDRA

SEQ ID NO: 1387992 - protein, 25 aa, Mycobacterium tuberculosis
VTSILILIAFPLLTAALFGLAADRH

SEQ ID NO: 1387993 - protein, 17 aa, Mycobacterium tuberculosis
VTVFLGATPIGDATSRA

SEQ ID NO: 1387994 - protein, 24 aa, Mycobacterium tuberculosis
VVAVTPLLTPWLSKQLALGPRPDI

SEQ ID NO: 1387995 - protein, 22 aa, Mycobacterium tuberculosis
VVLPAACICLVLFAAIVVWPQV

SEQ ID NO: 1387996 - protein, 18 aa, Mycobacterium tuberculosis
VVLQLLESLALLRALYVI

SEQ ID NO: 1387997 - protein, 18 aa, Mycobacterium tuberculosis
VVMVLGWLVLIAVLALSL

SEQ ID NO: 1387998 - protein, 28 aa, Mycobacterium tuberculosis
VVPATRFTGWQWVLSALALPVVTWAAWP

SEQ ID NO: 1387999 - protein, 25 aa, Mycobacterium tuberculosis
VVVSNIAAFLLWPRGFPGTIAQSIH

SEQ ID NO: 1388000 - protein, 27 aa, Mycobacterium tuberculosis
VYRTMMMHLLRLARSFGVLPVGGWALR

SEQ ID NO: 1388001 - protein, 29 aa, Mycobacterium tuberculosis
WAGFSVGWLYWYFWVIVVGFEAVAGGKVL

SEQ ID NO: 1388002 - protein, 25 aa, Mycobacterium tuberculosis
WAPYHLRLDWLMWFAAISPGYALPW

SEQ ID NO: 1388003 - protein, 24 aa, Mycobacterium tuberculosis
WASPFWQTWDLLLLWLAQLHGGNG

SEQ ID NO: 1388004 - protein, 36 aa, Mycobacterium tuberculosis; identical to SEQ ID NO: 164216

SEQ ID NO: 1388005 - protein, 19 aa, Mycobacterium tuberculosis
WERHCFDIPICWSMRSLLN

SEQ ID NO: 1388006 - protein, 28 aa, Mycobacterium tuberculosis
WPQAVDAWLRLCQTYGWAPGVMGASSQG

SEQ ID NO: 1388007 - protein, 21 aa, Mycobacterium tuberculosis
WSLLVGYGCLPWVATAMLTMR

SEQ ID NO: 1388008 - protein, 19 aa, Mycobacterium tuberculosis
WVDALLRTFIGSAVVMLPL

SEQ ID NO: 1388009 - protein, 17 aa, Mycobacterium tuberculosis
WYAFLLLPSFVIYLISM

SEQ ID NO: 1388010 - protein, 22 aa, Mycobacterium tuberculosis
YGKVLFAITLSAAAVLVTLAGR

SEQ ID NO: 1388011 - protein, 28 aa, Mycobacterium tuberculosis
YIAGFHHGFFIFAIVLTALSIIPLGGGI

SEQ ID NO: 1388012 - protein, 26 aa, Mycobacterium tuberculosis
YIGQRPWTPLIGLLAQAGDLGLRVIV

SEQ ID NO: 1388013 - protein, 17 aa, Mycobacterium tuberculosis
YLLYLTKIAVYVAAGAA

SEQ ID NO: 1388014 - protein, 27 aa, Mycobacterium tuberculosis
YPVKASVSFGLYYPPGSALYHDTLAEL

SEQ ID NO: 1388015 - protein, 32 aa, Mycobacterium tuberculosis; identical to SEQ ID NO: 164295

SEQ ID NO: 1388016 - protein, 17 aa, Mycobacterium tuberculosis
YRYARAMARWSPTSRSE

SEQ ID NO: 1388017 - protein, 21 aa, Mycobacterium tuberculosis
YTLPSLDLLISGDPPKKRSAA

SEQ ID NO: 1388018 - protein, 26 aa, Mycobacterium tuberculosis
YTPEGKLVAPLKYPSLYAGDEDGKVT

SEQ ID NO: 1388019 - protein, 33 aa, Mycobacterium tuberculosis
AACKAWLLAQPYLVAGVLLVFYTATGRYVAAFG

SEQ ID NO: 1388020 - protein, 27 aa, Mycobacterium tuberculosis
AALIFSRYLWAFELTSALLITAAVGAM

SEQ ID NO: 1388021 - protein, 23 aa, Mycobacterium tuberculosis
AAPTWLKTVPKRLSALLNTSGLP

SEQ ID NO: 1388022 - protein, 18 aa, Mycobacterium tuberculosis
AAVAMPLFAGLYSISVLQ

SEQ ID NO: 1388023 - protein, 31 aa, Mycobacterium tuberculosis; identical to SEQ ID NO: 164311

SEQ ID NO: 1388024 - protein, 19 aa, Mycobacterium tuberculosis
AAVWLVFTGVSVAAAVALM

SEQ ID NO: 1388025 - protein, 24 aa, Mycobacterium tuberculosis
ADIDRQMYFFYAATMAPFLVMGIS

SEQ ID NO: 1388026 - protein, 21 aa, Mycobacterium tuberculosis
ADLLTRLHWPTPTAGAHRAPL

SEQ ID NO: 1388027 - protein, 22 aa, Mycobacterium tuberculosis
ADNPVIFWTPEHGAFVVRGALN

SEQ ID NO: 1388028 - protein, 20 aa, Mycobacterium tuberculosis
ADSHLLGVIAFRALVLANPE

SEQ ID NO: 1388029 - protein, 18 aa, Mycobacterium tuberculosis
AEPLYLLFDIAVVGRLGA

SEQ ID NO: 1388030 - protein, 19 aa, Mycobacterium tuberculosis
AERVTFATWAIVTGKSPGG

SEQ ID NO: 1388031 - protein, 28 aa, Mycobacterium tuberculosis
AETERIWLPFTIWLTAAPALLPPRSHRL

SEQ ID NO: 1388032 - protein, 25 aa, Mycobacterium tuberculosis
AEVIRLIRRLLPALVVVLAGCALLT

SEQ ID NO: 1388033 - protein, 22 aa, Mycobacterium tuberculosis
AFEVVGRRRLWFGVSGAIVAVA

SEQ ID NO: 1388034 - protein, 22 aa, Mycobacterium tuberculosis
AFRALQNWVPLVAAAGSMIIVA

SEQ ID NO: 1388035 - protein, 22 aa, Mycobacterium tuberculosis
AGVAALFWRLPSDDTTRSRAKT

SEQ ID NO: 1388036 - protein, 20 aa, Mycobacterium tuberculosis
AHLLLRFDQGRWVAIDNGSL

SEQ ID NO: 1388037 - protein, 21 aa, Mycobacterium tuberculosis
AHQGTLLPILLITLINGIAEE

SEQ ID NO: 1388038 - protein, 33 aa, Mycobacterium tuberculosis; identical to SEQ ID NO: 161833

SEQ ID NO: 1388039 - protein, 37 aa, Mycobacterium tuberculosis; identical to SEQ ID NO: 161837

SEQ ID NO: 1388040 - protein, 21 aa, Mycobacterium tuberculosis
AIIVILLIALTYTRLPWRPLA

SEQ ID NO: 1388041 - protein, 23 aa, Mycobacterium tuberculosis
AISLILIIMMIITRSVVAAVVIV

SEQ ID NO: 1388042 - protein, 29 aa, Mycobacterium tuberculosis
AISSLCLIFIIMLIITRAFIAAAVIVGTV

SEQ ID NO: 1388043 - protein, 21 aa, Mycobacterium tuberculosis
ALAGGPWDWARWAPASPWATP

SEQ ID NO: 1388044 - protein, 17 aa, Mycobacterium tuberculosis
ALALLIIGTGIGIAWPH

SEQ ID NO: 1388045 - protein, 23 aa, Mycobacterium tuberculosis
ALGIPWNGWTALAALAVTCAVAT

SEQ ID NO: 1388046 - protein, 23 aa, Mycobacterium tuberculosis
ALLAVLFSWLTYGNLLLRRGGSG

SEQ ID NO: 1388047 - protein, 24 aa, Mycobacterium tuberculosis
AMIAAIIPMLLWITGVYDTVRNIR

SEQ ID NO: 1388048 - protein, 21 aa, Mycobacterium tuberculosis
APVLLLLFGLAFPLGWLDAPD

SEQ ID NO: 1388049 - protein, 23 aa, Mycobacterium tuberculosis
AQGRLFTPFFITVGLVEAAYFIN

SEQ ID NO: 1388050 - protein, 48 aa, Mycobacterium tuberculosis; identical to SEQ ID NO: 161931

SEQ ID NO: 1388051 - protein, 20 aa, Mycobacterium tuberculosis
ARWWQLLLRVVLPMSRPTMV

SEQ ID NO: 1388052 - protein, 17 aa, Mycobacterium tuberculosis
ASAIIVILLIALTYTRL

SEQ ID NO: 1388053 - protein, 27 aa, Mycobacterium tuberculosis
ATALRLYTRWLGHVVLLVPTVLAVVAT

SEQ ID NO: 1388054 - protein, 22 aa, Mycobacterium tuberculosis
ATGAKYLYGPLLDKYESLGGAA

SEQ ID NO: 1388055 - protein, 17 aa, Mycobacterium tuberculosis
ATHPAAVKPELVAHQPN

SEQ ID NO: 1388056 - protein, 20 aa, Mycobacterium tuberculosis
AVAALTWDIPPGPASAPYNV

SEQ ID NO: 1388057 - protein, 18 aa, Mycobacterium tuberculosis
AVGLLGTGALLAAALTLW

SEQ ID NO: 1388058 - protein, 20 aa, Mycobacterium tuberculosis
AVLGFFGFYLSFVAELPPPP

SEQ ID NO: 1388059 - protein, 17 aa, Mycobacterium tuberculosis
AVLPTVVAPPLTSRRLE

SEQ ID NO: 1388060 - protein, 21 aa, Mycobacterium tuberculosis
AVMAPWCRVAYIAHGQHRVCG

SEQ ID NO: 1388061 - protein, 28 aa, Mycobacterium tuberculosis
AVTFAIVPLLHRFGGLVAPLTFIGTAYV

SEQ ID NO: 1388062 - protein, 17 aa, Mycobacterium tuberculosis
AVTFVASLSLAVGIQLA

SEQ ID NO: 1388063 - protein, 20 aa, Mycobacterium tuberculosis
AVVVLLKGKVWTGLLGMFVV

SEQ ID NO: 1388064 - protein, 23 aa, Mycobacterium tuberculosis
AWCALFPIIWALSGSLKADGEVT

SEQ ID NO: 1388065 - protein, 22 aa, Mycobacterium tuberculosis
AWTRTAFALLVNGVLLTLKDTQ

SEQ ID NO: 1388066 - protein, 25 aa, Mycobacterium tuberculosis
AYGSLVMVFQWGWARGLGFPALHSI

SEQ ID NO: 1388067 - protein, 17 aa, Mycobacterium tuberculosis
CFGVEVWFLAALAAPLL

SEQ ID NO: 1388068 - protein, 21 aa, Mycobacterium tuberculosis
CGLVYELALLTLAASLNGGGI

SEQ ID NO: 1388069 - protein, 25 aa, Mycobacterium tuberculosis
CVASMLIAHAMVRPIRRLEVGTQKI

SEQ ID NO: 1388070 - protein, 19 aa, Mycobacterium tuberculosis
DALFLTAGIVVGILISLRG

SEQ ID NO: 1388071 - protein, 23 aa, Mycobacterium tuberculosis
DDEFWMLMAGRKLAARDRRVLTA

SEQ ID NO: 1388072 - protein, 30 aa, Mycobacterium tuberculosis
DDPAKPLPASIPWTALWLSQAWQQRVLEEE

SEQ ID NO: 1388073 - protein, 17 aa, Mycobacterium tuberculosis
DDTLALHYLVTHAVPDA

SEQ ID NO: 1388074 - protein, 27 aa, Mycobacterium tuberculosis
DEGRPRRLIPLVGLIGCVVLAFALPLS

SEQ ID NO: 1388075 - protein, 18 aa, Mycobacterium tuberculosis
DFMNIMLSALSAAALWLL

SEQ ID NO: 1388076 - protein, 26 aa, Mycobacterium tuberculosis
DGAVFLLVSVLLLVLVRPAVRRRLTQ

SEQ ID NO: 1388077 - protein, 23 aa, Mycobacterium tuberculosis
DGTSLRALLKQYGPLTPARAVAI

SEQ ID NO: 1388078 - protein, 19 aa, Mycobacterium tuberculosis
DIVLVRPGERISADATVLA

SEQ ID NO: 1388079 - protein, 28 aa, Mycobacterium tuberculosis
DIYQLVDVDFWLRLMLRSAVCFVPHELS

SEQ ID NO: 1388080 - protein, 23 aa, Mycobacterium tuberculosis
DKLDITALLPTSPAQRYLQAYYT

SEQ ID NO: 1388081 - protein, 24 aa, Mycobacterium tuberculosis
DMMGELFWTVVPYVTMTIVAVGSW

SEQ ID NO: 1388082 - protein, 29 aa, Mycobacterium tuberculosis
DPSVDVAILAVPHLPPPPLVFAAEPAKTG

SEQ ID NO: 1388083 - protein, 21 aa, Mycobacterium tuberculosis
DQRVLAIRLTNGSSLLISKSL

SEQ ID NO: 1388084 - protein, 17 aa, Mycobacterium tuberculosis
DREPYWVCAIYLVLLAV

SEQ ID NO: 1388085 - protein, 19 aa, Mycobacterium tuberculosis
DRIGAYERYWLYPGAQNLA

SEQ ID NO: 1388086 - protein, 19 aa, Mycobacterium tuberculosis
DRLVYLSYGLAVILGFIGV

SEQ ID NO: 1388087 - protein, 26 aa, Mycobacterium tuberculosis
DSIGWTLMHYLPPTPGFRFIDHTVIG

SEQ ID NO: 1388088 - protein, 17 aa, Mycobacterium tuberculosis
DYPTVLLSGAWLSQEQT

SEQ ID NO: 1388089 - protein, 22 aa, Mycobacterium tuberculosis
EAELLALFAGSVLRGADLATLL

SEQ ID NO: 1388090 - protein, 28 aa, Mycobacterium tuberculosis
EALTTAFLIIFTVLALVGYPLVWETATR

SEQ ID NO: 1388091 - protein, 24 aa, Mycobacterium tuberculosis
EKHCYGIPICWSFRSIFDALDGID

SEQ ID NO: 1388092 - protein, 18 aa, Mycobacterium tuberculosis
EKIPLLGHLWSWELAIPM

SEQ ID NO: 1388093 - protein, 24 aa, Mycobacterium tuberculosis
ELAATIARRLGLTGALGTVAESVD

SEQ ID NO: 1388094 - protein, 19 aa, Mycobacterium tuberculosis
ELAGIWVYERRFTDDELLR

SEQ ID NO: 1388095 - protein, 18 aa, Mycobacterium tuberculosis
EMKLVANSLIKDGKIVHP

SEQ ID NO: 1388096 - protein, 26 aa, Mycobacterium tuberculosis
EPIAAAPPPLFRFGHRGPGDWQAGHR

SEQ ID NO: 1388097 - protein, 17 aa, Mycobacterium tuberculosis
EPNLTYRIALRTTSSHE

SEQ ID NO: 1388098 - protein, 24 aa, Mycobacterium tuberculosis
EQLTVRYALRRLGALRVWPARARA

SEQ ID NO: 1388099 - protein, 30 aa, Mycobacterium tuberculosis; identical to SEQ ID NO: 162244

SEQ ID NO: 1388100 - protein, 33 aa, Mycobacterium tuberculosis; identical to SEQ ID NO: 164365

SEQ ID NO: 1388101 - protein, 21 aa, Mycobacterium tuberculosis
ESYSLPLRRLLGLVAAGLDVS

SEQ ID NO: 1388102 - protein, 18 aa, Mycobacterium tuberculosis
FAAAYVSGLAALLRQRFP

SEQ ID NO: 1388103 - protein, 18 aa, Mycobacterium tuberculosis
FAELAGCSSSIEMTREQL

SEQ ID NO: 1388104 - protein, 17 aa, Mycobacterium tuberculosis
FAPFQRPGDHDNTTGVG

SEQ ID NO: 1388105 - protein, 24 aa, Mycobacterium tuberculosis
FARALRLRLLSKLSRLPLGWFTSR

SEQ ID NO: 1388106 - protein, 18 aa, Mycobacterium tuberculosis
FAVGIPFANNWYQPARRG

SEQ ID NO: 1388107 - protein, 32 aa, Mycobacterium tuberculosis; identical to SEQ ID NO: 162299

SEQ ID NO: 1388108 - protein, 21 aa, Mycobacterium tuberculosis
FGYNGFGWRFTGALLGVVLVA

SEQ ID NO: 1388109 - protein, 34 aa, Mycobacterium tuberculosis; identical to SEQ ID NO: 162309

SEQ ID NO: 1388110 - protein, 18 aa, Mycobacterium tuberculosis
FLAMTMIILAVFYMAQDA

SEQ ID NO: 1388111 - protein, 31 aa, Mycobacterium tuberculosis; identical to SEQ ID NO: 162319

SEQ ID NO: 1388112 - protein, 19 aa, Mycobacterium tuberculosis
FQAHLLYRWVRHPIMLGFV

SEQ ID NO: 1388113 - protein, 17 aa, Mycobacterium tuberculosis
FTAVTFAIVPLLHRFGG

SEQ ID NO: 1388114 - protein, 17 aa, Mycobacterium tuberculosis
FVVLLITGVYLTLFFDP

SEQ ID NO: 1388115 - protein, 22 aa, Mycobacterium tuberculosis
GAAIPVLIVGTVVWVGITNDRK

SEQ ID NO: 1388116 - protein, 22 aa, Mycobacterium tuberculosis
GAAVWMATFIFAKTLRGESLSR

SEQ ID NO: 1388117 - protein, 17 aa, Mycobacterium tuberculosis
GAGWFLLTLMVLTLCIG

SEQ ID NO: 1388118 - protein, 25 aa, Mycobacterium tuberculosis
GAHRLFTVGFAAVGLLGTGALLAAA

SEQ ID NO: 1388119 - protein, 33 aa, Mycobacterium tuberculosis; identical to SEQ ID NO: 162371

SEQ ID NO: 1388120 - protein, 17 aa, Mycobacterium tuberculosis
GALLAAALTLWLHVIDA

SEQ ID NO: 1388121 - protein, 25 aa, Mycobacterium tuberculosis
GALVTGLGLLRRRGLRQAVASGIAV

SEQ ID NO: 1388122 - protein, 31 aa, Mycobacterium tuberculosis; identical to SEQ ID NO: 162384

SEQ ID NO: 1388123 - protein, 24 aa, Mycobacterium tuberculosis
GATAAWAIGRWTPGTERRTATMGL

SEQ ID NO: 1388124 - protein, 26 aa, Mycobacterium tuberculosis
GESSFYWLTLALAAVWIAGALMSGPL

SEQ ID NO: 1388125 - protein, 18 aa, Mycobacterium tuberculosis
GFAIPFVPRGLDEIPRSP

SEQ ID NO: 1388126 - protein, 27 aa, Mycobacterium tuberculosis
GGESALFFIGVLIVALLGGVAPAALSA

SEQ ID NO: 1388127 - protein, 30 aa, Mycobacterium tuberculosis; identical to SEQ ID NO: 162426

SEQ ID NO: 1388128 - protein, 21 aa, Mycobacterium tuberculosis
GGIFVLLWHLLVVTNIDNVLR

SEQ ID NO: 1388129 - protein, 27 aa, Mycobacterium tuberculosis
GGILSLLLAPLFPMTVVVPLSAFVALP

SEQ ID NO: 1388130 - protein, 26 aa, Mycobacterium tuberculosis
GHVEDWFLITFAAVVLFVLARDLWGR

SEQ ID NO: 1388131 - protein, 38 aa, Mycobacterium tuberculosis; identical to SEQ ID NO: 162451

SEQ ID NO: 1388132 - protein, 17 aa, Mycobacterium tuberculosis
GLAPRFTPVAWGVLVGF

SEQ ID NO: 1388133 - protein, 18 aa, Mycobacterium tuberculosis
GLGLLFDTLVVRSFMTPS

SEQ ID NO: 1388134 - protein, 17 aa, Mycobacterium tuberculosis
GLQDFIRKSADPAKPIA

SEQ ID NO: 1388135 - protein, 19 aa, Mycobacterium tuberculosis
GNPVWPLAALGVTVVFGVL

SEQ ID NO: 1388136 - protein, 35 aa, Mycobacterium tuberculosis; identical to SEQ ID NO: 162504

SEQ ID NO: 1388137 - protein, 29 aa, Mycobacterium tuberculosis
GPRLGPPPVMPPSLAWWASSLQLSGLTAG

SEQ ID NO: 1388138 - protein, 17 aa, Mycobacterium tuberculosis
GQAEILWDVIPFDWIND

SEQ ID NO: 1388139 - protein, 24 aa, Mycobacterium tuberculosis
GRLPLLCCLVAFVLTFLVTRSFVR

SEQ ID NO: 1388140 - protein, 23 aa, Mycobacterium tuberculosis
GSVFLLTVILPWNSLELGASPYV

SEQ ID NO: 1388141 - protein, 22 aa, Mycobacterium tuberculosis
GSWRAALPHFLGSAGVRLLLVS

SEQ ID NO: 1388142 - protein, 21 aa, Mycobacterium tuberculosis
GTAVVRWPGPILATSVALALV

SEQ ID NO: 1388143 - protein, 29 aa, Mycobacterium tuberculosis
GTISYGVYLWHWPIFLALNGQRTGWSGPA

SEQ ID NO: 1388144 - protein, 27 aa, Mycobacterium tuberculosis
GVFDNLTKFITWTLPTNLGEGLVILAA

SEQ ID NO: 1388145 - protein, 23 aa, Mycobacterium tuberculosis
GVLVGFIALYLLGSLAGFPQMLL

SEQ ID NO: 1388146 - protein, 17 aa, Mycobacterium tuberculosis
GVPYFPNLVMPIVVGGI

SEQ ID NO: 1388147 - protein, 29 aa, Mycobacterium tuberculosis
GYPGAILGFALLWLTATAIWLRSRRAPID

SEQ ID NO: 1388148 - protein, 17 aa, Mycobacterium tuberculosis
HAPWARWRYTRHPEKMR

SEQ ID NO: 1388149 - protein, 18 aa, Mycobacterium tuberculosis
HDLRLIIAMTVCIVLLIL

SEQ ID NO: 1388150 - protein, 17 aa, Mycobacterium tuberculosis
HGAFVVRGALNAAWDKL

SEQ ID NO: 1388151 - protein, 27 aa, Mycobacterium tuberculosis
HKSIEQLLVVFPALFAAIITSAGGVPQ

SEQ ID NO: 1388152 - protein, 31 aa, Mycobacterium tuberculosis; identical to SEQ ID NO: 162619

SEQ ID NO: 1388153 - protein, 34 aa, Mycobacterium tuberculosis; identical to SEQ ID NO: 162629

SEQ ID NO: 1388154 - protein, 26 aa, Mycobacterium tuberculosis
HPMLSLGLPMLFIALGGIGLPGAAVY

SEQ ID NO: 1388155 - protein, 23 aa, Mycobacterium tuberculosis
HSPMTWRRWALLCVGIAQIALGT

SEQ ID NO: 1388156 - protein, 18 aa, Mycobacterium tuberculosis
IAALAAIGVLLGWPLWWV

SEQ ID NO: 1388157 - protein, 28 aa, Mycobacterium tuberculosis
IADFDDFWRPLRSFTYWERHCFDIPICW

SEQ ID NO: 1388158 - protein, 23 aa, Mycobacterium tuberculosis
IASTLLGVLSVAAVVLGAMIWSA

SEQ ID NO: 1388159 - protein, 17 aa, Mycobacterium tuberculosis
IAVAFLGTVLLYFAARD

SEQ ID NO: 1388160 - protein, 24 aa, Mycobacterium tuberculosis
ICLVLFAAIVVWPQVRHAGSGSGG

SEQ ID NO: 1388161 - protein, 19 aa, Mycobacterium tuberculosis
IGAASLALVLGLLVGAVTR

SEQ ID NO: 1388162 - protein, 20 aa, Mycobacterium tuberculosis
IGLGLLFDTLVVRSFMTPSI

SEQ ID NO: 1388163 - protein, 25 aa, Mycobacterium tuberculosis
IGMVILPPFVYFITYRWCIGLQRSD

SEQ ID NO: 1388164 - protein, 20 aa, Mycobacterium tuberculosis
IGSLGVGLGLTLWLSTDAAE

SEQ ID NO: 1388165 - protein, 26 aa, Mycobacterium tuberculosis
IKRQQLFLSSLLRSMISTDTLFNLSR

SEQ ID NO: 1388166 - protein, 21 aa, Mycobacterium tuberculosis
ILARFPGLYLQSLGLTFNGAT

SEQ ID NO: 1388167 - protein, 28 aa, Mycobacterium tuberculosis
ILLGPLVGLVLLALDFRITVLAAAGVFG

SEQ ID NO: 1388168 - protein, 27 aa, Mycobacterium tuberculosis
IPLSKWFLLIMAFGSLFMVAGKRYAEL

SEQ ID NO: 1388169 - protein, 36 aa, Mycobacterium tuberculosis; identical to SEQ ID NO: 162746

SEQ ID NO: 1388170 - protein, 20 aa, Mycobacterium tuberculosis
ITPAIFLVMVSAFVALQVKA

SEQ ID NO: 1388171 - protein, 25 aa, Mycobacterium tuberculosis
IVAVGSWWRYRYDKFGWTTRSSQLY

SEQ ID NO: 1388172 - protein, 18 aa, Mycobacterium tuberculosis
IYQEMLANYRVGQANSVL

SEQ ID NO: 1388173 - protein, 18 aa, Mycobacterium tuberculosis
KPPVAARWRVAGSAALFV

SEQ ID NO: 1388174 - protein, 17 aa, Mycobacterium tuberculosis
KSSTLAFSKPFFAQGLL

SEQ ID NO: 1388175 - protein, 23 aa, Mycobacterium tuberculosis
KTLKYRPDFPKRFESIEAARVHC

SEQ ID NO: 1388176 - protein, 23 aa, Mycobacterium tuberculosis
KTTTHLFQPLLYQVATGILSEGD

SEQ ID NO: 1388177 - protein, 31 aa, Mycobacterium tuberculosis; identical to SEQ ID NO: 164432

SEQ ID NO: 1388178 - protein, 20 aa, Mycobacterium tuberculosis
LAALSWAWGWLPLDAGSGIN

SEQ ID NO: 1388179 - protein, 26 aa, Mycobacterium tuberculosis
LAFSKPFFAQGLLNRRAVLKSSYAQF

SEQ ID NO: 1388180 - protein, 22 aa, Mycobacterium tuberculosis
LALVLGLLVGAVTRGTASGPAR

SEQ ID NO: 1388181 - protein, 21 aa, Mycobacterium tuberculosis
LAMALTCWWVISREVIPRLGH

SEQ ID NO: 1388182 - protein, 25 aa, Mycobacterium tuberculosis
LANPGLPLWPYLVCGALAGLGGGNF

SEQ ID NO: 1388183 - protein, 23 aa, Mycobacterium tuberculosis
LAPEVYWPLRRVGVQFHAAADGR

SEQ ID NO: 1388184 - protein, 26 aa, Mycobacterium tuberculosis
LAPTLNGWFFGVVYWLFDLSGVSHRL

SEQ ID NO: 1388185 - protein, 20 aa, Mycobacterium tuberculosis
LAVAYLGIGLLLACVVLRGL

SEQ ID NO: 1388186 - protein, 17 aa, Mycobacterium tuberculosis
LAVGWLVGALVVLVVGT

SEQ ID NO: 1388187 - protein, 35 aa, Mycobacterium tuberculosis; identical to SEQ ID NO: 162890

SEQ ID NO: 1388188 - protein, 26 aa, Mycobacterium tuberculosis
LEFWASLIKVIALVTFLIVGTVFLAG

SEQ ID NO: 1388189 - protein, 21 aa, Mycobacterium tuberculosis
LENRIKAMPPSSVVGLWTFDG

SEQ ID NO: 1388190 - protein, 19 aa, Mycobacterium tuberculosis
LFDTFVRYHWGHEFMAIHF

SEQ ID NO: 1388191 - protein, 32 aa, Mycobacterium tuberculosis; identical to SEQ ID NO: 162944

SEQ ID NO: 1388192 - protein, 32 aa, Mycobacterium tuberculosis; identical to SEQ ID NO: 162958

SEQ ID NO: 1388193 - protein, 19 aa, Mycobacterium tuberculosis
LINVFTAVTFAIVPLLHRF

SEQ ID NO: 1388194 - protein, 17 aa, Mycobacterium tuberculosis
LISIPVVSQLLGCTPLD

SEQ ID NO: 1388195 - protein, 25 aa, Mycobacterium tuberculosis
LLAAALTLWLHVIDARFARALRLRL

SEQ ID NO: 1388196 - protein, 19 aa, Mycobacterium tuberculosis
LLGHLWSWELAIPMSGIAM

SEQ ID NO: 1388197 - protein, 29 aa, Mycobacterium tuberculosis
LLLGWGVFLNYGLVLIVLPGMAVLAAADW

SEQ ID NO: 1388198 - protein, 17 aa, Mycobacterium tuberculosis
LLRSLLTYFHYASKETR

SEQ ID NO: 1388199 - protein, 17 aa, Mycobacterium tuberculosis
LLVLLTNENGLGPADEA

SEQ ID NO: 1388200 - protein, 18 aa, Mycobacterium tuberculosis
LQCRPDAAYLITGGLGAL

SEQ ID NO: 1388201 - protein, 28 aa, Mycobacterium tuberculosis
LQSDIIGALFVLGFLRYGLPPQDNIQLQ

SEQ ID NO: 1388202 - protein, 31 aa, Mycobacterium tuberculosis; identical to SEQ ID NO: 163024

SEQ ID NO: 1388203 - protein, 24 aa, Mycobacterium tuberculosis
LSAAALWLLFANRMGYPVSTTHSI

SEQ ID NO: 1388204 - protein, 20 aa, Mycobacterium tuberculosis
LSGLGLTMTGPRPGGFGALD

SEQ ID NO: 1388205 - protein, 24 aa, Mycobacterium tuberculosis
LSINRFIAIDFVGFARMVEALGGV

SEQ ID NO: 1388206 - protein, 29 aa, Mycobacterium tuberculosis
LSQLQLWTTPLWLILMAAPFGYLVVSHPD

SEQ ID NO: 1388207 - protein, 26 aa, Mycobacterium tuberculosis
LTARKRIAWLVLLANMVLAAVVNAAE

SEQ ID NO: 1388208 - protein, 29 aa, Mycobacterium tuberculosis
LTTAFGFLVLVLLLSLLNATLFQGAPQQS

SEQ ID NO: 1388209 - protein, 28 aa, Mycobacterium tuberculosis
LVALIALFPPYIMWAPNAIWKAFDLFVG

SEQ ID NO: 1388210 - protein, 30 aa, Mycobacterium tuberculosis
LVFTTVTWAPFLWLVTCVVIIVSYARKPAR

SEQ ID NO: 1388211 - protein, 28 aa, Mycobacterium tuberculosis
LVGGIVWNLLTWLLGIPSSSSHALIGGI

SEQ ID NO: 1388212 - protein, 24 aa, Mycobacterium tuberculosis
LVPSPTCIIVGLPAGLRLAVDNAI

SEQ ID NO: 1388213 - protein, 24 aa, Mycobacterium tuberculosis
LVVEGVAINFWLLRRDSVTVGTDD

SEQ ID NO: 1388214 - protein, 17 aa, Mycobacterium tuberculosis
LVVRMWALQRSAMYRDM

SEQ ID NO: 1388215 - protein, 17 aa, Mycobacterium tuberculosis
LVYLTITSSLTIQSGPR

SEQ ID NO: 1388216 - protein, 26 aa, Mycobacterium tuberculosis
LWGETLQRALLRAMTFMIVASPCAVV

SEQ ID NO: 1388217 - protein, 29 aa, Mycobacterium tuberculosis
LWISLVVLWLFVLVPMLISKRDAVRRTSD

SEQ ID NO: 1388218 - protein, 32 aa, Mycobacterium tuberculosis; identical to SEQ ID NO: 163131

SEQ ID NO: 1388219 - protein, 18 aa, Mycobacterium tuberculosis
MATYLSRDWARDWGSLRK

SEQ ID NO: 1388220 - protein, 20 aa, Mycobacterium tuberculosis
MLLYLFIPGWAVDSDFARLG

SEQ ID NO: 1388221 - protein, 23 aa, Mycobacterium tuberculosis
MLRPFAPRRLVRALLLPSGQHPS

SEQ ID NO: 1388222 - protein, 20 aa, Mycobacterium tuberculosis
MTDAYLAPLKLRTTTLTLIY

SEQ ID NO: 1388223 - protein, 25 aa, Mycobacterium tuberculosis
MVIAAMLLVIYRSVITAVLVLIMVG

SEQ ID NO: 1388224 - protein, 28 aa, Mycobacterium tuberculosis
NAPGVILRLMLAWIPSTGVPLLAIVLAV

SEQ ID NO: 1388225 - protein, 23 aa, Mycobacterium tuberculosis
NEGRGDFFAVVRSLALFVNALHQ

SEQ ID NO: 1388226 - protein, 29 aa, Mycobacterium tuberculosis
NFNRPYALWVPLVLSVPLGLLLMTARRRP

SEQ ID NO: 1388227 - protein, 30 aa, Mycobacterium tuberculosis; identical to SEQ ID NO: 163196

SEQ ID NO: 1388228 - protein, 24 aa, Mycobacterium tuberculosis
NGERLTLAMVFLLAIAGAFVVSKT

SEQ ID NO: 1388229 - protein, 27 aa, Mycobacterium tuberculosis
NGLSAFYYALLLLLAGFTGSIVVSTLV

SEQ ID NO: 1388230 - protein, 25 aa, Mycobacterium tuberculosis
NLAPAAWWRQLSWLPQRPVLVPGTV

SEQ ID NO: 1388231 - protein, 37 aa, Mycobacterium tuberculosis; identical to SEQ ID NO: 163217

SEQ ID NO: 1388232 - protein, 28 aa, Mycobacterium tuberculosis
NWGLMKPIVLAWVITLPSAAILASVGLV

SEQ ID NO: 1388233 - protein, 44 aa, Mycobacterium tuberculosis; identical to SEQ ID NO: 163239

SEQ ID NO: 1388234 - protein, 25 aa, Mycobacterium tuberculosis
PALDLDALIGGFKPVFRALDPAKVN

SEQ ID NO: 1388235 - protein, 25 aa, Mycobacterium tuberculosis
PDAPPIGFWIDVTVVLWVVVALVTS

SEQ ID NO: 1388236 - protein, 23 aa, Mycobacterium tuberculosis
PDFQRGLKLFLSPDGTCARFVIT

SEQ ID NO: 1388237 - protein, 17 aa, Mycobacterium tuberculosis
PEPLLDLIEPDLRAIIE

SEQ ID NO: 1388238 - protein, 34 aa, Mycobacterium tuberculosis; identical to SEQ ID NO: 163284

SEQ ID NO: 1388239 - protein, 35 aa, Mycobacterium tuberculosis; identical to SEQ ID NO: 163296

SEQ ID NO: 1388240 - protein, 18 aa, Mycobacterium tuberculosis
PHVFLNAIFGLFGAFALI

SEQ ID NO: 1388241 - protein, 20 aa, Mycobacterium tuberculosis
PLEHCYAYSDSITDLPMLEA

SEQ ID NO: 1388242 - protein, 24 aa, Mycobacterium tuberculosis
PMNAMTPMVLFIKSPRDLRTPGAL

SEQ ID NO: 1388243 - protein, 20 aa, Mycobacterium tuberculosis
PPPPTVTPPVPARAPRPAAQ

SEQ ID NO: 1388244 - protein, 27 aa, Mycobacterium tuberculosis
PSIAALLGRWFWWPNMIHSRPTVPEAH

SEQ ID NO: 1388245 - protein, 20 aa, Mycobacterium tuberculosis
PSSLLATTVFFSPGNEQAAA

SEQ ID NO: 1388246 - protein, 18 aa, Mycobacterium tuberculosis
PTAWALCGVFPLAAVPLV

SEQ ID NO: 1388247 - protein, 19 aa, Mycobacterium tuberculosis
PTGLLAYRYRLRVLAAATV

SEQ ID NO: 1388248 - protein, 18 aa, Mycobacterium tuberculosis
PTRSILAGLALQAVVVAL

SEQ ID NO: 1388249 - protein, 23 aa, Mycobacterium tuberculosis
PVLGVWVIFSPWVLPGVAVTAGM

SEQ ID NO: 1388250 - protein, 21 aa, Mycobacterium tuberculosis
PYIVYFTPLFDTFVRYHWGHE

SEQ ID NO: 1388251 - protein, 18 aa, Mycobacterium tuberculosis
PYLRTMFVVLLSTLTLAS

SEQ ID NO: 1388252 - protein, 27 aa, Mycobacterium tuberculosis
QDAEAEPAAWLRFWFPDPNGSNTEFQR

SEQ ID NO: 1388253 - protein, 19 aa, Mycobacterium tuberculosis
QGVLALPLPIDKINKIMTA

SEQ ID NO: 1388254 - protein, 26 aa, Mycobacterium tuberculosis
QHMADRFPAVLPVGEVLAIVTAVAGA

SEQ ID NO: 1388255 - protein, 18 aa, Mycobacterium tuberculosis
QIDHFWWTAIWAAILLSI

SEQ ID NO: 1388256 - protein, 39 aa, Mycobacterium tuberculosis; identical to SEQ ID NO: 163422

SEQ ID NO: 1388257 - protein, 23 aa, Mycobacterium tuberculosis
QRAPQIYRPPTAAPPPAGARGGT

SEQ ID NO: 1388258 - protein, 30 aa, Mycobacterium tuberculosis; identical to SEQ ID NO: 163451

SEQ ID NO: 1388259 - protein, 17 aa, Mycobacterium tuberculosis
RAAGFIGFAIGGPLSDG

SEQ ID NO: 1388260 - protein, 20 aa, Mycobacterium tuberculosis
RADVRVAHPLISRAHLLLRF

SEQ ID NO: 1388261 - protein, 25 aa, Mycobacterium tuberculosis
RALRMPLYRTLISLAVWATGGGVFI

SEQ ID NO: 1388262 - protein, 20 aa, Mycobacterium tuberculosis
RALVLVTVGIIVVICVASML

SEQ ID NO: 1388263 - protein, 24 aa, Mycobacterium tuberculosis
RANGIRRIVMLTGDHPEIAQVVAD

SEQ ID NO: 1388264 - protein, 25 aa, Mycobacterium tuberculosis
RDADKPAALWILTRGVHESVAPSAL

SEQ ID NO: 1388265 - protein, 23 aa, Mycobacterium tuberculosis
RETVSVWFRSVWVLQPRGDLMAE

SEQ ID NO: 1388266 - protein, 18 aa, Mycobacterium tuberculosis
RFGLLDPKRRLKTRGWRR

SEQ ID NO: 1388267 - protein, 19 aa, Mycobacterium tuberculosis
RGWLRRFAERAEAVRSVFT

SEQ ID NO: 1388268 - protein, 20 aa, Mycobacterium tuberculosis
RHRILAWIAAGAMASVVALV

SEQ ID NO: 1388269 - protein, 28 aa, Mycobacterium tuberculosis
RIESLLPAILEGRQLWQRVQAAVSVLLG

SEQ ID NO: 1388270 - protein, 39 aa, Mycobacterium tuberculosis; identical to SEQ ID NO: 163536

SEQ ID NO: 1388271 - protein, 27 aa, Mycobacterium tuberculosis
RLFRVPELLAGSFLLALLAVTAANFFT

SEQ ID NO: 1388272 - protein, 44 aa, Mycobacterium tuberculosis; identical to SEQ ID NO: 163542

SEQ ID NO: 1388273 - protein, 21 aa, Mycobacterium tuberculosis
RMMTPLLLVMIAVGGTDILFA

SEQ ID NO: 1388274 - protein, 28 aa, Mycobacterium tuberculosis
RNGEQLLLTMFIPITLLVGLTLLPMGSF

SEQ ID NO: 1388275 - protein, 24 aa, Mycobacterium tuberculosis
RQPGGYLLGGFGPAPEGMAMWIIG

SEQ ID NO: 1388276 - protein, 33 aa, Mycobacterium tuberculosis; identical to SEQ ID NO: 163579

SEQ ID NO: 1388277 - protein, 20 aa, Mycobacterium tuberculosis
RRASQEAELLALFAGSVLRG

SEQ ID NO: 1388278 - protein, 28 aa, Mycobacterium tuberculosis
RRDRMVRAIWVLRALLREYGRRLTEAGV

SEQ ID NO: 1388279 - protein, 19 aa, Mycobacterium tuberculosis
RRILQPYFSPAALSKALPS

SEQ ID NO: 1388280 - protein, 20 aa, Mycobacterium tuberculosis
RSLRPLAEFEQTAAAIGAGQ

SEQ ID NO: 1388281 - protein, 24 aa, Mycobacterium tuberculosis
RSLSAALIMLLTVGLELLAVRGII

SEQ ID NO: 1388282 - protein, 18 aa, Mycobacterium tuberculosis
RSQLWLSLLSWAVVVGCY

SEQ ID NO: 1388283 - protein, 19 aa, Mycobacterium tuberculosis
RTPWNTYMAQGLPATAICS

SEQ ID NO: 1388284 - protein, 23 aa, Mycobacterium tuberculosis
RVFAWLALVFGVGFSMLALLTRR

SEQ ID NO: 1388285 - protein, 19 aa, Mycobacterium tuberculosis
RVIVLVGALVWAGSLVWYL

SEQ ID NO: 1388286 - protein, 20 aa, Mycobacterium tuberculosis
RWQRIVALTMIGISTALIGG

SEQ ID NO: 1388287 - protein, 19 aa, Mycobacterium tuberculosis
RWRFWRRGRRPLETKVVLD

SEQ ID NO: 1388288 - protein, 18 aa, Mycobacterium tuberculosis
RWTRALLVPTLAGVALIA

SEQ ID NO: 1388289 - protein, 26 aa, Mycobacterium tuberculosis
SAPIGYLFRPYIIYRSREELVLTRPR

SEQ ID NO: 1388290 - protein, 23 aa, Mycobacterium tuberculosis
SASGLGFAIPVNEMKLVANSLIK

SEQ ID NO: 1388291 - protein, 21 aa, Mycobacterium tuberculosis
SAVYMLWLYQRVMTGPVAEGN

SEQ ID NO: 1388292 - protein, 29 aa, Mycobacterium tuberculosis
SEVSEFSWQLERVLPVPVFAQTMAQVTVA

SEQ ID NO: 1388293 - protein, 27 aa, Mycobacterium tuberculosis
SMLSKWPVGWVVVLLYAVCVVLRLARY

SEQ ID NO: 1388294 - protein, 23 aa, Mycobacterium tuberculosis
SQFGPYQLLRLLGRGGMGEVYEA

SEQ ID NO: 1388295 - protein, 20 aa, Mycobacterium tuberculosis
STYFRPLIVTLAIIGVIYGA

SEQ ID NO: 1388296 - protein, 22 aa, Mycobacterium tuberculosis
SVALALVGLLALPGYRPGYNDR

SEQ ID NO: 1388297 - protein, 41 aa, Mycobacterium tuberculosis; identical to SEQ ID NO: 163783

SEQ ID NO: 1388298 - protein, 20 aa, Mycobacterium tuberculosis
SVLKPPLITLRTLTLSGYRV

SEQ ID NO: 1388299 - protein, 26 aa, Mycobacterium tuberculosis
SVVGLGLFNPLSVGAGLILGRMAYKE

SEQ ID NO: 1388300 - protein, 29 aa, Mycobacterium tuberculosis
TAAVLVLFTLIFFLYGGRSIWQYVTKAFP

SEQ ID NO: 1388301 - protein, 26 aa, Mycobacterium tuberculosis
TDAFWIFMMCYAAAAVLTWKVYDRRT

SEQ ID NO: 1388302 - protein, 22 aa, Mycobacterium tuberculosis
TDLDSVLKRFGPLTPPRAVAII

SEQ ID NO: 1388303 - protein, 23 aa, Mycobacterium tuberculosis
TGEAVMFWVLSALALLGAVGVVL

SEQ ID NO: 1388304 - protein, 25 aa, Mycobacterium tuberculosis
TGLPLPVVLVPPMALSRILLGVHYP

SEQ ID NO: 1388305 - protein, 25 aa, Mycobacterium tuberculosis
TGVTIFTGYPFLRGALRSLRSGKAG

SEQ ID NO: 1388306 - protein, 28 aa, Mycobacterium tuberculosis
THRMDPVNLLPFMFLGTTFGARLLGIAY

SEQ ID NO: 1388307 - protein, 24 aa, Mycobacterium tuberculosis
TIAHFTFGLALLAGLYVAASPWIV

SEQ ID NO: 1388308 - protein, 32 aa, Mycobacterium tuberculosis; identical to SEQ ID NO: 163860

SEQ ID NO: 1388309 - protein, 32 aa, Mycobacterium tuberculosis; identical to SEQ ID NO: 163862

SEQ ID NO: 1388310 - protein, 27 aa, Mycobacterium tuberculosis
TLDSMIGYRSPRYLRFGWAAARLDDWA

SEQ ID NO: 1388311 - protein, 23 aa, Mycobacterium tuberculosis
TLPLIPIFMVLIGLATTNPSAAA

SEQ ID NO: 1388312 - protein, 35 aa, Mycobacterium tuberculosis; identical to SEQ ID NO: 163876

SEQ ID NO: 1388313 - protein, 23 aa, Mycobacterium tuberculosis
TQATFLRWVWYAARREGLHLDEA

SEQ ID NO: 1388314 - protein, 18 aa, Mycobacterium tuberculosis
TRRHSPLVIATALGSAGV

SEQ ID NO: 1388315 - protein, 24 aa, Mycobacterium tuberculosis
TSAFWAFGVFYLVASVLTWAIYVR

SEQ ID NO: 1388316 - protein, 51 aa, Mycobacterium tuberculosis; identical to SEQ ID NO: 163921

SEQ ID NO: 1388317 - protein, 24 aa, Mycobacterium tuberculosis
TSAVTLLSSLLLICVVAYHAAPAL

SEQ ID NO: 1388318 - protein, 24 aa, Mycobacterium tuberculosis
TVAITFLGMVFTQLGILKTVGPML

SEQ ID NO: 1388319 - protein, 23 aa, Mycobacterium tuberculosis
TVATIMFLVLLAVTYYQVRVMDR

SEQ ID NO: 1388320 - protein, 32 aa, Mycobacterium tuberculosis; identical to SEQ ID NO: 163943

SEQ ID NO: 1388321 - protein, 31 aa, Mycobacterium tuberculosis; identical to SEQ ID NO: 163955

SEQ ID NO: 1388322 - protein, 18 aa, Mycobacterium tuberculosis
TWRYWRTVTGVVVAGAVL

SEQ ID NO: 1388323 - protein, 25 aa, Mycobacterium tuberculosis
VAAVYVVFRWFFARDLRVVPDRQQL

SEQ ID NO: 1388324 - protein, 19 aa, Mycobacterium tuberculosis
VACAIPLPPIARLLDDLDV

SEQ ID NO: 1388325 - protein, 25 aa, Mycobacterium tuberculosis
VDVALYALLVMMLLSALFTDGAGPI

SEQ ID NO: 1388326 - protein, 18 aa, Mycobacterium tuberculosis
VDWFGIVVLAVWGALAAL

SEQ ID NO: 1388327 - protein, 17 aa, Mycobacterium tuberculosis
VEPTILLAVFALSIPAG

SEQ ID NO: 1388328 - protein, 25 aa, Mycobacterium tuberculosis
VGLGAFGLGVLTRPSPPPTVAEQVL

SEQ ID NO: 1388329 - protein, 30 aa, Mycobacterium tuberculosis; identical to SEQ ID NO: 164047

SEQ ID NO: 1388330 - protein, 20 aa, Mycobacterium tuberculosis
VGVLVYLFVVDWRVALVLFG

SEQ ID NO: 1388331 - protein, 22 aa, Mycobacterium tuberculosis
VIALAFFIPLLIGTGGNTGTQI

SEQ ID NO: 1388332 - protein, 24 aa, Mycobacterium tuberculosis
VIARFVQFIIVPIALIALARSQAV

SEQ ID NO: 1388333 - protein, 29 aa, Mycobacterium tuberculosis
VIDITIIFIGYILGLMLWATALTQFDEAL

SEQ ID NO: 1388334 - protein, 24 aa, Mycobacterium tuberculosis
VIGKARLIVWPPSRWGVVRSVNPQ

SEQ ID NO: 1388335 - protein, 32 aa, Mycobacterium tuberculosis; identical to SEQ ID NO: 164075

SEQ ID NO: 1388336 - protein, 18 aa, Mycobacterium tuberculosis
VKVIQKLSGLSINRFIAI

SEQ ID NO: 1388337 - protein, 23 aa, Mycobacterium tuberculosis
VLDTFLVRTVTVPALTTMIGRAN

SEQ ID NO: 1388338 - protein, 21 aa, Mycobacterium tuberculosis
VLIITVMVCWLLLAVLRGRLH

SEQ ID NO: 1388339 - protein, 25 aa, Mycobacterium tuberculosis
VLKSSYAQFIFLLSGADHDQMDRMR

SEQ ID NO: 1388340 - protein, 18 aa, Mycobacterium tuberculosis
VLTFLVTRSFVRFIHRRA

SEQ ID NO: 1388341 - protein, 24 aa, Mycobacterium tuberculosis
VNLKLLMPVFRWQRRDNLLTEPDP

SEQ ID NO: 1388342 - protein, 20 aa, Mycobacterium tuberculosis
VNRLLRLPLPEPYLPPRLEA

SEQ ID NO: 1388343 - protein, 22 aa, Mycobacterium tuberculosis
VPDRQQLKPAPRLPMFVLVVVA

SEQ ID NO: 1388344 - protein, 27 aa, Mycobacterium tuberculosis
VPLEAVPAFFRWLAQFEPMHQVFLGVR

SEQ ID NO: 1388345 - protein, 22 aa, Mycobacterium tuberculosis
VPRAWRMRITVQRVGDRVKVSD

SEQ ID NO: 1388346 - protein, 25 aa, Mycobacterium tuberculosis
VQTVVTPAWYAPLVLSVGGIGQTGM

SEQ ID NO: 1388347 - protein, 28 aa, Mycobacterium tuberculosis
VSAFLGANFMLLPRWLLGSGDEGASAIV

SEQ ID NO: 1388348 - protein, 19 aa, Mycobacterium tuberculosis
VTTKLPPFATRTDSVLLVA

SEQ ID NO: 1388349 - protein, 28 aa, Mycobacterium tuberculosis
VVDWRVALVLFGPVLVYLTITSSLTIQS

SEQ ID NO: 1388350 - protein, 25 aa, Mycobacterium tuberculosis
VVVRWPLPVLVATCAIALVGLLALP

SEQ ID NO: 1388351 - protein, 26 aa, Mycobacterium tuberculosis
VVYNLPKMVSLLVEPWYALVGEREQV

SEQ ID NO: 1388352 - protein, 28 aa, Mycobacterium tuberculosis
VVYTGAVMMLFLFVLMLIGVDSAESLKE

SEQ ID NO: 1388353 - protein, 30 aa, Mycobacterium tuberculosis; identical to SEQ ID NO: 164202

SEQ ID NO: 1388354 - protein, 26 aa, Mycobacterium tuberculosis
VYGICGIFVFLILRALGELVLHRPSS

SEQ ID NO: 1388355 - protein, 18 aa, Mycobacterium tuberculosis
WHPVLNLASARLIAATNA

SEQ ID NO: 1388356 - protein, 32 aa, Mycobacterium tuberculosis; identical to SEQ ID NO: 164237

SEQ ID NO: 1388357 - protein, 27 aa, Mycobacterium tuberculosis
WTDILLPIVMWALYAWSWHSNGDAVPK

SEQ ID NO: 1388358 - protein, 18 aa, Mycobacterium tuberculosis
WVCAIYLVLLAVAGLGAA

SEQ ID NO: 1388359 - protein, 17 aa, Mycobacterium tuberculosis
YIRYCYGARLPDSMRDW

SEQ ID NO: 1388360 - protein, 20 aa, Mycobacterium tuberculosis
YLHKPEQLAKLARAGFRVSD

SEQ ID NO: 1388361 - protein, 18 aa, Mycobacterium tuberculosis
YMMWTEGLARIWPPWEFY

SEQ ID NO: 1388362 - protein, 18 aa, Mycobacterium tuberculosis
YPSALRITIVERVPVVVK

SEQ ID NO: 1388363 - protein, 26 aa, Mycobacterium tuberculosis
YSGIITLILALILKFTIGLRLDAEQE

SEQ ID NO: 1388364 - protein, 25 aa, Mycobacterium tuberculosis
YTENLRYYYLILPTVDGSLSRRFGF

SEQ ID NO: 1388365 - protein, 17 aa, Mycobacterium tuberculosis
YVSLFFLAGLMAIPQDI

SEQ ID NO: 1388366 - protein, 51 aa, Mycobacterium tuberculosis; identical to SEQ ID NO: 164307

SEQ ID NO: 1388367 - protein, 33 aa, Mycobacterium tuberculosis; identical to SEQ ID NO: 161718

SEQ ID NO: 1388368 - protein, 31 aa, Mycobacterium tuberculosis; identical to SEQ ID NO: 161719

SEQ ID NO: 1388369 - protein, 30 aa, Mycobacterium tuberculosis; identical to SEQ ID NO: 161723

SEQ ID NO: 1388370 - protein, 25 aa, Mycobacterium tuberculosis
AAGYLIIDRIFFRALQAGWASVIVS

SEQ ID NO: 1388371 - protein, 34 aa, Mycobacterium tuberculosis; identical to SEQ ID NO: 161737

SEQ ID NO: 1388372 - protein, 20 aa, Mycobacterium tuberculosis
AAWVILAVIRYRGATTPGPV

SEQ ID NO: 1388373 - protein, 22 aa, Mycobacterium tuberculosis
ADGLITFFALVIVTSLSMVFGE

SEQ ID NO: 1388374 - protein, 39 aa, Mycobacterium tuberculosis; identical to SEQ ID NO: 161774

SEQ ID NO: 1388375 - protein, 34 aa, Mycobacterium tuberculosis; identical to SEQ ID NO: 161793

SEQ ID NO: 1388376 - protein, 25 aa, Mycobacterium tuberculosis
AGCLLPMVNLLWAPLYVIELALVED

SEQ ID NO: 1388377 - protein, 17 aa, Mycobacterium tuberculosis
AGLLSGYLLARKVVDAQ

SEQ ID NO: 1388378 - protein, 23 aa, Mycobacterium tuberculosis
AGNGWRVSGLLRIDEVASATGYR

SEQ ID NO: 1388379 - protein, 22 aa, Mycobacterium tuberculosis
AGSLFPFLFITIACGALSGFHA

SEQ ID NO: 1388380 - protein, 32 aa, Mycobacterium tuberculosis; identical to SEQ ID NO: 161816

SEQ ID NO: 1388381 - protein, 25 aa, Mycobacterium tuberculosis
AGSVAWLIMLMTSPPTRAAARLMTP

SEQ ID NO: 1388382 - protein, 21 aa, Mycobacterium tuberculosis
AKIVGCALGFPVINIARSSAK

SEQ ID NO: 1388383 - protein, 18 aa, Mycobacterium tuberculosis
ALATLISIPVVSQLLGCT

SEQ ID NO: 1388384 - protein, 19 aa, Mycobacterium tuberculosis
ALCLPLARALRRPTPSAMT

SEQ ID NO: 1388385 - protein, 31 aa, Mycobacterium tuberculosis; identical to SEQ ID NO: 161867

SEQ ID NO: 1388386 - protein, 20 aa, Mycobacterium tuberculosis
ALQEWAYGRRFRYSETMSLG

SEQ ID NO: 1388387 - protein, 28 aa, Mycobacterium tuberculosis
ALSAFTLIPYALVLLQLRVFYAREQPWT

SEQ ID NO: 1388388 - protein, 20 aa, Mycobacterium tuberculosis
APIEQAWSRLCDLEQMIPLM

SEQ ID NO: 1388389 - protein, 17 aa, Mycobacterium tuberculosis
AQPDFLRRPGRDLAPEL

SEQ ID NO: 1388390 - protein, 26 aa, Mycobacterium tuberculosis
ARRALDVVPTLWRGALVVLQSILAVA

SEQ ID NO: 1388391 - protein, 17 aa, Mycobacterium tuberculosis
ARSTIIAGALLLVLGVA

SEQ ID NO: 1388392 - protein, 27 aa, Mycobacterium tuberculosis
ASGSMVFAILVLLGRYINYTLDLAGIA

SEQ ID NO: 1388393 - protein, 17 aa, Mycobacterium tuberculosis
ATELFAELAGCSSSIEM

SEQ ID NO: 1388394 - protein, 19 aa, Mycobacterium tuberculosis
ATFTAIFVPVLARAEQDDP

SEQ ID NO: 1388395 - protein, 27 aa, Mycobacterium tuberculosis
AVARILAWRPLVWLGTISYGVYLWHWP

SEQ ID NO: 1388396 - protein, 17 aa, Mycobacterium tuberculosis
AVKHVCRGLSGLTSWLT

SEQ ID NO: 1388397 - protein, 21 aa, Mycobacterium tuberculosis
AVSFTTLRLIYQEMLANYRVG

SEQ ID NO: 1388398 - protein, 19 aa, Mycobacterium tuberculosis
AVSFWLTAPYLVAESIRHL

SEQ ID NO: 1388399 - protein, 18 aa, Mycobacterium tuberculosis
AVVLATMPPLLSAIANAG

SEQ ID NO: 1388400 - protein, 22 aa, Mycobacterium tuberculosis
AVWSNGWWIDPAIGLAIAGIAV

SEQ ID NO: 1388401 - protein, 19 aa, Mycobacterium tuberculosis
AWHYFPRHRFLFGDKYDSV

SEQ ID NO: 1388402 - protein, 19 aa, Mycobacterium tuberculosis
AYPRTGSVVVWYSPRRADR

SEQ ID NO: 1388403 - protein, 18 aa, Mycobacterium tuberculosis
CALAMMVFSKSFSVLRSA

SEQ ID NO: 1388404 - protein, 32 aa, Mycobacterium tuberculosis; identical to SEQ ID NO: 162063

SEQ ID NO: 1388405 - protein, 24 aa, Mycobacterium tuberculosis
CIARPLVPSIMIAAALIAGTGSVL

SEQ ID NO: 1388406 - protein, 26 aa, Mycobacterium tuberculosis
DAITVVAVLLWIVAALIVGSVVYLSA

SEQ ID NO: 1388407 - protein, 24 aa, Mycobacterium tuberculosis
DAYGFPAGLWRWLQRHPPPALHRL

SEQ ID NO: 1388408 - protein, 27 aa, Mycobacterium tuberculosis
DDVLQAYLNIIYFGRGAYGISAASKAY

SEQ ID NO: 1388409 - protein, 23 aa, Mycobacterium tuberculosis
DGLETVLHIFPTLAANINQLYHP

SEQ ID NO: 1388410 - protein, 22 aa, Mycobacterium tuberculosis
DGRTLLLGSPSLLRAEKVRVSK

SEQ ID NO: 1388411 - protein, 22 aa, Mycobacterium tuberculosis
DIKSLADGLARFTWQLRAADPR

SEQ ID NO: 1388412 - protein, 20 aa, Mycobacterium tuberculosis
DLVMMKYLAFGLMAALLLDA

SEQ ID NO: 1388413 - protein, 29 aa, Mycobacterium tuberculosis
DLVYLGYGLAILALPFVILIGLIVSRQWK

SEQ ID NO: 1388414 - protein, 17 aa, Mycobacterium tuberculosis
DPDLLLVEALDAMVLTA

SEQ ID NO: 1388415 - protein, 24 aa, Mycobacterium tuberculosis
DQRVLGAALWYAATVKDAVIVAAA

SEQ ID NO: 1388416 - protein, 17 aa, Mycobacterium tuberculosis
DSMRWLATVIQMDGRRI

SEQ ID NO: 1388417 - protein, 23 aa, Mycobacterium tuberculosis
DVIHAFWVPEFLFKRDVMPNPVA

SEQ ID NO: 1388418 - protein, 18 aa, Mycobacterium tuberculosis
DVLAVATRGLWAAALQLA

SEQ ID NO: 1388419 - protein, 36 aa, Mycobacterium tuberculosis; identical to SEQ ID NO: 162167

SEQ ID NO: 1388420 - protein, 25 aa, Mycobacterium tuberculosis
DYLAAHPLIGPWLDELQAFDVFSSF

SEQ ID NO: 1388421 - protein, 22 aa, Mycobacterium tuberculosis
EFDGQLWIDMDFVDGTDTVSLL

SEQ ID NO: 1388422 - protein, 25 aa, Mycobacterium tuberculosis
EFTEPEMWFVRQAHQICPVGAVVAT

SEQ ID NO: 1388423 - protein, 22 aa, Mycobacterium tuberculosis
EGLLTWLGGGHWRELGERHERS

SEQ ID NO: 1388424 - protein, 17 aa, Mycobacterium tuberculosis
ELGLLIDAPRSATVRAL

SEQ ID NO: 1388425 - protein, 24 aa, Mycobacterium tuberculosis
EPAHPRRWFISTTPGRIMTIGIVL

SEQ ID NO: 1388426 - protein, 28 aa, Mycobacterium tuberculosis
EPEPKSPPIPWYRLPAVIITGTTVAVLL

SEQ ID NO: 1388427 - protein, 23 aa, Mycobacterium tuberculosis
EPFGLAWRLNRGSLLLWTVGLCL

SEQ ID NO: 1388428 - protein, 23 aa, Mycobacterium tuberculosis
EQAPAKAPPSPYPARALAGGLHT

SEQ ID NO: 1388429 - protein, 19 aa, Mycobacterium tuberculosis
EVRRQSRWRTAAFASAAAI

SEQ ID NO: 1388430 - protein, 30 aa, Mycobacterium tuberculosis; identical to SEQ ID NO: 162278

SEQ ID NO: 1388431 - protein, 28 aa, Mycobacterium tuberculosis
FERVITALLLVIAIGFTASFFVVTPPPN

SEQ ID NO: 1388432 - protein, 21 aa, Mycobacterium tuberculosis
FGAAMVGMLAAMVRLRHLIFK

SEQ ID NO: 1388433 - protein, 22 aa, Mycobacterium tuberculosis
FLAAAVLYFLAIGQVKGFAFTL

SEQ ID NO: 1388434 - protein, 22 aa, Mycobacterium tuberculosis
FMNGWYYLTRREDVLAALRNPK

SEQ ID NO: 1388435 - protein, 33 aa, Mycobacterium tuberculosis; identical to SEQ ID NO: 162322

SEQ ID NO: 1388436 - protein, 25 aa, Mycobacterium tuberculosis
FVDGHFSKWLNFTPTPLTAPVIGLI

SEQ ID NO: 1388437 - protein, 24 aa, Mycobacterium tuberculosis
GAAFVRRLVTLATTLLLGATTLSV

SEQ ID NO: 1388438 - protein, 19 aa, Mycobacterium tuberculosis
GALIGWLYDISIGTLVVVV

SEQ ID NO: 1388439 - protein, 17 aa, Mycobacterium tuberculosis
GAMYCLGFTRLPYFNTL

SEQ ID NO: 1388440 - protein, 21 aa, Mycobacterium tuberculosis
GAQLGIFLKGYKSLEATRAVD

SEQ ID NO: 1388441 - protein, 23 aa, Mycobacterium tuberculosis
GARALVVAILVFVLLGSFILPHT

SEQ ID NO: 1388442 - protein, 24 aa, Mycobacterium tuberculosis
GASLYALLVNRWPLPEAGVRSGLA

SEQ ID NO: 1388443 - protein, 17 aa, Mycobacterium tuberculosis
GATFCLSFARMPYFQTL

SEQ ID NO: 1388444 - protein, 17 aa, Mycobacterium tuberculosis
GDLRRYAVLAATLGLLV

SEQ ID NO: 1388445 - protein, 27 aa, Mycobacterium tuberculosis
GEPGLDWRWLVLWWESHAPHIANNLMN

SEQ ID NO: 1388446 - protein, 17 aa, Mycobacterium tuberculosis
GFPVLVPGQLVSKEIIY

SEQ ID NO: 1388447 - protein, 19 aa, Mycobacterium tuberculosis
GFSVLAIAMTWLLCEMAPG

SEQ ID NO: 1388448 - protein, 27 aa, Mycobacterium tuberculosis
GGASALGALLMLPGVRGLGPGPVTTGA

SEQ ID NO: 1388449 - protein, 21 aa, Mycobacterium tuberculosis
GGPLDCHLMKLEDLRPPERAQ

SEQ ID NO: 1388450 - protein, 18 aa, Mycobacterium tuberculosis
GLLLGRWIPGLHTALEGV

SEQ ID NO: 1388451 - protein, 39 aa, Mycobacterium tuberculosis; identical to SEQ ID NO: 162481

SEQ ID NO: 1388452 - protein, 20 aa, Mycobacterium tuberculosis
GPKCLVKVIQKLSGLSINRF

SEQ ID NO: 1388453 - protein, 19 aa, Mycobacterium tuberculosis
GPWVKWYPGIPGYIDQQWV

SEQ ID NO: 1388454 - protein, 26 aa, Mycobacterium tuberculosis
GRWSYGLFIWHLAALAMVFPVIGAFP

SEQ ID NO: 1388455 - protein, 29 aa, Mycobacterium tuberculosis
GSAAKLYPLLFLYPLLLLGIRAGRLNALA

SEQ ID NO: 1388456 - protein, 23 aa, Mycobacterium tuberculosis
GSFPSWVLYPCALAMMVFSKSFS

SEQ ID NO: 1388457 - protein, 32 aa, Mycobacterium tuberculosis; identical to SEQ ID NO: 162549

SEQ ID NO: 1388458 - protein, 32 aa, Mycobacterium tuberculosis
GSSALLCPLLVYGWLGLPRWGLTGSAVANLVG

SEQ ID NO: 1388459 - protein, 24 aa, Mycobacterium tuberculosis
GVEHLRWYDYPLAAALSLVVLFTL

SEQ ID NO: 1388460 - protein, 18 aa, Mycobacterium tuberculosis
HHFGAFYKRSWRANDWMW

SEQ ID NO: 1388461 - protein, 17 aa, Mycobacterium tuberculosis
HIVGLCIFGFLLAMLRG

SEQ ID NO: 1388462 - protein, 17 aa, Mycobacterium tuberculosis
HLHWLVLAMSVIVLLAV

SEQ ID NO: 1388463 - protein, 20 aa, Mycobacterium tuberculosis
HLILWDIGGALLATLYGLAN

SEQ ID NO: 1388464 - protein, 27 aa, Mycobacterium tuberculosis
HLQRARVPMPIIAVSSLLRSHAVTLND

SEQ ID NO: 1388465 - protein, 30 aa, Mycobacterium tuberculosis; identical to SEQ ID NO: 162627

SEQ ID NO: 1388466 - protein, 26 aa, Mycobacterium tuberculosis
HRRVVLIIYLWVGIVAFGAASSIFFN

SEQ ID NO: 1388467 - protein, 17 aa, Mycobacterium tuberculosis
HSAVYRGYTASVGRFVP

SEQ ID NO: 1388468 - protein, 18 aa, Mycobacterium tuberculosis
IAQLRWPVAIAVGPALTY

SEQ ID NO: 1388469 - protein, 17 aa, Mycobacterium tuberculosis
IFGFVWYSHSIFGLDSL

SEQ ID NO: 1388470 - protein, 31 aa, Mycobacterium tuberculosis
IGVLPVLALMVVAVWLLGVGTLKDLALVQLI

SEQ ID NO: 1388471 - protein, 29 aa, Mycobacterium tuberculosis
IIGNLLQMAFRFWAFRRWVFPDEFARNPD

SEQ ID NO: 1388472 - protein, 21 aa, Mycobacterium tuberculosis
IMIGLLFDTLVVRSYMTPALA

SEQ ID NO: 1388473 - protein, 26 aa, Mycobacterium tuberculosis
INPLTWPPAFFSWFAAGMLLAEWAYS

SEQ ID NO: 1388474 - protein, 26 aa, Mycobacterium tuberculosis
IPSPPRGVWYLGPLPVRAYAVCVITG

SEQ ID NO: 1388475 - protein, 32 aa, Mycobacterium tuberculosis; identical to SEQ ID NO: 162737

SEQ ID NO: 1388476 - protein, 21 aa, Mycobacterium tuberculosis
IRKRWDRYAAFAEKTFNVTIP

SEQ ID NO: 1388477 - protein, 27 aa, Mycobacterium tuberculosis
ITLSVMAIFYLRLPATFGIGTYGVSAD

SEQ ID NO: 1388478 - protein, 25 aa, Mycobacterium tuberculosis
ITMMAGLLVSLLVRRRRVWARITPT

SEQ ID NO: 1388479 - protein, 18 aa, Mycobacterium tuberculosis
KEHWLPAHFSGDGSTYMP

SEQ ID NO: 1388480 - protein, 18 aa, Mycobacterium tuberculosis
KLARVLVADGRRVVLGAA

SEQ ID NO: 1388481 - protein, 24 aa, Mycobacterium tuberculosis
KQFALVFLLVLFLAPTLNGWFFGV

SEQ ID NO: 1388482 - protein, 34 aa, Mycobacterium tuberculosis; identical to SEQ ID NO: 164761

SEQ ID NO: 1388483 - protein, 20 aa, Mycobacterium tuberculosis
KSWHMYPVGFLFGLGFDTAT

SEQ ID NO: 1388484 - protein, 18 aa, Mycobacterium tuberculosis
LAARHYFTYRDVLGFLYA

SEQ ID NO: 1388485 - protein, 29 aa, Mycobacterium tuberculosis
LACGWAFLIWGMYAYLWAFVLYAVQMTMV

SEQ ID NO: 1388486 - protein, 24 aa, Mycobacterium tuberculosis
LADQHAVLPLRPESLRRLDRVDAI

SEQ ID NO: 1388487 - protein, 25 aa, Mycobacterium tuberculosis
LAGTIVGYYILRRALRPDGGQLIGV

SEQ ID NO: 1388488 - protein, 20 aa, Mycobacterium tuberculosis
LAIWLRFNMATEALPARLIS

SEQ ID NO: 1388489 - protein, 19 aa, Mycobacterium tuberculosis
LAQTLLTRRHSPLVIATAL

SEQ ID NO: 1388490 - protein, 24 aa, Mycobacterium tuberculosis
LATRLTMITLIPTVAFMTVGGPAI

SEQ ID NO: 1388491 - protein, 19 aa, Mycobacterium tuberculosis
LERLRDFAVFKAIGVPTRS

SEQ ID NO: 1388492 - protein, 18 aa, Mycobacterium tuberculosis
LFSLSMLQSDIIGALFVL

SEQ ID NO: 1388493 - protein, 31 aa, Mycobacterium tuberculosis; identical to SEQ ID NO: 162919

SEQ ID NO: 1388494 - protein, 17 aa, Mycobacterium tuberculosis
LGAMVLPFLLGFRLTCY

SEQ ID NO: 1388495 - protein, 20 aa, Mycobacterium tuberculosis
LGLLLVTPNLVALAGFILLV

SEQ ID NO: 1388496 - protein, 23 aa, Mycobacterium tuberculosis
LGRRRTFLSGVLVFTIASGLCAV

SEQ ID NO: 1388497 - protein, 29 aa, Mycobacterium tuberculosis
LGVEEQYYVVWPLLLIGATLLLAARARRR

SEQ ID NO: 1388498 - protein, 26 aa, Mycobacterium tuberculosis
LGVHRIFLITVALALLTASPASAITP

SEQ ID NO: 1388499 - protein, 27 aa, Mycobacterium tuberculosis
LHDPPPCMTGFLPPPLVRSPADESVRE

SEQ ID NO: 1388500 - protein, 24 aa, Mycobacterium tuberculosis
LIALGLVVIVMVFASGLLAMFPIA

SEQ ID NO: 1388501 - protein, 22 aa, Mycobacterium tuberculosis
LIRARFPTLTARQVMQRIESTA

SEQ ID NO: 1388502 - protein, 25 aa, Mycobacterium tuberculosis
LLDNRPIGVLFKRIFDRPARRPVRR

SEQ ID NO: 1388503 - protein, 21 aa, Mycobacterium tuberculosis
LLRIASPMFHFGILVVIVGHG

SEQ ID NO: 1388504 - protein, 19 aa, Mycobacterium tuberculosis
LLVAIRREHISLRPLWGID

SEQ ID NO: 1388505 - protein, 34 aa, Mycobacterium tuberculosis
LLVVLGTWQVSGRLLFALLSFSVVGAVLALATPV

SEQ ID NO: 1388506 - protein, 17 aa, Mycobacterium tuberculosis
LPAIGFALSMAGLILLW

SEQ ID NO: 1388507 - protein, 37 aa, Mycobacterium tuberculosis; identical to SEQ ID NO: 163014

SEQ ID NO: 1388508 - protein, 22 aa, Mycobacterium tuberculosis
LRGRRAIMLPAGALVYIAVPPA

SEQ ID NO: 1388509 - protein, 27 aa, Mycobacterium tuberculosis
LSGIVPWWFVLTLLTRDALLAGTLPLL

SEQ ID NO: 1388510 - protein, 19 aa, Mycobacterium tuberculosis
LVATGFVVFALYCGISRIG

SEQ ID NO: 1388511 - protein, 18 aa, Mycobacterium tuberculosis
LVHAFSAPIGYLFRPYII

SEQ ID NO: 1388512 - protein, 25 aa, Mycobacterium tuberculosis
LWSVIPRLFVWPPARSIAQVLERLS

SEQ ID NO: 1388513 - protein, 31 aa, Mycobacterium tuberculosis; identical to SEQ ID NO: 163125

SEQ ID NO: 1388514 - protein, 40 aa, Mycobacterium tuberculosis; identical to SEQ ID NO: 163129

SEQ ID NO: 1388515 - protein, 28 aa, Mycobacterium tuberculosis
MDLATRPATFLWLIAATGTLLVATHRMD

SEQ ID NO: 1388516 - protein, 25 aa, Mycobacterium tuberculosis
MGEGEAMLFGEYIRLMALVEYSADE

SEQ ID NO: 1388517 - protein, 19 aa, Mycobacterium tuberculosis
MYCLGFTRLPYFNTLASPC

SEQ ID NO: 1388518 - protein, 24 aa, Mycobacterium tuberculosis
NTSTAWTYLLYVGGWVGGPMRLEY

SEQ ID NO: 1388519 - protein, 25 aa, Mycobacterium tuberculosis
PAPALLLTAPLLLTSIPLLYAGRSV

SEQ ID NO: 1388520 - protein, 22 aa, Mycobacterium tuberculosis
PASVPVWLVWHIPGGTVWAEEA

SEQ ID NO: 1388521 - protein, 17 aa, Mycobacterium tuberculosis
PDQPLLTGWLVRRTLLV

SEQ ID NO: 1388522 - protein, 42 aa, Mycobacterium tuberculosis; identical to SEQ ID NO: 163275

SEQ ID NO: 1388523 - protein, 19 aa, Mycobacterium tuberculosis
PFWGTSFSAAYVSGVAALV

SEQ ID NO: 1388524 - protein, 33 aa, Mycobacterium tuberculosis; identical to SEQ ID NO: 163291

SEQ ID NO: 1388525 - protein, 40 aa, Mycobacterium tuberculosis; identical to SEQ ID NO: 163322

SEQ ID NO: 1388526 - protein, 26 aa, Mycobacterium tuberculosis
PLMDVTLLRDRWGFQPAWNAEECLED

SEQ ID NO: 1388527 - protein, 30 aa, Mycobacterium tuberculosis; identical to SEQ ID NO: 163338

SEQ ID NO: 1388528 - protein, 26 aa, Mycobacterium tuberculosis
PPNAYDEYPVLPPIGLQAPQVPIPPP

SEQ ID NO: 1388529 - protein, 24 aa, Mycobacterium tuberculosis
PPPAFPVWPLWYAALAWLHVRQAG

SEQ ID NO: 1388530 - protein, 39 aa, Mycobacterium tuberculosis; identical to SEQ ID NO: 164484

SEQ ID NO: 1388531 - protein, 30 aa, Mycobacterium tuberculosis; identical to SEQ ID NO: 163349

SEQ ID NO: 1388532 - protein, 29 aa, Mycobacterium tuberculosis
PSAELFVAAYVPYVAWLVQASADSAAAAG

SEQ ID NO: 1388533 - protein, 27 aa, Mycobacterium tuberculosis
PSIAALLGKWFWWPQVVRQRPVPQPWP

SEQ ID NO: 1388534 - protein, 19 aa, Mycobacterium tuberculosis
QAFIFALLTILYFSQAMEL

SEQ ID NO: 1388535 - protein, 26 aa, Mycobacterium tuberculosis
QAVEGVGLWLLKRWGEYFAVVATSIF

SEQ ID NO: 1388536 - protein, 18 aa, Mycobacterium tuberculosis
QEDGPKLFRSLSIAFMSS

SEQ ID NO: 1388537 - protein, 17 aa, Mycobacterium tuberculosis
QFYTPWSWLPRIVTQFA

SEQ ID NO: 1388538 - protein, 30 aa, Mycobacterium tuberculosis; identical to SEQ ID NO: 163428

SEQ ID NO: 1388539 - protein, 25 aa, Mycobacterium tuberculosis
QLVSKEIIYFLAQLDVKEIHGYNPD

SEQ ID NO: 1388540 - protein, 20 aa, Mycobacterium tuberculosis
QMHLDAGQQVWLITATPYEL

SEQ ID NO: 1388541 - protein, 25 aa, Mycobacterium tuberculosis
QPVQRSVARFALIQALSAVLVGAGT

SEQ ID NO: 1388542 - protein, 19 aa, Mycobacterium tuberculosis
QQVWLITATPYELAATIAR

SEQ ID NO: 1388543 - protein, 32 aa, Mycobacterium tuberculosis; identical to SEQ ID NO: 163447

SEQ ID NO: 1388544 - protein, 26 aa, Mycobacterium tuberculosis
QVAMFAALGWFYLSVLPGWLGLEQTT

SEQ ID NO: 1388545 - protein, 27 aa, Mycobacterium tuberculosis
QVPGGAWVLGWRRPQAYPLMSHLAARG

SEQ ID NO: 1388546 - protein, 20 aa, Mycobacterium tuberculosis
RAQLVLTESGLRPGWHRVPG

SEQ ID NO: 1388547 - protein, 25 aa, Mycobacterium tuberculosis
RDLFSGFGWLAVVLLAVAAACAPPG

SEQ ID NO: 1388548 - protein, 18 aa, Mycobacterium tuberculosis
REVFSDFPDLEVCVYAAP

SEQ ID NO: 1388549 - protein, 17 aa, Mycobacterium tuberculosis
RGWEIRDFRIARKAARI

SEQ ID NO: 1388550 - protein, 22 aa, Mycobacterium tuberculosis
RHMGLFVVGRLAGRHGIRVGLR

SEQ ID NO: 1388551 - protein, 28 aa, Mycobacterium tuberculosis
RHYFTYRDVLGFLYAQAKFQLLGKENSN

SEQ ID NO: 1388552 - protein, 30 aa, Mycobacterium tuberculosis; identical to SEQ ID NO: 24984

SEQ ID NO: 1388553 - protein, 20 aa, Mycobacterium tuberculosis
RIMTIGIVLAALGVASAFAT

SEQ ID NO: 1388554 - protein, 25 aa, Mycobacterium tuberculosis
RKYTFRKRALIVMAVILVGSAAAAF

SEQ ID NO: 1388555 - protein, 27 aa, Mycobacterium tuberculosis
RLAAGVIRPQLRRAYLEEAVQRALVSI

SEQ ID NO: 1388556 - protein, 18 aa, Mycobacterium tuberculosis
RLDSLFRLDHLAARLRRN

SEQ ID NO: 1388557 - protein, 20 aa, Mycobacterium tuberculosis
RLIEMLTTLPKFPGLPGLPS

SEQ ID NO: 1388558 - protein, 27 aa, Mycobacterium tuberculosis
RLRRPIVVWWIVWIVSNAISMFAFATS

SEQ ID NO: 1388559 - protein, 18 aa, Mycobacterium tuberculosis
RMGGLAMFLGIVGAVFLA

SEQ ID NO: 1388560 - protein, 28 aa, Mycobacterium tuberculosis
RMMLGPNAADWPLILADASQPLTLEAMA

SEQ ID NO: 1388561 - protein, 35 aa, Mycobacterium tuberculosis; identical to SEQ ID NO: 163559

SEQ ID NO: 1388562 - protein, 34 aa, Mycobacterium tuberculosis
RNLLLEQLHYRHEVLYFKVLADHLPELMPVVYTP

SEQ ID NO: 1388563 - protein, 21 aa, Mycobacterium tuberculosis
RNWTIFSALVLLIPTVGSILL

SEQ ID NO: 1388564 - protein, 18 aa, Mycobacterium tuberculosis
RPFFVPDEPQRDPVAPLR

SEQ ID NO: 1388565 - protein, 17 aa, Mycobacterium tuberculosis
RRILPFVNRISGALLVV

SEQ ID NO: 1388566 - protein, 22 aa, Mycobacterium tuberculosis
RSDTRLYYTPEDPTYDPTVAQV

SEQ ID NO: 1388567 - protein, 19 aa, Mycobacterium tuberculosis
RSGIWQALLGSDAIYFEVA

SEQ ID NO: 1388568 - protein, 18 aa, Mycobacterium tuberculosis
RSNALQEWAYGRRFRYSE

SEQ ID NO: 1388569 - protein, 20 aa, Mycobacterium tuberculosis
RSPLRGPWLTSVFGLVLLVA

SEQ ID NO: 1388570 - protein, 27 aa, Mycobacterium tuberculosis
RTLRTDLWWLPPLLTNLGLLAFICYAT

SEQ ID NO: 1388571 - protein, 23 aa, Mycobacterium tuberculosis
RVGTAIVRWPGPVLAATCLVASI

SEQ ID NO: 1388572 - protein, 26 aa, Mycobacterium tuberculosis
RVRKYLTLMAFRVPALILAAIAYGAW

SEQ ID NO: 1388573 - protein, 27 aa, Mycobacterium tuberculosis
RYHAGVEQLLVFLPQGAAIAQTVLTPT

SEQ ID NO: 1388574 - protein, 27 aa, Mycobacterium tuberculosis
SAFFTPRFVRWFGLFTTHAIVAAALAS

SEQ ID NO: 1388575 - protein, 29 aa, Mycobacterium tuberculosis
SASAMLRRNLLIYGLGGLVVPFIGIKLVD

SEQ ID NO: 1388576 - protein, 30 aa, Mycobacterium tuberculosis; identical to SEQ ID NO: 164521

SEQ ID NO: 1388577 - protein, 25 aa, Mycobacterium tuberculosis
SDSLTTRYMPSGMTRWSPDSGETIA

SEQ ID NO: 1388578 - protein, 26 aa, Mycobacterium tuberculosis
SESQNFFIAPFMLLGLLSVLAVVASA

SEQ ID NO: 1388579 - protein, 18 aa, Mycobacterium tuberculosis
SEWVDKLRRQAETPLLLA

SEQ ID NO: 1388580 - protein, 24 aa, Mycobacterium tuberculosis
SGAVILFVYLLIALSQIVLRRQTS

SEQ ID NO: 1388581 - protein, 28 aa, Mycobacterium tuberculosis
SGFWIRRARRLLPALVLMVLTVSAARAL

SEQ ID NO: 1388582 - protein, 30 aa, Mycobacterium tuberculosis
SGGYTYPPGPPPPPYSYGGPFGGPSPRSSS

SEQ ID NO: 1388583 - protein, 26 aa, Mycobacterium tuberculosis
SGYSTVLAFWLGWPTSEVPGVYLGAS

SEQ ID NO: 1388584 - protein, 20 aa, Mycobacterium tuberculosis
SILLTPVLIRLFTKQGFGHQ

SEQ ID NO: 1388585 - protein, 17 aa, Mycobacterium tuberculosis
SIWMRLPTLAMALTCWW

SEQ ID NO: 1388586 - protein, 20 aa, Mycobacterium tuberculosis
SLIVVVVITLFISLAVYGAS

SEQ ID NO: 1388587 - protein, 28 aa, Mycobacterium tuberculosis
SLVSPRLPAPWRIPLQAGLGSVLVLVTR

SEQ ID NO: 1388588 - protein, 25 aa, Mycobacterium tuberculosis
SMVFGELVPKYLAVARPLRTARSVV

SEQ ID NO: 1388589 - protein, 20 aa, Mycobacterium tuberculosis
SRARRWLRTLRNIGVFGVNL

SEQ ID NO: 1388590 - protein, 25 aa, Mycobacterium tuberculosis
SRLCDLEQMIPLMPGAQLIGHEGDE

SEQ ID NO: 1388591 - protein, 19 aa, Mycobacterium tuberculosis
SRLYAWVTTLYLVGSVVAA

SEQ ID NO: 1388592 - protein, 17 aa, Mycobacterium tuberculosis
SSPTFMQWGWRIPFLVS

SEQ ID NO: 1388593 - protein, 21 aa, Mycobacterium tuberculosis
STHPPGTPLLKLVRELRADRG

SEQ ID NO: 1388594 - protein, 23 aa, Mycobacterium tuberculosis
SVGLQHQLSRLTNQAWPVSMTGG

SEQ ID NO: 1388595 - protein, 26 aa, Mycobacterium tuberculosis
SVLGNPLVWIERALVVLVAAAPCALA

SEQ ID NO: 1388596 - protein, 26 aa, Mycobacterium tuberculosis
SVSSWLLAWPMWADGAVFLLVSVLLL

SEQ ID NO: 1388597 - protein, 33 aa, Mycobacterium tuberculosis; identical to SEQ ID NO: 163820

SEQ ID NO: 1388598 - protein, 32 aa, Mycobacterium tuberculosis; identical to SEQ ID NO: 164535

SEQ ID NO: 1388599 - protein, 19 aa, Mycobacterium tuberculosis
TFCLSFARMPYFQTLGIPC

SEQ ID NO: 1388600 - protein, 25 aa, Mycobacterium tuberculosis
TGDVRRAMTMLLIACPCAVGLSTPT

SEQ ID NO: 1388601 - protein, 19 aa, Mycobacterium tuberculosis
TGMRLHHFGAFYKRSWRAN

SEQ ID NO: 1388602 - protein, 23 aa, Mycobacterium tuberculosis
TGSTGTTVLPFNGLYQPQGLAVD

SEQ ID NO: 1388603 - protein, 17 aa, Mycobacterium tuberculosis
TILAILALTAGTGVFVA

SEQ ID NO: 1388604 - protein, 22 aa, Mycobacterium tuberculosis
TLAVVFLAGWRWFPRDVHTAGS

SEQ ID NO: 1388605 - protein, 26 aa, Mycobacterium tuberculosis
TLGSTMGILTWIFVDGHFSKWLNFTP

SEQ ID NO: 1388606 - protein, 21 aa, Mycobacterium tuberculosis
TPRGFARLFGGQRPALQGQHL

SEQ ID NO: 1388607 - protein, 18 aa, Mycobacterium tuberculosis
TPTPGAAQLPLAPAINYP

SEQ ID NO: 1388608 - protein, 28 aa, Mycobacterium tuberculosis
TRHQVTGWRFVMRRIAAGIALHDTRMLV

SEQ ID NO: 1388609 - protein, 28 aa, Mycobacterium tuberculosis
TRNPEVWAWMVWLPHNLHDELFDACGWR

SEQ ID NO: 1388610 - protein, 25 aa, Mycobacterium tuberculosis
TRTSLKTSWYLLGPAFVAAIAYVDP

SEQ ID NO: 1388611 - protein, 28 aa, Mycobacterium tuberculosis
TSFSNKPLVFIFYLGAAIFIISSSAAGY

SEQ ID NO: 1388612 - protein, 23 aa, Mycobacterium tuberculosis
TTSTVLPFTGLNTPLAVAVDSDR

SEQ ID NO: 1388613 - protein, 26 aa, Mycobacterium tuberculosis
TVVVRWPGPVLAATLLIALIGLLALP

SEQ ID NO: 1388614 - protein, 18 aa, Mycobacterium tuberculosis
TWEMSFLYAIVFGGFVAF

SEQ ID NO: 1388615 - protein, 18 aa, Mycobacterium tuberculosis
VAVVAVLAVLTVVVTIAI

SEQ ID NO: 1388616 - protein, 18 aa, Mycobacterium tuberculosis
VCFLLIITIPFGFAALRI

SEQ ID NO: 1388617 - protein, 23 aa, Mycobacterium tuberculosis
VERFFAESWARLTAGRTARVVLL

SEQ ID NO: 1388618 - protein, 18 aa, Mycobacterium tuberculosis
VFDMLKRYHAGVEQLLVF

SEQ ID NO: 1388619 - protein, 21 aa, Mycobacterium tuberculosis
VFGAFAHRWLARRTRRRINPG

SEQ ID NO: 1388620 - protein, 18 aa, Mycobacterium tuberculosis
VFGGLWLALGYLLASLVC

SEQ ID NO: 1388621 - protein, 18 aa, Mycobacterium tuberculosis
VGDNFVWAYQRSEALADD

SEQ ID NO: 1388622 - protein, 17 aa, Mycobacterium tuberculosis
VGGLWPLLMEQFSVRPN

SEQ ID NO: 1388623 - protein, 21 aa, Mycobacterium tuberculosis
VIGSLVVVLALAAGIVGVRLY

SEQ ID NO: 1388624 - protein, 19 aa, Mycobacterium tuberculosis
VLALRALVLPWLLARAVGA

SEQ ID NO: 1388625 - protein, 31 aa, Mycobacterium tuberculosis; identical to SEQ ID NO: 164089

SEQ ID NO: 1388626 - protein, 17 aa, Mycobacterium tuberculosis
VLLSMAPLWFSSYILQL

SEQ ID NO: 1388627 - protein, 19 aa, Mycobacterium tuberculosis
VLRDVLINELQPGMDRSIR

SEQ ID NO: 1388628 - protein, 18 aa, Mycobacterium tuberculosis
VLSLLGMVLLMLGTGRLY

SEQ ID NO: 1388629 - protein, 22 aa, Mycobacterium tuberculosis
VLVGLGMRTWADGRTLLLGSPS

SEQ ID NO: 1388630 - protein, 31 aa, Mycobacterium tuberculosis; identical to SEQ ID NO: 164103

SEQ ID NO: 1388631 - protein, 18 aa, Mycobacterium tuberculosis
VRCTVLVTVLAIAAAVAG

SEQ ID NO: 1388632 - protein, 33 aa, Mycobacterium tuberculosis; identical to SEQ ID NO: 164579

SEQ ID NO: 1388633 - protein, 27 aa, Mycobacterium tuberculosis
VTSVSIPSWWQPYVLSVASLTSAGQPS

SEQ ID NO: 1388634 - protein, 25 aa, Mycobacterium tuberculosis
VVAHRLPWRVLTLSTWATAAAWAFS

SEQ ID NO: 1388635 - protein, 18 aa, Mycobacterium tuberculosis
VVSSPSWFSDYVLSVGAV

SEQ ID NO: 1388636 - protein, 25 aa, Mycobacterium tuberculosis
VVWVTSAYLLAYAVPMLVAGRLGDR

SEQ ID NO: 1388637 - protein, 31 aa, Mycobacterium tuberculosis; identical to SEQ ID NO: 164585

SEQ ID NO: 1388638 - protein, 19 aa, Mycobacterium tuberculosis
VWSLWSVMVLFMPTSVYGF

SEQ ID NO: 1388639 - protein, 21 aa, Mycobacterium tuberculosis
WAILAVVVIVLFGAKKLPDAA

SEQ ID NO: 1388640 - protein, 19 aa, Mycobacterium tuberculosis
WAQTPRKTNPWPLVAGAAA

SEQ ID NO: 1388641 - protein, 27 aa, Mycobacterium tuberculosis
WLLVNLPVMLLFPRGWSEFFRLNTRRG

SEQ ID NO: 1388642 - protein, 18 aa, Mycobacterium tuberculosis
WMRLPTLAMALTCWWVIS

SEQ ID NO: 1388643 - protein, 18 aa, Mycobacterium tuberculosis
WWDIWSLGLLVLIPAVVY

SEQ ID NO: 1388644 - protein, 23 aa, Mycobacterium tuberculosis
YAPLWRTAWRRLRQRPFQYILLV

SEQ ID NO: 1388645 - protein, 20 aa, Mycobacterium tuberculosis
YAYLAPWQLSAHRWYTWVIA

SEQ ID NO: 1388646 - protein, 17 aa, Mycobacterium tuberculosis
YIYIPFQYLSVVLGAYL

SEQ ID NO: 1388647 - protein, 28 aa, Mycobacterium tuberculosis
YLREFGNLVFHFALLGLLVAVAVGKLFG

SEQ ID NO: 1388648 - protein, 22 aa, Mycobacterium tuberculosis
YMANYYRWFGTPEAPFGWYYDL

SEQ ID NO: 1388649 - protein, 25 aa, Mycobacterium tuberculosis
AAGRARTLIYHRLAHGPAAAAVGLH

SEQ ID NO: 1388650 - protein, 30 aa, Mycobacterium tuberculosis; identical to SEQ ID NO: 161725

SEQ ID NO: 1388651 - protein, 18 aa, Mycobacterium tuberculosis
AARRAHAIGLWGAAAAIA

SEQ ID NO: 1388652 - protein, 32 aa, Mycobacterium tuberculosis; identical to SEQ ID NO: 164606

SEQ ID NO: 1388653 - protein, 25 aa, Mycobacterium tuberculosis
ADPVFLDWLVGLAFPCQRPFGHQYG

SEQ ID NO: 1388654 - protein, 18 aa, Mycobacterium tuberculosis
AECLLVTTYLLIATAAAL

SEQ ID NO: 1388655 - protein, 19 aa, Mycobacterium tuberculosis
AGLAFTLGMVLTSTLMVRP

SEQ ID NO: 1388656 - protein, 24 aa, Mycobacterium tuberculosis
AGQRRRLLLARAVLSPARIVLLDE

SEQ ID NO: 1388657 - protein, 23 aa, Mycobacterium tuberculosis
AHSPDLDWKSVWDHGWSAAAEAA

SEQ ID NO: 1388658 - protein, 18 aa, Mycobacterium tuberculosis
AIALLLMPVLGWANHRVG

SEQ ID NO: 1388659 - protein, 21 aa, Mycobacterium tuberculosis
AKVVLALQHDKLPPSINFAGP

SEQ ID NO: 1388660 - protein, 17 aa, Mycobacterium tuberculosis
ALGVLPPPGAGAPPWYA

SEQ ID NO: 1388661 - protein, 30 aa, Mycobacterium tuberculosis; identical to SEQ ID NO: 161890

SEQ ID NO: 1388662 - protein, 17 aa, Mycobacterium tuberculosis
AMPLGIWVFSPLRRRAT

SEQ ID NO: 1388663 - protein, 22 aa, Mycobacterium tuberculosis
ANRVFVTIILFSVTICGVLVAT

SEQ ID NO: 1388664 - protein, 22 aa, Mycobacterium tuberculosis
APPRLARVLRRAADLLALGADP

SEQ ID NO: 1388665 - protein, 23 aa, Mycobacterium tuberculosis
ARTAALNLFVVVEAFYLFSCRSL

SEQ ID NO: 1388666 - protein, 31 aa, Mycobacterium tuberculosis; identical to SEQ ID NO: 161949

SEQ ID NO: 1388667 - protein, 19 aa, Mycobacterium tuberculosis
ASFPLAFEPSFLPFTKGTA

SEQ ID NO: 1388668 - protein, 32 aa, Mycobacterium tuberculosis; identical to SEQ ID NO: 23415

SEQ ID NO: 1388669 - protein, 17 aa, Mycobacterium tuberculosis
ASMALTMALLAAAVLYA

SEQ ID NO: 1388670 - protein, 18 aa, Mycobacterium tuberculosis
ASRWLLRPTAAEALSTVA

SEQ ID NO: 1388671 - protein, 24 aa, Mycobacterium tuberculosis
ASVSPLIRWIIKVPREFINDYLFN

SEQ ID NO: 1388672 - protein, 23 aa, Mycobacterium tuberculosis
ASVVWFAVLGFSAGRLQPFFATP

SEQ ID NO: 1388673 - protein, 29 aa, Mycobacterium tuberculosis
AVSPPPIDERWLPESALPAPPRPTVQREV

SEQ ID NO: 1388674 - protein, 27 aa, Mycobacterium tuberculosis
AVVYGGLYFALYALQFFLPQLVASLAH

SEQ ID NO: 1388675 - protein, 19 aa, Mycobacterium tuberculosis
AYLIAKVCVYTVLAVVQSA

SEQ ID NO: 1388676 - protein, 20 aa, Mycobacterium tuberculosis
CRLLTVRRTLAWVRVESLQL

SEQ ID NO: 1388677 - protein, 24 aa, Mycobacterium tuberculosis
DAALAALGLWLSVAAVAGALLALT

SEQ ID NO: 1388678 - protein, 19 aa, Mycobacterium tuberculosis
DAVVIFGFLLWHVIGANSS

SEQ ID NO: 1388679 - protein, 23 aa, Mycobacterium tuberculosis
DLAPELAGFWTGGFVQAPFNTRI

SEQ ID NO: 1388680 - protein, 19 aa, Mycobacterium tuberculosis
DPGALRRLDRVRVVVIDGA

SEQ ID NO: 1388681 - protein, 24 aa, Mycobacterium tuberculosis
DPGNPLAILVPLTAAAMDLVAMGA

SEQ ID NO: 1388682 - protein, 20 aa, Mycobacterium tuberculosis
DSFDGYEYLFWVGCAGAYDD

SEQ ID NO: 1388683 - protein, 25 aa, Mycobacterium tuberculosis
EEAQIWAQITLPLAPDPYPGHNPDR

SEQ ID NO: 1388684 - protein, 17 aa, Mycobacterium tuberculosis
EEPTRTVYWSQPEPRWP

SEQ ID NO: 1388685 - protein, 22 aa, Mycobacterium tuberculosis
EFRPERFLGTRPQTYAWVPFGG

SEQ ID NO: 1388686 - protein, 20 aa, Mycobacterium tuberculosis
EIQANLLKRAVGPSLKWFDE

SEQ ID NO: 1388687 - protein, 21 aa, Mycobacterium tuberculosis
ELTPVAWWICGSATGVTVLYL

SEQ ID NO: 1388688 - protein, 26 aa, Mycobacterium tuberculosis
ESVAPSALRQSFLWGLAGVIAAEHPE

SEQ ID NO: 1388689 - protein, 37 aa, Mycobacterium tuberculosis; identical to SEQ ID NO: 162259

SEQ ID NO: 1388690 - protein, 24 aa, Mycobacterium tuberculosis
EWLEVLAMIALLPAAAALGGLFAW

SEQ ID NO: 1388691 - protein, 23 aa, Mycobacterium tuberculosis
FAAAGVVAVLAWIDRDRSPRLTA

SEQ ID NO: 1388692 - protein, 22 aa, Mycobacterium tuberculosis
FAAMLWTAIAIWIEPLRSTFDY

SEQ ID NO: 1388693 - protein, 17 aa, Mycobacterium tuberculosis
FAVCCVLSFVVGFAMLG

SEQ ID NO: 1388694 - protein, 18 aa, Mycobacterium tuberculosis
FFATAVFLGITTFAIIRI

SEQ ID NO: 1388695 - protein, 19 aa, Mycobacterium tuberculosis
FFAVSGFLLWRGHAAAARD

SEQ ID NO: 1388696 - protein, 25 aa, Mycobacterium tuberculosis
FGALLRVVYVALPPLHDQWRPVLWA

SEQ ID NO: 1388697 - protein, 31 aa, Mycobacterium tuberculosis; identical to SEQ ID NO: 162305

SEQ ID NO: 1388698 - protein, 17 aa, Mycobacterium tuberculosis
FIAGFLLHIVVKIPHMV

SEQ ID NO: 1388699 - protein, 18 aa, Mycobacterium tuberculosis
FKVFALVAALEQGIGLGY

SEQ ID NO: 1388700 - protein, 17 aa, Mycobacterium tuberculosis
FPQMLLNLEPFAHIPRV

SEQ ID NO: 1388701 - protein, 17 aa, Mycobacterium tuberculosis
FRYFITGGAPMPEALIK

SEQ ID NO: 1388702 - protein, 21 aa, Mycobacterium tuberculosis
FVLSGFLITSLLLDELGRTGR

SEQ ID NO: 1388703 - protein, 19 aa, Mycobacterium tuberculosis
FWAKVRRGALFRAAAVWLA

SEQ ID NO: 1388704 - protein, 32 aa, Mycobacterium tuberculosis; identical to SEQ ID NO: 162358

SEQ ID NO: 1388705 - protein, 22 aa, Mycobacterium tuberculosis
GADLRPVLLRAMTFMIVASPCA

SEQ ID NO: 1388706 - protein, 25 aa, Mycobacterium tuberculosis
GAFLSQLFGAILRPLGQPANEIIET

SEQ ID NO: 1388707 - protein, 24 aa, Mycobacterium tuberculosis
GALKKAVMLLGVLAVLVAMVGLAA

SEQ ID NO: 1388708 - protein, 25 aa, Mycobacterium tuberculosis
GAQFGYLLLWVIVAANVMAALVQYL

SEQ ID NO: 1388709 - protein, 22 aa, Mycobacterium tuberculosis
GASLLLYTSFLVVVYLATQRFS

SEQ ID NO: 1388710 - protein, 21 aa, Mycobacterium tuberculosis
GCGYEFRLETSCYNPSFGGMD

SEQ ID NO: 1388711 - protein, 25 aa, Mycobacterium tuberculosis
GETRQLLERLQPTVPILLANLVSVG

SEQ ID NO: 1388712 - protein, 24 aa, Mycobacterium tuberculosis
GFALFIFWLLLIARVVVEFIRSFS

SEQ ID NO: 1388713 - protein, 30 aa, Mycobacterium tuberculosis; identical to SEQ ID NO: 162435

SEQ ID NO: 1388714 - protein, 24 aa, Mycobacterium tuberculosis
GINIGFYMLMPYLADYLAGPLGLA

SEQ ID NO: 1388715 - protein, 18 aa, Mycobacterium tuberculosis
GIRDLWLDLGALTELLRD

SEQ ID NO: 1388716 - protein, 23 aa, Mycobacterium tuberculosis
GIVFTVAVIFFSGALVLGQGKCP

SEQ ID NO: 1388717 - protein, 18 aa, Mycobacterium tuberculosis
GIWVFSPLRRRATAALAV

SEQ ID NO: 1388718 - protein, 23 aa, Mycobacterium tuberculosis
GKSQLLNSLLNLPAARVGDDEAT

SEQ ID NO: 1388719 - protein, 17 aa, Mycobacterium tuberculosis
GLALAWLTTVWATSGLA

SEQ ID NO: 1388720 - protein, 24 aa, Mycobacterium tuberculosis
GLIGRLDGRVVRLGRPGWLDAAEL

SEQ ID NO: 1388721 - protein, 22 aa, Mycobacterium tuberculosis
GLRDRVTAYAPLLLTAQNVIDA

SEQ ID NO: 1388722 - protein, 21 aa, Mycobacterium tuberculosis
GLRQLYFLIDGLLDRLVYLSY

SEQ ID NO: 1388723 - protein, 25 aa, Mycobacterium tuberculosis
GLRSDAIAAFLWTANWRFVAQNTDY

SEQ ID NO: 1388724 - protein, 26 aa, Mycobacterium tuberculosis
GLVPGVVPPPWWWGVVFENWIVVASI

SEQ ID NO: 1388725 - protein, 29 aa, Mycobacterium tuberculosis
GMVAATLALIVIPLMFGADLRPVLLRAMT

SEQ ID NO: 1388726 - protein, 25 aa, Mycobacterium tuberculosis
GNTVLTLVLAFAAAALLWLVVEELL

SEQ ID NO: 1388727 - protein, 30 aa, Mycobacterium tuberculosis; identical to SEQ ID NO: 162510

SEQ ID NO: 1388728 - protein, 26 aa, Mycobacterium tuberculosis
GPRDLEPFRCFYLSAPFVVPKKKEVA

SEQ ID NO: 1388729 - protein, 17 aa, Mycobacterium tuberculosis
GRKPIFLVGFAVLTARG

SEQ ID NO: 1388730 - protein, 19 aa, Mycobacterium tuberculosis
GRLAWLFVGPVVAFPAFGY

SEQ ID NO: 1388731 - protein, 21 aa, Mycobacterium tuberculosis
GTGRYLLVQTLLVLTWIVLNL

SEQ ID NO: 1388732 - protein, 20 aa, Mycobacterium tuberculosis
GVRMWLFPGLSIVTVTGIVA

SEQ ID NO: 1388733 - protein, 25 aa, Mycobacterium tuberculosis
GWEVDPYAIPLLQTAHRTGARVVLR

SEQ ID NO: 1388734 - protein, 18 aa, Mycobacterium tuberculosis
GYDVLPQTRWIPVVTFVQ

SEQ ID NO: 1388735 - protein, 18 aa, Mycobacterium tuberculosis
HAIGLWGAAAAIAAGLGP

SEQ ID NO: 1388736 - protein, 29 aa, Mycobacterium tuberculosis
HFIDAIICFVGFLFPLWDAKRQTLADKIM

SEQ ID NO: 1388737 - protein, 30 aa, Mycobacterium tuberculosis; identical to SEQ ID NO: 162643

SEQ ID NO: 1388738 - protein, 33 aa, Mycobacterium tuberculosis; identical to SEQ ID NO: 162656

SEQ ID NO: 1388739 - protein, 26 aa, Mycobacterium tuberculosis
IESEARRMTLLVDELLLLSRLSEGED

SEQ ID NO: 1388740 - protein, 17 aa, Mycobacterium tuberculosis
IGRTLLGLAATAVTAVL

SEQ ID NO: 1388741 - protein, 20 aa, Mycobacterium tuberculosis
IRALTTAPVPIVAGFMAAVF

SEQ ID NO: 1388742 - protein, 25 aa, Mycobacterium tuberculosis
IVASFLNIDVPLQALSRLPLLSIDG

SEQ ID NO: 1388743 - protein, 23 aa, Mycobacterium tuberculosis
IVGVPWLLSFAQPSIWQIGRPWY

SEQ ID NO: 1388744 - protein, 23 aa, Mycobacterium tuberculosis
IWGVLGLVVFGALLFGPAGTFDY

SEQ ID NO: 1388745 - protein, 23 aa, Mycobacterium tuberculosis
IYLVLGMIILTPPLLREWTHYDS

SEQ ID NO: 1388746 - protein, 21 aa, Mycobacterium tuberculosis
KEPPPPLPPDLPPNVRELIEI

SEQ ID NO: 1388747 - protein, 27 aa, Mycobacterium tuberculosis
KGVQTGLLWPAIFVAAFAALGLAVALV

SEQ ID NO: 1388748 - protein, 27 aa, Mycobacterium tuberculosis
KMSLNTSYYRLMLKLNGGPQAVADAAH

SEQ ID NO: 1388749 - protein, 26 aa, Mycobacterium tuberculosis
KTLVSTTFVVPYPPGFPVLVPGQLVS

SEQ ID NO: 1388750 - protein, 21 aa, Mycobacterium tuberculosis
KTTLLMTLAGLLPPVHGRVLL

SEQ ID NO: 1388751 - protein, 31 aa, Mycobacterium tuberculosis; identical to SEQ ID NO: 162874

SEQ ID NO: 1388752 - protein, 22 aa, Mycobacterium tuberculosis
LDAAPAVLPPMGPKLGLKAQRR

SEQ ID NO: 1388753 - protein, 20 aa, Mycobacterium tuberculosis
LDAPDFRYFITGGAPMPEAL

SEQ ID NO: 1388754 - protein, 24 aa, Mycobacterium tuberculosis
LDYLQGAVWVLPTFGVAIGLGSGA

SEQ ID NO: 1388755 - protein, 19 aa, Mycobacterium tuberculosis
LGFGGMSEVHLARDLRLHR

SEQ ID NO: 1388756 - protein, 30 aa, Mycobacterium tuberculosis; identical to SEQ ID NO: 162965

SEQ ID NO: 1388757 - protein, 17 aa, Mycobacterium tuberculosis
LLHIVVKIPHMVTGLRS

SEQ ID NO: 1388758 - protein, 19 aa, Mycobacterium tuberculosis
LLQKVLDLPAGQLPPEPPI

SEQ ID NO: 1388759 - protein, 18 aa, Mycobacterium tuberculosis
LPSIGGSKTLWRAVSVRA

SEQ ID NO: 1388760 - protein, 21 aa, Mycobacterium tuberculosis
LRATLFVIALGFLVQITGINA

SEQ ID NO: 1388761 - protein, 23 aa, Mycobacterium tuberculosis
LRSGSPILFYPAGALAITVLAFM

SEQ ID NO: 1388762 - protein, 30 aa, Mycobacterium tuberculosis; identical to SEQ ID NO: 163055

SEQ ID NO: 1388763 - protein, 17 aa, Mycobacterium tuberculosis
LTYVRRYYGGRIAHLVQ

SEQ ID NO: 1388764 - protein, 18 aa, Mycobacterium tuberculosis
LVAAVLPPLLKKLRIDPA

SEQ ID NO: 1388765 - protein, 18 aa, Mycobacterium tuberculosis
LVELIPKAALAGLLIVIG

SEQ ID NO: 1388766 - protein, 19 aa, Mycobacterium tuberculosis
LVIMDLRDHWMAKAPYILG

SEQ ID NO: 1388767 - protein, 57 aa, Mycobacterium tuberculosis
LVNYVYGGLRRPWRPRTFLRAISQTLRLSYMALFSVPVVAPLLLRVALSSAAVRRNM

SEQ ID NO: 1388768 - protein, 17 aa, Mycobacterium tuberculosis
LVQLLGRINAELAVYTG

SEQ ID NO: 1388769 - protein, 19 aa, Mycobacterium tuberculosis
LVQTLLVLTWIVLNLFAVG

SEQ ID NO: 1388770 - protein, 18 aa, Mycobacterium tuberculosis
LVRHGFWRVLGIRLLTVL

SEQ ID NO: 1388771 - protein, 23 aa, Mycobacterium tuberculosis
LVVAVLLNYPFSRYDSMALAAFD

SEQ ID NO: 1388772 - protein, 19 aa, Mycobacterium tuberculosis
LWSGRVFAEARWLSVALLS

SEQ ID NO: 1388773 - protein, 21 aa, Mycobacterium tuberculosis
MALTMALLAAAVLYASVAVAD

SEQ ID NO: 1388774 - protein, 17 aa, Mycobacterium tuberculosis
MRRLIPASWRTFTLTDA

SEQ ID NO: 1388775 - protein, 26 aa, Mycobacterium tuberculosis
NANPFALLLVALLGPIAATVIRMAVS

SEQ ID NO: 1388776 - protein, 24 aa, Mycobacterium tuberculosis
NDIEQLLVVFPMAIAAEQAGILAN

SEQ ID NO: 1388777 - protein, 28 aa, Mycobacterium tuberculosis
NDNGPPPPFTSWMPPGYPPEPPQVPYPA

SEQ ID NO: 1388778 - protein, 18 aa, Mycobacterium tuberculosis
NDYTVGLLLLVATALVAC

SEQ ID NO: 1388779 - protein, 22 aa, Mycobacterium tuberculosis
NKDAWMVGYTPSLSTAVWVGTV

SEQ ID NO: 1388780 - protein, 24 aa, Mycobacterium tuberculosis
PAGPLPYIVMEYVDGVTLRDIVHT

SEQ ID NO: 1388781 - protein, 25 aa, Mycobacterium tuberculosis
PAGVEELLRINLSFADGLPRLATAD

SEQ ID NO: 1388782 - protein, 22 aa, Mycobacterium tuberculosis
PAPTHRPLLVIPSRNLRDHDEL

SEQ ID NO: 1388783 - protein, 19 aa, Mycobacterium tuberculosis
PDFPLPFTYPPFAAVVFYP

SEQ ID NO: 1388784 - protein, 24 aa, Mycobacterium tuberculosis
PDIDPEILPHLFDRFVRASKSRSN

SEQ ID NO: 1388785 - protein, 33 aa, Mycobacterium tuberculosis; identical to SEQ ID NO: 163287

SEQ ID NO: 1388786 - protein, 22 aa, Mycobacterium tuberculosis
PGQSWVLVFAITMMAGLLVSLL

SEQ ID NO: 1388787 - protein, 21 aa, Mycobacterium tuberculosis
PGYTEFAVRLPLDGWQPLESS

SEQ ID NO: 1388788 - protein, 34 aa, Mycobacterium tuberculosis; identical to SEQ ID NO: 163312

SEQ ID NO: 1388789 - protein, 26 aa, Mycobacterium tuberculosis
PKVGPWALYGLLFTIVILFALQGDQI

SEQ ID NO: 1388790 - protein, 20 aa, Mycobacterium tuberculosis
PLAPWAVVLVAAAGATYLLT

SEQ ID NO: 1388791 - protein, 28 aa, Mycobacterium tuberculosis
PLTTAFAYLLLPQVLVYGLSSVFMAILN

SEQ ID NO: 1388792 - protein, 21 aa, Mycobacterium tuberculosis
PMLRILVRRHRLVGTLPLVSP

SEQ ID NO: 1388793 - protein, 22 aa, Mycobacterium tuberculosis
PSGRHWHRKSPVPMLPVVAVAD

SEQ ID NO: 1388794 - protein, 21 aa, Mycobacterium tuberculosis
PTRTVYWSQPEPRWPKSPPQD

SEQ ID NO: 1388795 - protein, 34 aa, Mycobacterium tuberculosis; identical to SEQ ID NO: 163380

SEQ ID NO: 1388796 - protein, 24 aa, Mycobacterium tuberculosis
PVTRRAVLTLYPHCAPKIGVPSQN

SEQ ID NO: 1388797 - protein, 25 aa, Mycobacterium tuberculosis
PVTTGPVWVLAGFGAQHRKMGKSLY

SEQ ID NO: 1388798 - protein, 19 aa, Mycobacterium tuberculosis
PYQPQLGVPTAWLVAPVEA

SEQ ID NO: 1388799 - protein, 22 aa, Mycobacterium tuberculosis
QDYANIPPTRFKRKEHWLPAHF

SEQ ID NO: 1388800 - protein, 31 aa, Mycobacterium tuberculosis; identical to SEQ ID NO: 163405

SEQ ID NO: 1388801 - protein, 30 aa, Mycobacterium tuberculosis; identical to SEQ ID NO: 163432

SEQ ID NO: 1388802 - protein, 27 aa, Mycobacterium tuberculosis
QNAQPGKFMPLLPTQQQAPVPPPPPDD

SEQ ID NO: 1388803 - protein, 23 aa, Mycobacterium tuberculosis
QPAPVVAAWLAVLLAVSVPAGPR

SEQ ID NO: 1388804 - protein, 25 aa, Mycobacterium tuberculosis
QPIRSTWWIRHYTFTGTAMGLVFVW

SEQ ID NO: 1388805 - protein, 20 aa, Mycobacterium tuberculosis
QVTIFAIQIALGELLRHHGA

SEQ ID NO: 1388806 - protein, 17 aa, Mycobacterium tuberculosis
RAVLRDVLINELQPGMD

SEQ ID NO: 1388807 - protein, 22 aa, Mycobacterium tuberculosis
RGRATLYLTYWTAGDTRNRGRE

SEQ ID NO: 1388808 - protein, 24 aa, Mycobacterium tuberculosis
RILGWGWLVLTIVGVPWLLSFAQP

SEQ ID NO: 1388809 - protein, 21 aa, Mycobacterium tuberculosis
RLLTMWSTVLVLALSVICEPV

SEQ ID NO: 1388810 - protein, 26 aa, Mycobacterium tuberculosis
RLMTPLRVMFAIALVFLALGWSTKAA

SEQ ID NO: 1388811 - protein, 17 aa, Mycobacterium tuberculosis
RLVDVIGCSLRLPGIYP

SEQ ID NO: 1388812 - protein, 17 aa, Mycobacterium tuberculosis
RPIPVFGSDELARLTEA

SEQ ID NO: 1388813 - protein, 18 aa, Mycobacterium tuberculosis
RRLLPLLFVLYVINFVDR

SEQ ID NO: 1388814 - protein, 22 aa, Mycobacterium tuberculosis
RTDYGLPVREPGARLVPGAAVP

SEQ ID NO: 1388815 - protein, 21 aa, Mycobacterium tuberculosis
RWDPYPFILLNLAFSTQASYA

SEQ ID NO: 1388816 - protein, 22 aa, Mycobacterium tuberculosis
RYRLLIFHGGVPPLQFWQALDT

SEQ ID NO: 1388817 - protein, 37 aa, Mycobacterium tuberculosis; identical to SEQ ID NO: 164517

SEQ ID NO: 1388818 - protein, 17 aa, Mycobacterium tuberculosis
SAGAALCLPLARALRRP

SEQ ID NO: 1388819 - protein, 17 aa, Mycobacterium tuberculosis
SAILSITVLPACLGILG

SEQ ID NO: 1388820 - protein, 22 aa, Mycobacterium tuberculosis
SAYFAGGLSLRDATRAICSRSH

SEQ ID NO: 1388821 - protein, 18 aa, Mycobacterium tuberculosis
SDRRALHTAFAGAAICLL

SEQ ID NO: 1388822 - protein, 27 aa, Mycobacterium tuberculosis
SFTGAGIWLGIAAFAAAGVVAVLAWID

SEQ ID NO: 1388823 - protein, 23 aa, Mycobacterium tuberculosis
SGANAYLLPARNWSVMAATEVRS

SEQ ID NO: 1388824 - protein, 25 aa, Mycobacterium tuberculosis
SGTLSWCSPLGWSLQVRPYAGERWW

SEQ ID NO: 1388825 - protein, 21 aa, Mycobacterium tuberculosis
SLSMRSLRYRALDFGLDVGRA

SEQ ID NO: 1388826 - protein, 17 aa, Mycobacterium tuberculosis
SMLAFSGRFGRARKITW

SEQ ID NO: 1388827 - protein, 17 aa, Mycobacterium tuberculosis
STLIGRTLLGLAATAVT

SEQ ID NO: 1388828 - protein, 20 aa, Mycobacterium tuberculosis
SVERLIAAHLMDPAPQPSQL

SEQ ID NO: 1388829 - protein, 30 aa, Mycobacterium tuberculosis; identical to SEQ ID NO: 163811

SEQ ID NO: 1388830 - protein, 21 aa, Mycobacterium tuberculosis
TAAVQLPAVWLLSAVTVGLFG

SEQ ID NO: 1388831 - protein, 17 aa, Mycobacterium tuberculosis
TAVALVAVGLTLALGLG

SEQ ID NO: 1388832 - protein, 19 aa, Mycobacterium tuberculosis
TDDLRPIPVFGSDELARLT

SEQ ID NO: 1388833 - protein, 23 aa, Mycobacterium tuberculosis
TDGRNILPPNKFPYIPPGADPDP

SEQ ID NO: 1388834 - protein, 30 aa, Mycobacterium tuberculosis; identical to SEQ ID NO: 163841

SEQ ID NO: 1388835 - protein, 37 aa, Mycobacterium tuberculosis; identical to SEQ ID NO: 163852

SEQ ID NO: 1388836 - protein, 22 aa, Mycobacterium tuberculosis
TGVTVLYLAYLRRQTRIEEKVR

SEQ ID NO: 1388837 - protein, 17 aa, Mycobacterium tuberculosis
TIPAIPYEQLEELDDEG

SEQ ID NO: 1388838 - protein, 25 aa, Mycobacterium tuberculosis
TLAQLAPFVLLVELSRLLVSGAGAH

SEQ ID NO: 1388839 - protein, 17 aa, Mycobacterium tuberculosis
TTVFFSPGNEQAAATVA

SEQ ID NO: 1388840 - protein, 21 aa, Mycobacterium tuberculosis
TVAASLLAGLLAHVADRLLGL

SEQ ID NO: 1388841 - protein, 27 aa, Mycobacterium tuberculosis
TVAPTTLAILMLLPLSAFEATVALPAA

SEQ ID NO: 1388842 - protein, 19 aa, Mycobacterium tuberculosis
TVGLLLLVATALVACTYTA

SEQ ID NO: 1388843 - protein, 36 aa, Mycobacterium tuberculosis
TVIAVGVLAITFLHFVRLPAMLFGVGRYTVTMELVE

SEQ ID NO: 1388844 - protein, 26 aa, Mycobacterium tuberculosis
TYGDFQNFYLCDLQIKWNGFQAGGPV

SEQ ID NO: 1388845 - protein, 17 aa, Mycobacterium tuberculosis
VAEMRKVIWPNRKQMLT

SEQ ID NO: 1388846 - protein, 26 aa, Mycobacterium tuberculosis
VDSGTWLAWAAWAALGLGVVALVVTK

SEQ ID NO: 1388847 - protein, 25 aa, Mycobacterium tuberculosis
VDVVYQFIPVLKANGYRLVTVSELL

SEQ ID NO: 1388848 - protein, 17 aa, Mycobacterium tuberculosis
VEPGPDRRPITAVALVA

SEQ ID NO: 1388849 - protein, 22 aa, Mycobacterium tuberculosis
VGLLGAALQRLPGRCWPVAATA

SEQ ID NO: 1388850 - protein, 33 aa, Mycobacterium tuberculosis; identical to SEQ ID NO: 164055

SEQ ID NO: 1388851 - protein, 17 aa, Mycobacterium tuberculosis
VIVTSLSMVFGELVPKY

SEQ ID NO: 1388852 - protein, 25 aa, Mycobacterium tuberculosis
VNLTALSLIALLVGIFLIYNTVTFN

SEQ ID NO: 1388853 - protein, 18 aa, Mycobacterium tuberculosis
VNWLIPVVQIGAAVAALG

SEQ ID NO: 1388854 - protein, 18 aa, Mycobacterium tuberculosis
VRELIEITLVKNPAMRYR

SEQ ID NO: 1388855 - protein, 21 aa, Mycobacterium tuberculosis
VTAPLVPLAVSAFLTSRKKAA

SEQ ID NO: 1388856 - protein, 31 aa, Mycobacterium tuberculosis; identical to SEQ ID NO: 164174

SEQ ID NO: 1388857 - protein, 18 aa, Mycobacterium tuberculosis
VVSIFLLRHVVSGRQLVT

SEQ ID NO: 1388858 - protein, 29 aa, Mycobacterium tuberculosis
VWAGGFTMFTMIPLGVLLGALVAFVIFGR

SEQ ID NO: 1388859 - protein, 26 aa, Mycobacterium tuberculosis
WAETTVIIRFWLLTAITCGLGVALFY

SEQ ID NO: 1388860 - protein, 18 aa, Mycobacterium tuberculosis
WCVTAIIGAFAARHGYRQ

SEQ ID NO: 1388861 - protein, 20 aa, Mycobacterium tuberculosis
WPVDRPFAMLTVARSLMLDV

SEQ ID NO: 1388862 - protein, 19 aa, Mycobacterium tuberculosis
YGRMRLGDFWGYLAGWGFV

SEQ ID NO: 1388863 - protein, 23 aa, Mycobacterium tuberculosis
YTWLLVALPLAGAAILLFGGRRT

SEQ ID NO: 1388864 - protein, 18 aa, Mycobacterium tuberculosis
AAAMVLYVLISQLGLVVG

SEQ ID NO: 1388865 - protein, 27 aa, Mycobacterium tuberculosis
AAATFVIGWQLVGFIWATVAGSVAWLI

SEQ ID NO: 1388866 - protein, 27 aa, Mycobacterium tuberculosis
AAWTAAGMFLAVWLPLDNGLRPEPIIA

SEQ ID NO: 1388867 - protein, 39 aa, Mycobacterium tuberculosis; identical to SEQ ID NO: 161772

SEQ ID NO: 1388868 - protein, 25 aa, Mycobacterium tuberculosis
AESRLNRLLAQQIPPARKVLAGADD

SEQ ID NO: 1388869 - protein, 18 aa, Mycobacterium tuberculosis
AGVTAYEILKKAAAKAPL

SEQ ID NO: 1388870 - protein, 18 aa, Mycobacterium tuberculosis
AGVWMRLPATLAGIACWL

SEQ ID NO: 1388871 - protein, 26 aa, Mycobacterium tuberculosis
AIIGLERQWRARMAGLRTNALVATGA

SEQ ID NO: 1388872 - protein, 30 aa, Mycobacterium tuberculosis
AIVLLTADLSLAVAWPLAAVVRGHDWGTDS

SEQ ID NO: 1388873 - protein, 17 aa, Mycobacterium tuberculosis
ALGVLVLLFSPPSIRWA

SEQ ID NO: 1388874 - protein, 35 aa, Mycobacterium tuberculosis; identical to SEQ ID NO: 161878

SEQ ID NO: 1388875 - protein, 18 aa, Mycobacterium tuberculosis
AMALWLGAGPSVVRARAG

SEQ ID NO: 1388876 - protein, 21 aa, Mycobacterium tuberculosis
AMRAMFGTRLLPREYADDFED

SEQ ID NO: 1388877 - protein, 18 aa, Mycobacterium tuberculosis
ANDLLPPGGLIPLSRTSP

SEQ ID NO: 1388878 - protein, 25 aa, Mycobacterium tuberculosis
AQPPKPRVFAIKPPCPEPAAADPTD

SEQ ID NO: 1388879 - protein, 23 aa, Mycobacterium tuberculosis
ARFLNRNLGWLFLFKQGNVSLAG

SEQ ID NO: 1388880 - protein, 17 aa, Mycobacterium tuberculosis
ASSLFRVSKLNCSITTS

SEQ ID NO: 1388881 - protein, 37 aa, Mycobacterium tuberculosis; identical to SEQ ID NO: 162000

SEQ ID NO: 1388882 - protein, 17 aa, Mycobacterium tuberculosis
AVGVGCGAIIGLERQWR

SEQ ID NO: 1388883 - protein, 25 aa, Mycobacterium tuberculosis
AVLAIIFGPPLLVIASPFVLTGSVI

SEQ ID NO: 1388884 - protein, 17 aa, Mycobacterium tuberculosis
AVPLVPVRLLPPGLETR

SEQ ID NO: 1388885 - protein, 33 aa, Mycobacterium tuberculosis
AWSMLIVVLFVPAALPWYYSWPLAVAAPLAQAR

SEQ ID NO: 1388886 - protein, 25 aa, Mycobacterium tuberculosis
AYRTTIFAFPVFGFGVIFGAIWAEE

SEQ ID NO: 1388887 - protein, 21 aa, Mycobacterium tuberculosis
DATAWLMRRSLQFGALTAEEL

SEQ ID NO: 1388888 - protein, 21 aa, Mycobacterium tuberculosis
DDAIMFEPRYAVRQPDGGWGE

SEQ ID NO: 1388889 - protein, 26 aa, Mycobacterium tuberculosis
DGMRHRRFLPARWWSTGGLDTLVIAV

SEQ ID NO: 1388890 - protein, 21 aa, Mycobacterium tuberculosis
DLAAAVRILSALPVARAASES

SEQ ID NO: 1388891 - protein, 27 aa, Mycobacterium tuberculosis
DLAELLAMRGIDGLPFSWTVASWTQHS

SEQ ID NO: 1388892 - protein, 22 aa, Mycobacterium tuberculosis
DPQQRMALELTWEALEHARIPA

SEQ ID NO: 1388893 - protein, 29 aa, Mycobacterium tuberculosis
DRSAPLSRRSLLIGNAVVAFAVIGFASLA

SEQ ID NO: 1388894 - protein, 21 aa, Mycobacterium tuberculosis
DVSIRWQLKQAAAPELFQQYK

SEQ ID NO: 1388895 - protein, 30 aa, Mycobacterium tuberculosis; identical to SEQ ID NO: 162172

SEQ ID NO: 1388896 - protein, 26 aa, Mycobacterium tuberculosis
DYSFLSYYPYWGFQGLTPHYANPLAQ

SEQ ID NO: 1388897 - protein, 24 aa, Mycobacterium tuberculosis
EGALLAALIRRPSTLDPAVDPEGA

SEQ ID NO: 1388898 - protein, 30 aa, Mycobacterium tuberculosis; identical to SEQ ID NO: 162197

SEQ ID NO: 1388899 - protein, 28 aa, Mycobacterium tuberculosis
ELDRTLLLWMLPLLIAPPMYSKDVYSYL

SEQ ID NO: 1388900 - protein, 19 aa, Mycobacterium tuberculosis
ELFATIGVTFFGAGVISTG

SEQ ID NO: 1388901 - protein, 26 aa, Mycobacterium tuberculosis
EPVDHLLGHSLPLFGLAGLPSYDRWD

SEQ ID NO: 1388902 - protein, 26 aa, Mycobacterium tuberculosis
EREPRNIWVMIGVPALIVALIGTIVM

SEQ ID NO: 1388903 - protein, 42 aa, Mycobacterium tuberculosis; identical to SEQ ID NO: 164687

SEQ ID NO: 1388904 - protein, 26 aa, Mycobacterium tuberculosis
EVTAEYQSWRVVWGSAAALLTVGVGI

SEQ ID NO: 1388905 - protein, 24 aa, Mycobacterium tuberculosis
FANHKKWIDLIIHIGQEGRGANVF

SEQ ID NO: 1388906 - protein, 28 aa, Mycobacterium tuberculosis
FATLISRITGFARIVLLAAILGAALASS

SEQ ID NO: 1388907 - protein, 21 aa, Mycobacterium tuberculosis
FEKLRDLVINAPARLDLLTQQ

SEQ ID NO: 1388908 - protein, 17 aa, Mycobacterium tuberculosis
FGAFLAFLDSTIVNIAF

SEQ ID NO: 1388909 - protein, 24 aa, Mycobacterium tuberculosis
FGAKSVEFIPPKTPSPKPLSPNAH

SEQ ID NO: 1388910 - protein, 22 aa, Mycobacterium tuberculosis
FLWILSVAFASMIALATLLTLI

SEQ ID NO: 1388911 - protein, 23 aa, Mycobacterium tuberculosis
FMTLDRWLLFNWMRWGRALEYLK

SEQ ID NO: 1388912 - protein, 17 aa, Mycobacterium tuberculosis
FNPLDPRNLDVSPLPSL

SEQ ID NO: 1388913 - protein, 27 aa, Mycobacterium tuberculosis
FPPMGSILYWMRFGTIRLPPWPDRVPW

SEQ ID NO: 1388914 - protein, 19 aa, Mycobacterium tuberculosis
FVVGDLMFVPGVPGVAQGA

SEQ ID NO: 1388915 - protein, 21 aa, Mycobacterium tuberculosis
GDDCWWAPRWARRLQTRIGLG

SEQ ID NO: 1388916 - protein, 29 aa, Mycobacterium tuberculosis
GFADFPKYPLNILADVNALLGIYYSHSLY

SEQ ID NO: 1388917 - protein, 22 aa, Mycobacterium tuberculosis
GFVLATQYWLVTSAGPMLVLLA

SEQ ID NO: 1388918 - protein, 27 aa, Mycobacterium tuberculosis
GGRLAPRPVFRPPVDPASRQAFGRPSG

SEQ ID NO: 1388919 - protein, 24 aa, Mycobacterium tuberculosis
GIMWPSLLVILLLVAVVALLFTGR

SEQ ID NO: 1388920 - protein, 27 aa, Mycobacterium tuberculosis
GISPCILPVLPVIFFSGAQSVDAAQVA

SEQ ID NO: 1388921 - protein, 23 aa, Mycobacterium tuberculosis
GIVFRVQQELGVPVKLVGLGEGP

SEQ ID NO: 1388922 - protein, 37 aa, Mycobacterium tuberculosis; identical to SEQ ID NO: 162471

SEQ ID NO: 1388923 - protein, 17 aa, Mycobacterium tuberculosis
GLGIMRYGVRSEPLHSM

SEQ ID NO: 1388924 - protein, 77 aa, Mycobacterium tuberculosis; identical to SEQ ID NO: 162476

SEQ ID NO: 1388925 - protein, 24 aa, Mycobacterium tuberculosis
GLQAPQVPIPPPPPGPDVIPGPVP

SEQ ID NO: 1388926 - protein, 27 aa, Mycobacterium tuberculosis
GLVLIKWWLLAIPHYLILAVFLSSGWR

SEQ ID NO: 1388927 - protein, 22 aa, Mycobacterium tuberculosis
GQALRDFILEQRKIRDIAKVVN

SEQ ID NO: 1388928 - protein, 24 aa, Mycobacterium tuberculosis
GRGANVFFMLGGQRLDLSSLQKVK

SEQ ID NO: 1388929 - protein, 33 aa, Mycobacterium tuberculosis; identical to SEQ ID NO: 162543

SEQ ID NO: 1388930 - protein, 27 aa, Mycobacterium tuberculosis
GTTIGLGLLFDTLIVRSFMTPSIAALL

SEQ ID NO: 1388931 - protein, 20 aa, Mycobacterium tuberculosis
GTYLGGWRIIRTLGKGLVEI

SEQ ID NO: 1388932 - protein, 17 aa, Mycobacterium tuberculosis
GVLVLLFSPPSIRWAAG

SEQ ID NO: 1388933 - protein, 27 aa, Mycobacterium tuberculosis
GVSAWLITRAWQMPPVLDLSVAVVAVR

SEQ ID NO: 1388934 - protein, 22 aa, Mycobacterium tuberculosis
HGMYSWLHFWIATACALTAWYV

SEQ ID NO: 1388935 - protein, 26 aa, Mycobacterium tuberculosis
IAAGVNLLLSPAVFRGFDQVGALSPT

SEQ ID NO: 1388936 - protein, 17 aa, Mycobacterium tuberculosis
IAAHLMDPAPQPSQLRP

SEQ ID NO: 1388937 - protein, 32 aa, Mycobacterium tuberculosis; identical to SEQ ID NO: 162653

SEQ ID NO: 1388938 - protein, 19 aa, Mycobacterium tuberculosis
IDIGVWVRIFAVATAITIV

SEQ ID NO: 1388939 - protein, 27 aa, Mycobacterium tuberculosis
IEMQGDGPYVLVGWSLGGVLAYACAIG

SEQ ID NO: 1388940 - protein, 26 aa, Mycobacterium tuberculosis
IIAAAPLGILPMPRAMPATAAFPPPA

SEQ ID NO: 1388941 - protein, 31 aa, Mycobacterium tuberculosis; identical to SEQ ID NO: 162710

SEQ ID NO: 1388942 - protein, 26 aa, Mycobacterium tuberculosis
IKVSVFAVVMLLVAAGLVVVFGDFRF

SEQ ID NO: 1388943 - protein, 28 aa, Mycobacterium tuberculosis
IVASAIGLLLFPQGFLKSLTYATIASVM

SEQ ID NO: 1388944 - protein, 30 aa, Mycobacterium tuberculosis; identical to SEQ ID NO: 162800

SEQ ID NO: 1388945 - protein, 29 aa, Mycobacterium tuberculosis
KLGIVSVVLLFFTVMIIVIFGQMRFDRTN

SEQ ID NO: 1388946 - protein, 20 aa, Mycobacterium tuberculosis
KRVFILGVALFTVASGLCAI

SEQ ID NO: 1388947 - protein, 20 aa, Mycobacterium tuberculosis
LAAYLIPALPHHPHRFDWFG

SEQ ID NO: 1388948 - protein, 24 aa, Mycobacterium tuberculosis
LAGLCMLMLGLLMLIFSEHRSSAL

SEQ ID NO: 1388949 - protein, 27 aa, Mycobacterium tuberculosis
LAGLVLALLSAPWLIAVGAICIAGAWL

SEQ ID NO: 1388950 - protein, 22 aa, Mycobacterium tuberculosis
LAGRDLPPVPVLLVIVDEYLEL

SEQ ID NO: 1388951 - protein, 32 aa, Mycobacterium tuberculosis; identical to SEQ ID NO: 164771

SEQ ID NO: 1388952 - protein, 24 aa, Mycobacterium tuberculosis
LEVNTLFQSLIDLLHKIDPLETNA

SEQ ID NO: 1388953 - protein, 28 aa, Mycobacterium tuberculosis
LFAAPIVIIMILLIIPVGKLSLGGISEK

SEQ ID NO: 1388954 - protein, 18 aa, Mycobacterium tuberculosis
LFGWGIAVTLGVVCGLIA

SEQ ID NO: 1388955 - protein, 19 aa, Mycobacterium tuberculosis
LGEDYLRLSALGSYGAFFN

SEQ ID NO: 1388956 - protein, 21 aa, Mycobacterium tuberculosis
LGLLTLGLIKGPDWGWASLPT

SEQ ID NO: 1388957 - protein, 17 aa, Mycobacterium tuberculosis
LGPVPIKLRESPGLMIL

SEQ ID NO: 1388958 - protein, 30 aa, Mycobacterium tuberculosis; identical to SEQ ID NO: 162934

SEQ ID NO: 1388959 - protein, 27 aa, Mycobacterium tuberculosis
LGSYGAFFNIYFCSVTIKINGPAGSDI

SEQ ID NO: 1388960 - protein, 29 aa, Mycobacterium tuberculosis
LHDELFDACGWRRLIFATPEELEAALGAE

SEQ ID NO: 1388961 - protein, 19 aa, Mycobacterium tuberculosis
LIFPRFEQLLEKPFSRIPQ

SEQ ID NO: 1388962 - protein, 26 aa, Mycobacterium tuberculosis
LIVALIGTIVMLYVSGVRSLATGFFP

SEQ ID NO: 1388963 - protein, 27 aa, Mycobacterium tuberculosis
LMALPTGCILAWILVRIINVRSFGWTL

SEQ ID NO: 1388964 - protein, 26 aa, Mycobacterium tuberculosis
LMCSAATMYTPERVTFFCIGGATMAQ

SEQ ID NO: 1388965 - protein, 25 aa, Mycobacterium tuberculosis
LMVGSAVLTYLSYTAAFTSTDTVTV

SEQ ID NO: 1388966 - protein, 17 aa, Mycobacterium tuberculosis
LPFALPTIVASLVMLAL

SEQ ID NO: 1388967 - protein, 17 aa, Mycobacterium tuberculosis
LPSKENGFALLKVGPRD

SEQ ID NO: 1388968 - protein, 18 aa, Mycobacterium tuberculosis
LPVAAIVIGLFASVAGLK

SEQ ID NO: 1388969 - protein, 25 aa, Mycobacterium tuberculosis
LRADLARDPSFYLRFRREAQNAAAL

SEQ ID NO: 1388970 - protein, 23 aa, Mycobacterium tuberculosis
LSLGLFGSFLLLPSYLQQVLHQS

SEQ ID NO: 1388971 - protein, 28 aa, Mycobacterium tuberculosis
LSWMLNAYNIVFAAFLVAAGRLADLMGR

SEQ ID NO: 1388972 - protein, 29 aa, Mycobacterium tuberculosis
LTATFALGAALPLLFFALAGQRIAERVGA

SEQ ID NO: 1388973 - protein, 24 aa, Mycobacterium tuberculosis
LVLSFGMVTLLGSALLSVLHLPQD

SEQ ID NO: 1388974 - protein, 22 aa, Mycobacterium tuberculosis
LVVVFGDFRFGPTTVYHATFTD

SEQ ID NO: 1388975 - protein, 35 aa, Mycobacterium tuberculosis; identical to SEQ ID NO: 163166

SEQ ID NO: 1388976 - protein, 28 aa, Mycobacterium tuberculosis
MVLTILAAGLLLGPPAGAQPPFRLSNYV

SEQ ID NO: 1388977 - protein, 18 aa, Mycobacterium tuberculosis
MWLGVHLVPISIGGRALG

SEQ ID NO: 1388978 - protein, 22 aa, Mycobacterium tuberculosis
NGFHGKWPWQMTHPMDGAVQID

SEQ ID NO: 1388979 - protein, 65 aa, Mycobacterium tuberculosis; identical to SEQ ID NO: 163215

SEQ ID NO: 1388980 - protein, 29 aa, Mycobacterium tuberculosis
NSISIVAVLLWIVAVLIVGSVVYLSALER

SEQ ID NO: 1388981 - protein, 24 aa, Mycobacterium tuberculosis
PAPPVEVPPPMPPPPPVTITQTVA

SEQ ID NO: 1388982 - protein, 25 aa, Mycobacterium tuberculosis
PDELPATGARLRWAPAQGPSATPAQ

SEQ ID NO: 1388983 - protein, 25 aa, Mycobacterium tuberculosis
PDVRGAVLLAFALGLLTLGLIKGPD

SEQ ID NO: 1388984 - protein, 23 aa, Mycobacterium tuberculosis
PEHLRRRKLLTPPLHGAALDRYV

SEQ ID NO: 1388985 - protein, 33 aa, Mycobacterium tuberculosis; identical to SEQ ID NO: 163283

SEQ ID NO: 1388986 - protein, 18 aa, Mycobacterium tuberculosis
PLIGVRKAGLFTSSSFVL

SEQ ID NO: 1388987 - protein, 26 aa, Mycobacterium tuberculosis
PRLVDIYVDWLWFGEVGFRSVWITVL

SEQ ID NO: 1388988 - protein, 20 aa, Mycobacterium tuberculosis
PVLENLPAVLPTVVAPPLTS

SEQ ID NO: 1388989 - protein, 17 aa, Mycobacterium tuberculosis
QIEPALHDGDYSGAAVA

SEQ ID NO: 1388990 - protein, 22 aa, Mycobacterium tuberculosis
QTSESLWWVTDAGARFGVEDSK

SEQ ID NO: 1388991 - protein, 24 aa, Mycobacterium tuberculosis
QVLAPLFPMIVAVPVGAYLALPVA

SEQ ID NO: 1388992 - protein, 17 aa, Mycobacterium tuberculosis
RAIGMTTRQLWKLMFIE

SEQ ID NO: 1388993 - protein, 22 aa, Mycobacterium tuberculosis
RALRLPFSRLLATLPISATPDG

SEQ ID NO: 1388994 - protein, 23 aa, Mycobacterium tuberculosis
RDTGLAMLVWALAVAGALAFGQL

SEQ ID NO: 1388995 - protein, 19 aa, Mycobacterium tuberculosis
RFVLRRLGPGPGGLASNRV

SEQ ID NO: 1388996 - protein, 17 aa, Mycobacterium tuberculosis
RIPVVPYAPYGPGSARA

SEQ ID NO: 1388997 - protein, 19 aa, Mycobacterium tuberculosis
RLGDFWGYLAGWGFVVGKT

SEQ ID NO: 1388998 - protein, 28 aa, Mycobacterium tuberculosis
RREHISLRPLWGIDQRLKRFGAMAAAMV

SEQ ID NO: 1388999 - protein, 21 aa, Mycobacterium tuberculosis
RRTLYVLITTWDAAGGGPFAA

SEQ ID NO: 1389000 - protein, 53 aa, Mycobacterium tuberculosis
RVDLPRVGQINWKWIRRSLYLTAAVVILLPMVTFTMAYLIVDVPKPGDIRTNQ

SEQ ID NO: 1389001 - protein, 18 aa, Mycobacterium tuberculosis
RWGNLLTLPVARGGLLYV

SEQ ID NO: 1389002 - protein, 21 aa, Mycobacterium tuberculosis
SDYSPVFGCLFKGIARGVKEF

SEQ ID NO: 1389003 - protein, 20 aa, Mycobacterium tuberculosis
SGHTTFLELAPNPVALMQVA

SEQ ID NO: 1389004 - protein, 22 aa, Mycobacterium tuberculosis
SIIANRVSYFYDFHGPSVTIDT

SEQ ID NO: 1389005 - protein, 21 aa, Mycobacterium tuberculosis
SPRRPWLAPLEDPEPVDRLVA

SEQ ID NO: 1389006 - protein, 25 aa, Mycobacterium tuberculosis
TALCLFTAVFIMLRRKRIPSVARGP

SEQ ID NO: 1389007 - protein, 25 aa, Mycobacterium tuberculosis
TDAGAQFFFLVAAALVVLLVGIEHT

SEQ ID NO: 1389008 - protein, 24 aa, Mycobacterium tuberculosis
TELAQQILLPRLPPKGLSQEELRA

SEQ ID NO: 1389009 - protein, 38 aa, Mycobacterium tuberculosis; identical to SEQ ID NO: 163838

SEQ ID NO: 1389010 - protein, 32 aa, Mycobacterium tuberculosis; identical to SEQ ID NO: 164538

SEQ ID NO: 1389011 - protein, 18 aa, Mycobacterium tuberculosis
TLALIALAIITRLRHPLP

SEQ ID NO: 1389012 - protein, 22 aa, Mycobacterium tuberculosis
TQHNVYIPWSMTVTPISQSDVG

SEQ ID NO: 1389013 - protein, 17 aa, Mycobacterium tuberculosis
TQPALDLDALLGGLRPV

SEQ ID NO: 1389014 - protein, 21 aa, Mycobacterium tuberculosis
TRGGYLKDIKGFDSEFFAVAK

SEQ ID NO: 1389015 - protein, 17 aa, Mycobacterium tuberculosis
TVAIHLLASMTMVWLAV

SEQ ID NO: 1389016 - protein, 24 aa, Mycobacterium tuberculosis
TVRQFNDLLRVLPPLPQEMPQQTG

SEQ ID NO: 1389017 - protein, 23 aa, Mycobacterium tuberculosis
TVRTGLLWWTVAIHLLASMTMVW

SEQ ID NO: 1389018 - protein, 25 aa, Mycobacterium tuberculosis
TVVYEPLLGRLPADTPMYGFERVEG

SEQ ID NO: 1389019 - protein, 17 aa, Mycobacterium tuberculosis
VATFFRFVARRLDSRPE

SEQ ID NO: 1389020 - protein, 17 aa, Mycobacterium tuberculosis
VDGRIESLLPAILEGRQ

SEQ ID NO: 1389021 - protein, 25 aa, Mycobacterium tuberculosis
VGPTIAWYQDFLRYYFLTVESNVEG

SEQ ID NO: 1389022 - protein, 18 aa, Mycobacterium tuberculosis
VINAPARLDLLTQQYVEL

SEQ ID NO: 1389023 - protein, 18 aa, Mycobacterium tuberculosis
VKEFAPLIGVRKAGLFTS

SEQ ID NO: 1389024 - protein, 19 aa, Mycobacterium tuberculosis
VLAYAWLMPVSTVVQAMIG

SEQ ID NO: 1389025 - protein, 24 aa, Mycobacterium tuberculosis
VLRESLYNVPHRSPRRPWLAPLED

SEQ ID NO: 1389026 - protein, 30 aa, Mycobacterium tuberculosis; identical to SEQ ID NO: 164105

SEQ ID NO: 1389027 - protein, 19 aa, Mycobacterium tuberculosis
VPMLVRRLITLGPALAILT

SEQ ID NO: 1389028 - protein, 24 aa, Mycobacterium tuberculosis
VQSMFIGPVFNPLLKMLGADKIAI

SEQ ID NO: 1389029 - protein, 30 aa, Mycobacterium tuberculosis; identical to SEQ ID NO: 164134

SEQ ID NO: 1389030 - protein, 31 aa, Mycobacterium tuberculosis; identical to SEQ ID NO: 164144

SEQ ID NO: 1389031 - protein, 32 aa, Mycobacterium tuberculosis
VSGVRSLATGFFPLMGIGAFSMLAFSGRFGRA

SEQ ID NO: 1389032 - protein, 26 aa, Mycobacterium tuberculosis
VVLAFLASLLTHYLFGGLRLTTGRGM

SEQ ID NO: 1389033 - protein, 22 aa, Mycobacterium tuberculosis
VVPVALAYPWQSTRDYVLLGVA

SEQ ID NO: 1389034 - protein, 17 aa, Mycobacterium tuberculosis
WAMAAICFIAVAVAAAV

SEQ ID NO: 1389035 - protein, 25 aa, Mycobacterium tuberculosis
WFTTSSGVLLLWSWLVMSLAQGYYS

SEQ ID NO: 1389036 - protein, 23 aa, Mycobacterium tuberculosis
WGRRIARLLPFVGLAGLAVTTHV

SEQ ID NO: 1389037 - protein, 22 aa, Mycobacterium tuberculosis
WLVHVLLDPRRVRWIVGERADT

SEQ ID NO: 1389038 - protein, 19 aa, Mycobacterium tuberculosis
WRRGLIFAMFVFAAIFTPG

SEQ ID NO: 1389039 - protein, 17 aa, Mycobacterium tuberculosis
YCGFTAITMLGFGTFGL

SEQ ID NO: 1389040 - protein, 25 aa, Mycobacterium tuberculosis
YLSAALTLMIPIGAFLGRIYDSWAR

SEQ ID NO: 1389041 - protein, 23 aa, Mycobacterium tuberculosis
YPQKPPVGAALWKLMERARQVGL

SEQ ID NO: 1389042 - protein, 17 aa, Mycobacterium tuberculosis
YSFVVLLITGVYLTLFF

SEQ ID NO: 1389043 - protein, 17 aa, Mycobacterium tuberculosis
YVPKLIEMQGDGPYVLV

SEQ ID NO: 1389044 - protein, 22 aa, Mycobacterium tuberculosis
ADLRHWLIDYLVTNIGCTPDEV

SEQ ID NO: 1389045 - protein, 20 aa, Mycobacterium tuberculosis
AGIFGIPGQGSYAAANSYLD

SEQ ID NO: 1389046 - protein, 30 aa, Mycobacterium tuberculosis
AIAGDFWPWALQFVATLWVSTFLVVASHEF

SEQ ID NO: 1389047 - protein, 17 aa, Mycobacterium tuberculosis
AIVLVAVLFLGSPISVM

SEQ ID NO: 1389048 - protein, 23 aa, Mycobacterium tuberculosis
ALGIMRFLAIFGPVHYFAQPVVS

SEQ ID NO: 1389049 - protein, 24 aa, Mycobacterium tuberculosis
ALSLILLIMMIITRSLVAALVIVG

SEQ ID NO: 1389050 - protein, 18 aa, Mycobacterium tuberculosis
ALTVAMKHIKEPPPPLPP

SEQ ID NO: 1389051 - protein, 22 aa, Mycobacterium tuberculosis
ASTLLLLLPMPLETRTVIALLF

SEQ ID NO: 1389052 - protein, 27 aa, Mycobacterium tuberculosis
ATGLTLSPTLIFDYPTPATLAEHLDSR

SEQ ID NO: 1389053 - protein, 19 aa, Mycobacterium tuberculosis
AVEALFRPMHDRLASAVVA

SEQ ID NO: 1389054 - protein, 17 aa, Mycobacterium tuberculosis
AVFFAVSGFLLWRGHAA

SEQ ID NO: 1389055 - protein, 18 aa, Mycobacterium tuberculosis
AVSALAPKWLASTVGVVQ

SEQ ID NO: 1389056 - protein, 33 aa, Mycobacterium tuberculosis; identical to SEQ ID NO: 162038

SEQ ID NO: 1389057 - protein, 19 aa, Mycobacterium tuberculosis
CGFAMLPAYLLLVVYGQDS

SEQ ID NO: 1389058 - protein, 23 aa, Mycobacterium tuberculosis
DAAYLITGGLGALGLLMADWLAD

SEQ ID NO: 1389059 - protein, 21 aa, Mycobacterium tuberculosis
DAVAALTWQLPAEPGGGAAPA

SEQ ID NO: 1389060 - protein, 24 aa, Mycobacterium tuberculosis
DKMDPQQRLLLEVAWEALEHAGIP

SEQ ID NO: 1389061 - protein, 19 aa, Mycobacterium tuberculosis
DPAPVAVPVPRRSTPGPSD

SEQ ID NO: 1389062 - protein, 17 aa, Mycobacterium tuberculosis
DRRRQATHPAAVKPELV

SEQ ID NO: 1389063 - protein, 24 aa, Mycobacterium tuberculosis
DTGLPVGVALLAALLAGVALVPKA

SEQ ID NO: 1389064 - protein, 27 aa, Mycobacterium tuberculosis
DTKVLSPPYSILAIGDPPTLAAAMNIP

SEQ ID NO: 1389065 - protein, 19 aa, Mycobacterium tuberculosis
DVAYALWSAIGTAAIVLVA

SEQ ID NO: 1389066 - protein, 26 aa, Mycobacterium tuberculosis
ERPPSTLWIWVALTGAAATVLILGWR

SEQ ID NO: 1389067 - protein, 35 aa, Mycobacterium tuberculosis; identical to SEQ ID NO: 164367

SEQ ID NO: 1389068 - protein, 19 aa, Mycobacterium tuberculosis
FFDTSALIIAFVVLGRHLE

SEQ ID NO: 1389069 - protein, 22 aa, Mycobacterium tuberculosis
FGELAVFVFFGPVAVLGTQYTQ

SEQ ID NO: 1389070 - protein, 20 aa, Mycobacterium tuberculosis
FLIDGLLDRLVYLSYGLAVI

SEQ ID NO: 1389071 - protein, 28 aa, Mycobacterium tuberculosis
FLVGKTPWIGALLGVLFVLTTALGDLVE

SEQ ID NO: 1389072 - protein, 25 aa, Mycobacterium tuberculosis
FPELSAYQIINRLIHTARPPARGVD

SEQ ID NO: 1389073 - protein, 18 aa, Mycobacterium tuberculosis
FTLSILIRRPIVGYLWSW

SEQ ID NO: 1389074 - protein, 17 aa, Mycobacterium tuberculosis
FVTILPAYDLTLFVNQL

SEQ ID NO: 1389075 - protein, 27 aa, Mycobacterium tuberculosis
GAAAWLHAAVWWKALLALAVAVALVIG

SEQ ID NO: 1389076 - protein, 23 aa, Mycobacterium tuberculosis
GALSGLWLGIAGWSLWAANSPGM

SEQ ID NO: 1389077 - protein, 26 aa, Mycobacterium tuberculosis
GASKLPMYLNIAVAVLGLAAYFASFG

SEQ ID NO: 1389078 - protein, 32 aa, Mycobacterium tuberculosis; identical to SEQ ID NO: 164707

SEQ ID NO: 1389079 - protein, 20 aa, Mycobacterium tuberculosis
GDRLWIRFIADTERRSQVIE

SEQ ID NO: 1389080 - protein, 25 aa, Mycobacterium tuberculosis
GEQQTMLPFSWQGVCLHASGAARVR

SEQ ID NO: 1389081 - protein, 22 aa, Mycobacterium tuberculosis
GFPGFPEFPAIPGFPALPGLPS

SEQ ID NO: 1389082 - protein, 58 aa, Mycobacterium tuberculosis
GIIIEILIQLFLISLEILFAIVAYTIIIVLILPLVIFAYAIVFAVLAIIFGPPLLVIA

SEQ ID NO: 1389083 - protein, 17 aa, Mycobacterium tuberculosis
GIVIIKRALAPLRRVAQ

SEQ ID NO: 1389084 - protein, 31 aa, Mycobacterium tuberculosis
GLDGLRPYFTGYLPTLLLAAILTPATVAVIG

SEQ ID NO: 1389085 - protein, 36 aa, Mycobacterium tuberculosis
GLSVLVWQHLLGIQLYWIVLALAVILLLAVGSDYNL

SEQ ID NO: 1389086 - protein, 18 aa, Mycobacterium tuberculosis
GSDSAVEALFRPMHDRLA

SEQ ID NO: 1389087 - protein, 23 aa, Mycobacterium tuberculosis
GSEPDFLRVWLPGQLLQGIGVGA

SEQ ID NO: 1389088 - protein, 20 aa, Mycobacterium tuberculosis
GVIHTPARRGFFRSNPERIQ

SEQ ID NO: 1389089 - protein, 41 aa, Mycobacterium tuberculosis; identical to SEQ ID NO: 162588

SEQ ID NO: 1389090 - protein, 31 aa, Mycobacterium tuberculosis; identical to SEQ ID NO: 162592

SEQ ID NO: 1389091 - protein, 17 aa, Mycobacterium tuberculosis
HGWVLASGSFMLCAAFN

SEQ ID NO: 1389092 - protein, 35 aa, Mycobacterium tuberculosis; identical to SEQ ID NO: 1376889

SEQ ID NO: 1389093 - protein, 24 aa, Mycobacterium tuberculosis
IFGLRRWYVITFLMGLFFVLGQAY

SEQ ID NO: 1389094 - protein, 24 aa, Mycobacterium tuberculosis
IGNTQALRWRTSVGAAAISVAQRV

SEQ ID NO: 1389095 - protein, 26 aa, Mycobacterium tuberculosis
IGVIVFQFLLGQEMHWSIPGLTFVIL

SEQ ID NO: 1389096 - protein, 24 aa, Mycobacterium tuberculosis
ITQAPLNALWQLTKAVRAELSDPL

SEQ ID NO: 1389097 - protein, 22 aa, Mycobacterium tuberculosis
ITRKPVLTLYRQRPPEVGVPSE

SEQ ID NO: 1389098 - protein, 23 aa, Mycobacterium tuberculosis
KARVPPYKTAGLGLVLVFALVVA

SEQ ID NO: 1389099 - protein, 24 aa, Mycobacterium tuberculosis
KFSMPGPWVGIAAPGENIASVSNS

SEQ ID NO: 1389100 - protein, 23 aa, Mycobacterium tuberculosis
KRTFSLPWRLANIQDLPAVDSPA

SEQ ID NO: 1389101 - protein, 23 aa, Mycobacterium tuberculosis
LAAGVLLWLFVRHEHRAAFPLVD

SEQ ID NO: 1389102 - protein, 17 aa, Mycobacterium tuberculosis
LAALLRQRFPDLTPAQI

SEQ ID NO: 1389103 - protein, 20 aa, Mycobacterium tuberculosis
LATELGRNLLLEQLHYRHEV

SEQ ID NO: 1389104 - protein, 24 aa, Mycobacterium tuberculosis
LDATVVRMFLVPSVMKLLGDDCWW

SEQ ID NO: 1389105 - protein, 18 aa, Mycobacterium tuberculosis
LMFALAWLLLADLPEYRT

SEQ ID NO: 1389106 - protein, 19 aa, Mycobacterium tuberculosis
LQELTLQAPLVLPADGVRV

SEQ ID NO: 1389107 - protein, 25 aa, Mycobacterium tuberculosis
LTIPTIALASLWLSGPLQLGLGAIQ

SEQ ID NO: 1389108 - protein, 25 aa, Mycobacterium tuberculosis
LVAYRRSRGLAGLSVAWGLWEQASA

SEQ ID NO: 1389109 - protein, 38 aa, Mycobacterium tuberculosis; identical to SEQ ID NO: 163083

SEQ ID NO: 1389110 - protein, 17 aa, Mycobacterium tuberculosis
MASLPLPAISSLNSRML

SEQ ID NO: 1389111 - protein, 17 aa, Mycobacterium tuberculosis
MLSRRRPMLNLFAFWVG

SEQ ID NO: 1389112 - protein, 27 aa, Mycobacterium tuberculosis
MLTRAIKTQLVLLTVLAVIAVVVLGWY

SEQ ID NO: 1389113 - protein, 19 aa, Mycobacterium tuberculosis
MPDLRGALLLAVTLGLVTL

SEQ ID NO: 1389114 - protein, 17 aa, Mycobacterium tuberculosis
NLWVGYFPTVQTAWNQL

SEQ ID NO: 1389115 - protein, 28 aa, Mycobacterium tuberculosis
PAAIGPLPPVTLLPRRTPGSSGIADVPA

SEQ ID NO: 1389116 - protein, 17 aa, Mycobacterium tuberculosis
PAIVKFLSEQVLSRATE

SEQ ID NO: 1389117 - protein, 22 aa, Mycobacterium tuberculosis
PALPILAAAPTPPLGPAWVALL

SEQ ID NO: 1389118 - protein, 20 aa, Mycobacterium tuberculosis
PASFRRWLNPVNAAAATALV

SEQ ID NO: 1389119 - protein, 24 aa, Mycobacterium tuberculosis
PEALFNPILMMALAALGIGSVSTL

SEQ ID NO: 1389120 - protein, 19 aa, Mycobacterium tuberculosis
PGIGTLAAWFAAAGEVVVF

SEQ ID NO: 1389121 - protein, 19 aa, Mycobacterium tuberculosis
PIVTLSWLTIAVAGILAAM

SEQ ID NO: 1389122 - protein, 18 aa, Mycobacterium tuberculosis
PLDVGWSLVNTRSLFDHR

SEQ ID NO: 1389123 - protein, 20 aa, Mycobacterium tuberculosis
PMLRPTMFFVLVTGIISAAQ

SEQ ID NO: 1389124 - protein, 24 aa, Mycobacterium tuberculosis
PSTPPTGFPSFSPPPPVSAGTGSQ

SEQ ID NO: 1389125 - protein, 17 aa, Mycobacterium tuberculosis
PVMLRAIGWPETIFRFA

SEQ ID NO: 1389126 - protein, 28 aa, Mycobacterium tuberculosis
PYAGRRETWLIMRLPVIGNTQALRWRTS

SEQ ID NO: 1389127 - protein, 17 aa, Mycobacterium tuberculosis
QALTNQARRLLAWVGAD

SEQ ID NO: 1389128 - protein, 19 aa, Mycobacterium tuberculosis
QGAQWLGMGAQLCATAPVF

SEQ ID NO: 1389129 - protein, 25 aa, Mycobacterium tuberculosis
QTTHAMLRSLFRVGLDPRNVAVIGK

SEQ ID NO: 1389130 - protein, 34 aa, Mycobacterium tuberculosis
RAMLMSPMSFLRRPARWMQLLATSGRCFSAAPNF

SEQ ID NO: 1389131 - protein, 26 aa, Mycobacterium tuberculosis
RLRQRPFQYILLVLGIALGVAMIVAI

SEQ ID NO: 1389132 - protein, 25 aa, Mycobacterium tuberculosis
RLVLTGRTPLPPRRDWQLDTLDTEL

SEQ ID NO: 1389133 - protein, 42 aa, Mycobacterium tuberculosis
RRDRKRQWRKQTWLGRFVSTYGWRAYALPVLMVLTTVVVYQT

SEQ ID NO: 1389134 - protein, 22 aa, Mycobacterium tuberculosis
RRGRVYAARLAPVAAGLTLPSA

SEQ ID NO: 1389135 - protein, 26 aa, Mycobacterium tuberculosis
RTPRPQLTAAFGGALWAARRPGDTSA

SEQ ID NO: 1389136 - protein, 24 aa, Mycobacterium tuberculosis
RVAGVWTVFVLASAGWALGGQLGA

SEQ ID NO: 1389137 - protein, 23 aa, Mycobacterium tuberculosis
RVGGWLLVVGLTLACAGLLWSDR

SEQ ID NO: 1389138 - protein, 24 aa, Mycobacterium tuberculosis
RVRPLRIRRTSPAPAKPAPNSGRR

SEQ ID NO: 1389139 - protein, 18 aa, Mycobacterium tuberculosis
SALLAWLTAAAVAIAMLT

SEQ ID NO: 1389140 - protein, 23 aa, Mycobacterium tuberculosis
SDRLSHTLLPKRIALPVFASDAM

SEQ ID NO: 1389141 - protein, 19 aa, Mycobacterium tuberculosis
SGLLGPRLPRILAAVALGV

SEQ ID NO: 1389142 - protein, 25 aa, Mycobacterium tuberculosis
SIIANRLSYFLDLRGPSVAVDTACS

SEQ ID NO: 1389143 - protein, 21 aa, Mycobacterium tuberculosis
SILIRRPIVGYLWSWLSGRDR

SEQ ID NO: 1389144 - protein, 18 aa, Mycobacterium tuberculosis
SLFDHRAVVVGADRTQLM

SEQ ID NO: 1389145 - protein, 26 aa, Mycobacterium tuberculosis
SLLTEPRPWHVPGRPRRAGVSSFGIS

SEQ ID NO: 1389146 - protein, 29 aa, Mycobacterium tuberculosis
SLVEAAAVPVAFLTAFYGLSVLAEVAAGQ

SEQ ID NO: 1389147 - protein, 20 aa, Mycobacterium tuberculosis
SRAALMFIVAALAATLALIA

SEQ ID NO: 1389148 - protein, 23 aa, Mycobacterium tuberculosis
SRMLKYVVKRFALKRGALMFGKL

SEQ ID NO: 1389149 - protein, 17 aa, Mycobacterium tuberculosis
SRRFWAWTIAGYTLTVV

SEQ ID NO: 1389150 - protein, 28 aa, Mycobacterium tuberculosis
SRRNLTLYVTALLFVLAWATSGINGWFY

SEQ ID NO: 1389151 - protein, 25 aa, Mycobacterium tuberculosis
SVTVTYPAHWGPAAVAALDSALRRA

SEQ ID NO: 1389152 - protein, 19 aa, Mycobacterium tuberculosis
SWAIGVMLAILALISLVCT

SEQ ID NO: 1389153 - protein, 31 aa, Mycobacterium tuberculosis; identical to SEQ ID NO: 163805

SEQ ID NO: 1389154 - protein, 26 aa, Mycobacterium tuberculosis
TAGDRGLLEMIWTPVPLEGGDIGDDA

SEQ ID NO: 1389155 - protein, 28 aa, Mycobacterium tuberculosis
TAGLGLVLVFALVVALVYLQFRGEFTPK

SEQ ID NO: 1389156 - protein, 22 aa, Mycobacterium tuberculosis
TKQILIYTWLTVAATLVLALAT

SEQ ID NO: 1389157 - protein, 28 aa, Mycobacterium tuberculosis
TVLILGWRSARWWRRGASLLAVPLCLLS

SEQ ID NO: 1389158 - protein, 18 aa, Mycobacterium tuberculosis
VAAPILLILCRLVQGFAT

SEQ ID NO: 1389159 - protein, 23 aa, Mycobacterium tuberculosis
VAERHRGVRYRAFDLVEAGPDRI

SEQ ID NO: 1389160 - protein, 26 aa, Mycobacterium tuberculosis
VDARLVTMVPAGWSLVEAAAVPVAFL

SEQ ID NO: 1389161 - protein, 28 aa, Mycobacterium tuberculosis
VDQWGWRSIFYVNLPMGALVLFLTLCYV

SEQ ID NO: 1389162 - protein, 23 aa, Mycobacterium tuberculosis
VELAPLLRHPLDLELDSISVVTF

SEQ ID NO: 1389163 - protein, 28 aa, Mycobacterium tuberculosis
VELPTYAFARQRFWLDGLGAVGGDLGGV

SEQ ID NO: 1389164 - protein, 25 aa, Mycobacterium tuberculosis
VEYWKKGLRHSVYFTHGIRNAVDSG

SEQ ID NO: 1389165 - protein, 47 aa, Mycobacterium tuberculosis; identical to SEQ ID NO: 164033

SEQ ID NO: 1389166 - protein, 18 aa, Mycobacterium tuberculosis
VGTLLSWYALVAAVTTVP

SEQ ID NO: 1389167 - protein, 45 aa, Mycobacterium tuberculosis; identical to SEQ ID NO: 164081

SEQ ID NO: 1389168 - protein, 25 aa, Mycobacterium tuberculosis
VLAYACAIGLRRLGKDVRFVGLIDA

SEQ ID NO: 1389169 - protein, 18 aa, Mycobacterium tuberculosis
VLFRLFVGARLIDAAREQ

SEQ ID NO: 1389170 - protein, 18 aa, Mycobacterium tuberculosis
VLLVIGALVVWWGWRERR

SEQ ID NO: 1389171 - protein, 22 aa, Mycobacterium tuberculosis
VVALSFLLLHAVTWFGSAPRAM

SEQ ID NO: 1389172 - protein, 18 aa, Mycobacterium tuberculosis
VVLPSLAFVALVLTWGKQ

SEQ ID NO: 1389173 - protein, 19 aa, Mycobacterium tuberculosis
VVLVLVAIVLFAAASLLFG

SEQ ID NO: 1389174 - protein, 17 aa, Mycobacterium tuberculosis
VWELPPHAGAQAGGDVL

SEQ ID NO: 1389175 - protein, 17 aa, Mycobacterium tuberculosis
YGLVHFIGGYPGAILGF

SEQ ID NO: 1389176 - protein, 20 aa, Mycobacterium tuberculosis
YPRTASIVIWYSRAICDTAA

SEQ ID NO: 1389177 - protein, 17 aa, Mycobacterium tuberculosis
YTELWVGFTAVSALLIL

SEQ ID NO: 1389178 - protein, 17 aa, Mycobacterium tuberculosis
AGWLPWFADIDRQMYFF

SEQ ID NO: 1389179 - protein, 34 aa, Mycobacterium tuberculosis; identical to SEQ ID NO: 216020

SEQ ID NO: 1389180 - protein, 31 aa, Mycobacterium tuberculosis; identical to SEQ ID NO: 161883

SEQ ID NO: 1389181 - protein, 23 aa, Mycobacterium tuberculosis
ASGPAWRLIGTTAVGLLLLTFTP

SEQ ID NO: 1389182 - protein, 17 aa, Mycobacterium tuberculosis
ATGVVVGIFWMGRRLVS

SEQ ID NO: 1389183 - protein, 26 aa, Mycobacterium tuberculosis
ATHYWKPLLLCFLVTLGGTVAFYTYS

SEQ ID NO: 1389184 - protein, 25 aa, Mycobacterium tuberculosis
AVAAAWTFLKILGPILRGIADAAVS

SEQ ID NO: 1389185 - protein, 17 aa, Mycobacterium tuberculosis
AVLLILLTGLQRRPWAI

SEQ ID NO: 1389186 - protein, 22 aa, Mycobacterium tuberculosis
AVRQVMWPKIGGSQVLHDAFPP

SEQ ID NO: 1389187 - protein, 21 aa, Mycobacterium tuberculosis
AVSAALAVLVIACPCALGLAT

SEQ ID NO: 1389188 - protein, 21 aa, Mycobacterium tuberculosis
AWALSVMFLVFTLRALLYKPF

SEQ ID NO: 1389189 - protein, 21 aa, Mycobacterium tuberculosis
AYAFARLQFRGRDALFWVYVA

SEQ ID NO: 1389190 - protein, 22 aa, Mycobacterium tuberculosis
CAIFTPYRWMIEHVTTKRGQLR

SEQ ID NO: 1389191 - protein, 37 aa, Mycobacterium tuberculosis
DALIHDAVLLAVILLTVVALASMWRGAVHGAAVGVGV

SEQ ID NO: 1389192 - protein, 20 aa, Mycobacterium tuberculosis
DELGWPMLCLMTIAAGALQI

SEQ ID NO: 1389193 - protein, 17 aa, Mycobacterium tuberculosis
EGVPIRGFGIHPAVLDA

SEQ ID NO: 1389194 - protein, 21 aa, Mycobacterium tuberculosis
ELGWICVAINYRHSPRNTWPD

SEQ ID NO: 1389195 - protein, 23 aa, Mycobacterium tuberculosis
EQIQLGLIGMQLALTELWCSYGV

SEQ ID NO: 1389196 - protein, 20 aa, Mycobacterium tuberculosis
FFFLGCFTIVGTRQFAIMTT

SEQ ID NO: 1389197 - protein, 25 aa, Mycobacterium tuberculosis
FSINVAAVVYLLISKRLFGVRGGRK

SEQ ID NO: 1389198 - protein, 17 aa, Mycobacterium tuberculosis
FVLAWRDSWEYWTHTLH

SEQ ID NO: 1389199 - protein, 21 aa, Mycobacterium tuberculosis
GALWLLYRYYRTGDPLFWFTT

SEQ ID NO: 1389200 - protein, 34 aa, Mycobacterium tuberculosis; identical to SEQ ID NO: 162446

SEQ ID NO: 1389201 - protein, 26 aa, Mycobacterium tuberculosis
GIVMFLGYIALFALVLYMHAGILTGC

SEQ ID NO: 1389202 - protein, 20 aa, Mycobacterium tuberculosis
GLTERYFYESFADREHFVRA

SEQ ID NO: 1389203 - protein, 27 aa, Mycobacterium tuberculosis
GMQLALTELWCSYGVRPDLVIGHSMGE

SEQ ID NO: 1389204 - protein, 18 aa, Mycobacterium tuberculosis
GMSEVHLARDLRLHRDVA

SEQ ID NO: 1389205 - protein, 21 aa, Mycobacterium tuberculosis
GPKLFRSLSIAFMSSADPIPA

SEQ ID NO: 1389206 - protein, 18 aa, Mycobacterium tuberculosis
GVLMLWLPGNNLVVAFVG

SEQ ID NO: 1389207 - protein, 23 aa, Mycobacterium tuberculosis
GVNFRDVLVALGMYPGGGELGVD

SEQ ID NO: 1389208 - protein, 24 aa, Mycobacterium tuberculosis
IARKPWLIAGVVFLLAAAAFPNYF

SEQ ID NO: 1389209 - protein, 25 aa, Mycobacterium tuberculosis
ISDGELFIMGRIKDLLIVDGRNHYP

SEQ ID NO: 1389210 - protein, 20 aa, Mycobacterium tuberculosis
ITSFQWNWKFGYQRVNFKDG

SEQ ID NO: 1389211 - protein, 17 aa, Mycobacterium tuberculosis
KHLHIFLAPINVTFKRL

SEQ ID NO: 1389212 - protein, 17 aa, Mycobacterium tuberculosis
LAGASWWLIEQPIRRWR

SEQ ID NO: 1389213 - protein, 17 aa, Mycobacterium tuberculosis
LARLADARRLGHPVLAL

SEQ ID NO: 1389214 - protein, 30 aa, Mycobacterium tuberculosis; identical to SEQ ID NO: 162877

SEQ ID NO: 1389215 - protein, 21 aa, Mycobacterium tuberculosis
LDRVRVVVIDGAALRGDNRAV

SEQ ID NO: 1389216 - protein, 17 aa, Mycobacterium tuberculosis
LFCLLAPVGVIPILLPD

SEQ ID NO: 1389217 - protein, 18 aa, Mycobacterium tuberculosis
LFSGRRWVTMLGAFILAL

SEQ ID NO: 1389218 - protein, 18 aa, Mycobacterium tuberculosis
LLLPLLNRQWRALVAAVV

SEQ ID NO: 1389219 - protein, 29 aa, Mycobacterium tuberculosis
LQVRPYAGERWWVLLLSLATAAVLTVLAY

SEQ ID NO: 1389220 - protein, 18 aa, Mycobacterium tuberculosis
LSVRQLMVRPVSAAALSR

SEQ ID NO: 1389221 - protein, 28 aa, Mycobacterium tuberculosis
MRLKMITTPTDWPRYGGYALAGVSSFGF

SEQ ID NO: 1389222 - protein, 22 aa, Mycobacterium tuberculosis
NFEKFAWLFMRFSGVVLVFLAI

SEQ ID NO: 1389223 - protein, 24 aa, Mycobacterium tuberculosis
NSKFTISMLWPGDRAWRQAGERRM

SEQ ID NO: 1389224 - protein, 24 aa, Mycobacterium tuberculosis
NVDNWVQRLFALPVLPAGYADRVV

SEQ ID NO: 1389225 - protein, 20 aa, Mycobacterium tuberculosis
PEGRLERLRGRLARSQNALG

SEQ ID NO: 1389226 - protein, 17 aa, Mycobacterium tuberculosis
PEPRPAPPPAKPAPPAG

SEQ ID NO: 1389227 - protein, 25 aa, Mycobacterium tuberculosis
PFGEYVPLRPLFGWITRYSKAAAKD

SEQ ID NO: 1389228 - protein, 17 aa, Mycobacterium tuberculosis
PGGAALALLLWLQRRVP

SEQ ID NO: 1389229 - protein, 25 aa, Mycobacterium tuberculosis
PILPTQILWINMTTAIALGLMLAFE

SEQ ID NO: 1389230 - protein, 23 aa, Mycobacterium tuberculosis
PIRRASVTVMEWGLRGTRRAEAA

SEQ ID NO: 1389231 - protein, 24 aa, Mycobacterium tuberculosis
PPGSVDFFYLTASAAGIFGIPGQG

SEQ ID NO: 1389232 - protein, 20 aa, Mycobacterium tuberculosis
PYIDFDAMRLKMITTPTDWP

SEQ ID NO: 1389233 - protein, 30 aa, Mycobacterium tuberculosis; identical to SEQ ID NO: 163392

SEQ ID NO: 1389234 - protein, 18 aa, Mycobacterium tuberculosis
QARRLLAWVGADENVRPL

SEQ ID NO: 1389235 - protein, 22 aa, Mycobacterium tuberculosis
QLADLDQVWRLTRGAGQRVAVI

SEQ ID NO: 1389236 - protein, 17 aa, Mycobacterium tuberculosis
QRYLPYATVLIGLALIA

SEQ ID NO: 1389237 - protein, 18 aa, Mycobacterium tuberculosis
QVPPQRWQPFEGGPPEVA

SEQ ID NO: 1389238 - protein, 33 aa, Mycobacterium tuberculosis; identical to SEQ ID NO: 163476

SEQ ID NO: 1389239 - protein, 17 aa, Mycobacterium tuberculosis
RFFPPMGSILYWMRFGT

SEQ ID NO: 1389240 - protein, 29 aa, Mycobacterium tuberculosis
RGTMATGGLVLLVLLAGIALLVSRQVVVP

SEQ ID NO: 1389241 - protein, 22 aa, Mycobacterium tuberculosis
RILTHLPVVIGAVLAIMVWRSA

SEQ ID NO: 1389242 - protein, 22 aa, Mycobacterium tuberculosis
RLDNARFLLPVVGVPPDQATDF

SEQ ID NO: 1389243 - protein, 17 aa, Mycobacterium tuberculosis
RLLRTFLRDVPNQVVLA

SEQ ID NO: 1389244 - protein, 19 aa, Mycobacterium tuberculosis
RLTLIVFVAMTLAAGLLIS

SEQ ID NO: 1389245 - protein, 18 aa, Mycobacterium tuberculosis
RRGHKMIIGMRGSYGGVV

SEQ ID NO: 1389246 - protein, 22 aa, Mycobacterium tuberculosis
RRWVTMLGAFILALAPGWFGVL

SEQ ID NO: 1389247 - protein, 30 aa, Mycobacterium tuberculosis
RTQPALDLDALIGGFKPLFRALNPEQVNAL

SEQ ID NO: 1389248 - protein, 17 aa, Mycobacterium tuberculosis
SAQRWKAIRGEAGWMTT

SEQ ID NO: 1389249 - protein, 19 aa, Mycobacterium tuberculosis
SAWRFVTVFGVVGLLADVV

SEQ ID NO: 1389250 - protein, 18 aa, Mycobacterium tuberculosis
SIHGLFAKMPLMVVILLT

SEQ ID NO: 1389251 - protein, 20 aa, Mycobacterium tuberculosis
SMFGPYHLKRLLGRGGMGEV

SEQ ID NO: 1389252 - protein, 31 aa, Mycobacterium tuberculosis; identical to SEQ ID NO: 163740

SEQ ID NO: 1389253 - protein, 32 aa, Mycobacterium tuberculosis; identical to SEQ ID NO: 163741

SEQ ID NO: 1389254 - protein, 19 aa, Mycobacterium tuberculosis
SPEQWFAFTPPRVPVLESL

SEQ ID NO: 1389255 - protein, 30 aa, Mycobacterium tuberculosis; identical to SEQ ID NO: 163766

SEQ ID NO: 1389256 - protein, 38 aa, Mycobacterium tuberculosis; identical to SEQ ID NO: 163769

SEQ ID NO: 1389257 - protein, 20 aa, Mycobacterium tuberculosis
SVVNFWAWNLIGPLSTSYAR

SEQ ID NO: 1389258 - protein, 18 aa, Mycobacterium tuberculosis
TAAVAVLIIACPCALGLA

SEQ ID NO: 1389259 - protein, 25 aa, Mycobacterium tuberculosis
TAGAVFLSAWLPFNNGLRPEPLIAL

SEQ ID NO: 1389260 - protein, 28 aa, Mycobacterium tuberculosis
TALLELTVLVLLLAAWFHFVANGDGRRT

SEQ ID NO: 1389261 - protein, 22 aa, Mycobacterium tuberculosis
TAQPLSLLPDAAAALYAIRADP

SEQ ID NO: 1389262 - protein, 24 aa, Mycobacterium tuberculosis
TGLGLLIGIWLGEGLIGLVTQTIN

SEQ ID NO: 1389263 - protein, 25 aa, Mycobacterium tuberculosis
TIYQNLGWAFGYNTAAIPLAALGAL

SEQ ID NO: 1389264 - protein, 22 aa, Mycobacterium tuberculosis
TLTVISFFWLWCATNLLAGVLA

SEQ ID NO: 1389265 - protein, 27 aa, Mycobacterium tuberculosis
TLVVGYALLPVLWIFSLSLKPTSTVKD

SEQ ID NO: 1389266 - protein, 18 aa, Mycobacterium tuberculosis
TQLDWVGQLTLIPAVALI

SEQ ID NO: 1389267 - protein, 17 aa, Mycobacterium tuberculosis
TTALLLHIGVMLAFLIL

SEQ ID NO: 1389268 - protein, 19 aa, Mycobacterium tuberculosis
TTDFVAFLDSDVTPRRGWL

SEQ ID NO: 1389269 - protein, 22 aa, Mycobacterium tuberculosis
TVVFGVLRWFFTTYRIDDENVS

SEQ ID NO: 1389270 - protein, 19 aa, Mycobacterium tuberculosis
VAFLDSDVTPRRGWLESLL

SEQ ID NO: 1389271 - protein, 26 aa, Mycobacterium tuberculosis
VATVRRFIERFAPYNLSPTAIRPSYG

SEQ ID NO: 1389272 - protein, 18 aa, Mycobacterium tuberculosis
VFLVAIPVSIALLWSLRF

SEQ ID NO: 1389273 - protein, 20 aa, Mycobacterium tuberculosis
VFSWTLAAVLTIGTITAATM

SEQ ID NO: 1389274 - protein, 24 aa, Mycobacterium tuberculosis
VIGALVVWWGWRERRDLFSGFGWL

SEQ ID NO: 1389275 - protein, 24 aa, Mycobacterium tuberculosis
VISGGALMAWILMSIGTGLGRLAS

SEQ ID NO: 1389276 - protein, 17 aa, Mycobacterium tuberculosis
VLTIPDGPGGQSGLAGG

SEQ ID NO: 1389277 - protein, 19 aa, Mycobacterium tuberculosis
VSPIDFWEHPTINALAAYL

SEQ ID NO: 1389278 - protein, 28 aa, Mycobacterium tuberculosis
VTAGMGMLALLLFGPRLVDIYVDWLWFG

SEQ ID NO: 1389279 - protein, 24 aa, Mycobacterium tuberculosis
VTTFLLAWELMAIASLILVLSEHA

SEQ ID NO: 1389280 - protein, 19 aa, Mycobacterium tuberculosis
WGSFLPDIDAFDAEFFEIS

SEQ ID NO: 1389281 - protein, 19 aa, Mycobacterium tuberculosis
WVRIFAVATAITIVVATDT

SEQ ID NO: 1389282 - protein, 17 aa, Mycobacterium tuberculosis
YAELPRSGGLYRTANVT

SEQ ID NO: 1389283 - protein, 25 aa, Mycobacterium tuberculosis
YAVAALWALLLAYSASRRFFALRRF

SEQ ID NO: 1389284 - protein, 29 aa, Mycobacterium tuberculosis
YFGLPTWLILFLRILFTAITFGALWLLYR

SEQ ID NO: 1389285 - protein, 18 aa, Mycobacterium tuberculosis
YLVGLAVLLILLTGLQRR

SEQ ID NO: 1389286 - protein, 17 aa, Mycobacterium tuberculosis
AALAYAVDVKNAVIVAA

SEQ ID NO: 1389287 - protein, 18 aa, Mycobacterium tuberculosis
AIAFGVMLPIRTAGQLPP

SEQ ID NO: 1389288 - protein, 21 aa, Mycobacterium tuberculosis
AKAGLFPFHTWLADAHSQAPA

SEQ ID NO: 1389289 - protein, 18 aa, Mycobacterium tuberculosis
ALLALTRAILIRVRNASW

SEQ ID NO: 1389290 - protein, 19 aa, Mycobacterium tuberculosis
ALQAARSYVVKLATMDCER

SEQ ID NO: 1389291 - protein, 24 aa, Mycobacterium tuberculosis
APYLLIWVIIIAYMCHIPFAVRSQ

SEQ ID NO: 1389292 - protein, 31 aa, Mycobacterium tuberculosis; identical to SEQ ID NO: 164332

SEQ ID NO: 1389293 - protein, 24 aa, Mycobacterium tuberculosis
ASAAILAILPLLGVLLGQLIGARP

SEQ ID NO: 1389294 - protein, 18 aa, Mycobacterium tuberculosis
ASDFAYLVDFGIARAASD

SEQ ID NO: 1389295 - protein, 27 aa, Mycobacterium tuberculosis
ATMITFRLRLPCRTILRVFSRNPLVRG

SEQ ID NO: 1389296 - protein, 25 aa, Mycobacterium tuberculosis
AVLARWRFRRRPAPARLPLWACGAA

SEQ ID NO: 1389297 - protein, 26 aa, Mycobacterium tuberculosis
AVVFYPLHLVPFGLIALLWQVVTMAA

SEQ ID NO: 1389298 - protein, 22 aa, Mycobacterium tuberculosis
DINNLLPLMQRLDTLMPQLTAM

SEQ ID NO: 1389299 - protein, 18 aa, Mycobacterium tuberculosis
DQLGGRRRPPGPPGPPGS

SEQ ID NO: 1389300 - protein, 18 aa, Mycobacterium tuberculosis
ELTFRRIAAALGRPMVPI

SEQ ID NO: 1389301 - protein, 23 aa, Mycobacterium tuberculosis
EPYLLLFTLFLAPAEHWLGHLRW

SEQ ID NO: 1389302 - protein, 27 aa, Mycobacterium tuberculosis
ESGLVLAYLGLLWWMMVCWSQPLRARP

SEQ ID NO: 1389303 - protein, 30 aa, Mycobacterium tuberculosis; identical to SEQ ID NO: 162251

SEQ ID NO: 1389304 - protein, 17 aa, Mycobacterium tuberculosis
EWFRIMPTAVDVLDSIG

SEQ ID NO: 1389305 - protein, 24 aa, Mycobacterium tuberculosis
EYIGFLVAWQRPLAGKKTLMDLAT

SEQ ID NO: 1389306 - protein, 27 aa, Mycobacterium tuberculosis
FFVVSNSLRLRKFGRYPLGCGTVGGPQ

SEQ ID NO: 1389307 - protein, 31 aa, Mycobacterium tuberculosis; identical to SEQ ID NO: 162295

SEQ ID NO: 1389308 - protein, 17 aa, Mycobacterium tuberculosis
FGGLLAAGLPMAQAVLA

SEQ ID NO: 1389309 - protein, 18 aa, Mycobacterium tuberculosis
FSPNPWSALVTGLVAGVF

SEQ ID NO: 1389310 - protein, 22 aa, Mycobacterium tuberculosis
GAVPGSPWWQHPVGSVTALATP

SEQ ID NO: 1389311 - protein, 25 aa, Mycobacterium tuberculosis
GHLQIAMVVLALLIAGLTAGGAFRM

SEQ ID NO: 1389312 - protein, 32 aa, Mycobacterium tuberculosis; identical to SEQ ID NO: 162513

SEQ ID NO: 1389313 - protein, 24 aa, Mycobacterium tuberculosis
GRLTRSVIGWVGAVAVVVSLAGSG

SEQ ID NO: 1389314 - protein, 19 aa, Mycobacterium tuberculosis
GWALRAIVAALLEWQRKSE

SEQ ID NO: 1389315 - protein, 35 aa, Mycobacterium tuberculosis; identical to SEQ ID NO: 162652

SEQ ID NO: 1389316 - protein, 22 aa, Mycobacterium tuberculosis
KHRGELVYLPPAWFDREHRSEN

SEQ ID NO: 1389317 - protein, 25 aa, Mycobacterium tuberculosis
KTLGFPIRLPQLPGGWTPNSGGRGG

SEQ ID NO: 1389318 - protein, 23 aa, Mycobacterium tuberculosis
LAMDPQQRLLLEVSWEALERAGI

SEQ ID NO: 1389319 - protein, 26 aa, Mycobacterium tuberculosis
LHLAVQSLRLGECDLALVGGVTVMAT

SEQ ID NO: 1389320 - protein, 25 aa, Mycobacterium tuberculosis
LHVSGYRFLLRRIECALLFGDVCAA

SEQ ID NO: 1389321 - protein, 18 aa, Mycobacterium tuberculosis
LLGLAVGWLVGALVVLVV

SEQ ID NO: 1389322 - protein, 20 aa, Mycobacterium tuberculosis
LQADCYAGVWAYYASTVKQE

SEQ ID NO: 1389323 - protein, 49 aa, Mycobacterium tuberculosis; identical to SEQ ID NO: 163088

SEQ ID NO: 1389324 - protein, 18 aa, Mycobacterium tuberculosis
LVTASDFAYLVDFGIARA

SEQ ID NO: 1389325 - protein, 19 aa, Mycobacterium tuberculosis
LWVGFTAVSALLILGLAQT

SEQ ID NO: 1389326 - protein, 25 aa, Mycobacterium tuberculosis
MTIPIAIFMGCYLRFLRPGRVSEVS

SEQ ID NO: 1389327 - protein, 18 aa, Mycobacterium tuberculosis
MVGAALWPSAAAGLAGVL

SEQ ID NO: 1389328 - protein, 19 aa, Mycobacterium tuberculosis
NALLGIYYSHSLYYGLTPE

SEQ ID NO: 1389329 - protein, 24 aa, Mycobacterium tuberculosis
PDIPGLPDFKWPPTPGSPLFPDLP

SEQ ID NO: 1389330 - protein, 26 aa, Mycobacterium tuberculosis
PDLAAGLVCWLLLSREVLPRLGPAVE

SEQ ID NO: 1389331 - protein, 17 aa, Mycobacterium tuberculosis
PLEVLFSSLLWIDGRNL

SEQ ID NO: 1389332 - protein, 22 aa, Mycobacterium tuberculosis
PNFTVLVILRLLYGIGMGGEWG

SEQ ID NO: 1389333 - protein, 27 aa, Mycobacterium tuberculosis
PPEPHPPIPTTPWQHTRHWITTKYPAG

SEQ ID NO: 1389334 - protein, 27 aa, Mycobacterium tuberculosis
PWLADHAVGPVVLFPGTGFVELALRAG

SEQ ID NO: 1389335 - protein, 35 aa, Mycobacterium tuberculosis; identical to SEQ ID NO: 164872

SEQ ID NO: 1389336 - protein, 21 aa, Mycobacterium tuberculosis
REGSFWRRLLSPPGFTSIAHV

SEQ ID NO: 1389337 - protein, 24 aa, Mycobacterium tuberculosis
RGYGYGPAFRGLQALWRRGAEVFA

SEQ ID NO: 1389338 - protein, 20 aa, Mycobacterium tuberculosis
RPVLPKRARLLVTAGMGMLA

SEQ ID NO: 1389339 - protein, 37 aa, Mycobacterium tuberculosis
RSRIEFAITILLLVILLIIYGNPITMVLPLITIGMSV

SEQ ID NO: 1389340 - protein, 19 aa, Mycobacterium tuberculosis
RTQRLRALIAPALVVGGIG

SEQ ID NO: 1389341 - protein, 35 aa, Mycobacterium tuberculosis; identical to SEQ ID NO: 163655

SEQ ID NO: 1389342 - protein, 25 aa, Mycobacterium tuberculosis
SCIFVAWFVLYLVLVLRAVGAGGNS

SEQ ID NO: 1389343 - protein, 44 aa, Mycobacterium tuberculosis; identical to SEQ ID NO: 163679

SEQ ID NO: 1389344 - protein, 39 aa, Mycobacterium tuberculosis; identical to SEQ ID NO: 163729

SEQ ID NO: 1389345 - protein, 24 aa, Mycobacterium tuberculosis
SPPSHLWQARLAPDAKPYQGGHRF

SEQ ID NO: 1389346 - protein, 18 aa, Mycobacterium tuberculosis
SYFREIVTRFDYDDAVLL

SEQ ID NO: 1389347 - protein, 27 aa, Mycobacterium tuberculosis
TFIAGLVVWDLAFTLPLPLGVARHEGS

SEQ ID NO: 1389348 - protein, 17 aa, Mycobacterium tuberculosis
TFVWLDRIGLRGGGWAG

SEQ ID NO: 1389349 - protein, 24 aa, Mycobacterium tuberculosis
TGRISVVAAPWLADHAVGPVVLFP

SEQ ID NO: 1389350 - protein, 20 aa, Mycobacterium tuberculosis
TLDVDLLMVVAAIGAAAIGQ

SEQ ID NO: 1389351 - protein, 30 aa, Mycobacterium tuberculosis; identical to SEQ ID NO: 163927

SEQ ID NO: 1389352 - protein, 35 aa, Mycobacterium tuberculosis
TVEIAPGITIPIGPPTTITLAPPPPAPPAATPTPP

SEQ ID NO: 1389353 - protein, 25 aa, Mycobacterium tuberculosis
TVMATPAMFIEFSRQRALSADGRCK

SEQ ID NO: 1389354 - protein, 18 aa, Mycobacterium tuberculosis
TVTFMLVWLINHHGWSVA

SEQ ID NO: 1389355 - protein, 24 aa, Mycobacterium tuberculosis
VHHSRWHFAVLYTFLSMVNSCLGL

SEQ ID NO: 1389356 - protein, 19 aa, Mycobacterium tuberculosis
VRIKLWLQYVIAGTPRMPD

SEQ ID NO: 1389357 - protein, 18 aa, Mycobacterium tuberculosis
VRRFVYLVLLMTAFNWMS

SEQ ID NO: 1389358 - protein, 27 aa, Mycobacterium tuberculosis
VTFTVIIVMLLLVYRSIITSAIMLTMV

SEQ ID NO: 1389359 - protein, 17 aa, Mycobacterium tuberculosis
VTLKRFIDRFAPFNLDP

SEQ ID NO: 1389360 - protein, 25 aa, Mycobacterium tuberculosis
VVLQSILAVAFGAGLFIAFDQLWRW

SEQ ID NO: 1389361 - protein, 26 aa, Mycobacterium tuberculosis
WLIEQPIRRWRPARVPLLPLAAATVA

SEQ ID NO: 1389362 - protein, 27 aa, Mycobacterium tuberculosis
WPALAMFAIIFFWTPPHTWALAMRYKQ

SEQ ID NO: 1389363 - protein, 28 aa, Mycobacterium tuberculosis
YFQTFLRPDDVFWSFLEALIITAIVMVS

SEQ ID NO: 1389364 - protein, 35 aa, Mycobacterium tuberculosis; identical to SEQ ID NO: 164269

SEQ ID NO: 1389365 - protein, 26 aa, Mycobacterium tuberculosis
AAHCPAYFQLLVKALVLPGLQELEHT

SEQ ID NO: 1389366 - protein, 18 aa, Mycobacterium tuberculosis
AAPLIAAGLRALFGHRHR

SEQ ID NO: 1389367 - protein, 27 aa, Mycobacterium tuberculosis
AGVNAEYWYRSIRQPVQFERAVRNAFD

SEQ ID NO: 1389368 - protein, 22 aa, Mycobacterium tuberculosis
AILAAVVCVLTLTIARPVRTYF

SEQ ID NO: 1389369 - protein, 19 aa, Mycobacterium tuberculosis
AILMLYTIVIIRGLRTAIA

SEQ ID NO: 1389370 - protein, 22 aa, Mycobacterium tuberculosis
ALFPMYFLKSFAYAGVATVAFV

SEQ ID NO: 1389371 - protein, 20 aa, Mycobacterium tuberculosis
ALRSRLLVRLGGAGGMVSLA

SEQ ID NO: 1389372 - protein, 17 aa, Mycobacterium tuberculosis
ANERLAWVLGAALLLIA

SEQ ID NO: 1389373 - protein, 21 aa, Mycobacterium tuberculosis
ARTRRGLRALLSLVPDQATVL

SEQ ID NO: 1389374 - protein, 57 aa, Mycobacterium tuberculosis; identical to SEQ ID NO: 161984

SEQ ID NO: 1389375 - protein, 26 aa, Mycobacterium tuberculosis
AVVALLVLLGLPFLSVKWGFPDDRVL

SEQ ID NO: 1389376 - protein, 21 aa, Mycobacterium tuberculosis
CAVVLATMPPLLAAIANAGRH

SEQ ID NO: 1389377 - protein, 20 aa, Mycobacterium tuberculosis
CGVFVFLILRALGELVLHRP

SEQ ID NO: 1389378 - protein, 19 aa, Mycobacterium tuberculosis
DLTANPLRFLARATNLWNS

SEQ ID NO: 1389379 - protein, 29 aa, Mycobacterium tuberculosis
DPGAAVQAPWPLLRTFAAGPALSRDAALL

SEQ ID NO: 1389380 - protein, 32 aa, Mycobacterium tuberculosis
DTVDHGLWVAFWFFLAQLNLILAAINLLPLLP

SEQ ID NO: 1389381 - protein, 18 aa, Mycobacterium tuberculosis
DVRRLVRRLLGRPDPVHK

SEQ ID NO: 1389382 - protein, 22 aa, Mycobacterium tuberculosis
ELVTILPIVLVIAAVAAYLLSR

SEQ ID NO: 1389383 - protein, 34 aa, Mycobacterium tuberculosis; identical to SEQ ID NO: 164683

SEQ ID NO: 1389384 - protein, 27 aa, Mycobacterium tuberculosis
GISALCLIFIIMLITTRSVVAAAVIVG

SEQ ID NO: 1389385 - protein, 19 aa, Mycobacterium tuberculosis
GRIGLGKRTFSLPWRLANI

SEQ ID NO: 1389386 - protein, 44 aa, Mycobacterium tuberculosis
GTRDRYLLMPSFTFVGVAQAALWTGYRPWFIDIDANTWQPCVHS

SEQ ID NO: 1389387 - protein, 19 aa, Mycobacterium tuberculosis
GWCGWVLFEKHQTDVAAGQ

SEQ ID NO: 1389388 - protein, 37 aa, Mycobacterium tuberculosis
GWVGTHAYWLGAQWWHPLVVVGLIALVAIMIAAATPG

SEQ ID NO: 1389389 - protein, 24 aa, Mycobacterium tuberculosis
HDDRRLLSLILLARDHVVHGWVLA

SEQ ID NO: 1389390 - protein, 22 aa, Mycobacterium tuberculosis
HKPVKQLFWYRSSKFVMRRWLP

SEQ ID NO: 1389391 - protein, 23 aa, Mycobacterium tuberculosis
IDRSRIKVIMDKVNGRWLASKVE

SEQ ID NO: 1389392 - protein, 19 aa, Mycobacterium tuberculosis
IGLGLLFDTLVVRAFMTPS

SEQ ID NO: 1389393 - protein, 23 aa, Mycobacterium tuberculosis
IRWRLTLVFSAAMALVLAAAGAV

SEQ ID NO: 1389394 - protein, 18 aa, Mycobacterium tuberculosis
ISRALFDGLPATEPLRVP

SEQ ID NO: 1389395 - protein, 25 aa, Mycobacterium tuberculosis
KAGLVPLHAWLPRAHPEAPSPVSAL

SEQ ID NO: 1389396 - protein, 24 aa, Mycobacterium tuberculosis
KLGIVWLVLSVFTVMIIVVFGQVR

SEQ ID NO: 1389397 - protein, 20 aa, Mycobacterium tuberculosis
LAILLCLVLGVAIVTQVRQT

SEQ ID NO: 1389398 - protein, 52 aa, Mycobacterium tuberculosis; identical to SEQ ID NO: 162859

SEQ ID NO: 1389399 - protein, 17 aa, Mycobacterium tuberculosis
LALPTIGIFLATLTAFV

SEQ ID NO: 1389400 - protein, 18 aa, Mycobacterium tuberculosis
LFSSLLWIDGRNLEPYLL

SEQ ID NO: 1389401 - protein, 26 aa, Mycobacterium tuberculosis
LGRVPMAVVPLFVAAMLLVPAAGSVT

SEQ ID NO: 1389402 - protein, 26 aa, Mycobacterium tuberculosis
LIAAITYVLLFLLTGSVVLPAKALVC

SEQ ID NO: 1389403 - protein, 17 aa, Mycobacterium tuberculosis
LIGYVGLADTARSSSRP

SEQ ID NO: 1389404 - protein, 19 aa, Mycobacterium tuberculosis
LLESLALLRALYVISSWRP

SEQ ID NO: 1389405 - protein, 17 aa, Mycobacterium tuberculosis
LLNPLIAGAAMAFSSFF

SEQ ID NO: 1389406 - protein, 26 aa, Mycobacterium tuberculosis
LLRLCMLPGLALLVWATPRLASHLGT

SEQ ID NO: 1389407 - protein, 18 aa, Mycobacterium tuberculosis
LNTKLPEDPPPPPKPAAV

SEQ ID NO: 1389408 - protein, 19 aa, Mycobacterium tuberculosis
LVAYLALLIGLGFGLLAVG

SEQ ID NO: 1389409 - protein, 24 aa, Mycobacterium tuberculosis
NSGHLFYNRRLRAATTRFSVRMKH

SEQ ID NO: 1389410 - protein, 22 aa, Mycobacterium tuberculosis
PFLLIMGGFMYFASRRQRRAMQ

SEQ ID NO: 1389411 - protein, 18 aa, Mycobacterium tuberculosis
PGAPGPMPAPPLGAVPSP

SEQ ID NO: 1389412 - protein, 17 aa, Mycobacterium tuberculosis
PGYGPPPGPPPPGYPTH

SEQ ID NO: 1389413 - protein, 18 aa, Mycobacterium tuberculosis
PITMVLPLITIGMSVVVA

SEQ ID NO: 1389414 - protein, 28 aa, Mycobacterium tuberculosis
PPAPGGSWPTAWLVALVVLACVAAAVVA

SEQ ID NO: 1389415 - protein, 26 aa, Mycobacterium tuberculosis
QAQNQAYGYLFPHGTFFVIGHLLGVP

SEQ ID NO: 1389416 - protein, 19 aa, Mycobacterium tuberculosis
QLRHTVLVPGPPPGSAIAG

SEQ ID NO: 1389417 - protein, 18 aa, Mycobacterium tuberculosis
RAGLRFAAPLIAAGLRAL

SEQ ID NO: 1389418 - protein, 17 aa, Mycobacterium tuberculosis
RGASLLAVPLCLLSATL

SEQ ID NO: 1389419 - protein, 36 aa, Mycobacterium tuberculosis; identical to SEQ ID NO: 164892

SEQ ID NO: 1389420 - protein, 20 aa, Mycobacterium tuberculosis
RLSHFGALVRIPRSVEALGR

SEQ ID NO: 1389421 - protein, 18 aa, Mycobacterium tuberculosis
RMWRRSGVRIVRRSTIHL

SEQ ID NO: 1389422 - protein, 17 aa, Mycobacterium tuberculosis
RPRYPAIEIYRVSAPAN

SEQ ID NO: 1389423 - protein, 20 aa, Mycobacterium tuberculosis
RPSRPIVLLIPVPGSSVIHD

SEQ ID NO: 1389424 - protein, 29 aa, Mycobacterium tuberculosis
RRQLADRPTPPWRPGAWAAAGVLAAGAVI

SEQ ID NO: 1389425 - protein, 21 aa, Mycobacterium tuberculosis
RRQRVLTITAWLAVVVTGSFA

SEQ ID NO: 1389426 - protein, 30 aa, Mycobacterium tuberculosis; identical to SEQ ID NO: 164907

SEQ ID NO: 1389427 - protein, 27 aa, Mycobacterium tuberculosis
RTLANKVPFVVLVIGSLGVGLGLTLWL

SEQ ID NO: 1389428 - protein, 20 aa, Mycobacterium tuberculosis
RWNWWAPRPLAWLHERFGVS

SEQ ID NO: 1389429 - protein, 25 aa, Mycobacterium tuberculosis
SAGRLQPFFATPAAWRILDALVAVT

SEQ ID NO: 1389430 - protein, 21 aa, Mycobacterium tuberculosis
SLIERFPLMLGTAAGVLLIGL

SEQ ID NO: 1389431 - protein, 22 aa, Mycobacterium tuberculosis
SRSARPILLHRSIAGSPGLAKL

SEQ ID NO: 1389432 - protein, 25 aa, Mycobacterium tuberculosis
SVEWDTLLFFAGLFIMVGALVKTGV

SEQ ID NO: 1389433 - protein, 20 aa, Mycobacterium tuberculosis
SVTILLAVALVFDLPAALQR

SEQ ID NO: 1389434 - protein, 20 aa, Mycobacterium tuberculosis
TFGVVPGYVLLALALGSYAL

SEQ ID NO: 1389435 - protein, 36 aa, Mycobacterium tuberculosis; identical to SEQ ID NO: 164937

SEQ ID NO: 1389436 - protein, 23 aa, Mycobacterium tuberculosis
TIPKIPFIRPSFPGPAELAEDFV

SEQ ID NO: 1389437 - protein, 20 aa, Mycobacterium tuberculosis
TLTLTLPRPTVVTGLRLAAS

SEQ ID NO: 1389438 - protein, 17 aa, Mycobacterium tuberculosis
TNFAWLYPVLTGLPISQ

SEQ ID NO: 1389439 - protein, 22 aa, Mycobacterium tuberculosis
TPKVFKAAAWVAIAAGTVFIVA

SEQ ID NO: 1389440 - protein, 27 aa, Mycobacterium tuberculosis
TPSIAVLLGRWFWWPQRVRPRPASRML

SEQ ID NO: 1389441 - protein, 17 aa, Mycobacterium tuberculosis
TPTLSRVANLELYLIFP

SEQ ID NO: 1389442 - protein, 27 aa, Mycobacterium tuberculosis
TSFREIRWNLRVIVMFSIGLVIATAVA

SEQ ID NO: 1389443 - protein, 21 aa, Mycobacterium tuberculosis
TVVRWRLAWLSKPETWRRRKR

SEQ ID NO: 1389444 - protein, 32 aa, Mycobacterium tuberculosis; identical to SEQ ID NO: 164057

SEQ ID NO: 1389445 - protein, 22 aa, Mycobacterium tuberculosis
VMTQLGFIAILVGLVVLAAAGG

SEQ ID NO: 1389446 - protein, 25 aa, Mycobacterium tuberculosis
VTDRLPMVLGLIAAITYVLLFLLTG

SEQ ID NO: 1389447 - protein, 17 aa, Mycobacterium tuberculosis
WVQLGMLGLIGAAAAVG

SEQ ID NO: 1389448 - protein, 18 aa, Mycobacterium tuberculosis
AAALWLVAPCTELYHDSR

SEQ ID NO: 1389449 - protein, 33 aa, Mycobacterium tuberculosis
AAALWTIIYGLANRLFIPRFLFSMGVIGVVAAT

SEQ ID NO: 1389450 - protein, 17 aa, Mycobacterium tuberculosis
AAIPRRRTDRRAYSCWP

SEQ ID NO: 1389451 - protein, 18 aa, Mycobacterium tuberculosis
AALSNYFRTGNLTALREI

SEQ ID NO: 1389452 - protein, 26 aa, Mycobacterium tuberculosis
ALVLVLLLAAPLLRPGYLLLRDAVST

SEQ ID NO: 1389453 - protein, 18 aa, Mycobacterium tuberculosis
ANWKISAAYLNWLADRLQ

SEQ ID NO: 1389454 - protein, 25 aa, Mycobacterium tuberculosis
AVALVLWWRMIRFEYALLVTVATAA

SEQ ID NO: 1389455 - protein, 18 aa, Mycobacterium tuberculosis
AVLFLTSSLYSTATFLAS

SEQ ID NO: 1389456 - protein, 28 aa, Mycobacterium tuberculosis
AVLTYHIAKPWRWGYLGVLLVIFGFPLI

SEQ ID NO: 1389457 - protein, 18 aa, Mycobacterium tuberculosis
DFVPILFVVFGIGALNTS

SEQ ID NO: 1389458 - protein, 24 aa, Mycobacterium tuberculosis
DSRPRLILGASLIGLSFLGLCHLW

SEQ ID NO: 1389459 - protein, 17 aa, Mycobacterium tuberculosis
DVFLGLPLLLAAIVLMQ

SEQ ID NO: 1389460 - protein, 24 aa, Mycobacterium tuberculosis
ETARPADLLVLLDSLRQREATLNA

SEQ ID NO: 1389461 - protein, 20 aa, Mycobacterium tuberculosis
FDGSTYVIWGGKRSQIDPTN

SEQ ID NO: 1389462 - protein, 20 aa, Mycobacterium tuberculosis
FEPRHRPPPLPPQQERPVWQ

SEQ ID NO: 1389463 - protein, 17 aa, Mycobacterium tuberculosis
FGFLITALCLFTAVFIM

SEQ ID NO: 1389464 - protein, 30 aa, Mycobacterium tuberculosis; identical to SEQ ID NO: 162328

SEQ ID NO: 1389465 - protein, 17 aa, Mycobacterium tuberculosis
FVGPVVAFPAFGYIHIQ

SEQ ID NO: 1389466 - protein, 27 aa, Mycobacterium tuberculosis
GFRALFGAFLLGLLFFVATTSMIRYVS

SEQ ID NO: 1389467 - protein, 24 aa, Mycobacterium tuberculosis
GLGPPLVALMLLGIPSLLASTYAG

SEQ ID NO: 1389468 - protein, 23 aa, Mycobacterium tuberculosis
GPLVFDLGICLVLITLPTLALFV

SEQ ID NO: 1389469 - protein, 22 aa, Mycobacterium tuberculosis
GSGLLLLLPLSLETRTVVALLC

SEQ ID NO: 1389470 - protein, 17 aa, Mycobacterium tuberculosis
GSPLFPDLPSFPGFPGF

SEQ ID NO: 1389471 - protein, 18 aa, Mycobacterium tuberculosis
GSPLLMTYLLVDVSGARL

SEQ ID NO: 1389472 - protein, 35 aa, Mycobacterium tuberculosis; identical to SEQ ID NO: 162563

SEQ ID NO: 1389473 - protein, 17 aa, Mycobacterium tuberculosis
GVRGFWMSIGVFSVMAV

SEQ ID NO: 1389474 - protein, 29 aa, Mycobacterium tuberculosis
GVSIPRAMFWTVLVYVFVATVISFIIGRP

SEQ ID NO: 1389475 - protein, 27 aa, Mycobacterium tuberculosis
IAAAPILGVPGWAWTLWAVLTAGCAGL

SEQ ID NO: 1389476 - protein, 25 aa, Mycobacterium tuberculosis
IAEGALLIVIFATSGALEALVTART

SEQ ID NO: 1389477 - protein, 18 aa, Mycobacterium tuberculosis
IAVLAVAFIAAISGWRAG

SEQ ID NO: 1389478 - protein, 19 aa, Mycobacterium tuberculosis
IIGLFLAVYLMANIPGSST

SEQ ID NO: 1389479 - protein, 19 aa, Mycobacterium tuberculosis
IMLALLVPVLPFAFSYAIY

SEQ ID NO: 1389480 - protein, 18 aa, Mycobacterium tuberculosis
IPSLMWISVPVILGIAIA

SEQ ID NO: 1389481 - protein, 24 aa, Mycobacterium tuberculosis
ISVISFTAILWNLSGTLNIFGVSI

SEQ ID NO: 1389482 - protein, 17 aa, Mycobacterium tuberculosis
KYQALVRQGMYGDFFAF

SEQ ID NO: 1389483 - protein, 17 aa, Mycobacterium tuberculosis
LAHLCFIGALLPLARQA

SEQ ID NO: 1389484 - protein, 21 aa, Mycobacterium tuberculosis
LAVTVSLLTIPFAAAAGTAVH

SEQ ID NO: 1389485 - protein, 27 aa, Mycobacterium tuberculosis
LGPLYGIFIVWLLHDWRDVFWINVPLT

SEQ ID NO: 1389486 - protein, 17 aa, Mycobacterium tuberculosis
LHAFAGQGPTIGSLLAQ

SEQ ID NO: 1389487 - protein, 23 aa, Mycobacterium tuberculosis
LIMGLHPLIFFLPVRQGANWVVL

SEQ ID NO: 1389488 - protein, 17 aa, Mycobacterium tuberculosis
LMLGTAAGVLLIGLVRW

SEQ ID NO: 1389489 - protein, 26 aa, Mycobacterium tuberculosis
LPYATVLIGLALIALGGWLLLGRGLT

SEQ ID NO: 1389490 - protein, 18 aa, Mycobacterium tuberculosis
LSEQLLHAFAGQGPTIGS

SEQ ID NO: 1389491 - protein, 19 aa, Mycobacterium tuberculosis
LTRFRSPLRGPWLTSVFGL

SEQ ID NO: 1389492 - protein, 20 aa, Mycobacterium tuberculosis
LVILVVVIVGGFTVHRIRGF

SEQ ID NO: 1389493 - protein, 17 aa, Mycobacterium tuberculosis
LWLHYYAASYEFGFVRR

SEQ ID NO: 1389494 - protein, 17 aa, Mycobacterium tuberculosis
NAGVTALVLLFVGGALY

SEQ ID NO: 1389495 - protein, 24 aa, Mycobacterium tuberculosis
NGKRPKLRRILSDPDARVIVVEHR

SEQ ID NO: 1389496 - protein, 26 aa, Mycobacterium tuberculosis
PARGRLVTMLLVGVVLLAVGHRGGLA

SEQ ID NO: 1389497 - protein, 21 aa, Mycobacterium tuberculosis
PELFCTIRNFYDADPLAKAAS

SEQ ID NO: 1389498 - protein, 27 aa, Mycobacterium tuberculosis
PFRRRNPRPAIVVVAFLVVVTCVMWTL

SEQ ID NO: 1389499 - protein, 24 aa, Mycobacterium tuberculosis
PGEEKLVFSRFWRSDPSRVRRSGG

SEQ ID NO: 1389500 - protein, 19 aa, Mycobacterium tuberculosis
PLLSIDGYRRLQVRSGYTL

SEQ ID NO: 1389501 - protein, 32 aa, Mycobacterium tuberculosis; identical to SEQ ID NO: 163347

SEQ ID NO: 1389502 - protein, 23 aa, Mycobacterium tuberculosis
QAHAFWDIATFLINGSLWVFVGV

SEQ ID NO: 1389503 - protein, 31 aa, Mycobacterium tuberculosis
QALVRQGMYGDFFAFYLCDVVLKVNGKGGQP

SEQ ID NO: 1389504 - protein, 24 aa, Mycobacterium tuberculosis
QFDSLLAVARPFFAKNREVLTHDV

SEQ ID NO: 1389505 - protein, 28 aa, Mycobacterium tuberculosis
RASIQSKLMVLLLLTSIVSVAAIAAIVY

SEQ ID NO: 1389506 - protein, 26 aa, Mycobacterium tuberculosis
RFALKRGALMFGKLVPMGIGAIIGAI

SEQ ID NO: 1389507 - protein, 19 aa, Mycobacterium tuberculosis
RHIVRLVVFAGFLVGMFYL

SEQ ID NO: 1389508 - protein, 17 aa, Mycobacterium tuberculosis
RRRHIVRLVVFAGFLVG

SEQ ID NO: 1389509 - protein, 26 aa, Mycobacterium tuberculosis
RSVGVPLYLLLGWVAVWYTATILHNA

SEQ ID NO: 1389510 - protein, 20 aa, Mycobacterium tuberculosis
RWDALGFLQDFFATAVFLGI

SEQ ID NO: 1389511 - protein, 19 aa, Mycobacterium tuberculosis
SAWGLYRFNQILAGLSAAI

SEQ ID NO: 1389512 - protein, 28 aa, Mycobacterium tuberculosis
SGGSALILAAYYPQQFPYAASLSGFLNP

SEQ ID NO: 1389513 - protein, 24 aa, Mycobacterium tuberculosis
SPRLTNLLVVAAWVAAAVIANLLL

SEQ ID NO: 1389514 - protein, 27 aa, Mycobacterium tuberculosis
TGLFRTLYVLPWICAPLAIAVMWRWIL

SEQ ID NO: 1389515 - protein, 27 aa, Mycobacterium tuberculosis
TGRQATTLLALLAGVFGGAASCAAPIQ

SEQ ID NO: 1389516 - protein, 20 aa, Mycobacterium tuberculosis
TMFLSQLPYVPLGTLRDVVC

SEQ ID NO: 1389517 - protein, 24 aa, Mycobacterium tuberculosis
TTLLSFRLQPTLSVLLVAAGAFGF

SEQ ID NO: 1389518 - protein, 18 aa, Mycobacterium tuberculosis
VAFARILLTKPKAVFLDE

SEQ ID NO: 1389519 - protein, 25 aa, Mycobacterium tuberculosis
VAVTAYFRMGWWSIIGYAAAAIIGV

SEQ ID NO: 1389520 - protein, 25 aa, Mycobacterium tuberculosis
VAVTLAVFAVPPLWGETLQRALLRA

SEQ ID NO: 1389521 - protein, 21 aa, Mycobacterium tuberculosis
VDWTRWWVMITLDVAIVYILY

SEQ ID NO: 1389522 - protein, 19 aa, Mycobacterium tuberculosis
VGGLWAWIAPPIHAVVAIT

SEQ ID NO: 1389523 - protein, 34 aa, Mycobacterium tuberculosis
VGHFTLFHLSLRHALWWLGSLAAVASFTLQAIAL

SEQ ID NO: 1389524 - protein, 18 aa, Mycobacterium tuberculosis
VGRWVAVVAVLAVLTVVV

SEQ ID NO: 1389525 - protein, 24 aa, Mycobacterium tuberculosis
VIFATFTFIFFALEGSIMAQGLKL

SEQ ID NO: 1389526 - protein, 25 aa, Mycobacterium tuberculosis
VIGNLFGVVPLLGGPLLGALAAAVV

SEQ ID NO: 1389527 - protein, 28 aa, Mycobacterium tuberculosis
VLATGVLGWWRWHHNTWLTTIYTAVIGV

SEQ ID NO: 1389528 - protein, 20 aa, Mycobacterium tuberculosis
VLPILFMVVLNIVLGNLAYV

SEQ ID NO: 1389529 - protein, 25 aa, Mycobacterium tuberculosis
VMAGFTGLPRRASTVALVALVAAQL

SEQ ID NO: 1389530 - protein, 24 aa, Mycobacterium tuberculosis
VMPGDIPFQVQLPSTPLAPPQPGS

SEQ ID NO: 1389531 - protein, 32 aa, Mycobacterium tuberculosis
VVAFLVVVTCVMWTLALTRPPDVREAAVCNPP

SEQ ID NO: 1389532 - protein, 29 aa, Mycobacterium tuberculosis
VVRLGVFLAVCLLTAFLLIAVFGEVRFGD

SEQ ID NO: 1389533 - protein, 25 aa, Mycobacterium tuberculosis
VVSQLLGCTPLDPLGWAQATAAATA

SEQ ID NO: 1389534 - protein, 32 aa, Mycobacterium tuberculosis
YLGALVGGLAWPFLLLPQLGMIRGAAVTGIVN

SEQ ID NO: 1389535 - protein, 37 aa, Mycobacterium tuberculosis; identical to SEQ ID NO: 164293

SEQ ID NO: 1389536 - protein, 18 aa, Mycobacterium tuberculosis
YTDAPWWVTFGVAPAYAT

SEQ ID NO: 1389537 - protein, 17 aa, Mycobacterium tuberculosis
AARDLPPACFSIFAVFW

SEQ ID NO: 1389538 - protein, 26 aa, Mycobacterium tuberculosis
AEWMPNFIELLQRKLSRIVDPVLQKL

SEQ ID NO: 1389539 - protein, 19 aa, Mycobacterium tuberculosis
AHQPFRYWLTHAATVATAA

SEQ ID NO: 1389540 - protein, 24 aa, Mycobacterium tuberculosis
ALAGALLMPWYIGSAPFPISALIS

SEQ ID NO: 1389541 - protein, 17 aa, Mycobacterium tuberculosis
ARLTTAMLTLYFILAVG

SEQ ID NO: 1389542 - protein, 23 aa, Mycobacterium tuberculosis
ASLIGLSFLGLCHLWAGSPEAPE

SEQ ID NO: 1389543 - protein, 24 aa, Mycobacterium tuberculosis
ATCGCLALGWWQWTRFQSTSGTFQ

SEQ ID NO: 1389544 - protein, 18 aa, Mycobacterium tuberculosis
AWILPVGLPGDLGSTQSK

SEQ ID NO: 1389545 - protein, 26 aa, Mycobacterium tuberculosis
DPVRRWLLLALVSTWGLRLSWHMYRK

SEQ ID NO: 1389546 - protein, 23 aa, Mycobacterium tuberculosis
DRDFIGISLFSLGLSVAVVVGAG

SEQ ID NO: 1389547 - protein, 18 aa, Mycobacterium tuberculosis
DSVVTPLRLALERDTRAV

SEQ ID NO: 1389548 - protein, 19 aa, Mycobacterium tuberculosis
ELILSCGVALHHCVVALAS

SEQ ID NO: 1389549 - protein, 23 aa, Mycobacterium tuberculosis
EYLRELTIWSGRYGSVAGVPARN

SEQ ID NO: 1389550 - protein, 17 aa, Mycobacterium tuberculosis
FAAFLLAQSLKCSGVVA

SEQ ID NO: 1389551 - protein, 31 aa, Mycobacterium tuberculosis
FPLADPIVGLLITAAILAVLRTAARDVFRRL

SEQ ID NO: 1389552 - protein, 22 aa, Mycobacterium tuberculosis
FPNAILWLHYYAASYEFGFVRR

SEQ ID NO: 1389553 - protein, 26 aa, Mycobacterium tuberculosis
FRALFGAFLLGLLFFVATTSMIRYVS

SEQ ID NO: 1389554 - protein, 26 aa, Mycobacterium tuberculosis
GDACVWWGLWLITINDWAPLATVGSP

SEQ ID NO: 1389555 - protein, 17 aa, Mycobacterium tuberculosis
GLALGVLYVPCAGPILA

SEQ ID NO: 1389556 - protein, 17 aa, Mycobacterium tuberculosis
GLGYFRKSLEDIIRFQA

SEQ ID NO: 1389557 - protein, 18 aa, Mycobacterium tuberculosis
GTMLLRLCMLPGLALLVW

SEQ ID NO: 1389558 - protein, 25 aa, Mycobacterium tuberculosis
GTSYRSVLMYPEKMPRPPWRHETHN

SEQ ID NO: 1389559 - protein, 34 aa, Mycobacterium tuberculosis; identical to SEQ ID NO: 164410

SEQ ID NO: 1389560 - protein, 26 aa, Mycobacterium tuberculosis
IAFGYSGLPFWPQGKTYDAYFTDAGG

SEQ ID NO: 1389561 - protein, 51 aa, Mycobacterium tuberculosis; identical to SEQ ID NO: 162659

SEQ ID NO: 1389562 - protein, 29 aa, Mycobacterium tuberculosis
IPINQLHRITWIVTMYLLGYIAAMPLLGR

SEQ ID NO: 1389563 - protein, 22 aa, Mycobacterium tuberculosis
IPLWAGYACSTLIIFPLVVYGM

SEQ ID NO: 1389564 - protein, 31 aa, Mycobacterium tuberculosis; identical to SEQ ID NO: 162812

SEQ ID NO: 1389565 - protein, 20 aa, Mycobacterium tuberculosis
KSMYLIVEPVKDPTTPAALS

SEQ ID NO: 1389566 - protein, 18 aa, Mycobacterium tuberculosis
LCGIAIFALVVFVTGLPL

SEQ ID NO: 1389567 - protein, 21 aa, Mycobacterium tuberculosis
LGGVWLTSFLLVATNTAIASV

SEQ ID NO: 1389568 - protein, 25 aa, Mycobacterium tuberculosis
LGLGPPLVALMLLGIPSLLASTYAG

SEQ ID NO: 1389569 - protein, 28 aa, Mycobacterium tuberculosis
LGWILPVIAQLVWWAVHPQPPWPHLAAA

SEQ ID NO: 1389570 - protein, 17 aa, Mycobacterium tuberculosis
LLVVSALATLSGLGTPV

SEQ ID NO: 1389571 - protein, 18 aa, Mycobacterium tuberculosis
LMPWYIGSAPFPISALIS

SEQ ID NO: 1389572 - protein, 44 aa, Mycobacterium tuberculosis
LSALLSELPAVAWVWFQLFVDILGFNIIGFIITLASNAQLLTEF

SEQ ID NO: 1389573 - protein, 17 aa, Mycobacterium tuberculosis
LTQRFIIAWRVWLTHHL

SEQ ID NO: 1389574 - protein, 19 aa, Mycobacterium tuberculosis
LTSPVLLPAGLTGLAGLGA

SEQ ID NO: 1389575 - protein, 27 aa, Mycobacterium tuberculosis
LVADGHPWRWFLIGFMVLFHLNILSNL

SEQ ID NO: 1389576 - protein, 28 aa, Mycobacterium tuberculosis
LVASGVFVLIMMIALPRVPIGWDEAAAT

SEQ ID NO: 1389577 - protein, 25 aa, Mycobacterium tuberculosis
LVVFAGFLVGMFYLVAATDVIDVAA

SEQ ID NO: 1389578 - protein, 18 aa, Mycobacterium tuberculosis
LVVWGIWHVYFVEAVFPN

SEQ ID NO: 1389579 - protein, 18 aa, Mycobacterium tuberculosis
MFLSQLPYVPLGTLRDVV

SEQ ID NO: 1389580 - protein, 21 aa, Mycobacterium tuberculosis
PALDLDALLGGLRPVLKGFDA

SEQ ID NO: 1389581 - protein, 40 aa, Mycobacterium tuberculosis; identical to SEQ ID NO: 163265

SEQ ID NO: 1389582 - protein, 36 aa, Mycobacterium tuberculosis; identical to SEQ ID NO: 164846

SEQ ID NO: 1389583 - protein, 19 aa, Mycobacterium tuberculosis
PIPGRLFAGPGLSQPSDVL

SEQ ID NO: 1389584 - protein, 19 aa, Mycobacterium tuberculosis
PQFSLWLVPLAVLALPHRR

SEQ ID NO: 1389585 - protein, 17 aa, Mycobacterium tuberculosis
PYPEQRPPWGVPPPGWD

SEQ ID NO: 1389586 - protein, 20 aa, Mycobacterium tuberculosis
RIMLALLVPVLPFAFSYAIY

SEQ ID NO: 1389587 - protein, 32 aa, Mycobacterium tuberculosis; identical to SEQ ID NO: 163606

SEQ ID NO: 1389588 - protein, 30 aa, Mycobacterium tuberculosis
RSSKFVMRRWLPVGTAVVALLVLLGLPFLS

SEQ ID NO: 1389589 - protein, 24 aa, Mycobacterium tuberculosis
RVAALPLWAWLLTVAAMSFGGPGD

SEQ ID NO: 1389590 - protein, 32 aa, Mycobacterium tuberculosis
RVRRGGRRPGWVLLTALLVLAIGASSALVFTD

SEQ ID NO: 1389591 - protein, 27 aa, Mycobacterium tuberculosis
SFAVGLIVLLGLPPFAMFASELAIARS

SEQ ID NO: 1389592 - protein, 21 aa, Mycobacterium tuberculosis
SFLYAIVFGGFVAFSNYLPTY

SEQ ID NO: 1389593 - protein, 25 aa, Mycobacterium tuberculosis
SRVAALPLWAWLLTVAAMSFGGPGD

SEQ ID NO: 1389594 - protein, 22 aa, Mycobacterium tuberculosis
SVISFTAILWNLSGTLNIFGVS

SEQ ID NO: 1389595 - protein, 40 aa, Mycobacterium tuberculosis; identical to SEQ ID NO: 163836

SEQ ID NO: 1389596 - protein, 20 aa, Mycobacterium tuberculosis
TFTFIFFALEGSIMAQGLKL

SEQ ID NO: 1389597 - protein, 20 aa, Mycobacterium tuberculosis
TGELMFCRNSIDLYHKQAAD

SEQ ID NO: 1389598 - protein, 18 aa, Mycobacterium tuberculosis
TMFFVLVTGIISAAQVFD

SEQ ID NO: 1389599 - protein, 17 aa, Mycobacterium tuberculosis
TMLLRLCMLPGLALLVW

SEQ ID NO: 1389600 - protein, 21 aa, Mycobacterium tuberculosis
TPRSPGRWSLVAALALAVVSL

SEQ ID NO: 1389601 - protein, 30 aa, Mycobacterium tuberculosis; identical to SEQ ID NO: 163897

SEQ ID NO: 1389602 - protein, 23 aa, Mycobacterium tuberculosis
TTLLSFRLQPTLSVLLVAAGAFG

SEQ ID NO: 1389603 - protein, 20 aa, Mycobacterium tuberculosis
TVLTLRRWLRPATAAVVCCL

SEQ ID NO: 1389604 - protein, 26 aa, Mycobacterium tuberculosis
VAVALVLWWRMIRFEYALLVTVATAA

SEQ ID NO: 1389605 - protein, 21 aa, Mycobacterium tuberculosis
VCGVFVFLILRALGELVLHRP

SEQ ID NO: 1389606 - protein, 22 aa, Mycobacterium tuberculosis
VDWTRWWVMITLDVAIVYILYA

SEQ ID NO: 1389607 - protein, 19 aa, Mycobacterium tuberculosis
VGRFVVSYLGGIMAGLLVG

SEQ ID NO: 1389608 - protein, 29 aa, Mycobacterium tuberculosis
VGVQLVVVLTAAWLLAMPLTQSKEQPELA

SEQ ID NO: 1389609 - protein, 17 aa, Mycobacterium tuberculosis
VLARWQSSWLRYAPLSF

SEQ ID NO: 1389610 - protein, 19 aa, Mycobacterium tuberculosis
VLPILFMVVLNIVLGNLAY

SEQ ID NO: 1389611 - protein, 23 aa, Mycobacterium tuberculosis
VNRHTAYRWFREGTLPVPAERVG

SEQ ID NO: 1389612 - protein, 28 aa, Mycobacterium tuberculosis
VSIPRAMFWTVLVYVFVATVISFIIGRP

SEQ ID NO: 1389613 - protein, 25 aa, Mycobacterium tuberculosis
VSQTIVPLPWVIQAPRLFAGQIDFG

SEQ ID NO: 1389614 - protein, 42 aa, Mycobacterium tuberculosis; identical to SEQ ID NO: 164586

SEQ ID NO: 1389615 - protein, 20 aa, Mycobacterium tuberculosis
YITEALKRLPTYATTLGEVV

SEQ ID NO: 1389616 - protein, 31 aa, Mycobacterium tuberculosis; identical to SEQ ID NO: 164280

SEQ ID NO: 1389617 - protein, 34 aa, Mycobacterium tuberculosis; identical to SEQ ID NO: 161708

SEQ ID NO: 1389618 - protein, 35 aa, Mycobacterium tuberculosis; identical to SEQ ID NO: 161739

SEQ ID NO: 1389619 - protein, 19 aa, Mycobacterium tuberculosis
AAPLIAAGLRALFGHRHRR

SEQ ID NO: 1389620 - protein, 27 aa, Mycobacterium tuberculosis
AEWMPNFIELLQRKLSRIVDPVLQKLV

SEQ ID NO: 1389621 - protein, 18 aa, Mycobacterium tuberculosis
AIWNPYVAERLLQGHWSL

SEQ ID NO: 1389622 - protein, 24 aa, Mycobacterium tuberculosis
AKVRGRLLALFGLALLEAAGVVAV

SEQ ID NO: 1389623 - protein, 26 aa, Mycobacterium tuberculosis
ARRPLQIALTLMWPAGIASLVYALLA

SEQ ID NO: 1389624 - protein, 27 aa, Mycobacterium tuberculosis
ATASFGVAPLLLWQVATRHFTNISVET

SEQ ID NO: 1389625 - protein, 23 aa, Mycobacterium tuberculosis
AVTAYFRMGWWSIIGYAAAAIIG

SEQ ID NO: 1389626 - protein, 17 aa, Mycobacterium tuberculosis
AVTFLAMVFTKLEVFSA

SEQ ID NO: 1389627 - protein, 31 aa, Mycobacterium tuberculosis; identical to SEQ ID NO: 164673

SEQ ID NO: 1389628 - protein, 17 aa, Mycobacterium tuberculosis
EAAGFAIPFVPRGLDEI

SEQ ID NO: 1389629 - protein, 18 aa, Mycobacterium tuberculosis
EAAGFAIPFVPRGLDEIP

SEQ ID NO: 1389630 - protein, 37 aa, Mycobacterium tuberculosis; identical to SEQ ID NO: 164677

SEQ ID NO: 1389631 - protein, 22 aa, Mycobacterium tuberculosis
ENFSRRFVPTSFIVSAIALLIT

SEQ ID NO: 1389632 - protein, 26 aa, Mycobacterium tuberculosis
FAVGLIVLLGLPPFAMFASELAIARS

SEQ ID NO: 1389633 - protein, 35 aa, Mycobacterium tuberculosis; identical to SEQ ID NO: 164376

SEQ ID NO: 1389634 - protein, 17 aa, Mycobacterium tuberculosis
FRRLGTHVARWPAPILV

SEQ ID NO: 1389635 - protein, 17 aa, Mycobacterium tuberculosis
FVPILFVVFGIGALNTS

SEQ ID NO: 1389636 - protein, 18 aa, Mycobacterium tuberculosis
GFLQDFFATAVFLGITTF

SEQ ID NO: 1389637 - protein, 26 aa, Mycobacterium tuberculosis
GRANWLPTFVLLILLAAVTAVYALRG

SEQ ID NO: 1389638 - protein, 18 aa, Mycobacterium tuberculosis
GRFVVSYLGGIMAGLLVG

SEQ ID NO: 1389639 - protein, 21 aa, Mycobacterium tuberculosis
GSGLLLLLPLSLETRTVVALL

SEQ ID NO: 1389640 - protein, 18 aa, Mycobacterium tuberculosis
HNTWLTTIYTAVIGVLVL

SEQ ID NO: 1389641 - protein, 23 aa, Mycobacterium tuberculosis
HRYAIWIVGVWALAAIIGNNFAP

SEQ ID NO: 1389642 - protein, 17 aa, Mycobacterium tuberculosis
HVARWPAPILVASGVFV

SEQ ID NO: 1389643 - protein, 17 aa, Mycobacterium tuberculosis
IIGLFLAVYLMANIPGS

SEQ ID NO: 1389644 - protein, 17 aa, Mycobacterium tuberculosis
IVGTPRPAPRTTVGVVE

SEQ ID NO: 1389645 - protein, 20 aa, Mycobacterium tuberculosis
KHILGDNLHWSVLPIAFVLL

SEQ ID NO: 1389646 - protein, 34 aa, Mycobacterium tuberculosis
KPSMSAPRRMLLFGLVVVVALAVLLCCWGFRVQR

SEQ ID NO: 1389647 - protein, 35 aa, Mycobacterium tuberculosis
KPSMSAPRRMLLFGLVVVVALAVLLCCWGFRVQRA

SEQ ID NO: 1389648 - protein, 20 aa, Mycobacterium tuberculosis
KVFGLQGLLTLFVSFPLQLS

SEQ ID NO: 1389649 - protein, 20 aa, Mycobacterium tuberculosis
LALGWWQWTRFQSTSGTFQN

SEQ ID NO: 1389650 - protein, 22 aa, Mycobacterium tuberculosis
LAVGLAALTLTPALVALASRAN

SEQ ID NO: 1389651 - protein, 19 aa, Mycobacterium tuberculosis
LAVILALGFVLTSQVTNRV

SEQ ID NO: 1389652 - protein, 17 aa, Mycobacterium tuberculosis
LGLIPRFGDVQIDGEVV

SEQ ID NO: 1389653 - protein, 25 aa, Mycobacterium tuberculosis
LHIPLWAGYACSTLIIFPLVVYGMK

SEQ ID NO: 1389654 - protein, 28 aa, Mycobacterium tuberculosis
LHWSVLPIAFVLLISVGSAYNLLFALRI

SEQ ID NO: 1389655 - protein, 19 aa, Mycobacterium tuberculosis
LIGGPRMWERRPGAADFCR

SEQ ID NO: 1389656 - protein, 23 aa, Mycobacterium tuberculosis
LNLPPPCTTGFLPAQQRRIPTFE

SEQ ID NO: 1389657 - protein, 24 aa, Mycobacterium tuberculosis
LPAPPKPVPPPTMPATAMAPRQPP

SEQ ID NO: 1389658 - protein, 30 aa, Mycobacterium tuberculosis; identical to SEQ ID NO: 163017

SEQ ID NO: 1389659 - protein, 33 aa, Mycobacterium tuberculosis
LQDLPPVNLLIFVSTVIILFLAGAVVNLKLLMP

SEQ ID NO: 1389660 - protein, 28 aa, Mycobacterium tuberculosis
LSRVANLELYLIFPLASEQATITLVRGT

SEQ ID NO: 1389661 - protein, 25 aa, Mycobacterium tuberculosis
LTLGLSLAVILALGFVLTSQVTNRV

SEQ ID NO: 1389662 - protein, 20 aa, Mycobacterium tuberculosis
LVAYLALLIGLGFGLLAVGA

SEQ ID NO: 1389663 - protein, 36 aa, Mycobacterium tuberculosis; identical to SEQ ID NO: 164812

SEQ ID NO: 1389664 - protein, 21 aa, Mycobacterium tuberculosis
LVFDLGICLVLITLPTLALFV

SEQ ID NO: 1389665 - protein, 26 aa, Mycobacterium tuberculosis
MSATALFPMYFLKSFAYAGVATVAFV

SEQ ID NO: 1389666 - protein, 31 aa, Mycobacterium tuberculosis
MTPSIAALLGRWFWWPLRVRPRPASQMLRPF

SEQ ID NO: 1389667 - protein, 23 aa, Mycobacterium tuberculosis
NGKRPKLRRILSDPDARVIVVEH

SEQ ID NO: 1389668 - protein, 27 aa, Mycobacterium tuberculosis
NWTHPDPATLWTLIGGPRMWERRPGAA

SEQ ID NO: 1389669 - protein, 23 aa, Mycobacterium tuberculosis
PAPPKPVPPPTMPATAMAPRQPP

SEQ ID NO: 1389670 - protein, 28 aa, Mycobacterium tuberculosis
PATRHPTFLAFPMMMLVSLVVTAVTGRG

SEQ ID NO: 1389671 - protein, 21 aa, Mycobacterium tuberculosis
PELFCTIRNFYDADPLAKAAA

SEQ ID NO: 1389672 - protein, 21 aa, Mycobacterium tuberculosis
PEVLNLLLVDFKGGATFLDLA

SEQ ID NO: 1389673 - protein, 24 aa, Mycobacterium tuberculosis
PLDEPPMLGALLRDAEPAQAELAV

SEQ ID NO: 1389674 - protein, 29 aa, Mycobacterium tuberculosis
PPFGTWYAAMLFAVVPLRTILPGSPPAGA

SEQ ID NO: 1389675 - protein, 23 aa, Mycobacterium tuberculosis
PPTPVIPLRAKPVALLAARQLRD

SEQ ID NO: 1389676 - protein, 19 aa, Mycobacterium tuberculosis
PPVFFARRPLQIALTLMWP

SEQ ID NO: 1389677 - protein, 21 aa, Mycobacterium tuberculosis
PQPAWRNLRFPLAWAPPEADV

SEQ ID NO: 1389678 - protein, 43 aa, Mycobacterium tuberculosis; identical to SEQ ID NO: 164866

SEQ ID NO: 1389679 - protein, 26 aa, Mycobacterium tuberculosis
QIAEGALLIVIFATSGALEALVTART

SEQ ID NO: 1389680 - protein, 24 aa, Mycobacterium tuberculosis
QPPTPVIPLRAKPVALLAARQLRD

SEQ ID NO: 1389681 - protein, 23 aa, Mycobacterium tuberculosis
QRPPWGVPPPGWDGSSRPAPSTT

SEQ ID NO: 1389682 - protein, 17 aa, Mycobacterium tuberculosis
RAGLRFAAPLIAAGLRA

SEQ ID NO: 1389683 - protein, 28 aa, Mycobacterium tuberculosis
RDIVLLVCVLLFTIIWWNVNHGRANWLP

SEQ ID NO: 1389684 - protein, 18 aa, Mycobacterium tuberculosis
RFWAWTIAGYTLTVVTVP

SEQ ID NO: 1389685 - protein, 24 aa, Mycobacterium tuberculosis
RGLLRAMICQLAVWHSPEELLIAG

SEQ ID NO: 1389686 - protein, 26 aa, Mycobacterium tuberculosis
RLQAHAFWDIATFLINGSLWVFVGVQ

SEQ ID NO: 1389687 - protein, 25 aa, Mycobacterium tuberculosis
RNRAHWDWLKWLPHNQHPNACDALG

SEQ ID NO: 1389688 - protein, 25 aa, Mycobacterium tuberculosis
RPGEEKLVFSRFWRSDPSRVRRSGG

SEQ ID NO: 1389689 - protein, 21 aa, Mycobacterium tuberculosis
RRNLLGLFMPSALTLLFVMFA

SEQ ID NO: 1389690 - protein, 18 aa, Mycobacterium tuberculosis
RVLARWQSSWLRYAPLSF

SEQ ID NO: 1389691 - protein, 17 aa, Mycobacterium tuberculosis
SDVKSMYLIVEPAKDPT

SEQ ID NO: 1389692 - protein, 27 aa, Mycobacterium tuberculosis
SGGSALILAAYYPQQFPYAASLSGFLN

SEQ ID NO: 1389693 - protein, 24 aa, Mycobacterium tuberculosis
SLIERFPLMLGTAAGVLLIGLVRW

SEQ ID NO: 1389694 - protein, 23 aa, Mycobacterium tuberculosis
SPRLTNLLVVAAWVAAAVIANLL

SEQ ID NO: 1389695 - protein, 24 aa, Mycobacterium tuberculosis
SVRVWLMLGVLLLSVVLAVRLNVL

SEQ ID NO: 1389696 - protein, 24 aa, Mycobacterium tuberculosis
TGAQLPCLPILFIVVDEFSELLSQ

SEQ ID NO: 1389697 - protein, 17 aa, Mycobacterium tuberculosis
TGPWLLRVGFGPDYQTG

SEQ ID NO: 1389698 - protein, 26 aa, Mycobacterium tuberculosis
TLAVIFAIAALLLRSPLAGLVVVGTI

SEQ ID NO: 1389699 - protein, 19 aa, Mycobacterium tuberculosis
TLIARYLDRYGIRADTIRI

SEQ ID NO: 1389700 - protein, 31 aa, Mycobacterium tuberculosis
TPTLSRVANLELYLIFPLASEQATITLVRGT

SEQ ID NO: 1389701 - protein, 28 aa, Mycobacterium tuberculosis
TSFREIRWNLRVIVMFSIGLVIATAVAV

SEQ ID NO: 1389702 - protein, 22 aa, Mycobacterium tuberculosis
TVLAYRWGGNLRALLLAAAVMA

SEQ ID NO: 1389703 - protein, 21 aa, Mycobacterium tuberculosis
TVLTLRRWLRPATAAVVCCLA

SEQ ID NO: 1389704 - protein, 24 aa, Mycobacterium tuberculosis
VAALRAGVAQRRRARRSLAAVGSV

SEQ ID NO: 1389705 - protein, 17 aa, Mycobacterium tuberculosis
VAIPIALARFYSGGLLA

SEQ ID NO: 1389706 - protein, 20 aa, Mycobacterium tuberculosis
VASELLMPWPSAAASGVVGW

SEQ ID NO: 1389707 - protein, 33 aa, Mycobacterium tuberculosis
VGHFTLFHLSLRHALWWLGSLAAVASFTLQAIA

SEQ ID NO: 1389708 - protein, 42 aa, Mycobacterium tuberculosis; identical to SEQ ID NO: 164044

SEQ ID NO: 1389709 - protein, 31 aa, Mycobacterium tuberculosis; identical to SEQ ID NO: 164050

SEQ ID NO: 1389710 - protein, 28 aa, Mycobacterium tuberculosis
VGVQLVVVLTAAWLLAMPLTQSKEQPEL

SEQ ID NO: 1389711 - protein, 22 aa, Mycobacterium tuberculosis
VGWLRLPAFTWPTRPSWLYRLT

SEQ ID NO: 1389712 - protein, 18 aa, Mycobacterium tuberculosis
VIILFLAGAVVNLKLLMP

SEQ ID NO: 1389713 - protein, 25 aa, Mycobacterium tuberculosis
VMPGDIPFQVQLPSTPLAPPQPGSD

SEQ ID NO: 1389714 - protein, 17 aa, Mycobacterium tuberculosis
WILPVGLPGDLGSTQSK

SEQ ID NO: 1389715 - protein, 17 aa, Mycobacterium tuberculosis
YCAGWLPWFADIDRQMY

SEQ ID NO: 1389716 - protein, 19 aa, Mycobacterium tuberculosis
YTDAPWWVTFGVAPAYATL

SEQ ID NO: 1389717 - protein, 23 aa, Mycobacterium tuberculosis
AAILAAVVCVLTLTIARPVRTYF

SEQ ID NO: 1389718 - protein, 20 aa, Mycobacterium tuberculosis
AALGAAIRYAAVDKDAVIVA

SEQ ID NO: 1389719 - protein, 29 aa, Mycobacterium tuberculosis
AGISALCLIFIIMLIITRSVVAAAVIVGT

SEQ ID NO: 1389720 - protein, 17 aa, Mycobacterium tuberculosis
AIAFGVMLPIRTAGQLP

SEQ ID NO: 1389721 - protein, 26 aa, Mycobacterium tuberculosis
ALSRAVAVAWRRSLQLRVVALTLGLS

SEQ ID NO: 1389722 - protein, 17 aa, Mycobacterium tuberculosis
AVLFLTSSLYSTATFLA

SEQ ID NO: 1389723 - protein, 29 aa, Mycobacterium tuberculosis
AVLTYHIAKPWRWGYLGVLLVIFGFPLIA

SEQ ID NO: 1389724 - protein, 17 aa, Mycobacterium tuberculosis
CAFVPTNAQRRATAKRK

SEQ ID NO: 1389725 - protein, 23 aa, Mycobacterium tuberculosis
DINNLLPLMQRLDTLMPQLTAMM

SEQ ID NO: 1389726 - protein, 19 aa, Mycobacterium tuberculosis
DVRRLVRRLLGRPDPVHKP

SEQ ID NO: 1389727 - protein, 17 aa, Mycobacterium tuberculosis
DYEVFLVSRIREYWLES

SEQ ID NO: 1389728 - protein, 24 aa, Mycobacterium tuberculosis
EPYLLLFTLFLAPAEHWLGHLRWL

SEQ ID NO: 1389729 - protein, 25 aa, Mycobacterium tuberculosis
ETARPADLLVLLDSLRQREATLNAE

SEQ ID NO: 1389730 - protein, 28 aa, Mycobacterium tuberculosis
ETERITRLVEDLLLLARLDSGRPLERGP

SEQ ID NO: 1389731 - protein, 23 aa, Mycobacterium tuberculosis
FGSSRPMPLPPGRGILVTGAGDE

SEQ ID NO: 1389732 - protein, 19 aa, Mycobacterium tuberculosis
FGVVPGYVLLALALGSYAL

SEQ ID NO: 1389733 - protein, 18 aa, Mycobacterium tuberculosis
FLVSRIREYWLESGAARP

SEQ ID NO: 1389734 - protein, 17 aa, Mycobacterium tuberculosis
FRVSKLNCSITTSDGTV

SEQ ID NO: 1389735 - protein, 27 aa, Mycobacterium tuberculosis
GDFMHGRVLLAPLFCLLAPVGVIPILL

SEQ ID NO: 1389736 - protein, 19 aa, Mycobacterium tuberculosis
GDPVAPPIPLLPARVDYDS

SEQ ID NO: 1389737 - protein, 28 aa, Mycobacterium tuberculosis
GGIYGDFFNFYLCDISLKVNGLQPGGPV

SEQ ID NO: 1389738 - protein, 22 aa, Mycobacterium tuberculosis
GLFSAGLLTQLCGAPQWVRWAL

SEQ ID NO: 1389739 - protein, 22 aa, Mycobacterium tuberculosis
GRWNWWAPRPLAWLHERFGVSE

SEQ ID NO: 1389740 - protein, 17 aa, Mycobacterium tuberculosis
GVGLLRRQDAVETFTAA

SEQ ID NO: 1389741 - protein, 21 aa, Mycobacterium tuberculosis
GWLRLPAFTWPTRPSWLYRLT

SEQ ID NO: 1389742 - protein, 23 aa, Mycobacterium tuberculosis
HHSRWHFAVLYTFLSMVNSCLGL

SEQ ID NO: 1389743 - protein, 27 aa, Mycobacterium tuberculosis
HLKVGKALYSVPWRLIGQRLHARTAGD

SEQ ID NO: 1389744 - protein, 28 aa, Mycobacterium tuberculosis
ILRGGRSRLVFGTLAILLCLVLGVAIVT

SEQ ID NO: 1389745 - protein, 30 aa, Mycobacterium tuberculosis; identical to SEQ ID NO: 162751

SEQ ID NO: 1389746 - protein, 23 aa, Mycobacterium tuberculosis
KLGIVWLVLSVFTVMIIVVFGQV

SEQ ID NO: 1389747 - protein, 19 aa, Mycobacterium tuberculosis
KSMYLIVEPAKDPTTPAAL

SEQ ID NO: 1389748 - protein, 19 aa, Mycobacterium tuberculosis
LAELWRSVGVVPDAVIGHS

SEQ ID NO: 1389749 - protein, 18 aa, Mycobacterium tuberculosis
LAGGLGAAGYFALRSHQE

SEQ ID NO: 1389750 - protein, 19 aa, Mycobacterium tuberculosis
LARLTTAMLTLYFILAVGA

SEQ ID NO: 1389751 - protein, 24 aa, Mycobacterium tuberculosis
LCGIAIFALVVFVTGLPLAYYAAR

SEQ ID NO: 1389752 - protein, 20 aa, Mycobacterium tuberculosis
LGKLPDAYRIIGRAGGIYGD

SEQ ID NO: 1389753 - protein, 26 aa, Mycobacterium tuberculosis
LGPLYGIFIVWLLHDWRDVFWINVPL

SEQ ID NO: 1389754 - protein, 18 aa, Mycobacterium tuberculosis
LIARYLDRYGIRADTIRI

SEQ ID NO: 1389755 - protein, 24 aa, Mycobacterium tuberculosis
LIRFQTAFVSGPLRRASPSAVHPV

SEQ ID NO: 1389756 - protein, 25 aa, Mycobacterium tuberculosis
LLRLCMLPGLALLVWATPRLASHLG

SEQ ID NO: 1389757 - protein, 23 aa, Mycobacterium tuberculosis
LPQDAIRWAALVALVAIGAGLIF

SEQ ID NO: 1389758 - protein, 18 aa, Mycobacterium tuberculosis
LSLLTPFAAFLLAQSLKC

SEQ ID NO: 1389759 - protein, 18 aa, Mycobacterium tuberculosis
LVFTDRVELLKLAVLLAL

SEQ ID NO: 1389760 - protein, 21 aa, Mycobacterium tuberculosis
LVVPTVALAVPWLTQLQRLFI

SEQ ID NO: 1389761 - protein, 22 aa, Mycobacterium tuberculosis
MSFLYAIVFGGFVAFSNYLPTY

SEQ ID NO: 1389762 - protein, 17 aa, Mycobacterium tuberculosis
PDARYGRPRLSRRARRR

SEQ ID NO: 1389763 - protein, 17 aa, Mycobacterium tuberculosis
PDFLRRPGRDLAPELAG

SEQ ID NO: 1389764 - protein, 28 aa, Mycobacterium tuberculosis
PINQLHRITWIVTMYLLGYIAAMPLLGR

SEQ ID NO: 1389765 - protein, 19 aa, Mycobacterium tuberculosis
PNAILWLHYYAASYEFGFV

SEQ ID NO: 1389766 - protein, 21 aa, Mycobacterium tuberculosis
PNFTVLVILRLLYGIGMGGEW

SEQ ID NO: 1389767 - protein, 18 aa, Mycobacterium tuberculosis
PRPLAWLHERFGVSEAAE

SEQ ID NO: 1389768 - protein, 17 aa, Mycobacterium tuberculosis
PSWFHDYVLTVGAVDAN

SEQ ID NO: 1389769 - protein, 25 aa, Mycobacterium tuberculosis
PVRRWLLLALVSTWGLRLSWHMYRK

SEQ ID NO: 1389770 - protein, 20 aa, Mycobacterium tuberculosis
REGSFWRRLLSPPGFTSIAH

SEQ ID NO: 1389771 - protein, 18 aa, Mycobacterium tuberculosis
RLALPTIGIFLATLTAFV

SEQ ID NO: 1389772 - protein, 19 aa, Mycobacterium tuberculosis
RMWRRSGVRIVRRPTIHLV

SEQ ID NO: 1389773 - protein, 17 aa, Mycobacterium tuberculosis
RRFVYLVLLMTAFNWMS

SEQ ID NO: 1389774 - protein, 41 aa, Mycobacterium tuberculosis; identical to SEQ ID NO: 163612

SEQ ID NO: 1389775 - protein, 28 aa, Mycobacterium tuberculosis
RTLANKVPFVVLVIGSLGVGLGLTLWLS

SEQ ID NO: 1389776 - protein, 24 aa, Mycobacterium tuberculosis
SGNPLMVLLEYLPHARDLGLHLVV

SEQ ID NO: 1389777 - protein, 32 aa, Mycobacterium tuberculosis
SNYFRTGNLTALREIALLWLADQVDAALEKYR

SEQ ID NO: 1389778 - protein, 23 aa, Mycobacterium tuberculosis
SQTIVPLPWVIQAPRLFAGQIDF

SEQ ID NO: 1389779 - protein, 24 aa, Mycobacterium tuberculosis
SVEWDTLLFFAGLFIMVGALVKTG

SEQ ID NO: 1389780 - protein, 33 aa, Mycobacterium tuberculosis; identical to SEQ ID NO: 163850

SEQ ID NO: 1389781 - protein, 39 aa, Mycobacterium tuberculosis
TISAICVLAILVLLRYLTPWGRQFWRITRAYFVGPNSVR

SEQ ID NO: 1389782 - protein, 21 aa, Mycobacterium tuberculosis
TKPAPPPPPPAPPPTTEIPTA

SEQ ID NO: 1389783 - protein, 17 aa, Mycobacterium tuberculosis
TNPASFRRWLNPVNAAA

SEQ ID NO: 1389784 - protein, 17 aa, Mycobacterium tuberculosis
TYPPLAAVLFSPFAWLQ

SEQ ID NO: 1389785 - protein, 23 aa, Mycobacterium tuberculosis
VHKPVKQLFWYRSSKFVMRRWLP

SEQ ID NO: 1389786 - protein, 31 aa, Mycobacterium tuberculosis; identical to SEQ ID NO: 164972

SEQ ID NO: 1389787 - protein, 26 aa, Mycobacterium tuberculosis
VRQRHETAILLGWFNAILLGWFNERQ

SEQ ID NO: 1389788 - protein, 36 aa, Mycobacterium tuberculosis; identical to SEQ ID NO: 164158

SEQ ID NO: 1389789 - protein, 21 aa, Mycobacterium tuberculosis
WLDIAVLAVAFIAAISGWRAG

SEQ ID NO: 1389790 - protein, 26 aa, Mycobacterium tuberculosis
AAAPILGVPGWAWTLWAVLTAGCAGL

SEQ ID NO: 1389791 - protein, 46 aa, Mycobacterium tuberculosis
AGTRDRYLLMPSFTFVGVAQAALWTGYRPWFIDIDANTWQPCVHSA

SEQ ID NO: 1389792 - protein, 17 aa, Mycobacterium tuberculosis
AIPVLAGPLLGALAAAV

SEQ ID NO: 1389793 - protein, 21 aa, Mycobacterium tuberculosis
AKVRGRLLALFGLALLEAAGV

SEQ ID NO: 1389794 - protein, 36 aa, Mycobacterium tuberculosis; identical to SEQ ID NO: 161880

SEQ ID NO: 1389795 - protein, 17 aa, Mycobacterium tuberculosis
ALTRAILIRVRNASWQH

SEQ ID NO: 1389796 - protein, 19 aa, Mycobacterium tuberculosis
AMPATAAFPPPAGPPPVTA

SEQ ID NO: 1389797 - protein, 33 aa, Mycobacterium tuberculosis; identical to SEQ ID NO: 164329

SEQ ID NO: 1389798 - protein, 32 aa, Mycobacterium tuberculosis; identical to SEQ ID NO: 164636

SEQ ID NO: 1389799 - protein, 28 aa, Mycobacterium tuberculosis
AVTFTVIIVMLLLVYRSIITSAIMLTMV

SEQ ID NO: 1389800 - protein, 22 aa, Mycobacterium tuberculosis
AYAFARLQFRGRDALFWVYVAT

SEQ ID NO: 1389801 - protein, 19 aa, Mycobacterium tuberculosis
DGSTYVIWGGKRSQIDPTN

SEQ ID NO: 1389802 - protein, 29 aa, Mycobacterium tuberculosis
DLVRELVTILPIVLVIAAVAAYLLSRAAL

SEQ ID NO: 1389803 - protein, 28 aa, Mycobacterium tuberculosis
DPGAAVQAPWPLLRTFAAGPALSRDAAL

SEQ ID NO: 1389804 - protein, 20 aa, Mycobacterium tuberculosis
ELGWICVAINYRHSPRNTWP

SEQ ID NO: 1389805 - protein, 17 aa, Mycobacterium tuberculosis
FAALWVLIAYLRAEVRR

SEQ ID NO: 1389806 - protein, 17 aa, Mycobacterium tuberculosis
FSPNPWSALVTGLVAGV

SEQ ID NO: 1389807 - protein, 17 aa, Mycobacterium tuberculosis
GFLQDFFATAVFLGITT

SEQ ID NO: 1389808 - protein, 18 aa, Mycobacterium tuberculosis
GFVLAWRDSWEYWTHTLH

SEQ ID NO: 1389809 - protein, 22 aa, Mycobacterium tuberculosis
GHLFYNRRLRAATTRFSVRMKH

SEQ ID NO: 1389810 - protein, 17 aa, Mycobacterium tuberculosis
GITFEAVGDWQLWVFKS

SEQ ID NO: 1389811 - protein, 28 aa, Mycobacterium tuberculosis
GLGLAAIAFLPIVLAPAVIPPASTPLAA

SEQ ID NO: 1389812 - protein, 19 aa, Mycobacterium tuberculosis
GLGLTLWLSTDAAERSYQL

SEQ ID NO: 1389813 - protein, 19 aa, Mycobacterium tuberculosis
GYLVGLAVLLILLTGLQRR

SEQ ID NO: 1389814 - protein, 33 aa, Mycobacterium tuberculosis
HIDAVHGLYYLLMHGWFAIFPPTELWSRLPSCL

SEQ ID NO: 1389815 - protein, 18 aa, Mycobacterium tuberculosis
IFALVVFVTGLPLAYYAA

SEQ ID NO: 1389816 - protein, 19 aa, Mycobacterium tuberculosis
IISNIFGAIPVLAGPLLGA

SEQ ID NO: 1389817 - protein, 33 aa, Mycobacterium tuberculosis
ILRGGRSRLVFGTLAILLCLVLGVAIVTQVRQT

SEQ ID NO: 1389818 - protein, 17 aa, Mycobacterium tuberculosis
ISRALFDGLPATEPLRV

SEQ ID NO: 1389819 - protein, 25 aa, Mycobacterium tuberculosis
KVFGLQGLLTLFVSFPLQLSAVTGP

SEQ ID NO: 1389820 - protein, 18 aa, Mycobacterium tuberculosis
LANERLAWVLGAALLLIA

SEQ ID NO: 1389821 - protein, 25 aa, Mycobacterium tuberculosis
LAPYLLIWVIIIAYMCHIPFAVRSQ

SEQ ID NO: 1389822 - protein, 18 aa, Mycobacterium tuberculosis
LAVLLILLTGLQRRPWAI

SEQ ID NO: 1389823 - protein, 27 aa, Mycobacterium tuberculosis
LGLAAIAFLPIVLAPAVIPPASTPLAA

SEQ ID NO: 1389824 - protein, 18 aa, Mycobacterium tuberculosis
LIIFPLVVYGMKVLSQLQ

SEQ ID NO: 1389825 - protein, 24 aa, Mycobacterium tuberculosis
LIMGLHPLIFFLPVRQGANWVVLQ

SEQ ID NO: 1389826 - protein, 32 aa, Mycobacterium tuberculosis
LKMQFGEGWWTSGWFLSFWVTGTSILLVSGIP

SEQ ID NO: 1389827 - protein, 18 aa, Mycobacterium tuberculosis
LLALFGLALLEAAGVVAV

SEQ ID NO: 1389828 - protein, 56 aa, Mycobacterium tuberculosis
LLESLALLRALYVISSWRPVLLIPLTFALFTPLAVPGFAWWAAALNSLPMLAALAW

SEQ ID NO: 1389829 - protein, 17 aa, Mycobacterium tuberculosis
LNLAFIVGPAIGGLMIA

SEQ ID NO: 1389830 - protein, 19 aa, Mycobacterium tuberculosis
LQADCYAGVWAYYASTVKQ

SEQ ID NO: 1389831 - protein, 21 aa, Mycobacterium tuberculosis
LTGELMFCRNSIDLYHKQAAD

SEQ ID NO: 1389832 - protein, 21 aa, Mycobacterium tuberculosis
LTLLAVITLAVIFAIAALLLR

SEQ ID NO: 1389833 - protein, 19 aa, Mycobacterium tuberculosis
LVFTDRVELLKLAVLLALW

SEQ ID NO: 1389834 - protein, 21 aa, Mycobacterium tuberculosis
LVVLLVLLHRAKGGGLSTLFG

SEQ ID NO: 1389835 - protein, 20 aa, Mycobacterium tuberculosis
LVVPTVALAVPWLTQLQRLF

SEQ ID NO: 1389836 - protein, 18 aa, Mycobacterium tuberculosis
LWYAVMTQLGFIAILVGL

SEQ ID NO: 1389837 - protein, 22 aa, Mycobacterium tuberculosis
NPIQALITYGPLLFALGYQIFF

SEQ ID NO: 1389838 - protein, 25 aa, Mycobacterium tuberculosis
NSKFTISMLWPGDRAWRQAGERRML

SEQ ID NO: 1389839 - protein, 18 aa, Mycobacterium tuberculosis
PALWAVMVSLAELWRSVG

SEQ ID NO: 1389840 - protein, 19 aa, Mycobacterium tuberculosis
PGAPGPMPAPPLGAVPSPA

SEQ ID NO: 1389841 - protein, 20 aa, Mycobacterium tuberculosis
PIRGFGIHPAVLDAALHAWG

SEQ ID NO: 1389842 - protein, 22 aa, Mycobacterium tuberculosis
PLEVLFSSLLWIDGRNLEPYLL

SEQ ID NO: 1389843 - protein, 19 aa, Mycobacterium tuberculosis
PLNTKLPEDPPPPPKPAAV

SEQ ID NO: 1389844 - protein, 18 aa, Mycobacterium tuberculosis
PPGYGPPPGPPPPGYPTH

SEQ ID NO: 1389845 - protein, 44 aa, Mycobacterium tuberculosis; identical to SEQ ID NO: 164868

SEQ ID NO: 1389846 - protein, 25 aa, Mycobacterium tuberculosis
QFDSLLAVVRPFFAKNREVLTHDVN

SEQ ID NO: 1389847 - protein, 31 aa, Mycobacterium tuberculosis
QLASAICRHYWPLALLAAILSRRCRRVVLIA

SEQ ID NO: 1389848 - protein, 19 aa, Mycobacterium tuberculosis
QPALWAVMVSLAELWRSVG

SEQ ID NO: 1389849 - protein, 18 aa, Mycobacterium tuberculosis
QQQMVTRMTIMSDPAVAL

SEQ ID NO: 1389850 - protein, 17 aa, Mycobacterium tuberculosis
RRIVVANLIVAVTFIAG

SEQ ID NO: 1389851 - protein, 20 aa, Mycobacterium tuberculosis
RRTQRLRALIAPALVVGGIG

SEQ ID NO: 1389852 - protein, 19 aa, Mycobacterium tuberculosis
RSLQLRVVALTLGLSLAVI

SEQ ID NO: 1389853 - protein, 23 aa, Mycobacterium tuberculosis
RTPPRLPPGFRWIAVRPGAAPPP

SEQ ID NO: 1389854 - protein, 18 aa, Mycobacterium tuberculosis
SAWGLYRFNQILAGLSAA

SEQ ID NO: 1389855 - protein, 25 aa, Mycobacterium tuberculosis
SEPSSLLIRLLPVVMSVATVGVMVT

SEQ ID NO: 1389856 - protein, 28 aa, Mycobacterium tuberculosis
SKSRVALYLLITIAPFAVIAPLIGPALD

SEQ ID NO: 1389857 - protein, 19 aa, Mycobacterium tuberculosis
SMFGPYHLKRLLGRGGMGE

SEQ ID NO: 1389858 - protein, 32 aa, Mycobacterium tuberculosis
SMVTLVLGFILMWILAWLTATPVRVVRAALRR

SEQ ID NO: 1389859 - protein, 25 aa, Mycobacterium tuberculosis
SPPSAVPPGFLPPGPTPAHPHKPRP

SEQ ID NO: 1389860 - protein, 19 aa, Mycobacterium tuberculosis
SYFREIVTRFDYDDAVLLD

SEQ ID NO: 1389861 - protein, 37 aa, Mycobacterium tuberculosis
TGLTAKLIIWYPHYAWLLLSVYLTVALVALVVVGSMA

SEQ ID NO: 1389862 - protein, 24 aa, Mycobacterium tuberculosis
TIPKIPFIRPSFPGPAELAEDFVQ

SEQ ID NO: 1389863 - protein, 23 aa, Mycobacterium tuberculosis
TTDFVAFLDSDVTPRRGWLESLL

SEQ ID NO: 1389864 - protein, 22 aa, Mycobacterium tuberculosis
TTIVLLVRWLVARRAAAFMHQG

SEQ ID NO: 1389865 - protein, 28 aa, Mycobacterium tuberculosis
TYGPLLFALGYQIFFNLVGWPTWGMILS

SEQ ID NO: 1389866 - protein, 34 aa, Mycobacterium tuberculosis
VAGLVDWPILLAVGGGALLLRKLNRTPEVAAPPV

SEQ ID NO: 1389867 - protein, 18 aa, Mycobacterium tuberculosis
VAVTFLAMVFTKLEVFSA

SEQ ID NO: 1389868 - protein, 26 aa, Mycobacterium tuberculosis
VAVTLAVFAVPPLWGETLQRALLRAM

SEQ ID NO: 1389869 - protein, 26 aa, Mycobacterium tuberculosis
VEQQALIALPPRAFELTSWSIGTVGV

SEQ ID NO: 1389870 - protein, 19 aa, Mycobacterium tuberculosis
VFSWTLAAVLTIGTITAAT

SEQ ID NO: 1389871 - protein, 26 aa, Mycobacterium tuberculosis
VMAGFTGLPRRASTVALVALVAAQLG

SEQ ID NO: 1389872 - protein, 25 aa, Mycobacterium tuberculosis
VPEMRQWLRNWVGKAVGKAPDSIDE

SEQ ID NO: 1389873 - protein, 30 aa, Mycobacterium tuberculosis
VRGTMATGGLVLLVLLAGIALLVSRQVVVP

SEQ ID NO: 1389874 - protein, 24 aa, Mycobacterium tuberculosis
VSQLLGCTPLDPLGWAQATAAATA

SEQ ID NO: 1389875 - protein, 18 aa, Mycobacterium tuberculosis
VTLKRFIDRFAPFNLDPK

SEQ ID NO: 1389876 - protein, 17 aa, Mycobacterium tuberculosis
VVIWKHILGDNLHWSVL

SEQ ID NO: 1389877 - protein, 17 aa, Mycobacterium tuberculosis
WERRPGAADFCRIRVGV

SEQ ID NO: 1389878 - protein, 18 aa, Mycobacterium tuberculosis
WLVGITFEAVGDWQLWVF

SEQ ID NO: 1389879 - protein, 18 aa, Mycobacterium tuberculosis
YEWFRIMPTAVDVLDSIG

SEQ ID NO: 1389880 - protein, 27 aa, Mycobacterium tuberculosis
YFQTFLRPDDVFWSFLEALIITAIVMV

SEQ ID NO: 1389881 - protein, 17 aa, Mycobacterium tuberculosis
AALGAAIRYAAVDKDAV

SEQ ID NO: 1389882 - protein, 36 aa, Mycobacterium tuberculosis; identical to SEQ ID NO: 164314

SEQ ID NO: 1389883 - protein, 24 aa, Mycobacterium tuberculosis
AGRLQPFFATPAAWRILDALVAVT

SEQ ID NO: 1389884 - protein, 22 aa, Mycobacterium tuberculosis
AKAGLFPFHTWLADAHSQAPAP

SEQ ID NO: 1389885 - protein, 26 aa, Mycobacterium tuberculosis
AKTLGFPIRLPQLPGGWTPNSGGRGG

SEQ ID NO: 1389886 - protein, 17 aa, Mycobacterium tuberculosis
AMLRDLAALRWLDAGES

SEQ ID NO: 1389887 - protein, 26 aa, Mycobacterium tuberculosis
AMTIPIAIFMGCYLRFLRPGRVSEVS

SEQ ID NO: 1389888 - protein, 17 aa, Mycobacterium tuberculosis
ANWKISAAYLNWLADRL

SEQ ID NO: 1389889 - protein, 17 aa, Mycobacterium tuberculosis
APPPPPGYGPPPGPPPP

SEQ ID NO: 1389890 - protein, 19 aa, Mycobacterium tuberculosis
APRLACAFVPTNAQRRATA

SEQ ID NO: 1389891 - protein, 18 aa, Mycobacterium tuberculosis
AQLRARSWWSGPDIYVVV

SEQ ID NO: 1389892 - protein, 29 aa, Mycobacterium tuberculosis
ATTWLHVSGYRFLLRRIECALLFGDVCAA

SEQ ID NO: 1389893 - protein, 20 aa, Mycobacterium tuberculosis
AVSAALAVLVIACPCALGLA

SEQ ID NO: 1389894 - protein, 22 aa, Mycobacterium tuberculosis
AWALSVMFLVFTLRALLYKPFV

SEQ ID NO: 1389895 - protein, 21 aa, Mycobacterium tuberculosis
DELGWPMLCLMTIAAGALQIV

SEQ ID NO: 1389896 - protein, 23 aa, Mycobacterium tuberculosis
DTGLPVGVALLAALLAGVALVPK

SEQ ID NO: 1389897 - protein, 20 aa, Mycobacterium tuberculosis
EASMSICDPALRNALRTLKL

SEQ ID NO: 1389898 - protein, 20 aa, Mycobacterium tuberculosis
EFLVAVIELIPRPFTPTVIV

SEQ ID NO: 1389899 - protein, 29 aa, Mycobacterium tuberculosis
ETERITRLVEDLLLLARLDSGRPLERGPV

SEQ ID NO: 1389900 - protein, 41 aa, Mycobacterium tuberculosis; identical to SEQ ID NO: 162271

SEQ ID NO: 1389901 - protein, 22 aa, Mycobacterium tuberculosis
FEPRHRPPPLPPQQERPVWQPV

SEQ ID NO: 1389902 - protein, 25 aa, Mycobacterium tuberculosis
FLLLPILVVVWLSLHRWDLLGPLRY

SEQ ID NO: 1389903 - protein, 19 aa, Mycobacterium tuberculosis
FLVGMFYLVAATDVIDVAA

SEQ ID NO: 1389904 - protein, 26 aa, Mycobacterium tuberculosis
FVVSNSLRLRKFGRYPLGCGTVGGPQ

SEQ ID NO: 1389905 - protein, 21 aa, Mycobacterium tuberculosis
GAVPGSPWWQHPVGSVTALAT

SEQ ID NO: 1389906 - protein, 21 aa, Mycobacterium tuberculosis
GEFLVAVIELIPRPFTPTVIV

SEQ ID NO: 1389907 - protein, 18 aa, Mycobacterium tuberculosis
GHVVDFLSVGWWPVFNVA

SEQ ID NO: 1389908 - protein, 25 aa, Mycobacterium tuberculosis
GTWYAAMLFAVVPLRTILPGSPPAG

SEQ ID NO: 1389909 - protein, 25 aa, Mycobacterium tuberculosis
GVIVFQFLLGQEMHWSIPGLTFVIL

SEQ ID NO: 1389910 - protein, 20 aa, Mycobacterium tuberculosis
GWALRAIVAALLEWQRKSEL

SEQ ID NO: 1389911 - protein, 17 aa, Mycobacterium tuberculosis
HQILMDGPSYRPRKRPG

SEQ ID NO: 1389912 - protein, 35 aa, Mycobacterium tuberculosis
IATGVVVGIFWMGRRLVSPWWALGLGMILGGAMGN

SEQ ID NO: 1389913 - protein, 25 aa, Mycobacterium tuberculosis
IFGLRRWYVITFLMGLFFVLGQAYE

SEQ ID NO: 1389914 - protein, 17 aa, Mycobacterium tuberculosis
IVFDIEIVFLYPWAVSY

SEQ ID NO: 1389915 - protein, 18 aa, Mycobacterium tuberculosis
IVGFISPTGRYLSLTQSN

SEQ ID NO: 1389916 - protein, 18 aa, Mycobacterium tuberculosis
IVTLSWLTIAVAGILAAM

SEQ ID NO: 1389917 - protein, 24 aa, Mycobacterium tuberculosis
LAAGVLLWLFVRHEHRAAFPLVDL

SEQ ID NO: 1389918 - protein, 24 aa, Mycobacterium tuberculosis
LDRLTLFVTGIWLVSIIGVALLIK

SEQ ID NO: 1389919 - protein, 18 aa, Mycobacterium tuberculosis
LGAAIRYAAVDKDAVIVA

SEQ ID NO: 1389920 - protein, 19 aa, Mycobacterium tuberculosis
LGAFLLAHLCFIGALLPLA

SEQ ID NO: 1389921 - protein, 22 aa, Mycobacterium tuberculosis
LPILVVVWLSLHRWDLLGPLRY

SEQ ID NO: 1389922 - protein, 19 aa, Mycobacterium tuberculosis
LRLLVVSALATLSGLGTPV

SEQ ID NO: 1389923 - protein, 26 aa, Mycobacterium tuberculosis
LTIPTIALASLWLSGPLQLGLGAIQL

SEQ ID NO: 1389924 - protein, 18 aa, Mycobacterium tuberculosis
LTRFRSPLRGPWLTSVFG

SEQ ID NO: 1389925 - protein, 50 aa, Mycobacterium tuberculosis
LVGIECLIAIPLRRDPLLFPFQPIHVTIAAWFTIGIPAFILSLAPNNERA

SEQ ID NO: 1389926 - protein, 22 aa, Mycobacterium tuberculosis
LYELISDRAITGKPLILTSNRA

SEQ ID NO: 1389927 - protein, 41 aa, Mycobacterium tuberculosis
MWFDPATARRVAVWAFVMVLAFSRHLFVRPVIRMDQTAWCA

SEQ ID NO: 1389928 - protein, 17 aa, Mycobacterium tuberculosis
NAATSIVGFISPTGRYL

SEQ ID NO: 1389929 - protein, 20 aa, Mycobacterium tuberculosis
NALLGIYYSHSLYYGLTPEQ

SEQ ID NO: 1389930 - protein, 21 aa, Mycobacterium tuberculosis
NFSRRFVPTSFIVSAIALLIT

SEQ ID NO: 1389931 - protein, 37 aa, Mycobacterium tuberculosis
NVLRRRPRFRASIQSKLMVLLLLTSIVSVAAIAAIVY

SEQ ID NO: 1389932 - protein, 24 aa, Mycobacterium tuberculosis
NVVALSFLLLHAVTWFGSAPRAMV

SEQ ID NO: 1389933 - protein, 22 aa, Mycobacterium tuberculosis
PCAVVLATMPPLLAAIANAGRH

SEQ ID NO: 1389934 - protein, 22 aa, Mycobacterium tuberculosis
PNNWYGLFPNPVVAESLLDRLI

SEQ ID NO: 1389935 - protein, 18 aa, Mycobacterium tuberculosis
PQFSLWLVPLAVLALPHR

SEQ ID NO: 1389936 - protein, 19 aa, Mycobacterium tuberculosis
QLVLLTVLAVIAVVVLGWY

SEQ ID NO: 1389937 - protein, 29 aa, Mycobacterium tuberculosis
QRYLPYATVLIGLALIALGGWLLLGRGLT

SEQ ID NO: 1389938 - protein, 19 aa, Mycobacterium tuberculosis
RARSWWSGPDIYVVVDDYD

SEQ ID NO: 1389939 - protein, 21 aa, Mycobacterium tuberculosis
RRWVTMLGAFILALAPGWFGV

SEQ ID NO: 1389940 - protein, 19 aa, Mycobacterium tuberculosis
SKVGPLRRTRLTEILRGGR

SEQ ID NO: 1389941 - protein, 20 aa, Mycobacterium tuberculosis
SLAELWRSVGVVPDAVIGHS

SEQ ID NO: 1389942 - protein, 23 aa, Mycobacterium tuberculosis
STPPTGFPSFSPPPPVSAGTGSQ

SEQ ID NO: 1389943 - protein, 30 aa, Mycobacterium tuberculosis
SYATFGEFLAWVIGWNLVLELAMGAAVVAK

SEQ ID NO: 1389944 - protein, 20 aa, Mycobacterium tuberculosis
TAGIVIIKRALAPLRRVAQT

SEQ ID NO: 1389945 - protein, 27 aa, Mycobacterium tuberculosis
TERITRLVEDLLLLARLDSGRPLERGP

SEQ ID NO: 1389946 - protein, 17 aa, Mycobacterium tuberculosis
TRFWLNSLLVLSMLFTL

SEQ ID NO: 1389947 - protein, 40 aa, Mycobacterium tuberculosis
TSLPPILPRLIRRFAVVIVLLWLGFTAFVNLAVPQLEVVG

SEQ ID NO: 1389948 - protein, 21 aa, Mycobacterium tuberculosis
TVLAYRWGGNLRALLLAAAVM

SEQ ID NO: 1389949 - protein, 17 aa, Mycobacterium tuberculosis
VAYALWSAIGTAAIVLV

SEQ ID NO: 1389950 - protein, 17 aa, Mycobacterium tuberculosis
VFLVAIPVSIALLWSLR

SEQ ID NO: 1389951 - protein, 18 aa, Mycobacterium tuberculosis
VNFWAWNLIGPLSTSYAR

SEQ ID NO: 1389952 - protein, 21 aa, Mycobacterium tuberculosis
VPIRGFGIHPAVLDAALHAWG

SEQ ID NO: 1389953 - protein, 17 aa, Mycobacterium tuberculosis
VTFMLVWLINHHGWSVA

SEQ ID NO: 1389954 - protein, 28 aa, Mycobacterium tuberculosis
AAGYIDVVILAYAAKFASAFYGPFREAV

SEQ ID NO: 1389955 - protein, 26 aa, Mycobacterium tuberculosis
AALSLILLIMMIITRSLVAALVIVGT

SEQ ID NO: 1389956 - protein, 29 aa, Mycobacterium tuberculosis
AIVLLTADLSLAVAWPLAAVVRGHDWGTD

SEQ ID NO: 1389957 - protein, 22 aa, Mycobacterium tuberculosis
ARKPWLIAGVVFLLAAAAFPNY

SEQ ID NO: 1389958 - protein, 22 aa, Mycobacterium tuberculosis
ARTRRGLRALLSLVPDQATVLR

SEQ ID NO: 1389959 - protein, 36 aa, Mycobacterium tuberculosis
ASALAPPCIIAFLETRYWWAGIALASLGVIVATVTF

SEQ ID NO: 1389960 - protein, 24 aa, Mycobacterium tuberculosis
ASTVFGVRFPAPLGLAAGFDKDGT

SEQ ID NO: 1389961 - protein, 26 aa, Mycobacterium tuberculosis
AVAPVRRLLRRLLGPTDPVLASTVFG

SEQ ID NO: 1389962 - protein, 29 aa, Mycobacterium tuberculosis
AVGTLILWAVGAALFTTLYGLANRLFIPQ

SEQ ID NO: 1389963 - protein, 25 aa, Mycobacterium tuberculosis
AVYCLSFTRLPYFQSLGIPASIGVM

SEQ ID NO: 1389964 - protein, 24 aa, Mycobacterium tuberculosis
DMSPIPRIVSVSLAWAAAIGLMVP

SEQ ID NO: 1389965 - protein, 17 aa, Mycobacterium tuberculosis
DPDGILNVALRDLAKDL

SEQ ID NO: 1389966 - protein, 30 aa, Mycobacterium tuberculosis; identical to SEQ ID NO: 164669

SEQ ID NO: 1389967 - protein, 32 aa, Mycobacterium tuberculosis
DSRPRLILGASLIGLSFLGLCHLWAGSPEAPE

SEQ ID NO: 1389968 - protein, 19 aa, Mycobacterium tuberculosis
EILIAGSGWALMWPTSAHP

SEQ ID NO: 1389969 - protein, 27 aa, Mycobacterium tuberculosis
FAAPIVIIMILLIIPVGKLSLGGISEK

SEQ ID NO: 1389970 - protein, 17 aa, Mycobacterium tuberculosis
FAWLYPVLTGLPISQQT

SEQ ID NO: 1389971 - protein, 19 aa, Mycobacterium tuberculosis
FEKFAWLFMRFSGVVLVFL

SEQ ID NO: 1389972 - protein, 26 aa, Mycobacterium tuberculosis
FGTWYAAMLFAVVPLRTILPGSPPAG

SEQ ID NO: 1389973 - protein, 23 aa, Mycobacterium tuberculosis
FKHRGELVYLPPAWFDREHRSEN

SEQ ID NO: 1389974 - protein, 17 aa, Mycobacterium tuberculosis
FLGLAVALRLAGSGMPR

SEQ ID NO: 1389975 - protein, 27 aa, Mycobacterium tuberculosis
FLVGKTPWIGALLGVLFVLTTALGDLV

SEQ ID NO: 1389976 - protein, 30 aa, Mycobacterium tuberculosis; identical to SEQ ID NO: 162323

SEQ ID NO: 1389977 - protein, 17 aa, Mycobacterium tuberculosis
FPDLPSFPGFPGFPEFP

SEQ ID NO: 1389978 - protein, 24 aa, Mycobacterium tuberculosis
FPELSAYQIINRLIHTARPPARGV

SEQ ID NO: 1389979 - protein, 28 aa, Mycobacterium tuberculosis
GALALVCAACWLIALLAGDYRHAQWAVA

SEQ ID NO: 1389980 - protein, 26 aa, Mycobacterium tuberculosis
GDFMHGRVLLAPLFCLLAPVGVIPIL

SEQ ID NO: 1389981 - protein, 27 aa, Mycobacterium tuberculosis
GMYLPAALTLMIPIGAFLGRIYDSWAR

SEQ ID NO: 1389982 - protein, 21 aa, Mycobacterium tuberculosis
GNPAPRLFRLADDRALLNRMG

SEQ ID NO: 1389983 - protein, 22 aa, Mycobacterium tuberculosis
GPQPAWRNLRFPLAWAPPEADV

SEQ ID NO: 1389984 - protein, 18 aa, Mycobacterium tuberculosis
GVGGLMLFGVPRDQDKDG

SEQ ID NO: 1389985 - protein, 26 aa, Mycobacterium tuberculosis
GWILPVIAQLVWWAVHPQPPWPHLAA

SEQ ID NO: 1389986 - protein, 27 aa, Mycobacterium tuberculosis
IVASAIGLLLFPQGFLKSLTYATIASV

SEQ ID NO: 1389987 - protein, 19 aa, Mycobacterium tuberculosis
KPAPPPPPPAPPPTTEIPT

SEQ ID NO: 1389988 - protein, 18 aa, Mycobacterium tuberculosis
LALLLIGANAFFVGAEFA

SEQ ID NO: 1389989 - protein, 20 aa, Mycobacterium tuberculosis
LATDLGRNLLLEQLHYRHEV

SEQ ID NO: 1389990 - protein, 18 aa, Mycobacterium tuberculosis
LDLPPEPVVIPGDAARLH

SEQ ID NO: 1389991 - protein, 36 aa, Mycobacterium tuberculosis; identical to SEQ ID NO: 164437

SEQ ID NO: 1389992 - protein, 20 aa, Mycobacterium tuberculosis
LFLIPPEHAHKLVFAVLRGV

SEQ ID NO: 1389993 - protein, 22 aa, Mycobacterium tuberculosis
LGAFLLAHLCFIGALLPLARQA

SEQ ID NO: 1389994 - protein, 25 aa, Mycobacterium tuberculosis
LGLVLVFALVVALVYLQFRGEFTPK

SEQ ID NO: 1389995 - protein, 17 aa, Mycobacterium tuberculosis
LLALAVAVALVIGVNYA

SEQ ID NO: 1389996 - protein, 25 aa, Mycobacterium tuberculosis
LPDIPGLPDFKWPPTPGSPLFPDLP

SEQ ID NO: 1389997 - protein, 21 aa, Mycobacterium tuberculosis
LPGIGTLAAWFAAAGEVVVFL

SEQ ID NO: 1389998 - protein, 22 aa, Mycobacterium tuberculosis
LPQDAIRWAALVALVAIGAGLI

SEQ ID NO: 1389999 - protein, 17 aa, Mycobacterium tuberculosis
LVKRGWMVLVAVAVVAV

SEQ ID NO: 1390000 - protein, 21 aa, Mycobacterium tuberculosis
LVTASDFAYLVDFGIARAASD

SEQ ID NO: 1390001 - protein, 22 aa, Mycobacterium tuberculosis
MLVSSWQMPGGIYAPMMHPWST

SEQ ID NO: 1390002 - protein, 18 aa, Mycobacterium tuberculosis
NAATSIVGFISPTGRYLS

SEQ ID NO: 1390003 - protein, 37 aa, Mycobacterium tuberculosis
NSRMLKYVVKRFALKRGALMFGKLVPMGIGAIIGAIG

SEQ ID NO: 1390004 - protein, 22 aa, Mycobacterium tuberculosis
PALDLDALLGGLRPVLKGFDAD

SEQ ID NO: 1390005 - protein, 18 aa, Mycobacterium tuberculosis
PPARWPVTLHVLPTVRDA

SEQ ID NO: 1390006 - protein, 32 aa, Mycobacterium tuberculosis; identical to SEQ ID NO: 163383

SEQ ID NO: 1390007 - protein, 17 aa, Mycobacterium tuberculosis
QALSRLPLLSIDGYRRL

SEQ ID NO: 1390008 - protein, 20 aa, Mycobacterium tuberculosis
QDAIRWAALVALVAIGAGLI

SEQ ID NO: 1390009 - protein, 34 aa, Mycobacterium tuberculosis
QRVCRALIHILDPLIALESLYRYLRKFHALDERR

SEQ ID NO: 1390010 - protein, 21 aa, Mycobacterium tuberculosis
QTSESLWWVTDAGARFGVEDS

SEQ ID NO: 1390011 - protein, 26 aa, Mycobacterium tuberculosis
QVLDTTLPWSYTITTTLPAVFANVVA

SEQ ID NO: 1390012 - protein, 21 aa, Mycobacterium tuberculosis
QYNTYLKQYLALYTNGMNDVV

SEQ ID NO: 1390013 - protein, 35 aa, Mycobacterium tuberculosis; identical to SEQ ID NO: 164496

SEQ ID NO: 1390014 - protein, 24 aa, Mycobacterium tuberculosis
REPRNIWVMIGVPALIVALIGTIV

SEQ ID NO: 1390015 - protein, 22 aa, Mycobacterium tuberculosis
RFLNRNLGWLFLFKQGNVSLAG

SEQ ID NO: 1390016 - protein, 17 aa, Mycobacterium tuberculosis
RFWAWTIAGYTLTVVTV

SEQ ID NO: 1390017 - protein, 20 aa, Mycobacterium tuberculosis
RGRIGLGKRTFSLPWRLANI

SEQ ID NO: 1390018 - protein, 25 aa, Mycobacterium tuberculosis
RITDVLTLALVGFLGGLITGISPCI

SEQ ID NO: 1390019 - protein, 21 aa, Mycobacterium tuberculosis
RLDNARFLLPVVGVPPDQATD

SEQ ID NO: 1390020 - protein, 35 aa, Mycobacterium tuberculosis
RLLQDGRDMFWSLAPLVVGCILLAGLVGMCSFQLG

SEQ ID NO: 1390021 - protein, 22 aa, Mycobacterium tuberculosis
RLRSTVAMRRLVAQTSLEPRHL

SEQ ID NO: 1390022 - protein, 17 aa, Mycobacterium tuberculosis
RLSHFGALVRIPRSVEA

SEQ ID NO: 1390023 - protein, 17 aa, Mycobacterium tuberculosis
RLTLIVFVAMTLAAGLL

SEQ ID NO: 1390024 - protein, 17 aa, Mycobacterium tuberculosis
RRRWYLIGVSLFTLGSI

SEQ ID NO: 1390025 - protein, 42 aa, Mycobacterium tuberculosis; identical to SEQ ID NO: 163611

SEQ ID NO: 1390026 - protein, 21 aa, Mycobacterium tuberculosis
RTLDVDLLMVVAAIGAAAIGQ

SEQ ID NO: 1390027 - protein, 19 aa, Mycobacterium tuberculosis
RWDALGFLQDFFATAVFLG

SEQ ID NO: 1390028 - protein, 26 aa, Mycobacterium tuberculosis
SGLVLAYLGLLWWMMVCWSQPLRARP

SEQ ID NO: 1390029 - protein, 21 aa, Mycobacterium tuberculosis
SGVPLFGIALLGILEMVLQNF

SEQ ID NO: 1390030 - protein, 25 aa, Mycobacterium tuberculosis
SGVPPALLHTLSLAVALAIVVALHV

SEQ ID NO: 1390031 - protein, 18 aa, Mycobacterium tuberculosis
SGWALMWPTSAHPRPEDL

SEQ ID NO: 1390032 - protein, 18 aa, Mycobacterium tuberculosis
SHFGALVRIPRSVEALGR

SEQ ID NO: 1390033 - protein, 19 aa, Mycobacterium tuberculosis
SLLGLAVGWLVGALVVLVV

SEQ ID NO: 1390034 - protein, 25 aa, Mycobacterium tuberculosis
SLLQGYTGFIYGGERWAKDIHEGIA

SEQ ID NO: 1390035 - protein, 39 aa, Mycobacterium tuberculosis
SSSSRVVLLVTVGIIVIVVAVLLVVMRHRNRRRRADELA

SEQ ID NO: 1390036 - protein, 25 aa, Mycobacterium tuberculosis
STGKDVYFNLSLWSAYNVMLMHTVL

SEQ ID NO: 1390037 - protein, 20 aa, Mycobacterium tuberculosis
SVPMLVRRLITLGPALAILT

SEQ ID NO: 1390038 - protein, 17 aa, Mycobacterium tuberculosis
TAGIVVGILISLRGVTN

SEQ ID NO: 1390039 - protein, 26 aa, Mycobacterium tuberculosis
TGLFRTLYVLPWICAPLAIAVMWRWI

SEQ ID NO: 1390040 - protein, 25 aa, Mycobacterium tuberculosis
THDDRRLLSLILLARDHVVHGWVLA

SEQ ID NO: 1390041 - protein, 19 aa, Mycobacterium tuberculosis
TMASLPLPAISSLNSRMLK

SEQ ID NO: 1390042 - protein, 57 aa, Mycobacterium tuberculosis; identical to SEQ ID NO: 164945

SEQ ID NO: 1390043 - protein, 17 aa, Mycobacterium tuberculosis
TPLAPVVEPPTPPTPAS

SEQ ID NO: 1390044 - protein, 24 aa, Mycobacterium tuberculosis
TQPSQLLVLLIIGGALMGCAASIR

SEQ ID NO: 1390045 - protein, 19 aa, Mycobacterium tuberculosis
TSFQWNWKFGYQRVNFKDG

SEQ ID NO: 1390046 - protein, 26 aa, Mycobacterium tuberculosis
TVRTGLLWWTVAIHLLASMTMVWLAV

SEQ ID NO: 1390047 - protein, 21 aa, Mycobacterium tuberculosis
TVVFGVLRWFFTTYRIDDENV

SEQ ID NO: 1390048 - protein, 24 aa, Mycobacterium tuberculosis
VAAAWTFLKILGPILRGIADAAVS

SEQ ID NO: 1390049 - protein, 20 aa, Mycobacterium tuberculosis
VAGRLGWSLTVLAAVAFIAR

SEQ ID NO: 1390050 - protein, 23 aa, Mycobacterium tuberculosis
VASTLLLLLPMPLETRTVIALLF

SEQ ID NO: 1390051 - protein, 29 aa, Mycobacterium tuberculosis
VDQWGWRSIFYVNLPMGALVLFLTLCYVE

SEQ ID NO: 1390052 - protein, 17 aa, Mycobacterium tuberculosis
VGAALWPSAAAGLAGVL

SEQ ID NO: 1390053 - protein, 19 aa, Mycobacterium tuberculosis
VGTLLSWYALVAAVTTVPL

SEQ ID NO: 1390054 - protein, 26 aa, Mycobacterium tuberculosis
VIAVMLLFVYRSVVTMVLVLITVLIE

SEQ ID NO: 1390055 - protein, 18 aa, Mycobacterium tuberculosis
VLAIVAAMGCAFVALLRP

SEQ ID NO: 1390056 - protein, 28 aa, Mycobacterium tuberculosis
VLVADGHPWRWFLIGFMVLFHLNILSNL

SEQ ID NO: 1390057 - protein, 29 aa, Mycobacterium tuberculosis
VRCNTQRRWLLYALVLMLSILVSINLALL

SEQ ID NO: 1390058 - protein, 20 aa, Mycobacterium tuberculosis
VRIKLWLQYVIAGTPRMPDE

SEQ ID NO: 1390059 - protein, 28 aa, Mycobacterium tuberculosis
VTFIAGLVVWDLAFTLPLPLGVARHEGS

SEQ ID NO: 1390060 - protein, 19 aa, Mycobacterium tuberculosis
VTILLAVALVFDLPAALQR

SEQ ID NO: 1390061 - protein, 18 aa, Mycobacterium tuberculosis
VTNFAWLYPVLTGLPISQ

SEQ ID NO: 1390062 - protein, 18 aa, Mycobacterium tuberculosis
WAIGVMLAILALISLVCT

SEQ ID NO: 1390063 - protein, 19 aa, Mycobacterium tuberculosis
WQRIVALTMIGISTALIGG

SEQ ID NO: 1390064 - protein, 18 aa, Mycobacterium tuberculosis
YAELPRSGGLYRTANVTY

SEQ ID NO: 1390065 - protein, 19 aa, Mycobacterium tuberculosis
YALMVATIVGLSAAGGWFY

SEQ ID NO: 1390066 - protein, 17 aa, Mycobacterium tuberculosis
YRSLSCAYWLWTCWLRD

SEQ ID NO: 1390067 - protein, 34 aa, Mycobacterium tuberculosis
AADRQYAVFLLVLPLLLSLFAHAVPGQAGLSLAK

SEQ ID NO: 1390068 - protein, 27 aa, Mycobacterium tuberculosis
ADYSFLSYYPYWGFQGLTPHYANPLAQ

SEQ ID NO: 1390069 - protein, 18 aa, Mycobacterium tuberculosis
AHLPYVAWLTQASADAAG

SEQ ID NO: 1390070 - protein, 25 aa, Mycobacterium tuberculosis
AIGSVARWIVPLLGVAAVASIGVIA

SEQ ID NO: 1390071 - protein, 19 aa, Mycobacterium tuberculosis
AILCRRYLAVIAADRQYAV

SEQ ID NO: 1390072 - protein, 20 aa, Mycobacterium tuberculosis
AKVRGRLLALFGLALLEAAG

SEQ ID NO: 1390073 - protein, 19 aa, Mycobacterium tuberculosis
ALGVLVLLFSPPSIRWAAG

SEQ ID NO: 1390074 - protein, 27 aa, Mycobacterium tuberculosis
ALLELTVLVLLLAAWFHFVANGDGRRT

SEQ ID NO: 1390075 - protein, 30 aa, Mycobacterium tuberculosis
ATLIGGFLLMWIMSWLTAAPVRVVRAALKR

SEQ ID NO: 1390076 - protein, 27 aa, Mycobacterium tuberculosis
AVVFYPLHLVPFGLIALLWQVVTMAAL

SEQ ID NO: 1390077 - protein, 27 aa, Mycobacterium tuberculosis
AVVVLLGWSFFYFSDDTRGYKPVDTSV

SEQ ID NO: 1390078 - protein, 28 aa, Mycobacterium tuberculosis
AVVYGGLYFALYALQFFLPQLVASLAHG

SEQ ID NO: 1390079 - protein, 25 aa, Mycobacterium tuberculosis
AWAAAIGLMVPIGLAPPAMAAPCSG

SEQ ID NO: 1390080 - protein, 33 aa, Mycobacterium tuberculosis; identical to SEQ ID NO: 162049

SEQ ID NO: 1390081 - protein, 21 aa, Mycobacterium tuberculosis
DGDRLWIRFIADTERRSQVIE

SEQ ID NO: 1390082 - protein, 26 aa, Mycobacterium tuberculosis
DGMRHRRFLPARWWSIGGLDTLVIAV

SEQ ID NO: 1390083 - protein, 24 aa, Mycobacterium tuberculosis
DPQTRLLSMLPSGYPTGTCKPTTP

SEQ ID NO: 1390084 - protein, 26 aa, Mycobacterium tuberculosis
DTKVLSPPYSILAIGDPPTLAAAMNI

SEQ ID NO: 1390085 - protein, 28 aa, Mycobacterium tuberculosis
ELATHYWKPLLLCFLVTLGGTVAFYTYS

SEQ ID NO: 1390086 - protein, 19 aa, Mycobacterium tuberculosis
ELTFRRIAAALGRPMVPIG

SEQ ID NO: 1390087 - protein, 26 aa, Mycobacterium tuberculosis
EMQGDGPYVLVGWSLGGVLAYACAIG

SEQ ID NO: 1390088 - protein, 28 aa, Mycobacterium tuberculosis
EPRDDPNSLLPRWLPDTSRGQGWADRIR

SEQ ID NO: 1390089 - protein, 24 aa, Mycobacterium tuberculosis
EQRPPWGVPPPGWDGSSRPAPSTT

SEQ ID NO: 1390090 - protein, 23 aa, Mycobacterium tuberculosis
EYIGFLVAWQRPLAGKKTLMDLA

SEQ ID NO: 1390091 - protein, 23 aa, Mycobacterium tuberculosis
FAAMLWTAIAIWIEPLRSTFDYG

SEQ ID NO: 1390092 - protein, 23 aa, Mycobacterium tuberculosis
FALFIFWLLLIARVVVEFIRSFS

SEQ ID NO: 1390093 - protein, 18 aa, Mycobacterium tuberculosis
FAVCCVLSFVVGFAMLGA

SEQ ID NO: 1390094 - protein, 25 aa, Mycobacterium tuberculosis
FAVTNDGVIFFFNPGELLPEAAGPT

SEQ ID NO: 1390095 - protein, 21 aa, Mycobacterium tuberculosis
FESIWILALVVGIWLVVIGAC

SEQ ID NO: 1390096 - protein, 38 aa, Mycobacterium tuberculosis; identical to SEQ ID NO: 162302

SEQ ID NO: 1390097 - protein, 17 aa, Mycobacterium tuberculosis
FLAVYLMANIPGSSTIA

SEQ ID NO: 1390098 - protein, 34 aa, Mycobacterium tuberculosis
FVHELSTPEFPWSALTIVLLIGVLAAAVGARLMQ

SEQ ID NO: 1390099 - protein, 18 aa, Mycobacterium tuberculosis
FVTILPAYDLTLFVNQLA

SEQ ID NO: 1390100 - protein, 24 aa, Mycobacterium tuberculosis
GAHADAYLWIKRPGESDGTCGRGE

SEQ ID NO: 1390101 - protein, 22 aa, Mycobacterium tuberculosis
GALSGLWLGIAGWSLWAANSPG

SEQ ID NO: 1390102 - protein, 29 aa, Mycobacterium tuberculosis
GALVLGVLFWFTFVGWVTVVIAGGISRRP

SEQ ID NO: 1390103 - protein, 23 aa, Mycobacterium tuberculosis
GASLLLYTSFLVVVYLATQRFSW

SEQ ID NO: 1390104 - protein, 29 aa, Mycobacterium tuberculosis
GDFMHGRVLLAPLFCLLAPVGVIPILLPD

SEQ ID NO: 1390105 - protein, 17 aa, Mycobacterium tuberculosis
GDRPPLDELARTDLLLD

SEQ ID NO: 1390106 - protein, 24 aa, Mycobacterium tuberculosis
GKRTFSLPWRLANIQDLPAVDSPA

SEQ ID NO: 1390107 - protein, 18 aa, Mycobacterium tuberculosis
GLALGVLYVPCAGPILAA

SEQ ID NO: 1390108 - protein, 24 aa, Mycobacterium tuberculosis
GLGAFLLAHLCFIGALLPLARQAA

SEQ ID NO: 1390109 - protein, 38 aa, Mycobacterium tuberculosis
GLGYGLLFGLVFYVSLLPWIGELVGPGPWLALATTCAL

SEQ ID NO: 1390110 - protein, 21 aa, Mycobacterium tuberculosis
GLIFPRFEQLLEKPFSRIPQK

SEQ ID NO: 1390111 - protein, 26 aa, Mycobacterium tuberculosis
GLRQLYFLIDGLLDRLVYLSYGLAVI

SEQ ID NO: 1390112 - protein, 21 aa, Mycobacterium tuberculosis
GMYSWLHFWIATACALTAWYV

SEQ ID NO: 1390113 - protein, 25 aa, Mycobacterium tuberculosis
GTALVLLFLLALAAIPGALLPQRGL

SEQ ID NO: 1390114 - protein, 25 aa, Mycobacterium tuberculosis
GTSYRSVLMYPEKMPRPPWRRETHN

SEQ ID NO: 1390115 - protein, 23 aa, Mycobacterium tuberculosis
GTTIVLLVRWLVARRAAAFMHQG

SEQ ID NO: 1390116 - protein, 38 aa, Mycobacterium tuberculosis
GWVGTHAYWLGAQWWHPLVVVGLIALVAIMIAAANPGR

SEQ ID NO: 1390117 - protein, 17 aa, Mycobacterium tuberculosis
HGGLSFGSVLLAAGVCL

SEQ ID NO: 1390118 - protein, 17 aa, Mycobacterium tuberculosis
HPEFVDVFLAIGRVGRS

SEQ ID NO: 1390119 - protein, 17 aa, Mycobacterium tuberculosis
HQVTVVSSPSWFSDYVL

SEQ ID NO: 1390120 - protein, 18 aa, Mycobacterium tuberculosis
HRIRYIRLKKSSPDCRAT

SEQ ID NO: 1390121 - protein, 20 aa, Mycobacterium tuberculosis
IGLGLLFDTLVVRAFMTPSI

SEQ ID NO: 1390122 - protein, 23 aa, Mycobacterium tuberculosis
IIGRTMVVWLLSSGVPLFGIALL

SEQ ID NO: 1390123 - protein, 19 aa, Mycobacterium tuberculosis
ITYDTLWQADTDPLPVVFP

SEQ ID NO: 1390124 - protein, 31 aa, Mycobacterium tuberculosis
KHDWPFADRVFAAALPWLAGQLATPGVPKIP

SEQ ID NO: 1390125 - protein, 21 aa, Mycobacterium tuberculosis
LAAVAFIARGIFLGRPVTAMH

SEQ ID NO: 1390126 - protein, 18 aa, Mycobacterium tuberculosis
LAGKPFYVDPASAAMVAA

SEQ ID NO: 1390127 - protein, 23 aa, Mycobacterium tuberculosis
LAGLCMLMLGLLMLIFSEHRSSA

SEQ ID NO: 1390128 - protein, 17 aa, Mycobacterium tuberculosis
LALFGLALLEAAGVVAV

SEQ ID NO: 1390129 - protein, 27 aa, Mycobacterium tuberculosis
LATVRRRRPWRGVLLTLAAVAVVASIG

SEQ ID NO: 1390130 - protein, 18 aa, Mycobacterium tuberculosis
LGAFLLAHLCFIGALLPL

SEQ ID NO: 1390131 - protein, 25 aa, Mycobacterium tuberculosis
LIEQPIRRWRPARVPLLPLAAATVA

SEQ ID NO: 1390132 - protein, 18 aa, Mycobacterium tuberculosis
LIGYVGLADTARPSSRPL

SEQ ID NO: 1390133 - protein, 30 aa, Mycobacterium tuberculosis
LILGWRSARWWRRGASLLAVPLCLLSATLT

SEQ ID NO: 1390134 - protein, 22 aa, Mycobacterium tuberculosis
LLAPLRVAVGTLILWAVGAALF

SEQ ID NO: 1390135 - protein, 17 aa, Mycobacterium tuberculosis
LMMPQTVTVTFMLVWLI

SEQ ID NO: 1390136 - protein, 23 aa, Mycobacterium tuberculosis
LPILVVVWLSLHRWDLLGPLRYV

SEQ ID NO: 1390137 - protein, 45 aa, Mycobacterium tuberculosis
LRPVKPPPRRPAHRVLVGWLSLAAGLLAIAALAWGVTALVMQNRD

SEQ ID NO: 1390138 - protein, 17 aa, Mycobacterium tuberculosis
LRVRMALDEGRYKIAKL

SEQ ID NO: 1390139 - protein, 30 aa, Mycobacterium tuberculosis
LTATFALGAALPLLFFALAGQRIAERVGAF

SEQ ID NO: 1390140 - protein, 44 aa, Mycobacterium tuberculosis
LVLARRTKLFALSEMRWAALALGLFSAGLLTQLCGAPQWVRWAL

SEQ ID NO: 1390141 - protein, 17 aa, Mycobacterium tuberculosis
LVLVRPAVRRRLTQTKG

SEQ ID NO: 1390142 - protein, 19 aa, Mycobacterium tuberculosis
LWYAVMTQLGFIAILVGLV

SEQ ID NO: 1390143 - protein, 26 aa, Mycobacterium tuberculosis
NAKRWGVLHVIWRQGYYPGIGAPSWT

SEQ ID NO: 1390144 - protein, 25 aa, Mycobacterium tuberculosis
NVDNWVQRLFALPVLPAGYADRVVQ

SEQ ID NO: 1390145 - protein, 19 aa, Mycobacterium tuberculosis
PILAAAPTPPLGPAWVALL

SEQ ID NO: 1390146 - protein, 17 aa, Mycobacterium tuberculosis
PILAVACAIAVVGLLAL

SEQ ID NO: 1390147 - protein, 24 aa, Mycobacterium tuberculosis
PILPTQILWINMTTAIALGLMLAF

SEQ ID NO: 1390148 - protein, 22 aa, Mycobacterium tuberculosis
PLRRRVRIQIILTIALITANLV

SEQ ID NO: 1390149 - protein, 23 aa, Mycobacterium tuberculosis
PMLRPTMFFVLVTGIISAAQVFD

SEQ ID NO: 1390150 - protein, 23 aa, Mycobacterium tuberculosis
PSGRHWHRKSPVPMLPVVAVADG

SEQ ID NO: 1390151 - protein, 17 aa, Mycobacterium tuberculosis
QADTDPLPVVFPIVQGE

SEQ ID NO: 1390152 - protein, 23 aa, Mycobacterium tuberculosis
QTPKVFKAAAWVAIAAGTVFIVA

SEQ ID NO: 1390153 - protein, 23 aa, Mycobacterium tuberculosis
QTSLEPRHLVLPMFVADGIDEPR

SEQ ID NO: 1390154 - protein, 33 aa, Mycobacterium tuberculosis; identical to SEQ ID NO: 164883

SEQ ID NO: 1390155 - protein, 17 aa, Mycobacterium tuberculosis
RAVFGTRLLPREYADDF

SEQ ID NO: 1390156 - protein, 20 aa, Mycobacterium tuberculosis
RGLLDPVAKMLRLPFGTPDF

SEQ ID NO: 1390157 - protein, 25 aa, Mycobacterium tuberculosis
RILGWGWLVLTIVGVPWLLSFAQPS

SEQ ID NO: 1390158 - protein, 23 aa, Mycobacterium tuberculosis
RILTHLPVVIGAVLAIMVWRSAS

SEQ ID NO: 1390159 - protein, 26 aa, Mycobacterium tuberculosis
RNFDVRIKIFMLVTAVVLLCCSGVAT

SEQ ID NO: 1390160 - protein, 20 aa, Mycobacterium tuberculosis
RNLLGLFMPSALTLLFVMFA

SEQ ID NO: 1390161 - protein, 34 aa, Mycobacterium tuberculosis; identical to SEQ ID NO: 164900

SEQ ID NO: 1390162 - protein, 20 aa, Mycobacterium tuberculosis
RTLYVLITTWDAAGGGPFAA

SEQ ID NO: 1390163 - protein, 23 aa, Mycobacterium tuberculosis
RVVVVIVLLMLAGAALRGHLPAD

SEQ ID NO: 1390164 - protein, 19 aa, Mycobacterium tuberculosis
SALLAWLTAAAVAIAMLTL

SEQ ID NO: 1390165 - protein, 24 aa, Mycobacterium tuberculosis
SDRLSHTLLPKRIALPVFASDAMS

SEQ ID NO: 1390166 - protein, 22 aa, Mycobacterium tuberculosis
SLIGLSFLGLCHLWAGSPEAPE

SEQ ID NO: 1390167 - protein, 19 aa, Mycobacterium tuberculosis
SRAALMFIVAALAATLALI

SEQ ID NO: 1390168 - protein, 20 aa, Mycobacterium tuberculosis
SRRFWAWTIAGYTLTVVTVP

SEQ ID NO: 1390169 - protein, 20 aa, Mycobacterium tuberculosis
SWRRGLIFAMFVFAAIFTPG

SEQ ID NO: 1390170 - protein, 17 aa, Mycobacterium tuberculosis
SWSPRFIDHLVGDRIHR

SEQ ID NO: 1390171 - protein, 20 aa, Mycobacterium tuberculosis
TAILMLYTIVIIRGLRTAIA

SEQ ID NO: 1390172 - protein, 27 aa, Mycobacterium tuberculosis
TGLFRTLYVLPWICAPLAIAVMWRWIV

SEQ ID NO: 1390173 - protein, 24 aa, Mycobacterium tuberculosis
TIVGVPWLLSFAQPSIWQIGRPWY

SEQ ID NO: 1390174 - protein, 18 aa, Mycobacterium tuberculosis
TNIFGYRQDPLKWHPNGL

SEQ ID NO: 1390175 - protein, 19 aa, Mycobacterium tuberculosis
TQLDWVGQLTLIPAVALIA

SEQ ID NO: 1390176 - protein, 18 aa, Mycobacterium tuberculosis
TYLGGWRIIRTLGKGLVE

SEQ ID NO: 1390177 - protein, 19 aa, Mycobacterium tuberculosis
VAAPILLILCRLVQGFATG

SEQ ID NO: 1390178 - protein, 25 aa, Mycobacterium tuberculosis
VANTPQSYWLDQAFPPATVGGTVAR

SEQ ID NO: 1390179 - protein, 17 aa, Mycobacterium tuberculosis
VFAVLRGVAAVAPVRRL

SEQ ID NO: 1390180 - protein, 24 aa, Mycobacterium tuberculosis
VLAYACAIGLRRLGKDVRFVGLID

SEQ ID NO: 1390181 - protein, 19 aa, Mycobacterium tuberculosis
VLWCLLWLLAGVALGYVAW

SEQ ID NO: 1390182 - protein, 56 aa, Mycobacterium tuberculosis; identical to SEQ ID NO: 164115

SEQ ID NO: 1390183 - protein, 23 aa, Mycobacterium tuberculosis
VPWWWWPLAFALAALIAFEVNLG

SEQ ID NO: 1390184 - protein, 23 aa, Mycobacterium tuberculosis
VQSMFIGPVFNPLLKMLGADKIA

SEQ ID NO: 1390185 - protein, 32 aa, Mycobacterium tuberculosis
VSFGIVPGYCVLAFILGTYWLTRQTARALRWA

SEQ ID NO: 1390186 - protein, 29 aa, Mycobacterium tuberculosis
VSGRPPLEQLSWLSPSRWAYAMAAATVDL

SEQ ID NO: 1390187 - protein, 19 aa, Mycobacterium tuberculosis
VSPYTLAFSAALRPKTQRR

SEQ ID NO: 1390188 - protein, 18 aa, Mycobacterium tuberculosis
VVGTSRRSRWARLFDEGI

SEQ ID NO: 1390189 - protein, 19 aa, Mycobacterium tuberculosis
VVHGWVLASGSFMLCAAFN

SEQ ID NO: 1390190 - protein, 46 aa, Mycobacterium tuberculosis
VVLALVALQLYDFLWYPYYASYGLLLLPFFTPTLSALTALSALIHL

SEQ ID NO: 1390191 - protein, 17 aa, Mycobacterium tuberculosis
VVRAPALILVDAANPLA

SEQ ID NO: 1390192 - protein, 28 aa, Mycobacterium tuberculosis
VWAGGFTMFTMIPLGVLLGALVTFVIFG

SEQ ID NO: 1390193 - protein, 19 aa, Mycobacterium tuberculosis
VWCVTAIIGAFAARHGYRQ

SEQ ID NO: 1390194 - protein, 18 aa, Mycobacterium tuberculosis
VYTELWVGFTAVSALLIL

SEQ ID NO: 1390195 - protein, 20 aa, Mycobacterium tuberculosis
YCAGWLPWFADIDRQMYFFY

SEQ ID NO: 1390196 - protein, 17 aa, Mycobacterium tuberculosis
YDVLPQTRWIPVVTFVQ

SEQ ID NO: 1390197 - protein, 18 aa, Mycobacterium tuberculosis
YQIEPALHDGDYSGAAVA

SEQ ID NO: 1390198 - protein, 25 aa, Mycobacterium tuberculosis
YVAAHLPYLAWLTKSSADSARLATQ

SEQ ID NO: 1390199 - protein, 18 aa, Mycobacterium tuberculosis
YVKVQTLAALRWASEEHT

SEQ ID NO: 1390200 - protein, 27 aa, Mycobacterium tuberculosis
AAHCPAYFQLLVKALVLPGLQELEHTA

SEQ ID NO: 1390201 - protein, 31 aa, Mycobacterium tuberculosis
AATFIAVLVLWDLFGQLPLPLGVVGHEGSTV

SEQ ID NO: 1390202 - protein, 32 aa, Mycobacterium tuberculosis
AATFVIGWQLVGFIWATVAGLVAWLIMLMTSP

SEQ ID NO: 1390203 - protein, 20 aa, Mycobacterium tuberculosis
AAVQLPAVWLLSAVTVGLFG

SEQ ID NO: 1390204 - protein, 17 aa, Mycobacterium tuberculosis
AAVWGLVRSAQAEHPGR

SEQ ID NO: 1390205 - protein, 26 aa, Mycobacterium tuberculosis
ADAALAALGLWLSVAAVAGALLALTR

SEQ ID NO: 1390206 - protein, 25 aa, Mycobacterium tuberculosis
AGLVAWLIMLMTSPPTRAAARLMTP

SEQ ID NO: 1390207 - protein, 29 aa, Mycobacterium tuberculosis
AIAGDFWPWALQFVATLWVSTFLVVASHE

SEQ ID NO: 1390208 - protein, 21 aa, Mycobacterium tuberculosis
AIQAFIFALLTILYFSQAMEL

SEQ ID NO: 1390209 - protein, 24 aa, Mycobacterium tuberculosis
AIYLVLGMIILTPPLLREWTHYDS

SEQ ID NO: 1390210 - protein, 19 aa, Mycobacterium tuberculosis
ALAGGLGAAGYFALRSHQE

SEQ ID NO: 1390211 - protein, 26 aa, Mycobacterium tuberculosis
ALATIARWLLTRRSVILREVGPETTP

SEQ ID NO: 1390212 - protein, 17 aa, Mycobacterium tuberculosis
ALVLVILIALQLKRIEP

SEQ ID NO: 1390213 - protein, 33 aa, Mycobacterium tuberculosis
ALVVIAALTLGLVLYRRRRISLSPRPERGVVDR

SEQ ID NO: 1390214 - protein, 25 aa, Mycobacterium tuberculosis
ANFDDFFRPIRSYFYWEKHCYDIPS

SEQ ID NO: 1390215 - protein, 18 aa, Mycobacterium tuberculosis
APLRVAVGTLILWAVGAA

SEQ ID NO: 1390216 - protein, 24 aa, Mycobacterium tuberculosis
AQFGYLLLWVIVAANVMAALVQYL

SEQ ID NO: 1390217 - protein, 32 aa, Mycobacterium tuberculosis
ARRQQGCHTMSLDWVAWRGLGLAADAQLVSEE

SEQ ID NO: 1390218 - protein, 25 aa, Mycobacterium tuberculosis
ARVRPLRIRRTSPAPAKPAPNSGRR

SEQ ID NO: 1390219 - protein, 24 aa, Mycobacterium tuberculosis
ASGPAWRLIGTTAVGLLLLTFTPT

SEQ ID NO: 1390220 - protein, 27 aa, Mycobacterium tuberculosis
AVEQQALIALPPRAFELTSWSIGTVGV

SEQ ID NO: 1390221 - protein, 25 aa, Mycobacterium tuberculosis
AVKGSLWWDIWSLGLLVLIPAVVYG

SEQ ID NO: 1390222 - protein, 23 aa, Mycobacterium tuberculosis
AVWSNGWWIDPAIGLAIAGIAVW

SEQ ID NO: 1390223 - protein, 18 aa, Mycobacterium tuberculosis
DDPWRDPAAAAALGTPAL

SEQ ID NO: 1390224 - protein, 17 aa, Mycobacterium tuberculosis
DGKIVHPTLGISTRSVS

SEQ ID NO: 1390225 - protein, 20 aa, Mycobacterium tuberculosis
DHQPLLRRLLEDRIGTAATA

SEQ ID NO: 1390226 - protein, 28 aa, Mycobacterium tuberculosis
DLDDELAAPRWPWVVGVAAIIAAVALVV

SEQ ID NO: 1390227 - protein, 27 aa, Mycobacterium tuberculosis
DNANPFALLLVALLGPIAATVIRMAVS

SEQ ID NO: 1390228 - protein, 17 aa, Mycobacterium tuberculosis
DRLEAVVMLLAVTVSLL

SEQ ID NO: 1390229 - protein, 23 aa, Mycobacterium tuberculosis
DSRRNLLGLFMPSALTLLFVMFA

SEQ ID NO: 1390230 - protein, 20 aa, Mycobacterium tuberculosis
DSVVTPLRLALERDTRAVDP

SEQ ID NO: 1390231 - protein, 17 aa, Mycobacterium tuberculosis
DVLAVATRGLWAAALQL

SEQ ID NO: 1390232 - protein, 23 aa, Mycobacterium tuberculosis
DVSIRWQLKQAAAPELFQQYKTF

SEQ ID NO: 1390233 - protein, 19 aa, Mycobacterium tuberculosis
EGRLERLRGRLARSQNALG

SEQ ID NO: 1390234 - protein, 41 aa, Mycobacterium tuberculosis; identical to SEQ ID NO: 164368

SEQ ID NO: 1390235 - protein, 26 aa, Mycobacterium tuberculosis
EVTAEYQSWRVFWGSAAALLTVGVGI

SEQ ID NO: 1390236 - protein, 17 aa, Mycobacterium tuberculosis
FAGSVLRGADLATLLQR

SEQ ID NO: 1390237 - protein, 26 aa, Mycobacterium tuberculosis
FEKLRDLVINAPARLDLLTQQYVELT

SEQ ID NO: 1390238 - protein, 23 aa, Mycobacterium tuberculosis
FGALLRVVYVALPPLHDQWRPVL

SEQ ID NO: 1390239 - protein, 21 aa, Mycobacterium tuberculosis
FGMVTLLGSALLSVLHLPQDA

SEQ ID NO: 1390240 - protein, 28 aa, Mycobacterium tuberculosis
FIDAIICFVGFLFPLWDAKRQTLADKIM

SEQ ID NO: 1390241 - protein, 27 aa, Mycobacterium tuberculosis
FSINVAAVVYLLISKRLFGGRKAYDVE

SEQ ID NO: 1390242 - protein, 24 aa, Mycobacterium tuberculosis
FSINVAAVVYLLISKRLFGVRGGR

SEQ ID NO: 1390243 - protein, 24 aa, Mycobacterium tuberculosis
FTLSILIRRPIVGYLWSWLSRRDR

SEQ ID NO: 1390244 - protein, 18 aa, Mycobacterium tuberculosis
FWAKVRRGALFRAAAVWL

SEQ ID NO: 1390245 - protein, 22 aa, Mycobacterium tuberculosis
GALLALTRAILIRVRNASWQHD

SEQ ID NO: 1390246 - protein, 23 aa, Mycobacterium tuberculosis
GCGYEFRLETSCYNPSFGGMDRQ

SEQ ID NO: 1390247 - protein, 31 aa, Mycobacterium tuberculosis; identical to SEQ ID NO: 164382

SEQ ID NO: 1390248 - protein, 30 aa, Mycobacterium tuberculosis
GFADFPKYPLNILADVNALLGIYYSHSLYY

SEQ ID NO: 1390249 - protein, 18 aa, Mycobacterium tuberculosis
GGLWAWIAPPIHAVVAIT

SEQ ID NO: 1390250 - protein, 68 aa, Mycobacterium tuberculosis
GIIIEILIQLFLISLEILFAIVAYTIIIVLILPLVIFAYAIVFAVLAIIFGPPLLVIASPFVLNGSVI

SEQ ID NO: 1390251 - protein, 25 aa, Mycobacterium tuberculosis
GLAAIAFLPIVLAPAVIPPASTPLA

SEQ ID NO: 1390252 - protein, 21 aa, Mycobacterium tuberculosis
GLLLGPPAGAQPPFRLSNYVT

SEQ ID NO: 1390253 - protein, 20 aa, Mycobacterium tuberculosis
GLMLFGVPRDQDKDGVGSAG

SEQ ID NO: 1390254 - protein, 24 aa, Mycobacterium tuberculosis
GLQVKTIWVARAVSVLFPQITNIF

SEQ ID NO: 1390255 - protein, 26 aa, Mycobacterium tuberculosis
GMTHTPIPRPDARYGRPRLSRRARRR

SEQ ID NO: 1390256 - protein, 35 aa, Mycobacterium tuberculosis
GPSPWAQTPRKTNPWPFVAVAAAVVLVLVLGAIGI

SEQ ID NO: 1390257 - protein, 25 aa, Mycobacterium tuberculosis
GTGLGLLIGIWLGEGLIGLVTQTIN

SEQ ID NO: 1390258 - protein, 24 aa, Mycobacterium tuberculosis
HATAAGLFLLAGLAAHVLVADLLG

SEQ ID NO: 1390259 - protein, 17 aa, Mycobacterium tuberculosis
IAALVVIAALTLGLVLY

SEQ ID NO: 1390260 - protein, 17 aa, Mycobacterium tuberculosis
IDMDAQVIGINTAGKSL

SEQ ID NO: 1390261 - protein, 25 aa, Mycobacterium tuberculosis
ILDYLQGAVWVLPTFGVAIGLGSGA

SEQ ID NO: 1390262 - protein, 29 aa, Mycobacterium tuberculosis
IMAGLVVIIPLYALAMIMSFLSPQITTTV

SEQ ID NO: 1390263 - protein, 44 aa, Mycobacterium tuberculosis; identical to SEQ ID NO: 164754

SEQ ID NO: 1390264 - protein, 26 aa, Mycobacterium tuberculosis
ITALCLFTAVFIMLRRKRIPSVARGP

SEQ ID NO: 1390265 - protein, 25 aa, Mycobacterium tuberculosis
IVALIGTIVMLYVSGVRSLATGFFP

SEQ ID NO: 1390266 - protein, 26 aa, Mycobacterium tuberculosis
LAAARVFLFGMVLVVVSWGAEAGLTD

SEQ ID NO: 1390267 - protein, 26 aa, Mycobacterium tuberculosis
LACGWAFLIWGMYAYLWAFVLYAVQM

SEQ ID NO: 1390268 - protein, 32 aa, Mycobacterium tuberculosis; identical to SEQ ID NO: 237314

SEQ ID NO: 1390269 - protein, 30 aa, Mycobacterium tuberculosis; identical to SEQ ID NO: 162901

SEQ ID NO: 1390270 - protein, 17 aa, Mycobacterium tuberculosis
LFRLFVGARLIDAAREQ

SEQ ID NO: 1390271 - protein, 19 aa, Mycobacterium tuberculosis
LGAIGIWIANRPDDNPKRN

SEQ ID NO: 1390272 - protein, 20 aa, Mycobacterium tuberculosis
LGGVWLTSFLLVATNTAIAS

SEQ ID NO: 1390273 - protein, 17 aa, Mycobacterium tuberculosis
LGLVLVTGLLIVALTFI

SEQ ID NO: 1390274 - protein, 43 aa, Mycobacterium tuberculosis
LGMWFDPATARRVAVWAFVMVLAFSRHLFVRPVIRMDQTAWCA

SEQ ID NO: 1390275 - protein, 25 aa, Mycobacterium tuberculosis
LGSTMGILTWIFVDGHFSKWLNFTP

SEQ ID NO: 1390276 - protein, 31 aa, Mycobacterium tuberculosis
LGVPGWVTQRLWWAVLLTVGFWGLLRVAEAL

SEQ ID NO: 1390277 - protein, 26 aa, Mycobacterium tuberculosis
LKVGKALYSVPWRLIGQRLHARTAGD

SEQ ID NO: 1390278 - protein, 17 aa, Mycobacterium tuberculosis
LLDKIFYRSGQGVTLQA

SEQ ID NO: 1390279 - protein, 36 aa, Mycobacterium tuberculosis
LLKWSIPGLAHFFTMWGFFILLTVYIEAYGLLFEER

SEQ ID NO: 1390280 - protein, 38 aa, Mycobacterium tuberculosis
LPGWRAMFVIEALAALLLAPLLRRLLPDNPQRASWLTP

SEQ ID NO: 1390281 - protein, 27 aa, Mycobacterium tuberculosis
LQAVEGVGLWLLKRWGEYFAVVATSIF

SEQ ID NO: 1390282 - protein, 20 aa, Mycobacterium tuberculosis
LQVRPYAGERWWVLLLSLAT

SEQ ID NO: 1390283 - protein, 32 aa, Mycobacterium tuberculosis; identical to SEQ ID NO: 164804

SEQ ID NO: 1390284 - protein, 26 aa, Mycobacterium tuberculosis
LSGIVPWWFVLTLLTRDALLAGTLPL

SEQ ID NO: 1390285 - protein, 21 aa, Mycobacterium tuberculosis
LTLNLWVGYFPTVQTAWNQLT

SEQ ID NO: 1390286 - protein, 17 aa, Mycobacterium tuberculosis
LTVAMKHIKEPPPPLPP

SEQ ID NO: 1390287 - protein, 26 aa, Mycobacterium tuberculosis
LVADGHPWRWFLIGFMVLFHLNILSN

SEQ ID NO: 1390288 - protein, 19 aa, Mycobacterium tuberculosis
LVALPLAGAAILLFGGRRT

SEQ ID NO: 1390289 - protein, 23 aa, Mycobacterium tuberculosis
LVASGVIMFIWSQQRRLIYFPSA

SEQ ID NO: 1390290 - protein, 18 aa, Mycobacterium tuberculosis
LVATGFVVFALYCGISRI

SEQ ID NO: 1390291 - protein, 18 aa, Mycobacterium tuberculosis
LWVGFTAVSALLILGLAQ

SEQ ID NO: 1390292 - protein, 18 aa, Mycobacterium tuberculosis
MPATAAFPPPAGPPPVTA

SEQ ID NO: 1390293 - protein, 17 aa, Mycobacterium tuberculosis
MWLGVHLVPISIGGRAL

SEQ ID NO: 1390294 - protein, 24 aa, Mycobacterium tuberculosis
NMCDRLLILAPGGRLAYFGPPQQA

SEQ ID NO: 1390295 - protein, 26 aa, Mycobacterium tuberculosis
NVQEDFAYHQFLIKKSKMPSQTPPEP

SEQ ID NO: 1390296 - protein, 23 aa, Mycobacterium tuberculosis
PAPTHRPLLVIPSRNLRDHDELV

SEQ ID NO: 1390297 - protein, 19 aa, Mycobacterium tuberculosis
PASFRRWLNPVNAAAATAL

SEQ ID NO: 1390298 - protein, 24 aa, Mycobacterium tuberculosis
PDDLLNALIDFLAAVRNGLVPIIE

SEQ ID NO: 1390299 - protein, 26 aa, Mycobacterium tuberculosis
PDLAAGLVCWLLLSREVLPRLGPAVA

SEQ ID NO: 1390300 - protein, 31 aa, Mycobacterium tuberculosis
PERTAMLLVPLYLVYVRLARPFIAFYNNCAN

SEQ ID NO: 1390301 - protein, 34 aa, Mycobacterium tuberculosis
PETTAPVWITMLWPLADRPRLAPGAPGGTVPVRL

SEQ ID NO: 1390302 - protein, 18 aa, Mycobacterium tuberculosis
PGSPLFPDLPSFPGFPGF

SEQ ID NO: 1390303 - protein, 23 aa, Mycobacterium tuberculosis
PGSPLFPDLPSFPGFPGFPSLPG

SEQ ID NO: 1390304 - protein, 23 aa, Mycobacterium tuberculosis
PPGSVDFFYLTASAAGIFGIPGQ

SEQ ID NO: 1390305 - protein, 26 aa, Mycobacterium tuberculosis
PPMGSILYWMRFGTIRLPPWPDRVPW

SEQ ID NO: 1390306 - protein, 32 aa, Mycobacterium tuberculosis
PPVFFARRPLQIALTLMWPAGIASLVYALLAA

SEQ ID NO: 1390307 - protein, 24 aa, Mycobacterium tuberculosis
PQAARRFSVLSLPTTLIFDVDGRQ

SEQ ID NO: 1390308 - protein, 27 aa, Mycobacterium tuberculosis
PRLVDIYVDWLWFGEVGFRSVWITVLL

SEQ ID NO: 1390309 - protein, 31 aa, Mycobacterium tuberculosis; identical to SEQ ID NO: 164862

SEQ ID NO: 1390310 - protein, 19 aa, Mycobacterium tuberculosis
PVAAQQFQFALPAGVASEE

SEQ ID NO: 1390311 - protein, 19 aa, Mycobacterium tuberculosis
PVLENLPAVLPTVVAPPLT

SEQ ID NO: 1390312 - protein, 20 aa, Mycobacterium tuberculosis
PYQPQLGVPTAWLVAPVEAG

SEQ ID NO: 1390313 - protein, 17 aa, Mycobacterium tuberculosis
QALGYFNCTDFADLFTL

SEQ ID NO: 1390314 - protein, 31 aa, Mycobacterium tuberculosis
QESDRGVSWLPFFHDMGLITVLLASVLGHSF

SEQ ID NO: 1390315 - protein, 17 aa, Mycobacterium tuberculosis
QLLHAFAGQGPTIGSLL

SEQ ID NO: 1390316 - protein, 20 aa, Mycobacterium tuberculosis
QPAWRNLRFPLAWAPPEADV

SEQ ID NO: 1390317 - protein, 30 aa, Mycobacterium tuberculosis
QTLTYTSVVLAFLAFMVALVAGADLGLTKL

SEQ ID NO: 1390318 - protein, 17 aa, Mycobacterium tuberculosis
RERYFYESFADREHFVR

SEQ ID NO: 1390319 - protein, 17 aa, Mycobacterium tuberculosis
RGRWLAIAASLVVSAAI

SEQ ID NO: 1390320 - protein, 18 aa, Mycobacterium tuberculosis
RIVRRSIMLVPRRGTRVR

SEQ ID NO: 1390321 - protein, 19 aa, Mycobacterium tuberculosis
RLLTVRRTLAWVRVESLQL

SEQ ID NO: 1390322 - protein, 17 aa, Mycobacterium tuberculosis
RLSRRARRRVAIALGVL

SEQ ID NO: 1390323 - protein, 19 aa, Mycobacterium tuberculosis
RPFIAFYNNCANAILRLVG

SEQ ID NO: 1390324 - protein, 18 aa, Mycobacterium tuberculosis
RRLALYGSDWITSTGRRF

SEQ ID NO: 1390325 - protein, 19 aa, Mycobacterium tuberculosis
RRLLPLLFVLYVINFVDRA

SEQ ID NO: 1390326 - protein, 31 aa, Mycobacterium tuberculosis
RRMEVLALPLVAVVLFFVFGGVIAAGLPVMV

SEQ ID NO: 1390327 - protein, 34 aa, Mycobacterium tuberculosis; identical to SEQ ID NO: 163591

SEQ ID NO: 1390328 - protein, 23 aa, Mycobacterium tuberculosis
RSRLVFGTLAILLCLVLGVAIVT

SEQ ID NO: 1390329 - protein, 22 aa, Mycobacterium tuberculosis
RTIQKFIVIGAFLGFFAMMVLS

SEQ ID NO: 1390330 - protein, 27 aa, Mycobacterium tuberculosis
RWDPYPFILLYLAFSTQASYAAPLILL

SEQ ID NO: 1390331 - protein, 17 aa, Mycobacterium tuberculosis
RWLAIAASLVVSAAILY

SEQ ID NO: 1390332 - protein, 24 aa, Mycobacterium tuberculosis
SAQLADLDQVWRLARGAGQRVAVI

SEQ ID NO: 1390333 - protein, 25 aa, Mycobacterium tuberculosis
SESQNFFIAPFMLLGLSSVLAVVAS

SEQ ID NO: 1390334 - protein, 31 aa, Mycobacterium tuberculosis
SGVRSLATGFFPLMGIGAFSMLAFSGRFGRA

SEQ ID NO: 1390335 - protein, 21 aa, Mycobacterium tuberculosis
SLQALILGFLGVALLPPPDQS

SEQ ID NO: 1390336 - protein, 33 aa, Mycobacterium tuberculosis
SRRFAVLVLLFCLFGVLFVLLRRGRVAGLASGP

SEQ ID NO: 1390337 - protein, 33 aa, Mycobacterium tuberculosis
SRRRHIVRLVVFAGFLVGMFYLVAATDVIDVAA

SEQ ID NO: 1390338 - protein, 21 aa, Mycobacterium tuberculosis
SSGVLLLWSWLVMSLAQGYYS

SEQ ID NO: 1390339 - protein, 31 aa, Mycobacterium tuberculosis
TAAVDRLYADRRIRLWVVYVENFSGQSALNW

SEQ ID NO: 1390340 - protein, 20 aa, Mycobacterium tuberculosis
TAIALLLMPVLGWANHRVGE

SEQ ID NO: 1390341 - protein, 25 aa, Mycobacterium tuberculosis
TDAGAQFFFFVAAALVVLLVGIEHT

SEQ ID NO: 1390342 - protein, 19 aa, Mycobacterium tuberculosis
TGRYLLVQTLLVLTWIVLN

SEQ ID NO: 1390343 - protein, 21 aa, Mycobacterium tuberculosis
TIGLGLLFDTLVVRAFMTPSI

SEQ ID NO: 1390344 - protein, 25 aa, Mycobacterium tuberculosis
TLAQLAPFVLLVELSRLLFSGAGAH

SEQ ID NO: 1390345 - protein, 17 aa, Mycobacterium tuberculosis
TMFFVLVTGIISAAQVF

SEQ ID NO: 1390346 - protein, 21 aa, Mycobacterium tuberculosis
TPDFPLPFTYPPFAAVVFYPL

SEQ ID NO: 1390347 - protein, 25 aa, Mycobacterium tuberculosis
TPEALFNPILMMALAALGIGSVSTL

SEQ ID NO: 1390348 - protein, 40 aa, Mycobacterium tuberculosis
TPSGPHPIIPRTIRLAAIPILLCWLGFTVFVSVAVPPLEA

SEQ ID NO: 1390349 - protein, 24 aa, Mycobacterium tuberculosis
TQPAPVVAAWLAVLLAVSVPAGPR

SEQ ID NO: 1390350 - protein, 34 aa, Mycobacterium tuberculosis
TQSPYPGGGPIPEKYYRTLDPFVALAAAAATTQS

SEQ ID NO: 1390351 - protein, 23 aa, Mycobacterium tuberculosis
TTPRSPGRWSLVAALALAVVSLG

SEQ ID NO: 1390352 - protein, 17 aa, Mycobacterium tuberculosis
TYPPFAAVVFYPLHLVP

SEQ ID NO: 1390353 - protein, 24 aa, Mycobacterium tuberculosis
VAATIGGVRFRWAPNRTASCRTSS

SEQ ID NO: 1390354 - protein, 23 aa, Mycobacterium tuberculosis
VAEMRKVIWPNRKQTLTYTSVVL

SEQ ID NO: 1390355 - protein, 17 aa, Mycobacterium tuberculosis
VAIALGVLVAAAGIVIA

SEQ ID NO: 1390356 - protein, 20 aa, Mycobacterium tuberculosis
VAVSFWLTAPYLVAESIRHL

SEQ ID NO: 1390357 - protein, 24 aa, Mycobacterium tuberculosis
VDGHFSKWLNFTPTPLTAPVIGLI

SEQ ID NO: 1390358 - protein, 36 aa, Mycobacterium tuberculosis
VFGGLPALAFPAPSWWWLAWFGLVPLLLVVRAAPTS

SEQ ID NO: 1390359 - protein, 20 aa, Mycobacterium tuberculosis
VGGLWAWIAPPIHAVVAITR

SEQ ID NO: 1390360 - protein, 17 aa, Mycobacterium tuberculosis
VGRWVAVVAVLAVLTVV

SEQ ID NO: 1390361 - protein, 41 aa, Mycobacterium tuberculosis
VPDSSGLPLRAMVMVLLFLGVVFLLLVWQALGSSPNSEDDS

SEQ ID NO: 1390362 - protein, 17 aa, Mycobacterium tuberculosis
VQTLLVLTWIVLNLFAV

SEQ ID NO: 1390363 - protein, 17 aa, Mycobacterium tuberculosis
VRHGFWRVLGIRLLTVL

SEQ ID NO: 1390364 - protein, 25 aa, Mycobacterium tuberculosis
VRKYLTLMAFRVPALILAAIAYGAW

SEQ ID NO: 1390365 - protein, 18 aa, Mycobacterium tuberculosis
VRLLRTFLRDVPNQVVLA

SEQ ID NO: 1390366 - protein, 36 aa, Mycobacterium tuberculosis
VVATPLTAKLAWFSKFLTIAILGLAALTFGVGLLRR

SEQ ID NO: 1390367 - protein, 25 aa, Mycobacterium tuberculosis
VVFYPLHLVPFGLIALLWQVVTMAA

SEQ ID NO: 1390368 - protein, 31 aa, Mycobacterium tuberculosis
VVIAALTLGLVLYRRRRISLSPRPERGVVDR

SEQ ID NO: 1390369 - protein, 27 aa, Mycobacterium tuberculosis
VVMLLAVTVSLLTIPFAAAAGTAVHDS

SEQ ID NO: 1390370 - protein, 17 aa, Mycobacterium tuberculosis
VVSIFLLRHVVSGRQLV

SEQ ID NO: 1390371 - protein, 17 aa, Mycobacterium tuberculosis
VVVSAVLGALFVPGPIL

SEQ ID NO: 1390372 - protein, 24 aa, Mycobacterium tuberculosis
VVYEPLLGRLPADTPMYGFERVEG

SEQ ID NO: 1390373 - protein, 18 aa, Mycobacterium tuberculosis
WHQVTVVSSPSWFSDYVL

SEQ ID NO: 1390374 - protein, 17 aa, Mycobacterium tuberculosis
WVGFTAVSALLILGLAQ

SEQ ID NO: 1390375 - protein, 24 aa, Mycobacterium tuberculosis
YAGERWWVLLLSLATAAVLTVLAY

SEQ ID NO: 1390376 - protein, 20 aa, Mycobacterium tuberculosis
YALPVLMVLTTVVVYQTVTG

SEQ ID NO: 1390377 - protein, 17 aa, Mycobacterium tuberculosis
YAYLAPWQLSAHRWYTW

SEQ ID NO: 1390378 - protein, 23 aa, Mycobacterium tuberculosis
YGRMRLGDFWGYLAGWGFVVGKT

SEQ ID NO: 1390379 - protein, 18 aa, Mycobacterium tuberculosis
YLAPWQLSAHRWYTWVIA

SEQ ID NO: 1390380 - protein, 17 aa, Mycobacterium tuberculosis
YVALPPLHDQWRPVLWA

SEQ ID NO: 1390381 - protein, 29 aa, Mycobacterium tuberculosis
AAGIVMFLGYIALFALVLYMHAGILTGCL

SEQ ID NO: 1390382 - protein, 19 aa, Mycobacterium tuberculosis
AAHLPYVAWLTQASADAAG

SEQ ID NO: 1390383 - protein, 23 aa, Mycobacterium tuberculosis
AALAVLVTVFTLIRDRTEPVMSA

SEQ ID NO: 1390384 - protein, 18 aa, Mycobacterium tuberculosis
AALAYAVDVKNAVIVAAA

SEQ ID NO: 1390385 - protein, 20 aa, Mycobacterium tuberculosis
AALRAGVAQRRRARRSLAAV

SEQ ID NO: 1390386 - protein, 22 aa, Mycobacterium tuberculosis
AALRAGVAQRRRARRSLAAVGS

SEQ ID NO: 1390387 - protein, 19 aa, Mycobacterium tuberculosis
AAMVGMLAAMVRLRHLIFK

SEQ ID NO: 1390388 - protein, 23 aa, Mycobacterium tuberculosis
AAVFFFLGCFTIVGTRQFAIMTT

SEQ ID NO: 1390389 - protein, 18 aa, Mycobacterium tuberculosis
AAVPLVPVRLLPPGLETR

SEQ ID NO: 1390390 - protein, 22 aa, Mycobacterium tuberculosis
AAYLITGGLGALGLLMADWLAD

SEQ ID NO: 1390391 - protein, 30 aa, Mycobacterium tuberculosis
ADGAVFLLVSVLLLVLVRPAVRRRLTQTKG

SEQ ID NO: 1390392 - protein, 25 aa, Mycobacterium tuberculosis
AEPAHPRRWFISTTPGRIMTIGIVL

SEQ ID NO: 1390393 - protein, 35 aa, Mycobacterium tuberculosis
AFYLFSCRSLTRSAWRLGMFANRWIILGVSAQAIA

SEQ ID NO: 1390394 - protein, 27 aa, Mycobacterium tuberculosis
AGIVMFLGYIALFALVLYMHAGILTGC

SEQ ID NO: 1390395 - protein, 25 aa, Mycobacterium tuberculosis
AGLIGRLDGRVVRLGRPGWLDAAEL

SEQ ID NO: 1390396 - protein, 22 aa, Mycobacterium tuberculosis
AGPLPYIVMEYVDGVTLRDIVH

SEQ ID NO: 1390397 - protein, 18 aa, Mycobacterium tuberculosis
AGTALVSYPLPQSPIVRI

SEQ ID NO: 1390398 - protein, 26 aa, Mycobacterium tuberculosis
AGVNAEYWYRSIRQPVQFARAVRNAF

SEQ ID NO: 1390399 - protein, 18 aa, Mycobacterium tuberculosis
AHVVKLLNWFFAIVVNEV

SEQ ID NO: 1390400 - protein, 23 aa, Mycobacterium tuberculosis
AKHAVFDRLVYRKLRAALGGNCR

SEQ ID NO: 1390401 - protein, 22 aa, Mycobacterium tuberculosis
ALGIMRFLAIFGPVHYFAQPVV

SEQ ID NO: 1390402 - protein, 19 aa, Mycobacterium tuberculosis
ALRSRLLVRLGGAGGMVSL

SEQ ID NO: 1390403 - protein, 18 aa, Mycobacterium tuberculosis
ALVAIGAGLIFPRFEQLL

SEQ ID NO: 1390404 - protein, 38 aa, Mycobacterium tuberculosis
ALVERRPSRLRRGWLVGIAATLLALAGGLGAAGYFALR

SEQ ID NO: 1390405 - protein, 20 aa, Mycobacterium tuberculosis
AMGPMQFISETWRLYGVAAR

SEQ ID NO: 1390406 - protein, 21 aa, Mycobacterium tuberculosis
AMPATAAFPPPAGPPPVTAAP

SEQ ID NO: 1390407 - protein, 25 aa, Mycobacterium tuberculosis
AQVLDWFISFVSGPVFTFLAYLVLD

SEQ ID NO: 1390408 - protein, 34 aa, Mycobacterium tuberculosis
ARAYHPTLLRKGERLLVFLPLAHVLARAISMAAF

SEQ ID NO: 1390409 - protein, 31 aa, Mycobacterium tuberculosis; identical to SEQ ID NO: 21911

SEQ ID NO: 1390410 - protein, 27 aa, Mycobacterium tuberculosis
ASVSSWLLAWPMWADGAVFLLVSVLLL

SEQ ID NO: 1390411 - protein, 20 aa, Mycobacterium tuberculosis
ATAWLMRRSLQFGALTAEEL

SEQ ID NO: 1390412 - protein, 19 aa, Mycobacterium tuberculosis
AVAALTWQLPAEPGGGAAP

SEQ ID NO: 1390413 - protein, 23 aa, Mycobacterium tuberculosis
AVAALWALLLAYSASRRFFALRR

SEQ ID NO: 1390414 - protein, 19 aa, Mycobacterium tuberculosis
AVNPWQWLLALLQQLWNAY

SEQ ID NO: 1390415 - protein, 34 aa, Mycobacterium tuberculosis
AVTVLLFPVVQPWYLLWAIIPLAAWATRPGFRVA

SEQ ID NO: 1390416 - protein, 19 aa, Mycobacterium tuberculosis
AVVVLLKGKVWTGLLGMFV

SEQ ID NO: 1390417 - protein, 17 aa, Mycobacterium tuberculosis
AWFFALTDQVSIAEAEE

SEQ ID NO: 1390418 - protein, 20 aa, Mycobacterium tuberculosis
DAIMFEPRYAVRQPDGGWGE

SEQ ID NO: 1390419 - protein, 25 aa, Mycobacterium tuberculosis
DASMALTMALLAAAVLYASVAVADE

SEQ ID NO: 1390420 - protein, 20 aa, Mycobacterium tuberculosis
DDCWWAPRWARRLQTRIGLG

SEQ ID NO: 1390421 - protein, 17 aa, Mycobacterium tuberculosis
DIGVWVRIFAVTTAITI

SEQ ID NO: 1390422 - protein, 34 aa, Mycobacterium tuberculosis
DKYQALVRQGMYGDFFAFYLCDVVLKVNGKGGQP

SEQ ID NO: 1390423 - protein, 18 aa, Mycobacterium tuberculosis
DPAPVAVPVPRRSTPGPS

SEQ ID NO: 1390424 - protein, 17 aa, Mycobacterium tuberculosis
DQLGGRRRPPGPPGPPG

SEQ ID NO: 1390425 - protein, 20 aa, Mycobacterium tuberculosis
DRLVYLSYGLAVILGFIGVK

SEQ ID NO: 1390426 - protein, 23 aa, Mycobacterium tuberculosis
DSGLRPRYPAIEIYRVSAPANPG

SEQ ID NO: 1390427 - protein, 22 aa, Mycobacterium tuberculosis
DSRPRLILGASLIGLSFLGLCH

SEQ ID NO: 1390428 - protein, 25 aa, Mycobacterium tuberculosis
DVLQAYLNIIYFGRGAYGISAASKA

SEQ ID NO: 1390429 - protein, 21 aa, Mycobacterium tuberculosis
EHAHKLVFAVLRGVAAVAPVR

SEQ ID NO: 1390430 - protein, 19 aa, Mycobacterium tuberculosis
ELAPLLRHPLDLELDSISV

SEQ ID NO: 1390431 - protein, 23 aa, Mycobacterium tuberculosis
ELDAPDFRYFITGGAPMPEALIK

SEQ ID NO: 1390432 - protein, 17 aa, Mycobacterium tuberculosis
EMKLVANSLIKDGKIVH

SEQ ID NO: 1390433 - protein, 23 aa, Mycobacterium tuberculosis
ENFSRRFVPTSFIVSAIALLITG

SEQ ID NO: 1390434 - protein, 19 aa, Mycobacterium tuberculosis
EPYPEQRPPWGVPPPGWDG

SEQ ID NO: 1390435 - protein, 26 aa, Mycobacterium tuberculosis
ETERIWLPFTIWLTAAPALLPPRSHR

SEQ ID NO: 1390436 - protein, 25 aa, Mycobacterium tuberculosis
EVENPKCHLAWTTLAGIGRVESHHG

SEQ ID NO: 1390437 - protein, 21 aa, Mycobacterium tuberculosis
EVLAYAWLMPVSTVVQAMIGG

SEQ ID NO: 1390438 - protein, 25 aa, Mycobacterium tuberculosis
EWMPNFIELLQRKLSRIVDPVLQKL

SEQ ID NO: 1390439 - protein, 21 aa, Mycobacterium tuberculosis
EYLVDAVFNYPTFSEAYKNAA

SEQ ID NO: 1390440 - protein, 23 aa, Mycobacterium tuberculosis
FARALRLRLLSKLSRLPLGWFTS

SEQ ID NO: 1390441 - protein, 33 aa, Mycobacterium tuberculosis
FATLIRTPALYAWILVLPIGLMLQQSSLRVGAL

SEQ ID NO: 1390442 - protein, 27 aa, Mycobacterium tuberculosis
FERVITALLLVIAIGFTASFFVVTPPP

SEQ ID NO: 1390443 - protein, 39 aa, Mycobacterium tuberculosis; identical to SEQ ID NO: 1379445

SEQ ID NO: 1390444 - protein, 17 aa, Mycobacterium tuberculosis
FGAAMVGMLAAMVRLRH

SEQ ID NO: 1390445 - protein, 17 aa, Mycobacterium tuberculosis
FHLRDLAVTFRFGEEVT

SEQ ID NO: 1390446 - protein, 19 aa, Mycobacterium tuberculosis
FLLALAAIPGALLPQRGLN

SEQ ID NO: 1390447 - protein, 26 aa, Mycobacterium tuberculosis
FLLLPILVVVWLSLHRWDLLGPLRYV

SEQ ID NO: 1390448 - protein, 17 aa, Mycobacterium tuberculosis
FMLVWLINHHGWSVAQA

SEQ ID NO: 1390449 - protein, 18 aa, Mycobacterium tuberculosis
FPAIVKFLSEQVLSRATE

SEQ ID NO: 1390450 - protein, 20 aa, Mycobacterium tuberculosis
FPNAILWLHYYAASYEFGFV

SEQ ID NO: 1390451 - protein, 19 aa, Mycobacterium tuberculosis
FPQMLLNLEPFAHIPRVGG

SEQ ID NO: 1390452 - protein, 21 aa, Mycobacterium tuberculosis
FPSWVLYPCALAMMVFSKSFS

SEQ ID NO: 1390453 - protein, 21 aa, Mycobacterium tuberculosis
FSMPGPWVGIAAPGENIASVS

SEQ ID NO: 1390454 - protein, 28 aa, Mycobacterium tuberculosis
FTSDIKNLLPMLAVFKPTVVVSVPRVFE

SEQ ID NO: 1390455 - protein, 20 aa, Mycobacterium tuberculosis
FTVVPQWILALIALTVVLSM

SEQ ID NO: 1390456 - protein, 26 aa, Mycobacterium tuberculosis
FVSEDKFFIIGRIKDLLIVYGRNHSP

SEQ ID NO: 1390457 - protein, 24 aa, Mycobacterium tuberculosis
GALGIMRFLAIFGPVHYFAQPVVS

SEQ ID NO: 1390458 - protein, 21 aa, Mycobacterium tuberculosis
GALLALTRAILIRVRNASWQH

SEQ ID NO: 1390459 - protein, 20 aa, Mycobacterium tuberculosis
GALWLLYRYYRTGDPLFWFT

SEQ ID NO: 1390460 - protein, 17 aa, Mycobacterium tuberculosis
GAWPWAVLLVVLVVGAF

SEQ ID NO: 1390461 - protein, 33 aa, Mycobacterium tuberculosis
GCLLWGLVTALLAAWGWFTSLLVITGTIAVTQA

SEQ ID NO: 1390462 - protein, 27 aa, Mycobacterium tuberculosis
GDACVWWGLWLITINDWAPLATVGSPL

SEQ ID NO: 1390463 - protein, 24 aa, Mycobacterium tuberculosis
GDKLDITALLPTSPAQRYLQAYYT

SEQ ID NO: 1390464 - protein, 18 aa, Mycobacterium tuberculosis
GEFLVAVIELIPRPFTPT

SEQ ID NO: 1390465 - protein, 21 aa, Mycobacterium tuberculosis
GELAVFVFFGPVAVLGTQYTQ

SEQ ID NO: 1390466 - protein, 18 aa, Mycobacterium tuberculosis
GFNPLDPRNLDVSPLPSL

SEQ ID NO: 1390467 - protein, 17 aa, Mycobacterium tuberculosis
GGLALAYFLTMSSVALG

SEQ ID NO: 1390468 - protein, 29 aa, Mycobacterium tuberculosis
GKLDRTLLLWMLPLLIAPPMYSKDVYSYL

SEQ ID NO: 1390469 - protein, 17 aa, Mycobacterium tuberculosis
GLLGAALQRLPGRSWPV

SEQ ID NO: 1390470 - protein, 23 aa, Mycobacterium tuberculosis
GLRDRVTAYAPLLLTAQNVIDAS

SEQ ID NO: 1390471 - protein, 28 aa, Mycobacterium tuberculosis
GMVAATLALIVIPLMFGADLRPVLLHAM

SEQ ID NO: 1390472 - protein, 24 aa, Mycobacterium tuberculosis
GMVILPPFVYFITYRWCIGLQRSD

SEQ ID NO: 1390473 - protein, 25 aa, Mycobacterium tuberculosis
GNTVLTLVLAFAAGALLWLVVEELL

SEQ ID NO: 1390474 - protein, 31 aa, Mycobacterium tuberculosis
GPMLVLLAAGLGVLWLPAGWLAHRLLSVPVT

SEQ ID NO: 1390475 - protein, 24 aa, Mycobacterium tuberculosis
GPTIAWYQDFLRYYFLTVESNVEG

SEQ ID NO: 1390476 - protein, 21 aa, Mycobacterium tuberculosis
GRIMTIGIVLAALGVASAFAT

SEQ ID NO: 1390477 - protein, 18 aa, Mycobacterium tuberculosis
GRKPIFLVGFAVLTARGF

SEQ ID NO: 1390478 - protein, 24 aa, Mycobacterium tuberculosis
GSEPDFLRVWLPGQLLQGIGVGAT

SEQ ID NO: 1390479 - protein, 35 aa, Mycobacterium tuberculosis
GVLLRIVSGLSIFRLLRYLAREYLLIFATSSSEVV

SEQ ID NO: 1390480 - protein, 25 aa, Mycobacterium tuberculosis
GVQTGLLWPAIFVAAFAALGLAVAL

SEQ ID NO: 1390481 - protein, 19 aa, Mycobacterium tuberculosis
GVRMWLFPGLSIVTVTGIV

SEQ ID NO: 1390482 - protein, 23 aa, Mycobacterium tuberculosis
GYEFRLLQIKFATLNITGDCFLL

SEQ ID NO: 1390483 - protein, 24 aa, Mycobacterium tuberculosis
HPVQLRHTVLVPGPPPGSAIAGWD

SEQ ID NO: 1390484 - protein, 25 aa, Mycobacterium tuberculosis
HVERFFAESWARLTAGRTARVVLLD

SEQ ID NO: 1390485 - protein, 17 aa, Mycobacterium tuberculosis
IADAMGHRLTWGEQIAL

SEQ ID NO: 1390486 - protein, 24 aa, Mycobacterium tuberculosis
IAWCALFPIIWALSGSLKADGEVT

SEQ ID NO: 1390487 - protein, 26 aa, Mycobacterium tuberculosis
ICVASMLIAHAMVRPIRRLEVGTQKI

SEQ ID NO: 1390488 - protein, 17 aa, Mycobacterium tuberculosis
IDDFVRPLRSYFYWEHH

SEQ ID NO: 1390489 - protein, 25 aa, Mycobacterium tuberculosis
IESEARRMTLLVDELLLLSRLSEGE

SEQ ID NO: 1390490 - protein, 17 aa, Mycobacterium tuberculosis
IFALVVFVTGLPLAYYA

SEQ ID NO: 1390491 - protein, 30 aa, Mycobacterium tuberculosis
IFSATRYEWAILDFAILAVGAVTVPIYETS

SEQ ID NO: 1390492 - protein, 23 aa, Mycobacterium tuberculosis
IGATAMLLASSCTWQLSLFITDG

SEQ ID NO: 1390493 - protein, 17 aa, Mycobacterium tuberculosis
IGGSKTLWRAVSVRASD

SEQ ID NO: 1390494 - protein, 28 aa, Mycobacterium tuberculosis
IIGNLLQMAFRFWAFRRWVFPDEFARNP

SEQ ID NO: 1390495 - protein, 20 aa, Mycobacterium tuberculosis
IIVILLIALTYTRLPWRPLA

SEQ ID NO: 1390496 - protein, 32 aa, Mycobacterium tuberculosis
IKVGSLSPWHWAILAVVVIVLFGAKKLPDAAR

SEQ ID NO: 1390497 - protein, 17 aa, Mycobacterium tuberculosis
ILNTRNVFGPPAWAPVV

SEQ ID NO: 1390498 - protein, 23 aa, Mycobacterium tuberculosis
INIGFYMLMPYLADYLAGPLGLA

SEQ ID NO: 1390499 - protein, 18 aa, Mycobacterium tuberculosis
IPARGIVAVCDFGGSGTG

SEQ ID NO: 1390500 - protein, 24 aa, Mycobacterium tuberculosis
ITQAPLNALWQLTKAMRAELSDPL

SEQ ID NO: 1390501 - protein, 17 aa, Mycobacterium tuberculosis
IYVTSQVYEAMRDVWQF

SEQ ID NO: 1390502 - protein, 18 aa, Mycobacterium tuberculosis
KHLHIFLAPINVTFKRLP

SEQ ID NO: 1390503 - protein, 21 aa, Mycobacterium tuberculosis
KHRGELVYLPPAWFDREHRSE

SEQ ID NO: 1390504 - protein, 24 aa, Mycobacterium tuberculosis
KKLTAAGFGLFKQANSPSTPELVG

SEQ ID NO: 1390505 - protein, 30 aa, Mycobacterium tuberculosis; identical to SEQ ID NO: 162810

SEQ ID NO: 1390506 - protein, 31 aa, Mycobacterium tuberculosis
KMQFGEGWWTSGWFLSFWVTGTSILLVSGIP

SEQ ID NO: 1390507 - protein, 21 aa, Mycobacterium tuberculosis
LAAYLIPALPHHPHRFDWFGV

SEQ ID NO: 1390508 - protein, 23 aa, Mycobacterium tuberculosis
LDATVVRMFLVPSVMKLLGDDCW

SEQ ID NO: 1390509 - protein, 20 aa, Mycobacterium tuberculosis
LDRVRVVVIDGAALRGDNRA

SEQ ID NO: 1390510 - protein, 18 aa, Mycobacterium tuberculosis
LEPNLTYRIALRTTSSHE

SEQ ID NO: 1390511 - protein, 18 aa, Mycobacterium tuberculosis
LERYDETLFLVLKTVNYV

SEQ ID NO: 1390512 - protein, 17 aa, Mycobacterium tuberculosis
LFGWGIAVTLGVVCGLI

SEQ ID NO: 1390513 - protein, 18 aa, Mycobacterium tuberculosis
LGAMVLPFLLGFRLTCYY

SEQ ID NO: 1390514 - protein, 17 aa, Mycobacterium tuberculosis
LGASLIGLSFLGLCHLW

SEQ ID NO: 1390515 - protein, 17 aa, Mycobacterium tuberculosis
LGGIIIGDLLSGGTRGG

SEQ ID NO: 1390516 - protein, 19 aa, Mycobacterium tuberculosis
LGGVWLTSFLLVATNTAIA

SEQ ID NO: 1390517 - protein, 26 aa, Mycobacterium tuberculosis
LGVSLAVCLLTAFLLIAVFGEVRFGD

SEQ ID NO: 1390518 - protein, 27 aa, Mycobacterium tuberculosis
LHDELFDACGWRRLIFATPEELEAALG

SEQ ID NO: 1390519 - protein, 21 aa, Mycobacterium tuberculosis
LLAVTVSLLTIPFAAAAGTAV

SEQ ID NO: 1390520 - protein, 17 aa, Mycobacterium tuberculosis
LLPLLNRQWRALVAAVV

SEQ ID NO: 1390521 - protein, 25 aa, Mycobacterium tuberculosis
LLTTTIVLMFLAFGSVVLPIKATLM

SEQ ID NO: 1390522 - protein, 17 aa, Mycobacterium tuberculosis
LLVDFKGGATFLDLAGA

SEQ ID NO: 1390523 - protein, 17 aa, Mycobacterium tuberculosis
LPDGLGPLLPLEADGKP

SEQ ID NO: 1390524 - protein, 22 aa, Mycobacterium tuberculosis
LPLLCCLVAFVLTFLVTRSFVR

SEQ ID NO: 1390525 - protein, 25 aa, Mycobacterium tuberculosis
LPVLGVWVIFSPWVLPGVAVTAGMM

SEQ ID NO: 1390526 - protein, 27 aa, Mycobacterium tuberculosis
LQTTHAMLRSLFRVGLDPRNVAVIGKC

SEQ ID NO: 1390527 - protein, 24 aa, Mycobacterium tuberculosis
LRADLARDPSFYLRFRREAQNAAA

SEQ ID NO: 1390528 - protein, 20 aa, Mycobacterium tuberculosis
LRATLFVIALGFLVQITGIN

SEQ ID NO: 1390529 - protein, 29 aa, Mycobacterium tuberculosis
LSALIHLPNLPPAGLLPIAAALGPGDQWG

SEQ ID NO: 1390530 - protein, 22 aa, Mycobacterium tuberculosis
LSEQLLHAFAGQGPTIGSLLAQ

SEQ ID NO: 1390531 - protein, 30 aa, Mycobacterium tuberculosis
LSQLQLWTTPLWLILMAAPFGYLVVSHPDS

SEQ ID NO: 1390532 - protein, 19 aa, Mycobacterium tuberculosis
LTFAPNSLYRASLAIGLAL

SEQ ID NO: 1390533 - protein, 17 aa, Mycobacterium tuberculosis
LTLYPHCAPKIGVPSQN

SEQ ID NO: 1390534 - protein, 28 aa, Mycobacterium tuberculosis
LVALIALFPPYIMWAPNAIWKAFDLLVG

SEQ ID NO: 1390535 - protein, 17 aa, Mycobacterium tuberculosis
LVFTDRVELLKLAVLLA

SEQ ID NO: 1390536 - protein, 29 aa, Mycobacterium tuberculosis
LVGWPTWGMILSSPFLLPAGLGLGLAAIA

SEQ ID NO: 1390537 - protein, 26 aa, Mycobacterium tuberculosis
LVLIKWWLLAIPHYLILAVFLSSGWR

SEQ ID NO: 1390538 - protein, 18 aa, Mycobacterium tuberculosis
LVQLLGRINAELAVYTGL

SEQ ID NO: 1390539 - protein, 17 aa, Mycobacterium tuberculosis
LWGIFVLAPKLEPITRF

SEQ ID NO: 1390540 - protein, 21 aa, Mycobacterium tuberculosis
MAPFGYLPFAPSRYLFISINT

SEQ ID NO: 1390541 - protein, 17 aa, Mycobacterium tuberculosis
MSEVHLARDLRLHRDVA

SEQ ID NO: 1390542 - protein, 25 aa, Mycobacterium tuberculosis
NGERLTLAMVFLLAIAGAFVVSKTV

SEQ ID NO: 1390543 - protein, 17 aa, Mycobacterium tuberculosis
NPSWRPGAWACRLVVVA

SEQ ID NO: 1390544 - protein, 17 aa, Mycobacterium tuberculosis
NQAWILPVGLPGDLGST

SEQ ID NO: 1390545 - protein, 26 aa, Mycobacterium tuberculosis
PAPALLLTAPLLLTSIPLLYAGRSVI

SEQ ID NO: 1390546 - protein, 21 aa, Mycobacterium tuberculosis
PASVPVWLVWHIPGGTVWAEE

SEQ ID NO: 1390547 - protein, 25 aa, Mycobacterium tuberculosis
PCAVVLATMPPLLAAIANAGRHGVL

SEQ ID NO: 1390548 - protein, 23 aa, Mycobacterium tuberculosis
PDIDPEILPHLFDRFVRASKSRS

SEQ ID NO: 1390549 - protein, 39 aa, Mycobacterium tuberculosis
PDPTKLILQLLKDFLELLRYLAVELLPGPLGDLIAQVLD

SEQ ID NO: 1390550 - protein, 27 aa, Mycobacterium tuberculosis
PEPKSPPIPWYRLPAVIITGTTVAVLL

SEQ ID NO: 1390551 - protein, 34 aa, Mycobacterium tuberculosis
PFIARMIHAFAVPIILGWLAVCVVVTVFVPSLEA

SEQ ID NO: 1390552 - protein, 33 aa, Mycobacterium tuberculosis
PILGGWLIGAYGWRWIFLVNLPVGLSALVLAAI

SEQ ID NO: 1390553 - protein, 25 aa, Mycobacterium tuberculosis
PLLGPLLLLPLLNRQWRALVAAVVV

SEQ ID NO: 1390554 - protein, 20 aa, Mycobacterium tuberculosis
PMLRILVRRHRLVGTLPLVS

SEQ ID NO: 1390555 - protein, 23 aa, Mycobacterium tuberculosis
PPRGVWYLGPLPVRAYAVCVITG

SEQ ID NO: 1390556 - protein, 21 aa, Mycobacterium tuberculosis
PPTMPTVTPPPIQAAPTGQPS

SEQ ID NO: 1390557 - protein, 28 aa, Mycobacterium tuberculosis
PRDRDTWMVIDDKAWFFALTDQVSIAEA

SEQ ID NO: 1390558 - protein, 28 aa, Mycobacterium tuberculosis
PSIAALLGKWFWWPQVVRQRPIPQPWPS

SEQ ID NO: 1390559 - protein, 18 aa, Mycobacterium tuberculosis
PSRAIYGLFANPDKLKQA

SEQ ID NO: 1390560 - protein, 22 aa, Mycobacterium tuberculosis
PTLTLTLPRPTVVTGLRLAASR

SEQ ID NO: 1390561 - protein, 25 aa, Mycobacterium tuberculosis
PTLTLTLPRPTVVTGLRLAASRSML

SEQ ID NO: 1390562 - protein, 18 aa, Mycobacterium tuberculosis
PVMWALSASLGWILPVIA

SEQ ID NO: 1390563 - protein, 22 aa, Mycobacterium tuberculosis
PVTRRAVLTLYPHCAPKIGVPS

SEQ ID NO: 1390564 - protein, 18 aa, Mycobacterium tuberculosis
QAHLLYRWVRHPIMLGFV

SEQ ID NO: 1390565 - protein, 17 aa, Mycobacterium tuberculosis
QDYANIPPTRFKRKEHW

SEQ ID NO: 1390566 - protein, 17 aa, Mycobacterium tuberculosis
QFSVRLLRTFLRDVPNQ

SEQ ID NO: 1390567 - protein, 20 aa, Mycobacterium tuberculosis
QGVLALPLPIDKINKIMTAD

SEQ ID NO: 1390568 - protein, 17 aa, Mycobacterium tuberculosis
QIDHFWWTAIWAAILLS

SEQ ID NO: 1390569 - protein, 26 aa, Mycobacterium tuberculosis
QTTHAMLRSLFRVGLDPRNVAVIGKC

SEQ ID NO: 1390570 - protein, 18 aa, Mycobacterium tuberculosis
QWLLALLQQLWNAYTGFY

SEQ ID NO: 1390571 - protein, 21 aa, Mycobacterium tuberculosis
RARRIVVANLIVAVTFIAGLV

SEQ ID NO: 1390572 - protein, 25 aa, Mycobacterium tuberculosis
RASAAILAILPLLGVLLGQLIGARP

SEQ ID NO: 1390573 - protein, 24 aa, Mycobacterium tuberculosis
RATKRRYRFARGLMAGLLGTMALT

SEQ ID NO: 1390574 - protein, 17 aa, Mycobacterium tuberculosis
RCSVLVSLLTDASGQRG

SEQ ID NO: 1390575 - protein, 19 aa, Mycobacterium tuberculosis
RERLRDRVTVGLAAGGLIL

SEQ ID NO: 1390576 - protein, 25 aa, Mycobacterium tuberculosis
RFALKRGALMFGKLVPMGIGAIIGA

SEQ ID NO: 1390577 - protein, 22 aa, Mycobacterium tuberculosis
RGAQLGIFLKGYKSLEATRAVD

SEQ ID NO: 1390578 - protein, 17 aa, Mycobacterium tuberculosis
RIVRRSIMLVPRRGTRV

SEQ ID NO: 1390579 - protein, 19 aa, Mycobacterium tuberculosis
RKRWDRYAAFAEKTFNVTI

SEQ ID NO: 1390580 - protein, 17 aa, Mycobacterium tuberculosis
RLTCYYYRKAYYRSVWQ

SEQ ID NO: 1390581 - protein, 24 aa, Mycobacterium tuberculosis
RLVLTGRTPLPPRRDWQLDTLDTE

SEQ ID NO: 1390582 - protein, 23 aa, Mycobacterium tuberculosis
RMMTPLLLVMIAVGGTNILFAFD

SEQ ID NO: 1390583 - protein, 38 aa, Mycobacterium tuberculosis
RMSTILHGVWILLFASLFTNLVELIPKAALAGLLIVIG

SEQ ID NO: 1390584 - protein, 33 aa, Mycobacterium tuberculosis; identical to SEQ ID NO: 163564

SEQ ID NO: 1390585 - protein, 33 aa, Mycobacterium tuberculosis; identical to SEQ ID NO: 164505

SEQ ID NO: 1390586 - protein, 27 aa, Mycobacterium tuberculosis
RREHISLRPLWGIDQRLKRFGAMAAAM

SEQ ID NO: 1390587 - protein, 27 aa, Mycobacterium tuberculosis
RRLRQRPFQYILLVLGIALGVAMIVAI

SEQ ID NO: 1390588 - protein, 28 aa, Mycobacterium tuberculosis
RSFTGAGIWLGIAAFAAAGVVAVLAWTD

SEQ ID NO: 1390589 - protein, 26 aa, Mycobacterium tuberculosis
SAAGYLIIDRIFFRALQAGWASVIVS

SEQ ID NO: 1390590 - protein, 23 aa, Mycobacterium tuberculosis
SAAILAILPLLGVLLGQLIGARP

SEQ ID NO: 1390591 - protein, 24 aa, Mycobacterium tuberculosis
SASGLGFAIPVNEMKLVANSLIKD

SEQ ID NO: 1390592 - protein, 20 aa, Mycobacterium tuberculosis
SAWHYFPRHRFLFGDKYDSV

SEQ ID NO: 1390593 - protein, 20 aa, Mycobacterium tuberculosis
SAWRFVTVFGVVGLLADVVY

SEQ ID NO: 1390594 - protein, 23 aa, Mycobacterium tuberculosis
SEVLGQRRLLKWSIPGLAHFFTM

SEQ ID NO: 1390595 - protein, 27 aa, Mycobacterium tuberculosis
SFSNKPRVFIFYLGAAIFIISSSAAGY

SEQ ID NO: 1390596 - protein, 25 aa, Mycobacterium tuberculosis
SGRPPLEQLSWLSPSRWAYAMAAAT

SEQ ID NO: 1390597 - protein, 24 aa, Mycobacterium tuberculosis
SIGAPPIVIGPLYAEKTIQLCAPG

SEQ ID NO: 1390598 - protein, 22 aa, Mycobacterium tuberculosis
SLGLFGSFLLLPSYLQQVLHQS

SEQ ID NO: 1390599 - protein, 18 aa, Mycobacterium tuberculosis
SLYPPCLFKLLTGWNCPA

SEQ ID NO: 1390600 - protein, 56 aa, Mycobacterium tuberculosis
SLYRASLAIGLALLPLLALLAFWRTGRRQLADRPTPPWRPGAWAAAGVLAAGAVIA

SEQ ID NO: 1390601 - protein, 18 aa, Mycobacterium tuberculosis
SMHELLRPGVLLMSASSS

SEQ ID NO: 1390602 - protein, 25 aa, Mycobacterium tuberculosis
SMTPSLLPRGPLFQGLVSGICGAFG

SEQ ID NO: 1390603 - protein, 25 aa, Mycobacterium tuberculosis
SPPSHLWQARLAPDAKPYQGGHRFH

SEQ ID NO: 1390604 - protein, 18 aa, Mycobacterium tuberculosis
SRLYAWVTTLYLVGSVVA

SEQ ID NO: 1390605 - protein, 26 aa, Mycobacterium tuberculosis
SRRNLTLYVTALLFVLAWATSGINGW

SEQ ID NO: 1390606 - protein, 25 aa, Mycobacterium tuberculosis
SVGVPLYLLLGWVAVWYTATILHNA

SEQ ID NO: 1390607 - protein, 21 aa, Mycobacterium tuberculosis
SVTILLAVALVFDLPAALQRA

SEQ ID NO: 1390608 - protein, 20 aa, Mycobacterium tuberculosis
SVVGLVHTPGLVTLAPGARI

SEQ ID NO: 1390609 - protein, 19 aa, Mycobacterium tuberculosis
SWHMYPVGFLFGLGFDTAT

SEQ ID NO: 1390610 - protein, 21 aa, Mycobacterium tuberculosis
SYGMLKLLVSTEDLKLLGVHI

SEQ ID NO: 1390611 - protein, 22 aa, Mycobacterium tuberculosis
TGFYGWMLQLIWQFLQDPIGNS

SEQ ID NO: 1390612 - protein, 25 aa, Mycobacterium tuberculosis
TIAHFTFGLALLAGLYVAASPWIVG

SEQ ID NO: 1390613 - protein, 33 aa, Mycobacterium tuberculosis
TIGILIAVFGMRLVFPLAIIWTTAGLDPVRAME

SEQ ID NO: 1390614 - protein, 25 aa, Mycobacterium tuberculosis
TLAGCLPAVIWWACHRPNRLWWRYT

SEQ ID NO: 1390615 - protein, 21 aa, Mycobacterium tuberculosis
TLAVVFLAGWRWFPRDVHTAG

SEQ ID NO: 1390616 - protein, 19 aa, Mycobacterium tuberculosis
TLFGMLSVAFMHSIGAPPI

SEQ ID NO: 1390617 - protein, 28 aa, Mycobacterium tuberculosis
TLIGGFLLMWIMSWLTAAPVRVVRAALK

SEQ ID NO: 1390618 - protein, 20 aa, Mycobacterium tuberculosis
TLIIFPLVVYGMKVLSQLQL

SEQ ID NO: 1390619 - protein, 29 aa, Mycobacterium tuberculosis
TLSRVANLELYLIFPLASEQATITLVRGT

SEQ ID NO: 1390620 - protein, 19 aa, Mycobacterium tuberculosis
TRFWLNSLLVLSMLFTLML

SEQ ID NO: 1390621 - protein, 28 aa, Mycobacterium tuberculosis
TRLRRPIVVWWIVWIVSNAISMFAFATS

SEQ ID NO: 1390622 - protein, 33 aa, Mycobacterium tuberculosis
TTALLLHIGVMLAFLILVLHSKHLHIFLAPINV

SEQ ID NO: 1390623 - protein, 22 aa, Mycobacterium tuberculosis
TTSTVLPFTGLNTPLAVAVDSD

SEQ ID NO: 1390624 - protein, 19 aa, Mycobacterium tuberculosis
TVLAYRWGGNLRALLLAAA

SEQ ID NO: 1390625 - protein, 20 aa, Mycobacterium tuberculosis
TVLAYRWGGNLRALLLAAAV

SEQ ID NO: 1390626 - protein, 26 aa, Mycobacterium tuberculosis
TVVWVTSAYLLAYAVPMLVAGRLGDR

SEQ ID NO: 1390627 - protein, 25 aa, Mycobacterium tuberculosis
VAALRAGVAQRRRARRSLAAVGSVA

SEQ ID NO: 1390628 - protein, 19 aa, Mycobacterium tuberculosis
VAFMHSIGAPPIVIGPLYA

SEQ ID NO: 1390629 - protein, 18 aa, Mycobacterium tuberculosis
VALPILPTQILWINMTTA

SEQ ID NO: 1390630 - protein, 19 aa, Mycobacterium tuberculosis
VASFSRALVLVTVGIIVVI

SEQ ID NO: 1390631 - protein, 40 aa, Mycobacterium tuberculosis
VATTFFFTSFVVALIPLVWLLWVVIARGWFAVTRSGWWTH

SEQ ID NO: 1390632 - protein, 24 aa, Mycobacterium tuberculosis
VAVTFLAMVFTKLKVFSAVGPAIA

SEQ ID NO: 1390633 - protein, 25 aa, Mycobacterium tuberculosis
VDSRRNLLGLFMPSALTLLFVMFAV

SEQ ID NO: 1390634 - protein, 24 aa, Mycobacterium tuberculosis
VFALRRVWWLYKLVMSGQPASGRT

SEQ ID NO: 1390635 - protein, 21 aa, Mycobacterium tuberculosis
VFFFLGCFTIVGTRQFAIMTT

SEQ ID NO: 1390636 - protein, 18 aa, Mycobacterium tuberculosis
VFLLVGVPVLASWVLLRR

SEQ ID NO: 1390637 - protein, 54 aa, Mycobacterium tuberculosis
VGPGPWLALATTCALFPGIFGLFAVVVRLLPGWPIWFAVGWAAQEWLKSILPFG

SEQ ID NO: 1390638 - protein, 20 aa, Mycobacterium tuberculosis
VHVLLDPRRVRWIVGERADT

SEQ ID NO: 1390639 - protein, 18 aa, Mycobacterium tuberculosis
VLAGASWWLIEQPIRRWR

SEQ ID NO: 1390640 - protein, 19 aa, Mycobacterium tuberculosis
VLAGASWWLIEQPIRRWRP

SEQ ID NO: 1390641 - protein, 20 aa, Mycobacterium tuberculosis
VLAYAWLMPVSTVVQAMIGG

SEQ ID NO: 1390642 - protein, 20 aa, Mycobacterium tuberculosis
VLIITVMVCWLLLAVLRGRL

SEQ ID NO: 1390643 - protein, 17 aa, Mycobacterium tuberculosis
VLLIFTIGVTWSSVHYL

SEQ ID NO: 1390644 - protein, 19 aa, Mycobacterium tuberculosis
VLPFLLGFRLTCYYYRKAY

SEQ ID NO: 1390645 - protein, 26 aa, Mycobacterium tuberculosis
VNLTALSLIALLVGIFLIYNTVTFNV

SEQ ID NO: 1390646 - protein, 21 aa, Mycobacterium tuberculosis
VSILLTPVLIRLFTKQGFGHQ

SEQ ID NO: 1390647 - protein, 20 aa, Mycobacterium tuberculosis
VSPRRWLRAVAVIGATAMLL

SEQ ID NO: 1390648 - protein, 24 aa, Mycobacterium tuberculosis
VVAHRLPWRVLTLSTWATAAAWAF

SEQ ID NO: 1390649 - protein, 22 aa, Mycobacterium tuberculosis
VVFGAFAHRWLARRTRRRINPG

SEQ ID NO: 1390650 - protein, 27 aa, Mycobacterium tuberculosis
VVLAFLASLLTHYLFGGLRLTTGRGML

SEQ ID NO: 1390651 - protein, 19 aa, Mycobacterium tuberculosis
VVLVLVLGAIGIWIANRPD

SEQ ID NO: 1390652 - protein, 31 aa, Mycobacterium tuberculosis
VVVGVALVFVQWWGQPAWSWAVLGLRGRRPV

SEQ ID NO: 1390653 - protein, 17 aa, Mycobacterium tuberculosis
WAVGAALFTTLYGLANR

SEQ ID NO: 1390654 - protein, 24 aa, Mycobacterium tuberculosis
WGEQIALLAFMIIASKGAAGVSGA

SEQ ID NO: 1390655 - protein, 24 aa, Mycobacterium tuberculosis
WGRRIARLLPFVGLAGLAVTTHVA

SEQ ID NO: 1390656 - protein, 17 aa, Mycobacterium tuberculosis
WLPPLDEPPMLGALLRD

SEQ ID NO: 1390657 - protein, 17 aa, Mycobacterium tuberculosis
WLVHVLLDPRRVRWIVG

SEQ ID NO: 1390658 - protein, 26 aa, Mycobacterium tuberculosis
WPALAMFAIIFFWTPPHTWALAMRYK

SEQ ID NO: 1390659 - protein, 18 aa, Mycobacterium tuberculosis
WQSTRDYVLLGVAAAVVI

SEQ ID NO: 1390660 - protein, 17 aa, Mycobacterium tuberculosis
WSGRVFAEARWLSVALL

SEQ ID NO: 1390661 - protein, 38 aa, Mycobacterium tuberculosis
WWACHRPNRLWWRYTAWWLLAMALATLWWVMALTQLHG

SEQ ID NO: 1390662 - protein, 22 aa, Mycobacterium tuberculosis
YAKIVGCALGFPVINIARSSAK

SEQ ID NO: 1390663 - protein, 20 aa, Mycobacterium tuberculosis
YANIPPTRFKRKEHWLPAHF

SEQ ID NO: 1390664 - protein, 24 aa, Mycobacterium tuberculosis
YAVAALWALLLAYSASRRFFALRR

SEQ ID NO: 1390665 - protein, 28 aa, Mycobacterium tuberculosis
YFGLPTWLILFLRILFTAITFGALWLLY

SEQ ID NO: 1390666 - protein, 17 aa, Mycobacterium tuberculosis
YGRRRWYLIGVSLFTLG

SEQ ID NO: 1390667 - protein, 19 aa, Mycobacterium tuberculosis
YGRRRWYLIGVSLFTLGSI

SEQ ID NO: 1390668 - protein, 19 aa, Mycobacterium tuberculosis
YIDFDAMRLKMITTPTDWP

SEQ ID NO: 1390669 - protein, 18 aa, Mycobacterium tuberculosis
YLIAKVCVYTVLAVVQSA

SEQ ID NO: 1390670 - protein, 27 aa, Mycobacterium tuberculosis
YLPYATVLIGLALIALGGWLLLGRGLT

SEQ ID NO: 1390671 - protein, 30 aa, Mycobacterium tuberculosis; identical to SEQ ID NO: 215432

SEQ ID NO: 1390672 - protein, 22 aa, Mycobacterium tuberculosis
AAAGVVAVLAWIDRDRSPRLTA

SEQ ID NO: 1390673 - protein, 26 aa, Mycobacterium tuberculosis
AAATFVIGWQLVGFIWATVAGSVAWL

SEQ ID NO: 1390674 - protein, 20 aa, Mycobacterium tuberculosis
AAAVAMPLFAGLYSISVLQA

SEQ ID NO: 1390675 - protein, 22 aa, Mycobacterium tuberculosis
AAFYRLSSLRLWPDRRLSRRGV

SEQ ID NO: 1390676 - protein, 23 aa, Mycobacterium tuberculosis
AAGLHATFLALALPIVCTGLVAI

SEQ ID NO: 1390677 - protein, 31 aa, Mycobacterium tuberculosis
AAGMRLTVLLALLANLFLPWGIAGAAPTALD

SEQ ID NO: 1390678 - protein, 26 aa, Mycobacterium tuberculosis
AAGRARTLIYHRLAHGPAAAAVGLHS

SEQ ID NO: 1390679 - protein, 26 aa, Mycobacterium tuberculosis
AAIGPLPPVTLLPRRTPGSRGIADVP

SEQ ID NO: 1390680 - protein, 22 aa, Mycobacterium tuberculosis
AALAVLVTVFTLIRDRTEPVMS

SEQ ID NO: 1390681 - protein, 24 aa, Mycobacterium tuberculosis
AALLGQWRDDLRWPPASALVSQDE

SEQ ID NO: 1390682 - protein, 23 aa, Mycobacterium tuberculosis
AAPLVTLYKQYVVRFGLGYREEV

SEQ ID NO: 1390683 - protein, 17 aa, Mycobacterium tuberculosis
AAVAVLIIACPCALGLA

SEQ ID NO: 1390684 - protein, 29 aa, Mycobacterium tuberculosis
AAVVILLPMVTFTMAYLIVDVPKPGDIRT

SEQ ID NO: 1390685 - protein, 21 aa, Mycobacterium tuberculosis
AAVWMATFIFAKTLRGESLSR

SEQ ID NO: 1390686 - protein, 26 aa, Mycobacterium tuberculosis
AAWTAAGMFLAVWLPLDDGLRPEPII

SEQ ID NO: 1390687 - protein, 23 aa, Mycobacterium tuberculosis
AAYEALRKMVVKAPLRAATVSVA

SEQ ID NO: 1390688 - protein, 19 aa, Mycobacterium tuberculosis
AAYLIPALPHHPHRFDWFG

SEQ ID NO: 1390689 - protein, 20 aa, Mycobacterium tuberculosis
AAYLLLRMFNFTLTSVAAPA

SEQ ID NO: 1390690 - protein, 24 aa, Mycobacterium tuberculosis
ADPLFLDWLVGLAFPCQRPFGHQY

SEQ ID NO: 1390691 - protein, 38 aa, Mycobacterium tuberculosis
ADTFSRPRWSGRRLAFVVALVTVLMTAGLLIGRAIIRS

SEQ ID NO: 1390692 - protein, 24 aa, Mycobacterium tuberculosis
AENIVPLYRRNALTERQLLAVNEV

SEQ ID NO: 1390693 - protein, 19 aa, Mycobacterium tuberculosis
AEWLVRQGVPFRSAHEAAG

SEQ ID NO: 1390694 - protein, 23 aa, Mycobacterium tuberculosis
AFAALMLDPRLAKSVAAAAITSG

SEQ ID NO: 1390695 - protein, 22 aa, Mycobacterium tuberculosis
AGATFCLSFARMPYFQTLGIPC

SEQ ID NO: 1390696 - protein, 20 aa, Mycobacterium tuberculosis
AGAVFLSAWLPFNNGLRPEP

SEQ ID NO: 1390697 - protein, 21 aa, Mycobacterium tuberculosis
AGAVFLSAWLPFNNGLRPEPL

SEQ ID NO: 1390698 - protein, 26 aa, Mycobacterium tuberculosis
AGCAYLLRRLFRGPRAPYLRTMFVVL

SEQ ID NO: 1390699 - protein, 24 aa, Mycobacterium tuberculosis
AGIVFTVAVIFFSGALVLGQGKCP

SEQ ID NO: 1390700 - protein, 27 aa, Mycobacterium tuberculosis
AGKGDFLLGLLLPHGLLELTAVFLAAA

SEQ ID NO: 1390701 - protein, 33 aa, Mycobacterium tuberculosis
AGLVDWPILLAVGGGALLLRKLNRTPEVAAPPV

SEQ ID NO: 1390702 - protein, 24 aa, Mycobacterium tuberculosis
AGRARTLIYHRLAHGPAAAAVGLH

SEQ ID NO: 1390703 - protein, 25 aa, Mycobacterium tuberculosis
AGRNYLYDAWAARFLVTARLNNSLP

SEQ ID NO: 1390704 - protein, 22 aa, Mycobacterium tuberculosis
AGSLFPFLFITIACGALSGFDA

SEQ ID NO: 1390705 - protein, 20 aa, Mycobacterium tuberculosis
AILNLAFIVGPAIGGLMIAT

SEQ ID NO: 1390706 - protein, 29 aa, Mycobacterium tuberculosis
AITMMAGLLVSLLVRRRRVWARITPTTAG

SEQ ID NO: 1390707 - protein, 30 aa, Mycobacterium tuberculosis
AKPQRIPVPSLLRALLSEHLDAGYAAVAAE

SEQ ID NO: 1390708 - protein, 18 aa, Mycobacterium tuberculosis
ALAYPWQSTRDYVLLGVA

SEQ ID NO: 1390709 - protein, 25 aa, Mycobacterium tuberculosis
ALCGIAIFALVVFVTGLPLAYYAAR

SEQ ID NO: 1390710 - protein, 25 aa, Mycobacterium tuberculosis
ALDRGALTAFLSWLESRPSPRARRR

SEQ ID NO: 1390711 - protein, 30 aa, Mycobacterium tuberculosis
ALDVLLFYVFFEAMLIPMYFLIGGFGQGAG

SEQ ID NO: 1390712 - protein, 40 aa, Mycobacterium tuberculosis
ALGVFVLVPLLEFAVVLELAILSIGWIISNIFGAIPVLAG

SEQ ID NO: 1390713 - protein, 17 aa, Mycobacterium tuberculosis
ALGVTVVFGVLRWFFTT

SEQ ID NO: 1390714 - protein, 24 aa, Mycobacterium tuberculosis
ALIRARFPTLTARQVMQRIESTAH

SEQ ID NO: 1390715 - protein, 26 aa, Mycobacterium tuberculosis
ALLELTVLVLLLAAWFHFVANGDGRR

SEQ ID NO: 1390716 - protein, 18 aa, Mycobacterium tuberculosis
ALLVNRWPLPEAGVRSGL

SEQ ID NO: 1390717 - protein, 17 aa, Mycobacterium tuberculosis
ALRDFILEQRKIRDIAK

SEQ ID NO: 1390718 - protein, 19 aa, Mycobacterium tuberculosis
ALRDFILEQRKIRDIAKVV

SEQ ID NO: 1390719 - protein, 17 aa, Mycobacterium tuberculosis
ALVAIGAGLIFPRFEQL

SEQ ID NO: 1390720 - protein, 19 aa, Mycobacterium tuberculosis
ALWLLYRYYRTGDPLFWFT

SEQ ID NO: 1390721 - protein, 20 aa, Mycobacterium tuberculosis
AMALTCWWVISREVIPRLGH

SEQ ID NO: 1390722 - protein, 19 aa, Mycobacterium tuberculosis
ANDLLPPGGLIPLSRTSPA

SEQ ID NO: 1390723 - protein, 24 aa, Mycobacterium tuberculosis
ANFDDFFRPIRSYFYWEKHCYDIP

SEQ ID NO: 1390724 - protein, 23 aa, Mycobacterium tuberculosis
ANRVFVTIILFSVTICGVLVATN

SEQ ID NO: 1390725 - protein, 21 aa, Mycobacterium tuberculosis
APEVYWPLRRVGVQFHAAADG

SEQ ID NO: 1390726 - protein, 17 aa, Mycobacterium tuberculosis
APLYYPSVFHGLVAVFC

SEQ ID NO: 1390727 - protein, 23 aa, Mycobacterium tuberculosis
APPRLARVLRRAADLLALGADPN

SEQ ID NO: 1390728 - protein, 17 aa, Mycobacterium tuberculosis
APRLACAFVPTNAQRRA

SEQ ID NO: 1390729 - protein, 22 aa, Mycobacterium tuberculosis
AQLRARSWWSGPDIYVVVDDYD

SEQ ID NO: 1390730 - protein, 23 aa, Mycobacterium tuberculosis
ARKPWLIAGVVFLLAAAAFPNYF

SEQ ID NO: 1390731 - protein, 21 aa, Mycobacterium tuberculosis
ARPFIAFYNNCANAILRLVGV

SEQ ID NO: 1390732 - protein, 28 aa, Mycobacterium tuberculosis
ARRASQEAELLALFAGSVLRGADLATLL

SEQ ID NO: 1390733 - protein, 42 aa, Mycobacterium tuberculosis
ARRRFEHPAMLSADRAFAAVPAALLRWGVSQFDAEVRPVRVA

SEQ ID NO: 1390734 - protein, 19 aa, Mycobacterium tuberculosis
ARTKGISIRRAPGPSWYHF

SEQ ID NO: 1390735 - protein, 31 aa, Mycobacterium tuberculosis
ASAGFYAYLLTHVLFLNYVWGYTLLEAGMAV

SEQ ID NO: 1390736 - protein, 23 aa, Mycobacterium tuberculosis
ASPFWQTWDLLLLWLAQLHGGNG

SEQ ID NO: 1390737 - protein, 21 aa, Mycobacterium tuberculosis
ASVVWFAVLGFSAGRLQPFFA

SEQ ID NO: 1390738 - protein, 23 aa, Mycobacterium tuberculosis
ATGNPVWPLAALGVTVVFGVLRW

SEQ ID NO: 1390739 - protein, 25 aa, Mycobacterium tuberculosis
ATLFGAFLRMPYALASAIFGGRNWA

SEQ ID NO: 1390740 - protein, 30 aa, Mycobacterium tuberculosis
ATWLLVNLPVMLLFPRGWSEFFRLNTRRGD

SEQ ID NO: 1390741 - protein, 22 aa, Mycobacterium tuberculosis
AVATILVASWTKTIDLSKADEV

SEQ ID NO: 1390742 - protein, 21 aa, Mycobacterium tuberculosis
AVFFAVSGFLLWRGHAAAARD

SEQ ID NO: 1390743 - protein, 29 aa, Mycobacterium tuberculosis
AVGFLTLGLLVPVLTWPVSAPLLVIPVAL

SEQ ID NO: 1390744 - protein, 25 aa, Mycobacterium tuberculosis
AVIARFVQFIIVPIALIALARSQAV

SEQ ID NO: 1390745 - protein, 24 aa, Mycobacterium tuberculosis
AVLALRALVLPWLLARAVGAEAAA

SEQ ID NO: 1390746 - protein, 21 aa, Mycobacterium tuberculosis
AVLGFFGFYLSFVAELPPPPP

SEQ ID NO: 1390747 - protein, 17 aa, Mycobacterium tuberculosis
AVLGFSAGRLQPFFATP

SEQ ID NO: 1390748 - protein, 26 aa, Mycobacterium tuberculosis
AVLPRSATPVLLPDVVAAAPGMTAAL

SEQ ID NO: 1390749 - protein, 25 aa, Mycobacterium tuberculosis
AVPPNSSWPNLDYPGLHALSTVPQC

SEQ ID NO: 1390750 - protein, 38 aa, Mycobacterium tuberculosis
AVPRRHGGELPRRGALALGCIALLLMGIVGCTTVTDGT

SEQ ID NO: 1390751 - protein, 22 aa, Mycobacterium tuberculosis
AVRLAARALGRKVPKSRRAVSL

SEQ ID NO: 1390752 - protein, 17 aa, Mycobacterium tuberculosis
AVSALAPKWLASTVGVV

SEQ ID NO: 1390753 - protein, 19 aa, Mycobacterium tuberculosis
AVVLATMPPLLSAIANAGR

SEQ ID NO: 1390754 - protein, 21 aa, Mycobacterium tuberculosis
AVVLVLVLGAIGIWIANRPDD

SEQ ID NO: 1390755 - protein, 22 aa, Mycobacterium tuberculosis
AYACAIGLRRLGKDVRFVGLID

SEQ ID NO: 1390756 - protein, 22 aa, Mycobacterium tuberculosis
AYGFPAGLWRWLQRHPPPALHR

SEQ ID NO: 1390757 - protein, 17 aa, Mycobacterium tuberculosis
AYGSLVMVFQWGWARGL

SEQ ID NO: 1390758 - protein, 21 aa, Mycobacterium tuberculosis
AYRTTIFAFPVFGFGVMFGAI

SEQ ID NO: 1390759 - protein, 20 aa, Mycobacterium tuberculosis
CAAVWLVFTGVSVAAAVALM

SEQ ID NO: 1390760 - protein, 21 aa, Mycobacterium tuberculosis
CAIFTPYRWMIEHVTTKRGQL

SEQ ID NO: 1390761 - protein, 25 aa, Mycobacterium tuberculosis
CIARPLVPSIMIAAALIAGTGSVLG

SEQ ID NO: 1390762 - protein, 30 aa, Mycobacterium tuberculosis
CLAATVVVAGWWTPPAWAIGPPVVDAAAQP

SEQ ID NO: 1390763 - protein, 27 aa, Mycobacterium tuberculosis
CLGVTREQLFWLIMTESLVAGLIGTGL

SEQ ID NO: 1390764 - protein, 23 aa, Mycobacterium tuberculosis
CLVLFAAIVVWPQVRHAGSGSGG

SEQ ID NO: 1390765 - protein, 19 aa, Mycobacterium tuberculosis
DAIMFEPRYAVRQPDGGWG

SEQ ID NO: 1390766 - protein, 27 aa, Mycobacterium tuberculosis
DAITVVAVLLWIVAALIVGSVVYLSAL

SEQ ID NO: 1390767 - protein, 18 aa, Mycobacterium tuberculosis
DALFLTAGIVVGILISLR

SEQ ID NO: 1390768 - protein, 24 aa, Mycobacterium tuberculosis
DAPPIGFWIDVTVVLWVVVALVTS

SEQ ID NO: 1390769 - protein, 18 aa, Mycobacterium tuberculosis
DAVVIFGFLLWHVIGANS

SEQ ID NO: 1390770 - protein, 18 aa, Mycobacterium tuberculosis
DDALAALLGQWRDDLRWP

SEQ ID NO: 1390771 - protein, 23 aa, Mycobacterium tuberculosis
DDKVNRLLRLPLPEPYLPPRLEA

SEQ ID NO: 1390772 - protein, 18 aa, Mycobacterium tuberculosis
DDLRPIPVFGSDELARLT

SEQ ID NO: 1390773 - protein, 17 aa, Mycobacterium tuberculosis
DFMNIMLSALSAAALWL

SEQ ID NO: 1390774 - protein, 22 aa, Mycobacterium tuberculosis
DGPWVKWYPGIPGYIDQQWVTQ

SEQ ID NO: 1390775 - protein, 33 aa, Mycobacterium tuberculosis
DHPPGPDPLRRLLREFRGPLALSLLLVAVQTCA

SEQ ID NO: 1390776 - protein, 20 aa, Mycobacterium tuberculosis
DIVLVRPGERISADATVLAG

SEQ ID NO: 1390777 - protein, 18 aa, Mycobacterium tuberculosis
DKYALTYLGGVLLACAVI

SEQ ID NO: 1390778 - protein, 25 aa, Mycobacterium tuberculosis
DLAAGLVCWLLLSREVLPRLGPAVE

SEQ ID NO: 1390779 - protein, 30 aa, Mycobacterium tuberculosis
DLVYLGYGLAILALPFVILIGLIVSRQWKL

SEQ ID NO: 1390780 - protein, 22 aa, Mycobacterium tuberculosis
DNQAWILPVGLPGDLGSTQSKQ

SEQ ID NO: 1390781 - protein, 25 aa, Mycobacterium tuberculosis
DPGQSWVLVFAITMMAGLLVSLLVR

SEQ ID NO: 1390782 - protein, 19 aa, Mycobacterium tuberculosis
DQRVLAIRLTNGSSLLISK

SEQ ID NO: 1390783 - protein, 17 aa, Mycobacterium tuberculosis
DRIAGILLANVFGVGNP

SEQ ID NO: 1390784 - protein, 27 aa, Mycobacterium tuberculosis
DSEAMLLAAIYVAALRSYGFAAHAETA

SEQ ID NO: 1390785 - protein, 24 aa, Mycobacterium tuberculosis
DSVAQLELLLPAMAGLVASLTFNV

SEQ ID NO: 1390786 - protein, 29 aa, Mycobacterium tuberculosis
DVAAADLVLAVGFFLLGDLAAIKLETRQL

SEQ ID NO: 1390787 - protein, 22 aa, Mycobacterium tuberculosis
DVIHAFWVPEFLFKRDVMPNPV

SEQ ID NO: 1390788 - protein, 19 aa, Mycobacterium tuberculosis
DVRRQSRWRTAAFASAAAI

SEQ ID NO: 1390789 - protein, 17 aa, Mycobacterium tuberculosis
DWFGIVVLAVWGALAAL

SEQ ID NO: 1390790 - protein, 24 aa, Mycobacterium tuberculosis
EAQGRLFTPFFITVGLVEAAYFIN

SEQ ID NO: 1390791 - protein, 23 aa, Mycobacterium tuberculosis
EAQIWAQITLPLAPDPYPGHNPD

SEQ ID NO: 1390792 - protein, 18 aa, Mycobacterium tuberculosis
EASSLFRVSKLNCSITTS

SEQ ID NO: 1390793 - protein, 25 aa, Mycobacterium tuberculosis
EEAQIWAQITLPLAPDPYPIHNPDR

SEQ ID NO: 1390794 - protein, 21 aa, Mycobacterium tuberculosis
EFDGQLWIDMDFVDGTDTVSL

SEQ ID NO: 1390795 - protein, 17 aa, Mycobacterium tuberculosis
EFLVAVIELIPRPFTPT

SEQ ID NO: 1390796 - protein, 23 aa, Mycobacterium tuberculosis
EGALLAALIRRPSTLDPAVDPEG

SEQ ID NO: 1390797 - protein, 29 aa, Mycobacterium tuberculosis
EGAVGRSVRWYLVFSQPAAVNVAEQVVLG

SEQ ID NO: 1390798 - protein, 25 aa, Mycobacterium tuberculosis
EGMGTTLTAILFAGNRLGLVHIGDS

SEQ ID NO: 1390799 - protein, 19 aa, Mycobacterium tuberculosis
EHAHKLVFAVLRGVAAVAP

SEQ ID NO: 1390800 - protein, 17 aa, Mycobacterium tuberculosis
EHWLPAHFSGDGSTYMP

SEQ ID NO: 1390801 - protein, 24 aa, Mycobacterium tuberculosis
EPEHLRRRKLLTPPLHGAALDRYV

SEQ ID NO: 1390802 - protein, 22 aa, Mycobacterium tuberculosis
EPFGLAWRLNRGSLLLWTVGLC

SEQ ID NO: 1390803 - protein, 20 aa, Mycobacterium tuberculosis
ERGADLPPLPTLFVVVDEFA

SEQ ID NO: 1390804 - protein, 20 aa, Mycobacterium tuberculosis
ERSGIWQALLGSDAIYFEVA

SEQ ID NO: 1390805 - protein, 31 aa, Mycobacterium tuberculosis
ESKITKLMPWLWVAWFGLGSFGVLMLWLPGN

SEQ ID NO: 1390806 - protein, 34 aa, Mycobacterium tuberculosis
EVVMFFNVAAFGLALAWLTTVWATSGLAGRRIWD

SEQ ID NO: 1390807 - protein, 24 aa, Mycobacterium tuberculosis
EYWKKGLRHSVYFTHGIRNAVDSG

SEQ ID NO: 1390808 - protein, 25 aa, Mycobacterium tuberculosis
FADIDRQMYFFYAATMAPFLVMGIS

SEQ ID NO: 1390809 - protein, 18 aa, Mycobacterium tuberculosis
FAGSVLRGADLATLLQRV

SEQ ID NO: 1390810 - protein, 17 aa, Mycobacterium tuberculosis
FAVGIPFANNWYQPARR

SEQ ID NO: 1390811 - protein, 17 aa, Mycobacterium tuberculosis
FEPVLASLRDLGCRALL

SEQ ID NO: 1390812 - protein, 17 aa, Mycobacterium tuberculosis
FFAVVVLIGFWVAGSHE

SEQ ID NO: 1390813 - protein, 17 aa, Mycobacterium tuberculosis
FGVLVLQFRNAAGLTPG

SEQ ID NO: 1390814 - protein, 17 aa, Mycobacterium tuberculosis
FINGVAFLIPRLENARG

SEQ ID NO: 1390815 - protein, 19 aa, Mycobacterium tuberculosis
FIPVLKANGYRLVTVSELL

SEQ ID NO: 1390816 - protein, 24 aa, Mycobacterium tuberculosis
FKYNPEYTCFLQGAKWYLDNGGYA

SEQ ID NO: 1390817 - protein, 18 aa, Mycobacterium tuberculosis
FLSAFLNVRVVAPVIAGI

SEQ ID NO: 1390818 - protein, 17 aa, Mycobacterium tuberculosis
FMSLFVYWQARNAREPL

SEQ ID NO: 1390819 - protein, 34 aa, Mycobacterium tuberculosis
FQGKSRPWTQTRYWAFALLTPLVVAMVLTGCSAS

SEQ ID NO: 1390820 - protein, 20 aa, Mycobacterium tuberculosis
FRALQNWVPLVAAAGSMIIV

SEQ ID NO: 1390821 - protein, 18 aa, Mycobacterium tuberculosis
FRVSKLNCSITTSDGTVL

SEQ ID NO: 1390822 - protein, 29 aa, Mycobacterium tuberculosis
FSSGQRALLWAAGVLGALAIIIAVLLVIK

SEQ ID NO: 1390823 - protein, 25 aa, Mycobacterium tuberculosis
FTGAGIWLGIAAFAAAGVVAVLAWI

SEQ ID NO: 1390824 - protein, 22 aa, Mycobacterium tuberculosis
FVAWFVLYLVLVLRAVGAGGNS

SEQ ID NO: 1390825 - protein, 26 aa, Mycobacterium tuberculosis
FVMRRWLPVGTAVVALLVLLGLPFLS

SEQ ID NO: 1390826 - protein, 26 aa, Mycobacterium tuberculosis
FWSLAPLVVGCILLAGLVGMCSFQLG

SEQ ID NO: 1390827 - protein, 19 aa, Mycobacterium tuberculosis
FYWAVGIAIGLPAGLIVLT

SEQ ID NO: 1390828 - protein, 32 aa, Mycobacterium tuberculosis
GAAAWLHAAVWWKALLALAVAVALVIGVNYAN

SEQ ID NO: 1390829 - protein, 23 aa, Mycobacterium tuberculosis
GAAFVRRLVTLATTLLLGATTLS

SEQ ID NO: 1390830 - protein, 24 aa, Mycobacterium tuberculosis
GAHRLFTVGFAAVGLLGTGALLAA

SEQ ID NO: 1390831 - protein, 24 aa, Mycobacterium tuberculosis
GALAIIIAVLLVIKAPGDNSPRPA

SEQ ID NO: 1390832 - protein, 21 aa, Mycobacterium tuberculosis
GARWWQLLLRVVLPMSRPTMV

SEQ ID NO: 1390833 - protein, 20 aa, Mycobacterium tuberculosis
GASLYALLVNRWPLPEAGVR

SEQ ID NO: 1390834 - protein, 29 aa, Mycobacterium tuberculosis
GAVLTSPVAFLQRPARWLQLMAREGQAFS

SEQ ID NO: 1390835 - protein, 24 aa, Mycobacterium tuberculosis
GDDEFWMLMAGRKLAARDRRVLTA

SEQ ID NO: 1390836 - protein, 28 aa, Mycobacterium tuberculosis
GEHYWLKLFVFFFPFTDQIAAFKIIMLC

SEQ ID NO: 1390837 - protein, 26 aa, Mycobacterium tuberculosis
GFALGVAMLLGGTWLTCVLAAVTSGV

SEQ ID NO: 1390838 - protein, 42 aa, Mycobacterium tuberculosis
GFSVLAIAMTWLLCEMAPGTPIWRLVLPFIALGVAGAFVWSP

SEQ ID NO: 1390839 - protein, 24 aa, Mycobacterium tuberculosis
GFWEPPLVLNTVVTLLFVLCCAAI

SEQ ID NO: 1390840 - protein, 17 aa, Mycobacterium tuberculosis
GGALWAARRPGDTSATV

SEQ ID NO: 1390841 - protein, 17 aa, Mycobacterium tuberculosis
GGLWAWIAPPIHAVVAI

SEQ ID NO: 1390842 - protein, 19 aa, Mycobacterium tuberculosis
GGPLDCHLMKLEDLRPPER

SEQ ID NO: 1390843 - protein, 28 aa, Mycobacterium tuberculosis
GGYTYPPGPPPPPYSYGGPFGGPSPRSS

SEQ ID NO: 1390844 - protein, 29 aa, Mycobacterium tuberculosis
GGYTYPPGPPPPPYSYGGPFGGPSPRSSS

SEQ ID NO: 1390845 - protein, 18 aa, Mycobacterium tuberculosis
GHPVVLVDRHGLCLPMCI

SEQ ID NO: 1390846 - protein, 21 aa, Mycobacterium tuberculosis
GIAGLLLCGIVPLLPVNQTTA

SEQ ID NO: 1390847 - protein, 18 aa, Mycobacterium tuberculosis
GIFGIPGQGSYAAANSYL

SEQ ID NO: 1390848 - protein, 26 aa, Mycobacterium tuberculosis
GIGHPCWANYFPVTRAVPEPPSIRQC

SEQ ID NO: 1390849 - protein, 20 aa, Mycobacterium tuberculosis
GIKSISFLVSTRILGGLVVI

SEQ ID NO: 1390850 - protein, 25 aa, Mycobacterium tuberculosis
GILSLLLAPLFPMTVVVPLSAFVAL

SEQ ID NO: 1390851 - protein, 19 aa, Mycobacterium tuberculosis
GIVPLLPVNQTTATIFWPQ

SEQ ID NO: 1390852 - protein, 17 aa, Mycobacterium tuberculosis
GLGWRSVFLVNVPLGAI

SEQ ID NO: 1390853 - protein, 26 aa, Mycobacterium tuberculosis
GLLAWARRRPVLAGVLIGLGSAAKLY

SEQ ID NO: 1390854 - protein, 17 aa, Mycobacterium tuberculosis
GLMLFGVPRDQDKDGVG

SEQ ID NO: 1390855 - protein, 19 aa, Mycobacterium tuberculosis
GLNGLRLLRHTAWRRAAGT

SEQ ID NO: 1390856 - protein, 22 aa, Mycobacterium tuberculosis
GLPGFPEFPAIPGFPALPGLPS

SEQ ID NO: 1390857 - protein, 29 aa, Mycobacterium tuberculosis
GLVGGIVWNLLTWLLGIPSSSSHALIGGI

SEQ ID NO: 1390858 - protein, 27 aa, Mycobacterium tuberculosis
GLVNFEPWLVLTGMIDMFFATVGFALG

SEQ ID NO: 1390859 - protein, 33 aa, Mycobacterium tuberculosis
GMAGLRRWLGPLSILLVLWGLRASIQWLQARLA

SEQ ID NO: 1390860 - protein, 25 aa, Mycobacterium tuberculosis
GMTAAVAVLIIACPCALGLATPTAI

SEQ ID NO: 1390861 - protein, 31 aa, Mycobacterium tuberculosis
GNFVVRWPLIVIGCWIAVAAALTLLLPTLQA

SEQ ID NO: 1390862 - protein, 25 aa, Mycobacterium tuberculosis
GPFLPLAIVLYWFSNNIWTFGQQHY

SEQ ID NO: 1390863 - protein, 53 aa, Mycobacterium tuberculosis
GPGPWLALATTCALFPGIFGLFAVVVRLLPGWPIWFAVGWAAQEWLKSILPFG

SEQ ID NO: 1390864 - protein, 18 aa, Mycobacterium tuberculosis
GPIGLGFRVPCFVISPYS

SEQ ID NO: 1390865 - protein, 25 aa, Mycobacterium tuberculosis
GPLYGIFIVWLLHDWRDVFWINVPL

SEQ ID NO: 1390866 - protein, 19 aa, Mycobacterium tuberculosis
GQFVVQRLHPCALDGFLVE

SEQ ID NO: 1390867 - protein, 19 aa, Mycobacterium tuberculosis
GQFYTPWSWLPRIVTQFAA

SEQ ID NO: 1390868 - protein, 28 aa, Mycobacterium tuberculosis
GQLIGARPLSFLLTGRVGGWLLVVGLTL

SEQ ID NO: 1390869 - protein, 17 aa, Mycobacterium tuberculosis
GRLERLRGRLARSQNAL

SEQ ID NO: 1390870 - protein, 21 aa, Mycobacterium tuberculosis
GRLHRIRYIRLKKSSPDCRAT

SEQ ID NO: 1390871 - protein, 19 aa, Mycobacterium tuberculosis
GSDSAVEALFRPMHDRLAS

SEQ ID NO: 1390872 - protein, 26 aa, Mycobacterium tuberculosis
GSFLTTALISLIQRPQLRNLLHEKPE

SEQ ID NO: 1390873 - protein, 17 aa, Mycobacterium tuberculosis
GSFPSWVLYPCALAMMV

SEQ ID NO: 1390874 - protein, 21 aa, Mycobacterium tuberculosis
GSLFPFLFITIACGALSGFHA

SEQ ID NO: 1390875 - protein, 23 aa, Mycobacterium tuberculosis
GSLVMVFQWGWARGLGFPALHSI

SEQ ID NO: 1390876 - protein, 35 aa, Mycobacterium tuberculosis
GSSIPGGWFTITVLLILLMIAVTAAVQIARRTMRT

SEQ ID NO: 1390877 - protein, 24 aa, Mycobacterium tuberculosis
GSVFLLTVILPWNSLELGASPYVA

SEQ ID NO: 1390878 - protein, 27 aa, Mycobacterium tuberculosis
GSVTVTYPAHWGPAAVAALDSALRRAS

SEQ ID NO: 1390879 - protein, 27 aa, Mycobacterium tuberculosis
GTRDRYLLMPSFTFVGVAQAALWTGYR

SEQ ID NO: 1390880 - protein, 28 aa, Mycobacterium tuberculosis
GTTIGLGLLFDTLIVRSFMTPSIAALLG

SEQ ID NO: 1390881 - protein, 25 aa, Mycobacterium tuberculosis
GVEHLRWYDYPLAAALSLVVLFTLV

SEQ ID NO: 1390882 - protein, 26 aa, Mycobacterium tuberculosis
GVGLAAHFACCLVLCLPVGVVEHSSR

SEQ ID NO: 1390883 - protein, 22 aa, Mycobacterium tuberculosis
GVLLFIIGFNFGFGSLVWVYAA

SEQ ID NO: 1390884 - protein, 28 aa, Mycobacterium tuberculosis
GVLLVIGALVVWWGWRERRDLFSGFGWL

SEQ ID NO: 1390885 - protein, 19 aa, Mycobacterium tuberculosis
GVLMLWLPGNNLVVAFVGL

SEQ ID NO: 1390886 - protein, 18 aa, Mycobacterium tuberculosis
GVLVYLFVVDWRVALVLF

SEQ ID NO: 1390887 - protein, 18 aa, Mycobacterium tuberculosis
GVPYFPNLVMPIVVGGIG

SEQ ID NO: 1390888 - protein, 30 aa, Mycobacterium tuberculosis; identical to SEQ ID NO: 162583

SEQ ID NO: 1390889 - protein, 28 aa, Mycobacterium tuberculosis
GVSAWLITRAWQMPPVLDLSVAVVAVRA

SEQ ID NO: 1390890 - protein, 20 aa, Mycobacterium tuberculosis
GVTVLYLAYLRRQTRIEEKV

SEQ ID NO: 1390891 - protein, 17 aa, Mycobacterium tuberculosis
GWIAPRRDLTRRFWRSS

SEQ ID NO: 1390892 - protein, 21 aa, Mycobacterium tuberculosis
GWRSVFLVNVPLGAIVWLLTL

SEQ ID NO: 1390893 - protein, 18 aa, Mycobacterium tuberculosis
GWVQLGMLGLIGAAAAVG

SEQ ID NO: 1390894 - protein, 23 aa, Mycobacterium tuberculosis
GYGYGPAFRGLQALWRRGAEVFA

SEQ ID NO: 1390895 - protein, 17 aa, Mycobacterium tuberculosis
GYNIVFAAFMVAAGRLA

SEQ ID NO: 1390896 - protein, 19 aa, Mycobacterium tuberculosis
GYTEFAVRLPLDGWQPLES

SEQ ID NO: 1390897 - protein, 26 aa, Mycobacterium tuberculosis
HASDPIAWWTPRLLFREPDWLREQRG

SEQ ID NO: 1390898 - protein, 25 aa, Mycobacterium tuberculosis
HATAAGLFLLAGLAAHVLVADLLGE

SEQ ID NO: 1390899 - protein, 17 aa, Mycobacterium tuberculosis
HAWLPRAHPEAPSPVSA

SEQ ID NO: 1390900 - protein, 17 aa, Mycobacterium tuberculosis
HDDRRLLSLILLARDHV

SEQ ID NO: 1390901 - protein, 47 aa, Mycobacterium tuberculosis
HDLRLIIAMTVCIVLLILIVLLRAIVAPLYLIGSVIVSYLAALGIGV

SEQ ID NO: 1390902 - protein, 23 aa, Mycobacterium tuberculosis
HEFRPERFLGTRPQTYAWVPFGG

SEQ ID NO: 1390903 - protein, 27 aa, Mycobacterium tuberculosis
HESVAPSALRQSFLWGLAGVIAAEHPE

SEQ ID NO: 1390904 - protein, 24 aa, Mycobacterium tuberculosis
HGLCLPMCIGTCQFVQRPRLPCGA

SEQ ID NO: 1390905 - protein, 24 aa, Mycobacterium tuberculosis
HIPLWAGYACSTLIIFPLVVYGMK

SEQ ID NO: 1390906 - protein, 25 aa, Mycobacterium tuberculosis
HKVGPVIRLPLVLGLAQLLSRVPLP

SEQ ID NO: 1390907 - protein, 25 aa, Mycobacterium tuberculosis
HMADRFPAVLPVGEVLAIVTAVAGA

SEQ ID NO: 1390908 - protein, 35 aa, Mycobacterium tuberculosis
HPARYLSVFLVMLIGIYLLVFFTGDKHTAPKLGID

SEQ ID NO: 1390909 - protein, 26 aa, Mycobacterium tuberculosis
HPIIPRTIRLAAIPILLCWLGFTVFV

SEQ ID NO: 1390910 - protein, 24 aa, Mycobacterium tuberculosis
HVEDWFLITFAAVVLFVLARDLWG

SEQ ID NO: 1390911 - protein, 34 aa, Mycobacterium tuberculosis; identical to SEQ ID NO: 164743

SEQ ID NO: 1390912 - protein, 17 aa, Mycobacterium tuberculosis
HWMAKAPYILGQKDASA

SEQ ID NO: 1390913 - protein, 19 aa, Mycobacterium tuberculosis
IAALRSVLRMRDTPRPARS

SEQ ID NO: 1390914 - protein, 18 aa, Mycobacterium tuberculosis
IAFVYNYLKQVVAEMRKV

SEQ ID NO: 1390915 - protein, 28 aa, Mycobacterium tuberculosis
IAGDFWPWALQFVATLWVSTFLVVASHE

SEQ ID NO: 1390916 - protein, 18 aa, Mycobacterium tuberculosis
IALGIVVAVLILAGAALL

SEQ ID NO: 1390917 - protein, 18 aa, Mycobacterium tuberculosis
IALTIAGGLAAVLTPTPQ

SEQ ID NO: 1390918 - protein, 22 aa, Mycobacterium tuberculosis
IASTLLGVLSVAAVVLGAMIWS

SEQ ID NO: 1390919 - protein, 18 aa, Mycobacterium tuberculosis
IAVAFLGTVLLYFAARDS

SEQ ID NO: 1390920 - protein, 35 aa, Mycobacterium tuberculosis
IAVLVGQANWWLPSSWRPETWWPLGRRRGRAQRTK

SEQ ID NO: 1390921 - protein, 24 aa, Mycobacterium tuberculosis
IAVMVLCGLVVWQIYRPGRDLVRT

SEQ ID NO: 1390922 - protein, 23 aa, Mycobacterium tuberculosis
IEGLLTWLGGGHWRELGERHERS

SEQ ID NO: 1390923 - protein, 24 aa, Mycobacterium tuberculosis
IEQIQLGLIGMQLALTELWCSYGV

SEQ ID NO: 1390924 - protein, 29 aa, Mycobacterium tuberculosis
IGEPGLDWRWLVLWWKSHAPHIANNLMND

SEQ ID NO: 1390925 - protein, 34 aa, Mycobacterium tuberculosis
IGMAMRAWWETGRSLWWPLAIGILGIAVLVGSFV

SEQ ID NO: 1390926 - protein, 19 aa, Mycobacterium tuberculosis
IGNTQALRWRTSVGAAAIS

SEQ ID NO: 1390927 - protein, 26 aa, Mycobacterium tuberculosis
IGQIFDGALLIVIFATSGALDDIATR

SEQ ID NO: 1390928 - protein, 30 aa, Mycobacterium tuberculosis
IGVLLVIGALVVWWGWRERRDLFSGFGWLA

SEQ ID NO: 1390929 - protein, 17 aa, Mycobacterium tuberculosis
ILAPTTSLLFKYNPEYT

SEQ ID NO: 1390930 - protein, 29 aa, Mycobacterium tuberculosis
ILLGPLVGLVLLALDFRITVLAAAGVFGL

SEQ ID NO: 1390931 - protein, 22 aa, Mycobacterium tuberculosis
IMGLHPLIFFLPVRQGANWVVL

SEQ ID NO: 1390932 - protein, 23 aa, Mycobacterium tuberculosis
IMWPSLLVILLLVAVVALLFTGR

SEQ ID NO: 1390933 - protein, 22 aa, Mycobacterium tuberculosis
IPKIPFIRPSFPGPAELAEDFV

SEQ ID NO: 1390934 - protein, 26 aa, Mycobacterium tuberculosis
IPLSKWFLLIMAFGSLFMAAGKRYAE

SEQ ID NO: 1390935 - protein, 19 aa, Mycobacterium tuberculosis
IRALTTAPVPIVAGFMAAV

SEQ ID NO: 1390936 - protein, 20 aa, Mycobacterium tuberculosis
ISHFSGVPRWDRSPGRASSA

SEQ ID NO: 1390937 - protein, 38 aa, Mycobacterium tuberculosis
ISLATALPLRLISWLLMPISRLLVLLGNALTPGCGFRN

SEQ ID NO: 1390938 - protein, 30 aa, Mycobacterium tuberculosis
ITVTTIVVLLILLLIVYRSAITATVPLLSV

SEQ ID NO: 1390939 - protein, 17 aa, Mycobacterium tuberculosis
IVAFLRTGLVVAVISVV

SEQ ID NO: 1390940 - protein, 24 aa, Mycobacterium tuberculosis
IVALIGTIVMLYVSGVRSLATGFF

SEQ ID NO: 1390941 - protein, 19 aa, Mycobacterium tuberculosis
IVIGIATLLVYMIAGIFAI

SEQ ID NO: 1390942 - protein, 28 aa, Mycobacterium tuberculosis
IWPPWEFYFWHHTIPAPVWVAVIMGLVF

SEQ ID NO: 1390943 - protein, 27 aa, Mycobacterium tuberculosis
IYQLVDVDFWLRLMLRSAVCFVPHELS

SEQ ID NO: 1390944 - protein, 28 aa, Mycobacterium tuberculosis
KADFDPYQFLLIPLARITGIEDPALRES

SEQ ID NO: 1390945 - protein, 17 aa, Mycobacterium tuberculosis
KCSANVVMTARLFRRSP

SEQ ID NO: 1390946 - protein, 27 aa, Mycobacterium tuberculosis
KEPVDHLLGHSLPLFGLAGLPSYDRWD

SEQ ID NO: 1390947 - protein, 29 aa, Mycobacterium tuberculosis
KGRLKWAWIPGIPLLWDLAVTLTASWQKI

SEQ ID NO: 1390948 - protein, 25 aa, Mycobacterium tuberculosis
KIEAFAMFNVFYQSGILLGPLVGLV

SEQ ID NO: 1390949 - protein, 17 aa, Mycobacterium tuberculosis
KLVFAVLRGVAAVAPVR

SEQ ID NO: 1390950 - protein, 18 aa, Mycobacterium tuberculosis
KPAPPPPPPAPPPTTEIP

SEQ ID NO: 1390951 - protein, 28 aa, Mycobacterium tuberculosis
KSSSGCHIYLFPTIFRWSNTSPTRWRSC

SEQ ID NO: 1390952 - protein, 18 aa, Mycobacterium tuberculosis
KVHRHWGFGGGPHRCLGS

SEQ ID NO: 1390953 - protein, 23 aa, Mycobacterium tuberculosis
KYTFRKRALIVMAVILVGSAAAA

SEQ ID NO: 1390954 - protein, 24 aa, Mycobacterium tuberculosis
LAECLLVTTYLLIATAAALAVPLP

SEQ ID NO: 1390955 - protein, 25 aa, Mycobacterium tuberculosis
LAELLAMRGIDGLPFSWTVASWTQH

SEQ ID NO: 1390956 - protein, 27 aa, Mycobacterium tuberculosis
LAGWAVALPWSLLVMPLIDSGSPSLFA

SEQ ID NO: 1390957 - protein, 22 aa, Mycobacterium tuberculosis
LAMLPILLVFIALQRQMIKGLT

SEQ ID NO: 1390958 - protein, 24 aa, Mycobacterium tuberculosis
LANRVFVTIILFSVTICGVLVATN

SEQ ID NO: 1390959 - protein, 24 aa, Mycobacterium tuberculosis
LATGVLGWWRWHHNTWLTTIYTAV

SEQ ID NO: 1390960 - protein, 17 aa, Mycobacterium tuberculosis
LAWAFDLLLHHPDALRR

SEQ ID NO: 1390961 - protein, 27 aa, Mycobacterium tuberculosis
LDGLRPYFTGYLPTLLLAAILTPATVA

SEQ ID NO: 1390962 - protein, 31 aa, Mycobacterium tuberculosis; identical to SEQ ID NO: 164436

SEQ ID NO: 1390963 - protein, 20 aa, Mycobacterium tuberculosis
LERLRDFAVFKAIGVPTRSI

SEQ ID NO: 1390964 - protein, 36 aa, Mycobacterium tuberculosis
LESKITKLMPWLWVAWFGLGSFGVLMLWLPGNNLVV

SEQ ID NO: 1390965 - protein, 25 aa, Mycobacterium tuberculosis
LFAKMPLMVVILLTTTIVLMFLAFG

SEQ ID NO: 1390966 - protein, 26 aa, Mycobacterium tuberculosis
LFAKMPLMVVILLTTTIVLMFLAFGS

SEQ ID NO: 1390967 - protein, 36 aa, Mycobacterium tuberculosis
LFAKMPLMVVILLTTTIVLMFLAFGSVVLPIKATLM

SEQ ID NO: 1390968 - protein, 26 aa, Mycobacterium tuberculosis
LFIAFDQLWRWNSIVALVLSVMVILG

SEQ ID NO: 1390969 - protein, 32 aa, Mycobacterium tuberculosis
LFTLVEIGQFIRWLFRFLVGQVDRIAPFRVSA

SEQ ID NO: 1390970 - protein, 17 aa, Mycobacterium tuberculosis
LGLTLWLSTDAAERSYQ

SEQ ID NO: 1390971 - protein, 29 aa, Mycobacterium tuberculosis
LGQLIGARPLSFLLTGRVGGWLLVVGLTL

SEQ ID NO: 1390972 - protein, 31 aa, Mycobacterium tuberculosis
LGSAAKLYPLLFLYPLLLLGIRAGRLNALAR

SEQ ID NO: 1390973 - protein, 23 aa, Mycobacterium tuberculosis
LIALGLVVIVMVFASGLLAMFPI

SEQ ID NO: 1390974 - protein, 19 aa, Mycobacterium tuberculosis
LIEMLTTLPKFPGLPGLPS

SEQ ID NO: 1390975 - protein, 19 aa, Mycobacterium tuberculosis
LILLILVVAAFPSLFTAAD

SEQ ID NO: 1390976 - protein, 19 aa, Mycobacterium tuberculosis
LIVVVVITLFISLAVYGAS

SEQ ID NO: 1390977 - protein, 29 aa, Mycobacterium tuberculosis
LIVWRRDLRAIVRLLAWQGAALAAIPLLR

SEQ ID NO: 1390978 - protein, 20 aa, Mycobacterium tuberculosis
LKTSWYLLGPAFVAAIAYVD

SEQ ID NO: 1390979 - protein, 31 aa, Mycobacterium tuberculosis
LLAIRARLVLLIFTTMPVLALATWQFRRASN

SEQ ID NO: 1390980 - protein, 17 aa, Mycobacterium tuberculosis
LLAVIGLMALWFPVYLD

SEQ ID NO: 1390981 - protein, 22 aa, Mycobacterium tuberculosis
LLAVTVSLLTIPFAAAAGTAVH

SEQ ID NO: 1390982 - protein, 23 aa, Mycobacterium tuberculosis
LLDAAPAVLPPMGPKLGLKAQRR

SEQ ID NO: 1390983 - protein, 32 aa, Mycobacterium tuberculosis
LLGVPGWVTQRLWWAVLLTVGFWGLLRVAEAL

SEQ ID NO: 1390984 - protein, 21 aa, Mycobacterium tuberculosis
LLLEVLFLRWLLDGRASRQWC

SEQ ID NO: 1390985 - protein, 20 aa, Mycobacterium tuberculosis
LLPRGPLFQGLVSGICGAFG

SEQ ID NO: 1390986 - protein, 20 aa, Mycobacterium tuberculosis
LLTFVWLDRIGLRGGGWAGL

SEQ ID NO: 1390987 - protein, 21 aa, Mycobacterium tuberculosis
LNTSYYRLMLKLNGGPQAVAD

SEQ ID NO: 1390988 - protein, 19 aa, Mycobacterium tuberculosis
LPIPLVLFDNAANVGLIAG

SEQ ID NO: 1390989 - protein, 22 aa, Mycobacterium tuberculosis
LPLIPIFMVLIGLATTNPSAAA

SEQ ID NO: 1390990 - protein, 25 aa, Mycobacterium tuberculosis
LPTWLILFLRILFTAITFGALWLLY

SEQ ID NO: 1390991 - protein, 19 aa, Mycobacterium tuberculosis
LPVNQTTATIFWPQGSTAD

SEQ ID NO: 1390992 - protein, 27 aa, Mycobacterium tuberculosis
LQRMSPFWQRMFLTIGILIAVFGMRLV

SEQ ID NO: 1390993 - protein, 31 aa, Mycobacterium tuberculosis
LRAIGWPETIFRFALYAFLCATALMVVRIEE

SEQ ID NO: 1390994 - protein, 21 aa, Mycobacterium tuberculosis
LRDRVTAYAPLLLTAQNVIDA

SEQ ID NO: 1390995 - protein, 17 aa, Mycobacterium tuberculosis
LRDVLINELQPGMDRSI

SEQ ID NO: 1390996 - protein, 19 aa, Mycobacterium tuberculosis
LRIASPMFHFGILVVIVGH

SEQ ID NO: 1390997 - protein, 24 aa, Mycobacterium tuberculosis
LRSDAIAAFLWTANWRFVAQNTDY

SEQ ID NO: 1390998 - protein, 20 aa, Mycobacterium tuberculosis
LRSGSPILFYPAGALAITVL

SEQ ID NO: 1390999 - protein, 22 aa, Mycobacterium tuberculosis
LRSGSPILFYPAGALAITVLAF

SEQ ID NO: 1391000 - protein, 17 aa, Mycobacterium tuberculosis
LRWRTSVGAAAISVAQR

SEQ ID NO: 1391001 - protein, 27 aa, Mycobacterium tuberculosis
LSAFTLIPYALVLLQLRVFYAREQPWT

SEQ ID NO: 1391002 - protein, 21 aa, Mycobacterium tuberculosis
LTGIYLINTPALRSMATGAIL

SEQ ID NO: 1391003 - protein, 22 aa, Mycobacterium tuberculosis
LTLLAVITLAVIFAIAALLLRS

SEQ ID NO: 1391004 - protein, 22 aa, Mycobacterium tuberculosis
LTLNLWVGYFPTVQTAWNQLTS

SEQ ID NO: 1391005 - protein, 20 aa, Mycobacterium tuberculosis
LTPVAWWICGSATGVTVLYL

SEQ ID NO: 1391006 - protein, 26 aa, Mycobacterium tuberculosis
LTTAFAYLLLPQVLVYGLSSVFMAIL

SEQ ID NO: 1391007 - protein, 28 aa, Mycobacterium tuberculosis
LTTAFGFLVLVLLLSLLNATLFQGAPQQ

SEQ ID NO: 1391008 - protein, 19 aa, Mycobacterium tuberculosis
LVAAVLPPLLKKLRIDPAI

SEQ ID NO: 1391009 - protein, 20 aa, Mycobacterium tuberculosis
LVCFLLIITIPFGFAALRIA

SEQ ID NO: 1391010 - protein, 18 aa, Mycobacterium tuberculosis
LVDGRIESLLPAILEGRQ

SEQ ID NO: 1391011 - protein, 19 aa, Mycobacterium tuberculosis
LVDGRIESLLPAILEGRQL

SEQ ID NO: 1391012 - protein, 19 aa, Mycobacterium tuberculosis
LVEPTILLAVFALSIPAGS

SEQ ID NO: 1391013 - protein, 17 aa, Mycobacterium tuberculosis
LVFTLRALLYKPFVRQI

SEQ ID NO: 1391014 - protein, 18 aa, Mycobacterium tuberculosis
LVMMKYLAFGLMAALLLD

SEQ ID NO: 1391015 - protein, 27 aa, Mycobacterium tuberculosis
LVPLAGAVLIILLPPGRRRLAKWAGMV

SEQ ID NO: 1391016 - protein, 19 aa, Mycobacterium tuberculosis
LVVAMVLAGLRVEAAMAST

SEQ ID NO: 1391017 - protein, 42 aa, Mycobacterium tuberculosis
LVVLQSILAVAFGAGLFIAFDQLWRWNSIVALVLSVMVILGL

SEQ ID NO: 1391018 - protein, 19 aa, Mycobacterium tuberculosis
MAVVPLFVAAMLLVPAAGS

SEQ ID NO: 1391019 - protein, 24 aa, Mycobacterium tuberculosis
MDGARWWQLLLRVVLPMSRPTMVA

SEQ ID NO: 1391020 - protein, 20 aa, Mycobacterium tuberculosis
MDRIGAYERYWLYPGAQNLA

SEQ ID NO: 1391021 - protein, 17 aa, Mycobacterium tuberculosis
MFALAWLLLADLPEYRT

SEQ ID NO: 1391022 - protein, 26 aa, Mycobacterium tuberculosis
MGVPLEWNVFFIFSLCYLFGHYGAIT

SEQ ID NO: 1391023 - protein, 18 aa, Mycobacterium tuberculosis
MIDMFFATVGFALGVFVL

SEQ ID NO: 1391024 - protein, 25 aa, Mycobacterium tuberculosis
MLAIAMLLMLVPLATGCLRVRASIT

SEQ ID NO: 1391025 - protein, 18 aa, Mycobacterium tuberculosis
MLFGVPRDQDKDGVGSAG

SEQ ID NO: 1391026 - protein, 26 aa, Mycobacterium tuberculosis
MLSKWPVGWVVVLLYAVCVVLRLARY

SEQ ID NO: 1391027 - protein, 18 aa, Mycobacterium tuberculosis
MPDLRGALLLAVTLGLVT

SEQ ID NO: 1391028 - protein, 23 aa, Mycobacterium tuberculosis
MRLKMITTPTDWPRYGGYALAGV

SEQ ID NO: 1391029 - protein, 23 aa, Mycobacterium tuberculosis
MRLKMITTPTDWPRYGGYALGGV

SEQ ID NO: 1391030 - protein, 17 aa, Mycobacterium tuberculosis
MRLPTLAMALTCWWVIS

SEQ ID NO: 1391031 - protein, 34 aa, Mycobacterium tuberculosis
MSRRFAVLVLLFCLFGVLFVLLRRGRVAGLASGP

SEQ ID NO: 1391032 - protein, 21 aa, Mycobacterium tuberculosis
MTDAYLAPRKLRTTTLTLIYP

SEQ ID NO: 1391033 - protein, 24 aa, Mycobacterium tuberculosis
MTIPIAIFMGCYLRFLRPGRVSEV

SEQ ID NO: 1391034 - protein, 20 aa, Mycobacterium tuberculosis
MTLDRWLLFNWMRWGRALEY

SEQ ID NO: 1391035 - protein, 27 aa, Mycobacterium tuberculosis
MVAVTLAVFAVPPLWGETLQRALLRAM

SEQ ID NO: 1391036 - protein, 17 aa, Mycobacterium tuberculosis
MVLKSAAKLKRLAPDAI

SEQ ID NO: 1391037 - protein, 40 aa, Mycobacterium tuberculosis; identical to SEQ ID NO: 164470

SEQ ID NO: 1391038 - protein, 22 aa, Mycobacterium tuberculosis
NDYTVGLLLLVATALVACTYTA

SEQ ID NO: 1391039 - protein, 26 aa, Mycobacterium tuberculosis
NGEQLLLTMFIPITLLVGLTLLPMGS

SEQ ID NO: 1391040 - protein, 23 aa, Mycobacterium tuberculosis
NGFHGKWPWQMTHPMDGAVQIDK

SEQ ID NO: 1391041 - protein, 25 aa, Mycobacterium tuberculosis
NPDFQRGLKLFLSPDGTCARFVITH

SEQ ID NO: 1391042 - protein, 18 aa, Mycobacterium tuberculosis
NRFFPPMGSILYWMRFGT

SEQ ID NO: 1391043 - protein, 23 aa, Mycobacterium tuberculosis
NTSTAWTYLLYVGGWVGGPMRLE

SEQ ID NO: 1391044 - protein, 30 aa, Mycobacterium tuberculosis
NYFRTGNLTALREIALLWLADQVDAALEKY

SEQ ID NO: 1391045 - protein, 27 aa, Mycobacterium tuberculosis
PAADIHMLWWMVLIVGVVSIIGAGYHV

SEQ ID NO: 1391046 - protein, 26 aa, Mycobacterium tuberculosis
PAEFSKILLLIFFSAVLVAKRGLFTS

SEQ ID NO: 1391047 - protein, 33 aa, Mycobacterium tuberculosis
PAKWSYYYLYVILDIFSRYVVGWMVASRESKVL

SEQ ID NO: 1391048 - protein, 26 aa, Mycobacterium tuberculosis
PAQPPKPRVFAIKPPCPEPAAADPTD

SEQ ID NO: 1391049 - protein, 17 aa, Mycobacterium tuberculosis
PCRTILRVFSRNPLVRG

SEQ ID NO: 1391050 - protein, 41 aa, Mycobacterium tuberculosis
PEFGYDIGFFVFDLPFYRSVLNWLFVAVVLAFLASLLTHYL

SEQ ID NO: 1391051 - protein, 20 aa, Mycobacterium tuberculosis
PEKISFLPAMRYYAGNWATS

SEQ ID NO: 1391052 - protein, 31 aa, Mycobacterium tuberculosis; identical to SEQ ID NO: 163281

SEQ ID NO: 1391053 - protein, 27 aa, Mycobacterium tuberculosis
PGALKKAVMLLGVLAVLVAMVGLAALD

SEQ ID NO: 1391054 - protein, 24 aa, Mycobacterium tuberculosis
PGARALVVAILVFVLLGSFILPHT

SEQ ID NO: 1391055 - protein, 27 aa, Mycobacterium tuberculosis
PGDQRVLGAALWYAATVKDAVIVAAAG

SEQ ID NO: 1391056 - protein, 23 aa, Mycobacterium tuberculosis
PGLPGFPEFPAIPGFPALPGLPS

SEQ ID NO: 1391057 - protein, 21 aa, Mycobacterium tuberculosis
PGPSWYHFTLNGAPGSILADK

SEQ ID NO: 1391058 - protein, 20 aa, Mycobacterium tuberculosis
PGYTEFAVRLPLDGWQPLES

SEQ ID NO: 1391059 - protein, 17 aa, Mycobacterium tuberculosis
PILFYPAGALAITVLAF

SEQ ID NO: 1391060 - protein, 20 aa, Mycobacterium tuberculosis
PILLCWLGFTVFVSVAVPPL

SEQ ID NO: 1391061 - protein, 19 aa, Mycobacterium tuberculosis
PKLFRSLSIAFMSSADPIP

SEQ ID NO: 1391062 - protein, 21 aa, Mycobacterium tuberculosis
PLAPWAVVLVAAAGATYLLMY

SEQ ID NO: 1391063 - protein, 25 aa, Mycobacterium tuberculosis
PLEAVPAFFRWLAQFEPMHQVFLGV

SEQ ID NO: 1391064 - protein, 28 aa, Mycobacterium tuberculosis
PLWGETLQRALLRAMTFMIVASPCAVVL

SEQ ID NO: 1391065 - protein, 19 aa, Mycobacterium tuberculosis
PMVWVRPRQGPKLADLIAA

SEQ ID NO: 1391066 - protein, 58 aa, Mycobacterium tuberculosis
PNSLYRASLAIGLALLPLLALLAFWRTGRRQLADRPTPPWRPGAWAAAGVLAAGAVIA

SEQ ID NO: 1391067 - protein, 20 aa, Mycobacterium tuberculosis
PPIQAAPTGQPSWAPNSGPM

SEQ ID NO: 1391068 - protein, 25 aa, Mycobacterium tuberculosis
PPPAFPVWPLWYAALAWLHVRQAGA

SEQ ID NO: 1391069 - protein, 19 aa, Mycobacterium tuberculosis
PPPPTVTPPVPARAPRPAA

SEQ ID NO: 1391070 - protein, 30 aa, Mycobacterium tuberculosis
PQVQFYLSPAMLILLALMTIDAIILGRKVG

SEQ ID NO: 1391071 - protein, 30 aa, Mycobacterium tuberculosis
PRKLRTTTLTLIYPTLTLPSWSAGSRVVAC

SEQ ID NO: 1391072 - protein, 17 aa, Mycobacterium tuberculosis
PSIGGSKTLWRAVSVRA

SEQ ID NO: 1391073 - protein, 23 aa, Mycobacterium tuberculosis
PTIAWYQDFLRYYFLTVESNVEG

SEQ ID NO: 1391074 - protein, 17 aa, Mycobacterium tuberculosis
PTLLLAAILTPATVAVI

SEQ ID NO: 1391075 - protein, 20 aa, Mycobacterium tuberculosis
PTQLDWVGQLTLIPAVALIA

SEQ ID NO: 1391076 - protein, 35 aa, Mycobacterium tuberculosis
PWHLSFSLLLAGSFVLFSWWAFDYAGSGANKVILV

SEQ ID NO: 1391077 - protein, 40 aa, Mycobacterium tuberculosis
QADTFSRPRWSGRRLAFVVALVTVLMTAGLLIGRAIIRSN

SEQ ID NO: 1391078 - protein, 22 aa, Mycobacterium tuberculosis
QINWKWIRRSLYLTAAVVILLP

SEQ ID NO: 1391079 - protein, 27 aa, Mycobacterium tuberculosis
QKLVFKVLVMVLWLAPIGAFGAIANIV

SEQ ID NO: 1391080 - protein, 20 aa, Mycobacterium tuberculosis
QLAQTLLTRRHSPLVIATAL

SEQ ID NO: 1391081 - protein, 22 aa, Mycobacterium tuberculosis
QNLGWAFGYNTAAIPLAALGAL

SEQ ID NO: 1391082 - protein, 23 aa, Mycobacterium tuberculosis
QPGGYLLGGFGPAPEGMAMWIIG

SEQ ID NO: 1391083 - protein, 41 aa, Mycobacterium tuberculosis
QPLLTGWLVRRTLLVSTLLVASAWWLFAWELDNGAGLHEAR

SEQ ID NO: 1391084 - protein, 17 aa, Mycobacterium tuberculosis
QQQMVTRMAIMSDPAVA

SEQ ID NO: 1391085 - protein, 17 aa, Mycobacterium tuberculosis
QRFSWVVIGLTLFAAGT

SEQ ID NO: 1391086 - protein, 17 aa, Mycobacterium tuberculosis
QTYAWVPFGGGVKRCLG

SEQ ID NO: 1391087 - protein, 30 aa, Mycobacterium tuberculosis
RAAEHPVPGDWLYFVTIDSQGTTLFTRDYQ

SEQ ID NO: 1391088 - protein, 26 aa, Mycobacterium tuberculosis
RAESRLNRLLAQQIPPARKVLAGADD

SEQ ID NO: 1391089 - protein, 21 aa, Mycobacterium tuberculosis
RALVLVTVGIIVVICVASMLI

SEQ ID NO: 1391090 - protein, 24 aa, Mycobacterium tuberculosis
RANWLPTFVLLILLAAVTAVYALR

SEQ ID NO: 1391091 - protein, 29 aa, Mycobacterium tuberculosis
RDDALAALLGQWRDDLRWPPASALVSQDE

SEQ ID NO: 1391092 - protein, 33 aa, Mycobacterium tuberculosis
RDERDRLALWSRVLPITFTAAGLVALVGGGLFA

SEQ ID NO: 1391093 - protein, 17 aa, Mycobacterium tuberculosis
RDFILEQRKIRDIAKVV

SEQ ID NO: 1391094 - protein, 27 aa, Mycobacterium tuberculosis
RDIVLLVCVLLFTIIWWNVNHGRANWL

SEQ ID NO: 1391095 - protein, 41 aa, Mycobacterium tuberculosis; identical to SEQ ID NO: 163485

SEQ ID NO: 1391096 - protein, 41 aa, Mycobacterium tuberculosis
REQVIMPSIPQSLLWISLVVLWLFVLVPMLISKRDAVRRTS

SEQ ID NO: 1391097 - protein, 30 aa, Mycobacterium tuberculosis
RERRDLFSGFGWLAVVLLAVAAACAPPGAL

SEQ ID NO: 1391098 - protein, 19 aa, Mycobacterium tuberculosis
RFGLLDPKRRLKTRGWRRV

SEQ ID NO: 1391099 - protein, 17 aa, Mycobacterium tuberculosis
RFVVSYLGGIMAGLLVG

SEQ ID NO: 1391100 - protein, 22 aa, Mycobacterium tuberculosis
RGANVFFMLGGQRLDLSSLQKV

SEQ ID NO: 1391101 - protein, 21 aa, Mycobacterium tuberculosis
RGRATLYLTYWTAGDTRNRGR

SEQ ID NO: 1391102 - protein, 24 aa, Mycobacterium tuberculosis
RGTPELAGIWVYERRFTDDELLRL

SEQ ID NO: 1391103 - protein, 38 aa, Mycobacterium tuberculosis
RHALIGRTRLMTPLRVMFAIALVFLALGWSTKAACLQS

SEQ ID NO: 1391104 - protein, 27 aa, Mycobacterium tuberculosis
RHQVTGWRFVMRRIAAGIALHDTRMLV

SEQ ID NO: 1391105 - protein, 17 aa, Mycobacterium tuberculosis
RIFAVATAITIVVATDT

SEQ ID NO: 1391106 - protein, 17 aa, Mycobacterium tuberculosis
RILSALPVARAASESAV

SEQ ID NO: 1391107 - protein, 17 aa, Mycobacterium tuberculosis
RLACAFVPTNAQRRATA

SEQ ID NO: 1391108 - protein, 29 aa, Mycobacterium tuberculosis
RLAWVLGAALLLIAIGFTALARNSGRMLL

SEQ ID NO: 1391109 - protein, 17 aa, Mycobacterium tuberculosis
RLFVWPPARSIAQVLER

SEQ ID NO: 1391110 - protein, 33 aa, Mycobacterium tuberculosis
RLGVRGQRLLALYYPFVALLCSLATTLVLLDGA

SEQ ID NO: 1391111 - protein, 27 aa, Mycobacterium tuberculosis
RLHDAWWTLILFAVIGVAVLVTAVSFT

SEQ ID NO: 1391112 - protein, 19 aa, Mycobacterium tuberculosis
RLLIFHGGVPPLQFWQALD

SEQ ID NO: 1391113 - protein, 32 aa, Mycobacterium tuberculosis
RLYLRRDRVSLPLWVLLLSVPLATVYIASVET

SEQ ID NO: 1391114 - protein, 17 aa, Mycobacterium tuberculosis
RMGGLAMFLGIVGAVFL

SEQ ID NO: 1391115 - protein, 32 aa, Mycobacterium tuberculosis
RNLRRCRWLVFTGWLLALVPAVYLAMTQSGNL

SEQ ID NO: 1391116 - protein, 19 aa, Mycobacterium tuberculosis
RPVLPKRARLLVTAGMGML

SEQ ID NO: 1391117 - protein, 24 aa, Mycobacterium tuberculosis
RPVRAVSWLVAAFSALGLLNLSRA

SEQ ID NO: 1391118 - protein, 27 aa, Mycobacterium tuberculosis
RQASLLRNYLLPLGAVLLLLVKASEVP

SEQ ID NO: 1391119 - protein, 20 aa, Mycobacterium tuberculosis
RQRVLTITAWLAVVVTGSFA

SEQ ID NO: 1391120 - protein, 22 aa, Mycobacterium tuberculosis
RRLSHFGALVRIPRSVEALGRV

SEQ ID NO: 1391121 - protein, 23 aa, Mycobacterium tuberculosis
RRRPKFVIAAALILLILVVAAFP

SEQ ID NO: 1391122 - protein, 22 aa, Mycobacterium tuberculosis
RRSWHAPRLGSISAGLVAVGMV

SEQ ID NO: 1391123 - protein, 25 aa, Mycobacterium tuberculosis
RSDRLSHTLLPKRIALPVFASDAMS

SEQ ID NO: 1391124 - protein, 20 aa, Mycobacterium tuberculosis
RSLQLRVVALTLGLSLAVIL

SEQ ID NO: 1391125 - protein, 17 aa, Mycobacterium tuberculosis
RSQPFVEVLRHAKAGTV

SEQ ID NO: 1391126 - protein, 41 aa, Mycobacterium tuberculosis
RSRIEFAITILLLVILLIIYGNPITMVLPLITIGMSVVVAQ

SEQ ID NO: 1391127 - protein, 19 aa, Mycobacterium tuberculosis
RSSKFVMRRWLPVGTAVVA

SEQ ID NO: 1391128 - protein, 20 aa, Mycobacterium tuberculosis
RSVNPIAFVYNYLKQVVAEM

SEQ ID NO: 1391129 - protein, 25 aa, Mycobacterium tuberculosis
RSVRSPVYLVLAARRRCVSGCARRR

SEQ ID NO: 1391130 - protein, 22 aa, Mycobacterium tuberculosis
RTAALNLFVVVEAFYLFSCRSL

SEQ ID NO: 1391131 - protein, 18 aa, Mycobacterium tuberculosis
RTFLSGVLVFTIASGLCA

SEQ ID NO: 1391132 - protein, 24 aa, Mycobacterium tuberculosis
RTPQHEGFLGPDRPWHLSFSLLLA

SEQ ID NO: 1391133 - protein, 23 aa, Mycobacterium tuberculosis
RTQHNVYIPWSMTVTPISQSDVG

SEQ ID NO: 1391134 - protein, 17 aa, Mycobacterium tuberculosis
RTREARRASQEAELLAL

SEQ ID NO: 1391135 - protein, 22 aa, Mycobacterium tuberculosis
RVGTAIVRWPGPVLAATCLVAS

SEQ ID NO: 1391136 - protein, 29 aa, Mycobacterium tuberculosis
RVLARWQSSWLRYAPLSFSGLVMIGAVIG

SEQ ID NO: 1391137 - protein, 31 aa, Mycobacterium tuberculosis
RVRRGGRRPGWVLLTALLVLAIGASSALVFT

SEQ ID NO: 1391138 - protein, 19 aa, Mycobacterium tuberculosis
RVYAAPYFHQFDAYRSIYV

SEQ ID NO: 1391139 - protein, 25 aa, Mycobacterium tuberculosis
RYLTPWGRQFWRITRAYFVGPNSVR

SEQ ID NO: 1391140 - protein, 19 aa, Mycobacterium tuberculosis
RYYAAQRTFWVDPVSGTIV

SEQ ID NO: 1391141 - protein, 22 aa, Mycobacterium tuberculosis
SAAALWLLFANRMGYPVSTTHS

SEQ ID NO: 1391142 - protein, 27 aa, Mycobacterium tuberculosis
SAELFVAAYVPYVAWLVQASADSAAAA

SEQ ID NO: 1391143 - protein, 27 aa, Mycobacterium tuberculosis
SAFLGANFMLLPRWLLGSGDEGASAIV

SEQ ID NO: 1391144 - protein, 26 aa, Mycobacterium tuberculosis
SALLAVLFSWLTYGNLLLRRGGSGQE

SEQ ID NO: 1391145 - protein, 17 aa, Mycobacterium tuberculosis
SALLAWLTAAAVAIAML

SEQ ID NO: 1391146 - protein, 24 aa, Mycobacterium tuberculosis
SCIFVAWFVLYLMLVLRAVGAGGN

SEQ ID NO: 1391147 - protein, 24 aa, Mycobacterium tuberculosis
SDGAVFCGLLWWIAFHMRDRPLVI

SEQ ID NO: 1391148 - protein, 23 aa, Mycobacterium tuberculosis
SDPAPVAVPVPRRSTPGPSDRRA

SEQ ID NO: 1391149 - protein, 28 aa, Mycobacterium tuberculosis
SETLPMMLAPWVLLPTILALRGTSGRSV

SEQ ID NO: 1391150 - protein, 28 aa, Mycobacterium tuberculosis
SEVSEFSWQLERVLPVPVFAQTMAQVTV

SEQ ID NO: 1391151 - protein, 25 aa, Mycobacterium tuberculosis
SGIITLILALILKFTIGLRLDAEQE

SEQ ID NO: 1391152 - protein, 17 aa, Mycobacterium tuberculosis
SGLIWLAVLLPMPVSLR

SEQ ID NO: 1391153 - protein, 25 aa, Mycobacterium tuberculosis
SGLVLAYLGLLWWMMVCWSQPLRAR

SEQ ID NO: 1391154 - protein, 36 aa, Mycobacterium tuberculosis
SGPVFTFLAYLVLDPLIYFGPFAPLTSPVLLPAGLT

SEQ ID NO: 1391155 - protein, 26 aa, Mycobacterium tuberculosis
SGTLSWCSPLGWSLQVRPYAGERWWV

SEQ ID NO: 1391156 - protein, 28 aa, Mycobacterium tuberculosis
SHFGEHCIGWLILALLGAIALPRRRREW

SEQ ID NO: 1391157 - protein, 17 aa, Mycobacterium tuberculosis
SIHGLFAKMPLMVVILL

SEQ ID NO: 1391158 - protein, 23 aa, Mycobacterium tuberculosis
SITRKPVLTLYRQRPPEVGVPSE

SEQ ID NO: 1391159 - protein, 24 aa, Mycobacterium tuberculosis
SITRKPVLTLYRQRPPEVGVPSEN

SEQ ID NO: 1391160 - protein, 25 aa, Mycobacterium tuberculosis
SLATRLTMITLIPTVAFMTVGGPAI

SEQ ID NO: 1391161 - protein, 17 aa, Mycobacterium tuberculosis
SLFVYWQARNAREPLIP

SEQ ID NO: 1391162 - protein, 22 aa, Mycobacterium tuberculosis
SLPEQWFTTTVLLRDIAVMVLC

SEQ ID NO: 1391163 - protein, 22 aa, Mycobacterium tuberculosis
SLSMRSLRYRALDFGLDVGRAQ

SEQ ID NO: 1391164 - protein, 21 aa, Mycobacterium tuberculosis
SPLVIFQIFTNFDALATGLAT

SEQ ID NO: 1391165 - protein, 24 aa, Mycobacterium tuberculosis
SQTIVPLPWVIQAPRLFAGQIDFG

SEQ ID NO: 1391166 - protein, 21 aa, Mycobacterium tuberculosis
SRARRWLRTLRNIGVFGVNLV

SEQ ID NO: 1391167 - protein, 18 aa, Mycobacterium tuberculosis
SRFNLREFAIRPAYGLAE

SEQ ID NO: 1391168 - protein, 22 aa, Mycobacterium tuberculosis
SRITGFARIVLLAAILGAALAS

SEQ ID NO: 1391169 - protein, 31 aa, Mycobacterium tuberculosis
SRPLAVEPGIPAWRRILDDLSYEPVMAPLRG

SEQ ID NO: 1391170 - protein, 24 aa, Mycobacterium tuberculosis
SRRLWTMLIFMLWHAIFVEHSVVP

SEQ ID NO: 1391171 - protein, 27 aa, Mycobacterium tuberculosis
SRRNLTLYVTALLFVLAWATSGINGWF

SEQ ID NO: 1391172 - protein, 29 aa, Mycobacterium tuberculosis
SSETLPMMLAPWVLLPTILALRGTSGRSV

SEQ ID NO: 1391173 - protein, 29 aa, Mycobacterium tuberculosis
SSRLAAGVIRPQLRRAYLEEAVQRALVSI

SEQ ID NO: 1391174 - protein, 24 aa, Mycobacterium tuberculosis
STAQPLSLLPDAAAALYAIRADPG

SEQ ID NO: 1391175 - protein, 23 aa, Mycobacterium tuberculosis
SVALALVGLLALPGYRPGYNDRY

SEQ ID NO: 1391176 - protein, 19 aa, Mycobacterium tuberculosis
SVERLIAAHLMDPAPQPSQ

SEQ ID NO: 1391177 - protein, 24 aa, Mycobacterium tuberculosis
SVGRWVAVVAVLAVLTVVVTIAIN

SEQ ID NO: 1391178 - protein, 32 aa, Mycobacterium tuberculosis
SVGSLLRLSVLALIMLPILAAVTLCARVPEAR

SEQ ID NO: 1391179 - protein, 26 aa, Mycobacterium tuberculosis
SVMTPPLVVAAFRPVGHYRLATDRAG

SEQ ID NO: 1391180 - protein, 36 aa, Mycobacterium tuberculosis
SVTRVHWPTFVLAMSVLALLTMLTRWAPRAPGPIIA

SEQ ID NO: 1391181 - protein, 26 aa, Mycobacterium tuberculosis
SVTVTYPAHWGPAAVAALDSALRRAS

SEQ ID NO: 1391182 - protein, 19 aa, Mycobacterium tuberculosis
SVVGLVHTPGLVTLAPGAR

SEQ ID NO: 1391183 - protein, 20 aa, Mycobacterium tuberculosis
SWRAALPHFLGSAGVRLLLV

SEQ ID NO: 1391184 - protein, 22 aa, Mycobacterium tuberculosis
TAGAVFLSAWLPFNNGLRPEPL

SEQ ID NO: 1391185 - protein, 22 aa, Mycobacterium tuberculosis
TAILMLYTIVIIRGLRTAIATR

SEQ ID NO: 1391186 - protein, 23 aa, Mycobacterium tuberculosis
TAQPLSLLPDAAAALYAIRADPG

SEQ ID NO: 1391187 - protein, 25 aa, Mycobacterium tuberculosis
TARKRIAWLVLLANMVLAAVVNAAE

SEQ ID NO: 1391188 - protein, 23 aa, Mycobacterium tuberculosis
TDLDSVLKRFGPLTPPRAVAIIT

SEQ ID NO: 1391189 - protein, 18 aa, Mycobacterium tuberculosis
TDWPRYGGYALAGVSSFG

SEQ ID NO: 1391190 - protein, 18 aa, Mycobacterium tuberculosis
TDWPRYGGYALGGVSSFG

SEQ ID NO: 1391191 - protein, 17 aa, Mycobacterium tuberculosis
TEEQLFAPFQRPGDHDN

SEQ ID NO: 1391192 - protein, 23 aa, Mycobacterium tuberculosis
TEEQLFAPFQRPGDHDNTTGVGL

SEQ ID NO: 1391193 - protein, 18 aa, Mycobacterium tuberculosis
TFTAIFVPVLARAEQDDP

SEQ ID NO: 1391194 - protein, 30 aa, Mycobacterium tuberculosis; identical to SEQ ID NO: 164934

SEQ ID NO: 1391195 - protein, 33 aa, Mycobacterium tuberculosis
TGAVPPLDLFIMSWLPFYHDMGLVLGVCAPIIV

SEQ ID NO: 1391196 - protein, 23 aa, Mycobacterium tuberculosis
TGLGLLIGIWLGEGLIGLVTQTI

SEQ ID NO: 1391197 - protein, 24 aa, Mycobacterium tuberculosis
TGLPLPVVLVPPMALSRILLGVHY

SEQ ID NO: 1391198 - protein, 22 aa, Mycobacterium tuberculosis
TGSVHRYLAYGALGVLIVLVVA

SEQ ID NO: 1391199 - protein, 18 aa, Mycobacterium tuberculosis
THLLASALVLVILAGCAG

SEQ ID NO: 1391200 - protein, 27 aa, Mycobacterium tuberculosis
THRMDPVNLLPFMFLGTTFGARLLGIA

SEQ ID NO: 1391201 - protein, 18 aa, Mycobacterium tuberculosis
THWLASHLAMALAGSAVA

SEQ ID NO: 1391202 - protein, 17 aa, Mycobacterium tuberculosis
THWLYLAVIFAVIAGVI

SEQ ID NO: 1391203 - protein, 35 aa, Mycobacterium tuberculosis; identical to SEQ ID NO: 164940

SEQ ID NO: 1391204 - protein, 26 aa, Mycobacterium tuberculosis
TLDSMIGYRSPRYLRFGWAAARLDDW

SEQ ID NO: 1391205 - protein, 17 aa, Mycobacterium tuberculosis
TLIVFVAMTLAAGLLIS

SEQ ID NO: 1391206 - protein, 17 aa, Mycobacterium tuberculosis
TLLSSRFPALNAPAVAI

SEQ ID NO: 1391207 - protein, 35 aa, Mycobacterium tuberculosis
TLRTIYQNLGWAFGYNTAAIPLAALGALNPVVAGA

SEQ ID NO: 1391208 - protein, 29 aa, Mycobacterium tuberculosis
TLSLLASVSPLIRWIIKVPREFINDYLFN

SEQ ID NO: 1391209 - protein, 43 aa, Mycobacterium tuberculosis
TLTAFVYSTYQLFAGGPLFFDTSALIIAFVVLGRHLEARATGK

SEQ ID NO: 1391210 - protein, 37 aa, Mycobacterium tuberculosis; identical to SEQ ID NO: 164545

SEQ ID NO: 1391211 - protein, 21 aa, Mycobacterium tuberculosis
TPMVWVRPRQGPKLADLIAAP

SEQ ID NO: 1391212 - protein, 25 aa, Mycobacterium tuberculosis
TPRQPWAWLALLVAGLTVGLFITQG

SEQ ID NO: 1391213 - protein, 28 aa, Mycobacterium tuberculosis
TPSIAVLLGRWFWWPQRVRPRPASRMLR

SEQ ID NO: 1391214 - protein, 25 aa, Mycobacterium tuberculosis
TSAFWAFGVFYLVASVLTWAIYVRR

SEQ ID NO: 1391215 - protein, 23 aa, Mycobacterium tuberculosis
TSAVTLLSSLLLICVVAYHAAPA

SEQ ID NO: 1391216 - protein, 17 aa, Mycobacterium tuberculosis
TTKLPPFATRTDSVLLV

SEQ ID NO: 1391217 - protein, 20 aa, Mycobacterium tuberculosis
TVAASLLAGLLAHVADRLLG

SEQ ID NO: 1391218 - protein, 25 aa, Mycobacterium tuberculosis
TVAITFLGMVFTQLGILKTVGPMLG

SEQ ID NO: 1391219 - protein, 47 aa, Mycobacterium tuberculosis
TVLAVIAVVVLGWYFLRIPSLVGIGRYTLYAELPRSGGLYRTANVTY

SEQ ID NO: 1391220 - protein, 32 aa, Mycobacterium tuberculosis; identical to SEQ ID NO: 1380463

SEQ ID NO: 1391221 - protein, 34 aa, Mycobacterium tuberculosis
TVSMGIILLGLLWYAGLPLRVFLSSLAAVVVSAA

SEQ ID NO: 1391222 - protein, 26 aa, Mycobacterium tuberculosis
TVVVRWPLPVLVATCAIALVGLLALP

SEQ ID NO: 1391223 - protein, 21 aa, Mycobacterium tuberculosis
TWPVDRPFAMLTVARSLMLDV

SEQ ID NO: 1391224 - protein, 25 aa, Mycobacterium tuberculosis
TYGDFQNFYLCDLQIKWNGFQAGGP

SEQ ID NO: 1391225 - protein, 22 aa, Mycobacterium tuberculosis
VAAYLLLRMFNFTLTSVAAPAL

SEQ ID NO: 1391226 - protein, 22 aa, Mycobacterium tuberculosis
VATFAGWTLIAANPVAGMTAAV

SEQ ID NO: 1391227 - protein, 30 aa, Mycobacterium tuberculosis
VAVTFIAGLVVWDLAFTLPLPLGVARHEGS

SEQ ID NO: 1391228 - protein, 23 aa, Mycobacterium tuberculosis
VAVTPLLTPWLSKQLALGPRPDI

SEQ ID NO: 1391229 - protein, 26 aa, Mycobacterium tuberculosis
VDSGTWLAWVAWAALGLGVVALVVTK

SEQ ID NO: 1391230 - protein, 21 aa, Mycobacterium tuberculosis
VDVVYQFIPVLKANGYRLVTV

SEQ ID NO: 1391231 - protein, 18 aa, Mycobacterium tuberculosis
VEALFRPMHDRLASAVVA

SEQ ID NO: 1391232 - protein, 31 aa, Mycobacterium tuberculosis
VEGLAALIFSRYLWAFELTSALLITAAVGAM

SEQ ID NO: 1391233 - protein, 23 aa, Mycobacterium tuberculosis
VEHLRWYDYPLAAALSLVVLFTL

SEQ ID NO: 1391234 - protein, 34 aa, Mycobacterium tuberculosis; identical to SEQ ID NO: 164012

SEQ ID NO: 1391235 - protein, 25 aa, Mycobacterium tuberculosis
VFASGLLAMFPIAALGALVVYAALR

SEQ ID NO: 1391236 - protein, 23 aa, Mycobacterium tuberculosis
VFMNGWYYLTRREDVLAALRNPK

SEQ ID NO: 1391237 - protein, 22 aa, Mycobacterium tuberculosis
VGGWLLVVGLTLACAGLLWSDR

SEQ ID NO: 1391238 - protein, 22 aa, Mycobacterium tuberculosis
VGTAVVRWPGPILATSVALALV

SEQ ID NO: 1391239 - protein, 18 aa, Mycobacterium tuberculosis
VGTHAYWLGAQWWHPLVV

SEQ ID NO: 1391240 - protein, 24 aa, Mycobacterium tuberculosis
VGTKPQWWHTLVMSMSLTAGRGPG

SEQ ID NO: 1391241 - protein, 30 aa, Mycobacterium tuberculosis
VGTVLGHRYRVGPPVLLILSGSLLGLIPRF

SEQ ID NO: 1391242 - protein, 21 aa, Mycobacterium tuberculosis
VHLILWDIGGALLATLYGLAN

SEQ ID NO: 1391243 - protein, 27 aa, Mycobacterium tuberculosis
VILAPQGLDYIVAFLGALQAGLIAVPL

SEQ ID NO: 1391244 - protein, 33 aa, Mycobacterium tuberculosis
VLFTLVEIGQFIRWLFRFLVGQVDRIAPFRVSA

SEQ ID NO: 1391245 - protein, 17 aa, Mycobacterium tuberculosis
VLFVMLGLSATGVLVGG

SEQ ID NO: 1391246 - protein, 19 aa, Mycobacterium tuberculosis
VLLLLFGLAFPLGWLDAPD

SEQ ID NO: 1391247 - protein, 27 aa, Mycobacterium tuberculosis
VLLVIGALVVWWGWRERRDLFSGFGWL

SEQ ID NO: 1391248 - protein, 17 aa, Mycobacterium tuberculosis
VLMLWLPGNNLVVAFVG

SEQ ID NO: 1391249 - protein, 29 aa, Mycobacterium tuberculosis
VLPVLTLMVVAVWLLGVGTLKDLALVQLI

SEQ ID NO: 1391250 - protein, 23 aa, Mycobacterium tuberculosis
VLRESLYNVPHRSPRRPWLAPLE

SEQ ID NO: 1391251 - protein, 19 aa, Mycobacterium tuberculosis
VLSGFLITSLLLDELGRTG

SEQ ID NO: 1391252 - protein, 27 aa, Mycobacterium tuberculosis
VLSTRDTWLLSLLYLGTFGSFIGFSFV

SEQ ID NO: 1391253 - protein, 18 aa, Mycobacterium tuberculosis
VLTGRRGWIAPRRDLTRR

SEQ ID NO: 1391254 - protein, 29 aa, Mycobacterium tuberculosis
VLVADGHPWRWFLIGFMVLFHLNILSNLP

SEQ ID NO: 1391255 - protein, 30 aa, Mycobacterium tuberculosis
VLVIAYCLGLGIPFVLLAFGSAWAVAGLGW

SEQ ID NO: 1391256 - protein, 22 aa, Mycobacterium tuberculosis
VMHHRTVWTVIAILALFGWPQV

SEQ ID NO: 1391257 - protein, 56 aa, Mycobacterium tuberculosis
VNKVWSPQFSLWLVPLAVLALPHRRILLAWMTIDALVWVPRMYYLYGNPSRSLPEQ

SEQ ID NO: 1391258 - protein, 28 aa, Mycobacterium tuberculosis
VPFGEYVPLRPLFGWITRYSKAAAKDRQ

SEQ ID NO: 1391259 - protein, 17 aa, Mycobacterium tuberculosis
VPVIVVCGFLLGVAGQV

SEQ ID NO: 1391260 - protein, 28 aa, Mycobacterium tuberculosis
VPWSNSFPKWRWSLTTALLELTVLVLLL

SEQ ID NO: 1391261 - protein, 17 aa, Mycobacterium tuberculosis
VRCTVLVTVLAIAAAVA

SEQ ID NO: 1391262 - protein, 17 aa, Mycobacterium tuberculosis
VRELIEITLVKNPAMRY

SEQ ID NO: 1391263 - protein, 21 aa, Mycobacterium tuberculosis
VRQVMWPKIGGSQVLHDAFPP

SEQ ID NO: 1391264 - protein, 24 aa, Mycobacterium tuberculosis
VRRRRPWRGVLLTLAAVAVVASIG

SEQ ID NO: 1391265 - protein, 32 aa, Mycobacterium tuberculosis
VRTPRPQLTAAFGGALWAARRPGDTSATVLTA

SEQ ID NO: 1391266 - protein, 25 aa, Mycobacterium tuberculosis
VSAWLITRAWQMPPVLDLSVAVVAV

SEQ ID NO: 1391267 - protein, 20 aa, Mycobacterium tuberculosis
VSMQYSFLPSWLSFLVDKEN

SEQ ID NO: 1391268 - protein, 17 aa, Mycobacterium tuberculosis
VSTRILGGLVVIMPLYA

SEQ ID NO: 1391269 - protein, 24 aa, Mycobacterium tuberculosis
VTAAYVLITFWQYRNACVTAPGLG

SEQ ID NO: 1391270 - protein, 18 aa, Mycobacterium tuberculosis
VTEFVLLAMAVAVAVLVD

SEQ ID NO: 1391271 - protein, 22 aa, Mycobacterium tuberculosis
VTLLFVLCCAAIAYIALTAPHR

SEQ ID NO: 1391272 - protein, 25 aa, Mycobacterium tuberculosis
VTSHAVLIGWRAVPRRHGGELPRRG

SEQ ID NO: 1391273 - protein, 34 aa, Mycobacterium tuberculosis
VTVAVIFIMLLLVYRSIITVVLLLITVGVELTAA

SEQ ID NO: 1391274 - protein, 24 aa, Mycobacterium tuberculosis
VTVVFGVLRWFFTTYRIDDENVSL

SEQ ID NO: 1391275 - protein, 21 aa, Mycobacterium tuberculosis
VVAVLLWIVAALIVGSVVYLS

SEQ ID NO: 1391276 - protein, 23 aa, Mycobacterium tuberculosis
VVIGSLVVVLALAAGIVGVRLYQ

SEQ ID NO: 1391277 - protein, 41 aa, Mycobacterium tuberculosis
VVLQSILAVAFGAGLFIAFDQLWRWNSIVALVLSVMVILGL

SEQ ID NO: 1391278 - protein, 17 aa, Mycobacterium tuberculosis
VVMIIHCYYGYTASGGP

SEQ ID NO: 1391279 - protein, 23 aa, Mycobacterium tuberculosis
VVRGLKALLATVVLAVVGIGLGL

SEQ ID NO: 1391280 - protein, 30 aa, Mycobacterium tuberculosis
VVTRNREVWAWMVWLPHNLHDELFDACGWR

SEQ ID NO: 1391281 - protein, 17 aa, Mycobacterium tuberculosis
VVVGRRKLVDEQHLVLP

SEQ ID NO: 1391282 - protein, 18 aa, Mycobacterium tuberculosis
VVYDMWGAAVSLAYQMHS

SEQ ID NO: 1391283 - protein, 27 aa, Mycobacterium tuberculosis
VVYNLPKMVSLLVEPWYALVGERERVL

SEQ ID NO: 1391284 - protein, 25 aa, Mycobacterium tuberculosis
WAETTVIIRFWLLTAITCGLGVALF

SEQ ID NO: 1391285 - protein, 31 aa, Mycobacterium tuberculosis
WAQTPRKTNPWPFVAVAAAVVLVLVLGAIGI

SEQ ID NO: 1391286 - protein, 20 aa, Mycobacterium tuberculosis
WASVQLLALISVSVVAASVV

SEQ ID NO: 1391287 - protein, 18 aa, Mycobacterium tuberculosis
WCGWVLFEKHQTDVAAGQ

SEQ ID NO: 1391288 - protein, 18 aa, Mycobacterium tuberculosis
WERRPGAADFCRIRVGVG

SEQ ID NO: 1391289 - protein, 27 aa, Mycobacterium tuberculosis
WGLMKPIVLAWVITLPSAAILASVGLV

SEQ ID NO: 1391290 - protein, 19 aa, Mycobacterium tuberculosis
WIPMVIVIVVAVAAVTVLN

SEQ ID NO: 1391291 - protein, 18 aa, Mycobacterium tuberculosis
WPPALSVGMWLLAVASVI

SEQ ID NO: 1391292 - protein, 23 aa, Mycobacterium tuberculosis
WQVSGRLLFALLSFSVVGAVLAL

SEQ ID NO: 1391293 - protein, 32 aa, Mycobacterium tuberculosis
WSLQVRPYAGERWWVLLLSLATAAVLTVLAYR

SEQ ID NO: 1391294 - protein, 29 aa, Mycobacterium tuberculosis
WSLVSPRLPAPWRIPLQAGLGSVLVLVTR

SEQ ID NO: 1391295 - protein, 18 aa, Mycobacterium tuberculosis
WTGVGVMLLAWLGLGRRV

SEQ ID NO: 1391296 - protein, 27 aa, Mycobacterium tuberculosis
WVMAGFTGLPRRASTVALVALVAAQLG

SEQ ID NO: 1391297 - protein, 27 aa, Mycobacterium tuberculosis
YAGRRETWLIMRLPVIGNTQALRWRTS

SEQ ID NO: 1391298 - protein, 21 aa, Mycobacterium tuberculosis
YALSFQIYLALPMQASILMPR

SEQ ID NO: 1391299 - protein, 31 aa, Mycobacterium tuberculosis
YCYGLTHVLYLNYVWHYSLLKAGFAIAPAAV

SEQ ID NO: 1391300 - protein, 19 aa, Mycobacterium tuberculosis
YFRMGWWSIIGYAAAAIIG

SEQ ID NO: 1391301 - protein, 34 aa, Mycobacterium tuberculosis
YGIVRFDLQLLGPGPRWWGLALLAVGGTSALYGV

SEQ ID NO: 1391302 - protein, 28 aa, Mycobacterium tuberculosis
YGNGAFLSQLFGAILRPLGQPANEIIET

SEQ ID NO: 1391303 - protein, 17 aa, Mycobacterium tuberculosis
YIWGVRVGGLFAALGVT

SEQ ID NO: 1391304 - protein, 21 aa, Mycobacterium tuberculosis
YLLMYVRRYYGGRIAHLVQHD

SEQ ID NO: 1391305 - protein, 30 aa, Mycobacterium tuberculosis
YLREFGNLVFHFALLGLLVAVAVGKLFGYE

SEQ ID NO: 1391306 - protein, 20 aa, Mycobacterium tuberculosis
YRRILQPYFSPAALSKALPS

SEQ ID NO: 1391307 - protein, 23 aa, Mycobacterium tuberculosis
YTDPVPFPSFKNGVGLMLQLPQA

SEQ ID NO: 1391308 - protein, 18 aa, Mycobacterium tuberculosis
AAALAWLVDEMEQRYQDM

SEQ ID NO: 1391309 - protein, 34 aa, Mycobacterium tuberculosis
AAAPATLLLPLLWRMPDTARWYLLKGRIADARSA

SEQ ID NO: 1391310 - protein, 33 aa, Mycobacterium tuberculosis
AAARTIHALSLPIILFWVALTIVVNVVAPQLQS

SEQ ID NO: 1391311 - protein, 21 aa, Mycobacterium tuberculosis
AAASQLPPFTPPPATTSGAGS

SEQ ID NO: 1391312 - protein, 33 aa, Mycobacterium tuberculosis
AAATPGWLEWFINWYLPISQLFYNTVGLPYFAI

SEQ ID NO: 1391313 - protein, 26 aa, Mycobacterium tuberculosis
AAAWLHAAVWWKALLALAVAVALVIG

SEQ ID NO: 1391314 - protein, 30 aa, Mycobacterium tuberculosis
AAAWRWRLPRCWVTWWRPRRWRVRRAWFRA

SEQ ID NO: 1391315 - protein, 17 aa, Mycobacterium tuberculosis
AADAILVPPGDGPWRLG

SEQ ID NO: 1391316 - protein, 35 aa, Mycobacterium tuberculosis
AADRQYAVFLLVLPLLLSLFAHAVPGQAGLSLAKA

SEQ ID NO: 1391317 - protein, 23 aa, Mycobacterium tuberculosis
AAEPLYLLFDIAVVGRLGAISLA

SEQ ID NO: 1391318 - protein, 28 aa, Mycobacterium tuberculosis
AAGIVMFLGYIALFALVLYMHAGILTGC

SEQ ID NO: 1391319 - protein, 17 aa, Mycobacterium tuberculosis
AAGLIFAASMSGLLFSS

SEQ ID NO: 1391320 - protein, 29 aa, Mycobacterium tuberculosis
AAGMRLTVLLALLANLFLPWGIAGAAPTA

SEQ ID NO: 1391321 - protein, 26 aa, Mycobacterium tuberculosis
AAGRLGWPLWAAYITVFALTVLVGAR

SEQ ID NO: 1391322 - protein, 27 aa, Mycobacterium tuberculosis
AAGRLGWPLWAAYITVFALTVLVGARL

SEQ ID NO: 1391323 - protein, 18 aa, Mycobacterium tuberculosis
AAGYLVLRPSWSPTQASG

SEQ ID NO: 1391324 - protein, 26 aa, Mycobacterium tuberculosis
AAIGPLPPVTLLPRRTPGSSGIADVP

SEQ ID NO: 1391325 - protein, 36 aa, Mycobacterium tuberculosis
AAILVTTIFGFVWYSHSIFGLDSLGEWLRHPYCALP

SEQ ID NO: 1391326 - protein, 20 aa, Mycobacterium tuberculosis
AAIPAPWPVLATLPSGPELS

SEQ ID NO: 1391327 - protein, 25 aa, Mycobacterium tuberculosis
AAISLILIIMMIITRSVVAAVVIVG

SEQ ID NO: 1391328 - protein, 17 aa, Mycobacterium tuberculosis
AAIVRWPGPILVGAVAL

SEQ ID NO: 1391329 - protein, 19 aa, Mycobacterium tuberculosis
AALATLISIPVVSQLLGCT

SEQ ID NO: 1391330 - protein, 22 aa, Mycobacterium tuberculosis
AALATLISIPVVSQLLGCTPLD

SEQ ID NO: 1391331 - protein, 17 aa, Mycobacterium tuberculosis
AALAVAVLARWRFRRRP

SEQ ID NO: 1391332 - protein, 19 aa, Mycobacterium tuberculosis
AALAYAVDVKNAVIVAAAG

SEQ ID NO: 1391333 - protein, 17 aa, Mycobacterium tuberculosis
AALGWFYLSVLPGWLGL

SEQ ID NO: 1391334 - protein, 17 aa, Mycobacterium tuberculosis
AALLLAAGVLLWLFVRH

SEQ ID NO: 1391335 - protein, 25 aa, Mycobacterium tuberculosis
AALSAWGLYRFNQILAGLSAAIPPN

SEQ ID NO: 1391336 - protein, 19 aa, Mycobacterium tuberculosis
AALYLVCLPALRRGAWSRA

SEQ ID NO: 1391337 - protein, 18 aa, Mycobacterium tuberculosis
AAMGCAFVALLRPQSALG

SEQ ID NO: 1391338 - protein, 17 aa, Mycobacterium tuberculosis
AAMLLVVTLIAGPLLFV

SEQ ID NO: 1391339 - protein, 21 aa, Mycobacterium tuberculosis
AAMMKATLPRAFIIGPDGSTT

SEQ ID NO: 1391340 - protein, 25 aa, Mycobacterium tuberculosis
AAPTTPGRLIWPSTAIRPLPGRPTS

SEQ ID NO: 1391341 - protein, 21 aa, Mycobacterium tuberculosis
AAPTWLKTVPKRLSALLNTSG

SEQ ID NO: 1391342 - protein, 17 aa, Mycobacterium tuberculosis
AARRAHAIGLWGAAAAI

SEQ ID NO: 1391343 - protein, 30 aa, Mycobacterium tuberculosis
AARRGLPTLRRPWRRSPGATIIVVPPSPNA

SEQ ID NO: 1391344 - protein, 19 aa, Mycobacterium tuberculosis
AATAFLLTAGVPLIVETWC

SEQ ID NO: 1391345 - protein, 20 aa, Mycobacterium tuberculosis
AAVAFIARGIFLGRPVTAMH

SEQ ID NO: 1391346 - protein, 19 aa, Mycobacterium tuberculosis
AAVIATLLLWHVIGATSSD

SEQ ID NO: 1391347 - protein, 21 aa, Mycobacterium tuberculosis
AAVLLTGAFVLGWTRFPRTPA

SEQ ID NO: 1391348 - protein, 17 aa, Mycobacterium tuberculosis
AAVLMVALLVLASVLSR

SEQ ID NO: 1391349 - protein, 27 aa, Mycobacterium tuberculosis
AAVLVLFTLIFFLYGGRSIWQYVTKAF

SEQ ID NO: 1391350 - protein, 28 aa, Mycobacterium tuberculosis
AAVLVLFTLIFFLYGGRSIWQYVTKAFP

SEQ ID NO: 1391351 - protein, 18 aa, Mycobacterium tuberculosis
AAVWAVGLVAGLVALTIG

SEQ ID NO: 1391352 - protein, 27 aa, Mycobacterium tuberculosis
AAWTAAGMFLAVWLPLDDGLRPEPIIA

SEQ ID NO: 1391353 - protein, 26 aa, Mycobacterium tuberculosis
AAWTAAGMFLAVWLPLDNGLRPEPII

SEQ ID NO: 1391354 - protein, 24 aa, Mycobacterium tuberculosis
AAYDQYLSALLPNSLRWLGFGSSS

SEQ ID NO: 1391355 - protein, 21 aa, Mycobacterium tuberculosis
AAYLITGGLGALGLLMADWLA

SEQ ID NO: 1391356 - protein, 20 aa, Mycobacterium tuberculosis
ACIVAFWFLGFDTAGSPVWV

SEQ ID NO: 1391357 - protein, 31 aa, Mycobacterium tuberculosis
ACKAWLLAQPYLVAGVLLVFYTATGRYVAAF

SEQ ID NO: 1391358 - protein, 28 aa, Mycobacterium tuberculosis
ADAPVGIIALWALALLIIGTGIGIAWPH

SEQ ID NO: 1391359 - protein, 24 aa, Mycobacterium tuberculosis
ADFEDFFRPIRSYFYWEKHCFDVP

SEQ ID NO: 1391360 - protein, 22 aa, Mycobacterium tuberculosis
ADHSMIFVFIAGSYTPFALLAL

SEQ ID NO: 1391361 - protein, 23 aa, Mycobacterium tuberculosis
ADMQVFARVSPEQRFRLWRRCSA

SEQ ID NO: 1391362 - protein, 23 aa, Mycobacterium tuberculosis
ADQRVLAIRLTNGSSLLISKSLK

SEQ ID NO: 1391363 - protein, 32 aa, Mycobacterium tuberculosis
ADRQYAVFLLVLPLLLSLFAHAVPGQAGLSLA

SEQ ID NO: 1391364 - protein, 18 aa, Mycobacterium tuberculosis
ADSHLLGVIAFRALVLAN

SEQ ID NO: 1391365 - protein, 26 aa, Mycobacterium tuberculosis
ADSLPSRIIASPSTVLFAIVVDFAIT

SEQ ID NO: 1391366 - protein, 31 aa, Mycobacterium tuberculosis
ADVVGCSMRLPFLYAPLPYGGTLHVDGGVLD

SEQ ID NO: 1391367 - protein, 20 aa, Mycobacterium tuberculosis
AEAPLYYQIHVLIGLALFAL

SEQ ID NO: 1391368 - protein, 24 aa, Mycobacterium tuberculosis
AEAPLYYQIHVLIGLALFALWPFT

SEQ ID NO: 1391369 - protein, 21 aa, Mycobacterium tuberculosis
AELLALFAGSVLRGADLATLL

SEQ ID NO: 1391370 - protein, 40 aa, Mycobacterium tuberculosis
AERSVAVWLLLGGVFGLALLLIFLFWPWEFKAADGESDFI

SEQ ID NO: 1391371 - protein, 27 aa, Mycobacterium tuberculosis
AETERIWLPFTIWLTAAPALLPPRSHR

SEQ ID NO: 1391372 - protein, 18 aa, Mycobacterium tuberculosis
AETTVIIRFWLLTAITCG

SEQ ID NO: 1391373 - protein, 24 aa, Mycobacterium tuberculosis
AEVIRLIRRLLPALVVVLAGCALL

SEQ ID NO: 1391374 - protein, 28 aa, Mycobacterium tuberculosis
AEVSAWLITRAWQMPPVLDLSVAVVAVR

SEQ ID NO: 1391375 - protein, 18 aa, Mycobacterium tuberculosis
AFAFIPFGPEVSVFGHRT

SEQ ID NO: 1391376 - protein, 25 aa, Mycobacterium tuberculosis
AFAGAAICLLALMATLATASRRLRP

SEQ ID NO: 1391377 - protein, 18 aa, Mycobacterium tuberculosis
AFAIPTYAFIAGIGTMLV

SEQ ID NO: 1391378 - protein, 18 aa, Mycobacterium tuberculosis
AFALIGAAIVLFLSQRAD

SEQ ID NO: 1391379 - protein, 20 aa, Mycobacterium tuberculosis
AFAYLLLPQVLVYGLSSVFM

SEQ ID NO: 1391380 - protein, 21 aa, Mycobacterium tuberculosis
AFEVVGRRRLWFGVSGAIVAV

SEQ ID NO: 1391381 - protein, 26 aa, Mycobacterium tuberculosis
AFFTPRFVRWFGLFTTHAIVAAALAS

SEQ ID NO: 1391382 - protein, 21 aa, Mycobacterium tuberculosis
AFGLGVLTRPSPPPTVAEQVL

SEQ ID NO: 1391383 - protein, 36 aa, Mycobacterium tuberculosis; identical to SEQ ID NO: 164615

SEQ ID NO: 1391384 - protein, 19 aa, Mycobacterium tuberculosis
AFLILFATLMAAAGVGVSI

SEQ ID NO: 1391385 - protein, 23 aa, Mycobacterium tuberculosis
AFTSYPLSPVRMLQPLQPRWSVR

SEQ ID NO: 1391386 - protein, 19 aa, Mycobacterium tuberculosis
AFVALLRPQSALGQAPIVM

SEQ ID NO: 1391387 - protein, 25 aa, Mycobacterium tuberculosis
AFYLFSCRSLTRSAWRLGMFANRWI

SEQ ID NO: 1391388 - protein, 24 aa, Mycobacterium tuberculosis
AGALGFVVIFWQGVGWAAGGVDGV

SEQ ID NO: 1391389 - protein, 22 aa, Mycobacterium tuberculosis
AGALLIKPLLAHAAIAFIAVEA

SEQ ID NO: 1391390 - protein, 23 aa, Mycobacterium tuberculosis
AGAMYCLGFTRLPYFNTLASPCA

SEQ ID NO: 1391391 - protein, 20 aa, Mycobacterium tuberculosis
AGAWVPLAFPALVAARSGAT

SEQ ID NO: 1391392 - protein, 20 aa, Mycobacterium tuberculosis
AGEVTLLPSPMFHALGYMHA

SEQ ID NO: 1391393 - protein, 21 aa, Mycobacterium tuberculosis
AGFGAFLAFLDSTIVNIAFPD

SEQ ID NO: 1391394 - protein, 23 aa, Mycobacterium tuberculosis
AGGIFVLLWHLLVVTNIDNVLRP

SEQ ID NO: 1391395 - protein, 27 aa, Mycobacterium tuberculosis
AGGTVRNWPWRRLVLSKTANTYSRLAL

SEQ ID NO: 1391396 - protein, 25 aa, Mycobacterium tuberculosis
AGIALPFLVWVWLRHLRERRGYRAG

SEQ ID NO: 1391397 - protein, 26 aa, Mycobacterium tuberculosis
AGIALPFLVWVWLRHLRERRGYRPVQ

SEQ ID NO: 1391398 - protein, 30 aa, Mycobacterium tuberculosis
AGISALCLIFIIMLIITRSVVAAAVIVGTV

SEQ ID NO: 1391399 - protein, 24 aa, Mycobacterium tuberculosis
AGKDLPVVGFIWEVLGRIGIGRKD

SEQ ID NO: 1391400 - protein, 24 aa, Mycobacterium tuberculosis
AGKTTLLMTLAGLLPPVHGRVLLD

SEQ ID NO: 1391401 - protein, 25 aa, Mycobacterium tuberculosis
AGLGLALLILPVIGLWAMIATLRAG

SEQ ID NO: 1391402 - protein, 26 aa, Mycobacterium tuberculosis
AGLGLVLVFALVVALVYLQFRGEFTP

SEQ ID NO: 1391403 - protein, 18 aa, Mycobacterium tuberculosis
AGLLLCGIVPLLPVNQTT

SEQ ID NO: 1391404 - protein, 20 aa, Mycobacterium tuberculosis
AGLLLGRWIPGLHTALEGVQ

SEQ ID NO: 1391405 - protein, 26 aa, Mycobacterium tuberculosis
AGLVLALLSAPWLIAVGAICIAGAWL

SEQ ID NO: 1391406 - protein, 20 aa, Mycobacterium tuberculosis
AGLVPLHAWLPRAHPEAPSP

SEQ ID NO: 1391407 - protein, 25 aa, Mycobacterium tuberculosis
AGMRLTVLLALLANLFLPWGIAGAA

SEQ ID NO: 1391408 - protein, 24 aa, Mycobacterium tuberculosis
AGNGWRVSGLLRIDEVASATGYRA

SEQ ID NO: 1391409 - protein, 31 aa, Mycobacterium tuberculosis
AGPLGLCFLPAFLCVGIVPLVVGLAGDVLQF

SEQ ID NO: 1391410 - protein, 33 aa, Mycobacterium tuberculosis
AGPMLVLLAAGLGVLWLPAGWLAHRLLSVPVTT

SEQ ID NO: 1391411 - protein, 34 aa, Mycobacterium tuberculosis
AGPMLVLLAAGLGVLWLPAGWLAHRLLSVPVTTC

SEQ ID NO: 1391412 - protein, 35 aa, Mycobacterium tuberculosis
AGPVARLWRGLLVFFSRWWQLETLYRSNMKYQPEW

SEQ ID NO: 1391413 - protein, 20 aa, Mycobacterium tuberculosis
AGRDLPPVPVLLVIVDEYLE

SEQ ID NO: 1391414 - protein, 25 aa, Mycobacterium tuberculosis
AGRLGWPLWAAYITVFALTVLVGAR

SEQ ID NO: 1391415 - protein, 25 aa, Mycobacterium tuberculosis
AGSAVLIILLPPGRRRLAKWAGMVV

SEQ ID NO: 1391416 - protein, 20 aa, Mycobacterium tuberculosis
AGSIAVVAWLIAAAALVVLA

SEQ ID NO: 1391417 - protein, 25 aa, Mycobacterium tuberculosis
AGTATVTRLALAIAAIASAANRPLR

SEQ ID NO: 1391418 - protein, 23 aa, Mycobacterium tuberculosis
AGTIVGYYILRRALRPDGGQLIG

SEQ ID NO: 1391419 - protein, 31 aa, Mycobacterium tuberculosis
AGTMLLRLCMLPGLALLVWATPRLASHLGTH

SEQ ID NO: 1391420 - protein, 24 aa, Mycobacterium tuberculosis
AGVEELLRINLSFADGLPRLATAD

SEQ ID NO: 1391421 - protein, 38 aa, Mycobacterium tuberculosis
AGVLTFVLMLARRGVWWAWWPRLWRCALPDRCDPGAAG

SEQ ID NO: 1391422 - protein, 17 aa, Mycobacterium tuberculosis
AGVWMRLPATLAGIACW

SEQ ID NO: 1391423 - protein, 23 aa, Mycobacterium tuberculosis
AGWALGYLYFLVCLCVFRPPSIF

SEQ ID NO: 1391424 - protein, 25 aa, Mycobacterium tuberculosis
AGWLVHVLLDPRRVRWIVGERADTN

SEQ ID NO: 1391425 - protein, 30 aa, Mycobacterium tuberculosis
AHQGLTWAAGLLYPAFCIGAILGNSLSPLI

SEQ ID NO: 1391426 - protein, 19 aa, Mycobacterium tuberculosis
AIAAIASAANRPLRRVKLG

SEQ ID NO: 1391427 - protein, 18 aa, Mycobacterium tuberculosis
AIAALLLHVLAHGIGKTV

SEQ ID NO: 1391428 - protein, 27 aa, Mycobacterium tuberculosis
AIAANFRDIMITLGMFTHDALLGGEGA

SEQ ID NO: 1391429 - protein, 28 aa, Mycobacterium tuberculosis
AIAPRLVPRTPLAPVLPAPSFPADATVA

SEQ ID NO: 1391430 - protein, 23 aa, Mycobacterium tuberculosis
AIFVDVALFALIGIGLAVILSYI

SEQ ID NO: 1391431 - protein, 32 aa, Mycobacterium tuberculosis
AIGLFDTWPGLILPYITFALPLAIYTLSAFFR

SEQ ID NO: 1391432 - protein, 18 aa, Mycobacterium tuberculosis
AIGPDWRLVLRGGPAEVV

SEQ ID NO: 1391433 - protein, 20 aa, Mycobacterium tuberculosis
AIHFLVVGYLFYWAIIGIDP

SEQ ID NO: 1391434 - protein, 18 aa, Mycobacterium tuberculosis
AIIFVYVFVALLVNREKL

SEQ ID NO: 1391435 - protein, 27 aa, Mycobacterium tuberculosis
AIIGLERQWRARMAGLRTNALVATGAT

SEQ ID NO: 1391436 - protein, 18 aa, Mycobacterium tuberculosis
AILAGHLHYSTNATFVGI

SEQ ID NO: 1391437 - protein, 27 aa, Mycobacterium tuberculosis
AILDYLQGAVWVLPTFGVAIGLGSGAV

SEQ ID NO: 1391438 - protein, 17 aa, Mycobacterium tuberculosis
AILMLYTIVIIRGLRTA

SEQ ID NO: 1391439 - protein, 17 aa, Mycobacterium tuberculosis
AILYWESMNTSFREIRW

SEQ ID NO: 1391440 - protein, 18 aa, Mycobacterium tuberculosis
AIMVHLARIFFTGAFRRP

SEQ ID NO: 1391441 - protein, 18 aa, Mycobacterium tuberculosis
AIPVLIVGTVVWVGITND

SEQ ID NO: 1391442 - protein, 19 aa, Mycobacterium tuberculosis
AIPVLIVGTVVWVGITNDR

SEQ ID NO: 1391443 - protein, 27 aa, Mycobacterium tuberculosis
AIRIGRRIVARLNWIKQGPAPAPVTEP

SEQ ID NO: 1391444 - protein, 19 aa, Mycobacterium tuberculosis
AIRYQIVVMYLLLAATAVA

SEQ ID NO: 1391445 - protein, 28 aa, Mycobacterium tuberculosis
AISSLCLIFIIMLIITRAFIAAAVIVGT

SEQ ID NO: 1391446 - protein, 31 aa, Mycobacterium tuberculosis
AIVQPFGEYLPMPWLFRHLSGYADRAGHFVP

SEQ ID NO: 1391447 - protein, 20 aa, Mycobacterium tuberculosis
AIYLVLGMIILHSAAASGMD

SEQ ID NO: 1391448 - protein, 17 aa, Mycobacterium tuberculosis
AKALARHFGARRKAYNW

SEQ ID NO: 1391449 - protein, 20 aa, Mycobacterium tuberculosis
AKCKCCWIIHAWTRAARPTS

SEQ ID NO: 1391450 - protein, 25 aa, Mycobacterium tuberculosis
AKQFALVFLLVLFLAPTLNGWFFGW

SEQ ID NO: 1391451 - protein, 20 aa, Mycobacterium tuberculosis
AKVVLALQHDKLPPSINFAG

SEQ ID NO: 1391452 - protein, 20 aa, Mycobacterium tuberculosis
ALAAHRRAHGLPAISLGWGL

SEQ ID NO: 1391453 - protein, 22 aa, Mycobacterium tuberculosis
ALAALSWAWGWLPLDAGSGINP

SEQ ID NO: 1391454 - protein, 20 aa, Mycobacterium tuberculosis
ALAERLFNRWGVRAVFLGRF

SEQ ID NO: 1391455 - protein, 20 aa, Mycobacterium tuberculosis
ALAGGPWDWARWAPASPWAT

SEQ ID NO: 1391456 - protein, 28 aa, Mycobacterium tuberculosis
ALAGLVLALLSAPWLIAVGAICIAGAWL

SEQ ID NO: 1391457 - protein, 22 aa, Mycobacterium tuberculosis
ALAGVYLLVHLALPAAMGAGDV

SEQ ID NO: 1391458 - protein, 19 aa, Mycobacterium tuberculosis
ALDLPPEPVVIPGDAARLH

SEQ ID NO: 1391459 - protein, 18 aa, Mycobacterium tuberculosis
ALFLGFMFAFAIKAPLWP

SEQ ID NO: 1391460 - protein, 18 aa, Mycobacterium tuberculosis
ALGRMESKPLRRGHKMII

SEQ ID NO: 1391461 - protein, 39 aa, Mycobacterium tuberculosis
ALGVFVLVPLLEFAVVLELAILSIGWIISNIFGAIPVLG

SEQ ID NO: 1391462 - protein, 33 aa, Mycobacterium tuberculosis
ALGVPSVLLYRLLTCWLPVFAGWQVMHWLTRHE

SEQ ID NO: 1391463 - protein, 28 aa, Mycobacterium tuberculosis
ALIEADGWRWVFLVNLPLGVFAVLAARA

SEQ ID NO: 1391464 - protein, 29 aa, Mycobacterium tuberculosis
ALIEADGWRWVFLVNLPLGVFAVLAARRA

SEQ ID NO: 1391465 - protein, 30 aa, Mycobacterium tuberculosis
ALIEADGWRWVFLVNLPLGVFAVLAARRAL

SEQ ID NO: 1391466 - protein, 34 aa, Mycobacterium tuberculosis
ALIEADGWRWVFLVNLPLGVFAVLAARRALVENR

SEQ ID NO: 1391467 - protein, 22 aa, Mycobacterium tuberculosis
ALINVFTAVTFAIVPLLHRFGG

SEQ ID NO: 1391468 - protein, 20 aa, Mycobacterium tuberculosis
ALLAALIRRPSTLDPAVDPE

SEQ ID NO: 1391469 - protein, 20 aa, Mycobacterium tuberculosis
ALLALTRAILIRVRNASWQH

SEQ ID NO: 1391470 - protein, 23 aa, Mycobacterium tuberculosis
ALLGQWRDDLRWPPASALVSQDE

SEQ ID NO: 1391471 - protein, 32 aa, Mycobacterium tuberculosis
ALLHATPEALFNPILMMALAALGIGSVSTLLV

SEQ ID NO: 1391472 - protein, 17 aa, Mycobacterium tuberculosis
ALLLPYTAYKEHVSPFV

SEQ ID NO: 1391473 - protein, 20 aa, Mycobacterium tuberculosis
ALLLVLLTNENGLGPADEAV

SEQ ID NO: 1391474 - protein, 20 aa, Mycobacterium tuberculosis
ALLSAPWLIAVGAICIAGAW

SEQ ID NO: 1391475 - protein, 23 aa, Mycobacterium tuberculosis
ALPTGCILAWILVRIINVRSFGW

SEQ ID NO: 1391476 - protein, 29 aa, Mycobacterium tuberculosis
ALSAFFTPQFVRWFGLFTTHAIVAAALAS

SEQ ID NO: 1391477 - protein, 17 aa, Mycobacterium tuberculosis
ALSAFFTPRFVRWFGLF

SEQ ID NO: 1391478 - protein, 34 aa, Mycobacterium tuberculosis
ALSASLGWILPVIAQLVWWAVHPQPPWPHLAAAA

SEQ ID NO: 1391479 - protein, 24 aa, Mycobacterium tuberculosis
ALSAWGLYRFNQILAGLSAAIPPN

SEQ ID NO: 1391480 - protein, 20 aa, Mycobacterium tuberculosis
ALSGMWGIPAVVAVATVGVV

SEQ ID NO: 1391481 - protein, 19 aa, Mycobacterium tuberculosis
ALSLLTPFAAFLLAQSLKC

SEQ ID NO: 1391482 - protein, 17 aa, Mycobacterium tuberculosis
ALSSWYVWAALGLYPST

SEQ ID NO: 1391483 - protein, 19 aa, Mycobacterium tuberculosis
ALSTICSTVWLSAAAYRLP

SEQ ID NO: 1391484 - protein, 20 aa, Mycobacterium tuberculosis
ALTMALLAAAVLYASVAVAD

SEQ ID NO: 1391485 - protein, 23 aa, Mycobacterium tuberculosis
ALTPIAAGPRRARSGAGTGLAGV

SEQ ID NO: 1391486 - protein, 26 aa, Mycobacterium tuberculosis
ALTTAFLIIFTVLALVGYPLVWETAT

SEQ ID NO: 1391487 - protein, 42 aa, Mycobacterium tuberculosis
ALVALQLYDFLWYPYYASYGLLLLPFFTPTLSALTALSALIH

SEQ ID NO: 1391488 - protein, 20 aa, Mycobacterium tuberculosis
ALVLGLLVGAVTRGTASGPA

SEQ ID NO: 1391489 - protein, 19 aa, Mycobacterium tuberculosis
ALVLLFVGGALYSIGGILY

SEQ ID NO: 1391490 - protein, 25 aa, Mycobacterium tuberculosis
ALVLSAVYMLWLYQRVMTGPVAEGN

SEQ ID NO: 1391491 - protein, 27 aa, Mycobacterium tuberculosis
ALVLVLLLAAPLLRPGYLLLRDAVSTP

SEQ ID NO: 1391492 - protein, 21 aa, Mycobacterium tuberculosis
ALVSWIVTAAGIVWPIGNVCA

SEQ ID NO: 1391493 - protein, 17 aa, Mycobacterium tuberculosis
ALVVATALRLYTRWLGH

SEQ ID NO: 1391494 - protein, 20 aa, Mycobacterium tuberculosis
ALVYLQFRGEFTPKTQLTML

SEQ ID NO: 1391495 - protein, 18 aa, Mycobacterium tuberculosis
ALWAARRPGDTSATVLTA

SEQ ID NO: 1391496 - protein, 21 aa, Mycobacterium tuberculosis
ALWARFPLPVIPAPGDPTPSA

SEQ ID NO: 1391497 - protein, 24 aa, Mycobacterium tuberculosis
AMIAAIIPMLLWITGVYEKVRNIR

SEQ ID NO: 1391498 - protein, 27 aa, Mycobacterium tuberculosis
AMLMSPMSFLRRPARWMQLLATSGRCF

SEQ ID NO: 1391499 - protein, 28 aa, Mycobacterium tuberculosis
AMLPLLSLPILIFGLLSIGLMPLKLFPH

SEQ ID NO: 1391500 - protein, 19 aa, Mycobacterium tuberculosis
AMLTLYFILAVGAHVRVRD

SEQ ID NO: 1391501 - protein, 19 aa, Mycobacterium tuberculosis
AMMKATLPRAFIIGPDGST

SEQ ID NO: 1391502 - protein, 20 aa, Mycobacterium tuberculosis
AMPATAAFPPPAGPPPVTAA

SEQ ID NO: 1391503 - protein, 22 aa, Mycobacterium tuberculosis
AMPATAAFPPPAGPPPVTAAPA

SEQ ID NO: 1391504 - protein, 26 aa, Mycobacterium tuberculosis
AMSLPFFFFFFFLLFFFFSLFFMIFL

SEQ ID NO: 1391505 - protein, 21 aa, Mycobacterium tuberculosis
AMVFNLFFVNLVTVGLHSLCG

SEQ ID NO: 1391506 - protein, 20 aa, Mycobacterium tuberculosis
AMVFNLFFVNLVTVGLHSYA

SEQ ID NO: 1391507 - protein, 30 aa, Mycobacterium tuberculosis
ANAMGLALCIYIGSLLIYTPIHGETSRRHR

SEQ ID NO: 1391508 - protein, 25 aa, Mycobacterium tuberculosis
ANAYCRRWVTIGWYSPALPRLGIPR

SEQ ID NO: 1391509 - protein, 18 aa, Mycobacterium tuberculosis
ANDLLPPGGLIPSSRTSP

SEQ ID NO: 1391510 - protein, 22 aa, Mycobacterium tuberculosis
ANGRGRWLAIAASLVVSAAILY

SEQ ID NO: 1391511 - protein, 21 aa, Mycobacterium tuberculosis
ANHKKWIDLIIHIGQEGRGAN

SEQ ID NO: 1391512 - protein, 18 aa, Mycobacterium tuberculosis
ANHRYLGPVLWSPDVKPP

SEQ ID NO: 1391513 - protein, 17 aa, Mycobacterium tuberculosis
ANLAKMPHLLVAGSTGS

SEQ ID NO: 1391514 - protein, 17 aa, Mycobacterium tuberculosis
ANLLKRAVGPSLKWFDE

SEQ ID NO: 1391515 - protein, 26 aa, Mycobacterium tuberculosis
ANRADTPLLFLHNTTGYMVGKDYEEG

SEQ ID NO: 1391516 - protein, 23 aa, Mycobacterium tuberculosis
ANRLFIPRFLFSMGVIGVVAATS

SEQ ID NO: 1391517 - protein, 20 aa, Mycobacterium tuberculosis
ANRQVLMIFGDTFGYCAVDG

SEQ ID NO: 1391518 - protein, 20 aa, Mycobacterium tuberculosis
ANYYRWFGTPEAPFGWYYDL

SEQ ID NO: 1391519 - protein, 17 aa, Mycobacterium tuberculosis
APFTSLTRPHWVSDGGL

SEQ ID NO: 1391520 - protein, 24 aa, Mycobacterium tuberculosis
APIGYLFRPYIIYRSREELVLTRP

SEQ ID NO: 1391521 - protein, 22 aa, Mycobacterium tuberculosis
APMFSIIIPTLNVAAVLPACLD

SEQ ID NO: 1391522 - protein, 23 aa, Mycobacterium tuberculosis
APNILLLIIFRVVQGFGGGMLTP

SEQ ID NO: 1391523 - protein, 19 aa, Mycobacterium tuberculosis
APPSSVMMLWIVGVGLGRG

SEQ ID NO: 1391524 - protein, 28 aa, Mycobacterium tuberculosis
APQSIEPSRRWGLPLALTASAVVMAAAI

SEQ ID NO: 1391525 - protein, 25 aa, Mycobacterium tuberculosis
APRRIIGFAVFVFIAAAVFGVPVAD

SEQ ID NO: 1391526 - protein, 20 aa, Mycobacterium tuberculosis
APVMWALSASLGWILPVIAQ

SEQ ID NO: 1391527 - protein, 24 aa, Mycobacterium tuberculosis
APVPSAGIRWPHYRARTSRTGASH

SEQ ID NO: 1391528 - protein, 28 aa, Mycobacterium tuberculosis
AQAAAVPVVFLTAWYGLADLAEIKAGES

SEQ ID NO: 1391529 - protein, 23 aa, Mycobacterium tuberculosis
AQAGALPALFSGLARRPRRRQID

SEQ ID NO: 1391530 - protein, 25 aa, Mycobacterium tuberculosis
AQFAFFGWRWSLPLGVAILLAAVGG

SEQ ID NO: 1391531 - protein, 24 aa, Mycobacterium tuberculosis
AQNQAYGYLFPHGTFFVIGHLLGV

SEQ ID NO: 1391532 - protein, 21 aa, Mycobacterium tuberculosis
AQPLSLLPDAAAALYAIRADP

SEQ ID NO: 1391533 - protein, 24 aa, Mycobacterium tuberculosis
AQPPKPRVFAIKPPCPEPAAADPT

SEQ ID NO: 1391534 - protein, 30 aa, Mycobacterium tuberculosis
AQPQRIPVPSLLRALLSEHLDAGYAAVAAE

SEQ ID NO: 1391535 - protein, 41 aa, Mycobacterium tuberculosis
AQVGKLEFAGYFAWLAWLVLHLVYLVGYRNRIAALFAWGIS

SEQ ID NO: 1391536 - protein, 36 aa, Mycobacterium tuberculosis
ARDVFALLSPFLLVVAVMFVPMLDLLLAIVRRTRAG

SEQ ID NO: 1391537 - protein, 24 aa, Mycobacterium tuberculosis
ARHMGLFVVGRLAGRHGIRVGLRG

SEQ ID NO: 1391538 - protein, 19 aa, Mycobacterium tuberculosis
ARIAGRPAAVLLHLGPGLG

SEQ ID NO: 1391539 - protein, 30 aa, Mycobacterium tuberculosis
ARKYTFRKRALIVMAVILVGSAAAAFELTP

SEQ ID NO: 1391540 - protein, 29 aa, Mycobacterium tuberculosis
ARMVLTPLRDLFATIFFLGIGLSVDPGKL

SEQ ID NO: 1391541 - protein, 26 aa, Mycobacterium tuberculosis
ARPVGVPANPWFRPVAAPNVLAGVLE

SEQ ID NO: 1391542 - protein, 26 aa, Mycobacterium tuberculosis
ARRQPAPHLHLRAAGRLSVRQPRRAN

SEQ ID NO: 1391543 - protein, 21 aa, Mycobacterium tuberculosis
ARSQLWLSLLSWAVVVGCYLV

SEQ ID NO: 1391544 - protein, 21 aa, Mycobacterium tuberculosis
ARWREFCLRVADRVVLVASNP

SEQ ID NO: 1391545 - protein, 21 aa, Mycobacterium tuberculosis
ARWWQLLLRVVLPMLRPTMVA

SEQ ID NO: 1391546 - protein, 30 aa, Mycobacterium tuberculosis
ASAGFYAYLLTHVLFLNYVWGYTLLEAGMA

SEQ ID NO: 1391547 - protein, 20 aa, Mycobacterium tuberculosis
ASGHLVFTLIGTGTIVAVHL

SEQ ID NO: 1391548 - protein, 21 aa, Mycobacterium tuberculosis
ASGLLGPRLPRILAAVALGVL

SEQ ID NO: 1391549 - protein, 25 aa, Mycobacterium tuberculosis
ASGSMVFAILVLLGRYINYTLDLAG

SEQ ID NO: 1391550 - protein, 44 aa, Mycobacterium tuberculosis
ASIELAIAVMLLVILMVIYRNPVTMLLPLVTIGASLMTAQALVA

SEQ ID NO: 1391551 - protein, 22 aa, Mycobacterium tuberculosis
ASLPSYIVFLTLQTADGVTIRD

SEQ ID NO: 1391552 - protein, 31 aa, Mycobacterium tuberculosis
ASLVAAWAYPLWPVVLGLKALALAVGASTFV

SEQ ID NO: 1391553 - protein, 21 aa, Mycobacterium tuberculosis
ASLVVFLVALPLSLGIAIASG

SEQ ID NO: 1391554 - protein, 23 aa, Mycobacterium tuberculosis
ASPVEVPPPMPPPPPVTITQTVA

SEQ ID NO: 1391555 - protein, 17 aa, Mycobacterium tuberculosis
ASQEAELLALFAGSVLR

SEQ ID NO: 1391556 - protein, 17 aa, Mycobacterium tuberculosis
ASQPLGAIVFAGLFAWL

SEQ ID NO: 1391557 - protein, 29 aa, Mycobacterium tuberculosis
ASRMGLLVDDLLLLARLDAHRPLELCRVD

SEQ ID NO: 1391558 - protein, 17 aa, Mycobacterium tuberculosis
ASRWLLRPTAAEALSTV

SEQ ID NO: 1391559 - protein, 22 aa, Mycobacterium tuberculosis
ASTTLPPWPPPAPLSPWAPAPI

SEQ ID NO: 1391560 - protein, 24 aa, Mycobacterium tuberculosis
ASVPPLWVIVSCAVAMAAGTYLGG

SEQ ID NO: 1391561 - protein, 19 aa, Mycobacterium tuberculosis
ASVQLLALISVSVVAASVV

SEQ ID NO: 1391562 - protein, 22 aa, Mycobacterium tuberculosis
ASVSPLIRWIIKVPREFINDYL

SEQ ID NO: 1391563 - protein, 28 aa, Mycobacterium tuberculosis
ATAGACIGFLWWNAAPAKIFMGDTGSLA

SEQ ID NO: 1391564 - protein, 29 aa, Mycobacterium tuberculosis
ATALRLYTRWLGHVVLLVPTVLAVVATAV

SEQ ID NO: 1391565 - protein, 21 aa, Mycobacterium tuberculosis
ATAMVLYVLISQLGLVVGNRI

SEQ ID NO: 1391566 - protein, 23 aa, Mycobacterium tuberculosis
ATARLLLVVAVSAAIFGVARLIG

SEQ ID NO: 1391567 - protein, 22 aa, Mycobacterium tuberculosis
ATAVFLGITTFAIIRILRNPRE

SEQ ID NO: 1391568 - protein, 30 aa, Mycobacterium tuberculosis
ATDVSLLPTLQSFLPPPFDAIPNPIEDLDV

SEQ ID NO: 1391569 - protein, 29 aa, Mycobacterium tuberculosis
ATFIAVLVLWDLFGQLPLPLGVVGHEGST

SEQ ID NO: 1391570 - protein, 25 aa, Mycobacterium tuberculosis
ATGARWLCETFPTCLERGAGIPAVE

SEQ ID NO: 1391571 - protein, 24 aa, Mycobacterium tuberculosis
ATGIAGWMFGWLADRSGSLAAPLL

SEQ ID NO: 1391572 - protein, 31 aa, Mycobacterium tuberculosis
ATHRMDPVNLLPFMFLGTTFGARLLGIAYGL

SEQ ID NO: 1391573 - protein, 56 aa, Mycobacterium tuberculosis
ATLAGCLPAVIWWACHRPNRLWWRYTAWWLLAMALATLWWVMALTQLHGVSPPFLD

SEQ ID NO: 1391574 - protein, 23 aa, Mycobacterium tuberculosis
ATLAVVFLAGWRWFPRDVHTAGS

SEQ ID NO: 1391575 - protein, 19 aa, Mycobacterium tuberculosis
ATLISRITGFARIVLLAAI

SEQ ID NO: 1391576 - protein, 26 aa, Mycobacterium tuberculosis
ATLISRITGFARIVLLSAILGAALAS

SEQ ID NO: 1391577 - protein, 19 aa, Mycobacterium tuberculosis
ATLLGRWFWWPRRVDRLAR

SEQ ID NO: 1391578 - protein, 27 aa, Mycobacterium tuberculosis
ATMITFRLRLPCRTILRVFSRNSLVRG

SEQ ID NO: 1391579 - protein, 18 aa, Mycobacterium tuberculosis
ATMPRGPLVGIPGAPSSF

SEQ ID NO: 1391580 - protein, 17 aa, Mycobacterium tuberculosis
ATMYTPERVTFFCIGGA

SEQ ID NO: 1391581 - protein, 24 aa, Mycobacterium tuberculosis
ATPDIFVEFSRWRGLSPDGRCKAF

SEQ ID NO: 1391582 - protein, 32 aa, Mycobacterium tuberculosis
ATPILAVAMPWLFLRLRFCRRKWTVTTLAATP

SEQ ID NO: 1391583 - protein, 31 aa, Mycobacterium tuberculosis
ATPPGHGWPPGLPPLPRRPRRYRRGVAAVAA

SEQ ID NO: 1391584 - protein, 25 aa, Mycobacterium tuberculosis
ATRPATFLWLIAATGTLLVATHRMD

SEQ ID NO: 1391585 - protein, 28 aa, Mycobacterium tuberculosis
ATSAFWAFGVFYLVASVLTWAIYVRRGL

SEQ ID NO: 1391586 - protein, 23 aa, Mycobacterium tuberculosis
ATTVIWLAPLLLSVPVFSRDITR

SEQ ID NO: 1391587 - protein, 28 aa, Mycobacterium tuberculosis
ATTWLHVSGYRFLLRRIECALLFGDVCA

SEQ ID NO: 1391588 - protein, 27 aa, Mycobacterium tuberculosis
ATVVVAGWWTPPAWAIGPPVVDAAAQP

SEQ ID NO: 1391589 - protein, 23 aa, Mycobacterium tuberculosis
ATWLRGVSIVHLPTTLLGMVDAA

SEQ ID NO: 1391590 - protein, 21 aa, Mycobacterium tuberculosis
ATYCLSFARLTLFHTMGPPLA

SEQ ID NO: 1391591 - protein, 21 aa, Mycobacterium tuberculosis
AVACAIPLPPIARLLDDLDVP

SEQ ID NO: 1391592 - protein, 24 aa, Mycobacterium tuberculosis
AVACQVPIFLMRSSPFTALELAQT

SEQ ID NO: 1391593 - protein, 18 aa, Mycobacterium tuberculosis
AVAGLFAQLSREYPPVRG

SEQ ID NO: 1391594 - protein, 17 aa, Mycobacterium tuberculosis
AVAMPLFAGLYSISVLQ

SEQ ID NO: 1391595 - protein, 26 aa, Mycobacterium tuberculosis
AVARILAWRPLVWLGTISYGVYLWHW

SEQ ID NO: 1391596 - protein, 17 aa, Mycobacterium tuberculosis
AVARRFALSPIPVYLLA

SEQ ID NO: 1391597 - protein, 25 aa, Mycobacterium tuberculosis
AVASGFCLVLLAHSWWSLVSGSALG

SEQ ID NO: 1391598 - protein, 23 aa, Mycobacterium tuberculosis
AVATFAGWTLIAANPVAGMTAAV

SEQ ID NO: 1391599 - protein, 28 aa, Mycobacterium tuberculosis
AVAVLARWRFRRRPAPARLPLWACGAAD

SEQ ID NO: 1391600 - protein, 22 aa, Mycobacterium tuberculosis
AVAWLLMLMASPTARSAASLLT

SEQ ID NO: 1391601 - protein, 26 aa, Mycobacterium tuberculosis
AVFLGRFIALLRIFAGPLAGALKMPH

SEQ ID NO: 1391602 - protein, 18 aa, Mycobacterium tuberculosis
AVFRAVFAFAVNDTPDGG

SEQ ID NO: 1391603 - protein, 20 aa, Mycobacterium tuberculosis
AVGDNFVWAYQRSEALADDV

SEQ ID NO: 1391604 - protein, 26 aa, Mycobacterium tuberculosis
AVGIALWLPWLIAAGVAFILASAAGL

SEQ ID NO: 1391605 - protein, 17 aa, Mycobacterium tuberculosis
AVGLLGTGALLAAALTL

SEQ ID NO: 1391606 - protein, 19 aa, Mycobacterium tuberculosis
AVGQLLCGWLVDRVGARVT

SEQ ID NO: 1391607 - protein, 18 aa, Mycobacterium tuberculosis
AVGSWWRYRYDKFGWTTR

SEQ ID NO: 1391608 - protein, 22 aa, Mycobacterium tuberculosis
AVGTVLLVPLMAALFGEAPQRA

SEQ ID NO: 1391609 - protein, 25 aa, Mycobacterium tuberculosis
AVGVIVWGLIFWSAVFHRKKNTDTE

SEQ ID NO: 1391610 - protein, 20 aa, Mycobacterium tuberculosis
AVHPQPPWPHLAAAALTAVA

SEQ ID NO: 1391611 - protein, 18 aa, Mycobacterium tuberculosis
AVIACRTYRDPIAGLTLS

SEQ ID NO: 1391612 - protein, 20 aa, Mycobacterium tuberculosis
AVLARWRFRRRPAPARLPLW

SEQ ID NO: 1391613 - protein, 20 aa, Mycobacterium tuberculosis
AVLGFFGFYLSFVAELPAPP

SEQ ID NO: 1391614 - protein, 25 aa, Mycobacterium tuberculosis
AVLMSPMAFLQRPARWMQLLAKHRA

SEQ ID NO: 1391615 - protein, 33 aa, Mycobacterium tuberculosis; identical to SEQ ID NO: 225994

SEQ ID NO: 1391616 - protein, 17 aa, Mycobacterium tuberculosis
AVLTYHIAKPWRWGYLG

SEQ ID NO: 1391617 - protein, 22 aa, Mycobacterium tuberculosis
AVLVLAPFWLIPTSLDVHLSMT

SEQ ID NO: 1391618 - protein, 22 aa, Mycobacterium tuberculosis
AVMAPWCRVAYIAHGQHRVCGE

SEQ ID NO: 1391619 - protein, 20 aa, Mycobacterium tuberculosis
AVNPWQWLLALLQQLWNAYT

SEQ ID NO: 1391620 - protein, 20 aa, Mycobacterium tuberculosis
AVPGSPWWQHPVGSVTALAT

SEQ ID NO: 1391621 - protein, 23 aa, Mycobacterium tuberculosis
AVRQVMWPKIGGSQVLHDAFPPG

SEQ ID NO: 1391622 - protein, 20 aa, Mycobacterium tuberculosis
AVRTLLRRRSQLAGPTVTVT

SEQ ID NO: 1391623 - protein, 24 aa, Mycobacterium tuberculosis
AVSAGWSVLAAPAAAAAPVPKWWS

SEQ ID NO: 1391624 - protein, 22 aa, Mycobacterium tuberculosis
AVSFTTLRLIYQEMLANYRVGQ

SEQ ID NO: 1391625 - protein, 30 aa, Mycobacterium tuberculosis
AVSPPPIDERWLPESALPAPPRPTVQREVC

SEQ ID NO: 1391626 - protein, 25 aa, Mycobacterium tuberculosis
AVTAAWTFLKILGPILRGIADAAVS

SEQ ID NO: 1391627 - protein, 37 aa, Mycobacterium tuberculosis
AVTDRLPMVLGLIAAITYVLLFLLTGSVVLPAKALVC

SEQ ID NO: 1391628 - protein, 29 aa, Mycobacterium tuberculosis
AVTFAIVPLLHRFGGLVAPLTFIGTAYVA

SEQ ID NO: 1391629 - protein, 22 aa, Mycobacterium tuberculosis
AVTIFVFILISNWLAVLPVQYT

SEQ ID NO: 1391630 - protein, 22 aa, Mycobacterium tuberculosis
AVTVGLFGWRRGSRRWRGACWS

SEQ ID NO: 1391631 - protein, 20 aa, Mycobacterium tuberculosis
AVVCCLALVLTLPDLAWGVW

SEQ ID NO: 1391632 - protein, 20 aa, Mycobacterium tuberculosis
AVVLATMPPLLSAIANAGRH

SEQ ID NO: 1391633 - protein, 23 aa, Mycobacterium tuberculosis
AVVLPAACICLVLFAAIVVWPQV

SEQ ID NO: 1391634 - protein, 20 aa, Mycobacterium tuberculosis
AVVLVLVLGAIGIWIANRPD

SEQ ID NO: 1391635 - protein, 26 aa, Mycobacterium tuberculosis
AVVMPISYNIVISLVLERYALGENMA

SEQ ID NO: 1391636 - protein, 26 aa, Mycobacterium tuberculosis
AVVVLLGWSFFYFSDDTRGYKPVDTS

SEQ ID NO: 1391637 - protein, 32 aa, Mycobacterium tuberculosis
AVWGVLTPRQPWPWLALLVAGLTVGPLHHPGP

SEQ ID NO: 1391638 - protein, 22 aa, Mycobacterium tuberculosis
AVWTTLWMLVGLAVHDAISIIG

SEQ ID NO: 1391639 - protein, 17 aa, Mycobacterium tuberculosis
AVYAVISAALYSDIDNQ

SEQ ID NO: 1391640 - protein, 20 aa, Mycobacterium tuberculosis
AWALSVMFLVFTLRALLYKP

SEQ ID NO: 1391641 - protein, 22 aa, Mycobacterium tuberculosis
AWARLADADLAWLDGDQLGRRV

SEQ ID NO: 1391642 - protein, 19 aa, Mycobacterium tuberculosis
AWGHLLGCAAALAAFGVGA

SEQ ID NO: 1391643 - protein, 17 aa, Mycobacterium tuberculosis
AWITAIVLTFHWAQVVW

SEQ ID NO: 1391644 - protein, 23 aa, Mycobacterium tuberculosis
AWLAEGLLIYLKPQTQDRLFDNI

SEQ ID NO: 1391645 - protein, 23 aa, Mycobacterium tuberculosis
AWLITRAWQMPPVLDLSVAVVAV

SEQ ID NO: 1391646 - protein, 17 aa, Mycobacterium tuberculosis
AWLPFNNGLRPEPLIAL

SEQ ID NO: 1391647 - protein, 29 aa, Mycobacterium tuberculosis
AWPQAVDAWLRLCQTYGWAPGVMGASSQG

SEQ ID NO: 1391648 - protein, 21 aa, Mycobacterium tuberculosis
AWRLGMFANRWIILGVSAQAI

SEQ ID NO: 1391649 - protein, 25 aa, Mycobacterium tuberculosis
AWTAAGMFLAVWLPLDNGLRPEPII

SEQ ID NO: 1391650 - protein, 17 aa, Mycobacterium tuberculosis
AYEYFIRHNPLSDYAFP

SEQ ID NO: 1391651 - protein, 17 aa, Mycobacterium tuberculosis
AYGFPAGLWRWLQRHPP

SEQ ID NO: 1391652 - protein, 17 aa, Mycobacterium tuberculosis
AYGWAFSSPVRKIYYNI

SEQ ID NO: 1391653 - protein, 19 aa, Mycobacterium tuberculosis
AYGYLFPHGTFFVIGHLLG

SEQ ID NO: 1391654 - protein, 32 aa, Mycobacterium tuberculosis
AYHPTLLRKGERLLVFLPLAHVLARAISMAAF

SEQ ID NO: 1391655 - protein, 19 aa, Mycobacterium tuberculosis
AYLAIIGVPPFAGFFSKDA

SEQ ID NO: 1391656 - protein, 27 aa, Mycobacterium tuberculosis
AYPKRMPVALIWLIAALVLVGAEALTG

SEQ ID NO: 1391657 - protein, 17 aa, Mycobacterium tuberculosis
AYQLKFTHHMYLPMDVD

SEQ ID NO: 1391658 - protein, 26 aa, Mycobacterium tuberculosis
AYRTTIFAFPVFGFGVIFGAIWAEEA

SEQ ID NO: 1391659 - protein, 20 aa, Mycobacterium tuberculosis
AYWLGAQWWHPLVVVGLIAL

SEQ ID NO: 1391660 - protein, 21 aa, Mycobacterium tuberculosis
AYWLGAQWWHPLVVVGLIALV

SEQ ID NO: 1391661 - protein, 17 aa, Mycobacterium tuberculosis
CAAILLFGGRRTDAWGH

SEQ ID NO: 1391662 - protein, 25 aa, Mycobacterium tuberculosis
CAPAAFRFMSQARHIGKVVLTMPSA

SEQ ID NO: 1391663 - protein, 26 aa, Mycobacterium tuberculosis
CDMSPIPRIVSVSLAWAAAIGLMVPI

SEQ ID NO: 1391664 - protein, 17 aa, Mycobacterium tuberculosis
CGLKWPRKWTLKRTTRT

SEQ ID NO: 1391665 - protein, 26 aa, Mycobacterium tuberculosis
CIATGRIMWCWPRVLWSACSTCAAPR

SEQ ID NO: 1391666 - protein, 38 aa, Mycobacterium tuberculosis
CICRGDYRLRHFGVRITRILALLLAVLLAVSGVAGCSA

SEQ ID NO: 1391667 - protein, 17 aa, Mycobacterium tuberculosis
CLGFTRLPYFNTLASPC

SEQ ID NO: 1391668 - protein, 21 aa, Mycobacterium tuberculosis
CRVREGFVMRLAIVGTAAAAA

SEQ ID NO: 1391669 - protein, 24 aa, Mycobacterium tuberculosis
CRVREGFVMRLAIVGTAAAAAIGG

SEQ ID NO: 1391670 - protein, 24 aa, Mycobacterium tuberculosis
CTPREWNWAVLLAGAVAVIVMSGN

SEQ ID NO: 1391671 - protein, 17 aa, Mycobacterium tuberculosis
CTRLWGDCLAPPRPALR

SEQ ID NO: 1391672 - protein, 17 aa, Mycobacterium tuberculosis
CTRLWGDCLAPPRPVLR

SEQ ID NO: 1391673 - protein, 18 aa, Mycobacterium tuberculosis
CVASAMLGLALSAIAKSN

SEQ ID NO: 1391674 - protein, 31 aa, Mycobacterium tuberculosis; identical to SEQ ID NO: 164657

SEQ ID NO: 1391675 - protein, 28 aa, Mycobacterium tuberculosis
CWQPITRDLWPAPYLVMDTGASLAPYNH

SEQ ID NO: 1391676 - protein, 18 aa, Mycobacterium tuberculosis
DADKPAALWILTRGVHES

SEQ ID NO: 1391677 - protein, 26 aa, Mycobacterium tuberculosis
DAEAEPAAWLRFWFPDPNGSNTEFQR

SEQ ID NO: 1391678 - protein, 30 aa, Mycobacterium tuberculosis
DAEYRFEKAWPLLWFVVIGLIAAAVGYLYA

SEQ ID NO: 1391679 - protein, 23 aa, Mycobacterium tuberculosis
DAGAQFFFLVAAALVVLLVGIEH

SEQ ID NO: 1391680 - protein, 21 aa, Mycobacterium tuberculosis
DAILVPPGDGPWRLGLGSAGT

SEQ ID NO: 1391681 - protein, 19 aa, Mycobacterium tuberculosis
DALGYVLLAFATRGWMAFP

SEQ ID NO: 1391682 - protein, 20 aa, Mycobacterium tuberculosis
DALHFAKPIFGPAARALAQL

SEQ ID NO: 1391683 - protein, 22 aa, Mycobacterium tuberculosis
DAMRAMFGTRLLPREYADDFED

SEQ ID NO: 1391684 - protein, 17 aa, Mycobacterium tuberculosis
DARAVLRDVLINELQPG

SEQ ID NO: 1391685 - protein, 23 aa, Mycobacterium tuberculosis
DASLRLLVRGGRFLEMGKTDIRD

SEQ ID NO: 1391686 - protein, 22 aa, Mycobacterium tuberculosis
DAVAALTWDIPPGPASAPYNVR

SEQ ID NO: 1391687 - protein, 25 aa, Mycobacterium tuberculosis
DAVPRMRGMLTLFEGVATGAADGYA

SEQ ID NO: 1391688 - protein, 25 aa, Mycobacterium tuberculosis
DAVWPVMIVLLLNLTAAYSARRFAP

SEQ ID NO: 1391689 - protein, 17 aa, Mycobacterium tuberculosis
DCHLMKLEDLRPPERAQ

SEQ ID NO: 1391690 - protein, 17 aa, Mycobacterium tuberculosis
DCRRQATHPAAVKPELV

SEQ ID NO: 1391691 - protein, 19 aa, Mycobacterium tuberculosis
DDALAALLGQWRDDLRWPP

SEQ ID NO: 1391692 - protein, 28 aa, Mycobacterium tuberculosis
DDALAALLGQWRDDLRWPPASALVSQDE

SEQ ID NO: 1391693 - protein, 20 aa, Mycobacterium tuberculosis
DDEFWMLMAGRKLAARDRRV

SEQ ID NO: 1391694 - protein, 31 aa, Mycobacterium tuberculosis
DDPAKPLPASIPWTALWLSQAWQQRVLEEEL

SEQ ID NO: 1391695 - protein, 18 aa, Mycobacterium tuberculosis
DDSMRWLATVIQMDGRRI

SEQ ID NO: 1391696 - protein, 19 aa, Mycobacterium tuberculosis
DDSMRWLATVIQMDGRRID

SEQ ID NO: 1391697 - protein, 22 aa, Mycobacterium tuberculosis
DDTLALHYLVTHAVPDASPRLS

SEQ ID NO: 1391698 - protein, 23 aa, Mycobacterium tuberculosis
DEFEALLLEFLGESAVTVPELGT

SEQ ID NO: 1391699 - protein, 27 aa, Mycobacterium tuberculosis
DEGRPRRLIPLLGLIGCVVLAFALPLS

SEQ ID NO: 1391700 - protein, 20 aa, Mycobacterium tuberculosis
DELFATIGVTFFGAGVISTG

SEQ ID NO: 1391701 - protein, 25 aa, Mycobacterium tuberculosis
DELTPGINLGLIAYAGTATVLVSPT

SEQ ID NO: 1391702 - protein, 24 aa, Mycobacterium tuberculosis
DERHMLWFELMKPMTSTATGREAA

SEQ ID NO: 1391703 - protein, 22 aa, Mycobacterium tuberculosis
DESWHQWFYGAAALWARSRPGT

SEQ ID NO: 1391704 - protein, 30 aa, Mycobacterium tuberculosis
DETENVLLQVVPWRGALGSVISVGAQQQPA

SEQ ID NO: 1391705 - protein, 23 aa, Mycobacterium tuberculosis
DFAITVVTGISFSAILKANAVIP

SEQ ID NO: 1391706 - protein, 17 aa, Mycobacterium tuberculosis
DFFQVLVTQFGSSGGPF

SEQ ID NO: 1391707 - protein, 20 aa, Mycobacterium tuberculosis
DFPFVPWPPALSVGMWLLAV

SEQ ID NO: 1391708 - protein, 32 aa, Mycobacterium tuberculosis
DGGSRRRRRDRWFGGWDRRQPGCGLGTAATAA

SEQ ID NO: 1391709 - protein, 29 aa, Mycobacterium tuberculosis
DGGVVVKALLLLGLWLAGWGAARLVATAL

SEQ ID NO: 1391710 - protein, 17 aa, Mycobacterium tuberculosis
DGHQWRYNTLFRSQDRD

SEQ ID NO: 1391711 - protein, 31 aa, Mycobacterium tuberculosis
DGIAYRTTIFAFPVFGFGVIFGAIWAEEAWG

SEQ ID NO: 1391712 - protein, 22 aa, Mycobacterium tuberculosis
DGLETVLHIFPTLAANINQLYH

SEQ ID NO: 1391713 - protein, 21 aa, Mycobacterium tuberculosis
DGPWVKWYPGIPGYIDQQWVT

SEQ ID NO: 1391714 - protein, 27 aa, Mycobacterium tuberculosis
DGRPEARLWALVRRQSLSRFERLAGQW

SEQ ID NO: 1391715 - protein, 38 aa, Mycobacterium tuberculosis
DGSSSVGVFLFINVFFFICFFFFFYYYFYFIVITFFFF

SEQ ID NO: 1391716 - protein, 17 aa, Mycobacterium tuberculosis
DGWAFMCTLIVVAAVVV

SEQ ID NO: 1391717 - protein, 25 aa, Mycobacterium tuberculosis
DHPRSKVGPLRWTRLTEILRGGRSR

SEQ ID NO: 1391718 - protein, 28 aa, Mycobacterium tuberculosis
DHSRRLWTMLIFMLWHAIFVEHSVVPQI

SEQ ID NO: 1391719 - protein, 18 aa, Mycobacterium tuberculosis
DIDRQMYFFYAATMAPFL

SEQ ID NO: 1391720 - protein, 21 aa, Mycobacterium tuberculosis
DILDPALLRPGRFDRQIPVSN

SEQ ID NO: 1391721 - protein, 25 aa, Mycobacterium tuberculosis
DILGFNIIGFIITLASNAQLLYLFW

SEQ ID NO: 1391722 - protein, 17 aa, Mycobacterium tuberculosis
DIPICWSMRSLLNSMDN

SEQ ID NO: 1391723 - protein, 18 aa, Mycobacterium tuberculosis
DIPICWSMRSLLNSMDNV

SEQ ID NO: 1391724 - protein, 17 aa, Mycobacterium tuberculosis
DIPVCWSLRSVFDTLDG

SEQ ID NO: 1391725 - protein, 17 aa, Mycobacterium tuberculosis
DKAWFFALTDQVSIAEA

SEQ ID NO: 1391726 - protein, 23 aa, Mycobacterium tuberculosis
DLAAAVRILSALPVARAASESAV

SEQ ID NO: 1391727 - protein, 25 aa, Mycobacterium tuberculosis
DLAAGLVCWLLLSREVLPRLGPAVA

SEQ ID NO: 1391728 - protein, 20 aa, Mycobacterium tuberculosis
DLAAMLRRQGPLAPPRAVAI

SEQ ID NO: 1391729 - protein, 27 aa, Mycobacterium tuberculosis
DLATRPATFLWLIAATGTLLVATHRMD

SEQ ID NO: 1391730 - protein, 21 aa, Mycobacterium tuberculosis
DLDSVLKRFGPLTPPRAVAII

SEQ ID NO: 1391731 - protein, 28 aa, Mycobacterium tuberculosis
DLHDPPPCMTGFLPPPLVRSPADESVRE

SEQ ID NO: 1391732 - protein, 26 aa, Mycobacterium tuberculosis
DLLGRRRTFLSGVLVFTIASGLCAVA

SEQ ID NO: 1391733 - protein, 17 aa, Mycobacterium tuberculosis
DLQLLGPGPRWWGACAA

SEQ ID NO: 1391734 - protein, 52 aa, Mycobacterium tuberculosis
DLQRGCTAPWVPLLPIAAVCACLWLMLNLTALTWIRFGIWLVAGTAIYVGYG

SEQ ID NO: 1391735 - protein, 17 aa, Mycobacterium tuberculosis
DLRLIIAMTVCIVLLIL

SEQ ID NO: 1391736 - protein, 17 aa, Mycobacterium tuberculosis
DLRMRQFITDASHELRT

SEQ ID NO: 1391737 - protein, 17 aa, Mycobacterium tuberculosis
DLSFLPALALIFLNCVW

SEQ ID NO: 1391738 - protein, 25 aa, Mycobacterium tuberculosis
DLVVAVLLNYPFSRYDSMALAAFDL

SEQ ID NO: 1391739 - protein, 17 aa, Mycobacterium tuberculosis
DLYTEAYLVDRPILRCV

SEQ ID NO: 1391740 - protein, 26 aa, Mycobacterium tuberculosis
DMTTSRTLRLLVVSALATLSGLGTPV

SEQ ID NO: 1391741 - protein, 17 aa, Mycobacterium tuberculosis
DNALLDRLAKAPGDLLL

SEQ ID NO: 1391742 - protein, 17 aa, Mycobacterium tuberculosis
DNPVIFWTPEHGAFVVR

SEQ ID NO: 1391743 - protein, 29 aa, Mycobacterium tuberculosis
DPAKPLPASIPWTALWLSQAWQQRVLEEE

SEQ ID NO: 1391744 - protein, 30 aa, Mycobacterium tuberculosis
DPALSRWQWLVKWFLAIPHYIVLFFLHVAA

SEQ ID NO: 1391745 - protein, 18 aa, Mycobacterium tuberculosis
DPDQPLLTGWLVRRTLLV

SEQ ID NO: 1391746 - protein, 17 aa, Mycobacterium tuberculosis
DPLRLVLGALFVAEITS

SEQ ID NO: 1391747 - protein, 25 aa, Mycobacterium tuberculosis
DPNDQPRWNPTPRLPLPKATRSHRR

SEQ ID NO: 1391748 - protein, 17 aa, Mycobacterium tuberculosis
DPQLTFAAQFRTPSTVT

SEQ ID NO: 1391749 - protein, 24 aa, Mycobacterium tuberculosis
DPQTRLLSMLPSGYPTGTCKPDHA

SEQ ID NO: 1391750 - protein, 18 aa, Mycobacterium tuberculosis
DPVAPPIPLLPARVDYDS

SEQ ID NO: 1391751 - protein, 17 aa, Mycobacterium tuberculosis
DPWRDPAAAAALGTPAL

SEQ ID NO: 1391752 - protein, 20 aa, Mycobacterium tuberculosis
DQFMLRLKVGMAAGIVLACP

SEQ ID NO: 1391753 - protein, 23 aa, Mycobacterium tuberculosis
DQKKRWLPGIADGSLTMAFAITE

SEQ ID NO: 1391754 - protein, 19 aa, Mycobacterium tuberculosis
DQLGGRRRPPGPPGPPGSS

SEQ ID NO: 1391755 - protein, 25 aa, Mycobacterium tuberculosis
DQQAVYLALLVSSVLHLARTIAGPG

SEQ ID NO: 1391756 - protein, 17 aa, Mycobacterium tuberculosis
DQRWLFGLGAVTASAVW

SEQ ID NO: 1391757 - protein, 23 aa, Mycobacterium tuberculosis
DREPYWVCAIYLVLLAVAGLGAA

SEQ ID NO: 1391758 - protein, 24 aa, Mycobacterium tuberculosis
DREPYWVCAIYLVLLAVAGLGAAL

SEQ ID NO: 1391759 - protein, 17 aa, Mycobacterium tuberculosis
DRFVYFVAPIISVIPAF

SEQ ID NO: 1391760 - protein, 36 aa, Mycobacterium tuberculosis
DRHGYRFIVGIGALIWAASLLWYLKVVGSQPDFLGE

SEQ ID NO: 1391761 - protein, 19 aa, Mycobacterium tuberculosis
DRHLRPMLARRFEIATGHR

SEQ ID NO: 1391762 - protein, 18 aa, Mycobacterium tuberculosis
DRLPLPNRLLATAPLVAL

SEQ ID NO: 1391763 - protein, 18 aa, Mycobacterium tuberculosis
DRLWIRFIADTERRSQVI

SEQ ID NO: 1391764 - protein, 22 aa, Mycobacterium tuberculosis
DRRLLSLILLARDHVVHGWVLA

SEQ ID NO: 1391765 - protein, 26 aa, Mycobacterium tuberculosis
DRSAPLSRRSLLIGNAVVAFAVIGFA

SEQ ID NO: 1391766 - protein, 35 aa, Mycobacterium tuberculosis
DRTAQRIVLTRNPRWWGARPRLDSITYLVLDDAAR

SEQ ID NO: 1391767 - protein, 24 aa, Mycobacterium tuberculosis
DSIGWEWIFFVNVPVGVIGLILAA

SEQ ID NO: 1391768 - protein, 23 aa, Mycobacterium tuberculosis
DSKGYCFQIDLTWRTVSNGFVVT

SEQ ID NO: 1391769 - protein, 23 aa, Mycobacterium tuberculosis
DSLTTRYMPSGMTRWSPDSGETI

SEQ ID NO: 1391770 - protein, 19 aa, Mycobacterium tuberculosis
DSQVRLKTRLTPATRWGPI

SEQ ID NO: 1391771 - protein, 21 aa, Mycobacterium tuberculosis
DSRPRLILGASLIGLSFLGLC

SEQ ID NO: 1391772 - protein, 17 aa, Mycobacterium tuberculosis
DSRRNLLGLFMPSALTL

SEQ ID NO: 1391773 - protein, 21 aa, Mycobacterium tuberculosis
DTGLAMLVWALAVAGALAFGQ

SEQ ID NO: 1391774 - protein, 22 aa, Mycobacterium tuberculosis
DTGLAMLVWALAVAGALAFGQL

SEQ ID NO: 1391775 - protein, 17 aa, Mycobacterium tuberculosis
DTLIVRSFMTPSIAALL

SEQ ID NO: 1391776 - protein, 18 aa, Mycobacterium tuberculosis
DTNFAWSFVLALLAAALT

SEQ ID NO: 1391777 - protein, 26 aa, Mycobacterium tuberculosis
DTRGDGKCHPAILPPLFGCNDRAMPD

SEQ ID NO: 1391778 - protein, 27 aa, Mycobacterium tuberculosis
DTRGDGKCHPAILPPLFGCNDRAMPDG

SEQ ID NO: 1391779 - protein, 24 aa, Mycobacterium tuberculosis
DTTAGWLAVVLALAVAATPILAVA

SEQ ID NO: 1391780 - protein, 20 aa, Mycobacterium tuberculosis
DTVQYYAVLPGRFAADFAGI

SEQ ID NO: 1391781 - protein, 24 aa, Mycobacterium tuberculosis
DVALYALLVMMLLSALFTDGAGPI

SEQ ID NO: 1391782 - protein, 18 aa, Mycobacterium tuberculosis
DVARRRIPLFPTAEPPAL

SEQ ID NO: 1391783 - protein, 19 aa, Mycobacterium tuberculosis
DVFALLSPFLLVVAVMFVP

SEQ ID NO: 1391784 - protein, 20 aa, Mycobacterium tuberculosis
DVFLGLPLLLAAIVLMQVMH

SEQ ID NO: 1391785 - protein, 17 aa, Mycobacterium tuberculosis
DVRGAVLLAFALGLLTL

SEQ ID NO: 1391786 - protein, 27 aa, Mycobacterium tuberculosis
DVVLRPHWTPLFAYAAAFLIALAHVAG

SEQ ID NO: 1391787 - protein, 25 aa, Mycobacterium tuberculosis
DWHQVTVVSSPSWFSDYVLSVGAVD

SEQ ID NO: 1391788 - protein, 18 aa, Mycobacterium tuberculosis
DWYTSVLAQLAAVSTAGV

SEQ ID NO: 1391789 - protein, 25 aa, Mycobacterium tuberculosis
DYSFLSYYPYWGFQGLTPHYANPLA

SEQ ID NO: 1391790 - protein, 23 aa, Mycobacterium tuberculosis
EAMLLAAIYVAALRSYGFAAHAE

SEQ ID NO: 1391791 - protein, 36 aa, Mycobacterium tuberculosis
EATSVRQRTWGWALAVVVIVLALAAIAILGTVLLTR

SEQ ID NO: 1391792 - protein, 26 aa, Mycobacterium tuberculosis
EAVMNKLRWVLLIVGGIGVAVAAVAG

SEQ ID NO: 1391793 - protein, 17 aa, Mycobacterium tuberculosis
ECRLLATAPFDQFMLRL

SEQ ID NO: 1391794 - protein, 17 aa, Mycobacterium tuberculosis
ECWPAVGGGVPSAYDLG

SEQ ID NO: 1391795 - protein, 25 aa, Mycobacterium tuberculosis
EDPARLDSLFPARSPGRPAAPQQRQ

SEQ ID NO: 1391796 - protein, 24 aa, Mycobacterium tuberculosis
EEESLPAVLAAIPAGYRALVVDNN

SEQ ID NO: 1391797 - protein, 23 aa, Mycobacterium tuberculosis
EEPTRTVYWSQPEPRWPKSPPQD

SEQ ID NO: 1391798 - protein, 24 aa, Mycobacterium tuberculosis
EEVSAWAVMAFTTAATGLLALNQA

SEQ ID NO: 1391799 - protein, 19 aa, Mycobacterium tuberculosis
EFEMKLKFARLSTAILGCA

SEQ ID NO: 1391800 - protein, 35 aa, Mycobacterium tuberculosis
EFINDYLFNFPDTNFAWSFVLALLAAALTARKRIA

SEQ ID NO: 1391801 - protein, 21 aa, Mycobacterium tuberculosis
EFLVLLGTFSRYWLAAAFGVT

SEQ ID NO: 1391802 - protein, 17 aa, Mycobacterium tuberculosis
EGALSLLTPFAAFLLAQ

SEQ ID NO: 1391803 - protein, 23 aa, Mycobacterium tuberculosis
EGIPHLITPIITQPKKAAAALAW

SEQ ID NO: 1391804 - protein, 25 aa, Mycobacterium tuberculosis
EGRPRRLIPLVGLIGCVVLAFALPL

SEQ ID NO: 1391805 - protein, 26 aa, Mycobacterium tuberculosis
EGRPRRLIPLVGLIGCVVLAFALPLS

SEQ ID NO: 1391806 - protein, 23 aa, Mycobacterium tuberculosis
EGVPIRGFGIHPAVLDAALHAWG

SEQ ID NO: 1391807 - protein, 23 aa, Mycobacterium tuberculosis
EHAHKLVFAVLRGVAAVAPVRRL

SEQ ID NO: 1391808 - protein, 24 aa, Mycobacterium tuberculosis
EIALYSFVVLLITGVYLTLFFDPS

SEQ ID NO: 1391809 - protein, 20 aa, Mycobacterium tuberculosis
EIEALYYLHPLTGEVIRQVD

SEQ ID NO: 1391810 - protein, 23 aa, Mycobacterium tuberculosis
EKNMPFWGTSFSAAYVSGVAALV

SEQ ID NO: 1391811 - protein, 38 aa, Mycobacterium tuberculosis; identical to SEQ ID NO: 217591

SEQ ID NO: 1391812 - protein, 17 aa, Mycobacterium tuberculosis
ELFAELAGCSSSIEMTR

SEQ ID NO: 1391813 - protein, 20 aa, Mycobacterium tuberculosis
ELFAELAGCSSSIEMTREQL

SEQ ID NO: 1391814 - protein, 18 aa, Mycobacterium tuberculosis
ELFATIGVTFFGAGVIST

SEQ ID NO: 1391815 - protein, 19 aa, Mycobacterium tuberculosis
ELHTRALLLAGEETRIATA

SEQ ID NO: 1391816 - protein, 26 aa, Mycobacterium tuberculosis
ELIGIVPPDLRIPFDPREVIARIVDG

SEQ ID NO: 1391817 - protein, 25 aa, Mycobacterium tuberculosis
ELIRFQTAFVSGPLRRASPSAVHPV

SEQ ID NO: 1391818 - protein, 18 aa, Mycobacterium tuberculosis
ELLVDPDSPFLELSPLAA

SEQ ID NO: 1391819 - protein, 21 aa, Mycobacterium tuberculosis
ELLVNVLRHPAFLDGATDTGF

SEQ ID NO: 1391820 - protein, 25 aa, Mycobacterium tuberculosis
ELLVVMLPLIGVLYVGIKALSSFTR

SEQ ID NO: 1391821 - protein, 22 aa, Mycobacterium tuberculosis
ELSAYQIINRLIHTARPPARGV

SEQ ID NO: 1391822 - protein, 46 aa, Mycobacterium tuberculosis
ELSNDQFMITVLILWAPLLIFGFILMWILAWLTATPVRVVREALNR

SEQ ID NO: 1391823 - protein, 24 aa, Mycobacterium tuberculosis
ELTALIQLYIVGVFISFTMSQVGM

SEQ ID NO: 1391824 - protein, 23 aa, Mycobacterium tuberculosis
ELWPDLNLGLPFTYHQGYQSSPV

SEQ ID NO: 1391825 - protein, 40 aa, Mycobacterium tuberculosis
EMDTIDGPYYLFGVLAKLAVLPSFTPMLLPDIGRTNIVPV

SEQ ID NO: 1391826 - protein, 27 aa, Mycobacterium tuberculosis
EMLVGTPAMWWLAVPVLAYAGWRMFVR

SEQ ID NO: 1391827 - protein, 22 aa, Mycobacterium tuberculosis
ENIVPLYRRNALTERQLLAVNE

SEQ ID NO: 1391828 - protein, 25 aa, Mycobacterium tuberculosis
EPDDPDWSWLKWLPHVQHQTETDAD

SEQ ID NO: 1391829 - protein, 33 aa, Mycobacterium tuberculosis
EPEQLWQVAKLRRAAFSGVLLTASLVAAWAYPL

SEQ ID NO: 1391830 - protein, 25 aa, Mycobacterium tuberculosis
EPIAAAPPPLFRFGHRGPGDWQAGH

SEQ ID NO: 1391831 - protein, 36 aa, Mycobacterium tuberculosis
EPKRRMRMGWRRIGTAIVRWPGPILAVACAIAVVGL

SEQ ID NO: 1391832 - protein, 19 aa, Mycobacterium tuberculosis
EPPPPLPPDLPPNVRELIE

SEQ ID NO: 1391833 - protein, 17 aa, Mycobacterium tuberculosis
EPRHRPPPLPPQQERPV

SEQ ID NO: 1391834 - protein, 17 aa, Mycobacterium tuberculosis
EPTWSRPGWRHLKHFNG

SEQ ID NO: 1391835 - protein, 18 aa, Mycobacterium tuberculosis
EPYPEQRPPWGVPPPGWD

SEQ ID NO: 1391836 - protein, 21 aa, Mycobacterium tuberculosis
ERPHMYRLMFGSTSAHGINVP

SEQ ID NO: 1391837 - protein, 27 aa, Mycobacterium tuberculosis
ERPPSTLWIWVALTGAAATVLILGWRS

SEQ ID NO: 1391838 - protein, 25 aa, Mycobacterium tuberculosis
ERPSRYYPTWLPSRSFIAAVIAIGG

SEQ ID NO: 1391839 - protein, 22 aa, Mycobacterium tuberculosis
ERPVVIPAVPAPQGHRSRLQST

SEQ ID NO: 1391840 - protein, 26 aa, Mycobacterium tuberculosis
ERRERYRWLFGAAVSVGLVFAAELAR

SEQ ID NO: 1391841 - protein, 18 aa, Mycobacterium tuberculosis
ERVTFATWAIVTGKSPGG

SEQ ID NO: 1391842 - protein, 19 aa, Mycobacterium tuberculosis
ESKPWTWPMSLRPVLYAID

SEQ ID NO: 1391843 - protein, 22 aa, Mycobacterium tuberculosis
ESNFPAIVKFLSEQVLSRATER

SEQ ID NO: 1391844 - protein, 36 aa, Mycobacterium tuberculosis
ESSNFLIPNGTFLVVLAIFLVVLAVIGTFVVPPILK

SEQ ID NO: 1391845 - protein, 25 aa, Mycobacterium tuberculosis
ESVAPSALRQSFLWGLAGVIAAEHP

SEQ ID NO: 1391846 - protein, 26 aa, Mycobacterium tuberculosis
ETAVVATMFVALLGLSTISSKADDID

SEQ ID NO: 1391847 - protein, 30 aa, Mycobacterium tuberculosis
ETIVRLKARLWFVHRGIEKLFHGRPATAAV

SEQ ID NO: 1391848 - protein, 18 aa, Mycobacterium tuberculosis
ETSALLLVLLTNENGLGP

SEQ ID NO: 1391849 - protein, 42 aa, Mycobacterium tuberculosis
ETTALLLHIGVMLAFLILVLHSKHLHIFLAPINVTFKRLPDG

SEQ ID NO: 1391850 - protein, 49 aa, Mycobacterium tuberculosis
ETTALLLHIGVMLAFLILVLHSKHLHIFLAPINVTFKRLPDGLGPLLPL

SEQ ID NO: 1391851 - protein, 33 aa, Mycobacterium tuberculosis
ETTPAVPRPARWVAPGLLLSRLGLQSAAYVELA

SEQ ID NO: 1391852 - protein, 21 aa, Mycobacterium tuberculosis
ETVSVWFRSVWVLQPRGDLMA

SEQ ID NO: 1391853 - protein, 25 aa, Mycobacterium tuberculosis
ETVVFAFIVLFVINIVVTAVGIPFM

SEQ ID NO: 1391854 - protein, 23 aa, Mycobacterium tuberculosis
EVDPYAIPLLQTAHRTGARVVLR

SEQ ID NO: 1391855 - protein, 24 aa, Mycobacterium tuberculosis
EVGLSLFYWWYHTLDKTAAVFVVL

SEQ ID NO: 1391856 - protein, 23 aa, Mycobacterium tuberculosis
EVIRLIRRLLPALVVVLAGCALL

SEQ ID NO: 1391857 - protein, 17 aa, Mycobacterium tuberculosis
EVLFSSLLWIDGRNLEP

SEQ ID NO: 1391858 - protein, 20 aa, Mycobacterium tuberculosis
EVLFSSLLWIDGRNLEPYLL

SEQ ID NO: 1391859 - protein, 23 aa, Mycobacterium tuberculosis
EVLVGLGMRTWADGRTLLLGSPS

SEQ ID NO: 1391860 - protein, 27 aa, Mycobacterium tuberculosis
EVSARMAVLLAGLSPRLPPALNPDDAD

SEQ ID NO: 1391861 - protein, 22 aa, Mycobacterium tuberculosis
EYIGFLVAWQRPLAGKKTCMDL

SEQ ID NO: 1391862 - protein, 29 aa, Mycobacterium tuberculosis
EYLELFANHKKWIGLIIHIGQEGRGANVF

SEQ ID NO: 1391863 - protein, 22 aa, Mycobacterium tuberculosis
EYWKKGLRHSVYFTHGIRNAVD

SEQ ID NO: 1391864 - protein, 39 aa, Mycobacterium tuberculosis
FAAYDQYLVRFCFPNFLRWLGFGFLFVDILGFNIIGFII

SEQ ID NO: 1391865 - protein, 17 aa, Mycobacterium tuberculosis
FAFPVFGFGVMFGAIWA

SEQ ID NO: 1391866 - protein, 18 aa, Mycobacterium tuberculosis
FAFPVFGFGVMFGAIWAE

SEQ ID NO: 1391867 - protein, 17 aa, Mycobacterium tuberculosis
FAGYLLTYTIANNGKEF

SEQ ID NO: 1391868 - protein, 23 aa, Mycobacterium tuberculosis
FAHQGTLLPILLITLINGIAEEM

SEQ ID NO: 1391869 - protein, 25 aa, Mycobacterium tuberculosis
FAHQGTLLPILLITLINGIAEEMFF

SEQ ID NO: 1391870 - protein, 24 aa, Mycobacterium tuberculosis
FAHSWFFLFLFVVAGLVALYILMQ

SEQ ID NO: 1391871 - protein, 21 aa, Mycobacterium tuberculosis
FAILCRRYLAVIAADRQYAVF

SEQ ID NO: 1391872 - protein, 27 aa, Mycobacterium tuberculosis
FALSMAGLILLWRLLRRESARPVVAGF

SEQ ID NO: 1391873 - protein, 18 aa, Mycobacterium tuberculosis
FASQPLGAIVFAGLLAWL

SEQ ID NO: 1391874 - protein, 27 aa, Mycobacterium tuberculosis
FATLISRITGFARIVLLAAILGAALAS

SEQ ID NO: 1391875 - protein, 26 aa, Mycobacterium tuberculosis
FATRGWMAFPIMILLASGGIGMPALQ

SEQ ID NO: 1391876 - protein, 18 aa, Mycobacterium tuberculosis
FAVHVVAIVVLVLGYREF

SEQ ID NO: 1391877 - protein, 38 aa, Mycobacterium tuberculosis
FAVITVLLLLVYRSIATTLLILPMVFIGLGATRGTIAF

SEQ ID NO: 1391878 - protein, 18 aa, Mycobacterium tuberculosis
FCLSFARMPYFQTLGIPC

SEQ ID NO: 1391879 - protein, 19 aa, Mycobacterium tuberculosis
FDAARPLGAWVDALLRTFI

SEQ ID NO: 1391880 - protein, 20 aa, Mycobacterium tuberculosis
FDGQLWIDMDFVDGTDTVSL

SEQ ID NO: 1391881 - protein, 17 aa, Mycobacterium tuberculosis
FDPMIVRSALPQSLRKL

SEQ ID NO: 1391882 - protein, 17 aa, Mycobacterium tuberculosis
FDTFVRYHWGHEFMAIH

SEQ ID NO: 1391883 - protein, 18 aa, Mycobacterium tuberculosis
FDTSALIIAFVVLGRHLE

SEQ ID NO: 1391884 - protein, 20 aa, Mycobacterium tuberculosis
FDYMGLLLLSPGLATFLFGV

SEQ ID NO: 1391885 - protein, 25 aa, Mycobacterium tuberculosis
FEKLRDLVINAPARLDLLTQQYVEL

SEQ ID NO: 1391886 - protein, 23 aa, Mycobacterium tuberculosis
FELTPVAWWICGSATGVTVLYLA

SEQ ID NO: 1391887 - protein, 21 aa, Mycobacterium tuberculosis
FEPRHRPPPLPPQQERPVWQP

SEQ ID NO: 1391888 - protein, 26 aa, Mycobacterium tuberculosis
FEVIVVPVLLVLMLSALLVPPVDWLD

SEQ ID NO: 1391889 - protein, 19 aa, Mycobacterium tuberculosis
FFAILRCLGVTREQLFWLI

SEQ ID NO: 1391890 - protein, 20 aa, Mycobacterium tuberculosis
FFAILRCLGVTREQLFWLIM

SEQ ID NO: 1391891 - protein, 18 aa, Mycobacterium tuberculosis
FFAVSGFLLWRGHAAAAR

SEQ ID NO: 1391892 - protein, 28 aa, Mycobacterium tuberculosis
FFVVSNSLRLRKFGRYPLGCGTVGGPQM

SEQ ID NO: 1391893 - protein, 24 aa, Mycobacterium tuberculosis
FGADLRPVLLRAMTFMIVASPCAV

SEQ ID NO: 1391894 - protein, 18 aa, Mycobacterium tuberculosis
FGAILRPLGQPANEIIET

SEQ ID NO: 1391895 - protein, 20 aa, Mycobacterium tuberculosis
FGAIPVLAGPLLGALAAAVV

SEQ ID NO: 1391896 - protein, 22 aa, Mycobacterium tuberculosis
FGALLRVVYVALPPLHDQWRPV

SEQ ID NO: 1391897 - protein, 17 aa, Mycobacterium tuberculosis
FGDTMGYRLVIYPEYAS

SEQ ID NO: 1391898 - protein, 23 aa, Mycobacterium tuberculosis
FGDTMGYRLVIYPEYASLDRVDP

SEQ ID NO: 1391899 - protein, 24 aa, Mycobacterium tuberculosis
FGELEFWFALIKVAAIVCLIAVGA

SEQ ID NO: 1391900 - protein, 31 aa, Mycobacterium tuberculosis
FGEVGFRSVWITVLLTRLAIVAAVALVVAGI

SEQ ID NO: 1391901 - protein, 18 aa, Mycobacterium tuberculosis
FGGLMLLGGRLGDTIGRK

SEQ ID NO: 1391902 - protein, 28 aa, Mycobacterium tuberculosis
FGIVPGYCVLAFILGTYWLTRQTARALR

SEQ ID NO: 1391903 - protein, 27 aa, Mycobacterium tuberculosis
FGLPTWLILFLRILFTAITFGALWLLY

SEQ ID NO: 1391904 - protein, 28 aa, Mycobacterium tuberculosis
FGLSVLLWQHILAIHLHWLVLAMSVIVL

SEQ ID NO: 1391905 - protein, 20 aa, Mycobacterium tuberculosis
FGMVTLLGSALLSVLHLPQD

SEQ ID NO: 1391906 - protein, 25 aa, Mycobacterium tuberculosis
FGRGQHFCPWISSRSPPRTDRHRSA

SEQ ID NO: 1391907 - protein, 18 aa, Mycobacterium tuberculosis
FGRRPVLLASLLGATIDY

SEQ ID NO: 1391908 - protein, 29 aa, Mycobacterium tuberculosis
FGSSALLCPLLVYGWLELPRWGLTGSAVA

SEQ ID NO: 1391909 - protein, 23 aa, Mycobacterium tuberculosis
FGSSSLWISWVSTLLGSLLRWHP

SEQ ID NO: 1391910 - protein, 32 aa, Mycobacterium tuberculosis
FGTPVLLHLFYVAKILLYVLVGWLIVLTTKGI

SEQ ID NO: 1391911 - protein, 24 aa, Mycobacterium tuberculosis
FIAFDQLWRWNSIVALVLSVMVIL

SEQ ID NO: 1391912 - protein, 32 aa, Mycobacterium tuberculosis
FIARMIHAFAVPIILGWLAVCVVVTVFVPSLE

SEQ ID NO: 1391913 - protein, 17 aa, Mycobacterium tuberculosis
FIDYCVNMLLSTAATYA

SEQ ID NO: 1391914 - protein, 21 aa, Mycobacterium tuberculosis
FLAAAVLYFLAIGQVKGFAFT

SEQ ID NO: 1391915 - protein, 26 aa, Mycobacterium tuberculosis
FLAGTIVGYYILRRALRPDGGQLIGV

SEQ ID NO: 1391916 - protein, 33 aa, Mycobacterium tuberculosis
FLAKLRLFRVPELLAGSFLLALLAVTAANFFTV

SEQ ID NO: 1391917 - protein, 19 aa, Mycobacterium tuberculosis
FLGTVLLYFAARDSGAAAA

SEQ ID NO: 1391918 - protein, 17 aa, Mycobacterium tuberculosis
FLISLWAGSSAISAFVD

SEQ ID NO: 1391919 - protein, 21 aa, Mycobacterium tuberculosis
FLLQKVLDLPAGQLPPEPPIW

SEQ ID NO: 1391920 - protein, 17 aa, Mycobacterium tuberculosis
FLRVWLPGQLLQGIGVG

SEQ ID NO: 1391921 - protein, 18 aa, Mycobacterium tuberculosis
FLSQLFGAILRPLGQPAN

SEQ ID NO: 1391922 - protein, 19 aa, Mycobacterium tuberculosis
FLYAIVFGGFVAFSNYLPT

SEQ ID NO: 1391923 - protein, 31 aa, Mycobacterium tuberculosis
FMFTFAIKAPLWPFHRWLPDAAVESTPATAV

SEQ ID NO: 1391924 - protein, 21 aa, Mycobacterium tuberculosis
FMNGWYYLTRREDVLAALRNP

SEQ ID NO: 1391925 - protein, 17 aa, Mycobacterium tuberculosis
FMTPSIAALLGRWFWWP

SEQ ID NO: 1391926 - protein, 19 aa, Mycobacterium tuberculosis
FNHPQAFFAPISAVVCMSA

SEQ ID NO: 1391927 - protein, 19 aa, Mycobacterium tuberculosis
FNIIGFIITLASNAQLLTE

SEQ ID NO: 1391928 - protein, 23 aa, Mycobacterium tuberculosis
FNTACLVLLGLFPLFVMFVITAI

SEQ ID NO: 1391929 - protein, 24 aa, Mycobacterium tuberculosis
FPSNLIIPEYLFIQSSTDLRTPKA

SEQ ID NO: 1391930 - protein, 32 aa, Mycobacterium tuberculosis
FQPPMTTWYAAMLFAVIPLRNALPDAPPIGFW

SEQ ID NO: 1391931 - protein, 17 aa, Mycobacterium tuberculosis
FQPWRRSWSRPRWYPVR

SEQ ID NO: 1391932 - protein, 26 aa, Mycobacterium tuberculosis
FQTFLRPEDVFWSFLEALIITAIVMV

SEQ ID NO: 1391933 - protein, 17 aa, Mycobacterium tuberculosis
FRGFTFGIDFKGGTTVS

SEQ ID NO: 1391934 - protein, 18 aa, Mycobacterium tuberculosis
FRRFFSRLQRPVDNFGEQ

SEQ ID NO: 1391935 - protein, 17 aa, Mycobacterium tuberculosis
FRRRPAPARLPLWACGA

SEQ ID NO: 1391936 - protein, 18 aa, Mycobacterium tuberculosis
FRRSELMLALATTAAVLG

SEQ ID NO: 1391937 - protein, 19 aa, Mycobacterium tuberculosis
FRVPELLAGSFLLALLAVT

SEQ ID NO: 1391938 - protein, 28 aa, Mycobacterium tuberculosis
FSATRYEWAILDFAILAVGAVTVPIYET

SEQ ID NO: 1391939 - protein, 25 aa, Mycobacterium tuberculosis
FSFFYFFFFFLFKKKKKKKKKKKKK

SEQ ID NO: 1391940 - protein, 27 aa, Mycobacterium tuberculosis
FSGRARMSSMLWTFQVNQADGVACPDG

SEQ ID NO: 1391941 - protein, 27 aa, Mycobacterium tuberculosis
FSMLALLTRRWALAWVALAGSAMASGT

SEQ ID NO: 1391942 - protein, 23 aa, Mycobacterium tuberculosis
FSQYFVDYFITPLVAAVWSCGGA

SEQ ID NO: 1391943 - protein, 26 aa, Mycobacterium tuberculosis
FSRGQLIQLVLIGALVYVAYPFISTV

SEQ ID NO: 1391944 - protein, 30 aa, Mycobacterium tuberculosis
FSSGQRALLWAAGVLGALAIIIAVLLVIKA

SEQ ID NO: 1391945 - protein, 17 aa, Mycobacterium tuberculosis
FSVWMLWSIVVVQMTAA

SEQ ID NO: 1391946 - protein, 18 aa, Mycobacterium tuberculosis
FTAFGWGVLFAESALAVL

SEQ ID NO: 1391947 - protein, 28 aa, Mycobacterium tuberculosis
FTAKVWGFLFIYFWLRATLPRLRYDQFM

SEQ ID NO: 1391948 - protein, 25 aa, Mycobacterium tuberculosis
FTAVPLLWLLAIDAALITLGAMAFR

SEQ ID NO: 1391949 - protein, 41 aa, Mycobacterium tuberculosis
FTGTLGLLRLYLRRDRVSLPLWVLLLSVPLATVYIASVETV

SEQ ID NO: 1391950 - protein, 20 aa, Mycobacterium tuberculosis
FTPKTQLTMLSARAGLVMDP

SEQ ID NO: 1391951 - protein, 20 aa, Mycobacterium tuberculosis
FTVAQWRWRWFRAAMCKTMA

SEQ ID NO: 1391952 - protein, 21 aa, Mycobacterium tuberculosis
FVAFWACLTLLARPACDLAGM

SEQ ID NO: 1391953 - protein, 19 aa, Mycobacterium tuberculosis
FVAGAVLAYLVLSKALGFL

SEQ ID NO: 1391954 - protein, 19 aa, Mycobacterium tuberculosis
FVATISFVIYLICWLLRRR

SEQ ID NO: 1391955 - protein, 21 aa, Mycobacterium tuberculosis
FVAWFVLYLMLVLRAVGAGGN

SEQ ID NO: 1391956 - protein, 20 aa, Mycobacterium tuberculosis
FVEGRWLSVGLLSVGVAGFC

SEQ ID NO: 1391957 - protein, 21 aa, Mycobacterium tuberculosis
FVFLALLPFIMGALSMSVPGD

SEQ ID NO: 1391958 - protein, 17 aa, Mycobacterium tuberculosis
FVGPLLAAVARIYGGRL

SEQ ID NO: 1391959 - protein, 26 aa, Mycobacterium tuberculosis
FVIDEGPLYFWLPCLACLLAVAELQL

SEQ ID NO: 1391960 - protein, 19 aa, Mycobacterium tuberculosis
FVIGHLLGVPGWVTQRLWW

SEQ ID NO: 1391961 - protein, 17 aa, Mycobacterium tuberculosis
FVLFCVVIVSAWSNAVN

SEQ ID NO: 1391962 - protein, 17 aa, Mycobacterium tuberculosis
FVLRRLGPGPGGLASNR

SEQ ID NO: 1391963 - protein, 19 aa, Mycobacterium tuberculosis
FWRTPSIFHFRYSDRVFAG

SEQ ID NO: 1391964 - protein, 33 aa, Mycobacterium tuberculosis
FYCYGLTHVLYLNYVWHYSLLKAGFAIAPAAVV

SEQ ID NO: 1391965 - protein, 19 aa, Mycobacterium tuberculosis
FYFFFFFIILFYKIFFFLI

SEQ ID NO: 1391966 - protein, 28 aa, Mycobacterium tuberculosis
FYGNIAWGIFVLLWHLLVVTNIDNVLRP

SEQ ID NO: 1391967 - protein, 19 aa, Mycobacterium tuberculosis
FYGWMLQLIWQFLQDPIGN

SEQ ID NO: 1391968 - protein, 17 aa, Mycobacterium tuberculosis
FYMLMPYLADYLAGPLG

SEQ ID NO: 1391969 - protein, 20 aa, Mycobacterium tuberculosis
FYRRGLFGTIGPYNLRYRVL

SEQ ID NO: 1391970 - protein, 20 aa, Mycobacterium tuberculosis
GAALAYAVDVKNAVIVAAAG

SEQ ID NO: 1391971 - protein, 20 aa, Mycobacterium tuberculosis
GAAVLMVALLVLASVLSRIF

SEQ ID NO: 1391972 - protein, 22 aa, Mycobacterium tuberculosis
GAAYLAGFAWGLSREYSVLVEM

SEQ ID NO: 1391973 - protein, 19 aa, Mycobacterium tuberculosis
GACIGFLWWNAAPAKIFHG

SEQ ID NO: 1391974 - protein, 19 aa, Mycobacterium tuberculosis
GADLRPVLLRAMTFMIVAS

SEQ ID NO: 1391975 - protein, 23 aa, Mycobacterium tuberculosis
GAEWGRWGSLSTCSPLYLSVVCL

SEQ ID NO: 1391976 - protein, 17 aa, Mycobacterium tuberculosis
GAEWLFTPVLLSQNYHL

SEQ ID NO: 1391977 - protein, 22 aa, Mycobacterium tuberculosis
GAFAARRWYRKWRARPRRRCGL

SEQ ID NO: 1391978 - protein, 22 aa, Mycobacterium tuberculosis
GAFLSQLFGAILRPLGQPANEI

SEQ ID NO: 1391979 - protein, 27 aa, Mycobacterium tuberculosis
GAHARSGGRRWIRCERLPIAGAELVGD

SEQ ID NO: 1391980 - protein, 18 aa, Mycobacterium tuberculosis
GAHRLFTVGFAAVGLLGT

SEQ ID NO: 1391981 - protein, 26 aa, Mycobacterium tuberculosis
GAIEPQFFAALLSGLGLSAADGADSA

SEQ ID NO: 1391982 - protein, 32 aa, Mycobacterium tuberculosis
GAIGLLLVLVYSLLYYRVLGLLTALSLVASGS

SEQ ID NO: 1391983 - protein, 24 aa, Mycobacterium tuberculosis
GAIQAFIFALLTNLYFRPSDGARR

SEQ ID NO: 1391984 - protein, 18 aa, Mycobacterium tuberculosis
GAISRTHWLASHLAMALA

SEQ ID NO: 1391985 - protein, 22 aa, Mycobacterium tuberculosis
GALAIIIAVLLVIKAPGDNSPQ

SEQ ID NO: 1391986 - protein, 20 aa, Mycobacterium tuberculosis
GALIGWLYDISIGTLVVVVI

SEQ ID NO: 1391987 - protein, 25 aa, Mycobacterium tuberculosis
GALKKAMMLLGVLAVLVAMVGLAAL

SEQ ID NO: 1391988 - protein, 18 aa, Mycobacterium tuberculosis
GALLLGARLGPARTAGIC

SEQ ID NO: 1391989 - protein, 19 aa, Mycobacterium tuberculosis
GALQIVFGLSRMARAALAI

SEQ ID NO: 1391990 - protein, 21 aa, Mycobacterium tuberculosis
GALSGMWGIPAVVAVATVGVV

SEQ ID NO: 1391991 - protein, 39 aa, Mycobacterium tuberculosis
GALTARMLAIAFFALLYLLPLILRLWRGDTTHDRHAAAR

SEQ ID NO: 1391992 - protein, 33 aa, Mycobacterium tuberculosis
GAMAYSWYLWHWPLLIFWLSYTGHRHANFVEGA

SEQ ID NO: 1391993 - protein, 17 aa, Mycobacterium tuberculosis
GAMYCLSFARLPYFETL

SEQ ID NO: 1391994 - protein, 17 aa, Mycobacterium tuberculosis
GAPGPMPAPPLGAVPSP

SEQ ID NO: 1391995 - protein, 17 aa, Mycobacterium tuberculosis
GAPLAELAPLLSAGATA

SEQ ID NO: 1391996 - protein, 19 aa, Mycobacterium tuberculosis
GAQFFFLVAAALVVLLVGI

SEQ ID NO: 1391997 - protein, 18 aa, Mycobacterium tuberculosis
GARGLFACRQSLRPRYLC

SEQ ID NO: 1391998 - protein, 26 aa, Mycobacterium tuberculosis
GARSPVSFFAYPGMPSDLVPAGCEVH

SEQ ID NO: 1391999 - protein, 25 aa, Mycobacterium tuberculosis
GASAWQRFWRITLPMLRPTMFFVLV

SEQ ID NO: 1392000 - protein, 32 aa, Mycobacterium tuberculosis
GASFGLSVLLWQHILAIHLHWLVLAMSVIVLL

SEQ ID NO: 1392001 - protein, 23 aa, Mycobacterium tuberculosis
GATAAWAIGRWTPGTERRTATMG

SEQ ID NO: 1392002 - protein, 27 aa, Mycobacterium tuberculosis
GAVLTSPVAFLQRPARWLQLMAREGQA

SEQ ID NO: 1392003 - protein, 25 aa, Mycobacterium tuberculosis
GAVNPWQWLLALLQQLWNAYTGFYG

SEQ ID NO: 1392004 - protein, 18 aa, Mycobacterium tuberculosis
GAVSRTHWLASHLAMALA

SEQ ID NO: 1392005 - protein, 24 aa, Mycobacterium tuberculosis
GAVVPHVRWPMWLRTAVATAALAA

SEQ ID NO: 1392006 - protein, 19 aa, Mycobacterium tuberculosis
GCAAATMLGLSLASSSASA

SEQ ID NO: 1392007 - protein, 24 aa, Mycobacterium tuberculosis
GCAYLLRRLFRGPRAPYLRTMFVV

SEQ ID NO: 1392008 - protein, 25 aa, Mycobacterium tuberculosis
GCNFSAWMRLLIRNRFAVHHSRWHF

SEQ ID NO: 1392009 - protein, 22 aa, Mycobacterium tuberculosis
GCSLRLPGIYPSPGLQRSTACG

SEQ ID NO: 1392010 - protein, 18 aa, Mycobacterium tuberculosis
GDADPLGNLPLFAGLDAA

SEQ ID NO: 1392011 - protein, 23 aa, Mycobacterium tuberculosis
GDADPLGNLPLFAGLDAATLAQL

SEQ ID NO: 1392012 - protein, 28 aa, Mycobacterium tuberculosis
GDASVGWLRLGALALALAALAALLINRR

SEQ ID NO: 1392013 - protein, 23 aa, Mycobacterium tuberculosis
GDGPYVLVGWSLGGVLAYACAIG

SEQ ID NO: 1392014 - protein, 24 aa, Mycobacterium tuberculosis
GDIKSLADGLARFTWQLRAADPRL

SEQ ID NO: 1392015 - protein, 19 aa, Mycobacterium tuberculosis
GDRLWIRFIADTERRSQVI

SEQ ID NO: 1392016 - protein, 24 aa, Mycobacterium tuberculosis
GDVRRAMTMLLIACPCAVGLSTPT

SEQ ID NO: 1392017 - protein, 28 aa, Mycobacterium tuberculosis
GDWILNRGLRIVMLLIAAVLAARFVTWL

SEQ ID NO: 1392018 - protein, 25 aa, Mycobacterium tuberculosis
GEIALYSFVVLLITGVYLTLFFDPS

SEQ ID NO: 1392019 - protein, 24 aa, Mycobacterium tuberculosis
GEIARRVFATCRRLGLGTVAVYTD

SEQ ID NO: 1392020 - protein, 25 aa, Mycobacterium tuberculosis
GEKNMPFWGTSFSAAYVSGVAALVR

SEQ ID NO: 1392021 - protein, 17 aa, Mycobacterium tuberculosis
GELFWTVVPYVTMTIVA

SEQ ID NO: 1392022 - protein, 18 aa, Mycobacterium tuberculosis
GELGLLIDAPRSATVRAL

SEQ ID NO: 1392023 - protein, 26 aa, Mycobacterium tuberculosis
GESALFFIGVLIVALLGGVAPAALSA

SEQ ID NO: 1392024 - protein, 26 aa, Mycobacterium tuberculosis
GESSFYWLALALAAVWIAGALMSGPL

SEQ ID NO: 1392025 - protein, 28 aa, Mycobacterium tuberculosis
GESSFYWLTLALAAVWIAGALMSGPLHL

SEQ ID NO: 1392026 - protein, 21 aa, Mycobacterium tuberculosis
GFFPGVIAYLTVWFPCAQRAR

SEQ ID NO: 1392027 - protein, 24 aa, Mycobacterium tuberculosis
GFGELAVFVFFGPVAVLGTQYTQA

SEQ ID NO: 1392028 - protein, 27 aa, Mycobacterium tuberculosis
GFLAGTIVGYYILRRALRPDGGQLIGV

SEQ ID NO: 1392029 - protein, 20 aa, Mycobacterium tuberculosis
GFMSLFVYWQARNAREPLIP

SEQ ID NO: 1392030 - protein, 21 aa, Mycobacterium tuberculosis
GFNIIGFIITLASNAQLLTEF

SEQ ID NO: 1392031 - protein, 20 aa, Mycobacterium tuberculosis
GFPAGLWRWLQRHPPPALHR

SEQ ID NO: 1392032 - protein, 26 aa, Mycobacterium tuberculosis
GFRTPLRRAGRWWAGYRVQHSALPAR

SEQ ID NO: 1392033 - protein, 20 aa, Mycobacterium tuberculosis
GFSVLAIAMTWLLCEMAPGT

SEQ ID NO: 1392034 - protein, 21 aa, Mycobacterium tuberculosis
GFVLATEYWLVTSAGPMLVLL

SEQ ID NO: 1392035 - protein, 18 aa, Mycobacterium tuberculosis
GFVVPLAYAWSKVHFGNI

SEQ ID NO: 1392036 - protein, 26 aa, Mycobacterium tuberculosis
GFWIRRARRLLPALVLMVLTVSAARA

SEQ ID NO: 1392037 - protein, 27 aa, Mycobacterium tuberculosis
GGAPPWGPPSSPLPRSARQPWLWVGVA

SEQ ID NO: 1392038 - protein, 32 aa, Mycobacterium tuberculosis
GGARRQRRYWRYWAPAVLTAVAVFSPVLVCLG

SEQ ID NO: 1392039 - protein, 27 aa, Mycobacterium tuberculosis
GGATVFTVAQWRWRWFRAAMCKTMAVA

SEQ ID NO: 1392040 - protein, 17 aa, Mycobacterium tuberculosis
GGAVAFSIVRRSSRPEP

SEQ ID NO: 1392041 - protein, 31 aa, Mycobacterium tuberculosis
GGDFMHGRVLLAPLFCLLAPVGVIPILLPDG

SEQ ID NO: 1392042 - protein, 36 aa, Mycobacterium tuberculosis
GGDFMHGRVLLAPLFCLLAPVGVIPILLPDGKDFSR

SEQ ID NO: 1392043 - protein, 24 aa, Mycobacterium tuberculosis
GGFVLATQYWLVTSAGPMLVLLAA

SEQ ID NO: 1392044 - protein, 49 aa, Mycobacterium tuberculosis
GGFVLATQYWLVTSAGPMLVLLAAGLGVLWLPAGWLAHRLLSVPVTTCR

SEQ ID NO: 1392045 - protein, 29 aa, Mycobacterium tuberculosis
GGGDFTAVPLLWLLAIDAALITLGRHGLP

SEQ ID NO: 1392046 - protein, 25 aa, Mycobacterium tuberculosis
GGGGPGIGWLLPNAGVASDNIGALL

SEQ ID NO: 1392047 - protein, 25 aa, Mycobacterium tuberculosis
GGGRLAPRPVFRPPVDPASGQAFGR

SEQ ID NO: 1392048 - protein, 20 aa, Mycobacterium tuberculosis
GGIFVLLWHLLVVTNIDNVL

SEQ ID NO: 1392049 - protein, 18 aa, Mycobacterium tuberculosis
GGILNPMTNLRHFPIALV

SEQ ID NO: 1392050 - protein, 19 aa, Mycobacterium tuberculosis
GGLARRMPATTVFFGVAAL

SEQ ID NO: 1392051 - protein, 22 aa, Mycobacterium tuberculosis
GGPAPPLRQPLPPPPTTTNRNR

SEQ ID NO: 1392052 - protein, 21 aa, Mycobacterium tuberculosis
GGQVARLWKLTSALTIDDRTG

SEQ ID NO: 1392053 - protein, 26 aa, Mycobacterium tuberculosis
GGTVIAILLMWSKLPAKVRIIPGPLV

SEQ ID NO: 1392054 - protein, 20 aa, Mycobacterium tuberculosis
GGVAAVYAWLRRRRRPPDSS

SEQ ID NO: 1392055 - protein, 39 aa, Mycobacterium tuberculosis
GGVIAVMAVLFIGAVLILGFWAPGFFVTTKLDVIKAQAG

SEQ ID NO: 1392056 - protein, 26 aa, Mycobacterium tuberculosis
GGVLLWQHLFWFFGHPEVYIIALPFF

SEQ ID NO: 1392057 - protein, 23 aa, Mycobacterium tuberculosis
GGVWLTSFLLVATNTAIASVLVC

SEQ ID NO: 1392058 - protein, 18 aa, Mycobacterium tuberculosis
GGWLLVVGLTLACAGLLW

SEQ ID NO: 1392059 - protein, 23 aa, Mycobacterium tuberculosis
GHWSLLVGYGCLPWVATAMLTMR

SEQ ID NO: 1392060 - protein, 32 aa, Mycobacterium tuberculosis; identical to SEQ ID NO: 817307

SEQ ID NO: 1392061 - protein, 22 aa, Mycobacterium tuberculosis
GIAATAFLLTAGVPLIVELGAS

SEQ ID NO: 1392062 - protein, 17 aa, Mycobacterium tuberculosis
GIALASLGVIVATVTFY

SEQ ID NO: 1392063 - protein, 20 aa, Mycobacterium tuberculosis
GIAVAFLGTVLLYFAARDSG

SEQ ID NO: 1392064 - protein, 25 aa, Mycobacterium tuberculosis
GIGLIDDRWGLDALTKFAGQITAAS

SEQ ID NO: 1392065 - protein, 20 aa, Mycobacterium tuberculosis
GIGMIFYGNIAWGIFVLLWH

SEQ ID NO: 1392066 - protein, 28 aa, Mycobacterium tuberculosis
GIGSIFPLFMMVGIMMMMFRGMGGGQQQ

SEQ ID NO: 1392067 - protein, 17 aa, Mycobacterium tuberculosis
GIGYVVDLQFKGPAANI

SEQ ID NO: 1392068 - protein, 27 aa, Mycobacterium tuberculosis
GIIIEILIQLFLISLEILFAIVAYTII

SEQ ID NO: 1392069 - protein, 68 aa, Mycobacterium tuberculosis
GIIIEILIQLFLISLEILFAIVAYTIIIVLILPLVIFAYAIVFAVLAIIFGPPLLVIASPFVLTGSVI

SEQ ID NO: 1392070 - protein, 32 aa, Mycobacterium tuberculosis; identical to SEQ ID NO: 162452

SEQ ID NO: 1392071 - protein, 29 aa, Mycobacterium tuberculosis
GILSLLLAPLFPMTVVLPLSAFVALPAIA

SEQ ID NO: 1392072 - protein, 24 aa, Mycobacterium tuberculosis
GIMWPSLLVILLLVAVVALLFTSR

SEQ ID NO: 1392073 - protein, 27 aa, Mycobacterium tuberculosis
GINPLTWPPAFFSWFAAGMLLAEWAYS

SEQ ID NO: 1392074 - protein, 23 aa, Mycobacterium tuberculosis
GINPLTWPPAFFSWFAAGMSVGA

SEQ ID NO: 1392075 - protein, 20 aa, Mycobacterium tuberculosis
GISPLGCWPGSSALLTIAVP

SEQ ID NO: 1392076 - protein, 26 aa, Mycobacterium tuberculosis
GIVGTFLFVPKLRRWLATAVRPKLRE

SEQ ID NO: 1392077 - protein, 31 aa, Mycobacterium tuberculosis
GIVLACPVWFYQLWAFITPGLYQRERRFAVA

SEQ ID NO: 1392078 - protein, 18 aa, Mycobacterium tuberculosis
GIVPLLPVNQTTATIFWP

SEQ ID NO: 1392079 - protein, 20 aa, Mycobacterium tuberculosis
GIVRFDLQLLGPGPRWWGAC

SEQ ID NO: 1392080 - protein, 34 aa, Mycobacterium tuberculosis
GKKTLMDLATRPATFLWLIAATGTLLVATHRMDP

SEQ ID NO: 1392081 - protein, 18 aa, Mycobacterium tuberculosis
GKLHFWLTFIGFHTTFLV

SEQ ID NO: 1392082 - protein, 24 aa, Mycobacterium tuberculosis
GKLRPALFVVPTDAPGFSYTPIEM

SEQ ID NO: 1392083 - protein, 24 aa, Mycobacterium tuberculosis
GKSQLLNSLLNLPAARVGDDEATV

SEQ ID NO: 1392084 - protein, 22 aa, Mycobacterium tuberculosis
GKTTLLMTLAGLLPPVHGRVLL

SEQ ID NO: 1392085 - protein, 18 aa, Mycobacterium tuberculosis
GLAALLRQRFPDLTPAQI

SEQ ID NO: 1392086 - protein, 31 aa, Mycobacterium tuberculosis
GLADLYSLGCALFRLLTGEAPFAAGAGAAVA

SEQ ID NO: 1392087 - protein, 30 aa, Mycobacterium tuberculosis
GLAIVFSILLFPPDPVVMLCSARADVLAAV

SEQ ID NO: 1392088 - protein, 25 aa, Mycobacterium tuberculosis
GLANRVFVTIILFSVTICGVLVATN

SEQ ID NO: 1392089 - protein, 31 aa, Mycobacterium tuberculosis
GLAPTLWGWRRTPVLRWFVLGAAVGVAGAGS

SEQ ID NO: 1392090 - protein, 18 aa, Mycobacterium tuberculosis
GLFVMFSRMQGGARMGFG

SEQ ID NO: 1392091 - protein, 19 aa, Mycobacterium tuberculosis
GLGLLFDTLIVRSFMTPSI

SEQ ID NO: 1392092 - protein, 22 aa, Mycobacterium tuberculosis
GLGLLIGIWLGEGLIGLVTQTI

SEQ ID NO: 1392093 - protein, 18 aa, Mycobacterium tuberculosis
GLGMPIPLGWQVWLYGVF

SEQ ID NO: 1392094 - protein, 18 aa, Mycobacterium tuberculosis
GLGVLWLPAGWLAHRLLS

SEQ ID NO: 1392095 - protein, 24 aa, Mycobacterium tuberculosis
GLIGRLDGRVVRLGRPGWLDVAEL

SEQ ID NO: 1392096 - protein, 29 aa, Mycobacterium tuberculosis
GLLDNRPIGVLFKRIFDRPARRPVRRVLL

SEQ ID NO: 1392097 - protein, 17 aa, Mycobacterium tuberculosis
GLLGPRLPRILAAVALG

SEQ ID NO: 1392098 - protein, 18 aa, Mycobacterium tuberculosis
GLLGPRLPRILAAVALGV

SEQ ID NO: 1392099 - protein, 23 aa, Mycobacterium tuberculosis
GLLLGPPAGAQPPFRLPNYVTDN

SEQ ID NO: 1392100 - protein, 28 aa, Mycobacterium tuberculosis
GLLVEWAGWRWVLLVNVPLGIVAAIATK

SEQ ID NO: 1392101 - protein, 29 aa, Mycobacterium tuberculosis
GLLVEWAGWRWVLLVNVPLGIVAAIATKR

SEQ ID NO: 1392102 - protein, 36 aa, Mycobacterium tuberculosis
GLLVVLGTWQVSGRLLFALLSFSVVGAVLALATPVV

SEQ ID NO: 1392103 - protein, 26 aa, Mycobacterium tuberculosis
GLMKPIVLAWVITLPSAAILASVGLV

SEQ ID NO: 1392104 - protein, 18 aa, Mycobacterium tuberculosis
GLNALRLLRHTAWRRAAG

SEQ ID NO: 1392105 - protein, 18 aa, Mycobacterium tuberculosis
GLNGLRLLRHTAWRRAAG

SEQ ID NO: 1392106 - protein, 21 aa, Mycobacterium tuberculosis
GLQAPQVPIPPPPPGPDVIPG

SEQ ID NO: 1392107 - protein, 22 aa, Mycobacterium tuberculosis
GLQAPQVPIPPPPPGPDVIPGP

SEQ ID NO: 1392108 - protein, 25 aa, Mycobacterium tuberculosis
GLQVKTIWVARAVSVLFPQITNIFG

SEQ ID NO: 1392109 - protein, 24 aa, Mycobacterium tuberculosis
GLRLAVVFLCAAAISAAVVTGYLR

SEQ ID NO: 1392110 - protein, 20 aa, Mycobacterium tuberculosis
GLRPRYPAIEIYRVSAPANP

SEQ ID NO: 1392111 - protein, 26 aa, Mycobacterium tuberculosis
GLSAFYYALLLLLAGFTGSIVVSTLV

SEQ ID NO: 1392112 - protein, 22 aa, Mycobacterium tuberculosis
GLSATLFYLVAYSFSTMGAFAI

SEQ ID NO: 1392113 - protein, 26 aa, Mycobacterium tuberculosis
GLSVLLWQHILAIHLHWLVLAMSVIV

SEQ ID NO: 1392114 - protein, 37 aa, Mycobacterium tuberculosis
GLSVLVWQHLLGIQLYWIVLALAVILLLAVGSDYNLL

SEQ ID NO: 1392115 - protein, 34 aa, Mycobacterium tuberculosis
GLTAKLIIWYPHYAWLLLSVYLTVALVALVVVGS

SEQ ID NO: 1392116 - protein, 33 aa, Mycobacterium tuberculosis
GLTFNDFMLHLTPLVVIVLIALIAVLHRLFGSI

SEQ ID NO: 1392117 - protein, 28 aa, Mycobacterium tuberculosis
GLTGCFGVEVWFLAALAAPLLTAVCGVM

SEQ ID NO: 1392118 - protein, 19 aa, Mycobacterium tuberculosis
GLTLSVIATIFGAVAGLLA

SEQ ID NO: 1392119 - protein, 20 aa, Mycobacterium tuberculosis
GLVCWLLLSREVLPRLGPAV

SEQ ID NO: 1392120 - protein, 21 aa, Mycobacterium tuberculosis
GLVLIAVLVFVPRVWVAIVAV

SEQ ID NO: 1392121 - protein, 18 aa, Mycobacterium tuberculosis
GLVPLHAWLPRAHPEAPS

SEQ ID NO: 1392122 - protein, 17 aa, Mycobacterium tuberculosis
GLWPPKLPDIPIPGLPD

SEQ ID NO: 1392123 - protein, 17 aa, Mycobacterium tuberculosis
GMRLHHFGAFYKRSWRA

SEQ ID NO: 1392124 - protein, 28 aa, Mycobacterium tuberculosis
GMVAATLALIVIPLMFGADLRPVLLRAM

SEQ ID NO: 1392125 - protein, 42 aa, Mycobacterium tuberculosis
GMWFDPATARRVAVWAFVMVLAFSRHLFVRPVIRMDQTAWCA

SEQ ID NO: 1392126 - protein, 22 aa, Mycobacterium tuberculosis
GNGWRVSGLLRIDEVASATGYR

SEQ ID NO: 1392127 - protein, 23 aa, Mycobacterium tuberculosis
GNKRTIVGYFTSAVGLYPGDQVR

SEQ ID NO: 1392128 - protein, 22 aa, Mycobacterium tuberculosis
GPALMFALAWLLLADLPEYRTG

SEQ ID NO: 1392129 - protein, 19 aa, Mycobacterium tuberculosis
GPKCLVKVIQKLSGLSINR

SEQ ID NO: 1392130 - protein, 21 aa, Mycobacterium tuberculosis
GPLAHPFQPLLAPRLREFALR

SEQ ID NO: 1392131 - protein, 26 aa, Mycobacterium tuberculosis
GPNVALLLLFVYRPLADNIRLSFFDW

SEQ ID NO: 1392132 - protein, 23 aa, Mycobacterium tuberculosis
GPNYFSIALIVITFVVVPAMAYL

SEQ ID NO: 1392133 - protein, 25 aa, Mycobacterium tuberculosis
GPRDLEPFRCFYLSAPFVVPKKKEV

SEQ ID NO: 1392134 - protein, 31 aa, Mycobacterium tuberculosis
GPVARLWRGLLVFFSRWWQLETLYRSNMKYQ

SEQ ID NO: 1392135 - protein, 35 aa, Mycobacterium tuberculosis
GPVFTFLAYLVLDPLIYFGPFAPLTSPVLLPAGLT

SEQ ID NO: 1392136 - protein, 25 aa, Mycobacterium tuberculosis
GPVLGLMVFAFVTAWLILFATAWAA

SEQ ID NO: 1392137 - protein, 17 aa, Mycobacterium tuberculosis
GPYELARLAWEIERVDL

SEQ ID NO: 1392138 - protein, 18 aa, Mycobacterium tuberculosis
GQFWPRRSRLPWWDCSHY

SEQ ID NO: 1392139 - protein, 31 aa, Mycobacterium tuberculosis
GQITKKAVIALVVFLVLVALYITVRYERYMT

SEQ ID NO: 1392140 - protein, 25 aa, Mycobacterium tuberculosis
GQPRFWGILVAGVASILFLVRTSRL

SEQ ID NO: 1392141 - protein, 21 aa, Mycobacterium tuberculosis
GQQVWLITATPYELAATIARR

SEQ ID NO: 1392142 - protein, 23 aa, Mycobacterium tuberculosis
GRARTLIYHRLAHGPAAAAVGLH

SEQ ID NO: 1392143 - protein, 26 aa, Mycobacterium tuberculosis
GRDGVPTFLLPANPVSALVVFEVMVR

SEQ ID NO: 1392144 - protein, 18 aa, Mycobacterium tuberculosis
GRDLPPVPVLLVIVDEYL

SEQ ID NO: 1392145 - protein, 23 aa, Mycobacterium tuberculosis
GRISVVAAPWLADHAVGPVVLFP

SEQ ID NO: 1392146 - protein, 19 aa, Mycobacterium tuberculosis
GRLVDVIGCSLRLPGIYPP

SEQ ID NO: 1392147 - protein, 17 aa, Mycobacterium tuberculosis
GRMPTVLVLTLIFRFAI

SEQ ID NO: 1392148 - protein, 25 aa, Mycobacterium tuberculosis
GRNTLLLPFRVAAVHLILWDIGGAL

SEQ ID NO: 1392149 - protein, 22 aa, Mycobacterium tuberculosis
GRNWTIFSALVLLIPTVGSILL

SEQ ID NO: 1392150 - protein, 22 aa, Mycobacterium tuberculosis
GRRIARLLPFVGLAGLAVTTHV

SEQ ID NO: 1392151 - protein, 20 aa, Mycobacterium tuberculosis
GRTLLLGSPSLLRAEKVRVS

SEQ ID NO: 1392152 - protein, 18 aa, Mycobacterium tuberculosis
GRTPLPPRRDWQLDTLDT

SEQ ID NO: 1392153 - protein, 36 aa, Mycobacterium tuberculosis
GRTRRRLRRRLSGGVLLLIALTIAGGLAAVLTPTPQ

SEQ ID NO: 1392154 - protein, 23 aa, Mycobacterium tuberculosis
GRVPMAVVPLFVAAMLLVPAAGS

SEQ ID NO: 1392155 - protein, 31 aa, Mycobacterium tuberculosis
GRWDALGFLQDFFATAVFLGITTFAIIRILR

SEQ ID NO: 1392156 - protein, 25 aa, Mycobacterium tuberculosis
GRWSYGLFIWHLAALAMVFPVIGAF

SEQ ID NO: 1392157 - protein, 28 aa, Mycobacterium tuberculosis
GSAAKLYPLLFLYPLLLLGIRAGRLNAL

SEQ ID NO: 1392158 - protein, 38 aa, Mycobacterium tuberculosis
GSAFGLSVLIWQHILHMPLHWLVLPMAIIVMLAVGSDY

SEQ ID NO: 1392159 - protein, 39 aa, Mycobacterium tuberculosis
GSAFGLSVLIWQHILHMPLHWLVLPMAIIVMLAVGSDYN

SEQ ID NO: 1392160 - protein, 17 aa, Mycobacterium tuberculosis
GSALRALAALSAKEVAV

SEQ ID NO: 1392161 - protein, 19 aa, Mycobacterium tuberculosis
GSAQRWKAIRGEAGWMTTY

SEQ ID NO: 1392162 - protein, 36 aa, Mycobacterium tuberculosis
GSDLTLLAVITLAVIFAIAALLLRSPLAGLVVVGTI

SEQ ID NO: 1392163 - protein, 25 aa, Mycobacterium tuberculosis
GSERPLQLSFGFGVDLGVHHVGVFF

SEQ ID NO: 1392164 - protein, 19 aa, Mycobacterium tuberculosis
GSFFMHRGVPYFPNLVMPI

SEQ ID NO: 1392165 - protein, 27 aa, Mycobacterium tuberculosis
GSFLTTALISLIQRPQLRNLLHEKPEL

SEQ ID NO: 1392166 - protein, 24 aa, Mycobacterium tuberculosis
GSGPLKWIYLTMSVQMIAAMVDTY

SEQ ID NO: 1392167 - protein, 17 aa, Mycobacterium tuberculosis
GSKTLWRAVSVRASDGY

SEQ ID NO: 1392168 - protein, 18 aa, Mycobacterium tuberculosis
GSLGVGLGLTLWLSTDAA

SEQ ID NO: 1392169 - protein, 19 aa, Mycobacterium tuberculosis
GSLGVGLGLTLWLSTDAAE

SEQ ID NO: 1392170 - protein, 22 aa, Mycobacterium tuberculosis
GSLLGMSLHQPYLMGCLSPRNE

SEQ ID NO: 1392171 - protein, 29 aa, Mycobacterium tuberculosis
GSLLRLSVLALIMLPILAAVTLCARVPEA

SEQ ID NO: 1392172 - protein, 22 aa, Mycobacterium tuberculosis
GSMVFAILVLLGRYINYTLDLA

SEQ ID NO: 1392173 - protein, 21 aa, Mycobacterium tuberculosis
GSRAALMFIVAALAATLALIA

SEQ ID NO: 1392174 - protein, 24 aa, Mycobacterium tuberculosis
GSRGLRYATVIALVAALVGGVYVL

SEQ ID NO: 1392175 - protein, 38 aa, Mycobacterium tuberculosis
GSRRRGRRRCRWSWRTGWVCLYFSVVFDGWPRPGRPER

SEQ ID NO: 1392176 - protein, 36 aa, Mycobacterium tuberculosis
GSTVVSWLPFYHDMGFVLGLILPILAGIPAVLTSPI

SEQ ID NO: 1392177 - protein, 18 aa, Mycobacterium tuberculosis
GSTYVIWGGKRSQIDPTN

SEQ ID NO: 1392178 - protein, 21 aa, Mycobacterium tuberculosis
GSVHRYLAYGALGVLIVLVVA

SEQ ID NO: 1392179 - protein, 28 aa, Mycobacterium tuberculosis
GSVLGNPLVWIERALVVLVAAAPCALAI

SEQ ID NO: 1392180 - protein, 21 aa, Mycobacterium tuberculosis
GSWAIGVMLAILALISLVCTY

SEQ ID NO: 1392181 - protein, 23 aa, Mycobacterium tuberculosis
GSYALLVFFGLFLGVAGTIFASA

SEQ ID NO: 1392182 - protein, 35 aa, Mycobacterium tuberculosis
GSYPPAYPPQKYPPGWPAGPYPPGPPPPGPGSKTP

SEQ ID NO: 1392183 - protein, 24 aa, Mycobacterium tuberculosis
GTAIQPIYGPTLDGSLPGQADHSS

SEQ ID NO: 1392184 - protein, 33 aa, Mycobacterium tuberculosis
GTAVSVLIILILVYRNLVTMLVPLATIGASVVT

SEQ ID NO: 1392185 - protein, 34 aa, Mycobacterium tuberculosis
GTAVSVLIILILVYRNLVTMLVPLATIGASVVTA

SEQ ID NO: 1392186 - protein, 27 aa, Mycobacterium tuberculosis
GTDAFWIFMMCYAAAAVLTWKVYDRRT

SEQ ID NO: 1392187 - protein, 17 aa, Mycobacterium tuberculosis
GTIASVAAVALYIGDVL

SEQ ID NO: 1392188 - protein, 19 aa, Mycobacterium tuberculosis
GTILALHHPPIPSVLDMAV

SEQ ID NO: 1392189 - protein, 19 aa, Mycobacterium tuberculosis
GTLLSSRFPALNAPAVAID

SEQ ID NO: 1392190 - protein, 17 aa, Mycobacterium tuberculosis
GTNPWRGPPIPYGTEVT

SEQ ID NO: 1392191 - protein, 23 aa, Mycobacterium tuberculosis
GTPELAGIWVYERRFTDDELLRL

SEQ ID NO: 1392192 - protein, 22 aa, Mycobacterium tuberculosis
GTSLRALLKQYGPLTPARAVAI

SEQ ID NO: 1392193 - protein, 25 aa, Mycobacterium tuberculosis
GTSNPWTLRKILRANQIAFENRLPV

SEQ ID NO: 1392194 - protein, 28 aa, Mycobacterium tuberculosis
GTTIGLGLLFDTLIVRSFMTPSIAALMG

SEQ ID NO: 1392195 - protein, 24 aa, Mycobacterium tuberculosis
GTTIVLLVRWLVARRAAAFMHQGL

SEQ ID NO: 1392196 - protein, 22 aa, Mycobacterium tuberculosis
GTVLTLRRWLRPATAAVVCCLA

SEQ ID NO: 1392197 - protein, 21 aa, Mycobacterium tuberculosis
GTWLAWAAWAALGLGVVALVV

SEQ ID NO: 1392198 - protein, 20 aa, Mycobacterium tuberculosis
GVAALLPLPTVVAVAVLGAT

SEQ ID NO: 1392199 - protein, 21 aa, Mycobacterium tuberculosis
GVAALLPLPTVVAVAVLGATL

SEQ ID NO: 1392200 - protein, 24 aa, Mycobacterium tuberculosis
GVAAPILLILCRLVQGFATGGEYG

SEQ ID NO: 1392201 - protein, 26 aa, Mycobacterium tuberculosis
GVALALLGVRRYVFARPPLLGTTGRT

SEQ ID NO: 1392202 - protein, 53 aa, Mycobacterium tuberculosis
GVDLPRVGQINWKWIRRSLYLTAAVVILLPMVTFTMAYLIVDVPKPGDIRTNQ

SEQ ID NO: 1392203 - protein, 23 aa, Mycobacterium tuberculosis
GVEELLRINLSFADGLPRLATAD

SEQ ID NO: 1392204 - protein, 18 aa, Mycobacterium tuberculosis
GVEWLPAKGFITDRLPRL

SEQ ID NO: 1392205 - protein, 20 aa, Mycobacterium tuberculosis
GVFLNYGLVLIVLPGMAVLA

SEQ ID NO: 1392206 - protein, 25 aa, Mycobacterium tuberculosis
GVGALSGMWGIPAVVAVATVGVVTV

SEQ ID NO: 1392207 - protein, 18 aa, Mycobacterium tuberculosis
GVGLLRRQDAVETFTAAI

SEQ ID NO: 1392208 - protein, 26 aa, Mycobacterium tuberculosis
GVILRLMLAWIPSTGVPLLAIVLAVA

SEQ ID NO: 1392209 - protein, 29 aa, Mycobacterium tuberculosis
GVLPVLALMVVAVWLLGVGTLKDLALVQL

SEQ ID NO: 1392210 - protein, 17 aa, Mycobacterium tuberculosis
GVLRFVVLDGLAKPGRM

SEQ ID NO: 1392211 - protein, 21 aa, Mycobacterium tuberculosis
GVLVGFIALYLLGSLAGFPQM

SEQ ID NO: 1392212 - protein, 23 aa, Mycobacterium tuberculosis
GVPSVLLYRLLTCWLPVFAGWQV

SEQ ID NO: 1392213 - protein, 17 aa, Mycobacterium tuberculosis
GVPWLYNYIGQPWKTQR

SEQ ID NO: 1392214 - protein, 29 aa, Mycobacterium tuberculosis
GVPWSNSFPKWRWSLTTALLELTVLVLLL

SEQ ID NO: 1392215 - protein, 17 aa, Mycobacterium tuberculosis
GVRDSIPLTPPQTIRAL

SEQ ID NO: 1392216 - protein, 34 aa, Mycobacterium tuberculosis
GVSFAVGLIVLLGLPPFAMFASELAIARSLANER

SEQ ID NO: 1392217 - protein, 22 aa, Mycobacterium tuberculosis
GVTIFTGYPFLRGALRSLRSGK

SEQ ID NO: 1392218 - protein, 41 aa, Mycobacterium tuberculosis
GVVPAPVPIPVPIIIPPFPGWQPGMPTIPTAPPTTPVTTPP

SEQ ID NO: 1392219 - protein, 19 aa, Mycobacterium tuberculosis
GVVPLLGGPLLGALAAAVV

SEQ ID NO: 1392220 - protein, 18 aa, Mycobacterium tuberculosis
GVVTVLWALYGYSIAFGD

SEQ ID NO: 1392221 - protein, 18 aa, Mycobacterium tuberculosis
GWAMAAICFIAVAVAAAV

SEQ ID NO: 1392222 - protein, 19 aa, Mycobacterium tuberculosis
GWAVLAIMGIIWMGMSVAA

SEQ ID NO: 1392223 - protein, 17 aa, Mycobacterium tuberculosis
GWGLWDQASAMTGGLDA

SEQ ID NO: 1392224 - protein, 23 aa, Mycobacterium tuberculosis
GWGRPGPIRALPLHSARSRKKKK

SEQ ID NO: 1392225 - protein, 26 aa, Mycobacterium tuberculosis
GWGVFLNYGLVLIVLPGMAVLAAADW

SEQ ID NO: 1392226 - protein, 29 aa, Mycobacterium tuberculosis
GWIISNIFGAIPVLAGPLLGALAAAVVPG

SEQ ID NO: 1392227 - protein, 17 aa, Mycobacterium tuberculosis
GWIVTGLITLLATVTRF

SEQ ID NO: 1392228 - protein, 17 aa, Mycobacterium tuberculosis
GWLGYIVIGGIAGWLAS

SEQ ID NO: 1392229 - protein, 19 aa, Mycobacterium tuberculosis
GWRHLKHFNGYATSFWVTP

SEQ ID NO: 1392230 - protein, 32 aa, Mycobacterium tuberculosis
GWSLVSPRLPAPWRIPLQAGLGSVLVLVTRAT

SEQ ID NO: 1392231 - protein, 18 aa, Mycobacterium tuberculosis
GWTLYAHRPARGIGISEC

SEQ ID NO: 1392232 - protein, 37 aa, Mycobacterium tuberculosis
GWVGTHAYWLGAQWWHPLVVVGLIALVAIMIAAANPG

SEQ ID NO: 1392233 - protein, 38 aa, Mycobacterium tuberculosis
GWVGTHAYWLGAQWWHPLVVVGLIALVAIMIAAATPGR

SEQ ID NO: 1392234 - protein, 21 aa, Mycobacterium tuberculosis
GYCAGWLPWFADIDRQMYFFY

SEQ ID NO: 1392235 - protein, 20 aa, Mycobacterium tuberculosis
GYLFYWAIIGIDPGPRRLPY

SEQ ID NO: 1392236 - protein, 23 aa, Mycobacterium tuberculosis
GYLRKWFLLGITIGVIAGLGAVV

SEQ ID NO: 1392237 - protein, 28 aa, Mycobacterium tuberculosis
GYPGAILGFALLWLTATAIWLRSRRAPI

SEQ ID NO: 1392238 - protein, 31 aa, Mycobacterium tuberculosis
GYPGAILGFALLWLTATAIWLRSRRAPIDHT

SEQ ID NO: 1392239 - protein, 22 aa, Mycobacterium tuberculosis
GYRFIVGIGALIWAASLLWYLK

SEQ ID NO: 1392240 - protein, 22 aa, Mycobacterium tuberculosis
GYRNRIAALFAWGISFMGRARG

SEQ ID NO: 1392241 - protein, 18 aa, Mycobacterium tuberculosis
GYVLLALALGSYALTRQT

SEQ ID NO: 1392242 - protein, 31 aa, Mycobacterium tuberculosis
HAALAMFLGSTLVLRRRFKPALVLEDIEKHK

SEQ ID NO: 1392243 - protein, 38 aa, Mycobacterium tuberculosis
HAARPFIPRMIRTFAVPIILGWLVTIAVLNVTVPQLET

SEQ ID NO: 1392244 - protein, 23 aa, Mycobacterium tuberculosis
HADTWIMSLLYIGTFGSFIGYSA

SEQ ID NO: 1392245 - protein, 17 aa, Mycobacterium tuberculosis
HAIGLWGAAAAIAAGLG

SEQ ID NO: 1392246 - protein, 20 aa, Mycobacterium tuberculosis
HALGYMHAALAMFLGSTLVL

SEQ ID NO: 1392247 - protein, 18 aa, Mycobacterium tuberculosis
HAPLYYPSVFHGLVAVFC

SEQ ID NO: 1392248 - protein, 24 aa, Mycobacterium tuberculosis
HAVELAFVGPLLAAVARIYGGRLA

SEQ ID NO: 1392249 - protein, 24 aa, Mycobacterium tuberculosis
HCLTNLWRGLAPQVHRLRAAEHPR

SEQ ID NO: 1392250 - protein, 25 aa, Mycobacterium tuberculosis
HDELFDACGWRRLIFATPEELEAAL

SEQ ID NO: 1392251 - protein, 26 aa, Mycobacterium tuberculosis
HDELFDACGWRRLIFATPEELEAALG

SEQ ID NO: 1392252 - protein, 17 aa, Mycobacterium tuberculosis
HDIVTPLVFAEAADLIA

SEQ ID NO: 1392253 - protein, 19 aa, Mycobacterium tuberculosis
HDIVTPLVFAEAADLIAAH

SEQ ID NO: 1392254 - protein, 41 aa, Mycobacterium tuberculosis
HDPGQSWVLVFAITMMAGLLVSLLVRRRRVWARITPTTAGT

SEQ ID NO: 1392255 - protein, 28 aa, Mycobacterium tuberculosis
HFESILIRGLMNYTFWMPNGSPEYRYCL

SEQ ID NO: 1392256 - protein, 17 aa, Mycobacterium tuberculosis
HFLVVGYLFYWAIIGID

SEQ ID NO: 1392257 - protein, 19 aa, Mycobacterium tuberculosis
HGGYWFTFFVALGGAVVLL

SEQ ID NO: 1392258 - protein, 29 aa, Mycobacterium tuberculosis
HGLGMPIPLGWQVWLYGVFAIIAVGVTSS

SEQ ID NO: 1392259 - protein, 22 aa, Mycobacterium tuberculosis
HGWRAMFGLAAAPATLLLPLLW

SEQ ID NO: 1392260 - protein, 17 aa, Mycobacterium tuberculosis
HGWVPLAVQVVTAVVLV

SEQ ID NO: 1392261 - protein, 28 aa, Mycobacterium tuberculosis
HHRCTPREWMWAVLLAGAVAVIVMSGNP

SEQ ID NO: 1392262 - protein, 27 aa, Mycobacterium tuberculosis
HHTASAWWFDMAMLVALSVIYVGFVRW

SEQ ID NO: 1392263 - protein, 19 aa, Mycobacterium tuberculosis
HIASWLAALVVPSVICAIT

SEQ ID NO: 1392264 - protein, 17 aa, Mycobacterium tuberculosis
HIGPPRQLPADSPQGQA

SEQ ID NO: 1392265 - protein, 19 aa, Mycobacterium tuberculosis
HKVGPVIRLPLVLGLAQLL

SEQ ID NO: 1392266 - protein, 32 aa, Mycobacterium tuberculosis
HLARQASLLRNYLLPLGAVLLLLVKASEVPAE

SEQ ID NO: 1392267 - protein, 28 aa, Mycobacterium tuberculosis
HLHGRSRLWLFRYQGTPIAFFLNVWGAD

SEQ ID NO: 1392268 - protein, 17 aa, Mycobacterium tuberculosis
HLILWDIGGALLATLYG

SEQ ID NO: 1392269 - protein, 17 aa, Mycobacterium tuberculosis
HLLGVIAFRALVLANPE

SEQ ID NO: 1392270 - protein, 33 aa, Mycobacterium tuberculosis
HLLGVPGWVTQRLWWAVLLTVGFWGLLRVAEAL

SEQ ID NO: 1392271 - protein, 17 aa, Mycobacterium tuberculosis
HLPVVIGAVLAIMVWRS

SEQ ID NO: 1392272 - protein, 19 aa, Mycobacterium tuberculosis
HNAGVTALVLLFVGGALYS

SEQ ID NO: 1392273 - protein, 24 aa, Mycobacterium tuberculosis
HNAVEYFVSYYDYYQPEAYIAQTD

SEQ ID NO: 1392274 - protein, 28 aa, Mycobacterium tuberculosis
HNGGAWLVLLMIFNVIWTYVLVRGSAVN

SEQ ID NO: 1392275 - protein, 17 aa, Mycobacterium tuberculosis
HNTWLTTIYTAVIGVLV

SEQ ID NO: 1392276 - protein, 24 aa, Mycobacterium tuberculosis
HPWESKPWTWPMSLRPVLYAIDQQ

SEQ ID NO: 1392277 - protein, 20 aa, Mycobacterium tuberculosis
HPYPRWLATAGAAGFALGVA

SEQ ID NO: 1392278 - protein, 19 aa, Mycobacterium tuberculosis
HQPLLRRLLEDRIGTAATA

SEQ ID NO: 1392279 - protein, 24 aa, Mycobacterium tuberculosis
HRGHLHRRPGAVGPFWAAAAATGC

SEQ ID NO: 1392280 - protein, 26 aa, Mycobacterium tuberculosis
HRLVLTGRTPLPPRRDWQLDTLDTEL

SEQ ID NO: 1392281 - protein, 25 aa, Mycobacterium tuberculosis
HRRVVLIIYLWVGIGAFGAASSIFF

SEQ ID NO: 1392282 - protein, 29 aa, Mycobacterium tuberculosis
HSHRRVVLIIYLWVGIVAFGAASSIFFNP

SEQ ID NO: 1392283 - protein, 24 aa, Mycobacterium tuberculosis
HSPMTWRRWALLCVGIAQIALGTV

SEQ ID NO: 1392284 - protein, 28 aa, Mycobacterium tuberculosis
HTAFAGAAICLLALMATLATASRRLRPR

SEQ ID NO: 1392285 - protein, 23 aa, Mycobacterium tuberculosis
HVHPDTFWWALALSADFGGNLTA

SEQ ID NO: 1392286 - protein, 31 aa, Mycobacterium tuberculosis
HVRRDPVGPFYTLTATIITARGIFVFFSFLF

SEQ ID NO: 1392287 - protein, 17 aa, Mycobacterium tuberculosis
HWHHTASAWWFDMAIDA

SEQ ID NO: 1392288 - protein, 18 aa, Mycobacterium tuberculosis
HWPGYLLIVAGVVGGVGA

SEQ ID NO: 1392289 - protein, 18 aa, Mycobacterium tuberculosis
HYFNTFLIPSDLLWSFMQ

SEQ ID NO: 1392290 - protein, 26 aa, Mycobacterium tuberculosis
HYFTYRDVLGFLYAQAKFQLLGKENS

SEQ ID NO: 1392291 - protein, 29 aa, Mycobacterium tuberculosis
IAAAPILGVPGWAWTLWAVLTAGCAGLAV

SEQ ID NO: 1392292 - protein, 26 aa, Mycobacterium tuberculosis
IAAVCLVFIVMLMITQSLIASLVIVG

SEQ ID NO: 1392293 - protein, 23 aa, Mycobacterium tuberculosis
IAAYGYWLISHWPVDLLADRHNI

SEQ ID NO: 1392294 - protein, 27 aa, Mycobacterium tuberculosis
IADFDDFWRPLRSFTYWERHCFDIPIC

SEQ ID NO: 1392295 - protein, 18 aa, Mycobacterium tuberculosis
IADFPQVTLGIYNSPRQT

SEQ ID NO: 1392296 - protein, 24 aa, Mycobacterium tuberculosis
IAEGALLIVIFATSGALEALVTAR

SEQ ID NO: 1392297 - protein, 18 aa, Mycobacterium tuberculosis
IAGALLLVLGVAAAIQSV

SEQ ID NO: 1392298 - protein, 19 aa, Mycobacterium tuberculosis
IAGLLLCGIVPLLPVNQTT

SEQ ID NO: 1392299 - protein, 17 aa, Mycobacterium tuberculosis
IAGLWQITGFYQVPMSV

SEQ ID NO: 1392300 - protein, 21 aa, Mycobacterium tuberculosis
IALAFFIPLLIGTGGNTGTQI

SEQ ID NO: 1392301 - protein, 19 aa, Mycobacterium tuberculosis
IALGLVVIVMVFASGLLAM

SEQ ID NO: 1392302 - protein, 20 aa, Mycobacterium tuberculosis
IALGLVVIVMVFASGLLAMF

SEQ ID NO: 1392303 - protein, 17 aa, Mycobacterium tuberculosis
IALLLVLGVYPKPVLDI

SEQ ID NO: 1392304 - protein, 35 aa, Mycobacterium tuberculosis
IALPLLAYFAIMWVGGYLLGAALRLGYRRTTTLAF

SEQ ID NO: 1392305 - protein, 30 aa, Mycobacterium tuberculosis
IALSAFTLIPYALVLLQLRVFYAREQPWTP

SEQ ID NO: 1392306 - protein, 17 aa, Mycobacterium tuberculosis
IALYLLGSLAGFPQMLL

SEQ ID NO: 1392307 - protein, 24 aa, Mycobacterium tuberculosis
IAMPLGIWVFSPLRRRATAALAVA

SEQ ID NO: 1392308 - protein, 18 aa, Mycobacterium tuberculosis
IAPIALHWSLNGMGALAA

SEQ ID NO: 1392309 - protein, 18 aa, Mycobacterium tuberculosis
IAPLISYEMTFSDLTRHA

SEQ ID NO: 1392310 - protein, 35 aa, Mycobacterium tuberculosis
IARSQPWFRRYMTTYLLFVPISLGTTFFSLRAAQS

SEQ ID NO: 1392311 - protein, 19 aa, Mycobacterium tuberculosis
IARSTIIAGALLLVLGVAA

SEQ ID NO: 1392312 - protein, 17 aa, Mycobacterium tuberculosis
IARYLDRYGIRADTIRI

SEQ ID NO: 1392313 - protein, 26 aa, Mycobacterium tuberculosis
IATCGCLALGWWQWTRFQSTSGTFQN

SEQ ID NO: 1392314 - protein, 17 aa, Mycobacterium tuberculosis
IAVWCVTAIIGAFAARR

SEQ ID NO: 1392315 - protein, 19 aa, Mycobacterium tuberculosis
IDGQLYVDMRLINGVDLAA

SEQ ID NO: 1392316 - protein, 20 aa, Mycobacterium tuberculosis
IDHPLAVATLLDRAALDARA

SEQ ID NO: 1392317 - protein, 25 aa, Mycobacterium tuberculosis
IDIGRLRWQFERIARGVPVAAPLGC

SEQ ID NO: 1392318 - protein, 24 aa, Mycobacterium tuberculosis
IDRSRIKVIMDKVNGRWLAGKVEL

SEQ ID NO: 1392319 - protein, 31 aa, Mycobacterium tuberculosis
IDVGIRRHVLSALWWAALAGTATVVIRWVVQ

SEQ ID NO: 1392320 - protein, 20 aa, Mycobacterium tuberculosis
IEFYDFLIYGTAAALVFPTV

SEQ ID NO: 1392321 - protein, 23 aa, Mycobacterium tuberculosis
IELPPGYLPLRVPIEVNFTQRVA

SEQ ID NO: 1392322 - protein, 21 aa, Mycobacterium tuberculosis
IERSGIWQALLGSDAIYFEVA

SEQ ID NO: 1392323 - protein, 18 aa, Mycobacterium tuberculosis
IFALMVFVTGLPLAYYAA

SEQ ID NO: 1392324 - protein, 22 aa, Mycobacterium tuberculosis
IFEGELFITGRIKELLVVDGAN

SEQ ID NO: 1392325 - protein, 18 aa, Mycobacterium tuberculosis
IFGFSFYTGHYFGAWVFI

SEQ ID NO: 1392326 - protein, 17 aa, Mycobacterium tuberculosis
IFGIPGQGSYAAANSYL

SEQ ID NO: 1392327 - protein, 18 aa, Mycobacterium tuberculosis
IFGLFGAFALIGAAIVLF

SEQ ID NO: 1392328 - protein, 22 aa, Mycobacterium tuberculosis
IFGYNGFGWRFTGALLGVVLVA

SEQ ID NO: 1392329 - protein, 20 aa, Mycobacterium tuberculosis
IFMMCYAAAAVLTWKVYDRR

SEQ ID NO: 1392330 - protein, 18 aa, Mycobacterium tuberculosis
IFSLPLAREKFLLDASNL

SEQ ID NO: 1392331 - protein, 17 aa, Mycobacterium tuberculosis
IFTALQAIATVGAVIGG

SEQ ID NO: 1392332 - protein, 26 aa, Mycobacterium tuberculosis
IGAGVLYFYFVLPRWPELMGDTGHSL

SEQ ID NO: 1392333 - protein, 25 aa, Mycobacterium tuberculosis
IGALIWAASLLWYLKVVGSQPDFLG

SEQ ID NO: 1392334 - protein, 25 aa, Mycobacterium tuberculosis
IGASLYALLVNRWPLPEAGVRSGLA

SEQ ID NO: 1392335 - protein, 26 aa, Mycobacterium tuberculosis
IGASLYALLVNRWPLPEAGVRSGLAP

SEQ ID NO: 1392336 - protein, 17 aa, Mycobacterium tuberculosis
IGATLAWGTRWYVTGNG

SEQ ID NO: 1392337 - protein, 21 aa, Mycobacterium tuberculosis
IGFLVAWQRPLAGKKTLMDLA

SEQ ID NO: 1392338 - protein, 27 aa, Mycobacterium tuberculosis
IGGQAAVWLTWPFGAVGALAGFGGMVV

SEQ ID NO: 1392339 - protein, 30 aa, Mycobacterium tuberculosis
IGGVALALLGVRRYVFARPPLLGTTGRTVA

SEQ ID NO: 1392340 - protein, 17 aa, Mycobacterium tuberculosis
IGGYPGAILGFALLWLT

SEQ ID NO: 1392341 - protein, 28 aa, Mycobacterium tuberculosis
IGLERQWRARMAGLRTNILVATGATLFV

SEQ ID NO: 1392342 - protein, 28 aa, Mycobacterium tuberculosis
IGLLLVLVYSLLYYRVLGLLTALSLVAS

SEQ ID NO: 1392343 - protein, 24 aa, Mycobacterium tuberculosis
IGNEWVALYRIRVGHRIGSAALIA

SEQ ID NO: 1392344 - protein, 18 aa, Mycobacterium tuberculosis
IGNLFGVVPLLGGPLLGA

SEQ ID NO: 1392345 - protein, 26 aa, Mycobacterium tuberculosis
IGNLLQMAFRFWAFRRWVFPDEFARN

SEQ ID NO: 1392346 - protein, 25 aa, Mycobacterium tuberculosis
IGSLGVGLGLTLWLSTDAAERSYQL

SEQ ID NO: 1392347 - protein, 35 aa, Mycobacterium tuberculosis
IGTLVFQLILGQEMHWSLPGLSFILLVAIGADYNM

SEQ ID NO: 1392348 - protein, 37 aa, Mycobacterium tuberculosis
IGTLVFQLILGQEMHWSLPGLSFILLVAIGADYNMLL

SEQ ID NO: 1392349 - protein, 23 aa, Mycobacterium tuberculosis
IGTMLVWGLFRIFVLGNPVRAES

SEQ ID NO: 1392350 - protein, 28 aa, Mycobacterium tuberculosis
IGTWVRMVINYLVPFLVASVGYLGARRG

SEQ ID NO: 1392351 - protein, 18 aa, Mycobacterium tuberculosis
IGVILVVAANRQPPERPV

SEQ ID NO: 1392352 - protein, 30 aa, Mycobacterium tuberculosis; identical to SEQ ID NO: 20812

SEQ ID NO: 1392353 - protein, 22 aa, Mycobacterium tuberculosis
IGWYSPALPRLGIPRGRRRLGS

SEQ ID NO: 1392354 - protein, 28 aa, Mycobacterium tuberculosis
IIAAAPLGILPMPKAMPATAAFPPPAGP

SEQ ID NO: 1392355 - protein, 18 aa, Mycobacterium tuberculosis
IIALPFFGIVSEIFPVFS

SEQ ID NO: 1392356 - protein, 22 aa, Mycobacterium tuberculosis
IIGRTMVVWLLSSGVPLFGIAL

SEQ ID NO: 1392357 - protein, 18 aa, Mycobacterium tuberculosis
IIPMLLWITGVYDTVRNI

SEQ ID NO: 1392358 - protein, 30 aa, Mycobacterium tuberculosis
IIQTPVISHFFGCTPLGPVAWTGVFSATAG

SEQ ID NO: 1392359 - protein, 17 aa, Mycobacterium tuberculosis
IIRFWLLTAITCGLGVA

SEQ ID NO: 1392360 - protein, 18 aa, Mycobacterium tuberculosis
IISNIFGAIPVLGGPLLG

SEQ ID NO: 1392361 - protein, 19 aa, Mycobacterium tuberculosis
IITLMYFMFENFPHRPGTP

SEQ ID NO: 1392362 - protein, 37 aa, Mycobacterium tuberculosis
IKAIPPSLLVLVLVSSVLPLAAPWLRDLRAGSVSINR

SEQ ID NO: 1392363 - protein, 26 aa, Mycobacterium tuberculosis
ILAGLCMLMLGLLMLIFSEHRSSALV

SEQ ID NO: 1392364 - protein, 27 aa, Mycobacterium tuberculosis
ILAWLLIAILLARLFVPDDVGPAAPIP

SEQ ID NO: 1392365 - protein, 25 aa, Mycobacterium tuberculosis
ILDLVVVFLVTWPLVYLASKSSLLA

SEQ ID NO: 1392366 - protein, 26 aa, Mycobacterium tuberculosis
ILDLVVVFLVTWPLVYLASKSSLLAK

SEQ ID NO: 1392367 - protein, 17 aa, Mycobacterium tuberculosis
ILDQHLYFTLNAPSLHT

SEQ ID NO: 1392368 - protein, 19 aa, Mycobacterium tuberculosis
ILFAVIGVAVLVTAVSFTG

SEQ ID NO: 1392369 - protein, 23 aa, Mycobacterium tuberculosis
ILGFGGMSEVHLARDLRLHRDVA

SEQ ID NO: 1392370 - protein, 32 aa, Mycobacterium tuberculosis
ILGGWLIGAYGWRWIFLVNLPVGLSALVLAAI

SEQ ID NO: 1392371 - protein, 17 aa, Mycobacterium tuberculosis
ILHDRRLVLAGSGLALA

SEQ ID NO: 1392372 - protein, 19 aa, Mycobacterium tuberculosis
ILIRRPIVGYLWSWLSGRD

SEQ ID NO: 1392373 - protein, 19 aa, Mycobacterium tuberculosis
ILLGPLVGLVLLALDFRIT

SEQ ID NO: 1392374 - protein, 17 aa, Mycobacterium tuberculosis
ILLLIFIAQNTASAQFA

SEQ ID NO: 1392375 - protein, 19 aa, Mycobacterium tuberculosis
ILNLAFIVGPAIGGLMIAT

SEQ ID NO: 1392376 - protein, 18 aa, Mycobacterium tuberculosis
ILPAPTRLFPPSLAVVFS

SEQ ID NO: 1392377 - protein, 21 aa, Mycobacterium tuberculosis
ILPTQILWINMTTAIALGLML

SEQ ID NO: 1392378 - protein, 26 aa, Mycobacterium tuberculosis
ILRENVVALTVLWLLNIGEYLQDPTL

SEQ ID NO: 1392379 - protein, 27 aa, Mycobacterium tuberculosis
ILRGGRSRLVFGTLAILLCLVLGVAIV

SEQ ID NO: 1392380 - protein, 17 aa, Mycobacterium tuberculosis
ILTHLPVVIGAVLAIMV

SEQ ID NO: 1392381 - protein, 30 aa, Mycobacterium tuberculosis
ILTLLRLVMVPVFLLALFYGGGHHSAARVV

SEQ ID NO: 1392382 - protein, 37 aa, Mycobacterium tuberculosis
ILTSPEAFIRKPARWMQLLAKHQAPFSAAPNFAFDLA

SEQ ID NO: 1392383 - protein, 29 aa, Mycobacterium tuberculosis
ILVALIALFPPYIMWAPNAIWKAFDLLVG

SEQ ID NO: 1392384 - protein, 18 aa, Mycobacterium tuberculosis
ILVFVLLGSFILPHTGSV

SEQ ID NO: 1392385 - protein, 22 aa, Mycobacterium tuberculosis
ILVTASDFAYLVDFGIARAASD

SEQ ID NO: 1392386 - protein, 17 aa, Mycobacterium tuberculosis
ILVVVWLSLHRWDLLGP

SEQ ID NO: 1392387 - protein, 17 aa, Mycobacterium tuberculosis
ILWDIGGALLATLYGLA

SEQ ID NO: 1392388 - protein, 25 aa, Mycobacterium tuberculosis
IMATTPVLWILYAGRIVAGITGATG

SEQ ID NO: 1392389 - protein, 20 aa, Mycobacterium tuberculosis
IMIGLLFDTLVVRSYMTPAL

SEQ ID NO: 1392390 - protein, 22 aa, Mycobacterium tuberculosis
IMWPSLLVILLLVAVVALLFTG

SEQ ID NO: 1392391 - protein, 18 aa, Mycobacterium tuberculosis
INIGFYMLMPYLADYLAG

SEQ ID NO: 1392392 - protein, 27 aa, Mycobacterium tuberculosis
INRREVVLVTGPWLAGVSGVRAALAER

SEQ ID NO: 1392393 - protein, 44 aa, Mycobacterium tuberculosis
INWKWIRRSLYLTAAVVILLPMVTFTMAYLIVDVPKPGDIRTNQ

SEQ ID NO: 1392394 - protein, 25 aa, Mycobacterium tuberculosis
IPGRWRPAWIGWWVSLGLATATIGG

SEQ ID NO: 1392395 - protein, 18 aa, Mycobacterium tuberculosis
IPILLPDGKDFSRETGRW

SEQ ID NO: 1392396 - protein, 30 aa, Mycobacterium tuberculosis
IPPPNSALVSWLPFYHDMGLVIGICAPILG

SEQ ID NO: 1392397 - protein, 26 aa, Mycobacterium tuberculosis
IPSPPRGVWYLGPLPVRAYAVSVITG

SEQ ID NO: 1392398 - protein, 18 aa, Mycobacterium tuberculosis
IQAAPTGQPSWAPNSGPM

SEQ ID NO: 1392399 - protein, 17 aa, Mycobacterium tuberculosis
IQANLLKRAVGPSLKWF

SEQ ID NO: 1392400 - protein, 19 aa, Mycobacterium tuberculosis
IQANLLKRAVGPSLKWFDE

SEQ ID NO: 1392401 - protein, 18 aa, Mycobacterium tuberculosis
IQKFIGIGAFLGFFAMMV

SEQ ID NO: 1392402 - protein, 29 aa, Mycobacterium tuberculosis
IQTPVISHFFGCTPLGPVAWTGVFSATAG

SEQ ID NO: 1392403 - protein, 17 aa, Mycobacterium tuberculosis
IQVLRIRYILTSTPTVR

SEQ ID NO: 1392404 - protein, 19 aa, Mycobacterium tuberculosis
IRARFPTLTARQVMQRIES

SEQ ID NO: 1392405 - protein, 17 aa, Mycobacterium tuberculosis
IRDAVLVLAAIATAIVV

SEQ ID NO: 1392406 - protein, 20 aa, Mycobacterium tuberculosis
IRDAVLVLAAIATAIVVVLV

SEQ ID NO: 1392407 - protein, 21 aa, Mycobacterium tuberculosis
IRDAVLVLAAIATAIVVVLVV

SEQ ID NO: 1392408 - protein, 18 aa, Mycobacterium tuberculosis
IRFTGPEVWWVLRVAHWA

SEQ ID NO: 1392409 - protein, 36 aa, Mycobacterium tuberculosis
IRGATPRPRPRWGTPALAAPAPHGALAGSGKLGVRD

SEQ ID NO: 1392410 - protein, 24 aa, Mycobacterium tuberculosis
IRIALLLLACLPLNAIMTIAAKSV

SEQ ID NO: 1392411 - protein, 20 aa, Mycobacterium tuberculosis
IRKRWDRYAAFAEKTFNVTI

SEQ ID NO: 1392412 - protein, 26 aa, Mycobacterium tuberculosis
IRPYRRLVAMLMMLQLVSTLASLYLP

SEQ ID NO: 1392413 - protein, 45 aa, Mycobacterium tuberculosis
ISLEILFAIVAYTIIIVLILPLVIFAYAIVFAVLAIIFGPPLLVI

SEQ ID NO: 1392414 - protein, 22 aa, Mycobacterium tuberculosis
ISLILIIMMIITRSVVAAVVIV

SEQ ID NO: 1392415 - protein, 30 aa, Mycobacterium tuberculosis
ISVGALVTYLLYIELLYTPIGELAQMFDDY

SEQ ID NO: 1392416 - protein, 17 aa, Mycobacterium tuberculosis
ITATILLSWSQPTAQPL

SEQ ID NO: 1392417 - protein, 22 aa, Mycobacterium tuberculosis
ITGGLVLFGGFSDLLVVIGGLA

SEQ ID NO: 1392418 - protein, 22 aa, Mycobacterium tuberculosis
ITLAIWNPYVAERLLQGHWSLL

SEQ ID NO: 1392419 - protein, 28 aa, Mycobacterium tuberculosis
ITLSVMAIFYLRLPATFGIGTYGVSADF

SEQ ID NO: 1392420 - protein, 20 aa, Mycobacterium tuberculosis
ITNFYNIYDPAQGTLNGLLS

SEQ ID NO: 1392421 - protein, 25 aa, Mycobacterium tuberculosis
ITNGRTLMSWWSTPSSPTVSPPQIG

SEQ ID NO: 1392422 - protein, 27 aa, Mycobacterium tuberculosis
ITVAVWTTLWMLVGLAVHDAISIIGEA

SEQ ID NO: 1392423 - protein, 18 aa, Mycobacterium tuberculosis
ITYRPQLGVLYPSELSTG

SEQ ID NO: 1392424 - protein, 23 aa, Mycobacterium tuberculosis
IVAAKLVFLVIWIGAATSKLNRH

SEQ ID NO: 1392425 - protein, 17 aa, Mycobacterium tuberculosis
IVAVHLLGRPLGRLVDR

SEQ ID NO: 1392426 - protein, 18 aa, Mycobacterium tuberculosis
IVDEYLELFANHKKWIGL

SEQ ID NO: 1392427 - protein, 24 aa, Mycobacterium tuberculosis
IVDLTVIGLGRYIPRIARVAAATE

SEQ ID NO: 1392428 - protein, 20 aa, Mycobacterium tuberculosis
IVFGVLRWLTRHRHTEMPGW

SEQ ID NO: 1392429 - protein, 23 aa, Mycobacterium tuberculosis
IVGALLVMSLLITPAAAAARVVV

SEQ ID NO: 1392430 - protein, 19 aa, Mycobacterium tuberculosis
IVGGLTFFPALALGPIVEQ

SEQ ID NO: 1392431 - protein, 20 aa, Mycobacterium tuberculosis
IVGGLTLFPALALGPIVEQL

SEQ ID NO: 1392432 - protein, 23 aa, Mycobacterium tuberculosis
IVGRTMLVWLLCSGVPNVGVALT

SEQ ID NO: 1392433 - protein, 17 aa, Mycobacterium tuberculosis
IVIFFVGSVFLLTVILP

SEQ ID NO: 1392434 - protein, 21 aa, Mycobacterium tuberculosis
IVISVAWWLATVNLLLGLFNL

SEQ ID NO: 1392435 - protein, 24 aa, Mycobacterium tuberculosis
IVLDTFLVRTVTVPALTAMIGRAN

SEQ ID NO: 1392436 - protein, 18 aa, Mycobacterium tuberculosis
IVLLLAGPRLIDAYVDWL

SEQ ID NO: 1392437 - protein, 18 aa, Mycobacterium tuberculosis
IVLMQVMHHRTVWTVIAI

SEQ ID NO: 1392438 - protein, 18 aa, Mycobacterium tuberculosis
IVLVRPGERISADATVLA

SEQ ID NO: 1392439 - protein, 18 aa, Mycobacterium tuberculosis
IVRSALPQSLRKLAPRVQ

SEQ ID NO: 1392440 - protein, 17 aa, Mycobacterium tuberculosis
IVTPLVFAEAADLIAAH

SEQ ID NO: 1392441 - protein, 19 aa, Mycobacterium tuberculosis
IVYFTPLFDTFVRYHWGHE

SEQ ID NO: 1392442 - protein, 17 aa, Mycobacterium tuberculosis
IWVLLFGIWLALGHLVS

SEQ ID NO: 1392443 - protein, 17 aa, Mycobacterium tuberculosis
IYDPWPTPLAAAVGSAG

SEQ ID NO: 1392444 - protein, 29 aa, Mycobacterium tuberculosis
IYIAGFHHGFFIFAIVLTALSIIPLGGGI

SEQ ID NO: 1392445 - protein, 30 aa, Mycobacterium tuberculosis; identical to SEQ ID NO: 162782

SEQ ID NO: 1392446 - protein, 17 aa, Mycobacterium tuberculosis
IYLINTPALRSMATGAI

SEQ ID NO: 1392447 - protein, 17 aa, Mycobacterium tuberculosis
IYQNLGWAFGYNTAAIP

SEQ ID NO: 1392448 - protein, 20 aa, Mycobacterium tuberculosis
KAGLFPFHTWLADAHSQAPA

SEQ ID NO: 1392449 - protein, 21 aa, Mycobacterium tuberculosis
KAGLVPLHAWLPRAHPEAPSP

SEQ ID NO: 1392450 - protein, 25 aa, Mycobacterium tuberculosis
KAQQPINLLLLAVAVAAAVVIGLHA

SEQ ID NO: 1392451 - protein, 21 aa, Mycobacterium tuberculosis
KARVPPYKTAGLGLVLVFALV

SEQ ID NO: 1392452 - protein, 24 aa, Mycobacterium tuberculosis
KATKRRYRFARGLMAGLLGTMALT

SEQ ID NO: 1392453 - protein, 20 aa, Mycobacterium tuberculosis
KDPVFRERMKREARIAGRLQ

SEQ ID NO: 1392454 - protein, 18 aa, Mycobacterium tuberculosis
KEIFIPGGQMFRDLTRLS

SEQ ID NO: 1392455 - protein, 20 aa, Mycobacterium tuberculosis
KEPPPPLPPDLPPNVRELIE

SEQ ID NO: 1392456 - protein, 18 aa, Mycobacterium tuberculosis
KFARLSTAILGCAAALVF

SEQ ID NO: 1392457 - protein, 22 aa, Mycobacterium tuberculosis
KGIGYALITVGLLIAVNQLEAH

SEQ ID NO: 1392458 - protein, 28 aa, Mycobacterium tuberculosis
KGVQTGLLWPAIFVAAFAALGLAVALVV

SEQ ID NO: 1392459 - protein, 18 aa, Mycobacterium tuberculosis
KHFNGYATSFWVTPSDIT

SEQ ID NO: 1392460 - protein, 25 aa, Mycobacterium tuberculosis
KIGRKPLLLWFGVGGLIYTYVLVTY

SEQ ID NO: 1392461 - protein, 18 aa, Mycobacterium tuberculosis
KLFRSLSIAFMSSADPIP

SEQ ID NO: 1392462 - protein, 20 aa, Mycobacterium tuberculosis
KLGIVWLVLSVFTVMIIVVF

SEQ ID NO: 1392463 - protein, 26 aa, Mycobacterium tuberculosis
KLLLSSLLLNWVLGPALMFALAWLLL

SEQ ID NO: 1392464 - protein, 26 aa, Mycobacterium tuberculosis
KLSKQPFSLQLIGPPPSPVQRYPLYC

SEQ ID NO: 1392465 - protein, 37 aa, Mycobacterium tuberculosis
KLTPAWRTTIKRWFRWFLTFLFLECGFVTIVSNPLAL

SEQ ID NO: 1392466 - protein, 31 aa, Mycobacterium tuberculosis
KLTRRSRILIMIALGVIVLLLAGPRLIDAYV

SEQ ID NO: 1392467 - protein, 21 aa, Mycobacterium tuberculosis
KLVIMDLRDHWMAKAPYILGQ

SEQ ID NO: 1392468 - protein, 18 aa, Mycobacterium tuberculosis
KMCWPAAPRSVGVPLYLL

SEQ ID NO: 1392469 - protein, 27 aa, Mycobacterium tuberculosis
KNNPFSLLFTLGGFVTLLLLAQAVASR

SEQ ID NO: 1392470 - protein, 20 aa, Mycobacterium tuberculosis
KPAALWILTRGVHESVAPSA

SEQ ID NO: 1392471 - protein, 17 aa, Mycobacterium tuberculosis
KPALWLPTLANPIFRTV

SEQ ID NO: 1392472 - protein, 17 aa, Mycobacterium tuberculosis
KPRRRIPSPIRGTTALG

SEQ ID NO: 1392473 - protein, 24 aa, Mycobacterium tuberculosis
KQFALVFRLVLFLAPTLNGWFFGV

SEQ ID NO: 1392474 - protein, 26 aa, Mycobacterium tuberculosis
KRARGSPLRIMILLVLVSALASALLD

SEQ ID NO: 1392475 - protein, 27 aa, Mycobacterium tuberculosis
KRFALKRGALMFGKLVPMGIGAIIGAI

SEQ ID NO: 1392476 - protein, 32 aa, Mycobacterium tuberculosis
KRNVKAIRTVRFWMAPIATTLALMSALAALYL

SEQ ID NO: 1392477 - protein, 20 aa, Mycobacterium tuberculosis
KSMYLIVEPAKDPTTPAALS

SEQ ID NO: 1392478 - protein, 21 aa, Mycobacterium tuberculosis
KSWHMYPVGFLFGLGFDTATE

SEQ ID NO: 1392479 - protein, 34 aa, Mycobacterium tuberculosis
KTAAWAWRFLVILAAMVALLWVLNKFEVIVVPVL

SEQ ID NO: 1392480 - protein, 21 aa, Mycobacterium tuberculosis
KTLLEQTLALLPAALPLLAAP

SEQ ID NO: 1392481 - protein, 18 aa, Mycobacterium tuberculosis
KTMGVIFLALMSYGAVST

SEQ ID NO: 1392482 - protein, 23 aa, Mycobacterium tuberculosis
KTPRGFARLFGGQRPALQGQHLV

SEQ ID NO: 1392483 - protein, 18 aa, Mycobacterium tuberculosis
KVGAAIVRWPGPILVGAV

SEQ ID NO: 1392484 - protein, 18 aa, Mycobacterium tuberculosis
KVGPLRRTRLTEILRGGR

SEQ ID NO: 1392485 - protein, 24 aa, Mycobacterium tuberculosis
KVGPWALYGLLFTIVILFALQGDQ

SEQ ID NO: 1392486 - protein, 21 aa, Mycobacterium tuberculosis
KVNRLLRLPLPEPYLPPRLEA

SEQ ID NO: 1392487 - protein, 26 aa, Mycobacterium tuberculosis
KVVDPSWFNWPALPVAMADTIVPDFP

SEQ ID NO: 1392488 - protein, 19 aa, Mycobacterium tuberculosis
KVWAVVGAAAIVLVAIVAA

SEQ ID NO: 1392489 - protein, 32 aa, Mycobacterium tuberculosis
KWSIPGLAHFFTMWGFFILLTVYIEAYGLLFE

SEQ ID NO: 1392490 - protein, 18 aa, Mycobacterium tuberculosis
LAAAFVASVLLGVGIGWG

SEQ ID NO: 1392491 - protein, 20 aa, Mycobacterium tuberculosis
LAAALTLWLHVIDARFARAL

SEQ ID NO: 1392492 - protein, 21 aa, Mycobacterium tuberculosis
LAAALTLWLHVIDARFARALR

SEQ ID NO: 1392493 - protein, 19 aa, Mycobacterium tuberculosis
LAAAVRILSALPVARAASE

SEQ ID NO: 1392494 - protein, 20 aa, Mycobacterium tuberculosis
LAAAVRILSALPVARAASES

SEQ ID NO: 1392495 - protein, 21 aa, Mycobacterium tuberculosis
LAAGVIRPQLRRAYLEEAVQR

SEQ ID NO: 1392496 - protein, 21 aa, Mycobacterium tuberculosis
LAAGVIRPQLRRAYLEETVQR

SEQ ID NO: 1392497 - protein, 24 aa, Mycobacterium tuberculosis
LAAIAFLPIVLAPAVIPPASTPLA

SEQ ID NO: 1392498 - protein, 18 aa, Mycobacterium tuberculosis
LAAIAFLPIVLRPRVIPP

SEQ ID NO: 1392499 - protein, 19 aa, Mycobacterium tuberculosis
LAAIAILGTVLLTRGKHSK

SEQ ID NO: 1392500 - protein, 26 aa, Mycobacterium tuberculosis
LAAIGVPWWFMVVQLPFAGIVFAVDG

SEQ ID NO: 1392501 - protein, 23 aa, Mycobacterium tuberculosis
LAALATLISIPVVSQLLGCTPLD

SEQ ID NO: 1392502 - protein, 17 aa, Mycobacterium tuberculosis
LAALLFAGALLAERVSL

SEQ ID NO: 1392503 - protein, 19 aa, Mycobacterium tuberculosis
LAALLFAVIACRTYRDPIA

SEQ ID NO: 1392504 - protein, 31 aa, Mycobacterium tuberculosis
LAARHYFTYRDVLGFLYAQAKFQLLGKENSN

SEQ ID NO: 1392505 - protein, 21 aa, Mycobacterium tuberculosis
LAATIARRLGLTGALGTVAES

SEQ ID NO: 1392506 - protein, 17 aa, Mycobacterium tuberculosis
LAATVVVAGWWTPPAWA

SEQ ID NO: 1392507 - protein, 20 aa, Mycobacterium tuberculosis
LAAVVRILSALPVARAASES

SEQ ID NO: 1392508 - protein, 19 aa, Mycobacterium tuberculosis
LADHAVGPVVPFPGTGFVE

SEQ ID NO: 1392509 - protein, 20 aa, Mycobacterium tuberculosis
LADLDQVWRLTRGAGQRVAV

SEQ ID NO: 1392510 - protein, 18 aa, Mycobacterium tuberculosis
LADYFALDELDAIRIGRR

SEQ ID NO: 1392511 - protein, 21 aa, Mycobacterium tuberculosis
LAEAFLPRRWRYGAQVTLALG

SEQ ID NO: 1392512 - protein, 26 aa, Mycobacterium tuberculosis
LAETLLVVLCGVGFYIGFVGSYQRMA

SEQ ID NO: 1392513 - protein, 17 aa, Mycobacterium tuberculosis
LAGAPLVAFSGLPIVPP

SEQ ID NO: 1392514 - protein, 18 aa, Mycobacterium tuberculosis
LAGGPWDWARWAPASPWA

SEQ ID NO: 1392515 - protein, 19 aa, Mycobacterium tuberculosis
LAGISLAWGLWEQPGGMTA

SEQ ID NO: 1392516 - protein, 20 aa, Mycobacterium tuberculosis
LAGLAFTLGMVLTSTLMVRP

SEQ ID NO: 1392517 - protein, 17 aa, Mycobacterium tuberculosis
LAGRRRRRRRRRRGRHR

SEQ ID NO: 1392518 - protein, 24 aa, Mycobacterium tuberculosis
LAGTIVGYYILRRALRPDGGQLIG

SEQ ID NO: 1392519 - protein, 24 aa, Mycobacterium tuberculosis
LAHSPDLDWKSVWDHGWSAAAEAA

SEQ ID NO: 1392520 - protein, 18 aa, Mycobacterium tuberculosis
LAITVGVAAALFVGSAAF

SEQ ID NO: 1392521 - protein, 17 aa, Mycobacterium tuberculosis
LAIVAAMGCAFVALLRP

SEQ ID NO: 1392522 - protein, 21 aa, Mycobacterium tuberculosis
LAIWLRFNMATEALPARLISS

SEQ ID NO: 1392523 - protein, 28 aa, Mycobacterium tuberculosis
LALAFVSIAALIYFLHHLMHSIQIDTIM

SEQ ID NO: 1392524 - protein, 19 aa, Mycobacterium tuberculosis
LALAMLLLAATRLLFDPIH

SEQ ID NO: 1392525 - protein, 17 aa, Mycobacterium tuberculosis
LALAYTATGGRALPGSV

SEQ ID NO: 1392526 - protein, 24 aa, Mycobacterium tuberculosis
LALFALWPFTRLVHAFSAPIGYLF

SEQ ID NO: 1392527 - protein, 25 aa, Mycobacterium tuberculosis
LALGLFSAGLLTQLCGAPQWVRWAL

SEQ ID NO: 1392528 - protein, 21 aa, Mycobacterium tuberculosis
LALLRQHIRPYRRLVAMLMML

SEQ ID NO: 1392529 - protein, 21 aa, Mycobacterium tuberculosis
LALSWPRVTAVFLVDVLILAV

SEQ ID NO: 1392530 - protein, 25 aa, Mycobacterium tuberculosis
LAMDPQQRMLLELSWEALERAGIDP

SEQ ID NO: 1392531 - protein, 19 aa, Mycobacterium tuberculosis
LAMLPILLVFIALQRQMIK

SEQ ID NO: 1392532 - protein, 17 aa, Mycobacterium tuberculosis
LAMVFTKLEVFSAVGPA

SEQ ID NO: 1392533 - protein, 33 aa, Mycobacterium tuberculosis
LANERLAWVLGAALLLIAIGFTALARNSGRMLL

SEQ ID NO: 1392534 - protein, 17 aa, Mycobacterium tuberculosis
LANLIDNALRYAPDCVV

SEQ ID NO: 1392535 - protein, 22 aa, Mycobacterium tuberculosis
LAPELAGFWTGGFVQAPFNTRI

SEQ ID NO: 1392536 - protein, 20 aa, Mycobacterium tuberculosis
LAQAWRKHIGPPRQLPADSP

SEQ ID NO: 1392537 - protein, 24 aa, Mycobacterium tuberculosis
LAQLAPFVLLVELSRLLVSGAGAH

SEQ ID NO: 1392538 - protein, 25 aa, Mycobacterium tuberculosis
LAQTLRYFPDLVVVLALLAAVALQA

SEQ ID NO: 1392539 - protein, 20 aa, Mycobacterium tuberculosis
LARFPGLYLQSLGLTFNGAT

SEQ ID NO: 1392540 - protein, 18 aa, Mycobacterium tuberculosis
LARLTTAMLTLYFILAVG

SEQ ID NO: 1392541 - protein, 20 aa, Mycobacterium tuberculosis
LARLTTAMLTLYFILAVGAH

SEQ ID NO: 1392542 - protein, 30 aa, Mycobacterium tuberculosis
LARSRALRMPLYRTLISLAVWATGGGVFIL

SEQ ID NO: 1392543 - protein, 28 aa, Mycobacterium tuberculosis
LASGGVGLLGWAWVVAGAVDLLTTGDSS

SEQ ID NO: 1392544 - protein, 17 aa, Mycobacterium tuberculosis
LASLVCFLLIITIPFGF

SEQ ID NO: 1392545 - protein, 23 aa, Mycobacterium tuberculosis
LASLVCFLLIITIPFGFAALRIA

SEQ ID NO: 1392546 - protein, 19 aa, Mycobacterium tuberculosis
LASLVFFGAFIPLIGAVVA

SEQ ID NO: 1392547 - protein, 27 aa, Mycobacterium tuberculosis
LATHYWKPLLLCFLVTLGGTVAFYTYS

SEQ ID NO: 1392548 - protein, 26 aa, Mycobacterium tuberculosis
LATRPATFLWLIAATGTLLVATHRMD

SEQ ID NO: 1392549 - protein, 17 aa, Mycobacterium tuberculosis
LATVNLLLGLFNLLPGA

SEQ ID NO: 1392550 - protein, 28 aa, Mycobacterium tuberculosis
LATVRRRRPWRGVLLTLAAVAVVASIGT

SEQ ID NO: 1392551 - protein, 26 aa, Mycobacterium tuberculosis
LAWAAAIGLMVPIGLAPPAMAAPCSG

SEQ ID NO: 1392552 - protein, 29 aa, Mycobacterium tuberculosis
LAYGAMLLYLFIPGWAVDSDFARLGLLAG

SEQ ID NO: 1392553 - protein, 24 aa, Mycobacterium tuberculosis
LAYVVIFSLPLAREKFLLDASNLA

SEQ ID NO: 1392554 - protein, 31 aa, Mycobacterium tuberculosis
LCAQYLAPVLDAIKFNYFPFGPERGQHRLDT

SEQ ID NO: 1392555 - protein, 17 aa, Mycobacterium tuberculosis
LCARVPEAWAALDAVRA

SEQ ID NO: 1392556 - protein, 17 aa, Mycobacterium tuberculosis
LCLPLARALRRPTPSAM

SEQ ID NO: 1392557 - protein, 25 aa, Mycobacterium tuberculosis
LCPQNLDYLISFFGALYSGRIAVPL

SEQ ID NO: 1392558 - protein, 18 aa, Mycobacterium tuberculosis
LCSESTMYRLLRERGQTG

SEQ ID NO: 1392559 - protein, 21 aa, Mycobacterium tuberculosis
LDAAPAVLPPMGPKLGLKAQR

SEQ ID NO: 1392560 - protein, 22 aa, Mycobacterium tuberculosis
LDAPDFRYFITGGAPMPEALIK

SEQ ID NO: 1392561 - protein, 22 aa, Mycobacterium tuberculosis
LDATVVRMFLVPSVMKLLGDDC

SEQ ID NO: 1392562 - protein, 17 aa, Mycobacterium tuberculosis
LDAVYLPPGRSAYVAAR

SEQ ID NO: 1392563 - protein, 22 aa, Mycobacterium tuberculosis
LDDPFLVQYLRYLGGILHGDLG

SEQ ID NO: 1392564 - protein, 25 aa, Mycobacterium tuberculosis
LDELLAPLAEPRYLIGRKILTPPAR

SEQ ID NO: 1392565 - protein, 18 aa, Mycobacterium tuberculosis
LDFIAPKVAGLSFSGLLG

SEQ ID NO: 1392566 - protein, 26 aa, Mycobacterium tuberculosis
LDGLRPYFTGYLPTLLLAAILTPATV

SEQ ID NO: 1392567 - protein, 18 aa, Mycobacterium tuberculosis
LDGVVRAIELSRQTLRTI

SEQ ID NO: 1392568 - protein, 25 aa, Mycobacterium tuberculosis
LDRQRILTWLIVDPLSPNSVRSAAA

SEQ ID NO: 1392569 - protein, 17 aa, Mycobacterium tuberculosis
LDRWLLFNWMRWGRALE

SEQ ID NO: 1392570 - protein, 20 aa, Mycobacterium tuberculosis
LDVRRLVRRLLGRPDPVHKP

SEQ ID NO: 1392571 - protein, 17 aa, Mycobacterium tuberculosis
LEDFAMAAYLPLFAVLA

SEQ ID NO: 1392572 - protein, 17 aa, Mycobacterium tuberculosis
LEEGALSLLTPFAAFLL

SEQ ID NO: 1392573 - protein, 24 aa, Mycobacterium tuberculosis
LEKIPLLGHLWSWELAIPMSGIAM

SEQ ID NO: 1392574 - protein, 20 aa, Mycobacterium tuberculosis
LENRIKAMPPSSVVGLWTFD

SEQ ID NO: 1392575 - protein, 18 aa, Mycobacterium tuberculosis
LEPVSHMWVVKFLRTHGL

SEQ ID NO: 1392576 - protein, 23 aa, Mycobacterium tuberculosis
LEPVSHMWVVKFLRTHGLIHDCP

SEQ ID NO: 1392577 - protein, 17 aa, Mycobacterium tuberculosis
LERFSWIALVIAVIAGI

SEQ ID NO: 1392578 - protein, 22 aa, Mycobacterium tuberculosis
LERQWRARMAGLRTNALVATGA

SEQ ID NO: 1392579 - protein, 23 aa, Mycobacterium tuberculosis
LERQWRARMAGLRTNALVATGAT

SEQ ID NO: 1392580 - protein, 37 aa, Mycobacterium tuberculosis
LESKITKLMPWLWVAWFGLGSFGVLMLWLPGNNLVVA

SEQ ID NO: 1392581 - protein, 19 aa, Mycobacterium tuberculosis
LEVLAMIALLPAAAALGGL

SEQ ID NO: 1392582 - protein, 18 aa, Mycobacterium tuberculosis
LFALWPFTRLVHAFSAPI

SEQ ID NO: 1392583 - protein, 19 aa, Mycobacterium tuberculosis
LFASTIGLFLMVVAGSLIT

SEQ ID NO: 1392584 - protein, 30 aa, Mycobacterium tuberculosis
LFAVGLRWDPYPFILLNLAFSTQASYAAPL

SEQ ID NO: 1392585 - protein, 20 aa, Mycobacterium tuberculosis
LFDIDGVLVLSWRAIPGAAE

SEQ ID NO: 1392586 - protein, 22 aa, Mycobacterium tuberculosis
LFGPLLDTFVTLPAFSAGAQAG

SEQ ID NO: 1392587 - protein, 19 aa, Mycobacterium tuberculosis
LFGSFLLLPSYLQQVLHQS

SEQ ID NO: 1392588 - protein, 26 aa, Mycobacterium tuberculosis
LFKRNICHQAIFYRRGLFGTIGPYNL

SEQ ID NO: 1392589 - protein, 19 aa, Mycobacterium tuberculosis
LFLGFFILEGFDFGVGMLM

SEQ ID NO: 1392590 - protein, 17 aa, Mycobacterium tuberculosis
LFLGFMFTFAIKAPLWP

SEQ ID NO: 1392591 - protein, 20 aa, Mycobacterium tuberculosis
LFPDWVIADGPWVKWYPGIP

SEQ ID NO: 1392592 - protein, 17 aa, Mycobacterium tuberculosis
LFRFVQQVYFRRRKTVI

SEQ ID NO: 1392593 - protein, 23 aa, Mycobacterium tuberculosis
LFTNLVELIPKAALAGLLIVIGA

SEQ ID NO: 1392594 - protein, 20 aa, Mycobacterium tuberculosis
LFTVGFAAVGLLGTGALLAA

SEQ ID NO: 1392595 - protein, 24 aa, Mycobacterium tuberculosis
LFVAAYVPYVAWLVQASADSAAAA

SEQ ID NO: 1392596 - protein, 17 aa, Mycobacterium tuberculosis
LFWRLPSDDTTRSRAKT

SEQ ID NO: 1392597 - protein, 27 aa, Mycobacterium tuberculosis
LGAINAPTQLWLGRPLIGDGVHGAPGT

SEQ ID NO: 1392598 - protein, 20 aa, Mycobacterium tuberculosis
LGAPTLLYLAAAGVGTIGIV

SEQ ID NO: 1392599 - protein, 37 aa, Mycobacterium tuberculosis
LGASFGLSVLLWQHILAIYLHWLVLAMSVIVLLAVGS

SEQ ID NO: 1392600 - protein, 25 aa, Mycobacterium tuberculosis
LGAVTLLPAILTLTGRRGWIKPRRD

SEQ ID NO: 1392601 - protein, 20 aa, Mycobacterium tuberculosis
LGCWPRPSTWPPAWHGRAIR

SEQ ID NO: 1392602 - protein, 18 aa, Mycobacterium tuberculosis
LGDFWGYLAGWGFVVGKT

SEQ ID NO: 1392603 - protein, 20 aa, Mycobacterium tuberculosis
LGELGLLIDAPRSATVRALR

SEQ ID NO: 1392604 - protein, 22 aa, Mycobacterium tuberculosis
LGFGGMSEVHLARDLRLHRDVA

SEQ ID NO: 1392605 - protein, 22 aa, Mycobacterium tuberculosis
LGGIRDLWLDLGALTELLRDPR

SEQ ID NO: 1392606 - protein, 23 aa, Mycobacterium tuberculosis
LGGVWLTSFLLVATNTAIASVLV

SEQ ID NO: 1392607 - protein, 21 aa, Mycobacterium tuberculosis
LGIMRFLAIFGPVHYFAQPVV

SEQ ID NO: 1392608 - protein, 22 aa, Mycobacterium tuberculosis
LGIPWNGWTALAALAVTCAVAT

SEQ ID NO: 1392609 - protein, 30 aa, Mycobacterium tuberculosis
LGLASMVIAFLPPLPVIMVLCAVVGLVYGP

SEQ ID NO: 1392610 - protein, 27 aa, Mycobacterium tuberculosis
LGLCFLPAFLCVGIVPLVVGLAGDVLQ

SEQ ID NO: 1392611 - protein, 17 aa, Mycobacterium tuberculosis
LGLFGSFLLLPSGRDRQ

SEQ ID NO: 1392612 - protein, 17 aa, Mycobacterium tuberculosis
LGLLFDTLVVRSFMTPS

SEQ ID NO: 1392613 - protein, 18 aa, Mycobacterium tuberculosis
LGLVLVTELLIVALTFIG

SEQ ID NO: 1392614 - protein, 30 aa, Mycobacterium tuberculosis
LGMVAATLALIVIPLMFGADLRPVLLRAMT

SEQ ID NO: 1392615 - protein, 17 aa, Mycobacterium tuberculosis
LGNLPLFAGLDAATLAQ

SEQ ID NO: 1392616 - protein, 17 aa, Mycobacterium tuberculosis
LGRLIEMLTTLPKFPGL

SEQ ID NO: 1392617 - protein, 27 aa, Mycobacterium tuberculosis
LGRLVYGLFIWHLAALAMVFPVIGAFP

SEQ ID NO: 1392618 - protein, 25 aa, Mycobacterium tuberculosis
LGRVPMAVVPLFVAAMLLVPAAGSV

SEQ ID NO: 1392619 - protein, 17 aa, Mycobacterium tuberculosis
LGSFGVLMLWLPGNNLV

SEQ ID NO: 1392620 - protein, 18 aa, Mycobacterium tuberculosis
LGSFGVLMLWLPGNNLVV

SEQ ID NO: 1392621 - protein, 25 aa, Mycobacterium tuberculosis
LGSYWAMFILVPGTLVLVFRILDEE

SEQ ID NO: 1392622 - protein, 30 aa, Mycobacterium tuberculosis
LGTISYGVYLWHWPIFLALNGQRTGWSGPA

SEQ ID NO: 1392623 - protein, 28 aa, Mycobacterium tuberculosis
LGVEEQYYVVWPLLLIGATLLLAARARR

SEQ ID NO: 1392624 - protein, 25 aa, Mycobacterium tuberculosis
LGVFVLVPLLEFAVVLELAILSIGW

SEQ ID NO: 1392625 - protein, 26 aa, Mycobacterium tuberculosis
LGVFVLVPLLEFAVVLELAILSIGWI

SEQ ID NO: 1392626 - protein, 33 aa, Mycobacterium tuberculosis
LGVRGQRLLALYYPFVAFLCSLATTLVLLDGAR

SEQ ID NO: 1392627 - protein, 17 aa, Mycobacterium tuberculosis
LGYIVIGGIAGWLASKI

SEQ ID NO: 1392628 - protein, 28 aa, Mycobacterium tuberculosis
LHDELFDACGWRRLIFATPEELEAALGA

SEQ ID NO: 1392629 - protein, 17 aa, Mycobacterium tuberculosis
LHKPEQLAKLARAGFRV

SEQ ID NO: 1392630 - protein, 29 aa, Mycobacterium tuberculosis
LHRPKLGFPVPIRHWLRAGELLEWAYATV

SEQ ID NO: 1392631 - protein, 27 aa, Mycobacterium tuberculosis
LHWSVLPIAFVLLISVGSAYNLLFALR

SEQ ID NO: 1392632 - protein, 24 aa, Mycobacterium tuberculosis
LIAAYGYWLISHWPVDLLADRHNI

SEQ ID NO: 1392633 - protein, 17 aa, Mycobacterium tuberculosis
LIAPPLTRFVMLRLAPG

SEQ ID NO: 1392634 - protein, 18 aa, Mycobacterium tuberculosis
LIAVLHDGVVIGSAVFSE

SEQ ID NO: 1392635 - protein, 18 aa, Mycobacterium tuberculosis
LIDGLLDRLVYLSYGLAV

SEQ ID NO: 1392636 - protein, 19 aa, Mycobacterium tuberculosis
LIDGLLDRLVYLSYGLAVI

SEQ ID NO: 1392637 - protein, 20 aa, Mycobacterium tuberculosis
LIDVVHWPGYLLIVAGVVGG

SEQ ID NO: 1392638 - protein, 28 aa, Mycobacterium tuberculosis
LIEADGWRWVFLVNLPLGVFAVLAARRA

SEQ ID NO: 1392639 - protein, 17 aa, Mycobacterium tuberculosis
LIEQPIRRWRPARVSLL

SEQ ID NO: 1392640 - protein, 26 aa, Mycobacterium tuberculosis
LIGGFLLMWIMSWLTAAPVRVVRAAL

SEQ ID NO: 1392641 - protein, 18 aa, Mycobacterium tuberculosis
LIGRTLLGLAATAVTAVL

SEQ ID NO: 1392642 - protein, 17 aa, Mycobacterium tuberculosis
LIGWLYDISIGTLVVVV

SEQ ID NO: 1392643 - protein, 18 aa, Mycobacterium tuberculosis
LIGYGLLAARRAWRPVAL

SEQ ID NO: 1392644 - protein, 17 aa, Mycobacterium tuberculosis
LIGYVGLADTARPSSRP

SEQ ID NO: 1392645 - protein, 17 aa, Mycobacterium tuberculosis
LIIACPCALGLAIPTAI

SEQ ID NO: 1392646 - protein, 19 aa, Mycobacterium tuberculosis
LIIYLWVGIVAFGAASSIF

SEQ ID NO: 1392647 - protein, 17 aa, Mycobacterium tuberculosis
LILAPGGRLAYFGPPQQ

SEQ ID NO: 1392648 - protein, 17 aa, Mycobacterium tuberculosis
LILSCGVALHHCVVALA

SEQ ID NO: 1392649 - protein, 18 aa, Mycobacterium tuberculosis
LILVLHSKHLHIFLAPIN

SEQ ID NO: 1392650 - protein, 26 aa, Mycobacterium tuberculosis
LIPRLYALHILLLPGIILALIGLHLA

SEQ ID NO: 1392651 - protein, 18 aa, Mycobacterium tuberculosis
LIRAFWPGALSLVVVQAP

SEQ ID NO: 1392652 - protein, 18 aa, Mycobacterium tuberculosis
LIRRPIVGYLWSWLSGRD

SEQ ID NO: 1392653 - protein, 31 aa, Mycobacterium tuberculosis
LIRTPELYAWILVLPIGLMLQQSSLRVGALT

SEQ ID NO: 1392654 - protein, 20 aa, Mycobacterium tuberculosis
LIRYVPHPVIFWIHGGNRDP

SEQ ID NO: 1392655 - protein, 23 aa, Mycobacterium tuberculosis
LIVSRFVLRRLGPGPGGLASNRV

SEQ ID NO: 1392656 - protein, 30 aa, Mycobacterium tuberculosis
LKATMLAHWAWLSMLLVGGAGAAGYWVRRH

SEQ ID NO: 1392657 - protein, 17 aa, Mycobacterium tuberculosis
LKIMTWVTAFFAPLTVA

SEQ ID NO: 1392658 - protein, 28 aa, Mycobacterium tuberculosis
LKSWRRGLIFAMFVFAAIFTPGSDPFSM

SEQ ID NO: 1392659 - protein, 23 aa, Mycobacterium tuberculosis
LLAAALTLWLHVIDARFARALRL

SEQ ID NO: 1392660 - protein, 20 aa, Mycobacterium tuberculosis
LLAGSFLLALLAVTAANFFT

SEQ ID NO: 1392661 - protein, 20 aa, Mycobacterium tuberculosis
LLAIWIGIGFIFRGVATTVS

SEQ ID NO: 1392662 - protein, 46 aa, Mycobacterium tuberculosis
LLALGSSMFFGAYPWAGWLAFAATLPVQFVAGWPILRGAVQQARAL

SEQ ID NO: 1392663 - protein, 19 aa, Mycobacterium tuberculosis
LLALLLPYTAYKEHVSPFV

SEQ ID NO: 1392664 - protein, 17 aa, Mycobacterium tuberculosis
LLAPVGVIPILLPDGKD

SEQ ID NO: 1392665 - protein, 32 aa, Mycobacterium tuberculosis
LLARILRQFHHPLIYVLLVAGTITAGLKEFVD

SEQ ID NO: 1392666 - protein, 25 aa, Mycobacterium tuberculosis
LLASLVCFLLIITIPFGFAALRIAS

SEQ ID NO: 1392667 - protein, 21 aa, Mycobacterium tuberculosis
LLAVLFSWLTYGNLLLRRGGS

SEQ ID NO: 1392668 - protein, 24 aa, Mycobacterium tuberculosis
LLAVTVSLLTIPFAAAAGTAVHDS

SEQ ID NO: 1392669 - protein, 19 aa, Mycobacterium tuberculosis
LLAYRSRPFFVPDEPQRDP

SEQ ID NO: 1392670 - protein, 17 aa, Mycobacterium tuberculosis
LLDTYSPELFCMIRNFH

SEQ ID NO: 1392671 - protein, 20 aa, Mycobacterium tuberculosis
LLERVLANLIDNALRYAPDC

SEQ ID NO: 1392672 - protein, 19 aa, Mycobacterium tuberculosis
LLEVLFLRWLLDGRASRQW

SEQ ID NO: 1392673 - protein, 28 aa, Mycobacterium tuberculosis
LLFADLCAIFTPYRWMIEHVTTKRGQLR

SEQ ID NO: 1392674 - protein, 20 aa, Mycobacterium tuberculosis
LLGLFNLLPGAPLDGGRLVR

SEQ ID NO: 1392675 - protein, 21 aa, Mycobacterium tuberculosis
LLGQWRDDLRWPPASALVSQD

SEQ ID NO: 1392676 - protein, 29 aa, Mycobacterium tuberculosis
LLGVAVMTWLSVPLALLAVLLVPVIGLIA

SEQ ID NO: 1392677 - protein, 17 aa, Mycobacterium tuberculosis
LLGWGVFLNYGLVLIVL

SEQ ID NO: 1392678 - protein, 30 aa, Mycobacterium tuberculosis
LLHATPEALFNPILMMALAALGIGSVSTLL

SEQ ID NO: 1392679 - protein, 31 aa, Mycobacterium tuberculosis
LLHATPEALFNPILMMALAALGIGSVSTLLV

SEQ ID NO: 1392680 - protein, 17 aa, Mycobacterium tuberculosis
LLHFLRDAAGSLAGVIT

SEQ ID NO: 1392681 - protein, 24 aa, Mycobacterium tuberculosis
LLIGALFFPWNLYFGFRIPDSSKT

SEQ ID NO: 1392682 - protein, 25 aa, Mycobacterium tuberculosis
LLKLAVLLALWAAVAGAFVSVLYRR

SEQ ID NO: 1392683 - protein, 20 aa, Mycobacterium tuberculosis
LLKLPVPNWPLWAAWAMPVG

SEQ ID NO: 1392684 - protein, 20 aa, Mycobacterium tuberculosis
LLLEVLFLRWLLDGRASRQW

SEQ ID NO: 1392685 - protein, 24 aa, Mycobacterium tuberculosis
LLLHIGVMLAFLILVLHSKHLHIF

SEQ ID NO: 1392686 - protein, 25 aa, Mycobacterium tuberculosis
LLLNMWALYVVGPPLEMWLGRLRFG

SEQ ID NO: 1392687 - protein, 20 aa, Mycobacterium tuberculosis
LLLSSLLLNWVLGPALMFAL

SEQ ID NO: 1392688 - protein, 24 aa, Mycobacterium tuberculosis
LLLSSLLLNWVLGPALMFALAWLL

SEQ ID NO: 1392689 - protein, 21 aa, Mycobacterium tuberculosis
LLLVIAIGFTASFFVVTPPPN

SEQ ID NO: 1392690 - protein, 25 aa, Mycobacterium tuberculosis
LLMAGFYLTCVVFVFGVLGVLLRIV

SEQ ID NO: 1392691 - protein, 32 aa, Mycobacterium tuberculosis
LLMAGFYLTCVVFVFGVLGVLLRIVSGLSIFR

SEQ ID NO: 1392692 - protein, 33 aa, Mycobacterium tuberculosis
LLMAGFYLTCVVFVFGVLGVLLRIVSGLSIFRL

SEQ ID NO: 1392693 - protein, 23 aa, Mycobacterium tuberculosis
LLMAVERIELFVDVLLKGGRTAD

SEQ ID NO: 1392694 - protein, 20 aa, Mycobacterium tuberculosis
LLMVALLAVPRFAIAVTANN

SEQ ID NO: 1392695 - protein, 18 aa, Mycobacterium tuberculosis
LLNWVLGPALMFALAWLL

SEQ ID NO: 1392696 - protein, 18 aa, Mycobacterium tuberculosis
LLRSLLTYFHYASKETRP

SEQ ID NO: 1392697 - protein, 32 aa, Mycobacterium tuberculosis
LLSELPAVAWVWFQLFVDILGFNIIGFIITLA

SEQ ID NO: 1392698 - protein, 34 aa, Mycobacterium tuberculosis
LLSELPAVAWVWFQLFVDILGFNIIGFIITLASN

SEQ ID NO: 1392699 - protein, 37 aa, Mycobacterium tuberculosis
LLTGWLVRRTLLVSTLLVASAWWLFAWELDNGAGLHE

SEQ ID NO: 1392700 - protein, 19 aa, Mycobacterium tuberculosis
LLTIYTQLFTTHVGWRESV

SEQ ID NO: 1392701 - protein, 24 aa, Mycobacterium tuberculosis
LLTTTIVLMFLAFGSVVLPIKATL

SEQ ID NO: 1392702 - protein, 19 aa, Mycobacterium tuberculosis
LLTWLGGGHWRELGERHER

SEQ ID NO: 1392703 - protein, 18 aa, Mycobacterium tuberculosis
LLVGWWSLVSLLAMNWIA

SEQ ID NO: 1392704 - protein, 19 aa, Mycobacterium tuberculosis
LLVIPVALSASIIRLRTLA

SEQ ID NO: 1392705 - protein, 25 aa, Mycobacterium tuberculosis
LLVNLPVMLLFPRGWSEFFRLNTRR

SEQ ID NO: 1392706 - protein, 17 aa, Mycobacterium tuberculosis
LLVPVIVVCGFLLGVAG

SEQ ID NO: 1392707 - protein, 27 aa, Mycobacterium tuberculosis
LLVRSAGFGYPFLAYHVAGRGHGAGAV

SEQ ID NO: 1392708 - protein, 17 aa, Mycobacterium tuberculosis
LLVVAVSAAIFGVARLI

SEQ ID NO: 1392709 - protein, 26 aa, Mycobacterium tuberculosis
LLVVEGVAINFWLLRRDSVTVGTDDD

SEQ ID NO: 1392710 - protein, 27 aa, Mycobacterium tuberculosis
LLVVEGVAINFWLLRRDSVTVGTDDDA

SEQ ID NO: 1392711 - protein, 33 aa, Mycobacterium tuberculosis
LLVVLGTWQVSGRLLFALLSFSVVGAVLALATP

SEQ ID NO: 1392712 - protein, 30 aa, Mycobacterium tuberculosis
LLYASFPPRNCWWAAVVALALLAWVLTHRA

SEQ ID NO: 1392713 - protein, 29 aa, Mycobacterium tuberculosis
LMALPTGCILAWILVRIINVRSFGWTLQM

SEQ ID NO: 1392714 - protein, 17 aa, Mycobacterium tuberculosis
LMIFGDTFGYCAVDGHQ

SEQ ID NO: 1392715 - protein, 17 aa, Mycobacterium tuberculosis
LMLMASPTARSAASLLT

SEQ ID NO: 1392716 - protein, 17 aa, Mycobacterium tuberculosis
LMLYTIVIIRGLRTAIA

SEQ ID NO: 1392717 - protein, 24 aa, Mycobacterium tuberculosis
LMTPLRVMFAIALVFLALGWSTKA

SEQ ID NO: 1392718 - protein, 26 aa, Mycobacterium tuberculosis
LNAINAPTQALLGRPLIGDGADGTAP

SEQ ID NO: 1392719 - protein, 26 aa, Mycobacterium tuberculosis
LNEYIGFLVAWQRPLAGKKTLMDLAT

SEQ ID NO: 1392720 - protein, 29 aa, Mycobacterium tuberculosis
LNGAPEAMWWTLYLACYLAGGWGSAWAGA

SEQ ID NO: 1392721 - protein, 24 aa, Mycobacterium tuberculosis
LNLPPPCTTGFLPAQQRRIPTFED

SEQ ID NO: 1392722 - protein, 21 aa, Mycobacterium tuberculosis
LPAKGFITDRLPRLCRKYLLT

SEQ ID NO: 1392723 - protein, 25 aa, Mycobacterium tuberculosis
LPASVPVWLVWHIPGGTVWAEEAAF

SEQ ID NO: 1392724 - protein, 19 aa, Mycobacterium tuberculosis
LPCLPWFISSNWNLAFGVL

SEQ ID NO: 1392725 - protein, 27 aa, Mycobacterium tuberculosis
LPDAPPIGFWIDVTVVLWVVVALVTSM

SEQ ID NO: 1392726 - protein, 25 aa, Mycobacterium tuberculosis
LPDIPGLPDFKWPPTPGSPLFPAIP

SEQ ID NO: 1392727 - protein, 34 aa, Mycobacterium tuberculosis
LPERLLQVLTGLLFLLFGLWLLFDDALGFRSVAI

SEQ ID NO: 1392728 - protein, 20 aa, Mycobacterium tuberculosis
LPGIGTLAAWFAAAGEVVVF

SEQ ID NO: 1392729 - protein, 20 aa, Mycobacterium tuberculosis
LPILAAAPTPPLGPAWVALL

SEQ ID NO: 1392730 - protein, 17 aa, Mycobacterium tuberculosis
LPILPTGLAIMGMGMGC

SEQ ID NO: 1392731 - protein, 18 aa, Mycobacterium tuberculosis
LPILPTGLAIMGMGMVCS

SEQ ID NO: 1392732 - protein, 27 aa, Mycobacterium tuberculosis
LPKVGPWALYGLLFTIVILFALQGDQI

SEQ ID NO: 1392733 - protein, 17 aa, Mycobacterium tuberculosis
LPLASLVFFGAFIPLIG

SEQ ID NO: 1392734 - protein, 24 aa, Mycobacterium tuberculosis
LPMLRPTMFFVLVTGIISAAQVFD

SEQ ID NO: 1392735 - protein, 18 aa, Mycobacterium tuberculosis
LPPLPPLPGCPAGPTVAA

SEQ ID NO: 1392736 - protein, 17 aa, Mycobacterium tuberculosis
LPQELPMLAPGQEWRMV

SEQ ID NO: 1392737 - protein, 17 aa, Mycobacterium tuberculosis
LPQYWQEAADWLRTHHA

SEQ ID NO: 1392738 - protein, 30 aa, Mycobacterium tuberculosis
LPRLTRMQRFWISLYFPLTMRSLCNAIVVP

SEQ ID NO: 1392739 - protein, 26 aa, Mycobacterium tuberculosis
LPRRIHAFVRWVVRTPWPLFSLSMLQ

SEQ ID NO: 1392740 - protein, 27 aa, Mycobacterium tuberculosis
LPRSARQPWLWVGVAVAVVVALAGGLG

SEQ ID NO: 1392741 - protein, 17 aa, Mycobacterium tuberculosis
LPRVGQINWKWIRRSLY

SEQ ID NO: 1392742 - protein, 37 aa, Mycobacterium tuberculosis
LPSAISAMLIYRLISWLLIAAIGWVVFFFMFRTESTA

SEQ ID NO: 1392743 - protein, 38 aa, Mycobacterium tuberculosis
LPSAISAMLIYRLISWLLIAAIGWVVFFFMFRTESTAD

SEQ ID NO: 1392744 - protein, 21 aa, Mycobacterium tuberculosis
LPSLGNPLTFLSPANIAFALG

SEQ ID NO: 1392745 - protein, 23 aa, Mycobacterium tuberculosis
LPSVLKPPLITLRTLTLSGYRVV

SEQ ID NO: 1392746 - protein, 27 aa, Mycobacterium tuberculosis
LPTPTLPWPILPNPRLPAPIFPKPRLC

SEQ ID NO: 1392747 - protein, 18 aa, Mycobacterium tuberculosis
LPTQILWINMTTAIALGL

SEQ ID NO: 1392748 - protein, 31 aa, Mycobacterium tuberculosis
LRALYVISSWRPVLLIPLTFALFTPLAVPGF

SEQ ID NO: 1392749 - protein, 24 aa, Mycobacterium tuberculosis
LRDTGLAMLVWALAVAGALAFGQL

SEQ ID NO: 1392750 - protein, 31 aa, Mycobacterium tuberculosis
LRELATHYWKPLLLCFLVTLGGTVAFYTYSV

SEQ ID NO: 1392751 - protein, 18 aa, Mycobacterium tuberculosis
LRERYFYESFADREHFVR

SEQ ID NO: 1392752 - protein, 24 aa, Mycobacterium tuberculosis
LRGKVVLIDFWAYPCINCQRAIPH

SEQ ID NO: 1392753 - protein, 17 aa, Mycobacterium tuberculosis
LRHTVLVPGPPPGSAIA

SEQ ID NO: 1392754 - protein, 44 aa, Mycobacterium tuberculosis
LRLPSSVVSWLPLYHDMGLMVGLFIPLFVGCPVILTSPEAFIRK

SEQ ID NO: 1392755 - protein, 18 aa, Mycobacterium tuberculosis
LRMVIGGVALALLGVRRY

SEQ ID NO: 1392756 - protein, 34 aa, Mycobacterium tuberculosis
LRNGINRILQFITYLLVPAGLLTIYTQLFTTHVG

SEQ ID NO: 1392757 - protein, 22 aa, Mycobacterium tuberculosis
LRPFAPRRLVRALLLPSGQHPS

SEQ ID NO: 1392758 - protein, 18 aa, Mycobacterium tuberculosis
LRRILPFVNRISGALLVV

SEQ ID NO: 1392759 - protein, 17 aa, Mycobacterium tuberculosis
LRRLLYREAQQRGIYAL

SEQ ID NO: 1392760 - protein, 24 aa, Mycobacterium tuberculosis
LRTDLRLRWSWRGLRLGLMFGFGG

SEQ ID NO: 1392761 - protein, 17 aa, Mycobacterium tuberculosis
LRYCLQLFPDPSTYFRP

SEQ ID NO: 1392762 - protein, 34 aa, Mycobacterium tuberculosis
LSAAINFFLIAFAVYFLVVLPYNTLRKKGEVEQP

SEQ ID NO: 1392763 - protein, 22 aa, Mycobacterium tuberculosis
LSAALTLMIPIGAFLGRIYDSW

SEQ ID NO: 1392764 - protein, 32 aa, Mycobacterium tuberculosis
LSAKPMWPRGWIIPTSWRFISAASSRVGYGLR

SEQ ID NO: 1392765 - protein, 22 aa, Mycobacterium tuberculosis
LSAVYMLWLYQRVMTGPVAEGN

SEQ ID NO: 1392766 - protein, 39 aa, Mycobacterium tuberculosis
LSDGLTAWIAAPLLFIGALFGLLLLAGITIREVPDAMRA

SEQ ID NO: 1392767 - protein, 24 aa, Mycobacterium tuberculosis
LSDVRSFMTMFTSPDPFHANEYAE

SEQ ID NO: 1392768 - protein, 25 aa, Mycobacterium tuberculosis
LSFSGLLGAVYFPGILSLLQDDMPF

SEQ ID NO: 1392769 - protein, 19 aa, Mycobacterium tuberculosis
LSGQLLFIVAVGALVYAVI

SEQ ID NO: 1392770 - protein, 17 aa, Mycobacterium tuberculosis
LSIGWIISNIFGAIPVL

SEQ ID NO: 1392771 - protein, 24 aa, Mycobacterium tuberculosis
LSIRRSCVMYWLRATFGVVPGRWP

SEQ ID NO: 1392772 - protein, 25 aa, Mycobacterium tuberculosis
LSLGLFGSFLLLPSYLQQVLHQSPM

SEQ ID NO: 1392773 - protein, 18 aa, Mycobacterium tuberculosis
LSLLPVLIGLMSAVPLGL

SEQ ID NO: 1392774 - protein, 17 aa, Mycobacterium tuberculosis
LSLLTPFAAFLLAQSLK

SEQ ID NO: 1392775 - protein, 26 aa, Mycobacterium tuberculosis
LSMVFGELVPKYLAVARPLRTARSVV

SEQ ID NO: 1392776 - protein, 21 aa, Mycobacterium tuberculosis
LSPFSGYLTLAFLAGVLILMY

SEQ ID NO: 1392777 - protein, 19 aa, Mycobacterium tuberculosis
LSPFSGYLTLAFLAGVLIV

SEQ ID NO: 1392778 - protein, 27 aa, Mycobacterium tuberculosis
LSRWQWLVKWFLAIPHYIVLFFLHVAA

SEQ ID NO: 1392779 - protein, 21 aa, Mycobacterium tuberculosis
LSRWREWAAPLWVGCNFSAWM

SEQ ID NO: 1392780 - protein, 18 aa, Mycobacterium tuberculosis
LSTLIGRTLLGLAATAVT

SEQ ID NO: 1392781 - protein, 20 aa, Mycobacterium tuberculosis
LSVLIWQHILHMPLHWLVLP

SEQ ID NO: 1392782 - protein, 19 aa, Mycobacterium tuberculosis
LSVLLFTIGASGVLLRRNA

SEQ ID NO: 1392783 - protein, 24 aa, Mycobacterium tuberculosis
LSVMAIFYLRLPATFGIGTYGVSA

SEQ ID NO: 1392784 - protein, 26 aa, Mycobacterium tuberculosis
LSVPSLWRETPAPYGPLFLWIVGGNL

SEQ ID NO: 1392785 - protein, 22 aa, Mycobacterium tuberculosis
LTAGIGLLGIILNAIKPSQAFE

SEQ ID NO: 1392786 - protein, 22 aa, Mycobacterium tuberculosis
LTAGIGLLGIILNAIKPSQASR

SEQ ID NO: 1392787 - protein, 17 aa, Mycobacterium tuberculosis
LTANPLRFLARATNLWN

SEQ ID NO: 1392788 - protein, 24 aa, Mycobacterium tuberculosis
LTELRTRLLISLAAILVTTIFGFV

SEQ ID NO: 1392789 - protein, 28 aa, Mycobacterium tuberculosis
LTEVSWRWAFLVNVPIGLVMIYLARTAV

SEQ ID NO: 1392790 - protein, 19 aa, Mycobacterium tuberculosis
LTFALFTPLAVPGFAWWAA

SEQ ID NO: 1392791 - protein, 18 aa, Mycobacterium tuberculosis
LTFAPNSLYRASLAIGLA

SEQ ID NO: 1392792 - protein, 17 aa, Mycobacterium tuberculosis
LTFRRIAAALGRPMVPI

SEQ ID NO: 1392793 - protein, 21 aa, Mycobacterium tuberculosis
LTGPWLLRVGFGPDYQTGGAL

SEQ ID NO: 1392794 - protein, 18 aa, Mycobacterium tuberculosis
LTHFVWGLIMVFALPPLF

SEQ ID NO: 1392795 - protein, 21 aa, Mycobacterium tuberculosis
LTKFITWTLPTNLGEGLVILA

SEQ ID NO: 1392796 - protein, 21 aa, Mycobacterium tuberculosis
LTLIARYLDRYGIRADTIRIT

SEQ ID NO: 1392797 - protein, 21 aa, Mycobacterium tuberculosis
LTPVAWWICGSATGLTVLYLA

SEQ ID NO: 1392798 - protein, 17 aa, Mycobacterium tuberculosis
LTSIPLLYAGRSVIGAF

SEQ ID NO: 1392799 - protein, 20 aa, Mycobacterium tuberculosis
LTSTGSVLATLAYAAPEVLA

SEQ ID NO: 1392800 - protein, 17 aa, Mycobacterium tuberculosis
LTTMRLLQGFAVGGEWA

SEQ ID NO: 1392801 - protein, 18 aa, Mycobacterium tuberculosis
LTTRANRADAWLTSLLAA

SEQ ID NO: 1392802 - protein, 19 aa, Mycobacterium tuberculosis
LVAFVILVQPTASVLRAAV

SEQ ID NO: 1392803 - protein, 25 aa, Mycobacterium tuberculosis
LVAGDVRLLLPMPADWSYAEAAAIS

SEQ ID NO: 1392804 - protein, 17 aa, Mycobacterium tuberculosis
LVALNGMRLLTNRSWRA

SEQ ID NO: 1392805 - protein, 18 aa, Mycobacterium tuberculosis
LVCRVVVPAVATTRRRLE

SEQ ID NO: 1392806 - protein, 34 aa, Mycobacterium tuberculosis
LVDGRIESLLPAILEGRQLWQRVQAAVSVLLGGN

SEQ ID NO: 1392807 - protein, 29 aa, Mycobacterium tuberculosis
LVDRNPTLDFVARFPLLKPLDMSDAICRT

SEQ ID NO: 1392808 - protein, 32 aa, Mycobacterium tuberculosis
LVERRPSRLRRGWLVGIAATLLALAGGLGAAG

SEQ ID NO: 1392809 - protein, 29 aa, Mycobacterium tuberculosis
LVFTTVTWAPFLWLVTCVVIIVSYAPQTR

SEQ ID NO: 1392810 - protein, 30 aa, Mycobacterium tuberculosis
LVFTTVTWAPFLWLVTYVVIIVSYARKPAR

SEQ ID NO: 1392811 - protein, 18 aa, Mycobacterium tuberculosis
LVGALPWLTASALGSSLT

SEQ ID NO: 1392812 - protein, 23 aa, Mycobacterium tuberculosis
LVGFLPLVWLSLAYGWGLAGIWS

SEQ ID NO: 1392813 - protein, 49 aa, Mycobacterium tuberculosis
LVGIECLIAIPLRRDPLLFPFQPIHVTIATWFTIGIPAFILSLAPNNER

SEQ ID NO: 1392814 - protein, 25 aa, Mycobacterium tuberculosis
LVGWPTWGMILSSPFLLPAGLGLGL

SEQ ID NO: 1392815 - protein, 20 aa, Mycobacterium tuberculosis
LVIMDLRDHWMAKAPYILGQ

SEQ ID NO: 1392816 - protein, 18 aa, Mycobacterium tuberculosis
LVIVTSLSMVFGELVPKY

SEQ ID NO: 1392817 - protein, 22 aa, Mycobacterium tuberculosis
LVLAGAVLLFARPRLRVGSAGL

SEQ ID NO: 1392818 - protein, 25 aa, Mycobacterium tuberculosis
LVLIKWWLLAIPHYLILAVFLSSGW

SEQ ID NO: 1392819 - protein, 18 aa, Mycobacterium tuberculosis
LVLLAAGLGVLWLPAGWL

SEQ ID NO: 1392820 - protein, 17 aa, Mycobacterium tuberculosis
LVLLGTFSRYWLAAAFG

SEQ ID NO: 1392821 - protein, 18 aa, Mycobacterium tuberculosis
LVLTGRTPLPPRRDWQLD

SEQ ID NO: 1392822 - protein, 25 aa, Mycobacterium tuberculosis
LVPAALVSWIVTAAGIVWPIGNVCA

SEQ ID NO: 1392823 - protein, 30 aa, Mycobacterium tuberculosis
LVPFGEYVPLRPLFGWITRYSKAAAKDRQR

SEQ ID NO: 1392824 - protein, 19 aa, Mycobacterium tuberculosis
LVPGLLVGAVTRGTASGPA

SEQ ID NO: 1392825 - protein, 22 aa, Mycobacterium tuberculosis
LVPLVAGPLPVAFFIGVLAGEE

SEQ ID NO: 1392826 - protein, 28 aa, Mycobacterium tuberculosis
LVRELVTILPIVLVIAAVAAYLLSRAAL

SEQ ID NO: 1392827 - protein, 25 aa, Mycobacterium tuberculosis
LVRKRRIGPVWLTAAGYAVACQVPI

SEQ ID NO: 1392828 - protein, 17 aa, Mycobacterium tuberculosis
LVRTVTVPALTTMIGRA

SEQ ID NO: 1392829 - protein, 27 aa, Mycobacterium tuberculosis
LVTGWWIGVLAYFLPRRSWLRAAAEDT

SEQ ID NO: 1392830 - protein, 19 aa, Mycobacterium tuberculosis
LVTMLLVGVVLLAVGHRGG

SEQ ID NO: 1392831 - protein, 22 aa, Mycobacterium tuberculosis
LVTRAAILVGLFLAAVALVWLL

SEQ ID NO: 1392832 - protein, 17 aa, Mycobacterium tuberculosis
LVTSAGPMLVLLAAGLG

SEQ ID NO: 1392833 - protein, 18 aa, Mycobacterium tuberculosis
LVVAAGALWMAARLPWVV

SEQ ID NO: 1392834 - protein, 18 aa, Mycobacterium tuberculosis
LVVAMVLAGLRVEAAMAS

SEQ ID NO: 1392835 - protein, 19 aa, Mycobacterium tuberculosis
LVVAVLLNYPFSRYDSMAL

SEQ ID NO: 1392836 - protein, 18 aa, Mycobacterium tuberculosis
LVVPFIGIKLADLVIVAL

SEQ ID NO: 1392837 - protein, 20 aa, Mycobacterium tuberculosis
LVVPTVALAVPWLTQLQLLF

SEQ ID NO: 1392838 - protein, 17 aa, Mycobacterium tuberculosis
LVVRFAEPLPPSPSGSF

SEQ ID NO: 1392839 - protein, 31 aa, Mycobacterium tuberculosis
LVVSHVTPIKMLLRLALDAGSGVFFFFFFFI

SEQ ID NO: 1392840 - protein, 29 aa, Mycobacterium tuberculosis
LVVTAALTVWVVDMRYARCAGSPRPPPRS

SEQ ID NO: 1392841 - protein, 19 aa, Mycobacterium tuberculosis
LVYELALLTLAASLNGGGI

SEQ ID NO: 1392842 - protein, 17 aa, Mycobacterium tuberculosis
LWAARRPGDTSATVLTA

SEQ ID NO: 1392843 - protein, 17 aa, Mycobacterium tuberculosis
LWLLYRYYRTGDPLFWF

SEQ ID NO: 1392844 - protein, 18 aa, Mycobacterium tuberculosis
LWPFTRLVHAFSAPIGYL

SEQ ID NO: 1392845 - protein, 19 aa, Mycobacterium tuberculosis
LWSGRVFAEARWLPVALLS

SEQ ID NO: 1392846 - protein, 18 aa, Mycobacterium tuberculosis
LWSGRVFAEARWLSVALL

SEQ ID NO: 1392847 - protein, 18 aa, Mycobacterium tuberculosis
LYCGFTAITMLGFGTFGL

SEQ ID NO: 1392848 - protein, 18 aa, Mycobacterium tuberculosis
LYNVVWKVPPDFGERGRR

SEQ ID NO: 1392849 - protein, 17 aa, Mycobacterium tuberculosis
LYTIVIIRGLRTAIATR

SEQ ID NO: 1392850 - protein, 27 aa, Mycobacterium tuberculosis
MAEAPLYYQIHVLIGLALFALWPFTRL

SEQ ID NO: 1392851 - protein, 39 aa, Mycobacterium tuberculosis
MAEAPLYYQIHVLIGLALFALWPFTRLVHAFSAPIGYLF

SEQ ID NO: 1392852 - protein, 24 aa, Mycobacterium tuberculosis
MAGAAAPYVGWLSAAPAGGVVGWS

SEQ ID NO: 1392853 - protein, 29 aa, Mycobacterium tuberculosis
MAGLRRWLGPLSILLVLWGLRASIQWLQA

SEQ ID NO: 1392854 - protein, 25 aa, Mycobacterium tuberculosis
MALPTGCILAWILVRIINVRSFGWT

SEQ ID NO: 1392855 - protein, 26 aa, Mycobacterium tuberculosis
MALPTGCILAWILVRIINVRSFGWTL

SEQ ID NO: 1392856 - protein, 25 aa, Mycobacterium tuberculosis
MALPTGCILVWILVRIINVRSFGWT

SEQ ID NO: 1392857 - protein, 21 aa, Mycobacterium tuberculosis
MANYYRWFGTPEAPFGWYYDL

SEQ ID NO: 1392858 - protein, 18 aa, Mycobacterium tuberculosis
MAPRCRVAYIAHGQHRVC

SEQ ID NO: 1392859 - protein, 20 aa, Mycobacterium tuberculosis
MARYHDLLWLGAAGLVCSGI

SEQ ID NO: 1392860 - protein, 17 aa, Mycobacterium tuberculosis
MATLRIAFLSALVLELL

SEQ ID NO: 1392861 - protein, 17 aa, Mycobacterium tuberculosis
MAVLPRSVKSSKNEQYI

SEQ ID NO: 1392862 - protein, 17 aa, Mycobacterium tuberculosis
MCDRLLILAPGGRLAYF

SEQ ID NO: 1392863 - protein, 25 aa, Mycobacterium tuberculosis
MCSAATMYTPERVTFFCIGGATMAQ

SEQ ID NO: 1392864 - protein, 22 aa, Mycobacterium tuberculosis
MDANYRWFHPAPNTLAAAVGSP

SEQ ID NO: 1392865 - protein, 20 aa, Mycobacterium tuberculosis
MDILITLLPQMRAQMPPMIS

SEQ ID NO: 1392866 - protein, 17 aa, Mycobacterium tuberculosis
MDKVRLRTLGLVDQLYP

SEQ ID NO: 1392867 - protein, 19 aa, Mycobacterium tuberculosis
MDYEVFLVSRIREYWLESG

SEQ ID NO: 1392868 - protein, 21 aa, Mycobacterium tuberculosis
MFAALGWFYLSVLPGWLGLEQ

SEQ ID NO: 1392869 - protein, 17 aa, Mycobacterium tuberculosis
MFLGIVGAVFLASQLPA

SEQ ID NO: 1392870 - protein, 17 aa, Mycobacterium tuberculosis
MFTVSATYHRVNWENPA

SEQ ID NO: 1392871 - protein, 18 aa, Mycobacterium tuberculosis
MFVVLLSTLTLASFIYAI

SEQ ID NO: 1392872 - protein, 21 aa, Mycobacterium tuberculosis
MGLHPLIFFLPVRQGANWVVL

SEQ ID NO: 1392873 - protein, 18 aa, Mycobacterium tuberculosis
MGYRLVIYPEYASLDRVD

SEQ ID NO: 1392874 - protein, 19 aa, Mycobacterium tuberculosis
MHLDAGQQVWLITATPYEL

SEQ ID NO: 1392875 - protein, 18 aa, Mycobacterium tuberculosis
MIAAIIPMLLWITGVYDT

SEQ ID NO: 1392876 - protein, 25 aa, Mycobacterium tuberculosis
MIGSFPILSVFGFVVMFGSVVYAIT

SEQ ID NO: 1392877 - protein, 24 aa, Mycobacterium tuberculosis
MIKPAIVVALLFRPWTLSGFSTTS

SEQ ID NO: 1392878 - protein, 17 aa, Mycobacterium tuberculosis
MKAITPKAPGLEQFLRD

SEQ ID NO: 1392879 - protein, 45 aa, Mycobacterium tuberculosis
MKFIVIATIVIVFLILVILLRALVAPIYLIGSVLISYLSALGIGT

SEQ ID NO: 1392880 - protein, 21 aa, Mycobacterium tuberculosis
MLKGWYMSFWPIISIAVITVT

SEQ ID NO: 1392881 - protein, 18 aa, Mycobacterium tuberculosis
MLNAYNIVFAAFLVAAGR

SEQ ID NO: 1392882 - protein, 19 aa, Mycobacterium tuberculosis
MLPISSTWCAIGCSPSPSA

SEQ ID NO: 1392883 - protein, 20 aa, Mycobacterium tuberculosis
MLQRKLRVGFAKAGRLMDLM

SEQ ID NO: 1392884 - protein, 17 aa, Mycobacterium tuberculosis
MLTLYFILAVGAHVRVR

SEQ ID NO: 1392885 - protein, 18 aa, Mycobacterium tuberculosis
MLVVLVGAVIITLAFLRD

SEQ ID NO: 1392886 - protein, 22 aa, Mycobacterium tuberculosis
MMGELFWTVVPYVTMTIVAVGS

SEQ ID NO: 1392887 - protein, 20 aa, Mycobacterium tuberculosis
MMIVDPRRRIEVARSLEREC

SEQ ID NO: 1392888 - protein, 30 aa, Mycobacterium tuberculosis
MNKMEALTPQFLALLPPMITTMKTMRTMML

SEQ ID NO: 1392889 - protein, 25 aa, Mycobacterium tuberculosis
MPIPLGWQVWLYGVFAIIAVGVTSS

SEQ ID NO: 1392890 - protein, 26 aa, Mycobacterium tuberculosis
MQLALTELWCSYGVQPDLVIGHSMGE

SEQ ID NO: 1392891 - protein, 26 aa, Mycobacterium tuberculosis
MQLALTELWCSYGVRPDLVIGHSMGE

SEQ ID NO: 1392892 - protein, 17 aa, Mycobacterium tuberculosis
MRIRNYGGALFAQLRDW

SEQ ID NO: 1392893 - protein, 30 aa, Mycobacterium tuberculosis
MRSHNSSPPPPRWAWPPLIAVGAVGMVGMA

SEQ ID NO: 1392894 - protein, 26 aa, Mycobacterium tuberculosis
MSLNTSYYRLMLKLNGGPQAVADAAH

SEQ ID NO: 1392895 - protein, 23 aa, Mycobacterium tuberculosis
MSVRFMRRIAFSGFAITIVMLVL

SEQ ID NO: 1392896 - protein, 21 aa, Mycobacterium tuberculosis
MSWVTPARWGFAASAATVDLI

SEQ ID NO: 1392897 - protein, 21 aa, Mycobacterium tuberculosis
MTDAYLAPLKLRTTTLTLIYP

SEQ ID NO: 1392898 - protein, 21 aa, Mycobacterium tuberculosis
MTLDRWLLFNWMRWGRALEYL

SEQ ID NO: 1392899 - protein, 25 aa, Mycobacterium tuberculosis
MTTSRTLRLLVVSALATLSGLGTPV

SEQ ID NO: 1392900 - protein, 18 aa, Mycobacterium tuberculosis
MVFNLFFVNLVTVGLHSY

SEQ ID NO: 1392901 - protein, 19 aa, Mycobacterium tuberculosis
MVGAALWPSAAAGLAGVLT

SEQ ID NO: 1392902 - protein, 18 aa, Mycobacterium tuberculosis
MVLLNLTRMQFATGVLII

SEQ ID NO: 1392903 - protein, 18 aa, Mycobacterium tuberculosis
MVLVAIAAGWMMLLNVLK

SEQ ID NO: 1392904 - protein, 25 aa, Mycobacterium tuberculosis
MVVHIGVVPLWRYRVHRWEISPQAV

SEQ ID NO: 1392905 - protein, 26 aa, Mycobacterium tuberculosis
MVVVLMSFAVYAVISAALYSDIDNQL

SEQ ID NO: 1392906 - protein, 18 aa, Mycobacterium tuberculosis
MVWVRPRQGPKLADLIAA

SEQ ID NO: 1392907 - protein, 40 aa, Mycobacterium tuberculosis
MWFDPATARRVAVWAFVMVLAFSRHLFVRPVIRMDQTAWC

SEQ ID NO: 1392908 - protein, 20 aa, Mycobacterium tuberculosis
MWLWRLGYSTVGAGARLLKR

SEQ ID NO: 1392909 - protein, 19 aa, Mycobacterium tuberculosis
MWPSLLVILLLVAVVALLF

SEQ ID NO: 1392910 - protein, 23 aa, Mycobacterium tuberculosis
MYCLSFARLPYFETLGAPIAIGM

SEQ ID NO: 1392911 - protein, 18 aa, Mycobacterium tuberculosis
MYTPERVTFFCIGGATMA

SEQ ID NO: 1392912 - protein, 25 aa, Mycobacterium tuberculosis
NAINAPTQTLLGRPLIGNGADGGPG

SEQ ID NO: 1392913 - protein, 25 aa, Mycobacterium tuberculosis
NANPFALLLVALLGPIAATVIRMAV

SEQ ID NO: 1392914 - protein, 19 aa, Mycobacterium tuberculosis
NAVPLRVAVFYIGALLAIL

SEQ ID NO: 1392915 - protein, 17 aa, Mycobacterium tuberculosis
NAYTGFYGWMLQLIWQF

SEQ ID NO: 1392916 - protein, 24 aa, Mycobacterium tuberculosis
NDIIRAVLAAIYLVAVITSSLITR

SEQ ID NO: 1392917 - protein, 19 aa, Mycobacterium tuberculosis
NDNGPPPPFTSWMPPGNPP

SEQ ID NO: 1392918 - protein, 31 aa, Mycobacterium tuberculosis
NDRAPLPKLGPLISALLNPGARNAAPLQQQA

SEQ ID NO: 1392919 - protein, 21 aa, Mycobacterium tuberculosis
NDYLFNFPDTNFAWSFVLALL

SEQ ID NO: 1392920 - protein, 23 aa, Mycobacterium tuberculosis
NDYTVGLLLLVATALVACTYTAL

SEQ ID NO: 1392921 - protein, 28 aa, Mycobacterium tuberculosis
NERPPSTLWIWVALTGAAATVLILGWRS

SEQ ID NO: 1392922 - protein, 30 aa, Mycobacterium tuberculosis
NFNRPYALWVPLVLSVPLGLLLMTARRRPS

SEQ ID NO: 1392923 - protein, 24 aa, Mycobacterium tuberculosis
NFNSAFYLFGLVLLVMAGNLARPT

SEQ ID NO: 1392924 - protein, 29 aa, Mycobacterium tuberculosis
NFVLPDPAPPLILFLTAGSGITPVMSMLR

SEQ ID NO: 1392925 - protein, 26 aa, Mycobacterium tuberculosis
NFYVSPFHQLAGYYLIRAPRPDRELD

SEQ ID NO: 1392926 - protein, 21 aa, Mycobacterium tuberculosis
NGFHGKWPWQMTHPMDDAVQI

SEQ ID NO: 1392927 - protein, 29 aa, Mycobacterium tuberculosis
NGINRILQFITYLLVPAGLLTIYTQLFTT

SEQ ID NO: 1392928 - protein, 24 aa, Mycobacterium tuberculosis
NGKRPKLRRILSDPDARVIVVKHR

SEQ ID NO: 1392929 - protein, 32 aa, Mycobacterium tuberculosis; identical to SEQ ID NO: 1380220

SEQ ID NO: 1392930 - protein, 33 aa, Mycobacterium tuberculosis
NGRYRLLIFHGGVPPLQFWQALDTALDRQVALT

SEQ ID NO: 1392931 - protein, 25 aa, Mycobacterium tuberculosis
NHAILRLLARLAWPPALAGDLGEHH

SEQ ID NO: 1392932 - protein, 24 aa, Mycobacterium tuberculosis
NICGMAVLPACRLGLVVCVATAVI

SEQ ID NO: 1392933 - protein, 33 aa, Mycobacterium tuberculosis
NIGVPLWTDILLPIVMWALYAWSWHSNGDAVPK

SEQ ID NO: 1392934 - protein, 33 aa, Mycobacterium tuberculosis
NIGVPLWTDILLPIVMWALYAWSWHSNGDAVRK

SEQ ID NO: 1392935 - protein, 19 aa, Mycobacterium tuberculosis
NILVATGATLFVLYAVATE

SEQ ID NO: 1392936 - protein, 17 aa, Mycobacterium tuberculosis
NIQLEPPYRGGPVLVDN

SEQ ID NO: 1392937 - protein, 21 aa, Mycobacterium tuberculosis
NIQYDYIFGFSFYTGHYFGAW

SEQ ID NO: 1392938 - protein, 23 aa, Mycobacterium tuberculosis
NLAPAAWWRQLYVAAAAAGAGPR

SEQ ID NO: 1392939 - protein, 27 aa, Mycobacterium tuberculosis
NLDRLTLFVTGIWLVSIIGVAVAHQIP

SEQ ID NO: 1392940 - protein, 17 aa, Mycobacterium tuberculosis
NLGVRMWLFPGLSIVTV

SEQ ID NO: 1392941 - protein, 20 aa, Mycobacterium tuberculosis
NLRYYYLILPTVDGSLSRRF

SEQ ID NO: 1392942 - protein, 25 aa, Mycobacterium tuberculosis
NLVAARFIQLTPVYTGGAVLPDNGR

SEQ ID NO: 1392943 - protein, 30 aa, Mycobacterium tuberculosis
NLVGWPTWGMILSSPFLLPAGLGLGLAAIA

SEQ ID NO: 1392944 - protein, 31 aa, Mycobacterium tuberculosis
NLVGWPTWGMILSSPFLLPAGLGLGLAAIAF

SEQ ID NO: 1392945 - protein, 19 aa, Mycobacterium tuberculosis
NLWLPQLSRASVVIGSLVV

SEQ ID NO: 1392946 - protein, 25 aa, Mycobacterium tuberculosis
NMCDRLLILAPGGRLAYFGPPQQAL

SEQ ID NO: 1392947 - protein, 24 aa, Mycobacterium tuberculosis
NNGFHGKWPWQMTHPMDGAVQIDK

SEQ ID NO: 1392948 - protein, 23 aa, Mycobacterium tuberculosis
NNTTMMVLAYLCAAAAVAAAARV

SEQ ID NO: 1392949 - protein, 28 aa, Mycobacterium tuberculosis
NNVQTVVTPAWYAPLVLSVGGIGQTGMP

SEQ ID NO: 1392950 - protein, 23 aa, Mycobacterium tuberculosis
NPFSLLFTLGGFVTLLLLAQAVA

SEQ ID NO: 1392951 - protein, 29 aa, Mycobacterium tuberculosis
NPSAPRPWALPAQFWLYCGFTAITMLGFG

SEQ ID NO: 1392952 - protein, 17 aa, Mycobacterium tuberculosis
NPVWPLAALGVTVVFGV

SEQ ID NO: 1392953 - protein, 33 aa, Mycobacterium tuberculosis; identical to SEQ ID NO: 21073

SEQ ID NO: 1392954 - protein, 25 aa, Mycobacterium tuberculosis
NQLHRITWIVTMYLLGYIAAMPLLG

SEQ ID NO: 1392955 - protein, 26 aa, Mycobacterium tuberculosis
NQLHRITWIVTMYLLGYIAAMPLLGR

SEQ ID NO: 1392956 - protein, 23 aa, Mycobacterium tuberculosis
NQVLAMLSLVPWGTTGVSLDLMR

SEQ ID NO: 1392957 - protein, 25 aa, Mycobacterium tuberculosis
NRIGTPLFFQRVFGAGIATLVAVAA

SEQ ID NO: 1392958 - protein, 26 aa, Mycobacterium tuberculosis
NRIGTPLFFQRVFGAGIATLVAVAAY

SEQ ID NO: 1392959 - protein, 37 aa, Mycobacterium tuberculosis
NRRAWLYVEGVVLLLVGALVLVLVYKQFRGEFTPKTE

SEQ ID NO: 1392960 - protein, 24 aa, Mycobacterium tuberculosis
NSAGGRLVSGWFPPQQRGLAMGIR

SEQ ID NO: 1392961 - protein, 30 aa, Mycobacterium tuberculosis
NSISIVAVLLWIVAVLIVGSVVYLSALERL

SEQ ID NO: 1392962 - protein, 57 aa, Mycobacterium tuberculosis
NSLYRASLAIGLALLPLLALLAFWRTGRRQLADRPTPPWRPGAWAAAGVLAAGAVIA

SEQ ID NO: 1392963 - protein, 25 aa, Mycobacterium tuberculosis
NSNRGPAFLILFATLMAAAGDGVSI

SEQ ID NO: 1392964 - protein, 24 aa, Mycobacterium tuberculosis
NSRMLKYVVKRFALKRGALMFGKL

SEQ ID NO: 1392965 - protein, 17 aa, Mycobacterium tuberculosis
NSTVPHISLLIGASYGA

SEQ ID NO: 1392966 - protein, 20 aa, Mycobacterium tuberculosis
NSYFREIVTRFDYDDAVLLD

SEQ ID NO: 1392967 - protein, 23 aa, Mycobacterium tuberculosis
NTGWWPLIWFTAKVWGFLFIYFW

SEQ ID NO: 1392968 - protein, 24 aa, Mycobacterium tuberculosis
NTLLAPLRVAVGTLILWAVGAALF

SEQ ID NO: 1392969 - protein, 19 aa, Mycobacterium tuberculosis
NTTVTLLFADLCAIFTPYR

SEQ ID NO: 1392970 - protein, 23 aa, Mycobacterium tuberculosis
NTVLTLVLAFAAAALLWLVVEEL

SEQ ID NO: 1392971 - protein, 28 aa, Mycobacterium tuberculosis
NVDATMLQMLIIFGIVTVIAVVAATTAG

SEQ ID NO: 1392972 - protein, 31 aa, Mycobacterium tuberculosis
NVNAPGVILRLMLAWIPSTGVPLLAIVLAVA

SEQ ID NO: 1392973 - protein, 17 aa, Mycobacterium tuberculosis
NVSFLVFVLALGVVVHA

SEQ ID NO: 1392974 - protein, 17 aa, Mycobacterium tuberculosis
NYYRWFGTPEAPFGWYY

SEQ ID NO: 1392975 - protein, 27 aa, Mycobacterium tuberculosis
PAAIGPLPPVTLLPRRTPGSRGIADVP

SEQ ID NO: 1392976 - protein, 17 aa, Mycobacterium tuberculosis
PAAVWGVLTPRQPWPWL

SEQ ID NO: 1392977 - protein, 19 aa, Mycobacterium tuberculosis
PACFSIFAVFWGALGIATG

SEQ ID NO: 1392978 - protein, 26 aa, Mycobacterium tuberculosis
PADLQSLLVPPAPGPAPAPPAPGAGP

SEQ ID NO: 1392979 - protein, 26 aa, Mycobacterium tuberculosis
PADVAFYYLVFVLPIAALVARDPNGP

SEQ ID NO: 1392980 - protein, 23 aa, Mycobacterium tuberculosis
PAGGVRPLGGLLYFLVFFFFFFF

SEQ ID NO: 1392981 - protein, 22 aa, Mycobacterium tuberculosis
PAGSIAVVAWLIAAAALVVLAV

SEQ ID NO: 1392982 - protein, 26 aa, Mycobacterium tuberculosis
PAGVEELLRINLSFADGLPRLATADI

SEQ ID NO: 1392983 - protein, 17 aa, Mycobacterium tuberculosis
PAILLVLSLLLFTIAMA

SEQ ID NO: 1392984 - protein, 35 aa, Mycobacterium tuberculosis
PAKIPTGTVVSWLPLYHDMGLILGICAPLVARRRA

SEQ ID NO: 1392985 - protein, 21 aa, Mycobacterium tuberculosis
PAKIVLVGIMLIAAGLGTFAF

SEQ ID NO: 1392986 - protein, 45 aa, Mycobacterium tuberculosis
PAKLVLVAIAVLCAVSFFTAIFLRDLRIPAMAAALLVLSAILVGG

SEQ ID NO: 1392987 - protein, 24 aa, Mycobacterium tuberculosis
PALLVIPCLLLAWAVSHPSLPFAV

SEQ ID NO: 1392988 - protein, 17 aa, Mycobacterium tuberculosis
PALPILAAAPTPPLGPA

SEQ ID NO: 1392989 - protein, 22 aa, Mycobacterium tuberculosis
PAPPLQQPLPPPPTTTNTQPGG

SEQ ID NO: 1392990 - protein, 17 aa, Mycobacterium tuberculosis
PARGIVAVCDFGGSGTG

SEQ ID NO: 1392991 - protein, 25 aa, Mycobacterium tuberculosis
PARGRLVTMLLVGVVLLAVGHRGGL

SEQ ID NO: 1392992 - protein, 26 aa, Mycobacterium tuberculosis
PARGRLVTMLLVGVVLLTVGHRGGLA

SEQ ID NO: 1392993 - protein, 21 aa, Mycobacterium tuberculosis
PARWMQLLAKHRAQISSAPNF

SEQ ID NO: 1392994 - protein, 23 aa, Mycobacterium tuberculosis
PARYLFVFLDHHGMLSVFGSPTW

SEQ ID NO: 1392995 - protein, 26 aa, Mycobacterium tuberculosis
PASMRKFFEAFAPYGLKQTAVKPSYG

SEQ ID NO: 1392996 - protein, 17 aa, Mycobacterium tuberculosis
PATAAFPPPAGPPPVTA

SEQ ID NO: 1392997 - protein, 29 aa, Mycobacterium tuberculosis
PATPWTVPKFYWTVLGLSALISGARALVP

SEQ ID NO: 1392998 - protein, 18 aa, Mycobacterium tuberculosis
PAVLPTVVAPPLTSRRLE

SEQ ID NO: 1392999 - protein, 21 aa, Mycobacterium tuberculosis
PCGFAMLPAYLLLVVYGQDSA

SEQ ID NO: 1393000 - protein, 23 aa, Mycobacterium tuberculosis
PDDGFVRVIYRWSRTGDLAAALA

SEQ ID NO: 1393001 - protein, 23 aa, Mycobacterium tuberculosis
PDDWSQLPKRLSCQLRPGPTPPA

SEQ ID NO: 1393002 - protein, 24 aa, Mycobacterium tuberculosis
PDELPATGARLRWAPAQGPSATPA

SEQ ID NO: 1393003 - protein, 29 aa, Mycobacterium tuberculosis
PDGSFWHQWMQTWFTGPQFYFDCVSGGEP

SEQ ID NO: 1393004 - protein, 25 aa, Mycobacterium tuberculosis
PDGVDRWITVPPATWVAAQGPRDTQ

SEQ ID NO: 1393005 - protein, 21 aa, Mycobacterium tuberculosis
PDQLPIWRIGIISGLVGMLCC

SEQ ID NO: 1393006 - protein, 40 aa, Mycobacterium tuberculosis
PDSSGLPLRAMVMVLLFLGVVFLLLVWQALGSSPNSEDDS

SEQ ID NO: 1393007 - protein, 25 aa, Mycobacterium tuberculosis
PDVAFPRLNAFSFWLFVFGATIGAA

SEQ ID NO: 1393008 - protein, 27 aa, Mycobacterium tuberculosis
PDVAFPRLNAFSFWLFVFGATIGAAGF

SEQ ID NO: 1393009 - protein, 22 aa, Mycobacterium tuberculosis
PDVKPPTWWHSLPTDRPIIYAT

SEQ ID NO: 1393010 - protein, 17 aa, Mycobacterium tuberculosis
PDWVIADGPWVKWYPGI

SEQ ID NO: 1393011 - protein, 25 aa, Mycobacterium tuberculosis
PEAIALIVVMVRYLEPFTAVSELAP

SEQ ID NO: 1393012 - protein, 29 aa, Mycobacterium tuberculosis
PEERLNLPPIPLQLPTPRPAPPGSAAAKY

SEQ ID NO: 1393013 - protein, 29 aa, Mycobacterium tuberculosis
PEFATYAPGLWRYWAEHLDPDRARRNDPL

SEQ ID NO: 1393014 - protein, 22 aa, Mycobacterium tuberculosis
PEHLRRRKLLTPPLHGAALDRY

SEQ ID NO: 1393015 - protein, 26 aa, Mycobacterium tuberculosis
PEHYQRYLDILRPLGFRPALGFSRVD

SEQ ID NO: 1393016 - protein, 18 aa, Mycobacterium tuberculosis
PEINSGRMFFGAGSGPML

SEQ ID NO: 1393017 - protein, 26 aa, Mycobacterium tuberculosis
PEPHPPIPTTPWQHTRHWITTKYPAG

SEQ ID NO: 1393018 - protein, 18 aa, Mycobacterium tuberculosis
PEPRPAPPPAKPAPPAGP

SEQ ID NO: 1393019 - protein, 18 aa, Mycobacterium tuberculosis
PEQWFAFTPPRVPVLESL

SEQ ID NO: 1393020 - protein, 22 aa, Mycobacterium tuberculosis
PESLANLLRYGYYPALILGLTV

SEQ ID NO: 1393021 - protein, 21 aa, Mycobacterium tuberculosis
PEVWWVLRVAHWASGVPAATV

SEQ ID NO: 1393022 - protein, 26 aa, Mycobacterium tuberculosis
PFGEYVPLRPLFGWITRYSKAAAKDR

SEQ ID NO: 1393023 - protein, 19 aa, Mycobacterium tuberculosis
PFGYLPFAPSRYLFISINT

SEQ ID NO: 1393024 - protein, 44 aa, Mycobacterium tuberculosis
PFRRRNPRPAIVVVAFLVVVTCVMWTLALTRPPDVREAAVCNPP

SEQ ID NO: 1393025 - protein, 26 aa, Mycobacterium tuberculosis
PGALKKAVMLLGVLAVLVAMVGLAAL

SEQ ID NO: 1393026 - protein, 18 aa, Mycobacterium tuberculosis
PGALLTFVWLDRIGLRGG

SEQ ID NO: 1393027 - protein, 21 aa, Mycobacterium tuberculosis
PGEEKLVFSRFWRSDPSRVRR

SEQ ID NO: 1393028 - protein, 30 aa, Mycobacterium tuberculosis
PGESSFYWLTLALAAVWIAGALMSGPLHLG

SEQ ID NO: 1393029 - protein, 26 aa, Mycobacterium tuberculosis
PGLPRRLRWVSPLVPLVAGPLPVAFF

SEQ ID NO: 1393030 - protein, 20 aa, Mycobacterium tuberculosis
PGMPLPILVAVSGAALSGVC

SEQ ID NO: 1393031 - protein, 29 aa, Mycobacterium tuberculosis
PGPFLSYGIQWISFGILAPIGLGYFAYAE

SEQ ID NO: 1393032 - protein, 25 aa, Mycobacterium tuberculosis
PGRYTYLKWWKFVLVVLGVWIGAGE

SEQ ID NO: 1393033 - protein, 18 aa, Mycobacterium tuberculosis
PGSPLFPAIPGFPALPGL

SEQ ID NO: 1393034 - protein, 21 aa, Mycobacterium tuberculosis
PGSVDFFYLTASAAGIFGIPG

SEQ ID NO: 1393035 - protein, 26 aa, Mycobacterium tuberculosis
PGTPPATLLDYFPEDFLLVIDESHVT

SEQ ID NO: 1393036 - protein, 21 aa, Mycobacterium tuberculosis
PGWRHLKHFNGYATSFWVTPS

SEQ ID NO: 1393037 - protein, 28 aa, Mycobacterium tuberculosis
PHTGQRWLPLILAGFTSGFLLLRGRSYV

SEQ ID NO: 1393038 - protein, 19 aa, Mycobacterium tuberculosis
PHVFLNAIFGLFGAFALIG

SEQ ID NO: 1393039 - protein, 18 aa, Mycobacterium tuberculosis
PIEQAWSRLCDLEQMIPL

SEQ ID NO: 1393040 - protein, 21 aa, Mycobacterium tuberculosis
PIGYLFRPYIIYRSREELVLT

SEQ ID NO: 1393041 - protein, 22 aa, Mycobacterium tuberculosis
PIGYLFRPYIIYRSREELVLTR

SEQ ID NO: 1393042 - protein, 17 aa, Mycobacterium tuberculosis
PINVTFKRLPDGLGPLL

SEQ ID NO: 1393043 - protein, 17 aa, Mycobacterium tuberculosis
PIPPPPPGPDVIPGPVP

SEQ ID NO: 1393044 - protein, 19 aa, Mycobacterium tuberculosis
PIPPWEQAAHLLDYGFNTP

SEQ ID NO: 1393045 - protein, 20 aa, Mycobacterium tuberculosis
PIPWRLRLRRPTIVLGSVVA

SEQ ID NO: 1393046 - protein, 20 aa, Mycobacterium tuberculosis
PIRRWRPARVPLLPLAAATV

SEQ ID NO: 1393047 - protein, 17 aa, Mycobacterium tuberculosis
PITMVLPLITIGMSVVV

SEQ ID NO: 1393048 - protein, 30 aa, Mycobacterium tuberculosis
PIVGVMLSMFLLAFAGIPLTSGFVSKFAVF

SEQ ID NO: 1393049 - protein, 20 aa, Mycobacterium tuberculosis
PKLFRSLSIAFMSSADPIPA

SEQ ID NO: 1393050 - protein, 19 aa, Mycobacterium tuberculosis
PLAGAVLIILLPPGRRRLA

SEQ ID NO: 1393051 - protein, 30 aa, Mycobacterium tuberculosis
PLALPLASLVFFGAFIPLIGAVVAGFLAVV

SEQ ID NO: 1393052 - protein, 30 aa, Mycobacterium tuberculosis; identical to SEQ ID NO: 158337

SEQ ID NO: 1393053 - protein, 17 aa, Mycobacterium tuberculosis
PLAYCLPGVRSRVVVSE

SEQ ID NO: 1393054 - protein, 26 aa, Mycobacterium tuberculosis
PLEAVPAFFRWLAQFEPMHQVFLGVR

SEQ ID NO: 1393055 - protein, 29 aa, Mycobacterium tuberculosis
PLGLCFLPAFLCVGIVPLVVGLAGDVLQF

SEQ ID NO: 1393056 - protein, 20 aa, Mycobacterium tuberculosis
PLIPIFMVLIGLATTNPSAA

SEQ ID NO: 1393057 - protein, 17 aa, Mycobacterium tuberculosis
PLISRAHLLLRFDQGRW

SEQ ID NO: 1393058 - protein, 17 aa, Mycobacterium tuberculosis
PLLLPVVALLNGLGLVM

SEQ ID NO: 1393059 - protein, 27 aa, Mycobacterium tuberculosis
PLMDVTLLRDRWGFQPAWNAEECLEDF

SEQ ID NO: 1393060 - protein, 18 aa, Mycobacterium tuberculosis
PLMLGTAAGVLLIGLVRW

SEQ ID NO: 1393061 - protein, 21 aa, Mycobacterium tuberculosis
PLPTEIYWRRRGLALGIAVVV

SEQ ID NO: 1393062 - protein, 17 aa, Mycobacterium tuberculosis
PLSVGAGLILGRMAYKE

SEQ ID NO: 1393063 - protein, 18 aa, Mycobacterium tuberculosis
PLTGRFWPPIGASFIGCG

SEQ ID NO: 1393064 - protein, 19 aa, Mycobacterium tuberculosis
PLTMVPAPTRRWAARRRGG

SEQ ID NO: 1393065 - protein, 18 aa, Mycobacterium tuberculosis
PLTMVPAPTRRWAARRVG

SEQ ID NO: 1393066 - protein, 27 aa, Mycobacterium tuberculosis
PLTTAFAYLLLPQVLVYGLSSVFMAIL

SEQ ID NO: 1393067 - protein, 30 aa, Mycobacterium tuberculosis
PLVDLKLFAEPLYRSVLIVYFVVMSCFFGT

SEQ ID NO: 1393068 - protein, 22 aa, Mycobacterium tuberculosis
PLVERVPGMRAKLFDAARLAAS

SEQ ID NO: 1393069 - protein, 22 aa, Mycobacterium tuberculosis
PLVFDLGICLVLITLPTLALFV

SEQ ID NO: 1393070 - protein, 24 aa, Mycobacterium tuberculosis
PLWATMLIWLTLWVLYLSIVNVGQ

SEQ ID NO: 1393071 - protein, 19 aa, Mycobacterium tuberculosis
PLWPYLGVCGPDRLKRRQL

SEQ ID NO: 1393072 - protein, 31 aa, Mycobacterium tuberculosis
PLYGSSLVTGWARLHGYPLGILANARGVLFS

SEQ ID NO: 1393073 - protein, 24 aa, Mycobacterium tuberculosis
PMGSILYWMRFGTIRLPPWPDRVP

SEQ ID NO: 1393074 - protein, 19 aa, Mycobacterium tuberculosis
PMLRPTMFFVLVTGIISAA

SEQ ID NO: 1393075 - protein, 29 aa, Mycobacterium tuberculosis
PMLVLLAAGLGVLWLPAGWLAHRLLSVPV

SEQ ID NO: 1393076 - protein, 25 aa, Mycobacterium tuberculosis
PMNAMTPMVLFIKSPRDLRTPGALA

SEQ ID NO: 1393077 - protein, 20 aa, Mycobacterium tuberculosis
PMRVARREALLDLGVVDRRS

SEQ ID NO: 1393078 - protein, 18 aa, Mycobacterium tuberculosis
PMTNLRHFPIALVNEDAG

SEQ ID NO: 1393079 - protein, 29 aa, Mycobacterium tuberculosis
PNSVRSAAALWWIPAWLAMIVEVAVLGPQ

SEQ ID NO: 1393080 - protein, 27 aa, Mycobacterium tuberculosis
PPEPHPPIPTTPWQHTRHWITSKYPAG

SEQ ID NO: 1393081 - protein, 28 aa, Mycobacterium tuberculosis
PPEPHPPIPTTPWQHTRHWITTKYPAGS

SEQ ID NO: 1393082 - protein, 18 aa, Mycobacterium tuberculosis
PPIPWRLRLRRPTIVLGS

SEQ ID NO: 1393083 - protein, 17 aa, Mycobacterium tuberculosis
PPIQAAPTGQPSWAPNS

SEQ ID NO: 1393084 - protein, 19 aa, Mycobacterium tuberculosis
PPPFTSWMPPGNPPEPPQV

SEQ ID NO: 1393085 - protein, 20 aa, Mycobacterium tuberculosis
PPQMGYLPSSIWIVVGAVLA

SEQ ID NO: 1393086 - protein, 21 aa, Mycobacterium tuberculosis
PPRLPCGLPRPAACAVAWVPR

SEQ ID NO: 1393087 - protein, 23 aa, Mycobacterium tuberculosis
PPRSPPCHLPMTTTRSACESVRG

SEQ ID NO: 1393088 - protein, 18 aa, Mycobacterium tuberculosis
PPRVLWRGPTATAPQTPP

SEQ ID NO: 1393089 - protein, 38 aa, Mycobacterium tuberculosis
PPSWSPRNWPVRWKVFTIALLPLVVAMVLAGLRVEAAM

SEQ ID NO: 1393090 - protein, 24 aa, Mycobacterium tuberculosis
PPTLAPIGGILSHVPFKAGEVTLL

SEQ ID NO: 1393091 - protein, 17 aa, Mycobacterium tuberculosis
PPVAARWRVAGSAALFV

SEQ ID NO: 1393092 - protein, 32 aa, Mycobacterium tuberculosis
PPVFFARRPLQIALTLMWLAGIASLVYALLAA

SEQ ID NO: 1393093 - protein, 22 aa, Mycobacterium tuberculosis
PPVRPFLMQFGEGQWKSRPETV

SEQ ID NO: 1393094 - protein, 27 aa, Mycobacterium tuberculosis
PQAVDAWLRLCQTYGWAPGVMGASSQG

SEQ ID NO: 1393095 - protein, 21 aa, Mycobacterium tuberculosis
PQDAIRWAALVALVAIGAGLI

SEQ ID NO: 1393096 - protein, 19 aa, Mycobacterium tuberculosis
PQLRRAYLEEAVQRALVSI

SEQ ID NO: 1393097 - protein, 24 aa, Mycobacterium tuberculosis
PQRAPQIYRPPTAAPPPAGARGGT

SEQ ID NO: 1393098 - protein, 28 aa, Mycobacterium tuberculosis
PQRQRRGRLIRRVLITVAASLRSEDMAG

SEQ ID NO: 1393099 - protein, 26 aa, Mycobacterium tuberculosis
PQRRAQLDGWRYGWVLNIGAAITGGV

SEQ ID NO: 1393100 - protein, 25 aa, Mycobacterium tuberculosis
PRDRDTWMVIDDKAWFFALTDQVSI

SEQ ID NO: 1393101 - protein, 27 aa, Mycobacterium tuberculosis
PRLGPPPVMPPSLAWWASSLQLSGLTA

SEQ ID NO: 1393102 - protein, 20 aa, Mycobacterium tuberculosis
PRMGGLAMFLGIVGAVFLAS

SEQ ID NO: 1393103 - protein, 23 aa, Mycobacterium tuberculosis
PRPRAKTNPWPLVAGAAAVVLVL

SEQ ID NO: 1393104 - protein, 18 aa, Mycobacterium tuberculosis
PRPTVVTGLRLAASRSML

SEQ ID NO: 1393105 - protein, 24 aa, Mycobacterium tuberculosis
PRQPWAWLALLVAGLTVGLFITQG

SEQ ID NO: 1393106 - protein, 20 aa, Mycobacterium tuberculosis
PRRRGSGRPGFYRPPGRPEV

SEQ ID NO: 1393107 - protein, 21 aa, Mycobacterium tuberculosis
PRRWRFWRRGRRPLETKVVLD

SEQ ID NO: 1393108 - protein, 29 aa, Mycobacterium tuberculosis
PRTLANKVPFVVLVIGSLGVGLGLTLWLS

SEQ ID NO: 1393109 - protein, 28 aa, Mycobacterium tuberculosis
PSAELFVAAYVPYVAWLVQASSDSAAAA

SEQ ID NO: 1393110 - protein, 28 aa, Mycobacterium tuberculosis
PSAPRPWALPAQFWLYCGFTAITMLGFG

SEQ ID NO: 1393111 - protein, 38 aa, Mycobacterium tuberculosis
PSDRRALHTAFAGAAICLLALMATLATASRRLRPRRNG

SEQ ID NO: 1393112 - protein, 27 aa, Mycobacterium tuberculosis
PSGALVGFRKLTRAITARFGKRWDRTI

SEQ ID NO: 1393113 - protein, 28 aa, Mycobacterium tuberculosis
PSIAALLGKWFWWPQVVRQRPVPQPWPS

SEQ ID NO: 1393114 - protein, 22 aa, Mycobacterium tuberculosis
PSQSWVLVFAITMMAGLLVSLL

SEQ ID NO: 1393115 - protein, 19 aa, Mycobacterium tuberculosis
PSTAIRPLPGRPTSIPTPS

SEQ ID NO: 1393116 - protein, 24 aa, Mycobacterium tuberculosis
PSTWRPNRPSSPLRWPRTGPTRRS

SEQ ID NO: 1393117 - protein, 24 aa, Mycobacterium tuberculosis
PSVDVAILAVPHLPPPLVFAAEPA

SEQ ID NO: 1393118 - protein, 21 aa, Mycobacterium tuberculosis
PSVVRAWFDYDRPAAGRFWCA

SEQ ID NO: 1393119 - protein, 20 aa, Mycobacterium tuberculosis
PSWVLYPCALAMMVFSKSFS

SEQ ID NO: 1393120 - protein, 25 aa, Mycobacterium tuberculosis
PTAMTTVWLTRRTCSTPRWPQPATC

SEQ ID NO: 1393121 - protein, 17 aa, Mycobacterium tuberculosis
PTAWALCGVFPLAAVPL

SEQ ID NO: 1393122 - protein, 19 aa, Mycobacterium tuberculosis
PTEQLYLAGAPLVAFSGLP

SEQ ID NO: 1393123 - protein, 25 aa, Mycobacterium tuberculosis
PTGAVGLLTLFFEIFSASPLLLALI

SEQ ID NO: 1393124 - protein, 20 aa, Mycobacterium tuberculosis
PTGLLAYRYRLRVLAAATVA

SEQ ID NO: 1393125 - protein, 24 aa, Mycobacterium tuberculosis
PTHKPLFVGLVIGVVLIVGGLTLF

SEQ ID NO: 1393126 - protein, 22 aa, Mycobacterium tuberculosis
PTIAWYQDFLRYYFLTVESNVE

SEQ ID NO: 1393127 - protein, 25 aa, Mycobacterium tuberculosis
PTKNAFWMWPTMAWGSPVTLWRAAW

SEQ ID NO: 1393128 - protein, 20 aa, Mycobacterium tuberculosis
PTKRTLLECFAARRLSRPAD

SEQ ID NO: 1393129 - protein, 23 aa, Mycobacterium tuberculosis
PTLNGWFFGVVYWLFDLSGVSHR

SEQ ID NO: 1393130 - protein, 27 aa, Mycobacterium tuberculosis
PTLRLRVRWETRGLRWLQSSSRRPPRR

SEQ ID NO: 1393131 - protein, 19 aa, Mycobacterium tuberculosis
PTMPTVTPPPIQAAPTGQP

SEQ ID NO: 1393132 - protein, 25 aa, Mycobacterium tuberculosis
PTQATFLRWVWYAARREGLHLDEAD

SEQ ID NO: 1393133 - protein, 18 aa, Mycobacterium tuberculosis
PTQTLLGRPLIGNGADGL

SEQ ID NO: 1393134 - protein, 25 aa, Mycobacterium tuberculosis
PTRWRSCLPVPLLSRATVRRSSAIR

SEQ ID NO: 1393135 - protein, 26 aa, Mycobacterium tuberculosis
PTRWRSCLPVPLLSRATVRRSSAIRN

SEQ ID NO: 1393136 - protein, 18 aa, Mycobacterium tuberculosis
PTSSVRPRLIVWPPSRWG

SEQ ID NO: 1393137 - protein, 29 aa, Mycobacterium tuberculosis
PTVAPTTLAILMLLPLSAFEATVALPAAA

SEQ ID NO: 1393138 - protein, 26 aa, Mycobacterium tuberculosis
PTVLVLTLIFRFAIAAVSYALVESPC

SEQ ID NO: 1393139 - protein, 29 aa, Mycobacterium tuberculosis
PVAAGVRLPRAAPLPTAPVHRPRPACPSS

SEQ ID NO: 1393140 - protein, 20 aa, Mycobacterium tuberculosis
PVAAQQFQFALPAGVASEEG

SEQ ID NO: 1393141 - protein, 18 aa, Mycobacterium tuberculosis
PVAVLFILGLSAIGVYGI

SEQ ID NO: 1393142 - protein, 17 aa, Mycobacterium tuberculosis
PVFRERMKREARIAGRL

SEQ ID NO: 1393143 - protein, 28 aa, Mycobacterium tuberculosis
PVGEEWLYQSWAAAYLPLLQVLAALADE

SEQ ID NO: 1393144 - protein, 24 aa, Mycobacterium tuberculosis
PVHKPVKQLFWYRSSKFVMRRWLP

SEQ ID NO: 1393145 - protein, 18 aa, Mycobacterium tuberculosis
PVICAHQGLTWAAGLLYP

SEQ ID NO: 1393146 - protein, 20 aa, Mycobacterium tuberculosis
PVIRLPLVLGLAQLLSRVPL

SEQ ID NO: 1393147 - protein, 20 aa, Mycobacterium tuberculosis
PVLLDAIYDPWPTPLAAAVG

SEQ ID NO: 1393148 - protein, 23 aa, Mycobacterium tuberculosis
PVQLRHTVLVPGPPPGSAIAGWD

SEQ ID NO: 1393149 - protein, 19 aa, Mycobacterium tuberculosis
PVRCWLWAWRSVPGGAPGD

SEQ ID NO: 1393150 - protein, 29 aa, Mycobacterium tuberculosis
PVRQRFFALFLYVVMLVFLVATAPVMVVV

SEQ ID NO: 1393151 - protein, 24 aa, Mycobacterium tuberculosis
PVTTGPVWVLAGFGAQHRKMGKSL

SEQ ID NO: 1393152 - protein, 32 aa, Mycobacterium tuberculosis
PVVLAKLWSVIPRLFVWPPARSIAQVLERLSV

SEQ ID NO: 1393153 - protein, 20 aa, Mycobacterium tuberculosis
PVVVGRRKLVDEQHLVLPDH

SEQ ID NO: 1393154 - protein, 19 aa, Mycobacterium tuberculosis
PVVVRRRKLVDEQHLVLPD

SEQ ID NO: 1393155 - protein, 17 aa, Mycobacterium tuberculosis
PVWGSPRTRSSRWPNDM

SEQ ID NO: 1393156 - protein, 23 aa, Mycobacterium tuberculosis
PYAVYLLYLTKIAVYVAAGAAII

SEQ ID NO: 1393157 - protein, 27 aa, Mycobacterium tuberculosis
PYIGQRPWTPLIGLLAQAGDLGLRVIV

SEQ ID NO: 1393158 - protein, 19 aa, Mycobacterium tuberculosis
PYLRTMFVVLLSTLTLASF

SEQ ID NO: 1393159 - protein, 23 aa, Mycobacterium tuberculosis
QAGAVAWVSLSSLLPAGAEEVSA

SEQ ID NO: 1393160 - protein, 25 aa, Mycobacterium tuberculosis
QAMTATWINLVGLILLMMLQPIGGM

SEQ ID NO: 1393161 - protein, 25 aa, Mycobacterium tuberculosis
QAQNQAYGYLFPHGTFFVIGHLLGV

SEQ ID NO: 1393162 - protein, 17 aa, Mycobacterium tuberculosis
QARRLLAWVGADENVRP

SEQ ID NO: 1393163 - protein, 20 aa, Mycobacterium tuberculosis
QDFFGGKVFFSPATGANAVE

SEQ ID NO: 1393164 - protein, 25 aa, Mycobacterium tuberculosis
QEDEFVWCMQGLPSPYLTIAFPNRP

SEQ ID NO: 1393165 - protein, 24 aa, Mycobacterium tuberculosis
QEDGPKLFRSLSIAFMSSADPIPA

SEQ ID NO: 1393166 - protein, 21 aa, Mycobacterium tuberculosis
QEPFLGRWLLLTAVAFGISAA

SEQ ID NO: 1393167 - protein, 20 aa, Mycobacterium tuberculosis
QERWVPTLVTLEKIAAWAIT

SEQ ID NO: 1393168 - protein, 17 aa, Mycobacterium tuberculosis
QFSLWLVPLAVLALPHR

SEQ ID NO: 1393169 - protein, 19 aa, Mycobacterium tuberculosis
QFYLAFLLLVAGCAYLLRR

SEQ ID NO: 1393170 - protein, 23 aa, Mycobacterium tuberculosis
QGAVPGSPWWQHPVGSVTALATP

SEQ ID NO: 1393171 - protein, 17 aa, Mycobacterium tuberculosis
QGPGYHRFIFWAYGRNG

SEQ ID NO: 1393172 - protein, 22 aa, Mycobacterium tuberculosis
QGRLFTPFFITVGLVEAAYFIN

SEQ ID NO: 1393173 - protein, 18 aa, Mycobacterium tuberculosis
QGWALRPPGAAPSSAGCT

SEQ ID NO: 1393174 - protein, 25 aa, Mycobacterium tuberculosis
QHPSTSVLIPDRPTWEAVAPAPAGG

SEQ ID NO: 1393175 - protein, 18 aa, Mycobacterium tuberculosis
QHQLSRLTNQAWPVNMTG

SEQ ID NO: 1393176 - protein, 25 aa, Mycobacterium tuberculosis
QIELPPGYLPLRVPIEVNFTQRVAV

SEQ ID NO: 1393177 - protein, 20 aa, Mycobacterium tuberculosis
QIMPLLVVAVMSQLVFSGGM

SEQ ID NO: 1393178 - protein, 27 aa, Mycobacterium tuberculosis
QIPNQRWFSWLALLTMPAPFLANSAGW

SEQ ID NO: 1393179 - protein, 20 aa, Mycobacterium tuberculosis
QITDLPVAVLFILGLSAIGV

SEQ ID NO: 1393180 - protein, 26 aa, Mycobacterium tuberculosis
QKLVFKVLVMVLWLAPIGAFGAIANI

SEQ ID NO: 1393181 - protein, 18 aa, Mycobacterium tuberculosis
QLEPPYRGGPVLVDNAVI

SEQ ID NO: 1393182 - protein, 17 aa, Mycobacterium tuberculosis
QLFTTHVGWRESVLRMV

SEQ ID NO: 1393183 - protein, 23 aa, Mycobacterium tuberculosis
QLHRITWIVTMYLLGYIAAMPLL

SEQ ID NO: 1393184 - protein, 40 aa, Mycobacterium tuberculosis
QLILFAIVSVVAIVVLGWYYLRIPSLVGIGQYTLKADLPA

SEQ ID NO: 1393185 - protein, 26 aa, Mycobacterium tuberculosis
QLIPATNIALLVFAAGIPAVAAVAIL

SEQ ID NO: 1393186 - protein, 22 aa, Mycobacterium tuberculosis
QLLGCTPLDPFGWAQATAAATA

SEQ ID NO: 1393187 - protein, 17 aa, Mycobacterium tuberculosis
QLRRAYLEETVQRALVS

SEQ ID NO: 1393188 - protein, 22 aa, Mycobacterium tuberculosis
QLTRSRIAAARLLDLTGSNRVR

SEQ ID NO: 1393189 - protein, 25 aa, Mycobacterium tuberculosis
QLVDVDFWLRLMLRSAVCFVPHELS

SEQ ID NO: 1393190 - protein, 24 aa, Mycobacterium tuberculosis
QLVKLAHIKLAWRTGNFVIYAITI

SEQ ID NO: 1393191 - protein, 18 aa, Mycobacterium tuberculosis
QMIPLMPGAQLIGHEGDE

SEQ ID NO: 1393192 - protein, 31 aa, Mycobacterium tuberculosis
QMLTYTSVVLAFLPFMVALVAGADLGLTKLV

SEQ ID NO: 1393193 - protein, 23 aa, Mycobacterium tuberculosis
QNLGVRMWLFPGLSIVTVTGIVA

SEQ ID NO: 1393194 - protein, 28 aa, Mycobacterium tuberculosis
QPAWRNLRFPLAWAPPEPTWRALSPMTR

SEQ ID NO: 1393195 - protein, 31 aa, Mycobacterium tuberculosis
QPGAVARILAWRPLVWLGTISYGVYLWHWPI

SEQ ID NO: 1393196 - protein, 22 aa, Mycobacterium tuberculosis
QPGGYLLGGFGPAPEGMAMWII

SEQ ID NO: 1393197 - protein, 21 aa, Mycobacterium tuberculosis
QPLGAIVFAGLFAWLYQRTRV

SEQ ID NO: 1393198 - protein, 21 aa, Mycobacterium tuberculosis
QPLGAIVFAGLLAWLYQRTRV

SEQ ID NO: 1393199 - protein, 31 aa, Mycobacterium tuberculosis; identical to SEQ ID NO: 163438

SEQ ID NO: 1393200 - protein, 19 aa, Mycobacterium tuberculosis
QPVSWKRTSAIWGPIQGVP

SEQ ID NO: 1393201 - protein, 25 aa, Mycobacterium tuberculosis
QPWTPITIIVVITGVKILGSLLAPH

SEQ ID NO: 1393202 - protein, 26 aa, Mycobacterium tuberculosis
QPWTPITIIVVITGVKILGSLLAPHI

SEQ ID NO: 1393203 - protein, 24 aa, Mycobacterium tuberculosis
QQALGYFNCTDFADLFTLLEHDTS

SEQ ID NO: 1393204 - protein, 18 aa, Mycobacterium tuberculosis
QQQMVTRMAIMSDPAVAL

SEQ ID NO: 1393205 - protein, 25 aa, Mycobacterium tuberculosis
QQRERLRFFWITAVTTDGSIVVANS

SEQ ID NO: 1393206 - protein, 27 aa, Mycobacterium tuberculosis
QQTYSQQFDWRYPPSPPPQPTQYRQPY

SEQ ID NO: 1393207 - protein, 32 aa, Mycobacterium tuberculosis
QRERRFAVAFVIPAAVLFVAGAVLAYLVLSKA

SEQ ID NO: 1393208 - protein, 25 aa, Mycobacterium tuberculosis
QRLPDRPLFHFTADGSGLAMSVNGL

SEQ ID NO: 1393209 - protein, 20 aa, Mycobacterium tuberculosis
QRLTIARAILGDTPVLILDE

SEQ ID NO: 1393210 - protein, 23 aa, Mycobacterium tuberculosis
QRPARWIQMLASNTLAFTAAPNF

SEQ ID NO: 1393211 - protein, 20 aa, Mycobacterium tuberculosis
QRPKFRMPLSPFSGYLTLAF

SEQ ID NO: 1393212 - protein, 21 aa, Mycobacterium tuberculosis
QRPQLRNLLHEKPELIPAGVE

SEQ ID NO: 1393213 - protein, 25 aa, Mycobacterium tuberculosis
QRRAQLDGWRYGWVLNIGAAITGGS

SEQ ID NO: 1393214 - protein, 18 aa, Mycobacterium tuberculosis
QRVSIARALLKAAPVLLV

SEQ ID NO: 1393215 - protein, 28 aa, Mycobacterium tuberculosis
QSGHLAEYLLVTTYLLIATAAALAVPLP

SEQ ID NO: 1393216 - protein, 23 aa, Mycobacterium tuberculosis
QSKGYFLLGIWMSLLWAVVFTLS

SEQ ID NO: 1393217 - protein, 17 aa, Mycobacterium tuberculosis
QTAAVIGTAQYLSPEQA

SEQ ID NO: 1393218 - protein, 38 aa, Mycobacterium tuberculosis
QTLRTIYQNLGWAFGYNTAAIPLAALGALNPVVAGAAM

SEQ ID NO: 1393219 - protein, 24 aa, Mycobacterium tuberculosis
QTSLEPRHLVLPMFVADGIDEPRP

SEQ ID NO: 1393220 - protein, 24 aa, Mycobacterium tuberculosis
QTVVTPAWYAPLVLSVGGIGQTGM

SEQ ID NO: 1393221 - protein, 28 aa, Mycobacterium tuberculosis
QVQFYLSPAMLILLALMTIDAIILGRKV

SEQ ID NO: 1393222 - protein, 25 aa, Mycobacterium tuberculosis
QVTGWRFVMRRIAAGIALHDTRMLV

SEQ ID NO: 1393223 - protein, 17 aa, Mycobacterium tuberculosis
QVWLITATPYELAATIA

SEQ ID NO: 1393224 - protein, 26 aa, Mycobacterium tuberculosis
QWGWRSIFYVNLPMGALVLFLTLCYV

SEQ ID NO: 1393225 - protein, 19 aa, Mycobacterium tuberculosis
QWLLALLQQLWNAYTGFYG

SEQ ID NO: 1393226 - protein, 21 aa, Mycobacterium tuberculosis
QWWHPLVVVGLIALVAIMIAA

SEQ ID NO: 1393227 - protein, 24 aa, Mycobacterium tuberculosis
QWWHPLVVVGLIALVAIMIAAATP

SEQ ID NO: 1393228 - protein, 17 aa, Mycobacterium tuberculosis
QYALRRETASPTANCVG

SEQ ID NO: 1393229 - protein, 18 aa, Mycobacterium tuberculosis
QYALRRETASPTANCVGS

SEQ ID NO: 1393230 - protein, 21 aa, Mycobacterium tuberculosis
QYLWWVPHNVAGLVTALGGRT

SEQ ID NO: 1393231 - protein, 21 aa, Mycobacterium tuberculosis
QYPSALRITIVERVPVVVKDF

SEQ ID NO: 1393232 - protein, 20 aa, Mycobacterium tuberculosis
RACRNFIRKSADPAKPIAGQ

SEQ ID NO: 1393233 - protein, 27 aa, Mycobacterium tuberculosis
RADVRVAHPLISRAHLLLRFDQGRWVA

SEQ ID NO: 1393234 - protein, 17 aa, Mycobacterium tuberculosis
RAGELLEWAYATVGSSQ

SEQ ID NO: 1393235 - protein, 24 aa, Mycobacterium tuberculosis
RAGGVAVIVTFFCLIDCCRPGPPT

SEQ ID NO: 1393236 - protein, 25 aa, Mycobacterium tuberculosis
RAGHQVRWTILLDGAVRISVGCQSG

SEQ ID NO: 1393237 - protein, 34 aa, Mycobacterium tuberculosis
RAGPAIRWLGGIGAVIPLLALVLVLVVLVIEAMG

SEQ ID NO: 1393238 - protein, 17 aa, Mycobacterium tuberculosis
RAGVLRFVVLDGLAKPG

SEQ ID NO: 1393239 - protein, 21 aa, Mycobacterium tuberculosis
RAHGLPAISLGWGLWDQASAM

SEQ ID NO: 1393240 - protein, 21 aa, Mycobacterium tuberculosis
RAHLLLRFDQGRWVAIDNGSL

SEQ ID NO: 1393241 - protein, 17 aa, Mycobacterium tuberculosis
RAIMLPAGALVYIAVPP

SEQ ID NO: 1393242 - protein, 20 aa, Mycobacterium tuberculosis
RAITARFGKRWDRTISTLHR

SEQ ID NO: 1393243 - protein, 17 aa, Mycobacterium tuberculosis
RALAPLRRVAQTASEVV

SEQ ID NO: 1393244 - protein, 17 aa, Mycobacterium tuberculosis
RALDVVPTLWRGALVVL

SEQ ID NO: 1393245 - protein, 18 aa, Mycobacterium tuberculosis
RALDVVPTLWRGALVVLQ

SEQ ID NO: 1393246 - protein, 23 aa, Mycobacterium tuberculosis
RALGIQRLLAARSQRGRKIPDLL

SEQ ID NO: 1393247 - protein, 27 aa, Mycobacterium tuberculosis
RALGTPALAAPAPHGALAGSGKLGVRD

SEQ ID NO: 1393248 - protein, 18 aa, Mycobacterium tuberculosis
RALTTAPVPIVAGFMAAV

SEQ ID NO: 1393249 - protein, 27 aa, Mycobacterium tuberculosis
RANRADAWLTSLLAAFAASATIGAIGT

SEQ ID NO: 1393250 - protein, 33 aa, Mycobacterium tuberculosis
RANVFTRINAILGVLLLIVLATGSLINGMFGLL

SEQ ID NO: 1393251 - protein, 23 aa, Mycobacterium tuberculosis
RANWLPTFVLLILLAAVTAVYAL

SEQ ID NO: 1393252 - protein, 20 aa, Mycobacterium tuberculosis
RAPRYDLLISGGAAISLILI

SEQ ID NO: 1393253 - protein, 27 aa, Mycobacterium tuberculosis
RAQAASRLLAPLKLPLVLSGVLAALVT

SEQ ID NO: 1393254 - protein, 29 aa, Mycobacterium tuberculosis
RAQAASRLLAPLKLPLVLSGVLAALVTLA

SEQ ID NO: 1393255 - protein, 30 aa, Mycobacterium tuberculosis
RAQAASRLLAPLKLPLVLSGVLAALVTLAQ

SEQ ID NO: 1393256 - protein, 21 aa, Mycobacterium tuberculosis
RAQLTPRWNPPTRRRIRRGSQ

SEQ ID NO: 1393257 - protein, 26 aa, Mycobacterium tuberculosis
RASAAILAILPLLGVLLGQLIGARPL

SEQ ID NO: 1393258 - protein, 23 aa, Mycobacterium tuberculosis
RASWPWALVVFLVVVFVAPLCEE

SEQ ID NO: 1393259 - protein, 17 aa, Mycobacterium tuberculosis
RATLFVIALGFLVQITG

SEQ ID NO: 1393260 - protein, 19 aa, Mycobacterium tuberculosis
RATLFVIALGFLVQITGIN

SEQ ID NO: 1393261 - protein, 18 aa, Mycobacterium tuberculosis
RATLYLTYWTAGDTRNRG

SEQ ID NO: 1393262 - protein, 24 aa, Mycobacterium tuberculosis
RATTVIWLAPLLLSVPVFSRDTYS

SEQ ID NO: 1393263 - protein, 23 aa, Mycobacterium tuberculosis
RCATYPVLAVQAWAAFHDMTLRA

SEQ ID NO: 1393264 - protein, 23 aa, Mycobacterium tuberculosis
RCGGRTVTLFRSEWRRPVELSTS

SEQ ID NO: 1393265 - protein, 26 aa, Mycobacterium tuberculosis
RCSKHHLWIFAGIAAAILAGGAVAFS

SEQ ID NO: 1393266 - protein, 30 aa, Mycobacterium tuberculosis
RDDALAALLGQWRDDLRWPPASALVSQDEA

SEQ ID NO: 1393267 - protein, 26 aa, Mycobacterium tuberculosis
RDIVLLVCVLLFTIIWWNVNHGRANW

SEQ ID NO: 1393268 - protein, 18 aa, Mycobacterium tuberculosis
RDPELHRRWLQDTSITPP

SEQ ID NO: 1393269 - protein, 29 aa, Mycobacterium tuberculosis
RDRAGELLFWLPYPSFATYLHVGCAQIRR

SEQ ID NO: 1393270 - protein, 23 aa, Mycobacterium tuberculosis
RDRLPLPNRLLATAPLVALGAMA

SEQ ID NO: 1393271 - protein, 23 aa, Mycobacterium tuberculosis
RDVRWGVAGPLRRLRRDSDPAGA

SEQ ID NO: 1393272 - protein, 19 aa, Mycobacterium tuberculosis
REALLDLGVVDRRSGYPLE

SEQ ID NO: 1393273 - protein, 32 aa, Mycobacterium tuberculosis
REDDTEWLHVPFLPVPIPVPIPQNPGAGEPQN

SEQ ID NO: 1393274 - protein, 18 aa, Mycobacterium tuberculosis
REHISLRPLWGIDQRLKR

SEQ ID NO: 1393275 - protein, 35 aa, Mycobacterium tuberculosis; identical to SEQ ID NO: 236824

SEQ ID NO: 1393276 - protein, 24 aa, Mycobacterium tuberculosis
RFALKRGALMFGKLVPMGIGAIIG

SEQ ID NO: 1393277 - protein, 19 aa, Mycobacterium tuberculosis
RFGLRQMVDIALRALSPAL

SEQ ID NO: 1393278 - protein, 17 aa, Mycobacterium tuberculosis
RFLPVWIGSAMAAGLLL

SEQ ID NO: 1393279 - protein, 18 aa, Mycobacterium tuberculosis
RFNASPLREALIGHPAMR

SEQ ID NO: 1393280 - protein, 19 aa, Mycobacterium tuberculosis
RFTERFAPFNLSETAIRPS

SEQ ID NO: 1393281 - protein, 18 aa, Mycobacterium tuberculosis
RFVLRRLGPGPGGLASNR

SEQ ID NO: 1393282 - protein, 20 aa, Mycobacterium tuberculosis
RGAPLAELAPLLSAGATAAI

SEQ ID NO: 1393283 - protein, 30 aa, Mycobacterium tuberculosis
RGELDRTLLLWMLPLLIAPPMYSKDVYSYL

SEQ ID NO: 1393284 - protein, 18 aa, Mycobacterium tuberculosis
RGFRCCWSAALARPAIGC

SEQ ID NO: 1393285 - protein, 26 aa, Mycobacterium tuberculosis
RGGRRPGWVLLTALLVLAIGASSALV

SEQ ID NO: 1393286 - protein, 17 aa, Mycobacterium tuberculosis
RGHFFVHSLVVAGLITT

SEQ ID NO: 1393287 - protein, 26 aa, Mycobacterium tuberculosis
RGPRRSMALKYLLDTSVIKRLSRPAV

SEQ ID NO: 1393288 - protein, 21 aa, Mycobacterium tuberculosis
RGRLVDVIGCSLRLPGIYPPQ

SEQ ID NO: 1393289 - protein, 21 aa, Mycobacterium tuberculosis
RGRPRFSAWYGPCARRAASAA

SEQ ID NO: 1393290 - protein, 23 aa, Mycobacterium tuberculosis
RGTPTRLLLLRHGQTELSEQRRY

SEQ ID NO: 1393291 - protein, 20 aa, Mycobacterium tuberculosis
RGWAMAAICFIAVAVAAAVL

SEQ ID NO: 1393292 - protein, 17 aa, Mycobacterium tuberculosis
RGWLRRFAERAEAVRSV

SEQ ID NO: 1393293 - protein, 18 aa, Mycobacterium tuberculosis
RGWLRRFAERAEAVRSVF

SEQ ID NO: 1393294 - protein, 21 aa, Mycobacterium tuberculosis
RHALIGRTRLMTPLRVMFAIA

SEQ ID NO: 1393295 - protein, 23 aa, Mycobacterium tuberculosis
RHEGRYFVAGQPTDLVREGDAEA

SEQ ID NO: 1393296 - protein, 17 aa, Mycobacterium tuberculosis
RHFGARRKAYNWTVATL

SEQ ID NO: 1393297 - protein, 25 aa, Mycobacterium tuberculosis
RHGWALAAICFVAVGIGALSLGRIR

SEQ ID NO: 1393298 - protein, 17 aa, Mycobacterium tuberculosis
RHGYRFIVGIGALIWAA

SEQ ID NO: 1393299 - protein, 34 aa, Mycobacterium tuberculosis
RHGYRFIVGIGALIWAASLLWYLKVVGSQPDFLG

SEQ ID NO: 1393300 - protein, 23 aa, Mycobacterium tuberculosis
RHHEALLFFAFSGVGVLLSMAPL

SEQ ID NO: 1393301 - protein, 19 aa, Mycobacterium tuberculosis
RHRGPTPPVLLIDEIDRAD

SEQ ID NO: 1393302 - protein, 18 aa, Mycobacterium tuberculosis
RHRILAWIAAGAMASVVA

SEQ ID NO: 1393303 - protein, 19 aa, Mycobacterium tuberculosis
RHRILAWIAAGAMASVVAL

SEQ ID NO: 1393304 - protein, 20 aa, Mycobacterium tuberculosis
RHRTILSSLGLPVSYDPDAL

SEQ ID NO: 1393305 - protein, 21 aa, Mycobacterium tuberculosis
RHTGKVVMLMPGSWAAGTVLI

SEQ ID NO: 1393306 - protein, 17 aa, Mycobacterium tuberculosis
RIACFYVGSTVLLALLL

SEQ ID NO: 1393307 - protein, 30 aa, Mycobacterium tuberculosis
RIADFDDFWRPLRSFTYWERHCFDIPICWS

SEQ ID NO: 1393308 - protein, 29 aa, Mycobacterium tuberculosis
RIESLLPAILEGRQLWQRVQAAVSVLLGG

SEQ ID NO: 1393309 - protein, 19 aa, Mycobacterium tuberculosis
RIFAALAKRLPKLATGPFP

SEQ ID NO: 1393310 - protein, 18 aa, Mycobacterium tuberculosis
RIGLGKRTFSLPWRLANI

SEQ ID NO: 1393311 - protein, 20 aa, Mycobacterium tuberculosis
RILRLIIAQSGFYSAALQLG

SEQ ID NO: 1393312 - protein, 19 aa, Mycobacterium tuberculosis
RILTWLIVDPLSPNSVRSA

SEQ ID NO: 1393313 - protein, 18 aa, Mycobacterium tuberculosis
RIPLFPTAEPPALEPRRQ

SEQ ID NO: 1393314 - protein, 17 aa, Mycobacterium tuberculosis
RIRIQGIRLWLRRVPVV

SEQ ID NO: 1393315 - protein, 18 aa, Mycobacterium tuberculosis
RIVIFFVGSVFLLTVILP

SEQ ID NO: 1393316 - protein, 17 aa, Mycobacterium tuberculosis
RKAILDYLQGAVWVLPT

SEQ ID NO: 1393317 - protein, 31 aa, Mycobacterium tuberculosis
RKILTPPARPVARRLFAVRAVVGLSLPGTVA

SEQ ID NO: 1393318 - protein, 17 aa, Mycobacterium tuberculosis
RKLVDEQHLVLPDHLAA

SEQ ID NO: 1393319 - protein, 18 aa, Mycobacterium tuberculosis
RKRRLVITIISTGLIFGM

SEQ ID NO: 1393320 - protein, 39 aa, Mycobacterium tuberculosis
RKTAAWAWRFLVILAAMVALLWVLNKFEVIVVPVLLVLM

SEQ ID NO: 1393321 - protein, 19 aa, Mycobacterium tuberculosis
RLDSLFRLDHLAARLRRNS

SEQ ID NO: 1393322 - protein, 25 aa, Mycobacterium tuberculosis
RLGIRLVIVLVRRWPKVISRAMVMR

SEQ ID NO: 1393323 - protein, 17 aa, Mycobacterium tuberculosis
RLGLTGRLPSAVLTLDQ

SEQ ID NO: 1393324 - protein, 33 aa, Mycobacterium tuberculosis
RLGRLIVRRPWVVIAFWVALAGLLAPTVPSLDA

SEQ ID NO: 1393325 - protein, 25 aa, Mycobacterium tuberculosis
RLGVFLAVCLLTAFLLIAVFGEVRF

SEQ ID NO: 1393326 - protein, 41 aa, Mycobacterium tuberculosis
RLIIAMTVCIVLLILIVLLRAIVAPLYLIGSVIVSYLAALG

SEQ ID NO: 1393327 - protein, 34 aa, Mycobacterium tuberculosis
RLKTRLTPATRWGPILQWILVGAAAAVVLVAMRQ

SEQ ID NO: 1393328 - protein, 22 aa, Mycobacterium tuberculosis
RLLTCWLPVFAGWQVMHWLTRH

SEQ ID NO: 1393329 - protein, 17 aa, Mycobacterium tuberculosis
RLMVALSAFDLIESTAS

SEQ ID NO: 1393330 - protein, 18 aa, Mycobacterium tuberculosis
RLPDGLGPLLPLEADGKP

SEQ ID NO: 1393331 - protein, 19 aa, Mycobacterium tuberculosis
RLPDGLGPLLPLEADGKPI

SEQ ID NO: 1393332 - protein, 18 aa, Mycobacterium tuberculosis
RLPGIYPPQVYNGRLHVD

SEQ ID NO: 1393333 - protein, 17 aa, Mycobacterium tuberculosis
RLRDLFGRYVGEDVARR

SEQ ID NO: 1393334 - protein, 24 aa, Mycobacterium tuberculosis
RLRSGSPILFYPAGALAITVLAFM

SEQ ID NO: 1393335 - protein, 18 aa, Mycobacterium tuberculosis
RLRWSWRGLRLGLMFGFG

SEQ ID NO: 1393336 - protein, 17 aa, Mycobacterium tuberculosis
RLSFEVFVVFVVARVEV

SEQ ID NO: 1393337 - protein, 17 aa, Mycobacterium tuberculosis
RLTAWATERDLGVGQVM

SEQ ID NO: 1393338 - protein, 18 aa, Mycobacterium tuberculosis
RLTRSVIGWVGAVAVVVS

SEQ ID NO: 1393339 - protein, 18 aa, Mycobacterium tuberculosis
RLVDVIGCSLRLPGIYPS

SEQ ID NO: 1393340 - protein, 27 aa, Mycobacterium tuberculosis
RLVGASRWYTQLPFLVEAMLAATMGVG

SEQ ID NO: 1393341 - protein, 18 aa, Mycobacterium tuberculosis
RLVVRFAEPLPPSPSGSF

SEQ ID NO: 1393342 - protein, 19 aa, Mycobacterium tuberculosis
RLWTMLIFMLWHAIFVEHS

SEQ ID NO: 1393343 - protein, 21 aa, Mycobacterium tuberculosis
RLYGVLTPAFLCAMVLAVCAN

SEQ ID NO: 1393344 - protein, 17 aa, Mycobacterium tuberculosis
RLYIRPVLNSMPAQPAA

SEQ ID NO: 1393345 - protein, 20 aa, Mycobacterium tuberculosis
RMAVLLAGLSPRLPPALNPD

SEQ ID NO: 1393346 - protein, 19 aa, Mycobacterium tuberculosis
RMESKPLRRGHKMIIGMRG

SEQ ID NO: 1393347 - protein, 20 aa, Mycobacterium tuberculosis
RMPDLRGALLLAVTLGLVTL

SEQ ID NO: 1393348 - protein, 18 aa, Mycobacterium tuberculosis
RMRAISIPRWPTSSWRCA

SEQ ID NO: 1393349 - protein, 19 aa, Mycobacterium tuberculosis
RNLLGLFMPSALTLLFVMF

SEQ ID NO: 1393350 - protein, 30 aa, Mycobacterium tuberculosis
RNVKAIRTVRFWMAPIATTLALMSALAALY

SEQ ID NO: 1393351 - protein, 17 aa, Mycobacterium tuberculosis
RPFFVPDEPQRDPVAPL

SEQ ID NO: 1393352 - protein, 24 aa, Mycobacterium tuberculosis
RPGLIPGVIPTMTPPPGMVRQRPR

SEQ ID NO: 1393353 - protein, 27 aa, Mycobacterium tuberculosis
RPHVFLNAIFGLFGAFALIGAAIVLFL

SEQ ID NO: 1393354 - protein, 31 aa, Mycobacterium tuberculosis; identical to SEQ ID NO: 1377195

SEQ ID NO: 1393355 - protein, 17 aa, Mycobacterium tuberculosis
RPQLRNLLHEKPELIPA

SEQ ID NO: 1393356 - protein, 26 aa, Mycobacterium tuberculosis
RPSTWRPNRPSSPLRWPRTGPTRRSL

SEQ ID NO: 1393357 - protein, 18 aa, Mycobacterium tuberculosis
RPVLLRAMTFMIVASPCA

SEQ ID NO: 1393358 - protein, 18 aa, Mycobacterium tuberculosis
RPVLWAIAILTMTVGTVT

SEQ ID NO: 1393359 - protein, 23 aa, Mycobacterium tuberculosis
RPVPLWQHVLVGKRMFDLFDYRI

SEQ ID NO: 1393360 - protein, 23 aa, Mycobacterium tuberculosis
RQADYLPILPTGLAIMGMGMGCS

SEQ ID NO: 1393361 - protein, 22 aa, Mycobacterium tuberculosis
RQFQVFLDDVRLPADALVGAED

SEQ ID NO: 1393362 - protein, 21 aa, Mycobacterium tuberculosis
RQIAMMQIISPLAPMVVAARI

SEQ ID NO: 1393363 - protein, 23 aa, Mycobacterium tuberculosis
RQINRLFGVRGLLLGSALLNAAA

SEQ ID NO: 1393364 - protein, 29 aa, Mycobacterium tuberculosis
RQLSPYMLMMPLMMSVMMVGGLAGSTGGG

SEQ ID NO: 1393365 - protein, 19 aa, Mycobacterium tuberculosis
RQMYFFYAATMAPFLVMGI

SEQ ID NO: 1393366 - protein, 17 aa, Mycobacterium tuberculosis
RQPIPPWEQAAHLLDYG

SEQ ID NO: 1393367 - protein, 29 aa, Mycobacterium tuberculosis
RQQGCHTMSLDWVAWRGLGLAADAQLVSE

SEQ ID NO: 1393368 - protein, 18 aa, Mycobacterium tuberculosis
RQQLKPAPRLPMFVLVVV

SEQ ID NO: 1393369 - protein, 36 aa, Mycobacterium tuberculosis
RQRRLPNWLTLPGAGVILLFAGLAGRGVPALAGAAA

SEQ ID NO: 1393370 - protein, 17 aa, Mycobacterium tuberculosis
RQWVKNVLVLAAPLAAL

SEQ ID NO: 1393371 - protein, 19 aa, Mycobacterium tuberculosis
RRAARGWVRSRFTFARIGL

SEQ ID NO: 1393372 - protein, 27 aa, Mycobacterium tuberculosis
RRDLFSGFGWLAVVLLAVAAACAPPGA

SEQ ID NO: 1393373 - protein, 27 aa, Mycobacterium tuberculosis
RREHISLRPLWGIDQRLKRFGAMATAM

SEQ ID NO: 1393374 - protein, 17 aa, Mycobacterium tuberculosis
RRFAASMVGTTLTAATL

SEQ ID NO: 1393375 - protein, 25 aa, Mycobacterium tuberculosis
RRGLRRPWLYFVSSLFTSFAFAFAF

SEQ ID NO: 1393376 - protein, 17 aa, Mycobacterium tuberculosis
RRHSPLVIATALGSAGV

SEQ ID NO: 1393377 - protein, 21 aa, Mycobacterium tuberculosis
RRIARLLPFVGLAGLAVTTHV

SEQ ID NO: 1393378 - protein, 17 aa, Mycobacterium tuberculosis
RRLLPLLFVLYVINFVD

SEQ ID NO: 1393379 - protein, 20 aa, Mycobacterium tuberculosis
RRLLSLILLARDHVVHGWVL

SEQ ID NO: 1393380 - protein, 28 aa, Mycobacterium tuberculosis
RRLRQRPFQYILLVLGIALGVAMIVAID

SEQ ID NO: 1393381 - protein, 18 aa, Mycobacterium tuberculosis
RRMPATTVFFGVAALGAC

SEQ ID NO: 1393382 - protein, 25 aa, Mycobacterium tuberculosis
RRNLTLYVTALLFVLAWATSGINGW

SEQ ID NO: 1393383 - protein, 17 aa, Mycobacterium tuberculosis
RRRIPLFPTAEPPALEP

SEQ ID NO: 1393384 - protein, 20 aa, Mycobacterium tuberculosis
RRRRRAVAPRGRRPGGAGDA

SEQ ID NO: 1393385 - protein, 21 aa, Mycobacterium tuberculosis
RRSSMFTRRFAASMVGTTLTA

SEQ ID NO: 1393386 - protein, 25 aa, Mycobacterium tuberculosis
RRSVSVWFRSIWMLAPRGDLMAQAT

SEQ ID NO: 1393387 - protein, 24 aa, Mycobacterium tuberculosis
RRTFLAPWRVAVGHLMFWGVGTAL

SEQ ID NO: 1393388 - protein, 21 aa, Mycobacterium tuberculosis
RRTQRLRALIAPALVVGGIGA

SEQ ID NO: 1393389 - protein, 24 aa, Mycobacterium tuberculosis
RRVGTAIVRWPGPVLAATCLVASI

SEQ ID NO: 1393390 - protein, 20 aa, Mycobacterium tuberculosis
RRWTRALLVPTLAGVALIAA

SEQ ID NO: 1393391 - protein, 23 aa, Mycobacterium tuberculosis
RRYGFDLVGYYPLILTAFLLLTS

SEQ ID NO: 1393392 - protein, 21 aa, Mycobacterium tuberculosis
RSARPILLHRSIAGSPGLAKL

SEQ ID NO: 1393393 - protein, 21 aa, Mycobacterium tuberculosis
RSFDVYPPWETLGSTTVICAD

SEQ ID NO: 1393394 - protein, 25 aa, Mycobacterium tuberculosis
RSGYPLELLVRAAAAGWRVVELDVS

SEQ ID NO: 1393395 - protein, 26 aa, Mycobacterium tuberculosis
RSIYMIFSVFFFFFFFFFFFFFFFFF

SEQ ID NO: 1393396 - protein, 20 aa, Mycobacterium tuberculosis
RSKVGPLRRTRLTEILRGGR

SEQ ID NO: 1393397 - protein, 23 aa, Mycobacterium tuberculosis
RSLSAALIMLLTVGLELLAVRGI

SEQ ID NO: 1393398 - protein, 25 aa, Mycobacterium tuberculosis
RSPRLTNLLVVAAWVAAAVIANLLL

SEQ ID NO: 1393399 - protein, 30 aa, Mycobacterium tuberculosis
RSQLITMTYTLRYRWWVVLTGVAIAAFTVH

SEQ ID NO: 1393400 - protein, 23 aa, Mycobacterium tuberculosis
RSRDLHDALRRRCLYHWIDYPEP

SEQ ID NO: 1393401 - protein, 36 aa, Mycobacterium tuberculosis
RSRIEFAITILLLVILLIIYGNPITMVLPLITIGMS

SEQ ID NO: 1393402 - protein, 25 aa, Mycobacterium tuberculosis
RSRRPRPPRICWCGSLPWEPPTERV

SEQ ID NO: 1393403 - protein, 28 aa, Mycobacterium tuberculosis
RSSALPAYWERLAVWWQLGSDHGLAIAS

SEQ ID NO: 1393404 - protein, 42 aa, Mycobacterium tuberculosis
RSSKFVMRRWLPVGTAVVALLVLLGLPFLSVKWGFPDDRVLP

SEQ ID NO: 1393405 - protein, 38 aa, Mycobacterium tuberculosis
RSVAVWLLLGGVFGLALLLIFLFWPWEFKAADGESDFI

SEQ ID NO: 1393406 - protein, 27 aa, Mycobacterium tuberculosis
RSVGVPLYLLLGWVAVWYTATILHNAG

SEQ ID NO: 1393407 - protein, 32 aa, Mycobacterium tuberculosis; identical to SEQ ID NO: 164911

SEQ ID NO: 1393408 - protein, 23 aa, Mycobacterium tuberculosis
RTANWWWALLGLAVSALTYVGAA

SEQ ID NO: 1393409 - protein, 34 aa, Mycobacterium tuberculosis
RTAQRIVLTRNPRWWGARPRLDSITYLVLDDAAR

SEQ ID NO: 1393410 - protein, 24 aa, Mycobacterium tuberculosis
RTEQPTFYIDFPTSVSPLTRPHRS

SEQ ID NO: 1393411 - protein, 19 aa, Mycobacterium tuberculosis
RTFLSGVLVFTIASGLCAV

SEQ ID NO: 1393412 - protein, 20 aa, Mycobacterium tuberculosis
RTHWLYLAVIFAVIAGVIVG

SEQ ID NO: 1393413 - protein, 28 aa, Mycobacterium tuberculosis
RTIHALSLPIILFWVALTIVVNVVAPQL

SEQ ID NO: 1393414 - protein, 18 aa, Mycobacterium tuberculosis
RTLPRWQRIVALTMIGIS

SEQ ID NO: 1393415 - protein, 19 aa, Mycobacterium tuberculosis
RTLVGPMRVLRDGALKVAH

SEQ ID NO: 1393416 - protein, 20 aa, Mycobacterium tuberculosis
RTLVGPMRVLRDGALKVAHT

SEQ ID NO: 1393417 - protein, 32 aa, Mycobacterium tuberculosis
RTRLMTPLRVMFAIALVFLALGWSTKAACLQS

SEQ ID NO: 1393418 - protein, 25 aa, Mycobacterium tuberculosis
RTRQHPLFRARWAKCPSNTTPTSSN

SEQ ID NO: 1393419 - protein, 24 aa, Mycobacterium tuberculosis
RTSLKTSWYLLGPAFVAAIAYVDP

SEQ ID NO: 1393420 - protein, 24 aa, Mycobacterium tuberculosis
RVAALPLWALLLTVAAMSFGGPGD

SEQ ID NO: 1393421 - protein, 36 aa, Mycobacterium tuberculosis
RVDDVWHPVLNLATARFFFFFFFSTRTGCPKSELGH

SEQ ID NO: 1393422 - protein, 28 aa, Mycobacterium tuberculosis
RVFAEARWLPVALLSIGLAGFCLHATLL

SEQ ID NO: 1393423 - protein, 22 aa, Mycobacterium tuberculosis
RVFAWLALVFGVGFSMLALLTR

SEQ ID NO: 1393424 - protein, 21 aa, Mycobacterium tuberculosis
RVGGWLLVVGLTLACAGLLWP

SEQ ID NO: 1393425 - protein, 29 aa, Mycobacterium tuberculosis
RVGQINWKWIRRSLYLTAAVVILLPMVTF

SEQ ID NO: 1393426 - protein, 18 aa, Mycobacterium tuberculosis
RVLADWDFNIRCFSNPAL

SEQ ID NO: 1393427 - protein, 24 aa, Mycobacterium tuberculosis
RVLTKPRFRGWIHVYSAGTAVLAG

SEQ ID NO: 1393428 - protein, 19 aa, Mycobacterium tuberculosis
RVRRRPACAPAWRSRRDAC

SEQ ID NO: 1393429 - protein, 19 aa, Mycobacterium tuberculosis
RVSISCRVREGFVMRLAIV

SEQ ID NO: 1393430 - protein, 32 aa, Mycobacterium tuberculosis
RWCRIVTAIVRWPLPILAMACAIAVVGLLALP

SEQ ID NO: 1393431 - protein, 22 aa, Mycobacterium tuberculosis
RWFPGFMTFRFLECGLLTMVSN

SEQ ID NO: 1393432 - protein, 21 aa, Mycobacterium tuberculosis
RWQRIVALTMIGISTALIGGC

SEQ ID NO: 1393433 - protein, 22 aa, Mycobacterium tuberculosis
RWQSSWLRYAPLSFSGLVMIGA

SEQ ID NO: 1393434 - protein, 18 aa, Mycobacterium tuberculosis
RWVAMNDLTLASAGALTA

SEQ ID NO: 1393435 - protein, 19 aa, Mycobacterium tuberculosis
RYRRSVLGPFWITIATGTT

SEQ ID NO: 1393436 - protein, 18 aa, Mycobacterium tuberculosis
SAAAVRWPQRQRRGRLIR

SEQ ID NO: 1393437 - protein, 34 aa, Mycobacterium tuberculosis
SAACKAWLLAQPYLVAGVLLVFYTATGRYVAAFG

SEQ ID NO: 1393438 - protein, 27 aa, Mycobacterium tuberculosis
SAFFTPQFVRWFGLFTTHAIVAAALAS

SEQ ID NO: 1393439 - protein, 27 aa, Mycobacterium tuberculosis
SAFLDANFMLLPRWLLGSGDEGASAIV

SEQ ID NO: 1393440 - protein, 25 aa, Mycobacterium tuberculosis
SAGQRRRLLLARAVLSPARIVLLDE

SEQ ID NO: 1393441 - protein, 26 aa, Mycobacterium tuberculosis
SALAGALLMPWYIGSAPFPISALISG

SEQ ID NO: 1393442 - protein, 34 aa, Mycobacterium tuberculosis
SALAPPCIIAFLETRYWWAGIALASLGVIVAMVT

SEQ ID NO: 1393443 - protein, 21 aa, Mycobacterium tuberculosis
SALFPAAVGVLWQSGLRDPTP

SEQ ID NO: 1393444 - protein, 19 aa, Mycobacterium tuberculosis
SALIHLLNLPPAGLLPIAA

SEQ ID NO: 1393445 - protein, 29 aa, Mycobacterium tuberculosis
SALLCPLLVYGWLGLPRWGLTGSAVANLV

SEQ ID NO: 1393446 - protein, 25 aa, Mycobacterium tuberculosis
SALWNQATWWQSIAVWFVAAVVAHD

SEQ ID NO: 1393447 - protein, 22 aa, Mycobacterium tuberculosis
SAMATLRIAFLSALVLELLATL

SEQ ID NO: 1393448 - protein, 24 aa, Mycobacterium tuberculosis
SAMLRRNLLIYGLGGLVVPFIGIK

SEQ ID NO: 1393449 - protein, 47 aa, Mycobacterium tuberculosis
SAMPPPGKKFTWHWWWLGAAALGVLLVVMVALVVFGLRRRRRGYDAA

SEQ ID NO: 1393450 - protein, 18 aa, Mycobacterium tuberculosis
SAPPPPMIVNSPGALGIP

SEQ ID NO: 1393451 - protein, 22 aa, Mycobacterium tuberculosis
SARCRSLWRIAGKALAFMGQTV

SEQ ID NO: 1393452 - protein, 29 aa, Mycobacterium tuberculosis
SASAMLRRNLLIYGLGGLVVPFIGIKLAD

SEQ ID NO: 1393453 - protein, 28 aa, Mycobacterium tuberculosis
SASAMLRRNLLIYGLGGLVVPFIGIKLV

SEQ ID NO: 1393454 - protein, 23 aa, Mycobacterium tuberculosis
SAVLFLTSSLYSTATFLASWRDN

SEQ ID NO: 1393455 - protein, 19 aa, Mycobacterium tuberculosis
SAWGLYRFNQILAGLSAVI

SEQ ID NO: 1393456 - protein, 20 aa, Mycobacterium tuberculosis
SAWRFVTVFGVVSLLADVVY

SEQ ID NO: 1393457 - protein, 20 aa, Mycobacterium tuberculosis
SAYFAGGLSLRDATRAICSR

SEQ ID NO: 1393458 - protein, 24 aa, Mycobacterium tuberculosis
SCIFVAWFVLYLVLVLRAVGARGN

SEQ ID NO: 1393459 - protein, 25 aa, Mycobacterium tuberculosis
SCIFVAWFVLYLVLVLRAVGTGGNS

SEQ ID NO: 1393460 - protein, 26 aa, Mycobacterium tuberculosis
SDDELFFFAVLLLVAGYESTAHMIST

SEQ ID NO: 1393461 - protein, 21 aa, Mycobacterium tuberculosis
SDFPFVPWPPALSVGMWLLAV

SEQ ID NO: 1393462 - protein, 37 aa, Mycobacterium tuberculosis
SDGLTAWIAAPLLFIGALFGLLLLAGITIREVPDAMR

SEQ ID NO: 1393463 - protein, 18 aa, Mycobacterium tuberculosis
SDLDLSMFALCSSIAATV

SEQ ID NO: 1393464 - protein, 23 aa, Mycobacterium tuberculosis
SDLDQWDWVKWLPHFGDSRRHDA

SEQ ID NO: 1393465 - protein, 22 aa, Mycobacterium tuberculosis
SDNSYWLVGVQLLDGIGAGIFG

SEQ ID NO: 1393466 - protein, 37 aa, Mycobacterium tuberculosis
SDRRALHTAFAGAAICLLALMATLATASRRLRPRRNG

SEQ ID NO: 1393467 - protein, 29 aa, Mycobacterium tuberculosis
SDSAVEALFRRRALFRPMHDRLASAVVAE

SEQ ID NO: 1393468 - protein, 24 aa, Mycobacterium tuberculosis
SDSLTTRYMPSGMTRWSPDSGETI

SEQ ID NO: 1393469 - protein, 23 aa, Mycobacterium tuberculosis
SDVKSMYLIVDPAKDPTTPAALS

SEQ ID NO: 1393470 - protein, 19 aa, Mycobacterium tuberculosis
SEHFGFGDQFPLEPVAPDA

SEQ ID NO: 1393471 - protein, 22 aa, Mycobacterium tuberculosis
SEPDFLRVWLPGQLLQGIGVGA

SEQ ID NO: 1393472 - protein, 24 aa, Mycobacterium tuberculosis
SEPFGLAWRLNRGSLLLWTVGLCL

SEQ ID NO: 1393473 - protein, 25 aa, Mycobacterium tuberculosis
SEPFGLAWRLNRGSLLLWTVGLCLY

SEQ ID NO: 1393474 - protein, 17 aa, Mycobacterium tuberculosis
SERVLRPVAVAALRSGV

SEQ ID NO: 1393475 - protein, 26 aa, Mycobacterium tuberculosis
SETLPMMLAPWVLLPTILALRGTSGR

SEQ ID NO: 1393476 - protein, 23 aa, Mycobacterium tuberculosis
SETPVPELTWVPAGGGAPVGNPA

SEQ ID NO: 1393477 - protein, 44 aa, Mycobacterium tuberculosis
SEVLGQRRLLKWSIPGLAHFFTMWGFFILLTVYIEDYGLLFEER

SEQ ID NO: 1393478 - protein, 30 aa, Mycobacterium tuberculosis
SFAAAYVSGLAALLRQRFPDLTPAQIIHRI

SEQ ID NO: 1393479 - protein, 22 aa, Mycobacterium tuberculosis
SFALVRHGFWRVLGIRLLTVLV

SEQ ID NO: 1393480 - protein, 29 aa, Mycobacterium tuberculosis
SFAVGLIVLLGLPPFAMFASELAIARSLA

SEQ ID NO: 1393481 - protein, 18 aa, Mycobacterium tuberculosis
SFAVGYLGISLWVVPDVA

SEQ ID NO: 1393482 - protein, 18 aa, Mycobacterium tuberculosis
SFDGYEYLFWVGCAGAYD

SEQ ID NO: 1393483 - protein, 39 aa, Mycobacterium tuberculosis
SFGLSVLIWQHILGIELHWLVLAMAVIILLAVGADYNLL

SEQ ID NO: 1393484 - protein, 19 aa, Mycobacterium tuberculosis
SFKVFALVAALEQGIGLGY

SEQ ID NO: 1393485 - protein, 20 aa, Mycobacterium tuberculosis
SFLYAIVFGGFVAFSNYLPT

SEQ ID NO: 1393486 - protein, 34 aa, Mycobacterium tuberculosis
SFMTPSIAALMGRWFWWPLRVRSRPARTPTVPSE

SEQ ID NO: 1393487 - protein, 17 aa, Mycobacterium tuberculosis
SFPLAFEPSFLPFTKGT

SEQ ID NO: 1393488 - protein, 19 aa, Mycobacterium tuberculosis
SFWASLFPAVWSFCLALRS

SEQ ID NO: 1393489 - protein, 24 aa, Mycobacterium tuberculosis
SGAVILFVYLLIALSQIVLLRQTS

SEQ ID NO: 1393490 - protein, 17 aa, Mycobacterium tuberculosis
SGAWRRSPPLTARRSSR

SEQ ID NO: 1393491 - protein, 32 aa, Mycobacterium tuberculosis
SGGGQRVVVLVALLVCLIPTTIGALLSAIGIA

SEQ ID NO: 1393492 - protein, 19 aa, Mycobacterium tuberculosis
SGHTTFLELAPNPVALMQV

SEQ ID NO: 1393493 - protein, 21 aa, Mycobacterium tuberculosis
SGHTTFLELAPNPVALMQVAL

SEQ ID NO: 1393494 - protein, 19 aa, Mycobacterium tuberculosis
SGLAALLRQRFPDLTPAQI

SEQ ID NO: 1393495 - protein, 27 aa, Mycobacterium tuberculosis
SGLDSRAYRLPWPTRTVVYEIDQPKVM

SEQ ID NO: 1393496 - protein, 17 aa, Mycobacterium tuberculosis
SGPAWRLIGTTAVGLLL

SEQ ID NO: 1393497 - protein, 37 aa, Mycobacterium tuberculosis
SGPHPIIPRTIRLAAIPILLCWLGFTVFVSVAVPPLE

SEQ ID NO: 1393498 - protein, 23 aa, Mycobacterium tuberculosis
SGRPNSVWVGALIALSTICSTVW

SEQ ID NO: 1393499 - protein, 43 aa, Mycobacterium tuberculosis
SGTLSWCSPLGWSLQVRPYAGERWWVLLLSLATRGRAYRAGLS

SEQ ID NO: 1393500 - protein, 31 aa, Mycobacterium tuberculosis
SHNGGAWLVLLMIFNVIWTYVLVRGSAVNNG

SEQ ID NO: 1393501 - protein, 32 aa, Mycobacterium tuberculosis
SHNGGAWLVLLMIFNVIWTYVLVRGSAVNNGT

SEQ ID NO: 1393502 - protein, 27 aa, Mycobacterium tuberculosis
SHRRVVLIIYLWVGIGAFGAASSIFFN

SEQ ID NO: 1393503 - protein, 28 aa, Mycobacterium tuberculosis
SIAALLGRWFWWPLRVRSRPARTPTVPS

SEQ ID NO: 1393504 - protein, 37 aa, Mycobacterium tuberculosis; identical to SEQ ID NO: 164525

SEQ ID NO: 1393505 - protein, 27 aa, Mycobacterium tuberculosis
SIAVRIPPRFWWPQRVRPRPASRMLRP

SEQ ID NO: 1393506 - protein, 21 aa, Mycobacterium tuberculosis
SIDRLAMRRLQRRSPPRPDMD

SEQ ID NO: 1393507 - protein, 25 aa, Mycobacterium tuberculosis
SIGWTLIHYLPPTPGFRFIDHTVIG

SEQ ID NO: 1393508 - protein, 25 aa, Mycobacterium tuberculosis
SKAGLVPLHAWLLRAHPEAPSPVSA

SEQ ID NO: 1393509 - protein, 24 aa, Mycobacterium tuberculosis
SKLGHHSFLSRLYTGTGAFEVVGR

SEQ ID NO: 1393510 - protein, 17 aa, Mycobacterium tuberculosis
SLAIWMAGVTREINLLA

SEQ ID NO: 1393511 - protein, 26 aa, Mycobacterium tuberculosis
SLATRLTMITLIPTVAFMTVGGPAIG

SEQ ID NO: 1393512 - protein, 28 aa, Mycobacterium tuberculosis
SLAWAAAIGLMVPIGLAPPAMAAPCSGD

SEQ ID NO: 1393513 - protein, 20 aa, Mycobacterium tuberculosis
SLFILMRYREELRCGRRPPD

SEQ ID NO: 1393514 - protein, 18 aa, Mycobacterium tuberculosis
SLGFLISLWAGSSAISAF

SEQ ID NO: 1393515 - protein, 25 aa, Mycobacterium tuberculosis
SLGGVWLTSFLLVATNTAIASVLVC

SEQ ID NO: 1393516 - protein, 18 aa, Mycobacterium tuberculosis
SLGLFGSFLLLPSYLQQV

SEQ ID NO: 1393517 - protein, 18 aa, Mycobacterium tuberculosis
SLLALILGVSRTTLAMAR

SEQ ID NO: 1393518 - protein, 21 aa, Mycobacterium tuberculosis
SLLGLAVGWLVGALVVLVVGT

SEQ ID NO: 1393519 - protein, 22 aa, Mycobacterium tuberculosis
SLLGLAVGWLVGALVVLVVGTP

SEQ ID NO: 1393520 - protein, 19 aa, Mycobacterium tuberculosis
SLLIVALTVWYYKLNVNPP

SEQ ID NO: 1393521 - protein, 17 aa, Mycobacterium tuberculosis
SLLPTLAVSIPLTVLII

SEQ ID NO: 1393522 - protein, 19 aa, Mycobacterium tuberculosis
SLLVGYGCLPWVATAMLTM

SEQ ID NO: 1393523 - protein, 17 aa, Mycobacterium tuberculosis
SLPLRRLLGLVAAGLDV

SEQ ID NO: 1393524 - protein, 22 aa, Mycobacterium tuberculosis
SLRAELRRWLATRASKLREVTN

SEQ ID NO: 1393525 - protein, 18 aa, Mycobacterium tuberculosis
SLRPLAEFEQTAAAIGAG

SEQ ID NO: 1393526 - protein, 23 aa, Mycobacterium tuberculosis
SLRPRYLCMLAEILRFHRAAARL

SEQ ID NO: 1393527 - protein, 20 aa, Mycobacterium tuberculosis
SLRVVYLFLAGYPDRRVELE

SEQ ID NO: 1393528 - protein, 20 aa, Mycobacterium tuberculosis
SLTHILTFLAAETGGCSGSR

SEQ ID NO: 1393529 - protein, 18 aa, Mycobacterium tuberculosis
SLVGFNRAPAGPSGGPVA

SEQ ID NO: 1393530 - protein, 20 aa, Mycobacterium tuberculosis
SLVSGWDLHCGAPWCGIVVM

SEQ ID NO: 1393531 - protein, 27 aa, Mycobacterium tuberculosis
SLVSPRLPAPWRIPLQAGLGSVLVLVT

SEQ ID NO: 1393532 - protein, 18 aa, Mycobacterium tuberculosis
SLVVFLVALPLSLGIAIA

SEQ ID NO: 1393533 - protein, 25 aa, Mycobacterium tuberculosis
SMLGDLPWWVTVLILTRELGVTVLR

SEQ ID NO: 1393534 - protein, 29 aa, Mycobacterium tuberculosis
SMLIVVLFVPAALPWYYSWPLAVAAPLAQ

SEQ ID NO: 1393535 - protein, 23 aa, Mycobacterium tuberculosis
SMLKGWYMSFWPIISIAVITVTS

SEQ ID NO: 1393536 - protein, 23 aa, Mycobacterium tuberculosis
SMLVLLGIVVALYERERSGVGQV

SEQ ID NO: 1393537 - protein, 19 aa, Mycobacterium tuberculosis
SMRIWSIMAHVLAGALIVG

SEQ ID NO: 1393538 - protein, 21 aa, Mycobacterium tuberculosis
SMTLPILIPFVYFSHALNKVW

SEQ ID NO: 1393539 - protein, 26 aa, Mycobacterium tuberculosis
SMVIAAMLLVIYRSVITAVLVLIMVG

SEQ ID NO: 1393540 - protein, 23 aa, Mycobacterium tuberculosis
SNAPLTYAWLVVLVITTIIQNNL

SEQ ID NO: 1393541 - protein, 32 aa, Mycobacterium tuberculosis
SNFGVPWSNSFPKWRWSITTALLELTVLVLLL

SEQ ID NO: 1393542 - protein, 31 aa, Mycobacterium tuberculosis
SNYFRTGNLTALREIALLWLADQVDAALEKY

SEQ ID NO: 1393543 - protein, 26 aa, Mycobacterium tuberculosis
SPFLLVVAVMFVPMLDLLLAIVRRTR

SEQ ID NO: 1393544 - protein, 17 aa, Mycobacterium tuberculosis
SPGPYELARLAWEIERV

SEQ ID NO: 1393545 - protein, 19 aa, Mycobacterium tuberculosis
SPGTRWPQPTPWAGGAPPW

SEQ ID NO: 1393546 - protein, 20 aa, Mycobacterium tuberculosis
SPKVADLRRAVVLSRVVQAG

SEQ ID NO: 1393547 - protein, 17 aa, Mycobacterium tuberculosis
SPLGWSLQVRPYAGERW

SEQ ID NO: 1393548 - protein, 18 aa, Mycobacterium tuberculosis
SPLILQRAGQLRHLLMAA

SEQ ID NO: 1393549 - protein, 17 aa, Mycobacterium tuberculosis
SPLLMTYLLVDVSGARL

SEQ ID NO: 1393550 - protein, 18 aa, Mycobacterium tuberculosis
SPMFHALGYMHAALAMFL

SEQ ID NO: 1393551 - protein, 24 aa, Mycobacterium tuberculosis
SPVLVCLGVFFFFFYVLWFFFFFS

SEQ ID NO: 1393552 - protein, 34 aa, Mycobacterium tuberculosis
SPVTKNIPALKYLSYRLFMKRYDARWLVTRMTTI

SEQ ID NO: 1393553 - protein, 21 aa, Mycobacterium tuberculosis
SPVTLWRAAWVRDTSVWLRIG

SEQ ID NO: 1393554 - protein, 22 aa, Mycobacterium tuberculosis
SQFSVRLLRTFLRDVPNQVVLA

SEQ ID NO: 1393555 - protein, 25 aa, Mycobacterium tuberculosis
SQSMLLPAFVALFGIVAALFLVDFT

SEQ ID NO: 1393556 - protein, 24 aa, Mycobacterium tuberculosis
SQTIVPMPWVIQAPRLFAGQIDFG

SEQ ID NO: 1393557 - protein, 19 aa, Mycobacterium tuberculosis
SQTMLNLPAAWQFSRGEGQ

SEQ ID NO: 1393558 - protein, 19 aa, Mycobacterium tuberculosis
SQVPPQRWQPFEGGPPEVA

SEQ ID NO: 1393559 - protein, 21 aa, Mycobacterium tuberculosis
SRAGLFFVPLAVAAAVCAFLF

SEQ ID NO: 1393560 - protein, 22 aa, Mycobacterium tuberculosis
SRALVLVTVGIIVVICVASMLI

SEQ ID NO: 1393561 - protein, 19 aa, Mycobacterium tuberculosis
SRAQLLIASGSLAADPGKA

SEQ ID NO: 1393562 - protein, 24 aa, Mycobacterium tuberculosis
SRAVAVAWRRSLQLRVVALTLGLS

SEQ ID NO: 1393563 - protein, 17 aa, Mycobacterium tuberculosis
SRHRDPLRLVLGALFVA

SEQ ID NO: 1393564 - protein, 22 aa, Mycobacterium tuberculosis
SRLCDLEQMIPLMPGAQLIGHE

SEQ ID NO: 1393565 - protein, 28 aa, Mycobacterium tuberculosis
SRLQAHAFWDIATFLINGSLWVFVGVQI

SEQ ID NO: 1393566 - protein, 21 aa, Mycobacterium tuberculosis
SRLTLIVFVAMTLAAGLLISA

SEQ ID NO: 1393567 - protein, 33 aa, Mycobacterium tuberculosis
SRNRMAFLAALFFLLALCWATTNGWWYVSSYGV

SEQ ID NO: 1393568 - protein, 21 aa, Mycobacterium tuberculosis
SRPGWAPVWGSPRTRSSRWPN

SEQ ID NO: 1393569 - protein, 20 aa, Mycobacterium tuberculosis
SRPRRSVILPSRPSAPPTPG

SEQ ID NO: 1393570 - protein, 22 aa, Mycobacterium tuberculosis
SRPRRSVILPSRPSAPPTPGAV

SEQ ID NO: 1393571 - protein, 29 aa, Mycobacterium tuberculosis
SRRNLTLYVTALLFVLAWATSGINGWFYV

SEQ ID NO: 1393572 - protein, 24 aa, Mycobacterium tuberculosis
SRRPPWWLWSCFVMHPTFGPTPTR

SEQ ID NO: 1393573 - protein, 35 aa, Mycobacterium tuberculosis
SRRRHVLRLALFAGILLGLFYLVAVARVIHVDGVR

SEQ ID NO: 1393574 - protein, 23 aa, Mycobacterium tuberculosis
SRSARPILLHRSIAGSPGLAKLA

SEQ ID NO: 1393575 - protein, 18 aa, Mycobacterium tuberculosis
SRSPLAYCLPGVRSRVVV

SEQ ID NO: 1393576 - protein, 23 aa, Mycobacterium tuberculosis
SRTDYGLPVREPGARLVPGAAVP

SEQ ID NO: 1393577 - protein, 21 aa, Mycobacterium tuberculosis
SRVGFLGWSMGGYGALLLGAR

SEQ ID NO: 1393578 - protein, 19 aa, Mycobacterium tuberculosis
SRVPTLARVAAAGVALALL

SEQ ID NO: 1393579 - protein, 22 aa, Mycobacterium tuberculosis
SRWVAMNDLTLASAGALTARML

SEQ ID NO: 1393580 - protein, 31 aa, Mycobacterium tuberculosis
SSALLCPLLVYGWLGLPRWGLTGSAVANLVG

SEQ ID NO: 1393581 - protein, 21 aa, Mycobacterium tuberculosis
SSASFPLAFEPSFLPFTKGTA

SEQ ID NO: 1393582 - protein, 25 aa, Mycobacterium tuberculosis
SSGAVILFVYLLIALSQIVLRRQTS

SEQ ID NO: 1393583 - protein, 26 aa, Mycobacterium tuberculosis
SSGAVILFVYLLIALSQIVLRRQTSG

SEQ ID NO: 1393584 - protein, 24 aa, Mycobacterium tuberculosis
SSSALVVAMLLTTCALIGSSPGPY

SEQ ID NO: 1393585 - protein, 35 aa, Mycobacterium tuberculosis
SSSSRVVLLVTVGIIVIVVAVLLVVMRHRNRRRRA

SEQ ID NO: 1393586 - protein, 18 aa, Mycobacterium tuberculosis
SSWYVWAALGLYPSTPGT

SEQ ID NO: 1393587 - protein, 26 aa, Mycobacterium tuberculosis
SSYLLNGLFFSLPWYYRSGYDVLLYT

SEQ ID NO: 1393588 - protein, 44 aa, Mycobacterium tuberculosis
STAALITLLMTALWVLAVIARPYQWWRLALVLASGLAYVVIFSL

SEQ ID NO: 1393589 - protein, 21 aa, Mycobacterium tuberculosis
STALRPLALLMLAAAVAALAV

SEQ ID NO: 1393590 - protein, 28 aa, Mycobacterium tuberculosis
STDGIYPLLIMILLPVLVGLDVSTRRAA

SEQ ID NO: 1393591 - protein, 19 aa, Mycobacterium tuberculosis
STEFYALAARALAPGGLMV

SEQ ID NO: 1393592 - protein, 23 aa, Mycobacterium tuberculosis
STGTTVLPFNGLYQPPGLAVDGA

SEQ ID NO: 1393593 - protein, 29 aa, Mycobacterium tuberculosis
STQPSQLLVLLIIGGALMAVLPRSVKSSK

SEQ ID NO: 1393594 - protein, 28 aa, Mycobacterium tuberculosis
STVFAFFPLFLLVVVWVSGFVVVWSCLC

SEQ ID NO: 1393595 - protein, 19 aa, Mycobacterium tuberculosis
STVLFAIVVDFAITVVTGI

SEQ ID NO: 1393596 - protein, 20 aa, Mycobacterium tuberculosis
STWHYFPRHRFLFGDKYDSV

SEQ ID NO: 1393597 - protein, 19 aa, Mycobacterium tuberculosis
STWNGLAWIVGAALYLVCL

SEQ ID NO: 1393598 - protein, 21 aa, Mycobacterium tuberculosis
STYFRPLIVTLAIIGVIYGAI

SEQ ID NO: 1393599 - protein, 20 aa, Mycobacterium tuberculosis
SVDWFGIVVLAVWGALAALA

SEQ ID NO: 1393600 - protein, 22 aa, Mycobacterium tuberculosis
SVERLIAAHLMDPAPQPSQLRP

SEQ ID NO: 1393601 - protein, 29 aa, Mycobacterium tuberculosis
SVGALVTYLLYIELLYTPIGELAQMFDDY

SEQ ID NO: 1393602 - protein, 25 aa, Mycobacterium tuberculosis
SVGRWVAVVAVLAVLTVVVTIAINT

SEQ ID NO: 1393603 - protein, 23 aa, Mycobacterium tuberculosis
SVGVLTWIVLNLFAVGLRWDPYP

SEQ ID NO: 1393604 - protein, 29 aa, Mycobacterium tuberculosis
SVIFTIPSLALFVVLPLIIGTRILDEANV

SEQ ID NO: 1393605 - protein, 19 aa, Mycobacterium tuberculosis
SVIPRLFVWPPARSIAQVL

SEQ ID NO: 1393606 - protein, 22 aa, Mycobacterium tuberculosis
SVIPRLFVWPPARSIAQVLERL

SEQ ID NO: 1393607 - protein, 18 aa, Mycobacterium tuberculosis
SVLATLAYAAPEVLAGQG

SEQ ID NO: 1393608 - protein, 27 aa, Mycobacterium tuberculosis
SVLGNPLVWIERALVVLVAAAPCALAI

SEQ ID NO: 1393609 - protein, 17 aa, Mycobacterium tuberculosis
SVLIWQHFVGLQVHWTI

SEQ ID NO: 1393610 - protein, 17 aa, Mycobacterium tuberculosis
SVLLVAGAWRNDIAIQR

SEQ ID NO: 1393611 - protein, 31 aa, Mycobacterium tuberculosis
SVLWLVPLAGAVLIILLPPGRRRLAKWAGMV

SEQ ID NO: 1393612 - protein, 23 aa, Mycobacterium tuberculosis
SVMAIFYLRLPATFGIGTYGVSA

SEQ ID NO: 1393613 - protein, 23 aa, Mycobacterium tuberculosis
SVPPLWVIVSCAVAMAAGTYLGG

SEQ ID NO: 1393614 - protein, 24 aa, Mycobacterium tuberculosis
SVQVIVHLVLLILFSALAGTSTDL

SEQ ID NO: 1393615 - protein, 25 aa, Mycobacterium tuberculosis
SVRANLHFLWLRLARVWPVYLVTLH

SEQ ID NO: 1393616 - protein, 23 aa, Mycobacterium tuberculosis
SVRVWLMLGVLLLSVVLAVRLNV

SEQ ID NO: 1393617 - protein, 30 aa, Mycobacterium tuberculosis; identical to SEQ ID NO: 370310

SEQ ID NO: 1393618 - protein, 17 aa, Mycobacterium tuberculosis
SVSLLPTLAVSIPLTVL

SEQ ID NO: 1393619 - protein, 25 aa, Mycobacterium tuberculosis
SVSSWLLAWPMWADGAVFLLVSVLL

SEQ ID NO: 1393620 - protein, 27 aa, Mycobacterium tuberculosis
SVVAGQVLFSLLLTPAIRLTNGAANWI

SEQ ID NO: 1393621 - protein, 25 aa, Mycobacterium tuberculosis
SVVIWKHILGDNLHWSVLPIAFVLL

SEQ ID NO: 1393622 - protein, 19 aa, Mycobacterium tuberculosis
SVVYDMWGAAVSLAYQMHS

SEQ ID NO: 1393623 - protein, 17 aa, Mycobacterium tuberculosis
SVWLFPVSAAVLTWRAV

SEQ ID NO: 1393624 - protein, 23 aa, Mycobacterium tuberculosis
SVWSLWSVMVLFMPTSVYGFSAG

SEQ ID NO: 1393625 - protein, 25 aa, Mycobacterium tuberculosis
SWMLNAYNIVFAAFLVAAGRLADLM

SEQ ID NO: 1393626 - protein, 22 aa, Mycobacterium tuberculosis
SYALLVFFGLFLGVAGTIFAVG

SEQ ID NO: 1393627 - protein, 23 aa, Mycobacterium tuberculosis
SYTPFALLALPAHDGRVVLSIVW

SEQ ID NO: 1393628 - protein, 19 aa, Mycobacterium tuberculosis
TAAALWLVAPCTELYHDSR

SEQ ID NO: 1393629 - protein, 17 aa, Mycobacterium tuberculosis
TAAFPPPAGPPPVTAAP

SEQ ID NO: 1393630 - protein, 24 aa, Mycobacterium tuberculosis
TAARAAPAVVAALAGRRRRRRRRR

SEQ ID NO: 1393631 - protein, 19 aa, Mycobacterium tuberculosis
TAATLGLAALGFAGTASAS

SEQ ID NO: 1393632 - protein, 21 aa, Mycobacterium tuberculosis
TAAVAVLIIACPCALGLAIPT

SEQ ID NO: 1393633 - protein, 21 aa, Mycobacterium tuberculosis
TAAVVAPRRFTKTRSLVSGRS

SEQ ID NO: 1393634 - protein, 31 aa, Mycobacterium tuberculosis
TAAVVILLPMVTFTMAYLIVDVPKPGDIRTN

SEQ ID NO: 1393635 - protein, 22 aa, Mycobacterium tuberculosis
TAGAVFLSAWLPFNNGLRPESL

SEQ ID NO: 1393636 - protein, 25 aa, Mycobacterium tuberculosis
TAGQPLIWLEAMKMEHTIAAPADGV

SEQ ID NO: 1393637 - protein, 24 aa, Mycobacterium tuberculosis
TAGVWMRLPATLAGIACWLIVSRF

SEQ ID NO: 1393638 - protein, 32 aa, Mycobacterium tuberculosis
TAKLIIWYPHYAWLLLSVYLTVALVALVVVGS

SEQ ID NO: 1393639 - protein, 18 aa, Mycobacterium tuberculosis
TALATPPGHGWPPGLPPL

SEQ ID NO: 1393640 - protein, 46 aa, Mycobacterium tuberculosis
TALSGDRYFGFLLNLLVVFGVSFEFPLLIVMLNLAGLLTYERLKSW

SEQ ID NO: 1393641 - protein, 22 aa, Mycobacterium tuberculosis
TANEALYDWNYQRQLLSIRLAE

SEQ ID NO: 1393642 - protein, 20 aa, Mycobacterium tuberculosis
TAPLVPLAVSAFLTSRKKAA

SEQ ID NO: 1393643 - protein, 24 aa, Mycobacterium tuberculosis
TARKRIAWLVLLANMVLAAVVNAA

SEQ ID NO: 1393644 - protein, 22 aa, Mycobacterium tuberculosis
TARPADLLVLLDSLRQREATLN

SEQ ID NO: 1393645 - protein, 24 aa, Mycobacterium tuberculosis
TASAWWFDMAMLVALSVIYVGFVR

SEQ ID NO: 1393646 - protein, 39 aa, Mycobacterium tuberculosis
TAVIAALVVIAALTLGLVLYRRRRISLSPRPERGVVDRS

SEQ ID NO: 1393647 - protein, 31 aa, Mycobacterium tuberculosis
TAVSVLIILILVYRNLVTMLVPLATIGASVV

SEQ ID NO: 1393648 - protein, 28 aa, Mycobacterium tuberculosis
TAVVGVFALRRVWWLYKLVMSGQPASGR

SEQ ID NO: 1393649 - protein, 17 aa, Mycobacterium tuberculosis
TAWLIERLQRPTLVMAP

SEQ ID NO: 1393650 - protein, 19 aa, Mycobacterium tuberculosis
TAWLMRRSLQFGALTAEEL

SEQ ID NO: 1393651 - protein, 23 aa, Mycobacterium tuberculosis
TCGCLALGWWQWTRFQSTSGTFQ

SEQ ID NO: 1393652 - protein, 20 aa, Mycobacterium tuberculosis
TDAFWIFMMCYAAAAVLTWK

SEQ ID NO: 1393653 - protein, 26 aa, Mycobacterium tuberculosis
TDAFWIFMMCYAAAAVLTWKVYDRRS

SEQ ID NO: 1393654 - protein, 21 aa, Mycobacterium tuberculosis
TDDLRPIPVFGSDELARLTEA

SEQ ID NO: 1393655 - protein, 22 aa, Mycobacterium tuberculosis
TDDLRPIPVFGSDELARLTEAF

SEQ ID NO: 1393656 - protein, 23 aa, Mycobacterium tuberculosis
TDDLRPIPVFGSDELARLTEAFN

SEQ ID NO: 1393657 - protein, 27 aa, Mycobacterium tuberculosis
TDGIYPLLIMILLPVLVGLDVSTRRAA

SEQ ID NO: 1393658 - protein, 24 aa, Mycobacterium tuberculosis
TDGRNILPPNKFPYIPPGADPDPG

SEQ ID NO: 1393659 - protein, 26 aa, Mycobacterium tuberculosis
TDILLPIVMWALYAWSWHSNGDAVPK

SEQ ID NO: 1393660 - protein, 18 aa, Mycobacterium tuberculosis
TEAPFDWYTSVLAQLAAV

SEQ ID NO: 1393661 - protein, 20 aa, Mycobacterium tuberculosis
TEAPFDWYTSVLAQLAAVST

SEQ ID NO: 1393662 - protein, 17 aa, Mycobacterium tuberculosis
TEARLLHRLLGLTVLRV

SEQ ID NO: 1393663 - protein, 18 aa, Mycobacterium tuberculosis
TEARLLHRLLGLTVLRVG

SEQ ID NO: 1393664 - protein, 24 aa, Mycobacterium tuberculosis
TENLRYYYLILPTVDGSLSRRFGF

SEQ ID NO: 1393665 - protein, 23 aa, Mycobacterium tuberculosis
TEQIPFWTFLRNSLIITSVLAVV

SEQ ID NO: 1393666 - protein, 17 aa, Mycobacterium tuberculosis
TFAIIRILRNPREIGRS

SEQ ID NO: 1393667 - protein, 23 aa, Mycobacterium tuberculosis
TFAIVPLLHRFGGLVAPLTFIGT

SEQ ID NO: 1393668 - protein, 17 aa, Mycobacterium tuberculosis
TFALALGAAMAAGAATM

SEQ ID NO: 1393669 - protein, 18 aa, Mycobacterium tuberculosis
TFGAFGVPLWQMVVGSFI

SEQ ID NO: 1393670 - protein, 18 aa, Mycobacterium tuberculosis
TFGARLLGIAYGLGGLRT

SEQ ID NO: 1393671 - protein, 25 aa, Mycobacterium tuberculosis
TFGVVPGYVLLALALGSYALTRQTV

SEQ ID NO: 1393672 - protein, 31 aa, Mycobacterium tuberculosis
TFLVGKTPWIGALLGVLFVLTTALGDLVESQ

SEQ ID NO: 1393673 - protein, 25 aa, Mycobacterium tuberculosis
TGAFEVVGRRRLWFGVSGAIVAVAI

SEQ ID NO: 1393674 - protein, 17 aa, Mycobacterium tuberculosis
TGAIVLWGALATAVSPM

SEQ ID NO: 1393675 - protein, 25 aa, Mycobacterium tuberculosis
TGALAYFFGPVVVFWVLAGHGVDQR

SEQ ID NO: 1393676 - protein, 22 aa, Mycobacterium tuberculosis
TGAVMMLFLFVLMLIGVDSAES

SEQ ID NO: 1393677 - protein, 23 aa, Mycobacterium tuberculosis
TGAVMMLFLFVLMLIGVDSAVVT

SEQ ID NO: 1393678 - protein, 32 aa, Mycobacterium tuberculosis
TGAVPPLDLFIMSWLPFYHDMGLVLGVCAPII

SEQ ID NO: 1393679 - protein, 28 aa, Mycobacterium tuberculosis
TGDAAWLLAAVWWKALLALAVAVALVIG

SEQ ID NO: 1393680 - protein, 18 aa, Mycobacterium tuberculosis
TGDRKLLLSSLLLNWVLG

SEQ ID NO: 1393681 - protein, 31 aa, Mycobacterium tuberculosis
TGDRKLLLSSLLLNWVLGPALMFALAWLLLA

SEQ ID NO: 1393682 - protein, 20 aa, Mycobacterium tuberculosis
TGEIMIFVGKDFVVTVRHGE

SEQ ID NO: 1393683 - protein, 17 aa, Mycobacterium tuberculosis
TGFARIVLLAAILGAAL

SEQ ID NO: 1393684 - protein, 23 aa, Mycobacterium tuberculosis
TGFYGWMLQLIWQFLQDPIGNSI

SEQ ID NO: 1393685 - protein, 24 aa, Mycobacterium tuberculosis
TGFYGWMLQLIWQFLQDPIGNSIK

SEQ ID NO: 1393686 - protein, 22 aa, Mycobacterium tuberculosis
TGLEFALYQLLRSELPGLHRDQ

SEQ ID NO: 1393687 - protein, 18 aa, Mycobacterium tuberculosis
TGLIFGMTLVLTGLANGF

SEQ ID NO: 1393688 - protein, 27 aa, Mycobacterium tuberculosis
TGLSLSPTLIFDYPTPNRLASYIRTEL

SEQ ID NO: 1393689 - protein, 36 aa, Mycobacterium tuberculosis
TGLTAKLIIWYPHYAWLLLSVYLTVAWLRSWWSGRW

SEQ ID NO: 1393690 - protein, 23 aa, Mycobacterium tuberculosis
TGLTVLYLAYLRRQTRIEEKVRR

SEQ ID NO: 1393691 - protein, 24 aa, Mycobacterium tuberculosis
TGMRLHHFGAFYKRSWRANDWMWG

SEQ ID NO: 1393692 - protein, 23 aa, Mycobacterium tuberculosis
TGNFVIYAITIVCVVFLNLLEGV

SEQ ID NO: 1393693 - protein, 20 aa, Mycobacterium tuberculosis
TGNPVWPLAALGVTVVFGVL

SEQ ID NO: 1393694 - protein, 35 aa, Mycobacterium tuberculosis
TGPLLGGWLTDYLSWRWAFWINVPVSISVLTVAAT

SEQ ID NO: 1393695 - protein, 23 aa, Mycobacterium tuberculosis
TGRISVVAAPWLADHAVGPVVPF

SEQ ID NO: 1393696 - protein, 34 aa, Mycobacterium tuberculosis
TGSFLTTALISLIQRPQLRNLLHEKPELIPAGVE

SEQ ID NO: 1393697 - protein, 24 aa, Mycobacterium tuberculosis
TGSTGTTVLPFNGLYQPQGLAVDG

SEQ ID NO: 1393698 - protein, 22 aa, Mycobacterium tuberculosis
TGTTVLPFNGLYQPPGLAVDGA

SEQ ID NO: 1393699 - protein, 24 aa, Mycobacterium tuberculosis
TGVTVLYLAYLRRQTRIEEKVRRR

SEQ ID NO: 1393700 - protein, 18 aa, Mycobacterium tuberculosis
THSWRCAAILLFGGRRTD

SEQ ID NO: 1393701 - protein, 18 aa, Mycobacterium tuberculosis
THWLYLAVIFAVIAGVIV

SEQ ID NO: 1393702 - protein, 24 aa, Mycobacterium tuberculosis
THYWKPLLLCFLVTLGGTVAFYTY

SEQ ID NO: 1393703 - protein, 21 aa, Mycobacterium tuberculosis
TIAVMVGIALSLLVHRLRSRQ

SEQ ID NO: 1393704 - protein, 25 aa, Mycobacterium tuberculosis
TIGFDWTLLVLLATFVLGFGLLAPL

SEQ ID NO: 1393705 - protein, 21 aa, Mycobacterium tuberculosis
TIGFGWTLLVLLATFVLGFGL

SEQ ID NO: 1393706 - protein, 22 aa, Mycobacterium tuberculosis
TIGLGLLFDTLIVRSFMTPSIA

SEQ ID NO: 1393707 - protein, 22 aa, Mycobacterium tuberculosis
TIGLGLLFDTLVVRSFMTPSIA

SEQ ID NO: 1393708 - protein, 19 aa, Mycobacterium tuberculosis
TILAILALTAGTGVFVAAE

SEQ ID NO: 1393709 - protein, 32 aa, Mycobacterium tuberculosis
TILDLVVVFLVTWPLVYLASKSSLLPSRHTTA

SEQ ID NO: 1393710 - protein, 19 aa, Mycobacterium tuberculosis
TILIDRYWWTALAVTLAIT

SEQ ID NO: 1393711 - protein, 23 aa, Mycobacterium tuberculosis
TIMIGLLFDTLVVRSYMTPALAT

SEQ ID NO: 1393712 - protein, 27 aa, Mycobacterium tuberculosis
TISYGVYLWHWPIFLALNGQRTGWSGP

SEQ ID NO: 1393713 - protein, 22 aa, Mycobacterium tuberculosis
TIVAVHLLGRPLGRLVDRDNAV

SEQ ID NO: 1393714 - protein, 23 aa, Mycobacterium tuberculosis
TIVDGTGLLIYFWSRTDADELHG

SEQ ID NO: 1393715 - protein, 18 aa, Mycobacterium tuberculosis
TIYQNLGWAFGYNTAAIP

SEQ ID NO: 1393716 - protein, 24 aa, Mycobacterium tuberculosis
TKAAARWIRPLVPPFVARMLDNTT

SEQ ID NO: 1393717 - protein, 19 aa, Mycobacterium tuberculosis
TKFITWTLPTNLGEGLVIL

SEQ ID NO: 1393718 - protein, 21 aa, Mycobacterium tuberculosis
TKQILIYTWLTVAATLVLALA

SEQ ID NO: 1393719 - protein, 24 aa, Mycobacterium tuberculosis
TKVLSPPYSILAIGDPPTLAAAMK

SEQ ID NO: 1393720 - protein, 21 aa, Mycobacterium tuberculosis
TKYFDDYLLNATAGGIRQVAI

SEQ ID NO: 1393721 - protein, 24 aa, Mycobacterium tuberculosis
TLAGCLPAVIWWACHRPNRLWWRY

SEQ ID NO: 1393722 - protein, 49 aa, Mycobacterium tuberculosis
TLAGCLPAVIWWACHRPNRLWWRYTAWWLLAMALATLWWVMALTQLHGV

SEQ ID NO: 1393723 - protein, 24 aa, Mycobacterium tuberculosis
TLAGFLPAVIWWACHRPNRLWWRY

SEQ ID NO: 1393724 - protein, 17 aa, Mycobacterium tuberculosis
TLALIALAIITRLRHPL

SEQ ID NO: 1393725 - protein, 29 aa, Mycobacterium tuberculosis
TLALLPAALPLLAAPLAPLTLAPASAAGG

SEQ ID NO: 1393726 - protein, 21 aa, Mycobacterium tuberculosis
TLASFGLLEVSARMAVLLAGL

SEQ ID NO: 1393727 - protein, 25 aa, Mycobacterium tuberculosis
TLAVRALPIVLLTALVFFNTYVWLM

SEQ ID NO: 1393728 - protein, 19 aa, Mycobacterium tuberculosis
TLDRWLLFNWMRWGRALEY

SEQ ID NO: 1393729 - protein, 19 aa, Mycobacterium tuberculosis
TLDVDLLMVVAAIGAAAIG

SEQ ID NO: 1393730 - protein, 17 aa, Mycobacterium tuberculosis
TLHDIVTPLVFAEAADL

SEQ ID NO: 1393731 - protein, 29 aa, Mycobacterium tuberculosis
TLIGGFLLMWILAWLTAAPVRVVRAALKR

SEQ ID NO: 1393732 - protein, 19 aa, Mycobacterium tuberculosis
TLIIFPLVVYGMKVLSQLQ

SEQ ID NO: 1393733 - protein, 33 aa, Mycobacterium tuberculosis
TLIRTPELYAWILVLPIGLMLQQSSLRVGALTA

SEQ ID NO: 1393734 - protein, 17 aa, Mycobacterium tuberculosis
TLISRITGFARIVLLAA

SEQ ID NO: 1393735 - protein, 19 aa, Mycobacterium tuberculosis
TLKIMTWVTAFFAPTDGGV

SEQ ID NO: 1393736 - protein, 21 aa, Mycobacterium tuberculosis
TLKYRPDFPKRFESIEAARVH

SEQ ID NO: 1393737 - protein, 19 aa, Mycobacterium tuberculosis
TLNLWVGYFPTVQTAWNQL

SEQ ID NO: 1393738 - protein, 34 aa, Mycobacterium tuberculosis
TLPQTPMPAFPPYVPTLLPPPPPPQLATLINIAD

SEQ ID NO: 1393739 - protein, 26 aa, Mycobacterium tuberculosis
TLRTDLWWLPPLLTNLGLLAFICYAT

SEQ ID NO: 1393740 - protein, 27 aa, Mycobacterium tuberculosis
TLVLIAAFLAVWWIYETYRPQAPGHGD

SEQ ID NO: 1393741 - protein, 25 aa, Mycobacterium tuberculosis
TLVSTTLVVPYPPGFPVLVPGQLVS

SEQ ID NO: 1393742 - protein, 18 aa, Mycobacterium tuberculosis
TMASLPLPAISSLNSRML

SEQ ID NO: 1393743 - protein, 18 aa, Mycobacterium tuberculosis
TMFGPWGIIIGPVLMILI

SEQ ID NO: 1393744 - protein, 19 aa, Mycobacterium tuberculosis
TMFGPWGIIIGPVLMILIV

SEQ ID NO: 1393745 - protein, 22 aa, Mycobacterium tuberculosis
TMGLWPPRLWAGLRLGWAAGAA

SEQ ID NO: 1393746 - protein, 23 aa, Mycobacterium tuberculosis
TMHGTIMLLFYATPIVFGFANLV

SEQ ID NO: 1393747 - protein, 24 aa, Mycobacterium tuberculosis
TMITFRLRLPCRTILRGVSRNPLV

SEQ ID NO: 1393748 - protein, 20 aa, Mycobacterium tuberculosis
TMLLVGVVLLAVGHRGGLAS

SEQ ID NO: 1393749 - protein, 21 aa, Mycobacterium tuberculosis
TMLSVPRWAVGPVMELGTDHR

SEQ ID NO: 1393750 - protein, 17 aa, Mycobacterium tuberculosis
TMRLLGMQIPGQLLFSI

SEQ ID NO: 1393751 - protein, 20 aa, Mycobacterium tuberculosis
TMVAVLAMMVSISGLLALIT

SEQ ID NO: 1393752 - protein, 25 aa, Mycobacterium tuberculosis
TMVGVAVYAWIRPLPDDWSQLPKRL

SEQ ID NO: 1393753 - protein, 24 aa, Mycobacterium tuberculosis
TMVSNLLWLFLTSTRTPYCLRPPA

SEQ ID NO: 1393754 - protein, 39 aa, Mycobacterium tuberculosis
TNNLHRRVLLICTFAIGAAAVFAWLLAAFAVRPFKQLAE

SEQ ID NO: 1393755 - protein, 22 aa, Mycobacterium tuberculosis
TNPASFRRWLNPVNAAAATALV

SEQ ID NO: 1393756 - protein, 26 aa, Mycobacterium tuberculosis
TNPQVTLIRRSLLLLRSLVLRLSSVS

SEQ ID NO: 1393757 - protein, 19 aa, Mycobacterium tuberculosis
TPAIFLVMVSAFVALQVKA

SEQ ID NO: 1393758 - protein, 17 aa, Mycobacterium tuberculosis
TPDDPTFALALGAAMAA

SEQ ID NO: 1393759 - protein, 20 aa, Mycobacterium tuberculosis
TPDFPLPFTYPPFAAVVFYP

SEQ ID NO: 1393760 - protein, 20 aa, Mycobacterium tuberculosis
TPEAPFGWYYDLLALWAHVS

SEQ ID NO: 1393761 - protein, 30 aa, Mycobacterium tuberculosis
TPILAVAMPWLFLRLRFCRRKWTVPTLAAT

SEQ ID NO: 1393762 - protein, 24 aa, Mycobacterium tuberculosis
TPLAVPGFAWWAAALNSLPMLAAL

SEQ ID NO: 1393763 - protein, 20 aa, Mycobacterium tuberculosis
TPMVWVRPRQGPKLADLIAA

SEQ ID NO: 1393764 - protein, 37 aa, Mycobacterium tuberculosis
TPNEIALNILLAGLTIIFLLAVVTLQPFAIYSGGGQR

SEQ ID NO: 1393765 - protein, 25 aa, Mycobacterium tuberculosis
TPPARWPVTLHVLPTVGMPASARCR

SEQ ID NO: 1393766 - protein, 22 aa, Mycobacterium tuberculosis
TPPLGPAWVALLIVGASSGVAV

SEQ ID NO: 1393767 - protein, 23 aa, Mycobacterium tuberculosis
TPSAPPLRLLEDLPRRVRVSDAH

SEQ ID NO: 1393768 - protein, 20 aa, Mycobacterium tuberculosis
TPSGGIHRLGIRRWLRRRAS

SEQ ID NO: 1393769 - protein, 30 aa, Mycobacterium tuberculosis
TPSIAALLGRWFWWPLRVRSRPARTPTVPS

SEQ ID NO: 1393770 - protein, 29 aa, Mycobacterium tuberculosis
TPSIAALLGRWFWWPNMIHSRPTVPEAHT

SEQ ID NO: 1393771 - protein, 22 aa, Mycobacterium tuberculosis
TPVMSMLRTLVRRNQITDVVHL

SEQ ID NO: 1393772 - protein, 17 aa, Mycobacterium tuberculosis
TQLDWVGQLTLIPAVAL

SEQ ID NO: 1393773 - protein, 22 aa, Mycobacterium tuberculosis
TQMHLDAGQQVWLITATPYELA

SEQ ID NO: 1393774 - protein, 24 aa, Mycobacterium tuberculosis
TQNLGLLILRVGLGAVLIAHGLQK

SEQ ID NO: 1393775 - protein, 31 aa, Mycobacterium tuberculosis
TQSWFWSRWVGWVMRRPWITALAASTVLLVM

SEQ ID NO: 1393776 - protein, 32 aa, Mycobacterium tuberculosis
TQSWFWSRWVGWVMRRPWITALAASTVLLVMA

SEQ ID NO: 1393777 - protein, 18 aa, Mycobacterium tuberculosis
TQTAAVIGTAQYLSPEQA

SEQ ID NO: 1393778 - protein, 29 aa, Mycobacterium tuberculosis
TRATMGLWPPRLWAGLRLGWAAGAAAATA

SEQ ID NO: 1393779 - protein, 18 aa, Mycobacterium tuberculosis
TRCLTPRTYWAGPPATPP

SEQ ID NO: 1393780 - protein, 25 aa, Mycobacterium tuberculosis
TRGDGKCHPVILPPLFGCNDRAMPD

SEQ ID NO: 1393781 - protein, 32 aa, Mycobacterium tuberculosis
TRLVPFGEYVPLRPLFGWITRYSKAAAKDRQR

SEQ ID NO: 1393782 - protein, 26 aa, Mycobacterium tuberculosis
TRMPLREIYWMGFAIARSQPWFRRYM

SEQ ID NO: 1393783 - protein, 27 aa, Mycobacterium tuberculosis
TRNPEVWAWMVWLPHNLHDELFDACGW

SEQ ID NO: 1393784 - protein, 24 aa, Mycobacterium tuberculosis
TRPELARMLLLGTLIGLVWELPVF

SEQ ID NO: 1393785 - protein, 18 aa, Mycobacterium tuberculosis
TRRGLRALLSLVPDQATV

SEQ ID NO: 1393786 - protein, 22 aa, Mycobacterium tuberculosis
TRRGLRALLSLVPDQATVLREG

SEQ ID NO: 1393787 - protein, 17 aa, Mycobacterium tuberculosis
TRRQAALVLADALVRAR

SEQ ID NO: 1393788 - protein, 36 aa, Mycobacterium tuberculosis
TRRRPRRILVGAVAVLLLAGLFAVGIVIGRKTNTTA

SEQ ID NO: 1393789 - protein, 18 aa, Mycobacterium tuberculosis
TRSHRRTLRAVAGWLPTM

SEQ ID NO: 1393790 - protein, 52 aa, Mycobacterium tuberculosis
TSAMPPPGKKFTWHWWWLGAAALGVLLVVMVALVVFGLRRRRRGYDAAAYDD

SEQ ID NO: 1393791 - protein, 25 aa, Mycobacterium tuberculosis
TSAVTLLSSLLLICVVAYHAAPALS

SEQ ID NO: 1393792 - protein, 27 aa, Mycobacterium tuberculosis
TSDIKNLLPMLAVFKPTVVVSVPRVFE

SEQ ID NO: 1393793 - protein, 17 aa, Mycobacterium tuberculosis
TSFLLVATNTAIASVLV

SEQ ID NO: 1393794 - protein, 24 aa, Mycobacterium tuberculosis
TSILILIAFPLLTAALFGLAADRH

SEQ ID NO: 1393795 - protein, 40 aa, Mycobacterium tuberculosis
TSLPPILPRLIRQFAVVIVLLWLGFTAFVNLAVPQLEVVG

SEQ ID NO: 1393796 - protein, 29 aa, Mycobacterium tuberculosis
TSPSPPPIPPIPPIPEIPQLPPRIPQVPG

SEQ ID NO: 1393797 - protein, 27 aa, Mycobacterium tuberculosis
TSPSPPPIPPIPPIPEIPQLPPRNTSG

SEQ ID NO: 1393798 - protein, 26 aa, Mycobacterium tuberculosis
TSPSPPPIPPIPPIPEIPQLPSRNTS

SEQ ID NO: 1393799 - protein, 27 aa, Mycobacterium tuberculosis
TSPSPPPIPPIPPIPEIPQLPSRNTSG

SEQ ID NO: 1393800 - protein, 25 aa, Mycobacterium tuberculosis
TSRCCRWWAPRSPSTPTPACAAGPG

SEQ ID NO: 1393801 - protein, 24 aa, Mycobacterium tuberculosis
TSRSARPILLHRSIAGSPGLAKLA

SEQ ID NO: 1393802 - protein, 18 aa, Mycobacterium tuberculosis
TTALYVLLVHNLTETQLA

SEQ ID NO: 1393803 - protein, 27 aa, Mycobacterium tuberculosis
TTDTVLYLFFFFIFSYFYFFFFHVLLR

SEQ ID NO: 1393804 - protein, 22 aa, Mycobacterium tuberculosis
TTFLLAWELMAIASLILVLSEH

SEQ ID NO: 1393805 - protein, 24 aa, Mycobacterium tuberculosis
TTSRQAYALLLLGSLTVADALPLL

SEQ ID NO: 1393806 - protein, 31 aa, Mycobacterium tuberculosis
TTVGAGWFGLFGLAFWVALAGLTPSGLLLAA

SEQ ID NO: 1393807 - protein, 28 aa, Mycobacterium tuberculosis
TVAPTTLAILMLLPLSAFEATVALPAAA

SEQ ID NO: 1393808 - protein, 27 aa, Mycobacterium tuberculosis
TVFSALYLPLLAILFGMILRAVAIEWR

SEQ ID NO: 1393809 - protein, 18 aa, Mycobacterium tuberculosis
TVGKLARVLVAGGVLAAL

SEQ ID NO: 1393810 - protein, 17 aa, Mycobacterium tuberculosis
TVGLPYFAIGIGNSLIT

SEQ ID NO: 1393811 - protein, 43 aa, Mycobacterium tuberculosis
TVGMGLLLDALVIRGFVLPALMVLLGRWLWWPRRSVSNRQVPE

SEQ ID NO: 1393812 - protein, 20 aa, Mycobacterium tuberculosis
TVIIRFWLLTAITCGLGVAL

SEQ ID NO: 1393813 - protein, 22 aa, Mycobacterium tuberculosis
TVLIGLALIALGGWLLLGRGLT

SEQ ID NO: 1393814 - protein, 17 aa, Mycobacterium tuberculosis
TVLLALLLPYTAYKEHV

SEQ ID NO: 1393815 - protein, 19 aa, Mycobacterium tuberculosis
TVLLPMLHSRFTRHIAITV

SEQ ID NO: 1393816 - protein, 17 aa, Mycobacterium tuberculosis
TVLPFDGLNYPEGLAVD

SEQ ID NO: 1393817 - protein, 30 aa, Mycobacterium tuberculosis; identical to SEQ ID NO: 1377539

SEQ ID NO: 1393818 - protein, 21 aa, Mycobacterium tuberculosis
TVPHISLLIGASYGAGHYGMC

SEQ ID NO: 1393819 - protein, 19 aa, Mycobacterium tuberculosis
TVSVWFRSVWVLQPRGDLM

SEQ ID NO: 1393820 - protein, 17 aa, Mycobacterium tuberculosis
TVTPPPPPPPATTTAPP

SEQ ID NO: 1393821 - protein, 22 aa, Mycobacterium tuberculosis
TVVSWLPLYHDMGLILGICAPL

SEQ ID NO: 1393822 - protein, 25 aa, Mycobacterium tuberculosis
TVVVRWPGPVLAATLLIALIGLLAL

SEQ ID NO: 1393823 - protein, 27 aa, Mycobacterium tuberculosis
TVVVRWPGPVLAATLLIALIGLLALPK

SEQ ID NO: 1393824 - protein, 23 aa, Mycobacterium tuberculosis
TWKYVVICSVGIAVAFLGTVLLY

SEQ ID NO: 1393825 - protein, 18 aa, Mycobacterium tuberculosis
TWLGGGHWRELGERHERS

SEQ ID NO: 1393826 - protein, 18 aa, Mycobacterium tuberculosis
TYCLSFARLTLFHTMGPP

SEQ ID NO: 1393827 - protein, 19 aa, Mycobacterium tuberculosis
TYGLVHFIGGYPGAILGFA

SEQ ID NO: 1393828 - protein, 25 aa, Mycobacterium tuberculosis
TYHIAKPWRWGYLGVLLVIFGFPLI

SEQ ID NO: 1393829 - protein, 19 aa, Mycobacterium tuberculosis
VAAATPYVAWLSQAAARAE

SEQ ID NO: 1393830 - protein, 18 aa, Mycobacterium tuberculosis
VAAELFAELAGCSSSIEM

SEQ ID NO: 1393831 - protein, 18 aa, Mycobacterium tuberculosis
VAALTWDIPPGPASAPYN

SEQ ID NO: 1393832 - protein, 18 aa, Mycobacterium tuberculosis
VAALWALLLAYSASRRFF

SEQ ID NO: 1393833 - protein, 19 aa, Mycobacterium tuberculosis
VAALWALLLAYSASRRFFA

SEQ ID NO: 1393834 - protein, 24 aa, Mycobacterium tuberculosis
VAATALVWMPVCGCLSSVRSSRRW

SEQ ID NO: 1393835 - protein, 17 aa, Mycobacterium tuberculosis
VAAVLPPLLKKLRIDPA

SEQ ID NO: 1393836 - protein, 25 aa, Mycobacterium tuberculosis
VAAVYVVFRWFFARDLRVVPERQQL

SEQ ID NO: 1393837 - protein, 25 aa, Mycobacterium tuberculosis
VAAWAYPLWPVVLGLKALALAVGAS

SEQ ID NO: 1393838 - protein, 23 aa, Mycobacterium tuberculosis
VADGLITFFALVIVTSLSMVFGE

SEQ ID NO: 1393839 - protein, 24 aa, Mycobacterium tuberculosis
VADGLITFFALVIVTSLSMVFGEL

SEQ ID NO: 1393840 - protein, 20 aa, Mycobacterium tuberculosis
VADRAAVAGLFAQLSREYPP

SEQ ID NO: 1393841 - protein, 24 aa, Mycobacterium tuberculosis
VADRRRTWLVLRMNPQRNVAAVAC

SEQ ID NO: 1393842 - protein, 23 aa, Mycobacterium tuberculosis
VAETLVMMTLFLTGLIVAIVTGN

SEQ ID NO: 1393843 - protein, 28 aa, Mycobacterium tuberculosis
VAGMTAAVAVLIIACPCALGLATPTAIM

SEQ ID NO: 1393844 - protein, 23 aa, Mycobacterium tuberculosis
VAGSVLFGLWHIATSLGITSSNV

SEQ ID NO: 1393845 - protein, 26 aa, Mycobacterium tuberculosis
VAGVLLVLGLFTPLAAAGALAFLING

SEQ ID NO: 1393846 - protein, 23 aa, Mycobacterium tuberculosis
VAHRLPWRVLTLSTWATAAAWAF

SEQ ID NO: 1393847 - protein, 23 aa, Mycobacterium tuberculosis
VAITFLGMVFTQLGILKTVGPML

SEQ ID NO: 1393848 - protein, 35 aa, Mycobacterium tuberculosis
VAITGYARFWWPGLPIWVPALVTVALILAVNLFSV

SEQ ID NO: 1393849 - protein, 18 aa, Mycobacterium tuberculosis
VAIVVLVLGYREFWAKVR

SEQ ID NO: 1393850 - protein, 18 aa, Mycobacterium tuberculosis
VALSVIYVGFVRWKIRLK

SEQ ID NO: 1393851 - protein, 21 aa, Mycobacterium tuberculosis
VALVLFGPVLVYLTITSSLTI

SEQ ID NO: 1393852 - protein, 25 aa, Mycobacterium tuberculosis
VAMFAALGWFYLSVLPGWLGLEQTT

SEQ ID NO: 1393853 - protein, 23 aa, Mycobacterium tuberculosis
VANCGWPWPWLILRLVMSMCSRT

SEQ ID NO: 1393854 - protein, 17 aa, Mycobacterium tuberculosis
VAPLIALLLVLGVYPKP

SEQ ID NO: 1393855 - protein, 22 aa, Mycobacterium tuberculosis
VAPNPPIALPEREPRNIWVMIG

SEQ ID NO: 1393856 - protein, 24 aa, Mycobacterium tuberculosis
VARILAWRPLVWLGTISYGVYLWH

SEQ ID NO: 1393857 - protein, 20 aa, Mycobacterium tuberculosis
VARLAGGLLLIGYGAKAGLF

SEQ ID NO: 1393858 - protein, 33 aa, Mycobacterium tuberculosis
VASAGFYAYLLTHVLFLNYVWGYTLLEAGMAVA

SEQ ID NO: 1393859 - protein, 24 aa, Mycobacterium tuberculosis
VASFLNIDVPLQALSRLPLLSIDG

SEQ ID NO: 1393860 - protein, 21 aa, Mycobacterium tuberculosis
VASRWLLRPTAAEALSTVALG

SEQ ID NO: 1393861 - protein, 30 aa, Mycobacterium tuberculosis
VATALRLYTRWLGHVVLLVPTVLAVVATAV

SEQ ID NO: 1393862 - protein, 17 aa, Mycobacterium tuberculosis
VATGATLFVLYAVATED

SEQ ID NO: 1393863 - protein, 21 aa, Mycobacterium tuberculosis
VATILVASWTKTIDLSKADEV

SEQ ID NO: 1393864 - protein, 19 aa, Mycobacterium tuberculosis
VATLRRFTERFAPFNLSET

SEQ ID NO: 1393865 - protein, 27 aa, Mycobacterium tuberculosis
VATVRRFIERFAPYNLSPTAIRPSYGL

SEQ ID NO: 1393866 - protein, 22 aa, Mycobacterium tuberculosis
VAVFFAVSGFLLWRGHAAAARD

SEQ ID NO: 1393867 - protein, 20 aa, Mycobacterium tuberculosis
VAVGLTLALGLGALARRALS

SEQ ID NO: 1393868 - protein, 22 aa, Mycobacterium tuberculosis
VAVGSWWRYRYDKFGWTTRSSQ

SEQ ID NO: 1393869 - protein, 27 aa, Mycobacterium tuberculosis
VAVLARWRFRRRPAPARLPLWACGAAD

SEQ ID NO: 1393870 - protein, 31 aa, Mycobacterium tuberculosis
VAVTFIAGLVVWDLAFTLPLPLGVARHEGST

SEQ ID NO: 1393871 - protein, 23 aa, Mycobacterium tuberculosis
VAVTFLAMVFTKLEVFSAVGPAI

SEQ ID NO: 1393872 - protein, 19 aa, Mycobacterium tuberculosis
VAVVAVLAVLTVVVTIAIN

SEQ ID NO: 1393873 - protein, 22 aa, Mycobacterium tuberculosis
VCSVVFQHPYLFHGTIRDNVFA

SEQ ID NO: 1393874 - protein, 23 aa, Mycobacterium tuberculosis
VCVSPIAWCWWPATRPCLWPRCR

SEQ ID NO: 1393875 - protein, 19 aa, Mycobacterium tuberculosis
VDGQMFLEMRLVEGTDLDS

SEQ ID NO: 1393876 - protein, 18 aa, Mycobacterium tuberculosis
VDHLLGHSLPLFGLAGLP

SEQ ID NO: 1393877 - protein, 25 aa, Mycobacterium tuberculosis
VDILGFNIIGFIITLASNAQLLTEF

SEQ ID NO: 1393878 - protein, 22 aa, Mycobacterium tuberculosis
VDSFDGYEYLFWVGCAGAYDDK

SEQ ID NO: 1393879 - protein, 23 aa, Mycobacterium tuberculosis
VDSFDGYEYLFWVGCAGAYDDKA

SEQ ID NO: 1393880 - protein, 27 aa, Mycobacterium tuberculosis
VDSGTWLAWVAWAALGLGVVALVVTKR

SEQ ID NO: 1393881 - protein, 25 aa, Mycobacterium tuberculosis
VDSHAWLVVLTALGSLAALATLISI

SEQ ID NO: 1393882 - protein, 25 aa, Mycobacterium tuberculosis
VDVALYALLVMMLLSALFTDGTGPI

SEQ ID NO: 1393883 - protein, 17 aa, Mycobacterium tuberculosis
VDWRVALVLFGPVLVYL

SEQ ID NO: 1393884 - protein, 17 aa, Mycobacterium tuberculosis
VDYSLFILMRYREELRC

SEQ ID NO: 1393885 - protein, 23 aa, Mycobacterium tuberculosis
VDYSLFILMRYREELRCGRRPPD

SEQ ID NO: 1393886 - protein, 25 aa, Mycobacterium tuberculosis
VEGPYTLPSLDLLISGDPPKKRSAA

SEQ ID NO: 1393887 - protein, 17 aa, Mycobacterium tuberculosis
VELIPKAALAGLLIVIG

SEQ ID NO: 1393888 - protein, 25 aa, Mycobacterium tuberculosis
VEQQALIALPPRAFELTSWSIGTVG

SEQ ID NO: 1393889 - protein, 17 aa, Mycobacterium tuberculosis
VERADGMPVLQPGGRAS

SEQ ID NO: 1393890 - protein, 25 aa, Mycobacterium tuberculosis
VEWLEVLAMIALLPAAAALGGLFAW

SEQ ID NO: 1393891 - protein, 17 aa, Mycobacterium tuberculosis
VFAFAVNDTPDGGLTQL

SEQ ID NO: 1393892 - protein, 17 aa, Mycobacterium tuberculosis
VFAGVCWLGAVLSAAVV

SEQ ID NO: 1393893 - protein, 23 aa, Mycobacterium tuberculosis
VFAQLLLLPVAWYLIVGSHQPAI

SEQ ID NO: 1393894 - protein, 17 aa, Mycobacterium tuberculosis
VFAVPRYGGRPCSGRCC

SEQ ID NO: 1393895 - protein, 19 aa, Mycobacterium tuberculosis
VFDNLTKFITWTLPTNLGE

SEQ ID NO: 1393896 - protein, 19 aa, Mycobacterium tuberculosis
VFDVLAPLATIAALAAIGV

SEQ ID NO: 1393897 - protein, 17 aa, Mycobacterium tuberculosis
VFERLFDALVGGGLAIV

SEQ ID NO: 1393898 - protein, 18 aa, Mycobacterium tuberculosis
VFFIMQLVGQVPAALWVI

SEQ ID NO: 1393899 - protein, 24 aa, Mycobacterium tuberculosis
VFGGFYLGFLLIAAVTALILVLAA

SEQ ID NO: 1393900 - protein, 35 aa, Mycobacterium tuberculosis
VFGGLPALAFPAPSWWWLAWFGLVPLLLVVRAAPT

SEQ ID NO: 1393901 - protein, 17 aa, Mycobacterium tuberculosis
VFGLSRMARAALAIAPV

SEQ ID NO: 1393902 - protein, 34 aa, Mycobacterium tuberculosis
VFLAKLRLFRVPELLAGSFLLALLAVTAANFFTV

SEQ ID NO: 1393903 - protein, 18 aa, Mycobacterium tuberculosis
VFLGITTFAIIRILRNPR

SEQ ID NO: 1393904 - protein, 19 aa, Mycobacterium tuberculosis
VFLVSRIREYWLESGAARP

SEQ ID NO: 1393905 - protein, 27 aa, Mycobacterium tuberculosis
VFSALYLPLLAILFGIILRAVAIEWRG

SEQ ID NO: 1393906 - protein, 18 aa, Mycobacterium tuberculosis
VFSRFWRSDPSRVRRSGG

SEQ ID NO: 1393907 - protein, 24 aa, Mycobacterium tuberculosis
VFVAFQLMFAIITVALISGAVADR

SEQ ID NO: 1393908 - protein, 18 aa, Mycobacterium tuberculosis
VFVPRVWVAIVAVATLVA

SEQ ID NO: 1393909 - protein, 23 aa, Mycobacterium tuberculosis
VGAEVPLLMTLLQRGRVAGAADA

SEQ ID NO: 1393910 - protein, 17 aa, Mycobacterium tuberculosis
VGALPWLTASALGSSLT

SEQ ID NO: 1393911 - protein, 25 aa, Mycobacterium tuberculosis
VGALSGLWLGIAGWSLWAANSPGMG

SEQ ID NO: 1393912 - protein, 17 aa, Mycobacterium tuberculosis
VGDKVQIMGLPVGSIDK

SEQ ID NO: 1393913 - protein, 17 aa, Mycobacterium tuberculosis
VGFLGWSMGGYGALLLG

SEQ ID NO: 1393914 - protein, 21 aa, Mycobacterium tuberculosis
VGFLILILLLIFIAQNTASAQ

SEQ ID NO: 1393915 - protein, 26 aa, Mycobacterium tuberculosis
VGGALLYLTIMTLMNATNLRGILGRL

SEQ ID NO: 1393916 - protein, 20 aa, Mycobacterium tuberculosis
VGGWLLVVGLTLACAGLLWS

SEQ ID NO: 1393917 - protein, 43 aa, Mycobacterium tuberculosis
VGIECLIAIPLRRDPLLFPFQPIHVTIAAWFTIGIPAFILSLA

SEQ ID NO: 1393918 - protein, 29 aa, Mycobacterium tuberculosis
VGIHRHVLSALWWAALAGTATVVIRWVVQ

SEQ ID NO: 1393919 - protein, 32 aa, Mycobacterium tuberculosis
VGKLEFAGYFAWLAWLVLHLVYLVGYRNRIAA

SEQ ID NO: 1393920 - protein, 19 aa, Mycobacterium tuberculosis
VGLGAFGLGVLTRPSPPPT

SEQ ID NO: 1393921 - protein, 18 aa, Mycobacterium tuberculosis
VGLGYWRNPQQTEATFRA

SEQ ID NO: 1393922 - protein, 22 aa, Mycobacterium tuberculosis
VGLLGAALQRLPGRCWPVSATA

SEQ ID NO: 1393923 - protein, 19 aa, Mycobacterium tuberculosis
VGLVLLALDFRITVLTAAG

SEQ ID NO: 1393924 - protein, 23 aa, Mycobacterium tuberculosis
VGPIVLLFRRNAGLPGKWLGMGV

SEQ ID NO: 1393925 - protein, 17 aa, Mycobacterium tuberculosis
VGQWLAALLFAGALLAE

SEQ ID NO: 1393926 - protein, 19 aa, Mycobacterium tuberculosis
VGRWVAVVAVLAVLTVVVT

SEQ ID NO: 1393927 - protein, 17 aa, Mycobacterium tuberculosis
VGSWWRYRYDKFGWTTR

SEQ ID NO: 1393928 - protein, 17 aa, Mycobacterium tuberculosis
VGSYQRMATITDSFQQL

SEQ ID NO: 1393929 - protein, 23 aa, Mycobacterium tuberculosis
VGTPAMWWLAVPVLAYAGWRMFV

SEQ ID NO: 1393930 - protein, 25 aa, Mycobacterium tuberculosis
VGVATCWEVIFDRAPRKSILGGAQL

SEQ ID NO: 1393931 - protein, 24 aa, Mycobacterium tuberculosis
VGVMLSMFLLAFAGIPLTSGFVSK

SEQ ID NO: 1393932 - protein, 23 aa, Mycobacterium tuberculosis
VGVPLYLLLGWVAVWYTATILHN

SEQ ID NO: 1393933 - protein, 22 aa, Mycobacterium tuberculosis
VGYCAGWLPWFADIDRQMYFFY

SEQ ID NO: 1393934 - protein, 22 aa, Mycobacterium tuberculosis
VGYLFYWAIIGIDPGPRRLPYP

SEQ ID NO: 1393935 - protein, 19 aa, Mycobacterium tuberculosis
VHDIAPMRVARREALLDLG

SEQ ID NO: 1393936 - protein, 27 aa, Mycobacterium tuberculosis
VHKVGPVIRLPLVLGLAQLLSRVPLPG

SEQ ID NO: 1393937 - protein, 33 aa, Mycobacterium tuberculosis
VHKVGPVIRLPLVLGLAQLLSRVPLPGSAPRPA

SEQ ID NO: 1393938 - protein, 24 aa, Mycobacterium tuberculosis
VHLILWDIGGALLATLYGLANRVF

SEQ ID NO: 1393939 - protein, 26 aa, Mycobacterium tuberculosis
VHNRLLTLLLFDIGSFAGLAALLNSA

SEQ ID NO: 1393940 - protein, 25 aa, Mycobacterium tuberculosis
VIAELEASLLLYFGGVSRLSSEVIA

SEQ ID NO: 1393941 - protein, 27 aa, Mycobacterium tuberculosis
VIDITIIFIGYILGLMLWATALTQFDE

SEQ ID NO: 1393942 - protein, 23 aa, Mycobacterium tuberculosis
VIGALVVWWGWRERRDLFSGFGW

SEQ ID NO: 1393943 - protein, 20 aa, Mycobacterium tuberculosis
VIGSLVVVLALAAGIVGVRL

SEQ ID NO: 1393944 - protein, 23 aa, Mycobacterium tuberculosis
VIGTFVVPPILKVLRERDAMVAK

SEQ ID NO: 1393945 - protein, 17 aa, Mycobacterium tuberculosis
VIGWPFVGLLALGLVYV

SEQ ID NO: 1393946 - protein, 18 aa, Mycobacterium tuberculosis
VIMDLRDHWMAKAPYILG

SEQ ID NO: 1393947 - protein, 21 aa, Mycobacterium tuberculosis
VIRLIRRLLPALVVVLAGCAL

SEQ ID NO: 1393948 - protein, 26 aa, Mycobacterium tuberculosis
VISDGELFIMGRIKDLLIVDGRNHYP

SEQ ID NO: 1393949 - protein, 20 aa, Mycobacterium tuberculosis
VITIISTGLIFGMTLVLTGL

SEQ ID NO: 1393950 - protein, 17 aa, Mycobacterium tuberculosis
VITPAAPPPPPDHRARN

SEQ ID NO: 1393951 - protein, 22 aa, Mycobacterium tuberculosis
VITPTLWMLIGVVSRAVPVFHW

SEQ ID NO: 1393952 - protein, 17 aa, Mycobacterium tuberculosis
VIYLAARDLPPACFSIF

SEQ ID NO: 1393953 - protein, 17 aa, Mycobacterium tuberculosis
VIYRSVITAVLVLIMVG

SEQ ID NO: 1393954 - protein, 19 aa, Mycobacterium tuberculosis
VKNVLVLAAPLAALGGGVR

SEQ ID NO: 1393955 - protein, 18 aa, Mycobacterium tuberculosis
VLADALVRARLHGLRTNR

SEQ ID NO: 1393956 - protein, 24 aa, Mycobacterium tuberculosis
VLAFLASLLTHYLFGGLRLTTGRG

SEQ ID NO: 1393957 - protein, 23 aa, Mycobacterium tuberculosis
VLASFFVSTLLRVAFPDKAWADA

SEQ ID NO: 1393958 - protein, 18 aa, Mycobacterium tuberculosis
VLATQYWLVTSAGPMLVL

SEQ ID NO: 1393959 - protein, 23 aa, Mycobacterium tuberculosis
VLAVANLMWFVFAGFGALTLESN

SEQ ID NO: 1393960 - protein, 19 aa, Mycobacterium tuberculosis
VLDTFLVRTVTVPALTTMI

SEQ ID NO: 1393961 - protein, 17 aa, Mycobacterium tuberculosis
VLENLPAVLPTVVAPPL

SEQ ID NO: 1393962 - protein, 19 aa, Mycobacterium tuberculosis
VLFGVLVLQFRNAAGLTPG

SEQ ID NO: 1393963 - protein, 17 aa, Mycobacterium tuberculosis
VLGILFASTIGLFLMVV

SEQ ID NO: 1393964 - protein, 19 aa, Mycobacterium tuberculosis
VLGLAQLLSRVPLPGSAPR

SEQ ID NO: 1393965 - protein, 19 aa, Mycobacterium tuberculosis
VLIILLPPGRRRLAKWAGM

SEQ ID NO: 1393966 - protein, 23 aa, Mycobacterium tuberculosis
VLIKWWLLAIPHYLILAVFLSSG

SEQ ID NO: 1393967 - protein, 37 aa, Mycobacterium tuberculosis
VLILSITTLIFGFLVMWILAWLTAAPVRVVRAALKRV

SEQ ID NO: 1393968 - protein, 17 aa, Mycobacterium tuberculosis
VLKRFGPLTPPRAVAII

SEQ ID NO: 1393969 - protein, 17 aa, Mycobacterium tuberculosis
VLLAFALGLLTLGLIKG

SEQ ID NO: 1393970 - protein, 17 aa, Mycobacterium tuberculosis
VLLEVWPVIAVGALAWL

SEQ ID NO: 1393971 - protein, 17 aa, Mycobacterium tuberculosis
VLLGQLIGARPLSFLLT

SEQ ID NO: 1393972 - protein, 17 aa, Mycobacterium tuberculosis
VLLGRYINYTLDLAGIA

SEQ ID NO: 1393973 - protein, 18 aa, Mycobacterium tuberculosis
VLLNYPFSRYDSMALAAF

SEQ ID NO: 1393974 - protein, 22 aa, Mycobacterium tuberculosis
VLLPFFSFMTYLIAVPTGIKFF

SEQ ID NO: 1393975 - protein, 18 aa, Mycobacterium tuberculosis
VLLVNVPLGIVAAIATKR

SEQ ID NO: 1393976 - protein, 18 aa, Mycobacterium tuberculosis
VLLVVMRHRNRRRRADEL

SEQ ID NO: 1393977 - protein, 17 aa, Mycobacterium tuberculosis
VLRIACFYVGSTVLLAL

SEQ ID NO: 1393978 - protein, 36 aa, Mycobacterium tuberculosis
VLRRRPRFRASIQSKLMVLLLLTSIVSVAAIAAIVY

SEQ ID NO: 1393979 - protein, 17 aa, Mycobacterium tuberculosis
VLSIVWGGAIAGILLRC

SEQ ID NO: 1393980 - protein, 17 aa, Mycobacterium tuberculosis
VLSLLGMVLLMLGTGRL

SEQ ID NO: 1393981 - protein, 19 aa, Mycobacterium tuberculosis
VLSVRQLMVRPVSAAALSR

SEQ ID NO: 1393982 - protein, 28 aa, Mycobacterium tuberculosis
VLTGLRLLAGLIWLYNVVWKVPPDFGER

SEQ ID NO: 1393983 - protein, 19 aa, Mycobacterium tuberculosis
VLTLRRWLRPATAAVVCCL

SEQ ID NO: 1393984 - protein, 29 aa, Mycobacterium tuberculosis
VLTTAFGFLVLLLSLLNATLFQGAPQQSW

SEQ ID NO: 1393985 - protein, 21 aa, Mycobacterium tuberculosis
VLVGIAFLRAPCRVVYVIDEP

SEQ ID NO: 1393986 - protein, 19 aa, Mycobacterium tuberculosis
VLVLAPFWLIPTSLDVHLS

SEQ ID NO: 1393987 - protein, 17 aa, Mycobacterium tuberculosis
VLVLLKAVAYWLDRYEL

SEQ ID NO: 1393988 - protein, 19 aa, Mycobacterium tuberculosis
VLVTCAAFTFLNPHVYLDT

SEQ ID NO: 1393989 - protein, 24 aa, Mycobacterium tuberculosis
VLVTVAASLLAGLLAHVADRLLGL

SEQ ID NO: 1393990 - protein, 25 aa, Mycobacterium tuberculosis
VLVTVAASLLAGLLAHVADRLLGLS

SEQ ID NO: 1393991 - protein, 18 aa, Mycobacterium tuberculosis
VLVVSLLYYRVLGLLTAL

SEQ ID NO: 1393992 - protein, 19 aa, Mycobacterium tuberculosis
VLWLVPLAGAVLIILLPPG

SEQ ID NO: 1393993 - protein, 17 aa, Mycobacterium tuberculosis
VMLLAWLGLGRRVLAGE

SEQ ID NO: 1393994 - protein, 19 aa, Mycobacterium tuberculosis
VMMALAWLMLGRFTLGRRR

SEQ ID NO: 1393995 - protein, 18 aa, Mycobacterium tuberculosis
VMMLWIVGVGLGRGRVRR

SEQ ID NO: 1393996 - protein, 30 aa, Mycobacterium tuberculosis
VNAPGVILRLMLAWIPSTGVPLLAIVLAVA

SEQ ID NO: 1393997 - protein, 25 aa, Mycobacterium tuberculosis
VNFRDVLVALVMYPGGGELGVDGAG

SEQ ID NO: 1393998 - protein, 17 aa, Mycobacterium tuberculosis
VNFWAWNLIGPLSTSYA

SEQ ID NO: 1393999 - protein, 23 aa, Mycobacterium tuberculosis
VNHGGYWFTFFVALGGAVVLLWI

SEQ ID NO: 1394000 - protein, 17 aa, Mycobacterium tuberculosis
VNWLIPVVQIGAAVAAL

SEQ ID NO: 1394001 - protein, 29 aa, Mycobacterium tuberculosis
VPAMATLLGRASWWPGHPWQRCAPEEGQM

SEQ ID NO: 1394002 - protein, 27 aa, Mycobacterium tuberculosis
VPAPALLLTAPLLLTSIPLLYAGRSVI

SEQ ID NO: 1394003 - protein, 41 aa, Mycobacterium tuberculosis; identical to SEQ ID NO: 164578

SEQ ID NO: 1394004 - protein, 21 aa, Mycobacterium tuberculosis
VPHVRWPMWLRTAVATAALAA

SEQ ID NO: 1394005 - protein, 22 aa, Mycobacterium tuberculosis
VPRPGCFEVILVAPRPAATSPG

SEQ ID NO: 1394006 - protein, 19 aa, Mycobacterium tuberculosis
VPVNANAALRWSLLAGACS

SEQ ID NO: 1394007 - protein, 17 aa, Mycobacterium tuberculosis
VRDGWAFVAIRLTSTDL

SEQ ID NO: 1394008 - protein, 19 aa, Mycobacterium tuberculosis
VRGLLLGSALLNAAAALLC

SEQ ID NO: 1394009 - protein, 20 aa, Mycobacterium tuberculosis
VRGPNLAWLLAAYGVAGLVS

SEQ ID NO: 1394010 - protein, 20 aa, Mycobacterium tuberculosis
VRMTFRSSRLVYPMRLSVAA

SEQ ID NO: 1394011 - protein, 38 aa, Mycobacterium tuberculosis
VRPVSILYRLYRPLIFALYCLPLNWLRRKHGLSSLGWD

SEQ ID NO: 1394012 - protein, 23 aa, Mycobacterium tuberculosis
VRQFNDLLRVLPPLPQEMPQQPG

SEQ ID NO: 1394013 - protein, 25 aa, Mycobacterium tuberculosis
VRQRFFALFLYVVMLVFLVATAPVM

SEQ ID NO: 1394014 - protein, 20 aa, Mycobacterium tuberculosis
VRQVMWPKIGGSQVLHDAFP

SEQ ID NO: 1394015 - protein, 30 aa, Mycobacterium tuberculosis
VRRGGRRPGWVLLTALLVLAIGASSALVFT

SEQ ID NO: 1394016 - protein, 18 aa, Mycobacterium tuberculosis
VRSLPDFWRLLQVRVASQ

SEQ ID NO: 1394017 - protein, 21 aa, Mycobacterium tuberculosis
VRSTPGLRYRIYRPAVVVGDS

SEQ ID NO: 1394018 - protein, 34 aa, Mycobacterium tuberculosis
VRSYMTPALATLLGRWFWWPRRVDRLARQPQVLG

SEQ ID NO: 1394019 - protein, 27 aa, Mycobacterium tuberculosis
VRTPRPQLTAAFGGALWAARRPGDTSA

SEQ ID NO: 1394020 - protein, 29 aa, Mycobacterium tuberculosis
VRTPRPQLTAAFGGALWAARRPGDTSATV

SEQ ID NO: 1394021 - protein, 26 aa, Mycobacterium tuberculosis
VSAAAVLLAMALWLGAGPSVVRARAG

SEQ ID NO: 1394022 - protein, 27 aa, Mycobacterium tuberculosis
VSAAAVLLAMALWLGAGPSVVRARAGR

SEQ ID NO: 1394023 - protein, 33 aa, Mycobacterium tuberculosis
VSALVVFEVMVRPLIRLSLGKRHPMRRIVSART

SEQ ID NO: 1394024 - protein, 20 aa, Mycobacterium tuberculosis
VSEWLLVQSLIHAAPGHDPI

SEQ ID NO: 1394025 - protein, 20 aa, Mycobacterium tuberculosis
VSFTTLRLIYQEMLANYRVG

SEQ ID NO: 1394026 - protein, 19 aa, Mycobacterium tuberculosis
VSHMWVVKFLRTHGLIHDC

SEQ ID NO: 1394027 - protein, 22 aa, Mycobacterium tuberculosis
VSILLTPVLIRLFTKQGFGHQI

SEQ ID NO: 1394028 - protein, 42 aa, Mycobacterium tuberculosis; identical to SEQ ID NO: 164978

SEQ ID NO: 1394029 - protein, 43 aa, Mycobacterium tuberculosis
VSKGNQFVMPDLSGMFWVDAEPRLRALGWTGMLDKGADVDAGG

SEQ ID NO: 1394030 - protein, 17 aa, Mycobacterium tuberculosis
VSMLPVALALAAVTAAT

SEQ ID NO: 1394031 - protein, 18 aa, Mycobacterium tuberculosis
VSPIDFWEHPTINALAAY

SEQ ID NO: 1394032 - protein, 27 aa, Mycobacterium tuberculosis
VSPPPIDERWLPESALPAPPRPTVQRE

SEQ ID NO: 1394033 - protein, 17 aa, Mycobacterium tuberculosis
VSTASIWMRLPTLAMAL

SEQ ID NO: 1394034 - protein, 27 aa, Mycobacterium tuberculosis
VSVPAGPRPWQGPIAVLVAVTAGAALA

SEQ ID NO: 1394035 - protein, 25 aa, Mycobacterium tuberculosis
VTAEYQSWRVVWGSAAALLTVGVGI

SEQ ID NO: 1394036 - protein, 27 aa, Mycobacterium tuberculosis
VTAGMGMLALLLFGPRLVDIYVDWLWF

SEQ ID NO: 1394037 - protein, 29 aa, Mycobacterium tuberculosis
VTAPQPGPGRWWWFPRPAPSGPTRRTAIS

SEQ ID NO: 1394038 - protein, 24 aa, Mycobacterium tuberculosis
VTDGKMFIIGRIKDLLIVYGRNHS

SEQ ID NO: 1394039 - protein, 25 aa, Mycobacterium tuberculosis
VTDGRNILPPNKFPYIPPGADPDPG

SEQ ID NO: 1394040 - protein, 26 aa, Mycobacterium tuberculosis
VTFAIVPLLHRFGGLVAPLTFIGTAY

SEQ ID NO: 1394041 - protein, 29 aa, Mycobacterium tuberculosis
VTGRRRPVAGLHWPWVARVGTVVMSWRLR

SEQ ID NO: 1394042 - protein, 18 aa, Mycobacterium tuberculosis
VTIFAIQIALGELLRHHG

SEQ ID NO: 1394043 - protein, 17 aa, Mycobacterium tuberculosis
VTLVGILVALLAIRARL

SEQ ID NO: 1394044 - protein, 17 aa, Mycobacterium tuberculosis
VTLYLRLGDWVPVTAFV

SEQ ID NO: 1394045 - protein, 21 aa, Mycobacterium tuberculosis
VTNFAWLYPVLTGLPISQQTW

SEQ ID NO: 1394046 - protein, 38 aa, Mycobacterium tuberculosis
VTPLTSAILLPAVIALALLPISWQLGVAALAGVPLLLG

SEQ ID NO: 1394047 - protein, 29 aa, Mycobacterium tuberculosis
VTRHQVTGWRFVMRRIAAGIALHDTRMLV

SEQ ID NO: 1394048 - protein, 28 aa, Mycobacterium tuberculosis
VTRNREVWAWMVWLPHNLHDELFDACGW

SEQ ID NO: 1394049 - protein, 17 aa, Mycobacterium tuberculosis
VTRWLVVTRAAVLPMTL

SEQ ID NO: 1394050 - protein, 25 aa, Mycobacterium tuberculosis
VTSILILIAFPLLTAALLGLAADRH

SEQ ID NO: 1394051 - protein, 23 aa, Mycobacterium tuberculosis
VTSMVLYILCWWWHLKPDVDETM

SEQ ID NO: 1394052 - protein, 23 aa, Mycobacterium tuberculosis
VTSPRRWGQPKAGSLSSKEPLDT

SEQ ID NO: 1394053 - protein, 17 aa, Mycobacterium tuberculosis
VTTYLLIATAAALAVPL

SEQ ID NO: 1394054 - protein, 22 aa, Mycobacterium tuberculosis
VTVAASLLAGLLAHVADRLLGL

SEQ ID NO: 1394055 - protein, 25 aa, Mycobacterium tuberculosis
VVAGIVLAALLLAYRSRPFFVPDEP

SEQ ID NO: 1394056 - protein, 29 aa, Mycobacterium tuberculosis
VVAGIVLAALLLAYRSRPFFVPDEPQRDP

SEQ ID NO: 1394057 - protein, 34 aa, Mycobacterium tuberculosis
VVAGIVLAALLLAYRSRPFFVPDEPQRDPVAPLR

SEQ ID NO: 1394058 - protein, 20 aa, Mycobacterium tuberculosis
VVCMIWRLFMQDSVTRPTTG

SEQ ID NO: 1394059 - protein, 32 aa, Mycobacterium tuberculosis
VVCNAAVPLDWRWRRRGFFGDHGGRWCRHRSL

SEQ ID NO: 1394060 - protein, 24 aa, Mycobacterium tuberculosis
VVFAGFLVGMFYLVAATDVIDVAA

SEQ ID NO: 1394061 - protein, 20 aa, Mycobacterium tuberculosis
VVFGVLRWFFTTYRIDDENV

SEQ ID NO: 1394062 - protein, 22 aa, Mycobacterium tuberculosis
VVFVFGVLGVLLRIVSGLSIFR

SEQ ID NO: 1394063 - protein, 24 aa, Mycobacterium tuberculosis
VVGLGLFNPLSVGAGLILGRMAYK

SEQ ID NO: 1394064 - protein, 29 aa, Mycobacterium tuberculosis
VVGVALVFVQWWGQPAWSWAVLGLRGRRP

SEQ ID NO: 1394065 - protein, 24 aa, Mycobacterium tuberculosis
VVGVFALRRVWWLYKLVMSGQPAS

SEQ ID NO: 1394066 - protein, 25 aa, Mycobacterium tuberculosis
VVGVFALRRVWWLYKLVMSGQPASG

SEQ ID NO: 1394067 - protein, 17 aa, Mycobacterium tuberculosis
VVLDTTLIRLQCYEGLT

SEQ ID NO: 1394068 - protein, 20 aa, Mycobacterium tuberculosis
VVLELAILSIGWIISNIFGA

SEQ ID NO: 1394069 - protein, 21 aa, Mycobacterium tuberculosis
VVLELAILSIGWIISNIFGAI

SEQ ID NO: 1394070 - protein, 41 aa, Mycobacterium tuberculosis
VVLQSILAVAFGAGLFIAFDQLWRWNSIVSLVLSVMVILGL

SEQ ID NO: 1394071 - protein, 18 aa, Mycobacterium tuberculosis
VVLRIACFYVGSTVLLAL

SEQ ID NO: 1394072 - protein, 30 aa, Mycobacterium tuberculosis
VVNVHWSVLVILWLFTWSLATMLPGTVGGY

SEQ ID NO: 1394073 - protein, 17 aa, Mycobacterium tuberculosis
VVRPLPRVPQSLPLADA

SEQ ID NO: 1394074 - protein, 24 aa, Mycobacterium tuberculosis
VVSNIAAFLLWPRGFPGTIAQSIH

SEQ ID NO: 1394075 - protein, 26 aa, Mycobacterium tuberculosis
VVSQLLGCTPLDPLGWAQATAAATAA

SEQ ID NO: 1394076 - protein, 18 aa, Mycobacterium tuberculosis
VVVGLIALVAIMIAAATP

SEQ ID NO: 1394077 - protein, 21 aa, Mycobacterium tuberculosis
VVVLMSFAVYAVISAALYSDI

SEQ ID NO: 1394078 - protein, 17 aa, Mycobacterium tuberculosis
VVVWLSLHRWDLLGPLR

SEQ ID NO: 1394079 - protein, 23 aa, Mycobacterium tuberculosis
VVYEPLLGRLPADTPMYGFERVE

SEQ ID NO: 1394080 - protein, 26 aa, Mycobacterium tuberculosis
VWGMLQAAGLLFFAFAGYARIATLGE

SEQ ID NO: 1394081 - protein, 19 aa, Mycobacterium tuberculosis
VWLPGQLLQGIGVGATLPV

SEQ ID NO: 1394082 - protein, 21 aa, Mycobacterium tuberculosis
VWSLWSVMVRFMPTSVYGFSA

SEQ ID NO: 1394083 - protein, 42 aa, Mycobacterium tuberculosis
VYFGLPTWLILFLRILFTAITFGALWLLYRYYRTGDPAVFVH

SEQ ID NO: 1394084 - protein, 25 aa, Mycobacterium tuberculosis
VYGRMRLGDFWGYLAGWGFVVGKTA

SEQ ID NO: 1394085 - protein, 18 aa, Mycobacterium tuberculosis
VYLQFRGEFTPKTQLTML

SEQ ID NO: 1394086 - protein, 25 aa, Mycobacterium tuberculosis
VYNLPKMVSLLVEPWYALVGEREQV

SEQ ID NO: 1394087 - protein, 19 aa, Mycobacterium tuberculosis
WAAGLLYPAFCIGAILGNS

SEQ ID NO: 1394088 - protein, 36 aa, Mycobacterium tuberculosis; identical to SEQ ID NO: 165415

SEQ ID NO: 1394089 - protein, 37 aa, Mycobacterium tuberculosis
WACHRPNRLWWRYTAWWLLAMALATLWWVMALTQLHG

SEQ ID NO: 1394090 - protein, 26 aa, Mycobacterium tuberculosis
WAPYHLRLDWLMWFAAISPGYALPWM

SEQ ID NO: 1394091 - protein, 25 aa, Mycobacterium tuberculosis
WAPYHLRLDWLMWFAAISPGYALTW

SEQ ID NO: 1394092 - protein, 35 aa, Mycobacterium tuberculosis
WASTIDVRYRDRLLLPLPMFHVAALATVIFSAMRG

SEQ ID NO: 1394093 - protein, 17 aa, Mycobacterium tuberculosis
WDALGFLQDFFATAVFL

SEQ ID NO: 1394094 - protein, 23 aa, Mycobacterium tuberculosis
WDRHLRPMLARRFEIATGHRQAK

SEQ ID NO: 1394095 - protein, 25 aa, Mycobacterium tuberculosis
WEKHCYGIPICWSFRSIFDALDGID

SEQ ID NO: 1394096 - protein, 17 aa, Mycobacterium tuberculosis
WELAGGRFAIHATMTTV

SEQ ID NO: 1394097 - protein, 17 aa, Mycobacterium tuberculosis
WEMSFLYAIVFGGFVAF

SEQ ID NO: 1394098 - protein, 20 aa, Mycobacterium tuberculosis
WERHCFDIPICWSMRSLLNS

SEQ ID NO: 1394099 - protein, 19 aa, Mycobacterium tuberculosis
WFTTSSGVLLLWSWLVMSL

SEQ ID NO: 1394100 - protein, 19 aa, Mycobacterium tuberculosis
WGDCLAPPRPALRAALSPG

SEQ ID NO: 1394101 - protein, 20 aa, Mycobacterium tuberculosis
WGDCLAPPRPVLRAALSPGA

SEQ ID NO: 1394102 - protein, 21 aa, Mycobacterium tuberculosis
WGIIIGPVLMILIVTTIDVYL

SEQ ID NO: 1394103 - protein, 22 aa, Mycobacterium tuberculosis
WGRNIGQFQLIQLKLAKMEVAR

SEQ ID NO: 1394104 - protein, 20 aa, Mycobacterium tuberculosis
WGSFLPDIDAFDAEFFEISP

SEQ ID NO: 1394105 - protein, 18 aa, Mycobacterium tuberculosis
WHIVGLCIFGFLLAMLRG

SEQ ID NO: 1394106 - protein, 24 aa, Mycobacterium tuberculosis
WHQVTVVSSPSWFSDYVLSVGAVD

SEQ ID NO: 1394107 - protein, 19 aa, Mycobacterium tuberculosis
WICGSATGVTVLYLAYLRR

SEQ ID NO: 1394108 - protein, 21 aa, Mycobacterium tuberculosis
WIISNIFGAIPVLAGPLLGAL

SEQ ID NO: 1394109 - protein, 25 aa, Mycobacterium tuberculosis
WILNGYNIVFAAFMVAAGRLADLLG

SEQ ID NO: 1394110 - protein, 26 aa, Mycobacterium tuberculosis
WLADHAVGPVVLFPGTGFVELALRAG

SEQ ID NO: 1394111 - protein, 17 aa, Mycobacterium tuberculosis
WLADRSGSLAAPLLTHL

SEQ ID NO: 1394112 - protein, 20 aa, Mycobacterium tuberculosis
WLEEVLRPALGERLRVLDGW

SEQ ID NO: 1394113 - protein, 20 aa, Mycobacterium tuberculosis
WLEVLAMIALLPAAAALGGL

SEQ ID NO: 1394114 - protein, 21 aa, Mycobacterium tuberculosis
WLEVLAMIALLPAAAALGGLF

SEQ ID NO: 1394115 - protein, 17 aa, Mycobacterium tuberculosis
WLFPVSAAVLTWRAVRS

SEQ ID NO: 1394116 - protein, 20 aa, Mycobacterium tuberculosis
WLGAPRLGLICYLVALTMAV

SEQ ID NO: 1394117 - protein, 17 aa, Mycobacterium tuberculosis
WLHVIDARFARALRLRL

SEQ ID NO: 1394118 - protein, 27 aa, Mycobacterium tuberculosis
WLIEQPIRRWRPARVPLLPLAAATVAS

SEQ ID NO: 1394119 - protein, 22 aa, Mycobacterium tuberculosis
WMLNAYNIVFAAFLVAAGRLAD

SEQ ID NO: 1394120 - protein, 18 aa, Mycobacterium tuberculosis
WNAYTGFYGWMLQLIWQF

SEQ ID NO: 1394121 - protein, 22 aa, Mycobacterium tuberculosis
WPATRPCLWPRCRPERPAPTWC

SEQ ID NO: 1394122 - protein, 19 aa, Mycobacterium tuberculosis
WPLLLIGATLLLAARARRR

SEQ ID NO: 1394123 - protein, 25 aa, Mycobacterium tuberculosis
WPTITAVLWWIIGLAGLWLGLLGIA

SEQ ID NO: 1394124 - protein, 29 aa, Mycobacterium tuberculosis
WQDILGIELYWMVLAMSVILLLAVGSDYN

SEQ ID NO: 1394125 - protein, 24 aa, Mycobacterium tuberculosis
WQGEFLVAVIELIPRPFTPTVIVD

SEQ ID NO: 1394126 - protein, 22 aa, Mycobacterium tuberculosis
WQHILHMPLHWLVLPMAIIVML

SEQ ID NO: 1394127 - protein, 17 aa, Mycobacterium tuberculosis
WQMLSGLISLVLLLLFA

SEQ ID NO: 1394128 - protein, 27 aa, Mycobacterium tuberculosis
WQTITRELWPAPYLVMDTGASLAPYNH

SEQ ID NO: 1394129 - protein, 20 aa, Mycobacterium tuberculosis
WQWVLSALALPVVTWAAWPF

SEQ ID NO: 1394130 - protein, 17 aa, Mycobacterium tuberculosis
WRFRRRPAPARLPLWAC

SEQ ID NO: 1394131 - protein, 30 aa, Mycobacterium tuberculosis
WRLMGVIFGTMFFLMFTPTKWVHHFGLFAA

SEQ ID NO: 1394132 - protein, 17 aa, Mycobacterium tuberculosis
WRRWALLCVGIAQIALG

SEQ ID NO: 1394133 - protein, 23 aa, Mycobacterium tuberculosis
WRSRHWQRRWLPTAAAIGATLAW

SEQ ID NO: 1394134 - protein, 24 aa, Mycobacterium tuberculosis
WRVALVLFGPVLVYLTITSSLTIQ

SEQ ID NO: 1394135 - protein, 30 aa, Mycobacterium tuberculosis
WRVDIDGTLSFLLLPRLTTVLSKLPEGSEV

SEQ ID NO: 1394136 - protein, 20 aa, Mycobacterium tuberculosis
WSQLPKRLSCQLRPGPTPPA

SEQ ID NO: 1394137 - protein, 23 aa, Mycobacterium tuberculosis
WSSPTSWRAHWPRSGVTAASSPP

SEQ ID NO: 1394138 - protein, 19 aa, Mycobacterium tuberculosis
WTPVPLPEPLGSLRDKRTG

SEQ ID NO: 1394139 - protein, 20 aa, Mycobacterium tuberculosis
WVDALLRTFIGSAVVMLPLV

SEQ ID NO: 1394140 - protein, 36 aa, Mycobacterium tuberculosis
WVGTHAYWLGAQWWHPLVVVGLIALVAIMIAAATPG

SEQ ID NO: 1394141 - protein, 17 aa, Mycobacterium tuberculosis
WVGVGVAAVVTLLSVVS

SEQ ID NO: 1394142 - protein, 20 aa, Mycobacterium tuberculosis
WVMRRPWITALAASTVLLVM

SEQ ID NO: 1394143 - protein, 24 aa, Mycobacterium tuberculosis
WVSLYRAKWWWLLAAVAAAGASMH

SEQ ID NO: 1394144 - protein, 31 aa, Mycobacterium tuberculosis
YAAASVHSLLWIGVFLFLGGMAAGGCNSAGG

SEQ ID NO: 1394145 - protein, 17 aa, Mycobacterium tuberculosis
YAGSLSNLLWRGVLRRH

SEQ ID NO: 1394146 - protein, 19 aa, Mycobacterium tuberculosis
YAIVFGGFVAFSNYLPTYI

SEQ ID NO: 1394147 - protein, 17 aa, Mycobacterium tuberculosis
YALIVLAAIGGLILLVK

SEQ ID NO: 1394148 - protein, 20 aa, Mycobacterium tuberculosis
YALVLLQLRVFYAREQPWTP

SEQ ID NO: 1394149 - protein, 24 aa, Mycobacterium tuberculosis
YAPLWRTAWRRLRQRPFQYILLVL

SEQ ID NO: 1394150 - protein, 30 aa, Mycobacterium tuberculosis
YCYGLTHVLYLNYVWHYSLLKAGFAIAPAA

SEQ ID NO: 1394151 - protein, 30 aa, Mycobacterium tuberculosis
YDAALLLIVFLLLLIFIGRLINWLSRRRWD

SEQ ID NO: 1394152 - protein, 17 aa, Mycobacterium tuberculosis
YEHKVLFAVGAIVLIMA

SEQ ID NO: 1394153 - protein, 18 aa, Mycobacterium tuberculosis
YERLKSWRRGLIFAMFVF

SEQ ID NO: 1394154 - protein, 26 aa, Mycobacterium tuberculosis
YFAIIPAMFVGLYPVLDKLNVMALHS

SEQ ID NO: 1394155 - protein, 19 aa, Mycobacterium tuberculosis
YFAIMWVGGYLLGAALRLG

SEQ ID NO: 1394156 - protein, 28 aa, Mycobacterium tuberculosis
YFGAVRMVLALLPHWRERRFGPRRQRLQ

SEQ ID NO: 1394157 - protein, 25 aa, Mycobacterium tuberculosis
YGAKAGLFPFHTWLADAHSQAPAPV

SEQ ID NO: 1394158 - protein, 22 aa, Mycobacterium tuberculosis
YGALLLGARLGPARTAGICAIS

SEQ ID NO: 1394159 - protein, 17 aa, Mycobacterium tuberculosis
YGDERIFAALAKRLPKL

SEQ ID NO: 1394160 - protein, 21 aa, Mycobacterium tuberculosis
YGKVLFAITLSAAAVLVTLAG

SEQ ID NO: 1394161 - protein, 26 aa, Mycobacterium tuberculosis
YHAGVEQMWCFLPQGARDRTDRTHAN

SEQ ID NO: 1394162 - protein, 18 aa, Mycobacterium tuberculosis
YIDFDAMRLKMITTPTDW

SEQ ID NO: 1394163 - protein, 22 aa, Mycobacterium tuberculosis
YIGFLVAWQRPLAGKKTLMDLA

SEQ ID NO: 1394164 - protein, 20 aa, Mycobacterium tuberculosis
YIIALPFFGIVSEIFPVFSR

SEQ ID NO: 1394165 - protein, 25 aa, Mycobacterium tuberculosis
YISGWIPFWVTIPVNAAVTFVMFTV

SEQ ID NO: 1394166 - protein, 33 aa, Mycobacterium tuberculosis
YKVCKGLEKIPLLGHLWSWELAIPMSGIAMAVV

SEQ ID NO: 1394167 - protein, 17 aa, Mycobacterium tuberculosis
YLIAKVCVYTVLAVVQS

SEQ ID NO: 1394168 - protein, 19 aa, Mycobacterium tuberculosis
YLIGRKILTPPARPVARRL

SEQ ID NO: 1394169 - protein, 18 aa, Mycobacterium tuberculosis
YLIGSVIVSYLAALGIGV

SEQ ID NO: 1394170 - protein, 19 aa, Mycobacterium tuberculosis
YLTRVMLTAAEWTAVLINM

SEQ ID NO: 1394171 - protein, 31 aa, Mycobacterium tuberculosis
YNMPLELVLTVIPFLIISVLFYFTVVVQEKM

SEQ ID NO: 1394172 - protein, 50 aa, Mycobacterium tuberculosis
YNSDMKFIVIATIVIVFLILVILLRALVAPIYLIGSVLISYLSALGIGTL

SEQ ID NO: 1394173 - protein, 27 aa, Mycobacterium tuberculosis
YPGAILGFALLWLTATAIWLRSRRAPI

SEQ ID NO: 1394174 - protein, 22 aa, Mycobacterium tuberculosis
YPLEHCYAYSDSITDLPMLEAV

SEQ ID NO: 1394175 - protein, 23 aa, Mycobacterium tuberculosis
YPLEHCYAYSDSITDLPMLEAVG

SEQ ID NO: 1394176 - protein, 18 aa, Mycobacterium tuberculosis
YPRTGSVVVWYSPRRADR

SEQ ID NO: 1394177 - protein, 21 aa, Mycobacterium tuberculosis
YQDWVPAGGIAFGLFIVTNAA

SEQ ID NO: 1394178 - protein, 17 aa, Mycobacterium tuberculosis
YQEMLANYRVGQANSVL

SEQ ID NO: 1394179 - protein, 18 aa, Mycobacterium tuberculosis
YQPQLGVPTAWLVAPVEA

SEQ ID NO: 1394180 - protein, 36 aa, Mycobacterium tuberculosis
YRASLAIGLALLPLLALLAFWRTGRRQLADRPTPPW

SEQ ID NO: 1394181 - protein, 17 aa, Mycobacterium tuberculosis
YRDPIAGLTLSVIATIF

SEQ ID NO: 1394182 - protein, 18 aa, Mycobacterium tuberculosis
YRKWRARPRRRCGLAQLT

SEQ ID NO: 1394183 - protein, 21 aa, Mycobacterium tuberculosis
YRLLIFHGGVPPLQFWQALDT

SEQ ID NO: 1394184 - protein, 20 aa, Mycobacterium tuberculosis
YRQPYEALGGTRPGLIPGVI

SEQ ID NO: 1394185 - protein, 19 aa, Mycobacterium tuberculosis
YRRKIVDALWWAACVCCLA

SEQ ID NO: 1394186 - protein, 20 aa, Mycobacterium tuberculosis
YRYCQGFIENLSRPGADSEG

SEQ ID NO: 1394187 - protein, 29 aa, Mycobacterium tuberculosis
YSHPMLSLGLPMLFIALGGIGLPGAAVYV

SEQ ID NO: 1394188 - protein, 18 aa, Mycobacterium tuberculosis
YSRLALGIGIHDITAGYR

SEQ ID NO: 1394189 - protein, 20 aa, Mycobacterium tuberculosis
YSSIFFATPLLVTLRERTEL

SEQ ID NO: 1394190 - protein, 29 aa, Mycobacterium tuberculosis
YSTGWALWVVLAFIVFQAVAAVLALLVET

SEQ ID NO: 1394191 - protein, 19 aa, Mycobacterium tuberculosis
YTEAYLVDRPILRCVRHRG

SEQ ID NO: 1394192 - protein, 18 aa, Mycobacterium tuberculosis
YTEFAVRLPLDGWQPLES

SEQ ID NO: 1394193 - protein, 34 aa, Mycobacterium tuberculosis
YTGHYFGAWVFIAGFLLHIVVKIPHMVTGLRSIP

SEQ ID NO: 1394194 - protein, 20 aa, Mycobacterium tuberculosis
YTLPSLDLLISGDPPKKRSA

SEQ ID NO: 1394195 - protein, 26 aa, Mycobacterium tuberculosis
YTYNDVPFYFHYLGPGAQLDGPEIMT

SEQ ID NO: 1394196 - protein, 30 aa, Mycobacterium tuberculosis
YVDVDNLPQLPWWLRPFARFHADDHFADPF

SEQ ID NO: 1394197 - protein, 28 aa, Mycobacterium tuberculosis
YVHNRLLTLLLFDIGSFAGLAALLNSAV

SEQ ID NO: 1394198 - protein, 20 aa, Mycobacterium tuberculosis
YVTLGLIVWNLINAAILDGA

SEQ ID NO: 1394199 - protein, 17 aa, Mycobacterium tuberculosis
YVWGYTLLEAGMAVAPA

SEQ ID NO: 1394200 - protein, 17 aa, Mycobacterium tuberculosis
YWAAAMVLLTAWMPFNN

SEQ ID NO: 1394201 - protein, 19 aa, Mycobacterium tuberculosis
YWSGRTFWVSSCTGWCGDV

SEQ ID NO: 1394202 - protein, 17 aa, Mycobacterium tuberculosis
YYPLILTAFLLLTSIIV

SEQ ID NO: 1394203 - protein, 18 aa, Mycobacterium tuberculosis
YYQIHVLIGLALFALWPF

SEQ ID NO: 1394204 - protein, 19 aa, Mycobacterium tuberculosis
YYVKVQTLAALRWASEEHT

SEQ ID NO: 1394205 - protein, 23 aa, Mycobacterium tuberculosis
AAALALFVLLLGPTLFLLQSWVQ

SEQ ID NO: 1394206 - protein, 24 aa, Mycobacterium tuberculosis
AAVTLLPAILVLASPRGWVAPRGE

SEQ ID NO: 1394207 - protein, 20 aa, Mycobacterium tuberculosis
AAWLALLGLPLLLVAHRLPD

SEQ ID NO: 1394208 - protein, 25 aa, Mycobacterium tuberculosis
AGFLMLLWVFIWSVLRILKTDIYAP

SEQ ID NO: 1394209 - protein, 20 aa, Mycobacterium tuberculosis
ALALLPISWQLGVAALAGVP

SEQ ID NO: 1394210 - protein, 19 aa, Mycobacterium tuberculosis
ALALYLAAALMIWAQARLL

SEQ ID NO: 1394211 - protein, 24 aa, Mycobacterium tuberculosis
APQRAWLWLGWLSAATVAGWVLDA

SEQ ID NO: 1394212 - protein, 20 aa, Mycobacterium tuberculosis
ARGSPLRIMILLVLVSALAS

SEQ ID NO: 1394213 - protein, 18 aa, Mycobacterium tuberculosis
ASSWLVRRPPLHGLTPSA

SEQ ID NO: 1394214 - protein, 25 aa, Mycobacterium tuberculosis
ATGDWLLAIPWWTWAFVFGLGAFLL

SEQ ID NO: 1394215 - protein, 24 aa, Mycobacterium tuberculosis
DHGLWVAFWFFLAQLNLILAAINL

SEQ ID NO: 1394216 - protein, 33 aa, Mycobacterium tuberculosis; identical to SEQ ID NO: 165076

SEQ ID NO: 1394217 - protein, 26 aa, Mycobacterium tuberculosis
FPVVQPWYLLWAIIPLAAWATRPGFR

SEQ ID NO: 1394218 - protein, 24 aa, Mycobacterium tuberculosis
GGVALWWMIGLLVAAGVLGLMVVL

SEQ ID NO: 1394219 - protein, 24 aa, Mycobacterium tuberculosis
GLVGPIFLVVYFTLGLGSLMSWMF

SEQ ID NO: 1394220 - protein, 31 aa, Mycobacterium tuberculosis; identical to SEQ ID NO: 165138

SEQ ID NO: 1394221 - protein, 20 aa, Mycobacterium tuberculosis
HDMGFVLGLILPILAGIPAV

SEQ ID NO: 1394222 - protein, 27 aa, Mycobacterium tuberculosis
HNLFKPLLLFFYFGFLIPIFKVRFEFP

SEQ ID NO: 1394223 - protein, 25 aa, Mycobacterium tuberculosis
HWEFYMALAYFKLAIIAAGIDYRRR

SEQ ID NO: 1394224 - protein, 24 aa, Mycobacterium tuberculosis
HYWLKLFVFFFPFTDQIAAFKIIM

SEQ ID NO: 1394225 - protein, 27 aa, Mycobacterium tuberculosis
IAVVVLGWYFLRIPSLVGIGRYTLYAE

SEQ ID NO: 1394226 - protein, 20 aa, Mycobacterium tuberculosis
IGLVLLLLSSLIVGAGWPLI

SEQ ID NO: 1394227 - protein, 23 aa, Mycobacterium tuberculosis
ILYIISFSLFIYGLMGLTGPKTA

SEQ ID NO: 1394228 - protein, 26 aa, Mycobacterium tuberculosis
LGFYAFELPFYRLMLSYMLVSVFLAF

SEQ ID NO: 1394229 - protein, 21 aa, Mycobacterium tuberculosis
LTVTLVWLYIEILRLLSYLQN

SEQ ID NO: 1394230 - protein, 18 aa, Mycobacterium tuberculosis
LVIVGWLTLWPFLSWLTT

SEQ ID NO: 1394231 - protein, 28 aa, Mycobacterium tuberculosis
MAMFDRWNWWLPRWLAHILPSVDFDRPL

SEQ ID NO: 1394232 - protein, 23 aa, Mycobacterium tuberculosis
MATLLGRASWWPGHPWQRCAPEE

SEQ ID NO: 1394233 - protein, 18 aa, Mycobacterium tuberculosis
MLVAAAWLALLGLPLLLV

SEQ ID NO: 1394234 - protein, 29 aa, Mycobacterium tuberculosis
MQVTLKPVPVILILLMLISGGATGWLYLE

SEQ ID NO: 1394235 - protein, 24 aa, Mycobacterium tuberculosis
NRRRPLLHLLTFLCGGYTMAGGVA

SEQ ID NO: 1394236 - protein, 22 aa, Mycobacterium tuberculosis
PEFPWSALTIVLLIGVLAAAVG

SEQ ID NO: 1394237 - protein, 27 aa, Mycobacterium tuberculosis
PGGWFTITVLLILLMIAVTAAVQIARR

SEQ ID NO: 1394238 - protein, 22 aa, Mycobacterium tuberculosis
PLSFLVLIWVFGGLLAAGLPMA

SEQ ID NO: 1394239 - protein, 17 aa, Mycobacterium tuberculosis
PTLWGWRRTPVLRWFVL

SEQ ID NO: 1394240 - protein, 27 aa, Mycobacterium tuberculosis
QAIPATLLLLRYRWLRSEPLPVRRPAS

SEQ ID NO: 1394241 - protein, 30 aa, Mycobacterium tuberculosis; identical to SEQ ID NO: 25920

SEQ ID NO: 1394242 - protein, 20 aa, Mycobacterium tuberculosis
RAVSWMWQALAATLVAAVFA

SEQ ID NO: 1394243 - protein, 17 aa, Mycobacterium tuberculosis
RAWLRLFGVLPFDYDRL

SEQ ID NO: 1394244 - protein, 17 aa, Mycobacterium tuberculosis
RCWQARAVSWMWQALAA

SEQ ID NO: 1394245 - protein, 17 aa, Mycobacterium tuberculosis
RIPAIGLVLLLLSSLIV

SEQ ID NO: 1394246 - protein, 19 aa, Mycobacterium tuberculosis
RVRLPRLSTIAMAAAVVII

SEQ ID NO: 1394247 - protein, 23 aa, Mycobacterium tuberculosis
SATAFPWVFLFPASILVLILVCA

SEQ ID NO: 1394248 - protein, 24 aa, Mycobacterium tuberculosis
SGNRAWWILAAVVVVGVLVLVGGI

SEQ ID NO: 1394249 - protein, 20 aa, Mycobacterium tuberculosis
SIEAFRRFHAALFSKDIQPA

SEQ ID NO: 1394250 - protein, 18 aa, Mycobacterium tuberculosis
SVPILAVANYWIISHMLP

SEQ ID NO: 1394251 - protein, 23 aa, Mycobacterium tuberculosis
SVPRWLWIVLAIGFLTAALAGGT

SEQ ID NO: 1394252 - protein, 17 aa, Mycobacterium tuberculosis
TVLLIFTLNILLAQFGA

SEQ ID NO: 1394253 - protein, 22 aa, Mycobacterium tuberculosis
VALASLLWQLLLVSAGAFLRSR

SEQ ID NO: 1394254 - protein, 20 aa, Mycobacterium tuberculosis
VALLVSAWWLFEALRHPVRS

SEQ ID NO: 1394255 - protein, 26 aa, Mycobacterium tuberculosis
VDTLSLFVGWLWPLWDSRRRTFADLL

SEQ ID NO: 1394256 - protein, 26 aa, Mycobacterium tuberculosis
VFGLALLLIFLFWPWEFKAADGESDF

SEQ ID NO: 1394257 - protein, 27 aa, Mycobacterium tuberculosis
VLFIGAVLILGFWAPGFFVTTKLDVIK

SEQ ID NO: 1394258 - protein, 24 aa, Mycobacterium tuberculosis
VQPTFLYELIWNVLVFVALIYIDR

SEQ ID NO: 1394259 - protein, 25 aa, Mycobacterium tuberculosis
VSLAYLYVVLLFAPVLIVLERLPIV

SEQ ID NO: 1394260 - protein, 25 aa, Mycobacterium tuberculosis
VSMGIILLGLLWYAGLPLRVFLSSL

SEQ ID NO: 1394261 - protein, 17 aa, Mycobacterium tuberculosis
VTMLLPLVTIGASLMTA

SEQ ID NO: 1394262 - protein, 23 aa, Mycobacterium tuberculosis
VVVALGGGALWWCVARRSWHAPR

SEQ ID NO: 1394263 - protein, 18 aa, Mycobacterium tuberculosis
VVVFAVVLVFYIVTSRDD

SEQ ID NO: 1394264 - protein, 21 aa, Mycobacterium tuberculosis
YSTFFFFFFVAELLDTWIWRW

SEQ ID NO: 1394265 - protein, 19 aa, Mycobacterium tuberculosis
AEKLVFPVLLGILTLLLSA

SEQ ID NO: 1394266 - protein, 21 aa, Mycobacterium tuberculosis
AGWFGLFGLAFWVALAGLTPS

SEQ ID NO: 1394267 - protein, 26 aa, Mycobacterium tuberculosis
AHARRLLRRLLVAAVLFVPLADLSTL

SEQ ID NO: 1394268 - protein, 25 aa, Mycobacterium tuberculosis
AKVWGFLFIYFWLRATLPRLRYDQF

SEQ ID NO: 1394269 - protein, 21 aa, Mycobacterium tuberculosis
ALGILVMVVWVGTALTISTTA

SEQ ID NO: 1394270 - protein, 23 aa, Mycobacterium tuberculosis
ALTVWVVGYALRPLRRVAATAAE

SEQ ID NO: 1394271 - protein, 20 aa, Mycobacterium tuberculosis
APHHFLLTEWFAPYVEFLVS

SEQ ID NO: 1394272 - protein, 20 aa, Mycobacterium tuberculosis
ASLHWYTWLAFSGWVAVAVI

SEQ ID NO: 1394273 - protein, 28 aa, Mycobacterium tuberculosis
AVIFIMLLLVYRSIITVVLLLITVGVEL

SEQ ID NO: 1394274 - protein, 18 aa, Mycobacterium tuberculosis
AVWKPLLPGYTRPHMRLF

SEQ ID NO: 1394275 - protein, 24 aa, Mycobacterium tuberculosis
AYDIGLFYRYAWQNPVFADIVATR

SEQ ID NO: 1394276 - protein, 18 aa, Mycobacterium tuberculosis
DVNTWWAFRTSCTPTECL

SEQ ID NO: 1394277 - protein, 22 aa, Mycobacterium tuberculosis
ELLVVMLPLIGVLYVGIKALSS

SEQ ID NO: 1394278 - protein, 25 aa, Mycobacterium tuberculosis
EPKSPPIPWYRLPAVIITGTTVAVL

SEQ ID NO: 1394279 - protein, 17 aa, Mycobacterium tuberculosis
FAALIAVLLLTAPALGG

SEQ ID NO: 1394280 - protein, 30 aa, Mycobacterium tuberculosis; identical to SEQ ID NO: 165084

SEQ ID NO: 1394281 - protein, 22 aa, Mycobacterium tuberculosis
FAQLGLWRWAFGVMTLLTALMA

SEQ ID NO: 1394282 - protein, 33 aa, Mycobacterium tuberculosis; identical to SEQ ID NO: 165089

SEQ ID NO: 1394283 - protein, 18 aa, Mycobacterium tuberculosis
FPVLLGILTLLLSACQTA

SEQ ID NO: 1394284 - protein, 18 aa, Mycobacterium tuberculosis
FTFMTPAAFVRRPGRWIR

SEQ ID NO: 1394285 - protein, 21 aa, Mycobacterium tuberculosis
GAFAVLFLPYSLLGPFAGALM

SEQ ID NO: 1394286 - protein, 23 aa, Mycobacterium tuberculosis
GAYPMYLDAYPLPQYAIYGAVPL

SEQ ID NO: 1394287 - protein, 21 aa, Mycobacterium tuberculosis
GEYLPMPWLFRHLSGYADRAG

SEQ ID NO: 1394288 - protein, 26 aa, Mycobacterium tuberculosis
GFAHSWFFLFLFVVAGLVALYILMQL

SEQ ID NO: 1394289 - protein, 29 aa, Mycobacterium tuberculosis
GGLILLVKKIWWPLAVWLLLIVMNVDAGT

SEQ ID NO: 1394290 - protein, 20 aa, Mycobacterium tuberculosis
GIALWLPWLIAAGVAFILAS

SEQ ID NO: 1394291 - protein, 17 aa, Mycobacterium tuberculosis
GITFLGMRFAKLGVFST

SEQ ID NO: 1394292 - protein, 25 aa, Mycobacterium tuberculosis
GSIFPLFMMVGIMMMMFRGMGGGQQ

SEQ ID NO: 1394293 - protein, 18 aa, Mycobacterium tuberculosis
GWALAVVVIVLALAAIAI

SEQ ID NO: 1394294 - protein, 17 aa, Mycobacterium tuberculosis
GYWFTFFVALGGAVVLL

SEQ ID NO: 1394295 - protein, 19 aa, Mycobacterium tuberculosis
HGSLWVLPLRWSMVEYFYI

SEQ ID NO: 1394296 - protein, 20 aa, Mycobacterium tuberculosis
HPGLPLWPYLVCAALTGLGG

SEQ ID NO: 1394297 - protein, 26 aa, Mycobacterium tuberculosis
IFVLPALLMIGWWSGFPYWTTAAVCA

SEQ ID NO: 1394298 - protein, 22 aa, Mycobacterium tuberculosis
KFEPYRLWQPPLTQPVAIDDLV

SEQ ID NO: 1394299 - protein, 20 aa, Mycobacterium tuberculosis
KGDFLLGLLLPHGLLELTAV

SEQ ID NO: 1394300 - protein, 24 aa, Mycobacterium tuberculosis
KWSYYYLYVILDIFSRYVVGWMVA

SEQ ID NO: 1394301 - protein, 24 aa, Mycobacterium tuberculosis
LAIKPDICFLWDEAWYAFATAVPW

SEQ ID NO: 1394302 - protein, 18 aa, Mycobacterium tuberculosis
LDLDALLGGFRPLFQTLD

SEQ ID NO: 1394303 - protein, 19 aa, Mycobacterium tuberculosis
LHYRHEVLYFKVLADHLPE

SEQ ID NO: 1394304 - protein, 17 aa, Mycobacterium tuberculosis
LIAIPLRRDPLLFPFQP

SEQ ID NO: 1394305 - protein, 17 aa, Mycobacterium tuberculosis
LISLFYKAIYTGGPINE

SEQ ID NO: 1394306 - protein, 20 aa, Mycobacterium tuberculosis
LLPAVIALALLPISWQLGVA

SEQ ID NO: 1394307 - protein, 25 aa, Mycobacterium tuberculosis
LQGKPAVLWFWTPWCPFCNAEAPSL

SEQ ID NO: 1394308 - protein, 20 aa, Mycobacterium tuberculosis
LRRALPYLIGILIVGMIVAL

SEQ ID NO: 1394309 - protein, 34 aa, Mycobacterium tuberculosis; identical to SEQ ID NO: 165234

SEQ ID NO: 1394310 - protein, 25 aa, Mycobacterium tuberculosis
LTDYLSWRWAFWINVPVSIAVLTVA

SEQ ID NO: 1394311 - protein, 27 aa, Mycobacterium tuberculosis
LVGGLAWPFLLLPQLGMIRGAAVTGIV

SEQ ID NO: 1394312 - protein, 19 aa, Mycobacterium tuberculosis
MAMWIIGMVAAIGLALWIG

SEQ ID NO: 1394313 - protein, 25 aa, Mycobacterium tuberculosis
NGAPEAMWWTLYLACYLAGGWGSAW

SEQ ID NO: 1394314 - protein, 23 aa, Mycobacterium tuberculosis
NTRQLLLVNMLTDALPAAALAVS

SEQ ID NO: 1394315 - protein, 17 aa, Mycobacterium tuberculosis
NVHWSVLVILWLFTWSL

SEQ ID NO: 1394316 - protein, 26 aa, Mycobacterium tuberculosis
PALKYLSYRLFMKRYDARWLVTRMTT

SEQ ID NO: 1394317 - protein, 25 aa, Mycobacterium tuberculosis
PARWRHWWWALLLAFVPIHLVVSAI

SEQ ID NO: 1394318 - protein, 24 aa, Mycobacterium tuberculosis
PATRWGPILQWILVGAAAAVVLVA

SEQ ID NO: 1394319 - protein, 21 aa, Mycobacterium tuberculosis
PVPLIVAVTLSLLALLLIRQL

SEQ ID NO: 1394320 - protein, 23 aa, Mycobacterium tuberculosis
QEAALTWLLLVSVPILAVANYWI

SEQ ID NO: 1394321 - protein, 23 aa, Mycobacterium tuberculosis
QGGRFLCTFPFSFEITEGEDRYV

SEQ ID NO: 1394322 - protein, 19 aa, Mycobacterium tuberculosis
QPTSWWPLRWYPQNYRTAT

SEQ ID NO: 1394323 - protein, 26 aa, Mycobacterium tuberculosis
QVLTGLLFLLFGLWLLFDDALGFRSV

SEQ ID NO: 1394324 - protein, 21 aa, Mycobacterium tuberculosis
RILIMIALGVIVLLLAGPRLI

SEQ ID NO: 1394325 - protein, 23 aa, Mycobacterium tuberculosis
RILVGAVAVLLLAGLFAVGIVIG

SEQ ID NO: 1394326 - protein, 20 aa, Mycobacterium tuberculosis
RTANWWWALLGLAVSALTYV

SEQ ID NO: 1394327 - protein, 28 aa, Mycobacterium tuberculosis
RWRHVPAILLVLSLLLFTIAMAGPTHDV

SEQ ID NO: 1394328 - protein, 22 aa, Mycobacterium tuberculosis
SMVEYFYIKYYLPRGRSRPVIE

SEQ ID NO: 1394329 - protein, 22 aa, Mycobacterium tuberculosis
SRPRWSGRRLAFVVALVTVLMT

SEQ ID NO: 1394330 - protein, 21 aa, Mycobacterium tuberculosis
SVALFFVWMITVAFLYLVLGG

SEQ ID NO: 1394331 - protein, 25 aa, Mycobacterium tuberculosis
SVLLLPLHLLLLPWSSMRSSMHDGF

SEQ ID NO: 1394332 - protein, 24 aa, Mycobacterium tuberculosis
TLLLPLLWRMPDTARWYLLKGRIA

SEQ ID NO: 1394333 - protein, 28 aa, Mycobacterium tuberculosis
TTLIFGFLVMWILAWLTAAPVRVVRAAL

SEQ ID NO: 1394334 - protein, 21 aa, Mycobacterium tuberculosis
TTLTLIYPTLTLPSWSAGSRV

SEQ ID NO: 1394335 - protein, 17 aa, Mycobacterium tuberculosis
VFGMRLVFPLAIIWTTA

SEQ ID NO: 1394336 - protein, 18 aa, Mycobacterium tuberculosis
VGVIVWGLIFWSAVFHRK

SEQ ID NO: 1394337 - protein, 24 aa, Mycobacterium tuberculosis
VIARPYQWWRLALVLASGLAYVVI

SEQ ID NO: 1394338 - protein, 24 aa, Mycobacterium tuberculosis
VLSGAWLGLFIGLVLGFFSPNPWS

SEQ ID NO: 1394339 - protein, 18 aa, Mycobacterium tuberculosis
VSSVLPLAAPWLRDLRAG

SEQ ID NO: 1394340 - protein, 21 aa, Mycobacterium tuberculosis
VTLCWLLISYGFAASVLPVWL

SEQ ID NO: 1394341 - protein, 17 aa, Mycobacterium tuberculosis
WARYNVPWQPAFVFYRA

SEQ ID NO: 1394342 - protein, 18 aa, Mycobacterium tuberculosis
WIGALLGVLFVLTTALGD

SEQ ID NO: 1394343 - protein, 23 aa, Mycobacterium tuberculosis
WRNRPVLVFVLDAGMPGLTQGKP

SEQ ID NO: 1394344 - protein, 19 aa, Mycobacterium tuberculosis
ALLTRRWALAWVALAGSAM

SEQ ID NO: 1394345 - protein, 21 aa, Mycobacterium tuberculosis
AMLRRNLLIYGLGGLVVPFIG

SEQ ID NO: 1394346 - protein, 23 aa, Mycobacterium tuberculosis
ATMLQMLIIFGIVTVIALVAATT

SEQ ID NO: 1394347 - protein, 24 aa, Mycobacterium tuberculosis
AVMNKLRWVLLIVGGIGVAVAAVA

SEQ ID NO: 1394348 - protein, 24 aa, Mycobacterium tuberculosis
AVSIPLTVLIIFTLNILLAEFGAA

SEQ ID NO: 1394349 - protein, 18 aa, Mycobacterium tuberculosis
AYRTWRWWLATAVAFFAV

SEQ ID NO: 1394350 - protein, 20 aa, Mycobacterium tuberculosis
CACLWLMLNLTALTWIRFGI

SEQ ID NO: 1394351 - protein, 25 aa, Mycobacterium tuberculosis
DHARQLLIRLAIAAVLFVPVADLSV

SEQ ID NO: 1394352 - protein, 27 aa, Mycobacterium tuberculosis
DVRYRDRLLLPLPMFHVAALTTVIFSA

SEQ ID NO: 1394353 - protein, 25 aa, Mycobacterium tuberculosis
DYADILFITPWLLLLGVAMSGLTAY

SEQ ID NO: 1394354 - protein, 20 aa, Mycobacterium tuberculosis
EAVPAFFRWLAQFEPMHQVF

SEQ ID NO: 1394355 - protein, 26 aa, Mycobacterium tuberculosis
ERDRLALWSRVLPITFTAAGLVALVG

SEQ ID NO: 1394356 - protein, 18 aa, Mycobacterium tuberculosis
FAEPLYRSVLIVYFVVMS

SEQ ID NO: 1394357 - protein, 24 aa, Mycobacterium tuberculosis
FAIIPAMFVGLYPVLDKLNVMALH

SEQ ID NO: 1394358 - protein, 18 aa, Mycobacterium tuberculosis
FAIVPLLHRFGGLVAPLT

SEQ ID NO: 1394359 - protein, 17 aa, Mycobacterium tuberculosis
FFQRVFGAGIATLVAVA

SEQ ID NO: 1394360 - protein, 23 aa, Mycobacterium tuberculosis
FHLSLRHALWWLGSLAAVASFTL

SEQ ID NO: 1394361 - protein, 19 aa, Mycobacterium tuberculosis
FLRLPYTFAIPIFGGRNWT

SEQ ID NO: 1394362 - protein, 17 aa, Mycobacterium tuberculosis
FRLLTGEAPFAAGAGAA

SEQ ID NO: 1394363 - protein, 25 aa, Mycobacterium tuberculosis
FSVGWLYWYFWVIVVGFEAVAGGKV

SEQ ID NO: 1394364 - protein, 25 aa, Mycobacterium tuberculosis
FTKFTLLMALPWLSAVAAVYVVFRW

SEQ ID NO: 1394365 - protein, 17 aa, Mycobacterium tuberculosis
GAFLRLPYTFAIPIFGG

SEQ ID NO: 1394366 - protein, 19 aa, Mycobacterium tuberculosis
GAVAWLISLFYKAIYTGGP

SEQ ID NO: 1394367 - protein, 20 aa, Mycobacterium tuberculosis
GFASLWSWFIGLVVTEFPLP

SEQ ID NO: 1394368 - protein, 20 aa, Mycobacterium tuberculosis
GLTIIFLLAVVTLQPFAIYS

SEQ ID NO: 1394369 - protein, 18 aa, Mycobacterium tuberculosis
HIAKPWRWGYLGVLLVIF

SEQ ID NO: 1394370 - protein, 17 aa, Mycobacterium tuberculosis
ILALLAVALPLASLVGW

SEQ ID NO: 1394371 - protein, 26 aa, Mycobacterium tuberculosis
ISPQTLFFPFVLLLAATALYRGNDKK

SEQ ID NO: 1394372 - protein, 27 aa, Mycobacterium tuberculosis
IVSDRGYFVFLALLPFIMGALSMSVPG

SEQ ID NO: 1394373 - protein, 24 aa, Mycobacterium tuberculosis
KLMPWLWVAWFGLGSFGVLMLWLP

SEQ ID NO: 1394374 - protein, 17 aa, Mycobacterium tuberculosis
LAIVFLIPQRIGLTVLA

SEQ ID NO: 1394375 - protein, 17 aa, Mycobacterium tuberculosis
LGVAMLLGGTWLTCVLA

SEQ ID NO: 1394376 - protein, 19 aa, Mycobacterium tuberculosis
LSLFYWWYHTLDKTAAVFV

SEQ ID NO: 1394377 - protein, 17 aa, Mycobacterium tuberculosis
LVALPLAGAAILLFGGR

SEQ ID NO: 1394378 - protein, 19 aa, Mycobacterium tuberculosis
LVFVAVIAFLMLLISIRSV

SEQ ID NO: 1394379 - protein, 22 aa, Mycobacterium tuberculosis
LVTYLLYIELLYTPIGELAQMF

SEQ ID NO: 1394380 - protein, 25 aa, Mycobacterium tuberculosis
NFFLIAFAVYFLVVLPYNTLRKKGE

SEQ ID NO: 1394381 - protein, 24 aa, Mycobacterium tuberculosis
NLRSLPVPFILNQPPPPPGPVPAP

SEQ ID NO: 1394382 - protein, 23 aa, Mycobacterium tuberculosis
PLRRLLREFRGPLALSLLLVAVQ

SEQ ID NO: 1394383 - protein, 17 aa, Mycobacterium tuberculosis
PLTGFIYAFDDMLARHN

SEQ ID NO: 1394384 - protein, 18 aa, Mycobacterium tuberculosis
PPGPPPPPYSYGGPFGGP

SEQ ID NO: 1394385 - protein, 23 aa, Mycobacterium tuberculosis
PPKGPAWRRIRVSQLLIGVSAVV

SEQ ID NO: 1394386 - protein, 30 aa, Mycobacterium tuberculosis; identical to SEQ ID NO: 165284

SEQ ID NO: 1394387 - protein, 17 aa, Mycobacterium tuberculosis
PVLLIPLTFALFTPLAV

SEQ ID NO: 1394388 - protein, 33 aa, Mycobacterium tuberculosis; identical to SEQ ID NO: 165479

SEQ ID NO: 1394389 - protein, 23 aa, Mycobacterium tuberculosis
QQYPPGWPAGPYPPGPPPPGPGS

SEQ ID NO: 1394390 - protein, 22 aa, Mycobacterium tuberculosis
RCRWLVFTGWLLALVPAVYLAM

SEQ ID NO: 1394391 - protein, 21 aa, Mycobacterium tuberculosis
RNRMAFLAALFFLLALCWATT

SEQ ID NO: 1394392 - protein, 21 aa, Mycobacterium tuberculosis
RPWMAVMFFAGFLILYGLGVM

SEQ ID NO: 1394393 - protein, 22 aa, Mycobacterium tuberculosis
SRGTVYQMWLLGGAKGPRSAGT

SEQ ID NO: 1394394 - protein, 24 aa, Mycobacterium tuberculosis
SVRSAAALWWIPAWLAMIVEVAVL

SEQ ID NO: 1394395 - protein, 26 aa, Mycobacterium tuberculosis
TAPVWITMLWPLADRPRLAPGAPGGT

SEQ ID NO: 1394396 - protein, 24 aa, Mycobacterium tuberculosis
TERIWLPFTIWLTAAPALLPPRSH

SEQ ID NO: 1394397 - protein, 23 aa, Mycobacterium tuberculosis
TLVFQLILGQEMHWSLPGLSFIL

SEQ ID NO: 1394398 - protein, 21 aa, Mycobacterium tuberculosis
TYSMDLFLRIAPELYLKRLCV

SEQ ID NO: 1394399 - protein, 20 aa, Mycobacterium tuberculosis
VDAWLRLCQTYGWAPGVMGA

SEQ ID NO: 1394400 - protein, 24 aa, Mycobacterium tuberculosis
VFNGLVAAFLWFTVLFANFAEAMA

SEQ ID NO: 1394401 - protein, 30 aa, Mycobacterium tuberculosis; identical to SEQ ID NO: 165375

SEQ ID NO: 1394402 - protein, 20 aa, Mycobacterium tuberculosis
VIPPSLLRRALPYLIGILIV

SEQ ID NO: 1394403 - protein, 21 aa, Mycobacterium tuberculosis
VLGVLFWFTFVGWVTVVIAGG

SEQ ID NO: 1394404 - protein, 23 aa, Mycobacterium tuberculosis
VLVLFTLIFFLYGGRSIWQYVTK

SEQ ID NO: 1394405 - protein, 25 aa, Mycobacterium tuberculosis
VVAGQVLFSLLLTPAIRLTNGAANW

SEQ ID NO: 1394406 - protein, 18 aa, Mycobacterium tuberculosis
WFDMAMLVALSVIYVGFV

SEQ ID NO: 1394407 - protein, 24 aa, Mycobacterium tuberculosis
AAQEWLKSILPFGGFPWGSVAFGQ

SEQ ID NO: 1394408 - protein, 22 aa, Mycobacterium tuberculosis
AAVTALALLRRASLRQAVADGV

SEQ ID NO: 1394409 - protein, 24 aa, Mycobacterium tuberculosis
AGELLFWLPYPSFATYLHVGCAQI

SEQ ID NO: 1394410 - protein, 20 aa, Mycobacterium tuberculosis
AIVVLGWYYLRIPSLVGIGQ

SEQ ID NO: 1394411 - protein, 22 aa, Mycobacterium tuberculosis
ALALLGVRRYVFARPPLLGTTG

SEQ ID NO: 1394412 - protein, 17 aa, Mycobacterium tuberculosis
ALITLLTVPLSLLVTRA

SEQ ID NO: 1394413 - protein, 27 aa, Mycobacterium tuberculosis
AMAYSWYLWHWPLLIFWLSYTGHRHAN

SEQ ID NO: 1394414 - protein, 18 aa, Mycobacterium tuberculosis
APLWPFHRWLPDAAVEST

SEQ ID NO: 1394415 - protein, 24 aa, Mycobacterium tuberculosis
ARLWRGLLVFFSRWWQLETLYRSN

SEQ ID NO: 1394416 - protein, 28 aa, Mycobacterium tuberculosis
ATALPLRLISWLLMPISRLLVLLGNALT

SEQ ID NO: 1394417 - protein, 25 aa, Mycobacterium tuberculosis
AVVIVLLWLGFTAFVNLAVPQLEVV

SEQ ID NO: 1394418 - protein, 18 aa, Mycobacterium tuberculosis
DFDDFWRPIRSYFYWEKH

SEQ ID NO: 1394419 - protein, 27 aa, Mycobacterium tuberculosis
DGEVVLLLFLPAILYWESMNTSFREIR

SEQ ID NO: 1394420 - protein, 26 aa, Mycobacterium tuberculosis
DRGVSWLPFFHDMGLITVLLASVLGH

SEQ ID NO: 1394421 - protein, 21 aa, Mycobacterium tuberculosis
EFSWQLERVLPVPVFAQTMAQ

SEQ ID NO: 1394422 - protein, 18 aa, Mycobacterium tuberculosis
ETIFRFALYAFLCATALM

SEQ ID NO: 1394423 - protein, 23 aa, Mycobacterium tuberculosis
FGLASRYIRLLPRGLVKRVVPKP

SEQ ID NO: 1394424 - protein, 25 aa, Mycobacterium tuberculosis
FTAVPLLWLLAIDAALITLGAMAFR

SEQ ID NO: 1394425 - protein, 20 aa, Mycobacterium tuberculosis
FWPWALQFVATLWVSTFLVV

SEQ ID NO: 1394426 - protein, 22 aa, Mycobacterium tuberculosis
GACIGFLWWNAAPAKIFMGDTG

SEQ ID NO: 1394427 - protein, 21 aa, Mycobacterium tuberculosis
GKVSYLALGILVAIALVIGGI

SEQ ID NO: 1394428 - protein, 18 aa, Mycobacterium tuberculosis
GLILLWRLLRRESARPVV

SEQ ID NO: 1394429 - protein, 19 aa, Mycobacterium tuberculosis
HRRVLLICTFAIGAAAVFA

SEQ ID NO: 1394430 - protein, 25 aa, Mycobacterium tuberculosis
IAVLVLWDLFGQLPLPLGVVGHEGS

SEQ ID NO: 1394431 - protein, 18 aa, Mycobacterium tuberculosis
ICTFAIGAAAVFAWLLAA

SEQ ID NO: 1394432 - protein, 25 aa, Mycobacterium tuberculosis
IGFFVFDLPFYRSVLNWLFVAVVLA

SEQ ID NO: 1394433 - protein, 19 aa, Mycobacterium tuberculosis
IGTPLFFQRVFGAGIATLV

SEQ ID NO: 1394434 - protein, 26 aa, Mycobacterium tuberculosis
IGVLLGWPLWWVSTCSVLVLLVVEGV

SEQ ID NO: 1394435 - protein, 17 aa, Mycobacterium tuberculosis
IPFLIISVLFYFTVVVQ

SEQ ID NO: 1394436 - protein, 23 aa, Mycobacterium tuberculosis
IQSKLMVLLLLTSIVSVAAIAAI

SEQ ID NO: 1394437 - protein, 19 aa, Mycobacterium tuberculosis
IRRFAVVIVLLWLGFTAFV

SEQ ID NO: 1394438 - protein, 20 aa, Mycobacterium tuberculosis
IVLLILIVLLRAIVAPLYLI

SEQ ID NO: 1394439 - protein, 21 aa, Mycobacterium tuberculosis
LANLFPFQLFLVLYGLPLEDR

SEQ ID NO: 1394440 - protein, 17 aa, Mycobacterium tuberculosis
LGILVAIALVIGGIGGV

SEQ ID NO: 1394441 - protein, 19 aa, Mycobacterium tuberculosis
LIFSRYLWAFELTSALLIT

SEQ ID NO: 1394442 - protein, 20 aa, Mycobacterium tuberculosis
LLIVFLLLLIFIGRLINWLS

SEQ ID NO: 1394443 - protein, 23 aa, Mycobacterium tuberculosis
LPFVMLGAALLWFGWYGFNAGSA

SEQ ID NO: 1394444 - protein, 19 aa, Mycobacterium tuberculosis
LVVIMPLYALALDMAFTSG

SEQ ID NO: 1394445 - protein, 20 aa, Mycobacterium tuberculosis
LWGWRRTPVLRWFVLGAAVG

SEQ ID NO: 1394446 - protein, 19 aa, Mycobacterium tuberculosis
MLMMPLMMIVMMVGGLAGS

SEQ ID NO: 1394447 - protein, 24 aa, Mycobacterium tuberculosis
PLSKWFLLIMAFGSLFMVAGKRYA

SEQ ID NO: 1394448 - protein, 24 aa, Mycobacterium tuberculosis
PPWEFYFWHHTIPAPVWVAVIMGL

SEQ ID NO: 1394449 - protein, 19 aa, Mycobacterium tuberculosis
PYFTGYLPTLLLAAILTPA

SEQ ID NO: 1394450 - protein, 20 aa, Mycobacterium tuberculosis
QRWLPLILAGFTSGFLLLRG

SEQ ID NO: 1394451 - protein, 26 aa, Mycobacterium tuberculosis
RARYRPLWVFLLVPVLILLTVSGRWL

SEQ ID NO: 1394452 - protein, 18 aa, Mycobacterium tuberculosis
RLLPYMIGAFLLIVGASV

SEQ ID NO: 1394453 - protein, 25 aa, Mycobacterium tuberculosis
RNPEVWAWMVWLPHNLHDELFDACG

SEQ ID NO: 1394454 - protein, 20 aa, Mycobacterium tuberculosis
RTLLLWMLPLLIAPPMYSKD

SEQ ID NO: 1394455 - protein, 25 aa, Mycobacterium tuberculosis
SSLCLIFIIMLIITRAFIAAAVIVG

SEQ ID NO: 1394456 - protein, 24 aa, Mycobacterium tuberculosis
TAFGFLVLVLLLSLLNATLFQGAP

SEQ ID NO: 1394457 - protein, 25 aa, Mycobacterium tuberculosis
TTEWLHVPFLPVPIPVPIPQNPGAG

SEQ ID NO: 1394458 - protein, 22 aa, Mycobacterium tuberculosis
TVFTVAQWRWRWFRAAMCKTMA

SEQ ID NO: 1394459 - protein, 38 aa, Mycobacterium tuberculosis
VALQLYDFLWYPYYASYGLLLLPFFTPTLSALTALSAL

SEQ ID NO: 1394460 - protein, 17 aa, Mycobacterium tuberculosis
VAWLDRFMGIGGESALF

SEQ ID NO: 1394461 - protein, 18 aa, Mycobacterium tuberculosis
VIATIVIVFLILVILLRA

SEQ ID NO: 1394462 - protein, 18 aa, Mycobacterium tuberculosis
VLGLFTPLAAAGALAFLI

SEQ ID NO: 1394463 - protein, 21 aa, Mycobacterium tuberculosis
VMAIFYLRLPATFGIGTYGVS

SEQ ID NO: 1394464 - protein, 23 aa, Mycobacterium tuberculosis
VMVAGVILWRFFGDALSNRSHTA

SEQ ID NO: 1394465 - protein, 23 aa, Mycobacterium tuberculosis
VRRSNALLDWAYGRRFRYSETMS

SEQ ID NO: 1394466 - protein, 23 aa, Mycobacterium tuberculosis
YGDFQNFYLCDLQIKWNGFQAGG

SEQ ID NO: 1394467 - protein, 19 aa, Mycobacterium tuberculosis
YVISSWRPVLLIPLTFALF

SEQ ID NO: 1394468 - protein, 19 aa, Mycobacterium tuberculosis
AAGMFLAVWLPLDNGLRPE

SEQ ID NO: 1394469 - protein, 17 aa, Mycobacterium tuberculosis
ALLAALTVLLLIWVLRR

SEQ ID NO: 1394470 - protein, 19 aa, Mycobacterium tuberculosis
ARFWWPGLPIWVPALVTVA

SEQ ID NO: 1394471 - protein, 23 aa, Mycobacterium tuberculosis
DDELAAPRWPWVVGVAAIIAAVA

SEQ ID NO: 1394472 - protein, 23 aa, Mycobacterium tuberculosis
DLYSLGCALFRLLTGEAPFAAGA

SEQ ID NO: 1394473 - protein, 22 aa, Mycobacterium tuberculosis
EEQYYVVWPLLLIGATLLLAAR

SEQ ID NO: 1394474 - protein, 19 aa, Mycobacterium tuberculosis
FKDHLYIAGRIKDLVIIDG

SEQ ID NO: 1394475 - protein, 21 aa, Mycobacterium tuberculosis
FTLIPYALVLLQLRVFYAREQ

SEQ ID NO: 1394476 - protein, 19 aa, Mycobacterium tuberculosis
GGRALRWPRFPLVIEAAVA

SEQ ID NO: 1394477 - protein, 17 aa, Mycobacterium tuberculosis
GILTWIFVDGHFSKWLN

SEQ ID NO: 1394478 - protein, 17 aa, Mycobacterium tuberculosis
GLLVPVLTWPVSAPLLV

SEQ ID NO: 1394479 - protein, 20 aa, Mycobacterium tuberculosis
GVVLHWIIDYWNRFSLWVQH

SEQ ID NO: 1394480 - protein, 24 aa, Mycobacterium tuberculosis
GYSTVLAFWLGWPTSEVPGVYLGA

SEQ ID NO: 1394481 - protein, 19 aa, Mycobacterium tuberculosis
HVLYLNYVWHYSLLKAGFA

SEQ ID NO: 1394482 - protein, 27 aa, Mycobacterium tuberculosis
IAALLGRWFWWPLRVRSRPARTPTVPS

SEQ ID NO: 1394483 - protein, 18 aa, Mycobacterium tuberculosis
ILRLMLAWIPSTGVPLLA

SEQ ID NO: 1394484 - protein, 25 aa, Mycobacterium tuberculosis
IVAYTIIIVLILPLVIFAYAIVFAV

SEQ ID NO: 1394485 - protein, 17 aa, Mycobacterium tuberculosis
LAMFPIAALGALVVYAA

SEQ ID NO: 1394486 - protein, 19 aa, Mycobacterium tuberculosis
LDLVVVFLVTWPLVYLASK

SEQ ID NO: 1394487 - protein, 21 aa, Mycobacterium tuberculosis
LGVHRIFLITVALALLTASPA

SEQ ID NO: 1394488 - protein, 18 aa, Mycobacterium tuberculosis
LLAPLFPMTVVVPLSAFV

SEQ ID NO: 1394489 - protein, 24 aa, Mycobacterium tuberculosis
LLIGALFFPWNLYFGFRIPDSSKT

SEQ ID NO: 1394490 - protein, 18 aa, Mycobacterium tuberculosis
LLLAPLLRRLLPDNPQRA

SEQ ID NO: 1394491 - protein, 24 aa, Mycobacterium tuberculosis
LLLVLVYSLLYYRVLGLLTALSLV

SEQ ID NO: 1394492 - protein, 24 aa, Mycobacterium tuberculosis
LRENVVALTVLWLLNIGEYLQDLT

SEQ ID NO: 1394493 - protein, 17 aa, Mycobacterium tuberculosis
MLLGLIFLLWSGPGRWS

SEQ ID NO: 1394494 - protein, 17 aa, Mycobacterium tuberculosis
PGDWLYFVTIDSQGTTL

SEQ ID NO: 1394495 - protein, 21 aa, Mycobacterium tuberculosis
PVSWIMWVWYRLFAFVLGPSN

SEQ ID NO: 1394496 - protein, 22 aa, Mycobacterium tuberculosis
QWWHPLVVVGLIALVAIMIAAA

SEQ ID NO: 1394497 - protein, 20 aa, Mycobacterium tuberculosis
RLSVLALIMLPILAAVTLCA

SEQ ID NO: 1394498 - protein, 25 aa, Mycobacterium tuberculosis
SAAKLYPLLFLYPLLLLGIRAGRLN

SEQ ID NO: 1394499 - protein, 28 aa, Mycobacterium tuberculosis
SLVAAWAYPLWPVVLGLKALALAVGAST

SEQ ID NO: 1394500 - protein, 23 aa, Mycobacterium tuberculosis
SVLLWQHILAIHLHWLVLAMSVI

SEQ ID NO: 1394501 - protein, 25 aa, Mycobacterium tuberculosis
TDGIYPLLIMILLPVLVGLDVSTRR

SEQ ID NO: 1394502 - protein, 27 aa, Mycobacterium tuberculosis
TIVIVFLILVILLRALVAPIYLIGSVL

SEQ ID NO: 1394503 - protein, 19 aa, Mycobacterium tuberculosis
TLGSWLPPGPAAVADYPTV

SEQ ID NO: 1394504 - protein, 22 aa, Mycobacterium tuberculosis
VEPGIPAWRRILDDLSYEPVMA

SEQ ID NO: 1394505 - protein, 26 aa, Mycobacterium tuberculosis
VRSGHRRLWWALAGVVAFLGLVGAGV

SEQ ID NO: 1394506 - protein, 17 aa, Mycobacterium tuberculosis
VSTLLVASAWWLFAWEL

SEQ ID NO: 1394507 - protein, 20 aa, Mycobacterium tuberculosis
VVFLVTWPLVYLASKSSLLA

SEQ ID NO: 1394508 - protein, 23 aa, Mycobacterium tuberculosis
VVVLLGWSFFYFSDDTRGYKPVD

SEQ ID NO: 1394509 - protein, 21 aa, Mycobacterium tuberculosis
WSVLVILWLFTWSLATMLPGT

SEQ ID NO: 1394510 - protein, 18 aa, Mycobacterium tuberculosis
WVLGWRRPQAYPLMSHLA

SEQ ID NO: 1394511 - protein, 17 aa, Mycobacterium tuberculosis
AGLAFTLGMVLTSTLMV

SEQ ID NO: 1394512 - protein, 25 aa, Mycobacterium tuberculosis
AIYNYTWLVLMLPFGMIGVTVLTVV

SEQ ID NO: 1394513 - protein, 17 aa, Mycobacterium tuberculosis
FGLVFYVSLLPWIGELV

SEQ ID NO: 1394514 - protein, 19 aa, Mycobacterium tuberculosis
GGMVLICLFLYHVFRNRNW

SEQ ID NO: 1394515 - protein, 22 aa, Mycobacterium tuberculosis
GIGAAILLGWFTLAHRHPDQPG

SEQ ID NO: 1394516 - protein, 29 aa, Mycobacterium tuberculosis
GLTAWIAAPLLFIGALFGLLLLAGITIRE

SEQ ID NO: 1394517 - protein, 19 aa, Mycobacterium tuberculosis
IHALSLPIILFWVALTIVV

SEQ ID NO: 1394518 - protein, 23 aa, Mycobacterium tuberculosis
ILAVAMPWLFLRLRFCRRKWTVT

SEQ ID NO: 1394519 - protein, 19 aa, Mycobacterium tuberculosis
IYVDWLWFGEVGFRSVWIT

SEQ ID NO: 1394520 - protein, 19 aa, Mycobacterium tuberculosis
IYVLLPGRRMPIPQLPGAT

SEQ ID NO: 1394521 - protein, 20 aa, Mycobacterium tuberculosis
LFVAAYVPYVAWLVQASADS

SEQ ID NO: 1394522 - protein, 18 aa, Mycobacterium tuberculosis
LGPYLSIYLLLIHDWDQA

SEQ ID NO: 1394523 - protein, 27 aa, Mycobacterium tuberculosis
LGSSMFFGAYPWAGWLAFAATLPVQFV

SEQ ID NO: 1394524 - protein, 25 aa, Mycobacterium tuberculosis
LIPNGTFFVVLAIFLVVLAVIGTFV

SEQ ID NO: 1394525 - protein, 23 aa, Mycobacterium tuberculosis
LISLVLLLLFAIGGVVWGVMDGR

SEQ ID NO: 1394526 - protein, 17 aa, Mycobacterium tuberculosis
LLLVYRSIATTLLILPM

SEQ ID NO: 1394527 - protein, 22 aa, Mycobacterium tuberculosis
LLPNEDLPLLQPLRGIVPEPLL

SEQ ID NO: 1394528 - protein, 25 aa, Mycobacterium tuberculosis
LLTGWLVRRTLLVSTLLVASAWWLF

SEQ ID NO: 1394529 - protein, 18 aa, Mycobacterium tuberculosis
LPASIPWTALWLSQAWQQ

SEQ ID NO: 1394530 - protein, 18 aa, Mycobacterium tuberculosis
NSFPKWRWSLTTALLELT

SEQ ID NO: 1394531 - protein, 22 aa, Mycobacterium tuberculosis
PRRMLLFGLVVVVALAVLLCCW

SEQ ID NO: 1394532 - protein, 21 aa, Mycobacterium tuberculosis
QVSGRLLFALLSFSVVGAVLA

SEQ ID NO: 1394533 - protein, 17 aa, Mycobacterium tuberculosis
RFAVLVLLFCLFGVLFV

SEQ ID NO: 1394534 - protein, 17 aa, Mycobacterium tuberculosis
RNYLLPLGAVLLLLVKA

SEQ ID NO: 1394535 - protein, 25 aa, Mycobacterium tuberculosis
RQFHHPLIYVLLVAGTITAGLKEFV

SEQ ID NO: 1394536 - protein, 23 aa, Mycobacterium tuberculosis
RVHFDLDPLLPFPRWHEHAAMVE

SEQ ID NO: 1394537 - protein, 21 aa, Mycobacterium tuberculosis
RVSLPLWVLLLSVPLATVYIA

SEQ ID NO: 1394538 - protein, 19 aa, Mycobacterium tuberculosis
SFPLQVPWLPLAAPLAVLA

SEQ ID NO: 1394539 - protein, 31 aa, Mycobacterium tuberculosis; identical to SEQ ID NO: 165564

SEQ ID NO: 1394540 - protein, 23 aa, Mycobacterium tuberculosis
TVIIVMLLLVYRSIITSAIMLTM

SEQ ID NO: 1394541 - protein, 20 aa, Mycobacterium tuberculosis
VALLLLYWQWRTMPAVIWDV

SEQ ID NO: 1394542 - protein, 17 aa, Mycobacterium tuberculosis
VFALVVALVYLQFRGEF

SEQ ID NO: 1394543 - protein, 18 aa, Mycobacterium tuberculosis
VGPWALYGLLFTIVILFA

SEQ ID NO: 1394544 - protein, 25 aa, Mycobacterium tuberculosis
VLAITFLHFVRLPAMLFGVGRYTVT

SEQ ID NO: 1394545 - protein, 23 aa, Mycobacterium tuberculosis
VLQAYLNIIYFGRGAYGISAASK

SEQ ID NO: 1394546 - protein, 17 aa, Mycobacterium tuberculosis
VPVLTWPVSAPLLVIPV

SEQ ID NO: 1394547 - protein, 23 aa, Mycobacterium tuberculosis
VRLLPGWPIWFAVGWAAQEWLKS

SEQ ID NO: 1394548 - protein, 18 aa, Mycobacterium tuberculosis
VSTYGWRAYALPVLMVLT

SEQ ID NO: 1394549 - protein, 21 aa, Mycobacterium tuberculosis
WPLIVIGCWIAVAAALTLLLP

SEQ ID NO: 1394550 - protein, 18 aa, Mycobacterium tuberculosis
WRAYALPVLMVLTTVVVY

SEQ ID NO: 1394551 - protein, 17 aa, Mycobacterium tuberculosis
YGWRAYALPVLMVLTTV

SEQ ID NO: 1394552 - protein, 19 aa, Mycobacterium tuberculosis
YTWLLVALPLAGAAILLFG

SEQ ID NO: 1394553 - protein, 18 aa, Mycobacterium tuberculosis
AASLLWYLKVVGSQPDFL

SEQ ID NO: 1394554 - protein, 20 aa, Mycobacterium tuberculosis
AIGLLLFPQGFLKSLTYATI

SEQ ID NO: 1394555 - protein, 28 aa, Mycobacterium tuberculosis
APVPIPVPIIIPPFPGWQPGMPTIPTAP

SEQ ID NO: 1394556 - protein, 18 aa, Mycobacterium tuberculosis
FGLFAVVVRLLPGWPIWF

SEQ ID NO: 1394557 - protein, 19 aa, Mycobacterium tuberculosis
FLWILSVAFASMIALATLL

SEQ ID NO: 1394558 - protein, 26 aa, Mycobacterium tuberculosis
FYAYLLTHVLFLNYVWGYTLLEAGMA

SEQ ID NO: 1394559 - protein, 18 aa, Mycobacterium tuberculosis
FYWAVGIAIGLPAGLIVL

SEQ ID NO: 1394560 - protein, 19 aa, Mycobacterium tuberculosis
GFALLWLTATAIWLRSRRA

SEQ ID NO: 1394561 - protein, 17 aa, Mycobacterium tuberculosis
GTPIWRLVLPFIALGVA

SEQ ID NO: 1394562 - protein, 19 aa, Mycobacterium tuberculosis
HAAVWWKALLALAVAVALV

SEQ ID NO: 1394563 - protein, 21 aa, Mycobacterium tuberculosis
IAFDQLWRWNSIVALVLSVMV

SEQ ID NO: 1394564 - protein, 19 aa, Mycobacterium tuberculosis
LFCLFGVLFVLLRRGRVAG

SEQ ID NO: 1394565 - protein, 25 aa, Mycobacterium tuberculosis
LIEADGWRWVFLVNLPLGVFAVLAA

SEQ ID NO: 1394566 - protein, 18 aa, Mycobacterium tuberculosis
LSRRSLLIGNAVVAFAVI

SEQ ID NO: 1394567 - protein, 17 aa, Mycobacterium tuberculosis
LTTALISLIQRPQLRNL

SEQ ID NO: 1394568 - protein, 23 aa, Mycobacterium tuberculosis
LWISLVVLWLFVLVPMLISKRDA

SEQ ID NO: 1394569 - protein, 26 aa, Mycobacterium tuberculosis
MPAFPPYVPTLLPPPPPPQPATLINI

SEQ ID NO: 1394570 - protein, 19 aa, Mycobacterium tuberculosis
MVLTILAAGLLLGPPAGAQ

SEQ ID NO: 1394571 - protein, 19 aa, Mycobacterium tuberculosis
PCILPVLPVIFFSGAQSVD

SEQ ID NO: 1394572 - protein, 24 aa, Mycobacterium tuberculosis
RGGRSRLVFGTLAILLCLVLGVAI

SEQ ID NO: 1394573 - protein, 17 aa, Mycobacterium tuberculosis
RQPWAWLALLVAGLTVG

SEQ ID NO: 1394574 - protein, 20 aa, Mycobacterium tuberculosis
SLAALFAALALALTGGAWQW

SEQ ID NO: 1394575 - protein, 20 aa, Mycobacterium tuberculosis
SMRLPFLYAPLPYGGTLHVD

SEQ ID NO: 1394576 - protein, 31 aa, Mycobacterium tuberculosis; identical to SEQ ID NO: 165485

SEQ ID NO: 1394577 - protein, 22 aa, Mycobacterium tuberculosis
TILAWLLIAILLARLFVPDDVG

SEQ ID NO: 1394578 - protein, 17 aa, Mycobacterium tuberculosis
VIEALPALLLAPLLRRL

SEQ ID NO: 1394579 - protein, 22 aa, Mycobacterium tuberculosis
VLIAAFLAVWWIYETYRPQAPG

SEQ ID NO: 1394580 - protein, 26 aa, Mycobacterium tuberculosis
WSIPGLAHFFTMWGFFILLTVYIEAY

SEQ ID NO: 1394581 - protein, 22 aa, Mycobacterium tuberculosis
AALLGRWFWWPLRVRPRPASQM

SEQ ID NO: 1394582 - protein, 26 aa, Mycobacterium tuberculosis
APVGTRQLLLVNLLTDMFPALAVAVT

SEQ ID NO: 1394583 - protein, 30 aa, Mycobacterium tuberculosis; identical to SEQ ID NO: 165130

SEQ ID NO: 1394584 - protein, 24 aa, Mycobacterium tuberculosis
GRRETWLIMRLPVIGNTQALRWRT

SEQ ID NO: 1394585 - protein, 26 aa, Mycobacterium tuberculosis
LLVEWAGWRWVLLVNVPLGIVAAIAT

SEQ ID NO: 1394586 - protein, 18 aa, Mycobacterium tuberculosis
LLWPAIFVAAFAALGLAV

SEQ ID NO: 1394587 - protein, 27 aa, Mycobacterium tuberculosis
LTAKLAWFSKFLTIAILGLAALTFGVG

SEQ ID NO: 1394588 - protein, 19 aa, Mycobacterium tuberculosis
MGLVFVWFSMTPSLLPRGP

SEQ ID NO: 1394589 - protein, 17 aa, Mycobacterium tuberculosis
PIIPRTIRLAAIPILLC

SEQ ID NO: 1394590 - protein, 18 aa, Mycobacterium tuberculosis
PMYLNIAVAVLGLAAYFA

SEQ ID NO: 1394591 - protein, 34 aa, Mycobacterium tuberculosis; identical to SEQ ID NO: 165318

SEQ ID NO: 1394592 - protein, 23 aa, Mycobacterium tuberculosis
SRLRRGWLVGIAATLLALAGGLG

SEQ ID NO: 1394593 - protein, 17 aa, Mycobacterium tuberculosis
TVFIVAVIFFTGYILGK

SEQ ID NO: 1394594 - protein, 17 aa, Mycobacterium tuberculosis
VIIMILLIIPVGKLSLG

SEQ ID NO: 1394595 - protein, 20 aa, Mycobacterium tuberculosis
VMVGFLFLYPAFVAKAHEAN

SEQ ID NO: 1394596 - protein, 19 aa, Mycobacterium tuberculosis
VSIALWQHLLDRELNALVP

SEQ ID NO: 1394597 - protein, 17 aa, Mycobacterium tuberculosis
WQIVLILLLLGVLGLRD

SEQ ID NO: 1394598 - protein, 20 aa, Mycobacterium tuberculosis
YWLGAQWWHPLVVVGLIALV

SEQ ID NO: 1394599 - protein, 18 aa, Mycobacterium tuberculosis
AEVPLLMTLLQRGRVAGA

SEQ ID NO: 1394600 - protein, 21 aa, Mycobacterium tuberculosis
APSALRQSFLWGLAGVIAAEH

SEQ ID NO: 1394601 - protein, 19 aa, Mycobacterium tuberculosis
ASAWWFDMAMLVALSVIYV

SEQ ID NO: 1394602 - protein, 21 aa, Mycobacterium tuberculosis
ELVLTVIPFLIISVLFYFTVV

SEQ ID NO: 1394603 - protein, 31 aa, Mycobacterium tuberculosis; identical to SEQ ID NO: 165078

SEQ ID NO: 1394604 - protein, 17 aa, Mycobacterium tuberculosis
FGAFLRMPYALASAIFG

SEQ ID NO: 1394605 - protein, 20 aa, Mycobacterium tuberculosis
FLETRYWWAGIALASLGVIV

SEQ ID NO: 1394606 - protein, 18 aa, Mycobacterium tuberculosis
GCHTMSLDWVAWRGLGLA

SEQ ID NO: 1394607 - protein, 18 aa, Mycobacterium tuberculosis
GLGVLWLPAGWLAHRLLS

SEQ ID NO: 1394608 - protein, 21 aa, Mycobacterium tuberculosis
KLAVLLALWAAVAGAFVSVLY

SEQ ID NO: 1394609 - protein, 20 aa, Mycobacterium tuberculosis
LGDWTIFYWGWWISWAPFVG

SEQ ID NO: 1394610 - protein, 17 aa, Mycobacterium tuberculosis
LLLLARLDAHRPLELCR

SEQ ID NO: 1394611 - protein, 31 aa, Mycobacterium tuberculosis; identical to SEQ ID NO: 165226

SEQ ID NO: 1394612 - protein, 21 aa, Mycobacterium tuberculosis
PPCIIAFLETRYWWAGIALAS

SEQ ID NO: 1394613 - protein, 18 aa, Mycobacterium tuberculosis
RFIVGIGALIWAASLLWY

SEQ ID NO: 1394614 - protein, 18 aa, Mycobacterium tuberculosis
RPATFLWLIAATGTLLVA

SEQ ID NO: 1394615 - protein, 19 aa, Mycobacterium tuberculosis
RTFIRFWTVSFPVVAYRTW

SEQ ID NO: 1394616 - protein, 17 aa, Mycobacterium tuberculosis
TFLWLIAATGTLLVATH

SEQ ID NO: 1394617 - protein, 18 aa, Mycobacterium tuberculosis
TVLLALLANLFLPWGIAG

SEQ ID NO: 1394618 - protein, 25 aa, Mycobacterium tuberculosis
VGVALVFVQWWGQPAWSWAVLGLRG

SEQ ID NO: 1394619 - protein, 21 aa, Mycobacterium tuberculosis
VTWAPFLWLVTCVVIIVSYAR

SEQ ID NO: 1394620 - protein, 27 aa, Mycobacterium tuberculosis
WLIGAYGWRWIFLVNLPVGLSALVLAA

SEQ ID NO: 1394621 - protein, 18 aa, Mycobacterium tuberculosis
ALRRVWWLYKLVMSGQPA

SEQ ID NO: 1394622 - protein, 19 aa, Mycobacterium tuberculosis
EQLFWLIMTESLVAGLIGT

SEQ ID NO: 1394623 - protein, 17 aa, Mycobacterium tuberculosis
GAILGFALLWLTATAIW

SEQ ID NO: 1394624 - protein, 23 aa, Mycobacterium tuberculosis
GGRRPGWVLLTALLVLAIGASSA

SEQ ID NO: 1394625 - protein, 18 aa, Mycobacterium tuberculosis
GVFALRRVWWLYKLVMSG

SEQ ID NO: 1394626 - protein, 23 aa, Mycobacterium tuberculosis
LAGCLPAVIWWACHRPNRLWWRY

SEQ ID NO: 1394627 - protein, 18 aa, Mycobacterium tuberculosis
PDMGPWQLPPIPAAGAPN

SEQ ID NO: 1394628 - protein, 18 aa, Mycobacterium tuberculosis
RWLGGIGAVIPLLALVLV

SEQ ID NO: 1394629 - protein, 18 aa, Mycobacterium tuberculosis
SAMLIYRLISWLLIAAIG

SEQ ID NO: 1394630 - protein, 24 aa, Mycobacterium tuberculosis
SIITVLMPLALFGILGLAAVVLVH

SEQ ID NO: 1394631 - protein, 19 aa, Mycobacterium tuberculosis
TSAILLPAVIALALLPISW

SEQ ID NO: 1394632 - protein, 24 aa, Mycobacterium tuberculosis
VFGFILMWILAWLTATPVRVVRAA

SEQ ID NO: 1394633 - protein, 17 aa, Mycobacterium tuberculosis
VLLAAGLGVLWLPAGWL

SEQ ID NO: 1394634 - protein, 18 aa, Mycobacterium tuberculosis
VRAIWVLRALLREYGRRL

SEQ ID NO: 1394635 - protein, 25 aa, Mycobacterium tuberculosis
AAVVILLPMVTFTMAYLIVDVPKPG

SEQ ID NO: 1394636 - protein, 24 aa, Mycobacterium tuberculosis
ETLPMMLAPWVLLPTILALRGTSG

SEQ ID NO: 1394637 - protein, 17 aa, Mycobacterium tuberculosis
IRLPLVLGLAQLLSRVP

SEQ ID NO: 1394638 - protein, 17 aa, Mycobacterium tuberculosis
KVGPVIRLPLVLGLAQL

SEQ ID NO: 1394639 - protein, 17 aa, Mycobacterium tuberculosis
LRRAAFSGVLLTASLVA

SEQ ID NO: 1394640 - protein, 24 aa, Mycobacterium tuberculosis
NPLNPVQFPKALLLKVTGPIAQQF

SEQ ID NO: 1394641 - protein, 19 aa, Mycobacterium tuberculosis
PFLLIMGGFMYFASRRQRR

SEQ ID NO: 1394642 - protein, 23 aa, Mycobacterium tuberculosis
PRAKLFAALFLILALVVVGEVAG

SEQ ID NO: 1394643 - protein, 26 aa, Mycobacterium tuberculosis
QHLLGIQLYWIVLALAVILLLAVGSD

SEQ ID NO: 1394644 - protein, 19 aa, Mycobacterium tuberculosis
RFTGWQWVLSALALPVVTW

SEQ ID NO: 1394645 - protein, 19 aa, Mycobacterium tuberculosis
RMLRLIRRYGPIMTMPILS

SEQ ID NO: 1394646 - protein, 26 aa, Mycobacterium tuberculosis
SSFWFTAIYVLLFVSLVGCLAPRTIE

SEQ ID NO: 1394647 - protein, 17 aa, Mycobacterium tuberculosis
VAVIFFTGYILGKHAGH

SEQ ID NO: 1394648 - protein, 18 aa, Mycobacterium tuberculosis
VMVPVFLLALFYGGGHHS

SEQ ID NO: 1394649 - protein, 18 aa, Mycobacterium tuberculosis
VNAEYWYRSIRQPVQFER

SEQ ID NO: 1394650 - protein, 36 aa, Mycobacterium tuberculosis; identical to SEQ ID NO: 165415

SEQ ID NO: 1394651 - protein, 18 aa, Mycobacterium tuberculosis
WYRSIRQPVQFERAVRNA

SEQ ID NO: 1394652 - protein, 21 aa, Mycobacterium tuberculosis
AAVQAPWPLLRTFAAGPALSR

SEQ ID NO: 1394653 - protein, 17 aa, Mycobacterium tuberculosis
ANRLFIPRFLFSMGVIG

SEQ ID NO: 1394654 - protein, 21 aa, Mycobacterium tuberculosis
ARSASWRRRLRVRLPRLSTIA

SEQ ID NO: 1394655 - protein, 22 aa, Mycobacterium tuberculosis
GRKPLLLWFGVGGLIYTYVLVT

SEQ ID NO: 1394656 - protein, 22 aa, Mycobacterium tuberculosis
ILHGVWILLFASLFTNLVELIP

SEQ ID NO: 1394657 - protein, 18 aa, Mycobacterium tuberculosis
KWPVGWVVVLLYAVCVVL

SEQ ID NO: 1394658 - protein, 23 aa, Mycobacterium tuberculosis
LALTELWCSYGVRPDLVIGHSMG

SEQ ID NO: 1394659 - protein, 20 aa, Mycobacterium tuberculosis
LAWFPLWFVLLAVGWLVTQR

SEQ ID NO: 1394660 - protein, 17 aa, Mycobacterium tuberculosis
LFIMGRIKDLLIVDGRN

SEQ ID NO: 1394661 - protein, 21 aa, Mycobacterium tuberculosis
LGLSWRWLFGLSIIPALISLI

SEQ ID NO: 1394662 - protein, 30 aa, Mycobacterium tuberculosis; identical to SEQ ID NO: 165207

SEQ ID NO: 1394663 - protein, 19 aa, Mycobacterium tuberculosis
LLAVGGGALLLRKLNRTPE

SEQ ID NO: 1394664 - protein, 21 aa, Mycobacterium tuberculosis
LLSIPLWIVIVLPIAKILATS

SEQ ID NO: 1394665 - protein, 17 aa, Mycobacterium tuberculosis
LVILVVVIVGGFTVHRI

SEQ ID NO: 1394666 - protein, 20 aa, Mycobacterium tuberculosis
LVPLRVALAVLFLWGAAAAL

SEQ ID NO: 1394667 - protein, 24 aa, Mycobacterium tuberculosis
NDQFMITVLILWAPLLIFGFILMW

SEQ ID NO: 1394668 - protein, 18 aa, Mycobacterium tuberculosis
PGYCVLAFILGTYWLTRQ

SEQ ID NO: 1394669 - protein, 26 aa, Mycobacterium tuberculosis
SFSNKPLVFIFYLGAAIFIISSSAAG

SEQ ID NO: 1394670 - protein, 18 aa, Mycobacterium tuberculosis
TYLKWWKFVLVVLGVWIG

SEQ ID NO: 1394671 - protein, 28 aa, Mycobacterium tuberculosis
WAPLLIFGFILMWILAWLTATPVRVVRE

SEQ ID NO: 1394672 - protein, 17 aa, Mycobacterium tuberculosis
WIVIVLPIAKILATSLS

SEQ ID NO: 1394673 - protein, 17 aa, Mycobacterium tuberculosis
WTTPLWLILMAAPFGYL

SEQ ID NO: 1394674 - protein, 20 aa, Mycobacterium tuberculosis
CVWWGLWLITINDWAPLATV

SEQ ID NO: 1394675 - protein, 18 aa, Mycobacterium tuberculosis
DPLRTGIFGLVLVICVVL

SEQ ID NO: 1394676 - protein, 20 aa, Mycobacterium tuberculosis
EGWWTSGWFLSFWVTGTSIL

SEQ ID NO: 1394677 - protein, 22 aa, Mycobacterium tuberculosis
FLAYLVLDPLIYFGPFAPLTSP

SEQ ID NO: 1394678 - protein, 17 aa, Mycobacterium tuberculosis
GGLVVIMPLYALALDMA

SEQ ID NO: 1394679 - protein, 20 aa, Mycobacterium tuberculosis
GIFGLVLVICVVLIAFGYSG

SEQ ID NO: 1394680 - protein, 18 aa, Mycobacterium tuberculosis
LFYEPGASWYWVLTGPLA

SEQ ID NO: 1394681 - protein, 24 aa, Mycobacterium tuberculosis
LIVVLFVPAALPWYYSWPLAVAAP

SEQ ID NO: 1394682 - protein, 25 aa, Mycobacterium tuberculosis
LIVVLFVPAALPWYYSWPLAVAAPL

SEQ ID NO: 1394683 - protein, 18 aa, Mycobacterium tuberculosis
LPIILFWVALTIVVNVVA

SEQ ID NO: 1394684 - protein, 18 aa, Mycobacterium tuberculosis
LVASAWWLFAWELDNGAG

SEQ ID NO: 1394685 - protein, 18 aa, Mycobacterium tuberculosis
QERRLVFERFYRSASARA

SEQ ID NO: 1394686 - protein, 17 aa, Mycobacterium tuberculosis
RWLVLWWESHAPHIANN

SEQ ID NO: 1394687 - protein, 18 aa, Mycobacterium tuberculosis
VLVLLLAAPLLRPGYLLL

SEQ ID NO: 1394688 - protein, 21 aa, Mycobacterium tuberculosis
VVKALLLLGLWLAGWGAARLV

SEQ ID NO: 1394689 - protein, 21 aa, Mycobacterium tuberculosis
VVTWAAWPFHRVAMRNARHHA

SEQ ID NO: 1394690 - protein, 17 aa, Mycobacterium tuberculosis
DSLLAVARPFFAKNREV

SEQ ID NO: 1394691 - protein, 23 aa, Mycobacterium tuberculosis
EPEDLPWEVPLIELGLDSLMAVR

SEQ ID NO: 1394692 - protein, 21 aa, Mycobacterium tuberculosis
FLVPLRVALAVLFLWGAAAAL

SEQ ID NO: 1394693 - protein, 20 aa, Mycobacterium tuberculosis
GLSWRWLFGLSIIPALISLI

SEQ ID NO: 1394694 - protein, 25 aa, Mycobacterium tuberculosis
LALLPLLALLAFWRTGRRQLADRPT

SEQ ID NO: 1394695 - protein, 19 aa, Mycobacterium tuberculosis
LANRLFIPRFLFSMGVIGV

SEQ ID NO: 1394696 - protein, 19 aa, Mycobacterium tuberculosis
LAWFPLWFVLLAVGWLVTQ

SEQ ID NO: 1394697 - protein, 25 aa, Mycobacterium tuberculosis
NDQFMITVLILWAPLLIFGFILMWI

SEQ ID NO: 1394698 - protein, 24 aa, Mycobacterium tuberculosis
NGGAWLVLLMIFNVIWTYVLVRGS

SEQ ID NO: 1394699 - protein, 20 aa, Mycobacterium tuberculosis
NLELYLIFPLASEQATITLV

SEQ ID NO: 1394700 - protein, 18 aa, Mycobacterium tuberculosis
PALMVLLGRWLWWPRRSV

SEQ ID NO: 1394701 - protein, 19 aa, Mycobacterium tuberculosis
PGYCVLAFILGTYWLTRQT

SEQ ID NO: 1394702 - protein, 23 aa, Mycobacterium tuberculosis
TILHGVWILLFASLFTNLVELIP

SEQ ID NO: 1394703 - protein, 26 aa, Mycobacterium tuberculosis
TSMGTALVLLFLLALAAIPGALLPQR

SEQ ID NO: 1394704 - protein, 22 aa, Mycobacterium tuberculosis
VANLELYLIFPLASEQATITLV

SEQ ID NO: 1394705 - protein, 17 aa, Mycobacterium tuberculosis
VTREQLFWLIMTESLVA

SEQ ID NO: 1394706 - protein, 22 aa, Mycobacterium tuberculosis
VVKALLLLGLWLAGWGAARLVA

SEQ ID NO: 1394707 - protein, 20 aa, Mycobacterium tuberculosis
VVTWAAWPFHRVAMRNARHH

SEQ ID NO: 1394708 - protein, 20 aa, Mycobacterium tuberculosis
AVQAPWPLLRTFAAGPALSR

SEQ ID NO: 1394709 - protein, 20 aa, Mycobacterium tuberculosis
EKAWPLLWFVVIGLIAAAVG

SEQ ID NO: 1394710 - protein, 23 aa, Mycobacterium tuberculosis
FGEGWWTSVWFLSFWVTGTSILL

SEQ ID NO: 1394711 - protein, 17 aa, Mycobacterium tuberculosis
LFYEPGASWYWVLTGPL

SEQ ID NO: 1394712 - protein, 23 aa, Mycobacterium tuberculosis
LLSIPLWIVIVLPIAKILATSLS

SEQ ID NO: 1394713 - protein, 25 aa, Mycobacterium tuberculosis
LQDGRDMFWSLAPLVVGCILLAGLV

SEQ ID NO: 1394714 - protein, 23 aa, Mycobacterium tuberculosis
NGGAWLVLLMIFNVIWTYVLVRG

SEQ ID NO: 1394715 - protein, 19 aa, Mycobacterium tuberculosis
PDMGPWQLPPIPAAGAPNS

SEQ ID NO: 1394716 - protein, 22 aa, Mycobacterium tuberculosis
QRHETAILLGWFNAILLGWFNE

SEQ ID NO: 1394717 - protein, 22 aa, Mycobacterium tuberculosis
RHPTFLAFPMMMLVSLVVTAVT

SEQ ID NO: 1394718 - protein, 19 aa, Mycobacterium tuberculosis
RWLGGIGAVIPLLALVLVL

SEQ ID NO: 1394719 - protein, 17 aa, Mycobacterium tuberculosis
TALISLIQRPQLRNLLH

SEQ ID NO: 1394720 - protein, 26 aa, Mycobacterium tuberculosis
VLAILVLLRYLTPWGRQFWRITRAYF

SEQ ID NO: 1394721 - protein, 19 aa, Mycobacterium tuberculosis
VMVPVFLLALFYGGGHHSA

SEQ ID NO: 1394722 - protein, 18 aa, Mycobacterium tuberculosis
VNFEPWLVLTGMIDMFFA

SEQ ID NO: 1394723 - protein, 18 aa, Mycobacterium tuberculosis
WLVLTGMIDMFFATVGFA

SEQ ID NO: 1394724 - protein, 17 aa, Mycobacterium tuberculosis
WPLFAWFCVYAYRNFVR

SEQ ID NO: 1394725 - protein, 17 aa, Mycobacterium tuberculosis
WPVGWVVVLLYAVCVVL

SEQ ID NO: 1394726 - protein, 18 aa, Mycobacterium tuberculosis
AIAFLPIVLAPAVIPPAS

SEQ ID NO: 1394727 - protein, 30 aa, Mycobacterium tuberculosis
ENVHWTIWQLWLVVLLVALWKGRRIGPLVA

SEQ ID NO: 1394728 - protein, 18 aa, Mycobacterium tuberculosis
FDSLLAVVRPFFAKNREV

SEQ ID NO: 1394729 - protein, 20 aa, Mycobacterium tuberculosis
IVVLLILLLIVYRSAITATV

SEQ ID NO: 1394730 - protein, 19 aa, Mycobacterium tuberculosis
KAWPLLWFVVIGLIAAAVG

SEQ ID NO: 1394731 - protein, 17 aa, Mycobacterium tuberculosis
LAVIAVVVLGWYFLRIP

SEQ ID NO: 1394732 - protein, 18 aa, Mycobacterium tuberculosis
LLAVGGGALLLRKLNRTP

SEQ ID NO: 1394733 - protein, 17 aa, Mycobacterium tuberculosis
LLVLGLFTPLAAAGALA

SEQ ID NO: 1394734 - protein, 19 aa, Mycobacterium tuberculosis
PTWGMILSSPFLLPAGLGL

SEQ ID NO: 1394735 - protein, 20 aa, Mycobacterium tuberculosis
RSASWRRRLRVRLPRLSTIA

SEQ ID NO: 1394736 - protein, 18 aa, Mycobacterium tuberculosis
TFIRFWTVSFPVVAYRTW

SEQ ID NO: 1394737 - protein, 17 aa, Mycobacterium tuberculosis
TLLVASAWWLFAWELDN

SEQ ID NO: 1394738 - protein, 18 aa, Mycobacterium tuberculosis
TSAILLPAVIALALLPIS

SEQ ID NO: 1394739 - protein, 29 aa, Mycobacterium tuberculosis
WAPLLIFGFILMWILAWLTATPVRVVREA

SEQ ID NO: 1394740 - protein, 21 aa, Mycobacterium tuberculosis
WPTWGMILSSPFLLPAGLGLG

SEQ ID NO: 1394741 - protein, 21 aa, Mycobacterium tuberculosis
AAIAFLPIVLAPAVIPPASTP

SEQ ID NO: 1394742 - protein, 17 aa, Mycobacterium tuberculosis
AMFLGFVAPALSLSPVT

SEQ ID NO: 1394743 - protein, 17 aa, Mycobacterium tuberculosis
AVIALVVFLVLVALYIT

SEQ ID NO: 1394744 - protein, 17 aa, Mycobacterium tuberculosis
DWVAWRGLGLAADAQLV

SEQ ID NO: 1394745 - protein, 24 aa, Mycobacterium tuberculosis
ELPAVAWVWFQLFVDILGFNIIGF

SEQ ID NO: 1394746 - protein, 17 aa, Mycobacterium tuberculosis
ERRLVFERFYRSASARA

SEQ ID NO: 1394747 - protein, 25 aa, Mycobacterium tuberculosis
FSNKPLVFIFYLGAAIFIISSSAAG

SEQ ID NO: 1394748 - protein, 20 aa, Mycobacterium tuberculosis
GVSIALWQHLLDRELNALVP

SEQ ID NO: 1394749 - protein, 17 aa, Mycobacterium tuberculosis
PIILFWVALTIVVNVVA

SEQ ID NO: 1394750 - protein, 23 aa, Mycobacterium tuberculosis
PLNPVQFPKALLLKVTGPIAQQF

SEQ ID NO: 1394751 - protein, 22 aa, Mycobacterium tuberculosis
RAKLFAALFLILALVVVGEVAG

SEQ ID NO: 1394752 - protein, 18 aa, Mycobacterium tuberculosis
RFTGWQWVLSALALPVVT

SEQ ID NO: 1394753 - protein, 19 aa, Mycobacterium tuberculosis
SAMLIYRLISWLLIAAIGW

SEQ ID NO: 1394754 - protein, 19 aa, Mycobacterium tuberculosis
VMVGFLFLYPAFVAKAHEA

SEQ ID NO: 1394755 - protein, 24 aa, Mycobacterium tuberculosis
AVVILLPMVTFTMAYLIVDVPKPG

SEQ ID NO: 1394756 - protein, 19 aa, Mycobacterium tuberculosis
DRPTPPWRPGAWAAAGVLA

SEQ ID NO: 1394757 - protein, 20 aa, Mycobacterium tuberculosis
ELVLTVIPFLIISVLFYFTV

SEQ ID NO: 1394758 - protein, 17 aa, Mycobacterium tuberculosis
EVPLLMTLLQRGRVAGA

SEQ ID NO: 1394759 - protein, 18 aa, Mycobacterium tuberculosis
FALLWLTATAIWLRSRRA

SEQ ID NO: 1394760 - protein, 18 aa, Mycobacterium tuberculosis
FGAFLRMPYALASAIFGG

SEQ ID NO: 1394761 - protein, 17 aa, Mycobacterium tuberculosis
GMRLVFPLAIIWTTAGL

SEQ ID NO: 1394762 - protein, 22 aa, Mycobacterium tuberculosis
LCLIFIIMLIITRSVVAAAVIV

SEQ ID NO: 1394763 - protein, 18 aa, Mycobacterium tuberculosis
LFLIPPEHAHKLVFAVLR

SEQ ID NO: 1394764 - protein, 26 aa, Mycobacterium tuberculosis
LIGAYGWRWIFLVNLPVGLSALVLAA

SEQ ID NO: 1394765 - protein, 18 aa, Mycobacterium tuberculosis
LWQHLFWFFGHPEVYIIA

SEQ ID NO: 1394766 - protein, 18 aa, Mycobacterium tuberculosis
LWQVAKLRRAAFSGVLLT

SEQ ID NO: 1394767 - protein, 19 aa, Mycobacterium tuberculosis
MVRAIWVLRALLREYGRRL

SEQ ID NO: 1394768 - protein, 17 aa, Mycobacterium tuberculosis
PALAAPAPHGALAGSGK

SEQ ID NO: 1394769 - protein, 18 aa, Mycobacterium tuberculosis
PLLLWFGVGGLIYTYVLV

SEQ ID NO: 1394770 - protein, 17 aa, Mycobacterium tuberculosis
QDGRDMFWSLAPLVVGC

SEQ ID NO: 1394771 - protein, 20 aa, Mycobacterium tuberculosis
RDMFWSLAPLVVGCILLAGL

SEQ ID NO: 1394772 - protein, 25 aa, Mycobacterium tuberculosis
SSFWFTAIYVLLFVSLVGCLAPRTI

SEQ ID NO: 1394773 - protein, 26 aa, Mycobacterium tuberculosis
TILLLVILLIIYRNPITMVLPLITIG

SEQ ID NO: 1394774 - protein, 18 aa, Mycobacterium tuberculosis
VCAACWLIALLAGDYRHA

SEQ ID NO: 1394775 - protein, 17 aa, Mycobacterium tuberculosis
WQHLFWFFGHPEVYIIA

SEQ ID NO: 1394776 - protein, 28 aa, Mycobacterium tuberculosis
WQHLLGIQLYWIVLALAVILLLAVGSDY

SEQ ID NO: 1394777 - protein, 21 aa, Mycobacterium tuberculosis
AALLGRWFWWPLRVRPRPASQ

SEQ ID NO: 1394778 - protein, 17 aa, Mycobacterium tuberculosis
APLLLWQVATRHFTNIS

SEQ ID NO: 1394779 - protein, 18 aa, Mycobacterium tuberculosis
APVRRLLRRLLGPTDPVL

SEQ ID NO: 1394780 - protein, 17 aa, Mycobacterium tuberculosis
ASAWWFDMAMLVALSVI

SEQ ID NO: 1394781 - protein, 23 aa, Mycobacterium tuberculosis
ASFGVAPLLLWQVATRHFTNISV

SEQ ID NO: 1394782 - protein, 18 aa, Mycobacterium tuberculosis
FADRVFAAALPWLAGQLA

SEQ ID NO: 1394783 - protein, 19 aa, Mycobacterium tuberculosis
GDWTIFYWGWWISWAPFVG

SEQ ID NO: 1394784 - protein, 22 aa, Mycobacterium tuberculosis
GGFLLMWIMSWLTAAPVRVVRA

SEQ ID NO: 1394785 - protein, 23 aa, Mycobacterium tuberculosis
GTALVLLFLLALAAIPGALLPQR

SEQ ID NO: 1394786 - protein, 20 aa, Mycobacterium tuberculosis
IAVLLGRWFWWPQRVRPRPA

SEQ ID NO: 1394787 - protein, 21 aa, Mycobacterium tuberculosis
IAVLLGRWFWWPQRVRPRPAS

SEQ ID NO: 1394788 - protein, 22 aa, Mycobacterium tuberculosis
ISLVLLLLFAIGGVVWGVMDGR

SEQ ID NO: 1394789 - protein, 17 aa, Mycobacterium tuberculosis
KLGPLISALLNPGARNA

SEQ ID NO: 1394790 - protein, 18 aa, Mycobacterium tuberculosis
LRRAAFSGVLLTASLVAA

SEQ ID NO: 1394791 - protein, 28 aa, Mycobacterium tuberculosis
LTAWIAAPLLFIGALFGLLLLAGITIRE

SEQ ID NO: 1394792 - protein, 17 aa, Mycobacterium tuberculosis
MLRLIRRYGPIMTMPIL

SEQ ID NO: 1394793 - protein, 22 aa, Mycobacterium tuberculosis
PEDLPWEVPLIELGLDSLMAVR

SEQ ID NO: 1394794 - protein, 18 aa, Mycobacterium tuberculosis
PLVIFAYAIVFAVLAIIF

SEQ ID NO: 1394795 - protein, 24 aa, Mycobacterium tuberculosis
PSRLRRGWLVGIAATLLALAGGLG

SEQ ID NO: 1394796 - protein, 25 aa, Mycobacterium tuberculosis
PVGTRQLLLVNLLTDMFPALAVAVT

SEQ ID NO: 1394797 - protein, 26 aa, Mycobacterium tuberculosis
RDPLTVFLVLIIVFSLVLAGLIGGEL

SEQ ID NO: 1394798 - protein, 21 aa, Mycobacterium tuberculosis
RLSLPILLFWVGVAAITNAAV

SEQ ID NO: 1394799 - protein, 20 aa, Mycobacterium tuberculosis
RPATFLWLIAATGTLLVATH

SEQ ID NO: 1394800 - protein, 28 aa, Mycobacterium tuberculosis
RRDPLTVFLVLIIVFSLVLAGLIGGELY

SEQ ID NO: 1394801 - protein, 17 aa, Mycobacterium tuberculosis
SFGVAPLLLWQVATRHF

SEQ ID NO: 1394802 - protein, 17 aa, Mycobacterium tuberculosis
SIPSWWQPYVLSVASLT

SEQ ID NO: 1394803 - protein, 17 aa, Mycobacterium tuberculosis
TVLLALLANLFLPWGIA

SEQ ID NO: 1394804 - protein, 23 aa, Mycobacterium tuberculosis
TVTWAPFLWLVTCVVIIVSYARK

SEQ ID NO: 1394805 - protein, 19 aa, Mycobacterium tuberculosis
TYLKWWKFVLVVLGVWIGA

SEQ ID NO: 1394806 - protein, 18 aa, Mycobacterium tuberculosis
VAVIFFTGYILGKHAGHG

SEQ ID NO: 1394807 - protein, 24 aa, Mycobacterium tuberculosis
VLGFILMWILAWLTATPVRVVRAA

SEQ ID NO: 1394808 - protein, 19 aa, Mycobacterium tuberculosis
VPWWWWPLAFALAALIAFE

SEQ ID NO: 1394809 - protein, 18 aa, Mycobacterium tuberculosis
VTREQLFWLIMTESLVAG

SEQ ID NO: 1394810 - protein, 24 aa, Mycobacterium tuberculosis
WVTQRLWWAVLLTVGFWGLLRVAE

SEQ ID NO: 1394811 - protein, 22 aa, Mycobacterium tuberculosis
YGDFFNFYLCDISLKVNGLQPG

SEQ ID NO: 1394812 - protein, 19 aa, Mycobacterium tuberculosis
ALLLLYWQWRTMPAVIWDV

SEQ ID NO: 1394813 - protein, 25 aa, Mycobacterium tuberculosis
AVHYPWLPLRRLLLDHYPSIERIAS

SEQ ID NO: 1394814 - protein, 18 aa, Mycobacterium tuberculosis
AWPLLWFVVIGLIAAAVG

SEQ ID NO: 1394815 - protein, 17 aa, Mycobacterium tuberculosis
AWWFDMAMLVALSVIYV

SEQ ID NO: 1394816 - protein, 21 aa, Mycobacterium tuberculosis
DELAAPRWPWVVGVAAIIAAV

SEQ ID NO: 1394817 - protein, 21 aa, Mycobacterium tuberculosis
DGVVLHWIIDYWNRFSLWVQH

SEQ ID NO: 1394818 - protein, 17 aa, Mycobacterium tuberculosis
DTTLPWSYTITTTLPAV

SEQ ID NO: 1394819 - protein, 28 aa, Mycobacterium tuberculosis
ERTAMLLVPLYLVYVRLARPFIAFYNNC

SEQ ID NO: 1394820 - protein, 17 aa, Mycobacterium tuberculosis
FFNIYFCSVTIKINGPA

SEQ ID NO: 1394821 - protein, 17 aa, Mycobacterium tuberculosis
FIGVLIVALLGGVAPAA

SEQ ID NO: 1394822 - protein, 21 aa, Mycobacterium tuberculosis
GDFFNFYLCDISLKVNGLQPG

SEQ ID NO: 1394823 - protein, 34 aa, Mycobacterium tuberculosis
GLPLRAMVMVLLFLGVVFLLLVWQALGSSPNSED

SEQ ID NO: 1394824 - protein, 17 aa, Mycobacterium tuberculosis
GRPPLEQLSWLSPSRWA

SEQ ID NO: 1394825 - protein, 22 aa, Mycobacterium tuberculosis
IAVLLGRWFWWPQRVRPRPASR

SEQ ID NO: 1394826 - protein, 21 aa, Mycobacterium tuberculosis
IGAAILLGWFTLAHRHPDQPG

SEQ ID NO: 1394827 - protein, 18 aa, Mycobacterium tuberculosis
ILAVAMPWLFLRLRFCRR

SEQ ID NO: 1394828 - protein, 27 aa, Mycobacterium tuberculosis
LAFPAPSWWWLAWFGLVPLLLVVRAAP

SEQ ID NO: 1394829 - protein, 30 aa, Mycobacterium tuberculosis
LAIGLALLPLLALLAFWRTGRRQLADRPTP

SEQ ID NO: 1394830 - protein, 19 aa, Mycobacterium tuberculosis
LLLAPLLRRLLPDNPQRAS

SEQ ID NO: 1394831 - protein, 25 aa, Mycobacterium tuberculosis
LLVEWAGWRWVLLVNVPLGIVAAIA

SEQ ID NO: 1394832 - protein, 18 aa, Mycobacterium tuberculosis
LLVLPLLLSLFAHAVPGQ

SEQ ID NO: 1394833 - protein, 24 aa, Mycobacterium tuberculosis
LQDGRDMFWSLAPLVVGCILLAGL

SEQ ID NO: 1394834 - protein, 17 aa, Mycobacterium tuberculosis
LVASAWWLFAWELDNGA

SEQ ID NO: 1394835 - protein, 26 aa, Mycobacterium tuberculosis
PPCIIAFLETRYWWAGIALASLGVIV

SEQ ID NO: 1394836 - protein, 23 aa, Mycobacterium tuberculosis
PPEPPTLLWPIGVPFSDGLNTLS

SEQ ID NO: 1394837 - protein, 21 aa, Mycobacterium tuberculosis
PPLEQLSWLSPSRWAYAMAAA

SEQ ID NO: 1394838 - protein, 17 aa, Mycobacterium tuberculosis
PRLYALHILLLPGIILA

SEQ ID NO: 1394839 - protein, 22 aa, Mycobacterium tuberculosis
PVSWIMWVWYRLFAFVLGPSNF

SEQ ID NO: 1394840 - protein, 22 aa, Mycobacterium tuberculosis
QEDFAYHQFLIKKSKMPSQTPP

SEQ ID NO: 1394841 - protein, 24 aa, Mycobacterium tuberculosis
QLALTELWCSYGVRPDLVIGHSMG

SEQ ID NO: 1394842 - protein, 21 aa, Mycobacterium tuberculosis
RSRLVFGTLAILLCLVLGVAI

SEQ ID NO: 1394843 - protein, 25 aa, Mycobacterium tuberculosis
SELPAVAWVWFQLFVDILGFNIIGF

SEQ ID NO: 1394844 - protein, 23 aa, Mycobacterium tuberculosis
SIAVLLGRWFWWPQRVRPRPASR

SEQ ID NO: 1394845 - protein, 24 aa, Mycobacterium tuberculosis
SMLTYNIAGLPFPLSSAILPRFFY

SEQ ID NO: 1394846 - protein, 26 aa, Mycobacterium tuberculosis
TAKLAWFSKFLTIAILGLAALTFGVG

SEQ ID NO: 1394847 - protein, 18 aa, Mycobacterium tuberculosis
TAQWVILALLAVALPLAS

SEQ ID NO: 1394848 - protein, 22 aa, Mycobacterium tuberculosis
TVIIVMLLLVYRSIITSAIMLT

SEQ ID NO: 1394849 - protein, 31 aa, Mycobacterium tuberculosis
VGKLEFAGYFAWLAWLVLHLVYLVGYRNRIA

SEQ ID NO: 1394850 - protein, 22 aa, Mycobacterium tuberculosis
VRLLPGWPIWFAVGWAAQEWLK

SEQ ID NO: 1394851 - protein, 17 aa, Mycobacterium tuberculosis
YLKWWKFVLVVLGVWIG

SEQ ID NO: 1394852 - protein, 19 aa, Mycobacterium tuberculosis
YWLGAQWWHPLVVVGLIAL

SEQ ID NO: 1394853 - protein, 19 aa, Mycobacterium tuberculosis
AAGMFLAVWLPLDDGLRPE

SEQ ID NO: 1394854 - protein, 24 aa, Mycobacterium tuberculosis
ACHRPNRLWWRYTAWWLLAMALAT

SEQ ID NO: 1394855 - protein, 20 aa, Mycobacterium tuberculosis
AGLVVWDLAFTLPLPLGVAR

SEQ ID NO: 1394856 - protein, 18 aa, Mycobacterium tuberculosis
ALITLLTVPLSLLVTRAI

SEQ ID NO: 1394857 - protein, 20 aa, Mycobacterium tuberculosis
ALVFVQWWGQPAWSWAVLGL

SEQ ID NO: 1394858 - protein, 17 aa, Mycobacterium tuberculosis
ALYYPFVALLCSLATTL

SEQ ID NO: 1394859 - protein, 20 aa, Mycobacterium tuberculosis
ARFWWPGLPIWVPALVTVAL

SEQ ID NO: 1394860 - protein, 18 aa, Mycobacterium tuberculosis
AVLLGRWFWWPQRVRPRP

SEQ ID NO: 1394861 - protein, 21 aa, Mycobacterium tuberculosis
CLIFIIMLIITRSVVAAAVIV

SEQ ID NO: 1394862 - protein, 17 aa, Mycobacterium tuberculosis
DDLLLLARLDAHRPLEL

SEQ ID NO: 1394863 - protein, 22 aa, Mycobacterium tuberculosis
DLYSLGCALFRLLTGEAPFAAG

SEQ ID NO: 1394864 - protein, 19 aa, Mycobacterium tuberculosis
GFLLMWIMSWLTAAPVRVV

SEQ ID NO: 1394865 - protein, 26 aa, Mycobacterium tuberculosis
GLALLPLLALLAFWRTGRRQLADRPT

SEQ ID NO: 1394866 - protein, 19 aa, Mycobacterium tuberculosis
GLLWPAIFVAAFAALGLAV

SEQ ID NO: 1394867 - protein, 30 aa, Mycobacterium tuberculosis
GLSLSIITVLMPLALFGILGLAAVVLVHEF

SEQ ID NO: 1394868 - protein, 17 aa, Mycobacterium tuberculosis
GPYLSIYLLLIHDWDQA

SEQ ID NO: 1394869 - protein, 17 aa, Mycobacterium tuberculosis
GRKPLLLWFGVGGLIYT

SEQ ID NO: 1394870 - protein, 19 aa, Mycobacterium tuberculosis
GSYWAMFILVPGTLVLVFR

SEQ ID NO: 1394871 - protein, 20 aa, Mycobacterium tuberculosis
GTWLAWVAWAALGLGVVALV

SEQ ID NO: 1394872 - protein, 23 aa, Mycobacterium tuberculosis
GVTREQLFWLIMTESLVAGLIGT

SEQ ID NO: 1394873 - protein, 19 aa, Mycobacterium tuberculosis
IEILIQLFLISLEILFAIV

SEQ ID NO: 1394874 - protein, 20 aa, Mycobacterium tuberculosis
IGGMVLICLFLYHVFRNRNW

SEQ ID NO: 1394875 - protein, 17 aa, Mycobacterium tuberculosis
IGLLLFPQGFLKSLTYA

SEQ ID NO: 1394876 - protein, 19 aa, Mycobacterium tuberculosis
IGQFIRWLFRFLVGQVDRI

SEQ ID NO: 1394877 - protein, 18 aa, Mycobacterium tuberculosis
IKNLLPMLAVFKPTVVVS

SEQ ID NO: 1394878 - protein, 17 aa, Mycobacterium tuberculosis
IQLFLISLEILFAIVAY

SEQ ID NO: 1394879 - protein, 26 aa, Mycobacterium tuberculosis
IVAYTIIIVLILPLVIFAYAIVFAVL

SEQ ID NO: 1394880 - protein, 24 aa, Mycobacterium tuberculosis
IYNYTWLVLMLPFGMIGVTVLTVV

SEQ ID NO: 1394881 - protein, 18 aa, Mycobacterium tuberculosis
KDHLYIAGRIKDLVIIDG

SEQ ID NO: 1394882 - protein, 20 aa, Mycobacterium tuberculosis
KLAVLLALWAAVAGAFVSVL

SEQ ID NO: 1394883 - protein, 19 aa, Mycobacterium tuberculosis
KPLLLWFGVGGLIYTYVLV

SEQ ID NO: 1394884 - protein, 19 aa, Mycobacterium tuberculosis
LAWLLIAILLARLFVPDDV

SEQ ID NO: 1394885 - protein, 21 aa, Mycobacterium tuberculosis
LGDWTIFYWGWWISWAPFVGM

SEQ ID NO: 1394886 - protein, 24 aa, Mycobacterium tuberculosis
LIPNGTFFVVLAIFLVVLAVIGTF

SEQ ID NO: 1394887 - protein, 22 aa, Mycobacterium tuberculosis
LKLAVLLALWAAVAGAFVSVLY

SEQ ID NO: 1394888 - protein, 18 aa, Mycobacterium tuberculosis
LLLLVYRSIATTLLILPM

SEQ ID NO: 1394889 - protein, 25 aa, Mycobacterium tuberculosis
LLRKGERLLVFLPLAHVLARAISMA

SEQ ID NO: 1394890 - protein, 21 aa, Mycobacterium tuberculosis
LPNEDLPLLQPLRGIVPEPLL

SEQ ID NO: 1394891 - protein, 19 aa, Mycobacterium tuberculosis
LVGWLSLAAGLLAIAALAW

SEQ ID NO: 1394892 - protein, 24 aa, Mycobacterium tuberculosis
LWISLVVLWLFVLVPMLISKRDAV

SEQ ID NO: 1394893 - protein, 18 aa, Mycobacterium tuberculosis
MLRLIRRYGPIMTMPILS

SEQ ID NO: 1394894 - protein, 19 aa, Mycobacterium tuberculosis
NLELYLIFPLASEQATITL

SEQ ID NO: 1394895 - protein, 25 aa, Mycobacterium tuberculosis
PAFPPYVPTLLPPPPPPQPATLINI

SEQ ID NO: 1394896 - protein, 18 aa, Mycobacterium tuberculosis
PEDLPWEVPLIELGLDSL

SEQ ID NO: 1394897 - protein, 18 aa, Mycobacterium tuberculosis
PGTPIWRLVLPFIALGVA

SEQ ID NO: 1394898 - protein, 18 aa, Mycobacterium tuberculosis
PIIPRTIRLAAIPILLCW

SEQ ID NO: 1394899 - protein, 17 aa, Mycobacterium tuberculosis
PLGWQVWLYGVFAIIAV

SEQ ID NO: 1394900 - protein, 21 aa, Mycobacterium tuberculosis
PLRVMFAIALVFLALGWSTKA

SEQ ID NO: 1394901 - protein, 20 aa, Mycobacterium tuberculosis
PSALRQSFLWGLAGVIAAEH

SEQ ID NO: 1394902 - protein, 19 aa, Mycobacterium tuberculosis
QGCHTMSLDWVAWRGLGLA

SEQ ID NO: 1394903 - protein, 27 aa, Mycobacterium tuberculosis
QHLLGIQLYWIVLALAVILLLAVGSDY

SEQ ID NO: 1394904 - protein, 25 aa, Mycobacterium tuberculosis
RNREVWAWMVWLPHNLHDELFDACG

SEQ ID NO: 1394905 - protein, 25 aa, Mycobacterium tuberculosis
RSGHRRLWWALAGVVAFLGLVGAGV

SEQ ID NO: 1394906 - protein, 22 aa, Mycobacterium tuberculosis
SLAALFAALALALTGGAWQWSA

SEQ ID NO: 1394907 - protein, 20 aa, Mycobacterium tuberculosis
SVLVILWLFTWSLATMLPGT

SEQ ID NO: 1394908 - protein, 17 aa, Mycobacterium tuberculosis
TILAWLLIAILLARLFV

SEQ ID NO: 1394909 - protein, 21 aa, Mycobacterium tuberculosis
TSFPLQVPWLPLAAPLAVLAT

SEQ ID NO: 1394910 - protein, 20 aa, Mycobacterium tuberculosis
VAMPWLFLRLRFCRRKWTVT

SEQ ID NO: 1394911 - protein, 20 aa, Mycobacterium tuberculosis
VFALRRVWWLYKLVMSGQPA

SEQ ID NO: 1394912 - protein, 20 aa, Mycobacterium tuberculosis
VGSLSPWHWAILAVVVIVLF

SEQ ID NO: 1394913 - protein, 25 aa, Mycobacterium tuberculosis
VLGFILMWILAWLTATPVRVVRAAL

SEQ ID NO: 1394914 - protein, 19 aa, Mycobacterium tuberculosis
VLLILIVLLRAIVAPLYLI

SEQ ID NO: 1394915 - protein, 27 aa, Mycobacterium tuberculosis
VPPLDLFIMSWLPFYHDMGLVLGVCAP

SEQ ID NO: 1394916 - protein, 22 aa, Mycobacterium tuberculosis
VVLLGWSFFYFSDDTRGYKPVD

SEQ ID NO: 1394917 - protein, 18 aa, Mycobacterium tuberculosis
WYRSIRQPVQFARAVRNA

SEQ ID NO: 1394918 - protein, 17 aa, Mycobacterium tuberculosis
AAVTALALLRRASLRQA

SEQ ID NO: 1394919 - protein, 19 aa, Mycobacterium tuberculosis
ACLWLMLNLTALTWIRFGI

SEQ ID NO: 1394920 - protein, 19 aa, Mycobacterium tuberculosis
ADLVLAVGFFLLGDLAAIK

SEQ ID NO: 1394921 - protein, 23 aa, Mycobacterium tuberculosis
AGELLFWLPYPSFATYLHVGCAQ

SEQ ID NO: 1394922 - protein, 19 aa, Mycobacterium tuberculosis
AIGLLLFPQGFLKSLTYAT

SEQ ID NO: 1394923 - protein, 28 aa, Mycobacterium tuberculosis
AIGVLLGWPLWWVSTCSVLVLLVVEGVA

SEQ ID NO: 1394924 - protein, 30 aa, Mycobacterium tuberculosis
AKLIIWYPHYAWLLLSVYLTVALVALVVVG

SEQ ID NO: 1394925 - protein, 24 aa, Mycobacterium tuberculosis
ALVTYLLYIELLYTPIGELAQMFD

SEQ ID NO: 1394926 - protein, 19 aa, Mycobacterium tuberculosis
ALVVWWGWRERRDLFSGFG

SEQ ID NO: 1394927 - protein, 23 aa, Mycobacterium tuberculosis
AQEWLKSILPFGGFPWGSVAFGQ

SEQ ID NO: 1394928 - protein, 30 aa, Mycobacterium tuberculosis
ATALPLRLISWLLMPISRLLVLLGNALTPG

SEQ ID NO: 1394929 - protein, 23 aa, Mycobacterium tuberculosis
AWLHAAVWWKALLALAVAVALVI

SEQ ID NO: 1394930 - protein, 23 aa, Mycobacterium tuberculosis
DFDPYQFLLIPLARITGIEDPAL

SEQ ID NO: 1394931 - protein, 26 aa, Mycobacterium tuberculosis
DGEVVLLLFLPAILYWESMNTSFREI

SEQ ID NO: 1394932 - protein, 24 aa, Mycobacterium tuberculosis
DGIYPLLIMILLPVLVGLDVSTRR

SEQ ID NO: 1394933 - protein, 20 aa, Mycobacterium tuberculosis
DGKCHPAILPPLFGCNDRAM

SEQ ID NO: 1394934 - protein, 19 aa, Mycobacterium tuberculosis
EADGWRWVFLVNLPLGVFA

SEQ ID NO: 1394935 - protein, 20 aa, Mycobacterium tuberculosis
EFSWQLERVLPVPVFAQTMA

SEQ ID NO: 1394936 - protein, 17 aa, Mycobacterium tuberculosis
EGALLIVIFATSGALEA

SEQ ID NO: 1394937 - protein, 21 aa, Mycobacterium tuberculosis
EGWWTSVWFLSFWVTGTSILL

SEQ ID NO: 1394938 - protein, 21 aa, Mycobacterium tuberculosis
EPGIPAWRRILDDLSYEPVMA

SEQ ID NO: 1394939 - protein, 17 aa, Mycobacterium tuberculosis
EWAILDFAILAVGAVTV

SEQ ID NO: 1394940 - protein, 23 aa, Mycobacterium tuberculosis
FAAVPAALLRWGVSQFDAEVRPV

SEQ ID NO: 1394941 - protein, 17 aa, Mycobacterium tuberculosis
FGEGWWTSVWFLSFWVT

SEQ ID NO: 1394942 - protein, 17 aa, Mycobacterium tuberculosis
FGLFAVVVRLLPGWPIW

SEQ ID NO: 1394943 - protein, 17 aa, Mycobacterium tuberculosis
FIVGIGALIWAASLLWY

SEQ ID NO: 1394944 - protein, 24 aa, Mycobacterium tuberculosis
FSNKPRVFIFYLGAAIFIISSSAA

SEQ ID NO: 1394945 - protein, 19 aa, Mycobacterium tuberculosis
FVLFSWWAFDYAGSGANKV

SEQ ID NO: 1394946 - protein, 17 aa, Mycobacterium tuberculosis
FWHHTIPAPVWVAVIMG

SEQ ID NO: 1394947 - protein, 17 aa, Mycobacterium tuberculosis
FWSLAPLVVGCILLAGL

SEQ ID NO: 1394948 - protein, 17 aa, Mycobacterium tuberculosis
FYWAVGIAIGLPAGLIV

SEQ ID NO: 1394949 - protein, 21 aa, Mycobacterium tuberculosis
GACIGFLWWNAAPAKIFMGDT

SEQ ID NO: 1394950 - protein, 18 aa, Mycobacterium tuberculosis
GAILGFALLWLTATAIWL

SEQ ID NO: 1394951 - protein, 17 aa, Mycobacterium tuberculosis
GGMVLICLFLYHVFRNR

SEQ ID NO: 1394952 - protein, 22 aa, Mycobacterium tuberculosis
GKVSYLALGILVAIALVIGGIG

SEQ ID NO: 1394953 - protein, 22 aa, Mycobacterium tuberculosis
GLASRYIRLLPRGLVKRVVPKP

SEQ ID NO: 1394954 - protein, 18 aa, Mycobacterium tuberculosis
GLVFVWFSMTPSLLPRGP

SEQ ID NO: 1394955 - protein, 28 aa, Mycobacterium tuberculosis
GSAAKLYPLLFLYPLLLLGIRAGRLNAL

SEQ ID NO: 1394956 - protein, 17 aa, Mycobacterium tuberculosis
GSWLPPGPAAVADYPTV

SEQ ID NO: 1394957 - protein, 29 aa, Mycobacterium tuberculosis
GVPGWVTQRLWWAVLLTVGFWGLLRVAEA

SEQ ID NO: 1394958 - protein, 17 aa, Mycobacterium tuberculosis
IEILIQLFLISLEILFA

SEQ ID NO: 1394959 - protein, 28 aa, Mycobacterium tuberculosis
IGLALLPLLALLAFWRTGRRQLADRPTP

SEQ ID NO: 1394960 - protein, 18 aa, Mycobacterium tuberculosis
IGTPLFFQRVFGAGIATL

SEQ ID NO: 1394961 - protein, 18 aa, Mycobacterium tuberculosis
IITVLMPLALFGILGLAA

SEQ ID NO: 1394962 - protein, 26 aa, Mycobacterium tuberculosis
IVIVFLILVILLRALVAPIYLIGSVL

SEQ ID NO: 1394963 - protein, 22 aa, Mycobacterium tuberculosis
LANLFPFQLFLVLYGLPLEDRD

SEQ ID NO: 1394964 - protein, 22 aa, Mycobacterium tuberculosis
LDWRWLVLWWKSHAPHIANNLM

SEQ ID NO: 1394965 - protein, 18 aa, Mycobacterium tuberculosis
LEQLSWLSPSRWAYAMAA

SEQ ID NO: 1394966 - protein, 20 aa, Mycobacterium tuberculosis
LLALYYPFVALLCSLATTLV

SEQ ID NO: 1394967 - protein, 19 aa, Mycobacterium tuberculosis
LLIVFLLLLIFIGRLINWL

SEQ ID NO: 1394968 - protein, 26 aa, Mycobacterium tuberculosis
LLTGWLVRRTLLVSTLLVASAWWLFA

SEQ ID NO: 1394969 - protein, 25 aa, Mycobacterium tuberculosis
LLVNLPVMLLFPRGWSEFFRLNTRR

SEQ ID NO: 1394970 - protein, 19 aa, Mycobacterium tuberculosis
LLVPPYLVYVRLARPFIAF

SEQ ID NO: 1394971 - protein, 19 aa, Mycobacterium tuberculosis
LSVLALIMLPILAAVTLCA

SEQ ID NO: 1394972 - protein, 17 aa, Mycobacterium tuberculosis
LVLTGMIDMFFATVGFA

SEQ ID NO: 1394973 - protein, 17 aa, Mycobacterium tuberculosis
LVVIMPLYALALDMAFT

SEQ ID NO: 1394974 - protein, 30 aa, Mycobacterium tuberculosis
LWAPLLIFGFILMWILAWLTATPVRVVREA

SEQ ID NO: 1394975 - protein, 22 aa, Mycobacterium tuberculosis
MLAIAMLLMLVPLATGCLRVRA

SEQ ID NO: 1394976 - protein, 17 aa, Mycobacterium tuberculosis
MPLALFGILGLAAVVLV

SEQ ID NO: 1394977 - protein, 17 aa, Mycobacterium tuberculosis
MSFLRRPARWMQLLATS

SEQ ID NO: 1394978 - protein, 17 aa, Mycobacterium tuberculosis
NAEYWYRSIRQPVQFAR

SEQ ID NO: 1394979 - protein, 20 aa, Mycobacterium tuberculosis
PEDLPWEVPLIELGLDSLMA

SEQ ID NO: 1394980 - protein, 17 aa, Mycobacterium tuberculosis
PFVAVAAAVVLVLVLGA

SEQ ID NO: 1394981 - protein, 24 aa, Mycobacterium tuberculosis
PLSKWFLLIMAFGSLFMAAGKRYA

SEQ ID NO: 1394982 - protein, 21 aa, Mycobacterium tuberculosis
PPWEFYFWHHTIPAPVWVAVI

SEQ ID NO: 1394983 - protein, 29 aa, Mycobacterium tuberculosis
PRNWPVRWKVFTIALLPLVVAMVLAGLRV

SEQ ID NO: 1394984 - protein, 23 aa, Mycobacterium tuberculosis
PRRMLLFGLVVVVALAVLLCCWG

SEQ ID NO: 1394985 - protein, 18 aa, Mycobacterium tuberculosis
PWALQFVATLWVSTFLVV

SEQ ID NO: 1394986 - protein, 17 aa, Mycobacterium tuberculosis
PWRWFLIGFMVLFHLNI

SEQ ID NO: 1394987 - protein, 24 aa, Mycobacterium tuberculosis
RDRLALWSRVLPITFTAAGLVALV

SEQ ID NO: 1394988 - protein, 24 aa, Mycobacterium tuberculosis
REFGNLVFHFALLGLLVAVAVGKL

SEQ ID NO: 1394989 - protein, 25 aa, Mycobacterium tuberculosis
RGVSWLPFFHDMGLITVLLASVLGH

SEQ ID NO: 1394990 - protein, 24 aa, Mycobacterium tuberculosis
RLHDAWWTLILFAVIGVAVLVTAV

SEQ ID NO: 1394991 - protein, 17 aa, Mycobacterium tuberculosis
RLLPYMIGAFLLIVGAS

SEQ ID NO: 1394992 - protein, 24 aa, Mycobacterium tuberculosis
RRCRWLVFTGWLLALVPAVYLAMT

SEQ ID NO: 1394993 - protein, 19 aa, Mycobacterium tuberculosis
RSASWRRRLRVRLPRLSTI

SEQ ID NO: 1394994 - protein, 17 aa, Mycobacterium tuberculosis
RSCLPVPLLSRATVRRS

SEQ ID NO: 1394995 - protein, 18 aa, Mycobacterium tuberculosis
RYLTPWGRQFWRITRAYF

SEQ ID NO: 1394996 - protein, 17 aa, Mycobacterium tuberculosis
SGMFWVDAEPRLRALGW

SEQ ID NO: 1394997 - protein, 29 aa, Mycobacterium tuberculosis
SIPQSLLWISLVVLWLFVLVPMLISKRDA

SEQ ID NO: 1394998 - protein, 25 aa, Mycobacterium tuberculosis
TAKLAWFSKFLTIAILGLAALTFGV

SEQ ID NO: 1394999 - protein, 19 aa, Mycobacterium tuberculosis
THTPIPRPDARYGRPRLSR

SEQ ID NO: 1395000 - protein, 20 aa, Mycobacterium tuberculosis
THTPIPRPDARYGRPRLSRR

SEQ ID NO: 1395001 - protein, 21 aa, Mycobacterium tuberculosis
TILAWLLIAILLARLFVPDDV

SEQ ID NO: 1395002 - protein, 17 aa, Mycobacterium tuberculosis
TLIPYALVLLQLRVFYA

SEQ ID NO: 1395003 - protein, 20 aa, Mycobacterium tuberculosis
TLLVASAWWLFAWELDNGAG

SEQ ID NO: 1395004 - protein, 18 aa, Mycobacterium tuberculosis
TNPWPFVAVAAAVVLVLV

SEQ ID NO: 1395005 - protein, 22 aa, Mycobacterium tuberculosis
VAPSALRQSFLWGLAGVIAAEH

SEQ ID NO: 1395006 - protein, 21 aa, Mycobacterium tuberculosis
VAYRTWRWWLATAVAFFAVVV

SEQ ID NO: 1395007 - protein, 19 aa, Mycobacterium tuberculosis
VENPKCHLAWTTLAGIGRV

SEQ ID NO: 1395008 - protein, 21 aa, Mycobacterium tuberculosis
VFTVAQWRWRWFRAAMCKTMA

SEQ ID NO: 1395009 - protein, 26 aa, Mycobacterium tuberculosis
VGQANWWLPSSWRPETWWPLGRRRGR

SEQ ID NO: 1395010 - protein, 25 aa, Mycobacterium tuberculosis
VGRSVRWYLVFSQPAAVNVAEQVVL

SEQ ID NO: 1395011 - protein, 17 aa, Mycobacterium tuberculosis
VIMPLYALALDMAFTSG

SEQ ID NO: 1395012 - protein, 21 aa, Mycobacterium tuberculosis
VLIAAFLAVWWIYETYRPQAP

SEQ ID NO: 1395013 - protein, 23 aa, Mycobacterium tuberculosis
VLIAAFLAVWWIYETYRPQAPGP

SEQ ID NO: 1395014 - protein, 18 aa, Mycobacterium tuberculosis
VLSALWWAALAGTATVVI

SEQ ID NO: 1395015 - protein, 22 aa, Mycobacterium tuberculosis
VMNKLRWVLLIVGGIGVAVAAV

SEQ ID NO: 1395016 - protein, 22 aa, Mycobacterium tuberculosis
VRRSNALLDWAYGRRFRYSETM

SEQ ID NO: 1395017 - protein, 23 aa, Mycobacterium tuberculosis
VSEDKFFIIGRIKDLLIVYGRNH

SEQ ID NO: 1395018 - protein, 20 aa, Mycobacterium tuberculosis
VTALALLRRASLRQAVADGV

SEQ ID NO: 1395019 - protein, 22 aa, Mycobacterium tuberculosis
VTREQLFWLIMTESLVAGLIGT

SEQ ID NO: 1395020 - protein, 19 aa, Mycobacterium tuberculosis
VVLLILLLIVYRSAITATV

SEQ ID NO: 1395021 - protein, 19 aa, Mycobacterium tuberculosis
VWWGLWLITINDWAPLATV

SEQ ID NO: 1395022 - protein, 24 aa, Mycobacterium tuberculosis
VYSTYQLFAGGPLFFDTSALIIAF

SEQ ID NO: 1395023 - protein, 17 aa, Mycobacterium tuberculosis
WEVPLIELGLDSLMAVR

SEQ ID NO: 1395024 - protein, 19 aa, Mycobacterium tuberculosis
WGWRRTPVLRWFVLGAAVG

SEQ ID NO: 1395025 - protein, 18 aa, Mycobacterium tuberculosis
WHWAILAVVVIVLFGAKK

SEQ ID NO: 1395026 - protein, 18 aa, Mycobacterium tuberculosis
WLIMRLPVIGNTQALRWR

SEQ ID NO: 1395027 - protein, 17 aa, Mycobacterium tuberculosis
WLPLILAGFTSGFLLLR

SEQ ID NO: 1395028 - protein, 20 aa, Mycobacterium tuberculosis
WPLIVIGCWIAVAAALTLLL

SEQ ID NO: 1395029 - protein, 17 aa, Mycobacterium tuberculosis
WWALSRLLERMRGIPDV

SEQ ID NO: 1395030 - protein, 23 aa, Mycobacterium tuberculosis
WWETGRSLWWPLAIGILGIAVLV

SEQ ID NO: 1395031 - protein, 17 aa, Mycobacterium tuberculosis
YAPLWRTAWRRLRQRPF

SEQ ID NO: 1395032 - protein, 18 aa, Mycobacterium tuberculosis
YFTGYLPTLLLAAILTPA

SEQ ID NO: 1395033 - protein, 17 aa, Mycobacterium tuberculosis
YLLLGWVAVWYTATILH

SEQ ID NO: 1395034 - protein, 28 aa, Mycobacterium tuberculosis
YRLRHFGVRITRILALLLAVLLAVSGVA

SEQ ID NO: 1395035 - protein, 17 aa, Mycobacterium tuberculosis
YVDWLWFGEVGFRSVWI

SEQ ID NO: 1395036 - protein, 20 aa, Mycobacterium tuberculosis
AAAVLLAMALWLGAGPSVVR

SEQ ID NO: 1395037 - protein, 24 aa, Mycobacterium tuberculosis
AAAVPVVFLTAWYGLADLAEIKAG

SEQ ID NO: 1395038 - protein, 17 aa, Mycobacterium tuberculosis
AAINFFLIAFAVYFLVV

SEQ ID NO: 1395039 - protein, 26 aa, Mycobacterium tuberculosis
AALLGRWFWWPLRVRSRPARTPTVPS

SEQ ID NO: 1395040 - protein, 26 aa, Mycobacterium tuberculosis
AALMGRWFWWPLRVRSRPARTPTVPS

SEQ ID NO: 1395041 - protein, 29 aa, Mycobacterium tuberculosis
ACHRPNRLWWRYTAWWLLAMALATLWWVM

SEQ ID NO: 1395042 - protein, 32 aa, Mycobacterium tuberculosis
ACHRPNRLWWRYTAWWLLAMALATLWWVMALT

SEQ ID NO: 1395043 - protein, 22 aa, Mycobacterium tuberculosis
AEARWLPVALLSIGLAGFCLHA

SEQ ID NO: 1395044 - protein, 20 aa, Mycobacterium tuberculosis
AFAVLFLPYSLLGPFAGALM

SEQ ID NO: 1395045 - protein, 18 aa, Mycobacterium tuberculosis
AFFGWRWSLPLGVAILLA

SEQ ID NO: 1395046 - protein, 26 aa, Mycobacterium tuberculosis
AFPAPSWWWLAWFGLVPLLLVVRAAP

SEQ ID NO: 1395047 - protein, 23 aa, Mycobacterium tuberculosis
AFTLIPYALVLLQLRVFYAREQP

SEQ ID NO: 1395048 - protein, 20 aa, Mycobacterium tuberculosis
AGCLPAVIWWACHRPNRLWW

SEQ ID NO: 1395049 - protein, 20 aa, Mycobacterium tuberculosis
AGLGVLWLPAGWLAHRLLSV

SEQ ID NO: 1395050 - protein, 22 aa, Mycobacterium tuberculosis
AGLTIIFLLAVVTLQPFAIYSG

SEQ ID NO: 1395051 - protein, 19 aa, Mycobacterium tuberculosis
AIAFLPIVLAPAVIPPAST

SEQ ID NO: 1395052 - protein, 18 aa, Mycobacterium tuberculosis
AIGLLLFPQGFLKSLTYA

SEQ ID NO: 1395053 - protein, 24 aa, Mycobacterium tuberculosis
AIRTVRFWMAPIATTLALMSALAA

SEQ ID NO: 1395054 - protein, 19 aa, Mycobacterium tuberculosis
AIVRWPLPILAMACAIAVV

SEQ ID NO: 1395055 - protein, 23 aa, Mycobacterium tuberculosis
AKLIIWYPHYAWLLLSVYLTVAW

SEQ ID NO: 1395056 - protein, 28 aa, Mycobacterium tuberculosis
AKPMWPRGWIIPTSWRFISAASSRVGYG

SEQ ID NO: 1395057 - protein, 24 aa, Mycobacterium tuberculosis
ALIFSRYLWAFELTSALLITAAVG

SEQ ID NO: 1395058 - protein, 25 aa, Mycobacterium tuberculosis
ALIFSRYLWAFELTSALLITAAVGA

SEQ ID NO: 1395059 - protein, 24 aa, Mycobacterium tuberculosis
ALKYLSYRLFMKRYDARWLVTRMT

SEQ ID NO: 1395060 - protein, 20 aa, Mycobacterium tuberculosis
ALLCPLLVYGWLELPRWGLT

SEQ ID NO: 1395061 - protein, 18 aa, Mycobacterium tuberculosis
ALLLLYWQWRTMPAVIWD

SEQ ID NO: 1395062 - protein, 20 aa, Mycobacterium tuberculosis
ALLTRRWALAWVALAGSAMA

SEQ ID NO: 1395063 - protein, 37 aa, Mycobacterium tuberculosis; identical to SEQ ID NO: 165037

SEQ ID NO: 1395064 - protein, 23 aa, Mycobacterium tuberculosis
ALRLYTRWLGHVVLLVPTVLAVV

SEQ ID NO: 1395065 - protein, 20 aa, Mycobacterium tuberculosis
ALTWLLLVSVPILAVANYWI

SEQ ID NO: 1395066 - protein, 17 aa, Mycobacterium tuberculosis
ALYYPFVAFLCSLATTL

SEQ ID NO: 1395067 - protein, 28 aa, Mycobacterium tuberculosis
AMAYSWYLWHWPLLIFWLSYTGHRHANF

SEQ ID NO: 1395068 - protein, 19 aa, Mycobacterium tuberculosis
ANRLFIPRFLFSMGVIGVV

SEQ ID NO: 1395069 - protein, 19 aa, Mycobacterium tuberculosis
APGLWRYWAEHLDPDRARR

SEQ ID NO: 1395070 - protein, 26 aa, Mycobacterium tuberculosis
APGVILRLMLAWIPSTGVPLLAIVLA

SEQ ID NO: 1395071 - protein, 20 aa, Mycobacterium tuberculosis
APLWPFHRWLPDAAVESTPA

SEQ ID NO: 1395072 - protein, 31 aa, Mycobacterium tuberculosis; identical to SEQ ID NO: 1380911

SEQ ID NO: 1395073 - protein, 19 aa, Mycobacterium tuberculosis
APVRRLLRRLLGPTDPVLA

SEQ ID NO: 1395074 - protein, 20 aa, Mycobacterium tuberculosis
APWCGIVVMKIMFISPLWCL

SEQ ID NO: 1395075 - protein, 19 aa, Mycobacterium tuberculosis
ARLWALVRRQSLSRFERLA

SEQ ID NO: 1395076 - protein, 23 aa, Mycobacterium tuberculosis
ARLWRGLLVFFSRWWQLETLYRS

SEQ ID NO: 1395077 - protein, 26 aa, Mycobacterium tuberculosis
ARLWRGLLVFFSRWWQLETLYRSNMK

SEQ ID NO: 1395078 - protein, 23 aa, Mycobacterium tuberculosis
ASVGWLRLGALALALAALAALLI

SEQ ID NO: 1395079 - protein, 23 aa, Mycobacterium tuberculosis
ATMLAHWAWLSMLLVGGAGAAGY

SEQ ID NO: 1395080 - protein, 22 aa, Mycobacterium tuberculosis
AVDAWLRLCQTYGWAPGVMGAS

SEQ ID NO: 1395081 - protein, 17 aa, Mycobacterium tuberculosis
AVPLLWLLAIDAALITL

SEQ ID NO: 1395082 - protein, 25 aa, Mycobacterium tuberculosis
AVSIPLTVLIIFTLNILLAEFGAAD

SEQ ID NO: 1395083 - protein, 21 aa, Mycobacterium tuberculosis
AVVFFFFFFLRFCRHPCYTRW

SEQ ID NO: 1395084 - protein, 31 aa, Mycobacterium tuberculosis
AWRTTIKRWFRWFLTFLFLECGFVTIVSNPL

SEQ ID NO: 1395085 - protein, 22 aa, Mycobacterium tuberculosis
AYLLTHVLFLNYVWGYTLLEAG

SEQ ID NO: 1395086 - protein, 23 aa, Mycobacterium tuberculosis
AYSWYLWHWPLLIFWLSYTGHRH

SEQ ID NO: 1395087 - protein, 30 aa, Mycobacterium tuberculosis
AYWLGAQWWHPLVVVGLIALVAIMIAAATP

SEQ ID NO: 1395088 - protein, 18 aa, Mycobacterium tuberculosis
CCRWWAPRSPSTPTPACA

SEQ ID NO: 1395089 - protein, 23 aa, Mycobacterium tuberculosis
CHRPNRLWWRYTAWWLLAMALAT

SEQ ID NO: 1395090 - protein, 18 aa, Mycobacterium tuberculosis
CIIAFLETRYWWAGIALA

SEQ ID NO: 1395091 - protein, 18 aa, Mycobacterium tuberculosis
DAELWIAALIFPAFTAGG

SEQ ID NO: 1395092 - protein, 23 aa, Mycobacterium tuberculosis
DATMLQMLIIFGIVTVIAVVAAT

SEQ ID NO: 1395093 - protein, 23 aa, Mycobacterium tuberculosis
DDELFFFAVLLLVAGYESTAHMI

SEQ ID NO: 1395094 - protein, 19 aa, Mycobacterium tuberculosis
DFDDFWRPIRSYFYWEKHC

SEQ ID NO: 1395095 - protein, 18 aa, Mycobacterium tuberculosis
DGELFIMGRIKDLLIVDG

SEQ ID NO: 1395096 - protein, 18 aa, Mycobacterium tuberculosis
DLVVVFLVTWPLVYLASK

SEQ ID NO: 1395097 - protein, 23 aa, Mycobacterium tuberculosis
DPAPPLILFLTAGSGITPVMSML

SEQ ID NO: 1395098 - protein, 25 aa, Mycobacterium tuberculosis
DPLRRLLREFRGPLALSLLLVAVQT

SEQ ID NO: 1395099 - protein, 24 aa, Mycobacterium tuberculosis
DRTLLLWMLPLLIAPPMYSKDVYS

SEQ ID NO: 1395100 - protein, 23 aa, Mycobacterium tuberculosis
DRVSLPLWVLLLSVPLATVYIAS

SEQ ID NO: 1395101 - protein, 24 aa, Mycobacterium tuberculosis
DRVSLPLWVLLLSVPLATVYIASV

SEQ ID NO: 1395102 - protein, 25 aa, Mycobacterium tuberculosis
DTEWLHVPFLPVPIPVPIPQNPGAG

SEQ ID NO: 1395103 - protein, 24 aa, Mycobacterium tuberculosis
DVLQAYLNIIYFGRGAYGISAASK

SEQ ID NO: 1395104 - protein, 26 aa, Mycobacterium tuberculosis
DVRYRDRLLLPLPMFHVAALATVIFS

SEQ ID NO: 1395105 - protein, 21 aa, Mycobacterium tuberculosis
EADGWRWVFLVNLPLGVFAVL

SEQ ID NO: 1395106 - protein, 19 aa, Mycobacterium tuberculosis
EALFRRRALFRPMHDRLAS

SEQ ID NO: 1395107 - protein, 21 aa, Mycobacterium tuberculosis
EEQYYVVWPLLLIGATLLLAA

SEQ ID NO: 1395108 - protein, 20 aa, Mycobacterium tuberculosis
EFAGYFAWLAWLVLHLVYLV

SEQ ID NO: 1395109 - protein, 19 aa, Mycobacterium tuberculosis
ELVLTVIPFLIISVLFYFT

SEQ ID NO: 1395110 - protein, 18 aa, Mycobacterium tuberculosis
ENPKCHLAWTTLAGIGRV

SEQ ID NO: 1395111 - protein, 19 aa, Mycobacterium tuberculosis
EPSRRWGLPLALTASAVVM

SEQ ID NO: 1395112 - protein, 18 aa, Mycobacterium tuberculosis
ERIWLPFTIWLTAAPALL

SEQ ID NO: 1395113 - protein, 22 aa, Mycobacterium tuberculosis
ERIWLPFTIWLTAAPALLPPRS

SEQ ID NO: 1395114 - protein, 17 aa, Mycobacterium tuberculosis
ETIFRFALYAFLCATAL

SEQ ID NO: 1395115 - protein, 17 aa, Mycobacterium tuberculosis
ETRYWWAGIALASLGVI

SEQ ID NO: 1395116 - protein, 21 aa, Mycobacterium tuberculosis
EWLYQSWAAAYLPLLQVLAAL

SEQ ID NO: 1395117 - protein, 17 aa, Mycobacterium tuberculosis
FAALALALTGGAWQWSA

SEQ ID NO: 1395118 - protein, 17 aa, Mycobacterium tuberculosis
FAEPLYRSVLIVYFVVM

SEQ ID NO: 1395119 - protein, 19 aa, Mycobacterium tuberculosis
FAGILLGLFYLVAVARVIH

SEQ ID NO: 1395120 - protein, 17 aa, Mycobacterium tuberculosis
FASLWSWFIGLVVTEFP

SEQ ID NO: 1395121 - protein, 19 aa, Mycobacterium tuberculosis
FAVPIILGWLVTIAVLNVT

SEQ ID NO: 1395122 - protein, 17 aa, Mycobacterium tuberculosis
FCLFGVLFVLLRRGRVA

SEQ ID NO: 1395123 - protein, 18 aa, Mycobacterium tuberculosis
FDSLLAVARPFFAKNREV

SEQ ID NO: 1395124 - protein, 17 aa, Mycobacterium tuberculosis
FFFTSFVVALIPLVWLL

SEQ ID NO: 1395125 - protein, 24 aa, Mycobacterium tuberculosis
FGEYLPMPWLFRHLSGYADRAGHF

SEQ ID NO: 1395126 - protein, 17 aa, Mycobacterium tuberculosis
FGFWRGLYFTTIARRGL

SEQ ID NO: 1395127 - protein, 26 aa, Mycobacterium tuberculosis
FIAVLVLWDLFGQLPLPLGVVGHEGS

SEQ ID NO: 1395128 - protein, 17 aa, Mycobacterium tuberculosis
FLLGLLLPHGLLELTAV

SEQ ID NO: 1395129 - protein, 17 aa, Mycobacterium tuberculosis
FLLMWIMSWLTAAPVRV

SEQ ID NO: 1395130 - protein, 22 aa, Mycobacterium tuberculosis
FLTTALISLIQRPQLRNLLHEK

SEQ ID NO: 1395131 - protein, 18 aa, Mycobacterium tuberculosis
FPLQVPWLPLAAPLAVLA

SEQ ID NO: 1395132 - protein, 19 aa, Mycobacterium tuberculosis
FQLILGQEMHWSLPGLSFI

SEQ ID NO: 1395133 - protein, 24 aa, Mycobacterium tuberculosis
FTAVPLLWLLAIDAALITLGRHGL

SEQ ID NO: 1395134 - protein, 20 aa, Mycobacterium tuberculosis
FTSFVVALIPLVWLLWVVIA

SEQ ID NO: 1395135 - protein, 18 aa, Mycobacterium tuberculosis
FTYRDVLGFLYAQAKFQL

SEQ ID NO: 1395136 - protein, 17 aa, Mycobacterium tuberculosis
FVAAYVPYVAWLVQASA

SEQ ID NO: 1395137 - protein, 17 aa, Mycobacterium tuberculosis
FVAAYVPYVAWLVQASS

SEQ ID NO: 1395138 - protein, 18 aa, Mycobacterium tuberculosis
FVFLALLPFIMGALSMSV

SEQ ID NO: 1395139 - protein, 18 aa, Mycobacterium tuberculosis
FVIEALPALLLAPLLRRL

SEQ ID NO: 1395140 - protein, 17 aa, Mycobacterium tuberculosis
FVLIMMIALPRVPIGWD

SEQ ID NO: 1395141 - protein, 23 aa, Mycobacterium tuberculosis
GAGWFGLFGLAFWVALAGLTPSG

SEQ ID NO: 1395142 - protein, 18 aa, Mycobacterium tuberculosis
GAVAWLISLFYKAIYTGG

SEQ ID NO: 1395143 - protein, 20 aa, Mycobacterium tuberculosis
GAVAWLISLFYKAIYTGGPI

SEQ ID NO: 1395144 - protein, 17 aa, Mycobacterium tuberculosis
GCHTMSLDWVAWRGLGL

SEQ ID NO: 1395145 - protein, 25 aa, Mycobacterium tuberculosis
GDAAWLLAAVWWKALLALAVAVALV

SEQ ID NO: 1395146 - protein, 17 aa, Mycobacterium tuberculosis
GERWWVLLLSLATRGRA

SEQ ID NO: 1395147 - protein, 24 aa, Mycobacterium tuberculosis
GGFLLMWILAWLTAAPVRVVRAAL

SEQ ID NO: 1395148 - protein, 28 aa, Mycobacterium tuberculosis
GGLILLVKKIWWPLAVWLLLIVMNVDAG

SEQ ID NO: 1395149 - protein, 21 aa, Mycobacterium tuberculosis
GGLVVIMPLYALALDMAFTSG

SEQ ID NO: 1395150 - protein, 24 aa, Mycobacterium tuberculosis
GKVSYLALGILVAIALVIGGIGGV

SEQ ID NO: 1395151 - protein, 21 aa, Mycobacterium tuberculosis
GLAHFFTMWGFFILLTVYIEA

SEQ ID NO: 1395152 - protein, 20 aa, Mycobacterium tuberculosis
GLGPYLSIYLLLIHDWDQAS

SEQ ID NO: 1395153 - protein, 20 aa, Mycobacterium tuberculosis
GLLVPVLTWPVSAPLLVIPV

SEQ ID NO: 1395154 - protein, 32 aa, Mycobacterium tuberculosis
GLPALAFPAPSWWWLAWFGLVPLLLVVRAAPT

SEQ ID NO: 1395155 - protein, 34 aa, Mycobacterium tuberculosis; identical to SEQ ID NO: 165458

SEQ ID NO: 1395156 - protein, 28 aa, Mycobacterium tuberculosis
GLSLSIITVLMPLALFGILGLAAVVLVH

SEQ ID NO: 1395157 - protein, 24 aa, Mycobacterium tuberculosis
GLSVLLWQHILAIYLHWLVLAMSV

SEQ ID NO: 1395158 - protein, 19 aa, Mycobacterium tuberculosis
GLSWRWLFGLSIIPALISL

SEQ ID NO: 1395159 - protein, 17 aa, Mycobacterium tuberculosis
GMRLTVLLALLANLFLP

SEQ ID NO: 1395160 - protein, 24 aa, Mycobacterium tuberculosis
GRAYDPRFLFAWPSAKSAVMGGAQ

SEQ ID NO: 1395161 - protein, 20 aa, Mycobacterium tuberculosis
GSALLAALTVLLLIWVLRRR

SEQ ID NO: 1395162 - protein, 17 aa, Mycobacterium tuberculosis
GSYWAMFILVPGTLVLV

SEQ ID NO: 1395163 - protein, 24 aa, Mycobacterium tuberculosis
GVALVFVQWWGQPAWSWAVLGLRG

SEQ ID NO: 1395164 - protein, 23 aa, Mycobacterium tuberculosis
GVILRLMLAWIPSTGVPLLAIVL

SEQ ID NO: 1395165 - protein, 18 aa, Mycobacterium tuberculosis
GVLFWFTFVGWVTVVIAG

SEQ ID NO: 1395166 - protein, 18 aa, Mycobacterium tuberculosis
GVRITRILALLLAVLLAV

SEQ ID NO: 1395167 - protein, 18 aa, Mycobacterium tuberculosis
GWRRTPVLRWFVLGAAVG

SEQ ID NO: 1395168 - protein, 25 aa, Mycobacterium tuberculosis
GWVTQRLWWAVLLTVGFWGLLRVAE

SEQ ID NO: 1395169 - protein, 26 aa, Mycobacterium tuberculosis
GWVTQRLWWAVLLTVGFWGLLRVAEA

SEQ ID NO: 1395170 - protein, 17 aa, Mycobacterium tuberculosis
GYPLELLVRAAAAGWRV

SEQ ID NO: 1395171 - protein, 18 aa, Mycobacterium tuberculosis
HALSLPIILFWVALTIVV

SEQ ID NO: 1395172 - protein, 23 aa, Mycobacterium tuberculosis
HARSGGRRWIRCERLPIAGAELV

SEQ ID NO: 1395173 - protein, 23 aa, Mycobacterium tuberculosis
HGRSRLWLFRYQGTPIAFFLNVW

SEQ ID NO: 1395174 - protein, 18 aa, Mycobacterium tuberculosis
HGSLWVLPLRWSMVEYFY

SEQ ID NO: 1395175 - protein, 18 aa, Mycobacterium tuberculosis
HHGFFIFAIVLTALSIIP

SEQ ID NO: 1395176 - protein, 17 aa, Mycobacterium tuberculosis
HIAKPWRWGYLGVLLVI

SEQ ID NO: 1395177 - protein, 19 aa, Mycobacterium tuberculosis
HKVGPVIRLPLVLGLAQLL

SEQ ID NO: 1395178 - protein, 25 aa, Mycobacterium tuberculosis
HNGGAWLVLLMIFNVIWTYVLVRGS

SEQ ID NO: 1395179 - protein, 26 aa, Mycobacterium tuberculosis
HNGGAWLVLLMIFNVIWTYVLVRGSA

SEQ ID NO: 1395180 - protein, 21 aa, Mycobacterium tuberculosis
HPTFLAFPMMMLVSLVVTAVT

SEQ ID NO: 1395181 - protein, 18 aa, Mycobacterium tuberculosis
HRRVLLICTFAIGAAAVF

SEQ ID NO: 1395182 - protein, 17 aa, Mycobacterium tuberculosis
HWAILAVVVIVLFGAKK

SEQ ID NO: 1395183 - protein, 22 aa, Mycobacterium tuberculosis
IAFDQLWRWNSIVALVLSVMVI

SEQ ID NO: 1395184 - protein, 21 aa, Mycobacterium tuberculosis
IAFDQLWRWNSIVSLVLSVMV

SEQ ID NO: 1395185 - protein, 19 aa, Mycobacterium tuberculosis
IDGPYYLFGVLAKLAVLPS

SEQ ID NO: 1395186 - protein, 22 aa, Mycobacterium tuberculosis
IEADGWRWVFLVNLPLGVFAVL

SEQ ID NO: 1395187 - protein, 23 aa, Mycobacterium tuberculosis
IEADGWRWVFLVNLPLGVFAVLA

SEQ ID NO: 1395188 - protein, 18 aa, Mycobacterium tuberculosis
IFGFVWYSHSIFGLDSLG

SEQ ID NO: 1395189 - protein, 27 aa, Mycobacterium tuberculosis
IFVLPALLMIGWWSGFPYWTTAAVCAL

SEQ ID NO: 1395190 - protein, 24 aa, Mycobacterium tuberculosis
IGFFVFDLPFYRSVLNWLFVAVVL

SEQ ID NO: 1395191 - protein, 18 aa, Mycobacterium tuberculosis
IGQFIRWLFRFLVGQVDR

SEQ ID NO: 1395192 - protein, 24 aa, Mycobacterium tuberculosis
IHALSLPIILFWVALTIVVNVVAP

SEQ ID NO: 1395193 - protein, 17 aa, Mycobacterium tuberculosis
IILILVYRNLVTMLVPL

SEQ ID NO: 1395194 - protein, 17 aa, Mycobacterium tuberculosis
IITVLMPLALFGILGLA

SEQ ID NO: 1395195 - protein, 22 aa, Mycobacterium tuberculosis
ILAWLLIAILLARLFVPDDVGP

SEQ ID NO: 1395196 - protein, 18 aa, Mycobacterium tuberculosis
ILFLRILFTAITFGALWL

SEQ ID NO: 1395197 - protein, 27 aa, Mycobacterium tuberculosis
INFFLIAFAVYFLVVLPYNTLRKKGEV

SEQ ID NO: 1395198 - protein, 24 aa, Mycobacterium tuberculosis
INRILQFITYLLVPAGLLTIYTQL

SEQ ID NO: 1395199 - protein, 25 aa, Mycobacterium tuberculosis
INTYSMDLFLRIAPELYLKRLCVGG

SEQ ID NO: 1395200 - protein, 23 aa, Mycobacterium tuberculosis
IPNGTFFVVLAIFLVVLAVIGTF

SEQ ID NO: 1395201 - protein, 21 aa, Mycobacterium tuberculosis
IPQLPPPEYLRFPGIGQFSAI

SEQ ID NO: 1395202 - protein, 17 aa, Mycobacterium tuberculosis
IPYALVLLQLRVFYARE

SEQ ID NO: 1395203 - protein, 29 aa, Mycobacterium tuberculosis
IRRFAVVIVLLWLGFTAFVNLAVPQLEVV

SEQ ID NO: 1395204 - protein, 19 aa, Mycobacterium tuberculosis
IRTVRFWMAPIATTLALMS

SEQ ID NO: 1395205 - protein, 17 aa, Mycobacterium tuberculosis
ISALLNPGARNAAPLQQ

SEQ ID NO: 1395206 - protein, 21 aa, Mycobacterium tuberculosis
ISAMLIYRLISWLLIAAIGWV

SEQ ID NO: 1395207 - protein, 25 aa, Mycobacterium tuberculosis
ISPQTLFFPFVLLLAATALYRGNDK

SEQ ID NO: 1395208 - protein, 30 aa, Mycobacterium tuberculosis
ITTLIFGFLVMWILAWLTAAPVRVVRAALK

SEQ ID NO: 1395209 - protein, 25 aa, Mycobacterium tuberculosis
IVIVFLILVILLRALVAPIYLIGSV

SEQ ID NO: 1395210 - protein, 23 aa, Mycobacterium tuberculosis
IVRRPWVVIAFWVALAGLLAPTV

SEQ ID NO: 1395211 - protein, 19 aa, Mycobacterium tuberculosis
IVVLLILLLIVYRSAITAT

SEQ ID NO: 1395212 - protein, 17 aa, Mycobacterium tuberculosis
IYLLLIHDWDQASIGFV

SEQ ID NO: 1395213 - protein, 17 aa, Mycobacterium tuberculosis
KALLLLGLWLAGWGAAR

SEQ ID NO: 1395214 - protein, 17 aa, Mycobacterium tuberculosis
KARLWFVHRGIEKLFHG

SEQ ID NO: 1395215 - protein, 18 aa, Mycobacterium tuberculosis
KCHPVILPPLFGCNDRAM

SEQ ID NO: 1395216 - protein, 18 aa, Mycobacterium tuberculosis
KGDFLLGLLLPHGLLELT

SEQ ID NO: 1395217 - protein, 29 aa, Mycobacterium tuberculosis
KLEFAGYFAWLAWLVLHLVYLVGYRNRIA

SEQ ID NO: 1395218 - protein, 29 aa, Mycobacterium tuberculosis
KLIIWYPHYAWLLLSVYLTVALVALVVVG

SEQ ID NO: 1395219 - protein, 21 aa, Mycobacterium tuberculosis
KLYPLLFLYPLLLLGIRAGRL

SEQ ID NO: 1395220 - protein, 22 aa, Mycobacterium tuberculosis
KPLPASIPWTALWLSQAWQQRV

SEQ ID NO: 1395221 - protein, 22 aa, Mycobacterium tuberculosis
KTNPWPFVAVAAAVVLVLVLGA

SEQ ID NO: 1395222 - protein, 21 aa, Mycobacterium tuberculosis
KVGPWALYGLLFTIVILFALQ

SEQ ID NO: 1395223 - protein, 22 aa, Mycobacterium tuberculosis
KYPPGWPAGPYPPGPPPPGPGS

SEQ ID NO: 1395224 - protein, 17 aa, Mycobacterium tuberculosis
LAAPAPHGALAGSGKLG

SEQ ID NO: 1395225 - protein, 17 aa, Mycobacterium tuberculosis
LAAPLLRPGYLLLRDAV

SEQ ID NO: 1395226 - protein, 25 aa, Mycobacterium tuberculosis
LACPVWFYQLWAFITPGLYQRERRF

SEQ ID NO: 1395227 - protein, 18 aa, Mycobacterium tuberculosis
LAGLAFTLGMVLTSTLMV

SEQ ID NO: 1395228 - protein, 18 aa, Mycobacterium tuberculosis
LAIVFLIPQRIGLTVLAW

SEQ ID NO: 1395229 - protein, 21 aa, Mycobacterium tuberculosis
LAPHHFLLTEWFAPYVEFLVS

SEQ ID NO: 1395230 - protein, 18 aa, Mycobacterium tuberculosis
LAPLFPMTVVLPLSAFVA

SEQ ID NO: 1395231 - protein, 17 aa, Mycobacterium tuberculosis
LAPLFPMTVVVPLSAFV

SEQ ID NO: 1395232 - protein, 23 aa, Mycobacterium tuberculosis
LCLIFIIMLIITRSVVAAAVIVG

SEQ ID NO: 1395233 - protein, 18 aa, Mycobacterium tuberculosis
LDWVAWRGLGLAADAQLV

SEQ ID NO: 1395234 - protein, 18 aa, Mycobacterium tuberculosis
LETRYWWAGIALASLGVI

SEQ ID NO: 1395235 - protein, 18 aa, Mycobacterium tuberculosis
LFCLFGVLFVLLRRGRVA

SEQ ID NO: 1395236 - protein, 18 aa, Mycobacterium tuberculosis
LFFQRVFGAGIATLVAVA

SEQ ID NO: 1395237 - protein, 24 aa, Mycobacterium tuberculosis
LFHLSLRHALWWLGSLAAVASFTL

SEQ ID NO: 1395238 - protein, 18 aa, Mycobacterium tuberculosis
LFIMGRIKDLLIVDGRNH

SEQ ID NO: 1395239 - protein, 18 aa, Mycobacterium tuberculosis
LFNPILMMALAALGIGSV

SEQ ID NO: 1395240 - protein, 19 aa, Mycobacterium tuberculosis
LFVAAYVPYVAWLVQASAD

SEQ ID NO: 1395241 - protein, 17 aa, Mycobacterium tuberculosis
LFWLIMTESLVAGLIGT

SEQ ID NO: 1395242 - protein, 17 aa, Mycobacterium tuberculosis
LGHLWSWELAIPMSGIA

SEQ ID NO: 1395243 - protein, 19 aa, Mycobacterium tuberculosis
LGPYLSIYLLLIHDWDQAS

SEQ ID NO: 1395244 - protein, 19 aa, Mycobacterium tuberculosis
LGWAFGYNTAAIPLAALGA

SEQ ID NO: 1395245 - protein, 20 aa, Mycobacterium tuberculosis
LIAFAVYFLVVLPYNTLRKK

SEQ ID NO: 1395246 - protein, 25 aa, Mycobacterium tuberculosis
LIGAYGWRWIFLVNLPVGLSALVLA

SEQ ID NO: 1395247 - protein, 28 aa, Mycobacterium tuberculosis
LIVSDRGYFVFLALLPFIMGALSMSVPG

SEQ ID NO: 1395248 - protein, 23 aa, Mycobacterium tuberculosis
LLGRWFWWPLRVRSRPARTPTVP

SEQ ID NO: 1395249 - protein, 17 aa, Mycobacterium tuberculosis
LLIMILLPVLVGLDVST

SEQ ID NO: 1395250 - protein, 18 aa, Mycobacterium tuberculosis
LLIMILLPVLVGLDVSTR

SEQ ID NO: 1395251 - protein, 17 aa, Mycobacterium tuberculosis
LLMPWYIGSAPFPISAL

SEQ ID NO: 1395252 - protein, 21 aa, Mycobacterium tuberculosis
LLPTLQSFLPPPFDAIPNPIE

SEQ ID NO: 1395253 - protein, 23 aa, Mycobacterium tuberculosis
LLVLVYSLLYYRVLGLLTALSLV

SEQ ID NO: 1395254 - protein, 18 aa, Mycobacterium tuberculosis
LMPLALFGILGLAAVVLV

SEQ ID NO: 1395255 - protein, 19 aa, Mycobacterium tuberculosis
LMPLALFGILGLAAVVLVH

SEQ ID NO: 1395256 - protein, 17 aa, Mycobacterium tuberculosis
LMSPMAFLQRPARWMQL

SEQ ID NO: 1395257 - protein, 23 aa, Mycobacterium tuberculosis
LMSPMSFLRRPARWMQLLATSGR

SEQ ID NO: 1395258 - protein, 24 aa, Mycobacterium tuberculosis
LMVGLFIPLFVGCPVILTSPEAFI

SEQ ID NO: 1395259 - protein, 25 aa, Mycobacterium tuberculosis
LNLATARFFFFFFFSTRTGCPKSEL

SEQ ID NO: 1395260 - protein, 17 aa, Mycobacterium tuberculosis
LNPVQFPKALLLKVTGP

SEQ ID NO: 1395261 - protein, 32 aa, Mycobacterium tuberculosis
LPLRAMVMVLLFLGVVFLLLVWQALGSSPNSE

SEQ ID NO: 1395262 - protein, 22 aa, Mycobacterium tuberculosis
LPMMLAPWVLLPTILALRGTSG

SEQ ID NO: 1395263 - protein, 17 aa, Mycobacterium tuberculosis
LPTGCILAWILVRIINV

SEQ ID NO: 1395264 - protein, 19 aa, Mycobacterium tuberculosis
LPTLRRPWRRSPGATIIVV

SEQ ID NO: 1395265 - protein, 17 aa, Mycobacterium tuberculosis
LPWEVPLIELGLDSLMA

SEQ ID NO: 1395266 - protein, 35 aa, Mycobacterium tuberculosis
LQLYDFLWYPYYASYGLLLLPFFTPTLSALTALSA

SEQ ID NO: 1395267 - protein, 23 aa, Mycobacterium tuberculosis
LRENVVALTVLWLLNIGEYLQDL

SEQ ID NO: 1395268 - protein, 22 aa, Mycobacterium tuberculosis
LRKGERLLVFLPLAHVLARAIS

SEQ ID NO: 1395269 - protein, 18 aa, Mycobacterium tuberculosis
LRNYLLPLGAVLLLLVKA

SEQ ID NO: 1395270 - protein, 26 aa, Mycobacterium tuberculosis
LRQFHHPLIYVLLVAGTITAGLKEFV

SEQ ID NO: 1395271 - protein, 26 aa, Mycobacterium tuberculosis
LRRRLSGGVLLLIALTIAGGLAAVLT

SEQ ID NO: 1395272 - protein, 25 aa, Mycobacterium tuberculosis
LSIITVLMPLALFGILGLAAVVLVH

SEQ ID NO: 1395273 - protein, 20 aa, Mycobacterium tuberculosis
LSLPILLFWVGVAAITNAAV

SEQ ID NO: 1395274 - protein, 24 aa, Mycobacterium tuberculosis
LTDYLSWRWAFWINVPVSISVLTV

SEQ ID NO: 1395275 - protein, 18 aa, Mycobacterium tuberculosis
LTGWLVRRTLLVSTLLVA

SEQ ID NO: 1395276 - protein, 24 aa, Mycobacterium tuberculosis
LTGWLVRRTLLVSTLLVASAWWLF

SEQ ID NO: 1395277 - protein, 17 aa, Mycobacterium tuberculosis
LTLLLFDIGSFAGLAAL

SEQ ID NO: 1395278 - protein, 26 aa, Mycobacterium tuberculosis
LVFGFILMWILAWLTATPVRVVRAAL

SEQ ID NO: 1395279 - protein, 18 aa, Mycobacterium tuberculosis
LVGWLSLAAGLLAIAALA

SEQ ID NO: 1395280 - protein, 17 aa, Mycobacterium tuberculosis
LVLAYLGLLWWMMVCWS

SEQ ID NO: 1395281 - protein, 21 aa, Mycobacterium tuberculosis
LVLFTLIFFLYGGRSIWQYVT

SEQ ID NO: 1395282 - protein, 18 aa, Mycobacterium tuberculosis
LVLLAAGLGVLWLPAGWL

SEQ ID NO: 1395283 - protein, 20 aa, Mycobacterium tuberculosis
LVLLAAGLGVLWLPAGWLAH

SEQ ID NO: 1395284 - protein, 21 aa, Mycobacterium tuberculosis
LVLVLLLAAPLLRPGYLLLRD

SEQ ID NO: 1395285 - protein, 20 aa, Mycobacterium tuberculosis
LVLVYSLLYYRVLGLLTALS

SEQ ID NO: 1395286 - protein, 19 aa, Mycobacterium tuberculosis
LVTTIFGFVWYSHSIFGLD

SEQ ID NO: 1395287 - protein, 18 aa, Mycobacterium tuberculosis
LVWIERALVVLVAAAPCA

SEQ ID NO: 1395288 - protein, 18 aa, Mycobacterium tuberculosis
LWLLAIDAALITLGAMAF

SEQ ID NO: 1395289 - protein, 19 aa, Mycobacterium tuberculosis
LWQHLFWFFGHPEVYIIAL

SEQ ID NO: 1395290 - protein, 17 aa, Mycobacterium tuberculosis
LYGLLFTIVILFALQGD

SEQ ID NO: 1395291 - protein, 25 aa, Mycobacterium tuberculosis
MAYSWYLWHWPLLIFWLSYTGHRHA

SEQ ID NO: 1395292 - protein, 17 aa, Mycobacterium tuberculosis
MFWVDAEPRLRALGWTG

SEQ ID NO: 1395293 - protein, 18 aa, Mycobacterium tuberculosis
MLIGIYLLVFFTGDKHTA

SEQ ID NO: 1395294 - protein, 17 aa, Mycobacterium tuberculosis
MLLVIYRSVITAVLVLI

SEQ ID NO: 1395295 - protein, 18 aa, Mycobacterium tuberculosis
MLMMPLMMIVMMVGGLAG

SEQ ID NO: 1395296 - protein, 20 aa, Mycobacterium tuberculosis
MLMMPLMMIVMMVGGLAGST

SEQ ID NO: 1395297 - protein, 18 aa, Mycobacterium tuberculosis
MLMMPLMMSVMMVGGLAG

SEQ ID NO: 1395298 - protein, 26 aa, Mycobacterium tuberculosis
MLVLLAAGLGVLWLPAGWLAHRLLSV

SEQ ID NO: 1395299 - protein, 17 aa, Mycobacterium tuberculosis
MMLAPWVLLPTILALRG

SEQ ID NO: 1395300 - protein, 18 aa, Mycobacterium tuberculosis
MMLAPWVLLPTILALRGT

SEQ ID NO: 1395301 - protein, 17 aa, Mycobacterium tuberculosis
MVLICLFLYHVFRNRNW

SEQ ID NO: 1395302 - protein, 18 aa, Mycobacterium tuberculosis
MWLWRLGYSTVGAGARLL

SEQ ID NO: 1395303 - protein, 18 aa, Mycobacterium tuberculosis
NAEYWYRSIRQPVQFARA

SEQ ID NO: 1395304 - protein, 22 aa, Mycobacterium tuberculosis
NDVPFYFHYLGPGAQLDGPEIM

SEQ ID NO: 1395305 - protein, 19 aa, Mycobacterium tuberculosis
NEDLPLLQPLRGIVPEPLL

SEQ ID NO: 1395306 - protein, 21 aa, Mycobacterium tuberculosis
NGTFLVVLAIFLVVLAVIGTF

SEQ ID NO: 1395307 - protein, 21 aa, Mycobacterium tuberculosis
NPLVWIERALVVLVAAAPCAL

SEQ ID NO: 1395308 - protein, 19 aa, Mycobacterium tuberculosis
NRMAFLAALFFLLALCWAT

SEQ ID NO: 1395309 - protein, 17 aa, Mycobacterium tuberculosis
NSFPKWRWSITTALLEL

SEQ ID NO: 1395310 - protein, 17 aa, Mycobacterium tuberculosis
NSFPKWRWSLTTALLEL

SEQ ID NO: 1395311 - protein, 25 aa, Mycobacterium tuberculosis
NVFNGLVAAFLWFTVLFANFAEAMA

SEQ ID NO: 1395312 - protein, 23 aa, Mycobacterium tuberculosis
PAFPPYVPTLLPPPPPPQLATLI

SEQ ID NO: 1395313 - protein, 17 aa, Mycobacterium tuberculosis
PAKPLPASIPWTALWLS

SEQ ID NO: 1395314 - protein, 19 aa, Mycobacterium tuberculosis
PALMVLLGRWLWWPRRSVS

SEQ ID NO: 1395315 - protein, 30 aa, Mycobacterium tuberculosis
PARYLSVFLVMLIGIYLLVFFTGDKHTAPK

SEQ ID NO: 1395316 - protein, 20 aa, Mycobacterium tuberculosis
PDVNTWWAFRTSCTPTECLA

SEQ ID NO: 1395317 - protein, 21 aa, Mycobacterium tuberculosis
PFVMLGAALLWFGWYGFNAGS

SEQ ID NO: 1395318 - protein, 22 aa, Mycobacterium tuberculosis
PFVMLGAALLWFGWYGFNAGSA

SEQ ID NO: 1395319 - protein, 19 aa, Mycobacterium tuberculosis
PGPLVLWLFIWHLAPAGPG

SEQ ID NO: 1395320 - protein, 23 aa, Mycobacterium tuberculosis
PGVILRLMLAWIPSTGVPLLAIV

SEQ ID NO: 1395321 - protein, 17 aa, Mycobacterium tuberculosis
PHWTPLFAYAAAFLIAL

SEQ ID NO: 1395322 - protein, 27 aa, Mycobacterium tuberculosis
PILAVAMPWLFLRLRFCRRKWTVTTLA

SEQ ID NO: 1395323 - protein, 20 aa, Mycobacterium tuberculosis
PKLGPLISALLNPGARNAAP

SEQ ID NO: 1395324 - protein, 19 aa, Mycobacterium tuberculosis
PLEQLSWLSPSRWAYAMAA

SEQ ID NO: 1395325 - protein, 17 aa, Mycobacterium tuberculosis
PLIRLSLGKRHPMRRIV

SEQ ID NO: 1395326 - protein, 17 aa, Mycobacterium tuberculosis
PLLWLLAIDAALITLGA

SEQ ID NO: 1395327 - protein, 17 aa, Mycobacterium tuberculosis
PLRPLFGWITRYSKAAA

SEQ ID NO: 1395328 - protein, 24 aa, Mycobacterium tuberculosis
PLRRLLREFRGPLALSLLLVAVQT

SEQ ID NO: 1395329 - protein, 20 aa, Mycobacterium tuberculosis
PLYLLLGWVAVWYTATILHN

SEQ ID NO: 1395330 - protein, 20 aa, Mycobacterium tuberculosis
PMMLAPWVLLPTILALRGTS

SEQ ID NO: 1395331 - protein, 23 aa, Mycobacterium tuberculosis
PNSALVSWLPFYHDMGLVIGICA

SEQ ID NO: 1395332 - protein, 20 aa, Mycobacterium tuberculosis
PPCIIAFLETRYWWAGIALA

SEQ ID NO: 1395333 - protein, 27 aa, Mycobacterium tuberculosis
PPGKKFTWHWWWLGAAALGVLLVVMVA

SEQ ID NO: 1395334 - protein, 20 aa, Mycobacterium tuberculosis
PPIPPIPPIPEIPQLPPRIP

SEQ ID NO: 1395335 - protein, 17 aa, Mycobacterium tuberculosis
PPKPRVFAIKPPCPEPA

SEQ ID NO: 1395336 - protein, 17 aa, Mycobacterium tuberculosis
PPRFWWPQRVRPRPASR

SEQ ID NO: 1395337 - protein, 23 aa, Mycobacterium tuberculosis
PPWEFYFWHHTIPAPVWVAVIMG

SEQ ID NO: 1395338 - protein, 24 aa, Mycobacterium tuberculosis
PRAKLFAALFLILALVVVGEVAGV

SEQ ID NO: 1395339 - protein, 24 aa, Mycobacterium tuberculosis
PRQPWPWLALLVAGLTVGPLHHPG

SEQ ID NO: 1395340 - protein, 22 aa, Mycobacterium tuberculosis
PSTPVSWLPFYHDMGLMLGIIL

SEQ ID NO: 1395341 - protein, 18 aa, Mycobacterium tuberculosis
PTIALPTFSARVFVLVAF

SEQ ID NO: 1395342 - protein, 19 aa, Mycobacterium tuberculosis
PTQLWLGRPLIGDGVHGAP

SEQ ID NO: 1395343 - protein, 22 aa, Mycobacterium tuberculosis
PVVTWAAWPFHRVAMRNARHHA

SEQ ID NO: 1395344 - protein, 20 aa, Mycobacterium tuberculosis
PWIGALLGVLFVLTTALGDL

SEQ ID NO: 1395345 - protein, 18 aa, Mycobacterium tuberculosis
QEAALTWLLLVSVPILAV

SEQ ID NO: 1395346 - protein, 20 aa, Mycobacterium tuberculosis
QGCHTMSLDWVAWRGLGLAA

SEQ ID NO: 1395347 - protein, 17 aa, Mycobacterium tuberculosis
QHPLFRARWAKCPSNTT

SEQ ID NO: 1395348 - protein, 18 aa, Mycobacterium tuberculosis
QLFWLIMTESLVAGLIGT

SEQ ID NO: 1395349 - protein, 17 aa, Mycobacterium tuberculosis
QLILFAIVSVVAIVVLG

SEQ ID NO: 1395350 - protein, 17 aa, Mycobacterium tuberculosis
QLLGPGPRWWGLALLAV

SEQ ID NO: 1395351 - protein, 18 aa, Mycobacterium tuberculosis
QLTAAFGGALWAARRPGD

SEQ ID NO: 1395352 - protein, 23 aa, Mycobacterium tuberculosis
QPSQLLVLLIIGGALMAVLPRSV

SEQ ID NO: 1395353 - protein, 17 aa, Mycobacterium tuberculosis
QVSGRLLFALLSFSVVG

SEQ ID NO: 1395354 - protein, 19 aa, Mycobacterium tuberculosis
QWPLFAWFCVYAYRNFVRY

SEQ ID NO: 1395355 - protein, 24 aa, Mycobacterium tuberculosis
QYAVFLLVLPLLLSLFAHAVPGQA

SEQ ID NO: 1395356 - protein, 25 aa, Mycobacterium tuberculosis
RAGELLFWLPYPSFATYLHVGCAQI

SEQ ID NO: 1395357 - protein, 17 aa, Mycobacterium tuberculosis
RAQLDGWRYGWVLNIGA

SEQ ID NO: 1395358 - protein, 26 aa, Mycobacterium tuberculosis
RDRVSLPLWVLLLSVPLATVYIASVE

SEQ ID NO: 1395359 - protein, 27 aa, Mycobacterium tuberculosis
RERRTWLPRVWLALPLGLLALGSSMFF

SEQ ID NO: 1395360 - protein, 20 aa, Mycobacterium tuberculosis
RERYRWLFGAAVSVGLVFAA

SEQ ID NO: 1395361 - protein, 23 aa, Mycobacterium tuberculosis
RGGRSRLVFGTLAILLCLVLGVA

SEQ ID NO: 1395362 - protein, 19 aa, Mycobacterium tuberculosis
RGRLIRRVLITVAASLRSE

SEQ ID NO: 1395363 - protein, 17 aa, Mycobacterium tuberculosis
RIPPRFWWPQRVRPRPA

SEQ ID NO: 1395364 - protein, 19 aa, Mycobacterium tuberculosis
RKRIAWLVLLANMVLAAVV

SEQ ID NO: 1395365 - protein, 18 aa, Mycobacterium tuberculosis
RLPAPWRIPLQAGLGSVL

SEQ ID NO: 1395366 - protein, 21 aa, Mycobacterium tuberculosis
RLRRGWLVGIAATLLALAGGL

SEQ ID NO: 1395367 - protein, 20 aa, Mycobacterium tuberculosis
RLTVLLALLANLFLPWGIAG

SEQ ID NO: 1395368 - protein, 19 aa, Mycobacterium tuberculosis
RLWFVHRGIEKLFHGRPAT

SEQ ID NO: 1395369 - protein, 31 aa, Mycobacterium tuberculosis
RMLAIAFFALLYLLPLILRLWRGDTTHDRHA

SEQ ID NO: 1395370 - protein, 23 aa, Mycobacterium tuberculosis
RMQRFWISLYFPLTMRSLCNAIV

SEQ ID NO: 1395371 - protein, 26 aa, Mycobacterium tuberculosis
RPWTQTRYWAFALLTPLVVAMVLTGC

SEQ ID NO: 1395372 - protein, 28 aa, Mycobacterium tuberculosis
RQFAVVIVLLWLGFTAFVNLAVPQLEVV

SEQ ID NO: 1395373 - protein, 18 aa, Mycobacterium tuberculosis
RQPWAWLALLVAGLTVGL

SEQ ID NO: 1395374 - protein, 33 aa, Mycobacterium tuberculosis
RRERRTWLPRVWLALPLGLLALGSSMFFGAYPW

SEQ ID NO: 1395375 - protein, 31 aa, Mycobacterium tuberculosis
RRGRRRCRWSWRTGWVCLYFSVVFDGWPRPG

SEQ ID NO: 1395376 - protein, 25 aa, Mycobacterium tuberculosis
RRILVGAVAVLLLAGLFAVGIVIGR

SEQ ID NO: 1395377 - protein, 21 aa, Mycobacterium tuberculosis
RRQRRYWRYWAPAVLTAVAVF

SEQ ID NO: 1395378 - protein, 17 aa, Mycobacterium tuberculosis
RSLWWPLAIGILGIAVL

SEQ ID NO: 1395379 - protein, 23 aa, Mycobacterium tuberculosis
RSRILIMIALGVIVLLLAGPRLI

SEQ ID NO: 1395380 - protein, 17 aa, Mycobacterium tuberculosis
RTAMLLVPPYLVYVRLA

SEQ ID NO: 1395381 - protein, 21 aa, Mycobacterium tuberculosis
RVIPPSLLRRALPYLIGILIV

SEQ ID NO: 1395382 - protein, 20 aa, Mycobacterium tuberculosis
RVSLPLWVLLLSVPLATVYI

SEQ ID NO: 1395383 - protein, 19 aa, Mycobacterium tuberculosis
RWLPLILAGFTSGFLLLRG

SEQ ID NO: 1395384 - protein, 23 aa, Mycobacterium tuberculosis
RWPLIVIGCWIAVAAALTLLLPT

SEQ ID NO: 1395385 - protein, 24 aa, Mycobacterium tuberculosis
RWPLIVIGCWIAVAAALTLLLPTL

SEQ ID NO: 1395386 - protein, 17 aa, Mycobacterium tuberculosis
SALVVFEVMVRPLIRLS

SEQ ID NO: 1395387 - protein, 18 aa, Mycobacterium tuberculosis
SASWRRRLRVRLPRLSTI

SEQ ID NO: 1395388 - protein, 22 aa, Mycobacterium tuberculosis
SFFYFFFFFLFKKKKKKKKKKK

SEQ ID NO: 1395389 - protein, 22 aa, Mycobacterium tuberculosis
SGGVGLLGWAWVVAGAVDLLTT

SEQ ID NO: 1395390 - protein, 19 aa, Mycobacterium tuberculosis
SGRLLFALLSFSVVGAVLA

SEQ ID NO: 1395391 - protein, 23 aa, Mycobacterium tuberculosis
SIFPLFMMVGIMMMMFRGMGGGQ

SEQ ID NO: 1395392 - protein, 19 aa, Mycobacterium tuberculosis
SIITVLMPLALFGILGLAA

SEQ ID NO: 1395393 - protein, 19 aa, Mycobacterium tuberculosis
SIYLLLIHDWDQASIGFVM

SEQ ID NO: 1395394 - protein, 24 aa, Mycobacterium tuberculosis
SLCLIFIIMLIITRAFIAAAVIVG

SEQ ID NO: 1395395 - protein, 18 aa, Mycobacterium tuberculosis
SLGCALFRLLTGEAPFAA

SEQ ID NO: 1395396 - protein, 19 aa, Mycobacterium tuberculosis
SLHWYTWLAFSGWVAVAVI

SEQ ID NO: 1395397 - protein, 25 aa, Mycobacterium tuberculosis
SLLRLSVLALIMLPILAAVTLCARV

SEQ ID NO: 1395398 - protein, 26 aa, Mycobacterium tuberculosis
SLLRLSVLALIMLPILAAVTLCARVP

SEQ ID NO: 1395399 - protein, 25 aa, Mycobacterium tuberculosis
SMGTALVLLFLLALAAIPGALLPQR

SEQ ID NO: 1395400 - protein, 42 aa, Mycobacterium tuberculosis
SNDQFMITVLILWAPLLIFGFILMWILAWLTATPVRVVREAL

SEQ ID NO: 1395401 - protein, 23 aa, Mycobacterium tuberculosis
SNKPRVFIFYLGAAIFIISSSAA

SEQ ID NO: 1395402 - protein, 30 aa, Mycobacterium tuberculosis
SPRNWPVRWKVFTIALLPLVVAMVLAGLRV

SEQ ID NO: 1395403 - protein, 21 aa, Mycobacterium tuberculosis
SRPRWSGRRLAFVVALVTVLM

SEQ ID NO: 1395404 - protein, 28 aa, Mycobacterium tuberculosis
SRPWTQTRYWAFALLTPLVVAMVLTGCS

SEQ ID NO: 1395405 - protein, 24 aa, Mycobacterium tuberculosis
SRRLWTMLIFMLWHAIFVEHSVVP

SEQ ID NO: 1395406 - protein, 27 aa, Mycobacterium tuberculosis
SRRRRRDRWFGGWDRRQPGCGLGTAAT

SEQ ID NO: 1395407 - protein, 19 aa, Mycobacterium tuberculosis
STLWIWVALTGAAATVLIL

SEQ ID NO: 1395408 - protein, 25 aa, Mycobacterium tuberculosis
SVHSLLWIGVFLFLGGMAAGGCNSA

SEQ ID NO: 1395409 - protein, 22 aa, Mycobacterium tuberculosis
SVLIILILVYRNLVTMLVPLAT

SEQ ID NO: 1395410 - protein, 17 aa, Mycobacterium tuberculosis
SVLWLVPLAGAVLIILL

SEQ ID NO: 1395411 - protein, 25 aa, Mycobacterium tuberculosis
SVRSAAALWWIPAWLAMIVEVAVLG

SEQ ID NO: 1395412 - protein, 22 aa, Mycobacterium tuberculosis
SWRRGLIFAMFVFAAIFTPGSD

SEQ ID NO: 1395413 - protein, 22 aa, Mycobacterium tuberculosis
TAFGFLVLLLSLLNATLFQGAP

SEQ ID NO: 1395414 - protein, 25 aa, Mycobacterium tuberculosis
TALRLYTRWLGHVVLLVPTVLAVVA

SEQ ID NO: 1395415 - protein, 23 aa, Mycobacterium tuberculosis
TAQWVILALLAVALPLASLVGWL

SEQ ID NO: 1395416 - protein, 17 aa, Mycobacterium tuberculosis
TDRLPMVLGLIAAITYV

SEQ ID NO: 1395417 - protein, 26 aa, Mycobacterium tuberculosis
TENVLLQVVPWRGALGSVISVGAQQQ

SEQ ID NO: 1395418 - protein, 22 aa, Mycobacterium tuberculosis
TGARWLCETFPTCLERGAGIPA

SEQ ID NO: 1395419 - protein, 23 aa, Mycobacterium tuberculosis
TGWWIGVLAYFLPRRSWLRAAAE

SEQ ID NO: 1395420 - protein, 24 aa, Mycobacterium tuberculosis
TGYARFWWPGLPIWVPALVTVALI

SEQ ID NO: 1395421 - protein, 21 aa, Mycobacterium tuberculosis
THVLYLNYVWHYSLLKAGFAI

SEQ ID NO: 1395422 - protein, 17 aa, Mycobacterium tuberculosis
TLALIVIPLMFGADLRP

SEQ ID NO: 1395423 - protein, 20 aa, Mycobacterium tuberculosis
TLCWLLISYGFAASVLPVWL

SEQ ID NO: 1395424 - protein, 19 aa, Mycobacterium tuberculosis
TLTLIYPTLTLPSWSAGSR

SEQ ID NO: 1395425 - protein, 22 aa, Mycobacterium tuberculosis
TMLQMLIIFGIVTVIALVAATT

SEQ ID NO: 1395426 - protein, 20 aa, Mycobacterium tuberculosis
TPALAAPAPHGALAGSGKLG

SEQ ID NO: 1395427 - protein, 26 aa, Mycobacterium tuberculosis
TPATRWGPILQWILVGAAAAVVLVAM

SEQ ID NO: 1395428 - protein, 25 aa, Mycobacterium tuberculosis
TPGWLEWFINWYLPISQLFYNTVGL

SEQ ID NO: 1395429 - protein, 23 aa, Mycobacterium tuberculosis
TRPATFLWLIAATGTLLVATHRM

SEQ ID NO: 1395430 - protein, 25 aa, Mycobacterium tuberculosis
TSAILLPAVIALALLPISWQLGVAA

SEQ ID NO: 1395431 - protein, 21 aa, Mycobacterium tuberculosis
TVLLLLVYRSIATTLLILPMV

SEQ ID NO: 1395432 - protein, 24 aa, Mycobacterium tuberculosis
TWQVSGRLLFALLSFSVVGAVLAL

SEQ ID NO: 1395433 - protein, 25 aa, Mycobacterium tuberculosis
VAAWAYPLWPVVLGLKALALAVGAS

SEQ ID NO: 1395434 - protein, 23 aa, Mycobacterium tuberculosis
VAGQVLFSLLLTPAIRLTNGAAN

SEQ ID NO: 1395435 - protein, 22 aa, Mycobacterium tuberculosis
VAIVVLGWYYLRIPSLVGIGQY

SEQ ID NO: 1395436 - protein, 26 aa, Mycobacterium tuberculosis
VALIPLVWLLWVVIARGWFAVTRSGW

SEQ ID NO: 1395437 - protein, 21 aa, Mycobacterium tuberculosis
VAMPWLFLRLRFCRRKWTVPT

SEQ ID NO: 1395438 - protein, 19 aa, Mycobacterium tuberculosis
VAVLLWIVAVLIVGSVVYL

SEQ ID NO: 1395439 - protein, 19 aa, Mycobacterium tuberculosis
VAWVWFQLFVDILGFNIIG

SEQ ID NO: 1395440 - protein, 24 aa, Mycobacterium tuberculosis
VDNLPQLPWWLRPFARFHADDHFA

SEQ ID NO: 1395441 - protein, 20 aa, Mycobacterium tuberculosis
VEYFYIKYYLPRGRSRPVIE

SEQ ID NO: 1395442 - protein, 19 aa, Mycobacterium tuberculosis
VFGMRLVFPLAIIWTTAGL

SEQ ID NO: 1395443 - protein, 17 aa, Mycobacterium tuberculosis
VFVAVIAFLMLLISIRS

SEQ ID NO: 1395444 - protein, 25 aa, Mycobacterium tuberculosis
VGGLAWPFLLLPQLGMIRGAAVTGI

SEQ ID NO: 1395445 - protein, 18 aa, Mycobacterium tuberculosis
VGITFLGMRFAKLGVFST

SEQ ID NO: 1395446 - protein, 17 aa, Mycobacterium tuberculosis
VGTHAYWLGAQWWHPLV

SEQ ID NO: 1395447 - protein, 22 aa, Mycobacterium tuberculosis
VGVFALRRVWWLYKLVMSGQPA

SEQ ID NO: 1395448 - protein, 18 aa, Mycobacterium tuberculosis
VGVPLYLLLGWVAVWYTA

SEQ ID NO: 1395449 - protein, 17 aa, Mycobacterium tuberculosis
VGWLSLAAGLLAIAALA

SEQ ID NO: 1395450 - protein, 17 aa, Mycobacterium tuberculosis
VIAIMLFIAYRSLSAAL

SEQ ID NO: 1395451 - protein, 17 aa, Mycobacterium tuberculosis
VIATIVIVFLILVILLR

SEQ ID NO: 1395452 - protein, 20 aa, Mycobacterium tuberculosis
VILRLMLAWIPSTGVPLLAI

SEQ ID NO: 1395453 - protein, 19 aa, Mycobacterium tuberculosis
VIRLPLVLGLAQLLSRVPL

SEQ ID NO: 1395454 - protein, 18 aa, Mycobacterium tuberculosis
VISSWRPVLLIPLTFALF

SEQ ID NO: 1395455 - protein, 17 aa, Mycobacterium tuberculosis
VLARWRFRRRPAPARLP

SEQ ID NO: 1395456 - protein, 17 aa, Mycobacterium tuberculosis
VLGLFTPLAAAGALAFL

SEQ ID NO: 1395457 - protein, 17 aa, Mycobacterium tuberculosis
VLHVIWRQGYYPGIGAP

SEQ ID NO: 1395458 - protein, 19 aa, Mycobacterium tuberculosis
VLIAAFLAVWWIYETYRPQ

SEQ ID NO: 1395459 - protein, 17 aa, Mycobacterium tuberculosis
VLIPDRPTWEAVAPAPA

SEQ ID NO: 1395460 - protein, 25 aa, Mycobacterium tuberculosis
VLTGLLFLLFGLWLLFDDALGFRSV

SEQ ID NO: 1395461 - protein, 17 aa, Mycobacterium tuberculosis
VNLLPFMFLGTTFGARL

SEQ ID NO: 1395462 - protein, 17 aa, Mycobacterium tuberculosis
VPAFFRWLAQFEPMHQV

SEQ ID NO: 1395463 - protein, 18 aa, Mycobacterium tuberculosis
VPAFFRWLAQFEPMHQVF

SEQ ID NO: 1395464 - protein, 26 aa, Mycobacterium tuberculosis
VRFCFPNFLRWLGFGFLFVDILGFNI

SEQ ID NO: 1395465 - protein, 20 aa, Mycobacterium tuberculosis
VRNWPWRRLVLSKTANTYSR

SEQ ID NO: 1395466 - protein, 18 aa, Mycobacterium tuberculosis
VRRTLLVSTLLVASAWWL

SEQ ID NO: 1395467 - protein, 22 aa, Mycobacterium tuberculosis
VRSAAALWWIPAWLAMIVEVAV

SEQ ID NO: 1395468 - protein, 20 aa, Mycobacterium tuberculosis
VSILYRLYRPLIFALYCLPL

SEQ ID NO: 1395469 - protein, 23 aa, Mycobacterium tuberculosis
VSIPLTVLIIFTLNILLAEFGAA

SEQ ID NO: 1395470 - protein, 18 aa, Mycobacterium tuberculosis
VSVVAIVVLGWYYLRIPS

SEQ ID NO: 1395471 - protein, 22 aa, Mycobacterium tuberculosis
VTWAPFLWLVTCVVIIVSYAPQ

SEQ ID NO: 1395472 - protein, 22 aa, Mycobacterium tuberculosis
VVFEVMVRPLIRLSLGKRHPMR

SEQ ID NO: 1395473 - protein, 22 aa, Mycobacterium tuberculosis
VVFLVTWPLVYLASKSSLLPSR

SEQ ID NO: 1395474 - protein, 28 aa, Mycobacterium tuberculosis
VVGCSMRLPFLYAPLPYGGTLHVDGGVL

SEQ ID NO: 1395475 - protein, 24 aa, Mycobacterium tuberculosis
VVMVAGVILWRFFGDALSNRSHTA

SEQ ID NO: 1395476 - protein, 23 aa, Mycobacterium tuberculosis
VVVKALLLLGLWLAGWGAARLVA

SEQ ID NO: 1395477 - protein, 21 aa, Mycobacterium tuberculosis
VWGFLFIYFWLRATLPRLRYD

SEQ ID NO: 1395478 - protein, 35 aa, Mycobacterium tuberculosis
WACHRPNRLWWRYTAWWLLAMALATLWWVMALTQL

SEQ ID NO: 1395479 - protein, 17 aa, Mycobacterium tuberculosis
WAWWPRLWRCALPDRCD

SEQ ID NO: 1395480 - protein, 21 aa, Mycobacterium tuberculosis
WGTPALAAPAPHGALAGSGKL

SEQ ID NO: 1395481 - protein, 17 aa, Mycobacterium tuberculosis
WLFGAAVSVGLVFAAEL

SEQ ID NO: 1395482 - protein, 17 aa, Mycobacterium tuberculosis
WLILFLRILFTAITFGA

SEQ ID NO: 1395483 - protein, 17 aa, Mycobacterium tuberculosis
WLTLALAAVWIAGALMS

SEQ ID NO: 1395484 - protein, 18 aa, Mycobacterium tuberculosis
WMAVMFFAGFLILYGLGV

SEQ ID NO: 1395485 - protein, 17 aa, Mycobacterium tuberculosis
WQVAKLRRAAFSGVLLT

SEQ ID NO: 1395486 - protein, 26 aa, Mycobacterium tuberculosis
WSIPGLAHFFTMWGFFILLTVYIEDY

SEQ ID NO: 1395487 - protein, 17 aa, Mycobacterium tuberculosis
WSYGLFIWHLAALAMVF

SEQ ID NO: 1395488 - protein, 21 aa, Mycobacterium tuberculosis
WTVPKFYWTVLGLSALISGAR

SEQ ID NO: 1395489 - protein, 19 aa, Mycobacterium tuberculosis
WWHPLVVVGLIALVAIMIA

SEQ ID NO: 1395490 - protein, 18 aa, Mycobacterium tuberculosis
YALVLLQLRVFYAREQPW

SEQ ID NO: 1395491 - protein, 23 aa, Mycobacterium tuberculosis
YDIGLFYRYAWQNPVFADIVATR

SEQ ID NO: 1395492 - protein, 17 aa, Mycobacterium tuberculosis
YFGFLLNLLVVFGVSFE

SEQ ID NO: 1395493 - protein, 17 aa, Mycobacterium tuberculosis
YGLFIWHLAALAMVFPV

SEQ ID NO: 1395494 - protein, 17 aa, Mycobacterium tuberculosis
YLLVFFTGDKHTAPKLG

SEQ ID NO: 1395495 - protein, 17 aa, Mycobacterium tuberculosis
YLVLDPLIYFGPFAPLT

SEQ ID NO: 1395496 - protein, 18 aa, Mycobacterium tuberculosis
YQWWRLALVLASGLAYVV

SEQ ID NO: 1395497 - protein, 18 aa, Mycobacterium tuberculosis
YVDWLWFGEVGFRSVWIT

SEQ ID NO: 1395498 - protein, 18 aa, Mycobacterium tuberculosis
YVLLPGRRMPIPQLPGAT

SEQ ID NO: 1395499 - protein, 5 aa, Mycobacterium tuberculosis
SGTGN

SEQ ID NO: 1395500 - protein, 16 aa, Mycobacterium tuberculosis
VDAGARPGTTTEESAE

SEQ ID NO: 1395501 - protein, 8 aa, Mycobacterium tuberculosis
KPGKPWRS

SEQ ID NO: 1395502 - protein, 8 aa, Mycobacterium tuberculosis
TDRGSQYT

SEQ ID NO: 1395503 - protein, 17 aa, Mycobacterium tuberculosis
AGIQPSVGAVGSSYDNA

SEQ ID NO: 1395504 - protein, 7 aa, Mycobacterium tuberculosis
FGPPAPN

SEQ ID NO: 1395505 - protein, 24 aa, Mycobacterium tuberculosis
LSGTTRGKARRTTIADPATARPAD

SEQ ID NO: 1395506 - protein, 7 aa, Mycobacterium tuberculosis
RDNAELR

SEQ ID NO: 1395507 - protein, 13 aa, Mycobacterium tuberculosis
NREPSRRELRDGE

SEQ ID NO: 1395508 - protein, 6 aa, Mycobacterium tuberculosis
GQHDSE

SEQ ID NO: 1395509 - protein, 6 aa, Mycobacterium tuberculosis
AQASPD

SEQ ID NO: 1395510 - protein, 7 aa, Mycobacterium tuberculosis
KRAERAL

SEQ ID NO: 1395511 - protein, 5 aa, Mycobacterium tuberculosis
NAEGY

SEQ ID NO: 1395512 - protein, 5 aa, Mycobacterium tuberculosis
LASPA

SEQ ID NO: 1395513 - protein, 7 aa, Mycobacterium tuberculosis
TSAEDGA

SEQ ID NO: 1395514 - protein, 16 aa, Mycobacterium tuberculosis
ANNYEQQEQASQQILS

SEQ ID NO: 1395515 - protein, 6 aa, Mycobacterium tuberculosis
TVEDEA

SEQ ID NO: 1395516 - protein, 25 aa, Mycobacterium tuberculosis
NAHGQKVQAAGNNMAQTDSAVGSSW

SEQ ID NO: 1395517 - protein, 7 aa, Mycobacterium tuberculosis
RPLDAGP

SEQ ID NO: 1395518 - protein, 4 aa, Mycobacterium tuberculosis
AAAA

SEQ ID NO: 1395519 - protein, 20 aa, Mycobacterium tuberculosis
ALTSTEEPAKQQTTNTPALT

SEQ ID NO: 1395520 - protein, 4 aa, Mycobacterium tuberculosis
DTAR

SEQ ID NO: 1395521 - protein, 4 aa, Mycobacterium tuberculosis
VRRR

SEQ ID NO: 1395522 - protein, 7 aa, Mycobacterium tuberculosis
ATPKPSW

SEQ ID NO: 1395523 - protein, 7 aa, Mycobacterium tuberculosis
DQPDAES

SEQ ID NO: 1395524 - protein, 8 aa, Mycobacterium tuberculosis
NNPQERLN

SEQ ID NO: 1395525 - protein, 17 aa, Mycobacterium tuberculosis
GYRERSDERSNQRNGYR

SEQ ID NO: 1395526 - protein, 5 aa, Mycobacterium tuberculosis
LSKSQ

SEQ ID NO: 1395527 - protein, 9 aa, Mycobacterium tuberculosis
PAATTPANI

SEQ ID NO: 1395528 - protein, 4 aa, Mycobacterium tuberculosis
EGRG

SEQ ID NO: 1395529 - protein, 6 aa, Mycobacterium tuberculosis
GADEVS

SEQ ID NO: 1395530 - protein, 4 aa, Mycobacterium tuberculosis
GGAG

SEQ ID NO: 1395531 - protein, 4 aa, Mycobacterium tuberculosis
RSGE

SEQ ID NO: 1395532 - protein, 4 aa, Mycobacterium tuberculosis
VEPD

SEQ ID NO: 1395533 - protein, 8 aa, Mycobacterium tuberculosis
ANTGTGNI

SEQ ID NO: 1395534 - protein, 5 aa, Mycobacterium tuberculosis
AAPYA

SEQ ID NO: 1395535 - protein, 4 aa, Mycobacterium tuberculosis
AAEP

SEQ ID NO: 1395536 - protein, 12 aa, Mycobacterium tuberculosis
REPSRRELRDGE

SEQ ID NO: 1395537 - protein, 4 aa, Mycobacterium tuberculosis
TGGV

SEQ ID NO: 1395538 - protein, 7 aa, Mycobacterium tuberculosis
RNGTRLD

SEQ ID NO: 1395539 - protein, 4 aa, Mycobacterium tuberculosis
AARG

SEQ ID NO: 1395540 - protein, 4 aa, Mycobacterium tuberculosis
LPPE

SEQ ID NO: 1395541 - protein, 7 aa, Mycobacterium tuberculosis
GADEVSA

SEQ ID NO: 1395542 - protein, 5 aa, Mycobacterium tuberculosis
GISGT

SEQ ID NO: 1395543 - protein, 5 aa, Mycobacterium tuberculosis
QLPDG

SEQ ID NO: 1395544 - protein, 7 aa, Mycobacterium tuberculosis
NISGAGW

SEQ ID NO: 1395545 - protein, 9 aa, Mycobacterium tuberculosis
LSGGTSPVT

SEQ ID NO: 1395546 - protein, 7 aa, Mycobacterium tuberculosis
GGAGSAA

SEQ ID NO: 1395547 - protein, 7 aa, Mycobacterium tuberculosis
EGNDAMT

SEQ ID NO: 1395548 - protein, 5 aa, Mycobacterium tuberculosis
HGQPR

SEQ ID NO: 1395549 - protein, 4 aa, Mycobacterium tuberculosis
AAGA

SEQ ID NO: 1395550 - protein, 7 aa, Mycobacterium tuberculosis
SHSPQVD

SEQ ID NO: 1395551 - protein, 8 aa, Mycobacterium tuberculosis
TSTGRTDI

SEQ ID NO: 1395552 - protein, 8 aa, Mycobacterium tuberculosis
RRDNAELR

SEQ ID NO: 1395553 - protein, 4 aa, Mycobacterium tuberculosis
AGVS

SEQ ID NO: 1395554 - protein, 10 aa, Mycobacterium tuberculosis
FEGSRDDRPL

SEQ ID NO: 1395555 - protein, 5 aa, Mycobacterium tuberculosis
GQHDS

SEQ ID NO: 1395556 - protein, 4 aa, Mycobacterium tuberculosis
PARA

SEQ ID NO: 1395557 - protein, 4 aa, Mycobacterium tuberculosis
PARK

SEQ ID NO: 1395558 - protein, 22 aa, Mycobacterium tuberculosis
DTTPDAAAIDRDTRSQAQRNHD

SEQ ID NO: 1395559 - protein, 4 aa, Mycobacterium tuberculosis
ERSS

SEQ ID NO: 1395560 - protein, 14 aa, Mycobacterium tuberculosis
GDLTDTERARKRGI

SEQ ID NO: 1395561 - protein, 7 aa, Mycobacterium tuberculosis
GTGMAGS

SEQ ID NO: 1395562 - protein, 7 aa, Mycobacterium tuberculosis
NQQYDGM

SEQ ID NO: 1395563 - protein, 4 aa, Mycobacterium tuberculosis
RPSG

SEQ ID NO: 1395564 - protein, 4 aa, Mycobacterium tuberculosis
RTPT

SEQ ID NO: 1395565 - protein, 4 aa, Mycobacterium tuberculosis
AGAQ

SEQ ID NO: 1395566 - protein, 4 aa, Mycobacterium tuberculosis
DAAR

SEQ ID NO: 1395567 - protein, 13 aa, Mycobacterium tuberculosis
LQTGAGKGFTGGG

SEQ ID NO: 1395568 - protein, 4 aa, Mycobacterium tuberculosis
TACS

SEQ ID NO: 1395569 - protein, 9 aa, Mycobacterium tuberculosis
YSPASGRYP

SEQ ID NO: 1395570 - protein, 4 aa, Mycobacterium tuberculosis
AGDG

SEQ ID NO: 1395571 - protein, 6 aa, Mycobacterium tuberculosis
NAPTQT

SEQ ID NO: 1395572 - protein, 9 aa, Mycobacterium tuberculosis
YAGPGSASL

SEQ ID NO: 1395573 - protein, 4 aa, Mycobacterium tuberculosis
AGAR

SEQ ID NO: 1395574 - protein, 14 aa, Mycobacterium tuberculosis
RGCTKPGCDAPAYH

SEQ ID NO: 1395575 - protein, 5 aa, Mycobacterium tuberculosis
SGDGN

SEQ ID NO: 1395576 - protein, 8 aa, Mycobacterium tuberculosis
GNTGNNNI

SEQ ID NO: 1395577 - protein, 6 aa, Mycobacterium tuberculosis
NAGLSA

SEQ ID NO: 1395578 - protein, 5 aa, Mycobacterium tuberculosis
NSGSH

SEQ ID NO: 1395579 - protein, 7 aa, Mycobacterium tuberculosis
THENTRR

SEQ ID NO: 1395580 - protein, 4 aa, Mycobacterium tuberculosis
ADAE

SEQ ID NO: 1395581 - protein, 4 aa, Mycobacterium tuberculosis
AGEA

SEQ ID NO: 1395582 - protein, 8 aa, Mycobacterium tuberculosis
ANTGNNNI

SEQ ID NO: 1395583 - protein, 8 aa, Mycobacterium tuberculosis
ANTGSGNF

SEQ ID NO: 1395584 - protein, 7 aa, Mycobacterium tuberculosis
KLGQHNG

SEQ ID NO: 1395585 - protein, 7 aa, Mycobacterium tuberculosis
LSGGTNA

SEQ ID NO: 1395586 - protein, 4 aa, Mycobacterium tuberculosis
SAAR

SEQ ID NO: 1395587 - protein, 4 aa, Mycobacterium tuberculosis
AGSP

SEQ ID NO: 1395588 - protein, 4 aa, Mycobacterium tuberculosis
VTTG

SEQ ID NO: 1395589 - protein, 4 aa, Mycobacterium tuberculosis
AAVG

SEQ ID NO: 1395590 - protein, 7 aa, Mycobacterium tuberculosis
EAYADGI

SEQ ID NO: 1395591 - protein, 9 aa, Mycobacterium tuberculosis
FANTGSNNI

SEQ ID NO: 1395592 - protein, 8 aa, Mycobacterium tuberculosis
HGQPRTNT

SEQ ID NO: 1395593 - protein, 4 aa, Mycobacterium tuberculosis
PPTV

SEQ ID NO: 1395594 - protein, 12 aa, Mycobacterium tuberculosis
TAAADAARIGSA

SEQ ID NO: 1395595 - protein, 4 aa, Mycobacterium tuberculosis
ARAR

SEQ ID NO: 1395596 - protein, 4 aa, Mycobacterium tuberculosis
SPRA

SEQ ID NO: 1395597 - protein, 6 aa, Mycobacterium tuberculosis
TVPPPV

SEQ ID NO: 1395598 - protein, 4 aa, Mycobacterium tuberculosis
ARQR

SEQ ID NO: 1395599 - protein, 6 aa, Mycobacterium tuberculosis
NAPTQA

SEQ ID NO: 1395600 - protein, 5 aa, Mycobacterium tuberculosis
SGSGN

SEQ ID NO: 1395601 - protein, 5 aa, Mycobacterium tuberculosis
ADEVS

SEQ ID NO: 1395602 - protein, 9 aa, Mycobacterium tuberculosis
SAAEPGAAG

SEQ ID NO: 1395603 - protein, 11 aa, Mycobacterium tuberculosis
SNMGHTQAAAG

SEQ ID NO: 1395604 - protein, 7 aa, Mycobacterium tuberculosis
NSGLTPG

SEQ ID NO: 1395605 - protein, 8 aa, Mycobacterium tuberculosis
QNISGAGW

SEQ ID NO: 1395606 - protein, 4 aa, Mycobacterium tuberculosis
RPGG

SEQ ID NO: 1395607 - protein, 9 aa, Mycobacterium tuberculosis
SGAGGVSGF

SEQ ID NO: 1395608 - protein, 4 aa, Mycobacterium tuberculosis
SPES

SEQ ID NO: 1395609 - protein, 5 aa, Mycobacterium tuberculosis
TPQAR

SEQ ID NO: 1395610 - protein, 4 aa, Mycobacterium tuberculosis
GPAV

SEQ ID NO: 1395611 - protein, 4 aa, Mycobacterium tuberculosis
HNPA

SEQ ID NO: 1395612 - protein, 4 aa, Mycobacterium tuberculosis
VGAT

SEQ ID NO: 1395613 - protein, 4 aa, Mycobacterium tuberculosis
AADL

SEQ ID NO: 1395614 - protein, 4 aa, Mycobacterium tuberculosis
GRPP

SEQ ID NO: 1395615 - protein, 4 aa, Mycobacterium tuberculosis
RAEA

SEQ ID NO: 1395616 - protein, 4 aa, Mycobacterium tuberculosis
AGSL

SEQ ID NO: 1395617 - protein, 4 aa, Mycobacterium tuberculosis
ARGP

SEQ ID NO: 1395618 - protein, 8 aa, Mycobacterium tuberculosis
DGDGQAVG

SEQ ID NO: 1395619 - protein, 5 aa, Mycobacterium tuberculosis
DKEGT

SEQ ID NO: 1395620 - protein, 4 aa, Mycobacterium tuberculosis
DRPR

SEQ ID NO: 1395621 - protein, 8 aa, Mycobacterium tuberculosis
EDTSAYDR

SEQ ID NO: 1395622 - protein, 17 aa, Mycobacterium tuberculosis
FGPGGTTAGSGGAWYPT

SEQ ID NO: 1395623 - protein, 4 aa, Mycobacterium tuberculosis
GLGA

SEQ ID NO: 1395624 - protein, 15 aa, Mycobacterium tuberculosis
GNFSDQERARKRGIT

SEQ ID NO: 1395625 - protein, 5 aa, Mycobacterium tuberculosis
GSPWR

SEQ ID NO: 1395626 - protein, 6 aa, Mycobacterium tuberculosis
GSTEVG

SEQ ID NO: 1395627 - protein, 4 aa, Mycobacterium tuberculosis
IRPG

SEQ ID NO: 1395628 - protein, 8 aa, Mycobacterium tuberculosis
LDTPAGAR

SEQ ID NO: 1395629 - protein, 5 aa, Mycobacterium tuberculosis
LGPDA

SEQ ID NO: 1395630 - protein, 5 aa, Mycobacterium tuberculosis
MGESA

SEQ ID NO: 1395631 - protein, 4 aa, Mycobacterium tuberculosis
PTRT

SEQ ID NO: 1395632 - protein, 5 aa, Mycobacterium tuberculosis
QGTGG

SEQ ID NO: 1395633 - protein, 5 aa, Mycobacterium tuberculosis
RAEES

SEQ ID NO: 1395634 - protein, 12 aa, Mycobacterium tuberculosis
RGCSRPGCDAPA

SEQ ID NO: 1395635 - protein, 6 aa, Mycobacterium tuberculosis
RGIANE

SEQ ID NO: 1395636 - protein, 8 aa, Mycobacterium tuberculosis
RRRQGAAE

SEQ ID NO: 1395637 - protein, 4 aa, Mycobacterium tuberculosis
RSGG

SEQ ID NO: 1395638 - protein, 6 aa, Mycobacterium tuberculosis
SARRAE

SEQ ID NO: 1395639 - protein, 4 aa, Mycobacterium tuberculosis
SATG

SEQ ID NO: 1395640 - protein, 5 aa, Mycobacterium tuberculosis
SDEFT

SEQ ID NO: 1395641 - protein, 4 aa, Mycobacterium tuberculosis
SGAS

SEQ ID NO: 1395642 - protein, 7 aa, Mycobacterium tuberculosis
SGCGKTT

SEQ ID NO: 1395643 - protein, 10 aa, Mycobacterium tuberculosis
SHEGKPGRRF

SEQ ID NO: 1395644 - protein, 4 aa, Mycobacterium tuberculosis
SREG

SEQ ID NO: 1395645 - protein, 6 aa, Mycobacterium tuberculosis
SVGATA

SEQ ID NO: 1395646 - protein, 6 aa, Mycobacterium tuberculosis
TGGVGQ

SEQ ID NO: 1395647 - protein, 4 aa, Mycobacterium tuberculosis
TPAQ

SEQ ID NO: 1395648 - protein, 4 aa, Mycobacterium tuberculosis
TSPL

SEQ ID NO: 1395649 - protein, 4 aa, Mycobacterium tuberculosis
AAAG

SEQ ID NO: 1395650 - protein, 13 aa, Mycobacterium tuberculosis
AANEDGTFKSDEE

SEQ ID NO: 1395651 - protein, 5 aa, Mycobacterium tuberculosis
AASAA

SEQ ID NO: 1395652 - protein, 7 aa, Mycobacterium tuberculosis
AASASAS

SEQ ID NO: 1395653 - protein, 5 aa, Mycobacterium tuberculosis
AASRD

SEQ ID NO: 1395654 - protein, 4 aa, Mycobacterium tuberculosis
ADGL

SEQ ID NO: 1395655 - protein, 9 aa, Mycobacterium tuberculosis
AGLDNSKET

SEQ ID NO: 1395656 - protein, 25 aa, Mycobacterium tuberculosis
AGSYNTGSFNAGQANTGGFNPGSVN

SEQ ID NO: 1395657 - protein, 10 aa, Mycobacterium tuberculosis
APPKTTNSAG

SEQ ID NO: 1395658 - protein, 13 aa, Mycobacterium tuberculosis
ATAAAQREGKIGR

SEQ ID NO: 1395659 - protein, 4 aa, Mycobacterium tuberculosis
CSSG

SEQ ID NO: 1395660 - protein, 6 aa, Mycobacterium tuberculosis
DSAGGY

SEQ ID NO: 1395661 - protein, 4 aa, Mycobacterium tuberculosis
DSEH

SEQ ID NO: 1395662 - protein, 4 aa, Mycobacterium tuberculosis
ELTP

SEQ ID NO: 1395663 - protein, 4 aa, Mycobacterium tuberculosis
EQLS

SEQ ID NO: 1395664 - protein, 5 aa, Mycobacterium tuberculosis
ESTNT

SEQ ID NO: 1395665 - protein, 5 aa, Mycobacterium tuberculosis
GDEPA

SEQ ID NO: 1395666 - protein, 4 aa, Mycobacterium tuberculosis
GEEH

SEQ ID NO: 1395667 - protein, 6 aa, Mycobacterium tuberculosis
GNAGSY

SEQ ID NO: 1395668 - protein, 4 aa, Mycobacterium tuberculosis
GSQW

SEQ ID NO: 1395669 - protein, 4 aa, Mycobacterium tuberculosis
GTGN

SEQ ID NO: 1395670 - protein, 7 aa, Mycobacterium tuberculosis
ITPTERT

SEQ ID NO: 1395671 - protein, 4 aa, Mycobacterium tuberculosis
LPAG

SEQ ID NO: 1395672 - protein, 8 aa, Mycobacterium tuberculosis
MDPDKERR

SEQ ID NO: 1395673 - protein, 6 aa, Mycobacterium tuberculosis
NGPAIG

SEQ ID NO: 1395674 - protein, 9 aa, Mycobacterium tuberculosis
NRTPPKTQA

SEQ ID NO: 1395675 - protein, 4 aa, Mycobacterium tuberculosis
PDDL

SEQ ID NO: 1395676 - protein, 5 aa, Mycobacterium tuberculosis
PDGTR

SEQ ID NO: 1395677 - protein, 10 aa, Mycobacterium tuberculosis
PEGAGPGTKG

SEQ ID NO: 1395678 - protein, 4 aa, Mycobacterium tuberculosis
PETL

SEQ ID NO: 1395679 - protein, 4 aa, Mycobacterium tuberculosis
PGGC

SEQ ID NO: 1395680 - protein, 7 aa, Mycobacterium tuberculosis
PNPRPLD

SEQ ID NO: 1395681 - protein, 5 aa, Mycobacterium tuberculosis
PPGCG

SEQ ID NO: 1395682 - protein, 6 aa, Mycobacterium tuberculosis
QAPGNA

SEQ ID NO: 1395683 - protein, 6 aa, Mycobacterium tuberculosis
QDEVST

SEQ ID NO: 1395684 - protein, 8 aa, Mycobacterium tuberculosis
RGDHPNHR

SEQ ID NO: 1395685 - protein, 4 aa, Mycobacterium tuberculosis
RGRA

SEQ ID NO: 1395686 - protein, 4 aa, Mycobacterium tuberculosis
RGTD

SEQ ID NO: 1395687 - protein, 4 aa, Mycobacterium tuberculosis
RNGV

SEQ ID NO: 1395688 - protein, 4 aa, Mycobacterium tuberculosis
RPEQ

SEQ ID NO: 1395689 - protein, 6 aa, Mycobacterium tuberculosis
SPDEFS

SEQ ID NO: 1395690 - protein, 4 aa, Mycobacterium tuberculosis
SPVG

SEQ ID NO: 1395691 - protein, 16 aa, Mycobacterium tuberculosis
SSGSYAATEAANAAAA

SEQ ID NO: 1395692 - protein, 6 aa, Mycobacterium tuberculosis
TAATAT

SEQ ID NO: 1395693 - protein, 4 aa, Mycobacterium tuberculosis
TDER

SEQ ID NO: 1395694 - protein, 4 aa, Mycobacterium tuberculosis
TPRT

SEQ ID NO: 1395695 - protein, 5 aa, Mycobacterium tuberculosis
VDSPE

SEQ ID NO: 1395696 - protein, 7 aa, Mycobacterium tuberculosis
VSSSGAL

SEQ ID NO: 1395697 - protein, 4 aa, Mycobacterium tuberculosis
AGRA

SEQ ID NO: 1395698 - protein, 4 aa, Mycobacterium tuberculosis
AHGA

SEQ ID NO: 1395699 - protein, 6 aa, Mycobacterium tuberculosis
DALADG

SEQ ID NO: 1395700 - protein, 4 aa, Mycobacterium tuberculosis
DERS

SEQ ID NO: 1395701 - protein, 4 aa, Mycobacterium tuberculosis
DGRT

SEQ ID NO: 1395702 - protein, 5 aa, Mycobacterium tuberculosis
DPSGA

SEQ ID NO: 1395703 - protein, 5 aa, Mycobacterium tuberculosis
DTAAA

SEQ ID NO: 1395704 - protein, 5 aa, Mycobacterium tuberculosis
DTPTG

SEQ ID NO: 1395705 - protein, 6 aa, Mycobacterium tuberculosis
EASRRG

SEQ ID NO: 1395706 - protein, 5 aa, Mycobacterium tuberculosis
EATSL

SEQ ID NO: 1395707 - protein, 6 aa, Mycobacterium tuberculosis
ERVRPE

SEQ ID NO: 1395708 - protein, 8 aa, Mycobacterium tuberculosis
GKSKSDVI

SEQ ID NO: 1395709 - protein, 6 aa, Mycobacterium tuberculosis
GQAELT

SEQ ID NO: 1395710 - protein, 6 aa, Mycobacterium tuberculosis
HETTAA

SEQ ID NO: 1395711 - protein, 8 aa, Mycobacterium tuberculosis
KGEEGKQA

SEQ ID NO: 1395712 - protein, 4 aa, Mycobacterium tuberculosis
LGER

SEQ ID NO: 1395713 - protein, 7 aa, Mycobacterium tuberculosis
LNSGSGN

SEQ ID NO: 1395714 - protein, 5 aa, Mycobacterium tuberculosis
LPDGT

SEQ ID NO: 1395715 - protein, 5 aa, Mycobacterium tuberculosis
LPTPA

SEQ ID NO: 1395716 - protein, 6 aa, Mycobacterium tuberculosis
NRPEGL

SEQ ID NO: 1395717 - protein, 8 aa, Mycobacterium tuberculosis
PGEAAAAR

SEQ ID NO: 1395718 - protein, 4 aa, Mycobacterium tuberculosis
PGTA

SEQ ID NO: 1395719 - protein, 4 aa, Mycobacterium tuberculosis
PTTG

SEQ ID NO: 1395720 - protein, 4 aa, Mycobacterium tuberculosis
SGPR

SEQ ID NO: 1395721 - protein, 4 aa, Mycobacterium tuberculosis
STVS

SEQ ID NO: 1395722 - protein, 5 aa, Mycobacterium tuberculosis
VEGEA

SEQ ID NO: 1395723 - protein, 5 aa, Mycobacterium tuberculosis
VTDGD

SEQ ID NO: 1395724 - protein, 11 aa, Mycobacterium tuberculosis
AARAEQAGMQA

SEQ ID NO: 1395725 - protein, 8 aa, Mycobacterium tuberculosis
ANTGPGLT

SEQ ID NO: 1395726 - protein, 4 aa, Mycobacterium tuberculosis
ARDR

SEQ ID NO: 1395727 - protein, 4 aa, Mycobacterium tuberculosis
ASAA

SEQ ID NO: 1395728 - protein, 5 aa, Mycobacterium tuberculosis
GASAA

SEQ ID NO: 1395729 - protein, 6 aa, Mycobacterium tuberculosis
GGIGEK

SEQ ID NO: 1395730 - protein, 5 aa, Mycobacterium tuberculosis
GGTPF

SEQ ID NO: 1395731 - protein, 4 aa, Mycobacterium tuberculosis
GPAT

SEQ ID NO: 1395732 - protein, 4 aa, Mycobacterium tuberculosis
GTAV

SEQ ID NO: 1395733 - protein, 4 aa, Mycobacterium tuberculosis
IDTG

SEQ ID NO: 1395734 - protein, 7 aa, Mycobacterium tuberculosis
LNSGTGN

SEQ ID NO: 1395735 - protein, 5 aa, Mycobacterium tuberculosis
NAGDT

SEQ ID NO: 1395736 - protein, 8 aa, Mycobacterium tuberculosis
PAAADSTD

SEQ ID NO: 1395737 - protein, 5 aa, Mycobacterium tuberculosis
PTHGP

SEQ ID NO: 1395738 - protein, 6 aa, Mycobacterium tuberculosis
SGIADP

SEQ ID NO: 1395739 - protein, 5 aa, Mycobacterium tuberculosis
AAERA

SEQ ID NO: 1395740 - protein, 4 aa, Mycobacterium tuberculosis
AEGA

SEQ ID NO: 1395741 - protein, 18 aa, Mycobacterium tuberculosis
ANTGSNNVGFGNTGSNNV

SEQ ID NO: 1395742 - protein, 4 aa, Mycobacterium tuberculosis
ARHT

SEQ ID NO: 1395743 - protein, 21 aa, Mycobacterium tuberculosis
AVNQDGASNGLTAPNGPSQQR

SEQ ID NO: 1395744 - protein, 15 aa, Mycobacterium tuberculosis
DINTGVANSGDVNTG

SEQ ID NO: 1395745 - protein, 4 aa, Mycobacterium tuberculosis
DPAA

SEQ ID NO: 1395746 - protein, 9 aa, Mycobacterium tuberculosis
EADASGDLI

SEQ ID NO: 1395747 - protein, 5 aa, Mycobacterium tuberculosis
ETSPD

SEQ ID NO: 1395748 - protein, 4 aa, Mycobacterium tuberculosis
GEPV

SEQ ID NO: 1395749 - protein, 10 aa, Mycobacterium tuberculosis
GGGNIGGNNV

SEQ ID NO: 1395750 - protein, 7 aa, Mycobacterium tuberculosis
GPGSGPM

SEQ ID NO: 1395751 - protein, 5 aa, Mycobacterium tuberculosis
GRSAA

SEQ ID NO: 1395752 - protein, 10 aa, Mycobacterium tuberculosis
LGRAASVGSL

SEQ ID NO: 1395753 - protein, 19 aa, Mycobacterium tuberculosis
NHESAGKRHHGARRTGNQH

SEQ ID NO: 1395754 - protein, 8 aa, Mycobacterium tuberculosis
NHSPDDIE

SEQ ID NO: 1395755 - protein, 4 aa, Mycobacterium tuberculosis
PASG

SEQ ID NO: 1395756 - protein, 4 aa, Mycobacterium tuberculosis
PDPD

SEQ ID NO: 1395757 - protein, 4 aa, Mycobacterium tuberculosis
QPGQ

SEQ ID NO: 1395758 - protein, 5 aa, Mycobacterium tuberculosis
RARGG

SEQ ID NO: 1395759 - protein, 5 aa, Mycobacterium tuberculosis
SDGAA

SEQ ID NO: 1395760 - protein, 9 aa, Mycobacterium tuberculosis
TRAENRAAA

SEQ ID NO: 1395761 - protein, 4 aa, Mycobacterium tuberculosis
VADP

SEQ ID NO: 1395762 - protein, 11 aa, Mycobacterium tuberculosis
VGSSGQANYAA

SEQ ID NO: 1395763 - protein, 4 aa, Mycobacterium tuberculosis
VPPN

SEQ ID NO: 1395764 - protein, 4 aa, Mycobacterium tuberculosis
VSGT

SEQ ID NO: 1395765 - protein, 5 aa, Mycobacterium tuberculosis
AAAAY

SEQ ID NO: 1395766 - protein, 7 aa, Mycobacterium tuberculosis
AATGGRG

SEQ ID NO: 1395767 - protein, 4 aa, Mycobacterium tuberculosis
AERR

SEQ ID NO: 1395768 - protein, 8 aa, Mycobacterium tuberculosis
AGDQLGGS

SEQ ID NO: 1395769 - protein, 8 aa, Mycobacterium tuberculosis
ALAGGADR

SEQ ID NO: 1395770 - protein, 6 aa, Mycobacterium tuberculosis
ATVEPT

SEQ ID NO: 1395771 - protein, 11 aa, Mycobacterium tuberculosis
CAAGKRPAAPP

SEQ ID NO: 1395772 - protein, 8 aa, Mycobacterium tuberculosis
DGQPRTLD

SEQ ID NO: 1395773 - protein, 5 aa, Mycobacterium tuberculosis
EPAGA

SEQ ID NO: 1395774 - protein, 4 aa, Mycobacterium tuberculosis
EPAL

SEQ ID NO: 1395775 - protein, 4 aa, Mycobacterium tuberculosis
ERRG

SEQ ID NO: 1395776 - protein, 14 aa, Mycobacterium tuberculosis
GDAPPEPGYAPSKA

SEQ ID NO: 1395777 - protein, 5 aa, Mycobacterium tuberculosis
GDDGL

SEQ ID NO: 1395778 - protein, 13 aa, Mycobacterium tuberculosis
GHGTGTTLGDPIE

SEQ ID NO: 1395779 - protein, 4 aa, Mycobacterium tuberculosis
GVSG

SEQ ID NO: 1395780 - protein, 4 aa, Mycobacterium tuberculosis
HRDR

SEQ ID NO: 1395781 - protein, 5 aa, Mycobacterium tuberculosis
ITTSG

SEQ ID NO: 1395782 - protein, 10 aa, Mycobacterium tuberculosis
KSESALRGQA

SEQ ID NO: 1395783 - protein, 5 aa, Mycobacterium tuberculosis
LDPSR

SEQ ID NO: 1395784 - protein, 4 aa, Mycobacterium tuberculosis
LPAR

SEQ ID NO: 1395785 - protein, 6 aa, Mycobacterium tuberculosis
LSGYDD

SEQ ID NO: 1395786 - protein, 5 aa, Mycobacterium tuberculosis
MGDED

SEQ ID NO: 1395787 - protein, 4 aa, Mycobacterium tuberculosis
PATI

SEQ ID NO: 1395788 - protein, 4 aa, Mycobacterium tuberculosis
PGSP

SEQ ID NO: 1395789 - protein, 4 aa, Mycobacterium tuberculosis
PPAP

SEQ ID NO: 1395790 - protein, 4 aa, Mycobacterium tuberculosis
PRGR

SEQ ID NO: 1395791 - protein, 4 aa, Mycobacterium tuberculosis
PTDR

SEQ ID NO: 1395792 - protein, 4 aa, Mycobacterium tuberculosis
QGTD

SEQ ID NO: 1395793 - protein, 4 aa, Mycobacterium tuberculosis
RGLG

SEQ ID NO: 1395794 - protein, 10 aa, Mycobacterium tuberculosis
RRGPDAPGAA

SEQ ID NO: 1395795 - protein, 5 aa, Mycobacterium tuberculosis
SGAGN

SEQ ID NO: 1395796 - protein, 6 aa, Mycobacterium tuberculosis
SGCGKT

SEQ ID NO: 1395797 - protein, 4 aa, Mycobacterium tuberculosis
TAPV

SEQ ID NO: 1395798 - protein, 4 aa, Mycobacterium tuberculosis
TEKR

SEQ ID NO: 1395799 - protein, 14 aa, Mycobacterium tuberculosis
TINGTGSAPASQMN

SEQ ID NO: 1395800 - protein, 10 aa, Mycobacterium tuberculosis
TSGSTRTPAG

SEQ ID NO: 1395801 - protein, 5 aa, Mycobacterium tuberculosis
VNGPA

SEQ ID NO: 1395802 - protein, 8 aa, Mycobacterium tuberculosis
YEEPPSVV

SEQ ID NO: 1395803 - protein, 9 aa, Mycobacterium tuberculosis
ACEEELGGT

SEQ ID NO: 1395804 - protein, 4 aa, Mycobacterium tuberculosis
ADAG

SEQ ID NO: 1395805 - protein, 4 aa, Mycobacterium tuberculosis
ADRA

SEQ ID NO: 1395806 - protein, 11 aa, Mycobacterium tuberculosis
AGKAAQYRPDE

SEQ ID NO: 1395807 - protein, 6 aa, Mycobacterium tuberculosis
APPGYV

SEQ ID NO: 1395808 - protein, 5 aa, Mycobacterium tuberculosis
APQQR

SEQ ID NO: 1395809 - protein, 4 aa, Mycobacterium tuberculosis
ARAG

SEQ ID NO: 1395810 - protein, 6 aa, Mycobacterium tuberculosis
ATATGL

SEQ ID NO: 1395811 - protein, 4 aa, Mycobacterium tuberculosis
DDPA

SEQ ID NO: 1395812 - protein, 4 aa, Mycobacterium tuberculosis
GGAN

SEQ ID NO: 1395813 - protein, 13 aa, Mycobacterium tuberculosis
GNQGSYNIGPANL

SEQ ID NO: 1395814 - protein, 6 aa, Mycobacterium tuberculosis
GPGGGL

SEQ ID NO: 1395815 - protein, 4 aa, Mycobacterium tuberculosis
KGHP

SEQ ID NO: 1395816 - protein, 4 aa, Mycobacterium tuberculosis
KTGA

SEQ ID NO: 1395817 - protein, 5 aa, Mycobacterium tuberculosis
LDGPT

SEQ ID NO: 1395818 - protein, 7 aa, Mycobacterium tuberculosis
QVEEDGT

SEQ ID NO: 1395819 - protein, 9 aa, Mycobacterium tuberculosis
RRRTRAQDR

SEQ ID NO: 1395820 - protein, 4 aa, Mycobacterium tuberculosis
RSGQ

SEQ ID NO: 1395821 - protein, 4 aa, Mycobacterium tuberculosis
SPTR

SEQ ID NO: 1395822 - protein, 4 aa, Mycobacterium tuberculosis
TDGS

SEQ ID NO: 1395823 - protein, 6 aa, Mycobacterium tuberculosis
TDIRDP

SEQ ID NO: 1395824 - protein, 4 aa, Mycobacterium tuberculosis
TESG

SEQ ID NO: 1395825 - protein, 4 aa, Mycobacterium tuberculosis
VDGP

SEQ ID NO: 1395826 - protein, 4 aa, Mycobacterium tuberculosis
VNAT

SEQ ID NO: 1395827 - protein, 9 aa, Mycobacterium tuberculosis
YAGPGSGPM

SEQ ID NO: 1395828 - protein, 9 aa, Mycobacterium tuberculosis
AAGGPTHAS

SEQ ID NO: 1395829 - protein, 5 aa, Mycobacterium tuberculosis
AATSY

SEQ ID NO: 1395830 - protein, 4 aa, Mycobacterium tuberculosis
AERL

SEQ ID NO: 1395831 - protein, 7 aa, Mycobacterium tuberculosis
AQTEHPG

SEQ ID NO: 1395832 - protein, 7 aa, Mycobacterium tuberculosis
ASKGKWD

SEQ ID NO: 1395833 - protein, 8 aa, Mycobacterium tuberculosis
FNTGSGNV

SEQ ID NO: 1395834 - protein, 4 aa, Mycobacterium tuberculosis
GAAA

SEQ ID NO: 1395835 - protein, 4 aa, Mycobacterium tuberculosis
GDAP

SEQ ID NO: 1395836 - protein, 8 aa, Mycobacterium tuberculosis
GGGGGNFG

SEQ ID NO: 1395837 - protein, 5 aa, Mycobacterium tuberculosis
GLPPT

SEQ ID NO: 1395838 - protein, 15 aa, Mycobacterium tuberculosis
GSYNTGIGNSGIAST

SEQ ID NO: 1395839 - protein, 4 aa, Mycobacterium tuberculosis
GTLN

SEQ ID NO: 1395840 - protein, 4 aa, Mycobacterium tuberculosis
GVEP

SEQ ID NO: 1395841 - protein, 7 aa, Mycobacterium tuberculosis
IAATEAQ

SEQ ID NO: 1395842 - protein, 13 aa, Mycobacterium tuberculosis
INTANTAAAATTQ

SEQ ID NO: 1395843 - protein, 7 aa, Mycobacterium tuberculosis
PDPRYGQ

SEQ ID NO: 1395844 - protein, 5 aa, Mycobacterium tuberculosis
QNAPA

SEQ ID NO: 1395845 - protein, 4 aa, Mycobacterium tuberculosis
RPAA

SEQ ID NO: 1395846 - protein, 7 aa, Mycobacterium tuberculosis
RPGCRPS

SEQ ID NO: 1395847 - protein, 4 aa, Mycobacterium tuberculosis
SGIT

SEQ ID NO: 1395848 - protein, 6 aa, Mycobacterium tuberculosis
SSVASG

SEQ ID NO: 1395849 - protein, 4 aa, Mycobacterium tuberculosis
TGAE

SEQ ID NO: 1395850 - protein, 4 aa, Mycobacterium tuberculosis
VDRR

SEQ ID NO: 1395851 - protein, 4 aa, Mycobacterium tuberculosis
VPGE

SEQ ID NO: 1395852 - protein, 14 aa, Mycobacterium tuberculosis
VSINSGGEKVYPEE

SEQ ID NO: 1395853 - protein, 11 aa, Mycobacterium tuberculosis
YGQDRGEPGEP

SEQ ID NO: 1395854 - protein, 5 aa, Mycobacterium tuberculosis
AAAQR

SEQ ID NO: 1395855 - protein, 4 aa, Mycobacterium tuberculosis
AAEL

SEQ ID NO: 1395856 - protein, 13 aa, Mycobacterium tuberculosis
AAPGATNPDDHTP

SEQ ID NO: 1395857 - protein, 4 aa, Mycobacterium tuberculosis
ADEV

SEQ ID NO: 1395858 - protein, 5 aa, Mycobacterium tuberculosis
AEVDD

SEQ ID NO: 1395859 - protein, 5 aa, Mycobacterium tuberculosis
ALPGA

SEQ ID NO: 1395860 - protein, 4 aa, Mycobacterium tuberculosis
ASGS

SEQ ID NO: 1395861 - protein, 4 aa, Mycobacterium tuberculosis
DATA

SEQ ID NO: 1395862 - protein, 6 aa, Mycobacterium tuberculosis
DEEERR

SEQ ID NO: 1395863 - protein, 19 aa, Mycobacterium tuberculosis
EQTEARPADDVHAGHVTSG

SEQ ID NO: 1395864 - protein, 4 aa, Mycobacterium tuberculosis
EVPT

SEQ ID NO: 1395865 - protein, 4 aa, Mycobacterium tuberculosis
GGVE

SEQ ID NO: 1395866 - protein, 9 aa, Mycobacterium tuberculosis
GPPGTGKTT

SEQ ID NO: 1395867 - protein, 4 aa, Mycobacterium tuberculosis
GRRG

SEQ ID NO: 1395868 - protein, 5 aa, Mycobacterium tuberculosis
GSAPM

SEQ ID NO: 1395869 - protein, 4 aa, Mycobacterium tuberculosis
LGSR

SEQ ID NO: 1395870 - protein, 5 aa, Mycobacterium tuberculosis
LPDET

SEQ ID NO: 1395871 - protein, 12 aa, Mycobacterium tuberculosis
QQKSIEGNDAMT

SEQ ID NO: 1395872 - protein, 4 aa, Mycobacterium tuberculosis
QRAG

SEQ ID NO: 1395873 - protein, 7 aa, Mycobacterium tuberculosis
RRTKNNP

SEQ ID NO: 1395874 - protein, 24 aa, Mycobacterium tuberculosis
SAAGNGDAVVQPSGAGIHEVDVKI

SEQ ID NO: 1395875 - protein, 5 aa, Mycobacterium tuberculosis
SGREL

SEQ ID NO: 1395876 - protein, 4 aa, Mycobacterium tuberculosis
TADA

SEQ ID NO: 1395877 - protein, 8 aa, Mycobacterium tuberculosis
TPPITTPP

SEQ ID NO: 1395878 - protein, 11 aa, Mycobacterium tuberculosis
TTDKASGIVND

SEQ ID NO: 1395879 - protein, 4 aa, Mycobacterium tuberculosis
VGEG

SEQ ID NO: 1395880 - protein, 4 aa, Mycobacterium tuberculosis
APGA

SEQ ID NO: 1395881 - protein, 4 aa, Mycobacterium tuberculosis
ASGA

SEQ ID NO: 1395882 - protein, 7 aa, Mycobacterium tuberculosis
DGGATEL

SEQ ID NO: 1395883 - protein, 7 aa, Mycobacterium tuberculosis
DSRGQAY

SEQ ID NO: 1395884 - protein, 16 aa, Mycobacterium tuberculosis
ERPHPYSTPGRKRGAQ

SEQ ID NO: 1395885 - protein, 4 aa, Mycobacterium tuberculosis
ERQA

SEQ ID NO: 1395886 - protein, 6 aa, Mycobacterium tuberculosis
GDGVGG

SEQ ID NO: 1395887 - protein, 4 aa, Mycobacterium tuberculosis
GPQV

SEQ ID NO: 1395888 - protein, 11 aa, Mycobacterium tuberculosis
HQPSSEHTQPA

SEQ ID NO: 1395889 - protein, 10 aa, Mycobacterium tuberculosis
KRSPAGKPDY

SEQ ID NO: 1395890 - protein, 4 aa, Mycobacterium tuberculosis
LASG

SEQ ID NO: 1395891 - protein, 4 aa, Mycobacterium tuberculosis
PAER

SEQ ID NO: 1395892 - protein, 4 aa, Mycobacterium tuberculosis
PPAD

SEQ ID NO: 1395893 - protein, 7 aa, Mycobacterium tuberculosis
QAGSTYA

SEQ ID NO: 1395894 - protein, 16 aa, Mycobacterium tuberculosis
QTRKSARSRGKSDPID

SEQ ID NO: 1395895 - protein, 4 aa, Mycobacterium tuberculosis
RDAL

SEQ ID NO: 1395896 - protein, 5 aa, Mycobacterium tuberculosis
RLPKT

SEQ ID NO: 1395897 - protein, 4 aa, Mycobacterium tuberculosis
SAAG

SEQ ID NO: 1395898 - protein, 13 aa, Mycobacterium tuberculosis
SPSGHTYVSTPGS

SEQ ID NO: 1395899 - protein, 9 aa, Mycobacterium tuberculosis
TTPPITTPP

SEQ ID NO: 1395900 - protein, 4 aa, Mycobacterium tuberculosis
VPPG

SEQ ID NO: 1395901 - protein, 5 aa, Mycobacterium tuberculosis
VRSDS

SEQ ID NO: 1395902 - protein, 7 aa, Mycobacterium tuberculosis
AADEVSA

SEQ ID NO: 1395903 - protein, 5 aa, Mycobacterium tuberculosis
AAGVT

SEQ ID NO: 1395904 - protein, 4 aa, Mycobacterium tuberculosis
AEAQ

SEQ ID NO: 1395905 - protein, 4 aa, Mycobacterium tuberculosis
APMA

SEQ ID NO: 1395906 - protein, 8 aa, Mycobacterium tuberculosis
ARRPHGQH

SEQ ID NO: 1395907 - protein, 8 aa, Mycobacterium tuberculosis
ATSRRPDH

SEQ ID NO: 1395908 - protein, 9 aa, Mycobacterium tuberculosis
DAALGTPRR

SEQ ID NO: 1395909 - protein, 4 aa, Mycobacterium tuberculosis
DGMG

SEQ ID NO: 1395910 - protein, 4 aa, Mycobacterium tuberculosis
GDRA

SEQ ID NO: 1395911 - protein, 10 aa, Mycobacterium tuberculosis
GGAGTTAAGL

SEQ ID NO: 1395912 - protein, 5 aa, Mycobacterium tuberculosis
GNYSN

SEQ ID NO: 1395913 - protein, 4 aa, Mycobacterium tuberculosis
GPAG

SEQ ID NO: 1395914 - protein, 10 aa, Mycobacterium tuberculosis
GRAGEGSDAH

SEQ ID NO: 1395915 - protein, 8 aa, Mycobacterium tuberculosis
GRPRRAGV

SEQ ID NO: 1395916 - protein, 5 aa, Mycobacterium tuberculosis
LQDPV

SEQ ID NO: 1395917 - protein, 9 aa, Mycobacterium tuberculosis
NQAVTPAAR

SEQ ID NO: 1395918 - protein, 4 aa, Mycobacterium tuberculosis
PAPT

SEQ ID NO: 1395919 - protein, 5 aa, Mycobacterium tuberculosis
PRTTR

SEQ ID NO: 1395920 - protein, 4 aa, Mycobacterium tuberculosis
QGSA

SEQ ID NO: 1395921 - protein, 19 aa, Mycobacterium tuberculosis
RDHDNSDGVSDQRPPLPGN

SEQ ID NO: 1395922 - protein, 7 aa, Mycobacterium tuberculosis
SSGNAHT

SEQ ID NO: 1395923 - protein, 31 aa, Mycobacterium tuberculosis
TPGEASRRIAEAEDLGERRALTGEPLPAQLT

SEQ ID NO: 1395924 - protein, 4 aa, Mycobacterium tuberculosis
TPRA

SEQ ID NO: 1395925 - protein, 6 aa, Mycobacterium tuberculosis
VNPGGN

SEQ ID NO: 1395926 - protein, 4 aa, Mycobacterium tuberculosis
VQSL

SEQ ID NO: 1395927 - protein, 4 aa, Mycobacterium tuberculosis
VSGD

SEQ ID NO: 1395928 - protein, 34 aa, Mycobacterium tuberculosis; identical to SEQ ID NO: 165701

SEQ ID NO: 1395929 - protein, 7 aa, Mycobacterium tuberculosis
AGQRNAI

SEQ ID NO: 1395930 - protein, 4 aa, Mycobacterium tuberculosis
ARAY

SEQ ID NO: 1395931 - protein, 26 aa, Mycobacterium tuberculosis
DGRPLSSDPVSRPVTSYTASPPDNTI

SEQ ID NO: 1395932 - protein, 4 aa, Mycobacterium tuberculosis
DQLD

SEQ ID NO: 1395933 - protein, 5 aa, Mycobacterium tuberculosis
GAAAS

SEQ ID NO: 1395934 - protein, 6 aa, Mycobacterium tuberculosis
GQNTPA

SEQ ID NO: 1395935 - protein, 4 aa, Mycobacterium tuberculosis
GRGR

SEQ ID NO: 1395936 - protein, 8 aa, Mycobacterium tuberculosis
HQRDDNAA

SEQ ID NO: 1395937 - protein, 5 aa, Mycobacterium tuberculosis
KKGAN

SEQ ID NO: 1395938 - protein, 12 aa, Mycobacterium tuberculosis
LPQEQSQRPGHI

SEQ ID NO: 1395939 - protein, 4 aa, Mycobacterium tuberculosis
LSSP

SEQ ID NO: 1395940 - protein, 7 aa, Mycobacterium tuberculosis
NSRVRAE

SEQ ID NO: 1395941 - protein, 4 aa, Mycobacterium tuberculosis
PMPG

SEQ ID NO: 1395942 - protein, 14 aa, Mycobacterium tuberculosis
RPTLPGRHNHPQIS

SEQ ID NO: 1395943 - protein, 6 aa, Mycobacterium tuberculosis
SGSGNV

SEQ ID NO: 1395944 - protein, 12 aa, Mycobacterium tuberculosis
TERRQNHAARQR

SEQ ID NO: 1395945 - protein, 6 aa, Mycobacterium tuberculosis
TNEGLR

SEQ ID NO: 1395946 - protein, 4 aa, Mycobacterium tuberculosis
TTIG

SEQ ID NO: 1395947 - protein, 5 aa, Mycobacterium tuberculosis
TVPPP

SEQ ID NO: 1395948 - protein, 4 aa, Mycobacterium tuberculosis
DDAG

SEQ ID NO: 1395949 - protein, 4 aa, Mycobacterium tuberculosis
DGVE

SEQ ID NO: 1395950 - protein, 5 aa, Mycobacterium tuberculosis
ETEID

SEQ ID NO: 1395951 - protein, 4 aa, Mycobacterium tuberculosis
GEAV

SEQ ID NO: 1395952 - protein, 13 aa, Mycobacterium tuberculosis
GLAGGSGQAWQGA

SEQ ID NO: 1395953 - protein, 4 aa, Mycobacterium tuberculosis
IAGA

SEQ ID NO: 1395954 - protein, 30 aa, Mycobacterium tuberculosis
IARTEPKWGRGRPGKNAAPRPGRERARRLK

SEQ ID NO: 1395955 - protein, 9 aa, Mycobacterium tuberculosis
KNYDGSWTE

SEQ ID NO: 1395956 - protein, 4 aa, Mycobacterium tuberculosis
LDPA

SEQ ID NO: 1395957 - protein, 5 aa, Mycobacterium tuberculosis
LGAAA

SEQ ID NO: 1395958 - protein, 4 aa, Mycobacterium tuberculosis
LTGD

SEQ ID NO: 1395959 - protein, 9 aa, Mycobacterium tuberculosis
PEDLTERQS

SEQ ID NO: 1395960 - protein, 5 aa, Mycobacterium tuberculosis
QTQRA

SEQ ID NO: 1395961 - protein, 4 aa, Mycobacterium tuberculosis
SGGL

SEQ ID NO: 1395962 - protein, 4 aa, Mycobacterium tuberculosis
SGPM

SEQ ID NO: 1395963 - protein, 5 aa, Mycobacterium tuberculosis
TGNGQ

SEQ ID NO: 1395964 - protein, 5 aa, Mycobacterium tuberculosis
THRTD

SEQ ID NO: 1395965 - protein, 5 aa, Mycobacterium tuberculosis
AAPAG

SEQ ID NO: 1395966 - protein, 11 aa, Mycobacterium tuberculosis
AARAGGAAVQA

SEQ ID NO: 1395967 - protein, 4 aa, Mycobacterium tuberculosis
ARIS

SEQ ID NO: 1395968 - protein, 4 aa, Mycobacterium tuberculosis
DDGI

SEQ ID NO: 1395969 - protein, 10 aa, Mycobacterium tuberculosis
DTQASEEELG

SEQ ID NO: 1395970 - protein, 10 aa, Mycobacterium tuberculosis
EEDDAGDGAR

SEQ ID NO: 1395971 - protein, 7 aa, Mycobacterium tuberculosis
FPRPQTQ

SEQ ID NO: 1395972 - protein, 6 aa, Mycobacterium tuberculosis
GDGQIG

SEQ ID NO: 1395973 - protein, 4 aa, Mycobacterium tuberculosis
GGAA

SEQ ID NO: 1395974 - protein, 10 aa, Mycobacterium tuberculosis
GGASAAAAAL

SEQ ID NO: 1395975 - protein, 4 aa, Mycobacterium tuberculosis
GGDA

SEQ ID NO: 1395976 - protein, 5 aa, Mycobacterium tuberculosis
ITNPG

SEQ ID NO: 1395977 - protein, 4 aa, Mycobacterium tuberculosis
RPEL

SEQ ID NO: 1395978 - protein, 6 aa, Mycobacterium tuberculosis
RTTRQI

SEQ ID NO: 1395979 - protein, 6 aa, Mycobacterium tuberculosis
TATGLT

SEQ ID NO: 1395980 - protein, 5 aa, Mycobacterium tuberculosis
TGAAQ

SEQ ID NO: 1395981 - protein, 4 aa, Mycobacterium tuberculosis
ADPV

SEQ ID NO: 1395982 - protein, 4 aa, Mycobacterium tuberculosis
AGID

SEQ ID NO: 1395983 - protein, 4 aa, Mycobacterium tuberculosis
ALQT

SEQ ID NO: 1395984 - protein, 15 aa, Mycobacterium tuberculosis
ASGTGLGGAGGLGAG

SEQ ID NO: 1395985 - protein, 7 aa, Mycobacterium tuberculosis
CDEPATN

SEQ ID NO: 1395986 - protein, 4 aa, Mycobacterium tuberculosis
DATG

SEQ ID NO: 1395987 - protein, 5 aa, Mycobacterium tuberculosis
EDPPM

SEQ ID NO: 1395988 - protein, 8 aa, Mycobacterium tuberculosis
FANTGNNN

SEQ ID NO: 1395989 - protein, 4 aa, Mycobacterium tuberculosis
GADQ

SEQ ID NO: 1395990 - protein, 4 aa, Mycobacterium tuberculosis
GARE

SEQ ID NO: 1395991 - protein, 4 aa, Mycobacterium tuberculosis
GLRP

SEQ ID NO: 1395992 - protein, 4 aa, Mycobacterium tuberculosis
GTPG

SEQ ID NO: 1395993 - protein, 4 aa, Mycobacterium tuberculosis
PDSR

SEQ ID NO: 1395994 - protein, 4 aa, Mycobacterium tuberculosis
PGRP

SEQ ID NO: 1395995 - protein, 4 aa, Mycobacterium tuberculosis
QLPD

SEQ ID NO: 1395996 - protein, 9 aa, Mycobacterium tuberculosis
QTYVTTPGS

SEQ ID NO: 1395997 - protein, 4 aa, Mycobacterium tuberculosis
RAKP

SEQ ID NO: 1395998 - protein, 4 aa, Mycobacterium tuberculosis
RDYP

SEQ ID NO: 1395999 - protein, 4 aa, Mycobacterium tuberculosis
RGGK

SEQ ID NO: 1396000 - protein, 9 aa, Mycobacterium tuberculosis
RSDTREEIS

SEQ ID NO: 1396001 - protein, 13 aa, Mycobacterium tuberculosis
VDGAKRPPKPIPV

SEQ ID NO: 1396002 - protein, 4 aa, Mycobacterium tuberculosis
YPGQ

SEQ ID NO: 1396003 - protein, 18 aa, Mycobacterium tuberculosis
AAGQAELSAGQATAAATA

SEQ ID NO: 1396004 - protein, 6 aa, Mycobacterium tuberculosis
ADEVST

SEQ ID NO: 1396005 - protein, 5 aa, Mycobacterium tuberculosis
AERAA

SEQ ID NO: 1396006 - protein, 7 aa, Mycobacterium tuberculosis
AGAGSGP

SEQ ID NO: 1396007 - protein, 4 aa, Mycobacterium tuberculosis
AGED

SEQ ID NO: 1396008 - protein, 4 aa, Mycobacterium tuberculosis
AGWA

SEQ ID NO: 1396009 - protein, 4 aa, Mycobacterium tuberculosis
APTA

SEQ ID NO: 1396010 - protein, 8 aa, Mycobacterium tuberculosis
ASQAGAQL

SEQ ID NO: 1396011 - protein, 6 aa, Mycobacterium tuberculosis
EATSLD

SEQ ID NO: 1396012 - protein, 4 aa, Mycobacterium tuberculosis
FEET

SEQ ID NO: 1396013 - protein, 8 aa, Mycobacterium tuberculosis
FGNSGNNN

SEQ ID NO: 1396014 - protein, 7 aa, Mycobacterium tuberculosis
GAGAGMP

SEQ ID NO: 1396015 - protein, 4 aa, Mycobacterium tuberculosis
GGLG

SEQ ID NO: 1396016 - protein, 8 aa, Mycobacterium tuberculosis
GNTGNGNI

SEQ ID NO: 1396017 - protein, 4 aa, Mycobacterium tuberculosis
GRDD

SEQ ID NO: 1396018 - protein, 8 aa, Mycobacterium tuberculosis
GRGGANPH

SEQ ID NO: 1396019 - protein, 18 aa, Mycobacterium tuberculosis
GTTANTAGLAGAEAAGLA

SEQ ID NO: 1396020 - protein, 4 aa, Mycobacterium tuberculosis
LAGQ

SEQ ID NO: 1396021 - protein, 14 aa, Mycobacterium tuberculosis
NSPAPTLMISVDEY

SEQ ID NO: 1396022 - protein, 9 aa, Mycobacterium tuberculosis
RGTATAAGK

SEQ ID NO: 1396023 - protein, 6 aa, Mycobacterium tuberculosis
RPEYGG

SEQ ID NO: 1396024 - protein, 7 aa, Mycobacterium tuberculosis
SGDNQQG

SEQ ID NO: 1396025 - protein, 9 aa, Mycobacterium tuberculosis
TSAAQTAPG

SEQ ID NO: 1396026 - protein, 23 aa, Mycobacterium tuberculosis
WGGAAPVTRAGDDAEQSDGEERR

SEQ ID NO: 1396027 - protein, 5 aa, Mycobacterium tuberculosis
AAAYP

SEQ ID NO: 1396028 - protein, 8 aa, Mycobacterium tuberculosis
AASATPLQ

SEQ ID NO: 1396029 - protein, 16 aa, Mycobacterium tuberculosis
AGPEPAPPKPPTPPMP

SEQ ID NO: 1396030 - protein, 5 aa, Mycobacterium tuberculosis
ALPGD

SEQ ID NO: 1396031 - protein, 4 aa, Mycobacterium tuberculosis
AQGR

SEQ ID NO: 1396032 - protein, 4 aa, Mycobacterium tuberculosis
EQGT

SEQ ID NO: 1396033 - protein, 5 aa, Mycobacterium tuberculosis
ETETG

SEQ ID NO: 1396034 - protein, 4 aa, Mycobacterium tuberculosis
GAPI

SEQ ID NO: 1396035 - protein, 6 aa, Mycobacterium tuberculosis
GELGQH

SEQ ID NO: 1396036 - protein, 13 aa, Mycobacterium tuberculosis
GIDPTGLRGSATG

SEQ ID NO: 1396037 - protein, 4 aa, Mycobacterium tuberculosis
GRDG

SEQ ID NO: 1396038 - protein, 8 aa, Mycobacterium tuberculosis
HISDSRSL

SEQ ID NO: 1396039 - protein, 5 aa, Mycobacterium tuberculosis
LRSGE

SEQ ID NO: 1396040 - protein, 6 aa, Mycobacterium tuberculosis
RGSQWA

SEQ ID NO: 1396041 - protein, 4 aa, Mycobacterium tuberculosis
RSAA

SEQ ID NO: 1396042 - protein, 4 aa, Mycobacterium tuberculosis
RTGE

SEQ ID NO: 1396043 - protein, 4 aa, Mycobacterium tuberculosis
SKSQ

SEQ ID NO: 1396044 - protein, 4 aa, Mycobacterium tuberculosis
TDPA

SEQ ID NO: 1396045 - protein, 6 aa, Mycobacterium tuberculosis
AAAPYA

SEQ ID NO: 1396046 - protein, 5 aa, Mycobacterium tuberculosis
AGAGA

SEQ ID NO: 1396047 - protein, 5 aa, Mycobacterium tuberculosis
DGSSI

SEQ ID NO: 1396048 - protein, 4 aa, Mycobacterium tuberculosis
DPGL

SEQ ID NO: 1396049 - protein, 4 aa, Mycobacterium tuberculosis
DVPT

SEQ ID NO: 1396050 - protein, 4 aa, Mycobacterium tuberculosis
EGFL

SEQ ID NO: 1396051 - protein, 4 aa, Mycobacterium tuberculosis
ERRA

SEQ ID NO: 1396052 - protein, 4 aa, Mycobacterium tuberculosis
GDRL

SEQ ID NO: 1396053 - protein, 16 aa, Mycobacterium tuberculosis
GNANTGVANAGNVNTG

SEQ ID NO: 1396054 - protein, 4 aa, Mycobacterium tuberculosis
GSLR

SEQ ID NO: 1396055 - protein, 7 aa, Mycobacterium tuberculosis
GTGGVGQ

SEQ ID NO: 1396056 - protein, 13 aa, Mycobacterium tuberculosis
HDPRSREQRRADA

SEQ ID NO: 1396057 - protein, 4 aa, Mycobacterium tuberculosis
HDTL

SEQ ID NO: 1396058 - protein, 12 aa, Mycobacterium tuberculosis
IPAPEADPPYDH

SEQ ID NO: 1396059 - protein, 4 aa, Mycobacterium tuberculosis
PDQL

SEQ ID NO: 1396060 - protein, 4 aa, Mycobacterium tuberculosis
PGVT

SEQ ID NO: 1396061 - protein, 23 aa, Mycobacterium tuberculosis
QHSAGACSDTLATGGTVGLQEIR

SEQ ID NO: 1396062 - protein, 7 aa, Mycobacterium tuberculosis
QNTPAIA

SEQ ID NO: 1396063 - protein, 6 aa, Mycobacterium tuberculosis
RDRREG

SEQ ID NO: 1396064 - protein, 8 aa, Mycobacterium tuberculosis
SGDNQQGF

SEQ ID NO: 1396065 - protein, 4 aa, Mycobacterium tuberculosis
TAVT

SEQ ID NO: 1396066 - protein, 4 aa, Mycobacterium tuberculosis
TTGL

SEQ ID NO: 1396067 - protein, 4 aa, Mycobacterium tuberculosis
YDPR

SEQ ID NO: 1396068 - protein, 4 aa, Mycobacterium tuberculosis
YGPQ

SEQ ID NO: 1396069 - protein, 16 aa, Mycobacterium tuberculosis
YRERSDERSNQRNGYR

SEQ ID NO: 1396070 - protein, 4 aa, Mycobacterium tuberculosis
AAGV

SEQ ID NO: 1396071 - protein, 4 aa, Mycobacterium tuberculosis
AERG

SEQ ID NO: 1396072 - protein, 8 aa, Mycobacterium tuberculosis
ANTGSNNI

SEQ ID NO: 1396073 - protein, 4 aa, Mycobacterium tuberculosis
ARGL

SEQ ID NO: 1396074 - protein, 4 aa, Mycobacterium tuberculosis
ATGE

SEQ ID NO: 1396075 - protein, 4 aa, Mycobacterium tuberculosis
AVTG

SEQ ID NO: 1396076 - protein, 4 aa, Mycobacterium tuberculosis
DGDA

SEQ ID NO: 1396077 - protein, 4 aa, Mycobacterium tuberculosis
DYDD

SEQ ID NO: 1396078 - protein, 4 aa, Mycobacterium tuberculosis
ENGG

SEQ ID NO: 1396079 - protein, 9 aa, Mycobacterium tuberculosis
GARTRRAGV

SEQ ID NO: 1396080 - protein, 7 aa, Mycobacterium tuberculosis
GDSGFVS

SEQ ID NO: 1396081 - protein, 4 aa, Mycobacterium tuberculosis
GDYP

SEQ ID NO: 1396082 - protein, 6 aa, Mycobacterium tuberculosis
GEPQPE

SEQ ID NO: 1396083 - protein, 4 aa, Mycobacterium tuberculosis
GETI

SEQ ID NO: 1396084 - protein, 4 aa, Mycobacterium tuberculosis
GPAA

SEQ ID NO: 1396085 - protein, 20 aa, Mycobacterium tuberculosis
GPDNRLAEKGWTTHNNTHGH

SEQ ID NO: 1396086 - protein, 6 aa, Mycobacterium tuberculosis
HRNHQA

SEQ ID NO: 1396087 - protein, 5 aa, Mycobacterium tuberculosis
LDEDS

SEQ ID NO: 1396088 - protein, 4 aa, Mycobacterium tuberculosis
LGTG

SEQ ID NO: 1396089 - protein, 7 aa, Mycobacterium tuberculosis
LSAPGSR

SEQ ID NO: 1396090 - protein, 6 aa, Mycobacterium tuberculosis
LSPGAG

SEQ ID NO: 1396091 - protein, 7 aa, Mycobacterium tuberculosis
NAPAIAA

SEQ ID NO: 1396092 - protein, 9 aa, Mycobacterium tuberculosis
NWKGSSSDL

SEQ ID NO: 1396093 - protein, 4 aa, Mycobacterium tuberculosis
PGRT

SEQ ID NO: 1396094 - protein, 4 aa, Mycobacterium tuberculosis
PKLR

SEQ ID NO: 1396095 - protein, 4 aa, Mycobacterium tuberculosis
PQQR

SEQ ID NO: 1396096 - protein, 4 aa, Mycobacterium tuberculosis
PRVR

SEQ ID NO: 1396097 - protein, 11 aa, Mycobacterium tuberculosis
QAYQAASAQAA

SEQ ID NO: 1396098 - protein, 9 aa, Mycobacterium tuberculosis
QDAGKTKRA

SEQ ID NO: 1396099 - protein, 4 aa, Mycobacterium tuberculosis
RTDA

SEQ ID NO: 1396100 - protein, 10 aa, Mycobacterium tuberculosis
SGGRRRGDTR

SEQ ID NO: 1396101 - protein, 4 aa, Mycobacterium tuberculosis
SRAG

SEQ ID NO: 1396102 - protein, 7 aa, Mycobacterium tuberculosis
STNVRAH

SEQ ID NO: 1396103 - protein, 4 aa, Mycobacterium tuberculosis
TAER

SEQ ID NO: 1396104 - protein, 8 aa, Mycobacterium tuberculosis
TGPADNLT

SEQ ID NO: 1396105 - protein, 8 aa, Mycobacterium tuberculosis
THDETSRE

SEQ ID NO: 1396106 - protein, 5 aa, Mycobacterium tuberculosis
TPGDL

SEQ ID NO: 1396107 - protein, 4 aa, Mycobacterium tuberculosis
TPHE

SEQ ID NO: 1396108 - protein, 5 aa, Mycobacterium tuberculosis
AAAPY

SEQ ID NO: 1396109 - protein, 4 aa, Mycobacterium tuberculosis
AATS

SEQ ID NO: 1396110 - protein, 4 aa, Mycobacterium tuberculosis
AQRA

SEQ ID NO: 1396111 - protein, 4 aa, Mycobacterium tuberculosis
ARAC

SEQ ID NO: 1396112 - protein, 5 aa, Mycobacterium tuberculosis
AVRPG

SEQ ID NO: 1396113 - protein, 4 aa, Mycobacterium tuberculosis
DELG

SEQ ID NO: 1396114 - protein, 4 aa, Mycobacterium tuberculosis
DFPA

SEQ ID NO: 1396115 - protein, 6 aa, Mycobacterium tuberculosis
DGGRKK

SEQ ID NO: 1396116 - protein, 5 aa, Mycobacterium tuberculosis
DIYGD

SEQ ID NO: 1396117 - protein, 4 aa, Mycobacterium tuberculosis
DSAA

SEQ ID NO: 1396118 - protein, 5 aa, Mycobacterium tuberculosis
EADPD

SEQ ID NO: 1396119 - protein, 4 aa, Mycobacterium tuberculosis
EALG

SEQ ID NO: 1396120 - protein, 5 aa, Mycobacterium tuberculosis
EASNR

SEQ ID NO: 1396121 - protein, 9 aa, Mycobacterium tuberculosis
FGNTGNNNI

SEQ ID NO: 1396122 - protein, 4 aa, Mycobacterium tuberculosis
GAGK

SEQ ID NO: 1396123 - protein, 4 aa, Mycobacterium tuberculosis
GDRV

SEQ ID NO: 1396124 - protein, 5 aa, Mycobacterium tuberculosis
GGARG

SEQ ID NO: 1396125 - protein, 4 aa, Mycobacterium tuberculosis
GPGV

SEQ ID NO: 1396126 - protein, 4 aa, Mycobacterium tuberculosis
GVPA

SEQ ID NO: 1396127 - protein, 6 aa, Mycobacterium tuberculosis
HGRGGF

SEQ ID NO: 1396128 - protein, 10 aa, Mycobacterium tuberculosis
KDEKKTAETF

SEQ ID NO: 1396129 - protein, 10 aa, Mycobacterium tuberculosis
LGNTGSTNTG

SEQ ID NO: 1396130 - protein, 4 aa, Mycobacterium tuberculosis
PDGV

SEQ ID NO: 1396131 - protein, 4 aa, Mycobacterium tuberculosis
PPAG

SEQ ID NO: 1396132 - protein, 4 aa, Mycobacterium tuberculosis
PPRF

SEQ ID NO: 1396133 - protein, 4 aa, Mycobacterium tuberculosis
PPRP

SEQ ID NO: 1396134 - protein, 4 aa, Mycobacterium tuberculosis
PRKA

SEQ ID NO: 1396135 - protein, 4 aa, Mycobacterium tuberculosis
RTRP

SEQ ID NO: 1396136 - protein, 4 aa, Mycobacterium tuberculosis
SDGA

SEQ ID NO: 1396137 - protein, 4 aa, Mycobacterium tuberculosis
SDGG

SEQ ID NO: 1396138 - protein, 4 aa, Mycobacterium tuberculosis
SDPS

SEQ ID NO: 1396139 - protein, 4 aa, Mycobacterium tuberculosis
SRGL

SEQ ID NO: 1396140 - protein, 6 aa, Mycobacterium tuberculosis
TDAEAA

SEQ ID NO: 1396141 - protein, 4 aa, Mycobacterium tuberculosis
TDFG

SEQ ID NO: 1396142 - protein, 5 aa, Mycobacterium tuberculosis
TEEQK

SEQ ID NO: 1396143 - protein, 4 aa, Mycobacterium tuberculosis
VPAG

SEQ ID NO: 1396144 - protein, 6 aa, Mycobacterium tuberculosis
AADTAV

SEQ ID NO: 1396145 - protein, 4 aa, Mycobacterium tuberculosis
APTV

SEQ ID NO: 1396146 - protein, 4 aa, Mycobacterium tuberculosis
DEVS

SEQ ID NO: 1396147 - protein, 4 aa, Mycobacterium tuberculosis
DGAG

SEQ ID NO: 1396148 - protein, 16 aa, Mycobacterium tuberculosis
EAATGKGVTGGGSRVP

SEQ ID NO: 1396149 - protein, 4 aa, Mycobacterium tuberculosis
EAPV

SEQ ID NO: 1396150 - protein, 6 aa, Mycobacterium tuberculosis
EPGVGK

SEQ ID NO: 1396151 - protein, 5 aa, Mycobacterium tuberculosis
GDGQI

SEQ ID NO: 1396152 - protein, 9 aa, Mycobacterium tuberculosis
GDGSTNPIR

SEQ ID NO: 1396153 - protein, 4 aa, Mycobacterium tuberculosis
GELP

SEQ ID NO: 1396154 - protein, 4 aa, Mycobacterium tuberculosis
GRSG

SEQ ID NO: 1396155 - protein, 4 aa, Mycobacterium tuberculosis
GTGQ

SEQ ID NO: 1396156 - protein, 14 aa, Mycobacterium tuberculosis
ITGQPTEWIVPRGT

SEQ ID NO: 1396157 - protein, 4 aa, Mycobacterium tuberculosis
LEPG

SEQ ID NO: 1396158 - protein, 12 aa, Mycobacterium tuberculosis
LVGSPGQGAYAA

SEQ ID NO: 1396159 - protein, 5 aa, Mycobacterium tuberculosis
PPTWE

SEQ ID NO: 1396160 - protein, 4 aa, Mycobacterium tuberculosis
PTTA

SEQ ID NO: 1396161 - protein, 8 aa, Mycobacterium tuberculosis
QAVTPAAR

SEQ ID NO: 1396162 - protein, 4 aa, Mycobacterium tuberculosis
RGAG

SEQ ID NO: 1396163 - protein, 5 aa, Mycobacterium tuberculosis
RLPEA

SEQ ID NO: 1396164 - protein, 6 aa, Mycobacterium tuberculosis
RPAPDT

SEQ ID NO: 1396165 - protein, 10 aa, Mycobacterium tuberculosis
RTGPPQSTSW

SEQ ID NO: 1396166 - protein, 4 aa, Mycobacterium tuberculosis
SDGR

SEQ ID NO: 1396167 - protein, 4 aa, Mycobacterium tuberculosis
SELT

SEQ ID NO: 1396168 - protein, 4 aa, Mycobacterium tuberculosis
SGLP

SEQ ID NO: 1396169 - protein, 4 aa, Mycobacterium tuberculosis
SGVA

SEQ ID NO: 1396170 - protein, 4 aa, Mycobacterium tuberculosis
SRED

SEQ ID NO: 1396171 - protein, 8 aa, Mycobacterium tuberculosis
SRSGNRQL

SEQ ID NO: 1396172 - protein, 4 aa, Mycobacterium tuberculosis
TGRS

SEQ ID NO: 1396173 - protein, 5 aa, Mycobacterium tuberculosis
AARAG

SEQ ID NO: 1396174 - protein, 5 aa, Mycobacterium tuberculosis
AETYG

SEQ ID NO: 1396175 - protein, 10 aa, Mycobacterium tuberculosis
AEVPAAGGPM

SEQ ID NO: 1396176 - protein, 4 aa, Mycobacterium tuberculosis
AGAE

SEQ ID NO: 1396177 - protein, 9 aa, Mycobacterium tuberculosis
AGPWSGPAS

SEQ ID NO: 1396178 - protein, 4 aa, Mycobacterium tuberculosis
AGTF

SEQ ID NO: 1396179 - protein, 10 aa, Mycobacterium tuberculosis
AKASGASRSE

SEQ ID NO: 1396180 - protein, 4 aa, Mycobacterium tuberculosis
APEV

SEQ ID NO: 1396181 - protein, 4 aa, Mycobacterium tuberculosis
EERR

SEQ ID NO: 1396182 - protein, 4 aa, Mycobacterium tuberculosis
GDGN

SEQ ID NO: 1396183 - protein, 4 aa, Mycobacterium tuberculosis
GGVD

SEQ ID NO: 1396184 - protein, 12 aa, Mycobacterium tuberculosis
GKLTGYGGGINR

SEQ ID NO: 1396185 - protein, 4 aa, Mycobacterium tuberculosis
GPDL

SEQ ID NO: 1396186 - protein, 5 aa, Mycobacterium tuberculosis
GPGLT

SEQ ID NO: 1396187 - protein, 7 aa, Mycobacterium tuberculosis
GRPSRID

SEQ ID NO: 1396188 - protein, 4 aa, Mycobacterium tuberculosis
GYAR

SEQ ID NO: 1396189 - protein, 5 aa, Mycobacterium tuberculosis
KTPHI

SEQ ID NO: 1396190 - protein, 9 aa, Mycobacterium tuberculosis
LDGAAAGQQ

SEQ ID NO: 1396191 - protein, 5 aa, Mycobacterium tuberculosis
LSPGQ

SEQ ID NO: 1396192 - protein, 6 aa, Mycobacterium tuberculosis
LTPAEG

SEQ ID NO: 1396193 - protein, 10 aa, Mycobacterium tuberculosis
MTAKSLTDRL

SEQ ID NO: 1396194 - protein, 4 aa, Mycobacterium tuberculosis
NDPE

SEQ ID NO: 1396195 - protein, 9 aa, Mycobacterium tuberculosis
QIGAPGAAR

SEQ ID NO: 1396196 - protein, 7 aa, Mycobacterium tuberculosis
RASASSF

SEQ ID NO: 1396197 - protein, 4 aa, Mycobacterium tuberculosis
RDDA

SEQ ID NO: 1396198 - protein, 4 aa, Mycobacterium tuberculosis
REEP

SEQ ID NO: 1396199 - protein, 8 aa, Mycobacterium tuberculosis
RTGSEGRI

SEQ ID NO: 1396200 - protein, 4 aa, Mycobacterium tuberculosis
SAAA

SEQ ID NO: 1396201 - protein, 4 aa, Mycobacterium tuberculosis
SALD

SEQ ID NO: 1396202 - protein, 4 aa, Mycobacterium tuberculosis
SDYD

SEQ ID NO: 1396203 - protein, 5 aa, Mycobacterium tuberculosis
SWPNP

SEQ ID NO: 1396204 - protein, 4 aa, Mycobacterium tuberculosis
TNSG

SEQ ID NO: 1396205 - protein, 4 aa, Mycobacterium tuberculosis
TPAT

SEQ ID NO: 1396206 - protein, 4 aa, Mycobacterium tuberculosis
VGPS

SEQ ID NO: 1396207 - protein, 10 aa, Mycobacterium tuberculosis
YGTGSKQERL

SEQ ID NO: 1396208 - protein, 5 aa, Mycobacterium tuberculosis
YPTLD

SEQ ID NO: 1396209 - protein, 13 aa, Mycobacterium tuberculosis
AAAQGPAAHTDEE

SEQ ID NO: 1396210 - protein, 5 aa, Mycobacterium tuberculosis
AADPA

SEQ ID NO: 1396211 - protein, 6 aa, Mycobacterium tuberculosis
AADRDV

SEQ ID NO: 1396212 - protein, 12 aa, Mycobacterium tuberculosis
AAGAAASSDITA

SEQ ID NO: 1396213 - protein, 6 aa, Mycobacterium tuberculosis
AAGGGV

SEQ ID NO: 1396214 - protein, 8 aa, Mycobacterium tuberculosis
AAGSNAPV

SEQ ID NO: 1396215 - protein, 6 aa, Mycobacterium tuberculosis
AAGVGS

SEQ ID NO: 1396216 - protein, 4 aa, Mycobacterium tuberculosis
AAPS

SEQ ID NO: 1396217 - protein, 5 aa, Mycobacterium tuberculosis
ADGNL

SEQ ID NO: 1396218 - protein, 4 aa, Mycobacterium tuberculosis
ADPE

SEQ ID NO: 1396219 - protein, 4 aa, Mycobacterium tuberculosis
ADQA

SEQ ID NO: 1396220 - protein, 7 aa, Mycobacterium tuberculosis
AEGSQVR

SEQ ID NO: 1396221 - protein, 5 aa, Mycobacterium tuberculosis
AEKEL

SEQ ID NO: 1396222 - protein, 4 aa, Mycobacterium tuberculosis
AEPA

SEQ ID NO: 1396223 - protein, 15 aa, Mycobacterium tuberculosis
AEYDPDGLFNSWMGR

SEQ ID NO: 1396224 - protein, 18 aa, Mycobacterium tuberculosis
AGAAPAGAAVEAAEEQSE

SEQ ID NO: 1396225 - protein, 9 aa, Mycobacterium tuberculosis
AGGAGEGQR

SEQ ID NO: 1396226 - protein, 8 aa, Mycobacterium tuberculosis
AGGDPQGA

SEQ ID NO: 1396227 - protein, 9 aa, Mycobacterium tuberculosis
AGSHNPGHT

SEQ ID NO: 1396228 - protein, 29 aa, Mycobacterium tuberculosis
AGSSATASQLAPFSEPPQTTNPSATAAQS

SEQ ID NO: 1396229 - protein, 5 aa, Mycobacterium tuberculosis
AGSSV

SEQ ID NO: 1396230 - protein, 7 aa, Mycobacterium tuberculosis
AGSVSER

SEQ ID NO: 1396231 - protein, 10 aa, Mycobacterium tuberculosis
AIDGKANDAV

SEQ ID NO: 1396232 - protein, 7 aa, Mycobacterium tuberculosis
ALANSNG

SEQ ID NO: 1396233 - protein, 8 aa, Mycobacterium tuberculosis
ALPAGPAA

SEQ ID NO: 1396234 - protein, 8 aa, Mycobacterium tuberculosis
ANPAAQDL

SEQ ID NO: 1396235 - protein, 9 aa, Mycobacterium tuberculosis
ANTAGEDTF

SEQ ID NO: 1396236 - protein, 6 aa, Mycobacterium tuberculosis
APASQL

SEQ ID NO: 1396237 - protein, 6 aa, Mycobacterium tuberculosis
APEVAS

SEQ ID NO: 1396238 - protein, 4 aa, Mycobacterium tuberculosis
APGP

SEQ ID NO: 1396239 - protein, 4 aa, Mycobacterium tuberculosis
APGT

SEQ ID NO: 1396240 - protein, 6 aa, Mycobacterium tuberculosis
APLGNA

SEQ ID NO: 1396241 - protein, 4 aa, Mycobacterium tuberculosis
AQGQ

SEQ ID NO: 1396242 - protein, 6 aa, Mycobacterium tuberculosis
AQQAGL

SEQ ID NO: 1396243 - protein, 8 aa, Mycobacterium tuberculosis
ARASGKSA

SEQ ID NO: 1396244 - protein, 6 aa, Mycobacterium tuberculosis
ARRPGR

SEQ ID NO: 1396245 - protein, 10 aa, Mycobacterium tuberculosis
ASAGSGADGA

SEQ ID NO: 1396246 - protein, 5 aa, Mycobacterium tuberculosis
ASGAD

SEQ ID NO: 1396247 - protein, 7 aa, Mycobacterium tuberculosis
ASLAGGA

SEQ ID NO: 1396248 - protein, 14 aa, Mycobacterium tuberculosis
ASSTKKSGATVLSG

SEQ ID NO: 1396249 - protein, 4 aa, Mycobacterium tuberculosis
ATRG

SEQ ID NO: 1396250 - protein, 13 aa, Mycobacterium tuberculosis
ATTATATSASAGW

SEQ ID NO: 1396251 - protein, 8 aa, Mycobacterium tuberculosis
ATTGEPTV

SEQ ID NO: 1396252 - protein, 4 aa, Mycobacterium tuberculosis
CGPD

SEQ ID NO: 1396253 - protein, 5 aa, Mycobacterium tuberculosis
CPPRQ

SEQ ID NO: 1396254 - protein, 5 aa, Mycobacterium tuberculosis
DASAG

SEQ ID NO: 1396255 - protein, 4 aa, Mycobacterium tuberculosis
DDGL

SEQ ID NO: 1396256 - protein, 7 aa, Mycobacterium tuberculosis
DDNTHTT

SEQ ID NO: 1396257 - protein, 12 aa, Mycobacterium tuberculosis
DEAADKAAELAS

SEQ ID NO: 1396258 - protein, 5 aa, Mycobacterium tuberculosis
DEHPG

SEQ ID NO: 1396259 - protein, 4 aa, Mycobacterium tuberculosis
DEPG

SEQ ID NO: 1396260 - protein, 6 aa, Mycobacterium tuberculosis
DGNITS

SEQ ID NO: 1396261 - protein, 7 aa, Mycobacterium tuberculosis
DGPGTQL

SEQ ID NO: 1396262 - protein, 5 aa, Mycobacterium tuberculosis
DGSAL

SEQ ID NO: 1396263 - protein, 8 aa, Mycobacterium tuberculosis
DGTPTALR

SEQ ID NO: 1396264 - protein, 7 aa, Mycobacterium tuberculosis
DIQGGGS

SEQ ID NO: 1396265 - protein, 6 aa, Mycobacterium tuberculosis
DKFGGD

SEQ ID NO: 1396266 - protein, 9 aa, Mycobacterium tuberculosis
DLAQAGAPK

SEQ ID NO: 1396267 - protein, 10 aa, Mycobacterium tuberculosis
DLVDGAPKPL

SEQ ID NO: 1396268 - protein, 5 aa, Mycobacterium tuberculosis
DMPGV

SEQ ID NO: 1396269 - protein, 7 aa, Mycobacterium tuberculosis
DPDPSAV

SEQ ID NO: 1396270 - protein, 4 aa, Mycobacterium tuberculosis
DRRT

SEQ ID NO: 1396271 - protein, 7 aa, Mycobacterium tuberculosis
DSGAGAL

SEQ ID NO: 1396272 - protein, 4 aa, Mycobacterium tuberculosis
DSPD

SEQ ID NO: 1396273 - protein, 6 aa, Mycobacterium tuberculosis
DSVSER

SEQ ID NO: 1396274 - protein, 6 aa, Mycobacterium tuberculosis
DTERPS

SEQ ID NO: 1396275 - protein, 4 aa, Mycobacterium tuberculosis
DVDG

SEQ ID NO: 1396276 - protein, 4 aa, Mycobacterium tuberculosis
DWQD

SEQ ID NO: 1396277 - protein, 11 aa, Mycobacterium tuberculosis
DYSRRKHTEAG

SEQ ID NO: 1396278 - protein, 9 aa, Mycobacterium tuberculosis
EAGPAFQGT

SEQ ID NO: 1396279 - protein, 8 aa, Mycobacterium tuberculosis
EAQNRYGR

SEQ ID NO: 1396280 - protein, 7 aa, Mycobacterium tuberculosis
EDGTVTP

SEQ ID NO: 1396281 - protein, 15 aa, Mycobacterium tuberculosis
EDLPAHGEAVRRRFE

SEQ ID NO: 1396282 - protein, 9 aa, Mycobacterium tuberculosis
EDRSTPERA

SEQ ID NO: 1396283 - protein, 8 aa, Mycobacterium tuberculosis
EGESQTVP

SEQ ID NO: 1396284 - protein, 22 aa, Mycobacterium tuberculosis
EGRGGGKADLAQGSGKNPTGID

SEQ ID NO: 1396285 - protein, 9 aa, Mycobacterium tuberculosis
EGYPTPTDK

SEQ ID NO: 1396286 - protein, 8 aa, Mycobacterium tuberculosis
ENDEAERR

SEQ ID NO: 1396287 - protein, 11 aa, Mycobacterium tuberculosis
ENLGARPARFA

SEQ ID NO: 1396288 - protein, 6 aa, Mycobacterium tuberculosis
EPFTPE

SEQ ID NO: 1396289 - protein, 13 aa, Mycobacterium tuberculosis
EQVGSPTDVYDAP

SEQ ID NO: 1396290 - protein, 10 aa, Mycobacterium tuberculosis
ERGEGTTKED

SEQ ID NO: 1396291 - protein, 15 aa, Mycobacterium tuberculosis
ERGGDPRRPGKSDEL

SEQ ID NO: 1396292 - protein, 4 aa, Mycobacterium tuberculosis
ERST

SEQ ID NO: 1396293 - protein, 5 aa, Mycobacterium tuberculosis
ESQEA

SEQ ID NO: 1396294 - protein, 8 aa, Mycobacterium tuberculosis
ESQHRGSA

SEQ ID NO: 1396295 - protein, 14 aa, Mycobacterium tuberculosis
ESTEQARAELANEP

SEQ ID NO: 1396296 - protein, 8 aa, Mycobacterium tuberculosis
EVNRGQRR

SEQ ID NO: 1396297 - protein, 9 aa, Mycobacterium tuberculosis
FANTGNNNI

SEQ ID NO: 1396298 - protein, 9 aa, Mycobacterium tuberculosis
FATTPNGRG

SEQ ID NO: 1396299 - protein, 7 aa, Mycobacterium tuberculosis
FGSGKTT

SEQ ID NO: 1396300 - protein, 6 aa, Mycobacterium tuberculosis
GADPDL

SEQ ID NO: 1396301 - protein, 7 aa, Mycobacterium tuberculosis
GAEESQA

SEQ ID NO: 1396302 - protein, 5 aa, Mycobacterium tuberculosis
GAFPA

SEQ ID NO: 1396303 - protein, 4 aa, Mycobacterium tuberculosis
GASD

SEQ ID NO: 1396304 - protein, 5 aa, Mycobacterium tuberculosis
GATVG

SEQ ID NO: 1396305 - protein, 5 aa, Mycobacterium tuberculosis
GEPDH

SEQ ID NO: 1396306 - protein, 8 aa, Mycobacterium tuberculosis
GETRSYGE

SEQ ID NO: 1396307 - protein, 6 aa, Mycobacterium tuberculosis
GGGGLS

SEQ ID NO: 1396308 - protein, 6 aa, Mycobacterium tuberculosis
GKPTGP

SEQ ID NO: 1396309 - protein, 4 aa, Mycobacterium tuberculosis
GKPV

SEQ ID NO: 1396310 - protein, 8 aa, Mycobacterium tuberculosis
GLNSGTGN

SEQ ID NO: 1396311 - protein, 10 aa, Mycobacterium tuberculosis
GLPDDSDDTV

SEQ ID NO: 1396312 - protein, 8 aa, Mycobacterium tuberculosis
GPCGPSSE

SEQ ID NO: 1396313 - protein, 13 aa, Mycobacterium tuberculosis
GPEFGPAGGPIVS

SEQ ID NO: 1396314 - protein, 6 aa, Mycobacterium tuberculosis
GPGATN

SEQ ID NO: 1396315 - protein, 7 aa, Mycobacterium tuberculosis
GPSPSEV

SEQ ID NO: 1396316 - protein, 6 aa, Mycobacterium tuberculosis
GQRPIR

SEQ ID NO: 1396317 - protein, 7 aa, Mycobacterium tuberculosis
GRPHQDL

SEQ ID NO: 1396318 - protein, 5 aa, Mycobacterium tuberculosis
GRTPN

SEQ ID NO: 1396319 - protein, 18 aa, Mycobacterium tuberculosis
GSESGWDRGSDRPPPPLP

SEQ ID NO: 1396320 - protein, 5 aa, Mycobacterium tuberculosis
GSGPM

SEQ ID NO: 1396321 - protein, 9 aa, Mycobacterium tuberculosis
GSKTPGHPE

SEQ ID NO: 1396322 - protein, 4 aa, Mycobacterium tuberculosis
GSSL

SEQ ID NO: 1396323 - protein, 7 aa, Mycobacterium tuberculosis
GSTDLSS

SEQ ID NO: 1396324 - protein, 4 aa, Mycobacterium tuberculosis
GTQA

SEQ ID NO: 1396325 - protein, 8 aa, Mycobacterium tuberculosis
GVRASEQR

SEQ ID NO: 1396326 - protein, 10 aa, Mycobacterium tuberculosis
GVSPGNDGRG

SEQ ID NO: 1396327 - protein, 6 aa, Mycobacterium tuberculosis
GWRPGD

SEQ ID NO: 1396328 - protein, 5 aa, Mycobacterium tuberculosis
GYAPG

SEQ ID NO: 1396329 - protein, 14 aa, Mycobacterium tuberculosis
HEGDTAAAVAILEA

SEQ ID NO: 1396330 - protein, 12 aa, Mycobacterium tuberculosis
HPSADRRGIHSA

SEQ ID NO: 1396331 - protein, 14 aa, Mycobacterium tuberculosis
HRQYPAHRKPAPSW

SEQ ID NO: 1396332 - protein, 5 aa, Mycobacterium tuberculosis
HTTRA

SEQ ID NO: 1396333 - protein, 8 aa, Mycobacterium tuberculosis
HVSNTAQI

SEQ ID NO: 1396334 - protein, 17 aa, Mycobacterium tuberculosis
IDADKGRAVVGPGKGGS

SEQ ID NO: 1396335 - protein, 6 aa, Mycobacterium tuberculosis
IDNGRE

SEQ ID NO: 1396336 - protein, 4 aa, Mycobacterium tuberculosis
IDPD

SEQ ID NO: 1396337 - protein, 11 aa, Mycobacterium tuberculosis
IPITTSGKVRR

SEQ ID NO: 1396338 - protein, 4 aa, Mycobacterium tuberculosis
IPRG

SEQ ID NO: 1396339 - protein, 12 aa, Mycobacterium tuberculosis
IRPQRDHRRIPG

SEQ ID NO: 1396340 - protein, 4 aa, Mycobacterium tuberculosis
ISAE

SEQ ID NO: 1396341 - protein, 7 aa, Mycobacterium tuberculosis
ITRGDAE

SEQ ID NO: 1396342 - protein, 6 aa, Mycobacterium tuberculosis
KARQRT

SEQ ID NO: 1396343 - protein, 7 aa, Mycobacterium tuberculosis
KDGASSL

SEQ ID NO: 1396344 - protein, 6 aa, Mycobacterium tuberculosis
KNQANH

SEQ ID NO: 1396345 - protein, 6 aa, Mycobacterium tuberculosis
KRHPDL

SEQ ID NO: 1396346 - protein, 9 aa, Mycobacterium tuberculosis
KVPSEEVPA

SEQ ID NO: 1396347 - protein, 5 aa, Mycobacterium tuberculosis
LAATG

SEQ ID NO: 1396348 - protein, 16 aa, Mycobacterium tuberculosis
LAGESGADDLRRRRCR

SEQ ID NO: 1396349 - protein, 6 aa, Mycobacterium tuberculosis
LAPHSP

SEQ ID NO: 1396350 - protein, 6 aa, Mycobacterium tuberculosis
LAQPTK

SEQ ID NO: 1396351 - protein, 8 aa, Mycobacterium tuberculosis
LDAGADDY

SEQ ID NO: 1396352 - protein, 13 aa, Mycobacterium tuberculosis
LDEPTAIEVSDIH

SEQ ID NO: 1396353 - protein, 8 aa, Mycobacterium tuberculosis
LDGDDREA

SEQ ID NO: 1396354 - protein, 6 aa, Mycobacterium tuberculosis
LDTPKA

SEQ ID NO: 1396355 - protein, 22 aa, Mycobacterium tuberculosis
LGPQAKSVQSPEFAARLAAAQH

SEQ ID NO: 1396356 - protein, 9 aa, Mycobacterium tuberculosis
LGRSPQSYG

SEQ ID NO: 1396357 - protein, 6 aa, Mycobacterium tuberculosis
LGTHPG

SEQ ID NO: 1396358 - protein, 7 aa, Mycobacterium tuberculosis
LNPRTRE

SEQ ID NO: 1396359 - protein, 11 aa, Mycobacterium tuberculosis
LPAEPADDDGV

SEQ ID NO: 1396360 - protein, 17 aa, Mycobacterium tuberculosis
LPGTGAAPALAAEAPGA

SEQ ID NO: 1396361 - protein, 16 aa, Mycobacterium tuberculosis
LPPPARTASGYRNYGP

SEQ ID NO: 1396362 - protein, 8 aa, Mycobacterium tuberculosis
LPTNPGPR

SEQ ID NO: 1396363 - protein, 4 aa, Mycobacterium tuberculosis
LQPG

SEQ ID NO: 1396364 - protein, 10 aa, Mycobacterium tuberculosis
LRSGDRVDRN

SEQ ID NO: 1396365 - protein, 4 aa, Mycobacterium tuberculosis
LSGP

SEQ ID NO: 1396366 - protein, 9 aa, Mycobacterium tuberculosis
LTPRGRERY

SEQ ID NO: 1396367 - protein, 7 aa, Mycobacterium tuberculosis
LTPRTPT

SEQ ID NO: 1396368 - protein, 4 aa, Mycobacterium tuberculosis
LTSL

SEQ ID NO: 1396369 - protein, 6 aa, Mycobacterium tuberculosis
LTTSGV

SEQ ID NO: 1396370 - protein, 6 aa, Mycobacterium tuberculosis
MGPSYP

SEQ ID NO: 1396371 - protein, 6 aa, Mycobacterium tuberculosis
MSKSRG

SEQ ID NO: 1396372 - protein, 7 aa, Mycobacterium tuberculosis
NARSKID

SEQ ID NO: 1396373 - protein, 7 aa, Mycobacterium tuberculosis
NDEYAGP

SEQ ID NO: 1396374 - protein, 6 aa, Mycobacterium tuberculosis
NDSQSG

SEQ ID NO: 1396375 - protein, 14 aa, Mycobacterium tuberculosis
NGDELADQARAHPD

SEQ ID NO: 1396376 - protein, 6 aa, Mycobacterium tuberculosis
NGEEIA

SEQ ID NO: 1396377 - protein, 14 aa, Mycobacterium tuberculosis
NHLAGPPDDPRIPD

SEQ ID NO: 1396378 - protein, 7 aa, Mycobacterium tuberculosis
NNVEEGR

SEQ ID NO: 1396379 - protein, 5 aa, Mycobacterium tuberculosis
NPDMA

SEQ ID NO: 1396380 - protein, 4 aa, Mycobacterium tuberculosis
NSRD

SEQ ID NO: 1396381 - protein, 6 aa, Mycobacterium tuberculosis
NTAGQM

SEQ ID NO: 1396382 - protein, 9 aa, Mycobacterium tuberculosis
PADPRRGGQ

SEQ ID NO: 1396383 - protein, 12 aa, Mycobacterium tuberculosis
PAFADSPEEAEQ

SEQ ID NO: 1396384 - protein, 5 aa, Mycobacterium tuberculosis
PAGAA

SEQ ID NO: 1396385 - protein, 4 aa, Mycobacterium tuberculosis
PAGL

SEQ ID NO: 1396386 - protein, 14 aa, Mycobacterium tuberculosis
PATWASKAAGPLGA

SEQ ID NO: 1396387 - protein, 6 aa, Mycobacterium tuberculosis
PDDPAD

SEQ ID NO: 1396388 - protein, 16 aa, Mycobacterium tuberculosis
PERDQRMGEAAVIGAW

SEQ ID NO: 1396389 - protein, 10 aa, Mycobacterium tuberculosis
PGDGSDTHAV

SEQ ID NO: 1396390 - protein, 17 aa, Mycobacterium tuberculosis
PGGSVRDEEVTEAAAKA

SEQ ID NO: 1396391 - protein, 9 aa, Mycobacterium tuberculosis
PGHPVSGEE

SEQ ID NO: 1396392 - protein, 11 aa, Mycobacterium tuberculosis
PGVDTPAEDGV

SEQ ID NO: 1396393 - protein, 10 aa, Mycobacterium tuberculosis
PGVSGTTRQT

SEQ ID NO: 1396394 - protein, 4 aa, Mycobacterium tuberculosis
PHIP

SEQ ID NO: 1396395 - protein, 8 aa, Mycobacterium tuberculosis
PHPTDGRT

SEQ ID NO: 1396396 - protein, 4 aa, Mycobacterium tuberculosis
PIQR

SEQ ID NO: 1396397 - protein, 4 aa, Mycobacterium tuberculosis
PKEI

SEQ ID NO: 1396398 - protein, 11 aa, Mycobacterium tuberculosis
PLAGGSELRPI

SEQ ID NO: 1396399 - protein, 6 aa, Mycobacterium tuberculosis
PLDAGP

SEQ ID NO: 1396400 - protein, 5 aa, Mycobacterium tuberculosis
PLNGS

SEQ ID NO: 1396401 - protein, 11 aa, Mycobacterium tuberculosis
PQVKSGSGTEL

SEQ ID NO: 1396402 - protein, 11 aa, Mycobacterium tuberculosis
PRKSKPSATRR

SEQ ID NO: 1396403 - protein, 13 aa, Mycobacterium tuberculosis
PRPRTRPPSDGSS

SEQ ID NO: 1396404 - protein, 5 aa, Mycobacterium tuberculosis
PSEGR

SEQ ID NO: 1396405 - protein, 5 aa, Mycobacterium tuberculosis
PSETV

SEQ ID NO: 1396406 - protein, 8 aa, Mycobacterium tuberculosis
PSTDAEMA

SEQ ID NO: 1396407 - protein, 4 aa, Mycobacterium tuberculosis
PTRR

SEQ ID NO: 1396408 - protein, 5 aa, Mycobacterium tuberculosis
PTSGN

SEQ ID NO: 1396409 - protein, 4 aa, Mycobacterium tuberculosis
PVDD

SEQ ID NO: 1396410 - protein, 10 aa, Mycobacterium tuberculosis
PVSRDQAADA

SEQ ID NO: 1396411 - protein, 8 aa, Mycobacterium tuberculosis
PYGEDGTI

SEQ ID NO: 1396412 - protein, 10 aa, Mycobacterium tuberculosis
QALGDKRGIR

SEQ ID NO: 1396413 - protein, 7 aa, Mycobacterium tuberculosis
QAPNQRS

SEQ ID NO: 1396414 - protein, 4 aa, Mycobacterium tuberculosis
QDSV

SEQ ID NO: 1396415 - protein, 7 aa, Mycobacterium tuberculosis
QDVEPSA

SEQ ID NO: 1396416 - protein, 7 aa, Mycobacterium tuberculosis
QEATSGK

SEQ ID NO: 1396417 - protein, 6 aa, Mycobacterium tuberculosis
QNAPGV

SEQ ID NO: 1396418 - protein, 5 aa, Mycobacterium tuberculosis
QRFTP

SEQ ID NO: 1396419 - protein, 6 aa, Mycobacterium tuberculosis
QRRDHR

SEQ ID NO: 1396420 - protein, 15 aa, Mycobacterium tuberculosis
QRRRAKADAAARKHA

SEQ ID NO: 1396421 - protein, 13 aa, Mycobacterium tuberculosis
QRSGSVRSGDARR

SEQ ID NO: 1396422 - protein, 4 aa, Mycobacterium tuberculosis
QTRE

SEQ ID NO: 1396423 - protein, 7 aa, Mycobacterium tuberculosis
RAAKPGA

SEQ ID NO: 1396424 - protein, 13 aa, Mycobacterium tuberculosis
RAEQTQKNTLGRA

SEQ ID NO: 1396425 - protein, 4 aa, Mycobacterium tuberculosis
RAGL

SEQ ID NO: 1396426 - protein, 11 aa, Mycobacterium tuberculosis
RARIERRTRES

SEQ ID NO: 1396427 - protein, 7 aa, Mycobacterium tuberculosis
RASKPGA

SEQ ID NO: 1396428 - protein, 6 aa, Mycobacterium tuberculosis
RATDQS

SEQ ID NO: 1396429 - protein, 9 aa, Mycobacterium tuberculosis
RATRGTDRK

SEQ ID NO: 1396430 - protein, 4 aa, Mycobacterium tuberculosis
RDDE

SEQ ID NO: 1396431 - protein, 8 aa, Mycobacterium tuberculosis
RDETRPER

SEQ ID NO: 1396432 - protein, 8 aa, Mycobacterium tuberculosis
RDGADEVG

SEQ ID NO: 1396433 - protein, 10 aa, Mycobacterium tuberculosis
RDNTTAASLK

SEQ ID NO: 1396434 - protein, 28 aa, Mycobacterium tuberculosis
REASHAETTTQAVRDEDREWEGTVGDGL

SEQ ID NO: 1396435 - protein, 4 aa, Mycobacterium tuberculosis
REHN

SEQ ID NO: 1396436 - protein, 7 aa, Mycobacterium tuberculosis
REPESDA

SEQ ID NO: 1396437 - protein, 5 aa, Mycobacterium tuberculosis
RGEAP

SEQ ID NO: 1396438 - protein, 5 aa, Mycobacterium tuberculosis
RGEPA

SEQ ID NO: 1396439 - protein, 8 aa, Mycobacterium tuberculosis
RGGDPSAP

SEQ ID NO: 1396440 - protein, 11 aa, Mycobacterium tuberculosis
RLPDGQVKTDR

SEQ ID NO: 1396441 - protein, 8 aa, Mycobacterium tuberculosis
RNRRSATD

SEQ ID NO: 1396442 - protein, 8 aa, Mycobacterium tuberculosis
RNSKESRA

SEQ ID NO: 1396443 - protein, 5 aa, Mycobacterium tuberculosis
RNTRD

SEQ ID NO: 1396444 - protein, 16 aa, Mycobacterium tuberculosis
RPGEPSWPSPFGPGRP

SEQ ID NO: 1396445 - protein, 8 aa, Mycobacterium tuberculosis
RRAGETVR

SEQ ID NO: 1396446 - protein, 6 aa, Mycobacterium tuberculosis
RRDGLD

SEQ ID NO: 1396447 - protein, 7 aa, Mycobacterium tuberculosis
RREPEAA

SEQ ID NO: 1396448 - protein, 4 aa, Mycobacterium tuberculosis
RRPE

SEQ ID NO: 1396449 - protein, 9 aa, Mycobacterium tuberculosis
RSTPGGSEM

SEQ ID NO: 1396450 - protein, 4 aa, Mycobacterium tuberculosis
RTGG

SEQ ID NO: 1396451 - protein, 10 aa, Mycobacterium tuberculosis
RTSGEERTRV

SEQ ID NO: 1396452 - protein, 8 aa, Mycobacterium tuberculosis
SAATGGAF

SEQ ID NO: 1396453 - protein, 7 aa, Mycobacterium tuberculosis
SAATQGL

SEQ ID NO: 1396454 - protein, 7 aa, Mycobacterium tuberculosis
SADAPVD

SEQ ID NO: 1396455 - protein, 8 aa, Mycobacterium tuberculosis
SAGDPATL

SEQ ID NO: 1396456 - protein, 5 aa, Mycobacterium tuberculosis
SAGGH

SEQ ID NO: 1396457 - protein, 4 aa, Mycobacterium tuberculosis
SANG

SEQ ID NO: 1396458 - protein, 7 aa, Mycobacterium tuberculosis
SAPRYPV

SEQ ID NO: 1396459 - protein, 10 aa, Mycobacterium tuberculosis
SARSSGKNYR

SEQ ID NO: 1396460 - protein, 4 aa, Mycobacterium tuberculosis
SDPT

SEQ ID NO: 1396461 - protein, 5 aa, Mycobacterium tuberculosis
SDRPD

SEQ ID NO: 1396462 - protein, 4 aa, Mycobacterium tuberculosis
SDTR

SEQ ID NO: 1396463 - protein, 23 aa, Mycobacterium tuberculosis
SGATASGAAPLSAAELEKLFLAL

SEQ ID NO: 1396464 - protein, 13 aa, Mycobacterium tuberculosis
SGATSRFKRFRLS

SEQ ID NO: 1396465 - protein, 4 aa, Mycobacterium tuberculosis
SGTN

SEQ ID NO: 1396466 - protein, 6 aa, Mycobacterium tuberculosis
SGYDRD

SEQ ID NO: 1396467 - protein, 7 aa, Mycobacterium tuberculosis
SLRRTDD

SEQ ID NO: 1396468 - protein, 11 aa, Mycobacterium tuberculosis
SQQDTSDDGLG

SEQ ID NO: 1396469 - protein, 7 aa, Mycobacterium tuberculosis
SSIGSGV

SEQ ID NO: 1396470 - protein, 4 aa, Mycobacterium tuberculosis
SSSA

SEQ ID NO: 1396471 - protein, 10 aa, Mycobacterium tuberculosis
SYGPPTEHDH

SEQ ID NO: 1396472 - protein, 5 aa, Mycobacterium tuberculosis
SYPDE

SEQ ID NO: 1396473 - protein, 5 aa, Mycobacterium tuberculosis
TAEQA

SEQ ID NO: 1396474 - protein, 15 aa, Mycobacterium tuberculosis
TAKPAEGADPRSGRW

SEQ ID NO: 1396475 - protein, 19 aa, Mycobacterium tuberculosis
TANDPQYQAELPEGSDTSV

SEQ ID NO: 1396476 - protein, 11 aa, Mycobacterium tuberculosis
TAPGGAPTPVA

SEQ ID NO: 1396477 - protein, 10 aa, Mycobacterium tuberculosis
TGSPADPATL

SEQ ID NO: 1396478 - protein, 6 aa, Mycobacterium tuberculosis
TIPDKG

SEQ ID NO: 1396479 - protein, 10 aa, Mycobacterium tuberculosis
TLSADPDDAE

SEQ ID NO: 1396480 - protein, 13 aa, Mycobacterium tuberculosis
TPAATLPRSRRIP

SEQ ID NO: 1396481 - protein, 5 aa, Mycobacterium tuberculosis
TPAPD

SEQ ID NO: 1396482 - protein, 6 aa, Mycobacterium tuberculosis
TPAQTG

SEQ ID NO: 1396483 - protein, 9 aa, Mycobacterium tuberculosis
TPDSSRYWP

SEQ ID NO: 1396484 - protein, 11 aa, Mycobacterium tuberculosis
TPGTALPPPTG

SEQ ID NO: 1396485 - protein, 11 aa, Mycobacterium tuberculosis
TPSGGSIPEYN

SEQ ID NO: 1396486 - protein, 5 aa, Mycobacterium tuberculosis
TQGNT

SEQ ID NO: 1396487 - protein, 9 aa, Mycobacterium tuberculosis
TSGSTRAPA

SEQ ID NO: 1396488 - protein, 5 aa, Mycobacterium tuberculosis
TSPFG

SEQ ID NO: 1396489 - protein, 4 aa, Mycobacterium tuberculosis
TSTK

SEQ ID NO: 1396490 - protein, 4 aa, Mycobacterium tuberculosis
TTPE

SEQ ID NO: 1396491 - protein, 4 aa, Mycobacterium tuberculosis
TTTG

SEQ ID NO: 1396492 - protein, 4 aa, Mycobacterium tuberculosis
VAPP

SEQ ID NO: 1396493 - protein, 8 aa, Mycobacterium tuberculosis
VARSRSDA

SEQ ID NO: 1396494 - protein, 7 aa, Mycobacterium tuberculosis
VESTPEV

SEQ ID NO: 1396495 - protein, 12 aa, Mycobacterium tuberculosis
VGDESGEVGPGD

SEQ ID NO: 1396496 - protein, 9 aa, Mycobacterium tuberculosis
VGDQGGDIA

SEQ ID NO: 1396497 - protein, 14 aa, Mycobacterium tuberculosis
VGDTNTGGFNPGSI

SEQ ID NO: 1396498 - protein, 7 aa, Mycobacterium tuberculosis
VGESENV

SEQ ID NO: 1396499 - protein, 7 aa, Mycobacterium tuberculosis
VGNHEDD

SEQ ID NO: 1396500 - protein, 4 aa, Mycobacterium tuberculosis
VGPN

SEQ ID NO: 1396501 - protein, 4 aa, Mycobacterium tuberculosis
VPAA

SEQ ID NO: 1396502 - protein, 19 aa, Mycobacterium tuberculosis
VPAPENGFNTRPAEAHDHD

SEQ ID NO: 1396503 - protein, 8 aa, Mycobacterium tuberculosis
VPNPRPLD

SEQ ID NO: 1396504 - protein, 4 aa, Mycobacterium tuberculosis
VPNT

SEQ ID NO: 1396505 - protein, 10 aa, Mycobacterium tuberculosis
VRASEQDAAA

SEQ ID NO: 1396506 - protein, 7 aa, Mycobacterium tuberculosis
VRGREDS

SEQ ID NO: 1396507 - protein, 4 aa, Mycobacterium tuberculosis
VRPI

SEQ ID NO: 1396508 - protein, 9 aa, Mycobacterium tuberculosis
VRRDRSGKH

SEQ ID NO: 1396509 - protein, 11 aa, Mycobacterium tuberculosis
VSTKAASTHAG

SEQ ID NO: 1396510 - protein, 5 aa, Mycobacterium tuberculosis
VTGRE

SEQ ID NO: 1396511 - protein, 12 aa, Mycobacterium tuberculosis
WKTRKNAHGDTE

SEQ ID NO: 1396512 - protein, 9 aa, Mycobacterium tuberculosis
YAGPGSGPL

SEQ ID NO: 1396513 - protein, 8 aa, Mycobacterium tuberculosis
YRSSHRGI

SEQ ID NO: 1396514 - protein, 8 aa, Mycobacterium tuberculosis
YSATSGSV

SEQ ID NO: 1396515 - protein, 10 aa, Mycobacterium tuberculosis
AAAAAGLSGA

SEQ ID NO: 1396516 - protein, 10 aa, Mycobacterium tuberculosis
AAAAAGVPTA

SEQ ID NO: 1396517 - protein, 9 aa, Mycobacterium tuberculosis
AAAAAPPPL

SEQ ID NO: 1396518 - protein, 7 aa, Mycobacterium tuberculosis
AAAADKD

SEQ ID NO: 1396519 - protein, 7 aa, Mycobacterium tuberculosis
AAAAGRP

SEQ ID NO: 1396520 - protein, 10 aa, Mycobacterium tuberculosis
AAAAGSLQGI

SEQ ID NO: 1396521 - protein, 10 aa, Mycobacterium tuberculosis
AAAATTAPEP

SEQ ID NO: 1396522 - protein, 16 aa, Mycobacterium tuberculosis
AAADATKAAARLGPQQ

SEQ ID NO: 1396523 - protein, 7 aa, Mycobacterium tuberculosis
AAADEVS

SEQ ID NO: 1396524 - protein, 5 aa, Mycobacterium tuberculosis
AAAEA

SEQ ID NO: 1396525 - protein, 7 aa, Mycobacterium tuberculosis
AAAEGRL

SEQ ID NO: 1396526 - protein, 11 aa, Mycobacterium tuberculosis
AAAEPEPSSAE

SEQ ID NO: 1396527 - protein, 11 aa, Mycobacterium tuberculosis
AAAGGRGGLGN

SEQ ID NO: 1396528 - protein, 8 aa, Mycobacterium tuberculosis
AAAGGSSC

SEQ ID NO: 1396529 - protein, 8 aa, Mycobacterium tuberculosis
AAAGRADD

SEQ ID NO: 1396530 - protein, 7 aa, Mycobacterium tuberculosis
AAAKAEA

SEQ ID NO: 1396531 - protein, 16 aa, Mycobacterium tuberculosis
AAAKAKSLLDQEGRDD

SEQ ID NO: 1396532 - protein, 7 aa, Mycobacterium tuberculosis
AAAKANE

SEQ ID NO: 1396533 - protein, 14 aa, Mycobacterium tuberculosis
AAAKPGSAMTPLPG

SEQ ID NO: 1396534 - protein, 7 aa, Mycobacterium tuberculosis
AAALSSA

SEQ ID NO: 1396535 - protein, 4 aa, Mycobacterium tuberculosis
AAAP

SEQ ID NO: 1396536 - protein, 6 aa, Mycobacterium tuberculosis
AAAPGS

SEQ ID NO: 1396537 - protein, 5 aa, Mycobacterium tuberculosis
AAAPT

SEQ ID NO: 1396538 - protein, 6 aa, Mycobacterium tuberculosis
AAARAG

SEQ ID NO: 1396539 - protein, 14 aa, Mycobacterium tuberculosis
AAARNQVDGEPEEL

SEQ ID NO: 1396540 - protein, 7 aa, Mycobacterium tuberculosis
AAARSGA

SEQ ID NO: 1396541 - protein, 7 aa, Mycobacterium tuberculosis
AAARSRG

SEQ ID NO: 1396542 - protein, 27 aa, Mycobacterium tuberculosis
AAASAQGASPEPNAAVPPGDAVIGGST

SEQ ID NO: 1396543 - protein, 8 aa, Mycobacterium tuberculosis
AAASGGGT

SEQ ID NO: 1396544 - protein, 9 aa, Mycobacterium tuberculosis
AAASGTPIA

SEQ ID NO: 1396545 - protein, 13 aa, Mycobacterium tuberculosis
AAATGADNVSQEA

SEQ ID NO: 1396546 - protein, 8 aa, Mycobacterium tuberculosis
AAATGKRA

SEQ ID NO: 1396547 - protein, 8 aa, Mycobacterium tuberculosis
AAATRNPQ

SEQ ID NO: 1396548 - protein, 8 aa, Mycobacterium tuberculosis
AAATSTDT

SEQ ID NO: 1396549 - protein, 13 aa, Mycobacterium tuberculosis
AAATTRPPADPAA

SEQ ID NO: 1396550 - protein, 5 aa, Mycobacterium tuberculosis
AAAVG

SEQ ID NO: 1396551 - protein, 9 aa, Mycobacterium tuberculosis
AAAYPNPAL

SEQ ID NO: 1396552 - protein, 18 aa, Mycobacterium tuberculosis
AADAAGDVLGEATSGGLG

SEQ ID NO: 1396553 - protein, 12 aa, Mycobacterium tuberculosis
AADDDSATGGPD

SEQ ID NO: 1396554 - protein, 6 aa, Mycobacterium tuberculosis
AADDSV

SEQ ID NO: 1396555 - protein, 6 aa, Mycobacterium tuberculosis
AADEGE

SEQ ID NO: 1396556 - protein, 12 aa, Mycobacterium tuberculosis
AADESGRFRSRE

SEQ ID NO: 1396557 - protein, 8 aa, Mycobacterium tuberculosis
AADGEGAY

SEQ ID NO: 1396558 - protein, 13 aa, Mycobacterium tuberculosis
AADGGCDADDAPA

SEQ ID NO: 1396559 - protein, 50 aa, Mycobacterium tuberculosis; identical to SEQ ID NO: 166866

SEQ ID NO: 1396560 - protein, 10 aa, Mycobacterium tuberculosis
AADGSVSATA

SEQ ID NO: 1396561 - protein, 7 aa, Mycobacterium tuberculosis
AADGTRH

SEQ ID NO: 1396562 - protein, 13 aa, Mycobacterium tuberculosis
AADLAKSPDFSAA

SEQ ID NO: 1396563 - protein, 8 aa, Mycobacterium tuberculosis
AADNGGSA

SEQ ID NO: 1396564 - protein, 9 aa, Mycobacterium tuberculosis
AADPADFPD

SEQ ID NO: 1396565 - protein, 7 aa, Mycobacterium tuberculosis
AADPDAP

SEQ ID NO: 1396566 - protein, 9 aa, Mycobacterium tuberculosis
AADPEPSTA

SEQ ID NO: 1396567 - protein, 5 aa, Mycobacterium tuberculosis
AADPN

SEQ ID NO: 1396568 - protein, 7 aa, Mycobacterium tuberculosis
AADPNAR

SEQ ID NO: 1396569 - protein, 16 aa, Mycobacterium tuberculosis
AADPNRSLVGRLLRSD

SEQ ID NO: 1396570 - protein, 5 aa, Mycobacterium tuberculosis
AADPT

SEQ ID NO: 1396571 - protein, 14 aa, Mycobacterium tuberculosis
AADQLRDQVGSDEF

SEQ ID NO: 1396572 - protein, 6 aa, Mycobacterium tuberculosis
AADRPV

SEQ ID NO: 1396573 - protein, 10 aa, Mycobacterium tuberculosis
AADSPPQTVD

SEQ ID NO: 1396574 - protein, 8 aa, Mycobacterium tuberculosis
AADTPEVA

SEQ ID NO: 1396575 - protein, 6 aa, Mycobacterium tuberculosis
AAEAQR

SEQ ID NO: 1396576 - protein, 8 aa, Mycobacterium tuberculosis
AAEDDEAR

SEQ ID NO: 1396577 - protein, 5 aa, Mycobacterium tuberculosis
AAEGA

SEQ ID NO: 1396578 - protein, 7 aa, Mycobacterium tuberculosis
AAEGETI

SEQ ID NO: 1396579 - protein, 5 aa, Mycobacterium tuberculosis
AAEGT

SEQ ID NO: 1396580 - protein, 8 aa, Mycobacterium tuberculosis
AAEPDGTG

SEQ ID NO: 1396581 - protein, 12 aa, Mycobacterium tuberculosis
AAEPGSKEYGVP

SEQ ID NO: 1396582 - protein, 8 aa, Mycobacterium tuberculosis
AAEPPPNV

SEQ ID NO: 1396583 - protein, 7 aa, Mycobacterium tuberculosis
AAEPSPL

SEQ ID NO: 1396584 - protein, 4 aa, Mycobacterium tuberculosis
AAER

SEQ ID NO: 1396585 - protein, 8 aa, Mycobacterium tuberculosis
AAERERAE

SEQ ID NO: 1396586 - protein, 9 aa, Mycobacterium tuberculosis
AAERSPQAI

SEQ ID NO: 1396587 - protein, 5 aa, Mycobacterium tuberculosis
AAGAE

SEQ ID NO: 1396588 - protein, 14 aa, Mycobacterium tuberculosis
AAGAPIAEVLDQTQ

SEQ ID NO: 1396589 - protein, 9 aa, Mycobacterium tuberculosis
AAGASRHGS
